United States Patent 10,706,955 (BIOINFORMATIC PROCESSES FOR DETERMINATION OF PEPTIDE BINDING) - sequence listing, part 3

SEQ ID NO: 79058 - protein, 23 aa, Mycobacterium avium
DVTEWLNAHGWRATAEHSTAAMR

SEQ ID NO: 79059 - protein, 23 aa, Mycobacterium avium
DVTYPLHRYFLWAKHNELTLGPA

SEQ ID NO: 79060 - protein, 31 aa, Mycobacterium avium
DVVFASHHWPTWGRDGIVEFLSLQRDLYAYL

SEQ ID NO: 79061 - protein, 31 aa, Mycobacterium avium
DVWFVGKKGGAGWVEWGGCGMVHPNVLRAAG

SEQ ID NO: 79062 - protein, 21 aa, Mycobacterium avium
DVYRTRFGALLTAAADRRAAL

SEQ ID NO: 79063 - protein, 18 aa, Mycobacterium avium
DWDAMAATLADDFLLDDR

SEQ ID NO: 79064 - protein, 22 aa, Mycobacterium avium
DWDDELLSFFTIPRAMLPEIGP

SEQ ID NO: 79065 - protein, 18 aa, Mycobacterium avium
DWFCSFSSAAALVGSPGQ

SEQ ID NO: 79066 - protein, 19 aa, Mycobacterium avium
DWFRPKAMRALKVRVDELA

SEQ ID NO: 79067 - protein, 19 aa, Mycobacterium avium
DWHRARGSGMPDLNELDRR

SEQ ID NO: 79068 - protein, 19 aa, Mycobacterium avium
DWLGAAGITGELAADIVLV

SEQ ID NO: 79069 - protein, 22 aa, Mycobacterium avium
DWPDPWVLIGALAQVTTRLRFV

SEQ ID NO: 79070 - protein, 20 aa, Mycobacterium avium
DWPHLGVALMQPRARGCLTL

SEQ ID NO: 79071 - protein, 25 aa, Mycobacterium avium
DYAALRRWAHRFYPGPQPAPTDFGY

SEQ ID NO: 79072 - protein, 18 aa, Mycobacterium avium
DYAPVVMVNWEFFDNQTP

SEQ ID NO: 79073 - protein, 18 aa, Mycobacterium avium
DYCKERLGLDAALGSIDR

SEQ ID NO: 79074 - protein, 27 aa, Mycobacterium avium
DYDMSMARLLYWGCDVWLNNPLRPLEA

SEQ ID NO: 79075 - protein, 18 aa, Mycobacterium avium
DYHDFPSLRCELGDDGVL

SEQ ID NO: 79076 - protein, 19 aa, Mycobacterium avium
DYIDFSWFDAVVMALDPAF

SEQ ID NO: 79077 - protein, 19 aa, Mycobacterium avium
DYLIALFGALYAGRIAVPL

SEQ ID NO: 79078 - protein, 30 aa, Mycobacterium avium
DYNLQWKPVGGFPITFGWLHAVRRGQARLH

SEQ ID NO: 79079 - protein, 21 aa, Mycobacterium avium
DYRHSTTFAQRAQWANATADL

SEQ ID NO: 79080 - protein, 19 aa, Mycobacterium avium
DYRMPGMDGAQVAAAVRAD

SEQ ID NO: 79081 - protein, 19 aa, Mycobacterium avium
DYRTFWTQFGRVVKEGLLS

SEQ ID NO: 79082 - protein, 23 aa, Mycobacterium avium
DYVKAFWNVVNWADVQKRYAAAT

SEQ ID NO: 79083 - protein, 20 aa, Mycobacterium avium
DYVSDGRFRLGIGTSGPQVI

SEQ ID NO: 79084 - protein, 23 aa, Mycobacterium avium
EAAADLRLDFFVSTSSIASVWGG

SEQ ID NO: 79085 - protein, 23 aa, Mycobacterium avium
EAAALMIDLFWYGLKGSPEEREA

SEQ ID NO: 79086 - protein, 25 aa, Mycobacterium avium
EAAAPRPAPQFEVMYRLDDCAPAAA

SEQ ID NO: 79087 - protein, 21 aa, Mycobacterium avium
EAADAAALRRALADGVIDCVA

SEQ ID NO: 79088 - protein, 22 aa, Mycobacterium avium
EAAGEWFARILFSLFSTPSPTL

SEQ ID NO: 79089 - protein, 25 aa, Mycobacterium avium
EAAGGRVRAKYGWTDVARFAALGIP

SEQ ID NO: 79090 - protein, 17 aa, Mycobacterium avium
EAAGLRWLSSVDGGVPC

SEQ ID NO: 79091 - protein, 18 aa, Mycobacterium avium
EAAKAMAYVARFITHALQ

SEQ ID NO: 79092 - protein, 24 aa, Mycobacterium avium
EAAKGVAMPLRLTSPAPCTNCHGS

SEQ ID NO: 79093 - protein, 25 aa, Mycobacterium avium
EAASRMTGKPGLCIGTLGPGMANIA

SEQ ID NO: 79094 - protein, 25 aa, Mycobacterium avium
EAAYPGRFLLGIGVGHPEAHTEYRK

SEQ ID NO: 79095 - protein, 20 aa, Mycobacterium avium
EACGLRGAYDIAALGLRTAV

SEQ ID NO: 79096 - protein, 18 aa, Mycobacterium avium
EADFPMPDPIALGHEAIG

SEQ ID NO: 79097 - protein, 22 aa, Mycobacterium avium
EADGRRPRILVAKMGQDGHDRG

SEQ ID NO: 79098 - protein, 18 aa, Mycobacterium avium
EADLVLLAMGFVGPEKEG

SEQ ID NO: 79099 - protein, 17 aa, Mycobacterium avium
EAEGAKADARRKVRDSG

SEQ ID NO: 79100 - protein, 24 aa, Mycobacterium avium
EAEHIVAAFAFELGKVEMPEIRSA

SEQ ID NO: 79101 - protein, 18 aa, Mycobacterium avium
EAELEGATCDGVLDGILA

SEQ ID NO: 79102 - protein, 19 aa, Mycobacterium avium
EAFADFLSGFHIVDRHFQT

SEQ ID NO: 79103 - protein, 21 aa, Mycobacterium avium
EAFEALLRYMRDSRGFDFTGY

SEQ ID NO: 79104 - protein, 21 aa, Mycobacterium avium
EAFQSGLSWLTILRKRENFRR

SEQ ID NO: 79105 - protein, 25 aa, Mycobacterium avium
EAGAVGMPGVPLAGLPGAHEDEFSE

SEQ ID NO: 79106 - protein, 18 aa, Mycobacterium avium
EAGGDPWAINASLQAGSP

SEQ ID NO: 79107 - protein, 25 aa, Mycobacterium avium
EAGRAATLRAVRNLTGVPIDYFAEV

SEQ ID NO: 79108 - protein, 20 aa, Mycobacterium avium
EAGSDFAGLRTRAVRDGDVF

SEQ ID NO: 79109 - protein, 23 aa, Mycobacterium avium
EAGSKVKVTIMFRGREQSRPELG

SEQ ID NO: 79110 - protein, 21 aa, Mycobacterium avium
EAIAAQLQRRGRGAGAPTADQ

SEQ ID NO: 79111 - protein, 25 aa, Mycobacterium avium
EAIDAEIPLLVVITEGIPVQDSAYA

SEQ ID NO: 79112 - protein, 21 aa, Mycobacterium avium
EAIFKKTWLNVGRVNRLPRTG

SEQ ID NO: 79113 - protein, 17 aa, Mycobacterium avium
EAIGVNYIDTYFRSGQY

SEQ ID NO: 79114 - protein, 20 aa, Mycobacterium avium
EAIPRISRAQAMDALSSQGN

SEQ ID NO: 79115 - protein, 24 aa, Mycobacterium avium
EAIRGSGLSAGIIDAGLSRGLAGV

SEQ ID NO: 79116 - protein, 17 aa, Mycobacterium avium
EAKGAIRQIDFLTRATA

SEQ ID NO: 79117 - protein, 41 aa, Mycobacterium avium
EAKYAAKRVRKWTRRRYQLLELPQLPGRGWVEYEPYGTVLI

SEQ ID NO: 79118 - protein, 20 aa, Mycobacterium avium
EALAAAAVHEVFVHTLSTSS

SEQ ID NO: 79119 - protein, 24 aa, Mycobacterium avium
EALADGVVRPVVFLAYSGEARWRD

SEQ ID NO: 79120 - protein, 19 aa, Mycobacterium avium
EALELTWRSLGEIGNLSSA

SEQ ID NO: 79121 - protein, 20 aa, Mycobacterium avium
EALERLVAAGARPASSPKEV

SEQ ID NO: 79122 - protein, 22 aa, Mycobacterium avium
EALGKIYAGMGIVRHPEIREVR

SEQ ID NO: 79123 - protein, 19 aa, Mycobacterium avium
EALGLARLGATVVVNDIAT

SEQ ID NO: 79124 - protein, 18 aa, Mycobacterium avium
EALIRLDLAEMLREEGYE

SEQ ID NO: 79125 - protein, 21 aa, Mycobacterium avium
EALPLRAIDMTVRRNAFGRQV

SEQ ID NO: 79126 - protein, 19 aa, Mycobacterium avium
EALQLPLWGGLGEEDRLRA

SEQ ID NO: 79127 - protein, 28 aa, Mycobacterium avium
EALQRLGKGGGFFSFGIMHYYMTGVHTP

SEQ ID NO: 79128 - protein, 17 aa, Mycobacterium avium
EALRLSRDTGIITEELV

SEQ ID NO: 79129 - protein, 17 aa, Mycobacterium avium
EALRRINEGAAMIRSKG

SEQ ID NO: 79130 - protein, 24 aa, Mycobacterium avium
EALSARHLLPVPWVEPVDVSNAVV

SEQ ID NO: 79131 - protein, 19 aa, Mycobacterium avium
EALTELLMIVATYYGLALV

SEQ ID NO: 79132 - protein, 19 aa, Mycobacterium avium
EALVPLVLAGTTHRETPRL

SEQ ID NO: 79133 - protein, 17 aa, Mycobacterium avium
EALWISDHFHPWNDEQG

SEQ ID NO: 79134 - protein, 31 aa, Mycobacterium avium
EAMFGPGHDAGWRVGDDVAHPDLGHGWVQGA

SEQ ID NO: 79135 - protein, 21 aa, Mycobacterium avium
EAMPNICLQMLLRGRNTVGYT

SEQ ID NO: 79136 - protein, 25 aa, Mycobacterium avium
EAMVKKLSIRLGVPCFPDDPLRFTG

SEQ ID NO: 79137 - protein, 27 aa, Mycobacterium avium
EANIAPWLRAAHRYGAKVKWAEIDIET

SEQ ID NO: 79138 - protein, 24 aa, Mycobacterium avium
EANLRLVVSLAKRYTGRGMPLLDL

SEQ ID NO: 79139 - protein, 25 aa, Mycobacterium avium
EAPARAYNPLFIWGESGLGKTHLLH

SEQ ID NO: 79140 - protein, 21 aa, Mycobacterium avium
EAPGMMSALVGFWMTPESIYL

SEQ ID NO: 79141 - protein, 19 aa, Mycobacterium avium
EAQKARWLEPMAAGDVVAS

SEQ ID NO: 79142 - protein, 23 aa, Mycobacterium avium
EAQLRFLADQGVDLIVTSGGLGP

SEQ ID NO: 79143 - protein, 20 aa, Mycobacterium avium
EAQYAEMWVQDATMMATYQA

SEQ ID NO: 79144 - protein, 26 aa, Mycobacterium avium
EARAAGLKAANTWHATRAIQESREAC

SEQ ID NO: 79145 - protein, 23 aa, Mycobacterium avium
EARANRLAHRFRKAGLREGDTVA

SEQ ID NO: 79146 - protein, 23 aa, Mycobacterium avium
EARMLREQLEFMVTSGSTVCAYV

SEQ ID NO: 79147 - protein, 29 aa, Mycobacterium avium
EARPQTVFMYLDYIHHWRHPIRDGLGELR

SEQ ID NO: 79148 - protein, 21 aa, Mycobacterium avium
EASWGDLAMMLSVPYQGLGNA

SEQ ID NO: 79149 - protein, 17 aa, Mycobacterium avium
EATDEFRVPPPGPLGRH

SEQ ID NO: 79150 - protein, 23 aa, Mycobacterium avium
EATEARFPQINWEITAGNSSPLS

SEQ ID NO: 79151 - protein, 17 aa, Mycobacterium avium
EATLPAVQYIPFTDVAQ

SEQ ID NO: 79152 - protein, 21 aa, Mycobacterium avium
EATRVLGTFLRDVIARNKDRF

SEQ ID NO: 79153 - protein, 20 aa, Mycobacterium avium
EATSRAAARGATVWVQDYQL

SEQ ID NO: 79154 - protein, 21 aa, Mycobacterium avium
EAVAACGPAGVPVIADGGLQY

SEQ ID NO: 79155 - protein, 22 aa, Mycobacterium avium
EAVAAFGRGECFVERYLDKPRH

SEQ ID NO: 79156 - protein, 20 aa, Mycobacterium avium
EAVARLGRHQFPLVLTDTVN

SEQ ID NO: 79157 - protein, 22 aa, Mycobacterium avium
EAVFKAAYRQGLALVLKGPTGC

SEQ ID NO: 79158 - protein, 21 aa, Mycobacterium avium
EAVGAEIAWFSTCGSSLSVRA

SEQ ID NO: 79159 - protein, 29 aa, Mycobacterium avium
EAVGGPATWRLGGAFNCGKAQPGQIAPVS

SEQ ID NO: 79160 - protein, 23 aa, Mycobacterium avium
EAVTGLDLVEWQLRVAAGEKLVF

SEQ ID NO: 79161 - protein, 20 aa, Mycobacterium avium
EAVVDCRILPGRKAAFEAEI

SEQ ID NO: 79162 - protein, 24 aa, Mycobacterium avium
EAYADMPLFLFHLLEYMDVDYELD

SEQ ID NO: 79163 - protein, 17 aa, Mycobacterium avium
EAYVRLYPAQVIKQADL

SEQ ID NO: 79164 - protein, 17 aa, Mycobacterium avium
ECFLELLAVDIEKLGAK

SEQ ID NO: 79165 - protein, 20 aa, Mycobacterium avium
ECGLPVLVETARLWLSLGHH

SEQ ID NO: 79166 - protein, 23 aa, Mycobacterium avium
EDAEGPGATILLRLDQDVPADVR

SEQ ID NO: 79167 - protein, 20 aa, Mycobacterium avium
EDAGFCEKGRGMEFVADHDL

SEQ ID NO: 79168 - protein, 19 aa, Mycobacterium avium
EDAKITAMRAFWSPTDVQV

SEQ ID NO: 79169 - protein, 25 aa, Mycobacterium avium
EDCHFCSQSGLFASPVRSARLDIPS

SEQ ID NO: 79170 - protein, 21 aa, Mycobacterium avium
EDERIGVLSFPLGKQQRPASA

SEQ ID NO: 79171 - protein, 18 aa, Mycobacterium avium
EDFYHTGIIVPDLEAAMA

SEQ ID NO: 79172 - protein, 24 aa, Mycobacterium avium
EDGARLIAERGRLFGSLPAGGRMV

SEQ ID NO: 79173 - protein, 24 aa, Mycobacterium avium
EDGEPLFMAGLWSVWKPAKDAPPL

SEQ ID NO: 79174 - protein, 23 aa, Mycobacterium avium
EDLFVRPGFRRRGLARALLAALA

SEQ ID NO: 79175 - protein, 20 aa, Mycobacterium avium
EDRPRSVIWVAGRGTAETAG

SEQ ID NO: 79176 - protein, 23 aa, Mycobacterium avium
EDSRGRTSLVITELPYQVNHDNF

SEQ ID NO: 79177 - protein, 19 aa, Mycobacterium avium
EDVGLPLTFTLVVANSGDP

SEQ ID NO: 79178 - protein, 19 aa, Mycobacterium avium
EDVRARIGVLSQVPSLWTE

SEQ ID NO: 79179 - protein, 20 aa, Mycobacterium avium
EEAIASFARLWVADPHWQAA

SEQ ID NO: 79180 - protein, 22 aa, Mycobacterium avium
EEAPLRIALVAALDSGTAPSMR

SEQ ID NO: 79181 - protein, 22 aa, Mycobacterium avium
EEDAAAMARRMRAICDQLADFP

SEQ ID NO: 79182 - protein, 26 aa, Mycobacterium avium
EEDLTSFLIRFEFDGHRLTDEQLLNI

SEQ ID NO: 79183 - protein, 24 aa, Mycobacterium avium
EEFARAGYDYVGFDAQHGYLDDAD

SEQ ID NO: 79184 - protein, 22 aa, Mycobacterium avium
EEFDSRCAALGFDAYAVDNLYG

SEQ ID NO: 79185 - protein, 22 aa, Mycobacterium avium
EEFMPRPVWYALDRGLIMESGP

SEQ ID NO: 79186 - protein, 23 aa, Mycobacterium avium
EEFNRLAAELVEAGTLKKLNEKK

SEQ ID NO: 79187 - protein, 22 aa, Mycobacterium avium
EEIARSGVSVAVIGFREHASWA

SEQ ID NO: 79188 - protein, 27 aa, Mycobacterium avium
EEIPGAMARLGVWPGVGPQLDLHQPTF

SEQ ID NO: 79189 - protein, 21 aa, Mycobacterium avium
EEIPPGFSHCMLLSEGRVVAA

SEQ ID NO: 79190 - protein, 21 aa, Mycobacterium avium
EELKPGPATRLVFDLDPGEGV

SEQ ID NO: 79191 - protein, 23 aa, Mycobacterium avium
EELLELLSTLPLDSAQQDRLGRL

SEQ ID NO: 79192 - protein, 21 aa, Mycobacterium avium
EEPARLLSQFIHGIKRLPVAW

SEQ ID NO: 79193 - protein, 22 aa, Mycobacterium avium
EEPPEVRTLYSFEPDATTLFES

SEQ ID NO: 79194 - protein, 20 aa, Mycobacterium avium
EEQARRLVIRGFFAEIISKI

SEQ ID NO: 79195 - protein, 17 aa, Mycobacterium avium
EEQCGALDRFAKAGPAL

SEQ ID NO: 79196 - protein, 25 aa, Mycobacterium avium
EERHGPEFAQRFGLGFSAQDREENI

SEQ ID NO: 79197 - protein, 26 aa, Mycobacterium avium
EERTRACGYRRLYLITGNRQPEAEAL

SEQ ID NO: 79198 - protein, 20 aa, Mycobacterium avium
EERYRLCSTVHTKIAVVKSI

SEQ ID NO: 79199 - protein, 30 aa, Mycobacterium avium
EESALFAADLARMYIRYAERHGWTVTVLDE

SEQ ID NO: 79200 - protein, 21 aa, Mycobacterium avium
EESRYGAVHPREFERPEMGRP

SEQ ID NO: 79201 - protein, 27 aa, Mycobacterium avium
EEVAPWLDLVRKLGLLAATLSDGPPVS

SEQ ID NO: 79202 - protein, 21 aa, Mycobacterium avium
EEVDDGWVLTCQALPTSPTVR

SEQ ID NO: 79203 - protein, 19 aa, Mycobacterium avium
EEVLACADAGIPVTVVPGV

SEQ ID NO: 79204 - protein, 24 aa, Mycobacterium avium
EEVREYMAQLGFRTLNEAVGQVKS

SEQ ID NO: 79205 - protein, 24 aa, Mycobacterium avium
EEVVLRLRALLRRTGVTTVDSGAQ

SEQ ID NO: 79206 - protein, 23 aa, Mycobacterium avium
EEYKEFYKHIAHAWDDPLEVIAM

SEQ ID NO: 79207 - protein, 26 aa, Mycobacterium avium
EEYSRRKHIEAGYEFVNTPHITKAQL

SEQ ID NO: 79208 - protein, 19 aa, Mycobacterium avium
EFADLLAWLKDTLSDHVKE

SEQ ID NO: 79209 - protein, 21 aa, Mycobacterium avium
EFAEGYCLPTIRNNALYMDRY

SEQ ID NO: 79210 - protein, 28 aa, Mycobacterium avium
EFAGAFKPPLRWGMRMTGKKFLREYPYR

SEQ ID NO: 79211 - protein, 31 aa, Mycobacterium avium
EFATAAKIAASWRLPVVFVVQNVRGGPDARR

SEQ ID NO: 79212 - protein, 18 aa, Mycobacterium avium
EFDDIRWRLDVWNASAQV

SEQ ID NO: 79213 - protein, 26 aa, Mycobacterium avium
EFDSRAVGPGGLFLALPGARTDGHDH

SEQ ID NO: 79214 - protein, 19 aa, Mycobacterium avium
EFGAYPAVIGRELDRYLPF

SEQ ID NO: 79215 - protein, 17 aa, Mycobacterium avium
EFIPRPVKSSFREGLTV

SEQ ID NO: 79216 - protein, 18 aa, Mycobacterium avium
EFKARVLGEQGAVPKARR

SEQ ID NO: 79217 - protein, 27 aa, Mycobacterium avium
EFLAWEPFTHMAFRFNECSTRSVAAFA

SEQ ID NO: 79218 - protein, 17 aa, Mycobacterium avium
EFMRTAAKDTVVRGVPI

SEQ ID NO: 79219 - protein, 20 aa, Mycobacterium avium
EFPAACAAFTRSISLFAKGF

SEQ ID NO: 79220 - protein, 26 aa, Mycobacterium avium
EFRLPANELEFFFFVLAFAGSDTTKN

SEQ ID NO: 79221 - protein, 20 aa, Mycobacterium avium
EFTASWYGRVLHFGVREHAM

SEQ ID NO: 79222 - protein, 18 aa, Mycobacterium avium
EFTEAWTTFATVEKSWAY

SEQ ID NO: 79223 - protein, 22 aa, Mycobacterium avium
EFYECDSHVLALGYIGMTLGAY

SEQ ID NO: 79224 - protein, 19 aa, Mycobacterium avium
EGAAFPWRTIRGQECSAYW

SEQ ID NO: 79225 - protein, 17 aa, Mycobacterium avium
EGARLVCGGGRPEGLDS

SEQ ID NO: 79226 - protein, 19 aa, Mycobacterium avium
EGAVAYGHLQIRVEELAEA

SEQ ID NO: 79227 - protein, 21 aa, Mycobacterium avium
EGEGWRFLIYPALDCSSGDVG

SEQ ID NO: 79228 - protein, 23 aa, Mycobacterium avium
EGESCRRCGAVMRREKFMNRSSF

SEQ ID NO: 79229 - protein, 18 aa, Mycobacterium avium
EGFSLEASDSLGLQIVRT

SEQ ID NO: 79230 - protein, 18 aa, Mycobacterium avium
EGGSSWGNQMRSYVLHPY

SEQ ID NO: 79231 - protein, 18 aa, Mycobacterium avium
EGGWLGMTIPTEYGGHGL

SEQ ID NO: 79232 - protein, 24 aa, Mycobacterium avium
EGHLYRLFTKLGINSREQLTLLVA

SEQ ID NO: 79233 - protein, 23 aa, Mycobacterium avium
EGIIAAAAIRCMGGAIQAQLAPR

SEQ ID NO: 79234 - protein, 27 aa, Mycobacterium avium
EGIRGLSKVAALEWGRDNIRVNVVCPF

SEQ ID NO: 79235 - protein, 27 aa, Mycobacterium avium
EGITWLAGHLRQRWARNTGGLLLVTHD

SEQ ID NO: 79236 - protein, 23 aa, Mycobacterium avium
EGKNLIHWRGWTHAYHGTIPKLS

SEQ ID NO: 79237 - protein, 24 aa, Mycobacterium avium
EGKRFMFDYIPPVFKGQYAETEQE

SEQ ID NO: 79238 - protein, 20 aa, Mycobacterium avium
EGLASRAAMLRQRMVDARLA

SEQ ID NO: 79239 - protein, 17 aa, Mycobacterium avium
EGLGFYQLMEQLARERL

SEQ ID NO: 79240 - protein, 20 aa, Mycobacterium avium
EGLISQQPRRGFVVLPVTRR

SEQ ID NO: 79241 - protein, 20 aa, Mycobacterium avium
EGLLRGLYRYHVATEQRANK

SEQ ID NO: 79242 - protein, 19 aa, Mycobacterium avium
EGLRKLFRQFSFPGGIPSH

SEQ ID NO: 79243 - protein, 25 aa, Mycobacterium avium
EGLRRSGRTLTEFPIIAQAMVAVGR

SEQ ID NO: 79244 - protein, 18 aa, Mycobacterium avium
EGLYAVVVDREMSALLDG

SEQ ID NO: 79245 - protein, 25 aa, Mycobacterium avium
EGPLPQTRFVLRKALAAHLPVILVV

SEQ ID NO: 79246 - protein, 21 aa, Mycobacterium avium
EGPRGISAFVVEKGSAGLSFG

SEQ ID NO: 79247 - protein, 25 aa, Mycobacterium avium
EGRAPRPGERFRLPAHADTLEAIAA

SEQ ID NO: 79248 - protein, 22 aa, Mycobacterium avium
EGRKTEFAEHGWDASKKGEIPD

SEQ ID NO: 79249 - protein, 17 aa, Mycobacterium avium
EGSRPGVDLMVAAESGM

SEQ ID NO: 79250 - protein, 19 aa, Mycobacterium avium
EGTEFRAGVNVGVDITADQ

SEQ ID NO: 79251 - protein, 24 aa, Mycobacterium avium
EGTPADKVLEHWLASARRDDEARG

SEQ ID NO: 79252 - protein, 19 aa, Mycobacterium avium
EGVDVPRLSVGIYATSAST

SEQ ID NO: 79253 - protein, 17 aa, Mycobacterium avium
EGVRLFRFDRIVEASEL

SEQ ID NO: 79254 - protein, 20 aa, Mycobacterium avium
EGYAEDWDLDALWTALKTLY

SEQ ID NO: 79255 - protein, 22 aa, Mycobacterium avium
EHAELLAAAGARVAEFDPLVDA

SEQ ID NO: 79256 - protein, 17 aa, Mycobacterium avium
EHARVRGSVRLHDTELL

SEQ ID NO: 79257 - protein, 25 aa, Mycobacterium avium
EHAVFRRRRFFSGKPVGRRGQDGLR

SEQ ID NO: 79258 - protein, 25 aa, Mycobacterium avium
EHGLRPLVRLVSWAVAGVAPHIMGI

SEQ ID NO: 79259 - protein, 18 aa, Mycobacterium avium
EHHPAMRAFLAVPITIRG

SEQ ID NO: 79260 - protein, 19 aa, Mycobacterium avium
EHHPHLTPLAQRVLEPTDA

SEQ ID NO: 79261 - protein, 20 aa, Mycobacterium avium
EHIADTFIAMGWELAEGPEV

SEQ ID NO: 79262 - protein, 17 aa, Mycobacterium avium
EHILLRTVRCVSGTVEL

SEQ ID NO: 79263 - protein, 21 aa, Mycobacterium avium
EHKGSLSGLRMCYLGDGANNM

SEQ ID NO: 79264 - protein, 19 aa, Mycobacterium avium
EHLGHCVTRAVAGGGDDAD

SEQ ID NO: 79265 - protein, 23 aa, Mycobacterium avium
EHPGVRYRAFDLFEAGPDRIARL

SEQ ID NO: 79266 - protein, 20 aa, Mycobacterium avium
EHRLLDVFNLVPAVIDTHDE

SEQ ID NO: 79267 - protein, 18 aa, Mycobacterium avium
EHRSCAKAQALVAERGFE

SEQ ID NO: 79268 - protein, 24 aa, Mycobacterium avium
EHVCFPSSMVDRITPSTTLQMAAE

SEQ ID NO: 79269 - protein, 23 aa, Mycobacterium avium
EHVKPRLLGHWGTTPGLNLVYAH

SEQ ID NO: 79270 - protein, 22 aa, Mycobacterium avium
EHVNRIGLDAAPDWPSGHDNDV

SEQ ID NO: 79271 - protein, 24 aa, Mycobacterium avium
EIADRAGVSKPVLYQHFTSKLELY

SEQ ID NO: 79272 - protein, 20 aa, Mycobacterium avium
EIAEGWQPVFYLPDKAGSIW

SEQ ID NO: 79273 - protein, 18 aa, Mycobacterium avium
EIAELITMLVRFRTQAVA

SEQ ID NO: 79274 - protein, 19 aa, Mycobacterium avium
EIAEQLLRVLARRLRHTNN

SEQ ID NO: 79275 - protein, 27 aa, Mycobacterium avium
EIDRVFAGKVWGAWHLSEAAADLRLDF

SEQ ID NO: 79276 - protein, 24 aa, Mycobacterium avium
EIEAELFGANGWQPGDAWMAETTL

SEQ ID NO: 79277 - protein, 17 aa, Mycobacterium avium
EIEALYYLHPLTGDVIR

SEQ ID NO: 79278 - protein, 17 aa, Mycobacterium avium
EIEGAWKPDQYANPEGP

SEQ ID NO: 79279 - protein, 24 aa, Mycobacterium avium
EIFGPVLCVIPFDDEEDAIRIAND

SEQ ID NO: 79280 - protein, 24 aa, Mycobacterium avium
EIGCGTGDCAIYLAQHGWNVTAVD

SEQ ID NO: 79281 - protein, 20 aa, Mycobacterium avium
EIGPRLGMAPADVELLAQLV

SEQ ID NO: 79282 - protein, 26 aa, Mycobacterium avium
EIGRPSRLKGAGFYEYVDGKRTRLWP

SEQ ID NO: 79283 - protein, 18 aa, Mycobacterium avium
EIGRRLAPEPVLHAALGP

SEQ ID NO: 79284 - protein, 20 aa, Mycobacterium avium
EIGSGLAVFHPRGGVVRREL

SEQ ID NO: 79285 - protein, 19 aa, Mycobacterium avium
EIIDRGSLSELDRWSNSFV

SEQ ID NO: 79286 - protein, 26 aa, Mycobacterium avium
EILATEILDPLGFRWTNFGVAKQDVP

SEQ ID NO: 79287 - protein, 19 aa, Mycobacterium avium
EINVMGAMQLFAACQKAPS

SEQ ID NO: 79288 - protein, 21 aa, Mycobacterium avium
EIRGTCVLVDGAVKSLSGSAM

SEQ ID NO: 79289 - protein, 18 aa, Mycobacterium avium
EIRKEGKIGRVYYPAPYM

SEQ ID NO: 79290 - protein, 32 aa, Mycobacterium avium
EIRRARKSIAQFKLREGMPIGARVTLRGDRMW

SEQ ID NO: 79291 - protein, 19 aa, Mycobacterium avium
EKAAELLVSTNRKLDKAAS

SEQ ID NO: 79292 - protein, 23 aa, Mycobacterium avium
EKDLVVSHILHLLLTGKLRTGDR

SEQ ID NO: 79293 - protein, 18 aa, Mycobacterium avium
EKESRGLRHHRWVEKEAA

SEQ ID NO: 79294 - protein, 17 aa, Mycobacterium avium
EKFREILEQEYLNRRLI

SEQ ID NO: 79295 - protein, 22 aa, Mycobacterium avium
EKGKAFGAMYAYIEELVQRKAR

SEQ ID NO: 79296 - protein, 17 aa, Mycobacterium avium
EKGPRLGVLGVVVEIDG

SEQ ID NO: 79297 - protein, 24 aa, Mycobacterium avium
EKLDYLVDLGVDFVELMPVNSFAG

SEQ ID NO: 79298 - protein, 17 aa, Mycobacterium avium
EKLEAFANFGFPESHAL

SEQ ID NO: 79299 - protein, 21 aa, Mycobacterium avium
EKLFDRWIKALARVAEQAKGE

SEQ ID NO: 79300 - protein, 17 aa, Mycobacterium avium
EKLRGKTVRDVLPDHLV

SEQ ID NO: 79301 - protein, 18 aa, Mycobacterium avium
EKMEKAVAVARDDLSTIR

SEQ ID NO: 79302 - protein, 25 aa, Mycobacterium avium
EKRDLAFGTSRWSSKLVHGGLRYLA

SEQ ID NO: 79303 - protein, 17 aa, Mycobacterium avium
EKVELCLIDSRGAETRI

SEQ ID NO: 79304 - protein, 21 aa, Mycobacterium avium
EKYRIVAAPVQFDETPPAPAR

SEQ ID NO: 79305 - protein, 27 aa, Mycobacterium avium
ELAFLRPLPVRRLWGVGAVTAEKLRAH

SEQ ID NO: 79306 - protein, 26 aa, Mycobacterium avium
ELAGRWLRPGGLIGIEHDDTTSHQTV

SEQ ID NO: 79307 - protein, 20 aa, Mycobacterium avium
ELAPHPLLVRALEQTARSRE

SEQ ID NO: 79308 - protein, 23 aa, Mycobacterium avium
ELARGELRTEVFALYDPPAPPGM

SEQ ID NO: 79309 - protein, 26 aa, Mycobacterium avium
ELARRSDVFLTSFLPAHRKKFGIDVD

SEQ ID NO: 79310 - protein, 17 aa, Mycobacterium avium
ELCSAGMEGVVFVGVPR

SEQ ID NO: 79311 - protein, 19 aa, Mycobacterium avium
ELDAYVVRRLNLPFRDVDW

SEQ ID NO: 79312 - protein, 23 aa, Mycobacterium avium
ELDDCAFPLLSGVEIGADPNKIF

SEQ ID NO: 79313 - protein, 18 aa, Mycobacterium avium
ELDHLLAKLKRFREEAGK

SEQ ID NO: 79314 - protein, 25 aa, Mycobacterium avium
ELDIAPDGSFEWRVRPTSNGQLVIR

SEQ ID NO: 79315 - protein, 20 aa, Mycobacterium avium
ELEAAASIAAARVKVAIQEP

SEQ ID NO: 79316 - protein, 17 aa, Mycobacterium avium
ELERLYVPWSERTGKRW

SEQ ID NO: 79317 - protein, 19 aa, Mycobacterium avium
ELFIALAGRVARAVIAESP

SEQ ID NO: 79318 - protein, 17 aa, Mycobacterium avium
ELGESWVRVNSIRPGLI

SEQ ID NO: 79319 - protein, 18 aa, Mycobacterium avium
ELGIPAGAGGRVGAARKP

SEQ ID NO: 79320 - protein, 17 aa, Mycobacterium avium
ELGQLFRLPIAALGNGS

SEQ ID NO: 79321 - protein, 19 aa, Mycobacterium avium
ELIDDVVWGCVSQVGDQSS

SEQ ID NO: 79322 - protein, 20 aa, Mycobacterium avium
ELIVAAAFTCFGRQGLQKAT

SEQ ID NO: 79323 - protein, 24 aa, Mycobacterium avium
ELKGCQPQAAKLVEWLKLALDEPH

SEQ ID NO: 79324 - protein, 18 aa, Mycobacterium avium
ELKLCMIHGADPWWDVAI

SEQ ID NO: 79325 - protein, 26 aa, Mycobacterium avium
ELKLDRKIAERRVFPAVDVNPSGTRK

SEQ ID NO: 79326 - protein, 24 aa, Mycobacterium avium
ELLAHCYRMTGSLHDAEDLVQETL

SEQ ID NO: 79327 - protein, 18 aa, Mycobacterium avium
ELLRLGDLAFPIAPGTAG

SEQ ID NO: 79328 - protein, 21 aa, Mycobacterium avium
ELLRRYPRIELVGEVDRMRAT

SEQ ID NO: 79329 - protein, 25 aa, Mycobacterium avium
ELNEFSLRVLHSFLTDPGRPPRTGA

SEQ ID NO: 79330 - protein, 22 aa, Mycobacterium avium
ELPLPRPKYEIFVYSPRVEGVH

SEQ ID NO: 79331 - protein, 22 aa, Mycobacterium avium
ELPPELPATAGVWREGMLDGQH

SEQ ID NO: 79332 - protein, 30 aa, Mycobacterium avium
ELPTYPFQRRRFWPKASGIAGIDGQGAAAS

SEQ ID NO: 79333 - protein, 20 aa, Mycobacterium avium
ELQFGTNHLGHFALTGLLLD

SEQ ID NO: 79334 - protein, 19 aa, Mycobacterium avium
ELRGPAWSGDAAAAMAAAV

SEQ ID NO: 79335 - protein, 21 aa, Mycobacterium avium
ELRIGLATAEDIRQWSYGEVK

SEQ ID NO: 79336 - protein, 24 aa, Mycobacterium avium
ELSRSVFSKGIFPAVDPLASSSTI

SEQ ID NO: 79337 - protein, 23 aa, Mycobacterium avium
ELSVIPRQRVLVISTGSELVAPG

SEQ ID NO: 79338 - protein, 21 aa, Mycobacterium avium
ELTAACGAALMADDPAVKPLR

SEQ ID NO: 79339 - protein, 26 aa, Mycobacterium avium
ELTAARAARLKWWTTDLQVRTADRCL

SEQ ID NO: 79340 - protein, 19 aa, Mycobacterium avium
ELTEATVAEAGWKLDDVLP

SEQ ID NO: 79341 - protein, 17 aa, Mycobacterium avium
ELTEFDIELDLRGSEFQ

SEQ ID NO: 79342 - protein, 21 aa, Mycobacterium avium
ELTPHRGAWCGNDIWREVLPP

SEQ ID NO: 79343 - protein, 20 aa, Mycobacterium avium
ELVDAAGISYAFRIVEDVGV

SEQ ID NO: 79344 - protein, 19 aa, Mycobacterium avium
ELVERLAVRGSRLAEVLSR

SEQ ID NO: 79345 - protein, 25 aa, Mycobacterium avium
ELVERLRLTIPELPWLSRKRIQQEW

SEQ ID NO: 79346 - protein, 18 aa, Mycobacterium avium
ELVYAVLNLYPYNPGHLM

SEQ ID NO: 79347 - protein, 18 aa, Mycobacterium avium
ELWFGAHPGDPAWLETDN

SEQ ID NO: 79348 - protein, 23 aa, Mycobacterium avium
ELYGKPQFWPLWEAAADANLPVA

SEQ ID NO: 79349 - protein, 18 aa, Mycobacterium avium
ELYRINLHHVFLVTHAFL

SEQ ID NO: 79350 - protein, 25 aa, Mycobacterium avium
EMADLIVSGALEFDIAATYPLDRVA

SEQ ID NO: 79351 - protein, 25 aa, Mycobacterium avium
EMGEGARPPWSIGEPQPEIAALIEA

SEQ ID NO: 79352 - protein, 24 aa, Mycobacterium avium
EMGLARLWQSWGVEPDVVLGHSVG

SEQ ID NO: 79353 - protein, 20 aa, Mycobacterium avium
EMHARVSGLADYFAVDELDA

SEQ ID NO: 79354 - protein, 19 aa, Mycobacterium avium
EMHQAGAPGGVFASLFTCG

SEQ ID NO: 79355 - protein, 23 aa, Mycobacterium avium
EMLTMGFAEEVDRILSETPEYKQ

SEQ ID NO: 79356 - protein, 17 aa, Mycobacterium avium
EMMPRLMAQQIDEAGGA

SEQ ID NO: 79357 - protein, 19 aa, Mycobacterium avium
EMMRHVLSPVLRIYRLDVP

SEQ ID NO: 79358 - protein, 21 aa, Mycobacterium avium
EMNLRTILRLSPEAVFKPRWL

SEQ ID NO: 79359 - protein, 18 aa, Mycobacterium avium
EMNWRILKFRPRESDAAA

SEQ ID NO: 79360 - protein, 21 aa, Mycobacterium avium
EMREAVLHFAVYAGWPKASRF

SEQ ID NO: 79361 - protein, 18 aa, Mycobacterium avium
EMTGLALQRVYLDRVAKL

SEQ ID NO: 79362 - protein, 26 aa, Mycobacterium avium
EMVARGCPFSGLLYAGLAITSNGPAV

SEQ ID NO: 79363 - protein, 23 aa, Mycobacterium avium
ENAIWKARTQDIGYLDLTGCMAL

SEQ ID NO: 79364 - protein, 25 aa, Mycobacterium avium
ENDFRDVLPAAGWEISYLGPTTYQV

SEQ ID NO: 79365 - protein, 24 aa, Mycobacterium avium
ENDSVRIAREFLIRVVNDAIEHGE

SEQ ID NO: 79366 - protein, 17 aa, Mycobacterium avium
ENFRPGTLEKWNLGYDV

SEQ ID NO: 79367 - protein, 23 aa, Mycobacterium avium
ENFSPRVVENFGLDYDSLTALNP

SEQ ID NO: 79368 - protein, 17 aa, Mycobacterium avium
ENGARASFMPKPFGQHP

SEQ ID NO: 79369 - protein, 25 aa, Mycobacterium avium
ENLAREFMELFALGHGNGYTESDVR

SEQ ID NO: 79370 - protein, 26 aa, Mycobacterium avium
ENLFFKEKRYDLARVGRYKVNKKLGL

SEQ ID NO: 79371 - protein, 18 aa, Mycobacterium avium
ENLRRLAHVAALLADCGN

SEQ ID NO: 79372 - protein, 19 aa, Mycobacterium avium
ENMRARVNAALGITEQGFN

SEQ ID NO: 79373 - protein, 24 aa, Mycobacterium avium
ENRLPPVHVFAGINLSFGAMGPLL

SEQ ID NO: 79374 - protein, 24 aa, Mycobacterium avium
ENSTCLNCGSALGFSIEQMALLVI

SEQ ID NO: 79375 - protein, 23 aa, Mycobacterium avium
ENTVPYGFDFARPVSRFEEALRV

SEQ ID NO: 79376 - protein, 26 aa, Mycobacterium avium
ENVDAFLAVCRKWDVLATVIGEVTDG

SEQ ID NO: 79377 - protein, 23 aa, Mycobacterium avium
ENVPEIWRRLDAVGLRTTEACGD

SEQ ID NO: 79378 - protein, 19 aa, Mycobacterium avium
EPAEPKGPGLLERLWHDRD

SEQ ID NO: 79379 - protein, 21 aa, Mycobacterium avium
EPATEKVRQLFADAGIRIPTQ

SEQ ID NO: 79380 - protein, 21 aa, Mycobacterium avium
EPCSALDPISTMAIEELISEL

SEQ ID NO: 79381 - protein, 20 aa, Mycobacterium avium
EPDARMRAVLAHRSPAVRVL

SEQ ID NO: 79382 - protein, 30 aa, Mycobacterium avium
EPDWVNTIFLSTRFKAWRVGGYNEYLYTFF

SEQ ID NO: 79383 - protein, 19 aa, Mycobacterium avium
EPFGAEVFHVNPVCGDEVT

SEQ ID NO: 79384 - protein, 18 aa, Mycobacterium avium
EPGDLCVLNEPPHTALAE

SEQ ID NO: 79385 - protein, 18 aa, Mycobacterium avium
EPGMTLLDIGCGWGATMR

SEQ ID NO: 79386 - protein, 17 aa, Mycobacterium avium
EPGMVLAVTGYVWEEGV

SEQ ID NO: 79387 - protein, 23 aa, Mycobacterium avium
EPGTAARFIPLWDRTVPERLGEP

SEQ ID NO: 79388 - protein, 25 aa, Mycobacterium avium
EPGTLIWRNRWITRDGIVECREALA

SEQ ID NO: 79389 - protein, 25 aa, Mycobacterium avium
EPHLRKAYNGFRRMGLDADTAETAA

SEQ ID NO: 79390 - protein, 23 aa, Mycobacterium avium
EPIDRIVSLGAFEHFADGAGDAG

SEQ ID NO: 79391 - protein, 24 aa, Mycobacterium avium
EPIGVCGLITPWNWPINQVAVKVY

SEQ ID NO: 79392 - protein, 20 aa, Mycobacterium avium
EPIVAPGSWIGGDRDGNPNV

SEQ ID NO: 79393 - protein, 23 aa, Mycobacterium avium
EPKDTRLLLEFMGLANHRKAIRA

SEQ ID NO: 79394 - protein, 24 aa, Mycobacterium avium
EPLGNTGPTGWRTRVRLDVGADRR

SEQ ID NO: 79395 - protein, 24 aa, Mycobacterium avium
EPLPEGSGFEFVDKVVGGAVPRQF

SEQ ID NO: 79396 - protein, 23 aa, Mycobacterium avium
EPMIPIYIFYSMFGFQRTGDGLW

SEQ ID NO: 79397 - protein, 26 aa, Mycobacterium avium
EPNRAWRLYRRLGFTDIIRRYHFAGD

SEQ ID NO: 79398 - protein, 25 aa, Mycobacterium avium
EPRPSWGHPKYDPIWAAATKHDIVV

SEQ ID NO: 79399 - protein, 20 aa, Mycobacterium avium
EPRTFTLRAARLLAGRTADF

SEQ ID NO: 79400 - protein, 20 aa, Mycobacterium avium
EPTPRRLTIVVSNDNGGGIF

SEQ ID NO: 79401 - protein, 22 aa, Mycobacterium avium
EPVDISNAVLFLASDESRYITG

SEQ ID NO: 79402 - protein, 25 aa, Mycobacterium avium
EPVLKLLKITGDWQKFKGLPGAEGR

SEQ ID NO: 79403 - protein, 18 aa, Mycobacterium avium
EPYPEIMHALKVRSAITR

SEQ ID NO: 79404 - protein, 24 aa, Mycobacterium avium
EQARRAAAPWSRAIVGSAVSAAEW

SEQ ID NO: 79405 - protein, 29 aa, Mycobacterium avium
EQARRLKVPPERWVYPLAGTDAHDTASIA

SEQ ID NO: 79406 - protein, 19 aa, Mycobacterium avium
EQATADAFTDGWFKTGDLG

SEQ ID NO: 79407 - protein, 18 aa, Mycobacterium avium
EQDHARFAKIFDVNLWAP

SEQ ID NO: 79408 - protein, 23 aa, Mycobacterium avium
EQDLQHRLGRMVASTTAFGANEN

SEQ ID NO: 79409 - protein, 22 aa, Mycobacterium avium
EQEMPGLMSLRREYHDVQPLKG

SEQ ID NO: 79410 - protein, 24 aa, Mycobacterium avium
EQGDPRFSDVSSRVFGTPHDVDVG

SEQ ID NO: 79411 - protein, 18 aa, Mycobacterium avium
EQHDVVAFDSRREALERL

SEQ ID NO: 79412 - protein, 26 aa, Mycobacterium avium
EQIDFWRFNVAFARQILAQQPISGPG

SEQ ID NO: 79413 - protein, 24 aa, Mycobacterium avium
EQIYEMYRLLAIAKYEERYVIPTA

SEQ ID NO: 79414 - protein, 24 aa, Mycobacterium avium
EQLNGHKGCVIWFTGLSGSGKSTV

SEQ ID NO: 79415 - protein, 17 aa, Mycobacterium avium
EQLRFQIGRWQYRDLIR

SEQ ID NO: 79416 - protein, 32 aa, Mycobacterium avium
EQPEKTRWGLPVDRLRFAMSNYQRLTMQQMTH

SEQ ID NO: 79417 - protein, 26 aa, Mycobacterium avium
EQPWFTGRFATIGMSYLGFTQWALLQ

SEQ ID NO: 79418 - protein, 24 aa, Mycobacterium avium
EQQDRFLAGVARGGVLTAALNEPG

SEQ ID NO: 79419 - protein, 19 aa, Mycobacterium avium
EQRGRRWPVIISGTITDAS

SEQ ID NO: 79420 - protein, 18 aa, Mycobacterium avium
EQSLREFLGPMITALEGY

SEQ ID NO: 79421 - protein, 23 aa, Mycobacterium avium
EQSQWPRWVPVGRMGLPEDQARV

SEQ ID NO: 79422 - protein, 24 aa, Mycobacterium avium
EQTAVCVLEHDWTTVVMVDSHDGQ

SEQ ID NO: 79423 - protein, 18 aa, Mycobacterium avium
EQTLFRFVDVDGRELEHY

SEQ ID NO: 79424 - protein, 21 aa, Mycobacterium avium
EQVPAALAMRPDLITVCAGMN

SEQ ID NO: 79425 - protein, 19 aa, Mycobacterium avium
ERALAIGVRVMANIVEQSA

SEQ ID NO: 79426 - protein, 24 aa, Mycobacterium avium
ERAVFVLREVFGFDYDEIAEAVGK

SEQ ID NO: 79427 - protein, 18 aa, Mycobacterium avium
ERAYQIFGNHEFGLPPGD

SEQ ID NO: 79428 - protein, 21 aa, Mycobacterium avium
ERDRERFAISAGGVVAVGKGV

SEQ ID NO: 79429 - protein, 26 aa, Mycobacterium avium
ERDTCWPWLQAEWRLISEHVRVVVAL

SEQ ID NO: 79430 - protein, 20 aa, Mycobacterium avium
ERFAVSRYTIREALRRLRED

SEQ ID NO: 79431 - protein, 25 aa, Mycobacterium avium
ERGDILLIRTGWWTRYLETGNKTEP

SEQ ID NO: 79432 - protein, 23 aa, Mycobacterium avium
ERHFARAARACYVSQPALSEAIR

SEQ ID NO: 79433 - protein, 23 aa, Mycobacterium avium
ERHVEAVTAWLQRHHAGDRNRGR

SEQ ID NO: 79434 - protein, 24 aa, Mycobacterium avium
ERIAPRPTTPFAQALRLALIDAAP

SEQ ID NO: 79435 - protein, 18 aa, Mycobacterium avium
ERLKGLFMASFEAIEHRH

SEQ ID NO: 79436 - protein, 17 aa, Mycobacterium avium
ERLLLTVHVDPFTREQT

SEQ ID NO: 79437 - protein, 22 aa, Mycobacterium avium
ERLSRLGGIVGTAFQISDDIID

SEQ ID NO: 79438 - protein, 27 aa, Mycobacterium avium
ERLTRAWTGLRAMRSYALATMDVEQPG

SEQ ID NO: 79439 - protein, 18 aa, Mycobacterium avium
ERMRLGALARHIAQELPP

SEQ ID NO: 79440 - protein, 26 aa, Mycobacterium avium
ERNQLPSGSAICFISSVAGMGWENDL

SEQ ID NO: 79441 - protein, 29 aa, Mycobacterium avium
ERPATAADEIVRWATPVTSFQRTALQDYE

SEQ ID NO: 79442 - protein, 19 aa, Mycobacterium avium
ERPGRPLGASTAEFADLAA

SEQ ID NO: 79443 - protein, 17 aa, Mycobacterium avium
ERPPLRQVLNGPSDDPF

SEQ ID NO: 79444 - protein, 23 aa, Mycobacterium avium
ERQRIEPLLARSANWVTGESSAD

SEQ ID NO: 79445 - protein, 23 aa, Mycobacterium avium
ERRKEMLHNSALRGEQMKGHAST

SEQ ID NO: 79446 - protein, 22 aa, Mycobacterium avium
ERRKQICARAYRVLTEEVGFPP

SEQ ID NO: 79447 - protein, 23 aa, Mycobacterium avium
ERRMKKEIADVITLQEQLGLDVL

SEQ ID NO: 79448 - protein, 24 aa, Mycobacterium avium
ERSARAWLFTVARNMIIDDRRSAR

SEQ ID NO: 79449 - protein, 25 aa, Mycobacterium avium
ERSGPSRARYLMLRLLERAGEQRVA

SEQ ID NO: 79450 - protein, 22 aa, Mycobacterium avium
ERSSHTWFVLTHLLGKPGVRNY

SEQ ID NO: 79451 - protein, 19 aa, Mycobacterium avium
ERTGIELTESMAMWPGAAV

SEQ ID NO: 79452 - protein, 19 aa, Mycobacterium avium
ERTGLPIRVDRRLRETHLG

SEQ ID NO: 79453 - protein, 24 aa, Mycobacterium avium
ERTRARAGAVAATIRTDGAARAAR

SEQ ID NO: 79454 - protein, 18 aa, Mycobacterium avium
ERVGKRGLGFGAEVRSKA

SEQ ID NO: 79455 - protein, 22 aa, Mycobacterium avium
ERYRCRVHTFAADVGDAAQVEQ

SEQ ID NO: 79456 - protein, 20 aa, Mycobacterium avium
ERYVIPTAFAPQARDLEQMG

SEQ ID NO: 79457 - protein, 17 aa, Mycobacterium avium
ESAETQTAMGFSQDPDT

SEQ ID NO: 79458 - protein, 23 aa, Mycobacterium avium
ESAVLRLATAVAVAKSVDELLSI

SEQ ID NO: 79459 - protein, 18 aa, Mycobacterium avium
ESDILARIGGDEFCVMVT

SEQ ID NO: 79460 - protein, 20 aa, Mycobacterium avium
ESGFPLMPMMVPPPTTSAGT

SEQ ID NO: 79461 - protein, 24 aa, Mycobacterium avium
ESGHPGRFLLGIGAGHREHTREYV

SEQ ID NO: 79462 - protein, 27 aa, Mycobacterium avium
ESGLRGGILIPARWVGYPPYHDRRYDK

SEQ ID NO: 79463 - protein, 17 aa, Mycobacterium avium
ESGWTFDHFYPIFSDSS

SEQ ID NO: 79464 - protein, 19 aa, Mycobacterium avium
ESIADRLAEAFAERMHQRV

SEQ ID NO: 79465 - protein, 31 aa, Mycobacterium avium
ESIRKTSAGWVWKFDPAIFGGEFLQPTPADE

SEQ ID NO: 79466 - protein, 21 aa, Mycobacterium avium
ESLASLPGCRLLVRPDEIRRD

SEQ ID NO: 79467 - protein, 19 aa, Mycobacterium avium
ESLDSLGPIFSELRDAGRE

SEQ ID NO: 79468 - protein, 17 aa, Mycobacterium avium
ESLDVCFELADRILKSM

SEQ ID NO: 79469 - protein, 20 aa, Mycobacterium avium
ESLIKAGAFDSLKHARKGLF

SEQ ID NO: 79470 - protein, 23 aa, Mycobacterium avium
ESLLPRYLTTRVYAALLESAASE

SEQ ID NO: 79471 - protein, 22 aa, Mycobacterium avium
ESLPKLNSFVLPGGSPLSALLH

SEQ ID NO: 79472 - protein, 23 aa, Mycobacterium avium
ESLRLTTDYLKTRKQFGVTLNKF

SEQ ID NO: 79473 - protein, 17 aa, Mycobacterium avium
ESLRPVPPGVVGELYVA

SEQ ID NO: 79474 - protein, 19 aa, Mycobacterium avium
ESLSREFRGLLDRVPPADP

SEQ ID NO: 79475 - protein, 27 aa, Mycobacterium avium
ESLTGAPMPRWLAGALAAPAGPPRPCR

SEQ ID NO: 79476 - protein, 24 aa, Mycobacterium avium
ESMGFKTFGFAFGREDVWEPEEIL

SEQ ID NO: 79477 - protein, 24 aa, Mycobacterium avium
ESNAPVLLGLIGLWYSNFMGAQSR

SEQ ID NO: 79478 - protein, 26 aa, Mycobacterium avium
ESPRETWLRLLLLRAGFPRPRTQLPV

SEQ ID NO: 79479 - protein, 28 aa, Mycobacterium avium
ESQCGWLKDRFGLSWQIVPDRLFELIGD

SEQ ID NO: 79480 - protein, 18 aa, Mycobacterium avium
ESRRLRRGFTAFGQTQWS

SEQ ID NO: 79481 - protein, 20 aa, Mycobacterium avium
ESSAWAHALASRYELHTPAV

SEQ ID NO: 79482 - protein, 24 aa, Mycobacterium avium
ESSQLRSGFGFLAIHGGGLEEMTD

SEQ ID NO: 79483 - protein, 24 aa, Mycobacterium avium
ESTPLSRRGTLWSYTENRYAPPPP

SEQ ID NO: 79484 - protein, 37 aa, Mycobacterium avium
ESTPVDGKVGWKGFHAIERDLWQAGAITPGTKALSTE

SEQ ID NO: 79485 - protein, 20 aa, Mycobacterium avium
ESTWSTFMATYWQLGNTPHV

SEQ ID NO: 79486 - protein, 17 aa, Mycobacterium avium
ESVAAILRYCSQHRIAV

SEQ ID NO: 79487 - protein, 17 aa, Mycobacterium avium
ESVKYAKERQSFGQPIG

SEQ ID NO: 79488 - protein, 17 aa, Mycobacterium avium
ESVRVYLATGLTRVDRP

SEQ ID NO: 79489 - protein, 18 aa, Mycobacterium avium
ESYCYIPLLEELDFMPSK

SEQ ID NO: 79490 - protein, 24 aa, Mycobacterium avium
ETAARGYSAVITRLHGESWSGSAS

SEQ ID NO: 79491 - protein, 20 aa, Mycobacterium avium
ETAARLGLRPLARIHTTAVV

SEQ ID NO: 79492 - protein, 25 aa, Mycobacterium avium
ETAEYSLRGANLWDEVKDRLDRPGG

SEQ ID NO: 79493 - protein, 24 aa, Mycobacterium avium
ETAKTFKDGWLHTGDMAREDEDGF

SEQ ID NO: 79494 - protein, 23 aa, Mycobacterium avium
ETAWKLAKQYFKLTGKPGKHKVI

SEQ ID NO: 79495 - protein, 18 aa, Mycobacterium avium
ETAWKLASDLDRFGEWMT

SEQ ID NO: 79496 - protein, 17 aa, Mycobacterium avium
ETAYAWRTILARGNGSG

SEQ ID NO: 79497 - protein, 18 aa, Mycobacterium avium
ETAYCLGVEKLLGITDQI

SEQ ID NO: 79498 - protein, 25 aa, Mycobacterium avium
ETCVGRLRYLGVVLYDMDRVLEAAS

SEQ ID NO: 79499 - protein, 24 aa, Mycobacterium avium
ETDDLRPLWLAAPVTEVLPRTTVA

SEQ ID NO: 79500 - protein, 27 aa, Mycobacterium avium
ETDKPFLMPVEDVFTITGRGTVVTGRV

SEQ ID NO: 79501 - protein, 21 aa, Mycobacterium avium
ETGELLRWLDSQTKRNLVITF

SEQ ID NO: 79502 - protein, 22 aa, Mycobacterium avium
ETLDPSIYWMGMHHSRLIKRDS

SEQ ID NO: 79503 - protein, 22 aa, Mycobacterium avium
ETLNSMKALWARPKDEVSEEEY

SEQ ID NO: 79504 - protein, 17 aa, Mycobacterium avium
ETLRLHPPLIILMRVAK

SEQ ID NO: 79505 - protein, 20 aa, Mycobacterium avium
ETLTTLVIRGEGGFGGMPGQ

SEQ ID NO: 79506 - protein, 26 aa, Mycobacterium avium
ETLVALGAEVRWASCNIFSTQDHAAA

SEQ ID NO: 79507 - protein, 20 aa, Mycobacterium avium
ETPACFEPTLDYVVVKAPRF

SEQ ID NO: 79508 - protein, 24 aa, Mycobacterium avium
ETTKGEAECAQWVAEQLAAVGYAP

SEQ ID NO: 79509 - protein, 23 aa, Mycobacterium avium
ETTKRYMHHYNFPPFSTGETGRV

SEQ ID NO: 79510 - protein, 23 aa, Mycobacterium avium
ETTLPRECLLVFGQEGPGITDDT

SEQ ID NO: 79511 - protein, 23 aa, Mycobacterium avium
ETTRARAPLPLNVIGLNNIAPAI

SEQ ID NO: 79512 - protein, 23 aa, Mycobacterium avium
ETVTEARCGIGYLHTGIEKNLEY

SEQ ID NO: 79513 - protein, 17 aa, Mycobacterium avium
ETYGALFDRLKDGKISQ

SEQ ID NO: 79514 - protein, 19 aa, Mycobacterium avium
EVAAEFGAGLVCSHTGNAL

SEQ ID NO: 79515 - protein, 19 aa, Mycobacterium avium
EVADTYFALMDRLGTDGLL

SEQ ID NO: 79516 - protein, 20 aa, Mycobacterium avium
EVAEGYILTCQGVPDTDSVT

SEQ ID NO: 79517 - protein, 17 aa, Mycobacterium avium
EVAERAGSIALQTRQRV

SEQ ID NO: 79518 - protein, 28 aa, Mycobacterium avium
EVAEVWRRGSVIGSWLLDLTAIALHESP

SEQ ID NO: 79519 - protein, 23 aa, Mycobacterium avium
EVAFKLSRLTGRTKLVAAQEAFH

SEQ ID NO: 79520 - protein, 25 aa, Mycobacterium avium
EVALSLPLGAGRLTREWLPDDPPGR

SEQ ID NO: 79521 - protein, 27 aa, Mycobacterium avium
EVARYLFRRVVSWGRSSNVFLRNGARL

SEQ ID NO: 79522 - protein, 24 aa, Mycobacterium avium
EVASRAGLIQVMRDMLAAPDQFDW

SEQ ID NO: 79523 - protein, 27 aa, Mycobacterium avium
EVAVDLRQDWPAALRAAGFDPTQRTAW

SEQ ID NO: 79524 - protein, 18 aa, Mycobacterium avium
EVDGFVWHAYIPGIEPGQ

SEQ ID NO: 79525 - protein, 20 aa, Mycobacterium avium
EVDKVFVVACGTAYHSGLLA

SEQ ID NO: 79526 - protein, 18 aa, Mycobacterium avium
EVDPAAALKAELRSKPGD

SEQ ID NO: 79527 - protein, 24 aa, Mycobacterium avium
EVEGGKIRVAEGWAHGPQIDKGAR

SEQ ID NO: 79528 - protein, 26 aa, Mycobacterium avium
EVFVLRPCIVAGPGATALADAMPWNQ

SEQ ID NO: 79529 - protein, 24 aa, Mycobacterium avium
EVGRPDIMIVVGGVIPPGDFDELY

SEQ ID NO: 79530 - protein, 25 aa, Mycobacterium avium
EVHGVLIPGGFGIRGIEGKIGAIHY

SEQ ID NO: 79531 - protein, 24 aa, Mycobacterium avium
EVIEKMRVAGRIAAGALVEAGKAV

SEQ ID NO: 79532 - protein, 26 aa, Mycobacterium avium
EVIELRPDLDWDKGKTLHWVIEHLRR

SEQ ID NO: 79533 - protein, 19 aa, Mycobacterium avium
EVIGPKGKIINAITEETGA

SEQ ID NO: 79534 - protein, 18 aa, Mycobacterium avium
EVKQRLATEGSLQLIDAL

SEQ ID NO: 79535 - protein, 23 aa, Mycobacterium avium
EVLDRYLPVLTELRLRYLDDHDF

SEQ ID NO: 79536 - protein, 27 aa, Mycobacterium avium
EVLGAGIPLFGICFGNQILGRALGLST

SEQ ID NO: 79537 - protein, 22 aa, Mycobacterium avium
EVLPEKPELVLLDNFPVWQTQM

SEQ ID NO: 79538 - protein, 23 aa, Mycobacterium avium
EVLPNYSGGLGILAGDHLKSASD

SEQ ID NO: 79539 - protein, 22 aa, Mycobacterium avium
EVLRSFLDWLFARYREIIDSES

SEQ ID NO: 79540 - protein, 19 aa, Mycobacterium avium
EVLSALGVVVNKGNVGALE

SEQ ID NO: 79541 - protein, 24 aa, Mycobacterium avium
EVNEAFAPVPMAWLKDIGADEKKL

SEQ ID NO: 79542 - protein, 18 aa, Mycobacterium avium
EVNGGWTVMRFALDAEHG

SEQ ID NO: 79543 - protein, 18 aa, Mycobacterium avium
EVPDGVVVEAMLAGDGNL

SEQ ID NO: 79544 - protein, 20 aa, Mycobacterium avium
EVRAYLRATARTVLAAHWRE

SEQ ID NO: 79545 - protein, 20 aa, Mycobacterium avium
EVRGPWIAGSYYLGRDDSKF

SEQ ID NO: 79546 - protein, 19 aa, Mycobacterium avium
EVRHRIAFLPDYDMSMARL

SEQ ID NO: 79547 - protein, 24 aa, Mycobacterium avium
EVRIATAPGDYVFIPPYLPHREEN

SEQ ID NO: 79548 - protein, 35 aa, Mycobacterium avium
EVRMGMRVEAVWKPREQWGFGIDNIEYFRPTGEPD

SEQ ID NO: 79549 - protein, 17 aa, Mycobacterium avium
EVRRKHGPASMVFNNAG

SEQ ID NO: 79550 - protein, 25 aa, Mycobacterium avium
EVRSRSDLLAALPERLHDRAVTLEV

SEQ ID NO: 79551 - protein, 23 aa, Mycobacterium avium
EVRVPAKALWRAQTQRAVENFPI

SEQ ID NO: 79552 - protein, 18 aa, Mycobacterium avium
EVRWDIRPSPHLGTLEMR

SEQ ID NO: 79553 - protein, 27 aa, Mycobacterium avium
EVTAFSRPATWWARAGGPVLRVGQRVI

SEQ ID NO: 79554 - protein, 21 aa, Mycobacterium avium
EVTGVPILFASTGEKLEDFDV

SEQ ID NO: 79555 - protein, 17 aa, Mycobacterium avium
EVTRKLDKMGWRSSDTA

SEQ ID NO: 79556 - protein, 24 aa, Mycobacterium avium
EVTVSSYVRWPESMRPLVRPLAPA

SEQ ID NO: 79557 - protein, 20 aa, Mycobacterium avium
EVVAAHLVNLMWNGLTHLEA

SEQ ID NO: 79558 - protein, 24 aa, Mycobacterium avium
EVVAIGITPQGSWVLTDGDPAALA

SEQ ID NO: 79559 - protein, 20 aa, Mycobacterium avium
EVVARFCGRELVLDAEVEEK

SEQ ID NO: 79560 - protein, 20 aa, Mycobacterium avium
EVVRRLKAAGAVIVGKTNTC

SEQ ID NO: 79561 - protein, 20 aa, Mycobacterium avium
EVVRRLRAAGAVIIGKTNVP

SEQ ID NO: 79562 - protein, 21 aa, Mycobacterium avium
EVYCAPEVVEYLGAATDQIRD

SEQ ID NO: 79563 - protein, 20 aa, Mycobacterium avium
EVYDYLRLLYARAGTPHCPV

SEQ ID NO: 79564 - protein, 24 aa, Mycobacterium avium
EWKPEAEGGFSRVQRRIWELEKRR

SEQ ID NO: 79565 - protein, 20 aa, Mycobacterium avium
EWLPTDHPLVGMPNVVLTPH

SEQ ID NO: 79566 - protein, 18 aa, Mycobacterium avium
EWMSRPHLVQAWESNWPL

SEQ ID NO: 79567 - protein, 28 aa, Mycobacterium avium
EWPENPRFLMCTPLSHAGAAFFVPTIIK

SEQ ID NO: 79568 - protein, 22 aa, Mycobacterium avium
EWREIDGAATLYTFTVARRPTG

SEQ ID NO: 79569 - protein, 19 aa, Mycobacterium avium
EYDRAIGYEAAYAGTSFAT

SEQ ID NO: 79570 - protein, 18 aa, Mycobacterium avium
EYGARGWAMNTLFDGIEA

SEQ ID NO: 79571 - protein, 17 aa, Mycobacterium avium
EYGGLGLDYEYQKAFDA

SEQ ID NO: 79572 - protein, 19 aa, Mycobacterium avium
EYGGRGFSAIEQFIFAEEA

SEQ ID NO: 79573 - protein, 27 aa, Mycobacterium avium
EYGRTPAQVLVRWNLQLDNVVVSRSSK

SEQ ID NO: 79574 - protein, 17 aa, Mycobacterium avium
EYLDMFYNLGIAGRAMR

SEQ ID NO: 79575 - protein, 18 aa, Mycobacterium avium
EYLSFLPSNCFDQPPIVN

SEQ ID NO: 79576 - protein, 25 aa, Mycobacterium avium
EYQRRLRAANALDFDDLIGETVAVL

SEQ ID NO: 79577 - protein, 19 aa, Mycobacterium avium
FAAAAGFSQPILHGLCTYG

SEQ ID NO: 79578 - protein, 23 aa, Mycobacterium avium
FAACVEAGVPFCTQVGHTGPLRP

SEQ ID NO: 79579 - protein, 19 aa, Mycobacterium avium
FAAHRGMDRLPLAKSASGG

SEQ ID NO: 79580 - protein, 18 aa, Mycobacterium avium
FAAQALAVMREWKFGAAD

SEQ ID NO: 79581 - protein, 24 aa, Mycobacterium avium
FAAQPGIFTFGWGPVLHQLAAGLG

SEQ ID NO: 79582 - protein, 23 aa, Mycobacterium avium
FAARFLICATGCLSAVNRPDIPG

SEQ ID NO: 79583 - protein, 20 aa, Mycobacterium avium
FAASSRFGGIVSPPVMLQTW

SEQ ID NO: 79584 - protein, 32 aa, Mycobacterium avium
FAAVRQFRASVCVLGPLVGRCKRARVALPGGD

SEQ ID NO: 79585 - protein, 26 aa, Mycobacterium avium
FADDGIGVNCLWPQTYIATAAVANMA

SEQ ID NO: 79586 - protein, 18 aa, Mycobacterium avium
FAELEPDFQRAYKELAKQ

SEQ ID NO: 79587 - protein, 22 aa, Mycobacterium avium
FAELLAIVSAMVCNRIDKVTVN

SEQ ID NO: 79588 - protein, 24 aa, Mycobacterium avium
FAELRYRPGDVLMFGPEPTGLDAA

SEQ ID NO: 79589 - protein, 18 aa, Mycobacterium avium
FAEQGWYFAGDSAYYDRD

SEQ ID NO: 79590 - protein, 18 aa, Mycobacterium avium
FAGAALFAAFSMVTHAGQ

SEQ ID NO: 79591 - protein, 17 aa, Mycobacterium avium
FAGGPWSNYVMHSIATM

SEQ ID NO: 79592 - protein, 26 aa, Mycobacterium avium
FAGPVLRPSTTLVRRSRGFAEASADS

SEQ ID NO: 79593 - protein, 25 aa, Mycobacterium avium
FAHKKIAGPGIEWYIMPGSDKPMRR

SEQ ID NO: 79594 - protein, 19 aa, Mycobacterium avium
FAICCATILDMGSEQQKRT

SEQ ID NO: 79595 - protein, 21 aa, Mycobacterium avium
FAIELGRLGGLGVLNGEGLIG

SEQ ID NO: 79596 - protein, 24 aa, Mycobacterium avium
FAKLREPLEVPGLLDVQIDSFEWL

SEQ ID NO: 79597 - protein, 26 aa, Mycobacterium avium
FAKNMLPRLSGLRGIIEAIDDEIMKL

SEQ ID NO: 79598 - protein, 20 aa, Mycobacterium avium
FAKRMVGSAAAVYAHNDPVM

SEQ ID NO: 79599 - protein, 27 aa, Mycobacterium avium
FALDRGGGLPAALVLAEAVSWQGRGEE

SEQ ID NO: 79600 - protein, 23 aa, Mycobacterium avium
FALEKRRLFARAWTFVGHESEIP

SEQ ID NO: 79601 - protein, 17 aa, Mycobacterium avium
FALELVESVVGEDQVDA

SEQ ID NO: 79602 - protein, 20 aa, Mycobacterium avium
FALIARRHMHVYGTTREQLS

SEQ ID NO: 79603 - protein, 23 aa, Mycobacterium avium
FALMCGDLSAPVTFAVDRTGWAP

SEQ ID NO: 79604 - protein, 17 aa, Mycobacterium avium
FALPPGFPEEMKADFTR

SEQ ID NO: 79605 - protein, 20 aa, Mycobacterium avium
FALSTLRDIYGAALGYQVDA

SEQ ID NO: 79606 - protein, 24 aa, Mycobacterium avium
FAPGPGRRLGVLVDHLVPGSKEAR

SEQ ID NO: 79607 - protein, 19 aa, Mycobacterium avium
FAPITRWAAGIPTARAIPE

SEQ ID NO: 79608 - protein, 23 aa, Mycobacterium avium
FAPPTLHAMGIRVATSFPSFSKR

SEQ ID NO: 79609 - protein, 17 aa, Mycobacterium avium
FAPRRPRTGPAELLYLG

SEQ ID NO: 79610 - protein, 19 aa, Mycobacterium avium
FAPVSAESLFSWLATAEDG

SEQ ID NO: 79611 - protein, 20 aa, Mycobacterium avium
FARIDARAAAPLAAVSVPGT

SEQ ID NO: 79612 - protein, 17 aa, Mycobacterium avium
FARLCKAMGRAELATDE

SEQ ID NO: 79613 - protein, 23 aa, Mycobacterium avium
FASRLPLYFPTPLRHRFTPEIRA

SEQ ID NO: 79614 - protein, 24 aa, Mycobacterium avium
FATELRNLLARCAERGVDPQALER

SEQ ID NO: 79615 - protein, 18 aa, Mycobacterium avium
FAVAWEWENTALISELVE

SEQ ID NO: 79616 - protein, 22 aa, Mycobacterium avium
FAVLEPRADGFRNFARPGEKAP

SEQ ID NO: 79617 - protein, 17 aa, Mycobacterium avium
FAVPRIVASAPKVVIQE

SEQ ID NO: 79618 - protein, 18 aa, Mycobacterium avium
FAVVEFVVSPLFGSPPEA

SEQ ID NO: 79619 - protein, 17 aa, Mycobacterium avium
FAYQKSMLINVGDEKGL

SEQ ID NO: 79620 - protein, 22 aa, Mycobacterium avium
FCDAMIAIRGEIDRVGAGEWPV

SEQ ID NO: 79621 - protein, 24 aa, Mycobacterium avium
FCEKVDVVCGIGWDNVDSDNPAFR

SEQ ID NO: 79622 - protein, 25 aa, Mycobacterium avium
FCIPAVEAKGSLLLEDVGVPLPALG

SEQ ID NO: 79623 - protein, 20 aa, Mycobacterium avium
FCVTRCGYCDFNTYTPAELG

SEQ ID NO: 79624 - protein, 19 aa, Mycobacterium avium
FDAALVLDVIERFRITNFT

SEQ ID NO: 79625 - protein, 18 aa, Mycobacterium avium
FDAKLGRGPAVTVEDDLL

SEQ ID NO: 79626 - protein, 20 aa, Mycobacterium avium
FDALCAHLATMHPSRYLTLI

SEQ ID NO: 79627 - protein, 19 aa, Mycobacterium avium
FDASRPAVWSAEGLVRYLP

SEQ ID NO: 79628 - protein, 26 aa, Mycobacterium avium
FDCPGHPSFSLLRAGATAGFTVVALD

SEQ ID NO: 79629 - protein, 25 aa, Mycobacterium avium
FDCRDPARLAGWWAEQFGGTTHDIL

SEQ ID NO: 79630 - protein, 18 aa, Mycobacterium avium
FDDAGAIGRRYRRQDEIG

SEQ ID NO: 79631 - protein, 19 aa, Mycobacterium avium
FDDARPVLERASARETAAR

SEQ ID NO: 79632 - protein, 25 aa, Mycobacterium avium
FDDLEWIKARWPGKLVVKGIQTLDD

SEQ ID NO: 79633 - protein, 26 aa, Mycobacterium avium
FDDLLIELDIHFRIEDDLYYPALKEA

SEQ ID NO: 79634 - protein, 18 aa, Mycobacterium avium
FDEGFKLVKVNPMATWTD

SEQ ID NO: 79635 - protein, 25 aa, Mycobacterium avium
FDGEAAELMWRYYLGPTVGSAAAVP

SEQ ID NO: 79636 - protein, 19 aa, Mycobacterium avium
FDGRGAWADGPEAIRGYLE

SEQ ID NO: 79637 - protein, 17 aa, Mycobacterium avium
FDHGKALALYHTKRLAS

SEQ ID NO: 79638 - protein, 18 aa, Mycobacterium avium
FDHPGVPFVLRIKEGYAI

SEQ ID NO: 79639 - protein, 18 aa, Mycobacterium avium
FDKDRDGFVFGEAGALML

SEQ ID NO: 79640 - protein, 25 aa, Mycobacterium avium
FDLAARKRLPVVLFAEGGGGRPGDT

SEQ ID NO: 79641 - protein, 17 aa, Mycobacterium avium
FDLCAMVGHPEWIDEDS

SEQ ID NO: 79642 - protein, 17 aa, Mycobacterium avium
FDLLRRHSQALNIKLAE

SEQ ID NO: 79643 - protein, 17 aa, Mycobacterium avium
FDLPGPKPFGHFMVVEL

SEQ ID NO: 79644 - protein, 19 aa, Mycobacterium avium
FDNELIPIAGLATDEFIRP

SEQ ID NO: 79645 - protein, 18 aa, Mycobacterium avium
FDPARARVTGVWLDPVAG

SEQ ID NO: 79646 - protein, 25 aa, Mycobacterium avium
FDPRRIDTELGWAQFYGHNTARVFL

SEQ ID NO: 79647 - protein, 24 aa, Mycobacterium avium
FDPRRIDTELGWARRNGFNAVRVF

SEQ ID NO: 79648 - protein, 24 aa, Mycobacterium avium
FDPSRAMPAYNWMTVAKSALESVN

SEQ ID NO: 79649 - protein, 22 aa, Mycobacterium avium
FDSILGRLPYDVSLEGEDTIVV

SEQ ID NO: 79650 - protein, 24 aa, Mycobacterium avium
FDSMLIKLTCRGRDFPTAVRRARR

SEQ ID NO: 79651 - protein, 19 aa, Mycobacterium avium
FEAAQVCRWLLTSRLELIE

SEQ ID NO: 79652 - protein, 17 aa, Mycobacterium avium
FEALSALSAGVKDVRAV

SEQ ID NO: 79653 - protein, 25 aa, Mycobacterium avium
FEAMTIDCPEEFVGAITQLMAARKG

SEQ ID NO: 79654 - protein, 24 aa, Mycobacterium avium
FEARFRFVEEMIRLGADARTDGHH

SEQ ID NO: 79655 - protein, 28 aa, Mycobacterium avium
FEASVPPGRLGWGWAKFAFNGWKTLSWV

SEQ ID NO: 79656 - protein, 26 aa, Mycobacterium avium
FEAVGACARGLMPREDVDAIERAICP

SEQ ID NO: 79657 - protein, 19 aa, Mycobacterium avium
FEEACAVLTSLLSQETTDF

SEQ ID NO: 79658 - protein, 20 aa, Mycobacterium avium
FEEIKRFWNPTTGYDLRGVS

SEQ ID NO: 79659 - protein, 17 aa, Mycobacterium avium
FEEIQIPVGPRLGNVVV

SEQ ID NO: 79660 - protein, 23 aa, Mycobacterium avium
FEESKEWYSMWGVDDSPQPATYD

SEQ ID NO: 79661 - protein, 21 aa, Mycobacterium avium
FEETHPLWIVRRTMLDLIRPI

SEQ ID NO: 79662 - protein, 21 aa, Mycobacterium avium
FEFPTRIISTLLGLPAEDLDL

SEQ ID NO: 79663 - protein, 27 aa, Mycobacterium avium
FEGELAVVIGRPCKDVSAAQAAENILG

SEQ ID NO: 79664 - protein, 18 aa, Mycobacterium avium
FEGLMVEQLEIFNAEDRF

SEQ ID NO: 79665 - protein, 18 aa, Mycobacterium avium
FEGPVHRANFDAVDSSPV

SEQ ID NO: 79666 - protein, 17 aa, Mycobacterium avium
FEGTSFGGALMTTTEVE

SEQ ID NO: 79667 - protein, 21 aa, Mycobacterium avium
FEGVMMPELFMADAVGATGKP

SEQ ID NO: 79668 - protein, 18 aa, Mycobacterium avium
FEGWRARKNGQRFRAGVA

SEQ ID NO: 79669 - protein, 24 aa, Mycobacterium avium
FEIERRLIEALDCPVMHDDQHGTA

SEQ ID NO: 79670 - protein, 24 aa, Mycobacterium avium
FEIKEFKSGAARMAVEAGVPIVPH

SEQ ID NO: 79671 - protein, 31 aa, Mycobacterium avium
FEKEAWLSMVMLEWGCCGQVATAIPDERSQA

SEQ ID NO: 79672 - protein, 25 aa, Mycobacterium avium
FEKRWAGVQAHNRWQVDFCSLAPDR

SEQ ID NO: 79673 - protein, 30 aa, Mycobacterium avium
FELAELVSRVGAVLRRRGRLPQVIQVGDVT

SEQ ID NO: 79674 - protein, 19 aa, Mycobacterium avium
FELHEELIVAVGLTRQEAA

SEQ ID NO: 79675 - protein, 18 aa, Mycobacterium avium
FELLRFLMRNPRRALSRT

SEQ ID NO: 79676 - protein, 17 aa, Mycobacterium avium
FENAIAVVMAFGGSTNA

SEQ ID NO: 79677 - protein, 25 aa, Mycobacterium avium
FENFPDLRLTAAPQRRSLINLHGYT

SEQ ID NO: 79678 - protein, 19 aa, Mycobacterium avium
FEPKPDWKNPFSYQPEIWD

SEQ ID NO: 79679 - protein, 17 aa, Mycobacterium avium
FEPNNDWTHFFAEQYEL

SEQ ID NO: 79680 - protein, 20 aa, Mycobacterium avium
FEPRYGALVRHCLDTGEQFG

SEQ ID NO: 79681 - protein, 18 aa, Mycobacterium avium
FEPTLDYVVVKAPRFAFE

SEQ ID NO: 79682 - protein, 21 aa, Mycobacterium avium
FEQHLRAVLDYPLGDTDALAP

SEQ ID NO: 79683 - protein, 24 aa, Mycobacterium avium
FESEAIPTLPPVPGIDLYDYGHRL

SEQ ID NO: 79684 - protein, 19 aa, Mycobacterium avium
FESHCGWPSFYDPANSDAV

SEQ ID NO: 79685 - protein, 22 aa, Mycobacterium avium
FESPKLLMLSGIGPGRELAKHG

SEQ ID NO: 79686 - protein, 22 aa, Mycobacterium avium
FEVNEAFAPVPLAWLAETGADA

SEQ ID NO: 79687 - protein, 20 aa, Mycobacterium avium
FEYDFRMLLGQRHGGQPWSD

SEQ ID NO: 79688 - protein, 20 aa, Mycobacterium avium
FFFLRPKDIAIYVGSGELDF

SEQ ID NO: 79689 - protein, 21 aa, Mycobacterium avium
FFGDRRKAFLEDLAIVTGGQV

SEQ ID NO: 79690 - protein, 29 aa, Mycobacterium avium
FFLHIPFPPVELFMQLPWRTEIVKGLLGA

SEQ ID NO: 79691 - protein, 23 aa, Mycobacterium avium
FFNNYRPQFYFRTTDVTGVVTLP

SEQ ID NO: 79692 - protein, 23 aa, Mycobacterium avium
FFRELPELAVRWQAETFPELRLL

SEQ ID NO: 79693 - protein, 19 aa, Mycobacterium avium
FFTPLLRNLGHCARVVVVG

SEQ ID NO: 79694 - protein, 17 aa, Mycobacterium avium
FFVHDPFTLEPYSRDPR

SEQ ID NO: 79695 - protein, 22 aa, Mycobacterium avium
FGACLNRELGRFIDAVRADIDF

SEQ ID NO: 79696 - protein, 22 aa, Mycobacterium avium
FGAEGWRPGLHRLTDGLINDAR

SEQ ID NO: 79697 - protein, 19 aa, Mycobacterium avium
FGAKHADALFTLHGSLEAG

SEQ ID NO: 79698 - protein, 17 aa, Mycobacterium avium
FGALLGEAWTEKKRMSP

SEQ ID NO: 79699 - protein, 20 aa, Mycobacterium avium
FGAWEGLTFGEAAERDPGLH

SEQ ID NO: 79700 - protein, 19 aa, Mycobacterium avium
FGDAGTFELTYQIGLENMR

SEQ ID NO: 79701 - protein, 21 aa, Mycobacterium avium
FGDKVLPLYLPTGLPACTGLI

SEQ ID NO: 79702 - protein, 25 aa, Mycobacterium avium
FGDYFKREAIELAWTLLTGSVEQGG

SEQ ID NO: 79703 - protein, 19 aa, Mycobacterium avium
FGEFKGWAKAQGRHSNIGY

SEQ ID NO: 79704 - protein, 25 aa, Mycobacterium avium
FGEGPRWFEGLLWFSDMLGEAVHTT

SEQ ID NO: 79705 - protein, 31 aa, Mycobacterium avium
FGFATAPLVVSGCIMMRVCHLDTCPVGVATQ

SEQ ID NO: 79706 - protein, 26 aa, Mycobacterium avium
FGFSPLRLPPDLDFTALFHGVDERVP

SEQ ID NO: 79707 - protein, 18 aa, Mycobacterium avium
FGGEVERGLSMVDGVLLL

SEQ ID NO: 79708 - protein, 19 aa, Mycobacterium avium
FGGFAARVRGGDVDIAVTG

SEQ ID NO: 79709 - protein, 17 aa, Mycobacterium avium
FGGGFQHWGEAMMTDGR

SEQ ID NO: 79710 - protein, 19 aa, Mycobacterium avium
FGGPPAVGALLLRRDVACV

SEQ ID NO: 79711 - protein, 25 aa, Mycobacterium avium
FGGRLPELFCGFPRSQFASPVPYPT

SEQ ID NO: 79712 - protein, 18 aa, Mycobacterium avium
FGIEPDLAEALVCAAARE

SEQ ID NO: 79713 - protein, 26 aa, Mycobacterium avium
FGINGEATFDYGAAFDRSRKVAEGRV

SEQ ID NO: 79714 - protein, 23 aa, Mycobacterium avium
FGIPEVKRGLVAGGGGLLRLPQR

SEQ ID NO: 79715 - protein, 25 aa, Mycobacterium avium
FGKHHRIGFPFTWITNAATDPAASL

SEQ ID NO: 79716 - protein, 17 aa, Mycobacterium avium
FGLGCVAGAAGVARMHD

SEQ ID NO: 79717 - protein, 18 aa, Mycobacterium avium
FGLGCVAGAAGVARMHDY

SEQ ID NO: 79718 - protein, 26 aa, Mycobacterium avium
FGLIPEFIGRLPVVASVTNLDRESLV

SEQ ID NO: 79719 - protein, 26 aa, Mycobacterium avium
FGNDARLLADLSFDAVVLLINGVPKL

SEQ ID NO: 79720 - protein, 18 aa, Mycobacterium avium
FGNIIRLLPPLTISDELL

SEQ ID NO: 79721 - protein, 24 aa, Mycobacterium avium
FGPACPQPVFPNMPLDLGAPQGED

SEQ ID NO: 79722 - protein, 19 aa, Mycobacterium avium
FGPEVKRRIMIGTYALSAG

SEQ ID NO: 79723 - protein, 17 aa, Mycobacterium avium
FGPGNRAPLSFPMAGWN

SEQ ID NO: 79724 - protein, 25 aa, Mycobacterium avium
FGPVARGGLRWSDRRDDFRTEILGL

SEQ ID NO: 79725 - protein, 26 aa, Mycobacterium avium
FGQPEIKLGVLPGMGGSQRLTRAIGK

SEQ ID NO: 79726 - protein, 25 aa, Mycobacterium avium
FGRRVAVVVCEFGFLGGSIGVAAAE

SEQ ID NO: 79727 - protein, 21 aa, Mycobacterium avium
FGRTGGVEGLHEFLQVKNIRI

SEQ ID NO: 79728 - protein, 19 aa, Mycobacterium avium
FGSATPMVMEEAGAVGMPG

SEQ ID NO: 79729 - protein, 18 aa, Mycobacterium avium
FGSLQAYLRDAGVGEADV

SEQ ID NO: 79730 - protein, 24 aa, Mycobacterium avium
FGSPTRFGSPAAQLRAFLDSLGGL

SEQ ID NO: 79731 - protein, 29 aa, Mycobacterium avium
FGSSSFRYAGPAGRDWKIADLAGKRIATA

SEQ ID NO: 79732 - protein, 17 aa, Mycobacterium avium
FGTPEFIDRIVTGGVNQ

SEQ ID NO: 79733 - protein, 32 aa, Mycobacterium avium
FGTPNFTGRSWPLADVRLLAPILASKVVCVGK

SEQ ID NO: 79734 - protein, 24 aa, Mycobacterium avium
FGTPSGRGGAAFLSRVPPNQLPDL

SEQ ID NO: 79735 - protein, 26 aa, Mycobacterium avium
FGTTQRFGVPMGFGGPHAGYLAVHAN

SEQ ID NO: 79736 - protein, 28 aa, Mycobacterium avium
FGVPPPDVIRRLGALGLLVMVTVTSAYE

SEQ ID NO: 79737 - protein, 22 aa, Mycobacterium avium
FGVSRITVRRALADLAAQGYIE

SEQ ID NO: 79738 - protein, 23 aa, Mycobacterium avium
FGWTGPFAQRAATEFTLQAWAGS

SEQ ID NO: 79739 - protein, 26 aa, Mycobacterium avium
FHAALEFWSALHGFVLLEMTGVMDDI

SEQ ID NO: 79740 - protein, 19 aa, Mycobacterium avium
FHAMYPRIDEWIAVRRKVD

SEQ ID NO: 79741 - protein, 21 aa, Mycobacterium avium
FHDRFTASRLFGAPPGYVGYE

SEQ ID NO: 79742 - protein, 23 aa, Mycobacterium avium
FHEAANMAALWDLPIVFVCQNNR

SEQ ID NO: 79743 - protein, 25 aa, Mycobacterium avium
FHLRNRLVVAALHWDGDITGLVRSH

SEQ ID NO: 79744 - protein, 20 aa, Mycobacterium avium
FHNTRGCGLASAYAAVGAGV

SEQ ID NO: 79745 - protein, 18 aa, Mycobacterium avium
FHVDLLWLLEIGSNQKIA

SEQ ID NO: 79746 - protein, 18 aa, Mycobacterium avium
FHVTGFTSAVGVAALAAE

SEQ ID NO: 79747 - protein, 19 aa, Mycobacterium avium
FIDLLKAMRPGLTTPLRLA

SEQ ID NO: 79748 - protein, 26 aa, Mycobacterium avium
FIEHLDALGFDEVWLGEHHSAGSEII

SEQ ID NO: 79749 - protein, 23 aa, Mycobacterium avium
FIEQRPQLLTARSSADRGTKILN

SEQ ID NO: 79750 - protein, 17 aa, Mycobacterium avium
FIETFVLTSALGAVTSK

SEQ ID NO: 79751 - protein, 17 aa, Mycobacterium avium
FIRLSRLGLSFGGESPV

SEQ ID NO: 79752 - protein, 17 aa, Mycobacterium avium
FKAHKRSGAEIVSGRLA

SEQ ID NO: 79753 - protein, 25 aa, Mycobacterium avium
FKEGERLWISWAMANRDPAVFHDPD

SEQ ID NO: 79754 - protein, 19 aa, Mycobacterium avium
FKGDERWRNLPTPSGNTFE

SEQ ID NO: 79755 - protein, 20 aa, Mycobacterium avium
FKHVAEMFAELEASALRSYP

SEQ ID NO: 79756 - protein, 19 aa, Mycobacterium avium
FKLSGDFDPAQVIKHGNDD

SEQ ID NO: 79757 - protein, 21 aa, Mycobacterium avium
FKMAAELAYLEFGDLIDSLVA

SEQ ID NO: 79758 - protein, 27 aa, Mycobacterium avium
FKPLYGSSLVTGWARLHGYPIGILANA

SEQ ID NO: 79759 - protein, 21 aa, Mycobacterium avium
FKQFEEWDVCIVPREKLQLTP

SEQ ID NO: 79760 - protein, 22 aa, Mycobacterium avium
FKSKEAVVLSLLEPVIARADAE

SEQ ID NO: 79761 - protein, 24 aa, Mycobacterium avium
FKVDKPGTVAITFTPADGSEPIVH

SEQ ID NO: 79762 - protein, 25 aa, Mycobacterium avium
FKVLLKELQSLCLNVEVLSSDGAAI

SEQ ID NO: 79763 - protein, 25 aa, Mycobacterium avium
FLAASGFPINLIGVLAQLQTASGFQ

SEQ ID NO: 79764 - protein, 18 aa, Mycobacterium avium
FLAEGLRLREHRGKIHDL

SEQ ID NO: 79765 - protein, 26 aa, Mycobacterium avium
FLAHLPGYQGWQWAVVVAAYPGADHA

SEQ ID NO: 79766 - protein, 32 aa, Mycobacterium avium
FLAIAGRRVQLEIFTKFSIPINIARVIHRDQK

SEQ ID NO: 79767 - protein, 21 aa, Mycobacterium avium
FLDGKEFIETFVLTSALGAVT

SEQ ID NO: 79768 - protein, 18 aa, Mycobacterium avium
FLDGLAWRLREQGVNGIS

SEQ ID NO: 79769 - protein, 25 aa, Mycobacterium avium
FLDHIVAHPRLRWVGNANELNAGYA

SEQ ID NO: 79770 - protein, 18 aa, Mycobacterium avium
FLEGCGRTDFPGGDSDEM

SEQ ID NO: 79771 - protein, 20 aa, Mycobacterium avium
FLEGRLARHAVYPTMGPEPQ

SEQ ID NO: 79772 - protein, 18 aa, Mycobacterium avium
FLELAAIRTKAVRQGDPL

SEQ ID NO: 79773 - protein, 18 aa, Mycobacterium avium
FLELLAVDIEKLGAKIAA

SEQ ID NO: 79774 - protein, 24 aa, Mycobacterium avium
FLESLRYDLAVQEIFVFTPKGDVI

SEQ ID NO: 79775 - protein, 18 aa, Mycobacterium avium
FLGAPYWVGRGFGLNLSV

SEQ ID NO: 79776 - protein, 18 aa, Mycobacterium avium
FLGGPVIKDGRPVDFGSF

SEQ ID NO: 79777 - protein, 18 aa, Mycobacterium avium
FLGPMITALEGYPFDKMT

SEQ ID NO: 79778 - protein, 17 aa, Mycobacterium avium
FLGPMITGLDGYPFDKL

SEQ ID NO: 79779 - protein, 18 aa, Mycobacterium avium
FLIAGAGAGLARRVDDTD

SEQ ID NO: 79780 - protein, 18 aa, Mycobacterium avium
FLIMPKLIPALIAGCTVI

SEQ ID NO: 79781 - protein, 18 aa, Mycobacterium avium
FLKRVRKVVDDEFPGRVL

SEQ ID NO: 79782 - protein, 24 aa, Mycobacterium avium
FLKSKLRTGGLLLNHCITRHDNTS

SEQ ID NO: 79783 - protein, 20 aa, Mycobacterium avium
FLLNTGRLPHQWHTMTKTGK

SEQ ID NO: 79784 - protein, 17 aa, Mycobacterium avium
FLLQGGDCAETFTENTE

SEQ ID NO: 79785 - protein, 18 aa, Mycobacterium avium
FLLQRPLLTAIRRTEPTV

SEQ ID NO: 79786 - protein, 25 aa, Mycobacterium avium
FLMSVGDLIIGWLLQRQAAVAVAAL

SEQ ID NO: 79787 - protein, 18 aa, Mycobacterium avium
FLPAMARHLLSETLLLPS

SEQ ID NO: 79788 - protein, 25 aa, Mycobacterium avium
FLPDLGLRRENIVFISGIGCSSRFP

SEQ ID NO: 79789 - protein, 21 aa, Mycobacterium avium
FLRAADLARAITFVAETPRGG

SEQ ID NO: 79790 - protein, 23 aa, Mycobacterium avium
FLRDLEKCWSLLLTGILQPDRTE

SEQ ID NO: 79791 - protein, 25 aa, Mycobacterium avium
FLTPDGRPFFCGTYYPKDAFLQLLS

SEQ ID NO: 79792 - protein, 19 aa, Mycobacterium avium
FLTRMLARMVPHPDRVDVI

SEQ ID NO: 79793 - protein, 18 aa, Mycobacterium avium
FMAKYGKATPEALVESAL

SEQ ID NO: 79794 - protein, 18 aa, Mycobacterium avium
FMATRTAFFDEFFLAAAD

SEQ ID NO: 79795 - protein, 27 aa, Mycobacterium avium
FMEVAKLRAGRLLWSELVSQFNPKNPK

SEQ ID NO: 79796 - protein, 17 aa, Mycobacterium avium
FMRHDYVNFGFDHADAV

SEQ ID NO: 79797 - protein, 27 aa, Mycobacterium avium
FMSSTARLKCPFTSLGVAPEAASSYLL

SEQ ID NO: 79798 - protein, 24 aa, Mycobacterium avium
FMTIAKFRAARTVWARVAEVVGEP

SEQ ID NO: 79799 - protein, 28 aa, Mycobacterium avium
FNAFPASYWRRWSICESVVLKVELTGTG

SEQ ID NO: 79800 - protein, 26 aa, Mycobacterium avium
FNQASGRIKLAWFLLNAARYMPVLVY

SEQ ID NO: 79801 - protein, 17 aa, Mycobacterium avium
FNSLPFTLGMKEPAEGF

SEQ ID NO: 79802 - protein, 26 aa, Mycobacterium avium
FPDQMLAYNCSPSFNWKKHLDDATIA

SEQ ID NO: 79803 - protein, 18 aa, Mycobacterium avium
FPDRPALELDGWATPRPL

SEQ ID NO: 79804 - protein, 23 aa, Mycobacterium avium
FPESYNRRALMRFVTSVKSGSDY

SEQ ID NO: 79805 - protein, 19 aa, Mycobacterium avium
FPGCAVVISHDRWFLDRTC

SEQ ID NO: 79806 - protein, 17 aa, Mycobacterium avium
FPGGVLGVALNLDEHSV

SEQ ID NO: 79807 - protein, 17 aa, Mycobacterium avium
FPGLDTFAGQVYHTAAW

SEQ ID NO: 79808 - protein, 26 aa, Mycobacterium avium
FPGLRWGVTECGAFWANDLLWLMDTR

SEQ ID NO: 79809 - protein, 33 aa, Mycobacterium avium
FPKASVMTHLRWLKALAAFGGIGLRLKSSDTLY

SEQ ID NO: 79810 - protein, 24 aa, Mycobacterium avium
FPKSRTSILAAHRAGVKIAVGTDA

SEQ ID NO: 79811 - protein, 19 aa, Mycobacterium avium
FPLGSAFPGLPKVTDNAVV

SEQ ID NO: 79812 - protein, 20 aa, Mycobacterium avium
FPLKGERLSRREARRRCIEL

SEQ ID NO: 79813 - protein, 17 aa, Mycobacterium avium
FPLMPRIFMAVRRESRF

SEQ ID NO: 79814 - protein, 21 aa, Mycobacterium avium
FPNLFTVFGPYGYVGSSYFAL

SEQ ID NO: 79815 - protein, 19 aa, Mycobacterium avium
FPPAGTLTGIAKRELRGVS

SEQ ID NO: 79816 - protein, 17 aa, Mycobacterium avium
FPPERITFHGNNKSVAE

SEQ ID NO: 79817 - protein, 21 aa, Mycobacterium avium
FPRIGHLPYLLTLPGHGFYWF

SEQ ID NO: 79818 - protein, 18 aa, Mycobacterium avium
FPSACGKTNLAMLQPTIP

SEQ ID NO: 79819 - protein, 19 aa, Mycobacterium avium
FPTRVIARLLGLPDEDLPM

SEQ ID NO: 79820 - protein, 25 aa, Mycobacterium avium
FPVIRRYALAYHVVFIPPAEVDRRG

SEQ ID NO: 79821 - protein, 21 aa, Mycobacterium avium
FPWTERRQGVLGEVHLHRAPV

SEQ ID NO: 79822 - protein, 24 aa, Mycobacterium avium
FQAEARQLLDLMVHSVYSNKDSFL

SEQ ID NO: 79823 - protein, 27 aa, Mycobacterium avium
FQLEIGRAHTPWFHWGTTAVVARLVKQ

SEQ ID NO: 79824 - protein, 20 aa, Mycobacterium avium
FQLGSLWYISLDYINHQTSL

SEQ ID NO: 79825 - protein, 23 aa, Mycobacterium avium
FQMMGLCQMLRDGVIPPNRSLDC

SEQ ID NO: 79826 - protein, 25 aa, Mycobacterium avium
FQMPGGIYAPMIHPWSSGRDLYFNL

SEQ ID NO: 79827 - protein, 23 aa, Mycobacterium avium
FQRCAPETRIWWGAYLGTADELL

SEQ ID NO: 79828 - protein, 20 aa, Mycobacterium avium
FQRRVWRALQTIPYGETRSY

SEQ ID NO: 79829 - protein, 18 aa, Mycobacterium avium
FQTITGGAVFAYWVANPS

SEQ ID NO: 79830 - protein, 19 aa, Mycobacterium avium
FQYAKTWRTLAKLSLPNKY

SEQ ID NO: 79831 - protein, 17 aa, Mycobacterium avium
FRAGVNVGVDITADQLR

SEQ ID NO: 79832 - protein, 23 aa, Mycobacterium avium
FRDELAMTFPQWRTQVRLQHALV

SEQ ID NO: 79833 - protein, 17 aa, Mycobacterium avium
FRDELRTIYTTKIPEEL

SEQ ID NO: 79834 - protein, 27 aa, Mycobacterium avium
FRDYSWGMRVPRRLRELHVQISRTTAD

SEQ ID NO: 79835 - protein, 19 aa, Mycobacterium avium
FREGVGFTGVVLTKLDGDA

SEQ ID NO: 79836 - protein, 21 aa, Mycobacterium avium
FREVEELAARFGVLKSGVAAG

SEQ ID NO: 79837 - protein, 21 aa, Mycobacterium avium
FRFDLAATLARELHDVDRLSA

SEQ ID NO: 79838 - protein, 19 aa, Mycobacterium avium
FRFSEAVSFTVHCKDQDEV

SEQ ID NO: 79839 - protein, 19 aa, Mycobacterium avium
FRFVECSRLVDGRPDGDIT

SEQ ID NO: 79840 - protein, 17 aa, Mycobacterium avium
FRGSELIAEKWNLSREE

SEQ ID NO: 79841 - protein, 17 aa, Mycobacterium avium
FRIEDDLYYPALKEASK

SEQ ID NO: 79842 - protein, 21 aa, Mycobacterium avium
FRLGARARHTAVAEVAFTVRR

SEQ ID NO: 79843 - protein, 22 aa, Mycobacterium avium
FRMAYDVLPPGGIMLLHTIVRP

SEQ ID NO: 79844 - protein, 26 aa, Mycobacterium avium
FRPGTLEKWNLGYDVLCERNPGIILV

SEQ ID NO: 79845 - protein, 18 aa, Mycobacterium avium
FRQFSFPGGIPSHVAAQT

SEQ ID NO: 79846 - protein, 19 aa, Mycobacterium avium
FRSGDGWLDATLQGLDQNR

SEQ ID NO: 79847 - protein, 19 aa, Mycobacterium avium
FRTGRWPDVLNQFPEGKGW

SEQ ID NO: 79848 - protein, 17 aa, Mycobacterium avium
FRVWGSSDLRRWLPLDI

SEQ ID NO: 79849 - protein, 17 aa, Mycobacterium avium
FRYNTIITEETTRGRYS

SEQ ID NO: 79850 - protein, 17 aa, Mycobacterium avium
FSAIKVGANLVRTDERI

SEQ ID NO: 79851 - protein, 19 aa, Mycobacterium avium
FSAVTLRPDAVPDFVGGIY

SEQ ID NO: 79852 - protein, 24 aa, Mycobacterium avium
FSDEFRIQLAWMRLSPPTANPGWS

SEQ ID NO: 79853 - protein, 18 aa, Mycobacterium avium
FSDHAEWVLPTDWPVAPG

SEQ ID NO: 79854 - protein, 18 aa, Mycobacterium avium
FSDVVGVRMGMPGVEYYA

SEQ ID NO: 79855 - protein, 20 aa, Mycobacterium avium
FSEHSGHLLAGTALSVISGR

SEQ ID NO: 79856 - protein, 23 aa, Mycobacterium avium
FSEKWCGGMLPDVGKLVELARAL

SEQ ID NO: 79857 - protein, 24 aa, Mycobacterium avium
FSEPCTDCRGSGSIIEHPCDECKG

SEQ ID NO: 79858 - protein, 25 aa, Mycobacterium avium
FSEPCTLREPAFAILDSHRIDYEIA

SEQ ID NO: 79859 - protein, 17 aa, Mycobacterium avium
FSGDGFLRNLEVVAQLQ

SEQ ID NO: 79860 - protein, 22 aa, Mycobacterium avium
FSGEVYFTAAWPREDPDLRGKR

SEQ ID NO: 79861 - protein, 18 aa, Mycobacterium avium
FSGRVSDSGEGRWTSIAA

SEQ ID NO: 79862 - protein, 24 aa, Mycobacterium avium
FSHGGSLKSSWYGDCLPERDFPTL

SEQ ID NO: 79863 - protein, 17 aa, Mycobacterium avium
FSHGRDWGSPKIPEEMN

SEQ ID NO: 79864 - protein, 20 aa, Mycobacterium avium
FSHPQSQYFVVGRLAQDQVA

SEQ ID NO: 79865 - protein, 23 aa, Mycobacterium avium
FSKAYGLAGLRIGYGVASPRLAR

SEQ ID NO: 79866 - protein, 17 aa, Mycobacterium avium
FSLASGAGRTELQTLLA

SEQ ID NO: 79867 - protein, 26 aa, Mycobacterium avium
FSLASGRIAYALGVHGPALTVDTACS

SEQ ID NO: 79868 - protein, 17 aa, Mycobacterium avium
FSLCMDNGMPILVFNLL

SEQ ID NO: 79869 - protein, 18 aa, Mycobacterium avium
FSLHYPWSQQLPVHSLDG

SEQ ID NO: 79870 - protein, 21 aa, Mycobacterium avium
FSQFKRSALPNGPKVSHGGAL

SEQ ID NO: 79871 - protein, 22 aa, Mycobacterium avium
FSQPSPQPGVHWSKDVRLDKVA

SEQ ID NO: 79872 - protein, 23 aa, Mycobacterium avium
FSRADAGAGWLLHAEGVLRAGSA

SEQ ID NO: 79873 - protein, 17 aa, Mycobacterium avium
FSRISDVLLPFLVTRQL

SEQ ID NO: 79874 - protein, 24 aa, Mycobacterium avium
FSRMADGQIKACWIICTNPVASVA

SEQ ID NO: 79875 - protein, 21 aa, Mycobacterium avium
FSSADPRRGRVLFTDARTNPV

SEQ ID NO: 79876 - protein, 30 aa, Mycobacterium avium
FSSDAAMARRCVDAGWLLSLSGTVSFRNAR

SEQ ID NO: 79877 - protein, 19 aa, Mycobacterium avium
FSSDRARSASSPGADAELV

SEQ ID NO: 79878 - protein, 18 aa, Mycobacterium avium
FSSELPFALDGFQRRACA

SEQ ID NO: 79879 - protein, 19 aa, Mycobacterium avium
FSSKFAAAVAKNPFVGDPV

SEQ ID NO: 79880 - protein, 17 aa, Mycobacterium avium
FSVERYRAVMDAYLAGM

SEQ ID NO: 79881 - protein, 19 aa, Mycobacterium avium
FTAAGAEWRQAGCSMCLGM

SEQ ID NO: 79882 - protein, 21 aa, Mycobacterium avium
FTDQMRWLFGQLIGDRPRWSP

SEQ ID NO: 79883 - protein, 19 aa, Mycobacterium avium
FTETWKDSLSIGWQGNGAE

SEQ ID NO: 79884 - protein, 28 aa, Mycobacterium avium
FTFMTPAAFVRRPGRWIREMARKPDDAP

SEQ ID NO: 79885 - protein, 26 aa, Mycobacterium avium
FTFRGCEGDALLMLLDANGIECSTGS

SEQ ID NO: 79886 - protein, 17 aa, Mycobacterium avium
FTGAIPQRARVIEIEGG

SEQ ID NO: 79887 - protein, 19 aa, Mycobacterium avium
FTGDPAFRQRYWARNHVGW

SEQ ID NO: 79888 - protein, 23 aa, Mycobacterium avium
FTGDRVLAAILFEQTMDRDIEGK

SEQ ID NO: 79889 - protein, 18 aa, Mycobacterium avium
FTGNMLLCEDVLVESGVT

SEQ ID NO: 79890 - protein, 23 aa, Mycobacterium avium
FTGVPCIVDLATMREAIADLGGN

SEQ ID NO: 79891 - protein, 18 aa, Mycobacterium avium
FTHRLRKYIGAYLAVLGH

SEQ ID NO: 79892 - protein, 17 aa, Mycobacterium avium
FTIRPDRWLSADFTGDL

SEQ ID NO: 79893 - protein, 18 aa, Mycobacterium avium
FTKKLFAAEGLPIGDYAV

SEQ ID NO: 79894 - protein, 25 aa, Mycobacterium avium
FTLAERKRLAALAFQHTADYDIAVA

SEQ ID NO: 79895 - protein, 21 aa, Mycobacterium avium
FTLSGGHLFSIYDGCRDEGIR

SEQ ID NO: 79896 - protein, 19 aa, Mycobacterium avium
FTNDYEWELLLSKTGWSEA

SEQ ID NO: 79897 - protein, 25 aa, Mycobacterium avium
FTNICYTGCRFCAFAQRKGDADAYS

SEQ ID NO: 79898 - protein, 20 aa, Mycobacterium avium
FTPPPPRYKTGVLAKYVKLV

SEQ ID NO: 79899 - protein, 17 aa, Mycobacterium avium
FTQVGAPRAGLACDPDG

SEQ ID NO: 79900 - protein, 27 aa, Mycobacterium avium
FTSDIKNLLPMFAVFKPTVVVSVPRVF

SEQ ID NO: 79901 - protein, 30 aa, Mycobacterium avium
FTSDQEVRWCPGCGDYVILNTIRNFLPDLG

SEQ ID NO: 79902 - protein, 19 aa, Mycobacterium avium
FTSEVSWKGALEAFAEGYH

SEQ ID NO: 79903 - protein, 24 aa, Mycobacterium avium
FTSKLELYLAVLARHVENLVSGVQ

SEQ ID NO: 79904 - protein, 20 aa, Mycobacterium avium
FTSSKVMCWVALDRGAKLAE

SEQ ID NO: 79905 - protein, 17 aa, Mycobacterium avium
FVAAFDVDAKKVGFDLS

SEQ ID NO: 79906 - protein, 17 aa, Mycobacterium avium
FVAEAIATLGAQVGRDA

SEQ ID NO: 79907 - protein, 18 aa, Mycobacterium avium
FVAPWGMFTTAEFALIAR

SEQ ID NO: 79908 - protein, 23 aa, Mycobacterium avium
FVEVRRAGIALAREVERRAPDAV

SEQ ID NO: 79909 - protein, 23 aa, Mycobacterium avium
FVFDPRTPYVVFWVVDPDTGERV

SEQ ID NO: 79910 - protein, 17 aa, Mycobacterium avium
FVGAATFEALSGQPVHT

SEQ ID NO: 79911 - protein, 36 aa, Mycobacterium avium
FVGATSRPSALSLDDVVKFLLPRGATKKVAKGAAST

SEQ ID NO: 79912 - protein, 24 aa, Mycobacterium avium
FVGELRAGLRAADCALFVIAANEG

SEQ ID NO: 79913 - protein, 18 aa, Mycobacterium avium
FVGFRGREIVLTLFESIT

SEQ ID NO: 79914 - protein, 17 aa, Mycobacterium avium
FVGQCISLGRAAATFQL

SEQ ID NO: 79915 - protein, 19 aa, Mycobacterium avium
FVHFNWRAQHEDLKNLPFP

SEQ ID NO: 79916 - protein, 23 aa, Mycobacterium avium
FVIGASNRFAHAAALAIAEAPAR

SEQ ID NO: 79917 - protein, 17 aa, Mycobacterium avium
FVMSNSFSNQVIAQIEL

SEQ ID NO: 79918 - protein, 25 aa, Mycobacterium avium
FVNSRPKPLSAYLFTKTRETRERVI

SEQ ID NO: 79919 - protein, 24 aa, Mycobacterium avium
FVPAFSGLFAPYWRSDARGAIVGL

SEQ ID NO: 79920 - protein, 24 aa, Mycobacterium avium
FVPSAGAVLAEWGAEVVKVEHAVT

SEQ ID NO: 79921 - protein, 21 aa, Mycobacterium avium
FVPSHQWIRDGGWNIADCVQR

SEQ ID NO: 79922 - protein, 21 aa, Mycobacterium avium
FVQDWGSLIGLRIAAEQPDRV

SEQ ID NO: 79923 - protein, 17 aa, Mycobacterium avium
FVRCLESGYAANVEAVI

SEQ ID NO: 79924 - protein, 18 aa, Mycobacterium avium
FVRQRHGLDNGDLDRTHR

SEQ ID NO: 79925 - protein, 24 aa, Mycobacterium avium
FVRYLRPVRQGSAFAVPRMLRSGR

SEQ ID NO: 79926 - protein, 25 aa, Mycobacterium avium
FVSGEGCVMLLLKRLDDARRDGDRI

SEQ ID NO: 79927 - protein, 27 aa, Mycobacterium avium
FVSGGKCLRSTFVYLGWLCGAPRDRAA

SEQ ID NO: 79928 - protein, 18 aa, Mycobacterium avium
FVSQLGFTVAPRVREAIE

SEQ ID NO: 79929 - protein, 27 aa, Mycobacterium avium
FVVCNEILPRWGVQTVFVDGDDLAQWE

SEQ ID NO: 79930 - protein, 17 aa, Mycobacterium avium
FVVYSVCDDDPYLQAVL

SEQ ID NO: 79931 - protein, 19 aa, Mycobacterium avium
FWNSLRCNEALDRVRVPVL

SEQ ID NO: 79932 - protein, 19 aa, Mycobacterium avium
FYAAVKLALDKNVVLPANS

SEQ ID NO: 79933 - protein, 18 aa, Mycobacterium avium
FYAQCAIDAGVAFVNALP

SEQ ID NO: 79934 - protein, 18 aa, Mycobacterium avium
FYEGKIAVASFFAKNFLP

SEQ ID NO: 79935 - protein, 18 aa, Mycobacterium avium
FYFACPATVLGPYDDAPT

SEQ ID NO: 79936 - protein, 18 aa, Mycobacterium avium
FYFLEMNTRLQVEHPVTE

SEQ ID NO: 79937 - protein, 18 aa, Mycobacterium avium
FYNVCRHRGNKLVWNDFP

SEQ ID NO: 79938 - protein, 19 aa, Mycobacterium avium
GAAALWFALETDLPVIVDA

SEQ ID NO: 79939 - protein, 18 aa, Mycobacterium avium
GAAIWHMAWSDKDDAIDW

SEQ ID NO: 79940 - protein, 20 aa, Mycobacterium avium
GAAKHARKVAGWGADAMIVQ

SEQ ID NO: 79941 - protein, 20 aa, Mycobacterium avium
GAALARLESRIALERLLDFM

SEQ ID NO: 79942 - protein, 23 aa, Mycobacterium avium
GAAPRAGVVGVLKGPLHDGIVIP

SEQ ID NO: 79943 - protein, 17 aa, Mycobacterium avium
GAARSAWQAALDYATQR

SEQ ID NO: 79944 - protein, 21 aa, Mycobacterium avium
GADAWALQDVMALGVTAGAPP

SEQ ID NO: 79945 - protein, 19 aa, Mycobacterium avium
GADGARLTPRVIVIARDER

SEQ ID NO: 79946 - protein, 19 aa, Mycobacterium avium
GADIIAVDICKPIRAGVVD

SEQ ID NO: 79947 - protein, 23 aa, Mycobacterium avium
GADIPRQHYAFLVSEQEFDTIYG

SEQ ID NO: 79948 - protein, 23 aa, Mycobacterium avium
GADPAHQGLHMWLAEFPQPRPPR

SEQ ID NO: 79949 - protein, 26 aa, Mycobacterium avium
GADVGYRWFAAKGHVPMFAFGHGLSY

SEQ ID NO: 79950 - protein, 24 aa, Mycobacterium avium
GADVLPWLPVRGAVLLVERGSAPV

SEQ ID NO: 79951 - protein, 17 aa, Mycobacterium avium
GAEAARPHRVTHRKLTR

SEQ ID NO: 79952 - protein, 29 aa, Mycobacterium avium
GAEAEPAWAYSVLALRWAAKYYAAEREFA

SEQ ID NO: 79953 - protein, 19 aa, Mycobacterium avium
GAELARGLARRGFPLLLVA

SEQ ID NO: 79954 - protein, 27 aa, Mycobacterium avium
GAEPSTWMPSTRVSRTDWRKIFADNLE

SEQ ID NO: 79955 - protein, 18 aa, Mycobacterium avium
GAERWLRRITALTQAGVR

SEQ ID NO: 79956 - protein, 25 aa, Mycobacterium avium
GAEWRQAGCSMCLGMNPDQLAPGER

SEQ ID NO: 79957 - protein, 26 aa, Mycobacterium avium
GAFGLLKRFAKGWVVRANQVGVDEFA

SEQ ID NO: 79958 - protein, 18 aa, Mycobacterium avium
GAGAWRVVAEHAETGDDR

SEQ ID NO: 79959 - protein, 22 aa, Mycobacterium avium
GAGERGLCAGGDVVSIYHSARK

SEQ ID NO: 79960 - protein, 20 aa, Mycobacterium avium
GAGLPLLVIHGGPGLPHDYL

SEQ ID NO: 79961 - protein, 26 aa, Mycobacterium avium
GAGRTWHPYQVPAFLAAGYRVITFDN

SEQ ID NO: 79962 - protein, 26 aa, Mycobacterium avium
GAGVKRVPLARARRAAQRHDYLGNYV

SEQ ID NO: 79963 - protein, 17 aa, Mycobacterium avium
GAHCGMICDASYPTFLL

SEQ ID NO: 79964 - protein, 21 aa, Mycobacterium avium
GAICKPGSGPFSLTGQPNAMG

SEQ ID NO: 79965 - protein, 17 aa, Mycobacterium avium
GAIDMPVTVRVPSFGGI

SEQ ID NO: 79966 - protein, 29 aa, Mycobacterium avium
GAIIRQPIPPFKWWRGLRARQLLEDYFSE

SEQ ID NO: 79967 - protein, 19 aa, Mycobacterium avium
GAILADWGADVIKVEHPVR

SEQ ID NO: 79968 - protein, 21 aa, Mycobacterium avium
GAITDWAALVAQAHERGALVA

SEQ ID NO: 79969 - protein, 18 aa, Mycobacterium avium
GAIVPWNVPQFLIMPKLI

SEQ ID NO: 79970 - protein, 20 aa, Mycobacterium avium
GAKIAVPCLFIGGTADPVLS

SEQ ID NO: 79971 - protein, 21 aa, Mycobacterium avium
GALEAGELAVWLAEHSSGKRF

SEQ ID NO: 79972 - protein, 24 aa, Mycobacterium avium
GALKLGPELGRGAIIVVNLSGRGD

SEQ ID NO: 79973 - protein, 20 aa, Mycobacterium avium
GALLAALAEFGIRGIDLTRI

SEQ ID NO: 79974 - protein, 19 aa, Mycobacterium avium
GALLARMIGDLGISVHVGT

SEQ ID NO: 79975 - protein, 20 aa, Mycobacterium avium
GALMTARFVSFAEISGQLDE

SEQ ID NO: 79976 - protein, 21 aa, Mycobacterium avium
GALPTFSSWVNPAATRGHDGT

SEQ ID NO: 79977 - protein, 23 aa, Mycobacterium avium
GALREVTIELSVFGSEGRQGKLD

SEQ ID NO: 79978 - protein, 19 aa, Mycobacterium avium
GALRLARELGGAGYTAPEF

SEQ ID NO: 79979 - protein, 21 aa, Mycobacterium avium
GALRSAWIGYWVPRSATGGGV

SEQ ID NO: 79980 - protein, 24 aa, Mycobacterium avium
GALVAPVCDFRIMSRQGAIFTAGP

SEQ ID NO: 79981 - protein, 18 aa, Mycobacterium avium
GAMLARAELRAVFDELLL

SEQ ID NO: 79982 - protein, 19 aa, Mycobacterium avium
GANGISSFMVHKDDEGFTV

SEQ ID NO: 79983 - protein, 25 aa, Mycobacterium avium
GANMADCHPILFLRMMDRVKAGAKL

SEQ ID NO: 79984 - protein, 24 aa, Mycobacterium avium
GANPRELAGWLAAALAETDGIASA

SEQ ID NO: 79985 - protein, 19 aa, Mycobacterium avium
GANVIPIQIPVGSEGDFEG

SEQ ID NO: 79986 - protein, 17 aa, Mycobacterium avium
GANWSRWAKPIVLHSSW

SEQ ID NO: 79987 - protein, 23 aa, Mycobacterium avium
GAPETKGPMLINARADKVTSSPA

SEQ ID NO: 79988 - protein, 17 aa, Mycobacterium avium
GAPLGSRLGHFFRGVGL

SEQ ID NO: 79989 - protein, 33 aa, Mycobacterium avium
GAPSFAEALRWGAEVYHSLKSVLKKEGLSTGLG

SEQ ID NO: 79990 - protein, 17 aa, Mycobacterium avium
GAPSGAYVRRAGDDVQP

SEQ ID NO: 79991 - protein, 24 aa, Mycobacterium avium
GAQAGNIARLSWLAAGYPEEVPGV

SEQ ID NO: 79992 - protein, 19 aa, Mycobacterium avium
GAQLADTAEQVWADAELLL

SEQ ID NO: 79993 - protein, 19 aa, Mycobacterium avium
GAQLGRGWSDAAVRAALDD

SEQ ID NO: 79994 - protein, 18 aa, Mycobacterium avium
GAQLGVLVTRGHLQTDDY

SEQ ID NO: 79995 - protein, 20 aa, Mycobacterium avium
GAQLLDVPAGAAAVFEDALS

SEQ ID NO: 79996 - protein, 19 aa, Mycobacterium avium
GARALEWIVGHPSRVRAGL

SEQ ID NO: 79997 - protein, 24 aa, Mycobacterium avium
GARDKVLPGYGWIFPLGNGEVNIG

SEQ ID NO: 79998 - protein, 21 aa, Mycobacterium avium
GAREHALLLALRKDPQVTGLA

SEQ ID NO: 79999 - protein, 21 aa, Mycobacterium avium
GARFEVMPGCGHWPQYEDAKT

SEQ ID NO: 80000 - protein, 21 aa, Mycobacterium avium
GARLYPQIAARPFGMMIGFQG

SEQ ID NO: 80001 - protein, 18 aa, Mycobacterium avium
GARPRGPGMERSDLLEAN

SEQ ID NO: 80002 - protein, 24 aa, Mycobacterium avium
GARRGTGILDCWLVSQDDHADIEG

SEQ ID NO: 80003 - protein, 21 aa, Mycobacterium avium
GARVAFLIRFGSGVLPEPKSV

SEQ ID NO: 80004 - protein, 27 aa, Mycobacterium avium
GARVVKAHVPLSEMFGYVGDLRSKTQG

SEQ ID NO: 80005 - protein, 20 aa, Mycobacterium avium
GARVWPGVSIPDGGIRYSSD

SEQ ID NO: 80006 - protein, 26 aa, Mycobacterium avium
GARYAFVCAVDMPLLSPELIDDLVHL

SEQ ID NO: 80007 - protein, 20 aa, Mycobacterium avium
GASMGGMIAQIFAARFRQRT

SEQ ID NO: 80008 - protein, 20 aa, Mycobacterium avium
GASVLKQLVAYVGLEHFLAG

SEQ ID NO: 80009 - protein, 26 aa, Mycobacterium avium
GATGFLGRYLALEWLERMDMVDGKVI

SEQ ID NO: 80010 - protein, 19 aa, Mycobacterium avium
GATMLRMLLRPEEELDDAW

SEQ ID NO: 80011 - protein, 26 aa, Mycobacterium avium
GATPEWARTAIGLARRAAELFAEDPD

SEQ ID NO: 80012 - protein, 24 aa, Mycobacterium avium
GATPGCFVALLFSRSAEAIVAMLA

SEQ ID NO: 80013 - protein, 24 aa, Mycobacterium avium
GATRRWPECILFERGGDGLISHIS

SEQ ID NO: 80014 - protein, 18 aa, Mycobacterium avium
GAVALGWIASRWPGLLPE

SEQ ID NO: 80015 - protein, 20 aa, Mycobacterium avium
GAVEGVKGKAKEVGGTILGR

SEQ ID NO: 80016 - protein, 18 aa, Mycobacterium avium
GAVFAYWVANPSAYGVVE

SEQ ID NO: 80017 - protein, 24 aa, Mycobacterium avium
GAVGLCALRSALFQGAATVFAVDQ

SEQ ID NO: 80018 - protein, 18 aa, Mycobacterium avium
GAVHGGSLGMLFDTVLGL

SEQ ID NO: 80019 - protein, 17 aa, Mycobacterium avium
GAVKDGFVWGRGAVDMK

SEQ ID NO: 80020 - protein, 17 aa, Mycobacterium avium
GAVPRVALDRVDLAVSS

SEQ ID NO: 80021 - protein, 18 aa, Mycobacterium avium
GAVSRAHRGVLFLDECAE

SEQ ID NO: 80022 - protein, 29 aa, Mycobacterium avium
GAWRDPRVWWQLRNPFRPSWGEPYTEIAA

SEQ ID NO: 80023 - protein, 18 aa, Mycobacterium avium
GAYREFHIDWDLAAAEKG

SEQ ID NO: 80024 - protein, 17 aa, Mycobacterium avium
GCAELQVVDSICGHDGF

SEQ ID NO: 80025 - protein, 22 aa, Mycobacterium avium
GCALNRWQRAQMRRWRDGDRVA

SEQ ID NO: 80026 - protein, 33 aa, Mycobacterium avium
GCDGVVIGRGCLGRPWLFAELSAAFTGSPPPTP

SEQ ID NO: 80027 - protein, 20 aa, Mycobacterium avium
GCDRIRFTPYQKLVLLDIPD

SEQ ID NO: 80028 - protein, 20 aa, Mycobacterium avium
GCGESGILAGVRLKQANIPF

SEQ ID NO: 80029 - protein, 21 aa, Mycobacterium avium
GCGQWPGSVTRLQAPVIPHMG

SEQ ID NO: 80030 - protein, 22 aa, Mycobacterium avium
GCRMGICQSCVVGLVEGHVRDL

SEQ ID NO: 80031 - protein, 21 aa, Mycobacterium avium
GCTAPGCTVPGYYAEVHHCTD

SEQ ID NO: 80032 - protein, 23 aa, Mycobacterium avium
GCVFAYGRCRDGAPAPYAAVRDA

SEQ ID NO: 80033 - protein, 21 aa, Mycobacterium avium
GDAALKVLRRRGIDVRLGTTL

SEQ ID NO: 80034 - protein, 18 aa, Mycobacterium avium
GDAAVSLMDAFRSADEVL

SEQ ID NO: 80035 - protein, 23 aa, Mycobacterium avium
GDALRPLTAVVRSARMAAVTAIL

SEQ ID NO: 80036 - protein, 17 aa, Mycobacterium avium
GDALWAATFLRRRGAAA

SEQ ID NO: 80037 - protein, 22 aa, Mycobacterium avium
GDCLPERDFPTLIELYLQGRLP

SEQ ID NO: 80038 - protein, 25 aa, Mycobacterium avium
GDDIAEVLALLGVRPVWDDASRRVV

SEQ ID NO: 80039 - protein, 22 aa, Mycobacterium avium
GDDIRARFVVLASGPFHRPKLP

SEQ ID NO: 80040 - protein, 18 aa, Mycobacterium avium
GDDLAVRPHPEWFRTGDL

SEQ ID NO: 80041 - protein, 26 aa, Mycobacterium avium
GDDLRLVVIDGRVVAAALRLPPEVIG

SEQ ID NO: 80042 - protein, 18 aa, Mycobacterium avium
GDDRARAALARWSLVRTD

SEQ ID NO: 80043 - protein, 23 aa, Mycobacterium avium
GDESRGGVDISRPGAVDEVCAQV

SEQ ID NO: 80044 - protein, 26 aa, Mycobacterium avium
GDEVQIGKFRLVFLTGPKQGEDGGSS

SEQ ID NO: 80045 - protein, 19 aa, Mycobacterium avium
GDFARRGLDPDLAPLYAQA

SEQ ID NO: 80046 - protein, 19 aa, Mycobacterium avium
GDFKAVLPALTEVRPTLFL

SEQ ID NO: 80047 - protein, 20 aa, Mycobacterium avium
GDFRFYLDYYTRQSAGGVEL

SEQ ID NO: 80048 - protein, 24 aa, Mycobacterium avium
GDGFARYWLHNGWVTMGGEKMSKS

SEQ ID NO: 80049 - protein, 22 aa, Mycobacterium avium
GDGGDGALHWLINEIERGVADP

SEQ ID NO: 80050 - protein, 19 aa, Mycobacterium avium
GDGMWNWFAAPNLPAQIAE

SEQ ID NO: 80051 - protein, 31 aa, Mycobacterium avium
GDGPARAWERGRFGAPYLRDSLLAAGALCET

SEQ ID NO: 80052 - protein, 26 aa, Mycobacterium avium
GDGPLAGTVRFEWDPLRWFEEDEPIY

SEQ ID NO: 80053 - protein, 25 aa, Mycobacterium avium
GDGRCWSEFVLGSAYEGPPRLVHGG

SEQ ID NO: 80054 - protein, 23 aa, Mycobacterium avium
GDGWRVAMGTLTFERGVSTLGQQ

SEQ ID NO: 80055 - protein, 21 aa, Mycobacterium avium
GDGWVHFDAPAGMLIPDSVAT

SEQ ID NO: 80056 - protein, 18 aa, Mycobacterium avium
GDHFVVFGAVQSLSEAPK

SEQ ID NO: 80057 - protein, 17 aa, Mycobacterium avium
GDIDVLVCTTVIEVGVD

SEQ ID NO: 80058 - protein, 20 aa, Mycobacterium avium
GDIRIGMRVSPVFYDLQDGI

SEQ ID NO: 80059 - protein, 18 aa, Mycobacterium avium
GDIWRMPIVRDEPIRDWV

SEQ ID NO: 80060 - protein, 18 aa, Mycobacterium avium
GDLAFPIAPGTAGGTGPE

SEQ ID NO: 80061 - protein, 18 aa, Mycobacterium avium
GDLAPLWSDEVLKAAIDT

SEQ ID NO: 80062 - protein, 32 aa, Mycobacterium avium
GDLATIWRGGCIIRAKFLNRIKDAFDENPDLP

SEQ ID NO: 80063 - protein, 30 aa, Mycobacterium avium
GDLAYRDADGWIYLAGRTADWMRVDGENLA

SEQ ID NO: 80064 - protein, 19 aa, Mycobacterium avium
GDLCLIWAEQMLRDSGLEA

SEQ ID NO: 80065 - protein, 21 aa, Mycobacterium avium
GDLDEGFALLSDDFSYWTLYT

SEQ ID NO: 80066 - protein, 23 aa, Mycobacterium avium
GDLGFPLSIHLEATYGISGPAFQ

SEQ ID NO: 80067 - protein, 21 aa, Mycobacterium avium
GDLLIGWRLLVHADVAQRALA

SEQ ID NO: 80068 - protein, 40 aa, Mycobacterium avium
GDLRVGDRVVIPFQICCGSCYMCGQQLYTQCETTQVRDQG

SEQ ID NO: 80069 - protein, 22 aa, Mycobacterium avium
GDLVSCPQWVISVTALGELDGR

SEQ ID NO: 80070 - protein, 18 aa, Mycobacterium avium
GDPLFYSSYMHLHTRLTQ

SEQ ID NO: 80071 - protein, 25 aa, Mycobacterium avium
GDPTARLHQIWSLLLPGIVSQASLP

SEQ ID NO: 80072 - protein, 25 aa, Mycobacterium avium
GDQTMFRKLFESVIAGHVKVLIGRK

SEQ ID NO: 80073 - protein, 19 aa, Mycobacterium avium
GDRFIKTAVAILGETGRTD

SEQ ID NO: 80074 - protein, 18 aa, Mycobacterium avium
GDRIFSWQLAAAVRPSLF

SEQ ID NO: 80075 - protein, 18 aa, Mycobacterium avium
GDRMLRDMLRGMTPEDAR

SEQ ID NO: 80076 - protein, 19 aa, Mycobacterium avium
GDRMWEFLDRLTSIALPRI

SEQ ID NO: 80077 - protein, 27 aa, Mycobacterium avium
GDRRAAIRHAVAWAGPGDVVLVAGKGH

SEQ ID NO: 80078 - protein, 17 aa, Mycobacterium avium
GDRTELRSLAQTYGDTE

SEQ ID NO: 80079 - protein, 18 aa, Mycobacterium avium
GDRWCVTALNWLRAHHDG

SEQ ID NO: 80080 - protein, 17 aa, Mycobacterium avium
GDSDWLHGMWKGEKFTE

SEQ ID NO: 80081 - protein, 23 aa, Mycobacterium avium
GDTIKRILLELGGKSASIVLDDA

SEQ ID NO: 80082 - protein, 21 aa, Mycobacterium avium
GDTRLGLLPFRRNLTFYALDL

SEQ ID NO: 80083 - protein, 18 aa, Mycobacterium avium
GDTTRSWYVIDATDVVLG

SEQ ID NO: 80084 - protein, 31 aa, Mycobacterium avium
GDVGWIPYFLWRAEHVYNRHSGWTLATFPPG

SEQ ID NO: 80085 - protein, 25 aa, Mycobacterium avium
GDVMPPRGVGVIELRGESVTPGYLT

SEQ ID NO: 80086 - protein, 24 aa, Mycobacterium avium
GDVRGRGAMIAIELVKSGTAEPDK

SEQ ID NO: 80087 - protein, 19 aa, Mycobacterium avium
GDYRVVSFAADVQAVLGTL

SEQ ID NO: 80088 - protein, 25 aa, Mycobacterium avium
GEAEGAFLLCGFMMALAEHQLGHTH

SEQ ID NO: 80089 - protein, 23 aa, Mycobacterium avium
GEAEGAYAEMWAQDAAAMYGYAA

SEQ ID NO: 80090 - protein, 19 aa, Mycobacterium avium
GEAELDLVLAILRARQLFG

SEQ ID NO: 80091 - protein, 17 aa, Mycobacterium avium
GEAIPAQAIAQVCELTW

SEQ ID NO: 80092 - protein, 25 aa, Mycobacterium avium
GEALLSGLLRAGRQVKDLVVVERVP

SEQ ID NO: 80093 - protein, 26 aa, Mycobacterium avium
GEALREYGVRVLVIRPGQVRTRMSAH

SEQ ID NO: 80094 - protein, 19 aa, Mycobacterium avium
GEAVLRPAALVSDRLQAAA

SEQ ID NO: 80095 - protein, 17 aa, Mycobacterium avium
GECHVHAGINGDELGER

SEQ ID NO: 80096 - protein, 22 aa, Mycobacterium avium
GEDCLRLNVWASADTQPGDAKP

SEQ ID NO: 80097 - protein, 24 aa, Mycobacterium avium
GEDGRYRPAAGLAVLGASFDRNVR

SEQ ID NO: 80098 - protein, 26 aa, Mycobacterium avium
GEDVLRPLPVTRFDVRRAPAALRYLS

SEQ ID NO: 80099 - protein, 24 aa, Mycobacterium avium
GEEEAFSHIDLVDFSGNVEGAQQA

SEQ ID NO: 80100 - protein, 23 aa, Mycobacterium avium
GEGKRLYPLTADRAKPAVPFGGA

SEQ ID NO: 80101 - protein, 21 aa, Mycobacterium avium
GEGLAKLPADRMPVLYCKTGV

SEQ ID NO: 80102 - protein, 21 aa, Mycobacterium avium
GEGVLRFFEYVAARTDIALGM

SEQ ID NO: 80103 - protein, 18 aa, Mycobacterium avium
GEHIRVFPLSNWTEFDIW

SEQ ID NO: 80104 - protein, 24 aa, Mycobacterium avium
GEIARRAGAHLVRHPINLGQGAAI

SEQ ID NO: 80105 - protein, 22 aa, Mycobacterium avium
GEIEWAKASLIGPEEYPAAVAA

SEQ ID NO: 80106 - protein, 21 aa, Mycobacterium avium
GEIGQDLAALAFDVLGSRDDG

SEQ ID NO: 80107 - protein, 21 aa, Mycobacterium avium
GEKAFRIGRLCTKRSARGQGH

SEQ ID NO: 80108 - protein, 20 aa, Mycobacterium avium
GELAEAVFWALDNYEADEEA

SEQ ID NO: 80109 - protein, 27 aa, Mycobacterium avium
GELASLLRFVLELLGDYGLTDFYLELS

SEQ ID NO: 80110 - protein, 24 aa, Mycobacterium avium
GELGEPFTTVGLCCYRDGSDSVAW

SEQ ID NO: 80111 - protein, 18 aa, Mycobacterium avium
GELGRLGCTEVRFYRQLA

SEQ ID NO: 80112 - protein, 18 aa, Mycobacterium avium
GELIRVRILPTWLRLDAR

SEQ ID NO: 80113 - protein, 22 aa, Mycobacterium avium
GELLLQPMVDAVWDRVAKPTDA

SEQ ID NO: 80114 - protein, 20 aa, Mycobacterium avium
GELNAAAVRSMWSTVRDKVR

SEQ ID NO: 80115 - protein, 27 aa, Mycobacterium avium
GELPTWQWEGLIGKSTRLVAVASASAT

SEQ ID NO: 80116 - protein, 25 aa, Mycobacterium avium
GELRLKGPQCFLGYADPTLDADAFD

SEQ ID NO: 80117 - protein, 23 aa, Mycobacterium avium
GELRRRVKAMSYGLAYGLSAYGL

SEQ ID NO: 80118 - protein, 17 aa, Mycobacterium avium
GELTAAINAGGGRAVAY

SEQ ID NO: 80119 - protein, 21 aa, Mycobacterium avium
GELTLPGRSLLFVRNVGHLMT

SEQ ID NO: 80120 - protein, 25 aa, Mycobacterium avium
GEMTLSYDPPRKWWQAGPGEGSIGF

SEQ ID NO: 80121 - protein, 19 aa, Mycobacterium avium
GENGWPMPLPDELKEDLKS

SEQ ID NO: 80122 - protein, 20 aa, Mycobacterium avium
GENIPAWLVFDQQYRDRYIF

SEQ ID NO: 80123 - protein, 26 aa, Mycobacterium avium
GENIVCPWHGWQWRGDGSNALIPYSK

SEQ ID NO: 80124 - protein, 23 aa, Mycobacterium avium
GEPAEVGRICVFLAGGQADFVNG

SEQ ID NO: 80125 - protein, 18 aa, Mycobacterium avium
GERLDAKALVAFTQSGDT

SEQ ID NO: 80126 - protein, 23 aa, Mycobacterium avium
GERLKRVSLELGGKSAAIILDDA

SEQ ID NO: 80127 - protein, 19 aa, Mycobacterium avium
GERLLGLDLANGGHLTHGM

SEQ ID NO: 80128 - protein, 26 aa, Mycobacterium avium
GERREVRGRLALVTGAGAGIGRATAV

SEQ ID NO: 80129 - protein, 24 aa, Mycobacterium avium
GERRRVALCKLLLSKPDLLLLDEP

SEQ ID NO: 80130 - protein, 20 aa, Mycobacterium avium
GESLLTYALCVEELARGWMS

SEQ ID NO: 80131 - protein, 18 aa, Mycobacterium avium
GETASIFLPSVPNLLQLA

SEQ ID NO: 80132 - protein, 28 aa, Mycobacterium avium
GETRRLRVSGPLKAMVEAEWVFDRGSAT

SEQ ID NO: 80133 - protein, 26 aa, Mycobacterium avium
GEVLERSLVHLGLKHYFLVDFPQEPG

SEQ ID NO: 80134 - protein, 24 aa, Mycobacterium avium
GEVLQCPFHGWQWSAEGRNVCIPY

SEQ ID NO: 80135 - protein, 23 aa, Mycobacterium avium
GEVVAGLRIPGKIDKLGYKGIET

SEQ ID NO: 80136 - protein, 17 aa, Mycobacterium avium
GEWAPFDMATVFADQQE

SEQ ID NO: 80137 - protein, 17 aa, Mycobacterium avium
GEWVVPPLVAMQGTKFT

SEQ ID NO: 80138 - protein, 17 aa, Mycobacterium avium
GEYATWLDAERVVVNVY

SEQ ID NO: 80139 - protein, 24 aa, Mycobacterium avium
GEYTRRAAGAGARLVVFPEATMCR

SEQ ID NO: 80140 - protein, 42 aa, Mycobacterium avium
GFAVGQRVAVGWFGGCCYRCDPCRAGLFIHCVNGKVPSWHYP

SEQ ID NO: 80141 - protein, 18 aa, Mycobacterium avium
GFDGASCGVNIGIGAQSP

SEQ ID NO: 80142 - protein, 20 aa, Mycobacterium avium
GFDRLRLIQRIVDRLPEKAP

SEQ ID NO: 80143 - protein, 21 aa, Mycobacterium avium
GFERSKYASGEFFDKYTEQVW

SEQ ID NO: 80144 - protein, 20 aa, Mycobacterium avium
GFFGRMLATIRPYRPSLSHP

SEQ ID NO: 80145 - protein, 17 aa, Mycobacterium avium
GFGLRVPIVNAPMGGVA

SEQ ID NO: 80146 - protein, 17 aa, Mycobacterium avium
GFGRIGRNFYRALLAQQ

SEQ ID NO: 80147 - protein, 17 aa, Mycobacterium avium
GFGYPWALGDAGDSLAN

SEQ ID NO: 80148 - protein, 19 aa, Mycobacterium avium
GFLSEPWWCRMVVLSAERI

SEQ ID NO: 80149 - protein, 20 aa, Mycobacterium avium
GFNLARVVAVELGFDFLPGT

SEQ ID NO: 80150 - protein, 44 aa, Mycobacterium avium
GFPESHALSFASLVFYSSWFKLHHPAAFCAALLRAQPMGFYSPQ

SEQ ID NO: 80151 - protein, 23 aa, Mycobacterium avium
GFRFDLAATLAREFYDVDRLATF

SEQ ID NO: 80152 - protein, 18 aa, Mycobacterium avium
GGAETFQAIVSRFYAQVP

SEQ ID NO: 80153 - protein, 24 aa, Mycobacterium avium
GGAEVAAWLGTLGTLGRAAFQLGV

SEQ ID NO: 80154 - protein, 19 aa, Mycobacterium avium
GGAGIPGFYTRTGYGTTLA

SEQ ID NO: 80155 - protein, 18 aa, Mycobacterium avium
GGAHKCIGMVFGQLEVKT

SEQ ID NO: 80156 - protein, 22 aa, Mycobacterium avium
GGAIALGHPFGMTGARITTTLL

SEQ ID NO: 80157 - protein, 17 aa, Mycobacterium avium
GGANLINAVVRDAQVPT

SEQ ID NO: 80158 - protein, 19 aa, Mycobacterium avium
GGAVKFFAGRLVKAAEREA

SEQ ID NO: 80159 - protein, 19 aa, Mycobacterium avium
GGCELAMMCDVLIAADTAK

SEQ ID NO: 80160 - protein, 18 aa, Mycobacterium avium
GGDARRIRQLAGRVTPAI

SEQ ID NO: 80161 - protein, 18 aa, Mycobacterium avium
GGDAWVRAMMLVDAGVDV

SEQ ID NO: 80162 - protein, 22 aa, Mycobacterium avium
GGDGRCKLVPYAKRTPKTARTR

SEQ ID NO: 80163 - protein, 18 aa, Mycobacterium avium
GGDIGIGGNSAWRAIAGP

SEQ ID NO: 80164 - protein, 18 aa, Mycobacterium avium
GGDLEFADELTLGRALAG

SEQ ID NO: 80165 - protein, 21 aa, Mycobacterium avium
GGDLRRMGISAATVAALGQAL

SEQ ID NO: 80166 - protein, 20 aa, Mycobacterium avium
GGDPLRIGASLVVRAIRPVA

SEQ ID NO: 80167 - protein, 20 aa, Mycobacterium avium
GGEMGRLWYEHGKLLEKKNT

SEQ ID NO: 80168 - protein, 18 aa, Mycobacterium avium
GGEPRWGGYAAAKEGIRG

SEQ ID NO: 80169 - protein, 24 aa, Mycobacterium avium
GGERNRLNLALTLKQGGNLILLDE

SEQ ID NO: 80170 - protein, 18 aa, Mycobacterium avium
GGFGTLLMLGHDWASPEA

SEQ ID NO: 80171 - protein, 19 aa, Mycobacterium avium
GGFLNTGIWESWRHRPPRY

SEQ ID NO: 80172 - protein, 22 aa, Mycobacterium avium
GGGAGAAHLVDWADDIDPAWLE

SEQ ID NO: 80173 - protein, 20 aa, Mycobacterium avium
GGGAHFCLGANLARREIRVV

SEQ ID NO: 80174 - protein, 28 aa, Mycobacterium avium
GGGEVQRPVWPMIVLRTPKGWTGPKVVD

SEQ ID NO: 80175 - protein, 25 aa, Mycobacterium avium
GGGGRGRARLCCLMLARAPAPGRRP

SEQ ID NO: 80176 - protein, 26 aa, Mycobacterium avium
GGGIAHRLGMRPSWVLDLNNGGCAAF

SEQ ID NO: 80177 - protein, 24 aa, Mycobacterium avium
GGGLPIGACLAVGPAADLLTPGLH

SEQ ID NO: 80178 - protein, 28 aa, Mycobacterium avium
GGHTQPAGWFRFYFADQRWEWSEQVQRM

SEQ ID NO: 80179 - protein, 18 aa, Mycobacterium avium
GGICHWFHSDAIYRAVLA

SEQ ID NO: 80180 - protein, 19 aa, Mycobacterium avium
GGINPIWAYAHVPFGYTGD

SEQ ID NO: 80181 - protein, 18 aa, Mycobacterium avium
GGITDWLRAAAVAAAHNV

SEQ ID NO: 80182 - protein, 24 aa, Mycobacterium avium
GGKALKFYASVRMDVRRIETLKDG

SEQ ID NO: 80183 - protein, 22 aa, Mycobacterium avium
GGKTFPLPNPFLVMATQNPIEH

SEQ ID NO: 80184 - protein, 19 aa, Mycobacterium avium
GGKVTAWRYIRAAVPAVWG

SEQ ID NO: 80185 - protein, 17 aa, Mycobacterium avium
GGLDTSVAISWIGKETG

SEQ ID NO: 80186 - protein, 24 aa, Mycobacterium avium
GGLDVCGLAGCHLAGGHSVDDPEP

SEQ ID NO: 80187 - protein, 25 aa, Mycobacterium avium
GGLDVLVHAAGLWQPGIPGCIGADD

SEQ ID NO: 80188 - protein, 20 aa, Mycobacterium avium
GGLDYEIWDDGWTVVTKDRK

SEQ ID NO: 80189 - protein, 20 aa, Mycobacterium avium
GGLGGCPFAPGATGNIATED

SEQ ID NO: 80190 - protein, 25 aa, Mycobacterium avium
GGLGKVRFGDWRAPFDGFAHLPNVA

SEQ ID NO: 80191 - protein, 17 aa, Mycobacterium avium
GGLHFCLGAHVARAQLR

SEQ ID NO: 80192 - protein, 18 aa, Mycobacterium avium
GGLLHHAPSLLAFTNPTT

SEQ ID NO: 80193 - protein, 19 aa, Mycobacterium avium
GGLRPGRTEREVSRELEAL

SEQ ID NO: 80194 - protein, 20 aa, Mycobacterium avium
GGLTRPGLLDACFDHLPSGG

SEQ ID NO: 80195 - protein, 19 aa, Mycobacterium avium
GGLTRVALVEGSRVVNSSQ

SEQ ID NO: 80196 - protein, 19 aa, Mycobacterium avium
GGMLPGVLYDAGLKTITDL

SEQ ID NO: 80197 - protein, 24 aa, Mycobacterium avium
GGMNPRTSVPMLLSLYQAGDLKLD

SEQ ID NO: 80198 - protein, 18 aa, Mycobacterium avium
GGNIEFRTLPVVRYDNID

SEQ ID NO: 80199 - protein, 20 aa, Mycobacterium avium
GGNPDFRYNTIITEETTRGR

SEQ ID NO: 80200 - protein, 19 aa, Mycobacterium avium
GGPGLMWGGGTIAAARRAG

SEQ ID NO: 80201 - protein, 21 aa, Mycobacterium avium
GGPPPRLALSLGDSLAGMFGA

SEQ ID NO: 80202 - protein, 26 aa, Mycobacterium avium
GGPWLKTGDQGFLFDGALFIVGRIKD

SEQ ID NO: 80203 - protein, 18 aa, Mycobacterium avium
GGRTSYRGLVQVNKGAHG

SEQ ID NO: 80204 - protein, 21 aa, Mycobacterium avium
GGTCPLWNVYETFANPGKILV

SEQ ID NO: 80205 - protein, 20 aa, Mycobacterium avium
GGTLKLMRPLFSAGLGGRLG

SEQ ID NO: 80206 - protein, 20 aa, Mycobacterium avium
GGTPLRSRVGHSYIKALMAD

SEQ ID NO: 80207 - protein, 25 aa, Mycobacterium avium
GGTSALWGGRCVKFDRIDFEHRLIT

SEQ ID NO: 80208 - protein, 17 aa, Mycobacterium avium
GGTSRRLLVVLSDGLAY

SEQ ID NO: 80209 - protein, 23 aa, Mycobacterium avium
GGTWRINTYPGLACDVKSHLYSY

SEQ ID NO: 80210 - protein, 29 aa, Mycobacterium avium
GGVELRGPQRWRIRANWKIGAENFAGDMY

SEQ ID NO: 80211 - protein, 19 aa, Mycobacterium avium
GGVHYCLGANLARREIAEA

SEQ ID NO: 80212 - protein, 24 aa, Mycobacterium avium
GGVKGFFEKTFAPLGLKKIQGEVL

SEQ ID NO: 80213 - protein, 20 aa, Mycobacterium avium
GGWYFTSRALQWDSVPSRHP

SEQ ID NO: 80214 - protein, 19 aa, Mycobacterium avium
GGYCYEQNGLLGYALAEIG

SEQ ID NO: 80215 - protein, 26 aa, Mycobacterium avium
GGYDMTAFWCRAGTAATITPAGMPGM

SEQ ID NO: 80216 - protein, 17 aa, Mycobacterium avium
GGYQLAVVRYGRLAAAG

SEQ ID NO: 80217 - protein, 17 aa, Mycobacterium avium
GGYRVSGPIRWASNLYP

SEQ ID NO: 80218 - protein, 17 aa, Mycobacterium avium
GHAGFLGAERIRELMTG

SEQ ID NO: 80219 - protein, 19 aa, Mycobacterium avium
GHAKVRRLLIDFVGHHATP

SEQ ID NO: 80220 - protein, 21 aa, Mycobacterium avium
GHDGDYRFGQQIVVSHDGGDY

SEQ ID NO: 80221 - protein, 18 aa, Mycobacterium avium
GHDISRVVMPPSFVQSKR

SEQ ID NO: 80222 - protein, 17 aa, Mycobacterium avium
GHDITLFSRTMTIEADK

SEQ ID NO: 80223 - protein, 27 aa, Mycobacterium avium
GHERTMMWLGFADRLENMIADFQPGTE

SEQ ID NO: 80224 - protein, 18 aa, Mycobacterium avium
GHFFEWLTDKGFRSFAGH

SEQ ID NO: 80225 - protein, 23 aa, Mycobacterium avium
GHGHSAWRADGDYSPQLNADALL

SEQ ID NO: 80226 - protein, 18 aa, Mycobacterium avium
GHGLHLFATLLSAAERAG

SEQ ID NO: 80227 - protein, 19 aa, Mycobacterium avium
GHGPHRYYIAVHAVDTEKL

SEQ ID NO: 80228 - protein, 21 aa, Mycobacterium avium
GHGRLTGLITVKDFVKTEQHP

SEQ ID NO: 80229 - protein, 17 aa, Mycobacterium avium
GHIRLTVDTNFTMPTTD

SEQ ID NO: 80230 - protein, 19 aa, Mycobacterium avium
GHLDWYADGMFPPMHLDAE

SEQ ID NO: 80231 - protein, 26 aa, Mycobacterium avium
GHPILYVAQMWDWIYPLGDNPDYEPD

SEQ ID NO: 80232 - protein, 19 aa, Mycobacterium avium
GHPLFAHITLLRSERSPIA

SEQ ID NO: 80233 - protein, 24 aa, Mycobacterium avium
GHPSRVRAGLLLAVGARATADQIG

SEQ ID NO: 80234 - protein, 25 aa, Mycobacterium avium
GHQGLCYFAYLAGYREVHEAAQDPV

SEQ ID NO: 80235 - protein, 24 aa, Mycobacterium avium
GHSLGGGVAMQFAYQFPHLVERLI

SEQ ID NO: 80236 - protein, 19 aa, Mycobacterium avium
GHTNYPVVVGHEIAGVVTE

SEQ ID NO: 80237 - protein, 17 aa, Mycobacterium avium
GHTTRLGLATGVLVLPN

SEQ ID NO: 80238 - protein, 24 aa, Mycobacterium avium
GIAEGCVRAGCALLGGETAEHPGL

SEQ ID NO: 80239 - protein, 18 aa, Mycobacterium avium
GIAERLGVEIPRDRGYGH

SEQ ID NO: 80240 - protein, 19 aa, Mycobacterium avium
GIASARWDAEQLAAHLAGV

SEQ ID NO: 80241 - protein, 26 aa, Mycobacterium avium
GICDAVLCALPARYITPSSKKKPRPM

SEQ ID NO: 80242 - protein, 29 aa, Mycobacterium avium
GIDAAAVWMMAHREILRAGYAYVAVSAQR

SEQ ID NO: 80243 - protein, 24 aa, Mycobacterium avium
GIDPDVYSGFAFGMGLERTLQFRN

SEQ ID NO: 80244 - protein, 25 aa, Mycobacterium avium
GIDRFPIDMVRLYFDDHADDAAGAP

SEQ ID NO: 80245 - protein, 24 aa, Mycobacterium avium
GIEEKRMFGGLAFLLNGNMSVAAS

SEQ ID NO: 80246 - protein, 18 aa, Mycobacterium avium
GIEFCKLSFAETRVRAQG

SEQ ID NO: 80247 - protein, 19 aa, Mycobacterium avium
GIEFCKLSFAETRVRTQTL

SEQ ID NO: 80248 - protein, 20 aa, Mycobacterium avium
GIETARWPFAPRRPRTGPAE

SEQ ID NO: 80249 - protein, 24 aa, Mycobacterium avium
GIETKGGVMTKLIERNTTIPTKRS

SEQ ID NO: 80250 - protein, 18 aa, Mycobacterium avium
GIHACLGAALARIEGATA

SEQ ID NO: 80251 - protein, 25 aa, Mycobacterium avium
GIHPVDLGALGWRGLLDRVDVDPAA

SEQ ID NO: 80252 - protein, 18 aa, Mycobacterium avium
GIMIPFLASHTAKVQSQV

SEQ ID NO: 80253 - protein, 18 aa, Mycobacterium avium
GIMPDRHLGSALHAAHNE

SEQ ID NO: 80254 - protein, 20 aa, Mycobacterium avium
GIMQHFTIPVSFFDESVFED

SEQ ID NO: 80255 - protein, 25 aa, Mycobacterium avium
GINRCLPDLPAEVHFERNIMARNLL

SEQ ID NO: 80256 - protein, 24 aa, Mycobacterium avium
GIPDIPGYAARVFRAVADADVNID

SEQ ID NO: 80257 - protein, 22 aa, Mycobacterium avium
GIPKLRIEEAAARTQARIDSGI

SEQ ID NO: 80258 - protein, 19 aa, Mycobacterium avium
GIPRAELFVTTKLATSDQG

SEQ ID NO: 80259 - protein, 18 aa, Mycobacterium avium
GIRHPRDVALALAAGASN

SEQ ID NO: 80260 - protein, 24 aa, Mycobacterium avium
GIRRRVAADLQILKRFAQAVELAK

SEQ ID NO: 80261 - protein, 25 aa, Mycobacterium avium
GIRVNSVAPGYIWGDTLQAYFEHQA

SEQ ID NO: 80262 - protein, 23 aa, Mycobacterium avium
GITKADIGFWCSGSSDYLAGRAF

SEQ ID NO: 80263 - protein, 17 aa, Mycobacterium avium
GIVPAAFYRHFESMESL

SEQ ID NO: 80264 - protein, 18 aa, Mycobacterium avium
GIWMRPEAVPGFRRLTDA

SEQ ID NO: 80265 - protein, 22 aa, Mycobacterium avium
GKAQEHFFDFIVTPRRGDDGSI

SEQ ID NO: 80266 - protein, 19 aa, Mycobacterium avium
GKDISCNLGSLNIAKTMDS

SEQ ID NO: 80267 - protein, 18 aa, Mycobacterium avium
GKDWTPTQHQIWADEMQL

SEQ ID NO: 80268 - protein, 21 aa, Mycobacterium avium
GKEASLACMAAWANTDFRPDL

SEQ ID NO: 80269 - protein, 30 aa, Mycobacterium avium
GKEGDRGLSWLPFFHDMGLITAMLSPVLGH

SEQ ID NO: 80270 - protein, 26 aa, Mycobacterium avium
GKELLRRLKGLPGFGEQKARIFLALL

SEQ ID NO: 80271 - protein, 25 aa, Mycobacterium avium
GKEVPPVVVVPYFWSDQYDVKIQCL

SEQ ID NO: 80272 - protein, 20 aa, Mycobacterium avium
GKGFAGTMKRHGFRGQGASH

SEQ ID NO: 80273 - protein, 22 aa, Mycobacterium avium
GKGGEYFLRHLLGTDSNASAVP

SEQ ID NO: 80274 - protein, 18 aa, Mycobacterium avium
GKGLSRLVRQNCDEVVSI

SEQ ID NO: 80275 - protein, 18 aa, Mycobacterium avium
GKHLGVGVTSIYWYFRKK

SEQ ID NO: 80276 - protein, 27 aa, Mycobacterium avium
GKIEALLRVLEPFGIREIVQSGVVSLS

SEQ ID NO: 80277 - protein, 23 aa, Mycobacterium avium
GKIPAGGGWRMLGRTVGNRNAQA

SEQ ID NO: 80278 - protein, 19 aa, Mycobacterium avium
GKIRRAGCIEQYRQRQFTR

SEQ ID NO: 80279 - protein, 26 aa, Mycobacterium avium
GKKCYSLRIASAMAHDEGWLAEHMLI

SEQ ID NO: 80280 - protein, 28 aa, Mycobacterium avium
GKLGVGWPKEFGGLGFGPIEQSIFVNEA

SEQ ID NO: 80281 - protein, 19 aa, Mycobacterium avium
GKLPSEVFREHFLTCFISD

SEQ ID NO: 80282 - protein, 18 aa, Mycobacterium avium
GKLSRKEKVMGFGHRVYK

SEQ ID NO: 80283 - protein, 22 aa, Mycobacterium avium
GKNTFHGLLLLRHVGDLVNTGW

SEQ ID NO: 80284 - protein, 20 aa, Mycobacterium avium
GKPDYRWAKEQTEARPADDV

SEQ ID NO: 80285 - protein, 27 aa, Mycobacterium avium
GKPERLRSGWLNGIKHWQVDYHTNGSS

SEQ ID NO: 80286 - protein, 24 aa, Mycobacterium avium
GKPQRIGARFGVILASGGFDHDLA

SEQ ID NO: 80287 - protein, 21 aa, Mycobacterium avium
GKPTRAGWGVERIARAWETLM

SEQ ID NO: 80288 - protein, 22 aa, Mycobacterium avium
GKQIPATLAMDYPRLSDVAEYL

SEQ ID NO: 80289 - protein, 18 aa, Mycobacterium avium
GKQLWSWLQDGAQLYVCG

SEQ ID NO: 80290 - protein, 26 aa, Mycobacterium avium
GKQTIYRWWPTRPALVADVMLEDADR

SEQ ID NO: 80291 - protein, 20 aa, Mycobacterium avium
GKRKRTRTGFGKRKSTKRAI

SEQ ID NO: 80292 - protein, 21 aa, Mycobacterium avium
GKSATTAWLIERLQRPTLVMA

SEQ ID NO: 80293 - protein, 22 aa, Mycobacterium avium
GKSMRIFKSELREMQSENKTET

SEQ ID NO: 80294 - protein, 21 aa, Mycobacterium avium
GKSPAVFYRYFADKEDLLAAL

SEQ ID NO: 80295 - protein, 19 aa, Mycobacterium avium
GKVKEVAGAVAGRDDLMRE

SEQ ID NO: 80296 - protein, 26 aa, Mycobacterium avium
GKVTKLVPFGAFVRVEEGIEGLVHIS

SEQ ID NO: 80297 - protein, 18 aa, Mycobacterium avium
GLAAGRLSRIVISALSSG

SEQ ID NO: 80298 - protein, 18 aa, Mycobacterium avium
GLAAWGYASGISLGDGSF

SEQ ID NO: 80299 - protein, 18 aa, Mycobacterium avium
GLADIEWTVQLLQLLHAH

SEQ ID NO: 80300 - protein, 18 aa, Mycobacterium avium
GLAERVEVQVAYAIGKAA

SEQ ID NO: 80301 - protein, 20 aa, Mycobacterium avium
GLARYPRPLAPVAAAAAAGM

SEQ ID NO: 80302 - protein, 18 aa, Mycobacterium avium
GLAVPNWPVEWGGKDWTP

SEQ ID NO: 80303 - protein, 31 aa, Mycobacterium avium
GLAYEGYRVLPYCWRDETPLSNHELRMDDDV

SEQ ID NO: 80304 - protein, 17 aa, Mycobacterium avium
GLCRAKAPNRRGVHNHL

SEQ ID NO: 80305 - protein, 28 aa, Mycobacterium avium
GLDARAYRLPWPAGTTVFEIDQPRVLEF

SEQ ID NO: 80306 - protein, 24 aa, Mycobacterium avium
GLDGLRWLQDRGFDGDRVVVAGDS

SEQ ID NO: 80307 - protein, 19 aa, Mycobacterium avium
GLDHCFGPVMLHRVEATVR

SEQ ID NO: 80308 - protein, 23 aa, Mycobacterium avium
GLDREADDFFAFIADVSGANNNE

SEQ ID NO: 80309 - protein, 26 aa, Mycobacterium avium
GLDSRAYRLDWPAGTTVYEIDQPQVL

SEQ ID NO: 80310 - protein, 24 aa, Mycobacterium avium
GLDSRAYRLEWPPATTVFEVDLAK

SEQ ID NO: 80311 - protein, 29 aa, Mycobacterium avium
GLDSRAYRLPWPAGTVVYEIDQPRVIEFK

SEQ ID NO: 80312 - protein, 27 aa, Mycobacterium avium
GLEKCIGCELCAWACPADAIYVEGADN

SEQ ID NO: 80313 - protein, 25 aa, Mycobacterium avium
GLELSTGVAVAFPRSPFVTAAVAWE

SEQ ID NO: 80314 - protein, 25 aa, Mycobacterium avium
GLERIGFAAQHIWDGSAERVLAHAT

SEQ ID NO: 80315 - protein, 17 aa, Mycobacterium avium
GLERPAIEVDYEVGESV

SEQ ID NO: 80316 - protein, 19 aa, Mycobacterium avium
GLESFPPGGALVVGNHSGG

SEQ ID NO: 80317 - protein, 24 aa, Mycobacterium avium
GLFGALRFARNVLVHRDARKRVLT

SEQ ID NO: 80318 - protein, 29 aa, Mycobacterium avium
GLGAWAGPPPQWWAQRFGIEPDLAEALVC

SEQ ID NO: 80319 - protein, 18 aa, Mycobacterium avium
GLGCDLDLVELAGLAHDI

SEQ ID NO: 80320 - protein, 23 aa, Mycobacterium avium
GLGCELRHAHRLVYSEGLDVSGG

SEQ ID NO: 80321 - protein, 21 aa, Mycobacterium avium
GLGCSLVALSDIVYIAENAYL

SEQ ID NO: 80322 - protein, 19 aa, Mycobacterium avium
GLGREYALTLAREGASVVV

SEQ ID NO: 80323 - protein, 17 aa, Mycobacterium avium
GLGRRRPDIAVTILRLA

SEQ ID NO: 80324 - protein, 25 aa, Mycobacterium avium
GLGYFSNGITAFWSQLAQQLVSGPG

SEQ ID NO: 80325 - protein, 24 aa, Mycobacterium avium
GLHFCLGSALARMEARVAFEEVLK

SEQ ID NO: 80326 - protein, 23 aa, Mycobacterium avium
GLHFICRDVWLRVASTSTAWTSR

SEQ ID NO: 80327 - protein, 25 aa, Mycobacterium avium
GLIGPFRVRIPLLLSADDGHQLVDA

SEQ ID NO: 80328 - protein, 26 aa, Mycobacterium avium
GLKDPKRPSGSFIFAGPSGVGKTELS

SEQ ID NO: 80329 - protein, 20 aa, Mycobacterium avium
GLKSYRGDMINGFAPNAAVR

SEQ ID NO: 80330 - protein, 19 aa, Mycobacterium avium
GLLALAWPKEHGGGGGSVW

SEQ ID NO: 80331 - protein, 18 aa, Mycobacterium avium
GLLDACFDHLPSGGRLVA

SEQ ID NO: 80332 - protein, 20 aa, Mycobacterium avium
GLLDGHRVTTHWAFADRLAS

SEQ ID NO: 80333 - protein, 32 aa, Mycobacterium avium
GLLDGRRATSHWLTIPALKAFGVTAVPDERIV

SEQ ID NO: 80334 - protein, 25 aa, Mycobacterium avium
GLLGSLRIGNRFVHTGKPTPAGYAQ

SEQ ID NO: 80335 - protein, 21 aa, Mycobacterium avium
GLLGTRPSYELMRDCDTLLTV

SEQ ID NO: 80336 - protein, 18 aa, Mycobacterium avium
GLLPRPLTEVIFATDKDT

SEQ ID NO: 80337 - protein, 29 aa, Mycobacterium avium
GLLPRQLRPVLRLVWPVLTSLAARPVVVC

SEQ ID NO: 80338 - protein, 28 aa, Mycobacterium avium
GLLRLPQRIPSAIAMELALTGDNLSAER

SEQ ID NO: 80339 - protein, 18 aa, Mycobacterium avium
GLMHVKFGQYHVRDVKFV

SEQ ID NO: 80340 - protein, 27 aa, Mycobacterium avium
GLNAVIRAVVRTCDSRYGSSVVGFQDG

SEQ ID NO: 80341 - protein, 23 aa, Mycobacterium avium
GLNERYVREWLAGMTTGRVVDYH

SEQ ID NO: 80342 - protein, 26 aa, Mycobacterium avium
GLNFREVLNVLGLYPGDPGPLGGDFA

SEQ ID NO: 80343 - protein, 21 aa, Mycobacterium avium
GLPDGGRMVAVFADAQYVEEL

SEQ ID NO: 80344 - protein, 18 aa, Mycobacterium avium
GLPILGHIIELFRGGPDY

SEQ ID NO: 80345 - protein, 25 aa, Mycobacterium avium
GLPLCAVSLALLHAGRTVVAVTHAP

SEQ ID NO: 80346 - protein, 19 aa, Mycobacterium avium
GLPVLGMAGSVFFDEAARR

SEQ ID NO: 80347 - protein, 24 aa, Mycobacterium avium
GLPYLGLEHRAAWVEAEADGTITS

SEQ ID NO: 80348 - protein, 21 aa, Mycobacterium avium
GLQAPHWPAPYGRGASPAEQL

SEQ ID NO: 80349 - protein, 20 aa, Mycobacterium avium
GLRNLFKLSSLASFEGQLGK

SEQ ID NO: 80350 - protein, 18 aa, Mycobacterium avium
GLRYRFHSYRRDPRSSVR

SEQ ID NO: 80351 - protein, 19 aa, Mycobacterium avium
GLSPEFVRRSIVKSLPALM

SEQ ID NO: 80352 - protein, 24 aa, Mycobacterium avium
GLSVLRYAIRTEIRLITSELATDL

SEQ ID NO: 80353 - protein, 18 aa, Mycobacterium avium
GLTHRWPPGDARGRIVRL

SEQ ID NO: 80354 - protein, 18 aa, Mycobacterium avium
GLTKSTFFRHFPDKRDVL

SEQ ID NO: 80355 - protein, 18 aa, Mycobacterium avium
GLTSALCYGARPHPSYNP

SEQ ID NO: 80356 - protein, 26 aa, Mycobacterium avium
GLVALTMNLSRRWAGDGIRVNAIAPG

SEQ ID NO: 80357 - protein, 25 aa, Mycobacterium avium
GLVGLKTHCKTCLVVRREGSAIRRY

SEQ ID NO: 80358 - protein, 19 aa, Mycobacterium avium
GLVHGGVYCSMIESMASVA

SEQ ID NO: 80359 - protein, 23 aa, Mycobacterium avium
GLVRRARESAGVDLVYVNDNYGD

SEQ ID NO: 80360 - protein, 22 aa, Mycobacterium avium
GLVSGALRLTADYVANRKQFGK

SEQ ID NO: 80361 - protein, 18 aa, Mycobacterium avium
GLVSLRLPTEEELAAAGL

SEQ ID NO: 80362 - protein, 23 aa, Mycobacterium avium
GLYAKARAGEITQFTGIDSPYQP

SEQ ID NO: 80363 - protein, 24 aa, Mycobacterium avium
GMACVLHCHGARFDVVTIAAEVLQ

SEQ ID NO: 80364 - protein, 20 aa, Mycobacterium avium
GMEPYERFWVRDEITGQEFQ

SEQ ID NO: 80365 - protein, 19 aa, Mycobacterium avium
GMGELHLDILVDRMRREFK

SEQ ID NO: 80366 - protein, 27 aa, Mycobacterium avium
GMIPLYYDWLFGMVVSGANCPPTRTAF

SEQ ID NO: 80367 - protein, 19 aa, Mycobacterium avium
GMLELLLRELDVHPGDVIE

SEQ ID NO: 80368 - protein, 22 aa, Mycobacterium avium
GMLFRRKLVMFGPREVLLTSDE

SEQ ID NO: 80369 - protein, 18 aa, Mycobacterium avium
GMLKYGFDDARPVLERAS

SEQ ID NO: 80370 - protein, 21 aa, Mycobacterium avium
GMLNRIKWTVVRYKPPEGMTL

SEQ ID NO: 80371 - protein, 27 aa, Mycobacterium avium
GMLTCAIRPSGIWGRGDQTMFRKLFES

SEQ ID NO: 80372 - protein, 23 aa, Mycobacterium avium
GMPEAQLTLAHCTVYLATAPKSN

SEQ ID NO: 80373 - protein, 21 aa, Mycobacterium avium
GMPTGLWGRVVEAFAPAHVVE

SEQ ID NO: 80374 - protein, 20 aa, Mycobacterium avium
GMRARGCGHIVNISSMTGLV

SEQ ID NO: 80375 - protein, 24 aa, Mycobacterium avium
GMRFDKGYISGYFVTDAERQEAVL

SEQ ID NO: 80376 - protein, 18 aa, Mycobacterium avium
GMSELSCVAAVSHPRDAR

SEQ ID NO: 80377 - protein, 30 aa, Mycobacterium avium
GMSGARITLHAALELSRRGSGYAVAALCGA

SEQ ID NO: 80378 - protein, 21 aa, Mycobacterium avium
GMSLRSPARFLATAERVVRLW

SEQ ID NO: 80379 - protein, 19 aa, Mycobacterium avium
GMTLSQLGAEVIRVDPIGG

SEQ ID NO: 80380 - protein, 26 aa, Mycobacterium avium
GMVFQRPNPFPAMSIRDNVVAGLKLQ

SEQ ID NO: 80381 - protein, 26 aa, Mycobacterium avium
GNAPLDLFLRIIVELFRRHWSSTGQA

SEQ ID NO: 80382 - protein, 23 aa, Mycobacterium avium
GNCGVGFAPVRPGTEQWLIELME

SEQ ID NO: 80383 - protein, 19 aa, Mycobacterium avium
GNDEVRWFDIEPCYVYHPL

SEQ ID NO: 80384 - protein, 21 aa, Mycobacterium avium
GNGLARGGLRTPWVDVPIART

SEQ ID NO: 80385 - protein, 21 aa, Mycobacterium avium
GNGPLAAFVHALAGVGFDVAV

SEQ ID NO: 80386 - protein, 20 aa, Mycobacterium avium
GNKISWADLIIFAGNCALES

SEQ ID NO: 80387 - protein, 23 aa, Mycobacterium avium
GNLDPVVLLAGWPVVETAARAVV

SEQ ID NO: 80388 - protein, 25 aa, Mycobacterium avium
GNLHASVIDRGRWKDHREGETGRGR

SEQ ID NO: 80389 - protein, 17 aa, Mycobacterium avium
GNLVGTFLCNLATDLDD

SEQ ID NO: 80390 - protein, 25 aa, Mycobacterium avium
GNPDAWRPVFARLAELGIFGVAVPE

SEQ ID NO: 80391 - protein, 17 aa, Mycobacterium avium
GNPEFVFHDGVHEVRIA

SEQ ID NO: 80392 - protein, 22 aa, Mycobacterium avium
GNPHVARLLGTYEMAGADGTPE

SEQ ID NO: 80393 - protein, 23 aa, Mycobacterium avium
GNPVCAAAALAVLRVLASENLVR

SEQ ID NO: 80394 - protein, 17 aa, Mycobacterium avium
GNREFFSAVTLRPDAVP

SEQ ID NO: 80395 - protein, 26 aa, Mycobacterium avium
GNRPHCIYRGYCLQGCKVNAKASPYV

SEQ ID NO: 80396 - protein, 21 aa, Mycobacterium avium
GNRRYAEQRARAEGLADRDKF

SEQ ID NO: 80397 - protein, 24 aa, Mycobacterium avium
GNTEVKSFVQKVCNEQLTHWFEAN

SEQ ID NO: 80398 - protein, 17 aa, Mycobacterium avium
GNTGGGLDMMWNNAGIG

SEQ ID NO: 80399 - protein, 19 aa, Mycobacterium avium
GNVEYFLRLRARTDRPLAG

SEQ ID NO: 80400 - protein, 18 aa, Mycobacterium avium
GNYFAPRTSRRVLHQLYL

SEQ ID NO: 80401 - protein, 23 aa, Mycobacterium avium
GPADLPNGFAVRYQAATRPLQVG

SEQ ID NO: 80402 - protein, 19 aa, Mycobacterium avium
GPAGAPVLLAFSRRRLFAV

SEQ ID NO: 80403 - protein, 19 aa, Mycobacterium avium
GPASHYATTGPEIWADTDG

SEQ ID NO: 80404 - protein, 24 aa, Mycobacterium avium
GPATRAVVIYLEYLGTTLADLLNA

SEQ ID NO: 80405 - protein, 23 aa, Mycobacterium avium
GPATRRPIHLTGLDKTFPLYPTL

SEQ ID NO: 80406 - protein, 18 aa, Mycobacterium avium
GPDAARLRELLVGPIDDD

SEQ ID NO: 80407 - protein, 18 aa, Mycobacterium avium
GPDHGAVSRGEWRTSVGD

SEQ ID NO: 80408 - protein, 18 aa, Mycobacterium avium
GPDLRVAVLAGDQRTVDR

SEQ ID NO: 80409 - protein, 19 aa, Mycobacterium avium
GPDMPWNLLQDSAFSAVSV

SEQ ID NO: 80410 - protein, 17 aa, Mycobacterium avium
GPDRPVVLVAHGGLIAA

SEQ ID NO: 80411 - protein, 25 aa, Mycobacterium avium
GPERLPADHPLAVHFDVYQWLTVLQ

SEQ ID NO: 80412 - protein, 28 aa, Mycobacterium avium
GPFYDGAVFHRVIRGFMIQGGDPTGTGR

SEQ ID NO: 80413 - protein, 30 aa, Mycobacterium avium
GPGGGLPITYSRKVFIPVTHLCRDNCHYCT

SEQ ID NO: 80414 - protein, 19 aa, Mycobacterium avium
GPGIRPRAAGAPRWSGRSA

SEQ ID NO: 80415 - protein, 24 aa, Mycobacterium avium
GPGRPVLLMHPWPLSGQSWSAQVP

SEQ ID NO: 80416 - protein, 26 aa, Mycobacterium avium
GPGSRARFGDVLPFLVKVLAADEPLS

SEQ ID NO: 80417 - protein, 17 aa, Mycobacterium avium
GPHDVYVSMNMVRKNGL

SEQ ID NO: 80418 - protein, 25 aa, Mycobacterium avium
GPHFSFSWYRGSPIGRERKTEELSR

SEQ ID NO: 80419 - protein, 17 aa, Mycobacterium avium
GPKGGPGMREMLAITGA

SEQ ID NO: 80420 - protein, 18 aa, Mycobacterium avium
GPLAAGWHSNKFLNPVTD

SEQ ID NO: 80421 - protein, 19 aa, Mycobacterium avium
GPLDEAIRASIAIPGVIAP

SEQ ID NO: 80422 - protein, 24 aa, Mycobacterium avium
GPLIEAMGLTVGWITAESSSEERR

SEQ ID NO: 80423 - protein, 24 aa, Mycobacterium avium
GPLLRRSGVIFIRRNIGNDQLYKY

SEQ ID NO: 80424 - protein, 21 aa, Mycobacterium avium
GPLPLQVICDMMGIPEEDHQR

SEQ ID NO: 80425 - protein, 22 aa, Mycobacterium avium
GPLPPRLRVLAVVLAAEQTVVA

SEQ ID NO: 80426 - protein, 20 aa, Mycobacterium avium
GPLPVMVFIHGGGYFLGSSA

SEQ ID NO: 80427 - protein, 18 aa, Mycobacterium avium
GPMGLPELTSTKWIAWGD

SEQ ID NO: 80428 - protein, 26 aa, Mycobacterium avium
GPNAGIELADLVVLLDHFGIKSEMVS

SEQ ID NO: 80429 - protein, 23 aa, Mycobacterium avium
GPNQLGAFLFWMVRKRPALQIHL

SEQ ID NO: 80430 - protein, 19 aa, Mycobacterium avium
GPPDSRFVYLSDVLPTAWQ

SEQ ID NO: 80431 - protein, 22 aa, Mycobacterium avium
GPPGCGKTLIAKAVANSLAKKM

SEQ ID NO: 80432 - protein, 18 aa, Mycobacterium avium
GPPRRWLVVTGTNGKTTT

SEQ ID NO: 80433 - protein, 22 aa, Mycobacterium avium
GPPTLDRWVIDLAAGKVRESRI

SEQ ID NO: 80434 - protein, 23 aa, Mycobacterium avium
GPRGCGKTSSARILARSLNCVQG

SEQ ID NO: 80435 - protein, 22 aa, Mycobacterium avium
GPRKVSPLAVQMIMPNGAAAVV

SEQ ID NO: 80436 - protein, 20 aa, Mycobacterium avium
GPRQPGRIIAIASADTPLKG

SEQ ID NO: 80437 - protein, 21 aa, Mycobacterium avium
GPRRKGVRYFGPYSHAWAIRE

SEQ ID NO: 80438 - protein, 17 aa, Mycobacterium avium
GPRRLLRGLRMVGRGVL

SEQ ID NO: 80439 - protein, 25 aa, Mycobacterium avium
GPRVKRTLTANGLRQLISFISRMTT

SEQ ID NO: 80440 - protein, 17 aa, Mycobacterium avium
GPSGAGHFVKMVHNGIE

SEQ ID NO: 80441 - protein, 21 aa, Mycobacterium avium
GPTGCGKTYLAQTLAKMLNVP

SEQ ID NO: 80442 - protein, 23 aa, Mycobacterium avium
GPTLMVSDLFDFGIYVDARIEDI

SEQ ID NO: 80443 - protein, 18 aa, Mycobacterium avium
GPVDRPWRERTLHIADPD

SEQ ID NO: 80444 - protein, 17 aa, Mycobacterium avium
GPWTGPSSIAMAAAAAP

SEQ ID NO: 80445 - protein, 18 aa, Mycobacterium avium
GPYEVLRNLPGAEVRFVW

SEQ ID NO: 80446 - protein, 20 aa, Mycobacterium avium
GQAAAGIRRSGRWRGRPKNQ

SEQ ID NO: 80447 - protein, 23 aa, Mycobacterium avium
GQAAETFAILNLASAGDHIVSSP

SEQ ID NO: 80448 - protein, 20 aa, Mycobacterium avium
GQAAHVWTRTSLRPSDVDVA

SEQ ID NO: 80449 - protein, 17 aa, Mycobacterium avium
GQANSWQSLPGIGPKTA

SEQ ID NO: 80450 - protein, 19 aa, Mycobacterium avium
GQAVGGAFVRLLDSSDEFT

SEQ ID NO: 80451 - protein, 25 aa, Mycobacterium avium
GQCPPRQFERARVVVFAGDHGVARC

SEQ ID NO: 80452 - protein, 22 aa, Mycobacterium avium
GQDWGGLIGLRLAAEHPERFAR

SEQ ID NO: 80453 - protein, 24 aa, Mycobacterium avium
GQGCAITTRLLVPRDRYDEAVAAA

SEQ ID NO: 80454 - protein, 25 aa, Mycobacterium avium
GQGLMKNAYVGRTFIQPSQTIRQLG

SEQ ID NO: 80455 - protein, 17 aa, Mycobacterium avium
GQIAGLNVLRIVNEPTA

SEQ ID NO: 80456 - protein, 21 aa, Mycobacterium avium
GQIAQCLAELVTLDTPTVSVL

SEQ ID NO: 80457 - protein, 17 aa, Mycobacterium avium
GQIHDFQLAAPMVPEAR

SEQ ID NO: 80458 - protein, 23 aa, Mycobacterium avium
GQPRVSPLAYFRIDGKLLVIGSF

SEQ ID NO: 80459 - protein, 19 aa, Mycobacterium avium
GQPVPDWFCESADLAELAA

SEQ ID NO: 80460 - protein, 24 aa, Mycobacterium avium
GQQDSRYPLAPARVVADTRAALGR

SEQ ID NO: 80461 - protein, 22 aa, Mycobacterium avium
GQRRFWFMWDDLVRGAIGAVVL

SEQ ID NO: 80462 - protein, 24 aa, Mycobacterium avium
GQVAQRYAAVYGYDERAMAKIVVD

SEQ ID NO: 80463 - protein, 27 aa, Mycobacterium avium
GQVLKEIQSRLGFLLDVGLEYLSLSRA

SEQ ID NO: 80464 - protein, 17 aa, Mycobacterium avium
GQYTQFWQNLIGGATGS

SEQ ID NO: 80465 - protein, 33 aa, Mycobacterium avium
GRAAVLAPRLWVPDEFGLCRYLAAGLAVVHAVD

SEQ ID NO: 80466 - protein, 21 aa, Mycobacterium avium
GRAKIPITVQVGAPLRAREDI

SEQ ID NO: 80467 - protein, 24 aa, Mycobacterium avium
GRAKIVKFSGCYHGHVDALLADAG

SEQ ID NO: 80468 - protein, 18 aa, Mycobacterium avium
GRAMAAGGQAVFELAPQG

SEQ ID NO: 80469 - protein, 19 aa, Mycobacterium avium
GRARWYRNRWVRTAHVCAA

SEQ ID NO: 80470 - protein, 24 aa, Mycobacterium avium
GRAVAVNLLLPFTRRRHVAVCVEA

SEQ ID NO: 80471 - protein, 22 aa, Mycobacterium avium
GRCKRARVALPGGDAIGSRPLD

SEQ ID NO: 80472 - protein, 20 aa, Mycobacterium avium
GRDDLALRIAVQPGGCAGLR

SEQ ID NO: 80473 - protein, 20 aa, Mycobacterium avium
GRDFTVDWVHLKLNDQAQRT

SEQ ID NO: 80474 - protein, 19 aa, Mycobacterium avium
GRDGFALIDVIRDWGDIGI

SEQ ID NO: 80475 - protein, 25 aa, Mycobacterium avium
GRDPDSVRVWSCFATVGDHLPEQLR

SEQ ID NO: 80476 - protein, 20 aa, Mycobacterium avium
GREAYPGDVFYLHSRLLERC

SEQ ID NO: 80477 - protein, 25 aa, Mycobacterium avium
GRELFIEKVWDWKRESGGAIGGQMR

SEQ ID NO: 80478 - protein, 21 aa, Mycobacterium avium
GREQFRPVAPMVLAERAAEIF

SEQ ID NO: 80479 - protein, 18 aa, Mycobacterium avium
GRERGYCLMIGGDEEAFA

SEQ ID NO: 80480 - protein, 18 aa, Mycobacterium avium
GRFELGLGAGSWPAEFAR

SEQ ID NO: 80481 - protein, 19 aa, Mycobacterium avium
GRFTLGLGASGPQVIEGFH

SEQ ID NO: 80482 - protein, 18 aa, Mycobacterium avium
GRGADVWDELHPTADQQV

SEQ ID NO: 80483 - protein, 20 aa, Mycobacterium avium
GRGLSKATLFGPVEVAEHYG

SEQ ID NO: 80484 - protein, 24 aa, Mycobacterium avium
GRGRDAVRILPGLITTIGSSRAEA

SEQ ID NO: 80485 - protein, 24 aa, Mycobacterium avium
GRGVTVGRPLGLLLTRRSENATVT

SEQ ID NO: 80486 - protein, 25 aa, Mycobacterium avium
GRHLAFSGGRHFCLGAALARAEGEV

SEQ ID NO: 80487 - protein, 25 aa, Mycobacterium avium
GRHLLESWIPLLALAAHDRGRDWSA

SEQ ID NO: 80488 - protein, 17 aa, Mycobacterium avium
GRHRGFVVLRWLDNPSP

SEQ ID NO: 80489 - protein, 25 aa, Mycobacterium avium
GRIDRRGRMLWSLPKGHIELGETAE

SEQ ID NO: 80490 - protein, 22 aa, Mycobacterium avium
GRIFAMAVQTAVDWSEAADRGR

SEQ ID NO: 80491 - protein, 30 aa, Mycobacterium avium
GRIGRGEHPSLCLFASWAAPDSPAGRRLTA

SEQ ID NO: 80492 - protein, 27 aa, Mycobacterium avium
GRILGVKGRVLPMCPIALQIEADVSGL

SEQ ID NO: 80493 - protein, 22 aa, Mycobacterium avium
GRILRVRGRGVPKRSGGHGDLL

SEQ ID NO: 80494 - protein, 22 aa, Mycobacterium avium
GRILTAMSVFFFGLVDAPNHLA

SEQ ID NO: 80495 - protein, 24 aa, Mycobacterium avium
GRIPLPVPGFGVWALDSLRRANRY

SEQ ID NO: 80496 - protein, 18 aa, Mycobacterium avium
GRISLRTQVPLLLDEYTR

SEQ ID NO: 80497 - protein, 19 aa, Mycobacterium avium
GRITGVFTPAGIDSCGTLE

SEQ ID NO: 80498 - protein, 24 aa, Mycobacterium avium
GRITLWRDYFDFFDMLKATARGVA

SEQ ID NO: 80499 - protein, 19 aa, Mycobacterium avium
GRLAGRGFAAYGTAKAALS

SEQ ID NO: 80500 - protein, 23 aa, Mycobacterium avium
GRLDPKDLFGWQANASADRLTTP

SEQ ID NO: 80501 - protein, 21 aa, Mycobacterium avium
GRLILADAIVRACEDNPDYLI

SEQ ID NO: 80502 - protein, 17 aa, Mycobacterium avium
GRLILGIGSGWKQKDYD

SEQ ID NO: 80503 - protein, 17 aa, Mycobacterium avium
GRLPHTIRYTAQGLGRV

SEQ ID NO: 80504 - protein, 23 aa, Mycobacterium avium
GRLPKDRLSDMVRRILRSIFAVG

SEQ ID NO: 80505 - protein, 23 aa, Mycobacterium avium
GRLPRAPHALRIPAAENRLDTGG

SEQ ID NO: 80506 - protein, 24 aa, Mycobacterium avium
GRLPRPDGKLAHAAVRINGFMVML

SEQ ID NO: 80507 - protein, 17 aa, Mycobacterium avium
GRLVGGVGADWAYATGW

SEQ ID NO: 80508 - protein, 20 aa, Mycobacterium avium
GRNDIRIEAALAKLWSSEMA

SEQ ID NO: 80509 - protein, 19 aa, Mycobacterium avium
GRNQLRVGMFPAVDPDDVS

SEQ ID NO: 80510 - protein, 18 aa, Mycobacterium avium
GRNVWRTDLAAALDKLTT

SEQ ID NO: 80511 - protein, 22 aa, Mycobacterium avium
GRPDELAGIYLYLASAASSYMT

SEQ ID NO: 80512 - protein, 21 aa, Mycobacterium avium
GRPLFAANLALPWPEDPLAAL

SEQ ID NO: 80513 - protein, 20 aa, Mycobacterium avium
GRPNPDFEVRILDAHGNSLP

SEQ ID NO: 80514 - protein, 25 aa, Mycobacterium avium
GRQARRFVADFGIERFYDVGRHGIC

SEQ ID NO: 80515 - protein, 19 aa, Mycobacterium avium
GRQGRRGRRFRDRRRRGER

SEQ ID NO: 80516 - protein, 20 aa, Mycobacterium avium
GRRIASMIPGARFEVMPGCG

SEQ ID NO: 80517 - protein, 31 aa, Mycobacterium avium
GRRKLLGRREILPGVGLYLDGGFGVGKTHLL

SEQ ID NO: 80518 - protein, 19 aa, Mycobacterium avium
GRRLAEPGPYSMLEVLAPT

SEQ ID NO: 80519 - protein, 25 aa, Mycobacterium avium
GRRLRRAIPKYGFRPVVMPRPPAAG

SEQ ID NO: 80520 - protein, 25 aa, Mycobacterium avium
GRRRPDIAVTILRLANMIGPAMDTT

SEQ ID NO: 80521 - protein, 24 aa, Mycobacterium avium
GRRRVAMLRDWLDAELAEASENIL

SEQ ID NO: 80522 - protein, 23 aa, Mycobacterium avium
GRRSAESLYDFNLATYDEGDSFD

SEQ ID NO: 80523 - protein, 23 aa, Mycobacterium avium
GRSELRLAAEAVLDALDDAGLSP

SEQ ID NO: 80524 - protein, 29 aa, Mycobacterium avium
GRSGEPFPYPVTVGYMYIMKLHHLVDDKI

SEQ ID NO: 80525 - protein, 17 aa, Mycobacterium avium
GRSGGKRVLVRDIHEYT

SEQ ID NO: 80526 - protein, 24 aa, Mycobacterium avium
GRSGRLRWRWLAGCDARPVDSAGH

SEQ ID NO: 80527 - protein, 22 aa, Mycobacterium avium
GRTRDVEWRKRQLLQLQKLMEE

SEQ ID NO: 80528 - protein, 27 aa, Mycobacterium avium
GRVERMHRACLILTFGGGTNEVQRDII

SEQ ID NO: 80529 - protein, 17 aa, Mycobacterium avium
GRVGVCAATSGPGAIHL

SEQ ID NO: 80530 - protein, 20 aa, Mycobacterium avium
GRVKQMLLKIGWPAEDLAGY

SEQ ID NO: 80531 - protein, 23 aa, Mycobacterium avium
GRVNGRPGLLLGTRDAEQTHVSL

SEQ ID NO: 80532 - protein, 18 aa, Mycobacterium avium
GRVSFSRTANDWATLLDG

SEQ ID NO: 80533 - protein, 24 aa, Mycobacterium avium
GRYDEPRKGMAVLLDALPRLVERF

SEQ ID NO: 80534 - protein, 22 aa, Mycobacterium avium
GRYLGCVPLQRLLREAPAELVG

SEQ ID NO: 80535 - protein, 24 aa, Mycobacterium avium
GRYPDKRSALLPLLHLVQSQDSYL

SEQ ID NO: 80536 - protein, 20 aa, Mycobacterium avium
GSAIAQHWMYDGKHVLIVFD

SEQ ID NO: 80537 - protein, 19 aa, Mycobacterium avium
GSALLSDIHRSDCQILLVD

SEQ ID NO: 80538 - protein, 23 aa, Mycobacterium avium
GSAVKLPGGLWIVTERGVATESG

SEQ ID NO: 80539 - protein, 21 aa, Mycobacterium avium
GSCSWKIYVKDGIITWETQQT

SEQ ID NO: 80540 - protein, 20 aa, Mycobacterium avium
GSCVPLLKQLLEAEGVEQSK

SEQ ID NO: 80541 - protein, 26 aa, Mycobacterium avium
GSDGQWRLSPKAMRRLGETALRDVAQ

SEQ ID NO: 80542 - protein, 21 aa, Mycobacterium avium
GSDSLLRMRLDLEECATGVTK

SEQ ID NO: 80543 - protein, 19 aa, Mycobacterium avium
GSEGWRRYVALVVDAISVD

SEQ ID NO: 80544 - protein, 19 aa, Mycobacterium avium
GSFAGAPVSPAWVHNLRAN

SEQ ID NO: 80545 - protein, 17 aa, Mycobacterium avium
GSGARIMTTLLYHMRDK

SEQ ID NO: 80546 - protein, 17 aa, Mycobacterium avium
GSGELTLEDFLEQMLAI

SEQ ID NO: 80547 - protein, 32 aa, Mycobacterium avium
GSGFAIAQARLGPGRIHHCMRALGGAERALAL

SEQ ID NO: 80548 - protein, 24 aa, Mycobacterium avium
GSGGPPRWDLRVLTSIEVSATAAE

SEQ ID NO: 80549 - protein, 21 aa, Mycobacterium avium
GSGKGSPEWWVVNVKPGRVLF

SEQ ID NO: 80550 - protein, 25 aa, Mycobacterium avium
GSHRLGHACVLAFLDVDGLKQVNDE

SEQ ID NO: 80551 - protein, 23 aa, Mycobacterium avium
GSIASESLVGWANSVGVDGRDPY

SEQ ID NO: 80552 - protein, 27 aa, Mycobacterium avium
GSITYNEWSFAVGKQLSMASIITSAGP

SEQ ID NO: 80553 - protein, 24 aa, Mycobacterium avium
GSLGHERVMLWMGYVDLLHELSAD

SEQ ID NO: 80554 - protein, 18 aa, Mycobacterium avium
GSLGMLFDTVLGLTASVL

SEQ ID NO: 80555 - protein, 20 aa, Mycobacterium avium
GSLLLPPWVLTRYGPDGVEM

SEQ ID NO: 80556 - protein, 23 aa, Mycobacterium avium
GSLRLKRGMAAWVAADDAPIRLV

SEQ ID NO: 80557 - protein, 19 aa, Mycobacterium avium
GSMGGARALEWIVGHPSRV

SEQ ID NO: 80558 - protein, 18 aa, Mycobacterium avium
GSMGKAALVGSMSVPQGW

SEQ ID NO: 80559 - protein, 21 aa, Mycobacterium avium
GSPEHARLFGLPVTGPAHPTP

SEQ ID NO: 80560 - protein, 23 aa, Mycobacterium avium
GSPFWLRTARTLSFDPLTDVHTF

SEQ ID NO: 80561 - protein, 19 aa, Mycobacterium avium
GSPGAFQGSFSYLLQDEDG

SEQ ID NO: 80562 - protein, 17 aa, Mycobacterium avium
GSPVCPECKQIYDRLKK

SEQ ID NO: 80563 - protein, 24 aa, Mycobacterium avium
GSRMAGFAAAFGMEVIAWSQNLTD

SEQ ID NO: 80564 - protein, 25 aa, Mycobacterium avium
GSSDLRRWLPLDIGRPFKSTLITLD

SEQ ID NO: 80565 - protein, 19 aa, Mycobacterium avium
GSSIMPGKVNPVIPEAVTQ

SEQ ID NO: 80566 - protein, 23 aa, Mycobacterium avium
GSSPMCYPVGDFLVGDRDVLLGV

SEQ ID NO: 80567 - protein, 22 aa, Mycobacterium avium
GSSRPPRLVRLIHRGSRLAKKS

SEQ ID NO: 80568 - protein, 24 aa, Mycobacterium avium
GSTGERGLHHLIWEVVDNSVDEAM

SEQ ID NO: 80569 - protein, 20 aa, Mycobacterium avium
GSTPKALRLYGIEDSAYSSE

SEQ ID NO: 80570 - protein, 18 aa, Mycobacterium avium
GSTPTASGKTVWAIIGPE

SEQ ID NO: 80571 - protein, 17 aa, Mycobacterium avium
GSTPWLVHGYQAIRALF

SEQ ID NO: 80572 - protein, 22 aa, Mycobacterium avium
GSTWVLSLSAGRLVAADHIGGA

SEQ ID NO: 80573 - protein, 25 aa, Mycobacterium avium
GSVARLRFGPATHRKVKKWLVDGDF

SEQ ID NO: 80574 - protein, 22 aa, Mycobacterium avium
GSVCWYAPELGVVFSGDTLFSG

SEQ ID NO: 80575 - protein, 18 aa, Mycobacterium avium
GSVKRFTALLSNAETIFW

SEQ ID NO: 80576 - protein, 18 aa, Mycobacterium avium
GSYCGKLLLDAGAQVRKI

SEQ ID NO: 80577 - protein, 18 aa, Mycobacterium avium
GTAELLGAMSAALKPAPA

SEQ ID NO: 80578 - protein, 23 aa, Mycobacterium avium
GTALTEGITWGWETYPEYLDAIG

SEQ ID NO: 80579 - protein, 18 aa, Mycobacterium avium
GTALWLESAVEQLIPAGD

SEQ ID NO: 80580 - protein, 25 aa, Mycobacterium avium
GTAQEKASVLSFVLAGHEPLEVGKA

SEQ ID NO: 80581 - protein, 18 aa, Mycobacterium avium
GTARRLRVGAVGLIRSWR

SEQ ID NO: 80582 - protein, 29 aa, Mycobacterium avium
GTCAEELQARLRLAIGRRRGGLDGTLKFG

SEQ ID NO: 80583 - protein, 29 aa, Mycobacterium avium
GTDEQKKWAVMAAERGWGSTMVLTEPDAG

SEQ ID NO: 80584 - protein, 20 aa, Mycobacterium avium
GTDHCDWIILGAMLGDEQGV

SEQ ID NO: 80585 - protein, 19 aa, Mycobacterium avium
GTEQWLIELMEGVEDIPGT

SEQ ID NO: 80586 - protein, 24 aa, Mycobacterium avium
GTESGYRAGLLASIAASCTASYTV

SEQ ID NO: 80587 - protein, 24 aa, Mycobacterium avium
GTGEFLCVYWPSRGQEAIAAAMGV

SEQ ID NO: 80588 - protein, 17 aa, Mycobacterium avium
GTGGFGDKGYWAITKHK

SEQ ID NO: 80589 - protein, 22 aa, Mycobacterium avium
GTGKRLTTAVLDISVEGDVIAA

SEQ ID NO: 80590 - protein, 19 aa, Mycobacterium avium
GTGRWASIIPQTWIHSLRP

SEQ ID NO: 80591 - protein, 18 aa, Mycobacterium avium
GTGTSGYQAADWLREHAR

SEQ ID NO: 80592 - protein, 17 aa, Mycobacterium avium
GTHPGALAEQWAGLERL

SEQ ID NO: 80593 - protein, 28 aa, Mycobacterium avium
GTHRLLQTGVRWKDLGLVVVDEEQRFGV

SEQ ID NO: 80594 - protein, 19 aa, Mycobacterium avium
GTINLCIISPTGLIRDTFE

SEQ ID NO: 80595 - protein, 19 aa, Mycobacterium avium
GTIRGDFGLETQFNLVHGS

SEQ ID NO: 80596 - protein, 17 aa, Mycobacterium avium
GTITPFAMIQLADRGQF

SEQ ID NO: 80597 - protein, 25 aa, Mycobacterium avium
GTKGKRYALPHARILMHQPLGGVTG

SEQ ID NO: 80598 - protein, 20 aa, Mycobacterium avium
GTKVPGWARPLATAEPEDVA

SEQ ID NO: 80599 - protein, 18 aa, Mycobacterium avium
GTLDLFYPECLEYARRLR

SEQ ID NO: 80600 - protein, 19 aa, Mycobacterium avium
GTLPLLAPMSEVAGRLSAQ

SEQ ID NO: 80601 - protein, 23 aa, Mycobacterium avium
GTMTRGPWGAAMGGQIVGGLLGW

SEQ ID NO: 80602 - protein, 40 aa, Mycobacterium avium
GTPEEPRGVPVFAWKGETLEEYWWAAEQALTWPPLADGTE

SEQ ID NO: 80603 - protein, 30 aa, Mycobacterium avium
GTPEQKQRWAVPILRAEMTASLGMSEPGAG

SEQ ID NO: 80604 - protein, 22 aa, Mycobacterium avium
GTPIPSCARGTLKRVEAALADA

SEQ ID NO: 80605 - protein, 17 aa, Mycobacterium avium
GTPSIFQETAFRFTDGS

SEQ ID NO: 80606 - protein, 28 aa, Mycobacterium avium
GTPVDLRYLGSLTHGFANLFQLGGDSMV

SEQ ID NO: 80607 - protein, 20 aa, Mycobacterium avium
GTPWRARQAGVLLAGDVNGL

SEQ ID NO: 80608 - protein, 21 aa, Mycobacterium avium
GTQKRLAVWLVDDPARVPGIA

SEQ ID NO: 80609 - protein, 20 aa, Mycobacterium avium
GTRSAWDYGPLGVEFKENIK

SEQ ID NO: 80610 - protein, 19 aa, Mycobacterium avium
GTSGMRKNELIAAIKEVRG

SEQ ID NO: 80611 - protein, 19 aa, Mycobacterium avium
GTTMKRAVERFDVNVIGLT

SEQ ID NO: 80612 - protein, 18 aa, Mycobacterium avium
GTVAFAWGGLSHVPLTRS

SEQ ID NO: 80613 - protein, 25 aa, Mycobacterium avium
GTVAKWKLQATKSRVRDVQVDVDVA

SEQ ID NO: 80614 - protein, 20 aa, Mycobacterium avium
GTVFAPRVLREYALLADGER

SEQ ID NO: 80615 - protein, 17 aa, Mycobacterium avium
GTVKQLPEELAREAHDW

SEQ ID NO: 80616 - protein, 17 aa, Mycobacterium avium
GTVLVEWLNVSGGIDAA

SEQ ID NO: 80617 - protein, 27 aa, Mycobacterium avium
GTVRNWPWRRWALSWTANTYARLALGI

SEQ ID NO: 80618 - protein, 19 aa, Mycobacterium avium
GTYCGKSTLFLGAAAQQTG

SEQ ID NO: 80619 - protein, 25 aa, Mycobacterium avium
GTYYKGHLYIAGRIKDLVIIDGRNH

SEQ ID NO: 80620 - protein, 20 aa, Mycobacterium avium
GVAELARRFGVRVVSDEIHA

SEQ ID NO: 80621 - protein, 20 aa, Mycobacterium avium
GVALSLVYRDGRLERAATRG

SEQ ID NO: 80622 - protein, 19 aa, Mycobacterium avium
GVCAARIVLVGARTRDGEL

SEQ ID NO: 80623 - protein, 26 aa, Mycobacterium avium
GVDAKWAASISGYWRRGRTEETFRQW

SEQ ID NO: 80624 - protein, 23 aa, Mycobacterium avium
GVDEARALYEWNHAKQILRIQAG

SEQ ID NO: 80625 - protein, 24 aa, Mycobacterium avium
GVDGFPNLFLVSGPGAPAVLANMV

SEQ ID NO: 80626 - protein, 19 aa, Mycobacterium avium
GVEARRFWRDEYQLNAQIS

SEQ ID NO: 80627 - protein, 23 aa, Mycobacterium avium
GVEEARKGFFRVPLIRGTITHPV

SEQ ID NO: 80628 - protein, 20 aa, Mycobacterium avium
GVEVHWVYRGGRADLVPEDR

SEQ ID NO: 80629 - protein, 18 aa, Mycobacterium avium
GVEWKDIQAATGGSWTVA

SEQ ID NO: 80630 - protein, 17 aa, Mycobacterium avium
GVFRGALEAGARRITEK

SEQ ID NO: 80631 - protein, 24 aa, Mycobacterium avium
GVGDAFRAGFLTGRSAGLNLERSA

SEQ ID NO: 80632 - protein, 33 aa, Mycobacterium avium
GVGDRVGIAWLRHTCGVCKYCRRGDENLCPESR

SEQ ID NO: 80633 - protein, 25 aa, Mycobacterium avium
GVGEIWRRIRAANLPVALSDRLTLD

SEQ ID NO: 80634 - protein, 19 aa, Mycobacterium avium
GVGKWNLDLGDLVPALSVR

SEQ ID NO: 80635 - protein, 22 aa, Mycobacterium avium
GVGRPQFSAVVECASAARELGG

SEQ ID NO: 80636 - protein, 26 aa, Mycobacterium avium
GVGTFSWPGAYGTWWQADPTAELILI

SEQ ID NO: 80637 - protein, 17 aa, Mycobacterium avium
GVGTLVMTHYVPALVAG

SEQ ID NO: 80638 - protein, 18 aa, Mycobacterium avium
GVHPNGADAWALQDVMAL

SEQ ID NO: 80639 - protein, 17 aa, Mycobacterium avium
GVHRVQRVPVTESQGRV

SEQ ID NO: 80640 - protein, 17 aa, Mycobacterium avium
GVIGPRTRMRWEQVADW

SEQ ID NO: 80641 - protein, 24 aa, Mycobacterium avium
GVIKPGHVAAVRFTINGVYRGETR

SEQ ID NO: 80642 - protein, 23 aa, Mycobacterium avium
GVIWGIDSFDQWGVELGKTQAKA

SEQ ID NO: 80643 - protein, 35 aa, Mycobacterium avium
GVKFKDAELLGVPWIVVVGRGWADGVVELRDRFAG

SEQ ID NO: 80644 - protein, 20 aa, Mycobacterium avium
GVKNYPAYFGFLKSKLRTGG

SEQ ID NO: 80645 - protein, 25 aa, Mycobacterium avium
GVLAGQARFTPQLTLAYRDAVAVVD

SEQ ID NO: 80646 - protein, 17 aa, Mycobacterium avium
GVLDRLGVRSVDLVAHD

SEQ ID NO: 80647 - protein, 38 aa, Mycobacterium avium
GVLERGLLLRLRFELDHHINLRPGRLYPGVSSPLAGNP

SEQ ID NO: 80648 - protein, 23 aa, Mycobacterium avium
GVLPERLHRCLVSSPEFAENLAR

SEQ ID NO: 80649 - protein, 20 aa, Mycobacterium avium
GVLRRLAAMRSYMRDINLGR

SEQ ID NO: 80650 - protein, 17 aa, Mycobacterium avium
GVNEVMREMIAAAGLKV

SEQ ID NO: 80651 - protein, 25 aa, Mycobacterium avium
GVPAQRLTATVLRFNGFAAAGVDED

SEQ ID NO: 80652 - protein, 17 aa, Mycobacterium avium
GVPDGRGLALFISGDNL

SEQ ID NO: 80653 - protein, 18 aa, Mycobacterium avium
GVPLIEIVTKPIVGAGER

SEQ ID NO: 80654 - protein, 22 aa, Mycobacterium avium
GVPPERIDTIISFEKAAEVGAK

SEQ ID NO: 80655 - protein, 19 aa, Mycobacterium avium
GVPVPRYAEINSLDELDAF

SEQ ID NO: 80656 - protein, 25 aa, Mycobacterium avium
GVRACGICGSDLHFAAHGAQVLQMS

SEQ ID NO: 80657 - protein, 24 aa, Mycobacterium avium
GVRDELPHSLAVVIDEVNPREDRD

SEQ ID NO: 80658 - protein, 21 aa, Mycobacterium avium
GVRLSRSFGARGWSPHTYYFA

SEQ ID NO: 80659 - protein, 20 aa, Mycobacterium avium
GVSALRLVQRAFTPDPDDDE

SEQ ID NO: 80660 - protein, 25 aa, Mycobacterium avium
GVSSRFKAPFVFTGGTIARVTLDLS

SEQ ID NO: 80661 - protein, 29 aa, Mycobacterium avium
GVTAPAGFRAAGIAAGIKASGKRDLALVF

SEQ ID NO: 80662 - protein, 23 aa, Mycobacterium avium
GVTKSGLSIREWLISLREAGLDT

SEQ ID NO: 80663 - protein, 17 aa, Mycobacterium avium
GVTRGSFYWHFEDIDNY

SEQ ID NO: 80664 - protein, 28 aa, Mycobacterium avium
GVTSCLSCADLHRRDRDAAWPVICAQLR

SEQ ID NO: 80665 - protein, 20 aa, Mycobacterium avium
GVVARQLWRDSGCKPQDIQT

SEQ ID NO: 80666 - protein, 17 aa, Mycobacterium avium
GVVDARFVAVPLANSLR

SEQ ID NO: 80667 - protein, 20 aa, Mycobacterium avium
GVVEKLGPMARMLKAVLHDT

SEQ ID NO: 80668 - protein, 17 aa, Mycobacterium avium
GVVENMSGLTLPDGSTL

SEQ ID NO: 80669 - protein, 24 aa, Mycobacterium avium
GVVGDAVAVFPSWETLPHERLSPG

SEQ ID NO: 80670 - protein, 25 aa, Mycobacterium avium
GVVGRRAADCAFAHAGLRRDDVDVL

SEQ ID NO: 80671 - protein, 19 aa, Mycobacterium avium
GVVMARYILELEPFASLPP

SEQ ID NO: 80672 - protein, 23 aa, Mycobacterium avium
GVVMTDGLPWTWETFPEYLDTLE

SEQ ID NO: 80673 - protein, 27 aa, Mycobacterium avium
GVWISKLFPQRMFKKVNQLRAFEGYND

SEQ ID NO: 80674 - protein, 22 aa, Mycobacterium avium
GVYRFLLKRNRRLYGVAYTLDN

SEQ ID NO: 80675 - protein, 20 aa, Mycobacterium avium
GWADGVVELRDRFAGQTREL

SEQ ID NO: 80676 - protein, 21 aa, Mycobacterium avium
GWAGVRWRNLTGGIVALHAAH

SEQ ID NO: 80677 - protein, 23 aa, Mycobacterium avium
GWDQRAPIGWNMKDPTPVAKTVC

SEQ ID NO: 80678 - protein, 19 aa, Mycobacterium avium
GWHDARVIPYGPIELDPSA

SEQ ID NO: 80679 - protein, 24 aa, Mycobacterium avium
GWHKICVERGILPGMQELVRRIGD

SEQ ID NO: 80680 - protein, 17 aa, Mycobacterium avium
GWLRGPDGLRFLTGNLV

SEQ ID NO: 80681 - protein, 24 aa, Mycobacterium avium
GWSAYPRVLDFAAFASIADEVGAK

SEQ ID NO: 80682 - protein, 19 aa, Mycobacterium avium
GWVGINCLTGQHWLDVCAM

SEQ ID NO: 80683 - protein, 25 aa, Mycobacterium avium
GYAIPQQWGGLGLNLMQDVELAMEL

SEQ ID NO: 80684 - protein, 20 aa, Mycobacterium avium
GYCRHMGGDLSRGEVKGNEI

SEQ ID NO: 80685 - protein, 27 aa, Mycobacterium avium
GYDESLWRLLCEQVGAAALVIPEELGG

SEQ ID NO: 80686 - protein, 38 aa, Mycobacterium avium
GYFRPDLDVDLVYRFIRDTTWVSVRWYQPGGPLTAEQV

SEQ ID NO: 80687 - protein, 24 aa, Mycobacterium avium
GYIEARPAITLSWIRELPSLGAAA

SEQ ID NO: 80688 - protein, 20 aa, Mycobacterium avium
GYLEREWKPEAEGGFSRVQR

SEQ ID NO: 80689 - protein, 18 aa, Mycobacterium avium
GYMAKIFNDAWMSSYGFL

SEQ ID NO: 80690 - protein, 25 aa, Mycobacterium avium
GYQVPEFRRKAVMIAVGGVYDPRIH

SEQ ID NO: 80691 - protein, 23 aa, Mycobacterium avium
GYRVLCPDLRGAGWSSAPRSSYR

SEQ ID NO: 80692 - protein, 18 aa, Mycobacterium avium
GYTPRPADVADLIGALHR

SEQ ID NO: 80693 - protein, 20 aa, Mycobacterium avium
GYTRLSWAVLNWNTDAIALY

SEQ ID NO: 80694 - protein, 18 aa, Mycobacterium avium
GYVRLCVMAPRQWHGLRR

SEQ ID NO: 80695 - protein, 24 aa, Mycobacterium avium
GYYQIRGGIPYAIAKSLAAAPFAD

SEQ ID NO: 80696 - protein, 24 aa, Mycobacterium avium
HAAEGFPSLSCIVLNGGFALHPSI

SEQ ID NO: 80697 - protein, 19 aa, Mycobacterium avium
HAAERGEPVILVRDHTRPE

SEQ ID NO: 80698 - protein, 19 aa, Mycobacterium avium
HAAEVLALLGPNGAGKTTT

SEQ ID NO: 80699 - protein, 17 aa, Mycobacterium avium
HAAFGREDYWLARIAPA

SEQ ID NO: 80700 - protein, 17 aa, Mycobacterium avium
HAAVAPHLGVNALDAVT

SEQ ID NO: 80701 - protein, 19 aa, Mycobacterium avium
HAAVFPACRAVVHHGGSGT

SEQ ID NO: 80702 - protein, 18 aa, Mycobacterium avium
HAAVRINGFMVMLNDDFP

SEQ ID NO: 80703 - protein, 26 aa, Mycobacterium avium
HADAFPLLITHGWPGSIVEFHKVIEP

SEQ ID NO: 80704 - protein, 17 aa, Mycobacterium avium
HADCAKVGITSIRRDLP

SEQ ID NO: 80705 - protein, 24 aa, Mycobacterium avium
HADDPRLRRMAVFDVLVNNADRKG

SEQ ID NO: 80706 - protein, 27 aa, Mycobacterium avium
HADHCLDLPGLFVWRRYHPTRPLGKAM

SEQ ID NO: 80707 - protein, 21 aa, Mycobacterium avium
HAEHIRYSFELAQRANEQGAL

SEQ ID NO: 80708 - protein, 25 aa, Mycobacterium avium
HAGGLPRPLMVVTMGLPASGKTTLA

SEQ ID NO: 80709 - protein, 24 aa, Mycobacterium avium
HAGHIPGAIKLDWRSDLQDPVKRD

SEQ ID NO: 80710 - protein, 23 aa, Mycobacterium avium
HAGRGRPAKRYRLTSAGRAKLDH

SEQ ID NO: 80711 - protein, 26 aa, Mycobacterium avium
HAKAEVLKLINWELASSDGHALGPAD

SEQ ID NO: 80712 - protein, 17 aa, Mycobacterium avium
HAKEQKAKVLAICNTNG

SEQ ID NO: 80713 - protein, 18 aa, Mycobacterium avium
HALALLLAAAREIPAADA

SEQ ID NO: 80714 - protein, 22 aa, Mycobacterium avium
HALAQGADWVWLADDDGRPQDA

SEQ ID NO: 80715 - protein, 20 aa, Mycobacterium avium
HALDGIKRPLIVFTPKSMLR

SEQ ID NO: 80716 - protein, 29 aa, Mycobacterium avium
HAMLTAAGRRSLLCGNIGSPVLDVLDQPA

SEQ ID NO: 80717 - protein, 29 aa, Mycobacterium avium
HAMSPLDFLARPSAWLRLISDVRATHTPV

SEQ ID NO: 80718 - protein, 22 aa, Mycobacterium avium
HANRGKRSIGLDISVPEGKEVL

SEQ ID NO: 80719 - protein, 20 aa, Mycobacterium avium
HAPRTATEWDARRDGPPLLV

SEQ ID NO: 80720 - protein, 22 aa, Mycobacterium avium
HASRDWKAFEPLIGHARSDAVR

SEQ ID NO: 80721 - protein, 25 aa, Mycobacterium avium
HAVARLRTVRDLELRLVAKVEPNGP

SEQ ID NO: 80722 - protein, 24 aa, Mycobacterium avium
HAVDPRPSVDLGLLADELDAEALR

SEQ ID NO: 80723 - protein, 23 aa, Mycobacterium avium
HAVQQRMAKMLARAVDEVAEMQA

SEQ ID NO: 80724 - protein, 18 aa, Mycobacterium avium
HCDVWEGFVFVNFAKTPE

SEQ ID NO: 80725 - protein, 25 aa, Mycobacterium avium
HCFGCGEGGDVYAFLQKIEHVSFVE

SEQ ID NO: 80726 - protein, 17 aa, Mycobacterium avium
HCGPSGAGHFVKMVHNG

SEQ ID NO: 80727 - protein, 25 aa, Mycobacterium avium
HDAHLYLRRAHAIGRFLGGAERWLR

SEQ ID NO: 80728 - protein, 18 aa, Mycobacterium avium
HDALDPFVALGFAAATTS

SEQ ID NO: 80729 - protein, 24 aa, Mycobacterium avium
HDAYQWLRLRGYQPDQIVLAGDSA

SEQ ID NO: 80730 - protein, 25 aa, Mycobacterium avium
HDDGPRPTLCVIHGFLGSSYLANGR

SEQ ID NO: 80731 - protein, 23 aa, Mycobacterium avium
HDEGWLAEHMLILKLISPENKAY

SEQ ID NO: 80732 - protein, 18 aa, Mycobacterium avium
HDELPFQTLMTGYGLTEA

SEQ ID NO: 80733 - protein, 17 aa, Mycobacterium avium
HDGPQILLCIQGCTTVH

SEQ ID NO: 80734 - protein, 27 aa, Mycobacterium avium
HDHERIAPLIADWADDLGRPIDVALQE

SEQ ID NO: 80735 - protein, 19 aa, Mycobacterium avium
HDHHSRRGLLLLVGRRRRL

SEQ ID NO: 80736 - protein, 18 aa, Mycobacterium avium
HDLDVWSLTDLVAYSTGA

SEQ ID NO: 80737 - protein, 18 aa, Mycobacterium avium
HDPLVMRRALEYATGLGV

SEQ ID NO: 80738 - protein, 23 aa, Mycobacterium avium
HDPPCRRARITLLQPTRNAKSNY

SEQ ID NO: 80739 - protein, 21 aa, Mycobacterium avium
HDQLWRLASLRDARVPVALST

SEQ ID NO: 80740 - protein, 23 aa, Mycobacterium avium
HDRLKAELDQLIANRPVIAAEIN

SEQ ID NO: 80741 - protein, 26 aa, Mycobacterium avium
HDRMPLVMPERDWDRWLDPDAPVDEE

SEQ ID NO: 80742 - protein, 25 aa, Mycobacterium avium
HDTVDLRRSYPFYGQPHQGGIDTPP

SEQ ID NO: 80743 - protein, 26 aa, Mycobacterium avium
HDVFHIDRGYPLFVENLAILGAEIER

SEQ ID NO: 80744 - protein, 20 aa, Mycobacterium avium
HDVPAKGWLVGEVHNGIAQM

SEQ ID NO: 80745 - protein, 23 aa, Mycobacterium avium
HDYDLSSLFLLASTAALFSPSIK

SEQ ID NO: 80746 - protein, 26 aa, Mycobacterium avium
HEADEKFWLGVGLTRSEAYVMIASGS

SEQ ID NO: 80747 - protein, 25 aa, Mycobacterium avium
HEDLKRFFDGFPRNAHPMPVLSSAV

SEQ ID NO: 80748 - protein, 19 aa, Mycobacterium avium
HEGKPFFASLLEFITSGPV

SEQ ID NO: 80749 - protein, 32 aa, Mycobacterium avium
HELLKPFTPRYFEAIPGVWARRSSEVAQTVVV

SEQ ID NO: 80750 - protein, 20 aa, Mycobacterium avium
HELLPYSDLDLMLLHDNKSD

SEQ ID NO: 80751 - protein, 26 aa, Mycobacterium avium
HELSADFRPADALQRDRYATLVMDAH

SEQ ID NO: 80752 - protein, 19 aa, Mycobacterium avium
HERGIRVITDLVMNHTSES

SEQ ID NO: 80753 - protein, 20 aa, Mycobacterium avium
HGALPPRRAVLAADVDDLTY

SEQ ID NO: 80754 - protein, 27 aa, Mycobacterium avium
HGAPSEQARAWWGNFLVQKANEANIGL

SEQ ID NO: 80755 - protein, 17 aa, Mycobacterium avium
HGARKGLADTALRTADS

SEQ ID NO: 80756 - protein, 21 aa, Mycobacterium avium
HGEFRAIGYTSIYEEVEHVAL

SEQ ID NO: 80757 - protein, 24 aa, Mycobacterium avium
HGEPARLAAIVDWEMTTVGDPLLD

SEQ ID NO: 80758 - protein, 19 aa, Mycobacterium avium
HGEPSWSYLYRKMIPVLAG

SEQ ID NO: 80759 - protein, 20 aa, Mycobacterium avium
HGESGKVIGIRVFSREDDDE

SEQ ID NO: 80760 - protein, 23 aa, Mycobacterium avium
HGFDRGCAFPHGGHLINLHVAAG

SEQ ID NO: 80761 - protein, 27 aa, Mycobacterium avium
HGFRFFPAYYLHIWDLFQRIPVYELRN

SEQ ID NO: 80762 - protein, 26 aa, Mycobacterium avium
HGGGRLGAIARRFARLWRGPRGPEDA

SEQ ID NO: 80763 - protein, 24 aa, Mycobacterium avium
HGGLRYLEQLEFGLVREALYEREL

SEQ ID NO: 80764 - protein, 17 aa, Mycobacterium avium
HGITCAIRAWAYQIDDL

SEQ ID NO: 80765 - protein, 23 aa, Mycobacterium avium
HGKALRAATTFELDDVIDPAASR

SEQ ID NO: 80766 - protein, 19 aa, Mycobacterium avium
HGLDPWVIDFGEPDKVEGG

SEQ ID NO: 80767 - protein, 19 aa, Mycobacterium avium
HGLKVWDRAAGALIAAEAG

SEQ ID NO: 80768 - protein, 18 aa, Mycobacterium avium
HGLPELRAIFGELLGIPV

SEQ ID NO: 80769 - protein, 21 aa, Mycobacterium avium
HGLSWGFDRIFAASANHSIWF

SEQ ID NO: 80770 - protein, 18 aa, Mycobacterium avium
HGNLEWLPGKTLGLSAGC

SEQ ID NO: 80771 - protein, 26 aa, Mycobacterium avium
HGRDEIWRFTPLRRLRGLHDGSAPAT

SEQ ID NO: 80772 - protein, 26 aa, Mycobacterium avium
HGRGERLCWWGGPWPVDERWWDDRGQ

SEQ ID NO: 80773 - protein, 20 aa, Mycobacterium avium
HGSLLDRHRPLWEAHLVEGL

SEQ ID NO: 80774 - protein, 24 aa, Mycobacterium avium
HGSSWRAAMRKADTALSEFGVEGV

SEQ ID NO: 80775 - protein, 24 aa, Mycobacterium avium
HGTELRAGEKIMLLFESGNFDESV

SEQ ID NO: 80776 - protein, 20 aa, Mycobacterium avium
HGVGRLKRPWLAGYLGPEVM

SEQ ID NO: 80777 - protein, 21 aa, Mycobacterium avium
HGYCMGGGIYLGLLTDFCVAS

SEQ ID NO: 80778 - protein, 26 aa, Mycobacterium avium
HHAWSADPWTTLPARYGLPLPGRPAP

SEQ ID NO: 80779 - protein, 19 aa, Mycobacterium avium
HHCRLCNSLREGSALDAGG

SEQ ID NO: 80780 - protein, 20 aa, Mycobacterium avium
HHELDWWTSPSRKFDGIPES

SEQ ID NO: 80781 - protein, 19 aa, Mycobacterium avium
HHHELGWFARQALRLFDDL

SEQ ID NO: 80782 - protein, 27 aa, Mycobacterium avium
HHIDKWKFTVPFVCGATNLGEALRRIN

SEQ ID NO: 80783 - protein, 24 aa, Mycobacterium avium
HHLRRFSEHAARGLDMARLNIGVW

SEQ ID NO: 80784 - protein, 22 aa, Mycobacterium avium
HHRAAWRAARLLVLDAFTTAEA

SEQ ID NO: 80785 - protein, 17 aa, Mycobacterium avium
HHTAGGMSRWLPYLSEL

SEQ ID NO: 80786 - protein, 25 aa, Mycobacterium avium
HHVFKEWADRYAGRFDMGYERYREV

SEQ ID NO: 80787 - protein, 18 aa, Mycobacterium avium
HIAGRPVTRKRWPNGVDQ

SEQ ID NO: 80788 - protein, 35 aa, Mycobacterium avium
HIGHVRSGVAFDILRRWLIALGYDVAFIRNVTDID

SEQ ID NO: 80789 - protein, 31 aa, Mycobacterium avium
HILGFPFTEHGLRLGVEAALRNLARVAPTQR

SEQ ID NO: 80790 - protein, 25 aa, Mycobacterium avium
HIMAGKRGGSIVFTSSIGGLRGAEN

SEQ ID NO: 80791 - protein, 18 aa, Mycobacterium avium
HIQIMPQVWAMRYTLERA

SEQ ID NO: 80792 - protein, 25 aa, Mycobacterium avium
HIRPWRVSPPGGRRELDEAIGQIAS

SEQ ID NO: 80793 - protein, 34 aa, Mycobacterium avium
HISTLLLTLLFRFMRPLIEHGHVFLAQPPLYKLK

SEQ ID NO: 80794 - protein, 22 aa, Mycobacterium avium
HKDLRRARAAALNIVPTSTGAA

SEQ ID NO: 80795 - protein, 25 aa, Mycobacterium avium
HKGDFLLHALRLCRPAVIFTDPEHR

SEQ ID NO: 80796 - protein, 18 aa, Mycobacterium avium
HKGIRVVSTPEFLREGRA

SEQ ID NO: 80797 - protein, 22 aa, Mycobacterium avium
HKLSDDEFGFFVILLAVAGNET

SEQ ID NO: 80798 - protein, 18 aa, Mycobacterium avium
HKTFCIPHGGGGPGVGPV

SEQ ID NO: 80799 - protein, 24 aa, Mycobacterium avium
HLAKAGLTCLGWPVEHGGRGLSTA

SEQ ID NO: 80800 - protein, 27 aa, Mycobacterium avium
HLDGSCPDCTRGAFRADRPYQAEVARQ

SEQ ID NO: 80801 - protein, 25 aa, Mycobacterium avium
HLDKKFKRRGVQMLSDGKRTWAVIG

SEQ ID NO: 80802 - protein, 20 aa, Mycobacterium avium
HLELPGHDFAAVLRHAGTNA

SEQ ID NO: 80803 - protein, 17 aa, Mycobacterium avium
HLERMLSLDDVFDTDEL

SEQ ID NO: 80804 - protein, 27 aa, Mycobacterium avium
HLGQGRVALDWLDRVDVIGQTQASSRF

SEQ ID NO: 80805 - protein, 25 aa, Mycobacterium avium
HLHLRRAVVTAALFGGDAPAADVFE

SEQ ID NO: 80806 - protein, 23 aa, Mycobacterium avium
HLIDVKRAIAWVRENIADYGGDP

SEQ ID NO: 80807 - protein, 22 aa, Mycobacterium avium
HLKMEGSWRVGPRVRVDHRARI

SEQ ID NO: 80808 - protein, 23 aa, Mycobacterium avium
HLLMDSRAGYKYGDVTVLDHMAY

SEQ ID NO: 80809 - protein, 22 aa, Mycobacterium avium
HLLRRKLVNAGFTRKRVKEKEP

SEQ ID NO: 80810 - protein, 26 aa, Mycobacterium avium
HLLTHPRLLGALPLLREANRIPASYA

SEQ ID NO: 80811 - protein, 18 aa, Mycobacterium avium
HLMRLKAIAQPWEAAVTG

SEQ ID NO: 80812 - protein, 18 aa, Mycobacterium avium
HLPAEVLDAAAVTINKLW

SEQ ID NO: 80813 - protein, 26 aa, Mycobacterium avium
HLPVFRPPLDMARLFGQPRLGACEDG

SEQ ID NO: 80814 - protein, 18 aa, Mycobacterium avium
HLQVASLDHAMWFMRAFR

SEQ ID NO: 80815 - protein, 31 aa, Mycobacterium avium
HLRASKPLVRLRVPFTLSRYEIDNVERGAND

SEQ ID NO: 80816 - protein, 21 aa, Mycobacterium avium
HLRNMAFYNFALRMLKRTRDA

SEQ ID NO: 80817 - protein, 21 aa, Mycobacterium avium
HLSDGRAAWNMVTSSDAFTGE

SEQ ID NO: 80818 - protein, 19 aa, Mycobacterium avium
HLTKVLCVHRRFRDGEQPL

SEQ ID NO: 80819 - protein, 34 aa, Mycobacterium avium
HLTRAGALRLCPGLKRSALIGGIRYYDTIVDDAR

SEQ ID NO: 80820 - protein, 20 aa, Mycobacterium avium
HLVKSFYRRPLNVGDAGGGA

SEQ ID NO: 80821 - protein, 25 aa, Mycobacterium avium
HMFFHRLGPVLARRLLLTGDIIDAG

SEQ ID NO: 80822 - protein, 24 aa, Mycobacterium avium
HMKEPGRWSGWVRIDGQRVSVDGF

SEQ ID NO: 80823 - protein, 25 aa, Mycobacterium avium
HMTTFGFIMGEVFRRVTGRTIGHYL

SEQ ID NO: 80824 - protein, 30 aa, Mycobacterium avium
HNARFTIHAGEAFGLPSIHEAIAFCGADRL

SEQ ID NO: 80825 - protein, 17 aa, Mycobacterium avium
HNNAVVFAGTWNKTFTR

SEQ ID NO: 80826 - protein, 22 aa, Mycobacterium avium
HNPIAIVVPCHRVIGASGKLTG

SEQ ID NO: 80827 - protein, 17 aa, Mycobacterium avium
HNQELLSGLGLSDADIA

SEQ ID NO: 80828 - protein, 21 aa, Mycobacterium avium
HNRMISWPYTKLMNSNNMVDQ

SEQ ID NO: 80829 - protein, 19 aa, Mycobacterium avium
HPAAMAFDLPAGGNRILQG

SEQ ID NO: 80830 - protein, 19 aa, Mycobacterium avium
HPADRPQVIDGINDMIRRR

SEQ ID NO: 80831 - protein, 19 aa, Mycobacterium avium
HPAHMPRAGLPEEIGPVAA

SEQ ID NO: 80832 - protein, 18 aa, Mycobacterium avium
HPARFVVEATRAFPDDGI

SEQ ID NO: 80833 - protein, 23 aa, Mycobacterium avium
HPDLRCLMLTSFTSDEAMLEAIL

SEQ ID NO: 80834 - protein, 22 aa, Mycobacterium avium
HPDRLRGLLRTVYRLTADGALP

SEQ ID NO: 80835 - protein, 18 aa, Mycobacterium avium
HPEIEGFSITAGNACGAN

SEQ ID NO: 80836 - protein, 17 aa, Mycobacterium avium
HPEPLRRGADRTITGVA

SEQ ID NO: 80837 - protein, 31 aa, Mycobacterium avium
HPESATAWFGDRFGVPLPRGLRERAEAMSWD

SEQ ID NO: 80838 - protein, 22 aa, Mycobacterium avium
HPGPRWLVGDLAELDLPARGIT

SEQ ID NO: 80839 - protein, 24 aa, Mycobacterium avium
HPLGATGLAQCAELTWQLRGTADK

SEQ ID NO: 80840 - protein, 26 aa, Mycobacterium avium
HPMEVGAFPLALARRSLSGSNIGGIA

SEQ ID NO: 80841 - protein, 20 aa, Mycobacterium avium
HPPFRWQRRYAEGFTEQVAT

SEQ ID NO: 80842 - protein, 23 aa, Mycobacterium avium
HPRETLWRPPVLTMSAAQGTGLP

SEQ ID NO: 80843 - protein, 20 aa, Mycobacterium avium
HPYLDTVLFLLGVTRGEIEA

SEQ ID NO: 80844 - protein, 24 aa, Mycobacterium avium
HQACQALRLGECDLALAGGANVLL

SEQ ID NO: 80845 - protein, 19 aa, Mycobacterium avium
HQAGLPPRIEVVGPGQQQQ

SEQ ID NO: 80846 - protein, 24 aa, Mycobacterium avium
HQDADGPAVAWVHTLEYGRLKLPA

SEQ ID NO: 80847 - protein, 17 aa, Mycobacterium avium
HQIGLPYHWGVGGDAVV

SEQ ID NO: 80848 - protein, 23 aa, Mycobacterium avium
HQLWAETRIELFAQSTDTRPEEL

SEQ ID NO: 80849 - protein, 17 aa, Mycobacterium avium
HQPWPGLIEAYRDRLPV

SEQ ID NO: 80850 - protein, 18 aa, Mycobacterium avium
HQRVMLVEVMGRHAGWIA

SEQ ID NO: 80851 - protein, 18 aa, Mycobacterium avium
HRALWHLIFSGALDRHPD

SEQ ID NO: 80852 - protein, 24 aa, Mycobacterium avium
HRDLRLLAADMVFDLPVVGEAARK

SEQ ID NO: 80853 - protein, 18 aa, Mycobacterium avium
HRDMEIVTWVLAGALAHQ

SEQ ID NO: 80854 - protein, 26 aa, Mycobacterium avium
HRHLFSVLMDREWKHGVAAAVDVTLL

SEQ ID NO: 80855 - protein, 17 aa, Mycobacterium avium
HRHMRSLLNKAFTPRAI

SEQ ID NO: 80856 - protein, 25 aa, Mycobacterium avium
HRHRGCAIPGCGATRGLHAHHLRHW

SEQ ID NO: 80857 - protein, 24 aa, Mycobacterium avium
HRLLRRYRLELARPGYQPRWDYGG

SEQ ID NO: 80858 - protein, 18 aa, Mycobacterium avium
HRQLFLVLHDEIDRGVIA

SEQ ID NO: 80859 - protein, 24 aa, Mycobacterium avium
HRRLLSVLMDPAWTPGVAAAVDAT

SEQ ID NO: 80860 - protein, 18 aa, Mycobacterium avium
HRRLWTPVAEAMTLADLA

SEQ ID NO: 80861 - protein, 26 aa, Mycobacterium avium
HRTEVTEILPLDGFDFDDLDFCDDAG

SEQ ID NO: 80862 - protein, 23 aa, Mycobacterium avium
HRTFHYPGGLVDFVKHINRTKNP

SEQ ID NO: 80863 - protein, 25 aa, Mycobacterium avium
HRVARRLQAGSVWVNRHSDIEPQGP

SEQ ID NO: 80864 - protein, 18 aa, Mycobacterium avium
HRVIRPEVRGQAGFDDPV

SEQ ID NO: 80865 - protein, 20 aa, Mycobacterium avium
HRVQYRFTRTGLVLPDDPSV

SEQ ID NO: 80866 - protein, 18 aa, Mycobacterium avium
HSDPEFAAAAGFSQPILH

SEQ ID NO: 80867 - protein, 18 aa, Mycobacterium avium
HSGWWDHIAPFFSHTHRV

SEQ ID NO: 80868 - protein, 21 aa, Mycobacterium avium
HSLGGGVAMQFVYQHPDYAQR

SEQ ID NO: 80869 - protein, 27 aa, Mycobacterium avium
HSPAESWPPTGWFEGWAGGLDVFDVER

SEQ ID NO: 80870 - protein, 30 aa, Mycobacterium avium
HSPMDVLWFRLKWRPGDPRELFGVFRKGLM

SEQ ID NO: 80871 - protein, 31 aa, Mycobacterium avium
HSRFSTNTFPSWPLAHPFRRIAHNGEINTVT

SEQ ID NO: 80872 - protein, 22 aa, Mycobacterium avium
HSRRVFLFGALQGRRRGLQPDL

SEQ ID NO: 80873 - protein, 20 aa, Mycobacterium avium
HSVRYGRSRLLLPVGPAEPS

SEQ ID NO: 80874 - protein, 24 aa, Mycobacterium avium
HTAVKISPRRSGPVVWVKDASRSV

SEQ ID NO: 80875 - protein, 24 aa, Mycobacterium avium
HTDELRFLVHWSAEVFSDYDELKK

SEQ ID NO: 80876 - protein, 20 aa, Mycobacterium avium
HTDSGVALSSRIAHELGEAS

SEQ ID NO: 80877 - protein, 18 aa, Mycobacterium avium
HTEKVTLWKLMDVKERTG

SEQ ID NO: 80878 - protein, 18 aa, Mycobacterium avium
HTEVLPLYARLPTAEQQK

SEQ ID NO: 80879 - protein, 17 aa, Mycobacterium avium
HTGKAALYRRWDTKCEL

SEQ ID NO: 80880 - protein, 19 aa, Mycobacterium avium
HTGLPWPDVHDAGTVTLLQ

SEQ ID NO: 80881 - protein, 26 aa, Mycobacterium avium
HTGPAMSAFNAWVLLKGLETMAIRVE

SEQ ID NO: 80882 - protein, 18 aa, Mycobacterium avium
HTHELRQTVLALLADHDL

SEQ ID NO: 80883 - protein, 18 aa, Mycobacterium avium
HTKGPKIRIHKFRNKTGY

SEQ ID NO: 80884 - protein, 26 aa, Mycobacterium avium
HTLEYGRLKLPAPDRQVLLAVSAELA

SEQ ID NO: 80885 - protein, 26 aa, Mycobacterium avium
HTLLLDLWRRHGFGVLLVTHDVDEAV

SEQ ID NO: 80886 - protein, 25 aa, Mycobacterium avium
HTNRGDIKVALFGNHAPKTVANFVG

SEQ ID NO: 80887 - protein, 18 aa, Mycobacterium avium
HTQREFTSEVSWKGALEA

SEQ ID NO: 80888 - protein, 24 aa, Mycobacterium avium
HTRFGTEVEALWWQERRRQWQIHS

SEQ ID NO: 80889 - protein, 30 aa, Mycobacterium avium
HTTARLRLVPLRWALACLLIDIGSVEFSSR

SEQ ID NO: 80890 - protein, 18 aa, Mycobacterium avium
HTVILYRAGLLSEEQRDG

SEQ ID NO: 80891 - protein, 19 aa, Mycobacterium avium
HTWKRSSFSGTEIFGKTVG

SEQ ID NO: 80892 - protein, 25 aa, Mycobacterium avium
HTYFPRLRLELDKGLGWKAEVEAAL

SEQ ID NO: 80893 - protein, 33 aa, Mycobacterium avium
HVAGRGPVVPALGLALLGARAAGKVVLDGVFND

SEQ ID NO: 80894 - protein, 23 aa, Mycobacterium avium
HVDECWYCGPCAARCPTGAVTVN

SEQ ID NO: 80895 - protein, 20 aa, Mycobacterium avium
HVDGVPCCTHIGPDGAGHFV

SEQ ID NO: 80896 - protein, 19 aa, Mycobacterium avium
HVFRMEWLSGEPFPADDES

SEQ ID NO: 80897 - protein, 21 aa, Mycobacterium avium
HVHVVPRWGGDANFITIIGGS

SEQ ID NO: 80898 - protein, 22 aa, Mycobacterium avium
HVIDYLNGLGWRAEGVTRTELF

SEQ ID NO: 80899 - protein, 24 aa, Mycobacterium avium
HVLMARHMFTLWAPERAGVTDAVA

SEQ ID NO: 80900 - protein, 24 aa, Mycobacterium avium
HVPDYLMQIIARFARYLRESNSVD

SEQ ID NO: 80901 - protein, 24 aa, Mycobacterium avium
HVPMFAFGHGLSYTRFEHRDLVVR

SEQ ID NO: 80902 - protein, 24 aa, Mycobacterium avium
HVPQWRFVAEWTRSRAEELKPGPA

SEQ ID NO: 80903 - protein, 17 aa, Mycobacterium avium
HVREVVCEDSLGLAEEF

SEQ ID NO: 80904 - protein, 23 aa, Mycobacterium avium
HVRRSALPSPRRVRELLELTSRW

SEQ ID NO: 80905 - protein, 22 aa, Mycobacterium avium
HVVAALPRRGIGKVDRAALVRR

SEQ ID NO: 80906 - protein, 17 aa, Mycobacterium avium
HVVALPMRVRFRGITTR

SEQ ID NO: 80907 - protein, 21 aa, Mycobacterium avium
HWLGRDRFVLSAGHSSLTLYL

SEQ ID NO: 80908 - protein, 21 aa, Mycobacterium avium
HWSGCIPVELTGHVEFPRIGH

SEQ ID NO: 80909 - protein, 17 aa, Mycobacterium avium
HWWAHRALWHLIFSGAL

SEQ ID NO: 80910 - protein, 30 aa, Mycobacterium avium
HYDCRSTQELRNWLMLRAYESGVLPVGAQP

SEQ ID NO: 80911 - protein, 29 aa, Mycobacterium avium
HYDKSNEFFKLWLDPSMTYSCGYWEEGAK

SEQ ID NO: 80912 - protein, 23 aa, Mycobacterium avium
HYHCYPRLVGETGGKDFIVAHAS

SEQ ID NO: 80913 - protein, 26 aa, Mycobacterium avium
HYVDLVCSWGPMILGHAHPAVVEAVA

SEQ ID NO: 80914 - protein, 17 aa, Mycobacterium avium
IAAAAVDAFGSVHGLVN

SEQ ID NO: 80915 - protein, 24 aa, Mycobacterium avium
IAAAKARGINLWRVDDDHVSVACD

SEQ ID NO: 80916 - protein, 26 aa, Mycobacterium avium
IAAALALGAEGVWCGSVWLTTEEAET

SEQ ID NO: 80917 - protein, 19 aa, Mycobacterium avium
IAAALKLLQDRSFSSLSLR

SEQ ID NO: 80918 - protein, 18 aa, Mycobacterium avium
IAACADALGAARAVMDLA

SEQ ID NO: 80919 - protein, 23 aa, Mycobacterium avium
IAADGWRVGSVFGTETALLQRYR

SEQ ID NO: 80920 - protein, 21 aa, Mycobacterium avium
IAAEATRVGMPYVNQRWLGGM

SEQ ID NO: 80921 - protein, 25 aa, Mycobacterium avium
IAAELPMQMICILLGVPESERHWLF

SEQ ID NO: 80922 - protein, 23 aa, Mycobacterium avium
IAAELRELASLRDAGILTQQEFE

SEQ ID NO: 80923 - protein, 24 aa, Mycobacterium avium
IAAGLAAFGARVAIWERDAQTCTR

SEQ ID NO: 80924 - protein, 24 aa, Mycobacterium avium
IAAHNKLLGSFELTGIPPAPRGVP

SEQ ID NO: 80925 - protein, 25 aa, Mycobacterium avium
IAAHWRYKEAKGRNGVPHPHAAAEI

SEQ ID NO: 80926 - protein, 17 aa, Mycobacterium avium
IAALCGERLKRVSLELG

SEQ ID NO: 80927 - protein, 24 aa, Mycobacterium avium
IAALSRLGAIAVVMRPDADLAASV

SEQ ID NO: 80928 - protein, 18 aa, Mycobacterium avium
IAAPFAGVVTVAAEVGRQ

SEQ ID NO: 80929 - protein, 17 aa, Mycobacterium avium
IAAPRPLAPMTVRQAVK

SEQ ID NO: 80930 - protein, 17 aa, Mycobacterium avium
IAASGIPRAELFVTTKL

SEQ ID NO: 80931 - protein, 25 aa, Mycobacterium avium
IAASGRWVPDFLSLPIAVENSLKDQ

SEQ ID NO: 80932 - protein, 19 aa, Mycobacterium avium
IACGIEAMSRVGLGANAGP

SEQ ID NO: 80933 - protein, 20 aa, Mycobacterium avium
IACGTLRLVVEDAELDGHLF

SEQ ID NO: 80934 - protein, 23 aa, Mycobacterium avium
IADDIRAAIAVRHGVTVRDLLLV

SEQ ID NO: 80935 - protein, 18 aa, Mycobacterium avium
IADLIEWRRKHEKHIERI

SEQ ID NO: 80936 - protein, 19 aa, Mycobacterium avium
IADSSGCEELMAFATSAVR

SEQ ID NO: 80937 - protein, 18 aa, Mycobacterium avium
IADVRRVGFGVGAEVVGK

SEQ ID NO: 80938 - protein, 19 aa, Mycobacterium avium
IAEAAPMESGELGSVLEAL

SEQ ID NO: 80939 - protein, 23 aa, Mycobacterium avium
IAEAEGLTVLGWRNVPTDDSSLG

SEQ ID NO: 80940 - protein, 23 aa, Mycobacterium avium
IAEEYYISFLLDRANRTYLAMCS

SEQ ID NO: 80941 - protein, 26 aa, Mycobacterium avium
IAEFARRFGCRVVDSFGSSEFAVIVV

SEQ ID NO: 80942 - protein, 20 aa, Mycobacterium avium
IAELRPGDEQALIAIPGIGA

SEQ ID NO: 80943 - protein, 22 aa, Mycobacterium avium
IAEQRPDLVPIFLNALPAPLIE

SEQ ID NO: 80944 - protein, 20 aa, Mycobacterium avium
IAESGLRFSGTSPDGHLVEF

SEQ ID NO: 80945 - protein, 34 aa, Mycobacterium avium
IAESLRAALRAVPAERLWVNPDCGLKTRNPDEVS

SEQ ID NO: 80946 - protein, 24 aa, Mycobacterium avium
IAEVRRAITTLGRISAEGMHLRGL

SEQ ID NO: 80947 - protein, 17 aa, Mycobacterium avium
IAFAGGIHMCLGMHLAR

SEQ ID NO: 80948 - protein, 19 aa, Mycobacterium avium
IAGITYRQLDYWARTSLVV

SEQ ID NO: 80949 - protein, 36 aa, Mycobacterium avium
IAGNGLRPEIWDEFTQRFGIARVCEFYASSEGNAAF

SEQ ID NO: 80950 - protein, 24 aa, Mycobacterium avium
IAGPRGVGMLAVRRELMENLHPRL

SEQ ID NO: 80951 - protein, 20 aa, Mycobacterium avium
IAGRAMRRIGAIEFATTIAP

SEQ ID NO: 80952 - protein, 24 aa, Mycobacterium avium
IAGYKVPRSLWLVDEVKRSPAGKP

SEQ ID NO: 80953 - protein, 19 aa, Mycobacterium avium
IAHCTRGLGIWDWASTARS

SEQ ID NO: 80954 - protein, 17 aa, Mycobacterium avium
IAIERGTHFKGFERSKY

SEQ ID NO: 80955 - protein, 26 aa, Mycobacterium avium
IAISRTYIASWLRRWQERGELADDLD

SEQ ID NO: 80956 - protein, 18 aa, Mycobacterium avium
IAIVNRGDTRGDHLATVK

SEQ ID NO: 80957 - protein, 24 aa, Mycobacterium avium
IAKFLDKRGPGIQQMAMRVSDLDT

SEQ ID NO: 80958 - protein, 20 aa, Mycobacterium avium
IAKRELRGVSARAVKSPADL

SEQ ID NO: 80959 - protein, 20 aa, Mycobacterium avium
IALACLATLAGYRRTDEAMK

SEQ ID NO: 80960 - protein, 23 aa, Mycobacterium avium
IALLSRGKLAYGVIDDQNQPPGS

SEQ ID NO: 80961 - protein, 18 aa, Mycobacterium avium
IALPDLQPGSSIMPGKVN

SEQ ID NO: 80962 - protein, 17 aa, Mycobacterium avium
IALRAAEYGRNVCVLTI

SEQ ID NO: 80963 - protein, 18 aa, Mycobacterium avium
IALTPARLLMVVITDSGR

SEQ ID NO: 80964 - protein, 22 aa, Mycobacterium avium
IANRLPMMVVCRLLGLPDDDVD

SEQ ID NO: 80965 - protein, 20 aa, Mycobacterium avium
IAPGLFKTPLLGSLPEEAQA

SEQ ID NO: 80966 - protein, 21 aa, Mycobacterium avium
IAPGLWCSPGLSNSYLLTTAE

SEQ ID NO: 80967 - protein, 17 aa, Mycobacterium avium
IAPLYAGFVERYGDQIA

SEQ ID NO: 80968 - protein, 18 aa, Mycobacterium avium
IAQLLVQRVELVELVEVS

SEQ ID NO: 80969 - protein, 18 aa, Mycobacterium avium
IAQVHGWCVGGASDYALC

SEQ ID NO: 80970 - protein, 24 aa, Mycobacterium avium
IARALAAAGNEVWGVARLKDPAAR

SEQ ID NO: 80971 - protein, 17 aa, Mycobacterium avium
IAREEIFGPVITVIPYR

SEQ ID NO: 80972 - protein, 27 aa, Mycobacterium avium
IARLSLLDRGMVFAIAHVRGGGEMGRL

SEQ ID NO: 80973 - protein, 23 aa, Mycobacterium avium
IARNCSPASLAVIKRQAYDDALR

SEQ ID NO: 80974 - protein, 22 aa, Mycobacterium avium
IARVAPVERIRLVNSGTEATMS

SEQ ID NO: 80975 - protein, 26 aa, Mycobacterium avium
IASGSRFLVFMQRYTPAALFISSPDQ

SEQ ID NO: 80976 - protein, 17 aa, Mycobacterium avium
IASKGGYEAVQMRAVAD

SEQ ID NO: 80977 - protein, 18 aa, Mycobacterium avium
IASLGRYGYGWADSDVAG

SEQ ID NO: 80978 - protein, 20 aa, Mycobacterium avium
IASLNYLLTSHVWRQDHNGA

SEQ ID NO: 80979 - protein, 19 aa, Mycobacterium avium
IASRAKLQIGRSGRHIAQE

SEQ ID NO: 80980 - protein, 18 aa, Mycobacterium avium
IATGIYLLGAADRDEAVK

SEQ ID NO: 80981 - protein, 18 aa, Mycobacterium avium
IATKLQEMADELTARDSG

SEQ ID NO: 80982 - protein, 20 aa, Mycobacterium avium
IAVADLDAAIAWYHDHLGMI

SEQ ID NO: 80983 - protein, 22 aa, Mycobacterium avium
IAVAGPRSSFALTEARIGVAPA

SEQ ID NO: 80984 - protein, 20 aa, Mycobacterium avium
IAVDICKPIRAGVVDTAIPA

SEQ ID NO: 80985 - protein, 18 aa, Mycobacterium avium
IAVDLCDQIASVPYPLAT

SEQ ID NO: 80986 - protein, 19 aa, Mycobacterium avium
IAVGLALRGFVPVPEIQFD

SEQ ID NO: 80987 - protein, 22 aa, Mycobacterium avium
IAVKDGRIVGVRGRAVDRVNHG

SEQ ID NO: 80988 - protein, 19 aa, Mycobacterium avium
IAWPADLKVGPDGLGNSPE

SEQ ID NO: 80989 - protein, 25 aa, Mycobacterium avium
IAYVLEILPALGYLHSIGLVYNDLK

SEQ ID NO: 80990 - protein, 29 aa, Mycobacterium avium
ICGLRAGQKLRIVKYLAYGWSSMRSRPAL

SEQ ID NO: 80991 - protein, 18 aa, Mycobacterium avium
ICPLTAGLPPQAFADAVD

SEQ ID NO: 80992 - protein, 20 aa, Mycobacterium avium
ICRHIMLYHLDRGWADHLAY

SEQ ID NO: 80993 - protein, 19 aa, Mycobacterium avium
IDAAGKWVLPGFIDVHTHY

SEQ ID NO: 80994 - protein, 18 aa, Mycobacterium avium
IDAAHLWHPYSTIGAESV

SEQ ID NO: 80995 - protein, 19 aa, Mycobacterium avium
IDAFVEFYHAPILHQGQYT

SEQ ID NO: 80996 - protein, 18 aa, Mycobacterium avium
IDAGAVAITDSWRALADV

SEQ ID NO: 80997 - protein, 18 aa, Mycobacterium avium
IDALLALKADTVIYTPFM

SEQ ID NO: 80998 - protein, 18 aa, Mycobacterium avium
IDALRFGTDVLTHFLTHC

SEQ ID NO: 80999 - protein, 24 aa, Mycobacterium avium
IDALTELWVRPALSLPAVAEDLRR

SEQ ID NO: 81000 - protein, 22 aa, Mycobacterium avium
IDAPPRLVWDVFTDVERWPEWT

SEQ ID NO: 81001 - protein, 23 aa, Mycobacterium avium
IDAPRFREAYRWALDSLHRRGAR

SEQ ID NO: 81002 - protein, 25 aa, Mycobacterium avium
IDAYRDFLIEIGYLLPEPEDFTITT

SEQ ID NO: 81003 - protein, 26 aa, Mycobacterium avium
IDDHSRMCVCAKLMARERTRAVCDGL

SEQ ID NO: 81004 - protein, 20 aa, Mycobacterium avium
IDEEGLSLDVCTGGELAVAL

SEQ ID NO: 81005 - protein, 20 aa, Mycobacterium avium
IDELIGPDVTREWIKDFSSY

SEQ ID NO: 81006 - protein, 19 aa, Mycobacterium avium
IDERMSRLDLRRMSYVQRL

SEQ ID NO: 81007 - protein, 17 aa, Mycobacterium avium
IDFTNIYFYTVLYHALR

SEQ ID NO: 81008 - protein, 22 aa, Mycobacterium avium
IDGLLREIRLVRALSGTDVPHA

SEQ ID NO: 81009 - protein, 17 aa, Mycobacterium avium
IDGLRRRIAELAVPAEA

SEQ ID NO: 81010 - protein, 17 aa, Mycobacterium avium
IDGQKMWLTNGATSTLI

SEQ ID NO: 81011 - protein, 22 aa, Mycobacterium avium
IDGSCRRFGAGAGNAPVEALIG

SEQ ID NO: 81012 - protein, 18 aa, Mycobacterium avium
IDGWRPGQRLDVYQHCRA

SEQ ID NO: 81013 - protein, 17 aa, Mycobacterium avium
IDHAALRLHKPVISHDL

SEQ ID NO: 81014 - protein, 21 aa, Mycobacterium avium
IDISNAVLFFASDEARYITGV

SEQ ID NO: 81015 - protein, 21 aa, Mycobacterium avium
IDLERRRISLSLKQANEDYTE

SEQ ID NO: 81016 - protein, 20 aa, Mycobacterium avium
IDLIMPIGKGQRALIVSPPK

SEQ ID NO: 81017 - protein, 18 aa, Mycobacterium avium
IDLPSYGLVWKWPQIDCA

SEQ ID NO: 81018 - protein, 17 aa, Mycobacterium avium
IDLVCTLICAVDGSVVS

SEQ ID NO: 81019 - protein, 30 aa, Mycobacterium avium
IDLYLRIAPELFLKRCVVGGFDKVFELNRV

SEQ ID NO: 81020 - protein, 26 aa, Mycobacterium avium
IDPALPATRIEFMLGDAAPVVAVSTA

SEQ ID NO: 81021 - protein, 33 aa, Mycobacterium avium
IDPDAVELPGWYRPNPGLARDLAFIAFSAAGGE

SEQ ID NO: 81022 - protein, 26 aa, Mycobacterium avium
IDPELRRPITELGMVKSIDTEPDGAV

SEQ ID NO: 81023 - protein, 17 aa, Mycobacterium avium
IDPEYYKKFMSVNLDGA

SEQ ID NO: 81024 - protein, 19 aa, Mycobacterium avium
IDPGHALRGPRRLRRLREL

SEQ ID NO: 81025 - protein, 18 aa, Mycobacterium avium
IDPVALHHYMSFHSVVPA

SEQ ID NO: 81026 - protein, 23 aa, Mycobacterium avium
IDPYLRPLYDALYDMMDPEVIPK

SEQ ID NO: 81027 - protein, 24 aa, Mycobacterium avium
IDRDRLSACADLLMTTSPNVLIYA

SEQ ID NO: 81028 - protein, 17 aa, Mycobacterium avium
IDRKNVREHIAFGRGIH

SEQ ID NO: 81029 - protein, 24 aa, Mycobacterium avium
IDRPLRPSFVDGLRNEIQVVVTIL

SEQ ID NO: 81030 - protein, 19 aa, Mycobacterium avium
IDRPRVWWQGVRLRTESAP

SEQ ID NO: 81031 - protein, 27 aa, Mycobacterium avium
IDSFEWLIGAPRWREAAIARGDAEPKG

SEQ ID NO: 81032 - protein, 25 aa, Mycobacterium avium
IDTDLRWRIVTALAAAGEIDADGPA

SEQ ID NO: 81033 - protein, 28 aa, Mycobacterium avium
IDTPPQRYAMFMSFSLASGAGRTELQTL

SEQ ID NO: 81034 - protein, 23 aa, Mycobacterium avium
IDTRLQWYVELGIDPQNLRLFEH

SEQ ID NO: 81035 - protein, 20 aa, Mycobacterium avium
IDTWLPLSWSLNMVNRSMGH

SEQ ID NO: 81036 - protein, 19 aa, Mycobacterium avium
IDVAYRYFATPKRKFIIAD

SEQ ID NO: 81037 - protein, 19 aa, Mycobacterium avium
IDYFAEVNLAGFYDLAQTL

SEQ ID NO: 81038 - protein, 24 aa, Mycobacterium avium
IDYRDRICRAREQLAATDNPLHKV

SEQ ID NO: 81039 - protein, 21 aa, Mycobacterium avium
IEAALELKNQILVKIYNRKAL

SEQ ID NO: 81040 - protein, 23 aa, Mycobacterium avium
IEAGASGTVRWTGQVGTTYQIGA

SEQ ID NO: 81041 - protein, 17 aa, Mycobacterium avium
IEALVRVVREFRPHVMT

SEQ ID NO: 81042 - protein, 19 aa, Mycobacterium avium
IEAVNLFRAKVIDVSPEAL

SEQ ID NO: 81043 - protein, 17 aa, Mycobacterium avium
IEDDLYYPALKEASKLI

SEQ ID NO: 81044 - protein, 26 aa, Mycobacterium avium
IEDFSGSMSLSFSDPRFDEVKAPVDE

SEQ ID NO: 81045 - protein, 21 aa, Mycobacterium avium
IEDRLKDMIITGGENVYGPEV

SEQ ID NO: 81046 - protein, 18 aa, Mycobacterium avium
IEEGVRWEPPLLTITRVA

SEQ ID NO: 81047 - protein, 22 aa, Mycobacterium avium
IEELLRGADMVFVTAGEGGGTG

SEQ ID NO: 81048 - protein, 19 aa, Mycobacterium avium
IEEMLRWTSPVKNMCRTLT

SEQ ID NO: 81049 - protein, 21 aa, Mycobacterium avium
IEFRTLPVVRYDNIDGQDVNI

SEQ ID NO: 81050 - protein, 18 aa, Mycobacterium avium
IEGVKRFISGGDVGDTAE

SEQ ID NO: 81051 - protein, 25 aa, Mycobacterium avium
IEILPVAGLPEFRPGDDLGAAVAKA

SEQ ID NO: 81052 - protein, 18 aa, Mycobacterium avium
IEITRPLISDSFEAQEMA

SEQ ID NO: 81053 - protein, 18 aa, Mycobacterium avium
IEKIVPEVFDLRPGAIIR

SEQ ID NO: 81054 - protein, 36 aa, Mycobacterium avium
IELDGLRLITWRGAARAEQGLPFAREAALAKRLGAD

SEQ ID NO: 81055 - protein, 25 aa, Mycobacterium avium
IELMGKEVLPEFIERDAKAVADKAT

SEQ ID NO: 81056 - protein, 24 aa, Mycobacterium avium
IELPEGAHLLLMWGAANRDPTHFK

SEQ ID NO: 81057 - protein, 23 aa, Mycobacterium avium
IELPLMEVRALLDLGDVAKATRK

SEQ ID NO: 81058 - protein, 25 aa, Mycobacterium avium
IENPDRWAPPYAEAGAHNVTFHAEA

SEQ ID NO: 81059 - protein, 21 aa, Mycobacterium avium
IEPGHGLRIGYFAQEHDTLDN

SEQ ID NO: 81060 - protein, 23 aa, Mycobacterium avium
IEPLEPGFGYTLGNSLRRTLLSS

SEQ ID NO: 81061 - protein, 28 aa, Mycobacterium avium
IEPPAGDPLRRWGPFASGVVDPDRSGLF

SEQ ID NO: 81062 - protein, 23 aa, Mycobacterium avium
IEPWLMMNWHRTMDWLLLAPTLS

SEQ ID NO: 81063 - protein, 19 aa, Mycobacterium avium
IERARAGSFVVRLKGGDPF

SEQ ID NO: 81064 - protein, 18 aa, Mycobacterium avium
IERFAHLIGGARMGTRPD

SEQ ID NO: 81065 - protein, 17 aa, Mycobacterium avium
IERTARRSAVWAIINGI

SEQ ID NO: 81066 - protein, 23 aa, Mycobacterium avium
IESAGFKLGTDVALALDAAATEF

SEQ ID NO: 81067 - protein, 17 aa, Mycobacterium avium
IESAREHGGRLLVRLAG

SEQ ID NO: 81068 - protein, 22 aa, Mycobacterium avium
IESIKQLKARYCRYLDTKDWAA

SEQ ID NO: 81069 - protein, 20 aa, Mycobacterium avium
IETLSLRMERHVANAQRVAE

SEQ ID NO: 81070 - protein, 26 aa, Mycobacterium avium
IETNVEFWAAVILDFARVPANMMPAM

SEQ ID NO: 81071 - protein, 24 aa, Mycobacterium avium
IETRGRFGTFVARYDPTDAAMAAA

SEQ ID NO: 81072 - protein, 27 aa, Mycobacterium avium
IEVAVCSTGLIGDRLPMDKLLAGVRTI

SEQ ID NO: 81073 - protein, 19 aa, Mycobacterium avium
IEVIEFCVGIPHLLKGEYS

SEQ ID NO: 81074 - protein, 26 aa, Mycobacterium avium
IEVLRFRTADGLVHYVSLGCSRHPMT

SEQ ID NO: 81075 - protein, 33 aa, Mycobacterium avium
IEVVKGGLILDIGLRGFLPASLVEMRRVRDLQP

SEQ ID NO: 81076 - protein, 17 aa, Mycobacterium avium
IEVVTDMWGRPRVRLSG

SEQ ID NO: 81077 - protein, 17 aa, Mycobacterium avium
IFADAVVRPRLKIVESI

SEQ ID NO: 81078 - protein, 18 aa, Mycobacterium avium
IFQREMRGAQGIDHPLIR

SEQ ID NO: 81079 - protein, 20 aa, Mycobacterium avium
IFREEMCRLGRQPVAPEYEA

SEQ ID NO: 81080 - protein, 26 aa, Mycobacterium avium
IFVKDKPAWLGRAWRRIGEEVAAGRQ

SEQ ID NO: 81081 - protein, 17 aa, Mycobacterium avium
IGAARLSAFSVLLEMLG

SEQ ID NO: 81082 - protein, 18 aa, Mycobacterium avium
IGADRLPIVDTWWQTETG

SEQ ID NO: 81083 - protein, 18 aa, Mycobacterium avium
IGASGLRQVHELVRQLRG

SEQ ID NO: 81084 - protein, 19 aa, Mycobacterium avium
IGCGLPAAKALPILDALLN

SEQ ID NO: 81085 - protein, 22 aa, Mycobacterium avium
IGDGCVMPGFVEAHGHPLMEAV

SEQ ID NO: 81086 - protein, 20 aa, Mycobacterium avium
IGDLFGGLFGRASGGRPSRP

SEQ ID NO: 81087 - protein, 18 aa, Mycobacterium avium
IGDPRIDVGWFLINCDPD

SEQ ID NO: 81088 - protein, 19 aa, Mycobacterium avium
IGDRLGLAAAGVRRHLDAL

SEQ ID NO: 81089 - protein, 34 aa, Mycobacterium avium
IGEACRRARRKGIKVAHAHLRYLNPFPANLGEVL

SEQ ID NO: 81090 - protein, 22 aa, Mycobacterium avium
IGGAKRGKAIIILNPADPPMIM

SEQ ID NO: 81091 - protein, 18 aa, Mycobacterium avium
IGGDGFRIVLSADVANIA

SEQ ID NO: 81092 - protein, 19 aa, Mycobacterium avium
IGGGGRYDGLMRQLGGQDL

SEQ ID NO: 81093 - protein, 19 aa, Mycobacterium avium
IGGLLRYGIPEFKMEKRVL

SEQ ID NO: 81094 - protein, 20 aa, Mycobacterium avium
IGGLPRGRVVEIYGPESSGK

SEQ ID NO: 81095 - protein, 24 aa, Mycobacterium avium
IGGMPAPPPLAWAVNEMLICANPS

SEQ ID NO: 81096 - protein, 19 aa, Mycobacterium avium
IGGNSAWRAIAGPTPRVNP

SEQ ID NO: 81097 - protein, 26 aa, Mycobacterium avium
IGGPVKRDAALCLATLRVGADPQGAP

SEQ ID NO: 81098 - protein, 17 aa, Mycobacterium avium
IGIGGNSAWRAIAGPTP

SEQ ID NO: 81099 - protein, 25 aa, Mycobacterium avium
IGIGLLIDGRWRWRSYSLTSSPATS

SEQ ID NO: 81100 - protein, 20 aa, Mycobacterium avium
IGILPRHIPLVAQLVDDAMV

SEQ ID NO: 81101 - protein, 24 aa, Mycobacterium avium
IGISRIGRRTGIPGLELTMEAVRA

SEQ ID NO: 81102 - protein, 20 aa, Mycobacterium avium
IGKGCARKLVERGYDVLLCA

SEQ ID NO: 81103 - protein, 21 aa, Mycobacterium avium
IGLAGRPRLLIADEPTSALDV

SEQ ID NO: 81104 - protein, 17 aa, Mycobacterium avium
IGLRLKSSDTLYCCLPL

SEQ ID NO: 81105 - protein, 24 aa, Mycobacterium avium
IGMFTDRHALALGPGKALLDGQIQ

SEQ ID NO: 81106 - protein, 22 aa, Mycobacterium avium
IGNPPLVVTVNFLGTRQLTEAL

SEQ ID NO: 81107 - protein, 22 aa, Mycobacterium avium
IGNTEWPKWETVMATDPVDPAQ

SEQ ID NO: 81108 - protein, 29 aa, Mycobacterium avium
IGNTWECAAHVYLRRALTSTELWPVALKE

SEQ ID NO: 81109 - protein, 19 aa, Mycobacterium avium
IGNWHGWSRQRIVNAVDAA

SEQ ID NO: 81110 - protein, 17 aa, Mycobacterium avium
IGPELIDDVVWGCVSQV

SEQ ID NO: 81111 - protein, 24 aa, Mycobacterium avium
IGPKTIRSAAAWADGLAGTTLDLD

SEQ ID NO: 81112 - protein, 21 aa, Mycobacterium avium
IGPRTRMRWEQVADWDYVCEQ

SEQ ID NO: 81113 - protein, 22 aa, Mycobacterium avium
IGPTRITAVLGILKAYTTRVGS

SEQ ID NO: 81114 - protein, 17 aa, Mycobacterium avium
IGPVAAFLASRRNSYMT

SEQ ID NO: 81115 - protein, 19 aa, Mycobacterium avium
IGQAFGRDHTTVMYAQRKI

SEQ ID NO: 81116 - protein, 22 aa, Mycobacterium avium
IGQCFTGGFALAAAVDESVLAP

SEQ ID NO: 81117 - protein, 19 aa, Mycobacterium avium
IGQLLPCNVVVRSDPAEGD

SEQ ID NO: 81118 - protein, 17 aa, Mycobacterium avium
IGRLRWQFDRIARSIPL

SEQ ID NO: 81119 - protein, 20 aa, Mycobacterium avium
IGRPDAWEVQGRGELALAVL

SEQ ID NO: 81120 - protein, 25 aa, Mycobacterium avium
IGSKCPQCGTYVFPPRENNCPNPGC

SEQ ID NO: 81121 - protein, 26 aa, Mycobacterium avium
IGSNVARTVFKSMLIAVLDRMPDYRC

SEQ ID NO: 81122 - protein, 17 aa, Mycobacterium avium
IGTAGFSALHRINVICS

SEQ ID NO: 81123 - protein, 17 aa, Mycobacterium avium
IGTLGFMRHDYVNFGFD

SEQ ID NO: 81124 - protein, 25 aa, Mycobacterium avium
IGTLQRLAALQGRRVDALTEEEPGR

SEQ ID NO: 81125 - protein, 23 aa, Mycobacterium avium
IGVDAGRWPELLAALDDSSLVVA

SEQ ID NO: 81126 - protein, 19 aa, Mycobacterium avium
IGVHRCIGSNVARTVFKSM

SEQ ID NO: 81127 - protein, 19 aa, Mycobacterium avium
IGVKIRWVGSRPRLWRSVI

SEQ ID NO: 81128 - protein, 20 aa, Mycobacterium avium
IGVLYGRREVLSQLPPFLTG

SEQ ID NO: 81129 - protein, 17 aa, Mycobacterium avium
IGVVGLLNVQYALKDDV

SEQ ID NO: 81130 - protein, 22 aa, Mycobacterium avium
IGYTCAGTVEFLLDERGNHVFI

SEQ ID NO: 81131 - protein, 26 aa, Mycobacterium avium
IHESAKRICKEAHYYGAGTVEYLVGQ

SEQ ID NO: 81132 - protein, 19 aa, Mycobacterium avium
IHETREWILRNSPVPVGTV

SEQ ID NO: 81133 - protein, 17 aa, Mycobacterium avium
IHGADPWWDVAIRLLLK

SEQ ID NO: 81134 - protein, 19 aa, Mycobacterium avium
IHGVQICQHHCPVSHVAEE

SEQ ID NO: 81135 - protein, 23 aa, Mycobacterium avium
IHPVAACATAAVSVEEGVDKIRL

SEQ ID NO: 81136 - protein, 21 aa, Mycobacterium avium
IHRTGRCVVMHEGPRTLGYGA

SEQ ID NO: 81137 - protein, 17 aa, Mycobacterium avium
IHSCPGAPLARAETRVA

SEQ ID NO: 81138 - protein, 21 aa, Mycobacterium avium
IHVYRWKPTPAGGEFDQLVAS

SEQ ID NO: 81139 - protein, 18 aa, Mycobacterium avium
IIAAVPVLLSDDVEGARA

SEQ ID NO: 81140 - protein, 23 aa, Mycobacterium avium
IIDRLKDIINRGGENVSSVEVEA

SEQ ID NO: 81141 - protein, 18 aa, Mycobacterium avium
IIEEGFAAATAKHVAERA

SEQ ID NO: 81142 - protein, 24 aa, Mycobacterium avium
IIELFRGGPDYALFLYRNHGPLIY

SEQ ID NO: 81143 - protein, 26 aa, Mycobacterium avium
IIFDPNCFALATGIEEHATYGIDFIE

SEQ ID NO: 81144 - protein, 18 aa, Mycobacterium avium
IIGMLTLLIGGGFDTTTA

SEQ ID NO: 81145 - protein, 24 aa, Mycobacterium avium
IIGRIKDLLIVYGRNHSPDDIEAT

SEQ ID NO: 81146 - protein, 19 aa, Mycobacterium avium
IIHRPRYDDWSLPKGKVDP

SEQ ID NO: 81147 - protein, 26 aa, Mycobacterium avium
IIRVAARLAAAGWPLAGIDVSEVIPG

SEQ ID NO: 81148 - protein, 19 aa, Mycobacterium avium
IISCGAALDHFRVAMAAAG

SEQ ID NO: 81149 - protein, 24 aa, Mycobacterium avium
IISNGRASYILALGYRPEEFEHFG

SEQ ID NO: 81150 - protein, 25 aa, Mycobacterium avium
IIYDEVHLLPAPVFRMTADLQSKRR

SEQ ID NO: 81151 - protein, 26 aa, Mycobacterium avium
IKAGKAGLVPAHLRDGHYSGAAALGH

SEQ ID NO: 81152 - protein, 18 aa, Mycobacterium avium
IKDAGGRAVANYDSVAEP

SEQ ID NO: 81153 - protein, 19 aa, Mycobacterium avium
IKENLPGVHLSGGISNVSF

SEQ ID NO: 81154 - protein, 22 aa, Mycobacterium avium
IKHLCAEMLCRAEQAEVAAADA

SEQ ID NO: 81155 - protein, 22 aa, Mycobacterium avium
IKKGVLELADIVVVNKADGEHL

SEQ ID NO: 81156 - protein, 25 aa, Mycobacterium avium
IKKHARLNMMAHLLSTIPYHAVEAP

SEQ ID NO: 81157 - protein, 22 aa, Mycobacterium avium
IKKQMIDWWGPIIDEYYASSEA

SEQ ID NO: 81158 - protein, 17 aa, Mycobacterium avium
IKLADLVSSLGKPELVI

SEQ ID NO: 81159 - protein, 27 aa, Mycobacterium avium
IKPQRGRISTWPLPEAFNGITVNGVLA

SEQ ID NO: 81160 - protein, 22 aa, Mycobacterium avium
IKPSHLAGGYAQHAFAFNYLGP

SEQ ID NO: 81161 - protein, 18 aa, Mycobacterium avium
IKQVWTPRQQRVVGEDGF

SEQ ID NO: 81162 - protein, 22 aa, Mycobacterium avium
IKSREIYEAPGAMVLITAHTEL

SEQ ID NO: 81163 - protein, 22 aa, Mycobacterium avium
IKTAKLRAAQRVQRFLDAAQAI

SEQ ID NO: 81164 - protein, 26 aa, Mycobacterium avium
IKTRQAIRREAFRLIEQNGYAATTVE

SEQ ID NO: 81165 - protein, 19 aa, Mycobacterium avium
IKTWSRRSTIIPDFIGHTF

SEQ ID NO: 81166 - protein, 29 aa, Mycobacterium avium
IKVPLAIAALRKDWLGARELATKAVTESD

SEQ ID NO: 81167 - protein, 24 aa, Mycobacterium avium
IKVVREIVSGLGLKEAKDLVDGAP

SEQ ID NO: 81168 - protein, 22 aa, Mycobacterium avium
ILCDPWVNPAYFASWFPFPDNS

SEQ ID NO: 81169 - protein, 19 aa, Mycobacterium avium
ILDQLRTAYGQGFLDDIPK

SEQ ID NO: 81170 - protein, 17 aa, Mycobacterium avium
ILDREVFDVVAARLRAQ

SEQ ID NO: 81171 - protein, 22 aa, Mycobacterium avium
ILEARGSGQWATFSELVADCEG

SEQ ID NO: 81172 - protein, 18 aa, Mycobacterium avium
ILENPAWYTAYTPYQPEI

SEQ ID NO: 81173 - protein, 24 aa, Mycobacterium avium
ILERRARIGGTWDLFRYPGVRSDS

SEQ ID NO: 81174 - protein, 17 aa, Mycobacterium avium
ILGAIAPLAPEIATGEA

SEQ ID NO: 81175 - protein, 18 aa, Mycobacterium avium
ILGDPVVDMVVAVRRLEQ

SEQ ID NO: 81176 - protein, 22 aa, Mycobacterium avium
ILGRSRWAPSVFGCQAPDSGNA

SEQ ID NO: 81177 - protein, 17 aa, Mycobacterium avium
ILICNRTGSALGRSVKL

SEQ ID NO: 81178 - protein, 23 aa, Mycobacterium avium
ILIGHSLGGFVIQRYLETHRVPA

SEQ ID NO: 81179 - protein, 19 aa, Mycobacterium avium
ILKNPALEAVRVAARSAPK

SEQ ID NO: 81180 - protein, 25 aa, Mycobacterium avium
ILLDAPSVLGWAEFRDVAQRYSLGM

SEQ ID NO: 81181 - protein, 18 aa, Mycobacterium avium
ILLLDGLPNYQRLFSLRI

SEQ ID NO: 81182 - protein, 18 aa, Mycobacterium avium
ILLRRRPSGLVRPDDTEL

SEQ ID NO: 81183 - protein, 19 aa, Mycobacterium avium
ILLVEHGPGLTVSRDLPKL

SEQ ID NO: 81184 - protein, 30 aa, Mycobacterium avium
ILNFVFGEMWLRPGLGMKERRLITVACVAF

SEQ ID NO: 81185 - protein, 22 aa, Mycobacterium avium
ILNKLLRSSVRFQHLPVPFELY

SEQ ID NO: 81186 - protein, 21 aa, Mycobacterium avium
ILRAPLVKAFLLQVSAKTLGE

SEQ ID NO: 81187 - protein, 17 aa, Mycobacterium avium
ILREEWARRITEAELLT

SEQ ID NO: 81188 - protein, 19 aa, Mycobacterium avium
ILRIATWHYQFHRLRSPFR

SEQ ID NO: 81189 - protein, 22 aa, Mycobacterium avium
ILRRELPDLAVRVVNVVDLMRL

SEQ ID NO: 81190 - protein, 20 aa, Mycobacterium avium
ILSERYGYRFDYHDIDSFAE

SEQ ID NO: 81191 - protein, 34 aa, Mycobacterium avium
ILSRELPESIIIAGAGAIGMEFGYVLHNYGVEVT

SEQ ID NO: 81192 - protein, 24 aa, Mycobacterium avium
ILTAAWLRALERFQARALAADGDT

SEQ ID NO: 81193 - protein, 19 aa, Mycobacterium avium
ILTQRGDAVTSLFRNPDHA

SEQ ID NO: 81194 - protein, 24 aa, Mycobacterium avium
ILVCPADRGPLVLVGQELLYNPRL

SEQ ID NO: 81195 - protein, 18 aa, Mycobacterium avium
IMDSLRYWVTEMHVDGFR

SEQ ID NO: 81196 - protein, 19 aa, Mycobacterium avium
IMIRRRSYNYTDGLDANGQ

SEQ ID NO: 81197 - protein, 31 aa, Mycobacterium avium
IMKADHGLALPRRLQIEFSQVIQKISEGEGG

SEQ ID NO: 81198 - protein, 23 aa, Mycobacterium avium
IMVSFPVECWKQPRVPDSGASTL

SEQ ID NO: 81199 - protein, 23 aa, Mycobacterium avium
INDEYPFLLGHEAAGRVEAVGPD

SEQ ID NO: 81200 - protein, 18 aa, Mycobacterium avium
INEAASLVQDAAHQDANI

SEQ ID NO: 81201 - protein, 17 aa, Mycobacterium avium
INGGNYFGADSPFGGFK

SEQ ID NO: 81202 - protein, 23 aa, Mycobacterium avium
INGYPRLLCMTRMSTFAEDEVVT

SEQ ID NO: 81203 - protein, 19 aa, Mycobacterium avium
INIACSLGMLTAEQVEQLA

SEQ ID NO: 81204 - protein, 18 aa, Mycobacterium avium
INIPEDFDGIAAHRSSVT

SEQ ID NO: 81205 - protein, 19 aa, Mycobacterium avium
INISSALGLFSAPGQAAYV

SEQ ID NO: 81206 - protein, 24 aa, Mycobacterium avium
INKITWANACRFFSWDPFARTPRD

SEQ ID NO: 81207 - protein, 24 aa, Mycobacterium avium
INPEAWRWYRSVIGADRLPIVDTW

SEQ ID NO: 81208 - protein, 21 aa, Mycobacterium avium
INPGQRYGFRVYGPFEPSAGH

SEQ ID NO: 81209 - protein, 19 aa, Mycobacterium avium
INTMPGFTTISMYPRMWAA

SEQ ID NO: 81210 - protein, 24 aa, Mycobacterium avium
IPADRPAIVIADGLFPFLNKEQII

SEQ ID NO: 81211 - protein, 21 aa, Mycobacterium avium
IPAIRIPLHGRIEVDHPYVLL

SEQ ID NO: 81212 - protein, 22 aa, Mycobacterium avium
IPAQAIAQVCELTWQLRGQATG

SEQ ID NO: 81213 - protein, 21 aa, Mycobacterium avium
IPARPVVIGPITFLLLSKGVD

SEQ ID NO: 81214 - protein, 17 aa, Mycobacterium avium
IPDAAAVTVNFRFAPDR

SEQ ID NO: 81215 - protein, 26 aa, Mycobacterium avium
IPDFVKLAEALGCVGLRCEREEDVVD

SEQ ID NO: 81216 - protein, 17 aa, Mycobacterium avium
IPDKGRILTAMSVFFFG

SEQ ID NO: 81217 - protein, 19 aa, Mycobacterium avium
IPDSEFKAAGAQLADTAEQ

SEQ ID NO: 81218 - protein, 25 aa, Mycobacterium avium
IPEGLLNYLALLGWAIADDRDVFSL

SEQ ID NO: 81219 - protein, 19 aa, Mycobacterium avium
IPEVRAHALAIGDDLVGRG

SEQ ID NO: 81220 - protein, 19 aa, Mycobacterium avium
IPGAPVIGELVPRGEHTIV

SEQ ID NO: 81221 - protein, 21 aa, Mycobacterium avium
IPGFYTRTGYGTTLAEGKDTR

SEQ ID NO: 81222 - protein, 27 aa, Mycobacterium avium
IPIDLRGDWPAALSAAGFDPAAPTAWL

SEQ ID NO: 81223 - protein, 17 aa, Mycobacterium avium
IPIRAGSDVVLLGALIN

SEQ ID NO: 81224 - protein, 20 aa, Mycobacterium avium
IPLAIARPDLEVVLLEPLLR

SEQ ID NO: 81225 - protein, 20 aa, Mycobacterium avium
IPLDAARVAGVYAAYEALKA

SEQ ID NO: 81226 - protein, 27 aa, Mycobacterium avium
IPPAHRAAIEFAPPLPAEYEQLARHWP

SEQ ID NO: 81227 - protein, 17 aa, Mycobacterium avium
IPPDFSAPFDREIGLQF

SEQ ID NO: 81228 - protein, 23 aa, Mycobacterium avium
IPPELRPMVQLDGGRFATSDLND

SEQ ID NO: 81229 - protein, 22 aa, Mycobacterium avium
IPPERLRYAPGQFLTLRVPSER

SEQ ID NO: 81230 - protein, 18 aa, Mycobacterium avium
IPQFLAIAREAAERATGL

SEQ ID NO: 81231 - protein, 19 aa, Mycobacterium avium
IPQPIAWPGSSDRNFYDRS

SEQ ID NO: 81232 - protein, 21 aa, Mycobacterium avium
IPRAHRGIVAVNELPDLAERI

SEQ ID NO: 81233 - protein, 25 aa, Mycobacterium avium
IPRSEYRIDDVWHVVGLRGTGSNTV

SEQ ID NO: 81234 - protein, 28 aa, Mycobacterium avium
IPSYKACFLAMVRRFYELGVKDLNGHLL

SEQ ID NO: 81235 - protein, 22 aa, Mycobacterium avium
IPTTRHIPAFKLTRSSAAYWRG

SEQ ID NO: 81236 - protein, 17 aa, Mycobacterium avium
IPVDSIYSPVLKVTYKV

SEQ ID NO: 81237 - protein, 20 aa, Mycobacterium avium
IPVRRSWRLNERHYGALQGL

SEQ ID NO: 81238 - protein, 25 aa, Mycobacterium avium
IQAIKGVEIGDGFATARRRGSQAHD

SEQ ID NO: 81239 - protein, 26 aa, Mycobacterium avium
IQAQDFFFRKIVRDKGVALAHVSEQI

SEQ ID NO: 81240 - protein, 20 aa, Mycobacterium avium
IQDGPGWWTARAAIQQTAHA

SEQ ID NO: 81241 - protein, 23 aa, Mycobacterium avium
IQDGRLHYVYNFLGERQQEVSSS

SEQ ID NO: 81242 - protein, 19 aa, Mycobacterium avium
IQEALKAAAIISGVAQAIV

SEQ ID NO: 81243 - protein, 26 aa, Mycobacterium avium
IQGHASPGIYARAFLEGRLTADQLDG

SEQ ID NO: 81244 - protein, 26 aa, Mycobacterium avium
IQIPVGPRLGNVVVEVEHLDKGYDGR

SEQ ID NO: 81245 - protein, 20 aa, Mycobacterium avium
IQLAEWEWPENPRFLMCTPL

SEQ ID NO: 81246 - protein, 24 aa, Mycobacterium avium
IQNYGDVAYGWAMEDTTGVVKLIA

SEQ ID NO: 81247 - protein, 22 aa, Mycobacterium avium
IQRRAEAGIGLTSPELCTLMAH

SEQ ID NO: 81248 - protein, 18 aa, Mycobacterium avium
IQTAFIYDHFTPFVFVQL

SEQ ID NO: 81249 - protein, 21 aa, Mycobacterium avium
IRADLAIVKAWKGDKAGNLVY

SEQ ID NO: 81250 - protein, 19 aa, Mycobacterium avium
IRADLPPERCVSLGYTDPD

SEQ ID NO: 81251 - protein, 19 aa, Mycobacterium avium
IRAGAVWVAANIDLTLPTE

SEQ ID NO: 81252 - protein, 18 aa, Mycobacterium avium
IRAGLGSSVPDFWEGELQ

SEQ ID NO: 81253 - protein, 25 aa, Mycobacterium avium
IRDFARASFKYGLNAKWPVYLSTKN

SEQ ID NO: 81254 - protein, 21 aa, Mycobacterium avium
IRGADVFLGLSGGVVPEEMIA

SEQ ID NO: 81255 - protein, 17 aa, Mycobacterium avium
IRGEIDRVGAGEWPVED

SEQ ID NO: 81256 - protein, 18 aa, Mycobacterium avium
IRGEVLRILAGVDGEIRR

SEQ ID NO: 81257 - protein, 25 aa, Mycobacterium avium
IRGLPPKRRYEVLKALNDDRLADIL

SEQ ID NO: 81258 - protein, 19 aa, Mycobacterium avium
IRHVARFCELLGVESAHFV

SEQ ID NO: 81259 - protein, 20 aa, Mycobacterium avium
IRIGAPASWTAAVDAQQQSH

SEQ ID NO: 81260 - protein, 17 aa, Mycobacterium avium
IRKPPELSWEVAGSLYV

SEQ ID NO: 81261 - protein, 18 aa, Mycobacterium avium
IRLAVDAVEDMFRLPDLT

SEQ ID NO: 81262 - protein, 18 aa, Mycobacterium avium
IRLEGKSVLISDSERLAR

SEQ ID NO: 81263 - protein, 17 aa, Mycobacterium avium
IRLLKLPIAVQRRVAAG

SEQ ID NO: 81264 - protein, 29 aa, Mycobacterium avium
IRNVWRFWYQIPISLPVIGPRVISTPDSR

SEQ ID NO: 81265 - protein, 18 aa, Mycobacterium avium
IRQDIDWMDYLDRPTGPR

SEQ ID NO: 81266 - protein, 27 aa, Mycobacterium avium
IRREAAKPGSYRWLKGGQRVPADERVG

SEQ ID NO: 81267 - protein, 20 aa, Mycobacterium avium
IRRKAMEELHRIRKDGEAGE

SEQ ID NO: 81268 - protein, 18 aa, Mycobacterium avium
IRSCGAPILTLRTDRDWI

SEQ ID NO: 81269 - protein, 34 aa, Mycobacterium avium
IRSKGDSADGVWSRMKFEGGVHRVQRVPVTESQG

SEQ ID NO: 81270 - protein, 19 aa, Mycobacterium avium
IRSRIRFNTKVLAAEFDDE

SEQ ID NO: 81271 - protein, 18 aa, Mycobacterium avium
IRTIAGVYRDEAGKATNI

SEQ ID NO: 81272 - protein, 29 aa, Mycobacterium avium
IRTLPQILSEAGWYSALFGMQHETSYPKR

SEQ ID NO: 81273 - protein, 18 aa, Mycobacterium avium
IRTLSALALLDTEVLLPG

SEQ ID NO: 81274 - protein, 27 aa, Mycobacterium avium
IRVDGWPGQQFALLFVDWLTADPDARA

SEQ ID NO: 81275 - protein, 23 aa, Mycobacterium avium
IRVLRPGGRFVFAGEPTSAGDVY

SEQ ID NO: 81276 - protein, 22 aa, Mycobacterium avium
IRVRILPTWLRLDARFGSVYRR

SEQ ID NO: 81277 - protein, 22 aa, Mycobacterium avium
IRWAEHALAVIARRLPTTDADS

SEQ ID NO: 81278 - protein, 22 aa, Mycobacterium avium
IRWMGSGPLTGLAEIALPDLQP

SEQ ID NO: 81279 - protein, 20 aa, Mycobacterium avium
IRYLMFSVFAVRPGALGDQR

SEQ ID NO: 81280 - protein, 19 aa, Mycobacterium avium
IRYTELRPFVLHVNHTGAR

SEQ ID NO: 81281 - protein, 19 aa, Mycobacterium avium
ISAAGGRAVVMTYWNPVLR

SEQ ID NO: 81282 - protein, 22 aa, Mycobacterium avium
ISADELRARFGFYFDKFDVRPE

SEQ ID NO: 81283 - protein, 25 aa, Mycobacterium avium
ISAGCAGFGYALGVAADMVRGGTAG

SEQ ID NO: 81284 - protein, 17 aa, Mycobacterium avium
ISAIKAIFAAWEGRARL

SEQ ID NO: 81285 - protein, 21 aa, Mycobacterium avium
ISCVSAGSILRNLDPRRFEVV

SEQ ID NO: 81286 - protein, 18 aa, Mycobacterium avium
ISEAVLFLASDAARYITG

SEQ ID NO: 81287 - protein, 17 aa, Mycobacterium avium
ISEHVRVVVALGGFGWQ

SEQ ID NO: 81288 - protein, 19 aa, Mycobacterium avium
ISEQEWRQHWPAGDTDPEP

SEQ ID NO: 81289 - protein, 21 aa, Mycobacterium avium
ISFQLRQGRTLGIVGESGSGK

SEQ ID NO: 81290 - protein, 26 aa, Mycobacterium avium
ISGAFLAKLGCTFVVVGHSERRTYHN

SEQ ID NO: 81291 - protein, 18 aa, Mycobacterium avium
ISHDRWFLDRTCTHILAW

SEQ ID NO: 81292 - protein, 21 aa, Mycobacterium avium
ISHVYPTGASLYFTVVAGQRG

SEQ ID NO: 81293 - protein, 23 aa, Mycobacterium avium
ISIDLRDDWPAALREGGFDVTRP

SEQ ID NO: 81294 - protein, 25 aa, Mycobacterium avium
ISKAPLVPSMLEWLHTARTSMVMDT

SEQ ID NO: 81295 - protein, 17 aa, Mycobacterium avium
ISKPVGLGFTQGGGENN

SEQ ID NO: 81296 - protein, 22 aa, Mycobacterium avium
ISPSGPRLAGALGTSLLSLSMS

SEQ ID NO: 81297 - protein, 24 aa, Mycobacterium avium
ISQGRLEALLNFQTMVADLTGLEI

SEQ ID NO: 81298 - protein, 24 aa, Mycobacterium avium
ISQNWRLSGLAGEYITPVPAQQRL

SEQ ID NO: 81299 - protein, 20 aa, Mycobacterium avium
ISQPFWPAYITKERFAKARN

SEQ ID NO: 81300 - protein, 22 aa, Mycobacterium avium
ISRLTRRRVRLIARRPDGATLV

SEQ ID NO: 81301 - protein, 18 aa, Mycobacterium avium
ISRTAFLHVDYRKITPID

SEQ ID NO: 81302 - protein, 18 aa, Mycobacterium avium
ISTLPMAVPVNLRAEADT

SEQ ID NO: 81303 - protein, 23 aa, Mycobacterium avium
ISVHVRGSVVLQRLYEKNQSSDV

SEQ ID NO: 81304 - protein, 17 aa, Mycobacterium avium
ITAAGLRESHPHDVAMT

SEQ ID NO: 81305 - protein, 25 aa, Mycobacterium avium
ITEFLQREVQGFLRLAQPPAATSRF

SEQ ID NO: 81306 - protein, 26 aa, Mycobacterium avium
ITEVPMKRFDLMNGIQVRGTYAVSQA

SEQ ID NO: 81307 - protein, 17 aa, Mycobacterium avium
ITGELAADIVLVVNEAC

SEQ ID NO: 81308 - protein, 29 aa, Mycobacterium avium
ITGPHRYPGWPFRIAPGPRRHHRTAPPTL

SEQ ID NO: 81309 - protein, 17 aa, Mycobacterium avium
ITGSARFRNLIKAEDYD

SEQ ID NO: 81310 - protein, 22 aa, Mycobacterium avium
ITIPQFRTLVILSNRGPVNLAT

SEQ ID NO: 81311 - protein, 23 aa, Mycobacterium avium
ITLEAGVSLGAMPIYRFGNEEQK

SEQ ID NO: 81312 - protein, 19 aa, Mycobacterium avium
ITPFNFPAMIPLWKAGPAL

SEQ ID NO: 81313 - protein, 25 aa, Mycobacterium avium
ITRKNGRGETEWIPPPHLDHGRPRT

SEQ ID NO: 81314 - protein, 28 aa, Mycobacterium avium
ITRKNGRGETEWIPPPHLERGQPRVNSF

SEQ ID NO: 81315 - protein, 18 aa, Mycobacterium avium
ITSVKVRSVLTCTTGTGV

SEQ ID NO: 81316 - protein, 26 aa, Mycobacterium avium
ITTWAPRSTGAIAYRALAREFIDRFG

SEQ ID NO: 81317 - protein, 30 aa, Mycobacterium avium
ITVEPWVPLPEFWVRRARKKILHAALEGLR

SEQ ID NO: 81318 - protein, 23 aa, Mycobacterium avium
ITVPEFPNFFIIYGPGTHLAHGG

SEQ ID NO: 81319 - protein, 20 aa, Mycobacterium avium
ITVRAANFGNLYLADDRQGR

SEQ ID NO: 81320 - protein, 24 aa, Mycobacterium avium
IVARVVSMPCVEWFESQPDDYRDS

SEQ ID NO: 81321 - protein, 18 aa, Mycobacterium avium
IVDLCTGSGALAVALAHH

SEQ ID NO: 81322 - protein, 25 aa, Mycobacterium avium
IVDRALQRWGHIDFLINNAGVGSPK

SEQ ID NO: 81323 - protein, 24 aa, Mycobacterium avium
IVEEPPEHLIFIFATTEPEKVLPT

SEQ ID NO: 81324 - protein, 20 aa, Mycobacterium avium
IVEICRMVWRRERVQYAGRH

SEQ ID NO: 81325 - protein, 25 aa, Mycobacterium avium
IVEPKYWGGVCLNVGCIPSKALLRN

SEQ ID NO: 81326 - protein, 17 aa, Mycobacterium avium
IVGFRIPYIKGKDTEPL

SEQ ID NO: 81327 - protein, 24 aa, Mycobacterium avium
IVGRIKDLLIINGRNHYPEDIEAT

SEQ ID NO: 81328 - protein, 34 aa, Mycobacterium avium
IVHSHYWLSGQVGWLARDRWAVPLVHTAHTLAAV

SEQ ID NO: 81329 - protein, 18 aa, Mycobacterium avium
IVIELKRDAVAKVVLNNL

SEQ ID NO: 81330 - protein, 18 aa, Mycobacterium avium
IVRDLRREFDWLGVALQA

SEQ ID NO: 81331 - protein, 22 aa, Mycobacterium avium
IVRFYADLLRSYPFTEDLGEKE

SEQ ID NO: 81332 - protein, 18 aa, Mycobacterium avium
IVTWVLAGALAHQDSTGN

SEQ ID NO: 81333 - protein, 18 aa, Mycobacterium avium
IVVARLAKGLTWQELADA

SEQ ID NO: 81334 - protein, 19 aa, Mycobacterium avium
IVVREGLSADLARALHDDA

SEQ ID NO: 81335 - protein, 19 aa, Mycobacterium avium
IWEPGWFLTYHYWPTAVDR

SEQ ID NO: 81336 - protein, 19 aa, Mycobacterium avium
IWGFPKIMADFTVREQGRF

SEQ ID NO: 81337 - protein, 19 aa, Mycobacterium avium
IWKMIKENLILPYLDIDLD

SEQ ID NO: 81338 - protein, 17 aa, Mycobacterium avium
IWYPMVYDMPARAKESF

SEQ ID NO: 81339 - protein, 25 aa, Mycobacterium avium
IYCRPSCPVRPPFARNVRFYPTAAA

SEQ ID NO: 81340 - protein, 18 aa, Mycobacterium avium
IYQFRISPHPTIELASTP

SEQ ID NO: 81341 - protein, 19 aa, Mycobacterium avium
IYSFLRLLLPAGLETTYRS

SEQ ID NO: 81342 - protein, 19 aa, Mycobacterium avium
IYSFLRLLLPAGVETTYRA

SEQ ID NO: 81343 - protein, 18 aa, Mycobacterium avium
IYTRRMQRALGYEGDDVI

SEQ ID NO: 81344 - protein, 18 aa, Mycobacterium avium
IYVDRIIQGIGYEKRIEF

SEQ ID NO: 81345 - protein, 17 aa, Mycobacterium avium
IYVKDGIITWETQQTDY

SEQ ID NO: 81346 - protein, 20 aa, Mycobacterium avium
IYVPRLTRRSGQPAAAALTL

SEQ ID NO: 81347 - protein, 30 aa, Mycobacterium avium
KAAAAGRPWWEWAATYERAFSAAYDALDVL

SEQ ID NO: 81348 - protein, 25 aa, Mycobacterium avium
KAAAEGRLKGILKYYDAPIVSSDIV

SEQ ID NO: 81349 - protein, 17 aa, Mycobacterium avium
KAALRALIPHLKRKEDR

SEQ ID NO: 81350 - protein, 21 aa, Mycobacterium avium
KAALVGSMSVPQGWTEAAPAI

SEQ ID NO: 81351 - protein, 31 aa, Mycobacterium avium
KADFWFDPLCPWAWITSRWILEVEKVRDIEV

SEQ ID NO: 81352 - protein, 32 aa, Mycobacterium avium
KADLPRHIAVLCDGNRRWARDAGYDDVSYGYR

SEQ ID NO: 81353 - protein, 25 aa, Mycobacterium avium
KAEAALRERFGYDAWVLVYDLDTVR

SEQ ID NO: 81354 - protein, 18 aa, Mycobacterium avium
KAFSMLRNHYSVVLVDCV

SEQ ID NO: 81355 - protein, 24 aa, Mycobacterium avium
KAGEGDAFISAGVETVSRFPKGSA

SEQ ID NO: 81356 - protein, 22 aa, Mycobacterium avium
KAGIERRALRVILGNPLIAITM

SEQ ID NO: 81357 - protein, 30 aa, Mycobacterium avium
KAGMHLVEMRARHAALRFGDRAQAARVDEL

SEQ ID NO: 81358 - protein, 18 aa, Mycobacterium avium
KAIGYGMPGIRVDGNDVL

SEQ ID NO: 81359 - protein, 23 aa, Mycobacterium avium
KAKAQQLGLSWLAEIGAHGVVAG

SEQ ID NO: 81360 - protein, 18 aa, Mycobacterium avium
KALAGGGGRGMRKVHNAA

SEQ ID NO: 81361 - protein, 24 aa, Mycobacterium avium
KALEFRPKVIIAGWSAYPRVLDFA

SEQ ID NO: 81362 - protein, 20 aa, Mycobacterium avium
KALERFPISRVVSSPQRRAV

SEQ ID NO: 81363 - protein, 30 aa, Mycobacterium avium
KALEVREGPAALPWGDLGVDVVVESTGLFT

SEQ ID NO: 81364 - protein, 17 aa, Mycobacterium avium
KALGHAYGGGSQYYSMW

SEQ ID NO: 81365 - protein, 18 aa, Mycobacterium avium
KALRHARTILAAHDTALD

SEQ ID NO: 81366 - protein, 17 aa, Mycobacterium avium
KAMADRTLAEFGGIDYL

SEQ ID NO: 81367 - protein, 18 aa, Mycobacterium avium
KAMLQDMAILTGGQVISE

SEQ ID NO: 81368 - protein, 27 aa, Mycobacterium avium
KAMYANKAVPCWMIFDDGYVRRYVTSA

SEQ ID NO: 81369 - protein, 19 aa, Mycobacterium avium
KAPEAFPSDPVEMVKNRIH

SEQ ID NO: 81370 - protein, 21 aa, Mycobacterium avium
KAPKDRDIAMVFQSYALYPHM

SEQ ID NO: 81371 - protein, 19 aa, Mycobacterium avium
KARAGEIKGFTGIDDPYEA

SEQ ID NO: 81372 - protein, 17 aa, Mycobacterium avium
KARANRTPIDWDGYTPP

SEQ ID NO: 81373 - protein, 24 aa, Mycobacterium avium
KARVRALGVAGAFHTKYMASALDG

SEQ ID NO: 81374 - protein, 22 aa, Mycobacterium avium
KARYELALLAGRDPELAAALSE

SEQ ID NO: 81375 - protein, 26 aa, Mycobacterium avium
KASGLTARAGLLCLPTLSTHGYEVVA

SEQ ID NO: 81376 - protein, 26 aa, Mycobacterium avium
KATALREFAQRAGVPMAQTVAVGDGA

SEQ ID NO: 81377 - protein, 18 aa, Mycobacterium avium
KATFDVRVTAPRHWKVIS

SEQ ID NO: 81378 - protein, 21 aa, Mycobacterium avium
KATPEMVAFMVRYTSGYLCVP

SEQ ID NO: 81379 - protein, 26 aa, Mycobacterium avium
KATQEDPWRHFARTHAIGQIVPGKVT

SEQ ID NO: 81380 - protein, 17 aa, Mycobacterium avium
KATRDEIFVDLKQRVAA

SEQ ID NO: 81381 - protein, 17 aa, Mycobacterium avium
KAVRPARGRPPVAEADD

SEQ ID NO: 81382 - protein, 25 aa, Mycobacterium avium
KAVWWQRAVEAWPDYAEYQTKTDRQ

SEQ ID NO: 81383 - protein, 24 aa, Mycobacterium avium
KAYRVAGYRAGWLAITGPKDHAGS

SEQ ID NO: 81384 - protein, 32 aa, Mycobacterium avium
KCDPWGLDSFQLFPNFVILFWGQGWYLTYHYW

SEQ ID NO: 81385 - protein, 27 aa, Mycobacterium avium
KCQQVWCPVCALAALATGDQHPLLTAI

SEQ ID NO: 81386 - protein, 29 aa, Mycobacterium avium
KDAMAREVRRGGLPLQRLVNAESMSAVAR

SEQ ID NO: 81387 - protein, 25 aa, Mycobacterium avium
KDEKVEFVDVRFCDLPGIMQHFTIP

SEQ ID NO: 81388 - protein, 19 aa, Mycobacterium avium
KDGKRSLVVAGIKNCETMR

SEQ ID NO: 81389 - protein, 21 aa, Mycobacterium avium
KDGRPFPPWTDPESAFEAWKK

SEQ ID NO: 81390 - protein, 19 aa, Mycobacterium avium
KDICVRGMEIRTFMTDRPD

SEQ ID NO: 81391 - protein, 24 aa, Mycobacterium avium
KDIDFAFAVGQLFATVPYAQLILE

SEQ ID NO: 81392 - protein, 24 aa, Mycobacterium avium
KDLEIATAAPLRAVIETGIAQGVF

SEQ ID NO: 81393 - protein, 18 aa, Mycobacterium avium
KDLIKQFADHLPGDPRKV

SEQ ID NO: 81394 - protein, 21 aa, Mycobacterium avium
KDLPAATGDDIVWADAVIFGS

SEQ ID NO: 81395 - protein, 22 aa, Mycobacterium avium
KDLPGRLAAAGFADIHADARGG

SEQ ID NO: 81396 - protein, 18 aa, Mycobacterium avium
KDLSLALALGEAVSVDLP

SEQ ID NO: 81397 - protein, 25 aa, Mycobacterium avium
KDRFGAEIRTHYPLELSAEVGVIAQ

SEQ ID NO: 81398 - protein, 21 aa, Mycobacterium avium
KEESVGFLFNVTVEAVPAPQV

SEQ ID NO: 81399 - protein, 27 aa, Mycobacterium avium
KEFELLKYLAQHAGRVFTRAQLLHEVW

SEQ ID NO: 81400 - protein, 21 aa, Mycobacterium avium
KEFFTTLFMQQQWLRGGAEAG

SEQ ID NO: 81401 - protein, 18 aa, Mycobacterium avium
KEGAFRPGASRLLHELAP

SEQ ID NO: 81402 - protein, 23 aa, Mycobacterium avium
KEHKALVIKGGYMDGRALSVAEV

SEQ ID NO: 81403 - protein, 23 aa, Mycobacterium avium
KEHPANFGRLCTKGATTADLLAA

SEQ ID NO: 81404 - protein, 24 aa, Mycobacterium avium
KEIGPRIVPIIPDEARTFGMDSWF

SEQ ID NO: 81405 - protein, 25 aa, Mycobacterium avium
KEILEYHWGPDWVVYDAKGTSQQHG

SEQ ID NO: 81406 - protein, 27 aa, Mycobacterium avium
KEKGPRFALAGSYALWAYGAPEPSHDA

SEQ ID NO: 81407 - protein, 19 aa, Mycobacterium avium
KEKVMGFGHRVYKNGDSRV

SEQ ID NO: 81408 - protein, 19 aa, Mycobacterium avium
KELAEICGHVAGLPLDRDH

SEQ ID NO: 81409 - protein, 19 aa, Mycobacterium avium
KELAFPNAVLALFHYPDKT

SEQ ID NO: 81410 - protein, 18 aa, Mycobacterium avium
KELERMRLASARAAAGNA

SEQ ID NO: 81411 - protein, 23 aa, Mycobacterium avium
KELRNGSTVALVYLSPAAKPAAT

SEQ ID NO: 81412 - protein, 23 aa, Mycobacterium avium
KEMQRTEGFTALIDANRGCFAAF

SEQ ID NO: 81413 - protein, 19 aa, Mycobacterium avium
KEPVLSRVVEYWYNIDADI

SEQ ID NO: 81414 - protein, 23 aa, Mycobacterium avium
KEPWFRDAYRRAWDWADSTGWKP

SEQ ID NO: 81415 - protein, 18 aa, Mycobacterium avium
KERLLELLPNRVITDSIG

SEQ ID NO: 81416 - protein, 19 aa, Mycobacterium avium
KERPRVIAVDAVPNEVNST

SEQ ID NO: 81417 - protein, 18 aa, Mycobacterium avium
KERQRLGLEAAYCAETVA

SEQ ID NO: 81418 - protein, 18 aa, Mycobacterium avium
KFADEFHPELQFDRPYLL

SEQ ID NO: 81419 - protein, 24 aa, Mycobacterium avium
KFGKSTGGGSLWLDPALTTPYAWY

SEQ ID NO: 81420 - protein, 32 aa, Mycobacterium avium
KFQKELAAMGFKFQFITLAGFHALNYSMFDLA

SEQ ID NO: 81421 - protein, 19 aa, Mycobacterium avium
KGACAQVNKDLGLLAPEKA

SEQ ID NO: 81422 - protein, 18 aa, Mycobacterium avium
KGADEIRALAGRVDTARH

SEQ ID NO: 81423 - protein, 20 aa, Mycobacterium avium
KGAIRQIDFLTRATAQRPDA

SEQ ID NO: 81424 - protein, 29 aa, Mycobacterium avium
KGASRRARRAGKIPAVLYGHGTDPQHLEL

SEQ ID NO: 81425 - protein, 19 aa, Mycobacterium avium
KGCAISSSTCALVLAELER

SEQ ID NO: 81426 - protein, 23 aa, Mycobacterium avium
KGDPTLLTWEIYRDTVIEQCEQG

SEQ ID NO: 81427 - protein, 19 aa, Mycobacterium avium
KGEASLWLEEFRGEVTATM

SEQ ID NO: 81428 - protein, 21 aa, Mycobacterium avium
KGGGHKRAYRVIDFRRNDKDG

SEQ ID NO: 81429 - protein, 23 aa, Mycobacterium avium
KGGPGMREMLAITGAIKGAGLGK

SEQ ID NO: 81430 - protein, 19 aa, Mycobacterium avium
KGKVRLGRLANILRDKRIP

SEQ ID NO: 81431 - protein, 21 aa, Mycobacterium avium
KGLPGAEGRLKVAPPKPSKLE

SEQ ID NO: 81432 - protein, 18 aa, Mycobacterium avium
KGLTWQELADAIGRPLLW

SEQ ID NO: 81433 - protein, 23 aa, Mycobacterium avium
KGNEIACPFHDWRWGGDGRCKQV

SEQ ID NO: 81434 - protein, 17 aa, Mycobacterium avium
KGQLLSLHLGRLKDSTG

SEQ ID NO: 81435 - protein, 19 aa, Mycobacterium avium
KGSELMDKWVGSSEKAVRE

SEQ ID NO: 81436 - protein, 22 aa, Mycobacterium avium
KGSPQRRGVCTRVYTTTPKKPN

SEQ ID NO: 81437 - protein, 19 aa, Mycobacterium avium
KGVDAVVVPGGFSYGDYLR

SEQ ID NO: 81438 - protein, 17 aa, Mycobacterium avium
KGVPCLIAVDQDPTGKG

SEQ ID NO: 81439 - protein, 22 aa, Mycobacterium avium
KGWTLAEAERWLAPNLGYNPED

SEQ ID NO: 81440 - protein, 28 aa, Mycobacterium avium
KHGAKMVTAVACARVPKLTVVIGGSYGA

SEQ ID NO: 81441 - protein, 25 aa, Mycobacterium avium
KHKFADMKLWLEACRATTWAAVAEV

SEQ ID NO: 81442 - protein, 24 aa, Mycobacterium avium
KHLDECPPCLVYLQQMLDLKILLR

SEQ ID NO: 81443 - protein, 18 aa, Mycobacterium avium
KHPHHMAEWSPASRTHVA

SEQ ID NO: 81444 - protein, 18 aa, Mycobacterium avium
KHRMADLYVTVAAAKAVV

SEQ ID NO: 81445 - protein, 26 aa, Mycobacterium avium
KHVAERAGVTWGVIQYHFGDRNGLLM

SEQ ID NO: 81446 - protein, 23 aa, Mycobacterium avium
KIAAGELHFSIGYSEPGAGTDLA

SEQ ID NO: 81447 - protein, 24 aa, Mycobacterium avium
KIALGTALARLGMFAPALSYLEEP

SEQ ID NO: 81448 - protein, 19 aa, Mycobacterium avium
KIAVASFFAKNFLPMLTST

SEQ ID NO: 81449 - protein, 19 aa, Mycobacterium avium
KIDDHTAWRLLEGLDDIAL

SEQ ID NO: 81450 - protein, 17 aa, Mycobacterium avium
KIFADNLETAFFMSQAV

SEQ ID NO: 81451 - protein, 31 aa, Mycobacterium avium
KIFDVNLWAPLLWTSLAVKSWMGEHGGSIVN

SEQ ID NO: 81452 - protein, 40 aa, Mycobacterium avium
KIFGPTRDWECYCGKYKRVRFKGIICERCGVEVTRAKVRR

SEQ ID NO: 81453 - protein, 33 aa, Mycobacterium avium
KIGGARRCAAQSWPLERIKNVKNAAGVTVNDVV

SEQ ID NO: 81454 - protein, 23 aa, Mycobacterium avium
KIISLELRGCFAMTETGHGSDVQ

SEQ ID NO: 81455 - protein, 25 aa, Mycobacterium avium
KINEPRFPSFKGIMAAKKKEVTVLT

SEQ ID NO: 81456 - protein, 20 aa, Mycobacterium avium
KIPGRLFAGPMLAMPSGSSA

SEQ ID NO: 81457 - protein, 22 aa, Mycobacterium avium
KKCGHLGGKVLIPTQQHIRTLT

SEQ ID NO: 81458 - protein, 20 aa, Mycobacterium avium
KKDMFIVGGFNAYPAEIEGF

SEQ ID NO: 81459 - protein, 21 aa, Mycobacterium avium
KKGYHVTWVLSQGSNKANEGL

SEQ ID NO: 81460 - protein, 17 aa, Mycobacterium avium
KKHFRPEFLNRIDDIIV

SEQ ID NO: 81461 - protein, 20 aa, Mycobacterium avium
KKIKEKLGIGAVVTDDLSDD

SEQ ID NO: 81462 - protein, 31 aa, Mycobacterium avium
KKLSFETARFIKFIVTEIFPGGRLPSTQMMV

SEQ ID NO: 81463 - protein, 18 aa, Mycobacterium avium
KKPRPMVDAMFFGSSSNQ

SEQ ID NO: 81464 - protein, 18 aa, Mycobacterium avium
KKQLLLDALADKLQVQVG

SEQ ID NO: 81465 - protein, 21 aa, Mycobacterium avium
KKQVRCVYVAIGQKGTTIASV

SEQ ID NO: 81466 - protein, 26 aa, Mycobacterium avium
KKVALWRVLVALSIRHVGPTAARALA

SEQ ID NO: 81467 - protein, 18 aa, Mycobacterium avium
KKVEAGWVSVLRSDATPT

SEQ ID NO: 81468 - protein, 19 aa, Mycobacterium avium
KKVNQLRAFEGYNDPHTPE

SEQ ID NO: 81469 - protein, 18 aa, Mycobacterium avium
KKVSVPMVPGETLLETAR

SEQ ID NO: 81470 - protein, 18 aa, Mycobacterium avium
KLAANRPGTFLLESAEHG

SEQ ID NO: 81471 - protein, 18 aa, Mycobacterium avium
KLAERKRRESAADLASPA

SEQ ID NO: 81472 - protein, 19 aa, Mycobacterium avium
KLAPKGTGAVLSFELAGGV

SEQ ID NO: 81473 - protein, 17 aa, Mycobacterium avium
KLCDGGLGAHLLLGRGE

SEQ ID NO: 81474 - protein, 20 aa, Mycobacterium avium
KLDALSWVNVNALDQFSDEF

SEQ ID NO: 81475 - protein, 24 aa, Mycobacterium avium
KLEELKALWFAEAARYNGLPLSDL

SEQ ID NO: 81476 - protein, 36 aa, Mycobacterium avium
KLGELRPLYRPGLFHMYHALTWGPLVREIVYAATGK

SEQ ID NO: 81477 - protein, 17 aa, Mycobacterium avium
KLIADKMFEEFKEPQYG

SEQ ID NO: 81478 - protein, 19 aa, Mycobacterium avium
KLKELIPRQQFEVPVQAAI

SEQ ID NO: 81479 - protein, 24 aa, Mycobacterium avium
KLLQRPEEVAARRGLPIEDVAPAG

SEQ ID NO: 81480 - protein, 24 aa, Mycobacterium avium
KLQLWVAACLYRYFVDQHEFLHGP

SEQ ID NO: 81481 - protein, 25 aa, Mycobacterium avium
KLRALKRLKVVAAFQQSGNSPMGMV

SEQ ID NO: 81482 - protein, 18 aa, Mycobacterium avium
KLRARADALAAIRAGIDG

SEQ ID NO: 81483 - protein, 21 aa, Mycobacterium avium
KLRHALPGAVFVSAATGDGID

SEQ ID NO: 81484 - protein, 17 aa, Mycobacterium avium
KLRIEVVNRGFSPGQNH

SEQ ID NO: 81485 - protein, 23 aa, Mycobacterium avium
KLRRLPAEAARELALTQLDRVGL

SEQ ID NO: 81486 - protein, 26 aa, Mycobacterium avium
KLSAEAGAILGRWCTALTRAFVNDGF

SEQ ID NO: 81487 - protein, 17 aa, Mycobacterium avium
KLSVGLGRLAAEDPTLR

SEQ ID NO: 81488 - protein, 18 aa, Mycobacterium avium
KLTGEIQPGVTATDVVLT

SEQ ID NO: 81489 - protein, 19 aa, Mycobacterium avium
KLVALRAYWEMDRAAANTK

SEQ ID NO: 81490 - protein, 24 aa, Mycobacterium avium
KLVIPMRVIMSVAAILCQLDAHVP

SEQ ID NO: 81491 - protein, 20 aa, Mycobacterium avium
KLVIRDLLGRLGVGSDTVRT

SEQ ID NO: 81492 - protein, 18 aa, Mycobacterium avium
KLVLVRPAPVPGLVKPRS

SEQ ID NO: 81493 - protein, 18 aa, Mycobacterium avium
KLVREIRALTGTGEPDDK

SEQ ID NO: 81494 - protein, 22 aa, Mycobacterium avium
KLYRARFLFFGSGYYNYDEGYT

SEQ ID NO: 81495 - protein, 21 aa, Mycobacterium avium
KMAVICLIGAMLVEDGHSDDQ

SEQ ID NO: 81496 - protein, 18 aa, Mycobacterium avium
KMDALTRVLEVEPFEAMI

SEQ ID NO: 81497 - protein, 19 aa, Mycobacterium avium
KMEDGLRLGAKHYHATADP

SEQ ID NO: 81498 - protein, 20 aa, Mycobacterium avium
KMFNCTGWKIGWACGPAHLI

SEQ ID NO: 81499 - protein, 22 aa, Mycobacterium avium
KMKAGDKVALWYNSANRDESTF

SEQ ID NO: 81500 - protein, 18 aa, Mycobacterium avium
KMSAEVFETMFGASDFHI

SEQ ID NO: 81501 - protein, 17 aa, Mycobacterium avium
KMTKRGGGAIVNQSSTA

SEQ ID NO: 81502 - protein, 18 aa, Mycobacterium avium
KMWASSMNIAGAGWSGQA

SEQ ID NO: 81503 - protein, 24 aa, Mycobacterium avium
KMWMARLYPTYERNTCLISNGLST

SEQ ID NO: 81504 - protein, 20 aa, Mycobacterium avium
KNARQHISFGRGIHSCPGAP

SEQ ID NO: 81505 - protein, 26 aa, Mycobacterium avium
KNGQRFRAGVALSVFTDDAGSAIGFT

SEQ ID NO: 81506 - protein, 21 aa, Mycobacterium avium
KNHPACLEVLIGGASVGAVTT

SEQ ID NO: 81507 - protein, 21 aa, Mycobacterium avium
KNIDTGMGVERVAFVLQGVHN

SEQ ID NO: 81508 - protein, 25 aa, Mycobacterium avium
KNNVKRAWELMGMRVHLQVSHILTN

SEQ ID NO: 81509 - protein, 25 aa, Mycobacterium avium
KNPQRVLGLHFFNPVPVLPLVELVS

SEQ ID NO: 81510 - protein, 20 aa, Mycobacterium avium
KNPRSALLHRRIDVDFNGWW

SEQ ID NO: 81511 - protein, 23 aa, Mycobacterium avium
KPAPCPRITLVHGDAKPGNFAFT

SEQ ID NO: 81512 - protein, 18 aa, Mycobacterium avium
KPAVVAFDHAYHGRTNLA

SEQ ID NO: 81513 - protein, 20 aa, Mycobacterium avium
KPDDAPDCEVFTVAPNFAFE

SEQ ID NO: 81514 - protein, 19 aa, Mycobacterium avium
KPGLPLSLTKPLGIGVLNN

SEQ ID NO: 81515 - protein, 28 aa, Mycobacterium avium
KPGVLARVAALFSRRGFNIESLAVGATE

SEQ ID NO: 81516 - protein, 25 aa, Mycobacterium avium
KPIEIREFLEGYVIGQDTAKRTLAV

SEQ ID NO: 81517 - protein, 20 aa, Mycobacterium avium
KPLLANVETLRCWLDDEREE

SEQ ID NO: 81518 - protein, 19 aa, Mycobacterium avium
KPLQPRGDRSYLITGGLGA

SEQ ID NO: 81519 - protein, 24 aa, Mycobacterium avium
KPMEIPYPVLWRNLTQVVAAILEQ

SEQ ID NO: 81520 - protein, 20 aa, Mycobacterium avium
KPSASKGRYLKKITVSTTTG

SEQ ID NO: 81521 - protein, 21 aa, Mycobacterium avium
KPSEVDIVFSTTVTGLAVPTL

SEQ ID NO: 81522 - protein, 19 aa, Mycobacterium avium
KPSMPLWSYPVEIALTADT

SEQ ID NO: 81523 - protein, 19 aa, Mycobacterium avium
KPTPAGGEFDQLVASVARR

SEQ ID NO: 81524 - protein, 30 aa, Mycobacterium avium
KPTSVPAFRPGAQFKAVVSGAQRLPSEGPA

SEQ ID NO: 81525 - protein, 31 aa, Mycobacterium avium
KPVIGTVMRQGYKLGDQVLRHALVGVVDTVT

SEQ ID NO: 81526 - protein, 24 aa, Mycobacterium avium
KPWLPHFYLGHGIGVNAAEMPMIG

SEQ ID NO: 81527 - protein, 27 aa, Mycobacterium avium
KQAEAYRAISLLLRRPPGREAYPGDVF

SEQ ID NO: 81528 - protein, 24 aa, Mycobacterium avium
KQAKDRLLELSIAMHSTGPDVMGR

SEQ ID NO: 81529 - protein, 25 aa, Mycobacterium avium
KQFPEELGKMGFVFNFITYGGHQID

SEQ ID NO: 81530 - protein, 18 aa, Mycobacterium avium
KQHCPRRVDVYFDNVGGP

SEQ ID NO: 81531 - protein, 18 aa, Mycobacterium avium
KQLRARSSVPVIMVTARD

SEQ ID NO: 81532 - protein, 24 aa, Mycobacterium avium
KQNEEFMWRLADRQLDEFLHNGEC

SEQ ID NO: 81533 - protein, 19 aa, Mycobacterium avium
KQQLDHWARVGRAVSSQHT

SEQ ID NO: 81534 - protein, 24 aa, Mycobacterium avium
KQRAFEVLDKLTLIDISNNLGDAK

SEQ ID NO: 81535 - protein, 26 aa, Mycobacterium avium
KQRGEPVSCFLLRIEDNMESIGRSIN

SEQ ID NO: 81536 - protein, 22 aa, Mycobacterium avium
KQVALHHPGNWTVGGMAKGAGM

SEQ ID NO: 81537 - protein, 17 aa, Mycobacterium avium
KQVRLPGFRPGKAPAKL

SEQ ID NO: 81538 - protein, 17 aa, Mycobacterium avium
KRDEVLADMAAQQEALE

SEQ ID NO: 81539 - protein, 30 aa, Mycobacterium avium
KRDSEWMGRVHRFLGLDVGVILAQMTPDER

SEQ ID NO: 81540 - protein, 19 aa, Mycobacterium avium
KREDLQIVRSYKLRGAYNL

SEQ ID NO: 81541 - protein, 24 aa, Mycobacterium avium
KRGGLPWDAVFAAEMAGVFKPDPA

SEQ ID NO: 81542 - protein, 20 aa, Mycobacterium avium
KRIQQEWGVSDEVMRDLVNA

SEQ ID NO: 81543 - protein, 24 aa, Mycobacterium avium
KRKFLPRCAAGAISAFLLTEPDVG

SEQ ID NO: 81544 - protein, 18 aa, Mycobacterium avium
KRKIIGRQFIRAFEGAVR

SEQ ID NO: 81545 - protein, 20 aa, Mycobacterium avium
KRMALPNARVLIHQPSLQGV

SEQ ID NO: 81546 - protein, 18 aa, Mycobacterium avium
KRMRLRGSRPLSVVITRI

SEQ ID NO: 81547 - protein, 18 aa, Mycobacterium avium
KRPATPIFTPGRITLQSV

SEQ ID NO: 81548 - protein, 32 aa, Mycobacterium avium
KRPSYSLKEIRHWLQVFVQRFYSFSQFKRSAL

SEQ ID NO: 81549 - protein, 17 aa, Mycobacterium avium
KRRAAAVSHAVNVSVPV

SEQ ID NO: 81550 - protein, 18 aa, Mycobacterium avium
KRRIMIGTYALSAGYYDA

SEQ ID NO: 81551 - protein, 20 aa, Mycobacterium avium
KRSPAGKPDYRWAKEQTEAR

SEQ ID NO: 81552 - protein, 24 aa, Mycobacterium avium
KRSPEEVRFLMGFNRDVVRMRRVN

SEQ ID NO: 81553 - protein, 19 aa, Mycobacterium avium
KRTGVPISTHTHAGLRRGL

SEQ ID NO: 81554 - protein, 18 aa, Mycobacterium avium
KRVALVFSAYPTKHARIG

SEQ ID NO: 81555 - protein, 23 aa, Mycobacterium avium
KRVDNMTMAWGLEGRVPFLDHEL

SEQ ID NO: 81556 - protein, 20 aa, Mycobacterium avium
KSARDVQPLVCLDADGNKFS

SEQ ID NO: 81557 - protein, 17 aa, Mycobacterium avium
KSARLDNSYVHNLIHGF

SEQ ID NO: 81558 - protein, 17 aa, Mycobacterium avium
KSERELLAKALADVQGM

SEQ ID NO: 81559 - protein, 18 aa, Mycobacterium avium
KSHLGWGHGVHVCLGMHL

SEQ ID NO: 81560 - protein, 21 aa, Mycobacterium avium
KSKGRPAIKSFIVPRDHPGVT

SEQ ID NO: 81561 - protein, 32 aa, Mycobacterium avium
KSLPGMLMAAARLDLASVFLYAGSILPGVAKL

SEQ ID NO: 81562 - protein, 24 aa, Mycobacterium avium
KSMAGPLLQMMSQMGGMAFGSQLG

SEQ ID NO: 81563 - protein, 19 aa, Mycobacterium avium
KSMSPVEWVRFAANAVGDR

SEQ ID NO: 81564 - protein, 27 aa, Mycobacterium avium
KSPHLEAFKAKGYEVLLLTDPVDEVWV

SEQ ID NO: 81565 - protein, 19 aa, Mycobacterium avium
KSRRFAYPPNLYVVDGGAP

SEQ ID NO: 81566 - protein, 18 aa, Mycobacterium avium
KSSITPRDALASAGKTLV

SEQ ID NO: 81567 - protein, 20 aa, Mycobacterium avium
KSTHFDWVLAPYDIVASRAH

SEQ ID NO: 81568 - protein, 23 aa, Mycobacterium avium
KSTLLLEVAHRWAQSGRRALYIS

SEQ ID NO: 81569 - protein, 26 aa, Mycobacterium avium
KSTLLRLCNRLELPTSGRVSFYGSDI

SEQ ID NO: 81570 - protein, 17 aa, Mycobacterium avium
KSVAAFRLALPRTMLRF

SEQ ID NO: 81571 - protein, 19 aa, Mycobacterium avium
KSYQIYRLDAVPNTEKLPY

SEQ ID NO: 81572 - protein, 24 aa, Mycobacterium avium
KTACLIAAAGRFGAMFSGADADQV

SEQ ID NO: 81573 - protein, 26 aa, Mycobacterium avium
KTAHFCSMCGPKFCSMRITQDVRDYA

SEQ ID NO: 81574 - protein, 23 aa, Mycobacterium avium
KTALLRLAGRYGVGEDQVDELLR

SEQ ID NO: 81575 - protein, 22 aa, Mycobacterium avium
KTDALDALLWRAARPGEPSWPS

SEQ ID NO: 81576 - protein, 23 aa, Mycobacterium avium
KTEPALDVLAGWLASRIDGPVRR

SEQ ID NO: 81577 - protein, 24 aa, Mycobacterium avium
KTERLRIGHLVLCDAFRHPAVLAK

SEQ ID NO: 81578 - protein, 25 aa, Mycobacterium avium
KTGKAEKCTLCYPRMEVGLPTICSE

SEQ ID NO: 81579 - protein, 17 aa, Mycobacterium avium
KTIGDAVMFVCPEPRPL

SEQ ID NO: 81580 - protein, 17 aa, Mycobacterium avium
KTLKSAKAEALKCAKGF

SEQ ID NO: 81581 - protein, 18 aa, Mycobacterium avium
KTPLLAQVTRIGHRIGAP

SEQ ID NO: 81582 - protein, 17 aa, Mycobacterium avium
KTVCALLSDWLPATTGT

SEQ ID NO: 81583 - protein, 19 aa, Mycobacterium avium
KVAALCGSPSQARKHADAG

SEQ ID NO: 81584 - protein, 18 aa, Mycobacterium avium
KVAEGFGCHGEYVEKEDE

SEQ ID NO: 81585 - protein, 23 aa, Mycobacterium avium
KVAEGRVAGVHFLMKKNKITEIH

SEQ ID NO: 81586 - protein, 18 aa, Mycobacterium avium
KVARGMVMAVRRAVEKEG

SEQ ID NO: 81587 - protein, 25 aa, Mycobacterium avium
KVDGGWTINGHKIWTSAAHRADYGA

SEQ ID NO: 81588 - protein, 25 aa, Mycobacterium avium
KVDNIGRLPMAWVDPAAADTRTVLA

SEQ ID NO: 81589 - protein, 24 aa, Mycobacterium avium
KVDRSAAYAMRWVAKNIVAAGLAE

SEQ ID NO: 81590 - protein, 24 aa, Mycobacterium avium
KVEMPEIRSAVVAQLARVDDQLAA

SEQ ID NO: 81591 - protein, 21 aa, Mycobacterium avium
KVFLEWPVLRQVRSTDKLGRG

SEQ ID NO: 81592 - protein, 20 aa, Mycobacterium avium
KVFRNKVPITVAAGRPLPPR

SEQ ID NO: 81593 - protein, 24 aa, Mycobacterium avium
KVGGESARSRVCFTMDEVRETVAE

SEQ ID NO: 81594 - protein, 33 aa, Mycobacterium avium
KVGGTLAVSVPRWLPERVCWLLSDEYHSNEGGH

SEQ ID NO: 81595 - protein, 21 aa, Mycobacterium avium
KVGLGSVRFLMSVGDLIIGWL

SEQ ID NO: 81596 - protein, 20 aa, Mycobacterium avium
KVGLRRGKIIVVRPEHDRGA

SEQ ID NO: 81597 - protein, 25 aa, Mycobacterium avium
KVGRIARVLGPRGLMPNPKTGTVTP

SEQ ID NO: 81598 - protein, 24 aa, Mycobacterium avium
KVHADAGFDFIEVFCDTPIEECEK

SEQ ID NO: 81599 - protein, 21 aa, Mycobacterium avium
KVIGSELGWSREVWSQLADTG

SEQ ID NO: 81600 - protein, 18 aa, Mycobacterium avium
KVLASRMVRDYVEQYYTP

SEQ ID NO: 81601 - protein, 21 aa, Mycobacterium avium
KVLGYRNWLGLNKGDLSEEVS

SEQ ID NO: 81602 - protein, 21 aa, Mycobacterium avium
KVLIMKANGKGFCSGHAIGNN

SEQ ID NO: 81603 - protein, 19 aa, Mycobacterium avium
KVLRVSWCTVLRSAGGELH

SEQ ID NO: 81604 - protein, 17 aa, Mycobacterium avium
KVPSIAETIDWGRTLLA

SEQ ID NO: 81605 - protein, 21 aa, Mycobacterium avium
KVRPGVPVVFLDTGYHFAETI

SEQ ID NO: 81606 - protein, 25 aa, Mycobacterium avium
KVSHPIVFGHAVKVFYKEAFAKHQA

SEQ ID NO: 81607 - protein, 18 aa, Mycobacterium avium
KVTPDFAPYGKRIIRDPG

SEQ ID NO: 81608 - protein, 19 aa, Mycobacterium avium
KWQKMWKPVVCAVQGMCTA

SEQ ID NO: 81609 - protein, 23 aa, Mycobacterium avium
KYAADIDGVLAWARESRERLAQL

SEQ ID NO: 81610 - protein, 25 aa, Mycobacterium avium
KYDDLRAGLRMNIIGNPGVEKANFE

SEQ ID NO: 81611 - protein, 22 aa, Mycobacterium avium
KYDLFREVFLALGQQLVDATAF

SEQ ID NO: 81612 - protein, 25 aa, Mycobacterium avium
KYLGLRTEGLFLIAHLSRAGWLRWS

SEQ ID NO: 81613 - protein, 24 aa, Mycobacterium avium
KYLNRLSDLLFILSRVANPDGDVL

SEQ ID NO: 81614 - protein, 25 aa, Mycobacterium avium
KYLRGTPLGPLRCDAWIDRREGVKV

SEQ ID NO: 81615 - protein, 27 aa, Mycobacterium avium
KYPARVKCALLGWMACKDALAQAYSRR

SEQ ID NO: 81616 - protein, 44 aa, Mycobacterium avium
KYRLIFDKLRLAPGDRLLDVGCGWGGMVRYAARRGVRAIGATLS

SEQ ID NO: 81617 - protein, 18 aa, Mycobacterium avium
LAAAGYRFPRVAGSSAGA

SEQ ID NO: 81618 - protein, 32 aa, Mycobacterium avium
LAAARWWRKPLVRRWYGFLAMQQEVARHIPDL

SEQ ID NO: 81619 - protein, 24 aa, Mycobacterium avium
LAADGRAAIGFGAYREYEFTDFLN

SEQ ID NO: 81620 - protein, 18 aa, Mycobacterium avium
LAAELVAAVAEFLETDVR

SEQ ID NO: 81621 - protein, 17 aa, Mycobacterium avium
LAAERAESVVVVHDGVA

SEQ ID NO: 81622 - protein, 19 aa, Mycobacterium avium
LAAGQALAAVSAYETAFAE

SEQ ID NO: 81623 - protein, 23 aa, Mycobacterium avium
LAAHADHFWTWSIDMLGHGYTDK

SEQ ID NO: 81624 - protein, 26 aa, Mycobacterium avium
LAAKFAEGVKAEFPDQMLAYNCSPSF

SEQ ID NO: 81625 - protein, 30 aa, Mycobacterium avium
LAALAALELIDWPVAVVIAAGHLLASNHHN

SEQ ID NO: 81626 - protein, 23 aa, Mycobacterium avium
LAAQDRLRFAAGNFYVNDKPTGA

SEQ ID NO: 81627 - protein, 23 aa, Mycobacterium avium
LAARIGAPLVLRGVGVRRVADDR

SEQ ID NO: 81628 - protein, 18 aa, Mycobacterium avium
LAARPITVPARWTEELAE

SEQ ID NO: 81629 - protein, 20 aa, Mycobacterium avium
LAAVGVDLPDVFVVLENEGV

SEQ ID NO: 81630 - protein, 17 aa, Mycobacterium avium
LAAVPADASSTVFEPDP

SEQ ID NO: 81631 - protein, 20 aa, Mycobacterium avium
LAAWSGRYAAVAGVPARNTP

SEQ ID NO: 81632 - protein, 17 aa, Mycobacterium avium
LACGPDIAIPALVIGNL

SEQ ID NO: 81633 - protein, 19 aa, Mycobacterium avium
LADAALRLGARKGRGPGGI

SEQ ID NO: 81634 - protein, 24 aa, Mycobacterium avium
LADARRLAPGGAIVVGGPRDSSEL

SEQ ID NO: 81635 - protein, 24 aa, Mycobacterium avium
LADDEWPHLFLPFREGAAHESDLP

SEQ ID NO: 81636 - protein, 22 aa, Mycobacterium avium
LADEAFRLLGGVDVVFSNAGIV

SEQ ID NO: 81637 - protein, 19 aa, Mycobacterium avium
LADELVRIIGVLRGMQLKK

SEQ ID NO: 81638 - protein, 18 aa, Mycobacterium avium
LADGCVALGIPVTGGNVS

SEQ ID NO: 81639 - protein, 23 aa, Mycobacterium avium
LADGRHWDLLSGRPVTGDDRGEL

SEQ ID NO: 81640 - protein, 19 aa, Mycobacterium avium
LADGTVLWMADERAIGEHI

SEQ ID NO: 81641 - protein, 23 aa, Mycobacterium avium
LADHAVGGVVLFPGAGFVELAIR

SEQ ID NO: 81642 - protein, 18 aa, Mycobacterium avium
LADIWPVIDRDPAVRAVL

SEQ ID NO: 81643 - protein, 22 aa, Mycobacterium avium
LADLALSCALWVGMGRVLRTLD

SEQ ID NO: 81644 - protein, 24 aa, Mycobacterium avium
LADLCLTAGAGRAHFEHRAALVVD

SEQ ID NO: 81645 - protein, 33 aa, Mycobacterium avium
LADMKCRIDAARMLVWRAGWMARNNQAFDAAEG

SEQ ID NO: 81646 - protein, 17 aa, Mycobacterium avium
LAEALVCAAARETFEES

SEQ ID NO: 81647 - protein, 24 aa, Mycobacterium avium
LAEAVAAARAHRRSFVADRLATGT

SEQ ID NO: 81648 - protein, 19 aa, Mycobacterium avium
LAEGLRVVARVSSLCAQMT

SEQ ID NO: 81649 - protein, 21 aa, Mycobacterium avium
LAEGVIRTMRLLGVTCLEELS

SEQ ID NO: 81650 - protein, 21 aa, Mycobacterium avium
LAEIRRVLVPGGRLVVLEHVR

SEQ ID NO: 81651 - protein, 18 aa, Mycobacterium avium
LAELRRVLDAAGVTGLTL

SEQ ID NO: 81652 - protein, 21 aa, Mycobacterium avium
LAERLPAYMVPAAVLAIEALP

SEQ ID NO: 81653 - protein, 18 aa, Mycobacterium avium
LAGDAAHLMPVWQGQGYN

SEQ ID NO: 81654 - protein, 21 aa, Mycobacterium avium
LAGEIRSAFSMTEPAVASSDA

SEQ ID NO: 81655 - protein, 17 aa, Mycobacterium avium
LAGELSPGIASAVVLVD

SEQ ID NO: 81656 - protein, 24 aa, Mycobacterium avium
LAGHSMGGITIAAWSNRYRHKVSR

SEQ ID NO: 81657 - protein, 17 aa, Mycobacterium avium
LAGLKPAFRKDGTITAG

SEQ ID NO: 81658 - protein, 23 aa, Mycobacterium avium
LAGLRTVGDVVAYIQKLEEENPE

SEQ ID NO: 81659 - protein, 17 aa, Mycobacterium avium
LAGPRAVFHREVKRMQG

SEQ ID NO: 81660 - protein, 25 aa, Mycobacterium avium
LAGRPIDWSAVHLFWGDERYVPEDD

SEQ ID NO: 81661 - protein, 18 aa, Mycobacterium avium
LAGTCQRVEQVRCMEIHD

SEQ ID NO: 81662 - protein, 23 aa, Mycobacterium avium
LAHEVRMRWCGPEVEVEGIISLK

SEQ ID NO: 81663 - protein, 19 aa, Mycobacterium avium
LAHLLKFDSILGRLPYDVS

SEQ ID NO: 81664 - protein, 18 aa, Mycobacterium avium
LAHLSQWCFVVARTEKGS

SEQ ID NO: 81665 - protein, 24 aa, Mycobacterium avium
LAHQPRFVQAYSWALESLHRKGAR

SEQ ID NO: 81666 - protein, 17 aa, Mycobacterium avium
LAIEYEVMDRLKPAIIL

SEQ ID NO: 81667 - protein, 17 aa, Mycobacterium avium
LAILKGLNVPLHEAEIL

SEQ ID NO: 81668 - protein, 22 aa, Mycobacterium avium
LAIRVNGPRSWGLDITVDVTLA

SEQ ID NO: 81669 - protein, 28 aa, Mycobacterium avium
LAKAMDRKVWLPSGGTLVIDRTEAMTVI

SEQ ID NO: 81670 - protein, 24 aa, Mycobacterium avium
LAKELEFRPRKSLGQNFVHDANTV

SEQ ID NO: 81671 - protein, 18 aa, Mycobacterium avium
LAKFTEWESELSAAAPAD

SEQ ID NO: 81672 - protein, 17 aa, Mycobacterium avium
LAKRLAAAGAEVVLAVR

SEQ ID NO: 81673 - protein, 18 aa, Mycobacterium avium
LALCESFGLPVISLCDTP

SEQ ID NO: 81674 - protein, 17 aa, Mycobacterium avium
LALGIGVHDITAGYRAY

SEQ ID NO: 81675 - protein, 25 aa, Mycobacterium avium
LALPPGSAGKPYFQYVVDDPTRLPP

SEQ ID NO: 81676 - protein, 18 aa, Mycobacterium avium
LALPWPEDPLAALWHATT

SEQ ID NO: 81677 - protein, 25 aa, Mycobacterium avium
LALQKMSFEVAWRILQATPVTATGL

SEQ ID NO: 81678 - protein, 18 aa, Mycobacterium avium
LALSLGDSLAGMFGAQGA

SEQ ID NO: 81679 - protein, 26 aa, Mycobacterium avium
LAMLRRLMMDDSFFRGELIYVFDGDA

SEQ ID NO: 81680 - protein, 17 aa, Mycobacterium avium
LANEAFAGMKLLEIHTT

SEQ ID NO: 81681 - protein, 18 aa, Mycobacterium avium
LANFFRIKPAYFTDDEYY

SEQ ID NO: 81682 - protein, 17 aa, Mycobacterium avium
LANIAITVQGGRNLARR

SEQ ID NO: 81683 - protein, 19 aa, Mycobacterium avium
LAPDGRCKVYAGAADGTSW

SEQ ID NO: 81684 - protein, 19 aa, Mycobacterium avium
LAPDRRRGLIQIFPNDVEL

SEQ ID NO: 81685 - protein, 22 aa, Mycobacterium avium
LAPELFAGILAQVPFVDPLTTI

SEQ ID NO: 81686 - protein, 18 aa, Mycobacterium avium
LAPESPPPAQFDDAYAAT

SEQ ID NO: 81687 - protein, 18 aa, Mycobacterium avium
LAPGTGLRDGLERILRGR

SEQ ID NO: 81688 - protein, 25 aa, Mycobacterium avium
LAPPEIWRSYIRTVGRTPNGVWGGK

SEQ ID NO: 81689 - protein, 20 aa, Mycobacterium avium
LAPPMGRGWEALAGDEVWNW

SEQ ID NO: 81690 - protein, 20 aa, Mycobacterium avium
LAQKERWLPELMTLEKIAAW

SEQ ID NO: 81691 - protein, 25 aa, Mycobacterium avium
LAQTRLRTQPALDRLAEAVVDGTQD

SEQ ID NO: 81692 - protein, 20 aa, Mycobacterium avium
LAREDLSVWVVTGDGDALSI

SEQ ID NO: 81693 - protein, 18 aa, Mycobacterium avium
LARERPVEADLVIGVPES

SEQ ID NO: 81694 - protein, 23 aa, Mycobacterium avium
LARFAETLLPLFSENTEEAIALA

SEQ ID NO: 81695 - protein, 20 aa, Mycobacterium avium
LARGRLRIVCNLGAEPVTVP

SEQ ID NO: 81696 - protein, 25 aa, Mycobacterium avium
LARPKRYAAGFSRELDDEWQLPDAV

SEQ ID NO: 81697 - protein, 18 aa, Mycobacterium avium
LARRAAMSPRHFTRVFTA

SEQ ID NO: 81698 - protein, 21 aa, Mycobacterium avium
LARRLAAEEGLLVGISSGAAL

SEQ ID NO: 81699 - protein, 21 aa, Mycobacterium avium
LARRLAARADIVVENFSPRVV

SEQ ID NO: 81700 - protein, 17 aa, Mycobacterium avium
LASKPWVKTTMAPGSQV

SEQ ID NO: 81701 - protein, 33 aa, Mycobacterium avium
LASLAPLRFGELCLEAGLPPGLVNVLPAGPEGG

SEQ ID NO: 81702 - protein, 18 aa, Mycobacterium avium
LASLHLVHDWNREFVRTS

SEQ ID NO: 81703 - protein, 20 aa, Mycobacterium avium
LASLRDARVPVALSTDMPFG

SEQ ID NO: 81704 - protein, 17 aa, Mycobacterium avium
LASPEPWIERFERCWEL

SEQ ID NO: 81705 - protein, 17 aa, Mycobacterium avium
LASRPTFQKGLAHHRAA

SEQ ID NO: 81706 - protein, 18 aa, Mycobacterium avium
LASSYGHWVYSIRSGQGA

SEQ ID NO: 81707 - protein, 17 aa, Mycobacterium avium
LASYDGRNRVNPPLREA

SEQ ID NO: 81708 - protein, 34 aa, Mycobacterium avium
LAVAARPELTLGRARYAVHAAFALAVDIGRLVYP

SEQ ID NO: 81709 - protein, 17 aa, Mycobacterium avium
LAVCDRIGLPAKDIDLL

SEQ ID NO: 81710 - protein, 25 aa, Mycobacterium avium
LAVEEMLRWNSPVVHMARTATADVE

SEQ ID NO: 81711 - protein, 25 aa, Mycobacterium avium
LAVELGRAGAKLAISDVDTAGLAQT

SEQ ID NO: 81712 - protein, 26 aa, Mycobacterium avium
LAVMPWNFPLWQAVRFAAPALMAGNV

SEQ ID NO: 81713 - protein, 27 aa, Mycobacterium avium
LAVNRLRPSEIQWALNHDAVHGIAYAF

SEQ ID NO: 81714 - protein, 23 aa, Mycobacterium avium
LAVRPHPEWFRTGDLGRLDRDQN

SEQ ID NO: 81715 - protein, 18 aa, Mycobacterium avium
LAVYPRAEFEQLARRASK

SEQ ID NO: 81716 - protein, 17 aa, Mycobacterium avium
LAYLLSRLGTKRLIITG

SEQ ID NO: 81717 - protein, 26 aa, Mycobacterium avium
LCAFSSDRIPKWLLPVINDNLANDGS

SEQ ID NO: 81718 - protein, 20 aa, Mycobacterium avium
LCAMAKRYVTDTCFEVADKA

SEQ ID NO: 81719 - protein, 17 aa, Mycobacterium avium
LCASQLVGLGIMRYGIR

SEQ ID NO: 81720 - protein, 22 aa, Mycobacterium avium
LCEIKDVQIRDGLHVLGQKPTG

SEQ ID NO: 81721 - protein, 27 aa, Mycobacterium avium
LCGAYNASIFRRAEELFSLLREQGKTP

SEQ ID NO: 81722 - protein, 18 aa, Mycobacterium avium
LCINPFFHNFGYKAGILA

SEQ ID NO: 81723 - protein, 21 aa, Mycobacterium avium
LCMDNGMPILVFNLLTNGNIA

SEQ ID NO: 81724 - protein, 17 aa, Mycobacterium avium
LCNSAGFGTSGVFHELP

SEQ ID NO: 81725 - protein, 24 aa, Mycobacterium avium
LCRDNCHYCTFVTVPGKLRARGAG

SEQ ID NO: 81726 - protein, 25 aa, Mycobacterium avium
LCRQHHRLKTFGGWRDRQLADGTVV

SEQ ID NO: 81727 - protein, 29 aa, Mycobacterium avium
LCSERPAIHRFPGSMAKRIQALAQLLVDR

SEQ ID NO: 81728 - protein, 18 aa, Mycobacterium avium
LCSPTRAALLTGRNATTV

SEQ ID NO: 81729 - protein, 18 aa, Mycobacterium avium
LDAAIAWYHDHLGMILVH

SEQ ID NO: 81730 - protein, 19 aa, Mycobacterium avium
LDAATGRLAAERASVGDEE

SEQ ID NO: 81731 - protein, 20 aa, Mycobacterium avium
LDADLLRRAKHHGLSDRQIA

SEQ ID NO: 81732 - protein, 19 aa, Mycobacterium avium
LDAEFPKFRQLLPAEHTAV

SEQ ID NO: 81733 - protein, 24 aa, Mycobacterium avium
LDALGRNKMRVVPGLTSKAMSVAS

SEQ ID NO: 81734 - protein, 19 aa, Mycobacterium avium
LDALVSVCRACPRLVEWRE

SEQ ID NO: 81735 - protein, 21 aa, Mycobacterium avium
LDAPICLTWELTYACNLACVH

SEQ ID NO: 81736 - protein, 27 aa, Mycobacterium avium
LDASGVRLGIVASTWHSRICDALLAGA

SEQ ID NO: 81737 - protein, 19 aa, Mycobacterium avium
LDASLLLVVLTRFLPPDDP

SEQ ID NO: 81738 - protein, 17 aa, Mycobacterium avium
LDAVALAHHSGYRTMMS

SEQ ID NO: 81739 - protein, 20 aa, Mycobacterium avium
LDAYYEHGLKVWDRAAGALI

SEQ ID NO: 81740 - protein, 20 aa, Mycobacterium avium
LDDFGVPFTLTRRGALTAEL

SEQ ID NO: 81741 - protein, 23 aa, Mycobacterium avium
LDDGTTWRVDIERAHMEEDTGKL

SEQ ID NO: 81742 - protein, 31 aa, Mycobacterium avium
LDDHPGLRIGWFEGGISWVPWALQDAEHLVA

SEQ ID NO: 81743 - protein, 27 aa, Mycobacterium avium
LDDKGRLTLPAKFRDALAGGLMVTKSQ

SEQ ID NO: 81744 - protein, 18 aa, Mycobacterium avium
LDDLAKRLIVLVEPVEAI

SEQ ID NO: 81745 - protein, 20 aa, Mycobacterium avium
LDEFAYRLSGSADLYEHTGR

SEQ ID NO: 81746 - protein, 24 aa, Mycobacterium avium
LDEHRAGGAAVRWDDENVTACFRC

SEQ ID NO: 81747 - protein, 23 aa, Mycobacterium avium
LDELCLTIAPYLVGGHARRIATG

SEQ ID NO: 81748 - protein, 26 aa, Mycobacterium avium
LDELLNRWPEWDIDYDTAQLASTSTV

SEQ ID NO: 81749 - protein, 24 aa, Mycobacterium avium
LDEMPDIAIPLVFTLLGETGAHAP

SEQ ID NO: 81750 - protein, 24 aa, Mycobacterium avium
LDEPPLRLLLGRDVLKAMRDKIAA

SEQ ID NO: 81751 - protein, 19 aa, Mycobacterium avium
LDFFAELTIYTSTACLIGL

SEQ ID NO: 81752 - protein, 18 aa, Mycobacterium avium
LDFFFRKIVRDRGQALQF

SEQ ID NO: 81753 - protein, 25 aa, Mycobacterium avium
LDGDARGGAALSVREVTGVPILFAS

SEQ ID NO: 81754 - protein, 19 aa, Mycobacterium avium
LDGETSRSLALKAIRGALD

SEQ ID NO: 81755 - protein, 17 aa, Mycobacterium avium
LDGGFGVGKTHLLASAY

SEQ ID NO: 81756 - protein, 25 aa, Mycobacterium avium
LDGLDKLAKLGVTWVSVHLPGDSMA

SEQ ID NO: 81757 - protein, 18 aa, Mycobacterium avium
LDGLLSAWQSTLAGDMQA

SEQ ID NO: 81758 - protein, 25 aa, Mycobacterium avium
LDGLPNYQRLFSLRIGQTLREQFEA

SEQ ID NO: 81759 - protein, 19 aa, Mycobacterium avium
LDGMAAFVESGRAVALGVV

SEQ ID NO: 81760 - protein, 21 aa, Mycobacterium avium
LDGNYPLSIVLDGQALNITLA

SEQ ID NO: 81761 - protein, 24 aa, Mycobacterium avium
LDGRAARLVACWGNNDGPALRARL

SEQ ID NO: 81762 - protein, 27 aa, Mycobacterium avium
LDGRADPGEIVWTWVVYEDDPSRGKDR

SEQ ID NO: 81763 - protein, 21 aa, Mycobacterium avium
LDGRIRHVMIPGIIAEDDDRP

SEQ ID NO: 81764 - protein, 25 aa, Mycobacterium avium
LDGTLKFGDLLLHPASFTASLDGRE

SEQ ID NO: 81765 - protein, 25 aa, Mycobacterium avium
LDGYPRAGKTVLFLGRYDEPRKGMA

SEQ ID NO: 81766 - protein, 27 aa, Mycobacterium avium
LDINVFGRRAGIAAANYARGHDFVDMP

SEQ ID NO: 81767 - protein, 18 aa, Mycobacterium avium
LDKKLAYRHSGYPGGLRS

SEQ ID NO: 81768 - protein, 23 aa, Mycobacterium avium
LDKLPAHLRMTFAVESTDGTELA

SEQ ID NO: 81769 - protein, 20 aa, Mycobacterium avium
LDKLTKWSMPLLRHDGRMLA

SEQ ID NO: 81770 - protein, 18 aa, Mycobacterium avium
LDKMGWRSSDTAELSYTD

SEQ ID NO: 81771 - protein, 17 aa, Mycobacterium avium
LDKRFMAKYGKATPEAL

SEQ ID NO: 81772 - protein, 23 aa, Mycobacterium avium
LDKTRPLWEMYLVEGLSKNRLAL

SEQ ID NO: 81773 - protein, 24 aa, Mycobacterium avium
LDLGSLVAGSRYRGDFEERLKKVL

SEQ ID NO: 81774 - protein, 18 aa, Mycobacterium avium
LDLIPPELAAAMDNVVVL

SEQ ID NO: 81775 - protein, 25 aa, Mycobacterium avium
LDLLPTVRGAFCLTFMDENTLYACR

SEQ ID NO: 81776 - protein, 18 aa, Mycobacterium avium
LDLLRWHGAEEVEHKAVA

SEQ ID NO: 81777 - protein, 22 aa, Mycobacterium avium
LDLQAPVARYWPEFAQAGKQDI

SEQ ID NO: 81778 - protein, 20 aa, Mycobacterium avium
LDLRGLNFIGTAGFSALHRI

SEQ ID NO: 81779 - protein, 17 aa, Mycobacterium avium
LDLRSPRGATYLATAPG

SEQ ID NO: 81780 - protein, 26 aa, Mycobacterium avium
LDLSKLARPTSTWTYMVNDNPLSDDT

SEQ ID NO: 81781 - protein, 21 aa, Mycobacterium avium
LDLTGCMALGITGPILRATGL

SEQ ID NO: 81782 - protein, 18 aa, Mycobacterium avium
LDLVLAILRARQLFGGEQ

SEQ ID NO: 81783 - protein, 19 aa, Mycobacterium avium
LDLVRDFATHAAIALVLAA

SEQ ID NO: 81784 - protein, 21 aa, Mycobacterium avium
LDMFYNLGIAGRAMRRIGAIE

SEQ ID NO: 81785 - protein, 19 aa, Mycobacterium avium
LDNPALALMFFLTSSRIFG

SEQ ID NO: 81786 - protein, 27 aa, Mycobacterium avium
LDPDTLRYLRDFRFGGDIDGYAEGELY

SEQ ID NO: 81787 - protein, 22 aa, Mycobacterium avium
LDPLIPASVRFSAEDSLPVPTS

SEQ ID NO: 81788 - protein, 25 aa, Mycobacterium avium
LDPPRSGEVLVRMAVAGICHSDDHL

SEQ ID NO: 81789 - protein, 19 aa, Mycobacterium avium
LDPSACCRDDLAAQIQARL

SEQ ID NO: 81790 - protein, 20 aa, Mycobacterium avium
LDPTMAYTCAFFERDDMTLE

SEQ ID NO: 81791 - protein, 20 aa, Mycobacterium avium
LDPTMCDAWLARILAGEQSL

SEQ ID NO: 81792 - protein, 20 aa, Mycobacterium avium
LDPTMFAAFAPHALELTVEE

SEQ ID NO: 81793 - protein, 17 aa, Mycobacterium avium
LDQWGRFDEAFAALRKW

SEQ ID NO: 81794 - protein, 24 aa, Mycobacterium avium
LDRLLRPGGVVDMLTSEGGLLDRL

SEQ ID NO: 81795 - protein, 18 aa, Mycobacterium avium
LDRRVLQFGGRVYTAKDS

SEQ ID NO: 81796 - protein, 23 aa, Mycobacterium avium
LDRTLRVAWSVADLAGRTSPGPE

SEQ ID NO: 81797 - protein, 20 aa, Mycobacterium avium
LDSEVPWVPAQLAPPATARV

SEQ ID NO: 81798 - protein, 21 aa, Mycobacterium avium
LDSLGGLWAQGKLADKVYAAF

SEQ ID NO: 81799 - protein, 26 aa, Mycobacterium avium
LDSLIWQCPVVLLGEVRSVGVQGDNR

SEQ ID NO: 81800 - protein, 19 aa, Mycobacterium avium
LDSRAWRLPFEDGTTVYEL

SEQ ID NO: 81801 - protein, 20 aa, Mycobacterium avium
LDTFGPRWVNAVMQRQTVQP

SEQ ID NO: 81802 - protein, 18 aa, Mycobacterium avium
LDTPGVILGEHFDLLALG

SEQ ID NO: 81803 - protein, 24 aa, Mycobacterium avium
LDTRRPPRLFGLIKHSGGHASRDW

SEQ ID NO: 81804 - protein, 17 aa, Mycobacterium avium
LDTSAWCGLAPASATID

SEQ ID NO: 81805 - protein, 20 aa, Mycobacterium avium
LDTSVAISWIGKETGREVVA

SEQ ID NO: 81806 - protein, 18 aa, Mycobacterium avium
LDVARMVLFGQVGRELVN

SEQ ID NO: 81807 - protein, 19 aa, Mycobacterium avium
LDVDVEFSPFFNALPIRRL

SEQ ID NO: 81808 - protein, 19 aa, Mycobacterium avium
LDVEGWRGDNFAFTFNIAD

SEQ ID NO: 81809 - protein, 25 aa, Mycobacterium avium
LDVMMPRLDGLEVCRQLRSTGDDLP

SEQ ID NO: 81810 - protein, 24 aa, Mycobacterium avium
LDVPTFRMLAGLRGRVPLVSVVSG

SEQ ID NO: 81811 - protein, 19 aa, Mycobacterium avium
LDVRWRLDEPDGRAAYLQG

SEQ ID NO: 81812 - protein, 26 aa, Mycobacterium avium
LDYAGGVRAGHRLKFWTPGGSSTPLL

SEQ ID NO: 81813 - protein, 17 aa, Mycobacterium avium
LDYAYYNPLSLVIRDQQ

SEQ ID NO: 81814 - protein, 20 aa, Mycobacterium avium
LDYDCPRAVLDKATAITPGL

SEQ ID NO: 81815 - protein, 18 aa, Mycobacterium avium
LEAAAGIAGVIKVILALE

SEQ ID NO: 81816 - protein, 33 aa, Mycobacterium avium
LEAAMARLSALAGYRWITPVSYTLPFRTVSGTR

SEQ ID NO: 81817 - protein, 17 aa, Mycobacterium avium
LEAEGHRILKLNIGNPA

SEQ ID NO: 81818 - protein, 22 aa, Mycobacterium avium
LEAFANFGFPESHALSFASLVF

SEQ ID NO: 81819 - protein, 23 aa, Mycobacterium avium
LEAHCKHLGAHLGHGGTVVGDCV

SEQ ID NO: 81820 - protein, 36 aa, Mycobacterium avium
LEANLRLVVSLAKRYTGRGMAFLDLIQEGNLGLIRA

SEQ ID NO: 81821 - protein, 17 aa, Mycobacterium avium
LEARIDSLAARNSKLME

SEQ ID NO: 81822 - protein, 18 aa, Mycobacterium avium
LEAVRKRPGMYIGSTGER

SEQ ID NO: 81823 - protein, 18 aa, Mycobacterium avium
LEDCYTALTWLAGLPSVD

SEQ ID NO: 81824 - protein, 17 aa, Mycobacterium avium
LEDFDVFHPDRMSSRIL

SEQ ID NO: 81825 - protein, 17 aa, Mycobacterium avium
LEDLGWYVADNLPPQLI

SEQ ID NO: 81826 - protein, 19 aa, Mycobacterium avium
LEERLCAAAVFVTQARRVI

SEQ ID NO: 81827 - protein, 19 aa, Mycobacterium avium
LEGACPVVASFGGRDLTGK

SEQ ID NO: 81828 - protein, 18 aa, Mycobacterium avium
LEGASAIDILRWTDEHFG

SEQ ID NO: 81829 - protein, 25 aa, Mycobacterium avium
LEGGPRPTHFAGVLTVVCKLLQIVR

SEQ ID NO: 81830 - protein, 21 aa, Mycobacterium avium
LEGKSSLGRLGLLTHSTAGFI

SEQ ID NO: 81831 - protein, 27 aa, Mycobacterium avium
LEGPSYTRPPSWRGLDVPEVLLSGDHA

SEQ ID NO: 81832 - protein, 17 aa, Mycobacterium avium
LEGSGWTVASEAEPVTA

SEQ ID NO: 81833 - protein, 17 aa, Mycobacterium avium
LEGYLLTGRHGLFNCYE

SEQ ID NO: 81834 - protein, 18 aa, Mycobacterium avium
LEHGHVIQVFGLPNMRTV

SEQ ID NO: 81835 - protein, 31 aa, Mycobacterium avium
LEHYEKLEGVPLTFAGKVNRLAIMVRGNLAA

SEQ ID NO: 81836 - protein, 23 aa, Mycobacterium avium
LEKAKAMGAIALFGESYPEQVRV

SEQ ID NO: 81837 - protein, 23 aa, Mycobacterium avium
LELADGKLICLVRAASDDDARRR

SEQ ID NO: 81838 - protein, 17 aa, Mycobacterium avium
LELDRRLRAAGSPIVTQ

SEQ ID NO: 81839 - protein, 29 aa, Mycobacterium avium
LELGFRSSIQKEWEWRVSRGESLKNLQAF

SEQ ID NO: 81840 - protein, 20 aa, Mycobacterium avium
LELRTPRWVSGEDRLLVTVL

SEQ ID NO: 81841 - protein, 18 aa, Mycobacterium avium
LELSMMTERVLKRLPDLR

SEQ ID NO: 81842 - protein, 17 aa, Mycobacterium avium
LELVGCYAWSAEKVGRD

SEQ ID NO: 81843 - protein, 17 aa, Mycobacterium avium
LEMLPVECVARGYLTGS

SEQ ID NO: 81844 - protein, 19 aa, Mycobacterium avium
LEMNTRLQVEHPVTEETTG

SEQ ID NO: 81845 - protein, 28 aa, Mycobacterium avium
LENLSGWFEFVWKPGYADYYPELPGGSE

SEQ ID NO: 81846 - protein, 17 aa, Mycobacterium avium
LEPVRFAEFEAGEAPFP

SEQ ID NO: 81847 - protein, 23 aa, Mycobacterium avium
LEQELNVPLVRRGQKFEGLTPEG

SEQ ID NO: 81848 - protein, 20 aa, Mycobacterium avium
LEQLDLFPANRNAAGQIVAA

SEQ ID NO: 81849 - protein, 23 aa, Mycobacterium avium
LEQPGLRLPQIIRTVLDGYADRP

SEQ ID NO: 81850 - protein, 19 aa, Mycobacterium avium
LEQTRISGVLINLQPDRAA

SEQ ID NO: 81851 - protein, 17 aa, Mycobacterium avium
LEQYCKRGATFTYNSID

SEQ ID NO: 81852 - protein, 17 aa, Mycobacterium avium
LERFANLIESYDLTGDE

SEQ ID NO: 81853 - protein, 17 aa, Mycobacterium avium
LERIPVPVLAIAGDGSI

SEQ ID NO: 81854 - protein, 23 aa, Mycobacterium avium
LERLGLDYVDLYLIHWPAPALGT

SEQ ID NO: 81855 - protein, 25 aa, Mycobacterium avium
LERLKSELLLLMAGVERLAHAPVPV

SEQ ID NO: 81856 - protein, 23 aa, Mycobacterium avium
LERLRAWGVEHVFGYPGDGINGL

SEQ ID NO: 81857 - protein, 36 aa, Mycobacterium avium
LERLYPRTAAELFSWGKSWLETCQQAFAGLAVDPDR

SEQ ID NO: 81858 - protein, 23 aa, Mycobacterium avium
LERRAKRLIVFDVDSTLVQGEVI

SEQ ID NO: 81859 - protein, 19 aa, Mycobacterium avium
LERRGFLEVETPMLQTLAG

SEQ ID NO: 81860 - protein, 17 aa, Mycobacterium avium
LERRNARRALITLCIGG

SEQ ID NO: 81861 - protein, 18 aa, Mycobacterium avium
LERTQIRALGLLKGACAQ

SEQ ID NO: 81862 - protein, 25 aa, Mycobacterium avium
LERVGIELGRGGYLTVDRVSRTSVP

SEQ ID NO: 81863 - protein, 21 aa, Mycobacterium avium
LESRLDNVVYRAGLARTRRMA

SEQ ID NO: 81864 - protein, 19 aa, Mycobacterium avium
LESTMRFILSAKSAYVDGQ

SEQ ID NO: 81865 - protein, 18 aa, Mycobacterium avium
LESYLPKLAVTHGKAMGT

SEQ ID NO: 81866 - protein, 17 aa, Mycobacterium avium
LETARSFFPNVVTTHTW

SEQ ID NO: 81867 - protein, 22 aa, Mycobacterium avium
LETHLGWVAKSGWNIDGNPEWA

SEQ ID NO: 81868 - protein, 21 aa, Mycobacterium avium
LETLIDFSYLIAVKDIKTDLV

SEQ ID NO: 81869 - protein, 18 aa, Mycobacterium avium
LETQDAWVADLRDRLRAR

SEQ ID NO: 81870 - protein, 20 aa, Mycobacterium avium
LEVAEQLFATPQEGRVLGVD

SEQ ID NO: 81871 - protein, 22 aa, Mycobacterium avium
LEVEPFEAMIVFVRTKQATEEV

SEQ ID NO: 81872 - protein, 24 aa, Mycobacterium avium
LEVTMPREMLLRISDLAHLLRLPG

SEQ ID NO: 81873 - protein, 19 aa, Mycobacterium avium
LEVVADVRPELVSFTFGVP

SEQ ID NO: 81874 - protein, 24 aa, Mycobacterium avium
LEYIYCPWHQWGFELATGTTAVKP

SEQ ID NO: 81875 - protein, 20 aa, Mycobacterium avium
LFARRLPEGRRYGVVGGTGR

SEQ ID NO: 81876 - protein, 19 aa, Mycobacterium avium
LFASWRSDPSFVLNLSPFD

SEQ ID NO: 81877 - protein, 18 aa, Mycobacterium avium
LFDEWDLPVPALFGQMRL

SEQ ID NO: 81878 - protein, 20 aa, Mycobacterium avium
LFDGTGWDAAACAERGARVE

SEQ ID NO: 81879 - protein, 31 aa, Mycobacterium avium
LFEMNEAFAAIAIKIQQYFGIPDQKYNVNGG

SEQ ID NO: 81880 - protein, 24 aa, Mycobacterium avium
LFGSGKMFLPQVVKSARVMKKAVA

SEQ ID NO: 81881 - protein, 18 aa, Mycobacterium avium
LFPDEFAKRARALGESVG

SEQ ID NO: 81882 - protein, 20 aa, Mycobacterium avium
LFQQRLHGCGADLVSAPLST

SEQ ID NO: 81883 - protein, 18 aa, Mycobacterium avium
LFRYPGVRSDSSIFTLSF

SEQ ID NO: 81884 - protein, 19 aa, Mycobacterium avium
LFSHVPWLASQLLGAVEAY

SEQ ID NO: 81885 - protein, 19 aa, Mycobacterium avium
LFSVPGKAGFDSMNTKDYG

SEQ ID NO: 81886 - protein, 18 aa, Mycobacterium avium
LFTAFVPFAARWPVEVHI

SEQ ID NO: 81887 - protein, 18 aa, Mycobacterium avium
LFYANRSRDAVIFDEDLA

SEQ ID NO: 81888 - protein, 19 aa, Mycobacterium avium
LFYPECLEYARRLREAGVP

SEQ ID NO: 81889 - protein, 17 aa, Mycobacterium avium
LFYPNFMLLIWEPGWFL

SEQ ID NO: 81890 - protein, 21 aa, Mycobacterium avium
LGAALAEYGRRVLLVDMDPQG

SEQ ID NO: 81891 - protein, 17 aa, Mycobacterium avium
LGAAVAKAAPWLRDGDV

SEQ ID NO: 81892 - protein, 23 aa, Mycobacterium avium
LGAEVRYRRVLGAVAELEALAVG

SEQ ID NO: 81893 - protein, 17 aa, Mycobacterium avium
LGAFSRAVSLGVGHEPA

SEQ ID NO: 81894 - protein, 18 aa, Mycobacterium avium
LGAGIGVPVPEFVETMTR

SEQ ID NO: 81895 - protein, 20 aa, Mycobacterium avium
LGAGLDWKTSLQELTAARGM

SEQ ID NO: 81896 - protein, 22 aa, Mycobacterium avium
LGAGSWPAEFARFDVGQQDPKA

SEQ ID NO: 81897 - protein, 19 aa, Mycobacterium avium
LGAHDLLNEYIRHIGSAIF

SEQ ID NO: 81898 - protein, 26 aa, Mycobacterium avium
LGALGFGRGTLYSAISPVAGMGNAGT

SEQ ID NO: 81899 - protein, 22 aa, Mycobacterium avium
LGALRMLAGDVIEMATGEGKTL

SEQ ID NO: 81900 - protein, 20 aa, Mycobacterium avium
LGAMTPMFVGFRGREIVLTL

SEQ ID NO: 81901 - protein, 19 aa, Mycobacterium avium
LGANLARLELRVLFEELLS

SEQ ID NO: 81902 - protein, 22 aa, Mycobacterium avium
LGAPCRAVHVGDELQIGELTVR

SEQ ID NO: 81903 - protein, 18 aa, Mycobacterium avium
LGAPRIAERFTELAKEVP

SEQ ID NO: 81904 - protein, 20 aa, Mycobacterium avium
LGAQGAWTGSQWLMVEESSN

SEQ ID NO: 81905 - protein, 18 aa, Mycobacterium avium
LGASRKRFLGTLLAGPDG

SEQ ID NO: 81906 - protein, 17 aa, Mycobacterium avium
LGAVSGFVRRVDGKVQA

SEQ ID NO: 81907 - protein, 21 aa, Mycobacterium avium
LGAYHGFGSATPMVMEEAGAV

SEQ ID NO: 81908 - protein, 17 aa, Mycobacterium avium
LGDFVKLGFEQDVEIWR

SEQ ID NO: 81909 - protein, 28 aa, Mycobacterium avium
LGDGLAGGVLRFSADFAELADRDVVFVC

SEQ ID NO: 81910 - protein, 23 aa, Mycobacterium avium
LGDGRQWLSWIGIDDLIDVYHRA

SEQ ID NO: 81911 - protein, 20 aa, Mycobacterium avium
LGDPPYYAFRIVLGDLGTSG

SEQ ID NO: 81912 - protein, 26 aa, Mycobacterium avium
LGDRLRLALDADLCAAVTGLPAPLAH

SEQ ID NO: 81913 - protein, 17 aa, Mycobacterium avium
LGDTFRWKGENVATTQV

SEQ ID NO: 81914 - protein, 18 aa, Mycobacterium avium
LGDYRMMPRATFCQPNVA

SEQ ID NO: 81915 - protein, 34 aa, Mycobacterium avium
LGEAAEFLRWTAARAPGAAGYWPAPAVANHALAG

SEQ ID NO: 81916 - protein, 25 aa, Mycobacterium avium
LGEGWFINQHIIWRVGDEDVAEMNW

SEQ ID NO: 81917 - protein, 18 aa, Mycobacterium avium
LGELFRRRVFTPPDDAGR

SEQ ID NO: 81918 - protein, 23 aa, Mycobacterium avium
LGEPMKAIPAFREPGARLEVMDE

SEQ ID NO: 81919 - protein, 17 aa, Mycobacterium avium
LGEVFTAAGAEWRQAGC

SEQ ID NO: 81920 - protein, 18 aa, Mycobacterium avium
LGEVNPRLSGASPMTNLT

SEQ ID NO: 81921 - protein, 25 aa, Mycobacterium avium
LGFEAADVAARWPVPGPHDDKYTQG

SEQ ID NO: 81922 - protein, 17 aa, Mycobacterium avium
LGFQLGSLWYISLDYIN

SEQ ID NO: 81923 - protein, 24 aa, Mycobacterium avium
LGGAAALRAARAVLDAVPELTVDY

SEQ ID NO: 81924 - protein, 17 aa, Mycobacterium avium
LGGHFHNTRGCGLASAY

SEQ ID NO: 81925 - protein, 17 aa, Mycobacterium avium
LGGHVWADGGIRHPRDV

SEQ ID NO: 81926 - protein, 18 aa, Mycobacterium avium
LGGIRAVGYSPELVAAVR

SEQ ID NO: 81927 - protein, 18 aa, Mycobacterium avium
LGGMDYLSPERVELRYTM

SEQ ID NO: 81928 - protein, 17 aa, Mycobacterium avium
LGGRAGYYDGIGAARDV

SEQ ID NO: 81929 - protein, 23 aa, Mycobacterium avium
LGGRLSFALAERLHITRSDASRR

SEQ ID NO: 81930 - protein, 25 aa, Mycobacterium avium
LGGVAMPKALLWALHEHILGANPAV

SEQ ID NO: 81931 - protein, 28 aa, Mycobacterium avium
LGIEFPIFAFTHCRDVVVAVSKAGGFGV

SEQ ID NO: 81932 - protein, 26 aa, Mycobacterium avium
LGIRLKLNPLREVIRGKRLIVVDDSI

SEQ ID NO: 81933 - protein, 18 aa, Mycobacterium avium
LGKLKLEPGMTLLDIGCG

SEQ ID NO: 81934 - protein, 23 aa, Mycobacterium avium
LGKQRPGSIRALGRDEVGRLYQA

SEQ ID NO: 81935 - protein, 23 aa, Mycobacterium avium
LGKTLRAGIELDDGMARVDEFAV

SEQ ID NO: 81936 - protein, 18 aa, Mycobacterium avium
LGLARAYVAGDLQAYGVH

SEQ ID NO: 81937 - protein, 21 aa, Mycobacterium avium
LGLDGTEVFDITGIEELNKGK

SEQ ID NO: 81938 - protein, 18 aa, Mycobacterium avium
LGLDRYGVRFRVEGNDRD

SEQ ID NO: 81939 - protein, 24 aa, Mycobacterium avium
LGLEPPRFCAACGRRMVVQVRPDG

SEQ ID NO: 81940 - protein, 18 aa, Mycobacterium avium
LGLFEINEAASLVQDAAH

SEQ ID NO: 81941 - protein, 17 aa, Mycobacterium avium
LGLGEPHPISAMHGRGV

SEQ ID NO: 81942 - protein, 23 aa, Mycobacterium avium
LGLIDPQAWAFVWVVDPPLFEPA

SEQ ID NO: 81943 - protein, 22 aa, Mycobacterium avium
LGLKPRKAFGPIRVGATGTTIS

SEQ ID NO: 81944 - protein, 27 aa, Mycobacterium avium
LGLPANLRSAPMLGVVRAADGWVGINC

SEQ ID NO: 81945 - protein, 17 aa, Mycobacterium avium
LGLRWPASVAPFDVHLV

SEQ ID NO: 81946 - protein, 18 aa, Mycobacterium avium
LGPEPEILGSYRGAELLG

SEQ ID NO: 81947 - protein, 18 aa, Mycobacterium avium
LGPNGIGVLYGRREVLSQ

SEQ ID NO: 81948 - protein, 25 aa, Mycobacterium avium
LGQHGVNIMEFCKAYNAATENQRGQ

SEQ ID NO: 81949 - protein, 24 aa, Mycobacterium avium
LGQRPRGAGLFLMGHSGGCELVLR

SEQ ID NO: 81950 - protein, 17 aa, Mycobacterium avium
LGQWPFTSGPGFGHTRN

SEQ ID NO: 81951 - protein, 22 aa, Mycobacterium avium
LGRCIGVGLAQRGDRVALLARR

SEQ ID NO: 81952 - protein, 23 aa, Mycobacterium avium
LGRGRPRPAALISASAIGYYGYD

SEQ ID NO: 81953 - protein, 22 aa, Mycobacterium avium
LGRHQFPLVLTDTVNQFLAAVS

SEQ ID NO: 81954 - protein, 24 aa, Mycobacterium avium
LGRLTRPERWSGFGDLGDLADVGD

SEQ ID NO: 81955 - protein, 23 aa, Mycobacterium avium
LGRPEEYAKLALAIVDNPMLNGQ

SEQ ID NO: 81956 - protein, 23 aa, Mycobacterium avium
LGRRCRRPEWVAAGQFARQYEQV

SEQ ID NO: 81957 - protein, 17 aa, Mycobacterium avium
LGRRHRFGYTVGTDGGY

SEQ ID NO: 81958 - protein, 17 aa, Mycobacterium avium
LGRSYHAVREALSQSGQ

SEQ ID NO: 81959 - protein, 20 aa, Mycobacterium avium
LGRTEIRRLAKELEFRPRKS

SEQ ID NO: 81960 - protein, 20 aa, Mycobacterium avium
LGRVCSPVWSSVALHRPAEF

SEQ ID NO: 81961 - protein, 20 aa, Mycobacterium avium
LGSIRLPGSHFRTDIAQSAA

SEQ ID NO: 81962 - protein, 27 aa, Mycobacterium avium
LGSKMNRFFLRGALVARLLSESAWKQY

SEQ ID NO: 81963 - protein, 25 aa, Mycobacterium avium
LGSLRPRSGAVITREDVLSAAHGTG

SEQ ID NO: 81964 - protein, 25 aa, Mycobacterium avium
LGTLGRAAFQLGVLERGLQMTAEYA

SEQ ID NO: 81965 - protein, 25 aa, Mycobacterium avium
LGTPAGDWVSMAVISDGSYGVPEGL

SEQ ID NO: 81966 - protein, 19 aa, Mycobacterium avium
LGVCAPVLGGYRGELSSPL

SEQ ID NO: 81967 - protein, 17 aa, Mycobacterium avium
LGVDLVALSFVRSPSDV

SEQ ID NO: 81968 - protein, 20 aa, Mycobacterium avium
LGVGVGWCREEFALMGERFE

SEQ ID NO: 81969 - protein, 19 aa, Mycobacterium avium
LGVGVTSIYWYFRKKDDLL

SEQ ID NO: 81970 - protein, 18 aa, Mycobacterium avium
LGVLQVWQALTEGISRRP

SEQ ID NO: 81971 - protein, 27 aa, Mycobacterium avium
LGVSQWKNFFIYAPWSAAMAKSSLGAG

SEQ ID NO: 81972 - protein, 21 aa, Mycobacterium avium
LGVTCSIFVDQIHYWGDVLVD

SEQ ID NO: 81973 - protein, 25 aa, Mycobacterium avium
LGYACGVVSGGFRRIIEPLAEELML

SEQ ID NO: 81974 - protein, 25 aa, Mycobacterium avium
LGYRPEEFEHFGVPIKKRGRLCDEK

SEQ ID NO: 81975 - protein, 28 aa, Mycobacterium avium
LHAEQQWRPGLPMPRDEFHIALAEQSKN

SEQ ID NO: 81976 - protein, 20 aa, Mycobacterium avium
LHAHVLLQRDVHYIVRDDAV

SEQ ID NO: 81977 - protein, 19 aa, Mycobacterium avium
LHAKLFYQPLLESIGPAGL

SEQ ID NO: 81978 - protein, 18 aa, Mycobacterium avium
LHDICSAVHPLALASPFF

SEQ ID NO: 81979 - protein, 20 aa, Mycobacterium avium
LHERLLRRGVPAVVLNAKND

SEQ ID NO: 81980 - protein, 18 aa, Mycobacterium avium
LHGAWGVRVHDVRATVDA

SEQ ID NO: 81981 - protein, 18 aa, Mycobacterium avium
LHGLRLVFERNRDAQRGR

SEQ ID NO: 81982 - protein, 27 aa, Mycobacterium avium
LHGNHPVRLFIGSGMPTGLWGRVVEAF

SEQ ID NO: 81983 - protein, 18 aa, Mycobacterium avium
LHGRIEVDHPYVLLLPTY

SEQ ID NO: 81984 - protein, 24 aa, Mycobacterium avium
LHGWQWRLDDGRCLTAKGHQLRSS

SEQ ID NO: 81985 - protein, 24 aa, Mycobacterium avium
LHHHIKRSLILDGLLGSARELTRQ

SEQ ID NO: 81986 - protein, 18 aa, Mycobacterium avium
LHIAAAWGGKSTFEGFGA

SEQ ID NO: 81987 - protein, 25 aa, Mycobacterium avium
LHKQRTGLPHLTWKYASSVDGRSAA

SEQ ID NO: 81988 - protein, 19 aa, Mycobacterium avium
LHLAARAYTASGLSRNLAP

SEQ ID NO: 81989 - protein, 18 aa, Mycobacterium avium
LHLDILVDRMRREFKVEA

SEQ ID NO: 81990 - protein, 17 aa, Mycobacterium avium
LHLGRLKDSTGLRPEQV

SEQ ID NO: 81991 - protein, 18 aa, Mycobacterium avium
LHLLDALIELTRREITAL

SEQ ID NO: 81992 - protein, 25 aa, Mycobacterium avium
LHLLMARGAIEFEKLFPGLLDDMTA

SEQ ID NO: 81993 - protein, 19 aa, Mycobacterium avium
LHLWLPHPSDRLWRALAGT

SEQ ID NO: 81994 - protein, 21 aa, Mycobacterium avium
LHNVVPVRFLQAVETLAQAIA

SEQ ID NO: 81995 - protein, 22 aa, Mycobacterium avium
LHPEYRTMPMVWYIPPLSPVVD

SEQ ID NO: 81996 - protein, 17 aa, Mycobacterium avium
LHPRALAAYRREQGRLP

SEQ ID NO: 81997 - protein, 19 aa, Mycobacterium avium
LHPVLDRYDYVLIDCQPSL

SEQ ID NO: 81998 - protein, 33 aa, Mycobacterium avium
LHQCGLPKLMALELFKPFVMKRLVDLNHAQNIK

SEQ ID NO: 81999 - protein, 24 aa, Mycobacterium avium
LHQEMLRAGHPVRVTTVHPGGIKT

SEQ ID NO: 82000 - protein, 18 aa, Mycobacterium avium
LHRIVVNACLDRLRRTKA

SEQ ID NO: 82001 - protein, 24 aa, Mycobacterium avium
LHRSDCPLFAPGGYPHRPTVVTPT

SEQ ID NO: 82002 - protein, 18 aa, Mycobacterium avium
LHSARYTGWPGLLESQRK

SEQ ID NO: 82003 - protein, 27 aa, Mycobacterium avium
LHTHLPWLAHHGRWPVGEEWLYQSWAA

SEQ ID NO: 82004 - protein, 19 aa, Mycobacterium avium
LHWERRYDRVAAYGQSKLA

SEQ ID NO: 82005 - protein, 18 aa, Mycobacterium avium
LIAGPGVYICDECIDLCN

SEQ ID NO: 82006 - protein, 17 aa, Mycobacterium avium
LIARLAARPLDKTRPLW

SEQ ID NO: 82007 - protein, 21 aa, Mycobacterium avium
LIDELRCGRTPARVTGPDPVP

SEQ ID NO: 82008 - protein, 24 aa, Mycobacterium avium
LIDFVFGEVWSRPGLSRRDRRFVT

SEQ ID NO: 82009 - protein, 23 aa, Mycobacterium avium
LIDPALLRPGRLERLVFVEPPDA

SEQ ID NO: 82010 - protein, 18 aa, Mycobacterium avium
LIDQIGVDKVMWSSDYPH

SEQ ID NO: 82011 - protein, 17 aa, Mycobacterium avium
LIEEGFALYDPMPFDLS

SEQ ID NO: 82012 - protein, 25 aa, Mycobacterium avium
LIEESIYGWKEFELELMRDGNDNVV

SEQ ID NO: 82013 - protein, 20 aa, Mycobacterium avium
LIERLQRPTLVMAPNKTLAA

SEQ ID NO: 82014 - protein, 18 aa, Mycobacterium avium
LIGALSMIHCAPRDSATI

SEQ ID NO: 82015 - protein, 25 aa, Mycobacterium avium
LIGQFGIGFYSSFMVADKVELLTRK

SEQ ID NO: 82016 - protein, 19 aa, Mycobacterium avium
LIGRKSARLDNSYVHNLIH

SEQ ID NO: 82017 - protein, 20 aa, Mycobacterium avium
LIGRLWRGGVIVLPTGDDGV

SEQ ID NO: 82018 - protein, 22 aa, Mycobacterium avium
LIGTGLGWRRLDVVEQTGSTNA

SEQ ID NO: 82019 - protein, 18 aa, Mycobacterium avium
LIIGRAARRHGFRISLSP

SEQ ID NO: 82020 - protein, 25 aa, Mycobacterium avium
LIKERPRLTAALDKLRVFSNTATRL

SEQ ID NO: 82021 - protein, 21 aa, Mycobacterium avium
LIKNIEVAARVGGGDPAGNPT

SEQ ID NO: 82022 - protein, 22 aa, Mycobacterium avium
LIPDQRAGCSLADSITPEDLRA

SEQ ID NO: 82023 - protein, 29 aa, Mycobacterium avium
LIQARGLVDVVIPRGGANLINAVVRDAQV

SEQ ID NO: 82024 - protein, 17 aa, Mycobacterium avium
LIRSVCTANRYPEFLPE

SEQ ID NO: 82025 - protein, 25 aa, Mycobacterium avium
LISRGGWCTITVRYDRASVRDEALF

SEQ ID NO: 82026 - protein, 18 aa, Mycobacterium avium
LITTPGLINVDFADVKGI

SEQ ID NO: 82027 - protein, 18 aa, Mycobacterium avium
LITVKRYWNEWKDPRLII

SEQ ID NO: 82028 - protein, 25 aa, Mycobacterium avium
LKAAGRPDDEFGFVVHGTMADPRWL

SEQ ID NO: 82029 - protein, 20 aa, Mycobacterium avium
LKAFVPILLERGEGHVVNTC

SEQ ID NO: 82030 - protein, 19 aa, Mycobacterium avium
LKATLKHLACLEYSTVAIQ

SEQ ID NO: 82031 - protein, 21 aa, Mycobacterium avium
LKCAIADGCADVAALKSCTSA

SEQ ID NO: 82032 - protein, 20 aa, Mycobacterium avium
LKDLEIRGAGNVLGVEQSGH

SEQ ID NO: 82033 - protein, 19 aa, Mycobacterium avium
LKEFMVRNTYIYPPKPSMR

SEQ ID NO: 82034 - protein, 26 aa, Mycobacterium avium
LKEYASRGTWIWPPEPSLRLIADTIE

SEQ ID NO: 82035 - protein, 22 aa, Mycobacterium avium
LKFAFSEGGIGWIPFYLDRSDR

SEQ ID NO: 82036 - protein, 17 aa, Mycobacterium avium
LKGGRPADTPVLVVQHG

SEQ ID NO: 82037 - protein, 20 aa, Mycobacterium avium
LKGLYEFFTPLLRNLGHCAR

SEQ ID NO: 82038 - protein, 28 aa, Mycobacterium avium
LKHRLARSLFLYALCNGWIGEGTTVVEA

SEQ ID NO: 82039 - protein, 18 aa, Mycobacterium avium
LKHRNARKCSMFTCRAFS

SEQ ID NO: 82040 - protein, 25 aa, Mycobacterium avium
LKHTPLKMCWVPRYSDYYPESPGGR

SEQ ID NO: 82041 - protein, 19 aa, Mycobacterium avium
LKIVARAGVGLDNVDVDAA

SEQ ID NO: 82042 - protein, 18 aa, Mycobacterium avium
LKLAEHMVEGAAIMAALL

SEQ ID NO: 82043 - protein, 20 aa, Mycobacterium avium
LKLGTEHLVDATIYVLAHPC

SEQ ID NO: 82044 - protein, 17 aa, Mycobacterium avium
LKLKELAYMHAEGFAAG

SEQ ID NO: 82045 - protein, 19 aa, Mycobacterium avium
LKLVEPLVISSPRQRSLAT

SEQ ID NO: 82046 - protein, 19 aa, Mycobacterium avium
LKNKIALMCDVDIDGVIST

SEQ ID NO: 82047 - protein, 18 aa, Mycobacterium avium
LKNLMAVARKDVVLSAGW

SEQ ID NO: 82048 - protein, 19 aa, Mycobacterium avium
LKPDCVVYNPMWIDVDELV

SEQ ID NO: 82049 - protein, 19 aa, Mycobacterium avium
LKPEILAVTLAAGRHGKKS

SEQ ID NO: 82050 - protein, 26 aa, Mycobacterium avium
LKPENKRALADWTWGRQSIDLLAQLP

SEQ ID NO: 82051 - protein, 21 aa, Mycobacterium avium
LKPFEDGGWIWFDITTDTEVN

SEQ ID NO: 82052 - protein, 17 aa, Mycobacterium avium
LKPLDYVDHRWGAEEFA

SEQ ID NO: 82053 - protein, 20 aa, Mycobacterium avium
LKSSDTLYCCLPLYHNNALT

SEQ ID NO: 82054 - protein, 18 aa, Mycobacterium avium
LKTASGHRALRVDHVGST

SEQ ID NO: 82055 - protein, 17 aa, Mycobacterium avium
LKTLRRRAERVGGTLTV

SEQ ID NO: 82056 - protein, 21 aa, Mycobacterium avium
LKTMQRLVGVFKQLAPGADVQ

SEQ ID NO: 82057 - protein, 25 aa, Mycobacterium avium
LKVGDIVLAGWGFRTDRRAHPEISA

SEQ ID NO: 82058 - protein, 19 aa, Mycobacterium avium
LKVGTSVAVLPGRHPVLVA

SEQ ID NO: 82059 - protein, 22 aa, Mycobacterium avium
LKWQRSDPEFAYSDRERDGLLE

SEQ ID NO: 82060 - protein, 19 aa, Mycobacterium avium
LKYPGGVVLAGDRRSTQGN

SEQ ID NO: 82061 - protein, 24 aa, Mycobacterium avium
LLAAERGRIRVLLVDDAQQLDPQA

SEQ ID NO: 82062 - protein, 17 aa, Mycobacterium avium
LLAEAKVPWVLMHWRSV

SEQ ID NO: 82063 - protein, 31 aa, Mycobacterium avium
LLAGLDRFAHVQVRWGSPMTGCREDADGVNV

SEQ ID NO: 82064 - protein, 31 aa, Mycobacterium avium
LLAKYAIEHWTRLPVEVELASEFRYRDPVLD

SEQ ID NO: 82065 - protein, 17 aa, Mycobacterium avium
LLALYRRRGPVIDAGAG

SEQ ID NO: 82066 - protein, 26 aa, Mycobacterium avium
LLAPEIDVRFGLGWGAVTVLDAAAGI

SEQ ID NO: 82067 - protein, 18 aa, Mycobacterium avium
LLAPILTPLVYRAAVSAR

SEQ ID NO: 82068 - protein, 21 aa, Mycobacterium avium
LLARSPCRLLYVGHASSADDD

SEQ ID NO: 82069 - protein, 21 aa, Mycobacterium avium
LLARTRLRLPAQRLRAANVAA

SEQ ID NO: 82070 - protein, 24 aa, Mycobacterium avium
LLATARSWSWLSGRNYVTPDDVKA

SEQ ID NO: 82071 - protein, 17 aa, Mycobacterium avium
LLAVGDLLIGWRLLVHA

SEQ ID NO: 82072 - protein, 18 aa, Mycobacterium avium
LLDCGTSGGVWGRERGYC

SEQ ID NO: 82073 - protein, 21 aa, Mycobacterium avium
LLDIGCGWGATMRRAIEKYDV

SEQ ID NO: 82074 - protein, 25 aa, Mycobacterium avium
LLDIGCGWGTTIVRALERYDVNVVG

SEQ ID NO: 82075 - protein, 21 aa, Mycobacterium avium
LLDIGCGWGTTMKRAVERFDV

SEQ ID NO: 82076 - protein, 24 aa, Mycobacterium avium
LLDPSIPLPEVFKQYAETLARDFA

SEQ ID NO: 82077 - protein, 18 aa, Mycobacterium avium
LLDQEGRDDLALRIAVQP

SEQ ID NO: 82078 - protein, 21 aa, Mycobacterium avium
LLDVGCGWGATMRRAVENYDV

SEQ ID NO: 82079 - protein, 26 aa, Mycobacterium avium
LLDVGCGWGGAVVRALEKYDVNVIGI

SEQ ID NO: 82080 - protein, 29 aa, Mycobacterium avium
LLEALPERERTVLVLRFFESMTQTQIAER

SEQ ID NO: 82081 - protein, 19 aa, Mycobacterium avium
LLECGWRPNDSVVLAAAGT

SEQ ID NO: 82082 - protein, 20 aa, Mycobacterium avium
LLEIEPALKALEGVVMELDD

SEQ ID NO: 82083 - protein, 24 aa, Mycobacterium avium
LLEVEEVYLPLARLIHLQVAARQR

SEQ ID NO: 82084 - protein, 22 aa, Mycobacterium avium
LLEVVRPATFLFAAGQETVTKL

SEQ ID NO: 82085 - protein, 37 aa, Mycobacterium avium
LLFIGCTPIVWAGPIANWVAACDAMIALDAPTVVPGH

SEQ ID NO: 82086 - protein, 29 aa, Mycobacterium avium
LLFVHGGWHAAWCWENFLDFFADAGYRAV

SEQ ID NO: 82087 - protein, 26 aa, Mycobacterium avium
LLGGRPIREPVFHYGPFVMNTRTELI

SEQ ID NO: 82088 - protein, 18 aa, Mycobacterium avium
LLGIPWIELSPHPLYLPS

SEQ ID NO: 82089 - protein, 17 aa, Mycobacterium avium
LLGKKCYSLRIASAMAH

SEQ ID NO: 82090 - protein, 17 aa, Mycobacterium avium
LLGNAAVIFARHPDQWQ

SEQ ID NO: 82091 - protein, 17 aa, Mycobacterium avium
LLGPRLAARSGHFMPAA

SEQ ID NO: 82092 - protein, 18 aa, Mycobacterium avium
LLGTEEWAAAHSLTPLAY

SEQ ID NO: 82093 - protein, 18 aa, Mycobacterium avium
LLGTGAPWFESWIEHADP

SEQ ID NO: 82094 - protein, 26 aa, Mycobacterium avium
LLGVDEVWAVGGAQAVALLAYGGTDT

SEQ ID NO: 82095 - protein, 19 aa, Mycobacterium avium
LLGVRDWRNYPGFGPTERA

SEQ ID NO: 82096 - protein, 17 aa, Mycobacterium avium
LLIPGGVLMIYVATVTQ

SEQ ID NO: 82097 - protein, 20 aa, Mycobacterium avium
LLKIGWPAEDLAGYVDGEAH

SEQ ID NO: 82098 - protein, 27 aa, Mycobacterium avium
LLLETDQLFGWIAFEFGVYRYGLQQRL

SEQ ID NO: 82099 - protein, 17 aa, Mycobacterium avium
LLLPAGVETTYRALGSL

SEQ ID NO: 82100 - protein, 24 aa, Mycobacterium avium
LLLSRTTAGLSYQQCVGVTYQQLH

SEQ ID NO: 82101 - protein, 19 aa, Mycobacterium avium
LLMRAPRVIQDYGDGPSGP

SEQ ID NO: 82102 - protein, 20 aa, Mycobacterium avium
LLMSEFEYWGVPGPDLTVTS

SEQ ID NO: 82103 - protein, 27 aa, Mycobacterium avium
LLNDVLKDAWAYRGWVMSDWGATPGWE

SEQ ID NO: 82104 - protein, 25 aa, Mycobacterium avium
LLNGPRYWLMNGIEKQPQGPRITKT

SEQ ID NO: 82105 - protein, 19 aa, Mycobacterium avium
LLNGQKIWSSRAPFAERGF

SEQ ID NO: 82106 - protein, 19 aa, Mycobacterium avium
LLNRNRLNVAVSRAQYAAV

SEQ ID NO: 82107 - protein, 17 aa, Mycobacterium avium
LLNTALEAGETVLLEGS

SEQ ID NO: 82108 - protein, 25 aa, Mycobacterium avium
LLPIADEGLRRWGVDAEVRDRFLGV

SEQ ID NO: 82109 - protein, 23 aa, Mycobacterium avium
LLPLRYGQVSLREKMPRRFYCRG

SEQ ID NO: 82110 - protein, 19 aa, Mycobacterium avium
LLPVGRLRAGRTFRPARRR

SEQ ID NO: 82111 - protein, 18 aa, Mycobacterium avium
LLQDRSFSSLSLREVTRE

SEQ ID NO: 82112 - protein, 18 aa, Mycobacterium avium
LLQERGSFRAEYRGITLR

SEQ ID NO: 82113 - protein, 20 aa, Mycobacterium avium
LLQLCGLTGIPVSKGSGQTL

SEQ ID NO: 82114 - protein, 18 aa, Mycobacterium avium
LLQPEQWGGLQCDPTLFY

SEQ ID NO: 82115 - protein, 18 aa, Mycobacterium avium
LLQPMGLVHGGVYCSMIE

SEQ ID NO: 82116 - protein, 18 aa, Mycobacterium avium
LLQRYRVSRAVFREAVRL

SEQ ID NO: 82117 - protein, 25 aa, Mycobacterium avium
LLQTLLVLEMFYRVEIDVPPDDPLP

SEQ ID NO: 82118 - protein, 17 aa, Mycobacterium avium
LLRAGIEEADAFAAVSS

SEQ ID NO: 82119 - protein, 24 aa, Mycobacterium avium
LLRCGDEEHLLVAVVHHIAADGWS

SEQ ID NO: 82120 - protein, 17 aa, Mycobacterium avium
LLRDFDAKLGRGPAVTV

SEQ ID NO: 82121 - protein, 31 aa, Mycobacterium avium
LLREAHDLCGLPVAVFRCDMILADTTYAGQL

SEQ ID NO: 82122 - protein, 29 aa, Mycobacterium avium
LLRQLRLGEYDVLVGINLLREGLDLPEVS

SEQ ID NO: 82123 - protein, 18 aa, Mycobacterium avium
LLRRQRGAWVGWPGIVDE

SEQ ID NO: 82124 - protein, 17 aa, Mycobacterium avium
LLSALDLEDVVLVGNDT

SEQ ID NO: 82125 - protein, 19 aa, Mycobacterium avium
LLSDIALDFKPVVQTRYEP

SEQ ID NO: 82126 - protein, 21 aa, Mycobacterium avium
LLSIPLRHVYAALWRVGVLEV

SEQ ID NO: 82127 - protein, 25 aa, Mycobacterium avium
LLSKHIRLLAAFDHRHIFLDPNPDA

SEQ ID NO: 82128 - protein, 24 aa, Mycobacterium avium
LLSMRTGQGYAEFAVSSFGTDAAI

SEQ ID NO: 82129 - protein, 17 aa, Mycobacterium avium
LLSRAGTVAVIAHVHPD

SEQ ID NO: 82130 - protein, 27 aa, Mycobacterium avium
LLSVGYAACHWCHVMAHESFEDPDVAA

SEQ ID NO: 82131 - protein, 18 aa, Mycobacterium avium
LLTHWARDRSRGDKLALE

SEQ ID NO: 82132 - protein, 23 aa, Mycobacterium avium
LLTRALVALCAIQLGVVERALRI

SEQ ID NO: 82133 - protein, 18 aa, Mycobacterium avium
LLTRELFYTAVTRAKSRV

SEQ ID NO: 82134 - protein, 18 aa, Mycobacterium avium
LLTRPEFGAMFLDDLLNG

SEQ ID NO: 82135 - protein, 19 aa, Mycobacterium avium
LLTSVPFAPGYGVEIGLLV

SEQ ID NO: 82136 - protein, 18 aa, Mycobacterium avium
LLVAGGRGLIAFTSSPGS

SEQ ID NO: 82137 - protein, 20 aa, Mycobacterium avium
LLVALYPFEALAGFRPASRT

SEQ ID NO: 82138 - protein, 19 aa, Mycobacterium avium
LLVESGMAPLFPLVVIVYA

SEQ ID NO: 82139 - protein, 25 aa, Mycobacterium avium
LLVGARLNWLLGHGESPQWSAGVKF

SEQ ID NO: 82140 - protein, 19 aa, Mycobacterium avium
LLVHCGRLSVEKRVDRSID

SEQ ID NO: 82141 - protein, 17 aa, Mycobacterium avium
LLYERRLFHSTFATADQ

SEQ ID NO: 82142 - protein, 29 aa, Mycobacterium avium
LLYKLLRSDWLEPRWMVGIDPQSEGLARA

SEQ ID NO: 82143 - protein, 23 aa, Mycobacterium avium
LLYRLCGDRNPLHSDPEFAAAAG

SEQ ID NO: 82144 - protein, 18 aa, Mycobacterium avium
LLYTLGWHEVPPQPSNDG

SEQ ID NO: 82145 - protein, 19 aa, Mycobacterium avium
LMDAVPVTLGQEFSGYARQ

SEQ ID NO: 82146 - protein, 18 aa, Mycobacterium avium
LMETRPSALVAIAALSRL

SEQ ID NO: 82147 - protein, 28 aa, Mycobacterium avium
LMGIPGPGGLHFAGRVGTGFTERDLANL

SEQ ID NO: 82148 - protein, 27 aa, Mycobacterium avium
LMHGVEPNMRWRTFCAELVAIADKLNV

SEQ ID NO: 82149 - protein, 21 aa, Mycobacterium avium
LMLGGAAEHRARIAEEYRAAD

SEQ ID NO: 82150 - protein, 24 aa, Mycobacterium avium
LMLNRARHELLLGAARDPGLAETS

SEQ ID NO: 82151 - protein, 25 aa, Mycobacterium avium
LMPLATEEMIRWVTPVKEFMRTAAK

SEQ ID NO: 82152 - protein, 20 aa, Mycobacterium avium
LMPLGLRLIEEGFALYDPMP

SEQ ID NO: 82153 - protein, 18 aa, Mycobacterium avium
LMPTSSVNLGDWSASRLV

SEQ ID NO: 82154 - protein, 17 aa, Mycobacterium avium
LMRSGAKDQLRFSAPPR

SEQ ID NO: 82155 - protein, 25 aa, Mycobacterium avium
LMRTFAVELGQHFIRVNSVHPTNVN

SEQ ID NO: 82156 - protein, 19 aa, Mycobacterium avium
LNAAGSVFLTRPSLAHFIR

SEQ ID NO: 82157 - protein, 29 aa, Mycobacterium avium
LNALRHDIGYRIAHHADLNAPPAVDVREH

SEQ ID NO: 82158 - protein, 21 aa, Mycobacterium avium
LNALVGLARPGKFGGDVSHLN

SEQ ID NO: 82159 - protein, 18 aa, Mycobacterium avium
LNDVIAYCDQYPLDDLPE

SEQ ID NO: 82160 - protein, 23 aa, Mycobacterium avium
LNEAFASVVLKFQKDLNIPDEKL

SEQ ID NO: 82161 - protein, 22 aa, Mycobacterium avium
LNEPRRVAVLAVHTSPLAQPGT

SEQ ID NO: 82162 - protein, 17 aa, Mycobacterium avium
LNFFVHDPFTLEPYSRD

SEQ ID NO: 82163 - protein, 29 aa, Mycobacterium avium
LNGGKRLRPAFAYWGWRAVATEAPDDQAL

SEQ ID NO: 82164 - protein, 24 aa, Mycobacterium avium
LNIGKLLAKRARVIGTTLRGRPVS

SEQ ID NO: 82165 - protein, 20 aa, Mycobacterium avium
LNIKGPELLNKFVGETERHI

SEQ ID NO: 82166 - protein, 21 aa, Mycobacterium avium
LNIPTGIPLRYDLDARLRPLV

SEQ ID NO: 82167 - protein, 17 aa, Mycobacterium avium
LNKQRFVEVPADAPNAV

SEQ ID NO: 82168 - protein, 22 aa, Mycobacterium avium
LNLSIRDGWWDEWYDGENGWEI

SEQ ID NO: 82169 - protein, 26 aa, Mycobacterium avium
LNMPGGFDPNAGWFNYFSTWGNQFIS

SEQ ID NO: 82170 - protein, 17 aa, Mycobacterium avium
LNPPDFLVGEMANLSGQ

SEQ ID NO: 82171 - protein, 20 aa, Mycobacterium avium
LNRPEVLMIIGAGQTQGYRR

SEQ ID NO: 82172 - protein, 21 aa, Mycobacterium avium
LNRPRWPELAGRETFSGISIH

SEQ ID NO: 82173 - protein, 23 aa, Mycobacterium avium
LNVGCIPTKMFVYAADVATTIRE

SEQ ID NO: 82174 - protein, 20 aa, Mycobacterium avium
LPADDPRIWPNIVAAQLDWD

SEQ ID NO: 82175 - protein, 25 aa, Mycobacterium avium
LPADLRPGDLLAVACTGAYHHSMAS

SEQ ID NO: 82176 - protein, 17 aa, Mycobacterium avium
LPAGSALPSERRLAEVF

SEQ ID NO: 82177 - protein, 18 aa, Mycobacterium avium
LPAKGPWQQKVIKQLPQT

SEQ ID NO: 82178 - protein, 19 aa, Mycobacterium avium
LPALLDMFGYFNGVTAARR

SEQ ID NO: 82179 - protein, 26 aa, Mycobacterium avium
LPAMFADVRRALAIAEVIRAATVTDT

SEQ ID NO: 82180 - protein, 19 aa, Mycobacterium avium
LPAPLRWLERRTRDDLLHP

SEQ ID NO: 82181 - protein, 25 aa, Mycobacterium avium
LPAPWVACAADLVGVAGAALRRSVE

SEQ ID NO: 82182 - protein, 19 aa, Mycobacterium avium
LPASQVVRFIVPRYVQDDP

SEQ ID NO: 82183 - protein, 19 aa, Mycobacterium avium
LPATEFAGFLWVSLDPGAT

SEQ ID NO: 82184 - protein, 17 aa, Mycobacterium avium
LPDEVVVPFDLPVLHRD

SEQ ID NO: 82185 - protein, 22 aa, Mycobacterium avium
LPDGALMRRAAFGLATEIAAEL

SEQ ID NO: 82186 - protein, 17 aa, Mycobacterium avium
LPDLRLADDGDLPLRPA

SEQ ID NO: 82187 - protein, 21 aa, Mycobacterium avium
LPDMVAANWGRIVMISSSSAQ

SEQ ID NO: 82188 - protein, 31 aa, Mycobacterium avium
LPDREFDALFTRDRPVIFAYHGYPWLIHRLT

SEQ ID NO: 82189 - protein, 19 aa, Mycobacterium avium
LPDTTLWSVMERLQPANAT

SEQ ID NO: 82190 - protein, 26 aa, Mycobacterium avium
LPEDASPAFLGFNLFQHAIARAVIHG

SEQ ID NO: 82191 - protein, 17 aa, Mycobacterium avium
LPEDRVVVELSPYDLSR

SEQ ID NO: 82192 - protein, 17 aa, Mycobacterium avium
LPEELAREAHDWTLSPQ

SEQ ID NO: 82193 - protein, 23 aa, Mycobacterium avium
LPEGRRAIKYLGDFVKDVTAAGT

SEQ ID NO: 82194 - protein, 25 aa, Mycobacterium avium
LPELMTLEKIAAWAITEPDSGSDAF

SEQ ID NO: 82195 - protein, 21 aa, Mycobacterium avium
LPERFAEEFAAALAQHRCWQR

SEQ ID NO: 82196 - protein, 18 aa, Mycobacterium avium
LPESPYLAAVNGRKPHRV

SEQ ID NO: 82197 - protein, 21 aa, Mycobacterium avium
LPEVIRRSGVDPAAIDDIIFA

SEQ ID NO: 82198 - protein, 17 aa, Mycobacterium avium
LPFKIDDHTAWRLLEGL

SEQ ID NO: 82199 - protein, 20 aa, Mycobacterium avium
LPFKPTAFRSLAMGHRPVED

SEQ ID NO: 82200 - protein, 23 aa, Mycobacterium avium
LPFYHDMGLVLGVCAPVLGGYRG

SEQ ID NO: 82201 - protein, 23 aa, Mycobacterium avium
LPGDLRARLDAALAKPAAQQPSW

SEQ ID NO: 82202 - protein, 17 aa, Mycobacterium avium
LPGDPLALIAPASSGGG

SEQ ID NO: 82203 - protein, 18 aa, Mycobacterium avium
LPGDPTVFPGHWYSAEPS

SEQ ID NO: 82204 - protein, 19 aa, Mycobacterium avium
LPGIRELPDRATVETVFAT

SEQ ID NO: 82205 - protein, 27 aa, Mycobacterium avium
LPGLAGRLDLPAGWSYQPRVLTSELRV

SEQ ID NO: 82206 - protein, 24 aa, Mycobacterium avium
LPGREPITGVSFAFVSNSSPWTFA

SEQ ID NO: 82207 - protein, 26 aa, Mycobacterium avium
LPGRERAKILWRIGDLIDEHAEEFAQ

SEQ ID NO: 82208 - protein, 21 aa, Mycobacterium avium
LPGRRYYGGCEYVDVVENIAR

SEQ ID NO: 82209 - protein, 17 aa, Mycobacterium avium
LPGSRFTPFLTVAGAEN

SEQ ID NO: 82210 - protein, 25 aa, Mycobacterium avium
LPGVFSGHVRLCLGYTEPEGGSDVA

SEQ ID NO: 82211 - protein, 19 aa, Mycobacterium avium
LPHNRVWVKALGKLPDDPV

SEQ ID NO: 82212 - protein, 24 aa, Mycobacterium avium
LPIEPKPLPALMVREADGIIEVFA

SEQ ID NO: 82213 - protein, 22 aa, Mycobacterium avium
LPIGDHRIGIVVGDCVGRGLPA

SEQ ID NO: 82214 - protein, 20 aa, Mycobacterium avium
LPKRAYRADADLVLDVTDPL

SEQ ID NO: 82215 - protein, 20 aa, Mycobacterium avium
LPKRRPVPLRLRDWREVYEE

SEQ ID NO: 82216 - protein, 17 aa, Mycobacterium avium
LPLALTVQACEAAIADA

SEQ ID NO: 82217 - protein, 26 aa, Mycobacterium avium
LPLPGHCPSGLGFRPDGSLLIASTRD

SEQ ID NO: 82218 - protein, 18 aa, Mycobacterium avium
LPLQVIVTGHYQDTFHRV

SEQ ID NO: 82219 - protein, 17 aa, Mycobacterium avium
LPLTFTLVVANSGDPTW

SEQ ID NO: 82220 - protein, 17 aa, Mycobacterium avium
LPMLRWAGHGVAMGNAH

SEQ ID NO: 82221 - protein, 23 aa, Mycobacterium avium
LPMSLRRHRHWGSFYAEERLVPM

SEQ ID NO: 82222 - protein, 18 aa, Mycobacterium avium
LPNMRTVLHCLPPKDWTE

SEQ ID NO: 82223 - protein, 17 aa, Mycobacterium avium
LPPGYAVDIHFKPRYNP

SEQ ID NO: 82224 - protein, 22 aa, Mycobacterium avium
LPPLRSCTLRAAGHQIEIRGTC

SEQ ID NO: 82225 - protein, 19 aa, Mycobacterium avium
LPQQCLRSDRLSALHQWGA

SEQ ID NO: 82226 - protein, 19 aa, Mycobacterium avium
LPQRLSLFGHTRLACTDVE

SEQ ID NO: 82227 - protein, 25 aa, Mycobacterium avium
LPRLKPRVFYDLVVEVALIRPGPIQ

SEQ ID NO: 82228 - protein, 21 aa, Mycobacterium avium
LPRPECADADLVGDVDLLLKA

SEQ ID NO: 82229 - protein, 22 aa, Mycobacterium avium
LPSEERHGFIWAVLTADATIDL

SEQ ID NO: 82230 - protein, 20 aa, Mycobacterium avium
LPSFTRQGIATALVRHQLRD

SEQ ID NO: 82231 - protein, 18 aa, Mycobacterium avium
LPSPYAGRIVEMNGAEGD

SEQ ID NO: 82232 - protein, 22 aa, Mycobacterium avium
LPSTLWAQYGLAGVLEHEAFVR

SEQ ID NO: 82233 - protein, 26 aa, Mycobacterium avium
LPSYPHPRLMPDFWEFPTVSMGLGPL

SEQ ID NO: 82234 - protein, 26 aa, Mycobacterium avium
LPTAAPRWVIDPDFNLDFHVRRVRVA

SEQ ID NO: 82235 - protein, 24 aa, Mycobacterium avium
LPTQLCAFAAGVLRAEASHEPGYY

SEQ ID NO: 82236 - protein, 24 aa, Mycobacterium avium
LPTRPRATLVLRKDADHSINRLRL

SEQ ID NO: 82237 - protein, 25 aa, Mycobacterium avium
LPTYAVICCPAFGAAGLVGKFNWAM

SEQ ID NO: 82238 - protein, 23 aa, Mycobacterium avium
LPVAAIRWCLDHAGVRAEDIDAV

SEQ ID NO: 82239 - protein, 25 aa, Mycobacterium avium
LPVIGSKELIAWLPTLLGLGPADLI

SEQ ID NO: 82240 - protein, 18 aa, Mycobacterium avium
LPVLRELGIGFVAYSPLG

SEQ ID NO: 82241 - protein, 20 aa, Mycobacterium avium
LPVPERLGGDGVGLPEVATV

SEQ ID NO: 82242 - protein, 18 aa, Mycobacterium avium
LPVPSLVISELLGVPYED

SEQ ID NO: 82243 - protein, 17 aa, Mycobacterium avium
LPVTGYADLVRAVKARV

SEQ ID NO: 82244 - protein, 17 aa, Mycobacterium avium
LPVYDAIVVDAPPTGRI

SEQ ID NO: 82245 - protein, 20 aa, Mycobacterium avium
LPVYMVPAAVVALDAIPLTP

SEQ ID NO: 82246 - protein, 21 aa, Mycobacterium avium
LPWLSRKRIQQEWGVSDEVMR

SEQ ID NO: 82247 - protein, 18 aa, Mycobacterium avium
LPYSELFGPNALGTAELI

SEQ ID NO: 82248 - protein, 25 aa, Mycobacterium avium
LPYTEFPRFHALMAEQSGVVFDTAL

SEQ ID NO: 82249 - protein, 24 aa, Mycobacterium avium
LQAESRGATMIFTRTKRTAQKVAD

SEQ ID NO: 82250 - protein, 25 aa, Mycobacterium avium
LQAIPPLVVGRGFRPEHVRTPDVHA

SEQ ID NO: 82251 - protein, 23 aa, Mycobacterium avium
LQAPYELVVEVARAGKLPVTLFT

SEQ ID NO: 82252 - protein, 20 aa, Mycobacterium avium
LQCAEVVGVVQTVFDFTTQW

SEQ ID NO: 82253 - protein, 18 aa, Mycobacterium avium
LQDVVRFGPGITLVGYGH

SEQ ID NO: 82254 - protein, 17 aa, Mycobacterium avium
LQGRGAALIANHGLVAV

SEQ ID NO: 82255 - protein, 18 aa, Mycobacterium avium
LQGWTLDRLPAVDRAILR

SEQ ID NO: 82256 - protein, 18 aa, Mycobacterium avium
LQHDRVWIIDPLDGTREF

SEQ ID NO: 82257 - protein, 17 aa, Mycobacterium avium
LQINPYFHTFGLKAGLI

SEQ ID NO: 82258 - protein, 26 aa, Mycobacterium avium
LQKISELYDRVGFAAAGKFNEFDNLR

SEQ ID NO: 82259 - protein, 18 aa, Mycobacterium avium
LQKRDRIRYHGGEFIELI

SEQ ID NO: 82260 - protein, 23 aa, Mycobacterium avium
LQLFIKVLMRLTTRYALQSRTDS

SEQ ID NO: 82261 - protein, 18 aa, Mycobacterium avium
LQLHGGYGYLREYGLEKI

SEQ ID NO: 82262 - protein, 25 aa, Mycobacterium avium
LQLSKRGGGVALLLTNIREHGAPIK

SEQ ID NO: 82263 - protein, 19 aa, Mycobacterium avium
LQNRLPCIYLVDSGGAFLP

SEQ ID NO: 82264 - protein, 21 aa, Mycobacterium avium
LQPEMFCEVSPELAAERGLQP

SEQ ID NO: 82265 - protein, 24 aa, Mycobacterium avium
LQPETLHAIMWLMSDRALPRSYRM

SEQ ID NO: 82266 - protein, 24 aa, Mycobacterium avium
LQPHKRTGIDIAIALLTPLVGQEF

SEQ ID NO: 82267 - protein, 26 aa, Mycobacterium avium
LQPIEWRYTNDPAWVMRTKGERLPHN

SEQ ID NO: 82268 - protein, 17 aa, Mycobacterium avium
LQPYGWATIISPRAAIE

SEQ ID NO: 82269 - protein, 20 aa, Mycobacterium avium
LQQVLARSAGILGIELGAEA

SEQ ID NO: 82270 - protein, 17 aa, Mycobacterium avium
LQRDVHYIVRDDAVHLI

SEQ ID NO: 82271 - protein, 21 aa, Mycobacterium avium
LQRFPGAFSPLVAKLVAELGF

SEQ ID NO: 82272 - protein, 23 aa, Mycobacterium avium
LQRHAGPIFPLIEDLFGVSVAQL

SEQ ID NO: 82273 - protein, 21 aa, Mycobacterium avium
LQRKGFEFKELEAAGLSRQGR

SEQ ID NO: 82274 - protein, 23 aa, Mycobacterium avium
LQRLGKVWAAMAITEPGFGSDSA

SEQ ID NO: 82275 - protein, 17 aa, Mycobacterium avium
LQRLWTPYRMTYLAEAP

SEQ ID NO: 82276 - protein, 24 aa, Mycobacterium avium
LQSARAQILAGFCDVALVIGADTT

SEQ ID NO: 82277 - protein, 25 aa, Mycobacterium avium
LQSLRARFGTLTGVERPVAEGDFVS

SEQ ID NO: 82278 - protein, 22 aa, Mycobacterium avium
LQSYEVPRDFIIETTPFSLENG

SEQ ID NO: 82279 - protein, 24 aa, Mycobacterium avium
LQTVAALLRLQARRTTNPEGREAL

SEQ ID NO: 82280 - protein, 18 aa, Mycobacterium avium
LQVREQLLILPIIGVLDS

SEQ ID NO: 82281 - protein, 18 aa, Mycobacterium avium
LQYPWGVMPEKYIARVED

SEQ ID NO: 82282 - protein, 18 aa, Mycobacterium avium
LRAAEYGRNVCVLTIDPA

SEQ ID NO: 82283 - protein, 24 aa, Mycobacterium avium
LRAAGVPVRVALPVGTSFSDHAEW

SEQ ID NO: 82284 - protein, 19 aa, Mycobacterium avium
LRAAKARERAARAGLSAAR

SEQ ID NO: 82285 - protein, 21 aa, Mycobacterium avium
LRAARLLAGRTADFDVVHDNQ

SEQ ID NO: 82286 - protein, 18 aa, Mycobacterium avium
LRAATELAHAGDLSGIEN

SEQ ID NO: 82287 - protein, 17 aa, Mycobacterium avium
LRAAVGVALTEPHGATR

SEQ ID NO: 82288 - protein, 23 aa, Mycobacterium avium
LRADGSTAAGCWIYTGVYANAVN

SEQ ID NO: 82289 - protein, 17 aa, Mycobacterium avium
LRAEARQGRMLPYVIEL

SEQ ID NO: 82290 - protein, 21 aa, Mycobacterium avium
LRAELRALAPTGDRRMSANPH

SEQ ID NO: 82291 - protein, 19 aa, Mycobacterium avium
LRAGQIWVNSALAADPSMP

SEQ ID NO: 82292 - protein, 25 aa, Mycobacterium avium
LRAGVARSGFYFYFDSKYAVLAQLM

SEQ ID NO: 82293 - protein, 24 aa, Mycobacterium avium
LRAHIPDAGGMIIASDRVAARAYA

SEQ ID NO: 82294 - protein, 26 aa, Mycobacterium avium
LRAILDEWKTITGLDRRVDDALWKRY

SEQ ID NO: 82295 - protein, 21 aa, Mycobacterium avium
LRALAAPPQRRQWWIDRVTAC

SEQ ID NO: 82296 - protein, 17 aa, Mycobacterium avium
LRALAVSDLDPFIELLG

SEQ ID NO: 82297 - protein, 21 aa, Mycobacterium avium
LRALDYPKLVIGISGGLDSTH

SEQ ID NO: 82298 - protein, 17 aa, Mycobacterium avium
LRALHAVAIVNENDTVA

SEQ ID NO: 82299 - protein, 26 aa, Mycobacterium avium
LRANTFHQFRERFAPYGLRPEALTGA

SEQ ID NO: 82300 - protein, 17 aa, Mycobacterium avium
LRAPITDALSRRLGQQI

SEQ ID NO: 82301 - protein, 21 aa, Mycobacterium avium
LRASNRIAIERGTHFKGFERS

SEQ ID NO: 82302 - protein, 17 aa, Mycobacterium avium
LRATGYRALANELAGRP

SEQ ID NO: 82303 - protein, 28 aa, Mycobacterium avium
LRDDPRLRFEMCLGVSGVHYPHETGREL

SEQ ID NO: 82304 - protein, 17 aa, Mycobacterium avium
LRDGHYSGAAALGHAQG

SEQ ID NO: 82305 - protein, 23 aa, Mycobacterium avium
LRDPRFQIPPGINLLAQGIDSGP

SEQ ID NO: 82306 - protein, 18 aa, Mycobacterium avium
LRDSMRMPPQVVGRPADG

SEQ ID NO: 82307 - protein, 29 aa, Mycobacterium avium
LREAHDLCGLPVSVFRCDMILADTSYAGQ

SEQ ID NO: 82308 - protein, 20 aa, Mycobacterium avium
LREATRIAVRALRAGSESSN

SEQ ID NO: 82309 - protein, 19 aa, Mycobacterium avium
LREKWSTRRGAVESQVAQR

SEQ ID NO: 82310 - protein, 19 aa, Mycobacterium avium
LRELARCAGVSHAAPAHHF

SEQ ID NO: 82311 - protein, 18 aa, Mycobacterium avium
LRELERGGLRAAVDAAVQ

SEQ ID NO: 82312 - protein, 24 aa, Mycobacterium avium
LRERADPAVAPWIHRGLTSQDVLD

SEQ ID NO: 82313 - protein, 20 aa, Mycobacterium avium
LRERVRRGSAEVNRDDIVTS

SEQ ID NO: 82314 - protein, 25 aa, Mycobacterium avium
LRESVRLMRELWRGDRVDFDGEYYR

SEQ ID NO: 82315 - protein, 26 aa, Mycobacterium avium
LREYIDWQPFFNAWEMKGRFPDILNN

SEQ ID NO: 82316 - protein, 30 aa, Mycobacterium avium
LRGAFHVLRPAFPVMCRAGYGRIVLTSSIG

SEQ ID NO: 82317 - protein, 25 aa, Mycobacterium avium
LRGNELWQIALLELWLQRHGVTGPV

SEQ ID NO: 82318 - protein, 23 aa, Mycobacterium avium
LRGRVPLVSVVSGRCFAGNAALA

SEQ ID NO: 82319 - protein, 19 aa, Mycobacterium avium
LRGSEFQRRVWRALQTIPY

SEQ ID NO: 82320 - protein, 18 aa, Mycobacterium avium
LRGSRSGIFVGVGANEYS

SEQ ID NO: 82321 - protein, 23 aa, Mycobacterium avium
LRGSRVALRVPRRGDKRALAETV

SEQ ID NO: 82322 - protein, 19 aa, Mycobacterium avium
LRHEIGIDIIAWECDYPHS

SEQ ID NO: 82323 - protein, 20 aa, Mycobacterium avium
LRHRIYRPAVVVGDSRTGEM

SEQ ID NO: 82324 - protein, 20 aa, Mycobacterium avium
LRHRPEPGLVLLADLRRIHR

SEQ ID NO: 82325 - protein, 17 aa, Mycobacterium avium
LRHWVKEVKAAMGALEI

SEQ ID NO: 82326 - protein, 17 aa, Mycobacterium avium
LRIGASLVHLAHASRLW

SEQ ID NO: 82327 - protein, 23 aa, Mycobacterium avium
LRINVNCAGIGNAIKTLSKDGPF

SEQ ID NO: 82328 - protein, 22 aa, Mycobacterium avium
LRKEYPDAVVLPAASELPPPRY

SEQ ID NO: 82329 - protein, 26 aa, Mycobacterium avium
LRKKALEVFPRAKAMLPKAIEAGVRI

SEQ ID NO: 82330 - protein, 27 aa, Mycobacterium avium
LRKLLVQEWVRFGWFFLVTRRDPRGLA

SEQ ID NO: 82331 - protein, 21 aa, Mycobacterium avium
LRLAGELGVVGVLAVELFETT

SEQ ID NO: 82332 - protein, 21 aa, Mycobacterium avium
LRLEAYRRLAAAGSDDEIDAV

SEQ ID NO: 82333 - protein, 21 aa, Mycobacterium avium
LRLFDDLRLLHGRLDQPIPVG

SEQ ID NO: 82334 - protein, 17 aa, Mycobacterium avium
LRLGLRMLAQGTPAWGT

SEQ ID NO: 82335 - protein, 18 aa, Mycobacterium avium
LRLGVIPAASSIVALLTD

SEQ ID NO: 82336 - protein, 17 aa, Mycobacterium avium
LRLHKPVISHDLPAGGR

SEQ ID NO: 82337 - protein, 23 aa, Mycobacterium avium
LRLHPPLIILMRVAKGEFEVEGF

SEQ ID NO: 82338 - protein, 17 aa, Mycobacterium avium
LRLIPSVADGAFETLFS

SEQ ID NO: 82339 - protein, 17 aa, Mycobacterium avium
LRLLCRAAGITEVSAPS

SEQ ID NO: 82340 - protein, 17 aa, Mycobacterium avium
LRLLGALPTLYDSRTTH

SEQ ID NO: 82341 - protein, 20 aa, Mycobacterium avium
LRLLGSAALARAARGEDDVA

SEQ ID NO: 82342 - protein, 18 aa, Mycobacterium avium
LRLLHPVIPFITEALWQA

SEQ ID NO: 82343 - protein, 19 aa, Mycobacterium avium
LRLLPALDGLWFGLTPVSL

SEQ ID NO: 82344 - protein, 17 aa, Mycobacterium avium
LRLPAQRLRAANVAALR

SEQ ID NO: 82345 - protein, 20 aa, Mycobacterium avium
LRLPRDAELIVDGRNVVADV

SEQ ID NO: 82346 - protein, 22 aa, Mycobacterium avium
LRLRGLSAMLARIKRRLRESPG

SEQ ID NO: 82347 - protein, 22 aa, Mycobacterium avium
LRLRMADLQARVDLLQHGLNGI

SEQ ID NO: 82348 - protein, 21 aa, Mycobacterium avium
LRLVAGLDRPSGGRIEIDGKA

SEQ ID NO: 82349 - protein, 19 aa, Mycobacterium avium
LRMAPGLAAVHVHPVTCSL

SEQ ID NO: 82350 - protein, 20 aa, Mycobacterium avium
LRNAKRPVVLAGHGAARADA

SEQ ID NO: 82351 - protein, 17 aa, Mycobacterium avium
LRNARPVLLNFAGAGRR

SEQ ID NO: 82352 - protein, 23 aa, Mycobacterium avium
LRNHARLMRKTFMGNPILCDLIL

SEQ ID NO: 82353 - protein, 20 aa, Mycobacterium avium
LRPELGCILQPLGGEYAATR

SEQ ID NO: 82354 - protein, 36 aa, Mycobacterium avium
LRPEVSGALGPLGLTLPEFVCLRILSMFPGMSSAEL

SEQ ID NO: 82355 - protein, 18 aa, Mycobacterium avium
LRPGTPMRDIAVDAVFVG

SEQ ID NO: 82356 - protein, 18 aa, Mycobacterium avium
LRPPKGVLLYGPPGCGKT

SEQ ID NO: 82357 - protein, 17 aa, Mycobacterium avium
LRPSRGTHLVFDAAAFG

SEQ ID NO: 82358 - protein, 19 aa, Mycobacterium avium
LRQMKSLLSEGLRTGEIAI

SEQ ID NO: 82359 - protein, 26 aa, Mycobacterium avium
LRQPRPVTFSALTGWEAPDPAWWTAQ

SEQ ID NO: 82360 - protein, 21 aa, Mycobacterium avium
LRRAFAADMAFLRNCGIHPVV

SEQ ID NO: 82361 - protein, 18 aa, Mycobacterium avium
LRRARELQNMSAYDFFVG

SEQ ID NO: 82362 - protein, 20 aa, Mycobacterium avium
LRREELLGGKGANQAVGLAQ

SEQ ID NO: 82363 - protein, 20 aa, Mycobacterium avium
LRRELLRDGQAFYVHNRVSS

SEQ ID NO: 82364 - protein, 29 aa, Mycobacterium avium
LRRELSALVARSPFGQGAAWPVVETVQRD

SEQ ID NO: 82365 - protein, 17 aa, Mycobacterium avium
LRRHYRFGADVVDAAFE

SEQ ID NO: 82366 - protein, 18 aa, Mycobacterium avium
LRRLPLVMRPLGWLPQPD

SEQ ID NO: 82367 - protein, 23 aa, Mycobacterium avium
LRRRAELAAHWLSHGQWTDGWDP

SEQ ID NO: 82368 - protein, 22 aa, Mycobacterium avium
LRRRSAQALRNWVSREQRALAQ

SEQ ID NO: 82369 - protein, 19 aa, Mycobacterium avium
LRRRTLVTAAQYLALGIDP

SEQ ID NO: 82370 - protein, 19 aa, Mycobacterium avium
LRRVLKAAMELTGARYAVL

SEQ ID NO: 82371 - protein, 18 aa, Mycobacterium avium
LRRVWEMVSLNVLGGPAA

SEQ ID NO: 82372 - protein, 20 aa, Mycobacterium avium
LRSACRRKGIRIVAEAAIAQ

SEQ ID NO: 82373 - protein, 20 aa, Mycobacterium avium
LRSALTWLCNAQSRIANSPS

SEQ ID NO: 82374 - protein, 19 aa, Mycobacterium avium
LRSELSGYGYRFFSHSDTE

SEQ ID NO: 82375 - protein, 18 aa, Mycobacterium avium
LRSGGSIISVVPENPPAG

SEQ ID NO: 82376 - protein, 18 aa, Mycobacterium avium
LRTADRSAGVPVLRNGRR

SEQ ID NO: 82377 - protein, 18 aa, Mycobacterium avium
LRTATLRMLLAAIQTEEV

SEQ ID NO: 82378 - protein, 24 aa, Mycobacterium avium
LRTDSRWPKYQADALARTPIRSIL

SEQ ID NO: 82379 - protein, 24 aa, Mycobacterium avium
LRTGEAPEQFAWSLVVTASDLSRR

SEQ ID NO: 82380 - protein, 17 aa, Mycobacterium avium
LRTLFSHNPTVYKARVL

SEQ ID NO: 82381 - protein, 18 aa, Mycobacterium avium
LRTLVPLDVDTVVASVRR

SEQ ID NO: 82382 - protein, 26 aa, Mycobacterium avium
LRTLYRDRLLVLAALDLAATVEDEPV

SEQ ID NO: 82383 - protein, 29 aa, Mycobacterium avium
LRTRFGEAFWLPDRGWYAVALDGRKDRVD

SEQ ID NO: 82384 - protein, 25 aa, Mycobacterium avium
LRTRKAGAVGLVMAEPLTYFFSDPA

SEQ ID NO: 82385 - protein, 27 aa, Mycobacterium avium
LRTVAELHTRLTLSFIVTPHTSINLAT

SEQ ID NO: 82386 - protein, 17 aa, Mycobacterium avium
LRTVRCVSGTVELMMSC

SEQ ID NO: 82387 - protein, 17 aa, Mycobacterium avium
LRVAVLAGDQRTVDRVH

SEQ ID NO: 82388 - protein, 28 aa, Mycobacterium avium
LRVEWWQSCRLPVNWKLATAAFMEGYHV

SEQ ID NO: 82389 - protein, 24 aa, Mycobacterium avium
LRVLALHRFAKTPMLIGGQMLNLQ

SEQ ID NO: 82390 - protein, 18 aa, Mycobacterium avium
LRVQMRGEIARLQKRLGT

SEQ ID NO: 82391 - protein, 19 aa, Mycobacterium avium
LRVRLPLPKLTVAVENPQH

SEQ ID NO: 82392 - protein, 17 aa, Mycobacterium avium
LRVRPRRAATAAHYENR

SEQ ID NO: 82393 - protein, 19 aa, Mycobacterium avium
LRYDEVLTRVARDGDLLAE

SEQ ID NO: 82394 - protein, 22 aa, Mycobacterium avium
LRYDLSAGFPLITTKKVHLKSV

SEQ ID NO: 82395 - protein, 20 aa, Mycobacterium avium
LSACPEALTADGNRRALVEA

SEQ ID NO: 82396 - protein, 18 aa, Mycobacterium avium
LSAFGTHLIAYDPYVSPA

SEQ ID NO: 82397 - protein, 23 aa, Mycobacterium avium
LSAGHARALLSLEAGPEAQEELA

SEQ ID NO: 82398 - protein, 29 aa, Mycobacterium avium
LSAGLRARSAWLWSRRRGVVAGRSAAALY

SEQ ID NO: 82399 - protein, 24 aa, Mycobacterium avium
LSAGRMHGYWALHEGCLQLRGDAG

SEQ ID NO: 82400 - protein, 19 aa, Mycobacterium avium
LSASFLRRAFELGATASML

SEQ ID NO: 82401 - protein, 19 aa, Mycobacterium avium
LSASPGFRRAQLPPLTAPL

SEQ ID NO: 82402 - protein, 24 aa, Mycobacterium avium
LSAVEFLGSVGLKILAATYEKLGK

SEQ ID NO: 82403 - protein, 26 aa, Mycobacterium avium
LSDAAAWPRWATVITKVTWTSPEPRG

SEQ ID NO: 82404 - protein, 25 aa, Mycobacterium avium
LSDAELDGGPSWHEGPAAGMWNGAP

SEQ ID NO: 82405 - protein, 17 aa, Mycobacterium avium
LSDDCLYVDMPVPALSA

SEQ ID NO: 82406 - protein, 21 aa, Mycobacterium avium
LSDDEFGFFVVMLAVAGNETT

SEQ ID NO: 82407 - protein, 28 aa, Mycobacterium avium
LSDGDALFFGHGLNIHFGLIKPPAEVTV

SEQ ID NO: 82408 - protein, 18 aa, Mycobacterium avium
LSDRFGELKAAEIADLLE

SEQ ID NO: 82409 - protein, 24 aa, Mycobacterium avium
LSEAARQGFSIALIPDGDDPRREI

SEQ ID NO: 82410 - protein, 24 aa, Mycobacterium avium
LSEALKRRCLFLHIDFPSPDLERR

SEQ ID NO: 82411 - protein, 22 aa, Mycobacterium avium
LSEDDWDGWAALTASIGDRVQL

SEQ ID NO: 82412 - protein, 19 aa, Mycobacterium avium
LSEHLCQGWLEGYLLTGRH

SEQ ID NO: 82413 - protein, 17 aa, Mycobacterium avium
LSEKGIRLLDCGTSGGV

SEQ ID NO: 82414 - protein, 19 aa, Mycobacterium avium
LSELLAWPTDHLTEAADHW

SEQ ID NO: 82415 - protein, 21 aa, Mycobacterium avium
LSEQIMPGFLAFHPMGALVGQ

SEQ ID NO: 82416 - protein, 17 aa, Mycobacterium avium
LSESAWKQYPQYADVAI

SEQ ID NO: 82417 - protein, 22 aa, Mycobacterium avium
LSEYTSAVAMCRCDDKRLTRRL

SEQ ID NO: 82418 - protein, 27 aa, Mycobacterium avium
LSFADARGIPFSGQWDGLNAGIYGDGR

SEQ ID NO: 82419 - protein, 20 aa, Mycobacterium avium
LSFTLPRNGIVGVIGPNGVG

SEQ ID NO: 82420 - protein, 17 aa, Mycobacterium avium
LSGGLINLGESPRAARY

SEQ ID NO: 82421 - protein, 33 aa, Mycobacterium avium
LSGGRFTLAVGVGYLKREFAALGVSYDERAELF

SEQ ID NO: 82422 - protein, 18 aa, Mycobacterium avium
LSGGRFTLGVGRGIAAIY

SEQ ID NO: 82423 - protein, 25 aa, Mycobacterium avium
LSGGRVSLGVGFGWNTDELADHGVP

SEQ ID NO: 82424 - protein, 19 aa, Mycobacterium avium
LSGLGREGGGIGGLHQYME

SEQ ID NO: 82425 - protein, 20 aa, Mycobacterium avium
LSGPIGGLVARVLRSDVHKS

SEQ ID NO: 82426 - protein, 21 aa, Mycobacterium avium
LSGSGPAYFFLLVEALVDAGV

SEQ ID NO: 82427 - protein, 23 aa, Mycobacterium avium
LSHVLTPFLPDWVAEPEDIADTV

SEQ ID NO: 82428 - protein, 23 aa, Mycobacterium avium
LSINAEFARPLSPERARELLDGA

SEQ ID NO: 82429 - protein, 22 aa, Mycobacterium avium
LSKAQILDRVWSYDFGGRSNIV

SEQ ID NO: 82430 - protein, 21 aa, Mycobacterium avium
LSKARFTGTITVKYLRGTPLG

SEQ ID NO: 82431 - protein, 24 aa, Mycobacterium avium
LSKTYRLTKGVLRRSAGEVRAVDR

SEQ ID NO: 82432 - protein, 17 aa, Mycobacterium avium
LSLDVCTGGELAVALHA

SEQ ID NO: 82433 - protein, 20 aa, Mycobacterium avium
LSLFFVPKFLFDFETGELGE

SEQ ID NO: 82434 - protein, 18 aa, Mycobacterium avium
LSLLLLRVQAVRSAWGPP

SEQ ID NO: 82435 - protein, 27 aa, Mycobacterium avium
LSLMVKAGVQWGLFGGAVENLGTERHH

SEQ ID NO: 82436 - protein, 21 aa, Mycobacterium avium
LSLPGPRAAAYRQLDLWLDGY

SEQ ID NO: 82437 - protein, 18 aa, Mycobacterium avium
LSNLRLGATTVQLEAEGE

SEQ ID NO: 82438 - protein, 32 aa, Mycobacterium avium
LSPERVELRYTMPLGEIIFDFFDSLKSRTRGY

SEQ ID NO: 82439 - protein, 39 aa, Mycobacterium avium
LSPRVRVNAIAPGVVRTRLAEALWKDHEDPLSSSIALGR

SEQ ID NO: 82440 - protein, 17 aa, Mycobacterium avium
LSPSFNWDTTGMTDEQM

SEQ ID NO: 82441 - protein, 22 aa, Mycobacterium avium
LSQARFEFRWNDQFALSLDPDT

SEQ ID NO: 82442 - protein, 26 aa, Mycobacterium avium
LSRKAPRLVRWLLRRKAINSLPPGYA

SEQ ID NO: 82443 - protein, 19 aa, Mycobacterium avium
LSSALWLKYNLLAERHTRG

SEQ ID NO: 82444 - protein, 23 aa, Mycobacterium avium
LSSLALAAVPGWVSATSPPFNIV

SEQ ID NO: 82445 - protein, 35 aa, Mycobacterium avium
LSTAERWQLLAGSWLDLPGRPALIGGRGPDGKPYG

SEQ ID NO: 82446 - protein, 20 aa, Mycobacterium avium
LSTEISRAAGKLATSSTSET

SEQ ID NO: 82447 - protein, 20 aa, Mycobacterium avium
LSTLTWRIATNVTKLPGLGS

SEQ ID NO: 82448 - protein, 17 aa, Mycobacterium avium
LSTPPGFEAVGQVYGDF

SEQ ID NO: 82449 - protein, 17 aa, Mycobacterium avium
LSTYKMVFGHRGINIPV

SEQ ID NO: 82450 - protein, 17 aa, Mycobacterium avium
LSVGIGVGGRQEDYHAV

SEQ ID NO: 82451 - protein, 18 aa, Mycobacterium avium
LSVLAQRIAEDFTALGKE

SEQ ID NO: 82452 - protein, 22 aa, Mycobacterium avium
LSVLRPGLVVLVAFDPAAREEL

SEQ ID NO: 82453 - protein, 17 aa, Mycobacterium avium
LSVPASWASAAPTPPSV

SEQ ID NO: 82454 - protein, 18 aa, Mycobacterium avium
LSVPPTWGATGAAITPLA

SEQ ID NO: 82455 - protein, 23 aa, Mycobacterium avium
LSVPTRQGRWWYYARTYEGKQYR

SEQ ID NO: 82456 - protein, 19 aa, Mycobacterium avium
LSVSLKFQGFEVHTATNGA

SEQ ID NO: 82457 - protein, 24 aa, Mycobacterium avium
LSVVRRLAHRVVVLRAGRVVETGD

SEQ ID NO: 82458 - protein, 20 aa, Mycobacterium avium
LSWNALKGIVEVGGSLEKFR

SEQ ID NO: 82459 - protein, 18 aa, Mycobacterium avium
LTADMVRPGAAVLDVGVS

SEQ ID NO: 82460 - protein, 18 aa, Mycobacterium avium
LTAFMIEHGLAVNALNQI

SEQ ID NO: 82461 - protein, 23 aa, Mycobacterium avium
LTAGPKEARAWVIHQGDTAPKAA

SEQ ID NO: 82462 - protein, 24 aa, Mycobacterium avium
LTAKLRAYWARRLPATIVGRTGEQ

SEQ ID NO: 82463 - protein, 22 aa, Mycobacterium avium
LTALLPDDGWFAGHRLARDFSV

SEQ ID NO: 82464 - protein, 19 aa, Mycobacterium avium
LTAPDGVEVHWVYRGGRAD

SEQ ID NO: 82465 - protein, 24 aa, Mycobacterium avium
LTATDIRGAYLLNGTKVWCPGAGF

SEQ ID NO: 82466 - protein, 28 aa, Mycobacterium avium
LTATLLTARCPVLFAPAMHTEMWLHPAT

SEQ ID NO: 82467 - protein, 19 aa, Mycobacterium avium
LTDEAKMAPDLRGRISMAS

SEQ ID NO: 82468 - protein, 24 aa, Mycobacterium avium
LTDERIAYADGWFAETHDNSASIT

SEQ ID NO: 82469 - protein, 20 aa, Mycobacterium avium
LTDHSPRLTIANGLSPERLR

SEQ ID NO: 82470 - protein, 24 aa, Mycobacterium avium
LTDKAKALLAKRGFDPVLGARPLR

SEQ ID NO: 82471 - protein, 22 aa, Mycobacterium avium
LTDSPACLITDAFGITPALARL

SEQ ID NO: 82472 - protein, 17 aa, Mycobacterium avium
LTEEGHVVVCGRVKDVI

SEQ ID NO: 82473 - protein, 21 aa, Mycobacterium avium
LTFDAPRRLGMLHGDAHPGNF

SEQ ID NO: 82474 - protein, 17 aa, Mycobacterium avium
LTFDDLEWIKARWPGKL

SEQ ID NO: 82475 - protein, 29 aa, Mycobacterium avium
LTFQQVVERIRCAAGAFAELGVEKGDRVA

SEQ ID NO: 82476 - protein, 18 aa, Mycobacterium avium
LTGALTYYGLTPRDTRRT

SEQ ID NO: 82477 - protein, 20 aa, Mycobacterium avium
LTGHGGWPMTCFLTPDGRPF

SEQ ID NO: 82478 - protein, 18 aa, Mycobacterium avium
LTGPWRDNPAFAYVIESA

SEQ ID NO: 82479 - protein, 25 aa, Mycobacterium avium
LTGQPAAVVPWDFDADGLPMSVQLV

SEQ ID NO: 82480 - protein, 19 aa, Mycobacterium avium
LTGRGWRVSARPRRDLFDD

SEQ ID NO: 82481 - protein, 37 aa, Mycobacterium avium
LTGSMAAAWGRKGIRVNCIACGAIRTDGLLADAAKGG

SEQ ID NO: 82482 - protein, 18 aa, Mycobacterium avium
LTIANGLSPERLRKQLDV

SEQ ID NO: 82483 - protein, 17 aa, Mycobacterium avium
LTLELGGKSPLIMFDDA

SEQ ID NO: 82484 - protein, 18 aa, Mycobacterium avium
LTLVPALRDALKEVGRPD

SEQ ID NO: 82485 - protein, 20 aa, Mycobacterium avium
LTMRGLKTLVLRMQRHTENA

SEQ ID NO: 82486 - protein, 18 aa, Mycobacterium avium
LTPALGIGAFADKTLVAA

SEQ ID NO: 82487 - protein, 17 aa, Mycobacterium avium
LTPDRYVHELLVENLHV

SEQ ID NO: 82488 - protein, 28 aa, Mycobacterium avium
LTPLEFDLLVALARKPRQVFTRDVLLEQ

SEQ ID NO: 82489 - protein, 25 aa, Mycobacterium avium
LTPWNFPHCLNVMKLNHALAAGNTV

SEQ ID NO: 82490 - protein, 18 aa, Mycobacterium avium
LTQILAWDLPLTKKVSDH

SEQ ID NO: 82491 - protein, 25 aa, Mycobacterium avium
LTQKMVWDRVCTALTPGNVVLADQG

SEQ ID NO: 82492 - protein, 20 aa, Mycobacterium avium
LTSFAQRSPFAEAFRSAGQG

SEQ ID NO: 82493 - protein, 26 aa, Mycobacterium avium
LTSLRESRRLVREWLTTWSQSKLIPV

SEQ ID NO: 82494 - protein, 19 aa, Mycobacterium avium
LTTFTLWGSGVVDLRYADF

SEQ ID NO: 82495 - protein, 18 aa, Mycobacterium avium
LTTRVIDLIMPIGKGQRA

SEQ ID NO: 82496 - protein, 18 aa, Mycobacterium avium
LTVKVEVSAHKFSGSARE

SEQ ID NO: 82497 - protein, 17 aa, Mycobacterium avium
LTVQIGVADMFTLDVID

SEQ ID NO: 82498 - protein, 19 aa, Mycobacterium avium
LTVYFALTVRGRLQRGETV

SEQ ID NO: 82499 - protein, 19 aa, Mycobacterium avium
LVAAAGLAFQGWLRNSPYY

SEQ ID NO: 82500 - protein, 26 aa, Mycobacterium avium
LVAAARGYRCVLTMPETMSVERRMLL

SEQ ID NO: 82501 - protein, 30 aa, Mycobacterium avium
LVAADGGPLTWPLHISLLLAKEYALTGTRI

SEQ ID NO: 82502 - protein, 17 aa, Mycobacterium avium
LVAAGANPIELGAGISK

SEQ ID NO: 82503 - protein, 18 aa, Mycobacterium avium
LVAAGARPASSPKEVADG

SEQ ID NO: 82504 - protein, 31 aa, Mycobacterium avium
LVACFPGPAPAGWRIIGRVLDGPARVLVDER

SEQ ID NO: 82505 - protein, 23 aa, Mycobacterium avium
LVAGLRLRLPIVATALGTYDTAS

SEQ ID NO: 82506 - protein, 24 aa, Mycobacterium avium
LVARAVDLVQLFPAAAYGKNGADI

SEQ ID NO: 82507 - protein, 18 aa, Mycobacterium avium
LVASFAIDELLDYRSRRP

SEQ ID NO: 82508 - protein, 26 aa, Mycobacterium avium
LVASGLRSLPWEGLNLSHGEPAIPTT

SEQ ID NO: 82509 - protein, 22 aa, Mycobacterium avium
LVATEVGMLYQLRRAAPQVDFQ

SEQ ID NO: 82510 - protein, 18 aa, Mycobacterium avium
LVATNFFGVNTIPIAVNE

SEQ ID NO: 82511 - protein, 17 aa, Mycobacterium avium
LVDACRLSRARVVVTPH

SEQ ID NO: 82512 - protein, 19 aa, Mycobacterium avium
LVDDFGINTDNMFGFWDWV

SEQ ID NO: 82513 - protein, 22 aa, Mycobacterium avium
LVDVRFPVQYVIRPHTHEHQDH

SEQ ID NO: 82514 - protein, 24 aa, Mycobacterium avium
LVECSEFFKDTTFRVFQAPYVGAV

SEQ ID NO: 82515 - protein, 22 aa, Mycobacterium avium
LVEMRRVRDLQPYIGKEIEAKI

SEQ ID NO: 82516 - protein, 25 aa, Mycobacterium avium
LVFAHGVAVAARLAERAVAYRDLVM

SEQ ID NO: 82517 - protein, 17 aa, Mycobacterium avium
LVFDTVITRTVRFPETS

SEQ ID NO: 82518 - protein, 20 aa, Mycobacterium avium
LVFPVKRLADLGFRVLATEG

SEQ ID NO: 82519 - protein, 22 aa, Mycobacterium avium
LVFYHGGGWSIGDLDTHDSLCR

SEQ ID NO: 82520 - protein, 17 aa, Mycobacterium avium
LVGCYAWSAEKVGRDAG

SEQ ID NO: 82521 - protein, 19 aa, Mycobacterium avium
LVGDAARFLLEGMPVQVAF

SEQ ID NO: 82522 - protein, 18 aa, Mycobacterium avium
LVGISTRLLAGARQVRAR

SEQ ID NO: 82523 - protein, 22 aa, Mycobacterium avium
LVHGLPLFHVHGLVLGLLGSLR

SEQ ID NO: 82524 - protein, 20 aa, Mycobacterium avium
LVKGGLRLVAAGANPIELGA

SEQ ID NO: 82525 - protein, 20 aa, Mycobacterium avium
LVKHVEKWARVRGDKLAYRF

SEQ ID NO: 82526 - protein, 20 aa, Mycobacterium avium
LVKLRPYFDHPLFVEMFAGA

SEQ ID NO: 82527 - protein, 24 aa, Mycobacterium avium
LVLANWKLGIVLEKTYAAGVRGGS

SEQ ID NO: 82528 - protein, 18 aa, Mycobacterium avium
LVLGAWRILGAVQQSLRI

SEQ ID NO: 82529 - protein, 17 aa, Mycobacterium avium
LVLGGSGPRMMELVRTH

SEQ ID NO: 82530 - protein, 17 aa, Mycobacterium avium
LVMPMWERLEAAWGPAR

SEQ ID NO: 82531 - protein, 18 aa, Mycobacterium avium
LVNLKVTLLDGAFHEVDS

SEQ ID NO: 82532 - protein, 21 aa, Mycobacterium avium
LVPQHLMRRLFFTAATVDAAT

SEQ ID NO: 82533 - protein, 24 aa, Mycobacterium avium
LVPRAERIRMIGAATLDLAFVAEG

SEQ ID NO: 82534 - protein, 17 aa, Mycobacterium avium
LVQSAVMAARWNRVLGA

SEQ ID NO: 82535 - protein, 17 aa, Mycobacterium avium
LVQYAAWHLDRDHHMEV

SEQ ID NO: 82536 - protein, 24 aa, Mycobacterium avium
LVRAVGVDFFTRWVTGDLVAADVD

SEQ ID NO: 82537 - protein, 20 aa, Mycobacterium avium
LVRHPGVGKVHFTGGHATAQ

SEQ ID NO: 82538 - protein, 24 aa, Mycobacterium avium
LVRLKAWRLDVAKEQKVPAYVVFT

SEQ ID NO: 82539 - protein, 24 aa, Mycobacterium avium
LVRPEVMAGTGFLGAHAEEVYRIE

SEQ ID NO: 82540 - protein, 25 aa, Mycobacterium avium
LVSARGIEVAHIFQLGRKYTDAFTA

SEQ ID NO: 82541 - protein, 19 aa, Mycobacterium avium
LVSDIDWRASVSTLSGGQR

SEQ ID NO: 82542 - protein, 17 aa, Mycobacterium avium
LVSEAGITVPRARLATF

SEQ ID NO: 82543 - protein, 18 aa, Mycobacterium avium
LVSHALRLRSAALLGAAQ

SEQ ID NO: 82544 - protein, 17 aa, Mycobacterium avium
LVSKGFTPRRIRELEPR

SEQ ID NO: 82545 - protein, 18 aa, Mycobacterium avium
LVVGCGESGILAGVRLKQ

SEQ ID NO: 82546 - protein, 17 aa, Mycobacterium avium
LVVIVDVPGYLPGVDQE

SEQ ID NO: 82547 - protein, 18 aa, Mycobacterium avium
LVVRLRAPLRGVAPGQTL

SEQ ID NO: 82548 - protein, 25 aa, Mycobacterium avium
LVWNTLLALLFEWGVGLQHVEIGKI

SEQ ID NO: 82549 - protein, 31 aa, Mycobacterium avium
LVYDARTAAFVFRPGPVFTNLLLADEINRTP

SEQ ID NO: 82550 - protein, 17 aa, Mycobacterium avium
LVYYYFPTMDDLFVEVL

SEQ ID NO: 82551 - protein, 20 aa, Mycobacterium avium
LWKKVAPKLSAGRVQSVATR

SEQ ID NO: 82552 - protein, 17 aa, Mycobacterium avium
LWLRSESNISVIEHGSE

SEQ ID NO: 82553 - protein, 25 aa, Mycobacterium avium
LWPHPPEALGPRYVAAMGGIDRVVD

SEQ ID NO: 82554 - protein, 19 aa, Mycobacterium avium
LWPVGTRWADNDMFGHLNN

SEQ ID NO: 82555 - protein, 21 aa, Mycobacterium avium
LWQRCGSDPVALLGAVKPARL

SEQ ID NO: 82556 - protein, 18 aa, Mycobacterium avium
LWQTALIRLSRLQITDEI

SEQ ID NO: 82557 - protein, 19 aa, Mycobacterium avium
LYCRNRNEIVIAMLGIVKA

SEQ ID NO: 82558 - protein, 17 aa, Mycobacterium avium
LYDAGLSVITWPKKYGG

SEQ ID NO: 82559 - protein, 23 aa, Mycobacterium avium
LYDDLKPLLTFIVAGGLATTVKA

SEQ ID NO: 82560 - protein, 24 aa, Mycobacterium avium
LYHPDHPEWGFAGYVRHFIDKPTI

SEQ ID NO: 82561 - protein, 17 aa, Mycobacterium avium
LYHPMPLRGKALDRYYG

SEQ ID NO: 82562 - protein, 18 aa, Mycobacterium avium
LYILGAGMHPWGKWGNDF

SEQ ID NO: 82563 - protein, 25 aa, Mycobacterium avium
LYLMPWSTMFPLGISAATIGIAEGA

SEQ ID NO: 82564 - protein, 25 aa, Mycobacterium avium
LYPRKGVSELTRFTPEAVVEKYGLT

SEQ ID NO: 82565 - protein, 24 aa, Mycobacterium avium
LYPRLLPIARDWWGKLGRDPVWPD

SEQ ID NO: 82566 - protein, 18 aa, Mycobacterium avium
LYREAPLMGIWEGSGNVS

SEQ ID NO: 82567 - protein, 23 aa, Mycobacterium avium
LYRTATDEFLRYFSVNQTLSRTV

SEQ ID NO: 82568 - protein, 17 aa, Mycobacterium avium
LYRTRLWLRSESNISVI

SEQ ID NO: 82569 - protein, 25 aa, Mycobacterium avium
LYSYSFDLNAHWSRLWSGQPEILDY

SEQ ID NO: 82570 - protein, 24 aa, Mycobacterium avium
LYVPWSERTGKRWLGSFTTTFRYN

SEQ ID NO: 82571 - protein, 20 aa, Mycobacterium avium
LYVTCEVVRIAALLVQPVMP

SEQ ID NO: 82572 - protein, 20 aa, Mycobacterium avium
MAAAAAPYVAWLQATGAQAE

SEQ ID NO: 82573 - protein, 23 aa, Mycobacterium avium
MAAAVEPYVAWATGTAARAGQAA

SEQ ID NO: 82574 - protein, 20 aa, Mycobacterium avium
MAADMAVDFRGTGVATVSIW

SEQ ID NO: 82575 - protein, 18 aa, Mycobacterium avium
MAADSGVRLEVLKVDGGI

SEQ ID NO: 82576 - protein, 17 aa, Mycobacterium avium
MAAGGQAVFELAPQGAA

SEQ ID NO: 82577 - protein, 19 aa, Mycobacterium avium
MAAKSDWAAMPFDERAAVF

SEQ ID NO: 82578 - protein, 20 aa, Mycobacterium avium
MAALVLRAGAQLSPEEFGRF

SEQ ID NO: 82579 - protein, 23 aa, Mycobacterium avium
MADAGWAAVSWPREYGGRGATVL

SEQ ID NO: 82580 - protein, 18 aa, Mycobacterium avium
MADPRWLDPTVDPNERTP

SEQ ID NO: 82581 - protein, 18 aa, Mycobacterium avium
MADSLHFDLNVVVEGDDG

SEQ ID NO: 82582 - protein, 19 aa, Mycobacterium avium
MAECGFCADGEQEKLLADG

SEQ ID NO: 82583 - protein, 20 aa, Mycobacterium avium
MAETVARRGGLVILPQDLPI

SEQ ID NO: 82584 - protein, 20 aa, Mycobacterium avium
MAGAAAPYFAWLAEAGTQAE

SEQ ID NO: 82585 - protein, 23 aa, Mycobacterium avium
MAGFPVTVKGLSRFTDAAESRAV

SEQ ID NO: 82586 - protein, 18 aa, Mycobacterium avium
MAGNFSFGDYFKREAIEL

SEQ ID NO: 82587 - protein, 19 aa, Mycobacterium avium
MAIMCGASLIFQYDVTADD

SEQ ID NO: 82588 - protein, 23 aa, Mycobacterium avium
MALLQRVQRAIGLVRVDDPDAAV

SEQ ID NO: 82589 - protein, 17 aa, Mycobacterium avium
MAMWPGAAVSGWYFSHP

SEQ ID NO: 82590 - protein, 18 aa, Mycobacterium avium
MAPLFPLVVIVYADVEVR

SEQ ID NO: 82591 - protein, 23 aa, Mycobacterium avium
MAQAFPASRFTGIDFSEHAIAAG

SEQ ID NO: 82592 - protein, 19 aa, Mycobacterium avium
MARGTAWLDTGTFDSLLDA

SEQ ID NO: 82593 - protein, 17 aa, Mycobacterium avium
MARRPFSPSSRGWQKTT

SEQ ID NO: 82594 - protein, 25 aa, Mycobacterium avium
MARVFPNLFATHRVRAVDDYAAHLL

SEQ ID NO: 82595 - protein, 18 aa, Mycobacterium avium
MASLKPAFKEDGVIHAGN

SEQ ID NO: 82596 - protein, 18 aa, Mycobacterium avium
MCAEIRRVAAKGCRAVTM

SEQ ID NO: 82597 - protein, 17 aa, Mycobacterium avium
MCDVRFAAAGAKFATAF

SEQ ID NO: 82598 - protein, 26 aa, Mycobacterium avium
MCPICRKEQLTLVSWVFGEHLGPVSG

SEQ ID NO: 82599 - protein, 29 aa, Mycobacterium avium
MCTIGDPLLDLGWLLATWRQPDGSAVFSH

SEQ ID NO: 82600 - protein, 19 aa, Mycobacterium avium
MDAAWALYEAYIKLLTGEV

SEQ ID NO: 82601 - protein, 24 aa, Mycobacterium avium
MDEFKAIIRWIQTRGHYSALNVFK

SEQ ID NO: 82602 - protein, 23 aa, Mycobacterium avium
MDEGLRFAIREGGRTVGAGRVVK

SEQ ID NO: 82603 - protein, 21 aa, Mycobacterium avium
MDIDTIYVWTHDSIGLGEDGP

SEQ ID NO: 82604 - protein, 27 aa, Mycobacterium avium
MDPQQRMFLELSWEALERAGIDPVKLR

SEQ ID NO: 82605 - protein, 18 aa, Mycobacterium avium
MDQLGARLFAIWESTPYN

SEQ ID NO: 82606 - protein, 26 aa, Mycobacterium avium
MDSRLWRLLLAPGRGIGRLVTGAMGL

SEQ ID NO: 82607 - protein, 17 aa, Mycobacterium avium
MDTRYLREHSAKKMSHL

SEQ ID NO: 82608 - protein, 17 aa, Mycobacterium avium
MDVRFLPNPHWVDELRP

SEQ ID NO: 82609 - protein, 17 aa, Mycobacterium avium
MEEAGLKAETWAVLVDL

SEQ ID NO: 82610 - protein, 19 aa, Mycobacterium avium
MELQIVLPTLLRRVPTLRL

SEQ ID NO: 82611 - protein, 17 aa, Mycobacterium avium
MERLAPLGPVYQAGTLS

SEQ ID NO: 82612 - protein, 18 aa, Mycobacterium avium
MESPMLWDPIRYDETCPS

SEQ ID NO: 82613 - protein, 19 aa, Mycobacterium avium
MEVVGRFLALLELYRSRAV

SEQ ID NO: 82614 - protein, 17 aa, Mycobacterium avium
MEYMLPRLRGWGESMSR

SEQ ID NO: 82615 - protein, 23 aa, Mycobacterium avium
MFAAAGRYVLDRAIFDALRRIDR

SEQ ID NO: 82616 - protein, 22 aa, Mycobacterium avium
MFLHHVPGFSFLPNRRPPEPNQ

SEQ ID NO: 82617 - protein, 19 aa, Mycobacterium avium
MGAAALHFGNVAEMKTGEG

SEQ ID NO: 82618 - protein, 19 aa, Mycobacterium avium
MGAAARYLGVPGEQDLLGR

SEQ ID NO: 82619 - protein, 20 aa, Mycobacterium avium
MGADGLRAASLTAITSANYI

SEQ ID NO: 82620 - protein, 24 aa, Mycobacterium avium
MGAEHARLLAAEGAKVVIGDILDD

SEQ ID NO: 82621 - protein, 29 aa, Mycobacterium avium
MGAGLELWGMRCDGTVFPVDVSLSPLQTE

SEQ ID NO: 82622 - protein, 26 aa, Mycobacterium avium
MGAPMATRMTEWPGGVTVYDIRIEAM

SEQ ID NO: 82623 - protein, 27 aa, Mycobacterium avium
MGAYAPVPWLPDRVYRDIVHRIVEPVA

SEQ ID NO: 82624 - protein, 17 aa, Mycobacterium avium
MGDRAGGELAWELTATR

SEQ ID NO: 82625 - protein, 17 aa, Mycobacterium avium
MGDSHVGLQARLMSQAL

SEQ ID NO: 82626 - protein, 35 aa, Mycobacterium avium
MGHIELAAPVTHIWYFKGVPSRLGYLLDLAPKDLE

SEQ ID NO: 82627 - protein, 18 aa, Mycobacterium avium
MGIPANFAAPAANFMADH

SEQ ID NO: 82628 - protein, 17 aa, Mycobacterium avium
MGLCSEVRRVRASELLD

SEQ ID NO: 82629 - protein, 24 aa, Mycobacterium avium
MGPEGRAAIGLGDGVVRISVGLEG

SEQ ID NO: 82630 - protein, 25 aa, Mycobacterium avium
MGRASAELFAARGADVAILDRESSD

SEQ ID NO: 82631 - protein, 19 aa, Mycobacterium avium
MGRATSGVQGMRFNADDYL

SEQ ID NO: 82632 - protein, 26 aa, Mycobacterium avium
MGRIDPRTRWLLRELVYALLVKKDHA

SEQ ID NO: 82633 - protein, 19 aa, Mycobacterium avium
MGVSGCARECAEARSKDVG

SEQ ID NO: 82634 - protein, 18 aa, Mycobacterium avium
MGYRVPKTSFAFQKFSDA

SEQ ID NO: 82635 - protein, 22 aa, Mycobacterium avium
MHKLTAPTLLTWGRDDRVSPPD

SEQ ID NO: 82636 - protein, 20 aa, Mycobacterium avium
MHRRIPGSRFELFESSAHMP

SEQ ID NO: 82637 - protein, 18 aa, Mycobacterium avium
MHVLPIPYVEPADISNAI

SEQ ID NO: 82638 - protein, 20 aa, Mycobacterium avium
MIALKEVVRIAADEAGVPPP

SEQ ID NO: 82639 - protein, 34 aa, Mycobacterium avium
MIDVSSIKELCRRWYPRIYFGQPVKGLTHRALAD

SEQ ID NO: 82640 - protein, 17 aa, Mycobacterium avium
MILPPIAHDVRVISIAQ

SEQ ID NO: 82641 - protein, 20 aa, Mycobacterium avium
MKDMVGMMIVVARHLKRAGI

SEQ ID NO: 82642 - protein, 25 aa, Mycobacterium avium
MKEGDDVFVALSWTKHPPPQTYQEA

SEQ ID NO: 82643 - protein, 22 aa, Mycobacterium avium
MKHLRAGYWRQVRTQLVVTPAM

SEQ ID NO: 82644 - protein, 17 aa, Mycobacterium avium
MKIPAGTVGSVYGYHRG

SEQ ID NO: 82645 - protein, 20 aa, Mycobacterium avium
MKLDFLLTIDPEYYKKFMSV

SEQ ID NO: 82646 - protein, 35 aa, Mycobacterium avium
MKLTHEIVEFSRFILAEIFPGGWLPTPQTVGEYGV

SEQ ID NO: 82647 - protein, 17 aa, Mycobacterium avium
MKMEIPVLAEVGGTVSK

SEQ ID NO: 82648 - protein, 22 aa, Mycobacterium avium
MLADEVEGYFLLGQNPAVGSAH

SEQ ID NO: 82649 - protein, 19 aa, Mycobacterium avium
MLALARLQRKMRLVESPYR

SEQ ID NO: 82650 - protein, 19 aa, Mycobacterium avium
MLAQRVGAWVPLHEVPEVW

SEQ ID NO: 82651 - protein, 24 aa, Mycobacterium avium
MLDLKILLRHVFDGEQLGEHDVTR

SEQ ID NO: 82652 - protein, 20 aa, Mycobacterium avium
MLELPLYRALVAARGQSQEV

SEQ ID NO: 82653 - protein, 26 aa, Mycobacterium avium
MLFQSCSLHAGQACILHSRLLLPDSL

SEQ ID NO: 82654 - protein, 23 aa, Mycobacterium avium
MLGPRGGAFVVAQTRLGGGRIHH

SEQ ID NO: 82655 - protein, 26 aa, Mycobacterium avium
MLHPLSAPMTLRWLTDRFEGRPVTEH

SEQ ID NO: 82656 - protein, 17 aa, Mycobacterium avium
MLLHPAGVLGLSDGGAH

SEQ ID NO: 82657 - protein, 26 aa, Mycobacterium avium
MLNELERIGGRYGLQTMCEGGGTANV

SEQ ID NO: 82658 - protein, 21 aa, Mycobacterium avium
MLNQHAKWLATSRELPWRRPI

SEQ ID NO: 82659 - protein, 18 aa, Mycobacterium avium
MLNVKIGGARRCAAQSWP

SEQ ID NO: 82660 - protein, 18 aa, Mycobacterium avium
MLPPVQPPPGFAVRYEPA

SEQ ID NO: 82661 - protein, 21 aa, Mycobacterium avium
MLRAARFVSQLGFTVAPRVRE

SEQ ID NO: 82662 - protein, 18 aa, Mycobacterium avium
MLRANSKLAARTGVPEES

SEQ ID NO: 82663 - protein, 29 aa, Mycobacterium avium
MLRGLPARHVIALGESQSAMFLTTYINAV

SEQ ID NO: 82664 - protein, 18 aa, Mycobacterium avium
MLVVPGSMRVRAQAEAEG

SEQ ID NO: 82665 - protein, 18 aa, Mycobacterium avium
MLWCTSGIAEFWALTLDE

SEQ ID NO: 82666 - protein, 18 aa, Mycobacterium avium
MMADCFDLTLDEVTFSYE

SEQ ID NO: 82667 - protein, 18 aa, Mycobacterium avium
MMALGIIDECHRLCVDYA

SEQ ID NO: 82668 - protein, 17 aa, Mycobacterium avium
MMFLPGVIVAMWGGQVR

SEQ ID NO: 82669 - protein, 20 aa, Mycobacterium avium
MMIYMAWSMAGRGAQEGRTA

SEQ ID NO: 82670 - protein, 21 aa, Mycobacterium avium
MMLGVALSAYEHWLGDESVPL

SEQ ID NO: 82671 - protein, 17 aa, Mycobacterium avium
MMSSMLGGMGIPGLGRK

SEQ ID NO: 82672 - protein, 23 aa, Mycobacterium avium
MMVPGLPNLFSISGPGSPSVLAN

SEQ ID NO: 82673 - protein, 34 aa, Mycobacterium avium
MNAGGILASICFPSFPGFAGRLFATEDNDFSIAL

SEQ ID NO: 82674 - protein, 24 aa, Mycobacterium avium
MNESLRMVTPLPFNMRQAVRDTEL

SEQ ID NO: 82675 - protein, 17 aa, Mycobacterium avium
MNSAVFFLLGLYALLIT

SEQ ID NO: 82676 - protein, 26 aa, Mycobacterium avium
MPADVPRWLSAPARLVVQSLLGRVQL

SEQ ID NO: 82677 - protein, 20 aa, Mycobacterium avium
MPDDEVAALLGRMRADDAAD

SEQ ID NO: 82678 - protein, 24 aa, Mycobacterium avium
MPDRVKCLHVLIAHSLAKGPGVNP

SEQ ID NO: 82679 - protein, 20 aa, Mycobacterium avium
MPFYVMAAIDGWSPMDGGWP

SEQ ID NO: 82680 - protein, 21 aa, Mycobacterium avium
MPGMDGFGVLRRLRADGIDAP

SEQ ID NO: 82681 - protein, 17 aa, Mycobacterium avium
MPGWEAGIVHTFLADAP

SEQ ID NO: 82682 - protein, 24 aa, Mycobacterium avium
MPIHMRLPKLKGFRNRFRTEYEIV

SEQ ID NO: 82683 - protein, 22 aa, Mycobacterium avium
MPISGHKQSGWGGERGRKGIEA

SEQ ID NO: 82684 - protein, 21 aa, Mycobacterium avium
MPLKFRDGAHFAALDAGPVTL

SEQ ID NO: 82685 - protein, 21 aa, Mycobacterium avium
MPMWERLEAAWGPARDVRDRQ

SEQ ID NO: 82686 - protein, 24 aa, Mycobacterium avium
MPPDSYPRMLAWGRSGSPLLDLGI

SEQ ID NO: 82687 - protein, 17 aa, Mycobacterium avium
MPSPKLEGIGERGGAPV

SEQ ID NO: 82688 - protein, 22 aa, Mycobacterium avium
MPYRQGDWVYLPKATTWRQLPD

SEQ ID NO: 82689 - protein, 18 aa, Mycobacterium avium
MQPFMIHYTASKHAVTGL

SEQ ID NO: 82690 - protein, 30 aa, Mycobacterium avium
MQRLGMSHLKWLVVRDFNLIESATWWKDGP

SEQ ID NO: 82691 - protein, 17 aa, Mycobacterium avium
MREAIGWALDEAGQGRC

SEQ ID NO: 82692 - protein, 18 aa, Mycobacterium avium
MREEGYAAATSRRVAAEA

SEQ ID NO: 82693 - protein, 18 aa, Mycobacterium avium
MRGARRCSSLVGRADLVM

SEQ ID NO: 82694 - protein, 17 aa, Mycobacterium avium
MRGQGFGQIIAMSSAAG

SEQ ID NO: 82695 - protein, 20 aa, Mycobacterium avium
MRHGMYWSGDLAYRDADGWI

SEQ ID NO: 82696 - protein, 18 aa, Mycobacterium avium
MRIAHLVERGHRRIAFAY

SEQ ID NO: 82697 - protein, 24 aa, Mycobacterium avium
MRINGVNRLACKVLMRDLLPEPKK

SEQ ID NO: 82698 - protein, 20 aa, Mycobacterium avium
MRKPEVRARILADKPGEGHP

SEQ ID NO: 82699 - protein, 20 aa, Mycobacterium avium
MRPGDSLLLGTDLVKDTERL

SEQ ID NO: 82700 - protein, 19 aa, Mycobacterium avium
MRRALEYATGLGVLIAQHA

SEQ ID NO: 82701 - protein, 32 aa, Mycobacterium avium
MRRHHLPVPPAFCLTTAVGLRYLADPAATMDA

SEQ ID NO: 82702 - protein, 18 aa, Mycobacterium avium
MRRMRAAAAKLVDAEITD

SEQ ID NO: 82703 - protein, 18 aa, Mycobacterium avium
MRRVAPIWWNEQPIGAGG

SEQ ID NO: 82704 - protein, 18 aa, Mycobacterium avium
MRSFGKKVEAGWVSVLRS

SEQ ID NO: 82705 - protein, 23 aa, Mycobacterium avium
MRVEALLRYPVKSMLGETLDRLA

SEQ ID NO: 82706 - protein, 22 aa, Mycobacterium avium
MRVPLEGGGRLVVELTPDEAAA

SEQ ID NO: 82707 - protein, 23 aa, Mycobacterium avium
MSADEWRAFAARASLYSAKAKAK

SEQ ID NO: 82708 - protein, 21 aa, Mycobacterium avium
MSDHRRILATLSMADDKETLG

SEQ ID NO: 82709 - protein, 21 aa, Mycobacterium avium
MSDVIRLSRHAHHYLAIFDQG

SEQ ID NO: 82710 - protein, 25 aa, Mycobacterium avium
MSKAFAFAGGRLGYLIATPAVIEAM

SEQ ID NO: 82711 - protein, 17 aa, Mycobacterium avium
MSLELGDRVGLVGHNGA

SEQ ID NO: 82712 - protein, 19 aa, Mycobacterium avium
MSPAGGVGINLAVADAVAA

SEQ ID NO: 82713 - protein, 24 aa, Mycobacterium avium
MSRKRNLVEYGFRLPSACDNRPLT

SEQ ID NO: 82714 - protein, 31 aa, Mycobacterium avium
MSRSTPRAGDGFIRLDVNGVVAYASPNALSA

SEQ ID NO: 82715 - protein, 19 aa, Mycobacterium avium
MSVASGYAPRAIVAPIVGS

SEQ ID NO: 82716 - protein, 17 aa, Mycobacterium avium
MSVPQGWTEAAPAIRTL

SEQ ID NO: 82717 - protein, 20 aa, Mycobacterium avium
MTADMRRRITLSANDDERTV

SEQ ID NO: 82718 - protein, 18 aa, Mycobacterium avium
MTETSPLATMAWPPPGTP

SEQ ID NO: 82719 - protein, 17 aa, Mycobacterium avium
MTGHFSRFHVGGNHAVH

SEQ ID NO: 82720 - protein, 19 aa, Mycobacterium avium
MTGTLRWGEQVHQVSGSSG

SEQ ID NO: 82721 - protein, 25 aa, Mycobacterium avium
MTKMLRRTLEEISRMQAEAQAEAES

SEQ ID NO: 82722 - protein, 25 aa, Mycobacterium avium
MTKSLRAGKIFVDWSQNNGSKTTIA

SEQ ID NO: 82723 - protein, 26 aa, Mycobacterium avium
MTLGAYRWLRPSGRRSAKEIAAEFST

SEQ ID NO: 82724 - protein, 35 aa, Mycobacterium avium
MTNHAAGWVRMDFIVPSRGLIGFRTDFLTITRGTG

SEQ ID NO: 82725 - protein, 23 aa, Mycobacterium avium
MTPGCTKEACHFRDLAAEFAAVG

SEQ ID NO: 82726 - protein, 18 aa, Mycobacterium avium
MTPGERLLGLDLANGGHL

SEQ ID NO: 82727 - protein, 19 aa, Mycobacterium avium
MTPPFPGLDTFAGQVYHTA

SEQ ID NO: 82728 - protein, 19 aa, Mycobacterium avium
MTSFYDWYADLPVASPQVF

SEQ ID NO: 82729 - protein, 26 aa, Mycobacterium avium
MTSRPCPTCRGVGVVIPDPCHQCMGD

SEQ ID NO: 82730 - protein, 17 aa, Mycobacterium avium
MTVLVGGLRALGANHGG

SEQ ID NO: 82731 - protein, 28 aa, Mycobacterium avium
MVAACLKWEGGYVWACKNYDGDVQSDAI

SEQ ID NO: 82732 - protein, 23 aa, Mycobacterium avium
MVADSFHLPIVFLADNPGMLPGS

SEQ ID NO: 82733 - protein, 22 aa, Mycobacterium avium
MVERLLGFGLAKGHGAADWSKR

SEQ ID NO: 82734 - protein, 18 aa, Mycobacterium avium
MVFHEITEPAILEAAENP

SEQ ID NO: 82735 - protein, 17 aa, Mycobacterium avium
MVIGVWISKLFPQRMFK

SEQ ID NO: 82736 - protein, 21 aa, Mycobacterium avium
MVIKDGRFGPYVTDGETNASL

SEQ ID NO: 82737 - protein, 24 aa, Mycobacterium avium
MVRGNPALASWFAVTRPPIAGELA

SEQ ID NO: 82738 - protein, 17 aa, Mycobacterium avium
MVSALKAVWGEFQQPVV

SEQ ID NO: 82739 - protein, 31 aa, Mycobacterium avium
MVSNWARRDFPALAPAVRVPVHFSIAEHEKV

SEQ ID NO: 82740 - protein, 25 aa, Mycobacterium avium
MWQTTECWRQWINIGNFPDHPWRAY

SEQ ID NO: 82741 - protein, 21 aa, Mycobacterium avium
MWTSLIAYADWVWLAVRTNPE

SEQ ID NO: 82742 - protein, 24 aa, Mycobacterium avium
MYAAGRIPGSFFRREGRPSTDAIL

SEQ ID NO: 82743 - protein, 18 aa, Mycobacterium avium
MYAGELSMGALNFYAERP

SEQ ID NO: 82744 - protein, 17 aa, Mycobacterium avium
MYFGAELVKVTPMDFLR

SEQ ID NO: 82745 - protein, 24 aa, Mycobacterium avium
MYLFSPYDVERVYGLPFADISVTE

SEQ ID NO: 82746 - protein, 26 aa, Mycobacterium avium
MYREAKARLGDPVLAWADIQADPERR

SEQ ID NO: 82747 - protein, 20 aa, Mycobacterium avium
MYTGGACRLAFWQDDRYLVC

SEQ ID NO: 82748 - protein, 19 aa, Mycobacterium avium
MYVGSLAILRRPRAGLSYE

SEQ ID NO: 82749 - protein, 23 aa, Mycobacterium avium
MYVLAGRMRLILGDRDFTIDPGE

SEQ ID NO: 82750 - protein, 24 aa, Mycobacterium avium
NAALALAAVEAFFGAGAQRQLDVD

SEQ ID NO: 82751 - protein, 25 aa, Mycobacterium avium
NADAYTVSLLKAWWGEAATADNDWA

SEQ ID NO: 82752 - protein, 19 aa, Mycobacterium avium
NADVDLLAFTRVVSALRAE

SEQ ID NO: 82753 - protein, 21 aa, Mycobacterium avium
NAEKVFTSWMVAGDAALSSPV

SEQ ID NO: 82754 - protein, 25 aa, Mycobacterium avium
NAFRPSARLARPYVVVSADVVVAED

SEQ ID NO: 82755 - protein, 21 aa, Mycobacterium avium
NAGKLVVVVLPDFGERYLSTP

SEQ ID NO: 82756 - protein, 19 aa, Mycobacterium avium
NAGVHACAVIMSSEPLTEA

SEQ ID NO: 82757 - protein, 24 aa, Mycobacterium avium
NAISGRVAFALGLEGPAVAVDTAC

SEQ ID NO: 82758 - protein, 19 aa, Mycobacterium avium
NALSAALRDRFFGALADAE

SEQ ID NO: 82759 - protein, 28 aa, Mycobacterium avium
NALYTPAHWKYLTSGLLGLARGTDAGDL

SEQ ID NO: 82760 - protein, 19 aa, Mycobacterium avium
NAMRIAREEIFGPVITVIP

SEQ ID NO: 82761 - protein, 23 aa, Mycobacterium avium
NAQISEFAKPYVAVMDGIVMGGG

SEQ ID NO: 82762 - protein, 23 aa, Mycobacterium avium
NARLRPRIGVMLQGGGGYPAARA

SEQ ID NO: 82763 - protein, 24 aa, Mycobacterium avium
NARRARLGLSVADYRRRMGELFAP

SEQ ID NO: 82764 - protein, 24 aa, Mycobacterium avium
NASDRPLPWAVMHKLTAPTLLTWG

SEQ ID NO: 82765 - protein, 19 aa, Mycobacterium avium
NAVKPMLSSAVGAGQVSGS

SEQ ID NO: 82766 - protein, 19 aa, Mycobacterium avium
NCEIVPWCRFARKNYFYPD

SEQ ID NO: 82767 - protein, 19 aa, Mycobacterium avium
NCGDAGQSPGTWKQNGQTG

SEQ ID NO: 82768 - protein, 17 aa, Mycobacterium avium
NCGVGFAPCRQSDHDVL

SEQ ID NO: 82769 - protein, 18 aa, Mycobacterium avium
NCVEHAYRGFVAGTMVLD

SEQ ID NO: 82770 - protein, 24 aa, Mycobacterium avium
NDCPAELWSALDPHAIAKEHGAAM

SEQ ID NO: 82771 - protein, 17 aa, Mycobacterium avium
NDGETFASWALRADEEE

SEQ ID NO: 82772 - protein, 23 aa, Mycobacterium avium
NDGRGFFTTRVFSTYLLEAFNML

SEQ ID NO: 82773 - protein, 23 aa, Mycobacterium avium
NDIPHITAPVIVKYVTDLQLLGL

SEQ ID NO: 82774 - protein, 26 aa, Mycobacterium avium
NDLAARGEVIDSCLYTTPSKYGGEGA

SEQ ID NO: 82775 - protein, 18 aa, Mycobacterium avium
NDLGRVCAPGTVRVDDYS

SEQ ID NO: 82776 - protein, 25 aa, Mycobacterium avium
NDPDWQRFHLIGATNPVYFALLARR

SEQ ID NO: 82777 - protein, 21 aa, Mycobacterium avium
NDRDRLVVIIAGYRADLDKFL

SEQ ID NO: 82778 - protein, 24 aa, Mycobacterium avium
NDVSRWPELRAALTEKFASRDRDH

SEQ ID NO: 82779 - protein, 26 aa, Mycobacterium avium
NDYLDLVSDFARHAAIALALAAGRQH

SEQ ID NO: 82780 - protein, 31 aa, Mycobacterium avium
NEAAPYLAGHGWRLNSVTIRDLFAANGLDPL

SEQ ID NO: 82781 - protein, 21 aa, Mycobacterium avium
NEAFASVVLSWARVHEPDMAR

SEQ ID NO: 82782 - protein, 19 aa, Mycobacterium avium
NEDFLWRLADEQLNRFIAN

SEQ ID NO: 82783 - protein, 18 aa, Mycobacterium avium
NEDMLCWESDFPHSDSNW

SEQ ID NO: 82784 - protein, 27 aa, Mycobacterium avium
NEGDVFCSVVRRVALPDSFFAIDGQIE

SEQ ID NO: 82785 - protein, 17 aa, Mycobacterium avium
NEIATGYQGEWPEFKER

SEQ ID NO: 82786 - protein, 17 aa, Mycobacterium avium
NEIQVVVTILSLDPNDL

SEQ ID NO: 82787 - protein, 19 aa, Mycobacterium avium
NEKNFKWIARSADGWITTP

SEQ ID NO: 82788 - protein, 20 aa, Mycobacterium avium
NELPPGLADFDLSKLKFPGN

SEQ ID NO: 82789 - protein, 26 aa, Mycobacterium avium
NELREMLPHNAVEYFVSYYDYYQPEA

SEQ ID NO: 82790 - protein, 17 aa, Mycobacterium avium
NEQRLAANVAQRVGAPL

SEQ ID NO: 82791 - protein, 18 aa, Mycobacterium avium
NERLEFLGDAVLGLTITD

SEQ ID NO: 82792 - protein, 23 aa, Mycobacterium avium
NETRPGDRWRLSSPHGGLRVDRD

SEQ ID NO: 82793 - protein, 20 aa, Mycobacterium avium
NFALEYCLREDKVPAAELAG

SEQ ID NO: 82794 - protein, 24 aa, Mycobacterium avium
NFLNPRPGTPFGDLEVMPATEALK

SEQ ID NO: 82795 - protein, 20 aa, Mycobacterium avium
NFMLLIWEPGWFLTYHYWPT

SEQ ID NO: 82796 - protein, 23 aa, Mycobacterium avium
NFRRHAIEALEFMGISVEFSHHE

SEQ ID NO: 82797 - protein, 18 aa, Mycobacterium avium
NFSPRVMDQFGLTADVLL

SEQ ID NO: 82798 - protein, 28 aa, Mycobacterium avium
NGAINTAAWWVCATIPNAVSLGKTLGTV

SEQ ID NO: 82799 - protein, 19 aa, Mycobacterium avium
NGAITKWDDPALKAVNPGL

SEQ ID NO: 82800 - protein, 19 aa, Mycobacterium avium
NGAVLPILALYVVAAEEQG

SEQ ID NO: 82801 - protein, 24 aa, Mycobacterium avium
NGERTGNVCLVTLGLNLFSRGVDP

SEQ ID NO: 82802 - protein, 21 aa, Mycobacterium avium
NGFQVLCEAGLLPGALTRNVG

SEQ ID NO: 82803 - protein, 24 aa, Mycobacterium avium
NGGLPCLDCLPGVVEAADGLPVLF

SEQ ID NO: 82804 - protein, 31 aa, Mycobacterium avium
NGGLPGRITVCYRFTRPGHDITLFSRTMTIE

SEQ ID NO: 82805 - protein, 18 aa, Mycobacterium avium
NGIRFHVVEALPVGDARG

SEQ ID NO: 82806 - protein, 20 aa, Mycobacterium avium
NGLARPGEVLACTDSHTCAA

SEQ ID NO: 82807 - protein, 25 aa, Mycobacterium avium
NGRPRRAGVSSFGFTGTNAHVLIEE

SEQ ID NO: 82808 - protein, 28 aa, Mycobacterium avium
NGYCVRFLTDWAGPEAMVKKLSIRLGVP

SEQ ID NO: 82809 - protein, 24 aa, Mycobacterium avium
NHAQGFAYACRMLQVHGRVYVPAK

SEQ ID NO: 82810 - protein, 25 aa, Mycobacterium avium
NHDDWRWVIDIDLWGSIHAVEAFLP

SEQ ID NO: 82811 - protein, 18 aa, Mycobacterium avium
NHGPMFPQCGGISDQTVA

SEQ ID NO: 82812 - protein, 23 aa, Mycobacterium avium
NHRKDMRAEIAYYAERFRDEQQR

SEQ ID NO: 82813 - protein, 24 aa, Mycobacterium avium
NHRQTLRMYDEWATLADLREGDRY

SEQ ID NO: 82814 - protein, 25 aa, Mycobacterium avium
NHVLPAWDVCCGLYAALSVVTAVHR

SEQ ID NO: 82815 - protein, 19 aa, Mycobacterium avium
NIALPSIYYAHRRKVFRRD

SEQ ID NO: 82816 - protein, 19 aa, Mycobacterium avium
NIEVPYAFNAEIEQLADAT

SEQ ID NO: 82817 - protein, 17 aa, Mycobacterium avium
NIRLRNLLLDDVAGGYT

SEQ ID NO: 82818 - protein, 28 aa, Mycobacterium avium
NIRRIGAVAKLFCEAGIIALTAFISPYV

SEQ ID NO: 82819 - protein, 17 aa, Mycobacterium avium
NIVPLGRPGHVDEIASA

SEQ ID NO: 82820 - protein, 27 aa, Mycobacterium avium
NKALADFAHRGWIRLEGKSVLISDSER

SEQ ID NO: 82821 - protein, 17 aa, Mycobacterium avium
NKDGGYLASSWAVYRAE

SEQ ID NO: 82822 - protein, 25 aa, Mycobacterium avium
NKFVFANADAFSWRATFENLALVDG

SEQ ID NO: 82823 - protein, 19 aa, Mycobacterium avium
NKNGMPWASAQLEDLTGGI

SEQ ID NO: 82824 - protein, 18 aa, Mycobacterium avium
NKTEWLPLIAKGEMICAV

SEQ ID NO: 82825 - protein, 25 aa, Mycobacterium avium
NKVPGARCALAWSVETAQLAREHNN

SEQ ID NO: 82826 - protein, 18 aa, Mycobacterium avium
NLADGIVVLEFVDHEHDA

SEQ ID NO: 82827 - protein, 23 aa, Mycobacterium avium
NLARAKMGLPVPVTSRHTLLLGP

SEQ ID NO: 82828 - protein, 22 aa, Mycobacterium avium
NLARGKSGVVLYVVPHVAVGEM

SEQ ID NO: 82829 - protein, 19 aa, Mycobacterium avium
NLDEVRLLVDIDVTDAASQ

SEQ ID NO: 82830 - protein, 19 aa, Mycobacterium avium
NLFGLSWPLRHRVVPNAAT

SEQ ID NO: 82831 - protein, 18 aa, Mycobacterium avium
NLFVPQPSVADWVALDYY

SEQ ID NO: 82832 - protein, 25 aa, Mycobacterium avium
NLGEVLRRYPQVVCPEMNLGQLALL

SEQ ID NO: 82833 - protein, 21 aa, Mycobacterium avium
NLGSVWFLSRCAVKPMMTQGS

SEQ ID NO: 82834 - protein, 21 aa, Mycobacterium avium
NLKGKLDGYALRVPIPTGSVT

SEQ ID NO: 82835 - protein, 25 aa, Mycobacterium avium
NLKGPFRLSALVGERMVAAGRGSII

SEQ ID NO: 82836 - protein, 19 aa, Mycobacterium avium
NLLGWPREVLPFELAAETL

SEQ ID NO: 82837 - protein, 21 aa, Mycobacterium avium
NLPDMFTRLMLSLVATGIAPG

SEQ ID NO: 82838 - protein, 20 aa, Mycobacterium avium
NLPPAYIGVAGYDPLRDDGI

SEQ ID NO: 82839 - protein, 19 aa, Mycobacterium avium
NLRAVNFVIDGILGQGVAY

SEQ ID NO: 82840 - protein, 22 aa, Mycobacterium avium
NLSDGRIEWMSAIANRLPMMVV

SEQ ID NO: 82841 - protein, 24 aa, Mycobacterium avium
NLVKMALHYEGWVVDIAHNGREAM

SEQ ID NO: 82842 - protein, 30 aa, Mycobacterium avium
NLVMGSNVQVVWEKFCRYFDVEPRYLPMEE

SEQ ID NO: 82843 - protein, 18 aa, Mycobacterium avium
NLYGISWNPANTVAALRR

SEQ ID NO: 82844 - protein, 24 aa, Mycobacterium avium
NMTRRLAREEAMLVGGSCGMAVVA

SEQ ID NO: 82845 - protein, 23 aa, Mycobacterium avium
NNNWFAAYAYWYFKLYGHEKVKL

SEQ ID NO: 82846 - protein, 19 aa, Mycobacterium avium
NPARLAAALRRLLAQKFQC

SEQ ID NO: 82847 - protein, 17 aa, Mycobacterium avium
NPFALLVGMLLDQQVPI

SEQ ID NO: 82848 - protein, 23 aa, Mycobacterium avium
NPFLEGYTSLGFLAAQTSTIELA

SEQ ID NO: 82849 - protein, 18 aa, Mycobacterium avium
NPGVMSWSEMARLKPVAP

SEQ ID NO: 82850 - protein, 19 aa, Mycobacterium avium
NPGYTGLHFMAAYELEECW

SEQ ID NO: 82851 - protein, 17 aa, Mycobacterium avium
NPIYIPRNHLVEEALAA

SEQ ID NO: 82852 - protein, 23 aa, Mycobacterium avium
NPKPLGMPLQYMVSGMAVRATNK

SEQ ID NO: 82853 - protein, 19 aa, Mycobacterium avium
NPKPLKGMPPFSGPQGPFA

SEQ ID NO: 82854 - protein, 22 aa, Mycobacterium avium
NPLEWLDDKFCNYIEERRREPR

SEQ ID NO: 82855 - protein, 22 aa, Mycobacterium avium
NPPMIRYPIPPMIHGATQSATW

SEQ ID NO: 82856 - protein, 23 aa, Mycobacterium avium
NPQRRARVLMRFIELVNQHNDEL

SEQ ID NO: 82857 - protein, 33 aa, Mycobacterium avium
NPVSALVSFEVFIRPALRAAMGLPDPERPHRSA

SEQ ID NO: 82858 - protein, 19 aa, Mycobacterium avium
NPYLTFAVLLAAGLRGVEK

SEQ ID NO: 82859 - protein, 18 aa, Mycobacterium avium
NQRGQVIPVEITVYEDRS

SEQ ID NO: 82860 - protein, 23 aa, Mycobacterium avium
NQRLARLCDRVVLVVAGQPVPIK

SEQ ID NO: 82861 - protein, 28 aa, Mycobacterium avium
NQSPARYFGPNLSRLSAVRQKYDPGRVM

SEQ ID NO: 82862 - protein, 21 aa, Mycobacterium avium
NQVALEIMPAWGGAERLAALV

SEQ ID NO: 82863 - protein, 26 aa, Mycobacterium avium
NRAFFDWMNHGKLCYGIDFDRDADQL

SEQ ID NO: 82864 - protein, 20 aa, Mycobacterium avium
NRAPLSFPMAGWNVAMDFPN

SEQ ID NO: 82865 - protein, 20 aa, Mycobacterium avium
NRGLRLKVYPVREQYDCVFV

SEQ ID NO: 82866 - protein, 26 aa, Mycobacterium avium
NRHFSFGLGIHRCIGSNVARTVFKSM

SEQ ID NO: 82867 - protein, 19 aa, Mycobacterium avium
NRIPEDFPDPDAFKPDRYN

SEQ ID NO: 82868 - protein, 24 aa, Mycobacterium avium
NRIVRRLLAAAGFPVESLVRTDIG

SEQ ID NO: 82869 - protein, 25 aa, Mycobacterium avium
NRLPRDGRGPLGWLYTPSGDVTSLL

SEQ ID NO: 82870 - protein, 23 aa, Mycobacterium avium
NRLVGILHGCLRHRTHYDEHKAW

SEQ ID NO: 82871 - protein, 24 aa, Mycobacterium avium
NRLWERPYIAAGIFLYDRLGGAKS

SEQ ID NO: 82872 - protein, 17 aa, Mycobacterium avium
NRPDIPGAQDFSGEVYF

SEQ ID NO: 82873 - protein, 24 aa, Mycobacterium avium
NRPEFLEITWGCQLSGLYYTPVNT

SEQ ID NO: 82874 - protein, 19 aa, Mycobacterium avium
NRPGPRGFLGQPIPIEGLY

SEQ ID NO: 82875 - protein, 23 aa, Mycobacterium avium
NRPGYLRFDFNWQGPLTEEQRTQ

SEQ ID NO: 82876 - protein, 28 aa, Mycobacterium avium
NRPRKYWVLKGFHGFRLKELFDTYPDAR

SEQ ID NO: 82877 - protein, 18 aa, Mycobacterium avium
NRSACVRIPITGTNPKAK

SEQ ID NO: 82878 - protein, 20 aa, Mycobacterium avium
NRTRLAQLLATNRFGTNTAA

SEQ ID NO: 82879 - protein, 18 aa, Mycobacterium avium
NRTRPGVARGECTDPPTT

SEQ ID NO: 82880 - protein, 18 aa, Mycobacterium avium
NSAIARFAGPTAGSLSLK

SEQ ID NO: 82881 - protein, 26 aa, Mycobacterium avium
NSCRQCSSCTAGLEQYCKRGATFTYN

SEQ ID NO: 82882 - protein, 30 aa, Mycobacterium avium
NSFSKYYAMTGWRLGWLLVPVELRRAVECL

SEQ ID NO: 82883 - protein, 25 aa, Mycobacterium avium
NSGAQRATHEWLCVRTDPTGTRHRG

SEQ ID NO: 82884 - protein, 24 aa, Mycobacterium avium
NSIGGFRNSMTFVLTGLDIEAKAE

SEQ ID NO: 82885 - protein, 30 aa, Mycobacterium avium
NSLSDLLVFGRRAGLGAADYVRALSSRPTI

SEQ ID NO: 82886 - protein, 18 aa, Mycobacterium avium
NSMEAVGGPATWRLGGAF

SEQ ID NO: 82887 - protein, 23 aa, Mycobacterium avium
NSPLRAHRAVVCIDDEAGREMAA

SEQ ID NO: 82888 - protein, 25 aa, Mycobacterium avium
NSPNGYRTEVDWATQMSYSGVFVHS

SEQ ID NO: 82889 - protein, 24 aa, Mycobacterium avium
NSPRGRVSLHWGPRRDAHLLIPEI

SEQ ID NO: 82890 - protein, 23 aa, Mycobacterium avium
NSTGMCAALGLLAKIISGTGGQV

SEQ ID NO: 82891 - protein, 24 aa, Mycobacterium avium
NSTRTRFSFEVGIAQLGGHAVVVD

SEQ ID NO: 82892 - protein, 31 aa, Mycobacterium avium
NSWSVKVPRRLKELHLRLGTATADLSQRLGR

SEQ ID NO: 82893 - protein, 26 aa, Mycobacterium avium
NTAKLADVMLRYNFPGAGLTDDALRT

SEQ ID NO: 82894 - protein, 20 aa, Mycobacterium avium
NTCAAALPHLIGGGGGSLVN

SEQ ID NO: 82895 - protein, 17 aa, Mycobacterium avium
NTGYDLPALFVGAEGTL

SEQ ID NO: 82896 - protein, 24 aa, Mycobacterium avium
NTHGVSWLPLYHDMGLSMIGFPAV

SEQ ID NO: 82897 - protein, 31 aa, Mycobacterium avium
NTPGYSGVLGRLWLARGGTYVLANIRGGGEY

SEQ ID NO: 82898 - protein, 18 aa, Mycobacterium avium
NTPIEWLIGVIRSLRVPV

SEQ ID NO: 82899 - protein, 18 aa, Mycobacterium avium
NTPKALAALDGWTTDALD

SEQ ID NO: 82900 - protein, 26 aa, Mycobacterium avium
NTPVVWRGPMLHRALQQFLADVYWGD

SEQ ID NO: 82901 - protein, 20 aa, Mycobacterium avium
NTPWRSEYLYSRAATIYGGT

SEQ ID NO: 82902 - protein, 25 aa, Mycobacterium avium
NTQVCPVCLGLPGSLPVLNQAAVES

SEQ ID NO: 82903 - protein, 20 aa, Mycobacterium avium
NTVLWGGYTWEYWRATRAVK

SEQ ID NO: 82904 - protein, 24 aa, Mycobacterium avium
NTVRYRLKRITDFTGRDPMQPRDA

SEQ ID NO: 82905 - protein, 23 aa, Mycobacterium avium
NVARATLYRHFPSGNDLLAAAFN

SEQ ID NO: 82906 - protein, 19 aa, Mycobacterium avium
NVAVSRAQYAAVIVRSPTL

SEQ ID NO: 82907 - protein, 24 aa, Mycobacterium avium
NVCGDRTPPRLAVIAMGKCGAREL

SEQ ID NO: 82908 - protein, 26 aa, Mycobacterium avium
NVELLADVVNRVWFLDAVRGEVDVYN

SEQ ID NO: 82909 - protein, 20 aa, Mycobacterium avium
NVGHCLWTGIATDEHAAAIV

SEQ ID NO: 82910 - protein, 18 aa, Mycobacterium avium
NVGHWLRHPGGFADTDPQ

SEQ ID NO: 82911 - protein, 17 aa, Mycobacterium avium
NVMGTVRAWAAAGVPPR

SEQ ID NO: 82912 - protein, 17 aa, Mycobacterium avium
NVSVPVFVARAGGGIVE

SEQ ID NO: 82913 - protein, 17 aa, Mycobacterium avium
NVTKLKLAEHMVEGAAI

SEQ ID NO: 82914 - protein, 18 aa, Mycobacterium avium
NVTRPDRLVALGGSAGGL

SEQ ID NO: 82915 - protein, 23 aa, Mycobacterium avium
NVYRSELLFRHGIDPYRAGRDVG

SEQ ID NO: 82916 - protein, 22 aa, Mycobacterium avium
NWIKEFDPRFNVRYRDDKSYPV

SEQ ID NO: 82917 - protein, 23 aa, Mycobacterium avium
NWLRTADPNSWALADATVDAMGV

SEQ ID NO: 82918 - protein, 18 aa, Mycobacterium avium
NWMRAREALIKTDVFGTE

SEQ ID NO: 82919 - protein, 17 aa, Mycobacterium avium
NWPQARLTLALSPATLP

SEQ ID NO: 82920 - protein, 25 aa, Mycobacterium avium
NWSIRRLSTLVGHGRARAMLLAAEK

SEQ ID NO: 82921 - protein, 17 aa, Mycobacterium avium
NWSPRRRQSWLLEQISL

SEQ ID NO: 82922 - protein, 29 aa, Mycobacterium avium
NWTLLKWLDEPCTFYDWRSSETGKPRVHP

SEQ ID NO: 82923 - protein, 21 aa, Mycobacterium avium
NYERLLAGPVMGRVKEFVTRL

SEQ ID NO: 82924 - protein, 23 aa, Mycobacterium avium
NYRAWRHFIAMRASEHADVEIRR

SEQ ID NO: 82925 - protein, 21 aa, Mycobacterium avium
NYVIKHARLIPVDRRSGHDAF

SEQ ID NO: 82926 - protein, 23 aa, Mycobacterium avium
PAADRPGPTLLYGYGGFESSNTP

SEQ ID NO: 82927 - protein, 24 aa, Mycobacterium avium
PAAERTGLVAFSLHYPWSQQLPVH

SEQ ID NO: 82928 - protein, 24 aa, Mycobacterium avium
PAALFDPRFQQLGLHPGGGATWML

SEQ ID NO: 82929 - protein, 18 aa, Mycobacterium avium
PAALRRRGLGPADIAPRP

SEQ ID NO: 82930 - protein, 17 aa, Mycobacterium avium
PAAQARLLATIEAHGEA

SEQ ID NO: 82931 - protein, 19 aa, Mycobacterium avium
PAAVCARLAELGGLSRGVL

SEQ ID NO: 82932 - protein, 27 aa, Mycobacterium avium
PAAVSPWWLQRRLLLSGIRATSPAVDV

SEQ ID NO: 82933 - protein, 24 aa, Mycobacterium avium
PAAWAAEGLLGFLPPQAQDRLLDN

SEQ ID NO: 82934 - protein, 18 aa, Mycobacterium avium
PADAYWLLRHAIACPDPV

SEQ ID NO: 82935 - protein, 24 aa, Mycobacterium avium
PADEAIGPGDRWIVEQIRATAPKT

SEQ ID NO: 82936 - protein, 25 aa, Mycobacterium avium
PADGAPAWLRFFGCNPRHHSLAFLP

SEQ ID NO: 82937 - protein, 31 aa, Mycobacterium avium
PADGASNWYLEFARLAPLMEKDVHYEVDLRK

SEQ ID NO: 82938 - protein, 23 aa, Mycobacterium avium
PADLRIPFDPREVIARIVDGSEF

SEQ ID NO: 82939 - protein, 25 aa, Mycobacterium avium
PADRHPHCAWTVIIDESYPEAQPIP

SEQ ID NO: 82940 - protein, 25 aa, Mycobacterium avium
PAELHFLGAVLWRRGIHRVLREFVE

SEQ ID NO: 82941 - protein, 24 aa, Mycobacterium avium
PAEVRRIEHQVAREVVAEVDMRPR

SEQ ID NO: 82942 - protein, 23 aa, Mycobacterium avium
PAFDRLLASLPWPLNKTTTVDKC

SEQ ID NO: 82943 - protein, 19 aa, Mycobacterium avium
PAFDYHRVGATWEYSANAY

SEQ ID NO: 82944 - protein, 23 aa, Mycobacterium avium
PAFGDSIGGMFIAGGISAALLHR

SEQ ID NO: 82945 - protein, 24 aa, Mycobacterium avium
PAFLLNEMLVWGFTGQVISALLDV

SEQ ID NO: 82946 - protein, 22 aa, Mycobacterium avium
PAGAYFKGGISPVTVWVSTEYV

SEQ ID NO: 82947 - protein, 17 aa, Mycobacterium avium
PAGEWMPAVIAAADQRL

SEQ ID NO: 82948 - protein, 19 aa, Mycobacterium avium
PAGLARQAAATAQAAGTGA

SEQ ID NO: 82949 - protein, 18 aa, Mycobacterium avium
PAGWSHFDADRWELFHIE

SEQ ID NO: 82950 - protein, 25 aa, Mycobacterium avium
PAIARSREVWLMVSGAGKADAVAAA

SEQ ID NO: 82951 - protein, 20 aa, Mycobacterium avium
PAIERRGSGLSGVDVLALPA

SEQ ID NO: 82952 - protein, 20 aa, Mycobacterium avium
PAIKGMWTVPVFGNPTGVTY

SEQ ID NO: 82953 - protein, 17 aa, Mycobacterium avium
PAKVVAMCNQKGGVGKT

SEQ ID NO: 82954 - protein, 22 aa, Mycobacterium avium
PALAATSWALLGMMSYEEEVSG

SEQ ID NO: 82955 - protein, 31 aa, Mycobacterium avium
PALCQLWKDNYCVYGARKLWKTARRDGHDVG

SEQ ID NO: 82956 - protein, 17 aa, Mycobacterium avium
PALEVLLENQMYLHQVV

SEQ ID NO: 82957 - protein, 29 aa, Mycobacterium avium
PALGWALGGAFGIKLARPHAPVVAICGDG

SEQ ID NO: 82958 - protein, 18 aa, Mycobacterium avium
PALIFGLQCAAFMETLDP

SEQ ID NO: 82959 - protein, 18 aa, Mycobacterium avium
PALPHLFFVDGGALAVEN

SEQ ID NO: 82960 - protein, 21 aa, Mycobacterium avium
PAMRISHCRPPGSDRDVVLMH

SEQ ID NO: 82961 - protein, 26 aa, Mycobacterium avium
PAMSKFEVLTAMAFAAFADAPVDVAV

SEQ ID NO: 82962 - protein, 24 aa, Mycobacterium avium
PANDVLLRMCLDYIDRVFGAGSEL

SEQ ID NO: 82963 - protein, 25 aa, Mycobacterium avium
PAPDLEILGNLGLVIGGGFDTTTAL

SEQ ID NO: 82964 - protein, 22 aa, Mycobacterium avium
PAPERAPVVVLWASQTGNAEEL

SEQ ID NO: 82965 - protein, 25 aa, Mycobacterium avium
PAPLAHPGLVCDVAIGQSTLVTQRV

SEQ ID NO: 82966 - protein, 18 aa, Mycobacterium avium
PAPLRAGDRLPIGEHTQD

SEQ ID NO: 82967 - protein, 17 aa, Mycobacterium avium
PAPLSGASRTTWTGDGR

SEQ ID NO: 82968 - protein, 20 aa, Mycobacterium avium
PAPPPRELDMLLTAGERISN

SEQ ID NO: 82969 - protein, 21 aa, Mycobacterium avium
PARFIPMAIPVIWDAEECAKE

SEQ ID NO: 82970 - protein, 22 aa, Mycobacterium avium
PARLAEIGDPWAGMDDAVGDLD

SEQ ID NO: 82971 - protein, 21 aa, Mycobacterium avium
PARLLGSVPDPSKFVGSLGFR

SEQ ID NO: 82972 - protein, 23 aa, Mycobacterium avium
PARPTILAIHGFPDNHHVWDGVA

SEQ ID NO: 82973 - protein, 17 aa, Mycobacterium avium
PASAVALLRAMRAHGYR

SEQ ID NO: 82974 - protein, 18 aa, Mycobacterium avium
PASDLDKWVIYVPGENAD

SEQ ID NO: 82975 - protein, 29 aa, Mycobacterium avium
PASGRPLAMPRLDMVTGLYYLTTEVEGDK

SEQ ID NO: 82976 - protein, 24 aa, Mycobacterium avium
PASIKDRWLLRNRPHLVLDGLRLA

SEQ ID NO: 82977 - protein, 19 aa, Mycobacterium avium
PASILMLFAPGAPREAYFE

SEQ ID NO: 82978 - protein, 19 aa, Mycobacterium avium
PATALCLYDASTLDDGVLA

SEQ ID NO: 82979 - protein, 26 aa, Mycobacterium avium
PATLQRFVDRFAHFNFRDEMVRPSYG

SEQ ID NO: 82980 - protein, 26 aa, Mycobacterium avium
PATLRRFTEKFARFNLPGKAVRPAYG

SEQ ID NO: 82981 - protein, 19 aa, Mycobacterium avium
PAVDAMLAKFTEWESELSA

SEQ ID NO: 82982 - protein, 18 aa, Mycobacterium avium
PAVREALKRLSAASLVEV

SEQ ID NO: 82983 - protein, 20 aa, Mycobacterium avium
PAVRECVRALAAANLLGVGW

SEQ ID NO: 82984 - protein, 18 aa, Mycobacterium avium
PAWTRLRTAHAHKFEPAK

SEQ ID NO: 82985 - protein, 25 aa, Mycobacterium avium
PCPGPLGQRADWWWYDPFQPQPPPT

SEQ ID NO: 82986 - protein, 17 aa, Mycobacterium avium
PCPLLSYQCAIDAVSSR

SEQ ID NO: 82987 - protein, 23 aa, Mycobacterium avium
PCTMCAGALVLARIARLVFGAWE

SEQ ID NO: 82988 - protein, 25 aa, Mycobacterium avium
PDAFLREVVDFELPPEGSYATGIAF

SEQ ID NO: 82989 - protein, 18 aa, Mycobacterium avium
PDAIAIRYGERQWSWAEW

SEQ ID NO: 82990 - protein, 21 aa, Mycobacterium avium
PDALLTRGLYQYRPELPFVLG

SEQ ID NO: 82991 - protein, 25 aa, Mycobacterium avium
PDAPTASGFWHWAVANLPADVTELP

SEQ ID NO: 82992 - protein, 22 aa, Mycobacterium avium
PDDPRYDPILLRDGDTRNVVDA

SEQ ID NO: 82993 - protein, 24 aa, Mycobacterium avium
PDDTPWGGKPVRRLQLPRDAALVT

SEQ ID NO: 82994 - protein, 20 aa, Mycobacterium avium
PDEARPVLHLSNEEAEAVAQ

SEQ ID NO: 82995 - protein, 24 aa, Mycobacterium avium
PDEGAAAVIMCRADLAHKFTDKPV

SEQ ID NO: 82996 - protein, 20 aa, Mycobacterium avium
PDELVFRVNYLGGDMPTFTL

SEQ ID NO: 82997 - protein, 29 aa, Mycobacterium avium
PDEQARELLGILCDLYALSVIEDDKAWYI

SEQ ID NO: 82998 - protein, 18 aa, Mycobacterium avium
PDEVVAFLKAQHNLIEDM

SEQ ID NO: 82999 - protein, 17 aa, Mycobacterium avium
PDEYGALAVHIVENPML

SEQ ID NO: 83000 - protein, 22 aa, Mycobacterium avium
PDFVMCRAELAPVLLGAIRDAW

SEQ ID NO: 83001 - protein, 17 aa, Mycobacterium avium
PDGGRGYMAKIFNDAWM

SEQ ID NO: 83002 - protein, 28 aa, Mycobacterium avium
PDGQPQWPTFGIRLSARPGIPPTHPVHG

SEQ ID NO: 83003 - protein, 17 aa, Mycobacterium avium
PDGRLLADMYHMKEPGR

SEQ ID NO: 83004 - protein, 19 aa, Mycobacterium avium
PDGRPRYVTAIDADTATVR

SEQ ID NO: 83005 - protein, 22 aa, Mycobacterium avium
PDGRPSASLIALRVPLPGTTFI

SEQ ID NO: 83006 - protein, 17 aa, Mycobacterium avium
PDHSVGWTLVGDAAEHQ

SEQ ID NO: 83007 - protein, 22 aa, Mycobacterium avium
PDIETAEWLWVLDPVDGTSNFV

SEQ ID NO: 83008 - protein, 30 aa, Mycobacterium avium
PDISPLQARCGWAIGWKKEAFFGRDALLAE

SEQ ID NO: 83009 - protein, 20 aa, Mycobacterium avium
PDISPRWPALTKPVIGAING

SEQ ID NO: 83010 - protein, 19 aa, Mycobacterium avium
PDLAARSGLRTDPLGRLLT

SEQ ID NO: 83011 - protein, 20 aa, Mycobacterium avium
PDLAHILRIHYALVEELQVT

SEQ ID NO: 83012 - protein, 18 aa, Mycobacterium avium
PDLGGRLRAGRSRNDQVA

SEQ ID NO: 83013 - protein, 19 aa, Mycobacterium avium
PDLGPFGVWLSTRSITAEL

SEQ ID NO: 83014 - protein, 18 aa, Mycobacterium avium
PDLIETWISFKRETEILP

SEQ ID NO: 83015 - protein, 33 aa, Mycobacterium avium
PDLKPLSAPERLRSGWLNGIKHWQVDYTGKCPV

SEQ ID NO: 83016 - protein, 20 aa, Mycobacterium avium
PDLQPGSSIMPGKVNPVIPE

SEQ ID NO: 83017 - protein, 20 aa, Mycobacterium avium
PDLRGKFAVVTGANSGLGFG

SEQ ID NO: 83018 - protein, 24 aa, Mycobacterium avium
PDLRGRLQLMIDFMATRTAFFDEF

SEQ ID NO: 83019 - protein, 17 aa, Mycobacterium avium
PDLRLLGALPTLYDSRT

SEQ ID NO: 83020 - protein, 20 aa, Mycobacterium avium
PDLTAALSSMVFVVRPPTAT

SEQ ID NO: 83021 - protein, 25 aa, Mycobacterium avium
PDLTAGRALAGFGLTEPGAGSDAGA

SEQ ID NO: 83022 - protein, 23 aa, Mycobacterium avium
PDLVDRLAAEFGVQDAEPVVAEP

SEQ ID NO: 83023 - protein, 20 aa, Mycobacterium avium
PDNILCLDVRRGIEQTRAHE

SEQ ID NO: 83024 - protein, 17 aa, Mycobacterium avium
PDQFDWLATRLEIARKL

SEQ ID NO: 83025 - protein, 18 aa, Mycobacterium avium
PDQLAGVIGPLFRSALRA

SEQ ID NO: 83026 - protein, 30 aa, Mycobacterium avium
PDQRRLALRRACAAGALATLVPGAGDCAPR

SEQ ID NO: 83027 - protein, 17 aa, Mycobacterium avium
PDRFSVVVGTGLGGAER

SEQ ID NO: 83028 - protein, 24 aa, Mycobacterium avium
PDRMKSNFELFDFELDERAMEAIS

SEQ ID NO: 83029 - protein, 19 aa, Mycobacterium avium
PDRMSSRILGMGDVLSLIE

SEQ ID NO: 83030 - protein, 18 aa, Mycobacterium avium
PDRRGVLEALDLTHDAAA

SEQ ID NO: 83031 - protein, 30 aa, Mycobacterium avium
PDSHFGFGILTWHLPILFRTPPGYNLLVRG

SEQ ID NO: 83032 - protein, 26 aa, Mycobacterium avium
PDTGYRAPAAFGYRPFEGGLALKRLA

SEQ ID NO: 83033 - protein, 19 aa, Mycobacterium avium
PDTVTAWRRALHRWLQHEV

SEQ ID NO: 83034 - protein, 17 aa, Mycobacterium avium
PDVGKLVELARALGRLS

SEQ ID NO: 83035 - protein, 18 aa, Mycobacterium avium
PDVPPLRVRPRRAATAAH

SEQ ID NO: 83036 - protein, 17 aa, Mycobacterium avium
PDVRPTVWAAVPRIWEK

SEQ ID NO: 83037 - protein, 27 aa, Mycobacterium avium
PDYGMRLSWDFLARSTAGLRDWEERLG

SEQ ID NO: 83038 - protein, 17 aa, Mycobacterium avium
PEADALLVRSATTVDAE

SEQ ID NO: 83039 - protein, 20 aa, Mycobacterium avium
PEALTVFLAPPSWEDLEARL

SEQ ID NO: 83040 - protein, 21 aa, Mycobacterium avium
PEAQLDRFLLKLNVTLPPREA

SEQ ID NO: 83041 - protein, 23 aa, Mycobacterium avium
PEDIADAVAWLASDQSRLVTASQ

SEQ ID NO: 83042 - protein, 18 aa, Mycobacterium avium
PEDVSGMLAARGIVTEVG

SEQ ID NO: 83043 - protein, 17 aa, Mycobacterium avium
PEEFGRFLASQPDLSPK

SEQ ID NO: 83044 - protein, 23 aa, Mycobacterium avium
PEELRPEDEWVLFDYESVSQAFR

SEQ ID NO: 83045 - protein, 25 aa, Mycobacterium avium
PEEMKADFTRCFDLVFAEAAEQGVL

SEQ ID NO: 83046 - protein, 23 aa, Mycobacterium avium
PEEQAGAILFLLSELSSYVTGQT

SEQ ID NO: 83047 - protein, 18 aa, Mycobacterium avium
PEERTTWTGAAMILAADA

SEQ ID NO: 83048 - protein, 25 aa, Mycobacterium avium
PEFDGRIITVPFSFKEIDDDGLISY

SEQ ID NO: 83049 - protein, 21 aa, Mycobacterium avium
PEGPPRFTVAALDLGIKTNTP

SEQ ID NO: 83050 - protein, 21 aa, Mycobacterium avium
PEGQPHFELDFVPAFGSAFQW

SEQ ID NO: 83051 - protein, 17 aa, Mycobacterium avium
PEGTRFLVLAPVVRTRK

SEQ ID NO: 83052 - protein, 27 aa, Mycobacterium avium
PEGVGAWLVLCCRAMRAGAQEALSIAD

SEQ ID NO: 83053 - protein, 20 aa, Mycobacterium avium
PEIAQGLAAVSGRDVTVSFT

SEQ ID NO: 83054 - protein, 18 aa, Mycobacterium avium
PELAFAEHRSCAKAQALV

SEQ ID NO: 83055 - protein, 17 aa, Mycobacterium avium
PELGYRLLQRLGADVAE

SEQ ID NO: 83056 - protein, 19 aa, Mycobacterium avium
PELLAAVERQRLLAGAILG

SEQ ID NO: 83057 - protein, 31 aa, Mycobacterium avium
PELLNLELPFPCVWVTGWSREGGRAAALAPL

SEQ ID NO: 83058 - protein, 21 aa, Mycobacterium avium
PELPVGVRLIFQAAEELMPGG

SEQ ID NO: 83059 - protein, 17 aa, Mycobacterium avium
PELVAVLAGRRIAVLTG

SEQ ID NO: 83060 - protein, 19 aa, Mycobacterium avium
PELVGTFTVLLVENILPEA

SEQ ID NO: 83061 - protein, 26 aa, Mycobacterium avium
PEMAYFEVLHELKLIVDLMYEGGIAR

SEQ ID NO: 83062 - protein, 24 aa, Mycobacterium avium
PEMPEPWPREALDDLLVLLSAGPT

SEQ ID NO: 83063 - protein, 20 aa, Mycobacterium avium
PEPDLPRWRSAIEAATRRWC

SEQ ID NO: 83064 - protein, 18 aa, Mycobacterium avium
PEPGQLWSVWAAEAPDAV

SEQ ID NO: 83065 - protein, 20 aa, Mycobacterium avium
PEPKYGLAVTGIADPNRLLR

SEQ ID NO: 83066 - protein, 20 aa, Mycobacterium avium
PEPLPAPVADQWQDRALCAQ

SEQ ID NO: 83067 - protein, 22 aa, Mycobacterium avium
PEPTFVPVLGRIAAGGPILAEE

SEQ ID NO: 83068 - protein, 23 aa, Mycobacterium avium
PERCARVAGLAVRHARLRHVGPA

SEQ ID NO: 83069 - protein, 20 aa, Mycobacterium avium
PETAWPLGMVTEFAANAAEG

SEQ ID NO: 83070 - protein, 21 aa, Mycobacterium avium
PEVEAAEPLAEWEQELLASAT

SEQ ID NO: 83071 - protein, 17 aa, Mycobacterium avium
PEVEVEGIISLKTGGCP

SEQ ID NO: 83072 - protein, 19 aa, Mycobacterium avium
PEVIASPTPASAGRVQSWV

SEQ ID NO: 83073 - protein, 23 aa, Mycobacterium avium
PEVIPKLMSAGVIEVAPLAYMRG

SEQ ID NO: 83074 - protein, 20 aa, Mycobacterium avium
PEVLARLTAQRAHWPVGTLQ

SEQ ID NO: 83075 - protein, 23 aa, Mycobacterium avium
PEVRSKRLIIDYADRTCKGVTVI

SEQ ID NO: 83076 - protein, 20 aa, Mycobacterium avium
PEVVIPMLVPDGAHSYPDAA

SEQ ID NO: 83077 - protein, 20 aa, Mycobacterium avium
PEYPAAAILGNYLPRYLRGI

SEQ ID NO: 83078 - protein, 18 aa, Mycobacterium avium
PFAATAIGLAVFLDKESG

SEQ ID NO: 83079 - protein, 22 aa, Mycobacterium avium
PFACKRPIIDQGYYETFNRDNV

SEQ ID NO: 83080 - protein, 24 aa, Mycobacterium avium
PFAGHPTVGAAWWLREQGSPINTL

SEQ ID NO: 83081 - protein, 21 aa, Mycobacterium avium
PFAPGCTRVEQGIKNGFSGNH

SEQ ID NO: 83082 - protein, 18 aa, Mycobacterium avium
PFDAYLTMRGLKTLVLRM

SEQ ID NO: 83083 - protein, 21 aa, Mycobacterium avium
PFDLDGRWVGEASFVLPTDLP

SEQ ID NO: 83084 - protein, 19 aa, Mycobacterium avium
PFDLLARTRFRVTVNTDNR

SEQ ID NO: 83085 - protein, 18 aa, Mycobacterium avium
PFEPFAVAAVELAKEGLI

SEQ ID NO: 83086 - protein, 20 aa, Mycobacterium avium
PFFASLLEFITSGPVVAAIV

SEQ ID NO: 83087 - protein, 22 aa, Mycobacterium avium
PFGELVFPLPATELPYLHPVTV

SEQ ID NO: 83088 - protein, 18 aa, Mycobacterium avium
PFGGFRLSGLGREGGGIG

SEQ ID NO: 83089 - protein, 27 aa, Mycobacterium avium
PFLHKELYREYALRPPKGVLLYGPPGC

SEQ ID NO: 83090 - protein, 33 aa, Mycobacterium avium
PFSPVCRPDCPGLCPECGVSLAAEPGHQHDRID

SEQ ID NO: 83091 - protein, 18 aa, Mycobacterium avium
PFSREKVISGVRRACQGR

SEQ ID NO: 83092 - protein, 21 aa, Mycobacterium avium
PFSSLCWGERIAFDNPDSLTL

SEQ ID NO: 83093 - protein, 20 aa, Mycobacterium avium
PFTPRAKKVLELSLREALQL

SEQ ID NO: 83094 - protein, 29 aa, Mycobacterium avium
PFVEQMMNKRVCVRIVARRARSWDHRKLG

SEQ ID NO: 83095 - protein, 27 aa, Mycobacterium avium
PFVLTLRLLVIALRRNEIMNSTWVDTP

SEQ ID NO: 83096 - protein, 19 aa, Mycobacterium avium
PFWRADGFSGQALSDEGPV

SEQ ID NO: 83097 - protein, 26 aa, Mycobacterium avium
PGAAELSFRAGIGVKVIAALERIGHT

SEQ ID NO: 83098 - protein, 19 aa, Mycobacterium avium
PGADRLAAEANRRRRELLR

SEQ ID NO: 83099 - protein, 22 aa, Mycobacterium avium
PGAEWCREPGTAGGYVVTADPD

SEQ ID NO: 83100 - protein, 18 aa, Mycobacterium avium
PGALQRLGLDFASVSAAN

SEQ ID NO: 83101 - protein, 20 aa, Mycobacterium avium
PGAPEELWDVLSINNVPDDE

SEQ ID NO: 83102 - protein, 20 aa, Mycobacterium avium
PGAPIARAEVRVSLERILSR

SEQ ID NO: 83103 - protein, 20 aa, Mycobacterium avium
PGAPLARAETRVAIERLLDR

SEQ ID NO: 83104 - protein, 25 aa, Mycobacterium avium
PGAQFELVKLPALDAPPAEMTALAE

SEQ ID NO: 83105 - protein, 21 aa, Mycobacterium avium
PGARLAWREDATWAPHGGESR

SEQ ID NO: 83106 - protein, 17 aa, Mycobacterium avium
PGARLWWQAGHRSTEPG

SEQ ID NO: 83107 - protein, 23 aa, Mycobacterium avium
PGARVPFRRVHLSTGDHFDLYDT

SEQ ID NO: 83108 - protein, 21 aa, Mycobacterium avium
PGAYVAGWIKRGPSGFIGTNK

SEQ ID NO: 83109 - protein, 25 aa, Mycobacterium avium
PGDDVLWRMTHPDKDFRTIADGDTI

SEQ ID NO: 83110 - protein, 22 aa, Mycobacterium avium
PGDEVLLRLFGKIVELAFLAVP

SEQ ID NO: 83111 - protein, 23 aa, Mycobacterium avium
PGDLRVGLRVRVQFHTVAADVTL

SEQ ID NO: 83112 - protein, 18 aa, Mycobacterium avium
PGDQLVLGASNPVRDAAL

SEQ ID NO: 83113 - protein, 24 aa, Mycobacterium avium
PGDRIAVLCPQNLDYLIALFGALY

SEQ ID NO: 83114 - protein, 23 aa, Mycobacterium avium
PGECCRLRKVAPLGKTLRGYSAW

SEQ ID NO: 83115 - protein, 24 aa, Mycobacterium avium
PGEISGGMRKRASLARALVMDPQI

SEQ ID NO: 83116 - protein, 19 aa, Mycobacterium avium
PGELHAMMLDMRRTFDEMV

SEQ ID NO: 83117 - protein, 21 aa, Mycobacterium avium
PGEPLSFGGRVTGKRLDESGS

SEQ ID NO: 83118 - protein, 25 aa, Mycobacterium avium
PGGCAGLRYNLFFDDRSLDGDLTAE

SEQ ID NO: 83119 - protein, 18 aa, Mycobacterium avium
PGGCTTQSIVMRSKSGTV

SEQ ID NO: 83120 - protein, 18 aa, Mycobacterium avium
PGGLAVLSYTVWLGPFGG

SEQ ID NO: 83121 - protein, 27 aa, Mycobacterium avium
PGGNRPWRPDVVHAHDWLVAHPAIALA

SEQ ID NO: 83122 - protein, 24 aa, Mycobacterium avium
PGGQTQFAAPVWMPRARRDSIREV

SEQ ID NO: 83123 - protein, 18 aa, Mycobacterium avium
PGGRLVVCEFSTPSNALF

SEQ ID NO: 83124 - protein, 26 aa, Mycobacterium avium
PGGRLYALPPRGRFVLTDTDRQLVAF

SEQ ID NO: 83125 - protein, 23 aa, Mycobacterium avium
PGGYLKAAVDFALDRDDYGPDLR

SEQ ID NO: 83126 - protein, 23 aa, Mycobacterium avium
PGHPESLVNWDALAALTGTIVLL

SEQ ID NO: 83127 - protein, 23 aa, Mycobacterium avium
PGHVCPISMTYAVVPALRFNPEL

SEQ ID NO: 83128 - protein, 17 aa, Mycobacterium avium
PGILYRLHLDLASLSIA

SEQ ID NO: 83129 - protein, 20 aa, Mycobacterium avium
PGIPESFKVLLKELQSLCLN

SEQ ID NO: 83130 - protein, 23 aa, Mycobacterium avium
PGKGNAMGPAFWSELPELFETLD

SEQ ID NO: 83131 - protein, 19 aa, Mycobacterium avium
PGKLPAIRQQIWTLIRAAK

SEQ ID NO: 83132 - protein, 19 aa, Mycobacterium avium
PGLARAVVNLHRRYRITTA

SEQ ID NO: 83133 - protein, 19 aa, Mycobacterium avium
PGLARLIANRFRRALPPVL

SEQ ID NO: 83134 - protein, 20 aa, Mycobacterium avium
PGLGASPSWHAFAVDQTGIA

SEQ ID NO: 83135 - protein, 19 aa, Mycobacterium avium
PGLGRKSATRKAKGAKGKA

SEQ ID NO: 83136 - protein, 17 aa, Mycobacterium avium
PGLMLAMGPGFCSELVL

SEQ ID NO: 83137 - protein, 19 aa, Mycobacterium avium
PGLQEKPLSIALREIHGDL

SEQ ID NO: 83138 - protein, 17 aa, Mycobacterium avium
PGLRALQKYAVRVGGGV

SEQ ID NO: 83139 - protein, 24 aa, Mycobacterium avium
PGLWANLACRKRFIADKLKESLDD

SEQ ID NO: 83140 - protein, 19 aa, Mycobacterium avium
PGMNGIDVCRVLRADSGVP

SEQ ID NO: 83141 - protein, 20 aa, Mycobacterium avium
PGMVERRAGGILISGSAAGN

SEQ ID NO: 83142 - protein, 20 aa, Mycobacterium avium
PGMYGRVALIQTMREVSQEL

SEQ ID NO: 83143 - protein, 24 aa, Mycobacterium avium
PGNLDIADWWAYLDDVQSTYPLSY

SEQ ID NO: 83144 - protein, 22 aa, Mycobacterium avium
PGNPRVGLAQVYGAPGTASATI

SEQ ID NO: 83145 - protein, 27 aa, Mycobacterium avium
PGNSLFINVNCWGRLVTGVGAALGKGA

SEQ ID NO: 83146 - protein, 21 aa, Mycobacterium avium
PGNVIRLGAAIGDTVTAGQSL

SEQ ID NO: 83147 - protein, 20 aa, Mycobacterium avium
PGPDPAALGRLAGILVAGQR

SEQ ID NO: 83148 - protein, 20 aa, Mycobacterium avium
PGPDRVPLLALLRSTPLTEE

SEQ ID NO: 83149 - protein, 18 aa, Mycobacterium avium
PGPGFARFVESMRRLQDL

SEQ ID NO: 83150 - protein, 24 aa, Mycobacterium avium
PGQCQSELQFFYELGKRIRQRLAG

SEQ ID NO: 83151 - protein, 20 aa, Mycobacterium avium
PGQPGLAGLMNFLDGSDGNV

SEQ ID NO: 83152 - protein, 20 aa, Mycobacterium avium
PGRDDWAVHVALWQRPTNGR

SEQ ID NO: 83153 - protein, 24 aa, Mycobacterium avium
PGRLSSRFWRLLGASTEKNRSRSL

SEQ ID NO: 83154 - protein, 24 aa, Mycobacterium avium
PGRPMPAFIVRRASENVLDAAMKG

SEQ ID NO: 83155 - protein, 21 aa, Mycobacterium avium
PGRPPLMFRAVRQMDRGGTRH

SEQ ID NO: 83156 - protein, 25 aa, Mycobacterium avium
PGSDFELAQGFLLTEGIIGAREDVH

SEQ ID NO: 83157 - protein, 22 aa, Mycobacterium avium
PGSIGLMIAMGPAFCSELVLLA

SEQ ID NO: 83158 - protein, 17 aa, Mycobacterium avium
PGSWTRFGRWLREPVGP

SEQ ID NO: 83159 - protein, 20 aa, Mycobacterium avium
PGTFLLESAEHGRSWSRWSF

SEQ ID NO: 83160 - protein, 17 aa, Mycobacterium avium
PGTGDVIAVIDPATEEK

SEQ ID NO: 83161 - protein, 20 aa, Mycobacterium avium
PGTPVAMTMNLDWHTDGTPY

SEQ ID NO: 83162 - protein, 17 aa, Mycobacterium avium
PGTPVVIGRDVSGPDED

SEQ ID NO: 83163 - protein, 20 aa, Mycobacterium avium
PGTRPAPAFTPARPDEFTAL

SEQ ID NO: 83164 - protein, 26 aa, Mycobacterium avium
PGTSFARWSSILAEYAKSPAVVAAAA

SEQ ID NO: 83165 - protein, 20 aa, Mycobacterium avium
PGVHLSGGISNVSFSFRGNN

SEQ ID NO: 83166 - protein, 25 aa, Mycobacterium avium
PGVLSGKIRLCLGYTEPEGGSDVAT

SEQ ID NO: 83167 - protein, 27 aa, Mycobacterium avium
PGVSCVKPAGALYAFPRLDPEVYDITD

SEQ ID NO: 83168 - protein, 19 aa, Mycobacterium avium
PGYDLTYNDVFIMPNRSEV

SEQ ID NO: 83169 - protein, 24 aa, Mycobacterium avium
PHADVPKLLAAGAAAVFPTGTPLD

SEQ ID NO: 83170 - protein, 24 aa, Mycobacterium avium
PHALQLIMDSLRYWVTEMHVDGFR

SEQ ID NO: 83171 - protein, 23 aa, Mycobacterium avium
PHETRLLLRKSLKLLRDKQLWFR

SEQ ID NO: 83172 - protein, 18 aa, Mycobacterium avium
PHLCSRAFITEQYDRYVR

SEQ ID NO: 83173 - protein, 26 aa, Mycobacterium avium
PHPTSRRELLAALTTRGRDVVHQVTA

SEQ ID NO: 83174 - protein, 26 aa, Mycobacterium avium
PHQIPRAGNMLSVFFTDTPVTDFASA

SEQ ID NO: 83175 - protein, 18 aa, Mycobacterium avium
PHRGRLNVLANIVGKPYS

SEQ ID NO: 83176 - protein, 22 aa, Mycobacterium avium
PHRRPMQLIAERACALTDAEQA

SEQ ID NO: 83177 - protein, 23 aa, Mycobacterium avium
PHRVGVSLVLPGIINTELSAGTK

SEQ ID NO: 83178 - protein, 26 aa, Mycobacterium avium
PHTDIRPGLLVQLAFAAADFGFQQWV

SEQ ID NO: 83179 - protein, 25 aa, Mycobacterium avium
PHTKPPDFWAWLIAAVKGIDPDVLF

SEQ ID NO: 83180 - protein, 25 aa, Mycobacterium avium
PIAAESRIGYALRRISPGAIRLLAR

SEQ ID NO: 83181 - protein, 19 aa, Mycobacterium avium
PIALEFLLQLLVPLDVATR

SEQ ID NO: 83182 - protein, 20 aa, Mycobacterium avium
PIARTVIDAAVFLDATSTVP

SEQ ID NO: 83183 - protein, 18 aa, Mycobacterium avium
PIASELILPIAVAVQNRI

SEQ ID NO: 83184 - protein, 25 aa, Mycobacterium avium
PIDEISVLVPDDFVGAVMGDLSGRR

SEQ ID NO: 83185 - protein, 24 aa, Mycobacterium avium
PIDISGPEPLSWHTATIAPESACT

SEQ ID NO: 83186 - protein, 25 aa, Mycobacterium avium
PIDPWGGSYYVEWLTHHLARKARAH

SEQ ID NO: 83187 - protein, 20 aa, Mycobacterium avium
PIELTLEMASEAGLQVDEVG

SEQ ID NO: 83188 - protein, 24 aa, Mycobacterium avium
PIFSVYGRNAWKSRLRSHPDVASA

SEQ ID NO: 83189 - protein, 23 aa, Mycobacterium avium
PIFVMSRITGWTAHIIEQTASNA

SEQ ID NO: 83190 - protein, 17 aa, Mycobacterium avium
PIIVWGAHRIWPKDHPK

SEQ ID NO: 83191 - protein, 19 aa, Mycobacterium avium
PILRSRGLFRASYAEATLR

SEQ ID NO: 83192 - protein, 29 aa, Mycobacterium avium
PINMFEFARPVVEACGVNWPRVRVNGPIV

SEQ ID NO: 83193 - protein, 25 aa, Mycobacterium avium
PIPLPLKTSYAWAAARYGGDDPVAE

SEQ ID NO: 83194 - protein, 20 aa, Mycobacterium avium
PIQGLGAGFVPPVLAMDLVD

SEQ ID NO: 83195 - protein, 22 aa, Mycobacterium avium
PIQPGRPCRLLGLLFDDADGCA

SEQ ID NO: 83196 - protein, 23 aa, Mycobacterium avium
PITIRGAVFGNLYLTHVDEARVF

SEQ ID NO: 83197 - protein, 20 aa, Mycobacterium avium
PIYHREWWDRYVAVNRRFAE

SEQ ID NO: 83198 - protein, 20 aa, Mycobacterium avium
PIYPCQDGYVRLCVMAPRQW

SEQ ID NO: 83199 - protein, 18 aa, Mycobacterium avium
PKALRARLDRPFDVDELT

SEQ ID NO: 83200 - protein, 21 aa, Mycobacterium avium
PKEFGASWQVVVYTGPEETTP

SEQ ID NO: 83201 - protein, 19 aa, Mycobacterium avium
PKELVARVRARLRRNDDEP

SEQ ID NO: 83202 - protein, 18 aa, Mycobacterium avium
PKFTPAREALDNPTYRLV

SEQ ID NO: 83203 - protein, 21 aa, Mycobacterium avium
PKGAQWDAAMRYWQQLRTDPG

SEQ ID NO: 83204 - protein, 20 aa, Mycobacterium avium
PKIISGEAVLAIAMTEPGTG

SEQ ID NO: 83205 - protein, 22 aa, Mycobacterium avium
PKIRLGRFATGPTYWADGETVR

SEQ ID NO: 83206 - protein, 17 aa, Mycobacterium avium
PKLASVLVAETPVRGAM

SEQ ID NO: 83207 - protein, 19 aa, Mycobacterium avium
PKLRRAGLDYHDLASVTVH

SEQ ID NO: 83208 - protein, 21 aa, Mycobacterium avium
PKPAGMPADLAIYRLKTLKEL

SEQ ID NO: 83209 - protein, 19 aa, Mycobacterium avium
PKPPPQRITLTLPAIARSR

SEQ ID NO: 83210 - protein, 18 aa, Mycobacterium avium
PKTAWLFTGQGSQYAGMA

SEQ ID NO: 83211 - protein, 23 aa, Mycobacterium avium
PKTLIQHLIRWVISSEEFAPEVG

SEQ ID NO: 83212 - protein, 20 aa, Mycobacterium avium
PKVFFQVYWLGGRDAIAERV

SEQ ID NO: 83213 - protein, 17 aa, Mycobacterium avium
PKVKAEAAAEAKEVIEA

SEQ ID NO: 83214 - protein, 18 aa, Mycobacterium avium
PLAAARWGLDTLADGVVD

SEQ ID NO: 83215 - protein, 21 aa, Mycobacterium avium
PLAARGCELVLVLGGDGTFLR

SEQ ID NO: 83216 - protein, 19 aa, Mycobacterium avium
PLACPGLLGAMTVGATTVF

SEQ ID NO: 83217 - protein, 22 aa, Mycobacterium avium
PLADFYAKDATYGWNIGPKEDV

SEQ ID NO: 83218 - protein, 19 aa, Mycobacterium avium
PLAGDALCRAVRRAVESGP

SEQ ID NO: 83219 - protein, 18 aa, Mycobacterium avium
PLAPVAAAAAAGMALPSR

SEQ ID NO: 83220 - protein, 27 aa, Mycobacterium avium
PLATPDFPLLVAHGMACVLHCHGARFD

SEQ ID NO: 83221 - protein, 19 aa, Mycobacterium avium
PLDEIPMLLQPGVLSIAWG

SEQ ID NO: 83222 - protein, 24 aa, Mycobacterium avium
PLDFRRASCCLFYRLPGGSVCGDC

SEQ ID NO: 83223 - protein, 21 aa, Mycobacterium avium
PLDRPFAWALIKLDGADTPLL

SEQ ID NO: 83224 - protein, 24 aa, Mycobacterium avium
PLDWAVELDERWVIVGPNGAGKTS

SEQ ID NO: 83225 - protein, 17 aa, Mycobacterium avium
PLEIAREEVVAFGDMPN

SEQ ID NO: 83226 - protein, 20 aa, Mycobacterium avium
PLEVLRRALPAGIVCVQNAY

SEQ ID NO: 83227 - protein, 27 aa, Mycobacterium avium
PLGEKVLDCAINWKLAIDTFAENYHFA

SEQ ID NO: 83228 - protein, 21 aa, Mycobacterium avium
PLGSRLGHFFRGVGLTIHEGY

SEQ ID NO: 83229 - protein, 23 aa, Mycobacterium avium
PLHSCSLLIPALLSTAATRSATT

SEQ ID NO: 83230 - protein, 26 aa, Mycobacterium avium
PLIPARRLSEKTGCTVHLKVEGLNPT

SEQ ID NO: 83231 - protein, 20 aa, Mycobacterium avium
PLIRVIEDAMRFYLEAYHDL

SEQ ID NO: 83232 - protein, 18 aa, Mycobacterium avium
PLISDSFEAQEMAEHVKD

SEQ ID NO: 83233 - protein, 17 aa, Mycobacterium avium
PLLAALRPELGCILQPL

SEQ ID NO: 83234 - protein, 18 aa, Mycobacterium avium
PLLVACDLQRPAAVNQLQ

SEQ ID NO: 83235 - protein, 22 aa, Mycobacterium avium
PLLVELHRATGLVVHLAVLDGP

SEQ ID NO: 83236 - protein, 29 aa, Mycobacterium avium
PLMPPQMLHMILPRKDYEIVEDSWNVVGL

SEQ ID NO: 83237 - protein, 21 aa, Mycobacterium avium
PLNALGCLIRSITLRMTTAPV

SEQ ID NO: 83238 - protein, 24 aa, Mycobacterium avium
PLPASGRTAERWQRLAELAAENIV

SEQ ID NO: 83239 - protein, 23 aa, Mycobacterium avium
PLPRSEAKGVTFVEPVLVGEVRY

SEQ ID NO: 83240 - protein, 22 aa, Mycobacterium avium
PLPTEKNVYCVIRSPHKYKDSR

SEQ ID NO: 83241 - protein, 22 aa, Mycobacterium avium
PLPTWTHRRLWLTDGGLESPTH

SEQ ID NO: 83242 - protein, 18 aa, Mycobacterium avium
PLQRLLREAPAELVGGIV

SEQ ID NO: 83243 - protein, 26 aa, Mycobacterium avium
PLRAEAAFEYAARLGYDGVELMVWAE

SEQ ID NO: 83244 - protein, 19 aa, Mycobacterium avium
PLRRGLVWRRRASELRTEA

SEQ ID NO: 83245 - protein, 24 aa, Mycobacterium avium
PLSAKLELLAAVAATGVREVEATA

SEQ ID NO: 83246 - protein, 24 aa, Mycobacterium avium
PLSIGYRLARGIAHNATKADPEAH

SEQ ID NO: 83247 - protein, 17 aa, Mycobacterium avium
PLTEVIFATDKDTGGEA

SEQ ID NO: 83248 - protein, 18 aa, Mycobacterium avium
PLTPGGPGLMWGGGTIAA

SEQ ID NO: 83249 - protein, 23 aa, Mycobacterium avium
PLTSGVWRGDWGQPQGRSAISDI

SEQ ID NO: 83250 - protein, 18 aa, Mycobacterium avium
PLVAPIWFVVDDGELAFN

SEQ ID NO: 83251 - protein, 25 aa, Mycobacterium avium
PLWAVWRFGTDPAFTQISMEFMALA

SEQ ID NO: 83252 - protein, 23 aa, Mycobacterium avium
PMAGTGWLHGWRLTFGGEDIGWE

SEQ ID NO: 83253 - protein, 21 aa, Mycobacterium avium
PMDRVICGDVGYGKTEIAVRA

SEQ ID NO: 83254 - protein, 25 aa, Mycobacterium avium
PMHLHRHTFEITRFAGTPTAGVRKD

SEQ ID NO: 83255 - protein, 23 aa, Mycobacterium avium
PMIADGRVRPIIGARLPIQQAGD

SEQ ID NO: 83256 - protein, 19 aa, Mycobacterium avium
PMIARRGLTLVGFAVSGID

SEQ ID NO: 83257 - protein, 24 aa, Mycobacterium avium
PMIRKGAMKNTTWIKAYEDANVDI

SEQ ID NO: 83258 - protein, 25 aa, Mycobacterium avium
PMKPKLDVLDFWSVVKPELPGIKGL

SEQ ID NO: 83259 - protein, 18 aa, Mycobacterium avium
PMLEMPAAEFQRIQDTNV

SEQ ID NO: 83260 - protein, 30 aa, Mycobacterium avium
PMMARNILESFKLLTNVSRLFAERCISGLS

SEQ ID NO: 83261 - protein, 19 aa, Mycobacterium avium
PNANGRIPFDTALLSEALA

SEQ ID NO: 83262 - protein, 21 aa, Mycobacterium avium
PNARPPVCKIMDYGKFKYEAA

SEQ ID NO: 83263 - protein, 22 aa, Mycobacterium avium
PNARTRFVLVGPPAPPPARTGA

SEQ ID NO: 83264 - protein, 17 aa, Mycobacterium avium
PNLLKVIEAYAKYNIRR

SEQ ID NO: 83265 - protein, 23 aa, Mycobacterium avium
PNPKATVALLRRVEDVLDIEVPL

SEQ ID NO: 83266 - protein, 18 aa, Mycobacterium avium
PNQRLRLETTPDRLTTRV

SEQ ID NO: 83267 - protein, 25 aa, Mycobacterium avium
PNRGFLRCVAALARAADTIGETDEY

SEQ ID NO: 83268 - protein, 20 aa, Mycobacterium avium
PNSHMAFGFGTHFCLGNQLA

SEQ ID NO: 83269 - protein, 20 aa, Mycobacterium avium
PNVLIYAAMDGWRRQMVQHG

SEQ ID NO: 83270 - protein, 27 aa, Mycobacterium avium
PNVNIRLAIDWLDRWADDMPLSLLGTV

SEQ ID NO: 83271 - protein, 24 aa, Mycobacterium avium
PPAAAAPQGWGSCSQFVTDTSDIP

SEQ ID NO: 83272 - protein, 18 aa, Mycobacterium avium
PPDFNWPGWERKRQHVMT

SEQ ID NO: 83273 - protein, 25 aa, Mycobacterium avium
PPDIDRLTAVLARVRDGVRFCAVCG

SEQ ID NO: 83274 - protein, 22 aa, Mycobacterium avium
PPELETRIAILRKKAQMERLAV

SEQ ID NO: 83275 - protein, 18 aa, Mycobacterium avium
PPELYRITYDGSIADEPH

SEQ ID NO: 83276 - protein, 19 aa, Mycobacterium avium
PPGCGKTFVVRALASTGQL

SEQ ID NO: 83277 - protein, 17 aa, Mycobacterium avium
PPGIGIAPLRHAIAAQR

SEQ ID NO: 83278 - protein, 27 aa, Mycobacterium avium
PPGPPFSEFDRTAGFGIYGTAKAALNR

SEQ ID NO: 83279 - protein, 27 aa, Mycobacterium avium
PPINMNPRWLGAHPAYTLSKYGMTLLS

SEQ ID NO: 83280 - protein, 28 aa, Mycobacterium avium
PPLTMKPDVCWQLPIRRSQEWVTRPDGT

SEQ ID NO: 83281 - protein, 20 aa, Mycobacterium avium
PPLYAEHWEPLWAACAEAGV

SEQ ID NO: 83282 - protein, 21 aa, Mycobacterium avium
PPMKWNAWGDPAAAKPLSEGI

SEQ ID NO: 83283 - protein, 18 aa, Mycobacterium avium
PPPAPRALLALLKGPPPD

SEQ ID NO: 83284 - protein, 22 aa, Mycobacterium avium
PPPDACPLCPGPTGLTSEVPAA

SEQ ID NO: 83285 - protein, 18 aa, Mycobacterium avium
PPPPRLPFDPALQPARAL

SEQ ID NO: 83286 - protein, 17 aa, Mycobacterium avium
PPQGDWLRRYSASGSPV

SEQ ID NO: 83287 - protein, 25 aa, Mycobacterium avium
PPRLWPEYHPGYFGAFVRDPDGNNV

SEQ ID NO: 83288 - protein, 19 aa, Mycobacterium avium
PPSIREIGDAVGLTSTSSV

SEQ ID NO: 83289 - protein, 19 aa, Mycobacterium avium
PPSPFPVITNPAGGFGTLA

SEQ ID NO: 83290 - protein, 22 aa, Mycobacterium avium
PPSTEEAVRWLAAVRDGKPEPP

SEQ ID NO: 83291 - protein, 17 aa, Mycobacterium avium
PPSVKGILVTEGVRGDG

SEQ ID NO: 83292 - protein, 33 aa, Mycobacterium avium
PPTHRIWALESGFTFPVLSDFWPHGAVSQSYGV

SEQ ID NO: 83293 - protein, 25 aa, Mycobacterium avium
PPTTFPKWLGRSWRRSAMLRYGENP

SEQ ID NO: 83294 - protein, 21 aa, Mycobacterium avium
PPVRELMGYRWSARDEWLHRR

SEQ ID NO: 83295 - protein, 17 aa, Mycobacterium avium
PPWWLKPANKLFIRLSR

SEQ ID NO: 83296 - protein, 21 aa, Mycobacterium avium
PPYHIYCRAIDSGQFREVSAT

SEQ ID NO: 83297 - protein, 19 aa, Mycobacterium avium
PQDRIALSQAKSVFREQIP

SEQ ID NO: 83298 - protein, 18 aa, Mycobacterium avium
PQFSRASALLAQALDPFS

SEQ ID NO: 83299 - protein, 18 aa, Mycobacterium avium
PQGSIPVIGTFTELLNTS

SEQ ID NO: 83300 - protein, 17 aa, Mycobacterium avium
PQHHDMGLISAYMFILL

SEQ ID NO: 83301 - protein, 20 aa, Mycobacterium avium
PQHRGLREPFGAEVFHVNPV

SEQ ID NO: 83302 - protein, 24 aa, Mycobacterium avium
PQHTRLRKIISRAFTPRAVERLRD

SEQ ID NO: 83303 - protein, 22 aa, Mycobacterium avium
PQIPEMAQWGIFLRNHDELTLE

SEQ ID NO: 83304 - protein, 17 aa, Mycobacterium avium
PQISFFFYTHGDFFEEI

SEQ ID NO: 83305 - protein, 23 aa, Mycobacterium avium
PQLFKQLLMVAGMERYYQIARCY

SEQ ID NO: 83306 - protein, 18 aa, Mycobacterium avium
PQPCAGAYLAVLAEGVIT

SEQ ID NO: 83307 - protein, 19 aa, Mycobacterium avium
PQPGVAFAQARSVAVDVLR

SEQ ID NO: 83308 - protein, 17 aa, Mycobacterium avium
PQTRFQPTAAMLAELDP

SEQ ID NO: 83309 - protein, 20 aa, Mycobacterium avium
PQVRADLLATLDVLRADATE

SEQ ID NO: 83310 - protein, 19 aa, Mycobacterium avium
PQVVKEVAPLPVLAAGGIG

SEQ ID NO: 83311 - protein, 26 aa, Mycobacterium avium
PQVWAMRYTLERAMRGQDTIAVTGNI

SEQ ID NO: 83312 - protein, 22 aa, Mycobacterium avium
PQYDIPQLLSMYKAGKLNLDDM

SEQ ID NO: 83313 - protein, 22 aa, Mycobacterium avium
PQYMGINWVGPALMRYGTEEQK

SEQ ID NO: 83314 - protein, 22 aa, Mycobacterium avium
PQYRIAVADARTRRDGRSIEII

SEQ ID NO: 83315 - protein, 18 aa, Mycobacterium avium
PRAGTRVVPRPASSSYAQ

SEQ ID NO: 83316 - protein, 17 aa, Mycobacterium avium
PRAQFLAALSAQMRPGD

SEQ ID NO: 83317 - protein, 19 aa, Mycobacterium avium
PRATFLLMQAVHPLLVKEG

SEQ ID NO: 83318 - protein, 19 aa, Mycobacterium avium
PRAVLCVHESVALAAAIGH

SEQ ID NO: 83319 - protein, 20 aa, Mycobacterium avium
PRDALLRLLVDVQYTRNDLS

SEQ ID NO: 83320 - protein, 18 aa, Mycobacterium avium
PRECDAVLYTRAGPEIGV

SEQ ID NO: 83321 - protein, 31 aa, Mycobacterium avium
PREQPVCDARYWANNMRRMVRFATAVQAALE

SEQ ID NO: 83322 - protein, 21 aa, Mycobacterium avium
PREWGDWATRAAMPALRIPDF

SEQ ID NO: 83323 - protein, 18 aa, Mycobacterium avium
PRFARITRLYTARQVAEQ

SEQ ID NO: 83324 - protein, 19 aa, Mycobacterium avium
PRGASFSWYSYSPTRVRYP

SEQ ID NO: 83325 - protein, 22 aa, Mycobacterium avium
PRGRIQLAQFIMRSDLEPDLDV

SEQ ID NO: 83326 - protein, 18 aa, Mycobacterium avium
PRGTDWHPHRGFETVTYL

SEQ ID NO: 83327 - protein, 20 aa, Mycobacterium avium
PRGVNRWAVSLAYLTDALFA

SEQ ID NO: 83328 - protein, 19 aa, Mycobacterium avium
PRGYRLVARPGAVTRRAIS

SEQ ID NO: 83329 - protein, 18 aa, Mycobacterium avium
PRHLRPRSNNVILRETKV

SEQ ID NO: 83330 - protein, 19 aa, Mycobacterium avium
PRHQLYFLGCRLDGMYPLG

SEQ ID NO: 83331 - protein, 17 aa, Mycobacterium avium
PRHVMPVHGTWRMLRAN

SEQ ID NO: 83332 - protein, 17 aa, Mycobacterium avium
PRIAAAAVDAFGSVHGL

SEQ ID NO: 83333 - protein, 19 aa, Mycobacterium avium
PRIDVTVRISGFFRDAFPH

SEQ ID NO: 83334 - protein, 26 aa, Mycobacterium avium
PRIFKRIRPAFTYRRSLDVLTAAREA

SEQ ID NO: 83335 - protein, 20 aa, Mycobacterium avium
PRINAVIDWEIWSIGDPRID

SEQ ID NO: 83336 - protein, 19 aa, Mycobacterium avium
PRKIFDLLEQAPIGVAVVT

SEQ ID NO: 83337 - protein, 25 aa, Mycobacterium avium
PRKRECGLCSITTLVYDGDRLVDVE

SEQ ID NO: 83338 - protein, 20 aa, Mycobacterium avium
PRLIRARRGVILASGGFEHN

SEQ ID NO: 83339 - protein, 19 aa, Mycobacterium avium
PRLLCASCVLTTERPNDAD

SEQ ID NO: 83340 - protein, 23 aa, Mycobacterium avium
PRMALPPCHAFFQFYVADGRLSC

SEQ ID NO: 83341 - protein, 20 aa, Mycobacterium avium
PRNEWLFTDAWGVDVAVSTP

SEQ ID NO: 83342 - protein, 20 aa, Mycobacterium avium
PRPCRIDWDVADRAAHRDGV

SEQ ID NO: 83343 - protein, 21 aa, Mycobacterium avium
PRPDKVLHITALVERTAQIVW

SEQ ID NO: 83344 - protein, 19 aa, Mycobacterium avium
PRPDLRHLNQLADIVKDGN

SEQ ID NO: 83345 - protein, 19 aa, Mycobacterium avium
PRPGETVLASSLRQAPGGK

SEQ ID NO: 83346 - protein, 23 aa, Mycobacterium avium
PRPPEVPYYSATLFDPREQPVCD

SEQ ID NO: 83347 - protein, 18 aa, Mycobacterium avium
PRPSGSIRQVRSSRKVAR

SEQ ID NO: 83348 - protein, 19 aa, Mycobacterium avium
PRPTPGYWREVEKQVQAKR

SEQ ID NO: 83349 - protein, 21 aa, Mycobacterium avium
PRQSLREFLGPMITGLDGYPF

SEQ ID NO: 83350 - protein, 18 aa, Mycobacterium avium
PRRAVLVRPPRGLAAAEL

SEQ ID NO: 83351 - protein, 22 aa, Mycobacterium avium
PRRTLDGWQEWAKQRGAKGLAY

SEQ ID NO: 83352 - protein, 24 aa, Mycobacterium avium
PRSDTSLHLARAVLTDWLTQWDIR

SEQ ID NO: 83353 - protein, 25 aa, Mycobacterium avium
PRTAKLPAGFRVVIIGAGIAGITAA

SEQ ID NO: 83354 - protein, 17 aa, Mycobacterium avium
PRTGRFGPVPAHPATGP

SEQ ID NO: 83355 - protein, 19 aa, Mycobacterium avium
PRTRIRTHHLQKMKAEGHK

SEQ ID NO: 83356 - protein, 18 aa, Mycobacterium avium
PRTVEFLDALPLNATGKV

SEQ ID NO: 83357 - protein, 20 aa, Mycobacterium avium
PRTVFQILKRHYARYTPEMV

SEQ ID NO: 83358 - protein, 20 aa, Mycobacterium avium
PRTYLGLGVDGFPNLFLVSG

SEQ ID NO: 83359 - protein, 19 aa, Mycobacterium avium
PRVFMLFVGGFGVYLDICA

SEQ ID NO: 83360 - protein, 17 aa, Mycobacterium avium
PRVLDAIGLDFATVQSI

SEQ ID NO: 83361 - protein, 28 aa, Mycobacterium avium
PRVLQIRALVLGCAMDWLEDNKASTNHI

SEQ ID NO: 83362 - protein, 17 aa, Mycobacterium avium
PRVMDQFGLTADVLLDI

SEQ ID NO: 83363 - protein, 18 aa, Mycobacterium avium
PRVPELFGDAEGLMLSLG

SEQ ID NO: 83364 - protein, 17 aa, Mycobacterium avium
PRVSFLIEDGDTYDTLR

SEQ ID NO: 83365 - protein, 21 aa, Mycobacterium avium
PRYAELIKRTQWWGRQMLIWG

SEQ ID NO: 83366 - protein, 25 aa, Mycobacterium avium
PRYNPWDQRMCLIPDADLYNAITAG

SEQ ID NO: 83367 - protein, 17 aa, Mycobacterium avium
PRYVTAIDADTATVRVG

SEQ ID NO: 83368 - protein, 19 aa, Mycobacterium avium
PSAGHPITIEPTRGRVQVR

SEQ ID NO: 83369 - protein, 18 aa, Mycobacterium avium
PSAIRRLRLTYDDLRRHN

SEQ ID NO: 83370 - protein, 20 aa, Mycobacterium avium
PSANFFCLGPFMSQALYLEG

SEQ ID NO: 83371 - protein, 22 aa, Mycobacterium avium
PSDPFAAFGISGEFGMGDLGQI

SEQ ID NO: 83372 - protein, 19 aa, Mycobacterium avium
PSFIELRTIIGYPAPNAMN

SEQ ID NO: 83373 - protein, 24 aa, Mycobacterium avium
PSGEGLHVGHPLGYIATDVYARYF

SEQ ID NO: 83374 - protein, 20 aa, Mycobacterium avium
PSIRAGEFLIAGAGAGLARR

SEQ ID NO: 83375 - protein, 24 aa, Mycobacterium avium
PSLAELFGQIGMRPGTRNGQFAMT

SEQ ID NO: 83376 - protein, 25 aa, Mycobacterium avium
PSLDIGLPWRQYRSVQRGIAGFSSW

SEQ ID NO: 83377 - protein, 25 aa, Mycobacterium avium
PSLHAGHLVPLLALRRFQRAGHRPI

SEQ ID NO: 83378 - protein, 17 aa, Mycobacterium avium
PSLWPKLASVLVAETPV

SEQ ID NO: 83379 - protein, 25 aa, Mycobacterium avium
PSMPKSVVINPYFDWGNDRPPDHHY

SEQ ID NO: 83380 - protein, 22 aa, Mycobacterium avium
PSMRSLLRMQHRVLAGTRRLFR

SEQ ID NO: 83381 - protein, 21 aa, Mycobacterium avium
PSQANFLWLPLGSRTEDFVQE

SEQ ID NO: 83382 - protein, 20 aa, Mycobacterium avium
PSTDAILTCRLIDRPLRPSF

SEQ ID NO: 83383 - protein, 24 aa, Mycobacterium avium
PSTDEPFSALAFKVATHPFFGKLT

SEQ ID NO: 83384 - protein, 18 aa, Mycobacterium avium
PSTPWPTYPLMYRVSSAH

SEQ ID NO: 83385 - protein, 30 aa, Mycobacterium avium
PSVDARIAARLGLRDDVRRVPLFGLGCVAG

SEQ ID NO: 83386 - protein, 18 aa, Mycobacterium avium
PSVPHVLIEPGVRTGIPL

SEQ ID NO: 83387 - protein, 22 aa, Mycobacterium avium
PSWDINAGYVLRSVHALPKSGT

SEQ ID NO: 83388 - protein, 17 aa, Mycobacterium avium
PSYGLAEATLFVSTTPM

SEQ ID NO: 83389 - protein, 23 aa, Mycobacterium avium
PSYSESFGLVALEAQACGTPVAA

SEQ ID NO: 83390 - protein, 24 aa, Mycobacterium avium
PTAARLGLAGWPRAAEESIVARDA

SEQ ID NO: 83391 - protein, 25 aa, Mycobacterium avium
PTASLDIWWCQGFSEPDAGSDLASL

SEQ ID NO: 83392 - protein, 24 aa, Mycobacterium avium
PTDIQTAVLYDHFTPFTLIQLEEL

SEQ ID NO: 83393 - protein, 17 aa, Mycobacterium avium
PTDKVVVFGAGPIGLGA

SEQ ID NO: 83394 - protein, 18 aa, Mycobacterium avium
PTERELAAGDVLWTDISI

SEQ ID NO: 83395 - protein, 23 aa, Mycobacterium avium
PTFEVVARPGAWEEYFKYGNPEG

SEQ ID NO: 83396 - protein, 25 aa, Mycobacterium avium
PTGDAELLLIGWGSSYGPIGEACRR

SEQ ID NO: 83397 - protein, 20 aa, Mycobacterium avium
PTGLAGLGILISEAVRGEGG

SEQ ID NO: 83398 - protein, 19 aa, Mycobacterium avium
PTGLGMLTVFEELFWGDAG

SEQ ID NO: 83399 - protein, 19 aa, Mycobacterium avium
PTHPVHGPVSLGIAAIETL

SEQ ID NO: 83400 - protein, 20 aa, Mycobacterium avium
PTKFWADVCRHVDLPELADD

SEQ ID NO: 83401 - protein, 30 aa, Mycobacterium avium
PTKGIFTSNFGYRWGVLHAGIDLANSIGTP

SEQ ID NO: 83402 - protein, 22 aa, Mycobacterium avium
PTLIVAPYFRSAIEAAIDGWRR

SEQ ID NO: 83403 - protein, 17 aa, Mycobacterium avium
PTLLIFADSLAYYGPTG

SEQ ID NO: 83404 - protein, 21 aa, Mycobacterium avium
PTLPLPRARTLANYLAAKAAG

SEQ ID NO: 83405 - protein, 26 aa, Mycobacterium avium
PTLPLRIRAAWLWSGRTAVIAGAAAA

SEQ ID NO: 83406 - protein, 18 aa, Mycobacterium avium
PTLQRLRPLPPMRPQHPV

SEQ ID NO: 83407 - protein, 26 aa, Mycobacterium avium
PTNDARFLFHPAMKELTLDIASLVFM

SEQ ID NO: 83408 - protein, 20 aa, Mycobacterium avium
PTPFNLLGIDRWIRNFFYLT

SEQ ID NO: 83409 - protein, 19 aa, Mycobacterium avium
PTPGLARHRIKATAPDGSS

SEQ ID NO: 83410 - protein, 24 aa, Mycobacterium avium
PTPQARLGLISAIRAAGLDCHVMV

SEQ ID NO: 83411 - protein, 25 aa, Mycobacterium avium
PTQKEIFIPGGRMFRDLTRLSAAGI

SEQ ID NO: 83412 - protein, 18 aa, Mycobacterium avium
PTTMPWGNRALLFRDPDG

SEQ ID NO: 83413 - protein, 18 aa, Mycobacterium avium
PTVEHTIEILKGLRDRYE

SEQ ID NO: 83414 - protein, 21 aa, Mycobacterium avium
PTVFCERYLPTGHHVEVQVLA

SEQ ID NO: 83415 - protein, 18 aa, Mycobacterium avium
PTVVVSVPRVFEKVYNTA

SEQ ID NO: 83416 - protein, 18 aa, Mycobacterium avium
PVAGDRALIMAIINRTPD

SEQ ID NO: 83417 - protein, 24 aa, Mycobacterium avium
PVAPGLYSWLPLGLRVLRRIEHIV

SEQ ID NO: 83418 - protein, 17 aa, Mycobacterium avium
PVARLLRDAQVNTIWEG

SEQ ID NO: 83419 - protein, 18 aa, Mycobacterium avium
PVAYAAVGPSFWGDGQYP

SEQ ID NO: 83420 - protein, 19 aa, Mycobacterium avium
PVAYLDMGWPEWMVAVEYD

SEQ ID NO: 83421 - protein, 34 aa, Mycobacterium avium
PVDYPALAALCDIFYPRVFLRRGGFVPSGTISLT

SEQ ID NO: 83422 - protein, 19 aa, Mycobacterium avium
PVEALIGVFDKIGVKTGID

SEQ ID NO: 83423 - protein, 17 aa, Mycobacterium avium
PVEETRQMLGLAAAELY

SEQ ID NO: 83424 - protein, 17 aa, Mycobacterium avium
PVEEVKVGIQILESLNL

SEQ ID NO: 83425 - protein, 19 aa, Mycobacterium avium
PVEFIAAAISTLGSQITDS

SEQ ID NO: 83426 - protein, 19 aa, Mycobacterium avium
PVEGARTWVGVAGTMTTLS

SEQ ID NO: 83427 - protein, 19 aa, Mycobacterium avium
PVEQRAAIVAVDMQGYSVA

SEQ ID NO: 83428 - protein, 17 aa, Mycobacterium avium
PVEWKRDQALKFGATHV

SEQ ID NO: 83429 - protein, 22 aa, Mycobacterium avium
PVGASPPGYLPVLRAYDYAGDE

SEQ ID NO: 83430 - protein, 19 aa, Mycobacterium avium
PVGGWQCRPTAEFGYLACA

SEQ ID NO: 83431 - protein, 26 aa, Mycobacterium avium
PVGLARFCTLRGWLSQWSYDDARGDA

SEQ ID NO: 83432 - protein, 24 aa, Mycobacterium avium
PVGNAGNITAYWKGYTEYHHEGLI

SEQ ID NO: 83433 - protein, 23 aa, Mycobacterium avium
PVHCDVWNGFVFINFDPQPRQSL

SEQ ID NO: 83434 - protein, 20 aa, Mycobacterium avium
PVHGVCSLDAIGGQTTGDTL

SEQ ID NO: 83435 - protein, 19 aa, Mycobacterium avium
PVHQIPQPIAWPGSSDRNF

SEQ ID NO: 83436 - protein, 20 aa, Mycobacterium avium
PVHTRRGKPVIPAWEDVLLG

SEQ ID NO: 83437 - protein, 17 aa, Mycobacterium avium
PVIEVPFDPHLRPGGVI

SEQ ID NO: 83438 - protein, 19 aa, Mycobacterium avium
PVILAAKSKATFRAVAQAM

SEQ ID NO: 83439 - protein, 23 aa, Mycobacterium avium
PVKARKCVFCAKKDQAIDYKDTA

SEQ ID NO: 83440 - protein, 20 aa, Mycobacterium avium
PVLAAPPMRGGLPTAVPTDP

SEQ ID NO: 83441 - protein, 26 aa, Mycobacterium avium
PVLAEWFLRRFSLLDSLYLIPPPRIV

SEQ ID NO: 83442 - protein, 17 aa, Mycobacterium avium
PVLAIKRKNAINEPLFS

SEQ ID NO: 83443 - protein, 23 aa, Mycobacterium avium
PVLECLRAGVPATALYVALGTEA

SEQ ID NO: 83444 - protein, 25 aa, Mycobacterium avium
PVLFGRGSVVFARLVVPTGELLDLH

SEQ ID NO: 83445 - protein, 18 aa, Mycobacterium avium
PVLGDAGLPILGHIIELF

SEQ ID NO: 83446 - protein, 25 aa, Mycobacterium avium
PVLGVCVGMQILFARGVEFSVETSG

SEQ ID NO: 83447 - protein, 25 aa, Mycobacterium avium
PVLNARFALNAANARWGSLYDALYG

SEQ ID NO: 83448 - protein, 27 aa, Mycobacterium avium
PVLPRRLRELIVLRTASAMDCAYELGQ

SEQ ID NO: 83449 - protein, 37 aa, Mycobacterium avium
PVLRACGFDTPYPPARLEKWWLPGPDRLLDCVERTLE

SEQ ID NO: 83450 - protein, 18 aa, Mycobacterium avium
PVMAKARIGHFVEAQILQ

SEQ ID NO: 83451 - protein, 22 aa, Mycobacterium avium
PVMLDMLRWHGAEEVEHKAVAF

SEQ ID NO: 83452 - protein, 24 aa, Mycobacterium avium
PVNWPRVLTVWRANLIGSSGKGGE

SEQ ID NO: 83453 - protein, 24 aa, Mycobacterium avium
PVPNRAPVPVLWLGAGERVSALVS

SEQ ID NO: 83454 - protein, 24 aa, Mycobacterium avium
PVQRTWPELIPLLQSGRLDVDGIF

SEQ ID NO: 83455 - protein, 23 aa, Mycobacterium avium
PVSELRSGGLGVREVKRLSKTTG

SEQ ID NO: 83456 - protein, 25 aa, Mycobacterium avium
PVSMLIPRVVGFKLTGEIQPGVTAT

SEQ ID NO: 83457 - protein, 18 aa, Mycobacterium avium
PVVIEAPEGITFAVQSPT

SEQ ID NO: 83458 - protein, 27 aa, Mycobacterium avium
PVWCSDIRAGAGLVLAGLVADGDTEVH

SEQ ID NO: 83459 - protein, 20 aa, Mycobacterium avium
PVYRSARARLQRLLDEHRAG

SEQ ID NO: 83460 - protein, 18 aa, Mycobacterium avium
PVYVRACEIRTRRYGAYE

SEQ ID NO: 83461 - protein, 19 aa, Mycobacterium avium
PWDKKGYKMPGGTPSSPAL

SEQ ID NO: 83462 - protein, 22 aa, Mycobacterium avium
PWGSRFPRISIRDQVEADIAAL

SEQ ID NO: 83463 - protein, 20 aa, Mycobacterium avium
PWGVMPEKYIARVEDAARQG

SEQ ID NO: 83464 - protein, 18 aa, Mycobacterium avium
PWPTYPLMYRVSSAHEEG

SEQ ID NO: 83465 - protein, 17 aa, Mycobacterium avium
PWQLMPDTFAAFHQPGT

SEQ ID NO: 83466 - protein, 24 aa, Mycobacterium avium
PWSDPRLRQAPTLHLGGTREQMAR

SEQ ID NO: 83467 - protein, 26 aa, Mycobacterium avium
PWWDVAIRLLLKYANLRLMTSAWSPK

SEQ ID NO: 83468 - protein, 23 aa, Mycobacterium avium
PYEAPPRPELRLDGAAKDAETLA

SEQ ID NO: 83469 - protein, 19 aa, Mycobacterium avium
PYEVELCVAEVAHYGETKP

SEQ ID NO: 83470 - protein, 27 aa, Mycobacterium avium
PYGRGFPFALVFGGLYAARGYHVVLQS

SEQ ID NO: 83471 - protein, 18 aa, Mycobacterium avium
PYGTVLIIGAWNYPFYLT

SEQ ID NO: 83472 - protein, 24 aa, Mycobacterium avium
PYIPERWRKFFFEHRVGELIYYDA

SEQ ID NO: 83473 - protein, 23 aa, Mycobacterium avium
PYLHLPAELIGGGTREIQLNIIA

SEQ ID NO: 83474 - protein, 17 aa, Mycobacterium avium
PYLLKLRPDIPVVGSKF

SEQ ID NO: 83475 - protein, 26 aa, Mycobacterium avium
PYLQRACDWAACGRAVFNARDIPELA

SEQ ID NO: 83476 - protein, 17 aa, Mycobacterium avium
PYLVAFQNNSGVRDVYG

SEQ ID NO: 83477 - protein, 17 aa, Mycobacterium avium
PYPELSTGMLLRPVQPP

SEQ ID NO: 83478 - protein, 21 aa, Mycobacterium avium
PYPVWQRMREEAPLYYNEKYN

SEQ ID NO: 83479 - protein, 18 aa, Mycobacterium avium
PYPYTRDGQRRWQPFTDW

SEQ ID NO: 83480 - protein, 20 aa, Mycobacterium avium
QAAGRLDEFAEWAKSLTQRT

SEQ ID NO: 83481 - protein, 25 aa, Mycobacterium avium
QAALLARALGDWIGGRGRLVSFSVQ

SEQ ID NO: 83482 - protein, 25 aa, Mycobacterium avium
QAAMFDGRFLGFADFLVRDGERYQV

SEQ ID NO: 83483 - protein, 23 aa, Mycobacterium avium
QAARKLFAERGFHGTTLADITSA

SEQ ID NO: 83484 - protein, 18 aa, Mycobacterium avium
QAAVWARENIDGVLPERL

SEQ ID NO: 83485 - protein, 28 aa, Mycobacterium avium
QADEFTCSSCFLVQHRSRLASEKNGVMI

SEQ ID NO: 83486 - protein, 21 aa, Mycobacterium avium
QAEGLGQLFVRLLTANFEEAV

SEQ ID NO: 83487 - protein, 27 aa, Mycobacterium avium
QAFDGLRLAGRPVRRPDLTLATEDHNV

SEQ ID NO: 83488 - protein, 17 aa, Mycobacterium avium
QAGALEFIPAKRVGTAA

SEQ ID NO: 83489 - protein, 24 aa, Mycobacterium avium
QAGEIYFSGGYSFEYLNDEAKTAA

SEQ ID NO: 83490 - protein, 23 aa, Mycobacterium avium
QAGHGDRVAIHWEGESPGDQRSL

SEQ ID NO: 83491 - protein, 24 aa, Mycobacterium avium
QAGLAMLAPIWGYKPLLDTDDATA

SEQ ID NO: 83492 - protein, 19 aa, Mycobacterium avium
QAIGVAFGATVDRAPELLH

SEQ ID NO: 83493 - protein, 19 aa, Mycobacterium avium
QALARLPGRALFVTNNASR

SEQ ID NO: 83494 - protein, 20 aa, Mycobacterium avium
QALNVARMRLLGATVVSVQS

SEQ ID NO: 83495 - protein, 17 aa, Mycobacterium avium
QALPALLDSGRGVVVNF

SEQ ID NO: 83496 - protein, 19 aa, Mycobacterium avium
QALVREGLRNVAAGANPLG

SEQ ID NO: 83497 - protein, 25 aa, Mycobacterium avium
QALYREGFFGLSWPREYGGQELAPV

SEQ ID NO: 83498 - protein, 17 aa, Mycobacterium avium
QAMEFLPWGNRQASGDL

SEQ ID NO: 83499 - protein, 18 aa, Mycobacterium avium
QAMLPGHAVVLHPGPMLR

SEQ ID NO: 83500 - protein, 21 aa, Mycobacterium avium
QANADLWLTFAQDYRDETGSK

SEQ ID NO: 83501 - protein, 17 aa, Mycobacterium avium
QAPGLSVRFTGINQSAI

SEQ ID NO: 83502 - protein, 22 aa, Mycobacterium avium
QARTRIRPHFFPFTEPSAEVDV

SEQ ID NO: 83503 - protein, 24 aa, Mycobacterium avium
QASFPLALGYCRDALDLLGEQRWA

SEQ ID NO: 83504 - protein, 38 aa, Mycobacterium avium
QATRCMDCGIPFCHNGCPLGNLIPEWNDLVRTGRWRDA

SEQ ID NO: 83505 - protein, 17 aa, Mycobacterium avium
QATVIKANWQRAAKLLG

SEQ ID NO: 83506 - protein, 23 aa, Mycobacterium avium
QAWLRRVTPRLTRTEIAQHQRVL

SEQ ID NO: 83507 - protein, 21 aa, Mycobacterium avium
QAWRSIPSWEFHRANVDPRRA

SEQ ID NO: 83508 - protein, 24 aa, Mycobacterium avium
QAWTNRSGTEYVWFNNVETRPGQG

SEQ ID NO: 83509 - protein, 19 aa, Mycobacterium avium
QAWWFPAVAPLPGKAPAVM

SEQ ID NO: 83510 - protein, 26 aa, Mycobacterium avium
QCLAYFAHLCGFEFVHEAARDPLFAE

SEQ ID NO: 83511 - protein, 18 aa, Mycobacterium avium
QCRPELIERTFAACQGAP

SEQ ID NO: 83512 - protein, 18 aa, Mycobacterium avium
QDFSLFHVLRYGFRPSKI

SEQ ID NO: 83513 - protein, 22 aa, Mycobacterium avium
QDIRVAAELALPHRRRRDPFDD

SEQ ID NO: 83514 - protein, 21 aa, Mycobacterium avium
QDLARRIALRHSVEMVRVTME

SEQ ID NO: 83515 - protein, 30 aa, Mycobacterium avium
QDLRAAEDALWRWMTAAALVRPRGDGGVVM

SEQ ID NO: 83516 - protein, 25 aa, Mycobacterium avium
QDPALRAPLTWEVDEPCPVPRPETY

SEQ ID NO: 83517 - protein, 21 aa, Mycobacterium avium
QDRGIPFARDIFRYYRSDAAA

SEQ ID NO: 83518 - protein, 24 aa, Mycobacterium avium
QDRPADRPLWLGSIKSNIGHTSAA

SEQ ID NO: 83519 - protein, 23 aa, Mycobacterium avium
QDVLPGDLFAALPGATTHGARHA

SEQ ID NO: 83520 - protein, 20 aa, Mycobacterium avium
QDVSTAWQLDAYRFEIPVLA

SEQ ID NO: 83521 - protein, 17 aa, Mycobacterium avium
QDYDLAELREYIDWQPF

SEQ ID NO: 83522 - protein, 26 aa, Mycobacterium avium
QEAKRGDGWIKLVGDWIDRSVGDLAP

SEQ ID NO: 83523 - protein, 22 aa, Mycobacterium avium
QEALALRFEQIFHHAPASESLL

SEQ ID NO: 83524 - protein, 19 aa, Mycobacterium avium
QEALEALNAAGFNAVHVPE

SEQ ID NO: 83525 - protein, 25 aa, Mycobacterium avium
QEEQWRALAAREFAGRVELGDDLHR

SEQ ID NO: 83526 - protein, 24 aa, Mycobacterium avium
QEIDLRFADALSMADNVMTFRYVI

SEQ ID NO: 83527 - protein, 20 aa, Mycobacterium avium
QEILFPALLPRAPYEATNRW

SEQ ID NO: 83528 - protein, 22 aa, Mycobacterium avium
QEKSWKVKRIRHTPRVTLATCT

SEQ ID NO: 83529 - protein, 35 aa, Mycobacterium avium
QELESFFRGAGWNVIKVVWGREWDALLHADRDGAL

SEQ ID NO: 83530 - protein, 22 aa, Mycobacterium avium
QELKAAKVLQAIGFAPNVEGYG

SEQ ID NO: 83531 - protein, 23 aa, Mycobacterium avium
QENRLLRVIARMDGTAFPTTMRL

SEQ ID NO: 83532 - protein, 19 aa, Mycobacterium avium
QEPRVIGSIVDFRYAPEDP

SEQ ID NO: 83533 - protein, 25 aa, Mycobacterium avium
QEPTVLPSRFPNLLANGSGGIAVGM

SEQ ID NO: 83534 - protein, 17 aa, Mycobacterium avium
QERLNISFDRFIRTTDP

SEQ ID NO: 83535 - protein, 23 aa, Mycobacterium avium
QERPRTAAALGERAQEFLALKVE

SEQ ID NO: 83536 - protein, 24 aa, Mycobacterium avium
QERRGRPAAHLQFGRWHQDRGLSG

SEQ ID NO: 83537 - protein, 24 aa, Mycobacterium avium
QERRTDWLNNFYFGGEHGVADSIA

SEQ ID NO: 83538 - protein, 17 aa, Mycobacterium avium
QETAFRFTDGSGRDAAA

SEQ ID NO: 83539 - protein, 21 aa, Mycobacterium avium
QETRLRVLLVRAGLPKPQTQI

SEQ ID NO: 83540 - protein, 24 aa, Mycobacterium avium
QEVCALLAGGGYAEYVAVPAGQLL

SEQ ID NO: 83541 - protein, 26 aa, Mycobacterium avium
QFAAPRPGRRIGLVFRSSSGRDDSYR

SEQ ID NO: 83542 - protein, 19 aa, Mycobacterium avium
QFEYSKKLLAGFPTDRNIE

SEQ ID NO: 83543 - protein, 21 aa, Mycobacterium avium
QFISSPGYEHAWLNPDNTEVS

SEQ ID NO: 83544 - protein, 26 aa, Mycobacterium avium
QFKSYRGMGSLGAMAGRGSGAGKSYS

SEQ ID NO: 83545 - protein, 33 aa, Mycobacterium avium
QFMERRVPPRWWPPVMKKFVWPWVAGRRQVVVN

SEQ ID NO: 83546 - protein, 21 aa, Mycobacterium avium
QFPAYELTALIAGDLSKVDAK

SEQ ID NO: 83547 - protein, 22 aa, Mycobacterium avium
QGARPPLVKRMVLQTAARLSRR

SEQ ID NO: 83548 - protein, 17 aa, Mycobacterium avium
QGAVHLDKGCYRGQETV

SEQ ID NO: 83549 - protein, 22 aa, Mycobacterium avium
QGDHLWMIYLMRVVDAQTVLDK

SEQ ID NO: 83550 - protein, 18 aa, Mycobacterium avium
QGFIRKSGSWFTYEGEQL

SEQ ID NO: 83551 - protein, 17 aa, Mycobacterium avium
QGGFLDFDAAIATPDQM

SEQ ID NO: 83552 - protein, 17 aa, Mycobacterium avium
QGGMWCYQVAAYRRSKS

SEQ ID NO: 83553 - protein, 24 aa, Mycobacterium avium
QGGYGLDPERIWTTVYFDDDEAVR

SEQ ID NO: 83554 - protein, 18 aa, Mycobacterium avium
QGKLADKVYAAFTSSNTL

SEQ ID NO: 83555 - protein, 25 aa, Mycobacterium avium
QGLTDRLRRSFGRMPWTTTQKRRPR

SEQ ID NO: 83556 - protein, 19 aa, Mycobacterium avium
QGLWAAHLRPELGGQGFGQ

SEQ ID NO: 83557 - protein, 23 aa, Mycobacterium avium
QGMQRFAPLNSWPDNVSLDKARR

SEQ ID NO: 83558 - protein, 26 aa, Mycobacterium avium
QGRFPYRNDGALGWVGTSPVGVFAPN

SEQ ID NO: 83559 - protein, 22 aa, Mycobacterium avium
QGRGRGGIRLTVAMTVTDDHPG

SEQ ID NO: 83560 - protein, 19 aa, Mycobacterium avium
QGTDLLSDIALDFKPVVQT

SEQ ID NO: 83561 - protein, 27 aa, Mycobacterium avium
QGTVGEMFGRKVARLMEWCAMVGCPII

SEQ ID NO: 83562 - protein, 25 aa, Mycobacterium avium
QGVLSDWWIRRMVVVRQPFHEKLTL

SEQ ID NO: 83563 - protein, 24 aa, Mycobacterium avium
QGWPHRCLPMLIANQSGWEVRNRS

SEQ ID NO: 83564 - protein, 20 aa, Mycobacterium avium
QGYGSLGLMTSVLMTADGKT

SEQ ID NO: 83565 - protein, 27 aa, Mycobacterium avium
QHGWQWCAGCGTDAAPYFRVFNPAAQG

SEQ ID NO: 83566 - protein, 23 aa, Mycobacterium avium
QHLAKLRMARLVRTRREGTTIFY

SEQ ID NO: 83567 - protein, 22 aa, Mycobacterium avium
QHLMRNRGKQLWSWLQDGAQLY

SEQ ID NO: 83568 - protein, 22 aa, Mycobacterium avium
QHRDRLAALVLNELTCLRDEFD

SEQ ID NO: 83569 - protein, 29 aa, Mycobacterium avium
QHVKPGKGPAFVRTKLKNVLSGKVVDKTY

SEQ ID NO: 83570 - protein, 17 aa, Mycobacterium avium
QHVRLVFEISQDVRIDA

SEQ ID NO: 83571 - protein, 20 aa, Mycobacterium avium
QHVSFPRRRTVFVEGEPGDD

SEQ ID NO: 83572 - protein, 32 aa, Mycobacterium avium
QHWGEAMMTDGRWDPGKDFAMVSARETGPTQK

SEQ ID NO: 83573 - protein, 25 aa, Mycobacterium avium
QHYHGKALGAFTGWHPQFPVTQWAV

SEQ ID NO: 83574 - protein, 19 aa, Mycobacterium avium
QIADAPFEFPAHERDERGR

SEQ ID NO: 83575 - protein, 18 aa, Mycobacterium avium
QIAEIFPLKGERLSRREA

SEQ ID NO: 83576 - protein, 18 aa, Mycobacterium avium
QIEELRVSLWAQQLGTPR

SEQ ID NO: 83577 - protein, 19 aa, Mycobacterium avium
QIEEWFEFVGEKLPTGVRD

SEQ ID NO: 83578 - protein, 27 aa, Mycobacterium avium
QIEQFRLLVLRTAWLIDKHHDYQKVRR

SEQ ID NO: 83579 - protein, 25 aa, Mycobacterium avium
QINYLRCIGCGLCVEACPTRALTMT

SEQ ID NO: 83580 - protein, 27 aa, Mycobacterium avium
QIQGVWVHPEWRGLGLGTAGTATVAAV

SEQ ID NO: 83581 - protein, 20 aa, Mycobacterium avium
QIVPDRLFELIGDPDRSRAA

SEQ ID NO: 83582 - protein, 19 aa, Mycobacterium avium
QKAKVLAICNTNGSQIPRE

SEQ ID NO: 83583 - protein, 21 aa, Mycobacterium avium
QKLKVLVSIFGRETPVELTFS

SEQ ID NO: 83584 - protein, 31 aa, Mycobacterium avium
QKQRFLPRMAVGETRGAFSMSEPELGSDVAA

SEQ ID NO: 83585 - protein, 26 aa, Mycobacterium avium
QLAAAVRPSLFVFTSIGRLGHDRDGN

SEQ ID NO: 83586 - protein, 22 aa, Mycobacterium avium
QLAELLWSFAPAPRSRPADASE

SEQ ID NO: 83587 - protein, 24 aa, Mycobacterium avium
QLARASVMALSYVAQSARGIYQPA

SEQ ID NO: 83588 - protein, 27 aa, Mycobacterium avium
QLARTFLMYRTQRWPDVLLTAAEELPP

SEQ ID NO: 83589 - protein, 18 aa, Mycobacterium avium
QLCHHLHGGMGMDITYPM

SEQ ID NO: 83590 - protein, 18 aa, Mycobacterium avium
QLEFKRVQFTPDLMPGDV

SEQ ID NO: 83591 - protein, 19 aa, Mycobacterium avium
QLEKAGWFGKTFKSARDVQ

SEQ ID NO: 83592 - protein, 19 aa, Mycobacterium avium
QLGELAVGDGLRIDDVSVD

SEQ ID NO: 83593 - protein, 29 aa, Mycobacterium avium
QLGGGFARYSVDNAWVVPHFEKMLYDNAL

SEQ ID NO: 83594 - protein, 19 aa, Mycobacterium avium
QLGGLPFSGPIGGVRVALI

SEQ ID NO: 83595 - protein, 17 aa, Mycobacterium avium
QLGPINWVIAKLGARTV

SEQ ID NO: 83596 - protein, 19 aa, Mycobacterium avium
QLHGGYGYMREYGVARAFV

SEQ ID NO: 83597 - protein, 18 aa, Mycobacterium avium
QLLVRVRAAAVNFPDVLF

SEQ ID NO: 83598 - protein, 26 aa, Mycobacterium avium
QLMRNRIDLLIGHGRFVDPHTIEVED

SEQ ID NO: 83599 - protein, 24 aa, Mycobacterium avium
QLNTEYFVAPGLWRGFDHGGLARA

SEQ ID NO: 83600 - protein, 32 aa, Mycobacterium avium
QLPDGISRLRFRLRWRDFRVTVDVNHADVTYT

SEQ ID NO: 83601 - protein, 21 aa, Mycobacterium avium
QLPGHKVYPWVAEVRHSTPGV

SEQ ID NO: 83602 - protein, 19 aa, Mycobacterium avium
QLPPGGRLGLYGFGGSAHI

SEQ ID NO: 83603 - protein, 26 aa, Mycobacterium avium
QLRETFRAIGVDLMFTHIKESLHEFG

SEQ ID NO: 83604 - protein, 22 aa, Mycobacterium avium
QLRYFWPRVVGDTGWQLLDSKF

SEQ ID NO: 83605 - protein, 28 aa, Mycobacterium avium
QLSGGMCQRALIAIGLAGRPRLLIADEP

SEQ ID NO: 83606 - protein, 29 aa, Mycobacterium avium
QLTADFNFAWPTARIAVIGAEGAAQLLMK

SEQ ID NO: 83607 - protein, 26 aa, Mycobacterium avium
QLTQPVRWDLCTATLRELEVAAAVEF

SEQ ID NO: 83608 - protein, 26 aa, Mycobacterium avium
QLVANLLPQVFRWARAVDASQPLTSG

SEQ ID NO: 83609 - protein, 17 aa, Mycobacterium avium
QLVVPVLNARFALNAAN

SEQ ID NO: 83610 - protein, 26 aa, Mycobacterium avium
QMAANCPRTKMVLGGYSQGAAVMGFV

SEQ ID NO: 83611 - protein, 23 aa, Mycobacterium avium
QMAEPKWVLAMGVCASSGGMFNN

SEQ ID NO: 83612 - protein, 26 aa, Mycobacterium avium
QMGIGAGWYEHEWRAYGYGFPSAGVR

SEQ ID NO: 83613 - protein, 23 aa, Mycobacterium avium
QMSECYRIRLRYAQADARGPESV

SEQ ID NO: 83614 - protein, 28 aa, Mycobacterium avium
QMSTCSEFFRYYAGWCSKINGTAYDVKT

SEQ ID NO: 83615 - protein, 19 aa, Mycobacterium avium
QMVKIAAAVRLHKQAHLPY

SEQ ID NO: 83616 - protein, 17 aa, Mycobacterium avium
QNIFGVWPVTGEVTAAL

SEQ ID NO: 83617 - protein, 18 aa, Mycobacterium avium
QNRFSWKNTGQTLADEGL

SEQ ID NO: 83618 - protein, 23 aa, Mycobacterium avium
QNSRWIVEPVLRLLDCCQESDGG

SEQ ID NO: 83619 - protein, 18 aa, Mycobacterium avium
QNVRLPWQVSGGEDAGKE

SEQ ID NO: 83620 - protein, 23 aa, Mycobacterium avium
QPACAVVMAALRRMEYRGYDSSG

SEQ ID NO: 83621 - protein, 36 aa, Mycobacterium avium
QPAVMRNYAKWHMEVPRGRELAPIVRRAFQVAQSSP

SEQ ID NO: 83622 - protein, 22 aa, Mycobacterium avium
QPELRKGRYPDRKTARRVSEVV

SEQ ID NO: 83623 - protein, 25 aa, Mycobacterium avium
QPHAKGAGAYGRFEVTADVSEYTKA

SEQ ID NO: 83624 - protein, 18 aa, Mycobacterium avium
QPLKGARISGSLHMTVQT

SEQ ID NO: 83625 - protein, 29 aa, Mycobacterium avium
QPLLAPRLREFALREGLADAALRLGARKG

SEQ ID NO: 83626 - protein, 20 aa, Mycobacterium avium
QPLVSSFQMPGGIYAPMIHP

SEQ ID NO: 83627 - protein, 19 aa, Mycobacterium avium
QPMIRHWAYAMADMNPVYL

SEQ ID NO: 83628 - protein, 23 aa, Mycobacterium avium
QPPHVGGGWIGYLSYPDGGADAK

SEQ ID NO: 83629 - protein, 19 aa, Mycobacterium avium
QPTIPGWRAETLGDDIAWM

SEQ ID NO: 83630 - protein, 26 aa, Mycobacterium avium
QPYWGRPVPSWGSARPRLLIVGLAPA

SEQ ID NO: 83631 - protein, 17 aa, Mycobacterium avium
QQAVRFGLFHLLQASAR

SEQ ID NO: 83632 - protein, 22 aa, Mycobacterium avium
QQDCAIPVWPKEMTREQIDLQR

SEQ ID NO: 83633 - protein, 23 aa, Mycobacterium avium
QQEELWLLRGGDPARPGMLPPAV

SEQ ID NO: 83634 - protein, 19 aa, Mycobacterium avium
QQLLARYAVTITQEDIDGL

SEQ ID NO: 83635 - protein, 17 aa, Mycobacterium avium
QQLRYDLSAGFPLITTK

SEQ ID NO: 83636 - protein, 24 aa, Mycobacterium avium
QQLTLPFGAPRTMLNVKIGGARRC

SEQ ID NO: 83637 - protein, 25 aa, Mycobacterium avium
QQLTLPFQAPRSMFNVRIGGARRVA

SEQ ID NO: 83638 - protein, 24 aa, Mycobacterium avium
QQPPEVMEVLLAQCVQADAAVARA

SEQ ID NO: 83639 - protein, 21 aa, Mycobacterium avium
QQQRLCIARAIAVQPDVLLMD

SEQ ID NO: 83640 - protein, 26 aa, Mycobacterium avium
QQRRWAAEGVERGWAATMVLTEPDAG

SEQ ID NO: 83641 - protein, 17 aa, Mycobacterium avium
QQVCIGRHYAGARCDVH

SEQ ID NO: 83642 - protein, 19 aa, Mycobacterium avium
QRAAAAWKDGVFTDEVVPV

SEQ ID NO: 83643 - protein, 25 aa, Mycobacterium avium
QRAEGRYALMPGIIGALAESGTPLS

SEQ ID NO: 83644 - protein, 24 aa, Mycobacterium avium
QRALDEWRVLTAAALVGLVEETMT

SEQ ID NO: 83645 - protein, 22 aa, Mycobacterium avium
QRAQQPCRWIFRGRNQRAEQRR

SEQ ID NO: 83646 - protein, 26 aa, Mycobacterium avium
QRCAAAGLTLRIPRPGLCTDNGAMIA

SEQ ID NO: 83647 - protein, 18 aa, Mycobacterium avium
QRDWDFAHEFGLPIVEVI

SEQ ID NO: 83648 - protein, 19 aa, Mycobacterium avium
QREILILRVVVGLSAEETA

SEQ ID NO: 83649 - protein, 26 aa, Mycobacterium avium
QRESLRTLGLRRIRHSVIREDNPQTR

SEQ ID NO: 83650 - protein, 25 aa, Mycobacterium avium
QRFWKHFPVRDWDAMAATLADDFLL

SEQ ID NO: 83651 - protein, 20 aa, Mycobacterium avium
QRHHTWRRIGLIDCGERWAV

SEQ ID NO: 83652 - protein, 20 aa, Mycobacterium avium
QRHRGEIAFIHYAPTPAEAC

SEQ ID NO: 83653 - protein, 19 aa, Mycobacterium avium
QRIAEALASVGLSDDKLDR

SEQ ID NO: 83654 - protein, 20 aa, Mycobacterium avium
QRIRAGEVVVMLYGSANRDE

SEQ ID NO: 83655 - protein, 18 aa, Mycobacterium avium
QRITPFVLTLRLLVIALR

SEQ ID NO: 83656 - protein, 25 aa, Mycobacterium avium
QRKVVVFRPLYAVGGQELGYLPGSE

SEQ ID NO: 83657 - protein, 19 aa, Mycobacterium avium
QRLRIDLSALRIVGDGLAW

SEQ ID NO: 83658 - protein, 24 aa, Mycobacterium avium
QRLRRFELDAGVLYPDRQDVADLL

SEQ ID NO: 83659 - protein, 17 aa, Mycobacterium avium
QRLVRRFLDAVAAGDKF

SEQ ID NO: 83660 - protein, 19 aa, Mycobacterium avium
QRPGEVLAIGQVLDTVVKV

SEQ ID NO: 83661 - protein, 22 aa, Mycobacterium avium
QRQLEMRLNRQLADVEKLQVNV

SEQ ID NO: 83662 - protein, 20 aa, Mycobacterium avium
QRQYLLGGRFTFAMTGSAPI

SEQ ID NO: 83663 - protein, 19 aa, Mycobacterium avium
QRRSASVTAVAWRTSAGAA

SEQ ID NO: 83664 - protein, 20 aa, Mycobacterium avium
QRSSNFMLWQAAYAEYIFQD

SEQ ID NO: 83665 - protein, 25 aa, Mycobacterium avium
QRSTVESWARLAVAARPELTLGRAR

SEQ ID NO: 83666 - protein, 17 aa, Mycobacterium avium
QRTAPWVESLDGGLDHV

SEQ ID NO: 83667 - protein, 19 aa, Mycobacterium avium
QRVFARGGVRARYYPDGAA

SEQ ID NO: 83668 - protein, 20 aa, Mycobacterium avium
QRWIAAGLFEPAVREKAGMH

SEQ ID NO: 83669 - protein, 17 aa, Mycobacterium avium
QRWPETKIEPSLTRISA

SEQ ID NO: 83670 - protein, 28 aa, Mycobacterium avium
QRYLEGPCLHAAWTRKVVVVDDLRTDSR

SEQ ID NO: 83671 - protein, 22 aa, Mycobacterium avium
QSCNAPSRMLVPASRMAEAISI

SEQ ID NO: 83672 - protein, 25 aa, Mycobacterium avium
QSEGLRRFAALSGNSVGSEKLWMGE

SEQ ID NO: 83673 - protein, 23 aa, Mycobacterium avium
QSEPIELWAWVAAYDHVALCQLW

SEQ ID NO: 83674 - protein, 17 aa, Mycobacterium avium
QSFLPGDFSAVLMQYDD

SEQ ID NO: 83675 - protein, 22 aa, Mycobacterium avium
QSFRIHGGYGYSKEYEIERLMR

SEQ ID NO: 83676 - protein, 17 aa, Mycobacterium avium
QSIHFAAAGVIAGHYDV

SEQ ID NO: 83677 - protein, 19 aa, Mycobacterium avium
QSIRHALDIGKTRDWMHAF

SEQ ID NO: 83678 - protein, 19 aa, Mycobacterium avium
QSLAARMRLALRDRGVPLW

SEQ ID NO: 83679 - protein, 20 aa, Mycobacterium avium
QSLQLHYARTLDLWAQALEA

SEQ ID NO: 83680 - protein, 25 aa, Mycobacterium avium
QSPEQLKRLVAQISEQPESVQHHNV

SEQ ID NO: 83681 - protein, 18 aa, Mycobacterium avium
QSPERFRVALAPKAFGAS

SEQ ID NO: 83682 - protein, 22 aa, Mycobacterium avium
QSPRGRDVLRRLIATCDVIVEN

SEQ ID NO: 83683 - protein, 22 aa, Mycobacterium avium
QSRSGPPQVRWLEPDVADHLRA

SEQ ID NO: 83684 - protein, 24 aa, Mycobacterium avium
QSTEFAQPALFVFEVALAALWESL

SEQ ID NO: 83685 - protein, 25 aa, Mycobacterium avium
QSVRPVIFSTFLMWLLADLYTQLPE

SEQ ID NO: 83686 - protein, 25 aa, Mycobacterium avium
QSYGSRCVRPPILYGDVVRTHPMTV

SEQ ID NO: 83687 - protein, 23 aa, Mycobacterium avium
QTAGRGRHGRGWSATPRAQVTMS

SEQ ID NO: 83688 - protein, 35 aa, Mycobacterium avium
QTALALNHLVCTRFRSDALQIIAFGRYARTVTAAE

SEQ ID NO: 83689 - protein, 18 aa, Mycobacterium avium
QTCWRTARADRFAAIIDA

SEQ ID NO: 83690 - protein, 26 aa, Mycobacterium avium
QTDHRPEILLSFGFVPKMESRVGLIN

SEQ ID NO: 83691 - protein, 26 aa, Mycobacterium avium
QTEGCVREMLVLAAALSIPDPRERPS

SEQ ID NO: 83692 - protein, 18 aa, Mycobacterium avium
QTFRSDRYPEYKANRSAT

SEQ ID NO: 83693 - protein, 23 aa, Mycobacterium avium
QTRRWNPKMKRFIFTDRNGIYII

SEQ ID NO: 83694 - protein, 24 aa, Mycobacterium avium
QTSGWSLTAQDAFNNVARTCIEAM

SEQ ID NO: 83695 - protein, 21 aa, Mycobacterium avium
QTVRRWSGMRALGNAKTFPAD

SEQ ID NO: 83696 - protein, 22 aa, Mycobacterium avium
QVAPTIRYEFHGAKPEVVSGKD

SEQ ID NO: 83697 - protein, 23 aa, Mycobacterium avium
QVDCTALVRLSERLGPAEQRITP

SEQ ID NO: 83698 - protein, 28 aa, Mycobacterium avium
QVDWMLGNGGLDWAVKRTADSAGRLYSW

SEQ ID NO: 83699 - protein, 20 aa, Mycobacterium avium
QVGLRHCPFLELAENSSNVV

SEQ ID NO: 83700 - protein, 20 aa, Mycobacterium avium
QVGNFPGLWTEWNGKYRDTV

SEQ ID NO: 83701 - protein, 18 aa, Mycobacterium avium
QVLATVTAWCARIDVLAT

SEQ ID NO: 83702 - protein, 23 aa, Mycobacterium avium
QVLRRELRRPSWRRETVALGTNT

SEQ ID NO: 83703 - protein, 26 aa, Mycobacterium avium
QVNRKVLPGYILVRMDLTDDSWAAVR

SEQ ID NO: 83704 - protein, 27 aa, Mycobacterium avium
QVQRCWDQSGGFGCMLQMGHEWANPAA

SEQ ID NO: 83705 - protein, 22 aa, Mycobacterium avium
QVRPGETMGLLGPNGAGKTTMV

SEQ ID NO: 83706 - protein, 23 aa, Mycobacterium avium
QVSRLKSSVAMELVRKQRGLAVA

SEQ ID NO: 83707 - protein, 26 aa, Mycobacterium avium
QVTAELLAGCARRLLDAPAVLGLARD

SEQ ID NO: 83708 - protein, 18 aa, Mycobacterium avium
QVTEAFWNSIRHAKPIAV

SEQ ID NO: 83709 - protein, 24 aa, Mycobacterium avium
QVVARARAAGVICRPRDVFVEQTV

SEQ ID NO: 83710 - protein, 19 aa, Mycobacterium avium
QVVKEIKDAGGRAVANYDS

SEQ ID NO: 83711 - protein, 38 aa, Mycobacterium avium
QVVPPPFVMRQFVKTGVFLPERLGFMFVGAAEMAGCIL

SEQ ID NO: 83712 - protein, 17 aa, Mycobacterium avium
QVWRQADKYDVPRICFV

SEQ ID NO: 83713 - protein, 18 aa, Mycobacterium avium
QWEQARRGVVPADPTVVL

SEQ ID NO: 83714 - protein, 26 aa, Mycobacterium avium
QWESIISLLTTEQWTGGGSAAAAAAA

SEQ ID NO: 83715 - protein, 19 aa, Mycobacterium avium
QWFVRAHLESAGGQLAHKG

SEQ ID NO: 83716 - protein, 19 aa, Mycobacterium avium
QWIGQELPQFSSAPTDHAG

SEQ ID NO: 83717 - protein, 20 aa, Mycobacterium avium
QYKVAVGDVVKVEKLDSEPG

SEQ ID NO: 83718 - protein, 19 aa, Mycobacterium avium
QYSLLPLLHNYRTPEKPIN

SEQ ID NO: 83719 - protein, 18 aa, Mycobacterium avium
QYTAGWQGGEKVVGLLDE

SEQ ID NO: 83720 - protein, 17 aa, Mycobacterium avium
RAAALGIDPSRLLRQSP

SEQ ID NO: 83721 - protein, 26 aa, Mycobacterium avium
RAAASFELLHAFALLQDDVMDGAQER

SEQ ID NO: 83722 - protein, 19 aa, Mycobacterium avium
RAACLKLGTEHLVDATIYV

SEQ ID NO: 83723 - protein, 18 aa, Mycobacterium avium
RAADPVFMLTGPIPATRY

SEQ ID NO: 83724 - protein, 18 aa, Mycobacterium avium
RAAEKCFVSQPALSAAIA

SEQ ID NO: 83725 - protein, 17 aa, Mycobacterium avium
RAAELLADRRARGPAKR

SEQ ID NO: 83726 - protein, 41 aa, Mycobacterium avium
RAAELMGIQIPRFCDHPLLEPVGACRQCLVEVEGQRKPMAS

SEQ ID NO: 83727 - protein, 20 aa, Mycobacterium avium
RAAGCSRATLYRYFENREAL

SEQ ID NO: 83728 - protein, 18 aa, Mycobacterium avium
RAAGYGMPGVRVDGNDPL

SEQ ID NO: 83729 - protein, 23 aa, Mycobacterium avium
RAAHGISGPLFIGRDTHGLSEPA

SEQ ID NO: 83730 - protein, 17 aa, Mycobacterium avium
RAAIVAVDMQGYSVADT

SEQ ID NO: 83731 - protein, 24 aa, Mycobacterium avium
RAAKELRDGYYVNLGIGIPTLVAN

SEQ ID NO: 83732 - protein, 26 aa, Mycobacterium avium
RAALDALGYRGFWMGYFAARSAPLGA

SEQ ID NO: 83733 - protein, 18 aa, Mycobacterium avium
RAALRAAASFELLHAFAL

SEQ ID NO: 83734 - protein, 18 aa, Mycobacterium avium
RAANLAWGCGDAEGATRV

SEQ ID NO: 83735 - protein, 19 aa, Mycobacterium avium
RAARAGLSAARSFEESAVQ

SEQ ID NO: 83736 - protein, 17 aa, Mycobacterium avium
RADFISVHLPKTPETAG

SEQ ID NO: 83737 - protein, 22 aa, Mycobacterium avium
RADGEKWVWAGAAVIHPEYTRA

SEQ ID NO: 83738 - protein, 18 aa, Mycobacterium avium
RADSVLGVAGLVNAARAG

SEQ ID NO: 83739 - protein, 22 aa, Mycobacterium avium
RAEHKKHRYAFAPFGGGAHKCI

SEQ ID NO: 83740 - protein, 22 aa, Mycobacterium avium
RAELKMPLILLGGITNRETMDL

SEQ ID NO: 83741 - protein, 25 aa, Mycobacterium avium
RAELQRLGRPVFGPTFEVDIDSDLC

SEQ ID NO: 83742 - protein, 19 aa, Mycobacterium avium
RAERGESHLGFISAASKCL

SEQ ID NO: 83743 - protein, 17 aa, Mycobacterium avium
RAFRPGRLPFPVMHVDT

SEQ ID NO: 83744 - protein, 19 aa, Mycobacterium avium
RAFVDARIQTIYGGTNEIM

SEQ ID NO: 83745 - protein, 18 aa, Mycobacterium avium
RAGALAWELSWTDPTRPL

SEQ ID NO: 83746 - protein, 19 aa, Mycobacterium avium
RAGASLINMEFVQFHPTGM

SEQ ID NO: 83747 - protein, 24 aa, Mycobacterium avium
RAGDSRLAAVLAELDDADTRASVT

SEQ ID NO: 83748 - protein, 23 aa, Mycobacterium avium
RAGEPRPRIALAAPTGKAAARLA

SEQ ID NO: 83749 - protein, 20 aa, Mycobacterium avium
RAGGELAWELTATRLGRFVG

SEQ ID NO: 83750 - protein, 20 aa, Mycobacterium avium
RAGIELLALGGRFIELGKRD

SEQ ID NO: 83751 - protein, 19 aa, Mycobacterium avium
RAGIKDVVLESAVTTIMDF

SEQ ID NO: 83752 - protein, 17 aa, Mycobacterium avium
RAGLPLASTTYYFSSLD

SEQ ID NO: 83753 - protein, 19 aa, Mycobacterium avium
RAGPRIRIAPVGSATVGRA

SEQ ID NO: 83754 - protein, 18 aa, Mycobacterium avium
RAGRDIQAGRVWVNCYHA

SEQ ID NO: 83755 - protein, 20 aa, Mycobacterium avium
RAGSDVVLLGALINHVLTND

SEQ ID NO: 83756 - protein, 19 aa, Mycobacterium avium
RAHGADMLLLIVAALEQSA

SEQ ID NO: 83757 - protein, 19 aa, Mycobacterium avium
RAHGSALFQRGETQILGVT

SEQ ID NO: 83758 - protein, 18 aa, Mycobacterium avium
RAIALLIGPLVLGRLSTL

SEQ ID NO: 83759 - protein, 23 aa, Mycobacterium avium
RAIGGEIRRLMSLSEDELYVAAK

SEQ ID NO: 83760 - protein, 17 aa, Mycobacterium avium
RAIGIPVYLLPGNHDPL

SEQ ID NO: 83761 - protein, 18 aa, Mycobacterium avium
RAIIGRPDLELVGVHAAG

SEQ ID NO: 83762 - protein, 37 aa, Mycobacterium avium
RAILVRPAPVPGFRGPRSFALPEFDPFWERVVEYDVL

SEQ ID NO: 83763 - protein, 18 aa, Mycobacterium avium
RAIMAAALEGAQVDFDTA

SEQ ID NO: 83764 - protein, 23 aa, Mycobacterium avium
RAIPEMVRKAFKLAESERPAAVY

SEQ ID NO: 83765 - protein, 24 aa, Mycobacterium avium
RAKDAGMAAALWALSEQLTKTEFP

SEQ ID NO: 83766 - protein, 31 aa, Mycobacterium avium
RAKMSGLRQGFVKVFCRKSTGVVIGGVVVAP

SEQ ID NO: 83767 - protein, 24 aa, Mycobacterium avium
RAKRTGETFVPFDPAADYRKYVDG

SEQ ID NO: 83768 - protein, 23 aa, Mycobacterium avium
RAKTIRDGREIVLGMARCRIPVV

SEQ ID NO: 83769 - protein, 19 aa, Mycobacterium avium
RALAARPGDVVARNDLLRV

SEQ ID NO: 83770 - protein, 19 aa, Mycobacterium avium
RALAKLADRFDVVIVDCPP

SEQ ID NO: 83771 - protein, 23 aa, Mycobacterium avium
RALEPYVDWLRITAQQCQEIATS

SEQ ID NO: 83772 - protein, 30 aa, Mycobacterium avium
RALGEIYAMWRINELLNWQVAAAGEDINVA

SEQ ID NO: 83773 - protein, 17 aa, Mycobacterium avium
RALIARFLRAIGEFPTA

SEQ ID NO: 83774 - protein, 17 aa, Mycobacterium avium
RALICAAVDVAHRQVRS

SEQ ID NO: 83775 - protein, 24 aa, Mycobacterium avium
RALMDTHPFGWLPLLSRVLASAQL

SEQ ID NO: 83776 - protein, 21 aa, Mycobacterium avium
RALRVADLFAAQGVWLISSMT

SEQ ID NO: 83777 - protein, 20 aa, Mycobacterium avium
RALYELGMTGIPIVNVNNNC

SEQ ID NO: 83778 - protein, 21 aa, Mycobacterium avium
RAMAGARAHNRWLAELCSHSP

SEQ ID NO: 83779 - protein, 25 aa, Mycobacterium avium
RAMIAACPLTFPWNVLGWPSINVPA

SEQ ID NO: 83780 - protein, 29 aa, Mycobacterium avium
RANGFRDIICPPLFLQYAILGVSRLDSLR

SEQ ID NO: 83781 - protein, 20 aa, Mycobacterium avium
RAPAVRKRAFDGLAHSNIDA

SEQ ID NO: 83782 - protein, 18 aa, Mycobacterium avium
RAPLALARQALGGVPKDQ

SEQ ID NO: 83783 - protein, 23 aa, Mycobacterium avium
RAPLRLTAPVLRISPHLDTTAED

SEQ ID NO: 83784 - protein, 24 aa, Mycobacterium avium
RARAGEITAEMAFIAAREGMPAEL

SEQ ID NO: 83785 - protein, 24 aa, Mycobacterium avium
RARCADLSALIGVPIRPAIGLLAV

SEQ ID NO: 83786 - protein, 22 aa, Mycobacterium avium
RARDAGAMAYLVKPFTISDLIP

SEQ ID NO: 83787 - protein, 24 aa, Mycobacterium avium
RARELRENPAWITGIEHRIESPAL

SEQ ID NO: 83788 - protein, 24 aa, Mycobacterium avium
RARGLEHWADPGARRPGEINHNDG

SEQ ID NO: 83789 - protein, 18 aa, Mycobacterium avium
RARIRAAVGAAFPIAVLN

SEQ ID NO: 83790 - protein, 18 aa, Mycobacterium avium
RARSADVQQRLNAAVDDL

SEQ ID NO: 83791 - protein, 26 aa, Mycobacterium avium
RARVRTRLVELFDLFDPADPEVVAGR

SEQ ID NO: 83792 - protein, 23 aa, Mycobacterium avium
RASAIAIAQRGATVFALARNGAA

SEQ ID NO: 83793 - protein, 25 aa, Mycobacterium avium
RASARLASALTHTWVSTTDEDAGVL

SEQ ID NO: 83794 - protein, 22 aa, Mycobacterium avium
RASEKLGELGVSDWLFTDEALQ

SEQ ID NO: 83795 - protein, 19 aa, Mycobacterium avium
RASFMPKPFGQHPGSAMHT

SEQ ID NO: 83796 - protein, 25 aa, Mycobacterium avium
RASILVDADDGWSYAVAEGTAELTP

SEQ ID NO: 83797 - protein, 23 aa, Mycobacterium avium
RASKTRFAIYLGDLGTDTAARAR

SEQ ID NO: 83798 - protein, 22 aa, Mycobacterium avium
RATAPVCWNDVTNFWALLKYED

SEQ ID NO: 83799 - protein, 17 aa, Mycobacterium avium
RATLPRLGELAIGGTAV

SEQ ID NO: 83800 - protein, 24 aa, Mycobacterium avium
RAVADLFAAFGMAPVGYYDLRRAA

SEQ ID NO: 83801 - protein, 18 aa, Mycobacterium avium
RAVDAGAAGHVFNLGHGV

SEQ ID NO: 83802 - protein, 20 aa, Mycobacterium avium
RAVEKFDYTKGYKFSTYATW

SEQ ID NO: 83803 - protein, 25 aa, Mycobacterium avium
RAVGPRVAARFGRVLLELGGNNAAV

SEQ ID NO: 83804 - protein, 20 aa, Mycobacterium avium
RAVLECAGVHDILAKSLGSD

SEQ ID NO: 83805 - protein, 18 aa, Mycobacterium avium
RAVLERMKPFGVNLHYFD

SEQ ID NO: 83806 - protein, 18 aa, Mycobacterium avium
RAVPPERIADLQVRATYL

SEQ ID NO: 83807 - protein, 17 aa, Mycobacterium avium
RAVQLLEAAGMPDPAKQ

SEQ ID NO: 83808 - protein, 21 aa, Mycobacterium avium
RAWETLMLRLGYQRYGAQGGD

SEQ ID NO: 83809 - protein, 24 aa, Mycobacterium avium
RAYRREVLEAIDLDGVDSKGYCFQ

SEQ ID NO: 83810 - protein, 20 aa, Mycobacterium avium
RCADAVFVSSAWHWMDPQRA

SEQ ID NO: 83811 - protein, 23 aa, Mycobacterium avium
RCARARVRLAELLGYLDAGAHAA

SEQ ID NO: 83812 - protein, 25 aa, Mycobacterium avium
RCAVGIDLRDDWPAALRRVGFDAAQ

SEQ ID NO: 83813 - protein, 20 aa, Mycobacterium avium
RCGIREFVDDGAIDPDHASP

SEQ ID NO: 83814 - protein, 25 aa, Mycobacterium avium
RCIDYARGRFDAIVPEHVLRELPYD

SEQ ID NO: 83815 - protein, 20 aa, Mycobacterium avium
RCQGHTLCSMIAPDSFQLSD

SEQ ID NO: 83816 - protein, 18 aa, Mycobacterium avium
RCQPRPTDKVVVFGAGPI

SEQ ID NO: 83817 - protein, 17 aa, Mycobacterium avium
RCVHELVDALGVPQPLV

SEQ ID NO: 83818 - protein, 20 aa, Mycobacterium avium
RDAAHEFGRRLAVTHDAGAA

SEQ ID NO: 83819 - protein, 19 aa, Mycobacterium avium
RDAGGPAPVLQWLIYPRTD

SEQ ID NO: 83820 - protein, 20 aa, Mycobacterium avium
RDAIFKVFRRVSSGINPDIE

SEQ ID NO: 83821 - protein, 22 aa, Mycobacterium avium
RDALLRLPVAFMVVPKTSRPWR

SEQ ID NO: 83822 - protein, 24 aa, Mycobacterium avium
RDAYKRYGDFVALDHVDFVVPTGS

SEQ ID NO: 83823 - protein, 26 aa, Mycobacterium avium
RDDLVRLGLQIGDFVALITSPELTAD

SEQ ID NO: 83824 - protein, 20 aa, Mycobacterium avium
RDDPRSWIAQPMMELSTVPT

SEQ ID NO: 83825 - protein, 26 aa, Mycobacterium avium
RDELYRRWTGLLSYRYIGRKHSSMNL

SEQ ID NO: 83826 - protein, 20 aa, Mycobacterium avium
RDFATHAAIALVLAAAREDA

SEQ ID NO: 83827 - protein, 25 aa, Mycobacterium avium
RDGAWYTARLCPAPLLPEERHTAVA

SEQ ID NO: 83828 - protein, 23 aa, Mycobacterium avium
RDGEAIGALLTRMGAQDTRLIWE

SEQ ID NO: 83829 - protein, 20 aa, Mycobacterium avium
RDGGSFATRRVNAIQHGEII

SEQ ID NO: 83830 - protein, 18 aa, Mycobacterium avium
RDGPNWRLDGAKELVPAA

SEQ ID NO: 83831 - protein, 24 aa, Mycobacterium avium
RDGRRYLDMFTFFASSALGMNHPA

SEQ ID NO: 83832 - protein, 20 aa, Mycobacterium avium
RDGSDWILKGQKVFISGIDQ

SEQ ID NO: 83833 - protein, 19 aa, Mycobacterium avium
RDGSDWVLDGRKLWITNGS

SEQ ID NO: 83834 - protein, 17 aa, Mycobacterium avium
RDIPVLIGGGGERKTLR

SEQ ID NO: 83835 - protein, 24 aa, Mycobacterium avium
RDIRFVRLWFTDVLGFLKSVAIAP

SEQ ID NO: 83836 - protein, 23 aa, Mycobacterium avium
RDKRIPLELCPSSNVQTGAVKSI

SEQ ID NO: 83837 - protein, 20 aa, Mycobacterium avium
RDKRSLVFPVKRLADLGFRV

SEQ ID NO: 83838 - protein, 25 aa, Mycobacterium avium
RDLAAELRRFWNIEFDDAGAIGRRY

SEQ ID NO: 83839 - protein, 25 aa, Mycobacterium avium
RDLGASFAEFGGWLMPVSYAGTVSE

SEQ ID NO: 83840 - protein, 19 aa, Mycobacterium avium
RDLKQRPAVIEAAAQGSSP

SEQ ID NO: 83841 - protein, 17 aa, Mycobacterium avium
RDLRIGASLVHLAHASR

SEQ ID NO: 83842 - protein, 20 aa, Mycobacterium avium
RDLVNAGAVDLVIETVKHGA

SEQ ID NO: 83843 - protein, 19 aa, Mycobacterium avium
RDMIDVNLSGVWKTVKAGV

SEQ ID NO: 83844 - protein, 25 aa, Mycobacterium avium
RDNRAVHALARIMLHGRISQIQTSW

SEQ ID NO: 83845 - protein, 26 aa, Mycobacterium avium
RDNVVSWLRAGNVDWVRINGFGTPWW

SEQ ID NO: 83846 - protein, 24 aa, Mycobacterium avium
RDPAIKVIVLRGAGRAFSGGYDFG

SEQ ID NO: 83847 - protein, 24 aa, Mycobacterium avium
RDPDGSWRRSAIKQVASGRFGVTS

SEQ ID NO: 83848 - protein, 17 aa, Mycobacterium avium
RDPIAAARANWERAGWG

SEQ ID NO: 83849 - protein, 26 aa, Mycobacterium avium
RDPLRLPGNAHFTFRGCEGDALLMLL

SEQ ID NO: 83850 - protein, 26 aa, Mycobacterium avium
RDPMAMLPFLGYHVGDYFQHWIDLGK

SEQ ID NO: 83851 - protein, 21 aa, Mycobacterium avium
RDPSLRTAVALADGREMTGLA

SEQ ID NO: 83852 - protein, 18 aa, Mycobacterium avium
RDQALKFGATHVYPDIMA

SEQ ID NO: 83853 - protein, 19 aa, Mycobacterium avium
RDRIVEFLHRVRPEMVLAV

SEQ ID NO: 83854 - protein, 18 aa, Mycobacterium avium
RDRMPVFPVPEGHDQASW

SEQ ID NO: 83855 - protein, 20 aa, Mycobacterium avium
RDRTVMAKLYLREVNQRVGR

SEQ ID NO: 83856 - protein, 19 aa, Mycobacterium avium
RDSAVDAIVKWIADRENSV

SEQ ID NO: 83857 - protein, 19 aa, Mycobacterium avium
RDSIDLLELLTTWTAGFPE

SEQ ID NO: 83858 - protein, 19 aa, Mycobacterium avium
RDSRVVTVSSLGHRLRAAI

SEQ ID NO: 83859 - protein, 20 aa, Mycobacterium avium
RDTAEWALRELVVLHEVAHH

SEQ ID NO: 83860 - protein, 20 aa, Mycobacterium avium
RDTEGRWRITVFAEEADAAY

SEQ ID NO: 83861 - protein, 18 aa, Mycobacterium avium
RDTLGRIGPRVTHLVGDG

SEQ ID NO: 83862 - protein, 21 aa, Mycobacterium avium
RDTLLWAKLIDKYKGTMTAAP

SEQ ID NO: 83863 - protein, 17 aa, Mycobacterium avium
RDVEVITLGSGVGVRLF

SEQ ID NO: 83864 - protein, 27 aa, Mycobacterium avium
RDVPAARAAWRAVLDGFDTPTLVAPRG

SEQ ID NO: 83865 - protein, 20 aa, Mycobacterium avium
RDVTVPPVRFVKTIGDAVMF

SEQ ID NO: 83866 - protein, 19 aa, Mycobacterium avium
RDWFEVSLIPTTRELTTLG

SEQ ID NO: 83867 - protein, 18 aa, Mycobacterium avium
REACGGAGYMAENRLIAL

SEQ ID NO: 83868 - protein, 23 aa, Mycobacterium avium
REAIARSGITHFMPVYSSQKAAL

SEQ ID NO: 83869 - protein, 22 aa, Mycobacterium avium
REAIFKRAWLNVARVEQLPRKG

SEQ ID NO: 83870 - protein, 24 aa, Mycobacterium avium
REALKSALQYPALAGPVFDSLTVE

SEQ ID NO: 83871 - protein, 20 aa, Mycobacterium avium
REALRQAALVRFLAQGVEDT

SEQ ID NO: 83872 - protein, 18 aa, Mycobacterium avium
REAVRDWIVAVMAPFPHM

SEQ ID NO: 83873 - protein, 23 aa, Mycobacterium avium
RECDAICQVVRVFADDDVTHVAG

SEQ ID NO: 83874 - protein, 17 aa, Mycobacterium avium
REELDAYVVRRLNLPFR

SEQ ID NO: 83875 - protein, 25 aa, Mycobacterium avium
REELLDICFLFLIAGLDTVTDSLDC

SEQ ID NO: 83876 - protein, 25 aa, Mycobacterium avium
REESEWPLARTRWRALHLGDAGVLR

SEQ ID NO: 83877 - protein, 25 aa, Mycobacterium avium
REEVKFGIEPWFRYFQKVAAFPQMT

SEQ ID NO: 83878 - protein, 18 aa, Mycobacterium avium
REEWARRITEAELLTAMT

SEQ ID NO: 83879 - protein, 18 aa, Mycobacterium avium
REFVKPHLALYIGGMGAK

SEQ ID NO: 83880 - protein, 25 aa, Mycobacterium avium
REGADIIAIDVCKQLDGVKLPMSTP

SEQ ID NO: 83881 - protein, 20 aa, Mycobacterium avium
REGFECGMTLGYSDIKEGDV

SEQ ID NO: 83882 - protein, 26 aa, Mycobacterium avium
REGPGRRDICIYARESHVVVAEAPTE

SEQ ID NO: 83883 - protein, 25 aa, Mycobacterium avium
REGRALDDFATWCALAEEYGPDWHS

SEQ ID NO: 83884 - protein, 26 aa, Mycobacterium avium
REHDILAFERQWWKFAGVKEDAIKEL

SEQ ID NO: 83885 - protein, 20 aa, Mycobacterium avium
REHHGLKCIVVGHSMGGGIV

SEQ ID NO: 83886 - protein, 22 aa, Mycobacterium avium
REHPRPGIINALAQLRIDGEPA

SEQ ID NO: 83887 - protein, 21 aa, Mycobacterium avium
REIGKAVGMLMLLHEMTEDEA

SEQ ID NO: 83888 - protein, 23 aa, Mycobacterium avium
REIKLGSGGLRDVEFAVQLLQLV

SEQ ID NO: 83889 - protein, 23 aa, Mycobacterium avium
REIQARGAITIVIAEEGDDTVRP

SEQ ID NO: 83890 - protein, 24 aa, Mycobacterium avium
REISDIPVGVGLGVRSREQAAQIG

SEQ ID NO: 83891 - protein, 17 aa, Mycobacterium avium
REIVEICRMVWRRERVQ

SEQ ID NO: 83892 - protein, 24 aa, Mycobacterium avium
REKASEGTPVIVFFDEMDSIFRTR

SEQ ID NO: 83893 - protein, 27 aa, Mycobacterium avium
RELALQVAEAFSRYGAHLPKINVLPIY

SEQ ID NO: 83894 - protein, 22 aa, Mycobacterium avium
RELDPLVGAGGFDFIRDLGAMM

SEQ ID NO: 83895 - protein, 25 aa, Mycobacterium avium
RELGDRPPFGAALIRTADTEHRFVL

SEQ ID NO: 83896 - protein, 21 aa, Mycobacterium avium
RELLLERGFDGLTIEAVAARA

SEQ ID NO: 83897 - protein, 18 aa, Mycobacterium avium
RELLRVVLEAVGDRARVI

SEQ ID NO: 83898 - protein, 21 aa, Mycobacterium avium
RELPVYVISIGRTFRTDELDA

SEQ ID NO: 83899 - protein, 25 aa, Mycobacterium avium
RELQELRKSTGLDVSDRISVVMSVP

SEQ ID NO: 83900 - protein, 23 aa, Mycobacterium avium
RELRQLWEDRGCPRMPPRSPDAH

SEQ ID NO: 83901 - protein, 23 aa, Mycobacterium avium
RELRRLNAILRRRDKILQSGPDI

SEQ ID NO: 83902 - protein, 20 aa, Mycobacterium avium
RELVGDGTLFLLKVVGDSMV

SEQ ID NO: 83903 - protein, 24 aa, Mycobacterium avium
REPKPMVYSGLYPVDGSDYPDLRD

SEQ ID NO: 83904 - protein, 17 aa, Mycobacterium avium
REPLADFGCEFPQIDPR

SEQ ID NO: 83905 - protein, 19 aa, Mycobacterium avium
REPMRIRVALHTGEAELRD

SEQ ID NO: 83906 - protein, 17 aa, Mycobacterium avium
REQGVTAPAGFRAAGIA

SEQ ID NO: 83907 - protein, 17 aa, Mycobacterium avium
REQRPHVVVGYDPAGGY

SEQ ID NO: 83908 - protein, 19 aa, Mycobacterium avium
RERARAEAAKAPREPGQEP

SEQ ID NO: 83909 - protein, 19 aa, Mycobacterium avium
RERARRKFDEYARVDWQVI

SEQ ID NO: 83910 - protein, 20 aa, Mycobacterium avium
RERESAKWTKASREITTALL

SEQ ID NO: 83911 - protein, 18 aa, Mycobacterium avium
RERFKKVADEIGFEQTVD

SEQ ID NO: 83912 - protein, 17 aa, Mycobacterium avium
RERIPLVVLIWEDGGYG

SEQ ID NO: 83913 - protein, 23 aa, Mycobacterium avium
RERLAEAFAAFNATGDRPYRLSA

SEQ ID NO: 83914 - protein, 21 aa, Mycobacterium avium
RERLAKAFGPVRVAIAAEQAH

SEQ ID NO: 83915 - protein, 22 aa, Mycobacterium avium
RERLMGAAIAEFARAGMAEADV

SEQ ID NO: 83916 - protein, 19 aa, Mycobacterium avium
RESRFPISEILAQTPQIPE

SEQ ID NO: 83917 - protein, 21 aa, Mycobacterium avium
RETLDRVALTGAWLDRDVLAL

SEQ ID NO: 83918 - protein, 24 aa, Mycobacterium avium
RETVSGLLAPLGIEHTLQYRRGVP

SEQ ID NO: 83919 - protein, 23 aa, Mycobacterium avium
REVAAEFERPVLLFSGGKDSIVM

SEQ ID NO: 83920 - protein, 25 aa, Mycobacterium avium
REVAGKIRAGWVTINHAFDLNAPFG

SEQ ID NO: 83921 - protein, 19 aa, Mycobacterium avium
REVEPVVMRAWRELDDYVD

SEQ ID NO: 83922 - protein, 20 aa, Mycobacterium avium
REVHHMAALVGFGAAAINPY

SEQ ID NO: 83923 - protein, 24 aa, Mycobacterium avium
REVLFCPDQFLGAHVRRMTGRENL

SEQ ID NO: 83924 - protein, 17 aa, Mycobacterium avium
REVLRYLLDSGVAGKRI

SEQ ID NO: 83925 - protein, 19 aa, Mycobacterium avium
REVPQIPVATRLSGLEPLN

SEQ ID NO: 83926 - protein, 19 aa, Mycobacterium avium
REYALKRALAKLADRFDVV

SEQ ID NO: 83927 - protein, 27 aa, Mycobacterium avium
RFADTHARVGLLPTWGLSVRLPQKVGI

SEQ ID NO: 83928 - protein, 27 aa, Mycobacterium avium
RFAGNPWAAPTGWRAGGSPAPVRTDMR

SEQ ID NO: 83929 - protein, 18 aa, Mycobacterium avium
RFAGPRRHGKWLVLPTDG

SEQ ID NO: 83930 - protein, 19 aa, Mycobacterium avium
RFAQAGIRKTWVFQAFDDD

SEQ ID NO: 83931 - protein, 20 aa, Mycobacterium avium
RFAQLGSWSGRIVIDGQEIA

SEQ ID NO: 83932 - protein, 21 aa, Mycobacterium avium
RFATCCRALGIVVYQRQRPAD

SEQ ID NO: 83933 - protein, 24 aa, Mycobacterium avium
RFDEQANIRWARALEQAGVHVVYG

SEQ ID NO: 83934 - protein, 18 aa, Mycobacterium avium
RFDGRYVSFADIAFEPKP

SEQ ID NO: 83935 - protein, 18 aa, Mycobacterium avium
RFDVDDVYLGNGVSELIT

SEQ ID NO: 83936 - protein, 17 aa, Mycobacterium avium
RFFTMLGTLVRGRITVG

SEQ ID NO: 83937 - protein, 17 aa, Mycobacterium avium
RFGDAFIPMDETLAHAA

SEQ ID NO: 83938 - protein, 26 aa, Mycobacterium avium
RFHTVYWPAFLMSAGIELPRRVFAHG

SEQ ID NO: 83939 - protein, 27 aa, Mycobacterium avium
RFIRFCDAFNIPLVFVVDTPGFLPGAE

SEQ ID NO: 83940 - protein, 19 aa, Mycobacterium avium
RFLAEKAPIAHHVRRLLDD

SEQ ID NO: 83941 - protein, 20 aa, Mycobacterium avium
RFLEREGWIAWSGPAISELL

SEQ ID NO: 83942 - protein, 20 aa, Mycobacterium avium
RFLMRNPRRALSRTEILDRV

SEQ ID NO: 83943 - protein, 17 aa, Mycobacterium avium
RFLPAILDGTVEFAIGY

SEQ ID NO: 83944 - protein, 18 aa, Mycobacterium avium
RFMTRWQGEPDPRHIEAI

SEQ ID NO: 83945 - protein, 25 aa, Mycobacterium avium
RFRSMCEARGLPAVRIGVVDQASDE

SEQ ID NO: 83946 - protein, 29 aa, Mycobacterium avium
RFSFNVKGGRCEACTGDGTIKIEMNFLPD

SEQ ID NO: 83947 - protein, 27 aa, Mycobacterium avium
RFTALLSNAETIFWNGPMGVFEFPAFA

SEQ ID NO: 83948 - protein, 26 aa, Mycobacterium avium
RFTAYDCARLRFILTAQRDHYLPLKV

SEQ ID NO: 83949 - protein, 24 aa, Mycobacterium avium
RFYERKEIRDIIAYLRVLDNPGDA

SEQ ID NO: 83950 - protein, 17 aa, Mycobacterium avium
RFYGFLGGETDQWYPDL

SEQ ID NO: 83951 - protein, 21 aa, Mycobacterium avium
RGAAGIALLACMPPRPGEREL

SEQ ID NO: 83952 - protein, 24 aa, Mycobacterium avium
RGADEYPLVTGIVAGVGGRRVFVG

SEQ ID NO: 83953 - protein, 26 aa, Mycobacterium avium
RGAEYSVDFVPKVRIEVVVDDSIVDK

SEQ ID NO: 83954 - protein, 18 aa, Mycobacterium avium
RGAPVVILAHGFPELAYS

SEQ ID NO: 83955 - protein, 22 aa, Mycobacterium avium
RGARLAFGDRVLWEDLDLSVSR

SEQ ID NO: 83956 - protein, 21 aa, Mycobacterium avium
RGDDGGFLWPGFGENSRVLKW

SEQ ID NO: 83957 - protein, 25 aa, Mycobacterium avium
RGDDGRWRLGPAVTELAAHVNDPLL

SEQ ID NO: 83958 - protein, 24 aa, Mycobacterium avium
RGDLALKMGLPVLAVVAYAQSFAD

SEQ ID NO: 83959 - protein, 17 aa, Mycobacterium avium
RGDQMFMTMLRRHCDHV

SEQ ID NO: 83960 - protein, 18 aa, Mycobacterium avium
RGDRRYRITGTRGTSAYL

SEQ ID NO: 83961 - protein, 23 aa, Mycobacterium avium
RGEPACDGWSPPAIQMPADLPDR

SEQ ID NO: 83962 - protein, 24 aa, Mycobacterium avium
RGFDEMARLGAQITIFRLGSDPGL

SEQ ID NO: 83963 - protein, 19 aa, Mycobacterium avium
RGFFTSRVIGTFVNEALAM

SEQ ID NO: 83964 - protein, 28 aa, Mycobacterium avium
RGGAEPGAPARRSWAVLGEMAELGDDAI

SEQ ID NO: 83965 - protein, 21 aa, Mycobacterium avium
RGGCMAAKFFTGLPLDGPDPE

SEQ ID NO: 83966 - protein, 19 aa, Mycobacterium avium
RGGGELIRLSMAGVAAGYA

SEQ ID NO: 83967 - protein, 18 aa, Mycobacterium avium
RGGGIGVAAMCAGGGQGG

SEQ ID NO: 83968 - protein, 18 aa, Mycobacterium avium
RGGHFAAFEQPELFVEDL

SEQ ID NO: 83969 - protein, 20 aa, Mycobacterium avium
RGGLLAHLFGTVAVLDPQDQ

SEQ ID NO: 83970 - protein, 25 aa, Mycobacterium avium
RGGLVDCAIALGFEKMQPGSLGGGA

SEQ ID NO: 83971 - protein, 19 aa, Mycobacterium avium
RGGRVRGQRGWIVEKSADP

SEQ ID NO: 83972 - protein, 19 aa, Mycobacterium avium
RGGSLAGIHPVDLGALGWR

SEQ ID NO: 83973 - protein, 18 aa, Mycobacterium avium
RGHARFRDPHTLQVGEDL

SEQ ID NO: 83974 - protein, 19 aa, Mycobacterium avium
RGHSVPVPGELGGAAMVID

SEQ ID NO: 83975 - protein, 24 aa, Mycobacterium avium
RGIFPRTTITMAFGSTMVLSQAVT

SEQ ID NO: 83976 - protein, 27 aa, Mycobacterium avium
RGIGATIAEVFARDGARVVAIDVESAA

SEQ ID NO: 83977 - protein, 19 aa, Mycobacterium avium
RGIGKVDRAALVRRFAGGG

SEQ ID NO: 83978 - protein, 19 aa, Mycobacterium avium
RGIGRLMLDRLLEFADGGV

SEQ ID NO: 83979 - protein, 17 aa, Mycobacterium avium
RGINIPVIDHATGRVAV

SEQ ID NO: 83980 - protein, 24 aa, Mycobacterium avium
RGKGCDICKPVVASILASTGSEHI

SEQ ID NO: 83981 - protein, 18 aa, Mycobacterium avium
RGKMFARLIKNIEVAARV

SEQ ID NO: 83982 - protein, 17 aa, Mycobacterium avium
RGKVWVFGDNLNTDAMY

SEQ ID NO: 83983 - protein, 20 aa, Mycobacterium avium
RGLFDFFFLAEGLRLREHRG

SEQ ID NO: 83984 - protein, 18 aa, Mycobacterium avium
RGLGEKDLSLALALGEAV

SEQ ID NO: 83985 - protein, 26 aa, Mycobacterium avium
RGLHPYRVRHLLDRYGSLIGDVLALA

SEQ ID NO: 83986 - protein, 26 aa, Mycobacterium avium
RGLKSAIAAVRGWRRGKRASVARRTG

SEQ ID NO: 83987 - protein, 20 aa, Mycobacterium avium
RGLLLTELHPGVTVEEVRAK

SEQ ID NO: 83988 - protein, 24 aa, Mycobacterium avium
RGLLPPSFSLVGFARRDWSTQDFG

SEQ ID NO: 83989 - protein, 20 aa, Mycobacterium avium
RGLPRTPPLNAMAFAVRSPT

SEQ ID NO: 83990 - protein, 27 aa, Mycobacterium avium
RGLRMVGRGVLRAGLTVLVGDTPVGVT

SEQ ID NO: 83991 - protein, 22 aa, Mycobacterium avium
RGLSMAHLRGTLDAFARAEFGP

SEQ ID NO: 83992 - protein, 18 aa, Mycobacterium avium
RGLVDCVVEVATLDHGLH

SEQ ID NO: 83993 - protein, 17 aa, Mycobacterium avium
RGLVPVRLREPALTETV

SEQ ID NO: 83994 - protein, 20 aa, Mycobacterium avium
RGLWGAPYEPGYRVLDGIRA

SEQ ID NO: 83995 - protein, 26 aa, Mycobacterium avium
RGLYQYRPELPFVLGAEIAGVVRSAP

SEQ ID NO: 83996 - protein, 20 aa, Mycobacterium avium
RGLYRVEIEGSPSMRCEFEM

SEQ ID NO: 83997 - protein, 25 aa, Mycobacterium avium
RGMLLKWSDDLVCGLSSHIDPTSAE

SEQ ID NO: 83998 - protein, 21 aa, Mycobacterium avium
RGNHVFIEMNPRIQVEHTVTE

SEQ ID NO: 83999 - protein, 19 aa, Mycobacterium avium
RGPDGLRFLTGNLVPTGAA

SEQ ID NO: 84000 - protein, 26 aa, Mycobacterium avium
RGPMDRFHRRLLWPIRSSAGEVIGFG

SEQ ID NO: 84001 - protein, 19 aa, Mycobacterium avium
RGPQVPFTDVFLHGLIRDE

SEQ ID NO: 84002 - protein, 21 aa, Mycobacterium avium
RGPVATVLIQRGTLRVGDSIV

SEQ ID NO: 84003 - protein, 24 aa, Mycobacterium avium
RGQPRLRPPFPAVAGLYGCPTVIN

SEQ ID NO: 84004 - protein, 19 aa, Mycobacterium avium
RGQSIPAIAGELYVAPSTV

SEQ ID NO: 84005 - protein, 32 aa, Mycobacterium avium
RGRDLVRLGLDGGRWGAAPLRPRERARRRATV

SEQ ID NO: 84006 - protein, 20 aa, Mycobacterium avium
RGRDMPVGVLVGSWHTIEGL

SEQ ID NO: 84007 - protein, 24 aa, Mycobacterium avium
RGRDWSAVCIGRMRRGTGIRVQRL

SEQ ID NO: 84008 - protein, 31 aa, Mycobacterium avium
RGREGGYELARPGKDISIADVLRCIDGPLAS

SEQ ID NO: 84009 - protein, 19 aa, Mycobacterium avium
RGREVSVEREVFPALLSDP

SEQ ID NO: 84010 - protein, 22 aa, Mycobacterium avium
RGRGLMCAFSLPTTADRDELIG

SEQ ID NO: 84011 - protein, 20 aa, Mycobacterium avium
RGRLQRGETVLVHGAAGGIG

SEQ ID NO: 84012 - protein, 19 aa, Mycobacterium avium
RGRPGWHTECVAMAHEYLG

SEQ ID NO: 84013 - protein, 18 aa, Mycobacterium avium
RGRPHLCFDTFNATQKMT

SEQ ID NO: 84014 - protein, 22 aa, Mycobacterium avium
RGRRKTRIGYVVSDKMQKTIVV

SEQ ID NO: 84015 - protein, 24 aa, Mycobacterium avium
RGRRPRPFLPDDFEAAQLRTAIEL

SEQ ID NO: 84016 - protein, 25 aa, Mycobacterium avium
RGRTHPEWANMVGPFGGITAATLLS

SEQ ID NO: 84017 - protein, 28 aa, Mycobacterium avium
RGRVQSVLLPRLLNWMSYAPDPDGGLLA

SEQ ID NO: 84018 - protein, 25 aa, Mycobacterium avium
RGSAKRITAVMPFYPYARQDKKHRG

SEQ ID NO: 84019 - protein, 21 aa, Mycobacterium avium
RGSGEPVVFIAGHGGAGRTWH

SEQ ID NO: 84020 - protein, 19 aa, Mycobacterium avium
RGSGYAVAALCGAGGQGDA

SEQ ID NO: 84021 - protein, 18 aa, Mycobacterium avium
RGSMKAGVFSGDALADPD

SEQ ID NO: 84022 - protein, 17 aa, Mycobacterium avium
RGTGARGLRAIMEEVLL

SEQ ID NO: 84023 - protein, 17 aa, Mycobacterium avium
RGTHLVFDAAAFGNPTA

SEQ ID NO: 84024 - protein, 28 aa, Mycobacterium avium
RGTLPVKLCYAGPFFRYERPQAGRYRQL

SEQ ID NO: 84025 - protein, 22 aa, Mycobacterium avium
RGTRLPVWLSQWGFQRPPEEVI

SEQ ID NO: 84026 - protein, 22 aa, Mycobacterium avium
RGVADPDSWPAFVPTNGGSVNA

SEQ ID NO: 84027 - protein, 17 aa, Mycobacterium avium
RGVFSRQVYLGHGLDTD

SEQ ID NO: 84028 - protein, 23 aa, Mycobacterium avium
RGVLPDCMAHWTLPQLTNLGVAA

SEQ ID NO: 84029 - protein, 18 aa, Mycobacterium avium
RGVLVEMYREAKARLGDP

SEQ ID NO: 84030 - protein, 20 aa, Mycobacterium avium
RGVPQIEVTFDIDANGIVHV

SEQ ID NO: 84031 - protein, 25 aa, Mycobacterium avium
RGVSSCATCDGFFFKDQDIAVIGGG

SEQ ID NO: 84032 - protein, 19 aa, Mycobacterium avium
RGWLTAPVIVLSARTDSSD

SEQ ID NO: 84033 - protein, 20 aa, Mycobacterium avium
RGYKGISIPTASRVSAVRGG

SEQ ID NO: 84034 - protein, 19 aa, Mycobacterium avium
RGYVLRRLLRRVIRSARLL

SEQ ID NO: 84035 - protein, 26 aa, Mycobacterium avium
RHAGLDLLPQLVFRDGELDAGVFRSI

SEQ ID NO: 84036 - protein, 27 aa, Mycobacterium avium
RHEILADLRLVPGFSERLGEMVASIDE

SEQ ID NO: 84037 - protein, 19 aa, Mycobacterium avium
RHFDAWWKKQRHQTPDLLT

SEQ ID NO: 84038 - protein, 25 aa, Mycobacterium avium
RHFFVCSTHDWILFFTTQGRVYRAK

SEQ ID NO: 84039 - protein, 22 aa, Mycobacterium avium
RHFRPEFFAAMRRLCDEHDALL

SEQ ID NO: 84040 - protein, 18 aa, Mycobacterium avium
RHGGSPLLRRLLDAGTVE

SEQ ID NO: 84041 - protein, 17 aa, Mycobacterium avium
RHIEAIDAYWVSAAEHG

SEQ ID NO: 84042 - protein, 17 aa, Mycobacterium avium
RHLAVNLTGTFLCLQAA

SEQ ID NO: 84043 - protein, 24 aa, Mycobacterium avium
RHLLDMRSGVAFSENYDDPAAQIH

SEQ ID NO: 84044 - protein, 20 aa, Mycobacterium avium
RHPRSLRVCTLLRKPDARGA

SEQ ID NO: 84045 - protein, 18 aa, Mycobacterium avium
RHRLRVAYRPVFPNVYLP

SEQ ID NO: 84046 - protein, 18 aa, Mycobacterium avium
RHRPGWLPIPLRSIARLT

SEQ ID NO: 84047 - protein, 18 aa, Mycobacterium avium
RHRQGRRTARENIDDLVD

SEQ ID NO: 84048 - protein, 17 aa, Mycobacterium avium
RHRVECAVLLRGIGGFG

SEQ ID NO: 84049 - protein, 17 aa, Mycobacterium avium
RHRYALVDMANKVRPTS

SEQ ID NO: 84050 - protein, 18 aa, Mycobacterium avium
RHSKTLSEKGIRLLDCGT

SEQ ID NO: 84051 - protein, 18 aa, Mycobacterium avium
RHTIEWYSAAHGFAVPDN

SEQ ID NO: 84052 - protein, 18 aa, Mycobacterium avium
RHVDKWYGNRHVLQDVSL

SEQ ID NO: 84053 - protein, 23 aa, Mycobacterium avium
RHVSRGKLLPRERVDRLLDPGSP

SEQ ID NO: 84054 - protein, 21 aa, Mycobacterium avium
RHWPQGRLSKAYAAYSTPFWR

SEQ ID NO: 84055 - protein, 22 aa, Mycobacterium avium
RIAGEFRRGRLLLAGDAAHLMP

SEQ ID NO: 84056 - protein, 26 aa, Mycobacterium avium
RIAGLRTAPPFAVHRFWLDRPVSPRR

SEQ ID NO: 84057 - protein, 17 aa, Mycobacterium avium
RICDALLAGARKVAADS

SEQ ID NO: 84058 - protein, 18 aa, Mycobacterium avium
RIDDIIVFHQLTRDEIIR

SEQ ID NO: 84059 - protein, 18 aa, Mycobacterium avium
RIEEEVVRAALTEHDGVL

SEQ ID NO: 84060 - protein, 23 aa, Mycobacterium avium
RIFEELSLRGCVAALDGSDVIRA

SEQ ID NO: 84061 - protein, 17 aa, Mycobacterium avium
RIFEPRYGALVRHCLDT

SEQ ID NO: 84062 - protein, 27 aa, Mycobacterium avium
RIFSQAVCFKAPYFSTVHPVIVELRPG

SEQ ID NO: 84063 - protein, 19 aa, Mycobacterium avium
RIFYRIGFTPWDGHPLAQS

SEQ ID NO: 84064 - protein, 20 aa, Mycobacterium avium
RIGAEVRDGDILVGKVTPKG

SEQ ID NO: 84065 - protein, 19 aa, Mycobacterium avium
RIGAIEFATTIAPGLRDVL

SEQ ID NO: 84066 - protein, 20 aa, Mycobacterium avium
RIGASLVVRAIRPVANPALY

SEQ ID NO: 84067 - protein, 25 aa, Mycobacterium avium
RIGELMGGPVARWAEETDRNPPRLE

SEQ ID NO: 84068 - protein, 18 aa, Mycobacterium avium
RIGLALNCEIVPWCRFAR

SEQ ID NO: 84069 - protein, 24 aa, Mycobacterium avium
RIGQDFLDRYAAKYGGRRPEYCVP

SEQ ID NO: 84070 - protein, 19 aa, Mycobacterium avium
RIGVRARRGVILGTGGFEW

SEQ ID NO: 84071 - protein, 21 aa, Mycobacterium avium
RIIYIGSVSGMWGIGNQSNYA

SEQ ID NO: 84072 - protein, 19 aa, Mycobacterium avium
RINEALLGRRHRFGYTVGT

SEQ ID NO: 84073 - protein, 20 aa, Mycobacterium avium
RINHAYLFSGPRGCGKTSSA

SEQ ID NO: 84074 - protein, 17 aa, Mycobacterium avium
RINRPTLENLLRELDSN

SEQ ID NO: 84075 - protein, 18 aa, Mycobacterium avium
RIPLAVEEMLRWNSPVVH

SEQ ID NO: 84076 - protein, 20 aa, Mycobacterium avium
RIPLPGRRRPSSRAVRSARV

SEQ ID NO: 84077 - protein, 25 aa, Mycobacterium avium
RIQRELPDWLSADVAILGEPTGGYI

SEQ ID NO: 84078 - protein, 18 aa, Mycobacterium avium
RIRDFMISGLDGFDSLEQ

SEQ ID NO: 84079 - protein, 24 aa, Mycobacterium avium
RIRELMTGSGLDFDTALAVVRSST

SEQ ID NO: 84080 - protein, 18 aa, Mycobacterium avium
RIRRAGAVLHALPPEHGG

SEQ ID NO: 84081 - protein, 25 aa, Mycobacterium avium
RIRYHGGEFIELIVGGTTYDQAAEA

SEQ ID NO: 84082 - protein, 21 aa, Mycobacterium avium
RISDVLLPFLVTRQLICGAGK

SEQ ID NO: 84083 - protein, 19 aa, Mycobacterium avium
RISGFGQTGPFRRRPATPL

SEQ ID NO: 84084 - protein, 21 aa, Mycobacterium avium
RISNAISRDARYRFSHDRVAE

SEQ ID NO: 84085 - protein, 17 aa, Mycobacterium avium
RISNALVAMAIESLGAQ

SEQ ID NO: 84086 - protein, 18 aa, Mycobacterium avium
RISPGAIRLLARWDIRQT

SEQ ID NO: 84087 - protein, 20 aa, Mycobacterium avium
RITAQQCQEIATSVQTATAA

SEQ ID NO: 84088 - protein, 25 aa, Mycobacterium avium
RITDWKIELCDTIADNASSAGFVLG

SEQ ID NO: 84089 - protein, 18 aa, Mycobacterium avium
RITEAELLTAMTPEELFS

SEQ ID NO: 84090 - protein, 28 aa, Mycobacterium avium
RITKTSDVSTVWTWPDKPGVAGCAAMDG

SEQ ID NO: 84091 - protein, 17 aa, Mycobacterium avium
RIVKRLQAGSVQVNCQL

SEQ ID NO: 84092 - protein, 17 aa, Mycobacterium avium
RIVRLCLDSPSVAEISA

SEQ ID NO: 84093 - protein, 26 aa, Mycobacterium avium
RIVTAFPYRLVDFWRDHRAPSEEDLE

SEQ ID NO: 84094 - protein, 19 aa, Mycobacterium avium
RIVTIGAFEAFKMERYSAF

SEQ ID NO: 84095 - protein, 25 aa, Mycobacterium avium
RIVVLGDAWDLLKFLNDDEYAIDPK

SEQ ID NO: 84096 - protein, 21 aa, Mycobacterium avium
RKDTHAHAWALRMSPDGNVWG

SEQ ID NO: 84097 - protein, 23 aa, Mycobacterium avium
RKDWDEFDRLFAPNVSIENRRKI

SEQ ID NO: 84098 - protein, 19 aa, Mycobacterium avium
RKGIARGKSVVALVYAGGV

SEQ ID NO: 84099 - protein, 17 aa, Mycobacterium avium
RKGKIVVEFGSVDDLQR

SEQ ID NO: 84100 - protein, 17 aa, Mycobacterium avium
RKIEIGCYQGLRHRRGL

SEQ ID NO: 84101 - protein, 25 aa, Mycobacterium avium
RKLARNTFYGMARWQAKLEQRQGFL

SEQ ID NO: 84102 - protein, 30 aa, Mycobacterium avium
RKLDNGKWTWRYDAIRKFPDFDGLWADVDA

SEQ ID NO: 84103 - protein, 19 aa, Mycobacterium avium
RKLPAKARKAILEGSDHQV

SEQ ID NO: 84104 - protein, 19 aa, Mycobacterium avium
RKMWASSMNIAGAGWSGQA

SEQ ID NO: 84105 - protein, 25 aa, Mycobacterium avium
RKPHRVPVWFMRQAGRSLPEYRALR

SEQ ID NO: 84106 - protein, 17 aa, Mycobacterium avium
RKPRQVFTRDVLLEQVW

SEQ ID NO: 84107 - protein, 23 aa, Mycobacterium avium
RKSQWIRNGVGFTDFAAFLDETI

SEQ ID NO: 84108 - protein, 26 aa, Mycobacterium avium
RKTLKAVAVKAPFFGDRRKAFLEDLA

SEQ ID NO: 84109 - protein, 18 aa, Mycobacterium avium
RKVLDCDDVIAATTSSRD

SEQ ID NO: 84110 - protein, 19 aa, Mycobacterium avium
RKYIGAYLAVLGHTDVISF

SEQ ID NO: 84111 - protein, 20 aa, Mycobacterium avium
RLAAHVTETFLIPAESPSGR

SEQ ID NO: 84112 - protein, 26 aa, Mycobacterium avium
RLAEAIRRFGPIFAQYYGQSEAPMVI

SEQ ID NO: 84113 - protein, 19 aa, Mycobacterium avium
RLAERPANLTFFLRALAAR

SEQ ID NO: 84114 - protein, 25 aa, Mycobacterium avium
RLAHRRELVELVSAWTRTRTPVRAA

SEQ ID NO: 84115 - protein, 21 aa, Mycobacterium avium
RLARVPWGLLAIPKSGPSKEE

SEQ ID NO: 84116 - protein, 21 aa, Mycobacterium avium
RLATEAGRLLLGVRDEFADAP

SEQ ID NO: 84117 - protein, 19 aa, Mycobacterium avium
RLAWERELLPGAQVVLAPT

SEQ ID NO: 84118 - protein, 19 aa, Mycobacterium avium
RLCTACFDGQYPIELPGET

SEQ ID NO: 84119 - protein, 18 aa, Mycobacterium avium
RLDGLTIRDAARLGRRLK

SEQ ID NO: 84120 - protein, 19 aa, Mycobacterium avium
RLDGVKSLVPAAADAELFI

SEQ ID NO: 84121 - protein, 17 aa, Mycobacterium avium
RLDLRRMSYVQRLAKLL

SEQ ID NO: 84122 - protein, 19 aa, Mycobacterium avium
RLDLSLLDREVPDWRERQT

SEQ ID NO: 84123 - protein, 18 aa, Mycobacterium avium
RLDPGLPLPSRAHEGDAG

SEQ ID NO: 84124 - protein, 23 aa, Mycobacterium avium
RLEIPRLLVELVRPTSPDGSPRR

SEQ ID NO: 84125 - protein, 17 aa, Mycobacterium avium
RLFAAGMDLQGTLARAR

SEQ ID NO: 84126 - protein, 19 aa, Mycobacterium avium
RLFAERCISGLSANVEHLR

SEQ ID NO: 84127 - protein, 22 aa, Mycobacterium avium
RLFPQGLARFIGLRDQRCRTPY

SEQ ID NO: 84128 - protein, 17 aa, Mycobacterium avium
RLFPVIRRYALAYHVVF

SEQ ID NO: 84129 - protein, 17 aa, Mycobacterium avium
RLFQEIRELRGLAYSVY

SEQ ID NO: 84130 - protein, 20 aa, Mycobacterium avium
RLGALVLTSCDAFEHFPPPV

SEQ ID NO: 84131 - protein, 26 aa, Mycobacterium avium
RLGARKGRGPGGIWAPECAYAPGLEH

SEQ ID NO: 84132 - protein, 18 aa, Mycobacterium avium
RLGWVRELGRIIGSDGDG

SEQ ID NO: 84133 - protein, 22 aa, Mycobacterium avium
RLIAELHELRLPIVGRDQDPDY

SEQ ID NO: 84134 - protein, 21 aa, Mycobacterium avium
RLIDRAGRWLLNYRPQPLAVG

SEQ ID NO: 84135 - protein, 18 aa, Mycobacterium avium
RLLAEQRLETGWVNTDFV

SEQ ID NO: 84136 - protein, 17 aa, Mycobacterium avium
RLLGPRPDTSVRFKHNR

SEQ ID NO: 84137 - protein, 22 aa, Mycobacterium avium
RLLHELAPGLVLWECDKTVYRA

SEQ ID NO: 84138 - protein, 19 aa, Mycobacterium avium
RLLKTYARLSGRWHTGLPV

SEQ ID NO: 84139 - protein, 25 aa, Mycobacterium avium
RLLNLALEMGCVFSIDTDAHAPGQL

SEQ ID NO: 84140 - protein, 24 aa, Mycobacterium avium
RLLQRLGADVAEYGFVETSAKQDG

SEQ ID NO: 84141 - protein, 28 aa, Mycobacterium avium
RLLRSAILPVSFGFPFGLSAVIPPNLPL

SEQ ID NO: 84142 - protein, 19 aa, Mycobacterium avium
RLLTLDAYVAAGFHVVALL

SEQ ID NO: 84143 - protein, 20 aa, Mycobacterium avium
RLMAERGRLFGGLPDGGRMV

SEQ ID NO: 84144 - protein, 17 aa, Mycobacterium avium
RLMRDGASFTELSVDRL

SEQ ID NO: 84145 - protein, 19 aa, Mycobacterium avium
RLMTWRGGYHGDTFTPMSV

SEQ ID NO: 84146 - protein, 24 aa, Mycobacterium avium
RLMVYRGDLGRRWAGPAFLLNEML

SEQ ID NO: 84147 - protein, 24 aa, Mycobacterium avium
RLPDLRVRFRLDRNVSLADSIDRG

SEQ ID NO: 84148 - protein, 19 aa, Mycobacterium avium
RLPHYGVVAITGYEEATEV

SEQ ID NO: 84149 - protein, 29 aa, Mycobacterium avium
RLPPQVFGALFSHEWFVDPALPTGTVRRD

SEQ ID NO: 84150 - protein, 21 aa, Mycobacterium avium
RLPTVRELAGQLGVAVNTVAR

SEQ ID NO: 84151 - protein, 20 aa, Mycobacterium avium
RLRAKLGPEYEALIGTVRNV

SEQ ID NO: 84152 - protein, 20 aa, Mycobacterium avium
RLRAVLHAEQQWRPGLPMPR

SEQ ID NO: 84153 - protein, 20 aa, Mycobacterium avium
RLRCGTGDYIDFSWFDAVVM

SEQ ID NO: 84154 - protein, 18 aa, Mycobacterium avium
RLREFELDAAIAHTAPDD

SEQ ID NO: 84155 - protein, 22 aa, Mycobacterium avium
RLRELIDRYPLRGIKGPMGTSQ

SEQ ID NO: 84156 - protein, 24 aa, Mycobacterium avium
RLRELTGAGMLDCKNALAESDGDF

SEQ ID NO: 84157 - protein, 19 aa, Mycobacterium avium
RLREVLVSHALRLRSAALL

SEQ ID NO: 84158 - protein, 23 aa, Mycobacterium avium
RLRKDIFELYGYNAVVHVLSASG

SEQ ID NO: 84159 - protein, 18 aa, Mycobacterium avium
RLRPSGRGADVWDELHPT

SEQ ID NO: 84160 - protein, 19 aa, Mycobacterium avium
RLRRLPAATVDEFRQTELF

SEQ ID NO: 84161 - protein, 19 aa, Mycobacterium avium
RLRRSHPAELERISDDGRR

SEQ ID NO: 84162 - protein, 20 aa, Mycobacterium avium
RLSAQVGAYHLMRTHGGRGV

SEQ ID NO: 84163 - protein, 18 aa, Mycobacterium avium
RLSPPTANPGWSYATRLR

SEQ ID NO: 84164 - protein, 18 aa, Mycobacterium avium
RLSRRGRRLGLTDTNNGL

SEQ ID NO: 84165 - protein, 17 aa, Mycobacterium avium
RLSRWTGVTAQPVTTMD

SEQ ID NO: 84166 - protein, 19 aa, Mycobacterium avium
RLTAEKLPDGWDADLPHWE

SEQ ID NO: 84167 - protein, 19 aa, Mycobacterium avium
RLTDFMTEHVFAAEAEYDK

SEQ ID NO: 84168 - protein, 20 aa, Mycobacterium avium
RLTELGPERFAAWLRESGGV

SEQ ID NO: 84169 - protein, 20 aa, Mycobacterium avium
RLTGELADWFGIDAGTLRPG

SEQ ID NO: 84170 - protein, 18 aa, Mycobacterium avium
RLTMARWSTERLLQLPHC

SEQ ID NO: 84171 - protein, 19 aa, Mycobacterium avium
RLTSALGIVHSRFSTNTFP

SEQ ID NO: 84172 - protein, 18 aa, Mycobacterium avium
RLVIVDGVPMSALVAEAE

SEQ ID NO: 84173 - protein, 19 aa, Mycobacterium avium
RLVKRRFQRGDSHFICVVA

SEQ ID NO: 84174 - protein, 17 aa, Mycobacterium avium
RLVSKAFAPRVVAALEP

SEQ ID NO: 84175 - protein, 25 aa, Mycobacterium avium
RLVSRVRGGKLMRLSGILDDLIRES

SEQ ID NO: 84176 - protein, 27 aa, Mycobacterium avium
RLVVFPEATMCRFGVPLAPIAEPVDGP

SEQ ID NO: 84177 - protein, 17 aa, Mycobacterium avium
RLYDAIDQWAFCALNTS

SEQ ID NO: 84178 - protein, 23 aa, Mycobacterium avium
RMASLRGLLKFRAGVRPPVPLEE

SEQ ID NO: 84179 - protein, 17 aa, Mycobacterium avium
RMEMRWKFQSESLGADL

SEQ ID NO: 84180 - protein, 19 aa, Mycobacterium avium
RMFRDLTRLSAAGIPTIAL

SEQ ID NO: 84181 - protein, 20 aa, Mycobacterium avium
RMGALALHVAKIARRRHPQH

SEQ ID NO: 84182 - protein, 21 aa, Mycobacterium avium
RMGANIVRRVVKGGHECVVYD

SEQ ID NO: 84183 - protein, 19 aa, Mycobacterium avium
RMGIEGIYLGGWATSAKGS

SEQ ID NO: 84184 - protein, 24 aa, Mycobacterium avium
RMLANWLTECGWVRDDTLVRRLEN

SEQ ID NO: 84185 - protein, 22 aa, Mycobacterium avium
RMLRSGRRAMVMQVDIFGDGDD

SEQ ID NO: 84186 - protein, 30 aa, Mycobacterium avium
RMNGGFFPSVREYSSLYGLSDRRQAMLPGH

SEQ ID NO: 84187 - protein, 17 aa, Mycobacterium avium
RMPGFGLTGPWRDNPAF

SEQ ID NO: 84188 - protein, 20 aa, Mycobacterium avium
RMPGLEDFRDGLIPRFANAY

SEQ ID NO: 84189 - protein, 19 aa, Mycobacterium avium
RMPGYGLHGPWRDYVGWAL

SEQ ID NO: 84190 - protein, 19 aa, Mycobacterium avium
RMPLHPVAIELLREVGPMA

SEQ ID NO: 84191 - protein, 19 aa, Mycobacterium avium
RMQGYEVLWQPGMDHAGIA

SEQ ID NO: 84192 - protein, 17 aa, Mycobacterium avium
RMRAETGARLRGAMADH

SEQ ID NO: 84193 - protein, 18 aa, Mycobacterium avium
RMRHVPFRITPLARDAWL

SEQ ID NO: 84194 - protein, 23 aa, Mycobacterium avium
RMRWKGKRPSVRGVVMNPVDHPH

SEQ ID NO: 84195 - protein, 24 aa, Mycobacterium avium
RMTGRNVLHALGFDAFGLPAEQYA

SEQ ID NO: 84196 - protein, 21 aa, Mycobacterium avium
RMVDARLAARMYTREHGEDDP

SEQ ID NO: 84197 - protein, 20 aa, Mycobacterium avium
RNAGRMLAIMHALDGALATV

SEQ ID NO: 84198 - protein, 20 aa, Mycobacterium avium
RNAIELCRALGVTFSEIDIR

SEQ ID NO: 84199 - protein, 18 aa, Mycobacterium avium
RNAPHAFGSLGLTNIAIW

SEQ ID NO: 84200 - protein, 26 aa, Mycobacterium avium
RNEDNRWTVQLAWKVGRSDNVAHFCF

SEQ ID NO: 84201 - protein, 18 aa, Mycobacterium avium
RNEIAVGLGVSRVPIQEA

SEQ ID NO: 84202 - protein, 27 aa, Mycobacterium avium
RNFVTSLQLLLTFPFPNFGIKQAVRGD

SEQ ID NO: 84203 - protein, 20 aa, Mycobacterium avium
RNGERYQFLRWGQGAFSDFK

SEQ ID NO: 84204 - protein, 22 aa, Mycobacterium avium
RNGRPRVAGVSSFGFAGTNAHV

SEQ ID NO: 84205 - protein, 18 aa, Mycobacterium avium
RNIVSPFWAVLGFGRASA

SEQ ID NO: 84206 - protein, 20 aa, Mycobacterium avium
RNLGHCARVVVVGTTPDAAA

SEQ ID NO: 84207 - protein, 24 aa, Mycobacterium avium
RNLIGISLVQPVWRVPRSARAAET

SEQ ID NO: 84208 - protein, 17 aa, Mycobacterium avium
RNLYRPMRHPLIDNPLP

SEQ ID NO: 84209 - protein, 19 aa, Mycobacterium avium
RNNVVLSRRAWLEQTQSEV

SEQ ID NO: 84210 - protein, 20 aa, Mycobacterium avium
RNQGAFGFSEPCTDCRGSGS

SEQ ID NO: 84211 - protein, 23 aa, Mycobacterium avium
RNQIELFTALLLSLPGSPVLYYG

SEQ ID NO: 84212 - protein, 24 aa, Mycobacterium avium
RNVSRSLIGPVLRAASFSDLQVSR

SEQ ID NO: 84213 - protein, 25 aa, Mycobacterium avium
RNVWANAVIFCGHFPDGAEKFTKTD

SEQ ID NO: 84214 - protein, 25 aa, Mycobacterium avium
RPADRAARIAKFWAAEAGARVAATA

SEQ ID NO: 84215 - protein, 22 aa, Mycobacterium avium
RPAEEMLYLAMEDFRVDVVVGK

SEQ ID NO: 84216 - protein, 20 aa, Mycobacterium avium
RPAGFKEWHHFVVHGRGVRL

SEQ ID NO: 84217 - protein, 25 aa, Mycobacterium avium
RPALLSVSFGTDWSWVAKAHDAGIP

SEQ ID NO: 84218 - protein, 17 aa, Mycobacterium avium
RPAWDTDRWLRDFFGPA

SEQ ID NO: 84219 - protein, 20 aa, Mycobacterium avium
RPDAVPDFVGGIYDLAREHP

SEQ ID NO: 84220 - protein, 23 aa, Mycobacterium avium
RPDDAWLASWSRAEAAVPHPIDP

SEQ ID NO: 84221 - protein, 20 aa, Mycobacterium avium
RPDIAYEIVALDWACVEQPE

SEQ ID NO: 84222 - protein, 19 aa, Mycobacterium avium
RPDLLELFDIAELEKYYTD

SEQ ID NO: 84223 - protein, 18 aa, Mycobacterium avium
RPDRAIETNVEFWAAVIL

SEQ ID NO: 84224 - protein, 29 aa, Mycobacterium avium
RPDRSTTLALRWLVSFSRQRREKTMVERL

SEQ ID NO: 84225 - protein, 26 aa, Mycobacterium avium
RPDVIARLTTEWVDLQSAGAVAPQLT

SEQ ID NO: 84226 - protein, 19 aa, Mycobacterium avium
RPDVLVAMNPAALKANIGD

SEQ ID NO: 84227 - protein, 21 aa, Mycobacterium avium
RPDYGITGWVILTLIQHGTPW

SEQ ID NO: 84228 - protein, 30 aa, Mycobacterium avium
RPEERAALPPQCWRLVWRNPVNGRKALYLA

SEQ ID NO: 84229 - protein, 19 aa, Mycobacterium avium
RPEFLNRIDDIIVFHQLTR

SEQ ID NO: 84230 - protein, 24 aa, Mycobacterium avium
RPEMGRPRFGSWLRNSTRGALAMD

SEQ ID NO: 84231 - protein, 20 aa, Mycobacterium avium
RPEPPIGRAMVRRAGTDVTV

SEQ ID NO: 84232 - protein, 22 aa, Mycobacterium avium
RPERRRGMAVIISDFLGPINWQ

SEQ ID NO: 84233 - protein, 25 aa, Mycobacterium avium
RPGDGWRLAMDLLPYERSSCFWQRI

SEQ ID NO: 84234 - protein, 19 aa, Mycobacterium avium
RPGGELLRLNPRNVDQLLF

SEQ ID NO: 84235 - protein, 19 aa, Mycobacterium avium
RPGQVRTRMSAHVKEAPLT

SEQ ID NO: 84236 - protein, 18 aa, Mycobacterium avium
RPHYARTLDTWAANLEAN

SEQ ID NO: 84237 - protein, 20 aa, Mycobacterium avium
RPHYIKTLHIWGDTLESNRD

SEQ ID NO: 84238 - protein, 17 aa, Mycobacterium avium
RPIGLIIGLQLSANPFV

SEQ ID NO: 84239 - protein, 26 aa, Mycobacterium avium
RPIPGPLKWDLTLGVATDTRESLINS

SEQ ID NO: 84240 - protein, 17 aa, Mycobacterium avium
RPIRINRVGDLGVLDSD

SEQ ID NO: 84241 - protein, 19 aa, Mycobacterium avium
RPITVPVLLTLTERFDLPT

SEQ ID NO: 84242 - protein, 20 aa, Mycobacterium avium
RPKLHPEILAATRAVGKQLE

SEQ ID NO: 84243 - protein, 29 aa, Mycobacterium avium
RPKVWPPVRRIDGAYGDRNLVCSCPPVEA

SEQ ID NO: 84244 - protein, 17 aa, Mycobacterium avium
RPLDVANVIAFLASDAA

SEQ ID NO: 84245 - protein, 18 aa, Mycobacterium avium
RPLGKLVAAVLEPGSVAK

SEQ ID NO: 84246 - protein, 19 aa, Mycobacterium avium
RPLPAEWLNYAALDVELLI

SEQ ID NO: 84247 - protein, 19 aa, Mycobacterium avium
RPLRGRLFAVLGSSLALGD

SEQ ID NO: 84248 - protein, 20 aa, Mycobacterium avium
RPLSLGRLDRGWVVASETAA

SEQ ID NO: 84249 - protein, 27 aa, Mycobacterium avium
RPLYYLEMPPSLFAPIVENLAKADLLE

SEQ ID NO: 84250 - protein, 19 aa, Mycobacterium avium
RPMHEKIVGRIAVSDLARR

SEQ ID NO: 84251 - protein, 26 aa, Mycobacterium avium
RPMILKRFVKGITQEAVFQKRAPANR

SEQ ID NO: 84252 - protein, 23 aa, Mycobacterium avium
RPNARGVPFIFVRTDSAGNISKR

SEQ ID NO: 84253 - protein, 21 aa, Mycobacterium avium
RPPGRKDPAAFVLENFTSTER

SEQ ID NO: 84254 - protein, 28 aa, Mycobacterium avium
RPPVVGRLEGGRCLLDLRTVSPEDDELL

SEQ ID NO: 84255 - protein, 26 aa, Mycobacterium avium
RPQGVSGLNAVVSWPAEEWGRDPAGF

SEQ ID NO: 84256 - protein, 20 aa, Mycobacterium avium
RPQVWDVLEEVIAEHPVLLN

SEQ ID NO: 84257 - protein, 18 aa, Mycobacterium avium
RPRDELAVAAGLARAERG

SEQ ID NO: 84258 - protein, 18 aa, Mycobacterium avium
RPRIAELLQPDRVALRKL

SEQ ID NO: 84259 - protein, 20 aa, Mycobacterium avium
RPRMLYDYFQQLFAQVTNPP

SEQ ID NO: 84260 - protein, 24 aa, Mycobacterium avium
RPRSSSHVPEWARRWQRLLFDSGW

SEQ ID NO: 84261 - protein, 20 aa, Mycobacterium avium
RPRVRREGFGRIYETPTDEF

SEQ ID NO: 84262 - protein, 21 aa, Mycobacterium avium
RPRWRRIADGLMHTKARDAEA

SEQ ID NO: 84263 - protein, 27 aa, Mycobacterium avium
RPSPHLGTLEMRICDGVSNLHELAALV

SEQ ID NO: 84264 - protein, 25 aa, Mycobacterium avium
RPSRLVNLSSAFGLIAVPYQGAYST

SEQ ID NO: 84265 - protein, 17 aa, Mycobacterium avium
RPTCHLVSVPVDLRHDW

SEQ ID NO: 84266 - protein, 33 aa, Mycobacterium avium
RPTGPRPFLRLEGSAVFRWAAFEMGKVGQQAMD

SEQ ID NO: 84267 - protein, 33 aa, Mycobacterium avium
RPTLRGRPVLVGGLGGRGVVAGASYEARVFGAR

SEQ ID NO: 84268 - protein, 27 aa, Mycobacterium avium
RPTRTGLGIYRFFADCVGHIDDEPVAE

SEQ ID NO: 84269 - protein, 20 aa, Mycobacterium avium
RPTYRRLAAECSREELAQRL

SEQ ID NO: 84270 - protein, 19 aa, Mycobacterium avium
RPVHDPARYDQIWKEQVLP

SEQ ID NO: 84271 - protein, 18 aa, Mycobacterium avium
RPVKSSFREGLTVLEYFI

SEQ ID NO: 84272 - protein, 19 aa, Mycobacterium avium
RPVPFVIGVAGSVAVGKST

SEQ ID NO: 84273 - protein, 20 aa, Mycobacterium avium
RPVPIERRVLAALGPKMLKL

SEQ ID NO: 84274 - protein, 30 aa, Mycobacterium avium
RPVQPPPSEGWRLLLYKLSGGLINLGESPR

SEQ ID NO: 84275 - protein, 25 aa, Mycobacterium avium
RPVRVDTWGGWLWINMDPDCEPLAD

SEQ ID NO: 84276 - protein, 18 aa, Mycobacterium avium
RPVVLAGHGAARADATKA

SEQ ID NO: 84277 - protein, 18 aa, Mycobacterium avium
RPWYRAFNAYKMAVICLI

SEQ ID NO: 84278 - protein, 20 aa, Mycobacterium avium
RPYPVPIICALLGAPREDWR

SEQ ID NO: 84279 - protein, 18 aa, Mycobacterium avium
RQAAVAAGIGWDVPALSI

SEQ ID NO: 84280 - protein, 18 aa, Mycobacterium avium
RQAEWRRGTLPPGQLGWR

SEQ ID NO: 84281 - protein, 21 aa, Mycobacterium avium
RQAGFDVGRPAAWAAEGLLGF

SEQ ID NO: 84282 - protein, 19 aa, Mycobacterium avium
RQDIEDIFWLQATIAKELA

SEQ ID NO: 84283 - protein, 18 aa, Mycobacterium avium
RQGEVLWTAMPLFHLSAA

SEQ ID NO: 84284 - protein, 21 aa, Mycobacterium avium
RQGLKVSVPEEVAWQQGWITD

SEQ ID NO: 84285 - protein, 24 aa, Mycobacterium avium
RQGVLSEGWRLNPRSDPVAAEVAA

SEQ ID NO: 84286 - protein, 17 aa, Mycobacterium avium
RQGVVGLFQPGLVGEQA

SEQ ID NO: 84287 - protein, 19 aa, Mycobacterium avium
RQIGCSWCVDFGSMLQRLD

SEQ ID NO: 84288 - protein, 24 aa, Mycobacterium avium
RQKLALTCRALFDAGHDSGLAGQI

SEQ ID NO: 84289 - protein, 18 aa, Mycobacterium avium
RQKVSLISAFSSRARLLL

SEQ ID NO: 84290 - protein, 20 aa, Mycobacterium avium
RQLDASRASHDWAKGMRDQL

SEQ ID NO: 84291 - protein, 18 aa, Mycobacterium avium
RQLILLDAPSVLGWAEFR

SEQ ID NO: 84292 - protein, 23 aa, Mycobacterium avium
RQLNAVAVAAGWPTDEGGEFLDN

SEQ ID NO: 84293 - protein, 20 aa, Mycobacterium avium
RQLRLERVVLVGVWTDGTAA

SEQ ID NO: 84294 - protein, 24 aa, Mycobacterium avium
RQNMPAPMLAPGPRLPETTVPVQT

SEQ ID NO: 84295 - protein, 21 aa, Mycobacterium avium
RQRAVLLLRDVLGWRAAEVAE

SEQ ID NO: 84296 - protein, 22 aa, Mycobacterium avium
RQRFLAEQGYGYIIRDADDLLG

SEQ ID NO: 84297 - protein, 20 aa, Mycobacterium avium
RQRFPRELIEHLGARGVFSE

SEQ ID NO: 84298 - protein, 25 aa, Mycobacterium avium
RQRLDASEALSFVRQRHGLDNGDLD

SEQ ID NO: 84299 - protein, 25 aa, Mycobacterium avium
RQRLMFSIPELKAAMYDEYYRTVTV

SEQ ID NO: 84300 - protein, 19 aa, Mycobacterium avium
RQRMALFFDVISAWMQAEP

SEQ ID NO: 84301 - protein, 22 aa, Mycobacterium avium
RQRMVAIEFDFPAADVEEGIVA

SEQ ID NO: 84302 - protein, 18 aa, Mycobacterium avium
RQSIDLLAQLPVSASAHE

SEQ ID NO: 84303 - protein, 20 aa, Mycobacterium avium
RQTFATGRTRDVEWRKRQLL

SEQ ID NO: 84304 - protein, 24 aa, Mycobacterium avium
RQTWACGPEGMLNAAERVWSAAGI

SEQ ID NO: 84305 - protein, 17 aa, Mycobacterium avium
RQYLAQVGATWVVPSAG

SEQ ID NO: 84306 - protein, 25 aa, Mycobacterium avium
RRAADLPPAVGVLVEYQGSGKDSDK

SEQ ID NO: 84307 - protein, 19 aa, Mycobacterium avium
RRAALPRLQLWRIDADGTY

SEQ ID NO: 84308 - protein, 24 aa, Mycobacterium avium
RRAALRVSNQVQRRWRAFSRTGVP

SEQ ID NO: 84309 - protein, 17 aa, Mycobacterium avium
RRAASFVSACALVSASG

SEQ ID NO: 84310 - protein, 21 aa, Mycobacterium avium
RRAEWDDGRAFVLTDTVGFVR

SEQ ID NO: 84311 - protein, 18 aa, Mycobacterium avium
RRAGIGVATVSGDRGHAV

SEQ ID NO: 84312 - protein, 18 aa, Mycobacterium avium
RRAKRLCERLLSYASPLH

SEQ ID NO: 84313 - protein, 19 aa, Mycobacterium avium
RRALADGVIDCVATDHAPH

SEQ ID NO: 84314 - protein, 33 aa, Mycobacterium avium
RRALHQAAVRLCARVGLRGLATVEFLVSGERFV

SEQ ID NO: 84315 - protein, 21 aa, Mycobacterium avium
RRALVRTGVAVAIPFGMVGLV

SEQ ID NO: 84316 - protein, 24 aa, Mycobacterium avium
RRAMAYQVHVGRWDQLDGLVEASY

SEQ ID NO: 84317 - protein, 20 aa, Mycobacterium avium
RRAPVDITMISPVDYMLYTP

SEQ ID NO: 84318 - protein, 24 aa, Mycobacterium avium
RRARKGEFRKLWISRINAAARAND

SEQ ID NO: 84319 - protein, 26 aa, Mycobacterium avium
RRAVPVSFAGRSWWVAIEDIGRLRDG

SEQ ID NO: 84320 - protein, 30 aa, Mycobacterium avium
RRAVVTRYELVDGFPRFDVDDVYLGNGVSE

SEQ ID NO: 84321 - protein, 24 aa, Mycobacterium avium
RRDHGGVIFIDLRDASGITQVVFR

SEQ ID NO: 84322 - protein, 21 aa, Mycobacterium avium
RRDLADAILRRRTNRLPFRAP

SEQ ID NO: 84323 - protein, 27 aa, Mycobacterium avium
RREDKPFWWAHFDRLNFPIDEWADNTD

SEQ ID NO: 84324 - protein, 27 aa, Mycobacterium avium
RREWGPAVAALARWSGDLTVAEDAVQE

SEQ ID NO: 84325 - protein, 19 aa, Mycobacterium avium
RRFAEATSRAAARGATVWV

SEQ ID NO: 84326 - protein, 21 aa, Mycobacterium avium
RRFARHYVHAGMIGWDGHKMS

SEQ ID NO: 84327 - protein, 22 aa, Mycobacterium avium
RRFMRMYRRLYAILERVVPLKF

SEQ ID NO: 84328 - protein, 26 aa, Mycobacterium avium
RRFMSPRLPTPALMHYLSEVDYVDHF

SEQ ID NO: 84329 - protein, 23 aa, Mycobacterium avium
RRFREMYRRIVGVERPVPSDPYT

SEQ ID NO: 84330 - protein, 23 aa, Mycobacterium avium
RRGEPGPPFFAAYGEWMGTPPPT

SEQ ID NO: 84331 - protein, 17 aa, Mycobacterium avium
RRGKVLRRLAGDDPEVN

SEQ ID NO: 84332 - protein, 18 aa, Mycobacterium avium
RRGLRAKGGKLVWTEQDR

SEQ ID NO: 84333 - protein, 21 aa, Mycobacterium avium
RRGNALIMMGGRYIDRLERRD

SEQ ID NO: 84334 - protein, 20 aa, Mycobacterium avium
RRGPDYSSMMVQMFGQDALR

SEQ ID NO: 84335 - protein, 19 aa, Mycobacterium avium
RRGPLLRAKHALFDRLVYH

SEQ ID NO: 84336 - protein, 26 aa, Mycobacterium avium
RRGVILGTGGFEWDPVLVQAFLRGPM

SEQ ID NO: 84337 - protein, 25 aa, Mycobacterium avium
RRHMLADSGVRAWLGPLPDEPDGLP

SEQ ID NO: 84338 - protein, 18 aa, Mycobacterium avium
RRIAAALGPGWPRAVKST

SEQ ID NO: 84339 - protein, 19 aa, Mycobacterium avium
RRIAEETAKAEGKPEQALP

SEQ ID NO: 84340 - protein, 20 aa, Mycobacterium avium
RRIEHLPIGTVVRLPNADAA

SEQ ID NO: 84341 - protein, 21 aa, Mycobacterium avium
RRIGLAASKYWVCKRSTPHAA

SEQ ID NO: 84342 - protein, 22 aa, Mycobacterium avium
RRINAPAWRRAMAARQRINNLV

SEQ ID NO: 84343 - protein, 25 aa, Mycobacterium avium
RRKLTPHYRIGCKRILNSSTYYGAV

SEQ ID NO: 84344 - protein, 21 aa, Mycobacterium avium
RRKPFSVVLFDEIEKAHQEIY

SEQ ID NO: 84345 - protein, 30 aa, Mycobacterium avium
RRLAIPELPEELFLESLRQLIAVDNAWVPA

SEQ ID NO: 84346 - protein, 18 aa, Mycobacterium avium
RRLALLLTYQRFLPATGP

SEQ ID NO: 84347 - protein, 20 aa, Mycobacterium avium
RRLAPEPVLHAALGPGALIA

SEQ ID NO: 84348 - protein, 20 aa, Mycobacterium avium
RRLEAALGLVDPGAQSPRES

SEQ ID NO: 84349 - protein, 23 aa, Mycobacterium avium
RRLEMLEQLGWVIVRVVAEDRPA

SEQ ID NO: 84350 - protein, 24 aa, Mycobacterium avium
RRLGDMLFNDFLALHFSQTRPQTE

SEQ ID NO: 84351 - protein, 20 aa, Mycobacterium avium
RRLGETFFTTAYFDPNMAHM

SEQ ID NO: 84352 - protein, 18 aa, Mycobacterium avium
RRLIDERVLFGPADPAGP

SEQ ID NO: 84353 - protein, 22 aa, Mycobacterium avium
RRLKDACPHVHLLVVDDSSPDG

SEQ ID NO: 84354 - protein, 18 aa, Mycobacterium avium
RRLLKYVAQIDVERYRSL

SEQ ID NO: 84355 - protein, 18 aa, Mycobacterium avium
RRLLVVLSDGLAYDHGYE

SEQ ID NO: 84356 - protein, 18 aa, Mycobacterium avium
RRLPGLRLAVPPEQLKFK

SEQ ID NO: 84357 - protein, 26 aa, Mycobacterium avium
RRLRRRGPVHVVDWRNVQGLTPSALA

SEQ ID NO: 84358 - protein, 24 aa, Mycobacterium avium
RRLRSKARLKFLVKDWGIEKFREV

SEQ ID NO: 84359 - protein, 22 aa, Mycobacterium avium
RRLRVGAVGLIRSWRARNSGRG

SEQ ID NO: 84360 - protein, 21 aa, Mycobacterium avium
RRLTSVPARVAGLGDRGRIAV

SEQ ID NO: 84361 - protein, 19 aa, Mycobacterium avium
RRLVGLFCQQGHFDRTKAE

SEQ ID NO: 84362 - protein, 19 aa, Mycobacterium avium
RRMGRAEFVRADIRNPFIA

SEQ ID NO: 84363 - protein, 17 aa, Mycobacterium avium
RRNARRALITLCIGGGM

SEQ ID NO: 84364 - protein, 19 aa, Mycobacterium avium
RRPHGAHSYYVPAQLFPTA

SEQ ID NO: 84365 - protein, 17 aa, Mycobacterium avium
RRPVYEAALAAQETLNG

SEQ ID NO: 84366 - protein, 18 aa, Mycobacterium avium
RRQHAFDMGGPERLDKHR

SEQ ID NO: 84367 - protein, 21 aa, Mycobacterium avium
RRQLIEFCLLASQYDGLAATM

SEQ ID NO: 84368 - protein, 19 aa, Mycobacterium avium
RRQSWLLERVSMVAALEHY

SEQ ID NO: 84369 - protein, 23 aa, Mycobacterium avium
RRRAALLPALRSAGFAVDHSEAG

SEQ ID NO: 84370 - protein, 18 aa, Mycobacterium avium
RRRAERVGGTLTVGAAAG

SEQ ID NO: 84371 - protein, 20 aa, Mycobacterium avium
RRRARLNPLRVLDDKRPEVR

SEQ ID NO: 84372 - protein, 21 aa, Mycobacterium avium
RRRFSTVIEFFSYTPDELVAL

SEQ ID NO: 84373 - protein, 26 aa, Mycobacterium avium
RRRGIPVILRPAVLAKLMDGRTTLMV

SEQ ID NO: 84374 - protein, 18 aa, Mycobacterium avium
RRRLGSAGLDGVRVGTVD

SEQ ID NO: 84375 - protein, 21 aa, Mycobacterium avium
RRRPELWPNAVEEILRLESPV

SEQ ID NO: 84376 - protein, 18 aa, Mycobacterium avium
RRRRAEVFGTEPGGASAP

SEQ ID NO: 84377 - protein, 20 aa, Mycobacterium avium
RRRRDLSVLLLLDVSGSAAE

SEQ ID NO: 84378 - protein, 20 aa, Mycobacterium avium
RRRRELLRRNNLDGTLQEIK

SEQ ID NO: 84379 - protein, 19 aa, Mycobacterium avium
RRRSCPECGRRFTTVETAV

SEQ ID NO: 84380 - protein, 23 aa, Mycobacterium avium
RRRSQLVDWTWQMVRDTVLDRLL

SEQ ID NO: 84381 - protein, 19 aa, Mycobacterium avium
RRRWLPKIISGEAVLAIAM

SEQ ID NO: 84382 - protein, 20 aa, Mycobacterium avium
RRRYYRISGADAYTMRRKAR

SEQ ID NO: 84383 - protein, 26 aa, Mycobacterium avium
RRSADLRPARSFAVDYAGWVGLSQES

SEQ ID NO: 84384 - protein, 19 aa, Mycobacterium avium
RRSVAAGAYEQWRWTQDSF

SEQ ID NO: 84385 - protein, 17 aa, Mycobacterium avium
RRTEGLAALVVASADGQ

SEQ ID NO: 84386 - protein, 32 aa, Mycobacterium avium
RRTFVCPFHGWCWSLDGRNTFVLRPETFAQEN

SEQ ID NO: 84387 - protein, 20 aa, Mycobacterium avium
RRTLPGATIIKASVGPMDNN

SEQ ID NO: 84388 - protein, 17 aa, Mycobacterium avium
RRTLVIFDEIHHGGDAK

SEQ ID NO: 84389 - protein, 20 aa, Mycobacterium avium
RRTTALGRVCSPVWSSVALH

SEQ ID NO: 84390 - protein, 21 aa, Mycobacterium avium
RRVALPNIVRLLPPARAAGVR

SEQ ID NO: 84391 - protein, 25 aa, Mycobacterium avium
RRVEVELDQCWDLLRQRRALRESGG

SEQ ID NO: 84392 - protein, 19 aa, Mycobacterium avium
RRVILDLRGLNFIGTAGFS

SEQ ID NO: 84393 - protein, 20 aa, Mycobacterium avium
RRWADNLWDTGIEFGTVGVG

SEQ ID NO: 84394 - protein, 26 aa, Mycobacterium avium
RRWCSGTSNRWCEMRVRIDGRKGGLI

SEQ ID NO: 84395 - protein, 20 aa, Mycobacterium avium
RRYEIGVSNILWGNDFPHPE

SEQ ID NO: 84396 - protein, 28 aa, Mycobacterium avium
RRYLDALMPMVWVACEREDFVVEVQAMR

SEQ ID NO: 84397 - protein, 18 aa, Mycobacterium avium
RRYLSYFPPSAWSYPPSL

SEQ ID NO: 84398 - protein, 22 aa, Mycobacterium avium
RRYRWDLTLRRDYQRAAFEAGW

SEQ ID NO: 84399 - protein, 23 aa, Mycobacterium avium
RSAAETLGAIGLGSAASDVDDPR

SEQ ID NO: 84400 - protein, 26 aa, Mycobacterium avium
RSAIDAVLIGAAWQRCRVHFLRNVLA

SEQ ID NO: 84401 - protein, 20 aa, Mycobacterium avium
RSAKELYRGAPYGVGYFAGA

SEQ ID NO: 84402 - protein, 20 aa, Mycobacterium avium
RSARAFWSMTRRFRPADYRF

SEQ ID NO: 84403 - protein, 21 aa, Mycobacterium avium
RSDGDAFGRLILLYDPEGADA

SEQ ID NO: 84404 - protein, 20 aa, Mycobacterium avium
RSDGLPVWIYQFRISPHPTI

SEQ ID NO: 84405 - protein, 29 aa, Mycobacterium avium
RSEKDFRAPFAPKGRFEGLMVEQLEIFNA

SEQ ID NO: 84406 - protein, 18 aa, Mycobacterium avium
RSELARKGIARGKSVVAL

SEQ ID NO: 84407 - protein, 23 aa, Mycobacterium avium
RSGAPRGSVYYHFPDGRNQILAE

SEQ ID NO: 84408 - protein, 20 aa, Mycobacterium avium
RSGARIALVLGDRDIDAGTV

SEQ ID NO: 84409 - protein, 18 aa, Mycobacterium avium
RSGLIALLCKTDPKATPR

SEQ ID NO: 84410 - protein, 17 aa, Mycobacterium avium
RSGMAWCISSFGRDEMV

SEQ ID NO: 84411 - protein, 20 aa, Mycobacterium avium
RSGREVLYRLADHHLAHIVV

SEQ ID NO: 84412 - protein, 20 aa, Mycobacterium avium
RSGRMLRQYDDMICERFTRL

SEQ ID NO: 84413 - protein, 26 aa, Mycobacterium avium
RSGYGRELAGLGIRAFCNAKTVWIGS

SEQ ID NO: 84414 - protein, 27 aa, Mycobacterium avium
RSISGICMSTGFSLWAHRMTVEYLLTA

SEQ ID NO: 84415 - protein, 20 aa, Mycobacterium avium
RSLAHAVLMMIPEAWERHES

SEQ ID NO: 84416 - protein, 25 aa, Mycobacterium avium
RSLARRPAAEIKRVIRGVSPEEAIA

SEQ ID NO: 84417 - protein, 19 aa, Mycobacterium avium
RSLDWHHVYVFTGRSTDEL

SEQ ID NO: 84418 - protein, 19 aa, Mycobacterium avium
RSLEHLVDVVLHFEGDRNG

SEQ ID NO: 84419 - protein, 19 aa, Mycobacterium avium
RSLLPAGITAVSGRFYAGD

SEQ ID NO: 84420 - protein, 17 aa, Mycobacterium avium
RSLLRARYRDRRKLLEM

SEQ ID NO: 84421 - protein, 23 aa, Mycobacterium avium
RSLNATKVFAWPDAEVAVMGAKA

SEQ ID NO: 84422 - protein, 19 aa, Mycobacterium avium
RSLRACIDLAALGENTIAV

SEQ ID NO: 84423 - protein, 18 aa, Mycobacterium avium
RSNGLRVRVFEAGPDVGG

SEQ ID NO: 84424 - protein, 18 aa, Mycobacterium avium
RSRPCVAAAAALYSEILD

SEQ ID NO: 84425 - protein, 21 aa, Mycobacterium avium
RSRPLITNMIRLLKLPIAVQR

SEQ ID NO: 84426 - protein, 19 aa, Mycobacterium avium
RSRRPGETASIFLPSVPNL

SEQ ID NO: 84427 - protein, 20 aa, Mycobacterium avium
RSRSAWPVAAEGLIDAIVGL

SEQ ID NO: 84428 - protein, 23 aa, Mycobacterium avium
RSSAYDRAWWFARFVADSYGPPK

SEQ ID NO: 84429 - protein, 20 aa, Mycobacterium avium
RSTGQWVIIAALRQDRTYKP

SEQ ID NO: 84430 - protein, 20 aa, Mycobacterium avium
RSTPHAAEALECLGGNGYVE

SEQ ID NO: 84431 - protein, 24 aa, Mycobacterium avium
RSVARRIGAAPARAVLEPIGGQGP

SEQ ID NO: 84432 - protein, 24 aa, Mycobacterium avium
RSVKRHMGTDWSIEIDGKKYTAQE

SEQ ID NO: 84433 - protein, 18 aa, Mycobacterium avium
RSWCEPAYNITHWTDMPR

SEQ ID NO: 84434 - protein, 20 aa, Mycobacterium avium
RSWFDRYARTFAATIAGGTS

SEQ ID NO: 84435 - protein, 18 aa, Mycobacterium avium
RSWLRGAGIQSPRGAELW

SEQ ID NO: 84436 - protein, 20 aa, Mycobacterium avium
RSYVLHPYQMVKDLRTEYEV

SEQ ID NO: 84437 - protein, 26 aa, Mycobacterium avium
RSYYADFEGVLAFLQRKMAQTESEQM

SEQ ID NO: 84438 - protein, 19 aa, Mycobacterium avium
RTADSAGRLYSWAEERDYT

SEQ ID NO: 84439 - protein, 17 aa, Mycobacterium avium
RTAEGTKLFSAVANHAV

SEQ ID NO: 84440 - protein, 21 aa, Mycobacterium avium
RTAFCDGYAAASGIDPRDSAP

SEQ ID NO: 84441 - protein, 21 aa, Mycobacterium avium
RTAGSGEAWLAICPATPQLVQ

SEQ ID NO: 84442 - protein, 18 aa, Mycobacterium avium
RTAHELRGMFELAAECLA

SEQ ID NO: 84443 - protein, 17 aa, Mycobacterium avium
RTCRDVSDALALQYFHV

SEQ ID NO: 84444 - protein, 19 aa, Mycobacterium avium
RTDGGWRITGQKIWTTAAQ

SEQ ID NO: 84445 - protein, 23 aa, Mycobacterium avium
RTEKSVMFVIPWGSHWIIGTTDT

SEQ ID NO: 84446 - protein, 26 aa, Mycobacterium avium
RTERAELVRWLLAQGITAEEIRTTNP

SEQ ID NO: 84447 - protein, 19 aa, Mycobacterium avium
RTERGWKISGTGYDRTYDA

SEQ ID NO: 84448 - protein, 25 aa, Mycobacterium avium
RTFELFTRAPFRGASPATRMGLMPV

SEQ ID NO: 84449 - protein, 20 aa, Mycobacterium avium
RTFPLRSSFAPSYNMTINLV

SEQ ID NO: 84450 - protein, 32 aa, Mycobacterium avium
RTFSKAYGLAGLRVGYAIGHPELITALDKVVM

SEQ ID NO: 84451 - protein, 22 aa, Mycobacterium avium
RTGASLRWYGVTDDGRIDLDSL

SEQ ID NO: 84452 - protein, 29 aa, Mycobacterium avium
RTGEVLSVPVGDAFLGRVVNPLGQPIDGQ

SEQ ID NO: 84453 - protein, 18 aa, Mycobacterium avium
RTGHLCVAGTALIAGLLK

SEQ ID NO: 84454 - protein, 18 aa, Mycobacterium avium
RTGLPALEQYLAKNRKII

SEQ ID NO: 84455 - protein, 32 aa, Mycobacterium avium
RTGTARVKRGMAEMLKGGVIMDVVTPEQAKIA

SEQ ID NO: 84456 - protein, 21 aa, Mycobacterium avium
RTGTLTVCTMVPMRSVPHRVV

SEQ ID NO: 84457 - protein, 20 aa, Mycobacterium avium
RTGTTIRFWADPDIFETTEY

SEQ ID NO: 84458 - protein, 17 aa, Mycobacterium avium
RTGVWKRYLEEVEKDPT

SEQ ID NO: 84459 - protein, 20 aa, Mycobacterium avium
RTHALQEFFAGHGASGFFEA

SEQ ID NO: 84460 - protein, 25 aa, Mycobacterium avium
RTIFKRLYDAGLIYRAERLVNWSPV

SEQ ID NO: 84461 - protein, 17 aa, Mycobacterium avium
RTIIGYPAPNAMNTGKA

SEQ ID NO: 84462 - protein, 18 aa, Mycobacterium avium
RTKHPVFRRRRFFEGEPI

SEQ ID NO: 84463 - protein, 19 aa, Mycobacterium avium
RTKSCPKLGDSIEHAVAEG

SEQ ID NO: 84464 - protein, 18 aa, Mycobacterium avium
RTLGHLILAGVFERYPTL

SEQ ID NO: 84465 - protein, 27 aa, Mycobacterium avium
RTLRITARYAQHWNFVGGPPDVFAHKR

SEQ ID NO: 84466 - protein, 18 aa, Mycobacterium avium
RTLWGKNIGQFQLIQLKL

SEQ ID NO: 84467 - protein, 17 aa, Mycobacterium avium
RTMGYGRCTIVDADNPG

SEQ ID NO: 84468 - protein, 21 aa, Mycobacterium avium
RTNVAIPRWHMVGHIQRNKAR

SEQ ID NO: 84469 - protein, 17 aa, Mycobacterium avium
RTPDRFVAGTVGQPGNR

SEQ ID NO: 84470 - protein, 24 aa, Mycobacterium avium
RTPHVLGCVYSVFTEGYWSTAGPS

SEQ ID NO: 84471 - protein, 20 aa, Mycobacterium avium
RTPMGASLANGGRPYPQAFL

SEQ ID NO: 84472 - protein, 17 aa, Mycobacterium avium
RTPRLARTRAWTTLQQD

SEQ ID NO: 84473 - protein, 19 aa, Mycobacterium avium
RTQSSWELVTDALARSRSG

SEQ ID NO: 84474 - protein, 18 aa, Mycobacterium avium
RTRAVDVFSWEAVAAQTV

SEQ ID NO: 84475 - protein, 20 aa, Mycobacterium avium
RTRLRAATWAAFPGVHGKAY

SEQ ID NO: 84476 - protein, 22 aa, Mycobacterium avium
RTRSPGLLTAWVATGFDVLASR

SEQ ID NO: 84477 - protein, 24 aa, Mycobacterium avium
RTRVSFEVAGKWMSADVINVSAAG

SEQ ID NO: 84478 - protein, 28 aa, Mycobacterium avium
RTSGEQRLSGFLLWQSAYSEMWFTEAHW

SEQ ID NO: 84479 - protein, 20 aa, Mycobacterium avium
RTSGLLKVAPYIARTMPQLL

SEQ ID NO: 84480 - protein, 17 aa, Mycobacterium avium
RTSHQLLGALGFCDESD

SEQ ID NO: 84481 - protein, 25 aa, Mycobacterium avium
RTSRPDALLPLARRETGECLAEDLR

SEQ ID NO: 84482 - protein, 19 aa, Mycobacterium avium
RTTFELFARRLPEGRRYGV

SEQ ID NO: 84483 - protein, 18 aa, Mycobacterium avium
RTTIFALRSPAAVAGDFR

SEQ ID NO: 84484 - protein, 27 aa, Mycobacterium avium
RTTVNLKACIKAAADRVVFINTGFLDR

SEQ ID NO: 84485 - protein, 19 aa, Mycobacterium avium
RTTWPTMFNPMTYVGMARL

SEQ ID NO: 84486 - protein, 19 aa, Mycobacterium avium
RTVLVAAPPGYRLNIPDDR

SEQ ID NO: 84487 - protein, 21 aa, Mycobacterium avium
RTYALLKRRGTQFVVVSAAEP

SEQ ID NO: 84488 - protein, 26 aa, Mycobacterium avium
RTYGHFGQAGGFIWADPDIERALVVL

SEQ ID NO: 84489 - protein, 23 aa, Mycobacterium avium
RVADSRTGVFIGLTHGDYQLLAA

SEQ ID NO: 84490 - protein, 19 aa, Mycobacterium avium
RVAGLGDRGRIAVGYKADL

SEQ ID NO: 84491 - protein, 19 aa, Mycobacterium avium
RVALSALTMAEWFRDEAGQ

SEQ ID NO: 84492 - protein, 18 aa, Mycobacterium avium
RVASNSIGFVAPIPATTN

SEQ ID NO: 84493 - protein, 20 aa, Mycobacterium avium
RVCRPGGRIGLISWTPEGFF

SEQ ID NO: 84494 - protein, 18 aa, Mycobacterium avium
RVEEAYGPHVAVFLPELE

SEQ ID NO: 84495 - protein, 18 aa, Mycobacterium avium
RVEITARGRGPVSRAEAC

SEQ ID NO: 84496 - protein, 18 aa, Mycobacterium avium
RVGHSLDPKADYGPLVTG

SEQ ID NO: 84497 - protein, 20 aa, Mycobacterium avium
RVGLGPALRILRAVATMTRK

SEQ ID NO: 84498 - protein, 21 aa, Mycobacterium avium
RVGTEVPRDALLRLLVDVQYT

SEQ ID NO: 84499 - protein, 23 aa, Mycobacterium avium
RVHRVPSRMFPKVTTLPLGVPTP

SEQ ID NO: 84500 - protein, 19 aa, Mycobacterium avium
RVIPSDANFVLFGEFTDAP

SEQ ID NO: 84501 - protein, 20 aa, Mycobacterium avium
RVISDVWLSNLLAWLTRRAS

SEQ ID NO: 84502 - protein, 25 aa, Mycobacterium avium
RVKGPDFPTSGLIVGTQGIADAYKT

SEQ ID NO: 84503 - protein, 25 aa, Mycobacterium avium
RVLALGGAVGEEWDSRAIAVFGHRP

SEQ ID NO: 84504 - protein, 17 aa, Mycobacterium avium
RVLDGRVAVVGLDDSRA

SEQ ID NO: 84505 - protein, 18 aa, Mycobacterium avium
RVLEFKAATIAQLGAEPT

SEQ ID NO: 84506 - protein, 17 aa, Mycobacterium avium
RVLEMVASIQGTRPPTR

SEQ ID NO: 84507 - protein, 18 aa, Mycobacterium avium
RVLPDPVALLRCAGGADL

SEQ ID NO: 84508 - protein, 17 aa, Mycobacterium avium
RVLRGWSSLPVRLGPAR

SEQ ID NO: 84509 - protein, 23 aa, Mycobacterium avium
RVMKKAVAYLLPFIEAEKEESGV

SEQ ID NO: 84510 - protein, 17 aa, Mycobacterium avium
RVNDPRNEWLFTDAWGV

SEQ ID NO: 84511 - protein, 18 aa, Mycobacterium avium
RVPAESKAAIGQTVELAL

SEQ ID NO: 84512 - protein, 27 aa, Mycobacterium avium
RVPAWSEFVEVHWSRWGEAYVTPVEPD

SEQ ID NO: 84513 - protein, 25 aa, Mycobacterium avium
RVPPQRRGIGFVFQHYAAFKHLTVR

SEQ ID NO: 84514 - protein, 20 aa, Mycobacterium avium
RVPTEKGYREFVDRLDDVKP

SEQ ID NO: 84515 - protein, 29 aa, Mycobacterium avium
RVQLKGSNLEFALGYSHPVVIEAPEGITF

SEQ ID NO: 84516 - protein, 19 aa, Mycobacterium avium
RVRAVSWVASLPVSHGEAV

SEQ ID NO: 84517 - protein, 20 aa, Mycobacterium avium
RVRIEGMAPFGSAVFSVTAR

SEQ ID NO: 84518 - protein, 18 aa, Mycobacterium avium
RVRLAMGVVTSIDPEILL

SEQ ID NO: 84519 - protein, 17 aa, Mycobacterium avium
RVRRESGRLDLLVNNAA

SEQ ID NO: 84520 - protein, 22 aa, Mycobacterium avium
RVRRLEARGVITGYSARIEPEA

SEQ ID NO: 84521 - protein, 21 aa, Mycobacterium avium
RVSFVGRSMVRNMGIARELGF

SEQ ID NO: 84522 - protein, 18 aa, Mycobacterium avium
RVSNWRATGSLEDELIRQ

SEQ ID NO: 84523 - protein, 19 aa, Mycobacterium avium
RVSQFPRVWAAVSTGDGRR

SEQ ID NO: 84524 - protein, 18 aa, Mycobacterium avium
RVSRAMFNELWPGFDSNE

SEQ ID NO: 84525 - protein, 23 aa, Mycobacterium avium
RVSTALTGMGFRVIPSDANFVLF

SEQ ID NO: 84526 - protein, 21 aa, Mycobacterium avium
RVVAAALRLPPEVIGTGEHSV

SEQ ID NO: 84527 - protein, 22 aa, Mycobacterium avium
RVVDDVGWCYPDPPPESLPIKG

SEQ ID NO: 84528 - protein, 25 aa, Mycobacterium avium
RVVEIGGPFSLELCGGTHVHNSAQI

SEQ ID NO: 84529 - protein, 24 aa, Mycobacterium avium
RVVHARGAGAYGYFEPYDDRLAQY

SEQ ID NO: 84530 - protein, 18 aa, Mycobacterium avium
RVVNPRWMAAMRRHGYKG

SEQ ID NO: 84531 - protein, 23 aa, Mycobacterium avium
RVVPEVLETVGLSGKANRLPHEL

SEQ ID NO: 84532 - protein, 19 aa, Mycobacterium avium
RVVPLKFLYLPIAVEGFKR

SEQ ID NO: 84533 - protein, 19 aa, Mycobacterium avium
RVVQLAVLVDRGHRELPLR

SEQ ID NO: 84534 - protein, 19 aa, Mycobacterium avium
RVVRHPGTLMLPGPAVDAR

SEQ ID NO: 84535 - protein, 20 aa, Mycobacterium avium
RWADDMPLSLLGTVIPMLEV

SEQ ID NO: 84536 - protein, 20 aa, Mycobacterium avium
RWAKTWEFQALLKARAAVGD

SEQ ID NO: 84537 - protein, 20 aa, Mycobacterium avium
RWDGELNALVITVGPGAAGT

SEQ ID NO: 84538 - protein, 18 aa, Mycobacterium avium
RWEPSVIGPVCEQLVDEI

SEQ ID NO: 84539 - protein, 21 aa, Mycobacterium avium
RWFLDRTCTHILAWEGDDDNE

SEQ ID NO: 84540 - protein, 20 aa, Mycobacterium avium
RWFLMASPILRGGNLIVTEQ

SEQ ID NO: 84541 - protein, 18 aa, Mycobacterium avium
RWGGARSGVRVHDGLARG

SEQ ID NO: 84542 - protein, 23 aa, Mycobacterium avium
RWGYHRYWLAEHHFVAVASSAPV

SEQ ID NO: 84543 - protein, 19 aa, Mycobacterium avium
RWINQGALEVGHDAAGRKV

SEQ ID NO: 84544 - protein, 24 aa, Mycobacterium avium
RWMAAMRRHGYKGAFEMAATVDYL

SEQ ID NO: 84545 - protein, 24 aa, Mycobacterium avium
RWPSKAELVLAAFIEGVRQVAVPP

SEQ ID NO: 84546 - protein, 17 aa, Mycobacterium avium
RWREYCLSSVTTHDLPP

SEQ ID NO: 84547 - protein, 20 aa, Mycobacterium avium
RWRHGAAVSVGLVFAAELAR

SEQ ID NO: 84548 - protein, 18 aa, Mycobacterium avium
RWRTAYLVLSGRTVGAAT

SEQ ID NO: 84549 - protein, 23 aa, Mycobacterium avium
RWSPQGKPIVGFVGRLAPEKHVE

SEQ ID NO: 84550 - protein, 31 aa, Mycobacterium avium
RWTQDSFVPWVWRRLRGLSSYDGREPKRPRL

SEQ ID NO: 84551 - protein, 21 aa, Mycobacterium avium
RWVLTKGKLPTSLWIEIVTTA

SEQ ID NO: 84552 - protein, 19 aa, Mycobacterium avium
RYAPYKGAHLALRAAHEAG

SEQ ID NO: 84553 - protein, 20 aa, Mycobacterium avium
RYARELSNLAELARRNGAAD

SEQ ID NO: 84554 - protein, 26 aa, Mycobacterium avium
RYATLVMDAHALRLLGSAALAAAARG

SEQ ID NO: 84555 - protein, 19 aa, Mycobacterium avium
RYEAYGWHVQRVEGGENVV

SEQ ID NO: 84556 - protein, 19 aa, Mycobacterium avium
RYGDDDGWEQKLEVVADVR

SEQ ID NO: 84557 - protein, 32 aa, Mycobacterium avium
RYGPAFRGLTSMWRRGDEIFAEVNLPTDAGVS

SEQ ID NO: 84558 - protein, 23 aa, Mycobacterium avium
RYILPSFIEHSSFGIKESNPYNK

SEQ ID NO: 84559 - protein, 17 aa, Mycobacterium avium
RYIPVMRDYVTSVMTQF

SEQ ID NO: 84560 - protein, 20 aa, Mycobacterium avium
RYKTGVLAKYVKLVGSAAIG

SEQ ID NO: 84561 - protein, 19 aa, Mycobacterium avium
RYLAARGGISAVFASPLQR

SEQ ID NO: 84562 - protein, 23 aa, Mycobacterium avium
RYMLDRRRTLGGFLPERRTKAKA

SEQ ID NO: 84563 - protein, 28 aa, Mycobacterium avium
RYPEVKKWLAEVLPNFPVYAHMLGNFSV

SEQ ID NO: 84564 - protein, 26 aa, Mycobacterium avium
RYPEWSDGVTGCWVLARYDDGRPSQL

SEQ ID NO: 84565 - protein, 26 aa, Mycobacterium avium
RYPVEEVREALTLPPHIPVITVDARD

SEQ ID NO: 84566 - protein, 24 aa, Mycobacterium avium
RYQVHSLHGYFLRPGDAKERTVFI

SEQ ID NO: 84567 - protein, 18 aa, Mycobacterium avium
RYRAELAVPDLVRAEVAL

SEQ ID NO: 84568 - protein, 25 aa, Mycobacterium avium
RYRDRGRPFLAFLYGIAAHKVADAH

SEQ ID NO: 84569 - protein, 18 aa, Mycobacterium avium
RYRISSQLFADFLASMRM

SEQ ID NO: 84570 - protein, 30 aa, Mycobacterium avium
RYSGWMRAPLRWALRASLAVRARLMVRSAL

SEQ ID NO: 84571 - protein, 18 aa, Mycobacterium avium
RYTDEWRAYVTRQARWVD

SEQ ID NO: 84572 - protein, 19 aa, Mycobacterium avium
RYTGWPGLLESQRKYLDNF

SEQ ID NO: 84573 - protein, 22 aa, Mycobacterium avium
RYVELWNLVFMQSERGEGTSKT

SEQ ID NO: 84574 - protein, 27 aa, Mycobacterium avium
RYWNEWKDPRLIIAVLHNNDLNQVTWE

SEQ ID NO: 84575 - protein, 21 aa, Mycobacterium avium
RYWPADEYRVGVPQTSFDKQF

SEQ ID NO: 84576 - protein, 18 aa, Mycobacterium avium
SAAASVFRAVRLRGPVGR

SEQ ID NO: 84577 - protein, 28 aa, Mycobacterium avium
SAALAEFDRAGADIVLLDLMLPGMSGTD

SEQ ID NO: 84578 - protein, 24 aa, Mycobacterium avium
SAALLKLPVPNWPMLGGMGNASWV

SEQ ID NO: 84579 - protein, 18 aa, Mycobacterium avium
SAALRRVELARPRSVIGK

SEQ ID NO: 84580 - protein, 19 aa, Mycobacterium avium
SAAPLLLLRSFLGLDPHVP

SEQ ID NO: 84581 - protein, 19 aa, Mycobacterium avium
SAASSLRKAKKLRVRLPLP

SEQ ID NO: 84582 - protein, 20 aa, Mycobacterium avium
SAATTCFWNDNQINIIDTPG

SEQ ID NO: 84583 - protein, 20 aa, Mycobacterium avium
SADGSRLACEAIPDMSEVDT

SEQ ID NO: 84584 - protein, 19 aa, Mycobacterium avium
SADPEVRQLILLDAPSVLG

SEQ ID NO: 84585 - protein, 22 aa, Mycobacterium avium
SADYKTLFREFGFTAEAVAAAA

SEQ ID NO: 84586 - protein, 22 aa, Mycobacterium avium
SAEEMYKYLVAVSREPELDKIR

SEQ ID NO: 84587 - protein, 18 aa, Mycobacterium avium
SAELGWERNIAALAARYR

SEQ ID NO: 84588 - protein, 25 aa, Mycobacterium avium
SAERAKEIGLVWKLVEPDRLQAEAR

SEQ ID NO: 84589 - protein, 22 aa, Mycobacterium avium
SAFCSAHPLVKVQILSRLSAGE

SEQ ID NO: 84590 - protein, 20 aa, Mycobacterium avium
SAGEAFKAVPGAAAAAGTST

SEQ ID NO: 84591 - protein, 25 aa, Mycobacterium avium
SAGNSFGAFVPRGITLRVYGDANDY

SEQ ID NO: 84592 - protein, 24 aa, Mycobacterium avium
SAGRPCDYTGLSYAKLRGGSGIQW

SEQ ID NO: 84593 - protein, 21 aa, Mycobacterium avium
SAGRRRAVLRLLRASPEPMSI

SEQ ID NO: 84594 - protein, 20 aa, Mycobacterium avium
SAIAAARPRGKTVWFTGLSG

SEQ ID NO: 84595 - protein, 20 aa, Mycobacterium avium
SAIRKARAALRSGEIDQAEY

SEQ ID NO: 84596 - protein, 26 aa, Mycobacterium avium
SAIVRPLLRVFFRSWFRVEVSGIENL

SEQ ID NO: 84597 - protein, 20 aa, Mycobacterium avium
SAIYPRRSPGGWQLIGHTDA

SEQ ID NO: 84598 - protein, 21 aa, Mycobacterium avium
SAKAEALKCAKGFRYYAQNAE

SEQ ID NO: 84599 - protein, 17 aa, Mycobacterium avium
SAKFAREHLGSLAGVPS

SEQ ID NO: 84600 - protein, 21 aa, Mycobacterium avium
SAKQLRGALYGGMNPRTSVPM

SEQ ID NO: 84601 - protein, 19 aa, Mycobacterium avium
SAKVVVCERLSRMRTSFLQ

SEQ ID NO: 84602 - protein, 28 aa, Mycobacterium avium
SALIKSIGLRLGVPWYAYDTVTFSGEVT

SEQ ID NO: 84603 - protein, 25 aa, Mycobacterium avium
SALLDRHWRNLRTLFSHNPTVYKAR

SEQ ID NO: 84604 - protein, 19 aa, Mycobacterium avium
SALNDWQANHWLDSRNNWH

SEQ ID NO: 84605 - protein, 18 aa, Mycobacterium avium
SALPYKRRLFGQIVAAAV

SEQ ID NO: 84606 - protein, 21 aa, Mycobacterium avium
SALQNAASIAGLFLTTEAVVA

SEQ ID NO: 84607 - protein, 18 aa, Mycobacterium avium
SALSADRPTVLDVYTDPD

SEQ ID NO: 84608 - protein, 19 aa, Mycobacterium avium
SAMRRAGALDARLREVARD

SEQ ID NO: 84609 - protein, 28 aa, Mycobacterium avium
SANIRRLRRPDPYKGKGVRYEGEQIRRK

SEQ ID NO: 84610 - protein, 19 aa, Mycobacterium avium
SANPFVLYPSYREIAHLPL

SEQ ID NO: 84611 - protein, 19 aa, Mycobacterium avium
SAPALPGFVLARLLAVGEV

SEQ ID NO: 84612 - protein, 25 aa, Mycobacterium avium
SAPLPVPVFDRLAGLTGHQPVERYG

SEQ ID NO: 84613 - protein, 19 aa, Mycobacterium avium
SARDLNARLRAVLDEDQIL

SEQ ID NO: 84614 - protein, 23 aa, Mycobacterium avium
SARGRPLAEIDLDYTPVQLEDTF

SEQ ID NO: 84615 - protein, 20 aa, Mycobacterium avium
SARPRRDLFDDYGLAYPEDD

SEQ ID NO: 84616 - protein, 18 aa, Mycobacterium avium
SASGIRKSTRYVLRVAND

SEQ ID NO: 84617 - protein, 22 aa, Mycobacterium avium
SATLRAGLRVGEPVDDDVALVA

SEQ ID NO: 84618 - protein, 17 aa, Mycobacterium avium
SATLRVAPHASWMFEYY

SEQ ID NO: 84619 - protein, 24 aa, Mycobacterium avium
SAVACALAHGFTVPDAVAFGKRWV

SEQ ID NO: 84620 - protein, 18 aa, Mycobacterium avium
SAVAMGWSPYYPQFDRSS

SEQ ID NO: 84621 - protein, 17 aa, Mycobacterium avium
SAVRLVRQIPYTVACDL

SEQ ID NO: 84622 - protein, 24 aa, Mycobacterium avium
SAVSAAEWWCRAGTMPRAELVEHL

SEQ ID NO: 84623 - protein, 18 aa, Mycobacterium avium
SAYSEMWFTEAHWPAFRR

SEQ ID NO: 84624 - protein, 27 aa, Mycobacterium avium
SAYVPKHWDKLCEVIGRPDLRDDERFA

SEQ ID NO: 84625 - protein, 22 aa, Mycobacterium avium
SCRQGFCGTCRVKVLAGQVDHR

SEQ ID NO: 84626 - protein, 26 aa, Mycobacterium avium
SDAFKAADGYLVISAYVPKHWDKLCE

SEQ ID NO: 84627 - protein, 20 aa, Mycobacterium avium
SDAVRRLSDRFGELKAAEIA

SEQ ID NO: 84628 - protein, 21 aa, Mycobacterium avium
SDDFFRLFLDPTMTYSCAYWD

SEQ ID NO: 84629 - protein, 20 aa, Mycobacterium avium
SDDPVLRFRTLVYSASVKLR

SEQ ID NO: 84630 - protein, 21 aa, Mycobacterium avium
SDDTVRRWINQGALEVGHDAA

SEQ ID NO: 84631 - protein, 18 aa, Mycobacterium avium
SDEFFALFLDPTRTYSCA

SEQ ID NO: 84632 - protein, 28 aa, Mycobacterium avium
SDEKKTALGTGFFLTWLTTYTDQNGEVL

SEQ ID NO: 84633 - protein, 25 aa, Mycobacterium avium
SDELWDLLPGYLIFRSIVPTRPPSR

SEQ ID NO: 84634 - protein, 25 aa, Mycobacterium avium
SDERGRRFLVHTSKIAYVEIGIADV

SEQ ID NO: 84635 - protein, 18 aa, Mycobacterium avium
SDFRRTAPIGLREALGRQ

SEQ ID NO: 84636 - protein, 23 aa, Mycobacterium avium
SDGKPARVGYRLDEETGKRVRIS

SEQ ID NO: 84637 - protein, 20 aa, Mycobacterium avium
SDGKRTWAVIGDRVNHFIPN

SEQ ID NO: 84638 - protein, 20 aa, Mycobacterium avium
SDHIPKWLLPVVHDNLRSGG

SEQ ID NO: 84639 - protein, 17 aa, Mycobacterium avium
SDIGGAVQRLIRRLPAG

SEQ ID NO: 84640 - protein, 17 aa, Mycobacterium avium
SDISKPVGLGFTQGGGE

SEQ ID NO: 84641 - protein, 19 aa, Mycobacterium avium
SDLHLYEILGAFMKPGDIL

SEQ ID NO: 84642 - protein, 17 aa, Mycobacterium avium
SDLLEAIELGFLLELAE

SEQ ID NO: 84643 - protein, 21 aa, Mycobacterium avium
SDLLVIFGITGDLARKMTFRA

SEQ ID NO: 84644 - protein, 21 aa, Mycobacterium avium
SDMLASLRRWTGGSIPDTDIP

SEQ ID NO: 84645 - protein, 17 aa, Mycobacterium avium
SDMVLRLAAGLERRTAH

SEQ ID NO: 84646 - protein, 18 aa, Mycobacterium avium
SDPSFVLNLSPFDRGSVL

SEQ ID NO: 84647 - protein, 17 aa, Mycobacterium avium
SDQVLMWVNRFDTETTL

SEQ ID NO: 84648 - protein, 20 aa, Mycobacterium avium
SDRARWTPFQKLVILDVPDD

SEQ ID NO: 84649 - protein, 25 aa, Mycobacterium avium
SDRPGRLLGFHWTKVHLDQPGLGEV

SEQ ID NO: 84650 - protein, 19 aa, Mycobacterium avium
SDTAEFGGYLSGPRVIDAG

SEQ ID NO: 84651 - protein, 19 aa, Mycobacterium avium
SDVAEYLLGDVLDLRGQPD

SEQ ID NO: 84652 - protein, 19 aa, Mycobacterium avium
SDVAGQWRALALVTTTADL

SEQ ID NO: 84653 - protein, 18 aa, Mycobacterium avium
SDVAPLEMTKWFDTNYHY

SEQ ID NO: 84654 - protein, 17 aa, Mycobacterium avium
SEAQRRALLAGLLDTDG

SEQ ID NO: 84655 - protein, 26 aa, Mycobacterium avium
SEASRICASLGLPERVLTQQLRTLSG

SEQ ID NO: 84656 - protein, 22 aa, Mycobacterium avium
SEASYFGPSFMINWLHNSYGDY

SEQ ID NO: 84657 - protein, 24 aa, Mycobacterium avium
SEAYPVLCGSAFKNKGVQPMLDAV

SEQ ID NO: 84658 - protein, 21 aa, Mycobacterium avium
SEEGLSALAARVEELGRELAG

SEQ ID NO: 84659 - protein, 21 aa, Mycobacterium avium
SEGPGESWISPTVDLVKGESM

SEQ ID NO: 84660 - protein, 18 aa, Mycobacterium avium
SEHCSYKSSKVHLRYFGE

SEQ ID NO: 84661 - protein, 20 aa, Mycobacterium avium
SEHWEVVRIEVPPEVARYVV

SEQ ID NO: 84662 - protein, 19 aa, Mycobacterium avium
SEIRAVGVGELLARIERLR

SEQ ID NO: 84663 - protein, 19 aa, Mycobacterium avium
SELAPLLCAGIIGYRALLR

SEQ ID NO: 84664 - protein, 24 aa, Mycobacterium avium
SELGDWLVLHEAWRGELPDELGEG

SEQ ID NO: 84665 - protein, 21 aa, Mycobacterium avium
SELGLSIAWNGCIYNYKELRS

SEQ ID NO: 84666 - protein, 20 aa, Mycobacterium avium
SELGLSYLLPRAIGSSRAFE

SEQ ID NO: 84667 - protein, 24 aa, Mycobacterium avium
SELGRSGGVLPVMSALENRNTYIQ

SEQ ID NO: 84668 - protein, 20 aa, Mycobacterium avium
SELILPIAVAVQNRITVNEL

SEQ ID NO: 84669 - protein, 21 aa, Mycobacterium avium
SELLQKLFAGQTMKDLVAAGQ

SEQ ID NO: 84670 - protein, 20 aa, Mycobacterium avium
SELRLTPGDRVWFSVKAHEV

SEQ ID NO: 84671 - protein, 20 aa, Mycobacterium avium
SEMAFKIAGSQVLKKAAAQA

SEQ ID NO: 84672 - protein, 19 aa, Mycobacterium avium
SEMIRRIATQPDLELIGVH

SEQ ID NO: 84673 - protein, 17 aa, Mycobacterium avium
SEQSIRHALDIGKTRDW

SEQ ID NO: 84674 - protein, 18 aa, Mycobacterium avium
SERIDFVRKEFRRLRVKA

SEQ ID NO: 84675 - protein, 28 aa, Mycobacterium avium
SESDLLAWCRDRMAGFKVPRTVEFLDAL

SEQ ID NO: 84676 - protein, 19 aa, Mycobacterium avium
SESNAMWALSIPVPFIKPV

SEQ ID NO: 84677 - protein, 20 aa, Mycobacterium avium
SEVLLPRRGTLVAWTTQGFP

SEQ ID NO: 84678 - protein, 17 aa, Mycobacterium avium
SEYAKPFATLAIADLLG

SEQ ID NO: 84679 - protein, 26 aa, Mycobacterium avium
SFAGADFELGMMWREVHRLRQPVLLI

SEQ ID NO: 84680 - protein, 26 aa, Mycobacterium avium
SFFAAARTLLGWGQFGTGLNLANIQA

SEQ ID NO: 84681 - protein, 19 aa, Mycobacterium avium
SFGARGWSPHTYYFADPDG

SEQ ID NO: 84682 - protein, 23 aa, Mycobacterium avium
SFGASPRASLGIIAGARSLALVR

SEQ ID NO: 84683 - protein, 26 aa, Mycobacterium avium
SFGKWTRRAWMGAGYLVARTLDADGV

SEQ ID NO: 84684 - protein, 19 aa, Mycobacterium avium
SFIERRAAMFAGLADSTLS

SEQ ID NO: 84685 - protein, 27 aa, Mycobacterium avium
SFLRYGKDGSVMACVFNFAGAEHSGYR

SEQ ID NO: 84686 - protein, 24 aa, Mycobacterium avium
SFNNELGHPWTVLRATADTDYLVL

SEQ ID NO: 84687 - protein, 24 aa, Mycobacterium avium
SFVVRLKGGDPFVFARGYEEVLAC

SEQ ID NO: 84688 - protein, 23 aa, Mycobacterium avium
SFWPAIEMDGFVAGNGYWALTKH

SEQ ID NO: 84689 - protein, 31 aa, Mycobacterium avium
SGAEMGMSYHLPRIVGTGVAADWMLTGRTVS

SEQ ID NO: 84690 - protein, 20 aa, Mycobacterium avium
SGAHYCARGLATVRTDPDAP

SEQ ID NO: 84691 - protein, 25 aa, Mycobacterium avium
SGAWCVAADFSVGMLAAGAARRVPK

SEQ ID NO: 84692 - protein, 33 aa, Mycobacterium avium
SGDLAYRDADGWIYLAGRTADWMRVDGENLAAA

SEQ ID NO: 84693 - protein, 19 aa, Mycobacterium avium
SGDLCIRREETWGPVTGGT

SEQ ID NO: 84694 - protein, 25 aa, Mycobacterium avium
SGDPSGGLLAWLGLAPNTNGPGQPG

SEQ ID NO: 84695 - protein, 18 aa, Mycobacterium avium
SGDPTWPDAITMIEKANA

SEQ ID NO: 84696 - protein, 25 aa, Mycobacterium avium
SGDPYRLAAQLGMPPWRVQKAQKQA

SEQ ID NO: 84697 - protein, 17 aa, Mycobacterium avium
SGEGRWTSIAAIDEGVP

SEQ ID NO: 84698 - protein, 19 aa, Mycobacterium avium
SGEPMKVSWGPNWDDNLAG

SEQ ID NO: 84699 - protein, 17 aa, Mycobacterium avium
SGETFVFVEQWADEEAL

SEQ ID NO: 84700 - protein, 23 aa, Mycobacterium avium
SGGECQRVAIARALVLRPQIVVL

SEQ ID NO: 84701 - protein, 19 aa, Mycobacterium avium
SGGLPAAAFGGRAEVMERL

SEQ ID NO: 84702 - protein, 25 aa, Mycobacterium avium
SGGLYTGHCLLRLRDGDITHREVES

SEQ ID NO: 84703 - protein, 24 aa, Mycobacterium avium
SGGPFPGALWLQVRDLEATQAELR

SEQ ID NO: 84704 - protein, 18 aa, Mycobacterium avium
SGGRFRLGLGSQIKVHVE

SEQ ID NO: 84705 - protein, 22 aa, Mycobacterium avium
SGGVLPRLARQGYLPGELADLL

SEQ ID NO: 84706 - protein, 18 aa, Mycobacterium avium
SGGYRKKYLRAMSRLLAL

SEQ ID NO: 84707 - protein, 22 aa, Mycobacterium avium
SGHRGSALAGAFNEAHILAITQ

SEQ ID NO: 84708 - protein, 23 aa, Mycobacterium avium
SGIPKAGGVEAILRLDEGPRGLY

SEQ ID NO: 84709 - protein, 19 aa, Mycobacterium avium
SGKDWQVWAGDQVADLVQL

SEQ ID NO: 84710 - protein, 25 aa, Mycobacterium avium
SGKRRLALDHLPRLARALSVSTDEL

SEQ ID NO: 84711 - protein, 27 aa, Mycobacterium avium
SGLDARAYRLAWPAGTTVFEIDQPQVI

SEQ ID NO: 84712 - protein, 26 aa, Mycobacterium avium
SGLDARAYRLAWPAGTVVYEVDQPQV

SEQ ID NO: 84713 - protein, 24 aa, Mycobacterium avium
SGNYLPRFGPYLSSASNPWGEGIN

SEQ ID NO: 84714 - protein, 19 aa, Mycobacterium avium
SGPARWFLEHARVALSSGH

SEQ ID NO: 84715 - protein, 18 aa, Mycobacterium avium
SGPAVLRNPDLIMLRGNI

SEQ ID NO: 84716 - protein, 23 aa, Mycobacterium avium
SGQRVDGKFVRRVIDTLILPAVR

SEQ ID NO: 84717 - protein, 24 aa, Mycobacterium avium
SGQYPRELPFIIGQELCGTVAAAG

SEQ ID NO: 84718 - protein, 24 aa, Mycobacterium avium
SGTEPKVKCYLEIRCAPSDDLASS

SEQ ID NO: 84719 - protein, 23 aa, Mycobacterium avium
SGTQACRVLKAEGLQVSLVNSNP

SEQ ID NO: 84720 - protein, 23 aa, Mycobacterium avium
SGVNVCTSAAWITGGKQTPEDRR

SEQ ID NO: 84721 - protein, 23 aa, Mycobacterium avium
SGVQPRWITPRWDAERHFSHPPS

SEQ ID NO: 84722 - protein, 24 aa, Mycobacterium avium
SGYDLKKWIDWSVDLYYWSPSYSQ

SEQ ID NO: 84723 - protein, 24 aa, Mycobacterium avium
SGYMRGVPVERIYRDVRLLRLYEG

SEQ ID NO: 84724 - protein, 17 aa, Mycobacterium avium
SHAEGAPDDAMWVKTGD

SEQ ID NO: 84725 - protein, 29 aa, Mycobacterium avium
SHAPNLPWPWGLIDLTARVLLPVSATVRE

SEQ ID NO: 84726 - protein, 19 aa, Mycobacterium avium
SHCRDVVAAVTNAGGFGIL

SEQ ID NO: 84727 - protein, 23 aa, Mycobacterium avium
SHGRGGRGYRYYRLVATSETATP

SEQ ID NO: 84728 - protein, 18 aa, Mycobacterium avium
SHIYYRMGDMPKAIRANK

SEQ ID NO: 84729 - protein, 22 aa, Mycobacterium avium
SHLYPDSLRTMGYDVGATGFEL

SEQ ID NO: 84730 - protein, 22 aa, Mycobacterium avium
SHSVHIEALLKVFPDARLIWAH

SEQ ID NO: 84731 - protein, 19 aa, Mycobacterium avium
SHVMGRSILYGTLGNGGTA

SEQ ID NO: 84732 - protein, 30 aa, Mycobacterium avium
SHVPAHTQLAWVLGCFTGFGQASRMTQFKD

SEQ ID NO: 84733 - protein, 25 aa, Mycobacterium avium
SIAETIDWGRTLLALGLDTIDDAVV

SEQ ID NO: 84734 - protein, 18 aa, Mycobacterium avium
SIAHGIRRFEFMIHADES

SEQ ID NO: 84735 - protein, 26 aa, Mycobacterium avium
SIDERARAGIFLAMQYPVEVPGVSVS

SEQ ID NO: 84736 - protein, 21 aa, Mycobacterium avium
SIGVPEPLKLAGTPEQKRKFL

SEQ ID NO: 84737 - protein, 17 aa, Mycobacterium avium
SIIGNGVDWFRSMGSEK

SEQ ID NO: 84738 - protein, 22 aa, Mycobacterium avium
SILELAARHKLVVTCEDNGVNG

SEQ ID NO: 84739 - protein, 24 aa, Mycobacterium avium
SIRIPSTWCGLFGLKPQRDRVSLE

SEQ ID NO: 84740 - protein, 19 aa, Mycobacterium avium
SIRTDLRNAGAHVVDEEVV

SEQ ID NO: 84741 - protein, 22 aa, Mycobacterium avium
SISGESLGGWVAARAAIDHPDV

SEQ ID NO: 84742 - protein, 23 aa, Mycobacterium avium
SISVPTLYALGALGDLRARLTGK

SEQ ID NO: 84743 - protein, 22 aa, Mycobacterium avium
SIVDTPGGRVCIESVVSGQRRY

SEQ ID NO: 84744 - protein, 18 aa, Mycobacterium avium
SIVLWPQVVKEVAPLPVL

SEQ ID NO: 84745 - protein, 17 aa, Mycobacterium avium
SKAAIGQTVELALDTTK

SEQ ID NO: 84746 - protein, 23 aa, Mycobacterium avium
SKAFSQKALARWEDELVGRVGNS

SEQ ID NO: 84747 - protein, 22 aa, Mycobacterium avium
SKAGGFGVLGAVGFTPEQLEIE

SEQ ID NO: 84748 - protein, 23 aa, Mycobacterium avium
SKALRTGYVAAFSVPANQLPKEV

SEQ ID NO: 84749 - protein, 19 aa, Mycobacterium avium
SKAVSKCEGRLVPAPADPE

SEQ ID NO: 84750 - protein, 24 aa, Mycobacterium avium
SKDGPFPLDAFKKVVGVNLIGTFN

SEQ ID NO: 84751 - protein, 26 aa, Mycobacterium avium
SKDRPDVVHAYGWLGGLAAQLAARRR

SEQ ID NO: 84752 - protein, 31 aa, Mycobacterium avium
SKGTSEGWCPHCGSAYSFLPQLNPGDIVANQ

SEQ ID NO: 84753 - protein, 20 aa, Mycobacterium avium
SKIHSVASFFVSRVDTEIDK

SEQ ID NO: 84754 - protein, 17 aa, Mycobacterium avium
SKLKANIAQILKNEGYI

SEQ ID NO: 84755 - protein, 21 aa, Mycobacterium avium
SKLRFNFFVLKLPIRPPALVA

SEQ ID NO: 84756 - protein, 19 aa, Mycobacterium avium
SKPRWRDYFSAARRGLVPG

SEQ ID NO: 84757 - protein, 25 aa, Mycobacterium avium
SKQRSRLALWARRLLGEAITQAQYL

SEQ ID NO: 84758 - protein, 27 aa, Mycobacterium avium
SKRYRIAELALRDKIPLVMLLEGAGFR

SEQ ID NO: 84759 - protein, 24 aa, Mycobacterium avium
SKSPKEHFDFFPLTVDVEERMYAA

SEQ ID NO: 84760 - protein, 20 aa, Mycobacterium avium
SKWAGEVLLREAHDLCGLPV

SEQ ID NO: 84761 - protein, 26 aa, Mycobacterium avium
SLAILRRPRAGLSYETLLHTIEQRLP

SEQ ID NO: 84762 - protein, 19 aa, Mycobacterium avium
SLATDSWLSAASFQETTRV

SEQ ID NO: 84763 - protein, 33 aa, Mycobacterium avium
SLDARIAGRLGLRPDVRRVPLFGLGCAAGAAGV

SEQ ID NO: 84764 - protein, 25 aa, Mycobacterium avium
SLDHAMWFMRAFRADEWLLYDQSSP

SEQ ID NO: 84765 - protein, 18 aa, Mycobacterium avium
SLDKARRLLWPVKKKYGN

SEQ ID NO: 84766 - protein, 17 aa, Mycobacterium avium
SLDKLLMTWVEQSVGHA

SEQ ID NO: 84767 - protein, 19 aa, Mycobacterium avium
SLDLPGGAGQHFFFDAGNG

SEQ ID NO: 84768 - protein, 19 aa, Mycobacterium avium
SLFAKFGLPAALGPRQEGV

SEQ ID NO: 84769 - protein, 25 aa, Mycobacterium avium
SLFAKGFPSPWLVVVGAFQAQAEGA

SEQ ID NO: 84770 - protein, 35 aa, Mycobacterium avium
SLFHVLRYGFRPSKIAFLAWHAWSDPEQGNWPPGF

SEQ ID NO: 84771 - protein, 18 aa, Mycobacterium avium
SLFSRLLPVLPTTVESSG

SEQ ID NO: 84772 - protein, 26 aa, Mycobacterium avium
SLGHRLRAAIHFDDLHWERRYDRVAA

SEQ ID NO: 84773 - protein, 23 aa, Mycobacterium avium
SLHAEGYDGAPLHGVDADGVAPA

SEQ ID NO: 84774 - protein, 18 aa, Mycobacterium avium
SLHLATGIVNIWSAPAAA

SEQ ID NO: 84775 - protein, 18 aa, Mycobacterium avium
SLIAQWMLIGFVHGVMNT

SEQ ID NO: 84776 - protein, 17 aa, Mycobacterium avium
SLIGDLLPPGVVNVVNG

SEQ ID NO: 84777 - protein, 25 aa, Mycobacterium avium
SLIPNAYCTTVFLAILDTETGVLQY

SEQ ID NO: 84778 - protein, 24 aa, Mycobacterium avium
SLISAFSSRARLLLLDEPSSGLDP

SEQ ID NO: 84779 - protein, 24 aa, Mycobacterium avium
SLITAGRAWARFEHGQVVFKAEVG

SEQ ID NO: 84780 - protein, 20 aa, Mycobacterium avium
SLKALEPLYMGSRLRAGEVT

SEQ ID NO: 84781 - protein, 24 aa, Mycobacterium avium
SLKHLRAGASIIVIGSNAAFMSSL

SEQ ID NO: 84782 - protein, 21 aa, Mycobacterium avium
SLLPGRDGLVHISKLGKGKRI

SEQ ID NO: 84783 - protein, 19 aa, Mycobacterium avium
SLLSTAVARWAREERLGVD

SEQ ID NO: 84784 - protein, 19 aa, Mycobacterium avium
SLLVFPFDVAIDGGFPGTA

SEQ ID NO: 84785 - protein, 17 aa, Mycobacterium avium
SLMDIDTIYVWTHDSIG

SEQ ID NO: 84786 - protein, 20 aa, Mycobacterium avium
SLNPFRMFTSMLATRDRRYF

SEQ ID NO: 84787 - protein, 22 aa, Mycobacterium avium
SLPEYRALRAQHDMLSACFDAE

SEQ ID NO: 84788 - protein, 19 aa, Mycobacterium avium
SLPGRRRPPTVAVINVDGT

SEQ ID NO: 84789 - protein, 24 aa, Mycobacterium avium
SLPLLERAKFLAIFASNLDEFYMV

SEQ ID NO: 84790 - protein, 18 aa, Mycobacterium avium
SLPLTVTEWDEWGNPLAD

SEQ ID NO: 84791 - protein, 18 aa, Mycobacterium avium
SLPSRPAVPVLSGVLLSG

SEQ ID NO: 84792 - protein, 24 aa, Mycobacterium avium
SLRAKLLDDRVRAFIAQHADAVVV

SEQ ID NO: 84793 - protein, 29 aa, Mycobacterium avium
SLREKMPRRFYCRGKWRPSALDSETQVFD

SEQ ID NO: 84794 - protein, 22 aa, Mycobacterium avium
SLREREVTGILVAGMTADHVLE

SEQ ID NO: 84795 - protein, 17 aa, Mycobacterium avium
SLRLIADTIEFCAAEVP

SEQ ID NO: 84796 - protein, 24 aa, Mycobacterium avium
SLRRRMAEMSGRMSGAASGAAAPA

SEQ ID NO: 84797 - protein, 19 aa, Mycobacterium avium
SLRSGECDLALAGGATVNA

SEQ ID NO: 84798 - protein, 17 aa, Mycobacterium avium
SLSEIKAAAAAAPPPLD

SEQ ID NO: 84799 - protein, 33 aa, Mycobacterium avium
SLSHPVPPAALWGRPGYVRALLGERIGEITTAR

SEQ ID NO: 84800 - protein, 17 aa, Mycobacterium avium
SLSVRAAMMAVAGGQGS

SEQ ID NO: 84801 - protein, 22 aa, Mycobacterium avium
SLTVTCPRDLVLNAPVKLAEGT

SEQ ID NO: 84802 - protein, 20 aa, Mycobacterium avium
SLTYPGYKPSLAGLVGSALF

SEQ ID NO: 84803 - protein, 18 aa, Mycobacterium avium
SLVDGIDVWGVRTLGQLQ

SEQ ID NO: 84804 - protein, 26 aa, Mycobacterium avium
SLVKKYSDFIAWPIRMEVERRTPATE

SEQ ID NO: 84805 - protein, 17 aa, Mycobacterium avium
SLVSCGVSTGWGSATVS

SEQ ID NO: 84806 - protein, 24 aa, Mycobacterium avium
SLYEKLGFRRVPVLAIKRKNAINE

SEQ ID NO: 84807 - protein, 23 aa, Mycobacterium avium
SMEQGRLAAYHAFGEASDGITEL

SEQ ID NO: 84808 - protein, 17 aa, Mycobacterium avium
SMFDLAYGYARNQMTAY

SEQ ID NO: 84809 - protein, 23 aa, Mycobacterium avium
SMGRNGGGWAHYVGQEKVRPLTG

SEQ ID NO: 84810 - protein, 24 aa, Mycobacterium avium
SMIARLCRELGLPLVVDAAQALGQ

SEQ ID NO: 84811 - protein, 22 aa, Mycobacterium avium
SMPAMIRAGGKMYGADGRQKDT

SEQ ID NO: 84812 - protein, 21 aa, Mycobacterium avium
SMQKKRFGRIIYIGSVSGMWG

SEQ ID NO: 84813 - protein, 25 aa, Mycobacterium avium
SMRAAGRGRIVLVSSAAGVRGQPGT

SEQ ID NO: 84814 - protein, 26 aa, Mycobacterium avium
SMRKFYEAFKPYGLRETAIKPSYGLA

SEQ ID NO: 84815 - protein, 22 aa, Mycobacterium avium
SMVLATGWLGSLAVPGGPRPLV

SEQ ID NO: 84816 - protein, 22 aa, Mycobacterium avium
SNAGGLFLGWVDRVVAQADPAS

SEQ ID NO: 84817 - protein, 18 aa, Mycobacterium avium
SNFRLARRTTRIGDVEVQ

SEQ ID NO: 84818 - protein, 25 aa, Mycobacterium avium
SNGHFYGAGLINWWDPQGTRKTLDE

SEQ ID NO: 84819 - protein, 23 aa, Mycobacterium avium
SNGPAVVEFNCRFGDPETQAVLA

SEQ ID NO: 84820 - protein, 18 aa, Mycobacterium avium
SNHLSWGQQVFKMAAELA

SEQ ID NO: 84821 - protein, 23 aa, Mycobacterium avium
SNICTAQVLLAVMAAMYASYHGA

SEQ ID NO: 84822 - protein, 17 aa, Mycobacterium avium
SNTEPLLRLNVEGRTAE

SEQ ID NO: 84823 - protein, 26 aa, Mycobacterium avium
SNVDEWRATFAVNVFGPVELTLALLP

SEQ ID NO: 84824 - protein, 18 aa, Mycobacterium avium
SNYVYRASDLDQWRMLMG

SEQ ID NO: 84825 - protein, 19 aa, Mycobacterium avium
SPAELVLLPGAARALAALN

SEQ ID NO: 84826 - protein, 18 aa, Mycobacterium avium
SPDEFSGKILAPAHLPQE

SEQ ID NO: 84827 - protein, 26 aa, Mycobacterium avium
SPEKLAKLRPVFGVKAGDATMTAGNS

SEQ ID NO: 84828 - protein, 19 aa, Mycobacterium avium
SPERFGMSAAILLGDLALA

SEQ ID NO: 84829 - protein, 21 aa, Mycobacterium avium
SPFAASLLFGYVGAFMYEGDS

SEQ ID NO: 84830 - protein, 17 aa, Mycobacterium avium
SPFAEAFRANGQSATGT

SEQ ID NO: 84831 - protein, 26 aa, Mycobacterium avium
SPFGNGRPGWHVECAAIALSRIGSGL

SEQ ID NO: 84832 - protein, 18 aa, Mycobacterium avium
SPGFTLYSLSGHVTRPGQ

SEQ ID NO: 84833 - protein, 24 aa, Mycobacterium avium
SPGIDIRPLYAWSGYRTNEVHFHD

SEQ ID NO: 84834 - protein, 20 aa, Mycobacterium avium
SPGLHALVTIGARRSLRMRS

SEQ ID NO: 84835 - protein, 26 aa, Mycobacterium avium
SPGSRAGCGRIVLCSRALPNPKALAT

SEQ ID NO: 84836 - protein, 25 aa, Mycobacterium avium
SPHIPWDRLAVQVVKEATAWQRNGR

SEQ ID NO: 84837 - protein, 28 aa, Mycobacterium avium
SPHNERLFCIPATIDLAGAEIELVSMVA

SEQ ID NO: 84838 - protein, 23 aa, Mycobacterium avium
SPIGKRNGWLSGLHATELLGAVQ

SEQ ID NO: 84839 - protein, 19 aa, Mycobacterium avium
SPIRLRTVAATVFTRPEIA

SEQ ID NO: 84840 - protein, 24 aa, Mycobacterium avium
SPLGRGFLTGAIRSAHELPDTDYR

SEQ ID NO: 84841 - protein, 21 aa, Mycobacterium avium
SPLNLLRWTSARTIKETFVPA

SEQ ID NO: 84842 - protein, 24 aa, Mycobacterium avium
SPLRSAGAWAAWAAAARSARLASE

SEQ ID NO: 84843 - protein, 21 aa, Mycobacterium avium
SPLSALLHVARTVVRRAERSA

SEQ ID NO: 84844 - protein, 17 aa, Mycobacterium avium
SPLTPLAGLALARLIDE

SEQ ID NO: 84845 - protein, 20 aa, Mycobacterium avium
SPPIGVPVDGAGLFVLDAWL

SEQ ID NO: 84846 - protein, 25 aa, Mycobacterium avium
SPQRSRANFAYYARRALARHPDALT

SEQ ID NO: 84847 - protein, 20 aa, Mycobacterium avium
SPRGAELWNAYSSLSDGETR

SEQ ID NO: 84848 - protein, 19 aa, Mycobacterium avium
SPRLARPLWDQQLPFGIAI

SEQ ID NO: 84849 - protein, 19 aa, Mycobacterium avium
SPRLIAVAVQISEPGNAGT

SEQ ID NO: 84850 - protein, 25 aa, Mycobacterium avium
SPRRVRELLELTSRWHSSLLDRHRP

SEQ ID NO: 84851 - protein, 17 aa, Mycobacterium avium
SPSSMRKFYEAFKPYGL

SEQ ID NO: 84852 - protein, 25 aa, Mycobacterium avium
SPTGARLAGKHGIGLLSIGATLTVE

SEQ ID NO: 84853 - protein, 27 aa, Mycobacterium avium
SQAGCGMACPFCATGQGGLSRNLSTAE

SEQ ID NO: 84854 - protein, 17 aa, Mycobacterium avium
SQFRGSELIAEKWNLSR

SEQ ID NO: 84855 - protein, 17 aa, Mycobacterium avium
SQLAWPGRSREEFVACI

SEQ ID NO: 84856 - protein, 20 aa, Mycobacterium avium
SQRDCIRTLSALALLDTEVL

SEQ ID NO: 84857 - protein, 19 aa, Mycobacterium avium
SQSAMFLTTYINAVDPLAG

SEQ ID NO: 84858 - protein, 26 aa, Mycobacterium avium
SRAGVLRFVVLDGLAKPGRLAGPDPS

SEQ ID NO: 84859 - protein, 20 aa, Mycobacterium avium
SRAPLGSLYHFFPGGKQDLA

SEQ ID NO: 84860 - protein, 18 aa, Mycobacterium avium
SRAPRWAVAYKYPPQEAQ

SEQ ID NO: 84861 - protein, 19 aa, Mycobacterium avium
SRASALLAQALDPFSTITG

SEQ ID NO: 84862 - protein, 19 aa, Mycobacterium avium
SRASHDWAKGMRDQLLGRA

SEQ ID NO: 84863 - protein, 25 aa, Mycobacterium avium
SRDFAAEAAFVFAMIGVDLSRLAED

SEQ ID NO: 84864 - protein, 19 aa, Mycobacterium avium
SREAYRWMRANQPVFRDRN

SEQ ID NO: 84865 - protein, 17 aa, Mycobacterium avium
SRFAEIWRRGGELDGVR

SEQ ID NO: 84866 - protein, 21 aa, Mycobacterium avium
SRFNVPVQLLAPIPDGVSAVD

SEQ ID NO: 84867 - protein, 25 aa, Mycobacterium avium
SRFRECAARALLLPRRHPGRRSPLW

SEQ ID NO: 84868 - protein, 24 aa, Mycobacterium avium
SRGEPHRDICLIPSSAHGTNAASA

SEQ ID NO: 84869 - protein, 23 aa, Mycobacterium avium
SRGRLCPKGSASEQLVNSPGRQL

SEQ ID NO: 84870 - protein, 22 aa, Mycobacterium avium
SRIKLGQMCTAMSYRNPVYLAK

SEQ ID NO: 84871 - protein, 17 aa, Mycobacterium avium
SRILGMGDVLSLIEQAE

SEQ ID NO: 84872 - protein, 20 aa, Mycobacterium avium
SRITGGCLCITMFEGTEQHV

SEQ ID NO: 84873 - protein, 23 aa, Mycobacterium avium
SRKCGVPYLYRFELMGTQDDVDA

SEQ ID NO: 84874 - protein, 17 aa, Mycobacterium avium
SRLLPWARSGHLAVPRG

SEQ ID NO: 84875 - protein, 19 aa, Mycobacterium avium
SRLSKQLGDRTFGVVVQMY

SEQ ID NO: 84876 - protein, 20 aa, Mycobacterium avium
SRPYAYLGITVPEFPNFFII

SEQ ID NO: 84877 - protein, 23 aa, Mycobacterium avium
SRQRVYRQPGFVAAMRDIMALQD

SEQ ID NO: 84878 - protein, 25 aa, Mycobacterium avium
SRRPDRPGVRLLLRHGATDPVLLSG

SEQ ID NO: 84879 - protein, 19 aa, Mycobacterium avium
SRRRRGPETIAEVLADLLV

SEQ ID NO: 84880 - protein, 33 aa, Mycobacterium avium
SRSFEEVFIRAGIPYKVVGGVRFYERKEIRDII

SEQ ID NO: 84881 - protein, 24 aa, Mycobacterium avium
SRSWKAIEATGRFCVNVLTEKQKH

SEQ ID NO: 84882 - protein, 19 aa, Mycobacterium avium
SRTTPSIVAFARNGEVLVG

SEQ ID NO: 84883 - protein, 19 aa, Mycobacterium avium
SRVALPEVDGFVWHAYIPG

SEQ ID NO: 84884 - protein, 20 aa, Mycobacterium avium
SRVERARRTLIEIQESGAKD

SEQ ID NO: 84885 - protein, 18 aa, Mycobacterium avium
SRVLKWIVDRIEHKAGGQ

SEQ ID NO: 84886 - protein, 17 aa, Mycobacterium avium
SRWNAGKDLSFVPLRPE

SEQ ID NO: 84887 - protein, 21 aa, Mycobacterium avium
SRWWKEEREGVFVDFNQNAKD

SEQ ID NO: 84888 - protein, 19 aa, Mycobacterium avium
SSAEQVRWVLQDSEAVLAF

SEQ ID NO: 84889 - protein, 20 aa, Mycobacterium avium
SSAGMVWRAAAAVELGICEA

SEQ ID NO: 84890 - protein, 20 aa, Mycobacterium avium
SSAKFNRKIIELNLIGALSV

SEQ ID NO: 84891 - protein, 22 aa, Mycobacterium avium
SSAPDWLPRASVTHRSGTTTYP

SEQ ID NO: 84892 - protein, 23 aa, Mycobacterium avium
SSAQRGSPFAAHYAASKGAVITL

SEQ ID NO: 84893 - protein, 17 aa, Mycobacterium avium
SSARRLAIPELPEELFL

SEQ ID NO: 84894 - protein, 25 aa, Mycobacterium avium
SSDFERIRHEFGFPGDDLVIAKCFL

SEQ ID NO: 84895 - protein, 21 aa, Mycobacterium avium
SSFSMNWKFTREFMPVRFEVD

SEQ ID NO: 84896 - protein, 26 aa, Mycobacterium avium
SSGAIELTGAWPGLRCDVDTPTDLAA

SEQ ID NO: 84897 - protein, 36 aa, Mycobacterium avium
SSGKSARFVKRFADIGGELRRAATQYAHEVAAGVFP

SEQ ID NO: 84898 - protein, 22 aa, Mycobacterium avium
SSGLVRRARCPVAVIHDEDPMM

SEQ ID NO: 84899 - protein, 20 aa, Mycobacterium avium
SSGSIVFRLMYNPFRAAYER

SEQ ID NO: 84900 - protein, 21 aa, Mycobacterium avium
SSHALLAMVARVTWGCEPDEV

SEQ ID NO: 84901 - protein, 20 aa, Mycobacterium avium
SSIKRLAERTSIPVRDGVFI

SEQ ID NO: 84902 - protein, 24 aa, Mycobacterium avium
SSLAPRAALGVGISLGNLTMPPAT

SEQ ID NO: 84903 - protein, 22 aa, Mycobacterium avium
SSLAPRYVDLRPFAVNDGEDVW

SEQ ID NO: 84904 - protein, 25 aa, Mycobacterium avium
SSLIESWDGPSAMAMLQSVQPYLLW

SEQ ID NO: 84905 - protein, 25 aa, Mycobacterium avium
SSLLSRPSVNNVLRVAPRQFKMPRP

SEQ ID NO: 84906 - protein, 18 aa, Mycobacterium avium
SSLLSRRDVVVVASVSCI

SEQ ID NO: 84907 - protein, 20 aa, Mycobacterium avium
SSLPDLLPMLEKVAESGKPL

SEQ ID NO: 84908 - protein, 22 aa, Mycobacterium avium
SSLPRRAAASTVLIVPVVSTGD

SEQ ID NO: 84909 - protein, 23 aa, Mycobacterium avium
SSLRLVVCGGSAVPVSLMRTFEE

SEQ ID NO: 84910 - protein, 27 aa, Mycobacterium avium
SSLTVFSGYRFVRHAAARGIPIAIVNR

SEQ ID NO: 84911 - protein, 19 aa, Mycobacterium avium
SSMRSRPALRDQVAAALHS

SEQ ID NO: 84912 - protein, 26 aa, Mycobacterium avium
SSPGFSWQPLHTMPGISTFYTFYDDV

SEQ ID NO: 84913 - protein, 24 aa, Mycobacterium avium
SSPLLRCRRTLEPLADTLCLAPLV

SEQ ID NO: 84914 - protein, 24 aa, Mycobacterium avium
SSPRLDRLAAEGILFTRAHATAPL

SEQ ID NO: 84915 - protein, 25 aa, Mycobacterium avium
SSSPDEIAHILVLNSRFDGGVTSSV

SEQ ID NO: 84916 - protein, 17 aa, Mycobacterium avium
SSTLLRDRIIKATLDQT

SEQ ID NO: 84917 - protein, 36 aa, Mycobacterium avium
STADALRMLTLPATFGLYVERAWPRHRRLSLTAEDA

SEQ ID NO: 84918 - protein, 23 aa, Mycobacterium avium
STALYPPKRFLGAARNIEEGGSL

SEQ ID NO: 84919 - protein, 18 aa, Mycobacterium avium
STASQWESIISLLTTEQW

SEQ ID NO: 84920 - protein, 27 aa, Mycobacterium avium
STEMQLHLACFAAFDDIGCVIHSHPVW

SEQ ID NO: 84921 - protein, 22 aa, Mycobacterium avium
STFQVLPWASPNGHHHSARMFC

SEQ ID NO: 84922 - protein, 23 aa, Mycobacterium avium
STGHAMAQLGFDMITLAAEAQAL

SEQ ID NO: 84923 - protein, 22 aa, Mycobacterium avium
STKDLKDAFTFNVATAHALTVA

SEQ ID NO: 84924 - protein, 18 aa, Mycobacterium avium
STLLRLVAGLDRPSGGRI

SEQ ID NO: 84925 - protein, 17 aa, Mycobacterium avium
STLPDFDYRECALAAVD

SEQ ID NO: 84926 - protein, 25 aa, Mycobacterium avium
STLQRPSMRGVPFSFIRVDRAGNMS

SEQ ID NO: 84927 - protein, 22 aa, Mycobacterium avium
STLRLIPNIVVLPYRNPFVVAK

SEQ ID NO: 84928 - protein, 24 aa, Mycobacterium avium
STNLPRVLGGLGVAIISTSSGLLT

SEQ ID NO: 84929 - protein, 19 aa, Mycobacterium avium
STVADMMIYMAWSMAGRGA

SEQ ID NO: 84930 - protein, 21 aa, Mycobacterium avium
STVALGLLHRLTATVAKVGVF

SEQ ID NO: 84931 - protein, 18 aa, Mycobacterium avium
STVFPACRAVVHHGGPGT

SEQ ID NO: 84932 - protein, 18 aa, Mycobacterium avium
SVAELKPGAPDGIVDLLV

SEQ ID NO: 84933 - protein, 19 aa, Mycobacterium avium
SVALRILVYSSNAQTRERV

SEQ ID NO: 84934 - protein, 22 aa, Mycobacterium avium
SVDEAMAGYADRVDVRILDDGS

SEQ ID NO: 84935 - protein, 28 aa, Mycobacterium avium
SVDRRARWGDAVPDGFARISLGIEDTDD

SEQ ID NO: 84936 - protein, 23 aa, Mycobacterium avium
SVEEFRAGRIATIPLGRFADPVE

SEQ ID NO: 84937 - protein, 23 aa, Mycobacterium avium
SVFHSIRCALALAGLVDDPQPEW

SEQ ID NO: 84938 - protein, 19 aa, Mycobacterium avium
SVGLEFLSFSGPDVQEGLA

SEQ ID NO: 84939 - protein, 22 aa, Mycobacterium avium
SVGMGRFALARAAEYVKTRQVW

SEQ ID NO: 84940 - protein, 25 aa, Mycobacterium avium
SVHAFNLWLDEDWGFDRPDHRIIAA

SEQ ID NO: 84941 - protein, 17 aa, Mycobacterium avium
SVIPPLAKKFRVIAPDL

SEQ ID NO: 84942 - protein, 18 aa, Mycobacterium avium
SVLAALEAGCRLIDTAAS

SEQ ID NO: 84943 - protein, 23 aa, Mycobacterium avium
SVNLDGALWCTRAVYKKMTKRGG

SEQ ID NO: 84944 - protein, 17 aa, Mycobacterium avium
SVSHAFHSPLMEPMIDE

SEQ ID NO: 84945 - protein, 23 aa, Mycobacterium avium
SVTDALDILRWAPQAASEPVAKV

SEQ ID NO: 84946 - protein, 26 aa, Mycobacterium avium
SVTEALRAGGFFHHAKVEMVWVASDD

SEQ ID NO: 84947 - protein, 25 aa, Mycobacterium avium
SVVVAGLCRLLARRGVRVAPFKAQN

SEQ ID NO: 84948 - protein, 17 aa, Mycobacterium avium
SVYAMAMLFALDRAAAV

SEQ ID NO: 84949 - protein, 17 aa, Mycobacterium avium
SVYARVNPFGFIETPYR

SEQ ID NO: 84950 - protein, 19 aa, Mycobacterium avium
SVYRDARRALADGTLSFAD

SEQ ID NO: 84951 - protein, 17 aa, Mycobacterium avium
SWGEPYTEIAARMETAV

SEQ ID NO: 84952 - protein, 28 aa, Mycobacterium avium
SWLDDRKWAYVRLEGRAFGDVPLNLEYK

SEQ ID NO: 84953 - protein, 25 aa, Mycobacterium avium
SWMEIEAFRLLTLQTAWKIDQFNDY

SEQ ID NO: 84954 - protein, 19 aa, Mycobacterium avium
SWTPEGFFGRMLATIRPYR

SEQ ID NO: 84955 - protein, 23 aa, Mycobacterium avium
SWVKFHFKSNQGIEWLTQEEGDR

SEQ ID NO: 84956 - protein, 25 aa, Mycobacterium avium
SWWKEERGARIFIDFNQNARDRTMA

SEQ ID NO: 84957 - protein, 25 aa, Mycobacterium avium
SYANRFGYNVVRDFTGHGIGTTFHN

SEQ ID NO: 84958 - protein, 18 aa, Mycobacterium avium
SYGEYAGEMTLSYDPPRK

SEQ ID NO: 84959 - protein, 23 aa, Mycobacterium avium
SYGSLEVFSGVDLAIDRGSRVVV

SEQ ID NO: 84960 - protein, 32 aa, Mycobacterium avium
SYHREIAMNFGMDGPWGQWVNRWTAEENRHGI

SEQ ID NO: 84961 - protein, 18 aa, Mycobacterium avium
SYIDSMVLATGWLGSLAV

SEQ ID NO: 84962 - protein, 24 aa, Mycobacterium avium
SYIDYAMSVIVGRALPEVRDGLKP

SEQ ID NO: 84963 - protein, 22 aa, Mycobacterium avium
SYLRCLRVLMAGSGYPMVASHD

SEQ ID NO: 84964 - protein, 24 aa, Mycobacterium avium
SYPPEAIDWLLPVGARQVLDLGAG

SEQ ID NO: 84965 - protein, 18 aa, Mycobacterium avium
SYPTFLLTHWARDRSRGD

SEQ ID NO: 84966 - protein, 24 aa, Mycobacterium avium
SYQPEIWDYLKGVTEKYGLRRYIE

SEQ ID NO: 84967 - protein, 24 aa, Mycobacterium avium
SYRDLAGFGRRFIDVAADELLADV

SEQ ID NO: 84968 - protein, 24 aa, Mycobacterium avium
SYRELPLRLFEFGTVYRYEKSGVV

SEQ ID NO: 84969 - protein, 21 aa, Mycobacterium avium
SYSTYFLTHWARDRKSGRFSV

SEQ ID NO: 84970 - protein, 30 aa, Mycobacterium avium
SYVFGAELFPRMRIPQAWYDAGIAVRADNL

SEQ ID NO: 84971 - protein, 18 aa, Mycobacterium avium
TAAAFWLRAQAWFTTCGF

SEQ ID NO: 84972 - protein, 29 aa, Mycobacterium avium
TAAGLRAGVPMLILWLWLDQPVWAEAVSA

SEQ ID NO: 84973 - protein, 24 aa, Mycobacterium avium
TAAIAVEFARLYAVELEHYEKLEG

SEQ ID NO: 84974 - protein, 23 aa, Mycobacterium avium
TAAKRLCRSRVGIDAEAGPTEIA

SEQ ID NO: 84975 - protein, 33 aa, Mycobacterium avium
TAARPAVMPMDAWRDGDQFVVEFDLPGVNADSL

SEQ ID NO: 84976 - protein, 23 aa, Mycobacterium avium
TAARTCFTERGFSNTTMQDIADA

SEQ ID NO: 84977 - protein, 27 aa, Mycobacterium avium
TAARWSAERHLVFACGRYEGIDQRVVE

SEQ ID NO: 84978 - protein, 18 aa, Mycobacterium avium
TAATFDRLDIDGACSTND

SEQ ID NO: 84979 - protein, 18 aa, Mycobacterium avium
TAAVIRAALPYLKATGGR

SEQ ID NO: 84980 - protein, 21 aa, Mycobacterium avium
TADGYASNWLCDNARPGMRIH

SEQ ID NO: 84981 - protein, 19 aa, Mycobacterium avium
TADIRPGQDVAIVGVGGVG

SEQ ID NO: 84982 - protein, 21 aa, Mycobacterium avium
TAEQMAEFYAGLLGAYPLVSI

SEQ ID NO: 84983 - protein, 26 aa, Mycobacterium avium
TAEQMKMFLTRLGFGSKIVVTGDITQ

SEQ ID NO: 84984 - protein, 25 aa, Mycobacterium avium
TAEQWRLVLDVNLIGAWNTCAAALP

SEQ ID NO: 84985 - protein, 19 aa, Mycobacterium avium
TAEVFLAALRPLRLTASAA

SEQ ID NO: 84986 - protein, 23 aa, Mycobacterium avium
TAEVLARLGLTAADIERLADAKT

SEQ ID NO: 84987 - protein, 19 aa, Mycobacterium avium
TAFDIGRRGAVRSAVVRLD

SEQ ID NO: 84988 - protein, 18 aa, Mycobacterium avium
TAGDRPDVLVAMNPAALK

SEQ ID NO: 84989 - protein, 25 aa, Mycobacterium avium
TAGGMSRWLPYLSELQPEMFCEVSP

SEQ ID NO: 84990 - protein, 20 aa, Mycobacterium avium
TAGLDDVYLLAAEDVPDGPG

SEQ ID NO: 84991 - protein, 19 aa, Mycobacterium avium
TAHEVTWSQFGVRLEAIGA

SEQ ID NO: 84992 - protein, 19 aa, Mycobacterium avium
TAHVCAALGEPAPGGLDPR

SEQ ID NO: 84993 - protein, 18 aa, Mycobacterium avium
TAIDVQRVVAVSWPSGDG

SEQ ID NO: 84994 - protein, 17 aa, Mycobacterium avium
TAIRIGAPASWTAAVDA

SEQ ID NO: 84995 - protein, 25 aa, Mycobacterium avium
TAKGLEFPVVFVTGWEDGMFPHMRS

SEQ ID NO: 84996 - protein, 24 aa, Mycobacterium avium
TAKLKRKPIATGYAAQIDAMYTEQ

SEQ ID NO: 84997 - protein, 23 aa, Mycobacterium avium
TAKREIRLLSRFTGANPHVPVIG

SEQ ID NO: 84998 - protein, 25 aa, Mycobacterium avium
TAKSMPYKGGFGPFAPEIYRAPLSY

SEQ ID NO: 84999 - protein, 26 aa, Mycobacterium avium
TALDLCPRIRVNAIAPGSILTSALDV

SEQ ID NO: 85000 - protein, 24 aa, Mycobacterium avium
TALLVAGWRALHAVSPRPLVRDDY

SEQ ID NO: 85001 - protein, 25 aa, Mycobacterium avium
TALRLPRYRELSGFSEANDAYLEVA

SEQ ID NO: 85002 - protein, 18 aa, Mycobacterium avium
TALVSGLLRELGRRIVSW

SEQ ID NO: 85003 - protein, 25 aa, Mycobacterium avium
TAMLARCLIALQWIPENILAEIGKR

SEQ ID NO: 85004 - protein, 18 aa, Mycobacterium avium
TAMWYAVVDGEIWLETKA

SEQ ID NO: 85005 - protein, 24 aa, Mycobacterium avium
TANRRPAVAYAYSKLAIVLFTKEL

SEQ ID NO: 85006 - protein, 19 aa, Mycobacterium avium
TAPHLLRKSVLMSETDHSN

SEQ ID NO: 85007 - protein, 19 aa, Mycobacterium avium
TAQCTTVSVPIDYNNPGAG

SEQ ID NO: 85008 - protein, 17 aa, Mycobacterium avium
TAQRPGDVLTQYGGTTV

SEQ ID NO: 85009 - protein, 24 aa, Mycobacterium avium
TARAPVRVGFRLGEPAAGELGVRG

SEQ ID NO: 85010 - protein, 19 aa, Mycobacterium avium
TASALTWMVERACQQNLPA

SEQ ID NO: 85011 - protein, 25 aa, Mycobacterium avium
TASEVSDRFLAYFAARDWDAMANMT

SEQ ID NO: 85012 - protein, 17 aa, Mycobacterium avium
TASVPVMRVEAQGTTAT

SEQ ID NO: 85013 - protein, 27 aa, Mycobacterium avium
TATRPAVMPMDAWREGEHFVVEFDLPG

SEQ ID NO: 85014 - protein, 19 aa, Mycobacterium avium
TATVIERWVQEYLEATNRL

SEQ ID NO: 85015 - protein, 20 aa, Mycobacterium avium
TAVACPRFVDFVERGVTSGR

SEQ ID NO: 85016 - protein, 23 aa, Mycobacterium avium
TAVADAGLTWVGPPVDAVRAMGS

SEQ ID NO: 85017 - protein, 20 aa, Mycobacterium avium
TAVEELMRYLSIIQTGQRRI

SEQ ID NO: 85018 - protein, 26 aa, Mycobacterium avium
TAVEEVLRWASPVAYWTRTAKVDVEM

SEQ ID NO: 85019 - protein, 17 aa, Mycobacterium avium
TAVERFGGLDIMVNNAG

SEQ ID NO: 85020 - protein, 18 aa, Mycobacterium avium
TAVLPEVIRRSGVDPAAI

SEQ ID NO: 85021 - protein, 17 aa, Mycobacterium avium
TAVNEWLDEDGNPKHEV

SEQ ID NO: 85022 - protein, 26 aa, Mycobacterium avium
TAVRRARRAVAEFRIRGVSTNIPFLQ

SEQ ID NO: 85023 - protein, 19 aa, Mycobacterium avium
TCLRRGEIEMVTRYEPTAA

SEQ ID NO: 85024 - protein, 25 aa, Mycobacterium avium
TCRFPGCSRPAVICDLDHSVPFNHQ

SEQ ID NO: 85025 - protein, 25 aa, Mycobacterium avium
TCTRAAESIGGLGIVTDVRDSGQVD

SEQ ID NO: 85026 - protein, 17 aa, Mycobacterium avium
TDAALRVTDEFAALRPP

SEQ ID NO: 85027 - protein, 21 aa, Mycobacterium avium
TDADGGPALVEFAGRACYQSW

SEQ ID NO: 85028 - protein, 19 aa, Mycobacterium avium
TDALVSWADPEFLNGRPAL

SEQ ID NO: 85029 - protein, 19 aa, Mycobacterium avium
TDALVVWLPEERILFTGNL

SEQ ID NO: 85030 - protein, 18 aa, Mycobacterium avium
TDAPRYAELIKRTQWWGR

SEQ ID NO: 85031 - protein, 18 aa, Mycobacterium avium
TDEPGLWLAHDRLGSETK

SEQ ID NO: 85032 - protein, 29 aa, Mycobacterium avium
TDEPRPGFWPNLVELGWLGLHIDEEYGGS

SEQ ID NO: 85033 - protein, 22 aa, Mycobacterium avium
TDEVVDVVLLWWRDGDGDLVDT

SEQ ID NO: 85034 - protein, 17 aa, Mycobacterium avium
TDGAQEFGGAPVPDTPG

SEQ ID NO: 85035 - protein, 20 aa, Mycobacterium avium
TDGARRWWSVAGRHDPDDVR

SEQ ID NO: 85036 - protein, 22 aa, Mycobacterium avium
TDGDRLRITWHGQTVVDVPPRT

SEQ ID NO: 85037 - protein, 19 aa, Mycobacterium avium
TDGPVCEELAWAAVQSEML

SEQ ID NO: 85038 - protein, 22 aa, Mycobacterium avium
TDKGRALAVAVMRKHRLAERLL

SEQ ID NO: 85039 - protein, 25 aa, Mycobacterium avium
TDLARAIPLPTQFEFMAVSSYGSST

SEQ ID NO: 85040 - protein, 35 aa, Mycobacterium avium
TDLLDEAWWFPAIQWPDGRMQFMLNERMMPAQFIV

SEQ ID NO: 85041 - protein, 23 aa, Mycobacterium avium
TDLPLGYHRVWLRSGGSEASAAL

SEQ ID NO: 85042 - protein, 17 aa, Mycobacterium avium
TDMPRGGHFAAFEQPEL

SEQ ID NO: 85043 - protein, 23 aa, Mycobacterium avium
TDPLCYVDPYLPIESFKRRDEAR

SEQ ID NO: 85044 - protein, 17 aa, Mycobacterium avium
TDPRCLALLDEQRKILD

SEQ ID NO: 85045 - protein, 24 aa, Mycobacterium avium
TDRPHPRGELLLRTENMFPGYYKR

SEQ ID NO: 85046 - protein, 23 aa, Mycobacterium avium
TDRPVYICGPGAFMDSAREALET

SEQ ID NO: 85047 - protein, 18 aa, Mycobacterium avium
TDRSNCFIFADGAAGVVV

SEQ ID NO: 85048 - protein, 23 aa, Mycobacterium avium
TDSAAGWERRLRPLGVPAAAVRT

SEQ ID NO: 85049 - protein, 19 aa, Mycobacterium avium
TDSAVRRYVTDAGPLLPRL

SEQ ID NO: 85050 - protein, 26 aa, Mycobacterium avium
TDTGSFRWASARALRLAARLVDIGVD

SEQ ID NO: 85051 - protein, 19 aa, Mycobacterium avium
TDVDDWWEYGWVFHAMNTN

SEQ ID NO: 85052 - protein, 17 aa, Mycobacterium avium
TDVRAPRALWLEPTGDV

SEQ ID NO: 85053 - protein, 17 aa, Mycobacterium avium
TDVRGGGSFDVSAGAVI

SEQ ID NO: 85054 - protein, 23 aa, Mycobacterium avium
TEACAKIPIGLGPDIVCVVPEMN

SEQ ID NO: 85055 - protein, 25 aa, Mycobacterium avium
TEACGDCPRVILGSPLAGESLEEVI

SEQ ID NO: 85056 - protein, 17 aa, Mycobacterium avium
TEAEWEYAARAGATTTY

SEQ ID NO: 85057 - protein, 24 aa, Mycobacterium avium
TEALPARYGQAVAESEVHPLGQPE

SEQ ID NO: 85058 - protein, 24 aa, Mycobacterium avium
TEALRYVQRLGVERIAAYEHALLE

SEQ ID NO: 85059 - protein, 24 aa, Mycobacterium avium
TEALTNWYVRRSRSRFWSEDADAI

SEQ ID NO: 85060 - protein, 29 aa, Mycobacterium avium
TEAPAEMHFYFPQFRALCMAENATHNLHN

SEQ ID NO: 85061 - protein, 23 aa, Mycobacterium avium
TEAYKHLKPIGAYGAGVDLLRKA

SEQ ID NO: 85062 - protein, 24 aa, Mycobacterium avium
TECDDRFDIVQAFTDDALTTCKHC

SEQ ID NO: 85063 - protein, 22 aa, Mycobacterium avium
TEDARVGKSLIVQLKYGPSRER

SEQ ID NO: 85064 - protein, 25 aa, Mycobacterium avium
TEDPALVGMPRWYAENGQYLTTQFF

SEQ ID NO: 85065 - protein, 19 aa, Mycobacterium avium
TEFAGPISTVRCFQDNALL

SEQ ID NO: 85066 - protein, 18 aa, Mycobacterium avium
TEFEAAFYDAYRTDQPLI

SEQ ID NO: 85067 - protein, 22 aa, Mycobacterium avium
TEFLPGSLIDRAEFEAENRRVV

SEQ ID NO: 85068 - protein, 19 aa, Mycobacterium avium
TEGALYLRMDDFPARLVIV

SEQ ID NO: 85069 - protein, 28 aa, Mycobacterium avium
TEGVPRWRKGSGLGWLTAEYAMLPSATH

SEQ ID NO: 85070 - protein, 24 aa, Mycobacterium avium
TEHFPRPAPRPTYSALGSRESAAA

SEQ ID NO: 85071 - protein, 21 aa, Mycobacterium avium
TEHLPAITVPTVFTHGTSDPF

SEQ ID NO: 85072 - protein, 23 aa, Mycobacterium avium
TEIRTFSGLLERFGRGKGCDICK

SEQ ID NO: 85073 - protein, 24 aa, Mycobacterium avium
TEIVPGIERTVYWLTQAYQNADAG

SEQ ID NO: 85074 - protein, 24 aa, Mycobacterium avium
TELEALLRGYGYRPITVAGDDPTD

SEQ ID NO: 85075 - protein, 32 aa, Mycobacterium avium
TELEFTEGVGFDKGFLSAYFVTDFDAQQAVLD

SEQ ID NO: 85076 - protein, 25 aa, Mycobacterium avium
TELLEYHWGPDWMVWDADRTAQQHG

SEQ ID NO: 85077 - protein, 24 aa, Mycobacterium avium
TELRVRCVRQLRDAMREHIEELRD

SEQ ID NO: 85078 - protein, 20 aa, Mycobacterium avium
TELTLAYILGVLLIGSAGWQ

SEQ ID NO: 85079 - protein, 18 aa, Mycobacterium avium
TELVAWINGHPEFTALPV

SEQ ID NO: 85080 - protein, 24 aa, Mycobacterium avium
TELVLMELGMDWDRIEELKNAGAI

SEQ ID NO: 85081 - protein, 25 aa, Mycobacterium avium
TEMGRLAMWQMRYHVDRPLRARERI

SEQ ID NO: 85082 - protein, 21 aa, Mycobacterium avium
TEMHSRSGLIDEVKASTVDLA

SEQ ID NO: 85083 - protein, 24 aa, Mycobacterium avium
TEMPEMPLIRFLDGYETIAEMEAA

SEQ ID NO: 85084 - protein, 24 aa, Mycobacterium avium
TEPEAFKWIQRAAMDRRTTMKRVA

SEQ ID NO: 85085 - protein, 17 aa, Mycobacterium avium
TEPLLRLNVEGRTAEDV

SEQ ID NO: 85086 - protein, 21 aa, Mycobacterium avium
TEPYSGLDWRCAQWLHDHEVA

SEQ ID NO: 85087 - protein, 23 aa, Mycobacterium avium
TEQQARFAMRMIRRPVHDPARYD

SEQ ID NO: 85088 - protein, 20 aa, Mycobacterium avium
TERILYYTGISYKIGEVHDG

SEQ ID NO: 85089 - protein, 23 aa, Mycobacterium avium
TERRVRRGRIQFVRQEPLFAPSV

SEQ ID NO: 85090 - protein, 21 aa, Mycobacterium avium
TESALRFVGAATFEALSGQPV

SEQ ID NO: 85091 - protein, 38 aa, Mycobacterium avium
TESIADLRAIPWVLAWSQSRVMLPGWYGTGSAFEQWIA

SEQ ID NO: 85092 - protein, 17 aa, Mycobacterium avium
TETALTWAGSCRPGDGL

SEQ ID NO: 85093 - protein, 18 aa, Mycobacterium avium
TEVPRPGPSDLLVAVRAC

SEQ ID NO: 85094 - protein, 20 aa, Mycobacterium avium
TEYNVRFTAVVPVPNDGKGA

SEQ ID NO: 85095 - protein, 20 aa, Mycobacterium avium
TFAGLPAYKQGLGRKVRFMA

SEQ ID NO: 85096 - protein, 19 aa, Mycobacterium avium
TFAPILYVLTYDRLDDAIA

SEQ ID NO: 85097 - protein, 22 aa, Mycobacterium avium
TFDYPSRIIAGLLGLPEQDYPQ

SEQ ID NO: 85098 - protein, 21 aa, Mycobacterium avium
TFGMDSWFPSLKIYNRNGQLY

SEQ ID NO: 85099 - protein, 25 aa, Mycobacterium avium
TFQRLWYQVGTNIGHYHCYPRLVGE

SEQ ID NO: 85100 - protein, 25 aa, Mycobacterium avium
TFRYNEVIHYWALDGGWDCFANHYP

SEQ ID NO: 85101 - protein, 23 aa, Mycobacterium avium
TFSEAYKVAALDVMNKVRALNQF

SEQ ID NO: 85102 - protein, 22 aa, Mycobacterium avium
TFTKLRGSFDLMLNTVSANLKL

SEQ ID NO: 85103 - protein, 18 aa, Mycobacterium avium
TFVGLALSVCAQAPLEPV

SEQ ID NO: 85104 - protein, 22 aa, Mycobacterium avium
TFVRASGMALPFADDSVDICLS

SEQ ID NO: 85105 - protein, 25 aa, Mycobacterium avium
TFYRDRIGLAIAREYSGGTVFFAGQ

SEQ ID NO: 85106 - protein, 20 aa, Mycobacterium avium
TGAANRFWAHGTLEPARATA

SEQ ID NO: 85107 - protein, 25 aa, Mycobacterium avium
TGADLRRYLTRWIGPAIAYPQLLRA

SEQ ID NO: 85108 - protein, 24 aa, Mycobacterium avium
TGAGGYFCAGMDLKAATKKPPGES

SEQ ID NO: 85109 - protein, 23 aa, Mycobacterium avium
TGAKEILCIRVLGGSSRRYAGIG

SEQ ID NO: 85110 - protein, 21 aa, Mycobacterium avium
TGARGLRAIMEEVLLPVMYDI

SEQ ID NO: 85111 - protein, 26 aa, Mycobacterium avium
TGASPRFLLDFSRRFPDATVVRLERD

SEQ ID NO: 85112 - protein, 18 aa, Mycobacterium avium
TGAVYAQLAAAGWGGAWR

SEQ ID NO: 85113 - protein, 20 aa, Mycobacterium avium
TGCADAFRAGYIDVNQFTLA

SEQ ID NO: 85114 - protein, 22 aa, Mycobacterium avium
TGEPLSAAAARDWGLINEVVEA

SEQ ID NO: 85115 - protein, 23 aa, Mycobacterium avium
TGEPSYAMDICLSSRKGDHNHAG

SEQ ID NO: 85116 - protein, 18 aa, Mycobacterium avium
TGFFAAPAARRMGAGLEL

SEQ ID NO: 85117 - protein, 21 aa, Mycobacterium avium
TGFGEIFLDDVFVPDRDVIGT

SEQ ID NO: 85118 - protein, 18 aa, Mycobacterium avium
TGGARLTFRATVQVRVPI

SEQ ID NO: 85119 - protein, 21 aa, Mycobacterium avium
TGGAVPAIIAEYLGLPQLTHL

SEQ ID NO: 85120 - protein, 34 aa, Mycobacterium avium
TGGQRIDMFGARVDQLPAIWKRLVDGGMESGHAY

SEQ ID NO: 85121 - protein, 22 aa, Mycobacterium avium
TGGRIPREYIPSVDAGAQDAMQ

SEQ ID NO: 85122 - protein, 22 aa, Mycobacterium avium
TGGVEPWAYLIVGGVQLATHSW

SEQ ID NO: 85123 - protein, 20 aa, Mycobacterium avium
TGHTAEYFTRMMAGLGDELG

SEQ ID NO: 85124 - protein, 29 aa, Mycobacterium avium
TGIVSRGGSIMAAWCLAHHRESFLYTNFD

SEQ ID NO: 85125 - protein, 20 aa, Mycobacterium avium
TGKIAFPIARALAAAGNEVW

SEQ ID NO: 85126 - protein, 23 aa, Mycobacterium avium
TGKLRPPVFGILRYLADAVDEID

SEQ ID NO: 85127 - protein, 18 aa, Mycobacterium avium
TGKPHGWIHNELRRRCGG

SEQ ID NO: 85128 - protein, 22 aa, Mycobacterium avium
TGKSVFLKSLIGLLRPERGSVV

SEQ ID NO: 85129 - protein, 17 aa, Mycobacterium avium
TGLESTMRFILSAKSAY

SEQ ID NO: 85130 - protein, 20 aa, Mycobacterium avium
TGLLDLLNRLGITPLPNTAG

SEQ ID NO: 85131 - protein, 19 aa, Mycobacterium avium
TGMELRAAIDAGDVVVAEK

SEQ ID NO: 85132 - protein, 18 aa, Mycobacterium avium
TGNALPRTRPFRVSYGTS

SEQ ID NO: 85133 - protein, 24 aa, Mycobacterium avium
TGPELLSRAAALNWDTTAPATVVV

SEQ ID NO: 85134 - protein, 17 aa, Mycobacterium avium
TGPRILATRSRIYPDTE

SEQ ID NO: 85135 - protein, 17 aa, Mycobacterium avium
TGQDPAVRDYVLGQPGA

SEQ ID NO: 85136 - protein, 23 aa, Mycobacterium avium
TGQPRVSPLLYLREGDRVILVAS

SEQ ID NO: 85137 - protein, 20 aa, Mycobacterium avium
TGRPPRAIPEPQPRTSHGPA

SEQ ID NO: 85138 - protein, 27 aa, Mycobacterium avium
TGSAKWALKIAREWSGERVQWGKPLAE

SEQ ID NO: 85139 - protein, 18 aa, Mycobacterium avium
TGSFLFQYAKTWRTLAKL

SEQ ID NO: 85140 - protein, 25 aa, Mycobacterium avium
TGTFLCLQAALPDMVEAGWGRVVTI

SEQ ID NO: 85141 - protein, 26 aa, Mycobacterium avium
TGTPWLTAFAQRSPFAEAFRANGQSA

SEQ ID NO: 85142 - protein, 20 aa, Mycobacterium avium
TGVAVAIPFGMVGLVHPRSG

SEQ ID NO: 85143 - protein, 17 aa, Mycobacterium avium
TGVRVFFPDPWPKARHH

SEQ ID NO: 85144 - protein, 24 aa, Mycobacterium avium
TGYVMPHWPKPWGRAADAVEQLVI

SEQ ID NO: 85145 - protein, 20 aa, Mycobacterium avium
THAGLFLEYFNGCKSFRFSE

SEQ ID NO: 85146 - protein, 19 aa, Mycobacterium avium
THIPCWLITDHRSWNRYVI

SEQ ID NO: 85147 - protein, 19 aa, Mycobacterium avium
THLLAAFGADVVKIESIQR

SEQ ID NO: 85148 - protein, 17 aa, Mycobacterium avium
THLRKLSIENGKVTGER

SEQ ID NO: 85149 - protein, 22 aa, Mycobacterium avium
THLSFVPGWNRRQLRRLIRDLR

SEQ ID NO: 85150 - protein, 18 aa, Mycobacterium avium
THLSRLVPQHLMRRLFFT

SEQ ID NO: 85151 - protein, 24 aa, Mycobacterium avium
THLTRLRLITSMLDRGYTIAHVRE

SEQ ID NO: 85152 - protein, 24 aa, Mycobacterium avium
THRPPSCRFWNMVVWNQFMATYGA

SEQ ID NO: 85153 - protein, 19 aa, Mycobacterium avium
THSLALEYAKQGLRAVNIQ

SEQ ID NO: 85154 - protein, 29 aa, Mycobacterium avium
THVVRRYGAAFERPGPRLRDYLLAVKACF

SEQ ID NO: 85155 - protein, 18 aa, Mycobacterium avium
THYLRVYLAQLRRKLEND

SEQ ID NO: 85156 - protein, 24 aa, Mycobacterium avium
TIAASCPLAGPVVVIGDARAYNTA

SEQ ID NO: 85157 - protein, 18 aa, Mycobacterium avium
TIAGLEFGFHRVFNQASG

SEQ ID NO: 85158 - protein, 19 aa, Mycobacterium avium
TIAGLRAFVAVAEKRQFSG

SEQ ID NO: 85159 - protein, 17 aa, Mycobacterium avium
TIARLCAFSSDRIPKWL

SEQ ID NO: 85160 - protein, 23 aa, Mycobacterium avium
TIASRRIAVLAADGVDVVGTQRF

SEQ ID NO: 85161 - protein, 24 aa, Mycobacterium avium
TIFRLGSDPGLARFIDQVARRVEG

SEQ ID NO: 85162 - protein, 17 aa, Mycobacterium avium
TIGIYLSRLLDCAQAGQ

SEQ ID NO: 85163 - protein, 23 aa, Mycobacterium avium
TIHPDGFLTYRVVGSRQHAFRPP

SEQ ID NO: 85164 - protein, 18 aa, Mycobacterium avium
TIPAGRRVLLLYGSANRD

SEQ ID NO: 85165 - protein, 24 aa, Mycobacterium avium
TIQHADLLVVRRGEKVVVEVTVVI

SEQ ID NO: 85166 - protein, 23 aa, Mycobacterium avium
TIRLGKYDLGIAIGLDKHPRGAF

SEQ ID NO: 85167 - protein, 24 aa, Mycobacterium avium
TIRQRLGGIEGRRVVIVGDVLHSR

SEQ ID NO: 85168 - protein, 28 aa, Mycobacterium avium
TIRTGRANPGMFSRIVIDYYGAATPITQ

SEQ ID NO: 85169 - protein, 26 aa, Mycobacterium avium
TISMYPRMWAASGVDYPSLLATMVET

SEQ ID NO: 85170 - protein, 18 aa, Mycobacterium avium
TISPPINMNPRWLGAHPA

SEQ ID NO: 85171 - protein, 19 aa, Mycobacterium avium
TKDHIEAIANWDPKAEPSI

SEQ ID NO: 85172 - protein, 17 aa, Mycobacterium avium
TKFFDEFFLNATKAGIA

SEQ ID NO: 85173 - protein, 17 aa, Mycobacterium avium
TKGLSLFFVPKFLFDFE

SEQ ID NO: 85174 - protein, 18 aa, Mycobacterium avium
TKIEFVFRDTYQCGNEEA

SEQ ID NO: 85175 - protein, 22 aa, Mycobacterium avium
TKLPGLGSWRRPQAELDESSRA

SEQ ID NO: 85176 - protein, 22 aa, Mycobacterium avium
TKLRDAWLSARRDLADRRNRMR

SEQ ID NO: 85177 - protein, 23 aa, Mycobacterium avium
TKRPPAFPEDIWVPERDPGNTRL

SEQ ID NO: 85178 - protein, 17 aa, Mycobacterium avium
TKRSETFTTADDNQPSV

SEQ ID NO: 85179 - protein, 18 aa, Mycobacterium avium
TKTVMGRSVLLTRTSDGS

SEQ ID NO: 85180 - protein, 25 aa, Mycobacterium avium
TLAVSFSECNAGLVVDEVDADLLAA

SEQ ID NO: 85181 - protein, 24 aa, Mycobacterium avium
TLDALVSLVLDWRRPVKLFIETKH

SEQ ID NO: 85182 - protein, 18 aa, Mycobacterium avium
TLDEGRIARIWLNRPDAH

SEQ ID NO: 85183 - protein, 32 aa, Mycobacterium avium
TLEARLATRVGLRPDVKRVPLFGLGCVAGAAG

SEQ ID NO: 85184 - protein, 25 aa, Mycobacterium avium
TLEDRLRTRFEWGLITDVQPPELET

SEQ ID NO: 85185 - protein, 17 aa, Mycobacterium avium
TLELGGKSPNIFFSDVM

SEQ ID NO: 85186 - protein, 26 aa, Mycobacterium avium
TLGPKGRNVVLEKKWGAPTITNDGVS

SEQ ID NO: 85187 - protein, 21 aa, Mycobacterium avium
TLGQYADWIFCLVRTDPQAPK

SEQ ID NO: 85188 - protein, 19 aa, Mycobacterium avium
TLGVITRVRLRVHRIPQAV

SEQ ID NO: 85189 - protein, 19 aa, Mycobacterium avium
TLHALAWMVPGELAVFGLG

SEQ ID NO: 85190 - protein, 25 aa, Mycobacterium avium
TLHSVKVIPSRGAWLEFDVDKRDTV

SEQ ID NO: 85191 - protein, 27 aa, Mycobacterium avium
TLIAMPALRLDAAFVHLNLGDAQGNAA

SEQ ID NO: 85192 - protein, 24 aa, Mycobacterium avium
TLIHLTLAAARDFPWTERRQGVLG

SEQ ID NO: 85193 - protein, 18 aa, Mycobacterium avium
TLLYKKSNVMFGIDLAKR

SEQ ID NO: 85194 - protein, 29 aa, Mycobacterium avium
TLRCYLDDQPIFLGRNGRISVFTSERALA

SEQ ID NO: 85195 - protein, 25 aa, Mycobacterium avium
TLREHMLRSAYQRWLNLGFAVRADW

SEQ ID NO: 85196 - protein, 20 aa, Mycobacterium avium
TLRQMRWANAMLKELSPQVL

SEQ ID NO: 85197 - protein, 21 aa, Mycobacterium avium
TLRTEMGYPLHGHELSPDISP

SEQ ID NO: 85198 - protein, 25 aa, Mycobacterium avium
TLSMLPRLAGPTVNVAWDAPQTGAA

SEQ ID NO: 85199 - protein, 17 aa, Mycobacterium avium
TLTEFKLLNFLVQHAGQ

SEQ ID NO: 85200 - protein, 23 aa, Mycobacterium avium
TLTGDGIGIVFRKGLPLEDMEFH

SEQ ID NO: 85201 - protein, 18 aa, Mycobacterium avium
TLTGFKWLARADAEVPGG

SEQ ID NO: 85202 - protein, 25 aa, Mycobacterium avium
TLVDGRGGPHFLPFGAATVGSDTIA

SEQ ID NO: 85203 - protein, 24 aa, Mycobacterium avium
TLVNCVGVFDFYRGVADIDAGALA

SEQ ID NO: 85204 - protein, 18 aa, Mycobacterium avium
TLVRAVCGDRRLVTLDGP

SEQ ID NO: 85205 - protein, 25 aa, Mycobacterium avium
TLVRMAQPWSLRYPLVDGQGNFGSP

SEQ ID NO: 85206 - protein, 27 aa, Mycobacterium avium
TLYLQLYLGGFGLELSDIESLRTWGSK

SEQ ID NO: 85207 - protein, 18 aa, Mycobacterium avium
TMAPFVIPCEAGVVSADP

SEQ ID NO: 85208 - protein, 23 aa, Mycobacterium avium
TMGIGGGYVTAWIGDPGAVTEYN

SEQ ID NO: 85209 - protein, 23 aa, Mycobacterium avium
TMKHLRAGYWRQVRTQLLVTPAL

SEQ ID NO: 85210 - protein, 21 aa, Mycobacterium avium
TMMTAMTWLALGRDLEAWPQP

SEQ ID NO: 85211 - protein, 19 aa, Mycobacterium avium
TMVVTGLHLLGGARADATR

SEQ ID NO: 85212 - protein, 24 aa, Mycobacterium avium
TMWERRLDTPIARASYEIHAAGAS

SEQ ID NO: 85213 - protein, 27 aa, Mycobacterium avium
TMYAGWREVIAGFVARRCECKTTDLAP

SEQ ID NO: 85214 - protein, 19 aa, Mycobacterium avium
TNAWVPFVVAGTVLVRDGG

SEQ ID NO: 85215 - protein, 23 aa, Mycobacterium avium
TNEGLRSRFTRNIDFPSYAPSEL

SEQ ID NO: 85216 - protein, 18 aa, Mycobacterium avium
TNFYVMRNPHKLAALATA

SEQ ID NO: 85217 - protein, 20 aa, Mycobacterium avium
TNLNPVWKVGFQIREALRAN

SEQ ID NO: 85218 - protein, 27 aa, Mycobacterium avium
TNPVYFALLARRRMDLYGATLEDFAQV

SEQ ID NO: 85219 - protein, 23 aa, Mycobacterium avium
TNSTCGACFGYHMGLLGAGEVCI

SEQ ID NO: 85220 - protein, 21 aa, Mycobacterium avium
TNTPRNFARRGIRSHVLPSSA

SEQ ID NO: 85221 - protein, 25 aa, Mycobacterium avium
TNVMPQWAGSSWYELRYTDPHNSER

SEQ ID NO: 85222 - protein, 19 aa, Mycobacterium avium
TPAGLIELGAFLALTQPDL

SEQ ID NO: 85223 - protein, 19 aa, Mycobacterium avium
TPARVARAYREMFAGLYTD

SEQ ID NO: 85224 - protein, 24 aa, Mycobacterium avium
TPDELSCIRTAIRITDEAMVEVQK

SEQ ID NO: 85225 - protein, 22 aa, Mycobacterium avium
TPDVRNGIEFKVADLSLADYGR

SEQ ID NO: 85226 - protein, 29 aa, Mycobacterium avium
TPFPKACPAPGVMQGCLESTSGLIMGPDS

SEQ ID NO: 85227 - protein, 22 aa, Mycobacterium avium
TPFRRDRRWGGDNTDAYYFICP

SEQ ID NO: 85228 - protein, 23 aa, Mycobacterium avium
TPGADRLRAFLGPDAAALIDQQM

SEQ ID NO: 85229 - protein, 24 aa, Mycobacterium avium
TPGCVIGGTAWDFANANRIPPGSL

SEQ ID NO: 85230 - protein, 18 aa, Mycobacterium avium
TPGDLLFHIRAESLDVCF

SEQ ID NO: 85231 - protein, 21 aa, Mycobacterium avium
TPGHPEFRHTKGVEITTGPLG

SEQ ID NO: 85232 - protein, 18 aa, Mycobacterium avium
TPGPRAQFLAALSAQMRP

SEQ ID NO: 85233 - protein, 20 aa, Mycobacterium avium
TPHAGEFARLAGSPPGDDRV

SEQ ID NO: 85234 - protein, 28 aa, Mycobacterium avium
TPITDGRWSCVRWGTLTPPFYPEAAEIP

SEQ ID NO: 85235 - protein, 22 aa, Mycobacterium avium
TPLGRPILCTEYMARPRGSTVE

SEQ ID NO: 85236 - protein, 24 aa, Mycobacterium avium
TPLRHRFTPEIRAHQLRREIVATM

SEQ ID NO: 85237 - protein, 23 aa, Mycobacterium avium
TPNPLRWDCFTFGLVQHPDHFTF

SEQ ID NO: 85238 - protein, 25 aa, Mycobacterium avium
TPPGKRLGFSAVRCTVSLAGDADEA

SEQ ID NO: 85239 - protein, 26 aa, Mycobacterium avium
TPQAARRVRRVWANIRTEVLGGQYLD

SEQ ID NO: 85240 - protein, 27 aa, Mycobacterium avium
TPQRVGWFRFYFEGERWVWSDQVQRMH

SEQ ID NO: 85241 - protein, 23 aa, Mycobacterium avium
TPRSRRVLLHGWEEFDEPVDRIV

SEQ ID NO: 85242 - protein, 23 aa, Mycobacterium avium
TPRVIPVGYFWTGAEFVIATAAT

SEQ ID NO: 85243 - protein, 18 aa, Mycobacterium avium
TPSGYRLDGVKSLVPAAA

SEQ ID NO: 85244 - protein, 25 aa, Mycobacterium avium
TPSRREFQRTPGLNGPAVSRAWNHY

SEQ ID NO: 85245 - protein, 25 aa, Mycobacterium avium
TPVPEYRFPGLLPGDRWCVTALNWL

SEQ ID NO: 85246 - protein, 24 aa, Mycobacterium avium
TPWNFPMPIASWGIAPALAAGNAV

SEQ ID NO: 85247 - protein, 19 aa, Mycobacterium avium
TPYSRMWGAYLTGMWLYRL

SEQ ID NO: 85248 - protein, 25 aa, Mycobacterium avium
TQALERLETLLALIEGWVQVVVAAA

SEQ ID NO: 85249 - protein, 18 aa, Mycobacterium avium
TQASSGWYHDPRTGDYRL

SEQ ID NO: 85250 - protein, 20 aa, Mycobacterium avium
TQATAIRQDIDWMDYLDRPT

SEQ ID NO: 85251 - protein, 23 aa, Mycobacterium avium
TQGKVIPDLIAWWCDRDGVRPDK

SEQ ID NO: 85252 - protein, 19 aa, Mycobacterium avium
TQIKIAIEKIFSVKVASVN

SEQ ID NO: 85253 - protein, 33 aa, Mycobacterium avium
TQLEPVGVVGLIIPWNGPFFVAMLKVAPALAAG

SEQ ID NO: 85254 - protein, 24 aa, Mycobacterium avium
TQQCVAVLFAAMFGDAALRATGVF

SEQ ID NO: 85255 - protein, 20 aa, Mycobacterium avium
TQRIATRHARVFLDSVRPAL

SEQ ID NO: 85256 - protein, 27 aa, Mycobacterium avium
TQRVKANLFYRGLVFHRFPVIGDSLYT

SEQ ID NO: 85257 - protein, 17 aa, Mycobacterium avium
TQTAMGFSQDPDTPGLA

SEQ ID NO: 85258 - protein, 29 aa, Mycobacterium avium
TQTLAVEWGPKVRVNACVVGMVETEQSEL

SEQ ID NO: 85259 - protein, 24 aa, Mycobacterium avium
TRAPGCPFAPPPKVLQLNADKQLS

SEQ ID NO: 85260 - protein, 19 aa, Mycobacterium avium
TRARERWEALRALAELVDD

SEQ ID NO: 85261 - protein, 22 aa, Mycobacterium avium
TRARTRTGASIVAIVRDDEVLA

SEQ ID NO: 85262 - protein, 19 aa, Mycobacterium avium
TRAYADWSAEINAGYRGQL

SEQ ID NO: 85263 - protein, 20 aa, Mycobacterium avium
TRDALLASLRRGLSSRQAAA

SEQ ID NO: 85264 - protein, 23 aa, Mycobacterium avium
TRDEIIRMVDLMITRVAGQLKSK

SEQ ID NO: 85265 - protein, 25 aa, Mycobacterium avium
TRDQRWKRFNLFNLVWNTLLALLFE

SEQ ID NO: 85266 - protein, 22 aa, Mycobacterium avium
TRDSSIWIGPRVVIPTLALRAR

SEQ ID NO: 85267 - protein, 21 aa, Mycobacterium avium
TRELVWPAMRISHCRPPGSDR

SEQ ID NO: 85268 - protein, 22 aa, Mycobacterium avium
TREQLSFLFGGVIYDLGGTLLG

SEQ ID NO: 85269 - protein, 30 aa, Mycobacterium avium
TRFRRMLSKPFTFKRVEALRPAVQKITDDH

SEQ ID NO: 85270 - protein, 20 aa, Mycobacterium avium
TRGAIDFNRPGIPIVASLPS

SEQ ID NO: 85271 - protein, 21 aa, Mycobacterium avium
TRGLGIWDWASTARSIGAEPD

SEQ ID NO: 85272 - protein, 18 aa, Mycobacterium avium
TRGPWQLMPDTFAAFHQP

SEQ ID NO: 85273 - protein, 20 aa, Mycobacterium avium
TRHNVGFMVADLLAARMGSK

SEQ ID NO: 85274 - protein, 23 aa, Mycobacterium avium
TRKLQVVSWHVMFMSRGKVGPFR

SEQ ID NO: 85275 - protein, 17 aa, Mycobacterium avium
TRKSRRLRTDLVGGDQA

SEQ ID NO: 85276 - protein, 22 aa, Mycobacterium avium
TRLRELAKMDGAVVLSTDGSRI

SEQ ID NO: 85277 - protein, 17 aa, Mycobacterium avium
TRPEVRGGLGGFAGLFA

SEQ ID NO: 85278 - protein, 23 aa, Mycobacterium avium
TRPFGPMCVLVRATGDIYLNSTD

SEQ ID NO: 85279 - protein, 19 aa, Mycobacterium avium
TRPHPLFVAFVGAAMDYKA

SEQ ID NO: 85280 - protein, 20 aa, Mycobacterium avium
TRPREYARVLSPLHRLIRDI

SEQ ID NO: 85281 - protein, 20 aa, Mycobacterium avium
TRPSALVAIAALSRLGAIAV

SEQ ID NO: 85282 - protein, 21 aa, Mycobacterium avium
TRPTNLGGLGFSMKWNMGWMH

SEQ ID NO: 85283 - protein, 23 aa, Mycobacterium avium
TRPYRLWWPRGTTVYEIDRPRVL

SEQ ID NO: 85284 - protein, 20 aa, Mycobacterium avium
TRQPFKSVIADAGISVSDID

SEQ ID NO: 85285 - protein, 24 aa, Mycobacterium avium
TRQSRKGLISSWKAYAPAWAGKVA

SEQ ID NO: 85286 - protein, 22 aa, Mycobacterium avium
TRRGRPTTHVRFASLHRDRQWQ

SEQ ID NO: 85287 - protein, 20 aa, Mycobacterium avium
TRRPGVCLTTSGPGFLNALP

SEQ ID NO: 85288 - protein, 28 aa, Mycobacterium avium
TRRWAVEHPACWALLYGSPVPGYHAPPE

SEQ ID NO: 85289 - protein, 19 aa, Mycobacterium avium
TRSGAALPRSADTVADIAS

SEQ ID NO: 85290 - protein, 20 aa, Mycobacterium avium
TRSLSDFGFANVDRNPSPES

SEQ ID NO: 85291 - protein, 22 aa, Mycobacterium avium
TRTAFFDEFFLAAADAGVRQVV

SEQ ID NO: 85292 - protein, 19 aa, Mycobacterium avium
TRTLAEWTERFATLAGPWA

SEQ ID NO: 85293 - protein, 18 aa, Mycobacterium avium
TRVGERLTDLPLTLFSDP

SEQ ID NO: 85294 - protein, 17 aa, Mycobacterium avium
TRVPAPVLAAVAHGELL

SEQ ID NO: 85295 - protein, 17 aa, Mycobacterium avium
TRVWPLLERNKAALADI

SEQ ID NO: 85296 - protein, 25 aa, Mycobacterium avium
TRWHPVNCLPPMAFDHGQMVDNARA

SEQ ID NO: 85297 - protein, 18 aa, Mycobacterium avium
TSALRLGLRMLAQGTPAW

SEQ ID NO: 85298 - protein, 29 aa, Mycobacterium avium
TSARIERFLQLWAEGSMTIAMPSTPSNYF

SEQ ID NO: 85299 - protein, 28 aa, Mycobacterium avium
TSCDAFEHFPPPVLRPVILAAKSKATFR

SEQ ID NO: 85300 - protein, 30 aa, Mycobacterium avium
TSGGRGIHVFLRIATDWDFVEVRRAGIALA

SEQ ID NO: 85301 - protein, 20 aa, Mycobacterium avium
TSGGVWGRERGYCLMIGGDE

SEQ ID NO: 85302 - protein, 28 aa, Mycobacterium avium
TSGYLCVPLDGAICDRLGLLPMYAVNQD

SEQ ID NO: 85303 - protein, 17 aa, Mycobacterium avium
TSHLELRGPDGARDKVL

SEQ ID NO: 85304 - protein, 18 aa, Mycobacterium avium
TSIASRFTSPVFPGETLT

SEQ ID NO: 85305 - protein, 24 aa, Mycobacterium avium
TSIQAPRLRGWGGRLATVLPAGGR

SEQ ID NO: 85306 - protein, 19 aa, Mycobacterium avium
TSKERRPVYEAALAAQETL

SEQ ID NO: 85307 - protein, 18 aa, Mycobacterium avium
TSLAARPVVVCSAAVAHP

SEQ ID NO: 85308 - protein, 19 aa, Mycobacterium avium
TSLNEVICHGIPDSTVIED

SEQ ID NO: 85309 - protein, 21 aa, Mycobacterium avium
TSLRSAEIVQRLRRFELDAGV

SEQ ID NO: 85310 - protein, 18 aa, Mycobacterium avium
TSPANWDAIMGVNVRGVI

SEQ ID NO: 85311 - protein, 22 aa, Mycobacterium avium
TSPGTRTPVFVRFSTVAGSRGS

SEQ ID NO: 85312 - protein, 32 aa, Mycobacterium avium
TSPWPEDYELLGVPFARRGKRMDECIEIIQGL

SEQ ID NO: 85313 - protein, 19 aa, Mycobacterium avium
TSRSLALKAIRGALDDAGL

SEQ ID NO: 85314 - protein, 27 aa, Mycobacterium avium
TSSEGFPADMPFLIWGYGATRAGSPGI

SEQ ID NO: 85315 - protein, 25 aa, Mycobacterium avium
TSSFYRPTQQGAYPIVLATYEIVCS

SEQ ID NO: 85316 - protein, 23 aa, Mycobacterium avium
TSVLSRGVCGVAGQTLIVNLPGS

SEQ ID NO: 85317 - protein, 19 aa, Mycobacterium avium
TSYLLPKIVGAGVARELML

SEQ ID NO: 85318 - protein, 22 aa, Mycobacterium avium
TSYSDVADWCLLLARTDPQAKR

SEQ ID NO: 85319 - protein, 26 aa, Mycobacterium avium
TTAARYVWEVPYYPQYYIPLADVRTE

SEQ ID NO: 85320 - protein, 21 aa, Mycobacterium avium
TTAEGFSWTPVHTMAGPDTSA

SEQ ID NO: 85321 - protein, 18 aa, Mycobacterium avium
TTEEVLSALGVVVNKGNV

SEQ ID NO: 85322 - protein, 17 aa, Mycobacterium avium
TTFALRVAAELLGQRAV

SEQ ID NO: 85323 - protein, 17 aa, Mycobacterium avium
TTGLGRERARAEAAKAP

SEQ ID NO: 85324 - protein, 25 aa, Mycobacterium avium
TTLDRARFDLGWNRFGMIGRTATAA

SEQ ID NO: 85325 - protein, 18 aa, Mycobacterium avium
TTLLPGLMDMELNLLIGG

SEQ ID NO: 85326 - protein, 41 aa, Mycobacterium avium
TTNPPVEGAFYWLNNREVRWRPEHFWKSGTVIDVAVNTYGV

SEQ ID NO: 85327 - protein, 20 aa, Mycobacterium avium
TTPALLWIHGGGYVLGTAQQ

SEQ ID NO: 85328 - protein, 21 aa, Mycobacterium avium
TTSVFRADFLNELDAPAQAGT

SEQ ID NO: 85329 - protein, 19 aa, Mycobacterium avium
TTVSVPIDYNNPGAGQAKL

SEQ ID NO: 85330 - protein, 23 aa, Mycobacterium avium
TVAACPNSRIVLGGYSQGSTVID

SEQ ID NO: 85331 - protein, 25 aa, Mycobacterium avium
TVAAGRWPAVRFAVRNTAVQGPNAV

SEQ ID NO: 85332 - protein, 22 aa, Mycobacterium avium
TVADIYRHFGLTLTEEAKAAMA

SEQ ID NO: 85333 - protein, 20 aa, Mycobacterium avium
TVAEAGWKLDDVLPQGTRLR

SEQ ID NO: 85334 - protein, 18 aa, Mycobacterium avium
TVARKFWDSWSPGAVIAD

SEQ ID NO: 85335 - protein, 23 aa, Mycobacterium avium
TVARQRIAVIRAIRNALERRGFL

SEQ ID NO: 85336 - protein, 24 aa, Mycobacterium avium
TVAVLLRITEVFGVDATFFSSQDD

SEQ ID NO: 85337 - protein, 25 aa, Mycobacterium avium
TVCILDRPRHAKLIDEVRETGARIR

SEQ ID NO: 85338 - protein, 18 aa, Mycobacterium avium
TVDLLRPALLAPVQIRTS

SEQ ID NO: 85339 - protein, 24 aa, Mycobacterium avium
TVDLVMPVPGFLIKKGSKSLMDTA

SEQ ID NO: 85340 - protein, 25 aa, Mycobacterium avium
TVEGRPKHYWSIYQKMIVKGRDFDD

SEQ ID NO: 85341 - protein, 25 aa, Mycobacterium avium
TVEHYLRVPFVLTKCAVPHMRKQGA

SEQ ID NO: 85342 - protein, 19 aa, Mycobacterium avium
TVEIVKWAKQQGISITAEV

SEQ ID NO: 85343 - protein, 18 aa, Mycobacterium avium
TVEVTFGGFAARVRGGDV

SEQ ID NO: 85344 - protein, 17 aa, Mycobacterium avium
TVEYLVDAVFNYPTFSE

SEQ ID NO: 85345 - protein, 23 aa, Mycobacterium avium
TVFYCVANMPSAVPKTSTVALTN

SEQ ID NO: 85346 - protein, 21 aa, Mycobacterium avium
TVGACGICGTDAHFVNGAFPG

SEQ ID NO: 85347 - protein, 23 aa, Mycobacterium avium
TVGECARCLTALDGEVRVRLTEL

SEQ ID NO: 85348 - protein, 17 aa, Mycobacterium avium
TVKAAADYGDWANAAHS

SEQ ID NO: 85349 - protein, 26 aa, Mycobacterium avium
TVKTFKRAGGQVWLMPHNPAFDPIPG

SEQ ID NO: 85350 - protein, 19 aa, Mycobacterium avium
TVLMTGFGFAPPVMTPTWG

SEQ ID NO: 85351 - protein, 24 aa, Mycobacterium avium
TVNGIKLAINYGLNKVRFPAPVPV

SEQ ID NO: 85352 - protein, 19 aa, Mycobacterium avium
TVNVCKYNLGWGAVGMCTH

SEQ ID NO: 85353 - protein, 35 aa, Mycobacterium avium
TVPDAVAFGKRWVTECLRASYPLGHGHGPVSALFR

SEQ ID NO: 85354 - protein, 24 aa, Mycobacterium avium
TVRFALGTQTGWAVPLGAFSRAVS

SEQ ID NO: 85355 - protein, 17 aa, Mycobacterium avium
TVRGFCAEHVLPHVAEW

SEQ ID NO: 85356 - protein, 23 aa, Mycobacterium avium
TVRGVCRRAGLAARYFYESFTDK

SEQ ID NO: 85357 - protein, 27 aa, Mycobacterium avium
TVRSYNCLKREGVHTVGELVSRTESDL

SEQ ID NO: 85358 - protein, 23 aa, Mycobacterium avium
TVSLRDPYPFFARKRREAGVFAG

SEQ ID NO: 85359 - protein, 24 aa, Mycobacterium avium
TVSPQLYIALGISGAIQHRAGMQT

SEQ ID NO: 85360 - protein, 23 aa, Mycobacterium avium
TVTAWCARIDVLATDMRVEQRSL

SEQ ID NO: 85361 - protein, 19 aa, Mycobacterium avium
TVTELGLRHALLEVEQFAG

SEQ ID NO: 85362 - protein, 32 aa, Mycobacterium avium
TVTESRMAIAMARAGGMGVLHRNLPVAEQAGQ

SEQ ID NO: 85363 - protein, 17 aa, Mycobacterium avium
TVVDAVGLLPVAGISPV

SEQ ID NO: 85364 - protein, 20 aa, Mycobacterium avium
TVVGCARSPLDTIPGIEPDW

SEQ ID NO: 85365 - protein, 28 aa, Mycobacterium avium
TVVGDCVQCPFHGWRWGPDGTNRYIPYQ

SEQ ID NO: 85366 - protein, 18 aa, Mycobacterium avium
TVVLPCLNEEESLPGVLA

SEQ ID NO: 85367 - protein, 18 aa, Mycobacterium avium
TVVPLLPAQDFKRVGDAD

SEQ ID NO: 85368 - protein, 24 aa, Mycobacterium avium
TVYATHIALAWSMMRRQDQFRSAL

SEQ ID NO: 85369 - protein, 22 aa, Mycobacterium avium
TWFKHAVFYEVLVRAFFDANAD

SEQ ID NO: 85370 - protein, 23 aa, Mycobacterium avium
TWNGTRLAAAIMRENKRGAIINM

SEQ ID NO: 85371 - protein, 25 aa, Mycobacterium avium
TWQELADAIGRPLLWTTSALLGQHP

SEQ ID NO: 85372 - protein, 19 aa, Mycobacterium avium
TWTGAGGVKGFFEKTFAPL

SEQ ID NO: 85373 - protein, 23 aa, Mycobacterium avium
TYAFDRRRFWLSGDGAASDAAGL

SEQ ID NO: 85374 - protein, 24 aa, Mycobacterium avium
TYAFDRRRFWLSGEGAAADASGLG

SEQ ID NO: 85375 - protein, 30 aa, Mycobacterium avium
TYEHPYPHCWRCRNPLIYRAVSSWFVAVTR

SEQ ID NO: 85376 - protein, 17 aa, Mycobacterium avium
TYFFSDPAARDFVTGVA

SEQ ID NO: 85377 - protein, 25 aa, Mycobacterium avium
TYGIDFIEACAWIKENLPGVHLSGG

SEQ ID NO: 85378 - protein, 17 aa, Mycobacterium avium
TYGRPGLVVSPQYDSLL

SEQ ID NO: 85379 - protein, 18 aa, Mycobacterium avium
TYIRSCVDAGDVVAAMEA

SEQ ID NO: 85380 - protein, 23 aa, Mycobacterium avium
TYPSMEWYGFVLAWHERHGRAPY

SEQ ID NO: 85381 - protein, 20 aa, Mycobacterium avium
TYRITPLALWNARAAGHDAE

SEQ ID NO: 85382 - protein, 21 aa, Mycobacterium avium
TYVFDHIRLGAAVPTPPVLIV

SEQ ID NO: 85383 - protein, 23 aa, Mycobacterium avium
VAAARAGARVQFVGAVGDDAAAG

SEQ ID NO: 85384 - protein, 23 aa, Mycobacterium avium
VAADVWSVTSWGELNRDGVAIDR

SEQ ID NO: 85385 - protein, 25 aa, Mycobacterium avium
VAAEAVCTWVARHFQIPLTIIRICS

SEQ ID NO: 85386 - protein, 22 aa, Mycobacterium avium
VAAEVARLALFLTSPAARHITG

SEQ ID NO: 85387 - protein, 17 aa, Mycobacterium avium
VAAFPGAGYCEMALAAA

SEQ ID NO: 85388 - protein, 20 aa, Mycobacterium avium
VAAGLGLGGCEAYPGVFAPF

SEQ ID NO: 85389 - protein, 17 aa, Mycobacterium avium
VAALEGWMDANRYARLP

SEQ ID NO: 85390 - protein, 24 aa, Mycobacterium avium
VAALKEAGWWRLGMAEEIGGMPAP

SEQ ID NO: 85391 - protein, 25 aa, Mycobacterium avium
VAALPRPLRRLPLLGDRIAELLDAE

SEQ ID NO: 85392 - protein, 26 aa, Mycobacterium avium
VAALQRSDLLIALGTRFDDRVTGKLD

SEQ ID NO: 85393 - protein, 34 aa, Mycobacterium avium
VAALYACARIGVIAVPVSPPLPMSFESGLAKLGF

SEQ ID NO: 85394 - protein, 19 aa, Mycobacterium avium
VAAMYADLFDEWDLPVPAL

SEQ ID NO: 85395 - protein, 25 aa, Mycobacterium avium
VAAQSWPLERINAVKAATGATVNDV

SEQ ID NO: 85396 - protein, 19 aa, Mycobacterium avium
VAARCGYDLVDVTFSGATT

SEQ ID NO: 85397 - protein, 17 aa, Mycobacterium avium
VAARTDIALGMFNSPSS

SEQ ID NO: 85398 - protein, 17 aa, Mycobacterium avium
VAAWPALCSGLRAEARQ

SEQ ID NO: 85399 - protein, 21 aa, Mycobacterium avium
VAAYGARFAGVAFPGETLKVG

SEQ ID NO: 85400 - protein, 17 aa, Mycobacterium avium
VAAYLPYRSKPRSPEGL

SEQ ID NO: 85401 - protein, 17 aa, Mycobacterium avium
VACGGRFTLGIGPSHHW

SEQ ID NO: 85402 - protein, 18 aa, Mycobacterium avium
VACPFGESGTRMYRTGDL

SEQ ID NO: 85403 - protein, 17 aa, Mycobacterium avium
VACTGAYHHSMASNYNM

SEQ ID NO: 85404 - protein, 24 aa, Mycobacterium avium
VADDLPRLVAMLYSVLSTMDAGSE

SEQ ID NO: 85405 - protein, 17 aa, Mycobacterium avium
VADEWFETVAIAQQRAK

SEQ ID NO: 85406 - protein, 22 aa, Mycobacterium avium
VADFGFDACIDYKNDDVAAALK

SEQ ID NO: 85407 - protein, 17 aa, Mycobacterium avium
VADLSLADYGRRDIELS

SEQ ID NO: 85408 - protein, 17 aa, Mycobacterium avium
VADRASWRRWWPDLRLQ

SEQ ID NO: 85409 - protein, 18 aa, Mycobacterium avium
VADVVAWLAGDGSGTLTG

SEQ ID NO: 85410 - protein, 18 aa, Mycobacterium avium
VAEAFPATPVPGVAAKDI

SEQ ID NO: 85411 - protein, 27 aa, Mycobacterium avium
VAECRRLRPDFAVGLQPARWGTGFILG

SEQ ID NO: 85412 - protein, 23 aa, Mycobacterium avium
VAEGLPALPPGAAGELNIVVDPA

SEQ ID NO: 85413 - protein, 27 aa, Mycobacterium avium
VAEISARLDLPLGVARVLVGDLVLSGY

SEQ ID NO: 85414 - protein, 23 aa, Mycobacterium avium
VAEPGALIGFLGPRVYQQLYGEP

SEQ ID NO: 85415 - protein, 32 aa, Mycobacterium avium
VAERGADAALEFGASFDGVRPAAVRVPEAALD

SEQ ID NO: 85416 - protein, 26 aa, Mycobacterium avium
VAETLGEHVFDFFLRNKRTEWATYRS

SEQ ID NO: 85417 - protein, 17 aa, Mycobacterium avium
VAEVIGFVASRPAHVNL

SEQ ID NO: 85418 - protein, 21 aa, Mycobacterium avium
VAEVRAELLASVDAAVAAGVD

SEQ ID NO: 85419 - protein, 30 aa, Mycobacterium avium
VAFSIPRDDWVPFSGVPGYNHIKIKEAYGL

SEQ ID NO: 85420 - protein, 25 aa, Mycobacterium avium
VAFSPRPVPTVSVGHLHEVKVSVPE

SEQ ID NO: 85421 - protein, 45 aa, Mycobacterium avium
VAFTAAKPSLAWAETYPGTLSYYLASAFGEIWMQPGGSVGLIGFA

SEQ ID NO: 85422 - protein, 24 aa, Mycobacterium avium
VAGALLRKDVRLVVDLAEQAGAAG

SEQ ID NO: 85423 - protein, 18 aa, Mycobacterium avium
VAGAVSFLASEDASYIAG

SEQ ID NO: 85424 - protein, 24 aa, Mycobacterium avium
VAGCGSCAGCATRDPVLCHSGFQI

SEQ ID NO: 85425 - protein, 23 aa, Mycobacterium avium
VAGEESYVLLVRVESARALEDLL

SEQ ID NO: 85426 - protein, 17 aa, Mycobacterium avium
VAGEPITTWAPRSTGAI

SEQ ID NO: 85427 - protein, 35 aa, Mycobacterium avium
VAGGARFVVATGRPPRWIRPVVDALGFAPIAVCAN

SEQ ID NO: 85428 - protein, 25 aa, Mycobacterium avium
VAGGFTLDGLGGWFVDGIDGDPSNV

SEQ ID NO: 85429 - protein, 25 aa, Mycobacterium avium
VAGHDRFRFYLNVEVGKHLSHADLL

SEQ ID NO: 85430 - protein, 23 aa, Mycobacterium avium
VAGLIRARPPVAVPLAQAQGLVL

SEQ ID NO: 85431 - protein, 20 aa, Mycobacterium avium
VAGRRMAETVARRGGLVILP

SEQ ID NO: 85432 - protein, 17 aa, Mycobacterium avium
VAGVRGREDSFYDFATK

SEQ ID NO: 85433 - protein, 28 aa, Mycobacterium avium
VAHALWACLELRLLEALDMTGQRISNAI

SEQ ID NO: 85434 - protein, 23 aa, Mycobacterium avium
VAHDWGGPVAFIMMLRHPEKVTG

SEQ ID NO: 85435 - protein, 17 aa, Mycobacterium avium
VAHLCVIHGAHVGPEAL

SEQ ID NO: 85436 - protein, 26 aa, Mycobacterium avium
VAIFRARPSPFYIMDEVEAALDDTNL

SEQ ID NO: 85437 - protein, 21 aa, Mycobacterium avium
VAITDSWRALADVLLSSAVPA

SEQ ID NO: 85438 - protein, 17 aa, Mycobacterium avium
VAKGEFEVEGFPIHEGD

SEQ ID NO: 85439 - protein, 24 aa, Mycobacterium avium
VALDRLGFDEAWFGEHHSGGYELI

SEQ ID NO: 85440 - protein, 28 aa, Mycobacterium avium
VALFSGTCPEWVYFWLGAARIGAVSAAI

SEQ ID NO: 85441 - protein, 17 aa, Mycobacterium avium
VALGGFGWQIALRLPGV

SEQ ID NO: 85442 - protein, 18 aa, Mycobacterium avium
VALIDGTWVAFPTVEQLE

SEQ ID NO: 85443 - protein, 17 aa, Mycobacterium avium
VALLRRRLGSAGLDGVR

SEQ ID NO: 85444 - protein, 17 aa, Mycobacterium avium
VALPDMVAANWGRIVMI

SEQ ID NO: 85445 - protein, 20 aa, Mycobacterium avium
VALQKYHWVEKINHVHTGGN

SEQ ID NO: 85446 - protein, 27 aa, Mycobacterium avium
VALRGELIGAPVLDADLLRRAKHHGLS

SEQ ID NO: 85447 - protein, 24 aa, Mycobacterium avium
VALSGADHAWSFVFLASDRSRGIT

SEQ ID NO: 85448 - protein, 19 aa, Mycobacterium avium
VALSSRIAHELGEASEAAI

SEQ ID NO: 85449 - protein, 20 aa, Mycobacterium avium
VALTELFKRIRGYEVDEANA

SEQ ID NO: 85450 - protein, 17 aa, Mycobacterium avium
VALTGHGGWPMTCFLTP

SEQ ID NO: 85451 - protein, 23 aa, Mycobacterium avium
VAMPQAAVDWAIRDTMPKWAKQM

SEQ ID NO: 85452 - protein, 18 aa, Mycobacterium avium
VAMVVDMHGRRSRDIVDK

SEQ ID NO: 85453 - protein, 20 aa, Mycobacterium avium
VANAVAWLVSDQARYITGVT

SEQ ID NO: 85454 - protein, 21 aa, Mycobacterium avium
VANCLVALALLDAVGVSPEQA

SEQ ID NO: 85455 - protein, 34 aa, Mycobacterium avium
VANLPITLWPGMKIGQLCILRLTSPAEHPYGSTR

SEQ ID NO: 85456 - protein, 17 aa, Mycobacterium avium
VANPALYLYAAISPEGD

SEQ ID NO: 85457 - protein, 20 aa, Mycobacterium avium
VANRLCAQILLLAAEDPTKD

SEQ ID NO: 85458 - protein, 18 aa, Mycobacterium avium
VAPDALFALMCGDLSAPV

SEQ ID NO: 85459 - protein, 29 aa, Mycobacterium avium
VAPMSAALCKRLLWDSAINRYPPRQVAAL

SEQ ID NO: 85460 - protein, 18 aa, Mycobacterium avium
VAQACAFINYAMGRYGVA

SEQ ID NO: 85461 - protein, 26 aa, Mycobacterium avium
VAQMGKDGWLTLNWPKEYGGQDRSPM

SEQ ID NO: 85462 - protein, 23 aa, Mycobacterium avium
VAQRLLTRNGWRNTTLAQIAGEA

SEQ ID NO: 85463 - protein, 21 aa, Mycobacterium avium
VAQRRLPLLIASGADVHVISR

SEQ ID NO: 85464 - protein, 17 aa, Mycobacterium avium
VAQRYSLGMTEQLLTEA

SEQ ID NO: 85465 - protein, 25 aa, Mycobacterium avium
VAQTVARWLVLYLRRPGGQTQFAAP

SEQ ID NO: 85466 - protein, 18 aa, Mycobacterium avium
VARIKFPTPAACGRTPLT

SEQ ID NO: 85467 - protein, 17 aa, Mycobacterium avium
VARPDLLALGALLHDIG

SEQ ID NO: 85468 - protein, 24 aa, Mycobacterium avium
VARRARVSMATIYKRYRTRDELIV

SEQ ID NO: 85469 - protein, 18 aa, Mycobacterium avium
VASPLYWAALATFTVDGA

SEQ ID NO: 85470 - protein, 18 aa, Mycobacterium avium
VASRAGQLQSIFDDTSNR

SEQ ID NO: 85471 - protein, 17 aa, Mycobacterium avium
VASRCDAFAVGDVVTTL

SEQ ID NO: 85472 - protein, 23 aa, Mycobacterium avium
VATKLFAARGYHGTRMDDVADVI

SEQ ID NO: 85473 - protein, 17 aa, Mycobacterium avium
VATQMLCIFIGGTETVP

SEQ ID NO: 85474 - protein, 23 aa, Mycobacterium avium
VATRRRCVVRPATALNRMTRYRG

SEQ ID NO: 85475 - protein, 25 aa, Mycobacterium avium
VATTCGRPFADFELRIDDSGEVLLR

SEQ ID NO: 85476 - protein, 21 aa, Mycobacterium avium
VAVGARGAWLTLIRDGAEVRA

SEQ ID NO: 85477 - protein, 18 aa, Mycobacterium avium
VAVGPPIELVLDVVAEGR

SEQ ID NO: 85478 - protein, 19 aa, Mycobacterium avium
VAVGPRPDKVLHITALVER

SEQ ID NO: 85479 - protein, 26 aa, Mycobacterium avium
VAVIRRFFDQLPCWVDAPTRDAAEAD

SEQ ID NO: 85480 - protein, 17 aa, Mycobacterium avium
VAVSRLLGAGWAAAPGA

SEQ ID NO: 85481 - protein, 18 aa, Mycobacterium avium
VAVTNCLNFGSPEDPAVM

SEQ ID NO: 85482 - protein, 17 aa, Mycobacterium avium
VAVYPADDPAGFGPALQ

SEQ ID NO: 85483 - protein, 21 aa, Mycobacterium avium
VAYALAGTMDFDFEKQPLGKD

SEQ ID NO: 85484 - protein, 18 aa, Mycobacterium avium
VAYGYPGAPGQWWQQQVV

SEQ ID NO: 85485 - protein, 17 aa, Mycobacterium avium
VCELTWQLRGQATGRQV

SEQ ID NO: 85486 - protein, 19 aa, Mycobacterium avium
VCEPFLVRAGMVARTPRGR

SEQ ID NO: 85487 - protein, 26 aa, Mycobacterium avium
VCIDDAWRGALPPARGVRIVERHGFD

SEQ ID NO: 85488 - protein, 23 aa, Mycobacterium avium
VCRACPRLVEWREEVAVVKRRAF

SEQ ID NO: 85489 - protein, 33 aa, Mycobacterium avium
VDADEALRMGLVWRVCAPDELLPQARHHAEILA

SEQ ID NO: 85490 - protein, 17 aa, Mycobacterium avium
VDADPLAARGCELVLVL

SEQ ID NO: 85491 - protein, 17 aa, Mycobacterium avium
VDAIVKWIADRENSVPS

SEQ ID NO: 85492 - protein, 26 aa, Mycobacterium avium
VDALCARFRISGLPVVDDSGALVGII

SEQ ID NO: 85493 - protein, 26 aa, Mycobacterium avium
VDAQGRLRVGAAIGINGDVGAKARSL

SEQ ID NO: 85494 - protein, 20 aa, Mycobacterium avium
VDARTIVTLSGFAPPTLHAM

SEQ ID NO: 85495 - protein, 25 aa, Mycobacterium avium
VDASLRLVAPGGIFLEMGKTDIRDP

SEQ ID NO: 85496 - protein, 17 aa, Mycobacterium avium
VDCNFDDVMLPGTCAEE

SEQ ID NO: 85497 - protein, 18 aa, Mycobacterium avium
VDCPHFEYALAAYYLILP

SEQ ID NO: 85498 - protein, 25 aa, Mycobacterium avium
VDDAARLTVVWLADWADDAVHVSMH

SEQ ID NO: 85499 - protein, 17 aa, Mycobacterium avium
VDDPAFVLHGNHPVRLF

SEQ ID NO: 85500 - protein, 25 aa, Mycobacterium avium
VDDPTRLPPGWHIEQSEVAPWFHQP

SEQ ID NO: 85501 - protein, 23 aa, Mycobacterium avium
VDEDAARQCVQLTLERFGSVDIL

SEQ ID NO: 85502 - protein, 19 aa, Mycobacterium avium
VDEFGRLDSWVAIAVATDD

SEQ ID NO: 85503 - protein, 22 aa, Mycobacterium avium
VDEGAVCTAMLDLYQNEGIIAE

SEQ ID NO: 85504 - protein, 17 aa, Mycobacterium avium
VDEPICMIVPQRRAELE

SEQ ID NO: 85505 - protein, 30 aa, Mycobacterium avium
VDESRLTFLAVRRWYGWSAGRIINLDIGGG

SEQ ID NO: 85506 - protein, 17 aa, Mycobacterium avium
VDFAVEGDIPWTNPHCA

SEQ ID NO: 85507 - protein, 20 aa, Mycobacterium avium
VDGDAQWAAEVRRLAKLRGA

SEQ ID NO: 85508 - protein, 21 aa, Mycobacterium avium
VDGPLRLTFQQVVERIRCAAG

SEQ ID NO: 85509 - protein, 17 aa, Mycobacterium avium
VDGTSWITGADEPGRHV

SEQ ID NO: 85510 - protein, 23 aa, Mycobacterium avium
VDGVSLLAQMMWTMKSTGALRDR

SEQ ID NO: 85511 - protein, 23 aa, Mycobacterium avium
VDHPRLGWRQAPVGQVLADALGL

SEQ ID NO: 85512 - protein, 26 aa, Mycobacterium avium
VDILHDLYRRWPFFRSVLSNLAQVLA

SEQ ID NO: 85513 - protein, 18 aa, Mycobacterium avium
VDLAMPMIGLLKRKAERR

SEQ ID NO: 85514 - protein, 24 aa, Mycobacterium avium
VDLDPMPGVSWRRIVDVALVAREV

SEQ ID NO: 85515 - protein, 18 aa, Mycobacterium avium
VDLLPALLNQALEELVEA

SEQ ID NO: 85516 - protein, 17 aa, Mycobacterium avium
VDLPVNVARKFKTVRRV

SEQ ID NO: 85517 - protein, 25 aa, Mycobacterium avium
VDLSRLAEDVILWSSTEFGYVKLHD

SEQ ID NO: 85518 - protein, 17 aa, Mycobacterium avium
VDLTAFWAGPSATHLLA

SEQ ID NO: 85519 - protein, 17 aa, Mycobacterium avium
VDMKAGKPLFDQLRTQV

SEQ ID NO: 85520 - protein, 25 aa, Mycobacterium avium
VDMPPDPAAMVVRWVADILSEHGNE

SEQ ID NO: 85521 - protein, 21 aa, Mycobacterium avium
VDMPPELLVRMFESIDNVAMV

SEQ ID NO: 85522 - protein, 18 aa, Mycobacterium avium
VDMRPRNVVVLGPGTIPK

SEQ ID NO: 85523 - protein, 19 aa, Mycobacterium avium
VDNRPELFAGVTEAIGEVG

SEQ ID NO: 85524 - protein, 26 aa, Mycobacterium avium
VDPASARGSLRLSLGHTSIDADVDAV

SEQ ID NO: 85525 - protein, 24 aa, Mycobacterium avium
VDPDRPLPEYGLDSLGGLELLTRI

SEQ ID NO: 85526 - protein, 17 aa, Mycobacterium avium
VDPIRVLLIGGHSYLEA

SEQ ID NO: 85527 - protein, 26 aa, Mycobacterium avium
VDPKAVPSRLAWEAGVALADSLLTRY

SEQ ID NO: 85528 - protein, 26 aa, Mycobacterium avium
VDPLLPEVAWSWLVEALESRMEHVVA

SEQ ID NO: 85529 - protein, 24 aa, Mycobacterium avium
VDPRRPAALPAERAAGLPVLVVGC

SEQ ID NO: 85530 - protein, 17 aa, Mycobacterium avium
VDPRVVDGTSWITGADE

SEQ ID NO: 85531 - protein, 23 aa, Mycobacterium avium
VDPVVGMAFALARTHRLKVGTSV

SEQ ID NO: 85532 - protein, 29 aa, Mycobacterium avium
VDQDRCRGWRMCVSGCPYKKVYFNHKTGK

SEQ ID NO: 85533 - protein, 22 aa, Mycobacterium avium
VDRDEVLLDIGYKTEGVIPARE

SEQ ID NO: 85534 - protein, 17 aa, Mycobacterium avium
VDRGWDVEGLYDPDPDA

SEQ ID NO: 85535 - protein, 23 aa, Mycobacterium avium
VDRIVSIEAFEHFGHENYDDFFK

SEQ ID NO: 85536 - protein, 26 aa, Mycobacterium avium
VDRKIWSGEATFLFTRTTVGEIGILP

SEQ ID NO: 85537 - protein, 18 aa, Mycobacterium avium
VDRLGCLGDGAAVRPLEV

SEQ ID NO: 85538 - protein, 24 aa, Mycobacterium avium
VDRRPDLPSGKGLVIAEGVLVVQR

SEQ ID NO: 85539 - protein, 18 aa, Mycobacterium avium
VDRVVKLGFEVRVELTSA

SEQ ID NO: 85540 - protein, 24 aa, Mycobacterium avium
VDSAAFFDRFIERVGPFARRVGGG

SEQ ID NO: 85541 - protein, 28 aa, Mycobacterium avium
VDSARLMIDPGLGFAKTGQHNWALLHAL

SEQ ID NO: 85542 - protein, 20 aa, Mycobacterium avium
VDTKAGYAFERIPKAEVEDL

SEQ ID NO: 85543 - protein, 26 aa, Mycobacterium avium
VDVANHFYCYSFEPNNDWTHFFAEQY

SEQ ID NO: 85544 - protein, 24 aa, Mycobacterium avium
VDVAPRVAQIFGVDAVPTVVALAA

SEQ ID NO: 85545 - protein, 24 aa, Mycobacterium avium
VDVLELYDPFSFEIIRQLEAFGFC

SEQ ID NO: 85546 - protein, 17 aa, Mycobacterium avium
VDVLRRLLDNASLASSL

SEQ ID NO: 85547 - protein, 17 aa, Mycobacterium avium
VDVPRLVSFHDLTVDEP

SEQ ID NO: 85548 - protein, 17 aa, Mycobacterium avium
VDVSIRSRAEWARRYHE

SEQ ID NO: 85549 - protein, 23 aa, Mycobacterium avium
VDVVRFAGGWIFDRSMAGWDVTV

SEQ ID NO: 85550 - protein, 17 aa, Mycobacterium avium
VDYQHSYSGVRMVDVEP

SEQ ID NO: 85551 - protein, 19 aa, Mycobacterium avium
VEAAFRYVVDNSAALNADA

SEQ ID NO: 85552 - protein, 19 aa, Mycobacterium avium
VEALMAMLAPDATWTADSG

SEQ ID NO: 85553 - protein, 18 aa, Mycobacterium avium
VEALRYRPNLVIATPPGY

SEQ ID NO: 85554 - protein, 20 aa, Mycobacterium avium
VEAYVGLDSFRHLAKERALM

SEQ ID NO: 85555 - protein, 17 aa, Mycobacterium avium
VEDCTVFGVEVPRTGGR

SEQ ID NO: 85556 - protein, 17 aa, Mycobacterium avium
VEDGALWLLQTRAAERS

SEQ ID NO: 85557 - protein, 32 aa, Mycobacterium avium
VEDHLTRIGRLWARFNAVAVDNPHAWIRTPHS

SEQ ID NO: 85558 - protein, 18 aa, Mycobacterium avium
VEDVFPLPRELVGDGTLF

SEQ ID NO: 85559 - protein, 25 aa, Mycobacterium avium
VEELGIDVFLVMPFTTDFMKLTPDR

SEQ ID NO: 85560 - protein, 17 aa, Mycobacterium avium
VEEYCTFMGQLIGVEPK

SEQ ID NO: 85561 - protein, 24 aa, Mycobacterium avium
VEFDAHPGLWMFTNMGVFFNSMDY

SEQ ID NO: 85562 - protein, 20 aa, Mycobacterium avium
VEFLDALPLNATGKVMKDQL

SEQ ID NO: 85563 - protein, 19 aa, Mycobacterium avium
VEGDIPWTNPHCARAGSVH

SEQ ID NO: 85564 - protein, 23 aa, Mycobacterium avium
VEGFTRDGVHRWRSIPYARPPVG

SEQ ID NO: 85565 - protein, 21 aa, Mycobacterium avium
VEGGWKINGQKVWTSGAHYCA

SEQ ID NO: 85566 - protein, 19 aa, Mycobacterium avium
VEGILECAELLVVALGDDR

SEQ ID NO: 85567 - protein, 23 aa, Mycobacterium avium
VEGLPAGSALLVVKRGPNAGSRF

SEQ ID NO: 85568 - protein, 25 aa, Mycobacterium avium
VEGMLALTGYFGWHKICVERGILPG

SEQ ID NO: 85569 - protein, 17 aa, Mycobacterium avium
VEGSGGYGIVFGPEASD

SEQ ID NO: 85570 - protein, 22 aa, Mycobacterium avium
VEGVRPYWEAGFTDIALVQIGG

SEQ ID NO: 85571 - protein, 18 aa, Mycobacterium avium
VEHFILEDYWGRWLGRWT

SEQ ID NO: 85572 - protein, 20 aa, Mycobacterium avium
VEHFNWLEDLGFQFERSYYP

SEQ ID NO: 85573 - protein, 23 aa, Mycobacterium avium
VEHHAVLDSVNWLVEHEGAEVTW

SEQ ID NO: 85574 - protein, 17 aa, Mycobacterium avium
VEIKKQMIDWWGPIIDE

SEQ ID NO: 85575 - protein, 17 aa, Mycobacterium avium
VEINASFYPKRPAGQKL

SEQ ID NO: 85576 - protein, 22 aa, Mycobacterium avium
VEINEAFAPVVLAWLKEIKADP

SEQ ID NO: 85577 - protein, 25 aa, Mycobacterium avium
VEIRRLAIECLRRLADVAPAVFADF

SEQ ID NO: 85578 - protein, 23 aa, Mycobacterium avium
VEKLAALKPAFAEDGVIHAGNSS

SEQ ID NO: 85579 - protein, 17 aa, Mycobacterium avium
VELARDGGCLVVSVDYR

SEQ ID NO: 85580 - protein, 24 aa, Mycobacterium avium
VELFTAEAIWEMPPYTGWYQGART

SEQ ID NO: 85581 - protein, 20 aa, Mycobacterium avium
VELGLTPIVRYVAGAVTGAD

SEQ ID NO: 85582 - protein, 17 aa, Mycobacterium avium
VELKGKRVALVGAGASG

SEQ ID NO: 85583 - protein, 19 aa, Mycobacterium avium
VELTELLVGGGFRDVSISG

SEQ ID NO: 85584 - protein, 28 aa, Mycobacterium avium
VELTLALLPALRRARGQVVFINSGAGRN

SEQ ID NO: 85585 - protein, 27 aa, Mycobacterium avium
VEMGLARLWQSWGFEPDVVLGHSVGQY

SEQ ID NO: 85586 - protein, 22 aa, Mycobacterium avium
VEMMSRRAKSRFTQGSLLADKQ

SEQ ID NO: 85587 - protein, 17 aa, Mycobacterium avium
VENKLRTVLWGWAGKPV

SEQ ID NO: 85588 - protein, 23 aa, Mycobacterium avium
VEPSRKAILCALEHGKSVVTANK

SEQ ID NO: 85589 - protein, 25 aa, Mycobacterium avium
VEQIKRFRILPTLWEPGGDEITLTM

SEQ ID NO: 85590 - protein, 19 aa, Mycobacterium avium
VERFGDLVFDTVITRTVRF

SEQ ID NO: 85591 - protein, 20 aa, Mycobacterium avium
VERIELFAEALLKGGRPADT

SEQ ID NO: 85592 - protein, 22 aa, Mycobacterium avium
VERPEPKRAGVLVVSSDRGLCG

SEQ ID NO: 85593 - protein, 20 aa, Mycobacterium avium
VERRARWVVRVITSLLLFPG

SEQ ID NO: 85594 - protein, 25 aa, Mycobacterium avium
VERRYRAWIRWNAAIMVHRAQRPGV

SEQ ID NO: 85595 - protein, 19 aa, Mycobacterium avium
VERVALALLTYVEERTDGF

SEQ ID NO: 85596 - protein, 18 aa, Mycobacterium avium
VESAEIATGIYLLGAADR

SEQ ID NO: 85597 - protein, 25 aa, Mycobacterium avium
VESFGFKYGLPMDADMVMDVRFLPN

SEQ ID NO: 85598 - protein, 27 aa, Mycobacterium avium
VESKLPVPIHVGGGYGGDSDWLHGMWK

SEQ ID NO: 85599 - protein, 18 aa, Mycobacterium avium
VESMWIVFDQQYRNSYVF

SEQ ID NO: 85600 - protein, 23 aa, Mycobacterium avium
VESRLPVIAAIDGHVRAGGFGLV

SEQ ID NO: 85601 - protein, 25 aa, Mycobacterium avium
VETLRRAGERFGFAVEAMSLLSEHH

SEQ ID NO: 85602 - protein, 18 aa, Mycobacterium avium
VEVARRVIFQATGRLPEE

SEQ ID NO: 85603 - protein, 22 aa, Mycobacterium avium
VEVCRTCSWNHLVKSYVLGAAR

SEQ ID NO: 85604 - protein, 25 aa, Mycobacterium avium
VEVGLPMRCVFALTAMGFLPQSPDA

SEQ ID NO: 85605 - protein, 24 aa, Mycobacterium avium
VEVLATAELLEWEILRDICDADAM

SEQ ID NO: 85606 - protein, 25 aa, Mycobacterium avium
VEVLGRAGLGVSLAGVNYVAGDAAS

SEQ ID NO: 85607 - protein, 19 aa, Mycobacterium avium
VEVPFSFHHPMWRENCEID

SEQ ID NO: 85608 - protein, 17 aa, Mycobacterium avium
VEYDPAYHELMRTAIAH

SEQ ID NO: 85609 - protein, 17 aa, Mycobacterium avium
VFAETTLDVAFSIVVKP

SEQ ID NO: 85610 - protein, 17 aa, Mycobacterium avium
VFDIMLLAHGWALKHWH

SEQ ID NO: 85611 - protein, 23 aa, Mycobacterium avium
VFEEWEADFGRTFLLGDDPHKKA

SEQ ID NO: 85612 - protein, 22 aa, Mycobacterium avium
VFEHLGRLLIIDCGVMFPTHDE

SEQ ID NO: 85613 - protein, 19 aa, Mycobacterium avium
VFHREVKRMQGAITAVADC

SEQ ID NO: 85614 - protein, 21 aa, Mycobacterium avium
VFKEKLIRRDISMKAFDAGEP

SEQ ID NO: 85615 - protein, 23 aa, Mycobacterium avium
VFPGETLTTLIWRTEPGKAVFRT

SEQ ID NO: 85616 - protein, 25 aa, Mycobacterium avium
VFREPLPRIGLDSLPDQGAWLQPFR

SEQ ID NO: 85617 - protein, 21 aa, Mycobacterium avium
VFRKGLMMAMIYRGDYWQVAY

SEQ ID NO: 85618 - protein, 23 aa, Mycobacterium avium
VFTRAQLLHEVWGYDFFGGTRTV

SEQ ID NO: 85619 - protein, 20 aa, Mycobacterium avium
VFVPPKFAKDAIIEAIDAEI

SEQ ID NO: 85620 - protein, 24 aa, Mycobacterium avium
VFYLHSRLLERCAKLSDELGGGSM

SEQ ID NO: 85621 - protein, 17 aa, Mycobacterium avium
VGAAGNEKNFKWIARSA

SEQ ID NO: 85622 - protein, 25 aa, Mycobacterium avium
VGAHRFLQRVWRLVVDEQTGETRVV

SEQ ID NO: 85623 - protein, 22 aa, Mycobacterium avium
VGALRGGYEYARTGNPTRAALE

SEQ ID NO: 85624 - protein, 26 aa, Mycobacterium avium
VGAQRAVWVGHDWGAAVVWNAPLLHP

SEQ ID NO: 85625 - protein, 21 aa, Mycobacterium avium
VGARFKHIIMDSSTYGVPVNS

SEQ ID NO: 85626 - protein, 22 aa, Mycobacterium avium
VGAVDCRGGAPGTRETDLLDPA

SEQ ID NO: 85627 - protein, 17 aa, Mycobacterium avium
VGAVILGDFEKIEEGQQ

SEQ ID NO: 85628 - protein, 22 aa, Mycobacterium avium
VGDPLLDLAWCLLGYDGENPRE

SEQ ID NO: 85629 - protein, 23 aa, Mycobacterium avium
VGDRFPLMPIPSWMDNPIDPISI

SEQ ID NO: 85630 - protein, 25 aa, Mycobacterium avium
VGEAWRFLKELRLERGPLDPDEATA

SEQ ID NO: 85631 - protein, 23 aa, Mycobacterium avium
VGEIACRPRHPHVMSEGYIGDDL

SEQ ID NO: 85632 - protein, 24 aa, Mycobacterium avium
VGEICVSGPLLSGGYWNLPEETAK

SEQ ID NO: 85633 - protein, 22 aa, Mycobacterium avium
VGELGVPIYRGHRIATCTQDDT

SEQ ID NO: 85634 - protein, 28 aa, Mycobacterium avium
VGETVYKHGWWLPERPLTPIGAQMNIGY

SEQ ID NO: 85635 - protein, 20 aa, Mycobacterium avium
VGFACQSFAALSLDPPLVLF

SEQ ID NO: 85636 - protein, 24 aa, Mycobacterium avium
VGFDIPNDFVVGYGLDYDERYRDL

SEQ ID NO: 85637 - protein, 19 aa, Mycobacterium avium
VGFEGQPSWSGKPEVAAAA

SEQ ID NO: 85638 - protein, 22 aa, Mycobacterium avium
VGFKGSRKSTPFAAQLAAENAA

SEQ ID NO: 85639 - protein, 23 aa, Mycobacterium avium
VGFLWEVLGRIGIGRKDALVSLG

SEQ ID NO: 85640 - protein, 20 aa, Mycobacterium avium
VGFQDGWRGLLENRRIQLHN

SEQ ID NO: 85641 - protein, 23 aa, Mycobacterium avium
VGGEVLLHCCGPDMPWNLLQDSA

SEQ ID NO: 85642 - protein, 24 aa, Mycobacterium avium
VGGNCPLWVVHHAFSRPGQFLTQV

SEQ ID NO: 85643 - protein, 19 aa, Mycobacterium avium
VGGTWHWNTYPGIAVDIPS

SEQ ID NO: 85644 - protein, 18 aa, Mycobacterium avium
VGGVKVKLMAKVQPKADG

SEQ ID NO: 85645 - protein, 18 aa, Mycobacterium avium
VGHPRYGDDDGWEQKLEV

SEQ ID NO: 85646 - protein, 26 aa, Mycobacterium avium
VGHRKGFLQFRWQRVSRQLTEADGPT

SEQ ID NO: 85647 - protein, 18 aa, Mycobacterium avium
VGIGDLKFFSQIGYGGGA

SEQ ID NO: 85648 - protein, 25 aa, Mycobacterium avium
VGIQFSDDFIEWSISFSQKPFPPPC

SEQ ID NO: 85649 - protein, 23 aa, Mycobacterium avium
VGISVDCARYWLDSDRPISKADA

SEQ ID NO: 85650 - protein, 17 aa, Mycobacterium avium
VGKFAYRVMHSVKAGIK

SEQ ID NO: 85651 - protein, 23 aa, Mycobacterium avium
VGKLLVRGPMMFDGYLNRPDATA

SEQ ID NO: 85652 - protein, 25 aa, Mycobacterium avium
VGLAAWRLGAGRSRPGERVQAGAGL

SEQ ID NO: 85653 - protein, 17 aa, Mycobacterium avium
VGLARARRMLLLGEKVG

SEQ ID NO: 85654 - protein, 26 aa, Mycobacterium avium
VGLHSPCLHTAGIFRGRTCAVAGHRC

SEQ ID NO: 85655 - protein, 20 aa, Mycobacterium avium
VGLQPARWGTGFILGTNRWG

SEQ ID NO: 85656 - protein, 17 aa, Mycobacterium avium
VGLRIVIELKRDAVAKV

SEQ ID NO: 85657 - protein, 32 aa, Mycobacterium avium
VGLSVCYDIRFPELYTELARRGAQLIAVCASW

SEQ ID NO: 85658 - protein, 25 aa, Mycobacterium avium
VGLYPCPPFALLTGQDKWLLRPPPK

SEQ ID NO: 85659 - protein, 20 aa, Mycobacterium avium
VGMARAFAAELGRYNIRVNS

SEQ ID NO: 85660 - protein, 19 aa, Mycobacterium avium
VGMCLFLLSDEASWITGQI

SEQ ID NO: 85661 - protein, 28 aa, Mycobacterium avium
VGMPYVNQRWLGGMLTNFSTVHKRLQRL

SEQ ID NO: 85662 - protein, 25 aa, Mycobacterium avium
VGNALCAAAVALECGATVEQVVAAL

SEQ ID NO: 85663 - protein, 17 aa, Mycobacterium avium
VGNLMFVLPDERDCRRA

SEQ ID NO: 85664 - protein, 27 aa, Mycobacterium avium
VGPQVARAALLFGMRFDAEAAVRHGLA

SEQ ID NO: 85665 - protein, 24 aa, Mycobacterium avium
VGQDIRFGLGAVRNVGANVVGSLI

SEQ ID NO: 85666 - protein, 23 aa, Mycobacterium avium
VGQKRFSLEGAESVIPMMDAAID

SEQ ID NO: 85667 - protein, 29 aa, Mycobacterium avium
VGQRFPIDPPFGLVAMAWRDDDAVQAWLR

SEQ ID NO: 85668 - protein, 23 aa, Mycobacterium avium
VGRARGGVRKALRSCPVPVVVGG

SEQ ID NO: 85669 - protein, 27 aa, Mycobacterium avium
VGREIKKLPTLRGRTVVTMFYENSTRT

SEQ ID NO: 85670 - protein, 24 aa, Mycobacterium avium
VGREMGVAGLEEFLERKTFAVVAG

SEQ ID NO: 85671 - protein, 26 aa, Mycobacterium avium
VGRIAARVPQEWLLPYVHQRYDDVAL

SEQ ID NO: 85672 - protein, 27 aa, Mycobacterium avium
VGRKALNYYTFRNWDISGSWTGFSEQP

SEQ ID NO: 85673 - protein, 23 aa, Mycobacterium avium
VGRRRWNRRGAMVTDRYQRLCHH

SEQ ID NO: 85674 - protein, 25 aa, Mycobacterium avium
VGSGPELRAAAAWFEALKLERRRQR

SEQ ID NO: 85675 - protein, 24 aa, Mycobacterium avium
VGSNWGRRRHPSWSANLKAAQRVT

SEQ ID NO: 85676 - protein, 17 aa, Mycobacterium avium
VGSRKRPYLGMSREPAD

SEQ ID NO: 85677 - protein, 17 aa, Mycobacterium avium
VGTEPRKIFDLLEQAPI

SEQ ID NO: 85678 - protein, 17 aa, Mycobacterium avium
VGVAGRVIFARNSGKLC

SEQ ID NO: 85679 - protein, 25 aa, Mycobacterium avium
VGVEGWPVTVSNDFDAELPAADAVL

SEQ ID NO: 85680 - protein, 17 aa, Mycobacterium avium
VGVGGHISTYASSAALY

SEQ ID NO: 85681 - protein, 26 aa, Mycobacterium avium
VGVPEGWMIAGHIVVGWPKGKHGPLR

SEQ ID NO: 85682 - protein, 21 aa, Mycobacterium avium
VHESVALAAAIGHHMASARPQ

SEQ ID NO: 85683 - protein, 20 aa, Mycobacterium avium
VHGFATLWLNDAVDAAVRAA

SEQ ID NO: 85684 - protein, 28 aa, Mycobacterium avium
VHGFPQNWWEWRALIGPLAADGYRVLCP

SEQ ID NO: 85685 - protein, 19 aa, Mycobacterium avium
VHGTWRMLRANSKLAARTG

SEQ ID NO: 85686 - protein, 18 aa, Mycobacterium avium
VHHRERLGALVLTSCDAF

SEQ ID NO: 85687 - protein, 25 aa, Mycobacterium avium
VHKKGSALVPSWVAFAVTGLLEQHF

SEQ ID NO: 85688 - protein, 23 aa, Mycobacterium avium
VHLKSVVYELLWFLRGDSNVDWL

SEQ ID NO: 85689 - protein, 19 aa, Mycobacterium avium
VHNTQPWRWLVGQESLHLY

SEQ ID NO: 85690 - protein, 24 aa, Mycobacterium avium
VHPVTCSLGLPTRHLDLQFVAHAP

SEQ ID NO: 85691 - protein, 20 aa, Mycobacterium avium
VHQRRLFPLIAKSYALQFAQ

SEQ ID NO: 85692 - protein, 17 aa, Mycobacterium avium
VHRADLIGQHIGETEAK

SEQ ID NO: 85693 - protein, 28 aa, Mycobacterium avium
VHRLCAPHLRPAPMPNSLPGQWTGHVTM

SEQ ID NO: 85694 - protein, 18 aa, Mycobacterium avium
VHSCPGGPLARVEGRVSI

SEQ ID NO: 85695 - protein, 18 aa, Mycobacterium avium
VHTARAALRRDVGPGGPV

SEQ ID NO: 85696 - protein, 20 aa, Mycobacterium avium
VHTEECRKLGLPFAADPSQQ

SEQ ID NO: 85697 - protein, 31 aa, Mycobacterium avium
VHVRIASPPVKWPCFYGIDFPSPAELIANAV

SEQ ID NO: 85698 - protein, 25 aa, Mycobacterium avium
VHYVMECLQLMALRRATTVEVTQRA

SEQ ID NO: 85699 - protein, 17 aa, Mycobacterium avium
VIAEIGAGLDLDATLHR

SEQ ID NO: 85700 - protein, 24 aa, Mycobacterium avium
VIDLGEAILLPGLMDMEVNLLMGG

SEQ ID NO: 85701 - protein, 32 aa, Mycobacterium avium
VIEFCRRHLAGFKCPRTVDFVAELPRNASGKI

SEQ ID NO: 85702 - protein, 19 aa, Mycobacterium avium
VIENCLLPNWPACSRGCCL

SEQ ID NO: 85703 - protein, 17 aa, Mycobacterium avium
VIEPAAGLTRSFMAFLI

SEQ ID NO: 85704 - protein, 18 aa, Mycobacterium avium
VIFHLAITPDRGYCMSLR

SEQ ID NO: 85705 - protein, 23 aa, Mycobacterium avium
VIGLPEVMLGVLPGAGGVARSVR

SEQ ID NO: 85706 - protein, 18 aa, Mycobacterium avium
VINRHVFESLAMNARIAL

SEQ ID NO: 85707 - protein, 23 aa, Mycobacterium avium
VIPGHASLQYAMRAVESDSLREL

SEQ ID NO: 85708 - protein, 25 aa, Mycobacterium avium
VIPKGEYGAGRVVIWDSGTYDAEKF

SEQ ID NO: 85709 - protein, 26 aa, Mycobacterium avium
VITAFNFPVAVWAWNAALALVCGDTV

SEQ ID NO: 85710 - protein, 20 aa, Mycobacterium avium
VIVRQMLRRVTIIDSGSTEF

SEQ ID NO: 85711 - protein, 19 aa, Mycobacterium avium
VKAGAILVNVNYRYVEGEL

SEQ ID NO: 85712 - protein, 19 aa, Mycobacterium avium
VKCAPGIDFEQVRRLGFAG

SEQ ID NO: 85713 - protein, 17 aa, Mycobacterium avium
VKDGFVWGRGAVDMKDM

SEQ ID NO: 85714 - protein, 25 aa, Mycobacterium avium
VKEAVLPFHRFRTVEGAGIDSLLGP

SEQ ID NO: 85715 - protein, 21 aa, Mycobacterium avium
VKEPLRKLRLVLDETEGVAAD

SEQ ID NO: 85716 - protein, 25 aa, Mycobacterium avium
VKEVKAAMGALEIDPAFAERNVNEG

SEQ ID NO: 85717 - protein, 24 aa, Mycobacterium avium
VKGGRRFSFTALVIVGDGNGMVGV

SEQ ID NO: 85718 - protein, 25 aa, Mycobacterium avium
VKGKAKEVGGTILGRDDLTEEGQAQ

SEQ ID NO: 85719 - protein, 17 aa, Mycobacterium avium
VKKKYGNKISWADLIIF

SEQ ID NO: 85720 - protein, 19 aa, Mycobacterium avium
VKLIQPVAMDEGLRFAIRE

SEQ ID NO: 85721 - protein, 23 aa, Mycobacterium avium
VKLQEWVRHSGARLVVVFEGRDA

SEQ ID NO: 85722 - protein, 18 aa, Mycobacterium avium
VKLVERFDAGSYVVLTEA

SEQ ID NO: 85723 - protein, 24 aa, Mycobacterium avium
VKPARGGSSIGVSRVSSWDELDAA

SEQ ID NO: 85724 - protein, 20 aa, Mycobacterium avium
VKPGSGVRGLIAKKGNIPVG

SEQ ID NO: 85725 - protein, 23 aa, Mycobacterium avium
VKRGPNAGSRFLLDQATTSAGRH

SEQ ID NO: 85726 - protein, 40 aa, Mycobacterium avium
VKRLARLHTPLPLLAFTAWPEVRSQLAMTWGTETFIVPMM

SEQ ID NO: 85727 - protein, 22 aa, Mycobacterium avium
VKSRLHYAVRALRLTLQELGVT

SEQ ID NO: 85728 - protein, 22 aa, Mycobacterium avium
VKSSLRTAVRAFREAAHAGDKE

SEQ ID NO: 85729 - protein, 20 aa, Mycobacterium avium
VKVRFFGRVRRCGMVSPTVF

SEQ ID NO: 85730 - protein, 22 aa, Mycobacterium avium
VKWKEVRTGGYGQSIVHREPIG

SEQ ID NO: 85731 - protein, 17 aa, Mycobacterium avium
VLAARPVGVPAIVAPPV

SEQ ID NO: 85732 - protein, 23 aa, Mycobacterium avium
VLAERIGALLLEVNRRFGTPVPP

SEQ ID NO: 85733 - protein, 18 aa, Mycobacterium avium
VLAGPLVRSSYRAGRLYR

SEQ ID NO: 85734 - protein, 19 aa, Mycobacterium avium
VLAHWPEVIASPTPASAGR

SEQ ID NO: 85735 - protein, 25 aa, Mycobacterium avium
VLARLYGWHRAMRIFDGPDEVHMRT

SEQ ID NO: 85736 - protein, 24 aa, Mycobacterium avium
VLDELRELAGILGVARDAEVLAER

SEQ ID NO: 85737 - protein, 18 aa, Mycobacterium avium
VLELLHLGGRSLAHAVLM

SEQ ID NO: 85738 - protein, 26 aa, Mycobacterium avium
VLERLRPGDFYRPAHQNVYDAILDLY

SEQ ID NO: 85739 - protein, 17 aa, Mycobacterium avium
VLETEYLKRPLIDGPAP

SEQ ID NO: 85740 - protein, 25 aa, Mycobacterium avium
VLGARLTVPLGMIILRKGYGLGAMA

SEQ ID NO: 85741 - protein, 18 aa, Mycobacterium avium
VLGDAVFYLMEPVDGFNA

SEQ ID NO: 85742 - protein, 19 aa, Mycobacterium avium
VLHEVRLMLDQYWPSVPHV

SEQ ID NO: 85743 - protein, 24 aa, Mycobacterium avium
VLHLLYARFWHKVLYDLGHVSSRE

SEQ ID NO: 85744 - protein, 19 aa, Mycobacterium avium
VLHSFCGPTRKLGGDCADF

SEQ ID NO: 85745 - protein, 18 aa, Mycobacterium avium
VLIDLQFATMWISPTRIH

SEQ ID NO: 85746 - protein, 19 aa, Mycobacterium avium
VLIEPGVRTGIPLLVDNPK

SEQ ID NO: 85747 - protein, 18 aa, Mycobacterium avium
VLKRLGFNQPYIAMMPQW

SEQ ID NO: 85748 - protein, 29 aa, Mycobacterium avium
VLLDRERCILCARCTRFSEQIAGDPFIDM

SEQ ID NO: 85749 - protein, 25 aa, Mycobacterium avium
VLLNSKTRRPSVCNAAETLLVDAAI

SEQ ID NO: 85750 - protein, 25 aa, Mycobacterium avium
VLLRARPGTRLVVAGVCMQPDTVHP

SEQ ID NO: 85751 - protein, 19 aa, Mycobacterium avium
VLLRNILENPAWYTAYTPY

SEQ ID NO: 85752 - protein, 23 aa, Mycobacterium avium
VLLSDPWACSRFAEHEVVVPLVV

SEQ ID NO: 85753 - protein, 17 aa, Mycobacterium avium
VLPGRPPLATLFLPHNR

SEQ ID NO: 85754 - protein, 22 aa, Mycobacterium avium
VLQRVADALWYPLWDANVRLDH

SEQ ID NO: 85755 - protein, 19 aa, Mycobacterium avium
VLQVEGWDGIQPELNALSK

SEQ ID NO: 85756 - protein, 24 aa, Mycobacterium avium
VLRDGGRFGLIWTSRDRDVDWVRD

SEQ ID NO: 85757 - protein, 26 aa, Mycobacterium avium
VLRNLPGAEVRFVWHETGPITADSGV

SEQ ID NO: 85758 - protein, 18 aa, Mycobacterium avium
VLRQAVDVLRRLLDNASL

SEQ ID NO: 85759 - protein, 17 aa, Mycobacterium avium
VLRRLDGHFTLVFANAD

SEQ ID NO: 85760 - protein, 25 aa, Mycobacterium avium
VLRTPESWLLIDFEGEPGQPLEERR

SEQ ID NO: 85761 - protein, 26 aa, Mycobacterium avium
VLRVVRHWIDHGVKFFRVDNPHTKPP

SEQ ID NO: 85762 - protein, 21 aa, Mycobacterium avium
VLTERFVRYYAGYPDKLTGAS

SEQ ID NO: 85763 - protein, 35 aa, Mycobacterium avium
VLTPLAVDPAHPFPFVSGLSLNLAVMVRQTEDGGQ

SEQ ID NO: 85764 - protein, 29 aa, Mycobacterium avium
VLVDFWASWCGPCRQFGPTFQASSEKHPD

SEQ ID NO: 85765 - protein, 25 aa, Mycobacterium avium
VLVETARLWLSLGHHDRHGVWHLDG

SEQ ID NO: 85766 - protein, 36 aa, Mycobacterium avium
VLVRPAPVPGYRGSRSFGFEEFDPFWQACVRAEIPV

SEQ ID NO: 85767 - protein, 20 aa, Mycobacterium avium
VMAPRQWHGLRRWLGEPEDF

SEQ ID NO: 85768 - protein, 18 aa, Mycobacterium avium
VMENRWLPMKQTALALNH

SEQ ID NO: 85769 - protein, 43 aa, Mycobacterium avium
VMGKSGLFSDYLIKMAQVITWFCLDTGSGFTYWPDGPLKAPAR

SEQ ID NO: 85770 - protein, 18 aa, Mycobacterium avium
VMHEGPRTLGYGAELAAR

SEQ ID NO: 85771 - protein, 18 aa, Mycobacterium avium
VMLGAALLARNAVEKGLA

SEQ ID NO: 85772 - protein, 30 aa, Mycobacterium avium
VMLLHGFGSFWWSWRHQLRGLTGARVVAVD

SEQ ID NO: 85773 - protein, 19 aa, Mycobacterium avium
VMMDEPFGALDTRTRAAMQ

SEQ ID NO: 85774 - protein, 25 aa, Mycobacterium avium
VMSQLRTALRMQILAGYPIAEALEA

SEQ ID NO: 85775 - protein, 22 aa, Mycobacterium avium
VMSYQWPKDRRSVSWTLVSSSL

SEQ ID NO: 85776 - protein, 19 aa, Mycobacterium avium
VMTGFRVSRSGWYGIDPVD

SEQ ID NO: 85777 - protein, 18 aa, Mycobacterium avium
VMYFKDFNSGAMIQNVVD

SEQ ID NO: 85778 - protein, 19 aa, Mycobacterium avium
VNACLDRLRRTKAHPTVPL

SEQ ID NO: 85779 - protein, 21 aa, Mycobacterium avium
VNANGIYVCRAIVSHRMPDGV

SEQ ID NO: 85780 - protein, 40 aa, Mycobacterium avium
VNARGEGTFVKFHWKPRLGVHSLIWDECQKIAGKDPDYNR

SEQ ID NO: 85781 - protein, 21 aa, Mycobacterium avium
VNARYLRICVLTQYKSHSLDR

SEQ ID NO: 85782 - protein, 25 aa, Mycobacterium avium
VNDGAQPWVRPVFPLINEMVVVDLP

SEQ ID NO: 85783 - protein, 21 aa, Mycobacterium avium
VNGICCGAGMDWVTTTDIVIA

SEQ ID NO: 85784 - protein, 22 aa, Mycobacterium avium
VNGPCVGAGLALCLAADIRICS

SEQ ID NO: 85785 - protein, 20 aa, Mycobacterium avium
VNGPLALAVGRRLRERYGID

SEQ ID NO: 85786 - protein, 17 aa, Mycobacterium avium
VNGPRGWATCNYVVASS

SEQ ID NO: 85787 - protein, 26 aa, Mycobacterium avium
VNGYRGCSHACRYCFARPSHEYLELN

SEQ ID NO: 85788 - protein, 27 aa, Mycobacterium avium
VNHAGRITAPRGWDLVRHAGPLPTHPD

SEQ ID NO: 85789 - protein, 20 aa, Mycobacterium avium
VNLTGTFLVVREALPALLDN

SEQ ID NO: 85790 - protein, 18 aa, Mycobacterium avium
VNLTGTWRTLRATVPAMI

SEQ ID NO: 85791 - protein, 23 aa, Mycobacterium avium
VNMTLLRFISFILKEIYPGGKLP

SEQ ID NO: 85792 - protein, 20 aa, Mycobacterium avium
VNNVGFARFGRLGSIELDHL

SEQ ID NO: 85793 - protein, 25 aa, Mycobacterium avium
VNPTGKFVVGGPMGDAGLTGRKIIV

SEQ ID NO: 85794 - protein, 24 aa, Mycobacterium avium
VNRLPRTGSYFTRELPSAGKGTSV

SEQ ID NO: 85795 - protein, 24 aa, Mycobacterium avium
VNRTAGGLYRWEGRYLRGDDQRKL

SEQ ID NO: 85796 - protein, 17 aa, Mycobacterium avium
VNSDWGLDEILLPTTGP

SEQ ID NO: 85797 - protein, 24 aa, Mycobacterium avium
VNSSYRMEQGFTFELNLAGVSDEH

SEQ ID NO: 85798 - protein, 18 aa, Mycobacterium avium
VNTGMGFEGPVHRANFDA

SEQ ID NO: 85799 - protein, 18 aa, Mycobacterium avium
VNVDADFEPLYIISPEKK

SEQ ID NO: 85800 - protein, 23 aa, Mycobacterium avium
VNVDGELPAGVTAKDIILALIAK

SEQ ID NO: 85801 - protein, 23 aa, Mycobacterium avium
VNVLCTPGVWARHRKLANTAPAL

SEQ ID NO: 85802 - protein, 24 aa, Mycobacterium avium
VNYLGPVRLLLGLLPAMRDNGRGH

SEQ ID NO: 85803 - protein, 35 aa, Mycobacterium avium
VPAARARLLAPIPRPPSIRDSLCFLDHMRNCQAAL

SEQ ID NO: 85804 - protein, 22 aa, Mycobacterium avium
VPAEAAVDVVIPYHRGDLVARL

SEQ ID NO: 85805 - protein, 25 aa, Mycobacterium avium
VPAELVATAAQWQALSSQFIGAPPS

SEQ ID NO: 85806 - protein, 26 aa, Mycobacterium avium
VPAFALGDYEWILAFEAPELHRIVDL

SEQ ID NO: 85807 - protein, 18 aa, Mycobacterium avium
VPAGGLLLAHHPLLLRGV

SEQ ID NO: 85808 - protein, 33 aa, Mycobacterium avium
VPAHGMRRISFVPGPAGFRFYHTHVVPRADLSR

SEQ ID NO: 85809 - protein, 21 aa, Mycobacterium avium
VPARVANLVERLRAAEKELER

SEQ ID NO: 85810 - protein, 19 aa, Mycobacterium avium
VPDHPDHVMYVWVDALTNY

SEQ ID NO: 85811 - protein, 25 aa, Mycobacterium avium
VPDPSKFVGSLGFRESVVRLVVSGG

SEQ ID NO: 85812 - protein, 25 aa, Mycobacterium avium
VPESKRFCWNCGKPVGRSTKKSKGT

SEQ ID NO: 85813 - protein, 27 aa, Mycobacterium avium
VPEVFDLRPGAIIRDLDLLRPIYAQTA

SEQ ID NO: 85814 - protein, 20 aa, Mycobacterium avium
VPFAARWPVEVHIYPNRFVP

SEQ ID NO: 85815 - protein, 20 aa, Mycobacterium avium
VPFGTQWYGYFMRRLAERPA

SEQ ID NO: 85816 - protein, 20 aa, Mycobacterium avium
VPFTLTRRGALTAELPGESA

SEQ ID NO: 85817 - protein, 18 aa, Mycobacterium avium
VPGASYWYAHTDQWRYDG

SEQ ID NO: 85818 - protein, 23 aa, Mycobacterium avium
VPGDPICSGAVNPAAHRQYVEAG

SEQ ID NO: 85819 - protein, 29 aa, Mycobacterium avium
VPGLRALVRLAIYWGQEALAFGMTKRPNL

SEQ ID NO: 85820 - protein, 21 aa, Mycobacterium avium
VPIDLRQDWPKALQEAGFDAS

SEQ ID NO: 85821 - protein, 23 aa, Mycobacterium avium
VPKKLLEEWLAMWSENYHLGEKL

SEQ ID NO: 85822 - protein, 23 aa, Mycobacterium avium
VPLPDPRLDKLAEMFKSERIVAA

SEQ ID NO: 85823 - protein, 20 aa, Mycobacterium avium
VPNLFWCVGYTNASWTLRAD

SEQ ID NO: 85824 - protein, 17 aa, Mycobacterium avium
VPPPGPLGRHFPFDPSQ

SEQ ID NO: 85825 - protein, 23 aa, Mycobacterium avium
VPPPTTSAGTGWRKRKQQKYEDV

SEQ ID NO: 85826 - protein, 27 aa, Mycobacterium avium
VPPRWLPGPRELRAWTLAAGNPEGEHY

SEQ ID NO: 85827 - protein, 20 aa, Mycobacterium avium
VPQCPRRWRYLSPAIPADPG

SEQ ID NO: 85828 - protein, 26 aa, Mycobacterium avium
VPRAEVLRPGLLVLPVRGAARYFGSE

SEQ ID NO: 85829 - protein, 21 aa, Mycobacterium avium
VPRGISFLLNRNRLNVAVSRA

SEQ ID NO: 85830 - protein, 19 aa, Mycobacterium avium
VPRRAEPRTAVPAGSVALA

SEQ ID NO: 85831 - protein, 22 aa, Mycobacterium avium
VPRTKRGVISYAARDIGERLDA

SEQ ID NO: 85832 - protein, 21 aa, Mycobacterium avium
VPSERTGSVARCYSLCSSPFT

SEQ ID NO: 85833 - protein, 19 aa, Mycobacterium avium
VPTCPDWTLRQLFRHVGRG

SEQ ID NO: 85834 - protein, 25 aa, Mycobacterium avium
VPTRFARGWHCLGLIRDFGDGKPHP

SEQ ID NO: 85835 - protein, 23 aa, Mycobacterium avium
VPTRFCALDGAGLADEVAAAEVL

SEQ ID NO: 85836 - protein, 20 aa, Mycobacterium avium
VPTYRFLRRYAGVVTNPRHP

SEQ ID NO: 85837 - protein, 25 aa, Mycobacterium avium
VPVDLRDDWPAALTAAGFQAARPTA

SEQ ID NO: 85838 - protein, 22 aa, Mycobacterium avium
VPVDLRHDWPAALRQAGFDAHA

SEQ ID NO: 85839 - protein, 24 aa, Mycobacterium avium
VPVNPSGGLACFGEAIPAQAIAQV

SEQ ID NO: 85840 - protein, 17 aa, Mycobacterium avium
VPVSASVWREGHEAVAA

SEQ ID NO: 85841 - protein, 26 aa, Mycobacterium avium
VPWDRFQTLCGIQYYFDTEFQLLRGH

SEQ ID NO: 85842 - protein, 21 aa, Mycobacterium avium
VQAGLRTDYLFRLANQRGGIV

SEQ ID NO: 85843 - protein, 19 aa, Mycobacterium avium
VQELFEARIPRGKAPIADV

SEQ ID NO: 85844 - protein, 22 aa, Mycobacterium avium
VQGEAAAGVVLLRPASPGTGVI

SEQ ID NO: 85845 - protein, 21 aa, Mycobacterium avium
VQGMCTAGAFYFVNESDVVIC

SEQ ID NO: 85846 - protein, 19 aa, Mycobacterium avium
VQLTLERFGSVDILVNNAG

SEQ ID NO: 85847 - protein, 18 aa, Mycobacterium avium
VQMMWQMRASGMWTDARG

SEQ ID NO: 85848 - protein, 25 aa, Mycobacterium avium
VQTGFARSGAMFACEHEGPNGLEPD

SEQ ID NO: 85849 - protein, 24 aa, Mycobacterium avium
VQTVLRWASAHGVPVVTRGAGSGL

SEQ ID NO: 85850 - protein, 18 aa, Mycobacterium avium
VQVFDSWAGALSLANYRS

SEQ ID NO: 85851 - protein, 28 aa, Mycobacterium avium
VQYRLPNYYRWLLYEADHAGAYRFHRIF

SEQ ID NO: 85852 - protein, 19 aa, Mycobacterium avium
VRAGARILLSPDGPDLRVQ

SEQ ID NO: 85853 - protein, 19 aa, Mycobacterium avium
VRAIWEMYTGWFRHRSTTE

SEQ ID NO: 85854 - protein, 17 aa, Mycobacterium avium
VRALEAFGRTPAASELQ

SEQ ID NO: 85855 - protein, 24 aa, Mycobacterium avium
VRALRLDRFHLFGNSWGGMLAQQY

SEQ ID NO: 85856 - protein, 19 aa, Mycobacterium avium
VRAMDRLGLLALLTRALER

SEQ ID NO: 85857 - protein, 22 aa, Mycobacterium avium
VRAPSASAWTVFTSARWHVSIW

SEQ ID NO: 85858 - protein, 24 aa, Mycobacterium avium
VRAVGVDFFTRWAAGELDAADVDV

SEQ ID NO: 85859 - protein, 21 aa, Mycobacterium avium
VRCGMVPAGVDVIWENHQHVP

SEQ ID NO: 85860 - protein, 18 aa, Mycobacterium avium
VRDGDILVGKVTPKGETE

SEQ ID NO: 85861 - protein, 19 aa, Mycobacterium avium
VRDGLKPVHRRVLYAMYDS

SEQ ID NO: 85862 - protein, 19 aa, Mycobacterium avium
VRDGMVWMRSLGTLKRVDV

SEQ ID NO: 85863 - protein, 19 aa, Mycobacterium avium
VRDGQKWLDIYQILERGMA

SEQ ID NO: 85864 - protein, 17 aa, Mycobacterium avium
VRDVRRIGSAALDLCMV

SEQ ID NO: 85865 - protein, 25 aa, Mycobacterium avium
VREAIERMAPQLARISAERVAAELD

SEQ ID NO: 85866 - protein, 23 aa, Mycobacterium avium
VREAIHSVFLFHAIKAGLDMGIV

SEQ ID NO: 85867 - protein, 24 aa, Mycobacterium avium
VREARLCRKYGAAVVVMAFDEQGQ

SEQ ID NO: 85868 - protein, 20 aa, Mycobacterium avium
VREMLGRAVVFTSGTAPSGP

SEQ ID NO: 85869 - protein, 19 aa, Mycobacterium avium
VRETMTFKSVPDALAVVAP

SEQ ID NO: 85870 - protein, 24 aa, Mycobacterium avium
VREVPVGTARPVWIDDGDFDITYH

SEQ ID NO: 85871 - protein, 38 aa, Mycobacterium avium
VRGGFDGLTRWLTGMFERDGWQPGGIVVVGAHSDIDGL

SEQ ID NO: 85872 - protein, 23 aa, Mycobacterium avium
VRGGFLAGDALRFLAGTPASTLP

SEQ ID NO: 85873 - protein, 18 aa, Mycobacterium avium
VRGGNIFRDGSIPYQRFR

SEQ ID NO: 85874 - protein, 24 aa, Mycobacterium avium
VRGGRLSRQSAWQVLQDAAERAGI

SEQ ID NO: 85875 - protein, 34 aa, Mycobacterium avium
VRGIDPRCAVVFQEPRLLPWRSLAANVAFGLPRG

SEQ ID NO: 85876 - protein, 19 aa, Mycobacterium avium
VRGPRAEIVLRLRDPGPVT

SEQ ID NO: 85877 - protein, 23 aa, Mycobacterium avium
VRGSRLAEVLSRCSYLCDGIAVR

SEQ ID NO: 85878 - protein, 18 aa, Mycobacterium avium
VRGVYGYSPRDRIPNSSS

SEQ ID NO: 85879 - protein, 21 aa, Mycobacterium avium
VRHDPSWSVLRSFKRLLNDAG

SEQ ID NO: 85880 - protein, 19 aa, Mycobacterium avium
VRHGLTLGGPIAVEIGNTE

SEQ ID NO: 85881 - protein, 17 aa, Mycobacterium avium
VRHLHKVVVDWVDAYRR

SEQ ID NO: 85882 - protein, 17 aa, Mycobacterium avium
VRIARELTDLPGEPPRL

SEQ ID NO: 85883 - protein, 19 aa, Mycobacterium avium
VRIEHRVHLGVAVATERGL

SEQ ID NO: 85884 - protein, 18 aa, Mycobacterium avium
VRILGGYRAWQHGIDTVL

SEQ ID NO: 85885 - protein, 21 aa, Mycobacterium avium
VRIPHELRIPAPDRLEHDAEA

SEQ ID NO: 85886 - protein, 22 aa, Mycobacterium avium
VRKEFRRLRVKADEETVTAMLD

SEQ ID NO: 85887 - protein, 23 aa, Mycobacterium avium
VRLAKACAAEGAHGLLVVTPYYS

SEQ ID NO: 85888 - protein, 20 aa, Mycobacterium avium
VRLDGAVIFDGVKVEAGSVI

SEQ ID NO: 85889 - protein, 21 aa, Mycobacterium avium
VRLEPGRRALVRTGVAVAIPF

SEQ ID NO: 85890 - protein, 20 aa, Mycobacterium avium
VRLGGPRLKDVAGLSLTKLF

SEQ ID NO: 85891 - protein, 21 aa, Mycobacterium avium
VRLKRMYPAASYRATTSTVQV

SEQ ID NO: 85892 - protein, 18 aa, Mycobacterium avium
VRLLNMVPYFQANPRVTR

SEQ ID NO: 85893 - protein, 25 aa, Mycobacterium avium
VRLPQKVGIGLARRMSLTGDYLSAA

SEQ ID NO: 85894 - protein, 19 aa, Mycobacterium avium
VRLRLPWDPSNVTIGDMVH

SEQ ID NO: 85895 - protein, 18 aa, Mycobacterium avium
VRLSNRLTDSPACLITDA

SEQ ID NO: 85896 - protein, 21 aa, Mycobacterium avium
VRLWQEIAGLPAERIQRRGME

SEQ ID NO: 85897 - protein, 17 aa, Mycobacterium avium
VRMFLHHVPGFSFLPNR

SEQ ID NO: 85898 - protein, 18 aa, Mycobacterium avium
VRPGCAVAVRLDAGHSRE

SEQ ID NO: 85899 - protein, 20 aa, Mycobacterium avium
VRPPRQVPGASYWYAHTDQW

SEQ ID NO: 85900 - protein, 23 aa, Mycobacterium avium
VRQIPYTVACDLLLTGRHITAAE

SEQ ID NO: 85901 - protein, 28 aa, Mycobacterium avium
VRQLRLRDIGGIVVIDFIDMVLESNRDL

SEQ ID NO: 85902 - protein, 19 aa, Mycobacterium avium
VRRQFYWHRFFSHQPDLNY

SEQ ID NO: 85903 - protein, 24 aa, Mycobacterium avium
VRRYIIGCALRWMRDFHADGLRLD

SEQ ID NO: 85904 - protein, 17 aa, Mycobacterium avium
VRSAPGLRHRIYRPAVV

SEQ ID NO: 85905 - protein, 25 aa, Mycobacterium avium
VRSGLPFGTCLDAVYLHPCGSDEFR

SEQ ID NO: 85906 - protein, 18 aa, Mycobacterium avium
VRSGWDDLVLAGGVESMS

SEQ ID NO: 85907 - protein, 23 aa, Mycobacterium avium
VRSYKLRGAYNLLVQLSETELAA

SEQ ID NO: 85908 - protein, 18 aa, Mycobacterium avium
VRTAVIVQMSIYLRNHAR

SEQ ID NO: 85909 - protein, 27 aa, Mycobacterium avium
VRTEFHARAGIDMSKSPSFLWLQVDDV

SEQ ID NO: 85910 - protein, 21 aa, Mycobacterium avium
VRTSGYLAGPHDVYVSMNMVR

SEQ ID NO: 85911 - protein, 24 aa, Mycobacterium avium
VRVLRRAVELGVNFIDTADSYGPY

SEQ ID NO: 85912 - protein, 17 aa, Mycobacterium avium
VRVPVHFSIAEHEKVWQ

SEQ ID NO: 85913 - protein, 20 aa, Mycobacterium avium
VRVTVIAAGFDAAGPGRKPV

SEQ ID NO: 85914 - protein, 25 aa, Mycobacterium avium
VRWNCKAGKCGSCSAEINGYPRLLC

SEQ ID NO: 85915 - protein, 19 aa, Mycobacterium avium
VRWRADGQLDYLGRADEQV

SEQ ID NO: 85916 - protein, 22 aa, Mycobacterium avium
VRYIDRFVMYYIRTADRLQRTA

SEQ ID NO: 85917 - protein, 21 aa, Mycobacterium avium
VRYPYARGVLVEMYREAKARL

SEQ ID NO: 85918 - protein, 24 aa, Mycobacterium avium
VSAATCFPNLSFVHNWPKVRDGRD

SEQ ID NO: 85919 - protein, 24 aa, Mycobacterium avium
VSADAALGLLRRNKIEKLPIVDGH

SEQ ID NO: 85920 - protein, 20 aa, Mycobacterium avium
VSADAFCWSMVRSLVGALLA

SEQ ID NO: 85921 - protein, 23 aa, Mycobacterium avium
VSAGAGYRLTGTRTQVGFGPVAD

SEQ ID NO: 85922 - protein, 20 aa, Mycobacterium avium
VSAKGEFLGGAIAPGLQVSS

SEQ ID NO: 85923 - protein, 26 aa, Mycobacterium avium
VSALKALEGDAKWVESVEQLMEAVDE

SEQ ID NO: 85924 - protein, 23 aa, Mycobacterium avium
VSDATAYCASKFGVVGFTRALAA

SEQ ID NO: 85925 - protein, 23 aa, Mycobacterium avium
VSDDIRRMLGYSIHPPFVGAVDG

SEQ ID NO: 85926 - protein, 22 aa, Mycobacterium avium
VSDRLFNAIIAWGDEEAVMRRV

SEQ ID NO: 85927 - protein, 29 aa, Mycobacterium avium
VSDRVRPGNCFAPFHWNDAFGEYLSINAV

SEQ ID NO: 85928 - protein, 19 aa, Mycobacterium avium
VSGAWNFGSGIGHSQYVAA

SEQ ID NO: 85929 - protein, 25 aa, Mycobacterium avium
VSGDRFGVCGYCMGGRTSLIVAGRL

SEQ ID NO: 85930 - protein, 17 aa, Mycobacterium avium
VSGGPLREWLHKQRTGL

SEQ ID NO: 85931 - protein, 22 aa, Mycobacterium avium
VSGGTARLSRLLSELLVSADAS

SEQ ID NO: 85932 - protein, 17 aa, Mycobacterium avium
VSGPRGEFDVIRTTLEA

SEQ ID NO: 85933 - protein, 22 aa, Mycobacterium avium
VSGRGAGFCAGFDLSAYADRTG

SEQ ID NO: 85934 - protein, 20 aa, Mycobacterium avium
VSIRSRAEWARRYHEKQLAG

SEQ ID NO: 85935 - protein, 22 aa, Mycobacterium avium
VSKLLWANWHRALGELAMDVIG

SEQ ID NO: 85936 - protein, 20 aa, Mycobacterium avium
VSLAELWKSVGVSPDAVIGH

SEQ ID NO: 85937 - protein, 20 aa, Mycobacterium avium
VSLGKRKGKIVVEFGSVDDL

SEQ ID NO: 85938 - protein, 18 aa, Mycobacterium avium
VSLIGAGMRSHPGVTATF

SEQ ID NO: 85939 - protein, 22 aa, Mycobacterium avium
VSLLGSGLWSLGHTVALTNHLH

SEQ ID NO: 85940 - protein, 21 aa, Mycobacterium avium
VSMALRYEGWNIATASDGASA

SEQ ID NO: 85941 - protein, 19 aa, Mycobacterium avium
VSMTAQWWLDTREPKKEVV

SEQ ID NO: 85942 - protein, 23 aa, Mycobacterium avium
VSPEKRTRLGVGHFVETLETYRR

SEQ ID NO: 85943 - protein, 19 aa, Mycobacterium avium
VSPKAAGLLDHAQRVAEGR

SEQ ID NO: 85944 - protein, 20 aa, Mycobacterium avium
VSPMPIGWAEHVLADGHWGR

SEQ ID NO: 85945 - protein, 18 aa, Mycobacterium avium
VSPVGTVVSWAWQPDPIE

SEQ ID NO: 85946 - protein, 22 aa, Mycobacterium avium
VSREEMDAWALRSHRNAIAAID

SEQ ID NO: 85947 - protein, 24 aa, Mycobacterium avium
VSRLAFGTWEFCSDWGHADEDAAI

SEQ ID NO: 85948 - protein, 17 aa, Mycobacterium avium
VSRSGWYGIDPVDADLF

SEQ ID NO: 85949 - protein, 26 aa, Mycobacterium avium
VSRVLPRSIALRMALMGKHERMSAQR

SEQ ID NO: 85950 - protein, 27 aa, Mycobacterium avium
VSRYTRSRFAPAFGPRARLEYLPSGVD

SEQ ID NO: 85951 - protein, 18 aa, Mycobacterium avium
VSTPRGSISLPLVITDMP

SEQ ID NO: 85952 - protein, 29 aa, Mycobacterium avium
VSTVSSIFLMCLPDRVLAYGDCAIIPNPT

SEQ ID NO: 85953 - protein, 27 aa, Mycobacterium avium
VSVAVIGFREHASWALASDTLDFVDLE

SEQ ID NO: 85954 - protein, 17 aa, Mycobacterium avium
VSVCTRGLTGVAGLAAE

SEQ ID NO: 85955 - protein, 24 aa, Mycobacterium avium
VSVDMLKYYAGWVGKIHGESANLV

SEQ ID NO: 85956 - protein, 25 aa, Mycobacterium avium
VSVRCELWGGCAWINLDDDAPALRD

SEQ ID NO: 85957 - protein, 19 aa, Mycobacterium avium
VSYDALWTGRRFVVQDTGG

SEQ ID NO: 85958 - protein, 19 aa, Mycobacterium avium
VTAPRHWKVISNSAAVSVN

SEQ ID NO: 85959 - protein, 24 aa, Mycobacterium avium
VTCLCPGPVPTEWAEIANAERFSI

SEQ ID NO: 85960 - protein, 24 aa, Mycobacterium avium
VTDMAHFFYIHFGLPTYFKNVFEG

SEQ ID NO: 85961 - protein, 17 aa, Mycobacterium avium
VTDPLGLAGGRFQLQTR

SEQ ID NO: 85962 - protein, 29 aa, Mycobacterium avium
VTEVRWWGARPLWFALWSGVFERFPGLRW

SEQ ID NO: 85963 - protein, 17 aa, Mycobacterium avium
VTEWDEWGNPLADKDVY

SEQ ID NO: 85964 - protein, 24 aa, Mycobacterium avium
VTFRPELRVPVLTLITETDVFGGP

SEQ ID NO: 85965 - protein, 24 aa, Mycobacterium avium
VTGGKRLDPGFFYAPTLLTNVDPD

SEQ ID NO: 85966 - protein, 24 aa, Mycobacterium avium
VTGLEFMGCCAFAVLTDEAKRCRQ

SEQ ID NO: 85967 - protein, 25 aa, Mycobacterium avium
VTGRLRPSMLEFMDSVAINAVEDTL

SEQ ID NO: 85968 - protein, 20 aa, Mycobacterium avium
VTGRNGVDLHQMWGSRPYAY

SEQ ID NO: 85969 - protein, 20 aa, Mycobacterium avium
VTGWFMVGWSPEFPIGEVRP

SEQ ID NO: 85970 - protein, 28 aa, Mycobacterium avium
VTGYDILFFWVARMMMFGTFVGDDDAIT

SEQ ID NO: 85971 - protein, 17 aa, Mycobacterium avium
VTHDRWFLDEVATTTWE

SEQ ID NO: 85972 - protein, 17 aa, Mycobacterium avium
VTKVFWSDLDVELHQTA

SEQ ID NO: 85973 - protein, 18 aa, Mycobacterium avium
VTLARRLRVPFVDADTLH

SEQ ID NO: 85974 - protein, 17 aa, Mycobacterium avium
VTLESIWHECLEPRRRH

SEQ ID NO: 85975 - protein, 26 aa, Mycobacterium avium
VTLGPRGRHVVLAKAFGGPAVTNDGV

SEQ ID NO: 85976 - protein, 25 aa, Mycobacterium avium
VTLLIPGGMHTPFFDGRPEQYKPPA

SEQ ID NO: 85977 - protein, 23 aa, Mycobacterium avium
VTLRRLGELAVRIKYLEVLCQRS

SEQ ID NO: 85978 - protein, 22 aa, Mycobacterium avium
VTPALLWLFIRGVRFMYSVDPH

SEQ ID NO: 85979 - protein, 19 aa, Mycobacterium avium
VTPGGALAIHDVFPDPRDG

SEQ ID NO: 85980 - protein, 18 aa, Mycobacterium avium
VTPWRTGLLLAVDEFETK

SEQ ID NO: 85981 - protein, 20 aa, Mycobacterium avium
VTQIARWAGCIGNRSTIIPV

SEQ ID NO: 85982 - protein, 22 aa, Mycobacterium avium
VTRAKMPLPHWEDADGPTEDMF

SEQ ID NO: 85983 - protein, 25 aa, Mycobacterium avium
VTRARNSGMTAVFWLDTERPHEVEL

SEQ ID NO: 85984 - protein, 23 aa, Mycobacterium avium
VTRLREDLCPDWPQPAQHGGSYR

SEQ ID NO: 85985 - protein, 24 aa, Mycobacterium avium
VTRTAVCQPGLFNAEVKKAAAEHG

SEQ ID NO: 85986 - protein, 17 aa, Mycobacterium avium
VTRTMSKAFAFAGGRLG

SEQ ID NO: 85987 - protein, 22 aa, Mycobacterium avium
VTSAPWLPGQVHVFIHGEAQAV

SEQ ID NO: 85988 - protein, 19 aa, Mycobacterium avium
VTSLLRFAGGLHIVGGRVV

SEQ ID NO: 85989 - protein, 17 aa, Mycobacterium avium
VTTHWAFADRLASEFPA

SEQ ID NO: 85990 - protein, 25 aa, Mycobacterium avium
VTTKLRAAGIPILGKTNMDEFAMGS

SEQ ID NO: 85991 - protein, 27 aa, Mycobacterium avium
VTTTPWLTSRHSFSFGDHYDPDNTHFG

SEQ ID NO: 85992 - protein, 23 aa, Mycobacterium avium
VTVARFPRFDWPRIDAPHLRCGA

SEQ ID NO: 85993 - protein, 19 aa, Mycobacterium avium
VTVIHEIAHHFGIDDERLH

SEQ ID NO: 85994 - protein, 18 aa, Mycobacterium avium
VTVKTTWTGAGGVKGFFE

SEQ ID NO: 85995 - protein, 25 aa, Mycobacterium avium
VTVVDPRWVLPVSDSILELAARHKL

SEQ ID NO: 85996 - protein, 25 aa, Mycobacterium avium
VTYAESFGAKGYRISHADELLPTLR

SEQ ID NO: 85997 - protein, 19 aa, Mycobacterium avium
VVACGTAYHSGLLAKYAIE

SEQ ID NO: 85998 - protein, 25 aa, Mycobacterium avium
VVADFRGASVAVEWPAQLQQQISRL

SEQ ID NO: 85999 - protein, 25 aa, Mycobacterium avium
VVAFAKEYGVPIAIKAAFGGGGKGM

SEQ ID NO: 86000 - protein, 34 aa, Mycobacterium avium
VVAICGDGSFNFGVPTAALWSAHRYGAPFVTVVL

SEQ ID NO: 86001 - protein, 19 aa, Mycobacterium avium
VVALCGEVFPVTRAAKPGS

SEQ ID NO: 86002 - protein, 17 aa, Mycobacterium avium
VVAQAWKSRGLPVTENI

SEQ ID NO: 86003 - protein, 24 aa, Mycobacterium avium
VVARASALFLRRGDHPDGQVWSPP

SEQ ID NO: 86004 - protein, 19 aa, Mycobacterium avium
VVAREALHLSVFQRSPAYT

SEQ ID NO: 86005 - protein, 18 aa, Mycobacterium avium
VVARGELVYAVLNLYPYN

SEQ ID NO: 86006 - protein, 25 aa, Mycobacterium avium
VVARIDWTRFLPLYQQAGQRSLLAE

SEQ ID NO: 86007 - protein, 20 aa, Mycobacterium avium
VVAVTRWTVRLAEKGWGNTV

SEQ ID NO: 86008 - protein, 18 aa, Mycobacterium avium
VVCEDSLGLAEEFEAAME

SEQ ID NO: 86009 - protein, 23 aa, Mycobacterium avium
VVCVSRLVPRKGQDMLIRAMPSI

SEQ ID NO: 86010 - protein, 24 aa, Mycobacterium avium
VVDAFEWTGPLGVTYPGVVTHGVV

SEQ ID NO: 86011 - protein, 25 aa, Mycobacterium avium
VVDDGVAALGRLDIIVANAGVAAPQ

SEQ ID NO: 86012 - protein, 18 aa, Mycobacterium avium
VVDGEIWLETKAKSQKAI

SEQ ID NO: 86013 - protein, 17 aa, Mycobacterium avium
VVDYALRRRSLLAEVYS

SEQ ID NO: 86014 - protein, 21 aa, Mycobacterium avium
VVEGVKLADGRAFSVQYHPEA

SEQ ID NO: 86015 - protein, 25 aa, Mycobacterium avium
VVEILATAGLLNWDILRDICDAEAV

SEQ ID NO: 86016 - protein, 19 aa, Mycobacterium avium
VVERNASVYIWHDLQRREP

SEQ ID NO: 86017 - protein, 25 aa, Mycobacterium avium
VVEVYRPRLAGPVPQAEDVVATAVR

SEQ ID NO: 86018 - protein, 19 aa, Mycobacterium avium
VVFAGTWNKTFTRLTSMEA

SEQ ID NO: 86019 - protein, 18 aa, Mycobacterium avium
VVFPELPPSPGGGPSRPP

SEQ ID NO: 86020 - protein, 19 aa, Mycobacterium avium
VVGAERWGKYLGLRTEGLF

SEQ ID NO: 86021 - protein, 35 aa, Mycobacterium avium
VVGQIIPWNFPILMGAWKLAPALAAGNAVVLKPAE

SEQ ID NO: 86022 - protein, 18 aa, Mycobacterium avium
VVGRQLWQQSGLKPTDIQ

SEQ ID NO: 86023 - protein, 25 aa, Mycobacterium avium
VVGVPYCYGAAFDAWTGRYLLVLED

SEQ ID NO: 86024 - protein, 20 aa, Mycobacterium avium
VVHGDFRLGNLLADGPRINA

SEQ ID NO: 86025 - protein, 17 aa, Mycobacterium avium
VVIHLAFIIMGSRDESA

SEQ ID NO: 86026 - protein, 20 aa, Mycobacterium avium
VVIIKANGKGFCGGHVARWG

SEQ ID NO: 86027 - protein, 22 aa, Mycobacterium avium
VVKLDRLDTEVAHLPRVSPQQR

SEQ ID NO: 86028 - protein, 23 aa, Mycobacterium avium
VVKVARIAGQYAKPRSADIDALG

SEQ ID NO: 86029 - protein, 25 aa, Mycobacterium avium
VVLKPAPDTPWCAAVLGQLIAEHTD

SEQ ID NO: 86030 - protein, 21 aa, Mycobacterium avium
VVLVAQAWHWVDPERAIPEVA

SEQ ID NO: 86031 - protein, 19 aa, Mycobacterium avium
VVNLHRRYRITTAQLAAAT

SEQ ID NO: 86032 - protein, 32 aa, Mycobacterium avium
VVPFLHPELKWDFRLPRVVSINVSGHKYGLTY

SEQ ID NO: 86033 - protein, 22 aa, Mycobacterium avium
VVPPDRLQRVLSLVPGNPRLGA

SEQ ID NO: 86034 - protein, 26 aa, Mycobacterium avium
VVQLLRYCLEYGYQLRVIEQMPLDAG

SEQ ID NO: 86035 - protein, 25 aa, Mycobacterium avium
VVQSVCPYCAVGCGQRVYVKDERVV

SEQ ID NO: 86036 - protein, 21 aa, Mycobacterium avium
VVRAADGWVGINCLTGQHWLD

SEQ ID NO: 86037 - protein, 17 aa, Mycobacterium avium
VVRKDTHAHAWALRMSP

SEQ ID NO: 86038 - protein, 25 aa, Mycobacterium avium
VVRLVGNRARAMWVSTFHSTCVRIL

SEQ ID NO: 86039 - protein, 24 aa, Mycobacterium avium
VVRVITSLLLFPGHDEADERAMIE

SEQ ID NO: 86040 - protein, 29 aa, Mycobacterium avium
VVSLFGAQFITWRGIPLIPSDKVPVEDGK

SEQ ID NO: 86041 - protein, 20 aa, Mycobacterium avium
VVSQRRFEVEFSVAAGEVLA

SEQ ID NO: 86042 - protein, 20 aa, Mycobacterium avium
VVSRASWALAQVLKRRGPAG

SEQ ID NO: 86043 - protein, 17 aa, Mycobacterium avium
VVSRKCGVPYLYRFELM

SEQ ID NO: 86044 - protein, 18 aa, Mycobacterium avium
VVTDHVWHRGQQVGLVDV

SEQ ID NO: 86045 - protein, 17 aa, Mycobacterium avium
VVTNWRIATHRLAHSLS

SEQ ID NO: 86046 - protein, 22 aa, Mycobacterium avium
VVTVSSMAHWPGRINLEDLNWR

SEQ ID NO: 86047 - protein, 22 aa, Mycobacterium avium
VVVGCGPGPFTGLRAGMATAAA

SEQ ID NO: 86048 - protein, 19 aa, Mycobacterium avium
VVVLPCGAGKTLVGAAAMA

SEQ ID NO: 86049 - protein, 20 aa, Mycobacterium avium
VVVLPDFGERYLSTPLFADL

SEQ ID NO: 86050 - protein, 18 aa, Mycobacterium avium
VVVTATRLGIPIPGFSSA

SEQ ID NO: 86051 - protein, 26 aa, Mycobacterium avium
VWDFWTSCPETAHLVTLVMGDRGIPR

SEQ ID NO: 86052 - protein, 20 aa, Mycobacterium avium
VWLSNLLAWLTRRASATDVS

SEQ ID NO: 86053 - protein, 27 aa, Mycobacterium avium
VWTSYALMASWCVLAACTDPDAPKHKR

SEQ ID NO: 86054 - protein, 27 aa, Mycobacterium avium
VWVRETLRLGDKFPLKAGMVTSLGFGH

SEQ ID NO: 86055 - protein, 24 aa, Mycobacterium avium
VYAEIRFAPELHINRGMSFDEIVD

SEQ ID NO: 86056 - protein, 22 aa, Mycobacterium avium
VYDFLNTRCLTIAGGTEQILLT

SEQ ID NO: 86057 - protein, 17 aa, Mycobacterium avium
VYFPSLSGQTFVYKGML

SEQ ID NO: 86058 - protein, 24 aa, Mycobacterium avium
VYKMPANRFDLAWSAEKAGAMRNQ

SEQ ID NO: 86059 - protein, 25 aa, Mycobacterium avium
VYLLSRAPGGLGLHAALTGAPFSGA

SEQ ID NO: 86060 - protein, 22 aa, Mycobacterium avium
VYLVHWPDPRMPAAETAGALAE

SEQ ID NO: 86061 - protein, 21 aa, Mycobacterium avium
VYRRWPDTRSIVAALLTRHVT

SEQ ID NO: 86062 - protein, 19 aa, Mycobacterium avium
VYVPCEVCHGARYNRETLE

SEQ ID NO: 86063 - protein, 24 aa, Mycobacterium avium
WAAFARSALFPALVAGLDDGIRDP

SEQ ID NO: 86064 - protein, 17 aa, Mycobacterium avium
WAALTASIGDRVQLVGD

SEQ ID NO: 86065 - protein, 19 aa, Mycobacterium avium
WADDLGRPIDVALQERPRG

SEQ ID NO: 86066 - protein, 18 aa, Mycobacterium avium
WADLIIFAGNCALESMGF

SEQ ID NO: 86067 - protein, 17 aa, Mycobacterium avium
WAGDADVALYLKDETTH

SEQ ID NO: 86068 - protein, 17 aa, Mycobacterium avium
WAGPGDVVLVAGKGHET

SEQ ID NO: 86069 - protein, 26 aa, Mycobacterium avium
WAGSYPDRFIPIAILPTWNPEAMCAE

SEQ ID NO: 86070 - protein, 25 aa, Mycobacterium avium
WAGVMRRLWHGELIFNHDGPMGKYP

SEQ ID NO: 86071 - protein, 20 aa, Mycobacterium avium
WALAGLRVGYALGAPEVLAR

SEQ ID NO: 86072 - protein, 17 aa, Mycobacterium avium
WALLGMMSYEEEVSGYD

SEQ ID NO: 86073 - protein, 19 aa, Mycobacterium avium
WALSIPVPFIKPVGAGAGG

SEQ ID NO: 86074 - protein, 17 aa, Mycobacterium avium
WAPSGANAQGWRFVVLR

SEQ ID NO: 86075 - protein, 22 aa, Mycobacterium avium
WARRNGFNAVRVFLHDLLWEQD

SEQ ID NO: 86076 - protein, 19 aa, Mycobacterium avium
WASIIPQTWIHSLRPPAGA

SEQ ID NO: 86077 - protein, 21 aa, Mycobacterium avium
WASLFPAAWSFCLALRSRGLG

SEQ ID NO: 86078 - protein, 18 aa, Mycobacterium avium
WASPNGHHHSARMFCDIT

SEQ ID NO: 86079 - protein, 21 aa, Mycobacterium avium
WATRAAMPALRIPDFHMSSVS

SEQ ID NO: 86080 - protein, 17 aa, Mycobacterium avium
WATVEGRAELVGPDDAQ

SEQ ID NO: 86081 - protein, 19 aa, Mycobacterium avium
WAVHVALWEAGELVAGAVA

SEQ ID NO: 86082 - protein, 22 aa, Mycobacterium avium
WCALTIRLLGRTEIRRLAKELE

SEQ ID NO: 86083 - protein, 19 aa, Mycobacterium avium
WDAGAAWPPILAAAAEHAA

SEQ ID NO: 86084 - protein, 26 aa, Mycobacterium avium
WDALYRANLRHVLLCTQRIARQLVSV

SEQ ID NO: 86085 - protein, 18 aa, Mycobacterium avium
WDDPALKAVNPGLNLPST

SEQ ID NO: 86086 - protein, 27 aa, Mycobacterium avium
WDFAHEFGLPIVEVIAGGDISEGAYAG

SEQ ID NO: 86087 - protein, 19 aa, Mycobacterium avium
WDGDITGLVRSHLKATLKH

SEQ ID NO: 86088 - protein, 19 aa, Mycobacterium avium
WDITPGDLATIWRGGCIIR

SEQ ID NO: 86089 - protein, 24 aa, Mycobacterium avium
WDKPEIIEKLDLPPGVNVKRVPQW

SEQ ID NO: 86090 - protein, 23 aa, Mycobacterium avium
WDPLRWFEEDEPIYGHPRNPYAR

SEQ ID NO: 86091 - protein, 19 aa, Mycobacterium avium
WDRPIRRSLAFGRGQHFCI

SEQ ID NO: 86092 - protein, 19 aa, Mycobacterium avium
WDRRWPELGLSVGPAEDPD

SEQ ID NO: 86093 - protein, 23 aa, Mycobacterium avium
WDVLGGPVALPFGIAPTGFTRLM

SEQ ID NO: 86094 - protein, 17 aa, Mycobacterium avium
WEAAGLRNDGRVVKVQA

SEQ ID NO: 86095 - protein, 20 aa, Mycobacterium avium
WEALERAGIDPVKLRGSATG

SEQ ID NO: 86096 - protein, 18 aa, Mycobacterium avium
WEDIKLAVEYDGDQHRTD

SEQ ID NO: 86097 - protein, 20 aa, Mycobacterium avium
WEFLDRLTSIALPRIRDFRG

SEQ ID NO: 86098 - protein, 20 aa, Mycobacterium avium
WEFNQPWSIEEIEIGDPQAH

SEQ ID NO: 86099 - protein, 20 aa, Mycobacterium avium
WEINEAFASVPIAACREYGL

SEQ ID NO: 86100 - protein, 19 aa, Mycobacterium avium
WELEDLSFAILHPKKYDEI

SEQ ID NO: 86101 - protein, 28 aa, Mycobacterium avium
WELTATRLGRFVGLVVIDRGHPRAADRD

SEQ ID NO: 86102 - protein, 22 aa, Mycobacterium avium
WESNWPLARWRRYLRAQLDGEF

SEQ ID NO: 86103 - protein, 17 aa, Mycobacterium avium
WEVLPRIYAEHRPARPG

SEQ ID NO: 86104 - protein, 26 aa, Mycobacterium avium
WEVQGRGELALAVLVEQMRREGFELT

SEQ ID NO: 86105 - protein, 19 aa, Mycobacterium avium
WFDIEPCYVYHPLNAYSEI

SEQ ID NO: 86106 - protein, 17 aa, Mycobacterium avium
WFETVAIAQQRAKRRLP

SEQ ID NO: 86107 - protein, 17 aa, Mycobacterium avium
WFPSLKIYNRNGQLYTA

SEQ ID NO: 86108 - protein, 17 aa, Mycobacterium avium
WFQRGPLDEAIRASIAI

SEQ ID NO: 86109 - protein, 17 aa, Mycobacterium avium
WFRTGDLGRLDRDQNLT

SEQ ID NO: 86110 - protein, 17 aa, Mycobacterium avium
WFVDPALPTGTVRRDIF

SEQ ID NO: 86111 - protein, 18 aa, Mycobacterium avium
WGAAVVWNAPLLHPDRVA

SEQ ID NO: 86112 - protein, 19 aa, Mycobacterium avium
WGADVIKVEHPVRGDTQRG

SEQ ID NO: 86113 - protein, 30 aa, Mycobacterium avium
WGAYLTGMWLYRLSLAKAKWHALTGRPLTG

SEQ ID NO: 86114 - protein, 25 aa, Mycobacterium avium
WGDDWDAFFCVVDLHAITIAQDPAA

SEQ ID NO: 86115 - protein, 17 aa, Mycobacterium avium
WGGPPIGAMVFRDPALL

SEQ ID NO: 86116 - protein, 19 aa, Mycobacterium avium
WGIAAAMTRGDISVTGVDP

SEQ ID NO: 86117 - protein, 17 aa, Mycobacterium avium
WGLEYLFGVLEAGPSGR

SEQ ID NO: 86118 - protein, 17 aa, Mycobacterium avium
WGPAYATETHYLRVYLA

SEQ ID NO: 86119 - protein, 17 aa, Mycobacterium avium
WGRRHVVMGANQVDRFG

SEQ ID NO: 86120 - protein, 18 aa, Mycobacterium avium
WGSSYGPIGEACRRARRK

SEQ ID NO: 86121 - protein, 26 aa, Mycobacterium avium
WGTTWSTSLKSLWMGDGEAVGDVTVG

SEQ ID NO: 86122 - protein, 27 aa, Mycobacterium avium
WGVRDWWSMDWIWSALHLDDGTHLHGV

SEQ ID NO: 86123 - protein, 19 aa, Mycobacterium avium
WHGEFQLDHCGALLDVEPM

SEQ ID NO: 86124 - protein, 17 aa, Mycobacterium avium
WHGGLGFTDKCCAPLSI

SEQ ID NO: 86125 - protein, 19 aa, Mycobacterium avium
WHGLRRWLGEPEDFQDPKY

SEQ ID NO: 86126 - protein, 25 aa, Mycobacterium avium
WHRGAREVQLGLAMLARLVGQAGEA

SEQ ID NO: 86127 - protein, 17 aa, Mycobacterium avium
WHRGELEVPLPGGETGS

SEQ ID NO: 86128 - protein, 18 aa, Mycobacterium avium
WHYFFQNTCRWRDLRKIT

SEQ ID NO: 86129 - protein, 17 aa, Mycobacterium avium
WIASRWPGLLPEVQRLL

SEQ ID NO: 86130 - protein, 19 aa, Mycobacterium avium
WIEQMKRIGIYGLAVPEEY

SEQ ID NO: 86131 - protein, 21 aa, Mycobacterium avium
WIERFERCWELLGDRRGVLLV

SEQ ID NO: 86132 - protein, 20 aa, Mycobacterium avium
WIGGRGRLVSFSVQNRAVAY

SEQ ID NO: 86133 - protein, 20 aa, Mycobacterium avium
WIKAQAYRLQTFGTVTRLAA

SEQ ID NO: 86134 - protein, 22 aa, Mycobacterium avium
WILNGAKCWITNGGKSSWYTVM

SEQ ID NO: 86135 - protein, 20 aa, Mycobacterium avium
WIRDGGWNIADCVQRSYDVE

SEQ ID NO: 86136 - protein, 20 aa, Mycobacterium avium
WISELGLAGFGDYLPKSLSG

SEQ ID NO: 86137 - protein, 20 aa, Mycobacterium avium
WKDSLSIGWQGNGAEALRSR

SEQ ID NO: 86138 - protein, 17 aa, Mycobacterium avium
WKFTREFMPVRFEVDEP

SEQ ID NO: 86139 - protein, 20 aa, Mycobacterium avium
WKGGEFRTGHKMNGQLEKAG

SEQ ID NO: 86140 - protein, 24 aa, Mycobacterium avium
WKIGWACGPAHLIAGVRAAKQYLS

SEQ ID NO: 86141 - protein, 29 aa, Mycobacterium avium
WKLASDLDRFGEWMTIFAGWRGPVPDTIG

SEQ ID NO: 86142 - protein, 17 aa, Mycobacterium avium
WKLFIDAFVEFYHAPIL

SEQ ID NO: 86143 - protein, 19 aa, Mycobacterium avium
WKYLMAKFNATIDERADPK

SEQ ID NO: 86144 - protein, 19 aa, Mycobacterium avium
WLAARAEGLGMGWVSLFEP

SEQ ID NO: 86145 - protein, 19 aa, Mycobacterium avium
WLALGRDLEAWPQPRADDS

SEQ ID NO: 86146 - protein, 19 aa, Mycobacterium avium
WLAPYTGSAIAQHWMYDGK

SEQ ID NO: 86147 - protein, 26 aa, Mycobacterium avium
WLATSRELPWRRPIASLNYLLTSHVW

SEQ ID NO: 86148 - protein, 26 aa, Mycobacterium avium
WLCDNARPGMRIHVLAPSGNFVPKTL

SEQ ID NO: 86149 - protein, 19 aa, Mycobacterium avium
WLCSVMGKSGLFSDYLIKM

SEQ ID NO: 86150 - protein, 17 aa, Mycobacterium avium
WLDGALPTFSSWVNPAA

SEQ ID NO: 86151 - protein, 17 aa, Mycobacterium avium
WLEDLWRRNVWQARHGG

SEQ ID NO: 86152 - protein, 20 aa, Mycobacterium avium
WLEGLFHGIQTALFAQQMAA

SEQ ID NO: 86153 - protein, 21 aa, Mycobacterium avium
WLHRHGVTIWDEWASDTGDLG

SEQ ID NO: 86154 - protein, 18 aa, Mycobacterium avium
WLIRVFLALWGWPLKDPA

SEQ ID NO: 86155 - protein, 18 aa, Mycobacterium avium
WLNLGFAVRADWLAREHP

SEQ ID NO: 86156 - protein, 19 aa, Mycobacterium avium
WLNRFRWNRCTTGDTRNGR

SEQ ID NO: 86157 - protein, 17 aa, Mycobacterium avium
WLPEERILFTGNLFGPL

SEQ ID NO: 86158 - protein, 25 aa, Mycobacterium avium
WLPYPGDNVLLCLGMCGQMIYVNRA

SEQ ID NO: 86159 - protein, 20 aa, Mycobacterium avium
WLRDGIVCPAQLGTAGYLFE

SEQ ID NO: 86160 - protein, 20 aa, Mycobacterium avium
WLRNSTRGALAMDPRRMAMM

SEQ ID NO: 86161 - protein, 18 aa, Mycobacterium avium
WLTDKGFRSFAGHRLDVR

SEQ ID NO: 86162 - protein, 17 aa, Mycobacterium avium
WMTRLVLGLGSGVQVLA

SEQ ID NO: 86163 - protein, 17 aa, Mycobacterium avium
WNAAIMVHRAQRPGVGV

SEQ ID NO: 86164 - protein, 23 aa, Mycobacterium avium
WNCDKGRWAFSYATQPDVITTPL

SEQ ID NO: 86165 - protein, 19 aa, Mycobacterium avium
WNLDFASALTRLLTATCIG

SEQ ID NO: 86166 - protein, 20 aa, Mycobacterium avium
WNLDLGDLVPALSVRAAPTE

SEQ ID NO: 86167 - protein, 23 aa, Mycobacterium avium
WNLSGLKAALAIAGPEAAADLNR

SEQ ID NO: 86168 - protein, 24 aa, Mycobacterium avium
WNRSDYRPLDGFVYAITPFNFTSI

SEQ ID NO: 86169 - protein, 20 aa, Mycobacterium avium
WNSIRHAKPIAVGLNCALGA

SEQ ID NO: 86170 - protein, 22 aa, Mycobacterium avium
WNSPRARAYRAHYGFADRHGTA

SEQ ID NO: 86171 - protein, 25 aa, Mycobacterium avium
WPAALRRVGFDAAQPTAWVAEQLLV

SEQ ID NO: 86172 - protein, 25 aa, Mycobacterium avium
WPDKPGVAGCAAMDGTVLVNLINTK

SEQ ID NO: 86173 - protein, 19 aa, Mycobacterium avium
WPGGVTVYDIRIEAMTPLA

SEQ ID NO: 86174 - protein, 19 aa, Mycobacterium avium
WPGLIEAYRDRLPVGDDWT

SEQ ID NO: 86175 - protein, 20 aa, Mycobacterium avium
WPGRSTHGAVIYELHLGTFT

SEQ ID NO: 86176 - protein, 25 aa, Mycobacterium avium
WPKEHGGGGGSVWQQTVLREEMWAQ

SEQ ID NO: 86177 - protein, 27 aa, Mycobacterium avium
WPLEYVDSFAGLVPRLGSAGTTHPVRL

SEQ ID NO: 86178 - protein, 17 aa, Mycobacterium avium
WPNIVAAQLDWDVELIG

SEQ ID NO: 86179 - protein, 18 aa, Mycobacterium avium
WPQFRSLDWRAVAQDAPL

SEQ ID NO: 86180 - protein, 20 aa, Mycobacterium avium
WPRHRRLSLTAEDARSAAVV

SEQ ID NO: 86181 - protein, 25 aa, Mycobacterium avium
WPTFADIPPGWRVVFGEADRTACLQ

SEQ ID NO: 86182 - protein, 21 aa, Mycobacterium avium
WPTSRGFERFYGFLGGETDQW

SEQ ID NO: 86183 - protein, 25 aa, Mycobacterium avium
WPVVAEPFTAWVLEDKFADGRPPLE

SEQ ID NO: 86184 - protein, 20 aa, Mycobacterium avium
WQLDTLPIVLSAADWEPLEA

SEQ ID NO: 86185 - protein, 18 aa, Mycobacterium avium
WQLGMTRHFLAGDAQPRY

SEQ ID NO: 86186 - protein, 19 aa, Mycobacterium avium
WQLRDYQQMAADSFWSGGS

SEQ ID NO: 86187 - protein, 28 aa, Mycobacterium avium
WQVLRLPRIPMRFPMYLPGPNRVMIVDE

SEQ ID NO: 86188 - protein, 31 aa, Mycobacterium avium
WRAEEPVVIVAPMFHAWGFSQLLLAASFACP

SEQ ID NO: 86189 - protein, 20 aa, Mycobacterium avium
WRALADVLLSSAVPAAGSSL

SEQ ID NO: 86190 - protein, 19 aa, Mycobacterium avium
WRALWKTVVDLGWTELAAA

SEQ ID NO: 86191 - protein, 24 aa, Mycobacterium avium
WRAPSAKNRQPWDFVIVTDRTQLQ

SEQ ID NO: 86192 - protein, 26 aa, Mycobacterium avium
WRAPSPPGRWRTLGLFAAADDNALEQ

SEQ ID NO: 86193 - protein, 25 aa, Mycobacterium avium
WREVHRLRQPVLLIWGREDRVNPLD

SEQ ID NO: 86194 - protein, 20 aa, Mycobacterium avium
WRIATHRLAHSLSDLAVSPD

SEQ ID NO: 86195 - protein, 20 aa, Mycobacterium avium
WRILKFRPRESDAAASPVPD

SEQ ID NO: 86196 - protein, 20 aa, Mycobacterium avium
WRKRLLRKAIDFTDPLRYAP

SEQ ID NO: 86197 - protein, 21 aa, Mycobacterium avium
WRMPIVRDEPIRDWVKLAVTR

SEQ ID NO: 86198 - protein, 17 aa, Mycobacterium avium
WRPSGALFDQFLGAAET

SEQ ID NO: 86199 - protein, 26 aa, Mycobacterium avium
WRQADKYDVPRICFVNKMDKIGADFY

SEQ ID NO: 86200 - protein, 28 aa, Mycobacterium avium
WRRFSSWADDVFKAFSFTVDLREVEPVV

SEQ ID NO: 86201 - protein, 24 aa, Mycobacterium avium
WRRGTLPPGQLGWRRVTEIRDQAA

SEQ ID NO: 86202 - protein, 20 aa, Mycobacterium avium
WRRIGLIDCGERWAVFNTGM

SEQ ID NO: 86203 - protein, 21 aa, Mycobacterium avium
WRRWWPDLRLQVVEDRGDKGI

SEQ ID NO: 86204 - protein, 30 aa, Mycobacterium avium
WRSGDTALYRYLWRSVLAFDGATRFRARLA

SEQ ID NO: 86205 - protein, 23 aa, Mycobacterium avium
WRYIRAAVPAVWGYTRREPMLTL

SEQ ID NO: 86206 - protein, 19 aa, Mycobacterium avium
WSAAMAKSSLGAGLASPGH

SEQ ID NO: 86207 - protein, 17 aa, Mycobacterium avium
WSAPRLRIRAGSLVIPA

SEQ ID NO: 86208 - protein, 21 aa, Mycobacterium avium
WSDGKNFYALGGQDWEPGQSK

SEQ ID NO: 86209 - protein, 26 aa, Mycobacterium avium
WSLEVIDLRSLVPLDFDTIATSIHRT

SEQ ID NO: 86210 - protein, 17 aa, Mycobacterium avium
WSNAGLIAGDGASLLVD

SEQ ID NO: 86211 - protein, 24 aa, Mycobacterium avium
WSPKRLPESLLHYMRTRGQDKVIF

SEQ ID NO: 86212 - protein, 19 aa, Mycobacterium avium
WSQGMPLAYTRELADYWAN

SEQ ID NO: 86213 - protein, 18 aa, Mycobacterium avium
WSSKLVHGGLRYLASGNV

SEQ ID NO: 86214 - protein, 23 aa, Mycobacterium avium
WSVRPQPLVPLYLRRPDATPRAA

SEQ ID NO: 86215 - protein, 22 aa, Mycobacterium avium
WTDDGLPLGVQFVGKLGADGDL

SEQ ID NO: 86216 - protein, 17 aa, Mycobacterium avium
WTIGPKVHGGAMLALCA

SEQ ID NO: 86217 - protein, 19 aa, Mycobacterium avium
WTNPHCARAGSVHLGGSFA

SEQ ID NO: 86218 - protein, 17 aa, Mycobacterium avium
WTNYQWHQLARTFLMYR

SEQ ID NO: 86219 - protein, 24 aa, Mycobacterium avium
WTRVPYEVLERISTRITNEVPEVN

SEQ ID NO: 86220 - protein, 24 aa, Mycobacterium avium
WTSGAADPRCKILIVMGRTNPDAA

SEQ ID NO: 86221 - protein, 26 aa, Mycobacterium avium
WTTSPLRPWPGFAPMLYERYSQPFFD

SEQ ID NO: 86222 - protein, 18 aa, Mycobacterium avium
WVAKLAVDFRQKFKKDVV

SEQ ID NO: 86223 - protein, 18 aa, Mycobacterium avium
WVEYEPYGTVLIIGAWNY

SEQ ID NO: 86224 - protein, 28 aa, Mycobacterium avium
WVMSDWGATPGWECALGGLDQECGAQID

SEQ ID NO: 86225 - protein, 24 aa, Mycobacterium avium
WVNMLRCTLAAFGAGVGGADSLLV

SEQ ID NO: 86226 - protein, 27 aa, Mycobacterium avium
WVPGDLRPGDLIGVAATGAYCYSLSSR

SEQ ID NO: 86227 - protein, 24 aa, Mycobacterium avium
WVPLHEVPEVWAAVTSVFRDYGYR

SEQ ID NO: 86228 - protein, 18 aa, Mycobacterium avium
WVPPPPFTWDYRLFAGPH

SEQ ID NO: 86229 - protein, 17 aa, Mycobacterium avium
WVPYFPLGSAFPGLPKV

SEQ ID NO: 86230 - protein, 21 aa, Mycobacterium avium
WVRGEAMMREALAQLGKAAST

SEQ ID NO: 86231 - protein, 18 aa, Mycobacterium avium
WVRPELVVQIGFTEWTRD

SEQ ID NO: 86232 - protein, 19 aa, Mycobacterium avium
WVSGEDRLLVTVLIGHLSL

SEQ ID NO: 86233 - protein, 21 aa, Mycobacterium avium
WVTPVKEFMRTAAKDTVVRGV

SEQ ID NO: 86234 - protein, 21 aa, Mycobacterium avium
WVVFEEEYFRAGAPGRASANG

SEQ ID NO: 86235 - protein, 18 aa, Mycobacterium avium
WWAAPTILEHGTPEQIER

SEQ ID NO: 86236 - protein, 23 aa, Mycobacterium avium
WWAATQDPRAWAALPRAGAVIFA

SEQ ID NO: 86237 - protein, 25 aa, Mycobacterium avium
WWDPDQRRWVGYDVPDFVVDRAPGA

SEQ ID NO: 86238 - protein, 17 aa, Mycobacterium avium
WWGEAATADNDWAYDYL

SEQ ID NO: 86239 - protein, 17 aa, Mycobacterium avium
WWQERRRQWQIHSVGPD

SEQ ID NO: 86240 - protein, 18 aa, Mycobacterium avium
WYAAPLLVAGGRGLIAFT

SEQ ID NO: 86241 - protein, 20 aa, Mycobacterium avium
WYGQRFPKPLARTREYIDII

SEQ ID NO: 86242 - protein, 18 aa, Mycobacterium avium
WYGTGSAFEQWIAAGPQS

SEQ ID NO: 86243 - protein, 27 aa, Mycobacterium avium
WYTVLACFKLGIVIEGTLARACAGQAE

SEQ ID NO: 86244 - protein, 18 aa, Mycobacterium avium
YAALMAGADLVLPDCHLD

SEQ ID NO: 86245 - protein, 19 aa, Mycobacterium avium
YADGCPIGTVACEVASSNE

SEQ ID NO: 86246 - protein, 26 aa, Mycobacterium avium
YADQAALDWHNFVAFRGRELAPEGRL

SEQ ID NO: 86247 - protein, 20 aa, Mycobacterium avium
YAERHGWTVTVLDEITSDLG

SEQ ID NO: 86248 - protein, 21 aa, Mycobacterium avium
YAGAFPAWLAPVQAVGIPVAD

SEQ ID NO: 86249 - protein, 25 aa, Mycobacterium avium
YAGDVSPLEAWKLLSDNPNAVLVDV

SEQ ID NO: 86250 - protein, 20 aa, Mycobacterium avium
YAGEAWIHVQLLPSVDSKGL

SEQ ID NO: 86251 - protein, 17 aa, Mycobacterium avium
YAGLTTDTGSFRWASAR

SEQ ID NO: 86252 - protein, 17 aa, Mycobacterium avium
YAGRGAVRVAVADREGR

SEQ ID NO: 86253 - protein, 21 aa, Mycobacterium avium
YAGYCSDFGRTWVVGREPTPR

SEQ ID NO: 86254 - protein, 19 aa, Mycobacterium avium
YALFLGRYAPYKGAHLALR

SEQ ID NO: 86255 - protein, 29 aa, Mycobacterium avium
YAQEIFEGLKAYRWADGSIVSFRAQANAA

SEQ ID NO: 86256 - protein, 21 aa, Mycobacterium avium
YARQRPRLLVDWLDGDPGDLD

SEQ ID NO: 86257 - protein, 20 aa, Mycobacterium avium
YARVHFDGVVVPRSAAVGTA

SEQ ID NO: 86258 - protein, 17 aa, Mycobacterium avium
YASRPLLELPWDIEESP

SEQ ID NO: 86259 - protein, 20 aa, Mycobacterium avium
YAYAVLRRAAERAGEAPPRL

SEQ ID NO: 86260 - protein, 20 aa, Mycobacterium avium
YCMGGRTSLIVAGRLPDRVA

SEQ ID NO: 86261 - protein, 17 aa, Mycobacterium avium
YDADKGFGFLSQEDGED

SEQ ID NO: 86262 - protein, 24 aa, Mycobacterium avium
YDAIDQWAFCALNTSPGARLFYDR

SEQ ID NO: 86263 - protein, 18 aa, Mycobacterium avium
YDDFFKRTFDIMPDDGRM

SEQ ID NO: 86264 - protein, 23 aa, Mycobacterium avium
YDDPEKWMYAAWMQLTDKGEQLA

SEQ ID NO: 86265 - protein, 25 aa, Mycobacterium avium
YDELKPDAWLANIFREEMCRLGRQP

SEQ ID NO: 86266 - protein, 19 aa, Mycobacterium avium
YDEPPLWPYPVRQTLASIL

SEQ ID NO: 86267 - protein, 20 aa, Mycobacterium avium
YDEPRWWSRRGWQHRQAAGL

SEQ ID NO: 86268 - protein, 18 aa, Mycobacterium avium
YDHFTPFVFVQLEELGFC

SEQ ID NO: 86269 - protein, 22 aa, Mycobacterium avium
YDIRAAASLGFQTAFVTRPFEF

SEQ ID NO: 86270 - protein, 24 aa, Mycobacterium avium
YDIYLKYLRGCAELFRDGYTNVCQ

SEQ ID NO: 86271 - protein, 22 aa, Mycobacterium avium
YDIYRGVVTYVRVVDGKITPRE

SEQ ID NO: 86272 - protein, 25 aa, Mycobacterium avium
YDLELALRLGAPVERVAQASGVDPW

SEQ ID NO: 86273 - protein, 24 aa, Mycobacterium avium
YDLMARKVIPHFKRQLDASRASHD

SEQ ID NO: 86274 - protein, 24 aa, Mycobacterium avium
YDMPARAKESFGIQKRQRQMDRAR

SEQ ID NO: 86275 - protein, 25 aa, Mycobacterium avium
YDPWFAKARTSGAIQAREMDEGMLR

SEQ ID NO: 86276 - protein, 20 aa, Mycobacterium avium
YDTGLSLPAVCDLEPYWEAL

SEQ ID NO: 86277 - protein, 24 aa, Mycobacterium avium
YDVKRAETGIIYIDEVDKIARKSE

SEQ ID NO: 86278 - protein, 19 aa, Mycobacterium avium
YDVPALVALMAGIAQRRVR

SEQ ID NO: 86279 - protein, 17 aa, Mycobacterium avium
YDWDYLAKFVDRGVWQR

SEQ ID NO: 86280 - protein, 21 aa, Mycobacterium avium
YDWYADLPVASPQVFGDQTDV

SEQ ID NO: 86281 - protein, 19 aa, Mycobacterium avium
YEELGAFGLLKRFAKGWVV

SEQ ID NO: 86282 - protein, 20 aa, Mycobacterium avium
YEELNLLVAPMVRTGAEPIG

SEQ ID NO: 86283 - protein, 17 aa, Mycobacterium avium
YEEPAFDIFALLPPPGD

SEQ ID NO: 86284 - protein, 20 aa, Mycobacterium avium
YEGRPSWVRLDRVLVVPEEG

SEQ ID NO: 86285 - protein, 20 aa, Mycobacterium avium
YEKPGMALAHSFFTPLGAEL

SEQ ID NO: 86286 - protein, 19 aa, Mycobacterium avium
YELLGRGDTLGVFQLDGGP

SEQ ID NO: 86287 - protein, 23 aa, Mycobacterium avium
YELLKLRVEVFVVEQAIPYPELD

SEQ ID NO: 86288 - protein, 17 aa, Mycobacterium avium
YELVQRLTAQPKYVQAG

SEQ ID NO: 86289 - protein, 29 aa, Mycobacterium avium
YENPANLFVAGFIGSPAMNFFPATLTPIG

SEQ ID NO: 86290 - protein, 24 aa, Mycobacterium avium
YEQLPVYALPLFVRVVDSIEQTTT

SEQ ID NO: 86291 - protein, 21 aa, Mycobacterium avium
YERHIACTRLPALRETMRRSL

SEQ ID NO: 86292 - protein, 17 aa, Mycobacterium avium
YERISGLRFDDWIGPRA

SEQ ID NO: 86293 - protein, 19 aa, Mycobacterium avium
YERLGIPTIATVPWTTDRL

SEQ ID NO: 86294 - protein, 21 aa, Mycobacterium avium
YESVFGWPVLLEVPDNADAST

SEQ ID NO: 86295 - protein, 17 aa, Mycobacterium avium
YETSSAEQVRWVLQDSE

SEQ ID NO: 86296 - protein, 26 aa, Mycobacterium avium
YEVKGCIAHGGLGWVYLAVDHNVNDR

SEQ ID NO: 86297 - protein, 26 aa, Mycobacterium avium
YEVMDRLKPAIILCREKQDSTTATLF

SEQ ID NO: 86298 - protein, 24 aa, Mycobacterium avium
YFDQGLRFYFGFNNREAYRAFKKA

SEQ ID NO: 86299 - protein, 17 aa, Mycobacterium avium
YFEDCVRPLLTDNDHVF

SEQ ID NO: 86300 - protein, 17 aa, Mycobacterium avium
YFMRRLAERPANLTFFL

SEQ ID NO: 86301 - protein, 18 aa, Mycobacterium avium
YFRSAIEAAIDGWRRVVV

SEQ ID NO: 86302 - protein, 23 aa, Mycobacterium avium
YFSAARRGLVPGPFEFLRVIGAY

SEQ ID NO: 86303 - protein, 17 aa, Mycobacterium avium
YFTRMMAGLGDELGFDV

SEQ ID NO: 86304 - protein, 23 aa, Mycobacterium avium
YGACPECSGLGIRKEVDPDLVVP

SEQ ID NO: 86305 - protein, 19 aa, Mycobacterium avium
YGAVWQREDIGVITTVIDV

SEQ ID NO: 86306 - protein, 28 aa, Mycobacterium avium
YGAYEICIDPSFSIARLSLLDRGMVFAI

SEQ ID NO: 86307 - protein, 25 aa, Mycobacterium avium
YGDAELPWSRVLEAMRALPSPETPQ

SEQ ID NO: 86308 - protein, 21 aa, Mycobacterium avium
YGFGSMVMSLLGFDHQVATFA

SEQ ID NO: 86309 - protein, 24 aa, Mycobacterium avium
YGGLQFKPATWARYGGVGNPAAAS

SEQ ID NO: 86310 - protein, 18 aa, Mycobacterium avium
YGLAAADGVMRWLEEHDR

SEQ ID NO: 86311 - protein, 27 aa, Mycobacterium avium
YGLFFRDARVLSRWELRVDGQVAEALS

SEQ ID NO: 86312 - protein, 19 aa, Mycobacterium avium
YGLHGPWRDYVGWALNFEQ

SEQ ID NO: 86313 - protein, 26 aa, Mycobacterium avium
YGLIEWKMDLELGAHYYVKFANPDVV

SEQ ID NO: 86314 - protein, 17 aa, Mycobacterium avium
YGLRRYIEFNSLVDRAH

SEQ ID NO: 86315 - protein, 24 aa, Mycobacterium avium
YGMVADPFGHHWSLGQPVREVSPE

SEQ ID NO: 86316 - protein, 18 aa, Mycobacterium avium
YGNSKWAGEVLLREAHDL

SEQ ID NO: 86317 - protein, 20 aa, Mycobacterium avium
YGQHVALDFVARIRGQHKFD

SEQ ID NO: 86318 - protein, 24 aa, Mycobacterium avium
YGQMWAQDVAAMFSYAAASESAGE

SEQ ID NO: 86319 - protein, 22 aa, Mycobacterium avium
YGRFLPAWHRVGAAESSRAPGH

SEQ ID NO: 86320 - protein, 17 aa, Mycobacterium avium
YGRPRFADRLRGRVYAR

SEQ ID NO: 86321 - protein, 24 aa, Mycobacterium avium
YGSASILPISWAYIRMMGADGLRA

SEQ ID NO: 86322 - protein, 20 aa, Mycobacterium avium
YGSFHRSFQLPGHVTDDDIT

SEQ ID NO: 86323 - protein, 19 aa, Mycobacterium avium
YGSSVVGFQDGWRGLLENR

SEQ ID NO: 86324 - protein, 18 aa, Mycobacterium avium
YHALRASNRIAIERGTHF

SEQ ID NO: 86325 - protein, 25 aa, Mycobacterium avium
YHELEAMPDLVARVLATIKPVAALA

SEQ ID NO: 86326 - protein, 23 aa, Mycobacterium avium
YHGAEGLTAIARRVHGHAEAIAA

SEQ ID NO: 86327 - protein, 18 aa, Mycobacterium avium
YHGWRYDLTGALKFVQQE

SEQ ID NO: 86328 - protein, 17 aa, Mycobacterium avium
YHRGDLVARLHADGRVQ

SEQ ID NO: 86329 - protein, 25 aa, Mycobacterium avium
YHSVWLPDHMVSFWPDSIWAPEFTD

SEQ ID NO: 86330 - protein, 17 aa, Mycobacterium avium
YIEFNSLVDRAHWDDDE

SEQ ID NO: 86331 - protein, 18 aa, Mycobacterium avium
YISYLRKKIDSGREPMIH

SEQ ID NO: 86332 - protein, 20 aa, Mycobacterium avium
YKGLRARNFVMFGPPGRLYT

SEQ ID NO: 86333 - protein, 32 aa, Mycobacterium avium
YKGTADLFLWPTLYLWEFPKPTISQIHGYCMG

SEQ ID NO: 86334 - protein, 20 aa, Mycobacterium avium
YKKSNVMFGIDLAKRDIAKG

SEQ ID NO: 86335 - protein, 18 aa, Mycobacterium avium
YKLVNLRVNAAMTKGALN

SEQ ID NO: 86336 - protein, 22 aa, Mycobacterium avium
YKMVFGHRGINIPVIDHATGRV

SEQ ID NO: 86337 - protein, 20 aa, Mycobacterium avium
YKPLNWMSPPCWLREEAGDA

SEQ ID NO: 86338 - protein, 23 aa, Mycobacterium avium
YKRATLRKLGVEYVYDSRSTDFA

SEQ ID NO: 86339 - protein, 23 aa, Mycobacterium avium
YKVGLASVRYLLAVGDLLIGWRL

SEQ ID NO: 86340 - protein, 25 aa, Mycobacterium avium
YLADPAATMDAVWDDVLDRIGWLQA

SEQ ID NO: 86341 - protein, 21 aa, Mycobacterium avium
YLAGLARRRQPVLIRVTPDID

SEQ ID NO: 86342 - protein, 19 aa, Mycobacterium avium
YLDAASLSPFVTWGTNPGQ

SEQ ID NO: 86343 - protein, 19 aa, Mycobacterium avium
YLDICAEVANAGYKGFSLV

SEQ ID NO: 86344 - protein, 21 aa, Mycobacterium avium
YLEGKALPGIEVLGRPQPTGG

SEQ ID NO: 86345 - protein, 17 aa, Mycobacterium avium
YLGDRLEGVITVEIAAD

SEQ ID NO: 86346 - protein, 18 aa, Mycobacterium avium
YLHYRMIDVSSIKELCRR

SEQ ID NO: 86347 - protein, 23 aa, Mycobacterium avium
YLIERGPARMVLRMPGARADAAR

SEQ ID NO: 86348 - protein, 17 aa, Mycobacterium avium
YLLGDVLDLRGQPDAKP

SEQ ID NO: 86349 - protein, 17 aa, Mycobacterium avium
YLMRALPRVARAVSSNP

SEQ ID NO: 86350 - protein, 17 aa, Mycobacterium avium
YLMSRQTPFSAIIAGLT

SEQ ID NO: 86351 - protein, 23 aa, Mycobacterium avium
YLMVSLRSLPLVMVIGRPEVRIP

SEQ ID NO: 86352 - protein, 19 aa, Mycobacterium avium
YLMWVCRDDGMLVCVAQCR

SEQ ID NO: 86353 - protein, 18 aa, Mycobacterium avium
YLNPFPANLGEVLRRYPQ

SEQ ID NO: 86354 - protein, 24 aa, Mycobacterium avium
YLRMDDFPARLVIVPGERDHLLEA

SEQ ID NO: 86355 - protein, 24 aa, Mycobacterium avium
YLSGGTRRNLDWVAPHVDLSGVGE

SEQ ID NO: 86356 - protein, 18 aa, Mycobacterium avium
YLSPRQRAVLLLRDVLGW

SEQ ID NO: 86357 - protein, 25 aa, Mycobacterium avium
YLSRGRLSVEVMARGTAWLDTGTFD

SEQ ID NO: 86358 - protein, 19 aa, Mycobacterium avium
YLSTYGPERVRSVVFASSV

SEQ ID NO: 86359 - protein, 18 aa, Mycobacterium avium
YLTGCADLFREGYTDVAQ

SEQ ID NO: 86360 - protein, 19 aa, Mycobacterium avium
YLTMLSWNALKGIVEVGGS

SEQ ID NO: 86361 - protein, 26 aa, Mycobacterium avium
YMIRVKEMWESIKIVEQCLDKLQPGP

SEQ ID NO: 86362 - protein, 22 aa, Mycobacterium avium
YNGAEVMGYMGFGRPLDEIPML

SEQ ID NO: 86363 - protein, 17 aa, Mycobacterium avium
YNHGFLRARMQLLHDEA

SEQ ID NO: 86364 - protein, 24 aa, Mycobacterium avium
YNHIKIKEAYGLTKQYVAQKLANQ

SEQ ID NO: 86365 - protein, 22 aa, Mycobacterium avium
YNHYPIGWAMAFNTPYKLYKRY

SEQ ID NO: 86366 - protein, 22 aa, Mycobacterium avium
YNKLFEERIIFLGVQVDDASAN

SEQ ID NO: 86367 - protein, 18 aa, Mycobacterium avium
YNLLHAWLQTPLTFAKWD

SEQ ID NO: 86368 - protein, 18 aa, Mycobacterium avium
YNPGHLMVVPYRRVSELE

SEQ ID NO: 86369 - protein, 18 aa, Mycobacterium avium
YNPLWPNVDELVRLLESG

SEQ ID NO: 86370 - protein, 17 aa, Mycobacterium avium
YPDIEFSALVASPNGAR

SEQ ID NO: 86371 - protein, 24 aa, Mycobacterium avium
YPDLHVKAAALLHSLARNHALVDG

SEQ ID NO: 86372 - protein, 18 aa, Mycobacterium avium
YPDLKFAFSEGGIGWIPF

SEQ ID NO: 86373 - protein, 20 aa, Mycobacterium avium
YPDVDFRSVVQWLHTATLFL

SEQ ID NO: 86374 - protein, 24 aa, Mycobacterium avium
YPEFLPERLRGVIAEHIGVPAELV

SEQ ID NO: 86375 - protein, 25 aa, Mycobacterium avium
YPGRFIPCGILPLFDVAEAAKEVNR

SEQ ID NO: 86376 - protein, 34 aa, Mycobacterium avium
YPILEHIDRLVPGDIIWAPAIDGAFVLTTRGGDF

SEQ ID NO: 86377 - protein, 24 aa, Mycobacterium avium
YPKIVLVTGACRFLGGYLTARLAQ

SEQ ID NO: 86378 - protein, 19 aa, Mycobacterium avium
YPLLGPWGAARVFGPQKGA

SEQ ID NO: 86379 - protein, 17 aa, Mycobacterium avium
YPMVYDMPARAKESFGI

SEQ ID NO: 86380 - protein, 18 aa, Mycobacterium avium
YPPKYARDSIPVINSYPD

SEQ ID NO: 86381 - protein, 21 aa, Mycobacterium avium
YPQMLLRIGWPPINADPLPAT

SEQ ID NO: 86382 - protein, 22 aa, Mycobacterium avium
YPSIGCAPCTAKPAPGEDPRSG

SEQ ID NO: 86383 - protein, 17 aa, Mycobacterium avium
YPTKLVVTRTMSKAFAF

SEQ ID NO: 86384 - protein, 20 aa, Mycobacterium avium
YPYLPSHPQYDLAKRQMSGG

SEQ ID NO: 86385 - protein, 19 aa, Mycobacterium avium
YPYYKRLRDEAPLYRNDEL

SEQ ID NO: 86386 - protein, 17 aa, Mycobacterium avium
YQAADWLREHARIDVGM

SEQ ID NO: 86387 - protein, 18 aa, Mycobacterium avium
YQAKLDWVEKFMAEELEP

SEQ ID NO: 86388 - protein, 26 aa, Mycobacterium avium
YQDKALEGFTMFALNQGEVCTCPSRS

SEQ ID NO: 86389 - protein, 21 aa, Mycobacterium avium
YQFPHLVERLILVGAGGVTKD

SEQ ID NO: 86390 - protein, 17 aa, Mycobacterium avium
YQGFMAIRQWAKQFYPE

SEQ ID NO: 86391 - protein, 24 aa, Mycobacterium avium
YQLCANLLLAECNWLVPVNEPRLL

SEQ ID NO: 86392 - protein, 19 aa, Mycobacterium avium
YQPSAALERAVRCRDLTCR

SEQ ID NO: 86393 - protein, 26 aa, Mycobacterium avium
YQRCAAEARLGFGDPALFAEALLGDA

SEQ ID NO: 86394 - protein, 19 aa, Mycobacterium avium
YQRCRACDLANFPPTEHCR

SEQ ID NO: 86395 - protein, 17 aa, Mycobacterium avium
YQYTVRLLDQIAANPEG

SEQ ID NO: 86396 - protein, 23 aa, Mycobacterium avium
YRADSMVNWCPGLGTVLANEEVT

SEQ ID NO: 86397 - protein, 24 aa, Mycobacterium avium
YRAFNERSGMRFGQVQTRLAGDAR

SEQ ID NO: 86398 - protein, 20 aa, Mycobacterium avium
YRAVLALLMLTGSMGRNGGG

SEQ ID NO: 86399 - protein, 24 aa, Mycobacterium avium
YRCELYDLPTLWQIASHNPWLSVS

SEQ ID NO: 86400 - protein, 18 aa, Mycobacterium avium
YRDGVLSLHIPVAEKAKP

SEQ ID NO: 86401 - protein, 23 aa, Mycobacterium avium
YRDTEIVRWLFTRDPSLTVTRDG

SEQ ID NO: 86402 - protein, 22 aa, Mycobacterium avium
YREIADRLAYVVRLILTGTTQA

SEQ ID NO: 86403 - protein, 21 aa, Mycobacterium avium
YRKKYLRAMSRLLALTAGANE

SEQ ID NO: 86404 - protein, 19 aa, Mycobacterium avium
YRLAETICAPQPIRRPPIL

SEQ ID NO: 86405 - protein, 26 aa, Mycobacterium avium
YRLNIPDDRCDLGRFITEKTAGVQAA

SEQ ID NO: 86406 - protein, 20 aa, Mycobacterium avium
YRMMQGFGVHTFRLVNARGE

SEQ ID NO: 86407 - protein, 20 aa, Mycobacterium avium
YRNNWKRLGFTDDEITRPGS

SEQ ID NO: 86408 - protein, 18 aa, Mycobacterium avium
YRPNLVIATPPGYPPYAE

SEQ ID NO: 86409 - protein, 27 aa, Mycobacterium avium
YRPPEEKLDWARRVLAAARSERGVFAF

SEQ ID NO: 86410 - protein, 24 aa, Mycobacterium avium
YRPWAGEIRARHTGSLVSDRAGTI

SEQ ID NO: 86411 - protein, 22 aa, Mycobacterium avium
YRQLDYWARTSLVVPSIRSAAG

SEQ ID NO: 86412 - protein, 20 aa, Mycobacterium avium
YRQRCWLRQLTPPATREQEN

SEQ ID NO: 86413 - protein, 18 aa, Mycobacterium avium
YRQSALAARARRFAGNPW

SEQ ID NO: 86414 - protein, 27 aa, Mycobacterium avium
YRRFLERRLREAFGFEGTPIRINVRVR

SEQ ID NO: 86415 - protein, 26 aa, Mycobacterium avium
YRRLRAKARLKFLVKDWGIEKFREIL

SEQ ID NO: 86416 - protein, 20 aa, Mycobacterium avium
YRRMTGRGIAMIDAIQGPPA

SEQ ID NO: 86417 - protein, 23 aa, Mycobacterium avium
YRRRAEEAWPNIVITDVDSTGLP

SEQ ID NO: 86418 - protein, 17 aa, Mycobacterium avium
YRSLGPLLEEISAHVDG

SEQ ID NO: 86419 - protein, 19 aa, Mycobacterium avium
YRSLPGLGVILGARVLGEF

SEQ ID NO: 86420 - protein, 22 aa, Mycobacterium avium
YRSPLKYAVYFDDWILFDDTGL

SEQ ID NO: 86421 - protein, 25 aa, Mycobacterium avium
YRVHPARLTAPVGLHLAHALVCDDY

SEQ ID NO: 86422 - protein, 19 aa, Mycobacterium avium
YRVSGPIRWASNLYPDSTM

SEQ ID NO: 86423 - protein, 21 aa, Mycobacterium avium
YRYFPEPDLEPVAPSRELVER

SEQ ID NO: 86424 - protein, 23 aa, Mycobacterium avium
YSHCSWSVTGIGQFLPHEGASPA

SEQ ID NO: 86425 - protein, 27 aa, Mycobacterium avium
YSLQRWRKADAALGRPVISNQVHFSLA

SEQ ID NO: 86426 - protein, 17 aa, Mycobacterium avium
YSMDWYYPILGSAVRGP

SEQ ID NO: 86427 - protein, 22 aa, Mycobacterium avium
YSPRVEGVHLRFGPVARGGLRW

SEQ ID NO: 86428 - protein, 18 aa, Mycobacterium avium
YSSARGCDLAMVRRGISP

SEQ ID NO: 86429 - protein, 21 aa, Mycobacterium avium
YSYQRHVDWVVSWFEHLNLSD

SEQ ID NO: 86430 - protein, 20 aa, Mycobacterium avium
YTCHYIRPGWKLPRRATSGS

SEQ ID NO: 86431 - protein, 17 aa, Mycobacterium avium
YTELKSLVRREGLHTVC

SEQ ID NO: 86432 - protein, 20 aa, Mycobacterium avium
YTELVAPTWTLGEARAKVTD

SEQ ID NO: 86433 - protein, 22 aa, Mycobacterium avium
YTGLHWFRAALDARPADEPIID

SEQ ID NO: 86434 - protein, 28 aa, Mycobacterium avium
YTKGYKFSTYATWWIRQAITRAMADQAR

SEQ ID NO: 86435 - protein, 17 aa, Mycobacterium avium
YTPLAWWGSSTSRVRLG

SEQ ID NO: 86436 - protein, 22 aa, Mycobacterium avium
YTPRMRVGIHTGRPQRLASDWL

SEQ ID NO: 86437 - protein, 18 aa, Mycobacterium avium
YTQLRAGIEAVFASWNSP

SEQ ID NO: 86438 - protein, 17 aa, Mycobacterium avium
YTVDVMAHWLGRGADGW

SEQ ID NO: 86439 - protein, 25 aa, Mycobacterium avium
YVDGKRTRLWPGLQETFNSGSTSIP

SEQ ID NO: 86440 - protein, 26 aa, Mycobacterium avium
YVDGRFGIGLVDWVMRNEAGLLEDAL

SEQ ID NO: 86441 - protein, 22 aa, Mycobacterium avium
YVDVLRLPVDIVAADRFAADAA

SEQ ID NO: 86442 - protein, 21 aa, Mycobacterium avium
YVERYMKLLAPKWQMMSDPQL

SEQ ID NO: 86443 - protein, 25 aa, Mycobacterium avium
YVGDWAGALERIWSKDRPDVVHAYG

SEQ ID NO: 86444 - protein, 19 aa, Mycobacterium avium
YVGVEEFLHRVRVRVGAVE

SEQ ID NO: 86445 - protein, 24 aa, Mycobacterium avium
YVINPRMVRGLDYYTKTTFEFVHD

SEQ ID NO: 86446 - protein, 19 aa, Mycobacterium avium
YVMRNPHKLAALATARDVS

SEQ ID NO: 86447 - protein, 19 aa, Mycobacterium avium
YVNQPWTIRQYAGFSTAAE

SEQ ID NO: 86448 - protein, 24 aa, Mycobacterium avium
YVPSRPQLEWQLRKRVHAIGNVTV

SEQ ID NO: 86449 - protein, 31 aa, Mycobacterium avium
YVRAGRWAREGPFPYGRDVSGLQVGILGLGR

SEQ ID NO: 86450 - protein, 32 aa, Mycobacterium avium
YVRGLADLGCFGMKIPSEFGGLNMSQVAYNRA

SEQ ID NO: 86451 - protein, 24 aa, Mycobacterium avium
YVRILDILERFYGLVLTDCGPGLL

SEQ ID NO: 86452 - protein, 27 aa, Mycobacterium avium
YVRTPDGWRLKTRAMTFIRRSGVHDSG

SEQ ID NO: 86453 - protein, 19 aa, Mycobacterium avium
YVSDGRFTLGLGASGPQVI

SEQ ID NO: 86454 - protein, 18 aa, Mycobacterium avium
YVVAGFPGADWVANARAA

SEQ ID NO: 86455 - protein, 26 aa, Mycobacterium avium
YWGMPEETRRVFGATLRSRLPDGSHA

SEQ ID NO: 86456 - protein, 26 aa, Mycobacterium avium
YWMLERAMREWARLDPVAAENIRAAD

SEQ ID NO: 86457 - protein, 24 aa, Mycobacterium avium
YWNMFKQNIGIMIAVAQLAATQQR

SEQ ID NO: 86458 - protein, 17 aa, Mycobacterium avium
YYEALRQRCPVTKESHH

SEQ ID NO: 86459 - protein, 18 aa, Mycobacterium avium
YYNRLRCGTGDYIDFSWF

SEQ ID NO: 86460 - protein, 17 aa, Mycobacterium avium
AAAAWDVLANALETAAR

SEQ ID NO: 86461 - protein, 18 aa, Mycobacterium avium
AAACGAGGDCGRCRRTLR

SEQ ID NO: 86462 - protein, 22 aa, Mycobacterium avium
AAAIPLPLGHTVELNAGTMDTD

SEQ ID NO: 86463 - protein, 24 aa, Mycobacterium avium
AAAKANGVALILVGHVTKDGAIAG

SEQ ID NO: 86464 - protein, 24 aa, Mycobacterium avium
AAAKAQRGPLCVGIDPHPELLRAW

SEQ ID NO: 86465 - protein, 28 aa, Mycobacterium avium
AAAKLKEAICRGTLWAIRREAAKPGSYR

SEQ ID NO: 86466 - protein, 26 aa, Mycobacterium avium
AAALARRTAELGIRVLRYGSGSHGQA

SEQ ID NO: 86467 - protein, 25 aa, Mycobacterium avium
AAALAVAPQPGWRVDVGDTAITVSG

SEQ ID NO: 86468 - protein, 24 aa, Mycobacterium avium
AAALFRLALEQAPAGSVLHAVGDE

SEQ ID NO: 86469 - protein, 23 aa, Mycobacterium avium
AAALLPDRWLIVGTGAADQELGD

SEQ ID NO: 86470 - protein, 17 aa, Mycobacterium avium
AAALPEFVAATDADPSM

SEQ ID NO: 86471 - protein, 17 aa, Mycobacterium avium
AAALPGVVDIVPAARTV

SEQ ID NO: 86472 - protein, 25 aa, Mycobacterium avium
AAALPRIAAMGFDVVYLPPIHPIGK

SEQ ID NO: 86473 - protein, 20 aa, Mycobacterium avium
AAALREWRGPVLDDLHNFAF

SEQ ID NO: 86474 - protein, 19 aa, Mycobacterium avium
AAAMVWRAAAAIELGICDA

SEQ ID NO: 86475 - protein, 17 aa, Mycobacterium avium
AAAPRVDIVAAYLGSDA

SEQ ID NO: 86476 - protein, 19 aa, Mycobacterium avium
AAAQKVWAQAGFRPVDPAV

SEQ ID NO: 86477 - protein, 18 aa, Mycobacterium avium
AAAQMWSRTDLTAADLDV

SEQ ID NO: 86478 - protein, 19 aa, Mycobacterium avium
AAATLFPRGAPVDAAAIVG

SEQ ID NO: 86479 - protein, 17 aa, Mycobacterium avium
AAAVLALNSLRIHSASA

SEQ ID NO: 86480 - protein, 22 aa, Mycobacterium avium
AAAVNSRLGGHIVQGHVDGTGR

SEQ ID NO: 86481 - protein, 17 aa, Mycobacterium avium
AACRELAAAGAQVAGYD

SEQ ID NO: 86482 - protein, 18 aa, Mycobacterium avium
AADFDAAVIPGLLTATTP

SEQ ID NO: 86483 - protein, 19 aa, Mycobacterium avium
AADIRICSAAATFANAAIL

SEQ ID NO: 86484 - protein, 25 aa, Mycobacterium avium
AADLTNRSTIRWTLHQLVASGVVNV

SEQ ID NO: 86485 - protein, 18 aa, Mycobacterium avium
AADPVSLLAAARFAQHGQ

SEQ ID NO: 86486 - protein, 19 aa, Mycobacterium avium
AADPVSLQTALGFSAQGQE

SEQ ID NO: 86487 - protein, 18 aa, Mycobacterium avium
AADRGRRGPLLRAKHALF

SEQ ID NO: 86488 - protein, 24 aa, Mycobacterium avium
AADRLGFTRYWVAEHHNMPSVGAT

SEQ ID NO: 86489 - protein, 18 aa, Mycobacterium avium
AADWSKRPLPAEWLNYAA

SEQ ID NO: 86490 - protein, 17 aa, Mycobacterium avium
AAEIPIRAKLFAVSEDE

SEQ ID NO: 86491 - protein, 19 aa, Mycobacterium avium
AAEPVLLWGDARVGNVLYR

SEQ ID NO: 86492 - protein, 19 aa, Mycobacterium avium
AAERGRLAAHLARQVFRSW

SEQ ID NO: 86493 - protein, 20 aa, Mycobacterium avium
AAFDNPYLVVACVIGDGEAE

SEQ ID NO: 86494 - protein, 18 aa, Mycobacterium avium
AAFSRPGIELTKRTLWSG

SEQ ID NO: 86495 - protein, 17 aa, Mycobacterium avium
AAGAAFDPDRGWRLHPQ

SEQ ID NO: 86496 - protein, 23 aa, Mycobacterium avium
AAGAKFATAFTRRGLIAEYGITW

SEQ ID NO: 86497 - protein, 18 aa, Mycobacterium avium
AAGAPWFAVSPLMHAAGM

SEQ ID NO: 86498 - protein, 17 aa, Mycobacterium avium
AAGARVRLCKGAYDEPA

SEQ ID NO: 86499 - protein, 21 aa, Mycobacterium avium
AAGGLRPDLAVGEPVLISDHL

SEQ ID NO: 86500 - protein, 32 aa, Mycobacterium avium
AAGHDFTYRFSVPNPGTYWAHPHTGLDEDTGL

SEQ ID NO: 86501 - protein, 20 aa, Mycobacterium avium
AAGLPSLLVLTGVNSARDAV

SEQ ID NO: 86502 - protein, 25 aa, Mycobacterium avium
AAGNYAQRLFPGMRVKYVSTEEFTN

SEQ ID NO: 86503 - protein, 29 aa, Mycobacterium avium
AAGRAAAQIPWRLGDLAALTDGHRLMELV

SEQ ID NO: 86504 - protein, 19 aa, Mycobacterium avium
AAGRSRAQSRFAWQRIALD

SEQ ID NO: 86505 - protein, 25 aa, Mycobacterium avium
AAGSDRRLRVIGVTWNDEASVPAAL

SEQ ID NO: 86506 - protein, 19 aa, Mycobacterium avium
AAGVLAGLPQPFTVSEARR

SEQ ID NO: 86507 - protein, 23 aa, Mycobacterium avium
AAGVRYGLLSAWRGPNGQDLVSN

SEQ ID NO: 86508 - protein, 24 aa, Mycobacterium avium
AAGWRVVELDVRYGPRTGGKSKVS

SEQ ID NO: 86509 - protein, 17 aa, Mycobacterium avium
AAHAHPGELIGVATGPL

SEQ ID NO: 86510 - protein, 22 aa, Mycobacterium avium
AAHGNFSLGLGLGAADLERRTF

SEQ ID NO: 86511 - protein, 22 aa, Mycobacterium avium
AAHRPDKVWRYRAGSGEAPELV

SEQ ID NO: 86512 - protein, 25 aa, Mycobacterium avium
AAHRRAHGLPAISLAWGLWDQASAM

SEQ ID NO: 86513 - protein, 25 aa, Mycobacterium avium
AAIESCPPGRVEVVANYTAFLALQR

SEQ ID NO: 86514 - protein, 17 aa, Mycobacterium avium
AAIRSRGGVTVCQSPDD

SEQ ID NO: 86515 - protein, 17 aa, Mycobacterium avium
AAKAVVDEACLDPSPTN

SEQ ID NO: 86516 - protein, 23 aa, Mycobacterium avium
AAKGLPYVFAHHFSGKGTEEALE

SEQ ID NO: 86517 - protein, 18 aa, Mycobacterium avium
AAKRLAPHALEWDAAEHF

SEQ ID NO: 86518 - protein, 17 aa, Mycobacterium avium
AALAGFCAQAAVRRTPL

SEQ ID NO: 86519 - protein, 24 aa, Mycobacterium avium
AALEQARPLFPHHLDTVVHVPAPS

SEQ ID NO: 86520 - protein, 19 aa, Mycobacterium avium
AALEVRLQAWALILEAVAG

SEQ ID NO: 86521 - protein, 25 aa, Mycobacterium avium
AALHRRGPHRVLRGDLAFAGLPGVV

SEQ ID NO: 86522 - protein, 19 aa, Mycobacterium avium
AALPELPGLIAEWDAALSG

SEQ ID NO: 86523 - protein, 17 aa, Mycobacterium avium
AALRLRGRLDAGALGAA

SEQ ID NO: 86524 - protein, 20 aa, Mycobacterium avium
AALRRYGLRPDENVAVAAEL

SEQ ID NO: 86525 - protein, 20 aa, Mycobacterium avium
AALRSGGVVIVFPGGDYDAY

SEQ ID NO: 86526 - protein, 21 aa, Mycobacterium avium
AALSRLGRPYVWGATGPDQFD

SEQ ID NO: 86527 - protein, 39 aa, Mycobacterium avium
AALTQVGSPYVWGGAAPGGFDCSGLVMWAFQQAGISLPH

SEQ ID NO: 86528 - protein, 26 aa, Mycobacterium avium
AALVGFGLDGSHGWERTHIDSLEAAY

SEQ ID NO: 86529 - protein, 18 aa, Mycobacterium avium
AALYPGSWSEWCADPARP

SEQ ID NO: 86530 - protein, 18 aa, Mycobacterium avium
AANDPRLVPGYTASGDPQ

SEQ ID NO: 86531 - protein, 20 aa, Mycobacterium avium
AANVVVRWLADAGVSIAGTR

SEQ ID NO: 86532 - protein, 26 aa, Mycobacterium avium
AAPLLCAGITLFSPLRHWKAGPGTRL

SEQ ID NO: 86533 - protein, 19 aa, Mycobacterium avium
AAPRPRLTVAVEDWRHTTS

SEQ ID NO: 86534 - protein, 24 aa, Mycobacterium avium
AAQFAQWGALLARTDPNAPKHNGI

SEQ ID NO: 86535 - protein, 24 aa, Mycobacterium avium
AAQLPRLNRYAAKLAAALGKVRAG

SEQ ID NO: 86536 - protein, 25 aa, Mycobacterium avium
AAQPALVPMDAWRDGEKFVVEFDLP

SEQ ID NO: 86537 - protein, 17 aa, Mycobacterium avium
AAQRAGIELLALGGRFI

SEQ ID NO: 86538 - protein, 17 aa, Mycobacterium avium
AARDVSNWGRWGDDDEL

SEQ ID NO: 86539 - protein, 25 aa, Mycobacterium avium
AARFDRISYSWIPRERNSHADRLAN

SEQ ID NO: 86540 - protein, 18 aa, Mycobacterium avium
AARFVCPYHAWTYKNTGE

SEQ ID NO: 86541 - protein, 18 aa, Mycobacterium avium
AARKVWDKADKFTRDTLG

SEQ ID NO: 86542 - protein, 17 aa, Mycobacterium avium
AARLTGWRIDIRGDSPG

SEQ ID NO: 86543 - protein, 24 aa, Mycobacterium avium
AARRARYAALAAHRDGPVLLGHTL

SEQ ID NO: 86544 - protein, 17 aa, Mycobacterium avium
AARRPRAAPAVLVHGDF

SEQ ID NO: 86545 - protein, 18 aa, Mycobacterium avium
AARSDGWIGDLIKTERAI

SEQ ID NO: 86546 - protein, 24 aa, Mycobacterium avium
AARSRLNPGAGVMVSAVWASETSQ

SEQ ID NO: 86547 - protein, 22 aa, Mycobacterium avium
AARVVNAIDWVCRAPQGLIGVE

SEQ ID NO: 86548 - protein, 23 aa, Mycobacterium avium
AARWPRAGALGPLVRDPDGSVYP

SEQ ID NO: 86549 - protein, 19 aa, Mycobacterium avium
AARYRRWLAALRGSARVVI

SEQ ID NO: 86550 - protein, 19 aa, Mycobacterium avium
AATEAEYGQMWAQDAAAMN

SEQ ID NO: 86551 - protein, 19 aa, Mycobacterium avium
AATGCARTAVQVHGALGQT

SEQ ID NO: 86552 - protein, 21 aa, Mycobacterium avium
AATRGGWRAAGVRDGMTGTLV

SEQ ID NO: 86553 - protein, 17 aa, Mycobacterium avium
AATRLTPMTAPRSNTSP

SEQ ID NO: 86554 - protein, 24 aa, Mycobacterium avium
AATRYPPAGVRSFGPLRVSLGHDP

SEQ ID NO: 86555 - protein, 18 aa, Mycobacterium avium
AAVAARRGITVALPSAGG

SEQ ID NO: 86556 - protein, 17 aa, Mycobacterium avium
AAVAAVFPSVTSPPAEQ

SEQ ID NO: 86557 - protein, 18 aa, Mycobacterium avium
AAVADFRPARVAAAKIKK

SEQ ID NO: 86558 - protein, 23 aa, Mycobacterium avium
AAVAEFAAALVLVSPEVGLTVVP

SEQ ID NO: 86559 - protein, 18 aa, Mycobacterium avium
AAVDRLDSEPGLSVGVLT

SEQ ID NO: 86560 - protein, 18 aa, Mycobacterium avium
AAVGAAFPIAVLNLKGGV

SEQ ID NO: 86561 - protein, 24 aa, Mycobacterium avium
AAVLPSHYEPFGIVALEAAAAGTP

SEQ ID NO: 86562 - protein, 20 aa, Mycobacterium avium
AAVLRFAAAEVVPRLAGSSA

SEQ ID NO: 86563 - protein, 19 aa, Mycobacterium avium
AAVLVCLPGGTYSREYWDL

SEQ ID NO: 86564 - protein, 22 aa, Mycobacterium avium
AAVLWRYALRLTGDASQSEDVV

SEQ ID NO: 86565 - protein, 24 aa, Mycobacterium avium
AAVNGFCVGGGIGLVGNSDVIVAS

SEQ ID NO: 86566 - protein, 18 aa, Mycobacterium avium
AAVRAALDIGYRHIDTAE

SEQ ID NO: 86567 - protein, 23 aa, Mycobacterium avium
AAVRAHLIDAARTFIFDTGLAPA

SEQ ID NO: 86568 - protein, 26 aa, Mycobacterium avium
AAVRRLAQRLALAAGRRLDDAQPWVD

SEQ ID NO: 86569 - protein, 18 aa, Mycobacterium avium
AAVTFPWYQLGRQVHLRG

SEQ ID NO: 86570 - protein, 27 aa, Mycobacterium avium
AAYLARAGLRVRLLERLGQVGGAAVSA

SEQ ID NO: 86571 - protein, 17 aa, Mycobacterium avium
AAYQVLERVGLDVKLAR

SEQ ID NO: 86572 - protein, 24 aa, Mycobacterium avium
ACAVEARKGVLLAAGGFGHNKQMR

SEQ ID NO: 86573 - protein, 19 aa, Mycobacterium avium
ACAVIPGGVNSPVRAFTAV

SEQ ID NO: 86574 - protein, 19 aa, Mycobacterium avium
ACEPVCPVEAIYYEDDLPE

SEQ ID NO: 86575 - protein, 20 aa, Mycobacterium avium
ACGLGTGGLFVEDVADVAAP

SEQ ID NO: 86576 - protein, 18 aa, Mycobacterium avium
ACGPPGLFCEEYDVRQRQ

SEQ ID NO: 86577 - protein, 19 aa, Mycobacterium avium
ACGTGGFLVEALEHLSPKV

SEQ ID NO: 86578 - protein, 38 aa, Mycobacterium avium
ACGYWRRGGLTASWFVACPFGAPGARMYRTGDLVCWRS

SEQ ID NO: 86579 - protein, 18 aa, Mycobacterium avium
ACILCECNCGIVVQVEDR

SEQ ID NO: 86580 - protein, 18 aa, Mycobacterium avium
ACNPALAHRALGIDRQIG

SEQ ID NO: 86581 - protein, 23 aa, Mycobacterium avium
ACTHCNQCMPTIYSRTHCVVTGA

SEQ ID NO: 86582 - protein, 19 aa, Mycobacterium avium
ACTPWYEPFGIVPLEAMAC

SEQ ID NO: 86583 - protein, 26 aa, Mycobacterium avium
ACVPHNYMIGAFVFGDLAGTHAASTL

SEQ ID NO: 86584 - protein, 19 aa, Mycobacterium avium
ADAALKTAHRLWGNEGLPG

SEQ ID NO: 86585 - protein, 28 aa, Mycobacterium avium
ADAALRRAARFGSGWWPFLTPPEQIAEK

SEQ ID NO: 86586 - protein, 33 aa, Mycobacterium avium
ADAAVPRWGKPEEMAELLAFCASDKAGYLTGTD

SEQ ID NO: 86587 - protein, 21 aa, Mycobacterium avium
ADADCDLGRFRGHKTAGVQAA

SEQ ID NO: 86588 - protein, 20 aa, Mycobacterium avium
ADAFTDGWFKTGDLGVLDDD

SEQ ID NO: 86589 - protein, 23 aa, Mycobacterium avium
ADAGRFLTTIKHRLEEGAFEADL

SEQ ID NO: 86590 - protein, 17 aa, Mycobacterium avium
ADAKRDWVMLRELDRRA

SEQ ID NO: 86591 - protein, 18 aa, Mycobacterium avium
ADAMPWNQLPGPLRAIVK

SEQ ID NO: 86592 - protein, 21 aa, Mycobacterium avium
ADAPALPVLPWMVSAKSAAAL

SEQ ID NO: 86593 - protein, 22 aa, Mycobacterium avium
ADAPALPVLPWVVSAKSAAALR

SEQ ID NO: 86594 - protein, 18 aa, Mycobacterium avium
ADAVFWEPFVERGFSPDS

SEQ ID NO: 86595 - protein, 17 aa, Mycobacterium avium
ADCALFVIAANEGVDEP

SEQ ID NO: 86596 - protein, 26 aa, Mycobacterium avium
ADDGTRVPVSIVHRADIEFPAPALIY

SEQ ID NO: 86597 - protein, 19 aa, Mycobacterium avium
ADDPYVIGMAADITGTLDV

SEQ ID NO: 86598 - protein, 18 aa, Mycobacterium avium
ADDWPKVLPARRLPGYLR

SEQ ID NO: 86599 - protein, 20 aa, Mycobacterium avium
ADEARWIYYSSGTTAAPKGI

SEQ ID NO: 86600 - protein, 26 aa, Mycobacterium avium
ADELRRTAGRLADWVHAHGDLALPDL

SEQ ID NO: 86601 - protein, 24 aa, Mycobacterium avium
ADEYLEVCYKLWEGSWEAGAVLRD

SEQ ID NO: 86602 - protein, 20 aa, Mycobacterium avium
ADFPRMLKLTQELFGSDDSE

SEQ ID NO: 86603 - protein, 23 aa, Mycobacterium avium
ADGFVSAPAHGRCEVVCFSADHT

SEQ ID NO: 86604 - protein, 24 aa, Mycobacterium avium
ADGGRAALVLGDWPADPPAPQPAP

SEQ ID NO: 86605 - protein, 22 aa, Mycobacterium avium
ADGLPAYGACAGMILLASEILD

SEQ ID NO: 86606 - protein, 19 aa, Mycobacterium avium
ADGLRALFTTWITAPQPDI

SEQ ID NO: 86607 - protein, 32 aa, Mycobacterium avium
ADGPASWTDVCLRPGDVLYLPRGQVHSARTHS

SEQ ID NO: 86608 - protein, 26 aa, Mycobacterium avium
ADGTRAGLWDGLRTAFNTTRALSVPF

SEQ ID NO: 86609 - protein, 17 aa, Mycobacterium avium
ADGYIDVKGLRLTLTQA

SEQ ID NO: 86610 - protein, 17 aa, Mycobacterium avium
ADHRLPQGVTFIGQPLW

SEQ ID NO: 86611 - protein, 17 aa, Mycobacterium avium
ADIDDVTCCMGADRRIG

SEQ ID NO: 86612 - protein, 24 aa, Mycobacterium avium
ADIDKRGKISLVLVEEDNSAPADT

SEQ ID NO: 86613 - protein, 26 aa, Mycobacterium avium
ADIFLREVQDVWTWVQPYFDDRATGA

SEQ ID NO: 86614 - protein, 20 aa, Mycobacterium avium
ADIGDAWAADIVVKVAPPTA

SEQ ID NO: 86615 - protein, 23 aa, Mycobacterium avium
ADIKRPGTDVSLIGYGRPVHDAL

SEQ ID NO: 86616 - protein, 17 aa, Mycobacterium avium
ADILPLTPLQQGLLFHS

SEQ ID NO: 86617 - protein, 17 aa, Mycobacterium avium
ADIQVVKVKGGYVVAGE

SEQ ID NO: 86618 - protein, 17 aa, Mycobacterium avium
ADKRVALVFSAYPTKHA

SEQ ID NO: 86619 - protein, 23 aa, Mycobacterium avium
ADKVVRFMLGLARRYGPGFYSAY

SEQ ID NO: 86620 - protein, 18 aa, Mycobacterium avium
ADLARLGRDGILALSSDE

SEQ ID NO: 86621 - protein, 28 aa, Mycobacterium avium
ADLGGTWDLFKYPGIRSDSDMFTLGFRF

SEQ ID NO: 86622 - protein, 18 aa, Mycobacterium avium
ADLHMIGKDIIRFHTVYW

SEQ ID NO: 86623 - protein, 18 aa, Mycobacterium avium
ADLKDLYAAVKALNDNRR

SEQ ID NO: 86624 - protein, 17 aa, Mycobacterium avium
ADLLAVVARLNRLATQR

SEQ ID NO: 86625 - protein, 22 aa, Mycobacterium avium
ADLPEKVREAALREVGKLERAS

SEQ ID NO: 86626 - protein, 22 aa, Mycobacterium avium
ADLRDARALPVLVVDGRDEREL

SEQ ID NO: 86627 - protein, 23 aa, Mycobacterium avium
ADLRDARLRLAADDLVNRRGERE

SEQ ID NO: 86628 - protein, 18 aa, Mycobacterium avium
ADMIRLIIRDEAVHGYYI

SEQ ID NO: 86629 - protein, 26 aa, Mycobacterium avium
ADPAELPLRLCAGQHLQADIAVSVPA

SEQ ID NO: 86630 - protein, 24 aa, Mycobacterium avium
ADPDRYAGELAHIIGCEPDDVLRV

SEQ ID NO: 86631 - protein, 22 aa, Mycobacterium avium
ADPRLAAAQRVLGRALVKSVIT

SEQ ID NO: 86632 - protein, 28 aa, Mycobacterium avium
ADPRLPDSRLWWLLNLVITRGTPPRLEG

SEQ ID NO: 86633 - protein, 20 aa, Mycobacterium avium
ADQRTFGGWMLADLLEVDGS

SEQ ID NO: 86634 - protein, 23 aa, Mycobacterium avium
ADRAGAPASQWRVNGTVDYVADA

SEQ ID NO: 86635 - protein, 21 aa, Mycobacterium avium
ADRYRRLHVIIGDANLAETST

SEQ ID NO: 86636 - protein, 19 aa, Mycobacterium avium
ADTDVAWTGRTMKVPWFAE

SEQ ID NO: 86637 - protein, 19 aa, Mycobacterium avium
ADTEFFWNGLRENKLLIQR

SEQ ID NO: 86638 - protein, 25 aa, Mycobacterium avium
ADTEIARLVPFIEWLRDAYPDQLIS

SEQ ID NO: 86639 - protein, 20 aa, Mycobacterium avium
ADTVRRAAGVAARSLSNTET

SEQ ID NO: 86640 - protein, 29 aa, Mycobacterium avium
ADVAFAAARGRFEASWNHRNGALPINDSA

SEQ ID NO: 86641 - protein, 17 aa, Mycobacterium avium
ADVDLGDIVSVHGTLIS

SEQ ID NO: 86642 - protein, 19 aa, Mycobacterium avium
ADVLEHFDPTFARDNLVDL

SEQ ID NO: 86643 - protein, 17 aa, Mycobacterium avium
ADVLRCIDGPLASVRDI

SEQ ID NO: 86644 - protein, 24 aa, Mycobacterium avium
ADVLVAFGRYPAFEGRLPELGTDF

SEQ ID NO: 86645 - protein, 17 aa, Mycobacterium avium
ADVPFFVTLCKTPGKPV

SEQ ID NO: 86646 - protein, 20 aa, Mycobacterium avium
ADVRARHGVILTELNIGGGH

SEQ ID NO: 86647 - protein, 20 aa, Mycobacterium avium
AEADLARWAGEHRPESLRKV

SEQ ID NO: 86648 - protein, 21 aa, Mycobacterium avium
AEAEIACGRADGVIGELEALV

SEQ ID NO: 86649 - protein, 25 aa, Mycobacterium avium
AEAFLTTRLDRRWGGAFGTMPDGLD

SEQ ID NO: 86650 - protein, 21 aa, Mycobacterium avium
AEDTYDLVQWVAGQPWSDGNV

SEQ ID NO: 86651 - protein, 30 aa, Mycobacterium avium
AEERELLGGLPVRRLWGIGPVAEEKLHRLG

SEQ ID NO: 86652 - protein, 20 aa, Mycobacterium avium
AEGGTFACGGGRPADKDVGF

SEQ ID NO: 86653 - protein, 19 aa, Mycobacterium avium
AEGLLPYLPPHAQDRLLDN

SEQ ID NO: 86654 - protein, 17 aa, Mycobacterium avium
AEGYAAAAVLAMPDQHL

SEQ ID NO: 86655 - protein, 17 aa, Mycobacterium avium
AEHGYRTFIESSPHPAL

SEQ ID NO: 86656 - protein, 26 aa, Mycobacterium avium
AEHVMYKPRWGAFYGTKLEQHLRESG

SEQ ID NO: 86657 - protein, 20 aa, Mycobacterium avium
AEIDDAFRWSEENPNLQRKA

SEQ ID NO: 86658 - protein, 18 aa, Mycobacterium avium
AEIPEPDPVVAHDDADEQ

SEQ ID NO: 86659 - protein, 33 aa, Mycobacterium avium
AEIYRLSFATIRAEADLARFPADVARVVVRLIH

SEQ ID NO: 86660 - protein, 23 aa, Mycobacterium avium
AEKLCDGRLVAVLEGGYDLQALA

SEQ ID NO: 86661 - protein, 17 aa, Mycobacterium avium
AELAALLASQAKVSQSV

SEQ ID NO: 86662 - protein, 17 aa, Mycobacterium avium
AELDPYIDVEIFDAGLA

SEQ ID NO: 86663 - protein, 25 aa, Mycobacterium avium
AELEHGASFRRLLGPLVARSEDVVA

SEQ ID NO: 86664 - protein, 24 aa, Mycobacterium avium
AELGASWHPGCPVEPGQLRRVDVD

SEQ ID NO: 86665 - protein, 20 aa, Mycobacterium avium
AELIASAGGDPWAINQSLQA

SEQ ID NO: 86666 - protein, 22 aa, Mycobacterium avium
AELIAYCRAHLAGYKCPRTVEF

SEQ ID NO: 86667 - protein, 19 aa, Mycobacterium avium
AELLAWAGVHPDYRSLPED

SEQ ID NO: 86668 - protein, 20 aa, Mycobacterium avium
AELNAMLGMERAKREIKLIK

SEQ ID NO: 86669 - protein, 18 aa, Mycobacterium avium
AELQIVFHTLVRRIPTLQ

SEQ ID NO: 86670 - protein, 25 aa, Mycobacterium avium
AELRHAWLDLHESWLAAKAAQIGIA

SEQ ID NO: 86671 - protein, 18 aa, Mycobacterium avium
AELRRIVGPWGEVHETAS

SEQ ID NO: 86672 - protein, 20 aa, Mycobacterium avium
AELRSAAVIYGSKRQLDLLD

SEQ ID NO: 86673 - protein, 20 aa, Mycobacterium avium
AELSCALARRGHDVVVYTRR

SEQ ID NO: 86674 - protein, 17 aa, Mycobacterium avium
AELTFADAYGADFFAPW

SEQ ID NO: 86675 - protein, 19 aa, Mycobacterium avium
AELTPWIFGSTRGQSAEVA

SEQ ID NO: 86676 - protein, 21 aa, Mycobacterium avium
AELTRRGHEVLVQSGAGEGSS

SEQ ID NO: 86677 - protein, 21 aa, Mycobacterium avium
AELVDRWAPGRTMINAYGPTE

SEQ ID NO: 86678 - protein, 31 aa, Mycobacterium avium
AEMAGALKNVFAIAVGMGYSLGIGENTRALV

SEQ ID NO: 86679 - protein, 22 aa, Mycobacterium avium
AEMARRIDVARVYSRNVVERQL

SEQ ID NO: 86680 - protein, 18 aa, Mycobacterium avium
AEMDWRTGQPPQWGIHHD

SEQ ID NO: 86681 - protein, 17 aa, Mycobacterium avium
AEMWAQDAAAMYAYAAA

SEQ ID NO: 86682 - protein, 25 aa, Mycobacterium avium
AENALPRRGVSALVRRPKRRPLDEG

SEQ ID NO: 86683 - protein, 22 aa, Mycobacterium avium
AENLRHTVRFAAAVQAALKDGF

SEQ ID NO: 86684 - protein, 34 aa, Mycobacterium avium
AEPAGKRALAKWAFGVGRARARAVSDGRPVGLAE

SEQ ID NO: 86685 - protein, 18 aa, Mycobacterium avium
AEPLRANTFHQFRERFAP

SEQ ID NO: 86686 - protein, 21 aa, Mycobacterium avium
AEPPGDVLVFLSGEREIRDTA

SEQ ID NO: 86687 - protein, 17 aa, Mycobacterium avium
AEQMLGDVWEWTTSPLR

SEQ ID NO: 86688 - protein, 22 aa, Mycobacterium avium
AEQRRWLAPWYSSVPLQSGPAE

SEQ ID NO: 86689 - protein, 17 aa, Mycobacterium avium
AERALALMVDRAQKRVA

SEQ ID NO: 86690 - protein, 19 aa, Mycobacterium avium
AERGLDWRAVRLDDVGEFV

SEQ ID NO: 86691 - protein, 25 aa, Mycobacterium avium
AERLAFVLHDVFAVPFAQIAAIVDG

SEQ ID NO: 86692 - protein, 20 aa, Mycobacterium avium
AERLPAYMVPAAVVVLDALP

SEQ ID NO: 86693 - protein, 20 aa, Mycobacterium avium
AERLPGYMVPAAVLMLDALP

SEQ ID NO: 86694 - protein, 24 aa, Mycobacterium avium
AERVWSGRVNPRLAELAADLPAGR

SEQ ID NO: 86695 - protein, 37 aa, Mycobacterium avium
AESQGRSRLALRLLGPLLRPLLRTILIVQRRLEGRGP

SEQ ID NO: 86696 - protein, 18 aa, Mycobacterium avium
AESVLRLARACHDDSAAL

SEQ ID NO: 86697 - protein, 24 aa, Mycobacterium avium
AETAEVACGYYIFEAENLDEALAL

SEQ ID NO: 86698 - protein, 18 aa, Mycobacterium avium
AETPRGGFIANMELQPEA

SEQ ID NO: 86699 - protein, 17 aa, Mycobacterium avium
AETQTAMGFSQDPDTPG

SEQ ID NO: 86700 - protein, 25 aa, Mycobacterium avium
AETREMIKTGGFDAVCFTSSSTVRN

SEQ ID NO: 86701 - protein, 17 aa, Mycobacterium avium
AEVRRLAKLRGATILAH

SEQ ID NO: 86702 - protein, 17 aa, Mycobacterium avium
AEVTRLLATSARTNVAI

SEQ ID NO: 86703 - protein, 22 aa, Mycobacterium avium
AFAAMCVATVKLLELDPDKVNV

SEQ ID NO: 86704 - protein, 24 aa, Mycobacterium avium
AFAEAVSEFAARRWQWHDLDVSRT

SEQ ID NO: 86705 - protein, 21 aa, Mycobacterium avium
AFAEFVDWSLIDALRGAPGAA

SEQ ID NO: 86706 - protein, 19 aa, Mycobacterium avium
AFCSTCDRTRLTADGQIRS

SEQ ID NO: 86707 - protein, 18 aa, Mycobacterium avium
AFDYAFLAAEAELAGIEL

SEQ ID NO: 86708 - protein, 18 aa, Mycobacterium avium
AFEAVRVIARAAGVDVRL

SEQ ID NO: 86709 - protein, 25 aa, Mycobacterium avium
AFEEVLKRWRDWEVDYANAERARTA

SEQ ID NO: 86710 - protein, 19 aa, Mycobacterium avium
AFGPVLGERVMLGMDEPVH

SEQ ID NO: 86711 - protein, 19 aa, Mycobacterium avium
AFHRLGNRVIIAARRGEQL

SEQ ID NO: 86712 - protein, 20 aa, Mycobacterium avium
AFLAENWRPYVAGDIVIHEI

SEQ ID NO: 86713 - protein, 25 aa, Mycobacterium avium
AFRERLRSWLSLHAKEFASSGDDYW

SEQ ID NO: 86714 - protein, 22 aa, Mycobacterium avium
AFVEDAIACGHSVGEYTALACV

SEQ ID NO: 86715 - protein, 18 aa, Mycobacterium avium
AGAAFFVPTIIKGGELVV

SEQ ID NO: 86716 - protein, 29 aa, Mycobacterium avium
AGAAKATFLRWAWYAARREELHLDGADDD

SEQ ID NO: 86717 - protein, 23 aa, Mycobacterium avium
AGADSLKGLCPFHDEKSPSFHVR

SEQ ID NO: 86718 - protein, 20 aa, Mycobacterium avium
AGAEYKKLRDILGLLRDAYC

SEQ ID NO: 86719 - protein, 18 aa, Mycobacterium avium
AGAFVRAGLVNRILVYLA

SEQ ID NO: 86720 - protein, 18 aa, Mycobacterium avium
AGAGGRVGAARKPQGPRR

SEQ ID NO: 86721 - protein, 17 aa, Mycobacterium avium
AGAIGGGLADWLAAAAA

SEQ ID NO: 86722 - protein, 20 aa, Mycobacterium avium
AGALSVRLGPQVLRTSTAAA

SEQ ID NO: 86723 - protein, 17 aa, Mycobacterium avium
AGALVVLVDGELAWFLE

SEQ ID NO: 86724 - protein, 24 aa, Mycobacterium avium
AGASFLRRDGSVWTTDKDGIILAL

SEQ ID NO: 86725 - protein, 25 aa, Mycobacterium avium
AGAYLTCYLGAFGADIVKVESIQRP

SEQ ID NO: 86726 - protein, 17 aa, Mycobacterium avium
AGDGVWAIYTVDAGGGA

SEQ ID NO: 86727 - protein, 19 aa, Mycobacterium avium
AGDLLRPTTVSARLHAEAT

SEQ ID NO: 86728 - protein, 21 aa, Mycobacterium avium
AGDRYTVWAPRWRDSGDEWEA

SEQ ID NO: 86729 - protein, 17 aa, Mycobacterium avium
AGDTAWLTRPLIDSYHT

SEQ ID NO: 86730 - protein, 19 aa, Mycobacterium avium
AGEEYLLYERGGEWVLATG

SEQ ID NO: 86731 - protein, 22 aa, Mycobacterium avium
AGEPRLWLLGSSMYSAHLAAAK

SEQ ID NO: 86732 - protein, 20 aa, Mycobacterium avium
AGFHTLRLQTFLTAGPKEAR

SEQ ID NO: 86733 - protein, 18 aa, Mycobacterium avium
AGFSTVWLTEHHFLEEYC

SEQ ID NO: 86734 - protein, 24 aa, Mycobacterium avium
AGGDCGRCRRTLRAILAASAKLET

SEQ ID NO: 86735 - protein, 29 aa, Mycobacterium avium
AGGVFRIAEQLPRKVAMRLLLTGEPLSAA

SEQ ID NO: 86736 - protein, 18 aa, Mycobacterium avium
AGHAPGWEPLPVQYVDYT

SEQ ID NO: 86737 - protein, 28 aa, Mycobacterium avium
AGHLAAELMGRFAFDRPGLAAISLPDAT

SEQ ID NO: 86738 - protein, 23 aa, Mycobacterium avium
AGHPHLHRPRVIAIDEIPDSAAE

SEQ ID NO: 86739 - protein, 19 aa, Mycobacterium avium
AGIANWARLWEMSEEQWLT

SEQ ID NO: 86740 - protein, 19 aa, Mycobacterium avium
AGICFPREYGGLGLSYEYK

SEQ ID NO: 86741 - protein, 22 aa, Mycobacterium avium
AGIPPFYVMDVWLAAAERQRSH

SEQ ID NO: 86742 - protein, 18 aa, Mycobacterium avium
AGKALPHKVTEVRMFLHH

SEQ ID NO: 86743 - protein, 28 aa, Mycobacterium avium
AGLDARSWRLPWPDGTVVYELDQPKVLD

SEQ ID NO: 86744 - protein, 18 aa, Mycobacterium avium
AGLGTAWGTQLAVAMLGE

SEQ ID NO: 86745 - protein, 19 aa, Mycobacterium avium
AGLLFGRGDLVERLRRHPA

SEQ ID NO: 86746 - protein, 24 aa, Mycobacterium avium
AGLPATLRQTLTWDQGKEMANHAA

SEQ ID NO: 86747 - protein, 25 aa, Mycobacterium avium
AGLPEVACTVWSNLVLIAGLRNGQL

SEQ ID NO: 86748 - protein, 18 aa, Mycobacterium avium
AGLREGRLSLDQLGVIAQ

SEQ ID NO: 86749 - protein, 21 aa, Mycobacterium avium
AGLRGLVGVAHYTAAKHGVVG

SEQ ID NO: 86750 - protein, 18 aa, Mycobacterium avium
AGLSPDEMRAVHLRIGRR

SEQ ID NO: 86751 - protein, 20 aa, Mycobacterium avium
AGMCKAVLVYRSLNGRSGYR

SEQ ID NO: 86752 - protein, 21 aa, Mycobacterium avium
AGMRAKLGLPAQVDAEFAAAL

SEQ ID NO: 86753 - protein, 24 aa, Mycobacterium avium
AGNDLPLAAGMAFSIEPGIYFPGR

SEQ ID NO: 86754 - protein, 17 aa, Mycobacterium avium
AGNGPGVHGLWPQALAL

SEQ ID NO: 86755 - protein, 22 aa, Mycobacterium avium
AGNLAMGFLRAVELPIISYHGM

SEQ ID NO: 86756 - protein, 22 aa, Mycobacterium avium
AGPAIEFCSPIGHRGAGGRVLE

SEQ ID NO: 86757 - protein, 24 aa, Mycobacterium avium
AGPFLTDVSRAWNLEAAQENPFRH

SEQ ID NO: 86758 - protein, 27 aa, Mycobacterium avium
AGPGAWSWIEAAGVWQQLSMELEQSAS

SEQ ID NO: 86759 - protein, 25 aa, Mycobacterium avium
AGPGERVALLFPRSAEAIVAILAAL

SEQ ID NO: 86760 - protein, 23 aa, Mycobacterium avium
AGPGQSVALLFSRSAEAVASILA

SEQ ID NO: 86761 - protein, 27 aa, Mycobacterium avium
AGPPPWHLYRFVLRAAVGVALTEPHGA

SEQ ID NO: 86762 - protein, 21 aa, Mycobacterium avium
AGPRPILRIDGLDLSGHSTEP

SEQ ID NO: 86763 - protein, 23 aa, Mycobacterium avium
AGQCGSCFNGTAAMAAAGGALRD

SEQ ID NO: 86764 - protein, 18 aa, Mycobacterium avium
AGQPCRRCGTPIEFDDSG

SEQ ID NO: 86765 - protein, 25 aa, Mycobacterium avium
AGRGANRSTRRWHWLDPQTRDALFA

SEQ ID NO: 86766 - protein, 24 aa, Mycobacterium avium
AGRGARFLLGMVVSTGVGGGLVLD

SEQ ID NO: 86767 - protein, 25 aa, Mycobacterium avium
AGRKRSHWMWFVFPQLRGLGGSAMA

SEQ ID NO: 86768 - protein, 19 aa, Mycobacterium avium
AGRLHILEVQRLIRFMPKV

SEQ ID NO: 86769 - protein, 20 aa, Mycobacterium avium
AGRPRFYRTPGRPDVIATLD

SEQ ID NO: 86770 - protein, 25 aa, Mycobacterium avium
AGRPVLGICGGFQMLCRRIDDRVES

SEQ ID NO: 86771 - protein, 17 aa, Mycobacterium avium
AGRQLCYAAFRDREGRA

SEQ ID NO: 86772 - protein, 20 aa, Mycobacterium avium
AGRVKRPQTGIATWIIPSIV

SEQ ID NO: 86773 - protein, 21 aa, Mycobacterium avium
AGRYADGWWPAGAWTPEHYAE

SEQ ID NO: 86774 - protein, 26 aa, Mycobacterium avium
AGSAEKLGFCRELGADITINYRDEDF

SEQ ID NO: 86775 - protein, 25 aa, Mycobacterium avium
AGSIGGKLSVPVAWSGAPATPALGH

SEQ ID NO: 86776 - protein, 28 aa, Mycobacterium avium
AGSLPVARSMLWARLRVSPGELRRRFAL

SEQ ID NO: 86777 - protein, 25 aa, Mycobacterium avium
AGSMGRSTLVGSLSVPPGWTTAAPV

SEQ ID NO: 86778 - protein, 20 aa, Mycobacterium avium
AGSSIQLLGKEGSYASLRMP

SEQ ID NO: 86779 - protein, 20 aa, Mycobacterium avium
AGTLRPGDRADFVVIDPAGL

SEQ ID NO: 86780 - protein, 20 aa, Mycobacterium avium
AGVGCTRLAIHAVTGSGEER

SEQ ID NO: 86781 - protein, 18 aa, Mycobacterium avium
AGVHQVRPGLQLVAAPWR

SEQ ID NO: 86782 - protein, 19 aa, Mycobacterium avium
AGVIGPLFRSALRAAEVRR

SEQ ID NO: 86783 - protein, 22 aa, Mycobacterium avium
AGVRRRLGIDLTEVEDQRPQIA

SEQ ID NO: 86784 - protein, 17 aa, Mycobacterium avium
AGVSLDWELLAQGAQAA

SEQ ID NO: 86785 - protein, 25 aa, Mycobacterium avium
AGVSRPTLYRWFASKEELLSAFSAY

SEQ ID NO: 86786 - protein, 23 aa, Mycobacterium avium
AGVWSQCHSYAFDVSVWEIFGAL

SEQ ID NO: 86787 - protein, 18 aa, Mycobacterium avium
AGYAFAKLAAAHYVNDFA

SEQ ID NO: 86788 - protein, 17 aa, Mycobacterium avium
AGYALAGRHVHVVTIND

SEQ ID NO: 86789 - protein, 25 aa, Mycobacterium avium
AHAPRRVVPEIPRWPTRARRRLLRT

SEQ ID NO: 86790 - protein, 21 aa, Mycobacterium avium
AHDVARCWLYLGLTRLGSGAL

SEQ ID NO: 86791 - protein, 25 aa, Mycobacterium avium
AHGELPNLRAIVGFAAETGDANGDV

SEQ ID NO: 86792 - protein, 17 aa, Mycobacterium avium
AHGMAPEMLAMAQTANL

SEQ ID NO: 86793 - protein, 22 aa, Mycobacterium avium
AHGRSGPILVRRTREMTGTTER

SEQ ID NO: 86794 - protein, 20 aa, Mycobacterium avium
AHHRESFLYTNFDELCEIFA

SEQ ID NO: 86795 - protein, 25 aa, Mycobacterium avium
AHLQRRLRALVGHGVDEVRGLGLWA

SEQ ID NO: 86796 - protein, 26 aa, Mycobacterium avium
AHPDRAVAVLAALPAWAGAPEEAPAA

SEQ ID NO: 86797 - protein, 25 aa, Mycobacterium avium
AHSLRELVARTGVDPAQIDDVIAGA

SEQ ID NO: 86798 - protein, 19 aa, Mycobacterium avium
AHVDLYFEAAVAGAIPVIR

SEQ ID NO: 86799 - protein, 19 aa, Mycobacterium avium
AIAALLTNIGVYRCDYPGL

SEQ ID NO: 86800 - protein, 23 aa, Mycobacterium avium
AIDEARRAAERECEQLLGDAKQG

SEQ ID NO: 86801 - protein, 21 aa, Mycobacterium avium
AIDGTFEWNQSLFGYNFGDPD

SEQ ID NO: 86802 - protein, 21 aa, Mycobacterium avium
AIDSGEAWVMLRAEQLEIEPV

SEQ ID NO: 86803 - protein, 17 aa, Mycobacterium avium
AIEAGFDAVEIHLGHNY

SEQ ID NO: 86804 - protein, 26 aa, Mycobacterium avium
AIELQRRGCAIARLVLLDAQPGLDGS

SEQ ID NO: 86805 - protein, 22 aa, Mycobacterium avium
AIGAPESWRAALGPYRATIRNT

SEQ ID NO: 86806 - protein, 20 aa, Mycobacterium avium
AIGKAAPVGLFVETFGTATV

SEQ ID NO: 86807 - protein, 27 aa, Mycobacterium avium
AIGMVIPYAAMEIMKLRLTPSAYQQAS

SEQ ID NO: 86808 - protein, 20 aa, Mycobacterium avium
AIILNCGFTAGGFATARDGN

SEQ ID NO: 86809 - protein, 17 aa, Mycobacterium avium
AILNVTSGLAFMPSALT

SEQ ID NO: 86810 - protein, 18 aa, Mycobacterium avium
AILSRGRPDLGWFPGLAA

SEQ ID NO: 86811 - protein, 20 aa, Mycobacterium avium
AIPEDIAWCRLDEFRCYATL

SEQ ID NO: 86812 - protein, 24 aa, Mycobacterium avium
AIPLGDRLVLIVGDVVGHGVEAAA

SEQ ID NO: 86813 - protein, 26 aa, Mycobacterium avium
AIRASGLPYALFRLGGIISPDTHASI

SEQ ID NO: 86814 - protein, 23 aa, Mycobacterium avium
AIRYLGEDGGRAFVQSLEGVEEV

SEQ ID NO: 86815 - protein, 24 aa, Mycobacterium avium
AISAGLMLIWACDLIVAADNAKFS

SEQ ID NO: 86816 - protein, 17 aa, Mycobacterium avium
AIVAMFNQFCYIQLGSA

SEQ ID NO: 86817 - protein, 18 aa, Mycobacterium avium
AIVEGLRRAYPIGEAVTY

SEQ ID NO: 86818 - protein, 23 aa, Mycobacterium avium
AIVKAVQAIPVLKPVVPDPGYPL

SEQ ID NO: 86819 - protein, 19 aa, Mycobacterium avium
AKAALRYTDALIWTPAHLV

SEQ ID NO: 86820 - protein, 18 aa, Mycobacterium avium
AKADVLLDCFRPGTCERL

SEQ ID NO: 86821 - protein, 20 aa, Mycobacterium avium
AKAFAAKPFDYWRQHLKTMK

SEQ ID NO: 86822 - protein, 25 aa, Mycobacterium avium
AKAIDAGWIDGPRVVPAGHAITPTG

SEQ ID NO: 86823 - protein, 19 aa, Mycobacterium avium
AKANLTWTPQPAMPGQLRA

SEQ ID NO: 86824 - protein, 17 aa, Mycobacterium avium
AKAQSYLTGDFLAYYTK

SEQ ID NO: 86825 - protein, 25 aa, Mycobacterium avium
AKDFIADGAIEIGGRLPINTHGGQL

SEQ ID NO: 86826 - protein, 25 aa, Mycobacterium avium
AKEELARYGVQPDWFGLGDRDIGTH

SEQ ID NO: 86827 - protein, 19 aa, Mycobacterium avium
AKFEFSNGYATVTIETTAN

SEQ ID NO: 86828 - protein, 20 aa, Mycobacterium avium
AKFGMTLCALGIAEEMREAG

SEQ ID NO: 86829 - protein, 17 aa, Mycobacterium avium
AKFLSVLSVRQLATEPS

SEQ ID NO: 86830 - protein, 17 aa, Mycobacterium avium
AKFRDAEKLTFPLLSDP

SEQ ID NO: 86831 - protein, 17 aa, Mycobacterium avium
AKIAFLMLPGVGTKEDI

SEQ ID NO: 86832 - protein, 24 aa, Mycobacterium avium
AKKTKRFLALEARGLKARAEQLSR

SEQ ID NO: 86833 - protein, 25 aa, Mycobacterium avium
AKLFSSRGATVFGIGRDTARLAEVF

SEQ ID NO: 86834 - protein, 17 aa, Mycobacterium avium
AKLKRFREEAGKTGPFE

SEQ ID NO: 86835 - protein, 20 aa, Mycobacterium avium
AKLPTIAAYAYKKSVGQPFL

SEQ ID NO: 86836 - protein, 24 aa, Mycobacterium avium
AKMSAAVTPYLEWLHSTATQAEQA

SEQ ID NO: 86837 - protein, 18 aa, Mycobacterium avium
AKPLPVAAAPEFRTLIRG

SEQ ID NO: 86838 - protein, 24 aa, Mycobacterium avium
AKRLVDFAAGLAFALRGSFDKVAT

SEQ ID NO: 86839 - protein, 30 aa, Mycobacterium avium; identical to SEQ ID NO: 15118

SEQ ID NO: 86840 - protein, 20 aa, Mycobacterium avium
AKSRLAGAYGEDAAAEIAAV

SEQ ID NO: 86841 - protein, 24 aa, Mycobacterium avium
AKTGKLRPALFVVPTDAPGFSATP

SEQ ID NO: 86842 - protein, 19 aa, Mycobacterium avium
AKTTFPVWTMNAIGDVTFH

SEQ ID NO: 86843 - protein, 35 aa, Mycobacterium avium
AKVPYYRVLELAPWLKWPQPNFPVSNFFHAGAAPL

SEQ ID NO: 86844 - protein, 26 aa, Mycobacterium avium
AKVSALRWGSTDARIVFVHGGGQNAH

SEQ ID NO: 86845 - protein, 20 aa, Mycobacterium avium
AKVTRLVLVDVVPRFEKDGS

SEQ ID NO: 86846 - protein, 24 aa, Mycobacterium avium
AKVVAERRLWLAVLRAQQQLGVAV

SEQ ID NO: 86847 - protein, 24 aa, Mycobacterium avium
AKYPETRWRFEYSPESYTGTELEY

SEQ ID NO: 86848 - protein, 25 aa, Mycobacterium avium
ALAAAGRPDGAFRLGPVHIDVVAGV

SEQ ID NO: 86849 - protein, 25 aa, Mycobacterium avium
ALAAELRLPLVLVIDTAGPALSAEA

SEQ ID NO: 86850 - protein, 17 aa, Mycobacterium avium
ALAKGRFVTAPQLEGVS

SEQ ID NO: 86851 - protein, 18 aa, Mycobacterium avium
ALAPRPGERLWDVGAGSG

SEQ ID NO: 86852 - protein, 19 aa, Mycobacterium avium
ALAQCLRGGTGDEVAKLVL

SEQ ID NO: 86853 - protein, 28 aa, Mycobacterium avium
ALARELTEAILVRRVDWVQEITRVHESG

SEQ ID NO: 86854 - protein, 28 aa, Mycobacterium avium
ALARTLRRTLPLMARLTLAKVPARVALR

SEQ ID NO: 86855 - protein, 23 aa, Mycobacterium avium
ALASALWLKCNILAERNTRGMPR

SEQ ID NO: 86856 - protein, 21 aa, Mycobacterium avium
ALAVGRRLRERYGIDEKPTAS

SEQ ID NO: 86857 - protein, 17 aa, Mycobacterium avium
ALCGSIAGRGWPGDEPV

SEQ ID NO: 86858 - protein, 25 aa, Mycobacterium avium
ALDACLDKYARLFAHLRTWDSHTEL

SEQ ID NO: 86859 - protein, 20 aa, Mycobacterium avium
ALEDGYRVFAELAPHPLLVR

SEQ ID NO: 86860 - protein, 24 aa, Mycobacterium avium
ALEKEMFWPRVWQMACRLEEIPKP

SEQ ID NO: 86861 - protein, 19 aa, Mycobacterium avium
ALEQYLAKNRKIIAFVNSS

SEQ ID NO: 86862 - protein, 20 aa, Mycobacterium avium
ALEVTGRLLLAASSRRSAWW

SEQ ID NO: 86863 - protein, 25 aa, Mycobacterium avium
ALFGEPSSGFSTMLWGGQPLPTINP

SEQ ID NO: 86864 - protein, 25 aa, Mycobacterium avium
ALFGTADSWVLWQLTGGPRGGVHAT

SEQ ID NO: 86865 - protein, 19 aa, Mycobacterium avium
ALGDKVARRVLESGQREEL

SEQ ID NO: 86866 - protein, 20 aa, Mycobacterium avium
ALGIREWDAVSLIGSRTTAA

SEQ ID NO: 86867 - protein, 25 aa, Mycobacterium avium
ALGPFPTDRGWAVSELLAGSRRSGF

SEQ ID NO: 86868 - protein, 17 aa, Mycobacterium avium
ALGPGPLCQDGRHAQRV

SEQ ID NO: 86869 - protein, 32 aa, Mycobacterium avium
ALGRPLRIAHAWSFAFDAAWQPLVALLDGHGV

SEQ ID NO: 86870 - protein, 25 aa, Mycobacterium avium
ALHFFPADTLELGWIQSHVTAAAEA

SEQ ID NO: 86871 - protein, 24 aa, Mycobacterium avium
ALHPVAGCTTHWAFVRSASKAYGP

SEQ ID NO: 86872 - protein, 18 aa, Mycobacterium avium
ALHRRWDALWDKLIAACH

SEQ ID NO: 86873 - protein, 17 aa, Mycobacterium avium
ALHRVAPELAQAYRVNA

SEQ ID NO: 86874 - protein, 19 aa, Mycobacterium avium
ALHSWDIHRCLGRQVELPP

SEQ ID NO: 86875 - protein, 22 aa, Mycobacterium avium
ALIKVCADLGLDTVRVPGRSGV

SEQ ID NO: 86876 - protein, 29 aa, Mycobacterium avium
ALIVDEPFLLPAHIDLAALRVKFDGGTLP

SEQ ID NO: 86877 - protein, 23 aa, Mycobacterium avium
ALKHELTPIICIGEHLEVREAGN

SEQ ID NO: 86878 - protein, 23 aa, Mycobacterium avium
ALKVTHPAAIVWAAQMGTVTLHP

SEQ ID NO: 86879 - protein, 20 aa, Mycobacterium avium
ALLAGLLSHVGMRREDSREF

SEQ ID NO: 86880 - protein, 21 aa, Mycobacterium avium
ALLALLPLVGVWRGEGEGRGH

SEQ ID NO: 86881 - protein, 22 aa, Mycobacterium avium
ALLEARWRDVVAALDRRFPDSE

SEQ ID NO: 86882 - protein, 27 aa, Mycobacterium avium
ALLFAKRPLMAEAMLRVFFEAYEIVAD

SEQ ID NO: 86883 - protein, 24 aa, Mycobacterium avium
ALLGEPGQGFLILQTRLAGGRLHH

SEQ ID NO: 86884 - protein, 18 aa, Mycobacterium avium
ALLLRVYAHWARRTGDPL

SEQ ID NO: 86885 - protein, 22 aa, Mycobacterium avium
ALLPHWRERRFGHVVNVSSAGV

SEQ ID NO: 86886 - protein, 22 aa, Mycobacterium avium
ALLPVLRPGKQVLLTDQLAERT

SEQ ID NO: 86887 - protein, 18 aa, Mycobacterium avium
ALLRRIGLAASKYWVCKR

SEQ ID NO: 86888 - protein, 26 aa, Mycobacterium avium
ALLRSCTGWPSGIWIDDPRRSAPDGS

SEQ ID NO: 86889 - protein, 18 aa, Mycobacterium avium
ALMSELLWSRIGAQRDAT

SEQ ID NO: 86890 - protein, 17 aa, Mycobacterium avium
ALNATWRSATCRVLAAA

SEQ ID NO: 86891 - protein, 17 aa, Mycobacterium avium
ALNDAVVDWHRARGSGM

SEQ ID NO: 86892 - protein, 24 aa, Mycobacterium avium
ALNTAVWSGGSFIYVPPGVHVDIP

SEQ ID NO: 86893 - protein, 25 aa, Mycobacterium avium
ALPEEFRMAVYYADVEGFPYKEIAE

SEQ ID NO: 86894 - protein, 24 aa, Mycobacterium avium
ALPEHLVIVGSGFVAAEFAHIFSA

SEQ ID NO: 86895 - protein, 19 aa, Mycobacterium avium
ALPHLRAGSSIIGSSSVNS

SEQ ID NO: 86896 - protein, 23 aa, Mycobacterium avium
ALPRAVEEMVRWTSPSPSKRRTA

SEQ ID NO: 86897 - protein, 23 aa, Mycobacterium avium
ALPSRPVQVIGFTSVPGAGDNLL

SEQ ID NO: 86898 - protein, 18 aa, Mycobacterium avium
ALQQEWRRAADVEADAAA

SEQ ID NO: 86899 - protein, 17 aa, Mycobacterium avium
ALQRGLPVLGICRGAQV

SEQ ID NO: 86900 - protein, 23 aa, Mycobacterium avium
ALRARLRELLGVEVAVLVTDTMG

SEQ ID NO: 86901 - protein, 23 aa, Mycobacterium avium
ALRDGHRAVVPALPLHDTVKAVD

SEQ ID NO: 86902 - protein, 18 aa, Mycobacterium avium
ALRISGRRRLSRLVENVG

SEQ ID NO: 86903 - protein, 26 aa, Mycobacterium avium
ALRLLRPKQVIMLGRPTLHRPVSALL

SEQ ID NO: 86904 - protein, 17 aa, Mycobacterium avium
ALRQGAVETLIIGDIGD

SEQ ID NO: 86905 - protein, 18 aa, Mycobacterium avium
ALSGRRVFADGLDGPPDG

SEQ ID NO: 86906 - protein, 24 aa, Mycobacterium avium
ALTAGTRRARLFYANRSRDAVIFD

SEQ ID NO: 86907 - protein, 19 aa, Mycobacterium avium
ALTARSWRAGLRQRAAARA

SEQ ID NO: 86908 - protein, 20 aa, Mycobacterium avium
ALTGRQSYWESIRFKPDAPS

SEQ ID NO: 86909 - protein, 18 aa, Mycobacterium avium
ALTLLLIEYGRSAAGWAQ

SEQ ID NO: 86910 - protein, 28 aa, Mycobacterium avium
ALTQLLRDIWLLIVDEIGHAIEAFQAFA

SEQ ID NO: 86911 - protein, 20 aa, Mycobacterium avium
ALTWQNPRTLAAMVGNGQAP

SEQ ID NO: 86912 - protein, 17 aa, Mycobacterium avium
ALVKQGTGGSIVLISSS

SEQ ID NO: 86913 - protein, 18 aa, Mycobacterium avium
ALVTPAMLSAHYRLGLHR

SEQ ID NO: 86914 - protein, 18 aa, Mycobacterium avium
ALYPGRIDMGLGRSGQRR

SEQ ID NO: 86915 - protein, 26 aa, Mycobacterium avium
AMAALPRLLGVAYAGLLARAARLTDS

SEQ ID NO: 86916 - protein, 18 aa, Mycobacterium avium
AMEKFDYTKGFKFSTYAT

SEQ ID NO: 86917 - protein, 17 aa, Mycobacterium avium
AMLECTDVQPTFRKHPA

SEQ ID NO: 86918 - protein, 17 aa, Mycobacterium avium
AMLQRLVADGSLAAVNG

SEQ ID NO: 86919 - protein, 17 aa, Mycobacterium avium
AMMEAVGLGRLGPSASL

SEQ ID NO: 86920 - protein, 17 aa, Mycobacterium avium
AMNECWVRHLSAHADAD

SEQ ID NO: 86921 - protein, 21 aa, Mycobacterium avium
AMSKRPLLVLAPGDRVTHDKY

SEQ ID NO: 86922 - protein, 19 aa, Mycobacterium avium
AMVERGAGGIVLFGSGAGL

SEQ ID NO: 86923 - protein, 18 aa, Mycobacterium avium
AMVTAVQPYVQWMHTTAG

SEQ ID NO: 86924 - protein, 19 aa, Mycobacterium avium
AMYLCRELTDLSLPKIGQA

SEQ ID NO: 86925 - protein, 24 aa, Mycobacterium avium
ANAMGRPGFTLGLGPSHEPLVSGV

SEQ ID NO: 86926 - protein, 21 aa, Mycobacterium avium
ANAQGWRFVVLRSPEQRAVVA

SEQ ID NO: 86927 - protein, 22 aa, Mycobacterium avium
ANARLAAALVRASLDDDVRRQV

SEQ ID NO: 86928 - protein, 23 aa, Mycobacterium avium
ANGDMIAALGMLDARHVAGDARL

SEQ ID NO: 86929 - protein, 17 aa, Mycobacterium avium
ANGECKEIVMVQDRDGH

SEQ ID NO: 86930 - protein, 29 aa, Mycobacterium avium
ANGGRKPWLPHFYLGHGIGTYPAEAPMIG

SEQ ID NO: 86931 - protein, 19 aa, Mycobacterium avium
ANLDSCFVVTSAVLPKMKA

SEQ ID NO: 86932 - protein, 19 aa, Mycobacterium avium
ANSIALFAEYIEWRADHPS

SEQ ID NO: 86933 - protein, 17 aa, Mycobacterium avium
ANSPFFFGHQLWAETRI

SEQ ID NO: 86934 - protein, 20 aa, Mycobacterium avium
APAALAARYSAARLRADGLA

SEQ ID NO: 86935 - protein, 24 aa, Mycobacterium avium
APAGPYVHWVVTGIAPGSGSTSAG

SEQ ID NO: 86936 - protein, 17 aa, Mycobacterium avium
APANRWSVRTVGDLELL

SEQ ID NO: 86937 - protein, 24 aa, Mycobacterium avium
APARARAAVLAAMRAAHPYEEPAF

SEQ ID NO: 86938 - protein, 23 aa, Mycobacterium avium
APARTVYRLAPRTAAPEAAAPRP

SEQ ID NO: 86939 - protein, 21 aa, Mycobacterium avium
APASIPGMFAAQVARSAEAVA

SEQ ID NO: 86940 - protein, 20 aa, Mycobacterium avium
APDFRLFWDNAYAVHTLTHD

SEQ ID NO: 86941 - protein, 18 aa, Mycobacterium avium
APDMEIIGMLTLLIGGGF

SEQ ID NO: 86942 - protein, 20 aa, Mycobacterium avium
APDPPGPHLLVLARGPEGYR

SEQ ID NO: 86943 - protein, 18 aa, Mycobacterium avium
APEAPGWYHNLKAKPEAE

SEQ ID NO: 86944 - protein, 23 aa, Mycobacterium avium
APERLRGAITAMLSGVAVVDDLD

SEQ ID NO: 86945 - protein, 25 aa, Mycobacterium avium
APESAPCWPVTVTVGPDDGAPTVDL

SEQ ID NO: 86946 - protein, 24 aa, Mycobacterium avium
APGELRPALERAFASGLPAVVNVL

SEQ ID NO: 86947 - protein, 17 aa, Mycobacterium avium
APGEPFATHVLNVLHLL

SEQ ID NO: 86948 - protein, 18 aa, Mycobacterium avium
APGSFSWHVLTSLADDVQ

SEQ ID NO: 86949 - protein, 18 aa, Mycobacterium avium
APHPELLYRLVVDEHLGP

SEQ ID NO: 86950 - protein, 22 aa, Mycobacterium avium
APHSKLAIRWALHDRPEDACRK

SEQ ID NO: 86951 - protein, 18 aa, Mycobacterium avium
APHTLLIPGTRSITHLEE

SEQ ID NO: 86952 - protein, 21 aa, Mycobacterium avium
APHVGEAEFGPLLRRLGRFLP

SEQ ID NO: 86953 - protein, 25 aa, Mycobacterium avium
APIERLEELVPIYAELLSLLADNGA

SEQ ID NO: 86954 - protein, 17 aa, Mycobacterium avium
APIPSLLAVAGVHHHLV

SEQ ID NO: 86955 - protein, 19 aa, Mycobacterium avium
APITRAFRRIVLYEPPIPS

SEQ ID NO: 86956 - protein, 21 aa, Mycobacterium avium
APLDRRLLLGMLSELPPGAGV

SEQ ID NO: 86957 - protein, 17 aa, Mycobacterium avium
APLFEYTLAQGIEDGFL

SEQ ID NO: 86958 - protein, 17 aa, Mycobacterium avium
APLLIRDDIDYMHALVD

SEQ ID NO: 86959 - protein, 22 aa, Mycobacterium avium
APLPTWAHRRLMLRRESVQRAH

SEQ ID NO: 86960 - protein, 25 aa, Mycobacterium avium
APLRGAAYGHGWATWFPPDGPPRTG

SEQ ID NO: 86961 - protein, 18 aa, Mycobacterium avium
APLTMVFVHGFCLQMGAF

SEQ ID NO: 86962 - protein, 18 aa, Mycobacterium avium
APLWKGSRFPMTSCISGW

SEQ ID NO: 86963 - protein, 25 aa, Mycobacterium avium
APNEVMRSLGLPTMFPTIGGHEGSG

SEQ ID NO: 86964 - protein, 26 aa, Mycobacterium avium
APNQAMKSVHRILRNFKMPGFTVPEF

SEQ ID NO: 86965 - protein, 26 aa, Mycobacterium avium
APPEVAALRFFWPRLTPGAFVLLDDY

SEQ ID NO: 86966 - protein, 18 aa, Mycobacterium avium
APPGLAINPLVNRYRTKD

SEQ ID NO: 86967 - protein, 23 aa, Mycobacterium avium
APQPAPAGALWALDLIDAPERLR

SEQ ID NO: 86968 - protein, 25 aa, Mycobacterium avium
APRRFWRRKFRILDRLGRSRPDVQL

SEQ ID NO: 86969 - protein, 23 aa, Mycobacterium avium
APSRLFGANGLRTGPDGRIYIAQ

SEQ ID NO: 86970 - protein, 21 aa, Mycobacterium avium
APTLHAGRLVARRLRASGVDT

SEQ ID NO: 86971 - protein, 17 aa, Mycobacterium avium
APTRLRELAKMDGAVVL

SEQ ID NO: 86972 - protein, 22 aa, Mycobacterium avium
APTRTALRNWLRRVRLDPEQTL

SEQ ID NO: 86973 - protein, 20 aa, Mycobacterium avium
APVDFPLGGVVPGFQKAIAG

SEQ ID NO: 86974 - protein, 22 aa, Mycobacterium avium
APVDGWDFSWLDGRATEERPSW

SEQ ID NO: 86975 - protein, 17 aa, Mycobacterium avium
APVGLFVETFGTATVDP

SEQ ID NO: 86976 - protein, 37 aa, Mycobacterium avium
AQARQALTEAVLWPLQHPDTFARLGVQPPRGVLLYGP

SEQ ID NO: 86977 - protein, 25 aa, Mycobacterium avium
AQATAGAPAHDWLTLTGGAIGYGIP

SEQ ID NO: 86978 - protein, 19 aa, Mycobacterium avium
AQATRVAREFARSAEESGG

SEQ ID NO: 86979 - protein, 27 aa, Mycobacterium avium
AQGARLGEALALLGWNMSLSNLRWDGD

SEQ ID NO: 86980 - protein, 19 aa, Mycobacterium avium
AQGIPPQFLVDILTNLRTD

SEQ ID NO: 86981 - protein, 27 aa, Mycobacterium avium
AQGVLCGSIVSGLRMRPGNWAGAYACW

SEQ ID NO: 86982 - protein, 28 aa, Mycobacterium avium
AQGWVCGMDVDWRGALGTGHLVDLPTYA

SEQ ID NO: 86983 - protein, 25 aa, Mycobacterium avium
AQIAKLGLRGGVLLPGIAPGTGIPP

SEQ ID NO: 86984 - protein, 19 aa, Mycobacterium avium
AQLAPVVFEGTSFGGALMT

SEQ ID NO: 86985 - protein, 17 aa, Mycobacterium avium
AQLPLPVTILELDDGSI

SEQ ID NO: 86986 - protein, 18 aa, Mycobacterium avium
AQLSPEEFGRFLASQPDL

SEQ ID NO: 86987 - protein, 24 aa, Mycobacterium avium
AQMRRFGGLVAVELADAAAVRALL

SEQ ID NO: 86988 - protein, 22 aa, Mycobacterium avium
AQPAERRLLIVIGDGLISDEGY

SEQ ID NO: 86989 - protein, 33 aa, Mycobacterium avium
AQPALRRLGLEATVRPSFAFYNTFEEIDVFLRA

SEQ ID NO: 86990 - protein, 19 aa, Mycobacterium avium
AQRKLLAPFFVWVTVGLYD

SEQ ID NO: 86991 - protein, 23 aa, Mycobacterium avium
AQTLERFTALVLPASGEPTVVVP

SEQ ID NO: 86992 - protein, 23 aa, Mycobacterium avium
AQTYCPPGQVLVEPIFVPRPGGT

SEQ ID NO: 86993 - protein, 24 aa, Mycobacterium avium
AQVLKRRGPAGARVIVGRDARHGS

SEQ ID NO: 86994 - protein, 19 aa, Mycobacterium avium
AQVSLAQMEYMLPRLRGWG

SEQ ID NO: 86995 - protein, 23 aa, Mycobacterium avium
AQVTEFDGGVLVNWDVREGFFPP

SEQ ID NO: 86996 - protein, 18 aa, Mycobacterium avium
AQYGEMWAQDAAAMYGYA

SEQ ID NO: 86997 - protein, 17 aa, Mycobacterium avium
ARAAGRQAIEHNLGLSN

SEQ ID NO: 86998 - protein, 21 aa, Mycobacterium avium
ARAALAERLPAYMVPAAVVVL

SEQ ID NO: 86999 - protein, 20 aa, Mycobacterium avium
ARAAQRRWARLAPADRAAGL

SEQ ID NO: 87000 - protein, 17 aa, Mycobacterium avium
ARAFLDFAGTHHISVTT

SEQ ID NO: 87001 - protein, 19 aa, Mycobacterium avium
ARAFSGVKIACVGESTADR

SEQ ID NO: 87002 - protein, 20 aa, Mycobacterium avium
ARAGIPFSLSTLGTCAIEDL

SEQ ID NO: 87003 - protein, 19 aa, Mycobacterium avium
ARAKFPGLTASQYDGVIGP

SEQ ID NO: 87004 - protein, 21 aa, Mycobacterium avium
ARALTPPALIARVVQALRDGH

SEQ ID NO: 87005 - protein, 17 aa, Mycobacterium avium
ARALVSALGSRYLDLAG

SEQ ID NO: 87006 - protein, 28 aa, Mycobacterium avium
ARAPEPLAEYVLGLAHRVIRPEVRGQAG

SEQ ID NO: 87007 - protein, 17 aa, Mycobacterium avium
ARAYLRHELLGPRLHEC

SEQ ID NO: 87008 - protein, 18 aa, Mycobacterium avium
ARCATPGPHRAFHVGAGG

SEQ ID NO: 87009 - protein, 18 aa, Mycobacterium avium
ARCGADVVIASRNLDNCV

SEQ ID NO: 87010 - protein, 19 aa, Mycobacterium avium
ARCRHCTGPLSLAESPGEG

SEQ ID NO: 87011 - protein, 22 aa, Mycobacterium avium
ARDHGWPQFADRLLELARAAET

SEQ ID NO: 87012 - protein, 25 aa, Mycobacterium avium
ARDVPSLGWRAYRLVAGEAASGWAP

SEQ ID NO: 87013 - protein, 18 aa, Mycobacterium avium
ARDVYQLGNLVLRGGPFA

SEQ ID NO: 87014 - protein, 19 aa, Mycobacterium avium
AREAAWRVLDQRPFDVQVM

SEQ ID NO: 87015 - protein, 17 aa, Mycobacterium avium
AREFGWAPVPSHDDGTL

SEQ ID NO: 87016 - protein, 17 aa, Mycobacterium avium
ARFAAMVVLERLSPDQR

SEQ ID NO: 87017 - protein, 21 aa, Mycobacterium avium
ARGAHALACDYAKIREQYGNP

SEQ ID NO: 87018 - protein, 17 aa, Mycobacterium avium
ARGALCVGPRSCPHLGA

SEQ ID NO: 87019 - protein, 19 aa, Mycobacterium avium
ARGIYYGRLSEMTSTDFQV

SEQ ID NO: 87020 - protein, 17 aa, Mycobacterium avium
ARHTGGTFVFRIEDTDA

SEQ ID NO: 87021 - protein, 24 aa, Mycobacterium avium
ARHVSAVLGRRVGPSTGTNVWGAF

SEQ ID NO: 87022 - protein, 25 aa, Mycobacterium avium
ARIADRPAAVLLHLGPGLGNGLANL

SEQ ID NO: 87023 - protein, 21 aa, Mycobacterium avium
ARIAVSYHTPVIVLSDGAIAN

SEQ ID NO: 87024 - protein, 23 aa, Mycobacterium avium
ARIESLGYGAAWIGGSPDAELSW

SEQ ID NO: 87025 - protein, 23 aa, Mycobacterium avium
ARIGPMSVPAGWTAATGNPVAAA

SEQ ID NO: 87026 - protein, 17 aa, Mycobacterium avium
ARIKQRWDDFVVDGLGI

SEQ ID NO: 87027 - protein, 26 aa, Mycobacterium avium
ARIVKALGGRGVFGVELMVNDDEVYF

SEQ ID NO: 87028 - protein, 19 aa, Mycobacterium avium
ARLALLLDMVREHFALAPD

SEQ ID NO: 87029 - protein, 33 aa, Mycobacterium avium
ARLAVANALALQFGWRLFAPILRAATGIEELTD

SEQ ID NO: 87030 - protein, 22 aa, Mycobacterium avium
ARLCDEIDCAAARIALAHARAL

SEQ ID NO: 87031 - protein, 20 aa, Mycobacterium avium
ARLKLADVMAEARERIGEEA

SEQ ID NO: 87032 - protein, 18 aa, Mycobacterium avium
ARLLRLSVHLGVADRVRF

SEQ ID NO: 87033 - protein, 23 aa, Mycobacterium avium
ARLQDGPVRFDFRVQIAGPTDST

SEQ ID NO: 87034 - protein, 18 aa, Mycobacterium avium
ARLQGWEEFDEPVDRIIS

SEQ ID NO: 87035 - protein, 23 aa, Mycobacterium avium
ARLSALARNAAELGLIPDTAHLE

SEQ ID NO: 87036 - protein, 25 aa, Mycobacterium avium
ARLVKAGKVAKDWNTDATKGIPFGS

SEQ ID NO: 87037 - protein, 17 aa, Mycobacterium avium
ARLVKQFGAPELADAIL

SEQ ID NO: 87038 - protein, 21 aa, Mycobacterium avium
ARMDLTFSLAERFTESGQRAG

SEQ ID NO: 87039 - protein, 21 aa, Mycobacterium avium
ARMDLTFTLGERWTSAGEPAG

SEQ ID NO: 87040 - protein, 17 aa, Mycobacterium avium
ARMLGGITVAELVDALR

SEQ ID NO: 87041 - protein, 18 aa, Mycobacterium avium
ARMYRTGDLVRWRADGQL

SEQ ID NO: 87042 - protein, 20 aa, Mycobacterium avium
ARNLANLLSLDAPNQPSPSI

SEQ ID NO: 87043 - protein, 20 aa, Mycobacterium avium
ARPDALRLLERVGLGNRTEH

SEQ ID NO: 87044 - protein, 20 aa, Mycobacterium avium
ARPDTLLGWLQSDIAANAIR

SEQ ID NO: 87045 - protein, 20 aa, Mycobacterium avium
ARPGAFERLSPPWSPIRLLT

SEQ ID NO: 87046 - protein, 21 aa, Mycobacterium avium
ARPREIAHAICFLLDEDAGYI

SEQ ID NO: 87047 - protein, 19 aa, Mycobacterium avium
ARPRYVRIAADLPSTATHK

SEQ ID NO: 87048 - protein, 26 aa, Mycobacterium avium
ARQAVWPERMFSLLAGFVEAGESFEV

SEQ ID NO: 87049 - protein, 23 aa, Mycobacterium avium
ARQGLPLVCVVGVDHQWGLEVGV

SEQ ID NO: 87050 - protein, 21 aa, Mycobacterium avium
ARRARDVWWVDVLLSQLEAKL

SEQ ID NO: 87051 - protein, 25 aa, Mycobacterium avium
ARRRAFRLWLDERRAALVRLAPGYE

SEQ ID NO: 87052 - protein, 22 aa, Mycobacterium avium
ARRVAAILVERIDGVPALAPRG

SEQ ID NO: 87053 - protein, 21 aa, Mycobacterium avium
ARRVGCWRFVTLHRQVDSSRD

SEQ ID NO: 87054 - protein, 20 aa, Mycobacterium avium
ARRWAMAATLGDHVRMTRPQ

SEQ ID NO: 87055 - protein, 20 aa, Mycobacterium avium
ARSASDAVIFMDHGKVVESG

SEQ ID NO: 87056 - protein, 21 aa, Mycobacterium avium
ARSEFWLEAATFTLTEDACTD

SEQ ID NO: 87057 - protein, 25 aa, Mycobacterium avium
ARSRPRFVAATLRHADKVILLSEQA

SEQ ID NO: 87058 - protein, 17 aa, Mycobacterium avium
ARSVARWAHTAHSVDST

SEQ ID NO: 87059 - protein, 18 aa, Mycobacterium avium
ARTRDEWARVFAGTDACV

SEQ ID NO: 87060 - protein, 23 aa, Mycobacterium avium
ARTTPPRIAFVFPGQGNQWQAMG

SEQ ID NO: 87061 - protein, 18 aa, Mycobacterium avium
ARVAEAFLGKLGITASES

SEQ ID NO: 87062 - protein, 34 aa, Mycobacterium avium
ARVAGGLRADGLRRGDRVAVRYPAGIDWVLAFWG

SEQ ID NO: 87063 - protein, 17 aa, Mycobacterium avium
ARVAIPHIMAGKRGGSI

SEQ ID NO: 87064 - protein, 17 aa, Mycobacterium avium
ARVEEWDIALLHRDHPS

SEQ ID NO: 87065 - protein, 22 aa, Mycobacterium avium
ARVFPEPDRLYLHRSGADRNVA

SEQ ID NO: 87066 - protein, 21 aa, Mycobacterium avium
ARVLQALLARWDHHPRVDLVT

SEQ ID NO: 87067 - protein, 18 aa, Mycobacterium avium
ARVLYDFVNDEALPGTDI

SEQ ID NO: 87068 - protein, 20 aa, Mycobacterium avium
ARVPSRHLVALLATGRDADP

SEQ ID NO: 87069 - protein, 19 aa, Mycobacterium avium
ARVQFLREAFEVDILTIGL

SEQ ID NO: 87070 - protein, 21 aa, Mycobacterium avium
ARVRLPGGMLTPAQLTVLCDI

SEQ ID NO: 87071 - protein, 18 aa, Mycobacterium avium
ARVWTRQGGLLASSHQVV

SEQ ID NO: 87072 - protein, 27 aa, Mycobacterium avium
ARYTWPRFVCALPREFFAAVRAELAQR

SEQ ID NO: 87073 - protein, 19 aa, Mycobacterium avium
ASAIDRAALPYVVGTIAGD

SEQ ID NO: 87074 - protein, 17 aa, Mycobacterium avium
ASALKEKGPRFALAGSY

SEQ ID NO: 87075 - protein, 24 aa, Mycobacterium avium
ASAQRGLSEAVVRDISAKKNEPGW

SEQ ID NO: 87076 - protein, 23 aa, Mycobacterium avium
ASARELFARNGIRNTSIRAVAAA

SEQ ID NO: 87077 - protein, 21 aa, Mycobacterium avium
ASARFLLRVRRDELLGAADVP

SEQ ID NO: 87078 - protein, 23 aa, Mycobacterium avium
ASARPAGAVPDWREPRVRGGGAL

SEQ ID NO: 87079 - protein, 19 aa, Mycobacterium avium
ASAVRARLAPAQAPGTAAS

SEQ ID NO: 87080 - protein, 17 aa, Mycobacterium avium
ASERRIAEETAKAEGKP

SEQ ID NO: 87081 - protein, 25 aa, Mycobacterium avium
ASEYVFRFAPLVGIYGGTLEVFRNM

SEQ ID NO: 87082 - protein, 23 aa, Mycobacterium avium
ASFCRERLAPFEVPAEFRRAAEL

SEQ ID NO: 87083 - protein, 17 aa, Mycobacterium avium
ASFYIYFEDKGHLLRRL

SEQ ID NO: 87084 - protein, 17 aa, Mycobacterium avium
ASGDWRPFADLFTEDVV

SEQ ID NO: 87085 - protein, 17 aa, Mycobacterium avium
ASGHLTRLADVLIGSHV

SEQ ID NO: 87086 - protein, 21 aa, Mycobacterium avium
ASGRVAYTLGLHGPAVTVDTA

SEQ ID NO: 87087 - protein, 17 aa, Mycobacterium avium
ASICARRGPTLQWVRSR

SEQ ID NO: 87088 - protein, 32 aa, Mycobacterium avium
ASITASGMLHWPDSGNGPAQFHCEIAVDGQVV

SEQ ID NO: 87089 - protein, 22 aa, Mycobacterium avium
ASLEPLANMGVIYWVYPNLILA

SEQ ID NO: 87090 - protein, 18 aa, Mycobacterium avium
ASLKDGRATLALPGGLRW

SEQ ID NO: 87091 - protein, 17 aa, Mycobacterium avium
ASLPNCTAADLAQVSAG

SEQ ID NO: 87092 - protein, 23 aa, Mycobacterium avium
ASLREARRGMALAAELRLPLVLV

SEQ ID NO: 87093 - protein, 24 aa, Mycobacterium avium
ASPAAVCPHVEWALSSTLGAKANL

SEQ ID NO: 87094 - protein, 25 aa, Mycobacterium avium
ASPAEEPHTAWATGMPAVASAGRGG

SEQ ID NO: 87095 - protein, 22 aa, Mycobacterium avium
ASPMARIDLRGAELTAARLRSA

SEQ ID NO: 87096 - protein, 22 aa, Mycobacterium avium
ASPQRRLDVGSGRATTIQELAN

SEQ ID NO: 87097 - protein, 22 aa, Mycobacterium avium
ASPRGIRFAAAHAEAVFVSGPT

SEQ ID NO: 87098 - protein, 26 aa, Mycobacterium avium
ASPSQSEWGWAWPADRRVLYNRASAD

SEQ ID NO: 87099 - protein, 19 aa, Mycobacterium avium
ASQAEYDRFVWVDDSDQPW

SEQ ID NO: 87100 - protein, 25 aa, Mycobacterium avium
ASSARTRALLGWNPSHHTLLEDLEH

SEQ ID NO: 87101 - protein, 27 aa, Mycobacterium avium
ASSAWTLGFYALHNWMLSLFDPRAQRE

SEQ ID NO: 87102 - protein, 24 aa, Mycobacterium avium
ASSGEYEDRCGPIITEWLAQQGFS

SEQ ID NO: 87103 - protein, 17 aa, Mycobacterium avium
ASVAAYTWLATRGGGNV

SEQ ID NO: 87104 - protein, 19 aa, Mycobacterium avium
ASVIMEFANEFGLTMPIAR

SEQ ID NO: 87105 - protein, 18 aa, Mycobacterium avium
ASVISELVGESWQGSSSE

SEQ ID NO: 87106 - protein, 20 aa, Mycobacterium avium
ASVPPPLIAANRMQVSQLQA

SEQ ID NO: 87107 - protein, 22 aa, Mycobacterium avium
ASVTCVRTGGKIDIGSGSTGGA

SEQ ID NO: 87108 - protein, 20 aa, Mycobacterium avium
ASWTSCRNGDGGLLPYTYRV

SEQ ID NO: 87109 - protein, 17 aa, Mycobacterium avium
ATARREIDRVLSEVREQ

SEQ ID NO: 87110 - protein, 20 aa, Mycobacterium avium
ATASMLEPIWQVMPPSKAEG

SEQ ID NO: 87111 - protein, 26 aa, Mycobacterium avium
ATAYLECAQACGLALLGGPPTPETAM

SEQ ID NO: 87112 - protein, 22 aa, Mycobacterium avium
ATCAVEGIPIKVALINNGNLGM

SEQ ID NO: 87113 - protein, 26 aa, Mycobacterium avium
ATDDLDFLRLAVLDALLVLQADVQPV

SEQ ID NO: 87114 - protein, 18 aa, Mycobacterium avium
ATDGLRGSLDLMPGSLEK

SEQ ID NO: 87115 - protein, 24 aa, Mycobacterium avium
ATDVPKLGSFEVMNRTIDIAQAAL

SEQ ID NO: 87116 - protein, 20 aa, Mycobacterium avium
ATEALNLVSYVVGDNRFERA

SEQ ID NO: 87117 - protein, 19 aa, Mycobacterium avium
ATELLAVFDVYRTRFGALL

SEQ ID NO: 87118 - protein, 19 aa, Mycobacterium avium
ATERPRGVFSRELVLGDNL

SEQ ID NO: 87119 - protein, 17 aa, Mycobacterium avium
ATEVGVAAADCLAHAVL

SEQ ID NO: 87120 - protein, 23 aa, Mycobacterium avium
ATGACGRLGLPASGYLYGTYENP

SEQ ID NO: 87121 - protein, 17 aa, Mycobacterium avium
ATGARMLVTLVHELRRR

SEQ ID NO: 87122 - protein, 24 aa, Mycobacterium avium
ATGCGTASRFSCPYHAWTYDNTGR

SEQ ID NO: 87123 - protein, 18 aa, Mycobacterium avium
ATGDAHFNEVFLTDVFVP

SEQ ID NO: 87124 - protein, 24 aa, Mycobacterium avium
ATGPDWFACAGVRVADEQLRGRAG

SEQ ID NO: 87125 - protein, 20 aa, Mycobacterium avium
ATGRRFEALSALSAGVKDVR

SEQ ID NO: 87126 - protein, 17 aa, Mycobacterium avium
ATKRLGMTVTLAERERV

SEQ ID NO: 87127 - protein, 19 aa, Mycobacterium avium
ATLASRWRHIHGGPGELLD

SEQ ID NO: 87128 - protein, 18 aa, Mycobacterium avium
ATLDEARAKFPGLTASQY

SEQ ID NO: 87129 - protein, 17 aa, Mycobacterium avium
ATLESIADMEMLPVDDD

SEQ ID NO: 87130 - protein, 19 aa, Mycobacterium avium
ATLFRAGEHLRLVVAGRWL

SEQ ID NO: 87131 - protein, 25 aa, Mycobacterium avium
ATLHHRASALIGRLMRELTSDWDYA

SEQ ID NO: 87132 - protein, 19 aa, Mycobacterium avium
ATLLARHPAVRAVRYPGLA

SEQ ID NO: 87133 - protein, 28 aa, Mycobacterium avium
ATLRLRAGECAVAYEEFERLIPDLVEVL

SEQ ID NO: 87134 - protein, 23 aa, Mycobacterium avium
ATLWRAAGRGRRWMVAPHVPPEP

SEQ ID NO: 87135 - protein, 25 aa, Mycobacterium avium
ATMLALLGERGMRRILTEGGPTLLN

SEQ ID NO: 87136 - protein, 19 aa, Mycobacterium avium
ATMPDPIITLARTFMNQPT

SEQ ID NO: 87137 - protein, 19 aa, Mycobacterium avium
ATMRALTARSWRAGLRQRA

SEQ ID NO: 87138 - protein, 24 aa, Mycobacterium avium
ATMRRARLLAPMRPDRYLRIAAAM

SEQ ID NO: 87139 - protein, 17 aa, Mycobacterium avium
ATPARRWAMAATLGDHV

SEQ ID NO: 87140 - protein, 21 aa, Mycobacterium avium
ATPETRDWWGGMWADRILHST

SEQ ID NO: 87141 - protein, 24 aa, Mycobacterium avium
ATPFSAVAVRPLLRGSVLGVTGMA

SEQ ID NO: 87142 - protein, 19 aa, Mycobacterium avium
ATRALPPVRQLGGGLVEIP

SEQ ID NO: 87143 - protein, 24 aa, Mycobacterium avium
ATREILDREILGIAEAIRGSGLSA

SEQ ID NO: 87144 - protein, 19 aa, Mycobacterium avium
ATRLSGLFRTRRFRVYTTD

SEQ ID NO: 87145 - protein, 25 aa, Mycobacterium avium
ATTVGRLSVPQTWAATNPAAGTAAE

SEQ ID NO: 87146 - protein, 17 aa, Mycobacterium avium
ATVKLLELDPDKVNVSG

SEQ ID NO: 87147 - protein, 23 aa, Mycobacterium avium
ATVPSIVRKGRGGSVVLVSSSQG

SEQ ID NO: 87148 - protein, 20 aa, Mycobacterium avium
ATWRRLGLSVPLVVDPVCAS

SEQ ID NO: 87149 - protein, 23 aa, Mycobacterium avium
AVAACPRQAISVLTEQPPYAPDE

SEQ ID NO: 87150 - protein, 22 aa, Mycobacterium avium
AVAAPRALIRLCAGGDTAAGLL

SEQ ID NO: 87151 - protein, 18 aa, Mycobacterium avium
AVAGGGGRGMRRVTDPGA

SEQ ID NO: 87152 - protein, 30 aa, Mycobacterium avium
AVAGHWLLARLGKRVLRPGGVELTRTLLSH

SEQ ID NO: 87153 - protein, 17 aa, Mycobacterium avium
AVAGRRGGVTVATNMAG

SEQ ID NO: 87154 - protein, 21 aa, Mycobacterium avium
AVAHAAWRGAPTVEEQDIRVA

SEQ ID NO: 87155 - protein, 20 aa, Mycobacterium avium
AVAKAAPWLRDGDVVVVTSK

SEQ ID NO: 87156 - protein, 30 aa, Mycobacterium avium
AVAKARFVRVSPRKARRVIDLVRGRSVTDA

SEQ ID NO: 87157 - protein, 20 aa, Mycobacterium avium
AVAMQRYHWVEAINHVHTGG

SEQ ID NO: 87158 - protein, 18 aa, Mycobacterium avium
AVAQCARAGEGVTAAVIA

SEQ ID NO: 87159 - protein, 29 aa, Mycobacterium avium
AVARGRLALGVGPSHHWIIRDMLGLPYQK

SEQ ID NO: 87160 - protein, 22 aa, Mycobacterium avium
AVARLSLVPPLYVSRTLGAQRK

SEQ ID NO: 87161 - protein, 32 aa, Mycobacterium avium
AVARPDRTFSLGSWWSGVAWSTIKVPLAIAAL

SEQ ID NO: 87162 - protein, 23 aa, Mycobacterium avium
AVARSEFAHPRFAALRDATPELA

SEQ ID NO: 87163 - protein, 24 aa, Mycobacterium avium
AVASWQIHRCIGMDGSTLVRTLSG

SEQ ID NO: 87164 - protein, 20 aa, Mycobacterium avium
AVDIDPRWVKKLAARDAAAD

SEQ ID NO: 87165 - protein, 24 aa, Mycobacterium avium
AVENALKVAFDWKNRHNERRGVDP

SEQ ID NO: 87166 - protein, 18 aa, Mycobacterium avium
AVFECVGAPGLIQNLVES

SEQ ID NO: 87167 - protein, 24 aa, Mycobacterium avium
AVGCERATVVAPSFTSMTGLVLAA

SEQ ID NO: 87168 - protein, 24 aa, Mycobacterium avium
AVGCKRPGFHNGYLATFNRDNVRL

SEQ ID NO: 87169 - protein, 22 aa, Mycobacterium avium
AVIAGALGSWLMSRGVAVSPTA

SEQ ID NO: 87170 - protein, 24 aa, Mycobacterium avium
AVIVCPIGFVADHIEVVWDLDEEL

SEQ ID NO: 87171 - protein, 18 aa, Mycobacterium avium
AVLCQAAGAAALPYPLVE

SEQ ID NO: 87172 - protein, 23 aa, Mycobacterium avium
AVLDEAQLRWTVTTETGERVTAR

SEQ ID NO: 87173 - protein, 19 aa, Mycobacterium avium
AVLRRAPWVDVVFGTHNIG

SEQ ID NO: 87174 - protein, 25 aa, Mycobacterium avium
AVLSRAQLLELVWGYDFAADTNVVD

SEQ ID NO: 87175 - protein, 17 aa, Mycobacterium avium
AVNDIRLTLGVMLEIGP

SEQ ID NO: 87176 - protein, 22 aa, Mycobacterium avium
AVNEADYARMWVQAATTMSTYQ

SEQ ID NO: 87177 - protein, 23 aa, Mycobacterium avium
AVNELRPGWVTPLDLPLIPGTGT

SEQ ID NO: 87178 - protein, 26 aa, Mycobacterium avium
AVNMLRGGFELAYRLLSYPKPVVMAC

SEQ ID NO: 87179 - protein, 22 aa, Mycobacterium avium
AVNYPLYVIMSLLGLPEADFPR

SEQ ID NO: 87180 - protein, 22 aa, Mycobacterium avium
AVPAEVRPIIAAMGEAAEALAA

SEQ ID NO: 87181 - protein, 24 aa, Mycobacterium avium
AVPEVARAWSSYAPTLVRLPDGRV

SEQ ID NO: 87182 - protein, 20 aa, Mycobacterium avium
AVQLQGRFVLGVGSGEALNE

SEQ ID NO: 87183 - protein, 24 aa, Mycobacterium avium
AVQSLRLYERHGLVTPARSQGGTR

SEQ ID NO: 87184 - protein, 25 aa, Mycobacterium avium
AVRPEPFGALLYHFGTRKLSFLKNR

SEQ ID NO: 87185 - protein, 22 aa, Mycobacterium avium
AVRRGEALVVPQVFFTKSGEVV

SEQ ID NO: 87186 - protein, 19 aa, Mycobacterium avium
AVRRIREHPGLTVGLEPLL

SEQ ID NO: 87187 - protein, 17 aa, Mycobacterium avium
AVRTRLVGLQREMASGP

SEQ ID NO: 87188 - protein, 24 aa, Mycobacterium avium
AVRVIRTLHRLGIRSVAVYSDPDA

SEQ ID NO: 87189 - protein, 18 aa, Mycobacterium avium
AVSFPAPQTYVAPIAFNV

SEQ ID NO: 87190 - protein, 18 aa, Mycobacterium avium
AVSGSKTEALRCLKRRLA

SEQ ID NO: 87191 - protein, 26 aa, Mycobacterium avium
AVSLELADGLGLPVLSVRAMVARSVS

SEQ ID NO: 87192 - protein, 19 aa, Mycobacterium avium
AVSLGDWPIALPREIAAAA

SEQ ID NO: 87193 - protein, 20 aa, Mycobacterium avium
AVSVPELFATQVARAPQDVA

SEQ ID NO: 87194 - protein, 18 aa, Mycobacterium avium
AVTARFPRARLDGEPQYK

SEQ ID NO: 87195 - protein, 19 aa, Mycobacterium avium
AVTFLRPLDGFPQRRARLM

SEQ ID NO: 87196 - protein, 23 aa, Mycobacterium avium
AVTRWVPFADWVDGRVLLGGRRP

SEQ ID NO: 87197 - protein, 20 aa, Mycobacterium avium
AVVDEACLDPSPTNAATARL

SEQ ID NO: 87198 - protein, 23 aa, Mycobacterium avium
AVVQGLSMTIGWPDLAEAALAIR

SEQ ID NO: 87199 - protein, 18 aa, Mycobacterium avium
AVVRAVLEPLGLTADEPV

SEQ ID NO: 87200 - protein, 23 aa, Mycobacterium avium
AVYLADCRKLGITVLPPDVNESL

SEQ ID NO: 87201 - protein, 18 aa, Mycobacterium avium
AWAAETCAEYAPELNVVG

SEQ ID NO: 87202 - protein, 22 aa, Mycobacterium avium
AWLADELTRSWGAQWPHLPDAM

SEQ ID NO: 87203 - protein, 26 aa, Mycobacterium avium
AWNVSELPCGPGRDVQEMLAAAADGT

SEQ ID NO: 87204 - protein, 24 aa, Mycobacterium avium
AWSVCMRMTLSGFYSHPWAWNEIG

SEQ ID NO: 87205 - protein, 20 aa, Mycobacterium avium
AWTELADAIGERGRAGLDRL

SEQ ID NO: 87206 - protein, 22 aa, Mycobacterium avium
AWTRIDDFGGWRAHVRAMVLDE

SEQ ID NO: 87207 - protein, 18 aa, Mycobacterium avium
AYAAFTWAHEHAGELGAI

SEQ ID NO: 87208 - protein, 27 aa, Mycobacterium avium
AYEDLAWFCIRAWRFGAPAGLGAGGLG

SEQ ID NO: 87209 - protein, 22 aa, Mycobacterium avium
AYFGCPQRFSFSKSALQDIRPK

SEQ ID NO: 87210 - protein, 19 aa, Mycobacterium avium
AYGAAGFAVLERTIAALRS

SEQ ID NO: 87211 - protein, 17 aa, Mycobacterium avium
AYLHAGGQWEWDSAAPA

SEQ ID NO: 87212 - protein, 18 aa, Mycobacterium avium
AYLLPALDRPNLEFHSGA

SEQ ID NO: 87213 - protein, 31 aa, Mycobacterium avium
AYLPIDPALPAARMEFMLGDATPIAAVTTAG

SEQ ID NO: 87214 - protein, 23 aa, Mycobacterium avium
AYLQGHLPGAVYVSLEDELSDHT

SEQ ID NO: 87215 - protein, 17 aa, Mycobacterium avium
AYQPRIVFVDADNKPVD

SEQ ID NO: 87216 - protein, 18 aa, Mycobacterium avium
AYSRFRRRARYLSIATDV

SEQ ID NO: 87217 - protein, 21 aa, Mycobacterium avium
CAAVDALPCAVPRSAASDAER

SEQ ID NO: 87218 - protein, 19 aa, Mycobacterium avium
CAAYGSSVLILPDASLDAV

SEQ ID NO: 87219 - protein, 17 aa, Mycobacterium avium
CACKIPPGELEDVVRGL

SEQ ID NO: 87220 - protein, 17 aa, Mycobacterium avium
CAEGGVLGVVCASIASV

SEQ ID NO: 87221 - protein, 23 aa, Mycobacterium avium
CAELELPLCVNTGIPGPPIPGEV

SEQ ID NO: 87222 - protein, 24 aa, Mycobacterium avium
CAELPAGRSGEVWVRSNQNMSGYL

SEQ ID NO: 87223 - protein, 18 aa, Mycobacterium avium
CAGADLSALGAAGGGSAE

SEQ ID NO: 87224 - protein, 19 aa, Mycobacterium avium
CAGHAPGWADLPVQYCDYT

SEQ ID NO: 87225 - protein, 27 aa, Mycobacterium avium
CANEGLCAMGLRFSEDWTSPRERFTAL

SEQ ID NO: 87226 - protein, 25 aa, Mycobacterium avium
CANFNKIGFRMCGGIELYEKTIRER

SEQ ID NO: 87227 - protein, 24 aa, Mycobacterium avium
CARVLDGWLKPVPVGVVGELYLSG

SEQ ID NO: 87228 - protein, 19 aa, Mycobacterium avium
CASLPWSIVEVGLSSVEPQ

SEQ ID NO: 87229 - protein, 24 aa, Mycobacterium avium
CAVPCSRPLPWPARPVSSRVPEEV

SEQ ID NO: 87230 - protein, 21 aa, Mycobacterium avium
CCARSRILVQRTVFDRFMELL

SEQ ID NO: 87231 - protein, 17 aa, Mycobacterium avium
CDDDSWWAPDAIARAEQ

SEQ ID NO: 87232 - protein, 26 aa, Mycobacterium avium
CDICVEAFAGFAVVKPQVAFFEAYGA

SEQ ID NO: 87233 - protein, 17 aa, Mycobacterium avium
CDLRVVSPDAFFQFPTS

SEQ ID NO: 87234 - protein, 18 aa, Mycobacterium avium
CDYRALRVADLFAAQGVW

SEQ ID NO: 87235 - protein, 21 aa, Mycobacterium avium
CESLRDNLWYLIDAKAATAIA

SEQ ID NO: 87236 - protein, 19 aa, Mycobacterium avium
CFDGQLSILSHPERLDEVE

SEQ ID NO: 87237 - protein, 17 aa, Mycobacterium avium
CGAADFTTRVVVLTPAE

SEQ ID NO: 87238 - protein, 19 aa, Mycobacterium avium
CGADAIYPGYGFLSENPDL

SEQ ID NO: 87239 - protein, 26 aa, Mycobacterium avium
CGALSEWRATLIVRESACLDAEDRRA

SEQ ID NO: 87240 - protein, 25 aa, Mycobacterium avium
CGGKPLDGPGWFYPPTVVTDITKDM

SEQ ID NO: 87241 - protein, 17 aa, Mycobacterium avium
CGIHPVVVHGGGPQITA

SEQ ID NO: 87242 - protein, 18 aa, Mycobacterium avium
CGNGVRVFAHYLRASGLE

SEQ ID NO: 87243 - protein, 20 aa, Mycobacterium avium
CGPIITEWLAQQGFSSAQPE

SEQ ID NO: 87244 - protein, 24 aa, Mycobacterium avium
CGPQSIDHLLAWEPRSVISHCHDC

SEQ ID NO: 87245 - protein, 33 aa, Mycobacterium avium
CGRAYSPRFLWMWPNARISVMGGEQAASVLATV

SEQ ID NO: 87246 - protein, 19 aa, Mycobacterium avium
CGRLRDRLLFAVLYDTGMR

SEQ ID NO: 87247 - protein, 20 aa, Mycobacterium avium
CGRSAHTRRAYLGDLRSLLA

SEQ ID NO: 87248 - protein, 18 aa, Mycobacterium avium
CGTEPLLIERIDAEYARY

SEQ ID NO: 87249 - protein, 19 aa, Mycobacterium avium
CGVNHGLVFRHFGTKEQLV

SEQ ID NO: 87250 - protein, 18 aa, Mycobacterium avium
CGVSARCAHTVLVARNYL

SEQ ID NO: 87251 - protein, 18 aa, Mycobacterium avium
CHAPSLHNSQPWRWVAGS

SEQ ID NO: 87252 - protein, 17 aa, Mycobacterium avium
CHAYPCVAHDIELAVRH

SEQ ID NO: 87253 - protein, 21 aa, Mycobacterium avium
CIAAKRFIVHTDIYDTFVDKF

SEQ ID NO: 87254 - protein, 28 aa, Mycobacterium avium
CKGQQVAWMREVDGLPVITSAKITELLA

SEQ ID NO: 87255 - protein, 18 aa, Mycobacterium avium
CLELPYVRRQGATAQEAM

SEQ ID NO: 87256 - protein, 19 aa, Mycobacterium avium
CLLTPPPWYPILRGTTQQA

SEQ ID NO: 87257 - protein, 24 aa, Mycobacterium avium
CLSEARYGIIWGAMGAARSAWQAA

SEQ ID NO: 87258 - protein, 21 aa, Mycobacterium avium
CNFPNCPRTSIYEASERDFRI

SEQ ID NO: 87259 - protein, 17 aa, Mycobacterium avium
CNPSRPVSVWAAHGTAD

SEQ ID NO: 87260 - protein, 24 aa, Mycobacterium avium
CNRCPVTTECLGWALNTGQDSGVW

SEQ ID NO: 87261 - protein, 17 aa, Mycobacterium avium
CPDLDTCMYTLGGGVDP

SEQ ID NO: 87262 - protein, 18 aa, Mycobacterium avium
CPHQGGPLCSGRPRGRTI

SEQ ID NO: 87263 - protein, 20 aa, Mycobacterium avium
CQPLTSGVWQGEWADPARRS

SEQ ID NO: 87264 - protein, 24 aa, Mycobacterium avium
CQPWLRPMEAFTLSVPRDIARTVS

SEQ ID NO: 87265 - protein, 31 aa, Mycobacterium avium
CQSILGYVVRWVAQGVGCSKVPDIHDVALME

SEQ ID NO: 87266 - protein, 17 aa, Mycobacterium avium
CREALAFPGDPERVVLL

SEQ ID NO: 87267 - protein, 26 aa, Mycobacterium avium
CRQFTCKYHAWRYSLDGDLTFVQQEE

SEQ ID NO: 87268 - protein, 21 aa, Mycobacterium avium
CSESQERMCAVVTPENVDAFL

SEQ ID NO: 87269 - protein, 21 aa, Mycobacterium avium
CSGSSDYLAGRAFSFISAIDS

SEQ ID NO: 87270 - protein, 19 aa, Mycobacterium avium
CTDVQPTFRKHPAFFGGVT

SEQ ID NO: 87271 - protein, 20 aa, Mycobacterium avium
CTHPAVADSAVFGLPDDRLG

SEQ ID NO: 87272 - protein, 21 aa, Mycobacterium avium
CTQLLLQRGRTVVAMDLRNDN

SEQ ID NO: 87273 - protein, 21 aa, Mycobacterium avium
CVEPLKKWRLDVGPNNSGIEW

SEQ ID NO: 87274 - protein, 20 aa, Mycobacterium avium
CVLNHPRLELAGCWVHSAEK

SEQ ID NO: 87275 - protein, 17 aa, Mycobacterium avium
CYEVEFSDGTVIVADAA

SEQ ID NO: 87276 - protein, 20 aa, Mycobacterium avium
CYHAYPAHAAFGGYKQSGIG

SEQ ID NO: 87277 - protein, 19 aa, Mycobacterium avium
CYQFGDAKPVYALEGSIAV

SEQ ID NO: 87278 - protein, 17 aa, Mycobacterium avium
CYQGLRHRRGLPVRGQR

SEQ ID NO: 87279 - protein, 25 aa, Mycobacterium avium
DAAAWLTGHGWRVHSVDNRDEMARL

SEQ ID NO: 87280 - protein, 24 aa, Mycobacterium avium
DAADPRPAVLADHDWLINQRGVAT

SEQ ID NO: 87281 - protein, 22 aa, Mycobacterium avium
DAAEDTVGWSIRVDGSAVVAVV

SEQ ID NO: 87282 - protein, 21 aa, Mycobacterium avium
DAALDTGERILAAAASCVVDF

SEQ ID NO: 87283 - protein, 18 aa, Mycobacterium avium
DAANGFILDGFPRSLQQA

SEQ ID NO: 87284 - protein, 19 aa, Mycobacterium avium
DAAPARRLATASADDVAAV

SEQ ID NO: 87285 - protein, 22 aa, Mycobacterium avium
DAAVALGRRVSFVGRSMVRNMG

SEQ ID NO: 87286 - protein, 17 aa, Mycobacterium avium
DAAVPVPHDIPWFPKDL

SEQ ID NO: 87287 - protein, 19 aa, Mycobacterium avium
DACAHALLDAIGRVPEIPE

SEQ ID NO: 87288 - protein, 20 aa, Mycobacterium avium
DADDIWALISATRVHLDESL

SEQ ID NO: 87289 - protein, 24 aa, Mycobacterium avium
DADFYVCGPNEFMDTVCTALRDAG

SEQ ID NO: 87290 - protein, 18 aa, Mycobacterium avium
DADVRWFDVEPCYVFHPM

SEQ ID NO: 87291 - protein, 27 aa, Mycobacterium avium
DAEAQLELKWRAIREDLERRGVGAPIV

SEQ ID NO: 87292 - protein, 25 aa, Mycobacterium avium
DAELKAALWELVWAGWITGDTFAPV

SEQ ID NO: 87293 - protein, 27 aa, Mycobacterium avium
DAELRIAQAQLVGWLEGLFHGIQTALF

SEQ ID NO: 87294 - protein, 18 aa, Mycobacterium avium
DAFQEFYHAPVLHANQSP

SEQ ID NO: 87295 - protein, 25 aa, Mycobacterium avium
DAGCGEAAVSLYLAERGFTTVGLDQ

SEQ ID NO: 87296 - protein, 17 aa, Mycobacterium avium
DAGGYKADAMWGPSSDP

SEQ ID NO: 87297 - protein, 24 aa, Mycobacterium avium
DAGPQLHANWTWARSVLTDEQLNR

SEQ ID NO: 87298 - protein, 17 aa, Mycobacterium avium
DAGRPAPRIVAGIPVCL

SEQ ID NO: 87299 - protein, 23 aa, Mycobacterium avium
DAGVRRIVYLGGFVPAGEVLSEH

SEQ ID NO: 87300 - protein, 22 aa, Mycobacterium avium
DAHLRPVPPGVVGELYVAGAGV

SEQ ID NO: 87301 - protein, 20 aa, Mycobacterium avium
DAKCVADWELPVLGRVSAPP

SEQ ID NO: 87302 - protein, 31 aa, Mycobacterium avium
DAKIGYPPTRVWGVPAAGLWAHRLGDQRAKR

SEQ ID NO: 87303 - protein, 29 aa, Mycobacterium avium
DALGGFPPSGGRVLLVWDAPNLDMGLGSI

SEQ ID NO: 87304 - protein, 25 aa, Mycobacterium avium
DALPPRYAKALQRYTFGPGVAKVDF

SEQ ID NO: 87305 - protein, 22 aa, Mycobacterium avium
DALPRLVERFADVQLLVVGRGD

SEQ ID NO: 87306 - protein, 17 aa, Mycobacterium avium
DALRIPMQYLAELFTAG

SEQ ID NO: 87307 - protein, 30 aa, Mycobacterium avium
DANEMYAAICIAATLTVRGCDHASLLVREN

SEQ ID NO: 87308 - protein, 17 aa, Mycobacterium avium
DANFGWSARDACYSYGS

SEQ ID NO: 87309 - protein, 19 aa, Mycobacterium avium
DAPLISFDESFKVVKVNPI

SEQ ID NO: 87310 - protein, 19 aa, Mycobacterium avium
DAPWKDIEAQGWIAPAECV

SEQ ID NO: 87311 - protein, 23 aa, Mycobacterium avium
DAQRRVLAALGWDDRHGDRHTAM

SEQ ID NO: 87312 - protein, 18 aa, Mycobacterium avium
DAQVKIRGHRVEPGEIAA

SEQ ID NO: 87313 - protein, 19 aa, Mycobacterium avium
DARGARRAVSLSGGAVLAV

SEQ ID NO: 87314 - protein, 23 aa, Mycobacterium avium
DARLRWPGFGEVSARELVLDTLL

SEQ ID NO: 87315 - protein, 20 aa, Mycobacterium avium
DARQRYFFRDGRGTDGELPP

SEQ ID NO: 87316 - protein, 27 aa, Mycobacterium avium
DASGPEPYCPVGISPLFETIEDLHNGA

SEQ ID NO: 87317 - protein, 19 aa, Mycobacterium avium
DATGADWSKTIPGRLLMGV

SEQ ID NO: 87318 - protein, 19 aa, Mycobacterium avium
DAVEFDFPAKSGVRRTVRV

SEQ ID NO: 87319 - protein, 24 aa, Mycobacterium avium
DAVNGMAGLMAWAQAPTRALGRFE

SEQ ID NO: 87320 - protein, 25 aa, Mycobacterium avium
DAVQQHWGPPPGQLFVDRSNDPDGE

SEQ ID NO: 87321 - protein, 24 aa, Mycobacterium avium
DAVRPGVVVLLNLSRDQLDRVGEI

SEQ ID NO: 87322 - protein, 18 aa, Mycobacterium avium
DAVRRACEQVGRDPATLE

SEQ ID NO: 87323 - protein, 21 aa, Mycobacterium avium
DAVSLHMSPPLPMIGAGESVS

SEQ ID NO: 87324 - protein, 19 aa, Mycobacterium avium
DAVVVVRLGFVPAPCRVVY

SEQ ID NO: 87325 - protein, 24 aa, Mycobacterium avium
DAVYRAAKLLGYRPNLAARNLARG

SEQ ID NO: 87326 - protein, 19 aa, Mycobacterium avium
DAYVTWDYCRGYADASLNE

SEQ ID NO: 87327 - protein, 18 aa, Mycobacterium avium
DCCVRDLYEAIARGEYPS

SEQ ID NO: 87328 - protein, 26 aa, Mycobacterium avium
DCGADFRLTDAAAWERFYGAPHAGSW

SEQ ID NO: 87329 - protein, 20 aa, Mycobacterium avium
DCPDFDLARHLRRVAIAGTG

SEQ ID NO: 87330 - protein, 29 aa, Mycobacterium avium
DCRTPTIASVHGWCIGGGVDLISAVDIRY

SEQ ID NO: 87331 - protein, 17 aa, Mycobacterium avium
DDAGFKQFEEWDVCIVP

SEQ ID NO: 87332 - protein, 31 aa, Mycobacterium avium
DDAIRRFHLADAREAVNLALRTLIDDAGPGH

SEQ ID NO: 87333 - protein, 22 aa, Mycobacterium avium
DDALMKITHVLRGEDLLPSTPR

SEQ ID NO: 87334 - protein, 24 aa, Mycobacterium avium
DDDEVRVPWSLAPRQRGPRRRPSL

SEQ ID NO: 87335 - protein, 20 aa, Mycobacterium avium
DDEAHWLVYEIWETVEHDEA

SEQ ID NO: 87336 - protein, 21 aa, Mycobacterium avium
DDEKRRFGALRVVHSLEASQR

SEQ ID NO: 87337 - protein, 34 aa, Mycobacterium avium
DDERLAFYRGLYRDHARYGAALWVVAANMASYSD

SEQ ID NO: 87338 - protein, 29 aa, Mycobacterium avium
DDFARYWAEICAIPISFIAESVRRAQARG

SEQ ID NO: 87339 - protein, 24 aa, Mycobacterium avium
DDGIGLDEYVDWLVDAGYSIERIA

SEQ ID NO: 87340 - protein, 23 aa, Mycobacterium avium
DDGLARLVGHVDVALAQHVLPFP

SEQ ID NO: 87341 - protein, 23 aa, Mycobacterium avium
DDGPRMPLLPGSWSAETEDPENG

SEQ ID NO: 87342 - protein, 24 aa, Mycobacterium avium
DDIDARLAQWFGRQDLDSTVELLA

SEQ ID NO: 87343 - protein, 26 aa, Mycobacterium avium
DDIGSRIDPVLARSWLLVNGTHPDRF

SEQ ID NO: 87344 - protein, 22 aa, Mycobacterium avium
DDLASACLFLLEHFDGPNHVNV

SEQ ID NO: 87345 - protein, 19 aa, Mycobacterium avium
DDLGLRVALVGTPAEEAGG

SEQ ID NO: 87346 - protein, 20 aa, Mycobacterium avium
DDLPDGGAWLYAETVRAIKE

SEQ ID NO: 87347 - protein, 20 aa, Mycobacterium avium
DDLPRRAHRGQVDGTPEDGD

SEQ ID NO: 87348 - protein, 22 aa, Mycobacterium avium
DDLVRRCRMVMAGEPLPKVEPA

SEQ ID NO: 87349 - protein, 18 aa, Mycobacterium avium
DDNALLMGYRVPKTSFAF

SEQ ID NO: 87350 - protein, 24 aa, Mycobacterium avium
DDPEWLRWNYATVVWGIATAHELY

SEQ ID NO: 87351 - protein, 22 aa, Mycobacterium avium
DDRVALAVALLVRALRGGSVCV

SEQ ID NO: 87352 - protein, 23 aa, Mycobacterium avium
DDTLPMLTGIRVEISGDTVVLAA

SEQ ID NO: 87353 - protein, 17 aa, Mycobacterium avium
DDVAERIAALGASPQGT

SEQ ID NO: 87354 - protein, 32 aa, Mycobacterium avium
DDVDRIVVHLAPWLEPEPICLAINHVRVRVAP

SEQ ID NO: 87355 - protein, 27 aa, Mycobacterium avium
DDVTKRLSAPVGIRADCLGVQDPLPAW

SEQ ID NO: 87356 - protein, 19 aa, Mycobacterium avium
DDVWFPLFRPSAVGEPGPL

SEQ ID NO: 87357 - protein, 26 aa, Mycobacterium avium
DDVYDAAAAWARRFLDGPRHALAAAK

SEQ ID NO: 87358 - protein, 20 aa, Mycobacterium avium
DDYARTALFHAFAVQMNLIG

SEQ ID NO: 87359 - protein, 22 aa, Mycobacterium avium
DDYLAILDIRPFTRGHTLVLPK

SEQ ID NO: 87360 - protein, 21 aa, Mycobacterium avium
DEAFPRLAVVRAPRHDRAVGP

SEQ ID NO: 87361 - protein, 17 aa, Mycobacterium avium
DEAMELFDTALIVDEPF

SEQ ID NO: 87362 - protein, 29 aa, Mycobacterium avium
DEARPRAGILRVREFVMKDSYSFDIDDAG

SEQ ID NO: 87363 - protein, 24 aa, Mycobacterium avium
DEDLRWQPPLWRALVARVAADPPH

SEQ ID NO: 87364 - protein, 24 aa, Mycobacterium avium
DEELSCWRIKLDRLDAATFDAALA

SEQ ID NO: 87365 - protein, 24 aa, Mycobacterium avium
DEFARAAVELALVDPGRVTGRTIG

SEQ ID NO: 87366 - protein, 20 aa, Mycobacterium avium
DEFLARFPQVEFTDVRGAGH

SEQ ID NO: 87367 - protein, 25 aa, Mycobacterium avium
DEFTCSSCFLVQHRSRLRRSAAGLP

SEQ ID NO: 87368 - protein, 24 aa, Mycobacterium avium
DEGFARPGARRSRADFEICATANI

SEQ ID NO: 87369 - protein, 18 aa, Mycobacterium avium
DEHRHYQAAIAHERVAEV

SEQ ID NO: 87370 - protein, 20 aa, Mycobacterium avium
DEIHAPVILPGSRFTPFLTV

SEQ ID NO: 87371 - protein, 19 aa, Mycobacterium avium
DEILARFTAVPSQELILPY

SEQ ID NO: 87372 - protein, 21 aa, Mycobacterium avium
DEIRKAVRYQIKHGAELIKVC

SEQ ID NO: 87373 - protein, 21 aa, Mycobacterium avium
DEKHPVPAWIVVGAGTGGTSA

SEQ ID NO: 87374 - protein, 18 aa, Mycobacterium avium
DELATEWARADKLVLSKL

SEQ ID NO: 87375 - protein, 24 aa, Mycobacterium avium
DELFAGPTAIAFVTGEPVDAAKAI

SEQ ID NO: 87376 - protein, 17 aa, Mycobacterium avium
DELKARTLPAVATGQVH

SEQ ID NO: 87377 - protein, 27 aa, Mycobacterium avium
DELPAGSMLVPFSWQRVSLHAAGAAAV

SEQ ID NO: 87378 - protein, 18 aa, Mycobacterium avium
DELVDEWLAVTGLDGQTP

SEQ ID NO: 87379 - protein, 20 aa, Mycobacterium avium
DEMRLPWDATKQRRFDRLIA

SEQ ID NO: 87380 - protein, 23 aa, Mycobacterium avium
DEPIAIVAMACRFPGAADPEAFW

SEQ ID NO: 87381 - protein, 17 aa, Mycobacterium avium
DERARAMRSTWRQHGLD

SEQ ID NO: 87382 - protein, 21 aa, Mycobacterium avium
DERDFPATSVRFFASSRSQGR

SEQ ID NO: 87383 - protein, 18 aa, Mycobacterium avium
DERRAALVRLAPGYEHPG

SEQ ID NO: 87384 - protein, 20 aa, Mycobacterium avium
DESGRGKAARDCTPDEIATE

SEQ ID NO: 87385 - protein, 20 aa, Mycobacterium avium
DEVDAFLDLVEAELTRLIEE

SEQ ID NO: 87386 - protein, 20 aa, Mycobacterium avium
DEVESLWAVLARTLPEPWRV

SEQ ID NO: 87387 - protein, 29 aa, Mycobacterium avium
DEVICAFGRIGSMFACADFGYVPDMITCA

SEQ ID NO: 87388 - protein, 34 aa, Mycobacterium avium
DEVSRALPGVEGFPADTFPVLVALMRNVFDGAAV

SEQ ID NO: 87389 - protein, 17 aa, Mycobacterium avium
DEWQPLYVFGTRTVPQI

SEQ ID NO: 87390 - protein, 26 aa, Mycobacterium avium
DFCDPEVVEALKFHLRDLAVTFRFGE

SEQ ID NO: 87391 - protein, 19 aa, Mycobacterium avium
DFDVWRRTLDVNLLGYVRT

SEQ ID NO: 87392 - protein, 26 aa, Mycobacterium avium
DFEYHGRGDLAWAFVDSYVRASGDDE

SEQ ID NO: 87393 - protein, 21 aa, Mycobacterium avium
DFFSDHDRLFLGMQPGATTGG

SEQ ID NO: 87394 - protein, 20 aa, Mycobacterium avium
DFGEWALDRWPAISDAVISE

SEQ ID NO: 87395 - protein, 23 aa, Mycobacterium avium
DFKVGDPRAPLLPLDEQGRAELR

SEQ ID NO: 87396 - protein, 24 aa, Mycobacterium avium
DFLPHALAAAAGRPVFLAGGIATA

SEQ ID NO: 87397 - protein, 17 aa, Mycobacterium avium
DFLSSGSPFSRPVNGTD

SEQ ID NO: 87398 - protein, 19 aa, Mycobacterium avium
DFNEVFFTDARVPAENLVG

SEQ ID NO: 87399 - protein, 19 aa, Mycobacterium avium
DFNSGGVLNAREDFITAHP

SEQ ID NO: 87400 - protein, 23 aa, Mycobacterium avium
DFPPRPGGIQSYLGEFVGRLAAA

SEQ ID NO: 87401 - protein, 24 aa, Mycobacterium avium
DFVECGVSYGFLSSAIMEYLDWDR

SEQ ID NO: 87402 - protein, 19 aa, Mycobacterium avium
DFVVIAGLQDGLWPNTVPR

SEQ ID NO: 87403 - protein, 20 aa, Mycobacterium avium
DFYRCGMLPASPEFTAEAGS

SEQ ID NO: 87404 - protein, 19 aa, Mycobacterium avium
DGANLKPAYTVTGGAVPGE

SEQ ID NO: 87405 - protein, 32 aa, Mycobacterium avium
DGAPIPPRYTCKGEGIAPPLAWSAPTGAALVV

SEQ ID NO: 87406 - protein, 24 aa, Mycobacterium avium
DGAPMLRPGRLFRSGELSGLDDEG

SEQ ID NO: 87407 - protein, 24 aa, Mycobacterium avium
DGAPREVLVPFVSAIVTAVSLDDG

SEQ ID NO: 87408 - protein, 21 aa, Mycobacterium avium
DGAQWSRIRLADRAHLEPWEP

SEQ ID NO: 87409 - protein, 24 aa, Mycobacterium avium
DGDHIMVVLALAMREAGELASDTL

SEQ ID NO: 87410 - protein, 25 aa, Mycobacterium avium
DGDITRARFYLFVNQIANFVPFAVS

SEQ ID NO: 87411 - protein, 26 aa, Mycobacterium avium
DGDLSRFYVRFGRYEMKNSGAFADPD

SEQ ID NO: 87412 - protein, 19 aa, Mycobacterium avium
DGEKFVVEFDLPGVLPESL

SEQ ID NO: 87413 - protein, 19 aa, Mycobacterium avium
DGFCSASLMVDHPACRRAV

SEQ ID NO: 87414 - protein, 18 aa, Mycobacterium avium
DGHRFARGAAVSMVDLAD

SEQ ID NO: 87415 - protein, 20 aa, Mycobacterium avium
DGIVECREALAFPGDPERVV

SEQ ID NO: 87416 - protein, 20 aa, Mycobacterium avium
DGLFPRLGVVDGDDALSRCP

SEQ ID NO: 87417 - protein, 19 aa, Mycobacterium avium
DGLHALVITGGYDLDPAGY

SEQ ID NO: 87418 - protein, 24 aa, Mycobacterium avium
DGLLPVAEIMIMDFIGIAADQLIN

SEQ ID NO: 87419 - protein, 23 aa, Mycobacterium avium
DGLTPRECLALLGRCEKARRRLP

SEQ ID NO: 87420 - protein, 21 aa, Mycobacterium avium
DGMGIALVGRRIAAVYTALAS

SEQ ID NO: 87421 - protein, 24 aa, Mycobacterium avium
DGMSELRGWLSPELRATLEAVLAK

SEQ ID NO: 87422 - protein, 18 aa, Mycobacterium avium
DGNGRWATERGMSRTDGH

SEQ ID NO: 87423 - protein, 26 aa, Mycobacterium avium
DGPFGARPGFGFGFGPGRVDRRALHE

SEQ ID NO: 87424 - protein, 25 aa, Mycobacterium avium
DGPVAEAWLPFHVPMSYHGTFTTRV

SEQ ID NO: 87425 - protein, 19 aa, Mycobacterium avium
DGQDPRYILWAAWHRSGLQ

SEQ ID NO: 87426 - protein, 19 aa, Mycobacterium avium
DGQMLRAAYTLRRDDDDWG

SEQ ID NO: 87427 - protein, 20 aa, Mycobacterium avium
DGRGPVLVHALEGFSDAGHA

SEQ ID NO: 87428 - protein, 20 aa, Mycobacterium avium
DGRRVKGEWVFGPRTPTSEH

SEQ ID NO: 87429 - protein, 23 aa, Mycobacterium avium
DGSIPYQRFRGGEIAGLTAGLVG

SEQ ID NO: 87430 - protein, 26 aa, Mycobacterium avium
DGTAFWTRSGIGYALTPEELGGALGQ

SEQ ID NO: 87431 - protein, 18 aa, Mycobacterium avium
DGTAMDRFRRLVAAQGGD

SEQ ID NO: 87432 - protein, 17 aa, Mycobacterium avium
DGTLPYLAGPRTIEEFI

SEQ ID NO: 87433 - protein, 20 aa, Mycobacterium avium
DGTLRLFGRDSLVVNTGGEK

SEQ ID NO: 87434 - protein, 18 aa, Mycobacterium avium
DGVIPPNRSLDCVDDELA

SEQ ID NO: 87435 - protein, 26 aa, Mycobacterium avium
DGVKVICRRSRLMARIAGRGAMASVE

SEQ ID NO: 87436 - protein, 22 aa, Mycobacterium avium
DGVLRLTIPVAEKAKPRRIEIN

SEQ ID NO: 87437 - protein, 17 aa, Mycobacterium avium
DGWWKDRDGAMVALVQR

SEQ ID NO: 87438 - protein, 20 aa, Mycobacterium avium
DHAIEAWVIESCDGTVLYAD

SEQ ID NO: 87439 - protein, 18 aa, Mycobacterium avium
DHFARVGNDISHGLGGSL

SEQ ID NO: 87440 - protein, 23 aa, Mycobacterium avium
DHGKAPVRRACYAADRTGHMILQ

SEQ ID NO: 87441 - protein, 24 aa, Mycobacterium avium
DHGQAVSSLFSWTGDATQGPEASI

SEQ ID NO: 87442 - protein, 23 aa, Mycobacterium avium
DHGVWLRPFRNLIYAMPPYICPP

SEQ ID NO: 87443 - protein, 18 aa, Mycobacterium avium
DHNMVWDFWTSCPETAHL

SEQ ID NO: 87444 - protein, 29 aa, Mycobacterium avium
DHPNPFLAAVLRRLAPRARVRVGADGIDD

SEQ ID NO: 87445 - protein, 19 aa, Mycobacterium avium
DHPTSVHWHGISLRNDMDG

SEQ ID NO: 87446 - protein, 19 aa, Mycobacterium avium
DHRGARLAVDWPAELQQQL

SEQ ID NO: 87447 - protein, 22 aa, Mycobacterium avium
DHVAEHYLHFGGVSPINGINRA

SEQ ID NO: 87448 - protein, 25 aa, Mycobacterium avium
DIDEALRLGERVAVFKGGMLQQCDE

SEQ ID NO: 87449 - protein, 30 aa, Mycobacterium avium
DIDKPKLVFFFDEAHLLFADASKAFLEQVE

SEQ ID NO: 87450 - protein, 23 aa, Mycobacterium avium
DIEEFGRRFGVQVEDGFGSTENA

SEQ ID NO: 87451 - protein, 22 aa, Mycobacterium avium
DIEKRYGCRIVTMYGMTEAFPI

SEQ ID NO: 87452 - protein, 17 aa, Mycobacterium avium
DIGELPAGLNPGRIEQW

SEQ ID NO: 87453 - protein, 21 aa, Mycobacterium avium
DIIACDICAPVSASVTYAPAS

SEQ ID NO: 87454 - protein, 17 aa, Mycobacterium avium
DILANVWDAHHHGPDNV

SEQ ID NO: 87455 - protein, 25 aa, Mycobacterium avium
DISRELAIALGRLGARVIAVDAHPQ

SEQ ID NO: 87456 - protein, 22 aa, Mycobacterium avium
DITPTGSLWCYATPETRDWWGG

SEQ ID NO: 87457 - protein, 24 aa, Mycobacterium avium
DKDQFVACVFDWVVAELAATTQAA

SEQ ID NO: 87458 - protein, 25 aa, Mycobacterium avium
DKLGPFCAALAYLCDKDMVLPMNSG

SEQ ID NO: 87459 - protein, 27 aa, Mycobacterium avium
DKRLPRIAGPCGMVIFGVTGDLARKKV

SEQ ID NO: 87460 - protein, 27 aa, Mycobacterium avium
DKSFKTSGCQPWQLTPDAVPPPSAPPA

SEQ ID NO: 87461 - protein, 18 aa, Mycobacterium avium
DKVVTALASEEWLGSASA

SEQ ID NO: 87462 - protein, 26 aa, Mycobacterium avium
DLADPPGGLGPRFTFVPADVTDESAV

SEQ ID NO: 87463 - protein, 19 aa, Mycobacterium avium
DLAKRCGKPLMIHNREADA

SEQ ID NO: 87464 - protein, 26 aa, Mycobacterium avium
DLASLRKLYATSEWLHRETTRIGQTL

SEQ ID NO: 87465 - protein, 17 aa, Mycobacterium avium
DLCDVESKVAAASAPIK

SEQ ID NO: 87466 - protein, 19 aa, Mycobacterium avium
DLCIRSRTLNGITVPYESL

SEQ ID NO: 87467 - protein, 30 aa, Mycobacterium avium
DLDAWTTNHWDWFDPFWAHRLLWPDRDYRP

SEQ ID NO: 87468 - protein, 27 aa, Mycobacterium avium
DLDEWKWWARWRVIRARAGWLTDELVA

SEQ ID NO: 87469 - protein, 22 aa, Mycobacterium avium
DLFPHAVRWKGITYLEDGLHRA

SEQ ID NO: 87470 - protein, 17 aa, Mycobacterium avium
DLGRSAAGFDLWRNQIG

SEQ ID NO: 87471 - protein, 23 aa, Mycobacterium avium
DLHLRRHKWTRLGAYAQSKLAVM

SEQ ID NO: 87472 - protein, 20 aa, Mycobacterium avium
DLIARRGYDGFTIEALAARV

SEQ ID NO: 87473 - protein, 21 aa, Mycobacterium avium
DLKERREGDVLGRNQSGRAVT

SEQ ID NO: 87474 - protein, 17 aa, Mycobacterium avium
DLLASAVAMGWSPYYPQ

SEQ ID NO: 87475 - protein, 17 aa, Mycobacterium avium
DLLCDLASREDLVAAEA

SEQ ID NO: 87476 - protein, 18 aa, Mycobacterium avium
DLNFRSRPYSAWLAYSQS

SEQ ID NO: 87477 - protein, 18 aa, Mycobacterium avium
DLPIVFVCQNNRYAEMTP

SEQ ID NO: 87478 - protein, 21 aa, Mycobacterium avium
DLPLLLLDEGHCLRDQALDVC

SEQ ID NO: 87479 - protein, 28 aa, Mycobacterium avium
DLQRFARFAPRRLVGPRTLPLMRVALAW

SEQ ID NO: 87480 - protein, 18 aa, Mycobacterium avium
DLRFFHFLGKEIFPGGQM

SEQ ID NO: 87481 - protein, 20 aa, Mycobacterium avium
DLRGLPGPRLLTGDLNMTPQ

SEQ ID NO: 87482 - protein, 21 aa, Mycobacterium avium
DLRLVVVDYLQLMSSGKKVES

SEQ ID NO: 87483 - protein, 28 aa, Mycobacterium avium
DLSLGKLGLRPGMTLLDVGCGWGATMRR

SEQ ID NO: 87484 - protein, 28 aa, Mycobacterium avium
DLTSALAYERRVLKLLAWGEPTRPWRLK

SEQ ID NO: 87485 - protein, 23 aa, Mycobacterium avium
DLTVSIPTPPGWAPFSSPNISPQ

SEQ ID NO: 87486 - protein, 25 aa, Mycobacterium avium
DLTWLLSRWTCVFGTPACQGTVAGR

SEQ ID NO: 87487 - protein, 19 aa, Mycobacterium avium
DLVALRREICSRFIRQPGY

SEQ ID NO: 87488 - protein, 18 aa, Mycobacterium avium
DLVCLCVIGDADIDELTD

SEQ ID NO: 87489 - protein, 24 aa, Mycobacterium avium
DLVEAIGVDAARYSLIRSSVDTPI

SEQ ID NO: 87490 - protein, 23 aa, Mycobacterium avium
DLVGIEPDEHWAVMRDLAQRADR

SEQ ID NO: 87491 - protein, 25 aa, Mycobacterium avium
DLVLRRLTEALARDRTRHQVSEVTS

SEQ ID NO: 87492 - protein, 19 aa, Mycobacterium avium
DLVLSRWHGVGPMGGTDLD

SEQ ID NO: 87493 - protein, 20 aa, Mycobacterium avium
DLVSMFAPITRWAAGIPTAR

SEQ ID NO: 87494 - protein, 26 aa, Mycobacterium avium
DMAGDPWPALRCWAAGRATAEIVERA

SEQ ID NO: 87495 - protein, 20 aa, Mycobacterium avium
DMHDFWSDEFIRDFFKNFLR

SEQ ID NO: 87496 - protein, 22 aa, Mycobacterium avium
DMLRAWRIGVEVVVECAREAAR

SEQ ID NO: 87497 - protein, 23 aa, Mycobacterium avium
DMLREAIKIIRELFGGQLVDFTG

SEQ ID NO: 87498 - protein, 19 aa, Mycobacterium avium
DMLSSPMLAEAIQTALAAK

SEQ ID NO: 87499 - protein, 24 aa, Mycobacterium avium
DMVVTHLFQVMAFVVMEPPTALEP

SEQ ID NO: 87500 - protein, 22 aa, Mycobacterium avium
DNGIKIFGPGGHKLDDGTEDRI

SEQ ID NO: 87501 - protein, 19 aa, Mycobacterium avium
DNGYVSFNFQVRDSDSMEI

SEQ ID NO: 87502 - protein, 23 aa, Mycobacterium avium
DNLRLETLAAHWGVTQQRPHDAF

SEQ ID NO: 87503 - protein, 17 aa, Mycobacterium avium
DNPGTWVMHCHNTYHQV

SEQ ID NO: 87504 - protein, 27 aa, Mycobacterium avium
DNPQRVWGWYLWRHYLVADVAPNAGHR

SEQ ID NO: 87505 - protein, 18 aa, Mycobacterium avium
DNRLLWQLDGRYMQALFG

SEQ ID NO: 87506 - protein, 27 aa, Mycobacterium avium
DNSQFGFGVWNLRGQQWDFLKNRDDAR

SEQ ID NO: 87507 - protein, 21 aa, Mycobacterium avium
DNSRVSLSFYGKRPGPGMKLD

SEQ ID NO: 87508 - protein, 18 aa, Mycobacterium avium
DNSYVHNLIHGFILAAQH

SEQ ID NO: 87509 - protein, 17 aa, Mycobacterium avium
DNVAHFCFTPGAHGGTV

SEQ ID NO: 87510 - protein, 25 aa, Mycobacterium avium
DPAAVGDWMLLAAIQALIDGHEYLA

SEQ ID NO: 87511 - protein, 17 aa, Mycobacterium avium
DPACGTGGFLVEALEHL

SEQ ID NO: 87512 - protein, 24 aa, Mycobacterium avium
DPAHRLITIILMRCGLRITDALRL

SEQ ID NO: 87513 - protein, 27 aa, Mycobacterium avium
DPAQGLGGWFRLGLVANQQTAWVHALV

SEQ ID NO: 87514 - protein, 17 aa, Mycobacterium avium
DPAWDFGGRGERFEVEI

SEQ ID NO: 87515 - protein, 24 aa, Mycobacterium avium
DPDAPKHKGISCLIVDMTLPGIEA

SEQ ID NO: 87516 - protein, 18 aa, Mycobacterium avium
DPDAWARLIDTHRVTVLH

SEQ ID NO: 87517 - protein, 19 aa, Mycobacterium avium
DPDAWEFVAAEVIPRLLAE

SEQ ID NO: 87518 - protein, 20 aa, Mycobacterium avium
DPDYCIRDLYEAIERGDHPS

SEQ ID NO: 87519 - protein, 24 aa, Mycobacterium avium
DPEAPKHRGISCLILDLHSPGVRI

SEQ ID NO: 87520 - protein, 19 aa, Mycobacterium avium
DPERAANFASRMRVGTVNV

SEQ ID NO: 87521 - protein, 17 aa, Mycobacterium avium
DPESAFEAWKKCSAGRP

SEQ ID NO: 87522 - protein, 21 aa, Mycobacterium avium
DPGPFLSWAQLCERAPAGRPA

SEQ ID NO: 87523 - protein, 21 aa, Mycobacterium avium
DPHHATAVLAWMGYDAPEFDD

SEQ ID NO: 87524 - protein, 23 aa, Mycobacterium avium
DPIAIVGMSCRFPGGVDSPEALW

SEQ ID NO: 87525 - protein, 29 aa, Mycobacterium avium
DPKVSLCILDERWPFSYLQVYADAALDED

SEQ ID NO: 87526 - protein, 32 aa, Mycobacterium avium
DPLPAAALHAGWRALGWWLVGTSRAMLTLGRR

SEQ ID NO: 87527 - protein, 26 aa, Mycobacterium avium
DPLWEAWPNHMKIFWNNKGVVAKATD

SEQ ID NO: 87528 - protein, 19 aa, Mycobacterium avium
DPLWECHQYALGDADETIT

SEQ ID NO: 87529 - protein, 25 aa, Mycobacterium avium
DPQHRLLLETAWRAVEHSGTAPTDL

SEQ ID NO: 87530 - protein, 23 aa, Mycobacterium avium
DPQHRLLLETSWEAMEHAGLTEE

SEQ ID NO: 87531 - protein, 26 aa, Mycobacterium avium
DPQQRMALELTWEALEHARIPASSLR

SEQ ID NO: 87532 - protein, 24 aa, Mycobacterium avium
DPQQRVALRVAWRALENSGINPDD

SEQ ID NO: 87533 - protein, 26 aa, Mycobacterium avium
DPSEWAHSTLQRFGGIGVDTVLSHGG

SEQ ID NO: 87534 - protein, 17 aa, Mycobacterium avium
DPSFSEKSLGFRSFSDF

SEQ ID NO: 87535 - protein, 17 aa, Mycobacterium avium
DPSVPVRLAELFVEAGL

SEQ ID NO: 87536 - protein, 24 aa, Mycobacterium avium
DPVLKIPRLQDAYFKRFPGYPKGI

SEQ ID NO: 87537 - protein, 19 aa, Mycobacterium avium
DPWARGFVVGFGVAPEVDD

SEQ ID NO: 87538 - protein, 23 aa, Mycobacterium avium
DPYAEIFCRAVGGSAADVLDGKD

SEQ ID NO: 87539 - protein, 22 aa, Mycobacterium avium
DQGMPLLRRAIRDGTGQDPDDD

SEQ ID NO: 87540 - protein, 24 aa, Mycobacterium avium
DQLRQRIGMVFQHFNLFPHRTVLD

SEQ ID NO: 87541 - protein, 22 aa, Mycobacterium avium
DQPRWADGLPYFVRDGNDLVPT

SEQ ID NO: 87542 - protein, 23 aa, Mycobacterium avium
DQPVEFWPTAAIRSALQSGDIAT

SEQ ID NO: 87543 - protein, 20 aa, Mycobacterium avium
DQRVAFVLHDGFAVPFSEVA

SEQ ID NO: 87544 - protein, 23 aa, Mycobacterium avium
DQVAELLCRIILQGLASRPPSDA

SEQ ID NO: 87545 - protein, 20 aa, Mycobacterium avium
DQVRFVPGWFKDTLKDAPID

SEQ ID NO: 87546 - protein, 29 aa, Mycobacterium avium
DRAKPAVPFGGAYRLIDFVLSNLVNARYL

SEQ ID NO: 87547 - protein, 19 aa, Mycobacterium avium
DREKHGALRGSMTVLAVNT

SEQ ID NO: 87548 - protein, 17 aa, Mycobacterium avium
DRFAYQKSMLINVGDEK

SEQ ID NO: 87549 - protein, 27 aa, Mycobacterium avium
DRFGVAPLHTFCLAGAFMVPDPLTGRA

SEQ ID NO: 87550 - protein, 20 aa, Mycobacterium avium
DRFLQNLTHHSWQDHGQAVS

SEQ ID NO: 87551 - protein, 22 aa, Mycobacterium avium
DRGENFAFLGGRDWDPSSATLP

SEQ ID NO: 87552 - protein, 25 aa, Mycobacterium avium
DRGHVFRRAFSWLPAQFASQSDAPV

SEQ ID NO: 87553 - protein, 22 aa, Mycobacterium avium
DRGPSYRSAIFYTDDEQKRIAL

SEQ ID NO: 87554 - protein, 17 aa, Mycobacterium avium
DRHDVSLMTSVYTEDGV

SEQ ID NO: 87555 - protein, 18 aa, Mycobacterium avium
DRLAQLRPGEPILGEEGG

SEQ ID NO: 87556 - protein, 22 aa, Mycobacterium avium
DRLDEWGNRAILTKPVKAPASI

SEQ ID NO: 87557 - protein, 20 aa, Mycobacterium avium
DRLDLLQAILAEYQKRADDL

SEQ ID NO: 87558 - protein, 20 aa, Mycobacterium avium
DRLDSEPGLSVGVLTGAGGS

SEQ ID NO: 87559 - protein, 21 aa, Mycobacterium avium
DRLKPWEVIAARLEAAAAADL

SEQ ID NO: 87560 - protein, 26 aa, Mycobacterium avium
DRLRISYAEACRRLREAKQLSPRLTL

SEQ ID NO: 87561 - protein, 22 aa, Mycobacterium avium
DRLSDWQPRRGAGRGRPPARAG

SEQ ID NO: 87562 - protein, 17 aa, Mycobacterium avium
DRLTMHDYFWRWDTDWF

SEQ ID NO: 87563 - protein, 24 aa, Mycobacterium avium
DRNRISGGLGVRFARPGETVVTLD

SEQ ID NO: 87564 - protein, 26 aa, Mycobacterium avium
DRPIPRPVPRPGAPRPGAPRPGASPG

SEQ ID NO: 87565 - protein, 17 aa, Mycobacterium avium
DRPVIVFSGDGAMQMNG

SEQ ID NO: 87566 - protein, 18 aa, Mycobacterium avium
DRQSMLFSATMPDPIITL

SEQ ID NO: 87567 - protein, 23 aa, Mycobacterium avium
DRQVSLPAGQSWSITAVGPTAVE

SEQ ID NO: 87568 - protein, 18 aa, Mycobacterium avium
DRRAELLALGAEVFGKRP

SEQ ID NO: 87569 - protein, 18 aa, Mycobacterium avium
DRRMPYTVGLLGSVPRLD

SEQ ID NO: 87570 - protein, 22 aa, Mycobacterium avium
DRSRLRCVSRSLYVWHRDEPAA

SEQ ID NO: 87571 - protein, 26 aa, Mycobacterium avium
DRTDPRVSPALAESLAGLAPALIAVA

SEQ ID NO: 87572 - protein, 19 aa, Mycobacterium avium
DRTGLDHIAFRLDSRDELD

SEQ ID NO: 87573 - protein, 25 aa, Mycobacterium avium
DRTGLWGRLLPEWDAIRDLPPRDVA

SEQ ID NO: 87574 - protein, 29 aa, Mycobacterium avium
DRVGGLSGNGCWGSFVLADARHAVTLPPE

SEQ ID NO: 87575 - protein, 23 aa, Mycobacterium avium
DRVKLGPSLWHRDFHDAVIVECP

SEQ ID NO: 87576 - protein, 19 aa, Mycobacterium avium
DRYEGCSFINVLLELGPEH

SEQ ID NO: 87577 - protein, 19 aa, Mycobacterium avium
DSDLNWCNPSGRALGTPPT

SEQ ID NO: 87578 - protein, 20 aa, Mycobacterium avium
DSFDRSRGITMYRADPANVF

SEQ ID NO: 87579 - protein, 17 aa, Mycobacterium avium
DSGDEWEAFLGKDEDLY

SEQ ID NO: 87580 - protein, 23 aa, Mycobacterium avium
DSGDYRWAATLLDHAMFTDGEHA

SEQ ID NO: 87581 - protein, 24 aa, Mycobacterium avium
DSGWKLEHMPVAMAARTRFFDSFF

SEQ ID NO: 87582 - protein, 28 aa, Mycobacterium avium
DSHCAMASQFTLYALGAGGGGTSGPGAG

SEQ ID NO: 87583 - protein, 25 aa, Mycobacterium avium
DSIRIMTLAGRWRRRGIAVDFATLA

SEQ ID NO: 87584 - protein, 23 aa, Mycobacterium avium
DSITETFAAITLEVDTRRWAGVP

SEQ ID NO: 87585 - protein, 23 aa, Mycobacterium avium
DSLLERMLAVWSGGGAPAGICTG

SEQ ID NO: 87586 - protein, 25 aa, Mycobacterium avium
DSLPPEFRAAVVLCDIEGLSYEEIG

SEQ ID NO: 87587 - protein, 17 aa, Mycobacterium avium
DSLTWKYFGDWRGMLQG

SEQ ID NO: 87588 - protein, 24 aa, Mycobacterium avium
DSMVEAAICDGDWVVVRQQHVADN

SEQ ID NO: 87589 - protein, 21 aa, Mycobacterium avium
DSPERLWEALLRGDDFVTEIP

SEQ ID NO: 87590 - protein, 18 aa, Mycobacterium avium
DSPLEVFVLRPCIVAGPG

SEQ ID NO: 87591 - protein, 41 aa, Mycobacterium avium
DSPLLQQVCDEWAQRGWLAVRYNLPFRRRRPTGPPSGSGAA

SEQ ID NO: 87592 - protein, 23 aa, Mycobacterium avium
DSPSLPVHFVQMWVIPDEAGIDP

SEQ ID NO: 87593 - protein, 22 aa, Mycobacterium avium
DSPYELAQHVVFGRAAGLTDHQ

SEQ ID NO: 87594 - protein, 21 aa, Mycobacterium avium
DSQAWLDVYRNFWTSFFRGFW

SEQ ID NO: 87595 - protein, 25 aa, Mycobacterium avium
DSRAYRLDWPAATTIFELDQPQVLD

SEQ ID NO: 87596 - protein, 19 aa, Mycobacterium avium
DSRLARRATTIGGVDIPAG

SEQ ID NO: 87597 - protein, 34 aa, Mycobacterium avium
DSRLRELIIMRIGWLTGCDYEWTQHWRVASRLGV

SEQ ID NO: 87598 - protein, 29 aa, Mycobacterium avium
DSRLRVLTRREFAGMISVAIESGDGAETT

SEQ ID NO: 87599 - protein, 19 aa, Mycobacterium avium
DSRVTLRLSAASDCTDATL

SEQ ID NO: 87600 - protein, 24 aa, Mycobacterium avium
DSVFTRLYLATGLISVGKTQLSEF

SEQ ID NO: 87601 - protein, 24 aa, Mycobacterium avium
DSVQRMAVALGFELDDMEFFIEHA

SEQ ID NO: 87602 - protein, 25 aa, Mycobacterium avium
DSYGRFMRIRVFDCWMHEQDIRVAL

SEQ ID NO: 87603 - protein, 23 aa, Mycobacterium avium
DTALAAYLVRPGQRSFSLDDLAL

SEQ ID NO: 87604 - protein, 18 aa, Mycobacterium avium
DTALRIGLVTEVVPAERL

SEQ ID NO: 87605 - protein, 24 aa, Mycobacterium avium
DTEIPSPAAGVLTKIIAQEDDTVE

SEQ ID NO: 87606 - protein, 18 aa, Mycobacterium avium
DTEWIRARVSSVAQDAHG

SEQ ID NO: 87607 - protein, 24 aa, Mycobacterium avium
DTIVLPGMVVPIALDDAARAAIDA

SEQ ID NO: 87608 - protein, 24 aa, Mycobacterium avium
DTNVYYRRALMLAASFGRSSDYPQ

SEQ ID NO: 87609 - protein, 23 aa, Mycobacterium avium
DTPEVRGDLAAFYGAISTADAAV

SEQ ID NO: 87610 - protein, 30 aa, Mycobacterium avium
DTRAYFRGECLRRFGADIAAASWDSVIFDL

SEQ ID NO: 87611 - protein, 25 aa, Mycobacterium avium
DTRAYRLAWPAGTVVYEIDQPQVIA

SEQ ID NO: 87612 - protein, 25 aa, Mycobacterium avium
DTRTARMDLAWSLAERWTPDGSPAG

SEQ ID NO: 87613 - protein, 22 aa, Mycobacterium avium
DTRTRISPISTMSFDEDAKITA

SEQ ID NO: 87614 - protein, 18 aa, Mycobacterium avium
DTVHPFFAIAKEINVQFV

SEQ ID NO: 87615 - protein, 21 aa, Mycobacterium avium
DTVNLVTAWRMLRATDPRSRL

SEQ ID NO: 87616 - protein, 24 aa, Mycobacterium avium
DVAERLRVLIDWTSSHLAEVEVSD

SEQ ID NO: 87617 - protein, 23 aa, Mycobacterium avium
DVAEYLDGLGWRSVGVPMSQLLA

SEQ ID NO: 87618 - protein, 19 aa, Mycobacterium avium
DVAHCIYAGLTTDTGSFRW

SEQ ID NO: 87619 - protein, 29 aa, Mycobacterium avium
DVALRIWRPRWAKWTAHVVRSGGLIRDGI

SEQ ID NO: 87620 - protein, 28 aa, Mycobacterium avium
DVAQRFNARFPDTFVVPEMLIPKVTAKI

SEQ ID NO: 87621 - protein, 24 aa, Mycobacterium avium
DVDEKLWDAAEWSVQVQLNHLRSE

SEQ ID NO: 87622 - protein, 18 aa, Mycobacterium avium
DVEPCAAVARELQGRGHD

SEQ ID NO: 87623 - protein, 27 aa, Mycobacterium avium
DVEVLKLSALRGLFSAVVEGPVTFVNA

SEQ ID NO: 87624 - protein, 20 aa, Mycobacterium avium
DVFDREWPLRVGDIDRTGRL

SEQ ID NO: 87625 - protein, 19 aa, Mycobacterium avium
DVGGFDCDFFGMTEREATA

SEQ ID NO: 87626 - protein, 24 aa, Mycobacterium avium
DVIPDVLRHRLVLTYDALADEISP

SEQ ID NO: 87627 - protein, 22 aa, Mycobacterium avium
DVKARPQALLDLAAKADVLLDC

SEQ ID NO: 87628 - protein, 24 aa, Mycobacterium avium
DVKGLRLTLTQAAWRVSEDLPAEV

SEQ ID NO: 87629 - protein, 25 aa, Mycobacterium avium
DVLLKIRLRQGLPVDLLNPAERERV

SEQ ID NO: 87630 - protein, 22 aa, Mycobacterium avium
DVLRILRRRSLAALRAQVEPVS

SEQ ID NO: 87631 - protein, 26 aa, Mycobacterium avium
DVLRWSEDRWKLARRSIFVDESVLRM

SEQ ID NO: 87632 - protein, 20 aa, Mycobacterium avium
DVPGTCYTRTGGFVDNVADF

SEQ ID NO: 87633 - protein, 18 aa, Mycobacterium avium
DVPLRVAVMGCVVNGPGE

SEQ ID NO: 87634 - protein, 20 aa, Mycobacterium avium
DVPVAAFGAVELWPVVHAVE

SEQ ID NO: 87635 - protein, 17 aa, Mycobacterium avium
DVQCIVHTHAFHVAALS

SEQ ID NO: 87636 - protein, 19 aa, Mycobacterium avium
DVQKAMAFAAAHNLKVAPR

SEQ ID NO: 87637 - protein, 18 aa, Mycobacterium avium
DVQVMGAAALHFGNVAEM

SEQ ID NO: 87638 - protein, 17 aa, Mycobacterium avium
DVRACAATGALAPVLAA

SEQ ID NO: 87639 - protein, 25 aa, Mycobacterium avium
DVRHTVFPVARWQYDIVGTDGGCDV

SEQ ID NO: 87640 - protein, 23 aa, Mycobacterium avium
DVRVRRALQLGIDRRAVVDTVLS

SEQ ID NO: 87641 - protein, 20 aa, Mycobacterium avium
DVSISGLFHGPRLREMDARH

SEQ ID NO: 87642 - protein, 25 aa, Mycobacterium avium
DVSSLRCVIHAAAPCPVDVKHRMMR

SEQ ID NO: 87643 - protein, 30 aa, Mycobacterium avium
DVTKRVGVPGIWYAGSHGFELTAPDGSHHQ

SEQ ID NO: 87644 - protein, 17 aa, Mycobacterium avium
DVTRAEFEYAITHEGAL

SEQ ID NO: 87645 - protein, 21 aa, Mycobacterium avium
DVTSELFGVVGRFRRQLRRSA

SEQ ID NO: 87646 - protein, 24 aa, Mycobacterium avium
DVWPLRPDCRILACSSVFGVWGGY

SEQ ID NO: 87647 - protein, 21 aa, Mycobacterium avium
DWAAKGTRLLGVRAVIAESFE

SEQ ID NO: 87648 - protein, 19 aa, Mycobacterium avium
DWAEVLGFDRLPEHIVDKR

SEQ ID NO: 87649 - protein, 25 aa, Mycobacterium avium
DWHERETYDFFGIIFDGHPSLTRIE

SEQ ID NO: 87650 - protein, 24 aa, Mycobacterium avium
DWMRRLSGEIDRPVSFALIQVDAD

SEQ ID NO: 87651 - protein, 27 aa, Mycobacterium avium
DWREPRVRGGGALWVRRGEVFAVHAAG

SEQ ID NO: 87652 - protein, 25 aa, Mycobacterium avium
DYAQRLATRHLLRYPGLQRAAERGA

SEQ ID NO: 87653 - protein, 23 aa, Mycobacterium avium
DYLKRLTADLRRTRRRVAELEGR

SEQ ID NO: 87654 - protein, 17 aa, Mycobacterium avium
DYLLPRQRERAALTEDE

SEQ ID NO: 87655 - protein, 21 aa, Mycobacterium avium
DYPARVVAVGADRDCLATQIA

SEQ ID NO: 87656 - protein, 25 aa, Mycobacterium avium
DYPHLRGLHKPLLPEGIAQPEDIAD

SEQ ID NO: 87657 - protein, 17 aa, Mycobacterium avium
DYRAWFATLPAEFTDAV

SEQ ID NO: 87658 - protein, 24 aa, Mycobacterium avium
DYRRRMGELFAPFTKVAAKNPFAS

SEQ ID NO: 87659 - protein, 20 aa, Mycobacterium avium
DYTFRLNVGAYFYLTKAALP

SEQ ID NO: 87660 - protein, 19 aa, Mycobacterium avium
EAAAPLPALVYAHGGGFVF

SEQ ID NO: 87661 - protein, 19 aa, Mycobacterium avium
EAAFLWHLTLDAGDTRTRI

SEQ ID NO: 87662 - protein, 25 aa, Mycobacterium avium
EAAGVHRGYKCSIRTPWWSTPSLWQ

SEQ ID NO: 87663 - protein, 26 aa, Mycobacterium avium
EAALAYAGSDPAPWVIGGAQIYLLAL

SEQ ID NO: 87664 - protein, 20 aa, Mycobacterium avium
EAALQRLRSQTAFEDASARA

SEQ ID NO: 87665 - protein, 20 aa, Mycobacterium avium
EAALYFATERSRYVTGTVLP

SEQ ID NO: 87666 - protein, 20 aa, Mycobacterium avium
EAAQPLYARYWLHNRGPAPL

SEQ ID NO: 87667 - protein, 26 aa, Mycobacterium avium
EAARRFGCGFAPSGWDTLTKHLQRKG

SEQ ID NO: 87668 - protein, 18 aa, Mycobacterium avium
EAAVRELLFAIGENPDRH

SEQ ID NO: 87669 - protein, 19 aa, Mycobacterium avium
EACLPELVDGWAPGRQMFN

SEQ ID NO: 87670 - protein, 21 aa, Mycobacterium avium
EACSLGILIERAAKLQLAAMA

SEQ ID NO: 87671 - protein, 17 aa, Mycobacterium avium
EADTCRNYVLPKLKDAG

SEQ ID NO: 87672 - protein, 19 aa, Mycobacterium avium
EADVLWDLASRLEGRMTAI

SEQ ID NO: 87673 - protein, 25 aa, Mycobacterium avium
EAEIAILHRHAHGFDPRDLSVVQPV

SEQ ID NO: 87674 - protein, 19 aa, Mycobacterium avium
EAEYAEMWAQDAAAMYAYA

SEQ ID NO: 87675 - protein, 21 aa, Mycobacterium avium
EAGMVLAITGYVWQRGIGAVF

SEQ ID NO: 87676 - protein, 20 aa, Mycobacterium avium
EAGVDCFVAGSAVYGADDPA

SEQ ID NO: 87677 - protein, 18 aa, Mycobacterium avium
EAGVFAGTVMDYSKTPES

SEQ ID NO: 87678 - protein, 29 aa, Mycobacterium avium
EAIPRRYVIEHLKAARSWTNPKEYVAELE

SEQ ID NO: 87679 - protein, 21 aa, Mycobacterium avium
EAISLPDAVALVVARATVVDR

SEQ ID NO: 87680 - protein, 21 aa, Mycobacterium avium
EAKIKLSDMRSGRMSDEDWTR

SEQ ID NO: 87681 - protein, 19 aa, Mycobacterium avium
EAKSALDALVSRWHAESSW

SEQ ID NO: 87682 - protein, 17 aa, Mycobacterium avium
EALKESFGCDGQPGSYT

SEQ ID NO: 87683 - protein, 25 aa, Mycobacterium avium
EALKPYYRFLCKRPCSNDDYLPSFN

SEQ ID NO: 87684 - protein, 21 aa, Mycobacterium avium
EALPGEIADKFHATFDASLYN

SEQ ID NO: 87685 - protein, 20 aa, Mycobacterium avium
EAMACAKALVRARRSDAVSA

SEQ ID NO: 87686 - protein, 29 aa, Mycobacterium avium
EAMASWSPKLMLRPATWVADTVADLERDM

SEQ ID NO: 87687 - protein, 22 aa, Mycobacterium avium
EANAANARRIWAHAGVADRVTC

SEQ ID NO: 87688 - protein, 25 aa, Mycobacterium avium
EANTVGRLSVPPTWASATPAIRLAS

SEQ ID NO: 87689 - protein, 22 aa, Mycobacterium avium
EAPARPGPAAARPSAPAPGQPK

SEQ ID NO: 87690 - protein, 28 aa, Mycobacterium avium
EAPRGTHALRFIRSCSAPLTAETAQALQ

SEQ ID NO: 87691 - protein, 24 aa, Mycobacterium avium
EAQDRYGRKVSWGVEVGSKTGTER

SEQ ID NO: 87692 - protein, 19 aa, Mycobacterium avium
EARAALADTVVRRGDTPLP

SEQ ID NO: 87693 - protein, 27 aa, Mycobacterium avium
EARGVPMTAGCVVPRGDVLELIDDIKD

SEQ ID NO: 87694 - protein, 22 aa, Mycobacterium avium
EARLAQGNPVAWIHATALRTEP

SEQ ID NO: 87695 - protein, 27 aa, Mycobacterium avium
EASEWPWRPRHLVVTLGSHGARYVGAD

SEQ ID NO: 87696 - protein, 17 aa, Mycobacterium avium
EASRSRLGLAQFAAPRP

SEQ ID NO: 87697 - protein, 24 aa, Mycobacterium avium
EATAEAFAGGWFHSGDLVRMDEDG

SEQ ID NO: 87698 - protein, 20 aa, Mycobacterium avium
EATFCYPEVAIGVPTIVGAI

SEQ ID NO: 87699 - protein, 21 aa, Mycobacterium avium
EAVGAHAGYPLLVKPVVGAVG

SEQ ID NO: 87700 - protein, 30 aa, Mycobacterium avium
EAVGIAAYHCGDWAQALAELRAARRMGSKS

SEQ ID NO: 87701 - protein, 17 aa, Mycobacterium avium
EAVQLFGGNGYMAEYRV

SEQ ID NO: 87702 - protein, 18 aa, Mycobacterium avium
EAYFEGFAALADMTDEER

SEQ ID NO: 87703 - protein, 21 aa, Mycobacterium avium
EAYLGLLRFLLGLDLVDRVQF

SEQ ID NO: 87704 - protein, 18 aa, Mycobacterium avium
EAYRLGMVSKVFPADELA

SEQ ID NO: 87705 - protein, 20 aa, Mycobacterium avium
ECLPYYVGMFEQMKRQALAG

SEQ ID NO: 87706 - protein, 24 aa, Mycobacterium avium
EDADFGMACAIGIAPCMHAGQGCA

SEQ ID NO: 87707 - protein, 21 aa, Mycobacterium avium
EDAGRCQRGYFIESLGGAQFA

SEQ ID NO: 87708 - protein, 17 aa, Mycobacterium avium
EDAPSMFAAAGRYVLDR

SEQ ID NO: 87709 - protein, 24 aa, Mycobacterium avium
EDENWRLLGSVALGRLVTNFAGEA

SEQ ID NO: 87710 - protein, 18 aa, Mycobacterium avium
EDGFWFIVDRVKDMIVTG

SEQ ID NO: 87711 - protein, 23 aa, Mycobacterium avium
EDGPHLQANWTWARSALDDKQIG

SEQ ID NO: 87712 - protein, 25 aa, Mycobacterium avium
EDIGRLRDGLGIAVPLGVPAAFTEE

SEQ ID NO: 87713 - protein, 21 aa, Mycobacterium avium
EDNCGLVSVADVVGEITGTAP

SEQ ID NO: 87714 - protein, 19 aa, Mycobacterium avium
EDPARGFLPTGGRVLGVFE

SEQ ID NO: 87715 - protein, 19 aa, Mycobacterium avium
EDPEFLTRMLARMVPHPDR

SEQ ID NO: 87716 - protein, 17 aa, Mycobacterium avium
EDSRLLTRELFYTAVTR

SEQ ID NO: 87717 - protein, 21 aa, Mycobacterium avium
EDVWGVPRGRLRTEVGTGTID

SEQ ID NO: 87718 - protein, 18 aa, Mycobacterium avium
EDYWGRWLGRWTAEEHLH

SEQ ID NO: 87719 - protein, 19 aa, Mycobacterium avium
EEADRLAARLDKIDAIQRD

SEQ ID NO: 87720 - protein, 22 aa, Mycobacterium avium
EEAKQWPGVQVRVIPAMTAAQA

SEQ ID NO: 87721 - protein, 22 aa, Mycobacterium avium
EEFDEYLALQCGRSAHTRRAYL

SEQ ID NO: 87722 - protein, 23 aa, Mycobacterium avium
EEGQWRCAPMAPKSLTSLSAAET

SEQ ID NO: 87723 - protein, 17 aa, Mycobacterium avium
EEITDWQLASNAEHSST

SEQ ID NO: 87724 - protein, 17 aa, Mycobacterium avium
EELREELILEVGSPRAI

SEQ ID NO: 87725 - protein, 24 aa, Mycobacterium avium
EEVERRREITGGKRSFILVPGIDV

SEQ ID NO: 87726 - protein, 23 aa, Mycobacterium avium
EEVYELRGGQLVRIDTPTDASVS

SEQ ID NO: 87727 - protein, 19 aa, Mycobacterium avium
EFDLDWRLSGIPPVAPPLF

SEQ ID NO: 87728 - protein, 25 aa, Mycobacterium avium
EFEEKLEWIRGFVRDEVEPLEVLFP

SEQ ID NO: 87729 - protein, 20 aa, Mycobacterium avium
EFGVTCTFHGHRRLSPDEVA

SEQ ID NO: 87730 - protein, 18 aa, Mycobacterium avium
EFLGEPGAPIGIDVEGHG

SEQ ID NO: 87731 - protein, 20 aa, Mycobacterium avium
EFRSGFVCLVGRPNTGKSTL

SEQ ID NO: 87732 - protein, 24 aa, Mycobacterium avium
EFVAEAIAKLGAQVMDGFETYHVM

SEQ ID NO: 87733 - protein, 24 aa, Mycobacterium avium
EFYTPRPIIRFIVQQVDPRLGEVI

SEQ ID NO: 87734 - protein, 25 aa, Mycobacterium avium
EGAGPGECVALLFSRSAEAIVSILA

SEQ ID NO: 87735 - protein, 17 aa, Mycobacterium avium
EGAPYLRYLNHKMKRDA

SEQ ID NO: 87736 - protein, 21 aa, Mycobacterium avium
EGCGILVLKRMSDAVRDGDRV

SEQ ID NO: 87737 - protein, 19 aa, Mycobacterium avium
EGDPHAWAIPRLTGTAKAA

SEQ ID NO: 87738 - protein, 26 aa, Mycobacterium avium
EGEAMLFGEYIRFMALVEYSADELKT

SEQ ID NO: 87739 - protein, 23 aa, Mycobacterium avium
EGELRPQLLDRFGLTVDVHASRD

SEQ ID NO: 87740 - protein, 24 aa, Mycobacterium avium
EGERRAEGRFALYSVADAHDDASA

SEQ ID NO: 87741 - protein, 23 aa, Mycobacterium avium
EGFKAEWRSIAVITVDRDLVDRL

SEQ ID NO: 87742 - protein, 20 aa, Mycobacterium avium
EGGFDVTRPTAWSAEGLLPY

SEQ ID NO: 87743 - protein, 17 aa, Mycobacterium avium
EGGMPPLVREVIGDVLR

SEQ ID NO: 87744 - protein, 24 aa, Mycobacterium avium
EGHLYRLFTKLGINNRDQLIQLIR

SEQ ID NO: 87745 - protein, 20 aa, Mycobacterium avium
EGKVKVELALARGKKAYDKR

SEQ ID NO: 87746 - protein, 18 aa, Mycobacterium avium
EGLRAARRAVPVSFAGRS

SEQ ID NO: 87747 - protein, 22 aa, Mycobacterium avium
EGNELGWRMEVEHDGQWHFFDD

SEQ ID NO: 87748 - protein, 24 aa, Mycobacterium avium
EGNHLGPTLSMRGIDNAAYYRLVD

SEQ ID NO: 87749 - protein, 18 aa, Mycobacterium avium
EGPLHRKAFADIPGPARA

SEQ ID NO: 87750 - protein, 20 aa, Mycobacterium avium
EGQLGKWSRMDAELIAEHAD

SEQ ID NO: 87751 - protein, 22 aa, Mycobacterium avium
EGRTDWRTVRLIITRTSLVTDA

SEQ ID NO: 87752 - protein, 18 aa, Mycobacterium avium
EGTQQGWLVEQARKHRVL

SEQ ID NO: 87753 - protein, 26 aa, Mycobacterium avium
EGVRLLRPGGVIVVHRAALGGRAGDP

SEQ ID NO: 87754 - protein, 20 aa, Mycobacterium avium
EGVTLRFGSKVPGTAMEVRD

SEQ ID NO: 87755 - protein, 24 aa, Mycobacterium avium
EGVTRAGGIAVLLPPQPVDTGIVG

SEQ ID NO: 87756 - protein, 31 aa, Mycobacterium avium
EHAAEVRALLTWGRPGVDAALIAALPNLEVI

SEQ ID NO: 87757 - protein, 25 aa, Mycobacterium avium
EHGEIPLGIYCRASLAQYMDAERLF

SEQ ID NO: 87758 - protein, 21 aa, Mycobacterium avium
EHGPDAFAMYVSGQMSLEAQY

SEQ ID NO: 87759 - protein, 21 aa, Mycobacterium avium
EHLAALRAIPKLSVVRPADAN

SEQ ID NO: 87760 - protein, 23 aa, Mycobacterium avium
EHPFPVWTERGGPATIVPMFLLY

SEQ ID NO: 87761 - protein, 21 aa, Mycobacterium avium
EHPGHAVARAQMRRFGGLVAV

SEQ ID NO: 87762 - protein, 26 aa, Mycobacterium avium
EHQGLRLAQTLTPWPAIDGQRTAAAS

SEQ ID NO: 87763 - protein, 17 aa, Mycobacterium avium
EHSRLSVREVMWGADPE

SEQ ID NO: 87764 - protein, 17 aa, Mycobacterium avium
EHWRGSLVAVFQPAEEL

SEQ ID NO: 87765 - protein, 20 aa, Mycobacterium avium
EIADPVLARRDGDVLRIAFN

SEQ ID NO: 87766 - protein, 26 aa, Mycobacterium avium
EIAIRAFRAAYELEMATVAVYPYEDR

SEQ ID NO: 87767 - protein, 22 aa, Mycobacterium avium
EIASCTPGFVVADLAALIREAA

SEQ ID NO: 87768 - protein, 22 aa, Mycobacterium avium
EIDAAAVDRIWAAGRHWYQGGF

SEQ ID NO: 87769 - protein, 30 aa, Mycobacterium avium
EIDAAEIYVPFSWFEPMWLENLGFAPEGEG

SEQ ID NO: 87770 - protein, 24 aa, Mycobacterium avium
EIDSARGPIYLKVSHLPDETLTAL

SEQ ID NO: 87771 - protein, 22 aa, Mycobacterium avium
EIEEFAPLIAYVLRSMQTGGDL

SEQ ID NO: 87772 - protein, 18 aa, Mycobacterium avium
EIEPRTGRQLGNFPQAFT

SEQ ID NO: 87773 - protein, 23 aa, Mycobacterium avium
EIERPPEDWLFKARTGDMRVDVL

SEQ ID NO: 87774 - protein, 19 aa, Mycobacterium avium
EIFGALLHGGRLVVIPDSV

SEQ ID NO: 87775 - protein, 22 aa, Mycobacterium avium
EIGYCLGRRWWGKGLMSEVLGM

SEQ ID NO: 87776 - protein, 23 aa, Mycobacterium avium
EIIELMRALWAPGWTEFEGEFYS

SEQ ID NO: 87777 - protein, 19 aa, Mycobacterium avium
EIRAEVAAFKAMDREQRKV

SEQ ID NO: 87778 - protein, 17 aa, Mycobacterium avium
EIRLSAVQRGPFARPPV

SEQ ID NO: 87779 - protein, 17 aa, Mycobacterium avium
EITAGRLGIEPFDDALV

SEQ ID NO: 87780 - protein, 20 aa, Mycobacterium avium
EITEQDFDTVFGLNTRATLF

SEQ ID NO: 87781 - protein, 23 aa, Mycobacterium avium
EIVDRWAPGRVMINAYGPTEATV

SEQ ID NO: 87782 - protein, 18 aa, Mycobacterium avium
EKAARRGLTSASFEVADI

SEQ ID NO: 87783 - protein, 18 aa, Mycobacterium avium
EKACAWDPSTGTRRRYPW

SEQ ID NO: 87784 - protein, 21 aa, Mycobacterium avium
EKAGDWRPLADFYAKDATYGW

SEQ ID NO: 87785 - protein, 18 aa, Mycobacterium avium
EKAHVRHSGALAMGMDGV

SEQ ID NO: 87786 - protein, 18 aa, Mycobacterium avium
EKALAAKTADEWVRLLQA

SEQ ID NO: 87787 - protein, 19 aa, Mycobacterium avium
EKDKASGDFVWDEDESEAL

SEQ ID NO: 87788 - protein, 24 aa, Mycobacterium avium
EKGGYRAPSCLITDTIGVETLAAS

SEQ ID NO: 87789 - protein, 23 aa, Mycobacterium avium
EKLAELYRRLELAKEPGGEKAAA

SEQ ID NO: 87790 - protein, 21 aa, Mycobacterium avium
EKLLRERGIEELPRYKPLLDS

SEQ ID NO: 87791 - protein, 18 aa, Mycobacterium avium
EKLPDGWDADLPHWEPGS

SEQ ID NO: 87792 - protein, 26 aa, Mycobacterium avium
EKPGRREGWDYPGMARESGTNALADA

SEQ ID NO: 87793 - protein, 20 aa, Mycobacterium avium
EKRFQRFAALMRALNPLINR

SEQ ID NO: 87794 - protein, 36 aa, Mycobacterium avium
EKRREMAYEGKIDWAFAELLALGSLVAEGKLVRLSG

SEQ ID NO: 87795 - protein, 23 aa, Mycobacterium avium
EKWGEAVTAVIVLRPDHPSDEES

SEQ ID NO: 87796 - protein, 19 aa, Mycobacterium avium
ELAELRKSAPIYWMDVPGG

SEQ ID NO: 87797 - protein, 23 aa, Mycobacterium avium
ELAFPRLYGVQTRFFDDFFDAAG

SEQ ID NO: 87798 - protein, 25 aa, Mycobacterium avium
ELAGRETFSGISIHSAHWDLELDLT

SEQ ID NO: 87799 - protein, 24 aa, Mycobacterium avium
ELAQLRLGLMHGRLSAEEKDAVMA

SEQ ID NO: 87800 - protein, 18 aa, Mycobacterium avium
ELAREFRARAGIDELTVS

SEQ ID NO: 87801 - protein, 19 aa, Mycobacterium avium
ELARRVASNSIGFVAPIPA

SEQ ID NO: 87802 - protein, 18 aa, Mycobacterium avium
ELATFFLTGLFALLATGA

SEQ ID NO: 87803 - protein, 22 aa, Mycobacterium avium
ELCDKRKVPLLFLQNIAGFMVG

SEQ ID NO: 87804 - protein, 25 aa, Mycobacterium avium
ELDTCPPLVVLTGRPDDAWLASWSR

SEQ ID NO: 87805 - protein, 20 aa, Mycobacterium avium
ELDVAWMIFAHMVFQELAGL

SEQ ID NO: 87806 - protein, 18 aa, Mycobacterium avium
ELEGRMYACFAAGAMAAG

SEQ ID NO: 87807 - protein, 26 aa, Mycobacterium avium
ELEKRRAHVPWVTWGTTAMVARSVAK

SEQ ID NO: 87808 - protein, 23 aa, Mycobacterium avium
ELELKRLFVLTFETEFFGKHGFT

SEQ ID NO: 87809 - protein, 22 aa, Mycobacterium avium
ELEQLPALGIMLTLFSAAGEST

SEQ ID NO: 87810 - protein, 19 aa, Mycobacterium avium
ELFLLRITLALLSNRPILV

SEQ ID NO: 87811 - protein, 18 aa, Mycobacterium avium
ELGAIPGRVAVGGDSAGG

SEQ ID NO: 87812 - protein, 19 aa, Mycobacterium avium
ELGDMGLVPAMTVKCTVAL

SEQ ID NO: 87813 - protein, 18 aa, Mycobacterium avium
ELGEWLHPFEKFWRTRLR

SEQ ID NO: 87814 - protein, 22 aa, Mycobacterium avium
ELGNRGKRSIAIDIKSETGREL

SEQ ID NO: 87815 - protein, 17 aa, Mycobacterium avium
ELHAHSAFSFLDGASTP

SEQ ID NO: 87816 - protein, 17 aa, Mycobacterium avium
ELHDCFYNAAFLEHAKR

SEQ ID NO: 87817 - protein, 18 aa, Mycobacterium avium
ELINRGGEKISPERVEGV

SEQ ID NO: 87818 - protein, 19 aa, Mycobacterium avium
ELLAALAAGERFAGLALQG

SEQ ID NO: 87819 - protein, 17 aa, Mycobacterium avium
ELLRFMMRNSKRVLSKA

SEQ ID NO: 87820 - protein, 21 aa, Mycobacterium avium
ELPETMLDAAPAMAVNGQQGM

SEQ ID NO: 87821 - protein, 23 aa, Mycobacterium avium
ELPGDAFVLAVQWHPEQSLHDLR

SEQ ID NO: 87822 - protein, 23 aa, Mycobacterium avium
ELPKPELCLAAILRDLGHARASA

SEQ ID NO: 87823 - protein, 26 aa, Mycobacterium avium
ELPSLLDFYMCYRAYVRGKVRSLRLA

SEQ ID NO: 87824 - protein, 20 aa, Mycobacterium avium
ELQEFIGAFWYHYDEAHYDE

SEQ ID NO: 87825 - protein, 24 aa, Mycobacterium avium
ELRALPREEWPSAIRRLVSGQLSL

SEQ ID NO: 87826 - protein, 20 aa, Mycobacterium avium
ELRAQAVLSVARRADELGWH

SEQ ID NO: 87827 - protein, 24 aa, Mycobacterium avium
ELRELAEIARLISPLRAHSGGDHP

SEQ ID NO: 87828 - protein, 25 aa, Mycobacterium avium
ELRELRSSGAVFGLLDVDDEFFVIV

SEQ ID NO: 87829 - protein, 25 aa, Mycobacterium avium
ELRGMLSARLPRYMVPQRIIMVDEI

SEQ ID NO: 87830 - protein, 22 aa, Mycobacterium avium
ELRRLDDDLAHLFIELAEKVWG

SEQ ID NO: 87831 - protein, 27 aa, Mycobacterium avium
ELRRRIGHAPLWLPGITAVTIRGRKVL

SEQ ID NO: 87832 - protein, 23 aa, Mycobacterium avium
ELRRTRPLFHHDLTPGVAATVHR

SEQ ID NO: 87833 - protein, 22 aa, Mycobacterium avium
ELRSWVACLVRPLTDHLEELGN

SEQ ID NO: 87834 - protein, 20 aa, Mycobacterium avium
ELRTFYRIRQSWAGKAVLLK

SEQ ID NO: 87835 - protein, 18 aa, Mycobacterium avium
ELSDVLRPVAPPREIDNV

SEQ ID NO: 87836 - protein, 29 aa, Mycobacterium avium
ELSQLRLLPFRLVLDGAREIDADITLAAF

SEQ ID NO: 87837 - protein, 19 aa, Mycobacterium avium
ELSTGMLLRPVQPPPSEGW

SEQ ID NO: 87838 - protein, 24 aa, Mycobacterium avium
ELTEAIKLVALVADRGAQVRMEFS

SEQ ID NO: 87839 - protein, 26 aa, Mycobacterium avium
ELVGELRAGLPPTLAVAGGYLDGIGV

SEQ ID NO: 87840 - protein, 18 aa, Mycobacterium avium
ELVGESWQGSSSESMAAA

SEQ ID NO: 87841 - protein, 17 aa, Mycobacterium avium
ELVKAAGTVEALREVKD

SEQ ID NO: 87842 - protein, 28 aa, Mycobacterium avium
ELVLDPRFRTAATWLPTLRAWRRVRRFR

SEQ ID NO: 87843 - protein, 23 aa, Mycobacterium avium
ELVQLRWAPRVNISAKTGRAVAK

SEQ ID NO: 87844 - protein, 17 aa, Mycobacterium avium
ELVRRIHDELPFQTLMT

SEQ ID NO: 87845 - protein, 18 aa, Mycobacterium avium
ELVSAAVLMGTRGRMDRA

SEQ ID NO: 87846 - protein, 22 aa, Mycobacterium avium
ELWSEAGKLGFLGVNLPEEYGG

SEQ ID NO: 87847 - protein, 22 aa, Mycobacterium avium
ELYLESARHAMTLLDLDLADRL

SEQ ID NO: 87848 - protein, 24 aa, Mycobacterium avium
EMGTRIYCAGGWYTGDTLDITTAT

SEQ ID NO: 87849 - protein, 19 aa, Mycobacterium avium
EMIAEKWGFDRTALDEFSL

SEQ ID NO: 87850 - protein, 25 aa, Mycobacterium avium
EMIRYCAPAQWFARTVRKPFDIHGQ

SEQ ID NO: 87851 - protein, 19 aa, Mycobacterium avium
EMLARADSVGVFQVESRAQ

SEQ ID NO: 87852 - protein, 17 aa, Mycobacterium avium
ENAKRPIRRALISVYDK

SEQ ID NO: 87853 - protein, 27 aa, Mycobacterium avium
ENFRPAIEAPYRWRDWAADPNGRTGDA

SEQ ID NO: 87854 - protein, 19 aa, Mycobacterium avium
ENIKRQWWRSVVTGREDVV

SEQ ID NO: 87855 - protein, 18 aa, Mycobacterium avium
ENIREVHRADLIGQHIGE

SEQ ID NO: 87856 - protein, 22 aa, Mycobacterium avium
ENQPGFLGFQLLRPVQGEDRYF

SEQ ID NO: 87857 - protein, 17 aa, Mycobacterium avium
ENVHMVSFTLWDMRYAG

SEQ ID NO: 87858 - protein, 23 aa, Mycobacterium avium
EPADYPPPAGYRGGYAEESRYGA

SEQ ID NO: 87859 - protein, 21 aa, Mycobacterium avium
EPCLRAFCDTVLAQDVEPRVP

SEQ ID NO: 87860 - protein, 19 aa, Mycobacterium avium
EPDAGRRLLSWARQAGFDD

SEQ ID NO: 87861 - protein, 19 aa, Mycobacterium avium
EPDAYAGLVSLRLPTEEEL

SEQ ID NO: 87862 - protein, 19 aa, Mycobacterium avium
EPEIAWRYLELDASDVDEQ

SEQ ID NO: 87863 - protein, 17 aa, Mycobacterium avium
EPELAWQYVELDAGADL

SEQ ID NO: 87864 - protein, 41 aa, Mycobacterium avium
EPERHWPALCRAVGRPEWRDDPRFADARARAANSVALIAAL

SEQ ID NO: 87865 - protein, 19 aa, Mycobacterium avium
EPFDAATLERMYPGGRTEY

SEQ ID NO: 87866 - protein, 17 aa, Mycobacterium avium
EPFELVVPVDVSDAEGN

SEQ ID NO: 87867 - protein, 25 aa, Mycobacterium avium
EPFGIVPLEAMACGVPVVATAVGGI

SEQ ID NO: 87868 - protein, 20 aa, Mycobacterium avium
EPGKFVKAADWVGRAEAEAE

SEQ ID NO: 87869 - protein, 18 aa, Mycobacterium avium
EPGLRAGAVQSHQVDVAR

SEQ ID NO: 87870 - protein, 17 aa, Mycobacterium avium
EPGRLRIALSTKVPTPL

SEQ ID NO: 87871 - protein, 19 aa, Mycobacterium avium
EPGWTMFMVSHFHYDPVWW

SEQ ID NO: 87872 - protein, 19 aa, Mycobacterium avium
EPHRVCRYLEDLAGDYHRF

SEQ ID NO: 87873 - protein, 18 aa, Mycobacterium avium
EPIRDWVKLAVTRARNSG

SEQ ID NO: 87874 - protein, 25 aa, Mycobacterium avium
EPLPGYLPSLWEIMPDLSVYIEAVH

SEQ ID NO: 87875 - protein, 18 aa, Mycobacterium avium
EPLRGRAAIAAFLRGVTG

SEQ ID NO: 87876 - protein, 24 aa, Mycobacterium avium
EPLRLLFKDEVRAVGRELGLPEEI

SEQ ID NO: 87877 - protein, 21 aa, Mycobacterium avium
EPLRPWKAEQLGGGYRISTWV

SEQ ID NO: 87878 - protein, 22 aa, Mycobacterium avium
EPLTAVAKKLDWVRGLAVDAGR

SEQ ID NO: 87879 - protein, 24 aa, Mycobacterium avium
EPPDRARLAYLRMKGRVAENRLQE

SEQ ID NO: 87880 - protein, 21 aa, Mycobacterium avium
EPPEAALPRYTGGTSPRALAM

SEQ ID NO: 87881 - protein, 20 aa, Mycobacterium avium
EPPRPLTHDLIRDVIAALGH

SEQ ID NO: 87882 - protein, 23 aa, Mycobacterium avium
EPPSPRIAAVLALDEPSVAELAP

SEQ ID NO: 87883 - protein, 20 aa, Mycobacterium avium
EPPTDFAAMLAMAEPSLPPA

SEQ ID NO: 87884 - protein, 17 aa, Mycobacterium avium
EPQLGWVAREGRIPLGY

SEQ ID NO: 87885 - protein, 25 aa, Mycobacterium avium
EPRHPTRGAPLCVFRETSRILAGLP

SEQ ID NO: 87886 - protein, 30 aa, Mycobacterium avium
EPRLAATVARGLKAEGFVVVTVGNGVDGLA

SEQ ID NO: 87887 - protein, 18 aa, Mycobacterium avium
EPSLPPAIVEGLRRAYPI

SEQ ID NO: 87888 - protein, 22 aa, Mycobacterium avium
EPSVRFNPILLKPGSDRTSQLV

SEQ ID NO: 87889 - protein, 22 aa, Mycobacterium avium
EQAAKLGRWGVIASVQPNFDAL

SEQ ID NO: 87890 - protein, 20 aa, Mycobacterium avium
EQANINWGKAGRMRWKGKRP

SEQ ID NO: 87891 - protein, 18 aa, Mycobacterium avium
EQAWQHFQAIEARGGFAE

SEQ ID NO: 87892 - protein, 28 aa, Mycobacterium avium
EQDAVFGVFCRRWGVPLIDGGTVRLPRL

SEQ ID NO: 87893 - protein, 26 aa, Mycobacterium avium
EQGAAPGECVALLFSRSDEAIVSILA

SEQ ID NO: 87894 - protein, 24 aa, Mycobacterium avium
EQLAEALARAGERGAPVVQQGVMP

SEQ ID NO: 87895 - protein, 17 aa, Mycobacterium avium
EQLAQTWLGLGPAVVAV

SEQ ID NO: 87896 - protein, 18 aa, Mycobacterium avium
EQLARGWMSLAGAMGGHT

SEQ ID NO: 87897 - protein, 17 aa, Mycobacterium avium
EQLAVGSGLAWVSLRPT

SEQ ID NO: 87898 - protein, 17 aa, Mycobacterium avium
EQLPRKGSYLTRELKVV

SEQ ID NO: 87899 - protein, 22 aa, Mycobacterium avium
EQLRAAQALPVYFGNRNWEPYV

SEQ ID NO: 87900 - protein, 24 aa, Mycobacterium avium
EQMWASDVAAMFGYHADASAAVAK

SEQ ID NO: 87901 - protein, 19 aa, Mycobacterium avium
EQQLRRWDASVTSLIRHGM

SEQ ID NO: 87902 - protein, 18 aa, Mycobacterium avium
EQVAKGFASHGESWSLAL

SEQ ID NO: 87903 - protein, 20 aa, Mycobacterium avium
EQWATAGHRRPFVGSLTLGL

SEQ ID NO: 87904 - protein, 29 aa, Mycobacterium avium
ERADGALRRSIKFPSFLDGIDAVRRVAEH

SEQ ID NO: 87905 - protein, 21 aa, Mycobacterium avium
ERADGTILWMADERAIGEHVV

SEQ ID NO: 87906 - protein, 19 aa, Mycobacterium avium
ERAGRPSLAGWLAEPQPFK

SEQ ID NO: 87907 - protein, 33 aa, Mycobacterium avium
ERAVARGSFFPVIPVCSSTGVGTCELLEVATRG

SEQ ID NO: 87908 - protein, 24 aa, Mycobacterium avium
ERDARRLGIEAGDLVHVSTPRGRI

SEQ ID NO: 87909 - protein, 19 aa, Mycobacterium avium
ERDRMAAAAEAKRQNLMRK

SEQ ID NO: 87910 - protein, 34 aa, Mycobacterium avium
EREGVNLTFLPFIARAVIDALKIHPNINASYNEE

SEQ ID NO: 87911 - protein, 22 aa, Mycobacterium avium
ERELRVPLHYYRDPKITEIEEG

SEQ ID NO: 87912 - protein, 20 aa, Mycobacterium avium
ERFSPFSGFGYFAGGLSGFA

SEQ ID NO: 87913 - protein, 21 aa, Mycobacterium avium
ERGLLLTTLWYIRVVDPTTLL

SEQ ID NO: 87914 - protein, 24 aa, Mycobacterium avium
ERGLPITMTKLRFMKFIMDEIFPG

SEQ ID NO: 87915 - protein, 23 aa, Mycobacterium avium
ERGLRETGFWRFVRDPDDPSESQ

SEQ ID NO: 87916 - protein, 24 aa, Mycobacterium avium
ERGRDKCRVPMPWSGQAPPFGFSS

SEQ ID NO: 87917 - protein, 18 aa, Mycobacterium avium
ERGRVLGEAVALLRDMLN

SEQ ID NO: 87918 - protein, 26 aa, Mycobacterium avium
ERIDAVLRAKVDAAWNLHELTRDMNL

SEQ ID NO: 87919 - protein, 18 aa, Mycobacterium avium
ERILFTGNLFGPLFGHVP

SEQ ID NO: 87920 - protein, 28 aa, Mycobacterium avium
ERLARISERWQRLGLNLNAADLFYRGER

SEQ ID NO: 87921 - protein, 18 aa, Mycobacterium avium
ERLGRGATIGSVLAGSPD

SEQ ID NO: 87922 - protein, 21 aa, Mycobacterium avium
ERLIPRTLMRAITKRVGGGRG

SEQ ID NO: 87923 - protein, 18 aa, Mycobacterium avium
ERLLLTVHVDPFTREQTE

SEQ ID NO: 87924 - protein, 21 aa, Mycobacterium avium
ERLNAWLPEYMVPTHIVALDE

SEQ ID NO: 87925 - protein, 23 aa, Mycobacterium avium
ERLRRHPAARALRVDKLTLAALE

SEQ ID NO: 87926 - protein, 23 aa, Mycobacterium avium
ERPDPPAGFSAFFDGVPTFIKDN

SEQ ID NO: 87927 - protein, 28 aa, Mycobacterium avium
ERPETAPDEIVRWATPVTAFQRTALEDY

SEQ ID NO: 87928 - protein, 29 aa, Mycobacterium avium
ERPFPLDLVPRVISAAEWARLERGITQRV

SEQ ID NO: 87929 - protein, 19 aa, Mycobacterium avium
ERPHYMPLFVAPQPLESSD

SEQ ID NO: 87930 - protein, 17 aa, Mycobacterium avium
ERSGNRWDISAPRNTYQ

SEQ ID NO: 87931 - protein, 18 aa, Mycobacterium avium
ERSGYRLEQLVADVDAVI

SEQ ID NO: 87932 - protein, 25 aa, Mycobacterium avium
ERVLVHPRPRVTIMALGGELVDISR

SEQ ID NO: 87933 - protein, 17 aa, Mycobacterium avium
ERVVEYDVLVGMHSSDS

SEQ ID NO: 87934 - protein, 19 aa, Mycobacterium avium
ERYAGTLARVGVLLDAVYD

SEQ ID NO: 87935 - protein, 25 aa, Mycobacterium avium
ESALDPSTRCWELGPDGQWTPSPQE

SEQ ID NO: 87936 - protein, 17 aa, Mycobacterium avium
ESATWWKDGPEIASGEL

SEQ ID NO: 87937 - protein, 43 aa, Mycobacterium avium
ESCKESLDRLGLDYLDLYLIHWPAPKLGKYVESFEGMIEARER

SEQ ID NO: 87938 - protein, 23 aa, Mycobacterium avium
ESEWNSLNLFTGWVDVGLTDKGR

SEQ ID NO: 87939 - protein, 24 aa, Mycobacterium avium
ESGYPRVVKRWRRGTPLDEAQTVF

SEQ ID NO: 87940 - protein, 17 aa, Mycobacterium avium
ESLFDSVMYVSFQELAT

SEQ ID NO: 87941 - protein, 22 aa, Mycobacterium avium
ESMAAAAAPYVAWLSATAGLAE

SEQ ID NO: 87942 - protein, 27 aa, Mycobacterium avium
ESPYGATIAHGFLTLSLIPGVSKDNYR

SEQ ID NO: 87943 - protein, 18 aa, Mycobacterium avium
ESRTFLISVAAELAGMHA

SEQ ID NO: 87944 - protein, 32 aa, Mycobacterium avium
ESSAAFQAAHARFVEVAARVNTLLDIAQANLG

SEQ ID NO: 87945 - protein, 20 aa, Mycobacterium avium
ESTRFFPMLTTAAGTVKPAS

SEQ ID NO: 87946 - protein, 23 aa, Mycobacterium avium
ESTWPEFFDAIRAAGYTRVSLGM

SEQ ID NO: 87947 - protein, 17 aa, Mycobacterium avium
ESVFRIDHYLGKETVRN

SEQ ID NO: 87948 - protein, 19 aa, Mycobacterium avium
ESVLRRLKQYSGRLATEAV

SEQ ID NO: 87949 - protein, 17 aa, Mycobacterium avium
ESVTEGTVTRWLKQEGD

SEQ ID NO: 87950 - protein, 26 aa, Mycobacterium avium
ETAFANWKALGARFFALRPATQLHWT

SEQ ID NO: 87951 - protein, 26 aa, Mycobacterium avium
ETDAAARVLLLWGRRPADPSRIRSRV

SEQ ID NO: 87952 - protein, 19 aa, Mycobacterium avium
ETDLAALVRSAATQVLPDA

SEQ ID NO: 87953 - protein, 18 aa, Mycobacterium avium
ETGRELFGRLLASADVFL

SEQ ID NO: 87954 - protein, 23 aa, Mycobacterium avium
ETHCLPTGLVLTSIGYRGKPIRD

SEQ ID NO: 87955 - protein, 22 aa, Mycobacterium avium
ETICRYRLPVTVVILNNGGVYR

SEQ ID NO: 87956 - protein, 39 aa, Mycobacterium avium
ETMVKAYAGFRSFRAGTNLKAWLYRILTNTYINSYRKKQ

SEQ ID NO: 87957 - protein, 19 aa, Mycobacterium avium
ETPRGAVFATEIAAAQNTV

SEQ ID NO: 87958 - protein, 22 aa, Mycobacterium avium
ETQTVLWARMLDRLAGSDPPAI

SEQ ID NO: 87959 - protein, 20 aa, Mycobacterium avium
ETREIWSYGSGYGGNALLGK

SEQ ID NO: 87960 - protein, 22 aa, Mycobacterium avium
ETRRLRVPGHQLINQLAEQSDP

SEQ ID NO: 87961 - protein, 22 aa, Mycobacterium avium
ETRTGDLWLFRGGSGPDRAIQT

SEQ ID NO: 87962 - protein, 20 aa, Mycobacterium avium
ETRTRLAIVGAGLPKPSTQI

SEQ ID NO: 87963 - protein, 20 aa, Mycobacterium avium
ETSMCVSISAPLTAGSGIPP

SEQ ID NO: 87964 - protein, 19 aa, Mycobacterium avium
ETWGALLHGGRLVVVPESV

SEQ ID NO: 87965 - protein, 17 aa, Mycobacterium avium
EVAARVGSDLVMSATAR

SEQ ID NO: 87966 - protein, 21 aa, Mycobacterium avium
EVARQGFEAMMRGHRKVVGGS

SEQ ID NO: 87967 - protein, 34 aa, Mycobacterium avium
EVDMTRLVGLRARAKAAFAEREGVNLTFLPFIAR

SEQ ID NO: 87968 - protein, 19 aa, Mycobacterium avium
EVDRARRAAGRAIRVYADL

SEQ ID NO: 87969 - protein, 21 aa, Mycobacterium avium
EVDRDCFARIAPGLPSNVIRI

SEQ ID NO: 87970 - protein, 18 aa, Mycobacterium avium
EVEINIACSLGMLTAEQV

SEQ ID NO: 87971 - protein, 20 aa, Mycobacterium avium
EVERMWPRVWQLACMVDHVA

SEQ ID NO: 87972 - protein, 24 aa, Mycobacterium avium
EVGLRYYAAAFFKVIPQVNAEVRN

SEQ ID NO: 87973 - protein, 20 aa, Mycobacterium avium
EVHAEACRWEHVMSEDVERR

SEQ ID NO: 87974 - protein, 24 aa, Mycobacterium avium
EVIADGPIPLARLIPAGVDIRGNA

SEQ ID NO: 87975 - protein, 27 aa, Mycobacterium avium
EVILANRLFPALTFGGSNLNFFPMGAW

SEQ ID NO: 87976 - protein, 19 aa, Mycobacterium avium
EVLDALQELTRLAVHQKTG

SEQ ID NO: 87977 - protein, 19 aa, Mycobacterium avium
EVLGFMFLMVIAGNETTTK

SEQ ID NO: 87978 - protein, 18 aa, Mycobacterium avium
EVLLRPNDEYGYLHDLFS

SEQ ID NO: 87979 - protein, 23 aa, Mycobacterium avium
EVLSQLPPFLTGGSMIETVTMES

SEQ ID NO: 87980 - protein, 25 aa, Mycobacterium avium
EVLVRRGRCPPVGSVRDTVGVDGHT

SEQ ID NO: 87981 - protein, 18 aa, Mycobacterium avium
EVMGWKIGGDGFRIVLSA

SEQ ID NO: 87982 - protein, 18 aa, Mycobacterium avium
EVNRRIRAALAPYPDDLV

SEQ ID NO: 87983 - protein, 19 aa, Mycobacterium avium
EVPQLRWRVTGAPLGLDRP

SEQ ID NO: 87984 - protein, 24 aa, Mycobacterium avium
EVPSRAYVSAFGFKGPDQQKPAGV

SEQ ID NO: 87985 - protein, 27 aa, Mycobacterium avium
EVRAAAVRGGHPWWTLSQLSDESAVEL

SEQ ID NO: 87986 - protein, 22 aa, Mycobacterium avium
EVRGAEVVDLLAALNTGHDGGA

SEQ ID NO: 87987 - protein, 19 aa, Mycobacterium avium
EVRGGLGGFAGLFALRGEY

SEQ ID NO: 87988 - protein, 22 aa, Mycobacterium avium
EVRLRGGTVVVELDTSGSIDVA

SEQ ID NO: 87989 - protein, 24 aa, Mycobacterium avium
EVRRRYECRSLRFAAASGSRMRPD

SEQ ID NO: 87990 - protein, 17 aa, Mycobacterium avium
EVSVIRAGHPGMLLQGG

SEQ ID NO: 87991 - protein, 19 aa, Mycobacterium avium
EVTATIAGYFARRPDRSAD

SEQ ID NO: 87992 - protein, 23 aa, Mycobacterium avium
EVVDRWAPGRVMINAYGPTEATV

SEQ ID NO: 87993 - protein, 23 aa, Mycobacterium avium
EVVDRWAPGRVMINVYGPTETTI

SEQ ID NO: 87994 - protein, 22 aa, Mycobacterium avium
EVVDRWAPGRVMVNAYGPTETT

SEQ ID NO: 87995 - protein, 17 aa, Mycobacterium avium
EVWLRNLYIPEYQHGSW

SEQ ID NO: 87996 - protein, 19 aa, Mycobacterium avium
EWEAFLGKDEDLYVFSSVA

SEQ ID NO: 87997 - protein, 17 aa, Mycobacterium avium
EWFPISLAPDRSYEVSH

SEQ ID NO: 87998 - protein, 23 aa, Mycobacterium avium
EYCDGCARWVHPASGRCRDCGGA

SEQ ID NO: 87999 - protein, 25 aa, Mycobacterium avium
EYDLLRRNQILFTFLHLAASRACTE

SEQ ID NO: 88000 - protein, 18 aa, Mycobacterium avium
EYDRFVWVDDSDQPWMNG

SEQ ID NO: 88001 - protein, 22 aa, Mycobacterium avium
EYELDCIIYASGFEITTEISRR

SEQ ID NO: 88002 - protein, 32 aa, Mycobacterium avium
EYGKTASQVLLRWNLQLGNAVIFRSANAEHIA

SEQ ID NO: 88003 - protein, 19 aa, Mycobacterium avium
EYPPVAISMLIAQAARSLC

SEQ ID NO: 88004 - protein, 24 aa, Mycobacterium avium
EYWKRHVRDAVRFADSVRFAQSAG

SEQ ID NO: 88005 - protein, 19 aa, Mycobacterium avium
EYYHVPALHSQQVPPEVRD

SEQ ID NO: 88006 - protein, 18 aa, Mycobacterium avium
FAAAMGFETIAINRGTGK

SEQ ID NO: 88007 - protein, 17 aa, Mycobacterium avium
FAADLKDLYAAVKALND

SEQ ID NO: 88008 - protein, 17 aa, Mycobacterium avium
FAADYGLCLARTDWQVP

SEQ ID NO: 88009 - protein, 18 aa, Mycobacterium avium
FAAELGRYNIRVNSLHPG

SEQ ID NO: 88010 - protein, 18 aa, Mycobacterium avium
FAAELGRYNIRVNSLNPG

SEQ ID NO: 88011 - protein, 24 aa, Mycobacterium avium
FAAPVGDPGWFGPDSAVWRVHSHL

SEQ ID NO: 88012 - protein, 20 aa, Mycobacterium avium
FAARARAWLADNMPAIDRES

SEQ ID NO: 88013 - protein, 17 aa, Mycobacterium avium
FAAVAALLRHRVATADR

SEQ ID NO: 88014 - protein, 22 aa, Mycobacterium avium
FADDARVLLVFGGSQGAASLNR

SEQ ID NO: 88015 - protein, 17 aa, Mycobacterium avium
FAEEGADVIAVDVPAAA

SEQ ID NO: 88016 - protein, 19 aa, Mycobacterium avium
FAEIWRRGGELDGVRVISP

SEQ ID NO: 88017 - protein, 36 aa, Mycobacterium avium
FAFNGWKTLSWVDANIWRRVVPKGWFYNVMVTGVKP

SEQ ID NO: 88018 - protein, 25 aa, Mycobacterium avium
FAGAGRRSVAGWADRVRVVDAKCVA

SEQ ID NO: 88019 - protein, 27 aa, Mycobacterium avium
FAGLRVLDLTTFWAGAYLTCYLGAFGA

SEQ ID NO: 88020 - protein, 18 aa, Mycobacterium avium
FAGSWGYQVTSYYAPTSR

SEQ ID NO: 88021 - protein, 17 aa, Mycobacterium avium
FAKAAYRINRVDDIGRG

SEQ ID NO: 88022 - protein, 17 aa, Mycobacterium avium
FAKLLPAVRAVRERLDW

SEQ ID NO: 88023 - protein, 30 aa, Mycobacterium avium
FAKRPALVRPSLGIAEWILPSVIRAAPKDL

SEQ ID NO: 88024 - protein, 19 aa, Mycobacterium avium
FALLHGDYRLDNLLFDPDR

SEQ ID NO: 88025 - protein, 17 aa, Mycobacterium avium
FANRRVDAVQDGTLLCS

SEQ ID NO: 88026 - protein, 17 aa, Mycobacterium avium
FAPEVHSTLLSSGPGPA

SEQ ID NO: 88027 - protein, 26 aa, Mycobacterium avium
FAPLEMGEALQALTAILTRRGVSSPP

SEQ ID NO: 88028 - protein, 17 aa, Mycobacterium avium
FARDIFRYYRSDAAAAI

SEQ ID NO: 88029 - protein, 20 aa, Mycobacterium avium
FARLLRACGEIDGLERVRFT

SEQ ID NO: 88030 - protein, 25 aa, Mycobacterium avium
FARQRYWGEPFPIVYDSDGRPHALD

SEQ ID NO: 88031 - protein, 17 aa, Mycobacterium avium
FARRGIRSHVLPSSATF

SEQ ID NO: 88032 - protein, 22 aa, Mycobacterium avium
FARSPRPTIGVEWEFALVDAQT

SEQ ID NO: 88033 - protein, 25 aa, Mycobacterium avium
FASLDRWPGTVAEYLSTMFDPSLTF

SEQ ID NO: 88034 - protein, 20 aa, Mycobacterium avium
FATRPLDEWAQIFANEPDFF

SEQ ID NO: 88035 - protein, 18 aa, Mycobacterium avium
FCPELGEPVQIIPAEPEI

SEQ ID NO: 88036 - protein, 19 aa, Mycobacterium avium
FCVDYRLAPRHRFPTAADD

SEQ ID NO: 88037 - protein, 19 aa, Mycobacterium avium
FDAAVIPGLLTATTPSQLV

SEQ ID NO: 88038 - protein, 20 aa, Mycobacterium avium
FDAVIAVHLKGHFATMRHAA

SEQ ID NO: 88039 - protein, 18 aa, Mycobacterium avium
FDDACAVIPGGVNSPVRA

SEQ ID NO: 88040 - protein, 24 aa, Mycobacterium avium
FDDLSVGQVFDWAPSVTLSSGLAA

SEQ ID NO: 88041 - protein, 20 aa, Mycobacterium avium
FDDPRWLVKHLPKAARDAVM

SEQ ID NO: 88042 - protein, 17 aa, Mycobacterium avium
FDDYQSWTDRVIPVVIC

SEQ ID NO: 88043 - protein, 18 aa, Mycobacterium avium
FDEAFAALRKWEAEGRLH

SEQ ID NO: 88044 - protein, 24 aa, Mycobacterium avium
FDELYAAGAAAIFPPGTVIADAAI

SEQ ID NO: 88045 - protein, 28 aa, Mycobacterium avium
FDFRGTDTTIAWKGDEAIELTSSTEERV

SEQ ID NO: 88046 - protein, 23 aa, Mycobacterium avium
FDGSDTVTLVWLGQRRIPGIDSG

SEQ ID NO: 88047 - protein, 18 aa, Mycobacterium avium
FDGTGWATDVELRIRCLD

SEQ ID NO: 88048 - protein, 17 aa, Mycobacterium avium
FDGYRFEIAGSVQFPTS

SEQ ID NO: 88049 - protein, 20 aa, Mycobacterium avium
FDHVGLDWQKHVKFDDRYLR

SEQ ID NO: 88050 - protein, 19 aa, Mycobacterium avium
FDIRRGRAALRYLSQARHI

SEQ ID NO: 88051 - protein, 17 aa, Mycobacterium avium
FDIWSYIGAENIALPSI

SEQ ID NO: 88052 - protein, 21 aa, Mycobacterium avium
FDLATGRRARRGRGALAALAR

SEQ ID NO: 88053 - protein, 22 aa, Mycobacterium avium
FDLGVPVFGICYGFQAMAQALG

SEQ ID NO: 88054 - protein, 29 aa, Mycobacterium avium
FDPHRMAKGMACRTRFYDDFFLDAARAGV

SEQ ID NO: 88055 - protein, 25 aa, Mycobacterium avium
FDPKKAVLFDDRWASAREDLVKLWL

SEQ ID NO: 88056 - protein, 20 aa, Mycobacterium avium
FDRLGLPGWAWSDVLDSFRA

SEQ ID NO: 88057 - protein, 26 aa, Mycobacterium avium
FDRVRAALLAARRSRIQPGRDDKVVT

SEQ ID NO: 88058 - protein, 24 aa, Mycobacterium avium
FDSLKHARKGLFLVHTDAVDSVLG

SEQ ID NO: 88059 - protein, 25 aa, Mycobacterium avium
FDTDPRARRGLAFQLVEGAAKLGRV

SEQ ID NO: 88060 - protein, 18 aa, Mycobacterium avium
FDTVFGLNTRATLFTVQK

SEQ ID NO: 88061 - protein, 20 aa, Mycobacterium avium
FDTVVDCAFYHVFATEPELR

SEQ ID NO: 88062 - protein, 17 aa, Mycobacterium avium
FEALAGFRPASRTVELL

SEQ ID NO: 88063 - protein, 24 aa, Mycobacterium avium
FEDARKRFDAAWNHQNGDHPINDS

SEQ ID NO: 88064 - protein, 27 aa, Mycobacterium avium
FEELLSRFGAVRVVRPVEWARSNRHTG

SEQ ID NO: 88065 - protein, 19 aa, Mycobacterium avium
FEGQVSVCWEDAPDGRGLN

SEQ ID NO: 88066 - protein, 19 aa, Mycobacterium avium
FEGTLYFPAPRTPRERVAQ

SEQ ID NO: 88067 - protein, 19 aa, Mycobacterium avium
FEIPGGGPATSAFAANLPA

SEQ ID NO: 88068 - protein, 26 aa, Mycobacterium avium
FEKTLRFWLERGVDGFRIDVAHGMAK

SEQ ID NO: 88069 - protein, 23 aa, Mycobacterium avium
FELELSLLLCYTGITRDSARVIE

SEQ ID NO: 88070 - protein, 23 aa, Mycobacterium avium
FELKEFKTGAARMAIDADVPIIP

SEQ ID NO: 88071 - protein, 17 aa, Mycobacterium avium
FELLRARSQLIIITHQK

SEQ ID NO: 88072 - protein, 26 aa, Mycobacterium avium
FENAWRVNCFGAFLGMRAALERLRGT

SEQ ID NO: 88073 - protein, 25 aa, Mycobacterium avium
FEPRHARFERFLSFGDVCEQIRRAS

SEQ ID NO: 88074 - protein, 21 aa, Mycobacterium avium
FEPSLSRGGDMAVDFLAGAQE

SEQ ID NO: 88075 - protein, 22 aa, Mycobacterium avium
FEQARKRFDAAWNHQNGDHPIN

SEQ ID NO: 88076 - protein, 18 aa, Mycobacterium avium
FEQCSVAWQAIPHWDTGD

SEQ ID NO: 88077 - protein, 19 aa, Mycobacterium avium
FETMASFMLVEHANGALFD

SEQ ID NO: 88078 - protein, 18 aa, Mycobacterium avium
FEVEFSVAAGEVLAVLGP

SEQ ID NO: 88079 - protein, 17 aa, Mycobacterium avium
FEVLRAIVADFVATKEP

SEQ ID NO: 88080 - protein, 17 aa, Mycobacterium avium
FEVLSRHGVELLNVEQV

SEQ ID NO: 88081 - protein, 18 aa, Mycobacterium avium
FEYSPESYTGTELEYAKQ

SEQ ID NO: 88082 - protein, 18 aa, Mycobacterium avium
FFRVSREITCAQANLMPA

SEQ ID NO: 88083 - protein, 26 aa, Mycobacterium avium
FFSLPWYYRAGYDVLMYTLPFHGKRA

SEQ ID NO: 88084 - protein, 25 aa, Mycobacterium avium
FFTAGGMVRTVSWLYLGQTMVIHQR

SEQ ID NO: 88085 - protein, 18 aa, Mycobacterium avium
FGAALAELDGGWNVGDGA

SEQ ID NO: 88086 - protein, 25 aa, Mycobacterium avium
FGADPKLLAGFPFPHLLQVAVRLAG

SEQ ID NO: 88087 - protein, 17 aa, Mycobacterium avium
FGAGLAMHLAAVRPDRV

SEQ ID NO: 88088 - protein, 24 aa, Mycobacterium avium
FGAPAGEALHAWLADGRPALANAE

SEQ ID NO: 88089 - protein, 17 aa, Mycobacterium avium
FGAQMVERGQGGTIINV

SEQ ID NO: 88090 - protein, 18 aa, Mycobacterium avium
FGAVELWPVVHAVEPSRR

SEQ ID NO: 88091 - protein, 26 aa, Mycobacterium avium
FGEGVLPLLERMGLWRHPNRRSRPAA

SEQ ID NO: 88092 - protein, 17 aa, Mycobacterium avium
FGELRWHNGAAVTVVLA

SEQ ID NO: 88093 - protein, 25 aa, Mycobacterium avium
FGELTQLAGVFGFAECVDLLADYTA

SEQ ID NO: 88094 - protein, 24 aa, Mycobacterium avium
FGEQKARIFLALLGKQYGVTPPGW

SEQ ID NO: 88095 - protein, 17 aa, Mycobacterium avium
FGFEHPMGDGWRGFQDI

SEQ ID NO: 88096 - protein, 20 aa, Mycobacterium avium
FGGALLPRLVTPREAARLRE

SEQ ID NO: 88097 - protein, 23 aa, Mycobacterium avium
FGGEAPDNWQLIVDDVADSDLPD

SEQ ID NO: 88098 - protein, 20 aa, Mycobacterium avium
FGGTDVRGVPRFDHVKVVGP

SEQ ID NO: 88099 - protein, 17 aa, Mycobacterium avium
FGHGDPWTAMRAAVHRT

SEQ ID NO: 88100 - protein, 22 aa, Mycobacterium avium
FGICAKHAPGYFSLDDWGYASL

SEQ ID NO: 88101 - protein, 17 aa, Mycobacterium avium
FGIPGGAVLPVYDPLFD

SEQ ID NO: 88102 - protein, 18 aa, Mycobacterium avium
FGKGVHFCVGAALARLEA

SEQ ID NO: 88103 - protein, 21 aa, Mycobacterium avium
FGLEVPGNIYTRIGNPTTDVV

SEQ ID NO: 88104 - protein, 17 aa, Mycobacterium avium
FGLGCAAGAAGVGRLHD

SEQ ID NO: 88105 - protein, 26 aa, Mycobacterium avium
FGMRRRSAFCDFDFRATRPEYTNGGK

SEQ ID NO: 88106 - protein, 22 aa, Mycobacterium avium
FGPGGPRGAWRRGGPGRGKRGD

SEQ ID NO: 88107 - protein, 17 aa, Mycobacterium avium
FGRDRYDDFFKMAYAAL

SEQ ID NO: 88108 - protein, 17 aa, Mycobacterium avium
FGRPGGAPRRGRKSKRQ

SEQ ID NO: 88109 - protein, 18 aa, Mycobacterium avium
FGRRAVPGVDELFDEAAD

SEQ ID NO: 88110 - protein, 17 aa, Mycobacterium avium
FGSAFQWQYPTPPEGDH

SEQ ID NO: 88111 - protein, 35 aa, Mycobacterium avium
FGSDEQKQRWAVPILRAEITASLGMSEPSAGSDLA

SEQ ID NO: 88112 - protein, 17 aa, Mycobacterium avium
FGSRGWTAVPTPLADYL

SEQ ID NO: 88113 - protein, 17 aa, Mycobacterium avium
FGSTAAIFPIDQETIDY

SEQ ID NO: 88114 - protein, 26 aa, Mycobacterium avium
FGTRSRAACFTWTVPDDVELTGPMAA

SEQ ID NO: 88115 - protein, 25 aa, Mycobacterium avium
FGVDQLRYFLLREVPFGQDGSYTED

SEQ ID NO: 88116 - protein, 17 aa, Mycobacterium avium
FGVTWPIPVTVISEQDA

SEQ ID NO: 88117 - protein, 17 aa, Mycobacterium avium
FHAKAVVLATGGSGRMY

SEQ ID NO: 88118 - protein, 17 aa, Mycobacterium avium
FHLAHTVARAARLPRTA

SEQ ID NO: 88119 - protein, 19 aa, Mycobacterium avium
FHRDLDIVFGTTVLRDLEL

SEQ ID NO: 88120 - protein, 25 aa, Mycobacterium avium
FHRVDGAWCFESRTMFVDQVGDVSH

SEQ ID NO: 88121 - protein, 18 aa, Mycobacterium avium
FHSSRWDYDYTGGDSGGN

SEQ ID NO: 88122 - protein, 19 aa, Mycobacterium avium
FHSYRRDPRSSVRGCSPSR

SEQ ID NO: 88123 - protein, 17 aa, Mycobacterium avium
FHVEGLATVIPFHRAVV

SEQ ID NO: 88124 - protein, 19 aa, Mycobacterium avium
FHVVEALPVGDARGLPATA

SEQ ID NO: 88125 - protein, 20 aa, Mycobacterium avium
FIDAARRAGFGWIDDLNDAA

SEQ ID NO: 88126 - protein, 30 aa, Mycobacterium avium
FIEGYNLNMAIPWTAAERGFIDAVIDPHET

SEQ ID NO: 88127 - protein, 26 aa, Mycobacterium avium
FILQELPLLLQVGLSLSITSLGGLAG

SEQ ID NO: 88128 - protein, 26 aa, Mycobacterium avium
FISSGFPINLLGVWAQLATAQGVASV

SEQ ID NO: 88129 - protein, 23 aa, Mycobacterium avium
FKAPKEFLFVAAVQRLGNGKADY

SEQ ID NO: 88130 - protein, 20 aa, Mycobacterium avium
FKDINCLPFAPPRDNPYSGA

SEQ ID NO: 88131 - protein, 21 aa, Mycobacterium avium
FKGIGDTGADIFLREVQDVWT

SEQ ID NO: 88132 - protein, 18 aa, Mycobacterium avium
FKHMSKMTWRSMISDGLA

SEQ ID NO: 88133 - protein, 22 aa, Mycobacterium avium
FKPGTLAALGFSYEQLRAINPR

SEQ ID NO: 88134 - protein, 20 aa, Mycobacterium avium
FKQKSALRFGATHSVATIAE

SEQ ID NO: 88135 - protein, 18 aa, Mycobacterium avium
FKTALRLARHRELVDGFE

SEQ ID NO: 88136 - protein, 24 aa, Mycobacterium avium
FLARLCKTAMWIDHGEIRMSGGIE

SEQ ID NO: 88137 - protein, 21 aa, Mycobacterium avium
FLDCVRAVIGGTSMDEFTDAT

SEQ ID NO: 88138 - protein, 17 aa, Mycobacterium avium
FLDQGITFSLSGQERPF

SEQ ID NO: 88139 - protein, 17 aa, Mycobacterium avium
FLDSLVDSVRMGMVVVD

SEQ ID NO: 88140 - protein, 17 aa, Mycobacterium avium
FLEDKDYWLAHRPGDGT

SEQ ID NO: 88141 - protein, 24 aa, Mycobacterium avium
FLGEPPVVIGPLFQDKTLKVCATE

SEQ ID NO: 88142 - protein, 19 aa, Mycobacterium avium
FLGSSCIYPKYAPQPIHES

SEQ ID NO: 88143 - protein, 17 aa, Mycobacterium avium
FLHDFAGLGADWTAANI

SEQ ID NO: 88144 - protein, 17 aa, Mycobacterium avium
FLIAVARMRALDPVTSE

SEQ ID NO: 88145 - protein, 19 aa, Mycobacterium avium
FLLGLDLVDRVQFWMLPLD

SEQ ID NO: 88146 - protein, 19 aa, Mycobacterium avium
FLQIYNAWFDPAANKARPI

SEQ ID NO: 88147 - protein, 18 aa, Mycobacterium avium
FLQYPWQVIPDELIKPLE

SEQ ID NO: 88148 - protein, 24 aa, Mycobacterium avium
FLREYPYREAYLLRDAKLFRAELK

SEQ ID NO: 88149 - protein, 17 aa, Mycobacterium avium
FMGDIYGGALLVEQAAW

SEQ ID NO: 88150 - protein, 23 aa, Mycobacterium avium
FMGNPILCDLILIRAALSPKAAR

SEQ ID NO: 88151 - protein, 17 aa, Mycobacterium avium
FMHVLPVGWVEPVDISN

SEQ ID NO: 88152 - protein, 18 aa, Mycobacterium avium
FNAAWNHQDGGPNPINSS

SEQ ID NO: 88153 - protein, 21 aa, Mycobacterium avium
FNEPFKSFWLTPRQHQDALAA

SEQ ID NO: 88154 - protein, 17 aa, Mycobacterium avium
FNLDEMPNPVASIYKTR

SEQ ID NO: 88155 - protein, 18 aa, Mycobacterium avium
FNSLFFRNAVNSGLPAIT

SEQ ID NO: 88156 - protein, 24 aa, Mycobacterium avium
FPAGSELRRALAMVKTLDELDRLL

SEQ ID NO: 88157 - protein, 17 aa, Mycobacterium avium
FPDATVVRLERDYRSTP

SEQ ID NO: 88158 - protein, 20 aa, Mycobacterium avium
FPDPWPKARHHKRRFLQPGT

SEQ ID NO: 88159 - protein, 19 aa, Mycobacterium avium
FPEGKGWRQPELKAAGAAM

SEQ ID NO: 88160 - protein, 19 aa, Mycobacterium avium
FPGLAAEWAHWGDRRPFVG

SEQ ID NO: 88161 - protein, 17 aa, Mycobacterium avium
FPGWEATTSYLLAEAEM

SEQ ID NO: 88162 - protein, 17 aa, Mycobacterium avium
FPGYFLVVHDIARFCRE

SEQ ID NO: 88163 - protein, 23 aa, Mycobacterium avium
FPHFRHPIPPPGRGRVTLLGDAA

SEQ ID NO: 88164 - protein, 17 aa, Mycobacterium avium
FPLMPIDGILVGTAAMA

SEQ ID NO: 88165 - protein, 23 aa, Mycobacterium avium
FPNAPMRATHLWAAPDRVTEAAP

SEQ ID NO: 88166 - protein, 25 aa, Mycobacterium avium
FPRELPRSGAEFLGILGQLATVGLT

SEQ ID NO: 88167 - protein, 25 aa, Mycobacterium avium
FPRVHRWARGVDVLRFAPSARSEAL

SEQ ID NO: 88168 - protein, 18 aa, Mycobacterium avium
FPTLIELYLQGRLPLEKF

SEQ ID NO: 88169 - protein, 22 aa, Mycobacterium avium
FPTRLERGAGIPAVERLAYFAE

SEQ ID NO: 88170 - protein, 20 aa, Mycobacterium avium
FPYAWPRKPVLADNVVCTSQ

SEQ ID NO: 88171 - protein, 22 aa, Mycobacterium avium
FQAEWREIGLLTFDGELLSRCE

SEQ ID NO: 88172 - protein, 20 aa, Mycobacterium avium
FQLDIMRVPGIIVARTDAEA

SEQ ID NO: 88173 - protein, 20 aa, Mycobacterium avium
FQLLVLCMLASKPIDAAIAV

SEQ ID NO: 88174 - protein, 20 aa, Mycobacterium avium
FQNTCRWRDLRKITIAQVQG

SEQ ID NO: 88175 - protein, 20 aa, Mycobacterium avium
FQRFTPRARGAVVAAQNAAH

SEQ ID NO: 88176 - protein, 27 aa, Mycobacterium avium
FRAGEIDFRLFATIVYRTDLITDRRVL

SEQ ID NO: 88177 - protein, 17 aa, Mycobacterium avium
FRGERLVNSMFTLSTLV

SEQ ID NO: 88178 - protein, 26 aa, Mycobacterium avium
FRGFWKMGEMRGMWREMWDLSDQCWA

SEQ ID NO: 88179 - protein, 27 aa, Mycobacterium avium
FRGTAPTGPGFWFPPTVLTPSRTDRCV

SEQ ID NO: 88180 - protein, 25 aa, Mycobacterium avium
FRHGLQLHGAMGFTWENDLQFALKR

SEQ ID NO: 88181 - protein, 35 aa, Mycobacterium avium
FRHVKAAMLRARHRIMLVGWDFDSRVTFERGDKTL

SEQ ID NO: 88182 - protein, 21 aa, Mycobacterium avium
FRKCIECFLCQNVCHVIRDHD

SEQ ID NO: 88183 - protein, 24 aa, Mycobacterium avium
FRKHPRARAGLDRASGRIPLDAPL

SEQ ID NO: 88184 - protein, 19 aa, Mycobacterium avium
FRLERDGVLVSWAVPKNLP

SEQ ID NO: 88185 - protein, 18 aa, Mycobacterium avium
FRLTGLLPGFTDPRNGRM

SEQ ID NO: 88186 - protein, 18 aa, Mycobacterium avium
FRLVDLYSAPSMRELDTW

SEQ ID NO: 88187 - protein, 17 aa, Mycobacterium avium
FRPERVSAELAAAGLRR

SEQ ID NO: 88188 - protein, 18 aa, Mycobacterium avium
FRQFARDFFDLVIVDECH

SEQ ID NO: 88189 - protein, 24 aa, Mycobacterium avium
FRRARPEPPLAVLLDRDDTLIVDR

SEQ ID NO: 88190 - protein, 17 aa, Mycobacterium avium
FRTPCVFFVQNNQWAIS

SEQ ID NO: 88191 - protein, 20 aa, Mycobacterium avium
FRVIGEPGLRAGAVQSHQVD

SEQ ID NO: 88192 - protein, 18 aa, Mycobacterium avium
FSGKILAPAHLPQEQSQR

SEQ ID NO: 88193 - protein, 27 aa, Mycobacterium avium
FSIEPGIYFPGRWGARIEDIVVVTDDG

SEQ ID NO: 88194 - protein, 17 aa, Mycobacterium avium
FSPEGQPHFELDFVPAF

SEQ ID NO: 88195 - protein, 18 aa, Mycobacterium avium
FSPFFNALPIRRLGLQER

SEQ ID NO: 88196 - protein, 18 aa, Mycobacterium avium
FSPLVAKLVAELGFDGVY

SEQ ID NO: 88197 - protein, 18 aa, Mycobacterium avium
FSQIGGLLKTGGHTAMLR

SEQ ID NO: 88198 - protein, 27 aa, Mycobacterium avium
FSRCTRCGRIYWPGSHHAKLLALVERL

SEQ ID NO: 88199 - protein, 18 aa, Mycobacterium avium
FSRQLKLLAKELEVPVVA

SEQ ID NO: 88200 - protein, 31 aa, Mycobacterium avium
FSRRCGTPGAPALVLVHGFPTSSIDYFALAG

SEQ ID NO: 88201 - protein, 17 aa, Mycobacterium avium
FSTHMRMFGLPYRITST

SEQ ID NO: 88202 - protein, 19 aa, Mycobacterium avium
FSYQFSFEQSRHWSRTYAP

SEQ ID NO: 88203 - protein, 21 aa, Mycobacterium avium
FTAAGYVCLVFDYRHFGASSG

SEQ ID NO: 88204 - protein, 17 aa, Mycobacterium avium
FTAEIGRQSGLAAQGLD

SEQ ID NO: 88205 - protein, 17 aa, Mycobacterium avium
FTALRERRVLGVRGSDG

SEQ ID NO: 88206 - protein, 24 aa, Mycobacterium avium
FTANPWLPGYMSQALALLTRDTGD

SEQ ID NO: 88207 - protein, 24 aa, Mycobacterium avium
FTASDRAIAAWLWSGRRAVVAGNS

SEQ ID NO: 88208 - protein, 17 aa, Mycobacterium avium
FTAYKLLIADVIGGELK

SEQ ID NO: 88209 - protein, 18 aa, Mycobacterium avium
FTDEPFELVVPVDVSDAE

SEQ ID NO: 88210 - protein, 18 aa, Mycobacterium avium
FTDGRWLLSHNGVVDRSV

SEQ ID NO: 88211 - protein, 17 aa, Mycobacterium avium
FTEADVRPPGSDRLIDA

SEQ ID NO: 88212 - protein, 18 aa, Mycobacterium avium
FTESGLMARREASINDVP

SEQ ID NO: 88213 - protein, 20 aa, Mycobacterium avium
FTHHMFLPMPPEDGGAPPPP

SEQ ID NO: 88214 - protein, 19 aa, Mycobacterium avium
FTHLLGYALVQAIKKFPNM

SEQ ID NO: 88215 - protein, 20 aa, Mycobacterium avium
FTIRDGVSFSDHTPLTAEVV

SEQ ID NO: 88216 - protein, 17 aa, Mycobacterium avium
FTLGERWTSAGEPAGIG

SEQ ID NO: 88217 - protein, 28 aa, Mycobacterium avium
FTPGELLGCVSGALGLRKFFEDGGHELV

SEQ ID NO: 88218 - protein, 17 aa, Mycobacterium avium
FTPTGRPTGEWAAAIAR

SEQ ID NO: 88219 - protein, 23 aa, Mycobacterium avium
FTVPVNRLLTAAMPRAAARAPNT

SEQ ID NO: 88220 - protein, 17 aa, Mycobacterium avium
FTVPYYWWTFNMPTDHG

SEQ ID NO: 88221 - protein, 17 aa, Mycobacterium avium
FTYGLLYQREADLAQRC

SEQ ID NO: 88222 - protein, 22 aa, Mycobacterium avium
FVANPFGGPGERMYRTGDLVRW

SEQ ID NO: 88223 - protein, 20 aa, Mycobacterium avium
FVDAFANLLLEERVAAHTAR

SEQ ID NO: 88224 - protein, 17 aa, Mycobacterium avium
FVGAGLALALAGRRHRW

SEQ ID NO: 88225 - protein, 17 aa, Mycobacterium avium
FVHARAAALSAADPGPG

SEQ ID NO: 88226 - protein, 32 aa, Mycobacterium avium
FVIDVNLGRLAWLLRLFGFDVWWSNDADDQTL

SEQ ID NO: 88227 - protein, 31 aa, Mycobacterium avium
FVVLNWRAVCGQCRACKRGRPHLCFDTFNAT

SEQ ID NO: 88228 - protein, 23 aa, Mycobacterium avium
FWMVRKRPALQIHLLKSNLRLLP

SEQ ID NO: 88229 - protein, 22 aa, Mycobacterium avium
FWNREYDILVCTTIVETGLDIS

SEQ ID NO: 88230 - protein, 21 aa, Mycobacterium avium
FWSVVTGVYSPQSWTTIPGGP

SEQ ID NO: 88231 - protein, 21 aa, Mycobacterium avium
FYAKHGFTVSGTRTFQLGAGR

SEQ ID NO: 88232 - protein, 29 aa, Mycobacterium avium
FYDDDREAAAWVRAGAPAGRMCLEAQVMD

SEQ ID NO: 88233 - protein, 18 aa, Mycobacterium avium
FYDDVRIPLSNVVGDVGE

SEQ ID NO: 88234 - protein, 22 aa, Mycobacterium avium
FYEGLLGFQFWWEIDPPDDRTA

SEQ ID NO: 88235 - protein, 18 aa, Mycobacterium avium
FYNAAFLEHAKRYWNAEY

SEQ ID NO: 88236 - protein, 17 aa, Mycobacterium avium
GAAAMAGGFIYLGGGTP

SEQ ID NO: 88237 - protein, 20 aa, Mycobacterium avium
GAAAVRARIVPVSPSAVSIE

SEQ ID NO: 88238 - protein, 24 aa, Mycobacterium avium
GAACWDARRWLGRPGLEHGASADL

SEQ ID NO: 88239 - protein, 23 aa, Mycobacterium avium
GAADADEGPAWWDGTVIGHLRVS

SEQ ID NO: 88240 - protein, 17 aa, Mycobacterium avium
GAAEAFALLSNLRPKRA

SEQ ID NO: 88241 - protein, 18 aa, Mycobacterium avium
GAAFDRLIALVRNTSGDD

SEQ ID NO: 88242 - protein, 26 aa, Mycobacterium avium
GAAGRVALDIATRYALQRKQFTTPDG

SEQ ID NO: 88243 - protein, 19 aa, Mycobacterium avium
GAAGVAMGTRFLLTSDSTV

SEQ ID NO: 88244 - protein, 20 aa, Mycobacterium avium
GAALADWGADVIKVEGVSSG

SEQ ID NO: 88245 - protein, 24 aa, Mycobacterium avium
GAATRLGHSVAFFIGTAYGSTETA

SEQ ID NO: 88246 - protein, 21 aa, Mycobacterium avium
GADAAYVCRGRVCDLPVTRTP

SEQ ID NO: 88247 - protein, 19 aa, Mycobacterium avium
GADAFVELSAHPSLLYPLS

SEQ ID NO: 88248 - protein, 24 aa, Mycobacterium avium
GADEVFAGYHWYPPMGDPAAATLD

SEQ ID NO: 88249 - protein, 20 aa, Mycobacterium avium
GADGFLAWQAARCVANWHGP

SEQ ID NO: 88250 - protein, 30 aa, Mycobacterium avium
GADPSVSGLPQWYGDQGMFLTTHYFGTKIM

SEQ ID NO: 88251 - protein, 33 aa, Mycobacterium avium
GADRRIGAEFLRPGPGWGGSCLPKDTAALLDIA

SEQ ID NO: 88252 - protein, 32 aa, Mycobacterium avium
GADYRWMNLVARLPRKGIPVYAKRLVQGVGGR

SEQ ID NO: 88253 - protein, 18 aa, Mycobacterium avium
GAEARALIRSRLVPPAQP

SEQ ID NO: 88254 - protein, 25 aa, Mycobacterium avium
GAEIRARLASFTVIAQRGNDFGARL

SEQ ID NO: 88255 - protein, 18 aa, Mycobacterium avium
GAELAAWSLVHGFATLWL

SEQ ID NO: 88256 - protein, 24 aa, Mycobacterium avium
GAEVARRLNAKGARLVLTDLNDAE

SEQ ID NO: 88257 - protein, 19 aa, Mycobacterium avium
GAFAPMALAVARRLADQGI

SEQ ID NO: 88258 - protein, 20 aa, Mycobacterium avium
GAGAGCLLLVYPNVIAVERQ

SEQ ID NO: 88259 - protein, 18 aa, Mycobacterium avium
GAGDGHWLLSGASEVTAG

SEQ ID NO: 88260 - protein, 19 aa, Mycobacterium avium
GAGGAGMRAAVEAGPRVRT

SEQ ID NO: 88261 - protein, 17 aa, Mycobacterium avium
GAGLPWGTPSTIDYVEG

SEQ ID NO: 88262 - protein, 26 aa, Mycobacterium avium
GAGLSRPTFYFYFKSKEAVVLSLLEP

SEQ ID NO: 88263 - protein, 17 aa, Mycobacterium avium
GAGPAPDSDLNWCNPSG

SEQ ID NO: 88264 - protein, 24 aa, Mycobacterium avium
GAGPHLHAEWTWAPSVLGAEQITR

SEQ ID NO: 88265 - protein, 25 aa, Mycobacterium avium
GAGPLRPGPDDVRRAVREGREGNLV

SEQ ID NO: 88266 - protein, 30 aa, Mycobacterium avium
GAGSGSISVEWCLGGNGCRATAFERDAQRR

SEQ ID NO: 88267 - protein, 18 aa, Mycobacterium avium
GAHFPGVNNTTVWSDPSA

SEQ ID NO: 88268 - protein, 17 aa, Mycobacterium avium
GAIARQRTVVVGVTNPL

SEQ ID NO: 88269 - protein, 23 aa, Mycobacterium avium
GAIGYTGAGTVEFLADDDGEFYF

SEQ ID NO: 88270 - protein, 19 aa, Mycobacterium avium
GAKLQWILDNVDGVREAAE

SEQ ID NO: 88271 - protein, 19 aa, Mycobacterium avium
GALADGWLGSFLTPAEARA

SEQ ID NO: 88272 - protein, 18 aa, Mycobacterium avium
GALAEQWAGLERLLTSGE

SEQ ID NO: 88273 - protein, 20 aa, Mycobacterium avium
GALAFKTAYARWAEPDESGD

SEQ ID NO: 88274 - protein, 25 aa, Mycobacterium avium
GALFRTAEGWQLRGPLRGDRELHDA

SEQ ID NO: 88275 - protein, 18 aa, Mycobacterium avium
GALPGLLPGGRPVADDDA

SEQ ID NO: 88276 - protein, 21 aa, Mycobacterium avium
GALRAGIRQVVILAAGLDSRA

SEQ ID NO: 88277 - protein, 17 aa, Mycobacterium avium
GALRLAGRAEAVAPVRR

SEQ ID NO: 88278 - protein, 24 aa, Mycobacterium avium
GAPSLLPGGRWAAVLAGAVMLAQC

SEQ ID NO: 88279 - protein, 20 aa, Mycobacterium avium
GAPSPAWLHRCEQANRHAVA

SEQ ID NO: 88280 - protein, 26 aa, Mycobacterium avium
GAPVEWHKMGAGWSWTRKAGSDDDHA

SEQ ID NO: 88281 - protein, 24 aa, Mycobacterium avium
GAPVTRAAFFVLDDWLRPVPPGVV

SEQ ID NO: 88282 - protein, 18 aa, Mycobacterium avium
GAQARRLCPHAVVVPPRM

SEQ ID NO: 88283 - protein, 24 aa, Mycobacterium avium
GAQLKRLKVGATRRFSATDRDSLV

SEQ ID NO: 88284 - protein, 21 aa, Mycobacterium avium
GAQRALHRVISLLAAGRAVLT

SEQ ID NO: 88285 - protein, 35 aa, Mycobacterium avium
GARDIAAEIGRPVMVKAQVKTGGRGKAGGVKYAAT

SEQ ID NO: 88286 - protein, 23 aa, Mycobacterium avium
GARFSGGVFACAAFAEYELTGAE

SEQ ID NO: 88287 - protein, 19 aa, Mycobacterium avium
GARGRRLDVRQARTVVHQT

SEQ ID NO: 88288 - protein, 17 aa, Mycobacterium avium
GARGYAHIGVIEALQAR

SEQ ID NO: 88289 - protein, 20 aa, Mycobacterium avium
GARIAFFFTRRKLAQMTGLE

SEQ ID NO: 88290 - protein, 29 aa, Mycobacterium avium
GARPRIVTVGRLVPRKGFDTIVRALPRIP

SEQ ID NO: 88291 - protein, 17 aa, Mycobacterium avium
GASAIVFRDTDHAAELA

SEQ ID NO: 88292 - protein, 26 aa, Mycobacterium avium
GASGFVIKDIKGMELARAIKDVGAGK

SEQ ID NO: 88293 - protein, 36 aa, Mycobacterium avium
GATACLRKTDWLFPQYRELGAFLVRGIPPGNVGAVW

SEQ ID NO: 88294 - protein, 23 aa, Mycobacterium avium
GATGFLGRYLVLEWLEQLEQVDG

SEQ ID NO: 88295 - protein, 23 aa, Mycobacterium avium
GATPAQVALAWLLAKGPDIVPIP

SEQ ID NO: 88296 - protein, 19 aa, Mycobacterium avium
GATVLRGVWGFHGDHPPHG

SEQ ID NO: 88297 - protein, 19 aa, Mycobacterium avium
GAVISELTSADWFGPSSMS

SEQ ID NO: 88298 - protein, 17 aa, Mycobacterium avium
GAVKRAATIAGLAGETD

SEQ ID NO: 88299 - protein, 17 aa, Mycobacterium avium
GAVLPVYDPLFDSKKLR

SEQ ID NO: 88300 - protein, 22 aa, Mycobacterium avium
GAVPKKLCHPGLEEIPVEVALD

SEQ ID NO: 88301 - protein, 28 aa, Mycobacterium avium
GAVTEPLLFEWTDRDTLLYALGVGAGVD

SEQ ID NO: 88302 - protein, 28 aa, Mycobacterium avium
GAWTVIGDLRIKLGPVRLGAASDLPAPP

SEQ ID NO: 88303 - protein, 17 aa, Mycobacterium avium
GCADPLYRRAVRVSMGH

SEQ ID NO: 88304 - protein, 32 aa, Mycobacterium avium
GCANPTRMLLPRSRYDEGVAILKGIYENVTCG

SEQ ID NO: 88305 - protein, 17 aa, Mycobacterium avium
GCASSAWTLGFYALHNW

SEQ ID NO: 88306 - protein, 21 aa, Mycobacterium avium
GCGFAELSLALAARGYTVVGI

SEQ ID NO: 88307 - protein, 19 aa, Mycobacterium avium
GCTESVFTIKVPDDEWEDK

SEQ ID NO: 88308 - protein, 18 aa, Mycobacterium avium
GCVLSATIDRYAQGSLAP

SEQ ID NO: 88309 - protein, 17 aa, Mycobacterium avium
GDAHIDFARSPRPTIGV

SEQ ID NO: 88310 - protein, 17 aa, Mycobacterium avium
GDAKFLSVLSVRQLATE

SEQ ID NO: 88311 - protein, 18 aa, Mycobacterium avium
GDARLRIKRRRTERERLQ

SEQ ID NO: 88312 - protein, 17 aa, Mycobacterium avium
GDEAIELTSSTEERVKA

SEQ ID NO: 88313 - protein, 17 aa, Mycobacterium avium
GDEKGVIGNSLQLMSNP

SEQ ID NO: 88314 - protein, 27 aa, Mycobacterium avium
GDEPFDAVVCSLVLCSVRDPQNVLRRL

SEQ ID NO: 88315 - protein, 17 aa, Mycobacterium avium
GDEQALIAIPGIGARKL

SEQ ID NO: 88316 - protein, 32 aa, Mycobacterium avium
GDFPGEPWAVPKFYWSVFATRPFEAAVQALTP

SEQ ID NO: 88317 - protein, 24 aa, Mycobacterium avium
GDFVKIDFGALVGGYHSDMTRTFV

SEQ ID NO: 88318 - protein, 21 aa, Mycobacterium avium
GDGAFGFSGMEWDTLVRHRVP

SEQ ID NO: 88319 - protein, 18 aa, Mycobacterium avium
GDGRWVVSIRCAQLSADR

SEQ ID NO: 88320 - protein, 25 aa, Mycobacterium avium
GDGTQRWPAVHRDDAAALFRLALEQ

SEQ ID NO: 88321 - protein, 34 aa, Mycobacterium avium
GDGVRWAMRHLPFYGRWYRFLVLWPGSDKGLDAA

SEQ ID NO: 88322 - protein, 38 aa, Mycobacterium avium
GDHVGGLSANGCWGTFLTCDARLAVTLPPGLADDQAAA

SEQ ID NO: 88323 - protein, 24 aa, Mycobacterium avium
GDILTRLTAPVIRGLGVGIVPAAT

SEQ ID NO: 88324 - protein, 26 aa, Mycobacterium avium
GDLAPRLGGPIAPCYHAAVDTSTGVF

SEQ ID NO: 88325 - protein, 18 aa, Mycobacterium avium
GDLARKMTFRALYRLERR

SEQ ID NO: 88326 - protein, 18 aa, Mycobacterium avium
GDLLCFVHGGAGLLHTEF

SEQ ID NO: 88327 - protein, 25 aa, Mycobacterium avium
GDLVCWRPDGQLDYRGRADEQVKVR

SEQ ID NO: 88328 - protein, 24 aa, Mycobacterium avium
GDLVCWRSDGQLDYRGRADEQVKV

SEQ ID NO: 88329 - protein, 17 aa, Mycobacterium avium
GDLVRWRADGQLDYLGR

SEQ ID NO: 88330 - protein, 19 aa, Mycobacterium avium
GDLVSRCELFDEADLPDAL

SEQ ID NO: 88331 - protein, 24 aa, Mycobacterium avium
GDMAARIADHLGYRVIAVDLVPER

SEQ ID NO: 88332 - protein, 19 aa, Mycobacterium avium
GDPAVPWDRAHAVPAPAWA

SEQ ID NO: 88333 - protein, 22 aa, Mycobacterium avium
GDPEGYASVFTMDADYVTFLGS

SEQ ID NO: 88334 - protein, 27 aa, Mycobacterium avium
GDPGESRFYLSLGDELMRRFNGAALEA

SEQ ID NO: 88335 - protein, 27 aa, Mycobacterium avium
GDPHYAYKLDWLAALRDSAAGWLREDP

SEQ ID NO: 88336 - protein, 22 aa, Mycobacterium avium
GDPLRPDVMLGPVITEAAADRI

SEQ ID NO: 88337 - protein, 17 aa, Mycobacterium avium
GDPNAWQTGLAPAEVSA

SEQ ID NO: 88338 - protein, 17 aa, Mycobacterium avium
GDQVDWAGLPVNLDFAF

SEQ ID NO: 88339 - protein, 23 aa, Mycobacterium avium
GDRNVVSVGFNWTMGEHVVPPKP

SEQ ID NO: 88340 - protein, 26 aa, Mycobacterium avium
GDRVAIWSPNTWHWVVACLAIHHAGA

SEQ ID NO: 88341 - protein, 28 aa, Mycobacterium avium
GDRWIINGAKTWSTWAFAADYGLCLART

SEQ ID NO: 88342 - protein, 20 aa, Mycobacterium avium
GDSIPGPVIRAAIGDEVAVT

SEQ ID NO: 88343 - protein, 26 aa, Mycobacterium avium
GDTALRRHFNWVRSWYDFAVPDIGRS

SEQ ID NO: 88344 - protein, 17 aa, Mycobacterium avium
GDTFAPVRALLGGGGTR

SEQ ID NO: 88345 - protein, 20 aa, Mycobacterium avium
GDTPLPVRTPLPVQLPEPMA

SEQ ID NO: 88346 - protein, 19 aa, Mycobacterium avium
GDTQWSWAQYLRDAAARAA

SEQ ID NO: 88347 - protein, 21 aa, Mycobacterium avium
GDVELAWRLDAAGHYGPPRRW

SEQ ID NO: 88348 - protein, 18 aa, Mycobacterium avium
GDVFKMTLTNGAVRENHV

SEQ ID NO: 88349 - protein, 18 aa, Mycobacterium avium
GDVIPEVLGPVVDLRDGT

SEQ ID NO: 88350 - protein, 18 aa, Mycobacterium avium
GDVTPQWLSAALSGRGAP

SEQ ID NO: 88351 - protein, 17 aa, Mycobacterium avium
GDWLGRHGWDVTVTPAP

SEQ ID NO: 88352 - protein, 29 aa, Mycobacterium avium
GDWLGTPYLRFERYGPIALCTIDRPQARN

SEQ ID NO: 88353 - protein, 20 aa, Mycobacterium avium
GDYGAALLLDTWALLGRQDL

SEQ ID NO: 88354 - protein, 17 aa, Mycobacterium avium
GEAMLPGATGLRGPLSC

SEQ ID NO: 88355 - protein, 21 aa, Mycobacterium avium
GEANLGLGQDVWQRLADTVDV

SEQ ID NO: 88356 - protein, 23 aa, Mycobacterium avium
GEAVAALLRDGRRGRTLGEAGRE

SEQ ID NO: 88357 - protein, 23 aa, Mycobacterium avium
GEDLSWLWDVRFEHFNDAFQTTP

SEQ ID NO: 88358 - protein, 23 aa, Mycobacterium avium
GEHRKSLTFALRFRAPDRTLTED

SEQ ID NO: 88359 - protein, 23 aa, Mycobacterium avium
GEHYRSVAVPVTFDAEGHPHFGA

SEQ ID NO: 88360 - protein, 19 aa, Mycobacterium avium
GEIFSCFSMTEPQGGADPR

SEQ ID NO: 88361 - protein, 19 aa, Mycobacterium avium
GELDKRWTIGPKVHGGAML

SEQ ID NO: 88362 - protein, 28 aa, Mycobacterium avium
GELFDYLRPRAVIYHRGLGPKFADVLGR

SEQ ID NO: 88363 - protein, 25 aa, Mycobacterium avium
GELLVRGGVVFSGYWRNEQATADAF

SEQ ID NO: 88364 - protein, 17 aa, Mycobacterium avium
GELNRFVFAMPEQLGRV

SEQ ID NO: 88365 - protein, 17 aa, Mycobacterium avium
GELPAGLNPGRIEQWGI

SEQ ID NO: 88366 - protein, 18 aa, Mycobacterium avium
GELWRLSPDSLSLSGAAA

SEQ ID NO: 88367 - protein, 24 aa, Mycobacterium avium
GEMTYLQWLQRYVELAIGDGDSTA

SEQ ID NO: 88368 - protein, 18 aa, Mycobacterium avium
GENVFFCATGVTNGDLLK

SEQ ID NO: 88369 - protein, 20 aa, Mycobacterium avium
GEPAMQWIAARFRGEPTAPN

SEQ ID NO: 88370 - protein, 20 aa, Mycobacterium avium
GEPFATHVLNVLHLLLPAGE

SEQ ID NO: 88371 - protein, 17 aa, Mycobacterium avium
GEPITTWAPRSTGAIAY

SEQ ID NO: 88372 - protein, 25 aa, Mycobacterium avium
GEPQCVATGLGVPDSVKFDARGHIV

SEQ ID NO: 88373 - protein, 20 aa, Mycobacterium avium
GERALLAGDFVRGFVGLDGH

SEQ ID NO: 88374 - protein, 21 aa, Mycobacterium avium
GERKRPARAVLVFTDEDGRAH

SEQ ID NO: 88375 - protein, 19 aa, Mycobacterium avium
GERPYKVVFKDATDGGYLV

SEQ ID NO: 88376 - protein, 22 aa, Mycobacterium avium
GERVQAGAGLRIHRRPGEPVAA

SEQ ID NO: 88377 - protein, 24 aa, Mycobacterium avium
GEVADFLAEYGWRLVEQAGPDELM

SEQ ID NO: 88378 - protein, 17 aa, Mycobacterium avium
GEVGLRRARAMAMVMLA

SEQ ID NO: 88379 - protein, 17 aa, Mycobacterium avium
GEVLACTDSHTCAAGAY

SEQ ID NO: 88380 - protein, 19 aa, Mycobacterium avium
GEVPLRRALIFPVCDLALH

SEQ ID NO: 88381 - protein, 25 aa, Mycobacterium avium
GEVPRRWRSPAPLWGDVSFESVAPA

SEQ ID NO: 88382 - protein, 19 aa, Mycobacterium avium
GEVQTRLRLGQDREALESA

SEQ ID NO: 88383 - protein, 17 aa, Mycobacterium avium
GEVVILPTVAGYSSSRL

SEQ ID NO: 88384 - protein, 23 aa, Mycobacterium avium
GEVVKAPEGFMLVCSYNPAYRSS

SEQ ID NO: 88385 - protein, 36 aa, Mycobacterium avium
GEVYFELRLSDAWVWDMYRPARFVKQVRVVTFKDVN

SEQ ID NO: 88386 - protein, 20 aa, Mycobacterium avium
GFAGTQWQLGLLVKIDGKVH

SEQ ID NO: 88387 - protein, 17 aa, Mycobacterium avium
GFARSASDAVIFMDHGK

SEQ ID NO: 88388 - protein, 19 aa, Mycobacterium avium
GFDPLALVTGGSRSASLRD

SEQ ID NO: 88389 - protein, 19 aa, Mycobacterium avium
GFEGGWALEQIIGPAPLLA

SEQ ID NO: 88390 - protein, 19 aa, Mycobacterium avium
GFGDKGYWAITKHKDVKEI

SEQ ID NO: 88391 - protein, 21 aa, Mycobacterium avium
GFGSLRLSDYPLIPARVDTWA

SEQ ID NO: 88392 - protein, 20 aa, Mycobacterium avium
GFLPTGGRVLGVFEPSGDGV

SEQ ID NO: 88393 - protein, 19 aa, Mycobacterium avium
GFNFRLLFRNPLWANTDRR

SEQ ID NO: 88394 - protein, 26 aa, Mycobacterium avium
GFPDYRPELPGGRPRGGRSLSAVPFD

SEQ ID NO: 88395 - protein, 20 aa, Mycobacterium avium
GFRYFDNRDLLGFVDGTENP

SEQ ID NO: 88396 - protein, 24 aa, Mycobacterium avium
GFTEPRPAGAVTRAHLNRLISKIQ

SEQ ID NO: 88397 - protein, 24 aa, Mycobacterium avium
GFVAAEFAHIFSALGVHVTVVIRS

SEQ ID NO: 88398 - protein, 18 aa, Mycobacterium avium
GFYAKWLPQLVFGEGQRP

SEQ ID NO: 88399 - protein, 17 aa, Mycobacterium avium
GFYSHPWAWNEIGFGGP

SEQ ID NO: 88400 - protein, 18 aa, Mycobacterium avium
GGAAEFLQAITIRVPADA

SEQ ID NO: 88401 - protein, 18 aa, Mycobacterium avium
GGAAFPLGVKLRTVRDNG

SEQ ID NO: 88402 - protein, 18 aa, Mycobacterium avium
GGAEMSRSEFYREGRVPL

SEQ ID NO: 88403 - protein, 19 aa, Mycobacterium avium
GGAEVQWWFDLPWSTGFVR

SEQ ID NO: 88404 - protein, 23 aa, Mycobacterium avium
GGALYDYACHAIDLMNFIAGVPH

SEQ ID NO: 88405 - protein, 20 aa, Mycobacterium avium
GGAPRRGRKSKRQKRQEYDS

SEQ ID NO: 88406 - protein, 18 aa, Mycobacterium avium
GGAWLREGPLIRLASAKG

SEQ ID NO: 88407 - protein, 24 aa, Mycobacterium avium
GGCEAYPGVFAPFGGYPDGCVVSS

SEQ ID NO: 88408 - protein, 20 aa, Mycobacterium avium
GGDATRLLYTLGWHEVPPQP

SEQ ID NO: 88409 - protein, 21 aa, Mycobacterium avium
GGDGEAIWPGILGFDDTVLPQ

SEQ ID NO: 88410 - protein, 20 aa, Mycobacterium avium
GGELAVALHADFPPERITFH

SEQ ID NO: 88411 - protein, 21 aa, Mycobacterium avium
GGESMTHLAFQLSRISDSIKR

SEQ ID NO: 88412 - protein, 18 aa, Mycobacterium avium
GGEVVRLTANVRYTSTGG

SEQ ID NO: 88413 - protein, 21 aa, Mycobacterium avium
GGFDHDLAWRKELLPEVDQDW

SEQ ID NO: 88414 - protein, 21 aa, Mycobacterium avium
GGFVPRLGDGRALLLGELVDD

SEQ ID NO: 88415 - protein, 19 aa, Mycobacterium avium
GGGDIRSALRGDLHVHSNW

SEQ ID NO: 88416 - protein, 18 aa, Mycobacterium avium
GGGGVWFPCNPVLIRAGT

SEQ ID NO: 88417 - protein, 19 aa, Mycobacterium avium
GGGIPWRKSDQFFNAPANG

SEQ ID NO: 88418 - protein, 23 aa, Mycobacterium avium
GGHAGWRALRRAVECAQRKSELR

SEQ ID NO: 88419 - protein, 20 aa, Mycobacterium avium
GGHHSWEDLDDLLLATYSEL

SEQ ID NO: 88420 - protein, 18 aa, Mycobacterium avium
GGIGWIPFYLDRSDRHYS

SEQ ID NO: 88421 - protein, 25 aa, Mycobacterium avium
GGISRKADKWLPLLENRTPVVAAAL

SEQ ID NO: 88422 - protein, 17 aa, Mycobacterium avium
GGLELAIWCDLRVVEQD

SEQ ID NO: 88423 - protein, 22 aa, Mycobacterium avium
GGLGGLGLFLAEKMASPGSRAG

SEQ ID NO: 88424 - protein, 17 aa, Mycobacterium avium
GGLGGLGLFLAGEMASR

SEQ ID NO: 88425 - protein, 24 aa, Mycobacterium avium
GGLRRRVRLASVLRRCTVLDAHLR

SEQ ID NO: 88426 - protein, 17 aa, Mycobacterium avium
GGLVKVVVKGSGEVVAV

SEQ ID NO: 88427 - protein, 25 aa, Mycobacterium avium
GGMFRRVDLASALVVPPKVLFLDEP

SEQ ID NO: 88428 - protein, 24 aa, Mycobacterium avium
GGMRQRVLIAIAFALNPGLLIADE

SEQ ID NO: 88429 - protein, 18 aa, Mycobacterium avium
GGNPFFLIQALHHVDESG

SEQ ID NO: 88430 - protein, 30 aa, Mycobacterium avium
GGNPYQLSWWVNRFLEIFQTIGRDLEEFPE

SEQ ID NO: 88431 - protein, 22 aa, Mycobacterium avium
GGPAYPRGFMRLGGATGPAAAR

SEQ ID NO: 88432 - protein, 20 aa, Mycobacterium avium
GGPEPAPAVIYCHAGGFALG

SEQ ID NO: 88433 - protein, 18 aa, Mycobacterium avium
GGPERSCVIESAREHGGR

SEQ ID NO: 88434 - protein, 22 aa, Mycobacterium avium
GGPKAPILEYARMRARISEMER

SEQ ID NO: 88435 - protein, 21 aa, Mycobacterium avium
GGPPVRFQLLWYPSTMWDASL

SEQ ID NO: 88436 - protein, 30 aa, Mycobacterium avium
GGPVGNGTCYWKRMGNPDGAVIDNAMTKKP

SEQ ID NO: 88437 - protein, 25 aa, Mycobacterium avium
GGQAISLRVCIVIRVGAHGMIERID

SEQ ID NO: 88438 - protein, 17 aa, Mycobacterium avium
GGQHLHSSFAPLFGQFS

SEQ ID NO: 88439 - protein, 25 aa, Mycobacterium avium
GGRLGPARTAAICAVSPALWLSSGA

SEQ ID NO: 88440 - protein, 18 aa, Mycobacterium avium
GGRLRLADFDHIELSNLN

SEQ ID NO: 88441 - protein, 23 aa, Mycobacterium avium
GGRLSDAAIDWVIDAYTRGLVAE

SEQ ID NO: 88442 - protein, 22 aa, Mycobacterium avium
GGRYRFNHAIVRQSLLAELSSV

SEQ ID NO: 88443 - protein, 19 aa, Mycobacterium avium
GGSCQRTWEHAVPKTTAPV

SEQ ID NO: 88444 - protein, 18 aa, Mycobacterium avium
GGSKDTWVLASRASSGDH

SEQ ID NO: 88445 - protein, 24 aa, Mycobacterium avium
GGSLYGIPMPPGLISHAPQGVHHG

SEQ ID NO: 88446 - protein, 20 aa, Mycobacterium avium
GGSTARSGGGVWIPNNEVLK

SEQ ID NO: 88447 - protein, 18 aa, Mycobacterium avium
GGTAAAVLVCLPGGTYSR

SEQ ID NO: 88448 - protein, 19 aa, Mycobacterium avium
GGTELRWRSTTAANDGREV

SEQ ID NO: 88449 - protein, 26 aa, Mycobacterium avium
GGTFRLIDKVFTRWNVEYTPVPLHQL

SEQ ID NO: 88450 - protein, 17 aa, Mycobacterium avium
GGTRRCVGAAFANMEMD

SEQ ID NO: 88451 - protein, 27 aa, Mycobacterium avium
GGTSFARWSSLLAEHALTPAVVEQADA

SEQ ID NO: 88452 - protein, 18 aa, Mycobacterium avium
GGTWYWNRYPGARCDVES

SEQ ID NO: 88453 - protein, 25 aa, Mycobacterium avium
GGYLIAADVVEFWQGRENRLHNRIR

SEQ ID NO: 88454 - protein, 19 aa, Mycobacterium avium
GGYTYGGRIAALADAAREN

SEQ ID NO: 88455 - protein, 20 aa, Mycobacterium avium
GHAPNAWAVLGAVAQATERV

SEQ ID NO: 88456 - protein, 17 aa, Mycobacterium avium
GHGEVKLGLLPLLDAVL

SEQ ID NO: 88457 - protein, 24 aa, Mycobacterium avium
GHKGARLTTQVSLAGRYLVYVPGA

SEQ ID NO: 88458 - protein, 18 aa, Mycobacterium avium
GHPRRSVIEAAWRAIGPG

SEQ ID NO: 88459 - protein, 26 aa, Mycobacterium avium
GHRNGGVVLLMWAGILAYLDRYGYDY

SEQ ID NO: 88460 - protein, 21 aa, Mycobacterium avium
GHRYSGAFAYEGDDWYERSPI

SEQ ID NO: 88461 - protein, 20 aa, Mycobacterium avium
GHSDLRAAVLGLDRATDATV

SEQ ID NO: 88462 - protein, 21 aa, Mycobacterium avium
GHSHWYIERFRAMARAGDDLA

SEQ ID NO: 88463 - protein, 20 aa, Mycobacterium avium
GIAAARRGANVVLLAKTDTP

SEQ ID NO: 88464 - protein, 17 aa, Mycobacterium avium
GIESLWERSEELLNDPP

SEQ ID NO: 88465 - protein, 19 aa, Mycobacterium avium
GIGPSRTRLIGGRAQEVLT

SEQ ID NO: 88466 - protein, 19 aa, Mycobacterium avium
GIIGYRALLRAQLPPGGRL

SEQ ID NO: 88467 - protein, 18 aa, Mycobacterium avium
GILADWGADVIKIEPPTG

SEQ ID NO: 88468 - protein, 23 aa, Mycobacterium avium
GILAPLTRQGCIPLAIHPAMTFT

SEQ ID NO: 88469 - protein, 20 aa, Mycobacterium avium
GINDRCRALRPHAQTLVDGF

SEQ ID NO: 88470 - protein, 25 aa, Mycobacterium avium
GIPGPRWMPRPVWKIVSAPLNAYAR

SEQ ID NO: 88471 - protein, 25 aa, Mycobacterium avium
GIPMTARAAWAWFRHLHTLADRTLA

SEQ ID NO: 88472 - protein, 18 aa, Mycobacterium avium
GIQFKDLTPLFADATAMT

SEQ ID NO: 88473 - protein, 19 aa, Mycobacterium avium
GIRCQLRSLLVEDVRQRLR

SEQ ID NO: 88474 - protein, 18 aa, Mycobacterium avium
GIRVDGNDVLACYAVTAE

SEQ ID NO: 88475 - protein, 19 aa, Mycobacterium avium
GISDFLWVRINDVPEVLGA

SEQ ID NO: 88476 - protein, 25 aa, Mycobacterium avium
GISDSAAFELLKWLSQEGNVKLRPL

SEQ ID NO: 88477 - protein, 19 aa, Mycobacterium avium
GITARGAWEAVKRHFREMG

SEQ ID NO: 88478 - protein, 17 aa, Mycobacterium avium
GITRLLTGLGYSGYFEL

SEQ ID NO: 88479 - protein, 17 aa, Mycobacterium avium
GIYLGHGYTVEKIRVFD

SEQ ID NO: 88480 - protein, 21 aa, Mycobacterium avium
GKAALRQYWTAALASIPDLRF

SEQ ID NO: 88481 - protein, 24 aa, Mycobacterium avium
GKAKEAVGAVAGRDDLTREGQAQQ

SEQ ID NO: 88482 - protein, 17 aa, Mycobacterium avium
GKALALYHTKRLASPAQ

SEQ ID NO: 88483 - protein, 18 aa, Mycobacterium avium
GKEECFLELLAVDIEKLG

SEQ ID NO: 88484 - protein, 20 aa, Mycobacterium avium
GKGRASGALHSVKPISLVVG

SEQ ID NO: 88485 - protein, 22 aa, Mycobacterium avium
GKIPAGGGWRMLGRTVGNRNAQ

SEQ ID NO: 88486 - protein, 19 aa, Mycobacterium avium
GKNALGRALLSTAAGSTPD

SEQ ID NO: 88487 - protein, 21 aa, Mycobacterium avium
GKNLYLRNEVFAEWIEKVDAL

SEQ ID NO: 88488 - protein, 18 aa, Mycobacterium avium
GKPGVAILLTYGPDRDWL

SEQ ID NO: 88489 - protein, 25 aa, Mycobacterium avium
GKPRRWLRRVPPRYGEHTAEVLTEL

SEQ ID NO: 88490 - protein, 21 aa, Mycobacterium avium
GKPSLVFPRELPRSGAEFLGI

SEQ ID NO: 88491 - protein, 27 aa, Mycobacterium avium
GKPVAAICHGPWTLVEAGVAAGRTLTS

SEQ ID NO: 88492 - protein, 17 aa, Mycobacterium avium
GKRLMQTAGVDRLSALY

SEQ ID NO: 88493 - protein, 24 aa, Mycobacterium avium
GKSTLLHRLTGMWPDRLAEEQRRG

SEQ ID NO: 88494 - protein, 23 aa, Mycobacterium avium
GKSTVAVPLIWRKRLLRKAIDFT

SEQ ID NO: 88495 - protein, 31 aa, Mycobacterium avium
GKTFVSMQIVWKLWNSQWVHGRHPRILYLAD

SEQ ID NO: 88496 - protein, 21 aa, Mycobacterium avium
GKTRFVEAMAYDLGRPLITVA

SEQ ID NO: 88497 - protein, 24 aa, Mycobacterium avium
GKWYRASDAFANPRYRDRIPLMIG

SEQ ID NO: 88498 - protein, 17 aa, Mycobacterium avium
GLACDFGERVDLGGASS

SEQ ID NO: 88499 - protein, 18 aa, Mycobacterium avium
GLAEFAMMLPMGGSDDPN

SEQ ID NO: 88500 - protein, 19 aa, Mycobacterium avium
GLAEIMRLGIALGAKGATL

SEQ ID NO: 88501 - protein, 23 aa, Mycobacterium avium
GLAGDLRRVSGMARRLSEAARQG

SEQ ID NO: 88502 - protein, 24 aa, Mycobacterium avium
GLCTYGMTCKAIVDALLDGDAGAV

SEQ ID NO: 88503 - protein, 29 aa, Mycobacterium avium
GLDARAYRLPWPAGTVVYEVDMPDVIEFK

SEQ ID NO: 88504 - protein, 28 aa, Mycobacterium avium
GLDARAYRLSWPAGTVVFEVDQPEVISF

SEQ ID NO: 88505 - protein, 24 aa, Mycobacterium avium
GLDFEAYAGLAARISGLPVAITRA

SEQ ID NO: 88506 - protein, 31 aa, Mycobacterium avium
GLDFLRSCSIKHRMASVIFSLEMSKSEIVMR

SEQ ID NO: 88507 - protein, 25 aa, Mycobacterium avium
GLDGLSLPLLRSWLSAAAAGGVART

SEQ ID NO: 88508 - protein, 19 aa, Mycobacterium avium
GLDSTALVVAGEACPAEVV

SEQ ID NO: 88509 - protein, 19 aa, Mycobacterium avium
GLDSTALVVAGEACPVEIV

SEQ ID NO: 88510 - protein, 27 aa, Mycobacterium avium
GLEEVLNRWPEWEIDMDNARRSRTSTV

SEQ ID NO: 88511 - protein, 20 aa, Mycobacterium avium
GLEIALACHHRIAADVKGLV

SEQ ID NO: 88512 - protein, 32 aa, Mycobacterium avium; identical to SEQ ID NO: 15933

SEQ ID NO: 88513 - protein, 19 aa, Mycobacterium avium
GLESTALVVAGEACPTDVV

SEQ ID NO: 88514 - protein, 19 aa, Mycobacterium avium
GLETMCVGGGQGMAMVIER

SEQ ID NO: 88515 - protein, 28 aa, Mycobacterium avium
GLFDPRLKRPIPFLPNMIGLITGRASAA

SEQ ID NO: 88516 - protein, 23 aa, Mycobacterium avium
GLGFSMKWNMGWMHDTLDYISRD

SEQ ID NO: 88517 - protein, 23 aa, Mycobacterium avium
GLGNTGGHLGRWYMAHVEGRVAR

SEQ ID NO: 88518 - protein, 17 aa, Mycobacterium avium
GLGPKFADVLGRGDVDL

SEQ ID NO: 88519 - protein, 22 aa, Mycobacterium avium
GLGVPAGAPLAVRMRPASLDEV

SEQ ID NO: 88520 - protein, 26 aa, Mycobacterium avium
GLIAEYGITWILPRLAGWGAAMDLLL

SEQ ID NO: 88521 - protein, 19 aa, Mycobacterium avium
GLIERLRLDGASDRACSWL

SEQ ID NO: 88522 - protein, 25 aa, Mycobacterium avium
GLKYPARLIDEYAWETDLGDKVISL

SEQ ID NO: 88523 - protein, 24 aa, Mycobacterium avium
GLLDGRRATTHWHDVRLFARAFPE

SEQ ID NO: 88524 - protein, 25 aa, Mycobacterium avium
GLLEPARAAFEWSRRTQRPDGSWPI

SEQ ID NO: 88525 - protein, 18 aa, Mycobacterium avium
GLLKTGGHTAMLRGLPAR

SEQ ID NO: 88526 - protein, 17 aa, Mycobacterium avium
GLLPEVQRLLPDVHPQA

SEQ ID NO: 88527 - protein, 17 aa, Mycobacterium avium
GLLRAKFTHPLRFDVPI

SEQ ID NO: 88528 - protein, 24 aa, Mycobacterium avium
GLLRDAYCRHIGVEYTHILDPEQQ

SEQ ID NO: 88529 - protein, 31 aa, Mycobacterium avium
GLLRGMPVGALGRRGAAAGYVNKYGFRYSVL

SEQ ID NO: 88530 - protein, 18 aa, Mycobacterium avium
GLLRPDRGLVRVGDRVLT

SEQ ID NO: 88531 - protein, 24 aa, Mycobacterium avium
GLLTLEGTNTWVLRGPGSDELVIV

SEQ ID NO: 88532 - protein, 32 aa, Mycobacterium avium
GLLVNFPLSQWLKFAPPIGYGALPKDALGAGL

SEQ ID NO: 88533 - protein, 19 aa, Mycobacterium avium
GLMLGEYWDLSALAADCAA

SEQ ID NO: 88534 - protein, 27 aa, Mycobacterium avium
GLNRRRAKARADELLEQFNLVDAADRR

SEQ ID NO: 88535 - protein, 30 aa, Mycobacterium avium
GLPDYRGLIGPRCRAVWLLTVRAEHVDGDD

SEQ ID NO: 88536 - protein, 27 aa, Mycobacterium avium
GLPRTAFKPSYGIAEATLFVATIAPRA

SEQ ID NO: 88537 - protein, 20 aa, Mycobacterium avium
GLPYFSTGMANTFTQIAKSV

SEQ ID NO: 88538 - protein, 18 aa, Mycobacterium avium
GLQIEAPIPLSAKLELLA

SEQ ID NO: 88539 - protein, 17 aa, Mycobacterium avium
GLQRFLPAMARHLLSET

SEQ ID NO: 88540 - protein, 18 aa, Mycobacterium avium
GLRDQRCRTPYCDAPIRH

SEQ ID NO: 88541 - protein, 23 aa, Mycobacterium avium
GLRGAPMVHPYVASKWGVRGLAK

SEQ ID NO: 88542 - protein, 18 aa, Mycobacterium avium
GLRPLRVAVDAGNGMAGL

SEQ ID NO: 88543 - protein, 25 aa, Mycobacterium avium
GLRTRLFAAPGWVVSPGVVKALPGN

SEQ ID NO: 88544 - protein, 20 aa, Mycobacterium avium
GLSALPDDYAGVLVVTSGDT

SEQ ID NO: 88545 - protein, 17 aa, Mycobacterium avium
GLSHPLAQCHIEVELAK

SEQ ID NO: 88546 - protein, 27 aa, Mycobacterium avium
GLSNYVHNWLRLGFTEADVRPPGSDRL

SEQ ID NO: 88547 - protein, 26 aa, Mycobacterium avium
GLTAIRLGAVAPDLVKELVLIDVTPS

SEQ ID NO: 88548 - protein, 19 aa, Mycobacterium avium
GLTVGSWLGPAATSMSAAA

SEQ ID NO: 88549 - protein, 19 aa, Mycobacterium avium
GLVADGWSTDSDFVSHGAT

SEQ ID NO: 88550 - protein, 18 aa, Mycobacterium avium
GLVDVSLYALAQVVQPTA

SEQ ID NO: 88551 - protein, 18 aa, Mycobacterium avium
GLVGRGGAAFPLGVKLRT

SEQ ID NO: 88552 - protein, 17 aa, Mycobacterium avium
GLVKRSRDPSDLRAVLV

SEQ ID NO: 88553 - protein, 23 aa, Mycobacterium avium
GLVRGAVFGTHWHGLLDNDDFRR

SEQ ID NO: 88554 - protein, 17 aa, Mycobacterium avium
GLVWKWPQIDCAHPLDD

SEQ ID NO: 88555 - protein, 20 aa, Mycobacterium avium
GMAAGSPFALAHTFAQTGPF

SEQ ID NO: 88556 - protein, 18 aa, Mycobacterium avium
GMIAQIFAARFRQRTKTL

SEQ ID NO: 88557 - protein, 21 aa, Mycobacterium avium
GMIWRYPDYFVVGREQLRQFA

SEQ ID NO: 88558 - protein, 23 aa, Mycobacterium avium
GMLTGPVTILAWSFVRDDQPLAD

SEQ ID NO: 88559 - protein, 22 aa, Mycobacterium avium
GMPPCTGTGMGIDRLLMTLTGL

SEQ ID NO: 88560 - protein, 19 aa, Mycobacterium avium
GMRSHPGVTATFCEALAQV

SEQ ID NO: 88561 - protein, 34 aa, Mycobacterium avium
GMSRLSGWLTPEARAGWEAVLAKLAAPGMCNPDD

SEQ ID NO: 88562 - protein, 21 aa, Mycobacterium avium
GMTEFPCATSPSLTAAPEVLD

SEQ ID NO: 88563 - protein, 22 aa, Mycobacterium avium
GNGDCVAFFWFADAPDRVPGIS

SEQ ID NO: 88564 - protein, 18 aa, Mycobacterium avium
GNGGRAEWAMGWSPDPTR

SEQ ID NO: 88565 - protein, 17 aa, Mycobacterium avium
GNPRMSDQLSRLARRGS

SEQ ID NO: 88566 - protein, 19 aa, Mycobacterium avium
GPAARLFGLLLRLPPQVFG

SEQ ID NO: 88567 - protein, 19 aa, Mycobacterium avium
GPADLSFGGARVVLTAGYP

SEQ ID NO: 88568 - protein, 19 aa, Mycobacterium avium
GPEGRRDFVMFGRLNPYKN

SEQ ID NO: 88569 - protein, 28 aa, Mycobacterium avium
GPERTGCLECGCCMTGCRYGAKNTLLKN

SEQ ID NO: 88570 - protein, 23 aa, Mycobacterium avium
GPGDAVGVLAGFPVEIAPTAQGL

SEQ ID NO: 88571 - protein, 18 aa, Mycobacterium avium
GPGGKACFVMMDEETQAL

SEQ ID NO: 88572 - protein, 26 aa, Mycobacterium avium
GPGGVALPMRLALPGAVNRGNAAQAV

SEQ ID NO: 88573 - protein, 21 aa, Mycobacterium avium
GPGHPTGGWWDEMVGPGAPID

SEQ ID NO: 88574 - protein, 21 aa, Mycobacterium avium
GPGHTVALLFSRSAEAIVAIL

SEQ ID NO: 88575 - protein, 23 aa, Mycobacterium avium
GPGNLLGGMPLAGAGAGGHGAAG

SEQ ID NO: 88576 - protein, 20 aa, Mycobacterium avium
GPGTGKCQQVWCPVCALAAL

SEQ ID NO: 88577 - protein, 23 aa, Mycobacterium avium
GPGVTGWRNFRGILPAFAAHYRC

SEQ ID NO: 88578 - protein, 31 aa, Mycobacterium avium
GPHPFPAMVRDFQRIIGLEARAQIQAQAGRL

SEQ ID NO: 88579 - protein, 18 aa, Mycobacterium avium
GPHVDLSRTVGWFTTKYP

SEQ ID NO: 88580 - protein, 25 aa, Mycobacterium avium
GPKTAETAAEFGLRVDVQPETAAVG

SEQ ID NO: 88581 - protein, 27 aa, Mycobacterium avium
GPLDRPADCTLPPPMRLLLDGEVPGVP

SEQ ID NO: 88582 - protein, 17 aa, Mycobacterium avium
GPLEASRPWATKDVVGA

SEQ ID NO: 88583 - protein, 24 aa, Mycobacterium avium
GPLRLQFWVCGVFEVQNGRITLWR

SEQ ID NO: 88584 - protein, 21 aa, Mycobacterium avium
GPLTECLADVVVRFLPYFTDV

SEQ ID NO: 88585 - protein, 17 aa, Mycobacterium avium
GPMARRIVEGGYPTTLW

SEQ ID NO: 88586 - protein, 19 aa, Mycobacterium avium
GPMLLPRIVASVFATEPRC

SEQ ID NO: 88587 - protein, 25 aa, Mycobacterium avium
GPNVDLPVPAGWQLNQNSGTSYGGI

SEQ ID NO: 88588 - protein, 21 aa, Mycobacterium avium
GPPELYAWLHYDPIPTRDDLA

SEQ ID NO: 88589 - protein, 19 aa, Mycobacterium avium
GPPPPARWSRRKPEAAARL

SEQ ID NO: 88590 - protein, 24 aa, Mycobacterium avium
GPPPRFDSLPTLFAEQAARTPDAV

SEQ ID NO: 88591 - protein, 19 aa, Mycobacterium avium
GPPVIPRGVCDPIAGLHAA

SEQ ID NO: 88592 - protein, 24 aa, Mycobacterium avium
GPQTGELMLGMATQGVVTRTVRDS

SEQ ID NO: 88593 - protein, 19 aa, Mycobacterium avium
GPRGRRRGRGARERILGAA

SEQ ID NO: 88594 - protein, 17 aa, Mycobacterium avium
GPRIRACELDVTDRAAA

SEQ ID NO: 88595 - protein, 17 aa, Mycobacterium avium
GPRMLRLAAQRSAGAHP

SEQ ID NO: 88596 - protein, 18 aa, Mycobacterium avium
GPRVLKLSAERSAGAHPY

SEQ ID NO: 88597 - protein, 17 aa, Mycobacterium avium
GPSPYIDFDGMRLKVID

SEQ ID NO: 88598 - protein, 17 aa, Mycobacterium avium
GPSRRRLAMAVGAIRAR

SEQ ID NO: 88599 - protein, 18 aa, Mycobacterium avium
GPSTGTNVWGAFGLLAEL

SEQ ID NO: 88600 - protein, 19 aa, Mycobacterium avium
GPVAVARCGHRLEHVEMID

SEQ ID NO: 88601 - protein, 22 aa, Mycobacterium avium
GPVDGPRGWATCKYVVACNMQD

SEQ ID NO: 88602 - protein, 19 aa, Mycobacterium avium
GPVPPTPIMRWLQAAERAG

SEQ ID NO: 88603 - protein, 17 aa, Mycobacterium avium
GPVQSDGRYLLRTDAGE

SEQ ID NO: 88604 - protein, 23 aa, Mycobacterium avium
GPVSRFLGPWVPEPQLWQDPVPP

SEQ ID NO: 88605 - protein, 24 aa, Mycobacterium avium
GPWIADRLLELGVELAHITICGDR

SEQ ID NO: 88606 - protein, 18 aa, Mycobacterium avium
GPYPWRNHHNAWRPAHIH

SEQ ID NO: 88607 - protein, 20 aa, Mycobacterium avium
GQCHSLAFDFSVWEIFGALL

SEQ ID NO: 88608 - protein, 17 aa, Mycobacterium avium
GQFPGPLLRFMQGRRTW

SEQ ID NO: 88609 - protein, 18 aa, Mycobacterium avium
GQIEWLFGTLLGPRPNWS

SEQ ID NO: 88610 - protein, 17 aa, Mycobacterium avium
GQILRRVPLAIVPSAQL

SEQ ID NO: 88611 - protein, 23 aa, Mycobacterium avium
GQLAEWMCFMLSDAADFLCGSVV

SEQ ID NO: 88612 - protein, 21 aa, Mycobacterium avium
GQLRAVTNWVGPVGTGAKLAN

SEQ ID NO: 88613 - protein, 22 aa, Mycobacterium avium
GQPAPDWFPLLGGHEGAGVVAE

SEQ ID NO: 88614 - protein, 22 aa, Mycobacterium avium
GQPARLPFWRGDGVGRPAELGA

SEQ ID NO: 88615 - protein, 24 aa, Mycobacterium avium
GQPLEWFCLFSSAAALVGSPGQGA

SEQ ID NO: 88616 - protein, 24 aa, Mycobacterium avium
GQPPRPGATPGPRPGPAPKPAART

SEQ ID NO: 88617 - protein, 20 aa, Mycobacterium avium
GQPVKGRLTIPPSAPGSKPG

SEQ ID NO: 88618 - protein, 17 aa, Mycobacterium avium
GQQEFASRIGVSAEELG

SEQ ID NO: 88619 - protein, 26 aa, Mycobacterium avium
GQRLLQSCPVCLYAGSIMPDDLLALC

SEQ ID NO: 88620 - protein, 27 aa, Mycobacterium avium
GQRLPAAGSYRAFLTWLAERDLDAARR

SEQ ID NO: 88621 - protein, 19 aa, Mycobacterium avium
GQSPFVWSVIGALSEATSL

SEQ ID NO: 88622 - protein, 23 aa, Mycobacterium avium
GQVWSQWHSLVFDVSVWETWGAL

SEQ ID NO: 88623 - protein, 25 aa, Mycobacterium avium
GQWYTARLRPGPLRPADRRTTVVDH

SEQ ID NO: 88624 - protein, 20 aa, Mycobacterium avium
GRAIMFADVAWRANAINRIR

SEQ ID NO: 88625 - protein, 19 aa, Mycobacterium avium
GRARFARFHLGRNGAVHGG

SEQ ID NO: 88626 - protein, 21 aa, Mycobacterium avium
GRAWANYRLTSRSLTIAGGTT

SEQ ID NO: 88627 - protein, 25 aa, Mycobacterium avium
GRAYLDFGEPLPLRKRLEELRAEES

SEQ ID NO: 88628 - protein, 20 aa, Mycobacterium avium
GRDSLLTAWMTLPLDVGLSI

SEQ ID NO: 88629 - protein, 25 aa, Mycobacterium avium
GREGAKLFHAKGWRVGAVDRNDDGL

SEQ ID NO: 88630 - protein, 21 aa, Mycobacterium avium
GRFGLRGGPVLIGRTPLACDY

SEQ ID NO: 88631 - protein, 25 aa, Mycobacterium avium
GRGADGWRLDAAYAVPETFWAATLP

SEQ ID NO: 88632 - protein, 20 aa, Mycobacterium avium
GRGLRCIAPTWPMGAHPEPL

SEQ ID NO: 88633 - protein, 20 aa, Mycobacterium avium
GRIAAMAAFDLDDFDAAIGE

SEQ ID NO: 88634 - protein, 20 aa, Mycobacterium avium
GRIKDLVIIDGRNHYPQDLE

SEQ ID NO: 88635 - protein, 17 aa, Mycobacterium avium
GRIVRAIGEAGSMNPVV

SEQ ID NO: 88636 - protein, 19 aa, Mycobacterium avium
GRLGQGRRGFEKSCVPEQT

SEQ ID NO: 88637 - protein, 23 aa, Mycobacterium avium
GRLPRLSNRLGVLTRTNSESIVG

SEQ ID NO: 88638 - protein, 24 aa, Mycobacterium avium
GRLRSADRGWSQALAHRETDLAEL

SEQ ID NO: 88639 - protein, 19 aa, Mycobacterium avium
GRLSIPFTTGLLVGIGETL

SEQ ID NO: 88640 - protein, 17 aa, Mycobacterium avium
GRLSVGIGVGGRQEDYH

SEQ ID NO: 88641 - protein, 24 aa, Mycobacterium avium
GRMSGVPPAAWGGLAAARFKEVID

SEQ ID NO: 88642 - protein, 20 aa, Mycobacterium avium
GRMYACFAAGAMAAGCEYEI

SEQ ID NO: 88643 - protein, 24 aa, Mycobacterium avium
GRNRGHCVAIHLNMPIGRPGQEAL

SEQ ID NO: 88644 - protein, 21 aa, Mycobacterium avium
GRPAPELKDVVAVAKRAAGHT

SEQ ID NO: 88645 - protein, 20 aa, Mycobacterium avium
GRPAQIASLARAFHDAGMST

SEQ ID NO: 88646 - protein, 20 aa, Mycobacterium avium
GRPGPEFRPSEVARLGYLAG

SEQ ID NO: 88647 - protein, 29 aa, Mycobacterium avium
GRPSGRWGEEIVALVELRAGTGAAADELH

SEQ ID NO: 88648 - protein, 23 aa, Mycobacterium avium
GRPWPAHQPRCMVRSTIAATAAD

SEQ ID NO: 88649 - protein, 26 aa, Mycobacterium avium
GRRHRWLRRAGLLAAGACAGFFRHPP

SEQ ID NO: 88650 - protein, 20 aa, Mycobacterium avium
GRRIAAYLKDAGVQLVSESR

SEQ ID NO: 88651 - protein, 19 aa, Mycobacterium avium
GRRVCAVVGSGDNGGDALW

SEQ ID NO: 88652 - protein, 21 aa, Mycobacterium avium
GRRYLDCLSAYSAVNFGHRHP

SEQ ID NO: 88653 - protein, 18 aa, Mycobacterium avium
GRSPAAWTPEYFGGNAVP

SEQ ID NO: 88654 - protein, 20 aa, Mycobacterium avium
GRSSWSAPWTIDANISALTD

SEQ ID NO: 88655 - protein, 17 aa, Mycobacterium avium
GRSVIRKAAGIDFPGWE

SEQ ID NO: 88656 - protein, 20 aa, Mycobacterium avium
GRTQPTWRNWPAKRAGTAAA

SEQ ID NO: 88657 - protein, 19 aa, Mycobacterium avium
GRTVDFKNTVLIFTSNLGT

SEQ ID NO: 88658 - protein, 18 aa, Mycobacterium avium
GRWGCVLGGDPDRRVTAM

SEQ ID NO: 88659 - protein, 17 aa, Mycobacterium avium
GRWLLSHNGVVDRSVLP

SEQ ID NO: 88660 - protein, 28 aa, Mycobacterium avium
GRYGNPAAAARYWAAQSLEDNCGLVSVA

SEQ ID NO: 88661 - protein, 32 aa, Mycobacterium avium
GRYHKVILSRCLQVPFALDFPSTYRLARRHNT

SEQ ID NO: 88662 - protein, 21 aa, Mycobacterium avium
GSAIAELRTLWHGPSSTAMAA

SEQ ID NO: 88663 - protein, 22 aa, Mycobacterium avium
GSALFRVARRIGPLGPDEVGFD

SEQ ID NO: 88664 - protein, 24 aa, Mycobacterium avium
GSDGVPSWVFRLLHVADTYNPIAP

SEQ ID NO: 88665 - protein, 19 aa, Mycobacterium avium
GSDMWKFRDTVIPNVALNA

SEQ ID NO: 88666 - protein, 18 aa, Mycobacterium avium
GSFRAPQFTVAWPTGEIG

SEQ ID NO: 88667 - protein, 21 aa, Mycobacterium avium
GSGALRPAAAEVFAAVDDAGI

SEQ ID NO: 88668 - protein, 25 aa, Mycobacterium avium
GSGHTRIELLAAIDKILAAGRAAGD

SEQ ID NO: 88669 - protein, 19 aa, Mycobacterium avium
GSGMPWHPGQVILEDSSRS

SEQ ID NO: 88670 - protein, 18 aa, Mycobacterium avium
GSGPWIAHWEEGPSTEVN

SEQ ID NO: 88671 - protein, 22 aa, Mycobacterium avium
GSGVSPGFAELLAIVSAMVCNR

SEQ ID NO: 88672 - protein, 26 aa, Mycobacterium avium
GSHLARLMSEVMVRAVLDRIPDYQVD

SEQ ID NO: 88673 - protein, 19 aa, Mycobacterium avium
GSIGRGIDGVAIYNSDTVT

SEQ ID NO: 88674 - protein, 27 aa, Mycobacterium avium
GSIPVKRLRQAGVLELLLALANESTGT

SEQ ID NO: 88675 - protein, 23 aa, Mycobacterium avium
GSKATVADLSWLRERGLAAAITA

SEQ ID NO: 88676 - protein, 17 aa, Mycobacterium avium
GSLGDWTPTPGPVTSWH

SEQ ID NO: 88677 - protein, 26 aa, Mycobacterium avium
GSLNLVGGLRRSMAKAGYCDLKEFQK

SEQ ID NO: 88678 - protein, 23 aa, Mycobacterium avium
GSLSLKPSQYWARQCYVGASFMR

SEQ ID NO: 88679 - protein, 27 aa, Mycobacterium avium
GSNMLRFGRVTVRFGKPMDFSRFEGLA

SEQ ID NO: 88680 - protein, 19 aa, Mycobacterium avium
GSPALMLAVGPGFGSELVL

SEQ ID NO: 88681 - protein, 17 aa, Mycobacterium avium
GSQWLGMATELLDTAPV

SEQ ID NO: 88682 - protein, 24 aa, Mycobacterium avium
GSRCSRAGAALADVGLPAHRRRAI

SEQ ID NO: 88683 - protein, 17 aa, Mycobacterium avium
GSRPLSVVITRIGARTS

SEQ ID NO: 88684 - protein, 22 aa, Mycobacterium avium
GSSYPHWQCADVHKLPPALSAE

SEQ ID NO: 88685 - protein, 19 aa, Mycobacterium avium
GSTELGWRMEVNDDGQWAF

SEQ ID NO: 88686 - protein, 20 aa, Mycobacterium avium
GSTKIPVFVFHPAGGSTVVY

SEQ ID NO: 88687 - protein, 19 aa, Mycobacterium avium
GSVCPHCRPAGSTTPPPGV

SEQ ID NO: 88688 - protein, 24 aa, Mycobacterium avium
GTAAALRFEVFGMVDGRPVVVLEH

SEQ ID NO: 88689 - protein, 35 aa, Mycobacterium avium
GTAFPTTMRLTGRWLRGRLPTAYDWARGIPVVDKK

SEQ ID NO: 88690 - protein, 23 aa, Mycobacterium avium
GTAKAAFVAVEFDEYGAGQGPRL

SEQ ID NO: 88691 - protein, 33 aa, Mycobacterium avium
GTALLCPFDPLIFFRPRVERLFEFHYRIEIYTP

SEQ ID NO: 88692 - protein, 17 aa, Mycobacterium avium
GTCKDIPLMLATPHVLI

SEQ ID NO: 88693 - protein, 19 aa, Mycobacterium avium
GTDALLLPGGFPEQFTAEL

SEQ ID NO: 88694 - protein, 19 aa, Mycobacterium avium
GTDPRWTYGAATPGEAVAA

SEQ ID NO: 88695 - protein, 24 aa, Mycobacterium avium
GTEIPVTVKFRIGIDEEHHTHLDA

SEQ ID NO: 88696 - protein, 17 aa, Mycobacterium avium
GTGAVPPSPFPVITNPA

SEQ ID NO: 88697 - protein, 18 aa, Mycobacterium avium
GTGLAAISWGLAHERMSI

SEQ ID NO: 88698 - protein, 27 aa, Mycobacterium avium
GTGPPPRPADREFPDGTAVPGFVDMHV

SEQ ID NO: 88699 - protein, 17 aa, Mycobacterium avium
GTIPGVRLPHSVASYTG

SEQ ID NO: 88700 - protein, 23 aa, Mycobacterium avium
GTLREVFDLAELILQSPMDISRP

SEQ ID NO: 88701 - protein, 21 aa, Mycobacterium avium
GTNITIWPGMNHRLPELWTDP

SEQ ID NO: 88702 - protein, 17 aa, Mycobacterium avium
GTPAIFLNVRGGRLSRQ

SEQ ID NO: 88703 - protein, 22 aa, Mycobacterium avium
GTPFQRLNFMVGKLNRAMQRNP

SEQ ID NO: 88704 - protein, 25 aa, Mycobacterium avium
GTPLPDRPATTFADGRLSGTKIGVG

SEQ ID NO: 88705 - protein, 25 aa, Mycobacterium avium
GTPRRYGVRWHYRVPAWSEFVEVHW

SEQ ID NO: 88706 - protein, 17 aa, Mycobacterium avium
GTPWLTSFAQRSPFAEA

SEQ ID NO: 88707 - protein, 19 aa, Mycobacterium avium
GTRACTATFWLLDAPDSLA

SEQ ID NO: 88708 - protein, 25 aa, Mycobacterium avium
GTRWACATTAFATRPEASVARAADQ

SEQ ID NO: 88709 - protein, 18 aa, Mycobacterium avium
GTSKPAIYRRWPSKAHLV

SEQ ID NO: 88710 - protein, 17 aa, Mycobacterium avium
GTTPAVWTGSPSPSGAG

SEQ ID NO: 88711 - protein, 21 aa, Mycobacterium avium
GTTSFYFRTRKALVHAMAGRL

SEQ ID NO: 88712 - protein, 18 aa, Mycobacterium avium
GTVSGLYVCEMVTARALV

SEQ ID NO: 88713 - protein, 19 aa, Mycobacterium avium
GTVTARFLISACGVLTVPN

SEQ ID NO: 88714 - protein, 19 aa, Mycobacterium avium
GVAGGRFLLRIRDGVGTCT

SEQ ID NO: 88715 - protein, 18 aa, Mycobacterium avium
GVANFLVLRTRRDGSRNG

SEQ ID NO: 88716 - protein, 17 aa, Mycobacterium avium
GVARAFVDARIQTIYGG

SEQ ID NO: 88717 - protein, 29 aa, Mycobacterium avium
GVATGYARRAGLTASRFVACPFGGPGARM

SEQ ID NO: 88718 - protein, 20 aa, Mycobacterium avium
GVAVGLKWPNDVLAGPAGSP

SEQ ID NO: 88719 - protein, 25 aa, Mycobacterium avium
GVDRLGYRLIRLSGQVSGPAELPPD

SEQ ID NO: 88720 - protein, 18 aa, Mycobacterium avium
GVGGRAAVQIGRRLARLA

SEQ ID NO: 88721 - protein, 25 aa, Mycobacterium avium
GVGKTRLAGEWSRRVYEQGAVVLYG

SEQ ID NO: 88722 - protein, 31 aa, Mycobacterium avium
GVGPGDCVAVMFPRCADAIVSMLAVLKTGAA

SEQ ID NO: 88723 - protein, 27 aa, Mycobacterium avium
GVGYVRRAGLTASRFVACPFGESGTRM

SEQ ID NO: 88724 - protein, 23 aa, Mycobacterium avium
GVHRPCYSGADLTAPFRADHDVE

SEQ ID NO: 88725 - protein, 19 aa, Mycobacterium avium
GVHYCLGANLARLEGRVAL

SEQ ID NO: 88726 - protein, 18 aa, Mycobacterium avium
GVHYCLGAPLARLEAGVA

SEQ ID NO: 88727 - protein, 17 aa, Mycobacterium avium
GVKQALVYYYFPTMDDL

SEQ ID NO: 88728 - protein, 21 aa, Mycobacterium avium
GVLKAGAAYLPIDPSLPSARI

SEQ ID NO: 88729 - protein, 22 aa, Mycobacterium avium
GVLKAGAAYLPIDPSLPSARIE

SEQ ID NO: 88730 - protein, 17 aa, Mycobacterium avium
GVLSRRIDPRNGTVLVW

SEQ ID NO: 88731 - protein, 19 aa, Mycobacterium avium
GVLSVARLPSGTAPAAPCS

SEQ ID NO: 88732 - protein, 31 aa, Mycobacterium avium
GVLTPGFHGVHIHKVGKCEPSSVAPTGGAPG

SEQ ID NO: 88733 - protein, 21 aa, Mycobacterium avium
GVLTQRCDPIFVMAAPGQPLP

SEQ ID NO: 88734 - protein, 23 aa, Mycobacterium avium
GVNELFAVLAYGEIAAFYRLTDE

SEQ ID NO: 88735 - protein, 18 aa, Mycobacterium avium
GVNVLGVAPGIMLNPQLK

SEQ ID NO: 88736 - protein, 25 aa, Mycobacterium avium
GVPFVLRIKEGYAIDDYLRPGPKHD

SEQ ID NO: 88737 - protein, 25 aa, Mycobacterium avium
GVPGRSVSRWGAFIDDVAGFDPEFF

SEQ ID NO: 88738 - protein, 21 aa, Mycobacterium avium
GVPISGILFGARRKTTVPLVT

SEQ ID NO: 88739 - protein, 20 aa, Mycobacterium avium
GVPMVFPVWFENLQVKYLNS

SEQ ID NO: 88740 - protein, 24 aa, Mycobacterium avium
GVPRPEGQPALGLGEVDGPYHQAL

SEQ ID NO: 88741 - protein, 17 aa, Mycobacterium avium
GVQNPRVRRWWPRRYRR

SEQ ID NO: 88742 - protein, 25 aa, Mycobacterium avium
GVRDWGRAFAWMGMPDEYFASSGNA

SEQ ID NO: 88743 - protein, 24 aa, Mycobacterium avium
GVRFRPALTVSRGEIDAAIGAVRD

SEQ ID NO: 88744 - protein, 22 aa, Mycobacterium avium
GVRPEHFELGGLGVEMEVDVVE

SEQ ID NO: 88745 - protein, 25 aa, Mycobacterium avium
GVRSRLMLDIASWRRRRREELAALG

SEQ ID NO: 88746 - protein, 19 aa, Mycobacterium avium
GVSARFAIAAAETVAAAAR

SEQ ID NO: 88747 - protein, 25 aa, Mycobacterium avium
GVSSFGFGGANAHLVVREVLPRDVI

SEQ ID NO: 88748 - protein, 18 aa, Mycobacterium avium
GVSVIAVDICDEVSPDNA

SEQ ID NO: 88749 - protein, 20 aa, Mycobacterium avium
GVTLREVWRDGAYAYLGMAV

SEQ ID NO: 88750 - protein, 17 aa, Mycobacterium avium
GVVAAIVPWNMPQFLIV

SEQ ID NO: 88751 - protein, 24 aa, Mycobacterium avium
GVWGEVIFPSLGMWASTFRTPELL

SEQ ID NO: 88752 - protein, 22 aa, Mycobacterium avium
GVWSQCHSLAFDVSVWEIFGAL

SEQ ID NO: 88753 - protein, 19 aa, Mycobacterium avium
GVWSQCHSYGFDVSVQEIW

SEQ ID NO: 88754 - protein, 24 aa, Mycobacterium avium
GWAGSLKRHGEWTVPTRLALVRRL

SEQ ID NO: 88755 - protein, 17 aa, Mycobacterium avium
GWDIMFNYEELFVATMV

SEQ ID NO: 88756 - protein, 19 aa, Mycobacterium avium
GWGEFGAFVEYGPPEAAHW

SEQ ID NO: 88757 - protein, 20 aa, Mycobacterium avium
GWHALARGWDGRALALAGDD

SEQ ID NO: 88758 - protein, 18 aa, Mycobacterium avium
GWIQPTWPREHGGRSLGL

SEQ ID NO: 88759 - protein, 23 aa, Mycobacterium avium
GWLAREFELLGVPFGERGRIADE

SEQ ID NO: 88760 - protein, 21 aa, Mycobacterium avium
GWMAVRAMPEFAARNAFDAAA

SEQ ID NO: 88761 - protein, 18 aa, Mycobacterium avium
GWRLDRVTAPSRLFGANG

SEQ ID NO: 88762 - protein, 21 aa, Mycobacterium avium
GWSEGGAMLVVERLSDARRLG

SEQ ID NO: 88763 - protein, 21 aa, Mycobacterium avium
GWTTAAPVLRTVASVLPAASS

SEQ ID NO: 88764 - protein, 25 aa, Mycobacterium avium
GWVRRKRPGSAAARAAEAAEKAAGG

SEQ ID NO: 88765 - protein, 18 aa, Mycobacterium avium
GWWTARAAIQQTAHAQRQ

SEQ ID NO: 88766 - protein, 25 aa, Mycobacterium avium
GYEGEGFPVVRAFAGVSTAALDPFV

SEQ ID NO: 88767 - protein, 19 aa, Mycobacterium avium
GYFDLAWAHAGGLPRPLMV

SEQ ID NO: 88768 - protein, 20 aa, Mycobacterium avium
GYGKTSWNVRAIWEMYTGWF

SEQ ID NO: 88769 - protein, 18 aa, Mycobacterium avium
GYHRVCASYHTDENTPIP

SEQ ID NO: 88770 - protein, 19 aa, Mycobacterium avium
GYIFNGRWQFSSGTDHCDW

SEQ ID NO: 88771 - protein, 20 aa, Mycobacterium avium
GYKCPRTVEFDTLPRDPNGK

SEQ ID NO: 88772 - protein, 24 aa, Mycobacterium avium
GYLGRPGLTASRFVACPFGGAGER

SEQ ID NO: 88773 - protein, 19 aa, Mycobacterium avium
GYRRYPNWRAMDMSAFTQD

SEQ ID NO: 88774 - protein, 26 aa, Mycobacterium avium
GYRSLREVVLPLGRLSVITGANGTGK

SEQ ID NO: 88775 - protein, 29 aa, Mycobacterium avium
GYTAGDTDLAWARITYWRALLAAAVDLAP

SEQ ID NO: 88776 - protein, 24 aa, Mycobacterium avium
GYTAPEFFDYLVALAAADPDLAHI

SEQ ID NO: 88777 - protein, 18 aa, Mycobacterium avium
HAAGAAAVRARIVPVSPS

SEQ ID NO: 88778 - protein, 18 aa, Mycobacterium avium
HAAGASAVRARLAPAQAP

SEQ ID NO: 88779 - protein, 20 aa, Mycobacterium avium
HAAGTAFDPGWWRRAAELGW

SEQ ID NO: 88780 - protein, 18 aa, Mycobacterium avium
HAAKVLNLRSTLLTLAGG

SEQ ID NO: 88781 - protein, 24 aa, Mycobacterium avium
HAALRRSTLPGGLRVVTEYLPAVR

SEQ ID NO: 88782 - protein, 19 aa, Mycobacterium avium
HACLFDLDGVLTDTASVHT

SEQ ID NO: 88783 - protein, 23 aa, Mycobacterium avium
HAILKTLCDRGWASRDPVDKTFA

SEQ ID NO: 88784 - protein, 23 aa, Mycobacterium avium
HAKARGANILARIMGASITSDGY

SEQ ID NO: 88785 - protein, 17 aa, Mycobacterium avium
HALGVPTTRSLAVVGTG

SEQ ID NO: 88786 - protein, 18 aa, Mycobacterium avium
HAMIDGRPVGVFSHDQTV

SEQ ID NO: 88787 - protein, 24 aa, Mycobacterium avium
HANACLTCPMFLTTAEFLPQHHQQ

SEQ ID NO: 88788 - protein, 25 aa, Mycobacterium avium
HAQLRALGGIGEMFDTLLVYENFPM

SEQ ID NO: 88789 - protein, 20 aa, Mycobacterium avium
HARGLGVLIDAVFNHLGPSG

SEQ ID NO: 88790 - protein, 27 aa, Mycobacterium avium
HASSFPPGGLPALLAEWQLASDVSSAV

SEQ ID NO: 88791 - protein, 17 aa, Mycobacterium avium
HAVSGTVVFPGAGFVEL

SEQ ID NO: 88792 - protein, 23 aa, Mycobacterium avium
HCFAGKDRTGFVVATVLEAVGVD

SEQ ID NO: 88793 - protein, 21 aa, Mycobacterium avium
HDAHLYVRHAWQTAALLGDSR

SEQ ID NO: 88794 - protein, 19 aa, Mycobacterium avium
HDATMRFTHELRMTLRALG

SEQ ID NO: 88795 - protein, 24 aa, Mycobacterium avium
HDDVIEFEPRYAIRQPDGGWGEYV

SEQ ID NO: 88796 - protein, 23 aa, Mycobacterium avium
HDEFYLFGCCHHIAIDGLGMALV

SEQ ID NO: 88797 - protein, 25 aa, Mycobacterium avium
HDLADWRWGIDVNVLGVIHGLKAFV

SEQ ID NO: 88798 - protein, 21 aa, Mycobacterium avium
HDLGRYLGAYGHRDVSSPRLD

SEQ ID NO: 88799 - protein, 18 aa, Mycobacterium avium
HDLLARRNIVAIDSPVSG

SEQ ID NO: 88800 - protein, 31 aa, Mycobacterium avium
HDPRRFATDLLERFRDLILLQAVPDAASRGV

SEQ ID NO: 88801 - protein, 17 aa, Mycobacterium avium
HDTFRSWFHHSGDGEFV

SEQ ID NO: 88802 - protein, 24 aa, Mycobacterium avium
HDVAEHWRSRIPAVTHVDGTARIQ

SEQ ID NO: 88803 - protein, 23 aa, Mycobacterium avium
HDWRVGKKLLAWERPLRPSEREA

SEQ ID NO: 88804 - protein, 18 aa, Mycobacterium avium
HDYYVLSRHADVWAAARD

SEQ ID NO: 88805 - protein, 18 aa, Mycobacterium avium
HEALMKQAWLAANEDQPV

SEQ ID NO: 88806 - protein, 23 aa, Mycobacterium avium
HEASRAKLVRLFPTVMKGTHVEL

SEQ ID NO: 88807 - protein, 24 aa, Mycobacterium avium
HEEFPRIDPAVICLVHDGGDRAVL

SEQ ID NO: 88808 - protein, 20 aa, Mycobacterium avium
HEFYIRDVLLDWDRDDPNYF

SEQ ID NO: 88809 - protein, 20 aa, Mycobacterium avium
HEIWGALLHGGRLVVVPESV

SEQ ID NO: 88810 - protein, 17 aa, Mycobacterium avium
HEPERFDEFTSRYKSEL

SEQ ID NO: 88811 - protein, 26 aa, Mycobacterium avium
HESCGKCTPCREGTFWLDQIYERLET

SEQ ID NO: 88812 - protein, 19 aa, Mycobacterium avium
HESGARWILDLGPGDILTR

SEQ ID NO: 88813 - protein, 20 aa, Mycobacterium avium
HEVELRKKVKEYLKEHDTEG

SEQ ID NO: 88814 - protein, 21 aa, Mycobacterium avium
HEWVRRSGDDTVRVGITDFAQ

SEQ ID NO: 88815 - protein, 23 aa, Mycobacterium avium
HEYRPFRSLIRAVLRHAGGVRID

SEQ ID NO: 88816 - protein, 17 aa, Mycobacterium avium
HFDDIRKLLKVINGLVD

SEQ ID NO: 88817 - protein, 20 aa, Mycobacterium avium
HFRNINEFWIGSADMMHRNL

SEQ ID NO: 88818 - protein, 24 aa, Mycobacterium avium
HGATLRFAPPLVVTAQEIDWAVGQ

SEQ ID NO: 88819 - protein, 17 aa, Mycobacterium avium
HGLLTTVCYQFGDAKPV

SEQ ID NO: 88820 - protein, 22 aa, Mycobacterium avium
HGPEVLSYHLVRSVLRDPRFQI

SEQ ID NO: 88821 - protein, 23 aa, Mycobacterium avium
HGRGGFPGMLLGSVSSHVAQSAT

SEQ ID NO: 88822 - protein, 23 aa, Mycobacterium avium
HGRGVRLLINFSFNNEAFGADGA

SEQ ID NO: 88823 - protein, 23 aa, Mycobacterium avium
HGVDEVRGLGLWAGVDIDPSLGS

SEQ ID NO: 88824 - protein, 25 aa, Mycobacterium avium
HGYVRRPGLTASRFVPNPFGAPGSR

SEQ ID NO: 88825 - protein, 24 aa, Mycobacterium avium
HHLVKTFWGWREQQLPDATLILTS

SEQ ID NO: 88826 - protein, 22 aa, Mycobacterium avium
HHTRLRKIISRGFTPRAVGRLR

SEQ ID NO: 88827 - protein, 21 aa, Mycobacterium avium
HHYGVFRGREAVRDWIVAVMA

SEQ ID NO: 88828 - protein, 28 aa, Mycobacterium avium
HIATVSGPSFLGWEHPPAAAASVTAPAK

SEQ ID NO: 88829 - protein, 21 aa, Mycobacterium avium
HIRRRGWQGAAVVEAEVDYDD

SEQ ID NO: 88830 - protein, 18 aa, Mycobacterium avium
HISHGRAGWQVRVSATEQ

SEQ ID NO: 88831 - protein, 25 aa, Mycobacterium avium
HITDEIKGRILAMAQPDAQGNRPDV

SEQ ID NO: 88832 - protein, 17 aa, Mycobacterium avium
HKLILRATVDDLENTAN

SEQ ID NO: 88833 - protein, 19 aa, Mycobacterium avium
HLDALIAEWEHDRDNTERV

SEQ ID NO: 88834 - protein, 19 aa, Mycobacterium avium
HLDSLRAAVVAHRADLGLA

SEQ ID NO: 88835 - protein, 23 aa, Mycobacterium avium
HLGSWRPGLSYRQLARELTDYVV

SEQ ID NO: 88836 - protein, 24 aa, Mycobacterium avium
HLIDWKGNDWYAGKTDTPAAHPNS

SEQ ID NO: 88837 - protein, 19 aa, Mycobacterium avium
HLPAEWGRIALSNLRLGAT

SEQ ID NO: 88838 - protein, 36 aa, Mycobacterium avium
HLTTAIEVLKNFAFTEQRGATLIAREPIGVCGLITP

SEQ ID NO: 88839 - protein, 26 aa, Mycobacterium avium
HLTTLFPPVRPRQWLEIRYLDSVPDT

SEQ ID NO: 88840 - protein, 19 aa, Mycobacterium avium
HLVAFLLGVGYPADRPLTP

SEQ ID NO: 88841 - protein, 20 aa, Mycobacterium avium
HLVCRSCGSTIEVGDHEVEE

SEQ ID NO: 88842 - protein, 24 aa, Mycobacterium avium
HLVGAFRLASAVLPGMLERQRGDL

SEQ ID NO: 88843 - protein, 23 aa, Mycobacterium avium
HMADLGFLPGVTRILAATPNDGQ

SEQ ID NO: 88844 - protein, 19 aa, Mycobacterium avium
HNRSWNCGVEGPTDDPDIT

SEQ ID NO: 88845 - protein, 21 aa, Mycobacterium avium
HNVAFSKPPIGKRGYNEDEVD

SEQ ID NO: 88846 - protein, 28 aa, Mycobacterium avium
HNWGRFRWGDDFGWTWGTILPAGPDDPW

SEQ ID NO: 88847 - protein, 20 aa, Mycobacterium avium
HPAGRPFVGAGLALALAGRR

SEQ ID NO: 88848 - protein, 24 aa, Mycobacterium avium
HPDDARLGPPLQVVVTAVRSLLQP

SEQ ID NO: 88849 - protein, 22 aa, Mycobacterium avium
HPDDRARVAATIDEIVTNHQAF

SEQ ID NO: 88850 - protein, 18 aa, Mycobacterium avium
HPKLPGTVYTAAKELEEA

SEQ ID NO: 88851 - protein, 21 aa, Mycobacterium avium
HPKLPSGPGQVWSQWHSLVFD

SEQ ID NO: 88852 - protein, 26 aa, Mycobacterium avium
HPLAHLRAFVLIPWLAVDPDARLTVA

SEQ ID NO: 88853 - protein, 24 aa, Mycobacterium avium
HPNQRLQAQILRRAPQRARVVAGE

SEQ ID NO: 88854 - protein, 17 aa, Mycobacterium avium
HPRRAAVSSYGLSGTNV

SEQ ID NO: 88855 - protein, 21 aa, Mycobacterium avium
HPVLMPVFRVSGLTELTTVEA

SEQ ID NO: 88856 - protein, 25 aa, Mycobacterium avium
HRADIEFPAPALIYGYGAYEICIDP

SEQ ID NO: 88857 - protein, 17 aa, Mycobacterium avium
HRALRGAAIGHFAATEI

SEQ ID NO: 88858 - protein, 20 aa, Mycobacterium avium
HRAPGPLPFAGLRVLDLTTF

SEQ ID NO: 88859 - protein, 18 aa, Mycobacterium avium
HRELPLRADYVGKNVPTS

SEQ ID NO: 88860 - protein, 25 aa, Mycobacterium avium
HRHPTCAVPGCGATRGLHAHHLRHW

SEQ ID NO: 88861 - protein, 25 aa, Mycobacterium avium
HRHWSLPVFVEWASGALIPCSCVGR

SEQ ID NO: 88862 - protein, 19 aa, Mycobacterium avium
HRIDVAALVACFPNVVVVR

SEQ ID NO: 88863 - protein, 19 aa, Mycobacterium avium
HRKVKKWLVDGDFDVLHLH

SEQ ID NO: 88864 - protein, 19 aa, Mycobacterium avium
HRLARRPVSHIALTHKHFD

SEQ ID NO: 88865 - protein, 31 aa, Mycobacterium avium
HRLRRMLTGNFTFRRCESMRPQIQDTVDHYL

SEQ ID NO: 88866 - protein, 22 aa, Mycobacterium avium
HRLTGELGRWYGIDAGTLRVGD

SEQ ID NO: 88867 - protein, 18 aa, Mycobacterium avium
HRLVFPLNTILELDDIPE

SEQ ID NO: 88868 - protein, 23 aa, Mycobacterium avium
HRPRRASSPFGQFAAVADAVNPA

SEQ ID NO: 88869 - protein, 24 aa, Mycobacterium avium
HRRLAPLCRFSRSRTRADAGCTIG

SEQ ID NO: 88870 - protein, 19 aa, Mycobacterium avium
HRRLGRWVQLGGHCDDDDA

SEQ ID NO: 88871 - protein, 18 aa, Mycobacterium avium
HRTDCVFTSVDHGRYLAE

SEQ ID NO: 88872 - protein, 17 aa, Mycobacterium avium
HRTEYRYSDVVTSSYGR

SEQ ID NO: 88873 - protein, 36 aa, Mycobacterium avium
HRVNHWLWRRGARLAARICAEITRILTGVEIHPGAV

SEQ ID NO: 88874 - protein, 17 aa, Mycobacterium avium
HRVRIEAVRALVSVDDV

SEQ ID NO: 88875 - protein, 23 aa, Mycobacterium avium
HRVTVLHFMPGWLEMLVEVGRGR

SEQ ID NO: 88876 - protein, 18 aa, Mycobacterium avium
HRWRDILDAVLAVTKAGV

SEQ ID NO: 88877 - protein, 22 aa, Mycobacterium avium
HSAWPSKLRPTLHNVDVGIALT

SEQ ID NO: 88878 - protein, 21 aa, Mycobacterium avium
HSEAGLYLWVTRGEPCRDTIT

SEQ ID NO: 88879 - protein, 20 aa, Mycobacterium avium
HSGAGILGPMAKLVKVRSGY

SEQ ID NO: 88880 - protein, 22 aa, Mycobacterium avium
HSMGALHSWCLAAQHPKLVSAL

SEQ ID NO: 88881 - protein, 19 aa, Mycobacterium avium
HSPQRLDNELNWIEQQTGG

SEQ ID NO: 88882 - protein, 22 aa, Mycobacterium avium
HSPRLANQIKHAARVVPTNFLT

SEQ ID NO: 88883 - protein, 18 aa, Mycobacterium avium
HSRRPMWRRGRRAEKATA

SEQ ID NO: 88884 - protein, 24 aa, Mycobacterium avium
HSRVLRVGVAEFRRSLDRVMPRDK

SEQ ID NO: 88885 - protein, 18 aa, Mycobacterium avium
HSSLLDRHRPLWETHIVE

SEQ ID NO: 88886 - protein, 17 aa, Mycobacterium avium
HSVGAVILGDFEKIEEG

SEQ ID NO: 88887 - protein, 19 aa, Mycobacterium avium
HSVMPWFTDHSHYYDVGSE

SEQ ID NO: 88888 - protein, 26 aa, Mycobacterium avium
HSYAFDFSVWEIWGALLHGGRLVVVP

SEQ ID NO: 88889 - protein, 17 aa, Mycobacterium avium
HTDPGGTVTARFLISAC

SEQ ID NO: 88890 - protein, 23 aa, Mycobacterium avium
HTFGLKAGLITSFLRGATMLPVP

SEQ ID NO: 88891 - protein, 19 aa, Mycobacterium avium
HTGLLGWAAAQRELFGLGA

SEQ ID NO: 88892 - protein, 17 aa, Mycobacterium avium
HTLIWPNLFLAEMNVMF

SEQ ID NO: 88893 - protein, 21 aa, Mycobacterium avium
HTLLMLALAGWARYLRGYDLN

SEQ ID NO: 88894 - protein, 23 aa, Mycobacterium avium
HTVGMLFSPGYPGFLRGVAASGP

SEQ ID NO: 88895 - protein, 22 aa, Mycobacterium avium
HVADLTARHGFRVGNAAVQVIG

SEQ ID NO: 88896 - protein, 21 aa, Mycobacterium avium
HVDVPELLRVLDFAPTTEDQL

SEQ ID NO: 88897 - protein, 21 aa, Mycobacterium avium
HVIRIGGTVIYPPRHFPQYPG

SEQ ID NO: 88898 - protein, 19 aa, Mycobacterium avium
HVLPVGWVEPVDISNAVLF

SEQ ID NO: 88899 - protein, 19 aa, Mycobacterium avium
HVLSAFGLAGVKPVYLGAS

SEQ ID NO: 88900 - protein, 30 aa, Mycobacterium avium
HVPKEVAARFALDIIRHFPGRQARKVSCPI

SEQ ID NO: 88901 - protein, 22 aa, Mycobacterium avium
HVQVFRMWLDAVGVTDDLHHFL

SEQ ID NO: 88902 - protein, 22 aa, Mycobacterium avium
HVRADLPAHVALSGHPNVTVTP

SEQ ID NO: 88903 - protein, 25 aa, Mycobacterium avium
HVRGRGLLCGVVLTAPRAKDAEAAA

SEQ ID NO: 88904 - protein, 26 aa, Mycobacterium avium
HVSGHAYAGELLFLYNGVRPRHVMPV

SEQ ID NO: 88905 - protein, 25 aa, Mycobacterium avium
HVTRLRPDLRPDLPQPAAGDGSYRV

SEQ ID NO: 88906 - protein, 23 aa, Mycobacterium avium
HVTRPGQYEAPLGITLRELLDYA

SEQ ID NO: 88907 - protein, 23 aa, Mycobacterium avium
HYDKIHLYDAFGFTESRTVAPGR

SEQ ID NO: 88908 - protein, 21 aa, Mycobacterium avium
IAAALLERGAAVLLVDIQQET

SEQ ID NO: 88909 - protein, 26 aa, Mycobacterium avium
IAAALTEWFTVDWHRAIVDKWRAAGV

SEQ ID NO: 88910 - protein, 19 aa, Mycobacterium avium
IAAARRAFDGTGWATDVEL

SEQ ID NO: 88911 - protein, 17 aa, Mycobacterium avium
IAADGSARFVRYHLVPT

SEQ ID NO: 88912 - protein, 17 aa, Mycobacterium avium
IAAMAPNGIVFALSNPD

SEQ ID NO: 88913 - protein, 21 aa, Mycobacterium avium
IAARLAERGATVALTARTLDP

SEQ ID NO: 88914 - protein, 23 aa, Mycobacterium avium
IAASGRPGAVLVDIPKDVLQGQC

SEQ ID NO: 88915 - protein, 27 aa, Mycobacterium avium
IAATEAHYAEMWAQDAAAMYAYAGASA

SEQ ID NO: 88916 - protein, 19 aa, Mycobacterium avium
IADAVAWGAIGARTTESQV

SEQ ID NO: 88917 - protein, 25 aa, Mycobacterium avium
IADDRISDVLGRLRAGYRVDGREVT

SEQ ID NO: 88918 - protein, 21 aa, Mycobacterium avium
IADILLRVALGIIVFPTDRLD

SEQ ID NO: 88919 - protein, 18 aa, Mycobacterium avium
IADYSPWQGYGGRQKPSW

SEQ ID NO: 88920 - protein, 18 aa, Mycobacterium avium
IAEATLFVATIAPRAEAT

SEQ ID NO: 88921 - protein, 26 aa, Mycobacterium avium
IAELARANGWAGLIVNGAVRDSAALR

SEQ ID NO: 88922 - protein, 20 aa, Mycobacterium avium
IAERPTMAALLIKDSVNAAS

SEQ ID NO: 88923 - protein, 17 aa, Mycobacterium avium
IAGAGWAGVRWRNLTGG

SEQ ID NO: 88924 - protein, 20 aa, Mycobacterium avium
IAGAPAAIAIVVPEPPDERR

SEQ ID NO: 88925 - protein, 17 aa, Mycobacterium avium
IAGELVSLYAKRQASPG

SEQ ID NO: 88926 - protein, 47 aa, Mycobacterium avium
IAGHGVATGYARRSGLTASRFVACPFGGPGARMYRTGDLVRWNQDGQ

SEQ ID NO: 88927 - protein, 18 aa, Mycobacterium avium
IAGRGVATGYARRAGLTA

SEQ ID NO: 88928 - protein, 20 aa, Mycobacterium avium
IAGYLDRYGIRADKVRITSR

SEQ ID NO: 88929 - protein, 19 aa, Mycobacterium avium
IAHDPYHPEARHGLDELLA

SEQ ID NO: 88930 - protein, 20 aa, Mycobacterium avium
IAHKERRAVTGTSRGGSRFI

SEQ ID NO: 88931 - protein, 19 aa, Mycobacterium avium
IAHRLGLIDPQAWAFVWVV

SEQ ID NO: 88932 - protein, 22 aa, Mycobacterium avium
IAIRGQRLFLGRTRFFGREQGP

SEQ ID NO: 88933 - protein, 24 aa, Mycobacterium avium
IAKGSLRGGLVLGLEDSGSRMSRL

SEQ ID NO: 88934 - protein, 18 aa, Mycobacterium avium
IAKKWGFSRTQLDEYSVR

SEQ ID NO: 88935 - protein, 17 aa, Mycobacterium avium
IALFGLGNARRALVESL

SEQ ID NO: 88936 - protein, 31 aa, Mycobacterium avium
IALGIRRDWPRPEARVTIPARATLLLYTDGL

SEQ ID NO: 88937 - protein, 24 aa, Mycobacterium avium
IALREGIRLAYDILTKGDGFKDLV

SEQ ID NO: 88938 - protein, 26 aa, Mycobacterium avium
IALSTYRFPTGWFIVAFGSDLAPGQV

SEQ ID NO: 88939 - protein, 20 aa, Mycobacterium avium
IALTRPGGVVLYATCSPHLA

SEQ ID NO: 88940 - protein, 24 aa, Mycobacterium avium
IANRLGGLGADIALIGRTLEKVQR

SEQ ID NO: 88941 - protein, 17 aa, Mycobacterium avium
IAPAAWQHAGRGRPAKR

SEQ ID NO: 88942 - protein, 23 aa, Mycobacterium avium
IAPRPGRIWLQITAFDDDRPGFG

SEQ ID NO: 88943 - protein, 18 aa, Mycobacterium avium
IAREAGVGVGTLFRHFPT

SEQ ID NO: 88944 - protein, 19 aa, Mycobacterium avium
IARGCLADAPLGRVGLEVE

SEQ ID NO: 88945 - protein, 22 aa, Mycobacterium avium
IARIAALGRIALVLISHRHGDH

SEQ ID NO: 88946 - protein, 24 aa, Mycobacterium avium
IARPELLEEMARQFGSQCIVLSVD

SEQ ID NO: 88947 - protein, 24 aa, Mycobacterium avium
IASKWIPFGPVMLSRAHWLEDVGL

SEQ ID NO: 88948 - protein, 24 aa, Mycobacterium avium
IATDNLMRFPGRFSEHLLAEHLQK

SEQ ID NO: 88949 - protein, 23 aa, Mycobacterium avium
IATRSPIALSVTLAAVRRAADLP

SEQ ID NO: 88950 - protein, 23 aa, Mycobacterium avium
IATWKRIAGALKRDPYGRTARQV

SEQ ID NO: 88951 - protein, 18 aa, Mycobacterium avium
IAVNCVGPSTAVRTPGAA

SEQ ID NO: 88952 - protein, 23 aa, Mycobacterium avium
IAVRRPLARLGMGLHRRHRQPQG

SEQ ID NO: 88953 - protein, 23 aa, Mycobacterium avium
IAYRERLGFEVLPLSGGERPPFE

SEQ ID NO: 88954 - protein, 22 aa, Mycobacterium avium
IAYRLGRNAARMEAALSAPSIY

SEQ ID NO: 88955 - protein, 19 aa, Mycobacterium avium
ICARRGPTLQWVRSRETAD

SEQ ID NO: 88956 - protein, 26 aa, Mycobacterium avium
ICGPETLRSLYFLSSRVTGGSPHALR

SEQ ID NO: 88957 - protein, 18 aa, Mycobacterium avium
ICHLARDLAGWSHRHLGE

SEQ ID NO: 88958 - protein, 21 aa, Mycobacterium avium
ICNRTGSALGRSVKLDGAYWR

SEQ ID NO: 88959 - protein, 18 aa, Mycobacterium avium
IDAARRLRNSVAPQNISS

SEQ ID NO: 88960 - protein, 18 aa, Mycobacterium avium
IDALLSLGADACCYNPLW

SEQ ID NO: 88961 - protein, 26 aa, Mycobacterium avium
IDECHRLCVDYAKSRTLWGKNIGQFQ

SEQ ID NO: 88962 - protein, 19 aa, Mycobacterium avium
IDGPAGWGEFGAFVEYGPP

SEQ ID NO: 88963 - protein, 24 aa, Mycobacterium avium
IDHGEIRMSGGIEDVVRAYEGEDA

SEQ ID NO: 88964 - protein, 25 aa, Mycobacterium avium
IDHIIGLFRLWWIPRGSAPTEGTYV

SEQ ID NO: 88965 - protein, 18 aa, Mycobacterium avium
IDHSRAAMITAVLEKHGK

SEQ ID NO: 88966 - protein, 17 aa, Mycobacterium avium
IDIFRIFDALNNVDSMR

SEQ ID NO: 88967 - protein, 17 aa, Mycobacterium avium
IDIGSAFDHLDEPHVAR

SEQ ID NO: 88968 - protein, 25 aa, Mycobacterium avium
IDLLVKRAEALGVQIRYETGATNLI

SEQ ID NO: 88969 - protein, 17 aa, Mycobacterium avium
IDLRGRRIVIIDDVLAT

SEQ ID NO: 88970 - protein, 25 aa, Mycobacterium avium
IDPAHPTARIEFMVADAAPIAAITT

SEQ ID NO: 88971 - protein, 25 aa, Mycobacterium avium
IDPALPAARVEFMLTDAAPIVAVTT

SEQ ID NO: 88972 - protein, 23 aa, Mycobacterium avium
IDPEAFGGWKQRNHKGAGASVAD

SEQ ID NO: 88973 - protein, 21 aa, Mycobacterium avium
IDQAAAVAILQSWLDQRRAAT

SEQ ID NO: 88974 - protein, 19 aa, Mycobacterium avium
IDRPHARNAIALDTMDQLE

SEQ ID NO: 88975 - protein, 19 aa, Mycobacterium avium
IDRRDWPLFRTVFTDDCVL

SEQ ID NO: 88976 - protein, 17 aa, Mycobacterium avium
IDSLEKLAWMIKSENRT

SEQ ID NO: 88977 - protein, 28 aa, Mycobacterium avium
IDSPTDWPRYGGYALAGVSSFGFGGANA

SEQ ID NO: 88978 - protein, 18 aa, Mycobacterium avium
IDSSDEWIYSRTGIKTRR

SEQ ID NO: 88979 - protein, 24 aa, Mycobacterium avium
IDTVLRAKVDAAWNLHELTRDLDV

SEQ ID NO: 88980 - protein, 24 aa, Mycobacterium avium
IDVAELGADFFVFSGHKIYGPTGI

SEQ ID NO: 88981 - protein, 18 aa, Mycobacterium avium
IDVAHGMAKPAGLPDSPD

SEQ ID NO: 88982 - protein, 17 aa, Mycobacterium avium
IDVLARLGGDEFAWQVP

SEQ ID NO: 88983 - protein, 18 aa, Mycobacterium avium
IDVSRLHPLATMEKMFIA

SEQ ID NO: 88984 - protein, 24 aa, Mycobacterium avium
IEAKAVVVSEPFLVAIPVLQEKDI

SEQ ID NO: 88985 - protein, 25 aa, Mycobacterium avium
IEGIGRPRVEPSFLPGVVDRMVAVP

SEQ ID NO: 88986 - protein, 24 aa, Mycobacterium avium
IELLAWQFASPVRWIETQDLLFTE

SEQ ID NO: 88987 - protein, 27 aa, Mycobacterium avium
IELPNGRYGWRVCLPAMMSYWSELARD

SEQ ID NO: 88988 - protein, 28 aa, Mycobacterium avium
IELQRRGCPVRHLILLDALLVIPSSDAL

SEQ ID NO: 88989 - protein, 19 aa, Mycobacterium avium
IELWPQLRAAFTPPDEQAS

SEQ ID NO: 88990 - protein, 23 aa, Mycobacterium avium
IENVKTASAFRDSFGDDYGVTIA

SEQ ID NO: 88991 - protein, 20 aa, Mycobacterium avium
IEPELATLVGEVDLLLEPVA

SEQ ID NO: 88992 - protein, 25 aa, Mycobacterium avium
IEPSDFRLWVCLHEVTHRVQFTANP

SEQ ID NO: 88993 - protein, 24 aa, Mycobacterium avium
IEQFVYAYVRACPGYTLDYNANGS

SEQ ID NO: 88994 - protein, 19 aa, Mycobacterium avium
IEQGLKGVEFIAINTDAQA

SEQ ID NO: 88995 - protein, 19 aa, Mycobacterium avium
IEQWGISNFQIFPNLEILI

SEQ ID NO: 88996 - protein, 26 aa, Mycobacterium avium
IERDWAAKVYGAWNLHCALQESGAEQ

SEQ ID NO: 88997 - protein, 19 aa, Mycobacterium avium
IEREFKPAFGAGEGSPIWK

SEQ ID NO: 88998 - protein, 17 aa, Mycobacterium avium
IERGVADPDSWPAFVPT

SEQ ID NO: 88999 - protein, 23 aa, Mycobacterium avium
IERIALLEAAGWAVIRVSAAMLS

SEQ ID NO: 89000 - protein, 22 aa, Mycobacterium avium
IERVARNFLKYRGEGERFAQWA

SEQ ID NO: 89001 - protein, 19 aa, Mycobacterium avium
IEVACLKDEVAHLSDTSPT

SEQ ID NO: 89002 - protein, 21 aa, Mycobacterium avium
IEWAESAGLDTAWMPQVPNDF

SEQ ID NO: 89003 - protein, 25 aa, Mycobacterium avium
IEYGRSAAGWAQRVVFVNGHGGNVA

SEQ ID NO: 89004 - protein, 19 aa, Mycobacterium avium
IFGALLRGGRLVVVPEAVT

SEQ ID NO: 89005 - protein, 17 aa, Mycobacterium avium
IFRAPKSHLGWGHGVHV

SEQ ID NO: 89006 - protein, 20 aa, Mycobacterium avium
IFRMRIPKPKFVLMPTPLWD

SEQ ID NO: 89007 - protein, 24 aa, Mycobacterium avium
IFRREMDTIFKTGWVYVAHESEVS

SEQ ID NO: 89008 - protein, 17 aa, Mycobacterium avium
IFYPQLLKRGSADAEGE

SEQ ID NO: 89009 - protein, 21 aa, Mycobacterium avium
IGAAVAAAWALAHPDRAVAVL

SEQ ID NO: 89010 - protein, 18 aa, Mycobacterium avium
IGADLENIAAALSEAQKS

SEQ ID NO: 89011 - protein, 23 aa, Mycobacterium avium
IGADRIRVLSTWNGPNQVKNLWL

SEQ ID NO: 89012 - protein, 24 aa, Mycobacterium avium
IGFRVRRLAGRVVWMQPPDTPPRA

SEQ ID NO: 89013 - protein, 18 aa, Mycobacterium avium
IGGPAAWLGTALALKPLL

SEQ ID NO: 89014 - protein, 17 aa, Mycobacterium avium
IGGVRMFFVKDPDGTPV

SEQ ID NO: 89015 - protein, 24 aa, Mycobacterium avium
IGHAIEAFQAFAPQIAAFSLALPA

SEQ ID NO: 89016 - protein, 25 aa, Mycobacterium avium
IGLDQRRPGCALGEFHEVDLADPES

SEQ ID NO: 89017 - protein, 21 aa, Mycobacterium avium
IGLELAELFAQRGYDLVVAAE

SEQ ID NO: 89018 - protein, 19 aa, Mycobacterium avium
IGLLGKFMPNYLFAPSGEL

SEQ ID NO: 89019 - protein, 18 aa, Mycobacterium avium
IGLLPRLEGTVHINIGLL

SEQ ID NO: 89020 - protein, 17 aa, Mycobacterium avium
IGLRGIYRGVAKAAGLP

SEQ ID NO: 89021 - protein, 25 aa, Mycobacterium avium
IGPEFWARDVVSVMDAVGCERATVV

SEQ ID NO: 89022 - protein, 18 aa, Mycobacterium avium
IGPYRRLIVLGGDAELAL

SEQ ID NO: 89023 - protein, 17 aa, Mycobacterium avium
IGRYAVLAAGWPESIPG

SEQ ID NO: 89024 - protein, 20 aa, Mycobacterium avium
IGSDVWDRLFSGPRPAELHR

SEQ ID NO: 89025 - protein, 20 aa, Mycobacterium avium
IGSNVARTVFKSMLTAVLER

SEQ ID NO: 89026 - protein, 17 aa, Mycobacterium avium
IGSPHLLLASGIGPPNH

SEQ ID NO: 89027 - protein, 20 aa, Mycobacterium avium
IGSPIAGAAMFVLDKWLQPV

SEQ ID NO: 89028 - protein, 17 aa, Mycobacterium avium
IGTAVEEFIRWASPVMT

SEQ ID NO: 89029 - protein, 23 aa, Mycobacterium avium
IGTYPGNGWAYYGLLEIATRDGS

SEQ ID NO: 89030 - protein, 17 aa, Mycobacterium avium
IGVEVVVECAREAARRL

SEQ ID NO: 89031 - protein, 17 aa, Mycobacterium avium
IGVGPGREQTIVRRDIL

SEQ ID NO: 89032 - protein, 21 aa, Mycobacterium avium
IGYEIPRPIPRISYADAMARY

SEQ ID NO: 89033 - protein, 18 aa, Mycobacterium avium
IHAVELRPGGGAKLARSA

SEQ ID NO: 89034 - protein, 27 aa, Mycobacterium avium
IHEALELVYSLGFRLTGLLPGFTDPRN

SEQ ID NO: 89035 - protein, 18 aa, Mycobacterium avium
IHGGYGYSTEYDVERYFR

SEQ ID NO: 89036 - protein, 34 aa, Mycobacterium avium
IHHLAVDAVSWWILLEDLNIAWALHRAGQPVELA

SEQ ID NO: 89037 - protein, 20 aa, Mycobacterium avium
IHPEYTRALISLSRGGSDAC

SEQ ID NO: 89038 - protein, 24 aa, Mycobacterium avium
IHRALRPGGVLLMADIKASSRLED

SEQ ID NO: 89039 - protein, 18 aa, Mycobacterium avium
IHRLITFLKPSARSEVFG

SEQ ID NO: 89040 - protein, 24 aa, Mycobacterium avium
IIADHSRTAAILIGDGVTPGNDGR

SEQ ID NO: 89041 - protein, 24 aa, Mycobacterium avium
IIAFLRLLLPAGLETTYRSSGNLL

SEQ ID NO: 89042 - protein, 24 aa, Mycobacterium avium
IIANRVSYFYDFRGPSVAVDTACS

SEQ ID NO: 89043 - protein, 19 aa, Mycobacterium avium
IIPLIVWGAHRIWTKDHPR

SEQ ID NO: 89044 - protein, 18 aa, Mycobacterium avium
IITSPAFTGDRVLAAILF

SEQ ID NO: 89045 - protein, 19 aa, Mycobacterium avium
IKAEVAAAIGADAPTSAPT

SEQ ID NO: 89046 - protein, 25 aa, Mycobacterium avium
IKDAKKRLGYTKVVLAGWSGGGSLS

SEQ ID NO: 89047 - protein, 18 aa, Mycobacterium avium
IKDLVAIDDALKFGSRAS

SEQ ID NO: 89048 - protein, 24 aa, Mycobacterium avium
IKELSKKLAIRRFSVTTAACALLV

SEQ ID NO: 89049 - protein, 29 aa, Mycobacterium avium
IKPVFLRENWYCPVCLEVTNSALCGHEAQ

SEQ ID NO: 89050 - protein, 17 aa, Mycobacterium avium
IKSDPNWQGGDYHDTGR

SEQ ID NO: 89051 - protein, 20 aa, Mycobacterium avium
IKTFGGHSFHSSRWDYDYTG

SEQ ID NO: 89052 - protein, 21 aa, Mycobacterium avium
IKVAIPALVKQGTGGSIVLIS

SEQ ID NO: 89053 - protein, 22 aa, Mycobacterium avium
ILAALWALIGYEIPRPIPRISY

SEQ ID NO: 89054 - protein, 17 aa, Mycobacterium avium
ILAEANHPLVIQAETMD

SEQ ID NO: 89055 - protein, 22 aa, Mycobacterium avium
ILAGDKRLLLTMATGTGKTFVS

SEQ ID NO: 89056 - protein, 17 aa, Mycobacterium avium
ILASNRFRAGLAKIPGA

SEQ ID NO: 89057 - protein, 23 aa, Mycobacterium avium
ILETRLRIGPKVAELAAEQHGPE

SEQ ID NO: 89058 - protein, 18 aa, Mycobacterium avium
ILFPGAIVRARIHLTVIE

SEQ ID NO: 89059 - protein, 25 aa, Mycobacterium avium
ILGPMAKLVKVRSGYEAAVAAVLGS

SEQ ID NO: 89060 - protein, 20 aa, Mycobacterium avium
ILIHWDDFFRPLSKPLRALP

SEQ ID NO: 89061 - protein, 18 aa, Mycobacterium avium
ILMGFGYHRGRDEGQLVL

SEQ ID NO: 89062 - protein, 18 aa, Mycobacterium avium
ILQRRVVFRADRAAVQEI

SEQ ID NO: 89063 - protein, 27 aa, Mycobacterium avium
ILQRYKDLQDIIAILGIDELSEEDKQL

SEQ ID NO: 89064 - protein, 21 aa, Mycobacterium avium
ILRNFKMPGFTVPEFRRKAVI

SEQ ID NO: 89065 - protein, 20 aa, Mycobacterium avium
ILRRVPLAIVPSAQLPNTND

SEQ ID NO: 89066 - protein, 20 aa, Mycobacterium avium
ILRTNLAAVLLQMAALQLGD

SEQ ID NO: 89067 - protein, 19 aa, Mycobacterium avium
ILSAASVFVCPSVYEPLGI

SEQ ID NO: 89068 - protein, 31 aa, Mycobacterium avium
ILVLRVGAIILHPYIELHLGKPFFTEQQLRR

SEQ ID NO: 89069 - protein, 19 aa, Mycobacterium avium
ILVRGRTGIDPALLSTVDT

SEQ ID NO: 89070 - protein, 17 aa, Mycobacterium avium
IMADFTVREQGRFGFDV

SEQ ID NO: 89071 - protein, 25 aa, Mycobacterium avium
INIAGWHRFPLRDKVAAAVPATPVV

SEQ ID NO: 89072 - protein, 28 aa, Mycobacterium avium
INLAMTEFKMFYKLPVEGLDIPKSALGA

SEQ ID NO: 89073 - protein, 20 aa, Mycobacterium avium
INRHIKRGGKVWINVFPDRP

SEQ ID NO: 89074 - protein, 24 aa, Mycobacterium avium
INSNRYDPLVPWTAANQLGRDWCA

SEQ ID NO: 89075 - protein, 24 aa, Mycobacterium avium
IPGDRIPYAPPFGVAMAAWDTEEE

SEQ ID NO: 89076 - protein, 18 aa, Mycobacterium avium
IPGRHQLFMHACDVSRRP

SEQ ID NO: 89077 - protein, 21 aa, Mycobacterium avium
IPHISAPVIVKYVTDLQLLGL

SEQ ID NO: 89078 - protein, 18 aa, Mycobacterium avium
IPHRDCGSFAAGGMASAD

SEQ ID NO: 89079 - protein, 22 aa, Mycobacterium avium
IPSCGRCPSCSTGHQSLCDLGA

SEQ ID NO: 89080 - protein, 18 aa, Mycobacterium avium
IPSGLAFDTVFTGDPSDR

SEQ ID NO: 89081 - protein, 20 aa, Mycobacterium avium
IPYRASRSAFAFKDTLAGGI

SEQ ID NO: 89082 - protein, 20 aa, Mycobacterium avium
IQLARLIWRVQGLKITITGV

SEQ ID NO: 89083 - protein, 22 aa, Mycobacterium avium
IQLCIRRHGRVVLNRAIGHGWG

SEQ ID NO: 89084 - protein, 23 aa, Mycobacterium avium
IQREVVARTGLRDCRTHGRTWDL

SEQ ID NO: 89085 - protein, 17 aa, Mycobacterium avium
IRADCLGVQDPLPAWAE

SEQ ID NO: 89086 - protein, 21 aa, Mycobacterium avium
IRAGESVSYGHTWTAQRDTNL

SEQ ID NO: 89087 - protein, 20 aa, Mycobacterium avium
IRAGIDCIEHGFLASDETIQ

SEQ ID NO: 89088 - protein, 21 aa, Mycobacterium avium
IRARTGVVLATGSFAYNDSMV

SEQ ID NO: 89089 - protein, 25 aa, Mycobacterium avium
IRARVAAALPDYMTPAAYVVLDEIP

SEQ ID NO: 89090 - protein, 32 aa, Mycobacterium avium
IRARWVRALVDLRVARLLAYRAVSLQDDPAAG

SEQ ID NO: 89091 - protein, 18 aa, Mycobacterium avium
IRDRWKRAVSLVESLMGD

SEQ ID NO: 89092 - protein, 18 aa, Mycobacterium avium
IREIPLGDVVKAVVQVEF

SEQ ID NO: 89093 - protein, 21 aa, Mycobacterium avium
IRGRIKELINRGGEKISPERV

SEQ ID NO: 89094 - protein, 18 aa, Mycobacterium avium
IRIDSARMLPALDGAIGA

SEQ ID NO: 89095 - protein, 18 aa, Mycobacterium avium
IRKHIAWYLHGFPAGSEL

SEQ ID NO: 89096 - protein, 22 aa, Mycobacterium avium
IRLGAELCALLPHEREAHALSA

SEQ ID NO: 89097 - protein, 18 aa, Mycobacterium avium
IRLGFGIMHLPPAVNHPA

SEQ ID NO: 89098 - protein, 17 aa, Mycobacterium avium
IRLRFGLDDGQPRTLDQ

SEQ ID NO: 89099 - protein, 20 aa, Mycobacterium avium
IRMPAFGLDGPWRDRVGFAQ

SEQ ID NO: 89100 - protein, 26 aa, Mycobacterium avium
IRQVTSITWCRRRTVQVGRIAARVPQ

SEQ ID NO: 89101 - protein, 19 aa, Mycobacterium avium
IRRGHDAIRAFYAGFQDAK

SEQ ID NO: 89102 - protein, 17 aa, Mycobacterium avium
IRRVCAQTSSLPPLPAP

SEQ ID NO: 89103 - protein, 24 aa, Mycobacterium avium
IRSEEVPVVVLLWSPRSDACVQLL

SEQ ID NO: 89104 - protein, 19 aa, Mycobacterium avium
IRTRGRLWLASRADRAMWL

SEQ ID NO: 89105 - protein, 17 aa, Mycobacterium avium
ISAVWGVGDTPPGKRLG

SEQ ID NO: 89106 - protein, 29 aa, Mycobacterium avium
ISDAGLIAPHWPKPWGLDAGPLRQLIIDD

SEQ ID NO: 89107 - protein, 20 aa, Mycobacterium avium
ISEALARLGKLRERFKNLHV

SEQ ID NO: 89108 - protein, 24 aa, Mycobacterium avium
ISEFPTDRGWDLAALYDPDPDARH

SEQ ID NO: 89109 - protein, 24 aa, Mycobacterium avium
ISGPHLNYAGAFLRSARTPRAVAR

SEQ ID NO: 89110 - protein, 27 aa, Mycobacterium avium
ISKGGKFPTARLVVFKLSGDFDPAQVI

SEQ ID NO: 89111 - protein, 18 aa, Mycobacterium avium
ISLAEANCLGQLSPAVAD

SEQ ID NO: 89112 - protein, 17 aa, Mycobacterium avium
ISPVTVWVSTEYVRASP

SEQ ID NO: 89113 - protein, 28 aa, Mycobacterium avium
ISSHFLPGIAGPAGWRVYLGTRRDEQQE

SEQ ID NO: 89114 - protein, 19 aa, Mycobacterium avium
ISTVRCFQDNALLKSVLSE

SEQ ID NO: 89115 - protein, 21 aa, Mycobacterium avium
ITAAWRKLLTNALAGFMALSR

SEQ ID NO: 89116 - protein, 17 aa, Mycobacterium avium
ITAESWSRIIDVNLTGT

SEQ ID NO: 89117 - protein, 19 aa, Mycobacterium avium
ITASIANWGSKALQFINAD

SEQ ID NO: 89118 - protein, 17 aa, Mycobacterium avium
ITATMLVPSMIYALMDH

SEQ ID NO: 89119 - protein, 21 aa, Mycobacterium avium
ITCAIRAWAYQIDDLARDYRV

SEQ ID NO: 89120 - protein, 25 aa, Mycobacterium avium
ITDLPEGRWSEFLEEPRIAARVAGA

SEQ ID NO: 89121 - protein, 17 aa, Mycobacterium avium
ITDRILLLDGLPNYQRL

SEQ ID NO: 89122 - protein, 25 aa, Mycobacterium avium
ITDRLKDMYICGGFNVYPAEVEQVL

SEQ ID NO: 89123 - protein, 25 aa, Mycobacterium avium
ITELRYRQMRNFWATLMVSQGTPMI

SEQ ID NO: 89124 - protein, 23 aa, Mycobacterium avium
ITGWDYPSCEAIGLLKMDFLGLR

SEQ ID NO: 89125 - protein, 17 aa, Mycobacterium avium
ITLARMMTRRQFGRTLF

SEQ ID NO: 89126 - protein, 27 aa, Mycobacterium avium
ITLGNLRARFNIALGIGSSGFSGNRVC

SEQ ID NO: 89127 - protein, 19 aa, Mycobacterium avium
ITPGEALAGITPANISGPG

SEQ ID NO: 89128 - protein, 41 aa, Mycobacterium avium
ITQQRPSRLVVCLDLDWRPQFRVDLVPSYKAHRVAEAEPAG

SEQ ID NO: 89129 - protein, 24 aa, Mycobacterium avium
IVAELFKPLPSMVVAHYLGVPEED

SEQ ID NO: 89130 - protein, 17 aa, Mycobacterium avium
IVALEAKLAAAHWDVVK

SEQ ID NO: 89131 - protein, 25 aa, Mycobacterium avium
IVAVAKRFGDKSVRSAHAVFSRAVA

SEQ ID NO: 89132 - protein, 22 aa, Mycobacterium avium
IVCVDPRLTPVARHATVHLAPL

SEQ ID NO: 89133 - protein, 19 aa, Mycobacterium avium
IVDKCLQIFGGYGYMTEYP

SEQ ID NO: 89134 - protein, 30 aa, Mycobacterium avium
IVDVGSVLELRPDYGVGIVTALVRVEGVPY

SEQ ID NO: 89135 - protein, 29 aa, Mycobacterium avium
IVGHDRLRLALLLCAVRPEIGGALIRGEK

SEQ ID NO: 89136 - protein, 24 aa, Mycobacterium avium
IVLANAGIAPLAFRQLSIEEELAQ

SEQ ID NO: 89137 - protein, 34 aa, Mycobacterium avium
IVPIGAGCKICDRPACPQRAFPYLGRPVSVDPHR

SEQ ID NO: 89138 - protein, 19 aa, Mycobacterium avium
IVVAHELFHYASRADTVAD

SEQ ID NO: 89139 - protein, 24 aa, Mycobacterium avium
IWFFLAPGAPEWAIRSGATVKVFE

SEQ ID NO: 89140 - protein, 20 aa, Mycobacterium avium
IYADEIFAWMAHTPVDEIRE

SEQ ID NO: 89141 - protein, 19 aa, Mycobacterium avium
IYFCDPHSPWQRGTNENTN

SEQ ID NO: 89142 - protein, 18 aa, Mycobacterium avium
IYGGALLVEQAAWERATR

SEQ ID NO: 89143 - protein, 24 aa, Mycobacterium avium
IYNKHMIFPKPGVDLSNPDNFASI

SEQ ID NO: 89144 - protein, 27 aa, Mycobacterium avium
IYQNLGAAHPMVWYKSFNYNLASQQPV

SEQ ID NO: 89145 - protein, 21 aa, Mycobacterium avium
IYREVEGLPKGSVKAVIDAFG

SEQ ID NO: 89146 - protein, 18 aa, Mycobacterium avium
IYRFEGQVSVCWEDAPDG

SEQ ID NO: 89147 - protein, 25 aa, Mycobacterium avium
IYSDGRYSYQLTIYVFRYGEGTAMA

SEQ ID NO: 89148 - protein, 27 aa, Mycobacterium avium
IYTSPDIRALYAFKRLAWWPYSVAMRQ

SEQ ID NO: 89149 - protein, 22 aa, Mycobacterium avium
IYYNERYDFWALSRHSDVERAL

SEQ ID NO: 89150 - protein, 18 aa, Mycobacterium avium
KAAPVLWSQQVVTTGALR

SEQ ID NO: 89151 - protein, 17 aa, Mycobacterium avium
KAARQGDPWTLSGQKNP

SEQ ID NO: 89152 - protein, 20 aa, Mycobacterium avium
KAFQRFAENLVFDRAPRLVR

SEQ ID NO: 89153 - protein, 33 aa, Mycobacterium avium
KAGASGWCTAAPCLRPQPCIDLYDAVRANDLDT

SEQ ID NO: 89154 - protein, 22 aa, Mycobacterium avium
KAGDKLWARMDIVSVDERFGAD

SEQ ID NO: 89155 - protein, 18 aa, Mycobacterium avium
KAGLWPYLEKLGFYLVGY

SEQ ID NO: 89156 - protein, 19 aa, Mycobacterium avium
KAGVDIVVACPGRLEDLMR

SEQ ID NO: 89157 - protein, 23 aa, Mycobacterium avium
KAKALGLRPRARIISQALVGAEP

SEQ ID NO: 89158 - protein, 18 aa, Mycobacterium avium
KAKKLRVRLPLPKLTVAV

SEQ ID NO: 89159 - protein, 20 aa, Mycobacterium avium
KALAALDGWTTDALDYGGHD

SEQ ID NO: 89160 - protein, 19 aa, Mycobacterium avium
KALADFAQRGWIRQQGKAL

SEQ ID NO: 89161 - protein, 23 aa, Mycobacterium avium
KALLARIGDAFLALPEGFTAHPR

SEQ ID NO: 89162 - protein, 19 aa, Mycobacterium avium
KALLRRLVEAGTRVVQYGY

SEQ ID NO: 89163 - protein, 24 aa, Mycobacterium avium
KALPKLANQFLRAWVPEDGGGIPW

SEQ ID NO: 89164 - protein, 23 aa, Mycobacterium avium
KAMARPTLRHRVMLRPEAELEGA

SEQ ID NO: 89165 - protein, 21 aa, Mycobacterium avium
KANPAVRVRVGGRWRTGTAHL

SEQ ID NO: 89166 - protein, 20 aa, Mycobacterium avium
KAQIGKGMWAMTELMADMVE

SEQ ID NO: 89167 - protein, 18 aa, Mycobacterium avium
KARAAWLSTGATLAGLSA

SEQ ID NO: 89168 - protein, 25 aa, Mycobacterium avium
KASMFRFGCVCGGASLYAPQAHNNI

SEQ ID NO: 89169 - protein, 18 aa, Mycobacterium avium
KASTLRLDGLTVVVDCAH

SEQ ID NO: 89170 - protein, 19 aa, Mycobacterium avium
KAVELDHQLLLSGGFQQIG

SEQ ID NO: 89171 - protein, 24 aa, Mycobacterium avium
KAVQRSAGALAIGPVLQGLRKPVN

SEQ ID NO: 89172 - protein, 17 aa, Mycobacterium avium
KAYAGAADGVGWSEGGA

SEQ ID NO: 89173 - protein, 27 aa, Mycobacterium avium
KCILCAACTTSCPIFWHEGSYYGPAAI

SEQ ID NO: 89174 - protein, 19 aa, Mycobacterium avium
KCLATAVAVMQLYEQGKVA

SEQ ID NO: 89175 - protein, 17 aa, Mycobacterium avium
KDATYGWNIGPKEDVMC

SEQ ID NO: 89176 - protein, 17 aa, Mycobacterium avium
KDFAALMPLVPPDTVAQ

SEQ ID NO: 89177 - protein, 21 aa, Mycobacterium avium
KDGDAIAGAFGYWRESGQFVL

SEQ ID NO: 89178 - protein, 18 aa, Mycobacterium avium
KDIAQRLATRVAEAVSAA

SEQ ID NO: 89179 - protein, 23 aa, Mycobacterium avium
KDIPLRVKAAAVGLAADEYHAQD

SEQ ID NO: 89180 - protein, 20 aa, Mycobacterium avium
KDPDIIIGRYIPNLVPRPFT

SEQ ID NO: 89181 - protein, 26 aa, Mycobacterium avium
KDRGCSHPGCDVSGYSCEVHHVTGYA

SEQ ID NO: 89182 - protein, 25 aa, Mycobacterium avium
KDRMIGIDATHAWAAVWTPHEPGQF

SEQ ID NO: 89183 - protein, 19 aa, Mycobacterium avium
KDSPLARALAKLGVGADDV

SEQ ID NO: 89184 - protein, 29 aa, Mycobacterium avium
KDTPEMMPLPIALAHRLSRRLTEVRKSGV

SEQ ID NO: 89185 - protein, 24 aa, Mycobacterium avium
KDTRGVIRVHQFDKVEGFVYCTPA

SEQ ID NO: 89186 - protein, 19 aa, Mycobacterium avium
KDVFVPRHRFLSYKAMNDG

SEQ ID NO: 89187 - protein, 26 aa, Mycobacterium avium
KDVLQGQCTFSWPPRIHLPGYKPTTK

SEQ ID NO: 89188 - protein, 20 aa, Mycobacterium avium
KDVRRWWRSDSLWQAHDARY

SEQ ID NO: 89189 - protein, 20 aa, Mycobacterium avium
KDWTEPGFMGLGMIYTAMPV

SEQ ID NO: 89190 - protein, 18 aa, Mycobacterium avium
KEALRRFGAVDVVCNNAG

SEQ ID NO: 89191 - protein, 21 aa, Mycobacterium avium
KELEAAMATARRDLDAARGEI

SEQ ID NO: 89192 - protein, 18 aa, Mycobacterium avium
KEVYARDLTLDKFLDATT

SEQ ID NO: 89193 - protein, 24 aa, Mycobacterium avium
KFAAEHPWLLGAYLTHTFGVDEVQ

SEQ ID NO: 89194 - protein, 19 aa, Mycobacterium avium
KFCHQLPGWIDQATRERAE

SEQ ID NO: 89195 - protein, 22 aa, Mycobacterium avium
KFDGGTLPPMFVDLINAPTRRQ

SEQ ID NO: 89196 - protein, 24 aa, Mycobacterium avium
KFDRCSWHPGPHRLPILDDAAAWF

SEQ ID NO: 89197 - protein, 24 aa, Mycobacterium avium
KFERLYRAAPLMRFGGGTNEVLRD

SEQ ID NO: 89198 - protein, 17 aa, Mycobacterium avium
KFLRYNANKALMNLGYE

SEQ ID NO: 89199 - protein, 18 aa, Mycobacterium avium
KFLTPGLHRQRHSGSVTN

SEQ ID NO: 89200 - protein, 17 aa, Mycobacterium avium
KGAAALAERARRLLGEH

SEQ ID NO: 89201 - protein, 23 aa, Mycobacterium avium
KGAPTPVAWTRMRVPRSLMASIG

SEQ ID NO: 89202 - protein, 20 aa, Mycobacterium avium
KGDDGRMVFLKRPVAPYFVP

SEQ ID NO: 89203 - protein, 17 aa, Mycobacterium avium
KGFKSFASPTTLRFEPG

SEQ ID NO: 89204 - protein, 26 aa, Mycobacterium avium
KGHFATMRHAAAYWRGLSKAGKAVDG

SEQ ID NO: 89205 - protein, 21 aa, Mycobacterium avium
KGIELRYVLAMQLAVHGPADI

SEQ ID NO: 89206 - protein, 22 aa, Mycobacterium avium
KGKSLPADVLIFDLEDAVGPDA

SEQ ID NO: 89207 - protein, 20 aa, Mycobacterium avium
KGKTLHWVIEHLRRSGSGAL

SEQ ID NO: 89208 - protein, 27 aa, Mycobacterium avium
KGRNVEIPDHYRLYVSQKLARLERFDR

SEQ ID NO: 89209 - protein, 25 aa, Mycobacterium avium
KGTLFRRFGSRAGLMMVLLDEDERA

SEQ ID NO: 89210 - protein, 22 aa, Mycobacterium avium
KGWRQPELKAAGAAMATTALAS

SEQ ID NO: 89211 - protein, 26 aa, Mycobacterium avium
KHAAETCRGCSLFADATQTVFGNGHP

SEQ ID NO: 89212 - protein, 19 aa, Mycobacterium avium
KHLTYRYGQFTAVDDVTLQ

SEQ ID NO: 89213 - protein, 19 aa, Mycobacterium avium
KHVDKRIRELLAHQRFPVH

SEQ ID NO: 89214 - protein, 17 aa, Mycobacterium avium
KIGSLAITEPGGGSDVG

SEQ ID NO: 89215 - protein, 26 aa, Mycobacterium avium
KIIGCFRTGGGLPYTEFPRFHALMAE

SEQ ID NO: 89216 - protein, 21 aa, Mycobacterium avium
KILGPQFLSRFYGRVINTHPA

SEQ ID NO: 89217 - protein, 21 aa, Mycobacterium avium
KIPLVMLLEGAGFRPTGGHYG

SEQ ID NO: 89218 - protein, 18 aa, Mycobacterium avium
KKILGFDPDKTFQVRDEV

SEQ ID NO: 89219 - protein, 40 aa, Mycobacterium avium
KKLPSVQVGDPFMEKVLIECCLELYAGGLVVGIQDLGGAG

SEQ ID NO: 89220 - protein, 21 aa, Mycobacterium avium
KKPLPFLLGMMNLVLHGVGQP

SEQ ID NO: 89221 - protein, 19 aa, Mycobacterium avium
KKVADEIGFEQTVDVGELM

SEQ ID NO: 89222 - protein, 17 aa, Mycobacterium avium
KLAAAHWDVVKRRDADL

SEQ ID NO: 89223 - protein, 18 aa, Mycobacterium avium
KLAPAFAGIGEFGGFDAV

SEQ ID NO: 89224 - protein, 34 aa, Mycobacterium avium
KLAQLMFAVELDWRSRLGGWGLMSNAAHPGLAKT

SEQ ID NO: 89225 - protein, 21 aa, Mycobacterium avium
KLAVSRWVRRHAVLAEWAGSG

SEQ ID NO: 89226 - protein, 18 aa, Mycobacterium avium
KLELRRVAHFDGTVEAYL

SEQ ID NO: 89227 - protein, 19 aa, Mycobacterium avium
KLFGLSRERVRQIERDVMS

SEQ ID NO: 89228 - protein, 17 aa, Mycobacterium avium
KLGCYGIQRIHPLKNVL

SEQ ID NO: 89229 - protein, 22 aa, Mycobacterium avium
KLHSGQTLIGFLAPRNADNSIG

SEQ ID NO: 89230 - protein, 20 aa, Mycobacterium avium
KLIDCANAYCTVGEMVSALK

SEQ ID NO: 89231 - protein, 18 aa, Mycobacterium avium
KLIEVLRRRGRILQSAPD

SEQ ID NO: 89232 - protein, 25 aa, Mycobacterium avium
KLIRSKGVGVFFCTQLPTDIPNDVL

SEQ ID NO: 89233 - protein, 21 aa, Mycobacterium avium
KLLAAEGLLALAWPKEHGGGG

SEQ ID NO: 89234 - protein, 25 aa, Mycobacterium avium
KLPPWNEVLQNLGFSNASTAVTRPA

SEQ ID NO: 89235 - protein, 23 aa, Mycobacterium avium
KLRELYLATCGLRRADLATAAQE

SEQ ID NO: 89236 - protein, 22 aa, Mycobacterium avium
KLRLAPIKFLSALVSDGDLRNL

SEQ ID NO: 89237 - protein, 24 aa, Mycobacterium avium
KLSDFKGRKVIVYFYPAASTPGCT

SEQ ID NO: 89238 - protein, 18 aa, Mycobacterium avium
KLSGKRIIIDPGRGGADH

SEQ ID NO: 89239 - protein, 22 aa, Mycobacterium avium
KMQARFAMTVLLTTHYMEEADA

SEQ ID NO: 89240 - protein, 24 aa, Mycobacterium avium
KMTSRWCYRSEVKANWKLYMDAFQ

SEQ ID NO: 89241 - protein, 34 aa, Mycobacterium avium
KMTWRSMISDGLAMRHGKEMTWSQVVMAANTPML

SEQ ID NO: 89242 - protein, 21 aa, Mycobacterium avium
KNFQYTAAAQKVWAQAGFRPV

SEQ ID NO: 89243 - protein, 17 aa, Mycobacterium avium
KNLPFPMLSDIKRELSL

SEQ ID NO: 89244 - protein, 22 aa, Mycobacterium avium
KPADIVSALALPVPSLVISQLL

SEQ ID NO: 89245 - protein, 19 aa, Mycobacterium avium
KPAELAAVVSSVLYESRGG

SEQ ID NO: 89246 - protein, 25 aa, Mycobacterium avium
KPAESAPPGLGRLVAALRRLQDLTV

SEQ ID NO: 89247 - protein, 19 aa, Mycobacterium avium
KPAFGAGEGSPIWKLKGTA

SEQ ID NO: 89248 - protein, 18 aa, Mycobacterium avium
KPDAPSYFVLAPRDGGAV

SEQ ID NO: 89249 - protein, 22 aa, Mycobacterium avium
KPFAEITIEDWNRHLAVNLTGT

SEQ ID NO: 89250 - protein, 19 aa, Mycobacterium avium
KPLIPLAVSAFLTSRKKAA

SEQ ID NO: 89251 - protein, 28 aa, Mycobacterium avium
KPNLDFPTGPAYYLMGFDIGAFTPIFVM

SEQ ID NO: 89252 - protein, 20 aa, Mycobacterium avium
KPPELSWEVAGSLYVVGVTA

SEQ ID NO: 89253 - protein, 18 aa, Mycobacterium avium
KPSRGLAPYGPQTGELML

SEQ ID NO: 89254 - protein, 18 aa, Mycobacterium avium
KPTGWFQVAWSDEIGVGD

SEQ ID NO: 89255 - protein, 33 aa, Mycobacterium avium
KPVYLGASWEGGWRCGEVVLSLVADNARAAWSA

SEQ ID NO: 89256 - protein, 17 aa, Mycobacterium avium
KPWSERKRYIWWDPDQR

SEQ ID NO: 89257 - protein, 23 aa, Mycobacterium avium
KQGEASAGYMLMKPLVESATAAG

SEQ ID NO: 89258 - protein, 18 aa, Mycobacterium avium
KQLAAWCECRGRDDIVAT

SEQ ID NO: 89259 - protein, 22 aa, Mycobacterium avium
KRCVWLCDSFEGVPPPDTAHYQ

SEQ ID NO: 89260 - protein, 18 aa, Mycobacterium avium
KRDAEGALRVSVEDAQAL

SEQ ID NO: 89261 - protein, 20 aa, Mycobacterium avium
KREVLFAGPVLRPSTTLVRR

SEQ ID NO: 89262 - protein, 24 aa, Mycobacterium avium
KRGEAGAYLNGWDPLLQQGLPQPT

SEQ ID NO: 89263 - protein, 19 aa, Mycobacterium avium
KRINTIVASAIEFEIKDPG

SEQ ID NO: 89264 - protein, 18 aa, Mycobacterium avium
KRIRGYEVDEANAVRVHS

SEQ ID NO: 89265 - protein, 19 aa, Mycobacterium avium
KRKGVLIGDTVMIRKAGDV

SEQ ID NO: 89266 - protein, 20 aa, Mycobacterium avium
KRLTLFLIPMDRPGFTVRPI

SEQ ID NO: 89267 - protein, 25 aa, Mycobacterium avium
KRLTSCGRPTLFARTALLDADGNPV

SEQ ID NO: 89268 - protein, 18 aa, Mycobacterium avium
KRMDECIEIIQGLTTGEY

SEQ ID NO: 89269 - protein, 19 aa, Mycobacterium avium
KRMGDGLMAVFGDPTVAVR

SEQ ID NO: 89270 - protein, 23 aa, Mycobacterium avium
KRPEFGKLTPLYPNQRLRLETTP

SEQ ID NO: 89271 - protein, 17 aa, Mycobacterium avium
KRPEPRLAQGREHVVAT

SEQ ID NO: 89272 - protein, 20 aa, Mycobacterium avium
KRSPHPFAATAIGLAVFLDK

SEQ ID NO: 89273 - protein, 26 aa, Mycobacterium avium
KRTQWWGRQMLIWGVHVHVGISSPNK

SEQ ID NO: 89274 - protein, 18 aa, Mycobacterium avium
KRVRKWAGAQDEPNEKYR

SEQ ID NO: 89275 - protein, 24 aa, Mycobacterium avium
KRVRTRWINFAAHAKPAGPAGSPE

SEQ ID NO: 89276 - protein, 17 aa, Mycobacterium avium
KSGFFEREITPVTLPDG

SEQ ID NO: 89277 - protein, 17 aa, Mycobacterium avium
KSHIGRIFGKLDLRDRA

SEQ ID NO: 89278 - protein, 17 aa, Mycobacterium avium
KSLLPGPLLPTVAAGAV

SEQ ID NO: 89279 - protein, 17 aa, Mycobacterium avium
KSPRLVKPEILASNRFR

SEQ ID NO: 89280 - protein, 19 aa, Mycobacterium avium
KSRLLPGLIDGTVTAGIGL

SEQ ID NO: 89281 - protein, 27 aa, Mycobacterium avium
KSSRYPGGLALRFARVLRYRDDKGPAE

SEQ ID NO: 89282 - protein, 20 aa, Mycobacterium avium
KSVAAKDVWVRPTERARAEA

SEQ ID NO: 89283 - protein, 20 aa, Mycobacterium avium
KTAETFKTFNGVRYAIPGDY

SEQ ID NO: 89284 - protein, 21 aa, Mycobacterium avium
KTGIDTCLWLLGQGVEPDRLT

SEQ ID NO: 89285 - protein, 18 aa, Mycobacterium avium
KTGIRLRLFHGRGGTVGR

SEQ ID NO: 89286 - protein, 24 aa, Mycobacterium avium
KTGRTSAQLLPRFETITYGEVAQR

SEQ ID NO: 89287 - protein, 22 aa, Mycobacterium avium
KTLKEKGFRLLAMTPQGSACGL

SEQ ID NO: 89288 - protein, 21 aa, Mycobacterium avium
KTLRGYSAWVTGLRRSEAATR

SEQ ID NO: 89289 - protein, 17 aa, Mycobacterium avium
KTLRLVAQYADVWNSMS

SEQ ID NO: 89290 - protein, 22 aa, Mycobacterium avium
KTMGIPILYPWANRLGGNTYAA

SEQ ID NO: 89291 - protein, 19 aa, Mycobacterium avium
KTNLLEALWYSSTLGSHRV

SEQ ID NO: 89292 - protein, 19 aa, Mycobacterium avium
KTQLGWRPVHTSAQALAAL

SEQ ID NO: 89293 - protein, 20 aa, Mycobacterium avium
KTQTFFPWDSWEHPDPAMPR

SEQ ID NO: 89294 - protein, 21 aa, Mycobacterium avium
KTRDELSCLRRAARITEEAIV

SEQ ID NO: 89295 - protein, 20 aa, Mycobacterium avium
KTRHAVLAVAQWLRDESAPE

SEQ ID NO: 89296 - protein, 17 aa, Mycobacterium avium
KTTAVRTPSGYRLDGVK

SEQ ID NO: 89297 - protein, 17 aa, Mycobacterium avium
KVARIVMDATVLKDTMV

SEQ ID NO: 89298 - protein, 21 aa, Mycobacterium avium
KVFRRDGMLLAVDRNMQPNPD

SEQ ID NO: 89299 - protein, 17 aa, Mycobacterium avium
KVGPDFIDPGYHGLAAG

SEQ ID NO: 89300 - protein, 27 aa, Mycobacterium avium
KVGYPAKWRDYSALVIDRGDLYGNYQR

SEQ ID NO: 89301 - protein, 18 aa, Mycobacterium avium
KVIGWALEQQRLPLRATV

SEQ ID NO: 89302 - protein, 25 aa, Mycobacterium avium
KVNDFLWMRIMNVPEVLPKRAYRAD

SEQ ID NO: 89303 - protein, 18 aa, Mycobacterium avium
KVRGLALMADVWPLRPDC

SEQ ID NO: 89304 - protein, 18 aa, Mycobacterium avium
KVSLATLRLRAGECAVAY

SEQ ID NO: 89305 - protein, 20 aa, Mycobacterium avium
KVVDDEFPGRVLLAEANQWP

SEQ ID NO: 89306 - protein, 19 aa, Mycobacterium avium
KVVDGAATVTVDWDPERVA

SEQ ID NO: 89307 - protein, 20 aa, Mycobacterium avium
KVYLDLRVKVAKNWQSDPKQ

SEQ ID NO: 89308 - protein, 22 aa, Mycobacterium avium
KWLRPAPEGVVGELYIAGRGVA

SEQ ID NO: 89309 - protein, 25 aa, Mycobacterium avium
KWRAHPADVLPLWVAEMDVKLAPTV

SEQ ID NO: 89310 - protein, 19 aa, Mycobacterium avium
KWTLEDGLRALLEWIGNRP

SEQ ID NO: 89311 - protein, 18 aa, Mycobacterium avium
KYAIPRMLDRGGGAIVNM

SEQ ID NO: 89312 - protein, 25 aa, Mycobacterium avium
KYGEGPCLAAAWEHHVMHIADLAAE

SEQ ID NO: 89313 - protein, 20 aa, Mycobacterium avium
KYPDRLTVLHWLESLQGLPS

SEQ ID NO: 89314 - protein, 25 aa, Mycobacterium avium
KYPVALRLGGLSWGQVVGGDEALGA

SEQ ID NO: 89315 - protein, 18 aa, Mycobacterium avium
LAAAAAWNALSAELRSAA

SEQ ID NO: 89316 - protein, 25 aa, Mycobacterium avium
LAAAARYLGALGMDAVQAHEERLVA

SEQ ID NO: 89317 - protein, 20 aa, Mycobacterium avium
LAAARFAQHGQAFQAVSAEA

SEQ ID NO: 89318 - protein, 20 aa, Mycobacterium avium
LAAARRLGAHQAYTPQQAVE

SEQ ID NO: 89319 - protein, 18 aa, Mycobacterium avium
LAADEYQGFMAIRQWAKQ

SEQ ID NO: 89320 - protein, 20 aa, Mycobacterium avium
LAADGAGLGTAWGTQLAVAM

SEQ ID NO: 89321 - protein, 17 aa, Mycobacterium avium
LAADSFGAHLLVDPREE

SEQ ID NO: 89322 - protein, 19 aa, Mycobacterium avium
LAAECLAPGGRLVFNTFLA

SEQ ID NO: 89323 - protein, 36 aa, Mycobacterium avium
LAAEICDGWLPIFYTPRLADMYNEWLDEGFARPGAR

SEQ ID NO: 89324 - protein, 19 aa, Mycobacterium avium
LAAFCADLALRTRRIDVDY

SEQ ID NO: 89325 - protein, 26 aa, Mycobacterium avium
LAAFPRYHPRWAWWLTSVPVLREFLV

SEQ ID NO: 89326 - protein, 18 aa, Mycobacterium avium
LAAKGGWGPGGRGEYLVR

SEQ ID NO: 89327 - protein, 18 aa, Mycobacterium avium
LAAKGLAAKGGWGPGGRG

SEQ ID NO: 89328 - protein, 19 aa, Mycobacterium avium
LAALCARVGADIDDVTCCM

SEQ ID NO: 89329 - protein, 17 aa, Mycobacterium avium
LAARLLSRHELRSRYVA

SEQ ID NO: 89330 - protein, 22 aa, Mycobacterium avium
LAARLRLDVRVAHVEGDDLLAR

SEQ ID NO: 89331 - protein, 27 aa, Mycobacterium avium
LAARTGLEPGTQWLSVRGYRQADGAPV

SEQ ID NO: 89332 - protein, 17 aa, Mycobacterium avium
LAASSRRSAWWAGTVTL

SEQ ID NO: 89333 - protein, 19 aa, Mycobacterium avium
LADADRAGRIRLHVRIDER

SEQ ID NO: 89334 - protein, 29 aa, Mycobacterium avium
LADALSRRGVGFGDRVMVLMLNRPEFMES

SEQ ID NO: 89335 - protein, 20 aa, Mycobacterium avium
LADKQGIQWMLVDSEVDLRA

SEQ ID NO: 89336 - protein, 19 aa, Mycobacterium avium
LADNEFLQFASRSFVAPPV

SEQ ID NO: 89337 - protein, 18 aa, Mycobacterium avium
LADRLNLAITALREEAEA

SEQ ID NO: 89338 - protein, 18 aa, Mycobacterium avium
LAEELAIPVLMNGMARGA

SEQ ID NO: 89339 - protein, 20 aa, Mycobacterium avium
LAEERRLLVAAMGRARQRLL

SEQ ID NO: 89340 - protein, 22 aa, Mycobacterium avium
LAEFRFVGTFATSLVEEKILTH

SEQ ID NO: 89341 - protein, 17 aa, Mycobacterium avium
LAEGGALGSVIFDGLLR

SEQ ID NO: 89342 - protein, 23 aa, Mycobacterium avium
LAEGLTKAAALMEGHEADSSHAF

SEQ ID NO: 89343 - protein, 25 aa, Mycobacterium avium
LAELERRVAEFLGFSTVLTSVGQVY

SEQ ID NO: 89344 - protein, 22 aa, Mycobacterium avium
LAEMQLPIGSVIVNRNIPAYLQ

SEQ ID NO: 89345 - protein, 17 aa, Mycobacterium avium
LAERARRLLGEHTVPSA

SEQ ID NO: 89346 - protein, 19 aa, Mycobacterium avium
LAERGYRYGPAFRGLTSMW

SEQ ID NO: 89347 - protein, 20 aa, Mycobacterium avium
LAERLQRILAAMAADPARLL

SEQ ID NO: 89348 - protein, 22 aa, Mycobacterium avium
LAETFCRDGVLEIRGFEPLRGR

SEQ ID NO: 89349 - protein, 24 aa, Mycobacterium avium
LAFAGKGRAGIAIGNPDKSRNTAV

SEQ ID NO: 89350 - protein, 17 aa, Mycobacterium avium
LAFASLDRWPGTVAEYL

SEQ ID NO: 89351 - protein, 19 aa, Mycobacterium avium
LAGVKPVYLGASWEGGWRC

SEQ ID NO: 89352 - protein, 32 aa, Mycobacterium avium
LAHFIRTGQEFSWRAEELFAAIAAGDITVEVG

SEQ ID NO: 89353 - protein, 19 aa, Mycobacterium avium
LAHIDGCHAYPCVAHDIEL

SEQ ID NO: 89354 - protein, 21 aa, Mycobacterium avium
LAIACLRAHGLAASYVSGYLA

SEQ ID NO: 89355 - protein, 22 aa, Mycobacterium avium
LAICAAVQVLGHWYETSAGERV

SEQ ID NO: 89356 - protein, 20 aa, Mycobacterium avium
LAKLEGDAAFFWAPDSSAKV

SEQ ID NO: 89357 - protein, 19 aa, Mycobacterium avium
LAKLGGPVDRDEWFMTPQT

SEQ ID NO: 89358 - protein, 17 aa, Mycobacterium avium
LAKQFGVRLPPRRPFGR

SEQ ID NO: 89359 - protein, 19 aa, Mycobacterium avium
LALAPKGIWLGPKELRTFY

SEQ ID NO: 89360 - protein, 18 aa, Mycobacterium avium
LALLCRMAAVPWVGAVSV

SEQ ID NO: 89361 - protein, 17 aa, Mycobacterium avium
LALLEADVSLPVVRAFV

SEQ ID NO: 89362 - protein, 24 aa, Mycobacterium avium
LALNRRTPIFGGWVTGPTLLGPEE

SEQ ID NO: 89363 - protein, 22 aa, Mycobacterium avium
LALPGHAFTVVALDGNPVPNRA

SEQ ID NO: 89364 - protein, 27 aa, Mycobacterium avium
LALSRELGVQFARQGIRVNALCPGPVN

SEQ ID NO: 89365 - protein, 18 aa, Mycobacterium avium
LALTPGFHAIQMPGGPGQ

SEQ ID NO: 89366 - protein, 21 aa, Mycobacterium avium
LANAPFKFAPDNGLAYFENLG

SEQ ID NO: 89367 - protein, 18 aa, Mycobacterium avium
LANCGYAGATVRHLLDMR

SEQ ID NO: 89368 - protein, 34 aa, Mycobacterium avium
LANLRARPQLAVTFRNGWQWATVEGRAELVGPDD

SEQ ID NO: 89369 - protein, 18 aa, Mycobacterium avium
LANSLRGVHAVRGRVDAV

SEQ ID NO: 89370 - protein, 23 aa, Mycobacterium avium
LAPAGTSFARWARLLDEHARDPE

SEQ ID NO: 89371 - protein, 24 aa, Mycobacterium avium
LAPKRVLPVFGLRSAIPAEREVFV

SEQ ID NO: 89372 - protein, 18 aa, Mycobacterium avium
LAPLAFVRFRLDGNDWPA

SEQ ID NO: 89373 - protein, 23 aa, Mycobacterium avium
LAPLPKRRLGETLDRYPNVREYF

SEQ ID NO: 89374 - protein, 17 aa, Mycobacterium avium
LAPTVCRDGLDGGLLAY

SEQ ID NO: 89375 - protein, 19 aa, Mycobacterium avium
LAQGAQHAIQWTKRSLNHW

SEQ ID NO: 89376 - protein, 21 aa, Mycobacterium avium
LAQNRIRTWSDWFENNSRSAR

SEQ ID NO: 89377 - protein, 18 aa, Mycobacterium avium
LAQRLAGRPVTVVDVDDP

SEQ ID NO: 89378 - protein, 18 aa, Mycobacterium avium
LAQVQARAVAAVREHDRR

SEQ ID NO: 89379 - protein, 19 aa, Mycobacterium avium
LAQVRARSLAAYDHQDVPF

SEQ ID NO: 89380 - protein, 19 aa, Mycobacterium avium
LARDLARKRGWSAQVAEGT

SEQ ID NO: 89381 - protein, 24 aa, Mycobacterium avium
LARELRPWVPVVSLVKGLEQGTNM

SEQ ID NO: 89382 - protein, 26 aa, Mycobacterium avium
LARKANRHFSFGIGVHRCIGSNVART

SEQ ID NO: 89383 - protein, 22 aa, Mycobacterium avium
LARLRDLGCDYVICYFPEAAYD

SEQ ID NO: 89384 - protein, 20 aa, Mycobacterium avium
LARRGRGTPAIFLNVRGGRL

SEQ ID NO: 89385 - protein, 17 aa, Mycobacterium avium
LARVFWPNGRVVVTREA

SEQ ID NO: 89386 - protein, 18 aa, Mycobacterium avium
LASAKGFRVIVTLHGSDF

SEQ ID NO: 89387 - protein, 17 aa, Mycobacterium avium
LASDVRPGVPVLFLDTG

SEQ ID NO: 89388 - protein, 25 aa, Mycobacterium avium
LASMMPMRVIGMLLGIPESEQVSVR

SEQ ID NO: 89389 - protein, 18 aa, Mycobacterium avium
LATARRLLAEGGTVVGAD

SEQ ID NO: 89390 - protein, 18 aa, Mycobacterium avium
LATGCARVNLGTAALENP

SEQ ID NO: 89391 - protein, 25 aa, Mycobacterium avium
LATVLSRNTFHWVLAFADGELLTRK

SEQ ID NO: 89392 - protein, 27 aa, Mycobacterium avium
LATYPWPASTVRNWFRGDYANLTLIVD

SEQ ID NO: 89393 - protein, 21 aa, Mycobacterium avium
LAVADGRIVAVGTRAEIAAHV

SEQ ID NO: 89394 - protein, 19 aa, Mycobacterium avium
LAVDAERGGTVASLIADGR

SEQ ID NO: 89395 - protein, 18 aa, Mycobacterium avium
LAVGDGLRIDDVSVDPRS

SEQ ID NO: 89396 - protein, 21 aa, Mycobacterium avium
LAVGSGLAWVSLRPTVFATNF

SEQ ID NO: 89397 - protein, 19 aa, Mycobacterium avium
LAVHRRGRRLRFMIKAEMQ

SEQ ID NO: 89398 - protein, 17 aa, Mycobacterium avium
LAVLPKSTALVVWQPRK

SEQ ID NO: 89399 - protein, 33 aa, Mycobacterium avium
LAVPPHGWINLHFSLLPAWRGAAPVQAAIAAGD

SEQ ID NO: 89400 - protein, 17 aa, Mycobacterium avium
LAVRELTWSAASPDIEA

SEQ ID NO: 89401 - protein, 25 aa, Mycobacterium avium
LAWIVEKFWDWADCDGHPENALSRD

SEQ ID NO: 89402 - protein, 20 aa, Mycobacterium avium
LAYFLGCALPAKDRREHYDA

SEQ ID NO: 89403 - protein, 21 aa, Mycobacterium avium
LCAETLELLLRSTGYSDDVTL

SEQ ID NO: 89404 - protein, 18 aa, Mycobacterium avium
LCHHYAPAMVERGAGGIV

SEQ ID NO: 89405 - protein, 24 aa, Mycobacterium avium
LDAAAAARCGRWALPRRDHVTVLT

SEQ ID NO: 89406 - protein, 19 aa, Mycobacterium avium
LDAAGDGMWNWFAAPNLPA

SEQ ID NO: 89407 - protein, 19 aa, Mycobacterium avium
LDAAGWKPGGDGVREKDGK

SEQ ID NO: 89408 - protein, 19 aa, Mycobacterium avium
LDAGRVVEFMLLYRLFPRS

SEQ ID NO: 89409 - protein, 38 aa, Mycobacterium avium
LDALITKVWKTPSFFLTHPLGIAAFGREATYRGVPPPV

SEQ ID NO: 89410 - protein, 23 aa, Mycobacterium avium
LDALRVRHGLLVISKADLADPGP

SEQ ID NO: 89411 - protein, 31 aa, Mycobacterium avium
LDALSGGRLRLCVGVGWLQEELRACGADFDN

SEQ ID NO: 89412 - protein, 27 aa, Mycobacterium avium
LDASTFLGRLALIRIYNGKLCKGQQVA

SEQ ID NO: 89413 - protein, 30 aa, Mycobacterium avium
LDAVLGRLAPRARVVLCGVISSYLTGDHPG

SEQ ID NO: 89414 - protein, 20 aa, Mycobacterium avium
LDDAALRVAREIAAKDTRVI

SEQ ID NO: 89415 - protein, 19 aa, Mycobacterium avium
LDDEVRWVLTKGKLPTSLW

SEQ ID NO: 89416 - protein, 18 aa, Mycobacterium avium
LDDGRNWSELSAGERADV

SEQ ID NO: 89417 - protein, 30 aa, Mycobacterium avium
LDDLAERVGWQWRLVWYKAVAELLTGDYDS

SEQ ID NO: 89418 - protein, 21 aa, Mycobacterium avium
LDDLRCGGVPMVPVGAERSGE

SEQ ID NO: 89419 - protein, 25 aa, Mycobacterium avium
LDDPRLELVGVYAFSEEKAGSDAGA

SEQ ID NO: 89420 - protein, 33 aa, Mycobacterium avium
LDEARPPVRFALKGRHPFAVYRWVFELDALDGP

SEQ ID NO: 89421 - protein, 17 aa, Mycobacterium avium
LDEFAEWAKSLTQRTIL

SEQ ID NO: 89422 - protein, 22 aa, Mycobacterium avium
LDFMFRHIQPYFTEDINQLVNE

SEQ ID NO: 89423 - protein, 17 aa, Mycobacterium avium
LDFTFAGLPAYKQGLGR

SEQ ID NO: 89424 - protein, 19 aa, Mycobacterium avium
LDFVPAFGSAFQWQYPTPP

SEQ ID NO: 89425 - protein, 23 aa, Mycobacterium avium
LDGGAPFYGCYETADGKYVAVGA

SEQ ID NO: 89426 - protein, 27 aa, Mycobacterium avium
LDGHPARPRLINMYGITETTVHASFRE

SEQ ID NO: 89427 - protein, 27 aa, Mycobacterium avium
LDGPLFKFALLQTRVDEFYLFVCCHHI

SEQ ID NO: 89428 - protein, 18 aa, Mycobacterium avium
LDGYRDPGALGGYRTYTP

SEQ ID NO: 89429 - protein, 17 aa, Mycobacterium avium
LDIASLVFMGHEPGTDH

SEQ ID NO: 89430 - protein, 19 aa, Mycobacterium avium
LDIGCGWGSTMRHAVEEYD

SEQ ID NO: 89431 - protein, 23 aa, Mycobacterium avium
LDIGRTALLTAGWPETVPGVTVD

SEQ ID NO: 89432 - protein, 21 aa, Mycobacterium avium
LDKPGSVVLWTNCHHPFYDHN

SEQ ID NO: 89433 - protein, 18 aa, Mycobacterium avium
LDLAMRFGTDSGGPVRVE

SEQ ID NO: 89434 - protein, 22 aa, Mycobacterium avium
LDLDLASYVLEWHARVPAWRDH

SEQ ID NO: 89435 - protein, 17 aa, Mycobacterium avium
LDLGSVLIPMPEAGQLQ

SEQ ID NO: 89436 - protein, 17 aa, Mycobacterium avium
LDLPAGTRVTRALEAKW

SEQ ID NO: 89437 - protein, 28 aa, Mycobacterium avium
LDLSIPRLKRGLMLGTHWGQLDQPLVPE

SEQ ID NO: 89438 - protein, 26 aa, Mycobacterium avium
LDLSRLRFISVEGFRALLLLNDELRK

SEQ ID NO: 89439 - protein, 17 aa, Mycobacterium avium
LDNELNWIEQQTGGKPY

SEQ ID NO: 89440 - protein, 25 aa, Mycobacterium avium
LDNHPSPRSKRVLLQGWEQFDEKVD

SEQ ID NO: 89441 - protein, 30 aa, Mycobacterium avium
LDNWLSPPYARWSFQHVEDFVPTAVIARGT

SEQ ID NO: 89442 - protein, 17 aa, Mycobacterium avium
LDPAIGLDGAWMREIAE

SEQ ID NO: 89443 - protein, 19 aa, Mycobacterium avium
LDPDASLGAGWACGVTVVL

SEQ ID NO: 89444 - protein, 17 aa, Mycobacterium avium
LDPELSVDELAALDVAA

SEQ ID NO: 89445 - protein, 22 aa, Mycobacterium avium
LDPPRAGEVLVQMAAAGLCHSD

SEQ ID NO: 89446 - protein, 20 aa, Mycobacterium avium
LDPRLPVFELLAEPLRANGF

SEQ ID NO: 89447 - protein, 21 aa, Mycobacterium avium
LDQGQRLLIFLPLAHVLARSL

SEQ ID NO: 89448 - protein, 24 aa, Mycobacterium avium
LDQLRLRTSMKWRAHPADVLPLWV

SEQ ID NO: 89449 - protein, 18 aa, Mycobacterium avium
LDRFLLWKDGVIRPAGDS

SEQ ID NO: 89450 - protein, 19 aa, Mycobacterium avium
LDRLAELGVSEIFGVPGDY

SEQ ID NO: 89451 - protein, 21 aa, Mycobacterium avium
LDRLYGYEVSPVLWKKVAPKL

SEQ ID NO: 89452 - protein, 30 aa, Mycobacterium avium
LDRREKTTLSWEFPFGFLDQGLSSPIRMPT

SEQ ID NO: 89453 - protein, 21 aa, Mycobacterium avium
LDRRRMLELAGKFAAEHPWLL

SEQ ID NO: 89454 - protein, 27 aa, Mycobacterium avium
LDRSRPLWEMWVIEGLDGNAGGRFATL

SEQ ID NO: 89455 - protein, 24 aa, Mycobacterium avium
LDRSRPLWEMYFVEGLANNRIAVV

SEQ ID NO: 89456 - protein, 18 aa, Mycobacterium avium
LDRTPWRAEEPVVIVAPM

SEQ ID NO: 89457 - protein, 18 aa, Mycobacterium avium
LDRWLRPAPPGVVGELYI

SEQ ID NO: 89458 - protein, 24 aa, Mycobacterium avium
LDSVPRMRGVLALFEGVATGAADG

SEQ ID NO: 89459 - protein, 18 aa, Mycobacterium avium
LDTERPHEVELRKKVKEY

SEQ ID NO: 89460 - protein, 27 aa, Mycobacterium avium
LDTLIKEKWLTANAVIGFFPANAIGPG

SEQ ID NO: 89461 - protein, 27 aa, Mycobacterium avium
LDTRAYRLDWPAGMTVFEIDQPAVIEF

SEQ ID NO: 89462 - protein, 25 aa, Mycobacterium avium
LDTWFSSALWPFSTLGWPEKTPELE

SEQ ID NO: 89463 - protein, 17 aa, Mycobacterium avium
LDVANVIAFLASDAAAA

SEQ ID NO: 89464 - protein, 25 aa, Mycobacterium avium
LDVARCPRNILTFSHGAHHCLGAAA

SEQ ID NO: 89465 - protein, 27 aa, Mycobacterium avium
LDVVRRARFAAAFTFQYSKRPGTPAAE

SEQ ID NO: 89466 - protein, 17 aa, Mycobacterium avium
LDWSTPHDIGRKAIAQN

SEQ ID NO: 89467 - protein, 19 aa, Mycobacterium avium
LDWVRGLAVDAGRILQYGL

SEQ ID NO: 89468 - protein, 20 aa, Mycobacterium avium
LDYASPVPAILTMKLMGLPY

SEQ ID NO: 89469 - protein, 26 aa, Mycobacterium avium
LEAGPSGRFRPLWAHNRSEERKALTD

SEQ ID NO: 89470 - protein, 27 aa, Mycobacterium avium
LEAHLISPWGTWDWMGPAAVGAVLPAR

SEQ ID NO: 89471 - protein, 19 aa, Mycobacterium avium
LEAVPEFRLKLADTPLNLD

SEQ ID NO: 89472 - protein, 19 aa, Mycobacterium avium
LEAWFMHIPGLKVIVPATP

SEQ ID NO: 89473 - protein, 20 aa, Mycobacterium avium
LECETFRFRGHYFGDRMPYI

SEQ ID NO: 89474 - protein, 20 aa, Mycobacterium avium
LEDAGFCAKGQGMQWIGGHD

SEQ ID NO: 89475 - protein, 24 aa, Mycobacterium avium
LEDLRPDIWVKGGDYVAAELPEAD

SEQ ID NO: 89476 - protein, 18 aa, Mycobacterium avium
LEEICAVSPRYVVTAQVS

SEQ ID NO: 89477 - protein, 20 aa, Mycobacterium avium
LEFRVLRDRLFETLAAVEPE

SEQ ID NO: 89478 - protein, 18 aa, Mycobacterium avium
LEGFRPGVMERMGLGPEE

SEQ ID NO: 89479 - protein, 20 aa, Mycobacterium avium
LEGLHKPLLPDGIAQPEDIA

SEQ ID NO: 89480 - protein, 18 aa, Mycobacterium avium
LEITTCLRRGEIEMVTRY

SEQ ID NO: 89481 - protein, 21 aa, Mycobacterium avium
LEKHGKLPVAVNDIYLSTVGG

SEQ ID NO: 89482 - protein, 18 aa, Mycobacterium avium
LELACWDLNAKLRDEPAC

SEQ ID NO: 89483 - protein, 24 aa, Mycobacterium avium
LELDRLPTHLVIVGGSYIALEFAQ

SEQ ID NO: 89484 - protein, 24 aa, Mycobacterium avium
LELGTYCGYGALRIARAAPGARVF

SEQ ID NO: 89485 - protein, 19 aa, Mycobacterium avium
LELKKYCPNCGKHQAHRET

SEQ ID NO: 89486 - protein, 28 aa, Mycobacterium avium
LELLARLQAELGLAYLFISHDLAVIRQI

SEQ ID NO: 89487 - protein, 18 aa, Mycobacterium avium
LELLAVLAVKATGTEITY

SEQ ID NO: 89488 - protein, 32 aa, Mycobacterium avium
LELLAYCAACTERLRLGVAVLVTSLHDPLQLA

SEQ ID NO: 89489 - protein, 19 aa, Mycobacterium avium
LELNVAFQMLYARYPDITA

SEQ ID NO: 89490 - protein, 17 aa, Mycobacterium avium
LELPPARHLDTFDECGN

SEQ ID NO: 89491 - protein, 18 aa, Mycobacterium avium
LELRRRRVEFDGDGVEWL

SEQ ID NO: 89492 - protein, 23 aa, Mycobacterium avium
LEMLERYGWIVVRVIAEDRPDEI

SEQ ID NO: 89493 - protein, 19 aa, Mycobacterium avium
LEMRTAVNLLLDRLPNLRL

SEQ ID NO: 89494 - protein, 29 aa, Mycobacterium avium
LENMRYKWRKWLYFDCNWKVALEAFNETY

SEQ ID NO: 89495 - protein, 17 aa, Mycobacterium avium
LEPDLDYGKVIDDAAAL

SEQ ID NO: 89496 - protein, 26 aa, Mycobacterium avium
LEPTARRILAHFGLDHHFEVIAGASP

SEQ ID NO: 89497 - protein, 21 aa, Mycobacterium avium
LEPTFRRSVIYIVEHNDGGTL

SEQ ID NO: 89498 - protein, 23 aa, Mycobacterium avium
LEQADLLLAHLVLRPFLDAYHIV

SEQ ID NO: 89499 - protein, 20 aa, Mycobacterium avium
LERQDVVKAFSMLRNHYSVV

SEQ ID NO: 89500 - protein, 18 aa, Mycobacterium avium
LERRGWRIIRVSADLLRN

SEQ ID NO: 89501 - protein, 19 aa, Mycobacterium avium
LERVRVCKRDGRLLEPPHA

SEQ ID NO: 89502 - protein, 26 aa, Mycobacterium avium
LESAAKWREIFGADNFFLELMDHGLS

SEQ ID NO: 89503 - protein, 27 aa, Mycobacterium avium
LESAEHGRSWSRWSFIGAGSPSALTVR

SEQ ID NO: 89504 - protein, 20 aa, Mycobacterium avium
LESEGGFDPVRRRIFQLEIG

SEQ ID NO: 89505 - protein, 29 aa, Mycobacterium avium
LESLRRLRGLGRRAVLPGHGPDLTDLESV

SEQ ID NO: 89506 - protein, 19 aa, Mycobacterium avium
LESRIALERLLDFMPRYEV

SEQ ID NO: 89507 - protein, 21 aa, Mycobacterium avium
LESVARLLIPGGVLMIYVATV

SEQ ID NO: 89508 - protein, 18 aa, Mycobacterium avium
LEVMALLVMQAEWLAKRS

SEQ ID NO: 89509 - protein, 21 aa, Mycobacterium avium
LEVTARLAAPLLPSVTELVWR

SEQ ID NO: 89510 - protein, 17 aa, Mycobacterium avium
LEYPQLWGGLADLAQGS

SEQ ID NO: 89511 - protein, 17 aa, Mycobacterium avium
LFALAQFMGDIYGGALL

SEQ ID NO: 89512 - protein, 18 aa, Mycobacterium avium
LFCIHAAGGLSWSYQVLG

SEQ ID NO: 89513 - protein, 18 aa, Mycobacterium avium
LFCIHPASGLSWPYHALG

SEQ ID NO: 89514 - protein, 24 aa, Mycobacterium avium
LFDDLRIGIELSPRQVWTQFHSYA

SEQ ID NO: 89515 - protein, 18 aa, Mycobacterium avium
LFDRTGLFDDVRAHRDLT

SEQ ID NO: 89516 - protein, 22 aa, Mycobacterium avium
LFIELAEKVWGRRDQQAVGAIR

SEQ ID NO: 89517 - protein, 25 aa, Mycobacterium avium
LFLGRFPLELIHPFPQPSDADEART

SEQ ID NO: 89518 - protein, 28 aa, Mycobacterium avium
LFLIHWPLPTLYGGDFVSTWRVLEEFAR

SEQ ID NO: 89519 - protein, 18 aa, Mycobacterium avium
LFNDLTVYFALTVRGRLQ

SEQ ID NO: 89520 - protein, 23 aa, Mycobacterium avium
LFNEDFAGLIVSGDDAWNTINEY

SEQ ID NO: 89521 - protein, 23 aa, Mycobacterium avium
LFNMCLHRGMQVCRAELGNASNF

SEQ ID NO: 89522 - protein, 22 aa, Mycobacterium avium
LFPGGEGRLRLTDPSNMLTTGI

SEQ ID NO: 89523 - protein, 26 aa, Mycobacterium avium
LFRRMEGRAAFEVKIHRIAADGGAVL

SEQ ID NO: 89524 - protein, 18 aa, Mycobacterium avium
LFTSRWPAAGVDLTGKRV

SEQ ID NO: 89525 - protein, 17 aa, Mycobacterium avium
LGAALGAFTGELAGLSR

SEQ ID NO: 89526 - protein, 26 aa, Mycobacterium avium
LGADWPRLVAPVFDPKKAVLFDDRWA

SEQ ID NO: 89527 - protein, 21 aa, Mycobacterium avium
LGAGCSMSKIGARHLTTVDSV

SEQ ID NO: 89528 - protein, 26 aa, Mycobacterium avium
LGAGLARYACGLGMTVVLADIDRDAV

SEQ ID NO: 89529 - protein, 23 aa, Mycobacterium avium
LGAGWACGVTVVLTPPGTVGAVD

SEQ ID NO: 89530 - protein, 17 aa, Mycobacterium avium
LGAHQAYTPQQAVEARV

SEQ ID NO: 89531 - protein, 21 aa, Mycobacterium avium
LGANLARREIRVVFDELRHEI

SEQ ID NO: 89532 - protein, 18 aa, Mycobacterium avium
LGAPKQRAVLAMLLIHRN

SEQ ID NO: 89533 - protein, 23 aa, Mycobacterium avium
LGAQGCLQRLWWLHSGPGEPRVL

SEQ ID NO: 89534 - protein, 17 aa, Mycobacterium avium
LGASGARIITTLVNALE

SEQ ID NO: 89535 - protein, 24 aa, Mycobacterium avium
LGAVLQRLAGYQARSVEIDGCTYR

SEQ ID NO: 89536 - protein, 20 aa, Mycobacterium avium
LGAYAARLWLPMLRAERTTA

SEQ ID NO: 89537 - protein, 24 aa, Mycobacterium avium
LGCKEALFTLGDRPEDRWPEAREW

SEQ ID NO: 89538 - protein, 24 aa, Mycobacterium avium
LGCRCGRADCAAGTRPAAGPVVIH

SEQ ID NO: 89539 - protein, 21 aa, Mycobacterium avium
LGDDLPVEWKHRSERYTEKLA

SEQ ID NO: 89540 - protein, 17 aa, Mycobacterium avium
LGDGRALLLGELVDDEG

SEQ ID NO: 89541 - protein, 18 aa, Mycobacterium avium
LGDTITFVIHIPLSIDLL

SEQ ID NO: 89542 - protein, 18 aa, Mycobacterium avium
LGDYRWRDLLDNHDRIVR

SEQ ID NO: 89543 - protein, 17 aa, Mycobacterium avium
LGEFPRVLKTAASLREP

SEQ ID NO: 89544 - protein, 23 aa, Mycobacterium avium
LGELEIYAGPVLAIGENTEPLRE

SEQ ID NO: 89545 - protein, 20 aa, Mycobacterium avium
LGFGCVAAPIGGPGEAAAAV

SEQ ID NO: 89546 - protein, 17 aa, Mycobacterium avium
LGFGTGIVTLTPAADHV

SEQ ID NO: 89547 - protein, 17 aa, Mycobacterium avium
LGFVEAQGGGTILLARG

SEQ ID NO: 89548 - protein, 23 aa, Mycobacterium avium
LGGAALRPAPVGAYPAGASACGA

SEQ ID NO: 89549 - protein, 25 aa, Mycobacterium avium
LGGDFGGVWYWNRYPGIQCDNESYC

SEQ ID NO: 89550 - protein, 29 aa, Mycobacterium avium
LGGDKDFWLQVGIDPIRIITSSGTFYTLR

SEQ ID NO: 89551 - protein, 22 aa, Mycobacterium avium
LGGPVDARCAARFRRLTGGNTL

SEQ ID NO: 89552 - protein, 18 aa, Mycobacterium avium
LGGVLGIISGAERVEPAT

SEQ ID NO: 89553 - protein, 25 aa, Mycobacterium avium
LGIGRPRLKTSLLSAADIKAIPFVI

SEQ ID NO: 89554 - protein, 21 aa, Mycobacterium avium
LGKRLPAYMVPAAVVVLESLP

SEQ ID NO: 89555 - protein, 26 aa, Mycobacterium avium
LGLPADWEPLGAIAIGYAAEPAGPRD

SEQ ID NO: 89556 - protein, 22 aa, Mycobacterium avium
LGMNDVKTWISFGASPRASLGI

SEQ ID NO: 89557 - protein, 29 aa, Mycobacterium avium
LGMVRCVRAALPLLRKAQWARIVNFSAHS

SEQ ID NO: 89558 - protein, 20 aa, Mycobacterium avium
LGNARRALVESLCYARQRRA

SEQ ID NO: 89559 - protein, 21 aa, Mycobacterium avium
LGNYLPRYLRGICDDADSLAH

SEQ ID NO: 89560 - protein, 24 aa, Mycobacterium avium
LGPEHEPRIALRADMDALPMAERT

SEQ ID NO: 89561 - protein, 19 aa, Mycobacterium avium
LGPPPDEPNAFVVEGAPTS

SEQ ID NO: 89562 - protein, 19 aa, Mycobacterium avium
LGPRWRRRRMRVSEVDDAA

SEQ ID NO: 89563 - protein, 26 aa, Mycobacterium avium
LGPVHVCSAFLPGMIETHGGGRVVNV

SEQ ID NO: 89564 - protein, 18 aa, Mycobacterium avium
LGPYLRATWDLITPNAYI

SEQ ID NO: 89565 - protein, 21 aa, Mycobacterium avium
LGQRVVAAIVLRDGRAAPSPD

SEQ ID NO: 89566 - protein, 20 aa, Mycobacterium avium
LGRDDWAVHVALWEAGELVA

SEQ ID NO: 89567 - protein, 24 aa, Mycobacterium avium
LGRDPRAVKVFTMVTPVVAETHDA

SEQ ID NO: 89568 - protein, 26 aa, Mycobacterium avium
LGREHPPLEFGLRVTTLVRDTSEQAW

SEQ ID NO: 89569 - protein, 19 aa, Mycobacterium avium
LGREWDFVVIAGLQDGLWP

SEQ ID NO: 89570 - protein, 18 aa, Mycobacterium avium
LGRLHFALAPQGTLFLGH

SEQ ID NO: 89571 - protein, 22 aa, Mycobacterium avium
LGRLRYAVVAHGGFGVAQRIVQ

SEQ ID NO: 89572 - protein, 20 aa, Mycobacterium avium
LGRRCGACRLEIDRGELSRI

SEQ ID NO: 89573 - protein, 23 aa, Mycobacterium avium
LGSEELRAGIGINTGAVAVGLVG

SEQ ID NO: 89574 - protein, 18 aa, Mycobacterium avium
LGSIEFAVSVLNVPLIVV

SEQ ID NO: 89575 - protein, 20 aa, Mycobacterium avium
LGSSGVWELFWPDFPIGGLY

SEQ ID NO: 89576 - protein, 28 aa, Mycobacterium avium
LGTAVDWRFAATVGRRLARPGPPSTDYT

SEQ ID NO: 89577 - protein, 22 aa, Mycobacterium avium
LGTPELRAAIAADYRRQHGLEV

SEQ ID NO: 89578 - protein, 17 aa, Mycobacterium avium
LGVAAAPRQRQRGGGQQ

SEQ ID NO: 89579 - protein, 31 aa, Mycobacterium avium
LGVDHLRKVVAWARDRGCLVASDECYLGLGW

SEQ ID NO: 89580 - protein, 19 aa, Mycobacterium avium
LGVPYTAIMTPVFDVHRSP

SEQ ID NO: 89581 - protein, 20 aa, Mycobacterium avium
LGWRAAEVAEAIGTTTAAVN

SEQ ID NO: 89582 - protein, 25 aa, Mycobacterium avium
LGWVAREGRIPLGYFDDPDATRKTF

SEQ ID NO: 89583 - protein, 24 aa, Mycobacterium avium
LGYWEPRAAISLNEAILRRLGTNW

SEQ ID NO: 89584 - protein, 21 aa, Mycobacterium avium
LHAIIKALRTAAVNDTKDALG

SEQ ID NO: 89585 - protein, 20 aa, Mycobacterium avium
LHAYFKARDWDAITDLLTDD

SEQ ID NO: 89586 - protein, 27 aa, Mycobacterium avium
LHEYHRQWQPKIPLGRMGRPDELAGIY

SEQ ID NO: 89587 - protein, 28 aa, Mycobacterium avium
LHGSLFEFRCARCAKPYTGELPAMAEPA

SEQ ID NO: 89588 - protein, 19 aa, Mycobacterium avium
LHHALALAGRHLRRHPNAQ

SEQ ID NO: 89589 - protein, 17 aa, Mycobacterium avium
LHIPRTTWYDDVRFEEV

SEQ ID NO: 89590 - protein, 17 aa, Mycobacterium avium
LHKASPIVGLPSIAAAS

SEQ ID NO: 89591 - protein, 20 aa, Mycobacterium avium
LHLLPMAGVLGVLPVLATDV

SEQ ID NO: 89592 - protein, 24 aa, Mycobacterium avium
LHLTLKHIHWNVVGPNFIGVHEMI

SEQ ID NO: 89593 - protein, 25 aa, Mycobacterium avium
LHLYLRRVTLYRGMFGTPEEHNLRV

SEQ ID NO: 89594 - protein, 21 aa, Mycobacterium avium
LHLYWRRAISLAASIGPANRW

SEQ ID NO: 89595 - protein, 23 aa, Mycobacterium avium
LHRRYGWQWNIVPLLKIPGVTNV

SEQ ID NO: 89596 - protein, 19 aa, Mycobacterium avium
LHTARLALCQATRQVIANG

SEQ ID NO: 89597 - protein, 19 aa, Mycobacterium avium
LIAARGVGVGQVLAITFTN

SEQ ID NO: 89598 - protein, 20 aa, Mycobacterium avium
LIAGCGTFQAAVYAYTNRAA

SEQ ID NO: 89599 - protein, 18 aa, Mycobacterium avium
LIATGGMGQVWEAVDNRL

SEQ ID NO: 89600 - protein, 19 aa, Mycobacterium avium
LIDATRGTVHLVIGGGGTS

SEQ ID NO: 89601 - protein, 17 aa, Mycobacterium avium
LIDEARTPLIISGPADG

SEQ ID NO: 89602 - protein, 25 aa, Mycobacterium avium
LIDRCWAPKVYGAWNLHQATAGQPL

SEQ ID NO: 89603 - protein, 17 aa, Mycobacterium avium
LIDVCGTGTSGYQAADW

SEQ ID NO: 89604 - protein, 18 aa, Mycobacterium avium
LIEKIQGGFLDFDAAIAT

SEQ ID NO: 89605 - protein, 19 aa, Mycobacterium avium
LIERIDAEYARYFTPTGRP

SEQ ID NO: 89606 - protein, 18 aa, Mycobacterium avium
LIGLRRCPSEAALDELHS

SEQ ID NO: 89607 - protein, 24 aa, Mycobacterium avium
LIGPLWFAIRAYRQMQTQDGMGCI

SEQ ID NO: 89608 - protein, 28 aa, Mycobacterium avium
LIHPPAPVCRYCRSRDIGVRAVSGRATL

SEQ ID NO: 89609 - protein, 20 aa, Mycobacterium avium
LINNAFRVPSMKPLAGTSFQ

SEQ ID NO: 89610 - protein, 26 aa, Mycobacterium avium
LINSGFTRRRVSVLEPKIREIVRGIL

SEQ ID NO: 89611 - protein, 18 aa, Mycobacterium avium
LIPHGVWILGYRIYLWDM

SEQ ID NO: 89612 - protein, 18 aa, Mycobacterium avium
LIRFAEAAIQVMGKGGDH

SEQ ID NO: 89613 - protein, 24 aa, Mycobacterium avium
LIRTAEDAYRFVLTNHHIVLDGWS

SEQ ID NO: 89614 - protein, 24 aa, Mycobacterium avium
LIVDEPFLAPARIDLGALRAHAVA

SEQ ID NO: 89615 - protein, 17 aa, Mycobacterium avium
LKAAAIISGVAQAIVAS

SEQ ID NO: 89616 - protein, 28 aa, Mycobacterium avium
LKAATTVRCEYCIDLGSQIARRWGITDE

SEQ ID NO: 89617 - protein, 25 aa, Mycobacterium avium
LKARAEALSRAFLDQGITFSLSGQE

SEQ ID NO: 89618 - protein, 19 aa, Mycobacterium avium
LKARISRVSPHATLEDVFR

SEQ ID NO: 89619 - protein, 17 aa, Mycobacterium avium
LKDVVAREQRRIIDDQL

SEQ ID NO: 89620 - protein, 18 aa, Mycobacterium avium
LKEALAQGIPARPVVIGP

SEQ ID NO: 89621 - protein, 18 aa, Mycobacterium avium
LKEPLYRIYEMRLRQELG

SEQ ID NO: 89622 - protein, 20 aa, Mycobacterium avium
LKKNGVIVILTIAPQAGPST

SEQ ID NO: 89623 - protein, 22 aa, Mycobacterium avium
LKLECPQHHPVGRILKDAPHQA

SEQ ID NO: 89624 - protein, 20 aa, Mycobacterium avium
LKLRGEGMVQLEPHRGHVVL

SEQ ID NO: 89625 - protein, 17 aa, Mycobacterium avium
LKNRLLLTDLLKRHPEI

SEQ ID NO: 89626 - protein, 20 aa, Mycobacterium avium
LKPAPATVVGVDWRTALADA

SEQ ID NO: 89627 - protein, 17 aa, Mycobacterium avium
LKPGDYVVVQVSKDPVG

SEQ ID NO: 89628 - protein, 21 aa, Mycobacterium avium
LKPYWDTRPEDRADLRRFIAQ

SEQ ID NO: 89629 - protein, 18 aa, Mycobacterium avium
LKQNYFFDMRTIRRGRVD

SEQ ID NO: 89630 - protein, 17 aa, Mycobacterium avium
LKRATVMQRKAKDILRA

SEQ ID NO: 89631 - protein, 17 aa, Mycobacterium avium
LKSIALRAIQVHGALGL

SEQ ID NO: 89632 - protein, 17 aa, Mycobacterium avium
LKTLPLVERTYHIDRTI

SEQ ID NO: 89633 - protein, 19 aa, Mycobacterium avium
LKTPLVLDLSRLRFISVEG

SEQ ID NO: 89634 - protein, 19 aa, Mycobacterium avium
LKVPAALAVDSVRYSIADA

SEQ ID NO: 89635 - protein, 17 aa, Mycobacterium avium
LLAAGGEHIEWVDSERP

SEQ ID NO: 89636 - protein, 17 aa, Mycobacterium avium
LLAERLGVRQTIGLGTV

SEQ ID NO: 89637 - protein, 20 aa, Mycobacterium avium
LLAHCGYRLSPIEQVMAGHI

SEQ ID NO: 89638 - protein, 20 aa, Mycobacterium avium
LLAHDWGSIQGWAAVTDESV

SEQ ID NO: 89639 - protein, 20 aa, Mycobacterium avium
LLAIPLHQLYAVLWRVGIIE

SEQ ID NO: 89640 - protein, 25 aa, Mycobacterium avium
LLANATPGPDGWIRAVGYHDSVAGA

SEQ ID NO: 89641 - protein, 32 aa, Mycobacterium avium
LLAPLCTRLPLPCLIGAPVLFGRGSVVFARLV

SEQ ID NO: 89642 - protein, 34 aa, Mycobacterium avium
LLAQLDYLQWLGIDCIWLPPFYDSPLRDGGYDIR

SEQ ID NO: 89643 - protein, 18 aa, Mycobacterium avium
LLAQRMGKKRVIAETGAG

SEQ ID NO: 89644 - protein, 17 aa, Mycobacterium avium
LLDAEGLFDPRLKRPIP

SEQ ID NO: 89645 - protein, 19 aa, Mycobacterium avium
LLDFMPRYEVDWAGCRRVT

SEQ ID NO: 89646 - protein, 21 aa, Mycobacterium avium
LLDIGCGWGGALKRALEKYDV

SEQ ID NO: 89647 - protein, 24 aa, Mycobacterium avium
LLDNRIVSCFSMTEPQGGADPKVF

SEQ ID NO: 89648 - protein, 20 aa, Mycobacterium avium
LLDYFPEDFLLVIDESHVTV

SEQ ID NO: 89649 - protein, 24 aa, Mycobacterium avium
LLDYWSDRVHRLLSACVRDRDLVA

SEQ ID NO: 89650 - protein, 21 aa, Mycobacterium avium
LLELLPHITLINGYGSSETGN

SEQ ID NO: 89651 - protein, 18 aa, Mycobacterium avium
LLETRPFAGISVDDLAKG

SEQ ID NO: 89652 - protein, 22 aa, Mycobacterium avium
LLEYPVWMWHWAVPGDPAVPWD

SEQ ID NO: 89653 - protein, 21 aa, Mycobacterium avium
LLGEQRWAGQFVLTRELALDA

SEQ ID NO: 89654 - protein, 17 aa, Mycobacterium avium
LLGIDRWIRNFFYLTYF

SEQ ID NO: 89655 - protein, 22 aa, Mycobacterium avium
LLGSLTLQRVWELAAAAAGPDS

SEQ ID NO: 89656 - protein, 22 aa, Mycobacterium avium
LLGTRYLPPFPYFMDSPNAFRV

SEQ ID NO: 89657 - protein, 20 aa, Mycobacterium avium
LLGWSFGGVVAHEIAIELQR

SEQ ID NO: 89658 - protein, 17 aa, Mycobacterium avium
LLHACALVHDDVIDDSA

SEQ ID NO: 89659 - protein, 17 aa, Mycobacterium avium
LLHPRPRSVLGELAAAV

SEQ ID NO: 89660 - protein, 22 aa, Mycobacterium avium
LLHRHRCSSAGWAKEVADELLP

SEQ ID NO: 89661 - protein, 20 aa, Mycobacterium avium
LLIAFAMAWTQVVGAGTPIG

SEQ ID NO: 89662 - protein, 17 aa, Mycobacterium avium
LLIFLPLAHVLARSLTL

SEQ ID NO: 89663 - protein, 17 aa, Mycobacterium avium
LLIVLFGIALAWANSPH

SEQ ID NO: 89664 - protein, 18 aa, Mycobacterium avium
LLLETSWDAIEHAGLDPA

SEQ ID NO: 89665 - protein, 18 aa, Mycobacterium avium
LLLGRSFAYADAHRYRVG

SEQ ID NO: 89666 - protein, 20 aa, Mycobacterium avium
LLLGRSFAYPDAHRARIGVN

SEQ ID NO: 89667 - protein, 18 aa, Mycobacterium avium
LLLQEIFAAYFGVRLPAP

SEQ ID NO: 89668 - protein, 23 aa, Mycobacterium avium
LLLSEFEGLLGPRTKLVAASHVS

SEQ ID NO: 89669 - protein, 17 aa, Mycobacterium avium
LLLWRTAFCEKLVGRGL

SEQ ID NO: 89670 - protein, 18 aa, Mycobacterium avium
LLNADGWGAGFFDGEVPR

SEQ ID NO: 89671 - protein, 18 aa, Mycobacterium avium
LLNEPQFDDPSLNSGGQA

SEQ ID NO: 89672 - protein, 21 aa, Mycobacterium avium
LLQEWLRRVPDYAIRADAATR

SEQ ID NO: 89673 - protein, 19 aa, Mycobacterium avium
LLQPLALAPKGIWLGPKEL

SEQ ID NO: 89674 - protein, 28 aa, Mycobacterium avium
LLREAHDLCGLPVSVFRSDMILADTSYA

SEQ ID NO: 89675 - protein, 25 aa, Mycobacterium avium
LLRRLGATMRFEFNSLPFTLGMKEP

SEQ ID NO: 89676 - protein, 23 aa, Mycobacterium avium
LLRSLGTAGLRFERQCQNARAVA

SEQ ID NO: 89677 - protein, 26 aa, Mycobacterium avium
LLRVRGALRPCDWDTAMERIVARSRE

SEQ ID NO: 89678 - protein, 22 aa, Mycobacterium avium
LLSEYDRFALLHGDYRLDNLLF

SEQ ID NO: 89679 - protein, 18 aa, Mycobacterium avium
LLSIDLLDGGEHDRLDEW

SEQ ID NO: 89680 - protein, 17 aa, Mycobacterium avium
LLSYVRGVLYFRTGRWP

SEQ ID NO: 89681 - protein, 26 aa, Mycobacterium avium
LLTFDGELLSRCELFDEADLPDALAR

SEQ ID NO: 89682 - protein, 23 aa, Mycobacterium avium
LLTGIRKLAWPKLKQHYGERLEQ

SEQ ID NO: 89683 - protein, 25 aa, Mycobacterium avium
LLTGMRLALFEAFDPAATPLAIAAH

SEQ ID NO: 89684 - protein, 18 aa, Mycobacterium avium
LLTSHVWRQDHNGASHQD

SEQ ID NO: 89685 - protein, 18 aa, Mycobacterium avium
LLVADLAYVRGMVHRQLG

SEQ ID NO: 89686 - protein, 20 aa, Mycobacterium avium
LLVHAWDYARAVGRDARAPE

SEQ ID NO: 89687 - protein, 23 aa, Mycobacterium avium
LLWGDARVGNVLYRDFVPVAVLD

SEQ ID NO: 89688 - protein, 17 aa, Mycobacterium avium
LLYAGAMFHDLGLTERY

SEQ ID NO: 89689 - protein, 18 aa, Mycobacterium avium
LLYFPVMGANEIWRVDPD

SEQ ID NO: 89690 - protein, 18 aa, Mycobacterium avium
LLYWTQVLMIARGLSLDD

SEQ ID NO: 89691 - protein, 18 aa, Mycobacterium avium
LMATPGIEQVFCFENRGE

SEQ ID NO: 89692 - protein, 27 aa, Mycobacterium avium
LMAVEDWPLLRWRMRQYRHGRWGTHIV

SEQ ID NO: 89693 - protein, 23 aa, Mycobacterium avium
LMDAAKAWGVLGAQLADTALTYR

SEQ ID NO: 89694 - protein, 18 aa, Mycobacterium avium
LMDGRLAARVDLKADRAE

SEQ ID NO: 89695 - protein, 20 aa, Mycobacterium avium
LMHAAGMWTAFAAIMSGTTV

SEQ ID NO: 89696 - protein, 25 aa, Mycobacterium avium
LMIEGLRIGRKIGMSQALDPWRAEE

SEQ ID NO: 89697 - protein, 17 aa, Mycobacterium avium
LMKLWWAEGQVAAVVGH

SEQ ID NO: 89698 - protein, 19 aa, Mycobacterium avium
LMPVNSFAGTRGWGYDGVL

SEQ ID NO: 89699 - protein, 20 aa, Mycobacterium avium
LMQPRARGCLTLMSADPAVP

SEQ ID NO: 89700 - protein, 21 aa, Mycobacterium avium
LMRAVEVSFIRDCAEMAARSS

SEQ ID NO: 89701 - protein, 22 aa, Mycobacterium avium
LMWLTGQHDVVFGTAVSGRPTE

SEQ ID NO: 89702 - protein, 21 aa, Mycobacterium avium
LNEVLRFCGIQVPEGDEPLTY

SEQ ID NO: 89703 - protein, 26 aa, Mycobacterium avium
LNKVRFPAPVPVGSRVRAQSSLVGVD

SEQ ID NO: 89704 - protein, 19 aa, Mycobacterium avium
LNLLTTKPFLYVFNADESV

SEQ ID NO: 89705 - protein, 24 aa, Mycobacterium avium
LNQGEVCTCPSRSLIQADIYDEFL

SEQ ID NO: 89706 - protein, 30 aa, Mycobacterium avium
LNRLLEFVVRQEPRLNWAIGDRADGTTILV

SEQ ID NO: 89707 - protein, 17 aa, Mycobacterium avium
LNSAMVRLMGSDLLTIR

SEQ ID NO: 89708 - protein, 24 aa, Mycobacterium avium
LNSNALALAEVWDAATVRVISKAE

SEQ ID NO: 89709 - protein, 20 aa, Mycobacterium avium
LNVTSGLAFMPSALTPTYCA

SEQ ID NO: 89710 - protein, 20 aa, Mycobacterium avium
LNWRSRRYSPWLAYSQSKLA

SEQ ID NO: 89711 - protein, 32 aa, Mycobacterium avium
LNYLGAVQLILKFIPGMRERGFGQIINVSSVG

SEQ ID NO: 89712 - protein, 22 aa, Mycobacterium avium
LNYYAPLRLIRGIAPGMIERGD

SEQ ID NO: 89713 - protein, 33 aa, Mycobacterium avium
LPAFPANLRKQLKGSRMPAPRAIMAAALEGAQV

SEQ ID NO: 89714 - protein, 20 aa, Mycobacterium avium
LPAGTRVTRALEAKWESAQS

SEQ ID NO: 89715 - protein, 20 aa, Mycobacterium avium
LPAGWAIAWLTAAAWSDSPS

SEQ ID NO: 89716 - protein, 19 aa, Mycobacterium avium
LPALLRRPHAAILNVTSGL

SEQ ID NO: 89717 - protein, 17 aa, Mycobacterium avium
LPAMMSYWSELARDPVL

SEQ ID NO: 89718 - protein, 19 aa, Mycobacterium avium
LPAQPLLRIAGFGYNEEAT

SEQ ID NO: 89719 - protein, 19 aa, Mycobacterium avium
LPASGGVVLTGRLSPSLQG

SEQ ID NO: 89720 - protein, 17 aa, Mycobacterium avium
LPAVIERRGYVLIVSSL

SEQ ID NO: 89721 - protein, 18 aa, Mycobacterium avium
LPDAGSFDDFCAREREYT

SEQ ID NO: 89722 - protein, 17 aa, Mycobacterium avium
LPDALARFEELHRPAPR

SEQ ID NO: 89723 - protein, 18 aa, Mycobacterium avium
LPDDRLDDLLALAHEVRM

SEQ ID NO: 89724 - protein, 18 aa, Mycobacterium avium
LPDGRHVWEYAPRNGETD

SEQ ID NO: 89725 - protein, 27 aa, Mycobacterium avium
LPDTPRFAVAHAVRFDRLVSGADPDAR

SEQ ID NO: 89726 - protein, 21 aa, Mycobacterium avium
LPDVYYRSGEWAPFDMATVFA

SEQ ID NO: 89727 - protein, 21 aa, Mycobacterium avium
LPEANLAVFLSYRDCDEVLRH

SEQ ID NO: 89728 - protein, 18 aa, Mycobacterium avium
LPEARAYLRHELLGPRLH

SEQ ID NO: 89729 - protein, 19 aa, Mycobacterium avium
LPEFPWDTLAEAKALAGSH

SEQ ID NO: 89730 - protein, 28 aa, Mycobacterium avium
LPEPALRLVAVARLRLLCRAAGITEVSA

SEQ ID NO: 89731 - protein, 17 aa, Mycobacterium avium
LPESARRAYDVRPIVTA

SEQ ID NO: 89732 - protein, 18 aa, Mycobacterium avium
LPEWERDRVREVINPAVV

SEQ ID NO: 89733 - protein, 17 aa, Mycobacterium avium
LPFDPALQPARALMERA

SEQ ID NO: 89734 - protein, 18 aa, Mycobacterium avium
LPFEREWRDPRPYPGVGG

SEQ ID NO: 89735 - protein, 17 aa, Mycobacterium avium
LPFGIAITSLLAVTASY

SEQ ID NO: 89736 - protein, 20 aa, Mycobacterium avium
LPFMARVQLRWMGVFVADIA

SEQ ID NO: 89737 - protein, 25 aa, Mycobacterium avium
LPFYHDMGLILGVCAPVLGGIPAVL

SEQ ID NO: 89738 - protein, 17 aa, Mycobacterium avium
LPGAAIWHMAWSDKDDA

SEQ ID NO: 89739 - protein, 21 aa, Mycobacterium avium
LPGDLKFTLVEPLRLLFKDEV

SEQ ID NO: 89740 - protein, 20 aa, Mycobacterium avium
LPGIEARPLVTLGGDADFAE

SEQ ID NO: 89741 - protein, 21 aa, Mycobacterium avium
LPGPRGAATLLEYVVGVLTQR

SEQ ID NO: 89742 - protein, 27 aa, Mycobacterium avium
LPGPVRRLTEGFALFITTGFLPQRFRD

SEQ ID NO: 89743 - protein, 26 aa, Mycobacterium avium
LPGREGFPDVTLRSAGLTELPATEFA

SEQ ID NO: 89744 - protein, 25 aa, Mycobacterium avium
LPHLQSRIRLAEFMLHSDMEPDLDV

SEQ ID NO: 89745 - protein, 33 aa, Mycobacterium avium
LPITDLAAGVSRPENFIGIHFFSPVEKMDPIEI

SEQ ID NO: 89746 - protein, 25 aa, Mycobacterium avium
LPLAAPEELDRLAVPASSPADEDTL

SEQ ID NO: 89747 - protein, 18 aa, Mycobacterium avium
LPLDATLRRMPVGVVANG

SEQ ID NO: 89748 - protein, 27 aa, Mycobacterium avium
LPLHPGFAASWHRLRTEPARLPLSHGD

SEQ ID NO: 89749 - protein, 17 aa, Mycobacterium avium
LPLRPFKTMAVNVDGEL

SEQ ID NO: 89750 - protein, 26 aa, Mycobacterium avium
LPLSASQLRSWFAYRMDGPSPVNNIP

SEQ ID NO: 89751 - protein, 17 aa, Mycobacterium avium
LPLVLPAVQLMGRVLGT

SEQ ID NO: 89752 - protein, 20 aa, Mycobacterium avium
LPMRTIGMLLGIPDADQPSV

SEQ ID NO: 89753 - protein, 25 aa, Mycobacterium avium
LPPARAAGVRIVHCLVQRRPDGLGS

SEQ ID NO: 89754 - protein, 22 aa, Mycobacterium avium
LPPATYFSGAKLQWILDNVDGV

SEQ ID NO: 89755 - protein, 17 aa, Mycobacterium avium
LPPEGASAIVFRDTDHA

SEQ ID NO: 89756 - protein, 19 aa, Mycobacterium avium
LPPIWIGASGPRMLDIAGR

SEQ ID NO: 89757 - protein, 17 aa, Mycobacterium avium
LPPPAALTGDWFDALAV

SEQ ID NO: 89758 - protein, 17 aa, Mycobacterium avium
LPPPASQLWRSRRQIRD

SEQ ID NO: 89759 - protein, 18 aa, Mycobacterium avium
LPPSINFAGPSPYIDFDG

SEQ ID NO: 89760 - protein, 18 aa, Mycobacterium avium
LPQRWIDFLRRWDPAGWP

SEQ ID NO: 89761 - protein, 18 aa, Mycobacterium avium
LPQTYALLGRTPRRALRL

SEQ ID NO: 89762 - protein, 17 aa, Mycobacterium avium
LPRGYALHRGLKLQRAI

SEQ ID NO: 89763 - protein, 20 aa, Mycobacterium avium
LPRKLDAVRRACEQVGRDPA

SEQ ID NO: 89764 - protein, 21 aa, Mycobacterium avium
LPRLRGWGESMSRQAGGRAGG

SEQ ID NO: 89765 - protein, 24 aa, Mycobacterium avium
LPSARRLLLFKADGSVSVHADDRA

SEQ ID NO: 89766 - protein, 17 aa, Mycobacterium avium
LPSCVPYDPASPEDLSE

SEQ ID NO: 89767 - protein, 20 aa, Mycobacterium avium
LPTLRAWRRVRRFRPDVVLA

SEQ ID NO: 89768 - protein, 18 aa, Mycobacterium avium
LPTPRLVVEPGRAIAGPG

SEQ ID NO: 89769 - protein, 19 aa, Mycobacterium avium
LPVEVLRVDGRHTGLQPAF

SEQ ID NO: 89770 - protein, 27 aa, Mycobacterium avium
LPVHECWDLLRGLTLGRLVTHADGQPD

SEQ ID NO: 89771 - protein, 22 aa, Mycobacterium avium
LPVRVRDGVGLVGPLVIPGVTS

SEQ ID NO: 89772 - protein, 20 aa, Mycobacterium avium
LPVSYWKLTEREIFHHYRSI

SEQ ID NO: 89773 - protein, 24 aa, Mycobacterium avium
LPWLTRLGTVYSYDAPWHRGRDVE

SEQ ID NO: 89774 - protein, 21 aa, Mycobacterium avium
LQEMAEWRSATVDRIMSLRPR

SEQ ID NO: 89775 - protein, 17 aa, Mycobacterium avium
LQESISLQGNQALVGQT

SEQ ID NO: 89776 - protein, 17 aa, Mycobacterium avium
LQGHLLMGTTLSMRHRE

SEQ ID NO: 89777 - protein, 17 aa, Mycobacterium avium
LQGSGWAVLGYDTLGSR

SEQ ID NO: 89778 - protein, 18 aa, Mycobacterium avium
LQGSLLVRHGHPAVAEAF

SEQ ID NO: 89779 - protein, 21 aa, Mycobacterium avium
LQIAALKARYLSRGDVPEDVV

SEQ ID NO: 89780 - protein, 31 aa, Mycobacterium avium
LQLWVGACLYKGGLDIYRMFIGELDGDDADR

SEQ ID NO: 89781 - protein, 25 aa, Mycobacterium avium
LQMMSTVLGRRVWENAGSPEVDSNR

SEQ ID NO: 89782 - protein, 18 aa, Mycobacterium avium
LQPARLTVDLPRPTALEP

SEQ ID NO: 89783 - protein, 19 aa, Mycobacterium avium
LQRAFPRYDAMRVELAVGQ

SEQ ID NO: 89784 - protein, 17 aa, Mycobacterium avium
LQRCRRQPTGNWYAFAA

SEQ ID NO: 89785 - protein, 28 aa, Mycobacterium avium
LQRIKDLVIPPAWKKVWISPHPNGHIQA

SEQ ID NO: 89786 - protein, 22 aa, Mycobacterium avium
LQSDLRGAVAIGASAGGVEALS

SEQ ID NO: 89787 - protein, 19 aa, Mycobacterium avium
LQSLGAVVHPCARITKLSE

SEQ ID NO: 89788 - protein, 18 aa, Mycobacterium avium
LQTGNPVTMPWLGAVNAV

SEQ ID NO: 89789 - protein, 26 aa, Mycobacterium avium
LQVIFAYPGVHAIWGHRVNHWLWRRG

SEQ ID NO: 89790 - protein, 22 aa, Mycobacterium avium
LQVNVRQALTLADQATAAGDTA

SEQ ID NO: 89791 - protein, 19 aa, Mycobacterium avium
LRAAAQRCESLRDNLWYLI

SEQ ID NO: 89792 - protein, 19 aa, Mycobacterium avium
LRAAIAALVDDLGDAEITV

SEQ ID NO: 89793 - protein, 19 aa, Mycobacterium avium
LRAAVGKYWVIDEIRPSFI

SEQ ID NO: 89794 - protein, 17 aa, Mycobacterium avium
LRAEGMLAASGDGAHAA

SEQ ID NO: 89795 - protein, 17 aa, Mycobacterium avium
LRAELTFAAGIGLLHLT

SEQ ID NO: 89796 - protein, 17 aa, Mycobacterium avium
LRAGAIARFAPVMTEVV

SEQ ID NO: 89797 - protein, 19 aa, Mycobacterium avium
LRAGDALLAQRFFRATTQY

SEQ ID NO: 89798 - protein, 17 aa, Mycobacterium avium
LRAGDRALLVYPPGLEM

SEQ ID NO: 89799 - protein, 17 aa, Mycobacterium avium
LRAGPMRWTCVEPLKKW

SEQ ID NO: 89800 - protein, 21 aa, Mycobacterium avium
LRAGRWSGYIKPDIDLPTLAD

SEQ ID NO: 89801 - protein, 17 aa, Mycobacterium avium
LRAGSSIIGSSSVNSDT

SEQ ID NO: 89802 - protein, 18 aa, Mycobacterium avium
LRALAAHPGWSHTNLQGN

SEQ ID NO: 89803 - protein, 17 aa, Mycobacterium avium
LRALAAPVRIAIVLQLR

SEQ ID NO: 89804 - protein, 19 aa, Mycobacterium avium
LRALAEVVYDPWIEQRPLR

SEQ ID NO: 89805 - protein, 19 aa, Mycobacterium avium
LRALTYTNICEAMKTETPG

SEQ ID NO: 89806 - protein, 19 aa, Mycobacterium avium
LRARLARTRWPEAECVDDW

SEQ ID NO: 89807 - protein, 20 aa, Mycobacterium avium
LRARRDRLAAGLIDIGFEVH

SEQ ID NO: 89808 - protein, 18 aa, Mycobacterium avium
LRCAGRSMTYRELDEAST

SEQ ID NO: 89809 - protein, 24 aa, Mycobacterium avium
LRDGSLRLPYWMIYDDKEGAVPPV

SEQ ID NO: 89810 - protein, 22 aa, Mycobacterium avium
LRDGVPILLIRGQMSDLVSQER

SEQ ID NO: 89811 - protein, 20 aa, Mycobacterium avium
LRDPWGLAGPDKAEGIHRAL

SEQ ID NO: 89812 - protein, 17 aa, Mycobacterium avium
LRDRLFETLAAVEPEVD

SEQ ID NO: 89813 - protein, 29 aa, Mycobacterium avium
LRDWRQWWHWVPGASWRHPFGPDSDVADR

SEQ ID NO: 89814 - protein, 24 aa, Mycobacterium avium
LRDYLLAVKACFAAFRSGTLEHHG

SEQ ID NO: 89815 - protein, 17 aa, Mycobacterium avium
LREGRPAQRIGLSATVR

SEQ ID NO: 89816 - protein, 26 aa, Mycobacterium avium
LREIVGAYFPLGWQLACHVQGDAGVD

SEQ ID NO: 89817 - protein, 25 aa, Mycobacterium avium
LRERLGFGELRWAVSGAAPIPKETL

SEQ ID NO: 89818 - protein, 18 aa, Mycobacterium avium
LRFQIGRWQYRDLIRELI

SEQ ID NO: 89819 - protein, 19 aa, Mycobacterium avium
LRGAIEVARRVPATLERRT

SEQ ID NO: 89820 - protein, 21 aa, Mycobacterium avium
LRGDGLPIRARHVDDSALVAG

SEQ ID NO: 89821 - protein, 26 aa, Mycobacterium avium
LRGGKALRPALSIATCLGLGGHLEAI

SEQ ID NO: 89822 - protein, 21 aa, Mycobacterium avium
LRGLARGGTFVTLGYASGTIP

SEQ ID NO: 89823 - protein, 20 aa, Mycobacterium avium
LRGLASLGLQGTRLDDAPDR

SEQ ID NO: 89824 - protein, 21 aa, Mycobacterium avium
LRGLKQIVLHLGNGCSASAIA

SEQ ID NO: 89825 - protein, 19 aa, Mycobacterium avium
LRGLRMVKEECEVDALRKA

SEQ ID NO: 89826 - protein, 18 aa, Mycobacterium avium
LRGMFELAAECLAPGGRL

SEQ ID NO: 89827 - protein, 27 aa, Mycobacterium avium
LRGPRRLRRLRELAAEAVPRVRLRLYE

SEQ ID NO: 89828 - protein, 19 aa, Mycobacterium avium
LRGTVSFAPAAAGTRITER

SEQ ID NO: 89829 - protein, 17 aa, Mycobacterium avium
LRHVPLGVVAVLTPWNF

SEQ ID NO: 89830 - protein, 20 aa, Mycobacterium avium
LRHYERRGLLTPARSDGGTR

SEQ ID NO: 89831 - protein, 17 aa, Mycobacterium avium
LRIGLQAANGSNAQSWR

SEQ ID NO: 89832 - protein, 18 aa, Mycobacterium avium
LRIPMQYLAELFTAGDTA

SEQ ID NO: 89833 - protein, 17 aa, Mycobacterium avium
LRKRCLLQLHEAIESEK

SEQ ID NO: 89834 - protein, 18 aa, Mycobacterium avium
LRKSAPIYWMDVPGGTGG

SEQ ID NO: 89835 - protein, 18 aa, Mycobacterium avium
LRLAAAVVGAERGYVYVS

SEQ ID NO: 89836 - protein, 19 aa, Mycobacterium avium
LRLDGASDRACSWLPLYHD

SEQ ID NO: 89837 - protein, 20 aa, Mycobacterium avium
LRLLDRGYFRSGGEQYAEEN

SEQ ID NO: 89838 - protein, 18 aa, Mycobacterium avium
LRLLEIFDRETRRLRVPG

SEQ ID NO: 89839 - protein, 19 aa, Mycobacterium avium
LRLPGRDIYAALKKGSGTQ

SEQ ID NO: 89840 - protein, 23 aa, Mycobacterium avium
LRLQECRSCASLIHPPAPVCRYC

SEQ ID NO: 89841 - protein, 20 aa, Mycobacterium avium
LRLRDHDGWPLYPMRPDHTY

SEQ ID NO: 89842 - protein, 30 aa, Mycobacterium avium
LRLSPEAVFKPRWLWKFGKTLRPPELRVPN

SEQ ID NO: 89843 - protein, 17 aa, Mycobacterium avium
LRLTIPVAEAAKPRKIE

SEQ ID NO: 89844 - protein, 17 aa, Mycobacterium avium
LRLTVRMISGPQSGPGQ

SEQ ID NO: 89845 - protein, 19 aa, Mycobacterium avium
LRLVHPLIVAVQTLFRGQT

SEQ ID NO: 89846 - protein, 21 aa, Mycobacterium avium
LRMLLREVFTAAGGSHDDWDE

SEQ ID NO: 89847 - protein, 17 aa, Mycobacterium avium
LRNNLSWTNSYYDDMAW

SEQ ID NO: 89848 - protein, 24 aa, Mycobacterium avium
LRNPRLAGPAPWKPMVSLSGPTSL

SEQ ID NO: 89849 - protein, 24 aa, Mycobacterium avium
LRNQGWRGSAGFMAGFRRVGAPHQ

SEQ ID NO: 89850 - protein, 19 aa, Mycobacterium avium
LRNWREALELPPARHLDTF

SEQ ID NO: 89851 - protein, 20 aa, Mycobacterium avium
LRPAPPGVVGELYIAGHGVA

SEQ ID NO: 89852 - protein, 23 aa, Mycobacterium avium
LRPKRAAVIAPSFTEPAAALSAA

SEQ ID NO: 89853 - protein, 44 aa, Mycobacterium avium
LRPLDGFPQRRARLMMEMHVLGPLHLCQLAIPAMRERGRGWIVN

SEQ ID NO: 89854 - protein, 19 aa, Mycobacterium avium
LRPLPPMRPQHPVPKPRPA

SEQ ID NO: 89855 - protein, 24 aa, Mycobacterium avium
LRPVPLRDPRFVIDVNLGRLAWLL

SEQ ID NO: 89856 - protein, 20 aa, Mycobacterium avium
LRPVPPGVVGELYVAGSGVA

SEQ ID NO: 89857 - protein, 32 aa, Mycobacterium avium
LRQKRLMTLIHLWLVHRFKADAVIYVTPTEDN

SEQ ID NO: 89858 - protein, 20 aa, Mycobacterium avium
LRRAVRLLAQLTRQVAIVQY

SEQ ID NO: 89859 - protein, 33 aa, Mycobacterium avium
LRRCVSSLRARYGDSPAMRRIVIDADRILSDVD

SEQ ID NO: 89860 - protein, 18 aa, Mycobacterium avium
LRREIERFPFVPADRERL

SEQ ID NO: 89861 - protein, 29 aa, Mycobacterium avium
LRRLATGHWLRRWWPASRQDGIAGLDRAL

SEQ ID NO: 89862 - protein, 25 aa, Mycobacterium avium
LRRRTGIDFDPHWLRHTAATRLLRD

SEQ ID NO: 89863 - protein, 20 aa, Mycobacterium avium
LRRSGRIGGPAAWLGTALAL

SEQ ID NO: 89864 - protein, 23 aa, Mycobacterium avium
LRRWQRPLAGYEIHHGRVSRCAE

SEQ ID NO: 89865 - protein, 20 aa, Mycobacterium avium
LRRYVPFDVDAGILSASAAA

SEQ ID NO: 89866 - protein, 25 aa, Mycobacterium avium
LRSGEEMARLFAWCPEAVTAAAELG

SEQ ID NO: 89867 - protein, 18 aa, Mycobacterium avium
LRSGTLVDLYPLVRRSIR

SEQ ID NO: 89868 - protein, 17 aa, Mycobacterium avium
LRSIFAVGVDRSDRAPA

SEQ ID NO: 89869 - protein, 18 aa, Mycobacterium avium
LRSLCFDVLAVGEPDESG

SEQ ID NO: 89870 - protein, 20 aa, Mycobacterium avium
LRSLLRDYQDSFGLGDDAWV

SEQ ID NO: 89871 - protein, 19 aa, Mycobacterium avium
LRSLPLHAWLQVDTTTPLH

SEQ ID NO: 89872 - protein, 17 aa, Mycobacterium avium
LRSMCRRATSTTCGLGW

SEQ ID NO: 89873 - protein, 17 aa, Mycobacterium avium
LRSRFGGRLDVRVSSIR

SEQ ID NO: 89874 - protein, 18 aa, Mycobacterium avium
LRSRPNITVCVGGGIGTP

SEQ ID NO: 89875 - protein, 19 aa, Mycobacterium avium
LRSSYARALHRATKPGARL

SEQ ID NO: 89876 - protein, 17 aa, Mycobacterium avium
LRTQLGKRLPAYMVPAA

SEQ ID NO: 89877 - protein, 20 aa, Mycobacterium avium
LRTYRGVLDAGRVVEFMLLY

SEQ ID NO: 89878 - protein, 19 aa, Mycobacterium avium
LRVAYRPVFPNVYLPAQVE

SEQ ID NO: 89879 - protein, 18 aa, Mycobacterium avium
LRVLASLPELVAAAPDGQ

SEQ ID NO: 89880 - protein, 22 aa, Mycobacterium avium
LRVSELPYLVPILEQSFDHPDY

SEQ ID NO: 89881 - protein, 27 aa, Mycobacterium avium
LRVSPGELRRRFALAARIRPRRSLTGP

SEQ ID NO: 89882 - protein, 24 aa, Mycobacterium avium
LRVVDARAALAARGYCGDETLTVA

SEQ ID NO: 89883 - protein, 17 aa, Mycobacterium avium
LRWLRDDLGALPRAVEE

SEQ ID NO: 89884 - protein, 22 aa, Mycobacterium avium
LRYREIPAAAVRRRFVGLGLGA

SEQ ID NO: 89885 - protein, 26 aa, Mycobacterium avium
LSAADWEPLEAGLLQRSRVLDAVLAD

SEQ ID NO: 89886 - protein, 29 aa, Mycobacterium avium
LSAEKRLGPAVFRDMLGLHFCSTRPVEDE

SEQ ID NO: 89887 - protein, 19 aa, Mycobacterium avium
LSAHLRLEPDLDYGKVIDD

SEQ ID NO: 89888 - protein, 20 aa, Mycobacterium avium
LSATFVRRAFELGATTNMLE

SEQ ID NO: 89889 - protein, 21 aa, Mycobacterium avium
LSDPCGYLARLRELVGPDAWI

SEQ ID NO: 89890 - protein, 22 aa, Mycobacterium avium
LSEPVAVVGMACRYAGGVDSPE

SEQ ID NO: 89891 - protein, 28 aa, Mycobacterium avium
LSFSRYELLRLLAFSRTGALPITKASDR

SEQ ID NO: 89892 - protein, 18 aa, Mycobacterium avium
LSGADVFDGWAVVVDEAG

SEQ ID NO: 89893 - protein, 24 aa, Mycobacterium avium
LSGAKRPVIMAGTNVWWGHGEAAL

SEQ ID NO: 89894 - protein, 17 aa, Mycobacterium avium
LSGEIFSCFSMTEPQGG

SEQ ID NO: 89895 - protein, 20 aa, Mycobacterium avium
LSGFAGRLVGTVAGDVALTG

SEQ ID NO: 89896 - protein, 22 aa, Mycobacterium avium
LSGFERRGRWNVPKKLTTFTLW

SEQ ID NO: 89897 - protein, 18 aa, Mycobacterium avium
LSGPISWDYGSDPSDLVF

SEQ ID NO: 89898 - protein, 17 aa, Mycobacterium avium
LSGRAALLGLRRAGQVS

SEQ ID NO: 89899 - protein, 17 aa, Mycobacterium avium
LSGSAALLGPRLAARSG

SEQ ID NO: 89900 - protein, 18 aa, Mycobacterium avium
LSIPPSWATATPSIRTVA

SEQ ID NO: 89901 - protein, 18 aa, Mycobacterium avium
LSKKPGIHAVHVSSGGKP

SEQ ID NO: 89902 - protein, 17 aa, Mycobacterium avium
LSLCGSTLPAGMCGADG

SEQ ID NO: 89903 - protein, 28 aa, Mycobacterium avium
LSLLTPRLAQLIAIGGFRNWDRMVKRYL

SEQ ID NO: 89904 - protein, 24 aa, Mycobacterium avium
LSPDGLRWSTTEQLGYNRRYTLTA

SEQ ID NO: 89905 - protein, 17 aa, Mycobacterium avium
LSPEIMGLGPIEATKKA

SEQ ID NO: 89906 - protein, 26 aa, Mycobacterium avium
LSPELIREMMDWAACEHVPDDYLPLI

SEQ ID NO: 89907 - protein, 17 aa, Mycobacterium avium
LSPPVLLGKEWLKPTAY

SEQ ID NO: 89908 - protein, 25 aa, Mycobacterium avium
LSPQNGCRMGICHTCTRRKTAGTVR

SEQ ID NO: 89909 - protein, 17 aa, Mycobacterium avium
LSPRVARVAALPVPTDR

SEQ ID NO: 89910 - protein, 19 aa, Mycobacterium avium
LSPTLPVPARIPRPEYVGK

SEQ ID NO: 89911 - protein, 21 aa, Mycobacterium avium
LSQEFPMLFIEDLLDGDDWAG

SEQ ID NO: 89912 - protein, 17 aa, Mycobacterium avium
LSQGARVDTNFVPLGEY

SEQ ID NO: 89913 - protein, 25 aa, Mycobacterium avium
LSQLWFEALAGICAHVRAGGGGLTP

SEQ ID NO: 89914 - protein, 24 aa, Mycobacterium avium
LSQMEIFTLLGYWNTPRAQISLVA

SEQ ID NO: 89915 - protein, 17 aa, Mycobacterium avium
LSRLGCRAVGESRDQEA

SEQ ID NO: 89916 - protein, 26 aa, Mycobacterium avium
LSRRIDPRNGTVLVWGAVNAGVAANA

SEQ ID NO: 89917 - protein, 18 aa, Mycobacterium avium
LSSAPVWCSDIRAGAGLV

SEQ ID NO: 89918 - protein, 26 aa, Mycobacterium avium
LSTFPHPRYELIPQLIVHDGEAAVRD

SEQ ID NO: 89919 - protein, 23 aa, Mycobacterium avium
LSTLRFALSGAEPVEPADVEDLL

SEQ ID NO: 89920 - protein, 18 aa, Mycobacterium avium
LSTLTARHLLASRQQAAL

SEQ ID NO: 89921 - protein, 17 aa, Mycobacterium avium
LSTQGAGVVREYYFNDH

SEQ ID NO: 89922 - protein, 17 aa, Mycobacterium avium
LSTYSGGMFRRVDLASA

SEQ ID NO: 89923 - protein, 17 aa, Mycobacterium avium
LSVAQARRIAVAAQGFT

SEQ ID NO: 89924 - protein, 17 aa, Mycobacterium avium
LSVHLGVADRVRFAGPV

SEQ ID NO: 89925 - protein, 18 aa, Mycobacterium avium
LSVPFWEGCRSRQLRYQR

SEQ ID NO: 89926 - protein, 20 aa, Mycobacterium avium
LSVPPGWTTAAPVLRTVASV

SEQ ID NO: 89927 - protein, 19 aa, Mycobacterium avium
LSVQLSGWMLMEAACNVSA

SEQ ID NO: 89928 - protein, 20 aa, Mycobacterium avium
LSVSRGEFVAVLGPNGSGKT

SEQ ID NO: 89929 - protein, 19 aa, Mycobacterium avium
LTAAAAWDALAAELQSAAS

SEQ ID NO: 89930 - protein, 37 aa, Mycobacterium avium
LTAARALGRYGVCANAICPRARTAMTADVFGDAPEVP

SEQ ID NO: 89931 - protein, 28 aa, Mycobacterium avium
LTAARLAAHAAVFWLGRGRTASRETAVA

SEQ ID NO: 89932 - protein, 23 aa, Mycobacterium avium
LTAARLRSALPRGGADVETVLPK

SEQ ID NO: 89933 - protein, 28 aa, Mycobacterium avium
LTAARPGWREARWVSVVINYRAERWSDV

SEQ ID NO: 89934 - protein, 18 aa, Mycobacterium avium
LTAGVLLFTARREVRGAY

SEQ ID NO: 89935 - protein, 18 aa, Mycobacterium avium
LTALLRATLTVVRGAAAE

SEQ ID NO: 89936 - protein, 30 aa, Mycobacterium avium
LTAMPGKPCLRLLGFERVELGPGESRHVTI

SEQ ID NO: 89937 - protein, 23 aa, Mycobacterium avium
LTANAYLGAWGIVDCLGDGANVV

SEQ ID NO: 89938 - protein, 19 aa, Mycobacterium avium
LTAQYGTPCYARVDAPADR

SEQ ID NO: 89939 - protein, 21 aa, Mycobacterium avium
LTDHPDRFRAMIVESSNPAHS

SEQ ID NO: 89940 - protein, 34 aa, Mycobacterium avium
LTDMIRFGSLFLREGVSLTGRRVLPEAWIADTLA

SEQ ID NO: 89941 - protein, 20 aa, Mycobacterium avium
LTEALSVEWQRHGVRVADVL

SEQ ID NO: 89942 - protein, 20 aa, Mycobacterium avium
LTERCFRVFNFIDPPSRLRD

SEQ ID NO: 89943 - protein, 20 aa, Mycobacterium avium
LTERKQVLVVIGRSDEAGAK

SEQ ID NO: 89944 - protein, 23 aa, Mycobacterium avium
LTERRRGVVVNPVLETSEIPETM

SEQ ID NO: 89945 - protein, 24 aa, Mycobacterium avium
LTFLDREGWDALTINALATQLGTK

SEQ ID NO: 89946 - protein, 18 aa, Mycobacterium avium
LTGAGVWGPPADRDECVR

SEQ ID NO: 89947 - protein, 18 aa, Mycobacterium avium
LTGCAKLFREGYTDVNQF

SEQ ID NO: 89948 - protein, 22 aa, Mycobacterium avium
LTGEEWMGPSAAAMVTAVQPYV

SEQ ID NO: 89949 - protein, 17 aa, Mycobacterium avium
LTGHKWFTSAPMCDIFL

SEQ ID NO: 89950 - protein, 17 aa, Mycobacterium avium
LTGLKRISRRAMSAPSS

SEQ ID NO: 89951 - protein, 17 aa, Mycobacterium avium
LTGRPFAASAPRIGAPR

SEQ ID NO: 89952 - protein, 18 aa, Mycobacterium avium
LTGVPIDYFAEVNLAGFY

SEQ ID NO: 89953 - protein, 19 aa, Mycobacterium avium
LTHALAAVRSRLAAAAEAA

SEQ ID NO: 89954 - protein, 19 aa, Mycobacterium avium
LTHGQRAMVLVARVLPQPV

SEQ ID NO: 89955 - protein, 22 aa, Mycobacterium avium
LTHLRANAPVSWVEVPNYKPFW

SEQ ID NO: 89956 - protein, 19 aa, Mycobacterium avium
LTIVEGFALLSVPSSFVQN

SEQ ID NO: 89957 - protein, 18 aa, Mycobacterium avium
LTKCGPWHQGGWDPIPER

SEQ ID NO: 89958 - protein, 30 aa, Mycobacterium avium
LTLCGLDLRPARSRAHCLQLIADHAAAHPG

SEQ ID NO: 89959 - protein, 17 aa, Mycobacterium avium
LTLEVAEQLFATPQEGR

SEQ ID NO: 89960 - protein, 25 aa, Mycobacterium avium
LTLRGALVRDPRAWSGYLTEAIDTF

SEQ ID NO: 89961 - protein, 17 aa, Mycobacterium avium
LTLSAFANKVTVGFTSD

SEQ ID NO: 89962 - protein, 17 aa, Mycobacterium avium
LTPFGAPPQTADANAAA

SEQ ID NO: 89963 - protein, 19 aa, Mycobacterium avium
LTPHSKWSFHSTYQDNLYM

SEQ ID NO: 89964 - protein, 18 aa, Mycobacterium avium
LTPMTAPRSNTSPEGVAA

SEQ ID NO: 89965 - protein, 26 aa, Mycobacterium avium
LTPRMRRIRFSGPRLHGLGWTPGQHV

SEQ ID NO: 89966 - protein, 28 aa, Mycobacterium avium
LTPTAVEEVVRWASPVVYMRRTLTRDVK

SEQ ID NO: 89967 - protein, 20 aa, Mycobacterium avium
LTRFPKLRIASVENGSAWIK

SEQ ID NO: 89968 - protein, 24 aa, Mycobacterium avium
LTRTDTRTYCPFKGEASYYSVTTS

SEQ ID NO: 89969 - protein, 21 aa, Mycobacterium avium
LTSPRGKRQFRRAVLDDDAGT

SEQ ID NO: 89970 - protein, 41 aa, Mycobacterium avium
LTTCKHCSGRLRKRFNSVGVVFKGSGFYRTDSRESGKKPAG

SEQ ID NO: 89971 - protein, 30 aa, Mycobacterium avium
LTTKTVGVALRFLPDSWKAAASRVNSTPAG

SEQ ID NO: 89972 - protein, 17 aa, Mycobacterium avium
LTTPYAWYQYFFNTADA

SEQ ID NO: 89973 - protein, 35 aa, Mycobacterium avium
LTTRKVWREPVGVVGAIVPWNFPFEVTLNKLGQAL

SEQ ID NO: 89974 - protein, 23 aa, Mycobacterium avium
LTVEEGVVFNAEISAAIDESLAR

SEQ ID NO: 89975 - protein, 26 aa, Mycobacterium avium
LVAANRARLAMLLATNFFGINYPAIA

SEQ ID NO: 89976 - protein, 26 aa, Mycobacterium avium
LVAAWKLLLAEGIEGRCRIIGPIDDY

SEQ ID NO: 89977 - protein, 19 aa, Mycobacterium avium
LVAEEFNSLFFRNAVNSGL

SEQ ID NO: 89978 - protein, 22 aa, Mycobacterium avium
LVAGEAASGWAPLRGSAIANEH

SEQ ID NO: 89979 - protein, 17 aa, Mycobacterium avium
LVARIGIVGTPEQCAEQ

SEQ ID NO: 89980 - protein, 20 aa, Mycobacterium avium
LVAVAEGKNALGRALLSTAA

SEQ ID NO: 89981 - protein, 17 aa, Mycobacterium avium
LVDVIACGVCHTDLTYR

SEQ ID NO: 89982 - protein, 17 aa, Mycobacterium avium
LVERWGPGRVMINEYGP

SEQ ID NO: 89983 - protein, 20 aa, Mycobacterium avium
LVFNDFLIAVARMRALDPVT

SEQ ID NO: 89984 - protein, 19 aa, Mycobacterium avium
LVGLLDEWTPVIAGAELGE

SEQ ID NO: 89985 - protein, 18 aa, Mycobacterium avium
LVGPRGYVAERMAAFAES

SEQ ID NO: 89986 - protein, 23 aa, Mycobacterium avium
LVGRARAVGALTVLDACQSVPHQ

SEQ ID NO: 89987 - protein, 17 aa, Mycobacterium avium
LVGRRLDTAGAINHGAQ

SEQ ID NO: 89988 - protein, 20 aa, Mycobacterium avium
LVGTSRAMLTLGRRHAVDRV

SEQ ID NO: 89989 - protein, 18 aa, Mycobacterium avium
LVHGDFRMGNLIVDGAQL

SEQ ID NO: 89990 - protein, 18 aa, Mycobacterium avium
LVIAPWFLAPGFITDGVS

SEQ ID NO: 89991 - protein, 24 aa, Mycobacterium avium
LVIPRPDGLRDIGYLTELLAREGI

SEQ ID NO: 89992 - protein, 22 aa, Mycobacterium avium
LVKSGMLIRVCHGVYAPNVPDV

SEQ ID NO: 89993 - protein, 17 aa, Mycobacterium avium
LVKSIRAGESVSYGHTW

SEQ ID NO: 89994 - protein, 20 aa, Mycobacterium avium
LVKVPAGWSHTAAATASVVF

SEQ ID NO: 89995 - protein, 17 aa, Mycobacterium avium
LVLFDGMGHDLPQQLWD

SEQ ID NO: 89996 - protein, 17 aa, Mycobacterium avium
LVMGGSCQRTWEHAVPK

SEQ ID NO: 89997 - protein, 25 aa, Mycobacterium avium
LVPVYRERYVLLAPADLLASGAATM

SEQ ID NO: 89998 - protein, 27 aa, Mycobacterium avium
LVQLTRKRLGTGLVEAFSTSCPNCGGR

SEQ ID NO: 89999 - protein, 26 aa, Mycobacterium avium
LVRDPRWIALAGWAPRIQVVHDDRPH

SEQ ID NO: 90000 - protein, 17 aa, Mycobacterium avium
LVRGRRRTYTFASADTP

SEQ ID NO: 90001 - protein, 22 aa, Mycobacterium avium
LVSGRASFELAQKAVMAGIPVL

SEQ ID NO: 90002 - protein, 26 aa, Mycobacterium avium
LVSNLRAAYRISISDLDWMTPQTRQR

SEQ ID NO: 90003 - protein, 24 aa, Mycobacterium avium
LVVPAERAEFGWDVIDATDWPADR

SEQ ID NO: 90004 - protein, 21 aa, Mycobacterium avium
LWGEGGTFCAGADLKAFGTPE

SEQ ID NO: 90005 - protein, 18 aa, Mycobacterium avium
LWLALMSPAALARVESIA

SEQ ID NO: 90006 - protein, 19 aa, Mycobacterium avium
LWLASRADRAMWLESAGAG

SEQ ID NO: 90007 - protein, 19 aa, Mycobacterium avium
LWQECNQVGMPRAVVITKL

SEQ ID NO: 90008 - protein, 23 aa, Mycobacterium avium
LWSKASGLDLVRLGTTASTEEIT

SEQ ID NO: 90009 - protein, 19 aa, Mycobacterium avium
LWVDGLLAGLFSRADASQQ

SEQ ID NO: 90010 - protein, 24 aa, Mycobacterium avium
LYAHPRAGALVAMESRARLFPQGL

SEQ ID NO: 90011 - protein, 19 aa, Mycobacterium avium
LYEDGRFPAAPDYCEAYGK

SEQ ID NO: 90012 - protein, 19 aa, Mycobacterium avium
LYFEGGPDFEYFKDPVKTA

SEQ ID NO: 90013 - protein, 24 aa, Mycobacterium avium
LYGRPAAAVLIDFADLAVTPVAFD

SEQ ID NO: 90014 - protein, 18 aa, Mycobacterium avium
LYGVPRAERAERVDQALA

SEQ ID NO: 90015 - protein, 22 aa, Mycobacterium avium
LYMAGAKLDSLVPLGPPVMDVA

SEQ ID NO: 90016 - protein, 18 aa, Mycobacterium avium
LYPRLSPGGFCIVDDYHA

SEQ ID NO: 90017 - protein, 17 aa, Mycobacterium avium
LYPSMPIAAAQAGADLV

SEQ ID NO: 90018 - protein, 18 aa, Mycobacterium avium
LYQPGTWGPNAIHQLIAP

SEQ ID NO: 90019 - protein, 18 aa, Mycobacterium avium
LYRALRLLADCGRGEVIG

SEQ ID NO: 90020 - protein, 25 aa, Mycobacterium avium
LYTQRPSWPGGIAVGKTAVSSSMID

SEQ ID NO: 90021 - protein, 18 aa, Mycobacterium avium
LYTTPDFERVVSLLSRTE

SEQ ID NO: 90022 - protein, 18 aa, Mycobacterium avium
LYWIGRYVERADDTARIL

SEQ ID NO: 90023 - protein, 22 aa, Mycobacterium avium
MAAAAAPFIAWLDGTAVQAEQT

SEQ ID NO: 90024 - protein, 19 aa, Mycobacterium avium
MAAAAAPYVAWLSATSAQA

SEQ ID NO: 90025 - protein, 19 aa, Mycobacterium avium
MAASLVHRAEAAGFKGIAV

SEQ ID NO: 90026 - protein, 20 aa, Mycobacterium avium
MAASMGEFLLAAGTKGKRYA

SEQ ID NO: 90027 - protein, 17 aa, Mycobacterium avium
MAAYGISAERAFDILVW

SEQ ID NO: 90028 - protein, 19 aa, Mycobacterium avium
MADLRDKVVILVDDGIATG

SEQ ID NO: 90029 - protein, 22 aa, Mycobacterium avium
MAGELKRRGFRFVGPTTAYALM

SEQ ID NO: 90030 - protein, 19 aa, Mycobacterium avium
MAGLDFGYSQTKWVAEQLA

SEQ ID NO: 90031 - protein, 17 aa, Mycobacterium avium
MAGLKPLVEGGRLTAAM

SEQ ID NO: 90032 - protein, 17 aa, Mycobacterium avium
MAGVLGVLPVLATDVLR

SEQ ID NO: 90033 - protein, 24 aa, Mycobacterium avium
MALIHKRAHGVAVVAFEGRPLGLV

SEQ ID NO: 90034 - protein, 18 aa, Mycobacterium avium
MAPGQPDLVCDFWTELGR

SEQ ID NO: 90035 - protein, 22 aa, Mycobacterium avium
MATGELLGCFGLTEPDVGSDPA

SEQ ID NO: 90036 - protein, 25 aa, Mycobacterium avium
MAYERVTLYGLPLVSRRRVGYARID

SEQ ID NO: 90037 - protein, 17 aa, Mycobacterium avium
MCLPGHRAAELGHFAAL

SEQ ID NO: 90038 - protein, 25 aa, Mycobacterium avium
MCRRATSTTCGLGWATVTPTIVPRT

SEQ ID NO: 90039 - protein, 18 aa, Mycobacterium avium
MDLYWPGRLDGCAEPAVQ

SEQ ID NO: 90040 - protein, 22 aa, Mycobacterium avium
MDRWDPARAVALMTAHRCTHMA

SEQ ID NO: 90041 - protein, 17 aa, Mycobacterium avium
MEAALGIPAGNLAATLE

SEQ ID NO: 90042 - protein, 17 aa, Mycobacterium avium
MEARVALTELFKRIRGY

SEQ ID NO: 90043 - protein, 21 aa, Mycobacterium avium
MEAVGLGRLGPSASLPGNPAD

SEQ ID NO: 90044 - protein, 17 aa, Mycobacterium avium
MEIVTWVLAGALAHQDS

SEQ ID NO: 90045 - protein, 19 aa, Mycobacterium avium
MELENRIAMMSRFATDFDT

SEQ ID NO: 90046 - protein, 17 aa, Mycobacterium avium
MELFKTALRLARHRELV

SEQ ID NO: 90047 - protein, 24 aa, Mycobacterium avium
MERFDLDAVEAFELLTRLSQQSNT

SEQ ID NO: 90048 - protein, 22 aa, Mycobacterium avium
MEWDVRNGVIARKGRAHGLPTP

SEQ ID NO: 90049 - protein, 23 aa, Mycobacterium avium
MFAKRPAFDFKQLITEDDLPCLR

SEQ ID NO: 90050 - protein, 18 aa, Mycobacterium avium
MFAVLPTIVAADMRRRRG

SEQ ID NO: 90051 - protein, 17 aa, Mycobacterium avium
MFGENFFYILYFQEPGV

SEQ ID NO: 90052 - protein, 18 aa, Mycobacterium avium
MFRRYWPADLHMIGKDII

SEQ ID NO: 90053 - protein, 24 aa, Mycobacterium avium
MFTLGFRFKPWRSAKSIADGASIK

SEQ ID NO: 90054 - protein, 20 aa, Mycobacterium avium
MFTRMLKLPEAVRHSYDLSS

SEQ ID NO: 90055 - protein, 17 aa, Mycobacterium avium
MGAQFARIQQEAVELAN

SEQ ID NO: 90056 - protein, 19 aa, Mycobacterium avium
MGFCTPQEYVLFLRQTPIF

SEQ ID NO: 90057 - protein, 17 aa, Mycobacterium avium
MGLATARCLADEGARVA

SEQ ID NO: 90058 - protein, 18 aa, Mycobacterium avium
MGLVPAMTVKCTVALVKS

SEQ ID NO: 90059 - protein, 20 aa, Mycobacterium avium
MGNLEFLVRNGIHAVVGTTG

SEQ ID NO: 90060 - protein, 21 aa, Mycobacterium avium
MGRLGVPVVAEFDCPEARTIV

SEQ ID NO: 90061 - protein, 18 aa, Mycobacterium avium
MGTFRLDPGQALVLDIAP

SEQ ID NO: 90062 - protein, 17 aa, Mycobacterium avium
MGVKAGLDPAVMIEVLN

SEQ ID NO: 90063 - protein, 23 aa, Mycobacterium avium
MHAKCPMAWTDTYGGHWVAAGSH

SEQ ID NO: 90064 - protein, 19 aa, Mycobacterium avium
MHDLVAFSMLYGGVDSQRP

SEQ ID NO: 90065 - protein, 32 aa, Mycobacterium avium
MHDWCISRQLWWGHRIPIWYGPNGEQRCVGPD

SEQ ID NO: 90066 - protein, 22 aa, Mycobacterium avium
MIAELLEAYGIPTAGAEGFEAD

SEQ ID NO: 90067 - protein, 26 aa, Mycobacterium avium
MINFLTRRGVALIRCAGWSDYYPNHK

SEQ ID NO: 90068 - protein, 18 aa, Mycobacterium avium
MIVIRLQTVVSREVAPTE

SEQ ID NO: 90069 - protein, 34 aa, Mycobacterium avium
MKAEGTFEYQALLFIPSHAPFDLFNRDAHTGIQL

SEQ ID NO: 90070 - protein, 20 aa, Mycobacterium avium
MKAGAGYFPVDPGYPSARKQ

SEQ ID NO: 90071 - protein, 19 aa, Mycobacterium avium
MKAQDPKGGRIINFGSSEA

SEQ ID NO: 90072 - protein, 19 aa, Mycobacterium avium
MKGNLAKAAGLFNAPASQV

SEQ ID NO: 90073 - protein, 17 aa, Mycobacterium avium
MKSGAVLVDISIDQGGC

SEQ ID NO: 90074 - protein, 20 aa, Mycobacterium avium
MLDLGFLPDIERILRQIPDD

SEQ ID NO: 90075 - protein, 24 aa, Mycobacterium avium
MLDRGWHSGPVFGTHAAAMASGKL

SEQ ID NO: 90076 - protein, 18 aa, Mycobacterium avium
MLEAAVIAGLTSQGVDAL

SEQ ID NO: 90077 - protein, 18 aa, Mycobacterium avium
MLGAIAVPLNFRLTAAEI

SEQ ID NO: 90078 - protein, 17 aa, Mycobacterium avium
MLGRPPLKSATREEQLR

SEQ ID NO: 90079 - protein, 22 aa, Mycobacterium avium
MLHSPPMYRAFRPDLPAPTRED

SEQ ID NO: 90080 - protein, 20 aa, Mycobacterium avium
MLLAEALGFDAFRQRVKIYA

SEQ ID NO: 90081 - protein, 22 aa, Mycobacterium avium
MLLMRAGREYALKRALAKLADR

SEQ ID NO: 90082 - protein, 25 aa, Mycobacterium avium
MLLQPGVLSLAWGSVVRQLAAGLGV

SEQ ID NO: 90083 - protein, 18 aa, Mycobacterium avium
MLLRSMGIPSHYVSGYLH

SEQ ID NO: 90084 - protein, 17 aa, Mycobacterium avium
MLPDVGKLVELARALGR

SEQ ID NO: 90085 - protein, 21 aa, Mycobacterium avium
MLTEPELMKLWWAEGQVAAVV

SEQ ID NO: 90086 - protein, 22 aa, Mycobacterium avium
MMDKLRTAGPWESEQTHESLRR

SEQ ID NO: 90087 - protein, 21 aa, Mycobacterium avium
MMGAQRLHWLGAELNGTPVDA

SEQ ID NO: 90088 - protein, 23 aa, Mycobacterium avium
MNDVKAALARRTNPAGLTGSLAE

SEQ ID NO: 90089 - protein, 20 aa, Mycobacterium avium
MPAALRLARSIAENNAYGVW

SEQ ID NO: 90090 - protein, 32 aa, Mycobacterium avium
MPECTGRVGIAGFCMGGRFALVMSPKGFGASA

SEQ ID NO: 90091 - protein, 21 aa, Mycobacterium avium
MPGVLSARWSGRHGDDAANTA

SEQ ID NO: 90092 - protein, 20 aa, Mycobacterium avium
MPLQAATQWDALSHVYYDDL

SEQ ID NO: 90093 - protein, 19 aa, Mycobacterium avium
MPTLPRMPGLEDFRDGLIP

SEQ ID NO: 90094 - protein, 17 aa, Mycobacterium avium
MPYVEACHHMYGGEYGQ

SEQ ID NO: 90095 - protein, 19 aa, Mycobacterium avium
MPYVLALADRGWRAACRSD

SEQ ID NO: 90096 - protein, 25 aa, Mycobacterium avium
MQTLTDCPLRWLAERHGGTDPRDLR

SEQ ID NO: 90097 - protein, 18 aa, Mycobacterium avium
MRAFGVELGQHMIRVNSV

SEQ ID NO: 90098 - protein, 22 aa, Mycobacterium avium
MREQALRFGADLRMEDVESVSL

SEQ ID NO: 90099 - protein, 31 aa, Mycobacterium avium
MRFSAGRPPDWDQWWEWGPVFLCSNNNKRGI

SEQ ID NO: 90100 - protein, 21 aa, Mycobacterium avium
MRGRPVVICRGHGITSAAATV

SEQ ID NO: 90101 - protein, 21 aa, Mycobacterium avium
MRLLGVTCLEELSPRHVTPLR

SEQ ID NO: 90102 - protein, 20 aa, Mycobacterium avium
MRLQLSAQVGDSWHDVHLDS

SEQ ID NO: 90103 - protein, 18 aa, Mycobacterium avium
MRLTMRCHDLLKSSRAAG

SEQ ID NO: 90104 - protein, 22 aa, Mycobacterium avium
MRPHDPPWCRPLLGQRRAVTHA

SEQ ID NO: 90105 - protein, 17 aa, Mycobacterium avium
MRQRSCAAANMLSDLGV

SEQ ID NO: 90106 - protein, 25 aa, Mycobacterium avium
MRRSYRAERFLGIIDRVRAAMPHAA

SEQ ID NO: 90107 - protein, 18 aa, Mycobacterium avium
MRSAAASYGAVISELTSA

SEQ ID NO: 90108 - protein, 26 aa, Mycobacterium avium
MRWPHGRLRYYVAMLAELSQLRLLPF

SEQ ID NO: 90109 - protein, 17 aa, Mycobacterium avium
MSAAAAWNTMAAEMRSA

SEQ ID NO: 90110 - protein, 17 aa, Mycobacterium avium
MSALSRMSRGEHRSITL

SEQ ID NO: 90111 - protein, 20 aa, Mycobacterium avium
MSAMFPGTQILAAFGQTEMS

SEQ ID NO: 90112 - protein, 22 aa, Mycobacterium avium
MSDVIRLARHAHHYLAVFDNGK

SEQ ID NO: 90113 - protein, 17 aa, Mycobacterium avium
MSECLPYYVGMFEQMKR

SEQ ID NO: 90114 - protein, 21 aa, Mycobacterium avium
MSEVIRLARHAHHYLAVFDNG

SEQ ID NO: 90115 - protein, 22 aa, Mycobacterium avium
MSLSNLRWDGDYVLVDVDASPA

SEQ ID NO: 90116 - protein, 25 aa, Mycobacterium avium
MSMRFYKSREALLDKAKRAEDAGFD

SEQ ID NO: 90117 - protein, 22 aa, Mycobacterium avium
MSNLGLHLAMRSAGITVRTTGV

SEQ ID NO: 90118 - protein, 25 aa, Mycobacterium avium
MSPKLSGRDAVMEWLSEHRKQSPYP

SEQ ID NO: 90119 - protein, 19 aa, Mycobacterium avium
MSRTARGGSIVIISSTSGI

SEQ ID NO: 90120 - protein, 18 aa, Mycobacterium avium
MSTEVIKLITGIGESLLG

SEQ ID NO: 90121 - protein, 19 aa, Mycobacterium avium
MSVAYRLTGTVADAEDIVQ

SEQ ID NO: 90122 - protein, 22 aa, Mycobacterium avium
MTAAAAPYVQWLIIAAAQAEVA

SEQ ID NO: 90123 - protein, 17 aa, Mycobacterium avium
MTDFRYYIPLAKAAEAA

SEQ ID NO: 90124 - protein, 25 aa, Mycobacterium avium
MTIHFRPAGALAFLGSPLSDLEDAL

SEQ ID NO: 90125 - protein, 23 aa, Mycobacterium avium
MTLARERHGVFVFTGNTRHRVEV

SEQ ID NO: 90126 - protein, 24 aa, Mycobacterium avium
MTTLRELPALVVLERIPVPVLAIA

SEQ ID NO: 90127 - protein, 19 aa, Mycobacterium avium
MTTRPFMEFHLRRRVKALP

SEQ ID NO: 90128 - protein, 26 aa, Mycobacterium avium
MTYQNAMRWYSFDPFTHISREQATVG

SEQ ID NO: 90129 - protein, 20 aa, Mycobacterium avium
MVAALRLHGPVDIGALGAAL

SEQ ID NO: 90130 - protein, 19 aa, Mycobacterium avium
MVDRCPSTRLVLGGFSQGA

SEQ ID NO: 90131 - protein, 18 aa, Mycobacterium avium
MVDSSGSIVFRLMYNPFR

SEQ ID NO: 90132 - protein, 18 aa, Mycobacterium avium
MVLPELRALANQVGVKGT

SEQ ID NO: 90133 - protein, 24 aa, Mycobacterium avium
MVPTAGRLARYWRLLPNVGAHAFD

SEQ ID NO: 90134 - protein, 18 aa, Mycobacterium avium
MVVRDRIRTEPPHQGSRY

SEQ ID NO: 90135 - protein, 22 aa, Mycobacterium avium
MWREMWDLSDQCWAQMNTTLLS

SEQ ID NO: 90136 - protein, 23 aa, Mycobacterium avium
MYARGGLVRCITRVMKELAAQRG

SEQ ID NO: 90137 - protein, 19 aa, Mycobacterium avium
MYEEIRVGVLAYMAYHEQN

SEQ ID NO: 90138 - protein, 20 aa, Mycobacterium avium
MYREGWRVVAAMRTPDQGMP

SEQ ID NO: 90139 - protein, 17 aa, Mycobacterium avium
MYSDLMHVMRTIFEPWE

SEQ ID NO: 90140 - protein, 17 aa, Mycobacterium avium
NAAALSYDKVVTALASE

SEQ ID NO: 90141 - protein, 17 aa, Mycobacterium avium
NAARLAIEAGFDAVEIH

SEQ ID NO: 90142 - protein, 18 aa, Mycobacterium avium
NAATARRHLPGLYERWCA

SEQ ID NO: 90143 - protein, 17 aa, Mycobacterium avium
NAAWVYRTLFARVGNRA

SEQ ID NO: 90144 - protein, 23 aa, Mycobacterium avium
NADIAMAFERYRIVTGDDDLEAE

SEQ ID NO: 90145 - protein, 24 aa, Mycobacterium avium
NADRFGIQDAIWRGVYYTPNGAQT

SEQ ID NO: 90146 - protein, 32 aa, Mycobacterium avium
NAELRQRCPVAWNENYGGFWFLSSYDAVSQTA

SEQ ID NO: 90147 - protein, 26 aa, Mycobacterium avium
NAEVELAWHILDPVLDNWASGGRPEP

SEQ ID NO: 90148 - protein, 26 aa, Mycobacterium avium
NAEVSGPLLRRKFRLGSAAMDPLQKA

SEQ ID NO: 90149 - protein, 20 aa, Mycobacterium avium
NAFGQLLAALGRRYDGDERL

SEQ ID NO: 90150 - protein, 24 aa, Mycobacterium avium
NAGICSPAPWNRITAQAFRDTIDT

SEQ ID NO: 90151 - protein, 19 aa, Mycobacterium avium
NAKELGALVQRGMTPAQAI

SEQ ID NO: 90152 - protein, 18 aa, Mycobacterium avium
NALLTPLVTLGFDEIGQV

SEQ ID NO: 90153 - protein, 18 aa, Mycobacterium avium
NALSPAMYFGIRYAVGRL

SEQ ID NO: 90154 - protein, 21 aa, Mycobacterium avium
NASALPFRYTVNGYRGCSHAC

SEQ ID NO: 90155 - protein, 18 aa, Mycobacterium avium
NAVWPPARLAPVLRGADL

SEQ ID NO: 90156 - protein, 17 aa, Mycobacterium avium
NDAELDDAFGFLQNGAG

SEQ ID NO: 90157 - protein, 18 aa, Mycobacterium avium
NDELKFWALSRHQDVLQG

SEQ ID NO: 90158 - protein, 23 aa, Mycobacterium avium
NDIVAVLALYRPGPMGMNAHNDY

SEQ ID NO: 90159 - protein, 23 aa, Mycobacterium avium
NDLRVVDNVRYFAALYGFDGQAA

SEQ ID NO: 90160 - protein, 26 aa, Mycobacterium avium
NDRWHSLARLAIRDDIYASLRSLCFD

SEQ ID NO: 90161 - protein, 25 aa, Mycobacterium avium
NDSVSCPRSGEVIVREQGHWYSTGA

SEQ ID NO: 90162 - protein, 17 aa, Mycobacterium avium
NEDEVDAFLDLVEAELT

SEQ ID NO: 90163 - protein, 24 aa, Mycobacterium avium
NEGKRIVPVCSMIGTVLKKHPEFD

SEQ ID NO: 90164 - protein, 18 aa, Mycobacterium avium
NEILREFRQAISYLSAEL

SEQ ID NO: 90165 - protein, 24 aa, Mycobacterium avium
NELAQRVAAVAGFLRQRLTGDYSV

SEQ ID NO: 90166 - protein, 20 aa, Mycobacterium avium
NELEGALWVAVRSLQEKARL

SEQ ID NO: 90167 - protein, 17 aa, Mycobacterium avium
NELLLYEALGLCGPGEA

SEQ ID NO: 90168 - protein, 17 aa, Mycobacterium avium
NELPELVAVLTPLLGQI

SEQ ID NO: 90169 - protein, 19 aa, Mycobacterium avium
NEPDFFWSPVNSLEDVVAD

SEQ ID NO: 90170 - protein, 21 aa, Mycobacterium avium
NEPVLSRVFAYWRHVDPDIGR

SEQ ID NO: 90171 - protein, 22 aa, Mycobacterium avium
NEVYRLPKHLDEKVARIHVEAL

SEQ ID NO: 90172 - protein, 20 aa, Mycobacterium avium
NEYIITLGMHDFEKVSADPD

SEQ ID NO: 90173 - protein, 24 aa, Mycobacterium avium
NFAEWKNHRIIVGAVPETLDQVDA

SEQ ID NO: 90174 - protein, 24 aa, Mycobacterium avium
NFFNGNAQAVAWLQQNLSGLLNPS

SEQ ID NO: 90175 - protein, 17 aa, Mycobacterium avium
NFHAWTFEGMAPGQPDL

SEQ ID NO: 90176 - protein, 19 aa, Mycobacterium avium
NFVPARLTLSLADVPATAT

SEQ ID NO: 90177 - protein, 24 aa, Mycobacterium avium
NGELPAVRVGRSFRVHAKAVHDML

SEQ ID NO: 90178 - protein, 24 aa, Mycobacterium avium
NGILASMCFPTFTGFSARHLNMHR

SEQ ID NO: 90179 - protein, 19 aa, Mycobacterium avium
NGKLCKGQQVAWMREVDGL

SEQ ID NO: 90180 - protein, 21 aa, Mycobacterium avium
NGLCQGGGFQIALCSDLSVVS

SEQ ID NO: 90181 - protein, 17 aa, Mycobacterium avium
NGLVLVIDGQLWQIVEF

SEQ ID NO: 90182 - protein, 17 aa, Mycobacterium avium
NGMPGVLSARWSGRHGD

SEQ ID NO: 90183 - protein, 22 aa, Mycobacterium avium
NGSFPEFPLPLGNPSEATASAM

SEQ ID NO: 90184 - protein, 21 aa, Mycobacterium avium
NGSPRAAGRLLSLVEGEQRDE

SEQ ID NO: 90185 - protein, 20 aa, Mycobacterium avium
NGSPRGAFRREIAARIKKLA

SEQ ID NO: 90186 - protein, 19 aa, Mycobacterium avium
NGTFTRRRNVALAGVDLED

SEQ ID NO: 90187 - protein, 18 aa, Mycobacterium avium
NGYCGLPVQQSCPHANAC

SEQ ID NO: 90188 - protein, 19 aa, Mycobacterium avium
NHGAQCTTMAWPQQADHTA

SEQ ID NO: 90189 - protein, 24 aa, Mycobacterium avium
NHPIRSRQVVKLVGISDEQELAYT

SEQ ID NO: 90190 - protein, 43 aa, Mycobacterium avium
NIAADLPGSIGFAVAFCYARFVRRGRKAPGFFVRSADNRYLLQ

SEQ ID NO: 90191 - protein, 19 aa, Mycobacterium avium
NIFESWSQMASQLFGTETF

SEQ ID NO: 90192 - protein, 20 aa, Mycobacterium avium
NIVEELMRYLSIVHSQVDRV

SEQ ID NO: 90193 - protein, 23 aa, Mycobacterium avium
NIVELYISYLRKKIDNGREPMIH

SEQ ID NO: 90194 - protein, 25 aa, Mycobacterium avium
NIVLFRPVGSMALFKQMIGRGTRLF

SEQ ID NO: 90195 - protein, 25 aa, Mycobacterium avium
NKACDPGLPLMLWAYDPLAFAGKGR

SEQ ID NO: 90196 - protein, 25 aa, Mycobacterium avium
NKRLAWTACRTFLAINAHWIEAPED

SEQ ID NO: 90197 - protein, 20 aa, Mycobacterium avium
NLAARFCPQYGEPVQVVPAD

SEQ ID NO: 90198 - protein, 24 aa, Mycobacterium avium
NLARREIAEALNVLANRLRNPRLA

SEQ ID NO: 90199 - protein, 18 aa, Mycobacterium avium
NLERAAAVNSRLGGHIVQ

SEQ ID NO: 90200 - protein, 27 aa, Mycobacterium avium
NLGGRWADRFGGLVFDATGITTPEGLK

SEQ ID NO: 90201 - protein, 23 aa, Mycobacterium avium
NLHRLPLAIARLRRARRRTAPLF

SEQ ID NO: 90202 - protein, 18 aa, Mycobacterium avium
NLHWPLEYVDSFAGLVPR

SEQ ID NO: 90203 - protein, 17 aa, Mycobacterium avium
NLPTPSGNTFEWSPDST

SEQ ID NO: 90204 - protein, 28 aa, Mycobacterium avium
NLRLRDGRWYWHWDPAFMTKPGDDPELR

SEQ ID NO: 90205 - protein, 19 aa, Mycobacterium avium
NLRRLISLFELLRARSQLI

SEQ ID NO: 90206 - protein, 27 aa, Mycobacterium avium
NLTGRPAISVPLHWTDDGLPLGVQFVG

SEQ ID NO: 90207 - protein, 18 aa, Mycobacterium avium
NLVAHAWGAKHLQPGDEI

SEQ ID NO: 90208 - protein, 27 aa, Mycobacterium avium
NLVAPDLVRRLCWDWEPTPDPFAAVEA

SEQ ID NO: 90209 - protein, 20 aa, Mycobacterium avium
NLYLRDLVLALQWVRDNIAE

SEQ ID NO: 90210 - protein, 25 aa, Mycobacterium avium
NMDDARWDAVLAVNLLAPLRLTEGL

SEQ ID NO: 90211 - protein, 23 aa, Mycobacterium avium
NMLFTNWPRPVLTTAEGDEMQAA

SEQ ID NO: 90212 - protein, 18 aa, Mycobacterium avium
NMPPRPGGVGGPGRPARP

SEQ ID NO: 90213 - protein, 18 aa, Mycobacterium avium
NMSPEFGSTAAIFPIDQE

SEQ ID NO: 90214 - protein, 19 aa, Mycobacterium avium
NNEFTREWLAKMAAATDTP

SEQ ID NO: 90215 - protein, 20 aa, Mycobacterium avium
NPAAMGYPSFHDEYWNPLWK

SEQ ID NO: 90216 - protein, 17 aa, Mycobacterium avium
NPAEAIATLLAHYPDAE

SEQ ID NO: 90217 - protein, 18 aa, Mycobacterium avium
NPAGSAFIIGGVLESQRH

SEQ ID NO: 90218 - protein, 21 aa, Mycobacterium avium
NPAHLAHALVLLLTVGGVPSV

SEQ ID NO: 90219 - protein, 17 aa, Mycobacterium avium
NPDNGYVSFNFQVRDSD

SEQ ID NO: 90220 - protein, 17 aa, Mycobacterium avium
NPFFDWGSDRAPLTPYH

SEQ ID NO: 90221 - protein, 18 aa, Mycobacterium avium
NPIIFNLPATVEMATPNV

SEQ ID NO: 90222 - protein, 24 aa, Mycobacterium avium
NPMLAQRLGVWVPLDEVPDVWEAV

SEQ ID NO: 90223 - protein, 28 aa, Mycobacterium avium
NPNAFRRKEIPVDEILNSAVLNYPLTQY

SEQ ID NO: 90224 - protein, 21 aa, Mycobacterium avium
NPNHYLAVAIEYLYTQRPSWP

SEQ ID NO: 90225 - protein, 19 aa, Mycobacterium avium
NPNLMFPQTPLSIGAKQGT

SEQ ID NO: 90226 - protein, 24 aa, Mycobacterium avium
NPNLRPLVNGPFYAVRMVLSDLGT

SEQ ID NO: 90227 - protein, 18 aa, Mycobacterium avium
NPPEKGSRVRLHPAPGHL

SEQ ID NO: 90228 - protein, 19 aa, Mycobacterium avium
NQINNVLAFPGVFRGALEA

SEQ ID NO: 90229 - protein, 17 aa, Mycobacterium avium
NQTMVLAAPAGVGVDDV

SEQ ID NO: 90230 - protein, 17 aa, Mycobacterium avium
NRIAVRFQYECRDRSGQ

SEQ ID NO: 90231 - protein, 18 aa, Mycobacterium avium
NRIRGVWLPGPVRRLTEG

SEQ ID NO: 90232 - protein, 21 aa, Mycobacterium avium
NRLGALIANGATMTRVPARSG

SEQ ID NO: 90233 - protein, 28 aa, Mycobacterium avium
NRNHSPGAVALVRRARRLLPGDPDFGDP

SEQ ID NO: 90234 - protein, 24 aa, Mycobacterium avium
NRPLFPSLRGCLAGGAPITAELSR

SEQ ID NO: 90235 - protein, 20 aa, Mycobacterium avium
NRPLRPVARITTERDTQVLY

SEQ ID NO: 90236 - protein, 18 aa, Mycobacterium avium
NRQEIKQALLALQRAAER

SEQ ID NO: 90237 - protein, 21 aa, Mycobacterium avium
NRRPVSWCRELLSATNRSSDY

SEQ ID NO: 90238 - protein, 24 aa, Mycobacterium avium
NRSKLSEMPVLWAYARDLFQTPGF

SEQ ID NO: 90239 - protein, 27 aa, Mycobacterium avium
NRVKTWLQFPQWFYFNIPVNTMVAPRL

SEQ ID NO: 90240 - protein, 19 aa, Mycobacterium avium
NRYLPRFIRQFPFNVLLYD

SEQ ID NO: 90241 - protein, 26 aa, Mycobacterium avium
NSAACREAFASLELMVVIDVAMTETA

SEQ ID NO: 90242 - protein, 26 aa, Mycobacterium avium
NSAGRYRPFYLRNLLDAVQGRTLEEA

SEQ ID NO: 90243 - protein, 23 aa, Mycobacterium avium
NSIHLRGSPPISNLRGDVATAAA

SEQ ID NO: 90244 - protein, 25 aa, Mycobacterium avium
NSIRSRLPRVLDWLARTDVDVLAMQ

SEQ ID NO: 90245 - protein, 19 aa, Mycobacterium avium
NSVHPWGVATPMGVPPTEF

SEQ ID NO: 90246 - protein, 17 aa, Mycobacterium avium
NTDNMFGFWDWVGGRYS

SEQ ID NO: 90247 - protein, 26 aa, Mycobacterium avium
NTITRLREHLTILGSVFHSGAVDFHG

SEQ ID NO: 90248 - protein, 27 aa, Mycobacterium avium
NTLGTWKRLCDPMAQQISTVWAASLPE

SEQ ID NO: 90249 - protein, 20 aa, Mycobacterium avium
NTTIPTKRSETFTTADDNQP

SEQ ID NO: 90250 - protein, 18 aa, Mycobacterium avium
NTVPRGGVLGTQRLLDVL

SEQ ID NO: 90251 - protein, 18 aa, Mycobacterium avium
NVARKFKTVRRVLGELPL

SEQ ID NO: 90252 - protein, 19 aa, Mycobacterium avium
NVDVPMMIVVVGSGAHIGR

SEQ ID NO: 90253 - protein, 25 aa, Mycobacterium avium
NVEARRYPAIMAMTSLNDTRVYYVE

SEQ ID NO: 90254 - protein, 20 aa, Mycobacterium avium
NVIDPLDWVDMFGADALRFT

SEQ ID NO: 90255 - protein, 17 aa, Mycobacterium avium
NVLGGYGVRLRWSSVPR

SEQ ID NO: 90256 - protein, 25 aa, Mycobacterium avium
NVPRLVPGWSKPIVIGRHAFGDQYR

SEQ ID NO: 90257 - protein, 28 aa, Mycobacterium avium
NVSKDLPFAQARFCGAEGIENVKTASAF

SEQ ID NO: 90258 - protein, 26 aa, Mycobacterium avium
NVTAALDIRPALLVHTSLATVQFVLD

SEQ ID NO: 90259 - protein, 21 aa, Mycobacterium avium
NVVDALAWVMGEQGAKTLRGG

SEQ ID NO: 90260 - protein, 26 aa, Mycobacterium avium
NWPAKRAGTAAALWELSEELTGTKFP

SEQ ID NO: 90261 - protein, 25 aa, Mycobacterium avium
NWREDKRWTPAWSDEQRAAGYAGWR

SEQ ID NO: 90262 - protein, 19 aa, Mycobacterium avium
NWWLRARTASDIGGAGLAL

SEQ ID NO: 90263 - protein, 26 aa, Mycobacterium avium
NWYAFDPCCPFGGYKNSGIGRENGPE

SEQ ID NO: 90264 - protein, 17 aa, Mycobacterium avium
NYCRHRGAMPACGSGNA

SEQ ID NO: 90265 - protein, 44 aa, Mycobacterium avium
NYPAIKGQNLFGFGWDIDTGYSRPRGRVFPIGSFGNTGFTGTTL

SEQ ID NO: 90266 - protein, 23 aa, Mycobacterium avium
NYVSRLLAKLGMERRTQAAVFAS

SEQ ID NO: 90267 - protein, 25 aa, Mycobacterium avium
PAAAVFRFLRRVPRDTVVLLDEAYV

SEQ ID NO: 90268 - protein, 23 aa, Mycobacterium avium
PAAGPPPRRGFGVDVGGSGIKGG

SEQ ID NO: 90269 - protein, 21 aa, Mycobacterium avium
PAAIRLGLLAGHYRGDRYWSD

SEQ ID NO: 90270 - protein, 25 aa, Mycobacterium avium
PAAPETRIGFMLADAKPVAALSTAE

SEQ ID NO: 90271 - protein, 23 aa, Mycobacterium avium
PAARAGEMLNLVAAYAADPLDPA

SEQ ID NO: 90272 - protein, 24 aa, Mycobacterium avium
PAARREFAEELGLAVPPGERIDLG

SEQ ID NO: 90273 - protein, 17 aa, Mycobacterium avium
PAARVVSTTGIPTRAIT

SEQ ID NO: 90274 - protein, 24 aa, Mycobacterium avium
PADCAGATLFLCTEAASYITGSTI

SEQ ID NO: 90275 - protein, 22 aa, Mycobacterium avium
PADESAVLLLRFTAGPPTSVAS

SEQ ID NO: 90276 - protein, 32 aa, Mycobacterium avium
PADPATLADLVFAWRVCRAVKSNAIVIAAGGA

SEQ ID NO: 90277 - protein, 25 aa, Mycobacterium avium
PAEACYRDELAALPSVRVLHGYTRS

SEQ ID NO: 90278 - protein, 20 aa, Mycobacterium avium
PAEALPWYRIALQSNGSEPG

SEQ ID NO: 90279 - protein, 22 aa, Mycobacterium avium
PAEAVVAVGDWVRGELEYLPGT

SEQ ID NO: 90280 - protein, 17 aa, Mycobacterium avium
PAEFGPIRVRFLGINAR

SEQ ID NO: 90281 - protein, 22 aa, Mycobacterium avium
PAERADFGWEVVDASGWSADQL

SEQ ID NO: 90282 - protein, 17 aa, Mycobacterium avium
PAGLNPGRIEQWGISNF

SEQ ID NO: 90283 - protein, 18 aa, Mycobacterium avium
PAHQRYLVQLTITSLADQ

SEQ ID NO: 90284 - protein, 20 aa, Mycobacterium avium
PAIAGELYVAPSTVKTHVQR

SEQ ID NO: 90285 - protein, 19 aa, Mycobacterium avium
PAIDRESPPPAPRDDERAW

SEQ ID NO: 90286 - protein, 21 aa, Mycobacterium avium
PAKKMPAFADFVGYDHSEVSG

SEQ ID NO: 90287 - protein, 25 aa, Mycobacterium avium
PAKLWTIADLGGWSAADPQLFDKNT

SEQ ID NO: 90288 - protein, 17 aa, Mycobacterium avium
PALPAARIEFLLGDAEP

SEQ ID NO: 90289 - protein, 25 aa, Mycobacterium avium
PALQPEIRLAAPLLAKGLPACPGVV

SEQ ID NO: 90290 - protein, 17 aa, Mycobacterium avium
PALRWYWDCYVPSTRDR

SEQ ID NO: 90291 - protein, 20 aa, Mycobacterium avium
PALVYAHGGGFVFCDLDSHD

SEQ ID NO: 90292 - protein, 21 aa, Mycobacterium avium
PALWIPDVGGPVFDAVGHLLG

SEQ ID NO: 90293 - protein, 21 aa, Mycobacterium avium
PAMHTEMWLHPATVDNVATLR

SEQ ID NO: 90294 - protein, 19 aa, Mycobacterium avium
PAPARRTGGHPAKRTFQAL

SEQ ID NO: 90295 - protein, 19 aa, Mycobacterium avium
PAPIGRAWMSQMRQGWPHR

SEQ ID NO: 90296 - protein, 30 aa, Mycobacterium avium
PAPLARSAMTAFDWFCWRLNKKVEDAQRRE

SEQ ID NO: 90297 - protein, 31 aa, Mycobacterium avium
PAPPRPDGLAAELLRRLPFELTAGQREVLDV

SEQ ID NO: 90298 - protein, 17 aa, Mycobacterium avium
PAQLLTALIEARAKVEK

SEQ ID NO: 90299 - protein, 25 aa, Mycobacterium avium
PAREVARLLAGIAPRSAAAAGRVVA

SEQ ID NO: 90300 - protein, 20 aa, Mycobacterium avium
PARFNGTVLVEWLNVSGGID

SEQ ID NO: 90301 - protein, 24 aa, Mycobacterium avium
PARKRRMFDLLVRMGYKEIEVGFP

SEQ ID NO: 90302 - protein, 20 aa, Mycobacterium avium
PARLHPGSFYALPQSPQLFK

SEQ ID NO: 90303 - protein, 25 aa, Mycobacterium avium
PARLKVGIISAGRVGTALGVALERA

SEQ ID NO: 90304 - protein, 23 aa, Mycobacterium avium
PARMLRTAWTDEWDRPENPDPLG

SEQ ID NO: 90305 - protein, 23 aa, Mycobacterium avium
PARNACAILALELLVHAWDYARA

SEQ ID NO: 90306 - protein, 27 aa, Mycobacterium avium
PARVRLRGGPVLAELTARFGAAARAKV

SEQ ID NO: 90307 - protein, 21 aa, Mycobacterium avium
PASEPDAGWAVIDVETSGFRP

SEQ ID NO: 90308 - protein, 19 aa, Mycobacterium avium
PASGAAHLLAEWTCGNGDS

SEQ ID NO: 90309 - protein, 23 aa, Mycobacterium avium
PASIRRPRGAPRQLLLDTARARF

SEQ ID NO: 90310 - protein, 37 aa, Mycobacterium avium
PASRVAILLPAHWQTAAVLFGVWWIGAEAVLAGPADL

SEQ ID NO: 90311 - protein, 18 aa, Mycobacterium avium
PASSFAIVGYAARFPGAA

SEQ ID NO: 90312 - protein, 18 aa, Mycobacterium avium
PATGPSLPELFTAQVANA

SEQ ID NO: 90313 - protein, 19 aa, Mycobacterium avium
PAVCSGAAIVPAKFSARNF

SEQ ID NO: 90314 - protein, 18 aa, Mycobacterium avium
PAVIRAALLAALDADPAS

SEQ ID NO: 90315 - protein, 20 aa, Mycobacterium avium
PAVIYCHAGGFALGNLDTDH

SEQ ID NO: 90316 - protein, 28 aa, Mycobacterium avium
PAYQRWLGTRLPYYANWIRLKSYWGTAD

SEQ ID NO: 90317 - protein, 19 aa, Mycobacterium avium
PCADSAALVLIDVQRDFYA

SEQ ID NO: 90318 - protein, 20 aa, Mycobacterium avium
PCPPAGTGTHHYRFTLYQLP

SEQ ID NO: 90319 - protein, 23 aa, Mycobacterium avium
PCRDTITWLARRGILAAPGEFYG

SEQ ID NO: 90320 - protein, 17 aa, Mycobacterium avium
PCRRPGWDEIAAVLDAL

SEQ ID NO: 90321 - protein, 18 aa, Mycobacterium avium
PDAGGAWSQGRVALGHRR

SEQ ID NO: 90322 - protein, 27 aa, Mycobacterium avium
PDAHPRGGVELELFASVFDYAMQLTAD

SEQ ID NO: 90323 - protein, 18 aa, Mycobacterium avium
PDARPGLVEAARLTEALR

SEQ ID NO: 90324 - protein, 20 aa, Mycobacterium avium
PDDEVPAFVAGIAERTGEFL

SEQ ID NO: 90325 - protein, 24 aa, Mycobacterium avium
PDDPEIRAPWTLPKRSRKAGPSSR

SEQ ID NO: 90326 - protein, 26 aa, Mycobacterium avium
PDELRTAWVDIPEVFSAATVTGTPDA

SEQ ID NO: 90327 - protein, 24 aa, Mycobacterium avium
PDERLGEVGRAFVVPRPGAQLDEQ

SEQ ID NO: 90328 - protein, 20 aa, Mycobacterium avium
PDFAGSCYVHVQKYLHDMSA

SEQ ID NO: 90329 - protein, 17 aa, Mycobacterium avium
PDGALGVMLYASYGRIG

SEQ ID NO: 90330 - protein, 23 aa, Mycobacterium avium
PDGIFARLAARFGANTPAARAEL

SEQ ID NO: 90331 - protein, 20 aa, Mycobacterium avium
PDGPELVWLGAAMIIGAGST

SEQ ID NO: 90332 - protein, 21 aa, Mycobacterium avium
PDGPLKAPARVLPPINNRGVV

SEQ ID NO: 90333 - protein, 26 aa, Mycobacterium avium
PDGPYHLVGWSFGGVVAHELAIELQR

SEQ ID NO: 90334 - protein, 21 aa, Mycobacterium avium
PDGTRWVGLWVPPGGHDAEAR

SEQ ID NO: 90335 - protein, 28 aa, Mycobacterium avium
PDILGQAGTAWQIFPNFQIGQGLTSALC

SEQ ID NO: 90336 - protein, 21 aa, Mycobacterium avium
PDLDGIRVLRTFDESLALREH

SEQ ID NO: 90337 - protein, 21 aa, Mycobacterium avium
PDLPSPYSLAVVQLDDSPVRV

SEQ ID NO: 90338 - protein, 18 aa, Mycobacterium avium
PDLPWPGRLPEPSPAVLL

SEQ ID NO: 90339 - protein, 17 aa, Mycobacterium avium
PDLVAAFTAATRAEEGN

SEQ ID NO: 90340 - protein, 23 aa, Mycobacterium avium
PDLVVSAGFMKILGPQFLSRFYG

SEQ ID NO: 90341 - protein, 20 aa, Mycobacterium avium
PDPDRFDIFRAPKSHLGWGH

SEQ ID NO: 90342 - protein, 19 aa, Mycobacterium avium
PDPERPHRSAVLAESLTSP

SEQ ID NO: 90343 - protein, 24 aa, Mycobacterium avium
PDPFCALESDLLWHLDTAHGDVVS

SEQ ID NO: 90344 - protein, 19 aa, Mycobacterium avium
PDPLGVLYWQVPKGSTLDS

SEQ ID NO: 90345 - protein, 20 aa, Mycobacterium avium
PDPRIDRSRIKMTMEKVDGR

SEQ ID NO: 90346 - protein, 17 aa, Mycobacterium avium
PDRGEVMAYERVTLYGL

SEQ ID NO: 90347 - protein, 19 aa, Mycobacterium avium
PDRLTWIMPRDSWLLDRAT

SEQ ID NO: 90348 - protein, 22 aa, Mycobacterium avium
PDRPYTRWERWAFAHLPLAKKL

SEQ ID NO: 90349 - protein, 30 aa, Mycobacterium avium
PDRSAITFRIKNMWGLLTVRGRFTDFTGDG

SEQ ID NO: 90350 - protein, 19 aa, Mycobacterium avium
PDRTGTCYLDPDAVEAHLL

SEQ ID NO: 90351 - protein, 23 aa, Mycobacterium avium
PDSGSTWLLARLVGLARARRMLL

SEQ ID NO: 90352 - protein, 21 aa, Mycobacterium avium
PDSRRAVVAPLLLASAYHARL

SEQ ID NO: 90353 - protein, 18 aa, Mycobacterium avium
PDTVELWRKISTVEDPEW

SEQ ID NO: 90354 - protein, 20 aa, Mycobacterium avium
PDVAVGFPIAGRRDPALDDL

SEQ ID NO: 90355 - protein, 18 aa, Mycobacterium avium
PDVDWLVVCMHQTAISTA

SEQ ID NO: 90356 - protein, 19 aa, Mycobacterium avium
PDVIARLTGDWVDLTTRPA

SEQ ID NO: 90357 - protein, 20 aa, Mycobacterium avium
PDWPQPRIAIAPKDLGYGLA

SEQ ID NO: 90358 - protein, 19 aa, Mycobacterium avium
PDYPCHRRGIPQGRHVHNF

SEQ ID NO: 90359 - protein, 22 aa, Mycobacterium avium
PDYRPREIVVRINGLDTEWHDD

SEQ ID NO: 90360 - protein, 19 aa, Mycobacterium avium
PDYSSSWPVHCLAGSAGAD

SEQ ID NO: 90361 - protein, 24 aa, Mycobacterium avium
PEAAELWAPCFGRDDVDPLDADLT

SEQ ID NO: 90362 - protein, 22 aa, Mycobacterium avium
PEAGRLLYSLVRATRPATVVEF

SEQ ID NO: 90363 - protein, 20 aa, Mycobacterium avium
PEAIDPVLLDLLRLGTYQLL

SEQ ID NO: 90364 - protein, 31 aa, Mycobacterium avium
PEALQMPSIHTRYWYPLFEAVCENKTVLCTH

SEQ ID NO: 90365 - protein, 24 aa, Mycobacterium avium
PEDLPAPRAKFYVDDVEVIVTAEA

SEQ ID NO: 90366 - protein, 20 aa, Mycobacterium avium
PEDQARVILFLASDCSSFIT

SEQ ID NO: 90367 - protein, 22 aa, Mycobacterium avium
PEEPHWYLAVIGSDPGVRGQGF

SEQ ID NO: 90368 - protein, 17 aa, Mycobacterium avium
PEERILFTGNLFGPLFG

SEQ ID NO: 90369 - protein, 21 aa, Mycobacterium avium
PEERLETICRHIMLYHLDRGW

SEQ ID NO: 90370 - protein, 17 aa, Mycobacterium avium
PEFAAAAGFSQPILHGL

SEQ ID NO: 90371 - protein, 26 aa, Mycobacterium avium
PEFAGYAPRLWRYWAEHLDPDRARRD

SEQ ID NO: 90372 - protein, 18 aa, Mycobacterium avium
PEFRRFAHSSGVEFRNTA

SEQ ID NO: 90373 - protein, 17 aa, Mycobacterium avium
PEGASAIVFRDTDHAAE

SEQ ID NO: 90374 - protein, 17 aa, Mycobacterium avium
PEGFLERQVPRWLSELE

SEQ ID NO: 90375 - protein, 20 aa, Mycobacterium avium
PEGFLSSHLVAGVEPGTVVR

SEQ ID NO: 90376 - protein, 21 aa, Mycobacterium avium
PEGGRRLFVFLGSTIGNLTPG

SEQ ID NO: 90377 - protein, 27 aa, Mycobacterium avium
PEGKHAASAFALWFPIEGEVDYGQAKI

SEQ ID NO: 90378 - protein, 18 aa, Mycobacterium avium
PEGTVGEIWIHGDNVAMG

SEQ ID NO: 90379 - protein, 22 aa, Mycobacterium avium
PEIAEQLLRVLARRLRRTNNNL

SEQ ID NO: 90380 - protein, 17 aa, Mycobacterium avium
PEIKREVLFAGPVLRPS

SEQ ID NO: 90381 - protein, 19 aa, Mycobacterium avium
PEIWARLVRALGVVTEADL

SEQ ID NO: 90382 - protein, 17 aa, Mycobacterium avium
PELAAKIGVPAQRLTAT

SEQ ID NO: 90383 - protein, 20 aa, Mycobacterium avium
PELLYRLVVDEHLGPLAAGL

SEQ ID NO: 90384 - protein, 17 aa, Mycobacterium avium
PELRSSYARALHRATKP

SEQ ID NO: 90385 - protein, 25 aa, Mycobacterium avium
PELVPRQVVIAGFPGVQALDVVGPH

SEQ ID NO: 90386 - protein, 20 aa, Mycobacterium avium
PELVSRWAAYMPPAPTRAFF

SEQ ID NO: 90387 - protein, 17 aa, Mycobacterium avium
PELYRTATDEFLRYFSV

SEQ ID NO: 90388 - protein, 17 aa, Mycobacterium avium
PENPIIFNLPATVEMAT

SEQ ID NO: 90389 - protein, 23 aa, Mycobacterium avium
PEPARVWPDVLAFTRSSDPAQTP

SEQ ID NO: 90390 - protein, 22 aa, Mycobacterium avium
PEPHGAPTPAGRPGGRPWTYTP

SEQ ID NO: 90391 - protein, 19 aa, Mycobacterium avium
PEPRLAQGREHVVATVDEI

SEQ ID NO: 90392 - protein, 26 aa, Mycobacterium avium
PERDRPRIFDLFDRILKALAPDAHPR

SEQ ID NO: 90393 - protein, 19 aa, Mycobacterium avium
PERVRADSGLLPGVSEIGS

SEQ ID NO: 90394 - protein, 17 aa, Mycobacterium avium
PESACRELGREADEVVC

SEQ ID NO: 90395 - protein, 21 aa, Mycobacterium avium
PESFGQLLARAEDRGGPVTGI

SEQ ID NO: 90396 - protein, 22 aa, Mycobacterium avium
PETIAYGLIPRAHRGIVAVNEL

SEQ ID NO: 90397 - protein, 20 aa, Mycobacterium avium
PETNYRIGFVPQGIGADLIA

SEQ ID NO: 90398 - protein, 17 aa, Mycobacterium avium
PETRLATEVGVAAADCL

SEQ ID NO: 90399 - protein, 17 aa, Mycobacterium avium
PEVYGGAGVHVTELVTQ

SEQ ID NO: 90400 - protein, 22 aa, Mycobacterium avium
PEWPQMLLRALMFRLAVHALHP

SEQ ID NO: 90401 - protein, 31 aa, Mycobacterium avium
PFALDGFQRRACAALERGHGVLVCAPTGAGK

SEQ ID NO: 90402 - protein, 18 aa, Mycobacterium avium
PFAPPPDVMALAHDKPLS

SEQ ID NO: 90403 - protein, 18 aa, Mycobacterium avium
PFASFGVADLAGRLQQIL

SEQ ID NO: 90404 - protein, 18 aa, Mycobacterium avium
PFDLLLQLIFAHRLDVTE

SEQ ID NO: 90405 - protein, 22 aa, Mycobacterium avium
PFDPHLRPGGVIDVNGEMAPAT

SEQ ID NO: 90406 - protein, 19 aa, Mycobacterium avium
PFGGPGRAPTMLVTDISLR

SEQ ID NO: 90407 - protein, 20 aa, Mycobacterium avium
PFLVAEAGGDPWSIDSGLQA

SEQ ID NO: 90408 - protein, 19 aa, Mycobacterium avium
PFMEFHLRRRVKALPNVTF

SEQ ID NO: 90409 - protein, 19 aa, Mycobacterium avium
PFTGGSWVLWERRDSCDSA

SEQ ID NO: 90410 - protein, 18 aa, Mycobacterium avium
PFVRLHQPSAFYGVNSLR

SEQ ID NO: 90411 - protein, 23 aa, Mycobacterium avium
PFVWDAWTVGLQWWRRFGPDRPL

SEQ ID NO: 90412 - protein, 17 aa, Mycobacterium avium
PFYAAAVELGMPLGVHG

SEQ ID NO: 90413 - protein, 21 aa, Mycobacterium avium
PGACDSTLLIAERVQSYAEVW

SEQ ID NO: 90414 - protein, 37 aa, Mycobacterium avium
PGCKPTYDRWAEYGGPEWTWQPLLPYLRKSATYHDDH

SEQ ID NO: 90415 - protein, 24 aa, Mycobacterium avium
PGDARLPLRFISAAPIDARSYRDI

SEQ ID NO: 90416 - protein, 22 aa, Mycobacterium avium
PGDIRECLRIGLQAANGSNAQS

SEQ ID NO: 90417 - protein, 17 aa, Mycobacterium avium
PGDKRLVAYVTESATGT

SEQ ID NO: 90418 - protein, 18 aa, Mycobacterium avium
PGDKRLVGYVTESVTGAA

SEQ ID NO: 90419 - protein, 24 aa, Mycobacterium avium
PGDVLQCYLELVLDGLVARLASGE

SEQ ID NO: 90420 - protein, 20 aa, Mycobacterium avium
PGEEAVICFEPMTAPTDALR

SEQ ID NO: 90421 - protein, 25 aa, Mycobacterium avium
PGEGGGGLVCRWCGRVDPTRRCARC

SEQ ID NO: 90422 - protein, 26 aa, Mycobacterium avium
PGELSVHYPFPIKDLVAIDDALKFGS

SEQ ID NO: 90423 - protein, 20 aa, Mycobacterium avium
PGESPRLFVLTRNAAVVVAG

SEQ ID NO: 90424 - protein, 26 aa, Mycobacterium avium
PGFTVPEFRRKAVIIAVGGVYDPRIH

SEQ ID NO: 90425 - protein, 26 aa, Mycobacterium avium
PGGANLRAAWLTMIAVASTHQGKGLW

SEQ ID NO: 90426 - protein, 19 aa, Mycobacterium avium
PGGDIKPEHLILIGQIAQD

SEQ ID NO: 90427 - protein, 24 aa, Mycobacterium avium
PGGLIAYLRAGWDLAEDVKNHILA

SEQ ID NO: 90428 - protein, 19 aa, Mycobacterium avium
PGGPLARVEGRVSIERILD

SEQ ID NO: 90429 - protein, 18 aa, Mycobacterium avium
PGGQLRYLEHIASAGARG

SEQ ID NO: 90430 - protein, 24 aa, Mycobacterium avium
PGGRTEYLERFTVALDAAIGAGFI

SEQ ID NO: 90431 - protein, 18 aa, Mycobacterium avium
PGIELTKRTLWSGLDAGS

SEQ ID NO: 90432 - protein, 18 aa, Mycobacterium avium
PGIVNALLQMRIDGEPAP

SEQ ID NO: 90433 - protein, 18 aa, Mycobacterium avium
PGKGWTMVPGSFRGAGDA

SEQ ID NO: 90434 - protein, 21 aa, Mycobacterium avium
PGKVMKTRAKIAAAVPIAEML

SEQ ID NO: 90435 - protein, 23 aa, Mycobacterium avium
PGLAEPWDSVGLVCGDPDEPVES

SEQ ID NO: 90436 - protein, 23 aa, Mycobacterium avium
PGLHRPRTLLGKRLNDLVRDTYA

SEQ ID NO: 90437 - protein, 23 aa, Mycobacterium avium
PGLPELGPGWTIRYTTELTDEVW

SEQ ID NO: 90438 - protein, 17 aa, Mycobacterium avium
PGNLCAAMGITMADNGI

SEQ ID NO: 90439 - protein, 20 aa, Mycobacterium avium
PGNRDGRLPVMAEVIRSISG

SEQ ID NO: 90440 - protein, 19 aa, Mycobacterium avium
PGPLLRFMQGRRTWVDVYN

SEQ ID NO: 90441 - protein, 17 aa, Mycobacterium avium
PGPSDLLVAVRACGVCR

SEQ ID NO: 90442 - protein, 25 aa, Mycobacterium avium
PGQRIPRKWLESGVIIQAETLEELA

SEQ ID NO: 90443 - protein, 17 aa, Mycobacterium avium
PGRFRDRFVAFEGSYGY

SEQ ID NO: 90444 - protein, 18 aa, Mycobacterium avium
PGRLPEPSPAVLLDDPVE

SEQ ID NO: 90445 - protein, 18 aa, Mycobacterium avium
PGRPARPGAPRPGGGRPG

SEQ ID NO: 90446 - protein, 20 aa, Mycobacterium avium
PGRQRLRIAVLTRSIQRECS

SEQ ID NO: 90447 - protein, 26 aa, Mycobacterium avium
PGRYRLVVARACPWANRAIIVRRLLG

SEQ ID NO: 90448 - protein, 24 aa, Mycobacterium avium
PGSGPMLAAAMAWDELAATLHSTA

SEQ ID NO: 90449 - protein, 22 aa, Mycobacterium avium
PGTAPGDAWTAAALAKAAAGEA

SEQ ID NO: 90450 - protein, 17 aa, Mycobacterium avium
PGVAELLAGSRTVAVLE

SEQ ID NO: 90451 - protein, 24 aa, Mycobacterium avium
PGVDELIEWQAPWVDFEAPELTAA

SEQ ID NO: 90452 - protein, 20 aa, Mycobacterium avium
PGVILGEHFDLLALGSTASS

SEQ ID NO: 90453 - protein, 26 aa, Mycobacterium avium
PGVPGRSVTRWGAFLDDVGGFDCDFF

SEQ ID NO: 90454 - protein, 18 aa, Mycobacterium avium
PGVPNGQPVKGRLTIPPS

SEQ ID NO: 90455 - protein, 18 aa, Mycobacterium avium
PGVSQWRTLRRVPIGGEA

SEQ ID NO: 90456 - protein, 19 aa, Mycobacterium avium
PGVTRRRLLTTGAVSAALG

SEQ ID NO: 90457 - protein, 17 aa, Mycobacterium avium
PHFRFSEAVSFTVHCKD

SEQ ID NO: 90458 - protein, 26 aa, Mycobacterium avium
PHGARLSVVVDHTWRAEALADMISEA

SEQ ID NO: 90459 - protein, 20 aa, Mycobacterium avium
PHGAVRWNTLVHNWIAEETG

SEQ ID NO: 90460 - protein, 25 aa, Mycobacterium avium
PHGPVRFPGVPTWFSQTPGRVAGPA

SEQ ID NO: 90461 - protein, 23 aa, Mycobacterium avium
PHHTRPVRFVWLQTPAVRTRLLD

SEQ ID NO: 90462 - protein, 19 aa, Mycobacterium avium
PHPELLRAWDLPTTADGLA

SEQ ID NO: 90463 - protein, 22 aa, Mycobacterium avium
PHPMFVPWLVGPLLTGDGVHLV

SEQ ID NO: 90464 - protein, 17 aa, Mycobacterium avium
PHSQWIIEDSFSDGRPP

SEQ ID NO: 90465 - protein, 26 aa, Mycobacterium avium
PIEPRLSLQWWVRVESLAKAAGDAVR

SEQ ID NO: 90466 - protein, 17 aa, Mycobacterium avium
PIKRARTTFTYLAVATS

SEQ ID NO: 90467 - protein, 18 aa, Mycobacterium avium
PIPPSRIVARLSKATGTP

SEQ ID NO: 90468 - protein, 34 aa, Mycobacterium avium
PIPREVHEFVLGLGIPVCEGYGMTECTAGATVNR

SEQ ID NO: 90469 - protein, 18 aa, Mycobacterium avium
PIRVRFLGINARHHSLAI

SEQ ID NO: 90470 - protein, 19 aa, Mycobacterium avium
PISDGSIWDAIAGCEAGGN

SEQ ID NO: 90471 - protein, 17 aa, Mycobacterium avium
PIWEGEDGVIAWLLSGP

SEQ ID NO: 90472 - protein, 19 aa, Mycobacterium avium
PKAARAVITMLRDAKLVER

SEQ ID NO: 90473 - protein, 20 aa, Mycobacterium avium
PKCLPARFADVVAQTPDAPA

SEQ ID NO: 90474 - protein, 20 aa, Mycobacterium avium
PKGALVHRLIRTGRSLFTAH

SEQ ID NO: 90475 - protein, 19 aa, Mycobacterium avium
PKGPGLLERLWHDRDVQSA

SEQ ID NO: 90476 - protein, 19 aa, Mycobacterium avium
PKIRVVTTALRVRRAHPDT

SEQ ID NO: 90477 - protein, 19 aa, Mycobacterium avium
PKITLACEVCKHRNYITKK

SEQ ID NO: 90478 - protein, 22 aa, Mycobacterium avium
PKTDAVRGWLAKTFSRNQNATR

SEQ ID NO: 90479 - protein, 17 aa, Mycobacterium avium
PKYGFRPTVMARPPFAG

SEQ ID NO: 90480 - protein, 24 aa, Mycobacterium avium
PLAADHFRYFAGALRAQEGSLSQI

SEQ ID NO: 90481 - protein, 25 aa, Mycobacterium avium
PLAEFSNDHVTAWATPSAPEGPDDG

SEQ ID NO: 90482 - protein, 18 aa, Mycobacterium avium
PLALRINYRAQLLVRADG

SEQ ID NO: 90483 - protein, 28 aa, Mycobacterium avium
PLDPGRPPWECWVIEGLRGNRWAMLMKT

SEQ ID NO: 90484 - protein, 24 aa, Mycobacterium avium
PLEVLFPGCEFLPLNDERRRIVDP

SEQ ID NO: 90485 - protein, 21 aa, Mycobacterium avium
PLFGPGGVGTFSWPGAYGTWW

SEQ ID NO: 90486 - protein, 22 aa, Mycobacterium avium
PLFTDFAPRLLVTHPAEVKVAH

SEQ ID NO: 90487 - protein, 24 aa, Mycobacterium avium
PLGAREFHKFLLAKQHEIASVVTE

SEQ ID NO: 90488 - protein, 24 aa, Mycobacterium avium
PLGDQRFPYVFLDATYCKARVNHR

SEQ ID NO: 90489 - protein, 17 aa, Mycobacterium avium
PLGVDAFLNEIWATRHH

SEQ ID NO: 90490 - protein, 18 aa, Mycobacterium avium
PLHHREPGPALALLRDPR

SEQ ID NO: 90491 - protein, 29 aa, Mycobacterium avium
PLLCEEEVDRACAPWGLLAEDKQATLVAG

SEQ ID NO: 90492 - protein, 17 aa, Mycobacterium avium
PLLKRLPPDTPMYGFER

SEQ ID NO: 90493 - protein, 19 aa, Mycobacterium avium
PLLLLTWKLAAGLAAGCTF

SEQ ID NO: 90494 - protein, 22 aa, Mycobacterium avium
PLPAPARWAMRIPGGKSVQRLL

SEQ ID NO: 90495 - protein, 25 aa, Mycobacterium avium
PLPCTPRGIVHLLRRYDVEIAGAHV

SEQ ID NO: 90496 - protein, 19 aa, Mycobacterium avium
PLPPGELVLASAPLLDGKL

SEQ ID NO: 90497 - protein, 19 aa, Mycobacterium avium
PLRERRWGQLMLALYRAGR

SEQ ID NO: 90498 - protein, 17 aa, Mycobacterium avium
PLRPGKGPIALRVHLGS

SEQ ID NO: 90499 - protein, 25 aa, Mycobacterium avium
PLRTPKHFRRARGRKVDVVLSDNST

SEQ ID NO: 90500 - protein, 23 aa, Mycobacterium avium
PLSGCRITALGLTFKAATSDTRE

SEQ ID NO: 90501 - protein, 30 aa, Mycobacterium avium
PLSPILLVRGDFLAGVPLQIADGYHRVCAS

SEQ ID NO: 90502 - protein, 17 aa, Mycobacterium avium
PLTERLGTTGWVIDTPG

SEQ ID NO: 90503 - protein, 23 aa, Mycobacterium avium
PLVDGLVPWLRRGADVADFGCGS

SEQ ID NO: 90504 - protein, 21 aa, Mycobacterium avium
PLWDQQLPFGIAITSLLAVTA

SEQ ID NO: 90505 - protein, 22 aa, Mycobacterium avium
PMADVWWRFREAITSAPQLNIG

SEQ ID NO: 90506 - protein, 20 aa, Mycobacterium avium
PMAPGLICTPFVAVSSSSET

SEQ ID NO: 90507 - protein, 24 aa, Mycobacterium avium
PMEELIAAFLPLLFPGMEIVEHHA

SEQ ID NO: 90508 - protein, 22 aa, Mycobacterium avium
PMHRCRALGAAVGTYLATLDKR

SEQ ID NO: 90509 - protein, 26 aa, Mycobacterium avium
PMKKTPKKVCHRITLGAGRNKVTATF

SEQ ID NO: 90510 - protein, 18 aa, Mycobacterium avium
PMLGTWQSIVLVDLNRDN

SEQ ID NO: 90511 - protein, 21 aa, Mycobacterium avium
PMLLQPGVLSIAWGTAIRQLA

SEQ ID NO: 90512 - protein, 18 aa, Mycobacterium avium
PMLSDIKRELSLATGVLN

SEQ ID NO: 90513 - protein, 22 aa, Mycobacterium avium
PMRADIRLLGAILGDTVREQNG

SEQ ID NO: 90514 - protein, 31 aa, Mycobacterium avium
PMSISVAFHEPVRWDGWLLYSHESTQVGAGM

SEQ ID NO: 90515 - protein, 21 aa, Mycobacterium avium
PNARVRYTTIQNWSGNVYNLV

SEQ ID NO: 90516 - protein, 23 aa, Mycobacterium avium
PNDPGTVCGPVISARQRDRVQGY

SEQ ID NO: 90517 - protein, 18 aa, Mycobacterium avium
PNGARRAVAAGLRAIEYV

SEQ ID NO: 90518 - protein, 24 aa, Mycobacterium avium
PNGDPHVGHAYEYIATDAIARFKR

SEQ ID NO: 90519 - protein, 19 aa, Mycobacterium avium
PNITVCVGGGIGTPERAAE

SEQ ID NO: 90520 - protein, 18 aa, Mycobacterium avium
PNLEVLRALMAAHTGSIP

SEQ ID NO: 90521 - protein, 24 aa, Mycobacterium avium
PNNWTSVFGGSAWTRVLEPDGNPG

SEQ ID NO: 90522 - protein, 18 aa, Mycobacterium avium
PNRSLDCVDDELAGSAHF

SEQ ID NO: 90523 - protein, 29 aa, Mycobacterium avium
PNTGWFKYWSTWGNQFLAASGFPINLIGV

SEQ ID NO: 90524 - protein, 18 aa, Mycobacterium avium
PNVPLPGFVLKRAVKGTI

SEQ ID NO: 90525 - protein, 18 aa, Mycobacterium avium
PPAKVWRMLTEPELMKLW

SEQ ID NO: 90526 - protein, 24 aa, Mycobacterium avium
PPAWLDPGQWWALVRIGCAGELLY

SEQ ID NO: 90527 - protein, 31 aa, Mycobacterium avium
PPDAEFAELLARAGVPLVAFGDSLRAMKTAA

SEQ ID NO: 90528 - protein, 21 aa, Mycobacterium avium
PPDPIPAVFFGGSSASAGPVA

SEQ ID NO: 90529 - protein, 26 aa, Mycobacterium avium
PPEFVDWRQQPGLRRALFQGNPVWVV

SEQ ID NO: 90530 - protein, 33 aa, Mycobacterium avium
PPEHAVKLWQHWDHCALHWFPGSHVLHISQLDY

SEQ ID NO: 90531 - protein, 22 aa, Mycobacterium avium
PPELVDRWAPGRTMVNVYGPTE

SEQ ID NO: 90532 - protein, 17 aa, Mycobacterium avium
PPFSCPVDDVYAACAPL

SEQ ID NO: 90533 - protein, 19 aa, Mycobacterium avium
PPFTWDYRLFAGPHPAPVA

SEQ ID NO: 90534 - protein, 17 aa, Mycobacterium avium
PPGPLTIGYSARSALNP

SEQ ID NO: 90535 - protein, 25 aa, Mycobacterium avium
PPGTAPMLAPLVLWAQGPARLDEVA

SEQ ID NO: 90536 - protein, 19 aa, Mycobacterium avium
PPGVVGEIWVHGENVADGY

SEQ ID NO: 90537 - protein, 23 aa, Mycobacterium avium
PPHLRPRVQITLTDGTRVTPDYI

SEQ ID NO: 90538 - protein, 23 aa, Mycobacterium avium
PPHPHLVKLVARCANVEGVGEVP

SEQ ID NO: 90539 - protein, 17 aa, Mycobacterium avium
PPLAGSLLIGGEGRVVE

SEQ ID NO: 90540 - protein, 25 aa, Mycobacterium avium
PPMGAELVAPVVGWLAHESCSVSGE

SEQ ID NO: 90541 - protein, 24 aa, Mycobacterium avium
PPNGHGIVALIALGILERFDMASL

SEQ ID NO: 90542 - protein, 17 aa, Mycobacterium avium
PPPLGRFAPTTLCAAPD

SEQ ID NO: 90543 - protein, 23 aa, Mycobacterium avium
PPPVPLDAAILFAPVGDLVLPAL

SEQ ID NO: 90544 - protein, 25 aa, Mycobacterium avium
PPQDFSGIVGHRFIYTYANGWQYEM

SEQ ID NO: 90545 - protein, 26 aa, Mycobacterium avium
PPRPRRRAAAGFGMRRRSAFCDFDFR

SEQ ID NO: 90546 - protein, 18 aa, Mycobacterium avium
PPSAIFIGGGLTRPGLLD

SEQ ID NO: 90547 - protein, 17 aa, Mycobacterium avium
PPTLLPVGVEGWPVTVS

SEQ ID NO: 90548 - protein, 17 aa, Mycobacterium avium
PPTRPGAIVAPADGEIC

SEQ ID NO: 90549 - protein, 17 aa, Mycobacterium avium
PPVAVPLAQAQGLVLAE

SEQ ID NO: 90550 - protein, 25 aa, Mycobacterium avium
PPVLRFFGDLLYFDRYWLEEEQVCT

SEQ ID NO: 90551 - protein, 18 aa, Mycobacterium avium
PPVPELRSGRSARENLLA

SEQ ID NO: 90552 - protein, 17 aa, Mycobacterium avium
PPVVTVMGHVDHGKTRL

SEQ ID NO: 90553 - protein, 18 aa, Mycobacterium avium
PPWHTARAPITAAADALV

SEQ ID NO: 90554 - protein, 17 aa, Mycobacterium avium
PPWIDVFIARNFHYLTE

SEQ ID NO: 90555 - protein, 23 aa, Mycobacterium avium
PQDPGTLCGPVISQVQRDRVMGY

SEQ ID NO: 90556 - protein, 21 aa, Mycobacterium avium
PQFQRWSISLLSWILNPQRGL

SEQ ID NO: 90557 - protein, 19 aa, Mycobacterium avium
PQGAFGFRHNPIHVMTVDG

SEQ ID NO: 90558 - protein, 18 aa, Mycobacterium avium
PQGILLHGGVLYVVDAGA

SEQ ID NO: 90559 - protein, 29 aa, Mycobacterium avium
PQGVLRLALRVWRRRPSMTMEAWNDPTLL

SEQ ID NO: 90560 - protein, 17 aa, Mycobacterium avium
PQHCAYGSSKWALRGLT

SEQ ID NO: 90561 - protein, 22 aa, Mycobacterium avium
PQIAEAVARIAALPAEQRQAAL

SEQ ID NO: 90562 - protein, 17 aa, Mycobacterium avium
PQIPGIDQVSAWLEQHR

SEQ ID NO: 90563 - protein, 18 aa, Mycobacterium avium
PQSAFRDSPIRFIGSTRG

SEQ ID NO: 90564 - protein, 20 aa, Mycobacterium avium
PRAAPAVLVHGDFRMGNLIV

SEQ ID NO: 90565 - protein, 27 aa, Mycobacterium avium
PRAAPPGCRCCRCSASACWAAGSPSGS

SEQ ID NO: 90566 - protein, 25 aa, Mycobacterium avium
PRAGELCAAVRFLVRRDSVVIELTA

SEQ ID NO: 90567 - protein, 22 aa, Mycobacterium avium
PRALLPATVLARWFRTEQARAL

SEQ ID NO: 90568 - protein, 20 aa, Mycobacterium avium
PRAPDDFVHLLLGVASVGAG

SEQ ID NO: 90569 - protein, 21 aa, Mycobacterium avium
PRAVAECERLGLGGWLDSRIR

SEQ ID NO: 90570 - protein, 19 aa, Mycobacterium avium
PRAVRDWLLAERRILTTFV

SEQ ID NO: 90571 - protein, 18 aa, Mycobacterium avium
PRAYRAAGARVIAINADP

SEQ ID NO: 90572 - protein, 17 aa, Mycobacterium avium
PRDCGLGAVKVIGKVLQ

SEQ ID NO: 90573 - protein, 18 aa, Mycobacterium avium
PREIVGAALFLASDASSF

SEQ ID NO: 90574 - protein, 19 aa, Mycobacterium avium
PREYGVLEFLMRNKDVVVT

SEQ ID NO: 90575 - protein, 21 aa, Mycobacterium avium
PRGEELLRLIADYQSRSGVTA

SEQ ID NO: 90576 - protein, 17 aa, Mycobacterium avium
PRGPGMERSDLLEANGA

SEQ ID NO: 90577 - protein, 19 aa, Mycobacterium avium
PRGPLYGRHVIVTGASSGI

SEQ ID NO: 90578 - protein, 20 aa, Mycobacterium avium
PRGSISLPLVITDMPDRVVW

SEQ ID NO: 90579 - protein, 18 aa, Mycobacterium avium
PRGVFSRQLFLGDNLDTD

SEQ ID NO: 90580 - protein, 25 aa, Mycobacterium avium
PRGYWEPRTAIMLNETILRRHDSNW

SEQ ID NO: 90581 - protein, 23 aa, Mycobacterium avium
PRIAQDFDATVCWMADNTTLEPG

SEQ ID NO: 90582 - protein, 24 aa, Mycobacterium avium
PRLADGIDIVGGWAEKVGLDVALA

SEQ ID NO: 90583 - protein, 24 aa, Mycobacterium avium
PRLEFRTIHGYRRAYRIAGSGPAI

SEQ ID NO: 90584 - protein, 19 aa, Mycobacterium avium
PRLLRGEEHWCQGFSEPGS

SEQ ID NO: 90585 - protein, 20 aa, Mycobacterium avium
PRLVKPEILASNRFRAGLAK

SEQ ID NO: 90586 - protein, 17 aa, Mycobacterium avium
PRNAGGKLLKARLRDQV

SEQ ID NO: 90587 - protein, 20 aa, Mycobacterium avium
PRPGGVGGPGRPARPGAPRP

SEQ ID NO: 90588 - protein, 17 aa, Mycobacterium avium
PRPGIVNALLQMRIDGE

SEQ ID NO: 90589 - protein, 25 aa, Mycobacterium avium
PRPGSRTGAKLGPFLVPATLSAPEG

SEQ ID NO: 90590 - protein, 21 aa, Mycobacterium avium
PRPPEGFFGWEAAGLRWLSSV

SEQ ID NO: 90591 - protein, 18 aa, Mycobacterium avium
PRPPRIPLVSNLTGQLAG

SEQ ID NO: 90592 - protein, 17 aa, Mycobacterium avium
PRPRRRKPLRTLGIDEG

SEQ ID NO: 90593 - protein, 19 aa, Mycobacterium avium
PRPTPCAQFDVTRLTDHLL

SEQ ID NO: 90594 - protein, 21 aa, Mycobacterium avium
PRQAGCPFAPPPDVMALAHDK

SEQ ID NO: 90595 - protein, 20 aa, Mycobacterium avium
PRQLESWVSFGDVRHLEPGH

SEQ ID NO: 90596 - protein, 22 aa, Mycobacterium avium
PRRHPGRRSPLWQQRQRAAQLL

SEQ ID NO: 90597 - protein, 17 aa, Mycobacterium avium
PRRRLRYAYPYSGRLGA

SEQ ID NO: 90598 - protein, 21 aa, Mycobacterium avium
PRRVLLERLLDGFPTGRIHCD

SEQ ID NO: 90599 - protein, 19 aa, Mycobacterium avium
PRSAEAIVAILAALKSGAA

SEQ ID NO: 90600 - protein, 20 aa, Mycobacterium avium
PRSGELPADPGLVAAMDQVR

SEQ ID NO: 90601 - protein, 30 aa, Mycobacterium avium
PRSGEVIELGDWVRPVLLDGLAVLLLEPPR

SEQ ID NO: 90602 - protein, 24 aa, Mycobacterium avium
PRTDYSLGAFAVWLRDFLDELGVS

SEQ ID NO: 90603 - protein, 18 aa, Mycobacterium avium
PRVGHALHGTQMLDRGWH

SEQ ID NO: 90604 - protein, 18 aa, Mycobacterium avium
PRVLSAAALVGRLRGVVC

SEQ ID NO: 90605 - protein, 21 aa, Mycobacterium avium
PRVMANFGLEWDAVRAANPRA

SEQ ID NO: 90606 - protein, 19 aa, Mycobacterium avium
PRVNPNLLRHIAHRREADR

SEQ ID NO: 90607 - protein, 26 aa, Mycobacterium avium
PRVRRWWPRRYRRSSVYSKLVSLDRR

SEQ ID NO: 90608 - protein, 26 aa, Mycobacterium avium
PRYILWAAWHRSGLQRRWLSVSERGG

SEQ ID NO: 90609 - protein, 21 aa, Mycobacterium avium
PRYQGCLDRCRGASARITAGS

SEQ ID NO: 90610 - protein, 20 aa, Mycobacterium avium
PRYRAQRSVEEYGKIVDYLV

SEQ ID NO: 90611 - protein, 23 aa, Mycobacterium avium
PRYRDRIPLMIGGSGEKKTIPLA

SEQ ID NO: 90612 - protein, 24 aa, Mycobacterium avium
PSANELRAKWASRVSRREVLDALA

SEQ ID NO: 90613 - protein, 22 aa, Mycobacterium avium
PSDFLHGKWLVLRRGKRTIAGV

SEQ ID NO: 90614 - protein, 20 aa, Mycobacterium avium
PSDPLGRFSAITREWFTSTF

SEQ ID NO: 90615 - protein, 17 aa, Mycobacterium avium
PSFAGRTVIVTGANAGL

SEQ ID NO: 90616 - protein, 25 aa, Mycobacterium avium
PSGCGKTTLIRCIVGTQILTKGSVT

SEQ ID NO: 90617 - protein, 17 aa, Mycobacterium avium
PSGWRNLPSGFQVKDYR

SEQ ID NO: 90618 - protein, 18 aa, Mycobacterium avium
PSHHYLAAYHWLDAGFGA

SEQ ID NO: 90619 - protein, 28 aa, Mycobacterium avium
PSKRRIHGVIFFPQWIRQHGERTVCFQN

SEQ ID NO: 90620 - protein, 23 aa, Mycobacterium avium
PSLDLFLTPTFRGYLANYGTVLY

SEQ ID NO: 90621 - protein, 19 aa, Mycobacterium avium
PSLIRRAAAYFDRAVVTRV

SEQ ID NO: 90622 - protein, 18 aa, Mycobacterium avium
PSLLHTWFELLSPEQIVM

SEQ ID NO: 90623 - protein, 29 aa, Mycobacterium avium
PSLYSALAEQCRRLDALGIDYEIVPGVPA

SEQ ID NO: 90624 - protein, 23 aa, Mycobacterium avium
PSMDSAWRKVLLVCEAAGGDEVI

SEQ ID NO: 90625 - protein, 23 aa, Mycobacterium avium
PSNVFVAGFIGSPAMNLFTLPVV

SEQ ID NO: 90626 - protein, 26 aa, Mycobacterium avium
PSPEMLWARYREWKGIKDDSAADGLL

SEQ ID NO: 90627 - protein, 18 aa, Mycobacterium avium
PSPGSVYPTLQLLADEGL

SEQ ID NO: 90628 - protein, 20 aa, Mycobacterium avium
PSPLWKSYVDQGWTELNDPE

SEQ ID NO: 90629 - protein, 18 aa, Mycobacterium avium
PSPWDWSREQADKYVASG

SEQ ID NO: 90630 - protein, 25 aa, Mycobacterium avium
PSRASICRFATWWVVLERHDQLVRL

SEQ ID NO: 90631 - protein, 24 aa, Mycobacterium avium
PSRDGACVRATWLKVVPDQLSRSL

SEQ ID NO: 90632 - protein, 25 aa, Mycobacterium avium
PSRGFPRPRFDDGYGRYDGDDYDDP

SEQ ID NO: 90633 - protein, 18 aa, Mycobacterium avium
PSRGRLPLDATLRRMPVG

SEQ ID NO: 90634 - protein, 21 aa, Mycobacterium avium
PSTGGSWDAGAAWPPILAAAA

SEQ ID NO: 90635 - protein, 25 aa, Mycobacterium avium
PSYALRRRAKALGSIGQFELFLITA

SEQ ID NO: 90636 - protein, 23 aa, Mycobacterium avium
PTARSIPWAKAVDESGRFRSRAE

SEQ ID NO: 90637 - protein, 23 aa, Mycobacterium avium
PTAWIAEGLFGYLAPEAQDGLLD

SEQ ID NO: 90638 - protein, 23 aa, Mycobacterium avium
PTAWIAEGLFGYLPPEAQDRLLD

SEQ ID NO: 90639 - protein, 18 aa, Mycobacterium avium
PTAWLAEGLLPYLPSDAQ

SEQ ID NO: 90640 - protein, 20 aa, Mycobacterium avium
PTDPRRVWRNGIKAFFTAFS

SEQ ID NO: 90641 - protein, 34 aa, Mycobacterium avium
PTFAETPPGWRVVFGAAGRADCLQYVEQNWSDIR

SEQ ID NO: 90642 - protein, 28 aa, Mycobacterium avium
PTGAFSAAPLRWAEWLSDSQATFTAGPN

SEQ ID NO: 90643 - protein, 25 aa, Mycobacterium avium
PTGEVWPGKAYPLGASYDGAGTNFA

SEQ ID NO: 90644 - protein, 20 aa, Mycobacterium avium
PTGIFIKVGYRGNLVVSGYT

SEQ ID NO: 90645 - protein, 19 aa, Mycobacterium avium
PTGPHVARWMAADFECYGT

SEQ ID NO: 90646 - protein, 27 aa, Mycobacterium avium
PTGRPTGEWAAAIARLADAEAAVAECA

SEQ ID NO: 90647 - protein, 18 aa, Mycobacterium avium
PTGTFTFAELLAHELSVE

SEQ ID NO: 90648 - protein, 19 aa, Mycobacterium avium
PTIATLVDWANRAGLGRTV

SEQ ID NO: 90649 - protein, 17 aa, Mycobacterium avium
PTLLHPRPRSVLGELAA

SEQ ID NO: 90650 - protein, 19 aa, Mycobacterium avium
PTLLLLRHLLRFGEHARVQ

SEQ ID NO: 90651 - protein, 18 aa, Mycobacterium avium
PTPLILGGLHLRASHVRQ

SEQ ID NO: 90652 - protein, 19 aa, Mycobacterium avium
PTPSGWEVTTHGGRRGTGI

SEQ ID NO: 90653 - protein, 23 aa, Mycobacterium avium
PTRQRLVDWLKSMVYDQALITEQ

SEQ ID NO: 90654 - protein, 28 aa, Mycobacterium avium
PTTKNMGQWLAALGFQPGIGGPGSISVG

SEQ ID NO: 90655 - protein, 18 aa, Mycobacterium avium
PTVFQRLAPGIMPLSVAE

SEQ ID NO: 90656 - protein, 23 aa, Mycobacterium avium
PTYPQDRLNFILGDADAKLVLRE

SEQ ID NO: 90657 - protein, 18 aa, Mycobacterium avium
PVAFPVGLLPTNPNDSGG

SEQ ID NO: 90658 - protein, 24 aa, Mycobacterium avium
PVAMAARTRFFDSFFQGATQAGIR

SEQ ID NO: 90659 - protein, 18 aa, Mycobacterium avium
PVDPTLLFDGMFALVQHS

SEQ ID NO: 90660 - protein, 18 aa, Mycobacterium avium
PVEDCYAALLWLARQPWV

SEQ ID NO: 90661 - protein, 24 aa, Mycobacterium avium
PVGLAEKLRYAFADRLVLSKVRRR

SEQ ID NO: 90662 - protein, 18 aa, Mycobacterium avium
PVGVPAIVAPPVDAADAL

SEQ ID NO: 90663 - protein, 22 aa, Mycobacterium avium
PVHAECAGLLYLVSELDGHPMC

SEQ ID NO: 90664 - protein, 19 aa, Mycobacterium avium
PVHAVRLAGLVAHQEILFG

SEQ ID NO: 90665 - protein, 18 aa, Mycobacterium avium
PVICAQLRDTVGVADRAT

SEQ ID NO: 90666 - protein, 18 aa, Mycobacterium avium
PVLADLVHGLPLPRRSPP

SEQ ID NO: 90667 - protein, 21 aa, Mycobacterium avium
PVLARELLPERALMGDASAIV

SEQ ID NO: 90668 - protein, 25 aa, Mycobacterium avium
PVLLAFSRRRLFAVIVLSIRDARVV

SEQ ID NO: 90669 - protein, 18 aa, Mycobacterium avium
PVLYELAHGTPFTELLAL

SEQ ID NO: 90670 - protein, 19 aa, Mycobacterium avium
PVNGGYIFNGRWQFSSGTD

SEQ ID NO: 90671 - protein, 18 aa, Mycobacterium avium
PVPATRPLVAAPMPPLDA

SEQ ID NO: 90672 - protein, 25 aa, Mycobacterium avium
PVPFEVYADGISLVVFEEFGSGAAA

SEQ ID NO: 90673 - protein, 24 aa, Mycobacterium avium
PVRALEEAERFLAHQATLLRPDQL

SEQ ID NO: 90674 - protein, 22 aa, Mycobacterium avium
PVRSARGWSAAPVRHGVSVVRS

SEQ ID NO: 90675 - protein, 21 aa, Mycobacterium avium
PVRSVAAAPTWSWTDCTDCAG

SEQ ID NO: 90676 - protein, 31 aa, Mycobacterium avium
PVSALVVFEVMVRPLIRLSLGKRQPMRRIVQ

SEQ ID NO: 90677 - protein, 18 aa, Mycobacterium avium
PVTECYADGSADLIAATA

SEQ ID NO: 90678 - protein, 19 aa, Mycobacterium avium
PVTTLRLAMHAVEAGLREI

SEQ ID NO: 90679 - protein, 19 aa, Mycobacterium avium
PVVAFRLAKNRGYTEFDVS

SEQ ID NO: 90680 - protein, 17 aa, Mycobacterium avium
PVVCSVRGWAVGFGCNL

SEQ ID NO: 90681 - protein, 17 aa, Mycobacterium avium
PVYRIATKLQEMADELT

SEQ ID NO: 90682 - protein, 32 aa, Mycobacterium avium
PVYVGFGSMPMRACRDVARVAIEAVRAQRRRA

SEQ ID NO: 90683 - protein, 19 aa, Mycobacterium avium
PWDVPGFEIPGGGPATSAF

SEQ ID NO: 90684 - protein, 23 aa, Mycobacterium avium
PWEAARPAGRRGALATEFTLDLD

SEQ ID NO: 90685 - protein, 17 aa, Mycobacterium avium
PWEMRVRGLRGRPGGAT

SEQ ID NO: 90686 - protein, 19 aa, Mycobacterium avium
PWEPWLHALPVEFDSAEQV

SEQ ID NO: 90687 - protein, 32 aa, Mycobacterium avium
PWLPERSASWVLPLLWRRWSPGYRAEEDLRHV

SEQ ID NO: 90688 - protein, 24 aa, Mycobacterium avium
PWMPEEIGELGVQVLRAVKDTLDP

SEQ ID NO: 90689 - protein, 23 aa, Mycobacterium avium
PWQETRPGFFGSDVYVRREPVGV

SEQ ID NO: 90690 - protein, 21 aa, Mycobacterium avium
PWTATLKPHYVRITPTEVTGR

SEQ ID NO: 90691 - protein, 23 aa, Mycobacterium avium
PWTMPEPLLPVAIAAHAKTDEDK

SEQ ID NO: 90692 - protein, 29 aa, Mycobacterium avium
PWVARVGTVVMSWRLRTRHGLPVHDIAPM

SEQ ID NO: 90693 - protein, 17 aa, Mycobacterium avium
PWYLVRYWRLLKFKLAN

SEQ ID NO: 90694 - protein, 24 aa, Mycobacterium avium
PYAKLLRDIPFRVGAVVQPPTHYA

SEQ ID NO: 90695 - protein, 17 aa, Mycobacterium avium
PYARTWSTIAGALVAHN

SEQ ID NO: 90696 - protein, 31 aa, Mycobacterium avium
PYERSSCFWQRIAYLYSRFDDLIAEVSAAGE

SEQ ID NO: 90697 - protein, 17 aa, Mycobacterium avium
PYGRRVRVLGDQFAPCR

SEQ ID NO: 90698 - protein, 27 aa, Mycobacterium avium
PYNRRSRFPQRWWWVALTDEAFPRLAV

SEQ ID NO: 90699 - protein, 18 aa, Mycobacterium avium
PYPQRAPVLVGIDGSPAS

SEQ ID NO: 90700 - protein, 18 aa, Mycobacterium avium
PYPTMYVNQPWTIRQYAG

SEQ ID NO: 90701 - protein, 18 aa, Mycobacterium avium
PYRAAMEQGLIYTRLGNP

SEQ ID NO: 90702 - protein, 18 aa, Mycobacterium avium
PYRKLGRNQLRVGMFPAV

SEQ ID NO: 90703 - protein, 18 aa, Mycobacterium avium
PYSPPEHAFKMVPSSLGI

SEQ ID NO: 90704 - protein, 18 aa, Mycobacterium avium
PYVASKWGVRGLAKSAAL

SEQ ID NO: 90705 - protein, 17 aa, Mycobacterium avium
PYWESVEPFPMPNEVGV

SEQ ID NO: 90706 - protein, 19 aa, Mycobacterium avium
QAAGAVLHWGMQRGSGLRV

SEQ ID NO: 90707 - protein, 17 aa, Mycobacterium avium
QAAHIVMRFQQNLAELV

SEQ ID NO: 90708 - protein, 22 aa, Mycobacterium avium
QAALKDGFRVFGELAPHPLLTH

SEQ ID NO: 90709 - protein, 29 aa, Mycobacterium avium
QAAQAFSEWRRTPAPVRGALVARLGELLR

SEQ ID NO: 90710 - protein, 24 aa, Mycobacterium avium
QAEAAYRKGLSWPEAADTIDLGEY

SEQ ID NO: 90711 - protein, 25 aa, Mycobacterium avium
QAELPGFRPPTAVGHTGELVSMRIG

SEQ ID NO: 90712 - protein, 24 aa, Mycobacterium avium
QAETFPELRLLVLNEPLATQLGLD

SEQ ID NO: 90713 - protein, 17 aa, Mycobacterium avium
QAGRPAQIASLARAFHD

SEQ ID NO: 90714 - protein, 17 aa, Mycobacterium avium
QAGSVQVNCQLVFDHDV

SEQ ID NO: 90715 - protein, 17 aa, Mycobacterium avium
QAIRAGMSLGIMHDLAV

SEQ ID NO: 90716 - protein, 18 aa, Mycobacterium avium
QAKIRAGASVEQVAAASG

SEQ ID NO: 90717 - protein, 22 aa, Mycobacterium avium
QALNRLAGTFAEQRDVVSQALQ

SEQ ID NO: 90718 - protein, 27 aa, Mycobacterium avium
QAQVNMPAMPAGLPVSVPAQVTLPKDL

SEQ ID NO: 90719 - protein, 19 aa, Mycobacterium avium
QARDCLRSVDALSDEALLA

SEQ ID NO: 90720 - protein, 23 aa, Mycobacterium avium
QARFGSVFIKAGFSSMDMGTSYL

SEQ ID NO: 90721 - protein, 27 aa, Mycobacterium avium
QARPPARLIGWTARFLGMVRPGDEVAF

SEQ ID NO: 90722 - protein, 24 aa, Mycobacterium avium
QASWRCVQAHDRAGWLALMSDDVV

SEQ ID NO: 90723 - protein, 18 aa, Mycobacterium avium
QAVIKGLVADGWSTDSDF

SEQ ID NO: 90724 - protein, 17 aa, Mycobacterium avium
QCESMGAAGRSRAQSRF

SEQ ID NO: 90725 - protein, 25 aa, Mycobacterium avium
QCHSSAFDFSVWEIFGALLRGRRLL

SEQ ID NO: 90726 - protein, 20 aa, Mycobacterium avium
QCNVTALPPYLESAYQEFMA

SEQ ID NO: 90727 - protein, 20 aa, Mycobacterium avium
QCYVGASFMRPVECAERHGI

SEQ ID NO: 90728 - protein, 25 aa, Mycobacterium avium
QDEATRAALQWAMSVAAQRAAALVA

SEQ ID NO: 90729 - protein, 24 aa, Mycobacterium avium
QDLPGDTFVGPRFGLYGRTQPTWR

SEQ ID NO: 90730 - protein, 17 aa, Mycobacterium avium
QDPRPAIEAIRAAVAQR

SEQ ID NO: 90731 - protein, 25 aa, Mycobacterium avium
QDQIVGLLLRLQRQLGLTYLFVSHD

SEQ ID NO: 90732 - protein, 26 aa, Mycobacterium avium
QDSERARRCHEFLGQLQGTPAAGPAT

SEQ ID NO: 90733 - protein, 18 aa, Mycobacterium avium
QDSYKAYLMCFGSTGMFE

SEQ ID NO: 90734 - protein, 26 aa, Mycobacterium avium
QDYALTELCALSWTVYSLPGAPVLDH

SEQ ID NO: 90735 - protein, 25 aa, Mycobacterium avium
QEATKGRFRLGLGTQVRTHVVRRYG

SEQ ID NO: 90736 - protein, 17 aa, Mycobacterium avium
QEHDWSQTVAWLAESQG

SEQ ID NO: 90737 - protein, 24 aa, Mycobacterium avium
QEIGQGHLSRFCDTEAQFPVIATT

SEQ ID NO: 90738 - protein, 20 aa, Mycobacterium avium
QEIMTELEIAPTRRLRGLGD

SEQ ID NO: 90739 - protein, 23 aa, Mycobacterium avium
QEITRGRCAAIAVPQGGMEKLVV

SEQ ID NO: 90740 - protein, 20 aa, Mycobacterium avium
QELEPACAALAARRPDRADT

SEQ ID NO: 90741 - protein, 18 aa, Mycobacterium avium
QELSHWVSGVIPWDAADP

SEQ ID NO: 90742 - protein, 23 aa, Mycobacterium avium
QEMMRRATAKWREHGFDLEFGDL

SEQ ID NO: 90743 - protein, 24 aa, Mycobacterium avium
QERMAALAEAVWALPQPVIAAVNG

SEQ ID NO: 90744 - protein, 22 aa, Mycobacterium avium
QFGLPEVKRGLIAAAGGVFRIA

SEQ ID NO: 90745 - protein, 20 aa, Mycobacterium avium
QFPATSFSPGYRSVWHRDRD

SEQ ID NO: 90746 - protein, 21 aa, Mycobacterium avium
QFRELEAFAAFASDLDATSKA

SEQ ID NO: 90747 - protein, 20 aa, Mycobacterium avium
QFTAMAWSLMKLATLHRTIK

SEQ ID NO: 90748 - protein, 17 aa, Mycobacterium avium
QGARYYGPRGFYETARG

SEQ ID NO: 90749 - protein, 24 aa, Mycobacterium avium
QGAWPRFGLELPELLPDKLTGLKR

SEQ ID NO: 90750 - protein, 24 aa, Mycobacterium avium
QGEPFWFPNWTRLVYAGDGLFSSE

SEQ ID NO: 90751 - protein, 19 aa, Mycobacterium avium
QGMREGWLSLDQVGVIAAR

SEQ ID NO: 90752 - protein, 29 aa, Mycobacterium avium
QGPTATPCGVCDSCLALAPNAPGSIDVVE

SEQ ID NO: 90753 - protein, 19 aa, Mycobacterium avium
QGRLARFVDIAARHGIKPL

SEQ ID NO: 90754 - protein, 18 aa, Mycobacterium avium
QGRVAFITGAARGQGRSH

SEQ ID NO: 90755 - protein, 24 aa, Mycobacterium avium
QGSARFWLFGVIPAWTHHLTIKRL

SEQ ID NO: 90756 - protein, 19 aa, Mycobacterium avium
QGSAWELPHTDYVTFAAGD

SEQ ID NO: 90757 - protein, 19 aa, Mycobacterium avium
QGSCYRITLAHDEAAKFDA

SEQ ID NO: 90758 - protein, 24 aa, Mycobacterium avium
QGSKRPTFASVHGRDATVVRAADL

SEQ ID NO: 90759 - protein, 17 aa, Mycobacterium avium
QHCRSRGLSRYKHPERL

SEQ ID NO: 90760 - protein, 17 aa, Mycobacterium avium
QHDKLPPSINFAGPSPY

SEQ ID NO: 90761 - protein, 24 aa, Mycobacterium avium
QHGWEGALIGTGWGRPDTFTVATA

SEQ ID NO: 90762 - protein, 17 aa, Mycobacterium avium
QHLCGTAPMGVDGDPRA

SEQ ID NO: 90763 - protein, 22 aa, Mycobacterium avium
QHLRSPDFFDVERFEKISVVVT

SEQ ID NO: 90764 - protein, 25 aa, Mycobacterium avium
QHRPKRRAEVVPIRVPPELKERLEA

SEQ ID NO: 90765 - protein, 18 aa, Mycobacterium avium
QILRALRINLSVRGYEVV

SEQ ID NO: 90766 - protein, 26 aa, Mycobacterium avium
QIVLWCMGESHAGVVLDALANRYGVT

SEQ ID NO: 90767 - protein, 27 aa, Mycobacterium avium
QIWAKGVELYPGWRKYEVRAGDRHIEA

SEQ ID NO: 90768 - protein, 30 aa, Mycobacterium avium
QKQRWLPKFCTGELITAIAMTEPGTGSDLQ

SEQ ID NO: 90769 - protein, 17 aa, Mycobacterium avium
QLAELVGPTGAFVSDGF

SEQ ID NO: 90770 - protein, 21 aa, Mycobacterium avium
QLDWMVCRTVATVLRTKVSAQ

SEQ ID NO: 90771 - protein, 20 aa, Mycobacterium avium
QLFPTAEGYLALFITHDGFW

SEQ ID NO: 90772 - protein, 29 aa, Mycobacterium avium
QLFTGDCLFPGGVGKTWQPGDFDQLIDDV

SEQ ID NO: 90773 - protein, 17 aa, Mycobacterium avium
QLIRKPPELSWEVAGSL

SEQ ID NO: 90774 - protein, 21 aa, Mycobacterium avium
QLLLERAYLLGVTGPEMTVLV

SEQ ID NO: 90775 - protein, 21 aa, Mycobacterium avium
QLLVLRKARVLGIAGPGNADW

SEQ ID NO: 90776 - protein, 17 aa, Mycobacterium avium
QLNAGFLRVRIYCPRGA

SEQ ID NO: 90777 - protein, 26 aa, Mycobacterium avium
QLPDRGWRRALRLATFGLIDLGPSPA

SEQ ID NO: 90778 - protein, 23 aa, Mycobacterium avium
QLPPEINSGLMYSGPGAGPLLAA

SEQ ID NO: 90779 - protein, 23 aa, Mycobacterium avium
QLQDWRSAVAYARTLDGIDPDRV

SEQ ID NO: 90780 - protein, 18 aa, Mycobacterium avium
QLRADRGLIGPFIEEALR

SEQ ID NO: 90781 - protein, 21 aa, Mycobacterium avium
QLRFCDPRVPAPERGDAARNR

SEQ ID NO: 90782 - protein, 20 aa, Mycobacterium avium
QLRFDRSTGQWVIIAALRQD

SEQ ID NO: 90783 - protein, 19 aa, Mycobacterium avium
QLRGRLDGLTIRDAARLGR

SEQ ID NO: 90784 - protein, 18 aa, Mycobacterium avium
QLRGVTVSMALDFMAPAR

SEQ ID NO: 90785 - protein, 35 aa, Mycobacterium avium
QLRKFLADKVVRWWLPERWTFVDEIPRTSVGKYDK

SEQ ID NO: 90786 - protein, 19 aa, Mycobacterium avium
QLRYAGKVGTGFDEATLHR

SEQ ID NO: 90787 - protein, 25 aa, Mycobacterium avium
QLVNSDPYGAGWLLDVQVSDAAALE

SEQ ID NO: 90788 - protein, 18 aa, Mycobacterium avium
QMAALLMAILLRGMDGGE

SEQ ID NO: 90789 - protein, 17 aa, Mycobacterium avium
QMMYELRDFGFSTSIGI

SEQ ID NO: 90790 - protein, 22 aa, Mycobacterium avium
QMPDDRTYFWIARTTSGGPSRY

SEQ ID NO: 90791 - protein, 18 aa, Mycobacterium avium
QMSGFGGMVSVRMRGGRQ

SEQ ID NO: 90792 - protein, 18 aa, Mycobacterium avium
QNDYRVAPGHVFVTGMSN

SEQ ID NO: 90793 - protein, 19 aa, Mycobacterium avium
QPAELAPIYVLLASDEASY

SEQ ID NO: 90794 - protein, 26 aa, Mycobacterium avium
QPDKYWAGFCRRIGLAELADDARFVP

SEQ ID NO: 90795 - protein, 17 aa, Mycobacterium avium
QPEIAALIEAGKFHGDV

SEQ ID NO: 90796 - protein, 18 aa, Mycobacterium avium
QPGARLFLHYADLTDGTR

SEQ ID NO: 90797 - protein, 24 aa, Mycobacterium avium
QPLATIAYDFARLMADIWDKNNSP

SEQ ID NO: 90798 - protein, 18 aa, Mycobacterium avium
QPLGQIGDLARRTQSAGF

SEQ ID NO: 90799 - protein, 25 aa, Mycobacterium avium
QPPALRAICPWEGFTDAYRDLMFPG

SEQ ID NO: 90800 - protein, 23 aa, Mycobacterium avium
QPPVCGCGGLIRPDIVWFGEQLP

SEQ ID NO: 90801 - protein, 19 aa, Mycobacterium avium
QPTEFNDIVAVLALYRPGP

SEQ ID NO: 90802 - protein, 28 aa, Mycobacterium avium
QPVFYLPDKAGSIWGEALAAGAAKRDPA

SEQ ID NO: 90803 - protein, 33 aa, Mycobacterium avium
QPWLRDLAKRWVRWRLSTGLGLEAGGGRPVVAL

SEQ ID NO: 90804 - protein, 19 aa, Mycobacterium avium
QQDIPEWISKAYVESYRGP

SEQ ID NO: 90805 - protein, 17 aa, Mycobacterium avium
QQLLDFQEHDWSQTVAW

SEQ ID NO: 90806 - protein, 19 aa, Mycobacterium avium
QQRLEAMAGAATVPVINAL

SEQ ID NO: 90807 - protein, 18 aa, Mycobacterium avium
QQRLQDICDYHSSVEQAA

SEQ ID NO: 90808 - protein, 17 aa, Mycobacterium avium
QQRLYRQALEMHPQYVL

SEQ ID NO: 90809 - protein, 17 aa, Mycobacterium avium
QQVFKMAAELAYLEFGD

SEQ ID NO: 90810 - protein, 24 aa, Mycobacterium avium
QQVISRLIDWVSFTPLHNVTGEPA

SEQ ID NO: 90811 - protein, 21 aa, Mycobacterium avium
QRAARRLVHVPVGRFAEPGEI

SEQ ID NO: 90812 - protein, 30 aa, Mycobacterium avium
QRAASSVKERHGWSYEKWAKQVTRVLVSIE

SEQ ID NO: 90813 - protein, 26 aa, Mycobacterium avium
QRAATEFTLQAWAGSPGFRGDPAGPP

SEQ ID NO: 90814 - protein, 19 aa, Mycobacterium avium
QRADAMWERFRGIRRRYVL

SEQ ID NO: 90815 - protein, 24 aa, Mycobacterium avium
QRAGAGGLLLPVGVRRLRNYHSTR

SEQ ID NO: 90816 - protein, 28 aa, Mycobacterium avium
QRAKNMFALGLLSWMYGRPIETSEKFIR

SEQ ID NO: 90817 - protein, 18 aa, Mycobacterium avium
QRAVPGPGARLVTTMTRH

SEQ ID NO: 90818 - protein, 28 aa, Mycobacterium avium
QRCLDLTVQWCRDRETFGRPLISRQSVQ

SEQ ID NO: 90819 - protein, 21 aa, Mycobacterium avium
QRDRFLFKINVGYPSPEEERE

SEQ ID NO: 90820 - protein, 20 aa, Mycobacterium avium
QRDWQRWAAAVGDHNPLYFD

SEQ ID NO: 90821 - protein, 17 aa, Mycobacterium avium
QRERQRNFHAWTFEGMA

SEQ ID NO: 90822 - protein, 29 aa, Mycobacterium avium
QRFAGMLVAGVFLREFVADGVGWAHIDVA

SEQ ID NO: 90823 - protein, 17 aa, Mycobacterium avium
QRFYAKHGFTVSGTRTF

SEQ ID NO: 90824 - protein, 20 aa, Mycobacterium avium
QRGGAAGAFGRPGGAPRRGR

SEQ ID NO: 90825 - protein, 17 aa, Mycobacterium avium
QRIHAFSPQALARPRDL

SEQ ID NO: 90826 - protein, 22 aa, Mycobacterium avium
QRIHPLKNVLILAGAGVGGGSL

SEQ ID NO: 90827 - protein, 19 aa, Mycobacterium avium
QRILGDWAQQQRHFVKVMP

SEQ ID NO: 90828 - protein, 19 aa, Mycobacterium avium
QRLAAACQRGGSSLYITGV

SEQ ID NO: 90829 - protein, 21 aa, Mycobacterium avium
QRLAPGTALARVFWPNGRVVV

SEQ ID NO: 90830 - protein, 23 aa, Mycobacterium avium
QRLARAGWRVVILEAGPFWHPDE

SEQ ID NO: 90831 - protein, 20 aa, Mycobacterium avium
QRLATQLGYSETVFVDLPAP

SEQ ID NO: 90832 - protein, 19 aa, Mycobacterium avium
QRLGGPPATPARTLDEQAE

SEQ ID NO: 90833 - protein, 17 aa, Mycobacterium avium
QRLLVKVPAGWSHTAAA

SEQ ID NO: 90834 - protein, 23 aa, Mycobacterium avium
QRLWPTEEFELARSRVPVRLPED

SEQ ID NO: 90835 - protein, 23 aa, Mycobacterium avium
QRPPRPGVHNSGWVQSPGAERLG

SEQ ID NO: 90836 - protein, 22 aa, Mycobacterium avium
QRRGPDAGTWCEAWTVRDVVVH

SEQ ID NO: 90837 - protein, 17 aa, Mycobacterium avium
QRRIAIEDIEIGGETIR

SEQ ID NO: 90838 - protein, 18 aa, Mycobacterium avium
QRRIWELEKRRAHVPWVT

SEQ ID NO: 90839 - protein, 26 aa, Mycobacterium avium
QRRLYLRLACGLAERIGAQAVVTGDS

SEQ ID NO: 90840 - protein, 19 aa, Mycobacterium avium
QRVAVELENSVSSYASTLS

SEQ ID NO: 90841 - protein, 21 aa, Mycobacterium avium
QRVLGRALVKSVITQAQQRAR

SEQ ID NO: 90842 - protein, 18 aa, Mycobacterium avium
QRWLDVVGLREFAGHYPR

SEQ ID NO: 90843 - protein, 20 aa, Mycobacterium avium
QRWLRMRERLGLDVNVAALT

SEQ ID NO: 90844 - protein, 18 aa, Mycobacterium avium
QRYAPLLAALDCPVHLIT

SEQ ID NO: 90845 - protein, 19 aa, Mycobacterium avium
QSDEIACLVLYGIHQAGLR

SEQ ID NO: 90846 - protein, 22 aa, Mycobacterium avium
QSEHGMPVGMMLSADIGQEALL

SEQ ID NO: 90847 - protein, 24 aa, Mycobacterium avium
QSGKYRRVLAMAWEKQSESNAMWA

SEQ ID NO: 90848 - protein, 21 aa, Mycobacterium avium
QSGRVRLALVCGGRQLSLPVP

SEQ ID NO: 90849 - protein, 20 aa, Mycobacterium avium
QSLRSGECDLALAGGVTVMA

SEQ ID NO: 90850 - protein, 23 aa, Mycobacterium avium
QSPCGLAELCERTELPRATAYRL

SEQ ID NO: 90851 - protein, 24 aa, Mycobacterium avium
QSRTAQFTARWGLTGTLITVDGEL

SEQ ID NO: 90852 - protein, 24 aa, Mycobacterium avium
QSRTIRLPVHLVEQVNKLARIKRE

SEQ ID NO: 90853 - protein, 20 aa, Mycobacterium avium
QSRVTFDAAPARRLATASAD

SEQ ID NO: 90854 - protein, 17 aa, Mycobacterium avium
QTLRAGRWSGYIKPDID

SEQ ID NO: 90855 - protein, 24 aa, Mycobacterium avium
QTNVEFLRFLLADERVRAGDLDTA

SEQ ID NO: 90856 - protein, 26 aa, Mycobacterium avium
QTPTLLFPFAAPRVAGDLSEAGSRSE

SEQ ID NO: 90857 - protein, 18 aa, Mycobacterium avium
QTRKTLWRALDGVTVESV

SEQ ID NO: 90858 - protein, 17 aa, Mycobacterium avium
QTVPGMITGFVPLVLKA

SEQ ID NO: 90859 - protein, 18 aa, Mycobacterium avium
QVARSEWAVIVADGAELP

SEQ ID NO: 90860 - protein, 19 aa, Mycobacterium avium
QVDGARWLSLEGRSKVNSD

SEQ ID NO: 90861 - protein, 25 aa, Mycobacterium avium
QVFLVDCGRGVLQRAAAVGVGAAGL

SEQ ID NO: 90862 - protein, 24 aa, Mycobacterium avium
QVGDTSRLLARFPALGGTDTSGRS

SEQ ID NO: 90863 - protein, 27 aa, Mycobacterium avium
QVGGARGGWKPFLHHISKGAPRSRRVI

SEQ ID NO: 90864 - protein, 17 aa, Mycobacterium avium
QVGLWTFRVDGWGDPIH

SEQ ID NO: 90865 - protein, 19 aa, Mycobacterium avium
QVHTLLDFHFHPHISAPSG

SEQ ID NO: 90866 - protein, 17 aa, Mycobacterium avium
QVIANGLAILGVTAPER

SEQ ID NO: 90867 - protein, 23 aa, Mycobacterium avium
QVISALLDVAGWAQPWDTSDQRE

SEQ ID NO: 90868 - protein, 26 aa, Mycobacterium avium
QVNGRYVFHKDLRRAVIFGRNDLVKD

SEQ ID NO: 90869 - protein, 25 aa, Mycobacterium avium
QVNRPLRGSYRVAFLSLKGGVGKTT

SEQ ID NO: 90870 - protein, 18 aa, Mycobacterium avium
QVRTRYSSAYDLEGTVKR

SEQ ID NO: 90871 - protein, 23 aa, Mycobacterium avium
QVTELIPGASWTWVQRSPGARVA

SEQ ID NO: 90872 - protein, 20 aa, Mycobacterium avium
QVVVCGKPSFYTGRGTFSLR

SEQ ID NO: 90873 - protein, 25 aa, Mycobacterium avium
QWDIREVIPVAATVATVFVENVLDH

SEQ ID NO: 90874 - protein, 19 aa, Mycobacterium avium
QWEEALEVAIRCMVEEPFS

SEQ ID NO: 90875 - protein, 17 aa, Mycobacterium avium
QWGKPAPGFGRISGVRL

SEQ ID NO: 90876 - protein, 18 aa, Mycobacterium avium
QWKRELVTRTSLTEDEIG

SEQ ID NO: 90877 - protein, 17 aa, Mycobacterium avium
QYDPLMSPLVWDLAHIG

SEQ ID NO: 90878 - protein, 19 aa, Mycobacterium avium
QYPEWELGVQLVAEDDEFS

SEQ ID NO: 90879 - protein, 24 aa, Mycobacterium avium
QYPPNEGPIHWYIHLMEQSRTPGA

SEQ ID NO: 90880 - protein, 17 aa, Mycobacterium avium
RAAAARLVAVAELLVLR

SEQ ID NO: 90881 - protein, 31 aa, Mycobacterium avium
RAAAEELRRLWRARRVLAVTFPSHTSATETA

SEQ ID NO: 90882 - protein, 18 aa, Mycobacterium avium
RAAAFAYETAFAETVPPP

SEQ ID NO: 90883 - protein, 33 aa, Mycobacterium avium
RAAALRLSGAVGYACSVVEKFGDSLVVTAFEGE

SEQ ID NO: 90884 - protein, 21 aa, Mycobacterium avium
RAAALRRLAAQPGPDRDDALR

SEQ ID NO: 90885 - protein, 17 aa, Mycobacterium avium
RAAARWRELGGTRLRDR

SEQ ID NO: 90886 - protein, 17 aa, Mycobacterium avium
RAAAVAGTRRDWVRRTL

SEQ ID NO: 90887 - protein, 19 aa, Mycobacterium avium
RAAEAWSGGYFAKSVVPVR

SEQ ID NO: 90888 - protein, 18 aa, Mycobacterium avium
RAAELGWTGLLVPEELGG

SEQ ID NO: 90889 - protein, 25 aa, Mycobacterium avium
RAAEPWEVAATIAFLASDYSSYLTG

SEQ ID NO: 90890 - protein, 18 aa, Mycobacterium avium
RAAERAGEAPPRLVTSAE

SEQ ID NO: 90891 - protein, 21 aa, Mycobacterium avium
RAAFEAGWIQPTWPREHGGRS

SEQ ID NO: 90892 - protein, 17 aa, Mycobacterium avium
RAAISAFWDKAIAPTTK

SEQ ID NO: 90893 - protein, 17 aa, Mycobacterium avium
RAALLGLRRAGQVSPGG

SEQ ID NO: 90894 - protein, 18 aa, Mycobacterium avium
RAAMPVTAPPSVARRLRL

SEQ ID NO: 90895 - protein, 18 aa, Mycobacterium avium
RAAMWLEHIRRRGWQGAA

SEQ ID NO: 90896 - protein, 18 aa, Mycobacterium avium
RAAREVARRGPGRVPDGV

SEQ ID NO: 90897 - protein, 18 aa, Mycobacterium avium
RAARIIVVPGDVDRVVTV

SEQ ID NO: 90898 - protein, 28 aa, Mycobacterium avium
RAATVGRLSVPPAWPAANPVAPLGETVI

SEQ ID NO: 90899 - protein, 17 aa, Mycobacterium avium
RAAVCAGVDALGARADA

SEQ ID NO: 90900 - protein, 21 aa, Mycobacterium avium
RAAVDSGYYPGQFQVGQTGKT

SEQ ID NO: 90901 - protein, 20 aa, Mycobacterium avium
RAAVQIGRRLARLARTHQVI

SEQ ID NO: 90902 - protein, 18 aa, Mycobacterium avium
RAAVTARCIAAAVFGAME

SEQ ID NO: 90903 - protein, 19 aa, Mycobacterium avium
RADALAWSVKLVGEHAEEW

SEQ ID NO: 90904 - protein, 21 aa, Mycobacterium avium
RADGAISLGLVVNGLDCSGVP

SEQ ID NO: 90905 - protein, 22 aa, Mycobacterium avium
RADGSVVPGLYAAGACASNLAQ

SEQ ID NO: 90906 - protein, 21 aa, Mycobacterium avium
RADIPFGGTVAVIGLGAVGLC

SEQ ID NO: 90907 - protein, 25 aa, Mycobacterium avium
RADYVLEYEPGMPIGVVEAKREYST

SEQ ID NO: 90908 - protein, 21 aa, Mycobacterium avium
RAEAPGLRFAGLGGATETPVH

SEQ ID NO: 90909 - protein, 26 aa, Mycobacterium avium
RAEEGNLWFEWSRSLDDPAEYVLVEA

SEQ ID NO: 90910 - protein, 26 aa, Mycobacterium avium
RAEGRDAGWCPCVAAGGDAHAGHTET

SEQ ID NO: 90911 - protein, 20 aa, Mycobacterium avium
RAEIDALLARLPQPGDTEDP

SEQ ID NO: 90912 - protein, 21 aa, Mycobacterium avium
RAEKATALRWLREVDAEPLAD

SEQ ID NO: 90913 - protein, 18 aa, Mycobacterium avium
RAESSALFAMLSGQHVGD

SEQ ID NO: 90914 - protein, 20 aa, Mycobacterium avium
RAESSWRKILDHFSPATQLG

SEQ ID NO: 90915 - protein, 20 aa, Mycobacterium avium
RAFCAALRAAGARTVGHAEL

SEQ ID NO: 90916 - protein, 26 aa, Mycobacterium avium
RAFDVAKGLPWPARFPSRVLANDFVE

SEQ ID NO: 90917 - protein, 19 aa, Mycobacterium avium
RAFQNVCRHRGNSLCSGSG

SEQ ID NO: 90918 - protein, 20 aa, Mycobacterium avium
RAFWPGALSLVVTQAPSLQW

SEQ ID NO: 90919 - protein, 34 aa, Mycobacterium avium
RAGASIAMVRACAAEHTPLLGVCLGHQAIGVAFG

SEQ ID NO: 90920 - protein, 19 aa, Mycobacterium avium
RAGGPVLRVGQRVIARRYL

SEQ ID NO: 90921 - protein, 18 aa, Mycobacterium avium
RAGLSISDVDLFEINEAF

SEQ ID NO: 90922 - protein, 19 aa, Mycobacterium avium
RAGLSTVFIPARNEPDLDD

SEQ ID NO: 90923 - protein, 20 aa, Mycobacterium avium
RAGLTWPQAAERFAAMVAPC

SEQ ID NO: 90924 - protein, 20 aa, Mycobacterium avium
RAGLVNRILVYLAPTLLGGP

SEQ ID NO: 90925 - protein, 17 aa, Mycobacterium avium
RAGRPAEALPWYRIALQ

SEQ ID NO: 90926 - protein, 19 aa, Mycobacterium avium
RAHCPDVAFLHLSGSAALL

SEQ ID NO: 90927 - protein, 24 aa, Mycobacterium avium
RAIMRRLYPLIGRLFARQTAEISL

SEQ ID NO: 90928 - protein, 17 aa, Mycobacterium avium
RAKAAVVNQLLGVLDDL

SEQ ID NO: 90929 - protein, 25 aa, Mycobacterium avium
RAKAAWLRSRRRGVLAGFSAAALHG

SEQ ID NO: 90930 - protein, 22 aa, Mycobacterium avium
RAKARPGVTPHLLVMTATPIPR

SEQ ID NO: 90931 - protein, 22 aa, Mycobacterium avium
RALEKHGPPVYVRHEIVHNRHV

SEQ ID NO: 90932 - protein, 17 aa, Mycobacterium avium
RALGRRLGHEGMKVVLA

SEQ ID NO: 90933 - protein, 22 aa, Mycobacterium avium
RALPELGRSGSLDILLAAYSLA

SEQ ID NO: 90934 - protein, 21 aa, Mycobacterium avium
RALRGYAAWVSGLRRVEAPTR

SEQ ID NO: 90935 - protein, 17 aa, Mycobacterium avium
RALRMSTPLALTEEELV

SEQ ID NO: 90936 - protein, 18 aa, Mycobacterium avium
RALRRAPLYELLSANGVA

SEQ ID NO: 90937 - protein, 17 aa, Mycobacterium avium
RALRVIRGRLTATAAEI

SEQ ID NO: 90938 - protein, 20 aa, Mycobacterium avium
RALSELKLVEPLVISSPRQR

SEQ ID NO: 90939 - protein, 26 aa, Mycobacterium avium
RAMQFLRGGRRWLLKSPQHLEQVPVL

SEQ ID NO: 90940 - protein, 17 aa, Mycobacterium avium
RAMSPSVWSYVTGGAGD

SEQ ID NO: 90941 - protein, 24 aa, Mycobacterium avium
RANASGLVRLQWVSARTLTIAPKD

SEQ ID NO: 90942 - protein, 17 aa, Mycobacterium avium
RANLERWAPLLRDGATL

SEQ ID NO: 90943 - protein, 17 aa, Mycobacterium avium
RANLYVSRMPIAVITAS

SEQ ID NO: 90944 - protein, 28 aa, Mycobacterium avium
RANREAFDRWGLIPRMFVGAAERDLSVQ

SEQ ID NO: 90945 - protein, 22 aa, Mycobacterium avium
RANRTPIDWDGYTPPVPAIGAG

SEQ ID NO: 90946 - protein, 18 aa, Mycobacterium avium
RAPAAYDAVCERLHTASL

SEQ ID NO: 90947 - protein, 17 aa, Mycobacterium avium
RAPLRGVAPGQTLALYR

SEQ ID NO: 90948 - protein, 19 aa, Mycobacterium avium
RAPLRISFAGGGTDVPPFP

SEQ ID NO: 90949 - protein, 22 aa, Mycobacterium avium
RAPVPFHLLPTVARELGKHTEI

SEQ ID NO: 90950 - protein, 17 aa, Mycobacterium avium
RAQAQWEALRRTYLRLG

SEQ ID NO: 90951 - protein, 36 aa, Mycobacterium avium
RAQLERWVHEWRIPRVKIKIGESWGSHERRDLDRIA

SEQ ID NO: 90952 - protein, 27 aa, Mycobacterium avium
RAQVGLPAFMIRAFCDLAERHPWQETR

SEQ ID NO: 90953 - protein, 21 aa, Mycobacterium avium
RARAMKLFRRMEGRAAFEVKI

SEQ ID NO: 90954 - protein, 23 aa, Mycobacterium avium
RARAWRRLPDWPPATTERALYLR

SEQ ID NO: 90955 - protein, 20 aa, Mycobacterium avium
RARDEVVGVIAIARGTEQPP

SEQ ID NO: 90956 - protein, 17 aa, Mycobacterium avium
RARLDGEPQYKTNVTLR

SEQ ID NO: 90957 - protein, 21 aa, Mycobacterium avium
RARLEAFGLPVVDVAATGAQP

SEQ ID NO: 90958 - protein, 18 aa, Mycobacterium avium
RARRGRGALAALARAVPA

SEQ ID NO: 90959 - protein, 21 aa, Mycobacterium avium
RASAGFWKLTPFDSPPPAADP

SEQ ID NO: 90960 - protein, 24 aa, Mycobacterium avium
RASAYRCGESWSTLVRHRPTGRRL

SEQ ID NO: 90961 - protein, 23 aa, Mycobacterium avium
RASRARVCPVPGHPCLDRITDAE

SEQ ID NO: 90962 - protein, 27 aa, Mycobacterium avium
RASVVKWAVDGGMMVRAPYTLRPDDDD

SEQ ID NO: 90963 - protein, 17 aa, Mycobacterium avium
RATLPAGEYRQISGNTA

SEQ ID NO: 90964 - protein, 19 aa, Mycobacterium avium
RAVAAGLRAIEYVVAADDT

SEQ ID NO: 90965 - protein, 20 aa, Mycobacterium avium
RAVDAATAWHGRLHGAVHCA

SEQ ID NO: 90966 - protein, 17 aa, Mycobacterium avium
RAVELFKPLATKATRPE

SEQ ID NO: 90967 - protein, 17 aa, Mycobacterium avium
RAVGVNFLTRWAIGELV

SEQ ID NO: 90968 - protein, 18 aa, Mycobacterium avium
RAVWEKFGEFGLDARAFS

SEQ ID NO: 90969 - protein, 17 aa, Mycobacterium avium
RAWAFRRVGGFSPILHF

SEQ ID NO: 90970 - protein, 22 aa, Mycobacterium avium
RAYIGCQAFTGGAIIRLDPDDR

SEQ ID NO: 90971 - protein, 18 aa, Mycobacterium avium
RAYVTRQARWVDFDHDYK

SEQ ID NO: 90972 - protein, 22 aa, Mycobacterium avium
RCGSCAATTFPVQQWCPRCSSG

SEQ ID NO: 90973 - protein, 24 aa, Mycobacterium avium
RCLPELPRRVRAERMVMVRNLLMH

SEQ ID NO: 90974 - protein, 20 aa, Mycobacterium avium
RCMLGGPPGGLPALDPDAVR

SEQ ID NO: 90975 - protein, 18 aa, Mycobacterium avium
RCPDRPGLVDERGSLTWR

SEQ ID NO: 90976 - protein, 17 aa, Mycobacterium avium
RCPSEAALDELHSAALR

SEQ ID NO: 90977 - protein, 19 aa, Mycobacterium avium
RCRTIARCRHCTGPLSLAE

SEQ ID NO: 90978 - protein, 17 aa, Mycobacterium avium
RDALKLTRKGGTCVLTG

SEQ ID NO: 90979 - protein, 21 aa, Mycobacterium avium
RDALQRVWRPLADKLDVHAYI

SEQ ID NO: 90980 - protein, 20 aa, Mycobacterium avium
RDDHGRWPQSVGLSVWGTSA

SEQ ID NO: 90981 - protein, 19 aa, Mycobacterium avium
RDDNQWGYHLNLRKGDDGR

SEQ ID NO: 90982 - protein, 20 aa, Mycobacterium avium
RDDVLLGLMLRRVDHALAES

SEQ ID NO: 90983 - protein, 26 aa, Mycobacterium avium
RDEIAERGWPVFLVSTVAREGLQPLI

SEQ ID NO: 90984 - protein, 27 aa, Mycobacterium avium
RDELTLAWQRLVPWPDVLPGLTRLKKK

SEQ ID NO: 90985 - protein, 17 aa, Mycobacterium avium
RDFARRYLVPLVLPAPA

SEQ ID NO: 90986 - protein, 19 aa, Mycobacterium avium
RDFFDLVIVDECHRGSARA

SEQ ID NO: 90987 - protein, 18 aa, Mycobacterium avium
RDFPAAVVVQQHLAGHDS

SEQ ID NO: 90988 - protein, 17 aa, Mycobacterium avium
RDFRSWAHADLELQPGR

SEQ ID NO: 90989 - protein, 22 aa, Mycobacterium avium
RDGEQPLALMIAYLPPGLGEAV

SEQ ID NO: 90990 - protein, 20 aa, Mycobacterium avium
RDGRACLIESHLQRLTQSAA

SEQ ID NO: 90991 - protein, 26 aa, Mycobacterium avium
RDGRDAGRRRPPVLTEAEFLARREAV

SEQ ID NO: 90992 - protein, 24 aa, Mycobacterium avium
RDHLELGESLGLIDMARGAKVSGS

SEQ ID NO: 90993 - protein, 26 aa, Mycobacterium avium
RDIPRFVELWRAGRLPVESLVSSTIR

SEQ ID NO: 90994 - protein, 38 aa, Mycobacterium avium
RDISAKKNEPGWMLQTRLKALRIFERKPMPTWGSNLDG

SEQ ID NO: 90995 - protein, 25 aa, Mycobacterium avium
RDIWADGPLTFLGMMVPGLPNLFSI

SEQ ID NO: 90996 - protein, 23 aa, Mycobacterium avium
RDLAPDRVYICTSFHQSPLPLAL

SEQ ID NO: 90997 - protein, 24 aa, Mycobacterium avium
RDLPRRPLHPELRVEDRTIPGPQG

SEQ ID NO: 90998 - protein, 17 aa, Mycobacterium avium
RDLRLHDHPALSAAADS

SEQ ID NO: 90999 - protein, 25 aa, Mycobacterium avium
RDPAHATAVGWLASFVPLAIPTAGA

SEQ ID NO: 91000 - protein, 17 aa, Mycobacterium avium
RDPGALAVADRLFAVPE

SEQ ID NO: 91001 - protein, 23 aa, Mycobacterium avium
RDPMKFPNLIRAGGRRADNDLHD

SEQ ID NO: 91002 - protein, 23 aa, Mycobacterium avium
RDRLRGWRFYDGFRVDAGAPARH

SEQ ID NO: 91003 - protein, 26 aa, Mycobacterium avium
RDRMAFRSASYWDIVAQLDASVSDPQ

SEQ ID NO: 91004 - protein, 20 aa, Mycobacterium avium
RDRRAIAMGRRGRPEEQAGA

SEQ ID NO: 91005 - protein, 19 aa, Mycobacterium avium
RDRVREVINPAVVVDETNR

SEQ ID NO: 91006 - protein, 18 aa, Mycobacterium avium
RDRYDDFFKMAYAALPDD

SEQ ID NO: 91007 - protein, 24 aa, Mycobacterium avium
RDSPARGGRHLGFAKALVHEMPHT

SEQ ID NO: 91008 - protein, 26 aa, Mycobacterium avium
RDVGWDSLWVYDHFHTVPVPTGEATH

SEQ ID NO: 91009 - protein, 21 aa, Mycobacterium avium
RDVLEVTGLDRFVQQRVDGIT

SEQ ID NO: 91010 - protein, 18 aa, Mycobacterium avium
RDVLGWRAAEVAEAIGTT

SEQ ID NO: 91011 - protein, 29 aa, Mycobacterium avium
RDVTEAVLWLAGPRSRYVTGVAIPVDAGH

SEQ ID NO: 91012 - protein, 24 aa, Mycobacterium avium
RDYRLAELLTGFLARLKTDLQQHS

SEQ ID NO: 91013 - protein, 25 aa, Mycobacterium avium
READVRRREWLAGRRDRVADQREQI

SEQ ID NO: 91014 - protein, 17 aa, Mycobacterium avium
REAGRRAAAAAGATVQR

SEQ ID NO: 91015 - protein, 24 aa, Mycobacterium avium
REAIFKRAWLNVARVEELPRVGSY

SEQ ID NO: 91016 - protein, 22 aa, Mycobacterium avium
REAKKICLGCEVRHECLEYALE

SEQ ID NO: 91017 - protein, 21 aa, Mycobacterium avium
REARLRAAAVAAAVADSGRLL

SEQ ID NO: 91018 - protein, 24 aa, Mycobacterium avium
RECVSARTALTMFLGRADQPDRVR

SEQ ID NO: 91019 - protein, 17 aa, Mycobacterium avium
REDRLDLLQAILAEYQK

SEQ ID NO: 91020 - protein, 17 aa, Mycobacterium avium
REEAGDAAPVWVVENKA

SEQ ID NO: 91021 - protein, 27 aa, Mycobacterium avium
REELTDLLWRMGIRTIGQFAALARGDV

SEQ ID NO: 91022 - protein, 18 aa, Mycobacterium avium
REFDRVKLGPSLWHRDFH

SEQ ID NO: 91023 - protein, 26 aa, Mycobacterium avium
REGFFPPGVIDAMFAYHIDELLRLAS

SEQ ID NO: 91024 - protein, 23 aa, Mycobacterium avium
REGSARARNVLVIKLDAQLIDEL

SEQ ID NO: 91025 - protein, 19 aa, Mycobacterium avium
REGWAARVRLAHALGPTMI

SEQ ID NO: 91026 - protein, 20 aa, Mycobacterium avium
REIDADITLAAFGNTRSYGG

SEQ ID NO: 91027 - protein, 17 aa, Mycobacterium avium
REISGMGTLYSYTVAHR

SEQ ID NO: 91028 - protein, 19 aa, Mycobacterium avium
RELATYFVGQVVGSLDRIR

SEQ ID NO: 91029 - protein, 18 aa, Mycobacterium avium
RELDPWLRDTFAEARHQL

SEQ ID NO: 91030 - protein, 22 aa, Mycobacterium avium
RELHEVCRRHRALLIVDEAHGL

SEQ ID NO: 91031 - protein, 20 aa, Mycobacterium avium
RELLERWTAMCAATPSPAAP

SEQ ID NO: 91032 - protein, 30 aa, Mycobacterium avium
RELPYDRALELGCGTGFFLLNLIQSGVARR

SEQ ID NO: 91033 - protein, 28 aa, Mycobacterium avium
RELRVRVDMGWREWKVAVEYDGIQHWDD

SEQ ID NO: 91034 - protein, 19 aa, Mycobacterium avium
RELSIPYLPIRWSTDNPDS

SEQ ID NO: 91035 - protein, 18 aa, Mycobacterium avium
RELSYWTELARTLEAGGF

SEQ ID NO: 91036 - protein, 22 aa, Mycobacterium avium
RELTAELALALGAAAARQLASG

SEQ ID NO: 91037 - protein, 20 aa, Mycobacterium avium
RELTGLAVLDLYAGSGALGL

SEQ ID NO: 91038 - protein, 28 aa, Mycobacterium avium
REMFMDLPGFDAWLARWRALGPDADAMD

SEQ ID NO: 91039 - protein, 17 aa, Mycobacterium avium
REMLARIEVPYRVIDVA

SEQ ID NO: 91040 - protein, 18 aa, Mycobacterium avium
RENPRPGIVNALLQMRID

SEQ ID NO: 91041 - protein, 17 aa, Mycobacterium avium
RENRIVIAYSPLEQGLL

SEQ ID NO: 91042 - protein, 23 aa, Mycobacterium avium
REPAEGFAAMWADLRRPELREFE

SEQ ID NO: 91043 - protein, 23 aa, Mycobacterium avium
REPAELPNGWVITTSGRISGVTE

SEQ ID NO: 91044 - protein, 25 aa, Mycobacterium avium
REPQKRLSAIASIGSDVWDRLFSGP

SEQ ID NO: 91045 - protein, 27 aa, Mycobacterium avium
REPRATLWRRTEFRAVDAVSFRLHRAR

SEQ ID NO: 91046 - protein, 18 aa, Mycobacterium avium
RERIPISIAALGPKNVEL

SEQ ID NO: 91047 - protein, 17 aa, Mycobacterium avium
RERLSAMMGTLVSPQYW

SEQ ID NO: 91048 - protein, 21 aa, Mycobacterium avium
RESLDSAAGWLAPLGGSHLRS

SEQ ID NO: 91049 - protein, 21 aa, Mycobacterium avium
RESYLRLLLIDAGLPRPQTQV

SEQ ID NO: 91050 - protein, 28 aa, Mycobacterium avium
RETFESGVWRKAPASHRANVLFRAARII

SEQ ID NO: 91051 - protein, 24 aa, Mycobacterium avium
RETLRLLVDLARTAKLEERRDQMF

SEQ ID NO: 91052 - protein, 25 aa, Mycobacterium avium
RETNGDRYLPIWIGQSEAAAIALEQ

SEQ ID NO: 91053 - protein, 17 aa, Mycobacterium avium
REVLEDYGLTPWPKTSG

SEQ ID NO: 91054 - protein, 19 aa, Mycobacterium avium
REVLPRDVIEREPEPTPAP

SEQ ID NO: 91055 - protein, 19 aa, Mycobacterium avium
REVSLGVLQVWQALTEGIS

SEQ ID NO: 91056 - protein, 31 aa, Mycobacterium avium
REVYERIKPAFKHWAAVVIHAGEPGAGTRMK

SEQ ID NO: 91057 - protein, 20 aa, Mycobacterium avium
REYGGRGATVLEQLVYTEET

SEQ ID NO: 91058 - protein, 18 aa, Mycobacterium avium
RFAGLALQGDITFDGAAS

SEQ ID NO: 91059 - protein, 19 aa, Mycobacterium avium
RFAGPVVVIELDMRFGSVQ

SEQ ID NO: 91060 - protein, 24 aa, Mycobacterium avium
RFAGRARAGAVMLIDGTPGIVIAA

SEQ ID NO: 91061 - protein, 17 aa, Mycobacterium avium
RFEVDWGAAGFADAGLD

SEQ ID NO: 91062 - protein, 25 aa, Mycobacterium avium
RFLPPTLRGEMIWCQLFSEPGAGSD

SEQ ID NO: 91063 - protein, 20 aa, Mycobacterium avium
RFLTRNRLVAAMAGATVVVE

SEQ ID NO: 91064 - protein, 22 aa, Mycobacterium avium
RFPKRQGMRIDFILGSPALARR

SEQ ID NO: 91065 - protein, 24 aa, Mycobacterium avium
RFRHRRVGFVFQFFNLLPTLSAWE

SEQ ID NO: 91066 - protein, 21 aa, Mycobacterium avium
RFTPLSLKHRIFRKAVGSHSG

SEQ ID NO: 91067 - protein, 26 aa, Mycobacterium avium
RFVACPFGGAGARMYRTGDLVRWDRD

SEQ ID NO: 91068 - protein, 23 aa, Mycobacterium avium
RFVACPFGGAGERMYRTGDLARW

SEQ ID NO: 91069 - protein, 23 aa, Mycobacterium avium
RFVACPFGGAGERMYRTGDLVRW

SEQ ID NO: 91070 - protein, 20 aa, Mycobacterium avium
RFYDSCRVLPQGDEQPTDLH

SEQ ID NO: 91071 - protein, 19 aa, Mycobacterium avium
RGAFHGRSGYTLSLTNTKP

SEQ ID NO: 91072 - protein, 18 aa, Mycobacterium avium
RGAHLALFRFAFASQEHE

SEQ ID NO: 91073 - protein, 22 aa, Mycobacterium avium
RGAPPVPGCALVTPNHEEARGF

SEQ ID NO: 91074 - protein, 25 aa, Mycobacterium avium
RGDGGFCTEPIDWERLAPPRPPHAA

SEQ ID NO: 91075 - protein, 17 aa, Mycobacterium avium
RGDLAFAGLPGVVYTPE

SEQ ID NO: 91076 - protein, 18 aa, Mycobacterium avium
RGDLKSWFDIHAESVLFL

SEQ ID NO: 91077 - protein, 24 aa, Mycobacterium avium
RGDRWIINGAKTWSTSAFAADYGL

SEQ ID NO: 91078 - protein, 19 aa, Mycobacterium avium
RGDTPWGDRVKPLVGELPA

SEQ ID NO: 91079 - protein, 17 aa, Mycobacterium avium
RGDVLELIDDIKDAIPG

SEQ ID NO: 91080 - protein, 25 aa, Mycobacterium avium
RGGAEAGAFNYAWLNLRKDRQVDLL

SEQ ID NO: 91081 - protein, 19 aa, Mycobacterium avium
RGGDMAVDFLAGAQEPDLR

SEQ ID NO: 91082 - protein, 20 aa, Mycobacterium avium
RGGEAPSWAPLRVQYADYAA

SEQ ID NO: 91083 - protein, 25 aa, Mycobacterium avium
RGGIDKKRRAELIERFDLDPHKKAR

SEQ ID NO: 91084 - protein, 21 aa, Mycobacterium avium
RGGKISFTHLLGYALVQAIKK

SEQ ID NO: 91085 - protein, 29 aa, Mycobacterium avium
RGGPFALGCFAGWLFTEFPPHVLTGHALS

SEQ ID NO: 91086 - protein, 17 aa, Mycobacterium avium
RGGTGDEVAKLVLTASG

SEQ ID NO: 91087 - protein, 17 aa, Mycobacterium avium
RGHRLDWAGVFAGLPAR

SEQ ID NO: 91088 - protein, 20 aa, Mycobacterium avium
RGHTAFLIFTRRLAPGVIAP

SEQ ID NO: 91089 - protein, 25 aa, Mycobacterium avium
RGHVRGFPLGPGFLLEGRPVILTAP

SEQ ID NO: 91090 - protein, 28 aa, Mycobacterium avium
RGIPPGNVGAVWRGTWHGGLGFTDKCCA

SEQ ID NO: 91091 - protein, 19 aa, Mycobacterium avium
RGIVKVRELLAYADGRAES

SEQ ID NO: 91092 - protein, 17 aa, Mycobacterium avium
RGLALRSTLLPSRQRRH

SEQ ID NO: 91093 - protein, 25 aa, Mycobacterium avium
RGLAREIACAYDLEFVDPADVKPLP

SEQ ID NO: 91094 - protein, 23 aa, Mycobacterium avium
RGLDCTAIRWGLWQDAGVVAGSE

SEQ ID NO: 91095 - protein, 18 aa, Mycobacterium avium
RGLGEAMVGINVEQIAQP

SEQ ID NO: 91096 - protein, 20 aa, Mycobacterium avium
RGLVPGPLRFVRAVANYYRP

SEQ ID NO: 91097 - protein, 24 aa, Mycobacterium avium
RGMELFCAGAHPFAQWTTQKLTDA

SEQ ID NO: 91098 - protein, 21 aa, Mycobacterium avium
RGNFASGYRGKLWTFRQYSGF

SEQ ID NO: 91099 - protein, 18 aa, Mycobacterium avium
RGNGFAVAACDRRIDELA

SEQ ID NO: 91100 - protein, 24 aa, Mycobacterium avium
RGQRPADDVYLVFTTNEEIGGVGG

SEQ ID NO: 91101 - protein, 21 aa, Mycobacterium avium
RGRAAAIERAVIRLDDLTDVE

SEQ ID NO: 91102 - protein, 20 aa, Mycobacterium avium
RGRAALRYLSQARHIGKVVM

SEQ ID NO: 91103 - protein, 21 aa, Mycobacterium avium
RGRAQILLMIGIGADDRIHTI

SEQ ID NO: 91104 - protein, 20 aa, Mycobacterium avium
RGRARAWLAANMPRLDPARA

SEQ ID NO: 91105 - protein, 19 aa, Mycobacterium avium
RGRASALVRPGSAEQLAEV

SEQ ID NO: 91106 - protein, 19 aa, Mycobacterium avium
RGRRRASGHLTRLADVLIG

SEQ ID NO: 91107 - protein, 20 aa, Mycobacterium avium
RGSGAVMVLAGPPGVGKTSL

SEQ ID NO: 91108 - protein, 19 aa, Mycobacterium avium
RGSSMPVNRYRPFAEEVEP

SEQ ID NO: 91109 - protein, 17 aa, Mycobacterium avium
RGVGVGQVLAITFTNKA

SEQ ID NO: 91110 - protein, 27 aa, Mycobacterium avium
RGVHFCLGAPLARLEGRIGLEEVLNRW

SEQ ID NO: 91111 - protein, 18 aa, Mycobacterium avium
RGVLSVRAKIKVRLTQLR

SEQ ID NO: 91112 - protein, 26 aa, Mycobacterium avium
RGWEALAGDEVWNWTDELAQLPSLLA

SEQ ID NO: 91113 - protein, 22 aa, Mycobacterium avium
RHCQQVLGGIGFTAEHPLHHHI

SEQ ID NO: 91114 - protein, 17 aa, Mycobacterium avium
RHLPTQLVEAFRSTLEE

SEQ ID NO: 91115 - protein, 19 aa, Mycobacterium avium
RHMDDTLPNAGHRALAALE

SEQ ID NO: 91116 - protein, 26 aa, Mycobacterium avium
RHNIGSAAWLCRADALHPVTRDAVLI

SEQ ID NO: 91117 - protein, 25 aa, Mycobacterium avium
RHRAMLEAFAQWRANTRGALTEVGV

SEQ ID NO: 91118 - protein, 27 aa, Mycobacterium avium
RIADLVPLGRPILCTEYMARPLGSTVQ

SEQ ID NO: 91119 - protein, 24 aa, Mycobacterium avium
RIAHDQCDAWTGLAAAGDVSLRVL

SEQ ID NO: 91120 - protein, 18 aa, Mycobacterium avium
RIAKLAGLVPGRDPYHPN

SEQ ID NO: 91121 - protein, 20 aa, Mycobacterium avium
RIAPAGNGRAWFSITSASSM

SEQ ID NO: 91122 - protein, 18 aa, Mycobacterium avium
RIATRMAGWSKRTARSAR

SEQ ID NO: 91123 - protein, 18 aa, Mycobacterium avium
RIDVGWFLINCDPDTYRR

SEQ ID NO: 91124 - protein, 21 aa, Mycobacterium avium
RIEDVPEIWRRLESVGLQTTE

SEQ ID NO: 91125 - protein, 21 aa, Mycobacterium avium
RIERGLWLTALLRATLTVVRG

SEQ ID NO: 91126 - protein, 19 aa, Mycobacterium avium
RIGDLPIRALISSPLLRCR

SEQ ID NO: 91127 - protein, 23 aa, Mycobacterium avium
RIGTIICALALPAGAVGCGGHGH

SEQ ID NO: 91128 - protein, 21 aa, Mycobacterium avium
RIHRLAAGVSLDWELLAQGAQ

SEQ ID NO: 91129 - protein, 19 aa, Mycobacterium avium
RIIDDLGARVRLARRRFSS

SEQ ID NO: 91130 - protein, 19 aa, Mycobacterium avium
RIKALTGRIDLVHCNDSRD

SEQ ID NO: 91131 - protein, 26 aa, Mycobacterium avium
RILAAAASCVVDFGVDRVTLAEIARR

SEQ ID NO: 91132 - protein, 17 aa, Mycobacterium avium
RILDRLYGYEVSPVLWK

SEQ ID NO: 91133 - protein, 19 aa, Mycobacterium avium
RILRGRTGALIVLGNDENV

SEQ ID NO: 91134 - protein, 20 aa, Mycobacterium avium
RIMLEICWEALERAGIDPSA

SEQ ID NO: 91135 - protein, 25 aa, Mycobacterium avium
RIMSLRPRRVLEIGAGSGLLLSQIA

SEQ ID NO: 91136 - protein, 17 aa, Mycobacterium avium
RINNLRVGHSLDPKADY

SEQ ID NO: 91137 - protein, 18 aa, Mycobacterium avium
RINRPVLERYLANLRSDS

SEQ ID NO: 91138 - protein, 19 aa, Mycobacterium avium
RIPQLAWLLFLKAFDGLEE

SEQ ID NO: 91139 - protein, 28 aa, Mycobacterium avium
RIQDVKWQRPGAETVWFEIHVNPLVDAE

SEQ ID NO: 91140 - protein, 19 aa, Mycobacterium avium
RIRELLAHQRFPVHTLEGD

SEQ ID NO: 91141 - protein, 18 aa, Mycobacterium avium
RIRSGRLLIFSPYVTHRL

SEQ ID NO: 91142 - protein, 17 aa, Mycobacterium avium
RIRYQLQRHFGISADEL

SEQ ID NO: 91143 - protein, 22 aa, Mycobacterium avium
RISAEQRARCLNQLGEALTKHA

SEQ ID NO: 91144 - protein, 25 aa, Mycobacterium avium
RISLDRPAYVYPLFEQALRVATGES

SEQ ID NO: 91145 - protein, 17 aa, Mycobacterium avium
RITALSDLWFEAARRVG

SEQ ID NO: 91146 - protein, 21 aa, Mycobacterium avium
RITTLSDLWFQAARRAGFDVA

SEQ ID NO: 91147 - protein, 20 aa, Mycobacterium avium
RIVDRPEWIAAAAESMRVMM

SEQ ID NO: 91148 - protein, 25 aa, Mycobacterium avium
RIVLGRAGGGALGYGGMAPDVAVAS

SEQ ID NO: 91149 - protein, 24 aa, Mycobacterium avium
RKAARKHGVPVYAVAPFATRSLTK

SEQ ID NO: 91150 - protein, 19 aa, Mycobacterium avium
RKDGFVIVAECADGDEVPA

SEQ ID NO: 91151 - protein, 20 aa, Mycobacterium avium
RKEQLGWVALNGRRNAALNP

SEQ ID NO: 91152 - protein, 19 aa, Mycobacterium avium
RKGGHILCGVDGRVYGVDH

SEQ ID NO: 91153 - protein, 27 aa, Mycobacterium avium
RKGWVPRLAAMDVIASYCLTEPGAGSD

SEQ ID NO: 91154 - protein, 19 aa, Mycobacterium avium
RKHPAFFGGVTNLAWSVDK

SEQ ID NO: 91155 - protein, 19 aa, Mycobacterium avium
RKIPPAWLESGVVKAAMTW

SEQ ID NO: 91156 - protein, 19 aa, Mycobacterium avium
RKLDAMSANLARLTDLTTE

SEQ ID NO: 91157 - protein, 25 aa, Mycobacterium avium
RKLDRKATLAFAFSHRSYLDGMLLP

SEQ ID NO: 91158 - protein, 22 aa, Mycobacterium avium
RKLIGGTCVNTGCIPTKTLVAS

SEQ ID NO: 91159 - protein, 22 aa, Mycobacterium avium
RKNKLRGGDVFAPVFDPVQVEV

SEQ ID NO: 91160 - protein, 19 aa, Mycobacterium avium
RKPDLARRVNVGGTENLLA

SEQ ID NO: 91161 - protein, 21 aa, Mycobacterium avium
RKPRFGHGVVAELAPGVRLLG

SEQ ID NO: 91162 - protein, 18 aa, Mycobacterium avium
RKRGRRISVVDVELTQGE

SEQ ID NO: 91163 - protein, 18 aa, Mycobacterium avium
RKRVLTMRRTFRKHRRQL

SEQ ID NO: 91164 - protein, 36 aa, Mycobacterium avium; identical to SEQ ID NO: 17410

SEQ ID NO: 91165 - protein, 19 aa, Mycobacterium avium
RKVRFLPYGIAVSVLDDDP

SEQ ID NO: 91166 - protein, 23 aa, Mycobacterium avium
RKWAKTHPAELAALLASQAKVSQ

SEQ ID NO: 91167 - protein, 25 aa, Mycobacterium avium
RLAAAKTRLAPVFSARTRESVVLAM

SEQ ID NO: 91168 - protein, 17 aa, Mycobacterium avium
RLAAGLIDIGFEVHDSA

SEQ ID NO: 91169 - protein, 18 aa, Mycobacterium avium
RLAANVAQRVGAPLAALH

SEQ ID NO: 91170 - protein, 18 aa, Mycobacterium avium
RLADFDHIELSNLNRVPA

SEQ ID NO: 91171 - protein, 20 aa, Mycobacterium avium
RLADFIRCRDLTCRAPGCDR

SEQ ID NO: 91172 - protein, 17 aa, Mycobacterium avium
RLAHLLAGLGAGPGQSV

SEQ ID NO: 91173 - protein, 19 aa, Mycobacterium avium
RLAPHALEWDAAEHFPVDV

SEQ ID NO: 91174 - protein, 18 aa, Mycobacterium avium
RLASDWLGVDVNIAARVM

SEQ ID NO: 91175 - protein, 25 aa, Mycobacterium avium
RLCDWCPHQQLCPLFGGTPPPYPGW

SEQ ID NO: 91176 - protein, 21 aa, Mycobacterium avium
RLCPHAVVVPPRMHAYTRASD

SEQ ID NO: 91177 - protein, 22 aa, Mycobacterium avium
RLCRAEFLHYLRIREWQDLVGQ

SEQ ID NO: 91178 - protein, 19 aa, Mycobacterium avium
RLDDLPVLYELAAEEGEGA

SEQ ID NO: 91179 - protein, 18 aa, Mycobacterium avium
RLDGCGLPIIDIADPRID

SEQ ID NO: 91180 - protein, 18 aa, Mycobacterium avium
RLEGEPKPIAGVPSSWTV

SEQ ID NO: 91181 - protein, 19 aa, Mycobacterium avium
RLELCTLDPAYRAVFADGS

SEQ ID NO: 91182 - protein, 23 aa, Mycobacterium avium
RLEPYRRMWVLRLLDMALDESAV

SEQ ID NO: 91183 - protein, 18 aa, Mycobacterium avium
RLESPVQLTARMALNDVE

SEQ ID NO: 91184 - protein, 18 aa, Mycobacterium avium
RLETGWVNTDFVDDKLPE

SEQ ID NO: 91185 - protein, 21 aa, Mycobacterium avium
RLEVAVLLQEWLRRVPDYAIR

SEQ ID NO: 91186 - protein, 18 aa, Mycobacterium avium
RLFEAGYVGADWPVEFGG

SEQ ID NO: 91187 - protein, 25 aa, Mycobacterium avium
RLFIGECREGGRLLEFDLAGGPPRV

SEQ ID NO: 91188 - protein, 23 aa, Mycobacterium avium
RLGEMCGLAGVAMERATQALLQA

SEQ ID NO: 91189 - protein, 22 aa, Mycobacterium avium
RLGERLPAYMVPAAVLGLDAIP

SEQ ID NO: 91190 - protein, 23 aa, Mycobacterium avium
RLGHARLTRFLIRHSRGAWREPH

SEQ ID NO: 91191 - protein, 19 aa, Mycobacterium avium
RLGLEAAYCAETVAITYEE

SEQ ID NO: 91192 - protein, 18 aa, Mycobacterium avium
RLGLLPMYAVNQDKHGTA

SEQ ID NO: 91193 - protein, 20 aa, Mycobacterium avium
RLGPDSLIWKFYGDNRTQLF

SEQ ID NO: 91194 - protein, 21 aa, Mycobacterium avium
RLGQRLPAYMVPAAVVVLDAL

SEQ ID NO: 91195 - protein, 20 aa, Mycobacterium avium
RLGRIGDCEIALDNALTAAR

SEQ ID NO: 91196 - protein, 21 aa, Mycobacterium avium
RLGRRVTEIALVFKRAPHLPF

SEQ ID NO: 91197 - protein, 27 aa, Mycobacterium avium
RLGSRDAKARWLPPLVSGSMRATTALW

SEQ ID NO: 91198 - protein, 26 aa, Mycobacterium avium
RLGVEEELLRLGARPGCAVTIGDMTF

SEQ ID NO: 91199 - protein, 43 aa, Mycobacterium avium
RLGVTELQFRPEVSDGLFLRLAVTSVESLACAYAVVLAEAKHY

SEQ ID NO: 91200 - protein, 20 aa, Mycobacterium avium
RLHDEFDAWAKAYASPFDDL

SEQ ID NO: 91201 - protein, 18 aa, Mycobacterium avium
RLHGLGWTPGQHVRLQVE

SEQ ID NO: 91202 - protein, 26 aa, Mycobacterium avium
RLHNGTVYRWNRPVYDVADGRPHLRL

SEQ ID NO: 91203 - protein, 21 aa, Mycobacterium avium
RLHRRGVEVVEIIGDDAQDAR

SEQ ID NO: 91204 - protein, 23 aa, Mycobacterium avium
RLIELFLAHFAIRDWDAMAELLA

SEQ ID NO: 91205 - protein, 17 aa, Mycobacterium avium
RLIELIGGATMLRMLLR

SEQ ID NO: 91206 - protein, 18 aa, Mycobacterium avium
RLIVLGGDAELALVLTRL

SEQ ID NO: 91207 - protein, 19 aa, Mycobacterium avium
RLKDVAGLSLTKLFVGSEG

SEQ ID NO: 91208 - protein, 17 aa, Mycobacterium avium
RLLAAADAVVWSGGSTV

SEQ ID NO: 91209 - protein, 18 aa, Mycobacterium avium
RLLADCGRGEVIGSLARE

SEQ ID NO: 91210 - protein, 17 aa, Mycobacterium avium
RLLAGAEHEAEHGALPP

SEQ ID NO: 91211 - protein, 21 aa, Mycobacterium avium
RLLDCCQETDGAVAVVVTSVE

SEQ ID NO: 91212 - protein, 18 aa, Mycobacterium avium
RLLFAVLYDTGMRIGEAL

SEQ ID NO: 91213 - protein, 17 aa, Mycobacterium avium
RLLGGLHRLVLDGRAGS

SEQ ID NO: 91214 - protein, 19 aa, Mycobacterium avium
RLLLPAGLETTYRSSGNLL

SEQ ID NO: 91215 - protein, 25 aa, Mycobacterium avium
RLLPPKTMRALIGRICEQEGVVVDD

SEQ ID NO: 91216 - protein, 28 aa, Mycobacterium avium
RLLWPDRDYRPGLDILIAGCGTFQAAVY

SEQ ID NO: 91217 - protein, 19 aa, Mycobacterium avium
RLMHRITLMGDVPVNVHGE

SEQ ID NO: 91218 - protein, 17 aa, Mycobacterium avium
RLMQLPLALTVQACEAA

SEQ ID NO: 91219 - protein, 20 aa, Mycobacterium avium
RLPAELDAFLDAGAPPVYVG

SEQ ID NO: 91220 - protein, 18 aa, Mycobacterium avium
RLPAYMVPAAVVVLDSLP

SEQ ID NO: 91221 - protein, 20 aa, Mycobacterium avium
RLPDRTWPDKVIDRAPLWCA

SEQ ID NO: 91222 - protein, 20 aa, Mycobacterium avium
RLPGFPHWNAGMLSTVHKRP

SEQ ID NO: 91223 - protein, 20 aa, Mycobacterium avium
RLQERWKQIEAKAIEIKEKA

SEQ ID NO: 91224 - protein, 17 aa, Mycobacterium avium
RLQEVWMGRQIAEVKSK

SEQ ID NO: 91225 - protein, 17 aa, Mycobacterium avium
RLQFAHADLLVRSFGTL

SEQ ID NO: 91226 - protein, 20 aa, Mycobacterium avium
RLRAACALIADNLREPLTLR

SEQ ID NO: 91227 - protein, 25 aa, Mycobacterium avium
RLRDRVLLRFGLHRALRLGKPLQLH

SEQ ID NO: 91228 - protein, 18 aa, Mycobacterium avium
RLREMDARHGGSIIDAQI

SEQ ID NO: 91229 - protein, 19 aa, Mycobacterium avium
RLREMLGQALVGKKLSAAS

SEQ ID NO: 91230 - protein, 19 aa, Mycobacterium avium
RLRFSDVVRELGLTQATAH

SEQ ID NO: 91231 - protein, 21 aa, Mycobacterium avium
RLRLFHGRGGTVGRGGGPSYE

SEQ ID NO: 91232 - protein, 24 aa, Mycobacterium avium
RLRRARRRTAPLFGIYDAALTPTV

SEQ ID NO: 91233 - protein, 18 aa, Mycobacterium avium
RLRVEDDGAGGWNLQAPE

SEQ ID NO: 91234 - protein, 18 aa, Mycobacterium avium
RLSVRVLFEAPTIAQLAA

SEQ ID NO: 91235 - protein, 19 aa, Mycobacterium avium
RLTCVFVDHGLLRAGERAQ

SEQ ID NO: 91236 - protein, 26 aa, Mycobacterium avium
RLTSIALPRIRDFRGLSPKQFDGVGN

SEQ ID NO: 91237 - protein, 19 aa, Mycobacterium avium
RLTSLEVMDEAEHELLDAW

SEQ ID NO: 91238 - protein, 19 aa, Mycobacterium avium
RLTTLMTMVTLRSVTDVLE

SEQ ID NO: 91239 - protein, 20 aa, Mycobacterium avium
RLTTPLLRVRGALRPCDWDT

SEQ ID NO: 91240 - protein, 17 aa, Mycobacterium avium
RLTVYLCTRDCYATNAI

SEQ ID NO: 91241 - protein, 27 aa, Mycobacterium avium
RLVGFYEMVTRVSAVWANELFAEIPTP

SEQ ID NO: 91242 - protein, 20 aa, Mycobacterium avium
RLVGLTGITFTNVFNACATA

SEQ ID NO: 91243 - protein, 19 aa, Mycobacterium avium
RLVLGPGMRIQAPPNLVSR

SEQ ID NO: 91244 - protein, 18 aa, Mycobacterium avium
RLVTQVGYHCRFIGAFRE

SEQ ID NO: 91245 - protein, 19 aa, Mycobacterium avium
RLWEMSEEQWLTMLDVNLS

SEQ ID NO: 91246 - protein, 19 aa, Mycobacterium avium
RLWVPARAPLAAVWLPDAD

SEQ ID NO: 91247 - protein, 25 aa, Mycobacterium avium
RMAALFATLGSLAWSNVVRTQQFKE

SEQ ID NO: 91248 - protein, 23 aa, Mycobacterium avium
RMASGEIRATMALTEPGGGSDLQ

SEQ ID NO: 91249 - protein, 30 aa, Mycobacterium avium
RMEADWESAYLLSLRAAWQADNKIPNSKEA

SEQ ID NO: 91250 - protein, 21 aa, Mycobacterium avium
RMIAEPLCLYDFCQETDGAVA

SEQ ID NO: 91251 - protein, 21 aa, Mycobacterium avium
RMICDPYPRLLVARDQVNQGA

SEQ ID NO: 91252 - protein, 20 aa, Mycobacterium avium
RMMGAGLRRLVRLSIPSPAK

SEQ ID NO: 91253 - protein, 21 aa, Mycobacterium avium
RMRHGMYWSGDLAYRDADGWI

SEQ ID NO: 91254 - protein, 27 aa, Mycobacterium avium
RMRPGNWAGAYACWGTENREAAVRFIV

SEQ ID NO: 91255 - protein, 22 aa, Mycobacterium avium
RMRQEILAGIGGVRAIRAYTTI

SEQ ID NO: 91256 - protein, 17 aa, Mycobacterium avium
RMRRVAGVWMWDGDVAV

SEQ ID NO: 91257 - protein, 18 aa, Mycobacterium avium
RMSDQLSRLARRGSTKIA

SEQ ID NO: 91258 - protein, 18 aa, Mycobacterium avium
RMSKRAGTVITLDDLVEA

SEQ ID NO: 91259 - protein, 23 aa, Mycobacterium avium
RMTRPQGKFVIRDDAPYHVFAGE

SEQ ID NO: 91260 - protein, 19 aa, Mycobacterium avium
RMVFLKRPVAPYFVPVPEL

SEQ ID NO: 91261 - protein, 25 aa, Mycobacterium avium
RNGGLRFAPRADLATREEQITVAEV

SEQ ID NO: 91262 - protein, 17 aa, Mycobacterium avium
RNGRIHAITELVSGQTP

SEQ ID NO: 91263 - protein, 17 aa, Mycobacterium avium
RNGWWLVARTKIIDDAI

SEQ ID NO: 91264 - protein, 19 aa, Mycobacterium avium
RNHKGSTWVLSLSAGRLVA

SEQ ID NO: 91265 - protein, 20 aa, Mycobacterium avium
RNHMRDMLFLFKGAPSTSPF

SEQ ID NO: 91266 - protein, 18 aa, Mycobacterium avium
RNPHELMRAVEVSFIRDC

SEQ ID NO: 91267 - protein, 17 aa, Mycobacterium avium
RNVSRGLVDVSLYALAQ

SEQ ID NO: 91268 - protein, 23 aa, Mycobacterium avium
RNYREAYGLFAVNGILFNHESPR

SEQ ID NO: 91269 - protein, 21 aa, Mycobacterium avium
RPAFGDSYGGLAIAGGIAAAL

SEQ ID NO: 91270 - protein, 45 aa, Mycobacterium avium
RPAPDGGRTALPFNGLRVLDLTTFWAGPCCTHFMAMLGAEVIHVE

SEQ ID NO: 91271 - protein, 26 aa, Mycobacterium avium
RPAPRIVAGIPVCLCAPSQVDEAKER

SEQ ID NO: 91272 - protein, 18 aa, Mycobacterium avium
RPDRGLVRVGDRVLTDTA

SEQ ID NO: 91273 - protein, 20 aa, Mycobacterium avium
RPDTDVGLVLRVAAASASTG

SEQ ID NO: 91274 - protein, 24 aa, Mycobacterium avium
RPEDFRFLIRLARQQGTRLGRAYL

SEQ ID NO: 91275 - protein, 19 aa, Mycobacterium avium
RPEPVLDELIGFFVNTLVL

SEQ ID NO: 91276 - protein, 20 aa, Mycobacterium avium
RPEQLAALAGTLADCLNPDG

SEQ ID NO: 91277 - protein, 21 aa, Mycobacterium avium
RPEQLQAILAKIRRQHAEVFG

SEQ ID NO: 91278 - protein, 25 aa, Mycobacterium avium
RPETPAQAAARCAVQACLDAVAARC

SEQ ID NO: 91279 - protein, 24 aa, Mycobacterium avium
RPFGLYVHVPFCVTRCGYCDFNTY

SEQ ID NO: 91280 - protein, 19 aa, Mycobacterium avium
RPFLVKWILEVAAVLHRRR

SEQ ID NO: 91281 - protein, 24 aa, Mycobacterium avium
RPGAPRPGASPGNMPPRPGGVGGP

SEQ ID NO: 91282 - protein, 19 aa, Mycobacterium avium
RPGGGRPGGPGGRDGGGGN

SEQ ID NO: 91283 - protein, 20 aa, Mycobacterium avium
RPGGRLAVMVPTAGRLARYW

SEQ ID NO: 91284 - protein, 24 aa, Mycobacterium avium
RPGLPAVLLGPGPFVGRGRELDGL

SEQ ID NO: 91285 - protein, 22 aa, Mycobacterium avium
RPGPDYPFALITGRTIYHFHTR

SEQ ID NO: 91286 - protein, 17 aa, Mycobacterium avium
RPGQFGLVAANGGIMSK

SEQ ID NO: 91287 - protein, 19 aa, Mycobacterium avium
RPHHVKTTIKILGLVDKEI

SEQ ID NO: 91288 - protein, 19 aa, Mycobacterium avium
RPHLRLENRVLPAGPTVID

SEQ ID NO: 91289 - protein, 24 aa, Mycobacterium avium
RPIPRISYADAMARYGSDKPDLRF

SEQ ID NO: 91290 - protein, 24 aa, Mycobacterium avium
RPIVVRYCRARVGTVERGGLSADD

SEQ ID NO: 91291 - protein, 19 aa, Mycobacterium avium
RPKGVLWRQSDIYVSSMVG

SEQ ID NO: 91292 - protein, 19 aa, Mycobacterium avium
RPKLIEAFNEIRGYGVEFD

SEQ ID NO: 91293 - protein, 20 aa, Mycobacterium avium
RPLLELPWDIEESPSGMAVA

SEQ ID NO: 91294 - protein, 20 aa, Mycobacterium avium
RPLRAVPEGGYPDWEAVYSD

SEQ ID NO: 91295 - protein, 18 aa, Mycobacterium avium
RPLRTMHGVDEFCEVYYD

SEQ ID NO: 91296 - protein, 24 aa, Mycobacterium avium
RPLSCAIAAVSVGVVDGRIRVDLP

SEQ ID NO: 91297 - protein, 26 aa, Mycobacterium avium
RPLSEFCWPSWPHLAWGQERQSAQQQ

SEQ ID NO: 91298 - protein, 17 aa, Mycobacterium avium
RPLTEWLTAVADGIALL

SEQ ID NO: 91299 - protein, 18 aa, Mycobacterium avium
RPMVDAMFFGSSSNQYGS

SEQ ID NO: 91300 - protein, 33 aa, Mycobacterium avium
RPNLEFHSGATVHRLRIRGSRCTGVEYTTAEGR

SEQ ID NO: 91301 - protein, 25 aa, Mycobacterium avium
RPPAKTGAASARWLDPARLGITACE

SEQ ID NO: 91302 - protein, 22 aa, Mycobacterium avium
RPPPVEQIEAFAALPSPSNPLD

SEQ ID NO: 91303 - protein, 17 aa, Mycobacterium avium
RPPRASITPPAWPTLLQ

SEQ ID NO: 91304 - protein, 18 aa, Mycobacterium avium
RPPRETWESNPLYRQLDA

SEQ ID NO: 91305 - protein, 19 aa, Mycobacterium avium
RPPRMLVLLHLDGSVDRPA

SEQ ID NO: 91306 - protein, 19 aa, Mycobacterium avium
RPQDGAIITGWDYPSCEAI

SEQ ID NO: 91307 - protein, 18 aa, Mycobacterium avium
RPQHELDLGLPPYATPAE

SEQ ID NO: 91308 - protein, 20 aa, Mycobacterium avium
RPQTGIATWIIPSIVAYGTD

SEQ ID NO: 91309 - protein, 21 aa, Mycobacterium avium
RPQTLRKWGLDYESLRAVNER

SEQ ID NO: 91310 - protein, 24 aa, Mycobacterium avium
RPRDLKLRVISWGAAPAPDALLRE

SEQ ID NO: 91311 - protein, 20 aa, Mycobacterium avium
RPRGKTVWFTGLSGSGKSSV

SEQ ID NO: 91312 - protein, 19 aa, Mycobacterium avium
RPRQKVVVEVGGRRLEVSL

SEQ ID NO: 91313 - protein, 28 aa, Mycobacterium avium
RPRSLEIVSCPSCGRAQVDVYTLANEVS

SEQ ID NO: 91314 - protein, 17 aa, Mycobacterium avium
RPRVAVVGGGIAGLTAA

SEQ ID NO: 91315 - protein, 18 aa, Mycobacterium avium
RPSAVPGVRLPALADQVG

SEQ ID NO: 91316 - protein, 17 aa, Mycobacterium avium
RPSLAGWLAEPQPFKQP

SEQ ID NO: 91317 - protein, 19 aa, Mycobacterium avium
RPSPHWWFDPQDGGNLYGP

SEQ ID NO: 91318 - protein, 19 aa, Mycobacterium avium
RPTELRLTVRMISGPQSGP

SEQ ID NO: 91319 - protein, 19 aa, Mycobacterium avium
RPTPELLDIVSRDNRRVYD

SEQ ID NO: 91320 - protein, 20 aa, Mycobacterium avium
RPVDYRARRAALQALEHPKI

SEQ ID NO: 91321 - protein, 21 aa, Mycobacterium avium
RPVEWCKSGRVSACGSVVATM

SEQ ID NO: 91322 - protein, 20 aa, Mycobacterium avium
RPVIDAVAARAPRPYDAGNH

SEQ ID NO: 91323 - protein, 19 aa, Mycobacterium avium
RPVIPPAILESGVTYHTSD

SEQ ID NO: 91324 - protein, 22 aa, Mycobacterium avium
RPVLRDVEWRIAPGERTGIVGA

SEQ ID NO: 91325 - protein, 27 aa, Mycobacterium avium
RPVLREFPAKVPVGVGFAKRSGLVRDG

SEQ ID NO: 91326 - protein, 25 aa, Mycobacterium avium
RPVRMSARRFWVRYAAEAAGALTLD

SEQ ID NO: 91327 - protein, 20 aa, Mycobacterium avium
RPWLAGYLGPEVMDLNRRIK

SEQ ID NO: 91328 - protein, 20 aa, Mycobacterium avium
RPWLDEVGEWLAAHRDGGVA

SEQ ID NO: 91329 - protein, 17 aa, Mycobacterium avium
RPWRRAGSGEVRPGDLV

SEQ ID NO: 91330 - protein, 23 aa, Mycobacterium avium
RPYRGVEAAERLATRRNRLLGAG

SEQ ID NO: 91331 - protein, 17 aa, Mycobacterium avium
RQAEGLGILRGEVGTPE

SEQ ID NO: 91332 - protein, 20 aa, Mycobacterium avium
RQALEMHPQYVLENGVDFAH

SEQ ID NO: 91333 - protein, 18 aa, Mycobacterium avium
RQFTCKYHAWRYDLDGNL

SEQ ID NO: 91334 - protein, 19 aa, Mycobacterium avium
RQGIRVNALCPGPVNTPLL

SEQ ID NO: 91335 - protein, 19 aa, Mycobacterium avium
RQHSIAALGLQAEETAFAL

SEQ ID NO: 91336 - protein, 31 aa, Mycobacterium avium
RQHYRLVGWRNGVCGYRRFFSITSLAGLRQE

SEQ ID NO: 91337 - protein, 18 aa, Mycobacterium avium
RQKHGLLNADGWGAGFFD

SEQ ID NO: 91338 - protein, 20 aa, Mycobacterium avium
RQLEFARLLGTPIGHPAASA

SEQ ID NO: 91339 - protein, 24 aa, Mycobacterium avium
RQLGRLTPPLALVVDTLSQCEPLP

SEQ ID NO: 91340 - protein, 17 aa, Mycobacterium avium
RQLKPLGRQAEVARRAQ

SEQ ID NO: 91341 - protein, 23 aa, Mycobacterium avium
RQLLPGAVAKFVRGDVKIVQTET

SEQ ID NO: 91342 - protein, 19 aa, Mycobacterium avium
RQLMRAPIWIYRARGGAVF

SEQ ID NO: 91343 - protein, 17 aa, Mycobacterium avium
RQLSLPVPGLVLADVLG

SEQ ID NO: 91344 - protein, 17 aa, Mycobacterium avium
RQLWVYGRAGQPCRRCG

SEQ ID NO: 91345 - protein, 17 aa, Mycobacterium avium
RQMLGLAAAELYNFDLG

SEQ ID NO: 91346 - protein, 18 aa, Mycobacterium avium
RQNPWWWDVLRNGHSSPY

SEQ ID NO: 91347 - protein, 21 aa, Mycobacterium avium
RQPEAVQHWNVDKAGLDDLLD

SEQ ID NO: 91348 - protein, 27 aa, Mycobacterium avium
RQPHAKGTGAFGRFEVTNDLSAYTKAA

SEQ ID NO: 91349 - protein, 17 aa, Mycobacterium avium
RQPRVRRDLASALRSAA

SEQ ID NO: 91350 - protein, 25 aa, Mycobacterium avium
RQPVTRARVSAVRGVNVDAVMRTLL

SEQ ID NO: 91351 - protein, 32 aa, Mycobacterium avium
RQSGEWKDGEALFLRCNIWREAAENVAESLTR

SEQ ID NO: 91352 - protein, 22 aa, Mycobacterium avium
RQTELFRLLLPARFGGLEASFP

SEQ ID NO: 91353 - protein, 18 aa, Mycobacterium avium
RQVLDGFDTPTLVGPAGR

SEQ ID NO: 91354 - protein, 20 aa, Mycobacterium avium
RQVVRERLEVALGVVPVEGA

SEQ ID NO: 91355 - protein, 23 aa, Mycobacterium avium
RQYCIRCLDPLVGSSSFDIIAEL

SEQ ID NO: 91356 - protein, 20 aa, Mycobacterium avium
RRAAGRAIRVYADLVVSLVG

SEQ ID NO: 91357 - protein, 18 aa, Mycobacterium avium
RRAALMGYTGKWAIHPDQ

SEQ ID NO: 91358 - protein, 21 aa, Mycobacterium avium
RRADAEPALSIRVRDRGRLRY

SEQ ID NO: 91359 - protein, 26 aa, Mycobacterium avium
RRADRAGWLRYGLPASLGGRDGSNVD

SEQ ID NO: 91360 - protein, 17 aa, Mycobacterium avium
RRAGFGWIDDLNDAAAQ

SEQ ID NO: 91361 - protein, 24 aa, Mycobacterium avium
RRAGIDVAVCKPVQTGTDDGDDDL

SEQ ID NO: 91362 - protein, 19 aa, Mycobacterium avium
RRAIAAAVTAFGRIDVVVN

SEQ ID NO: 91363 - protein, 17 aa, Mycobacterium avium
RRAVACSTFDSMDAMAR

SEQ ID NO: 91364 - protein, 17 aa, Mycobacterium avium
RRAYPIGEAVTYHHTAA

SEQ ID NO: 91365 - protein, 32 aa, Mycobacterium avium
RRCGMVSPTVFWPIPRVYSGLVRIDRYPTSPW

SEQ ID NO: 91366 - protein, 19 aa, Mycobacterium avium
RRCIELLDRVEIDRPAQRL

SEQ ID NO: 91367 - protein, 20 aa, Mycobacterium avium
RRDLEELVRIESVWADPGRR

SEQ ID NO: 91368 - protein, 24 aa, Mycobacterium avium
RRDLPWRAPGVSAWQILVSEFMLQ

SEQ ID NO: 91369 - protein, 26 aa, Mycobacterium avium
RREICSRFIRQPGYRFVELPDPKRSD

SEQ ID NO: 91370 - protein, 19 aa, Mycobacterium avium
RRFDGVLLSPGPGTPERAG

SEQ ID NO: 91371 - protein, 17 aa, Mycobacterium avium
RRFGIDLVAASVRRAQE

SEQ ID NO: 91372 - protein, 17 aa, Mycobacterium avium
RRFQRGDSHFICVVAEG

SEQ ID NO: 91373 - protein, 20 aa, Mycobacterium avium
RRGIDAAAMAAVYDDFRAIN

SEQ ID NO: 91374 - protein, 20 aa, Mycobacterium avium
RRGKYLWLLLDGRDTALVVH

SEQ ID NO: 91375 - protein, 19 aa, Mycobacterium avium
RRHEAFAIGTFEELGGSNP

SEQ ID NO: 91376 - protein, 22 aa, Mycobacterium avium
RRHESSTAPGAWEAIAAARFRR

SEQ ID NO: 91377 - protein, 17 aa, Mycobacterium avium
RRHGKWLVLPTDGPTLL

SEQ ID NO: 91378 - protein, 17 aa, Mycobacterium avium
RRHGRLLAAHFGEDKGM

SEQ ID NO: 91379 - protein, 18 aa, Mycobacterium avium
RRIEELPRVLAHVHRELV

SEQ ID NO: 91380 - protein, 25 aa, Mycobacterium avium
RRILEAAGRCIVRRGNTQFRMGEVA

SEQ ID NO: 91381 - protein, 19 aa, Mycobacterium avium
RRINEGAAMIRSKGEAGTG

SEQ ID NO: 91382 - protein, 17 aa, Mycobacterium avium
RRIRVNVLSPGQVATPI

SEQ ID NO: 91383 - protein, 18 aa, Mycobacterium avium
RRKGIRIVAEAAIAQTAQ

SEQ ID NO: 91384 - protein, 23 aa, Mycobacterium avium
RRLASICTGSFILGQAGLLDGRR

SEQ ID NO: 91385 - protein, 19 aa, Mycobacterium avium
RRLDGHFTLVFANADEPGT

SEQ ID NO: 91386 - protein, 19 aa, Mycobacterium avium
RRLGTNWYDPSFRFLDEQA

SEQ ID NO: 91387 - protein, 17 aa, Mycobacterium avium
RRLLERTSWIDATDVGD

SEQ ID NO: 91388 - protein, 18 aa, Mycobacterium avium
RRLRMRLSALGVYTTDAH

SEQ ID NO: 91389 - protein, 25 aa, Mycobacterium avium
RRLTTPELLIFLAVIAGAGVETTGR

SEQ ID NO: 91390 - protein, 18 aa, Mycobacterium avium
RRLVTSCEHFHRQAVGIV

SEQ ID NO: 91391 - protein, 29 aa, Mycobacterium avium
RRMPQWSPQCRWMKPLGPVRQGTRTINLN

SEQ ID NO: 91392 - protein, 18 aa, Mycobacterium avium
RRNDVLFIADEVQTGFAR

SEQ ID NO: 91393 - protein, 17 aa, Mycobacterium avium
RRNGWKGFGPVPYSHEP

SEQ ID NO: 91394 - protein, 17 aa, Mycobacterium avium
RRNVALAGVDLEDVKAV

SEQ ID NO: 91395 - protein, 24 aa, Mycobacterium avium
RRPAEVRASIGMAGQFTGLDPMLT

SEQ ID NO: 91396 - protein, 20 aa, Mycobacterium avium
RRPAHEFRVVNAHLAHKLLP

SEQ ID NO: 91397 - protein, 18 aa, Mycobacterium avium
RRPAIVAGASSGIGEATA

SEQ ID NO: 91398 - protein, 21 aa, Mycobacterium avium
RRPPPEPNWYGASSNNYGSPQ

SEQ ID NO: 91399 - protein, 18 aa, Mycobacterium avium
RRQGPVKLDRIIAQLQQM

SEQ ID NO: 91400 - protein, 23 aa, Mycobacterium avium
RRRELPIVHVVRLYRADGSNADP

SEQ ID NO: 91401 - protein, 24 aa, Mycobacterium avium
RRRGDRWYWHWDPQFISGTAAFPP

SEQ ID NO: 91402 - protein, 25 aa, Mycobacterium avium
RRRTMLREYLEAMRALWTDEEASYD

SEQ ID NO: 91403 - protein, 17 aa, Mycobacterium avium
RRRWEAVMMHNYGTPPV

SEQ ID NO: 91404 - protein, 21 aa, Mycobacterium avium
RRSGFKQIHDRGGFLSGAATF

SEQ ID NO: 91405 - protein, 21 aa, Mycobacterium avium
RRTAEELGRAFAGTTVITSSG

SEQ ID NO: 91406 - protein, 29 aa, Mycobacterium avium
RRTQVRAVWRAVSAVDEIFARSGGNAARM

SEQ ID NO: 91407 - protein, 26 aa, Mycobacterium avium
RRTSAVKAFTAWAVRRGLLTADPAAR

SEQ ID NO: 91408 - protein, 18 aa, Mycobacterium avium
RRVAVLEQLWLHALWAGR

SEQ ID NO: 91409 - protein, 19 aa, Mycobacterium avium
RRVLPEAWIADTLAGGPDS

SEQ ID NO: 91410 - protein, 21 aa, Mycobacterium avium
RRYEIGKVIALTNPASGHGAA

SEQ ID NO: 91411 - protein, 27 aa, Mycobacterium avium
RRYLRRWHRRRPLWIGVAIGGTVDSAT

SEQ ID NO: 91412 - protein, 17 aa, Mycobacterium avium
RRYPAWPASQDASLRVP

SEQ ID NO: 91413 - protein, 21 aa, Mycobacterium avium
RSEAFPLVIVEAMARGVPVAA

SEQ ID NO: 91414 - protein, 20 aa, Mycobacterium avium
RSEFDHLLLTAHQRLKASDT

SEQ ID NO: 91415 - protein, 17 aa, Mycobacterium avium
RSEGCGILVLKRMSDAV

SEQ ID NO: 91416 - protein, 24 aa, Mycobacterium avium
RSEIDRAELARMFAGIDIHQAIPV

SEQ ID NO: 91417 - protein, 24 aa, Mycobacterium avium
RSGKHLRRLAALVTELGAVEVVVG

SEQ ID NO: 91418 - protein, 19 aa, Mycobacterium avium
RSGVKFSVVKPTFVNTELI

SEQ ID NO: 91419 - protein, 26 aa, Mycobacterium avium
RSGYPLELLVRAAAAGWRVVELDVRY

SEQ ID NO: 91420 - protein, 18 aa, Mycobacterium avium
RSHPLAAMLADLHRSAGF

SEQ ID NO: 91421 - protein, 30 aa, Mycobacterium avium
RSLGKEDWYQWPWRVHVGLWAAASASLLDG

SEQ ID NO: 91422 - protein, 25 aa, Mycobacterium avium
RSLNGRSGYRFGHIEGPMQVQHHDQ

SEQ ID NO: 91423 - protein, 21 aa, Mycobacterium avium
RSPYGAAKVFSYWTTRNYREA

SEQ ID NO: 91424 - protein, 20 aa, Mycobacterium avium
RSRLGLAQFAAPRPGRRIGL

SEQ ID NO: 91425 - protein, 17 aa, Mycobacterium avium
RSRYTWSDTGLDAGAVR

SEQ ID NO: 91426 - protein, 19 aa, Mycobacterium avium
RTAHGWRIARRRYTQVRLT

SEQ ID NO: 91427 - protein, 18 aa, Mycobacterium avium
RTAVLRWSSPSVFTRSPG

SEQ ID NO: 91428 - protein, 18 aa, Mycobacterium avium
RTEFDGFIAANFDSPLSL

SEQ ID NO: 91429 - protein, 17 aa, Mycobacterium avium
RTGERVCAVVVPATADG

SEQ ID NO: 91430 - protein, 19 aa, Mycobacterium avium
RTGFEDGLFASWRSDPSFV

SEQ ID NO: 91431 - protein, 21 aa, Mycobacterium avium
RTGSFSINGGNYFGADSPFGG

SEQ ID NO: 91432 - protein, 21 aa, Mycobacterium avium
RTGTYAINWYAFDPCCPFGGY

SEQ ID NO: 91433 - protein, 28 aa, Mycobacterium avium
RTGYTFACDRWRVVPDVYLLGKALGGGV

SEQ ID NO: 91434 - protein, 17 aa, Mycobacterium avium
RTHRTCVFGYRRRNDGP

SEQ ID NO: 91435 - protein, 21 aa, Mycobacterium avium
RTITFPGFLKAYVETVDELAG

SEQ ID NO: 91436 - protein, 19 aa, Mycobacterium avium
RTKNIRLGFGIMHLPPAVN

SEQ ID NO: 91437 - protein, 19 aa, Mycobacterium avium
RTLFLPPYVAHGFQTLVDD

SEQ ID NO: 91438 - protein, 17 aa, Mycobacterium avium
RTLIALVMQHLDNSITT

SEQ ID NO: 91439 - protein, 20 aa, Mycobacterium avium
RTLPEPLTYGLLRYLNTDVD

SEQ ID NO: 91440 - protein, 19 aa, Mycobacterium avium
RTLPLMRVALAWRGRLGKP

SEQ ID NO: 91441 - protein, 17 aa, Mycobacterium avium
RTLWHGPSSTAMAAAAA

SEQ ID NO: 91442 - protein, 19 aa, Mycobacterium avium
RTMAMLGVHACVAVTAVTV

SEQ ID NO: 91443 - protein, 26 aa, Mycobacterium avium
RTPHAVAVTCGRRSWTYRELDSSANR

SEQ ID NO: 91444 - protein, 17 aa, Mycobacterium avium
RTRPAQLVSPVRSQFSA

SEQ ID NO: 91445 - protein, 23 aa, Mycobacterium avium
RTSDLIPLCHQLALTGVDVDFAV

SEQ ID NO: 91446 - protein, 29 aa, Mycobacterium avium
RTVAGIHLEGPWLSRARCGAHDARRMRDP

SEQ ID NO: 91447 - protein, 18 aa, Mycobacterium avium
RTVALTVYGDLETSTLRE

SEQ ID NO: 91448 - protein, 28 aa, Mycobacterium avium
RTVANLRLGHLLGQAILRSARRHEAADQ

SEQ ID NO: 91449 - protein, 20 aa, Mycobacterium avium
RTVENWNRYVAAGVDPDFGR

SEQ ID NO: 91450 - protein, 20 aa, Mycobacterium avium
RTVIATGILNLWMHSPAEVA

SEQ ID NO: 91451 - protein, 28 aa, Mycobacterium avium
RTVLRLDPRLAPVKAAVLPLSRHADLSP

SEQ ID NO: 91452 - protein, 23 aa, Mycobacterium avium
RTVRLNHEFHRAINIAADSPKLA

SEQ ID NO: 91453 - protein, 20 aa, Mycobacterium avium
RTVRTGSWVRRDRRTYTAKH

SEQ ID NO: 91454 - protein, 19 aa, Mycobacterium avium
RTVVLERLVKFNGEQHVAL

SEQ ID NO: 91455 - protein, 20 aa, Mycobacterium avium
RTWAAPQWLQLGYELAGSDS

SEQ ID NO: 91456 - protein, 19 aa, Mycobacterium avium
RVAAFKVGPDFIDPGYHGL

SEQ ID NO: 91457 - protein, 23 aa, Mycobacterium avium
RVAELLETVGLRRADAARYPAEF

SEQ ID NO: 91458 - protein, 24 aa, Mycobacterium avium
RVAELLPQVFAWARSVDPCQPLTS

SEQ ID NO: 91459 - protein, 19 aa, Mycobacterium avium
RVAKQILDLAMRFGTDSGG

SEQ ID NO: 91460 - protein, 20 aa, Mycobacterium avium
RVAPHASWMFEYYPMRDVRE

SEQ ID NO: 91461 - protein, 22 aa, Mycobacterium avium
RVAQPLFDRVHRALGTEATVEA

SEQ ID NO: 91462 - protein, 23 aa, Mycobacterium avium
RVARLRFAGTVARGADVVGPHGR

SEQ ID NO: 91463 - protein, 22 aa, Mycobacterium avium
RVDEFYLFVCCHHIVADGIGLA

SEQ ID NO: 91464 - protein, 26 aa, Mycobacterium avium
RVDKAVREVEAWLAAEPFRAPEADEL

SEQ ID NO: 91465 - protein, 20 aa, Mycobacterium avium
RVEERRARLTKFQEDLPEQF

SEQ ID NO: 91466 - protein, 18 aa, Mycobacterium avium
RVFFCNSGTEANEVAFKL

SEQ ID NO: 91467 - protein, 19 aa, Mycobacterium avium
RVFPDSIVVFTHRDPVPVA

SEQ ID NO: 91468 - protein, 22 aa, Mycobacterium avium
RVGKPRFIAGVGNRIKVEVKTR

SEQ ID NO: 91469 - protein, 18 aa, Mycobacterium avium
RVGLRAGSNPEFVVALLA

SEQ ID NO: 91470 - protein, 17 aa, Mycobacterium avium
RVGRLLFSTQLADPVVV

SEQ ID NO: 91471 - protein, 25 aa, Mycobacterium avium
RVGSLRAGHEANLVVLDDDWRVRAV

SEQ ID NO: 91472 - protein, 20 aa, Mycobacterium avium
RVGTALGVALERADHVVVAC

SEQ ID NO: 91473 - protein, 17 aa, Mycobacterium avium
RVGVRMLLHDEGNADKA

SEQ ID NO: 91474 - protein, 24 aa, Mycobacterium avium
RVHARTGLPCPVCGDTVREVSFAD

SEQ ID NO: 91475 - protein, 17 aa, Mycobacterium avium
RVIEPLDIDAYRDFLIE

SEQ ID NO: 91476 - protein, 19 aa, Mycobacterium avium
RVLGEAVALLRDMLNPDEL

SEQ ID NO: 91477 - protein, 20 aa, Mycobacterium avium
RVLKRLQPRLYSISSSPKAC

SEQ ID NO: 91478 - protein, 18 aa, Mycobacterium avium
RVLKTAASLREPHRVCRY

SEQ ID NO: 91479 - protein, 25 aa, Mycobacterium avium
RVLPIWPDWVRRWPTPSATAAASAA

SEQ ID NO: 91480 - protein, 24 aa, Mycobacterium avium
RVNPGGRLPITFPVDLHQTPRPQL

SEQ ID NO: 91481 - protein, 19 aa, Mycobacterium avium
RVPDRKGFGSLRLSDYPLI

SEQ ID NO: 91482 - protein, 24 aa, Mycobacterium avium
RVPGADAFRSWRVLVSKYGTPAPG

SEQ ID NO: 91483 - protein, 24 aa, Mycobacterium avium
RVPQPGRLELVLAHPSGITEIEVG

SEQ ID NO: 91484 - protein, 18 aa, Mycobacterium avium
RVQFELTGPLARVIRVSV

SEQ ID NO: 91485 - protein, 17 aa, Mycobacterium avium
RVQPVLEKRREMAYEGK

SEQ ID NO: 91486 - protein, 17 aa, Mycobacterium avium
RVQRWLDAMPQYGPGHA

SEQ ID NO: 91487 - protein, 18 aa, Mycobacterium avium
RVRFTSPHPAEFTDDVIE

SEQ ID NO: 91488 - protein, 20 aa, Mycobacterium avium
RVSLAHALIGWTRGTGLMGH

SEQ ID NO: 91489 - protein, 19 aa, Mycobacterium avium
RVSRDLAVVRLRLDQPMPY

SEQ ID NO: 91490 - protein, 21 aa, Mycobacterium avium
RVTAMPVRLVDGGAGGMRIIG

SEQ ID NO: 91491 - protein, 18 aa, Mycobacterium avium
RVTQPYIDRLEKWCDTYN

SEQ ID NO: 91492 - protein, 17 aa, Mycobacterium avium
RVTRLARDFPLYEGLED

SEQ ID NO: 91493 - protein, 20 aa, Mycobacterium avium
RVTRRLGDTITFVIHIPLSI

SEQ ID NO: 91494 - protein, 29 aa, Mycobacterium avium
RVVAVDLRDDWPAALRAAGFDPTRPTAWS

SEQ ID NO: 91495 - protein, 33 aa, Mycobacterium avium
RVVEFMLLYRLFPRSVFYSLRLAEHNLDELMHN

SEQ ID NO: 91496 - protein, 19 aa, Mycobacterium avium
RVVGDTGWQLLDSKFAVVA

SEQ ID NO: 91497 - protein, 26 aa, Mycobacterium avium
RVVGRGRPADRPALLGAVKTNVGHLE

SEQ ID NO: 91498 - protein, 17 aa, Mycobacterium avium
RVVLADRARREAAAAQS

SEQ ID NO: 91499 - protein, 24 aa, Mycobacterium avium
RVVLSVPVSGTWVEIPFTLPPNTI

SEQ ID NO: 91500 - protein, 20 aa, Mycobacterium avium
RVVSPDAFFQFPTSKYGLAL

SEQ ID NO: 91501 - protein, 18 aa, Mycobacterium avium
RVVVLCRPHNPTGTVEPA

SEQ ID NO: 91502 - protein, 24 aa, Mycobacterium avium
RVVVPDFQLSLAIGKEGQNARLAA

SEQ ID NO: 91503 - protein, 26 aa, Mycobacterium avium
RVYRHGWSIGDTVIWDNRGVLHRAAP

SEQ ID NO: 91504 - protein, 18 aa, Mycobacterium avium
RWAKPIVLHSSWARQGDP

SEQ ID NO: 91505 - protein, 21 aa, Mycobacterium avium
RWIDFLRRWDPAGWPSPRATS

SEQ ID NO: 91506 - protein, 24 aa, Mycobacterium avium
RWISAWQLPLEWLQIPRGGVALDV

SEQ ID NO: 91507 - protein, 29 aa, Mycobacterium avium
RWLAMSGSSPALALRVFRAIGRDDLLGDP

SEQ ID NO: 91508 - protein, 19 aa, Mycobacterium avium
RWLAPAAKRLAPRRFWRRK

SEQ ID NO: 91509 - protein, 18 aa, Mycobacterium avium
RWPAAGVDLTGKRVGVIG

SEQ ID NO: 91510 - protein, 18 aa, Mycobacterium avium
RWSWAPGDVAMWDNRATQ

SEQ ID NO: 91511 - protein, 25 aa, Mycobacterium avium
RYANLLEHLASWGIVAAAPDTQRGL

SEQ ID NO: 91512 - protein, 20 aa, Mycobacterium avium
RYDGRRAVVTGCASGIGEQV

SEQ ID NO: 91513 - protein, 17 aa, Mycobacterium avium
RYDWSVVASQIMRVYET

SEQ ID NO: 91514 - protein, 25 aa, Mycobacterium avium
RYEVDWAGCRRVTMQNVAGWKNVPV

SEQ ID NO: 91515 - protein, 17 aa, Mycobacterium avium
RYFREARLMKIAPVSQE

SEQ ID NO: 91516 - protein, 18 aa, Mycobacterium avium
RYGYDYVTGCVSVPIGDA

SEQ ID NO: 91517 - protein, 26 aa, Mycobacterium avium
RYILELEPFASLPPEQIAATIAPNLQ

SEQ ID NO: 91518 - protein, 25 aa, Mycobacterium avium
RYKEWLTIHRVWRSTLPDQIDKGTV

SEQ ID NO: 91519 - protein, 22 aa, Mycobacterium avium
RYLPDRHRITCPTLGLDITGEP

SEQ ID NO: 91520 - protein, 18 aa, Mycobacterium avium
RYLWPDVTLVGGPAGAPV

SEQ ID NO: 91521 - protein, 27 aa, Mycobacterium avium
RYLYPRVEVEVGFILNADLPGAGCTED

SEQ ID NO: 91522 - protein, 24 aa, Mycobacterium avium
RYQRARGKGGLVRITWAEATELIA

SEQ ID NO: 91523 - protein, 18 aa, Mycobacterium avium
RYRYDVVIHKAPAPVRSV

SEQ ID NO: 91524 - protein, 17 aa, Mycobacterium avium
RYSGIGFGLHNDIVAPY

SEQ ID NO: 91525 - protein, 25 aa, Mycobacterium avium
RYVAAHAPYLAWLERASANSAAVAA

SEQ ID NO: 91526 - protein, 17 aa, Mycobacterium avium
RYVAAWNAAFLPSKDLT

SEQ ID NO: 91527 - protein, 19 aa, Mycobacterium avium
SAAACRRVAVAAHDGLARS

SEQ ID NO: 91528 - protein, 20 aa, Mycobacterium avium
SAAALVGRLRGVVCAPDGAV

SEQ ID NO: 91529 - protein, 17 aa, Mycobacterium avium
SAAEMRQIWDAEVPGAC

SEQ ID NO: 91530 - protein, 18 aa, Mycobacterium avium
SAALRAPVVSLELVDPRF

SEQ ID NO: 91531 - protein, 25 aa, Mycobacterium avium
SAALRHKVPVFAMAWALVHLAGAGQ

SEQ ID NO: 91532 - protein, 25 aa, Mycobacterium avium
SAAPDRSLDWLVTKFAREVPGVAHA

SEQ ID NO: 91533 - protein, 24 aa, Mycobacterium avium
SAARKPTAAAWIVNRLALRHKDAR

SEQ ID NO: 91534 - protein, 25 aa, Mycobacterium avium
SAAYLKATFDWHIDGCTPLGDECPQ

SEQ ID NO: 91535 - protein, 28 aa, Mycobacterium avium
SADARGRFPGRYRMAVLENLSRVSSRLR

SEQ ID NO: 91536 - protein, 25 aa, Mycobacterium avium
SADAVRGALMGGYFAGLLNRSVLQT

SEQ ID NO: 91537 - protein, 17 aa, Mycobacterium avium
SADDYRGWIDGIASGVG

SEQ ID NO: 91538 - protein, 26 aa, Mycobacterium avium
SADPLRAGMRLGLIPTVAPYVLPTVL

SEQ ID NO: 91539 - protein, 24 aa, Mycobacterium avium
SAEADPRVLPGLVAASQQAAASAP

SEQ ID NO: 91540 - protein, 19 aa, Mycobacterium avium
SAEDFPRSEHLAWKIAEVA

SEQ ID NO: 91541 - protein, 27 aa, Mycobacterium avium
SAEGRVAALRRCVPMVAQIKDPTLRDE

SEQ ID NO: 91542 - protein, 23 aa, Mycobacterium avium
SAELFAAEVMPHFQGQAQPTLDA

SEQ ID NO: 91543 - protein, 21 aa, Mycobacterium avium
SAEYYWFTTCHHIAIDGMGIA

SEQ ID NO: 91544 - protein, 19 aa, Mycobacterium avium
SAGEAFGRAAEPWEVAATI

SEQ ID NO: 91545 - protein, 29 aa, Mycobacterium avium
SAGPLRYAGWSSCFRREAGSYGKDTRGVI

SEQ ID NO: 91546 - protein, 20 aa, Mycobacterium avium
SAGPPCFLDPELRHLNDDHG

SEQ ID NO: 91547 - protein, 17 aa, Mycobacterium avium
SAIRRSFDLVGFDPRGV

SEQ ID NO: 91548 - protein, 17 aa, Mycobacterium avium
SAKRFGLEESRYEGPTG

SEQ ID NO: 91549 - protein, 24 aa, Mycobacterium avium
SALDPELWTWVAVSGLNLLYQAYL

SEQ ID NO: 91550 - protein, 18 aa, Mycobacterium avium
SALDPRWTVRQILDGPLR

SEQ ID NO: 91551 - protein, 19 aa, Mycobacterium avium
SALLSCAIPTGYGSAANRA

SEQ ID NO: 91552 - protein, 24 aa, Mycobacterium avium
SANGITFHRGRLFIGECREGGRLL

SEQ ID NO: 91553 - protein, 17 aa, Mycobacterium avium
SAPAAAVAESFHRIESG

SEQ ID NO: 91554 - protein, 29 aa, Mycobacterium avium
SAPIGSPVPRAALFVLDRWLRPAPPGVVG

SEQ ID NO: 91555 - protein, 21 aa, Mycobacterium avium
SAPQTRVEFMLGDAEPIAAVT

SEQ ID NO: 91556 - protein, 17 aa, Mycobacterium avium
SARDEWLHRRFGDLVRI

SEQ ID NO: 91557 - protein, 22 aa, Mycobacterium avium
SARRRFRRLPAVEVPDAVRRGA

SEQ ID NO: 91558 - protein, 22 aa, Mycobacterium avium
SARSEWAPELALHEFGSAEEVL

SEQ ID NO: 91559 - protein, 20 aa, Mycobacterium avium
SARVAVLVADESGMSTVEYA

SEQ ID NO: 91560 - protein, 24 aa, Mycobacterium avium
SASMASAVAPYVGWMSTTAAQAEE

SEQ ID NO: 91561 - protein, 20 aa, Mycobacterium avium
SASNRPAIYVATYFGDPGAS

SEQ ID NO: 91562 - protein, 26 aa, Mycobacterium avium
SATIALPFDIAGALTGFHTDDIVSGW

SEQ ID NO: 91563 - protein, 17 aa, Mycobacterium avium
SAVAALGIREWDAVSLI

SEQ ID NO: 91564 - protein, 26 aa, Mycobacterium avium
SAVAAWRGFSRWLMRAYDVLIDEDQI

SEQ ID NO: 91565 - protein, 20 aa, Mycobacterium avium
SAVATRLTPFGAPPQTADAN

SEQ ID NO: 91566 - protein, 25 aa, Mycobacterium avium
SAVEEILRIASPVQMTARTPACDVD

SEQ ID NO: 91567 - protein, 21 aa, Mycobacterium avium
SAVLRRLRRYRDAGATDLAAR

SEQ ID NO: 91568 - protein, 18 aa, Mycobacterium avium
SAVPNMLNNLAVSPNALG

SEQ ID NO: 91569 - protein, 22 aa, Mycobacterium avium
SCDCRKPGPGMLLRAAAEHDVD

SEQ ID NO: 91570 - protein, 17 aa, Mycobacterium avium
SCIYPKYAPQPIHESAL

SEQ ID NO: 91571 - protein, 20 aa, Mycobacterium avium
SCNPIMAAAMFLARTSTLIA

SEQ ID NO: 91572 - protein, 22 aa, Mycobacterium avium
SCRYMKMITPAALLRCLVEGAD

SEQ ID NO: 91573 - protein, 26 aa, Mycobacterium avium
SCVKVKGFRNVIHWTVTRYDQPKSIE

SEQ ID NO: 91574 - protein, 17 aa, Mycobacterium avium
SDAVLWLASDLARTVTG

SEQ ID NO: 91575 - protein, 19 aa, Mycobacterium avium
SDAWQGPSAERYVAAHAPY

SEQ ID NO: 91576 - protein, 18 aa, Mycobacterium avium
SDAYLARTGSRPQALLLP

SEQ ID NO: 91577 - protein, 22 aa, Mycobacterium avium
SDDEWRARIALRQQQIAARMLG

SEQ ID NO: 91578 - protein, 23 aa, Mycobacterium avium
SDDTAHYLWAWTDRAAGALRSRM

SEQ ID NO: 91579 - protein, 22 aa, Mycobacterium avium
SDFPTRHPYGLALWQNHIERIL

SEQ ID NO: 91580 - protein, 27 aa, Mycobacterium avium
SDGCGCRKPRPGLILAAAEALGVPARR

SEQ ID NO: 91581 - protein, 32 aa, Mycobacterium avium
SDGPPDWPARKLPSMRVAAALPPPIDYRDRIC

SEQ ID NO: 91582 - protein, 26 aa, Mycobacterium avium
SDISRAQLAAGLAYHCPLTYRPVLAK

SEQ ID NO: 91583 - protein, 25 aa, Mycobacterium avium
SDLANRPAFRAALIRTADNRHRFVL

SEQ ID NO: 91584 - protein, 21 aa, Mycobacterium avium
SDLFYSIWWPRVPGDTADVPE

SEQ ID NO: 91585 - protein, 31 aa, Mycobacterium avium
SDLLVAECLRTGAWSGLKPAELAAVVSSVLY

SEQ ID NO: 91586 - protein, 18 aa, Mycobacterium avium
SDLPAFRGARGRLPGDDG

SEQ ID NO: 91587 - protein, 19 aa, Mycobacterium avium
SDLPGFVLHVEICEDMFVP

SEQ ID NO: 91588 - protein, 22 aa, Mycobacterium avium
SDLRGRFRWMGLYTQREQGYDG

SEQ ID NO: 91589 - protein, 18 aa, Mycobacterium avium
SDRLRLEAYRRLAAAGSD

SEQ ID NO: 91590 - protein, 28 aa, Mycobacterium avium
SDSFQGRSSVGTWLFGIVKHTAARHRRR

SEQ ID NO: 91591 - protein, 25 aa, Mycobacterium avium
SDSPLWPVRSAVIICGGGEIQQNEY

SEQ ID NO: 91592 - protein, 24 aa, Mycobacterium avium
SDWLPQQRWYAGRNRRLTGAEPSV

SEQ ID NO: 91593 - protein, 33 aa, Mycobacterium avium
SEAISGMNAVGGWRGAPRPVLARELLPERALMG

SEQ ID NO: 91594 - protein, 27 aa, Mycobacterium avium
SEAVMLGGLAMKWRWRAKTKDWKKRTP

SEQ ID NO: 91595 - protein, 23 aa, Mycobacterium avium
SEFPTDRGWDLAGVYNPDPDVPG

SEQ ID NO: 91596 - protein, 23 aa, Mycobacterium avium
SEFPWCAQAADLLRSRFGGRLDV

SEQ ID NO: 91597 - protein, 23 aa, Mycobacterium avium
SEGAMGPAGFLIADDGEIGMRNQ

SEQ ID NO: 91598 - protein, 23 aa, Mycobacterium avium
SEGNYRCRVGHAWTAEALLSARD

SEQ ID NO: 91599 - protein, 22 aa, Mycobacterium avium
SEITCSFLFACTGYYNYDEGYS

SEQ ID NO: 91600 - protein, 20 aa, Mycobacterium avium
SEIVFEFPVSRRVRPEAQTV

SEQ ID NO: 91601 - protein, 23 aa, Mycobacterium avium
SELHPDSAVVLVFINQTATSKQK

SEQ ID NO: 91602 - protein, 20 aa, Mycobacterium avium
SELLPELTLAQKWDLTATEL

SEQ ID NO: 91603 - protein, 23 aa, Mycobacterium avium
SELRSVWSGFMQKWIDQTAAMIT

SEQ ID NO: 91604 - protein, 21 aa, Mycobacterium avium
SELSAAPSFPVRVPGGTPIPV

SEQ ID NO: 91605 - protein, 22 aa, Mycobacterium avium
SELTSADWFGPSSMSMLAAVTP

SEQ ID NO: 91606 - protein, 18 aa, Mycobacterium avium
SELVDAFAKFEATVDAAA

SEQ ID NO: 91607 - protein, 23 aa, Mycobacterium avium
SEMAFDPRFRPMVEQLRGQLTVR

SEQ ID NO: 91608 - protein, 22 aa, Mycobacterium avium
SEMEMKVLLWAVQRLIGGLSKI

SEQ ID NO: 91609 - protein, 18 aa, Mycobacterium avium
SEMLRYFTDVGINLDSRL

SEQ ID NO: 91610 - protein, 19 aa, Mycobacterium avium
SEPGYRFAPASEREPYESS

SEQ ID NO: 91611 - protein, 25 aa, Mycobacterium avium
SEPLTEAIPLWKRPQDGAIITGWDY

SEQ ID NO: 91612 - protein, 17 aa, Mycobacterium avium
SEVARWIDEEGLSLDVC

SEQ ID NO: 91613 - protein, 17 aa, Mycobacterium avium
SEVELLRDQRIVGEKEN

SEQ ID NO: 91614 - protein, 19 aa, Mycobacterium avium
SEVKANWKLYMDAFQEFYH

SEQ ID NO: 91615 - protein, 25 aa, Mycobacterium avium
SFIPACGSCRFCVNGQSYICDVGAS

SEQ ID NO: 91616 - protein, 25 aa, Mycobacterium avium
SFPRCAAGLREGRFSLDQLGVIAQR

SEQ ID NO: 91617 - protein, 19 aa, Mycobacterium avium
SFVRNPRDGFLQPAHPYRM

SEQ ID NO: 91618 - protein, 17 aa, Mycobacterium avium
SGASRLTVQIGVADMFT

SEQ ID NO: 91619 - protein, 22 aa, Mycobacterium avium
SGDACRIPWATGDTETSDPAAN

SEQ ID NO: 91620 - protein, 27 aa, Mycobacterium avium
SGECSIEPWIFMNWRRAAYYLYLAEVI

SEQ ID NO: 91621 - protein, 19 aa, Mycobacterium avium
SGEYAMICAAAANNWIDER

SEQ ID NO: 91622 - protein, 26 aa, Mycobacterium avium
SGGAKPGWPGFVSTPLHAYRRHFDIA

SEQ ID NO: 91623 - protein, 25 aa, Mycobacterium avium
SGGFLLTFLACFDVGDRVAVASPGY

SEQ ID NO: 91624 - protein, 27 aa, Mycobacterium avium
SGGMIRRLEVAQALVNRPSLLVLDEPT

SEQ ID NO: 91625 - protein, 24 aa, Mycobacterium avium
SGGRGVGSAENFKVVEELADALGA

SEQ ID NO: 91626 - protein, 17 aa, Mycobacterium avium
SGGRLSVGIGVGGRQED

SEQ ID NO: 91627 - protein, 24 aa, Mycobacterium avium
SGGRMMVTFGVGWLAREFELLGVP

SEQ ID NO: 91628 - protein, 19 aa, Mycobacterium avium
SGGRPAALYRFTDAALRVT

SEQ ID NO: 91629 - protein, 17 aa, Mycobacterium avium
SGHLAAALREWRGPVLD

SEQ ID NO: 91630 - protein, 20 aa, Mycobacterium avium
SGIECFQVNPLIKDYNGPAC

SEQ ID NO: 91631 - protein, 20 aa, Mycobacterium avium
SGKLARRACRAQYLDGSLGA

SEQ ID NO: 91632 - protein, 26 aa, Mycobacterium avium
SGLLRYGHIPGALALAERLATGLLDA

SEQ ID NO: 91633 - protein, 26 aa, Mycobacterium avium
SGLPPLSGGMVGFFAYDLVRRLERLP

SEQ ID NO: 91634 - protein, 24 aa, Mycobacterium avium
SGLSRKRFAALFRCEVGLSPKAYL

SEQ ID NO: 91635 - protein, 19 aa, Mycobacterium avium
SGLVPQISLIFGKCAGGAV

SEQ ID NO: 91636 - protein, 18 aa, Mycobacterium avium
SGMPRLYREAPLMGIWEG

SEQ ID NO: 91637 - protein, 18 aa, Mycobacterium avium
SGMSCGHCEAAVHSEVAR

SEQ ID NO: 91638 - protein, 24 aa, Mycobacterium avium
SGPGDWRRAEIPARSAQFGNPLLA

SEQ ID NO: 91639 - protein, 20 aa, Mycobacterium avium
SGPQSGPGQWTFFSRDDNGQ

SEQ ID NO: 91640 - protein, 24 aa, Mycobacterium avium
SGRRWRVPVTAFWQAHRDAAATYR

SEQ ID NO: 91641 - protein, 20 aa, Mycobacterium avium
SGSSRDWAAKGTRLLGVRAV

SEQ ID NO: 91642 - protein, 24 aa, Mycobacterium avium
SGSVPQRLWAKPAITVIGIDATPI

SEQ ID NO: 91643 - protein, 18 aa, Mycobacterium avium
SGVFERFPGLRWGVTECG

SEQ ID NO: 91644 - protein, 18 aa, Mycobacterium avium
SGVGVCRTVRVASGPVAG

SEQ ID NO: 91645 - protein, 20 aa, Mycobacterium avium
SGVRFRNRFVRTRHYLRSTA

SEQ ID NO: 91646 - protein, 19 aa, Mycobacterium avium
SGVTLDRRRMLELAGKFAA

SEQ ID NO: 91647 - protein, 17 aa, Mycobacterium avium
SHAELRPFPGRPSRPTD

SEQ ID NO: 91648 - protein, 19 aa, Mycobacterium avium
SHDARFVLIGTMNPEEGEL

SEQ ID NO: 91649 - protein, 19 aa, Mycobacterium avium
SHIAWYTVLACFKLGIVIE

SEQ ID NO: 91650 - protein, 18 aa, Mycobacterium avium
SHLHIEIVPGLAPTNAVP

SEQ ID NO: 91651 - protein, 26 aa, Mycobacterium avium
SHPDLEILNHGLTLWDLDRVFKVNGF

SEQ ID NO: 91652 - protein, 21 aa, Mycobacterium avium
SHTRRPWAIRSLRPTAPNTLQ

SEQ ID NO: 91653 - protein, 17 aa, Mycobacterium avium
SHTWFVLYELLGHRNVK

SEQ ID NO: 91654 - protein, 18 aa, Mycobacterium avium
SIFPPVWNFQLALHTRGY

SEQ ID NO: 91655 - protein, 18 aa, Mycobacterium avium
SIRDARVVKIEAIADPAA

SEQ ID NO: 91656 - protein, 30 aa, Mycobacterium avium
SIYAGVPITFGRPVWRVDLFGSTESPPGTL

SEQ ID NO: 91657 - protein, 17 aa, Mycobacterium avium
SKELAHDATMRFTHELR

SEQ ID NO: 91658 - protein, 17 aa, Mycobacterium avium
SKGYGLNNCKPQELTES

SEQ ID NO: 91659 - protein, 24 aa, Mycobacterium avium
SKLNRRPRQTLDWKTPAEALDELL

SEQ ID NO: 91660 - protein, 24 aa, Mycobacterium avium
SKLPKVFFVNWFRRGDDGGFLWPG

SEQ ID NO: 91661 - protein, 26 aa, Mycobacterium avium
SKSALVAAVYLRFLRDLPVHTDVNET

SEQ ID NO: 91662 - protein, 27 aa, Mycobacterium avium
SKTEALRCLKRRLARVVFHHLHTDHQN

SEQ ID NO: 91663 - protein, 29 aa, Mycobacterium avium
SKVGIIAGCMITSGVVRRNAKARLLRDNV

SEQ ID NO: 91664 - protein, 18 aa, Mycobacterium avium
SLAAELNAAALSYDKVVT

SEQ ID NO: 91665 - protein, 25 aa, Mycobacterium avium
SLAGLARAIADIAARARSGNLKPDE

SEQ ID NO: 91666 - protein, 25 aa, Mycobacterium avium
SLALSLRLAAYELLRADESDPVLLL

SEQ ID NO: 91667 - protein, 25 aa, Mycobacterium avium
SLCNLWRLPQSLVMNTELLDQTEMG

SEQ ID NO: 91668 - protein, 20 aa, Mycobacterium avium
SLEGAILLARAHRSTRPLRE

SEQ ID NO: 91669 - protein, 18 aa, Mycobacterium avium
SLFRPRGNLSQALDAALS

SEQ ID NO: 91670 - protein, 19 aa, Mycobacterium avium
SLFSWLATAEDGGWDGVAG

SEQ ID NO: 91671 - protein, 26 aa, Mycobacterium avium
SLIERLPHLRLLTIVGRQLPNLDMAA

SEQ ID NO: 91672 - protein, 25 aa, Mycobacterium avium
SLLVEIPGLLAWRIDLRATVATRLM

SEQ ID NO: 91673 - protein, 18 aa, Mycobacterium avium
SLMRRVRHRMDQAGYTAF

SEQ ID NO: 91674 - protein, 22 aa, Mycobacterium avium
SLNDIRWLYELMHRVGSLNHAR

SEQ ID NO: 91675 - protein, 20 aa, Mycobacterium avium
SLPGTGVWSQCHSYGFDVSV

SEQ ID NO: 91676 - protein, 17 aa, Mycobacterium avium
SLPTVQSLIRWDPVGHA

SEQ ID NO: 91677 - protein, 18 aa, Mycobacterium avium
SLQLWVMMETPRAFLRAE

SEQ ID NO: 91678 - protein, 26 aa, Mycobacterium avium
SLRDPEFAAGFARLYNRWIADYCAQS

SEQ ID NO: 91679 - protein, 20 aa, Mycobacterium avium
SLRGEAVGVYVGFSNNDYQF

SEQ ID NO: 91680 - protein, 23 aa, Mycobacterium avium
SLRRFLLEETYELLDAVAGGNAE

SEQ ID NO: 91681 - protein, 37 aa, Mycobacterium avium
SLSAVPFDLARLGEWATRITSFPADWSNVGFDAETRA

SEQ ID NO: 91682 - protein, 24 aa, Mycobacterium avium
SLSDLQPGDVLTFYSDASHAGIYI

SEQ ID NO: 91683 - protein, 18 aa, Mycobacterium avium
SLTKCLATAVAVMQLYEQ

SEQ ID NO: 91684 - protein, 17 aa, Mycobacterium avium
SLVATKLVTAIRAECGV

SEQ ID NO: 91685 - protein, 20 aa, Mycobacterium avium
SLYVYARETVGYALVIGGRV

SEQ ID NO: 91686 - protein, 23 aa, Mycobacterium avium
SMADEITELFGPGLAEITVIRNG

SEQ ID NO: 91687 - protein, 18 aa, Mycobacterium avium
SMARAMILSIRHADVRDR

SEQ ID NO: 91688 - protein, 19 aa, Mycobacterium avium
SMLAAVTPYLTWLTDTATR

SEQ ID NO: 91689 - protein, 24 aa, Mycobacterium avium
SMLSELLRAGWLLRDPVRKTYHLG

SEQ ID NO: 91690 - protein, 22 aa, Mycobacterium avium
SMPVELREGYQRSIVQAAAPGA

SEQ ID NO: 91691 - protein, 21 aa, Mycobacterium avium
SMRIGEHRVLVLVGRIHAYEG

SEQ ID NO: 91692 - protein, 26 aa, Mycobacterium avium
SMSAFRSAVFVPGYASSKMGLVALTM

SEQ ID NO: 91693 - protein, 18 aa, Mycobacterium avium
SNATLWPLYHDVIVKPIY

SEQ ID NO: 91694 - protein, 19 aa, Mycobacterium avium
SNGLWKPSPGSVYPTLQLL

SEQ ID NO: 91695 - protein, 17 aa, Mycobacterium avium
SNIDAFHRALATATAEV

SEQ ID NO: 91696 - protein, 33 aa, Mycobacterium avium
SNLNFFPMGAWAKRTGAIFIRRQTKDLPVYRFV

SEQ ID NO: 91697 - protein, 17 aa, Mycobacterium avium
SNPRFSVSRVDIDRAGP

SEQ ID NO: 91698 - protein, 26 aa, Mycobacterium avium
SNQSVVFRPAFEFIEQQWRELGVVLQ

SEQ ID NO: 91699 - protein, 18 aa, Mycobacterium avium
SNRLAHRLAAAGAGPGQT

SEQ ID NO: 91700 - protein, 19 aa, Mycobacterium avium
SNSRFLLNVPLFGRQPLHP

SEQ ID NO: 91701 - protein, 27 aa, Mycobacterium avium
SPESGWIRTWLDTVLELPWNVRTDDST

SEQ ID NO: 91702 - protein, 18 aa, Mycobacterium avium
SPGLRRLEAALGLVDPGA

SEQ ID NO: 91703 - protein, 18 aa, Mycobacterium avium
SPGVRLRGTVSFAPAAAG

SEQ ID NO: 91704 - protein, 21 aa, Mycobacterium avium
SPHAWSAAPNFAFDLAARKTT

SEQ ID NO: 91705 - protein, 17 aa, Mycobacterium avium
SPHVVAVGFTFDPKTHI

SEQ ID NO: 91706 - protein, 31 aa, Mycobacterium avium
SPIGMPLAHLGFFVLDGWLRPVPAGVTGELY

SEQ ID NO: 91707 - protein, 19 aa, Mycobacterium avium
SPLDVGWSLVSTRAVFEHR

SEQ ID NO: 91708 - protein, 19 aa, Mycobacterium avium
SPLEFLYGLFSDYVRDRRR

SEQ ID NO: 91709 - protein, 18 aa, Mycobacterium avium
SPLGRFLLAAAIREAHTK

SEQ ID NO: 91710 - protein, 17 aa, Mycobacterium avium
SPLPLALLCRMAAVPWV

SEQ ID NO: 91711 - protein, 20 aa, Mycobacterium avium
SPLQELRKLLPENTIDFDPG

SEQ ID NO: 91712 - protein, 20 aa, Mycobacterium avium
SPLRHWKAGPGTRLAIVGLG

SEQ ID NO: 91713 - protein, 21 aa, Mycobacterium avium
SPPDRDALHALINTCENDALR

SEQ ID NO: 91714 - protein, 24 aa, Mycobacterium avium
SPPRRVALLQAFLVRRMRRNAVWP

SEQ ID NO: 91715 - protein, 21 aa, Mycobacterium avium
SPRLAEFLDHVDVAVSLHGYG

SEQ ID NO: 91716 - protein, 24 aa, Mycobacterium avium
SPSEARVAALIRRVCAQTSSLPPL

SEQ ID NO: 91717 - protein, 26 aa, Mycobacterium avium
SPSGSHLLPALIRRYEEAKAGGAEEV

SEQ ID NO: 91718 - protein, 24 aa, Mycobacterium avium
SPVGRGRFAGRHTMDLLASAVAMG

SEQ ID NO: 91719 - protein, 17 aa, Mycobacterium avium
SPVNRLQPFDGYTDPES

SEQ ID NO: 91720 - protein, 19 aa, Mycobacterium avium
SPVRYGGHVVAVLTRHQTA

SEQ ID NO: 91721 - protein, 18 aa, Mycobacterium avium
SQEGMPLAGLVLNRTHPP

SEQ ID NO: 91722 - protein, 19 aa, Mycobacterium avium
SQFGVRLEAIGARIQQVAS

SEQ ID NO: 91723 - protein, 25 aa, Mycobacterium avium
SQGFPLPWQLVVGALQAQAEGARGD

SEQ ID NO: 91724 - protein, 18 aa, Mycobacterium avium
SQLRCYRVVLADRARREA

SEQ ID NO: 91725 - protein, 20 aa, Mycobacterium avium
SQLVGLGIMRYGIRSEPLHS

SEQ ID NO: 91726 - protein, 23 aa, Mycobacterium avium
SQMKSYRIAGEQAAKAERESAKS

SEQ ID NO: 91727 - protein, 24 aa, Mycobacterium avium
SQQLCTRPSVVFATERMDADPRWR

SEQ ID NO: 91728 - protein, 18 aa, Mycobacterium avium
SQRVARFATEHAWTEDPP

SEQ ID NO: 91729 - protein, 17 aa, Mycobacterium avium
SQVAPLFHTRYEPLWAL

SEQ ID NO: 91730 - protein, 18 aa, Mycobacterium avium
SRAFGAQMVERGQGGTII

SEQ ID NO: 91731 - protein, 22 aa, Mycobacterium avium
SRANARGLVVVRMGTETKASEG

SEQ ID NO: 91732 - protein, 23 aa, Mycobacterium avium
SRAQSRFAWQRIALDALNIYQSL

SEQ ID NO: 91733 - protein, 17 aa, Mycobacterium avium
SRCREIASAFGGGNNVH

SEQ ID NO: 91734 - protein, 21 aa, Mycobacterium avium
SRCSWAGAQAARLAAEARDVY

SEQ ID NO: 91735 - protein, 23 aa, Mycobacterium avium
SRDECRALIAAGIDDWGGVSPLT

SEQ ID NO: 91736 - protein, 21 aa, Mycobacterium avium
SRDRAAGMGLTIDYREANAQA

SEQ ID NO: 91737 - protein, 30 aa, Mycobacterium avium
SRFVACPFGGPGARMYRTGDLVRWGADGQL

SEQ ID NO: 91738 - protein, 19 aa, Mycobacterium avium
SRGFLSYASRVIADLAEAG

SEQ ID NO: 91739 - protein, 22 aa, Mycobacterium avium
SRGKWDTLRAMGFDDDHIGDSR

SEQ ID NO: 91740 - protein, 25 aa, Mycobacterium avium
SRGMRFGLFIPQGWRMDLVGIEPDE

SEQ ID NO: 91741 - protein, 22 aa, Mycobacterium avium
SRGVPPTRLRLIYLADGQVLDY

SEQ ID NO: 91742 - protein, 25 aa, Mycobacterium avium
SRIEGAELRKAFGAVGIQYGPAFSG

SEQ ID NO: 91743 - protein, 19 aa, Mycobacterium avium
SRIYGRMPGVADVPVSGTP

SEQ ID NO: 91744 - protein, 19 aa, Mycobacterium avium
SRKRPYLGMSREPADIAAM

SEQ ID NO: 91745 - protein, 21 aa, Mycobacterium avium
SRLPMPDLIRMATKAIHYLAV

SEQ ID NO: 91746 - protein, 23 aa, Mycobacterium avium
SRLYPETLHIMGWNIGSAGMQLV

SEQ ID NO: 91747 - protein, 19 aa, Mycobacterium avium
SRMGRIAWSWLRHPVKSRE

SEQ ID NO: 91748 - protein, 20 aa, Mycobacterium avium
SRMRPDVVVAFMDEFGDVIY

SEQ ID NO: 91749 - protein, 21 aa, Mycobacterium avium
SRPTFQKGLAHHRAAWRAARL

SEQ ID NO: 91750 - protein, 30 aa, Mycobacterium avium
SRPTPLRDLRVVEISDRIAGSYCGKLLLDA

SEQ ID NO: 91751 - protein, 23 aa, Mycobacterium avium
SRRAIHFQEWWVRYRAQVPTHSF

SEQ ID NO: 91752 - protein, 22 aa, Mycobacterium avium
SRRAKHFRTAHVVANSGHSVQS

SEQ ID NO: 91753 - protein, 19 aa, Mycobacterium avium
SRRDVWALVSSLRVQGITV

SEQ ID NO: 91754 - protein, 24 aa, Mycobacterium avium
SRRLTEVRKSGVLPYLRPDGKTQV

SEQ ID NO: 91755 - protein, 20 aa, Mycobacterium avium
SRRRLAMAVGAIRARESLDS

SEQ ID NO: 91756 - protein, 25 aa, Mycobacterium avium
SRRRRRGRRGRGRGRGEQGGSDGPG

SEQ ID NO: 91757 - protein, 20 aa, Mycobacterium avium
SRRSAWWAGTVTLGVAKIIE

SEQ ID NO: 91758 - protein, 19 aa, Mycobacterium avium
SRRVIALKAPKKLPRVLSP

SEQ ID NO: 91759 - protein, 21 aa, Mycobacterium avium
SRSARFRPWMPAAGNHENELG

SEQ ID NO: 91760 - protein, 20 aa, Mycobacterium avium
SRSLLEFLDTVPLGEGGADG

SEQ ID NO: 91761 - protein, 17 aa, Mycobacterium avium
SRWILEVEKVRDIEVNF

SEQ ID NO: 91762 - protein, 31 aa, Mycobacterium avium
SSARLPADLLGQWGIRVVPLHILLDGTDLRD

SEQ ID NO: 91763 - protein, 25 aa, Mycobacterium avium
SSEPIAIVGMSCRFPGGVDSPEALW

SEQ ID NO: 91764 - protein, 25 aa, Mycobacterium avium
SSERLSEILAAYALLRDPARRADYD

SEQ ID NO: 91765 - protein, 21 aa, Mycobacterium avium
SSGLTAIHLACRSLHEGESDL

SEQ ID NO: 91766 - protein, 18 aa, Mycobacterium avium
SSGPQGAFGFRHNPIHVM

SEQ ID NO: 91767 - protein, 24 aa, Mycobacterium avium
SSHTRTESRWGLYHDRADLPGRDD

SEQ ID NO: 91768 - protein, 24 aa, Mycobacterium avium
SSIDVRLDCMFRVFNNTRYTHIDP

SEQ ID NO: 91769 - protein, 23 aa, Mycobacterium avium
SSLAGRAVAAAATRPVGGAASAA

SEQ ID NO: 91770 - protein, 18 aa, Mycobacterium avium
SSLASFEGQLGKWSRMDA

SEQ ID NO: 91771 - protein, 26 aa, Mycobacterium avium
SSLKRPDRRLAVVFGAGGERDPGKRA

SEQ ID NO: 91772 - protein, 18 aa, Mycobacterium avium
SSLQTSRMAFHAIKAGEG

SEQ ID NO: 91773 - protein, 19 aa, Mycobacterium avium
SSLREAFGHFPSGVVAIAA

SEQ ID NO: 91774 - protein, 22 aa, Mycobacterium avium
SSPRVLSELFWIGRYGERAESM

SEQ ID NO: 91775 - protein, 23 aa, Mycobacterium avium
SSRQRLEQVVIRFAGDSGDGMQL

SEQ ID NO: 91776 - protein, 25 aa, Mycobacterium avium
STASNPDLFWALRGGGGGNFGVTTS

SEQ ID NO: 91777 - protein, 25 aa, Mycobacterium avium
STDPLSEIWFLLTGQTTLPTSLGSA

SEQ ID NO: 91778 - protein, 22 aa, Mycobacterium avium
STECGLELAHGCVSCTIRNDLL

SEQ ID NO: 91779 - protein, 17 aa, Mycobacterium avium
STEEGWRQFVQTYLPGN

SEQ ID NO: 91780 - protein, 17 aa, Mycobacterium avium
STIKVPLAIAALRKDWL

SEQ ID NO: 91781 - protein, 27 aa, Mycobacterium avium
STITPRWLLHLLNWVPVEAGIYRVNRV

SEQ ID NO: 91782 - protein, 17 aa, Mycobacterium avium
STLGGYQAWQLGGTYQR

SEQ ID NO: 91783 - protein, 22 aa, Mycobacterium avium
STNARIAVNLGAPILLTVSGKG

SEQ ID NO: 91784 - protein, 24 aa, Mycobacterium avium
STPGCTKQACDFRDSLAELNGAGL

SEQ ID NO: 91785 - protein, 23 aa, Mycobacterium avium
STPIRPGEFGDRGGLQPVVEHRD

SEQ ID NO: 91786 - protein, 18 aa, Mycobacterium avium
STTIRILLGLVKADGGTV

SEQ ID NO: 91787 - protein, 22 aa, Mycobacterium avium
STVIKADWRAGVSDAMTHKVAS

SEQ ID NO: 91788 - protein, 17 aa, Mycobacterium avium
STVLARTALPTMTLLGA

SEQ ID NO: 91789 - protein, 25 aa, Mycobacterium avium
SVAKPSPPYAAAVREWEKLEQFVDG

SEQ ID NO: 91790 - protein, 23 aa, Mycobacterium avium
SVDERLHHLFARMPDARVHLYGK

SEQ ID NO: 91791 - protein, 24 aa, Mycobacterium avium
SVDKRNRSVLVFVLDAGMPGLTQG

SEQ ID NO: 91792 - protein, 17 aa, Mycobacterium avium
SVDPCQPLTSGVWQGEW

SEQ ID NO: 91793 - protein, 23 aa, Mycobacterium avium
SVELRIPPFAAVQCIPGPAHTRG

SEQ ID NO: 91794 - protein, 23 aa, Mycobacterium avium
SVESLAGQGARVTVTEIDPINAL

SEQ ID NO: 91795 - protein, 18 aa, Mycobacterium avium
SVGGRVGGSPGIAAYQAS

SEQ ID NO: 91796 - protein, 17 aa, Mycobacterium avium
SVGKVIPTVAARVVDEN

SEQ ID NO: 91797 - protein, 17 aa, Mycobacterium avium
SVGLLANATHRGVTLTK

SEQ ID NO: 91798 - protein, 21 aa, Mycobacterium avium
SVGVIFLEIHLTYAALVSGGR

SEQ ID NO: 91799 - protein, 23 aa, Mycobacterium avium
SVISGRIAYTLGLTGPALTVDSS

SEQ ID NO: 91800 - protein, 23 aa, Mycobacterium avium
SVKGEVIASTFDRPPSDHTSVAE

SEQ ID NO: 91801 - protein, 19 aa, Mycobacterium avium
SVLDCNKPVIAAVHGAATG

SEQ ID NO: 91802 - protein, 24 aa, Mycobacterium avium
SVLGRSWPVICDELLGHYEAVLSP

SEQ ID NO: 91803 - protein, 35 aa, Mycobacterium avium
SVLMTRNRVRHVPVLDGKKLIGIVSIGDVVKTRME

SEQ ID NO: 91804 - protein, 22 aa, Mycobacterium avium
SVPALMRGYLRLGAQVCGEPAH

SEQ ID NO: 91805 - protein, 22 aa, Mycobacterium avium
SVPERLGGPGVDDFRYNAIVVD

SEQ ID NO: 91806 - protein, 18 aa, Mycobacterium avium
SVPSARRYLPGSLIMETT

SEQ ID NO: 91807 - protein, 17 aa, Mycobacterium avium
SVREVMWGADPELLQST

SEQ ID NO: 91808 - protein, 22 aa, Mycobacterium avium
SWASIVPHTWLWASPLGPGIRA

SEQ ID NO: 91809 - protein, 25 aa, Mycobacterium avium
SWAVYRAELALVEVARKTGIRLRLF

SEQ ID NO: 91810 - protein, 28 aa, Mycobacterium avium
SWFDHWYRHLVALGVRFVRAAATRLDPV

SEQ ID NO: 91811 - protein, 21 aa, Mycobacterium avium
SWLPCFHDMGMVGFLTIPMYF

SEQ ID NO: 91812 - protein, 26 aa, Mycobacterium avium
SWRAGDVTLPLTYRFQPGAADDGVTV

SEQ ID NO: 91813 - protein, 22 aa, Mycobacterium avium
SWTRPEIQGAQFTHAVALAEAW

SEQ ID NO: 91814 - protein, 17 aa, Mycobacterium avium
SWVAIAVATDDQWHRLC

SEQ ID NO: 91815 - protein, 24 aa, Mycobacterium avium
SYFHPVGTCAMGTGPESVVDNQLR

SEQ ID NO: 91816 - protein, 33 aa, Mycobacterium avium
SYHREIAMNFGMDGPWGQWVNRWTAEEARHSTA

SEQ ID NO: 91817 - protein, 20 aa, Mycobacterium avium
SYLHSWRAGDVVMWDNRATM

SEQ ID NO: 91818 - protein, 23 aa, Mycobacterium avium
SYLNKLLWILTGNFAKRGGQHLH

SEQ ID NO: 91819 - protein, 18 aa, Mycobacterium avium
SYPEAAGISAVFTTAYMA

SEQ ID NO: 91820 - protein, 34 aa, Mycobacterium avium
SYPVLAVTLNEEFPRLMVYRGPRRKGVRYFGPYS

SEQ ID NO: 91821 - protein, 20 aa, Mycobacterium avium
SYRPGCWLDSGPFGCLGSGP

SEQ ID NO: 91822 - protein, 21 aa, Mycobacterium avium
SYYYRTRAALLQGVGKRVAEI

SEQ ID NO: 91823 - protein, 24 aa, Mycobacterium avium
TAAAPAIRPAALALPATTVTAAAE

SEQ ID NO: 91824 - protein, 23 aa, Mycobacterium avium
TAACALLVRGWCADGSDEVVLDF

SEQ ID NO: 91825 - protein, 17 aa, Mycobacterium avium
TACEPGREFGFTVLLGD

SEQ ID NO: 91826 - protein, 23 aa, Mycobacterium avium
TADGTCPVRLFFPDGSGPWPGVV

SEQ ID NO: 91827 - protein, 17 aa, Mycobacterium avium
TADPDWMVAFARHLEAC

SEQ ID NO: 91828 - protein, 17 aa, Mycobacterium avium
TAELAGRAVEAFGKLDI

SEQ ID NO: 91829 - protein, 18 aa, Mycobacterium avium
TAERGLFDFFFLAEGLRL

SEQ ID NO: 91830 - protein, 24 aa, Mycobacterium avium
TAETAWLFLQLVIRMLKDGGRCGI

SEQ ID NO: 91831 - protein, 18 aa, Mycobacterium avium
TAFFDNFFLAATRAGVRQ

SEQ ID NO: 91832 - protein, 18 aa, Mycobacterium avium
TAGSGAKVLLAHSDAATQ

SEQ ID NO: 91833 - protein, 26 aa, Mycobacterium avium
TAGSVIPLSRASLYPTTEQTLASVSI

SEQ ID NO: 91834 - protein, 26 aa, Mycobacterium avium
TAIPLAKACARIMLGATISQLRAEGM

SEQ ID NO: 91835 - protein, 26 aa, Mycobacterium avium
TAIVKGLRTGTDFEYELQMAQMNKHI

SEQ ID NO: 91836 - protein, 20 aa, Mycobacterium avium
TAKAVGWTPADWVDNTLGTW

SEQ ID NO: 91837 - protein, 23 aa, Mycobacterium avium
TALEAHPAVLLFSHRSYIDGAVV

SEQ ID NO: 91838 - protein, 23 aa, Mycobacterium avium
TALEIAERAGARFVLASTSEVYG

SEQ ID NO: 91839 - protein, 19 aa, Mycobacterium avium
TALHLARRGIEVEIFTRAT

SEQ ID NO: 91840 - protein, 25 aa, Mycobacterium avium
TALIYDLRLGPAWQGLGFGVGMITE

SEQ ID NO: 91841 - protein, 17 aa, Mycobacterium avium
TAMLRRLGIPGDFKGGF

SEQ ID NO: 91842 - protein, 22 aa, Mycobacterium avium
TAPETPRPAAPVTDATAILDEW

SEQ ID NO: 91843 - protein, 33 aa, Mycobacterium avium
TAPEVPYYSATLWNPRERPSFGGDYWAENLRHT

SEQ ID NO: 91844 - protein, 22 aa, Mycobacterium avium
TARELARVGGHVILAVRNTDKG

SEQ ID NO: 91845 - protein, 21 aa, Mycobacterium avium
TARLRRWRTATALPAGPDATD

SEQ ID NO: 91846 - protein, 23 aa, Mycobacterium avium
TASDRGAGPLGFAGTAPSAPAQA

SEQ ID NO: 91847 - protein, 22 aa, Mycobacterium avium
TASPGSPWLADTWRDRFEQMLQ

SEQ ID NO: 91848 - protein, 27 aa, Mycobacterium avium
TAVEMRNRLKAATGLALSPTLIFDYPN

SEQ ID NO: 91849 - protein, 20 aa, Mycobacterium avium
TAVQPYVQWMHTTAGQLQQA

SEQ ID NO: 91850 - protein, 24 aa, Mycobacterium avium
TAVYVCGPSAMLEAVRIARNEHAG

SEQ ID NO: 91851 - protein, 20 aa, Mycobacterium avium
TCPDCNGSLVSLSEGNYRCR

SEQ ID NO: 91852 - protein, 18 aa, Mycobacterium avium
TCVVRAVRRWTYFYKHES

SEQ ID NO: 91853 - protein, 19 aa, Mycobacterium avium
TDAGRKCVLVPGDLSDPAH

SEQ ID NO: 91854 - protein, 18 aa, Mycobacterium avium
TDCTDCAGLRDQLAARRP

SEQ ID NO: 91855 - protein, 30 aa, Mycobacterium avium
TDDIRWALDLLRRRFAKVIWVPGNHELWTT

SEQ ID NO: 91856 - protein, 27 aa, Mycobacterium avium
TDEDFRHTFDWCVTSAFIMSQLVAAHM

SEQ ID NO: 91857 - protein, 22 aa, Mycobacterium avium
TDEIVKFPALREHEEVVRRLHA

SEQ ID NO: 91858 - protein, 24 aa, Mycobacterium avium
TDEPMPLCPFIAAAVEISDPQHPA

SEQ ID NO: 91859 - protein, 22 aa, Mycobacterium avium
TDEVALPFAWQGVSLHAAGASA

SEQ ID NO: 91860 - protein, 28 aa, Mycobacterium avium
TDGDWPSFPLPLGDTWASSKGDLLTVEL

SEQ ID NO: 91861 - protein, 18 aa, Mycobacterium avium
TDGIALLISEGHPVHVVV

SEQ ID NO: 91862 - protein, 25 aa, Mycobacterium avium
TDGKSGCYWARLRSFDTNDIIDNNV

SEQ ID NO: 91863 - protein, 17 aa, Mycobacterium avium
TDIFTRMILSIVATGTA

SEQ ID NO: 91864 - protein, 24 aa, Mycobacterium avium
TDIGWLEMLWMQPVGINSHPAALP

SEQ ID NO: 91865 - protein, 17 aa, Mycobacterium avium
TDISRWREVGAVHAEVF

SEQ ID NO: 91866 - protein, 20 aa, Mycobacterium avium
TDLLLGLGMHDAFRFFSDHV

SEQ ID NO: 91867 - protein, 23 aa, Mycobacterium avium
TDLPFLIKLEERGDMLVPGKNLT

SEQ ID NO: 91868 - protein, 18 aa, Mycobacterium avium
TDLRAVVSALRIAADAQR

SEQ ID NO: 91869 - protein, 20 aa, Mycobacterium avium
TDLRCAQLPPGMLDGIAETQ

SEQ ID NO: 91870 - protein, 19 aa, Mycobacterium avium
TDLSAWPPVGAVPVDLGDG

SEQ ID NO: 91871 - protein, 17 aa, Mycobacterium avium
TDLTAFWAGPVATQLLG

SEQ ID NO: 91872 - protein, 19 aa, Mycobacterium avium
TDNGQNWGIFPTSIRTASP

SEQ ID NO: 91873 - protein, 18 aa, Mycobacterium avium
TDPERWRALWKTVVDLGW

SEQ ID NO: 91874 - protein, 23 aa, Mycobacterium avium
TDSRTAAAFALACRQAGVTLQRY

SEQ ID NO: 91875 - protein, 19 aa, Mycobacterium avium
TDTIPAWLSPHEYVEPSEA

SEQ ID NO: 91876 - protein, 21 aa, Mycobacterium avium
TDVRGGLLFVWHDHENNPPDP

SEQ ID NO: 91877 - protein, 25 aa, Mycobacterium avium
TEAAELHEIYKLGVVPIPTNKPMIR

SEQ ID NO: 91878 - protein, 23 aa, Mycobacterium avium
TEAELDQLIGFFVNILVLRNDLD

SEQ ID NO: 91879 - protein, 26 aa, Mycobacterium avium
TEAGRRAALEMVRRHRLLETFLVNEL

SEQ ID NO: 91880 - protein, 25 aa, Mycobacterium avium
TEAGRRIRDAFVVGDGYAELMTADY

SEQ ID NO: 91881 - protein, 17 aa, Mycobacterium avium
TEDAWRRVFSFFGEHLA

SEQ ID NO: 91882 - protein, 30 aa, Mycobacterium avium
TEDFAAGGFRRGEGFLCMMPSGPHGVGYFS

SEQ ID NO: 91883 - protein, 22 aa, Mycobacterium avium
TEEILLELDVDWDDIAKAKALK

SEQ ID NO: 91884 - protein, 26 aa, Mycobacterium avium
TEEQKKRWLPGIADGTLTMAFAITEP

SEQ ID NO: 91885 - protein, 23 aa, Mycobacterium avium
TEFAELRPRLVYDRNTGTLTARP

SEQ ID NO: 91886 - protein, 23 aa, Mycobacterium avium
TEGSGFDWDGWLQALGATPDAVA

SEQ ID NO: 91887 - protein, 23 aa, Mycobacterium avium
TEGVYQCRACGAELFRSTEKFES

SEQ ID NO: 91888 - protein, 23 aa, Mycobacterium avium
TEHPAGSVLIEFGHTKVMCTASV

SEQ ID NO: 91889 - protein, 23 aa, Mycobacterium avium
TEIARGGWGPSLSGHVVGGLLAW

SEQ ID NO: 91890 - protein, 17 aa, Mycobacterium avium
TEIFPGGQLPAIEVVEF

SEQ ID NO: 91891 - protein, 21 aa, Mycobacterium avium
TELHCPASMALAAKLLGVNES

SEQ ID NO: 91892 - protein, 32 aa, Mycobacterium avium
TELLGSLAPDLARPGQVWSQWHSYSFDISGWE

SEQ ID NO: 91893 - protein, 19 aa, Mycobacterium avium
TELLLAPEFFTNWADSRPA

SEQ ID NO: 91894 - protein, 23 aa, Mycobacterium avium
TERARELLAPYGNRVSIAAVNGR

SEQ ID NO: 91895 - protein, 21 aa, Mycobacterium avium
TERHIRLIFQRAREKASEGTP

SEQ ID NO: 91896 - protein, 17 aa, Mycobacterium avium
TERMPLPPNARRIEDPD

SEQ ID NO: 91897 - protein, 17 aa, Mycobacterium avium
TERPRGFLTGRVTGAQT

SEQ ID NO: 91898 - protein, 25 aa, Mycobacterium avium
TESARNPSRFMAMQGAFVDEHPDRR

SEQ ID NO: 91899 - protein, 20 aa, Mycobacterium avium
TEVGAVFTWAGYGTSHDGFD

SEQ ID NO: 91900 - protein, 19 aa, Mycobacterium avium
TEVGRRGAITPALATLGFA

SEQ ID NO: 91901 - protein, 26 aa, Mycobacterium avium
TEVLDWSRAPFAEWFADGTLNVAYNC

SEQ ID NO: 91902 - protein, 17 aa, Mycobacterium avium
TEVLIKAYHRWGDDFVS

SEQ ID NO: 91903 - protein, 23 aa, Mycobacterium avium
TEVPRVDMLQRLAQVCGKRLHIR

SEQ ID NO: 91904 - protein, 25 aa, Mycobacterium avium
TEVTLRFADGEVVTMHVISIVEETP

SEQ ID NO: 91905 - protein, 23 aa, Mycobacterium avium
TFADLQIHPSVLRAIADVGYETP

SEQ ID NO: 91906 - protein, 18 aa, Mycobacterium avium
TFIASTWLRTELRRAPRL

SEQ ID NO: 91907 - protein, 25 aa, Mycobacterium avium
TFSPRMREVIILRVAHLQDSPYELA

SEQ ID NO: 91908 - protein, 28 aa, Mycobacterium avium
TGADALASILSWQGWETLFELAHFVGVS

SEQ ID NO: 91909 - protein, 18 aa, Mycobacterium avium
TGDLVRWRADGQLDYLGR

SEQ ID NO: 91910 - protein, 24 aa, Mycobacterium avium
TGGAPGDFLSAGGHFQAPGHTGEP

SEQ ID NO: 91911 - protein, 19 aa, Mycobacterium avium
TGGEIIDLLARMRGGIDKK

SEQ ID NO: 91912 - protein, 23 aa, Mycobacterium avium
TGGFTEFVPLPFVHQSSPLYLAG

SEQ ID NO: 91913 - protein, 20 aa, Mycobacterium avium
TGGIPGMIQGLTGAQPSAAA

SEQ ID NO: 91914 - protein, 17 aa, Mycobacterium avium
TGGRVAWNIVTSYLDSA

SEQ ID NO: 91915 - protein, 25 aa, Mycobacterium avium
TGHSALDVPARWQAMVRAMRNNGRP

SEQ ID NO: 91916 - protein, 19 aa, Mycobacterium avium
TGLARLALQTGVPVIPVAM

SEQ ID NO: 91917 - protein, 25 aa, Mycobacterium avium
TGLDRFVQQRVDGITLREEHLAGKP

SEQ ID NO: 91918 - protein, 18 aa, Mycobacterium avium
TGLPVFCVDYRLAPRHRF

SEQ ID NO: 91919 - protein, 20 aa, Mycobacterium avium
TGLVCALLLTTRGAALTLRQ

SEQ ID NO: 91920 - protein, 17 aa, Mycobacterium avium
TGPLAVVEDLGRPGLAH

SEQ ID NO: 91921 - protein, 23 aa, Mycobacterium avium
TGPMIKFALFRTGSAEYYWFTTC

SEQ ID NO: 91922 - protein, 24 aa, Mycobacterium avium
TGPMPLLPNGRWLYEHGQPRRLAQ

SEQ ID NO: 91923 - protein, 21 aa, Mycobacterium avium
TGPQRYWWSPGVTQVVPNWND

SEQ ID NO: 91924 - protein, 18 aa, Mycobacterium avium
TGQVHVCFGVTEPGAGLD

SEQ ID NO: 91925 - protein, 20 aa, Mycobacterium avium
TGRHPLKFTAYDGSTAGSED

SEQ ID NO: 91926 - protein, 21 aa, Mycobacterium avium
TGRPYYNAIVWQDTRTDRIAS

SEQ ID NO: 91927 - protein, 24 aa, Mycobacterium avium
TGRQRVRVGALGLTVDFRAGEEML

SEQ ID NO: 91928 - protein, 25 aa, Mycobacterium avium
TGRRRRCGWFDAVIARYATRVNGIT

SEQ ID NO: 91929 - protein, 23 aa, Mycobacterium avium
TGRTVVLRLRFDDFTRATRSHTL

SEQ ID NO: 91930 - protein, 26 aa, Mycobacterium avium
TGSNPIDILAWLLGFNGQSSGGLGGM

SEQ ID NO: 91931 - protein, 23 aa, Mycobacterium avium
TGTRAHSARSWLGDNAIHKLGAV

SEQ ID NO: 91932 - protein, 35 aa, Mycobacterium avium
TGVEIAEMFRLPPALERAWHARGYYGSVSHNVKAI

SEQ ID NO: 91933 - protein, 20 aa, Mycobacterium avium
TGVRRFALRPVTGIDPAAVS

SEQ ID NO: 91934 - protein, 20 aa, Mycobacterium avium
TGYLRKGIPGPRWMPRPVWK

SEQ ID NO: 91935 - protein, 24 aa, Mycobacterium avium
TGYRRLRAWLTRLYRTEFDGFIAA

SEQ ID NO: 91936 - protein, 21 aa, Mycobacterium avium
THEVWKAGQPVSLSPTEFTLL

SEQ ID NO: 91937 - protein, 17 aa, Mycobacterium avium
THHYRFTLYQLPNDYQL

SEQ ID NO: 91938 - protein, 23 aa, Mycobacterium avium
THPDGRSAFALWFTGGIFVNQSG

SEQ ID NO: 91939 - protein, 23 aa, Mycobacterium avium
THPGCDAPGYWCEVHHLNEWATG

SEQ ID NO: 91940 - protein, 20 aa, Mycobacterium avium
THRECPPGVVGEIWVHGENV

SEQ ID NO: 91941 - protein, 19 aa, Mycobacterium avium
THRELPKRRPVPLRLRDWR

SEQ ID NO: 91942 - protein, 19 aa, Mycobacterium avium
TIDKAHWFYALSPQDRRNY

SEQ ID NO: 91943 - protein, 18 aa, Mycobacterium avium
TIGLGVSQWKNFFIYAPW

SEQ ID NO: 91944 - protein, 25 aa, Mycobacterium avium
TIKSAVAFGALLSRGIGDTIRVSLS

SEQ ID NO: 91945 - protein, 20 aa, Mycobacterium avium
TILEEARVQFLREAFEVDIL

SEQ ID NO: 91946 - protein, 23 aa, Mycobacterium avium
TIPGLDIENYWFRRHEVVYQRLA

SEQ ID NO: 91947 - protein, 17 aa, Mycobacterium avium
TIRNLVHGMGFQRDVLG

SEQ ID NO: 91948 - protein, 18 aa, Mycobacterium avium
TISAWLAGEVRLEPDQLV

SEQ ID NO: 91949 - protein, 22 aa, Mycobacterium avium
TISRRVREALAMADSDPIHPGQ

SEQ ID NO: 91950 - protein, 25 aa, Mycobacterium avium
TITWTLPNVRAWWEMTWQGRPDPAV

SEQ ID NO: 91951 - protein, 18 aa, Mycobacterium avium
TIVSWLPFYHDMGLVLGV

SEQ ID NO: 91952 - protein, 19 aa, Mycobacterium avium
TKADHFLVVTGIDTDTQIV

SEQ ID NO: 91953 - protein, 26 aa, Mycobacterium avium
TKANLKRAWELMGMRVHWQSSNDLVA

SEQ ID NO: 91954 - protein, 20 aa, Mycobacterium avium
TKCELVHAALVFALPPVPEL

SEQ ID NO: 91955 - protein, 23 aa, Mycobacterium avium
TKDDLKPVASWLVEVNGDPGKGW

SEQ ID NO: 91956 - protein, 20 aa, Mycobacterium avium
TKDVHIGPSDHVSWLDDRKW

SEQ ID NO: 91957 - protein, 18 aa, Mycobacterium avium
TKETLGWIALNQRANAEL

SEQ ID NO: 91958 - protein, 17 aa, Mycobacterium avium
TKMQSWDIFSCVRLVLD

SEQ ID NO: 91959 - protein, 21 aa, Mycobacterium avium
TKRLRAVDFTLGYEVRSVNAD

SEQ ID NO: 91960 - protein, 20 aa, Mycobacterium avium
TKVPWRDGFRRMIEARHPEI

SEQ ID NO: 91961 - protein, 25 aa, Mycobacterium avium
TLAAEYKKLLLAMLQRREAWEIIDY

SEQ ID NO: 91962 - protein, 23 aa, Mycobacterium avium
TLAAGLGRPELDITRNFYTTSSC

SEQ ID NO: 91963 - protein, 18 aa, Mycobacterium avium
TLAALPMGIPANFAAPAA

SEQ ID NO: 91964 - protein, 21 aa, Mycobacterium avium
TLACARMGWNVHDTEVISLVT

SEQ ID NO: 91965 - protein, 18 aa, Mycobacterium avium
TLADRYRATVSIPPATGL

SEQ ID NO: 91966 - protein, 23 aa, Mycobacterium avium
TLAPLYFELDGSFPHHEANPLDP

SEQ ID NO: 91967 - protein, 19 aa, Mycobacterium avium
TLASQAAHIVMRFQQNLAE

SEQ ID NO: 91968 - protein, 26 aa, Mycobacterium avium
TLDPVKLRLGIGYVIQHAGLMPHQRV

SEQ ID NO: 91969 - protein, 18 aa, Mycobacterium avium
TLERLGWIVIQVVAGDRP

SEQ ID NO: 91970 - protein, 18 aa, Mycobacterium avium
TLFGRDSLLTAWMTLPLD

SEQ ID NO: 91971 - protein, 17 aa, Mycobacterium avium
TLGSGVGVRLFRPAGAA

SEQ ID NO: 91972 - protein, 18 aa, Mycobacterium avium
TLIPRARAKISMRVAPGG

SEQ ID NO: 91973 - protein, 23 aa, Mycobacterium avium
TLLRAWKAYDRFEGKSSVRTWLH

SEQ ID NO: 91974 - protein, 25 aa, Mycobacterium avium
TLQDWADRGLRVIGLDAGGDTTLDD

SEQ ID NO: 91975 - protein, 19 aa, Mycobacterium avium
TLRECLRAGDALLAQRFFR

SEQ ID NO: 91976 - protein, 24 aa, Mycobacterium avium
TLRISSQLLANWLRHGVITEEDVR

SEQ ID NO: 91977 - protein, 21 aa, Mycobacterium avium
TLRRPAIAAVRADYDKVLRQR

SEQ ID NO: 91978 - protein, 18 aa, Mycobacterium avium
TLVGKLSIPPSWATATPS

SEQ ID NO: 91979 - protein, 17 aa, Mycobacterium avium
TLVPLPVRSAVLSHLPV

SEQ ID NO: 91980 - protein, 19 aa, Mycobacterium avium
TLWSIPIVFDMSADDIAER

SEQ ID NO: 91981 - protein, 18 aa, Mycobacterium avium
TMAAEMRSAAASYGAVIS

SEQ ID NO: 91982 - protein, 26 aa, Mycobacterium avium
TMADPGSVSYLFSRKGVVTCEKNGLT

SEQ ID NO: 91983 - protein, 18 aa, Mycobacterium avium
TMQMKKLRGGIGALTSHL

SEQ ID NO: 91984 - protein, 18 aa, Mycobacterium avium
TMRRLLGVRWGAREQAEF

SEQ ID NO: 91985 - protein, 30 aa, Mycobacterium avium
TMTLPSIRWSRWPLQRMALSRYADRQAVDF

SEQ ID NO: 91986 - protein, 18 aa, Mycobacterium avium
TMWVVPFCMGPLGAEDPK

SEQ ID NO: 91987 - protein, 19 aa, Mycobacterium avium
TNEKEVWVALSVPGQPIDH

SEQ ID NO: 91988 - protein, 17 aa, Mycobacterium avium
TNFAGMWSAQLREGDVV

SEQ ID NO: 91989 - protein, 31 aa, Mycobacterium avium
TNFDELCEIFARYDVTFSLGDGLRPGSIADA

SEQ ID NO: 91990 - protein, 23 aa, Mycobacterium avium
TNFRDVMITLGMFTHDALLGGEG

SEQ ID NO: 91991 - protein, 18 aa, Mycobacterium avium
TNHLGHFALTGLLLDHLL

SEQ ID NO: 91992 - protein, 21 aa, Mycobacterium avium
TNIAMPDWMRPAATNYTGPQR

SEQ ID NO: 91993 - protein, 18 aa, Mycobacterium avium
TNIRPQVDLWTFPDTGKS

SEQ ID NO: 91994 - protein, 17 aa, Mycobacterium avium
TNLGLAIDLQGKDGKRS

SEQ ID NO: 91995 - protein, 17 aa, Mycobacterium avium
TNPSPYMYLLHVPNDAG

SEQ ID NO: 91996 - protein, 24 aa, Mycobacterium avium
TNVPGPRRRLRVMGQTLERLLPVP

SEQ ID NO: 91997 - protein, 18 aa, Mycobacterium avium
TNVTKLPGLGSWRRPQAE

SEQ ID NO: 91998 - protein, 19 aa, Mycobacterium avium
TPAALLRCLVEGADEVHVD

SEQ ID NO: 91999 - protein, 23 aa, Mycobacterium avium
TPAEFVTPGWFASFIPVTVPVAG

SEQ ID NO: 92000 - protein, 18 aa, Mycobacterium avium
TPAFEWYYQSGLSVIMPV

SEQ ID NO: 92001 - protein, 24 aa, Mycobacterium avium
TPDACPSWLRPLVDNVDDVPDAAR

SEQ ID NO: 92002 - protein, 28 aa, Mycobacterium avium
TPDEGRALARICALNALAAVDALVGIDA

SEQ ID NO: 92003 - protein, 17 aa, Mycobacterium avium
TPEDLRPDWSMPSAEQF

SEQ ID NO: 92004 - protein, 21 aa, Mycobacterium avium
TPEGVGWLYNFIRAQGERNYG

SEQ ID NO: 92005 - protein, 19 aa, Mycobacterium avium
TPERLRLLEIFDRETRRLR

SEQ ID NO: 92006 - protein, 22 aa, Mycobacterium avium
TPGKMYSRFGGYLDQIDEFDPE

SEQ ID NO: 92007 - protein, 24 aa, Mycobacterium avium
TPGRQVLFDRLRRLAADVIALGES

SEQ ID NO: 92008 - protein, 18 aa, Mycobacterium avium
TPHFDGYPAVLVNLDAIS

SEQ ID NO: 92009 - protein, 18 aa, Mycobacterium avium
TPIPRTVALTVYGDLETS

SEQ ID NO: 92010 - protein, 22 aa, Mycobacterium avium
TPIRSILSFELFVDRTSMAALN

SEQ ID NO: 92011 - protein, 18 aa, Mycobacterium avium
TPLFEFAIRSALAELDLD

SEQ ID NO: 92012 - protein, 28 aa, Mycobacterium avium
TPLFVMLLAESWRWGADEAVIRSLLPAA

SEQ ID NO: 92013 - protein, 26 aa, Mycobacterium avium
TPLPLCWGEYRPGTLTTGRWGLLEPA

SEQ ID NO: 92014 - protein, 17 aa, Mycobacterium avium
TPLRGNELWQIALLELW

SEQ ID NO: 92015 - protein, 20 aa, Mycobacterium avium
TPRILRPGPVSAQRIAEVLG

SEQ ID NO: 92016 - protein, 25 aa, Mycobacterium avium
TPSFITNWNEFWSVVTGVYSPQSWT

SEQ ID NO: 92017 - protein, 19 aa, Mycobacterium avium
TPSKGAWQFIEPTFAAYHQ

SEQ ID NO: 92018 - protein, 19 aa, Mycobacterium avium
TQDSMCSWFTYSTADANKE

SEQ ID NO: 92019 - protein, 17 aa, Mycobacterium avium
TQILAAFGQTEMSPVTC

SEQ ID NO: 92020 - protein, 22 aa, Mycobacterium avium
TQKEFLLRQQLAAIRKELGEGE

SEQ ID NO: 92021 - protein, 18 aa, Mycobacterium avium
TQLGRLDIVLANAALASE

SEQ ID NO: 92022 - protein, 19 aa, Mycobacterium avium
TQLLRAHPLNREWVDCPDF

SEQ ID NO: 92023 - protein, 17 aa, Mycobacterium avium
TQMLCIFIGGTETVPKI

SEQ ID NO: 92024 - protein, 17 aa, Mycobacterium avium
TQPSSVQHKGDRDLVSD

SEQ ID NO: 92025 - protein, 17 aa, Mycobacterium avium
TQRDPWVNMLRCTLAAF

SEQ ID NO: 92026 - protein, 18 aa, Mycobacterium avium
TQVESMILPPIAHDVRVI

SEQ ID NO: 92027 - protein, 19 aa, Mycobacterium avium
TRAAIDMAARTVIARKGVL

SEQ ID NO: 92028 - protein, 24 aa, Mycobacterium avium
TRAQRPEWLAAAAAVTAGQPDRDD

SEQ ID NO: 92029 - protein, 21 aa, Mycobacterium avium
TRAVVAFGGLQDCCVQFPDAP

SEQ ID NO: 92030 - protein, 20 aa, Mycobacterium avium
TRDMNLSAFVMFSSMAGLVG

SEQ ID NO: 92031 - protein, 24 aa, Mycobacterium avium
TRFKRKEHWLDVHFSGDGSVIMPG

SEQ ID NO: 92032 - protein, 30 aa, Mycobacterium avium
TRFRRMLSKPFTFKRVEGLRPTIQQITDEH

SEQ ID NO: 92033 - protein, 26 aa, Mycobacterium avium
TRHGDSWLLNGFKWFASNCAGEAFIV

SEQ ID NO: 92034 - protein, 18 aa, Mycobacterium avium
TRHPRAWQRMRPVLEETL

SEQ ID NO: 92035 - protein, 17 aa, Mycobacterium avium
TRILQAFNDGMKHRPHS

SEQ ID NO: 92036 - protein, 20 aa, Mycobacterium avium
TRIWRDGRVEQLGWPRVKIH

SEQ ID NO: 92037 - protein, 18 aa, Mycobacterium avium
TRLAAALFDAAPTVHGHV

SEQ ID NO: 92038 - protein, 22 aa, Mycobacterium avium
TRLGPLPPLRMHPGEAPILDHY

SEQ ID NO: 92039 - protein, 20 aa, Mycobacterium avium
TRLLTGLGYSGYFELDGARR

SEQ ID NO: 92040 - protein, 23 aa, Mycobacterium avium
TRLPDLKVFICGGASVSPSLIRR

SEQ ID NO: 92041 - protein, 25 aa, Mycobacterium avium
TRLQRWGNRPALSRPATGPSLPELF

SEQ ID NO: 92042 - protein, 31 aa, Mycobacterium avium
TRLRRADVRGAYRIAGPLNVPGSRQGDLPVW

SEQ ID NO: 92043 - protein, 20 aa, Mycobacterium avium
TRLTPETDYAVLARACGGSG

SEQ ID NO: 92044 - protein, 20 aa, Mycobacterium avium
TRLVPERGYDLELITPVPLP

SEQ ID NO: 92045 - protein, 32 aa, Mycobacterium avium
TRNAAAYWRSRAKEAGGRIFGRIVNTASEAGL

SEQ ID NO: 92046 - protein, 17 aa, Mycobacterium avium
TRNEGQWALGDREPLND

SEQ ID NO: 92047 - protein, 34 aa, Mycobacterium avium
TRPGDTWLADRSWNRPGWTVAELEAAKAGRTISV

SEQ ID NO: 92048 - protein, 21 aa, Mycobacterium avium
TRRLFAGGGFGGRRFDTGGFG

SEQ ID NO: 92049 - protein, 22 aa, Mycobacterium avium
TRSRTGKMLPPKLGLLSYVADA

SEQ ID NO: 92050 - protein, 24 aa, Mycobacterium avium
TRVPGIGKRGAERMVLELRDKIGA

SEQ ID NO: 92051 - protein, 24 aa, Mycobacterium avium
TRVSLACALVCRPDLLVLDEPTVG

SEQ ID NO: 92052 - protein, 19 aa, Mycobacterium avium
TRYASCGDTDIAYQVLGDG

SEQ ID NO: 92053 - protein, 25 aa, Mycobacterium avium
TRYLRAVPLPGMGVVHDMALTTRYA

SEQ ID NO: 92054 - protein, 18 aa, Mycobacterium avium
TSALRLAPALGAARTIAV

SEQ ID NO: 92055 - protein, 27 aa, Mycobacterium avium
TSASAALIWRRPRWAKRLQPEPVADLL

SEQ ID NO: 92056 - protein, 19 aa, Mycobacterium avium
TSDQHVWCFLGDGEMDEPE

SEQ ID NO: 92057 - protein, 18 aa, Mycobacterium avium
TSEFLTHPAFTQYRTETA

SEQ ID NO: 92058 - protein, 17 aa, Mycobacterium avium
TSGRPNPDFEVRILDAH

SEQ ID NO: 92059 - protein, 29 aa, Mycobacterium avium
TSHKEVLLHLSAEGWVRWSNTVSDKLAQP

SEQ ID NO: 92060 - protein, 19 aa, Mycobacterium avium
TSIPEVFAAHVARTPHAVA

SEQ ID NO: 92061 - protein, 23 aa, Mycobacterium avium
TSLDPHGPVAFWGYSQGGGATAS

SEQ ID NO: 92062 - protein, 30 aa, Mycobacterium avium
TSLGESVARALGRKFVRVALGGVRDEAEIR

SEQ ID NO: 92063 - protein, 18 aa, Mycobacterium avium
TSLGHRADWCQLYVRTDP

SEQ ID NO: 92064 - protein, 24 aa, Mycobacterium avium
TSPHLQAAVAFKNFQYTAAAQKVW

SEQ ID NO: 92065 - protein, 28 aa, Mycobacterium avium
TSTPQTLEWGCFTYGIIQHAEYFTFYAS

SEQ ID NO: 92066 - protein, 17 aa, Mycobacterium avium
TSVFRATRAALRYFRDA

SEQ ID NO: 92067 - protein, 26 aa, Mycobacterium avium
TSWDLRKFLWAPKLGCYGIQRIHPLK

SEQ ID NO: 92068 - protein, 18 aa, Mycobacterium avium
TSYQAAVFEAEFGDGSKL

SEQ ID NO: 92069 - protein, 29 aa, Mycobacterium avium
TSYRGSVREACLWSAGLTQSGVRRRATVL

SEQ ID NO: 92070 - protein, 23 aa, Mycobacterium avium
TTADRGRAGLSIYAATKAAVRSL

SEQ ID NO: 92071 - protein, 28 aa, Mycobacterium avium
TTEAEYAEMWARDAAAMYGYAGAAAAAT

SEQ ID NO: 92072 - protein, 24 aa, Mycobacterium avium
TTFTKRGRLGIRWYTSKQGHGEPN

SEQ ID NO: 92073 - protein, 24 aa, Mycobacterium avium
TTFTPRHMGVMFGAPGGDYCHGLL

SEQ ID NO: 92074 - protein, 18 aa, Mycobacterium avium
TTGTGVCATCYGRSMATG

SEQ ID NO: 92075 - protein, 24 aa, Mycobacterium avium
TTKDGDWTIVQGLEIDEFSRSRID

SEQ ID NO: 92076 - protein, 18 aa, Mycobacterium avium
TTLGVMHFAETVFGRPVR

SEQ ID NO: 92077 - protein, 20 aa, Mycobacterium avium
TTLHEILELVAPQSGSIEVL

SEQ ID NO: 92078 - protein, 17 aa, Mycobacterium avium
TTMAWPQQADHTAHAEQ

SEQ ID NO: 92079 - protein, 25 aa, Mycobacterium avium
TTMNTRGRLAVSFARPPERFTDGLC

SEQ ID NO: 92080 - protein, 26 aa, Mycobacterium avium
TTRSVLPGGLNWPLDLAVGHDGRLYV

SEQ ID NO: 92081 - protein, 23 aa, Mycobacterium avium
TTVKAGLELLDFKVGDPRAPLLP

SEQ ID NO: 92082 - protein, 18 aa, Mycobacterium avium
TVAALGCTVLMEIGPQPV

SEQ ID NO: 92083 - protein, 19 aa, Mycobacterium avium
TVAKRGAAIIDARGASSAA

SEQ ID NO: 92084 - protein, 19 aa, Mycobacterium avium
TVAPLCDAMARLGGVTMSK

SEQ ID NO: 92085 - protein, 29 aa, Mycobacterium avium
TVASGPSMVRWARENGWSAAPGAGARDLA

SEQ ID NO: 92086 - protein, 19 aa, Mycobacterium avium
TVERFNRFAAKGLDPDFGR

SEQ ID NO: 92087 - protein, 28 aa, Mycobacterium avium
TVFADFPGLEVCVYAAPSQTVIGGPPEQ

SEQ ID NO: 92088 - protein, 17 aa, Mycobacterium avium
TVFTLSGGHLFSIYDGC

SEQ ID NO: 92089 - protein, 20 aa, Mycobacterium avium
TVGLGYRPVEYDALGADFGR

SEQ ID NO: 92090 - protein, 18 aa, Mycobacterium avium
TVIDVLRGKLEFESGEEG

SEQ ID NO: 92091 - protein, 18 aa, Mycobacterium avium
TVIKANWQRAAKLLGGAR

SEQ ID NO: 92092 - protein, 17 aa, Mycobacterium avium
TVLYVTCEVVRIAALLV

SEQ ID NO: 92093 - protein, 29 aa, Mycobacterium avium
TVPDALVGLCWPAVFAAIGAAATDTGVPV

SEQ ID NO: 92094 - protein, 20 aa, Mycobacterium avium
TVPPGAVPTPSGWEVTTHGG

SEQ ID NO: 92095 - protein, 18 aa, Mycobacterium avium
TVRGLRVLEQLAFDERRL

SEQ ID NO: 92096 - protein, 18 aa, Mycobacterium avium
TVRHCARIALGELGLPPA

SEQ ID NO: 92097 - protein, 17 aa, Mycobacterium avium
TVSLYFVLYRPDQRVGD

SEQ ID NO: 92098 - protein, 24 aa, Mycobacterium avium
TVVALRSAQLITFTAMDIDDPRAL

SEQ ID NO: 92099 - protein, 27 aa, Mycobacterium avium
TVYLARWLHPGQRAFQLATQIALLTQP

SEQ ID NO: 92100 - protein, 22 aa, Mycobacterium avium
TWADPWPMYRALRDHDPVHHVV

SEQ ID NO: 92101 - protein, 19 aa, Mycobacterium avium
TWDLLRLTRMPTVQVDVGY

SEQ ID NO: 92102 - protein, 18 aa, Mycobacterium avium
TWGNQFISSGFPINLLGV

SEQ ID NO: 92103 - protein, 24 aa, Mycobacterium avium
TWGVMGIGMGFAIGAAVETGRPVV

SEQ ID NO: 92104 - protein, 29 aa, Mycobacterium avium
TWLRTELRRAPRLGFEIDIDDAKISLPQI

SEQ ID NO: 92105 - protein, 24 aa, Mycobacterium avium
TWRSATCRVLAAATGSRTANAGPV

SEQ ID NO: 92106 - protein, 24 aa, Mycobacterium avium
TYAVPRLLARNGLSLQDFDFYEIH

SEQ ID NO: 92107 - protein, 21 aa, Mycobacterium avium
TYDRSQIGIGIAHFGVGGFHR

SEQ ID NO: 92108 - protein, 24 aa, Mycobacterium avium
TYKAWFPLTRRWLGFEDAHITFEA

SEQ ID NO: 92109 - protein, 17 aa, Mycobacterium avium
TYLDLPLFAGRPAPGLA

SEQ ID NO: 92110 - protein, 20 aa, Mycobacterium avium
TYLYRDGSDFVFMDSQDYEQ

SEQ ID NO: 92111 - protein, 18 aa, Mycobacterium avium
TYRCPGCDHEIRSGAAHL

SEQ ID NO: 92112 - protein, 28 aa, Mycobacterium avium
TYVFDFGRREVRNFLVANALYWLQEFHI

SEQ ID NO: 92113 - protein, 20 aa, Mycobacterium avium
TYVGALPGRIVRAIGEAGSM

SEQ ID NO: 92114 - protein, 20 aa, Mycobacterium avium
VAAALGERLPACDPAIITEL

SEQ ID NO: 92115 - protein, 19 aa, Mycobacterium avium
VAAAPEFRTLIRGPLDTDR

SEQ ID NO: 92116 - protein, 20 aa, Mycobacterium avium
VAAARRLRVPEERWVFLHGH

SEQ ID NO: 92117 - protein, 21 aa, Mycobacterium avium
VAADGRPLVAPIWFVVDDGEL

SEQ ID NO: 92118 - protein, 17 aa, Mycobacterium avium
VAAEAGVKPALVHYYFP

SEQ ID NO: 92119 - protein, 33 aa, Mycobacterium avium
VAAERPAVVPLSFAQSRLWFIGQLHGPSPVYNM

SEQ ID NO: 92120 - protein, 22 aa, Mycobacterium avium
VAAGIDCIEHGFLIDDEAIASM

SEQ ID NO: 92121 - protein, 24 aa, Mycobacterium avium
VAAGIPAVTFWAAVPHYVSQPPNP

SEQ ID NO: 92122 - protein, 26 aa, Mycobacterium avium
VAAIVPWNMPQFLIVTKLIPALLAGC

SEQ ID NO: 92123 - protein, 18 aa, Mycobacterium avium
VAAMLASARLGRIAPVSR

SEQ ID NO: 92124 - protein, 30 aa, Mycobacterium avium
VACIPSLYEGFSLPAVEAMASGTPIVASRV

SEQ ID NO: 92125 - protein, 20 aa, Mycobacterium avium
VADALRPGDQLVLGASNPVR

SEQ ID NO: 92126 - protein, 19 aa, Mycobacterium avium
VADAYRFLPTLGEVDLHLF

SEQ ID NO: 92127 - protein, 26 aa, Mycobacterium avium
VAEELGQPLPLFIKWDDAEYGLRAGE

SEQ ID NO: 92128 - protein, 24 aa, Mycobacterium avium
VAELGLPVVVRPSFTMGGLGSGMA

SEQ ID NO: 92129 - protein, 18 aa, Mycobacterium avium
VAFGRYPTFEGYQQQLGG

SEQ ID NO: 92130 - protein, 17 aa, Mycobacterium avium
VAFITGAARGQGRAHAV

SEQ ID NO: 92131 - protein, 23 aa, Mycobacterium avium
VAFLEAGAGWVPFFIDRLHEHYE

SEQ ID NO: 92132 - protein, 35 aa, Mycobacterium avium
VAGERPAVIPLSFAQTRLWFIDQFQGPSPMYNITV

SEQ ID NO: 92133 - protein, 29 aa, Mycobacterium avium
VAGGLARHVLCFRTLWEATHTELMKQGKI

SEQ ID NO: 92134 - protein, 18 aa, Mycobacterium avium
VAGHGFGASAAVFAAAGM

SEQ ID NO: 92135 - protein, 31 aa, Mycobacterium avium
VAGLGRKLIEVPVGFKWFVDGLIGGTLGFGG

SEQ ID NO: 92136 - protein, 26 aa, Mycobacterium avium
VAGRAAPRLGDGWLVAPAIAYGASGE

SEQ ID NO: 92137 - protein, 18 aa, Mycobacterium avium
VAGVWMWDGDVAVSASLS

SEQ ID NO: 92138 - protein, 17 aa, Mycobacterium avium
VAGYRIDLDLTDGNGAP

SEQ ID NO: 92139 - protein, 23 aa, Mycobacterium avium
VAHPDRRTVLLIGDGAAQLTVQE

SEQ ID NO: 92140 - protein, 18 aa, Mycobacterium avium
VAIRALVPRRGVNEIMDE

SEQ ID NO: 92141 - protein, 25 aa, Mycobacterium avium
VALAARLQLPIDVIATVPMAENMPS

SEQ ID NO: 92142 - protein, 30 aa, Mycobacterium avium
VALDFPELVIVCGHVGYPWTEEMVAVARKH

SEQ ID NO: 92143 - protein, 21 aa, Mycobacterium avium
VALHADFPPERITFHGNNKSV

SEQ ID NO: 92144 - protein, 17 aa, Mycobacterium avium
VALHAWSDVGVFPILGM

SEQ ID NO: 92145 - protein, 17 aa, Mycobacterium avium
VANAGIANWARLWEMSE

SEQ ID NO: 92146 - protein, 17 aa, Mycobacterium avium
VANLLAFQPEERIAQVI

SEQ ID NO: 92147 - protein, 17 aa, Mycobacterium avium
VANVIAFLASDAAAAVH

SEQ ID NO: 92148 - protein, 18 aa, Mycobacterium avium
VAPELAQAYRVNALRTAQ

SEQ ID NO: 92149 - protein, 22 aa, Mycobacterium avium
VAPRHAEEWLREPLQRACEAGN

SEQ ID NO: 92150 - protein, 22 aa, Mycobacterium avium
VAQASGIRYLGFRQEASAGNAA

SEQ ID NO: 92151 - protein, 24 aa, Mycobacterium avium
VARARPHARRNGGRVVVASYLLAD

SEQ ID NO: 92152 - protein, 19 aa, Mycobacterium avium
VARHGVNRCQPRPTDKVVV

SEQ ID NO: 92153 - protein, 17 aa, Mycobacterium avium
VARHVRLLIDRSGLGQQ

SEQ ID NO: 92154 - protein, 22 aa, Mycobacterium avium
VARMASRLVGAVLIGRDRREVA

SEQ ID NO: 92155 - protein, 19 aa, Mycobacterium avium
VARRRGISVLGDRPPMVSV

SEQ ID NO: 92156 - protein, 26 aa, Mycobacterium avium
VASAGRGGYGMGPRYGVKPKVMPTRL

SEQ ID NO: 92157 - protein, 21 aa, Mycobacterium avium
VASGFGRKAQWFRNIRANPRV

SEQ ID NO: 92158 - protein, 24 aa, Mycobacterium avium
VASKIMPVAPFPAVVRQRARASAR

SEQ ID NO: 92159 - protein, 17 aa, Mycobacterium avium
VASLAFLPWPLRVLAGP

SEQ ID NO: 92160 - protein, 23 aa, Mycobacterium avium
VASPRLDALIFGVGDFSLSQGAR

SEQ ID NO: 92161 - protein, 17 aa, Mycobacterium avium
VASSLYFMRTLGEGMAG

SEQ ID NO: 92162 - protein, 20 aa, Mycobacterium avium
VASVAWSGVPPGVFDAAEDT

SEQ ID NO: 92163 - protein, 34 aa, Mycobacterium avium
VATADQRLICYARDRGCTRPNCLEPGYHCEVHHA

SEQ ID NO: 92164 - protein, 18 aa, Mycobacterium avium
VAVARPLLPAAIESSAAV

SEQ ID NO: 92165 - protein, 30 aa, Mycobacterium avium
VAVASPGYPCYRNILSALGCEVVEIPCGPQ

SEQ ID NO: 92166 - protein, 22 aa, Mycobacterium avium
VAVDLRDDWPKALVEAGFDKGQ

SEQ ID NO: 92167 - protein, 21 aa, Mycobacterium avium
VAVDLRDDWSTALATAGLDSS

SEQ ID NO: 92168 - protein, 32 aa, Mycobacterium avium
VAVERPAVVPLSFAQQRLWFIDQLLGPSPIYN

SEQ ID NO: 92169 - protein, 17 aa, Mycobacterium avium
VAVGDRVMGLFPDGTGT

SEQ ID NO: 92170 - protein, 17 aa, Mycobacterium avium
VAVLAPRSPSDCFETAL

SEQ ID NO: 92171 - protein, 20 aa, Mycobacterium avium
VAWRDARGALCVGPRSCPHL

SEQ ID NO: 92172 - protein, 18 aa, Mycobacterium avium
VCGDRRLVTLDGPEVGAL

SEQ ID NO: 92173 - protein, 18 aa, Mycobacterium avium
VCPALHMPLQSGSDRVLR

SEQ ID NO: 92174 - protein, 17 aa, Mycobacterium avium
VDACHARGLGVLIDAVF

SEQ ID NO: 92175 - protein, 24 aa, Mycobacterium avium
VDAKPAQVALAWLISYPGVVAIPG

SEQ ID NO: 92176 - protein, 17 aa, Mycobacterium avium
VDARGWPEDRLREAMSA

SEQ ID NO: 92177 - protein, 28 aa, Mycobacterium avium
VDDPLAMYLFDLCTLPLNLAGHCGMSVP

SEQ ID NO: 92178 - protein, 19 aa, Mycobacterium avium
VDELLRSGTLVDLYPLVRR

SEQ ID NO: 92179 - protein, 24 aa, Mycobacterium avium
VDGDCGRWLDLCAGPGGKTALLAS

SEQ ID NO: 92180 - protein, 19 aa, Mycobacterium avium
VDGPYYFFGVLAKLAVLPR

SEQ ID NO: 92181 - protein, 17 aa, Mycobacterium avium
VDGRLRAACALIADNLR

SEQ ID NO: 92182 - protein, 26 aa, Mycobacterium avium
VDGSPASNFAVCWAARDAAMRNVPLT

SEQ ID NO: 92183 - protein, 25 aa, Mycobacterium avium
VDIGRGRNGVLYAGEVNWEAAGLGG

SEQ ID NO: 92184 - protein, 19 aa, Mycobacterium avium
VDKGLRRWRAVAKAAARQS

SEQ ID NO: 92185 - protein, 24 aa, Mycobacterium avium
VDLDLPRDALIVFTGLSGSGKSSL

SEQ ID NO: 92186 - protein, 22 aa, Mycobacterium avium
VDLFPTWLRIATRMAGWSKRTA

SEQ ID NO: 92187 - protein, 18 aa, Mycobacterium avium
VDLLEEFARSGRCIPRAE

SEQ ID NO: 92188 - protein, 25 aa, Mycobacterium avium
VDLRAEGFAGIATRNQRMVDRGADV

SEQ ID NO: 92189 - protein, 19 aa, Mycobacterium avium
VDLREDWPQALRDSGFDPD

SEQ ID NO: 92190 - protein, 33 aa, Mycobacterium avium
VDLRREVHDAARRARVASRVLALLPTVAKDQAL

SEQ ID NO: 92191 - protein, 20 aa, Mycobacterium avium
VDLSRTVGWFTTKYPVALAI

SEQ ID NO: 92192 - protein, 22 aa, Mycobacterium avium
VDLYSAPSMRELDTWAVDRVHA

SEQ ID NO: 92193 - protein, 17 aa, Mycobacterium avium
VDMFGADALRFTLARGA

SEQ ID NO: 92194 - protein, 22 aa, Mycobacterium avium
VDPMIREWLTVLLRRDLGLLVM

SEQ ID NO: 92195 - protein, 20 aa, Mycobacterium avium
VDPTRRCARCGSDAVRAVVV

SEQ ID NO: 92196 - protein, 25 aa, Mycobacterium avium
VDRCARAGAALAWAALHDAAHAKAL

SEQ ID NO: 92197 - protein, 28 aa, Mycobacterium avium
VDREMKVILWNRGCEELWGLRADETTGT

SEQ ID NO: 92198 - protein, 25 aa, Mycobacterium avium
VDRGGGLPAALVLAEAVSWQGRGEE

SEQ ID NO: 92199 - protein, 21 aa, Mycobacterium avium
VDRIISFEAFDAFKKERWPAF

SEQ ID NO: 92200 - protein, 23 aa, Mycobacterium avium
VDRVKDMIVTGGFNVFPREVEDV

SEQ ID NO: 92201 - protein, 24 aa, Mycobacterium avium
VDSKSAAMGTGFVALAAARAAAAG

SEQ ID NO: 92202 - protein, 25 aa, Mycobacterium avium
VDTEIPSPVAGVLISITAEEDSTVP

SEQ ID NO: 92203 - protein, 32 aa, Mycobacterium avium
VDTRIRFLPPDSWGNHEWDTMTAMPAVSAAVD

SEQ ID NO: 92204 - protein, 18 aa, Mycobacterium avium
VDVERFDQEPARPILHGL

SEQ ID NO: 92205 - protein, 17 aa, Mycobacterium avium
VEAALCTHPAVADSAVF

SEQ ID NO: 92206 - protein, 20 aa, Mycobacterium avium
VEALVGLGFAAKQAEEATDK

SEQ ID NO: 92207 - protein, 19 aa, Mycobacterium avium
VEATLRWAGNSMTTNGVSV

SEQ ID NO: 92208 - protein, 20 aa, Mycobacterium avium
VEAVHRLDSLGAVFSTVSHE

SEQ ID NO: 92209 - protein, 26 aa, Mycobacterium avium
VECGVWRGGASILMRAVLSAYGDEKR

SEQ ID NO: 92210 - protein, 19 aa, Mycobacterium avium
VECHRLWGRGLSAIDVHLL

SEQ ID NO: 92211 - protein, 23 aa, Mycobacterium avium
VEEPGRLREALVGARREAASSFG

SEQ ID NO: 92212 - protein, 17 aa, Mycobacterium avium
VEEYGKIVDYLVEQIAA

SEQ ID NO: 92213 - protein, 20 aa, Mycobacterium avium
VEFSTWTPHWFGVVDGPVEA

SEQ ID NO: 92214 - protein, 25 aa, Mycobacterium avium
VEHLTALCWDGGAALPFNADDIRTI

SEQ ID NO: 92215 - protein, 23 aa, Mycobacterium avium
VEIEGSPSMRCEFEMAEDHDHDL

SEQ ID NO: 92216 - protein, 17 aa, Mycobacterium avium
VEIGDGFRIPELLESTG

SEQ ID NO: 92217 - protein, 37 aa, Mycobacterium avium
VEIGDLHWFYVYSGVMWACVFMRTGARRVHFGETEKP

SEQ ID NO: 92218 - protein, 25 aa, Mycobacterium avium
VEILPTPFLPAGVFDVWGLPDDDPR

SEQ ID NO: 92219 - protein, 20 aa, Mycobacterium avium
VEINEAFAAVALASTRELGV

SEQ ID NO: 92220 - protein, 23 aa, Mycobacterium avium
VEIRMPVVVDPEWERPARSVTNE

SEQ ID NO: 92221 - protein, 21 aa, Mycobacterium avium
VELARSGVIHALWVSDAPDGD

SEQ ID NO: 92222 - protein, 17 aa, Mycobacterium avium
VELFKPLATKATRPEVR

SEQ ID NO: 92223 - protein, 19 aa, Mycobacterium avium
VELKTSWYSFITPLQAGAV

SEQ ID NO: 92224 - protein, 22 aa, Mycobacterium avium
VELRIPLRETFAGKAKGHGRHV

SEQ ID NO: 92225 - protein, 19 aa, Mycobacterium avium
VELTLRLAAEMLALAGVGD

SEQ ID NO: 92226 - protein, 21 aa, Mycobacterium avium
VEMRNRLKTATGLALSPTLIF

SEQ ID NO: 92227 - protein, 28 aa, Mycobacterium avium
VEPDPRQPGAFVVSGARPERWVRQTNFD

SEQ ID NO: 92228 - protein, 18 aa, Mycobacterium avium
VEPGRGLLLTELHPGVTV

SEQ ID NO: 92229 - protein, 17 aa, Mycobacterium avium
VEPRKGDNAPMAVIELV

SEQ ID NO: 92230 - protein, 27 aa, Mycobacterium avium
VEPVLTRSGAEWMPNFIDLLQRKLSRI

SEQ ID NO: 92231 - protein, 34 aa, Mycobacterium avium
VERTLAWRSLFRQRLGVAVPDGHRFARGAAVSMV

SEQ ID NO: 92232 - protein, 23 aa, Mycobacterium avium
VESDPRAAAVIARNIDTLGLPGA

SEQ ID NO: 92233 - protein, 19 aa, Mycobacterium avium
VESLPLIASSVMSKKLAEG

SEQ ID NO: 92234 - protein, 17 aa, Mycobacterium avium
VESRDVTEAVLWLAGPR

SEQ ID NO: 92235 - protein, 19 aa, Mycobacterium avium
VETERRFYLANSVEMTPRN

SEQ ID NO: 92236 - protein, 26 aa, Mycobacterium avium
VETLLVVMCGVGLYAGYVETYQEMLA

SEQ ID NO: 92237 - protein, 29 aa, Mycobacterium avium
VEVKTRGWLSRDWRCYFGSQVSQQQLDAR

SEQ ID NO: 92238 - protein, 19 aa, Mycobacterium avium
VEVMSRVPLGAARATGTPY

SEQ ID NO: 92239 - protein, 19 aa, Mycobacterium avium
VEVRGWLEGLRAARRAVPV

SEQ ID NO: 92240 - protein, 24 aa, Mycobacterium avium
VFAAEGFAGATIDAIGQAAGFTKG

SEQ ID NO: 92241 - protein, 19 aa, Mycobacterium avium
VFAAHVARTPHAVAVTCGR

SEQ ID NO: 92242 - protein, 27 aa, Mycobacterium avium
VFDRFPTLRIVFVEHAFTWILPLMWRM

SEQ ID NO: 92243 - protein, 20 aa, Mycobacterium avium
VFDRLAGRLSYLSGDVTDTG

SEQ ID NO: 92244 - protein, 23 aa, Mycobacterium avium
VFERRPRLAAAGGAVTVWSNGET

SEQ ID NO: 92245 - protein, 18 aa, Mycobacterium avium
VFGFPVAAALLLQIMQHR

SEQ ID NO: 92246 - protein, 20 aa, Mycobacterium avium
VFRVGELEPAFAEELAARYD

SEQ ID NO: 92247 - protein, 18 aa, Mycobacterium avium
VFSGHKIYGPTGIGALYG

SEQ ID NO: 92248 - protein, 19 aa, Mycobacterium avium
VFVCPSVYEPLGIVNLEAM

SEQ ID NO: 92249 - protein, 17 aa, Mycobacterium avium
VFVDHGLLRAGERAQVQ

SEQ ID NO: 92250 - protein, 19 aa, Mycobacterium avium
VFWPNGRVVVTREAIQLFG

SEQ ID NO: 92251 - protein, 18 aa, Mycobacterium avium
VFWQLPPVQQLALSAFNI

SEQ ID NO: 92252 - protein, 18 aa, Mycobacterium avium
VGAIRLPRRVGWANAMEL

SEQ ID NO: 92253 - protein, 20 aa, Mycobacterium avium
VGAKLWVDMAHFAGLVAAGL

SEQ ID NO: 92254 - protein, 34 aa, Mycobacterium avium
VGARVVLVFLPRCGRCAACATEGLTPCEPGSAAN

SEQ ID NO: 92255 - protein, 20 aa, Mycobacterium avium
VGEFVAWLRLPLRARHGQVA

SEQ ID NO: 92256 - protein, 23 aa, Mycobacterium avium
VGEPCYLGGAGRWRDSGMPGTPK

SEQ ID NO: 92257 - protein, 18 aa, Mycobacterium avium
VGFFKNVMQLTHPAFLIL

SEQ ID NO: 92258 - protein, 18 aa, Mycobacterium avium
VGFGCNLALAADFTVAAA

SEQ ID NO: 92259 - protein, 19 aa, Mycobacterium avium
VGGGPGYFAAAFADAGVRY

SEQ ID NO: 92260 - protein, 24 aa, Mycobacterium avium
VGGKLPGWRDYEGVLGVAGDAPPV

SEQ ID NO: 92261 - protein, 18 aa, Mycobacterium avium
VGGRGSGAVMVLAGPPGV

SEQ ID NO: 92262 - protein, 29 aa, Mycobacterium avium
VGGTAAWQGLKTLFSREMLDGLTSENVIS

SEQ ID NO: 92263 - protein, 19 aa, Mycobacterium avium
VGIAHELLRAGATVVGCAR

SEQ ID NO: 92264 - protein, 25 aa, Mycobacterium avium
VGIDNWRWAGVPVYLRTGKRMAEGI

SEQ ID NO: 92265 - protein, 25 aa, Mycobacterium avium
VGLRDVLAALEWVRDNITAFGGDPR

SEQ ID NO: 92266 - protein, 17 aa, Mycobacterium avium
VGLRRARAMAMVMLALP

SEQ ID NO: 92267 - protein, 19 aa, Mycobacterium avium
VGMRARRYGTEMNIRARTG

SEQ ID NO: 92268 - protein, 31 aa, Mycobacterium avium
VGNNFPVFFIQDGIKFPDFVHAVKPEPHNEI

SEQ ID NO: 92269 - protein, 17 aa, Mycobacterium avium
VGPGYRPGRVGFPPYFR

SEQ ID NO: 92270 - protein, 18 aa, Mycobacterium avium
VGPRGRAAAELLPGVDEL

SEQ ID NO: 92271 - protein, 17 aa, Mycobacterium avium
VGPRLAMATLAVHDAGA

SEQ ID NO: 92272 - protein, 17 aa, Mycobacterium avium
VGQRILGDWAQQQRHFV

SEQ ID NO: 92273 - protein, 27 aa, Mycobacterium avium
VGRATRWRLSGLGLRVIAHDPYHPEAR

SEQ ID NO: 92274 - protein, 23 aa, Mycobacterium avium
VGRDIPLRLVYVIDPHGAPGGHG

SEQ ID NO: 92275 - protein, 34 aa, Mycobacterium avium
VGRFRFFLDGHRWEWSDAVARMHGYRPGQVQPST

SEQ ID NO: 92276 - protein, 22 aa, Mycobacterium avium
VGSEKLWMGETHAFPGSASDNH

SEQ ID NO: 92277 - protein, 27 aa, Mycobacterium avium
VGTGAGVSGLWLLSGMSDDGVLTTIDI

SEQ ID NO: 92278 - protein, 25 aa, Mycobacterium avium
VGTSLCYKLRLTVPGGATLKAAWLA

SEQ ID NO: 92279 - protein, 22 aa, Mycobacterium avium
VGVCTNTLCAIMGGDAIFDALK

SEQ ID NO: 92280 - protein, 24 aa, Mycobacterium avium
VGVDIVWWPGDRGLEQSMGVLPDR

SEQ ID NO: 92281 - protein, 19 aa, Mycobacterium avium
VGVLPTPAVAYLTGAYDAD

SEQ ID NO: 92282 - protein, 23 aa, Mycobacterium avium
VGVNFLTRWAIGELVASDVDVEG

SEQ ID NO: 92283 - protein, 30 aa, Mycobacterium avium
VGWFTTKYPVALAIDGLDWASVVAGDDALG

SEQ ID NO: 92284 - protein, 31 aa, Mycobacterium avium
VGYARIDPVLARELFIRHALVEGDWHTRHRF

SEQ ID NO: 92285 - protein, 21 aa, Mycobacterium avium
VGYPREWRRRKPYGWLRQVLP

SEQ ID NO: 92286 - protein, 33 aa, Mycobacterium avium
VGYWRRPGLTAARFLACPFGEPGTRMYRTGDLV

SEQ ID NO: 92287 - protein, 25 aa, Mycobacterium avium
VHDQSARMDLVFSLAERWNPDGEFA

SEQ ID NO: 92288 - protein, 17 aa, Mycobacterium avium
VHFCVGAALARLEAHIV

SEQ ID NO: 92289 - protein, 18 aa, Mycobacterium avium
VHGLPLPRRSPPADAPDE

SEQ ID NO: 92290 - protein, 19 aa, Mycobacterium avium
VHIPAGTVIMLCLGAANRD

SEQ ID NO: 92291 - protein, 25 aa, Mycobacterium avium
VHKVAELPAGHGLNAEKLSYGDLIA

SEQ ID NO: 92292 - protein, 17 aa, Mycobacterium avium
VHLPQRVPMGFHGNWVP

SEQ ID NO: 92293 - protein, 17 aa, Mycobacterium avium
VHLRIGRRLITLGDDRL

SEQ ID NO: 92294 - protein, 25 aa, Mycobacterium avium
VHNTWRFGIDRILAGVAMSDDSNAW

SEQ ID NO: 92295 - protein, 24 aa, Mycobacterium avium
VHTMVRPGLLTWRDVAKVMSENPA

SEQ ID NO: 92296 - protein, 18 aa, Mycobacterium avium
VHVDPGIAAAGRRSVQRM

SEQ ID NO: 92297 - protein, 23 aa, Mycobacterium avium
VHVTCLLGAASLLAGAREHWRGS

SEQ ID NO: 92298 - protein, 18 aa, Mycobacterium avium
VIASYCLTEPGAGSDAAA

SEQ ID NO: 92299 - protein, 27 aa, Mycobacterium avium
VICDKGFPSYFLIVADLINYARSVDIR

SEQ ID NO: 92300 - protein, 18 aa, Mycobacterium avium
VIDAPMFVTGEPRSGTTL

SEQ ID NO: 92301 - protein, 18 aa, Mycobacterium avium
VIDASGWSPARVDDAIRD

SEQ ID NO: 92302 - protein, 22 aa, Mycobacterium avium
VIDGCVQLHGGYGYMTEYRVAR

SEQ ID NO: 92303 - protein, 18 aa, Mycobacterium avium
VIDGRWTPPQHCAEGSPA

SEQ ID NO: 92304 - protein, 20 aa, Mycobacterium avium
VIDIKSDFLSSGSPFSRPVN

SEQ ID NO: 92305 - protein, 22 aa, Mycobacterium avium
VIEAALPGLHDWVDERLAQNGS

SEQ ID NO: 92306 - protein, 17 aa, Mycobacterium avium
VIEHLWDQTQFVVECAR

SEQ ID NO: 92307 - protein, 17 aa, Mycobacterium avium
VIETGIAQGVFRSVDVD

SEQ ID NO: 92308 - protein, 25 aa, Mycobacterium avium
VIGFFPANAIGPGFEDIELYTDDTR

SEQ ID NO: 92309 - protein, 28 aa, Mycobacterium avium
VIHDLCSATHPFGVGSPFWKEIDLPSYG

SEQ ID NO: 92310 - protein, 25 aa, Mycobacterium avium
VIHLRGHTPGSIALALDGAATGGVT

SEQ ID NO: 92311 - protein, 27 aa, Mycobacterium avium
VIKDGRPVDFGSFLIPRSEYRIDDVWH

SEQ ID NO: 92312 - protein, 24 aa, Mycobacterium avium
VILHGWLAFTFEICRQRIIDPTTD

SEQ ID NO: 92313 - protein, 19 aa, Mycobacterium avium
VILQCARALSDYGVEPRHL

SEQ ID NO: 92314 - protein, 19 aa, Mycobacterium avium
VIREYRPDATPGIMIPFLA

SEQ ID NO: 92315 - protein, 23 aa, Mycobacterium avium
VITKRAGVSVGALFRHFDTMGDF

SEQ ID NO: 92316 - protein, 24 aa, Mycobacterium avium
VITRGGFPEGCFQTLLVPSSAVER

SEQ ID NO: 92317 - protein, 17 aa, Mycobacterium avium
VKAAGTVEALREVKDAG

SEQ ID NO: 92318 - protein, 19 aa, Mycobacterium avium
VKAAVDVFKEKLIRRDISM

SEQ ID NO: 92319 - protein, 22 aa, Mycobacterium avium
VKAMAPECDLVIVVGSRNSSNS

SEQ ID NO: 92320 - protein, 27 aa, Mycobacterium avium
VKDCIQVLGGIGCTWEHDAHLYLRRAH

SEQ ID NO: 92321 - protein, 29 aa, Mycobacterium avium
VKDGYGRNFLLPRGLAIVASRGAQKQADD

SEQ ID NO: 92322 - protein, 18 aa, Mycobacterium avium
VKEVRLSNRLTDSPACLI

SEQ ID NO: 92323 - protein, 17 aa, Mycobacterium avium
VKGMLTGPVTILAWSFV

SEQ ID NO: 92324 - protein, 17 aa, Mycobacterium avium
VKIHGYCVAGGTDIALH

SEQ ID NO: 92325 - protein, 18 aa, Mycobacterium avium
VKLGLLPLLDAVLDAVSV

SEQ ID NO: 92326 - protein, 18 aa, Mycobacterium avium
VKQHPDRTVAGWRVVALQ

SEQ ID NO: 92327 - protein, 27 aa, Mycobacterium avium
VKRAHDQFRWFAGGWKVNADLPTPAGF

SEQ ID NO: 92328 - protein, 22 aa, Mycobacterium avium
VKRIVGAKGKAALLRELSDAVP

SEQ ID NO: 92329 - protein, 27 aa, Mycobacterium avium
VKRRYRAAHNIGHFRFVECSRLVDGRP

SEQ ID NO: 92330 - protein, 19 aa, Mycobacterium avium
VKSAKWKVGEEAAFAALGR

SEQ ID NO: 92331 - protein, 17 aa, Mycobacterium avium
VKSALDLGVPVTGIAEA

SEQ ID NO: 92332 - protein, 20 aa, Mycobacterium avium
VKSCVGTDWCRYGQQDSVQL

SEQ ID NO: 92333 - protein, 18 aa, Mycobacterium avium
VKYHFKTDQGIQWLPQEE

SEQ ID NO: 92334 - protein, 17 aa, Mycobacterium avium
VKYHLGATGVYLQMFGD

SEQ ID NO: 92335 - protein, 18 aa, Mycobacterium avium
VLAAFEWGTERDTWRVGE

SEQ ID NO: 92336 - protein, 18 aa, Mycobacterium avium
VLADYGRFLRSLVDTSGL

SEQ ID NO: 92337 - protein, 18 aa, Mycobacterium avium
VLAECKTEALAIKTMVDY

SEQ ID NO: 92338 - protein, 26 aa, Mycobacterium avium
VLALARRRLNVLWAMLRDHAVYHPAT

SEQ ID NO: 92339 - protein, 20 aa, Mycobacterium avium
VLALTRWAGEPAARDALGIA

SEQ ID NO: 92340 - protein, 17 aa, Mycobacterium avium
VLAPLGLVFDENSPWLS

SEQ ID NO: 92341 - protein, 19 aa, Mycobacterium avium
VLATDVLRGLRMVKEECEV

SEQ ID NO: 92342 - protein, 24 aa, Mycobacterium avium
VLDAWLRPVPPGVVGELYVGGAGV

SEQ ID NO: 92343 - protein, 26 aa, Mycobacterium avium
VLDDWLRPVPPGVVGELYLAGDGVGV

SEQ ID NO: 92344 - protein, 18 aa, Mycobacterium avium
VLDFKREVLAGVDAHPRA

SEQ ID NO: 92345 - protein, 19 aa, Mycobacterium avium
VLDGLRLAAAVVGAERGYV

SEQ ID NO: 92346 - protein, 22 aa, Mycobacterium avium
VLDGWSKPLLLQEIFAAYFGVR

SEQ ID NO: 92347 - protein, 18 aa, Mycobacterium avium
VLDLPAFRIGTVPVTNGE

SEQ ID NO: 92348 - protein, 18 aa, Mycobacterium avium
VLEAMGIPHTEVDLIVVN

SEQ ID NO: 92349 - protein, 21 aa, Mycobacterium avium
VLELAWTTGLIRWEDDPQPGW

SEQ ID NO: 92350 - protein, 26 aa, Mycobacterium avium
VLELLEPRLSPGVLVVADNTSAADTQ

SEQ ID NO: 92351 - protein, 17 aa, Mycobacterium avium
VLEWHARVPAWRDHYLS

SEQ ID NO: 92352 - protein, 18 aa, Mycobacterium avium
VLFDPGTFAHGFEGITGL

SEQ ID NO: 92353 - protein, 21 aa, Mycobacterium avium
VLFEEIGPFFADRNGGYTRII

SEQ ID NO: 92354 - protein, 24 aa, Mycobacterium avium
VLGMARCRIPVVAAVNGPAVGLGC

SEQ ID NO: 92355 - protein, 21 aa, Mycobacterium avium
VLGRAAGPLLRAGRVRLCGTV

SEQ ID NO: 92356 - protein, 23 aa, Mycobacterium avium
VLGWPSINVPAGFTSDGLPIGVQ

SEQ ID NO: 92357 - protein, 18 aa, Mycobacterium avium
VLGWRAQHSQSHYAAAKA

SEQ ID NO: 92358 - protein, 22 aa, Mycobacterium avium
VLIKAYHRWGDDFVSHLFGMFA

SEQ ID NO: 92359 - protein, 21 aa, Mycobacterium avium
VLKSGAAYLPIDPALPGERIG

SEQ ID NO: 92360 - protein, 18 aa, Mycobacterium avium
VLLDPGLRESVRHGVTTV

SEQ ID NO: 92361 - protein, 30 aa, Mycobacterium avium
VLLGKEWLKPTAYMMAKFGMTLCALGIAEE

SEQ ID NO: 92362 - protein, 17 aa, Mycobacterium avium
VLPAERADFGWEVVDAS

SEQ ID NO: 92363 - protein, 24 aa, Mycobacterium avium
VLPARGAVDLGFRLAPPAWLDPGQ

SEQ ID NO: 92364 - protein, 21 aa, Mycobacterium avium
VLPGLRQALGLAEDGTDERSA

SEQ ID NO: 92365 - protein, 24 aa, Mycobacterium avium
VLQALTFLRGPRTWVLKSPQHCEQ

SEQ ID NO: 92366 - protein, 24 aa, Mycobacterium avium
VLQIEGCKTWRVSDEPPVPPQQIQ

SEQ ID NO: 92367 - protein, 17 aa, Mycobacterium avium
VLRELPYDRALELGCGT

SEQ ID NO: 92368 - protein, 20 aa, Mycobacterium avium
VLRLEGLEVIGSVLPSAPAG

SEQ ID NO: 92369 - protein, 19 aa, Mycobacterium avium
VLRSFKRLLNDAGPQTRVK

SEQ ID NO: 92370 - protein, 21 aa, Mycobacterium avium
VLSLCGGTLPTALLGADANNP

SEQ ID NO: 92371 - protein, 17 aa, Mycobacterium avium
VLSRHGVELLNVEQVVI

SEQ ID NO: 92372 - protein, 19 aa, Mycobacterium avium
VLSSPGYRAAAQRAAAGIA

SEQ ID NO: 92373 - protein, 23 aa, Mycobacterium avium
VLTRPDAASGRRGKPEPSPVARE

SEQ ID NO: 92374 - protein, 21 aa, Mycobacterium avium
VLTRRVAYLIAARGVGVGQVL

SEQ ID NO: 92375 - protein, 19 aa, Mycobacterium avium
VLTTELPQTYALLGRTPRR

SEQ ID NO: 92376 - protein, 29 aa, Mycobacterium avium
VLVGWSLGGALAYACAIGLKRAGADVRFV

SEQ ID NO: 92377 - protein, 18 aa, Mycobacterium avium
VLVHLAWNQPLATRTDRV

SEQ ID NO: 92378 - protein, 29 aa, Mycobacterium avium
VLVRMRACGICGSDAFYISIGGVPPRQGH

SEQ ID NO: 92379 - protein, 18 aa, Mycobacterium avium
VLVRPNLLPLLVRKQLEL

SEQ ID NO: 92380 - protein, 17 aa, Mycobacterium avium
VLYGTGYLRKGIPGPRW

SEQ ID NO: 92381 - protein, 23 aa, Mycobacterium avium
VMADAAAALAEFDVPAEVRVVSA

SEQ ID NO: 92382 - protein, 17 aa, Mycobacterium avium
VMAVRRAVEKEGTPIAV

SEQ ID NO: 92383 - protein, 19 aa, Mycobacterium avium
VMDAEFLKDAGFVVVAPHT

SEQ ID NO: 92384 - protein, 24 aa, Mycobacterium avium
VMFKIKHERTADCVVAGYRVHKSG

SEQ ID NO: 92385 - protein, 18 aa, Mycobacterium avium
VMLGRPCYEVEFSDGTVI

SEQ ID NO: 92386 - protein, 34 aa, Mycobacterium avium
VMLKLSLPTEANFYRPLIEHPKVMRVVALSGGYS

SEQ ID NO: 92387 - protein, 24 aa, Mycobacterium avium
VMPTTCPECGTPLAPAKEGDADIR

SEQ ID NO: 92388 - protein, 32 aa, Mycobacterium avium
VMSFVAVCGQCRWCASGMEYLCDVGIGTMIPG

SEQ ID NO: 92389 - protein, 17 aa, Mycobacterium avium
VNGRWLAEYEIPADRAT

SEQ ID NO: 92390 - protein, 29 aa, Mycobacterium avium
VNGSWNWSSGCDHATWAFLGGPVIKDGRP

SEQ ID NO: 92391 - protein, 18 aa, Mycobacterium avium
VNHGWTYITGALDLERGA

SEQ ID NO: 92392 - protein, 23 aa, Mycobacterium avium
VNHRLALRNGVLVQRKVPADPAT

SEQ ID NO: 92393 - protein, 21 aa, Mycobacterium avium
VNIRGTFLLTKACLPHLRRAA

SEQ ID NO: 92394 - protein, 23 aa, Mycobacterium avium
VNIRIPGAPAFSIGYTQGADGEV

SEQ ID NO: 92395 - protein, 30 aa, Mycobacterium avium
VNKLRGRHIPKLRQVIGTVFQDFRLLQQKT

SEQ ID NO: 92396 - protein, 24 aa, Mycobacterium avium
VNLGWKLALVVGGASPPALLDTYH

SEQ ID NO: 92397 - protein, 25 aa, Mycobacterium avium
VNLNGPFFLCRAALPQLLERGGNIV

SEQ ID NO: 92398 - protein, 21 aa, Mycobacterium avium
VNRARRIERFLSQNMMAAEQF

SEQ ID NO: 92399 - protein, 23 aa, Mycobacterium avium
VNSEPRTGLSMGEHQAITAKQMG

SEQ ID NO: 92400 - protein, 24 aa, Mycobacterium avium
VPAAIRLLAAIGYDVVLLETVGVG

SEQ ID NO: 92401 - protein, 20 aa, Mycobacterium avium
VPAALLRWGVDQFDADQRPD

SEQ ID NO: 92402 - protein, 26 aa, Mycobacterium avium
VPALPRLGPTDALPRCRRTVHRGAVI

SEQ ID NO: 92403 - protein, 19 aa, Mycobacterium avium
VPALVAWKTGCSPANAHTI

SEQ ID NO: 92404 - protein, 22 aa, Mycobacterium avium
VPDRPVPMLSYIDIRKLPFGDY

SEQ ID NO: 92405 - protein, 17 aa, Mycobacterium avium
VPDSVKFDARGHIVSTQ

SEQ ID NO: 92406 - protein, 18 aa, Mycobacterium avium
VPDWLVWTHGCPGGESVA

SEQ ID NO: 92407 - protein, 18 aa, Mycobacterium avium
VPEGAIVVFSAHGVAPTV

SEQ ID NO: 92408 - protein, 22 aa, Mycobacterium avium
VPEVVDAVAPVPVLAAGGIARG

SEQ ID NO: 92409 - protein, 17 aa, Mycobacterium avium
VPGAGVLNVDAHTAVVL

SEQ ID NO: 92410 - protein, 26 aa, Mycobacterium avium
VPGGATLKAAWLAMIAVAATHLGRGV

SEQ ID NO: 92411 - protein, 20 aa, Mycobacterium avium
VPGPGARLVTTMTRHPGGAS

SEQ ID NO: 92412 - protein, 24 aa, Mycobacterium avium
VPGPTALLAPEWVPWEQRVRPGDL

SEQ ID NO: 92413 - protein, 19 aa, Mycobacterium avium
VPGRCDISAMNYAVNAYLR

SEQ ID NO: 92414 - protein, 17 aa, Mycobacterium avium
VPGSSSATMCVGSLDFG

SEQ ID NO: 92415 - protein, 23 aa, Mycobacterium avium
VPGVPRLGVPPLLMSDAGLGVTN

SEQ ID NO: 92416 - protein, 20 aa, Mycobacterium avium
VPHHPVRLARFGPRALLPAT

SEQ ID NO: 92417 - protein, 20 aa, Mycobacterium avium
VPICRTEYYINRSFAAVGRL

SEQ ID NO: 92418 - protein, 24 aa, Mycobacterium avium
VPLRAIAEVIGRRLGVPVESAPAD

SEQ ID NO: 92419 - protein, 17 aa, Mycobacterium avium
VPPELKERLEARANSEQ

SEQ ID NO: 92420 - protein, 24 aa, Mycobacterium avium
VPRIWEKLKAGIEFTVANEQDEAT

SEQ ID NO: 92421 - protein, 20 aa, Mycobacterium avium
VPRNELIAFFVAADVMLVTP

SEQ ID NO: 92422 - protein, 25 aa, Mycobacterium avium
VPRPRAPLAAATIWAIDDFTADNGA

SEQ ID NO: 92423 - protein, 20 aa, Mycobacterium avium
VPRPWQLGAEMLRVTRPGGL

SEQ ID NO: 92424 - protein, 18 aa, Mycobacterium avium
VPTCAALAAAGRYSEVGR

SEQ ID NO: 92425 - protein, 20 aa, Mycobacterium avium
VPTGGDWVRPEVVRRLRAEA

SEQ ID NO: 92426 - protein, 24 aa, Mycobacterium avium
VPTLRLAAPLDELPFKHDALAYGL

SEQ ID NO: 92427 - protein, 17 aa, Mycobacterium avium
VPTPRLVSVLRGFDPHV

SEQ ID NO: 92428 - protein, 18 aa, Mycobacterium avium
VPVEAGIYRVNRVVNPEQ

SEQ ID NO: 92429 - protein, 20 aa, Mycobacterium avium
VPVFNFCDGTGLATDDPRGL

SEQ ID NO: 92430 - protein, 18 aa, Mycobacterium avium
VPVGIGVAIGGTRAVDKF

SEQ ID NO: 92431 - protein, 20 aa, Mycobacterium avium
VPVPLGRHLFGASYARTGTV

SEQ ID NO: 92432 - protein, 26 aa, Mycobacterium avium
VPVRRVGKHLVCTVFDLMLAQYGVAR

SEQ ID NO: 92433 - protein, 17 aa, Mycobacterium avium
VPVRWSDIDMYQHVNHA

SEQ ID NO: 92434 - protein, 19 aa, Mycobacterium avium
VPVYPTCHYVMGGIPTTVT

SEQ ID NO: 92435 - protein, 17 aa, Mycobacterium avium
VQAADCLETVDALSPAA

SEQ ID NO: 92436 - protein, 24 aa, Mycobacterium avium
VQAWTRSAAKAWAADHVTVNALAP

SEQ ID NO: 92437 - protein, 24 aa, Mycobacterium avium
VQEAYRLAASIQRTVMPLDGPLFK

SEQ ID NO: 92438 - protein, 19 aa, Mycobacterium avium
VQGGLNWDSLPLKLFAGGN

SEQ ID NO: 92439 - protein, 23 aa, Mycobacterium avium
VQGGRPEALAGLGGAEPGQLLPA

SEQ ID NO: 92440 - protein, 19 aa, Mycobacterium avium
VQHRSRLRRSAAGLPVCAD

SEQ ID NO: 92441 - protein, 18 aa, Mycobacterium avium
VQIIPADPAVEWRYVELD

SEQ ID NO: 92442 - protein, 23 aa, Mycobacterium avium
VQQVDPRLGEVILDPACGTGGFL

SEQ ID NO: 92443 - protein, 20 aa, Mycobacterium avium
VQRGGPMMLLASPTLPGRGL

SEQ ID NO: 92444 - protein, 18 aa, Mycobacterium avium
VQRLDRWASGRDDDVTVV

SEQ ID NO: 92445 - protein, 26 aa, Mycobacterium avium
VQSLSMTPLVNWRIPGPELKFEERWM

SEQ ID NO: 92446 - protein, 20 aa, Mycobacterium avium
VQTGMGRTGTFFAHQHDGIT

SEQ ID NO: 92447 - protein, 24 aa, Mycobacterium avium
VQTVFDFTTQWALDRHTFGRPLAS

SEQ ID NO: 92448 - protein, 21 aa, Mycobacterium avium
VRAACAAGVRAVVLTNAAGGL

SEQ ID NO: 92449 - protein, 21 aa, Mycobacterium avium
VRAAVGLLERQGWLVRRQGLG

SEQ ID NO: 92450 - protein, 19 aa, Mycobacterium avium
VRAAVLALLAERPMHGYEM

SEQ ID NO: 92451 - protein, 17 aa, Mycobacterium avium
VRAEARLAAARTVHESR

SEQ ID NO: 92452 - protein, 21 aa, Mycobacterium avium
VRAHCAPILGLPRHADPQSYW

SEQ ID NO: 92453 - protein, 20 aa, Mycobacterium avium
VRALDAMSSWWTAIHGHGHP

SEQ ID NO: 92454 - protein, 18 aa, Mycobacterium avium
VRASIRTGVPFFVGTLSA

SEQ ID NO: 92455 - protein, 28 aa, Mycobacterium avium
VRATRPATVVEFGMSFGISAVHLAAAVR

SEQ ID NO: 92456 - protein, 20 aa, Mycobacterium avium
VRDEVEPLEVLFPGCEFLPL

SEQ ID NO: 92457 - protein, 17 aa, Mycobacterium avium
VRDEWQPLYVFGTRTVP

SEQ ID NO: 92458 - protein, 19 aa, Mycobacterium avium
VRDLAFRASPVAQIVVTGE

SEQ ID NO: 92459 - protein, 24 aa, Mycobacterium avium
VRDRGRLRYPHWVPAAVAPEQVVR

SEQ ID NO: 92460 - protein, 18 aa, Mycobacterium avium
VRDVGWTMMDIGKRIERG

SEQ ID NO: 92461 - protein, 19 aa, Mycobacterium avium
VREGKVCALWDIANPDKFT

SEQ ID NO: 92462 - protein, 27 aa, Mycobacterium avium
VRELAREFGRLGLLGMHLHGYGCGGAS

SEQ ID NO: 92463 - protein, 22 aa, Mycobacterium avium
VRESLRRSLSFNGYSVELAHDG

SEQ ID NO: 92464 - protein, 19 aa, Mycobacterium avium
VRESLTWSQLSRRTINVAR

SEQ ID NO: 92465 - protein, 27 aa, Mycobacterium avium
VRGAMGFRLLVDKRKGAALNLFSDTPN

SEQ ID NO: 92466 - protein, 24 aa, Mycobacterium avium
VRHRRLSYAGAMTALTAGAISFVG

SEQ ID NO: 92467 - protein, 21 aa, Mycobacterium avium
VRIANCSGFYGDRLSAMREML

SEQ ID NO: 92468 - protein, 18 aa, Mycobacterium avium
VRIEVPPEVARYVVEKGS

SEQ ID NO: 92469 - protein, 19 aa, Mycobacterium avium
VRINDVPEVLGARGYAADT

SEQ ID NO: 92470 - protein, 17 aa, Mycobacterium avium
VRIPARSVIGVCIGSAN

SEQ ID NO: 92471 - protein, 20 aa, Mycobacterium avium
VRKAAVLALTRWAGEPAARD

SEQ ID NO: 92472 - protein, 18 aa, Mycobacterium avium
VRKFAGGSMFVMTNEQSC

SEQ ID NO: 92473 - protein, 19 aa, Mycobacterium avium
VRLAGLVAHQEILFGTEGE

SEQ ID NO: 92474 - protein, 21 aa, Mycobacterium avium
VRLEHCAAEWVRAPGVSGERA

SEQ ID NO: 92475 - protein, 22 aa, Mycobacterium avium
VRLKGAEAMRQAWDNDGVDVLD

SEQ ID NO: 92476 - protein, 17 aa, Mycobacterium avium
VRLLGAALQTLGERPDI

SEQ ID NO: 92477 - protein, 17 aa, Mycobacterium avium
VRLLGCYHPSQQNMFTG

SEQ ID NO: 92478 - protein, 21 aa, Mycobacterium avium
VRLPGFRPGKAPAKLLEARFG

SEQ ID NO: 92479 - protein, 22 aa, Mycobacterium avium
VRNGLEPCIARAKAYAPYSDLI

SEQ ID NO: 92480 - protein, 18 aa, Mycobacterium avium
VRPGDLVAFAAGALADGY

SEQ ID NO: 92481 - protein, 26 aa, Mycobacterium avium
VRPGTDAWCLAALAAVLVQENLCDEA

SEQ ID NO: 92482 - protein, 23 aa, Mycobacterium avium
VRPIGFEPLSWVRALAAEDPVPS

SEQ ID NO: 92483 - protein, 17 aa, Mycobacterium avium
VRPPELRRRGAARLRAA

SEQ ID NO: 92484 - protein, 17 aa, Mycobacterium avium
VRPTVWAAVPRIWEKLK

SEQ ID NO: 92485 - protein, 25 aa, Mycobacterium avium
VRQMIADRELETWLVVDMSASLDFG

SEQ ID NO: 92486 - protein, 18 aa, Mycobacterium avium
VRRGEVFAVHAAGNGPGV

SEQ ID NO: 92487 - protein, 18 aa, Mycobacterium avium
VRRGRPVAGVAFDSIGRF

SEQ ID NO: 92488 - protein, 25 aa, Mycobacterium avium
VRRLAKLRGATILAHNYQLPEIQDV

SEQ ID NO: 92489 - protein, 18 aa, Mycobacterium avium
VRRRIFQLEIGRAHTPWF

SEQ ID NO: 92490 - protein, 27 aa, Mycobacterium avium
VRRRLGMDRLRIGVTGAAPIPREVHEF

SEQ ID NO: 92491 - protein, 18 aa, Mycobacterium avium
VRRWARARLESPPRDAFL

SEQ ID NO: 92492 - protein, 17 aa, Mycobacterium avium
VRSAVVRLPRAVHDAGG

SEQ ID NO: 92493 - protein, 17 aa, Mycobacterium avium
VRSFPVPVGGFGDPGQL

SEQ ID NO: 92494 - protein, 20 aa, Mycobacterium avium
VRSGWKVAEAFPATPVPGVA

SEQ ID NO: 92495 - protein, 21 aa, Mycobacterium avium
VRSLGVPAWLSYTIDGAHTRA

SEQ ID NO: 92496 - protein, 22 aa, Mycobacterium avium
VRSSARLAGGIVGYRIPEIRPA

SEQ ID NO: 92497 - protein, 18 aa, Mycobacterium avium
VRSVLTCTTGTGVCATCY

SEQ ID NO: 92498 - protein, 19 aa, Mycobacterium avium
VRTAMGGAQARRLCPHAVV

SEQ ID NO: 92499 - protein, 26 aa, Mycobacterium avium
VRTGMAVYDWMCWRMNKKAEDRQRRE

SEQ ID NO: 92500 - protein, 18 aa, Mycobacterium avium
VRTPLPVQLPEPMAQQLR

SEQ ID NO: 92501 - protein, 19 aa, Mycobacterium avium
VRVIPCLDVDDGRVVKGVN

SEQ ID NO: 92502 - protein, 18 aa, Mycobacterium avium
VRVLYTPWAAQAWSRAGV

SEQ ID NO: 92503 - protein, 17 aa, Mycobacterium avium
VRVPGGTPIPVYVAAMG

SEQ ID NO: 92504 - protein, 22 aa, Mycobacterium avium
VRVPRRDGLALAAALRRGVGVL

SEQ ID NO: 92505 - protein, 19 aa, Mycobacterium avium
VRVSDRIDFWLWLDAGFGD

SEQ ID NO: 92506 - protein, 17 aa, Mycobacterium avium
VRWGNNVAILAGDYLFA

SEQ ID NO: 92507 - protein, 26 aa, Mycobacterium avium
VRWVHRHVLRLGGWTIVRSARDEVVL

SEQ ID NO: 92508 - protein, 17 aa, Mycobacterium avium
VRYEAGPDGVRRSQADH

SEQ ID NO: 92509 - protein, 17 aa, Mycobacterium avium
VRYGELLSHERTLDLRG

SEQ ID NO: 92510 - protein, 22 aa, Mycobacterium avium
VRYGFTIAPELVRTVLRDREPD

SEQ ID NO: 92511 - protein, 23 aa, Mycobacterium avium
VRYPAGIDWVLAFWGTVLAGGVA

SEQ ID NO: 92512 - protein, 33 aa, Mycobacterium avium
VRYPEWDVARGSYRPAWCTVREVEPAVTARATL

SEQ ID NO: 92513 - protein, 18 aa, Mycobacterium avium
VSALEPMGMLALGVPYGE

SEQ ID NO: 92514 - protein, 26 aa, Mycobacterium avium
VSALNRLRLREELPVMAIWGERDGII

SEQ ID NO: 92515 - protein, 33 aa, Mycobacterium avium
VSARAKLNWWESRALYGWTVLVPRTKDQAGEMS

SEQ ID NO: 92516 - protein, 25 aa, Mycobacterium avium
VSARPSDSVAIALRVGVPIYVEEAV

SEQ ID NO: 92517 - protein, 17 aa, Mycobacterium avium
VSARRVAAILVERIDGV

SEQ ID NO: 92518 - protein, 17 aa, Mycobacterium avium
VSCGMGLHRFNIGISEI

SEQ ID NO: 92519 - protein, 18 aa, Mycobacterium avium
VSDEFFALFLDPTMAYTC

SEQ ID NO: 92520 - protein, 21 aa, Mycobacterium avium
VSELIRHAALLYLATEAAQPP

SEQ ID NO: 92521 - protein, 20 aa, Mycobacterium avium
VSGTVVFPGAGFVELAIRAG

SEQ ID NO: 92522 - protein, 17 aa, Mycobacterium avium
VSIPTLILFKDGQPVKR

SEQ ID NO: 92523 - protein, 24 aa, Mycobacterium avium
VSKFVAAPGARTGWSSLFEDLSRR

SEQ ID NO: 92524 - protein, 17 aa, Mycobacterium avium
VSLEDRFTQLLPEVMLG

SEQ ID NO: 92525 - protein, 28 aa, Mycobacterium avium
VSPRGYRALAGIPRLQFAHADLLVRSFG

SEQ ID NO: 92526 - protein, 19 aa, Mycobacterium avium
VSPVLWKKVAPKLSAGRVQ

SEQ ID NO: 92527 - protein, 20 aa, Mycobacterium avium
VSRADWLWRVLGEAGHVALV

SEQ ID NO: 92528 - protein, 23 aa, Mycobacterium avium
VSRLRRHARLRKKIAGTPERPRL

SEQ ID NO: 92529 - protein, 20 aa, Mycobacterium avium
VSSPRAVLFVSPSARLARVP

SEQ ID NO: 92530 - protein, 18 aa, Mycobacterium avium
VSSVGYTALLVAGWRALH

SEQ ID NO: 92531 - protein, 25 aa, Mycobacterium avium
VSVDYRLAPENAWPAAAEDVYAATC

SEQ ID NO: 92532 - protein, 25 aa, Mycobacterium avium
VSVTMPGKFAALRFADERTERARRV

SEQ ID NO: 92533 - protein, 27 aa, Mycobacterium avium
VSVTPAPGWTLGNRGPNWVALNNSDTT

SEQ ID NO: 92534 - protein, 33 aa, Mycobacterium avium
VSYERLRRQPLQWPCPPQSTADRNPIRYLNDGV

SEQ ID NO: 92535 - protein, 26 aa, Mycobacterium avium
VTACFRCAVCVEQLRATDDVLLVAGM

SEQ ID NO: 92536 - protein, 25 aa, Mycobacterium avium
VTAPLRGPGLDKLRALAEVVYDPWI

SEQ ID NO: 92537 - protein, 17 aa, Mycobacterium avium
VTARFCVMATGPLSAAM

SEQ ID NO: 92538 - protein, 17 aa, Mycobacterium avium
VTAWPATLDRLLALGGP

SEQ ID NO: 92539 - protein, 20 aa, Mycobacterium avium
VTDFNRLMWDNGIAPTRVID

SEQ ID NO: 92540 - protein, 24 aa, Mycobacterium avium
VTDSLDCFFVYLARHPQHRRQLVE

SEQ ID NO: 92541 - protein, 25 aa, Mycobacterium avium
VTEFAANAAEGWAMATASVRDLFAE

SEQ ID NO: 92542 - protein, 38 aa, Mycobacterium avium
VTFEEMLEMAACGAKVLMLRCVEYARRYNIPVHVRSSY

SEQ ID NO: 92543 - protein, 19 aa, Mycobacterium avium
VTFGGLKPVHALGDCGRVK

SEQ ID NO: 92544 - protein, 23 aa, Mycobacterium avium
VTFSDDYPPAWMYRTQESGHRDG

SEQ ID NO: 92545 - protein, 18 aa, Mycobacterium avium
VTGARLASLIGLMRDEAV

SEQ ID NO: 92546 - protein, 22 aa, Mycobacterium avium
VTGEPRSGTTLMHALMSVDPHA

SEQ ID NO: 92547 - protein, 18 aa, Mycobacterium avium
VTILPLQHPIVLAKALAT

SEQ ID NO: 92548 - protein, 25 aa, Mycobacterium avium
VTLAERERVFSFARDEENMWLVTDP

SEQ ID NO: 92549 - protein, 17 aa, Mycobacterium avium
VTLCKTPGKPVNFVPVI

SEQ ID NO: 92550 - protein, 17 aa, Mycobacterium avium
VTLLPGGRSRLHVDLDM

SEQ ID NO: 92551 - protein, 17 aa, Mycobacterium avium
VTLPGAAIWHMAWSDKD

SEQ ID NO: 92552 - protein, 20 aa, Mycobacterium avium
VTPGYLTMGGFIPAQDENGW

SEQ ID NO: 92553 - protein, 26 aa, Mycobacterium avium
VTPLFSIYVSPRIRAAIGTFAGRLMD

SEQ ID NO: 92554 - protein, 22 aa, Mycobacterium avium
VTPLRARIAERLDQSGPTVSQT

SEQ ID NO: 92555 - protein, 26 aa, Mycobacterium avium
VTPRPRLAPTQAWRKMFGENFFYILY

SEQ ID NO: 92556 - protein, 20 aa, Mycobacterium avium
VTRPRVAVLEVVDANPHADT

SEQ ID NO: 92557 - protein, 18 aa, Mycobacterium avium
VTRSSLPTAQRARKLVYA

SEQ ID NO: 92558 - protein, 24 aa, Mycobacterium avium
VTRYDIPTGPGVRLDSGVEAGSVI

SEQ ID NO: 92559 - protein, 20 aa, Mycobacterium avium
VTSGRVSYVLGLEGPAVSVD

SEQ ID NO: 92560 - protein, 18 aa, Mycobacterium avium
VTTHCLTDGVGLCEALAD

SEQ ID NO: 92561 - protein, 24 aa, Mycobacterium avium
VTTTLRLSMYVLNSAFYKPALLSR

SEQ ID NO: 92562 - protein, 24 aa, Mycobacterium avium
VTVPPTHRWIPAGMTVEYKAQART

SEQ ID NO: 92563 - protein, 24 aa, Mycobacterium avium
VVADYLTGKGWRVTPHPARQLYAR

SEQ ID NO: 92564 - protein, 18 aa, Mycobacterium avium
VVAHGGFGVAQRIVQRDG

SEQ ID NO: 92565 - protein, 20 aa, Mycobacterium avium
VVALTRFAGYLADIGVESID

SEQ ID NO: 92566 - protein, 18 aa, Mycobacterium avium
VVAMPLQAPYIVSKHAVL

SEQ ID NO: 92567 - protein, 17 aa, Mycobacterium avium
VVARLVKQFGAPELADA

SEQ ID NO: 92568 - protein, 24 aa, Mycobacterium avium
VVAVARQLRILPFAPANRASGSAA

SEQ ID NO: 92569 - protein, 24 aa, Mycobacterium avium
VVDDLDRALALVAEHPRLRAVTLD

SEQ ID NO: 92570 - protein, 18 aa, Mycobacterium avium
VVDGYPFEREVDGYQSYV

SEQ ID NO: 92571 - protein, 26 aa, Mycobacterium avium
VVDIISMHMGWGWGGYGVGPLKFAHQ

SEQ ID NO: 92572 - protein, 17 aa, Mycobacterium avium
VVDSAVSLGDWPIALPR

SEQ ID NO: 92573 - protein, 21 aa, Mycobacterium avium
VVDSICGHDGFLVESEAVGEM

SEQ ID NO: 92574 - protein, 17 aa, Mycobacterium avium
VVEYLTGRGWRVSARPR

SEQ ID NO: 92575 - protein, 29 aa, Mycobacterium avium
VVGEWQLLADLSFADYLMWVCRDDGMLVC

SEQ ID NO: 92576 - protein, 24 aa, Mycobacterium avium
VVLPDAPVKIFLTASAETRARRRN

SEQ ID NO: 92577 - protein, 17 aa, Mycobacterium avium
VVLTRRPDYAWPPSSWP

SEQ ID NO: 92578 - protein, 22 aa, Mycobacterium avium
VVPEVADGPALVVATPGAEPRA

SEQ ID NO: 92579 - protein, 19 aa, Mycobacterium avium
VVPPGGRWQTEVMVQPTWS

SEQ ID NO: 92580 - protein, 19 aa, Mycobacterium avium
VVRRLRAEAPGLRFAGLGG

SEQ ID NO: 92581 - protein, 18 aa, Mycobacterium avium
VVSGWRADTFVAGTPEPR

SEQ ID NO: 92582 - protein, 24 aa, Mycobacterium avium
VVVACSAISHASRQRAQRRLPDTP

SEQ ID NO: 92583 - protein, 18 aa, Mycobacterium avium
VVVTKADILANVWDAHHH

SEQ ID NO: 92584 - protein, 29 aa, Mycobacterium avium
VWELFWPDFPIGGLYKFKVHGADGVVTER

SEQ ID NO: 92585 - protein, 18 aa, Mycobacterium avium
VWRTFEQQRLEAMAGAAT

SEQ ID NO: 92586 - protein, 20 aa, Mycobacterium avium
VYDVADGRPHLRLENRVLPA

SEQ ID NO: 92587 - protein, 20 aa, Mycobacterium avium
VYEDGRIVRDFVYIDDVVDA

SEQ ID NO: 92588 - protein, 20 aa, Mycobacterium avium
VYEPGQGWAPLNPSVTATET

SEQ ID NO: 92589 - protein, 18 aa, Mycobacterium avium
VYGEGAWQSGAEVFYPQP

SEQ ID NO: 92590 - protein, 21 aa, Mycobacterium avium
VYNERGWRSLGDMGHLDEDGY

SEQ ID NO: 92591 - protein, 29 aa, Mycobacterium avium
VYNPLRFLRAAMKWCRKAQALGTLDDAAA

SEQ ID NO: 92592 - protein, 23 aa, Mycobacterium avium
VYPSPERIAAAALKTLGRTLTGA

SEQ ID NO: 92593 - protein, 21 aa, Mycobacterium avium
VYRCDYPGLVALLPTALAETQ

SEQ ID NO: 92594 - protein, 18 aa, Mycobacterium avium
VYYMPQWDTFALSRFDDI

SEQ ID NO: 92595 - protein, 18 aa, Mycobacterium avium
WADCDGHPENALSRDELL

SEQ ID NO: 92596 - protein, 20 aa, Mycobacterium avium
WADRWPDLVAAFTAATRAEE

SEQ ID NO: 92597 - protein, 18 aa, Mycobacterium avium
WAEIARRLAAARHDFYVL

SEQ ID NO: 92598 - protein, 17 aa, Mycobacterium avium
WAGEVLLREAHDLCGLP

SEQ ID NO: 92599 - protein, 18 aa, Mycobacterium avium
WAGLPVNLDFAFSRDQRD

SEQ ID NO: 92600 - protein, 25 aa, Mycobacterium avium
WAGSCRPGDGLGIAGGEVLIVAADA

SEQ ID NO: 92601 - protein, 18 aa, Mycobacterium avium
WAGSPGFRGDPAGPPIAI

SEQ ID NO: 92602 - protein, 19 aa, Mycobacterium avium
WAIRSGATVKVFEAVERIG

SEQ ID NO: 92603 - protein, 22 aa, Mycobacterium avium
WALKHWHFGPIYTLDEYIALQT

SEQ ID NO: 92604 - protein, 17 aa, Mycobacterium avium
WALSRHQDVLQGFRNST

SEQ ID NO: 92605 - protein, 19 aa, Mycobacterium avium
WAPECAYAPGLEHDYAAAG

SEQ ID NO: 92606 - protein, 17 aa, Mycobacterium avium
WAQAGFRPVDPAVAADF

SEQ ID NO: 92607 - protein, 22 aa, Mycobacterium avium
WAQSGRRALYISGEESAGQIRL

SEQ ID NO: 92608 - protein, 27 aa, Mycobacterium avium
WARRLPELPDPPALPITAGRGANRSTR

SEQ ID NO: 92609 - protein, 17 aa, Mycobacterium avium
WASRPADLYGRRDHDRF

SEQ ID NO: 92610 - protein, 17 aa, Mycobacterium avium
WASSGHVGFKGSRKSTP

SEQ ID NO: 92611 - protein, 17 aa, Mycobacterium avium
WATPFTEVLDWSRAPFA

SEQ ID NO: 92612 - protein, 19 aa, Mycobacterium avium
WAVRLARPGAVIVADNVIR

SEQ ID NO: 92613 - protein, 21 aa, Mycobacterium avium
WCRLDEFRCYATLTVEVDANW

SEQ ID NO: 92614 - protein, 21 aa, Mycobacterium avium
WDDLLRPGVEVITPSPLSSGS

SEQ ID NO: 92615 - protein, 25 aa, Mycobacterium avium
WDDTPEGFGRIAATTARQVMLQRFR

SEQ ID NO: 92616 - protein, 23 aa, Mycobacterium avium
WDIFSCVRLVLDVLDPVPDPLPE

SEQ ID NO: 92617 - protein, 26 aa, Mycobacterium avium
WDLGDARGTVMLRMPLHPVAIELLRE

SEQ ID NO: 92618 - protein, 26 aa, Mycobacterium avium
WDLVIAVHLRGHFLLTRNAAAYWRSR

SEQ ID NO: 92619 - protein, 18 aa, Mycobacterium avium
WDPAELGPVVADLLGKAR

SEQ ID NO: 92620 - protein, 18 aa, Mycobacterium avium
WDRAHAVPAPAWAVSRKR

SEQ ID NO: 92621 - protein, 23 aa, Mycobacterium avium
WDRRRITAGLDRLRYAEGSSGAY

SEQ ID NO: 92622 - protein, 17 aa, Mycobacterium avium
WDSLPLKLFAGGNAKFW

SEQ ID NO: 92623 - protein, 23 aa, Mycobacterium avium
WDSRAIAVFGHRPYVGVSVNMVA

SEQ ID NO: 92624 - protein, 18 aa, Mycobacterium avium
WDTLAEAKALAGSHPDGI

SEQ ID NO: 92625 - protein, 20 aa, Mycobacterium avium
WEALEHARIPASSLRGEAVG

SEQ ID NO: 92626 - protein, 25 aa, Mycobacterium avium
WEALRRTYLRLGHRVDVIEPVAGLP

SEQ ID NO: 92627 - protein, 19 aa, Mycobacterium avium
WEGALKLGIEMRVGPVGIV

SEQ ID NO: 92628 - protein, 17 aa, Mycobacterium avium
WEPPAARMAEAISAIKA

SEQ ID NO: 92629 - protein, 18 aa, Mycobacterium avium
WEPTIVRPICNALIDDFI

SEQ ID NO: 92630 - protein, 23 aa, Mycobacterium avium
WEQVADWDYVCEQLAAAEPWWEP

SEQ ID NO: 92631 - protein, 26 aa, Mycobacterium avium
WERHPLMLRSYFQARSGPGGKRLIQR

SEQ ID NO: 92632 - protein, 17 aa, Mycobacterium avium
WERLCAMGATSMAVPES

SEQ ID NO: 92633 - protein, 18 aa, Mycobacterium avium
WERMDFAVAEANFLTAAR

SEQ ID NO: 92634 - protein, 17 aa, Mycobacterium avium
WERWAFAHLPLAKKLYR

SEQ ID NO: 92635 - protein, 19 aa, Mycobacterium avium
WESVEPFPMPNEVGVQPDP

SEQ ID NO: 92636 - protein, 24 aa, Mycobacterium avium
WETTCLISPAGSVEWMCVPRPDSP

SEQ ID NO: 92637 - protein, 20 aa, Mycobacterium avium
WFASNCAGEAFIVLAKPEGA

SEQ ID NO: 92638 - protein, 23 aa, Mycobacterium avium
WFDDPELMTWLSGARLDLFGHLI

SEQ ID NO: 92639 - protein, 27 aa, Mycobacterium avium
WFLETVPITPIWLCPLRLRDHDGWPLY

SEQ ID NO: 92640 - protein, 17 aa, Mycobacterium avium
WFYPPTVVTDITKDMAL

SEQ ID NO: 92641 - protein, 22 aa, Mycobacterium avium
WGADSGMLAALYVLAALGEQDR

SEQ ID NO: 92642 - protein, 18 aa, Mycobacterium avium
WGAGFFDGEVPRRWRSPA

SEQ ID NO: 92643 - protein, 17 aa, Mycobacterium avium
WGAVWGREELPRKTRSM

SEQ ID NO: 92644 - protein, 17 aa, Mycobacterium avium
WGDGWPLGVSRATTRAQ

SEQ ID NO: 92645 - protein, 17 aa, Mycobacterium avium
WGESMSRQAGGRAGGSG

SEQ ID NO: 92646 - protein, 19 aa, Mycobacterium avium
WGGALKRALEKYDVNVIGI

SEQ ID NO: 92647 - protein, 30 aa, Mycobacterium avium
WGGATYDVALRFLKEDPWERLAALREAMPN

SEQ ID NO: 92648 - protein, 21 aa, Mycobacterium avium
WGQCHSLAFDFSVWEIFGALL

SEQ ID NO: 92649 - protein, 40 aa, Mycobacterium avium
WGREVVGTAAGVVRFIGVDGYRWMIRCVVNGTHETMEALE

SEQ ID NO: 92650 - protein, 18 aa, Mycobacterium avium
WGVATPMGVPPTEFLTEH

SEQ ID NO: 92651 - protein, 17 aa, Mycobacterium avium
WHAKEELARYGVQPDWF

SEQ ID NO: 92652 - protein, 17 aa, Mycobacterium avium
WHARVPAWRDHYLSLDQ

SEQ ID NO: 92653 - protein, 21 aa, Mycobacterium avium
WHRAIVDKWRAAGVRMADERD

SEQ ID NO: 92654 - protein, 18 aa, Mycobacterium avium
WHRLCRALGSPSWAMDPE

SEQ ID NO: 92655 - protein, 20 aa, Mycobacterium avium
WIDRLGQMLAALVRDRDVIG

SEQ ID NO: 92656 - protein, 20 aa, Mycobacterium avium
WIINGAKTWSTSAFAADYGL

SEQ ID NO: 92657 - protein, 22 aa, Mycobacterium avium
WIPQHGEPFLSNWTPVAQPQTI

SEQ ID NO: 92658 - protein, 18 aa, Mycobacterium avium
WIREMLPIGELREILSAA

SEQ ID NO: 92659 - protein, 23 aa, Mycobacterium avium
WIRGGTPPICFGFGSMPVESPAD

SEQ ID NO: 92660 - protein, 25 aa, Mycobacterium avium
WISEGFPEMRVAVIPREQISFDDGW

SEQ ID NO: 92661 - protein, 32 aa, Mycobacterium avium
WKGSRFPMTSCISGWAMLNRDAAVIPDIYRDP

SEQ ID NO: 92662 - protein, 17 aa, Mycobacterium avium
WKIVSAPLNAYARLVVV

SEQ ID NO: 92663 - protein, 17 aa, Mycobacterium avium
WKPSPGSVYPTLQLLAD

SEQ ID NO: 92664 - protein, 17 aa, Mycobacterium avium
WKQIEAKAIEIKEKAAG

SEQ ID NO: 92665 - protein, 21 aa, Mycobacterium avium
WKQNWPQHLAGAYIDAGMADQ

SEQ ID NO: 92666 - protein, 19 aa, Mycobacterium avium
WKVAVEYDGIQHWDDPYQR

SEQ ID NO: 92667 - protein, 20 aa, Mycobacterium avium
WLADTWRDRFEQMLQRAEAR

SEQ ID NO: 92668 - protein, 21 aa, Mycobacterium avium
WLALRGLRVLGLDVSPVAIGQ

SEQ ID NO: 92669 - protein, 17 aa, Mycobacterium avium
WLAQRGWTVLAVDISAT

SEQ ID NO: 92670 - protein, 22 aa, Mycobacterium avium
WLDDGWVALLRKWIDDAERAGV

SEQ ID NO: 92671 - protein, 18 aa, Mycobacterium avium
WLDPALTTPYAWYQYFFN

SEQ ID NO: 92672 - protein, 21 aa, Mycobacterium avium
WLLKQAFYYSLTTINEAMREH

SEQ ID NO: 92673 - protein, 17 aa, Mycobacterium avium
WLLRPLGVDAFLNEIWA

SEQ ID NO: 92674 - protein, 17 aa, Mycobacterium avium
WLQGGRVHAPFWEVHAT

SEQ ID NO: 92675 - protein, 19 aa, Mycobacterium avium
WLRDDLGALPRAVEEMVRW

SEQ ID NO: 92676 - protein, 23 aa, Mycobacterium avium
WLREVWGGPFMLKGVMRVDDAKR

SEQ ID NO: 92677 - protein, 17 aa, Mycobacterium avium
WLRGGAEAGAFNYAWLN

SEQ ID NO: 92678 - protein, 19 aa, Mycobacterium avium
WLRLPLRARHGQVAVLPSV

SEQ ID NO: 92679 - protein, 20 aa, Mycobacterium avium
WLRRAQEFERAAGRVRGERW

SEQ ID NO: 92680 - protein, 17 aa, Mycobacterium avium
WLSGARLDLFGHLIGHL

SEQ ID NO: 92681 - protein, 23 aa, Mycobacterium avium
WLTATRARNALVLVRGKPTDQLP

SEQ ID NO: 92682 - protein, 26 aa, Mycobacterium avium
WLTVLLRRDLGLLVMIAVPGREPSRA

SEQ ID NO: 92683 - protein, 26 aa, Mycobacterium avium
WMCVPRPDSPSVFGAILDRSAGHFRL

SEQ ID NO: 92684 - protein, 25 aa, Mycobacterium avium
WNAGKDLSFVPLRPERVVEVRYDHM

SEQ ID NO: 92685 - protein, 30 aa, Mycobacterium avium
WNRAGSARAWWLLRAAGLDNVRILDGGLAA

SEQ ID NO: 92686 - protein, 18 aa, Mycobacterium avium
WNRGMTEYAAFLRGVNVG

SEQ ID NO: 92687 - protein, 17 aa, Mycobacterium avium
WPAANPVAPLGETVIRQ

SEQ ID NO: 92688 - protein, 19 aa, Mycobacterium avium
WPAGTPVLFPRPTKNIDGT

SEQ ID NO: 92689 - protein, 19 aa, Mycobacterium avium
WPAPIRVPAGTTAAAAVRD

SEQ ID NO: 92690 - protein, 18 aa, Mycobacterium avium
WPDTKNPLFSEAQERSAA

SEQ ID NO: 92691 - protein, 19 aa, Mycobacterium avium
WPEALRANGFDVTQATSWS

SEQ ID NO: 92692 - protein, 25 aa, Mycobacterium avium
WPEGESFPTLPPMMRITLNAILRAV

SEQ ID NO: 92693 - protein, 19 aa, Mycobacterium avium
WPEPLRTKALQGRGPAKPE

SEQ ID NO: 92694 - protein, 18 aa, Mycobacterium avium
WPGWERKRQHVMTLIGGD

SEQ ID NO: 92695 - protein, 19 aa, Mycobacterium avium
WPMTCFLTPDGRPFFCGTY

SEQ ID NO: 92696 - protein, 17 aa, Mycobacterium avium
WPNLFLAEMNVMFVEPQ

SEQ ID NO: 92697 - protein, 25 aa, Mycobacterium avium
WPPEHRPAVRRRGGVLVLFTSPELQ

SEQ ID NO: 92698 - protein, 22 aa, Mycobacterium avium
WPPGDARGRIVRLCLDSPSVAE

SEQ ID NO: 92699 - protein, 20 aa, Mycobacterium avium
WPTPRWRRHLGAQLQGSYSL

SEQ ID NO: 92700 - protein, 22 aa, Mycobacterium avium
WQAARCVANWHGPRVDKGLRRW

SEQ ID NO: 92701 - protein, 24 aa, Mycobacterium avium
WQIIARIACEMGFSEAFSYSCAEE

SEQ ID NO: 92702 - protein, 22 aa, Mycobacterium avium
WQLEKALPVPVFVQSMAQVTIA

SEQ ID NO: 92703 - protein, 17 aa, Mycobacterium avium
WQLPVAANDEMPLIGMP

SEQ ID NO: 92704 - protein, 19 aa, Mycobacterium avium
WQNHIERILADWVGELGVP

SEQ ID NO: 92705 - protein, 17 aa, Mycobacterium avium
WQPLYVFGTRTVPQIDL

SEQ ID NO: 92706 - protein, 17 aa, Mycobacterium avium
WQPWTGKDWGNPRDQAV

SEQ ID NO: 92707 - protein, 19 aa, Mycobacterium avium
WQRCRVHFLRNVLAQVPKG

SEQ ID NO: 92708 - protein, 18 aa, Mycobacterium avium
WQVGFSGFAPGFAYLVDG

SEQ ID NO: 92709 - protein, 17 aa, Mycobacterium avium
WRADGQLDYLGRADEQV

SEQ ID NO: 92710 - protein, 17 aa, Mycobacterium avium
WRADTFVAGTPEPRHDE

SEQ ID NO: 92711 - protein, 24 aa, Mycobacterium avium
WRAFNERSGFRFGGSGRNMAETPL

SEQ ID NO: 92712 - protein, 17 aa, Mycobacterium avium
WRALQTIPYGETRSYGE

SEQ ID NO: 92713 - protein, 21 aa, Mycobacterium avium
WRAQRAFAELPAEIVDRAAAL

SEQ ID NO: 92714 - protein, 21 aa, Mycobacterium avium
WRDGYKTLHGMTSRGFPNQFY

SEQ ID NO: 92715 - protein, 19 aa, Mycobacterium avium
WRDRFEQMLQRAEARLHAK

SEQ ID NO: 92716 - protein, 38 aa, Mycobacterium avium
WRELGKPLHLHRILLQRSWIAIFWSRFADAVELIAQAR

SEQ ID NO: 92717 - protein, 19 aa, Mycobacterium avium
WRGDGFTGVVVLTGPKNGD

SEQ ID NO: 92718 - protein, 18 aa, Mycobacterium avium
WRGVLDGAGFVELPTYAF

SEQ ID NO: 92719 - protein, 22 aa, Mycobacterium avium
WRIPGPELKFEERWMPPTHVEA

SEQ ID NO: 92720 - protein, 19 aa, Mycobacterium avium
WRMASKSLRPLPVAHKEMS

SEQ ID NO: 92721 - protein, 26 aa, Mycobacterium avium
WRNHHNAWRPAHIHFSVFGTAFTQRL

SEQ ID NO: 92722 - protein, 19 aa, Mycobacterium avium
WRNLPSGFQVKDYRDDEGH

SEQ ID NO: 92723 - protein, 20 aa, Mycobacterium avium
WRPLGDYWFEGVSRAARLRG

SEQ ID NO: 92724 - protein, 19 aa, Mycobacterium avium
WRRALHRWLQHEVRAPDDV

SEQ ID NO: 92725 - protein, 17 aa, Mycobacterium avium
WRRRKPYGWLRQVLPDP

SEQ ID NO: 92726 - protein, 19 aa, Mycobacterium avium
WRRTLDVNLLGYVRTSRAV

SEQ ID NO: 92727 - protein, 18 aa, Mycobacterium avium
WRSIARSLARRPAAEIKR

SEQ ID NO: 92728 - protein, 19 aa, Mycobacterium avium
WRSPALPEFDPFWRDVEDA

SEQ ID NO: 92729 - protein, 17 aa, Mycobacterium avium
WRTMLDVNLTGVWHTCR

SEQ ID NO: 92730 - protein, 20 aa, Mycobacterium avium
WRVESLRVEWWQSCRLPVNW

SEQ ID NO: 92731 - protein, 17 aa, Mycobacterium avium
WSAAPVRHGVSVVRSGQ

SEQ ID NO: 92732 - protein, 20 aa, Mycobacterium avium
WSDEFIRDFFKNFLRGPVTL

SEQ ID NO: 92733 - protein, 21 aa, Mycobacterium avium
WSEADRFGVTAGEEREGESLD

SEQ ID NO: 92734 - protein, 21 aa, Mycobacterium avium
WSERKRYIWWDPDQRRWVGYD

SEQ ID NO: 92735 - protein, 17 aa, Mycobacterium avium
WSGRPGPVLGEAIDRLL

SEQ ID NO: 92736 - protein, 17 aa, Mycobacterium avium
WSGVPPGVFDAAEDTVG

SEQ ID NO: 92737 - protein, 17 aa, Mycobacterium avium
WTDPNAFDIRRPRQAHI

SEQ ID NO: 92738 - protein, 26 aa, Mycobacterium avium
WTFLGPRPANWWIRRRLHETAVHRAD

SEQ ID NO: 92739 - protein, 25 aa, Mycobacterium avium
WTKRSLNHWYRMMGPTFETSVGLEF

SEQ ID NO: 92740 - protein, 24 aa, Mycobacterium avium
WTNSYYDDMAWLALALERAARIAG

SEQ ID NO: 92741 - protein, 23 aa, Mycobacterium avium
WTRNPRVSMDFYTRVVGLEPVRF

SEQ ID NO: 92742 - protein, 19 aa, Mycobacterium avium
WTRSRPGDRFIVAPQSDGG

SEQ ID NO: 92743 - protein, 28 aa, Mycobacterium avium
WTSAAHKARWGVCLARTDPDAPKHKGIT

SEQ ID NO: 92744 - protein, 29 aa, Mycobacterium avium
WTTIPGGPFLSFGQAYAWGQNGQGAAAYL

SEQ ID NO: 92745 - protein, 18 aa, Mycobacterium avium
WVGPALMRYGTEEQKAKH

SEQ ID NO: 92746 - protein, 24 aa, Mycobacterium avium
WVIDEIRPSFIVSNVPQIADAPFE

SEQ ID NO: 92747 - protein, 20 aa, Mycobacterium avium
WVKTLRPGWQRERQRNFHAW

SEQ ID NO: 92748 - protein, 18 aa, Mycobacterium avium
WVLLKGLETMAIRVEHSN

SEQ ID NO: 92749 - protein, 17 aa, Mycobacterium avium
WVLPGFIDVHTHYDAEV

SEQ ID NO: 92750 - protein, 24 aa, Mycobacterium avium
WVPAHFPKDAWALGRFDGTPLYEH

SEQ ID NO: 92751 - protein, 25 aa, Mycobacterium avium
WVQHVIWWQVYPLGFVGAYPLPQSS

SEQ ID NO: 92752 - protein, 17 aa, Mycobacterium avium
WVTAATGYGRFCVETGR

SEQ ID NO: 92753 - protein, 21 aa, Mycobacterium avium
WWFDLPWSTGFVRPQHPIETI

SEQ ID NO: 92754 - protein, 31 aa, Mycobacterium avium
WWPADYGHYGGLFIRMSWHAAGTYRIHDGRG

SEQ ID NO: 92755 - protein, 17 aa, Mycobacterium avium
WWSRRGWQHRQAAGLTA

SEQ ID NO: 92756 - protein, 19 aa, Mycobacterium avium
WWVRADGLATIHRDGPALD

SEQ ID NO: 92757 - protein, 19 aa, Mycobacterium avium
WYEGPTWLARVLRALPEAG

SEQ ID NO: 92758 - protein, 21 aa, Mycobacterium avium
YAAAVELGMPLGVHGAPGIHL

SEQ ID NO: 92759 - protein, 22 aa, Mycobacterium avium
YAAKAFLCSEVARWIDEEGLSL

SEQ ID NO: 92760 - protein, 19 aa, Mycobacterium avium
YAAQSGDWGVALELPTGMR

SEQ ID NO: 92761 - protein, 19 aa, Mycobacterium avium
YAAVGFEYGYTVGNPDALV

SEQ ID NO: 92762 - protein, 23 aa, Mycobacterium avium
YADRSGGVLPGYGGSKAALEHLT

SEQ ID NO: 92763 - protein, 19 aa, Mycobacterium avium
YAEPEWARDHGWPQFADRL

SEQ ID NO: 92764 - protein, 17 aa, Mycobacterium avium
YAESKAAADAHLRASDL

SEQ ID NO: 92765 - protein, 19 aa, Mycobacterium avium
YAFECPLLLGTTAVLMDRW

SEQ ID NO: 92766 - protein, 23 aa, Mycobacterium avium
YAGPAMLRRATYMYGTLLPRGPR

SEQ ID NO: 92767 - protein, 27 aa, Mycobacterium avium
YAHDLKDWFGFLAERGLDWRAVRLDDV

SEQ ID NO: 92768 - protein, 18 aa, Mycobacterium avium
YAKGRLAPYKAPKTVEFV

SEQ ID NO: 92769 - protein, 17 aa, Mycobacterium avium
YALAGRHVHVVTINDYL

SEQ ID NO: 92770 - protein, 23 aa, Mycobacterium avium
YAQLRKAKGVTVEQAREIMRDAT

SEQ ID NO: 92771 - protein, 23 aa, Mycobacterium avium
YARGGAAVELVWIIAQRAGLAVQ

SEQ ID NO: 92772 - protein, 17 aa, Mycobacterium avium
YASMFAALGTKVTVVEK

SEQ ID NO: 92773 - protein, 18 aa, Mycobacterium avium
YATIFPACRAVVHHGGSG

SEQ ID NO: 92774 - protein, 23 aa, Mycobacterium avium
YATPRLADIPGVRLIGTAQEKAS

SEQ ID NO: 92775 - protein, 17 aa, Mycobacterium avium
YATTVFAEMSALAARVE

SEQ ID NO: 92776 - protein, 17 aa, Mycobacterium avium
YCSDFGRTWIVGRDPSP

SEQ ID NO: 92777 - protein, 21 aa, Mycobacterium avium
YDALMRMLKTCQVRLEDDVRE

SEQ ID NO: 92778 - protein, 20 aa, Mycobacterium avium
YDGAVAWLVGEEGRGVPTII

SEQ ID NO: 92779 - protein, 25 aa, Mycobacterium avium
YDLDGMRLHSWNRIVIATGSPPAHQ

SEQ ID NO: 92780 - protein, 24 aa, Mycobacterium avium
YDLPFLQQWVYRPPHNEVIAQLRN

SEQ ID NO: 92781 - protein, 18 aa, Mycobacterium avium
YDRAMAGWEVTVLLPHGC

SEQ ID NO: 92782 - protein, 28 aa, Mycobacterium avium
YDRETCWRDYRLGVLQAPLISALGFAFA

SEQ ID NO: 92783 - protein, 17 aa, Mycobacterium avium
YDRGEEFGVGGGPIANE

SEQ ID NO: 92784 - protein, 25 aa, Mycobacterium avium
YDRQARIGITPTWVRFYDFGAGRLP

SEQ ID NO: 92785 - protein, 18 aa, Mycobacterium avium
YEDIRALTYMNGFGLEVL

SEQ ID NO: 92786 - protein, 17 aa, Mycobacterium avium
YEEIDWDTAIVEIAEGF

SEQ ID NO: 92787 - protein, 17 aa, Mycobacterium avium
YELSVDLAMPMIGLLKR

SEQ ID NO: 92788 - protein, 29 aa, Mycobacterium avium
YENLCSTVRFDLAVQCARSCGADAFVELS

SEQ ID NO: 92789 - protein, 33 aa, Mycobacterium avium
YEPETSVALGFGFRCGFLGLLHMEITRERLERE

SEQ ID NO: 92790 - protein, 19 aa, Mycobacterium avium
YERDARRAALMGYTGKWAI

SEQ ID NO: 92791 - protein, 17 aa, Mycobacterium avium
YESRLRTWEEWQPVAEL

SEQ ID NO: 92792 - protein, 21 aa, Mycobacterium avium
YFAESFVKRGLVVDGGGCYLL

SEQ ID NO: 92793 - protein, 24 aa, Mycobacterium avium
YFASWFERYARSFSGTIAGGTSEI

SEQ ID NO: 92794 - protein, 18 aa, Mycobacterium avium
YFECAWAGNAAKAVQYCR

SEQ ID NO: 92795 - protein, 25 aa, Mycobacterium avium
YFGDLRTGMMGVWIGAIQNMYPELG

SEQ ID NO: 92796 - protein, 24 aa, Mycobacterium avium
YFGVRLPAPVPYRNFITWLSAQDR

SEQ ID NO: 92797 - protein, 19 aa, Mycobacterium avium
YFRAARRGLVPGPLRFVRA

SEQ ID NO: 92798 - protein, 17 aa, Mycobacterium avium
YFRDFWGADSGMLAALY

SEQ ID NO: 92799 - protein, 23 aa, Mycobacterium avium
YFTHWGGAFKYAASLLGLPTGAY

SEQ ID NO: 92800 - protein, 19 aa, Mycobacterium avium
YGAALPWPASSADGARPGR

SEQ ID NO: 92801 - protein, 31 aa, Mycobacterium avium
YGARLPAPAPYRGFVTWLAARDVPAARAAWR

SEQ ID NO: 92802 - protein, 18 aa, Mycobacterium avium
YGGSTLWASTVAAYQQLP

SEQ ID NO: 92803 - protein, 18 aa, Mycobacterium avium
YGGTAYFGCPQRFSFSKS

SEQ ID NO: 92804 - protein, 17 aa, Mycobacterium avium
YGGWARHGGGAFSGKDP

SEQ ID NO: 92805 - protein, 17 aa, Mycobacterium avium
YGHEKVKLLDGGRKKWE

SEQ ID NO: 92806 - protein, 26 aa, Mycobacterium avium
YGISAERAFDILVWRSQETNLKLRDV

SEQ ID NO: 92807 - protein, 19 aa, Mycobacterium avium
YGLTYPGVGFVVWRSKEYL

SEQ ID NO: 92808 - protein, 18 aa, Mycobacterium avium
YGPIPAAVARRMVANAAA

SEQ ID NO: 92809 - protein, 18 aa, Mycobacterium avium
YGRMVIGVWISKLFPQRM

SEQ ID NO: 92810 - protein, 17 aa, Mycobacterium avium
YGSIFPPVWNFQLALHT

SEQ ID NO: 92811 - protein, 28 aa, Mycobacterium avium
YGTELVRAVARWLVVYLKRAGGQSQFSA

SEQ ID NO: 92812 - protein, 17 aa, Mycobacterium avium
YHGVVFAELGPPAYALK

SEQ ID NO: 92813 - protein, 25 aa, Mycobacterium avium
YIVEKRFNLSWSIEGTRSRTGKMLP

SEQ ID NO: 92814 - protein, 20 aa, Mycobacterium avium
YKADAMWGPSSDPAWQRNDP

SEQ ID NO: 92815 - protein, 19 aa, Mycobacterium avium
YKPAPELIAGFAIRTARPK

SEQ ID NO: 92816 - protein, 25 aa, Mycobacterium avium
YLAGEAAAYARTWSLLRASDAALDR

SEQ ID NO: 92817 - protein, 27 aa, Mycobacterium avium
YLAGLCGALRRYHEAFGVPISTLPMAV

SEQ ID NO: 92818 - protein, 17 aa, Mycobacterium avium
YLAGRGVGHGYVRRPGL

SEQ ID NO: 92819 - protein, 22 aa, Mycobacterium avium
YLDFAGNADFAIAIRTALMRGG

SEQ ID NO: 92820 - protein, 28 aa, Mycobacterium avium
YLDTEPWRAGPLLDYLRKMVFWSDVTPA

SEQ ID NO: 92821 - protein, 23 aa, Mycobacterium avium
YLEMAAALADMFPGRGEQRGRGP

SEQ ID NO: 92822 - protein, 18 aa, Mycobacterium avium
YLEWDLATEPERYAKRLA

SEQ ID NO: 92823 - protein, 22 aa, Mycobacterium avium
YLGDLRSLLAFAGERGTGLDGL

SEQ ID NO: 92824 - protein, 23 aa, Mycobacterium avium
YLGRAGLTAARFVACPFGGAGAR

SEQ ID NO: 92825 - protein, 23 aa, Mycobacterium avium
YLGRPGLTASRFVACPFGGAGER

SEQ ID NO: 92826 - protein, 19 aa, Mycobacterium avium
YLGWLSGPISWDYGSDPSD

SEQ ID NO: 92827 - protein, 19 aa, Mycobacterium avium
YLIDAKAATAIAVDDRTRA

SEQ ID NO: 92828 - protein, 17 aa, Mycobacterium avium
YLPDFVMCRAELAPVLL

SEQ ID NO: 92829 - protein, 20 aa, Mycobacterium avium
YLRATWDLITPNAYIETVHR

SEQ ID NO: 92830 - protein, 24 aa, Mycobacterium avium
YLRPDELHLGFNFRLTKIDFDAAQ

SEQ ID NO: 92831 - protein, 25 aa, Mycobacterium avium
YLSDPRLQRIFTFQSLYAGVAPRDA

SEQ ID NO: 92832 - protein, 26 aa, Mycobacterium avium
YLSGRWAEKYGFPLMPIDGILVGTAA

SEQ ID NO: 92833 - protein, 19 aa, Mycobacterium avium
YLTEAIPVQIVWGTKDVVV

SEQ ID NO: 92834 - protein, 21 aa, Mycobacterium avium
YLVRYWRLLKFKLANPHIITR

SEQ ID NO: 92835 - protein, 18 aa, Mycobacterium avium
YMAARTAFFDNFFLAATR

SEQ ID NO: 92836 - protein, 20 aa, Mycobacterium avium
YNAVCSVYGHLHIPRTTWYD

SEQ ID NO: 92837 - protein, 25 aa, Mycobacterium avium
YNGPACAYVANPFGGYQVNAQGERF

SEQ ID NO: 92838 - protein, 21 aa, Mycobacterium avium
YNITVALRLSGRLDADALRAA

SEQ ID NO: 92839 - protein, 22 aa, Mycobacterium avium
YNRMLSGYLLRDVVNKVNEINF

SEQ ID NO: 92840 - protein, 18 aa, Mycobacterium avium
YPAPSDWTRRTLTCGVAL

SEQ ID NO: 92841 - protein, 23 aa, Mycobacterium avium
YPASDSLSRWGVDVRPVQVDLRT

SEQ ID NO: 92842 - protein, 20 aa, Mycobacterium avium
YPAYLDWAVRLARPGAVIVA

SEQ ID NO: 92843 - protein, 25 aa, Mycobacterium avium
YPGAMTRPEQRVELAYGAVDRILGQ

SEQ ID NO: 92844 - protein, 27 aa, Mycobacterium avium
YPLIPARVDTWAGLVFVNLDPDAMPLP

SEQ ID NO: 92845 - protein, 19 aa, Mycobacterium avium
YPPEVLLTGIIVNKEGKRF

SEQ ID NO: 92846 - protein, 21 aa, Mycobacterium avium
YPPKPSMRIISDIFAYTSAKM

SEQ ID NO: 92847 - protein, 26 aa, Mycobacterium avium
YPPLRRPKHRRVFTVANQKGGVGKTT

SEQ ID NO: 92848 - protein, 17 aa, Mycobacterium avium
YPQLLKRGSADAEGETL

SEQ ID NO: 92849 - protein, 23 aa, Mycobacterium avium
YPRNQECLLRLAALAERQEPNPV

SEQ ID NO: 92850 - protein, 19 aa, Mycobacterium avium
YPTPGHAVGLSFSVAPDVS

SEQ ID NO: 92851 - protein, 19 aa, Mycobacterium avium
YQAAIAHERVAEVEDRAVA

SEQ ID NO: 92852 - protein, 20 aa, Mycobacterium avium
YQLGNLVLRGGPFALGCFAG

SEQ ID NO: 92853 - protein, 26 aa, Mycobacterium avium
YQPACGKAGCSTYKWETFLTSELPSY

SEQ ID NO: 92854 - protein, 37 aa, Mycobacterium avium
YRALGFPTRMFTVLFALGRLPGWIAHWREMHDEGDSK

SEQ ID NO: 92855 - protein, 24 aa, Mycobacterium avium
YRALKEASYRLGARTLYHQFGAPL

SEQ ID NO: 92856 - protein, 21 aa, Mycobacterium avium
YRALLRAQLPPGGRLGLYGFG

SEQ ID NO: 92857 - protein, 19 aa, Mycobacterium avium
YRATVSIPPATGLDPANYQ

SEQ ID NO: 92858 - protein, 19 aa, Mycobacterium avium
YRCGPYGVLIVRGDDGALR

SEQ ID NO: 92859 - protein, 18 aa, Mycobacterium avium
YRDPGALGGYRTYTPALK

SEQ ID NO: 92860 - protein, 25 aa, Mycobacterium avium
YRDPRIPHNLYRPTFVKSLVMVPIR

SEQ ID NO: 92861 - protein, 25 aa, Mycobacterium avium
YRDSRLGLFPFRRNLSLFAVDLALL

SEQ ID NO: 92862 - protein, 18 aa, Mycobacterium avium
YRDYIGWLAGRDLQASQR

SEQ ID NO: 92863 - protein, 23 aa, Mycobacterium avium
YREMCPRIMAMTVREGKVCALWD

SEQ ID NO: 92864 - protein, 19 aa, Mycobacterium avium
YRFDLDKLIPVAAKIGPTV

SEQ ID NO: 92865 - protein, 19 aa, Mycobacterium avium
YRFTEFRSAKTAPKDKGLQ

SEQ ID NO: 92866 - protein, 19 aa, Mycobacterium avium
YRGKLWTFRQYSGFGTAEE

SEQ ID NO: 92867 - protein, 18 aa, Mycobacterium avium
YRGRPTWSTAPGLPHDGY

SEQ ID NO: 92868 - protein, 27 aa, Mycobacterium avium
YRISGFAEILGFYGLNYWYPFQVTALG

SEQ ID NO: 92869 - protein, 19 aa, Mycobacterium avium
YRLELFGSDGTIIGDGDLR

SEQ ID NO: 92870 - protein, 19 aa, Mycobacterium avium
YRLGFPIEKIRTVDHYRDA

SEQ ID NO: 92871 - protein, 19 aa, Mycobacterium avium
YRLPTGFRAARRAARGAAR

SEQ ID NO: 92872 - protein, 20 aa, Mycobacterium avium
YRLVDFSGAVVRTLPARVTL

SEQ ID NO: 92873 - protein, 20 aa, Mycobacterium avium
YRMALLRWLSVCDIRDEHGQ

SEQ ID NO: 92874 - protein, 20 aa, Mycobacterium avium
YRPDATPGIMIPFLASHTAK

SEQ ID NO: 92875 - protein, 20 aa, Mycobacterium avium
YRPDGTLEFVGRADHRVKIS

SEQ ID NO: 92876 - protein, 26 aa, Mycobacterium avium
YRPERYRFSVTLPRTVPGPGAGIVER

SEQ ID NO: 92877 - protein, 27 aa, Mycobacterium avium
YRRFVSPRGALALFGGWTGVDLAELDP

SEQ ID NO: 92878 - protein, 19 aa, Mycobacterium avium
YRTKVMWWDRRTLAAHADP

SEQ ID NO: 92879 - protein, 18 aa, Mycobacterium avium
YRTPGGAGIRLDGGTTLG

SEQ ID NO: 92880 - protein, 20 aa, Mycobacterium avium
YRVAPGHVFVTGMSNGGFMS

SEQ ID NO: 92881 - protein, 20 aa, Mycobacterium avium
YRWVFELDALDGPARTRLRA

SEQ ID NO: 92882 - protein, 20 aa, Mycobacterium avium
YSGHQFGGFVPRLGDGRALL

SEQ ID NO: 92883 - protein, 33 aa, Mycobacterium avium
YSGPTAALTDVWRALRASMRLVLEETTLADVAT

SEQ ID NO: 92884 - protein, 17 aa, Mycobacterium avium
YSKAIDGTFEWNQSLFG

SEQ ID NO: 92885 - protein, 30 aa, Mycobacterium avium
YSPIGAIILPGGWWLLSLQALGLAQNAPGV

SEQ ID NO: 92886 - protein, 17 aa, Mycobacterium avium
YSPQSWTTIPGGPFLSF

SEQ ID NO: 92887 - protein, 17 aa, Mycobacterium avium
YSQNLACEVVLAELAAE

SEQ ID NO: 92888 - protein, 25 aa, Mycobacterium avium
YSTLQAGPEFARWLDERGPARMPEI

SEQ ID NO: 92889 - protein, 18 aa, Mycobacterium avium
YSVPMARFVETFVRVLGD

SEQ ID NO: 92890 - protein, 17 aa, Mycobacterium avium
YSYWGFGGADPGAYRRA

SEQ ID NO: 92891 - protein, 20 aa, Mycobacterium avium
YTAIMTPVFDVHRSPDGDLL

SEQ ID NO: 92892 - protein, 18 aa, Mycobacterium avium
YTDALIWTPAHLVADDVA

SEQ ID NO: 92893 - protein, 22 aa, Mycobacterium avium
YTEARLTPLAMEMLREIDEETV

SEQ ID NO: 92894 - protein, 28 aa, Mycobacterium avium
YTEEMPIAVPWSLPAARPVHSGDPDDPA

SEQ ID NO: 92895 - protein, 29 aa, Mycobacterium avium
YTEVLGFRSRGAFRVPLPAEFGPIRVRFL

SEQ ID NO: 92896 - protein, 17 aa, Mycobacterium avium
YTFTIRDGVSFSDHTPL

SEQ ID NO: 92897 - protein, 21 aa, Mycobacterium avium
YTGIARWRPLGDYWFEGVSRA

SEQ ID NO: 92898 - protein, 18 aa, Mycobacterium avium
YTGIVALFARLARQGQAL

SEQ ID NO: 92899 - protein, 27 aa, Mycobacterium avium
YTKGFKFSTYATWWIRQAITRGMADQS

SEQ ID NO: 92900 - protein, 17 aa, Mycobacterium avium
YTLAMLLAEALGFDAFR

SEQ ID NO: 92901 - protein, 27 aa, Mycobacterium avium
YTLKEPYSVVGLIFPWNGPIFNASAKL

SEQ ID NO: 92902 - protein, 18 aa, Mycobacterium avium
YTLKSVAAKDVWVRPTER

SEQ ID NO: 92903 - protein, 26 aa, Mycobacterium avium
YTLRFKDLRTGELYPDEIADIAAGAT

SEQ ID NO: 92904 - protein, 22 aa, Mycobacterium avium
YTLRLPLDVLVVASANPEDYTN

SEQ ID NO: 92905 - protein, 18 aa, Mycobacterium avium
YTQTLTLWRGVARVDCRT

SEQ ID NO: 92906 - protein, 20 aa, Mycobacterium avium
YTRDGQRRWQPFTDWPDPWV

SEQ ID NO: 92907 - protein, 23 aa, Mycobacterium avium
YTRSEGGGMFVLKRVDDARRDGD

SEQ ID NO: 92908 - protein, 24 aa, Mycobacterium avium
YTTSWCGYCHRLMTVLKSNGIPYE

SEQ ID NO: 92909 - protein, 20 aa, Mycobacterium avium
YTVEKIRVFDAFPLTHHSEC

SEQ ID NO: 92910 - protein, 18 aa, Mycobacterium avium
YVAECLAVARAEGARLSD

SEQ ID NO: 92911 - protein, 18 aa, Mycobacterium avium
YVAGAGVACGYWRRGGLT

SEQ ID NO: 92912 - protein, 25 aa, Mycobacterium avium
YVDCARCAGMLKPDIVYFGESVPKD

SEQ ID NO: 92913 - protein, 17 aa, Mycobacterium avium
YVEGEWGAVASLSPELF

SEQ ID NO: 92914 - protein, 24 aa, Mycobacterium avium
YVFRYGEGTAMAMMYPDNPVAHKS

SEQ ID NO: 92915 - protein, 17 aa, Mycobacterium avium
YVGGAGVACGYWRRGGL

SEQ ID NO: 92916 - protein, 18 aa, Mycobacterium avium
YVKDAAVAHGRGRDAVRI

SEQ ID NO: 92917 - protein, 27 aa, Mycobacterium avium
YVLAHPCPMCLGALYYCSPREVIFLTT

SEQ ID NO: 92918 - protein, 17 aa, Mycobacterium avium
YVLHARRYLADNGPIHP

SEQ ID NO: 92919 - protein, 20 aa, Mycobacterium avium
YVLNSAFYKPALLSRDMQAL

SEQ ID NO: 92920 - protein, 23 aa, Mycobacterium avium
YVRRRFTFDPGLLREAGMSNAAI

SEQ ID NO: 92921 - protein, 23 aa, Mycobacterium avium
YVSDADALYAEWAALDNLGGRLL

SEQ ID NO: 92922 - protein, 19 aa, Mycobacterium avium
YVVRRGEHLYNFWRDADNP

SEQ ID NO: 92923 - protein, 17 aa, Mycobacterium avium
YWERSESTVEGFVLPGF

SEQ ID NO: 92924 - protein, 20 aa, Mycobacterium avium
YWYRNIRQTVQFDQAVRSAA

SEQ ID NO: 92925 - protein, 18 aa, Mycobacterium avium
YYASKSLILYDIYQQAAE

SEQ ID NO: 92926 - protein, 26 aa, Mycobacterium avium
YYEKGLRDVMKYHVSMTSSFNFPAVD

SEQ ID NO: 92927 - protein, 23 aa, Mycobacterium avium
YYQRFGFTVTREIVLPDGGPSMW

SEQ ID NO: 92928 - protein, 23 aa, Mycobacterium avium
YYSQGRRAVSMVPVKRFDDQLNA

SEQ ID NO: 92929 - protein, 17 aa, Mycobacterium avium
AAAAAFETAYAMTVPPP

SEQ ID NO: 92930 - protein, 18 aa, Mycobacterium avium
AAAAARCRQHRCFPVLAG

SEQ ID NO: 92931 - protein, 19 aa, Mycobacterium avium
AAAADCLAHAVLGGVLAAD

SEQ ID NO: 92932 - protein, 27 aa, Mycobacterium avium
AAAADRLRVRPGRCVVVAGDPAAVEAA

SEQ ID NO: 92933 - protein, 20 aa, Mycobacterium avium
AAAATQVEWLTATAEQAAQT

SEQ ID NO: 92934 - protein, 35 aa, Mycobacterium avium
AAAAWPAAEQTWLHGWLLRAGPPPGRPAGPAADSA

SEQ ID NO: 92935 - protein, 32 aa, Mycobacterium avium
AAAAWPAAEQTWLHGWLLRAGPPSGRPAGPAA

SEQ ID NO: 92936 - protein, 18 aa, Mycobacterium avium
AAAAYELAHAMTVPPAAV

SEQ ID NO: 92937 - protein, 17 aa, Mycobacterium avium
AAACGAGGDCGRCRRTL

SEQ ID NO: 92938 - protein, 17 aa, Mycobacterium avium
AAADCLAHAVLGGVLAA

SEQ ID NO: 92939 - protein, 18 aa, Mycobacterium avium
AAADCLAHAVLGGVLAAD

SEQ ID NO: 92940 - protein, 22 aa, Mycobacterium avium
AAADFRLFWDNAYAVHTLTHDF

SEQ ID NO: 92941 - protein, 23 aa, Mycobacterium avium
AAADGWAEIAGRLAAARHDFYVL

SEQ ID NO: 92942 - protein, 22 aa, Mycobacterium avium
AAADPGCRWADAVPNADQPPLR

SEQ ID NO: 92943 - protein, 17 aa, Mycobacterium avium
AAAGAGRLRSRSRQGAT

SEQ ID NO: 92944 - protein, 19 aa, Mycobacterium avium
AAAGLRHLLVLLAAGIDEA

SEQ ID NO: 92945 - protein, 24 aa, Mycobacterium avium
AAAHPGRPVWGHGWDETSWPERTP

SEQ ID NO: 92946 - protein, 25 aa, Mycobacterium avium
AAAHPGRPVWGHGWDETSWPERTPP

SEQ ID NO: 92947 - protein, 17 aa, Mycobacterium avium
AAAHPGTRVRWVTGTPT

SEQ ID NO: 92948 - protein, 27 aa, Mycobacterium avium
AAAHSSCFSMALALKLGENHTPPQRLE

SEQ ID NO: 92949 - protein, 18 aa, Mycobacterium avium
AAAIPMPLMHTLELNAVT

SEQ ID NO: 92950 - protein, 24 aa, Mycobacterium avium
AAAKAGVIGLTIAAARDLSSAGIR

SEQ ID NO: 92951 - protein, 24 aa, Mycobacterium avium
AAAKAGVIGLTIAAARDLSSVGIR

SEQ ID NO: 92952 - protein, 26 aa, Mycobacterium avium
AAALARRTAELGIRVLRYGSGPHGQA

SEQ ID NO: 92953 - protein, 17 aa, Mycobacterium avium
AAALARVPGGTVQEGHD

SEQ ID NO: 92954 - protein, 25 aa, Mycobacterium avium
AAALAVAPQPGWRVEVGDTAITVSG

SEQ ID NO: 92955 - protein, 19 aa, Mycobacterium avium
AAALGPLAVPASWTSVIPA

SEQ ID NO: 92956 - protein, 23 aa, Mycobacterium avium
AAALLPDRWLIIGTGAADQELGD

SEQ ID NO: 92957 - protein, 18 aa, Mycobacterium avium
AAALPEFVAATDADPSMA

SEQ ID NO: 92958 - protein, 18 aa, Mycobacterium avium
AAALPGVVDIVPAARTVL

SEQ ID NO: 92959 - protein, 25 aa, Mycobacterium avium
AAALPRIAAMGFDVVYVPPIHPIGK

SEQ ID NO: 92960 - protein, 20 aa, Mycobacterium avium
AAALRRLAAQPGPDRDDALR

SEQ ID NO: 92961 - protein, 17 aa, Mycobacterium avium
AAAMAAVYDDFRAINAD

SEQ ID NO: 92962 - protein, 18 aa, Mycobacterium avium
AAAMGQATTVSKLSVPPS

SEQ ID NO: 92963 - protein, 17 aa, Mycobacterium avium
AAAPEFRTVIRGPLDTD

SEQ ID NO: 92964 - protein, 23 aa, Mycobacterium avium
AAAPRVCAVVGRAMTVGVLSAPP

SEQ ID NO: 92965 - protein, 23 aa, Mycobacterium avium
AAAPRVCAVVGRAMTVGVLSAPR

SEQ ID NO: 92966 - protein, 24 aa, Mycobacterium avium
AAAQRAPRAPALLVASERTPIAYA

SEQ ID NO: 92967 - protein, 25 aa, Mycobacterium avium
AAAQRAPRAPALLVASGRTPIAYAD

SEQ ID NO: 92968 - protein, 22 aa, Mycobacterium avium
AAAQRELWRAVSHDGDITGGLA

SEQ ID NO: 92969 - protein, 23 aa, Mycobacterium avium
AAARAAFDAGPWSRGGPSHRIAA

SEQ ID NO: 92970 - protein, 18 aa, Mycobacterium avium
AAARAGGQLAHIEAAVLG

SEQ ID NO: 92971 - protein, 17 aa, Mycobacterium avium
AAARAGIPFSLSTLGTC

SEQ ID NO: 92972 - protein, 18 aa, Mycobacterium avium
AAARARAGRGPTLIEAIT

SEQ ID NO: 92973 - protein, 19 aa, Mycobacterium avium
AAARCDCRALGMVPRRADG

SEQ ID NO: 92974 - protein, 17 aa, Mycobacterium avium
AAARFKEVIDRWNAESV

SEQ ID NO: 92975 - protein, 25 aa, Mycobacterium avium
AAARRARYAALAAHRDGPVLLGHTL

SEQ ID NO: 92976 - protein, 21 aa, Mycobacterium avium
AAARTGYSVFTFREKIASGEL

SEQ ID NO: 92977 - protein, 26 aa, Mycobacterium avium
AAARTWEVHGGTSLAGYVVPQRPIVD

SEQ ID NO: 92978 - protein, 17 aa, Mycobacterium avium
AAASAFEAAYAMTVPPP

SEQ ID NO: 92979 - protein, 25 aa, Mycobacterium avium
AAASARFGLLLARTGPDKHRDLSMF

SEQ ID NO: 92980 - protein, 22 aa, Mycobacterium avium
AAASRPALPTGPLTSASAADVI

SEQ ID NO: 92981 - protein, 19 aa, Mycobacterium avium
AAAVAFLVSEAASWITGET

SEQ ID NO: 92982 - protein, 24 aa, Mycobacterium avium
AAAVFRFLRRVPRDTVVLLDEAYV

SEQ ID NO: 92983 - protein, 19 aa, Mycobacterium avium
AAAVRAALDIGYRHIDTAE

SEQ ID NO: 92984 - protein, 17 aa, Mycobacterium avium
AAAYRRGLLATPGAGTL

SEQ ID NO: 92985 - protein, 26 aa, Mycobacterium avium
AACARLGERALICFGGTDVRGVPRFD

SEQ ID NO: 92986 - protein, 19 aa, Mycobacterium avium
AACGPPGLFCEEYDVRQRQ

SEQ ID NO: 92987 - protein, 17 aa, Mycobacterium avium
AACRELAAAGAQVAGHD

SEQ ID NO: 92988 - protein, 23 aa, Mycobacterium avium
AACTALSRPPLFLMASSAAVYGS

SEQ ID NO: 92989 - protein, 23 aa, Mycobacterium avium
AACWDARRWLGRPGLEHGASADL

SEQ ID NO: 92990 - protein, 19 aa, Mycobacterium avium
AADAVFWEPFVERGFSPDS

SEQ ID NO: 92991 - protein, 18 aa, Mycobacterium avium
AADCALFVIAANEGVDEP

SEQ ID NO: 92992 - protein, 21 aa, Mycobacterium avium
AADELSGLFVPTDVADEDAVN

SEQ ID NO: 92993 - protein, 23 aa, Mycobacterium avium
AADFLTPFIWRMDTFGRPHLEQT

SEQ ID NO: 92994 - protein, 25 aa, Mycobacterium avium
AADGKCPPPAGFFGTVASVDGNTIA

SEQ ID NO: 92995 - protein, 18 aa, Mycobacterium avium
AADGWLRTGDLGVVDADG

SEQ ID NO: 92996 - protein, 19 aa, Mycobacterium avium
AADGWRISHDMSVLGAAAA

SEQ ID NO: 92997 - protein, 23 aa, Mycobacterium avium
AADGWRISQDMSLLGAAAAVPMP

SEQ ID NO: 92998 - protein, 29 aa, Mycobacterium avium
AADIIVRARVKAVLVQKGFLGQDYAAPAG

SEQ ID NO: 92999 - protein, 26 aa, Mycobacterium avium
AADLTNRSTIRWTLHQLVASGVVSVY

SEQ ID NO: 93000 - protein, 23 aa, Mycobacterium avium
AADPRPAVLADHDWLINQRGVAT

SEQ ID NO: 93001 - protein, 23 aa, Mycobacterium avium
AADRAELAAGLAAIARGEEHALI

SEQ ID NO: 93002 - protein, 23 aa, Mycobacterium avium
AADRAELAAGLGAIARGEEHALI

SEQ ID NO: 93003 - protein, 18 aa, Mycobacterium avium
AADRGRPRGCGPLRQVVS

SEQ ID NO: 93004 - protein, 17 aa, Mycobacterium avium
AADRGRRGPLLRAKHAL

SEQ ID NO: 93005 - protein, 17 aa, Mycobacterium avium
AADVLRTVDPVLVPADV

SEQ ID NO: 93006 - protein, 19 aa, Mycobacterium avium
AAEALSWGLVTAVYPADEF

SEQ ID NO: 93007 - protein, 17 aa, Mycobacterium avium
AAEARRVALPNIVRLLP

SEQ ID NO: 93008 - protein, 18 aa, Mycobacterium avium
AAECLAPGGRLVFNTFLA

SEQ ID NO: 93009 - protein, 23 aa, Mycobacterium avium
AAEHPERFARLVVANTGLPNGDQ

SEQ ID NO: 93010 - protein, 18 aa, Mycobacterium avium
AAEIFGWLEEGRARVRVW

SEQ ID NO: 93011 - protein, 26 aa, Mycobacterium avium
AAELRHAWLDLHESWLAAKAAQIGIA

SEQ ID NO: 93012 - protein, 18 aa, Mycobacterium avium
AAEPGSDHQLAFVNALCS

SEQ ID NO: 93013 - protein, 17 aa, Mycobacterium avium
AAEPLLLIVDVAKPRPS

SEQ ID NO: 93014 - protein, 26 aa, Mycobacterium avium
AAEPVARWGAAVPWAAILEPAEWMPV

SEQ ID NO: 93015 - protein, 17 aa, Mycobacterium avium
AAERAGEAPPRLVTSAE

SEQ ID NO: 93016 - protein, 18 aa, Mycobacterium avium
AAERGRPRGCGPLRQVVS

SEQ ID NO: 93017 - protein, 31 aa, Mycobacterium avium
AAERPAVLPLSFAQSRLWFIDQLHGPSPVYN

SEQ ID NO: 93018 - protein, 18 aa, Mycobacterium avium
AAEVVRQALGFDVDVPIE

SEQ ID NO: 93019 - protein, 23 aa, Mycobacterium avium
AAEVYKRSLAVFFLSEPPEGFDT

SEQ ID NO: 93020 - protein, 21 aa, Mycobacterium avium
AAFAAVRSRHADLIPPGALRA

SEQ ID NO: 93021 - protein, 17 aa, Mycobacterium avium
AAFCADLALRTRRIDVD

SEQ ID NO: 93022 - protein, 18 aa, Mycobacterium avium
AAFRQAWGAEPIDMGMGG

SEQ ID NO: 93023 - protein, 19 aa, Mycobacterium avium
AAFRRRLILPCLRVGAATL

SEQ ID NO: 93024 - protein, 17 aa, Mycobacterium avium
AAGAGFFPPYVVGPPGI

SEQ ID NO: 93025 - protein, 23 aa, Mycobacterium avium
AAGAKFATAFTRRGLVAEYGITW

SEQ ID NO: 93026 - protein, 18 aa, Mycobacterium avium
AAGARVRLCKGAYDEPAS

SEQ ID NO: 93027 - protein, 17 aa, Mycobacterium avium
AAGARWATWAISMRTAT

SEQ ID NO: 93028 - protein, 25 aa, Mycobacterium avium
AAGEGFKARGIDGVGIDELMKAAGM

SEQ ID NO: 93029 - protein, 23 aa, Mycobacterium avium
AAGEMFAPFLARLVEDPRARSRY

SEQ ID NO: 93030 - protein, 22 aa, Mycobacterium avium
AAGEMFVPFLARLSEDPRARSD

SEQ ID NO: 93031 - protein, 18 aa, Mycobacterium avium
AAGFPSPLPYLVSPDEQS

SEQ ID NO: 93032 - protein, 21 aa, Mycobacterium avium
AAGIDCIEHGFLIDDEAIASM

SEQ ID NO: 93033 - protein, 30 aa, Mycobacterium avium
AAGLDSRAWRLAWPAGCVVYEIDQPKVLEF

SEQ ID NO: 93034 - protein, 26 aa, Mycobacterium avium
AAGLKWWTSEIQWEIIDRCLQLHGGY

SEQ ID NO: 93035 - protein, 18 aa, Mycobacterium avium
AAGLPSLLVLTGVNSARD

SEQ ID NO: 93036 - protein, 17 aa, Mycobacterium avium
AAGLPVSPRMIFENPTV

SEQ ID NO: 93037 - protein, 18 aa, Mycobacterium avium
AAGNGPGVHGLWPQVLAL

SEQ ID NO: 93038 - protein, 22 aa, Mycobacterium avium
AAGPPPRRGFGVDVGGSGIKGG

SEQ ID NO: 93039 - protein, 24 aa, Mycobacterium avium
AAGRAAAQIPWRLVDLAALTDGHR

SEQ ID NO: 93040 - protein, 25 aa, Mycobacterium avium
AAGRAVFTPSLAGLVLGEYRRIAQS

SEQ ID NO: 93041 - protein, 18 aa, Mycobacterium avium
AAGRRTQVRAVWRAVSAV

SEQ ID NO: 93042 - protein, 26 aa, Mycobacterium avium
AAGRRVRPGALLRPAGGVADRPGHRD

SEQ ID NO: 93043 - protein, 27 aa, Mycobacterium avium
AAGRSRAQSRFAWQRIALDALNIYQSL

SEQ ID NO: 93044 - protein, 18 aa, Mycobacterium avium
AAGSPPIYFGFGSSARVA

SEQ ID NO: 93045 - protein, 23 aa, Mycobacterium avium
AAGSRLFAERGYYAVRMEEIAAA

SEQ ID NO: 93046 - protein, 18 aa, Mycobacterium avium
AAGTPPIYFGFGSSARVA

SEQ ID NO: 93047 - protein, 18 aa, Mycobacterium avium
AAGVAVVHCLIEKRPDNR

SEQ ID NO: 93048 - protein, 24 aa, Mycobacterium avium
AAGVHRGYKCSIRTPWWSTPSLWQ

SEQ ID NO: 93049 - protein, 21 aa, Mycobacterium avium
AAGVRRLVLASSMVVYGQGGY

SEQ ID NO: 93050 - protein, 17 aa, Mycobacterium avium
AAHARIWSVITRAYSRT

SEQ ID NO: 93051 - protein, 20 aa, Mycobacterium avium
AAHARPDVLVPMTTLPTTPI

SEQ ID NO: 93052 - protein, 32 aa, Mycobacterium avium
AAHAYSAANWLALNCRRHMQLYGTRKEQLGWV

SEQ ID NO: 93053 - protein, 21 aa, Mycobacterium avium
AAHGWPEYWTCEKCRETVPYI

SEQ ID NO: 93054 - protein, 28 aa, Mycobacterium avium
AAIAAECDRRGWTVVGWYADEGVSGGKA

SEQ ID NO: 93055 - protein, 19 aa, Mycobacterium avium
AAIAALRPVQHGIRDARID

SEQ ID NO: 93056 - protein, 17 aa, Mycobacterium avium
AAIDNRLLWQLDGRDNR

SEQ ID NO: 93057 - protein, 17 aa, Mycobacterium avium
AAIDNRLLWQLDGRYMQ

SEQ ID NO: 93058 - protein, 27 aa, Mycobacterium avium
AAIRADFPILKRIMRSGNQLAYLDSGA

SEQ ID NO: 93059 - protein, 21 aa, Mycobacterium avium
AAIRADFPILKRIVRSGNQLA

SEQ ID NO: 93060 - protein, 18 aa, Mycobacterium avium
AAISMPGMMDTILNLGMN

SEQ ID NO: 93061 - protein, 19 aa, Mycobacterium avium
AAITGYRASNAVAVKIHPP

SEQ ID NO: 93062 - protein, 23 aa, Mycobacterium avium
AAKANGVALILVGHVTKDGAIAG

SEQ ID NO: 93063 - protein, 20 aa, Mycobacterium avium
AAKFKNLDLQAARQDGVTYQ

SEQ ID NO: 93064 - protein, 27 aa, Mycobacterium avium
AAKLKEAICRGTLWAIRREAAKPGSYR

SEQ ID NO: 93065 - protein, 20 aa, Mycobacterium avium
AALAEAVWALPQPVIAAVNG

SEQ ID NO: 93066 - protein, 17 aa, Mycobacterium avium
AALAIRAGAVWVAANID

SEQ ID NO: 93067 - protein, 24 aa, Mycobacterium avium
AALAMGSGHYAGWLEAGTRGPHGG

SEQ ID NO: 93068 - protein, 25 aa, Mycobacterium avium
AALARGRTGVFWIREMLPIGELREI

SEQ ID NO: 93069 - protein, 26 aa, Mycobacterium avium
AALARGRTGVFWIREMLPIGELREIL

SEQ ID NO: 93070 - protein, 18 aa, Mycobacterium avium
AALARLGAVQNPIIPVLR

SEQ ID NO: 93071 - protein, 27 aa, Mycobacterium avium
AALDACLDRYARLFAHLRTWDSHTELA

SEQ ID NO: 93072 - protein, 29 aa, Mycobacterium avium
AALEGHRRRLRAALCLRGEQRRDRRPGGG

SEQ ID NO: 93073 - protein, 24 aa, Mycobacterium avium
AALEQARPLFPHHLDTIVHVPAPS

SEQ ID NO: 93074 - protein, 20 aa, Mycobacterium avium
AALFPVVFTSGLGLVDASAR

SEQ ID NO: 93075 - protein, 18 aa, Mycobacterium avium
AALFRLALEQAPAGSVLH

SEQ ID NO: 93076 - protein, 17 aa, Mycobacterium avium
AALGLPLDEDIVAFVGR

SEQ ID NO: 93077 - protein, 19 aa, Mycobacterium avium
AALGLPLDKDIVAFVGRIQ

SEQ ID NO: 93078 - protein, 17 aa, Mycobacterium avium
AALGRAFQLTNFLRDVD

SEQ ID NO: 93079 - protein, 18 aa, Mycobacterium avium
AALGRAYLRRQVRDPAVR

SEQ ID NO: 93080 - protein, 26 aa, Mycobacterium avium
AALHPVAGCTAHWAFVRSASKAYGPD

SEQ ID NO: 93081 - protein, 23 aa, Mycobacterium avium
AALHRVAPELAQAYRVNALRTAQ

SEQ ID NO: 93082 - protein, 19 aa, Mycobacterium avium
AALIMFAGGDPWKINATLQ

SEQ ID NO: 93083 - protein, 18 aa, Mycobacterium avium
AALKSFARKGFANVTVTE

SEQ ID NO: 93084 - protein, 20 aa, Mycobacterium avium
AALKSGAAYLPIDPALPAAR

SEQ ID NO: 93085 - protein, 21 aa, Mycobacterium avium
AALKSGAAYLPIDPALPAARV

SEQ ID NO: 93086 - protein, 19 aa, Mycobacterium avium
AALLARSGAGPGALVGLST

SEQ ID NO: 93087 - protein, 18 aa, Mycobacterium avium
AALLRPAGSVLVEAHDEW

SEQ ID NO: 93088 - protein, 24 aa, Mycobacterium avium
AALPLCALLGGWLRGQVQPQAAAR

SEQ ID NO: 93089 - protein, 25 aa, Mycobacterium avium
AALPLCVLLGGWLRGQVQPRAAARA

SEQ ID NO: 93090 - protein, 26 aa, Mycobacterium avium
AALPLCVLLGGWLRRQVQPRAAARAR

SEQ ID NO: 93091 - protein, 17 aa, Mycobacterium avium
AALPSPFCYEIAQWAGE

SEQ ID NO: 93092 - protein, 18 aa, Mycobacterium avium
AALQAHWAALGVSRLSIL

SEQ ID NO: 93093 - protein, 23 aa, Mycobacterium avium
AALQARLAALAFEGALVATVPLP

SEQ ID NO: 93094 - protein, 24 aa, Mycobacterium avium
AALQARLAALAFEGALVATVPLPA

SEQ ID NO: 93095 - protein, 21 aa, Mycobacterium avium
AALRAERPVSWHPPVEDSLLP

SEQ ID NO: 93096 - protein, 22 aa, Mycobacterium avium
AALRAERPVSWHPPVEDSLLPD

SEQ ID NO: 93097 - protein, 19 aa, Mycobacterium avium
AALRAGAAGFVLKDSSAEE

SEQ ID NO: 93098 - protein, 24 aa, Mycobacterium avium
AALRARLRELLGVEVAVLVTDTMG

SEQ ID NO: 93099 - protein, 24 aa, Mycobacterium avium
AALRGVDRLVRFPGPNGLAHEIFT

SEQ ID NO: 93100 - protein, 17 aa, Mycobacterium avium
AALRLARSIAENNAYGV

SEQ ID NO: 93101 - protein, 17 aa, Mycobacterium avium
AALRPFFAAVTGAYSPI

SEQ ID NO: 93102 - protein, 17 aa, Mycobacterium avium
AALRRAGLDPSAPAVWL

SEQ ID NO: 93103 - protein, 22 aa, Mycobacterium avium
AALSRLGRPYVWGATGPDQFDC

SEQ ID NO: 93104 - protein, 18 aa, Mycobacterium avium
AALTASRFVACPFGGTGT

SEQ ID NO: 93105 - protein, 31 aa, Mycobacterium avium
AALVDLRADCALWHGLSWEPAVVARLLEAGT

SEQ ID NO: 93106 - protein, 22 aa, Mycobacterium avium
AAMPASGGAVFGEMAAASLAGR

SEQ ID NO: 93107 - protein, 22 aa, Mycobacterium avium
AAMPASGGAVFGEMAAASVAGR

SEQ ID NO: 93108 - protein, 18 aa, Mycobacterium avium
AAMRARIGVVSREERLHR

SEQ ID NO: 93109 - protein, 17 aa, Mycobacterium avium
AANASAGRRGRRLTINA

SEQ ID NO: 93110 - protein, 17 aa, Mycobacterium avium
AANGFILDGFPRSLQQA

SEQ ID NO: 93111 - protein, 17 aa, Mycobacterium avium
AANGLLCDTHMVVSVGP

SEQ ID NO: 93112 - protein, 18 aa, Mycobacterium avium
AANLCWKLAAVLRGQAPE

SEQ ID NO: 93113 - protein, 26 aa, Mycobacterium avium
AANRARLAAALGLKPDRVVWMNQVHG

SEQ ID NO: 93114 - protein, 25 aa, Mycobacterium avium
AANRECARLHLITGRDEIERAATLL

SEQ ID NO: 93115 - protein, 26 aa, Mycobacterium avium
AANSWLDAFTHWRRAQGLPATAIAWG

SEQ ID NO: 93116 - protein, 19 aa, Mycobacterium avium
AAPAADWGAALGDAAGMPA

SEQ ID NO: 93117 - protein, 19 aa, Mycobacterium avium
AAPEAFFIAKLEPLGLPVG

SEQ ID NO: 93118 - protein, 24 aa, Mycobacterium avium
AAPELRAARDLRYTLLDDVPVATL

SEQ ID NO: 93119 - protein, 19 aa, Mycobacterium avium
AAPFIAWATTTAGRAEQVA

SEQ ID NO: 93120 - protein, 20 aa, Mycobacterium avium
AAPGAAWRDNLRAVGAATAR

SEQ ID NO: 93121 - protein, 25 aa, Mycobacterium avium
AAPLLCAGITLFSPLRHWNAGPGTR

SEQ ID NO: 93122 - protein, 19 aa, Mycobacterium avium
AAPMLGIVRASDGWIGINC

SEQ ID NO: 93123 - protein, 21 aa, Mycobacterium avium
AAPMMAAAAAFSNLADELSTT

SEQ ID NO: 93124 - protein, 27 aa, Mycobacterium avium
AAPPGRPGPFGEMPLFGGAPLMGLPGR

SEQ ID NO: 93125 - protein, 18 aa, Mycobacterium avium
AAPPRIGSLTGVPVNPIA

SEQ ID NO: 93126 - protein, 19 aa, Mycobacterium avium
AAPPRRAHAPWASRATWSP

SEQ ID NO: 93127 - protein, 22 aa, Mycobacterium avium
AAPQVYSPLVWYIVDGTRVAYK

SEQ ID NO: 93128 - protein, 18 aa, Mycobacterium avium
AAQDAWREALAGFETPTL

SEQ ID NO: 93129 - protein, 24 aa, Mycobacterium avium
AAQFSQWGALLARTDPSAPKHSGI

SEQ ID NO: 93130 - protein, 24 aa, Mycobacterium avium
AAQFWASIHGFVMLELAGYCSDDG

SEQ ID NO: 93131 - protein, 25 aa, Mycobacterium avium
AAQIKRLKVGTARRFSATTSETLAA

SEQ ID NO: 93132 - protein, 25 aa, Mycobacterium avium
AAQIKRLKVGTARRFSATTSETLVA

SEQ ID NO: 93133 - protein, 24 aa, Mycobacterium avium
AAQLPRLNRYAAKLAAALDKVRAG

SEQ ID NO: 93134 - protein, 18 aa, Mycobacterium avium
AAQRAGIELLALGGRFIE

SEQ ID NO: 93135 - protein, 20 aa, Mycobacterium avium
AAQRKLLAPFFVWVTVGLYD

SEQ ID NO: 93136 - protein, 17 aa, Mycobacterium avium
AAQRRWARLAPADRAAG

SEQ ID NO: 93137 - protein, 20 aa, Mycobacterium avium
AAQTLLSLGCHRAQGFLLSR

SEQ ID NO: 93138 - protein, 23 aa, Mycobacterium avium
AARAAWGEALAGFDTPTLVGPPH

SEQ ID NO: 93139 - protein, 22 aa, Mycobacterium avium
AARAKAAGVVLAIENASSLYAD

SEQ ID NO: 93140 - protein, 24 aa, Mycobacterium avium
AARDVAVTLCAKAFQSTPVPGVVT

SEQ ID NO: 93141 - protein, 25 aa, Mycobacterium avium
AARFDRISYTWIPRERNSHADRLAN

SEQ ID NO: 93142 - protein, 18 aa, Mycobacterium avium
AARFVPNPAAAALEAQVY

SEQ ID NO: 93143 - protein, 18 aa, Mycobacterium avium
AARGPGCRDCVVSVILGV

SEQ ID NO: 93144 - protein, 22 aa, Mycobacterium avium
AARGRIACVAHHWSERGDELVD

SEQ ID NO: 93145 - protein, 24 aa, Mycobacterium avium
AARLQGGPVRFDFRVQIAGPTDST

SEQ ID NO: 93146 - protein, 18 aa, Mycobacterium avium
AARMSFTGATWQEIADAL

SEQ ID NO: 93147 - protein, 17 aa, Mycobacterium avium
AARQELAGWCARRDGQA

SEQ ID NO: 93148 - protein, 17 aa, Mycobacterium avium
AARRELTGLAVLDLYAG

SEQ ID NO: 93149 - protein, 18 aa, Mycobacterium avium
AARRPAVHQLGRAGFGAD

SEQ ID NO: 93150 - protein, 17 aa, Mycobacterium avium
AARRPRAAPAVLAHGDF

SEQ ID NO: 93151 - protein, 19 aa, Mycobacterium avium
AARSAVYARSFTRRAEEPK

SEQ ID NO: 93152 - protein, 25 aa, Mycobacterium avium
AARTWEVHGGTSLAGYVVPQRPIAD

SEQ ID NO: 93153 - protein, 24 aa, Mycobacterium avium
AARWPRAGALGPLVRDPDGSVYPS

SEQ ID NO: 93154 - protein, 23 aa, Mycobacterium avium
AARYLCSGGLNLRDQSQVLTAIL

SEQ ID NO: 93155 - protein, 26 aa, Mycobacterium avium
AASARLGERALICFGGTDVRGVPRFD

SEQ ID NO: 93156 - protein, 18 aa, Mycobacterium avium
AASFPAPQTYVAPIAFNV

SEQ ID NO: 93157 - protein, 18 aa, Mycobacterium avium
AASFTARTQATVGGVTQA

SEQ ID NO: 93158 - protein, 18 aa, Mycobacterium avium
AASGPWPTTPLQQAYWVG

SEQ ID NO: 93159 - protein, 19 aa, Mycobacterium avium
AASLAGRALAGAGVRTVGN

SEQ ID NO: 93160 - protein, 18 aa, Mycobacterium avium
AASLEYPQLWGGLADLAQ

SEQ ID NO: 93161 - protein, 24 aa, Mycobacterium avium
AASNAAAAARAWLAASSACAAVVL

SEQ ID NO: 93162 - protein, 25 aa, Mycobacterium avium
AASPKETWLRLLLIDAGIPVPATQI

SEQ ID NO: 93163 - protein, 20 aa, Mycobacterium avium
AASPLVIVRPGGYFEFASAP

SEQ ID NO: 93164 - protein, 20 aa, Mycobacterium avium
AASRPARPLLRDCDGATLTV

SEQ ID NO: 93165 - protein, 17 aa, Mycobacterium avium
AASRWGSQISTLILPAD

SEQ ID NO: 93166 - protein, 18 aa, Mycobacterium avium
AASRYCDRLHVGGGHGSS

SEQ ID NO: 93167 - protein, 18 aa, Mycobacterium avium
AASVKGADLFPDVAAHQS

SEQ ID NO: 93168 - protein, 19 aa, Mycobacterium avium
AASVMGFVVRGGRIREIDV

SEQ ID NO: 93169 - protein, 17 aa, Mycobacterium avium
AATDLRRAARLIGTARR

SEQ ID NO: 93170 - protein, 17 aa, Mycobacterium avium
AATELTGLGVPDYPVVN

SEQ ID NO: 93171 - protein, 18 aa, Mycobacterium avium
AATGRARLWVPARAPLAA

SEQ ID NO: 93172 - protein, 17 aa, Mycobacterium avium
AATLKGLVDVGTHNAYH

SEQ ID NO: 93173 - protein, 19 aa, Mycobacterium avium
AATRRWCGADGKARALPAA

SEQ ID NO: 93174 - protein, 23 aa, Mycobacterium avium
AATRVKLAEVCRELGITEFMLLQ

SEQ ID NO: 93175 - protein, 24 aa, Mycobacterium avium
AATRYPPAGVRSFGPLRASLGHDP

SEQ ID NO: 93176 - protein, 17 aa, Mycobacterium avium
AAVAAALAFPAYVRNAE

SEQ ID NO: 93177 - protein, 18 aa, Mycobacterium avium
AAVAAALAFPAYVRNAEL

SEQ ID NO: 93178 - protein, 24 aa, Mycobacterium avium
AAVAACPRQAISVLTEQPPYAPDE

SEQ ID NO: 93179 - protein, 21 aa, Mycobacterium avium
AAVADALRVMIDRARAVHADQ

SEQ ID NO: 93180 - protein, 23 aa, Mycobacterium avium
AAVAEFAGALVLVSPEVGLTVVP

SEQ ID NO: 93181 - protein, 25 aa, Mycobacterium avium
AAVAERLAGSGARVHRLAVSHAFHS

SEQ ID NO: 93182 - protein, 19 aa, Mycobacterium avium
AAVAGARDALPGWAATSPA

SEQ ID NO: 93183 - protein, 17 aa, Mycobacterium avium
AAVDRLDNEPGLSVGVL

SEQ ID NO: 93184 - protein, 19 aa, Mycobacterium avium
AAVDSGYYPGQFQVGQTGK

SEQ ID NO: 93185 - protein, 17 aa, Mycobacterium avium
AAVELAVAAAAEHGFGS

SEQ ID NO: 93186 - protein, 17 aa, Mycobacterium avium
AAVGFGCSLALACDLVV

SEQ ID NO: 93187 - protein, 24 aa, Mycobacterium avium
AAVLPSHYEPFGIVALEAATAGTP

SEQ ID NO: 93188 - protein, 18 aa, Mycobacterium avium
AAVLRFAAAEVVPRLAGS

SEQ ID NO: 93189 - protein, 25 aa, Mycobacterium avium
AAVLSVGRSGVWLTVSDGEIRPCAC

SEQ ID NO: 93190 - protein, 24 aa, Mycobacterium avium
AAVNGFCVGSGIGLVGNSDVIVAS

SEQ ID NO: 93191 - protein, 17 aa, Mycobacterium avium
AAVRQWIEAEVPAAWRS

SEQ ID NO: 93192 - protein, 17 aa, Mycobacterium avium
AAVTFPWYQLGRQVHLR

SEQ ID NO: 93193 - protein, 20 aa, Mycobacterium avium
AAVVDWLRPFIDELRVCLHG

SEQ ID NO: 93194 - protein, 20 aa, Mycobacterium avium
AAVVGHRRVGPIGGQLQPLR

SEQ ID NO: 93195 - protein, 24 aa, Mycobacterium avium
AAWAVCVYCASGPQHPELLGVAAE

SEQ ID NO: 93196 - protein, 18 aa, Mycobacterium avium
AAYGSSVLILPDASLDAV

SEQ ID NO: 93197 - protein, 24 aa, Mycobacterium avium
AAYLKATFDWHIDGCTPLGDECPQ

SEQ ID NO: 93198 - protein, 18 aa, Mycobacterium avium
AAYLPIDPALPAARVEFM

SEQ ID NO: 93199 - protein, 22 aa, Mycobacterium avium
AAYRYCGFGLAQNAGMAPSQMA

SEQ ID NO: 93200 - protein, 17 aa, Mycobacterium avium
AAYSLSCGFDGNNHPLL

SEQ ID NO: 93201 - protein, 20 aa, Mycobacterium avium
ACALVRRPDLLVLDEPTVGL

SEQ ID NO: 93202 - protein, 23 aa, Mycobacterium avium
ACEAAELTARFARPLRFGTAGLR

SEQ ID NO: 93203 - protein, 18 aa, Mycobacterium avium
ACEDGVGLTVRYLTPHSK

SEQ ID NO: 93204 - protein, 22 aa, Mycobacterium avium
ACGAAELAARFARPLRFGTAGL

SEQ ID NO: 93205 - protein, 21 aa, Mycobacterium avium
ACGQPSWLLRVAGDSIGNDAP

SEQ ID NO: 93206 - protein, 21 aa, Mycobacterium avium
ACGQPSWLLRVAGDSIGNDTP

SEQ ID NO: 93207 - protein, 17 aa, Mycobacterium avium
ACGVCLLAKDCPSFGLG

SEQ ID NO: 93208 - protein, 17 aa, Mycobacterium avium
ACHARRAGIDVAVCKPV

SEQ ID NO: 93209 - protein, 18 aa, Mycobacterium avium
ACHARRAGIDVAVCKPVQ

SEQ ID NO: 93210 - protein, 22 aa, Mycobacterium avium
ACIPRATTDLVYIRMHGPDPAA

SEQ ID NO: 93211 - protein, 22 aa, Mycobacterium avium
ACIPRATTDLVYVRMHGPDPAA

SEQ ID NO: 93212 - protein, 20 aa, Mycobacterium avium
ACLDAGVRVGCFRPPTVPAG

SEQ ID NO: 93213 - protein, 21 aa, Mycobacterium avium
ACLDGGVRVGCFRPPTVPAGT

SEQ ID NO: 93214 - protein, 21 aa, Mycobacterium avium
ACLHWPREFGGAAATVTYQAV

SEQ ID NO: 93215 - protein, 23 aa, Mycobacterium avium
ACNCETCIRFAAITGGGTDAANA

SEQ ID NO: 93216 - protein, 22 aa, Mycobacterium avium
ACPNSAAGCPPNYVPPSTRCWP

SEQ ID NO: 93217 - protein, 20 aa, Mycobacterium avium
ACRDGFTAVNVCSGQPISIL

SEQ ID NO: 93218 - protein, 25 aa, Mycobacterium avium
ACTALPRPPLFLMASSAAVYGSRNP

SEQ ID NO: 93219 - protein, 22 aa, Mycobacterium avium
ACTEMATAYAVGREQFGRPIGS

SEQ ID NO: 93220 - protein, 25 aa, Mycobacterium avium
ACTLRNWLGMWSLRVAQTRAEPHLA

SEQ ID NO: 93221 - protein, 26 aa, Mycobacterium avium
ACTLRNWLSMWSLRVAQTRAEPHLAR

SEQ ID NO: 93222 - protein, 22 aa, Mycobacterium avium
ACTTRVFFCNSGTEANEVAFKL

SEQ ID NO: 93223 - protein, 20 aa, Mycobacterium avium
ADACAHALLDAIGRVPEIPE

SEQ ID NO: 93224 - protein, 23 aa, Mycobacterium avium
ADADLDTACGIGTMMSVAILSGQ

SEQ ID NO: 93225 - protein, 18 aa, Mycobacterium avium
ADADVRGGNIFRDGSIPY

SEQ ID NO: 93226 - protein, 21 aa, Mycobacterium avium
ADAERAAAVAAQLLVGSVAVN

SEQ ID NO: 93227 - protein, 21 aa, Mycobacterium avium
ADAGLVLGGRVFRPLDVDLRW

SEQ ID NO: 93228 - protein, 18 aa, Mycobacterium avium
ADAGRPAPRIVAGIPVCL

SEQ ID NO: 93229 - protein, 17 aa, Mycobacterium avium
ADAILPGVLSGKIRLCL

SEQ ID NO: 93230 - protein, 23 aa, Mycobacterium avium
ADAITHFAFGCGDDNPLFHDPTY

SEQ ID NO: 93231 - protein, 19 aa, Mycobacterium avium
ADAKLVLREPVSGLGSYPT

SEQ ID NO: 93232 - protein, 17 aa, Mycobacterium avium
ADAKLVLREPVTDLADY

SEQ ID NO: 93233 - protein, 18 aa, Mycobacterium avium
ADAKLVLREPVTDLADYP

SEQ ID NO: 93234 - protein, 20 aa, Mycobacterium avium
ADALGALAAGAGRLACGCGS

SEQ ID NO: 93235 - protein, 21 aa, Mycobacterium avium
ADALRDGWLHSGDLGLVRADG

SEQ ID NO: 93236 - protein, 18 aa, Mycobacterium avium
ADALRVMIDRARAVHADQ

SEQ ID NO: 93237 - protein, 17 aa, Mycobacterium avium
ADAMPWNQLPGPLRAIV

SEQ ID NO: 93238 - protein, 17 aa, Mycobacterium avium
ADAVLAASVFHFRELTI

SEQ ID NO: 93239 - protein, 31 aa, Mycobacterium avium
ADAVLRRAARFGDGWAPWLTKPDELPAKLDY

SEQ ID NO: 93240 - protein, 33 aa, Mycobacterium avium
ADAVLRRAARFGDGWAPWLTRPEELPAKMDYLR

SEQ ID NO: 93241 - protein, 17 aa, Mycobacterium avium
ADAYRFLPTLGEVDLHL

SEQ ID NO: 93242 - protein, 27 aa, Mycobacterium avium
ADCRTPTIASVYGWCIGGGVDLISAVD

SEQ ID NO: 93243 - protein, 22 aa, Mycobacterium avium
ADDACAMGCLGYVARASGIRTD

SEQ ID NO: 93244 - protein, 21 aa, Mycobacterium avium
ADDARWIYFTSGTTGRPKGVR

SEQ ID NO: 93245 - protein, 27 aa, Mycobacterium avium
ADDGTRVPVSIVHRVDIEFPSPALIYG

SEQ ID NO: 93246 - protein, 25 aa, Mycobacterium avium
ADDIDARLARWFGRQDLDSTVDLLA

SEQ ID NO: 93247 - protein, 20 aa, Mycobacterium avium
ADDLGLRVALVGTPAEEAGG

SEQ ID NO: 93248 - protein, 23 aa, Mycobacterium avium
ADDLPTAFARFAAFRRRRVRRIV

SEQ ID NO: 93249 - protein, 19 aa, Mycobacterium avium
ADEARWIYYSSGTTAAPKG

SEQ ID NO: 93250 - protein, 26 aa, Mycobacterium avium
ADELRRTAGRLADWVHAHDDLALPDL

SEQ ID NO: 93251 - protein, 17 aa, Mycobacterium avium
ADELSFGTIRKIMDETV

SEQ ID NO: 93252 - protein, 20 aa, Mycobacterium avium
ADELSGLFVPTDVADEDAVN

SEQ ID NO: 93253 - protein, 27 aa, Mycobacterium avium
ADELSRRGGWCRCIQIVGALDAAAALT

SEQ ID NO: 93254 - protein, 21 aa, Mycobacterium avium
ADEVPPELPVGSGPGVAEAFM

SEQ ID NO: 93255 - protein, 24 aa, Mycobacterium avium
ADEVSASIAALFDAHSQVYQALSA

SEQ ID NO: 93256 - protein, 24 aa, Mycobacterium avium
ADFDDLRVGMPVTAVFRPVDDTDP

SEQ ID NO: 93257 - protein, 17 aa, Mycobacterium avium
ADFDRPRFDSAARQLVA

SEQ ID NO: 93258 - protein, 24 aa, Mycobacterium avium
ADFEPTRVAALAFLAGELLPHAAA

SEQ ID NO: 93259 - protein, 22 aa, Mycobacterium avium
ADFKALSWESWQPTARYSEWLI

SEQ ID NO: 93260 - protein, 17 aa, Mycobacterium avium
ADFKRPSPHWWFDPQDG

SEQ ID NO: 93261 - protein, 23 aa, Mycobacterium avium
ADFLTPFMWRMDTFGRPHLEQTP

SEQ ID NO: 93262 - protein, 24 aa, Mycobacterium avium
ADFPDRPDNMFALANTLMGLATGH

SEQ ID NO: 93263 - protein, 17 aa, Mycobacterium avium
ADFVGRPPAPVPADALL

SEQ ID NO: 93264 - protein, 25 aa, Mycobacterium avium
ADGAPREVLVPFVSAIVTAVSLEDG

SEQ ID NO: 93265 - protein, 20 aa, Mycobacterium avium
ADGDADWVCRIRAAPDRISR

SEQ ID NO: 93266 - protein, 17 aa, Mycobacterium avium
ADGFIVLAQRHWDMLLD

SEQ ID NO: 93267 - protein, 18 aa, Mycobacterium avium
ADGFIVLAQRHWDMLLDQ

SEQ ID NO: 93268 - protein, 26 aa, Mycobacterium avium
ADGKEIAGRLAARIGSGLLVDVVEVK

SEQ ID NO: 93269 - protein, 26 aa, Mycobacterium avium
ADGKEIAGRLAAWIGSGLLVDVVEVK

SEQ ID NO: 93270 - protein, 23 aa, Mycobacterium avium
ADGLPAYGACAGMILLASEILDA

SEQ ID NO: 93271 - protein, 18 aa, Mycobacterium avium
ADGLPVLFDSGIRSGADV

SEQ ID NO: 93272 - protein, 18 aa, Mycobacterium avium
ADGLRALFTTWITAPQPD

SEQ ID NO: 93273 - protein, 20 aa, Mycobacterium avium
ADGMSAGVIFLDIQTMYFSA

SEQ ID NO: 93274 - protein, 31 aa, Mycobacterium avium
ADGPAAAADRLRVRPGRCVVVAGDPAAVEAA

SEQ ID NO: 93275 - protein, 25 aa, Mycobacterium avium
ADGPVAEAWLQFHVPMSYHGTFTTR

SEQ ID NO: 93276 - protein, 20 aa, Mycobacterium avium
ADGRPAVMLLGSGDISRELA

SEQ ID NO: 93277 - protein, 23 aa, Mycobacterium avium
ADGTTIFPFRRVFIVAEVGSGRP

SEQ ID NO: 93278 - protein, 24 aa, Mycobacterium avium
ADGVKAWKGIRYAAPPIGDLRFRA

SEQ ID NO: 93279 - protein, 17 aa, Mycobacterium avium
ADGYPKVARIVMDATVL

SEQ ID NO: 93280 - protein, 17 aa, Mycobacterium avium
ADHAVAGTVLFPGAGFV

SEQ ID NO: 93281 - protein, 25 aa, Mycobacterium avium
ADHGDCAFCLGREAAHRGESEDQNP

SEQ ID NO: 93282 - protein, 18 aa, Mycobacterium avium
ADHMGFRIDPNIRTIQDV

SEQ ID NO: 93283 - protein, 18 aa, Mycobacterium avium
ADIAICGGVETKIEAVAI

SEQ ID NO: 93284 - protein, 17 aa, Mycobacterium avium
ADIDISAVWGVGDTPPG

SEQ ID NO: 93285 - protein, 24 aa, Mycobacterium avium
ADIDKRGKISLVLVEEDNSAPADA

SEQ ID NO: 93286 - protein, 18 aa, Mycobacterium avium
ADIGWDVVDTAGWSPARM

SEQ ID NO: 93287 - protein, 18 aa, Mycobacterium avium
ADIGWRVIDANGWPASRL

SEQ ID NO: 93288 - protein, 19 aa, Mycobacterium avium
ADIGYRPQRAAGLLDAAGW

SEQ ID NO: 93289 - protein, 17 aa, Mycobacterium avium
ADIIAIDICGPIENLAY

SEQ ID NO: 93290 - protein, 28 aa, Mycobacterium avium
ADIIVRARVKAVLVQKGFLGQDYAAPAG

SEQ ID NO: 93291 - protein, 26 aa, Mycobacterium avium
ADIIVRARVQAVLVQKGFLGQDYAAP

SEQ ID NO: 93292 - protein, 23 aa, Mycobacterium avium
ADIKRPGADVSLIGYGRPVHDAL

SEQ ID NO: 93293 - protein, 18 aa, Mycobacterium avium
ADILPLTPLQQGLLFHAT

SEQ ID NO: 93294 - protein, 24 aa, Mycobacterium avium
ADILQPVGFCPARGPIPRARNLSA

SEQ ID NO: 93295 - protein, 24 aa, Mycobacterium avium
ADILTRTGARFGVAPNWATITDAE

SEQ ID NO: 93296 - protein, 17 aa, Mycobacterium avium
ADIPIFLGAEGPRNVAL

SEQ ID NO: 93297 - protein, 20 aa, Mycobacterium avium
ADIRARHGVILTELNIGGGH

SEQ ID NO: 93298 - protein, 18 aa, Mycobacterium avium
ADIRICSAAATFANAAIL

SEQ ID NO: 93299 - protein, 24 aa, Mycobacterium avium
ADKVVRFMLGLARRYGPGFYSAYQ

SEQ ID NO: 93300 - protein, 27 aa, Mycobacterium avium
ADLAKRARHRPVWVKGFGEHVPFKTPT

SEQ ID NO: 93301 - protein, 28 aa, Mycobacterium avium
ADLAKRARHRPVWVKGFGEHVPFKTPTY

SEQ ID NO: 93302 - protein, 17 aa, Mycobacterium avium
ADLGFAGAHPMTRRLAD

SEQ ID NO: 93303 - protein, 19 aa, Mycobacterium avium
ADLHMIGKDIIRFHTVYWP

SEQ ID NO: 93304 - protein, 17 aa, Mycobacterium avium
ADLKVDLKKAGLPIPPP

SEQ ID NO: 93305 - protein, 20 aa, Mycobacterium avium
ADLLGALGLGPRRRAGSGGA

SEQ ID NO: 93306 - protein, 18 aa, Mycobacterium avium
ADLLGQRLHRALGPLVHV

SEQ ID NO: 93307 - protein, 17 aa, Mycobacterium avium
ADLLRRAAPDAALVAIV

SEQ ID NO: 93308 - protein, 20 aa, Mycobacterium avium
ADLPAIPYALGTDAELAETV

SEQ ID NO: 93309 - protein, 20 aa, Mycobacterium avium
ADLPAIPYALGTEAELAETV

SEQ ID NO: 93310 - protein, 35 aa, Mycobacterium avium
ADLPGPVDFVLLDGWKDLYLPVLELLEPRLSPGVL

SEQ ID NO: 93311 - protein, 36 aa, Mycobacterium avium
ADLPGPVDFVLLDGWKDLYLPVLELLEPRLSPGVLV

SEQ ID NO: 93312 - protein, 47 aa, Mycobacterium avium
ADLPGPVDFVLLDGWKDLYLPVLELLEPRLSPGVLVVADNTSAADTQ

SEQ ID NO: 93313 - protein, 29 aa, Mycobacterium avium
ADLPLHPGFAASWHRLRTEPARLPLSHGD

SEQ ID NO: 93314 - protein, 23 aa, Mycobacterium avium
ADLRRRGAQVVSRVSGKVGEEMR

SEQ ID NO: 93315 - protein, 25 aa, Mycobacterium avium
ADMGMALPGCIGALMHSGQGCALAT

SEQ ID NO: 93316 - protein, 17 aa, Mycobacterium avium
ADMLTSLICHGTLTRFP

SEQ ID NO: 93317 - protein, 18 aa, Mycobacterium avium
ADNEFLQFASRSFVAPPV

SEQ ID NO: 93318 - protein, 19 aa, Mycobacterium avium
ADPALRLDAIVVEASGLAD

SEQ ID NO: 93319 - protein, 26 aa, Mycobacterium avium
ADPAVEWRYVELDGTGAADADDLIEQ

SEQ ID NO: 93320 - protein, 19 aa, Mycobacterium avium
ADPAVEWRYVELDRTGAAD

SEQ ID NO: 93321 - protein, 26 aa, Mycobacterium avium
ADPDLTSSAFARYLADYIHEQGWQTY

SEQ ID NO: 93322 - protein, 27 aa, Mycobacterium avium
ADPDLTSSAFARYLADYIHEQGWQTYG

SEQ ID NO: 93323 - protein, 24 aa, Mycobacterium avium
ADPDRYAGELAHIIGCEPDDVLWV

SEQ ID NO: 93324 - protein, 17 aa, Mycobacterium avium
ADPFLGDVHFLRQRGDI

SEQ ID NO: 93325 - protein, 28 aa, Mycobacterium avium
ADPFTAAALRRLAPRARIQVGANGIGDT

SEQ ID NO: 93326 - protein, 26 aa, Mycobacterium avium
ADPGEILRILRWALLTDEEFSQPGRW

SEQ ID NO: 93327 - protein, 21 aa, Mycobacterium avium
ADPRAVVWLLARPLANSIAAG

SEQ ID NO: 93328 - protein, 21 aa, Mycobacterium avium
ADPRAVVWLLVRPLANSIAAG

SEQ ID NO: 93329 - protein, 29 aa, Mycobacterium avium
ADPRLPDSRLWWLLNLVITRGTPPRLEGC

SEQ ID NO: 93330 - protein, 31 aa, Mycobacterium avium
ADPRRPVSVTARRIGCWRFVTLHRQVDSSRD

SEQ ID NO: 93331 - protein, 25 aa, Mycobacterium avium
ADPRRPVSVTARRVGCWRFVTLHRQ

SEQ ID NO: 93332 - protein, 24 aa, Mycobacterium avium
ADPVAELLCRIILQGLASRPPSDT

SEQ ID NO: 93333 - protein, 26 aa, Mycobacterium avium
ADPVFIKRLLDVGAQNLIVPMIDDAG

SEQ ID NO: 93334 - protein, 17 aa, Mycobacterium avium
ADPVSLLAAARFAQHGQ

SEQ ID NO: 93335 - protein, 18 aa, Mycobacterium avium
ADPVSLQTALGFSAQGQE

SEQ ID NO: 93336 - protein, 20 aa, Mycobacterium avium
ADQADFAILLARTDPEQPKH

SEQ ID NO: 93337 - protein, 20 aa, Mycobacterium avium
ADQLAAWAGLAPVPSDSGKR

SEQ ID NO: 93338 - protein, 19 aa, Mycobacterium avium
ADQRTFGGWMLADLLEVDG

SEQ ID NO: 93339 - protein, 26 aa, Mycobacterium avium
ADRAAAYRAAGYWAGRTLDTILTDAA

SEQ ID NO: 93340 - protein, 18 aa, Mycobacterium avium
ADRGRPRGCGPLRQVVSR

SEQ ID NO: 93341 - protein, 21 aa, Mycobacterium avium
ADRLGVPLAKIGQFSGHGAQL

SEQ ID NO: 93342 - protein, 20 aa, Mycobacterium avium
ADRLGVPLAQIGQFSGHGAQ

SEQ ID NO: 93343 - protein, 17 aa, Mycobacterium avium
ADRLNLAITALREEAEA

SEQ ID NO: 93344 - protein, 20 aa, Mycobacterium avium
ADRVGVPLVVRYAMTECPTI

SEQ ID NO: 93345 - protein, 17 aa, Mycobacterium avium
ADRWPVPAWSRHRPRCD

SEQ ID NO: 93346 - protein, 21 aa, Mycobacterium avium
ADRYTGIHFLEDMGAGIFGKA

SEQ ID NO: 93347 - protein, 25 aa, Mycobacterium avium
ADSGSRIAAQLAYWQDALAGMPERL

SEQ ID NO: 93348 - protein, 25 aa, Mycobacterium avium
ADSGSRIAAQLAYWQQALAGMPERL

SEQ ID NO: 93349 - protein, 18 aa, Mycobacterium avium
ADTDVAWTGRTMKVPWFA

SEQ ID NO: 93350 - protein, 18 aa, Mycobacterium avium
ADTEFFWNGLRQNKLLIQ

SEQ ID NO: 93351 - protein, 26 aa, Mycobacterium avium
ADTEIARLVPFIEWLRGAYPDQLISA

SEQ ID NO: 93352 - protein, 22 aa, Mycobacterium avium
ADTRGGQLLVYGVDPLILRQAY

SEQ ID NO: 93353 - protein, 17 aa, Mycobacterium avium
ADTRLLGPLTRTRELLR

SEQ ID NO: 93354 - protein, 21 aa, Mycobacterium avium
ADTVRRAAGVAARSLSNTETV

SEQ ID NO: 93355 - protein, 18 aa, Mycobacterium avium
ADTVRWPAAAARPRWSAL

SEQ ID NO: 93356 - protein, 17 aa, Mycobacterium avium
ADVDLGDIVSVHGTVIS

SEQ ID NO: 93357 - protein, 19 aa, Mycobacterium avium
ADVLEHFDPTFARDNFVDL

SEQ ID NO: 93358 - protein, 17 aa, Mycobacterium avium
ADVLLAFGRHPSFEGRL

SEQ ID NO: 93359 - protein, 18 aa, Mycobacterium avium
ADVLRAWGKLGYPRRAKR

SEQ ID NO: 93360 - protein, 18 aa, Mycobacterium avium
ADVLRCIDGPLASVRDIG

SEQ ID NO: 93361 - protein, 23 aa, Mycobacterium avium
ADVLVAFGRYPAFEGRLPELGTD

SEQ ID NO: 93362 - protein, 23 aa, Mycobacterium avium
ADVPGPAVAQWSRRGEELGFESV

SEQ ID NO: 93363 - protein, 17 aa, Mycobacterium avium
ADVPIIMVGPGTGIAPF

SEQ ID NO: 93364 - protein, 17 aa, Mycobacterium avium
ADVRWFDVEPCYVFHPM

SEQ ID NO: 93365 - protein, 32 aa, Mycobacterium avium
ADVTKRVGVLGIWYAGSHGFELTAPDGSHHQN

SEQ ID NO: 93366 - protein, 19 aa, Mycobacterium avium
ADYGLCLARTDWQVPKHEG

SEQ ID NO: 93367 - protein, 20 aa, Mycobacterium avium
ADYGLCLARTDWQVPKHEGL

SEQ ID NO: 93368 - protein, 17 aa, Mycobacterium avium
ADYTLRIATGTVELAPG

SEQ ID NO: 93369 - protein, 17 aa, Mycobacterium avium
ADYVLGLGHREIGLLTM

SEQ ID NO: 93370 - protein, 23 aa, Mycobacterium avium
AEAADRVAAILARPDAAGRRPID

SEQ ID NO: 93371 - protein, 17 aa, Mycobacterium avium
AEAAERWHTGAYGPDSP

SEQ ID NO: 93372 - protein, 26 aa, Mycobacterium avium
AEACYREELAALPSVRVLHGYTRSAG

SEQ ID NO: 93373 - protein, 20 aa, Mycobacterium avium
AEADAGHFLVAYPDGLGRAW

SEQ ID NO: 93374 - protein, 22 aa, Mycobacterium avium
AEADGFMSLWYASTVAGDPLVA

SEQ ID NO: 93375 - protein, 19 aa, Mycobacterium avium
AEAEAHWRRHMENASAELL

SEQ ID NO: 93376 - protein, 25 aa, Mycobacterium avium
AEAFLTTRLDRRWGGAFGTMPDGLE

SEQ ID NO: 93377 - protein, 18 aa, Mycobacterium avium
AEAFPGLARTAALVRLVL

SEQ ID NO: 93378 - protein, 19 aa, Mycobacterium avium
AEAGRPAPRIIAAVPVLLS

SEQ ID NO: 93379 - protein, 22 aa, Mycobacterium avium
AEAGRPAPRIIAAVPVLLSDDV

SEQ ID NO: 93380 - protein, 23 aa, Mycobacterium avium
AEAIPEIAGWYQRRGLMPRLAVP

SEQ ID NO: 93381 - protein, 17 aa, Mycobacterium avium
AEALDWGMVARVVPHDE

SEQ ID NO: 93382 - protein, 22 aa, Mycobacterium avium
AEALGVPARRCVMIGDTGADVR

SEQ ID NO: 93383 - protein, 19 aa, Mycobacterium avium
AEALKESFGCDGQPGSYTD

SEQ ID NO: 93384 - protein, 21 aa, Mycobacterium avium
AEALRSGGVVIVFPGGDYDAY

SEQ ID NO: 93385 - protein, 20 aa, Mycobacterium avium
AEAPNLRFAGLGGATETPVH

SEQ ID NO: 93386 - protein, 19 aa, Mycobacterium avium
AEAQAGWIPYYLQRVDEVW

SEQ ID NO: 93387 - protein, 17 aa, Mycobacterium avium
AEAQRAASLGFRALSLP

SEQ ID NO: 93388 - protein, 22 aa, Mycobacterium avium
AEAREKFGFLLEAFTFGAPPHG

SEQ ID NO: 93389 - protein, 17 aa, Mycobacterium avium
AEARPNVVILAMVLAAF

SEQ ID NO: 93390 - protein, 17 aa, Mycobacterium avium
AEARSPELAAWVDEHVC

SEQ ID NO: 93391 - protein, 17 aa, Mycobacterium avium
AEASRALLRDSVLDAMR

SEQ ID NO: 93392 - protein, 26 aa, Mycobacterium avium
AEATLLRCTRGAIVAAAVDVRPDSLT

SEQ ID NO: 93393 - protein, 19 aa, Mycobacterium avium
AEAVAALERRGLIRLATDG

SEQ ID NO: 93394 - protein, 19 aa, Mycobacterium avium
AEAVAALERRGLIRLVTDG

SEQ ID NO: 93395 - protein, 25 aa, Mycobacterium avium
AEDAIRAIVDWDWCTIGDPIADLAW

SEQ ID NO: 93396 - protein, 18 aa, Mycobacterium avium
AEDEWIWGRATVLAAGYL

SEQ ID NO: 93397 - protein, 17 aa, Mycobacterium avium
AEDFTWHRAAAGMLASL

SEQ ID NO: 93398 - protein, 19 aa, Mycobacterium avium
AEDTYDLVQWIAGQPWSDG

SEQ ID NO: 93399 - protein, 27 aa, Mycobacterium avium
AEEARARFLHRALPDAWNHVVVVHSDI

SEQ ID NO: 93400 - protein, 25 aa, Mycobacterium avium
AEEARRIGTDWLRAYLALPNYANNL

SEQ ID NO: 93401 - protein, 27 aa, Mycobacterium avium
AEEFGDWWPQQRPFTMRYLDAPPRVAL

SEQ ID NO: 93402 - protein, 19 aa, Mycobacterium avium
AEEGLAPPVLALTADLAGV

SEQ ID NO: 93403 - protein, 23 aa, Mycobacterium avium
AEEQKLPLNVTWVNLTTGKSGTV

SEQ ID NO: 93404 - protein, 26 aa, Mycobacterium avium
AEEVRRYFGSKVLRTVIPRSVKVSEA

SEQ ID NO: 93405 - protein, 17 aa, Mycobacterium avium
AEFEAAFYDAYRTDQPL

SEQ ID NO: 93406 - protein, 18 aa, Mycobacterium avium
AEFEAAFYDAYRTDQPLI

SEQ ID NO: 93407 - protein, 19 aa, Mycobacterium avium
AEFEYAITYECALEVSDIV

SEQ ID NO: 93408 - protein, 19 aa, Mycobacterium avium
AEGGTFACGGGRPADKDVG

SEQ ID NO: 93409 - protein, 19 aa, Mycobacterium avium
AEGIGVPLVVRYAMTECPT

SEQ ID NO: 93410 - protein, 17 aa, Mycobacterium avium
AEGLLALAWPKEHGGGG

SEQ ID NO: 93411 - protein, 17 aa, Mycobacterium avium
AEGLLIYLPASAQEQLF

SEQ ID NO: 93412 - protein, 18 aa, Mycobacterium avium
AEGPAVLTLLETVTAAFV

SEQ ID NO: 93413 - protein, 20 aa, Mycobacterium avium
AEGPGGLLLDGPAADPDGVA

SEQ ID NO: 93414 - protein, 24 aa, Mycobacterium avium
AEGRDAGWCPCVAAGGDAHAGHTE

SEQ ID NO: 93415 - protein, 17 aa, Mycobacterium avium
AEHAVAIVHTDYVAQVS

SEQ ID NO: 93416 - protein, 17 aa, Mycobacterium avium
AEHFGVETIERFLHSSY

SEQ ID NO: 93417 - protein, 22 aa, Mycobacterium avium
AEHPEWGFAGYVHHFIDKPTIA

SEQ ID NO: 93418 - protein, 17 aa, Mycobacterium avium
AEHPQDRFGSAAYSLEQ

SEQ ID NO: 93419 - protein, 20 aa, Mycobacterium avium
AEHRHSLGGVQVRIPGLPPV

SEQ ID NO: 93420 - protein, 21 aa, Mycobacterium avium
AEIAGAHVVVIGRGVTVGRPL

SEQ ID NO: 93421 - protein, 25 aa, Mycobacterium avium
AEIDNWRWAGVPIFLRAGKALPHKV

SEQ ID NO: 93422 - protein, 19 aa, Mycobacterium avium
AEIGAPISFARRAQVGLPA

SEQ ID NO: 93423 - protein, 20 aa, Mycobacterium avium
AEIGAPISFARRAQVGLPAF

SEQ ID NO: 93424 - protein, 17 aa, Mycobacterium avium
AEIGLGRRWVMSAEGRA

SEQ ID NO: 93425 - protein, 21 aa, Mycobacterium avium
AEIMGLSFLFVLAGLDTVTAA

SEQ ID NO: 93426 - protein, 18 aa, Mycobacterium avium
AEITAGRLGIEPFDDALV

SEQ ID NO: 93427 - protein, 19 aa, Mycobacterium avium
AEITASLGMSEPSAGSDLA

SEQ ID NO: 93428 - protein, 21 aa, Mycobacterium avium
AEIYGAGIAFAERISDVDPVA

SEQ ID NO: 93429 - protein, 28 aa, Mycobacterium avium
AEKFACSFRLTGRFFRRRPEESKVLLAN

SEQ ID NO: 93430 - protein, 24 aa, Mycobacterium avium
AEKITAATAFEWGLISYVVDDDAY

SEQ ID NO: 93431 - protein, 21 aa, Mycobacterium avium
AEKVRCDWLDTSHAFHSALLD

SEQ ID NO: 93432 - protein, 17 aa, Mycobacterium avium
AELAALLASQATVSQSV

SEQ ID NO: 93433 - protein, 20 aa, Mycobacterium avium
AELADGWLPPAFTPGMLPAV

SEQ ID NO: 93434 - protein, 25 aa, Mycobacterium avium
AELARANGWAGLIVNGAVRDSAALR

SEQ ID NO: 93435 - protein, 24 aa, Mycobacterium avium
AELDPYLPVEVFAAGLTFDTVDAF

SEQ ID NO: 93436 - protein, 26 aa, Mycobacterium avium
AELDRAWRHLPFAAQWHSDNELARHR

SEQ ID NO: 93437 - protein, 19 aa, Mycobacterium avium
AELEARGWTIVRVSADMLR

SEQ ID NO: 93438 - protein, 19 aa, Mycobacterium avium
AELEELRALLGARVATVPD

SEQ ID NO: 93439 - protein, 17 aa, Mycobacterium avium
AELEGRLSEPVAVVGMA

SEQ ID NO: 93440 - protein, 24 aa, Mycobacterium avium
AELEHGASFRRLLGPLVARSDDVV

SEQ ID NO: 93441 - protein, 19 aa, Mycobacterium avium
AELGEWLHPFEKFWRTRLR

SEQ ID NO: 93442 - protein, 23 aa, Mycobacterium avium
AELIAEAGGDPWAINQSLQAGSP

SEQ ID NO: 93443 - protein, 21 aa, Mycobacterium avium
AELIAYCRAHLAGYKCPRTVE

SEQ ID NO: 93444 - protein, 20 aa, Mycobacterium avium
AELLAALAAGERFAGLALQG

SEQ ID NO: 93445 - protein, 20 aa, Mycobacterium avium
AELLAWAGVHPDYRSLPEDE

SEQ ID NO: 93446 - protein, 17 aa, Mycobacterium avium
AELLDFAAAAGLTVVAV

SEQ ID NO: 93447 - protein, 18 aa, Mycobacterium avium
AELLGAARAARGDAGHSD

SEQ ID NO: 93448 - protein, 28 aa, Mycobacterium avium
AELLRDGFRWFAQCLEIRSAAAGEPDLS

SEQ ID NO: 93449 - protein, 21 aa, Mycobacterium avium
AELNAMLGMERAKREIKLIKS

SEQ ID NO: 93450 - protein, 25 aa, Mycobacterium avium
AELPAELQALVTLAAGTGLRQGECF

SEQ ID NO: 93451 - protein, 23 aa, Mycobacterium avium
AELPAGRSGEVWVRSNQNMSGYL

SEQ ID NO: 93452 - protein, 18 aa, Mycobacterium avium
AELQIVFHSLVRRIPTLQ

SEQ ID NO: 93453 - protein, 18 aa, Mycobacterium avium
AELQQRIGDMARRHNATS

SEQ ID NO: 93454 - protein, 17 aa, Mycobacterium avium
AELQQRIGDVAHRHNAT

SEQ ID NO: 93455 - protein, 20 aa, Mycobacterium avium
AELQRPAALCEDRRDQLEHR

SEQ ID NO: 93456 - protein, 17 aa, Mycobacterium avium
AELREITDLLGKLAELR

SEQ ID NO: 93457 - protein, 26 aa, Mycobacterium avium
AELRIAQAQLVGWLEGLFHGIQTALF

SEQ ID NO: 93458 - protein, 17 aa, Mycobacterium avium
AELRRFLRDWVAPSVRA

SEQ ID NO: 93459 - protein, 21 aa, Mycobacterium avium
AELSGLCDWIELGDDGRTGTT

SEQ ID NO: 93460 - protein, 17 aa, Mycobacterium avium
AELSRRITATGVTGVTD

SEQ ID NO: 93461 - protein, 17 aa, Mycobacterium avium
AELTFADAYGADFFATW

SEQ ID NO: 93462 - protein, 24 aa, Mycobacterium avium
AELTPRSAFRDGPVRFVGSTRGAE

SEQ ID NO: 93463 - protein, 20 aa, Mycobacterium avium
AELTPWIFGSTRGQSAEVAG

SEQ ID NO: 93464 - protein, 26 aa, Mycobacterium avium
AELTRRGAWSRCVQTIGVLDAAAALS

SEQ ID NO: 93465 - protein, 17 aa, Mycobacterium avium
AELTRRGHEVLVQSGAG

SEQ ID NO: 93466 - protein, 18 aa, Mycobacterium avium
AELVAGAGGDPWEVNRTL

SEQ ID NO: 93467 - protein, 20 aa, Mycobacterium avium
AELVAGAGGDPWEVNRTLQA

SEQ ID NO: 93468 - protein, 18 aa, Mycobacterium avium
AELYRWADRRPILRGVGY

SEQ ID NO: 93469 - protein, 21 aa, Mycobacterium avium
AEMARRIDVARVYSRNVVERQ

SEQ ID NO: 93470 - protein, 19 aa, Mycobacterium avium
AEMDWRTGQSPQWGIHHDA

SEQ ID NO: 93471 - protein, 20 aa, Mycobacterium avium
AEMIAEKWGFDRAALDEFSL

SEQ ID NO: 93472 - protein, 18 aa, Mycobacterium avium
AEMIEQLELPQGVVSVLP

SEQ ID NO: 93473 - protein, 17 aa, Mycobacterium avium
AEMRQIWDAEVPGACDS

SEQ ID NO: 93474 - protein, 20 aa, Mycobacterium avium
AEMTIAISALLDRLPNLRLD

SEQ ID NO: 93475 - protein, 21 aa, Mycobacterium avium
AENPAGSAFIFGGVLESQRHP

SEQ ID NO: 93476 - protein, 23 aa, Mycobacterium avium
AENVRRTFYASGMADTFTAFSPV

SEQ ID NO: 93477 - protein, 33 aa, Mycobacterium avium
AEPAGKRALAKWAFGVGRARARAVSDGRPVGLV

SEQ ID NO: 93478 - protein, 18 aa, Mycobacterium avium
AEPCTLTGYAAVDSGAGG

SEQ ID NO: 93479 - protein, 17 aa, Mycobacterium avium
AEPEKFAGYTGQLGSPD

SEQ ID NO: 93480 - protein, 24 aa, Mycobacterium avium
AEPEMAWRYLELDGGDIDEQLEQL

SEQ ID NO: 93481 - protein, 24 aa, Mycobacterium avium
AEPEMAWRYLELDGGDIDGQLEQL

SEQ ID NO: 93482 - protein, 22 aa, Mycobacterium avium
AEPGEGYLAWSQLDTPAARYRR

SEQ ID NO: 93483 - protein, 23 aa, Mycobacterium avium
AEPHLARVRCPALVINADADTGV

SEQ ID NO: 93484 - protein, 23 aa, Mycobacterium avium
AEPLHWLPAEDEWIWGRATVLAA

SEQ ID NO: 93485 - protein, 35 aa, Mycobacterium avium
AEPLHWLPAQDEWIWPRAMVLSAAYLTGIATAAAA

SEQ ID NO: 93486 - protein, 17 aa, Mycobacterium avium
AEPLRANTFHQFRERFA

SEQ ID NO: 93487 - protein, 20 aa, Mycobacterium avium
AEPPARIPGAAMPLPPPPST

SEQ ID NO: 93488 - protein, 20 aa, Mycobacterium avium
AEPPVQREAFAWHIDLAKRC

SEQ ID NO: 93489 - protein, 22 aa, Mycobacterium avium
AEPSERRLLIVIGDGLISDEGY

SEQ ID NO: 93490 - protein, 18 aa, Mycobacterium avium
AEQIPALLGILSVGAVYL

SEQ ID NO: 93491 - protein, 23 aa, Mycobacterium avium
AEQRRWLAPWYSSVPLQSRPAEL

SEQ ID NO: 93492 - protein, 26 aa, Mycobacterium avium
AEQWKSVLTSDGWFRTGDRGYLRPDG

SEQ ID NO: 93493 - protein, 27 aa, Mycobacterium avium
AERAAAYRAAGLWTGRALDTILTDAAR

SEQ ID NO: 93494 - protein, 21 aa, Mycobacterium avium
AERENRIVIAYSPLEQGLLGG

SEQ ID NO: 93495 - protein, 17 aa, Mycobacterium avium
AERGLFDFFFLAEGLRL

SEQ ID NO: 93496 - protein, 24 aa, Mycobacterium avium
AERLAFVLHDVFSVPFDQIATIVD

SEQ ID NO: 93497 - protein, 21 aa, Mycobacterium avium
AERLLRDWARPLREISVLFDD

SEQ ID NO: 93498 - protein, 20 aa, Mycobacterium avium
AERLPAYLVPAAVVAIDAMP

SEQ ID NO: 93499 - protein, 23 aa, Mycobacterium avium
AERLRLGPHYLGDGVRVVVDDSG

SEQ ID NO: 93500 - protein, 17 aa, Mycobacterium avium
AERPDVVPLSFAQNRLW

SEQ ID NO: 93501 - protein, 26 aa, Mycobacterium avium
AERPNWREARWVSVVINYRAERWSDV

SEQ ID NO: 93502 - protein, 18 aa, Mycobacterium avium
AERPRGVFSRQLFLGDNL

SEQ ID NO: 93503 - protein, 19 aa, Mycobacterium avium
AERRARHVVVYRTIQMLGG

SEQ ID NO: 93504 - protein, 20 aa, Mycobacterium avium
AERYAGTLARVGVLLDAVYD

SEQ ID NO: 93505 - protein, 27 aa, Mycobacterium avium
AESALSYLSCRLTRLLILLHKPSQDTT

SEQ ID NO: 93506 - protein, 17 aa, Mycobacterium avium
AESFAAVVDQAAALCPV

SEQ ID NO: 93507 - protein, 20 aa, Mycobacterium avium
AESIQAWTPPAAPPAAPGGP

SEQ ID NO: 93508 - protein, 28 aa, Mycobacterium avium
AESLAVVNLMSLFGLHRALRGAAIGHFA

SEQ ID NO: 93509 - protein, 18 aa, Mycobacterium avium
AESLLCDVCSAADSELVR

SEQ ID NO: 93510 - protein, 21 aa, Mycobacterium avium
AESRAKIVYEYLKQFTDDPGV

SEQ ID NO: 93511 - protein, 17 aa, Mycobacterium avium
AESVLRLARACHDDSAA

SEQ ID NO: 93512 - protein, 22 aa, Mycobacterium avium
AETDALAGWLGREAGIELPNGP

SEQ ID NO: 93513 - protein, 26 aa, Mycobacterium avium
AETPGRQVLFDRLRRLAADVIALGES

SEQ ID NO: 93514 - protein, 17 aa, Mycobacterium avium
AETPRGGFIANMELQPE

SEQ ID NO: 93515 - protein, 23 aa, Mycobacterium avium
AETQTVLWARMLDRLAGSDPPAI

SEQ ID NO: 93516 - protein, 22 aa, Mycobacterium avium
AEVAAALGERLPACDPAIITEL

SEQ ID NO: 93517 - protein, 24 aa, Mycobacterium avium
AEVARRLKAKGARLVLTDLNDAEL

SEQ ID NO: 93518 - protein, 17 aa, Mycobacterium avium
AEVDVRDYYALKAAVDS

SEQ ID NO: 93519 - protein, 26 aa, Mycobacterium avium
AEVERIVVHLAPWLEPEPICVAISHV

SEQ ID NO: 93520 - protein, 17 aa, Mycobacterium avium
AEVIGYWGEPVSTAADA

SEQ ID NO: 93521 - protein, 17 aa, Mycobacterium avium
AEVIKVEPREGGDPQRG

SEQ ID NO: 93522 - protein, 17 aa, Mycobacterium avium
AEVKRVTLELGGKSANI

SEQ ID NO: 93523 - protein, 17 aa, Mycobacterium avium
AEVLEALTVTPTTDVAD

SEQ ID NO: 93524 - protein, 17 aa, Mycobacterium avium
AEVPRQVNITGADLVGP

SEQ ID NO: 93525 - protein, 25 aa, Mycobacterium avium
AEVPRRWRSPAPLWGDVSFESVAPA

SEQ ID NO: 93526 - protein, 21 aa, Mycobacterium avium
AEVRASIGMAGQFTGMDPMLT

SEQ ID NO: 93527 - protein, 24 aa, Mycobacterium avium
AEVSGPLLRRKFRLGSAAMDPLQK

SEQ ID NO: 93528 - protein, 24 aa, Mycobacterium avium
AEVTFPFMQAMPIPYIDPCDVSHA

SEQ ID NO: 93529 - protein, 18 aa, Mycobacterium avium
AEVWAIDGDGCFQMTNQE

SEQ ID NO: 93530 - protein, 26 aa, Mycobacterium avium
AEVWPLRPDCRILACSSVFGTWGGYG

SEQ ID NO: 93531 - protein, 21 aa, Mycobacterium avium
AEWLAAHGWVVDPVRNTLDLQ

SEQ ID NO: 93532 - protein, 18 aa, Mycobacterium avium
AEYPQAALAKAWVQLAYG

SEQ ID NO: 93533 - protein, 23 aa, Mycobacterium avium
AFAADYGLCLARTNWQVPKHEGL

SEQ ID NO: 93534 - protein, 19 aa, Mycobacterium avium
AFAAELGRYNIRVNSLNPG

SEQ ID NO: 93535 - protein, 18 aa, Mycobacterium avium
AFADLGFDSLIGVELRNR

SEQ ID NO: 93536 - protein, 24 aa, Mycobacterium avium
AFAEAVSEFAARRWQWHDLDVRRT

SEQ ID NO: 93537 - protein, 18 aa, Mycobacterium avium
AFAIVWDGEKVHGLNASG

SEQ ID NO: 93538 - protein, 19 aa, Mycobacterium avium
AFDNPYLVVACVIGDGEAE

SEQ ID NO: 93539 - protein, 20 aa, Mycobacterium avium
AFDPRFRPLVEQLRGQLTVR

SEQ ID NO: 93540 - protein, 25 aa, Mycobacterium avium
AFDSLKHARKGLFLVHTDAVDSVLG

SEQ ID NO: 93541 - protein, 26 aa, Mycobacterium avium
AFEEVLKRWPDWEVDYANAERARTAS

SEQ ID NO: 93542 - protein, 19 aa, Mycobacterium avium
AFESVRRALGPVQVLVTSA

SEQ ID NO: 93543 - protein, 24 aa, Mycobacterium avium
AFGPDFTMRFFAPRDDDVPESDPN

SEQ ID NO: 93544 - protein, 25 aa, Mycobacterium avium
AFGPTAPYWSDFEAALLRSVDELIR

SEQ ID NO: 93545 - protein, 29 aa, Mycobacterium avium
AFGPTAPYWSEFEVALLRCVDELIRDGQM

SEQ ID NO: 93546 - protein, 19 aa, Mycobacterium avium
AFGPVLGERVMLGIDEPVH

SEQ ID NO: 93547 - protein, 29 aa, Mycobacterium avium
AFGSRGGLLGHVWLRAGKRYLSFQRAAVA

SEQ ID NO: 93548 - protein, 30 aa, Mycobacterium avium
AFGSRGGLLGHVWLRAGKRYLSFQRAAVAK

SEQ ID NO: 93549 - protein, 20 aa, Mycobacterium avium
AFGVPPRDRYQVVHTHPAHE

SEQ ID NO: 93550 - protein, 19 aa, Mycobacterium avium
AFKRVPVAWDNVAAPAPPG

SEQ ID NO: 93551 - protein, 20 aa, Mycobacterium avium
AFLASGRGSLFGPIVQLVFS

SEQ ID NO: 93552 - protein, 27 aa, Mycobacterium avium
AFLDRFEARYGRRPGHSMPGLSHDAAT

SEQ ID NO: 93553 - protein, 22 aa, Mycobacterium avium
AFLEAGAGWVPFFIDRLHEHYE

SEQ ID NO: 93554 - protein, 17 aa, Mycobacterium avium
AFLWYLTLDAGDTRTRI

SEQ ID NO: 93555 - protein, 22 aa, Mycobacterium avium
AFNERSGFRFGGAGRQPGVTPL

SEQ ID NO: 93556 - protein, 17 aa, Mycobacterium avium
AFQAAALGVVQANDDNQ

SEQ ID NO: 93557 - protein, 17 aa, Mycobacterium avium
AFQTLVFRTDLITDAQA

SEQ ID NO: 93558 - protein, 26 aa, Mycobacterium avium
AFRHGLQLHGAMGFTWENDLQFALKR

SEQ ID NO: 93559 - protein, 23 aa, Mycobacterium avium
AFRRILALADGWLGSFLTPAEAR

SEQ ID NO: 93560 - protein, 22 aa, Mycobacterium avium
AFSAGGDMVMFGRLIDDAVARQ

SEQ ID NO: 93561 - protein, 22 aa, Mycobacterium avium
AFSAGGDMVMFGRLIEDEVART

SEQ ID NO: 93562 - protein, 17 aa, Mycobacterium avium
AFSGIRPSFPALAASLA

SEQ ID NO: 93563 - protein, 17 aa, Mycobacterium avium
AFSRPGIELTKRTLWSG

SEQ ID NO: 93564 - protein, 23 aa, Mycobacterium avium
AFTAGHCRGGGGVVTDRGGTVIG

SEQ ID NO: 93565 - protein, 23 aa, Mycobacterium avium
AFTASPFRWLAWLSESRATITAA

SEQ ID NO: 93566 - protein, 21 aa, Mycobacterium avium
AFVHAHPRWIAQAFADALGAA

SEQ ID NO: 93567 - protein, 19 aa, Mycobacterium avium
AFWDDIFRELSIPYLPIRW

SEQ ID NO: 93568 - protein, 18 aa, Mycobacterium avium
AGAAGRCVRSALRAAGFA

SEQ ID NO: 93569 - protein, 18 aa, Mycobacterium avium
AGAAGRCVRSALRAAGFT

SEQ ID NO: 93570 - protein, 17 aa, Mycobacterium avium
AGADLSALGAAGGGSAE

SEQ ID NO: 93571 - protein, 18 aa, Mycobacterium avium
AGADRIDEELARLRDALG

SEQ ID NO: 93572 - protein, 24 aa, Mycobacterium avium
AGADVRWSAAFTGLHARRVDLPTY

SEQ ID NO: 93573 - protein, 22 aa, Mycobacterium avium
AGAEPGSLIAVAGDLGRSAAGF

SEQ ID NO: 93574 - protein, 27 aa, Mycobacterium avium
AGAEYKKLRDILGLLRDAYCRHIGVEY

SEQ ID NO: 93575 - protein, 17 aa, Mycobacterium avium
AGAGGRVGAARKPQGPR

SEQ ID NO: 93576 - protein, 20 aa, Mycobacterium avium
AGAIPVMCLPGHRAAELGHF

SEQ ID NO: 93577 - protein, 21 aa, Mycobacterium avium
AGAIPVMCLPGHRAAELGHFA

SEQ ID NO: 93578 - protein, 36 aa, Mycobacterium avium
AGALDLRPTPKLPPKNFHRLLGVNVEGPFAVVQAAY

SEQ ID NO: 93579 - protein, 20 aa, Mycobacterium avium
AGALTPLPVKAFDARCAADA

SEQ ID NO: 93580 - protein, 19 aa, Mycobacterium avium
AGAPAAIAIVVPEPPDERR

SEQ ID NO: 93581 - protein, 24 aa, Mycobacterium avium
AGAPPHPCPLSFIVAPTLIQHGTD

SEQ ID NO: 93582 - protein, 24 aa, Mycobacterium avium
AGASEIPLDFRILDTILGAQTTFR

SEQ ID NO: 93583 - protein, 23 aa, Mycobacterium avium
AGASFLRRDGSVWTTDKDGIILA

SEQ ID NO: 93584 - protein, 17 aa, Mycobacterium avium
AGASGAWVGTRLSACPE

SEQ ID NO: 93585 - protein, 22 aa, Mycobacterium avium
AGASWGNAGWIAPALTFPLQPA

SEQ ID NO: 93586 - protein, 20 aa, Mycobacterium avium
AGAVCTGAWCDEGGGLHLGF

SEQ ID NO: 93587 - protein, 21 aa, Mycobacterium avium
AGAVLADWGADVIKVENPVTG

SEQ ID NO: 93588 - protein, 21 aa, Mycobacterium avium
AGAVLADWGADVVKIEHPVTG

SEQ ID NO: 93589 - protein, 21 aa, Mycobacterium avium
AGAVPVMCLPGHRAAELGHFA

SEQ ID NO: 93590 - protein, 24 aa, Mycobacterium avium
AGAVVKAPEGFMLVCSYNPAYRSS

SEQ ID NO: 93591 - protein, 25 aa, Mycobacterium avium
AGAYLTCYLGAFGADVIKVESIQRP

SEQ ID NO: 93592 - protein, 24 aa, Mycobacterium avium
AGCGEAAVSLYLAERGFTTVGLDQ

SEQ ID NO: 93593 - protein, 26 aa, Mycobacterium avium
AGCKSWVQLPVHARLGPPIHDDETLA

SEQ ID NO: 93594 - protein, 22 aa, Mycobacterium avium
AGDALAGPTGWGLRDLGYTLTR

SEQ ID NO: 93595 - protein, 23 aa, Mycobacterium avium
AGDALAGPTGWGLRDLGYTLTRR

SEQ ID NO: 93596 - protein, 17 aa, Mycobacterium avium
AGDGMRAAYQGVQTGTQ

SEQ ID NO: 93597 - protein, 17 aa, Mycobacterium avium
AGDIQWNFEKFLISPDG

SEQ ID NO: 93598 - protein, 19 aa, Mycobacterium avium
AGDIVRRALALGVTLFDTA

SEQ ID NO: 93599 - protein, 21 aa, Mycobacterium avium
AGDIVRRALALGVTLFDTAEI

SEQ ID NO: 93600 - protein, 18 aa, Mycobacterium avium
AGDMVAWYNGHPGHADDE

SEQ ID NO: 93601 - protein, 22 aa, Mycobacterium avium
AGDRYTVWAPRWRDSGDEWEAF

SEQ ID NO: 93602 - protein, 17 aa, Mycobacterium avium
AGEAAPYARTWSTIAGA

SEQ ID NO: 93603 - protein, 20 aa, Mycobacterium avium
AGEAGWRASMAKAVCSEALR

SEQ ID NO: 93604 - protein, 17 aa, Mycobacterium avium
AGEAMSESFAWTHRNNR

SEQ ID NO: 93605 - protein, 17 aa, Mycobacterium avium
AGEEMDSGFGLRTLATT

SEQ ID NO: 93606 - protein, 25 aa, Mycobacterium avium
AGEIERARAAAELAVAAASEHGFNS

SEQ ID NO: 93607 - protein, 17 aa, Mycobacterium avium
AGERLRLEIAAAAREVQ

SEQ ID NO: 93608 - protein, 30 aa, Mycobacterium avium
AGERPTVVPLSFAQNRLWFLDQLQGPSPVY

SEQ ID NO: 93609 - protein, 24 aa, Mycobacterium avium
AGFADRVATEWAGPRSRVVRRAMR

SEQ ID NO: 93610 - protein, 25 aa, Mycobacterium avium
AGFNVVSWNVFNTIVSNILYNHTLD

SEQ ID NO: 93611 - protein, 19 aa, Mycobacterium avium
AGFPLGWVHDVVWAPRPVS

SEQ ID NO: 93612 - protein, 17 aa, Mycobacterium avium
AGFRSASFMTVIADPNT

SEQ ID NO: 93613 - protein, 23 aa, Mycobacterium avium
AGGAGWRPVETCVIAEELGRAND

SEQ ID NO: 93614 - protein, 20 aa, Mycobacterium avium
AGGCICCLPDGGGLDEALGK

SEQ ID NO: 93615 - protein, 19 aa, Mycobacterium avium
AGGELARIEAAVLGAALQR

SEQ ID NO: 93616 - protein, 17 aa, Mycobacterium avium
AGGLAHCEVEHAGRDGL

SEQ ID NO: 93617 - protein, 18 aa, Mycobacterium avium
AGGLARCEVEHAGRDGLR

SEQ ID NO: 93618 - protein, 21 aa, Mycobacterium avium
AGGLPLRRAWPDGTEPFCGVA

SEQ ID NO: 93619 - protein, 20 aa, Mycobacterium avium
AGGMCVPLVPGMPPERVTSI

SEQ ID NO: 93620 - protein, 18 aa, Mycobacterium avium
AGGPVLRVGQRVIARRYL

SEQ ID NO: 93621 - protein, 22 aa, Mycobacterium avium
AGGRALPDWSPEASLQTMAELD

SEQ ID NO: 93622 - protein, 22 aa, Mycobacterium avium
AGGSGRVGVRMLLHDEGNADKA

SEQ ID NO: 93623 - protein, 20 aa, Mycobacterium avium
AGGVCAALFHRERTGEPTIV

SEQ ID NO: 93624 - protein, 19 aa, Mycobacterium avium
AGGWLRPDSPLTPPRFADR

SEQ ID NO: 93625 - protein, 18 aa, Mycobacterium avium
AGGWVCGWWLNQAGCRRG

SEQ ID NO: 93626 - protein, 18 aa, Mycobacterium avium
AGHAPGWAPLPVQYADYS

SEQ ID NO: 93627 - protein, 24 aa, Mycobacterium avium
AGHGNGPIILRCVRTTTAPTPRTR

SEQ ID NO: 93628 - protein, 28 aa, Mycobacterium avium
AGHLAAELMGRFAFDRPGLAAMSLPDAT

SEQ ID NO: 93629 - protein, 18 aa, Mycobacterium avium
AGHPRLVAYITGTADPAE

SEQ ID NO: 93630 - protein, 19 aa, Mycobacterium avium
AGHRRGRLGNVETSFEMFG

SEQ ID NO: 93631 - protein, 20 aa, Mycobacterium avium
AGHRRGRLGNVETSYEMFGL

SEQ ID NO: 93632 - protein, 28 aa, Mycobacterium avium
AGIAFCRKRHIVPGLDFVRGDAQNLSFP

SEQ ID NO: 93633 - protein, 17 aa, Mycobacterium avium
AGICCPAPWDQITGQAF

SEQ ID NO: 93634 - protein, 27 aa, Mycobacterium avium
AGISIRRAPAPAWSHFTFNGAPGSILA

SEQ ID NO: 93635 - protein, 24 aa, Mycobacterium avium
AGITRLLTGLGYSGYFELDGARRP

SEQ ID NO: 93636 - protein, 19 aa, Mycobacterium avium
AGKALPHKVTEVRMFLHHV

SEQ ID NO: 93637 - protein, 22 aa, Mycobacterium avium
AGKPDILSLWWPTDDGSGLAEA

SEQ ID NO: 93638 - protein, 20 aa, Mycobacterium avium
AGLAARLAQRVGRVARDGSV

SEQ ID NO: 93639 - protein, 27 aa, Mycobacterium avium
AGLCRHVLCFRTVWESTYAALRLHGGG

SEQ ID NO: 93640 - protein, 29 aa, Mycobacterium avium
AGLDARSWRLPWPAGTTVYELDQPRVLEF

SEQ ID NO: 93641 - protein, 27 aa, Mycobacterium avium
AGLDARSWRLPWPDGTVVYELDQPKVL

SEQ ID NO: 93642 - protein, 18 aa, Mycobacterium avium
AGLDFGYSQTKWVAEQLA

SEQ ID NO: 93643 - protein, 20 aa, Mycobacterium avium
AGLDYARNGIRVNAVAPGSI

SEQ ID NO: 93644 - protein, 27 aa, Mycobacterium avium
AGLEPDLKWERFITAVRLLAERLGVRQ

SEQ ID NO: 93645 - protein, 26 aa, Mycobacterium avium
AGLFVLDAWLRPVAPGVVGELYVAGA

SEQ ID NO: 93646 - protein, 19 aa, Mycobacterium avium
AGLGRRGVHPYSVSQPVDE

SEQ ID NO: 93647 - protein, 29 aa, Mycobacterium avium
AGLGTARFVGAMAVPPTWQGSMPAYIATP

SEQ ID NO: 93648 - protein, 17 aa, Mycobacterium avium
AGLKLLAPGGRFIEIGK

SEQ ID NO: 93649 - protein, 19 aa, Mycobacterium avium
AGLKPWREVLPPHDDVATG

SEQ ID NO: 93650 - protein, 25 aa, Mycobacterium avium
AGLKWWTSEVQWEIIDRCLQLHGGY

SEQ ID NO: 93651 - protein, 17 aa, Mycobacterium avium
AGLLARAARLTDSRAAH

SEQ ID NO: 93652 - protein, 18 aa, Mycobacterium avium
AGLLRGSGLDLVLADIAG

SEQ ID NO: 93653 - protein, 30 aa, Mycobacterium avium
AGLPDYPALIGPRCRAVWLLTVGAEQVDRD

SEQ ID NO: 93654 - protein, 25 aa, Mycobacterium avium
AGLPEVACTVWSNLVLIAGLRNGQR

SEQ ID NO: 93655 - protein, 20 aa, Mycobacterium avium
AGLPGRPTPVFSPGHTNGHC

SEQ ID NO: 93656 - protein, 21 aa, Mycobacterium avium
AGLPGRPTPVFSPGHTNGHCS

SEQ ID NO: 93657 - protein, 24 aa, Mycobacterium avium
AGLPPDIPDRIHVVCIEHARGMPW

SEQ ID NO: 93658 - protein, 29 aa, Mycobacterium avium
AGLTPGDFDELLIALSLFDMVGIGIQVPD

SEQ ID NO: 93659 - protein, 21 aa, Mycobacterium avium
AGLVALPWHAAYSASKYGLRG

SEQ ID NO: 93660 - protein, 19 aa, Mycobacterium avium
AGLVLGGRVVRPLDVDLRW

SEQ ID NO: 93661 - protein, 19 aa, Mycobacterium avium
AGLVNRILVYLAPTLLGGP

SEQ ID NO: 93662 - protein, 22 aa, Mycobacterium avium
AGMRAGVPTLVLWMRNEQPLWG

SEQ ID NO: 93663 - protein, 18 aa, Mycobacterium avium
AGMSLGIMHDLAVGVHPN

SEQ ID NO: 93664 - protein, 17 aa, Mycobacterium avium
AGNFGFVVGVDRVGQAE

SEQ ID NO: 93665 - protein, 24 aa, Mycobacterium avium
AGNYAQRLFPGMRVKYVSTEEFTN

SEQ ID NO: 93666 - protein, 17 aa, Mycobacterium avium
AGPAGRLELDLVVPRAE

SEQ ID NO: 93667 - protein, 18 aa, Mycobacterium avium
AGPAKIPAPGPGPGQTAY

SEQ ID NO: 93668 - protein, 17 aa, Mycobacterium avium
AGPAYAELALLRGDPSD

SEQ ID NO: 93669 - protein, 18 aa, Mycobacterium avium
AGPAYAELALLRGDPSDG

SEQ ID NO: 93670 - protein, 31 aa, Mycobacterium avium
AGPDRIAAMLAEVMELFAAGALTPLPVKAFD

SEQ ID NO: 93671 - protein, 24 aa, Mycobacterium avium
AGPFLTDVSRAWNLEAVQENPFRH

SEQ ID NO: 93672 - protein, 31 aa, Mycobacterium avium
AGPGESVALLFNRRAEAVVAVLAVLKTGAAY

SEQ ID NO: 93673 - protein, 25 aa, Mycobacterium avium
AGPGQRVAVVIPRSAEAVVAIFAVL

SEQ ID NO: 93674 - protein, 17 aa, Mycobacterium avium
AGPHSDAGAAARQQGAC

SEQ ID NO: 93675 - protein, 21 aa, Mycobacterium avium
AGPIRIATDFGLDELANADTI

SEQ ID NO: 93676 - protein, 19 aa, Mycobacterium avium
AGPLRPGPDDVRRAVREGR

SEQ ID NO: 93677 - protein, 27 aa, Mycobacterium avium
AGPLRYAGWSSCFRREAGSYGKDTRGV

SEQ ID NO: 93678 - protein, 19 aa, Mycobacterium avium
AGPPCFLDPELRHLNDDHG

SEQ ID NO: 93679 - protein, 19 aa, Mycobacterium avium
AGPQGGWGKPPTPLWPDAV

SEQ ID NO: 93680 - protein, 26 aa, Mycobacterium avium
AGPQLHANWRWARSVLTDEQLNRLSR

SEQ ID NO: 93681 - protein, 27 aa, Mycobacterium avium
AGPQRLSGPEALSFVRQRHELPRGDLD

SEQ ID NO: 93682 - protein, 27 aa, Mycobacterium avium
AGPTNCRKRLTGAAGLSARRDHAGRML

SEQ ID NO: 93683 - protein, 24 aa, Mycobacterium avium
AGPTNCRKRLTGAAGPSARRDHAG

SEQ ID NO: 93684 - protein, 17 aa, Mycobacterium avium
AGPVAAGLHPSPVPHAD

SEQ ID NO: 93685 - protein, 30 aa, Mycobacterium avium
AGQHARQPVCRRVEFAVGPGPLAAADRHRL

SEQ ID NO: 93686 - protein, 17 aa, Mycobacterium avium
AGQIVTRSGPFMATADS

SEQ ID NO: 93687 - protein, 17 aa, Mycobacterium avium
AGQPCRRCGTPIEFDDS

SEQ ID NO: 93688 - protein, 25 aa, Mycobacterium avium
AGQPLEWFCLFSSAAALVGSPGQGA

SEQ ID NO: 93689 - protein, 24 aa, Mycobacterium avium
AGQRFAVTVPKSYRPDYAPADREV

SEQ ID NO: 93690 - protein, 25 aa, Mycobacterium avium
AGQTRLRIVVLIGIPTVKRNLGDEV

SEQ ID NO: 93691 - protein, 21 aa, Mycobacterium avium
AGRALAGAGVRTVGNGTTGAA

SEQ ID NO: 93692 - protein, 24 aa, Mycobacterium avium
AGRARRFAWKFPDDDGAWLARTCA

SEQ ID NO: 93693 - protein, 24 aa, Mycobacterium avium
AGRAVFTPSLAGLVLGEYRRIAQS

SEQ ID NO: 93694 - protein, 21 aa, Mycobacterium avium
AGRGGYGMGPRYGVKPKVMPT

SEQ ID NO: 93695 - protein, 23 aa, Mycobacterium avium
AGRGVRFLLGMVVSTGVGGGLVL

SEQ ID NO: 93696 - protein, 21 aa, Mycobacterium avium
AGRPDAIRIVAWTDTEHQHTV

SEQ ID NO: 93697 - protein, 22 aa, Mycobacterium avium
AGRPDAIRIVAWTDTEHQHTVD

SEQ ID NO: 93698 - protein, 26 aa, Mycobacterium avium
AGRRGRGRGGGGLRNVVCAAGPGRTP

SEQ ID NO: 93699 - protein, 17 aa, Mycobacterium avium
AGRRTQVRAVWRAVSAV

SEQ ID NO: 93700 - protein, 31 aa, Mycobacterium avium
AGRRTQVRAVWRAVSAVDEIFARSGGNAARM

SEQ ID NO: 93701 - protein, 20 aa, Mycobacterium avium
AGRRVCAVVGSGDNGGDALW

SEQ ID NO: 93702 - protein, 22 aa, Mycobacterium avium
AGRSQMALGYFNHLAGDQGVAW

SEQ ID NO: 93703 - protein, 23 aa, Mycobacterium avium
AGRVVSVDGIFYLTHREDVLAAL

SEQ ID NO: 93704 - protein, 21 aa, Mycobacterium avium
AGRYADGWWPAGAWTPEHYAQ

SEQ ID NO: 93705 - protein, 24 aa, Mycobacterium avium
AGSDQRLRVIGVTWNDEASVPAAL

SEQ ID NO: 93706 - protein, 18 aa, Mycobacterium avium
AGSGEVRPGDLVAFAAGA

SEQ ID NO: 93707 - protein, 19 aa, Mycobacterium avium
AGSGEVRPGDLVAFAAGAL

SEQ ID NO: 93708 - protein, 27 aa, Mycobacterium avium
AGSLPVARSMLWARLRVSPGELRRRFA

SEQ ID NO: 93709 - protein, 26 aa, Mycobacterium avium
AGSPLLAGDFVRWCRQVLDLLDQVRN

SEQ ID NO: 93710 - protein, 17 aa, Mycobacterium avium
AGSPPVYFGFGSLPVKS

SEQ ID NO: 93711 - protein, 25 aa, Mycobacterium avium
AGSVLEARTAISYVGIEGARANLAA

SEQ ID NO: 93712 - protein, 19 aa, Mycobacterium avium
AGTGLAAISWGLAHERMSI

SEQ ID NO: 93713 - protein, 21 aa, Mycobacterium avium
AGTLRPGDRADFVVIDPAGLD

SEQ ID NO: 93714 - protein, 17 aa, Mycobacterium avium
AGTPPIYFGFGSSARVA

SEQ ID NO: 93715 - protein, 23 aa, Mycobacterium avium
AGTRAHSARSWLGDNAIHKLGAV

SEQ ID NO: 93716 - protein, 17 aa, Mycobacterium avium
AGTRVTRALEAKWESAQ

SEQ ID NO: 93717 - protein, 22 aa, Mycobacterium avium
AGTSGPGAVLWVQATPVPDAAI

SEQ ID NO: 93718 - protein, 18 aa, Mycobacterium avium
AGTVDRLTFDPAGFGFPR

SEQ ID NO: 93719 - protein, 18 aa, Mycobacterium avium
AGTWLRDYFHQLIEARRS

SEQ ID NO: 93720 - protein, 17 aa, Mycobacterium avium
AGVAAAVHAGRVGAQRG

SEQ ID NO: 93721 - protein, 18 aa, Mycobacterium avium
AGVELGLLGTAVLEGPLA

SEQ ID NO: 93722 - protein, 20 aa, Mycobacterium avium
AGVGCTRLAIHAATGSGEER

SEQ ID NO: 93723 - protein, 25 aa, Mycobacterium avium
AGVPPHPCPLSFILAPTLIAHGTQQ

SEQ ID NO: 93724 - protein, 22 aa, Mycobacterium avium
AGVRRRLGIDLTEVEDQRPQIT

SEQ ID NO: 93725 - protein, 26 aa, Mycobacterium avium
AGVVNACRKCGALIQQGASNYSAAEA

SEQ ID NO: 93726 - protein, 23 aa, Mycobacterium avium
AGVYYRRALMLAASFGRSSDYPQ

SEQ ID NO: 93727 - protein, 24 aa, Mycobacterium avium
AGWERPSNLAGWSVRDLVGHATGS

SEQ ID NO: 93728 - protein, 21 aa, Mycobacterium avium
AGWETCRRMLAFLKDKENRRL

SEQ ID NO: 93729 - protein, 20 aa, Mycobacterium avium
AGWIDRLGTVWVEGQLAQVS

SEQ ID NO: 93730 - protein, 19 aa, Mycobacterium avium
AGWYDWCRDNLVVGADTLA

SEQ ID NO: 93731 - protein, 19 aa, Mycobacterium avium
AGYAFAKLAAAHYVNDFAL

SEQ ID NO: 93732 - protein, 26 aa, Mycobacterium avium
AGYERRSLAIASHWPFEQWGRFLPEH

SEQ ID NO: 93733 - protein, 22 aa, Mycobacterium avium
AGYPRQAPAVGYVPALALLPRR

SEQ ID NO: 93734 - protein, 22 aa, Mycobacterium avium
AGYRGSDAIKVLTASAQLASEE

SEQ ID NO: 93735 - protein, 25 aa, Mycobacterium avium
AGYTAPEFFDYLVALAAADPDLAHI

SEQ ID NO: 93736 - protein, 17 aa, Mycobacterium avium
AHAALQFLLPQGSGKII

SEQ ID NO: 93737 - protein, 17 aa, Mycobacterium avium
AHAANPARARRRAAKVL

SEQ ID NO: 93738 - protein, 21 aa, Mycobacterium avium
AHAEVRPNVVILAMVLAAFEW

SEQ ID NO: 93739 - protein, 19 aa, Mycobacterium avium
AHAFDGVGVRVSRYSYLVS

SEQ ID NO: 93740 - protein, 17 aa, Mycobacterium avium
AHARPDVLAAMPSLPTT

SEQ ID NO: 93741 - protein, 20 aa, Mycobacterium avium
AHASSRMDFVLADAAPSAVI

SEQ ID NO: 93742 - protein, 20 aa, Mycobacterium avium
AHATAWYGLHDLARVKAGDK

SEQ ID NO: 93743 - protein, 30 aa, Mycobacterium avium
AHAYSAANWLALNCRRHMQLYGTRKEQLGW

SEQ ID NO: 93744 - protein, 21 aa, Mycobacterium avium
AHDALRAYVHAAVRAATQPAL

SEQ ID NO: 93745 - protein, 21 aa, Mycobacterium avium
AHDALRAYVHAAVRASTQPAL

SEQ ID NO: 93746 - protein, 27 aa, Mycobacterium avium
AHDETRKSFGIAGARVVESIKLSVPFK

SEQ ID NO: 93747 - protein, 25 aa, Mycobacterium avium
AHDVAIVLGSGWSPAVAALGAPTAV

SEQ ID NO: 93748 - protein, 23 aa, Mycobacterium avium
AHELGRALAPVPFVASAVLATGL

SEQ ID NO: 93749 - protein, 17 aa, Mycobacterium avium
AHFPGVNNTTVWSDPSA

SEQ ID NO: 93750 - protein, 18 aa, Mycobacterium avium
AHGISGEIVVEIRTDDPA

SEQ ID NO: 93751 - protein, 17 aa, Mycobacterium avium
AHGMAPEMLAMAQTADL

SEQ ID NO: 93752 - protein, 22 aa, Mycobacterium avium
AHGVFERFPGLRIGVVENGGSW

SEQ ID NO: 93753 - protein, 17 aa, Mycobacterium avium
AHHIAGVQVLVRSLLAG

SEQ ID NO: 93754 - protein, 32 aa, Mycobacterium avium
AHHLRSDYQLRFRWSAGAVVLWDNRGMQHTGI

SEQ ID NO: 93755 - protein, 24 aa, Mycobacterium avium
AHHPLIQVMLTWRGDDPTRLRLGE

SEQ ID NO: 93756 - protein, 21 aa, Mycobacterium avium
AHHRESFLYTNFDELCEIFAR

SEQ ID NO: 93757 - protein, 23 aa, Mycobacterium avium
AHIDCALLPWSIVEVGLSSVEPQ

SEQ ID NO: 93758 - protein, 23 aa, Mycobacterium avium
AHKTKVAAALQWVVREEAGVLER

SEQ ID NO: 93759 - protein, 18 aa, Mycobacterium avium
AHLARLELNVAFQMLYAR

SEQ ID NO: 93760 - protein, 19 aa, Mycobacterium avium
AHLGADGWATTTFGLADLF

SEQ ID NO: 93761 - protein, 24 aa, Mycobacterium avium
AHLISPWGTWDWMGPAAVGAVLPA

SEQ ID NO: 93762 - protein, 24 aa, Mycobacterium avium
AHLQRRLRALVGRRGGRGARPGVV

SEQ ID NO: 93763 - protein, 17 aa, Mycobacterium avium
AHLRRWGIPEQRIVELD

SEQ ID NO: 93764 - protein, 17 aa, Mycobacterium avium
AHMGTNHLGHFALTCLL

SEQ ID NO: 93765 - protein, 19 aa, Mycobacterium avium
AHNATSFMVVQAALAVLLA

SEQ ID NO: 93766 - protein, 20 aa, Mycobacterium avium
AHNGLRVIAMQAFVGADRDA

SEQ ID NO: 93767 - protein, 18 aa, Mycobacterium avium
AHPALDRPSQLALTLRLV

SEQ ID NO: 93768 - protein, 18 aa, Mycobacterium avium
AHPGRPEVLTAWMDAAVV

SEQ ID NO: 93769 - protein, 23 aa, Mycobacterium avium
AHPGRPEVLTAWMDAAVVDENDP

SEQ ID NO: 93770 - protein, 23 aa, Mycobacterium avium
AHPRPDFKTRILQAFNDGMKHRP

SEQ ID NO: 93771 - protein, 26 aa, Mycobacterium avium
AHPRTEPRPVPWGGNQQGLYRCALRV

SEQ ID NO: 93772 - protein, 26 aa, Mycobacterium avium
AHQIEFAEAFGPILIFRSVVPADPQH

SEQ ID NO: 93773 - protein, 25 aa, Mycobacterium avium
AHQNCPFSRLSRRLSPRVPESGVEL

SEQ ID NO: 93774 - protein, 20 aa, Mycobacterium avium
AHRGLHVGVLVLRQPGRQPA

SEQ ID NO: 93775 - protein, 22 aa, Mycobacterium avium
AHRLAGEWTFRRARPEPPLAVL

SEQ ID NO: 93776 - protein, 18 aa, Mycobacterium avium
AHRLGLIDPQAWAFVWVV

SEQ ID NO: 93777 - protein, 18 aa, Mycobacterium avium
AHRWPDVFALVAQYLIDA

SEQ ID NO: 93778 - protein, 23 aa, Mycobacterium avium
AHSLRELVARTGVDPAQVDDVIA

SEQ ID NO: 93779 - protein, 26 aa, Mycobacterium avium
AHSPLEFLYGLFFDYVRDRRRQPRED

SEQ ID NO: 93780 - protein, 22 aa, Mycobacterium avium
AHSQKFAWARLFRPMVHGHPLT

SEQ ID NO: 93781 - protein, 17 aa, Mycobacterium avium
AHTGRLPAGLPEIRSYR

SEQ ID NO: 93782 - protein, 19 aa, Mycobacterium avium
AHTRLWGPAFRARRANRVR

SEQ ID NO: 93783 - protein, 18 aa, Mycobacterium avium
AHVLCGRGNRGHRGLDLA

SEQ ID NO: 93784 - protein, 17 aa, Mycobacterium avium
AHVLLHFGSDEQKRMLL

SEQ ID NO: 93785 - protein, 24 aa, Mycobacterium avium
AHVRGRLTVEWARRAEHRGFAGLA

SEQ ID NO: 93786 - protein, 17 aa, Mycobacterium avium
AHYHLAWFQAINHRAGS

SEQ ID NO: 93787 - protein, 21 aa, Mycobacterium avium
AIAAACGYDAVYVDLEHTSTS

SEQ ID NO: 93788 - protein, 19 aa, Mycobacterium avium
AIAARRPGFPGAEEQAPVT

SEQ ID NO: 93789 - protein, 18 aa, Mycobacterium avium
AIAARRPGLPGAEEQAPV

SEQ ID NO: 93790 - protein, 17 aa, Mycobacterium avium
AIAASYVPLFRKLLRNT

SEQ ID NO: 93791 - protein, 19 aa, Mycobacterium avium
AIAAVSVGVVDGRIRVDLP

SEQ ID NO: 93792 - protein, 18 aa, Mycobacterium avium
AIAKEINVQFVLAYTPEE

SEQ ID NO: 93793 - protein, 19 aa, Mycobacterium avium
AIAKEINVQFVLAYTPEEF

SEQ ID NO: 93794 - protein, 18 aa, Mycobacterium avium
AIAKEINVQFVLAYTPRG

SEQ ID NO: 93795 - protein, 28 aa, Mycobacterium avium
AIALAKCAAYDPWFPKASHAIVDSWAEQ

SEQ ID NO: 93796 - protein, 26 aa, Mycobacterium avium
AIARPELLEEMARQFGSQCIVLSVDA

SEQ ID NO: 93797 - protein, 24 aa, Mycobacterium avium
AIARQTIDLYLSMSHEEASPVPVD

SEQ ID NO: 93798 - protein, 19 aa, Mycobacterium avium
AIDEARRAAERECEQLLGD

SEQ ID NO: 93799 - protein, 25 aa, Mycobacterium avium
AIDKGRWTFGYLMSRATTIGAGTAE

SEQ ID NO: 93800 - protein, 20 aa, Mycobacterium avium
AIDLRDDWAAALREERFDTQ

SEQ ID NO: 93801 - protein, 18 aa, Mycobacterium avium
AIEAHLDRGRGPVATVLI

SEQ ID NO: 93802 - protein, 18 aa, Mycobacterium avium
AIEKACRTGGSSFLGLGL

SEQ ID NO: 93803 - protein, 27 aa, Mycobacterium avium
AIELQRRGCAIARVVLLDAQPGLDGSV

SEQ ID NO: 93804 - protein, 23 aa, Mycobacterium avium
AIFDKGKALALYHTKRLASPAQR

SEQ ID NO: 93805 - protein, 22 aa, Mycobacterium avium
AIGMVIPYAAMEIMKLRLTPSA

SEQ ID NO: 93806 - protein, 22 aa, Mycobacterium avium
AIIESRGGTAVSDFSDVGDEEQ

SEQ ID NO: 93807 - protein, 21 aa, Mycobacterium avium
AIIETALARYGRLDVLVHNAG

SEQ ID NO: 93808 - protein, 19 aa, Mycobacterium avium
AIKSGFFEREITPVTLPDG

SEQ ID NO: 93809 - protein, 26 aa, Mycobacterium avium
AILSRARPDLGWFPGLAERLRAADRG

SEQ ID NO: 93810 - protein, 32 aa, Mycobacterium avium
AIMKAGAGYFPIDPGYPLARKQFMLDDVAPPV

SEQ ID NO: 93811 - protein, 17 aa, Mycobacterium avium
AIMSVALLLAHLGEDAA

SEQ ID NO: 93812 - protein, 36 aa, Mycobacterium avium
AINMVSAIPGPIGWVGIAASTAWEAFDLGGNKIGQW

SEQ ID NO: 93813 - protein, 25 aa, Mycobacterium avium
AIPLGDRLVLIVGDIVGHGVEAAAV

SEQ ID NO: 93814 - protein, 23 aa, Mycobacterium avium
AIQLCIRRHGRVVLNRAIGHGWG

SEQ ID NO: 93815 - protein, 20 aa, Mycobacterium avium
AIRAECGVEIGIRDVFELAT

SEQ ID NO: 93816 - protein, 24 aa, Mycobacterium avium
AIRAECGVELGIRDVFELATVGLL

SEQ ID NO: 93817 - protein, 21 aa, Mycobacterium avium
AIRAGVPSLVLAVSVDQPLWA

SEQ ID NO: 93818 - protein, 23 aa, Mycobacterium avium
AIRDARLQIAFYLTVKTYDSLVE

SEQ ID NO: 93819 - protein, 24 aa, Mycobacterium avium
AIRPDAQGLLAFVGVTHSDDRDKA

SEQ ID NO: 93820 - protein, 25 aa, Mycobacterium avium
AIRRKLRLADVLAYREELHARRNRF

SEQ ID NO: 93821 - protein, 22 aa, Mycobacterium avium
AIRYLGEEGGRAFVQSLEGVEE

SEQ ID NO: 93822 - protein, 25 aa, Mycobacterium avium
AISAGLMLIWACDLIVAADNAKFSD

SEQ ID NO: 93823 - protein, 18 aa, Mycobacterium avium
AISKGQRGGNLWLSDVFG

SEQ ID NO: 93824 - protein, 24 aa, Mycobacterium avium
AISPSGFEWEVGWNPVVVDENTWE

SEQ ID NO: 93825 - protein, 26 aa, Mycobacterium avium
AISSGARPARSWCWVEYAGNMLTPEL

SEQ ID NO: 93826 - protein, 21 aa, Mycobacterium avium
AITPWNFPVEIIANKVGQILA

SEQ ID NO: 93827 - protein, 26 aa, Mycobacterium avium
AIVKAEYKAGTALGEKLAGKIAGEGL

SEQ ID NO: 93828 - protein, 22 aa, Mycobacterium avium
AIVKAVQAIPVLKPVVPDPGYP

SEQ ID NO: 93829 - protein, 19 aa, Mycobacterium avium
AIWIGGRTPPAGAIRDLLS

SEQ ID NO: 93830 - protein, 42 aa, Mycobacterium avium
AIYNVRVMTQWVPKSGASYAYFGVGIFKNGLLYDTDVICLTS

SEQ ID NO: 93831 - protein, 19 aa, Mycobacterium avium
AKAFAAKPFDYWRQHLKTM

SEQ ID NO: 93832 - protein, 21 aa, Mycobacterium avium
AKAGDLALLIGYGAGLSYAAQ

SEQ ID NO: 93833 - protein, 21 aa, Mycobacterium avium
AKAGDLALLIGYGAGLSYTAQ

SEQ ID NO: 93834 - protein, 17 aa, Mycobacterium avium
AKAIAKLGFGYDDVAAI

SEQ ID NO: 93835 - protein, 26 aa, Mycobacterium avium
AKAIDAGWIDGPRVVPAGHAITPTGG

SEQ ID NO: 93836 - protein, 18 aa, Mycobacterium avium
AKALRRYTFGPGVAKVDF

SEQ ID NO: 93837 - protein, 17 aa, Mycobacterium avium
AKAREAGLWSLQTPEEY

SEQ ID NO: 93838 - protein, 19 aa, Mycobacterium avium
AKATAVLSMPMHRFRNPYT

SEQ ID NO: 93839 - protein, 19 aa, Mycobacterium avium
AKEALRRFGAVDVVCNNAG

SEQ ID NO: 93840 - protein, 18 aa, Mycobacterium avium
AKELGALVQRGMTPAQAI

SEQ ID NO: 93841 - protein, 20 aa, Mycobacterium avium
AKELITLAGRNIFPTEIETV

SEQ ID NO: 93842 - protein, 18 aa, Mycobacterium avium
AKEVLRVLAERDLLHPHP

SEQ ID NO: 93843 - protein, 23 aa, Mycobacterium avium
AKEVTALGRWFRIDGDKLSYSVQ

SEQ ID NO: 93844 - protein, 17 aa, Mycobacterium avium
AKFAANIPFPKRLGTPA

SEQ ID NO: 93845 - protein, 24 aa, Mycobacterium avium
AKFKAPEQVVLWDALPKNDAGKVL

SEQ ID NO: 93846 - protein, 19 aa, Mycobacterium avium
AKFRDAEKLTFPLLSDPDR

SEQ ID NO: 93847 - protein, 19 aa, Mycobacterium avium
AKFTHPLRFDVPITGQHST

SEQ ID NO: 93848 - protein, 19 aa, Mycobacterium avium
AKGAPRADSRCTLIGEIDR

SEQ ID NO: 93849 - protein, 18 aa, Mycobacterium avium
AKGFEPVALCARTPDRLE

SEQ ID NO: 93850 - protein, 23 aa, Mycobacterium avium
AKGYEPVALCARTPERLERVADK

SEQ ID NO: 93851 - protein, 18 aa, Mycobacterium avium
AKHAPGYFSLDDWGYASL

SEQ ID NO: 93852 - protein, 25 aa, Mycobacterium avium
AKHSAEIPYLFGGLTPAGSYDEVDA

SEQ ID NO: 93853 - protein, 23 aa, Mycobacterium avium
AKKHMAFGVGMHRCLGSHYAKLM

SEQ ID NO: 93854 - protein, 23 aa, Mycobacterium avium
AKKQMAFGVGMHRCLGSHYAKMM

SEQ ID NO: 93855 - protein, 24 aa, Mycobacterium avium
AKKTKRFLALEARGLKARAELLSR

SEQ ID NO: 93856 - protein, 23 aa, Mycobacterium avium
AKLFAEAGFPPGVINVVTGWGPE

SEQ ID NO: 93857 - protein, 20 aa, Mycobacterium avium
AKLGPNVRRLHYLSVPPKAA

SEQ ID NO: 93858 - protein, 21 aa, Mycobacterium avium
AKLGPNVRRLHYLSVPPKAAR

SEQ ID NO: 93859 - protein, 24 aa, Mycobacterium avium
AKLLERFRAMEPWLQGGRVHAPFW

SEQ ID NO: 93860 - protein, 17 aa, Mycobacterium avium
AKLTGTIQNDILKEYAS

SEQ ID NO: 93861 - protein, 18 aa, Mycobacterium avium
AKLVRLFPTVMTGTHVEL

SEQ ID NO: 93862 - protein, 18 aa, Mycobacterium avium
AKMGVPYNRVVVKEPMGV

SEQ ID NO: 93863 - protein, 35 aa, Mycobacterium avium
AKMKDFKGALSAARIEIGQDFLPAMTEVVGVLGES

SEQ ID NO: 93864 - protein, 24 aa, Mycobacterium avium
AKMSAAVTPYLEWLHTTATQAEQA

SEQ ID NO: 93865 - protein, 18 aa, Mycobacterium avium
AKNPQIWYLGSAADEETH

SEQ ID NO: 93866 - protein, 18 aa, Mycobacterium avium
AKPLPVAAAPEFRTVIRG

SEQ ID NO: 93867 - protein, 24 aa, Mycobacterium avium
AKPRPARPELVVLCDVSGSVAGFS

SEQ ID NO: 93868 - protein, 23 aa, Mycobacterium avium
AKPSPPYAAAVREWEKLEQFVDG

SEQ ID NO: 93869 - protein, 17 aa, Mycobacterium avium
AKREYLEQVSIFDVALR

SEQ ID NO: 93870 - protein, 20 aa, Mycobacterium avium
AKRGLVGLMQVWANELAQHW

SEQ ID NO: 93871 - protein, 22 aa, Mycobacterium avium
AKRLRRLGVGVLKSVTVTEVRW

SEQ ID NO: 93872 - protein, 25 aa, Mycobacterium avium
AKRLVDFAAGLAFALRGSFDKVATK

SEQ ID NO: 93873 - protein, 22 aa, Mycobacterium avium
AKRWVTLGFTWNGLRALGVPGD

SEQ ID NO: 93874 - protein, 22 aa, Mycobacterium avium
AKSAKYGLLLARTGPHKHRDLS

SEQ ID NO: 93875 - protein, 35 aa, Mycobacterium avium
AKSEIRVVRIRPVPGQGVVRVSQWIEQRDVTSSLT

SEQ ID NO: 93876 - protein, 30 aa, Mycobacterium avium
AKSFLQTSLQKWKGCAGQTVTVTNKSKTYR

SEQ ID NO: 93877 - protein, 20 aa, Mycobacterium avium
AKSRLAGAYGEDAAAEIAAL

SEQ ID NO: 93878 - protein, 25 aa, Mycobacterium avium
AKTGKLRPALFVLPTDAPGFSATPI

SEQ ID NO: 93879 - protein, 24 aa, Mycobacterium avium
AKTLGEFGFDHPMGDGWRGFQDID

SEQ ID NO: 93880 - protein, 17 aa, Mycobacterium avium
AKVADVFPGAGAGATRI

SEQ ID NO: 93881 - protein, 18 aa, Mycobacterium avium
AKVDAAWNLHELTRDLDV

SEQ ID NO: 93882 - protein, 18 aa, Mycobacterium avium
AKVDGAWNLHELTKDLDL

SEQ ID NO: 93883 - protein, 19 aa, Mycobacterium avium
AKVKPGYANFAIVEPPLKL

SEQ ID NO: 93884 - protein, 27 aa, Mycobacterium avium
AKVSALRWGSTDPRIVFVHGGGQNAHT

SEQ ID NO: 93885 - protein, 17 aa, Mycobacterium avium
AKWARSQGWTVFDDSKG

SEQ ID NO: 93886 - protein, 19 aa, Mycobacterium avium
AKYPRIAALALRNRCTKTL

SEQ ID NO: 93887 - protein, 22 aa, Mycobacterium avium
ALAAAGRPDGAFRLGPVHIDVV

SEQ ID NO: 93888 - protein, 19 aa, Mycobacterium avium
ALAAVIATHPRPDFKTRIL

SEQ ID NO: 93889 - protein, 22 aa, Mycobacterium avium
ALACGIGSFAHHTVVHEASCVK

SEQ ID NO: 93890 - protein, 17 aa, Mycobacterium avium
ALADCLRAVPMSAADTG

SEQ ID NO: 93891 - protein, 18 aa, Mycobacterium avium
ALADFAQRGWIRQQGKAL

SEQ ID NO: 93892 - protein, 21 aa, Mycobacterium avium
ALADLAAVFGLDVRPVDVRVQ

SEQ ID NO: 93893 - protein, 19 aa, Mycobacterium avium
ALAERARRLLGEHTVPSAP

SEQ ID NO: 93894 - protein, 28 aa, Mycobacterium avium
ALALAEWGCSANERLIHVDGPAFMVGHA

SEQ ID NO: 93895 - protein, 25 aa, Mycobacterium avium
ALAPVRFFNPIGMRFAKKATREDID

SEQ ID NO: 93896 - protein, 25 aa, Mycobacterium avium
ALAQARACASAECVTRRQAATAAAA

SEQ ID NO: 93897 - protein, 17 aa, Mycobacterium avium
ALARLGAVQNPIIPVLR

SEQ ID NO: 93898 - protein, 17 aa, Mycobacterium avium
ALARLYPESARIPAESV

SEQ ID NO: 93899 - protein, 19 aa, Mycobacterium avium
ALASEEWLGSASASMASAV

SEQ ID NO: 93900 - protein, 18 aa, Mycobacterium avium
ALAYVRFALDHPGHYQVM

SEQ ID NO: 93901 - protein, 21 aa, Mycobacterium avium
ALCDARGGAVAPVVTGQYRSG

SEQ ID NO: 93902 - protein, 22 aa, Mycobacterium avium
ALCDARGGAVAPVVTGQYRSGD

SEQ ID NO: 93903 - protein, 19 aa, Mycobacterium avium
ALCQLWKDNYCVYGARKLW

SEQ ID NO: 93904 - protein, 30 aa, Mycobacterium avium
ALCQLWKDNYCVYGARKLWKTARREGHDVG

SEQ ID NO: 93905 - protein, 24 aa, Mycobacterium avium
ALDAFTLRVGRPVAPMLAQTAAGV

SEQ ID NO: 93906 - protein, 18 aa, Mycobacterium avium
ALDDVRRYLSYFPPSAWS

SEQ ID NO: 93907 - protein, 17 aa, Mycobacterium avium
ALDGAAMARPFAAPATV

SEQ ID NO: 93908 - protein, 25 aa, Mycobacterium avium
ALDGSCKSCPSSAVTLELTVEDAVR

SEQ ID NO: 93909 - protein, 18 aa, Mycobacterium avium
ALDHGAEVIGYWGEPVST

SEQ ID NO: 93910 - protein, 18 aa, Mycobacterium avium
ALDKVRAGDTAWLTRPLI

SEQ ID NO: 93911 - protein, 25 aa, Mycobacterium avium
ALDNMRIHGGIGFTWEHDAHLYVRR

SEQ ID NO: 93912 - protein, 17 aa, Mycobacterium avium
ALDPRWTVRQILDGPLR

SEQ ID NO: 93913 - protein, 27 aa, Mycobacterium avium
ALDRDCAELRAAGVVAAEALRLQRAQV

SEQ ID NO: 93914 - protein, 24 aa, Mycobacterium avium
ALDTAGRWGVSRVWLGVNQKNQRA

SEQ ID NO: 93915 - protein, 23 aa, Mycobacterium avium
ALDTVVAAALRLSAEEQRSLRSA

SEQ ID NO: 93916 - protein, 19 aa, Mycobacterium avium
ALDTVVAAALRLSTEEQRS

SEQ ID NO: 93917 - protein, 21 aa, Mycobacterium avium
ALEAHPAVLLFSHRSYIDGAV

SEQ ID NO: 93918 - protein, 19 aa, Mycobacterium avium
ALEDGYRVFAELAPHPLLV

SEQ ID NO: 93919 - protein, 26 aa, Mycobacterium avium
ALEEILKRFPAWEVDWANAVPSETAA

SEQ ID NO: 93920 - protein, 17 aa, Mycobacterium avium
ALEGGWSTRWCRATSST

SEQ ID NO: 93921 - protein, 21 aa, Mycobacterium avium
ALEKHGPPVYVRHEIVHNRHV

SEQ ID NO: 93922 - protein, 20 aa, Mycobacterium avium
ALELLRGEGLITRVQGSGTF

SEQ ID NO: 93923 - protein, 18 aa, Mycobacterium avium
ALEPLFAKTLKWASTTPL

SEQ ID NO: 93924 - protein, 21 aa, Mycobacterium avium
ALEQLSAAPLRTLDAAMSPVT

SEQ ID NO: 93925 - protein, 20 aa, Mycobacterium avium
ALEQYLAKNRKIIAFVNSSV

SEQ ID NO: 93926 - protein, 18 aa, Mycobacterium avium
ALEVRLQAWALILEAVAG

SEQ ID NO: 93927 - protein, 20 aa, Mycobacterium avium
ALEVTGRLLLAAGSRRSAWW

SEQ ID NO: 93928 - protein, 18 aa, Mycobacterium avium
ALFSAVSVFCRRVQTPDD

SEQ ID NO: 93929 - protein, 19 aa, Mycobacterium avium
ALGDIGHDIMLIIDGDAWD

SEQ ID NO: 93930 - protein, 24 aa, Mycobacterium avium
ALGFELPRDVGYGFHVVAVLDGRR

SEQ ID NO: 93931 - protein, 18 aa, Mycobacterium avium
ALGGSLEDGQMCRLRAAG

SEQ ID NO: 93932 - protein, 20 aa, Mycobacterium avium
ALGILERFDMASLPVDSADS

SEQ ID NO: 93933 - protein, 21 aa, Mycobacterium avium
ALGIPEVRFTAALTSGGGGSA

SEQ ID NO: 93934 - protein, 24 aa, Mycobacterium avium
ALGNASLKWDRVSKLVFTNCDSFE

SEQ ID NO: 93935 - protein, 17 aa, Mycobacterium avium
ALGRIALVLISHRHGDH

SEQ ID NO: 93936 - protein, 25 aa, Mycobacterium avium
ALHFFPADTLELGWMQSHVTAAAEA

SEQ ID NO: 93937 - protein, 18 aa, Mycobacterium avium
ALHGANRCNPRTGDKVVV

SEQ ID NO: 93938 - protein, 18 aa, Mycobacterium avium
ALHLARRGIEVEIFTRAT

SEQ ID NO: 93939 - protein, 20 aa, Mycobacterium avium
ALHSVEPVAAAAHLKLEDVW

SEQ ID NO: 93940 - protein, 24 aa, Mycobacterium avium
ALHVYRALFGFLYGHVLTELQEIV

SEQ ID NO: 93941 - protein, 17 aa, Mycobacterium avium
ALIDRWSNRPALTEPAP

SEQ ID NO: 93942 - protein, 24 aa, Mycobacterium avium
ALIEIPDCSAFVMIDAPAKLAEAI

SEQ ID NO: 93943 - protein, 27 aa, Mycobacterium avium
ALIKPAPVYGYKGWRSPALPEFDPFWR

SEQ ID NO: 93944 - protein, 21 aa, Mycobacterium avium
ALIKVCADLGLDTVRVPGRSG

SEQ ID NO: 93945 - protein, 28 aa, Mycobacterium avium
ALIVDEPFLLPAHIDLAALRAKFDGGTL

SEQ ID NO: 93946 - protein, 23 aa, Mycobacterium avium
ALLAFPAMQPMPIPFIEPQDVSN

SEQ ID NO: 93947 - protein, 21 aa, Mycobacterium avium
ALLAGLLSHVGMRREDSREFA

SEQ ID NO: 93948 - protein, 20 aa, Mycobacterium avium
ALLALLPLVGVWRGEGEGRG

SEQ ID NO: 93949 - protein, 18 aa, Mycobacterium avium
ALLAQRWLHVTGAGTDAL

SEQ ID NO: 93950 - protein, 18 aa, Mycobacterium avium
ALLKGLTAHYLLKSVYPV

SEQ ID NO: 93951 - protein, 25 aa, Mycobacterium avium
ALLLRLYAHWARRTCDPLAARVTAE

SEQ ID NO: 93952 - protein, 17 aa, Mycobacterium avium
ALLNLLGAQGYINAYAA

SEQ ID NO: 93953 - protein, 17 aa, Mycobacterium avium
ALLPRRPDLKLIITSAT

SEQ ID NO: 93954 - protein, 22 aa, Mycobacterium avium
ALLPVLRPGKQVLLTDQLADRT

SEQ ID NO: 93955 - protein, 37 aa, Mycobacterium avium
ALLRECAEKMLVRHPNLRASFFSRGIARPVQIVPSRV

SEQ ID NO: 93956 - protein, 18 aa, Mycobacterium avium
ALLRGKRSVTLDVHNDAD

SEQ ID NO: 93957 - protein, 17 aa, Mycobacterium avium
ALLRQMPKVLVAFDSRW

SEQ ID NO: 93958 - protein, 18 aa, Mycobacterium avium
ALLRRTKIPLSIDTGLLT

SEQ ID NO: 93959 - protein, 17 aa, Mycobacterium avium
ALLWIHGGGTVMGHAAQ

SEQ ID NO: 93960 - protein, 19 aa, Mycobacterium avium
ALMSELLWSRIGAQRDATI

SEQ ID NO: 93961 - protein, 24 aa, Mycobacterium avium
ALMTTDWSLPVAMIPMANIDDAIA

SEQ ID NO: 93962 - protein, 18 aa, Mycobacterium avium
ALNLFSFRPNVWDTEAET

SEQ ID NO: 93963 - protein, 18 aa, Mycobacterium avium
ALNSRLGGHIVQGHVDGT

SEQ ID NO: 93964 - protein, 23 aa, Mycobacterium avium
ALNTAVWSGGSFIYVPPGVHVDI

SEQ ID NO: 93965 - protein, 27 aa, Mycobacterium avium
ALPAKAADSLTEWMLGYVRFHRTYRGV

SEQ ID NO: 93966 - protein, 23 aa, Mycobacterium avium
ALPDERIGFMLADAAPMVAISTA

SEQ ID NO: 93967 - protein, 24 aa, Mycobacterium avium
ALPEEFRMAVYYADVEGFPYKEIA

SEQ ID NO: 93968 - protein, 20 aa, Mycobacterium avium
ALPELGRSGSLDILLAAYSL

SEQ ID NO: 93969 - protein, 19 aa, Mycobacterium avium
ALPGIGFSGGIIGGLEGAA

SEQ ID NO: 93970 - protein, 19 aa, Mycobacterium avium
ALPGLGGLGGMLGGGAAAA

SEQ ID NO: 93971 - protein, 23 aa, Mycobacterium avium
ALPKFPLELGEAAADTPGAIDVF

SEQ ID NO: 93972 - protein, 23 aa, Mycobacterium avium
ALPKLANQFLRAWVPEDGGGIPW

SEQ ID NO: 93973 - protein, 25 aa, Mycobacterium avium
ALPKLRALLRCDLNLVPREEGLVEL

SEQ ID NO: 93974 - protein, 19 aa, Mycobacterium avium
ALPPRYAKALRRYTFGPGV

SEQ ID NO: 93975 - protein, 20 aa, Mycobacterium avium
ALPSNWGRWGTTDELGTLNL

SEQ ID NO: 93976 - protein, 23 aa, Mycobacterium avium
ALPSRPVQAIGFTSVPGAGDNLL

SEQ ID NO: 93977 - protein, 19 aa, Mycobacterium avium
ALQAQRLSAHLAERPQASP

SEQ ID NO: 93978 - protein, 24 aa, Mycobacterium avium
ALQPEIRLTAPLLAKGLPACPGVV

SEQ ID NO: 93979 - protein, 26 aa, Mycobacterium avium
ALQPYGGAWLNSWLDRDLGISGRLSV

SEQ ID NO: 93980 - protein, 18 aa, Mycobacterium avium
ALQRGLPVLGICRGAQVL

SEQ ID NO: 93981 - protein, 17 aa, Mycobacterium avium
ALRAEARRHFGFADDAR

SEQ ID NO: 93982 - protein, 21 aa, Mycobacterium avium
ALRAFQNVCRHRGNSLCSGSG

SEQ ID NO: 93983 - protein, 20 aa, Mycobacterium avium
ALRAGIRQVVILAAGLDSRA

SEQ ID NO: 93984 - protein, 19 aa, Mycobacterium avium
ALRDTCARIGEHLPGGLPD

SEQ ID NO: 93985 - protein, 31 aa, Mycobacterium avium
ALRELGWRPRIALKDGIDATVSWYRTNADAV

SEQ ID NO: 93986 - protein, 27 aa, Mycobacterium avium
ALRRAVAFRRFRAADVRSILAAGAGTP

SEQ ID NO: 93987 - protein, 24 aa, Mycobacterium avium
ALRRRAAGLRRLRVTRGGPPCPPR

SEQ ID NO: 93988 - protein, 19 aa, Mycobacterium avium
ALRRSPVADFPRLGGPAGG

SEQ ID NO: 93989 - protein, 23 aa, Mycobacterium avium
ALRSVGFPFPGVRVRIVGDDGRD

SEQ ID NO: 93990 - protein, 17 aa, Mycobacterium avium
ALRTEWAGSSMAVATVS

SEQ ID NO: 93991 - protein, 17 aa, Mycobacterium avium
ALSASGVLGEFTRSGYL

SEQ ID NO: 93992 - protein, 17 aa, Mycobacterium avium
ALSELYGVPVRVLTATD

SEQ ID NO: 93993 - protein, 24 aa, Mycobacterium avium
ALSERYPRLVVATITGWGSTGPFR

SEQ ID NO: 93994 - protein, 18 aa, Mycobacterium avium
ALSGDCLLEHAVTGKPLT

SEQ ID NO: 93995 - protein, 31 aa, Mycobacterium avium
ALSPRMLRIAGHFADGVVLWMASASVIESRI

SEQ ID NO: 93996 - protein, 31 aa, Mycobacterium avium
ALSPRMLRIAGRFADGVVLWMASASVIESRI

SEQ ID NO: 93997 - protein, 23 aa, Mycobacterium avium
ALSRFPDLKIFCVENGSGWVRNL

SEQ ID NO: 93998 - protein, 17 aa, Mycobacterium avium
ALTASRFVACPFGGTGT

SEQ ID NO: 93999 - protein, 21 aa, Mycobacterium avium
ALTERKQVLVVIGRSDEAGAK

SEQ ID NO: 94000 - protein, 23 aa, Mycobacterium avium
ALTHLRANAPVSWVEVPNYKPFW

SEQ ID NO: 94001 - protein, 21 aa, Mycobacterium avium
ALTPGQPVCHFGVITGETCGT

SEQ ID NO: 94002 - protein, 24 aa, Mycobacterium avium
ALTRAQAQVVAWWSPAYHEPNGGL

SEQ ID NO: 94003 - protein, 17 aa, Mycobacterium avium
ALTRARAGWLWSRRRGV

SEQ ID NO: 94004 - protein, 20 aa, Mycobacterium avium
ALTRLRRRGLLLAVVTNQSG

SEQ ID NO: 94005 - protein, 22 aa, Mycobacterium avium
ALTSDRGWVMLLSRYQRPKAIR

SEQ ID NO: 94006 - protein, 17 aa, Mycobacterium avium
ALVAAVENWGRRGCSGE

SEQ ID NO: 94007 - protein, 17 aa, Mycobacterium avium
ALVEFGLPGLAVDETLG

SEQ ID NO: 94008 - protein, 25 aa, Mycobacterium avium
ALVGFGLDGSHGWERTHIDSLEAAY

SEQ ID NO: 94009 - protein, 21 aa, Mycobacterium avium
ALVPRRIKINGAELLAPADRP

SEQ ID NO: 94010 - protein, 19 aa, Mycobacterium avium
ALVRGRRRTYTFASADTPT

SEQ ID NO: 94011 - protein, 21 aa, Mycobacterium avium
ALWTALKTLYPVGIDHATLTR

SEQ ID NO: 94012 - protein, 22 aa, Mycobacterium avium
ALWTALKTLYPVGIDHATLTRR

SEQ ID NO: 94013 - protein, 24 aa, Mycobacterium avium
ALWTALKTLYPVGIDYATLTRRDA

SEQ ID NO: 94014 - protein, 19 aa, Mycobacterium avium
ALYPGRIDMGLGRSGQRRA

SEQ ID NO: 94015 - protein, 24 aa, Mycobacterium avium
ALYRKGYVWVAVFARTTGGSADWT

SEQ ID NO: 94016 - protein, 20 aa, Mycobacterium avium
ALYSYWGFGGADPGAYRRAE

SEQ ID NO: 94017 - protein, 19 aa, Mycobacterium avium
ALYWIGRYVERADDTARIL

SEQ ID NO: 94018 - protein, 21 aa, Mycobacterium avium
AMAALPRLLGVAYAGLLARAA

SEQ ID NO: 94019 - protein, 20 aa, Mycobacterium avium
AMAGVFWPKTLVATNIASCA

SEQ ID NO: 94020 - protein, 21 aa, Mycobacterium avium
AMASAAAPYVAWMQQTAAQAA

SEQ ID NO: 94021 - protein, 33 aa, Mycobacterium avium
AMDPRQRLALELAWELLEDAFIVAETLRGEAVS

SEQ ID NO: 94022 - protein, 17 aa, Mycobacterium avium
AMEIMKLRLTPSAYQQA

SEQ ID NO: 94023 - protein, 21 aa, Mycobacterium avium
AMFDLWFPAALGARAVVTDED

SEQ ID NO: 94024 - protein, 25 aa, Mycobacterium avium
AMFFPEPRCRVLTGVGAFDPGLGRK

SEQ ID NO: 94025 - protein, 24 aa, Mycobacterium avium
AMGSADWSAVLARVGADPDGAHRA

SEQ ID NO: 94026 - protein, 17 aa, Mycobacterium avium
AMIEFYIPVTPEAGRLL

SEQ ID NO: 94027 - protein, 23 aa, Mycobacterium avium
AMIGEPGQGWAIANATLGHERTS

SEQ ID NO: 94028 - protein, 20 aa, Mycobacterium avium
AMIVIRLQTVVSREVAPTET

SEQ ID NO: 94029 - protein, 18 aa, Mycobacterium avium
AMKLFRRMEDRAAFEVKI

SEQ ID NO: 94030 - protein, 26 aa, Mycobacterium avium
AMLARAGVPPRQWQWPLGEIDKPFDM

SEQ ID NO: 94031 - protein, 17 aa, Mycobacterium avium
AMLGYTACRTKFFDDYF

SEQ ID NO: 94032 - protein, 18 aa, Mycobacterium avium
AMLQRLVADGSLAAVNGT

SEQ ID NO: 94033 - protein, 25 aa, Mycobacterium avium
AMLQRREAWEIIDYVNRLTDPSALA

SEQ ID NO: 94034 - protein, 25 aa, Mycobacterium avium
AMLWHVIGCCLENLMAGKPHEEEPN

SEQ ID NO: 94035 - protein, 19 aa, Mycobacterium avium
AMMQEVLDYAATRRAKPEE

SEQ ID NO: 94036 - protein, 35 aa, Mycobacterium avium
AMNFFPATLTPIGLKLPFGEVMLTPEIQQVIAEHP

SEQ ID NO: 94037 - protein, 34 aa, Mycobacterium avium
AMNFFPATLTPIGLKLPFGEVMLTPEVQQVIAEH

SEQ ID NO: 94038 - protein, 26 aa, Mycobacterium avium
AMNFFPATLTPIGLKVPFGEVMLTPE

SEQ ID NO: 94039 - protein, 21 aa, Mycobacterium avium
AMPAQRYMHDFGLTREHLGRI

SEQ ID NO: 94040 - protein, 21 aa, Mycobacterium avium
AMPAQRYMHDFGLTREQLGWI

SEQ ID NO: 94041 - protein, 28 aa, Mycobacterium avium
AMPGQTGMTGMPMMPPGAMGAGGEGGNK

SEQ ID NO: 94042 - protein, 22 aa, Mycobacterium avium
AMPHTYRLIMAMGSQLATAGAA

SEQ ID NO: 94043 - protein, 22 aa, Mycobacterium avium
AMPQRAPTALIIPADVQELPYS

SEQ ID NO: 94044 - protein, 17 aa, Mycobacterium avium
AMSNVCGWSNVPVRRIR

SEQ ID NO: 94045 - protein, 24 aa, Mycobacterium avium
AMTAELRFPAGHTGRVRCSMWSTR

SEQ ID NO: 94046 - protein, 19 aa, Mycobacterium avium
AMTALVHRINLFVHTDRAY

SEQ ID NO: 94047 - protein, 17 aa, Mycobacterium avium
AMTPVPEAQAFWHSNTG

SEQ ID NO: 94048 - protein, 19 aa, Mycobacterium avium
AMVGFGLPVRRSRRATAPL

SEQ ID NO: 94049 - protein, 25 aa, Mycobacterium avium
AMVQRNCMVPMQLCHHYAPAMVERG

SEQ ID NO: 94050 - protein, 26 aa, Mycobacterium avium
AMVQRNCMVPMQLCHHYAPAMVERGA

SEQ ID NO: 94051 - protein, 17 aa, Mycobacterium avium
AMYPSFDDYQSWTDRVI

SEQ ID NO: 94052 - protein, 17 aa, Mycobacterium avium
ANAFGYNQTKRAIVNSS

SEQ ID NO: 94053 - protein, 21 aa, Mycobacterium avium
ANAGICCPAPWDQITDQAFRD

SEQ ID NO: 94054 - protein, 17 aa, Mycobacterium avium
ANAGICCPAPWDQITGQ

SEQ ID NO: 94055 - protein, 23 aa, Mycobacterium avium
ANAGICPLGAHLPVQAFADAFDV

SEQ ID NO: 94056 - protein, 26 aa, Mycobacterium avium
ANAGICPLGNDIPVQGFVDAFDVDFI

SEQ ID NO: 94057 - protein, 25 aa, Mycobacterium avium
ANAGICSPAPWNRITAQAFRDTIDT

SEQ ID NO: 94058 - protein, 23 aa, Mycobacterium avium
ANAIAEFGGRLDVVVANAGICPL

SEQ ID NO: 94059 - protein, 20 aa, Mycobacterium avium
ANAQGWRFVVLRSPEQRAVV

SEQ ID NO: 94060 - protein, 17 aa, Mycobacterium avium
ANARTAGVSVNFELADA

SEQ ID NO: 94061 - protein, 18 aa, Mycobacterium avium
ANAVAFLVSDEARFITGT

SEQ ID NO: 94062 - protein, 24 aa, Mycobacterium avium
ANCARTFPRWWQLKTNTTAIYLHD

SEQ ID NO: 94063 - protein, 17 aa, Mycobacterium avium
ANCHRTAVMVGRNPDGQ

SEQ ID NO: 94064 - protein, 28 aa, Mycobacterium avium
ANDKDIEEFGRWFGVQVEDGFGSTENAV

SEQ ID NO: 94065 - protein, 20 aa, Mycobacterium avium
ANDVATIYGIVGIPITDLAR

SEQ ID NO: 94066 - protein, 20 aa, Mycobacterium avium
ANEILKRAASFFGAELDRQH

SEQ ID NO: 94067 - protein, 20 aa, Mycobacterium avium
ANELAQHWIRVNTIHPTGVA

SEQ ID NO: 94068 - protein, 29 aa, Mycobacterium avium
ANGGRKPWLPHFYLGHGIGPYPADAPMIG

SEQ ID NO: 94069 - protein, 24 aa, Mycobacterium avium
ANGPMECHELMALSFASHLFQSLA

SEQ ID NO: 94070 - protein, 19 aa, Mycobacterium avium
ANHRVFRRNALVAALDKSS

SEQ ID NO: 94071 - protein, 20 aa, Mycobacterium avium
ANIWADKSLTFFDPFTKSGV

SEQ ID NO: 94072 - protein, 17 aa, Mycobacterium avium
ANLARLEGRVALDELLN

SEQ ID NO: 94073 - protein, 17 aa, Mycobacterium avium
ANLAVFLSYRDCDEVLR

SEQ ID NO: 94074 - protein, 19 aa, Mycobacterium avium
ANLDSCFVVTSAVLPKMTA

SEQ ID NO: 94075 - protein, 24 aa, Mycobacterium avium
ANLKRAWELMGMRVHWQSSNDLVA

SEQ ID NO: 94076 - protein, 17 aa, Mycobacterium avium
ANLRARPQLAVTFRNGW

SEQ ID NO: 94077 - protein, 24 aa, Mycobacterium avium
ANLSAECFARYLADPHRAVLAAEL

SEQ ID NO: 94078 - protein, 33 aa, Mycobacterium avium
ANLSKGCVVEDGIQCPFHGWVWNGEGRNVRIPY

SEQ ID NO: 94079 - protein, 34 aa, Mycobacterium avium
ANNAKAAVRLGSDMGEFFMPYPGTRINQDSTPLN

SEQ ID NO: 94080 - protein, 26 aa, Mycobacterium avium
ANPLLSIPEALAFRESLAGWAHDDVA

SEQ ID NO: 94081 - protein, 25 aa, Mycobacterium avium
ANRLAHFWYAAGLREGDTVAALLEN

SEQ ID NO: 94082 - protein, 25 aa, Mycobacterium avium
ANSFRCPYHGWTFGNTGALQGVPMR

SEQ ID NO: 94083 - protein, 24 aa, Mycobacterium avium
ANSFRCPYHGWTFNNTGALQGVPM

SEQ ID NO: 94084 - protein, 18 aa, Mycobacterium avium
ANSPFFFGHQLWAETRIE

SEQ ID NO: 94085 - protein, 31 aa, Mycobacterium avium
ANSPGAVCLRLPVRTPFGFHGVFGHLAASVV

SEQ ID NO: 94086 - protein, 18 aa, Mycobacterium avium
ANSRRPGQHVLSRGVVDA

SEQ ID NO: 94087 - protein, 20 aa, Mycobacterium avium
ANSTPFVWDGTRAVNYQDPS

SEQ ID NO: 94088 - protein, 25 aa, Mycobacterium avium
ANVAKWLKRKPLRGRLFALHGRPQL

SEQ ID NO: 94089 - protein, 24 aa, Mycobacterium avium
ANVAKWLKRKPLRGRLFPLHGRPQ

SEQ ID NO: 94090 - protein, 17 aa, Mycobacterium avium
ANVSVVFVPPKFAKDAI

SEQ ID NO: 94091 - protein, 19 aa, Mycobacterium avium
ANVVVRWLADAGVSIAGTR

SEQ ID NO: 94092 - protein, 17 aa, Mycobacterium avium
ANWMKHLHHANWKMVVE

SEQ ID NO: 94093 - protein, 18 aa, Mycobacterium avium
ANWMKHLHHANWKMVVEN

SEQ ID NO: 94094 - protein, 18 aa, Mycobacterium avium
ANYADPFGDWRAGPFESV

SEQ ID NO: 94095 - protein, 18 aa, Mycobacterium avium
ANYRDAPCFSDLDKLILE

SEQ ID NO: 94096 - protein, 18 aa, Mycobacterium avium
APAADWGAALGDVAGMPA

SEQ ID NO: 94097 - protein, 23 aa, Mycobacterium avium
APAAELQAHWAALGVSRLSILDN

SEQ ID NO: 94098 - protein, 18 aa, Mycobacterium avium
APAAFAIPLRESGWLTTG

SEQ ID NO: 94099 - protein, 24 aa, Mycobacterium avium
APAASEEWAGLGVGLLGNAISFDA

SEQ ID NO: 94100 - protein, 23 aa, Mycobacterium avium
APACSSTGRPSCSSGYARWPAST

SEQ ID NO: 94101 - protein, 21 aa, Mycobacterium avium
APADAFGPLGQVFAVDQPSSS

SEQ ID NO: 94102 - protein, 23 aa, Mycobacterium avium
APADPKWAAWFIAELVRSVYHYY

SEQ ID NO: 94103 - protein, 21 aa, Mycobacterium avium
APAGLSAPVLDEFADAPRAPM

SEQ ID NO: 94104 - protein, 20 aa, Mycobacterium avium
APAGPARVATPAYAPAGSPS

SEQ ID NO: 94105 - protein, 21 aa, Mycobacterium avium
APAMRPPPLPVAWVPISTAVA

SEQ ID NO: 94106 - protein, 23 aa, Mycobacterium avium
APANFALHVMRYLHESPATKEHM

SEQ ID NO: 94107 - protein, 24 aa, Mycobacterium avium
APAPERSPASWLRCDVTSVNSVDE

SEQ ID NO: 94108 - protein, 20 aa, Mycobacterium avium
APARARAAVLTAMRAAHPYE

SEQ ID NO: 94109 - protein, 17 aa, Mycobacterium avium
APARGQRVGDWVVDPQW

SEQ ID NO: 94110 - protein, 17 aa, Mycobacterium avium
APATLALDYQRQAKVEN

SEQ ID NO: 94111 - protein, 18 aa, Mycobacterium avium
APAWIGVGTLDLFYPECL

SEQ ID NO: 94112 - protein, 23 aa, Mycobacterium avium
APDGARWVGLWVPPGGHHAEARA

SEQ ID NO: 94113 - protein, 17 aa, Mycobacterium avium
APDMEIIGMLTLLIGGG

SEQ ID NO: 94114 - protein, 20 aa, Mycobacterium avium
APDPPGPHLLVLARGAEGYR

SEQ ID NO: 94115 - protein, 25 aa, Mycobacterium avium
APDRVCATLSRVARALPQVKPGTVA

SEQ ID NO: 94116 - protein, 25 aa, Mycobacterium avium
APDRVCATLSRVARALPQVKPGTVT

SEQ ID NO: 94117 - protein, 17 aa, Mycobacterium avium
APELLFDASARPEQIGQ

SEQ ID NO: 94118 - protein, 17 aa, Mycobacterium avium
APELRKKALEVFPRAKA

SEQ ID NO: 94119 - protein, 18 aa, Mycobacterium avium
APELRKKALEVFPRAKAM

SEQ ID NO: 94120 - protein, 25 aa, Mycobacterium avium
APESAPCWPVTVTVGPDDSAPTVDL

SEQ ID NO: 94121 - protein, 18 aa, Mycobacterium avium
APESVFPAIPGWPEQSMK

SEQ ID NO: 94122 - protein, 23 aa, Mycobacterium avium
APEVPFYSASLFDPREQPLCDAD

SEQ ID NO: 94123 - protein, 23 aa, Mycobacterium avium
APFTLEFGRNGWIADASITLEWS

SEQ ID NO: 94124 - protein, 17 aa, Mycobacterium avium
APFWFAGSLGELEAVGA

SEQ ID NO: 94125 - protein, 17 aa, Mycobacterium avium
APGEIDVGVLGGHRSGR

SEQ ID NO: 94126 - protein, 20 aa, Mycobacterium avium
APGFAAFYRRCRLVTERLWP

SEQ ID NO: 94127 - protein, 20 aa, Mycobacterium avium
APGFAGFYQRCRLVTERLWP

SEQ ID NO: 94128 - protein, 22 aa, Mycobacterium avium
APGHYTLCAAVGWQQHKPGAEH

SEQ ID NO: 94129 - protein, 18 aa, Mycobacterium avium
APGPRRWERCILTCATST

SEQ ID NO: 94130 - protein, 17 aa, Mycobacterium avium
APGRRAGRVHVYVTGVD

SEQ ID NO: 94131 - protein, 20 aa, Mycobacterium avium
APGVIEWPLAGPEIVTRLSR

SEQ ID NO: 94132 - protein, 25 aa, Mycobacterium avium
APGVWALCHSLAFDVSVWEIFGALV

SEQ ID NO: 94133 - protein, 18 aa, Mycobacterium avium
APHALEWDAAEHFPVDVL

SEQ ID NO: 94134 - protein, 23 aa, Mycobacterium avium
APHSKLAIRWALHDRPEDACRKI

SEQ ID NO: 94135 - protein, 19 aa, Mycobacterium avium
APHVSRYVTRDVVVHDQTV

SEQ ID NO: 94136 - protein, 18 aa, Mycobacterium avium
APIPAVGVAPQLTLIAGG

SEQ ID NO: 94137 - protein, 18 aa, Mycobacterium avium
APIWEGEDGVIAWLLSGP

SEQ ID NO: 94138 - protein, 20 aa, Mycobacterium avium
APKHHGISCLILDLHSPGVR

SEQ ID NO: 94139 - protein, 17 aa, Mycobacterium avium
APKHSYSLADYGLSVET

SEQ ID NO: 94140 - protein, 19 aa, Mycobacterium avium
APKRMAGGESFTFHLPAYH

SEQ ID NO: 94141 - protein, 23 aa, Mycobacterium avium
APKRMAGGESFTFHLPAYHRDRV

SEQ ID NO: 94142 - protein, 25 aa, Mycobacterium avium
APLATRYAERLKIVMRVYFEKPRTT

SEQ ID NO: 94143 - protein, 21 aa, Mycobacterium avium
APLDRRLLLGMLSDLPPGAGV

SEQ ID NO: 94144 - protein, 31 aa, Mycobacterium avium
APLFHTRYEPLWALCAELDFTVVQHAGAGSP

SEQ ID NO: 94145 - protein, 28 aa, Mycobacterium avium
APLFHTRYEPLWALCAELDLTVVQHAGA

SEQ ID NO: 94146 - protein, 17 aa, Mycobacterium avium
APLGYLLYRVGAALRPE

SEQ ID NO: 94147 - protein, 18 aa, Mycobacterium avium
APLKAAAHKAVKMVADRL

SEQ ID NO: 94148 - protein, 17 aa, Mycobacterium avium
APLKAAAHKAVKVVADR

SEQ ID NO: 94149 - protein, 18 aa, Mycobacterium avium
APLKAVAHKAVKVVADRL

SEQ ID NO: 94150 - protein, 17 aa, Mycobacterium avium
APLKWCAGVQALGGTVV

SEQ ID NO: 94151 - protein, 18 aa, Mycobacterium avium
APLLAALGAADLALATVN

SEQ ID NO: 94152 - protein, 18 aa, Mycobacterium avium
APLLIRDDIDYMHALVDG

SEQ ID NO: 94153 - protein, 24 aa, Mycobacterium avium
APLPPEVPVPVQLGRPGAAPQPVV

SEQ ID NO: 94154 - protein, 26 aa, Mycobacterium avium
APLRGAAYGHGWATWFPPDGPPRTGR

SEQ ID NO: 94155 - protein, 19 aa, Mycobacterium avium
APLVQRLSEMMDHSDNVLA

SEQ ID NO: 94156 - protein, 19 aa, Mycobacterium avium
APMDAWGAAGTTLLRYEPL

SEQ ID NO: 94157 - protein, 17 aa, Mycobacterium avium
APMGRKPLRFTSFGDQS

SEQ ID NO: 94158 - protein, 17 aa, Mycobacterium avium
APMHAHWTGHGHALDGH

SEQ ID NO: 94159 - protein, 19 aa, Mycobacterium avium
APNLEVLRALMAAHTGSIP

SEQ ID NO: 94160 - protein, 19 aa, Mycobacterium avium
APNQAMKSVHRILRNFKMP

SEQ ID NO: 94161 - protein, 17 aa, Mycobacterium avium
APNRVGINFIPSRLTLD

SEQ ID NO: 94162 - protein, 35 aa, Mycobacterium avium
APPERAVKLWQHWDRCALHWFPGSHVLHISQLDYL

SEQ ID NO: 94163 - protein, 17 aa, Mycobacterium avium
APPFFVLHGQKDELVPS

SEQ ID NO: 94164 - protein, 20 aa, Mycobacterium avium
APPGAPRVALVSGEAIAIAQ

SEQ ID NO: 94165 - protein, 19 aa, Mycobacterium avium
APPHPNYGAGMRVAMMTRE

SEQ ID NO: 94166 - protein, 18 aa, Mycobacterium avium
APPIGTTVHIGFRHLGDV

SEQ ID NO: 94167 - protein, 18 aa, Mycobacterium avium
APPLPTARLRPRPIPERK

SEQ ID NO: 94168 - protein, 20 aa, Mycobacterium avium
APPRPERPALREVRAAREDR

SEQ ID NO: 94169 - protein, 21 aa, Mycobacterium avium
APQTPRPAAPVTDATAILDEW

SEQ ID NO: 94170 - protein, 22 aa, Mycobacterium avium
APRDRLAGLAMQIAKVLMDSPD

SEQ ID NO: 94171 - protein, 20 aa, Mycobacterium avium
APRFSHTPARPVGRPPATST

SEQ ID NO: 94172 - protein, 20 aa, Mycobacterium avium
APRFSHTPARPVGRPPATTT

SEQ ID NO: 94173 - protein, 19 aa, Mycobacterium avium
APRGSAPAQLWLVDTGPGT

SEQ ID NO: 94174 - protein, 24 aa, Mycobacterium avium
APRIDVPIFLAFGAAADVSPNPYA

SEQ ID NO: 94175 - protein, 19 aa, Mycobacterium avium
APRLELMDELGIDQCVMYP

SEQ ID NO: 94176 - protein, 20 aa, Mycobacterium avium
APRWDTVIIGLDCDTTLLDE

SEQ ID NO: 94177 - protein, 24 aa, Mycobacterium avium
APSRLFGANGLRTGPDGRIYIAQV

SEQ ID NO: 94178 - protein, 20 aa, Mycobacterium avium
APTIRRLAARLGADGSARAP

SEQ ID NO: 94179 - protein, 17 aa, Mycobacterium avium
APTKILRKISGLETYVN

SEQ ID NO: 94180 - protein, 21 aa, Mycobacterium avium
APTLHAGRLVARRLRAGGVDT

SEQ ID NO: 94181 - protein, 18 aa, Mycobacterium avium
APTRTSRGIPWCTTTMCG

SEQ ID NO: 94182 - protein, 25 aa, Mycobacterium avium
APTVKRVSLELGGKSAQIYLPDAVH

SEQ ID NO: 94183 - protein, 27 aa, Mycobacterium avium
APTVVAWVFGCAFEPYTRGPVEEQSDT

SEQ ID NO: 94184 - protein, 24 aa, Mycobacterium avium
APVARRLRESFGGGKAAEGAAKAP

SEQ ID NO: 94185 - protein, 18 aa, Mycobacterium avium
APVDADWLLLVELAADHD

SEQ ID NO: 94186 - protein, 19 aa, Mycobacterium avium
APVDADWLLLVELAADHDQ

SEQ ID NO: 94187 - protein, 24 aa, Mycobacterium avium
APVEWHKMGAGWSWTRKAGSDDDH

SEQ ID NO: 94188 - protein, 28 aa, Mycobacterium avium
APVLHLYRCREVCAAVDVARADILLVDE

SEQ ID NO: 94189 - protein, 18 aa, Mycobacterium avium
APVMSFGVMGGMMQPQGH

SEQ ID NO: 94190 - protein, 23 aa, Mycobacterium avium
APVNGYKGWRSPALPEFDPFWRD

SEQ ID NO: 94191 - protein, 18 aa, Mycobacterium avium
APVPFHLLSTVARELGKH

SEQ ID NO: 94192 - protein, 17 aa, Mycobacterium avium
APVPRGDLVAQIVGPPM

SEQ ID NO: 94193 - protein, 19 aa, Mycobacterium avium
APVSVYFGGVHLLAAAGAI

SEQ ID NO: 94194 - protein, 18 aa, Mycobacterium avium
APVVLYFHGGGFVIGDLD

SEQ ID NO: 94195 - protein, 18 aa, Mycobacterium avium
APYEPGYRVLDGIRAALG

SEQ ID NO: 94196 - protein, 19 aa, Mycobacterium avium
APYEPGYRVLDGIRAALGS

SEQ ID NO: 94197 - protein, 20 aa, Mycobacterium avium
APYPARRRHRSGARLLRRHR

SEQ ID NO: 94198 - protein, 23 aa, Mycobacterium avium
APYPDYRDLAGYERDARRAALMG

SEQ ID NO: 94199 - protein, 17 aa, Mycobacterium avium
APYWVGRGFGLNLSVVT

SEQ ID NO: 94200 - protein, 23 aa, Mycobacterium avium
AQAAAFHSQFVQLMNGGALQYAV

SEQ ID NO: 94201 - protein, 18 aa, Mycobacterium avium
AQAGAVWDDVVLTAIEHG

SEQ ID NO: 94202 - protein, 18 aa, Mycobacterium avium
AQALSRRWISAWQLPLEW

SEQ ID NO: 94203 - protein, 20 aa, Mycobacterium avium
AQAQQRFNAAWNHQDGGPNP

SEQ ID NO: 94204 - protein, 21 aa, Mycobacterium avium
AQAQQRFNAAWNHQDGGPNPI

SEQ ID NO: 94205 - protein, 24 aa, Mycobacterium avium
AQAQQRFNAAWNHQDGGPNPINSS

SEQ ID NO: 94206 - protein, 43 aa, Mycobacterium avium
AQARQALTEAVLWPLQHPDTFARLGVRPPRGVLLYGPPGCGKT

SEQ ID NO: 94207 - protein, 18 aa, Mycobacterium avium
AQARRAALLNALFAAATE

SEQ ID NO: 94208 - protein, 18 aa, Mycobacterium avium
AQEALDWGMVSRVVPHDD

SEQ ID NO: 94209 - protein, 18 aa, Mycobacterium avium
AQEKFGFLLEAFTFGAPP

SEQ ID NO: 94210 - protein, 19 aa, Mycobacterium avium
AQFHCEIAVDGQVVVQQDA

SEQ ID NO: 94211 - protein, 18 aa, Mycobacterium avium
AQFKAGNQIDARIVNTVS

SEQ ID NO: 94212 - protein, 18 aa, Mycobacterium avium
AQGARYYGPRGFYETARG

SEQ ID NO: 94213 - protein, 20 aa, Mycobacterium avium
AQGIPPQFLVDILTNLRTDR

SEQ ID NO: 94214 - protein, 24 aa, Mycobacterium avium
AQGRAEMAEFLARYGYRCAGEIEV

SEQ ID NO: 94215 - protein, 26 aa, Mycobacterium avium
AQGVLCGSIVSGLRIRPGNWAGAYAC

SEQ ID NO: 94216 - protein, 24 aa, Mycobacterium avium
AQGVPNWRSAPPVVLAVKDQVRSS

SEQ ID NO: 94217 - protein, 25 aa, Mycobacterium avium
AQHLRRFRENAARGIDMSRLLTAGW

SEQ ID NO: 94218 - protein, 19 aa, Mycobacterium avium
AQHSLAQIGVRLELVARAG

SEQ ID NO: 94219 - protein, 22 aa, Mycobacterium avium
AQILRRVPLAIVPSAQLPNTND

SEQ ID NO: 94220 - protein, 17 aa, Mycobacterium avium
AQIPRPAPVDDHVITRR

SEQ ID NO: 94221 - protein, 17 aa, Mycobacterium avium
AQIRIPLATVNRHGLVA

SEQ ID NO: 94222 - protein, 19 aa, Mycobacterium avium
AQLAFSRRFGPLEVTKVGA

SEQ ID NO: 94223 - protein, 19 aa, Mycobacterium avium
AQLAFSRRFGPLGVTKVGA

SEQ ID NO: 94224 - protein, 19 aa, Mycobacterium avium
AQLAFSRRFGPLRVTKVGA

SEQ ID NO: 94225 - protein, 18 aa, Mycobacterium avium
AQLAPVVFEGTSFGGALM

SEQ ID NO: 94226 - protein, 18 aa, Mycobacterium avium
AQLEASLASALRHNDRPE

SEQ ID NO: 94227 - protein, 23 aa, Mycobacterium avium
AQLEETRVLPAIRDDAAAADASV

SEQ ID NO: 94228 - protein, 18 aa, Mycobacterium avium
AQLRALGGVGEMFDTLLV

SEQ ID NO: 94229 - protein, 17 aa, Mycobacterium avium
AQLRVGMRVQPVFCDYP

SEQ ID NO: 94230 - protein, 20 aa, Mycobacterium avium
AQLRVGMRVQPVFCDYPEHD

SEQ ID NO: 94231 - protein, 18 aa, Mycobacterium avium
AQLRYEITVEQALAAPIV

SEQ ID NO: 94232 - protein, 17 aa, Mycobacterium avium
AQLSAVIVKANTNAISP

SEQ ID NO: 94233 - protein, 17 aa, Mycobacterium avium
AQMKSGAVLVDISIDQG

SEQ ID NO: 94234 - protein, 20 aa, Mycobacterium avium
AQMKSGAVLVDISIDQGGCF

SEQ ID NO: 94235 - protein, 21 aa, Mycobacterium avium
AQPALRRLGLEATVRPSFAFY

SEQ ID NO: 94236 - protein, 18 aa, Mycobacterium avium
AQPDRFGFFATVPMPHVD

SEQ ID NO: 94237 - protein, 17 aa, Mycobacterium avium
AQPDWTPRALEPALART

SEQ ID NO: 94238 - protein, 21 aa, Mycobacterium avium
AQPGTALPWPAPEDTAYIIYT

SEQ ID NO: 94239 - protein, 22 aa, Mycobacterium avium
AQPGTALPWPAPENTAYIIYTS

SEQ ID NO: 94240 - protein, 17 aa, Mycobacterium avium
AQPHLRAGASVIVTGSV

SEQ ID NO: 94241 - protein, 19 aa, Mycobacterium avium
AQPHVAALVLRVPLDATLR

SEQ ID NO: 94242 - protein, 19 aa, Mycobacterium avium
AQPIPRVGHRLDQLGRRAV

SEQ ID NO: 94243 - protein, 24 aa, Mycobacterium avium
AQPRLAELGGRFWFSLDDGRADVS

SEQ ID NO: 94244 - protein, 26 aa, Mycobacterium avium
AQPRLAELGGRFWFSLDDGRADVSGL

SEQ ID NO: 94245 - protein, 25 aa, Mycobacterium avium
AQPRLSELGGRFWFSLDDGRADVSG

SEQ ID NO: 94246 - protein, 22 aa, Mycobacterium avium
AQQAIRRRAFTKALRITGSPDT

SEQ ID NO: 94247 - protein, 19 aa, Mycobacterium avium
AQRAASLGFRALSLPARVE

SEQ ID NO: 94248 - protein, 22 aa, Mycobacterium avium
AQRAPRAPALLVASERNPIAYA

SEQ ID NO: 94249 - protein, 28 aa, Mycobacterium avium
AQRGEPARRLGFCHAVPIDLFDKNGAAA

SEQ ID NO: 94250 - protein, 18 aa, Mycobacterium avium
AQRGIDWRAIYTGRSREY

SEQ ID NO: 94251 - protein, 20 aa, Mycobacterium avium
AQRRRLRQVLHIGGFPMTIL

SEQ ID NO: 94252 - protein, 25 aa, Mycobacterium avium
AQRVAGELVGLVPHLARGLGPGPHV

SEQ ID NO: 94253 - protein, 17 aa, Mycobacterium avium
AQSALDMTCQWAKDRDV

SEQ ID NO: 94254 - protein, 25 aa, Mycobacterium avium
AQSPKESWLRVLLIDAGFPRPQTQI

SEQ ID NO: 94255 - protein, 27 aa, Mycobacterium avium
AQSPKETWLRLLLIRAGLPRPQTQIPV

SEQ ID NO: 94256 - protein, 23 aa, Mycobacterium avium
AQTPSNWLDFVWLGTDGGATELY

SEQ ID NO: 94257 - protein, 19 aa, Mycobacterium avium
AQTRAEPHLARIGCPALVI

SEQ ID NO: 94258 - protein, 17 aa, Mycobacterium avium
AQTRAFRLTERHANITT

SEQ ID NO: 94259 - protein, 20 aa, Mycobacterium avium
AQTWARSALAAGRPAASSAG

SEQ ID NO: 94260 - protein, 29 aa, Mycobacterium avium
AQVERGGLRLGRRSALAVAARQVLGVLPP

SEQ ID NO: 94261 - protein, 28 aa, Mycobacterium avium
AQVERVGLRLGRRSALAVAARQVLGVLP

SEQ ID NO: 94262 - protein, 18 aa, Mycobacterium avium
AQVREWYAGEDGLDLRAL

SEQ ID NO: 94263 - protein, 22 aa, Mycobacterium avium
AQVRISIDVPPDIVMGLLGSAD

SEQ ID NO: 94264 - protein, 23 aa, Mycobacterium avium
AQVTEFDGGVLVNWDVREGVFPA

SEQ ID NO: 94265 - protein, 17 aa, Mycobacterium avium
AQWARIVTFSAHSTQRQ

SEQ ID NO: 94266 - protein, 18 aa, Mycobacterium avium
AQWRFVWSSAAARAAEFA

SEQ ID NO: 94267 - protein, 18 aa, Mycobacterium avium
ARAAARWRELGGTRLRDR

SEQ ID NO: 94268 - protein, 21 aa, Mycobacterium avium
ARAADAAAKFPANEANGSQEM

SEQ ID NO: 94269 - protein, 31 aa, Mycobacterium avium
ARAALGVLRAEPWRSGAVLRHAGVLAEVCRV

SEQ ID NO: 94270 - protein, 31 aa, Mycobacterium avium
ARAALGVLRAEPWRVGAVLRHAGVLAEVCRV

SEQ ID NO: 94271 - protein, 20 aa, Mycobacterium avium
ARAAVELALVDPGRVTGRTI

SEQ ID NO: 94272 - protein, 18 aa, Mycobacterium avium
ARAFLDFAGTHHISVTTP

SEQ ID NO: 94273 - protein, 18 aa, Mycobacterium avium
ARAGRPLRRTWRNRRCGS

SEQ ID NO: 94274 - protein, 18 aa, Mycobacterium avium
ARAGWSRVNPVTGHEEFP

SEQ ID NO: 94275 - protein, 22 aa, Mycobacterium avium
ARAKARGALNMGVGSRSLAARA

SEQ ID NO: 94276 - protein, 19 aa, Mycobacterium avium
ARAKLQRKGCDLLVVNAVG

SEQ ID NO: 94277 - protein, 19 aa, Mycobacterium avium
ARALIARRRELRAAYEQID

SEQ ID NO: 94278 - protein, 20 aa, Mycobacterium avium
ARALTPPALIARVVQALHDG

SEQ ID NO: 94279 - protein, 18 aa, Mycobacterium avium
ARAMLGFMDAELRLDYRD

SEQ ID NO: 94280 - protein, 29 aa, Mycobacterium avium
ARAPRCGLCPLRRCAWREAGHPPATGPAR

SEQ ID NO: 94281 - protein, 28 aa, Mycobacterium avium
ARAPRCGLCPLRRCAWREAGHPPPTGPA

SEQ ID NO: 94282 - protein, 19 aa, Mycobacterium avium
ARAQLERAAARWAANDHAG

SEQ ID NO: 94283 - protein, 25 aa, Mycobacterium avium
ARARARLNPGAGLMLSAVWASETSQ

SEQ ID NO: 94284 - protein, 24 aa, Mycobacterium avium
ARAREVDILVADWVAGKTLSEAMA

SEQ ID NO: 94285 - protein, 21 aa, Mycobacterium avium
ARARLVYAGDLLHPVHPAHQD

SEQ ID NO: 94286 - protein, 25 aa, Mycobacterium avium
ARARSRLNPGAGLMLSAVWASATNE

SEQ ID NO: 94287 - protein, 21 aa, Mycobacterium avium
ARASALYLRRSEHRADQVWTS

SEQ ID NO: 94288 - protein, 18 aa, Mycobacterium avium
ARASRWNRISDYLVTADT

SEQ ID NO: 94289 - protein, 23 aa, Mycobacterium avium
ARAVLSESWRYGGLLSAQTAKVA

SEQ ID NO: 94290 - protein, 17 aa, Mycobacterium avium
ARAYLDARVQTIYGGTT

SEQ ID NO: 94291 - protein, 17 aa, Mycobacterium avium
ARAYLRHELLGPRLREC

SEQ ID NO: 94292 - protein, 21 aa, Mycobacterium avium
ARAYRLAWPDGTVVYELDQPH

SEQ ID NO: 94293 - protein, 21 aa, Mycobacterium avium
ARCAALLVILCDPGRTEVHAA

SEQ ID NO: 94294 - protein, 17 aa, Mycobacterium avium
ARCDVGVLSRIVDCVDQ

SEQ ID NO: 94295 - protein, 17 aa, Mycobacterium avium
ARCRQPPTPPIPHSHTH

SEQ ID NO: 94296 - protein, 25 aa, Mycobacterium avium
ARDAHSAQMSWWRATVLGGDSKDPK

SEQ ID NO: 94297 - protein, 24 aa, Mycobacterium avium
ARDEGWLAEHMLILKLTSPEQQVH

SEQ ID NO: 94298 - protein, 19 aa, Mycobacterium avium
ARDFAPWRGLTPRRDAGPG

SEQ ID NO: 94299 - protein, 25 aa, Mycobacterium avium
ARDHAKPGYIGYAWTAMEPVNAIPA

SEQ ID NO: 94300 - protein, 18 aa, Mycobacterium avium
ARDLGPMLVFLAGSGSGF

SEQ ID NO: 94301 - protein, 24 aa, Mycobacterium avium
ARDRGCTRPNCLEPGYRCEVHHAP

SEQ ID NO: 94302 - protein, 23 aa, Mycobacterium avium
ARDVAVTLCAKAFQSTPVPGVVT

SEQ ID NO: 94303 - protein, 19 aa, Mycobacterium avium
ARDVYQLGNLVLRGGPFAL

SEQ ID NO: 94304 - protein, 17 aa, Mycobacterium avium
AREAGLWSLQTPEEYGG

SEQ ID NO: 94305 - protein, 18 aa, Mycobacterium avium
AREGVCQDFARLAIACLR

SEQ ID NO: 94306 - protein, 21 aa, Mycobacterium avium
AREHGGRLLVRLAGVTDRDAA

SEQ ID NO: 94307 - protein, 23 aa, Mycobacterium avium
AREHGGRLLVRLAGVTDRDAADA

SEQ ID NO: 94308 - protein, 24 aa, Mycobacterium avium
AREHGGRLLVRLAGVTDRDAADAL

SEQ ID NO: 94309 - protein, 20 aa, Mycobacterium avium
ARELSYRELDDWSTRLARKL

SEQ ID NO: 94310 - protein, 25 aa, Mycobacterium avium
ARELSYRELDEWSTRLARKLIQHGV

SEQ ID NO: 94311 - protein, 23 aa, Mycobacterium avium
ARETFELGVWRKAPASHRANVLF

SEQ ID NO: 94312 - protein, 24 aa, Mycobacterium avium
AREVGSVRLVLGWLPAPIDGLDAD

SEQ ID NO: 94313 - protein, 20 aa, Mycobacterium avium
ARFCPELGEPVQIIPAEPEM

SEQ ID NO: 94314 - protein, 24 aa, Mycobacterium avium
ARFEFPGDLGSGLVPVPATRPLVA

SEQ ID NO: 94315 - protein, 21 aa, Mycobacterium avium
ARFGKLPFERLFAPAIAYGRN

SEQ ID NO: 94316 - protein, 17 aa, Mycobacterium avium
ARFNGTVLVEWLNVSGG

SEQ ID NO: 94317 - protein, 21 aa, Mycobacterium avium
ARFRAAGWWCDSTLSDAVRRN

SEQ ID NO: 94318 - protein, 20 aa, Mycobacterium avium
ARFSGGVFACAALVEHELTG

SEQ ID NO: 94319 - protein, 19 aa, Mycobacterium avium
ARFSGGVFACAARTEHRLT

SEQ ID NO: 94320 - protein, 22 aa, Mycobacterium avium
ARGAHALACDYAKIREQYGNPI

SEQ ID NO: 94321 - protein, 19 aa, Mycobacterium avium
ARGETQWLPPPHLDRNQPR

SEQ ID NO: 94322 - protein, 26 aa, Mycobacterium avium
ARGFGIRTPRHWAVLPAGNGDWAVID

SEQ ID NO: 94323 - protein, 18 aa, Mycobacterium avium
ARGGGVVHPGLRRDGRPV

SEQ ID NO: 94324 - protein, 23 aa, Mycobacterium avium
ARGKLLHRLGEIIAREADQLAEL

SEQ ID NO: 94325 - protein, 22 aa, Mycobacterium avium
ARGRAQILLMIGIGADDRIHTI

SEQ ID NO: 94326 - protein, 18 aa, Mycobacterium avium
ARGRFKLSATGREHLEAE

SEQ ID NO: 94327 - protein, 25 aa, Mycobacterium avium
ARHADLHAILTWSRFRNHDFLARLR

SEQ ID NO: 94328 - protein, 23 aa, Mycobacterium avium
ARHDGALRLLQRQNFTRYAHAIE

SEQ ID NO: 94329 - protein, 22 aa, Mycobacterium avium
ARHELIAEAFGGKGYHVSTAAE

SEQ ID NO: 94330 - protein, 18 aa, Mycobacterium avium
ARHGCPVMVPKARSASHL

SEQ ID NO: 94331 - protein, 23 aa, Mycobacterium avium
ARHVSAVLGRRVGPSTGTNVWGA

SEQ ID NO: 94332 - protein, 24 aa, Mycobacterium avium
ARIGAPRYVKIVDMTEADDAPLGY

SEQ ID NO: 94333 - protein, 24 aa, Mycobacterium avium
ARIGARVRADLGWPVDLSHPELEL

SEQ ID NO: 94334 - protein, 26 aa, Mycobacterium avium
ARIGARVRADLGWRVDLSHPELELTV

SEQ ID NO: 94335 - protein, 27 aa, Mycobacterium avium
ARIGARVRADLGWRVGLSHPELELTVE

SEQ ID NO: 94336 - protein, 20 aa, Mycobacterium avium
ARKHPHSMGEWSMASRTHVA

SEQ ID NO: 94337 - protein, 21 aa, Mycobacterium avium
ARKPTAAAWIVNRLALRHKDA

SEQ ID NO: 94338 - protein, 19 aa, Mycobacterium avium
ARKRVLTMRRTFRKHRRQL

SEQ ID NO: 94339 - protein, 25 aa, Mycobacterium avium
ARKSALPDFPITVYYAFKQSEMTDS

SEQ ID NO: 94340 - protein, 26 aa, Mycobacterium avium
ARKVLPRKPAHLVIRMYSALTEAVFF

SEQ ID NO: 94341 - protein, 20 aa, Mycobacterium avium
ARLACVHAMGGFFTHSATMI

SEQ ID NO: 94342 - protein, 20 aa, Mycobacterium avium
ARLADCAVAQSFPVAGVAST

SEQ ID NO: 94343 - protein, 17 aa, Mycobacterium avium
ARLAELGLTLPEVVAPL

SEQ ID NO: 94344 - protein, 23 aa, Mycobacterium avium
ARLAERLPAYMVPVAVVVLDALP

SEQ ID NO: 94345 - protein, 20 aa, Mycobacterium avium
ARLALLLDMVREHFALAPDA

SEQ ID NO: 94346 - protein, 17 aa, Mycobacterium avium
ARLARGGVPVYERAVLI

SEQ ID NO: 94347 - protein, 18 aa, Mycobacterium avium
ARLARGGVPVYERAVLIH

SEQ ID NO: 94348 - protein, 18 aa, Mycobacterium avium
ARLARGGVPVYERAVLIR

SEQ ID NO: 94349 - protein, 26 aa, Mycobacterium avium
ARLAVEAMTALVARHVDLAAVAAVAA

SEQ ID NO: 94350 - protein, 18 aa, Mycobacterium avium
ARLDWQLRHYPPRTEDVR

SEQ ID NO: 94351 - protein, 19 aa, Mycobacterium avium
ARLFLPAAGVCNWLVDTGI

SEQ ID NO: 94352 - protein, 19 aa, Mycobacterium avium
ARLGPPLQVVVTAVRSLLQ

SEQ ID NO: 94353 - protein, 21 aa, Mycobacterium avium
ARLGRIGDCEIALDNALTAAR

SEQ ID NO: 94354 - protein, 33 aa, Mycobacterium avium
ARLGRPLRIAHAWSFAFDAAWQPLVALLDGHGV

SEQ ID NO: 94355 - protein, 21 aa, Mycobacterium avium
ARLHDEFDAWAKAYASPFDDL

SEQ ID NO: 94356 - protein, 17 aa, Mycobacterium avium
ARLIWRVQGLKITITGV

SEQ ID NO: 94357 - protein, 19 aa, Mycobacterium avium
ARLKLADVMAEARERIGEE

SEQ ID NO: 94358 - protein, 21 aa, Mycobacterium avium
ARLNAGTVWVNAYRVVSPHVP

SEQ ID NO: 94359 - protein, 23 aa, Mycobacterium avium
ARLQELKGLVHADDWTRDRPGLG

SEQ ID NO: 94360 - protein, 18 aa, Mycobacterium avium
ARLQEVWMGRQIAEVKSK

SEQ ID NO: 94361 - protein, 18 aa, Mycobacterium avium
ARLQFVLADSAPVAAVTT

SEQ ID NO: 94362 - protein, 18 aa, Mycobacterium avium
ARLQGWEEFDEPVDQIIS

SEQ ID NO: 94363 - protein, 20 aa, Mycobacterium avium
ARLRADRGLIGPFIEEALRM

SEQ ID NO: 94364 - protein, 17 aa, Mycobacterium avium
ARLRLSPLRPDERRTAV

SEQ ID NO: 94365 - protein, 20 aa, Mycobacterium avium
ARLRSALPRGGADVETVLPK

SEQ ID NO: 94366 - protein, 19 aa, Mycobacterium avium
ARLTILEVMAEAIDEPDEM

SEQ ID NO: 94367 - protein, 18 aa, Mycobacterium avium
ARLTSPLRRRPDGSYEEI

SEQ ID NO: 94368 - protein, 17 aa, Mycobacterium avium
ARLVLDCTSIRELAEAI

SEQ ID NO: 94369 - protein, 21 aa, Mycobacterium avium
ARLWRDARVQRLYAGTTEIMK

SEQ ID NO: 94370 - protein, 20 aa, Mycobacterium avium
ARLWRDSRVQRLYAGTTEIM

SEQ ID NO: 94371 - protein, 30 aa, Mycobacterium avium
ARLYHDLMFGKGLACVRGFPVEQHSIEDLE

SEQ ID NO: 94372 - protein, 17 aa, Mycobacterium avium
ARMASGGTRLVHSREMK

SEQ ID NO: 94373 - protein, 18 aa, Mycobacterium avium
ARMASGGTRLVHSREMKV

SEQ ID NO: 94374 - protein, 18 aa, Mycobacterium avium
ARMASWLVGAVLIGRDRR

SEQ ID NO: 94375 - protein, 23 aa, Mycobacterium avium
ARMDLTFSLAERWTEDDEPAGIG

SEQ ID NO: 94376 - protein, 25 aa, Mycobacterium avium
ARMDLTFSLCERWTEEGRPAGIAGT

SEQ ID NO: 94377 - protein, 17 aa, Mycobacterium avium
ARMLIRGPGRYPFDPVV

SEQ ID NO: 94378 - protein, 24 aa, Mycobacterium avium
ARMPAFGVEGPWRDRVGFAPTMEQ

SEQ ID NO: 94379 - protein, 24 aa, Mycobacterium avium
ARMPAFGVEGPWRNRVGFAPTMEQ

SEQ ID NO: 94380 - protein, 30 aa, Mycobacterium avium
ARMYRTGDLVRWRGDGQLDYLGRVDEQVKI

SEQ ID NO: 94381 - protein, 23 aa, Mycobacterium avium
ARPDALRLLDRVGLGNRTEHRPA

SEQ ID NO: 94382 - protein, 25 aa, Mycobacterium avium
ARPDKLAELLALWDRYVEETGVILD

SEQ ID NO: 94383 - protein, 20 aa, Mycobacterium avium
ARPDTLLGWLQSDIAANAVR

SEQ ID NO: 94384 - protein, 21 aa, Mycobacterium avium
ARPGWPVSGPRSAGCSRSAAG

SEQ ID NO: 94385 - protein, 19 aa, Mycobacterium avium
ARPLTDWLTAVADGIALLT

SEQ ID NO: 94386 - protein, 25 aa, Mycobacterium avium
ARPQPARDADRAWWAQRLPELPDPP

SEQ ID NO: 94387 - protein, 24 aa, Mycobacterium avium
ARQGLPLVCVVGVDHQWGLEVGVY

SEQ ID NO: 94388 - protein, 19 aa, Mycobacterium avium
ARQQRLRIDATWRWASAIA

SEQ ID NO: 94389 - protein, 21 aa, Mycobacterium avium
ARQVFRSWYILYFQLPWLPER

SEQ ID NO: 94390 - protein, 17 aa, Mycobacterium avium
ARRAAERECEQLLGDAK

SEQ ID NO: 94391 - protein, 25 aa, Mycobacterium avium
ARRAARFRLPLSLADHLPDIADYYR

SEQ ID NO: 94392 - protein, 25 aa, Mycobacterium avium
ARRAARFRLPLSLADHLPEIADYYR

SEQ ID NO: 94393 - protein, 21 aa, Mycobacterium avium
ARRAHEFGVGQVWLAQQQSYD

SEQ ID NO: 94394 - protein, 23 aa, Mycobacterium avium
ARRALELTKAYALERTAFGQPIG

SEQ ID NO: 94395 - protein, 21 aa, Mycobacterium avium
ARRARDVWWVDVLLSQLEGKL

SEQ ID NO: 94396 - protein, 18 aa, Mycobacterium avium
ARRDLLALQQEWRRAADV

SEQ ID NO: 94397 - protein, 26 aa, Mycobacterium avium
ARREEYRRIEVPTVFTGMPVPIDPGG

SEQ ID NO: 94398 - protein, 18 aa, Mycobacterium avium
ARRELLALQQEWRRAADV

SEQ ID NO: 94399 - protein, 25 aa, Mycobacterium avium
ARRHLPGLYERWWAVTPGAVTRDKA

SEQ ID NO: 94400 - protein, 28 aa, Mycobacterium avium
ARRRAFRLWLDERRAALVRLAPGYEHPG

SEQ ID NO: 94401 - protein, 21 aa, Mycobacterium avium
ARRRFRRLPAVEVPDAVRRGA

SEQ ID NO: 94402 - protein, 17 aa, Mycobacterium avium
ARRSFSRRRASGQTRHH

SEQ ID NO: 94403 - protein, 18 aa, Mycobacterium avium
ARSASHLAQISRRLPTGT

SEQ ID NO: 94404 - protein, 19 aa, Mycobacterium avium
ARSGAPWRFGTDDPGGLCE

SEQ ID NO: 94405 - protein, 18 aa, Mycobacterium avium
ARSINVFHASGWGYHTPS

SEQ ID NO: 94406 - protein, 31 aa, Mycobacterium avium
ARSMTKLWARMWLLRFTWQRAIDSGDTSSAA

SEQ ID NO: 94407 - protein, 20 aa, Mycobacterium avium
ARSPAARRRIVRPLPRRPPP

SEQ ID NO: 94408 - protein, 26 aa, Mycobacterium avium
ARSREIPMAALAGMRRGQALPHGLRG

SEQ ID NO: 94409 - protein, 27 aa, Mycobacterium avium
ARSREIPMAALASMRRGQALPHGLRGF

SEQ ID NO: 94410 - protein, 26 aa, Mycobacterium avium
ARSSGLPRGFLLHRCRQTQHCDVSHR

SEQ ID NO: 94411 - protein, 17 aa, Mycobacterium avium
ARSSLPMNRVNAHHVSL

SEQ ID NO: 94412 - protein, 30 aa, Mycobacterium avium
ARSVAEVGIGFCFAPLFHPSYRHTSAVRRE

SEQ ID NO: 94413 - protein, 18 aa, Mycobacterium avium
ARSVAKRDDLRWHDLRHS

SEQ ID NO: 94414 - protein, 23 aa, Mycobacterium avium
ARTDARGPLGLDAAIERANRYAR

SEQ ID NO: 94415 - protein, 17 aa, Mycobacterium avium
ARTGADVVRLVAGDPLT

SEQ ID NO: 94416 - protein, 19 aa, Mycobacterium avium
ARTGDMLVDVLHRLNGVPV

SEQ ID NO: 94417 - protein, 18 aa, Mycobacterium avium
ARTGYRLAKQFGVRLPPR

SEQ ID NO: 94418 - protein, 19 aa, Mycobacterium avium
ARTGYRLAKQFGVRLPPRR

SEQ ID NO: 94419 - protein, 19 aa, Mycobacterium avium
ARTTAPFSALRAAYEKAYD

SEQ ID NO: 94420 - protein, 20 aa, Mycobacterium avium
ARTTFPVWTMNAIGDVTFHH

SEQ ID NO: 94421 - protein, 33 aa, Mycobacterium avium
ARTVTCPNPACGIAMPLVRSWWLGKKKGKEAYV

SEQ ID NO: 94422 - protein, 18 aa, Mycobacterium avium
ARVAAPYRVIQFAVNPFK

SEQ ID NO: 94423 - protein, 19 aa, Mycobacterium avium
ARVAVSVSQARYGVTAASI

SEQ ID NO: 94424 - protein, 23 aa, Mycobacterium avium
ARVFPEPDRLYLHRSGADRNVAF

SEQ ID NO: 94425 - protein, 25 aa, Mycobacterium avium
ARVLPLPVAMRLILMGKHEKLNAQR

SEQ ID NO: 94426 - protein, 22 aa, Mycobacterium avium
ARVLQALLARWDHHPRVDLVTT

SEQ ID NO: 94427 - protein, 25 aa, Mycobacterium avium
ARVLSRYVEAIVWRTFEQHRLEAMA

SEQ ID NO: 94428 - protein, 24 aa, Mycobacterium avium
ARVLSRYVEAIVWRTFEQQRLEAM

SEQ ID NO: 94429 - protein, 25 aa, Mycobacterium avium
ARVLSRYVEAIVWRTFEQQRLEAMA

SEQ ID NO: 94430 - protein, 19 aa, Mycobacterium avium
ARVPSRHLVALPATGRDAD

SEQ ID NO: 94431 - protein, 19 aa, Mycobacterium avium
ARVSILGWVHTPLGTLSLP

SEQ ID NO: 94432 - protein, 17 aa, Mycobacterium avium
ARVTLRGDRMWEFLDRL

SEQ ID NO: 94433 - protein, 18 aa, Mycobacterium avium
ARWPRWRPMFALSRMPCG

SEQ ID NO: 94434 - protein, 18 aa, Mycobacterium avium
ARWRPWRSYATQYLWTTL

SEQ ID NO: 94435 - protein, 19 aa, Mycobacterium avium
ARYDYLVNMCDEIGVITPE

SEQ ID NO: 94436 - protein, 27 aa, Mycobacterium avium
ARYILELEPFASLPPEQIAATIAPNLQ

SEQ ID NO: 94437 - protein, 18 aa, Mycobacterium avium
ARYPAPVLARSVMDELAA

SEQ ID NO: 94438 - protein, 23 aa, Mycobacterium avium
ARYTFDLATEIPLRAWLFRRNHD

SEQ ID NO: 94439 - protein, 25 aa, Mycobacterium avium
ASADEAWEAPGPPALPEAQRAVREA

SEQ ID NO: 94440 - protein, 18 aa, Mycobacterium avium
ASAEGRIGVRARRGVILG

SEQ ID NO: 94441 - protein, 20 aa, Mycobacterium avium
ASAGRRGRRLTINAERGELT

SEQ ID NO: 94442 - protein, 18 aa, Mycobacterium avium
ASAIDRAALPYVVGTIAG

SEQ ID NO: 94443 - protein, 18 aa, Mycobacterium avium
ASANDCRLSGLLISTDPP

SEQ ID NO: 94444 - protein, 24 aa, Mycobacterium avium
ASAQRGLSEAVVRDISAKKNEPEW

SEQ ID NO: 94445 - protein, 23 aa, Mycobacterium avium
ASARPEQIGQLSFVDLVPEHEHD

SEQ ID NO: 94446 - protein, 20 aa, Mycobacterium avium
ASARTAHYCYTRVTSTTATG

SEQ ID NO: 94447 - protein, 17 aa, Mycobacterium avium
ASAWTHVFEQLFTDVDG

SEQ ID NO: 94448 - protein, 17 aa, Mycobacterium avium
ASAWTHVFEQLFTNVDG

SEQ ID NO: 94449 - protein, 22 aa, Mycobacterium avium
ASAYRCGESWSTLVRHRPTGRR

SEQ ID NO: 94450 - protein, 24 aa, Mycobacterium avium
ASCAVPGAWPPVAIGGRRYMDGGV

SEQ ID NO: 94451 - protein, 18 aa, Mycobacterium avium
ASCLPKDVRALLYTADCL

SEQ ID NO: 94452 - protein, 18 aa, Mycobacterium avium
ASDEARYVTGLQMRVDAG

SEQ ID NO: 94453 - protein, 19 aa, Mycobacterium avium
ASDESRYVTGLQFKVDAGA

SEQ ID NO: 94454 - protein, 18 aa, Mycobacterium avium
ASDLGGFFVKPTVLTGVD

SEQ ID NO: 94455 - protein, 17 aa, Mycobacterium avium
ASDLSLAVMRLARQLRF

SEQ ID NO: 94456 - protein, 23 aa, Mycobacterium avium
ASDRGAGPIGFAGTTGATGSAPV

SEQ ID NO: 94457 - protein, 24 aa, Mycobacterium avium
ASEALRLGLDIMLIGVWNAFQVAI

SEQ ID NO: 94458 - protein, 23 aa, Mycobacterium avium
ASEALRLGLDIMLIGVWNTFQVA

SEQ ID NO: 94459 - protein, 19 aa, Mycobacterium avium
ASERPRGVFSRELVLGDNL

SEQ ID NO: 94460 - protein, 18 aa, Mycobacterium avium
ASFDRPAPPDAPAPDAPP

SEQ ID NO: 94461 - protein, 17 aa, Mycobacterium avium
ASFQPLLARMVDAAPRL

SEQ ID NO: 94462 - protein, 25 aa, Mycobacterium avium
ASFVDDFVLYWGFLALAPVRSGRHL

SEQ ID NO: 94463 - protein, 24 aa, Mycobacterium avium
ASFVDDFVLYWGFLALAQVRSGRH

SEQ ID NO: 94464 - protein, 18 aa, Mycobacterium avium
ASGAAHLLAEWTCGNGDS

SEQ ID NO: 94465 - protein, 19 aa, Mycobacterium avium
ASGFGRKAQWFRNIRANPR

SEQ ID NO: 94466 - protein, 23 aa, Mycobacterium avium
ASGGRLRLGLGVGSRCDDYTAVG

SEQ ID NO: 94467 - protein, 25 aa, Mycobacterium avium
ASGLPVPEWFPMLGGHEGSGVVEAV

SEQ ID NO: 94468 - protein, 19 aa, Mycobacterium avium
ASGRVRRPGWVETSGGHIA

SEQ ID NO: 94469 - protein, 18 aa, Mycobacterium avium
ASHFARRGEGLDDLVQVA

SEQ ID NO: 94470 - protein, 17 aa, Mycobacterium avium
ASHVLRTALPHLTDSAT

SEQ ID NO: 94471 - protein, 18 aa, Mycobacterium avium
ASHYGGSGARGFSPVPTL

SEQ ID NO: 94472 - protein, 17 aa, Mycobacterium avium
ASIANWGSKALQFINAD

SEQ ID NO: 94473 - protein, 24 aa, Mycobacterium avium
ASKAGLPVDEFLATVQRFNGFART

SEQ ID NO: 94474 - protein, 30 aa, Mycobacterium avium
ASKELRMIGWRVGWIVGPRAIMADIALVGL

SEQ ID NO: 94475 - protein, 19 aa, Mycobacterium avium
ASKVARTTLYRHFNSSSQL

SEQ ID NO: 94476 - protein, 23 aa, Mycobacterium avium
ASKWIPFGPVMLSRAHWLEDVGL

SEQ ID NO: 94477 - protein, 23 aa, Mycobacterium avium
ASLEPLANMGVIYWVYPNLILAN

SEQ ID NO: 94478 - protein, 21 aa, Mycobacterium avium
ASLHGLAGWVDVKPAVVATAI

SEQ ID NO: 94479 - protein, 18 aa, Mycobacterium avium
ASLKDGRATLALPSGLRW

SEQ ID NO: 94480 - protein, 18 aa, Mycobacterium avium
ASLLALLVSKGVAKFKAP

SEQ ID NO: 94481 - protein, 28 aa, Mycobacterium avium
ASLNADGWNRYGWPEAAGGLGGNEIHRA

SEQ ID NO: 94482 - protein, 18 aa, Mycobacterium avium
ASLREFLVGAAPVAEEIG

SEQ ID NO: 94483 - protein, 23 aa, Mycobacterium avium
ASLRIVLAHELFHYASRADTVAD

SEQ ID NO: 94484 - protein, 22 aa, Mycobacterium avium
ASLRVNFLRPFFAGGTSSYVAT

SEQ ID NO: 94485 - protein, 26 aa, Mycobacterium avium
ASLSMAGAVMPYVSWLTAVAEQCGRA

SEQ ID NO: 94486 - protein, 18 aa, Mycobacterium avium
ASLSWRAQTDTARGGQAE

SEQ ID NO: 94487 - protein, 24 aa, Mycobacterium avium
ASLTKCLATAVAVMQLYEQGKVAF

SEQ ID NO: 94488 - protein, 17 aa, Mycobacterium avium
ASLVSCGVTTGFGSGSV

SEQ ID NO: 94489 - protein, 17 aa, Mycobacterium avium
ASMARLVDEATLARIDA

SEQ ID NO: 94490 - protein, 17 aa, Mycobacterium avium
ASMDPGYDFTTFPEVVK

SEQ ID NO: 94491 - protein, 24 aa, Mycobacterium avium
ASMPAMIRLGGKMYGADGRTKDTK

SEQ ID NO: 94492 - protein, 19 aa, Mycobacterium avium
ASNPLIGYVNYGELVSDTD

SEQ ID NO: 94493 - protein, 23 aa, Mycobacterium avium
ASPESVSFLRQFLASPPGQRQQM

SEQ ID NO: 94494 - protein, 27 aa, Mycobacterium avium
ASPGYPCYRNILSALGCEVVEIPCGPQ

SEQ ID NO: 94495 - protein, 30 aa, Mycobacterium avium
ASPPDMRLPISLALGWPHRVPGAAACCDFS

SEQ ID NO: 94496 - protein, 36 aa, Mycobacterium avium
ASPPDMRLPISLALGWPHRVPGAAACCDFSTASSWE

SEQ ID NO: 94497 - protein, 25 aa, Mycobacterium avium
ASPSQSQWGWAWPADRRVLYNRASA

SEQ ID NO: 94498 - protein, 18 aa, Mycobacterium avium
ASQVCERRDSALLLMGFA

SEQ ID NO: 94499 - protein, 46 aa, Mycobacterium avium
ASRARLWKFGMTGARCRACGFMHLPPVRVCRSCNAIDEMDPQSAAG

SEQ ID NO: 94500 - protein, 23 aa, Mycobacterium avium
ASRPCHQTRLLSIGTHDTSPDHR

SEQ ID NO: 94501 - protein, 18 aa, Mycobacterium avium
ASSAREWWAPLRANHRVF

SEQ ID NO: 94502 - protein, 31 aa, Mycobacterium avium
ASSLDQGGPCARTVLDTALLHQVIAGHDIRD

SEQ ID NO: 94503 - protein, 20 aa, Mycobacterium avium
ASSLGGMSVPQGWSTAAPEL

SEQ ID NO: 94504 - protein, 23 aa, Mycobacterium avium
ASSLRLPTLLVRGGESDVLSVDD

SEQ ID NO: 94505 - protein, 17 aa, Mycobacterium avium
ASTEWKQAVTAAHRALA

SEQ ID NO: 94506 - protein, 31 aa, Mycobacterium avium
ASTLGGYQAWQLGGTYQRGGKTRVIAQKTVV

SEQ ID NO: 94507 - protein, 17 aa, Mycobacterium avium
ASVAGRALAGAGVRTVG

SEQ ID NO: 94508 - protein, 18 aa, Mycobacterium avium
ASVISELVVESWQGSSSG

SEQ ID NO: 94509 - protein, 23 aa, Mycobacterium avium
ASVLRLFGLRANEADKICRRPLP

SEQ ID NO: 94510 - protein, 17 aa, Mycobacterium avium
ASVMGFVVRGGRIRAID

SEQ ID NO: 94511 - protein, 18 aa, Mycobacterium avium
ASVMGFVVRGGRIRAIDV

SEQ ID NO: 94512 - protein, 18 aa, Mycobacterium avium
ASVWRSLIQQHYPDSGWV

SEQ ID NO: 94513 - protein, 17 aa, Mycobacterium avium
ASVYYAIALPILRTPWR

SEQ ID NO: 94514 - protein, 20 aa, Mycobacterium avium
ASWIDRLGTVWVEGQLAQVS

SEQ ID NO: 94515 - protein, 21 aa, Mycobacterium avium
ASWTSCRNGDGGLLPYTYRVS

SEQ ID NO: 94516 - protein, 21 aa, Mycobacterium avium
ASYLHSWRAGDVVMWDNRATM

SEQ ID NO: 94517 - protein, 19 aa, Mycobacterium avium
ATAAKREYEASVSRAQAEA

SEQ ID NO: 94518 - protein, 18 aa, Mycobacterium avium
ATAHELYHPMPLRGKALD

SEQ ID NO: 94519 - protein, 19 aa, Mycobacterium avium
ATAHELYHPMPLRGKALDR

SEQ ID NO: 94520 - protein, 20 aa, Mycobacterium avium
ATAHELYHPMPLRGKALDRY

SEQ ID NO: 94521 - protein, 17 aa, Mycobacterium avium
ATARRLAAAGATVLVVA

SEQ ID NO: 94522 - protein, 19 aa, Mycobacterium avium
ATASMLEPIWQVMPPSKAE

SEQ ID NO: 94523 - protein, 24 aa, Mycobacterium avium
ATAYCAHCACAIHTLTNLQLDPNR

SEQ ID NO: 94524 - protein, 19 aa, Mycobacterium avium
ATAYGQWQGGWVDFDGTSL

SEQ ID NO: 94525 - protein, 17 aa, Mycobacterium avium
ATCDVFLTSYLPTRRKK

SEQ ID NO: 94526 - protein, 27 aa, Mycobacterium avium
ATDDLDFLRLAVLDALLVLQADVQPVP

SEQ ID NO: 94527 - protein, 18 aa, Mycobacterium avium
ATDDQWHRLCRALGSPSW

SEQ ID NO: 94528 - protein, 19 aa, Mycobacterium avium
ATDGLRGSLDLMPGSLEKM

SEQ ID NO: 94529 - protein, 17 aa, Mycobacterium avium
ATDLETIAAVLAESQRT

SEQ ID NO: 94530 - protein, 22 aa, Mycobacterium avium
ATDRRAAAAVLDRLGIGALADR

SEQ ID NO: 94531 - protein, 35 aa, Mycobacterium avium
ATDVVIARGLSQRGVPFSWAGGGINGPTRGTGTGA

SEQ ID NO: 94532 - protein, 17 aa, Mycobacterium avium
ATEAAIWSNEFVVDDVD

SEQ ID NO: 94533 - protein, 18 aa, Mycobacterium avium
ATEAFTLGLVNRVVSAAD

SEQ ID NO: 94534 - protein, 20 aa, Mycobacterium avium
ATEALNLVSYVVGDNRFEGA

SEQ ID NO: 94535 - protein, 17 aa, Mycobacterium avium
ATEAVARLTRRGVAGAE

SEQ ID NO: 94536 - protein, 19 aa, Mycobacterium avium
ATERPRGVFSRQLVLGDNL

SEQ ID NO: 94537 - protein, 28 aa, Mycobacterium avium
ATFGDPIGRHAFGQSFLTAMFGVGSVVP

SEQ ID NO: 94538 - protein, 24 aa, Mycobacterium avium
ATFNGLLALAWRPGGLQESPETID

SEQ ID NO: 94539 - protein, 17 aa, Mycobacterium avium
ATFRPSALQTLSHFPIA

SEQ ID NO: 94540 - protein, 24 aa, Mycobacterium avium
ATGARSLGALVAWKTGCSPGNAET

SEQ ID NO: 94541 - protein, 22 aa, Mycobacterium avium
ATGCAIGWAVGRGHSFSVRPSP

SEQ ID NO: 94542 - protein, 18 aa, Mycobacterium avium
ATGCARTAVQVHGALGQT

SEQ ID NO: 94543 - protein, 17 aa, Mycobacterium avium
ATGCARVNLGTAALENP

SEQ ID NO: 94544 - protein, 17 aa, Mycobacterium avium
ATGDAHFNEVFLTDVFV

SEQ ID NO: 94545 - protein, 22 aa, Mycobacterium avium
ATGFLGRYLVLQWLERLELADG

SEQ ID NO: 94546 - protein, 24 aa, Mycobacterium avium
ATGPDWFACAGVRVADERLRGRAG

SEQ ID NO: 94547 - protein, 17 aa, Mycobacterium avium
ATGRARLWVPARAPLAA

SEQ ID NO: 94548 - protein, 18 aa, Mycobacterium avium
ATGRPRPAVKAAQLRTPR

SEQ ID NO: 94549 - protein, 23 aa, Mycobacterium avium
ATGRRVSFGVIDIIRIVDGKYVE

SEQ ID NO: 94550 - protein, 19 aa, Mycobacterium avium
ATGSEAFRNACYAVAAGAY

SEQ ID NO: 94551 - protein, 17 aa, Mycobacterium avium
ATGVFAGLIVQGYGMLA

SEQ ID NO: 94552 - protein, 34 aa, Mycobacterium avium
ATHARLGGPGSWLLALPAHHIAGVQVLVRSLLAG

SEQ ID NO: 94553 - protein, 20 aa, Mycobacterium avium
ATIDKAHWFYALSPQDRRNY

SEQ ID NO: 94554 - protein, 28 aa, Mycobacterium avium
ATIQEVRNALGLRCRWYVSAMETAGQIG

SEQ ID NO: 94555 - protein, 25 aa, Mycobacterium avium
ATIRNPLADAWDFLTRTPLANTPTN

SEQ ID NO: 94556 - protein, 19 aa, Mycobacterium avium
ATIRRAVTVGDGWTAGALR

SEQ ID NO: 94557 - protein, 18 aa, Mycobacterium avium
ATISGYGQDGPWRDRKAY

SEQ ID NO: 94558 - protein, 25 aa, Mycobacterium avium
ATKARRVDDGWVVSGQKVWTSDAVN

SEQ ID NO: 94559 - protein, 19 aa, Mycobacterium avium
ATKRLGMTVTLAERERVFS

SEQ ID NO: 94560 - protein, 17 aa, Mycobacterium avium
ATLARTGGTLVLHLAAA

SEQ ID NO: 94561 - protein, 18 aa, Mycobacterium avium
ATLARTGGTLVLQLAAAQ

SEQ ID NO: 94562 - protein, 20 aa, Mycobacterium avium
ATLASRWRRIHGGPGELLDL

SEQ ID NO: 94563 - protein, 17 aa, Mycobacterium avium
ATLEAVLAKLAAPGMCN

SEQ ID NO: 94564 - protein, 21 aa, Mycobacterium avium
ATLFRAGEHLRLVVAGRWLCP

SEQ ID NO: 94565 - protein, 25 aa, Mycobacterium avium
ATLHHRASALIGRLMRELTTDWDYA

SEQ ID NO: 94566 - protein, 20 aa, Mycobacterium avium
ATLLARHPAVRAVRYPGLAE

SEQ ID NO: 94567 - protein, 17 aa, Mycobacterium avium
ATLLPLRIIDDMLGVPR

SEQ ID NO: 94568 - protein, 20 aa, Mycobacterium avium
ATLPVLRPLLGFDKQEILAE

SEQ ID NO: 94569 - protein, 18 aa, Mycobacterium avium
ATLRELRDTSAVGSATDE

SEQ ID NO: 94570 - protein, 18 aa, Mycobacterium avium
ATMHPSRYLTLIEDVTAV

SEQ ID NO: 94571 - protein, 18 aa, Mycobacterium avium
ATMHPSRYLTLIEGVSAV

SEQ ID NO: 94572 - protein, 18 aa, Mycobacterium avium
ATMHPSRYLTLIEGVTAV

SEQ ID NO: 94573 - protein, 18 aa, Mycobacterium avium
ATMLALLGKRGMRRILTE

SEQ ID NO: 94574 - protein, 20 aa, Mycobacterium avium
ATMPDPIITLARTFMNQPTH

SEQ ID NO: 94575 - protein, 24 aa, Mycobacterium avium
ATMPPELACSAIAGWASGQIGPGS

SEQ ID NO: 94576 - protein, 23 aa, Mycobacterium avium
ATMRALTARSWRAGLRQRAAARA

SEQ ID NO: 94577 - protein, 18 aa, Mycobacterium avium
ATMRFEFNSLPFTLGMKE

SEQ ID NO: 94578 - protein, 20 aa, Mycobacterium avium
ATNGLASLPLPAPGLGSGGY

SEQ ID NO: 94579 - protein, 19 aa, Mycobacterium avium
ATNVTKLPGLGSWRRPQAE

SEQ ID NO: 94580 - protein, 17 aa, Mycobacterium avium
ATPAWDALRKHHDRIGD

SEQ ID NO: 94581 - protein, 23 aa, Mycobacterium avium
ATPFSAVAVRPLLRGSALGVTGM

SEQ ID NO: 94582 - protein, 23 aa, Mycobacterium avium
ATPIPRTVALTVYGDLETSTLRE

SEQ ID NO: 94583 - protein, 17 aa, Mycobacterium avium
ATPPWLQMTKPIICAVN

SEQ ID NO: 94584 - protein, 25 aa, Mycobacterium avium
ATPRVLPWQECPGAVASAARITGMT

SEQ ID NO: 94585 - protein, 28 aa, Mycobacterium avium
ATQAFSEWRRTPAPVRGALVARLGELLR

SEQ ID NO: 94586 - protein, 25 aa, Mycobacterium avium
ATREILDREILGIAEAIRGSGLSAG

SEQ ID NO: 94587 - protein, 18 aa, Mycobacterium avium
ATRSYRYIDYWGTAVTAF

SEQ ID NO: 94588 - protein, 19 aa, Mycobacterium avium
ATSEAAWRITASPLAAPAS

SEQ ID NO: 94589 - protein, 22 aa, Mycobacterium avium
ATSLLQCVWVYDRAIDLAGLRR

SEQ ID NO: 94590 - protein, 17 aa, Mycobacterium avium
ATTHWRAADLLNGLGAR

SEQ ID NO: 94591 - protein, 18 aa, Mycobacterium avium
ATTLLTRIATCWRTGAHY

SEQ ID NO: 94592 - protein, 25 aa, Mycobacterium avium
ATTVGRLSVPQSWAATNPAAGTVAE

SEQ ID NO: 94593 - protein, 18 aa, Mycobacterium avium
ATTVIGARMDANGNGVFC

SEQ ID NO: 94594 - protein, 17 aa, Mycobacterium avium
ATTVLIRVGAPADGSDA

SEQ ID NO: 94595 - protein, 27 aa, Mycobacterium avium
ATTVSKLSVPPSWAGATPVVGSSSAPL

SEQ ID NO: 94596 - protein, 23 aa, Mycobacterium avium
ATVLSRNTFHWVLAFADGELLTR

SEQ ID NO: 94597 - protein, 22 aa, Mycobacterium avium
ATVPSIVRKGRGGPVVLVSSSQ

SEQ ID NO: 94598 - protein, 25 aa, Mycobacterium avium
ATVQEVRNALGLRTRWYVSAMETAG

SEQ ID NO: 94599 - protein, 25 aa, Mycobacterium avium
ATVRPEVLHAWHLLQRSRGLIPVTA

SEQ ID NO: 94600 - protein, 25 aa, Mycobacterium avium
ATVRPEVLHAWHLLQRSRGLMPVTA

SEQ ID NO: 94601 - protein, 20 aa, Mycobacterium avium
ATVVGRLTGRYAMAVLGAGL

SEQ ID NO: 94602 - protein, 17 aa, Mycobacterium avium
ATWLYDNGKPCGREANT

SEQ ID NO: 94603 - protein, 24 aa, Mycobacterium avium
ATWRRLELSVPLVVDPVCASMHGD

SEQ ID NO: 94604 - protein, 25 aa, Mycobacterium avium
ATYLFGSEELYDWADGKSILRGIDY

SEQ ID NO: 94605 - protein, 22 aa, Mycobacterium avium
ATYTRAFRRWSRQFYPPTTSVR

SEQ ID NO: 94606 - protein, 17 aa, Mycobacterium avium
AVAAADPGCRWADAVPN

SEQ ID NO: 94607 - protein, 18 aa, Mycobacterium avium
AVAAGLRTIEYVVAADDT

SEQ ID NO: 94608 - protein, 20 aa, Mycobacterium avium
AVAALGRYGLHPDENVAVAA

SEQ ID NO: 94609 - protein, 23 aa, Mycobacterium avium
AVAAPRALIRLCAGGDTAAGLLR

SEQ ID NO: 94610 - protein, 18 aa, Mycobacterium avium
AVAAWLWSGRTATLAGLS

SEQ ID NO: 94611 - protein, 24 aa, Mycobacterium avium
AVAAWRGFSRWLMRAYDVLIDEDQ

SEQ ID NO: 94612 - protein, 20 aa, Mycobacterium avium
AVADALRVMIDRARAVHADQ

SEQ ID NO: 94613 - protein, 23 aa, Mycobacterium avium
AVAERLAGSGARVHRLAVSHAFH

SEQ ID NO: 94614 - protein, 30 aa, Mycobacterium avium
AVAGGLARHVLCFRTLWEATHAELMKQGKI

SEQ ID NO: 94615 - protein, 18 aa, Mycobacterium avium
AVAGGRLALGVGPSHHWI

SEQ ID NO: 94616 - protein, 21 aa, Mycobacterium avium
AVAGKPPEEWGLDPVRYEDMI

SEQ ID NO: 94617 - protein, 17 aa, Mycobacterium avium
AVAGRRGGVTVATHMAG

SEQ ID NO: 94618 - protein, 21 aa, Mycobacterium avium
AVAMQRYHWVEAINHVHTGGN

SEQ ID NO: 94619 - protein, 24 aa, Mycobacterium avium
AVARRPGLAPGWGSPHAVRPATAR

SEQ ID NO: 94620 - protein, 25 aa, Mycobacterium avium
AVASWQIHRCIGMDGSRLVRTLSGD

SEQ ID NO: 94621 - protein, 24 aa, Mycobacterium avium
AVATGEFLAAIGFSQVQAPTQVEV

SEQ ID NO: 94622 - protein, 18 aa, Mycobacterium avium
AVAVRVWHEAVRLGDTRA

SEQ ID NO: 94623 - protein, 18 aa, Mycobacterium avium
AVCRGRLGLPNPLVGKPV

SEQ ID NO: 94624 - protein, 19 aa, Mycobacterium avium
AVDACLRAASWAPSGGNQQ

SEQ ID NO: 94625 - protein, 25 aa, Mycobacterium avium
AVDALKRWDRPVLMAWGTSDKMFPL

SEQ ID NO: 94626 - protein, 18 aa, Mycobacterium avium
AVDFPIYVHPGLPEAPVS

SEQ ID NO: 94627 - protein, 20 aa, Mycobacterium avium
AVDIDPRWVKKLAARDATAD

SEQ ID NO: 94628 - protein, 26 aa, Mycobacterium avium
AVDLPAAPCLHVFLARGRADIEDVGE

SEQ ID NO: 94629 - protein, 29 aa, Mycobacterium avium
AVDQSMRVPGWWVLDPMRALPVAVGGHPV

SEQ ID NO: 94630 - protein, 27 aa, Mycobacterium avium
AVDRNGQLRWFGLDGVEHTGGPMVDFD

SEQ ID NO: 94631 - protein, 33 aa, Mycobacterium avium
AVEAFDVEAFSRWMLDYVRFHRVYRGVIRAWFD

SEQ ID NO: 94632 - protein, 22 aa, Mycobacterium avium
AVEARTGVPIPTLRYWRHIDAG

SEQ ID NO: 94633 - protein, 26 aa, Mycobacterium avium
AVEMRNRLKAATGLALSPTLIFDYPN

SEQ ID NO: 94634 - protein, 24 aa, Mycobacterium avium
AVENALKVAFDWKSRHNERRGVDP

SEQ ID NO: 94635 - protein, 20 aa, Mycobacterium avium
AVERVMVVRDRIRTEPPHQG

SEQ ID NO: 94636 - protein, 21 aa, Mycobacterium avium
AVFADPRWRAHHDRMSELGFE

SEQ ID NO: 94637 - protein, 25 aa, Mycobacterium avium
AVFEHRAVLVGCERGVLATGLAGVA

SEQ ID NO: 94638 - protein, 24 aa, Mycobacterium avium
AVFNMCLHRGMQVCRAELGNASNF

SEQ ID NO: 94639 - protein, 24 aa, Mycobacterium avium
AVGEIRLAYLSSFGSTVVPRLIAR

SEQ ID NO: 94640 - protein, 26 aa, Mycobacterium avium
AVGGWFFGWLTDRCGSLAAPMLAHLV

SEQ ID NO: 94641 - protein, 25 aa, Mycobacterium avium
AVGKSFKHRWLPALPHHRYKPVSGP

SEQ ID NO: 94642 - protein, 23 aa, Mycobacterium avium
AVHPHLHRPRVIAIDEIPDSAAE

SEQ ID NO: 94643 - protein, 23 aa, Mycobacterium avium
AVHPRVIVCLGATAAQSLLGTSF

SEQ ID NO: 94644 - protein, 17 aa, Mycobacterium avium
AVHPVVASSLYFMRTLG

SEQ ID NO: 94645 - protein, 22 aa, Mycobacterium avium
AVIAGALGSWLMSRGAAVSPTA

SEQ ID NO: 94646 - protein, 18 aa, Mycobacterium avium
AVIETGIAQGVFRSVDVD

SEQ ID NO: 94647 - protein, 18 aa, Mycobacterium avium
AVIKGEPSFELQLDVAFD

SEQ ID NO: 94648 - protein, 25 aa, Mycobacterium avium
AVIVCPIGFVADHIEVVWDLDEELR

SEQ ID NO: 94649 - protein, 24 aa, Mycobacterium avium
AVIVERRGLVMLGVRPVPHLATAA

SEQ ID NO: 94650 - protein, 24 aa, Mycobacterium avium
AVKVRGGVVLGEFATLVDPQRSIP

SEQ ID NO: 94651 - protein, 17 aa, Mycobacterium avium
AVLAAGWPESIPGTTVN

SEQ ID NO: 94652 - protein, 17 aa, Mycobacterium avium
AVLAALAAHGWVRAGSV

SEQ ID NO: 94653 - protein, 25 aa, Mycobacterium avium
AVLANRARLLVLIATNFFGQNTAAI

SEQ ID NO: 94654 - protein, 17 aa, Mycobacterium avium
AVLARELEICYAAIALV

SEQ ID NO: 94655 - protein, 19 aa, Mycobacterium avium
AVLCQAAGAAALPYPLVEE

SEQ ID NO: 94656 - protein, 23 aa, Mycobacterium avium
AVLDEAQLRWTVTTEAGERVTAR

SEQ ID NO: 94657 - protein, 20 aa, Mycobacterium avium
AVLFASRRRSSGAVKFPAER

SEQ ID NO: 94658 - protein, 22 aa, Mycobacterium avium
AVLKAGAAYLPIDPALPDERIG

SEQ ID NO: 94659 - protein, 21 aa, Mycobacterium avium
AVLPALLARELHPTAVAGFLM

SEQ ID NO: 94660 - protein, 20 aa, Mycobacterium avium
AVLRAERPVSWHPPVEDSLL

SEQ ID NO: 94661 - protein, 18 aa, Mycobacterium avium
AVLRFIVDYQHSYSGVRM

SEQ ID NO: 94662 - protein, 19 aa, Mycobacterium avium
AVLRFIVDYQHSYSGVRMV

SEQ ID NO: 94663 - protein, 21 aa, Mycobacterium avium
AVLRLFRPTQIVHLAAETGTA

SEQ ID NO: 94664 - protein, 22 aa, Mycobacterium avium
AVLRLFRPTQIVHLAAETGTAQ

SEQ ID NO: 94665 - protein, 20 aa, Mycobacterium avium
AVLRRLRRYRDAGATDLAAR

SEQ ID NO: 94666 - protein, 17 aa, Mycobacterium avium
AVLTAMRAAHPYEEPAF

SEQ ID NO: 94667 - protein, 25 aa, Mycobacterium avium
AVLVSRADCILGRFITGEVPADGTR

SEQ ID NO: 94668 - protein, 18 aa, Mycobacterium avium
AVNECVQYSTAVQLAGAP

SEQ ID NO: 94669 - protein, 23 aa, Mycobacterium avium
AVNELRPGWVTPLDLPLIPGAGT

SEQ ID NO: 94670 - protein, 25 aa, Mycobacterium avium
AVNLGWKLALVVGGASPPALLDTYH

SEQ ID NO: 94671 - protein, 23 aa, Mycobacterium avium
AVNYPLYVIMSLLGLPEADFPRM

SEQ ID NO: 94672 - protein, 25 aa, Mycobacterium avium
AVPDHLKVAVLLGAFAGLRVAEVSG

SEQ ID NO: 94673 - protein, 19 aa, Mycobacterium avium
AVPELRRMLLPTVREDFRL

SEQ ID NO: 94674 - protein, 18 aa, Mycobacterium avium
AVPVVAMVGGGQLARMTH

SEQ ID NO: 94675 - protein, 25 aa, Mycobacterium avium
AVQAWTRSAAKAWAADHVTVNALAP

SEQ ID NO: 94676 - protein, 19 aa, Mycobacterium avium
AVQLQGRFVLGVGSGEALN

SEQ ID NO: 94677 - protein, 19 aa, Mycobacterium avium
AVQRAWQLRIHRIHDLLVN

SEQ ID NO: 94678 - protein, 24 aa, Mycobacterium avium
AVQSLRLYERHGLVTPARSRGGTR

SEQ ID NO: 94679 - protein, 19 aa, Mycobacterium avium
AVQTRVWRGRPDPARDARA

SEQ ID NO: 94680 - protein, 19 aa, Mycobacterium avium
AVQVAGLLARRIICDAHVG

SEQ ID NO: 94681 - protein, 24 aa, Mycobacterium avium
AVQWSTEAWQRCAYFTEVRRAGGN

SEQ ID NO: 94682 - protein, 23 aa, Mycobacterium avium
AVQYRLPMTFVLFNNNAHAMCVT

SEQ ID NO: 94683 - protein, 23 aa, Mycobacterium avium
AVRESLRRSLSFNGYSVELAHDG

SEQ ID NO: 94684 - protein, 24 aa, Mycobacterium avium
AVRGFPNYFFACGPDPGPQARYIV

SEQ ID NO: 94685 - protein, 20 aa, Mycobacterium avium
AVRLAREGANIIGIDICADI

SEQ ID NO: 94686 - protein, 28 aa, Mycobacterium avium
AVRNEWGWAEAYLDMGWEEIKVAAEYDG

SEQ ID NO: 94687 - protein, 25 aa, Mycobacterium avium
AVRRAVSRAQGWAPFNTFGYAAASR

SEQ ID NO: 94688 - protein, 22 aa, Mycobacterium avium
AVRRQLPHVLLQWEDFASTHAQ

SEQ ID NO: 94689 - protein, 26 aa, Mycobacterium avium
AVRSVFARQALPMSWDYAESTPWGGS

SEQ ID NO: 94690 - protein, 25 aa, Mycobacterium avium
AVRVIRTLRRLGIRSVAVYSDPDAA

SEQ ID NO: 94691 - protein, 20 aa, Mycobacterium avium
AVSAALLIHRLVAKRFGGVL

SEQ ID NO: 94692 - protein, 24 aa, Mycobacterium avium
AVSFPRVLSELFWIGRYGERAESM

SEQ ID NO: 94693 - protein, 20 aa, Mycobacterium avium
AVSLHMSPPLPMIGAGESVS

SEQ ID NO: 94694 - protein, 25 aa, Mycobacterium avium
AVSTKARVALVDFSLVAVARDVDAE

SEQ ID NO: 94695 - protein, 17 aa, Mycobacterium avium
AVTLLPAERSRLHVDLD

SEQ ID NO: 94696 - protein, 20 aa, Mycobacterium avium
AVTLPSYGGSTLWASTVAAY

SEQ ID NO: 94697 - protein, 21 aa, Mycobacterium avium
AVTLPSYGGSTLWASTVAAYQ

SEQ ID NO: 94698 - protein, 21 aa, Mycobacterium avium
AVTRWVPFADWVDGRVLLGGR

SEQ ID NO: 94699 - protein, 19 aa, Mycobacterium avium
AVVKLRLAIEALVQLASHV

SEQ ID NO: 94700 - protein, 24 aa, Mycobacterium avium
AVVQGLSMTIGWPDLAEAALAIRA

SEQ ID NO: 94701 - protein, 17 aa, Mycobacterium avium
AVVRAVLEPLGLTAEEP

SEQ ID NO: 94702 - protein, 21 aa, Mycobacterium avium
AVVVDGRLQWEVRRHGDDHVR

SEQ ID NO: 94703 - protein, 20 aa, Mycobacterium avium
AVVVSEPFLVAIPVLQEKDI

SEQ ID NO: 94704 - protein, 17 aa, Mycobacterium avium
AVVVVRLGFVPAPCRVV

SEQ ID NO: 94705 - protein, 17 aa, Mycobacterium avium
AVYARKHLKKWMRRRRQ

SEQ ID NO: 94706 - protein, 22 aa, Mycobacterium avium
AVYEPGQGWAPLNPSVTATETD

SEQ ID NO: 94707 - protein, 18 aa, Mycobacterium avium
AVYRAASIERVCKLAYDV

SEQ ID NO: 94708 - protein, 18 aa, Mycobacterium avium
AWAAETCAEYAPEVNVVG

SEQ ID NO: 94709 - protein, 18 aa, Mycobacterium avium
AWAARGRSGRPWLQASVN

SEQ ID NO: 94710 - protein, 17 aa, Mycobacterium avium
AWAEVFAGFDTPTLVGP

SEQ ID NO: 94711 - protein, 18 aa, Mycobacterium avium
AWCAAPWRGDGHPDHEAV

SEQ ID NO: 94712 - protein, 26 aa, Mycobacterium avium
AWDPITRIVGSLGIYTKIDFDNREVV

SEQ ID NO: 94713 - protein, 18 aa, Mycobacterium avium
AWIAEGLLIYLPASAQEQ

SEQ ID NO: 94714 - protein, 18 aa, Mycobacterium avium
AWLAEGLLMYLPAEAQDR

SEQ ID NO: 94715 - protein, 20 aa, Mycobacterium avium
AWLARTCAEFEGLEPVDSIP

SEQ ID NO: 94716 - protein, 20 aa, Mycobacterium avium
AWLDPGQWWALVRIGCAGEL

SEQ ID NO: 94717 - protein, 23 aa, Mycobacterium avium
AWLGHADPAFTMRTYVHAENDAL

SEQ ID NO: 94718 - protein, 25 aa, Mycobacterium avium
AWNVSELPCGPGRDVQEMLAAAAAG

SEQ ID NO: 94719 - protein, 20 aa, Mycobacterium avium
AWPMIEEAVFRLFDELAAKG

SEQ ID NO: 94720 - protein, 19 aa, Mycobacterium avium
AWQPLPTWFERLAAAGVRA

SEQ ID NO: 94721 - protein, 20 aa, Mycobacterium avium
AWQRCRVHFLRNVLAQVPKG

SEQ ID NO: 94722 - protein, 20 aa, Mycobacterium avium
AWSSLCTEYAAAASALTALL

SEQ ID NO: 94723 - protein, 18 aa, Mycobacterium avium
AWSVRWVILHVINELARH

SEQ ID NO: 94724 - protein, 19 aa, Mycobacterium avium
AWTELADAIGERGRAGLDR

SEQ ID NO: 94725 - protein, 23 aa, Mycobacterium avium
AWVLCAAIAHNLLRAAGVLAGGA

SEQ ID NO: 94726 - protein, 18 aa, Mycobacterium avium
AYAAFTWAHEHAGELGAA

SEQ ID NO: 94727 - protein, 17 aa, Mycobacterium avium
AYAEAGVTWITIEPASR

SEQ ID NO: 94728 - protein, 17 aa, Mycobacterium avium
AYAFGRDTFEQWVDYAP

SEQ ID NO: 94729 - protein, 25 aa, Mycobacterium avium
AYAGNRFDPGLSLLAARFTDTDRIE

SEQ ID NO: 94730 - protein, 23 aa, Mycobacterium avium
AYDLGRRPGLVAAVIAIDSLARA

SEQ ID NO: 94731 - protein, 28 aa, Mycobacterium avium
AYEDLAWFCIRAWRFGAPAGFGAGGLGS

SEQ ID NO: 94732 - protein, 17 aa, Mycobacterium avium
AYFAALLGLPFVAVMPE

SEQ ID NO: 94733 - protein, 32 aa, Mycobacterium avium
AYHHPRRLHWYVPRSIRLIDVFKGLSPEFVRR

SEQ ID NO: 94734 - protein, 33 aa, Mycobacterium avium
AYHHPRRLHWYVPRSIRLIDVFKGLSPEFVRRS

SEQ ID NO: 94735 - protein, 17 aa, Mycobacterium avium
AYLKSSLTGEVQRILMI

SEQ ID NO: 94736 - protein, 17 aa, Mycobacterium avium
AYLPIDPALPAARVEFM

SEQ ID NO: 94737 - protein, 20 aa, Mycobacterium avium
AYNPVLRFLLERPVHAKISR

SEQ ID NO: 94738 - protein, 25 aa, Mycobacterium avium
AYPGYAGSLDHIWALAEHPPAGTGL

SEQ ID NO: 94739 - protein, 26 aa, Mycobacterium avium
AYPQLRPETIRGLIVHSAQWTDAMRN

SEQ ID NO: 94740 - protein, 25 aa, Mycobacterium avium
AYRARLRPAGRRALLELPGPPAVWR

SEQ ID NO: 94741 - protein, 19 aa, Mycobacterium avium
AYRRSHGIPDDGGTAVTVQ

SEQ ID NO: 94742 - protein, 20 aa, Mycobacterium avium
AYSARKRKVGVEVTSGESEA

SEQ ID NO: 94743 - protein, 19 aa, Mycobacterium avium
AYSRFRRRARYLSIATDVG

SEQ ID NO: 94744 - protein, 17 aa, Mycobacterium avium
AYSSAWRRFEGWCRRNG

SEQ ID NO: 94745 - protein, 17 aa, Mycobacterium avium
AYTLPWRVHRFQPGELD

SEQ ID NO: 94746 - protein, 19 aa, Mycobacterium avium
AYTPWYLVRYWRLLKFKLA

SEQ ID NO: 94747 - protein, 17 aa, Mycobacterium avium
AYTWADNVVSWTLVSSS

SEQ ID NO: 94748 - protein, 19 aa, Mycobacterium avium
AYVLHARRYLAANGPIHPR

SEQ ID NO: 94749 - protein, 24 aa, Mycobacterium avium
AYWDEMLDRFVPHKTVLYGTGYLR

SEQ ID NO: 94750 - protein, 18 aa, Mycobacterium avium
AYYLMGFDIGAFTPIFVM

SEQ ID NO: 94751 - protein, 17 aa, Mycobacterium avium
CAANPGLVYLRLTGWGQ

SEQ ID NO: 94752 - protein, 21 aa, Mycobacterium avium
CAAVDALPCAVPRSATSDAER

SEQ ID NO: 94753 - protein, 23 aa, Mycobacterium avium
CAAWWRARAWHRPSCTGRRAAAR

SEQ ID NO: 94754 - protein, 21 aa, Mycobacterium avium
CADLPAIPYALGTDAELAETV

SEQ ID NO: 94755 - protein, 17 aa, Mycobacterium avium
CADWQRPEDGITLEDLD

SEQ ID NO: 94756 - protein, 18 aa, Mycobacterium avium
CAEGGVLGVVCAAIASVM

SEQ ID NO: 94757 - protein, 22 aa, Mycobacterium avium
CAELELPLCVNTGIPGPPIPGE

SEQ ID NO: 94758 - protein, 20 aa, Mycobacterium avium
CAETLELLLRSTGYSDDVTL

SEQ ID NO: 94759 - protein, 17 aa, Mycobacterium avium
CAFLCPSAAAAVDVGTE

SEQ ID NO: 94760 - protein, 19 aa, Mycobacterium avium
CAGRVPDWVPLPVQYIDYA

SEQ ID NO: 94761 - protein, 18 aa, Mycobacterium avium
CAIEQVRILGFASGELAF

SEQ ID NO: 94762 - protein, 21 aa, Mycobacterium avium
CALGAGCPLGAGAAGGAVAVL

SEQ ID NO: 94763 - protein, 19 aa, Mycobacterium avium
CAMGPRSAEAFLEALDVDL

SEQ ID NO: 94764 - protein, 28 aa, Mycobacterium avium
CANEGLCAMGLRFGEDWTSPRERFTALK

SEQ ID NO: 94765 - protein, 20 aa, Mycobacterium avium
CAPAAEWFGSRGWTAVPTPL

SEQ ID NO: 94766 - protein, 18 aa, Mycobacterium avium
CAPANRWSVRTVGDLELL

SEQ ID NO: 94767 - protein, 17 aa, Mycobacterium avium
CAQRAQIDTGRRQEWLV

SEQ ID NO: 94768 - protein, 20 aa, Mycobacterium avium
CARCGEDGYIIARRADGPVC

SEQ ID NO: 94769 - protein, 18 aa, Mycobacterium avium
CATAPLPTGRRVAGFGAA

SEQ ID NO: 94770 - protein, 18 aa, Mycobacterium avium
CATHSMRVRVWTAVPPSR

SEQ ID NO: 94771 - protein, 24 aa, Mycobacterium avium
CAVPCSRPLPWPARTVSSRVPEEV

SEQ ID NO: 94772 - protein, 17 aa, Mycobacterium avium
CAVPVVAAVNGFCVGGG

SEQ ID NO: 94773 - protein, 24 aa, Mycobacterium avium
CAVRAKAAGVVLAIENASSLYADI

SEQ ID NO: 94774 - protein, 19 aa, Mycobacterium avium
CAVRAKAAGVVLAVENASS

SEQ ID NO: 94775 - protein, 22 aa, Mycobacterium avium
CDAAELAARFARPLRFGTAGLR

SEQ ID NO: 94776 - protein, 17 aa, Mycobacterium avium
CDARPGWPVSGPRSAGC

SEQ ID NO: 94777 - protein, 18 aa, Mycobacterium avium
CDLRVVSPDAFFQFPTSK

SEQ ID NO: 94778 - protein, 19 aa, Mycobacterium avium
CDPPPGFGYTREGTYKGFP

SEQ ID NO: 94779 - protein, 17 aa, Mycobacterium avium
CDRRRGLGADGVLRVTA

SEQ ID NO: 94780 - protein, 17 aa, Mycobacterium avium
CDRRRGLGADGVLRVTT

SEQ ID NO: 94781 - protein, 18 aa, Mycobacterium avium
CDYITKPRITAAITGKTP

SEQ ID NO: 94782 - protein, 23 aa, Mycobacterium avium
CEGFPEMRVAVIPREQISFDDGW

SEQ ID NO: 94783 - protein, 28 aa, Mycobacterium avium
CEGFQRFAMAMAPFGFRASAATPAYGMA

SEQ ID NO: 94784 - protein, 25 aa, Mycobacterium avium
CEHCNYVKETAGWTVSAGVDETHIH

SEQ ID NO: 94785 - protein, 19 aa, Mycobacterium avium
CEHCNYVKETPGWTVSAGV

SEQ ID NO: 94786 - protein, 20 aa, Mycobacterium avium
CEHHNLPALRDWLRRQRDER

SEQ ID NO: 94787 - protein, 25 aa, Mycobacterium avium
CELVAARSRVRYAVEDAMRSGFDVY

SEQ ID NO: 94788 - protein, 19 aa, Mycobacterium avium
CEPSRMGIGPVRAVEKLFY

SEQ ID NO: 94789 - protein, 17 aa, Mycobacterium avium
CEPVCPVEAIYYEDDLP

SEQ ID NO: 94790 - protein, 19 aa, Mycobacterium avium
CERVLEIACEYARTREQFG

SEQ ID NO: 94791 - protein, 21 aa, Mycobacterium avium
CEVKAMYPLGPIFHGSGLNIT

SEQ ID NO: 94792 - protein, 24 aa, Mycobacterium avium
CEYWRAQFKAGNPIDAHIVNTVSG

SEQ ID NO: 94793 - protein, 20 aa, Mycobacterium avium
CEYWRAQFKAGNQIDARIVN

SEQ ID NO: 94794 - protein, 18 aa, Mycobacterium avium
CFDGQLSILSHPERLDEV

SEQ ID NO: 94795 - protein, 17 aa, Mycobacterium avium
CFLDPELRHLNDDHGDP

SEQ ID NO: 94796 - protein, 18 aa, Mycobacterium avium
CGAADFTTRVVVLTPADP

SEQ ID NO: 94797 - protein, 18 aa, Mycobacterium avium
CGADAIYPGYGFLSENPD

SEQ ID NO: 94798 - protein, 21 aa, Mycobacterium avium
CGAIGGGIWHRSRLVAGGDAA

SEQ ID NO: 94799 - protein, 25 aa, Mycobacterium avium
CGALSEWRATLIVRESACLDAEDRR

SEQ ID NO: 94800 - protein, 19 aa, Mycobacterium avium
CGAVKAALGAIEEGAIPGG

SEQ ID NO: 94801 - protein, 20 aa, Mycobacterium avium
CGGGRPAGLDRGYYFEPTVL

SEQ ID NO: 94802 - protein, 27 aa, Mycobacterium avium
CGGKPLDGPGWFYPPTVVTDITKDMAL

SEQ ID NO: 94803 - protein, 22 aa, Mycobacterium avium
CGGTLMCRWHGLPLDGRAREFG

SEQ ID NO: 94804 - protein, 26 aa, Mycobacterium avium
CGGTPFGHLLQRDRLAGVAAVPAAEV

SEQ ID NO: 94805 - protein, 17 aa, Mycobacterium avium
CGHRPAFAPTMGAASGM

SEQ ID NO: 94806 - protein, 24 aa, Mycobacterium avium
CGKTRFAEAMAYDLGRPLITVACH

SEQ ID NO: 94807 - protein, 19 aa, Mycobacterium avium
CGLGTGGLFVEDVADVAAP

SEQ ID NO: 94808 - protein, 19 aa, Mycobacterium avium
CGNVCATLSVWYAPEQFAQ

SEQ ID NO: 94809 - protein, 33 aa, Mycobacterium avium
CGRAYSPRFLWLWPNARISVMGGEQAASVLATV

SEQ ID NO: 94810 - protein, 18 aa, Mycobacterium avium
CGVEIGIRDVFELATVGL

SEQ ID NO: 94811 - protein, 26 aa, Mycobacterium avium
CGVTLPGRRCRLGWTVSVLRCSRSRS

SEQ ID NO: 94812 - protein, 18 aa, Mycobacterium avium
CHAYPCVAHDIELAVRHT

SEQ ID NO: 94813 - protein, 26 aa, Mycobacterium avium
CHDCHPGLPGPRWRADLHEVQRWCAL

SEQ ID NO: 94814 - protein, 40 aa, Mycobacterium avium
CHDCHPGLPGPRWRADMHEVQRWCALLEWAGIPCDSTDIL

SEQ ID NO: 94815 - protein, 18 aa, Mycobacterium avium
CHELMALSFASHLFQSLA

SEQ ID NO: 94816 - protein, 17 aa, Mycobacterium avium
CHGYCGLLNTTLSDGSY

SEQ ID NO: 94817 - protein, 19 aa, Mycobacterium avium
CHNGLRALVDVHRVDDSDT

SEQ ID NO: 94818 - protein, 21 aa, Mycobacterium avium
CIAAKRFIVHTDIYDAFVDKF

SEQ ID NO: 94819 - protein, 20 aa, Mycobacterium avium
CIEACPTRALTMINDYEMAD

SEQ ID NO: 94820 - protein, 18 aa, Mycobacterium avium
CIGNERIMQIDGAGFMSM

SEQ ID NO: 94821 - protein, 19 aa, Mycobacterium avium
CIGVGPGREQAIVRRDILA

SEQ ID NO: 94822 - protein, 26 aa, Mycobacterium avium
CKTEALAIKTMVDYAVGQYLDGKNDP

SEQ ID NO: 94823 - protein, 19 aa, Mycobacterium avium
CLAGSRLLVHESVADALVE

SEQ ID NO: 94824 - protein, 19 aa, Mycobacterium avium
CLARTLMARPRVLLLDEPT

SEQ ID NO: 94825 - protein, 18 aa, Mycobacterium avium
CLCVDHLHIDAMFVGVGF

SEQ ID NO: 94826 - protein, 19 aa, Mycobacterium avium
CLITPEAVRLPLAVHDLTD

SEQ ID NO: 94827 - protein, 20 aa, Mycobacterium avium
CLLAKDCPSFGLGPTEPPLA

SEQ ID NO: 94828 - protein, 19 aa, Mycobacterium avium
CLLTPPPWYPILRGTTQQT

SEQ ID NO: 94829 - protein, 23 aa, Mycobacterium avium
CLPGFFPRRRSRVPGNDRTGSRI

SEQ ID NO: 94830 - protein, 25 aa, Mycobacterium avium
CLPGFFPRRRSRVPGNHRTGSRIPV

SEQ ID NO: 94831 - protein, 23 aa, Mycobacterium avium
CLSEARYGIIWGARGAARSAWQA

SEQ ID NO: 94832 - protein, 22 aa, Mycobacterium avium
CLTGQHWLDVCAMVGLPEFGDH

SEQ ID NO: 94833 - protein, 20 aa, Mycobacterium avium
CNFPNCPRTSIYEASERDFR

SEQ ID NO: 94834 - protein, 17 aa, Mycobacterium avium
CNFSYKDMEKWGRKMFV

SEQ ID NO: 94835 - protein, 17 aa, Mycobacterium avium
CPAELVDRWAPGRTMIN

SEQ ID NO: 94836 - protein, 27 aa, Mycobacterium avium
CPDEFRRPDLRLALMDRQGVYGAVMFP

SEQ ID NO: 94837 - protein, 41 aa, Mycobacterium avium
CPDIRLARKRLGWRPRVDYRTGLSTTLAWFAERAGRTGESA

SEQ ID NO: 94838 - protein, 20 aa, Mycobacterium avium
CPEGTVGEIWIHGDNVAMGY

SEQ ID NO: 94839 - protein, 17 aa, Mycobacterium avium
CPGDLAVMGVDASPMGM

SEQ ID NO: 94840 - protein, 17 aa, Mycobacterium avium
CPHCRSLDWEAVESSGR

SEQ ID NO: 94841 - protein, 22 aa, Mycobacterium avium
CPPELLDRWAPGRTMVNVYGPT

SEQ ID NO: 94842 - protein, 22 aa, Mycobacterium avium
CPSGWRCPPTDPIRRWPTTAAP

SEQ ID NO: 94843 - protein, 30 aa, Mycobacterium avium
CPSHVLWLDRLAAVFPDAKFVMTHRDPTDV

SEQ ID NO: 94844 - protein, 20 aa, Mycobacterium avium
CPVMVPKARSASHLAQISRR

SEQ ID NO: 94845 - protein, 17 aa, Mycobacterium avium
CQPERFAEVMAVTGGVL

SEQ ID NO: 94846 - protein, 17 aa, Mycobacterium avium
CQPERFAEVMAVTSGVL

SEQ ID NO: 94847 - protein, 17 aa, Mycobacterium avium
CQPWLRPMEAFTLSVPR

SEQ ID NO: 94848 - protein, 19 aa, Mycobacterium avium
CQRSAMARRSVGAAAASRA

SEQ ID NO: 94849 - protein, 21 aa, Mycobacterium avium
CQSGRGVVVPGEVLPGQHYLH

SEQ ID NO: 94850 - protein, 30 aa, Mycobacterium avium
CQSILGYVVRWVAQGVGCSKVPDIHDVALM

SEQ ID NO: 94851 - protein, 20 aa, Mycobacterium avium
CQWFKSQFDPLMGQINDFNT

SEQ ID NO: 94852 - protein, 19 aa, Mycobacterium avium
CRALRIWSRSAASIDGRSR

SEQ ID NO: 94853 - protein, 19 aa, Mycobacterium avium
CRDGFTAVNVCSGQPISIL

SEQ ID NO: 94854 - protein, 23 aa, Mycobacterium avium
CRDPEHFYRYLAERLASVDHIQA

SEQ ID NO: 94855 - protein, 22 aa, Mycobacterium avium
CRDTITWLARRGILAAPGEFYG

SEQ ID NO: 94856 - protein, 18 aa, Mycobacterium avium
CRETVPYILGRLDELGDD

SEQ ID NO: 94857 - protein, 24 aa, Mycobacterium avium
CRIAKGSLRGCLVLGLEDSGSRMS

SEQ ID NO: 94858 - protein, 18 aa, Mycobacterium avium
CRIDDSFWTTIPVVDSWR

SEQ ID NO: 94859 - protein, 20 aa, Mycobacterium avium
CRLDEFRCYATLTVEVDANW

SEQ ID NO: 94860 - protein, 17 aa, Mycobacterium avium
CRPWLITEIEAVHPRII

SEQ ID NO: 94861 - protein, 25 aa, Mycobacterium avium
CRQFTCKYHAWRYSLDGDLTLVQQE

SEQ ID NO: 94862 - protein, 25 aa, Mycobacterium avium
CRQLEWRRMIDIGADFSGAKVAVDE

SEQ ID NO: 94863 - protein, 27 aa, Mycobacterium avium
CRRTSTCWAKSAGLCPTSPRWAIEAGT

SEQ ID NO: 94864 - protein, 17 aa, Mycobacterium avium
CRTRFYDDFFLDAARAG

SEQ ID NO: 94865 - protein, 19 aa, Mycobacterium avium
CRVIRRHGRVMVICSDPRH

SEQ ID NO: 94866 - protein, 17 aa, Mycobacterium avium
CRVPAAAILGDEPGRGF

SEQ ID NO: 94867 - protein, 17 aa, Mycobacterium avium
CRWLLTSRLELIEDRNR

SEQ ID NO: 94868 - protein, 21 aa, Mycobacterium avium
CRYMKMITPAALLRCLVEGAD

SEQ ID NO: 94869 - protein, 24 aa, Mycobacterium avium
CSAAADLLWSRVIKQFPDVRFALS

SEQ ID NO: 94870 - protein, 24 aa, Mycobacterium avium
CSDLFYSIWWPRLPGDTADVPEGK

SEQ ID NO: 94871 - protein, 28 aa, Mycobacterium avium
CSECRHVTAKWVGRCLECGTWGTVDEVP

SEQ ID NO: 94872 - protein, 19 aa, Mycobacterium avium
CSEPAGYLTGSWIEVDGGL

SEQ ID NO: 94873 - protein, 17 aa, Mycobacterium avium
CSGHFYTDEEILREEGW

SEQ ID NO: 94874 - protein, 33 aa, Mycobacterium avium
CSGSGSGLRELKCGYHGWTWDLAGALKRVPDRK

SEQ ID NO: 94875 - protein, 18 aa, Mycobacterium avium
CSIQRRYQKLIEIAPAQG

SEQ ID NO: 94876 - protein, 19 aa, Mycobacterium avium
CSIRHGLCTPRIVSPIQMQ

SEQ ID NO: 94877 - protein, 24 aa, Mycobacterium avium
CSLDEPWCRTLATHLGHFDTGAEA

SEQ ID NO: 94878 - protein, 23 aa, Mycobacterium avium
CSLDEPWCRTLATHLGHFHSGAE

SEQ ID NO: 94879 - protein, 22 aa, Mycobacterium avium
CSSGLTAIHLACRSLHEGESDL

SEQ ID NO: 94880 - protein, 19 aa, Mycobacterium avium
CSVRGWAVGFGCNLALAAD

SEQ ID NO: 94881 - protein, 22 aa, Mycobacterium avium
CTHCNQCMPTIYSRTHCVVTGA

SEQ ID NO: 94882 - protein, 19 aa, Mycobacterium avium
CTPESLARLRPITSNGTVT

SEQ ID NO: 94883 - protein, 22 aa, Mycobacterium avium
CTRVWRDGRVEQLGWPRVKIHY

SEQ ID NO: 94884 - protein, 25 aa, Mycobacterium avium
CVAAGIPAVTFWAAVPHYVSQPPNP

SEQ ID NO: 94885 - protein, 18 aa, Mycobacterium avium
CVDECPVDCIYEGGRALY

SEQ ID NO: 94886 - protein, 17 aa, Mycobacterium avium
CVEVCPLDALAIDTDTG

SEQ ID NO: 94887 - protein, 18 aa, Mycobacterium avium
CVNPLPLFHTAGCVIATL

SEQ ID NO: 94888 - protein, 29 aa, Mycobacterium avium
CVRCGGPSAGMRLCLKCHSTVGTLQARLR

SEQ ID NO: 94889 - protein, 21 aa, Mycobacterium avium
CVSSPRAVLFVSPSARLARVP

SEQ ID NO: 94890 - protein, 17 aa, Mycobacterium avium
CVVRAVRRWTYFYKHES

SEQ ID NO: 94891 - protein, 20 aa, Mycobacterium avium
CWAAPGGQRWLHGEAVVDDT

SEQ ID NO: 94892 - protein, 21 aa, Mycobacterium avium
CWDLLRGLTLGRLVTHADGQP

SEQ ID NO: 94893 - protein, 19 aa, Mycobacterium avium
CWRPHGRQWNTPVSPRSAS

SEQ ID NO: 94894 - protein, 19 aa, Mycobacterium avium
CYAALLWLARQPWVDPERV

SEQ ID NO: 94895 - protein, 19 aa, Mycobacterium avium
DAAAAWRALVEEPIGAAIA

SEQ ID NO: 94896 - protein, 24 aa, Mycobacterium avium
DAAAIRTARFDSIIEIGYPTREAA

SEQ ID NO: 94897 - protein, 24 aa, Mycobacterium avium
DAAAPAARVRFMLADSAAVAAVTT

SEQ ID NO: 94898 - protein, 22 aa, Mycobacterium avium
DAAEDTVGWIIRVDGSAVVAVV

SEQ ID NO: 94899 - protein, 22 aa, Mycobacterium avium
DAAHAMPPWIGQGMSAGVRDAA

SEQ ID NO: 94900 - protein, 18 aa, Mycobacterium avium
DAALKTAHRLWGNEGLPG

SEQ ID NO: 94901 - protein, 25 aa, Mycobacterium avium
DAALRFVPEGARLQYGPGQLGTALL

SEQ ID NO: 94902 - protein, 27 aa, Mycobacterium avium
DAALRRAARFGSGWWPFLTPPEQIAEK

SEQ ID NO: 94903 - protein, 19 aa, Mycobacterium avium
DAATLKGLVDVGTHNAYHA

SEQ ID NO: 94904 - protein, 17 aa, Mycobacterium avium
DAAVPVPHDIPWFPKDQ

SEQ ID NO: 94905 - protein, 24 aa, Mycobacterium avium
DAAWAVASAQGFDGVQMRAVAAQA

SEQ ID NO: 94906 - protein, 17 aa, Mycobacterium avium
DAAYHCPHPANSCDCRK

SEQ ID NO: 94907 - protein, 21 aa, Mycobacterium avium
DACYFRARPVRRLTNSRRAIR

SEQ ID NO: 94908 - protein, 19 aa, Mycobacterium avium
DADAVAGLRRLTRIAEQDR

SEQ ID NO: 94909 - protein, 20 aa, Mycobacterium avium
DADAVAGLRRLTRIAEQDRQ

SEQ ID NO: 94910 - protein, 23 aa, Mycobacterium avium
DADFGMACAIGIAPCMHAGQGCA

SEQ ID NO: 94911 - protein, 24 aa, Mycobacterium avium
DADFYVCGPNEFMDAVCTALRDAG

SEQ ID NO: 94912 - protein, 25 aa, Mycobacterium avium
DADKAAGAGKWVCTTLQGGKQMSDV

SEQ ID NO: 94913 - protein, 23 aa, Mycobacterium avium
DADRFLVAVTFRIGRLGVPVVAE

SEQ ID NO: 94914 - protein, 26 aa, Mycobacterium avium
DADRLRLLLREVFTAAGGSHDDWDEY

SEQ ID NO: 94915 - protein, 23 aa, Mycobacterium avium
DADRSAGLAQEFRPSQAERDQQD

SEQ ID NO: 94916 - protein, 22 aa, Mycobacterium avium
DADRYRRLHVIIGDANLAETST

SEQ ID NO: 94917 - protein, 28 aa, Mycobacterium avium
DAEAARHFGCGFAPSGWDTLTKHLQRKG

SEQ ID NO: 94918 - protein, 27 aa, Mycobacterium avium
DAEAQLELKWRAIREDLERRGVGVPIV

SEQ ID NO: 94919 - protein, 20 aa, Mycobacterium avium
DAERGPGWHLAMLPLTDGGA

SEQ ID NO: 94920 - protein, 23 aa, Mycobacterium avium
DAERMFTPVLEWIAGRPELDPAG

SEQ ID NO: 94921 - protein, 27 aa, Mycobacterium avium
DAFAAYRIPGERACLGYAERGVRSSVI

SEQ ID NO: 94922 - protein, 17 aa, Mycobacterium avium
DAFQEFYHAPVLHANQS

SEQ ID NO: 94923 - protein, 19 aa, Mycobacterium avium
DAFTDGWFKTGDLGVLDED

SEQ ID NO: 94924 - protein, 20 aa, Mycobacterium avium
DAFWDDIFRELSIPYLPIRW

SEQ ID NO: 94925 - protein, 18 aa, Mycobacterium avium
DAGALHWVAGPTLPGSRN

SEQ ID NO: 94926 - protein, 18 aa, Mycobacterium avium
DAGALTRLGEAFGQREGQ

SEQ ID NO: 94927 - protein, 26 aa, Mycobacterium avium
DAGCGCAELSLALAARGYTVVGIDLT

SEQ ID NO: 94928 - protein, 30 aa, Mycobacterium avium
DAGGGPTQLSWWVTRVQEVARAISGDLSQS

SEQ ID NO: 94929 - protein, 18 aa, Mycobacterium avium
DAGGHLQNLCALVDSDTV

SEQ ID NO: 94930 - protein, 19 aa, Mycobacterium avium
DAGHFDIYVGADFERNVTD

SEQ ID NO: 94931 - protein, 17 aa, Mycobacterium avium
DAGHKGFTLFVVEAGMD

SEQ ID NO: 94932 - protein, 23 aa, Mycobacterium avium
DAGLRPADIDGMVTFSVDDNEEI

SEQ ID NO: 94933 - protein, 21 aa, Mycobacterium avium
DAGRAQAQWGALRRTYLRLGH

SEQ ID NO: 94934 - protein, 20 aa, Mycobacterium avium
DAGRCQRGYFIESLGGAQFA

SEQ ID NO: 94935 - protein, 18 aa, Mycobacterium avium
DAGRFLTTIKHRLEEGAF

SEQ ID NO: 94936 - protein, 23 aa, Mycobacterium avium
DAGVARGTFYFHFPTKEHVLVEV

SEQ ID NO: 94937 - protein, 24 aa, Mycobacterium avium
DAGVARGTFYFHFPTKEHVLVEVE

SEQ ID NO: 94938 - protein, 24 aa, Mycobacterium avium
DAGVRPGMTVAWQLPSHVNAAVAM

SEQ ID NO: 94939 - protein, 24 aa, Mycobacterium avium
DAGVRRIVYLGGFVPAGEVLSEHL

SEQ ID NO: 94940 - protein, 17 aa, Mycobacterium avium
DAIGQSSLWSVGQDNIF

SEQ ID NO: 94941 - protein, 20 aa, Mycobacterium avium
DAIIPPTFLTTAGRWAPAGV

SEQ ID NO: 94942 - protein, 22 aa, Mycobacterium avium
DAILTPRVNAGYSRNDDPATAP

SEQ ID NO: 94943 - protein, 17 aa, Mycobacterium avium
DAINLGLQMCRLSVDHG

SEQ ID NO: 94944 - protein, 20 aa, Mycobacterium avium
DAIPEIAGWYQRRGLTPRLA

SEQ ID NO: 94945 - protein, 30 aa, Mycobacterium avium
DAKIGYPPTRVWGVPAAGLWAHRLGDQRAK

SEQ ID NO: 94946 - protein, 18 aa, Mycobacterium avium
DAKTAKLASLLANADPAH

SEQ ID NO: 94947 - protein, 17 aa, Mycobacterium avium
DALAIHRHAHGLPALSV

SEQ ID NO: 94948 - protein, 17 aa, Mycobacterium avium
DALGQPRHAVVDRLDAG

SEQ ID NO: 94949 - protein, 17 aa, Mycobacterium avium
DALLSLGADACCYNPLW

SEQ ID NO: 94950 - protein, 17 aa, Mycobacterium avium
DALPGWAATSPAYRGAA

SEQ ID NO: 94951 - protein, 23 aa, Mycobacterium avium
DALPRLVERFADVQLLVVGRGDE

SEQ ID NO: 94952 - protein, 20 aa, Mycobacterium avium
DALRIPMQYLAELFTAGDTA

SEQ ID NO: 94953 - protein, 17 aa, Mycobacterium avium
DALSVLVRLLASLHDDD

SEQ ID NO: 94954 - protein, 17 aa, Mycobacterium avium
DALWDKLIAACHPDVRA

SEQ ID NO: 94955 - protein, 17 aa, Mycobacterium avium
DALWDKLIAACHPGVRA

SEQ ID NO: 94956 - protein, 25 aa, Mycobacterium avium
DAMKLTPREIGVWDMTHICRIDDSF

SEQ ID NO: 94957 - protein, 17 aa, Mycobacterium avium
DANFGWSARDACYSYGT

SEQ ID NO: 94958 - protein, 21 aa, Mycobacterium avium
DANRFLVAVTFRMGRLGVPVV

SEQ ID NO: 94959 - protein, 19 aa, Mycobacterium avium
DANVVPIVFHRSGFRRLGA

SEQ ID NO: 94960 - protein, 20 aa, Mycobacterium avium
DAPGVIAAWLQAGGRLASNE

SEQ ID NO: 94961 - protein, 20 aa, Mycobacterium avium
DAPGVIAAWLQAGGRLTSSE

SEQ ID NO: 94962 - protein, 20 aa, Mycobacterium avium
DAPLISFDESFKVLKVNPIA

SEQ ID NO: 94963 - protein, 19 aa, Mycobacterium avium
DAPLTMVFVHGFCLQMGAF

SEQ ID NO: 94964 - protein, 22 aa, Mycobacterium avium
DAPPVAGLHLQFGKNAGTEVVV

SEQ ID NO: 94965 - protein, 18 aa, Mycobacterium avium
DAPWKDIEAQGWIAPAEC

SEQ ID NO: 94966 - protein, 18 aa, Mycobacterium avium
DAQGFFRSGDLVRITDDG

SEQ ID NO: 94967 - protein, 19 aa, Mycobacterium avium
DAQGFFRSGDLVRVRDDGY

SEQ ID NO: 94968 - protein, 25 aa, Mycobacterium avium
DAQSGSIGLGFAIPVDQAKRIADEL

SEQ ID NO: 94969 - protein, 18 aa, Mycobacterium avium
DARCDVGVLSRIVDCVDQ

SEQ ID NO: 94970 - protein, 19 aa, Mycobacterium avium
DARGARRAVSLSGGAVLAA

SEQ ID NO: 94971 - protein, 21 aa, Mycobacterium avium
DARNLANLLSLDAPNQPSPSI

SEQ ID NO: 94972 - protein, 25 aa, Mycobacterium avium
DARSRLNLADGILVRAVWASETSQL

SEQ ID NO: 94973 - protein, 19 aa, Mycobacterium avium
DARSWARANGFNTQEAPAP

SEQ ID NO: 94974 - protein, 19 aa, Mycobacterium avium
DARVGRLLFSTQLADPVVV

SEQ ID NO: 94975 - protein, 18 aa, Mycobacterium avium
DASAVCMFTLAANPPVTV

SEQ ID NO: 94976 - protein, 25 aa, Mycobacterium avium
DASGPEPYCPVGISPLLETIEDLHN

SEQ ID NO: 94977 - protein, 24 aa, Mycobacterium avium
DASLRLVAPGGVFLEMGKTDIRDP

SEQ ID NO: 94978 - protein, 19 aa, Mycobacterium avium
DATTITWRQYRDRVRAIAA

SEQ ID NO: 94979 - protein, 24 aa, Mycobacterium avium
DAVAARAATLWRFTAGAVDQPDPV

SEQ ID NO: 94980 - protein, 24 aa, Mycobacterium avium
DAVDRIKALTGRIDLVHCNDSRDA

SEQ ID NO: 94981 - protein, 21 aa, Mycobacterium avium
DAVFTAEAWGSDAYTPLAWWG

SEQ ID NO: 94982 - protein, 18 aa, Mycobacterium avium
DAVLAALAAHGWVRAGSV

SEQ ID NO: 94983 - protein, 24 aa, Mycobacterium avium
DAVNGMAGLMAWAQAPTRALDRFE

SEQ ID NO: 94984 - protein, 18 aa, Mycobacterium avium
DAVRRACEEVGRDPATLE

SEQ ID NO: 94985 - protein, 23 aa, Mycobacterium avium
DAVRRGGRWRAWRSTRSGGSPRA

SEQ ID NO: 94986 - protein, 18 aa, Mycobacterium avium
DAVWLQRELLRFHGNPTA

SEQ ID NO: 94987 - protein, 23 aa, Mycobacterium avium
DAVYRAAKLLGYRPNLAARNLAR

SEQ ID NO: 94988 - protein, 27 aa, Mycobacterium avium
DAWKALGKDVTHWDEWGSNPAEALGKS

SEQ ID NO: 94989 - protein, 18 aa, Mycobacterium avium
DCCVRDLYEAIARGKYPS

SEQ ID NO: 94990 - protein, 26 aa, Mycobacterium avium
DCGADFRLTDAAAWERFYGSPHAGSW

SEQ ID NO: 94991 - protein, 17 aa, Mycobacterium avium
DCRKLAAERGWPIGDEY

SEQ ID NO: 94992 - protein, 24 aa, Mycobacterium avium
DCSLDEPWCRTLATHLGHFHSGAE

SEQ ID NO: 94993 - protein, 20 aa, Mycobacterium avium
DCTSIRWSSRADPVANGKTL

SEQ ID NO: 94994 - protein, 18 aa, Mycobacterium avium
DCVLLDLHLPDASGIDAL

SEQ ID NO: 94995 - protein, 25 aa, Mycobacterium avium
DDAARMWARLRIHLAEAGRRMRAND

SEQ ID NO: 94996 - protein, 24 aa, Mycobacterium avium
DDAESFDAAGFFRIGDLGRWALAD

SEQ ID NO: 94997 - protein, 24 aa, Mycobacterium avium
DDAESFDAAGFFRTGDLGRWALAD

SEQ ID NO: 94998 - protein, 30 aa, Mycobacterium avium
DDAIRRFHLADAREAVNLALRTLIDDAGPG

SEQ ID NO: 94999 - protein, 21 aa, Mycobacterium avium
DDALMKITHVLRGEDLLPSTP

SEQ ID NO: 95000 - protein, 26 aa, Mycobacterium avium
DDDAVRMWARLRIHLAEAGRRMRAND

SEQ ID NO: 95001 - protein, 24 aa, Mycobacterium avium
DDDEVRVPWSLAPRQRGSRRRPSL

SEQ ID NO: 95002 - protein, 21 aa, Mycobacterium avium
DDDLDGWYRYPECVADQPETP

SEQ ID NO: 95003 - protein, 21 aa, Mycobacterium avium
DDDLRCWAERITAWDGDGKDV

SEQ ID NO: 95004 - protein, 22 aa, Mycobacterium avium
DDDLRCWAERITAWDGDGKDVW

SEQ ID NO: 95005 - protein, 22 aa, Mycobacterium avium
DDDRGALCGQRQAMGAPDASTA

SEQ ID NO: 95006 - protein, 20 aa, Mycobacterium avium
DDEAHWLVYEIWETVEHDQA

SEQ ID NO: 95007 - protein, 21 aa, Mycobacterium avium
DDEKQRFGALRVVHSLEASQR

SEQ ID NO: 95008 - protein, 22 aa, Mycobacterium avium
DDEWPVLAFAAFGAAAPRPPGT

SEQ ID NO: 95009 - protein, 21 aa, Mycobacterium avium
DDEWPVLAFAAFGAATPRPPG

SEQ ID NO: 95010 - protein, 18 aa, Mycobacterium avium
DDEWRRLTTLLVDKGTFV

SEQ ID NO: 95011 - protein, 28 aa, Mycobacterium avium
DDFAQYWAEICSIPISFIAESVRRAQAE

SEQ ID NO: 95012 - protein, 26 aa, Mycobacterium avium
DDGFLWLDGRVSDMINRGGLKVFPGT

SEQ ID NO: 95013 - protein, 24 aa, Mycobacterium avium
DDGIGLDEYVDWLIDAGYPIERVD

SEQ ID NO: 95014 - protein, 24 aa, Mycobacterium avium
DDGIGLDEYVDWLIEAGYLIERVD

SEQ ID NO: 95015 - protein, 24 aa, Mycobacterium avium
DDGVGLDEYVDWLVDAGYSIERIA

SEQ ID NO: 95016 - protein, 26 aa, Mycobacterium avium
DDITKRLSAPVGIRADCLGVQDPLPA

SEQ ID NO: 95017 - protein, 23 aa, Mycobacterium avium
DDKPMKYPVMFRAVDVVLLNKID

SEQ ID NO: 95018 - protein, 29 aa, Mycobacterium avium
DDLAERVGWQWRLVWYKAVAELLTGDYDS

SEQ ID NO: 95019 - protein, 18 aa, Mycobacterium avium
DDLAPDWPQPRIAIAPKD

SEQ ID NO: 95020 - protein, 19 aa, Mycobacterium avium
DDLAPDWPTEIGYAVTFEG

SEQ ID NO: 95021 - protein, 40 aa, Mycobacterium avium
DDLDALITKVWKTPSFFLTHPLGIAAFGREATYRGVPPPV

SEQ ID NO: 95022 - protein, 23 aa, Mycobacterium avium
DDLELWLGEQVAKGFASHGESWS

SEQ ID NO: 95023 - protein, 25 aa, Mycobacterium avium
DDLGALAGWYVWAALGLYPATPGTP

SEQ ID NO: 95024 - protein, 18 aa, Mycobacterium avium
DDLHRFVVLVAEQGRQVG

SEQ ID NO: 95025 - protein, 23 aa, Mycobacterium avium
DDLMPRERLLAVFATPPAFTDEP

SEQ ID NO: 95026 - protein, 27 aa, Mycobacterium avium
DDLPAGSMLVPFSWQRVSLHAAGAAAV

SEQ ID NO: 95027 - protein, 21 aa, Mycobacterium avium
DDLPDGGAWLYAETVRAIKEL

SEQ ID NO: 95028 - protein, 23 aa, Mycobacterium avium
DDLWQSRLPKRLADLTPRAEKDP

SEQ ID NO: 95029 - protein, 23 aa, Mycobacterium avium
DDPGGLCERLGWSATVTDVAEPG

SEQ ID NO: 95030 - protein, 19 aa, Mycobacterium avium
DDPGTDWARYALKAPVMLV

SEQ ID NO: 95031 - protein, 19 aa, Mycobacterium avium
DDPLWERMDFAVAEANFLT

SEQ ID NO: 95032 - protein, 22 aa, Mycobacterium avium
DDPLWERMDFAVAEANFLTAAR

SEQ ID NO: 95033 - protein, 17 aa, Mycobacterium avium
DDPMVAIDFYRDNVLPK

SEQ ID NO: 95034 - protein, 19 aa, Mycobacterium avium
DDPRWLVKHLPKAARDAVM

SEQ ID NO: 95035 - protein, 17 aa, Mycobacterium avium
DDPRYLGWRHRRVDDDD

SEQ ID NO: 95036 - protein, 17 aa, Mycobacterium avium
DDPYPVWHRLREKGPVL

SEQ ID NO: 95037 - protein, 23 aa, Mycobacterium avium
DDRIDPRFPVFSATALTDALPGP

SEQ ID NO: 95038 - protein, 23 aa, Mycobacterium avium
DDRIDPRFPVFSATALTEALPGP

SEQ ID NO: 95039 - protein, 23 aa, Mycobacterium avium
DDRVALAVALLVRALRGGSVCVD

SEQ ID NO: 95040 - protein, 20 aa, Mycobacterium avium
DDTLPMLTGIRVEISGDTVV

SEQ ID NO: 95041 - protein, 17 aa, Mycobacterium avium
DDVDGHASAVMGEVAAE

SEQ ID NO: 95042 - protein, 21 aa, Mycobacterium avium
DDVGGFDCDFFGMTEREATAV

SEQ ID NO: 95043 - protein, 24 aa, Mycobacterium avium
DDVKQCLIVAPGGLVEQWQDELFF

SEQ ID NO: 95044 - protein, 27 aa, Mycobacterium avium
DDVYDAAAAWARRFLDGPRHALAAAKA

SEQ ID NO: 95045 - protein, 21 aa, Mycobacterium avium
DDWHAAFELGTLSAVRSVRAA

SEQ ID NO: 95046 - protein, 17 aa, Mycobacterium avium
DDYAGVLVVTSGDTPLL

SEQ ID NO: 95047 - protein, 20 aa, Mycobacterium avium
DDYSEAFKRVPVAWDNVAAP

SEQ ID NO: 95048 - protein, 19 aa, Mycobacterium avium
DEAAGLLDMFGTRERWATT

SEQ ID NO: 95049 - protein, 20 aa, Mycobacterium avium
DEAASRYIGLWTPDDSSAAP

SEQ ID NO: 95050 - protein, 17 aa, Mycobacterium avium
DEAFQAWAKGPAIEAHA

SEQ ID NO: 95051 - protein, 30 aa, Mycobacterium avium
DEAMASWSPKLMLRPATWVADTVADLERDM

SEQ ID NO: 95052 - protein, 30 aa, Mycobacterium avium
DEARFPDIWAATVARRGLVHAAENFEAACL

SEQ ID NO: 95053 - protein, 28 aa, Mycobacterium avium
DEARPRAGILRVREFVMKDSYSFDIDDA

SEQ ID NO: 95054 - protein, 24 aa, Mycobacterium avium
DEARRIGTDWLRAYLALPNYANNL

SEQ ID NO: 95055 - protein, 18 aa, Mycobacterium avium
DEAVSWSAVAAVVYGLVL

SEQ ID NO: 95056 - protein, 21 aa, Mycobacterium avium
DEAYPRLAVVRAPRHDRAVGP

SEQ ID NO: 95057 - protein, 25 aa, Mycobacterium avium
DECVTQVRRYCHLRGIRRDLDSWMQ

SEQ ID NO: 95058 - protein, 25 aa, Mycobacterium avium
DEDFRHTFDWCVTSAFIMSQLVAAH

SEQ ID NO: 95059 - protein, 19 aa, Mycobacterium avium
DEDGFWFIVDRVKDMIVTG

SEQ ID NO: 95060 - protein, 22 aa, Mycobacterium avium
DEDLRCWAERITAWDGDGKDVW

SEQ ID NO: 95061 - protein, 23 aa, Mycobacterium avium
DEDLRWQPPLWRALLARVAADPP

SEQ ID NO: 95062 - protein, 24 aa, Mycobacterium avium
DEEAVGLCFLFVLAGLDTVMDALG

SEQ ID NO: 95063 - protein, 18 aa, Mycobacterium avium
DEELARLRDALGYLHDQT

SEQ ID NO: 95064 - protein, 17 aa, Mycobacterium avium
DEELPAPGYVGSQSDGS

SEQ ID NO: 95065 - protein, 18 aa, Mycobacterium avium
DEFARAAVELALVDPGRV

SEQ ID NO: 95066 - protein, 21 aa, Mycobacterium avium
DEFARRLPLMADRRDFSEPTA

SEQ ID NO: 95067 - protein, 20 aa, Mycobacterium avium
DEFFARLAGRSTVAGSTERQ

SEQ ID NO: 95068 - protein, 18 aa, Mycobacterium avium
DEFGRTWQAVVPEQTDEE

SEQ ID NO: 95069 - protein, 19 aa, Mycobacterium avium
DEFLARFPQVEFTDVRGAG

SEQ ID NO: 95070 - protein, 22 aa, Mycobacterium avium
DEFVSCVFDWVVAELAATTQAA

SEQ ID NO: 95071 - protein, 24 aa, Mycobacterium avium
DEGDPRPVLRADLRPEWAEHDLSG

SEQ ID NO: 95072 - protein, 25 aa, Mycobacterium avium
DEGFHAASVRRIRPGEQLVLGDGAG

SEQ ID NO: 95073 - protein, 18 aa, Mycobacterium avium
DEHRHYQAAIAHERAAEV

SEQ ID NO: 95074 - protein, 17 aa, Mycobacterium avium
DEIHAPVILPGSRFTPF

SEQ ID NO: 95075 - protein, 20 aa, Mycobacterium avium
DEIRTRWPPWPAAAPACSGS

SEQ ID NO: 95076 - protein, 24 aa, Mycobacterium avium
DEKWGEAVTAVIVLRPDHPSDEES

SEQ ID NO: 95077 - protein, 19 aa, Mycobacterium avium
DELAAEWARADELVLSKLR

SEQ ID NO: 95078 - protein, 32 aa, Mycobacterium avium
DELAECPRLSYGLDEACLLIFGRRDLSADEAE

SEQ ID NO: 95079 - protein, 32 aa, Mycobacterium avium
DELAECPRLSYSLDEACLLIFGRRDLSADEAE

SEQ ID NO: 95080 - protein, 33 aa, Mycobacterium avium
DELAECPRLSYSLDEACLLIFGRRDLSADEAEA

SEQ ID NO: 95081 - protein, 18 aa, Mycobacterium avium
DELANELHVTAANIESVI

SEQ ID NO: 95082 - protein, 20 aa, Mycobacterium avium
DELARSVARAVAARHAAGSV

SEQ ID NO: 95083 - protein, 17 aa, Mycobacterium avium
DELEPTAGQQNWRHRLM

SEQ ID NO: 95084 - protein, 23 aa, Mycobacterium avium
DELFAGPTAIAFVTGEPVDAAKA

SEQ ID NO: 95085 - protein, 26 aa, Mycobacterium avium
DELIARFLKQLGINWDPAQGTVNGLD

SEQ ID NO: 95086 - protein, 18 aa, Mycobacterium avium
DELIRIEATAARRNGVGV

SEQ ID NO: 95087 - protein, 26 aa, Mycobacterium avium
DELKRFGDLRLQLRVNGQVRQDMRVD

SEQ ID NO: 95088 - protein, 20 aa, Mycobacterium avium
DELRLAYKKVVLVDNDKPIP

SEQ ID NO: 95089 - protein, 21 aa, Mycobacterium avium
DELRVPIGVTATGEPLIFDLK

SEQ ID NO: 95090 - protein, 26 aa, Mycobacterium avium
DELSAWTRKHFPGAVQTHFWSAQDYT

SEQ ID NO: 95091 - protein, 19 aa, Mycobacterium avium
DELVDEWLAVTGLDGQTPV

SEQ ID NO: 95092 - protein, 23 aa, Mycobacterium avium
DELYAAGAAAIFPPGTVIADAAI

SEQ ID NO: 95093 - protein, 26 aa, Mycobacterium avium
DEPDCVRELAAMAFAFAYETARDATR

SEQ ID NO: 95094 - protein, 22 aa, Mycobacterium avium
DEPDERWALLPLVPLIPKPVFR

SEQ ID NO: 95095 - protein, 21 aa, Mycobacterium avium
DEPIAIVSMACRFPGAADPEA

SEQ ID NO: 95096 - protein, 20 aa, Mycobacterium avium
DEPIPLSAMLARAGVPPRQW

SEQ ID NO: 95097 - protein, 25 aa, Mycobacterium avium
DEPRMSAGQHRMWFVQSVDPDSALL

SEQ ID NO: 95098 - protein, 24 aa, Mycobacterium avium
DEPRMSVGQHRMWFVQSVDPDSAL

SEQ ID NO: 95099 - protein, 30 aa, Mycobacterium avium
DEPTRRVRLMRWGLVPPWAKAGPDGAPETK

SEQ ID NO: 95100 - protein, 30 aa, Mycobacterium avium
DEPTRRVRLMRWGLVPPWAKAGRDGAPETK

SEQ ID NO: 95101 - protein, 29 aa, Mycobacterium avium
DERLARISERWQRLGLNLNAADLFYRGER

SEQ ID NO: 95102 - protein, 21 aa, Mycobacterium avium
DESGRGKAARDCTPDEIATEV

SEQ ID NO: 95103 - protein, 22 aa, Mycobacterium avium
DESRFMDWVGWVHTTVHDRAHD

SEQ ID NO: 95104 - protein, 30 aa, Mycobacterium avium
DEVICAFGRIGSMFACADFGYVPDMITCAK

SEQ ID NO: 95105 - protein, 17 aa, Mycobacterium avium
DEVRRLLQRLIDRFPGG

SEQ ID NO: 95106 - protein, 21 aa, Mycobacterium avium
DEVSDRLAVESVRTVVYSAAP

SEQ ID NO: 95107 - protein, 33 aa, Mycobacterium avium
DEVSRALPGVEGFPADTFPVLVALMRNVFDGAA

SEQ ID NO: 95108 - protein, 17 aa, Mycobacterium avium
DEVVVPFDLPVLHRDDD

SEQ ID NO: 95109 - protein, 30 aa, Mycobacterium avium
DEWAEGRRYLGLDILTRCRLTTITDDNPDI

SEQ ID NO: 95110 - protein, 33 aa, Mycobacterium avium
DEWCVISIRSDDEWRRAAAVFDHAEWADDPRFG

SEQ ID NO: 95111 - protein, 33 aa, Mycobacterium avium
DEWCVISIRSDDEWRRAASVFDHAEWADDPRFG

SEQ ID NO: 95112 - protein, 34 aa, Mycobacterium avium
DEWCVISIRSDDEWRRAASVFDHAEWADDPRFGT

SEQ ID NO: 95113 - protein, 24 aa, Mycobacterium avium
DEYRKLDEEFVWYGRIPRAKLADY

SEQ ID NO: 95114 - protein, 24 aa, Mycobacterium avium
DEYRKLDEEFVWYGRIPRAKLAKY

SEQ ID NO: 95115 - protein, 22 aa, Mycobacterium avium
DFAADLKDLYAAVKALNDNRRN

SEQ ID NO: 95116 - protein, 25 aa, Mycobacterium avium
DFADLYAEPTLRSWQRLFDAAPPVQ

SEQ ID NO: 95117 - protein, 25 aa, Mycobacterium avium
DFCDPEVVEALKFHLRDLAVTFRFG

SEQ ID NO: 95118 - protein, 22 aa, Mycobacterium avium
DFCKWGGIAALAACAGPPDGKA

SEQ ID NO: 95119 - protein, 22 aa, Mycobacterium avium
DFCKWGGIAALAACAGPPHGKA

SEQ ID NO: 95120 - protein, 24 aa, Mycobacterium avium
DFLPHALAAAGGRPVFLAGGIATA

SEQ ID NO: 95121 - protein, 22 aa, Mycobacterium avium
DFLTPFMWRMDTFGRPHLEQTP

SEQ ID NO: 95122 - protein, 18 aa, Mycobacterium avium
DFPATSVRFFASSRSQGR

SEQ ID NO: 95123 - protein, 20 aa, Mycobacterium avium
DFPPRPGGIHSYLGEFVGRL

SEQ ID NO: 95124 - protein, 18 aa, Mycobacterium avium
DFPRMLKLTQELFGSDDS

SEQ ID NO: 95125 - protein, 23 aa, Mycobacterium avium
DFSCRTCGIEGLNYADGKCTCCV

SEQ ID NO: 95126 - protein, 20 aa, Mycobacterium avium
DFYRCGMLPASPEFTPEAGS

SEQ ID NO: 95127 - protein, 21 aa, Mycobacterium avium
DGADLKPAYTVTGGAVPGEET

SEQ ID NO: 95128 - protein, 19 aa, Mycobacterium avium
DGAFGFSGMEWDTLVRHRV

SEQ ID NO: 95129 - protein, 17 aa, Mycobacterium avium
DGAFRLGPVHIDVVAGG

SEQ ID NO: 95130 - protein, 20 aa, Mycobacterium avium
DGAGGLARCEVEHAGRDGLR

SEQ ID NO: 95131 - protein, 17 aa, Mycobacterium avium
DGAQKVMRLVDALEDSD

SEQ ID NO: 95132 - protein, 22 aa, Mycobacterium avium
DGAQWSRIRLADRAHLEPWEPS

SEQ ID NO: 95133 - protein, 17 aa, Mycobacterium avium
DGARLMAERGRLFGGLP

SEQ ID NO: 95134 - protein, 25 aa, Mycobacterium avium
DGCGCRKPRPGLILAAAEALGVPAR

SEQ ID NO: 95135 - protein, 33 aa, Mycobacterium avium
DGDDDWLIARWGCLRAANLFWGCGDAEAARREA

SEQ ID NO: 95136 - protein, 33 aa, Mycobacterium avium
DGDDDWLIARWGCLRAANLFWGCGDVEAARREA

SEQ ID NO: 95137 - protein, 34 aa, Mycobacterium avium
DGDDDWLIARWGCLRAANLFWGCGDVEAARREAD

SEQ ID NO: 95138 - protein, 18 aa, Mycobacterium avium
DGEQFIVEFDLPGIDEQS

SEQ ID NO: 95139 - protein, 21 aa, Mycobacterium avium
DGFVPFPAERAAAYRAAGLWT

SEQ ID NO: 95140 - protein, 34 aa, Mycobacterium avium
DGFVPFPAERAAAYRAAGLWTGRALDTILTDAAR

SEQ ID NO: 95141 - protein, 22 aa, Mycobacterium avium
DGFVSAPAHGRCEVVCFSADHT

SEQ ID NO: 95142 - protein, 20 aa, Mycobacterium avium
DGFWDDIFRELSIPYLPIRW

SEQ ID NO: 95143 - protein, 25 aa, Mycobacterium avium
DGGAELRAAFTDRFVPALQAFSPEL

SEQ ID NO: 95144 - protein, 26 aa, Mycobacterium avium
DGGAELRAAFTDRIVPALQAFSPELI

SEQ ID NO: 95145 - protein, 17 aa, Mycobacterium avium
DGGCTESVFTIKVPDDE

SEQ ID NO: 95146 - protein, 21 aa, Mycobacterium avium
DGGCTESVFTIKVPDDEWEDK

SEQ ID NO: 95147 - protein, 19 aa, Mycobacterium avium
DGGGIGIDLYGLDLDYQGL

SEQ ID NO: 95148 - protein, 18 aa, Mycobacterium avium
DGGLWRRSAVTLRAARAG

SEQ ID NO: 95149 - protein, 32 aa, Mycobacterium avium
DGGRIPLGRYIRPRVEVELAFVMGEQLSGPGV

SEQ ID NO: 95150 - protein, 19 aa, Mycobacterium avium
DGGVPCARVLAVDATSLTL

SEQ ID NO: 95151 - protein, 17 aa, Mycobacterium avium
DGGYWTAQVRLMPDSWG

SEQ ID NO: 95152 - protein, 26 aa, Mycobacterium avium
DGHPVPGVYVTGWIKRGPHGVIGTNR

SEQ ID NO: 95153 - protein, 21 aa, Mycobacterium avium
DGIGLALICHRIGDVYNALAS

SEQ ID NO: 95154 - protein, 22 aa, Mycobacterium avium
DGIGLALICHRIGDVYNALASG

SEQ ID NO: 95155 - protein, 23 aa, Mycobacterium avium
DGIVECREALAFPGSPERVVLLR

SEQ ID NO: 95156 - protein, 25 aa, Mycobacterium avium
DGKDAGDLCGMPATGVIATRDIGAA

SEQ ID NO: 95157 - protein, 21 aa, Mycobacterium avium
DGKPLRAGDIAVIVERHRDAQ

SEQ ID NO: 95158 - protein, 22 aa, Mycobacterium avium
DGLARLVGHVDVALAQHVLPFP

SEQ ID NO: 95159 - protein, 29 aa, Mycobacterium avium
DGLEKCIGCELCAWACPADAIFVESADNT

SEQ ID NO: 95160 - protein, 20 aa, Mycobacterium avium
DGLFPRLGVVDGDDALARCP

SEQ ID NO: 95161 - protein, 18 aa, Mycobacterium avium
DGLGMALVCRRVATIYSA

SEQ ID NO: 95162 - protein, 17 aa, Mycobacterium avium
DGLGRAWNAGTCCGEPA

SEQ ID NO: 95163 - protein, 18 aa, Mycobacterium avium
DGLHALVITGGYDLDPAG

SEQ ID NO: 95164 - protein, 17 aa, Mycobacterium avium
DGLLVPIHWGTFRLAPH

SEQ ID NO: 95165 - protein, 17 aa, Mycobacterium avium
DGLPVLFDSGIRSGADV

SEQ ID NO: 95166 - protein, 19 aa, Mycobacterium avium
DGLQIEAPIPLSAKLELLA

SEQ ID NO: 95167 - protein, 17 aa, Mycobacterium avium
DGMRADLVVARAAVAHA

SEQ ID NO: 95168 - protein, 17 aa, Mycobacterium avium
DGMRADLVVARTAVAHA

SEQ ID NO: 95169 - protein, 23 aa, Mycobacterium avium
DGMSELRGWLSPELRATLEAVLA

SEQ ID NO: 95170 - protein, 24 aa, Mycobacterium avium
DGMSELRGWLTPELRATLEAVLAK

SEQ ID NO: 95171 - protein, 19 aa, Mycobacterium avium
DGPIDLVLLPGPSIPIDSV

SEQ ID NO: 95172 - protein, 20 aa, Mycobacterium avium
DGPLKAPARVLPPINNRGVV

SEQ ID NO: 95173 - protein, 19 aa, Mycobacterium avium
DGQAILPVNGHFRCTCSCG

SEQ ID NO: 95174 - protein, 30 aa, Mycobacterium avium
DGQIKVAIDEFVRWTTPVMTFRRTATQDTE

SEQ ID NO: 95175 - protein, 23 aa, Mycobacterium avium
DGQMLRAAYTLRRDDDDWGQAGT

SEQ ID NO: 95176 - protein, 22 aa, Mycobacterium avium
DGRAWANYRLTSRSLTIAGGTT

SEQ ID NO: 95177 - protein, 19 aa, Mycobacterium avium
DGRGPVLVHALEGFSDAGH

SEQ ID NO: 95178 - protein, 19 aa, Mycobacterium avium
DGRLRRVPPGVVGELYVAG

SEQ ID NO: 95179 - protein, 19 aa, Mycobacterium avium
DGRSIEIIGRYHAKEDPSL

SEQ ID NO: 95180 - protein, 17 aa, Mycobacterium avium
DGRWVVSIRCAQLSADR

SEQ ID NO: 95181 - protein, 17 aa, Mycobacterium avium
DGSEYRGRYGISVRQLE

SEQ ID NO: 95182 - protein, 17 aa, Mycobacterium avium
DGSEYRGRYGLSVRQLE

SEQ ID NO: 95183 - protein, 35 aa, Mycobacterium avium
DGSEYRGRYGLSVRQLEDWHRPRLEVLADADADVL

SEQ ID NO: 95184 - protein, 20 aa, Mycobacterium avium
DGSFRPSGWTRLWRLGLGSS

SEQ ID NO: 95185 - protein, 20 aa, Mycobacterium avium
DGSILPRPVAHLARDPLDPR

SEQ ID NO: 95186 - protein, 24 aa, Mycobacterium avium
DGSIPYQRFRGGEIAGLTAGLVGL

SEQ ID NO: 95187 - protein, 27 aa, Mycobacterium avium
DGSPLRELAGWPALLRGKLSVTLDLHD

SEQ ID NO: 95188 - protein, 27 aa, Mycobacterium avium
DGSPLRELASWPALLRGKRSVTLDVHN

SEQ ID NO: 95189 - protein, 27 aa, Mycobacterium avium
DGSPQVSWRVCVCYTGSVGSQVIRLLS

SEQ ID NO: 95190 - protein, 21 aa, Mycobacterium avium
DGTAITRAVPWFDDKSADEYV

SEQ ID NO: 95191 - protein, 22 aa, Mycobacterium avium
DGTAKPGTWLYGRDVLDLIRLG

SEQ ID NO: 95192 - protein, 27 aa, Mycobacterium avium
DGTALCGAPVRIPLLFGGRSAATVRRV

SEQ ID NO: 95193 - protein, 22 aa, Mycobacterium avium
DGTCAAEWGIIHGACASDELPS

SEQ ID NO: 95194 - protein, 20 aa, Mycobacterium avium
DGTCPVRLFLPDGSGPWPGV

SEQ ID NO: 95195 - protein, 25 aa, Mycobacterium avium
DGTRAGLWDDLRKAFNTTRALSVPF

SEQ ID NO: 95196 - protein, 17 aa, Mycobacterium avium
DGTRPMATITFTGATAL

SEQ ID NO: 95197 - protein, 21 aa, Mycobacterium avium
DGTRVAYKVFNRADNPEPGAP

SEQ ID NO: 95198 - protein, 21 aa, Mycobacterium avium
DGTRVAYKVLNRADNPQPGGL

SEQ ID NO: 95199 - protein, 17 aa, Mycobacterium avium
DGVIPPNRSLDCVDDEL

SEQ ID NO: 95200 - protein, 19 aa, Mycobacterium avium
DGVLIPFGVDRSGSPLMLD

SEQ ID NO: 95201 - protein, 18 aa, Mycobacterium avium
DGVLRLRIPVAEKAKPRK

SEQ ID NO: 95202 - protein, 26 aa, Mycobacterium avium
DGVQAALCFPSFPGFGGGTFVRAEVN

SEQ ID NO: 95203 - protein, 27 aa, Mycobacterium avium
DGVQSALCFPSFPGFGGGTFQRAEDKD

SEQ ID NO: 95204 - protein, 25 aa, Mycobacterium avium
DGVRFRPALTVSRGEIDAAIGAVRD

SEQ ID NO: 95205 - protein, 18 aa, Mycobacterium avium
DGVVFEFVERPLKYFSPA

SEQ ID NO: 95206 - protein, 22 aa, Mycobacterium avium
DGVVPLQFLFSGTVFRAGARGF

SEQ ID NO: 95207 - protein, 20 aa, Mycobacterium avium
DGWFRSGDRGHLRPDGRIVV

SEQ ID NO: 95208 - protein, 21 aa, Mycobacterium avium
DGWIRFTGRLGDLIKTGGGTN

SEQ ID NO: 95209 - protein, 24 aa, Mycobacterium avium
DGWSMPILLGEIFAAYYGQRLPAP

SEQ ID NO: 95210 - protein, 21 aa, Mycobacterium avium
DGYFSRPGLARVVAGKVSPSP

SEQ ID NO: 95211 - protein, 22 aa, Mycobacterium avium
DGYFSRPGLARVVAGKVSPSPP

SEQ ID NO: 95212 - protein, 23 aa, Mycobacterium avium
DGYFSRPGLARVVAGKVSPSPPR

SEQ ID NO: 95213 - protein, 19 aa, Mycobacterium avium
DGYHPPRRFVDSIGGDGLA

SEQ ID NO: 95214 - protein, 17 aa, Mycobacterium avium
DGYRLTGTLQIRGAARN

SEQ ID NO: 95215 - protein, 19 aa, Mycobacterium avium
DGYRLTGTLQIRGAARNHV

SEQ ID NO: 95216 - protein, 17 aa, Mycobacterium avium
DGYRLTGTLQIRGTARN

SEQ ID NO: 95217 - protein, 25 aa, Mycobacterium avium
DHAEAITLVVRFLHLQHRGAERDTG

SEQ ID NO: 95218 - protein, 17 aa, Mycobacterium avium
DHAEAREKFGFLLEAFT

SEQ ID NO: 95219 - protein, 19 aa, Mycobacterium avium
DHAVEAWVIESCDGTVLYV

SEQ ID NO: 95220 - protein, 18 aa, Mycobacterium avium
DHFTICLCVDHLHIDAMF

SEQ ID NO: 95221 - protein, 22 aa, Mycobacterium avium
DHGKAPVRRACYAADRTGHMIL

SEQ ID NO: 95222 - protein, 25 aa, Mycobacterium avium
DHGQAVSSLFSWTGDATKEPKQASP

SEQ ID NO: 95223 - protein, 19 aa, Mycobacterium avium
DHNMVWDFWTSCPETAHLV

SEQ ID NO: 95224 - protein, 34 aa, Mycobacterium avium
DHPEELADAFAKAWYKLLHRDMGPVSRFLGPWVP

SEQ ID NO: 95225 - protein, 26 aa, Mycobacterium avium
DHRGFTWRSFCARDFAAHGLNLDVAQ

SEQ ID NO: 95226 - protein, 22 aa, Mycobacterium avium
DHRTSGRLEIRYEQRGPEAWRL

SEQ ID NO: 95227 - protein, 26 aa, Mycobacterium avium
DHSRRLWTVLIFMLWHAIFVEHSVVP

SEQ ID NO: 95228 - protein, 19 aa, Mycobacterium avium
DHVLRLGLHRLPIDQFGHL

SEQ ID NO: 95229 - protein, 20 aa, Mycobacterium avium
DHYRMLAVQRYGRAVTADEP

SEQ ID NO: 95230 - protein, 20 aa, Mycobacterium avium
DIAGAVAWLVSDEAKFITGV

SEQ ID NO: 95231 - protein, 17 aa, Mycobacterium avium
DIAGLLGQELGRQRDTL

SEQ ID NO: 95232 - protein, 24 aa, Mycobacterium avium
DIAPRPGRIWLQITAFDDDRPGFG

SEQ ID NO: 95233 - protein, 17 aa, Mycobacterium avium
DIARADCQLVLADANSA

SEQ ID NO: 95234 - protein, 17 aa, Mycobacterium avium
DICAPCCGVDLDFSCRT

SEQ ID NO: 95235 - protein, 24 aa, Mycobacterium avium
DIDELRRLPAEQVRQASFDQCGVN

SEQ ID NO: 95236 - protein, 18 aa, Mycobacterium avium
DIDIRWRTVTFALVTHSE

SEQ ID NO: 95237 - protein, 29 aa, Mycobacterium avium
DIDTGYSRPRGRVFPIGSFGNTGFTGTTL

SEQ ID NO: 95238 - protein, 17 aa, Mycobacterium avium
DIEAALAGLPSWDGRTL

SEQ ID NO: 95239 - protein, 22 aa, Mycobacterium avium
DIEKRYGCRIVTMYGLTEAFPI

SEQ ID NO: 95240 - protein, 18 aa, Mycobacterium avium
DIFRAPKSHLGWGHGVHV

SEQ ID NO: 95241 - protein, 24 aa, Mycobacterium avium
DIFRERKPHIGFGHGAHVCLGMHL

SEQ ID NO: 95242 - protein, 21 aa, Mycobacterium avium
DIFSCVRLVLDVLDPVPDPLP

SEQ ID NO: 95243 - protein, 24 aa, Mycobacterium avium
DIGELPAGLNPGGIEQWGISNFQI

SEQ ID NO: 95244 - protein, 18 aa, Mycobacterium avium
DIGRGRNGVLYAGEVNWE

SEQ ID NO: 95245 - protein, 24 aa, Mycobacterium avium
DIGRLRDGLGIAVPLGVPAAFTEE

SEQ ID NO: 95246 - protein, 25 aa, Mycobacterium avium
DIGSRIDPVLARSWLLVNGTHPDRF

SEQ ID NO: 95247 - protein, 18 aa, Mycobacterium avium
DIGWQVIDASGWSPARLD

SEQ ID NO: 95248 - protein, 21 aa, Mycobacterium avium
DIIACDICAPVSASVTYAPAT

SEQ ID NO: 95249 - protein, 17 aa, Mycobacterium avium
DIIKLKPDCVVYAAMSD

SEQ ID NO: 95250 - protein, 20 aa, Mycobacterium avium
DILDYCFAQIMGVSPSDLGL

SEQ ID NO: 95251 - protein, 27 aa, Mycobacterium avium
DILGQAGTAWQIFPNFQIGQGLTSALC

SEQ ID NO: 95252 - protein, 20 aa, Mycobacterium avium
DINDRLAIRASDSVLAVSQH

SEQ ID NO: 95253 - protein, 20 aa, Mycobacterium avium
DIPEALGLDQRASFYEDTGA

SEQ ID NO: 95254 - protein, 20 aa, Mycobacterium avium
DIPEALGLDQRASFYEETGA

SEQ ID NO: 95255 - protein, 28 aa, Mycobacterium avium
DIPWFPKDLQAWSVRWVILHVINELARH

SEQ ID NO: 95256 - protein, 17 aa, Mycobacterium avium
DIRLVRFDGTAGAPGEL

SEQ ID NO: 95257 - protein, 21 aa, Mycobacterium avium
DIRRGHDAIRAFYAGFQDAKK

SEQ ID NO: 95258 - protein, 18 aa, Mycobacterium avium
DISRRPAEFCSGHGTQIF

SEQ ID NO: 95259 - protein, 20 aa, Mycobacterium avium
DITATPAWDALRKHHDRIGD

SEQ ID NO: 95260 - protein, 20 aa, Mycobacterium avium
DITATPAWDALRKHHDRIGG

SEQ ID NO: 95261 - protein, 19 aa, Mycobacterium avium
DITIALGFTEPECGSDVAA

SEQ ID NO: 95262 - protein, 20 aa, Mycobacterium avium
DIVLQCFRGKVAERAKIDEA

SEQ ID NO: 95263 - protein, 19 aa, Mycobacterium avium
DKAGLWPYLEKLGFYLVGY

SEQ ID NO: 95264 - protein, 24 aa, Mycobacterium avium
DKALLARIGDAFLALPEGFTAHPR

SEQ ID NO: 95265 - protein, 19 aa, Mycobacterium avium
DKAWECPLHGSRFAPDGTL

SEQ ID NO: 95266 - protein, 18 aa, Mycobacterium avium
DKDLALLCVKAWNDFYID

SEQ ID NO: 95267 - protein, 22 aa, Mycobacterium avium
DKDSRVLVEFNVDRSLALDQGT

SEQ ID NO: 95268 - protein, 18 aa, Mycobacterium avium
DKEALQWIVGQLLDALDA

SEQ ID NO: 95269 - protein, 23 aa, Mycobacterium avium
DKFYPEAMRAIGLPKLVEDERFA

SEQ ID NO: 95270 - protein, 18 aa, Mycobacterium avium
DKGGHTWPGGKQYLPAAV

SEQ ID NO: 95271 - protein, 21 aa, Mycobacterium avium
DKGKTLHWVIEHLRRSGSGAL

SEQ ID NO: 95272 - protein, 24 aa, Mycobacterium avium
DKGNACLSCGHFATDITHAAELRD

SEQ ID NO: 95273 - protein, 20 aa, Mycobacterium avium
DKHKLALEREMLGLYVSGHP

SEQ ID NO: 95274 - protein, 24 aa, Mycobacterium avium
DKINRRALDVARAIVHHITSAGYT

SEQ ID NO: 95275 - protein, 24 aa, Mycobacterium avium
DKLGPFCAALAYLCDKDMVLPMNS

SEQ ID NO: 95276 - protein, 20 aa, Mycobacterium avium
DKLIWAEGFSLPLTQSPGDV

SEQ ID NO: 95277 - protein, 22 aa, Mycobacterium avium
DKLRFPAPVPVDSRIRAGAELL

SEQ ID NO: 95278 - protein, 21 aa, Mycobacterium avium
DKLRPKVSCITRLAHPVDGRR

SEQ ID NO: 95279 - protein, 24 aa, Mycobacterium avium
DKQMALCALAHFLNLDRGGSYALA

SEQ ID NO: 95280 - protein, 18 aa, Mycobacterium avium
DKSEIQAAWFGELSTTDG

SEQ ID NO: 95281 - protein, 24 aa, Mycobacterium avium
DKSRGMGRNGPWIGGKLTERPSAI

SEQ ID NO: 95282 - protein, 19 aa, Mycobacterium avium
DKVFTRWNVEYTPVPLHQL

SEQ ID NO: 95283 - protein, 27 aa, Mycobacterium avium
DLAAGLFRAAPWPGVAPLTLFGYSMGG

SEQ ID NO: 95284 - protein, 25 aa, Mycobacterium avium
DLACARASIRTGVPFFVGTLSADPM

SEQ ID NO: 95285 - protein, 22 aa, Mycobacterium avium
DLAELDRRLGWDAVSGTVQRWK

SEQ ID NO: 95286 - protein, 19 aa, Mycobacterium avium
DLAGCKMLVTAGGTREPVD

SEQ ID NO: 95287 - protein, 25 aa, Mycobacterium avium
DLAHGWIPSGIALPAGVRLLEPERR

SEQ ID NO: 95288 - protein, 26 aa, Mycobacterium avium
DLAHGWIPSGIALPAGVRLLEPERRS

SEQ ID NO: 95289 - protein, 25 aa, Mycobacterium avium
DLAIAIEVFGRVWLDGGAPGYRVRV

SEQ ID NO: 95290 - protein, 27 aa, Mycobacterium avium
DLAKRAHHRPVWVKGFGEHVPFKTPTY

SEQ ID NO: 95291 - protein, 18 aa, Mycobacterium avium
DLAKRCGKPLMIHNREAD

SEQ ID NO: 95292 - protein, 20 aa, Mycobacterium avium
DLALTPGFHAIQMPGGPGQT

SEQ ID NO: 95293 - protein, 17 aa, Mycobacterium avium
DLCYSEFRNGSGFWPTP

SEQ ID NO: 95294 - protein, 30 aa, Mycobacterium avium
DLDAWTTNHWDWFDPFWAHRLLWPDREYRP

SEQ ID NO: 95295 - protein, 17 aa, Mycobacterium avium
DLDKLDFDCVFIDCPPS

SEQ ID NO: 95296 - protein, 29 aa, Mycobacterium avium
DLDLSIPRLKRGLMLGTHWGQLDQPLVPE

SEQ ID NO: 95297 - protein, 19 aa, Mycobacterium avium
DLEKFLAWEDMILHQSGVG

SEQ ID NO: 95298 - protein, 22 aa, Mycobacterium avium
DLELWLGEQVAKGFASHGESWS

SEQ ID NO: 95299 - protein, 25 aa, Mycobacterium avium
DLELWLGERVPKGFASHGESWSLAL

SEQ ID NO: 95300 - protein, 28 aa, Mycobacterium avium
DLERIYWAFCTHLGYLVSNNSFGHRMVR

SEQ ID NO: 95301 - protein, 25 aa, Mycobacterium avium
DLGPEHEPRIALRADMDALPMAERT

SEQ ID NO: 95302 - protein, 17 aa, Mycobacterium avium
DLGSGLVPVPATRPLVA

SEQ ID NO: 95303 - protein, 17 aa, Mycobacterium avium
DLHALLITEQVSVLSQT

SEQ ID NO: 95304 - protein, 23 aa, Mycobacterium avium
DLHCGGRPMLPLDAERRADATLD

SEQ ID NO: 95305 - protein, 24 aa, Mycobacterium avium
DLHLRRHKWTRLGAYAQSKLAVML

SEQ ID NO: 95306 - protein, 19 aa, Mycobacterium avium
DLIARRGYDGFTIEALAAR

SEQ ID NO: 95307 - protein, 23 aa, Mycobacterium avium
DLIKAAVRRFGRDGTDGYDLVLR

SEQ ID NO: 95308 - protein, 24 aa, Mycobacterium avium
DLIKAAVRRFGRDGTDGYDLVLRS

SEQ ID NO: 95309 - protein, 26 aa, Mycobacterium avium
DLINRWYYNPDYFKIMSSCANSQMGV

SEQ ID NO: 95310 - protein, 22 aa, Mycobacterium avium
DLKERREGDVLGRNQSGRAVTL

SEQ ID NO: 95311 - protein, 21 aa, Mycobacterium avium
DLKIALSEGGTGWIPYFLERA

SEQ ID NO: 95312 - protein, 17 aa, Mycobacterium avium
DLLARMRGGIDKRRRAE

SEQ ID NO: 95313 - protein, 17 aa, Mycobacterium avium
DLLCFVHGGAGLLHTEF

SEQ ID NO: 95314 - protein, 18 aa, Mycobacterium avium
DLLIVLFGIALAWANSPH

SEQ ID NO: 95315 - protein, 26 aa, Mycobacterium avium
DLLPKIFYVNWFRRGDDGTFLWPGFG

SEQ ID NO: 95316 - protein, 19 aa, Mycobacterium avium
DLLRIDLMRSLGVGINDIQ

SEQ ID NO: 95317 - protein, 17 aa, Mycobacterium avium
DLLSCSGVRVLALPVSG

SEQ ID NO: 95318 - protein, 18 aa, Mycobacterium avium
DLLSCSGVRVLALPVSGT

SEQ ID NO: 95319 - protein, 24 aa, Mycobacterium avium
DLLTGWRDAWELGRTARDDALALL

SEQ ID NO: 95320 - protein, 25 aa, Mycobacterium avium
DLLTGWRDAWELGRTVRDDALALLS

SEQ ID NO: 95321 - protein, 20 aa, Mycobacterium avium
DLLVRFETAVRWARAHPQQW

SEQ ID NO: 95322 - protein, 22 aa, Mycobacterium avium
DLPDRLAGVIYPPGTAAKRLAQ

SEQ ID NO: 95323 - protein, 22 aa, Mycobacterium avium
DLRADMQLVIAFRDDEDGFVVP

SEQ ID NO: 95324 - protein, 20 aa, Mycobacterium avium
DLRARLARTRWPEAECVDDW

SEQ ID NO: 95325 - protein, 18 aa, Mycobacterium avium
DLRAWLTTVVSRLGLDRL

SEQ ID NO: 95326 - protein, 28 aa, Mycobacterium avium
DLRDEPRWPRYAPAAVEHGVLSSLSFKL

SEQ ID NO: 95327 - protein, 21 aa, Mycobacterium avium
DLREACTRRDVLLIFDEIATG

SEQ ID NO: 95328 - protein, 22 aa, Mycobacterium avium
DLREIRAAIKRALVRHHDEPDE

SEQ ID NO: 95329 - protein, 25 aa, Mycobacterium avium
DLRFKGRRIRSGRLLIFSPYVTHRL

SEQ ID NO: 95330 - protein, 20 aa, Mycobacterium avium
DLRGLASLRLQGTRLDDAPD

SEQ ID NO: 95331 - protein, 19 aa, Mycobacterium avium
DLRHDWPEALRQAGFDASA

SEQ ID NO: 95332 - protein, 22 aa, Mycobacterium avium
DLRLMPRYVRTITGWQLSRVEE

SEQ ID NO: 95333 - protein, 23 aa, Mycobacterium avium
DLRLMPRYVRTITGWQLSRVEEA

SEQ ID NO: 95334 - protein, 17 aa, Mycobacterium avium
DLRPEWAEHDLSGLTEQ

SEQ ID NO: 95335 - protein, 26 aa, Mycobacterium avium
DLRREPRWPRYAPAAVQLGVLSSLSF

SEQ ID NO: 95336 - protein, 18 aa, Mycobacterium avium
DLRVCGRGFRALATAPEV

SEQ ID NO: 95337 - protein, 19 aa, Mycobacterium avium
DLSQVLAWPTQHLTDAARH

SEQ ID NO: 95338 - protein, 19 aa, Mycobacterium avium
DLSRTVGWFTAKYPVALRL

SEQ ID NO: 95339 - protein, 24 aa, Mycobacterium avium
DLSTLRFALSGAEPVEPADVEDLL

SEQ ID NO: 95340 - protein, 19 aa, Mycobacterium avium
DLSTVLGYVPTFPFTQNFI

SEQ ID NO: 95341 - protein, 24 aa, Mycobacterium avium
DLTAAIARCRRLLDLDADPEAVDE

SEQ ID NO: 95342 - protein, 25 aa, Mycobacterium avium
DLTAAIARCRRLLDLDADPEAVDEA

SEQ ID NO: 95343 - protein, 23 aa, Mycobacterium avium
DLTEFRFVGTFATSLVEEKILTH

SEQ ID NO: 95344 - protein, 19 aa, Mycobacterium avium
DLTRGMWVSGPIDPAQPNS

SEQ ID NO: 95345 - protein, 31 aa, Mycobacterium avium
DLTTYWAGAYLTCYLGAFGADIVKVESIQRP

SEQ ID NO: 95346 - protein, 31 aa, Mycobacterium avium
DLTWLLSRWTCVFGTPACRGTVAGRPDDGCC

SEQ ID NO: 95347 - protein, 18 aa, Mycobacterium avium
DLVALRREICSRFIRQPG

SEQ ID NO: 95348 - protein, 18 aa, Mycobacterium avium
DLVCLCVIGDADIDELTG

SEQ ID NO: 95349 - protein, 21 aa, Mycobacterium avium
DLVFNDFLIVVARMRALDPVT

SEQ ID NO: 95350 - protein, 24 aa, Mycobacterium avium
DLVLRRLTEALARDRTRHQVSEVT

SEQ ID NO: 95351 - protein, 24 aa, Mycobacterium avium
DLVRAEAFAHAFGFTTVLRSDDEL

SEQ ID NO: 95352 - protein, 18 aa, Mycobacterium avium
DLVRGRVALSVRRHEPVG

SEQ ID NO: 95353 - protein, 21 aa, Mycobacterium avium
DLVRRCRMVMAGEPLPKVEPA

SEQ ID NO: 95354 - protein, 19 aa, Mycobacterium avium
DLVSMFAPITRWAAGIPTA

SEQ ID NO: 95355 - protein, 18 aa, Mycobacterium avium
DMAERVAALAAHAPPERL

SEQ ID NO: 95356 - protein, 23 aa, Mycobacterium avium
DMASRIADHLGYRVIAVDLVPER

SEQ ID NO: 95357 - protein, 24 aa, Mycobacterium avium
DMCPHGCYPCADGAWISVAVATDA

SEQ ID NO: 95358 - protein, 23 aa, Mycobacterium avium
DMDERLVAMIARIVEAYGKYSSS

SEQ ID NO: 95359 - protein, 20 aa, Mycobacterium avium
DMFVNPWGLWWQEITASDIC

SEQ ID NO: 95360 - protein, 24 aa, Mycobacterium avium
DMHAAMLYDHFTAMMIMALEDFGF

SEQ ID NO: 95361 - protein, 25 aa, Mycobacterium avium
DMHLYLKRAHVFRHLFGEPTDVLAE

SEQ ID NO: 95362 - protein, 17 aa, Mycobacterium avium
DMIRAPLLTSLPFMPFD

SEQ ID NO: 95363 - protein, 19 aa, Mycobacterium avium
DMLCVPTMAVAMVESPARA

SEQ ID NO: 95364 - protein, 25 aa, Mycobacterium avium
DMLRAWRIGVEVVVECAREAARRLG

SEQ ID NO: 95365 - protein, 24 aa, Mycobacterium avium
DMLREAIKIIRELFGGQLVDFTGD

SEQ ID NO: 95366 - protein, 32 aa, Mycobacterium avium
DMTIPRLKRTLLAGTRWGDPDAPLVPAPGDPW

SEQ ID NO: 95367 - protein, 24 aa, Mycobacterium avium
DNAEAREKFGFLLEAFTFGAPPHG

SEQ ID NO: 95368 - protein, 21 aa, Mycobacterium avium
DNAPRPAGLRNYGPTPTADDV

SEQ ID NO: 95369 - protein, 17 aa, Mycobacterium avium
DNARRFMGLPIANPDPE

SEQ ID NO: 95370 - protein, 18 aa, Mycobacterium avium
DNGQNWGIFPTSIRTASP

SEQ ID NO: 95371 - protein, 22 aa, Mycobacterium avium
DNMSNPALINMGRIIAGRTDVT

SEQ ID NO: 95372 - protein, 23 aa, Mycobacterium avium
DNPRGMSYLVVRGRRGGSAMAAA

SEQ ID NO: 95373 - protein, 24 aa, Mycobacterium avium
DNSPQRFQVTASRFGHSVDVAAAV

SEQ ID NO: 95374 - protein, 23 aa, Mycobacterium avium
DNSQFGFGVWNLRGQQWDFLKNR

SEQ ID NO: 95375 - protein, 17 aa, Mycobacterium avium
DNSRVSLSFYGKRPGPG

SEQ ID NO: 95376 - protein, 18 aa, Mycobacterium avium
DNSYVHNLIHGFILADQH

SEQ ID NO: 95377 - protein, 22 aa, Mycobacterium avium
DNVWKNAPLVRALREPQSAGAC

SEQ ID NO: 95378 - protein, 22 aa, Mycobacterium avium
DNWITFGSALGMDVTPFDAVRT

SEQ ID NO: 95379 - protein, 25 aa, Mycobacterium avium
DPAEARTALAQRLPVYMVPAAVVAL

SEQ ID NO: 95380 - protein, 24 aa, Mycobacterium avium
DPAEARTALAQRLPVYMVPTAVVA

SEQ ID NO: 95381 - protein, 19 aa, Mycobacterium avium
DPAIIKLKLQVHARTPQVL

SEQ ID NO: 95382 - protein, 26 aa, Mycobacterium avium
DPALHGFELRLGLLRAGGGRLDALGQ

SEQ ID NO: 95383 - protein, 28 aa, Mycobacterium avium
DPAQGLGGWFRLGLVANQQTAWVHALVC

SEQ ID NO: 95384 - protein, 30 aa, Mycobacterium avium
DPATLADLAFAWRVCRAVKSNAIVIAAGGA

SEQ ID NO: 95385 - protein, 20 aa, Mycobacterium avium
DPAVGAAWPKLVQAKDGASS

SEQ ID NO: 95386 - protein, 22 aa, Mycobacterium avium
DPAWSLQCDIARQVLALDGVPA

SEQ ID NO: 95387 - protein, 18 aa, Mycobacterium avium
DPCHQCMGDGRVRARREI

SEQ ID NO: 95388 - protein, 18 aa, Mycobacterium avium
DPDAWARLIDAHQVTVLH

SEQ ID NO: 95389 - protein, 21 aa, Mycobacterium avium
DPDFAGSCYVHVQKYLHDMSA

SEQ ID NO: 95390 - protein, 21 aa, Mycobacterium avium
DPDPFADPGWFLTDDLGAVDD

SEQ ID NO: 95391 - protein, 24 aa, Mycobacterium avium
DPDPRAADIVQTWAHVLDQLERDP

SEQ ID NO: 95392 - protein, 21 aa, Mycobacterium avium
DPDQGWPTWWSDQFGNQGWDY

SEQ ID NO: 95393 - protein, 24 aa, Mycobacterium avium
DPDSRIGTQLAYWEDALAGMPERL

SEQ ID NO: 95394 - protein, 24 aa, Mycobacterium avium
DPDSRIGTQLAYWQDALAGMPERL

SEQ ID NO: 95395 - protein, 20 aa, Mycobacterium avium
DPDYCIRDLYEAIEHGDHPR

SEQ ID NO: 95396 - protein, 17 aa, Mycobacterium avium
DPEEVDDGWVLTCQALP

SEQ ID NO: 95397 - protein, 18 aa, Mycobacterium avium
DPEIQRIVLLEALAVLGW

SEQ ID NO: 95398 - protein, 20 aa, Mycobacterium avium
DPERAANFASRMRVGTVNVN

SEQ ID NO: 95399 - protein, 24 aa, Mycobacterium avium
DPERGVLLRAVWLRPAGGDGVLLL

SEQ ID NO: 95400 - protein, 17 aa, Mycobacterium avium
DPERPHRSAVLAESLTS

SEQ ID NO: 95401 - protein, 19 aa, Mycobacterium avium
DPFGDWRAGPFESVSYGSA

SEQ ID NO: 95402 - protein, 20 aa, Mycobacterium avium
DPFGGPGRAPTMLVTDISLR

SEQ ID NO: 95403 - protein, 22 aa, Mycobacterium avium
DPFWACASELGLPLTFHSGTGY

SEQ ID NO: 95404 - protein, 24 aa, Mycobacterium avium
DPGERRRIRWGARAMLWQASSLKA

SEQ ID NO: 95405 - protein, 22 aa, Mycobacterium avium
DPGLGRKAPIYVIEDAPWSAFR

SEQ ID NO: 95406 - protein, 26 aa, Mycobacterium avium
DPGLPSARIDFMLADAVPVVTVTTAE

SEQ ID NO: 95407 - protein, 26 aa, Mycobacterium avium
DPGLVRWTGRYDMRYVEGAMPGRDAD

SEQ ID NO: 95408 - protein, 26 aa, Mycobacterium avium
DPGLVRWTGRYDMRYVEGAMPGRDEE

SEQ ID NO: 95409 - protein, 26 aa, Mycobacterium avium
DPGLVRWTGRYDMRYVEGAMPGRGED

SEQ ID NO: 95410 - protein, 24 aa, Mycobacterium avium
DPGPRAADIVQTWAHVLDQLERDP

SEQ ID NO: 95411 - protein, 18 aa, Mycobacterium avium
DPGRCLITPEAVRLPLAV

SEQ ID NO: 95412 - protein, 18 aa, Mycobacterium avium
DPGRRGGPATGGRQAGRD

SEQ ID NO: 95413 - protein, 24 aa, Mycobacterium avium
DPGSRIAAQLAYWQDALAGMPERL

SEQ ID NO: 95414 - protein, 18 aa, Mycobacterium avium
DPGTDWARYALKAPVMLV

SEQ ID NO: 95415 - protein, 17 aa, Mycobacterium avium
DPGWWRRAAELGWTGLL

SEQ ID NO: 95416 - protein, 22 aa, Mycobacterium avium
DPHHATAVLAWMGYDAPEFDDS

SEQ ID NO: 95417 - protein, 17 aa, Mycobacterium avium
DPHSVPVIQCFAPSRSP

SEQ ID NO: 95418 - protein, 18 aa, Mycobacterium avium
DPIGEVTGLYRWLGEQVS

SEQ ID NO: 95419 - protein, 17 aa, Mycobacterium avium
DPIIFDYVERLMRDEVQ

SEQ ID NO: 95420 - protein, 17 aa, Mycobacterium avium
DPIRDWVKLAVDRARNS

SEQ ID NO: 95421 - protein, 19 aa, Mycobacterium avium
DPIYGLGPRLAQLAAGVFF

SEQ ID NO: 95422 - protein, 23 aa, Mycobacterium avium
DPKKARCFLRAWMEVPREDRRLP

SEQ ID NO: 95423 - protein, 17 aa, Mycobacterium avium
DPKRLAIYFTKHSSPNM

SEQ ID NO: 95424 - protein, 21 aa, Mycobacterium avium
DPLGRLAIRRITDATNGADPL

SEQ ID NO: 95425 - protein, 21 aa, Mycobacterium avium
DPLGRLAIRRITDATNGVDPL

SEQ ID NO: 95426 - protein, 18 aa, Mycobacterium avium
DPLVPRQQRFSAYTRSLM

SEQ ID NO: 95427 - protein, 18 aa, Mycobacterium avium
DPLWERMDFAVAEANFLT

SEQ ID NO: 95428 - protein, 17 aa, Mycobacterium avium
DPMECAELLDWPAKLRL

SEQ ID NO: 95429 - protein, 25 aa, Mycobacterium avium
DPNGIPLWAGAAFKHASAGPAADII

SEQ ID NO: 95430 - protein, 26 aa, Mycobacterium avium
DPNGIPLWAGAAFKHASAGPAADIIA

SEQ ID NO: 95431 - protein, 25 aa, Mycobacterium avium
DPNGIPLWAGAAFKHASAGPAADIV

SEQ ID NO: 95432 - protein, 23 aa, Mycobacterium avium
DPNLGRLGGRITDAITGKELWQV

SEQ ID NO: 95433 - protein, 21 aa, Mycobacterium avium
DPNTIPLTFFRKASGSITGPF

SEQ ID NO: 95434 - protein, 24 aa, Mycobacterium avium
DPNTQLWACVDFDYLKKSDRQGAR

SEQ ID NO: 95435 - protein, 18 aa, Mycobacterium avium
DPPEDWSEANRFGMTARE

SEQ ID NO: 95436 - protein, 25 aa, Mycobacterium avium
DPQHRLLLETAWRAVEHCGTAPTDL

SEQ ID NO: 95437 - protein, 18 aa, Mycobacterium avium
DPQHRLLLETSWDAIEHA

SEQ ID NO: 95438 - protein, 19 aa, Mycobacterium avium
DPQHRLLLETSWDAIEHAG

SEQ ID NO: 95439 - protein, 21 aa, Mycobacterium avium
DPQMKFALAVYGSRGDVEPHA

SEQ ID NO: 95440 - protein, 24 aa, Mycobacterium avium
DPQQRLALETVWEGLERAGYSPAA

SEQ ID NO: 95441 - protein, 24 aa, Mycobacterium avium
DPQVPPRVAALPGPATALTGDGRG

SEQ ID NO: 95442 - protein, 25 aa, Mycobacterium avium
DPQVRGWLLGRRQRIAPGAAAEASP

SEQ ID NO: 95443 - protein, 25 aa, Mycobacterium avium
DPQVRGWLLGRRQRIAPGGAAEASP

SEQ ID NO: 95444 - protein, 24 aa, Mycobacterium avium
DPRGLDCLRTVIYSAAPMTVHTLR

SEQ ID NO: 95445 - protein, 31 aa, Mycobacterium avium
DPRTRYGPPSAVLRRHVRVLLAAAHTTGDLD

SEQ ID NO: 95446 - protein, 31 aa, Mycobacterium avium
DPRTRYGPPSAVLRRHVRVLLAATHTTGDLD

SEQ ID NO: 95447 - protein, 20 aa, Mycobacterium avium
DPSISIGRDRLFLFMSAERW

SEQ ID NO: 95448 - protein, 21 aa, Mycobacterium avium
DPSPLWKSYVDQGWTELNDPE

SEQ ID NO: 95449 - protein, 25 aa, Mycobacterium avium
DPTEVRWWEVWLLNRDRREQARFSD

SEQ ID NO: 95450 - protein, 17 aa, Mycobacterium avium
DPVAPRLADTGRYEVFA

SEQ ID NO: 95451 - protein, 21 aa, Mycobacterium avium
DPVFIKQLLDIGAQNIIVPMI

SEQ ID NO: 95452 - protein, 22 aa, Mycobacterium avium
DPVWLRWNYATVVWGIATAHEL

SEQ ID NO: 95453 - protein, 17 aa, Mycobacterium avium
DPWEVNRTLQAGRPAQI

SEQ ID NO: 95454 - protein, 19 aa, Mycobacterium avium
DPYAKLFLEAAGDGIWRVY

SEQ ID NO: 95455 - protein, 24 aa, Mycobacterium avium
DQAAALCPVSRLFAGATISVDAEL

SEQ ID NO: 95456 - protein, 23 aa, Mycobacterium avium
DQARLDELAGLYAEGAVSAREWI

SEQ ID NO: 95457 - protein, 20 aa, Mycobacterium avium
DQFYLFACCHHIVIDGTGVG

SEQ ID NO: 95458 - protein, 19 aa, Mycobacterium avium
DQGKALALYHTKRLASPAQ

SEQ ID NO: 95459 - protein, 19 aa, Mycobacterium avium
DQGKALALYHTKRLASPGQ

SEQ ID NO: 95460 - protein, 24 aa, Mycobacterium avium
DQIAGLKPDLIVAINAGLDADTYQ

SEQ ID NO: 95461 - protein, 18 aa, Mycobacterium avium
DQIISFEAFDAFKKERWP

SEQ ID NO: 95462 - protein, 24 aa, Mycobacterium avium
DQLDALCALGLQSRVVGAALPDGA

SEQ ID NO: 95463 - protein, 18 aa, Mycobacterium avium
DQLQRSWRDVRAGPADTG

SEQ ID NO: 95464 - protein, 18 aa, Mycobacterium avium
DQLQRSWRDVRAGPVDTG

SEQ ID NO: 95465 - protein, 17 aa, Mycobacterium avium
DQLRAAAGVARSGACEL

SEQ ID NO: 95466 - protein, 25 aa, Mycobacterium avium
DQLRQRIGMVFQHFNLFPHRTVLDN

SEQ ID NO: 95467 - protein, 18 aa, Mycobacterium avium
DQPDPWARGFVVGFGAAP

SEQ ID NO: 95468 - protein, 18 aa, Mycobacterium avium
DQRIHAFSPQALARPRDL

SEQ ID NO: 95469 - protein, 21 aa, Mycobacterium avium
DQVFPKRCGHLPDKQVVDAAV

SEQ ID NO: 95470 - protein, 19 aa, Mycobacterium avium
DQVIGHAWSAAANGQVAVR

SEQ ID NO: 95471 - protein, 17 aa, Mycobacterium avium
DQYTVKDLRTWHGTVLA

SEQ ID NO: 95472 - protein, 23 aa, Mycobacterium avium
DQYTVKDLRTWHGTVLAAAAFAE

SEQ ID NO: 95473 - protein, 24 aa, Mycobacterium avium
DRAAEYLSALGFQFEAFELEHLGL

SEQ ID NO: 95474 - protein, 22 aa, Mycobacterium avium
DRAKPAVPFGGAYRLIDFVLSN

SEQ ID NO: 95475 - protein, 19 aa, Mycobacterium avium
DRASPSWTRCGRRRSGAGT

SEQ ID NO: 95476 - protein, 27 aa, Mycobacterium avium
DRAVRVRRLRAAKCQTRNLPLIGAPAN

SEQ ID NO: 95477 - protein, 30 aa, Mycobacterium avium
DRAVRVRRLRAAKCRTRNLPLIGAPANPGI

SEQ ID NO: 95478 - protein, 25 aa, Mycobacterium avium
DRCNLRCSYCMPAEGLDWLPGEQLL

SEQ ID NO: 95479 - protein, 18 aa, Mycobacterium avium
DRCVTEEIFGPVVTVLAF

SEQ ID NO: 95480 - protein, 19 aa, Mycobacterium avium
DRDAPLLLAFERATTGFGW

SEQ ID NO: 95481 - protein, 23 aa, Mycobacterium avium
DRDFGEWAMDRWPAISDAVISEY

SEQ ID NO: 95482 - protein, 30 aa, Mycobacterium avium
DRDLALACVRAWNDWHFEVWAGSYPDRIIP

SEQ ID NO: 95483 - protein, 24 aa, Mycobacterium avium
DRDLLADLYRAWAHGGQIPDEMST

SEQ ID NO: 95484 - protein, 24 aa, Mycobacterium avium
DREFGFECLQHYNDWLVEEWCGAA

SEQ ID NO: 95485 - protein, 19 aa, Mycobacterium avium
DREIDSFVLLLLGAGSGTT

SEQ ID NO: 95486 - protein, 25 aa, Mycobacterium avium
DREMKVVLWNRGCEELWGLRADETT

SEQ ID NO: 95487 - protein, 19 aa, Mycobacterium avium
DREWLARGGHHAFDPFVSL

SEQ ID NO: 95488 - protein, 17 aa, Mycobacterium avium
DRFFRKFMGRVGAGAAI

SEQ ID NO: 95489 - protein, 19 aa, Mycobacterium avium
DRFGGWDIGVRMEQLDREG

SEQ ID NO: 95490 - protein, 19 aa, Mycobacterium avium
DRFLIPLLRADEFWCQGFS

SEQ ID NO: 95491 - protein, 17 aa, Mycobacterium avium
DRFLLWKDGVIRPAGDS

SEQ ID NO: 95492 - protein, 19 aa, Mycobacterium avium
DRFLQNLTHHSWQDHGQAV

SEQ ID NO: 95493 - protein, 35 aa, Mycobacterium avium
DRFNLRRSDLIAALKTLPAHRPWAATLTTDEARLL

SEQ ID NO: 95494 - protein, 19 aa, Mycobacterium avium
DRFTARLVVRRVKDARFRD

SEQ ID NO: 95495 - protein, 19 aa, Mycobacterium avium
DRFTLLRPLLFTIAYEMLG

SEQ ID NO: 95496 - protein, 20 aa, Mycobacterium avium
DRFTLLRPLLFTIAYEMLGS

SEQ ID NO: 95497 - protein, 19 aa, Mycobacterium avium
DRGAVLLLRGSDPALAGQP

SEQ ID NO: 95498 - protein, 25 aa, Mycobacterium avium
DRGAWWPCKWCGGRADCYRVSDELW

SEQ ID NO: 95499 - protein, 24 aa, Mycobacterium avium
DRGCTAPGCTVPGYYSEVHHCTDY

SEQ ID NO: 95500 - protein, 20 aa, Mycobacterium avium
DRGENFAFLGGRDWDPSSAT

SEQ ID NO: 95501 - protein, 21 aa, Mycobacterium avium
DRGGTVIGRMAAFRDNTPSGT

SEQ ID NO: 95502 - protein, 17 aa, Mycobacterium avium
DRGPLPPVRYGAASLIV

SEQ ID NO: 95503 - protein, 18 aa, Mycobacterium avium
DRGWRAACRSNHALAKGL

SEQ ID NO: 95504 - protein, 23 aa, Mycobacterium avium
DRGYLRPDGRIVITGRTKDLIIR

SEQ ID NO: 95505 - protein, 20 aa, Mycobacterium avium
DRHAGTWVRANFIASVDGGA

SEQ ID NO: 95506 - protein, 17 aa, Mycobacterium avium
DRHDVSLMTSVYTDDGV

SEQ ID NO: 95507 - protein, 26 aa, Mycobacterium avium
DRHGRRWRADFAWPAHDPVGLIARIN

SEQ ID NO: 95508 - protein, 25 aa, Mycobacterium avium
DRHGRRWRADFAWPASMVLAEYDSV

SEQ ID NO: 95509 - protein, 21 aa, Mycobacterium avium
DRHLPRLGDVVVVCSGDTAVL

SEQ ID NO: 95510 - protein, 17 aa, Mycobacterium avium
DRHRGGCGLGQRRTVAP

SEQ ID NO: 95511 - protein, 18 aa, Mycobacterium avium
DRIACYFNPDGVFHDEDR

SEQ ID NO: 95512 - protein, 21 aa, Mycobacterium avium
DRIDPRFPVFSATALTDALPG

SEQ ID NO: 95513 - protein, 19 aa, Mycobacterium avium
DRIEAACAWHAKLVDNGLA

SEQ ID NO: 95514 - protein, 18 aa, Mycobacterium avium
DRIFAASANHSIWFHRQV

SEQ ID NO: 95515 - protein, 20 aa, Mycobacterium avium
DRIRVNAVAPTNCATPMITD

SEQ ID NO: 95516 - protein, 17 aa, Mycobacterium avium
DRKCLRHLGFGRGVHYC

SEQ ID NO: 95517 - protein, 24 aa, Mycobacterium avium
DRLAARATLSFAILARRDSVHSAA

SEQ ID NO: 95518 - protein, 19 aa, Mycobacterium avium
DRLAQLRPGEPILGEEGGG

SEQ ID NO: 95519 - protein, 18 aa, Mycobacterium avium
DRLDAVAQRLGATTFPLD

SEQ ID NO: 95520 - protein, 25 aa, Mycobacterium avium
DRLFPRSVFYSLRLAEHNLDELMHN

SEQ ID NO: 95521 - protein, 19 aa, Mycobacterium avium
DRLGICYVHTHVSSNLPPP

SEQ ID NO: 95522 - protein, 19 aa, Mycobacterium avium
DRLGIPLAKIGQFSGHGAQ

SEQ ID NO: 95523 - protein, 17 aa, Mycobacterium avium
DRLGLGRVWSQCHSLAF

SEQ ID NO: 95524 - protein, 19 aa, Mycobacterium avium
DRLGLLPMYAVNQDKHGTA

SEQ ID NO: 95525 - protein, 17 aa, Mycobacterium avium
DRLISWTVLGQIQPPIG

SEQ ID NO: 95526 - protein, 26 aa, Mycobacterium avium
DRLIWPSLEGELRWCQLFSEPGAGSD

SEQ ID NO: 95527 - protein, 21 aa, Mycobacterium avium
DRLKPWEVIAARLEAAATADL

SEQ ID NO: 95528 - protein, 28 aa, Mycobacterium avium
DRLPSEVFRERFLTCFIADPIGVKLRHD

SEQ ID NO: 95529 - protein, 21 aa, Mycobacterium avium
DRLRELFDLRSSYNAWAGGAY

SEQ ID NO: 95530 - protein, 17 aa, Mycobacterium avium
DRLRLEAYRRLAAAGSD

SEQ ID NO: 95531 - protein, 21 aa, Mycobacterium avium
DRLSDWQPRRGAGRGRPPARA

SEQ ID NO: 95532 - protein, 23 aa, Mycobacterium avium
DRLSRLAGRWLRVPVQAQSGYSF

SEQ ID NO: 95533 - protein, 26 aa, Mycobacterium avium
DRLVEVLRFPAKFFTTAPTSRVHPSD

SEQ ID NO: 95534 - protein, 21 aa, Mycobacterium avium
DRPGGVQPVDFAQRGQVDLEA

SEQ ID NO: 95535 - protein, 17 aa, Mycobacterium avium
DRPRPRAGDFVGAAGQY

SEQ ID NO: 95536 - protein, 20 aa, Mycobacterium avium
DRPVLELSRIDGKNCLAATV

SEQ ID NO: 95537 - protein, 17 aa, Mycobacterium avium
DRPVQRVALDAAVDAHE

SEQ ID NO: 95538 - protein, 21 aa, Mycobacterium avium
DRPYYFFGVLAKLAVLPRFTP

SEQ ID NO: 95539 - protein, 24 aa, Mycobacterium avium
DRQAQLFADWAVYLLVGYEQATLP

SEQ ID NO: 95540 - protein, 21 aa, Mycobacterium avium
DRQLPRLMVVAWDIPGACDIG

SEQ ID NO: 95541 - protein, 17 aa, Mycobacterium avium
DRQSMLFSATMPDPIIT

SEQ ID NO: 95542 - protein, 21 aa, Mycobacterium avium
DRQTPRLLGYRDHHRAGPWSI

SEQ ID NO: 95543 - protein, 19 aa, Mycobacterium avium
DRRAELLALGAEVFGKRPY

SEQ ID NO: 95544 - protein, 29 aa, Mycobacterium avium
DRREARPGRQWCALAGPHGGFGGAVDVDH

SEQ ID NO: 95545 - protein, 25 aa, Mycobacterium avium
DRRFTRARLRAEVLPLLEEVLGGGV

SEQ ID NO: 95546 - protein, 18 aa, Mycobacterium avium
DRRGARRRPVLRRRHRPS

SEQ ID NO: 95547 - protein, 17 aa, Mycobacterium avium
DRRMPYTVGLLGSVPRL

SEQ ID NO: 95548 - protein, 17 aa, Mycobacterium avium
DRRQGLVDAERLRSPAF

SEQ ID NO: 95549 - protein, 20 aa, Mycobacterium avium
DRRRRLCVALAERGVDAHGR

SEQ ID NO: 95550 - protein, 25 aa, Mycobacterium avium
DRSGKHLRRLAALVTELGAVEVVVG

SEQ ID NO: 95551 - protein, 21 aa, Mycobacterium avium
DRSLLRPAIEEAIRWMPTDPM

SEQ ID NO: 95552 - protein, 23 aa, Mycobacterium avium
DRSRLRCVSRSLYVWHRDEPAAI

SEQ ID NO: 95553 - protein, 24 aa, Mycobacterium avium
DRSTRLAAELARKGVAPETPVAIS

SEQ ID NO: 95554 - protein, 24 aa, Mycobacterium avium
DRTGLWGRLLPEWDAIRDLPPRDV

SEQ ID NO: 95555 - protein, 22 aa, Mycobacterium avium
DRTYEMHHLWTGQDFGDRLPSE

SEQ ID NO: 95556 - protein, 25 aa, Mycobacterium avium
DRVAIWSPNTWHWVVACLAIHHAGA

SEQ ID NO: 95557 - protein, 17 aa, Mycobacterium avium
DRVARGPVTAAGVVGCG

SEQ ID NO: 95558 - protein, 28 aa, Mycobacterium avium
DRVGGLSGNGCWGTFVLADARHAVTLPP

SEQ ID NO: 95559 - protein, 17 aa, Mycobacterium avium
DRVQRLRQVLAHTRERG

SEQ ID NO: 95560 - protein, 20 aa, Mycobacterium avium
DRVSSLVIINGAARTVYAPD

SEQ ID NO: 95561 - protein, 19 aa, Mycobacterium avium
DRWAPGRVMVNAYGPTETT

SEQ ID NO: 95562 - protein, 20 aa, Mycobacterium avium
DRYEGCSFINVLLELGPEHP

SEQ ID NO: 95563 - protein, 19 aa, Mycobacterium avium
DRYIPLAILPVWDIDATVA

SEQ ID NO: 95564 - protein, 17 aa, Mycobacterium avium
DSARRLWDISAELTGCE

SEQ ID NO: 95565 - protein, 26 aa, Mycobacterium avium
DSASGPRLHANWTWAPSALDDQQIAR

SEQ ID NO: 95566 - protein, 24 aa, Mycobacterium avium
DSATAWVCAAHAHPGELIGVATGP

SEQ ID NO: 95567 - protein, 21 aa, Mycobacterium avium
DSAVSLGDWPIALPREIAAAA

SEQ ID NO: 95568 - protein, 34 aa, Mycobacterium avium
DSDELPPLWRAFGASRRADGHWTLPELNTELASP

SEQ ID NO: 95569 - protein, 34 aa, Mycobacterium avium
DSDELPPLWRAFGASRRGDGHWTLPELNTELASP

SEQ ID NO: 95570 - protein, 34 aa, Mycobacterium avium
DSDELPPLWRAFGASRRGDGHWTLPELSTELASP

SEQ ID NO: 95571 - protein, 21 aa, Mycobacterium avium
DSDLCIRSRTLNGITVPYESL

SEQ ID NO: 95572 - protein, 20 aa, Mycobacterium avium
DSELNWCNPSGRALGTPPTA

SEQ ID NO: 95573 - protein, 24 aa, Mycobacterium avium
DSELRPVPCGATGELYLGGAQLAR

SEQ ID NO: 95574 - protein, 24 aa, Mycobacterium avium
DSERARRCHEFLGQLQGTPAAGPA

SEQ ID NO: 95575 - protein, 19 aa, Mycobacterium avium
DSFTRRDPVVLYRVTPQAF

SEQ ID NO: 95576 - protein, 21 aa, Mycobacterium avium
DSFWTTIPVVDSWRPTYADFS

SEQ ID NO: 95577 - protein, 23 aa, Mycobacterium avium
DSGDYRWAATLLDHAMFTDGEHV

SEQ ID NO: 95578 - protein, 18 aa, Mycobacterium avium
DSGQWAALGADPGRAPAI

SEQ ID NO: 95579 - protein, 21 aa, Mycobacterium avium
DSIQVRFGIEYVESHPAKATA

SEQ ID NO: 95580 - protein, 26 aa, Mycobacterium avium
DSIRIMTLAGRWRRQGIAVDFATLAE

SEQ ID NO: 95581 - protein, 24 aa, Mycobacterium avium
DSITETFAAITLEVDTRRWAGVPF

SEQ ID NO: 95582 - protein, 38 aa, Mycobacterium avium
DSKTLRPADRWWRLIADHGWRPTHMIQDGPGLTLIAHR

SEQ ID NO: 95583 - protein, 37 aa, Mycobacterium avium
DSLLAHARARLAAFKVPARWFVADAFPVTPTGKVRRF

SEQ ID NO: 95584 - protein, 20 aa, Mycobacterium avium
DSNNGINVFLNFSTATLAGF

SEQ ID NO: 95585 - protein, 22 aa, Mycobacterium avium
DSPARGGRHLGFAKALVHEMPH

SEQ ID NO: 95586 - protein, 26 aa, Mycobacterium avium
DSPGFSWKPLHTMPGVSTYYTFYDDV

SEQ ID NO: 95587 - protein, 41 aa, Mycobacterium avium
DSPLLQQVCEEWAQRGWLAVRYNLPFRRRRPTGPPSGSGAA

SEQ ID NO: 95588 - protein, 25 aa, Mycobacterium avium
DSPVLCAAARPVSRLPATCQQPARR

SEQ ID NO: 95589 - protein, 22 aa, Mycobacterium avium
DSPYELAQHVVFARAAGLTDRQ

SEQ ID NO: 95590 - protein, 21 aa, Mycobacterium avium
DSRKALQFHFDRHAPEYRERF

SEQ ID NO: 95591 - protein, 18 aa, Mycobacterium avium
DSRLRVLTRREFAGMISV

SEQ ID NO: 95592 - protein, 18 aa, Mycobacterium avium
DSRMVICGDTGVAHLAAA

SEQ ID NO: 95593 - protein, 24 aa, Mycobacterium avium
DSTEIDEILTLRVMTMTDQEKAQA

SEQ ID NO: 95594 - protein, 20 aa, Mycobacterium avium
DSVFTAEAWGSDAYTPLAWW

SEQ ID NO: 95595 - protein, 17 aa, Mycobacterium avium
DSVIMPGMRDLLDSGEI

SEQ ID NO: 95596 - protein, 23 aa, Mycobacterium avium
DSVPRMRGVLALFEGVATGAADG

SEQ ID NO: 95597 - protein, 17 aa, Mycobacterium avium
DSYKAYLMCFGSTGMFE

SEQ ID NO: 95598 - protein, 23 aa, Mycobacterium avium
DTAEHVRAAWSYINMPKNQKDYS

SEQ ID NO: 95599 - protein, 24 aa, Mycobacterium avium
DTALAAYLVRPGQRSFSLDDLALR

SEQ ID NO: 95600 - protein, 26 aa, Mycobacterium avium
DTALLDARLADFAPLPAPDDVLAAAG

SEQ ID NO: 95601 - protein, 18 aa, Mycobacterium avium
DTATELFYRDGINATGVE

SEQ ID NO: 95602 - protein, 20 aa, Mycobacterium avium
DTATELFYRDGINATGVERL

SEQ ID NO: 95603 - protein, 19 aa, Mycobacterium avium
DTAVLCDRCHGKGTNGDSA

SEQ ID NO: 95604 - protein, 24 aa, Mycobacterium avium
DTAVPVCFGFHPYLQLPAVPRAEW

SEQ ID NO: 95605 - protein, 24 aa, Mycobacterium avium
DTAVPVCFGFHPYLQLPGVPRAEW

SEQ ID NO: 95606 - protein, 23 aa, Mycobacterium avium
DTDLGAFSYRQCHIQDPESVDAL

SEQ ID NO: 95607 - protein, 24 aa, Mycobacterium avium
DTDLRARRGLAFQLVEGAAKLGRV

SEQ ID NO: 95608 - protein, 19 aa, Mycobacterium avium
DTEWIRARVSSVAQDAHGV

SEQ ID NO: 95609 - protein, 30 aa, Mycobacterium avium
DTGADCPDWVPGEYWVSGRGIARGYRGRPD

SEQ ID NO: 95610 - protein, 29 aa, Mycobacterium avium
DTGGDCPDWVPGELWVSGRGIARGYRGRP

SEQ ID NO: 95611 - protein, 29 aa, Mycobacterium avium
DTGGDCPEWVPGELWVSGRGIARGYRGRP

SEQ ID NO: 95612 - protein, 20 aa, Mycobacterium avium
DTGSPYALEYVWGRQVGDNT

SEQ ID NO: 95613 - protein, 27 aa, Mycobacterium avium
DTIALVVRAGRDWAIREIPLGDVVKAV

SEQ ID NO: 95614 - protein, 21 aa, Mycobacterium avium
DTKCELVHAALVFALPPVPEL

SEQ ID NO: 95615 - protein, 20 aa, Mycobacterium avium
DTLAAFIAHGVFERFPGLRI

SEQ ID NO: 95616 - protein, 17 aa, Mycobacterium avium
DTLAEAKALAGSHPDGI

SEQ ID NO: 95617 - protein, 23 aa, Mycobacterium avium
DTLGGPLAWFARRAARSGKPTKV

SEQ ID NO: 95618 - protein, 25 aa, Mycobacterium avium
DTMQMKKLRGGIGVLTSHLCDVLER

SEQ ID NO: 95619 - protein, 17 aa, Mycobacterium avium
DTMVMSYQWPKDRRSVS

SEQ ID NO: 95620 - protein, 28 aa, Mycobacterium avium
DTPERMPLPIALAHRLSRRLTEVRKNGV

SEQ ID NO: 95621 - protein, 21 aa, Mycobacterium avium
DTRKRRLGVLGYDDLLTRLAD

SEQ ID NO: 95622 - protein, 28 aa, Mycobacterium avium
DTRTARMDLAWSLAERWAPDGSPAGIGG

SEQ ID NO: 95623 - protein, 25 aa, Mycobacterium avium
DTRTARMDLAWSLAERWTSDGSPAG

SEQ ID NO: 95624 - protein, 23 aa, Mycobacterium avium
DTRTRISPISTMSFDEDAKITAM

SEQ ID NO: 95625 - protein, 20 aa, Mycobacterium avium
DTTLTRFAGIGVRTVLSHGS

SEQ ID NO: 95626 - protein, 27 aa, Mycobacterium avium
DTVALVVRAGRDWAIREIPLGDVVKAV

SEQ ID NO: 95627 - protein, 17 aa, Mycobacterium avium
DTVHPFFAIAKEINVQF

SEQ ID NO: 95628 - protein, 24 aa, Mycobacterium avium
DTVLPRKLIELLLGEPGRRDVGRR

SEQ ID NO: 95629 - protein, 20 aa, Mycobacterium avium
DTVLRAKVDAAWNLHELTRD

SEQ ID NO: 95630 - protein, 19 aa, Mycobacterium avium
DTVLRAKVDGAWNLHELTK

SEQ ID NO: 95631 - protein, 17 aa, Mycobacterium avium
DTVPRRRPPRCGWSAPC

SEQ ID NO: 95632 - protein, 23 aa, Mycobacterium avium
DTVRERIVALKLMSPALSNDPVF

SEQ ID NO: 95633 - protein, 24 aa, Mycobacterium avium
DTWFSSALWPFSTLGWPEKTPELE

SEQ ID NO: 95634 - protein, 17 aa, Mycobacterium avium
DTYSPELFCMIRNFHDA

SEQ ID NO: 95635 - protein, 17 aa, Mycobacterium avium
DVAELGADFFVFSGHKI

SEQ ID NO: 95636 - protein, 18 aa, Mycobacterium avium
DVAFLRLSGSAALLGPRL

SEQ ID NO: 95637 - protein, 18 aa, Mycobacterium avium
DVAHCIYAGLTTDTGSFR

SEQ ID NO: 95638 - protein, 27 aa, Mycobacterium avium
DVAQRFNARFPDTFVVPEMLIPKVTAK

SEQ ID NO: 95639 - protein, 24 aa, Mycobacterium avium
DVARCPRNILTFSHGAHHCLGAAA

SEQ ID NO: 95640 - protein, 19 aa, Mycobacterium avium
DVDACTRAGIAVCNNSGPG

SEQ ID NO: 95641 - protein, 24 aa, Mycobacterium avium
DVDEKLWDAAEWSVQVQLNYLRSE

SEQ ID NO: 95642 - protein, 17 aa, Mycobacterium avium
DVDPDRLIELIGGATML

SEQ ID NO: 95643 - protein, 26 aa, Mycobacterium avium
DVEAIRWTTWHAAWLIAEGRPAAREA

SEQ ID NO: 95644 - protein, 24 aa, Mycobacterium avium
DVEFPRGSVPALFNALHAEITFEE

SEQ ID NO: 95645 - protein, 19 aa, Mycobacterium avium
DVEFPRGSVPGLFNALHAE

SEQ ID NO: 95646 - protein, 23 aa, Mycobacterium avium
DVERPLLISRWLDIAFSARSAAM

SEQ ID NO: 95647 - protein, 29 aa, Mycobacterium avium
DVEVLKLSALRVLFSAVVEGPVTFVNAPA

SEQ ID NO: 95648 - protein, 25 aa, Mycobacterium avium
DVFSAGLMLIWACDLIVGSEEVRFA

SEQ ID NO: 95649 - protein, 18 aa, Mycobacterium avium
DVFVPRHRFLSYKAMNDG

SEQ ID NO: 95650 - protein, 26 aa, Mycobacterium avium
DVGARRPVMVWIHGGGFLNGASSMDL

SEQ ID NO: 95651 - protein, 19 aa, Mycobacterium avium
DVGCFVGASATGYGPEMAR

SEQ ID NO: 95652 - protein, 22 aa, Mycobacterium avium
DVGCGDGLLAARLAPVSRSVVG

SEQ ID NO: 95653 - protein, 24 aa, Mycobacterium avium
DVGCSWLPLYHDMGLSFLLASALG

SEQ ID NO: 95654 - protein, 21 aa, Mycobacterium avium
DVGEWFGRHGWDVRVTPSDEL

SEQ ID NO: 95655 - protein, 18 aa, Mycobacterium avium
DVGPDLSTVLGYVPTFPF

SEQ ID NO: 95656 - protein, 21 aa, Mycobacterium avium
DVGPLGGRAFAPFDSGGWNLK

SEQ ID NO: 95657 - protein, 18 aa, Mycobacterium avium
DVGWPTHRVDQIAAQCSL

SEQ ID NO: 95658 - protein, 25 aa, Mycobacterium avium
DVHVPEVLDVPGVVAAQRYDLAELD

SEQ ID NO: 95659 - protein, 22 aa, Mycobacterium avium
DVIRLSRHARHYLAIFDQGKAL

SEQ ID NO: 95660 - protein, 25 aa, Mycobacterium avium
DVITRGGFPEGCFQTLLVPSSAVER

SEQ ID NO: 95661 - protein, 21 aa, Mycobacterium avium
DVKAALSRRTNPAGLTGSLAE

SEQ ID NO: 95662 - protein, 23 aa, Mycobacterium avium
DVKARPRALLDLAAKADVLLDCF

SEQ ID NO: 95663 - protein, 26 aa, Mycobacterium avium
DVKDAMIDWWGPILVEYYGATEQHGT

SEQ ID NO: 95664 - protein, 23 aa, Mycobacterium avium
DVKHRMMRWFGPIIHEYYGGTEG

SEQ ID NO: 95665 - protein, 22 aa, Mycobacterium avium
DVKHRMMRWFGPVIHEYYGGTE

SEQ ID NO: 95666 - protein, 18 aa, Mycobacterium avium
DVKYHLGATGVYLQMFGD

SEQ ID NO: 95667 - protein, 21 aa, Mycobacterium avium
DVLAELPILVAAAGPQMVSLA

SEQ ID NO: 95668 - protein, 22 aa, Mycobacterium avium
DVLDRIGWLQAQTSRAFGRGPH

SEQ ID NO: 95669 - protein, 20 aa, Mycobacterium avium
DVLDRIGWLQAQTSRTFGRG

SEQ ID NO: 95670 - protein, 26 aa, Mycobacterium avium
DVLLKIRLRQGFPVDLLNSAERERAQ

SEQ ID NO: 95671 - protein, 17 aa, Mycobacterium avium
DVLRAWGKLGYPRRAKR

SEQ ID NO: 95672 - protein, 21 aa, Mycobacterium avium
DVMVYPGMEIRQDNRVCTLGY

SEQ ID NO: 95673 - protein, 24 aa, Mycobacterium avium
DVPGMPRLLKWISPLIPLVAGPLP

SEQ ID NO: 95674 - protein, 19 aa, Mycobacterium avium
DVPVGIGVAIGGTRAVDKF

SEQ ID NO: 95675 - protein, 19 aa, Mycobacterium avium
DVQKAMAFAAAHNLKVVPR

SEQ ID NO: 95676 - protein, 17 aa, Mycobacterium avium
DVQLLRLSFGRFGDQVA

SEQ ID NO: 95677 - protein, 17 aa, Mycobacterium avium
DVQTTLSTYGWVTQDAE

SEQ ID NO: 95678 - protein, 29 aa, Mycobacterium avium
DVRAPEPLAEYVLGLAHRVIRPEVRGQAG

SEQ ID NO: 95679 - protein, 22 aa, Mycobacterium avium
DVRARPDVIARRDIPASWDYDT

SEQ ID NO: 95680 - protein, 22 aa, Mycobacterium avium
DVRPGVPVLFLDTGYHFAETIG

SEQ ID NO: 95681 - protein, 18 aa, Mycobacterium avium
DVSHGCINISPANAKWFF

SEQ ID NO: 95682 - protein, 21 aa, Mycobacterium avium
DVSISGLFHGPRLREMDARHG

SEQ ID NO: 95683 - protein, 24 aa, Mycobacterium avium
DVSLPFAGLKVFDLSTFWAGAYLT

SEQ ID NO: 95684 - protein, 21 aa, Mycobacterium avium
DVSRADWLWRVLGEAGHVALL

SEQ ID NO: 95685 - protein, 19 aa, Mycobacterium avium
DVSRVRWVGYGGAPIAPSL

SEQ ID NO: 95686 - protein, 18 aa, Mycobacterium avium
DVTAWPATLDRLLALGGP

SEQ ID NO: 95687 - protein, 23 aa, Mycobacterium avium
DVTGQFGTPGWIISQGPQVLLDA

SEQ ID NO: 95688 - protein, 19 aa, Mycobacterium avium
DVTRAEFEYAITYECALEV

SEQ ID NO: 95689 - protein, 18 aa, Mycobacterium avium
DVTVVACEYTFGSAQPAR

SEQ ID NO: 95690 - protein, 22 aa, Mycobacterium avium
DVTYPLHRYFLWAKQIELSLGS

SEQ ID NO: 95691 - protein, 17 aa, Mycobacterium avium
DVVAYRYGQRTVTHAQL

SEQ ID NO: 95692 - protein, 20 aa, Mycobacterium avium
DVVDTAGWSPARMKEAIDAA

SEQ ID NO: 95693 - protein, 21 aa, Mycobacterium avium
DVVELTLRLAAEMLALAGVGD

SEQ ID NO: 95694 - protein, 17 aa, Mycobacterium avium
DVVNAVFMPIPVRIIAA

SEQ ID NO: 95695 - protein, 20 aa, Mycobacterium avium
DVVPLSFAQNRLWFIDQSQG

SEQ ID NO: 95696 - protein, 24 aa, Mycobacterium avium
DVVVTKADILANVWDAHHHGPDNV

SEQ ID NO: 95697 - protein, 19 aa, Mycobacterium avium
DVWFPLFRPSADGEPSPLP

SEQ ID NO: 95698 - protein, 29 aa, Mycobacterium avium
DVYNPLRFLRAAMKWCRKAQTLGTLDDAA

SEQ ID NO: 95699 - protein, 21 aa, Mycobacterium avium
DWAGLPVNLDFAFSRDQRDKV

SEQ ID NO: 95700 - protein, 23 aa, Mycobacterium avium
DWDAEVLEAMSIWDAEALIRLVD

SEQ ID NO: 95701 - protein, 25 aa, Mycobacterium avium
DWHERETYDFFGIVFDGHPSLTRIE

SEQ ID NO: 95702 - protein, 24 aa, Mycobacterium avium
DWMRRLSGEINRPVSFALIQVDAD

SEQ ID NO: 95703 - protein, 31 aa, Mycobacterium avium
DWNRAGSARAWWLLRAAGLDNVRILDGGLAA

SEQ ID NO: 95704 - protein, 27 aa, Mycobacterium avium
DWPARKLPSVRVAAALPPPIDYRDRIC

SEQ ID NO: 95705 - protein, 18 aa, Mycobacterium avium
DWPQPRIAITPKDLGYGL

SEQ ID NO: 95706 - protein, 23 aa, Mycobacterium avium
DWQPSGFPVEFLSLGANGIGVPI

SEQ ID NO: 95707 - protein, 23 aa, Mycobacterium avium
DWQPSGFPVEFLSLGTNGIGVPI

SEQ ID NO: 95708 - protein, 17 aa, Mycobacterium avium
DWTLRQLFRHVGRGDRW

SEQ ID NO: 95709 - protein, 21 aa, Mycobacterium avium
DWTRDRPGLGAGEVAFDAATL

SEQ ID NO: 95710 - protein, 19 aa, Mycobacterium avium
DWTRRLSAIEFLRDLGKHF

SEQ ID NO: 95711 - protein, 18 aa, Mycobacterium avium
DWVRPEVVRRLRAEAPGL

SEQ ID NO: 95712 - protein, 19 aa, Mycobacterium avium
DWVRPEVVRRLRAEAPGLR

SEQ ID NO: 95713 - protein, 19 aa, Mycobacterium avium
DWVRPEVVRRLRAEAPNLR

SEQ ID NO: 95714 - protein, 32 aa, Mycobacterium avium
DWWPADYGHYGGLFIRMSWHAAGTYRIHDGRG

SEQ ID NO: 95715 - protein, 17 aa, Mycobacterium avium
DYARMWTQAAATMSTYQ

SEQ ID NO: 95716 - protein, 17 aa, Mycobacterium avium
DYARTALFHAFAVQMNL

SEQ ID NO: 95717 - protein, 20 aa, Mycobacterium avium
DYARTDWRLERQDVVKAFSM

SEQ ID NO: 95718 - protein, 19 aa, Mycobacterium avium
DYASPVPAILTMKLMGLPY

SEQ ID NO: 95719 - protein, 25 aa, Mycobacterium avium
DYEVEIGLVIGRELPVGAAVSEANL

SEQ ID NO: 95720 - protein, 17 aa, Mycobacterium avium
DYFDGLRAGVWGYNRLS

SEQ ID NO: 95721 - protein, 19 aa, Mycobacterium avium
DYGRMVIGVWISKLFPQRM

SEQ ID NO: 95722 - protein, 19 aa, Mycobacterium avium
DYGRVLVMIGVHSREPIVE

SEQ ID NO: 95723 - protein, 18 aa, Mycobacterium avium
DYLLPRQRERAALTEDEV

SEQ ID NO: 95724 - protein, 19 aa, Mycobacterium avium
DYLREATAWLQLATAALIQ

SEQ ID NO: 95725 - protein, 28 aa, Mycobacterium avium
DYPLIPARVDTWAGLVFVNLDPDAMPLP

SEQ ID NO: 95726 - protein, 17 aa, Mycobacterium avium
DYRALRVADLFAAQGVW

SEQ ID NO: 95727 - protein, 17 aa, Mycobacterium avium
DYRAWFATLPAEFTGAV

SEQ ID NO: 95728 - protein, 24 aa, Mycobacterium avium
DYRRRMGELFAPFTKVAAKNPSAS

SEQ ID NO: 95729 - protein, 25 aa, Mycobacterium avium
DYRYRMVVCEEVSRVTALSFGLTIS

SEQ ID NO: 95730 - protein, 18 aa, Mycobacterium avium
DYVDAMAPMTGWAGDEDE

SEQ ID NO: 95731 - protein, 18 aa, Mycobacterium avium
DYVDAMAPTTGWAGDEDE

SEQ ID NO: 95732 - protein, 17 aa, Mycobacterium avium
DYWGRWLGRWTAEEHLH

SEQ ID NO: 95733 - protein, 17 aa, Mycobacterium avium
DYWSDRVHRLLSACVRD

SEQ ID NO: 95734 - protein, 17 aa, Mycobacterium avium
DYYALKAAVDSGVEQLG

SEQ ID NO: 95735 - protein, 24 aa, Mycobacterium avium
EAAAEAGVDLGLLGTAVREGPLTL

SEQ ID NO: 95736 - protein, 20 aa, Mycobacterium avium
EAAAEAGVELGLLGTAVLEG

SEQ ID NO: 95737 - protein, 18 aa, Mycobacterium avium
EAACLLMLNGDWTAPQYA

SEQ ID NO: 95738 - protein, 17 aa, Mycobacterium avium
EAADAFEAVRVIARAAG

SEQ ID NO: 95739 - protein, 19 aa, Mycobacterium avium
EAAEGRWFADQVRSNPNPY

SEQ ID NO: 95740 - protein, 24 aa, Mycobacterium avium
EAAELHEIYKLGVVPIPTNKPMIR

SEQ ID NO: 95741 - protein, 23 aa, Mycobacterium avium
EAAELWAPCFGRDDVDPLDADLT

SEQ ID NO: 95742 - protein, 24 aa, Mycobacterium avium
EAAGFRALRRWASGFYPEPEAAAE

SEQ ID NO: 95743 - protein, 18 aa, Mycobacterium avium
EAALAIRAGAVWVAANID

SEQ ID NO: 95744 - protein, 23 aa, Mycobacterium avium
EAALCVASSLFGRLHTGTGECID

SEQ ID NO: 95745 - protein, 21 aa, Mycobacterium avium
EAALQRLRSQTAFEDASARAE

SEQ ID NO: 95746 - protein, 20 aa, Mycobacterium avium
EAALYFATDRSRYVTGTVLP

SEQ ID NO: 95747 - protein, 27 aa, Mycobacterium avium
EAANRLAHRLAGFGVGAGERVALLFSR

SEQ ID NO: 95748 - protein, 17 aa, Mycobacterium avium
EAARPAPRIIAAVPVLL

SEQ ID NO: 95749 - protein, 23 aa, Mycobacterium avium
EAARSCPEQAIVLMNGTVGQGAG

SEQ ID NO: 95750 - protein, 19 aa, Mycobacterium avium
EAAVLLLRFTAAPPASVPS

SEQ ID NO: 95751 - protein, 18 aa, Mycobacterium avium
EAAVRELLFAIGEDPDRH

SEQ ID NO: 95752 - protein, 17 aa, Mycobacterium avium
EACQRFSEIYRRPRGLF

SEQ ID NO: 95753 - protein, 19 aa, Mycobacterium avium
EACSLGILIERAAKLQLAA

SEQ ID NO: 95754 - protein, 27 aa, Mycobacterium avium
EADAAFGPADIRAWVGHYFDYMDHHGA

SEQ ID NO: 95755 - protein, 19 aa, Mycobacterium avium
EADLARWAGEHRPESLRKV

SEQ ID NO: 95756 - protein, 20 aa, Mycobacterium avium
EAEGGMGPHGLMIGMTGSGK

SEQ ID NO: 95757 - protein, 33 aa, Mycobacterium avium
EAEGRGCARVEFKLRDWLFARQRYWGEPFPIVY

SEQ ID NO: 95758 - protein, 33 aa, Mycobacterium avium
EAEGRGCARVEYKLRDWLFARQRYWGEPFPIVY

SEQ ID NO: 95759 - protein, 43 aa, Mycobacterium avium
EAEGRGCARVEYKLRDWLFARQRYWGEPFPIVYDSDGRPHALD

SEQ ID NO: 95760 - protein, 25 aa, Mycobacterium avium
EAEIAILHRHAHGFDPRDLSVVHPV

SEQ ID NO: 95761 - protein, 20 aa, Mycobacterium avium
EAERIWRNRLAPIGDVTGPG

SEQ ID NO: 95762 - protein, 21 aa, Mycobacterium avium
EAEYAEMWAQDAAAMYEYAAG

SEQ ID NO: 95763 - protein, 19 aa, Mycobacterium avium
EAFEAIRCVRSLQHQKYVA

SEQ ID NO: 95764 - protein, 25 aa, Mycobacterium avium
EAFIYPRITAYLAQRLQVEDWYRRH

SEQ ID NO: 95765 - protein, 25 aa, Mycobacterium avium
EAGERLRLEIAAAREDVARLEGTDQ

SEQ ID NO: 95766 - protein, 17 aa, Mycobacterium avium
EAGRAGIRQVVILASGL

SEQ ID NO: 95767 - protein, 24 aa, Mycobacterium avium
EAGVDCFVAGLAVYGADDPAAAVE

SEQ ID NO: 95768 - protein, 17 aa, Mycobacterium avium
EAGVFAGTVMDYSKTPE

SEQ ID NO: 95769 - protein, 26 aa, Mycobacterium avium
EAGYAYFAGRLGDWMRVDGENLGAAP

SEQ ID NO: 95770 - protein, 22 aa, Mycobacterium avium
EAHGFWTSLGWERFDHPEGEQF

SEQ ID NO: 95771 - protein, 19 aa, Mycobacterium avium
EAHMGINHLGHFALTCLLG

SEQ ID NO: 95772 - protein, 19 aa, Mycobacterium avium
EAHRWPDVFALVAQYLIDA

SEQ ID NO: 95773 - protein, 21 aa, Mycobacterium avium
EAHRWPDVFALVAQYLIDARR

SEQ ID NO: 95774 - protein, 17 aa, Mycobacterium avium
EAIDAFIERGGCDLVGE

SEQ ID NO: 95775 - protein, 25 aa, Mycobacterium avium
EAIEEQFFWPAVRDAIGDGLVDKAL

SEQ ID NO: 95776 - protein, 20 aa, Mycobacterium avium
EAIPEIAGWYQRRGLTPRLA

SEQ ID NO: 95777 - protein, 21 aa, Mycobacterium avium
EAISLPDAVALVVARATVVGR

SEQ ID NO: 95778 - protein, 19 aa, Mycobacterium avium
EAIVAMFNQFCYVQLGSAR

SEQ ID NO: 95779 - protein, 28 aa, Mycobacterium avium
EAKAYLGSRRRLAGGLDHRHVGSVAPYQ

SEQ ID NO: 95780 - protein, 26 aa, Mycobacterium avium
EAKEFIADGAIEIGGRLPINTHGGQL

SEQ ID NO: 95781 - protein, 24 aa, Mycobacterium avium
EAKHWPSQPGRYFTVRAGSLVAWD

SEQ ID NO: 95782 - protein, 24 aa, Mycobacterium avium
EAKHWPSQPGRYFTVRAGSLVAWN

SEQ ID NO: 95783 - protein, 20 aa, Mycobacterium avium
EAKIKLSDMRSGRMSDEDWT

SEQ ID NO: 95784 - protein, 21 aa, Mycobacterium avium
EAKKICLGCEVRHECLEYALE

SEQ ID NO: 95785 - protein, 19 aa, Mycobacterium avium
EAKVDWILRNSLPLRSTAE

SEQ ID NO: 95786 - protein, 26 aa, Mycobacterium avium
EALAQARACASAECDTRRQAATAAAA

SEQ ID NO: 95787 - protein, 18 aa, Mycobacterium avium
EALDRLTAEHVRALQRPT

SEQ ID NO: 95788 - protein, 19 aa, Mycobacterium avium
EALERAGIDPSGLRGSATG

SEQ ID NO: 95789 - protein, 20 aa, Mycobacterium avium
EALGPFPTDRGWAVRELLAG

SEQ ID NO: 95790 - protein, 19 aa, Mycobacterium avium
EALGVPARRCVMIGDTGAD

SEQ ID NO: 95791 - protein, 23 aa, Mycobacterium avium
EALLRTWFAGLFEAGFAGADWPV

SEQ ID NO: 95792 - protein, 21 aa, Mycobacterium avium
EALPGEIADKFHATFDASLHN

SEQ ID NO: 95793 - protein, 28 aa, Mycobacterium avium
EALPLASIFKLYVLHALAGAVTAGRVSW

SEQ ID NO: 95794 - protein, 23 aa, Mycobacterium avium
EALSEHLHCVAIDMVGNGFSDKP

SEQ ID NO: 95795 - protein, 23 aa, Mycobacterium avium
EAMACAKALVRARRFDAVSAPDR

SEQ ID NO: 95796 - protein, 19 aa, Mycobacterium avium
EAMIDRVCQVIGDGAAALA

SEQ ID NO: 95797 - protein, 25 aa, Mycobacterium avium
EAMIKKLSIRLGVPAYPNDPMRFTG

SEQ ID NO: 95798 - protein, 23 aa, Mycobacterium avium
EAMTRPEQRVELAYGAVDRILGQ

SEQ ID NO: 95799 - protein, 25 aa, Mycobacterium avium
EANSVGRLSVPPTWASATPAIRLAS

SEQ ID NO: 95800 - protein, 19 aa, Mycobacterium avium
EAPIPLDAVTIIGRAGSGT

SEQ ID NO: 95801 - protein, 23 aa, Mycobacterium avium
EAQDRYGRKVSWGVEVRSKTGTE

SEQ ID NO: 95802 - protein, 26 aa, Mycobacterium avium
EAQLDRFAIRLELRYLSERDETSMLR

SEQ ID NO: 95803 - protein, 24 aa, Mycobacterium avium
EAQTYCPPGHVLVEPIFVPRPGGT

SEQ ID NO: 95804 - protein, 22 aa, Mycobacterium avium
EAREFGVRAGMPLRAAARRCPP

SEQ ID NO: 95805 - protein, 22 aa, Mycobacterium avium
EARGFAGFPIGGRFLRADNPVL

SEQ ID NO: 95806 - protein, 29 aa, Mycobacterium avium
EARIKLDCLFPGLWPSFWGVNEDPLPDGE

SEQ ID NO: 95807 - protein, 21 aa, Mycobacterium avium
EARLAQGNPVAWIHATALRTE

SEQ ID NO: 95808 - protein, 25 aa, Mycobacterium avium
EARSRLNPAAGVMLSALWVGSTGRL

SEQ ID NO: 95809 - protein, 24 aa, Mycobacterium avium
EARSRLNPAAGVMLSAVWANATGQ

SEQ ID NO: 95810 - protein, 24 aa, Mycobacterium avium
EASKGALFSGIRIGAIDAHATGDF

SEQ ID NO: 95811 - protein, 26 aa, Mycobacterium avium
EASPAAGFDFERSWRAVGPDDVLTIV

SEQ ID NO: 95812 - protein, 17 aa, Mycobacterium avium
EASRAKLVRLFPTVMTG

SEQ ID NO: 95813 - protein, 21 aa, Mycobacterium avium
EASRSAVEWHRGTLEFWDHMV

SEQ ID NO: 95814 - protein, 18 aa, Mycobacterium avium
EASWLRTGDSGFLSDREL

SEQ ID NO: 95815 - protein, 24 aa, Mycobacterium avium
EAVAISCGERSWTYRELDSSANRL

SEQ ID NO: 95816 - protein, 17 aa, Mycobacterium avium
EAVAVLERRGLIRLVTD

SEQ ID NO: 95817 - protein, 31 aa, Mycobacterium avium
EAVCGPGAECCRRLFRLPPVPVRQTRTSDPY

SEQ ID NO: 95818 - protein, 19 aa, Mycobacterium avium
EAVDLAVSVPPGLEVVGDT

SEQ ID NO: 95819 - protein, 19 aa, Mycobacterium avium
EAVDLAVSVPPSLEVVGDT

SEQ ID NO: 95820 - protein, 20 aa, Mycobacterium avium
EAVDNRLGRRVAVKVLKQEF

SEQ ID NO: 95821 - protein, 20 aa, Mycobacterium avium
EAVELCRRVNNDLAAQIAEN

SEQ ID NO: 95822 - protein, 21 aa, Mycobacterium avium
EAVERVMVVRDRIRTEPPHQG

SEQ ID NO: 95823 - protein, 24 aa, Mycobacterium avium
EAVERVMVVRDRIRTEPPHQGSRY

SEQ ID NO: 95824 - protein, 20 aa, Mycobacterium avium
EAVRLLGRLDGIAVTMGTAG

SEQ ID NO: 95825 - protein, 18 aa, Mycobacterium avium
EAVSFRRWVTGEVLPAIR

SEQ ID NO: 95826 - protein, 19 aa, Mycobacterium avium
EAWLRLSGSSGEIVNPDAW

SEQ ID NO: 95827 - protein, 19 aa, Mycobacterium avium
EAYFEGFAALADMTDEERR

SEQ ID NO: 95828 - protein, 22 aa, Mycobacterium avium
EAYLGLLRFLLGLDLVDRVQFW

SEQ ID NO: 95829 - protein, 19 aa, Mycobacterium avium
EAYRLGMVSKVFPADELAD

SEQ ID NO: 95830 - protein, 17 aa, Mycobacterium avium
EAYRRGADVVAFDQNEA

SEQ ID NO: 95831 - protein, 17 aa, Mycobacterium avium
EAYRRSADVVAFDQNEA

SEQ ID NO: 95832 - protein, 24 aa, Mycobacterium avium
ECADGRYVAVGALEPEFFAEMLAI

SEQ ID NO: 95833 - protein, 29 aa, Mycobacterium avium
ECAELLDWPAKLRLLEGFRQRENLSWSAP

SEQ ID NO: 95834 - protein, 23 aa, Mycobacterium avium
ECDGWPIRWSRQVSQDQPDVALL

SEQ ID NO: 95835 - protein, 23 aa, Mycobacterium avium
ECGQPRRPALRRGADGPGGCRAL

SEQ ID NO: 95836 - protein, 25 aa, Mycobacterium avium
ECGVWRGGASILMRAVLAAYGDEKR

SEQ ID NO: 95837 - protein, 26 aa, Mycobacterium avium
ECKTEALAIKTMVDYAVGQYLDGKND

SEQ ID NO: 95838 - protein, 24 aa, Mycobacterium avium
EDALTRMLIGIPVVYTSDYLVPEE

SEQ ID NO: 95839 - protein, 18 aa, Mycobacterium avium
EDAPSMFAAAGRYVLDRA

SEQ ID NO: 95840 - protein, 18 aa, Mycobacterium avium
EDCRHLSARLERDLLTAG

SEQ ID NO: 95841 - protein, 23 aa, Mycobacterium avium
EDDIPGIVAGLGYDDCLVMGSDY

SEQ ID NO: 95842 - protein, 31 aa, Mycobacterium avium
EDEPTRRVRLMRWGLVPPWAKAGPGGAPETK

SEQ ID NO: 95843 - protein, 20 aa, Mycobacterium avium
EDFAGLIVSGDDAWNTINEY

SEQ ID NO: 95844 - protein, 20 aa, Mycobacterium avium
EDFLFPGLAAEWAHWDGQRP

SEQ ID NO: 95845 - protein, 18 aa, Mycobacterium avium
EDHSYARHVEWMRALAFD

SEQ ID NO: 95846 - protein, 17 aa, Mycobacterium avium
EDHSYARHVEWMRAVAF

SEQ ID NO: 95847 - protein, 18 aa, Mycobacterium avium
EDHSYARHVEWMRAVAFD

SEQ ID NO: 95848 - protein, 22 aa, Mycobacterium avium
EDIADAVAWLASDQSRFVTASG

SEQ ID NO: 95849 - protein, 17 aa, Mycobacterium avium
EDIPGVVMTDGLPWTWE

SEQ ID NO: 95850 - protein, 21 aa, Mycobacterium avium
EDKHKLALEREMLGLYVSGHP

SEQ ID NO: 95851 - protein, 23 aa, Mycobacterium avium
EDKHKLALEREMLGLYVSGHPLN

SEQ ID NO: 95852 - protein, 24 aa, Mycobacterium avium
EDLDYWRPLMADLPEPLELPGPNG

SEQ ID NO: 95853 - protein, 25 aa, Mycobacterium avium
EDLDYWRPLMADLPEPLELPGPNGS

SEQ ID NO: 95854 - protein, 20 aa, Mycobacterium avium
EDLEWLRSRTSLPLMAKGIC

SEQ ID NO: 95855 - protein, 25 aa, Mycobacterium avium
EDLKLNLPAAERAKLERLIKDAHAD

SEQ ID NO: 95856 - protein, 23 aa, Mycobacterium avium
EDLRPDIWVKGGDYVAAELPEAD

SEQ ID NO: 95857 - protein, 26 aa, Mycobacterium avium
EDLRPDWSMPSAEQFTFGYADDHIDA

SEQ ID NO: 95858 - protein, 27 aa, Mycobacterium avium
EDLRPDWSMPSAEQFTFGYADDHIDAV

SEQ ID NO: 95859 - protein, 17 aa, Mycobacterium avium
EDLRYGPDVTTLATVPA

SEQ ID NO: 95860 - protein, 26 aa, Mycobacterium avium
EDMTEFWRGYCLGELTITEIDGNHFD

SEQ ID NO: 95861 - protein, 25 aa, Mycobacterium avium
EDNARRAATLLGCTPHDLWPNQYSP

SEQ ID NO: 95862 - protein, 19 aa, Mycobacterium avium
EDPARGFLPTGGRVLGVSE

SEQ ID NO: 95863 - protein, 17 aa, Mycobacterium avium
EDPARRSLLHWECIHPV

SEQ ID NO: 95864 - protein, 17 aa, Mycobacterium avium
EDPEFLTRMLARMVPHP

SEQ ID NO: 95865 - protein, 17 aa, Mycobacterium avium
EDQARVILFLVSDCSSF

SEQ ID NO: 95866 - protein, 20 aa, Mycobacterium avium
EDRTGLDHIAFRLDSRDELD

SEQ ID NO: 95867 - protein, 17 aa, Mycobacterium avium
EDSRLLVDVMHGTGLIP

SEQ ID NO: 95868 - protein, 21 aa, Mycobacterium avium
EDSRLLVDVMHGTGLIPGRRV

SEQ ID NO: 95869 - protein, 17 aa, Mycobacterium avium
EDVDLALLYDGFTFNCV

SEQ ID NO: 95870 - protein, 17 aa, Mycobacterium avium
EDVSAAIAYLVSDEARY

SEQ ID NO: 95871 - protein, 21 aa, Mycobacterium avium
EDVSAAIAYLVSDEARYVTGV

SEQ ID NO: 95872 - protein, 21 aa, Mycobacterium avium
EDVWGVPRGRLRTEVGTGTVD

SEQ ID NO: 95873 - protein, 26 aa, Mycobacterium avium
EDYALTELCALSWTVYSLPGAPVLDH

SEQ ID NO: 95874 - protein, 17 aa, Mycobacterium avium
EDYLILGACNPALAHRA

SEQ ID NO: 95875 - protein, 21 aa, Mycobacterium avium
EEADRFLVAVTFRMGRLGVPV

SEQ ID NO: 95876 - protein, 20 aa, Mycobacterium avium
EEALRIATAAKREYEASVSR

SEQ ID NO: 95877 - protein, 24 aa, Mycobacterium avium
EEARRIGTDWLRAYLALPNYANNL

SEQ ID NO: 95878 - protein, 17 aa, Mycobacterium avium
EEAVICFEPMTAPTDAL

SEQ ID NO: 95879 - protein, 20 aa, Mycobacterium avium
EEAYRLGMVSKIFRRDELAE

SEQ ID NO: 95880 - protein, 26 aa, Mycobacterium avium
EEEILKPVCFVFDFAPTRALRQLAEY

SEQ ID NO: 95881 - protein, 23 aa, Mycobacterium avium
EEFADCQVWWSNRVENERAWRVP

SEQ ID NO: 95882 - protein, 35 aa, Mycobacterium avium
EEFADCQVWWSNRVENERAWRVPIADIEANDMYNL

SEQ ID NO: 95883 - protein, 21 aa, Mycobacterium avium
EEFRASRIMLERARANDKITI

SEQ ID NO: 95884 - protein, 22 aa, Mycobacterium avium
EEFRASRIMLERARANDKITIV

SEQ ID NO: 95885 - protein, 23 aa, Mycobacterium avium
EEGADIILFDICHDIETNEYPLA

SEQ ID NO: 95886 - protein, 22 aa, Mycobacterium avium
EEGADIILFDICHDIETNKYPL

SEQ ID NO: 95887 - protein, 17 aa, Mycobacterium avium
EEHWCQGFSEPGSGSDL

SEQ ID NO: 95888 - protein, 18 aa, Mycobacterium avium
EEIRRINPSIIYVTGSGF

SEQ ID NO: 95889 - protein, 19 aa, Mycobacterium avium
EEITGSNGSKMWKVPVRSL

SEQ ID NO: 95890 - protein, 23 aa, Mycobacterium avium
EEKCLRMSGWPPATTMSSASRTR

SEQ ID NO: 95891 - protein, 30 aa, Mycobacterium avium
EELADAFAKAWYKLLHRDMGPVSRFLGPWV

SEQ ID NO: 95892 - protein, 27 aa, Mycobacterium avium
EELASRAGLPVDEFLATVQRFNGFART

SEQ ID NO: 95893 - protein, 17 aa, Mycobacterium avium
EELGRRAAAAGINTYRC

SEQ ID NO: 95894 - protein, 18 aa, Mycobacterium avium
EELRRCVGDLGFVGALIA

SEQ ID NO: 95895 - protein, 26 aa, Mycobacterium avium
EELTDLLWRMGIRTIGQFAALARGDV

SEQ ID NO: 95896 - protein, 34 aa, Mycobacterium avium
EELTLAWQRLVPWPDVLPGLTLLKKKFIIAALSN

SEQ ID NO: 95897 - protein, 18 aa, Mycobacterium avium
EELTRLRDALGYLHDQTV

SEQ ID NO: 95898 - protein, 18 aa, Mycobacterium avium
EELTRLRDALGYLHGQTV

SEQ ID NO: 95899 - protein, 24 aa, Mycobacterium avium
EEMGRALVCSPFFATVALATQAIL

SEQ ID NO: 95900 - protein, 34 aa, Mycobacterium avium
EEMLEMAACGAKVLMLRCVEYARRYNIPVHVRSS

SEQ ID NO: 95901 - protein, 19 aa, Mycobacterium avium
EEPHTAWATGMPAVASAGR

SEQ ID NO: 95902 - protein, 17 aa, Mycobacterium avium
EEPLPAVVRAVLEPLGL

SEQ ID NO: 95903 - protein, 26 aa, Mycobacterium avium
EEPMIFYRDLVRLMTHLSDKHGLNAV

SEQ ID NO: 95904 - protein, 25 aa, Mycobacterium avium
EEQKKRWLPGIADGTLTMAFAITEP

SEQ ID NO: 95905 - protein, 29 aa, Mycobacterium avium
EERELLGGLPVRRLWGIGPVAEEKLHRLG

SEQ ID NO: 95906 - protein, 18 aa, Mycobacterium avium
EERTIWSYGSGYGGNALL

SEQ ID NO: 95907 - protein, 18 aa, Mycobacterium avium
EESVFRIDHYLGKETVRN

SEQ ID NO: 95908 - protein, 19 aa, Mycobacterium avium
EEVMGWKIGGDGFRIVLSA

SEQ ID NO: 95909 - protein, 23 aa, Mycobacterium avium
EEVRRYFGSKVLRTVIPRSVKVS

SEQ ID NO: 95910 - protein, 22 aa, Mycobacterium avium
EEVYELRGGQLVRIDTPTDASV

SEQ ID NO: 95911 - protein, 26 aa, Mycobacterium avium
EFAGYTPRLWRYWAEHLDPDRARRDD

SEQ ID NO: 95912 - protein, 24 aa, Mycobacterium avium
EFARRPRIRSSRGLGLSELLRLNT

SEQ ID NO: 95913 - protein, 25 aa, Mycobacterium avium
EFEACQAVGLPVVWQDDAEVPFAYH

SEQ ID NO: 95914 - protein, 18 aa, Mycobacterium avium
EFHVEGLATVIPFHRAVV

SEQ ID NO: 95915 - protein, 17 aa, Mycobacterium avium
EFLDRWRDPTSRTGQQW

SEQ ID NO: 95916 - protein, 22 aa, Mycobacterium avium
EFLEEPRIAARVAGARTRGGYL

SEQ ID NO: 95917 - protein, 19 aa, Mycobacterium avium
EFLHRVRVRVGAVEPGEPN

SEQ ID NO: 95918 - protein, 19 aa, Mycobacterium avium
EFLHRVRVRVGAVEPGEPT

SEQ ID NO: 95919 - protein, 21 aa, Mycobacterium avium
EFNGFALSKLRGFIYEESRNI

SEQ ID NO: 95920 - protein, 19 aa, Mycobacterium avium
EFRRFGIDLVAASVRRAQE

SEQ ID NO: 95921 - protein, 23 aa, Mycobacterium avium
EFSRGELHGGSWDSLNVKRAWSV

SEQ ID NO: 95922 - protein, 25 aa, Mycobacterium avium
EFSSVKVGDLLPEKVYPLTRQDLVN

SEQ ID NO: 95923 - protein, 17 aa, Mycobacterium avium
EFWCQGFSEPGAGSDLA

SEQ ID NO: 95924 - protein, 34 aa, Mycobacterium avium
EGAGATWGGLVKNAWKESFVNAAVNPQEFAQARL

SEQ ID NO: 95925 - protein, 25 aa, Mycobacterium avium
EGARDIAAEIGLPVMVKAQVKTGGR

SEQ ID NO: 95926 - protein, 18 aa, Mycobacterium avium
EGDGLVIGGPLGDLLEGL

SEQ ID NO: 95927 - protein, 22 aa, Mycobacterium avium
EGDPRPVLRADLRPEWAEHDLS

SEQ ID NO: 95928 - protein, 27 aa, Mycobacterium avium
EGEDIFARGGPYLARGAADLVPTAELL

SEQ ID NO: 95929 - protein, 25 aa, Mycobacterium avium
EGEGVPSRARREGAARVRAASVPDV

SEQ ID NO: 95930 - protein, 26 aa, Mycobacterium avium
EGELRLKGPQCFLGYVDATLDAHAFD

SEQ ID NO: 95931 - protein, 22 aa, Mycobacterium avium
EGELRPQLLDRFGLTVDVHASR

SEQ ID NO: 95932 - protein, 23 aa, Mycobacterium avium
EGFARPGARRSRADFEICATANI

SEQ ID NO: 95933 - protein, 25 aa, Mycobacterium avium
EGFHAATVRRIRPGERLVLGDGAGG

SEQ ID NO: 95934 - protein, 24 aa, Mycobacterium avium
EGFHAATVRRIRPGERLVLGDRAG

SEQ ID NO: 95935 - protein, 17 aa, Mycobacterium avium
EGFLRRARDEGATVLVG

SEQ ID NO: 95936 - protein, 19 aa, Mycobacterium avium
EGFLSSHLVAGVEPGTVVR

SEQ ID NO: 95937 - protein, 22 aa, Mycobacterium avium
EGFPLTRLQQAYTLGAAGLNGS

SEQ ID NO: 95938 - protein, 18 aa, Mycobacterium avium
EGFTSLWYASTVAGDPLV

SEQ ID NO: 95939 - protein, 19 aa, Mycobacterium avium
EGGPARTWREHSMAAMKPR

SEQ ID NO: 95940 - protein, 20 aa, Mycobacterium avium
EGGQGISCFLVDKDTEGLTF

SEQ ID NO: 95941 - protein, 20 aa, Mycobacterium avium
EGHIYRACQRVGAQSRDELA

SEQ ID NO: 95942 - protein, 24 aa, Mycobacterium avium
EGHLYRLFTKLGINNRDQLIQLIG

SEQ ID NO: 95943 - protein, 17 aa, Mycobacterium avium
EGIGCGFTEAVRGVLSH

SEQ ID NO: 95944 - protein, 23 aa, Mycobacterium avium
EGIGRPRVEPSFLPGVVDRMVAV

SEQ ID NO: 95945 - protein, 17 aa, Mycobacterium avium
EGLAAVLTGAADQARAA

SEQ ID NO: 95946 - protein, 30 aa, Mycobacterium avium
EGLGGAWLTFKAIDIVGTILRPIASGLGTI

SEQ ID NO: 95947 - protein, 17 aa, Mycobacterium avium
EGLIDRGPRVGTHVAQR

SEQ ID NO: 95948 - protein, 18 aa, Mycobacterium avium
EGLLPYLPPHAQDRLLDN

SEQ ID NO: 95949 - protein, 19 aa, Mycobacterium avium
EGLRYLMSHLPRERLGVTA

SEQ ID NO: 95950 - protein, 22 aa, Mycobacterium avium
EGLWFPLTVATCVITLRDRSGF

SEQ ID NO: 95951 - protein, 21 aa, Mycobacterium avium
EGNELGWRMEVEHDGQWHFFD

SEQ ID NO: 95952 - protein, 23 aa, Mycobacterium avium
EGNHLGPTLSMRGIDNAAYYRLV

SEQ ID NO: 95953 - protein, 24 aa, Mycobacterium avium
EGNLTQLELQWGRTIGMQPPSPVT

SEQ ID NO: 95954 - protein, 24 aa, Mycobacterium avium
EGNLTQLELQWGRTIGMQPSPVTG

SEQ ID NO: 95955 - protein, 17 aa, Mycobacterium avium
EGQEWVLGHCEAHGVAV

SEQ ID NO: 95956 - protein, 25 aa, Mycobacterium avium
EGRCCPWCVIRTELRPCARCGEDGY

SEQ ID NO: 95957 - protein, 22 aa, Mycobacterium avium
EGRTDWRTVRLIITRTSLVTDT

SEQ ID NO: 95958 - protein, 20 aa, Mycobacterium avium
EGSARARNVLAIKLDAQLID

SEQ ID NO: 95959 - protein, 24 aa, Mycobacterium avium
EGTGREIPAGKDWVVQHGPAKEAF

SEQ ID NO: 95960 - protein, 18 aa, Mycobacterium avium
EGTQQGWLIEQARKHRVL

SEQ ID NO: 95961 - protein, 20 aa, Mycobacterium avium
EGTVTRWLKQEGDTVELDEP

SEQ ID NO: 95962 - protein, 18 aa, Mycobacterium avium
EGTWWKHRPIFNQEDPGE

SEQ ID NO: 95963 - protein, 25 aa, Mycobacterium avium
EGVDAEWRYHHLLMVDGESITRSEL

SEQ ID NO: 95964 - protein, 18 aa, Mycobacterium avium
EGVDAVIYDEEFTATVDR

SEQ ID NO: 95965 - protein, 21 aa, Mycobacterium avium
EGVDVRLGVGVAQVRGDTHVE

SEQ ID NO: 95966 - protein, 30 aa, Mycobacterium avium
EGVFERFPALKFVWADGAADFLTPFIWRMD

SEQ ID NO: 95967 - protein, 29 aa, Mycobacterium avium
EGVFERFPALKFVWADGAADFLTPFMWRM

SEQ ID NO: 95968 - protein, 30 aa, Mycobacterium avium
EGVFERFPALKFVWADGAADFLTPFMWRMD

SEQ ID NO: 95969 - protein, 24 aa, Mycobacterium avium
EGVFPAGVIDAMFAHHIDELLRLA

SEQ ID NO: 95970 - protein, 17 aa, Mycobacterium avium
EGVRLATDVWPNNLIIP

SEQ ID NO: 95971 - protein, 33 aa, Mycobacterium avium
EGVRWAMRHLPFYGRWYRFLVLWPGSDKGLDAA

SEQ ID NO: 95972 - protein, 21 aa, Mycobacterium avium
EGVTLRFGSKVPGTAMEVRDV

SEQ ID NO: 95973 - protein, 24 aa, Mycobacterium avium
EGVTRAGGIAVLLPPQPMDTGIVG

SEQ ID NO: 95974 - protein, 32 aa, Mycobacterium avium
EHAAEVRALLTWGRPGVDAALIAALPNLEVIV

SEQ ID NO: 95975 - protein, 24 aa, Mycobacterium avium
EHAAVLWRYALRLTGDASQSEDVV

SEQ ID NO: 95976 - protein, 23 aa, Mycobacterium avium
EHCWETKAGTFVKVPANVVHSLK

SEQ ID NO: 95977 - protein, 24 aa, Mycobacterium avium
EHDAIEPKPDWEPYYHYRVVIDGD

SEQ ID NO: 95978 - protein, 20 aa, Mycobacterium avium
EHDLHLFLRRIKFDEAVDGT

SEQ ID NO: 95979 - protein, 24 aa, Mycobacterium avium
EHDVAIVLGSGWSPAVAALGTPTA

SEQ ID NO: 95980 - protein, 17 aa, Mycobacterium avium
EHEFKRDTTVLVELVTV

SEQ ID NO: 95981 - protein, 24 aa, Mycobacterium avium
EHGEIPLGIYCRASLARYMDAERL

SEQ ID NO: 95982 - protein, 18 aa, Mycobacterium avium
EHGLLTTVCYQFGDAKPV

SEQ ID NO: 95983 - protein, 18 aa, Mycobacterium avium
EHLDRVEGFVKRAEADGA

SEQ ID NO: 95984 - protein, 20 aa, Mycobacterium avium
EHPIHLLLRRARANSVLVGR

SEQ ID NO: 95985 - protein, 19 aa, Mycobacterium avium
EHRDRLSTLMITYPSTHGV

SEQ ID NO: 95986 - protein, 19 aa, Mycobacterium avium
EHRHSLGGVQVRIPGLPPV

SEQ ID NO: 95987 - protein, 20 aa, Mycobacterium avium
EHRIDVAALVACFPNVVVVR

SEQ ID NO: 95988 - protein, 19 aa, Mycobacterium avium
EHRVFLNLLRERFETDKTK

SEQ ID NO: 95989 - protein, 34 aa, Mycobacterium avium
EHVLRELPYDWALELGCGTGFFLLNLIQSGVARR

SEQ ID NO: 95990 - protein, 26 aa, Mycobacterium avium
EHVMYKPRWGAFYGTKLVQHLRESGT

SEQ ID NO: 95991 - protein, 26 aa, Mycobacterium avium
EHVTRLRPDLRPDLPQPAAGDGSYRV

SEQ ID NO: 95992 - protein, 18 aa, Mycobacterium avium
EIAARWGEISDMSAAKLG

SEQ ID NO: 95993 - protein, 21 aa, Mycobacterium avium
EIAEQLLRVLARRLRRTNNNL

SEQ ID NO: 95994 - protein, 25 aa, Mycobacterium avium
EIAIRAFRAAYELEMATVAVYPYED

SEQ ID NO: 95995 - protein, 22 aa, Mycobacterium avium
EIDAAAVDRIWAAARHWYQGGF

SEQ ID NO: 95996 - protein, 19 aa, Mycobacterium avium
EIDGKPVFSGFNRDAQGGR

SEQ ID NO: 95997 - protein, 18 aa, Mycobacterium avium
EIERGVADPDSWPAFVPT

SEQ ID NO: 95998 - protein, 26 aa, Mycobacterium avium
EIERPPEDWLFKARTGDMLVDVLHRL

SEQ ID NO: 95999 - protein, 19 aa, Mycobacterium avium
EIFGALLHGGRLVIVPDDI

SEQ ID NO: 96000 - protein, 20 aa, Mycobacterium avium
EIFGPIIGVLGYRDIDDAVA

SEQ ID NO: 96001 - protein, 17 aa, Mycobacterium avium
EIFSCFSMTEPQGGADP

SEQ ID NO: 96002 - protein, 26 aa, Mycobacterium avium
EIGFRVRRLAGRVVWMQPPDTPPRAQ

SEQ ID NO: 96003 - protein, 18 aa, Mycobacterium avium
EIGGVRMFFVKDPDGTPV

SEQ ID NO: 96004 - protein, 21 aa, Mycobacterium avium
EIGHKLVATGLVVAFQFTDPQ

SEQ ID NO: 96005 - protein, 23 aa, Mycobacterium avium
EIGYCLGRRWWGKGLMSEVLGML

SEQ ID NO: 96006 - protein, 24 aa, Mycobacterium avium
EIHDIELRSPVVIAGLPRTGTTHL

SEQ ID NO: 96007 - protein, 18 aa, Mycobacterium avium
EIHSALLSSGPGPGPLLA

SEQ ID NO: 96008 - protein, 23 aa, Mycobacterium avium
EIIELMRALWAPGWTEFDGEFYS

SEQ ID NO: 96009 - protein, 17 aa, Mycobacterium avium
EIKFRSVLEEPTYEDGI

SEQ ID NO: 96010 - protein, 19 aa, Mycobacterium avium
EIKTLASIFTTVRIEGPDY

SEQ ID NO: 96011 - protein, 29 aa, Mycobacterium avium
EILRAAAPGAWCAAPWRGAGHPDHEAVGH

SEQ ID NO: 96012 - protein, 27 aa, Mycobacterium avium
EILRAAAPGAWCAAPWRGDGHPDHEAV

SEQ ID NO: 96013 - protein, 20 aa, Mycobacterium avium
EILTRSAIFRGVEPGAESLL

SEQ ID NO: 96014 - protein, 26 aa, Mycobacterium avium
EIMRLCAALWLDACADPEIQRIVLLE

SEQ ID NO: 96015 - protein, 24 aa, Mycobacterium avium
EIPGQPGKYLAIFGDSFSGNKMGD

SEQ ID NO: 96016 - protein, 24 aa, Mycobacterium avium
EIPGQPGKYLAIFGDSFSGNKMGE

SEQ ID NO: 96017 - protein, 29 aa, Mycobacterium avium
EIRARLAKRLPEYMVPAAVVVLDALPLTV

SEQ ID NO: 96018 - protein, 29 aa, Mycobacterium avium
EIRARLAKRLPEYMVPAAVVVLETLPLTA

SEQ ID NO: 96019 - protein, 25 aa, Mycobacterium avium
EIRARLAQRLPEYMVPAAVVVLETL

SEQ ID NO: 96020 - protein, 18 aa, Mycobacterium avium
EIRLSAVQRGPFARPPVV

SEQ ID NO: 96021 - protein, 17 aa, Mycobacterium avium
EIRSWRAFLAANNGALP

SEQ ID NO: 96022 - protein, 17 aa, Mycobacterium avium
EISGKRGAKGFRAVVED

SEQ ID NO: 96023 - protein, 17 aa, Mycobacterium avium
EISLFRTFIQDVIGVEV

SEQ ID NO: 96024 - protein, 25 aa, Mycobacterium avium
EISLVDFFWRGSLVDRLNYVHVDGA

SEQ ID NO: 96025 - protein, 19 aa, Mycobacterium avium
EIVARPAGFLLEMAGTTLA

SEQ ID NO: 96026 - protein, 23 aa, Mycobacterium avium
EIVPGHRALLGGMVAGLIGLAVA

SEQ ID NO: 96027 - protein, 19 aa, Mycobacterium avium
EIVSTGWLGLHVDEAFGGQ

SEQ ID NO: 96028 - protein, 23 aa, Mycobacterium avium
EKAGFRGADALKVLDAAAQGAGS

SEQ ID NO: 96029 - protein, 18 aa, Mycobacterium avium
EKALAAKTADEWVRLLQD

SEQ ID NO: 96030 - protein, 20 aa, Mycobacterium avium
EKEGRRIVARQADVRDADAV

SEQ ID NO: 96031 - protein, 18 aa, Mycobacterium avium
EKELKRIRAAGFSDRPFS

SEQ ID NO: 96032 - protein, 17 aa, Mycobacterium avium
EKGEPRWPDGVVGSLTH

SEQ ID NO: 96033 - protein, 20 aa, Mycobacterium avium
EKHGKLPVAVNDIYLSTVGG

SEQ ID NO: 96034 - protein, 25 aa, Mycobacterium avium
EKILGRPAVPFAHWVATHRDLFDRR

SEQ ID NO: 96035 - protein, 26 aa, Mycobacterium avium
EKILGRPAVPFAHWVATHRDLFDRRN

SEQ ID NO: 96036 - protein, 19 aa, Mycobacterium avium
EKLALLNRCERLRRRLPAI

SEQ ID NO: 96037 - protein, 22 aa, Mycobacterium avium
EKLCDGRLVAVLEGGYDLQALA

SEQ ID NO: 96038 - protein, 23 aa, Mycobacterium avium
EKLEAWAEIKRRGFNPNDRAVYP

SEQ ID NO: 96039 - protein, 18 aa, Mycobacterium avium
EKLPDGWDADLPHWEAGS

SEQ ID NO: 96040 - protein, 24 aa, Mycobacterium avium
EKPGRREGWDYPDMARESGTNALA

SEQ ID NO: 96041 - protein, 30 aa, Mycobacterium avium
EKRAVLRLDPRLAPVKAAVLPLSRHADLSP

SEQ ID NO: 96042 - protein, 21 aa, Mycobacterium avium
EKTETGWRINGQKVWSSAAKS

SEQ ID NO: 96043 - protein, 20 aa, Mycobacterium avium
EKTFPMSMGMTAGNHQTPNG

SEQ ID NO: 96044 - protein, 20 aa, Mycobacterium avium
EKVRCDWLDTSHAFHSALLD

SEQ ID NO: 96045 - protein, 20 aa, Mycobacterium avium
EKVRCDWLDTSHAFHSALRD

SEQ ID NO: 96046 - protein, 19 aa, Mycobacterium avium
ELACAALADLQLSATTVYE

SEQ ID NO: 96047 - protein, 19 aa, Mycobacterium avium
ELADPKWQGFPMLPTPELR

SEQ ID NO: 96048 - protein, 20 aa, Mycobacterium avium
ELADPKWQGFPMLPTPELRT

SEQ ID NO: 96049 - protein, 23 aa, Mycobacterium avium
ELAELRKSAPIYWVDVPGGTGGF

SEQ ID NO: 96050 - protein, 19 aa, Mycobacterium avium
ELAGRLALPQRLERLLRRW

SEQ ID NO: 96051 - protein, 25 aa, Mycobacterium avium
ELAGYKQPRRFVFWREFPLGPAGKI

SEQ ID NO: 96052 - protein, 23 aa, Mycobacterium avium
ELAQRVAAVAGFLRQRLTGDYSV

SEQ ID NO: 96053 - protein, 18 aa, Mycobacterium avium
ELARPFRRRELPIVHVVR

SEQ ID NO: 96054 - protein, 18 aa, Mycobacterium avium
ELARRGRGTPAIFLNVRG

SEQ ID NO: 96055 - protein, 18 aa, Mycobacterium avium
ELARRVASNSIGFVAPIP

SEQ ID NO: 96056 - protein, 21 aa, Mycobacterium avium
ELARTCGRCGCVGAERIDWCE

SEQ ID NO: 96057 - protein, 26 aa, Mycobacterium avium
ELATRCAALGRFAFLLSAAPPRIGSL

SEQ ID NO: 96058 - protein, 21 aa, Mycobacterium avium
ELCDKRKVPLLFLQNIAGFMV

SEQ ID NO: 96059 - protein, 25 aa, Mycobacterium avium
ELDACPPLVVLTGRPDDAWLASWSR

SEQ ID NO: 96060 - protein, 18 aa, Mycobacterium avium
ELDRLAVAASSPADEDTL

SEQ ID NO: 96061 - protein, 17 aa, Mycobacterium avium
ELDRRAAAVAGTRRDWV

SEQ ID NO: 96062 - protein, 18 aa, Mycobacterium avium
ELDRRAAAVAGTRRDWVR

SEQ ID NO: 96063 - protein, 23 aa, Mycobacterium avium
ELEGRMYACFAAGPMAAGCEYEI

SEQ ID NO: 96064 - protein, 26 aa, Mycobacterium avium
ELEKRRAHVPWVTWGTTAMVARSVTK

SEQ ID NO: 96065 - protein, 18 aa, Mycobacterium avium
ELELKRLFVLTFETEFFG

SEQ ID NO: 96066 - protein, 21 aa, Mycobacterium avium
ELEQLPALGIMLTPFSAAGES

SEQ ID NO: 96067 - protein, 21 aa, Mycobacterium avium
ELEVRDGGKLVREMVGQMRSL

SEQ ID NO: 96068 - protein, 22 aa, Mycobacterium avium
ELEYGMNWFAWILRGVYPPPAY

SEQ ID NO: 96069 - protein, 28 aa, Mycobacterium avium
ELEYVEMWLRDVAAMLGYHAGAQSAAQA

SEQ ID NO: 96070 - protein, 17 aa, Mycobacterium avium
ELFFSNLVAHCLEYTRD

SEQ ID NO: 96071 - protein, 25 aa, Mycobacterium avium
ELGCKEALFTLGDRPEDRWPEAREW

SEQ ID NO: 96072 - protein, 17 aa, Mycobacterium avium
ELGEVRAALLGVEGVEQ

SEQ ID NO: 96073 - protein, 17 aa, Mycobacterium avium
ELGFDFLPGTTVNRYCS

SEQ ID NO: 96074 - protein, 17 aa, Mycobacterium avium
ELGQRMCHAAAELETVI

SEQ ID NO: 96075 - protein, 19 aa, Mycobacterium avium
ELGSRLVVHSGPDDGPYDA

SEQ ID NO: 96076 - protein, 17 aa, Mycobacterium avium
ELGVSEVTYHCWRNQFG

SEQ ID NO: 96077 - protein, 27 aa, Mycobacterium avium
ELHAAASCYRSVIAGLTTGRWLGPSSL

SEQ ID NO: 96078 - protein, 18 aa, Mycobacterium avium
ELHAHSAFSFLDGVSTPE

SEQ ID NO: 96079 - protein, 21 aa, Mycobacterium avium
ELHEVCRRHRALLIVDEAHGL

SEQ ID NO: 96080 - protein, 17 aa, Mycobacterium avium
ELIARIRAVLRRGGDDD

SEQ ID NO: 96081 - protein, 17 aa, Mycobacterium avium
ELIKNFQPWIAEIQVPG

SEQ ID NO: 96082 - protein, 20 aa, Mycobacterium avium
ELIKNFQPWIAEIQVPGSAS

SEQ ID NO: 96083 - protein, 21 aa, Mycobacterium avium
ELIKNFQPWIAEIQVPGSASN

SEQ ID NO: 96084 - protein, 18 aa, Mycobacterium avium
ELIYGPARSRPWKTVEDV

SEQ ID NO: 96085 - protein, 26 aa, Mycobacterium avium
ELKATGLRNLPCHSFWANAAWLEIVL

SEQ ID NO: 96086 - protein, 17 aa, Mycobacterium avium
ELLAALGELDRSFLEGD

SEQ ID NO: 96087 - protein, 34 aa, Mycobacterium avium
ELLAALPRWKRPLGRLLIKLAATFIPLREEGKSA

SEQ ID NO: 96088 - protein, 22 aa, Mycobacterium avium
ELLAHCGYRLSPIEQVMAGHIG

SEQ ID NO: 96089 - protein, 18 aa, Mycobacterium avium
ELLHACALVHDDVIDDSA

SEQ ID NO: 96090 - protein, 22 aa, Mycobacterium avium
ELLRRKLAERGLARPTGAASVA

SEQ ID NO: 96091 - protein, 22 aa, Mycobacterium avium
ELLVRGGVVFTGYWRNEQATAD

SEQ ID NO: 96092 - protein, 18 aa, Mycobacterium avium
ELLYAGAMFHDLGLTERY

SEQ ID NO: 96093 - protein, 20 aa, Mycobacterium avium
ELMARAWEIADIVNSNAPLA

SEQ ID NO: 96094 - protein, 18 aa, Mycobacterium avium
ELMDRWAPGRLMVNQYGP

SEQ ID NO: 96095 - protein, 20 aa, Mycobacterium avium
ELMQRVCPDMIGAGGGAIIN

SEQ ID NO: 96096 - protein, 24 aa, Mycobacterium avium
ELMVRIRLACLVAAYHGTLTVDEL

SEQ ID NO: 96097 - protein, 19 aa, Mycobacterium avium
ELNPSTGVELLIPDFNGRP

SEQ ID NO: 96098 - protein, 23 aa, Mycobacterium avium
ELNVPRRDLRMLAAQLGSDVPFA

SEQ ID NO: 96099 - protein, 23 aa, Mycobacterium avium
ELPGDAFVLAVQWHPEQSLQDLR

SEQ ID NO: 96100 - protein, 19 aa, Mycobacterium avium
ELPGPPILRHSLTVALIAG

SEQ ID NO: 96101 - protein, 23 aa, Mycobacterium avium
ELPKPELCLAAILRDLGHARALA

SEQ ID NO: 96102 - protein, 17 aa, Mycobacterium avium
ELPLGAGVTRCLRKPDV

SEQ ID NO: 96103 - protein, 17 aa, Mycobacterium avium
ELPLRQRVEVVIDTAWS

SEQ ID NO: 96104 - protein, 21 aa, Mycobacterium avium
ELPTTLPLVGVGHSMGACLTT

SEQ ID NO: 96105 - protein, 29 aa, Mycobacterium avium
ELQAAGGPGCVARAAAALSTGALNGARGN

SEQ ID NO: 96106 - protein, 30 aa, Mycobacterium avium
ELQAAGGPGCVARAAAALSTGALNGARGNS

SEQ ID NO: 96107 - protein, 21 aa, Mycobacterium avium
ELQDWHALVTMRIDGDVHLPA

SEQ ID NO: 96108 - protein, 22 aa, Mycobacterium avium
ELQDWHALVTMRIDGDVHLPAN

SEQ ID NO: 96109 - protein, 19 aa, Mycobacterium avium
ELQEFIGAFWYHYDEAHYD

SEQ ID NO: 96110 - protein, 22 aa, Mycobacterium avium
ELQFGTNHLGHFALTGRLLALL

SEQ ID NO: 96111 - protein, 27 aa, Mycobacterium avium
ELQRRGCPVRHLILLDALLVIPSSDVL

SEQ ID NO: 96112 - protein, 24 aa, Mycobacterium avium
ELRAAWVDIPEVFSAATVTGTPDA

SEQ ID NO: 96113 - protein, 26 aa, Mycobacterium avium
ELRALLPRERLKRITAHSIGSRAALE

SEQ ID NO: 96114 - protein, 26 aa, Mycobacterium avium
ELRALLPRERLKRITAHSLGSRAALE

SEQ ID NO: 96115 - protein, 20 aa, Mycobacterium avium
ELRALPQRVVDVLHRQRRPV

SEQ ID NO: 96116 - protein, 19 aa, Mycobacterium avium
ELRERVGAVAMGRALTLII

SEQ ID NO: 96117 - protein, 22 aa, Mycobacterium avium
ELRERVGAVAMGRVLTLIIAPD

SEQ ID NO: 96118 - protein, 22 aa, Mycobacterium avium
ELRERVGAVAMGRVLTLIITPD

SEQ ID NO: 96119 - protein, 22 aa, Mycobacterium avium
ELRPVPCGATGELYLGGAQLAR

SEQ ID NO: 96120 - protein, 21 aa, Mycobacterium avium
ELRRAHAAGHDVARLHSGDPS

SEQ ID NO: 96121 - protein, 21 aa, Mycobacterium avium
ELRRLIPPWVTLGSRLAALPK

SEQ ID NO: 96122 - protein, 26 aa, Mycobacterium avium
ELRRRIGHAPLWLPGITAVTIRGRKV

SEQ ID NO: 96123 - protein, 22 aa, Mycobacterium avium
ELRRTRLLFHHDLTPGVAATVH

SEQ ID NO: 96124 - protein, 27 aa, Mycobacterium avium
ELRVRVDMGWREWKVAVEYDGIQHWDD

SEQ ID NO: 96125 - protein, 18 aa, Mycobacterium avium
ELSEIGVLVEQNLIGESY

SEQ ID NO: 96126 - protein, 22 aa, Mycobacterium avium
ELSGRPSYLGRFEHVADAARAV

SEQ ID NO: 96127 - protein, 24 aa, Mycobacterium avium
ELSPPCPVRHGWPSSTLPPFRRPN

SEQ ID NO: 96128 - protein, 25 aa, Mycobacterium avium
ELSQLRLLPFRLVLDGAQEIDAEIT

SEQ ID NO: 96129 - protein, 24 aa, Mycobacterium avium
ELTEAIKLVALVADRGAQVRMEFT

SEQ ID NO: 96130 - protein, 17 aa, Mycobacterium avium
ELTELELQWGRTIGQMP

SEQ ID NO: 96131 - protein, 19 aa, Mycobacterium avium
ELTGRPFAASAPRIGAPRW

SEQ ID NO: 96132 - protein, 18 aa, Mycobacterium avium
ELTQLALGVGRQYVAQTR

SEQ ID NO: 96133 - protein, 19 aa, Mycobacterium avium
ELTSKLLVRQGDRRAVRSV

SEQ ID NO: 96134 - protein, 17 aa, Mycobacterium avium
ELTVPGVAQTVTLSRVA

SEQ ID NO: 96135 - protein, 21 aa, Mycobacterium avium
ELVACDRIPPGPGQIEVAVSA

SEQ ID NO: 96136 - protein, 22 aa, Mycobacterium avium
ELVDFRRARREEYRRIEVPTVF

SEQ ID NO: 96137 - protein, 22 aa, Mycobacterium avium
ELVDRWAPDRVMVNVYGPTETT

SEQ ID NO: 96138 - protein, 18 aa, Mycobacterium avium
ELVERWGPGRVMINEYGP

SEQ ID NO: 96139 - protein, 25 aa, Mycobacterium avium
ELVGELRAGLPPTLAVAGGYLDGIG

SEQ ID NO: 96140 - protein, 19 aa, Mycobacterium avium
ELVGPFTVINVDARAGKSV

SEQ ID NO: 96141 - protein, 21 aa, Mycobacterium avium
ELVQLRWAQRVNISAKTGRAV

SEQ ID NO: 96142 - protein, 25 aa, Mycobacterium avium
ELVRRSHFLLLRFHEGRLPQRPVDP

SEQ ID NO: 96143 - protein, 25 aa, Mycobacterium avium
ELVVPFCAACAQVLDLDQEVCDDCG

SEQ ID NO: 96144 - protein, 18 aa, Mycobacterium avium
ELWPQLRAAFTPPDEQAS

SEQ ID NO: 96145 - protein, 22 aa, Mycobacterium avium
ELWSEAGKLGFLGVNLPEQYGG

SEQ ID NO: 96146 - protein, 17 aa, Mycobacterium avium
ELYPEQLQYIPANVTAQ

SEQ ID NO: 96147 - protein, 23 aa, Mycobacterium avium
ELYRRLREAGGPVFVRTNRPDSP

SEQ ID NO: 96148 - protein, 25 aa, Mycobacterium avium
EMAENVRGTWLFNRYPGARCDIESI

SEQ ID NO: 96149 - protein, 25 aa, Mycobacterium avium
EMIRYCTPAQWFARTVRKPFDIHGQ

SEQ ID NO: 96150 - protein, 32 aa, Mycobacterium avium
EMLAGLPLIPFIPRWLVRRGESLAMASSQLPV

SEQ ID NO: 96151 - protein, 22 aa, Mycobacterium avium
EMLDLGFLPDIERILRQIPDDR

SEQ ID NO: 96152 - protein, 18 aa, Mycobacterium avium
EMPEEWARLAQGHLPSAV

SEQ ID NO: 96153 - protein, 33 aa, Mycobacterium avium
EMPERYRAMVLLAAWCALRFGELTELRRRDIII

SEQ ID NO: 96154 - protein, 19 aa, Mycobacterium avium
EMPSFPALQQAGVRYRWDG

SEQ ID NO: 96155 - protein, 23 aa, Mycobacterium avium
EMRPRLAKPPAPQASWGQGSGGI

SEQ ID NO: 96156 - protein, 19 aa, Mycobacterium avium
EMSAFKWTALGHREIADMI

SEQ ID NO: 96157 - protein, 20 aa, Mycobacterium avium
EMVDRCPSTRLVLGGFSQGA

SEQ ID NO: 96158 - protein, 28 aa, Mycobacterium avium
EMYSRTAGPRIWEKTGLTPADMDVACMY

SEQ ID NO: 96159 - protein, 22 aa, Mycobacterium avium
ENAKMGINYGLNKVRFLAPVTA

SEQ ID NO: 96160 - protein, 25 aa, Mycobacterium avium
ENAKMGINYGLNKVRFLSAVTAGSR

SEQ ID NO: 96161 - protein, 24 aa, Mycobacterium avium
ENALPRRGVSALVRRPKRRPLDEG

SEQ ID NO: 96162 - protein, 23 aa, Mycobacterium avium
ENALWPDLFIAGGGISRKADKWL

SEQ ID NO: 96163 - protein, 23 aa, Mycobacterium avium
ENFSPRVVEQFGLDYDSIARVNP

SEQ ID NO: 96164 - protein, 19 aa, Mycobacterium avium
ENIKRQWWRSVVTAREDVV

SEQ ID NO: 96165 - protein, 24 aa, Mycobacterium avium
ENLCGTVRFDLAVQYARACGADTF

SEQ ID NO: 96166 - protein, 24 aa, Mycobacterium avium
ENLESRSGRRFGHVDHPLLVSVRS

SEQ ID NO: 96167 - protein, 26 aa, Mycobacterium avium
ENMSHWAGKEWDHFLHGTPVGRALNQ

SEQ ID NO: 96168 - protein, 21 aa, Mycobacterium avium
ENPAAMGYPSFHDEYWNPLWK

SEQ ID NO: 96169 - protein, 25 aa, Mycobacterium avium
ENPFLPVPLADQFGLSKGLPGLAEW

SEQ ID NO: 96170 - protein, 38 aa, Mycobacterium avium
ENPFLPVPLADRFGLSKGLPGLAEWTVGFLEDLVLGPL

SEQ ID NO: 96171 - protein, 18 aa, Mycobacterium avium
ENPIIFNLPATVEMATPN

SEQ ID NO: 96172 - protein, 21 aa, Mycobacterium avium
ENQPGFLGFQLLRPVQGEDRY

SEQ ID NO: 96173 - protein, 23 aa, Mycobacterium avium
ENQVARMDLVWSLAERWTADGRP

SEQ ID NO: 96174 - protein, 17 aa, Mycobacterium avium
ENVTSRLIELFLAHFAI

SEQ ID NO: 96175 - protein, 22 aa, Mycobacterium avium
EPAELVSAFGAQRLRYTAQTWG

SEQ ID NO: 96176 - protein, 31 aa, Mycobacterium avium
EPALARTLRRALPLMARLTLAKVPARVALRT

SEQ ID NO: 96177 - protein, 22 aa, Mycobacterium avium
EPARVWPDVLAFTRSGDPAQTP

SEQ ID NO: 96178 - protein, 18 aa, Mycobacterium avium
EPDAGWAVIDVETSGFRP

SEQ ID NO: 96179 - protein, 20 aa, Mycobacterium avium
EPDAYAGLVSLRLPTEEELA

SEQ ID NO: 96180 - protein, 20 aa, Mycobacterium avium
EPDRLTWIMPRDSWLLDRAT

SEQ ID NO: 96181 - protein, 30 aa, Mycobacterium avium
EPGELSVHYPFPIKDLVAIDDALKFGSRAS

SEQ ID NO: 96182 - protein, 19 aa, Mycobacterium avium
EPGKFVKAADWVGRAEAEA

SEQ ID NO: 96183 - protein, 17 aa, Mycobacterium avium
EPGRGLLLTELHPGVTV

SEQ ID NO: 96184 - protein, 23 aa, Mycobacterium avium
EPGRKFLRRRIAECTSAAESATG

SEQ ID NO: 96185 - protein, 26 aa, Mycobacterium avium
EPGTMGGMRFKLAGMVGGEERVVLEH

SEQ ID NO: 96186 - protein, 18 aa, Mycobacterium avium
EPGVAELLAGSRTVAVLE

SEQ ID NO: 96187 - protein, 19 aa, Mycobacterium avium
EPHGAPTPAGRPGGRPWTY

SEQ ID NO: 96188 - protein, 18 aa, Mycobacterium avium
EPHLARIGCPALVINAEA

SEQ ID NO: 96189 - protein, 17 aa, Mycobacterium avium
EPIRDWVKLAVTRARNS

SEQ ID NO: 96190 - protein, 17 aa, Mycobacterium avium
EPIRLPDRTWPDKVIDR

SEQ ID NO: 96191 - protein, 23 aa, Mycobacterium avium
EPLLADLDCGRWRGRALQTVDEA

SEQ ID NO: 96192 - protein, 26 aa, Mycobacterium avium
EPLPGFLPSLWEIMPDLSVYIEAVHR

SEQ ID NO: 96193 - protein, 19 aa, Mycobacterium avium
EPMLGTWQSIVLVDLNRDN

SEQ ID NO: 96194 - protein, 17 aa, Mycobacterium avium
EPMRFAPERWNPDAPGY

SEQ ID NO: 96195 - protein, 20 aa, Mycobacterium avium
EPPETARLVGFHGAATPAET

SEQ ID NO: 96196 - protein, 18 aa, Mycobacterium avium
EPPVGRLTAGSVIPLSRA

SEQ ID NO: 96197 - protein, 25 aa, Mycobacterium avium
EPRESDIWLLGAIGPRMVYSTNLDA

SEQ ID NO: 96198 - protein, 18 aa, Mycobacterium avium
EPRPIASMPKVVQHTRDS

SEQ ID NO: 96199 - protein, 22 aa, Mycobacterium avium
EPRRPLHWRPGSDPAVADLVGD

SEQ ID NO: 96200 - protein, 21 aa, Mycobacterium avium
EPRRPRLFLVSAGNIRDLRGT

SEQ ID NO: 96201 - protein, 20 aa, Mycobacterium avium
EPSAAWDVQHIGARGSCTDM

SEQ ID NO: 96202 - protein, 25 aa, Mycobacterium avium
EPSFGVPWLYNYIGQPWKTQHTVDR

SEQ ID NO: 96203 - protein, 26 aa, Mycobacterium avium
EPSRASICRFATWWVVLERHDQLVRL

SEQ ID NO: 96204 - protein, 22 aa, Mycobacterium avium
EPSVRFNPVLLKPGSDRTSQLV

SEQ ID NO: 96205 - protein, 17 aa, Mycobacterium avium
EPTPEPKPARASETPSA

SEQ ID NO: 96206 - protein, 21 aa, Mycobacterium avium
EPTTALPKMRAEGSGGSESDA

SEQ ID NO: 96207 - protein, 17 aa, Mycobacterium avium
EPVDLGGGQIEWRAKPD

SEQ ID NO: 96208 - protein, 18 aa, Mycobacterium avium
EPVQAGGRLGEWLAGTFA

SEQ ID NO: 96209 - protein, 19 aa, Mycobacterium avium
EPVQAGGRLGEWLAGTFAA

SEQ ID NO: 96210 - protein, 17 aa, Mycobacterium avium
EPVVVGVDGVRVGLSVC

SEQ ID NO: 96211 - protein, 25 aa, Mycobacterium avium
EPYHGRLPPIWIGASGPRMLDIAGR

SEQ ID NO: 96212 - protein, 19 aa, Mycobacterium avium
EQANINWGKAGRMRWKGKR

SEQ ID NO: 96213 - protein, 26 aa, Mycobacterium avium
EQAPRRCVVCGKSFIPQTSQVRTCGR

SEQ ID NO: 96214 - protein, 24 aa, Mycobacterium avium
EQARFGSVFIKAGFSSMDMGTSYL

SEQ ID NO: 96215 - protein, 19 aa, Mycobacterium avium
EQAWQHFQAIEARGGFAEA

SEQ ID NO: 96216 - protein, 29 aa, Mycobacterium avium
EQDAVFGVFCRRWGVPLIDGGTVRLPRLI

SEQ ID NO: 96217 - protein, 17 aa, Mycobacterium avium
EQDWSFGNPAAMGDGIR

SEQ ID NO: 96218 - protein, 25 aa, Mycobacterium avium
EQEIKRPLVTLGMPRTGTTVISYLL

SEQ ID NO: 96219 - protein, 17 aa, Mycobacterium avium
EQGEVIGAQGFYIDVST

SEQ ID NO: 96220 - protein, 19 aa, Mycobacterium avium
EQGEVIGAQGFYIDVSTPH

SEQ ID NO: 96221 - protein, 20 aa, Mycobacterium avium
EQHRGRLGVQLHRQATGAGV

SEQ ID NO: 96222 - protein, 23 aa, Mycobacterium avium
EQKRAQLRAGLESGRLQRFPGAF

SEQ ID NO: 96223 - protein, 18 aa, Mycobacterium avium
EQLAQTWLGLGPAIVAVT

SEQ ID NO: 96224 - protein, 20 aa, Mycobacterium avium
EQLLGVGVRVVAGRGELIDP

SEQ ID NO: 96225 - protein, 22 aa, Mycobacterium avium
EQLLLERAYLLGVTGPEMTVLV

SEQ ID NO: 96226 - protein, 17 aa, Mycobacterium avium
EQLPKIGADLENIAAAL

SEQ ID NO: 96227 - protein, 19 aa, Mycobacterium avium
EQLVTFAPRTGCGGRLGLV

SEQ ID NO: 96228 - protein, 24 aa, Mycobacterium avium
EQMAADLATVWARVRDDDDIHVAV

SEQ ID NO: 96229 - protein, 24 aa, Mycobacterium avium
EQMAAELAAVWARVRDDEDIRAAV

SEQ ID NO: 96230 - protein, 26 aa, Mycobacterium avium
EQRARWLPRLVSGDMVVGIGAKSNAT

SEQ ID NO: 96231 - protein, 23 aa, Mycobacterium avium
EQRKAYGGKVFDVLGEVFAETSL

SEQ ID NO: 96232 - protein, 26 aa, Mycobacterium avium
EQRRGLTIDLGFVWTELAGRRLAFVD

SEQ ID NO: 96233 - protein, 27 aa, Mycobacterium avium
EQRRGLTIDLGFVWTELAGRRLAFVDV

SEQ ID NO: 96234 - protein, 21 aa, Mycobacterium avium
EQVADWDYVCEQLAAAEPWWE

SEQ ID NO: 96235 - protein, 17 aa, Mycobacterium avium
EQVDGKLICLVRARSDE

SEQ ID NO: 96236 - protein, 21 aa, Mycobacterium avium
EQVDGKLICLVRARSDEEAWG

SEQ ID NO: 96237 - protein, 18 aa, Mycobacterium avium
EQVGACERVLEIATDYAR

SEQ ID NO: 96238 - protein, 27 aa, Mycobacterium avium
EQWQDELFFKFGLRFDLLTNQLIDANV

SEQ ID NO: 96239 - protein, 17 aa, Mycobacterium avium
EQWRKMIAINLMGPIHV

SEQ ID NO: 96240 - protein, 20 aa, Mycobacterium avium
EQYGGAGLSVLGQVVVAEEA

SEQ ID NO: 96241 - protein, 18 aa, Mycobacterium avium
ERAAALGDYRWRDLLDNH

SEQ ID NO: 96242 - protein, 19 aa, Mycobacterium avium
ERAAALGDYRWRDLLDNHD

SEQ ID NO: 96243 - protein, 19 aa, Mycobacterium avium
ERAAARRLAQIRESMRPQQ

SEQ ID NO: 96244 - protein, 19 aa, Mycobacterium avium
ERAADYIKAHVSKPVVGYV

SEQ ID NO: 96245 - protein, 21 aa, Mycobacterium avium
ERADGTILWMADERAIGDHVV

SEQ ID NO: 96246 - protein, 25 aa, Mycobacterium avium
ERAIMRRLYPLIGRLFARQTAEISL

SEQ ID NO: 96247 - protein, 17 aa, Mycobacterium avium
ERALRIAAEYTTGREQF

SEQ ID NO: 96248 - protein, 17 aa, Mycobacterium avium
ERALYGADALRVVKASE

SEQ ID NO: 96249 - protein, 21 aa, Mycobacterium avium
ERATTGFGWSRPGRSALAGNI

SEQ ID NO: 96250 - protein, 32 aa, Mycobacterium avium
ERAVARGSFFPVIPVCSSTGVGTLELLEVATR

SEQ ID NO: 96251 - protein, 17 aa, Mycobacterium avium
ERDNCPQRAFPALGRAL

SEQ ID NO: 96252 - protein, 17 aa, Mycobacterium avium
EREARAWAGAHHGSVVE

SEQ ID NO: 96253 - protein, 20 aa, Mycobacterium avium
EREEVFTPDGYYRTGDCGVE

SEQ ID NO: 96254 - protein, 22 aa, Mycobacterium avium
ERELRVPLHYYRDPKITEIEEA

SEQ ID NO: 96255 - protein, 18 aa, Mycobacterium avium
ERERHRYLTAQEVQTLAT

SEQ ID NO: 96256 - protein, 23 aa, Mycobacterium avium
ERFDLDAVEAFELLTRLSQQSNT

SEQ ID NO: 96257 - protein, 19 aa, Mycobacterium avium
ERFTTAMAPFGFDAGAATP

SEQ ID NO: 96258 - protein, 17 aa, Mycobacterium avium
ERGGEWVLATGVRAMIE

SEQ ID NO: 96259 - protein, 21 aa, Mycobacterium avium
ERGIGGLMLESFLVAGAQPLG

SEQ ID NO: 96260 - protein, 20 aa, Mycobacterium avium
ERGLLLTTLWYIRVVEPTTL

SEQ ID NO: 96261 - protein, 25 aa, Mycobacterium avium
ERGLPITMTKLRFMKFIMDEIFPGG

SEQ ID NO: 96262 - protein, 18 aa, Mycobacterium avium
ERGPEMLSFVLKHTPLKM

SEQ ID NO: 96263 - protein, 19 aa, Mycobacterium avium
ERGPEMLSFVLKHTPLKMC

SEQ ID NO: 96264 - protein, 20 aa, Mycobacterium avium
ERGPEMLSFVLKHTPLKMCW

SEQ ID NO: 96265 - protein, 18 aa, Mycobacterium avium
ERGRLCPDVGPGGHGDGH

SEQ ID NO: 96266 - protein, 23 aa, Mycobacterium avium
ERGVRPGAVVSWQLPTTLETMVL

SEQ ID NO: 96267 - protein, 25 aa, Mycobacterium avium
ERHAIKAHCCSGVRGLGPAQGGVPG

SEQ ID NO: 96268 - protein, 24 aa, Mycobacterium avium
ERHELRIGLEVEVHFDSASADTAL

SEQ ID NO: 96269 - protein, 27 aa, Mycobacterium avium
ERIIQCAAEVFLQNGFHATSIDMIATA

SEQ ID NO: 96270 - protein, 21 aa, Mycobacterium avium
ERILRGRTGALIVLGNDENVE

SEQ ID NO: 96271 - protein, 17 aa, Mycobacterium avium
ERIPISIAALGPKNVEL

SEQ ID NO: 96272 - protein, 21 aa, Mycobacterium avium
ERKICGLALYAPRDAIEVTCP

SEQ ID NO: 96273 - protein, 24 aa, Mycobacterium avium
ERLARLRDLGCDYVICYFPEAAYD

SEQ ID NO: 96274 - protein, 17 aa, Mycobacterium avium
ERLEAAASVKGADLFPD

SEQ ID NO: 96275 - protein, 18 aa, Mycobacterium avium
ERLEALGAVRLTARVDVD

SEQ ID NO: 96276 - protein, 17 aa, Mycobacterium avium
ERLESVALVLGGEACPV

SEQ ID NO: 96277 - protein, 18 aa, Mycobacterium avium
ERLGHRLSAMLWLTVAPR

SEQ ID NO: 96278 - protein, 19 aa, Mycobacterium avium
ERLGWAEITVESVLADPNT

SEQ ID NO: 96279 - protein, 17 aa, Mycobacterium avium
ERLLAPGGSLVFIDATA

SEQ ID NO: 96280 - protein, 17 aa, Mycobacterium avium
ERLLLTVHLDPFTREQT

SEQ ID NO: 96281 - protein, 17 aa, Mycobacterium avium
ERLPAYMVPAAVVTLDA

SEQ ID NO: 96282 - protein, 19 aa, Mycobacterium avium
ERLPTPFGLVRFGVAPDHQ

SEQ ID NO: 96283 - protein, 17 aa, Mycobacterium avium
ERLSRREARRRCIELLD

SEQ ID NO: 96284 - protein, 17 aa, Mycobacterium avium
ERLWPTLLEPLRSRRHA

SEQ ID NO: 96285 - protein, 21 aa, Mycobacterium avium
ERLWVGMAVSAVFRPVDVDDP

SEQ ID NO: 96286 - protein, 18 aa, Mycobacterium avium
ERMDRIQALMARIDPDRA

SEQ ID NO: 96287 - protein, 17 aa, Mycobacterium avium
ERMWARNAAAMYAYADA

SEQ ID NO: 96288 - protein, 33 aa, Mycobacterium avium
ERPAGSAPLSWPAGWSGWPHRVYGDTRLELAER

SEQ ID NO: 96289 - protein, 17 aa, Mycobacterium avium
ERPDGAWHAEWDTLRIL

SEQ ID NO: 96290 - protein, 23 aa, Mycobacterium avium
ERPDPPAGFSAFFDGAPTFIKDN

SEQ ID NO: 96291 - protein, 27 aa, Mycobacterium avium
ERPETAPDEIVRWATPVTAFQRTALED

SEQ ID NO: 96292 - protein, 17 aa, Mycobacterium avium
ERPRGVFSRQLFLGDNL

SEQ ID NO: 96293 - protein, 25 aa, Mycobacterium avium
ERPSAIFRRHVRVVPYPEDDIPGIV

SEQ ID NO: 96294 - protein, 25 aa, Mycobacterium avium
ERPWRRAGSGVVRPGDLVAFAAGAL

SEQ ID NO: 96295 - protein, 19 aa, Mycobacterium avium
ERQDVVKAFSMLRNHYSVV

SEQ ID NO: 96296 - protein, 18 aa, Mycobacterium avium
ERQLLCHNGLRALVDVHR

SEQ ID NO: 96297 - protein, 22 aa, Mycobacterium avium
ERQREIFGAFATSGAARRDAVM

SEQ ID NO: 96298 - protein, 19 aa, Mycobacterium avium
ERRAIQGFLESGVDLDDVL

SEQ ID NO: 96299 - protein, 18 aa, Mycobacterium avium
ERRFANRRVDAVQDGTLL

SEQ ID NO: 96300 - protein, 18 aa, Mycobacterium avium
ERRLARWMRLYPDVQAES

SEQ ID NO: 96301 - protein, 18 aa, Mycobacterium avium
ERRRLGLMGLLPTTVKTL

SEQ ID NO: 96302 - protein, 25 aa, Mycobacterium avium
ERRVRPARREVLPPPARREVLPPLA

SEQ ID NO: 96303 - protein, 21 aa, Mycobacterium avium
ERSAMITTVFARMGFAPELVP

SEQ ID NO: 96304 - protein, 19 aa, Mycobacterium avium
ERSGFRFGGSGRNMAETPL

SEQ ID NO: 96305 - protein, 18 aa, Mycobacterium avium
ERSGYRLDQLVADVDAVI

SEQ ID NO: 96306 - protein, 17 aa, Mycobacterium avium
ERSLELDDAKSFLDSLV

SEQ ID NO: 96307 - protein, 23 aa, Mycobacterium avium
ERSLIGAWCFIDHYGPAHTRMDV

SEQ ID NO: 96308 - protein, 20 aa, Mycobacterium avium
ERSLRWVAVHTAHELHHHLL

SEQ ID NO: 96309 - protein, 22 aa, Mycobacterium avium
ERSLVKVHDWIPLEAASLVSCG

SEQ ID NO: 96310 - protein, 22 aa, Mycobacterium avium
ERSPLPFGRHRWVLDRRPPDIA

SEQ ID NO: 96311 - protein, 20 aa, Mycobacterium avium
ERTEIVCVQNAYNLVDRAAQ

SEQ ID NO: 96312 - protein, 25 aa, Mycobacterium avium
ERTKALELNPAFALQQCMDAMQRAG

SEQ ID NO: 96313 - protein, 32 aa, Mycobacterium avium
ERTLAWRSLFRQRLGVAVPDGHRFARGAAVSM

SEQ ID NO: 96314 - protein, 17 aa, Mycobacterium avium
ERVAPSILMGRREGLSR

SEQ ID NO: 96315 - protein, 24 aa, Mycobacterium avium
ERVGLRLGRRSALAVAARQVLGVL

SEQ ID NO: 96316 - protein, 26 aa, Mycobacterium avium
ERVLVHPRPRVTIMALGGELVDISRT

SEQ ID NO: 96317 - protein, 25 aa, Mycobacterium avium
ERVSAELAAAGLRRTRWWTDGAEDF

SEQ ID NO: 96318 - protein, 18 aa, Mycobacterium avium
ERVVMCRADGNPINVLVV

SEQ ID NO: 96319 - protein, 17 aa, Mycobacterium avium
ERWGPGRVMINEYGPTE

SEQ ID NO: 96320 - protein, 17 aa, Mycobacterium avium
ERWLPKFVSGEYIGSIA

SEQ ID NO: 96321 - protein, 18 aa, Mycobacterium avium
ERYIPLAILPTWDIDACV

SEQ ID NO: 96322 - protein, 25 aa, Mycobacterium avium
ESAAKWREIFGADNFFLELMDHGLS

SEQ ID NO: 96323 - protein, 26 aa, Mycobacterium avium
ESAEHGRSWSRWSFIGAGSPSALTVR

SEQ ID NO: 96324 - protein, 18 aa, Mycobacterium avium
ESAKRFGLEESRYEGPTG

SEQ ID NO: 96325 - protein, 24 aa, Mycobacterium avium
ESARNPSRFMAMQGAFVDEHPDRR

SEQ ID NO: 96326 - protein, 18 aa, Mycobacterium avium
ESATWWKDGPEIASGELK

SEQ ID NO: 96327 - protein, 20 aa, Mycobacterium avium
ESAVRLGYRKELAAVTDPAE

SEQ ID NO: 96328 - protein, 19 aa, Mycobacterium avium
ESAWTPVRYPGAVRDPDTG

SEQ ID NO: 96329 - protein, 17 aa, Mycobacterium avium
ESAYDRYYGDPTNKPNP

SEQ ID NO: 96330 - protein, 18 aa, Mycobacterium avium
ESAYDRYYGDPTNKPNPN

SEQ ID NO: 96331 - protein, 32 aa, Mycobacterium avium
ESCKESLDRLGLDYLDLYLIHWPAPTLGKYVE

SEQ ID NO: 96332 - protein, 24 aa, Mycobacterium avium
ESDRSVFFTSHRVAVRAIVRLGFG

SEQ ID NO: 96333 - protein, 18 aa, Mycobacterium avium
ESDVGYARAVRVGPHVWV

SEQ ID NO: 96334 - protein, 19 aa, Mycobacterium avium
ESEIRMLRECTAEIQHAVL

SEQ ID NO: 96335 - protein, 20 aa, Mycobacterium avium
ESEPELFGLFSRSQVFPIRQ

SEQ ID NO: 96336 - protein, 24 aa, Mycobacterium avium
ESEPELFGLFSRSQVFPIRQFADG

SEQ ID NO: 96337 - protein, 26 aa, Mycobacterium avium
ESGAKALIMPARFRSISYVDRIAEFS

SEQ ID NO: 96338 - protein, 24 aa, Mycobacterium avium
ESGEIRFDPALWRELAASDLLGIA

SEQ ID NO: 96339 - protein, 25 aa, Mycobacterium avium
ESGVGWNYLAAINFIETRFGSIVGA

SEQ ID NO: 96340 - protein, 27 aa, Mycobacterium avium
ESLAVVNLMSLFGLHRALRGAAIGHFA

SEQ ID NO: 96341 - protein, 20 aa, Mycobacterium avium
ESLFDSVMYVLTFLEGCSGP

SEQ ID NO: 96342 - protein, 20 aa, Mycobacterium avium
ESLFSWLATAEDGGWDGVAG

SEQ ID NO: 96343 - protein, 18 aa, Mycobacterium avium
ESLPRTGTVYTHTTVRIP

SEQ ID NO: 96344 - protein, 17 aa, Mycobacterium avium
ESLRPVPPGVVGELYVG

SEQ ID NO: 96345 - protein, 28 aa, Mycobacterium avium
ESMWTAYRQSPAWGFCMWAIAPDQMYSV

SEQ ID NO: 96346 - protein, 31 aa, Mycobacterium avium
ESNKTRLASLLRRYGMGVPDAARALRSATDA

SEQ ID NO: 96347 - protein, 17 aa, Mycobacterium avium
ESPMAAQLAYWEQQLAG

SEQ ID NO: 96348 - protein, 23 aa, Mycobacterium avium
ESPPRPTPRRPLGDVLQFRPLSD

SEQ ID NO: 96349 - protein, 22 aa, Mycobacterium avium
ESPRLAEFLDHVDVAVSLHGYG

SEQ ID NO: 96350 - protein, 19 aa, Mycobacterium avium
ESPSRVGIDAMFRDTYVRS

SEQ ID NO: 96351 - protein, 17 aa, Mycobacterium avium
ESRTFLISVAAELAGMH

SEQ ID NO: 96352 - protein, 22 aa, Mycobacterium avium
ESRYFIDFADNWYIVNSSDRRG

SEQ ID NO: 96353 - protein, 24 aa, Mycobacterium avium
ESTLGLIFHWAKERNWPLVTTDNL

SEQ ID NO: 96354 - protein, 27 aa, Mycobacterium avium
ESTRASIAISVGNRWTEIMERVQVMEM

SEQ ID NO: 96355 - protein, 19 aa, Mycobacterium avium
ESTRFFPMLTTAAGTVKPA

SEQ ID NO: 96356 - protein, 23 aa, Mycobacterium avium
ESTWPEFFDAIGAAGYTRVSLGM

SEQ ID NO: 96357 - protein, 19 aa, Mycobacterium avium
ESVARLLIPGGVLMIYVAT

SEQ ID NO: 96358 - protein, 31 aa, Mycobacterium avium
ESVGVISRQVWYQVFAWRPGLIVDLLEAAER

SEQ ID NO: 96359 - protein, 20 aa, Mycobacterium avium
ESVLRRLKQYSGRLATEAVS

SEQ ID NO: 96360 - protein, 18 aa, Mycobacterium avium
ESVNDLYASLAMLTQSGM

SEQ ID NO: 96361 - protein, 19 aa, Mycobacterium avium
ETAAAFWLRGSVPGSGVSD

SEQ ID NO: 96362 - protein, 23 aa, Mycobacterium avium
ETAEVACGYYIFEAENLDEALAL

SEQ ID NO: 96363 - protein, 26 aa, Mycobacterium avium
ETAFANWKALGARFFALRPATQLRWT

SEQ ID NO: 96364 - protein, 18 aa, Mycobacterium avium
ETAMILDRFRLDDKVAVI

SEQ ID NO: 96365 - protein, 28 aa, Mycobacterium avium
ETAPYNDIVGWKWTEVPNALGVTDHLAF

SEQ ID NO: 96366 - protein, 27 aa, Mycobacterium avium
ETAPYNDIVGWKWTEVPNALGVTEHLA

SEQ ID NO: 96367 - protein, 26 aa, Mycobacterium avium
ETAPYNDIVGWKWTEVPNSLGVTDHL

SEQ ID NO: 96368 - protein, 20 aa, Mycobacterium avium
ETATFAELMARYGRSVPQGA

SEQ ID NO: 96369 - protein, 25 aa, Mycobacterium avium
ETDAAARVLLLWGRRPADPSRIRSR

SEQ ID NO: 96370 - protein, 22 aa, Mycobacterium avium
ETEIEWIDTWYASIGGNKLPDV

SEQ ID NO: 96371 - protein, 18 aa, Mycobacterium avium
ETFRYLYVDIDGNPIATR

SEQ ID NO: 96372 - protein, 19 aa, Mycobacterium avium
ETGKRLGATINDMVLAMST

SEQ ID NO: 96373 - protein, 19 aa, Mycobacterium avium
ETIKSALLTAYRHTEGHQN

SEQ ID NO: 96374 - protein, 20 aa, Mycobacterium avium
ETIKSALLTAYRHTEGHQND

SEQ ID NO: 96375 - protein, 17 aa, Mycobacterium avium
ETKLLALLHRFGIAAPA

SEQ ID NO: 96376 - protein, 20 aa, Mycobacterium avium
ETLAALLHRLSRPEVTIALG

SEQ ID NO: 96377 - protein, 30 aa, Mycobacterium avium
ETLAFFAGIGIPIAEVWGMSELSCVAAVSH

SEQ ID NO: 96378 - protein, 23 aa, Mycobacterium avium
ETLKAELPVALKDLQQGAIAPVD

SEQ ID NO: 96379 - protein, 24 aa, Mycobacterium avium
ETLLRAWKAYDRFEGKSSVRTWLH

SEQ ID NO: 96380 - protein, 25 aa, Mycobacterium avium
ETLLVVMCGVGLYAGYVETYQEMLA

SEQ ID NO: 96381 - protein, 19 aa, Mycobacterium avium
ETLNLTHLPGYRVGGTIHI

SEQ ID NO: 96382 - protein, 20 aa, Mycobacterium avium
ETLNLTHLPGYRVGGTIHII

SEQ ID NO: 96383 - protein, 23 aa, Mycobacterium avium
ETLNLTHLPGYRVGGTIHIIVNN

SEQ ID NO: 96384 - protein, 28 aa, Mycobacterium avium
ETLVLKQEMNAAGFVAWWRNPSRTAKDS

SEQ ID NO: 96385 - protein, 25 aa, Mycobacterium avium
ETMKERSTAEWLKLFGELEIPAAPL

SEQ ID NO: 96386 - protein, 38 aa, Mycobacterium avium
ETMVKAYAGFRSFRAGTNLKAWLYRILTNTYINSYRKK

SEQ ID NO: 96387 - protein, 21 aa, Mycobacterium avium
ETNAADICRLLAAGSTVITTT

SEQ ID NO: 96388 - protein, 17 aa, Mycobacterium avium
ETNRLVDRSAWVAAGKY

SEQ ID NO: 96389 - protein, 18 aa, Mycobacterium avium
ETPRGAVFATEIAAAQNT

SEQ ID NO: 96390 - protein, 23 aa, Mycobacterium avium
ETRCLPTGLVLTSIGYRGKPIRD

SEQ ID NO: 96391 - protein, 19 aa, Mycobacterium avium
ETREIWSYGSGYGGNALLG

SEQ ID NO: 96392 - protein, 21 aa, Mycobacterium avium
ETSLRDLLLHAIRYGDQPEVK

SEQ ID NO: 96393 - protein, 18 aa, Mycobacterium avium
ETSMLRRRLERGSAEPAV

SEQ ID NO: 96394 - protein, 21 aa, Mycobacterium avium
ETTELPAAIAATRSRSAPADA

SEQ ID NO: 96395 - protein, 18 aa, Mycobacterium avium
ETVRGLGLLFDAGGQQWR

SEQ ID NO: 96396 - protein, 17 aa, Mycobacterium avium
ETYLCIGPFDSKSQAES

SEQ ID NO: 96397 - protein, 24 aa, Mycobacterium avium
EVADFLAEYGWRLVEHAGPDELMQ

SEQ ID NO: 96398 - protein, 17 aa, Mycobacterium avium
EVADLLGAGAAKALLGK

SEQ ID NO: 96399 - protein, 17 aa, Mycobacterium avium
EVAGSHSVMPWFTDHSH

SEQ ID NO: 96400 - protein, 18 aa, Mycobacterium avium
EVAMEIALNAVRIHGGYG

SEQ ID NO: 96401 - protein, 17 aa, Mycobacterium avium
EVANAQAALRIEQLEQM

SEQ ID NO: 96402 - protein, 18 aa, Mycobacterium avium
EVAPRAVLVLAHGFGEHA

SEQ ID NO: 96403 - protein, 25 aa, Mycobacterium avium
EVATKYPGVHWVSGPLDVCPAVAFN

SEQ ID NO: 96404 - protein, 18 aa, Mycobacterium avium
EVDRARRAAGRAIRVYAD

SEQ ID NO: 96405 - protein, 18 aa, Mycobacterium avium
EVDRLAGRLAQRDEERDV

SEQ ID NO: 96406 - protein, 24 aa, Mycobacterium avium
EVEALLCREARDGVQKLHGNRLLA

SEQ ID NO: 96407 - protein, 25 aa, Mycobacterium avium
EVERLRAAGPAALRALFKTFHAACQ

SEQ ID NO: 96408 - protein, 19 aa, Mycobacterium avium
EVFEMPSVRHWPHFEDPEA

SEQ ID NO: 96409 - protein, 19 aa, Mycobacterium avium
EVFWQLPPVQQLALSAFNI

SEQ ID NO: 96410 - protein, 18 aa, Mycobacterium avium
EVGCGNGGGASYLTRTMR

SEQ ID NO: 96411 - protein, 25 aa, Mycobacterium avium
EVGLRYYAAAFFKVIPRVNAEVRNA

SEQ ID NO: 96412 - protein, 24 aa, Mycobacterium avium
EVGSVRAADCLRAVDSLSDAALVE

SEQ ID NO: 96413 - protein, 19 aa, Mycobacterium avium
EVGWMPYFLERAEQVLDKQ

SEQ ID NO: 96414 - protein, 18 aa, Mycobacterium avium
EVICRQARRSFSRRRASG

SEQ ID NO: 96415 - protein, 20 aa, Mycobacterium avium
EVIDAAVAIGLPMMQTNVVQ

SEQ ID NO: 96416 - protein, 33 aa, Mycobacterium avium
EVITSLPGIGFRLGAEFLAAVGDPARIGSADQL

SEQ ID NO: 96417 - protein, 20 aa, Mycobacterium avium
EVLAYPSVLRTWRIRLADGT

SEQ ID NO: 96418 - protein, 19 aa, Mycobacterium avium
EVLGRPVALLYTSEDRAAG

SEQ ID NO: 96419 - protein, 20 aa, Mycobacterium avium
EVLISAAFACFRTHGLRKTT

SEQ ID NO: 96420 - protein, 17 aa, Mycobacterium avium
EVLLRPNDEYGYLHDLF

SEQ ID NO: 96421 - protein, 17 aa, Mycobacterium avium
EVLPLLEEVLGGGVAEA

SEQ ID NO: 96422 - protein, 22 aa, Mycobacterium avium
EVLSQLPPFLTGGSMIETVTME

SEQ ID NO: 96423 - protein, 25 aa, Mycobacterium avium
EVLVRRSRCPPVGSVRDTVGVDGHT

SEQ ID NO: 96424 - protein, 21 aa, Mycobacterium avium
EVNSRLDVHLGVRALFEAPTI

SEQ ID NO: 96425 - protein, 19 aa, Mycobacterium avium
EVPNALGVTEHLAFRVQTY

SEQ ID NO: 96426 - protein, 18 aa, Mycobacterium avium
EVPYRRDVVRRVIDGGAP

SEQ ID NO: 96427 - protein, 34 aa, Mycobacterium avium
EVQRLIRFMPKVVICLVNGWAAGGGHSLHVVCDL

SEQ ID NO: 96428 - protein, 22 aa, Mycobacterium avium
EVRDLRFDQMLLIEDETPVFAL

SEQ ID NO: 96429 - protein, 23 aa, Mycobacterium avium
EVRLRGGTVVVELDTSGSIDVAA

SEQ ID NO: 96430 - protein, 20 aa, Mycobacterium avium
EVRQQFSLLFTTRVLGGELA

SEQ ID NO: 96431 - protein, 17 aa, Mycobacterium avium
EVRRYFRDYSWGMRVPR

SEQ ID NO: 96432 - protein, 25 aa, Mycobacterium avium
EVSMLLQRRCVWMVEQGDIPVAEGS

SEQ ID NO: 96433 - protein, 25 aa, Mycobacterium avium
EVTAEVLRDGWLRTGDVGTLDGDGN

SEQ ID NO: 96434 - protein, 18 aa, Mycobacterium avium
EVVDRWSPGRVMVNAYGP

SEQ ID NO: 96435 - protein, 24 aa, Mycobacterium avium
EVVHDYLFSRCLTIAGGTSEIVRN

SEQ ID NO: 96436 - protein, 29 aa, Mycobacterium avium
EVVPGFTIGDLRTGMTVVEYVDRPEFRLL

SEQ ID NO: 96437 - protein, 19 aa, Mycobacterium avium
EVVRRLRAEAPNLRFAGLG

SEQ ID NO: 96438 - protein, 18 aa, Mycobacterium avium
EVVYDPWIEQRPLRIYSA

SEQ ID NO: 96439 - protein, 34 aa, Mycobacterium avium
EVYFELRLSDAWVWDMYRPARFVKQVRVVTFKDV

SEQ ID NO: 96440 - protein, 25 aa, Mycobacterium avium
EVYKFRSDLMNGRIVLGRAGGGALG

SEQ ID NO: 96441 - protein, 17 aa, Mycobacterium avium
EVYSIRSPLGAAIAGAR

SEQ ID NO: 96442 - protein, 20 aa, Mycobacterium avium
EWAESAGLDTAWMPQVPNDF

SEQ ID NO: 96443 - protein, 20 aa, Mycobacterium avium
EWAIRSGATVKVFEAVERIG

SEQ ID NO: 96444 - protein, 18 aa, Mycobacterium avium
EWARLAQGHLPSAVDEDA

SEQ ID NO: 96445 - protein, 24 aa, Mycobacterium avium
EWATRITSFPADWSNVGFDAETRA

SEQ ID NO: 96446 - protein, 28 aa, Mycobacterium avium
EWDLVIAVHLRGHFLLTRNAAAYWRSRA

SEQ ID NO: 96447 - protein, 18 aa, Mycobacterium avium
EWEAFLGKDEDLYVFSSV

SEQ ID NO: 96448 - protein, 19 aa, Mycobacterium avium
EWGAVLARIDMGWEEWKVG

SEQ ID NO: 96449 - protein, 22 aa, Mycobacterium avium
EWGCFTYGIVQHADYFTFYASV

SEQ ID NO: 96450 - protein, 17 aa, Mycobacterium avium
EWIWGRATVLAAGYLTG

SEQ ID NO: 96451 - protein, 20 aa, Mycobacterium avium
EWLAAHGWVVDAVRNTLDLQ

SEQ ID NO: 96452 - protein, 20 aa, Mycobacterium avium
EWLAAHGWVVDPVRNTLDLQ

SEQ ID NO: 96453 - protein, 28 aa, Mycobacterium avium
EWMLQTRLKALRIFERKPMPTWGSNLDG

SEQ ID NO: 96454 - protein, 17 aa, Mycobacterium avium
EWRPFCDAAQRRGPDAG

SEQ ID NO: 96455 - protein, 25 aa, Mycobacterium avium
EWVALSVRHDDDWRAVLDAIDRPDL

SEQ ID NO: 96456 - protein, 20 aa, Mycobacterium avium
EYAAVGFEYGYTVGNPDALV

SEQ ID NO: 96457 - protein, 23 aa, Mycobacterium avium
EYCGKWASLRARALAGDDPKLLW

SEQ ID NO: 96458 - protein, 21 aa, Mycobacterium avium
EYCVVKSGFGLEVAKTADVSV

SEQ ID NO: 96459 - protein, 24 aa, Mycobacterium avium
EYDLLRRNQILFTFLHLAASRACT

SEQ ID NO: 96460 - protein, 18 aa, Mycobacterium avium
EYDRFVWVDNSDQPWMNG

SEQ ID NO: 96461 - protein, 19 aa, Mycobacterium avium
EYGGRGATVLEQLVYTEET

SEQ ID NO: 96462 - protein, 31 aa, Mycobacterium avium
EYGKTASQVLLRWNLQLSNAVIFRSANAEHI

SEQ ID NO: 96463 - protein, 24 aa, Mycobacterium avium
EYHGRGDLAWAFVDSYVRASGDDE

SEQ ID NO: 96464 - protein, 17 aa, Mycobacterium avium
EYLEAIPEDIAWCRLDE

SEQ ID NO: 96465 - protein, 18 aa, Mycobacterium avium
EYLEAIPEDIAWCRLDEF

SEQ ID NO: 96466 - protein, 18 aa, Mycobacterium avium
EYMVPAAVVVLETLPLTA

SEQ ID NO: 96467 - protein, 25 aa, Mycobacterium avium
EYRLRQRFWAGRVIHTIRLSQDGPR

SEQ ID NO: 96468 - protein, 24 aa, Mycobacterium avium
EYVEMWLRDVAAMLGYHAGAQSAA

SEQ ID NO: 96469 - protein, 24 aa, Mycobacterium avium
EYYAGAFPEVYKQAISPADAIGHI

SEQ ID NO: 96470 - protein, 17 aa, Mycobacterium avium
FAAAGARVRLCKGAYDE

SEQ ID NO: 96471 - protein, 22 aa, Mycobacterium avium
FAADPGAVVLWFSDDPSLNEQS

SEQ ID NO: 96472 - protein, 17 aa, Mycobacterium avium
FAAFRSGTLEHHGDFYD

SEQ ID NO: 96473 - protein, 24 aa, Mycobacterium avium
FAAPVGDPGWFGPESAVWRVHSHL

SEQ ID NO: 96474 - protein, 18 aa, Mycobacterium avium
FAAQAVWTLSGERTNITF

SEQ ID NO: 96475 - protein, 22 aa, Mycobacterium avium
FAARLGPLCPAWDHRRVALSSE

SEQ ID NO: 96476 - protein, 17 aa, Mycobacterium avium
FAAYAQMYQAVSAQAAA

SEQ ID NO: 96477 - protein, 26 aa, Mycobacterium avium
FADACRAAGVGFSFGYPVDVRVQDAV

SEQ ID NO: 96478 - protein, 19 aa, Mycobacterium avium
FADRALVMYAGRVVESAAV

SEQ ID NO: 96479 - protein, 19 aa, Mycobacterium avium
FADRLKIVMRVYFEKPRTT

SEQ ID NO: 96480 - protein, 17 aa, Mycobacterium avium
FADYLMWVCRDDGMLVC

SEQ ID NO: 96481 - protein, 17 aa, Mycobacterium avium
FAEALRMLVPCLGPDRL

SEQ ID NO: 96482 - protein, 18 aa, Mycobacterium avium
FAEALRMLVPCLGPDRLR

SEQ ID NO: 96483 - protein, 18 aa, Mycobacterium avium
FAEELGLAVPAGERIDLG

SEQ ID NO: 96484 - protein, 24 aa, Mycobacterium avium
FAEELRKIWYRTWVFVGHESEVAQ

SEQ ID NO: 96485 - protein, 20 aa, Mycobacterium avium
FAEFVDWSLIDALRGAPGAA

SEQ ID NO: 96486 - protein, 17 aa, Mycobacterium avium
FAEIWRRGGELDGVRVI

SEQ ID NO: 96487 - protein, 25 aa, Mycobacterium avium
FAELAAGRLPRWWDGLVANGFHAVH

SEQ ID NO: 96488 - protein, 26 aa, Mycobacterium avium
FAELAAGRLPRWWDRLVTNGFHAVHL

SEQ ID NO: 96489 - protein, 20 aa, Mycobacterium avium
FAELRTELRAVADGDIPYQP

SEQ ID NO: 96490 - protein, 23 aa, Mycobacterium avium
FAEPGSCRLFLPDPVVRHDDAAP

SEQ ID NO: 96491 - protein, 17 aa, Mycobacterium avium
FAEVMAVTGGVLESVAR

SEQ ID NO: 96492 - protein, 17 aa, Mycobacterium avium
FAFLGGRDWDPSSATLP

SEQ ID NO: 96493 - protein, 25 aa, Mycobacterium avium
FAFNGWKTLSWVDANIWRRVVPKGW

SEQ ID NO: 96494 - protein, 17 aa, Mycobacterium avium
FAFWNKWDPGAISAQHG

SEQ ID NO: 96495 - protein, 18 aa, Mycobacterium avium
FAGADWPVEYGGRDDYHP

SEQ ID NO: 96496 - protein, 25 aa, Mycobacterium avium
FAGAGRRSVAGWADRVRVVDAKCGA

SEQ ID NO: 96497 - protein, 24 aa, Mycobacterium avium
FAGALAVANVRWLATGSDPAASGF

SEQ ID NO: 96498 - protein, 17 aa, Mycobacterium avium
FAGANLIPLRGAPGDLT

SEQ ID NO: 96499 - protein, 17 aa, Mycobacterium avium
FAGATIDAIGQAAGFTK

SEQ ID NO: 96500 - protein, 21 aa, Mycobacterium avium
FAGEPDFFWSPVNSLEDVVAD

SEQ ID NO: 96501 - protein, 17 aa, Mycobacterium avium
FAGIGVRTVLSHGSHLD

SEQ ID NO: 96502 - protein, 18 aa, Mycobacterium avium
FAGLRAHEIAKVRGQDVD

SEQ ID NO: 96503 - protein, 18 aa, Mycobacterium avium
FAGLRVLDLTTYWAGAYL

SEQ ID NO: 96504 - protein, 18 aa, Mycobacterium avium
FAGPVVVIELDMRFGSVQ

SEQ ID NO: 96505 - protein, 23 aa, Mycobacterium avium
FAGRVPRKFADRAPCVVDTDTGG

SEQ ID NO: 96506 - protein, 17 aa, Mycobacterium avium
FAGSWGYQVTSYYAPTS

SEQ ID NO: 96507 - protein, 18 aa, Mycobacterium avium
FAGTLPKSGVRASGLNTL

SEQ ID NO: 96508 - protein, 22 aa, Mycobacterium avium
FAHGGYRLAVQHSRQRLASTSD

SEQ ID NO: 96509 - protein, 18 aa, Mycobacterium avium
FAICGGARHAPAPTGPFA

SEQ ID NO: 96510 - protein, 17 aa, Mycobacterium avium
FAIRTYRQMQTQDRMGC

SEQ ID NO: 96511 - protein, 24 aa, Mycobacterium avium
FAKLFAEAGFPPGVINVVTGWGPQ

SEQ ID NO: 96512 - protein, 26 aa, Mycobacterium avium
FAKPLADSYHTVWFELHEDLIGLAGL

SEQ ID NO: 96513 - protein, 21 aa, Mycobacterium avium
FAKRPAFNFKQLITEDDLPCL

SEQ ID NO: 96514 - protein, 29 aa, Mycobacterium avium
FAKRPALVRPSLGIAEWILPSVIRAAPKD

SEQ ID NO: 96515 - protein, 22 aa, Mycobacterium avium
FALAGELSRDFDIHLIDFPGYG

SEQ ID NO: 96516 - protein, 23 aa, Mycobacterium avium
FALAGELSRDFDIHLLDFPGYGL

SEQ ID NO: 96517 - protein, 17 aa, Mycobacterium avium
FALALPVAREHRLRPVA

SEQ ID NO: 96518 - protein, 18 aa, Mycobacterium avium
FALALPVAREHRLRPVAG

SEQ ID NO: 96519 - protein, 30 aa, Mycobacterium avium
FALDGFQRRACAALERGHGVLVCAPTGAGK

SEQ ID NO: 96520 - protein, 19 aa, Mycobacterium avium
FALLRAGAIPVMCLPGHRA

SEQ ID NO: 96521 - protein, 20 aa, Mycobacterium avium
FALLRAGAIPVMCLPGHRAA

SEQ ID NO: 96522 - protein, 17 aa, Mycobacterium avium
FALRPATQLHWTGHDDP

SEQ ID NO: 96523 - protein, 17 aa, Mycobacterium avium
FALRPATQLRWTGHDDP

SEQ ID NO: 96524 - protein, 18 aa, Mycobacterium avium
FALTCLLGDRIRDRVVLV

SEQ ID NO: 96525 - protein, 18 aa, Mycobacterium avium
FALTCLLGDRIRNRVVVV

SEQ ID NO: 96526 - protein, 20 aa, Mycobacterium avium
FANAVVRFGNRQECIGELRS

SEQ ID NO: 96527 - protein, 17 aa, Mycobacterium avium
FANRRVDAVQDGTLLSS

SEQ ID NO: 96528 - protein, 27 aa, Mycobacterium avium
FAPLEMGEALQALAAILTRRGVSSPPV

SEQ ID NO: 96529 - protein, 19 aa, Mycobacterium avium
FAPRELVELAVAAEAHGMD

SEQ ID NO: 96530 - protein, 21 aa, Mycobacterium avium
FAPRELVELAVAAEAHGMDSA

SEQ ID NO: 96531 - protein, 25 aa, Mycobacterium avium
FAQARRIAVDIGYPVLVRPSYVLGG

SEQ ID NO: 96532 - protein, 18 aa, Mycobacterium avium
FAQPAARVAGWGVSGRAR

SEQ ID NO: 96533 - protein, 18 aa, Mycobacterium avium
FARDIFRYYRSDAAAAIE

SEQ ID NO: 96534 - protein, 24 aa, Mycobacterium avium
FARMPAFGVEGTWRDRVGFAPTME

SEQ ID NO: 96535 - protein, 24 aa, Mycobacterium avium
FARPLRFGTAGLRGPVRAGPDAMN

SEQ ID NO: 96536 - protein, 24 aa, Mycobacterium avium
FARPLRFGTAGLRGPVRGGPDAMN

SEQ ID NO: 96537 - protein, 18 aa, Mycobacterium avium
FARRAARIGRPMKIPAPA

SEQ ID NO: 96538 - protein, 18 aa, Mycobacterium avium
FARRAQVGLPAFMIRAFC

SEQ ID NO: 96539 - protein, 31 aa, Mycobacterium avium
FARRAQVGLPAFMIRAFCDLAERHPWQETRP

SEQ ID NO: 96540 - protein, 18 aa, Mycobacterium avium
FARRGIRSHVLPSSATFE

SEQ ID NO: 96541 - protein, 17 aa, Mycobacterium avium
FASEVAMEIALNAVRIH

SEQ ID NO: 96542 - protein, 23 aa, Mycobacterium avium
FASGRVAYTLGLHGPAVTVDTAC

SEQ ID NO: 96543 - protein, 18 aa, Mycobacterium avium
FASIPVAVNSLWPATTVA

SEQ ID NO: 96544 - protein, 23 aa, Mycobacterium avium
FASLDRWPGTVAQYLSTMFDPSL

SEQ ID NO: 96545 - protein, 26 aa, Mycobacterium avium
FASRRTQLWDRIARWVPTVVSAAEPV

SEQ ID NO: 96546 - protein, 17 aa, Mycobacterium avium
FASVPIAVNSLWPATTI

SEQ ID NO: 96547 - protein, 18 aa, Mycobacterium avium
FATHVARGRIQDELDGII

SEQ ID NO: 96548 - protein, 18 aa, Mycobacterium avium
FATIPVLDGAGWSDDGMQ

SEQ ID NO: 96549 - protein, 19 aa, Mycobacterium avium
FATLLPLRIIDTMLGVPRE

SEQ ID NO: 96550 - protein, 21 aa, Mycobacterium avium
FATRPLDEWAQIFAGEPDFFW

SEQ ID NO: 96551 - protein, 27 aa, Mycobacterium avium
FAVGREIWRGTLVFYIRRGTLYIDYVE

SEQ ID NO: 96552 - protein, 17 aa, Mycobacterium avium
FAYPDAHRARIGVNHDQ

SEQ ID NO: 96553 - protein, 17 aa, Mycobacterium avium
FCELLGVESAHFVGNSM

SEQ ID NO: 96554 - protein, 20 aa, Mycobacterium avium
FCRSVLRWLRAGYPEGVPGP

SEQ ID NO: 96555 - protein, 18 aa, Mycobacterium avium
FCSTCDRTRLTADGQIRS

SEQ ID NO: 96556 - protein, 20 aa, Mycobacterium avium
FDAAPARRLATASADDVAAV

SEQ ID NO: 96557 - protein, 18 aa, Mycobacterium avium
FDADLSGWSLIYLGVLSR

SEQ ID NO: 96558 - protein, 19 aa, Mycobacterium avium
FDALAGICAHVRAGGGGLT

SEQ ID NO: 96559 - protein, 17 aa, Mycobacterium avium
FDALAGICTHVRAGGGG

SEQ ID NO: 96560 - protein, 18 aa, Mycobacterium avium
FDASGLMQYAYAGAGIKL

SEQ ID NO: 96561 - protein, 17 aa, Mycobacterium avium
FDAVCFTSSSTVRNLVG

SEQ ID NO: 96562 - protein, 29 aa, Mycobacterium avium
FDAVIAVHLKGRFATMRHAASYWRGLSKA

SEQ ID NO: 96563 - protein, 28 aa, Mycobacterium avium
FDAVIAVHLRGTWLGVREAAAVMRERKT

SEQ ID NO: 96564 - protein, 17 aa, Mycobacterium avium
FDAVSALGYLAASTQRV

SEQ ID NO: 96565 - protein, 17 aa, Mycobacterium avium
FDAWTGRYLLVLEDLPA

SEQ ID NO: 96566 - protein, 17 aa, Mycobacterium avium
FDDLFLMAADKRFLSVE

SEQ ID NO: 96567 - protein, 18 aa, Mycobacterium avium
FDDLRIGIELSAQQVWTQ

SEQ ID NO: 96568 - protein, 18 aa, Mycobacterium avium
FDDYQSWTDRVIPVVICD

SEQ ID NO: 96569 - protein, 19 aa, Mycobacterium avium
FDEAFAALRKWEAEGRLHH

SEQ ID NO: 96570 - protein, 17 aa, Mycobacterium avium
FDEHNSALKRLMTRWQL

SEQ ID NO: 96571 - protein, 20 aa, Mycobacterium avium
FDELLPYFKRSESMCGKDPS

SEQ ID NO: 96572 - protein, 17 aa, Mycobacterium avium
FDELLPYFKRSESTCGK

SEQ ID NO: 96573 - protein, 22 aa, Mycobacterium avium
FDEPRVAVCSVHSPLAKRAKLD

SEQ ID NO: 96574 - protein, 17 aa, Mycobacterium avium
FDEVKVLIVGQDPYPTP

SEQ ID NO: 96575 - protein, 20 aa, Mycobacterium avium
FDFRGTDTTIAWKGDEAIEL

SEQ ID NO: 96576 - protein, 21 aa, Mycobacterium avium
FDGGTLPPMFVDLINAPTRRQ

SEQ ID NO: 96577 - protein, 17 aa, Mycobacterium avium
FDGTDAWPSIIAANAAG

SEQ ID NO: 96578 - protein, 24 aa, Mycobacterium avium
FDHRGRASLMVAVHPLCPLSARQI

SEQ ID NO: 96579 - protein, 18 aa, Mycobacterium avium
FDHVGCGLGQAASMGEVA

SEQ ID NO: 96580 - protein, 17 aa, Mycobacterium avium
FDIYVGADFERNVTDQL

SEQ ID NO: 96581 - protein, 23 aa, Mycobacterium avium
FDKAAGCGADLVFLDLEDAVPPA

SEQ ID NO: 96582 - protein, 17 aa, Mycobacterium avium
FDLATEIPLRARLFRIA

SEQ ID NO: 96583 - protein, 19 aa, Mycobacterium avium
FDLDGEVPFNWNAGNPAFS

SEQ ID NO: 96584 - protein, 24 aa, Mycobacterium avium
FDLEAQLRPGLGLHGQRVVGGFAA

SEQ ID NO: 96585 - protein, 21 aa, Mycobacterium avium
FDLGVPVFGICYGFQAMAQAL

SEQ ID NO: 96586 - protein, 19 aa, Mycobacterium avium
FDLHAGAIVARRWDRHPLC

SEQ ID NO: 96587 - protein, 20 aa, Mycobacterium avium
FDLHAGAIVARRWDRHPLCP

SEQ ID NO: 96588 - protein, 17 aa, Mycobacterium avium
FDNGAKNPNAWRRKPMS

SEQ ID NO: 96589 - protein, 27 aa, Mycobacterium avium
FDNLNWWLGEWSWVFDKYSTMFVQWTA

SEQ ID NO: 96590 - protein, 27 aa, Mycobacterium avium
FDNLNWWLGEWSWVFEKYSTMFVQWTA

SEQ ID NO: 96591 - protein, 25 aa, Mycobacterium avium
FDPHRMAKGMACRTRFYDDFFLDAA

SEQ ID NO: 96592 - protein, 26 aa, Mycobacterium avium
FDRFPTLRIVFVEHAFTWILPLMWRM

SEQ ID NO: 96593 - protein, 19 aa, Mycobacterium avium
FDRIFAASANHSIWFHRQV

SEQ ID NO: 96594 - protein, 24 aa, Mycobacterium avium
FDRTGKRGGAGFYDYVDGTRAGLW

SEQ ID NO: 96595 - protein, 26 aa, Mycobacterium avium
FDRVRAALLAARRGRIQPGRDDKVVT

SEQ ID NO: 96596 - protein, 17 aa, Mycobacterium avium
FDTLLVYENFPMDGLTA

SEQ ID NO: 96597 - protein, 24 aa, Mycobacterium avium
FDTVVDCAFYHVFAAEPELRSSYA

SEQ ID NO: 96598 - protein, 19 aa, Mycobacterium avium
FDVAACRDIGLDHAFAQPV

SEQ ID NO: 96599 - protein, 30 aa, Mycobacterium avium
FDVALRIWRPRWAKWTAHVVRSGGLIRDGI

SEQ ID NO: 96600 - protein, 18 aa, Mycobacterium avium
FDVAWQLGVLVRIDGAID

SEQ ID NO: 96601 - protein, 25 aa, Mycobacterium avium
FDYAEGRLGWRTLDFEVEVLPIGDF

SEQ ID NO: 96602 - protein, 25 aa, Mycobacterium avium
FEAARPRLGALAYRMLGSFEDAQDA

SEQ ID NO: 96603 - protein, 25 aa, Mycobacterium avium
FEAARPRLGALAYRMLGSIDDAQDA

SEQ ID NO: 96604 - protein, 18 aa, Mycobacterium avium
FEAASAWDGLAAELSSSA

SEQ ID NO: 96605 - protein, 17 aa, Mycobacterium avium
FEAGQPWHLLRGRHRIE

SEQ ID NO: 96606 - protein, 20 aa, Mycobacterium avium
FEALASFTIIADDVDWQQRM

SEQ ID NO: 96607 - protein, 25 aa, Mycobacterium avium
FEASHMRFWFGAVYGRACRLTGRID

SEQ ID NO: 96608 - protein, 18 aa, Mycobacterium avium
FEAYRRGADVVAFDQNEA

SEQ ID NO: 96609 - protein, 17 aa, Mycobacterium avium
FEDPESFNAAAVEFLTR

SEQ ID NO: 96610 - protein, 17 aa, Mycobacterium avium
FEEIGPFFADRNGGYTR

SEQ ID NO: 96611 - protein, 23 aa, Mycobacterium avium
FEEKLEWIRGFVRDEVEPLEVLF

SEQ ID NO: 96612 - protein, 26 aa, Mycobacterium avium
FEELLSRFGAVRVVRPVEWTRSNRHT

SEQ ID NO: 96613 - protein, 17 aa, Mycobacterium avium
FEGDLVSRCELFDEADL

SEQ ID NO: 96614 - protein, 21 aa, Mycobacterium avium
FEGDLVSRCELFDEADLPDAL

SEQ ID NO: 96615 - protein, 18 aa, Mycobacterium avium
FEGKKLFPERIAETVPYE

SEQ ID NO: 96616 - protein, 24 aa, Mycobacterium avium
FEHRAVVVGCERGALATGLAGLAS

SEQ ID NO: 96617 - protein, 24 aa, Mycobacterium avium
FEKRCPRPPLENGATRAYERLHAY

SEQ ID NO: 96618 - protein, 24 aa, Mycobacterium avium
FELELSLLLCYTGITRDSARVIED

SEQ ID NO: 96619 - protein, 25 aa, Mycobacterium avium
FELERGRYGPLYPRTPACYGFSIIA

SEQ ID NO: 96620 - protein, 21 aa, Mycobacterium avium
FELGALGGRAALAPLPVHRLT

SEQ ID NO: 96621 - protein, 21 aa, Mycobacterium avium
FELGALGGRAALAPLPVHSLT

SEQ ID NO: 96622 - protein, 20 aa, Mycobacterium avium
FELGALGGRAALAPLPVYSL

SEQ ID NO: 96623 - protein, 24 aa, Mycobacterium avium
FELKEFKTGAARMAIDAGVPIIPL

SEQ ID NO: 96624 - protein, 18 aa, Mycobacterium avium
FELPGDLGSGLVPVPATR

SEQ ID NO: 96625 - protein, 26 aa, Mycobacterium avium
FENAWRVNCFGAFLGIRAALERLRGT

SEQ ID NO: 96626 - protein, 18 aa, Mycobacterium avium
FEPAASWACGSGRRGVEP

SEQ ID NO: 96627 - protein, 25 aa, Mycobacterium avium
FEPSLSRGGDMAVDFLAGAQEPDLR

SEQ ID NO: 96628 - protein, 17 aa, Mycobacterium avium
FEPVALCARTPDRLERA

SEQ ID NO: 96629 - protein, 23 aa, Mycobacterium avium
FEQAAGAVLRWGMQRGSGLRVQA

SEQ ID NO: 96630 - protein, 18 aa, Mycobacterium avium
FEQSRHWSRTYAHGRELK

SEQ ID NO: 96631 - protein, 17 aa, Mycobacterium avium
FEQSRHWSRTYAPGREL

SEQ ID NO: 96632 - protein, 18 aa, Mycobacterium avium
FEQSRHWSRTYAPGRELK

SEQ ID NO: 96633 - protein, 22 aa, Mycobacterium avium
FERATTGFGWSRPGRSALAGNS

SEQ ID NO: 96634 - protein, 22 aa, Mycobacterium avium
FERHELRGGYSIDKQSFAGRER

SEQ ID NO: 96635 - protein, 20 aa, Mycobacterium avium
FERLRQLLIERLPEVPQLRW

SEQ ID NO: 96636 - protein, 21 aa, Mycobacterium avium
FERLRQLLIERLPEVPQLRWR

SEQ ID NO: 96637 - protein, 24 aa, Mycobacterium avium
FERYGIPILVVYGATEFSGAVAGW

SEQ ID NO: 96638 - protein, 26 aa, Mycobacterium avium
FESALDPSTRCWELGPDGQWTPSPQE

SEQ ID NO: 96639 - protein, 19 aa, Mycobacterium avium
FESDVGYARAVRVGPHVWV

SEQ ID NO: 96640 - protein, 17 aa, Mycobacterium avium
FEVLRAIVADFIATKEP

SEQ ID NO: 96641 - protein, 18 aa, Mycobacterium avium
FEVRDVRAAGECVDVDVE

SEQ ID NO: 96642 - protein, 17 aa, Mycobacterium avium
FFDGELFIIGRMKDLLI

SEQ ID NO: 96643 - protein, 23 aa, Mycobacterium avium
FFFDILHCDGVDLLDAPTTDRLA

SEQ ID NO: 96644 - protein, 24 aa, Mycobacterium avium
FFGGEAPDNWQLIVDDVADSDLPD

SEQ ID NO: 96645 - protein, 17 aa, Mycobacterium avium
FFPPYVVGPPGIGTGSG

SEQ ID NO: 96646 - protein, 21 aa, Mycobacterium avium
FFQNTCRWRDLRKITIAQVQG

SEQ ID NO: 96647 - protein, 24 aa, Mycobacterium avium
FFRHFPTKESVLFQDYETQLEWLA

SEQ ID NO: 96648 - protein, 21 aa, Mycobacterium avium
FFRKFMGRVGAGAAIGGLAGA

SEQ ID NO: 96649 - protein, 30 aa, Mycobacterium avium
FFRLKRRGEIVGMRLGHRILIPAREITRLI

SEQ ID NO: 96650 - protein, 27 aa, Mycobacterium avium
FFRYFPTKESVLFFGEYDFIDAVSGVY

SEQ ID NO: 96651 - protein, 29 aa, Mycobacterium avium
FFRYFPTKESVLFFGEYDFIHAFSAVYLG

SEQ ID NO: 96652 - protein, 17 aa, Mycobacterium avium
FFSITSLAGLRQEDPAV

SEQ ID NO: 96653 - protein, 26 aa, Mycobacterium avium
FFSLPWYYRAGYDVLMYTLPFHGKRS

SEQ ID NO: 96654 - protein, 18 aa, Mycobacterium avium
FFVLDPWLCPAPVGVTGE

SEQ ID NO: 96655 - protein, 19 aa, Mycobacterium avium
FGAALAELDGGWSVGDGAP

SEQ ID NO: 96656 - protein, 18 aa, Mycobacterium avium
FGAEYGRIEAVAKVGDTL

SEQ ID NO: 96657 - protein, 17 aa, Mycobacterium avium
FGALLRGGRVVVMPEAV

SEQ ID NO: 96658 - protein, 19 aa, Mycobacterium avium
FGAWAQRVPGAVAISSADR

SEQ ID NO: 96659 - protein, 21 aa, Mycobacterium avium
FGDDLSVVALFDWETAGTGPP

SEQ ID NO: 96660 - protein, 18 aa, Mycobacterium avium
FGDKRVMRSPHPFAATAI

SEQ ID NO: 96661 - protein, 17 aa, Mycobacterium avium
FGDRLGICYVHTHVSSN

SEQ ID NO: 96662 - protein, 17 aa, Mycobacterium avium
FGDRLPSEVFRERFLTC

SEQ ID NO: 96663 - protein, 25 aa, Mycobacterium avium
FGEARIEKVIERFRRVLEAMTVDLE

SEQ ID NO: 96664 - protein, 23 aa, Mycobacterium avium
FGEVVALMPGWGVREVLRSPKAR

SEQ ID NO: 96665 - protein, 22 aa, Mycobacterium avium
FGEYRCRADQAGLYCVNYAHQS

SEQ ID NO: 96666 - protein, 19 aa, Mycobacterium avium
FGFPRAELDDLLGGDAQTN

SEQ ID NO: 96667 - protein, 17 aa, Mycobacterium avium
FGGARVVLTAGYPALSP

SEQ ID NO: 96668 - protein, 17 aa, Mycobacterium avium
FGGFPVVLIPKVSAADL

SEQ ID NO: 96669 - protein, 20 aa, Mycobacterium avium
FGGGRAQTWLTPNGPVDAKI

SEQ ID NO: 96670 - protein, 17 aa, Mycobacterium avium
FGGKLCIHPCQVAPVNS

SEQ ID NO: 96671 - protein, 21 aa, Mycobacterium avium
FGGSPRMPMVPGTWEQDTQNG

SEQ ID NO: 96672 - protein, 18 aa, Mycobacterium avium
FGGVHLLAAAGAINAGDP

SEQ ID NO: 96673 - protein, 18 aa, Mycobacterium avium
FGHGDPWTAMRAAVHRTT

SEQ ID NO: 96674 - protein, 18 aa, Mycobacterium avium
FGHGLWGFTDALRAAGWD

SEQ ID NO: 96675 - protein, 31 aa, Mycobacterium avium
FGHPAFRYVGWGPRLWWWAETMGLRKFSEML

SEQ ID NO: 96676 - protein, 17 aa, Mycobacterium avium
FGHPATRAADRAFAAVP

SEQ ID NO: 96677 - protein, 24 aa, Mycobacterium avium
FGHSMGAVVAFEFARVAETHGAAV

SEQ ID NO: 96678 - protein, 17 aa, Mycobacterium avium
FGIDLVAASVRRAQEQG

SEQ ID NO: 96679 - protein, 17 aa, Mycobacterium avium
FGIHPVLLDAALHALGV

SEQ ID NO: 96680 - protein, 21 aa, Mycobacterium avium
FGKGVHFCVGAALARLEAHIV

SEQ ID NO: 96681 - protein, 17 aa, Mycobacterium avium
FGKSPLLGADRLADIGY

SEQ ID NO: 96682 - protein, 23 aa, Mycobacterium avium
FGLADLFAAAGLPELTEAEQGPA

SEQ ID NO: 96683 - protein, 19 aa, Mycobacterium avium
FGLLRAGAVPVMCLPGHRA

SEQ ID NO: 96684 - protein, 22 aa, Mycobacterium avium
FGLPEVKRGLIAGAGGVFRIVE

SEQ ID NO: 96685 - protein, 26 aa, Mycobacterium avium
FGMRRRSAFCDFDFRATRPQYTNGGK

SEQ ID NO: 96686 - protein, 27 aa, Mycobacterium avium
FGMSMRFYKSREALLDKAKRAEDAGFD

SEQ ID NO: 96687 - protein, 20 aa, Mycobacterium avium
FGPGGGRASFPAVQAGPPGP

SEQ ID NO: 96688 - protein, 25 aa, Mycobacterium avium
FGPLRLQFWVCGVFEVQNGRITLWR

SEQ ID NO: 96689 - protein, 24 aa, Mycobacterium avium
FGPNPLDPGCRVPSARAGREQGRR

SEQ ID NO: 96690 - protein, 19 aa, Mycobacterium avium
FGPQAVRLAARIGDGYSIS

SEQ ID NO: 96691 - protein, 21 aa, Mycobacterium avium
FGPYHLKRLLGRGGMGEVYEA

SEQ ID NO: 96692 - protein, 19 aa, Mycobacterium avium
FGPYRLWQLVGRGGMGDVY

SEQ ID NO: 96693 - protein, 21 aa, Mycobacterium avium
FGRDRYDDFFKMAYAALPDDG

SEQ ID NO: 96694 - protein, 23 aa, Mycobacterium avium
FGRIWLEMGETLTSLANGADLLL

SEQ ID NO: 96695 - protein, 21 aa, Mycobacterium avium
FGRQALHPDVDFLVGDFTSSL

SEQ ID NO: 96696 - protein, 18 aa, Mycobacterium avium
FGRRAVPGVDELFDEASD

SEQ ID NO: 96697 - protein, 17 aa, Mycobacterium avium
FGRRPRREGVLTLPNEA

SEQ ID NO: 96698 - protein, 18 aa, Mycobacterium avium
FGRYEDRSALEMGAVAIS

SEQ ID NO: 96699 - protein, 18 aa, Mycobacterium avium
FGSAFQWQYPAPPEGDHI

SEQ ID NO: 96700 - protein, 23 aa, Mycobacterium avium
FGSDWPFAPVAVGKLFAAGLETY

SEQ ID NO: 96701 - protein, 20 aa, Mycobacterium avium
FGSKSRFALSAVTGAGKTVM

SEQ ID NO: 96702 - protein, 17 aa, Mycobacterium avium
FGTAISRPVIPIFVNAI

SEQ ID NO: 96703 - protein, 21 aa, Mycobacterium avium
FGTKIMRYMHDHGITEETLAR

SEQ ID NO: 96704 - protein, 21 aa, Mycobacterium avium
FGTKIMRYMHDHGITEQALAR

SEQ ID NO: 96705 - protein, 19 aa, Mycobacterium avium
FGTLRLSDYPLIPARVDTW

SEQ ID NO: 96706 - protein, 19 aa, Mycobacterium avium
FGTPASGFGRTVAADTRTY

SEQ ID NO: 96707 - protein, 26 aa, Mycobacterium avium
FGTRSRAACFTWNVPDDVELTGPMAA

SEQ ID NO: 96708 - protein, 18 aa, Mycobacterium avium
FGVAELQRPAALCEDRRD

SEQ ID NO: 96709 - protein, 24 aa, Mycobacterium avium
FGVDQLRYFLLREVPFGQDGSYTK

SEQ ID NO: 96710 - protein, 17 aa, Mycobacterium avium
FGVGGFHRAHQAMYLDR

SEQ ID NO: 96711 - protein, 19 aa, Mycobacterium avium
FGVGQPVDRPALRRQVLAP

SEQ ID NO: 96712 - protein, 18 aa, Mycobacterium avium
FGVLAAGGTIVFADGNET

SEQ ID NO: 96713 - protein, 17 aa, Mycobacterium avium
FGVTAGEEREGESLDDR

SEQ ID NO: 96714 - protein, 25 aa, Mycobacterium avium
FGWLGDAFPLSALTQIYKSDGESNF

SEQ ID NO: 96715 - protein, 20 aa, Mycobacterium avium
FGYACPLGAHARRLNPRDTA

SEQ ID NO: 96716 - protein, 24 aa, Mycobacterium avium
FGYSMGGVVAFEFARVAEANGTPV

SEQ ID NO: 96717 - protein, 27 aa, Mycobacterium avium
FHGSELCAAPSFPVRVPGGTPIPVYVA

SEQ ID NO: 96718 - protein, 25 aa, Mycobacterium avium
FHRVNGAWCFESRTMFVDQVGDVSH

SEQ ID NO: 96719 - protein, 20 aa, Mycobacterium avium
FHSSRWDYDYTGGDSGGNLH

SEQ ID NO: 96720 - protein, 18 aa, Mycobacterium avium
FHVVEALPVGDARGLPAT

SEQ ID NO: 96721 - protein, 17 aa, Mycobacterium avium
FIAAASWAHICPYSASV

SEQ ID NO: 96722 - protein, 17 aa, Mycobacterium avium
FIALKVGIDNWRWAGVP

SEQ ID NO: 96723 - protein, 18 aa, Mycobacterium avium
FIALKVGIDNWRWAGVPV

SEQ ID NO: 96724 - protein, 19 aa, Mycobacterium avium
FIDELRVCLHGCGVADLAG

SEQ ID NO: 96725 - protein, 18 aa, Mycobacterium avium
FIEVTFRGANSLGDHVSG

SEQ ID NO: 96726 - protein, 17 aa, Mycobacterium avium
FIICASLIRQFEFAQNV

SEQ ID NO: 96727 - protein, 25 aa, Mycobacterium avium
FIIGRMKDLLIVYGRNHSPDDIEST

SEQ ID NO: 96728 - protein, 25 aa, Mycobacterium avium
FILQELPLLLQVGLSLSITSLGGMA

SEQ ID NO: 96729 - protein, 26 aa, Mycobacterium avium
FISSGFPINLLDVWAQLATAQGVASV

SEQ ID NO: 96730 - protein, 22 aa, Mycobacterium avium
FKAAFTRLGGRIAKREQGRYEI

SEQ ID NO: 96731 - protein, 19 aa, Mycobacterium avium
FKALQEWTGRLFEAGYVGA

SEQ ID NO: 96732 - protein, 21 aa, Mycobacterium avium
FKDINCLPFAPPRDNPYSGAG

SEQ ID NO: 96733 - protein, 20 aa, Mycobacterium avium
FKERLPYVAAIVELDEGPRL

SEQ ID NO: 96734 - protein, 28 aa, Mycobacterium avium
FKGRNVEIPDHYRLYVSQKLARLERFDR

SEQ ID NO: 96735 - protein, 19 aa, Mycobacterium avium
FKHMSKMTWRSMISDGLAM

SEQ ID NO: 96736 - protein, 17 aa, Mycobacterium avium
FKKPIRFCHVDVGDDVD

SEQ ID NO: 96737 - protein, 20 aa, Mycobacterium avium
FKKVADEIGFEQTVDVGELM

SEQ ID NO: 96738 - protein, 23 aa, Mycobacterium avium
FKPGTLAALGFSYEQLRAINPRI

SEQ ID NO: 96739 - protein, 23 aa, Mycobacterium avium
FKPHVGDTVKLMWPATKHGFPEA

SEQ ID NO: 96740 - protein, 17 aa, Mycobacterium avium
FKREIAPTFGATHAAAD

SEQ ID NO: 96741 - protein, 17 aa, Mycobacterium avium
FKRLAWWPYSVAMRQVN

SEQ ID NO: 96742 - protein, 18 aa, Mycobacterium avium
FKRLAWWPYSVAMRQVNV

SEQ ID NO: 96743 - protein, 18 aa, Mycobacterium avium
FKRLAWWPYSVVMRQVNV

SEQ ID NO: 96744 - protein, 22 aa, Mycobacterium avium
FKVGDPRAPLLPLDEQGRAELR

SEQ ID NO: 96745 - protein, 18 aa, Mycobacterium avium
FKVGPDFIDPGYHGLTAG

SEQ ID NO: 96746 - protein, 19 aa, Mycobacterium avium
FKVKGRWRAYQSQVEIGRL

SEQ ID NO: 96747 - protein, 25 aa, Mycobacterium avium
FLANRIEAAEAMVQRNCMVPMQLCH

SEQ ID NO: 96748 - protein, 25 aa, Mycobacterium avium
FLARLCKTAMWIDHGQIRMSGGIED

SEQ ID NO: 96749 - protein, 19 aa, Mycobacterium avium
FLATLAQFVEFVRDGQFDQ

SEQ ID NO: 96750 - protein, 19 aa, Mycobacterium avium
FLATLGQFVEFVRDGQFDQ

SEQ ID NO: 96751 - protein, 18 aa, Mycobacterium avium
FLATLSQFVEFVRDGQFD

SEQ ID NO: 96752 - protein, 17 aa, Mycobacterium avium
FLCPLELASFTLATPED

SEQ ID NO: 96753 - protein, 20 aa, Mycobacterium avium
FLDCVRAVIGGTSMDEFTDA

SEQ ID NO: 96754 - protein, 18 aa, Mycobacterium avium
FLDGARVPDVHRVGAVND

SEQ ID NO: 96755 - protein, 21 aa, Mycobacterium avium
FLEEPRIAARVAGARTRGGYL

SEQ ID NO: 96756 - protein, 24 aa, Mycobacterium avium
FLERYGIPILITYGATEFAGAVAG

SEQ ID NO: 96757 - protein, 20 aa, Mycobacterium avium
FLGADGALRSDGYWVDESGA

SEQ ID NO: 96758 - protein, 17 aa, Mycobacterium avium
FLGQAAKMFAEHDFIDY

SEQ ID NO: 96759 - protein, 18 aa, Mycobacterium avium
FLHRVRVRVGAVEPGEPT

SEQ ID NO: 96760 - protein, 27 aa, Mycobacterium avium
FLIHWPLPTLYGGDFVSTWRVLEEFAR

SEQ ID NO: 96761 - protein, 19 aa, Mycobacterium avium
FLLEETYELLDAVAGGNAE

SEQ ID NO: 96762 - protein, 20 aa, Mycobacterium avium
FLLGLDLVDRVQFWMLPLDD

SEQ ID NO: 96763 - protein, 17 aa, Mycobacterium avium
FLLHPLAGLLLGQMLGP

SEQ ID NO: 96764 - protein, 17 aa, Mycobacterium avium
FLLRITLALLSNRPILV

SEQ ID NO: 96765 - protein, 17 aa, Mycobacterium avium
FLLSDICAFVTGQTIYA

SEQ ID NO: 96766 - protein, 34 aa, Mycobacterium avium
FLNLMLRAPFRLAREVLPHLPPGSAIINVTSTFA

SEQ ID NO: 96767 - protein, 19 aa, Mycobacterium avium
FLPSNCFDQPPIVNPGLEP

SEQ ID NO: 96768 - protein, 20 aa, Mycobacterium avium
FLQRPARWMQLLAKESHTFS

SEQ ID NO: 96769 - protein, 19 aa, Mycobacterium avium
FLQRPARWMQLLANNSRVF

SEQ ID NO: 96770 - protein, 22 aa, Mycobacterium avium
FLREYPYRDAYLLRDAKLFRAE

SEQ ID NO: 96771 - protein, 28 aa, Mycobacterium avium
FLRFGRFIRQGWMGSDYLVARRVLPDGS

SEQ ID NO: 96772 - protein, 19 aa, Mycobacterium avium
FLTDAFSRMIIGWRVASHM

SEQ ID NO: 96773 - protein, 26 aa, Mycobacterium avium
FLTEKDARGWLSLRQAEIIRKAWVPP

SEQ ID NO: 96774 - protein, 18 aa, Mycobacterium avium
FMARVQLRWMGVFVADIA

SEQ ID NO: 96775 - protein, 17 aa, Mycobacterium avium
FMGDVYGGALLVEQAAW

SEQ ID NO: 96776 - protein, 24 aa, Mycobacterium avium
FMGNPILCDLILIRAALSPKAARL

SEQ ID NO: 96777 - protein, 17 aa, Mycobacterium avium
FMLKDPIYGLGPRLAQL

SEQ ID NO: 96778 - protein, 23 aa, Mycobacterium avium
FMPIPVRIIAALLGLPESDVGEF

SEQ ID NO: 96779 - protein, 25 aa, Mycobacterium avium
FMVPPQWFAMWARRHQHEFGSTCED

SEQ ID NO: 96780 - protein, 25 aa, Mycobacterium avium
FMVPPQWFAMWARRHQHEYGSTSED

SEQ ID NO: 96781 - protein, 18 aa, Mycobacterium avium
FNCRGIPGSDRWSQHAYG

SEQ ID NO: 96782 - protein, 19 aa, Mycobacterium avium
FNCRGIPGSDRWSQHAYGR

SEQ ID NO: 96783 - protein, 17 aa, Mycobacterium avium
FNDELQRRLGPSVWNSG

SEQ ID NO: 96784 - protein, 25 aa, Mycobacterium avium
FNDVDLRWVILAARIGILRQPLNIK

SEQ ID NO: 96785 - protein, 25 aa, Mycobacterium avium
FNEPKLRPGNVYFLNAQKLSKGARL

SEQ ID NO: 96786 - protein, 18 aa, Mycobacterium avium
FNEVFFTDARVPAENLVG

SEQ ID NO: 96787 - protein, 19 aa, Mycobacterium avium
FNGEKGFGFITPDDGTKDL

SEQ ID NO: 96788 - protein, 17 aa, Mycobacterium avium
FNLTKGWITPAVRIGRR

SEQ ID NO: 96789 - protein, 25 aa, Mycobacterium avium
FNPEARLFIDGRLRDSSTGKTVDNI

SEQ ID NO: 96790 - protein, 19 aa, Mycobacterium avium
FNPNDRAVYPLGFHSTPEI

SEQ ID NO: 96791 - protein, 19 aa, Mycobacterium avium
FNWPALPVAMADTIVPDFP

SEQ ID NO: 96792 - protein, 24 aa, Mycobacterium avium
FPAGSELRRALAIVKTLDELDRLL

SEQ ID NO: 96793 - protein, 18 aa, Mycobacterium avium
FPAIPGWPEQSMKDHRRI

SEQ ID NO: 96794 - protein, 28 aa, Mycobacterium avium
FPARELPKARVADGVGIPISMPAYARAF

SEQ ID NO: 96795 - protein, 19 aa, Mycobacterium avium
FPDGTAVPGFVDMHVHGGG

SEQ ID NO: 96796 - protein, 29 aa, Mycobacterium avium
FPEFARSRPRFVAAMLRHADKVILLSEQA

SEQ ID NO: 96797 - protein, 18 aa, Mycobacterium avium
FPEFARSRPRFVAATLRH

SEQ ID NO: 96798 - protein, 26 aa, Mycobacterium avium
FPEGKGWRQPELKAAGAAMATTALAS

SEQ ID NO: 96799 - protein, 19 aa, Mycobacterium avium
FPEGLRLGFQKVPDPTPGK

SEQ ID NO: 96800 - protein, 22 aa, Mycobacterium avium
FPEQLVMWWNFVGRSHEDIVGY

SEQ ID NO: 96801 - protein, 25 aa, Mycobacterium avium
FPGEISGGMRKRASLARALVMDPQI

SEQ ID NO: 96802 - protein, 26 aa, Mycobacterium avium
FPGKRAPTVQLCRDPKGYVPIGRNPW

SEQ ID NO: 96803 - protein, 19 aa, Mycobacterium avium
FPGLGMLAGARVLAEIGDD

SEQ ID NO: 96804 - protein, 21 aa, Mycobacterium avium
FPGQPLSTFVAAVGRSGTGKT

SEQ ID NO: 96805 - protein, 18 aa, Mycobacterium avium
FPGYFLVVHDIARFCREN

SEQ ID NO: 96806 - protein, 19 aa, Mycobacterium avium
FPHAVRWKGTTYLEDGLHR

SEQ ID NO: 96807 - protein, 18 aa, Mycobacterium avium
FPILCAFEAGEPFGSSDP

SEQ ID NO: 96808 - protein, 19 aa, Mycobacterium avium
FPIYARIARRWEFRQVRLA

SEQ ID NO: 96809 - protein, 17 aa, Mycobacterium avium
FPKPTISQIHGYCMGGG

SEQ ID NO: 96810 - protein, 21 aa, Mycobacterium avium
FPKRQGMRIDFILGSPALARR

SEQ ID NO: 96811 - protein, 21 aa, Mycobacterium avium
FPLPKFSDIRYDYALAGGATM

SEQ ID NO: 96812 - protein, 19 aa, Mycobacterium avium
FPMLSDIKRELSLATGVLN

SEQ ID NO: 96813 - protein, 25 aa, Mycobacterium avium
FPNLKICLSEGGIGWVAGLLDRLDH

SEQ ID NO: 96814 - protein, 18 aa, Mycobacterium avium
FPPEIHSALLSSGPGPGP

SEQ ID NO: 96815 - protein, 21 aa, Mycobacterium avium
FPPGGRFGVPGIDRAEIERRF

SEQ ID NO: 96816 - protein, 18 aa, Mycobacterium avium
FPPIGNRSISGPNAVSGY

SEQ ID NO: 96817 - protein, 21 aa, Mycobacterium avium
FPPPKTRFYGVKTLSSDKVAL

SEQ ID NO: 96818 - protein, 17 aa, Mycobacterium avium
FPRARLDGEPQYKTNVT

SEQ ID NO: 96819 - protein, 27 aa, Mycobacterium avium
FPRVGFKQQRWWDVGWWHRRLADPPAV

SEQ ID NO: 96820 - protein, 17 aa, Mycobacterium avium
FPSPLPYLVSPDEQSWT

SEQ ID NO: 96821 - protein, 18 aa, Mycobacterium avium
FPSSCGKTNLAMLSPTLQ

SEQ ID NO: 96822 - protein, 26 aa, Mycobacterium avium
FPSYALRRRAKALGSIGQFELFLITA

SEQ ID NO: 96823 - protein, 19 aa, Mycobacterium avium
FPTDRGWAVRELLAGSRRS

SEQ ID NO: 96824 - protein, 17 aa, Mycobacterium avium
FPTRSLSDFGFANVDRN

SEQ ID NO: 96825 - protein, 26 aa, Mycobacterium avium
FPVRPCPTWIRRSPCAWRGSATPTWW

SEQ ID NO: 96826 - protein, 28 aa, Mycobacterium avium
FPVRPCPTWIRRSPCAWRGSATPTWWPS

SEQ ID NO: 96827 - protein, 19 aa, Mycobacterium avium
FPYAWPRKPVLADNVVCTS

SEQ ID NO: 96828 - protein, 17 aa, Mycobacterium avium
FPYHFVDDIGRPEGCIE

SEQ ID NO: 96829 - protein, 21 aa, Mycobacterium avium
FQAEWREIGLLTFDGELLSRC

SEQ ID NO: 96830 - protein, 24 aa, Mycobacterium avium
FQDARKRFDAAWNHQNGDHPINDS

SEQ ID NO: 96831 - protein, 21 aa, Mycobacterium avium
FQIGNLSWPRVVAAARGLSHG

SEQ ID NO: 96832 - protein, 22 aa, Mycobacterium avium
FQISKLAERFHIAGRCTEEADD

SEQ ID NO: 96833 - protein, 21 aa, Mycobacterium avium
FQRFTPRARGAVVAAQNAAHQ

SEQ ID NO: 96834 - protein, 19 aa, Mycobacterium avium
FQRGQIMVCSYVLRTGGSY

SEQ ID NO: 96835 - protein, 23 aa, Mycobacterium avium
FQRTPIWCFPKLDVPLPAPARWA

SEQ ID NO: 96836 - protein, 22 aa, Mycobacterium avium
FQVSRPSLREAVRVLESDRLVE

SEQ ID NO: 96837 - protein, 27 aa, Mycobacterium avium
FQVWESAGALKLSWDFVSQAVSPATAR

SEQ ID NO: 96838 - protein, 19 aa, Mycobacterium avium
FRAAWRGLVPGPLRFVRAV

SEQ ID NO: 96839 - protein, 27 aa, Mycobacterium avium
FRAGEIDFRLFATIVYRTDLITDRGVL

SEQ ID NO: 96840 - protein, 17 aa, Mycobacterium avium
FRAHAFGNATFDHLVAA

SEQ ID NO: 96841 - protein, 27 aa, Mycobacterium avium
FRAIDRLGPELSVREIAEEAGTAKPKI

SEQ ID NO: 96842 - protein, 20 aa, Mycobacterium avium
FRAQLVIGYQGYVELAYRSG

SEQ ID NO: 96843 - protein, 17 aa, Mycobacterium avium
FRDAEKLTFPLLSDPDR

SEQ ID NO: 96844 - protein, 18 aa, Mycobacterium avium
FRDALAFMSAEVIGAPGI

SEQ ID NO: 96845 - protein, 19 aa, Mycobacterium avium
FRDDPYGRFREMRESGCPV

SEQ ID NO: 96846 - protein, 17 aa, Mycobacterium avium
FRDRVAAISQRVGENGW

SEQ ID NO: 96847 - protein, 17 aa, Mycobacterium avium
FREEAGKTGPFEIHVIS

SEQ ID NO: 96848 - protein, 20 aa, Mycobacterium avium
FREIGGRPVLSGFNVDAHKG

SEQ ID NO: 96849 - protein, 21 aa, Mycobacterium avium
FRESYRAFLDRHVAPCHDEWE

SEQ ID NO: 96850 - protein, 22 aa, Mycobacterium avium
FRESYRAFLDRHVAPYHDEWEK

SEQ ID NO: 96851 - protein, 17 aa, Mycobacterium avium
FRFNAVIDEEIARYGGP

SEQ ID NO: 96852 - protein, 27 aa, Mycobacterium avium
FRGTAPTGPGFWFPPTVLTPSRTDRCA

SEQ ID NO: 96853 - protein, 27 aa, Mycobacterium avium
FRGTGKYYAGVKWAWYQPIYAGRPVLV

SEQ ID NO: 96854 - protein, 26 aa, Mycobacterium avium
FRGTGKYYSGVKWTWYRPIYAGRPVL

SEQ ID NO: 96855 - protein, 18 aa, Mycobacterium avium
FRHMHGFGLHTFSFLNAA

SEQ ID NO: 96856 - protein, 25 aa, Mycobacterium avium
FRIVEQLPRKVAMRLLLTGEPLSAA

SEQ ID NO: 96857 - protein, 21 aa, Mycobacterium avium
FRKCIECFLCQNVCHVVRDHE

SEQ ID NO: 96858 - protein, 22 aa, Mycobacterium avium
FRKRLPMYFWVAAWETGRRMMG

SEQ ID NO: 96859 - protein, 17 aa, Mycobacterium avium
FRLALEQAPAGSVLHAV

SEQ ID NO: 96860 - protein, 18 aa, Mycobacterium avium
FRLERDGVLVSWAVPKNL

SEQ ID NO: 96861 - protein, 25 aa, Mycobacterium avium
FRLGITTDWKSRWYADKQYADYVKE

SEQ ID NO: 96862 - protein, 17 aa, Mycobacterium avium
FRLGNLLADGPRINAVI

SEQ ID NO: 96863 - protein, 21 aa, Mycobacterium avium
FRLLGLPVIITDNIPAVSTKA

SEQ ID NO: 96864 - protein, 18 aa, Mycobacterium avium
FRLVDLYSAPSMRELNTW

SEQ ID NO: 96865 - protein, 17 aa, Mycobacterium avium
FRMLRDRLFETLAAVEP

SEQ ID NO: 96866 - protein, 18 aa, Mycobacterium avium
FRNACYAVAAGAYDVAMA

SEQ ID NO: 96867 - protein, 19 aa, Mycobacterium avium
FRNINEFWIGSADMMHRNL

SEQ ID NO: 96868 - protein, 17 aa, Mycobacterium avium
FRPTVAALGARLHRGRR

SEQ ID NO: 96869 - protein, 24 aa, Mycobacterium avium
FRQTELFRLLLPARFGGLEASFPE

SEQ ID NO: 96870 - protein, 17 aa, Mycobacterium avium
FRRIGALADGWLGSFLT

SEQ ID NO: 96871 - protein, 18 aa, Mycobacterium avium
FRRLRPDLDNATADDAAE

SEQ ID NO: 96872 - protein, 18 aa, Mycobacterium avium
FRRLRPDLDNPTADDAAE

SEQ ID NO: 96873 - protein, 18 aa, Mycobacterium avium
FRRNLAFYGVDLGLMSVD

SEQ ID NO: 96874 - protein, 20 aa, Mycobacterium avium
FRSAGCAYMDLSVAHDNAAA

SEQ ID NO: 96875 - protein, 17 aa, Mycobacterium avium
FRSHPDLEILNHGLTLW

SEQ ID NO: 96876 - protein, 17 aa, Mycobacterium avium
FRTDLYRRTTIERLAGW

SEQ ID NO: 96877 - protein, 18 aa, Mycobacterium avium
FRVPSMKPLAGTSFQHIR

SEQ ID NO: 96878 - protein, 19 aa, Mycobacterium avium
FRVPSMKPLAGTSFQHIRD

SEQ ID NO: 96879 - protein, 21 aa, Mycobacterium avium
FRVPSMKRLAGTSFQHIRDAI

SEQ ID NO: 96880 - protein, 17 aa, Mycobacterium avium
FRVSREITCAQANLMPA

SEQ ID NO: 96881 - protein, 17 aa, Mycobacterium avium
FSARLGAAGFLGLTVPK

SEQ ID NO: 96882 - protein, 18 aa, Mycobacterium avium
FSEGGGMLVVERLSDARR

SEQ ID NO: 96883 - protein, 20 aa, Mycobacterium avium
FSEPMYGFRPRIIGRPPAAG

SEQ ID NO: 96884 - protein, 22 aa, Mycobacterium avium
FSEQLVMWWNFVGRSHEDIVGY

SEQ ID NO: 96885 - protein, 17 aa, Mycobacterium avium
FSGKILAPAHLPQEQSQ

SEQ ID NO: 96886 - protein, 22 aa, Mycobacterium avium
FSGMFQRYPKLKIALSEGEVGW

SEQ ID NO: 96887 - protein, 22 aa, Mycobacterium avium
FSGWPADVPVMIGCTEHEGRFF

SEQ ID NO: 96888 - protein, 20 aa, Mycobacterium avium
FSLAGEFLVHGRIVYAAGPI

SEQ ID NO: 96889 - protein, 29 aa, Mycobacterium avium
FSLRLADRLIPHWVWILGYRIYLWDMRSR

SEQ ID NO: 96890 - protein, 19 aa, Mycobacterium avium
FSNATLWPLYHDVIVKPIY

SEQ ID NO: 96891 - protein, 25 aa, Mycobacterium avium
FSNGLAVSYCGKMFADAGADVVKVE

SEQ ID NO: 96892 - protein, 17 aa, Mycobacterium avium
FSPFFNALPIRRLGLQE

SEQ ID NO: 96893 - protein, 18 aa, Mycobacterium avium
FSPGSAERFRESAIEMTN

SEQ ID NO: 96894 - protein, 17 aa, Mycobacterium avium
FSPLVAKLVAELGFDGV

SEQ ID NO: 96895 - protein, 22 aa, Mycobacterium avium
FSRGELHGGSWDSLNVKRAWSV

SEQ ID NO: 96896 - protein, 23 aa, Mycobacterium avium
FSRKGDRLWRGPQLPHHVQEFGG

SEQ ID NO: 96897 - protein, 24 aa, Mycobacterium avium
FSVDRLVIDEAMIWSPASQAAIMP

SEQ ID NO: 96898 - protein, 21 aa, Mycobacterium avium
FSVRVPWQWRATGSAAEVIPR

SEQ ID NO: 96899 - protein, 20 aa, Mycobacterium avium
FSVSDLPGVLARVREFGGAV

SEQ ID NO: 96900 - protein, 20 aa, Mycobacterium avium
FSVSDLPGVLARVRQFGGAV

SEQ ID NO: 96901 - protein, 19 aa, Mycobacterium avium
FSYQFSFEQSRHWSRTYAH

SEQ ID NO: 96902 - protein, 17 aa, Mycobacterium avium
FTADGWFRTGDLGHLDT

SEQ ID NO: 96903 - protein, 18 aa, Mycobacterium avium
FTADLKPSHTLAAVDALK

SEQ ID NO: 96904 - protein, 18 aa, Mycobacterium avium
FTAEIGRQSGLAAQGLDA

SEQ ID NO: 96905 - protein, 17 aa, Mycobacterium avium
FTAGWTLLSTGQERALD

SEQ ID NO: 96906 - protein, 22 aa, Mycobacterium avium
FTAQAFVSPYLVGVLGAATESS

SEQ ID NO: 96907 - protein, 25 aa, Mycobacterium avium
FTARCLDPLVGSGRFDFVNDLGEQM

SEQ ID NO: 96908 - protein, 29 aa, Mycobacterium avium
FTCIATAKAAIWAGLASPVMIWSMAQAAC

SEQ ID NO: 96909 - protein, 20 aa, Mycobacterium avium
FTDEPFEFVVPVDVSDAEGN

SEQ ID NO: 96910 - protein, 35 aa, Mycobacterium avium
FTFPMEFTPFQGGWQLSRHTAETLLALGKSPQAPT

SEQ ID NO: 96911 - protein, 17 aa, Mycobacterium avium
FTGTAFGAIGQTLGEAV

SEQ ID NO: 96912 - protein, 17 aa, Mycobacterium avium
FTKRIQLHTMLHEDLKR

SEQ ID NO: 96913 - protein, 18 aa, Mycobacterium avium
FTSGEYIGSIAMSEPAAG

SEQ ID NO: 96914 - protein, 19 aa, Mycobacterium avium
FTSKEDFAFDLSARNVAAL

SEQ ID NO: 96915 - protein, 18 aa, Mycobacterium avium
FTSLVLLECRVDEPASIW

SEQ ID NO: 96916 - protein, 17 aa, Mycobacterium avium
FTTKYPVALTVGALDWA

SEQ ID NO: 96917 - protein, 17 aa, Mycobacterium avium
FTVAAHHRKLMVASAVH

SEQ ID NO: 96918 - protein, 23 aa, Mycobacterium avium
FVAAEFAHIFSALGVHVTVVIRS

SEQ ID NO: 96919 - protein, 18 aa, Mycobacterium avium
FVACPFGDAGARMYRTGD

SEQ ID NO: 96920 - protein, 18 aa, Mycobacterium avium
FVAEFGRTWQAVVPEETD

SEQ ID NO: 96921 - protein, 23 aa, Mycobacterium avium
FVASALARLGPLLVVTATGREAD

SEQ ID NO: 96922 - protein, 18 aa, Mycobacterium avium
FVATKAAWVAWLAASSGS

SEQ ID NO: 96923 - protein, 17 aa, Mycobacterium avium
FVCCHHIVADGIGLALI

SEQ ID NO: 96924 - protein, 17 aa, Mycobacterium avium
FVDEFPLTGLGKVAKAE

SEQ ID NO: 96925 - protein, 21 aa, Mycobacterium avium
FVEGSVIAWCPAEPGKQPPGH

SEQ ID NO: 96926 - protein, 20 aa, Mycobacterium avium
FVESTGIPFLPMSMAKGLLP

SEQ ID NO: 96927 - protein, 20 aa, Mycobacterium avium
FVHAHPRWIAQAFADALGAA

SEQ ID NO: 96928 - protein, 17 aa, Mycobacterium avium
FVIALAMVHNGTVVTEE

SEQ ID NO: 96929 - protein, 17 aa, Mycobacterium avium
FVLTEVRSDWLPVTLQI

SEQ ID NO: 96930 - protein, 18 aa, Mycobacterium avium
FVPNPAAAALEAQVYPSP

SEQ ID NO: 96931 - protein, 23 aa, Mycobacterium avium
FVPNPFGAPGSRMYRTGDLVCWG

SEQ ID NO: 96932 - protein, 24 aa, Mycobacterium avium
FVPNPFGAPGSRMYRTGDLVCWGP

SEQ ID NO: 96933 - protein, 18 aa, Mycobacterium avium
FVPSAGAVLADWGADVIK

SEQ ID NO: 96934 - protein, 18 aa, Mycobacterium avium
FVPSAGAVLADWGADVVK

SEQ ID NO: 96935 - protein, 24 aa, Mycobacterium avium
FVPSAGAVLAEWGAEVIKVEPREG

SEQ ID NO: 96936 - protein, 23 aa, Mycobacterium avium
FVQLMNGGALQYAVTEAANTTPL

SEQ ID NO: 96937 - protein, 17 aa, Mycobacterium avium
FVRLHQPSAFYGVNSLR

SEQ ID NO: 96938 - protein, 18 aa, Mycobacterium avium
FVSLPGEDTLYWVGDTGP

SEQ ID NO: 96939 - protein, 18 aa, Mycobacterium avium
FVTKGGAPVMSFGVMGGM

SEQ ID NO: 96940 - protein, 17 aa, Mycobacterium avium
FVVLRSSALRDVVTAAA

SEQ ID NO: 96941 - protein, 22 aa, Mycobacterium avium
FVWDAWTVGLQWWRRFGPDRPL

SEQ ID NO: 96942 - protein, 19 aa, Mycobacterium avium
FVYRTQRFEPSRTGRTELE

SEQ ID NO: 96943 - protein, 18 aa, Mycobacterium avium
FWALSRHQDVLQGFRNST

SEQ ID NO: 96944 - protein, 17 aa, Mycobacterium avium
FWDWAYKSLPNDSRMLM

SEQ ID NO: 96945 - protein, 17 aa, Mycobacterium avium
FWFIVDRVKDMIVTGGF

SEQ ID NO: 96946 - protein, 21 aa, Mycobacterium avium
FWNREYDILVCTTIVETGLDI

SEQ ID NO: 96947 - protein, 21 aa, Mycobacterium avium
FWREFPLGPAGKILKREIANQ

SEQ ID NO: 96948 - protein, 21 aa, Mycobacterium avium
FWSVVTGVYSPQSWSTIPGGP

SEQ ID NO: 96949 - protein, 17 aa, Mycobacterium avium
FWVKDGQNYLPFGTAAG

SEQ ID NO: 96950 - protein, 31 aa, Mycobacterium avium
FYDDDREAAAWARAGAPAGRMCLEAQVMDWA

SEQ ID NO: 96951 - protein, 17 aa, Mycobacterium avium
FYFRTRKALVHAMAGRL

SEQ ID NO: 96952 - protein, 17 aa, Mycobacterium avium
FYFVYRTQRFEPSRTGR

SEQ ID NO: 96953 - protein, 17 aa, Mycobacterium avium
FYGLNAFLFTNSAGATV

SEQ ID NO: 96954 - protein, 23 aa, Mycobacterium avium
GAADADEGPAWWDGTVIEHLRVS

SEQ ID NO: 96955 - protein, 19 aa, Mycobacterium avium
GAADWSKRPLPAEWLNYAA

SEQ ID NO: 96956 - protein, 24 aa, Mycobacterium avium
GAAEAEIGSAFVPVMTEVAKDAKW

SEQ ID NO: 96957 - protein, 17 aa, Mycobacterium avium
GAAEAFALLSNLRPARA

SEQ ID NO: 96958 - protein, 18 aa, Mycobacterium avium
GAAGVAMGTRFLLTSDST

SEQ ID NO: 96959 - protein, 17 aa, Mycobacterium avium
GAAIGILSVPPAWTRSM

SEQ ID NO: 96960 - protein, 17 aa, Mycobacterium avium
GAAIGILSVPRAWTRSV

SEQ ID NO: 96961 - protein, 19 aa, Mycobacterium avium
GAALALACDRVVAARDARF

SEQ ID NO: 96962 - protein, 24 aa, Mycobacterium avium
GAALKAAAGMHAYVATKHGIVGLT

SEQ ID NO: 96963 - protein, 20 aa, Mycobacterium avium
GAALRIAFRALTLAGVHGVE

SEQ ID NO: 96964 - protein, 20 aa, Mycobacterium avium
GAALSMPGMMDTVLNLGMND

SEQ ID NO: 96965 - protein, 17 aa, Mycobacterium avium
GAARAALNGPWGALTAT

SEQ ID NO: 96966 - protein, 23 aa, Mycobacterium avium
GAARGRIACVAHHWSERGDELVD

SEQ ID NO: 96967 - protein, 24 aa, Mycobacterium avium
GAATRLGHSVAFFIGTAYGSPETA

SEQ ID NO: 96968 - protein, 17 aa, Mycobacterium avium
GACAVPADGRPLIGELV

SEQ ID NO: 96969 - protein, 20 aa, Mycobacterium avium
GADAAYVCRGRVCDLPVTRT

SEQ ID NO: 96970 - protein, 27 aa, Mycobacterium avium
GADALASILSWQGWETLFELAHFVGVS

SEQ ID NO: 96971 - protein, 24 aa, Mycobacterium avium
GADEVFAGYHWYPPMGEPAAATLD

SEQ ID NO: 96972 - protein, 20 aa, Mycobacterium avium
GADGFLAWQAARCVANWHGA

SEQ ID NO: 96973 - protein, 24 aa, Mycobacterium avium
GADGWECQRALSVANNVIVDINAC

SEQ ID NO: 96974 - protein, 21 aa, Mycobacterium avium
GADLVGPVLIKFGSQEQKDRY

SEQ ID NO: 96975 - protein, 34 aa, Mycobacterium avium
GADRRIGAEFLRPGPGWGGSCLPKDTAALLDIAH

SEQ ID NO: 96976 - protein, 31 aa, Mycobacterium avium
GADYRWMNLVARLPRKGIPVYAKRLAQGVGG

SEQ ID NO: 96977 - protein, 19 aa, Mycobacterium avium
GAEARALIRSRLVPPAQPE

SEQ ID NO: 96978 - protein, 23 aa, Mycobacterium avium
GAELIKVCCSGGIMSLTGPPGAQ

SEQ ID NO: 96979 - protein, 24 aa, Mycobacterium avium
GAELIKVCCSGGIMSLTGPPGAQH

SEQ ID NO: 96980 - protein, 21 aa, Mycobacterium avium
GAELIKVCHSGGVMSLTGPPG

SEQ ID NO: 96981 - protein, 18 aa, Mycobacterium avium
GAEQMLGDVWEWTTSPLR

SEQ ID NO: 96982 - protein, 18 aa, Mycobacterium avium
GAFAPMALAVARRLADQG

SEQ ID NO: 96983 - protein, 17 aa, Mycobacterium avium
GAFVRAGLVNRILVYLA

SEQ ID NO: 96984 - protein, 23 aa, Mycobacterium avium
GAGANPFAALASFGAEALQAIAD

SEQ ID NO: 96985 - protein, 18 aa, Mycobacterium avium
GAGARPRLLYTAVEEAAK

SEQ ID NO: 96986 - protein, 42 aa, Mycobacterium avium
GAGDIGYNCHLIFRTDLYRRTTIERLAGWLVRAVTAFADDLD

SEQ ID NO: 96987 - protein, 25 aa, Mycobacterium avium
GAGGLAFRCVEPFHTWTMTYEGKAV

SEQ ID NO: 96988 - protein, 18 aa, Mycobacterium avium
GAGLPWGTPSAIDYVEGA

SEQ ID NO: 96989 - protein, 21 aa, Mycobacterium avium
GAGLSRPTFYFYFKSKEAVVL

SEQ ID NO: 96990 - protein, 18 aa, Mycobacterium avium
GAGPAPDSELNWCNPSGR

SEQ ID NO: 96991 - protein, 24 aa, Mycobacterium avium
GAGPGELVALVFSRSAEAIVAILA

SEQ ID NO: 96992 - protein, 18 aa, Mycobacterium avium
GAGPPLLLVHGSTGTRAR

SEQ ID NO: 96993 - protein, 17 aa, Mycobacterium avium
GAGRLAGARCTAFVTDL

SEQ ID NO: 96994 - protein, 17 aa, Mycobacterium avium
GAGRPPVLYELAHGTPF

SEQ ID NO: 96995 - protein, 23 aa, Mycobacterium avium
GAGSFPWVLAITCPYRDAAERNA

SEQ ID NO: 96996 - protein, 29 aa, Mycobacterium avium
GAGSGSISVEWCLSGTGCRATAFERDAQR

SEQ ID NO: 96997 - protein, 22 aa, Mycobacterium avium
GAGSLDEAVRWAASARAAVVVL

SEQ ID NO: 96998 - protein, 17 aa, Mycobacterium avium
GAIAFASPLSYPVIADQ

SEQ ID NO: 96999 - protein, 18 aa, Mycobacterium avium
GAIAYPYYLVNGRIAAFP

SEQ ID NO: 97000 - protein, 18 aa, Mycobacterium avium
GAIPLLFDEVLGRLASSG

SEQ ID NO: 97001 - protein, 25 aa, Mycobacterium avium
GAIRPDAQGLLAFVGVTHSDDRDKA

SEQ ID NO: 97002 - protein, 42 aa, Mycobacterium avium
GAITPDWLREGVRFWLRTALDAELLRWSSAVERARDMARHFG

SEQ ID NO: 97003 - protein, 18 aa, Mycobacterium avium
GALAEQWAGLERLFTSGE

SEQ ID NO: 97004 - protein, 24 aa, Mycobacterium avium
GALFRTAEGWQLRGPLRGDRELHD

SEQ ID NO: 97005 - protein, 18 aa, Mycobacterium avium
GALGVKLAQPESRVLAVV

SEQ ID NO: 97006 - protein, 17 aa, Mycobacterium avium
GALHVFGEGLGDRHRGG

SEQ ID NO: 97007 - protein, 19 aa, Mycobacterium avium
GALPDFIGLALRVNAPQPA

SEQ ID NO: 97008 - protein, 19 aa, Mycobacterium avium
GALPDFIGLALRVSAPQPA

SEQ ID NO: 97009 - protein, 20 aa, Mycobacterium avium
GALPRWAFANAATGEMSGDS

SEQ ID NO: 97010 - protein, 18 aa, Mycobacterium avium
GALRAGAAGFVLKDSSAE

SEQ ID NO: 97011 - protein, 19 aa, Mycobacterium avium
GALRAGAAGFVLKDSSAEE

SEQ ID NO: 97012 - protein, 28 aa, Mycobacterium avium
GALTAALQCFTQAFVLRQKNPKMYDLFM

SEQ ID NO: 97013 - protein, 25 aa, Mycobacterium avium
GALTESAAWGHDWSATELQVGAAVS

SEQ ID NO: 97014 - protein, 25 aa, Mycobacterium avium
GALTESAAWGHDWSATEVHVGAAVS

SEQ ID NO: 97015 - protein, 31 aa, Mycobacterium avium
GALTPRIASLELEYYGSMWPNNRPSAPATGR

SEQ ID NO: 97016 - protein, 28 aa, Mycobacterium avium
GALTPRIASLELEYYGSMWPNNSAVGAS

SEQ ID NO: 97017 - protein, 17 aa, Mycobacterium avium
GALVVLVEAHLALVELA

SEQ ID NO: 97018 - protein, 26 aa, Mycobacterium avium
GAMGTAWLAIKGYNIASTILSPIGTG

SEQ ID NO: 97019 - protein, 19 aa, Mycobacterium avium
GAMNECWVRHLSAHADADV

SEQ ID NO: 97020 - protein, 25 aa, Mycobacterium avium
GAMVLDELIPLLGNQGLDTSRVAFL

SEQ ID NO: 97021 - protein, 18 aa, Mycobacterium avium
GANIIGIDICADIAANGY

SEQ ID NO: 97022 - protein, 19 aa, Mycobacterium avium
GANIIGIDICADIAANGYP

SEQ ID NO: 97023 - protein, 20 aa, Mycobacterium avium
GAPADFAGYVPVAKRGELSP

SEQ ID NO: 97024 - protein, 20 aa, Mycobacterium avium
GAPDELKARISRVSPHATLE

SEQ ID NO: 97025 - protein, 18 aa, Mycobacterium avium
GAPGQWWQQQVVLGLQRG

SEQ ID NO: 97026 - protein, 19 aa, Mycobacterium avium
GAPGTFLRFGRFIRQGWMG

SEQ ID NO: 97027 - protein, 19 aa, Mycobacterium avium
GAPLLFFLDAGVPPLSALV

SEQ ID NO: 97028 - protein, 19 aa, Mycobacterium avium
GAPPEDWEQFRAWSDAAVG

SEQ ID NO: 97029 - protein, 20 aa, Mycobacterium avium
GAPPGLAINPLVNRYRTKDG

SEQ ID NO: 97030 - protein, 25 aa, Mycobacterium avium
GAPPTLPPFMLADGVASLNAAYAVM

SEQ ID NO: 97031 - protein, 19 aa, Mycobacterium avium
GAPPVAGLHLQFGKNAGTE

SEQ ID NO: 97032 - protein, 18 aa, Mycobacterium avium
GAPVLAICAAVQVLGHWY

SEQ ID NO: 97033 - protein, 19 aa, Mycobacterium avium
GAPVLAICAAVQVLGHWYE

SEQ ID NO: 97034 - protein, 20 aa, Mycobacterium avium
GAPVMSFGVMGGMMQPQGHV

SEQ ID NO: 97035 - protein, 17 aa, Mycobacterium avium
GAQARRLCPHAVVVPPR

SEQ ID NO: 97036 - protein, 29 aa, Mycobacterium avium
GAQGARLGESLALLGWNMSVSNLRWDGDY

SEQ ID NO: 97037 - protein, 19 aa, Mycobacterium avium
GAQHWSESCVEQQIYSQTL

SEQ ID NO: 97038 - protein, 24 aa, Mycobacterium avium
GAQLARLEARVMFEVLLGAFPTIE

SEQ ID NO: 97039 - protein, 19 aa, Mycobacterium avium
GAQLSPEEFGRFLASQPDL

SEQ ID NO: 97040 - protein, 24 aa, Mycobacterium avium
GAQQRRFRGATLRRQTDRHAQAGD

SEQ ID NO: 97041 - protein, 21 aa, Mycobacterium avium
GAQRALHRVISLLGAGRAVLT

SEQ ID NO: 97042 - protein, 26 aa, Mycobacterium avium
GAQSPKESWLRVLLIDAGFPRPQTQI

SEQ ID NO: 97043 - protein, 18 aa, Mycobacterium avium
GARGYAHIGVIEALQDRG

SEQ ID NO: 97044 - protein, 30 aa, Mycobacterium avium
GARLPAPAPYRGFVTWLAARDVPAARAAWR

SEQ ID NO: 97045 - protein, 30 aa, Mycobacterium avium
GARPPRIGIPLKVMYALGLCGDVAAKVLRR

SEQ ID NO: 97046 - protein, 21 aa, Mycobacterium avium
GARVGYGFITWSLARNPGVLD

SEQ ID NO: 97047 - protein, 25 aa, Mycobacterium avium
GASDIGYNCHLIFRTDLYRRTTIER

SEQ ID NO: 97048 - protein, 28 aa, Mycobacterium avium
GASDRACSWLPLYHDMGLAFLLTSALSG

SEQ ID NO: 97049 - protein, 28 aa, Mycobacterium avium
GASDRACSWLPLYHDMGLAFLLTSVLSG

SEQ ID NO: 97050 - protein, 26 aa, Mycobacterium avium
GASEYVFRFAPLVGIYGGTLEVFRNM

SEQ ID NO: 97051 - protein, 27 aa, Mycobacterium avium
GASGFVIKDIKGMELARAIKDVGAGKS

SEQ ID NO: 97052 - protein, 19 aa, Mycobacterium avium
GASLGRCRSGCMAGRTTGI

SEQ ID NO: 97053 - protein, 21 aa, Mycobacterium avium
GASVPALFGAWAQRVPGAVAI

SEQ ID NO: 97054 - protein, 18 aa, Mycobacterium avium
GASVPICRTEYYINRSFA

SEQ ID NO: 97055 - protein, 35 aa, Mycobacterium avium
GATACLRKTDWLFPQYRELGAFLVRGIPPGNVGAV

SEQ ID NO: 97056 - protein, 18 aa, Mycobacterium avium
GATALKLTGREAVDTIIE

SEQ ID NO: 97057 - protein, 30 aa, Mycobacterium avium
GATAPRLLLEVVCARLLLPSASDTEAALLQ

SEQ ID NO: 97058 - protein, 30 aa, Mycobacterium avium
GATAPRLLLEVVCARLLLPSASDTESALLQ

SEQ ID NO: 97059 - protein, 30 aa, Mycobacterium avium
GATAPRLLLEVVCARLLLPSASDTETALLQ

SEQ ID NO: 97060 - protein, 20 aa, Mycobacterium avium
GATARAYVDMYRKYADDFPR

SEQ ID NO: 97061 - protein, 21 aa, Mycobacterium avium
GATCIGCGSAVELKYIRAEGR

SEQ ID NO: 97062 - protein, 20 aa, Mycobacterium avium
GATFRPSALQTLSHFPIAVA

SEQ ID NO: 97063 - protein, 23 aa, Mycobacterium avium
GATGFLGRYLVLQWLERLELADG

SEQ ID NO: 97064 - protein, 23 aa, Mycobacterium avium
GATPAQVALAWLLAKGPDVVPIP

SEQ ID NO: 97065 - protein, 28 aa, Mycobacterium avium
GATPAQVGLAWILARAPHTLLIPGTRSI

SEQ ID NO: 97066 - protein, 17 aa, Mycobacterium avium
GATPERPVVLPVAEDIP

SEQ ID NO: 97067 - protein, 21 aa, Mycobacterium avium
GATVLRGVWAFHGDHPPHGDG

SEQ ID NO: 97068 - protein, 20 aa, Mycobacterium avium
GATVRECYRRGGRVYLLTLT

SEQ ID NO: 97069 - protein, 18 aa, Mycobacterium avium
GAVAKFVRGDVKIVQTET

SEQ ID NO: 97070 - protein, 18 aa, Mycobacterium avium
GAVDGLLSGFSQRAGDVG

SEQ ID NO: 97071 - protein, 18 aa, Mycobacterium avium
GAVDLGFRLAPPAWLDPG

SEQ ID NO: 97072 - protein, 17 aa, Mycobacterium avium
GAVELWPVVHAVEPSRR

SEQ ID NO: 97073 - protein, 19 aa, Mycobacterium avium
GAVLADWGADVIKIEHPET

SEQ ID NO: 97074 - protein, 20 aa, Mycobacterium avium
GAVQRVGLRVSLIPHSPVAG

SEQ ID NO: 97075 - protein, 17 aa, Mycobacterium avium
GAVRAPGYLSWLMGCDM

SEQ ID NO: 97076 - protein, 18 aa, Mycobacterium avium
GAWHAEWDTLRILGRRTA

SEQ ID NO: 97077 - protein, 17 aa, Mycobacterium avium
GAWLREGPLIRLAGAKG

SEQ ID NO: 97078 - protein, 17 aa, Mycobacterium avium
GAYDATAFWARGGSADG

SEQ ID NO: 97079 - protein, 24 aa, Mycobacterium avium
GCAEPAVQREAFAWHIDLAKRCGK

SEQ ID NO: 97080 - protein, 18 aa, Mycobacterium avium
GCAKCGRTDLALRRNSPE

SEQ ID NO: 97081 - protein, 31 aa, Mycobacterium avium
GCANPTRMLLPRSRYDEGVAILKGIYENVTC

SEQ ID NO: 97082 - protein, 25 aa, Mycobacterium avium
GCAPGCRTGGIAACRRSPGRSSNHA

SEQ ID NO: 97083 - protein, 28 aa, Mycobacterium avium
GCASSAWTLGFYALHNWMLSLFDPQAQR

SEQ ID NO: 97084 - protein, 20 aa, Mycobacterium avium
GCDHEIRSGAAHLVVWPVEP

SEQ ID NO: 97085 - protein, 24 aa, Mycobacterium avium
GCDPALVVVEGLRFSVSAQDSSLS

SEQ ID NO: 97086 - protein, 23 aa, Mycobacterium avium
GCGDACPFFPGKRYENWDLTDPA

SEQ ID NO: 97087 - protein, 17 aa, Mycobacterium avium
GCGGAPRWTVTAPTRPS

SEQ ID NO: 97088 - protein, 25 aa, Mycobacterium avium
GCGLLHCEHDTWLLTVMGVGGEEPA

SEQ ID NO: 97089 - protein, 20 aa, Mycobacterium avium
GCGRRWYRRRCASGYDQLDR

SEQ ID NO: 97090 - protein, 25 aa, Mycobacterium avium
GCGTELRDGWHLRIARSRLDRTDMF

SEQ ID NO: 97091 - protein, 35 aa, Mycobacterium avium
GCKPTYDRWAEYGGPEWTWQPLLPYLRKSATYHDD

SEQ ID NO: 97092 - protein, 17 aa, Mycobacterium avium
GCPVRRQCLAAALERAE

SEQ ID NO: 97093 - protein, 19 aa, Mycobacterium avium
GCQSDTLAAIAPVAGTLLT

SEQ ID NO: 97094 - protein, 34 aa, Mycobacterium avium
GCRSSTSTGCGWTRWPRCCTWTTPAPRAAGPPTS

SEQ ID NO: 97095 - protein, 24 aa, Mycobacterium avium
GCSDSRVAAELIFDQGLGDMFVVR

SEQ ID NO: 97096 - protein, 17 aa, Mycobacterium avium
GCTAPGCTAPGCTAPGC

SEQ ID NO: 97097 - protein, 18 aa, Mycobacterium avium
GCTAPGCTAPGCTAPGCT

SEQ ID NO: 97098 - protein, 24 aa, Mycobacterium avium
GCTAPGCTIPGYYAEVHHCTDYAT

SEQ ID NO: 97099 - protein, 22 aa, Mycobacterium avium
GCTAPGCTIPGYYSEVHHCTDY

SEQ ID NO: 97100 - protein, 23 aa, Mycobacterium avium
GCTAPGCTIPGYYSEVHHCTDYA

SEQ ID NO: 97101 - protein, 24 aa, Mycobacterium avium
GCTAPGCTIPGYYSEVHHCTDYAT

SEQ ID NO: 97102 - protein, 21 aa, Mycobacterium avium
GCTAPGCTVPGYYSEVHHCTD

SEQ ID NO: 97103 - protein, 22 aa, Mycobacterium avium
GCTVDFKNTVLIFTSNLGTSDI

SEQ ID NO: 97104 - protein, 17 aa, Mycobacterium avium
GCTVVRGHARFRDPHTL

SEQ ID NO: 97105 - protein, 18 aa, Mycobacterium avium
GCTVVRGHARFRDPHTLQ

SEQ ID NO: 97106 - protein, 21 aa, Mycobacterium avium
GDACRIPWATGDTETSDPAAN

SEQ ID NO: 97107 - protein, 21 aa, Mycobacterium avium
GDADAVAGLRRLTRIAEQDRQ

SEQ ID NO: 97108 - protein, 22 aa, Mycobacterium avium
GDAGDIAYPYYLVNGRIAASPK

SEQ ID NO: 97109 - protein, 30 aa, Mycobacterium avium
GDALGGFPPPGGRVLLVWDAPNLDMGLGSI

SEQ ID NO: 97110 - protein, 25 aa, Mycobacterium avium
GDDWQATAFPVEFLSLGTNGIGVPI

SEQ ID NO: 97111 - protein, 18 aa, Mycobacterium avium
GDEAGLHAAASRWHGFAA

SEQ ID NO: 97112 - protein, 18 aa, Mycobacterium avium
GDEAIELTSSTGERVKAA

SEQ ID NO: 97113 - protein, 18 aa, Mycobacterium avium
GDEKGVIGNSLQLMSNPN

SEQ ID NO: 97114 - protein, 27 aa, Mycobacterium avium
GDEPFDAVVCSLVLCSVRDPQGVLRRL

SEQ ID NO: 97115 - protein, 22 aa, Mycobacterium avium
GDERVASLLMWHFVEEVEHRSS

SEQ ID NO: 97116 - protein, 23 aa, Mycobacterium avium
GDFVKIDFGALVGGYHSDMTRTF

SEQ ID NO: 97117 - protein, 17 aa, Mycobacterium avium
GDGAILRELARLSDRVH

SEQ ID NO: 97118 - protein, 24 aa, Mycobacterium avium
GDGEFPDSAALFWEAISAESADRL

SEQ ID NO: 97119 - protein, 24 aa, Mycobacterium avium
GDGHSGFDTVLWDVLCNQVGVAGI

SEQ ID NO: 97120 - protein, 24 aa, Mycobacterium avium
GDGKAADMIPVYAANVGQNLSLEN

SEQ ID NO: 97121 - protein, 18 aa, Mycobacterium avium
GDGLDFGLLRYLRDDTAA

SEQ ID NO: 97122 - protein, 17 aa, Mycobacterium avium
GDGLVIGGPLGDLLEGL

SEQ ID NO: 97123 - protein, 20 aa, Mycobacterium avium
GDGPIDLVLLPGPSIPIDSV

SEQ ID NO: 97124 - protein, 26 aa, Mycobacterium avium
GDGPRPQEWLLFLGADDALDQPDTLA

SEQ ID NO: 97125 - protein, 23 aa, Mycobacterium avium
GDGTQRWPAVHRDDAAALFRLAL

SEQ ID NO: 97126 - protein, 17 aa, Mycobacterium avium
GDGTVTWVLDPIDGTVN

SEQ ID NO: 97127 - protein, 28 aa, Mycobacterium avium
GDGVKVICRRSRLMARIAGRGAMASVEL

SEQ ID NO: 97128 - protein, 20 aa, Mycobacterium avium
GDGYLSWPDLTAGRYRRTSP

SEQ ID NO: 97129 - protein, 23 aa, Mycobacterium avium
GDHRIDRCFARNAARQRLCHGGS

SEQ ID NO: 97130 - protein, 25 aa, Mycobacterium avium
GDHVGGLCPNGCWGTFVTCDANVAV

SEQ ID NO: 97131 - protein, 38 aa, Mycobacterium avium
GDHVGGLSANGCWGTFLTCDARLAVTVPPGLADDQAAA

SEQ ID NO: 97132 - protein, 17 aa, Mycobacterium avium
GDIAALLQLLAPDVLRT

SEQ ID NO: 97133 - protein, 20 aa, Mycobacterium avium
GDIGKAFGLGAGCLMTVRIG

SEQ ID NO: 97134 - protein, 26 aa, Mycobacterium avium
GDIQLYYRRVRGWAMVFGEPAVALDR

SEQ ID NO: 97135 - protein, 17 aa, Mycobacterium avium
GDIRRRAAELVALDQQV

SEQ ID NO: 97136 - protein, 25 aa, Mycobacterium avium
GDITRARFYLFVNHIANFVPFAVSS

SEQ ID NO: 97137 - protein, 19 aa, Mycobacterium avium
GDKITLTFSDPAGGGSRTL

SEQ ID NO: 97138 - protein, 17 aa, Mycobacterium avium
GDKRALAETVQRNAKEA

SEQ ID NO: 97139 - protein, 17 aa, Mycobacterium avium
GDLARKMTFRALYRLER

SEQ ID NO: 97140 - protein, 18 aa, Mycobacterium avium
GDLHAGPGDGHWLLSGAS

SEQ ID NO: 97141 - protein, 26 aa, Mycobacterium avium
GDLKRSCLDIGLAARVLGWQPKVGLQ

SEQ ID NO: 97142 - protein, 17 aa, Mycobacterium avium
GDLLLMREGRLVAHTTP

SEQ ID NO: 97143 - protein, 18 aa, Mycobacterium avium
GDLLRPTTVSGRLHAEAT

SEQ ID NO: 97144 - protein, 17 aa, Mycobacterium avium
GDLVRWGADGQLRYLGR

SEQ ID NO: 97145 - protein, 25 aa, Mycobacterium avium
GDLVRWGVGGGLEFVGRVDEQVKVR

SEQ ID NO: 97146 - protein, 19 aa, Mycobacterium avium
GDPAVPWERAHAVPAPAWA

SEQ ID NO: 97147 - protein, 27 aa, Mycobacterium avium
GDPGESRFYLSLGDELMRRFNGAALEV

SEQ ID NO: 97148 - protein, 26 aa, Mycobacterium avium
GDPHYAYKLDWLAALRDSAAAWLRED

SEQ ID NO: 97149 - protein, 22 aa, Mycobacterium avium
GDPLRPDVMLGPVITEAAANRI

SEQ ID NO: 97150 - protein, 19 aa, Mycobacterium avium
GDPQRGLVTMGIVDEGGGT

SEQ ID NO: 97151 - protein, 20 aa, Mycobacterium avium
GDPWEVNRTLQAGRPAQIER

SEQ ID NO: 97152 - protein, 17 aa, Mycobacterium avium
GDPYPVYRELRNTTPVV

SEQ ID NO: 97153 - protein, 23 aa, Mycobacterium avium
GDRDEVVLPFAWQGVSLHAAGAS

SEQ ID NO: 97154 - protein, 33 aa, Mycobacterium avium
GDRVMVIARNCIEWPEISFGLAKAGLITVPVNI

SEQ ID NO: 97155 - protein, 18 aa, Mycobacterium avium
GDRWIINGAKTWSTSAFA

SEQ ID NO: 97156 - protein, 20 aa, Mycobacterium avium
GDTFVGPRFGYLGRTQPVGR

SEQ ID NO: 97157 - protein, 19 aa, Mycobacterium avium
GDTMFPHGYTFGGHPVSAA

SEQ ID NO: 97158 - protein, 19 aa, Mycobacterium avium
GDTQWSWAQYLRGTAARAA

SEQ ID NO: 97159 - protein, 19 aa, Mycobacterium avium
GDVGPRPQLRVGRQQQVVE

SEQ ID NO: 97160 - protein, 18 aa, Mycobacterium avium
GDVHFLRQRGDIHFLPTL

SEQ ID NO: 97161 - protein, 24 aa, Mycobacterium avium
GDVIEVPGLLDLSSLRQIYDLDRP

SEQ ID NO: 97162 - protein, 25 aa, Mycobacterium avium
GDVIEVPGLLDLSSLWQIYDLDRPA

SEQ ID NO: 97163 - protein, 26 aa, Mycobacterium avium
GDVIEVPGLLDLSSLWQIYDLDRPAL

SEQ ID NO: 97164 - protein, 19 aa, Mycobacterium avium
GDVIPEVLGPVVDLRDGTE

SEQ ID NO: 97165 - protein, 17 aa, Mycobacterium avium
GDVKLYYAVGRTVDGGY

SEQ ID NO: 97166 - protein, 19 aa, Mycobacterium avium
GDVLLPIGYDASSPIPAAD

SEQ ID NO: 97167 - protein, 19 aa, Mycobacterium avium
GDYFDGLRAGVWGDNRLSE

SEQ ID NO: 97168 - protein, 17 aa, Mycobacterium avium
GDYFQHWLDIGANTNPD

SEQ ID NO: 97169 - protein, 27 aa, Mycobacterium avium
GDYPRPRLFSLLHEFVHLVLHTEGLCD

SEQ ID NO: 97170 - protein, 22 aa, Mycobacterium avium
GEAALLRLAEELAIPVLMNGMA

SEQ ID NO: 97171 - protein, 26 aa, Mycobacterium avium
GEAEAAFNLARGRFEQAWTHENDENP

SEQ ID NO: 97172 - protein, 20 aa, Mycobacterium avium
GEAEKLCAQRDFVAQVESVA

SEQ ID NO: 97173 - protein, 39 aa, Mycobacterium avium
GEAFNEIRAELGLAQAPRVDSYGGFIFASLAAEGVSLRE

SEQ ID NO: 97174 - protein, 24 aa, Mycobacterium avium
GEALAADVRRADCQFVVTDAEHRP

SEQ ID NO: 97175 - protein, 25 aa, Mycobacterium avium
GEALAADVRRADCQFVVTDAEHRPL

SEQ ID NO: 97176 - protein, 21 aa, Mycobacterium avium
GEAMSGFAHITGQAGAPPTLP

SEQ ID NO: 97177 - protein, 21 aa, Mycobacterium avium
GEAMSGFAHITGQAGTPPTLP

SEQ ID NO: 97178 - protein, 23 aa, Mycobacterium avium
GEARIEKLIERFRRVLEAMTVDL

SEQ ID NO: 97179 - protein, 24 aa, Mycobacterium avium
GEATGYRVAVTWGAQPGILSAVFV

SEQ ID NO: 97180 - protein, 24 aa, Mycobacterium avium
GEATGYRVAVTWGAQPGTLSAVFV

SEQ ID NO: 97181 - protein, 25 aa, Mycobacterium avium
GECSIEPWIFMNWRRAAYYLYLAEV

SEQ ID NO: 97182 - protein, 20 aa, Mycobacterium avium
GECVVCGRTRAGGKYRGGSL

SEQ ID NO: 97183 - protein, 18 aa, Mycobacterium avium
GEEHWCQGFSEPGSGSDL

SEQ ID NO: 97184 - protein, 21 aa, Mycobacterium avium
GEETEAMFARACRAGGSRFHA

SEQ ID NO: 97185 - protein, 18 aa, Mycobacterium avium
GEEYLLYERGGEWVLATG

SEQ ID NO: 97186 - protein, 23 aa, Mycobacterium avium
GEGRLPQNRLMGVDNTFGFPGRS

SEQ ID NO: 97187 - protein, 21 aa, Mycobacterium avium
GEGRMLKRLKRVADYVNTLSD

SEQ ID NO: 97188 - protein, 26 aa, Mycobacterium avium
GEHLQLLKGWHPVASVSNGQKRWDAN

SEQ ID NO: 97189 - protein, 22 aa, Mycobacterium avium
GEIERARAAVELAVAAAAEHGF

SEQ ID NO: 97190 - protein, 20 aa, Mycobacterium avium
GEIGLPRIGIEAVAANWDAH

SEQ ID NO: 97191 - protein, 19 aa, Mycobacterium avium
GEINGVLYIDMRLVQGQTL

SEQ ID NO: 97192 - protein, 21 aa, Mycobacterium avium
GEIPGSGAWVAGQLFGHAEGG

SEQ ID NO: 97193 - protein, 22 aa, Mycobacterium avium
GEITATPIIRWLQDVESAGGQV

SEQ ID NO: 97194 - protein, 17 aa, Mycobacterium avium
GEKVCLYAELAGPATDP

SEQ ID NO: 97195 - protein, 17 aa, Mycobacterium avium
GELAWMFLQSTTEGGDL

SEQ ID NO: 97196 - protein, 20 aa, Mycobacterium avium
GELDKRWTIGPKVHGGAMLA

SEQ ID NO: 97197 - protein, 22 aa, Mycobacterium avium
GELEIYAGPVLAIGENVEPLRE

SEQ ID NO: 97198 - protein, 19 aa, Mycobacterium avium
GELIVAVAMTEPGAGSDLA

SEQ ID NO: 97199 - protein, 24 aa, Mycobacterium avium
GELLGPKAHKVWKPVIAALHGIVA

SEQ ID NO: 97200 - protein, 22 aa, Mycobacterium avium
GELLPRTPLRFLLADDPGAGKT

SEQ ID NO: 97201 - protein, 18 aa, Mycobacterium avium
GELMTRYSVAQVTAVPSL

SEQ ID NO: 97202 - protein, 20 aa, Mycobacterium avium
GELPPRLTPRRPLGDVLQFR

SEQ ID NO: 97203 - protein, 24 aa, Mycobacterium avium
GELPRRPTPRRPLGDVLQFRPLSD

SEQ ID NO: 97204 - protein, 24 aa, Mycobacterium avium
GELRAIDALGLRFPSPEMVTAAAA

SEQ ID NO: 97205 - protein, 17 aa, Mycobacterium avium
GELRLGVIPAASSIVAL

SEQ ID NO: 97206 - protein, 31 aa, Mycobacterium avium
GELRYPDLADWGVPTARAIVEVRRLLPEIPL

SEQ ID NO: 97207 - protein, 24 aa, Mycobacterium avium
GELTQLAGVFGFAECVDLLADYTA

SEQ ID NO: 97208 - protein, 21 aa, Mycobacterium avium
GELVCAVVRRSPRHRDVTLDE

SEQ ID NO: 97209 - protein, 17 aa, Mycobacterium avium
GENVLLIALHYRVGGSV

SEQ ID NO: 97210 - protein, 22 aa, Mycobacterium avium
GEPFWFPNWTRLVYAGDGLFSS

SEQ ID NO: 97211 - protein, 17 aa, Mycobacterium avium
GEPGWEPMGDQGLMYSG

SEQ ID NO: 97212 - protein, 24 aa, Mycobacterium avium
GEPQCVATGLGVPDSVKFDARGHI

SEQ ID NO: 97213 - protein, 18 aa, Mycobacterium avium
GEPQLVVRDGVAYRARLR

SEQ ID NO: 97214 - protein, 21 aa, Mycobacterium avium
GEPRDIAAITAFLLSDEAEWI

SEQ ID NO: 97215 - protein, 17 aa, Mycobacterium avium
GEPSFELQLDVAFDGAP

SEQ ID NO: 97216 - protein, 17 aa, Mycobacterium avium
GEPTQWADLPSHMHQAL

SEQ ID NO: 97217 - protein, 18 aa, Mycobacterium avium
GEPVDCEGFQRFAMAMAP

SEQ ID NO: 97218 - protein, 25 aa, Mycobacterium avium
GEQMPMRVIGMLLGLPEDRQRQITD

SEQ ID NO: 97219 - protein, 22 aa, Mycobacterium avium
GERGIAGLMLESFLVAGAQSLS

SEQ ID NO: 97220 - protein, 24 aa, Mycobacterium avium
GERLAAGIPKAFCEIDGASMLARA

SEQ ID NO: 97221 - protein, 20 aa, Mycobacterium avium
GERVMVIARNCIEWPEISFG

SEQ ID NO: 97222 - protein, 24 aa, Mycobacterium avium
GERVQAGAGLRIHRHPGEPVAAGE

SEQ ID NO: 97223 - protein, 24 aa, Mycobacterium avium
GESEWNSLNLFTGWVDVGLTDKGR

SEQ ID NO: 97224 - protein, 24 aa, Mycobacterium avium
GESRLRAVIDLKLLREDPDAVRRS

SEQ ID NO: 97225 - protein, 20 aa, Mycobacterium avium
GESTAAFWSAIFNVPAEHLG

SEQ ID NO: 97226 - protein, 19 aa, Mycobacterium avium
GESVTEGTVTRWLKQEGDT

SEQ ID NO: 97227 - protein, 25 aa, Mycobacterium avium
GETAAKLRLIFDALIDTRGVYLFDE

SEQ ID NO: 97228 - protein, 18 aa, Mycobacterium avium
GETLWAYCKGLIGPRIEL

SEQ ID NO: 97229 - protein, 17 aa, Mycobacterium avium
GETVASWAVYEPGQGWA

SEQ ID NO: 97230 - protein, 17 aa, Mycobacterium avium
GEVIGAQGFYIDVSTPH

SEQ ID NO: 97231 - protein, 21 aa, Mycobacterium avium
GEVILSGSFTKPVFAEPGDTF

SEQ ID NO: 97232 - protein, 18 aa, Mycobacterium avium
GEVLACTDSHTCAAGAYN

SEQ ID NO: 97233 - protein, 21 aa, Mycobacterium avium
GEVLVCKMVDPGWTALVSLAG

SEQ ID NO: 97234 - protein, 18 aa, Mycobacterium avium
GEVQTRLRLGQDREALES

SEQ ID NO: 97235 - protein, 18 aa, Mycobacterium avium
GEVRRYFRDYSWGMRVPR

SEQ ID NO: 97236 - protein, 28 aa, Mycobacterium avium
GEVSRGVLFPKHRTDLIGCAVTAQRMLA

SEQ ID NO: 97237 - protein, 28 aa, Mycobacterium avium
GEVSRGVLFPKHRTDLIGCAVTVQRMLA

SEQ ID NO: 97238 - protein, 29 aa, Mycobacterium avium
GEVSRGVLFPKHRTDLIGCAVTVQRMLAG

SEQ ID NO: 97239 - protein, 23 aa, Mycobacterium avium
GEVTATPIIEWLRGVNGPVDEFN

SEQ ID NO: 97240 - protein, 25 aa, Mycobacterium avium
GEVVGWSAADAREWGETKLGSVGRP

SEQ ID NO: 97241 - protein, 20 aa, Mycobacterium avium
GEVVICPPGKALELTPQGRC

SEQ ID NO: 97242 - protein, 20 aa, Mycobacterium avium
GEVVICPPGKALELTPQGRW

SEQ ID NO: 97243 - protein, 24 aa, Mycobacterium avium
GFAAGELIGALAMTEPGAGSDLRG

SEQ ID NO: 97244 - protein, 22 aa, Mycobacterium avium
GFAAVAQRWGRLNSLVHTIGPG

SEQ ID NO: 97245 - protein, 26 aa, Mycobacterium avium
GFADFLRINGFAIIRAFLEIPYKQAL

SEQ ID NO: 97246 - protein, 22 aa, Mycobacterium avium
GFARSASDAVIFMDHGKVVESG

SEQ ID NO: 97247 - protein, 17 aa, Mycobacterium avium
GFATLPLYDPAAAAEEL

SEQ ID NO: 97248 - protein, 17 aa, Mycobacterium avium
GFAYDLSRAGTAGDDIR

SEQ ID NO: 97249 - protein, 19 aa, Mycobacterium avium
GFDAEWRAIVVGILDGDLY

SEQ ID NO: 97250 - protein, 18 aa, Mycobacterium avium
GFDAVCFTSSSTVRNLVG

SEQ ID NO: 97251 - protein, 17 aa, Mycobacterium avium
GFDFTGYKRTSLMRRVR

SEQ ID NO: 97252 - protein, 17 aa, Mycobacterium avium
GFDGGSCYWISTSGWSV

SEQ ID NO: 97253 - protein, 19 aa, Mycobacterium avium
GFDPLALVTGGSRPASLRD

SEQ ID NO: 97254 - protein, 19 aa, Mycobacterium avium
GFEGGWALEQIIGPAPPLA

SEQ ID NO: 97255 - protein, 18 aa, Mycobacterium avium
GFELPRDVGYGFHVVAVL

SEQ ID NO: 97256 - protein, 19 aa, Mycobacterium avium
GFEPPYIVAMVELAEEPDT

SEQ ID NO: 97257 - protein, 25 aa, Mycobacterium avium
GFGEQKARIFLALLGKQYGVTPPGW

SEQ ID NO: 97258 - protein, 20 aa, Mycobacterium avium
GFHRQRVVVVLAVGELGDGQ

SEQ ID NO: 97259 - protein, 17 aa, Mycobacterium avium
GFLLEMAGTTLADVMTA

SEQ ID NO: 97260 - protein, 25 aa, Mycobacterium avium
GFPDYRPELPGGRPSGGRSLSAVPF

SEQ ID NO: 97261 - protein, 23 aa, Mycobacterium avium
GFPGMPDLLLVPAVLDLPDAPGA

SEQ ID NO: 97262 - protein, 23 aa, Mycobacterium avium
GFPNAPMRAVHLWAAPERVTEAA

SEQ ID NO: 97263 - protein, 18 aa, Mycobacterium avium
GFQHQPPLAVCLGGVGLH

SEQ ID NO: 97264 - protein, 19 aa, Mycobacterium avium
GFRKGWYPFNKTLGKAGES

SEQ ID NO: 97265 - protein, 22 aa, Mycobacterium avium
GFRWWTRCRALELGLTGYAANQ

SEQ ID NO: 97266 - protein, 21 aa, Mycobacterium avium
GFSEGGAMLVVERLSDARRLG

SEQ ID NO: 97267 - protein, 20 aa, Mycobacterium avium
GFSGMCHKVSEGDYYEDPFW

SEQ ID NO: 97268 - protein, 23 aa, Mycobacterium avium
GFSHFTLLLVHALRQQFSRVRVF

SEQ ID NO: 97269 - protein, 17 aa, Mycobacterium avium
GFSTVWLTEHHFLEEYC

SEQ ID NO: 97270 - protein, 24 aa, Mycobacterium avium
GFTHVWASDHIQPWQDNEGHSMFP

SEQ ID NO: 97271 - protein, 25 aa, Mycobacterium avium
GFTVPEFRRKAVIIAVGGVYDPRIH

SEQ ID NO: 97272 - protein, 25 aa, Mycobacterium avium
GFVDMPIEIDGLYLAGAGCHGGPGI

SEQ ID NO: 97273 - protein, 18 aa, Mycobacterium avium
GFVPAPCRVVYVVDEPDI

SEQ ID NO: 97274 - protein, 19 aa, Mycobacterium avium
GFVPAPCRVVYVVDEPDIR

SEQ ID NO: 97275 - protein, 19 aa, Mycobacterium avium
GFVPFPADRAAAYRAAGYW

SEQ ID NO: 97276 - protein, 32 aa, Mycobacterium avium
GFVVLNWRAVCGQCRACKRGRPHLCFDTFNAT

SEQ ID NO: 97277 - protein, 17 aa, Mycobacterium avium
GFYAKWLPQLVFGEGQR

SEQ ID NO: 97278 - protein, 18 aa, Mycobacterium avium
GGAAAAVLVCLPGGTYSR

SEQ ID NO: 97279 - protein, 19 aa, Mycobacterium avium
GGAEVQWWFDLPWSAGFVR

SEQ ID NO: 97280 - protein, 18 aa, Mycobacterium avium
GGAFLMGSNSFYPEESPV

SEQ ID NO: 97281 - protein, 20 aa, Mycobacterium avium
GGAIPLLFDEVLGRLASSGD

SEQ ID NO: 97282 - protein, 23 aa, Mycobacterium avium
GGAKPGWPGFVSTPLHAYRRHFD

SEQ ID NO: 97283 - protein, 19 aa, Mycobacterium avium
GGALLPRLVTPREAARLRE

SEQ ID NO: 97284 - protein, 17 aa, Mycobacterium avium
GGAMFCGAHCARQAGNH

SEQ ID NO: 97285 - protein, 20 aa, Mycobacterium avium
GGARVPRLLVQEVAVGALLV

SEQ ID NO: 97286 - protein, 21 aa, Mycobacterium avium
GGATFRPSALQTLSHFPIAVA

SEQ ID NO: 97287 - protein, 17 aa, Mycobacterium avium
GGATLRLGTHPYAQELA

SEQ ID NO: 97288 - protein, 17 aa, Mycobacterium avium
GGAVPEFAQLGQRPAGQ

SEQ ID NO: 97289 - protein, 20 aa, Mycobacterium avium
GGAWYPTPQFAKLGLGNLGS

SEQ ID NO: 97290 - protein, 18 aa, Mycobacterium avium
GGCATWMGGETVGRRGRC

SEQ ID NO: 97291 - protein, 21 aa, Mycobacterium avium
GGDATRLLYTLGWHEVPPQPS

SEQ ID NO: 97292 - protein, 23 aa, Mycobacterium avium
GGDCGRCRRTLRAILAASAKLET

SEQ ID NO: 97293 - protein, 20 aa, Mycobacterium avium
GGDGEAIWPGILGFDDTVLP

SEQ ID NO: 97294 - protein, 18 aa, Mycobacterium avium
GGDHGAQQRRFRGATLRR

SEQ ID NO: 97295 - protein, 18 aa, Mycobacterium avium
GGDIAALLQLLAPDVLRT

SEQ ID NO: 97296 - protein, 20 aa, Mycobacterium avium
GGDIRSALRGDLHVHSNWSD

SEQ ID NO: 97297 - protein, 20 aa, Mycobacterium avium
GGDLPRPAIRCEAVGTQVAE

SEQ ID NO: 97298 - protein, 18 aa, Mycobacterium avium
GGEELRWQLVDEDACLRP

SEQ ID NO: 97299 - protein, 21 aa, Mycobacterium avium
GGEEPRWIYYSSGTTAAPKGA

SEQ ID NO: 97300 - protein, 19 aa, Mycobacterium avium
GGEGRLRLTDPSNMLTTGI

SEQ ID NO: 97301 - protein, 19 aa, Mycobacterium avium
GGEPVDCAGFERFTTAMAP

SEQ ID NO: 97302 - protein, 23 aa, Mycobacterium avium
GGEQVFLCPLELASFTMATAEDR

SEQ ID NO: 97303 - protein, 22 aa, Mycobacterium avium
GGERRAAICRELTKVHEEVVRG

SEQ ID NO: 97304 - protein, 21 aa, Mycobacterium avium
GGFDHDLAWRKELLPEVEQDW

SEQ ID NO: 97305 - protein, 19 aa, Mycobacterium avium
GGFDVTRPTAWSAEGLLPY

SEQ ID NO: 97306 - protein, 20 aa, Mycobacterium avium
GGFGDKGYWAITKHKDVKEI

SEQ ID NO: 97307 - protein, 21 aa, Mycobacterium avium
GGFVPRLGDGRALLLGELVDN

SEQ ID NO: 97308 - protein, 19 aa, Mycobacterium avium
GGGDRCWGRGRGLHDRPLI

SEQ ID NO: 97309 - protein, 18 aa, Mycobacterium avium
GGGIPWRKSDQFFNAPAN

SEQ ID NO: 97310 - protein, 18 aa, Mycobacterium avium
GGGLADWLAAAAARGEAR

SEQ ID NO: 97311 - protein, 17 aa, Mycobacterium avium
GGGPGYFAAAFTDAGVR

SEQ ID NO: 97312 - protein, 17 aa, Mycobacterium avium
GGIAERIVGPLARAALE

SEQ ID NO: 97313 - protein, 25 aa, Mycobacterium avium
GGIDKRRRAELIERFDLDPHKKART

SEQ ID NO: 97314 - protein, 17 aa, Mycobacterium avium
GGIGFTWEHPAHLLLRR

SEQ ID NO: 97315 - protein, 18 aa, Mycobacterium avium
GGIGVGCQRGRHGDASDD

SEQ ID NO: 97316 - protein, 18 aa, Mycobacterium avium
GGIGWIPFYLDRSDRHYT

SEQ ID NO: 97317 - protein, 18 aa, Mycobacterium avium
GGIGWVPYILERSDYVWE

SEQ ID NO: 97318 - protein, 18 aa, Mycobacterium avium
GGIGWVPYILERTDYVWE

SEQ ID NO: 97319 - protein, 21 aa, Mycobacterium avium
GGIQLRMGEIVGRRIAQVEHR

SEQ ID NO: 97320 - protein, 25 aa, Mycobacterium avium
GGIRVPGFITWPGFARQGQIGTAFS

SEQ ID NO: 97321 - protein, 26 aa, Mycobacterium avium
GGISRKADKWLPLLENRIPVVAAALL

SEQ ID NO: 97322 - protein, 33 aa, Mycobacterium avium
GGITGELLERCWAPKVVGAWNLHRVTAGEPLDW

SEQ ID NO: 97323 - protein, 23 aa, Mycobacterium avium
GGKLPGWRDYEGVLGAAGDAPPV

SEQ ID NO: 97324 - protein, 17 aa, Mycobacterium avium
GGLADWLAAAAARGEAR

SEQ ID NO: 97325 - protein, 19 aa, Mycobacterium avium
GGLAPFPGVTDGILCVENP

SEQ ID NO: 97326 - protein, 24 aa, Mycobacterium avium
GGLGFSMKWNMGWMHDTLDYISRD

SEQ ID NO: 97327 - protein, 19 aa, Mycobacterium avium
GGLGGIGLFLAEKLAAAGC

SEQ ID NO: 97328 - protein, 18 aa, Mycobacterium avium
GGLGGMFGLSSNGANIGN

SEQ ID NO: 97329 - protein, 17 aa, Mycobacterium avium
GGLGIAVTKSWGMIDNR

SEQ ID NO: 97330 - protein, 22 aa, Mycobacterium avium
GGLKVTTANAWFAARPSGTEDV

SEQ ID NO: 97331 - protein, 23 aa, Mycobacterium avium
GGLKVTTANAWFAARPSGTEDVY

SEQ ID NO: 97332 - protein, 26 aa, Mycobacterium avium
GGLLAPPALLMGWLIAPPWQPDGRPS

SEQ ID NO: 97333 - protein, 24 aa, Mycobacterium avium
GGLLRAKFSHPLRFDVPITGRHST

SEQ ID NO: 97334 - protein, 20 aa, Mycobacterium avium
GGLRAGQFVRASGVEVGKVA

SEQ ID NO: 97335 - protein, 25 aa, Mycobacterium avium
GGLRRRVRLASVLRRCTVLDAHLRG

SEQ ID NO: 97336 - protein, 27 aa, Mycobacterium avium
GGLSGLSTDVKFHWNGNAVELIGNTPA

SEQ ID NO: 97337 - protein, 25 aa, Mycobacterium avium
GGLSPLAPLRGGYVSAVAPDAGGVA

SEQ ID NO: 97338 - protein, 25 aa, Mycobacterium avium
GGLSPLAPLRGGYVSAVTPDAGGVA

SEQ ID NO: 97339 - protein, 28 aa, Mycobacterium avium
GGLTAIRLGAVAPDLVKELVLIDVTPSA

SEQ ID NO: 97340 - protein, 18 aa, Mycobacterium avium
GGLTASRFVACPFGGVGV

SEQ ID NO: 97341 - protein, 18 aa, Mycobacterium avium
GGLVARLQVDQVLHRAEV

SEQ ID NO: 97342 - protein, 18 aa, Mycobacterium avium
GGNRPRWLGADIGQRQFY

SEQ ID NO: 97343 - protein, 19 aa, Mycobacterium avium
GGPATSWRQVLARLTGGDD

SEQ ID NO: 97344 - protein, 25 aa, Mycobacterium avium
GGPELRAAFTDRIVPALQAFSPELI

SEQ ID NO: 97345 - protein, 19 aa, Mycobacterium avium
GGPEPAPAVIYCHAGGFAL

SEQ ID NO: 97346 - protein, 18 aa, Mycobacterium avium
GGPLARVEGRVSIERILD

SEQ ID NO: 97347 - protein, 18 aa, Mycobacterium avium
GGPMARRIVEGGYPTTLW

SEQ ID NO: 97348 - protein, 17 aa, Mycobacterium avium
GGPQRRTLFLLSSTDAY

SEQ ID NO: 97349 - protein, 25 aa, Mycobacterium avium
GGQAISLRVCIVIRVGAHGMTSAST

SEQ ID NO: 97350 - protein, 20 aa, Mycobacterium avium
GGQATIPIVFAVSRVVEVPY

SEQ ID NO: 97351 - protein, 17 aa, Mycobacterium avium
GGQLAHIEAAVLGAALQ

SEQ ID NO: 97352 - protein, 24 aa, Mycobacterium avium
GGRAGCALEAIEFHNPALKADPNS

SEQ ID NO: 97353 - protein, 33 aa, Mycobacterium avium
GGRAQVTVGVGWLKDEFDIIGVPFNKRGRITDE

SEQ ID NO: 97354 - protein, 18 aa, Mycobacterium avium
GGRDLWWHDVVDAAAPEH

SEQ ID NO: 97355 - protein, 26 aa, Mycobacterium avium
GGRLALGVGPSHHWIIRDMLGLPYQK

SEQ ID NO: 97356 - protein, 18 aa, Mycobacterium avium
GGRLGEWLAGTFAAAAAA

SEQ ID NO: 97357 - protein, 25 aa, Mycobacterium avium
GGRMDWARAFASWSPHELSGLATAV

SEQ ID NO: 97358 - protein, 22 aa, Mycobacterium avium
GGRRLEVCFEHGYPAAQIFAPP

SEQ ID NO: 97359 - protein, 23 aa, Mycobacterium avium
GGRTEYLERFTVALDAAIGAGFI

SEQ ID NO: 97360 - protein, 31 aa, Mycobacterium avium
GGRVFRPLDVDLRWVAALLLRNGTIEESGVA

SEQ ID NO: 97361 - protein, 18 aa, Mycobacterium avium
GGSGSAFGVWINNVPTQD

SEQ ID NO: 97362 - protein, 19 aa, Mycobacterium avium
GGSKDTWVLASRASSGDHE

SEQ ID NO: 97363 - protein, 32 aa, Mycobacterium avium
GGSKVARPLVRRALDLLPQVGFVNAYGLTETS

SEQ ID NO: 97364 - protein, 22 aa, Mycobacterium avium
GGSLHCVTCWPHHPRHCDSCEK

SEQ ID NO: 97365 - protein, 25 aa, Mycobacterium avium
GGSLYGIPMPPGLISHAPQGVHHGA

SEQ ID NO: 97366 - protein, 23 aa, Mycobacterium avium
GGSRCGCTRCCRRWRPPVPACRC

SEQ ID NO: 97367 - protein, 22 aa, Mycobacterium avium
GGSRPPAAIPLASPGVVDADPS

SEQ ID NO: 97368 - protein, 20 aa, Mycobacterium avium
GGSTGGYWAAKIAHTHRNSL

SEQ ID NO: 97369 - protein, 18 aa, Mycobacterium avium
GGTAEFLQAITIRVPADA

SEQ ID NO: 97370 - protein, 22 aa, Mycobacterium avium
GGTEITWRWDIHPRSPLTAWAL

SEQ ID NO: 97371 - protein, 22 aa, Mycobacterium avium
GGTFRLIDKVFTRWNVEYTPVP

SEQ ID NO: 97372 - protein, 18 aa, Mycobacterium avium
GGTGWIPYFVDRLDRTYE

SEQ ID NO: 97373 - protein, 25 aa, Mycobacterium avium
GGTNLRAAWLTMIAVASTHQGKGLW

SEQ ID NO: 97374 - protein, 17 aa, Mycobacterium avium
GGTRQARVQLGVSGDHQ

SEQ ID NO: 97375 - protein, 23 aa, Mycobacterium avium
GGTRSSIWYKAFNYNLGTKQPLT

SEQ ID NO: 97376 - protein, 26 aa, Mycobacterium avium
GGTSFARWASLLAEHASSPAVVEQAD

SEQ ID NO: 97377 - protein, 22 aa, Mycobacterium avium
GGVAAHGFRATRVDHQHGVVRR

SEQ ID NO: 97378 - protein, 21 aa, Mycobacterium avium
GGVCPCPHYGYIFEGSIRATY

SEQ ID NO: 97379 - protein, 20 aa, Mycobacterium avium
GGVDDFRFNAVIDEEIARYG

SEQ ID NO: 97380 - protein, 19 aa, Mycobacterium avium
GGVDVCLKEPVFEPLSGAD

SEQ ID NO: 97381 - protein, 18 aa, Mycobacterium avium
GGVGEMFDTLLVYENFPM

SEQ ID NO: 97382 - protein, 18 aa, Mycobacterium avium
GGVHAWIDSASALAATLS

SEQ ID NO: 97383 - protein, 19 aa, Mycobacterium avium
GGVITWLGGDDVGRSLFPD

SEQ ID NO: 97384 - protein, 33 aa, Mycobacterium avium
GGVSGYNLETCWRDYRLGVLQAPLISALGFAFA

SEQ ID NO: 97385 - protein, 17 aa, Mycobacterium avium
GGVVLYATCSPHLAETV

SEQ ID NO: 97386 - protein, 17 aa, Mycobacterium avium
GGVVPGFQKAIAGQKVG

SEQ ID NO: 97387 - protein, 19 aa, Mycobacterium avium
GGVVTPQLVSVIKRATQYT

SEQ ID NO: 97388 - protein, 18 aa, Mycobacterium avium
GGWQDLFIRQTLQQYAHL

SEQ ID NO: 97389 - protein, 22 aa, Mycobacterium avium
GHAFDLSTEIPLRATLFRNSLD

SEQ ID NO: 97390 - protein, 17 aa, Mycobacterium avium
GHAMLPIPAQHWTLETL

SEQ ID NO: 97391 - protein, 23 aa, Mycobacterium avium
GHEPKVDWILRNSFPLRSTAELS

SEQ ID NO: 97392 - protein, 17 aa, Mycobacterium avium
GHGAGLVPQAPRQRDRR

SEQ ID NO: 97393 - protein, 24 aa, Mycobacterium avium
GHGQRWQHLAGMLPEFALAAPDLV

SEQ ID NO: 97394 - protein, 25 aa, Mycobacterium avium
GHGTTPPMPIVWGISATTQNFEDAF

SEQ ID NO: 97395 - protein, 17 aa, Mycobacterium avium
GHHAFDPFVSLSFAAGA

SEQ ID NO: 97396 - protein, 24 aa, Mycobacterium avium
GHHALDPFVALAFAAAATTDVKLL

SEQ ID NO: 97397 - protein, 17 aa, Mycobacterium avium
GHILVRSCGGGYMHSVA

SEQ ID NO: 97398 - protein, 17 aa, Mycobacterium avium
GHILWAMLGDGRWSDGR

SEQ ID NO: 97399 - protein, 20 aa, Mycobacterium avium
GHLADFVFLLARTNPDKPKH

SEQ ID NO: 97400 - protein, 21 aa, Mycobacterium avium
GHLDVAWQLGVLVRIDGAIDP

SEQ ID NO: 97401 - protein, 19 aa, Mycobacterium avium
GHLGVQFAAAMGFETIAIN

SEQ ID NO: 97402 - protein, 21 aa, Mycobacterium avium
GHLGVQFAAAMGFETIAINRG

SEQ ID NO: 97403 - protein, 24 aa, Mycobacterium avium
GHLGVQFAAAMGFETIAINRGTGK

SEQ ID NO: 97404 - protein, 26 aa, Mycobacterium avium
GHNDPRFSGDPAVGWLDNLRASEDGQ

SEQ ID NO: 97405 - protein, 20 aa, Mycobacterium avium
GHPEHGYMGIGPGSYEIRRQ

SEQ ID NO: 97406 - protein, 18 aa, Mycobacterium avium
GHPWWTLSQLSDESAVEL

SEQ ID NO: 97407 - protein, 20 aa, Mycobacterium avium
GHQFSSLPLFSVVNKPFEAN

SEQ ID NO: 97408 - protein, 18 aa, Mycobacterium avium
GHRGRAAISAFWDKAIAP

SEQ ID NO: 97409 - protein, 25 aa, Mycobacterium avium
GHRNGGVVLLMWAGILAYLDRYGYD

SEQ ID NO: 97410 - protein, 19 aa, Mycobacterium avium
GHRRDAPGAGQVEVRPQQA

SEQ ID NO: 97411 - protein, 19 aa, Mycobacterium avium
GHRRGRLGNVETSYEMFGL

SEQ ID NO: 97412 - protein, 20 aa, Mycobacterium avium
GHSDLRAAVLGLDRATDPAV

SEQ ID NO: 97413 - protein, 21 aa, Mycobacterium avium
GHSPKTVAMLMRFQHATGLIA

SEQ ID NO: 97414 - protein, 21 aa, Mycobacterium avium
GHSPKTVAMLMRFQHATGRIA

SEQ ID NO: 97415 - protein, 24 aa, Mycobacterium avium
GHSPKTVAMLMRFQHATGRIAESA

SEQ ID NO: 97416 - protein, 19 aa, Mycobacterium avium
GHTAFLIFTRRLAPGVIAP

SEQ ID NO: 97417 - protein, 17 aa, Mycobacterium avium
GHVTFFYHLLLKVVEQL

SEQ ID NO: 97418 - protein, 23 aa, Mycobacterium avium
GIACATWPLGTVCRDCYHRRRLH

SEQ ID NO: 97419 - protein, 17 aa, Mycobacterium avium
GIAFAGVAKYPARVKCA

SEQ ID NO: 97420 - protein, 18 aa, Mycobacterium avium
GIAFAGVAKYPARVKCAL

SEQ ID NO: 97421 - protein, 18 aa, Mycobacterium avium
GIALRARLVLDCTSIREL

SEQ ID NO: 97422 - protein, 20 aa, Mycobacterium avium
GIALRARLVLDCTSIRELAE

SEQ ID NO: 97423 - protein, 20 aa, Mycobacterium avium
GIALRRCPLLNAARRYPTIV

SEQ ID NO: 97424 - protein, 18 aa, Mycobacterium avium
GICFPREYGGLGLSYEYK

SEQ ID NO: 97425 - protein, 18 aa, Mycobacterium avium
GICPLGGDLPITAFADAF

SEQ ID NO: 97426 - protein, 19 aa, Mycobacterium avium
GIDEPRPIASMPKVVQHTR

SEQ ID NO: 97427 - protein, 21 aa, Mycobacterium avium
GIDEPRPIASMPKVVQHTRDS

SEQ ID NO: 97428 - protein, 23 aa, Mycobacterium avium
GIDGLPEGFSFHDLRHYLASLLI

SEQ ID NO: 97429 - protein, 20 aa, Mycobacterium avium
GIDMALRLVELLVDRQAAQA

SEQ ID NO: 97430 - protein, 22 aa, Mycobacterium avium
GIDSAPQFPPRLRVNNAGQLAT

SEQ ID NO: 97431 - protein, 27 aa, Mycobacterium avium
GIEVARRLLPGIAHVAVFDTGFFHDLP

SEQ ID NO: 97432 - protein, 17 aa, Mycobacterium avium
GIGDAWAADIVVKVAPP

SEQ ID NO: 97433 - protein, 18 aa, Mycobacterium avium
GIGPSRTRLIGGRAQEVL

SEQ ID NO: 97434 - protein, 28 aa, Mycobacterium avium
GIGPYNLRYPIWADWDFNIRCFSNPALV

SEQ ID NO: 97435 - protein, 18 aa, Mycobacterium avium
GIGVPACVGAAGRAVEAL

SEQ ID NO: 97436 - protein, 25 aa, Mycobacterium avium
GIIARVSTAWTRRACTGSEKPARNS

SEQ ID NO: 97437 - protein, 25 aa, Mycobacterium avium
GIIARVSTAWTRRTCTGSEKPAGNS

SEQ ID NO: 97438 - protein, 25 aa, Mycobacterium avium
GIIGYRALLRAQLPPGGRLGLYGFG

SEQ ID NO: 97439 - protein, 17 aa, Mycobacterium avium
GIISLTLTAARALGRYG

SEQ ID NO: 97440 - protein, 18 aa, Mycobacterium avium
GIKLCRAGARPVGADSGL

SEQ ID NO: 97441 - protein, 32 aa, Mycobacterium avium
GIKLPTQLPMMLSFLDFRKIPLNGLWAETKFG

SEQ ID NO: 97442 - protein, 33 aa, Mycobacterium avium
GIKLPTQLPMMLSFLDFRKIPLNGLWAETKFGT

SEQ ID NO: 97443 - protein, 17 aa, Mycobacterium avium
GILLDRGYPIVCGVPTQ

SEQ ID NO: 97444 - protein, 18 aa, Mycobacterium avium
GILLDRGYPIVCGVPTQT

SEQ ID NO: 97445 - protein, 20 aa, Mycobacterium avium
GIMRRLHNAVALGLIDIDEF

SEQ ID NO: 97446 - protein, 17 aa, Mycobacterium avium
GIPEQRIVELDWHQSGK

SEQ ID NO: 97447 - protein, 19 aa, Mycobacterium avium
GIQFKDLTPLFAEATAMTA

SEQ ID NO: 97448 - protein, 21 aa, Mycobacterium avium
GIRAGVPSLVLAVSVDQPLWA

SEQ ID NO: 97449 - protein, 23 aa, Mycobacterium avium
GIRANVICPGFIETPMAHNVFSI

SEQ ID NO: 97450 - protein, 19 aa, Mycobacterium avium
GISDFLWVRINDIPEVLGA

SEQ ID NO: 97451 - protein, 23 aa, Mycobacterium avium
GISDGAACALIVPAERAREYTDT

SEQ ID NO: 97452 - protein, 20 aa, Mycobacterium avium
GITARGAWEAVKRHFREMGV

SEQ ID NO: 97453 - protein, 20 aa, Mycobacterium avium
GITLREHLGLAPAPGNAPGA

SEQ ID NO: 97454 - protein, 20 aa, Mycobacterium avium
GITLREHLGLAPAPGSAPGA

SEQ ID NO: 97455 - protein, 20 aa, Mycobacterium avium
GITLREHLGLAPAQGNAPGA

SEQ ID NO: 97456 - protein, 24 aa, Mycobacterium avium
GITRARTHLALSWALARSPGGRQS

SEQ ID NO: 97457 - protein, 25 aa, Mycobacterium avium
GITRARTHLALSWALARSPGGRQSR

SEQ ID NO: 97458 - protein, 24 aa, Mycobacterium avium
GITRARTYLALSWALARSPGGRQS

SEQ ID NO: 97459 - protein, 17 aa, Mycobacterium avium
GITRGALYFYFGSKQEV

SEQ ID NO: 97460 - protein, 24 aa, Mycobacterium avium
GIVSGELIVAVAMTEPGAGSDLAG

SEQ ID NO: 97461 - protein, 17 aa, Mycobacterium avium
GIYCGTIGLASPVAGCE

SEQ ID NO: 97462 - protein, 24 aa, Mycobacterium avium
GKADQLRKAAGIARNGASDIGAAQ

SEQ ID NO: 97463 - protein, 21 aa, Mycobacterium avium
GKAKEAVGAVAGRDDLTREGQ

SEQ ID NO: 97464 - protein, 24 aa, Mycobacterium avium
GKALDARPALTAALNTVETAQAAV

SEQ ID NO: 97465 - protein, 19 aa, Mycobacterium avium
GKARAAWLSTGATLAGLSA

SEQ ID NO: 97466 - protein, 18 aa, Mycobacterium avium
GKATRWHTDVTFAANYPA

SEQ ID NO: 97467 - protein, 18 aa, Mycobacterium avium
GKDNIRCNAVAPGFTATE

SEQ ID NO: 97468 - protein, 24 aa, Mycobacterium avium
GKDPRDAHFITSRICGICGDNHCT

SEQ ID NO: 97469 - protein, 21 aa, Mycobacterium avium
GKDRLSLWMLGNRHALAIAQK

SEQ ID NO: 97470 - protein, 25 aa, Mycobacterium avium
GKDTRGVIRVHQFDKVEGFVYCTPA

SEQ ID NO: 97471 - protein, 27 aa, Mycobacterium avium
GKEWLEPTAYMMAKFGMTLCALGIAEE

SEQ ID NO: 97472 - protein, 25 aa, Mycobacterium avium
GKFAAEHPWLLGAYLTHTFGVDEVQ

SEQ ID NO: 97473 - protein, 18 aa, Mycobacterium avium
GKFVRCETIAEFLDALEK

SEQ ID NO: 97474 - protein, 19 aa, Mycobacterium avium
GKIAPARKDHWLAALKADR

SEQ ID NO: 97475 - protein, 21 aa, Mycobacterium avium
GKKEYFLKRLDAYVSSADRTK

SEQ ID NO: 97476 - protein, 21 aa, Mycobacterium avium
GKKLYPGYIERLKNDGRDDLL

SEQ ID NO: 97477 - protein, 20 aa, Mycobacterium avium
GKKMTGFSWREEVLARVDKL

SEQ ID NO: 97478 - protein, 24 aa, Mycobacterium avium
GKLAELRATGALTDTEFAEQKQRL

SEQ ID NO: 97479 - protein, 25 aa, Mycobacterium avium
GKLDRPRIPDVCAAVGVPCLNLMGY

SEQ ID NO: 97480 - protein, 18 aa, Mycobacterium avium
GKPAALLRAARASLGDAG

SEQ ID NO: 97481 - protein, 19 aa, Mycobacterium avium
GKPGVAILLTYGPDRDWLK

SEQ ID NO: 97482 - protein, 18 aa, Mycobacterium avium
GKPSFYTGRGTFSLRLSE

SEQ ID NO: 97483 - protein, 27 aa, Mycobacterium avium
GKPVAAICHGPWTLVEAGVATGRTLTS

SEQ ID NO: 97484 - protein, 17 aa, Mycobacterium avium
GKRHGYMACLPRGRVRV

SEQ ID NO: 97485 - protein, 19 aa, Mycobacterium avium
GKRMDECIEIIQGLTTGEY

SEQ ID NO: 97486 - protein, 17 aa, Mycobacterium avium
GKRSVGLALDNSEARPL

SEQ ID NO: 97487 - protein, 19 aa, Mycobacterium avium
GKRSVGLSLALKQTRPVFE

SEQ ID NO: 97488 - protein, 23 aa, Mycobacterium avium
GKSRSARPVSCISKAGPTSSTSR

SEQ ID NO: 97489 - protein, 19 aa, Mycobacterium avium
GKSSAVLHPDSGRVFRPDG

SEQ ID NO: 97490 - protein, 17 aa, Mycobacterium avium
GKTDWAAQEFDYLREAG

SEQ ID NO: 97491 - protein, 27 aa, Mycobacterium avium
GKTGIDTCLWLLGRGVEPDRLTWIMPR

SEQ ID NO: 97492 - protein, 24 aa, Mycobacterium avium
GKTHSMLALWHVAAGLPVGEFPQD

SEQ ID NO: 97493 - protein, 19 aa, Mycobacterium avium
GKTLAAFLWALDSLAGQAE

SEQ ID NO: 97494 - protein, 19 aa, Mycobacterium avium
GKTLAAFLWALDSLAGQSE

SEQ ID NO: 97495 - protein, 29 aa, Mycobacterium avium
GKVGLRLYKGLDWFDMIVALYQQAGEPTP

SEQ ID NO: 97496 - protein, 18 aa, Mycobacterium avium
GKVGPFRVEGTAHPGASG

SEQ ID NO: 97497 - protein, 17 aa, Mycobacterium avium
GKVKVELALARGKKAYD

SEQ ID NO: 97498 - protein, 26 aa, Mycobacterium avium
GLAAEWAQCGVRRPFVGALTLELPTE

SEQ ID NO: 97499 - protein, 18 aa, Mycobacterium avium
GLAAWRAAGGRLVSGPVE

SEQ ID NO: 97500 - protein, 17 aa, Mycobacterium avium
GLACDFLHCTGAPFTDA

SEQ ID NO: 97501 - protein, 23 aa, Mycobacterium avium
GLAEQWATAGHRRPFVGSLTLGL

SEQ ID NO: 97502 - protein, 22 aa, Mycobacterium avium
GLAGDLRRVSGMARRLSEAARQ

SEQ ID NO: 97503 - protein, 19 aa, Mycobacterium avium
GLAPRPPWHTARAPITAAA

SEQ ID NO: 97504 - protein, 20 aa, Mycobacterium avium
GLAPRPPWHTARAPITAAAD

SEQ ID NO: 97505 - protein, 18 aa, Mycobacterium avium
GLARKAMDLLGCDLQQRY

SEQ ID NO: 97506 - protein, 23 aa, Mycobacterium avium
GLARLRATIGIAVPHTQPPHYYR

SEQ ID NO: 97507 - protein, 18 aa, Mycobacterium avium
GLCRGVDSSMFFHPDGER

SEQ ID NO: 97508 - protein, 24 aa, Mycobacterium avium
GLCTYGMTCKAIVDALLDSDAGAV

SEQ ID NO: 97509 - protein, 28 aa, Mycobacterium avium
GLDARAYRLTWPAGTVVFEVDQPEVISF

SEQ ID NO: 97510 - protein, 18 aa, Mycobacterium avium
GLDARLSVRVLFEAPTIA

SEQ ID NO: 97511 - protein, 26 aa, Mycobacterium avium
GLDAVWPLKRGGVEGRWELNAATFEF

SEQ ID NO: 97512 - protein, 24 aa, Mycobacterium avium
GLDKPSLGLGEWVVPTLLQHGSKE

SEQ ID NO: 97513 - protein, 25 aa, Mycobacterium avium
GLDPVLRADLWDQFAALARGGTTLP

SEQ ID NO: 97514 - protein, 23 aa, Mycobacterium avium
GLDQRRPGCALGEFHEVDLADPE

SEQ ID NO: 97515 - protein, 19 aa, Mycobacterium avium
GLDRYVQQRVDGITLREEH

SEQ ID NO: 97516 - protein, 18 aa, Mycobacterium avium
GLDWVLDLERIRDGADTT

SEQ ID NO: 97517 - protein, 19 aa, Mycobacterium avium
GLDWVLDLERIRDGADTTL

SEQ ID NO: 97518 - protein, 23 aa, Mycobacterium avium
GLEGAVRLGYRKELAAVTDPAER

SEQ ID NO: 97519 - protein, 20 aa, Mycobacterium avium
GLEIALACHHRIAADIKGLV

SEQ ID NO: 97520 - protein, 24 aa, Mycobacterium avium
GLEKPSLGLGNWVVPTLLQHGSAE

SEQ ID NO: 97521 - protein, 20 aa, Mycobacterium avium
GLERGMKTFLVRPAPVPSRF

SEQ ID NO: 97522 - protein, 19 aa, Mycobacterium avium
GLESTALVVAGEACPAELV

SEQ ID NO: 97523 - protein, 19 aa, Mycobacterium avium
GLESVSLVVVGEACPAEVV

SEQ ID NO: 97524 - protein, 19 aa, Mycobacterium avium
GLETMCIGGGQGLAAAFER

SEQ ID NO: 97525 - protein, 18 aa, Mycobacterium avium
GLETMCVGGGQGMAMVIE

SEQ ID NO: 97526 - protein, 20 aa, Mycobacterium avium
GLEVPGNIYTRIGNPTTDVV

SEQ ID NO: 97527 - protein, 29 aa, Mycobacterium avium
GLFDPRLKRPIPFLPNMIGLITGRASAAE

SEQ ID NO: 97528 - protein, 18 aa, Mycobacterium avium
GLFLSLPGVSQWRTLRRV

SEQ ID NO: 97529 - protein, 21 aa, Mycobacterium avium
GLGGLECLSGIPGSAGATPIQ

SEQ ID NO: 97530 - protein, 21 aa, Mycobacterium avium
GLGNLPPVAGVGHGVAAGVGQ

SEQ ID NO: 97531 - protein, 20 aa, Mycobacterium avium
GLGPVTCAVIAGRIGDPHRF

SEQ ID NO: 97532 - protein, 19 aa, Mycobacterium avium
GLGQLPVTFAPGKSRKTLR

SEQ ID NO: 97533 - protein, 18 aa, Mycobacterium avium
GLGSPCWATASTPEHRGT

SEQ ID NO: 97534 - protein, 17 aa, Mycobacterium avium
GLGSSRPVAALFVELGV

SEQ ID NO: 97535 - protein, 24 aa, Mycobacterium avium
GLHALWLQIVEKFVSAGAEEIERQ

SEQ ID NO: 97536 - protein, 17 aa, Mycobacterium avium
GLHARRVDLPTYAFARR

SEQ ID NO: 97537 - protein, 18 aa, Mycobacterium avium
GLHGLHVHEIGKCEPNSV

SEQ ID NO: 97538 - protein, 22 aa, Mycobacterium avium
GLHRPDPLVGRAQLAVGGGHGD

SEQ ID NO: 97539 - protein, 19 aa, Mycobacterium avium
GLHVDEAFGGQGYGLPELT

SEQ ID NO: 97540 - protein, 17 aa, Mycobacterium avium
GLIAVPVNIRLAPDEVA

SEQ ID NO: 97541 - protein, 17 aa, Mycobacterium avium
GLIGPFIEEALRMQSPT

SEQ ID NO: 97542 - protein, 18 aa, Mycobacterium avium
GLIHSVAVNPLFLVLSGG

SEQ ID NO: 97543 - protein, 17 aa, Mycobacterium avium
GLIYRALGFPTRMFTVL

SEQ ID NO: 97544 - protein, 25 aa, Mycobacterium avium
GLLDDRVRFVPGWFKDTLQDAPIER

SEQ ID NO: 97545 - protein, 23 aa, Mycobacterium avium
GLLDRLDHMLSYHAMYGTWQALG

SEQ ID NO: 97546 - protein, 25 aa, Mycobacterium avium
GLLEPARAAFDWSRRTQRPDGSWPI

SEQ ID NO: 97547 - protein, 18 aa, Mycobacterium avium
GLLFGRGDLVERLRRHPA

SEQ ID NO: 97548 - protein, 18 aa, Mycobacterium avium
GLLGKFMPNYLFAPSGEL

SEQ ID NO: 97549 - protein, 17 aa, Mycobacterium avium
GLLPRLEGTVHINVGLL

SEQ ID NO: 97550 - protein, 23 aa, Mycobacterium avium
GLLPVAEIMIMDFIGIAADQLIN

SEQ ID NO: 97551 - protein, 19 aa, Mycobacterium avium
GLLPVDCRFCHARVAVRRL

SEQ ID NO: 97552 - protein, 20 aa, Mycobacterium avium
GLLPVDCRFCHARVAVRRLG

SEQ ID NO: 97553 - protein, 17 aa, Mycobacterium avium
GLLRFTIGLAQTTTLLL

SEQ ID NO: 97554 - protein, 32 aa, Mycobacterium avium
GLLRGMPVGALGRRGAAAGYVNKYGFRYSVLT

SEQ ID NO: 97555 - protein, 24 aa, Mycobacterium avium
GLLTLEGTNTWVLRGRGSDELVIV

SEQ ID NO: 97556 - protein, 17 aa, Mycobacterium avium
GLMKQKWPERLVLVDEF

SEQ ID NO: 97557 - protein, 26 aa, Mycobacterium avium
GLNLPGVAFGHDWLTGAARYANLLEH

SEQ ID NO: 97558 - protein, 25 aa, Mycobacterium avium
GLNLPGVAFGHDWLTGTARYANLLE

SEQ ID NO: 97559 - protein, 26 aa, Mycobacterium avium
GLNRRRAKARADELLEQFNLVDAADR

SEQ ID NO: 97560 - protein, 20 aa, Mycobacterium avium
GLPCACGQPDCPARTGDQHA

SEQ ID NO: 97561 - protein, 26 aa, Mycobacterium avium
GLPGREGFPDVALRSAGLTELPATEF

SEQ ID NO: 97562 - protein, 19 aa, Mycobacterium avium
GLPGRPTPVFSPGHTNGHC

SEQ ID NO: 97563 - protein, 27 aa, Mycobacterium avium
GLPRTAFKPSYGIAEATLFVATIAPQA

SEQ ID NO: 97564 - protein, 17 aa, Mycobacterium avium
GLPRYKAPFEPVTPGGF

SEQ ID NO: 97565 - protein, 20 aa, Mycobacterium avium
GLPYPDCPHFTVFDYDSCMI

SEQ ID NO: 97566 - protein, 22 aa, Mycobacterium avium
GLQFCSEVSWQQALVDAGVPLW

SEQ ID NO: 97567 - protein, 18 aa, Mycobacterium avium
GLQGPWRDYVGWALNIEQ

SEQ ID NO: 97568 - protein, 21 aa, Mycobacterium avium
GLQLQIPVSRLVVYVRDPDPG

SEQ ID NO: 97569 - protein, 23 aa, Mycobacterium avium
GLQYPIVYLPFAFHRNTTDSDVV

SEQ ID NO: 97570 - protein, 17 aa, Mycobacterium avium
GLRAARRAVPVSFAGRS

SEQ ID NO: 97571 - protein, 20 aa, Mycobacterium avium
GLRAAVAGRPWRRWVTGRAA

SEQ ID NO: 97572 - protein, 25 aa, Mycobacterium avium
GLRAAVAGRPWRRWVTGRAAQLGST

SEQ ID NO: 97573 - protein, 20 aa, Mycobacterium avium
GLRCQRRCREAQRAAILVGG

SEQ ID NO: 97574 - protein, 22 aa, Mycobacterium avium
GLRGAPMVHPYVASKWGVRGLA

SEQ ID NO: 97575 - protein, 27 aa, Mycobacterium avium
GLRMPGALCSSTLWAADVLATAPALGE

SEQ ID NO: 97576 - protein, 26 aa, Mycobacterium avium
GLRQGECFGLTVDRVRFLERVLTVDR

SEQ ID NO: 97577 - protein, 22 aa, Mycobacterium avium
GLRQRFDEVIGRLAEGLATTVQ

SEQ ID NO: 97578 - protein, 34 aa, Mycobacterium avium
GLRRCVSSLRARYGDSPAMRRIVIDADRILSDVD

SEQ ID NO: 97579 - protein, 20 aa, Mycobacterium avium
GLRREIERFPFVPADRERLQ

SEQ ID NO: 97580 - protein, 27 aa, Mycobacterium avium
GLRTLPMPAELTVAMKQARKQQRERRL

SEQ ID NO: 97581 - protein, 24 aa, Mycobacterium avium
GLRTRLFAAPGWVVSPGVVKALPG

SEQ ID NO: 97582 - protein, 21 aa, Mycobacterium avium
GLSALPDDYAGVLVVTSGDTP

SEQ ID NO: 97583 - protein, 32 aa, Mycobacterium avium
GLSDLKFRLVRESFADAVSWVAKSLPSRPAVP

SEQ ID NO: 97584 - protein, 28 aa, Mycobacterium avium
GLSNYVHNWLRLGFTEADVRPPGSDRLI

SEQ ID NO: 97585 - protein, 23 aa, Mycobacterium avium
GLSRKRFAALFRCEVGLSPKAYL

SEQ ID NO: 97586 - protein, 19 aa, Mycobacterium avium
GLSVPLKWGVAVPPDDYDH

SEQ ID NO: 97587 - protein, 27 aa, Mycobacterium avium
GLSYAKLRGGSGIQWPCNTDHPDGTER

SEQ ID NO: 97588 - protein, 35 aa, Mycobacterium avium
GLTDESWSGPASMSMVAAVMPYIAWMTATAEQCQQ

SEQ ID NO: 97589 - protein, 17 aa, Mycobacterium avium
GLTHYRRLASPEPWIER

SEQ ID NO: 97590 - protein, 20 aa, Mycobacterium avium
GLTNESWLGPASLSMAGAVM

SEQ ID NO: 97591 - protein, 23 aa, Mycobacterium avium
GLTRERVLALGLRLLDRGYFRSG

SEQ ID NO: 97592 - protein, 18 aa, Mycobacterium avium
GLTSEPWQGPSAAAVTAA

SEQ ID NO: 97593 - protein, 20 aa, Mycobacterium avium
GLTTGRWLGPSSLAMASAFA

SEQ ID NO: 97594 - protein, 20 aa, Mycobacterium avium
GLVAEEFNSLFFRNAVNSGL

SEQ ID NO: 97595 - protein, 26 aa, Mycobacterium avium
GLVAHLRLAGAFVFVMVGTVAQARAA

SEQ ID NO: 97596 - protein, 19 aa, Mycobacterium avium
GLVALPWHAAYSASKYGLR

SEQ ID NO: 97597 - protein, 20 aa, Mycobacterium avium
GLVALPWHAAYSASKYGLRG

SEQ ID NO: 97598 - protein, 17 aa, Mycobacterium avium
GLVGRGGAAFPLGVKLR

SEQ ID NO: 97599 - protein, 17 aa, Mycobacterium avium
GLVPLGYIAGHTSKLKL

SEQ ID NO: 97600 - protein, 18 aa, Mycobacterium avium
GLVPQISLIFGKCAGGAV

SEQ ID NO: 97601 - protein, 17 aa, Mycobacterium avium
GLVSRFLGPWVPEPQLW

SEQ ID NO: 97602 - protein, 19 aa, Mycobacterium avium
GLWLALMSPAALARVESIA

SEQ ID NO: 97603 - protein, 30 aa, Mycobacterium avium
GLYSSNPWLYPFGSLYLFGVIDPPVGAQTI

SEQ ID NO: 97604 - protein, 22 aa, Mycobacterium avium
GMAPSQMASFGFVDDAPGPIIG

SEQ ID NO: 97605 - protein, 18 aa, Mycobacterium avium
GMARAFAAELGRYNIRVN

SEQ ID NO: 97606 - protein, 18 aa, Mycobacterium avium
GMDARAYRLAWPDGTVVY

SEQ ID NO: 97607 - protein, 20 aa, Mycobacterium avium
GMGAIKPRPVAVGTEVVVRP

SEQ ID NO: 97608 - protein, 24 aa, Mycobacterium avium
GMGGSIPFIAEFAAAFPEAKILVT

SEQ ID NO: 97609 - protein, 25 aa, Mycobacterium avium
GMGGSIPFIAEFAAAFPEAKILVTG

SEQ ID NO: 97610 - protein, 26 aa, Mycobacterium avium
GMGITHLTSLIARRSVYCSKWANGKH

SEQ ID NO: 97611 - protein, 23 aa, Mycobacterium avium
GMIANRISYLLGLRGASMTVDSG

SEQ ID NO: 97612 - protein, 17 aa, Mycobacterium avium
GMIAQIFAARFRQRTKT

SEQ ID NO: 97613 - protein, 18 aa, Mycobacterium avium
GMITGFVPLVLKASPGSS

SEQ ID NO: 97614 - protein, 17 aa, Mycobacterium avium
GMLGLACDATFDEVSAP

SEQ ID NO: 97615 - protein, 24 aa, Mycobacterium avium
GMLRCGRCGNRLFSQARHNNPTNR

SEQ ID NO: 97616 - protein, 17 aa, Mycobacterium avium
GMLRELADRTGLSAQVS

SEQ ID NO: 97617 - protein, 20 aa, Mycobacterium avium
GMLSAGWGRIVNVTSMTTLG

SEQ ID NO: 97618 - protein, 24 aa, Mycobacterium avium
GMMHVLAIEGARNGIAVNAIAPIA

SEQ ID NO: 97619 - protein, 21 aa, Mycobacterium avium
GMNDVKTWISFGASPRASLGI

SEQ ID NO: 97620 - protein, 20 aa, Mycobacterium avium
GMPAKPAAVAAVFPSVTSPP

SEQ ID NO: 97621 - protein, 21 aa, Mycobacterium avium
GMPAKPAAVAAVFPSVTSPPA

SEQ ID NO: 97622 - protein, 23 aa, Mycobacterium avium
GMPPCTGTGMGIDRLLMTLTGLS

SEQ ID NO: 97623 - protein, 17 aa, Mycobacterium avium
GMRAKLFEAARLAAGAI

SEQ ID NO: 97624 - protein, 19 aa, Mycobacterium avium
GMRLHSWNRIVIATGSPPA

SEQ ID NO: 97625 - protein, 18 aa, Mycobacterium avium
GMRSHPGVTATFCEALAQ

SEQ ID NO: 97626 - protein, 17 aa, Mycobacterium avium
GMRVDAGLARLLGLSRS

SEQ ID NO: 97627 - protein, 25 aa, Mycobacterium avium
GMSDSCQWFKSQFDPLMGQINDFNT

SEQ ID NO: 97628 - protein, 21 aa, Mycobacterium avium
GMSKRPLLVLAPGDRVTHDKY

SEQ ID NO: 97629 - protein, 17 aa, Mycobacterium avium
GMSLGIMHDLAVGVHPN

SEQ ID NO: 97630 - protein, 21 aa, Mycobacterium avium
GMSRLSGWLTPEARASWEAVL

SEQ ID NO: 97631 - protein, 17 aa, Mycobacterium avium
GMTVTLAERERVFSFAR

SEQ ID NO: 97632 - protein, 28 aa, Mycobacterium avium
GMYLSSELRRGWLYSFEINPSWADIAER

SEQ ID NO: 97633 - protein, 24 aa, Mycobacterium avium
GMYRRVDLASALVVPPKVLFLDEP

SEQ ID NO: 97634 - protein, 25 aa, Mycobacterium avium
GNALARLEGRIALEEILKRFPAWEV

SEQ ID NO: 97635 - protein, 28 aa, Mycobacterium avium
GNAQEFYFPVCFELAVTKGAPAPHDNET

SEQ ID NO: 97636 - protein, 28 aa, Mycobacterium avium
GNAQELYFPVCFELAVTKGAPAPHDNET

SEQ ID NO: 97637 - protein, 25 aa, Mycobacterium avium
GNFFNGNAQAVAWLQQNLSGLLNPS

SEQ ID NO: 97638 - protein, 32 aa, Mycobacterium avium
GNFPGEPWAVPKFYWSVFATRPFEAAVQALTP

SEQ ID NO: 97639 - protein, 18 aa, Mycobacterium avium
GNGARAEWAMGWSPDPTR

SEQ ID NO: 97640 - protein, 23 aa, Mycobacterium avium
GNGDCVAFFWFADAPDRLPGISS

SEQ ID NO: 97641 - protein, 17 aa, Mycobacterium avium
GNGRAWFSITSASSMTS

SEQ ID NO: 97642 - protein, 17 aa, Mycobacterium avium
GNGRWATERGMSRTDGH

SEQ ID NO: 97643 - protein, 17 aa, Mycobacterium avium
GNHSKRVFCEKVDVVCG

SEQ ID NO: 97644 - protein, 18 aa, Mycobacterium avium
GNHSKRVFCEKVDVVCGI

SEQ ID NO: 97645 - protein, 26 aa, Mycobacterium avium
GNKRLAWTACRTFLAINAHWIEAPED

SEQ ID NO: 97646 - protein, 17 aa, Mycobacterium avium
GNLPRLNSAMVRLMGSD

SEQ ID NO: 97647 - protein, 18 aa, Mycobacterium avium
GNMLPGLRCHSDAGSQFT

SEQ ID NO: 97648 - protein, 19 aa, Mycobacterium avium
GNRDGRLPVMAEVIRSISG

SEQ ID NO: 97649 - protein, 25 aa, Mycobacterium avium
GNSYGGSCALRLALDNPRRVGKLVL

SEQ ID NO: 97650 - protein, 20 aa, Mycobacterium avium
GNTELGWRMEVNDDGQWAFF

SEQ ID NO: 97651 - protein, 24 aa, Mycobacterium avium
GNVFTLRLPMWGPVVMVSDPQLAK

SEQ ID NO: 97652 - protein, 20 aa, Mycobacterium avium
GNVLLRLCQDLELRQQFIDD

SEQ ID NO: 97653 - protein, 18 aa, Mycobacterium avium
GPAARLFGLLLRLPPQVF

SEQ ID NO: 97654 - protein, 22 aa, Mycobacterium avium
GPADARTSITLVAYSVPEPGWS

SEQ ID NO: 97655 - protein, 17 aa, Mycobacterium avium
GPAGFPAQVELFDTAAD

SEQ ID NO: 97656 - protein, 17 aa, Mycobacterium avium
GPALSHRGRVRRRPRRR

SEQ ID NO: 97657 - protein, 19 aa, Mycobacterium avium
GPANRWARRLGELTCTRQR

SEQ ID NO: 97658 - protein, 18 aa, Mycobacterium avium
GPANRWTRRLGELTCTRQ

SEQ ID NO: 97659 - protein, 18 aa, Mycobacterium avium
GPARAAYIQGEWGAVASL

SEQ ID NO: 97660 - protein, 30 aa, Mycobacterium avium
GPASRTDVCLRPGDVLYLPRGQVHSARTHS

SEQ ID NO: 97661 - protein, 22 aa, Mycobacterium avium
GPASVRYSSRWDVDGWVGYYYY

SEQ ID NO: 97662 - protein, 29 aa, Mycobacterium avium
GPAVRFGDRPGYRFVQRDVCDPGLIDEVG

SEQ ID NO: 97663 - protein, 28 aa, Mycobacterium avium
GPAVRFGDRPGYRFVQRDVCEPGLIDEV

SEQ ID NO: 97664 - protein, 18 aa, Mycobacterium avium
GPDAIAMYVSGQMSLEAQ

SEQ ID NO: 97665 - protein, 19 aa, Mycobacterium avium
GPDAPTLCEGWTTRDLAAH

SEQ ID NO: 97666 - protein, 20 aa, Mycobacterium avium
GPDGAFQWFTQVLKMAFPDL

SEQ ID NO: 97667 - protein, 20 aa, Mycobacterium avium
GPDPLGVLYWQVPKGSTLDS

SEQ ID NO: 97668 - protein, 17 aa, Mycobacterium avium
GPDSAFEMLHRTGREWR

SEQ ID NO: 97669 - protein, 21 aa, Mycobacterium avium
GPEVLSYHLVRSVLRDPRFQI

SEQ ID NO: 97670 - protein, 18 aa, Mycobacterium avium
GPFEPFAAVLDSTIFGAF

SEQ ID NO: 97671 - protein, 28 aa, Mycobacterium avium
GPFHRPKLPGIPGIKTFGGHSFHSSRWD

SEQ ID NO: 97672 - protein, 33 aa, Mycobacterium avium
GPFHRPKLPGIPGIKTFGGHSFHSSRWDYDYTG

SEQ ID NO: 97673 - protein, 17 aa, Mycobacterium avium
GPFPGQPLSTFVAAVGR

SEQ ID NO: 97674 - protein, 18 aa, Mycobacterium avium
GPGAALWVQATPVPDAAI

SEQ ID NO: 97675 - protein, 24 aa, Mycobacterium avium
GPGDAVGVLAGFPVEIAPTAQGLW

SEQ ID NO: 97676 - protein, 17 aa, Mycobacterium avium
GPGDGHWLLSGASEVTA

SEQ ID NO: 97677 - protein, 20 aa, Mycobacterium avium
GPGEAVAAVSATRYPPNGIR

SEQ ID NO: 97678 - protein, 30 aa, Mycobacterium avium
GPGESVALLFNRRAEAVVAVLAVLKTGAAY

SEQ ID NO: 97679 - protein, 17 aa, Mycobacterium avium
GPGGDGWIDVPPRQGAF

SEQ ID NO: 97680 - protein, 19 aa, Mycobacterium avium
GPGGRVAVVLGNRMESVAT

SEQ ID NO: 97681 - protein, 18 aa, Mycobacterium avium
GPGNLCAAMGITMADNGI

SEQ ID NO: 97682 - protein, 22 aa, Mycobacterium avium
GPGPRVRPALHTAPWKQKLGTA

SEQ ID NO: 97683 - protein, 23 aa, Mycobacterium avium
GPGQRGRLGPWAVQRRRHRRDHR

SEQ ID NO: 97684 - protein, 21 aa, Mycobacterium avium
GPGQTVALLFSRSAEAVAAIL

SEQ ID NO: 97685 - protein, 23 aa, Mycobacterium avium
GPGSRAAGIAMAYKLIDAAQARW

SEQ ID NO: 97686 - protein, 19 aa, Mycobacterium avium
GPGTGKCQQVWCPVCALAA

SEQ ID NO: 97687 - protein, 26 aa, Mycobacterium avium
GPGVTGWRNFRGILPAFAPHYRCLVL

SEQ ID NO: 97688 - protein, 18 aa, Mycobacterium avium
GPHFRFSEAVSFTVHCKD

SEQ ID NO: 97689 - protein, 31 aa, Mycobacterium avium
GPHPFPAMVRDFQRIVGLEARAQIQAQAGRL

SEQ ID NO: 97690 - protein, 17 aa, Mycobacterium avium
GPHRPAAAGQRRRRSGR

SEQ ID NO: 97691 - protein, 18 aa, Mycobacterium avium
GPHRPAAAGQRRRRSGRS

SEQ ID NO: 97692 - protein, 23 aa, Mycobacterium avium
GPHYCMGAFMAKMQLESIFRELI

SEQ ID NO: 97693 - protein, 25 aa, Mycobacterium avium
GPIERLEELVPIYAELLSLLADNGA

SEQ ID NO: 97694 - protein, 18 aa, Mycobacterium avium
GPIITEWLAQQGFSSAQP

SEQ ID NO: 97695 - protein, 21 aa, Mycobacterium avium
GPKAPILEYARMRARISEMER

SEQ ID NO: 97696 - protein, 17 aa, Mycobacterium avium
GPLAVFARRAARIGRPM

SEQ ID NO: 97697 - protein, 24 aa, Mycobacterium avium
GPLGSGLLEMIGFPRVDEYLDRDP

SEQ ID NO: 97698 - protein, 19 aa, Mycobacterium avium
GPLIPARVVQAPWLTRLQA

SEQ ID NO: 97699 - protein, 26 aa, Mycobacterium avium
GPLIPARVVRAPWLTRLQALGEDVSL

SEQ ID NO: 97700 - protein, 18 aa, Mycobacterium avium
GPLIRLAGAKGFRVIVTL

SEQ ID NO: 97701 - protein, 18 aa, Mycobacterium avium
GPLIRLASAKGFRVIVTL

SEQ ID NO: 97702 - protein, 20 aa, Mycobacterium avium
GPLIRLASAKGFRVIVTLHG

SEQ ID NO: 97703 - protein, 17 aa, Mycobacterium avium
GPLSVPGSRQGDLPVWQ

SEQ ID NO: 97704 - protein, 22 aa, Mycobacterium avium
GPLTECLADVVVRFLPYFTDVI

SEQ ID NO: 97705 - protein, 24 aa, Mycobacterium avium
GPMLLPRIVASVFATEPRCRRVMF

SEQ ID NO: 97706 - protein, 25 aa, Mycobacterium avium
GPNVDLPVPAGWQLNQISGTSYGGI

SEQ ID NO: 97707 - protein, 18 aa, Mycobacterium avium
GPPDGKADYTLRIATGTV

SEQ ID NO: 97708 - protein, 17 aa, Mycobacterium avium
GPPEIPPAVSAYTGLPG

SEQ ID NO: 97709 - protein, 22 aa, Mycobacterium avium
GPPELYAWLHYDPIPTRDDLAK

SEQ ID NO: 97710 - protein, 19 aa, Mycobacterium avium
GPPHGKADYTLRIATGTVE

SEQ ID NO: 97711 - protein, 18 aa, Mycobacterium avium
GPPPPARWSRRKPEAAAR

SEQ ID NO: 97712 - protein, 21 aa, Mycobacterium avium
GPPPPFTSWQPPGGAAGAATA

SEQ ID NO: 97713 - protein, 18 aa, Mycobacterium avium
GPQAVRLAARIGDGYSIS

SEQ ID NO: 97714 - protein, 17 aa, Mycobacterium avium
GPQPDGRVWSPPVQMPP

SEQ ID NO: 97715 - protein, 18 aa, Mycobacterium avium
GPQPDGRVWSPPVQMPPL

SEQ ID NO: 97716 - protein, 21 aa, Mycobacterium avium
GPRAPQLWLPPLDEPIPLSAM

SEQ ID NO: 97717 - protein, 18 aa, Mycobacterium avium
GPRFAAMRVETVYDKVRG

SEQ ID NO: 97718 - protein, 20 aa, Mycobacterium avium
GPRLIRKIVHLIDASGPVET

SEQ ID NO: 97719 - protein, 21 aa, Mycobacterium avium
GPRRRAGSGGAQFIPEYVTAT

SEQ ID NO: 97720 - protein, 24 aa, Mycobacterium avium
GPRSAELLADIGLDVEVSGDPALL

SEQ ID NO: 97721 - protein, 17 aa, Mycobacterium avium
GPRWRRRRMRISEVDDA

SEQ ID NO: 97722 - protein, 27 aa, Mycobacterium avium
GPSAEAFVAAHVPYLAWLLQNSTNSTA

SEQ ID NO: 97723 - protein, 26 aa, Mycobacterium avium
GPSARACPCSARLPTVPHIMKLSSRN

SEQ ID NO: 97724 - protein, 19 aa, Mycobacterium avium
GPSTGTNVWGAFGLLAELV

SEQ ID NO: 97725 - protein, 17 aa, Mycobacterium avium
GPSTSPFCAWVNDPREP

SEQ ID NO: 97726 - protein, 20 aa, Mycobacterium avium
GPSYRSAIFYTDDEQKRIAL

SEQ ID NO: 97727 - protein, 28 aa, Mycobacterium avium
GPTATPCGVCDSCLALAPNAPGSIDVVE

SEQ ID NO: 97728 - protein, 17 aa, Mycobacterium avium
GPTMPMMPGSWEPGDDA

SEQ ID NO: 97729 - protein, 19 aa, Mycobacterium avium
GPVDRHAVAALVGHRRVGP

SEQ ID NO: 97730 - protein, 19 aa, Mycobacterium avium
GPVELEWKIPEHGSNTIER

SEQ ID NO: 97731 - protein, 26 aa, Mycobacterium avium
GPVGNGTCYWKRMGNPDGAVIDNAMT

SEQ ID NO: 97732 - protein, 21 aa, Mycobacterium avium
GPVRPTPIMRWLQDIDGPIDE

SEQ ID NO: 97733 - protein, 22 aa, Mycobacterium avium
GPVSAQRIAAVLGIDPESLAVP

SEQ ID NO: 97734 - protein, 24 aa, Mycobacterium avium
GPWLSELTHAWHVFDEHGLEQTLV

SEQ ID NO: 97735 - protein, 18 aa, Mycobacterium avium
GPYPWRNHHNAWRPAYIH

SEQ ID NO: 97736 - protein, 28 aa, Mycobacterium avium
GQAAHLWSRTDLRPEDVDLALLYDGFTF

SEQ ID NO: 97737 - protein, 21 aa, Mycobacterium avium
GQADVPWPCDHTKYISHFPEE

SEQ ID NO: 97738 - protein, 17 aa, Mycobacterium avium
GQAGLRGLVRVIGMEHP

SEQ ID NO: 97739 - protein, 17 aa, Mycobacterium avium
GQAIDVRGPALGVLERM

SEQ ID NO: 97740 - protein, 18 aa, Mycobacterium avium
GQASVCWEDAPDGRGLNY

SEQ ID NO: 97741 - protein, 18 aa, Mycobacterium avium
GQAVSWLYATSPRGLAGP

SEQ ID NO: 97742 - protein, 23 aa, Mycobacterium avium
GQEEVCRLWNLVASNTREGDVFV

SEQ ID NO: 97743 - protein, 22 aa, Mycobacterium avium
GQFPGPLLRFMQGRRTWVDVYN

SEQ ID NO: 97744 - protein, 24 aa, Mycobacterium avium
GQFVGGACPYRGQHQAGAGVQPGP

SEQ ID NO: 97745 - protein, 19 aa, Mycobacterium avium
GQHGIRDARIDLGDRTVTI

SEQ ID NO: 97746 - protein, 25 aa, Mycobacterium avium
GQIAKLGLRGGVLLPGIAPGTGIPP

SEQ ID NO: 97747 - protein, 31 aa, Mycobacterium avium
GQLCAALTRIVLPRSRYDEFVAALTAAVAEL

SEQ ID NO: 97748 - protein, 24 aa, Mycobacterium avium
GQLLGPKAHKVWKPVIAALHSIVA

SEQ ID NO: 97749 - protein, 26 aa, Mycobacterium avium
GQLQSAPRFANWVDRRFNAALRPGLV

SEQ ID NO: 97750 - protein, 23 aa, Mycobacterium avium
GQLRIGMAASFVRCEDPALLAQA

SEQ ID NO: 97751 - protein, 17 aa, Mycobacterium avium
GQLVIREVYGDWAAQRG

SEQ ID NO: 97752 - protein, 18 aa, Mycobacterium avium
GQLVIREVYGDWAAQRGT

SEQ ID NO: 97753 - protein, 20 aa, Mycobacterium avium
GQLVIREVYGDWAAQRGTLA

SEQ ID NO: 97754 - protein, 24 aa, Mycobacterium avium
GQLWCADVVVAAYRPAQVPWLPDI

SEQ ID NO: 97755 - protein, 25 aa, Mycobacterium avium
GQNYWGVRGCDDFLTGMTHVVSPVC

SEQ ID NO: 97756 - protein, 19 aa, Mycobacterium avium
GQPCPTYTDLLVNPPDTTA

SEQ ID NO: 97757 - protein, 18 aa, Mycobacterium avium
GQQVFKMAAELAYLEFGD

SEQ ID NO: 97758 - protein, 17 aa, Mycobacterium avium
GQRAELFLGGLEDVAQP

SEQ ID NO: 97759 - protein, 26 aa, Mycobacterium avium
GQRLCKGDRAILMWAAANRDPAMFED

SEQ ID NO: 97760 - protein, 32 aa, Mycobacterium avium
GQRLLQSCPVCLYAGSIMRDDLLALCPPDARI

SEQ ID NO: 97761 - protein, 28 aa, Mycobacterium avium
GQRLPAPAPYRGFVDWLAERDLDAARAA

SEQ ID NO: 97762 - protein, 19 aa, Mycobacterium avium
GQRLTGVHLRRRHDQRRPG

SEQ ID NO: 97763 - protein, 20 aa, Mycobacterium avium
GQRLVAFVVLADGSSATPDA

SEQ ID NO: 97764 - protein, 21 aa, Mycobacterium avium
GQRLYELASRIPIGTADRYTV

SEQ ID NO: 97765 - protein, 23 aa, Mycobacterium avium
GQRLYELASRIPIGTADRYTVLC

SEQ ID NO: 97766 - protein, 20 aa, Mycobacterium avium
GQRVVAAIVLRDGRAAPSPD

SEQ ID NO: 97767 - protein, 24 aa, Mycobacterium avium
GQTCLAGSRLLVDRSVADALVEKI

SEQ ID NO: 97768 - protein, 18 aa, Mycobacterium avium
GQVCCLLGPNGAGKTTLL

SEQ ID NO: 97769 - protein, 24 aa, Mycobacterium avium
GQVISALLDVAGWAQPWDTSDQRE

SEQ ID NO: 97770 - protein, 31 aa, Mycobacterium avium
GQVQALSQFVAWPGLLVFQGKAKLLYDGAEL

SEQ ID NO: 97771 - protein, 29 aa, Mycobacterium avium
GQVRWVPGTELEFGYRTSVFKRRADDGLE

SEQ ID NO: 97772 - protein, 19 aa, Mycobacterium avium
GRAAISAFWDKAIAPTTKI

SEQ ID NO: 97773 - protein, 21 aa, Mycobacterium avium
GRAAVQIGRRLARLARTHQVI

SEQ ID NO: 97774 - protein, 20 aa, Mycobacterium avium
GRAEIRAIFRSSKVGIIAGC

SEQ ID NO: 97775 - protein, 24 aa, Mycobacterium avium
GRAFRVSVPPSLSWFDVDQPSVIG

SEQ ID NO: 97776 - protein, 23 aa, Mycobacterium avium
GRAGGRPAVRLGPPHVGGQLGGP

SEQ ID NO: 97777 - protein, 21 aa, Mycobacterium avium
GRAGLPKIVPRLADAAAAGAV

SEQ ID NO: 97778 - protein, 18 aa, Mycobacterium avium
GRAGVLPGEVLPGQHHLH

SEQ ID NO: 97779 - protein, 23 aa, Mycobacterium avium
GRAHRRPIVPIGRVAVGAVGDGP

SEQ ID NO: 97780 - protein, 18 aa, Mycobacterium avium
GRAIVFADVAWRANAINR

SEQ ID NO: 97781 - protein, 23 aa, Mycobacterium avium
GRAKTRLAAAVGERAAAEIAAAA

SEQ ID NO: 97782 - protein, 24 aa, Mycobacterium avium
GRAKTRLAAAVGERAAAEIAAAAL

SEQ ID NO: 97783 - protein, 30 aa, Mycobacterium avium
GRAPRPGHRRIVLRFGARPVEVVGADRVEG

SEQ ID NO: 97784 - protein, 17 aa, Mycobacterium avium
GRASALVRPGSAEQLAE

SEQ ID NO: 97785 - protein, 26 aa, Mycobacterium avium
GRAVACFDEALALWRGIPELPDGRRG

SEQ ID NO: 97786 - protein, 26 aa, Mycobacterium avium
GRAVACFDEALGLWRGIPELPDGRRG

SEQ ID NO: 97787 - protein, 19 aa, Mycobacterium avium
GRCGCVGAERIDWCETCAS

SEQ ID NO: 97788 - protein, 20 aa, Mycobacterium avium
GRCHACTTTLAGTHADVRRV

SEQ ID NO: 97789 - protein, 17 aa, Mycobacterium avium
GRCIVRRGNTQFRMGEV

SEQ ID NO: 97790 - protein, 17 aa, Mycobacterium avium
GRCRIIGPIDDYVPPAT

SEQ ID NO: 97791 - protein, 26 aa, Mycobacterium avium
GRDCTAIRWGLWQGAGVVVGNEITRT

SEQ ID NO: 97792 - protein, 18 aa, Mycobacterium avium
GRDGTVFDSSYQRGAPVD

SEQ ID NO: 97793 - protein, 19 aa, Mycobacterium avium
GRDGYLRSIHRAAAAGASL

SEQ ID NO: 97794 - protein, 21 aa, Mycobacterium avium
GRDGYLRSIHRAAAPGASLFI

SEQ ID NO: 97795 - protein, 18 aa, Mycobacterium avium
GRDLPELHYTYRQYRQAI

SEQ ID NO: 97796 - protein, 19 aa, Mycobacterium avium
GRDRRQGLVDAERLRSPAF

SEQ ID NO: 97797 - protein, 20 aa, Mycobacterium avium
GRDSLLTAWMALPLDVGLSI

SEQ ID NO: 97798 - protein, 28 aa, Mycobacterium avium
GREDVLRWCEDRWKLARRSIFVDESVLR

SEQ ID NO: 97799 - protein, 24 aa, Mycobacterium avium
GREHPPLEFGLRVTTLVRDTSEEA

SEQ ID NO: 97800 - protein, 26 aa, Mycobacterium avium
GRERLPILCGLDLTRKVAMTPDHLTR

SEQ ID NO: 97801 - protein, 26 aa, Mycobacterium avium
GRERLPILCGLDLTRKVAMTPGHLTR

SEQ ID NO: 97802 - protein, 18 aa, Mycobacterium avium
GREVTRFAGEAAEFDADF

SEQ ID NO: 97803 - protein, 32 aa, Mycobacterium avium
GREVYERIKPAFKHWAAVVIHAGEPGAGTRMK

SEQ ID NO: 97804 - protein, 20 aa, Mycobacterium avium
GRFLLAAAIREAHTKTDGPP

SEQ ID NO: 97805 - protein, 20 aa, Mycobacterium avium
GRFLPMGLPVLWDPELCAKE

SEQ ID NO: 97806 - protein, 25 aa, Mycobacterium avium
GRGADGWRLDAAYAVPESFWAATLP

SEQ ID NO: 97807 - protein, 20 aa, Mycobacterium avium
GRGAVAVGVLVVRRRQGLAV

SEQ ID NO: 97808 - protein, 21 aa, Mycobacterium avium
GRGGFPGMLLGSVSSHVAQSA

SEQ ID NO: 97809 - protein, 17 aa, Mycobacterium avium
GRGGPRCMSCPVARDPL

SEQ ID NO: 97810 - protein, 19 aa, Mycobacterium avium
GRGGRDFWAKTSGTITARG

SEQ ID NO: 97811 - protein, 19 aa, Mycobacterium avium
GRGLRCIAPTWPMGAHPEP

SEQ ID NO: 97812 - protein, 25 aa, Mycobacterium avium
GRGPRPLLVSVRSGAALSMPGMMDT

SEQ ID NO: 97813 - protein, 18 aa, Mycobacterium avium
GRGRLRAAPRVRAARHAR

SEQ ID NO: 97814 - protein, 21 aa, Mycobacterium avium
GRGSLFGPIVQLVFSSVYLGI

SEQ ID NO: 97815 - protein, 18 aa, Mycobacterium avium
GRHRRRRRGGGRRRTVRP

SEQ ID NO: 97816 - protein, 18 aa, Mycobacterium avium
GRHTPYRCMLGGPPGGLP

SEQ ID NO: 97817 - protein, 20 aa, Mycobacterium avium
GRIAAMAAFDLDDFDAAIAA

SEQ ID NO: 97818 - protein, 17 aa, Mycobacterium avium
GRIDMGLGRSGQRRAEA

SEQ ID NO: 97819 - protein, 18 aa, Mycobacterium avium
GRIESLCPIAGVDGAGCC

SEQ ID NO: 97820 - protein, 19 aa, Mycobacterium avium
GRIESLCPIAGVDGAGCCD

SEQ ID NO: 97821 - protein, 20 aa, Mycobacterium avium
GRIESLCPIAGVDGAGCCDL

SEQ ID NO: 97822 - protein, 19 aa, Mycobacterium avium
GRIKDLVIIDGRNHYPQDL

SEQ ID NO: 97823 - protein, 26 aa, Mycobacterium avium
GRIPNAVGGFSYVLPAGWVESDASHL

SEQ ID NO: 97824 - protein, 18 aa, Mycobacterium avium
GRIPPELIDVYDRNVDAR

SEQ ID NO: 97825 - protein, 17 aa, Mycobacterium avium
GRIRLKMNALVDEQVID

SEQ ID NO: 97826 - protein, 17 aa, Mycobacterium avium
GRKAPIYVIEDAPWSAF

SEQ ID NO: 97827 - protein, 17 aa, Mycobacterium avium
GRKPLRFTSFGDQSTPA

SEQ ID NO: 97828 - protein, 18 aa, Mycobacterium avium
GRKSLRLEPSGPRGAAED

SEQ ID NO: 97829 - protein, 18 aa, Mycobacterium avium
GRKVRSWPVTERNESIYI

SEQ ID NO: 97830 - protein, 20 aa, Mycobacterium avium
GRLADFKVPQYITVVDGPLP

SEQ ID NO: 97831 - protein, 20 aa, Mycobacterium avium
GRLADFKVPQYVTIADGPLP

SEQ ID NO: 97832 - protein, 20 aa, Mycobacterium avium
GRLADFKVPQYVTVVDGPLP

SEQ ID NO: 97833 - protein, 17 aa, Mycobacterium avium
GRLADKQGIQWMLVDSE

SEQ ID NO: 97834 - protein, 19 aa, Mycobacterium avium
GRLAHSMHMYFLRRGDARQ

SEQ ID NO: 97835 - protein, 18 aa, Mycobacterium avium
GRLARFVDIAARHGIKPL

SEQ ID NO: 97836 - protein, 19 aa, Mycobacterium avium
GRLDGCAEPAVQREAFAWH

SEQ ID NO: 97837 - protein, 28 aa, Mycobacterium avium
GRLDGCAEPAVQREAFAWHIDLAKRCGK

SEQ ID NO: 97838 - protein, 18 aa, Mycobacterium avium
GRLDGCAEPPVQREAFAW

SEQ ID NO: 97839 - protein, 23 aa, Mycobacterium avium
GRLEDGRHVWAIRGALQAPDDPK

SEQ ID NO: 97840 - protein, 17 aa, Mycobacterium avium
GRLGEWLAGTFAAAAAA

SEQ ID NO: 97841 - protein, 20 aa, Mycobacterium avium
GRLGVPVVAEFDCPEARTIV

SEQ ID NO: 97842 - protein, 21 aa, Mycobacterium avium
GRLIHDGVIEFLGRRDNQVKI

SEQ ID NO: 97843 - protein, 17 aa, Mycobacterium avium
GRLPEPSPSVLLDDPVE

SEQ ID NO: 97844 - protein, 21 aa, Mycobacterium avium
GRLRAACALLADNLRKPLTLR

SEQ ID NO: 97845 - protein, 25 aa, Mycobacterium avium
GRLRSADRGWSQALAHRETDLAELS

SEQ ID NO: 97846 - protein, 20 aa, Mycobacterium avium
GRLSAYKVPKFIWVTAKQEL

SEQ ID NO: 97847 - protein, 22 aa, Mycobacterium avium
GRLSDAAIDWVIDAYTGGLVAE

SEQ ID NO: 97848 - protein, 19 aa, Mycobacterium avium
GRLSIPFTTGLLVGIGETP

SEQ ID NO: 97849 - protein, 17 aa, Mycobacterium avium
GRLVARRLRAGGVDTVF

SEQ ID NO: 97850 - protein, 23 aa, Mycobacterium avium
GRMADEYLEAMFELWHSDSPSYD

SEQ ID NO: 97851 - protein, 34 aa, Mycobacterium avium
GRMPPRLLNPQVWPRYCERFHDILGVHPTARVPA

SEQ ID NO: 97852 - protein, 24 aa, Mycobacterium avium
GRMSGVPPAAWGGLAAARFKEMID

SEQ ID NO: 97853 - protein, 18 aa, Mycobacterium avium
GRMYSGPGAGSFVAAATA

SEQ ID NO: 97854 - protein, 17 aa, Mycobacterium avium
GRNALALARRGHPVDAV

SEQ ID NO: 97855 - protein, 19 aa, Mycobacterium avium
GRNALALARRGHPVDAVEM

SEQ ID NO: 97856 - protein, 24 aa, Mycobacterium avium
GRNRGHCVAIHLNMPIGRPGQQAL

SEQ ID NO: 97857 - protein, 27 aa, Mycobacterium avium
GRPAPRIVAGIPVCLCAPSQVDEAKER

SEQ ID NO: 97858 - protein, 31 aa, Mycobacterium avium
GRPDAGLDLPIVLGGNMIQYNWTINGEPYSK

SEQ ID NO: 97859 - protein, 20 aa, Mycobacterium avium
GRPDAIRIVAWTDTEHQHTV

SEQ ID NO: 97860 - protein, 31 aa, Mycobacterium avium
GRPDPGLDLPIVLGGNMIQYNWTINGEPYSK

SEQ ID NO: 97861 - protein, 20 aa, Mycobacterium avium
GRPEVLTAWMDAAVVDENDP

SEQ ID NO: 97862 - protein, 17 aa, Mycobacterium avium
GRPGLRPAQLHDRGVRV

SEQ ID NO: 97863 - protein, 19 aa, Mycobacterium avium
GRPRFYRTPGRPDVIATLD

SEQ ID NO: 97864 - protein, 24 aa, Mycobacterium avium
GRPVLGICGGFQMLCRRIDDRVES

SEQ ID NO: 97865 - protein, 23 aa, Mycobacterium avium
GRPVLRDVEWRIAPGERTGIVGA

SEQ ID NO: 97866 - protein, 17 aa, Mycobacterium avium
GRPWRRWVTGRAAQLGS

SEQ ID NO: 97867 - protein, 25 aa, Mycobacterium avium
GRQARKVSCPILFAICENDTVAPAK

SEQ ID NO: 97868 - protein, 19 aa, Mycobacterium avium
GRQHGAYVLGELVEQPADP

SEQ ID NO: 97869 - protein, 23 aa, Mycobacterium avium
GRQLYERFEVFAGALDEAVAVVD

SEQ ID NO: 97870 - protein, 17 aa, Mycobacterium avium
GRQPGGFGRKVRQPVGL

SEQ ID NO: 97871 - protein, 18 aa, Mycobacterium avium
GRQRLRIAVLTRSIQREC

SEQ ID NO: 97872 - protein, 21 aa, Mycobacterium avium
GRQVHALACQRAHGRDLGQQH

SEQ ID NO: 97873 - protein, 17 aa, Mycobacterium avium
GRRALVTGASSGIGKQV

SEQ ID NO: 97874 - protein, 17 aa, Mycobacterium avium
GRRALVTGASTGIGKQV

SEQ ID NO: 97875 - protein, 17 aa, Mycobacterium avium
GRRALYISGEESAGQIR

SEQ ID NO: 97876 - protein, 19 aa, Mycobacterium avium
GRRCGACRLEIDRGELSRI

SEQ ID NO: 97877 - protein, 17 aa, Mycobacterium avium
GRRFAGLAVDVGNPHLA

SEQ ID NO: 97878 - protein, 19 aa, Mycobacterium avium
GRRFAGLAVDVGNPHLACL

SEQ ID NO: 97879 - protein, 26 aa, Mycobacterium avium
GRRGRGWPGDSRTLGWHGSTVTSRRP

SEQ ID NO: 97880 - protein, 17 aa, Mycobacterium avium
GRRHRLPGAGPVRHVRV

SEQ ID NO: 97881 - protein, 20 aa, Mycobacterium avium
GRRLEVCFEHGYPAAQIFTP

SEQ ID NO: 97882 - protein, 20 aa, Mycobacterium avium
GRRREWPRPTAPVRSPPGSR

SEQ ID NO: 97883 - protein, 17 aa, Mycobacterium avium
GRRSPLWQQRQRAAQLL

SEQ ID NO: 97884 - protein, 20 aa, Mycobacterium avium
GRRSRCGDGQLGQRGGQLAD

SEQ ID NO: 97885 - protein, 27 aa, Mycobacterium avium
GRSGSPLLDLGIDWKTYRDAIAGLRGV

SEQ ID NO: 97886 - protein, 26 aa, Mycobacterium avium
GRSGSPLLDLGIDWKTYRDAIDGLRG

SEQ ID NO: 97887 - protein, 26 aa, Mycobacterium avium
GRSGSPLLDLGIDWRTYRDAIDGLRG

SEQ ID NO: 97888 - protein, 17 aa, Mycobacterium avium
GRSPLLERTFDWLEAHW

SEQ ID NO: 97889 - protein, 20 aa, Mycobacterium avium
GRSSWSAPWTIDANISALAD

SEQ ID NO: 97890 - protein, 18 aa, Mycobacterium avium
GRTAYLVMELVNGEPLNS

SEQ ID NO: 97891 - protein, 19 aa, Mycobacterium avium
GRTAYLVMELVNGEPLNSV

SEQ ID NO: 97892 - protein, 28 aa, Mycobacterium avium
GRTGIYGHARACGWAIRDGVVGPSSTPG

SEQ ID NO: 97893 - protein, 18 aa, Mycobacterium avium
GRTRDEWARVFAGTDACV

SEQ ID NO: 97894 - protein, 17 aa, Mycobacterium avium
GRTRIDIGSAFDHLDEP

SEQ ID NO: 97895 - protein, 19 aa, Mycobacterium avium
GRTRIDIGSAFDHLDEPHV

SEQ ID NO: 97896 - protein, 26 aa, Mycobacterium avium
GRTVYRQEMLRIFGLPESGLAETLRE

SEQ ID NO: 97897 - protein, 26 aa, Mycobacterium avium
GRTVYRQEMLRMFGLPESGLAETLRE

SEQ ID NO: 97898 - protein, 18 aa, Mycobacterium avium
GRVAEAFLGKLGITASES

SEQ ID NO: 97899 - protein, 19 aa, Mycobacterium avium
GRVALSVRRHEPVGVVTAI

SEQ ID NO: 97900 - protein, 26 aa, Mycobacterium avium
GRVEPEMLRRALLYAIERKRAELIAA

SEQ ID NO: 97901 - protein, 17 aa, Mycobacterium avium
GRVHRPGWVETSGGHIA

SEQ ID NO: 97902 - protein, 20 aa, Mycobacterium avium
GRVKRLRRKLSRNATAPNSD

SEQ ID NO: 97903 - protein, 24 aa, Mycobacterium avium
GRVKRPQTGIATWIVPSIVAFGTE

SEQ ID NO: 97904 - protein, 20 aa, Mycobacterium avium
GRVPAARIVDRPEWIAAAAE

SEQ ID NO: 97905 - protein, 26 aa, Mycobacterium avium
GRVPAARIVDRPEWIAAAAESMRVMM

SEQ ID NO: 97906 - protein, 18 aa, Mycobacterium avium
GRVQPPLARNYGYVVLTN

SEQ ID NO: 97907 - protein, 18 aa, Mycobacterium avium
GRVVATPIMRWLQNMDGP

SEQ ID NO: 97908 - protein, 18 aa, Mycobacterium avium
GRWELCPNEALIVEVEPP

SEQ ID NO: 97909 - protein, 17 aa, Mycobacterium avium
GRWLCPTNPLTGQIPAA

SEQ ID NO: 97910 - protein, 18 aa, Mycobacterium avium
GRWLLSHNGVVDRSVLPV

SEQ ID NO: 97911 - protein, 31 aa, Mycobacterium avium
GRYHKVILSRCLQVPFAVDFPSTYRLARRHN

SEQ ID NO: 97912 - protein, 19 aa, Mycobacterium avium
GRYRLQRLIATGGMGQVWE

SEQ ID NO: 97913 - protein, 24 aa, Mycobacterium avium
GRYRLVVARACPWANRAIIVRRLL

SEQ ID NO: 97914 - protein, 23 aa, Mycobacterium avium
GRYVFHKDLRRAVIFGRNDLVKD

SEQ ID NO: 97915 - protein, 20 aa, Mycobacterium avium
GSAACLAFALAVPDDSTAMM

SEQ ID NO: 97916 - protein, 18 aa, Mycobacterium avium
GSAAEVFLANGFHATSLD

SEQ ID NO: 97917 - protein, 25 aa, Mycobacterium avium
GSAEKLDFCRELGADITINYRDEDF

SEQ ID NO: 97918 - protein, 18 aa, Mycobacterium avium
GSAMLMLVGAANRDHRRF

SEQ ID NO: 97919 - protein, 31 aa, Mycobacterium avium
GSAPAPVWLWQRIAKDFGVSEIVTGYGMTEC

SEQ ID NO: 97920 - protein, 21 aa, Mycobacterium avium
GSAPPYLACTHVHTGDLRGSL

SEQ ID NO: 97921 - protein, 17 aa, Mycobacterium avium
GSARLTALLAEERRGID

SEQ ID NO: 97922 - protein, 17 aa, Mycobacterium avium
GSDAQFLRRERISGRSG

SEQ ID NO: 97923 - protein, 30 aa, Mycobacterium avium
GSDEQKQRWAVPILRAEITASLGMSEPSAG

SEQ ID NO: 97924 - protein, 24 aa, Mycobacterium avium
GSDFLRAGWELDQHLDLYVETVHR

SEQ ID NO: 97925 - protein, 24 aa, Mycobacterium avium
GSDGVPSWAFRLLHVADTYNPIAP

SEQ ID NO: 97926 - protein, 19 aa, Mycobacterium avium
GSDGWKFRDTVIPNVALNA

SEQ ID NO: 97927 - protein, 21 aa, Mycobacterium avium
GSDIDRAVAIARRMRTGQVSV

SEQ ID NO: 97928 - protein, 25 aa, Mycobacterium avium
GSERLSEILAAYALLRDPARRADYD

SEQ ID NO: 97929 - protein, 17 aa, Mycobacterium avium
GSESMLAAAAAWNALSS

SEQ ID NO: 97930 - protein, 17 aa, Mycobacterium avium
GSFFPALLERRRRVDQC

SEQ ID NO: 97931 - protein, 24 aa, Mycobacterium avium
GSFLCTGMPFAFLGKPRRWLRRVP

SEQ ID NO: 97932 - protein, 18 aa, Mycobacterium avium
GSFRAPQFTVAWPTGEID

SEQ ID NO: 97933 - protein, 17 aa, Mycobacterium avium
GSFVARADMFSGPATGV

SEQ ID NO: 97934 - protein, 21 aa, Mycobacterium avium
GSGALRPAAAEVFAAVEDAGI

SEQ ID NO: 97935 - protein, 18 aa, Mycobacterium avium
GSGARGFSPVPTLYTEDD

SEQ ID NO: 97936 - protein, 20 aa, Mycobacterium avium
GSGKGFCAGHVMAPDAYPEF

SEQ ID NO: 97937 - protein, 19 aa, Mycobacterium avium
GSGLLQWAGRALSPRIAQS

SEQ ID NO: 97938 - protein, 23 aa, Mycobacterium avium
GSGMPWHPGQVILKDSSRSAEQI

SEQ ID NO: 97939 - protein, 18 aa, Mycobacterium avium
GSGPWIAHWEEGPSTEAN

SEQ ID NO: 97940 - protein, 17 aa, Mycobacterium avium
GSGRIIINTGVFYEGPL

SEQ ID NO: 97941 - protein, 27 aa, Mycobacterium avium
GSGSSRDWAAKGTRLLGVRAVIAESFE

SEQ ID NO: 97942 - protein, 20 aa, Mycobacterium avium
GSGTWAVAVDRNGQLRWFGL

SEQ ID NO: 97943 - protein, 21 aa, Mycobacterium avium
GSGTWAVAVDRNGQLRWFGLD

SEQ ID NO: 97944 - protein, 34 aa, Mycobacterium avium
GSGTWAVAVDRTGQLRWFGLDGVEHTGGPMVDFD

SEQ ID NO: 97945 - protein, 21 aa, Mycobacterium avium
GSHIKRLKVGTSRRFSATTPE

SEQ ID NO: 97946 - protein, 27 aa, Mycobacterium avium
GSHLARLMSEVMVRAVLVRIPDYQVDV

SEQ ID NO: 97947 - protein, 25 aa, Mycobacterium avium
GSIPAVIKNAIDWLSRPFGDGALKG

SEQ ID NO: 97948 - protein, 27 aa, Mycobacterium avium
GSIPVKRLRQAGVLELLLALANESTGA

SEQ ID NO: 97949 - protein, 17 aa, Mycobacterium avium
GSKARFRTSPAFDGEAA

SEQ ID NO: 97950 - protein, 17 aa, Mycobacterium avium
GSKATVADLSWVRERGL

SEQ ID NO: 97951 - protein, 18 aa, Mycobacterium avium
GSLGRMFGVCGNELSADG

SEQ ID NO: 97952 - protein, 28 aa, Mycobacterium avium
GSLPDVSKNFPLRYLVTNTGWGRGLDMR

SEQ ID NO: 97953 - protein, 24 aa, Mycobacterium avium
GSLRVNFLRPFFAGTESRYEGTTM

SEQ ID NO: 97954 - protein, 24 aa, Mycobacterium avium
GSLSLKPSQYWARQRYVGASFMRP

SEQ ID NO: 97955 - protein, 18 aa, Mycobacterium avium
GSNIIGRGQDAQFRLPDT

SEQ ID NO: 97956 - protein, 25 aa, Mycobacterium avium
GSPEYWKCHVRDAVRFADSVRFAQS

SEQ ID NO: 97957 - protein, 21 aa, Mycobacterium avium
GSRAAVSLRFANDVLAELDTR

SEQ ID NO: 97958 - protein, 22 aa, Mycobacterium avium
GSRAAVSLRFANDVLAELDTRK

SEQ ID NO: 97959 - protein, 26 aa, Mycobacterium avium
GSRCRQRGRCGGDRLPAVELAYYLGV

SEQ ID NO: 97960 - protein, 26 aa, Mycobacterium avium
GSRFPMTSCISGWAMLNRDAAVIPDI

SEQ ID NO: 97961 - protein, 26 aa, Mycobacterium avium
GSRFVACPFGAPATRMYRTGDLVRWR

SEQ ID NO: 97962 - protein, 22 aa, Mycobacterium avium
GSRMRPDVVVAFMDEFGDVIYN

SEQ ID NO: 97963 - protein, 17 aa, Mycobacterium avium
GSRPLSVVITRIGARNS

SEQ ID NO: 97964 - protein, 25 aa, Mycobacterium avium
GSRRAIHFQEWWVRYRAQVPTHSFA

SEQ ID NO: 97965 - protein, 20 aa, Mycobacterium avium
GSRTGARCTTRATARSAARA

SEQ ID NO: 97966 - protein, 23 aa, Mycobacterium avium
GSRTMKDERGFPIDEPPEGDVAE

SEQ ID NO: 97967 - protein, 23 aa, Mycobacterium avium
GSSDPWTGCEGWQARYGDQEISQ

SEQ ID NO: 97968 - protein, 17 aa, Mycobacterium avium
GSSGVWELFWPDFPIGG

SEQ ID NO: 97969 - protein, 18 aa, Mycobacterium avium
GSSLPGERLFAGRRDGVL

SEQ ID NO: 97970 - protein, 25 aa, Mycobacterium avium
GSSLVIRGELRAVPAAAQASLLVLP

SEQ ID NO: 97971 - protein, 21 aa, Mycobacterium avium
GSSYPHWQCADVHKLPPALSA

SEQ ID NO: 97972 - protein, 25 aa, Mycobacterium avium
GSTAELRTATPLDDVFVALKPPPGD

SEQ ID NO: 97973 - protein, 25 aa, Mycobacterium avium
GSTRNGPSIGRSCWPPPIRPTRTAP

SEQ ID NO: 97974 - protein, 17 aa, Mycobacterium avium
GSVAGLVPQAGGVSGQG

SEQ ID NO: 97975 - protein, 23 aa, Mycobacterium avium
GSVKELSKALGIRRSSVLTAACA

SEQ ID NO: 97976 - protein, 31 aa, Mycobacterium avium
GSVPLRRFIRPRVEVELAFVLGDELRGPGVT

SEQ ID NO: 97977 - protein, 19 aa, Mycobacterium avium
GSVSPPALREVLTRHDDVA

SEQ ID NO: 97978 - protein, 24 aa, Mycobacterium avium
GSVTFNGSVWFPAAFNNASGAGIV

SEQ ID NO: 97979 - protein, 19 aa, Mycobacterium avium
GSVVFGFNRLSIIDIAHSH

SEQ ID NO: 97980 - protein, 17 aa, Mycobacterium avium
GTAAVWLALRGLRVLGL

SEQ ID NO: 97981 - protein, 22 aa, Mycobacterium avium
GTADMSIHFLAPIVDGPARAVA

SEQ ID NO: 97982 - protein, 34 aa, Mycobacterium avium
GTAFPTTMRLTGRWLRGRLPTAYDWARGIPVVDK

SEQ ID NO: 97983 - protein, 24 aa, Mycobacterium avium
GTAFWTCSGIGYALTPEELGGALG

SEQ ID NO: 97984 - protein, 20 aa, Mycobacterium avium
GTALALKLINNLLFAANAQL

SEQ ID NO: 97985 - protein, 17 aa, Mycobacterium avium
GTAPCGEIGFLVDDVDE

SEQ ID NO: 97986 - protein, 21 aa, Mycobacterium avium
GTAPGDAWTAAALAKAAAGEA

SEQ ID NO: 97987 - protein, 26 aa, Mycobacterium avium
GTAPNPMFLAWVISEDLKRLWPSLGT

SEQ ID NO: 97988 - protein, 38 aa, Mycobacterium avium
GTAPNPMFLAWVISEDLKRLWPSLGTALTSLADGADLL

SEQ ID NO: 97989 - protein, 22 aa, Mycobacterium avium
GTARLAVEQGRAALAVNWPYAL

SEQ ID NO: 97990 - protein, 17 aa, Mycobacterium avium
GTARLLSFPVDYASVTR

SEQ ID NO: 97991 - protein, 20 aa, Mycobacterium avium
GTARVSVCYMGVNGRDGTVF

SEQ ID NO: 97992 - protein, 21 aa, Mycobacterium avium
GTAVPCGRPAPGAVLETLREQ

SEQ ID NO: 97993 - protein, 20 aa, Mycobacterium avium
GTDCPIGIGGEVVVRGPDQF

SEQ ID NO: 97994 - protein, 26 aa, Mycobacterium avium
GTDLRHGLRIARCHALRAVAADSVGV

SEQ ID NO: 97995 - protein, 19 aa, Mycobacterium avium
GTDPRWTYGAATPGESVAA

SEQ ID NO: 97996 - protein, 24 aa, Mycobacterium avium
GTEIPVTVKFRIGIDDEHHTHLDA

SEQ ID NO: 97997 - protein, 19 aa, Mycobacterium avium
GTERPRGFLTGRVTGAQTG

SEQ ID NO: 97998 - protein, 24 aa, Mycobacterium avium
GTFLCTGMPFAFLGKPRRWLRRVP

SEQ ID NO: 97999 - protein, 26 aa, Mycobacterium avium
GTGAGVSGLWLLSGMSDDGVLTTIDI

SEQ ID NO: 98000 - protein, 17 aa, Mycobacterium avium
GTGAGYLKAEFEALGAD

SEQ ID NO: 98001 - protein, 18 aa, Mycobacterium avium
GTGAVPPSPFPVITNPAG

SEQ ID NO: 98002 - protein, 19 aa, Mycobacterium avium
GTGDWDVPVGGMGALTTAL

SEQ ID NO: 98003 - protein, 23 aa, Mycobacterium avium
GTGHSGIVPVVFTYAADSPLLSA

SEQ ID NO: 98004 - protein, 24 aa, Mycobacterium avium
GTGKSVFLKSLIGLLRPERGSVVI

SEQ ID NO: 98005 - protein, 20 aa, Mycobacterium avium
GTGPPPRPADREFPDGTLVP

SEQ ID NO: 98006 - protein, 21 aa, Mycobacterium avium
GTHPKYGFDRFWRNIRTHTLH

SEQ ID NO: 98007 - protein, 23 aa, Mycobacterium avium
GTHYPSVAVPVTFDEEGHPHFGA

SEQ ID NO: 98008 - protein, 17 aa, Mycobacterium avium
GTIASVLHNVRRAPKRV

SEQ ID NO: 98009 - protein, 18 aa, Mycobacterium avium
GTIGGGGKLEFTLIGDAV

SEQ ID NO: 98010 - protein, 22 aa, Mycobacterium avium
GTKAARQGDSWTLSGQKNPVLA

SEQ ID NO: 98011 - protein, 25 aa, Mycobacterium avium
GTLKYTLWRLQERVVGRGPNAPQVP

SEQ ID NO: 98012 - protein, 25 aa, Mycobacterium avium
GTLKYTLWRLQERVVGRGPNSPQVP

SEQ ID NO: 98013 - protein, 23 aa, Mycobacterium avium
GTLREVFDLAELILQSPMEISRP

SEQ ID NO: 98014 - protein, 18 aa, Mycobacterium avium
GTLRMRVIEQYRRPFDEI

SEQ ID NO: 98015 - protein, 22 aa, Mycobacterium avium
GTMLSWLFSGMFQRYPKLKIAL

SEQ ID NO: 98016 - protein, 17 aa, Mycobacterium avium
GTMRFATVVTEYRNAAG

SEQ ID NO: 98017 - protein, 20 aa, Mycobacterium avium
GTNITIWPGMNHRLPELWTD

SEQ ID NO: 98018 - protein, 24 aa, Mycobacterium avium
GTNPELRWKVGPVTNANGMLSTQV

SEQ ID NO: 98019 - protein, 31 aa, Mycobacterium avium
GTNRWPAVHRLDAATLFRLALEKAPAGTALH

SEQ ID NO: 98020 - protein, 24 aa, Mycobacterium avium
GTPAALRDRVRWHGWAAGPGPALA

SEQ ID NO: 98021 - protein, 24 aa, Mycobacterium avium
GTPAALRDRVRWHGWSAGPGPALA

SEQ ID NO: 98022 - protein, 18 aa, Mycobacterium avium
GTPAEYADAATFLLSNGY

SEQ ID NO: 98023 - protein, 30 aa, Mycobacterium avium
GTPCVLIRRGPRSRFAGVAFQAADEADLRR

SEQ ID NO: 98024 - protein, 21 aa, Mycobacterium avium
GTPELRAAIAADYRRQHGLEV

SEQ ID NO: 98025 - protein, 21 aa, Mycobacterium avium
GTPFQRLNFMVGKLNRAMQRN

SEQ ID NO: 98026 - protein, 26 aa, Mycobacterium avium
GTPLPDRPATTFADGRLSGTKIGVGY

SEQ ID NO: 98027 - protein, 24 aa, Mycobacterium avium
GTPPTLPPFMLADGVTSLNAAYAV

SEQ ID NO: 98028 - protein, 26 aa, Mycobacterium avium
GTPRRYGVRWHYRVPAWSEFVEVHWS

SEQ ID NO: 98029 - protein, 19 aa, Mycobacterium avium
GTPVEYVTYLAWRGLVTME

SEQ ID NO: 98030 - protein, 19 aa, Mycobacterium avium
GTPYLKFTREGAFAVCTLD

SEQ ID NO: 98031 - protein, 20 aa, Mycobacterium avium
GTPYVTPLVRKLAAENNIDL

SEQ ID NO: 98032 - protein, 24 aa, Mycobacterium avium
GTPYVTPLVRRLAAENDIDLSSIT

SEQ ID NO: 98033 - protein, 28 aa, Mycobacterium avium
GTQEGWPDILFYGPGTWGFGNGPNSTNM

SEQ ID NO: 98034 - protein, 20 aa, Mycobacterium avium
GTRACTATFWLLDAPDSLAE

SEQ ID NO: 98035 - protein, 23 aa, Mycobacterium avium
GTRLGMCGMEYFGHPWEFGPRRT

SEQ ID NO: 98036 - protein, 19 aa, Mycobacterium avium
GTRLRLPGGEEIYQDNDVV

SEQ ID NO: 98037 - protein, 19 aa, Mycobacterium avium
GTSALRLAPALGAARTIAV

SEQ ID NO: 98038 - protein, 19 aa, Mycobacterium avium
GTSFARWASRLAGHAHHPD

SEQ ID NO: 98039 - protein, 18 aa, Mycobacterium avium
GTSRLRCTCSPSTPSSRP

SEQ ID NO: 98040 - protein, 20 aa, Mycobacterium avium
GTSRLRLTARASLDDAELEV

SEQ ID NO: 98041 - protein, 21 aa, Mycobacterium avium
GTSRLRLTARASLDDAELEVA

SEQ ID NO: 98042 - protein, 19 aa, Mycobacterium avium
GTTSFYFRTRKALVHAMAG

SEQ ID NO: 98043 - protein, 24 aa, Mycobacterium avium
GTVKSRLLQTFTWALVPSQPDAGA

SEQ ID NO: 98044 - protein, 25 aa, Mycobacterium avium
GTVPRCAVALGLPPWTPAMDIVKAW

SEQ ID NO: 98045 - protein, 22 aa, Mycobacterium avium
GTVPVVGRFSLGGGLPDQADKP

SEQ ID NO: 98046 - protein, 18 aa, Mycobacterium avium
GTVSGLYVYEMVTARALV

SEQ ID NO: 98047 - protein, 19 aa, Mycobacterium avium
GTVTRWLKQEGDTVELDEP

SEQ ID NO: 98048 - protein, 18 aa, Mycobacterium avium
GTWHYWWQAHLLDCLVDA

SEQ ID NO: 98049 - protein, 19 aa, Mycobacterium avium
GTYAARLWLPMLRAERTTA

SEQ ID NO: 98050 - protein, 21 aa, Mycobacterium avium
GVAAALRRRFNVVAYDVRGAG

SEQ ID NO: 98051 - protein, 19 aa, Mycobacterium avium
GVAAMLASARLGRIAPVSR

SEQ ID NO: 98052 - protein, 17 aa, Mycobacterium avium
GVAARVRRGRPARAAGL

SEQ ID NO: 98053 - protein, 26 aa, Mycobacterium avium
GVADKRLETVLPFSWQGVSLHAAGAS

SEQ ID NO: 98054 - protein, 19 aa, Mycobacterium avium
GVAGHGFGASAAVFAAAGM

SEQ ID NO: 98055 - protein, 19 aa, Mycobacterium avium
GVANFLVLRTRRDGSRNGV

SEQ ID NO: 98056 - protein, 25 aa, Mycobacterium avium
GVASRALAMAVQWARERHQFGRPIG

SEQ ID NO: 98057 - protein, 20 aa, Mycobacterium avium
GVAVGLKWPNDVLAGPAGTP

SEQ ID NO: 98058 - protein, 18 aa, Mycobacterium avium
GVAYLRAPVLPFKVTGTR

SEQ ID NO: 98059 - protein, 23 aa, Mycobacterium avium
GVCQDFARLAIACLRAHGLAASY

SEQ ID NO: 98060 - protein, 17 aa, Mycobacterium avium
GVDAVIYDEEFTATVDR

SEQ ID NO: 98061 - protein, 28 aa, Mycobacterium avium
GVDDVYLFRACVDLAKLSWGKNHDAHDW

SEQ ID NO: 98062 - protein, 24 aa, Mycobacterium avium
GVDRLGYRLIRLSGQVSGRAELPP

SEQ ID NO: 98063 - protein, 22 aa, Mycobacterium avium
GVDVRLGVGVSEVRGDRHVEAV

SEQ ID NO: 98064 - protein, 20 aa, Mycobacterium avium
GVDVRLGVGVSEVRGDTHVE

SEQ ID NO: 98065 - protein, 21 aa, Mycobacterium avium
GVEAYGRLDVIVANAGICVPA

SEQ ID NO: 98066 - protein, 17 aa, Mycobacterium avium
GVFRIVEQLPRKVALEL

SEQ ID NO: 98067 - protein, 19 aa, Mycobacterium avium
GVGCALALACDLVVATRAA

SEQ ID NO: 98068 - protein, 24 aa, Mycobacterium avium
GVGFRWWTRCRALELGLTGYAANQ

SEQ ID NO: 98069 - protein, 20 aa, Mycobacterium avium
GVGIAHELLRAGATVVGCAR

SEQ ID NO: 98070 - protein, 25 aa, Mycobacterium avium
GVGIDELMKAAGMSHGGFYNHFPSK

SEQ ID NO: 98071 - protein, 25 aa, Mycobacterium avium
GVGKGDVVALWLPSGIDYATCYAAA

SEQ ID NO: 98072 - protein, 23 aa, Mycobacterium avium
GVGKGDVVVLWLPSGIDYATCYA

SEQ ID NO: 98073 - protein, 25 aa, Mycobacterium avium
GVGKTRLAGEWSRRAYEQGAVVLYG

SEQ ID NO: 98074 - protein, 18 aa, Mycobacterium avium
GVGLTVRYLTPHSKWSFH

SEQ ID NO: 98075 - protein, 22 aa, Mycobacterium avium
GVGPGERVALLFSRSVDAVVAM

SEQ ID NO: 98076 - protein, 24 aa, Mycobacterium avium
GVGPGERVALLFSRSVDAVVAMLA

SEQ ID NO: 98077 - protein, 26 aa, Mycobacterium avium
GVGRVHLLAHDWGSIQAWAAVTDKAV

SEQ ID NO: 98078 - protein, 26 aa, Mycobacterium avium
GVGRVHLLAHDWGSIQAWAAVTDQAI

SEQ ID NO: 98079 - protein, 26 aa, Mycobacterium avium
GVGRVHLLAHDWGSIQAWAAVTDQAV

SEQ ID NO: 98080 - protein, 25 aa, Mycobacterium avium
GVGSRALAMSVEWAGERQQFGRPIG

SEQ ID NO: 98081 - protein, 26 aa, Mycobacterium avium
GVGWLKEEYDAIGVPFTKRGRMADEY

SEQ ID NO: 98082 - protein, 19 aa, Mycobacterium avium
GVHAFYASSAREWWAPLRA

SEQ ID NO: 98083 - protein, 24 aa, Mycobacterium avium
GVHRPCYRGADLTAPFRADHDVEV

SEQ ID NO: 98084 - protein, 19 aa, Mycobacterium avium
GVHYCLGANLARLEERVAL

SEQ ID NO: 98085 - protein, 19 aa, Mycobacterium avium
GVHYCLGAPLARLEAGVAL

SEQ ID NO: 98086 - protein, 20 aa, Mycobacterium avium
GVIAPWLLSEYDRFALLHGD

SEQ ID NO: 98087 - protein, 18 aa, Mycobacterium avium
GVIGPLFRSALRAAEVRR

SEQ ID NO: 98088 - protein, 25 aa, Mycobacterium avium
GVLDGKRATTHWVAAELFSATYPNV

SEQ ID NO: 98089 - protein, 17 aa, Mycobacterium avium
GVLDLPALTALVADSRM

SEQ ID NO: 98090 - protein, 22 aa, Mycobacterium avium
GVLDRFPTLRIVAVETGASWLG

SEQ ID NO: 98091 - protein, 18 aa, Mycobacterium avium
GVLGEFTRSGYLPVADQC

SEQ ID NO: 98092 - protein, 21 aa, Mycobacterium avium
GVLKAGAAYVPMDPAVPAARI

SEQ ID NO: 98093 - protein, 22 aa, Mycobacterium avium
GVLTRLDLAFSRDNKDATKQYV

SEQ ID NO: 98094 - protein, 18 aa, Mycobacterium avium
GVMGGTFDPIHYGHLVAA

SEQ ID NO: 98095 - protein, 17 aa, Mycobacterium avium
GVMRIFEDFRYLREIGD

SEQ ID NO: 98096 - protein, 17 aa, Mycobacterium avium
GVNAVIYDEEFTATVDR

SEQ ID NO: 98097 - protein, 17 aa, Mycobacterium avium
GVNTNWAIARPPGQTKP

SEQ ID NO: 98098 - protein, 24 aa, Mycobacterium avium
GVPAIAKALRWQFDGVDRVGPDLL

SEQ ID NO: 98099 - protein, 17 aa, Mycobacterium avium
GVPCGLIANSTHHLGGA

SEQ ID NO: 98100 - protein, 23 aa, Mycobacterium avium
GVPDERVGFVLADAAPIAAITGT

SEQ ID NO: 98101 - protein, 18 aa, Mycobacterium avium
GVPEPAAALAAELGALAF

SEQ ID NO: 98102 - protein, 26 aa, Mycobacterium avium
GVPFVLRIKEGYAIDDYLRPGAKHDS

SEQ ID NO: 98103 - protein, 24 aa, Mycobacterium avium
GVPGRSVSRWGAFIDDVAGFDPEF

SEQ ID NO: 98104 - protein, 18 aa, Mycobacterium avium
GVRIKSTAITTVRGLAAH

SEQ ID NO: 98105 - protein, 18 aa, Mycobacterium avium
GVRIPARSVIGVCIGSAN

SEQ ID NO: 98106 - protein, 18 aa, Mycobacterium avium
GVRLLGCYHPSQQNMFTG

SEQ ID NO: 98107 - protein, 18 aa, Mycobacterium avium
GVRRFALRPVTGIDPAAV

SEQ ID NO: 98108 - protein, 24 aa, Mycobacterium avium
GVRRRYECRSLRFAAASGSRMRPD

SEQ ID NO: 98109 - protein, 24 aa, Mycobacterium avium
GVRSRLMLDIASWRRRRREELAAL

SEQ ID NO: 98110 - protein, 26 aa, Mycobacterium avium
GVRVICRRSRLMSRIAGAGAMASVEL

SEQ ID NO: 98111 - protein, 18 aa, Mycobacterium avium
GVRYRAFDLFEPGRPRMH

SEQ ID NO: 98112 - protein, 18 aa, Mycobacterium avium
GVRYRAFDLFEPGRPRMR

SEQ ID NO: 98113 - protein, 24 aa, Mycobacterium avium
GVSPRKPRVPVVIHEANASAGLAN

SEQ ID NO: 98114 - protein, 25 aa, Mycobacterium avium
GVSPRKPRVPVVIHEANASAGLANR

SEQ ID NO: 98115 - protein, 21 aa, Mycobacterium avium
GVSTGRFGIHPVLLDAALHAL

SEQ ID NO: 98116 - protein, 24 aa, Mycobacterium avium
GVSYWARGGIAAMLTEDGDELVRS

SEQ ID NO: 98117 - protein, 28 aa, Mycobacterium avium
GVTPAQVGLAWILARAPHTLLIPGTRSI

SEQ ID NO: 98118 - protein, 20 aa, Mycobacterium avium
GVTPTCWQFTDQALVAGITV

SEQ ID NO: 98119 - protein, 20 aa, Mycobacterium avium
GVTVLCCVSTQLTMLMADPA

SEQ ID NO: 98120 - protein, 19 aa, Mycobacterium avium
GVTVLEFGSMFAGPYGATL

SEQ ID NO: 98121 - protein, 22 aa, Mycobacterium avium
GVVADALLELGLPGLAVNVRDD

SEQ ID NO: 98122 - protein, 19 aa, Mycobacterium avium
GVVTFGRYFLGGGGAVHGG

SEQ ID NO: 98123 - protein, 17 aa, Mycobacterium avium
GVYLDIPGDVLGQAMDA

SEQ ID NO: 98124 - protein, 23 aa, Mycobacterium avium
GWCGLRKGEVFALRRGDVAADGS

SEQ ID NO: 98125 - protein, 25 aa, Mycobacterium avium
GWDEEFSGRLGAAGFTGLTIPQRYG

SEQ ID NO: 98126 - protein, 17 aa, Mycobacterium avium
GWFQVAWSDEIGVGDVH

SEQ ID NO: 98127 - protein, 31 aa, Mycobacterium avium
GWFTTKYPVALRMSRRLDWARVVAGEAALGA

SEQ ID NO: 98128 - protein, 19 aa, Mycobacterium avium
GWFTTKYPVALTVGALEWE

SEQ ID NO: 98129 - protein, 19 aa, Mycobacterium avium
GWGADWPTALEVVREIAKV

SEQ ID NO: 98130 - protein, 20 aa, Mycobacterium avium
GWLRPVPAGVVGELYVAGRG

SEQ ID NO: 98131 - protein, 17 aa, Mycobacterium avium
GWMSLAGAMGGHTVVAK

SEQ ID NO: 98132 - protein, 18 aa, Mycobacterium avium
GWRLHRVTAPSRLFGANG

SEQ ID NO: 98133 - protein, 18 aa, Mycobacterium avium
GWSLPVFVNELMTLYRAG

SEQ ID NO: 98134 - protein, 18 aa, Mycobacterium avium
GWSLPVLLQEVFAGYYGQ

SEQ ID NO: 98135 - protein, 26 aa, Mycobacterium avium
GWSMAQAAGIPVVFLTAYYGLSVLAG

SEQ ID NO: 98136 - protein, 18 aa, Mycobacterium avium
GWSVPILLNETFACYTGQ

SEQ ID NO: 98137 - protein, 17 aa, Mycobacterium avium
GYAAASIDGIRSASSNK

SEQ ID NO: 98138 - protein, 22 aa, Mycobacterium avium
GYAPCFAALAGLASLVGYPGGP

SEQ ID NO: 98139 - protein, 18 aa, Mycobacterium avium
GYAPRTAPQLVELLERRT

SEQ ID NO: 98140 - protein, 19 aa, Mycobacterium avium
GYCSDFGRTWIVGRDPSPR

SEQ ID NO: 98141 - protein, 26 aa, Mycobacterium avium
GYDLTRWLSEIDMELTWRGRAAAPEP

SEQ ID NO: 98142 - protein, 25 aa, Mycobacterium avium
GYDLTRWLSEIGMELTWRGRAAAPE

SEQ ID NO: 98143 - protein, 25 aa, Mycobacterium avium
GYDLTRWLSEIGMELTWRGRAAAPG

SEQ ID NO: 98144 - protein, 25 aa, Mycobacterium avium
GYDQGYRPPGGYPPPGGQPAGGPQG

SEQ ID NO: 98145 - protein, 23 aa, Mycobacterium avium
GYEGEGFPVVRAFAGVSTAALDP

SEQ ID NO: 98146 - protein, 20 aa, Mycobacterium avium
GYEPLAGRSVDDFNREFTIE

SEQ ID NO: 98147 - protein, 20 aa, Mycobacterium avium
GYERDARRAALMGYTGKWAI

SEQ ID NO: 98148 - protein, 18 aa, Mycobacterium avium
GYFDLAWAHAGGLPRPLM

SEQ ID NO: 98149 - protein, 22 aa, Mycobacterium avium
GYGGLRAARWLGVPTVAVYQTD

SEQ ID NO: 98150 - protein, 23 aa, Mycobacterium avium
GYGGLRAARWLGVPTVAVYQTDV

SEQ ID NO: 98151 - protein, 21 aa, Mycobacterium avium
GYGKTSWNVRAIWEMYTGWFR

SEQ ID NO: 98152 - protein, 33 aa, Mycobacterium avium
GYGYGPAFRGLRAVWRRGAETFAEVELPEQAGV

SEQ ID NO: 98153 - protein, 17 aa, Mycobacterium avium
GYHRVCASYHTDENTPI

SEQ ID NO: 98154 - protein, 19 aa, Mycobacterium avium
GYKCPRTVEFDTLPRDPNG

SEQ ID NO: 98155 - protein, 24 aa, Mycobacterium avium
GYLESWAVVGCEPSRMGIGPVRAV

SEQ ID NO: 98156 - protein, 25 aa, Mycobacterium avium
GYLGRPGLTAARFVACPFGDAGARM

SEQ ID NO: 98157 - protein, 36 aa, Mycobacterium avium
GYLGRPSLTAARFVACPFGAPGARMYRTGDLVRWRA

SEQ ID NO: 98158 - protein, 36 aa, Mycobacterium avium
GYLGRPSLTAARFVACPFGAPSARMYRTGDLVRWRA

SEQ ID NO: 98159 - protein, 17 aa, Mycobacterium avium
GYLIAADVVEFWQGREN

SEQ ID NO: 98160 - protein, 20 aa, Mycobacterium avium
GYMACLPRGRVRVVRHDLPD

SEQ ID NO: 98161 - protein, 20 aa, Mycobacterium avium
GYPVVPARVDALLIGMAERY

SEQ ID NO: 98162 - protein, 36 aa, Mycobacterium avium
GYQGPCPPAGTGTHHYRFTLYQLPNDYQLPAGLAGV

SEQ ID NO: 98163 - protein, 27 aa, Mycobacterium avium
GYRPMIGQCAGFAPDGLMVSSHQAGEI

SEQ ID NO: 98164 - protein, 24 aa, Mycobacterium avium
GYRRCSHRNPLWCSTIHDHTDPQV

SEQ ID NO: 98165 - protein, 30 aa, Mycobacterium avium
GYTAGDTDLAWARITYWRALLAAAVDLAPH

SEQ ID NO: 98166 - protein, 28 aa, Mycobacterium avium
GYTQHWELRIKPRFGHVPVDEISRGDVQ

SEQ ID NO: 98167 - protein, 18 aa, Mycobacterium avium
GYTYGGRIAALADAAREN

SEQ ID NO: 98168 - protein, 19 aa, Mycobacterium avium
GYWPDLRLVVEFQEEQHSQ

SEQ ID NO: 98169 - protein, 18 aa, Mycobacterium avium
GYYLPVADQCAGFATGGL

SEQ ID NO: 98170 - protein, 23 aa, Mycobacterium avium
HAAGAAAVRARIVPVSPSAVSIE

SEQ ID NO: 98171 - protein, 24 aa, Mycobacterium avium
HAAGTAFDPGWWRRAAELGWTGLL

SEQ ID NO: 98172 - protein, 20 aa, Mycobacterium avium
HAAIFPACRAVVHHGGAGTT

SEQ ID NO: 98173 - protein, 17 aa, Mycobacterium avium
HAAKVLNLRSTLLTLAG

SEQ ID NO: 98174 - protein, 22 aa, Mycobacterium avium
HAARGRVGWFALDADRRIALGA

SEQ ID NO: 98175 - protein, 21 aa, Mycobacterium avium
HAASAFAYAFPVEVARDQHGR

SEQ ID NO: 98176 - protein, 27 aa, Mycobacterium avium
HAEATLLRCTRGAIVAAAVDVRPDSLT

SEQ ID NO: 98177 - protein, 18 aa, Mycobacterium avium
HAFDGVGVRVSRYSYLVS

SEQ ID NO: 98178 - protein, 17 aa, Mycobacterium avium
HAFFRQYYNLRALLARL

SEQ ID NO: 98179 - protein, 17 aa, Mycobacterium avium
HAFFRQYYNLRALLVRL

SEQ ID NO: 98180 - protein, 19 aa, Mycobacterium avium
HAGAAFFVPTIIKGGELVV

SEQ ID NO: 98181 - protein, 31 aa, Mycobacterium avium
HAGASPRFYASWCRLLPAGVDLYGVTYPGRD

SEQ ID NO: 98182 - protein, 22 aa, Mycobacterium avium
HAGDCWDLVIAELRRQEPGLRT

SEQ ID NO: 98183 - protein, 19 aa, Mycobacterium avium
HAGDIQWNFEKFLISPDGE

SEQ ID NO: 98184 - protein, 26 aa, Mycobacterium avium
HAGLSSRAEWLPAWEDGLARASAAID

SEQ ID NO: 98185 - protein, 24 aa, Mycobacterium avium
HAHGLPALSVAWGMWEEPSAMTAH

SEQ ID NO: 98186 - protein, 17 aa, Mycobacterium avium
HALCASGALGERSGAGY

SEQ ID NO: 98187 - protein, 19 aa, Mycobacterium avium
HALGVPATRSLAVVGTGRP

SEQ ID NO: 98188 - protein, 27 aa, Mycobacterium avium
HALKEWKGNPGLPLLRYMIANRIPFGV

SEQ ID NO: 98189 - protein, 17 aa, Mycobacterium avium
HAMLRLRVDTAADTGEW

SEQ ID NO: 98190 - protein, 17 aa, Mycobacterium avium
HANWKMVVENNVDGYHA

SEQ ID NO: 98191 - protein, 20 aa, Mycobacterium avium
HAPDADWGVVYARTGEGRHG

SEQ ID NO: 98192 - protein, 20 aa, Mycobacterium avium
HAPDADWGVVYARTGEGRNG

SEQ ID NO: 98193 - protein, 23 aa, Mycobacterium avium
HAPPERLLRCIEAVLECREALAV

SEQ ID NO: 98194 - protein, 23 aa, Mycobacterium avium
HARFGKLPFERLFAPAIAYGRNG

SEQ ID NO: 98195 - protein, 23 aa, Mycobacterium avium
HARFGKLPFERLFAPAISYGRNG

SEQ ID NO: 98196 - protein, 21 aa, Mycobacterium avium
HARGLGVLIDAVFNHLGPSGN

SEQ ID NO: 98197 - protein, 26 aa, Mycobacterium avium
HARGMPWEFECLVAYPDGTTDIYHTD

SEQ ID NO: 98198 - protein, 28 aa, Mycobacterium avium
HARLLALRYRLRHGVGLAGLRGPGSDRA

SEQ ID NO: 98199 - protein, 29 aa, Mycobacterium avium
HARLLALRYRLRHGVGLAGLRGPGSDRAA

SEQ ID NO: 98200 - protein, 18 aa, Mycobacterium avium
HASGWGPHLIRLLHHAEH

SEQ ID NO: 98201 - protein, 19 aa, Mycobacterium avium
HASSRMDFVLADAAPSAVI

SEQ ID NO: 98202 - protein, 20 aa, Mycobacterium avium
HATELLAVFDVYRTRFGALL

SEQ ID NO: 98203 - protein, 17 aa, Mycobacterium avium
HATVFGAFDAVPDGGAL

SEQ ID NO: 98204 - protein, 17 aa, Mycobacterium avium
HAVAGTVLFPGAGFVEL

SEQ ID NO: 98205 - protein, 28 aa, Mycobacterium avium
HAVCMVGLVEPRLRVAITSGQCDGGQSA

SEQ ID NO: 98206 - protein, 21 aa, Mycobacterium avium
HAVELRPGGGAKLALSAGSSI

SEQ ID NO: 98207 - protein, 22 aa, Mycobacterium avium
HAVHPIALYLNDLVRFGMRLPT

SEQ ID NO: 98208 - protein, 19 aa, Mycobacterium avium
HAVMYDFPDSIGLQRITRE

SEQ ID NO: 98209 - protein, 20 aa, Mycobacterium avium
HAVQPVIERAWPAVIRVAKQ

SEQ ID NO: 98210 - protein, 17 aa, Mycobacterium avium
HAVRGRVDAVDFAGRTL

SEQ ID NO: 98211 - protein, 33 aa, Mycobacterium avium
HAWHLALAGLRRGEICGLEWADVQLDDDRDAGT

SEQ ID NO: 98212 - protein, 26 aa, Mycobacterium avium
HCADMAVAVEAGRATLWAAALALDTA

SEQ ID NO: 98213 - protein, 23 aa, Mycobacterium avium
HCFAGKDRTGFVVATVLEAIGVD

SEQ ID NO: 98214 - protein, 24 aa, Mycobacterium avium
HCGDLLLMREGRLVAHTTPNRLRE

SEQ ID NO: 98215 - protein, 21 aa, Mycobacterium avium
HCQQVLGGIGFTAEHPLHHHI

SEQ ID NO: 98216 - protein, 17 aa, Mycobacterium avium
HCRNIGKHFGLYDSAIF

SEQ ID NO: 98217 - protein, 17 aa, Mycobacterium avium
HDAGGRYGLAGILIQLA

SEQ ID NO: 98218 - protein, 23 aa, Mycobacterium avium
HDAGKIVLRRSRPLQISLDGHDS

SEQ ID NO: 98219 - protein, 23 aa, Mycobacterium avium
HDAGKIVLRRSRPLQISLDGHDT

SEQ ID NO: 98220 - protein, 22 aa, Mycobacterium avium
HDAHLYVRHAWQTAALLGDSRA

SEQ ID NO: 98221 - protein, 17 aa, Mycobacterium avium
HDARFVLIGTMNPEEGE

SEQ ID NO: 98222 - protein, 19 aa, Mycobacterium avium
HDDELIAALTPVFATKTKL

SEQ ID NO: 98223 - protein, 24 aa, Mycobacterium avium
HDDHRIGTGVLRQWERHTAGSFAV

SEQ ID NO: 98224 - protein, 26 aa, Mycobacterium avium
HDEPRMSVGQHRMWFVQSVDPDSALL

SEQ ID NO: 98225 - protein, 27 aa, Mycobacterium avium
HDGDPWAWHAMSPLPIHGMRRRRRIDV

SEQ ID NO: 98226 - protein, 23 aa, Mycobacterium avium
HDGVLRLTIPVAEKAKPRRIEIN

SEQ ID NO: 98227 - protein, 19 aa, Mycobacterium avium
HDHRIATGVLRQWERHTAG

SEQ ID NO: 98228 - protein, 27 aa, Mycobacterium avium
HDIETPAPVQIRFGIDFVAASLADATV

SEQ ID NO: 98229 - protein, 26 aa, Mycobacterium avium
HDLADWRWGIDVNVLGVIHGLKAFVP

SEQ ID NO: 98230 - protein, 22 aa, Mycobacterium avium
HDLGRYLGAYGHRDVSSPRLDR

SEQ ID NO: 98231 - protein, 27 aa, Mycobacterium avium
HDLHLYLRRVTLYRGMFGTPEEHNLRV

SEQ ID NO: 98232 - protein, 25 aa, Mycobacterium avium
HDLPDERWALLPLVPLIPKRVFRRL

SEQ ID NO: 98233 - protein, 19 aa, Mycobacterium avium
HDLRHAAGVMAAQTGATVR

SEQ ID NO: 98234 - protein, 18 aa, Mycobacterium avium
HDLVAFSMLYGGVDSQRP

SEQ ID NO: 98235 - protein, 30 aa, Mycobacterium avium
HDPRRFATDLLERFRDLILLQAVPDAASRG

SEQ ID NO: 98236 - protein, 26 aa, Mycobacterium avium
HDRNRISGGLGVRFARPGETVVTLDD

SEQ ID NO: 98237 - protein, 17 aa, Mycobacterium avium
HDSCGAVKAALGAIEEG

SEQ ID NO: 98238 - protein, 24 aa, Mycobacterium avium
HDVGEHWRSRIPAVTHVDGTARIQ

SEQ ID NO: 98239 - protein, 17 aa, Mycobacterium avium
HDWGARAVLDRPATRTS

SEQ ID NO: 98240 - protein, 17 aa, Mycobacterium avium
HDWRVGKKLLAWERPLR

SEQ ID NO: 98241 - protein, 21 aa, Mycobacterium avium
HDYGRVLAMIGVHSREPIVEL

SEQ ID NO: 98242 - protein, 27 aa, Mycobacterium avium
HDYNHAFCFLRGAGLVQLGEHCWETKA

SEQ ID NO: 98243 - protein, 18 aa, Mycobacterium avium
HEAGCARWVDAPDPPLHV

SEQ ID NO: 98244 - protein, 22 aa, Mycobacterium avium
HEAKVDWILRNSFPLRSTAELS

SEQ ID NO: 98245 - protein, 25 aa, Mycobacterium avium
HEFLRKRLPHLTKRQRFWVSLYYPL

SEQ ID NO: 98246 - protein, 17 aa, Mycobacterium avium
HEGRFFVQPTMLYAHPE

SEQ ID NO: 98247 - protein, 17 aa, Mycobacterium avium
HEHPSRIIVTLRGNPYA

SEQ ID NO: 98248 - protein, 17 aa, Mycobacterium avium
HEIIGRMLPLVLLEGRA

SEQ ID NO: 98249 - protein, 22 aa, Mycobacterium avium
HEIRMAVPPNYIRFVESAGLSA

SEQ ID NO: 98250 - protein, 25 aa, Mycobacterium avium
HEIVSAYFPLGWQLACHVQGDAGVD

SEQ ID NO: 98251 - protein, 17 aa, Mycobacterium avium
HELAALVALTHCLVVDL

SEQ ID NO: 98252 - protein, 17 aa, Mycobacterium avium
HELAKYTICRPESLPAQ

SEQ ID NO: 98253 - protein, 18 aa, Mycobacterium avium
HELFFSNLVAHCLEYTRD

SEQ ID NO: 98254 - protein, 17 aa, Mycobacterium avium
HELGRRGMKIAVLDVDE

SEQ ID NO: 98255 - protein, 17 aa, Mycobacterium avium
HELGRRGMKIAVLDVNE

SEQ ID NO: 98256 - protein, 19 aa, Mycobacterium avium
HENELRKKVNTYLADQDTE

SEQ ID NO: 98257 - protein, 18 aa, Mycobacterium avium
HEPFRGQVHPAEIAVAQR

SEQ ID NO: 98258 - protein, 25 aa, Mycobacterium avium
HESCGKCTPCREGTFWLDQIYERLE

SEQ ID NO: 98259 - protein, 20 aa, Mycobacterium avium
HEVAALPAAAYCEIALTAAH

SEQ ID NO: 98260 - protein, 22 aa, Mycobacterium avium
HEYRPFRALIRAVLRHAGGVRI

SEQ ID NO: 98261 - protein, 19 aa, Mycobacterium avium
HFAANACSYRGKPADFVAS

SEQ ID NO: 98262 - protein, 21 aa, Mycobacterium avium
HFGGGRAQTWLTPNGPVDAKI

SEQ ID NO: 98263 - protein, 22 aa, Mycobacterium avium
HFGGGRAQTWLTPNGPVDAKII

SEQ ID NO: 98264 - protein, 18 aa, Mycobacterium avium
HFGVGGFHRAHQAMYLDR

SEQ ID NO: 98265 - protein, 17 aa, Mycobacterium avium
HGAAQGHEALRNWAAAR

SEQ ID NO: 98266 - protein, 17 aa, Mycobacterium avium
HGAAQGHEALRNWAGAR

SEQ ID NO: 98267 - protein, 26 aa, Mycobacterium avium
HGAGPGQSVALLFSRSAHAIVAILAV

SEQ ID NO: 98268 - protein, 17 aa, Mycobacterium avium
HGARLPAAAAVDLPAAP

SEQ ID NO: 98269 - protein, 25 aa, Mycobacterium avium
HGARLSVVVDHTWRAEALADMISEA

SEQ ID NO: 98270 - protein, 19 aa, Mycobacterium avium
HGDEGKFVRCETIAEFLDA

SEQ ID NO: 98271 - protein, 23 aa, Mycobacterium avium
HGDHPRWSVKVQIMPFEDAKTYR

SEQ ID NO: 98272 - protein, 23 aa, Mycobacterium avium
HGEAALLRLAEELAIPVLMNGMA

SEQ ID NO: 98273 - protein, 19 aa, Mycobacterium avium
HGEAALLRLAEELATPVLM

SEQ ID NO: 98274 - protein, 19 aa, Mycobacterium avium
HGEAVSRPRMKIVGLDALL

SEQ ID NO: 98275 - protein, 22 aa, Mycobacterium avium
HGFRYFDNRDLLGFVDGTENPD

SEQ ID NO: 98276 - protein, 33 aa, Mycobacterium avium
HGGPGGRPGCWQKITRDLWPAPYLVMDTGASLA

SEQ ID NO: 98277 - protein, 17 aa, Mycobacterium avium
HGGQVIMLNRAVVGTDP

SEQ ID NO: 98278 - protein, 25 aa, Mycobacterium avium
HGHPSTLHLWWARRPLAAARAVLFA

SEQ ID NO: 98279 - protein, 19 aa, Mycobacterium avium
HGIGRGHALELAKHGATVI

SEQ ID NO: 98280 - protein, 18 aa, Mycobacterium avium
HGKALALYHTKRLASPAQ

SEQ ID NO: 98281 - protein, 24 aa, Mycobacterium avium
HGLAEGIAAWLLDRDRPAALGLVG

SEQ ID NO: 98282 - protein, 20 aa, Mycobacterium avium
HGLCTPRIVSPIQMQSLPWW

SEQ ID NO: 98283 - protein, 30 aa, Mycobacterium avium
HGLMTCGSVWACPRCSAVIANTRAAEIGAT

SEQ ID NO: 98284 - protein, 17 aa, Mycobacterium avium
HGMKTLMGQSKWLDEFD

SEQ ID NO: 98285 - protein, 23 aa, Mycobacterium avium
HGPQLHANWTWAPSALNRDQVTR

SEQ ID NO: 98286 - protein, 20 aa, Mycobacterium avium
HGQLPNMRAIVGFAAETGDA

SEQ ID NO: 98287 - protein, 24 aa, Mycobacterium avium
HGQLRIGMAASFVRCEDPALLAHA

SEQ ID NO: 98288 - protein, 24 aa, Mycobacterium avium
HGQLRIGMAASFVRCEDPALLAQV

SEQ ID NO: 98289 - protein, 23 aa, Mycobacterium avium
HGRFMRIRVFDCWMHEQDIRVAL

SEQ ID NO: 98290 - protein, 19 aa, Mycobacterium avium
HGRGVRLLINFSLNNEAFG

SEQ ID NO: 98291 - protein, 17 aa, Mycobacterium avium
HGRHYRLDSGWTDRPEF

SEQ ID NO: 98292 - protein, 21 aa, Mycobacterium avium
HGRSGPILVRRTREMTGTTER

SEQ ID NO: 98293 - protein, 20 aa, Mycobacterium avium
HGSITWPAPLLPPVTELLST

SEQ ID NO: 98294 - protein, 19 aa, Mycobacterium avium
HGTGFNWPAPDHLRIVTLP

SEQ ID NO: 98295 - protein, 25 aa, Mycobacterium avium
HGTRVYRARVYYRGRYVASRTFSRK

SEQ ID NO: 98296 - protein, 18 aa, Mycobacterium avium
HGTYRIVIEGEPHIHCDL

SEQ ID NO: 98297 - protein, 26 aa, Mycobacterium avium
HGVTRAAVLLAAYTLVLRRWASQDDF

SEQ ID NO: 98298 - protein, 21 aa, Mycobacterium avium
HGYCGPFRRPTGWNPWRSQAR

SEQ ID NO: 98299 - protein, 17 aa, Mycobacterium avium
HHKGRKAIAASYVPLFR

SEQ ID NO: 98300 - protein, 17 aa, Mycobacterium avium
HHPGRTKAWLQGHRDGN

SEQ ID NO: 98301 - protein, 17 aa, Mycobacterium avium
HHPGRTKAWLQGHRDGS

SEQ ID NO: 98302 - protein, 31 aa, Mycobacterium avium
HHRARLLALRYRLRHGVGMAGLRGPGSDRAA

SEQ ID NO: 98303 - protein, 19 aa, Mycobacterium avium
HHRGPFLGCTALRESIQAA

SEQ ID NO: 98304 - protein, 24 aa, Mycobacterium avium
HHRHVGLAHPRRGGQHHGLVELVD

SEQ ID NO: 98305 - protein, 17 aa, Mycobacterium avium
HHRKLMVASAVHETLVD

SEQ ID NO: 98306 - protein, 17 aa, Mycobacterium avium
HHVKTTIKILGLVDKEI

SEQ ID NO: 98307 - protein, 25 aa, Mycobacterium avium
HIADEIKGRILAMAQPDAQGNRPDV

SEQ ID NO: 98308 - protein, 25 aa, Mycobacterium avium
HILTSAWTCFSRGGFHATSMDDVIA

SEQ ID NO: 98309 - protein, 21 aa, Mycobacterium avium
HIRRRGWQGAAVVEAEVDDDD

SEQ ID NO: 98310 - protein, 17 aa, Mycobacterium avium
HISHGRAGWQVRVSATE

SEQ ID NO: 98311 - protein, 35 aa, Mycobacterium avium
HIYLEEIFLFPPLREAGIVMPIFVMMREHGQLWHT

SEQ ID NO: 98312 - protein, 25 aa, Mycobacterium avium
HKFDRCSWHPGPHRLPILDDAAAWF

SEQ ID NO: 98313 - protein, 22 aa, Mycobacterium avium
HKGARLTTQVSLAGRYLVYVPG

SEQ ID NO: 98314 - protein, 18 aa, Mycobacterium avium
HKKPEWIRPIGSPVGAVD

SEQ ID NO: 98315 - protein, 21 aa, Mycobacterium avium
HKRLTLFLIPMDRPGFTVRPI

SEQ ID NO: 98316 - protein, 19 aa, Mycobacterium avium
HKVSPWRLNEYWSAVREPD

SEQ ID NO: 98317 - protein, 18 aa, Mycobacterium avium
HLAGLPGPTLLAASLGSA

SEQ ID NO: 98318 - protein, 18 aa, Mycobacterium avium
HLAGLPGPTLLAASLGSV

SEQ ID NO: 98319 - protein, 17 aa, Mycobacterium avium
HLARLELNVAFQMLYAR

SEQ ID NO: 98320 - protein, 23 aa, Mycobacterium avium
HLDGVRWPDIVSRVFGRIDPIAA

SEQ ID NO: 98321 - protein, 23 aa, Mycobacterium avium
HLDGVRWPDIVSRVFGRIDPIAL

SEQ ID NO: 98322 - protein, 18 aa, Mycobacterium avium
HLEACPGCFKHYGLEERI

SEQ ID NO: 98323 - protein, 24 aa, Mycobacterium avium
HLEIGQPLATEFVWGRQYGENTIN

SEQ ID NO: 98324 - protein, 19 aa, Mycobacterium avium
HLEIRWDGQVALLSDLNST

SEQ ID NO: 98325 - protein, 24 aa, Mycobacterium avium
HLIDWKGNDWYAGKTETPAAHPNS

SEQ ID NO: 98326 - protein, 22 aa, Mycobacterium avium
HLPEIRGGRELWCQLFSEPGAG

SEQ ID NO: 98327 - protein, 17 aa, Mycobacterium avium
HLQRQGIGVARCTVERL

SEQ ID NO: 98328 - protein, 24 aa, Mycobacterium avium
HLRPNHTFRLPGADVPIIMVGPGT

SEQ ID NO: 98329 - protein, 36 aa, Mycobacterium avium
HLTTAIEVLKNFPFTEQRGATLIAREPIGVCGLITP

SEQ ID NO: 98330 - protein, 17 aa, Mycobacterium avium
HLTYRYGQFTAVDDVTL

SEQ ID NO: 98331 - protein, 20 aa, Mycobacterium avium
HLVCRSCGSTIEVSDHEVEE

SEQ ID NO: 98332 - protein, 24 aa, Mycobacterium avium
HLVGAFRLASAVLPGMLKRQRGDL

SEQ ID NO: 98333 - protein, 18 aa, Mycobacterium avium
HMALNAMGALLAAIEIGA

SEQ ID NO: 98334 - protein, 20 aa, Mycobacterium avium
HMVHLYRYRDMLPLPARATV

SEQ ID NO: 98335 - protein, 22 aa, Mycobacterium avium
HNAEVLGALGLSAQEIAALREQ

SEQ ID NO: 98336 - protein, 25 aa, Mycobacterium avium
HNGELPAVRVGRSFRVHAKAVHDML

SEQ ID NO: 98337 - protein, 18 aa, Mycobacterium avium
HNGLRVVAVQAFVGADRD

SEQ ID NO: 98338 - protein, 18 aa, Mycobacterium avium
HNLIHGFILADQHLTPGG

SEQ ID NO: 98339 - protein, 21 aa, Mycobacterium avium
HNRLRIGGLDGQLAQLLGEQL

SEQ ID NO: 98340 - protein, 22 aa, Mycobacterium avium
HNRLRIGGLDGQLARLLGEQLG

SEQ ID NO: 98341 - protein, 27 aa, Mycobacterium avium
HNWGRFRWGDDFGWTWGTILPAEPDDP

SEQ ID NO: 98342 - protein, 30 aa, Mycobacterium avium
HPAARGLGVLLCFAGRVLQPLGLSKVATED

SEQ ID NO: 98343 - protein, 31 aa, Mycobacterium avium
HPAARGLGVLLCFAGRVLQPLGLSKVATEDL

SEQ ID NO: 98344 - protein, 19 aa, Mycobacterium avium
HPAFTAWRYNSAAYRELSE

SEQ ID NO: 98345 - protein, 21 aa, Mycobacterium avium
HPAGSVLIEFGHTKVMCTASV

SEQ ID NO: 98346 - protein, 21 aa, Mycobacterium avium
HPCDVFRRHVWINPFHEEDMS

SEQ ID NO: 98347 - protein, 19 aa, Mycobacterium avium
HPDDARLGPPLQVVVTAVR

SEQ ID NO: 98348 - protein, 23 aa, Mycobacterium avium
HPDDRARVAATIDEIVTNHQAFS

SEQ ID NO: 98349 - protein, 25 aa, Mycobacterium avium
HPDLEILNHGLTLWDLDRVFKVNGF

SEQ ID NO: 98350 - protein, 18 aa, Mycobacterium avium
HPDLKVLISEGGATWVPF

SEQ ID NO: 98351 - protein, 20 aa, Mycobacterium avium
HPDRHRPGAMVLGVERKPGL

SEQ ID NO: 98352 - protein, 24 aa, Mycobacterium avium
HPDTCRKLAKRAAALGVSVVDAPV

SEQ ID NO: 98353 - protein, 20 aa, Mycobacterium avium
HPDVIARLTGDWVDLTTRPA

SEQ ID NO: 98354 - protein, 31 aa, Mycobacterium avium
HPELVTPVVVYLCHRSCDRTAHIYSVGAGKV

SEQ ID NO: 98355 - protein, 19 aa, Mycobacterium avium
HPEYTRALISLSRGGSDAC

SEQ ID NO: 98356 - protein, 19 aa, Mycobacterium avium
HPFKRARTTFTYLAVATNG

SEQ ID NO: 98357 - protein, 17 aa, Mycobacterium avium
HPGGEPQLLLLAPEGEE

SEQ ID NO: 98358 - protein, 19 aa, Mycobacterium avium
HPGHAVARAQMRRFGGLVA

SEQ ID NO: 98359 - protein, 17 aa, Mycobacterium avium
HPGQADVPWPCDHTKYI

SEQ ID NO: 98360 - protein, 19 aa, Mycobacterium avium
HPLAGLVHLGEGCDVRPVL

SEQ ID NO: 98361 - protein, 26 aa, Mycobacterium avium
HPLAHLRAFVLIPWLAVDPDAQLTVA

SEQ ID NO: 98362 - protein, 18 aa, Mycobacterium avium
HPLGGRSMLSHLLHAIAK

SEQ ID NO: 98363 - protein, 21 aa, Mycobacterium avium
HPMFVPWLVGPLLTGDGVHLV

SEQ ID NO: 98364 - protein, 18 aa, Mycobacterium avium
HPMLRVRFLPDGTQRITP

SEQ ID NO: 98365 - protein, 17 aa, Mycobacterium avium
HPMTVEWISYAQSLTDK

SEQ ID NO: 98366 - protein, 20 aa, Mycobacterium avium
HPPGPACWRCRSTDVAPEPV

SEQ ID NO: 98367 - protein, 18 aa, Mycobacterium avium
HPPPAVPPCPGPLGERAD

SEQ ID NO: 98368 - protein, 22 aa, Mycobacterium avium
HPRPDFKTRILQAFNDGMKHRP

SEQ ID NO: 98369 - protein, 22 aa, Mycobacterium avium
HPSPRSKRVLLQGWEQFDEKVD

SEQ ID NO: 98370 - protein, 22 aa, Mycobacterium avium
HPVEVWGWDEAYLAVTATDPIE

SEQ ID NO: 98371 - protein, 23 aa, Mycobacterium avium
HPVLEWITGTALVPVRDRLDDDA

SEQ ID NO: 98372 - protein, 23 aa, Mycobacterium avium
HPVLEWITGTALVPVRERLDDDA

SEQ ID NO: 98373 - protein, 24 aa, Mycobacterium avium
HPWQETRPGFFGSDVYVRREPVGV

SEQ ID NO: 98374 - protein, 19 aa, Mycobacterium avium
HQFTKDEVQAIVAALDVAG

SEQ ID NO: 98375 - protein, 18 aa, Mycobacterium avium
HQGWILNALWLLDTGITA

SEQ ID NO: 98376 - protein, 28 aa, Mycobacterium avium
HQIVLWCMGESHAGVVLDALANRYGVTV

SEQ ID NO: 98377 - protein, 26 aa, Mycobacterium avium
HQLIRYGAGPGRCVAVLLERSAEAVA

SEQ ID NO: 98378 - protein, 28 aa, Mycobacterium avium
HQPRPPWLMSACAPAPVGDTPAVGEADR

SEQ ID NO: 98379 - protein, 24 aa, Mycobacterium avium
HQQSRWIIEPVLRLLDCCQESDGG

SEQ ID NO: 98380 - protein, 17 aa, Mycobacterium avium
HQVEFVLNQRHRGGQKV

SEQ ID NO: 98381 - protein, 21 aa, Mycobacterium avium
HRADALVGHLGRPVAGADHPG

SEQ ID NO: 98382 - protein, 31 aa, Mycobacterium avium
HRAFARIAPMLWLRAGARGPIITEIGDKGWD

SEQ ID NO: 98383 - protein, 23 aa, Mycobacterium avium
HRAGLRCPGDLAVMGVDASPMGM

SEQ ID NO: 98384 - protein, 18 aa, Mycobacterium avium
HRAIPGSRLCVIADGPHG

SEQ ID NO: 98385 - protein, 20 aa, Mycobacterium avium
HRAPGPLPFAGLRVLDLTTY

SEQ ID NO: 98386 - protein, 21 aa, Mycobacterium avium
HRCAGGLRGPARDGGDRHGQP

SEQ ID NO: 98387 - protein, 18 aa, Mycobacterium avium
HRELPLRAEYVGKNVPTS

SEQ ID NO: 98388 - protein, 18 aa, Mycobacterium avium
HRGGCGLGQRRTVAPPVD

SEQ ID NO: 98389 - protein, 17 aa, Mycobacterium avium
HRGPFLGCTALRESIQA

SEQ ID NO: 98390 - protein, 23 aa, Mycobacterium avium
HRHRGCAIPGCGATRGLHAHHLR

SEQ ID NO: 98391 - protein, 26 aa, Mycobacterium avium
HRHRGCAIPGCGATRGLQAHHLRHWE

SEQ ID NO: 98392 - protein, 24 aa, Mycobacterium avium
HRHWSLPVFVEWASGALIPCSCVG

SEQ ID NO: 98393 - protein, 20 aa, Mycobacterium avium
HRIALCGNLSGGQRTRVSLA

SEQ ID NO: 98394 - protein, 27 aa, Mycobacterium avium
HRLDWAGVFAGLPARRVDLPTYAFARE

SEQ ID NO: 98395 - protein, 27 aa, Mycobacterium avium
HRLDWAGVFAGLPARRVELPTYAFARE

SEQ ID NO: 98396 - protein, 18 aa, Mycobacterium avium
HRLPRTSTVLDMRVDLVI

SEQ ID NO: 98397 - protein, 19 aa, Mycobacterium avium
HRLSALGAVVTRVVHGKSD

SEQ ID NO: 98398 - protein, 20 aa, Mycobacterium avium
HRLSALGAVVTRVVRGTSDS

SEQ ID NO: 98399 - protein, 20 aa, Mycobacterium avium
HRLSAMLWLTVAPRDVHTVG

SEQ ID NO: 98400 - protein, 18 aa, Mycobacterium avium
HRPAPRPENVTSRLIELF

SEQ ID NO: 98401 - protein, 18 aa, Mycobacterium avium
HRPAPRPENVTSRLIERF

SEQ ID NO: 98402 - protein, 26 aa, Mycobacterium avium
HRPGIPYPEWNMWTQRFMHDHVAVVE

SEQ ID NO: 98403 - protein, 17 aa, Mycobacterium avium
HRPRPRNLDGLRKNLRL

SEQ ID NO: 98404 - protein, 35 aa, Mycobacterium avium
HRRCARPHAAICCTECSRARLNAVSTATMARYSHA

SEQ ID NO: 98405 - protein, 25 aa, Mycobacterium avium
HRREEFRASRIMLERARANDKITIV

SEQ ID NO: 98406 - protein, 28 aa, Mycobacterium avium
HRREFRRKVALCLDVFATMLARSCFESE

SEQ ID NO: 98407 - protein, 19 aa, Mycobacterium avium
HRRLGRWVQLGGHCDDDAG

SEQ ID NO: 98408 - protein, 18 aa, Mycobacterium avium
HRTAWIDDWLPAELNRAG

SEQ ID NO: 98409 - protein, 23 aa, Mycobacterium avium
HRTGWRGGGLAGRGGGGPCRQRP

SEQ ID NO: 98410 - protein, 26 aa, Mycobacterium avium
HRVAAKLRAGTVWVNAYRVVAPHVPF

SEQ ID NO: 98411 - protein, 19 aa, Mycobacterium avium
HRVAARLNAGTVWVNAYRV

SEQ ID NO: 98412 - protein, 25 aa, Mycobacterium avium
HRVDIEFPSPALIYGYGAYEICIDP

SEQ ID NO: 98413 - protein, 18 aa, Mycobacterium avium
HRVFLNLLRERFETDKTK

SEQ ID NO: 98414 - protein, 18 aa, Mycobacterium avium
HRVHVVHAVVALRGAGVE

SEQ ID NO: 98415 - protein, 24 aa, Mycobacterium avium
HRVPRRLQIQLGLRVQVGLQGQQR

SEQ ID NO: 98416 - protein, 27 aa, Mycobacterium avium
HRVRPRLPDGFRFVLRLFGADVQLRRG

SEQ ID NO: 98417 - protein, 36 aa, Mycobacterium avium
HRVVGRPAAHPGLRRAPPLRLGHRAVTGERVQVGDR

SEQ ID NO: 98418 - protein, 20 aa, Mycobacterium avium
HRYSGAFAYEGDDWYERSPI

SEQ ID NO: 98419 - protein, 21 aa, Mycobacterium avium
HSACAQFGLWQSRGVGKGAVL

SEQ ID NO: 98420 - protein, 25 aa, Mycobacterium avium
HSADRLIVIYADFKGEAGADSFRNF

SEQ ID NO: 98421 - protein, 24 aa, Mycobacterium avium
HSAWPSKLRPTLRNVDVGIALTLP

SEQ ID NO: 98422 - protein, 17 aa, Mycobacterium avium
HSGISILLVEHGPGLTV

SEQ ID NO: 98423 - protein, 27 aa, Mycobacterium avium
HSGQGCALATRMLVPRSHYDQAVEVAS

SEQ ID NO: 98424 - protein, 27 aa, Mycobacterium avium
HSGVYKFRSDLMNGRIVLGRAGGGALG

SEQ ID NO: 98425 - protein, 25 aa, Mycobacterium avium
HSPLAKRAKLDWAEVPRWPLVINTA

SEQ ID NO: 98426 - protein, 18 aa, Mycobacterium avium
HSPQRLDNELNWIEQQTG

SEQ ID NO: 98427 - protein, 21 aa, Mycobacterium avium
HSQKFAWTRLFRPMVHGHPLT

SEQ ID NO: 98428 - protein, 19 aa, Mycobacterium avium
HSVGVWPLVIDDATVVERS

SEQ ID NO: 98429 - protein, 19 aa, Mycobacterium avium
HSVGVWPLVINDATVVERS

SEQ ID NO: 98430 - protein, 18 aa, Mycobacterium avium
HSYRRDPRSSVRGCSPSR

SEQ ID NO: 98431 - protein, 18 aa, Mycobacterium avium
HSYVECRVTGTLDNDENT

SEQ ID NO: 98432 - protein, 26 aa, Mycobacterium avium
HTALIRLRWAFAAAVYHGEAPAITKK

SEQ ID NO: 98433 - protein, 27 aa, Mycobacterium avium
HTARMDLTFSVGERWCESGEPGGIGGT

SEQ ID NO: 98434 - protein, 24 aa, Mycobacterium avium
HTARMDLTFSVGERWSESGEPGGI

SEQ ID NO: 98435 - protein, 17 aa, Mycobacterium avium
HTARPGIVIGRRGTEAD

SEQ ID NO: 98436 - protein, 17 aa, Mycobacterium avium
HTDRYALLRSFRRDGSP

SEQ ID NO: 98437 - protein, 17 aa, Mycobacterium avium
HTDRYALLRSFRRDGTP

SEQ ID NO: 98438 - protein, 20 aa, Mycobacterium avium
HTFGLKAGLITSFLRGATML

SEQ ID NO: 98439 - protein, 28 aa, Mycobacterium avium
HTGDLRGSLRLLIRALRGHRRPVAPAGQ

SEQ ID NO: 98440 - protein, 27 aa, Mycobacterium avium
HTGGRRISIYWTWSYPWESQRDIQTLD

SEQ ID NO: 98441 - protein, 25 aa, Mycobacterium avium
HTGRWPTDLDLWWAQTIALLPDGRL

SEQ ID NO: 98442 - protein, 19 aa, Mycobacterium avium
HTKALPGDRVAILGVGGLG

SEQ ID NO: 98443 - protein, 20 aa, Mycobacterium avium
HTLLMLALAGWARYLRGYDL

SEQ ID NO: 98444 - protein, 17 aa, Mycobacterium avium
HTLRADIDYGLYEAKTT

SEQ ID NO: 98445 - protein, 19 aa, Mycobacterium avium
HTMMFQEMVNRVGADVPGM

SEQ ID NO: 98446 - protein, 18 aa, Mycobacterium avium
HTNLGLAIDLQGKDGKRS

SEQ ID NO: 98447 - protein, 17 aa, Mycobacterium avium
HTSRWIEIAAEWGTRDY

SEQ ID NO: 98448 - protein, 24 aa, Mycobacterium avium
HTVGMLFSPGYPGFLRGVAASGPG

SEQ ID NO: 98449 - protein, 21 aa, Mycobacterium avium
HVADLTARHGFRVGNAAVQVI

SEQ ID NO: 98450 - protein, 17 aa, Mycobacterium avium
HVAFGLGPHRCIGSHLA

SEQ ID NO: 98451 - protein, 23 aa, Mycobacterium avium
HVDAGLRVSRRLVLPDPPRRLLR

SEQ ID NO: 98452 - protein, 23 aa, Mycobacterium avium
HVDAGLRVTRRLVLPDPPRQLLR

SEQ ID NO: 98453 - protein, 23 aa, Mycobacterium avium
HVDAGLRVTRRLVLPDPPRRLLR

SEQ ID NO: 98454 - protein, 22 aa, Mycobacterium avium
HVEWKHGVCRALRLPHADQADI

SEQ ID NO: 98455 - protein, 23 aa, Mycobacterium avium
HVEWKHGVCRALRLPHADQADIA

SEQ ID NO: 98456 - protein, 18 aa, Mycobacterium avium
HVGPSGFMLIGLIDHGAW

SEQ ID NO: 98457 - protein, 19 aa, Mycobacterium avium
HVHFPRGYTVFAEHEPADR

SEQ ID NO: 98458 - protein, 23 aa, Mycobacterium avium
HVIRAAWPHLREQRYGRVVVATS

SEQ ID NO: 98459 - protein, 17 aa, Mycobacterium avium
HVLPVGWVEPVDISNAV

SEQ ID NO: 98460 - protein, 18 aa, Mycobacterium avium
HVLSLVVHHIASDHWSAG

SEQ ID NO: 98461 - protein, 17 aa, Mycobacterium avium
HVLSRPDLELVGVRVYD

SEQ ID NO: 98462 - protein, 31 aa, Mycobacterium avium
HVNKLRGRHIPKLRQVIGTVFQDFRLLQQKT

SEQ ID NO: 98463 - protein, 23 aa, Mycobacterium avium
HVPEVLDVPGVVAAQRYDITELK

SEQ ID NO: 98464 - protein, 21 aa, Mycobacterium avium
HVPRPWQLGAEMLRVTRPGGL

SEQ ID NO: 98465 - protein, 24 aa, Mycobacterium avium
HVPVLLERCVELLTPALTRRHPDG

SEQ ID NO: 98466 - protein, 23 aa, Mycobacterium avium
HVQVFRMWLDAVGVTDDLHHFLD

SEQ ID NO: 98467 - protein, 21 aa, Mycobacterium avium
HVRADLPAHVALSGHQNVTVT

SEQ ID NO: 98468 - protein, 23 aa, Mycobacterium avium
HVRAEAYGPVVLRPKGSTWRGVK

SEQ ID NO: 98469 - protein, 24 aa, Mycobacterium avium
HVRAEAYGPVVLRPKGSTWRGVKE

SEQ ID NO: 98470 - protein, 24 aa, Mycobacterium avium
HVRGRGLLCGVVLTAPHAKDAEAA

SEQ ID NO: 98471 - protein, 24 aa, Mycobacterium avium
HVSEAGYTQRLWEAIRAQDVQGND

SEQ ID NO: 98472 - protein, 27 aa, Mycobacterium avium
HVSVGIDLRLDWPKALAQAGFDASAPT

SEQ ID NO: 98473 - protein, 25 aa, Mycobacterium avium
HVTEFVEGSVIAWRPAEPGKQPPGH

SEQ ID NO: 98474 - protein, 17 aa, Mycobacterium avium
HVTRPGQYEAPLGITLR

SEQ ID NO: 98475 - protein, 23 aa, Mycobacterium avium
HVTRRLGDTITFVIHIPLSIDLL

SEQ ID NO: 98476 - protein, 22 aa, Mycobacterium avium
HVVPELPKTRSGKIMRRLLRDI

SEQ ID NO: 98477 - protein, 22 aa, Mycobacterium avium
HVYAGELLFLYNGVRPRHVMPV

SEQ ID NO: 98478 - protein, 24 aa, Mycobacterium avium
HYDKIHLYDAFGFTESRTVAPGRE

SEQ ID NO: 98479 - protein, 42 aa, Mycobacterium avium
HYEPFWKACVDLDLTLAVHAGWGFPQGRYQEFISAFVATHLG

SEQ ID NO: 98480 - protein, 20 aa, Mycobacterium avium
HYGVFRGREAVRDWIVAVMA

SEQ ID NO: 98481 - protein, 19 aa, Mycobacterium avium
HYLASLLIARGCDVKTVQA

SEQ ID NO: 98482 - protein, 22 aa, Mycobacterium avium
HYLESWLLPSLGLRATVFHFNP

SEQ ID NO: 98483 - protein, 18 aa, Mycobacterium avium
HYRREWVPSPGMGLSGIW

SEQ ID NO: 98484 - protein, 19 aa, Mycobacterium avium
IAAAISQCPFTDGFASSFA

SEQ ID NO: 98485 - protein, 22 aa, Mycobacterium avium
IAAALLERGAAVLLVDIQQETL

SEQ ID NO: 98486 - protein, 26 aa, Mycobacterium avium
IAAALTEWFTVDWHRAIVDKWRGAGV

SEQ ID NO: 98487 - protein, 19 aa, Mycobacterium avium
IAAANRLPINPIRTRIQHC

SEQ ID NO: 98488 - protein, 21 aa, Mycobacterium avium
IAADVVEFWQGRENRLHNRIR

SEQ ID NO: 98489 - protein, 21 aa, Mycobacterium avium
IAAECPHPALLGVDTPRRADG

SEQ ID NO: 98490 - protein, 17 aa, Mycobacterium avium
IAAGAPVAAHWTADRQV

SEQ ID NO: 98491 - protein, 17 aa, Mycobacterium avium
IAALGRIALVLISHRHG

SEQ ID NO: 98492 - protein, 19 aa, Mycobacterium avium
IAALKARYLSRDDVPEDVV

SEQ ID NO: 98493 - protein, 17 aa, Mycobacterium avium
IAALRPVQHGIRDARID

SEQ ID NO: 98494 - protein, 23 aa, Mycobacterium avium
IAARGRRAGGIARLRSRGRGTGG

SEQ ID NO: 98495 - protein, 18 aa, Mycobacterium avium
IAAVAAALAFPAHVRNAE

SEQ ID NO: 98496 - protein, 25 aa, Mycobacterium avium
IAAVRTLWRTWPFASVLGDRPTGVF

SEQ ID NO: 98497 - protein, 22 aa, Mycobacterium avium
IADACGFAVPYYELVDERPVLN

SEQ ID NO: 98498 - protein, 26 aa, Mycobacterium avium
IADDRISDVLGRLRAGYRVDGREVTP

SEQ ID NO: 98499 - protein, 18 aa, Mycobacterium avium
IADFVLRVRAGLEALGVG

SEQ ID NO: 98500 - protein, 18 aa, Mycobacterium avium
IADFVPRVRAGLDALEVG

SEQ ID NO: 98501 - protein, 20 aa, Mycobacterium avium
IADFVPRVRAGLEALGVGSR

SEQ ID NO: 98502 - protein, 17 aa, Mycobacterium avium
IADGFAAVAQRWGRLNS

SEQ ID NO: 98503 - protein, 19 aa, Mycobacterium avium
IADHMGFRIDPNIRTIQDV

SEQ ID NO: 98504 - protein, 18 aa, Mycobacterium avium
IADMITSLICHGTLTRFP

SEQ ID NO: 98505 - protein, 18 aa, Mycobacterium avium
IADYSPWQGYGGRQKPSR

SEQ ID NO: 98506 - protein, 17 aa, Mycobacterium avium
IAEEVRAAGAPIAAVGI

SEQ ID NO: 98507 - protein, 22 aa, Mycobacterium avium
IAELHAANGFAYAADDVAAAFA

SEQ ID NO: 98508 - protein, 19 aa, Mycobacterium avium
IAELRRIVGPWGEVHETAS

SEQ ID NO: 98509 - protein, 21 aa, Mycobacterium avium
IAERPTMAALLIKDSVNAASD

SEQ ID NO: 98510 - protein, 23 aa, Mycobacterium avium
IAEVPTMAALLIKESVNQSVDNM

SEQ ID NO: 98511 - protein, 25 aa, Mycobacterium avium
IAFGPTAPYWSDFDAALLRSVDELI

SEQ ID NO: 98512 - protein, 18 aa, Mycobacterium avium
IAGAGWAGVRWRNLTGGI

SEQ ID NO: 98513 - protein, 20 aa, Mycobacterium avium
IAGARSCVPPDFLFMHTGLA

SEQ ID NO: 98514 - protein, 19 aa, Mycobacterium avium
IAGCGTFQAAVYAYTNRAA

SEQ ID NO: 98515 - protein, 17 aa, Mycobacterium avium
IAGLCNSAGFGTSGVFH

SEQ ID NO: 98516 - protein, 22 aa, Mycobacterium avium
IAGLRGLVGVAHYTAAKHGVVG

SEQ ID NO: 98517 - protein, 20 aa, Mycobacterium avium
IAGRENIPWQELVVREGMAT

SEQ ID NO: 98518 - protein, 19 aa, Mycobacterium avium
IAGSARASMDPGYDFTTFP

SEQ ID NO: 98519 - protein, 21 aa, Mycobacterium avium
IAGSIEEIRLANALRGVAVNF

SEQ ID NO: 98520 - protein, 18 aa, Mycobacterium avium
IAHDPYHPEARHGLDELL

SEQ ID NO: 98521 - protein, 20 aa, Mycobacterium avium
IAHKERRAVTGTSRCGSRFI

SEQ ID NO: 98522 - protein, 19 aa, Mycobacterium avium
IAHLSRLFATMTRHHHLTR

SEQ ID NO: 98523 - protein, 19 aa, Mycobacterium avium
IAINGGEPVDCEGFQRFAM

SEQ ID NO: 98524 - protein, 19 aa, Mycobacterium avium
IAINGGEPVDCEGFQRFAT

SEQ ID NO: 98525 - protein, 19 aa, Mycobacterium avium
IAIRAGIPDYGYAFWPGRT

SEQ ID NO: 98526 - protein, 23 aa, Mycobacterium avium
IAIRGQRLFLGRTRFFGREQGPG

SEQ ID NO: 98527 - protein, 17 aa, Mycobacterium avium
IAKKWGFTRTQLDEYSV

SEQ ID NO: 98528 - protein, 17 aa, Mycobacterium avium
IALACDVVLASENAFFM

SEQ ID NO: 98529 - protein, 17 aa, Mycobacterium avium
IALCSNLSGGQRTRVSL

SEQ ID NO: 98530 - protein, 17 aa, Mycobacterium avium
IALGDFVKLGFEQDVEI

SEQ ID NO: 98531 - protein, 32 aa, Mycobacterium avium
IALGIRRDWPRPEARVTIPARATLLLYTDGLV

SEQ ID NO: 98532 - protein, 21 aa, Mycobacterium avium
IALREGIRLAYDILTKGDGFK

SEQ ID NO: 98533 - protein, 20 aa, Mycobacterium avium
IAMEKRWRKVLGERRLTELR

SEQ ID NO: 98534 - protein, 25 aa, Mycobacterium avium
IANDSRYGLVGAVWSADAERAAAVA

SEQ ID NO: 98535 - protein, 25 aa, Mycobacterium avium
IANDSRYGLVGAVWSSDEERAAAVA

SEQ ID NO: 98536 - protein, 17 aa, Mycobacterium avium
IANETDYGLAGSVWTAD

SEQ ID NO: 98537 - protein, 18 aa, Mycobacterium avium
IANETDYGLAGSVWTADV

SEQ ID NO: 98538 - protein, 17 aa, Mycobacterium avium
IAPDELRTAWVDIPEVF

SEQ ID NO: 98539 - protein, 19 aa, Mycobacterium avium
IAPEEIKAAGYDGVVNYVS

SEQ ID NO: 98540 - protein, 28 aa, Mycobacterium avium
IAPEQARSGLAYAVSKSFVKWYSQSQAE

SEQ ID NO: 98541 - protein, 27 aa, Mycobacterium avium
IAPNAWRLPFEREWRDPQTLPRSGQLR

SEQ ID NO: 98542 - protein, 17 aa, Mycobacterium avium
IAPNFAIGAVLSMHFAK

SEQ ID NO: 98543 - protein, 27 aa, Mycobacterium avium
IAPNFAIGAVLSMHFAKQAARFFDSAE

SEQ ID NO: 98544 - protein, 22 aa, Mycobacterium avium
IAQDCTRQFGGRFAIQQISLPR

SEQ ID NO: 98545 - protein, 34 aa, Mycobacterium avium
IAQMGWPLADAIRWPAQLISTFQWERMLDQDAKM

SEQ ID NO: 98546 - protein, 28 aa, Mycobacterium avium
IAQSALDMACRWARDRDVFGGRLADKQG

SEQ ID NO: 98547 - protein, 17 aa, Mycobacterium avium
IARAVIDALKIHPNINA

SEQ ID NO: 98548 - protein, 25 aa, Mycobacterium avium
IAREPRGDGGFGYDPVFVPDDAAGR

SEQ ID NO: 98549 - protein, 25 aa, Mycobacterium avium
IAREPRGDGGFGYDPVFVPDDAGGR

SEQ ID NO: 98550 - protein, 25 aa, Mycobacterium avium
IARFNGRTGYHLGLRAGINTGNVVS

SEQ ID NO: 98551 - protein, 18 aa, Mycobacterium avium
IARIAALGRIALVLISHR

SEQ ID NO: 98552 - protein, 21 aa, Mycobacterium avium
IARLAEFLSLLFDAPVVITSA

SEQ ID NO: 98553 - protein, 27 aa, Mycobacterium avium
IARNCIEWPEISFGLAKAGLIAVPVNI

SEQ ID NO: 98554 - protein, 19 aa, Mycobacterium avium
IARRVREARVFSEVIPHTA

SEQ ID NO: 98555 - protein, 22 aa, Mycobacterium avium
IARSEFWLDAATFTLTEDACTD

SEQ ID NO: 98556 - protein, 24 aa, Mycobacterium avium
IARSFAAALGLQFTRVQFTPDLLP

SEQ ID NO: 98557 - protein, 20 aa, Mycobacterium avium
IASICSGAFTVAAAGVLDGK

SEQ ID NO: 98558 - protein, 17 aa, Mycobacterium avium
IASYCLTEPGAGSDAAA

SEQ ID NO: 98559 - protein, 18 aa, Mycobacterium avium
IATDLETIAAVLAESQRT

SEQ ID NO: 98560 - protein, 20 aa, Mycobacterium avium
IATGVLRQWERHTAGSFAMS

SEQ ID NO: 98561 - protein, 27 aa, Mycobacterium avium
IATHPRPDFKTRILQAFNDGMKHRPHS

SEQ ID NO: 98562 - protein, 19 aa, Mycobacterium avium
IATILLTRIATCWRAGAHY

SEQ ID NO: 98563 - protein, 17 aa, Mycobacterium avium
IATRMAGWSKRTARSAR

SEQ ID NO: 98564 - protein, 17 aa, Mycobacterium avium
IATRSPIALSVTLAAVR

SEQ ID NO: 98565 - protein, 25 aa, Mycobacterium avium
IAVARSEFAHPRFAALRDATPELAW

SEQ ID NO: 98566 - protein, 24 aa, Mycobacterium avium
IAVRRPLARLGMGLHRRHRQPQGD

SEQ ID NO: 98567 - protein, 29 aa, Mycobacterium avium
IAVTNWFGDQPFAVWPWAADKLGGAQPTV

SEQ ID NO: 98568 - protein, 23 aa, Mycobacterium avium
IAVTRLGVTSVRFTGGEPLLARH

SEQ ID NO: 98569 - protein, 24 aa, Mycobacterium avium
IAVTRLGVTSVRFTGGEPLLARHL

SEQ ID NO: 98570 - protein, 23 aa, Mycobacterium avium
IAYRERLGFEVLPLSGGERSPFE

SEQ ID NO: 98571 - protein, 21 aa, Mycobacterium avium
IAYRLGRNAARMEAALSAPSI

SEQ ID NO: 98572 - protein, 17 aa, Mycobacterium avium
ICAFPDFEFPSYRSISE

SEQ ID NO: 98573 - protein, 18 aa, Mycobacterium avium
ICAFPDFEFPSYRSISEA

SEQ ID NO: 98574 - protein, 18 aa, Mycobacterium avium
ICARGYQQFVEYLHDPDA

SEQ ID NO: 98575 - protein, 21 aa, Mycobacterium avium
ICARSAMAGLIRTDSDTQDAG

SEQ ID NO: 98576 - protein, 19 aa, Mycobacterium avium
ICCPAPWDQITGQAFRDTI

SEQ ID NO: 98577 - protein, 17 aa, Mycobacterium avium
ICGHDGFLVESEAVGEM

SEQ ID NO: 98578 - protein, 19 aa, Mycobacterium avium
ICNRTGSALGRSVKLDGAY

SEQ ID NO: 98579 - protein, 23 aa, Mycobacterium avium
ICPARRRTNVLYALIRDNRTWQP

SEQ ID NO: 98580 - protein, 29 aa, Mycobacterium avium
IDAAEIYVPFSWFEPMWLENLGFAPEGEG

SEQ ID NO: 98581 - protein, 19 aa, Mycobacterium avium
IDAARRLRNSVAPQNISSV

SEQ ID NO: 98582 - protein, 23 aa, Mycobacterium avium
IDAAVALGRRVSFVGRSMVRNMG

SEQ ID NO: 98583 - protein, 17 aa, Mycobacterium avium
IDAELTAFIGASPHERV

SEQ ID NO: 98584 - protein, 17 aa, Mycobacterium avium
IDAFIERGGCDLVGELT

SEQ ID NO: 98585 - protein, 26 aa, Mycobacterium avium
IDAIARHRFDLCHEIPLRAQLFRLAE

SEQ ID NO: 98586 - protein, 17 aa, Mycobacterium avium
IDAKAATAIAVDDRTRA

SEQ ID NO: 98587 - protein, 24 aa, Mycobacterium avium
IDARLRWPGFGEVSARELVLDTLL

SEQ ID NO: 98588 - protein, 17 aa, Mycobacterium avium
IDAVPMATWLAMDDQRY

SEQ ID NO: 98589 - protein, 17 aa, Mycobacterium avium
IDCPPSLGLLTINALVA

SEQ ID NO: 98590 - protein, 22 aa, Mycobacterium avium
IDCPPSLGLLTINALVAAPEVM

SEQ ID NO: 98591 - protein, 20 aa, Mycobacterium avium
IDDGKLVLAQRVRTAGHATE

SEQ ID NO: 98592 - protein, 21 aa, Mycobacterium avium
IDDGKLVLAQRVRTAGHATEA

SEQ ID NO: 98593 - protein, 17 aa, Mycobacterium avium
IDDGWLVGPVSRIRKRV

SEQ ID NO: 98594 - protein, 17 aa, Mycobacterium avium
IDDLGMDSVAFAVSLVA

SEQ ID NO: 98595 - protein, 24 aa, Mycobacterium avium
IDEALRLGERVAVFKGGVLQQCDE

SEQ ID NO: 98596 - protein, 22 aa, Mycobacterium avium
IDEIRKAVRYQIKHGAELIKVC

SEQ ID NO: 98597 - protein, 17 aa, Mycobacterium avium
IDFLRRWEPAGWPSPRA

SEQ ID NO: 98598 - protein, 18 aa, Mycobacterium avium
IDGDRAVLLGSRRRSTGV

SEQ ID NO: 98599 - protein, 18 aa, Mycobacterium avium
IDGKGRFAEARVLVRRKA

SEQ ID NO: 98600 - protein, 20 aa, Mycobacterium avium
IDGLGMALVCRRVATIYSAM

SEQ ID NO: 98601 - protein, 24 aa, Mycobacterium avium
IDGPAGWGEFGAFVEYGPPEAAHW

SEQ ID NO: 98602 - protein, 17 aa, Mycobacterium avium
IDGRYHWQGTVFGSPSQ

SEQ ID NO: 98603 - protein, 18 aa, Mycobacterium avium
IDGSPSIACTIDLPSGQD

SEQ ID NO: 98604 - protein, 18 aa, Mycobacterium avium
IDGYRVLTDPVWSERCSP

SEQ ID NO: 98605 - protein, 24 aa, Mycobacterium avium
IDHIIGLFRLWWIPRGSAPTEGTY

SEQ ID NO: 98606 - protein, 18 aa, Mycobacterium avium
IDICGPIENLAYPHSTPE

SEQ ID NO: 98607 - protein, 18 aa, Mycobacterium avium
IDIKSDFLSSGSPFSRPV

SEQ ID NO: 98608 - protein, 19 aa, Mycobacterium avium
IDKGGHTWPGGKQYLPAAV

SEQ ID NO: 98609 - protein, 29 aa, Mycobacterium avium
IDKPKLVFFFDEAHLLFADASKAFLEQVE

SEQ ID NO: 98610 - protein, 22 aa, Mycobacterium avium
IDLGAFSYRQCHIQDPESVDAL

SEQ ID NO: 98611 - protein, 19 aa, Mycobacterium avium
IDLLARMRGGIDKKRRAEL

SEQ ID NO: 98612 - protein, 20 aa, Mycobacterium avium
IDLLARMRGGIDKKRRAELI

SEQ ID NO: 98613 - protein, 18 aa, Mycobacterium avium
IDLLASAVAMGWSPYYPQ

SEQ ID NO: 98614 - protein, 24 aa, Mycobacterium avium
IDLLVKRAEALGVQIRYETGATNL

SEQ ID NO: 98615 - protein, 19 aa, Mycobacterium avium
IDLRLACNCYHTYEQALQA

SEQ ID NO: 98616 - protein, 20 aa, Mycobacterium avium
IDLSRTVGWFTAKYPVSLDV

SEQ ID NO: 98617 - protein, 20 aa, Mycobacterium avium
IDLSRTVGWFTTKYPVSLDV

SEQ ID NO: 98618 - protein, 24 aa, Mycobacterium avium
IDLTARPGIDFGVQTRGDGRTVVG

SEQ ID NO: 98619 - protein, 25 aa, Mycobacterium avium
IDNLRLETLAAYWGVTQQRPHDAFD

SEQ ID NO: 98620 - protein, 26 aa, Mycobacterium avium
IDPALPAARIEFMLADAAPIAAVGTA

SEQ ID NO: 98621 - protein, 24 aa, Mycobacterium avium
IDPALPAARIEFMLDDTAPTAAVT

SEQ ID NO: 98622 - protein, 28 aa, Mycobacterium avium
IDPGALPTRYARGWHCLGVAKDFQDGKP

SEQ ID NO: 98623 - protein, 29 aa, Mycobacterium avium
IDPGALPTRYARGWHCLGVAKDFQDGKPH

SEQ ID NO: 98624 - protein, 26 aa, Mycobacterium avium
IDPGALPTRYARGWHCLGVANDFQDG

SEQ ID NO: 98625 - protein, 20 aa, Mycobacterium avium
IDQAAAVAILQSWLDQRRAA

SEQ ID NO: 98626 - protein, 17 aa, Mycobacterium avium
IDQVSAWLERHRPAHWT

SEQ ID NO: 98627 - protein, 24 aa, Mycobacterium avium
IDRCWAPKVYGAWNLHQATAGQPL

SEQ ID NO: 98628 - protein, 17 aa, Mycobacterium avium
IDRGPRVGTHVAQRKYD

SEQ ID NO: 98629 - protein, 19 aa, Mycobacterium avium
IDSSDEWIYSRTGIKTRRF

SEQ ID NO: 98630 - protein, 18 aa, Mycobacterium avium
IDTAWLSAFAERSRFAEA

SEQ ID NO: 98631 - protein, 19 aa, Mycobacterium avium
IDTLLTLPGVGGYTARAVA

SEQ ID NO: 98632 - protein, 25 aa, Mycobacterium avium
IDTRGVYLFDEVDALAGDRAAPNDV

SEQ ID NO: 98633 - protein, 22 aa, Mycobacterium avium
IDVGLPVGCEFLEPTSPQYIAD

SEQ ID NO: 98634 - protein, 22 aa, Mycobacterium avium
IDVSRLHPLATMEKMFIAPSQF

SEQ ID NO: 98635 - protein, 19 aa, Mycobacterium avium
IEAAARRWGARRPQGAVRY

SEQ ID NO: 98636 - protein, 22 aa, Mycobacterium avium
IEACMAVSLGLANHVVVYRSVW

SEQ ID NO: 98637 - protein, 17 aa, Mycobacterium avium
IEAHLDRGRGPVATVLI

SEQ ID NO: 98638 - protein, 25 aa, Mycobacterium avium
IEAVHPRIIVCLGATAAQSLLGTSF

SEQ ID NO: 98639 - protein, 25 aa, Mycobacterium avium
IEAVLECREALAVNVKPKFAVDAMV

SEQ ID NO: 98640 - protein, 27 aa, Mycobacterium avium
IEDKARWGYKFRFGVFKIDDHDLEVIR

SEQ ID NO: 98641 - protein, 28 aa, Mycobacterium avium
IEDYLSIGWQEARFRDALAFMSAEVIGA

SEQ ID NO: 98642 - protein, 21 aa, Mycobacterium avium
IEEFAPLIAYVLRSMQTGGDL

SEQ ID NO: 98643 - protein, 20 aa, Mycobacterium avium
IEELRWAAEQGFKAVFLPTT

SEQ ID NO: 98644 - protein, 17 aa, Mycobacterium avium
IEERFWAIDGSVYHVDP

SEQ ID NO: 98645 - protein, 19 aa, Mycobacterium avium
IEEVGKALAPVPLVPTVTA

SEQ ID NO: 98646 - protein, 24 aa, Mycobacterium avium
IEFTVQSGKLWLLQSRAAKRSPQA

SEQ ID NO: 98647 - protein, 21 aa, Mycobacterium avium
IEGDSAFGFSGMEIETICRYR

SEQ ID NO: 98648 - protein, 33 aa, Mycobacterium avium
IEGPAVLGWQRWRELQVQFGLGSIRALLEKAVE

SEQ ID NO: 98649 - protein, 29 aa, Mycobacterium avium
IEGYNLNMAIPWTAAERGFIDAVIDPHET

SEQ ID NO: 98650 - protein, 21 aa, Mycobacterium avium
IEHLAVLRAIPKLSVVRPADA

SEQ ID NO: 98651 - protein, 22 aa, Mycobacterium avium
IEKYLFGKFGMYIRGTRNLPRI

SEQ ID NO: 98652 - protein, 19 aa, Mycobacterium avium
IELAFKAAFTRLGGRIAKR

SEQ ID NO: 98653 - protein, 17 aa, Mycobacterium avium
IELAKPVVQAVVERSGL

SEQ ID NO: 98654 - protein, 22 aa, Mycobacterium avium
IELPDAHWRLVLTAHHIVIDGW

SEQ ID NO: 98655 - protein, 26 aa, Mycobacterium avium
IELPNGRYGWRVCLPAMMSYWSELAR

SEQ ID NO: 98656 - protein, 17 aa, Mycobacterium avium
IELRGGPELSACSAQWQ

SEQ ID NO: 98657 - protein, 18 aa, Mycobacterium avium
IELTAGWLQHLTRANWKL

SEQ ID NO: 98658 - protein, 31 aa, Mycobacterium avium
IEMWLRATVRQRVRVGALGLTVDFRAGEEML

SEQ ID NO: 98659 - protein, 19 aa, Mycobacterium avium
IENMTRFSLELGGKSAQVV

SEQ ID NO: 98660 - protein, 24 aa, Mycobacterium avium
IENVKTASAFRDSFGDDYGVTIAD

SEQ ID NO: 98661 - protein, 18 aa, Mycobacterium avium
IEPRDVSNAILFLISDAG

SEQ ID NO: 98662 - protein, 17 aa, Mycobacterium avium
IEPRTGRQLGNFPQAFT

SEQ ID NO: 98663 - protein, 23 aa, Mycobacterium avium
IEQFVYAYVRACPGYTLDYNANG

SEQ ID NO: 98664 - protein, 18 aa, Mycobacterium avium
IEQGLKGVEFIAINTDAQ

SEQ ID NO: 98665 - protein, 18 aa, Mycobacterium avium
IEQMKRIGIFGLAVPEEY

SEQ ID NO: 98666 - protein, 23 aa, Mycobacterium avium
IEQMPLDAGHQWRRDAALSADAV

SEQ ID NO: 98667 - protein, 17 aa, Mycobacterium avium
IERAWPAVIRVAKQLHR

SEQ ID NO: 98668 - protein, 24 aa, Mycobacterium avium
IERCAELVVAWWAVTKAGGVYAPV

SEQ ID NO: 98669 - protein, 24 aa, Mycobacterium avium
IERCAELVVAWWAVTKVGGVYAPV

SEQ ID NO: 98670 - protein, 25 aa, Mycobacterium avium
IERDWAAKVYGAWNLHLALQESGAE

SEQ ID NO: 98671 - protein, 20 aa, Mycobacterium avium
IERIALLEAAGWAVIRVSAA

SEQ ID NO: 98672 - protein, 18 aa, Mycobacterium avium
IEVACLKDEVAHLSDTSP

SEQ ID NO: 98673 - protein, 24 aa, Mycobacterium avium
IEVARRLLPDIAHVAVFDTGFFHD

SEQ ID NO: 98674 - protein, 18 aa, Mycobacterium avium
IEVIEFCVGIPHLLKGEY

SEQ ID NO: 98675 - protein, 18 aa, Mycobacterium avium
IEVLPLRDVIAVVGVVAD

SEQ ID NO: 98676 - protein, 24 aa, Mycobacterium avium
IEYGRSAAGWAQRVVFVNGHGGNV

SEQ ID NO: 98677 - protein, 39 aa, Mycobacterium avium
IFAEECARAGVPRQLGITAIDLVGPVLIKFGTDEQKARY

SEQ ID NO: 98678 - protein, 22 aa, Mycobacterium avium
IFDKGKALALYHTKRLASPGQR

SEQ ID NO: 98679 - protein, 19 aa, Mycobacterium avium
IFFGGRRAGAIPLVSQAFD

SEQ ID NO: 98680 - protein, 19 aa, Mycobacterium avium
IFGALLRGGRLVIVPDDVV

SEQ ID NO: 98681 - protein, 19 aa, Mycobacterium avium
IFGALLRGGRLVVVPEDVT

SEQ ID NO: 98682 - protein, 18 aa, Mycobacterium avium
IFGALLRGGRVVVMPEAV

SEQ ID NO: 98683 - protein, 22 aa, Mycobacterium avium
IFGDRYEAFKAAGGRANDVSFI

SEQ ID NO: 98684 - protein, 17 aa, Mycobacterium avium
IFIDKAVQIGCDALLGA

SEQ ID NO: 98685 - protein, 19 aa, Mycobacterium avium
IFLRAGKALPHKVTEVRMF

SEQ ID NO: 98686 - protein, 19 aa, Mycobacterium avium
IFRAPSLRLGEPEYLTGNF

SEQ ID NO: 98687 - protein, 19 aa, Mycobacterium avium
IFRMRIPKPKFVLIPTPLW

SEQ ID NO: 98688 - protein, 18 aa, Mycobacterium avium
IFSNRPPTHLTIETLVDN

SEQ ID NO: 98689 - protein, 20 aa, Mycobacterium avium
IFVEFSRMRGLSVDGRCKAY

SEQ ID NO: 98690 - protein, 24 aa, Mycobacterium avium
IFYGPEGTQSVAMYLGNNQMLEVG

SEQ ID NO: 98691 - protein, 19 aa, Mycobacterium avium
IFYLMGGLAPFPGVTDGIL

SEQ ID NO: 98692 - protein, 19 aa, Mycobacterium avium
IFYPQLLKRGSADAEGETL

SEQ ID NO: 98693 - protein, 25 aa, Mycobacterium avium
IFYRRELFDGIGPYNLRYRVWADWD

SEQ ID NO: 98694 - protein, 26 aa, Mycobacterium avium
IGADKRIGYDFLFPGIGYGASCLPKD

SEQ ID NO: 98695 - protein, 18 aa, Mycobacterium avium
IGADLENIAAALAEAQKA

SEQ ID NO: 98696 - protein, 17 aa, Mycobacterium avium
IGADLENIAAALSEAQK

SEQ ID NO: 98697 - protein, 25 aa, Mycobacterium avium
IGAFGRLDALINCAGIAEPAGSSIL

SEQ ID NO: 98698 - protein, 21 aa, Mycobacterium avium
IGATDLCEFVEFPTELLQVCG

SEQ ID NO: 98699 - protein, 17 aa, Mycobacterium avium
IGAWLGKFAHLMTSHPR

SEQ ID NO: 98700 - protein, 18 aa, Mycobacterium avium
IGDEWRIGEVDGGWQVLS

SEQ ID NO: 98701 - protein, 24 aa, Mycobacterium avium
IGDGDPRIGMWVASGSGYVTEICA

SEQ ID NO: 98702 - protein, 22 aa, Mycobacterium avium
IGEHSYRIPIVTTDPSASWTAE

SEQ ID NO: 98703 - protein, 24 aa, Mycobacterium avium
IGEKRFELAAGEFLLFPTVAHSHA

SEQ ID NO: 98704 - protein, 24 aa, Mycobacterium avium
IGFFPANAIGPGFEDIELYTDDTR

SEQ ID NO: 98705 - protein, 19 aa, Mycobacterium avium
IGGPFAFSVPYGLQSPGQM

SEQ ID NO: 98706 - protein, 21 aa, Mycobacterium avium
IGGSFGQYGGVWAHDETRKSF

SEQ ID NO: 98707 - protein, 24 aa, Mycobacterium avium
IGHTPLDMRVGGGFVTGEGGMGHV

SEQ ID NO: 98708 - protein, 21 aa, Mycobacterium avium
IGIAAARRGANVVLLAKTDTP

SEQ ID NO: 98709 - protein, 19 aa, Mycobacterium avium
IGIAHARDVVMPALTEIDG

SEQ ID NO: 98710 - protein, 17 aa, Mycobacterium avium
IGKAVCKAFRTERSGLI

SEQ ID NO: 98711 - protein, 28 aa, Mycobacterium avium
IGKLSFAECQALLRKGRGQWGPVQDAWE

SEQ ID NO: 98712 - protein, 17 aa, Mycobacterium avium
IGLDGAWMREIAEAMLA

SEQ ID NO: 98713 - protein, 18 aa, Mycobacterium avium
IGLDGAWMREIAEAMLSS

SEQ ID NO: 98714 - protein, 20 aa, Mycobacterium avium
IGLPEVFNDPDLASFNGAVT

SEQ ID NO: 98715 - protein, 17 aa, Mycobacterium avium
IGLVPRDRERVVAVAEE

SEQ ID NO: 98716 - protein, 20 aa, Mycobacterium avium
IGMACRFPGAPDPGSFWRLL

SEQ ID NO: 98717 - protein, 17 aa, Mycobacterium avium
IGMQKAKEMAFFGEKLS

SEQ ID NO: 98718 - protein, 17 aa, Mycobacterium avium
IGMQKAKEMAFFGERLS

SEQ ID NO: 98719 - protein, 28 aa, Mycobacterium avium
IGNSLFRPAYKHWLLKDELIRIEATAAR

SEQ ID NO: 98720 - protein, 22 aa, Mycobacterium avium
IGPADLAASMGRLGQPEHPDVV

SEQ ID NO: 98721 - protein, 21 aa, Mycobacterium avium
IGPALAAGCTVVLKPAPDAPL

SEQ ID NO: 98722 - protein, 24 aa, Mycobacterium avium
IGPANRWARRLGELTCTRQRDMAV

SEQ ID NO: 98723 - protein, 17 aa, Mycobacterium avium
IGPDMDGFFAAWEQAVL

SEQ ID NO: 98724 - protein, 20 aa, Mycobacterium avium
IGPLWFAIRTYRQMQTQDRM

SEQ ID NO: 98725 - protein, 23 aa, Mycobacterium avium
IGPTLRAAWTGAVLGQANASAER

SEQ ID NO: 98726 - protein, 21 aa, Mycobacterium avium
IGQAVSWLYRTSPRGLAGPLP

SEQ ID NO: 98727 - protein, 17 aa, Mycobacterium avium
IGRRLDHHLGGGIDDVV

SEQ ID NO: 98728 - protein, 25 aa, Mycobacterium avium
IGRYIRYRRYATRLCVVDPEHSAFF

SEQ ID NO: 98729 - protein, 20 aa, Mycobacterium avium
IGSDVWDRLFSGLRPAELHR

SEQ ID NO: 98730 - protein, 21 aa, Mycobacterium avium
IGSNVARTVFKSMLTAVLERM

SEQ ID NO: 98731 - protein, 17 aa, Mycobacterium avium
IGSRFALELVESVVGED

SEQ ID NO: 98732 - protein, 17 aa, Mycobacterium avium
IGTNCLADGSSAIATAL

SEQ ID NO: 98733 - protein, 24 aa, Mycobacterium avium
IGTPFLKDRILTGAINGDITIALG

SEQ ID NO: 98734 - protein, 22 aa, Mycobacterium avium
IGTYPGNGWAYYGLLEIATRDG

SEQ ID NO: 98735 - protein, 30 aa, Mycobacterium avium
IGYDIPRPIPRISYADAMARYGSDKPDLRF

SEQ ID NO: 98736 - protein, 18 aa, Mycobacterium avium
IHAPVILPGSRFTPFLTV

SEQ ID NO: 98737 - protein, 19 aa, Mycobacterium avium
IHDLLARRNIVAIDSPVSG

SEQ ID NO: 98738 - protein, 17 aa, Mycobacterium avium
IHGYCVAGGTDIALHAD

SEQ ID NO: 98739 - protein, 33 aa, Mycobacterium avium
IHLCTDWMGDDAWLWKLDCEFRLFNYVGDVHTV

SEQ ID NO: 98740 - protein, 18 aa, Mycobacterium avium
IHLVRGMLGRPGCGVLQM

SEQ ID NO: 98741 - protein, 19 aa, Mycobacterium avium
IHLVRGMLGRPGCGVLQMN

SEQ ID NO: 98742 - protein, 17 aa, Mycobacterium avium
IHQFLAWAVHRGYAHDV

SEQ ID NO: 98743 - protein, 24 aa, Mycobacterium avium
IHRALRPGGVLLMADVKASSRLED

SEQ ID NO: 98744 - protein, 25 aa, Mycobacterium avium
IHRAVRPHLTFSMGTHFCLGSALAR

SEQ ID NO: 98745 - protein, 25 aa, Mycobacterium avium
IHSESRPAPVVLYFHGGGFVIGDLD

SEQ ID NO: 98746 - protein, 25 aa, Mycobacterium avium
IHSGWEVTATWPIRSELGNRMIGAG

SEQ ID NO: 98747 - protein, 17 aa, Mycobacterium avium
IHWDDFFRPLSKPLRAL

SEQ ID NO: 98748 - protein, 22 aa, Mycobacterium avium
IIAELLEAYGIPTAGAEGFEAD

SEQ ID NO: 98749 - protein, 19 aa, Mycobacterium avium
IIAFLRLLLPGGLETTYRS

SEQ ID NO: 98750 - protein, 23 aa, Mycobacterium avium
IIAGRRGGSIILIGSAAGVKMQA

SEQ ID NO: 98751 - protein, 18 aa, Mycobacterium avium
IIARLAAAGVTWLTIAPS

SEQ ID NO: 98752 - protein, 24 aa, Mycobacterium avium
IIARVPTAWTRRACTGSEKPARNS

SEQ ID NO: 98753 - protein, 18 aa, Mycobacterium avium
IIDMLPAGAPTRCTVRHS

SEQ ID NO: 98754 - protein, 25 aa, Mycobacterium avium
IIDMPMIWQTDAFALATGFDEAASR

SEQ ID NO: 98755 - protein, 24 aa, Mycobacterium avium
IIDVGLPVGCEFLEPTSPQYIADA

SEQ ID NO: 98756 - protein, 25 aa, Mycobacterium avium
IIGCFRTGGGLPYTEFPRFHALMAE

SEQ ID NO: 98757 - protein, 17 aa, Mycobacterium avium
IIGRMLPLVLLEGRAWD

SEQ ID NO: 98758 - protein, 18 aa, Mycobacterium avium
IIHRFARLNDLEFGEIER

SEQ ID NO: 98759 - protein, 23 aa, Mycobacterium avium
IIPAEPAPAWQVVELHGEEQIRQ

SEQ ID NO: 98760 - protein, 19 aa, Mycobacterium avium
IKAEVAAAIGANAPTSAPT

SEQ ID NO: 98761 - protein, 24 aa, Mycobacterium avium
IKAGDKLWARMDIVSVDERFGADI

SEQ ID NO: 98762 - protein, 23 aa, Mycobacterium avium
IKANPAVRVRVGGRWRTGTAHLL

SEQ ID NO: 98763 - protein, 17 aa, Mycobacterium avium
IKAVSAYGGGGAGNRIL

SEQ ID NO: 98764 - protein, 24 aa, Mycobacterium avium
IKDAKKRLGYTKVVLAGWSGGGSL

SEQ ID NO: 98765 - protein, 17 aa, Mycobacterium avium
IKDVIIRAGETISSGQV

SEQ ID NO: 98766 - protein, 19 aa, Mycobacterium avium
IKEFPDLKIALSEGGTGWI

SEQ ID NO: 98767 - protein, 20 aa, Mycobacterium avium
IKEFPDLKIALSEGGTGWIP

SEQ ID NO: 98768 - protein, 26 aa, Mycobacterium avium
IKEFPDLKIALSEGGTGWIPYFLERA

SEQ ID NO: 98769 - protein, 20 aa, Mycobacterium avium
IKGVWAYARQLMMVISIEQT

SEQ ID NO: 98770 - protein, 28 aa, Mycobacterium avium
IKHKCADMLVDLEWARSASQAALEALDD

SEQ ID NO: 98771 - protein, 21 aa, Mycobacterium avium
IKLKPDCVVYAAMSDEMDAAA

SEQ ID NO: 98772 - protein, 17 aa, Mycobacterium avium
IKLYDAGHFDIYVGADF

SEQ ID NO: 98773 - protein, 18 aa, Mycobacterium avium
IKNFQPWIAEIQVPGSAS

SEQ ID NO: 98774 - protein, 18 aa, Mycobacterium avium
IKPLFVLFDSCWDPFPQP

SEQ ID NO: 98775 - protein, 21 aa, Mycobacterium avium
ILAALWALIGYDIPRPIPRIS

SEQ ID NO: 98776 - protein, 18 aa, Mycobacterium avium
ILADWGADVIKIEPPTGD

SEQ ID NO: 98777 - protein, 17 aa, Mycobacterium avium
ILALRRAGDLAAGGTVV

SEQ ID NO: 98778 - protein, 17 aa, Mycobacterium avium
ILAMVLAAFEWGTERDT

SEQ ID NO: 98779 - protein, 27 aa, Mycobacterium avium
ILAYTGLRWSELVGLRVKDIDLVARRL

SEQ ID NO: 98780 - protein, 17 aa, Mycobacterium avium
ILDLGPGDILTRLTAPV

SEQ ID NO: 98781 - protein, 20 aa, Mycobacterium avium
ILDRTPWRAEEPVVIVAPMF

SEQ ID NO: 98782 - protein, 27 aa, Mycobacterium avium
ILELLARLQADLGLAYLFISHDLAVIR

SEQ ID NO: 98783 - protein, 17 aa, Mycobacterium avium
ILELVAPQSGSIEVLGT

SEQ ID NO: 98784 - protein, 17 aa, Mycobacterium avium
ILEPFGLEKMRYKWRKW

SEQ ID NO: 98785 - protein, 22 aa, Mycobacterium avium
ILGDPWPSAGVRLQMLEEAVEV

SEQ ID NO: 98786 - protein, 23 aa, Mycobacterium avium
ILGDPWPSAGVRLQMLEEAVEVI

SEQ ID NO: 98787 - protein, 22 aa, Mycobacterium avium
ILGDPWPSAGVRLQMLERPSRS

SEQ ID NO: 98788 - protein, 17 aa, Mycobacterium avium
ILGPQYKSPRLVKPEIL

SEQ ID NO: 98789 - protein, 18 aa, Mycobacterium avium
ILGPQYKSPRLVKPEILA

SEQ ID NO: 98790 - protein, 17 aa, Mycobacterium avium
ILGQGVAYQARFDPQAK

SEQ ID NO: 98791 - protein, 17 aa, Mycobacterium avium
ILIDEWVAYARSLLGRD

SEQ ID NO: 98792 - protein, 17 aa, Mycobacterium avium
ILLGSSYYDDWTDQEMF

SEQ ID NO: 98793 - protein, 18 aa, Mycobacterium avium
ILMGFGYHRGRDENQLVL

SEQ ID NO: 98794 - protein, 18 aa, Mycobacterium avium
ILPASGMHHLSRVVLGIP

SEQ ID NO: 98795 - protein, 17 aa, Mycobacterium avium
ILQCSRALSDYGVEPRH

SEQ ID NO: 98796 - protein, 26 aa, Mycobacterium avium
ILQRYKDLQDIIAILGIDELSEEDKQ

SEQ ID NO: 98797 - protein, 23 aa, Mycobacterium avium
ILRAAGPGAWCAAPWRGDGHPDH

SEQ ID NO: 98798 - protein, 20 aa, Mycobacterium avium
ILRPREVPLGGPRALRVQRT

SEQ ID NO: 98799 - protein, 23 aa, Mycobacterium avium
ILRTNLAAVLLQMAALRLGDIEN

SEQ ID NO: 98800 - protein, 23 aa, Mycobacterium avium
ILSETYGLIVYQEQIMFIAQKVA

SEQ ID NO: 98801 - protein, 27 aa, Mycobacterium avium
ILTGRPAISVPLHWTDDGLPLGVQFVG

SEQ ID NO: 98802 - protein, 25 aa, Mycobacterium avium
IMAGLYIKELILRDDVKQCLIVAPG

SEQ ID NO: 98803 - protein, 27 aa, Mycobacterium avium
IMIPEKHLPLVMPLRYIGIDENTLNKL

SEQ ID NO: 98804 - protein, 23 aa, Mycobacterium avium
IMSSCANSQMGVWSLNSPDRTVV

SEQ ID NO: 98805 - protein, 18 aa, Mycobacterium avium
IMTDVWPNYDVYQSRTDR

SEQ ID NO: 98806 - protein, 19 aa, Mycobacterium avium
IMVHQRIRAPLRRVKGHLA

SEQ ID NO: 98807 - protein, 25 aa, Mycobacterium avium
INADNRLAVHIAFDPDDITGAIAEL

SEQ ID NO: 98808 - protein, 24 aa, Mycobacterium avium
INDLELLNCLLLLFMAGLDTVSNQ

SEQ ID NO: 98809 - protein, 19 aa, Mycobacterium avium
INDRCRALRPHAQTLVDGF

SEQ ID NO: 98810 - protein, 18 aa, Mycobacterium avium
INEILASKKLPPEKLAEI

SEQ ID NO: 98811 - protein, 18 aa, Mycobacterium avium
INHLGHFALTCLLGDRIR

SEQ ID NO: 98812 - protein, 25 aa, Mycobacterium avium
INIAGWHRFPLRDKVAAVVPATPVV

SEQ ID NO: 98813 - protein, 18 aa, Mycobacterium avium
INISPANAKWFFDNFGPG

SEQ ID NO: 98814 - protein, 27 aa, Mycobacterium avium
INLAMTEFKMFYKLPVEGLDIPKSALG

SEQ ID NO: 98815 - protein, 20 aa, Mycobacterium avium
INNEFTREWLAKMAAATDTP

SEQ ID NO: 98816 - protein, 17 aa, Mycobacterium avium
INNVLAFPGVFRGALEA

SEQ ID NO: 98817 - protein, 17 aa, Mycobacterium avium
INPGLGMDGSVSFDIPP

SEQ ID NO: 98818 - protein, 19 aa, Mycobacterium avium
INRHIKRGGKVWINVFPDR

SEQ ID NO: 98819 - protein, 17 aa, Mycobacterium avium
INRLIPALVKSTAGNSI

SEQ ID NO: 98820 - protein, 19 aa, Mycobacterium avium
INRLIPALVKSTAGNSISV

SEQ ID NO: 98821 - protein, 17 aa, Mycobacterium avium
INRMAPDLAPQWASAPH

SEQ ID NO: 98822 - protein, 17 aa, Mycobacterium avium
INTLASIFTTVRIEGPD

SEQ ID NO: 98823 - protein, 24 aa, Mycobacterium avium
INWGARGPLQWEAPYGHTLISKYA

SEQ ID NO: 98824 - protein, 27 aa, Mycobacterium avium
IPADPTMAWRYLELHANGSESDAQIRR

SEQ ID NO: 98825 - protein, 17 aa, Mycobacterium avium
IPAGARLQYGPGQLGTA

SEQ ID NO: 98826 - protein, 17 aa, Mycobacterium avium
IPALLGILSVGAVYLPI

SEQ ID NO: 98827 - protein, 17 aa, Mycobacterium avium
IPALVAVAQHLGVGGAD

SEQ ID NO: 98828 - protein, 29 aa, Mycobacterium avium
IPCRCAPAPRPIRCVLRSGFVGAAIRCRR

SEQ ID NO: 98829 - protein, 20 aa, Mycobacterium avium
IPDDIKRLLSSLVAESTASG

SEQ ID NO: 98830 - protein, 21 aa, Mycobacterium avium
IPDEKWRGITAPVMIVASGKD

SEQ ID NO: 98831 - protein, 18 aa, Mycobacterium avium
IPDLRFSVEGVYQGIDTV

SEQ ID NO: 98832 - protein, 19 aa, Mycobacterium avium
IPDYEIKPGTQLTYTAALR

SEQ ID NO: 98833 - protein, 24 aa, Mycobacterium avium
IPDYEIRPGTQLTYTAALRSVESL

SEQ ID NO: 98834 - protein, 22 aa, Mycobacterium avium
IPEERLETICRHIMLYHLDRGW

SEQ ID NO: 98835 - protein, 30 aa, Mycobacterium avium
IPEHARRDAFHWLSLTTEFGITVWNSVPGL

SEQ ID NO: 98836 - protein, 22 aa, Mycobacterium avium
IPEIRPAQVVSIRPGDLLVMRT

SEQ ID NO: 98837 - protein, 23 aa, Mycobacterium avium
IPFAAKLTGPWDIDALIAAVGDV

SEQ ID NO: 98838 - protein, 24 aa, Mycobacterium avium
IPFAARLTGPWDIDALIAAVGDVV

SEQ ID NO: 98839 - protein, 25 aa, Mycobacterium avium
IPFAARLTGPWDIDALIAAVGDVVA

SEQ ID NO: 98840 - protein, 27 aa, Mycobacterium avium
IPGAKPRAVLTMLGLHGGALVSADALM

SEQ ID NO: 98841 - protein, 17 aa, Mycobacterium avium
IPGELVPGVPFSFDPTV

SEQ ID NO: 98842 - protein, 20 aa, Mycobacterium avium
IPGFERTLIGRALDFWNEEV

SEQ ID NO: 98843 - protein, 22 aa, Mycobacterium avium
IPGLDIENYWFRRHEVVYQRLA

SEQ ID NO: 98844 - protein, 20 aa, Mycobacterium avium
IPGLRQALGLAEDGTDERSA

SEQ ID NO: 98845 - protein, 19 aa, Mycobacterium avium
IPGRHQLFMHACDVSRRPD

SEQ ID NO: 98846 - protein, 22 aa, Mycobacterium avium
IPGRLLMGVTGVRPAGQQNTAG

SEQ ID NO: 98847 - protein, 21 aa, Mycobacterium avium
IPGRLLMGVTGVRTAGQQNTA

SEQ ID NO: 98848 - protein, 17 aa, Mycobacterium avium
IPHEVGWIGGPGQGAVH

SEQ ID NO: 98849 - protein, 18 aa, Mycobacterium avium
IPHRDCGSFAAGGMATAD

SEQ ID NO: 98850 - protein, 26 aa, Mycobacterium avium
IPHVMVPGLAAALWATTARRALVLNL

SEQ ID NO: 98851 - protein, 18 aa, Mycobacterium avium
IPIGKLSLYTLIGGIDPA

SEQ ID NO: 98852 - protein, 23 aa, Mycobacterium avium
IPKTFRHMHGFGLHTFSFLNAAG

SEQ ID NO: 98853 - protein, 17 aa, Mycobacterium avium
IPLALALLRKGGVCVLT

SEQ ID NO: 98854 - protein, 18 aa, Mycobacterium avium
IPLALALLRKGGVCVLTG

SEQ ID NO: 98855 - protein, 22 aa, Mycobacterium avium
IPLPPDQNGYVFIETKSGSTRC

SEQ ID NO: 98856 - protein, 21 aa, Mycobacterium avium
IPLQSAYCGAKHAVNGFTESV

SEQ ID NO: 98857 - protein, 19 aa, Mycobacterium avium
IPLTAHFLGGAVIGQDAEH

SEQ ID NO: 98858 - protein, 19 aa, Mycobacterium avium
IPLTAHFLGGAVIGQDAER

SEQ ID NO: 98859 - protein, 25 aa, Mycobacterium avium
IPMTARAAWAWFRHLHTLAGRTLAP

SEQ ID NO: 98860 - protein, 17 aa, Mycobacterium avium
IPMYFGAELVKVTPMDF

SEQ ID NO: 98861 - protein, 19 aa, Mycobacterium avium
IPPAVSAYTGLPGDPVGPP

SEQ ID NO: 98862 - protein, 17 aa, Mycobacterium avium
IPPLRISARYAAEMRRK

SEQ ID NO: 98863 - protein, 22 aa, Mycobacterium avium
IPPPNEPGAIFADRQAYESWKS

SEQ ID NO: 98864 - protein, 20 aa, Mycobacterium avium
IPQHGEPFLSNWTPVAQPQT

SEQ ID NO: 98865 - protein, 21 aa, Mycobacterium avium
IPRFLRKLLRELPPAPDTDRS

SEQ ID NO: 98866 - protein, 21 aa, Mycobacterium avium
IPRHVEVVERIGFTAAGKLDR

SEQ ID NO: 98867 - protein, 24 aa, Mycobacterium avium
IPRTELLDRLGAHLTRHVGPGVEY

SEQ ID NO: 98868 - protein, 18 aa, Mycobacterium avium
IPSALLDRMELVTIDGYT

SEQ ID NO: 98869 - protein, 26 aa, Mycobacterium avium
IPSALPGDLHWDRILFCAKEATYKAW

SEQ ID NO: 98870 - protein, 18 aa, Mycobacterium avium
IPSGLAFDTVFAGDPSDR

SEQ ID NO: 98871 - protein, 18 aa, Mycobacterium avium
IPVTRVEVLTGFPEVLDG

SEQ ID NO: 98872 - protein, 27 aa, Mycobacterium avium
IPWFPKDLQAWSVRWVILHVINELARH

SEQ ID NO: 98873 - protein, 23 aa, Mycobacterium avium
IQALNRLAGTFAEQRDVVSQALQ

SEQ ID NO: 98874 - protein, 24 aa, Mycobacterium avium
IQCGPCPFSGELAARGHRVQAGLH

SEQ ID NO: 98875 - protein, 27 aa, Mycobacterium avium
IQDVKWQRPGAETVWFEIHVNPLVDAE

SEQ ID NO: 98876 - protein, 19 aa, Mycobacterium avium
IQGDDRFTILIAVDHLRAD

SEQ ID NO: 98877 - protein, 22 aa, Mycobacterium avium
IQITDAPLIRWLGHKKAAAVVL

SEQ ID NO: 98878 - protein, 27 aa, Mycobacterium avium
IQKEIAEALGGISDLFAEVDRVMSSAG

SEQ ID NO: 98879 - protein, 25 aa, Mycobacterium avium
IQNLSGFSGMYSRGGSGSADMSMTG

SEQ ID NO: 98880 - protein, 19 aa, Mycobacterium avium
IQPALSPARQWAGRQGSAG

SEQ ID NO: 98881 - protein, 26 aa, Mycobacterium avium
IQRLCGLGLGIGRPVALHSKKANKAA

SEQ ID NO: 98882 - protein, 26 aa, Mycobacterium avium
IQSKEGFFWRATLWATQETPVDNSIE

SEQ ID NO: 98883 - protein, 19 aa, Mycobacterium avium
IRAECGVEIGIRDVFELAT

SEQ ID NO: 98884 - protein, 25 aa, Mycobacterium avium
IRAELPLTPRRARAVQRDRDDIAAI

SEQ ID NO: 98885 - protein, 19 aa, Mycobacterium avium
IRAGVPSLVLAVSVDQPLW

SEQ ID NO: 98886 - protein, 17 aa, Mycobacterium avium
IRALTAYCVAKGGLEAL

SEQ ID NO: 98887 - protein, 22 aa, Mycobacterium avium
IRANVICPGFIETPMAHNVFSI

SEQ ID NO: 98888 - protein, 18 aa, Mycobacterium avium
IRARVAAALPDYMTPAAY

SEQ ID NO: 98889 - protein, 32 aa, Mycobacterium avium
IRARWVRALVDLRVARLLAYRAVSLQDDPASG

SEQ ID NO: 98890 - protein, 17 aa, Mycobacterium avium
IRAVTLAALAPRPGERL

SEQ ID NO: 98891 - protein, 19 aa, Mycobacterium avium
IRCQLRSLLVEDVRQRLRR

SEQ ID NO: 98892 - protein, 18 aa, Mycobacterium avium
IRDARRIADWNPRLRFLE

SEQ ID NO: 98893 - protein, 26 aa, Mycobacterium avium
IRFAEGERVWLSWAMANRDPSLFDNP

SEQ ID NO: 98894 - protein, 26 aa, Mycobacterium avium
IRGPGRYPFDPVVSALILRALVTRVP

SEQ ID NO: 98895 - protein, 18 aa, Mycobacterium avium
IRHSLSRGAMRIVARMTS

SEQ ID NO: 98896 - protein, 22 aa, Mycobacterium avium
IRIEDVPEIWRRLESVGLQTTE

SEQ ID NO: 98897 - protein, 17 aa, Mycobacterium avium
IRKGQRVVMFYRSANFD

SEQ ID NO: 98898 - protein, 17 aa, Mycobacterium avium
IRKHIAWYLHGFPAGSE

SEQ ID NO: 98899 - protein, 31 aa, Mycobacterium avium
IRKRVEPWLDCGLTGLVVRYGPEMTPEPVPE

SEQ ID NO: 98900 - protein, 18 aa, Mycobacterium avium
IRLAYDILTKGDGFKDLV

SEQ ID NO: 98901 - protein, 20 aa, Mycobacterium avium
IRLAYLSSFGSTVVPQLIAR

SEQ ID NO: 98902 - protein, 21 aa, Mycobacterium avium
IRLPDRTWPDKVIDRAPLWCA

SEQ ID NO: 98903 - protein, 19 aa, Mycobacterium avium
IRLPERFDVGEGYGRTTWN

SEQ ID NO: 98904 - protein, 18 aa, Mycobacterium avium
IRLRFGLDDGQPRTLDQI

SEQ ID NO: 98905 - protein, 22 aa, Mycobacterium avium
IRLRLFHGRGGTVGRGGGPSYE

SEQ ID NO: 98906 - protein, 21 aa, Mycobacterium avium
IRMAAKAIHYLAVFDEHTGRP

SEQ ID NO: 98907 - protein, 17 aa, Mycobacterium avium
IRMSGGIEDVVRAYEGE

SEQ ID NO: 98908 - protein, 27 aa, Mycobacterium avium
IRNALPLLRAADWGRIVTFAAHSIQRQ

SEQ ID NO: 98909 - protein, 19 aa, Mycobacterium avium
IRNELARVLAIVEVVTERP

SEQ ID NO: 98910 - protein, 20 aa, Mycobacterium avium
IRPGDLLVMRTDGIIDDYLD

SEQ ID NO: 98911 - protein, 17 aa, Mycobacterium avium
IRPGRLAGNAGPLGDVH

SEQ ID NO: 98912 - protein, 25 aa, Mycobacterium avium
IRQVTSITWCRRRTVQVGRIAARVP

SEQ ID NO: 98913 - protein, 24 aa, Mycobacterium avium
IRQYCIRCLDPLVGSSSFDIIAEL

SEQ ID NO: 98914 - protein, 17 aa, Mycobacterium avium
IRREIDEAAGIAWDDLL

SEQ ID NO: 98915 - protein, 30 aa, Mycobacterium avium
IRRQGVRKLAGFWGHAWQSAVFPSGKAFGY

SEQ ID NO: 98916 - protein, 17 aa, Mycobacterium avium
IRRSDVFLTNYLPSTRK

SEQ ID NO: 98917 - protein, 25 aa, Mycobacterium avium
IRSEEVPVVVLLWSPRSDACVQLLD

SEQ ID NO: 98918 - protein, 18 aa, Mycobacterium avium
IRSILSFELFVDRTSMAA

SEQ ID NO: 98919 - protein, 18 aa, Mycobacterium avium
IRSYGEFGIQLQAADAAA

SEQ ID NO: 98920 - protein, 22 aa, Mycobacterium avium
IRTGSFSINGGNYFGADSPFGG

SEQ ID NO: 98921 - protein, 17 aa, Mycobacterium avium
IRTLRFILQELPLLLQV

SEQ ID NO: 98922 - protein, 18 aa, Mycobacterium avium
IRVAFWEKLLAAVRRRTL

SEQ ID NO: 98923 - protein, 19 aa, Mycobacterium avium
IRVAQLFSGLLGHERVGVD

SEQ ID NO: 98924 - protein, 18 aa, Mycobacterium avium
IRVAQRLTALTGESDDRV

SEQ ID NO: 98925 - protein, 17 aa, Mycobacterium avium
IRVDGNDVLACYAVTAE

SEQ ID NO: 98926 - protein, 25 aa, Mycobacterium avium
IRWMPTDPMFSRWVMADTELAGVSI

SEQ ID NO: 98927 - protein, 19 aa, Mycobacterium avium
ISAALRAPVVSLELVDPRF

SEQ ID NO: 98928 - protein, 25 aa, Mycobacterium avium
ISAEWRRHLSGWIGLDSYDERNTVG

SEQ ID NO: 98929 - protein, 31 aa, Mycobacterium avium
ISCGGALEHLRAAMAAAGWTAEVERFPEPGN

SEQ ID NO: 98930 - protein, 28 aa, Mycobacterium avium
ISDAGLIAPHWPKPWGLDAGPLRQLIID

SEQ ID NO: 98931 - protein, 26 aa, Mycobacterium avium
ISEDLKRLWPSLGTALMSLADGADLL

SEQ ID NO: 98932 - protein, 17 aa, Mycobacterium avium
ISEGMGVPARRVSTAEE

SEQ ID NO: 98933 - protein, 18 aa, Mycobacterium avium
ISEGMGVPARRVSTAEEF

SEQ ID NO: 98934 - protein, 32 aa, Mycobacterium avium
ISEPMPVAASFSWEFENGFSLSRIARLDTMVT

SEQ ID NO: 98935 - protein, 21 aa, Mycobacterium avium
ISEQLMPHWLLSLQAEATRRG

SEQ ID NO: 98936 - protein, 23 aa, Mycobacterium avium
ISERGAHYWGRYGAAGLLLRAPQ

SEQ ID NO: 98937 - protein, 18 aa, Mycobacterium avium
ISGAFGPVYDAERFGARL

SEQ ID NO: 98938 - protein, 19 aa, Mycobacterium avium
ISPAAARFIEEIARQTARR

SEQ ID NO: 98939 - protein, 25 aa, Mycobacterium avium
ISPGRSGRGFAQWLSETWAQVVDHP

SEQ ID NO: 98940 - protein, 25 aa, Mycobacterium avium
ISPPLNLDPRWVGAHVGHTVGKYAE

SEQ ID NO: 98941 - protein, 17 aa, Mycobacterium avium
ISPRIARNTALIDLAGE

SEQ ID NO: 98942 - protein, 21 aa, Mycobacterium avium
ISPTPRPATVITVAPAGTTLS

SEQ ID NO: 98943 - protein, 19 aa, Mycobacterium avium
ISQRLDWARVVAGEAALGA

SEQ ID NO: 98944 - protein, 17 aa, Mycobacterium avium
ISREDQDEWALRSHQRA

SEQ ID NO: 98945 - protein, 17 aa, Mycobacterium avium
ISRRLPTGTALIALIET

SEQ ID NO: 98946 - protein, 21 aa, Mycobacterium avium
ISSETGLSCSVGISDNKQRAK

SEQ ID NO: 98947 - protein, 28 aa, Mycobacterium avium
ISSHFLPGIAGPAGWRVYLGTRRDERQE

SEQ ID NO: 98948 - protein, 20 aa, Mycobacterium avium
ISSQAEYDRFVWVDNSDQPW

SEQ ID NO: 98949 - protein, 25 aa, Mycobacterium avium
ISTAFLYDHFTPFVFTQLEELGFCG

SEQ ID NO: 98950 - protein, 17 aa, Mycobacterium avium
ISTLDWFSGGRAQVTVG

SEQ ID NO: 98951 - protein, 17 aa, Mycobacterium avium
ISVTVRYFAAARAAAGA

SEQ ID NO: 98952 - protein, 18 aa, Mycobacterium avium
ISVTVRYFAAARAAAGAE

SEQ ID NO: 98953 - protein, 17 aa, Mycobacterium avium
ISVTVRYFAAARAATGA

SEQ ID NO: 98954 - protein, 23 aa, Mycobacterium avium
ITAEEGVVFNAEISAAIDESLAR

SEQ ID NO: 98955 - protein, 22 aa, Mycobacterium avium
ITAEIGAPISFARRAQVGLPAF

SEQ ID NO: 98956 - protein, 20 aa, Mycobacterium avium
ITAVGVLRAYASITPHYPFS

SEQ ID NO: 98957 - protein, 21 aa, Mycobacterium avium
ITCAIRAWAYQIDDLAGDYRV

SEQ ID NO: 98958 - protein, 17 aa, Mycobacterium avium
ITDPATFWRMQGPGHAA

SEQ ID NO: 98959 - protein, 19 aa, Mycobacterium avium
ITDPVLARRDGDVLRIAFN

SEQ ID NO: 98960 - protein, 19 aa, Mycobacterium avium
ITEAVARIAALPAEQRQAA

SEQ ID NO: 98961 - protein, 26 aa, Mycobacterium avium
ITELRYRQMRNFWATLMVSQGTPMIA

SEQ ID NO: 98962 - protein, 18 aa, Mycobacterium avium
ITGLPGVLSRRIDPRNGT

SEQ ID NO: 98963 - protein, 20 aa, Mycobacterium avium
ITGLPGVLSRRIDPRNGTVL

SEQ ID NO: 98964 - protein, 20 aa, Mycobacterium avium
ITHGGYRVAAVWSSTDRGLE

SEQ ID NO: 98965 - protein, 21 aa, Mycobacterium avium
ITKRAGVSVGALFRHFDTMGD

SEQ ID NO: 98966 - protein, 21 aa, Mycobacterium avium
ITLALLSNRPILVVGDLEQVR

SEQ ID NO: 98967 - protein, 22 aa, Mycobacterium avium
ITLALLSNRPILVVGDLEQVRD

SEQ ID NO: 98968 - protein, 18 aa, Mycobacterium avium
ITLARMMTRRQFGRTLFE

SEQ ID NO: 98969 - protein, 23 aa, Mycobacterium avium
ITLGNLRARFNIALDIGSSGFSG

SEQ ID NO: 98970 - protein, 18 aa, Mycobacterium avium
ITPFNFPAMIPLWKAGPA

SEQ ID NO: 98971 - protein, 20 aa, Mycobacterium avium
ITPGEALAGITPANISGPGP

SEQ ID NO: 98972 - protein, 17 aa, Mycobacterium avium
ITPWRSVLVGDLREEVA

SEQ ID NO: 98973 - protein, 18 aa, Mycobacterium avium
ITPWRSVLVGDLREEVAD

SEQ ID NO: 98974 - protein, 17 aa, Mycobacterium avium
ITQEAVFQKRAPANRPD

SEQ ID NO: 98975 - protein, 40 aa, Mycobacterium avium
ITQQRPSRLVVCLDLDWRPQFRVDLVPSYKAHRVPEAEPA

SEQ ID NO: 98976 - protein, 17 aa, Mycobacterium avium
ITRCDMTVAVDVGAADR

SEQ ID NO: 98977 - protein, 17 aa, Mycobacterium avium
ITRPSAANADVFETAVA

SEQ ID NO: 98978 - protein, 17 aa, Mycobacterium avium
ITSFWFAFGSPRTAREQ

SEQ ID NO: 98979 - protein, 19 aa, Mycobacterium avium
ITSVSSLRNGGVRLNAELQ

SEQ ID NO: 98980 - protein, 24 aa, Mycobacterium avium
ITVGVGYCPRWYFDEVGGGDLSQA

SEQ ID NO: 98981 - protein, 18 aa, Mycobacterium avium
ITVYYAFKQSEMTDSGEA

SEQ ID NO: 98982 - protein, 21 aa, Mycobacterium avium
ITYENACRWYSFDPFEHRTRE

SEQ ID NO: 98983 - protein, 25 aa, Mycobacterium avium
IVAVAKRFADKSVRSAHAVFSRAVA

SEQ ID NO: 98984 - protein, 21 aa, Mycobacterium avium
IVAVVRGWAIGLGFHIALASD

SEQ ID NO: 98985 - protein, 25 aa, Mycobacterium avium
IVAWDIPGTCDIAAMTATINAHVRR

SEQ ID NO: 98986 - protein, 23 aa, Mycobacterium avium
IVCVDPRLTPVARHATVHLAPLP

SEQ ID NO: 98987 - protein, 23 aa, Mycobacterium avium
IVCVQRFGPLIAEIPDTVRVIRQ

SEQ ID NO: 98988 - protein, 24 aa, Mycobacterium avium
IVDRVKDMIVTGGFNVFPREVEDV

SEQ ID NO: 98989 - protein, 30 aa, Mycobacterium avium
IVDVGSVLELRPDYGVGIVTALVRVEGVPC

SEQ ID NO: 98990 - protein, 19 aa, Mycobacterium avium
IVEELMRYLSIVHSQVDRV

SEQ ID NO: 98991 - protein, 32 aa, Mycobacterium avium
IVEGGYPTTLWARRPATLEVFADTDAKVAGSP

SEQ ID NO: 98992 - protein, 17 aa, Mycobacterium avium
IVEHVGRRSGKPYRTPV

SEQ ID NO: 98993 - protein, 23 aa, Mycobacterium avium
IVEQLPRKVALELVLTGEPMTAS

SEQ ID NO: 98994 - protein, 17 aa, Mycobacterium avium
IVEVRRLLPEIPLVASG

SEQ ID NO: 98995 - protein, 19 aa, Mycobacterium avium
IVGAKGKAALLRELSDAVP

SEQ ID NO: 98996 - protein, 18 aa, Mycobacterium avium
IVGALGRLGHSGISDVRQ

SEQ ID NO: 98997 - protein, 27 aa, Mycobacterium avium
IVGHDRLRLALLLCAVRPEIGGALIRG

SEQ ID NO: 98998 - protein, 26 aa, Mycobacterium avium
IVGRACWAAPGGQGWLHGEAVVDDTT

SEQ ID NO: 98999 - protein, 20 aa, Mycobacterium avium
IVGRACWAAPGGQRWLHGEA

SEQ ID NO: 99000 - protein, 27 aa, Mycobacterium avium
IVLAAADLVTWARLIGFRAHPGLARAE

SEQ ID NO: 99001 - protein, 25 aa, Mycobacterium avium
IVLGMARCRIPVVAAVNGPAVGLGC

SEQ ID NO: 99002 - protein, 18 aa, Mycobacterium avium
IVLGRRGAAHAAFSVGEL

SEQ ID NO: 99003 - protein, 25 aa, Mycobacterium avium
IVLIDACKPFAWKDSYPRANRFDDN

SEQ ID NO: 99004 - protein, 18 aa, Mycobacterium avium
IVLQCFRGKAAERAKIDE

SEQ ID NO: 99005 - protein, 30 aa, Mycobacterium avium
IVPAEGFLPTLLDWCRRNDVLFIADEVQTG

SEQ ID NO: 99006 - protein, 33 aa, Mycobacterium avium
IVPAEGFLPTLLDWCRRNDVLFIADEVQTGFAR

SEQ ID NO: 99007 - protein, 23 aa, Mycobacterium avium
IVPEPRPGPALDGRSVDQVLQQC

SEQ ID NO: 99008 - protein, 23 aa, Mycobacterium avium
IVPEPRPGPALNGRSVDQVLQQC

SEQ ID NO: 99009 - protein, 34 aa, Mycobacterium avium
IVPIGAGCKICDRAACPQRAFPYLGRPVSVDPHR

SEQ ID NO: 99010 - protein, 19 aa, Mycobacterium avium
IVRCLKRAERLGAARVEVS

SEQ ID NO: 99011 - protein, 23 aa, Mycobacterium avium
IVRCLKRAQRLGATRVEVSEEAN

SEQ ID NO: 99012 - protein, 23 aa, Mycobacterium avium
IVRLCALSQSLGAIALKGLTTAP

SEQ ID NO: 99013 - protein, 20 aa, Mycobacterium avium
IVRLEPPAPMLPRVTTTEVT

SEQ ID NO: 99014 - protein, 19 aa, Mycobacterium avium
IVRLLPPARAAGVRIVHCL

SEQ ID NO: 99015 - protein, 29 aa, Mycobacterium avium
IVRLLPPARAAGVRIVHCLVQRRPDGLGS

SEQ ID NO: 99016 - protein, 19 aa, Mycobacterium avium
IVSSVGYTALLVAGWRALH

SEQ ID NO: 99017 - protein, 19 aa, Mycobacterium avium
IVVKLRLAIDALIDLARRV

SEQ ID NO: 99018 - protein, 19 aa, Mycobacterium avium
IVVPERWGGAGAGVVELAV

SEQ ID NO: 99019 - protein, 24 aa, Mycobacterium avium
IVYALPCYHMFGYIEGLLSAMFVG

SEQ ID NO: 99020 - protein, 18 aa, Mycobacterium avium
IWASRPADLYGRRDHDRF

SEQ ID NO: 99021 - protein, 24 aa, Mycobacterium avium
IWFFLAPSAPEWAIRSGATVKVFE

SEQ ID NO: 99022 - protein, 19 aa, Mycobacterium avium
IWGALAGGGRLVVVPESVT

SEQ ID NO: 99023 - protein, 22 aa, Mycobacterium avium
IWSALRRIPLRELRRTGLLDKL

SEQ ID NO: 99024 - protein, 19 aa, Mycobacterium avium
IYALACVLFECLTGSAPYR

SEQ ID NO: 99025 - protein, 17 aa, Mycobacterium avium
IYFLGSAEGLIFDVPSA

SEQ ID NO: 99026 - protein, 18 aa, Mycobacterium avium
IYGAGTAFAHRIADVDPV

SEQ ID NO: 99027 - protein, 31 aa, Mycobacterium avium
IYLNTFRHLYGLDCSHIAPANVYGPRQDPHG

SEQ ID NO: 99028 - protein, 21 aa, Mycobacterium avium
IYPQEVENVLTLHPKVFDVAV

SEQ ID NO: 99029 - protein, 18 aa, Mycobacterium avium
IYRFEGQASVCWEDAPDG

SEQ ID NO: 99030 - protein, 25 aa, Mycobacterium avium
IYSDGRYSYQLTIYVFRYGDGTAMA

SEQ ID NO: 99031 - protein, 27 aa, Mycobacterium avium
IYTSPDIRALYAFKRLAWWPYSVVMRQ

SEQ ID NO: 99032 - protein, 24 aa, Mycobacterium avium
IYVFRYGDGTAMAMMYPDNPVAHK

SEQ ID NO: 99033 - protein, 17 aa, Mycobacterium avium
IYVGADFERNVTDQLNF

SEQ ID NO: 99034 - protein, 17 aa, Mycobacterium avium
IYYEGGHSFQYLKDDAK

SEQ ID NO: 99035 - protein, 18 aa, Mycobacterium avium
KAAAVVLRPDGFIYAAAQ

SEQ ID NO: 99036 - protein, 18 aa, Mycobacterium avium
KAAEFGDEVIRQFTQDIE

SEQ ID NO: 99037 - protein, 18 aa, Mycobacterium avium
KAAEFGGEVIRQFTQDIE

SEQ ID NO: 99038 - protein, 19 aa, Mycobacterium avium
KAAEILGVEHIWLGFVDSG

SEQ ID NO: 99039 - protein, 17 aa, Mycobacterium avium
KAAELYRRLAMAPDHVC

SEQ ID NO: 99040 - protein, 28 aa, Mycobacterium avium
KAAGGRANDVSFIWAKMNRVIANKRASD

SEQ ID NO: 99041 - protein, 18 aa, Mycobacterium avium
KAAGLAVRTRDIFTEQTV

SEQ ID NO: 99042 - protein, 18 aa, Mycobacterium avium
KAALRYTDALIWTPAHLV

SEQ ID NO: 99043 - protein, 17 aa, Mycobacterium avium
KAARRGLTSASFEVADI

SEQ ID NO: 99044 - protein, 17 aa, Mycobacterium avium
KAAVDVFKEKLIRRDIS

SEQ ID NO: 99045 - protein, 25 aa, Mycobacterium avium
KAAVYLADCRKLGITVLPPDVNESL

SEQ ID NO: 99046 - protein, 19 aa, Mycobacterium avium
KADGIGWLILDRPEAGNAF

SEQ ID NO: 99047 - protein, 27 aa, Mycobacterium avium
KADPGLLKWLEDPKVGGVELRGFSRIG

SEQ ID NO: 99048 - protein, 17 aa, Mycobacterium avium
KADVLLDCFRPGTCERL

SEQ ID NO: 99049 - protein, 19 aa, Mycobacterium avium
KADYTLRIATGTVELAPGR

SEQ ID NO: 99050 - protein, 20 aa, Mycobacterium avium
KAELFPAPKTTAAGKPDILS

SEQ ID NO: 99051 - protein, 20 aa, Mycobacterium avium
KAELFRAVFEDVENDLTLRS

SEQ ID NO: 99052 - protein, 23 aa, Mycobacterium avium
KAFPRSDVLISYHAPFGTGVNFH

SEQ ID NO: 99053 - protein, 34 aa, Mycobacterium avium
KAGASGWCTAAPCLRPQPCIDLYGAVRANDLDAA

SEQ ID NO: 99054 - protein, 20 aa, Mycobacterium avium
KAGDWRPLADFYAKDATYGW

SEQ ID NO: 99055 - protein, 27 aa, Mycobacterium avium
KAGERPVREWCEMWLSAQPVRAPATER

SEQ ID NO: 99056 - protein, 24 aa, Mycobacterium avium
KAGGLPGDLTFSWYAVDKTHQPWV

SEQ ID NO: 99057 - protein, 20 aa, Mycobacterium avium
KAHVSLAQMEYMLPRLRGWG

SEQ ID NO: 99058 - protein, 25 aa, Mycobacterium avium
KAIKEAGLRSRILLQVHDELLFEVA

SEQ ID NO: 99059 - protein, 22 aa, Mycobacterium avium
KAKALGLRPRARIISQALVGAE

SEQ ID NO: 99060 - protein, 17 aa, Mycobacterium avium
KAKKLRVRLPLPKLTVA

SEQ ID NO: 99061 - protein, 17 aa, Mycobacterium avium
KALAALDGWTTDALDYG

SEQ ID NO: 99062 - protein, 18 aa, Mycobacterium avium
KALLRRLVEAGTRVVQYG

SEQ ID NO: 99063 - protein, 17 aa, Mycobacterium avium
KALPGDRVAILGVGGLG

SEQ ID NO: 99064 - protein, 20 aa, Mycobacterium avium
KALPGLGGLGGMLGGGAAAA

SEQ ID NO: 99065 - protein, 18 aa, Mycobacterium avium
KALSATKRLVWSGVGVPV

SEQ ID NO: 99066 - protein, 24 aa, Mycobacterium avium
KAMARPTLRHRVMLRPEAELEGAT

SEQ ID NO: 99067 - protein, 18 aa, Mycobacterium avium
KAPASHRANVLFRAARII

SEQ ID NO: 99068 - protein, 18 aa, Mycobacterium avium
KAQDPKGGRIINFGSSEA

SEQ ID NO: 99069 - protein, 19 aa, Mycobacterium avium
KAQIGKGMWAMTELMADMV

SEQ ID NO: 99070 - protein, 19 aa, Mycobacterium avium
KAQLRYEITVEQALAAPIV

SEQ ID NO: 99071 - protein, 20 aa, Mycobacterium avium
KAQVKTGGRGKAGGVKYAAT

SEQ ID NO: 99072 - protein, 20 aa, Mycobacterium avium
KARAVIMKAARAIASGDERA

SEQ ID NO: 99073 - protein, 17 aa, Mycobacterium avium
KARELATYFVGQVVGSL

SEQ ID NO: 99074 - protein, 20 aa, Mycobacterium avium
KARPRYVRIAADLPSTATHK

SEQ ID NO: 99075 - protein, 26 aa, Mycobacterium avium
KASMFRFGCVCGGASLYAPQAHNNIV

SEQ ID NO: 99076 - protein, 20 aa, Mycobacterium avium
KASPRSDVLISYHAPFGTGV

SEQ ID NO: 99077 - protein, 18 aa, Mycobacterium avium
KATLPRAFVIGPDGSTTV

SEQ ID NO: 99078 - protein, 17 aa, Mycobacterium avium
KATRWHTDVTFAANYPA

SEQ ID NO: 99079 - protein, 19 aa, Mycobacterium avium
KAVAGGGGRGMRRVTDPGA

SEQ ID NO: 99080 - protein, 23 aa, Mycobacterium avium
KAVQRSAGALAIGPVLQGLRKPV

SEQ ID NO: 99081 - protein, 21 aa, Mycobacterium avium
KAVVAEATWNRGVDKFICAMG

SEQ ID NO: 99082 - protein, 19 aa, Mycobacterium avium
KAYLELLAHCGYRLSPIEQ

SEQ ID NO: 99083 - protein, 20 aa, Mycobacterium avium
KAYLELLAHCGYRLSPIEQV

SEQ ID NO: 99084 - protein, 19 aa, Mycobacterium avium
KCGLPASSIYWHFKNKDDL

SEQ ID NO: 99085 - protein, 26 aa, Mycobacterium avium
KCILCAACTTSCPVFWHEGSYYGPAA

SEQ ID NO: 99086 - protein, 19 aa, Mycobacterium avium
KCVCRRLSLRTVSRRFRRA

SEQ ID NO: 99087 - protein, 22 aa, Mycobacterium avium
KDAEYARDHFIGNHPGMPFPDR

SEQ ID NO: 99088 - protein, 26 aa, Mycobacterium avium
KDALRCPACAYVRWAAVVSAHEDGGN

SEQ ID NO: 99089 - protein, 28 aa, Mycobacterium avium
KDARFRDALFPVWRYHPFFTNTDLPTAE

SEQ ID NO: 99090 - protein, 17 aa, Mycobacterium avium
KDARLIILEVMAEAIDE

SEQ ID NO: 99091 - protein, 17 aa, Mycobacterium avium
KDARLTILEVMAEAIDE

SEQ ID NO: 99092 - protein, 21 aa, Mycobacterium avium
KDARLTILEVMAEAIDEPDEM

SEQ ID NO: 99093 - protein, 18 aa, Mycobacterium avium
KDATYGWNIGPKEDVMCV

SEQ ID NO: 99094 - protein, 36 aa, Mycobacterium avium
KDDGTRINTIWGELAWQLGGAEAFALVAKADADRTT

SEQ ID NO: 99095 - protein, 19 aa, Mycobacterium avium
KDEHPGAVVVSYFNTTAAV

SEQ ID NO: 99096 - protein, 20 aa, Mycobacterium avium
KDGRQLVIRDLFYDAQGSRQ

SEQ ID NO: 99097 - protein, 19 aa, Mycobacterium avium
KDHRRILSALKKRDDKLAR

SEQ ID NO: 99098 - protein, 20 aa, Mycobacterium avium
KDHRRILSALKKRDDKLARA

SEQ ID NO: 99099 - protein, 24 aa, Mycobacterium avium
KDIPLRVKAAAVGLAADEYHAQDV

SEQ ID NO: 99100 - protein, 18 aa, Mycobacterium avium
KDKASGDFVWDEDESEAL

SEQ ID NO: 99101 - protein, 17 aa, Mycobacterium avium
KDLDLSAFVVFSSMAGI

SEQ ID NO: 99102 - protein, 24 aa, Mycobacterium avium
KDLTRLLGGPSHRLDLMAIASAAQ

SEQ ID NO: 99103 - protein, 24 aa, Mycobacterium avium
KDLTRLLGGPSHRLDLVAIASAAQ

SEQ ID NO: 99104 - protein, 24 aa, Mycobacterium avium
KDLTRLLGGPSHRLDLVAIASTAQ

SEQ ID NO: 99105 - protein, 17 aa, Mycobacterium avium
KDNIRCNAVAPGFTATE

SEQ ID NO: 99106 - protein, 22 aa, Mycobacterium avium
KDQIWRAAILLGESDRIRYLTP

SEQ ID NO: 99107 - protein, 23 aa, Mycobacterium avium
KDQIWRAAILLGESDRIRYLTPQ

SEQ ID NO: 99108 - protein, 18 aa, Mycobacterium avium
KDRIKAAAKKFGIKIEAG

SEQ ID NO: 99109 - protein, 17 aa, Mycobacterium avium
KDVAPSKQLREWYHHEP

SEQ ID NO: 99110 - protein, 21 aa, Mycobacterium avium
KDWTEPGFMGLGMIYTAMPVT

SEQ ID NO: 99111 - protein, 19 aa, Mycobacterium avium
KEAMVRQWALRFRDEANQR

SEQ ID NO: 99112 - protein, 17 aa, Mycobacterium avium
KEECFLELLAVDIEKLG

SEQ ID NO: 99113 - protein, 17 aa, Mycobacterium avium
KEIAGRLAARIGSGLLV

SEQ ID NO: 99114 - protein, 17 aa, Mycobacterium avium
KEIFYDWDQVTVEEEEY

SEQ ID NO: 99115 - protein, 22 aa, Mycobacterium avium
KEKFGGLRFYFHASESITEADR

SEQ ID NO: 99116 - protein, 21 aa, Mycobacterium avium
KELTRLALGVGRQYVAQTRIR

SEQ ID NO: 99117 - protein, 20 aa, Mycobacterium avium
KEMIDRWNAESVRLYHALHA

SEQ ID NO: 99118 - protein, 28 aa, Mycobacterium avium
KEMVSTGWLGLHIDERFGGQGYGLPELT

SEQ ID NO: 99119 - protein, 19 aa, Mycobacterium avium
KEPLPVFADRWFQRYSQGD

SEQ ID NO: 99120 - protein, 21 aa, Mycobacterium avium
KEPLPVFADRWFQRYSQGDDV

SEQ ID NO: 99121 - protein, 20 aa, Mycobacterium avium
KESPLARALAKLGVGADDVA

SEQ ID NO: 99122 - protein, 31 aa, Mycobacterium avium
KETLAFFAGIGIPIAEVWGMSELSCVAAVSH

SEQ ID NO: 99123 - protein, 32 aa, Mycobacterium avium
KETLAFFAGIGIPIAEVWGMSELSCVAAVSHP

SEQ ID NO: 99124 - protein, 17 aa, Mycobacterium avium
KETLGWIALNQRANAEL

SEQ ID NO: 99125 - protein, 20 aa, Mycobacterium avium
KETLRLVAQYADVWNSMSND

SEQ ID NO: 99126 - protein, 22 aa, Mycobacterium avium
KEYLRLGLLVEQMFPEARIQMV

SEQ ID NO: 99127 - protein, 20 aa, Mycobacterium avium
KFAVTKDGRHSLTHYDTVEA

SEQ ID NO: 99128 - protein, 44 aa, Mycobacterium avium
KFDPEHALECIQRYGITHGQFVPAMFVRMLRLPEAVRMSYDVSS

SEQ ID NO: 99129 - protein, 24 aa, Mycobacterium avium
KFERLYRAAPLMRFGGGANEVLRD

SEQ ID NO: 99130 - protein, 19 aa, Mycobacterium avium
KFGMTLCALGIAEEMREAG

SEQ ID NO: 99131 - protein, 22 aa, Mycobacterium avium
KFMPQPYGGYILPGSTLDDLKL

SEQ ID NO: 99132 - protein, 18 aa, Mycobacterium avium
KFPYRNDGARGWTGTSPV

SEQ ID NO: 99133 - protein, 18 aa, Mycobacterium avium
KFRPERVSAELAAAGLRR

SEQ ID NO: 99134 - protein, 18 aa, Mycobacterium avium
KFTHPLRFDVPITGRHST

SEQ ID NO: 99135 - protein, 18 aa, Mycobacterium avium
KGAAALAERARRLLGEHT

SEQ ID NO: 99136 - protein, 24 aa, Mycobacterium avium
KGAIAVYPVAGWWKNQRKYDQSNH

SEQ ID NO: 99137 - protein, 26 aa, Mycobacterium avium
KGAPTPVAWTRMRVPRSLMASIGTEE

SEQ ID NO: 99138 - protein, 17 aa, Mycobacterium avium
KGFRNMTYVRGLAPMLV

SEQ ID NO: 99139 - protein, 18 aa, Mycobacterium avium
KGGFRAQLVIGYQGYVEL

SEQ ID NO: 99140 - protein, 20 aa, Mycobacterium avium
KGGVGLAGYVERRGIATYLR

SEQ ID NO: 99141 - protein, 28 aa, Mycobacterium avium
KGIGFEVAKLLAAEGARVAILARTKTDV

SEQ ID NO: 99142 - protein, 17 aa, Mycobacterium avium
KGIPRAKLTGTIQNDIL

SEQ ID NO: 99143 - protein, 36 aa, Mycobacterium avium
KGIQRRRTRIYCPRWVALFRWAKPVLSSRLGEMPLH

SEQ ID NO: 99144 - protein, 37 aa, Mycobacterium avium
KGIQRRRTRIYCPRWVALFRWAKPVLSSRLGEMPLHS

SEQ ID NO: 99145 - protein, 21 aa, Mycobacterium avium
KGIRRELPHLPPSEAPNILMP

SEQ ID NO: 99146 - protein, 19 aa, Mycobacterium avium
KGLPHGPARPFGYEPDKIT

SEQ ID NO: 99147 - protein, 18 aa, Mycobacterium avium
KGLTMPIYEAELLAENYR

SEQ ID NO: 99148 - protein, 21 aa, Mycobacterium avium
KGQRGGNLWLSDVFGAELIIP

SEQ ID NO: 99149 - protein, 26 aa, Mycobacterium avium
KGTAAALRFEVFGMVDGRPVVVLEHV

SEQ ID NO: 99150 - protein, 24 aa, Mycobacterium avium
KGTLFRRFGSRAGLMMVLLDEDER

SEQ ID NO: 99151 - protein, 24 aa, Mycobacterium avium
KGTNGKCKYCGASQRALDRSEGLE

SEQ ID NO: 99152 - protein, 17 aa, Mycobacterium avium
KHASFFIVMAVTNPQAR

SEQ ID NO: 99153 - protein, 19 aa, Mycobacterium avium
KHAVMRGMLAFLAVNSTYR

SEQ ID NO: 99154 - protein, 20 aa, Mycobacterium avium
KHGFPEAMWVAIAHVGAHGQ

SEQ ID NO: 99155 - protein, 20 aa, Mycobacterium avium
KHHDRIGGTHLRQFFEEDPD

SEQ ID NO: 99156 - protein, 26 aa, Mycobacterium avium
KHKCADMLVDLEWARSASQAALEAVV

SEQ ID NO: 99157 - protein, 23 aa, Mycobacterium avium
KHMRADVTVGAFLSGGIDSTAIA

SEQ ID NO: 99158 - protein, 18 aa, Mycobacterium avium
KHRHMYRLMFGSTSAHGI

SEQ ID NO: 99159 - protein, 20 aa, Mycobacterium avium
KHWPQPQHGWTLTIEGDPSM

SEQ ID NO: 99160 - protein, 28 aa, Mycobacterium avium
KIAGEGLLKSASRVSLKTAGRLVPGVGT

SEQ ID NO: 99161 - protein, 24 aa, Mycobacterium avium
KIANEKCDWMPAVASNGGGRDGLI

SEQ ID NO: 99162 - protein, 20 aa, Mycobacterium avium
KICADDVYLSPAPIYHTAPL

SEQ ID NO: 99163 - protein, 18 aa, Mycobacterium avium
KIGSLAITEPGGGSDVGH

SEQ ID NO: 99164 - protein, 33 aa, Mycobacterium avium
KILRCPLRFPHDLPRPEGHAGQLARVRAALRGT

SEQ ID NO: 99165 - protein, 20 aa, Mycobacterium avium
KILRGEVIWCQGFSEPEAGS

SEQ ID NO: 99166 - protein, 18 aa, Mycobacterium avium
KILTFRGYLTTHINRQSP

SEQ ID NO: 99167 - protein, 26 aa, Mycobacterium avium
KIPAPAARWAFCNGMTAAQRRLTMSK

SEQ ID NO: 99168 - protein, 17 aa, Mycobacterium avium
KIPLNGLWAETKFGTYG

SEQ ID NO: 99169 - protein, 18 aa, Mycobacterium avium
KIPLNGLWAETKFGTYGD

SEQ ID NO: 99170 - protein, 22 aa, Mycobacterium avium
KIPLVMLLEGAGFRPTGGHYGR

SEQ ID NO: 99171 - protein, 20 aa, Mycobacterium avium
KISEGMGVPARRVSTAEEFA

SEQ ID NO: 99172 - protein, 23 aa, Mycobacterium avium
KITRLAPNFKDIVIRHITFAPYH

SEQ ID NO: 99173 - protein, 18 aa, Mycobacterium avium
KIVAGKLYSSIGMSEHGA

SEQ ID NO: 99174 - protein, 19 aa, Mycobacterium avium
KIVAGQLFSSIGMSEHGAG

SEQ ID NO: 99175 - protein, 17 aa, Mycobacterium avium
KKAARRGWLDSLADERR

SEQ ID NO: 99176 - protein, 23 aa, Mycobacterium avium
KKCLLELAELIGFDTAIDERAVQ

SEQ ID NO: 99177 - protein, 19 aa, Mycobacterium avium
KKELAQWVIDAEERAERAE

SEQ ID NO: 99178 - protein, 25 aa, Mycobacterium avium
KKGRVPVDPGFRIPLGQADIKRPGA

SEQ ID NO: 99179 - protein, 18 aa, Mycobacterium avium
KKILGFDPDKTFQVRDKV

SEQ ID NO: 99180 - protein, 32 aa, Mycobacterium avium
KKLNPRLLTMIIPARWFAGGKGLDEFRESMLT

SEQ ID NO: 99181 - protein, 40 aa, Mycobacterium avium
KKLPSVQVGDPFMEKVLIECCLELYAGGLVIGIQDLGGAG

SEQ ID NO: 99182 - protein, 21 aa, Mycobacterium avium
KKLRDILGLLRDAYCRHIGVE

SEQ ID NO: 99183 - protein, 34 aa, Mycobacterium avium
KKMYKRLIARELPEIFPLLILCIDELGAWAGQGL

SEQ ID NO: 99184 - protein, 21 aa, Mycobacterium avium
KKQMIAWWGPIIDEYYAASEA

SEQ ID NO: 99185 - protein, 19 aa, Mycobacterium avium
KKWMRRRRQSLPLAQLPGR

SEQ ID NO: 99186 - protein, 25 aa, Mycobacterium avium
KKYMLLEPGKFYDLQEYKVVSADQL

SEQ ID NO: 99187 - protein, 20 aa, Mycobacterium avium
KLADMSLLFEIEEPRFERAT

SEQ ID NO: 99188 - protein, 18 aa, Mycobacterium avium
KLAFAEAQAGWIPYYLQR

SEQ ID NO: 99189 - protein, 25 aa, Mycobacterium avium
KLANALRSWSVLRFEVTEDPSPGVD

SEQ ID NO: 99190 - protein, 20 aa, Mycobacterium avium
KLAQGAQHAIQWTKRSLNHW

SEQ ID NO: 99191 - protein, 17 aa, Mycobacterium avium
KLDESFPGLGMNGPSVG

SEQ ID NO: 99192 - protein, 23 aa, Mycobacterium avium
KLDRKATLAFAFSHRSYLDGMLL

SEQ ID NO: 99193 - protein, 28 aa, Mycobacterium avium
KLDRSRPLWEMWVIEGLDGNAGGRFATL

SEQ ID NO: 99194 - protein, 23 aa, Mycobacterium avium
KLDYRTYSAQGWTIVANADGTRF

SEQ ID NO: 99195 - protein, 26 aa, Mycobacterium avium
KLEKTKRFLLGELLGSITRHLLLMTA

SEQ ID NO: 99196 - protein, 19 aa, Mycobacterium avium
KLELRRVAHFDGTVEAYLH

SEQ ID NO: 99197 - protein, 18 aa, Mycobacterium avium
KLFGLSRERVRQIERDVM

SEQ ID NO: 99198 - protein, 19 aa, Mycobacterium avium
KLFRGLFRGTGKYYAGVKW

SEQ ID NO: 99199 - protein, 19 aa, Mycobacterium avium
KLFRGLFRGTGKYYSGVKW

SEQ ID NO: 99200 - protein, 21 aa, Mycobacterium avium
KLFSSQGATVFGIGRDTVRLA

SEQ ID NO: 99201 - protein, 17 aa, Mycobacterium avium
KLGTRIAQVTSRPPALA

SEQ ID NO: 99202 - protein, 23 aa, Mycobacterium avium
KLHSGQTLIGFLAPRNADNSIGA

SEQ ID NO: 99203 - protein, 19 aa, Mycobacterium avium
KLIKFATRIPAFMYLTDFR

SEQ ID NO: 99204 - protein, 21 aa, Mycobacterium avium
KLINSGFSRRQVQLLEPKVRQ

SEQ ID NO: 99205 - protein, 30 aa, Mycobacterium avium
KLIQRLSADMMKRNLLELGGKSVYLLLDDA

SEQ ID NO: 99206 - protein, 19 aa, Mycobacterium avium
KLLAAEGLLALAWPKEHGG

SEQ ID NO: 99207 - protein, 18 aa, Mycobacterium avium
KLLAMLGAEVIKIETADS

SEQ ID NO: 99208 - protein, 23 aa, Mycobacterium avium
KLLERFRAMEPWLQAGRVHAPFW

SEQ ID NO: 99209 - protein, 23 aa, Mycobacterium avium
KLLERFRAMEPWLQGGRVHAPFW

SEQ ID NO: 99210 - protein, 25 aa, Mycobacterium avium
KLLGFSIKRAVTWSEEAGNTRPRYA

SEQ ID NO: 99211 - protein, 25 aa, Mycobacterium avium
KLLPGMKLNQGELFKSSQAAADLDE

SEQ ID NO: 99212 - protein, 19 aa, Mycobacterium avium
KLLRCLRSPAQHHSTPAPG

SEQ ID NO: 99213 - protein, 19 aa, Mycobacterium avium
KLLRERGIEELPRYKPLLD

SEQ ID NO: 99214 - protein, 17 aa, Mycobacterium avium
KLLRLEVRNAETPIERK

SEQ ID NO: 99215 - protein, 25 aa, Mycobacterium avium
KLPELPLRVGDTWEEAGPDGDRIFS

SEQ ID NO: 99216 - protein, 24 aa, Mycobacterium avium
KLPELPLRVGDTWEETGPDGDRIF

SEQ ID NO: 99217 - protein, 19 aa, Mycobacterium avium
KLPHGTGFHALRHYYASLL

SEQ ID NO: 99218 - protein, 25 aa, Mycobacterium avium
KLPIFGGPFRWEDLEWLRSRTSLPL

SEQ ID NO: 99219 - protein, 25 aa, Mycobacterium avium
KLPIFGGPFRWEDLEWLRSTTSLPL

SEQ ID NO: 99220 - protein, 19 aa, Mycobacterium avium
KLPPEKLAEIQAVQMRCNA

SEQ ID NO: 99221 - protein, 19 aa, Mycobacterium avium
KLPSHLEWVAPFGALSAAN

SEQ ID NO: 99222 - protein, 17 aa, Mycobacterium avium
KLQVHARTPQVLQQIMD

SEQ ID NO: 99223 - protein, 20 aa, Mycobacterium avium
KLRDILGLLRDAYCRHIGVE

SEQ ID NO: 99224 - protein, 26 aa, Mycobacterium avium
KLRERLGFGELRWAVSGAAPIPKETL

SEQ ID NO: 99225 - protein, 17 aa, Mycobacterium avium
KLRIASVENGSAWIKPL

SEQ ID NO: 99226 - protein, 21 aa, Mycobacterium avium
KLRLAPIKFLSALVSDGDLRN

SEQ ID NO: 99227 - protein, 24 aa, Mycobacterium avium
KLRLQECRSCASLIHPPAPVCRYC

SEQ ID NO: 99228 - protein, 20 aa, Mycobacterium avium
KLRPKVSCITRLAHPVDGHR

SEQ ID NO: 99229 - protein, 20 aa, Mycobacterium avium
KLRPKVSCITRLAHPVDGRR

SEQ ID NO: 99230 - protein, 19 aa, Mycobacterium avium
KLSAWHCNVEKPVITAVNG

SEQ ID NO: 99231 - protein, 24 aa, Mycobacterium avium
KLSDFKGRKVIVYFYPAALTPGCT

SEQ ID NO: 99232 - protein, 20 aa, Mycobacterium avium
KLSVPPSWAGATPVVGSSSA

SEQ ID NO: 99233 - protein, 20 aa, Mycobacterium avium
KLTPAFAGIGEFGGFDAVAM

SEQ ID NO: 99234 - protein, 27 aa, Mycobacterium avium
KLVRELALLWADRSIRVNAVHPTNVST

SEQ ID NO: 99235 - protein, 18 aa, Mycobacterium avium
KLWDLSAELTGCDWQGAN

SEQ ID NO: 99236 - protein, 18 aa, Mycobacterium avium
KMFGENFFYILYFQEPGV

SEQ ID NO: 99237 - protein, 18 aa, Mycobacterium avium
KMGLFGYAIPQQWGGLGL

SEQ ID NO: 99238 - protein, 28 aa, Mycobacterium avium
KMTSRWCYRSEVKANWKLYIDAFQEFYH

SEQ ID NO: 99239 - protein, 19 aa, Mycobacterium avium
KMTVYRLVHNGELPAVRVG

SEQ ID NO: 99240 - protein, 33 aa, Mycobacterium avium
KMTWRSMISDGLAMRHGKEMTWSQVVMAANTPM

SEQ ID NO: 99241 - protein, 28 aa, Mycobacterium avium
KMTYQNAMRWYSFDPFTHISREQATVGA

SEQ ID NO: 99242 - protein, 17 aa, Mycobacterium avium
KMVPSSLGIEYPAIAPE

SEQ ID NO: 99243 - protein, 19 aa, Mycobacterium avium
KMVRKAKVAIPHWEDADGP

SEQ ID NO: 99244 - protein, 30 aa, Mycobacterium avium
KNALGRTRKSFVCGFHGWTYGLDGACTHIC

SEQ ID NO: 99245 - protein, 30 aa, Mycobacterium avium
KNALGRTRKSFVCGFHGWTYGLDGACTHIR

SEQ ID NO: 99246 - protein, 25 aa, Mycobacterium avium
KNAVPRYRLALVTVDPRGPQYDEVC

SEQ ID NO: 99247 - protein, 18 aa, Mycobacterium avium
KNGVNVILTIAPQAGPST

SEQ ID NO: 99248 - protein, 17 aa, Mycobacterium avium
KNLYRGRALTASENNGL

SEQ ID NO: 99249 - protein, 21 aa, Mycobacterium avium
KNRGAQCTTMAWPQQADHTVH

SEQ ID NO: 99250 - protein, 24 aa, Mycobacterium avium
KNYVSRLLAKLGMERRTQAAVFAS

SEQ ID NO: 99251 - protein, 17 aa, Mycobacterium avium
KPAALAIPREGYFELER

SEQ ID NO: 99252 - protein, 24 aa, Mycobacterium avium
KPAESAPPGLGRLIAALRRLQDLT

SEQ ID NO: 99253 - protein, 29 aa, Mycobacterium avium
KPAMETPWSALRWGRIIAEKTDIPAGVVN

SEQ ID NO: 99254 - protein, 27 aa, Mycobacterium avium
KPEPGARCPRCPCLAPQDVPRSPTRPA

SEQ ID NO: 99255 - protein, 18 aa, Mycobacterium avium
KPGYALNLDDLRAHFAAS

SEQ ID NO: 99256 - protein, 19 aa, Mycobacterium avium
KPIRKPHPVIWMGGDADAV

SEQ ID NO: 99257 - protein, 17 aa, Mycobacterium avium
KPLFVLFDSCWDPFPQP

SEQ ID NO: 99258 - protein, 30 aa, Mycobacterium avium
KPNAYTVYFAMKFSRPFISYGSWDGSTVYP

SEQ ID NO: 99259 - protein, 25 aa, Mycobacterium avium
KPNLDFPTGPAYYLMGFDIGAFTPI

SEQ ID NO: 99260 - protein, 25 aa, Mycobacterium avium
KPPFPYSDVRLLPYLNHSLWFLPSV

SEQ ID NO: 99261 - protein, 25 aa, Mycobacterium avium
KPRHPTRGAPLCVFRETSRILAGLP

SEQ ID NO: 99262 - protein, 17 aa, Mycobacterium avium
KPSFYTGRGTFSLRLSE

SEQ ID NO: 99263 - protein, 18 aa, Mycobacterium avium
KPSHTLAAVDALKRWDRP

SEQ ID NO: 99264 - protein, 24 aa, Mycobacterium avium
KPVDGGYIFNGRWQFSSGTDHCDW

SEQ ID NO: 99265 - protein, 28 aa, Mycobacterium avium
KPVFLRENWYCPVCLEVTNSALCGHEAQ

SEQ ID NO: 99266 - protein, 32 aa, Mycobacterium avium
KPVLVDFWATWCGPCKMVAPVLEEIASERGDH

SEQ ID NO: 99267 - protein, 23 aa, Mycobacterium avium
KPWSERKRYIWWDPDQRRWVGYD

SEQ ID NO: 99268 - protein, 22 aa, Mycobacterium avium
KQAHWNIVGINFRDLHLQLDEL

SEQ ID NO: 99269 - protein, 17 aa, Mycobacterium avium
KQFRLEHTGGRVGALRA

SEQ ID NO: 99270 - protein, 23 aa, Mycobacterium avium
KQGEASAGYMLMKPLVETATAAG

SEQ ID NO: 99271 - protein, 19 aa, Mycobacterium avium
KQGFLGMAVPEEYGGGGNP

SEQ ID NO: 99272 - protein, 25 aa, Mycobacterium avium
KQGLRLAQTLTPWPATDGQRIAAAS

SEQ ID NO: 99273 - protein, 19 aa, Mycobacterium avium
KQHPGEWNPYGALPEMRLL

SEQ ID NO: 99274 - protein, 19 aa, Mycobacterium avium
KQLAAWCECRGRDDIVATL

SEQ ID NO: 99275 - protein, 28 aa, Mycobacterium avium
KQPRRFEYRDEFPLGPAGKILKREIANQ

SEQ ID NO: 99276 - protein, 29 aa, Mycobacterium avium
KQRWLPKFCTGELITAIAMTEPGTGSDLQ

SEQ ID NO: 99277 - protein, 17 aa, Mycobacterium avium
KRAEEGLAPPVLALTAD

SEQ ID NO: 99278 - protein, 21 aa, Mycobacterium avium
KRAQLRAALESGRLQRFPGAF

SEQ ID NO: 99279 - protein, 25 aa, Mycobacterium avium
KRCLIPMDGYYEWRVNSDAAAGKKP

SEQ ID NO: 99280 - protein, 22 aa, Mycobacterium avium
KRCQGVRRLSHLDLNATPPFNY

SEQ ID NO: 99281 - protein, 18 aa, Mycobacterium avium
KRDARLTIVGVHKEPVSV

SEQ ID NO: 99282 - protein, 24 aa, Mycobacterium avium
KRDDLRWHDLRHSGAVLAAATGAT

SEQ ID NO: 99283 - protein, 19 aa, Mycobacterium avium
KREGLIDRGPRVGTHVAQR

SEQ ID NO: 99284 - protein, 19 aa, Mycobacterium avium
KREVLFAGPVLRPSTTLVR

SEQ ID NO: 99285 - protein, 21 aa, Mycobacterium avium
KRFAEALTFAYHRLGRADVGA

SEQ ID NO: 99286 - protein, 19 aa, Mycobacterium avium
KRFGWFEEITPVPLDAADP

SEQ ID NO: 99287 - protein, 21 aa, Mycobacterium avium
KRFLDSLVDSVRMGMVVVDRE

SEQ ID NO: 99288 - protein, 18 aa, Mycobacterium avium
KRGAKGFRAVVEDADGDS

SEQ ID NO: 99289 - protein, 19 aa, Mycobacterium avium
KRGLVGLMQVWANELAQYW

SEQ ID NO: 99290 - protein, 22 aa, Mycobacterium avium
KRGNLPAIRVGRTYRVLESDVD

SEQ ID NO: 99291 - protein, 21 aa, Mycobacterium avium
KRIAAAISQCPFTDGFASSFA

SEQ ID NO: 99292 - protein, 18 aa, Mycobacterium avium
KRINTIVASAIEFEIKDP

SEQ ID NO: 99293 - protein, 17 aa, Mycobacterium avium
KRIVGAKGKAALLRELS

SEQ ID NO: 99294 - protein, 17 aa, Mycobacterium avium
KRLGMTVTLAERERVFS

SEQ ID NO: 99295 - protein, 22 aa, Mycobacterium avium
KRLGRRVTEIALVFKRAPHLPF

SEQ ID NO: 99296 - protein, 26 aa, Mycobacterium avium
KRLTSCGRPTLFARTALLDADGNPVP

SEQ ID NO: 99297 - protein, 19 aa, Mycobacterium avium
KRNALRLILTAVLARGHIL

SEQ ID NO: 99298 - protein, 19 aa, Mycobacterium avium
KRNPVLSVLIRRAAIAGPP

SEQ ID NO: 99299 - protein, 17 aa, Mycobacterium avium
KRNRYASVWTVSAQLVD

SEQ ID NO: 99300 - protein, 25 aa, Mycobacterium avium
KRPEDFRFLIRLARQQGTRLGRAYL

SEQ ID NO: 99301 - protein, 24 aa, Mycobacterium avium
KRPEFGKLTPLYPNQRLRLETTPD

SEQ ID NO: 99302 - protein, 25 aa, Mycobacterium avium
KRPELPLRVGDTWEEAGPDGDRIFS

SEQ ID NO: 99303 - protein, 17 aa, Mycobacterium avium
KRPPRWVVVAELVETTR

SEQ ID NO: 99304 - protein, 17 aa, Mycobacterium avium
KRRLGVLGYDDLLTRLA

SEQ ID NO: 99305 - protein, 25 aa, Mycobacterium avium
KRTRVMILLAAFAGLRAHEIAKVRG

SEQ ID NO: 99306 - protein, 21 aa, Mycobacterium avium
KRTVIATGILNLWMHSPAEVA

SEQ ID NO: 99307 - protein, 18 aa, Mycobacterium avium
KRVEGLRPTIQQITDEHI

SEQ ID NO: 99308 - protein, 25 aa, Mycobacterium avium
KRVRTRWTNFAAHAKPAGPAGSPEW

SEQ ID NO: 99309 - protein, 19 aa, Mycobacterium avium
KRVTLELGGKSANIVFADC

SEQ ID NO: 99310 - protein, 17 aa, Mycobacterium avium
KRWEIGDFVGAMAEGEQ

SEQ ID NO: 99311 - protein, 21 aa, Mycobacterium avium
KRYAEALTFAYHRLGRADVGV

SEQ ID NO: 99312 - protein, 19 aa, Mycobacterium avium
KRYGGHGLGHLHRYVVTEE

SEQ ID NO: 99313 - protein, 17 aa, Mycobacterium avium
KRYRADHLIEAYEAKHG

SEQ ID NO: 99314 - protein, 21 aa, Mycobacterium avium
KSAKLAGQFGDGWITQSGDVT

SEQ ID NO: 99315 - protein, 17 aa, Mycobacterium avium
KSAKWKVGEEAAFAALG

SEQ ID NO: 99316 - protein, 19 aa, Mycobacterium avium
KSCVGTDWCRYGQQDSVQL

SEQ ID NO: 99317 - protein, 21 aa, Mycobacterium avium
KSELYGPGFTAAAVKLLQNAG

SEQ ID NO: 99318 - protein, 26 aa, Mycobacterium avium
KSFHLPKILGGEVIWCQGFSEPDAGS

SEQ ID NO: 99319 - protein, 25 aa, Mycobacterium avium
KSFKTSGCQPWQLTPDAVPPPSAPP

SEQ ID NO: 99320 - protein, 18 aa, Mycobacterium avium
KSLAREWAPHGITVNVVS

SEQ ID NO: 99321 - protein, 17 aa, Mycobacterium avium
KSLPPKWFYDSVGSDLF

SEQ ID NO: 99322 - protein, 17 aa, Mycobacterium avium
KSPEDYVQWFPESHPPT

SEQ ID NO: 99323 - protein, 17 aa, Mycobacterium avium
KSPSFLWLQVDDVVDQS

SEQ ID NO: 99324 - protein, 20 aa, Mycobacterium avium
KSQMAAGLMRKVAGDTVDVF

SEQ ID NO: 99325 - protein, 22 aa, Mycobacterium avium
KSTVAVPLIWRKRLLRKAIDFT

SEQ ID NO: 99326 - protein, 19 aa, Mycobacterium avium
KSVADWLWAGLCLPVVRAA

SEQ ID NO: 99327 - protein, 17 aa, Mycobacterium avium
KTAAFAIPILSKIDAAS

SEQ ID NO: 99328 - protein, 18 aa, Mycobacterium avium
KTAAFAIPILSKIDVAST

SEQ ID NO: 99329 - protein, 21 aa, Mycobacterium avium
KTAETFKTFNGVRYAIPGDYA

SEQ ID NO: 99330 - protein, 31 aa, Mycobacterium avium
KTAISTGWDCPRAEVLVSFRPAVDPTHITQL

SEQ ID NO: 99331 - protein, 17 aa, Mycobacterium avium
KTCSCSMFSPGRSSAST

SEQ ID NO: 99332 - protein, 24 aa, Mycobacterium avium
KTEALAIKTMVDYAVGQYLDGKND

SEQ ID NO: 99333 - protein, 24 aa, Mycobacterium avium
KTEGVYQCRACGAELFRSTEKFES

SEQ ID NO: 99334 - protein, 22 aa, Mycobacterium avium
KTGRPYYNAIVWQDTRTDRIAS

SEQ ID NO: 99335 - protein, 24 aa, Mycobacterium avium
KTGRTSAQLLPRFETITYSEVAQR

SEQ ID NO: 99336 - protein, 21 aa, Mycobacterium avium
KTHATAKCAFGVRTGDFTQCH

SEQ ID NO: 99337 - protein, 19 aa, Mycobacterium avium
KTHLGWRPVHTSAQALAAL

SEQ ID NO: 99338 - protein, 17 aa, Mycobacterium avium
KTIPGRLLMGVTGVRTA

SEQ ID NO: 99339 - protein, 20 aa, Mycobacterium avium
KTIRGAHWDLEIGCLTELLA

SEQ ID NO: 99340 - protein, 18 aa, Mycobacterium avium
KTLAAFLWALDSLAGQAE

SEQ ID NO: 99341 - protein, 17 aa, Mycobacterium avium
KTLHGALGNRLMGHGAD

SEQ ID NO: 99342 - protein, 23 aa, Mycobacterium avium
KTLKENGFRLLAMTPQGSACGLA

SEQ ID NO: 99343 - protein, 20 aa, Mycobacterium avium
KTPDGRSVATATFDFTGGYV

SEQ ID NO: 99344 - protein, 17 aa, Mycobacterium avium
KTPPCVDALLEAGVGTV

SEQ ID NO: 99345 - protein, 17 aa, Mycobacterium avium
KTPPCVDALLEAGVSTV

SEQ ID NO: 99346 - protein, 23 aa, Mycobacterium avium
KTRHAVLAVARWLRDESAPEPAR

SEQ ID NO: 99347 - protein, 26 aa, Mycobacterium avium
KTSGSRGFHIYARIARRWEFRQVRLA

SEQ ID NO: 99348 - protein, 24 aa, Mycobacterium avium
KTTAMGKGFFVTWVTTYRDQNGEV

SEQ ID NO: 99349 - protein, 24 aa, Mycobacterium avium
KTTLLRCLLGLLTPQSGTVRVAGD

SEQ ID NO: 99350 - protein, 18 aa, Mycobacterium avium
KTTLLRHLIRTVREHSSP

SEQ ID NO: 99351 - protein, 17 aa, Mycobacterium avium
KTVHHYLMRFSGGELSD

SEQ ID NO: 99352 - protein, 17 aa, Mycobacterium avium
KTVLIKWLIENGYLDWG

SEQ ID NO: 99353 - protein, 17 aa, Mycobacterium avium
KTVRSFAEREILPHVDE

SEQ ID NO: 99354 - protein, 18 aa, Mycobacterium avium
KTYDSLVELHGWTDEVAR

SEQ ID NO: 99355 - protein, 18 aa, Mycobacterium avium
KTYLDLPLFAGRPAPGLA

SEQ ID NO: 99356 - protein, 20 aa, Mycobacterium avium
KTYRCPGCDHEIRSGAAHLV

SEQ ID NO: 99357 - protein, 18 aa, Mycobacterium avium
KVAIPTLVKQGTGGSIVL

SEQ ID NO: 99358 - protein, 20 aa, Mycobacterium avium
KVFRRDGMLLAVDRNMQPNP

SEQ ID NO: 99359 - protein, 21 aa, Mycobacterium avium
KVHACLFDLDGVLTDTASVHT

SEQ ID NO: 99360 - protein, 24 aa, Mycobacterium avium
KVHRHWGFGGGPHRCLGSHLARLE

SEQ ID NO: 99361 - protein, 17 aa, Mycobacterium avium
KVIGWALEQQRLPLRAT

SEQ ID NO: 99362 - protein, 17 aa, Mycobacterium avium
KVLPDCGYTDVGTSVLR

SEQ ID NO: 99363 - protein, 26 aa, Mycobacterium avium
KVMRLWAQERVRGWTNERVRAALSAG

SEQ ID NO: 99364 - protein, 24 aa, Mycobacterium avium
KVNDFLWMRIMNVPEVLPKRAYRA

SEQ ID NO: 99365 - protein, 18 aa, Mycobacterium avium
KVPAALAVDSVRYSIADA

SEQ ID NO: 99366 - protein, 34 aa, Mycobacterium avium
KVPYYRVLELAPWLKWPQPNFPVSNFFHAGAAPL

SEQ ID NO: 99367 - protein, 20 aa, Mycobacterium avium
KVRSELGLAQAPRVDSYGGF

SEQ ID NO: 99368 - protein, 24 aa, Mycobacterium avium
KVRYGFAIAPELVRTVLRDREPDW

SEQ ID NO: 99369 - protein, 19 aa, Mycobacterium avium
KVTRLVLVDVVPRFEKDGS

SEQ ID NO: 99370 - protein, 20 aa, Mycobacterium avium
KVVCFPQRWLDLRYVGPAKD

SEQ ID NO: 99371 - protein, 20 aa, Mycobacterium avium
KVVCFPQRWLDLRYVGPAKG

SEQ ID NO: 99372 - protein, 28 aa, Mycobacterium avium
KVWTTDGHWARYGYLLARTDPDAPKHKG

SEQ ID NO: 99373 - protein, 21 aa, Mycobacterium avium
KVYLDLRVKVAKNWQSDPKQL

SEQ ID NO: 99374 - protein, 25 aa, Mycobacterium avium
KWRAHPADVLPLWVAEMDVRLAPTV

SEQ ID NO: 99375 - protein, 31 aa, Mycobacterium avium
KWWDPATGTWDWPKVEGFADGIYKTARSIPK

SEQ ID NO: 99376 - protein, 23 aa, Mycobacterium avium
KWYRASDAFANPRYRDRIPLMIG

SEQ ID NO: 99377 - protein, 20 aa, Mycobacterium avium
KYAPAVILIDEWVAYARSLL

SEQ ID NO: 99378 - protein, 19 aa, Mycobacterium avium
KYLHDMSAWTALSVTEQEN

SEQ ID NO: 99379 - protein, 20 aa, Mycobacterium avium
KYLHDMSAWTALSVTEQENV

SEQ ID NO: 99380 - protein, 17 aa, Mycobacterium avium
KYLPRMASGEMRATMAL

SEQ ID NO: 99381 - protein, 19 aa, Mycobacterium avium
KYPDRLTVLHWLESLQGLP

SEQ ID NO: 99382 - protein, 21 aa, Mycobacterium avium
KYPVSLDVAGLRWPQVAAGDP

SEQ ID NO: 99383 - protein, 18 aa, Mycobacterium avium
KYWVCKRSTPHAAEALEC

SEQ ID NO: 99384 - protein, 18 aa, Mycobacterium avium
LAAAAAWNALSSELRSAA

SEQ ID NO: 99385 - protein, 25 aa, Mycobacterium avium
LAAAARYLGAFGMDAVQAHEERLVA

SEQ ID NO: 99386 - protein, 24 aa, Mycobacterium avium
LAAAASCVVDFGVDRVTLAEIARR

SEQ ID NO: 99387 - protein, 23 aa, Mycobacterium avium
LAAACGLRVSTIFGGVSQHRQVT

SEQ ID NO: 99388 - protein, 24 aa, Mycobacterium avium
LAAACGLRVSTIFGGVSQHRQVTA

SEQ ID NO: 99389 - protein, 19 aa, Mycobacterium avium
LAAAGCGRIVLSSRSEPNQ

SEQ ID NO: 99390 - protein, 17 aa, Mycobacterium avium
LAAALALQGLKTLVIDL

SEQ ID NO: 99391 - protein, 24 aa, Mycobacterium avium
LAAAQRLGPLLAHHPGQRVDDVGL

SEQ ID NO: 99392 - protein, 19 aa, Mycobacterium avium
LAAARFAQHGQAFQAVSAE

SEQ ID NO: 99393 - protein, 21 aa, Mycobacterium avium
LAAARFKEMIDRWNAESVRLY

SEQ ID NO: 99394 - protein, 18 aa, Mycobacterium avium
LAAARFKEVIDRWNAESV

SEQ ID NO: 99395 - protein, 28 aa, Mycobacterium avium
LAAARLAAHAAVFWLGRGRTASRETAVA

SEQ ID NO: 99396 - protein, 17 aa, Mycobacterium avium
LAADEYQGFMAIRQWAK

SEQ ID NO: 99397 - protein, 22 aa, Mycobacterium avium
LAADVRRADCQFVVTDAEHRPL

SEQ ID NO: 99398 - protein, 26 aa, Mycobacterium avium
LAAFPRYHPRWAWSLTSVPVLREFLV

SEQ ID NO: 99399 - protein, 17 aa, Mycobacterium avium
LAAGRYLAANGFAADRD

SEQ ID NO: 99400 - protein, 17 aa, Mycobacterium avium
LAAGSRRSAWWAGTVTL

SEQ ID NO: 99401 - protein, 20 aa, Mycobacterium avium
LAAHGWVRAGSVAVMERPAG

SEQ ID NO: 99402 - protein, 18 aa, Mycobacterium avium
LAAHGWVRAGSVAVVERP

SEQ ID NO: 99403 - protein, 18 aa, Mycobacterium avium
LAAKGGWGPGGRDEYLVR

SEQ ID NO: 99404 - protein, 18 aa, Mycobacterium avium
LAAKGLAAKGGWGPGGRD

SEQ ID NO: 99405 - protein, 17 aa, Mycobacterium avium
LAAKIGVPAQRLTATVL

SEQ ID NO: 99406 - protein, 18 aa, Mycobacterium avium
LAAKIGVPAQRLTATVLR

SEQ ID NO: 99407 - protein, 18 aa, Mycobacterium avium
LAALACRDGFTAVNVCSG

SEQ ID NO: 99408 - protein, 18 aa, Mycobacterium avium
LAALAGFCAQAAVRRTPL

SEQ ID NO: 99409 - protein, 18 aa, Mycobacterium avium
LAALCARVGADIDDVTCC

SEQ ID NO: 99410 - protein, 21 aa, Mycobacterium avium
LAALCRAELAGYKQPRRFEYR

SEQ ID NO: 99411 - protein, 18 aa, Mycobacterium avium
LAALDGWTTDALDYGGHD

SEQ ID NO: 99412 - protein, 18 aa, Mycobacterium avium
LAALKRLGLCPPDVTPHP

SEQ ID NO: 99413 - protein, 17 aa, Mycobacterium avium
LAANVAQRVGAPLAALH

SEQ ID NO: 99414 - protein, 28 aa, Mycobacterium avium
LAAPASDVAPTWLASRANWMDSVTPIGS

SEQ ID NO: 99415 - protein, 18 aa, Mycobacterium avium
LAAPGWPKSVGGLELSLE

SEQ ID NO: 99416 - protein, 18 aa, Mycobacterium avium
LAAPGWPREVGGLDLSLA

SEQ ID NO: 99417 - protein, 24 aa, Mycobacterium avium
LAARDGYCALTLSRADDLAAVPAL

SEQ ID NO: 99418 - protein, 26 aa, Mycobacterium avium
LAARIKSLGYGAAWIGGSPDAELSWV

SEQ ID NO: 99419 - protein, 24 aa, Mycobacterium avium
LAARRELTGLAVLDLYAGSGALGL

SEQ ID NO: 99420 - protein, 27 aa, Mycobacterium avium
LAARTGLEPGTQWLSVRGYRQADGASV

SEQ ID NO: 99421 - protein, 17 aa, Mycobacterium avium
LAAVFGLDVRPVDMRVQ

SEQ ID NO: 99422 - protein, 18 aa, Mycobacterium avium
LAAVIAAHPRPDFKTRIL

SEQ ID NO: 99423 - protein, 19 aa, Mycobacterium avium
LACDHQVEFVLNQRHRGGQ

SEQ ID NO: 99424 - protein, 25 aa, Mycobacterium avium
LACDVRPGVPVLFLDTGYHFPETIG

SEQ ID NO: 99425 - protein, 23 aa, Mycobacterium avium
LACIPRATTDLVYIRMHGPDPAA

SEQ ID NO: 99426 - protein, 24 aa, Mycobacterium avium
LADCGAEVTMVEPLDGSPLRELAG

SEQ ID NO: 99427 - protein, 18 aa, Mycobacterium avium
LADHVASHFARRGEGLDD

SEQ ID NO: 99428 - protein, 18 aa, Mycobacterium avium
LADIPGVRLIGTAQEKAS

SEQ ID NO: 99429 - protein, 17 aa, Mycobacterium avium
LADLIVLAGSAAVEKAA

SEQ ID NO: 99430 - protein, 20 aa, Mycobacterium avium
LADMAIGAWLLEKAGIEEMA

SEQ ID NO: 99431 - protein, 23 aa, Mycobacterium avium
LADRLPGYMLPSAVLALDALPLT

SEQ ID NO: 99432 - protein, 18 aa, Mycobacterium avium
LADRLRRLLAAMPADPDR

SEQ ID NO: 99433 - protein, 32 aa, Mycobacterium avium
LADSARCYLRRWHRRRPLWIGVAIGGTVDSAT

SEQ ID NO: 99434 - protein, 17 aa, Mycobacterium avium
LADSWRMASKSLRPLPV

SEQ ID NO: 99435 - protein, 18 aa, Mycobacterium avium
LADVDAQLDAPISLHLNG

SEQ ID NO: 99436 - protein, 21 aa, Mycobacterium avium
LADVIVCCKFRDRRLDRAIVE

SEQ ID NO: 99437 - protein, 33 aa, Mycobacterium avium
LADVLRPDVLLTRLVRRDGLLHFSTEVSWQRTV

SEQ ID NO: 99438 - protein, 22 aa, Mycobacterium avium
LAEAAVPFGVRRGSTSAFAAGI

SEQ ID NO: 99439 - protein, 25 aa, Mycobacterium avium
LAEAIRRSGLPKVPTSVLSRGVCGV

SEQ ID NO: 99440 - protein, 20 aa, Mycobacterium avium
LAEDFVWFRGPPDMVNIMAV

SEQ ID NO: 99441 - protein, 18 aa, Mycobacterium avium
LAEDGSRGLTHGQVDRYA

SEQ ID NO: 99442 - protein, 18 aa, Mycobacterium avium
LAEEARIVSELSGTADAL

SEQ ID NO: 99443 - protein, 26 aa, Mycobacterium avium
LAEEARREAIPNIARLLGAARAAGVA

SEQ ID NO: 99444 - protein, 22 aa, Mycobacterium avium
LAEGLTKAAALMEGHEADSSHA

SEQ ID NO: 99445 - protein, 17 aa, Mycobacterium avium
LAEIMRLGIALGAKGAT

SEQ ID NO: 99446 - protein, 23 aa, Mycobacterium avium
LAEKGHLRLAVEAITLACEDAGI

SEQ ID NO: 99447 - protein, 25 aa, Mycobacterium avium
LAELERRVAEFLGFSMVLTSVGQVY

SEQ ID NO: 99448 - protein, 23 aa, Mycobacterium avium
LAELEVRDGGKLVREMIGQMKAL

SEQ ID NO: 99449 - protein, 26 aa, Mycobacterium avium
LAELPRDVVVGLEMPQREAALAGTGA

SEQ ID NO: 99450 - protein, 21 aa, Mycobacterium avium
LAEMQLPIGSVIVNRNIPAYL

SEQ ID NO: 99451 - protein, 18 aa, Mycobacterium avium
LAEPEKFAGYTGQLGSPD

SEQ ID NO: 99452 - protein, 17 aa, Mycobacterium avium
LAEPGRWAYYPWRRAVV

SEQ ID NO: 99453 - protein, 18 aa, Mycobacterium avium
LAEQVPIYAVNLLLSTAT

SEQ ID NO: 99454 - protein, 21 aa, Mycobacterium avium
LAERALRIAVEHVSVRVQFGA

SEQ ID NO: 99455 - protein, 18 aa, Mycobacterium avium
LAERAVELARLIAGHAPL

SEQ ID NO: 99456 - protein, 20 aa, Mycobacterium avium
LAERGYRYGPAFRGLTSMWR

SEQ ID NO: 99457 - protein, 25 aa, Mycobacterium avium
LAESDSRRGPAFVIELHREQGVEDF

SEQ ID NO: 99458 - protein, 18 aa, Mycobacterium avium
LAESWQWGADEAVIRSLL

SEQ ID NO: 99459 - protein, 25 aa, Mycobacterium avium
LAETMKCYGVRPGAVIGHSLGECAA

SEQ ID NO: 99460 - protein, 25 aa, Mycobacterium avium
LAFAGKGRAGIAIGNPDKARNTAVV

SEQ ID NO: 99461 - protein, 25 aa, Mycobacterium avium
LAFDKRLAGASAWWRYTPGATSACF

SEQ ID NO: 99462 - protein, 20 aa, Mycobacterium avium
LAFPRLYGAQTRFFDDFFDA

SEQ ID NO: 99463 - protein, 24 aa, Mycobacterium avium
LAGDDPKLLWLEWSAPEPPEDPAA

SEQ ID NO: 99464 - protein, 18 aa, Mycobacterium avium
LAGEAAPYARTWSTIAGA

SEQ ID NO: 99465 - protein, 24 aa, Mycobacterium avium
LAGELPAVVLAKLLGFSIKRAVTW

SEQ ID NO: 99466 - protein, 25 aa, Mycobacterium avium
LAGFADRVATEWAGPRSRVVRRAMR

SEQ ID NO: 99467 - protein, 26 aa, Mycobacterium avium
LAGFADRVATEWAGPRSRVVRRAMRL

SEQ ID NO: 99468 - protein, 24 aa, Mycobacterium avium
LAGFTETYTPAGYGTLGINSSGYA

SEQ ID NO: 99469 - protein, 24 aa, Mycobacterium avium
LAGGVCAALFHRGRTGEPTIVDSS

SEQ ID NO: 99470 - protein, 23 aa, Mycobacterium avium
LAGHLRPDALITRMAHSGDGLQF

SEQ ID NO: 99471 - protein, 28 aa, Mycobacterium avium
LAGHPAKLLLQFGRPVHRQPRAAVVGHR

SEQ ID NO: 99472 - protein, 18 aa, Mycobacterium avium
LAGIHERGGVPIEIKTNP

SEQ ID NO: 99473 - protein, 22 aa, Mycobacterium avium
LAGLARAIADIAARARSGNLKP

SEQ ID NO: 99474 - protein, 18 aa, Mycobacterium avium
LAGLRRFHRHLGAGRLAR

SEQ ID NO: 99475 - protein, 17 aa, Mycobacterium avium
LAGLSDVWTWAGTGSVH

SEQ ID NO: 99476 - protein, 17 aa, Mycobacterium avium
LAGRCGLDPADLIVSIT

SEQ ID NO: 99477 - protein, 29 aa, Mycobacterium avium
LAGRGARPGERVAVLVPRSAGAVVSILAV

SEQ ID NO: 99478 - protein, 25 aa, Mycobacterium avium
LAGRRPRPYASYNLSLAKLDNIHGL

SEQ ID NO: 99479 - protein, 23 aa, Mycobacterium avium
LAGYEQFAPWLLVEKRGNVHVVS

SEQ ID NO: 99480 - protein, 17 aa, Mycobacterium avium
LAGYQARSVDIDGCTYR

SEQ ID NO: 99481 - protein, 18 aa, Mycobacterium avium
LAHDWGSIQGWAAITDES

SEQ ID NO: 99482 - protein, 32 aa, Mycobacterium avium
LAHFIRTGQEFSWRAEELFVAIAAGDITVEVG

SEQ ID NO: 99483 - protein, 18 aa, Mycobacterium avium
LAHGDFRMGNLIVDGAQL

SEQ ID NO: 99484 - protein, 23 aa, Mycobacterium avium
LAHGWIPSGIALPAGVRLLEPER

SEQ ID NO: 99485 - protein, 18 aa, Mycobacterium avium
LAHTGRLPAALPEIRSYR

SEQ ID NO: 99486 - protein, 20 aa, Mycobacterium avium
LAIADGRIVAVGTRAEIAAH

SEQ ID NO: 99487 - protein, 23 aa, Mycobacterium avium
LAICAAVQVLGHWYETSAGERVD

SEQ ID NO: 99488 - protein, 17 aa, Mycobacterium avium
LAIDALIDLARRVTIDG

SEQ ID NO: 99489 - protein, 30 aa, Mycobacterium avium
LAKGRRTVWIPWALGPAAAVLRMLPQPIWR

SEQ ID NO: 99490 - protein, 18 aa, Mycobacterium avium
LAKLEGDAAFFWAPDSSA

SEQ ID NO: 99491 - protein, 18 aa, Mycobacterium avium
LAKLKRFREEAGKTGPFE

SEQ ID NO: 99492 - protein, 21 aa, Mycobacterium avium
LAKLPTIAAYAYKKSVGQPFL

SEQ ID NO: 99493 - protein, 18 aa, Mycobacterium avium
LAKRSDIVLQCFRGKAAE

SEQ ID NO: 99494 - protein, 18 aa, Mycobacterium avium
LAKRSDIVLQCFRGKVAE

SEQ ID NO: 99495 - protein, 23 aa, Mycobacterium avium
LALACGIGSFAHHTVVHEASCVK

SEQ ID NO: 99496 - protein, 17 aa, Mycobacterium avium
LALAPKGIWLGPKELRT

SEQ ID NO: 99497 - protein, 18 aa, Mycobacterium avium
LALEKAPAGTALHGTAES

SEQ ID NO: 99498 - protein, 17 aa, Mycobacterium avium
LALEQAPAGSVLHAVGD

SEQ ID NO: 99499 - protein, 25 aa, Mycobacterium avium
LALFDWPTHILEILTTAPQLLAPAL

SEQ ID NO: 99500 - protein, 19 aa, Mycobacterium avium
LALFPRLGTPPHPIPQSPA

SEQ ID NO: 99501 - protein, 18 aa, Mycobacterium avium
LALFRFAFVSQEHEPEAF

SEQ ID NO: 99502 - protein, 17 aa, Mycobacterium avium
LALGSGGARGYAHIGVI

SEQ ID NO: 99503 - protein, 18 aa, Mycobacterium avium
LALIMAMGALGQVDDLTA

SEQ ID NO: 99504 - protein, 17 aa, Mycobacterium avium
LALKLINNLLFAANAQL

SEQ ID NO: 99505 - protein, 24 aa, Mycobacterium avium
LALNRRSPIFGGWVTGPTLLGPEE

SEQ ID NO: 99506 - protein, 25 aa, Mycobacterium avium
LALPVVKHTAMRLASGAMAIANADG

SEQ ID NO: 99507 - protein, 22 aa, Mycobacterium avium
LAMASAAAPYVAWMQQTAAQAA

SEQ ID NO: 99508 - protein, 19 aa, Mycobacterium avium
LAMLYGCPLPKIDHRTQAP

SEQ ID NO: 99509 - protein, 17 aa, Mycobacterium avium
LANAEKVFTSWMVAGDA

SEQ ID NO: 99510 - protein, 24 aa, Mycobacterium avium
LANALRSWSVLRFEVTEDPSPGVD

SEQ ID NO: 99511 - protein, 21 aa, Mycobacterium avium
LANAPFKFAPDNGLAYFERLG

SEQ ID NO: 99512 - protein, 19 aa, Mycobacterium avium
LANCGYAGATVRHLLDMRS

SEQ ID NO: 99513 - protein, 24 aa, Mycobacterium avium
LANLERWMHGWADIYDAHAAVFAE

SEQ ID NO: 99514 - protein, 23 aa, Mycobacterium avium
LAPARTALRNWLRRVRLDPEQTL

SEQ ID NO: 99515 - protein, 20 aa, Mycobacterium avium
LAPGGRLVFNTFLARDGYVP

SEQ ID NO: 99516 - protein, 18 aa, Mycobacterium avium
LAPGPFLACTLGARVAAR

SEQ ID NO: 99517 - protein, 17 aa, Mycobacterium avium
LAPILSRLTERTNRISV

SEQ ID NO: 99518 - protein, 17 aa, Mycobacterium avium
LAPIYVLLASDEASYIS

SEQ ID NO: 99519 - protein, 17 aa, Mycobacterium avium
LAPKGIWLGPKELRTFY

SEQ ID NO: 99520 - protein, 19 aa, Mycobacterium avium
LAPLAFVRFRLDGHDWPAS

SEQ ID NO: 99521 - protein, 18 aa, Mycobacterium avium
LAPLELLAYCAACTERLR

SEQ ID NO: 99522 - protein, 21 aa, Mycobacterium avium
LAPLPKRRLGETLDRYPTCAS

SEQ ID NO: 99523 - protein, 17 aa, Mycobacterium avium
LAPNEYIITLGMHDFEK

SEQ ID NO: 99524 - protein, 24 aa, Mycobacterium avium
LAPQSLWAERVFADAVAELGGSAF

SEQ ID NO: 99525 - protein, 18 aa, Mycobacterium avium
LAPRLHGHHVVVLDVHDP

SEQ ID NO: 99526 - protein, 25 aa, Mycobacterium avium
LAPVRFFNPIGMRFAKKATRDDIDE

SEQ ID NO: 99527 - protein, 24 aa, Mycobacterium avium
LAPVRFFNPIGMRFAKKATREDID

SEQ ID NO: 99528 - protein, 24 aa, Mycobacterium avium
LAQARACASAECDTHRQAATAAAA

SEQ ID NO: 99529 - protein, 33 aa, Mycobacterium avium
LAQLDYLQWLGIDCIWLPPFYDSPLRDGGYDIR

SEQ ID NO: 99530 - protein, 17 aa, Mycobacterium avium
LAQRMGKKRVIAETGAG

SEQ ID NO: 99531 - protein, 26 aa, Mycobacterium avium
LAQRPLKWRLILTLGEPGDPTHDATK

SEQ ID NO: 99532 - protein, 26 aa, Mycobacterium avium
LAQVLKRRGPAGARVIVGRDARHGSA

SEQ ID NO: 99533 - protein, 19 aa, Mycobacterium avium
LAQVQARAVAAVREHDRRL

SEQ ID NO: 99534 - protein, 23 aa, Mycobacterium avium
LARAGMCCGCGYYFAVHGAHRAD

SEQ ID NO: 99535 - protein, 26 aa, Mycobacterium avium
LAREGITSMHFVPSLLGLFLSLPGAS

SEQ ID NO: 99536 - protein, 26 aa, Mycobacterium avium
LAREGITSMHFVPSLLGLFLSLPGVS

SEQ ID NO: 99537 - protein, 28 aa, Mycobacterium avium
LAREGITSMHFVPSLLGLFLSLPGVSQW

SEQ ID NO: 99538 - protein, 17 aa, Mycobacterium avium
LARKAMDLLGCELQQRY

SEQ ID NO: 99539 - protein, 17 aa, Mycobacterium avium
LARLGPLLVVTATGREA

SEQ ID NO: 99540 - protein, 22 aa, Mycobacterium avium
LARLLWQHRESWRYSTKAYGGT

SEQ ID NO: 99541 - protein, 18 aa, Mycobacterium avium
LARLPSRVWRAVRETRAV

SEQ ID NO: 99542 - protein, 19 aa, Mycobacterium avium
LARLREWEAAGGPVIEEAV

SEQ ID NO: 99543 - protein, 17 aa, Mycobacterium avium
LARLWSTALAGLVDIGY

SEQ ID NO: 99544 - protein, 27 aa, Mycobacterium avium
LARPATPVSVPTRFAAQAARTPDAVAL

SEQ ID NO: 99545 - protein, 17 aa, Mycobacterium avium
LARVLAIVEVVTERPDH

SEQ ID NO: 99546 - protein, 22 aa, Mycobacterium avium
LARWGADGQLHYVGRADEQVKI

SEQ ID NO: 99547 - protein, 18 aa, Mycobacterium avium
LARYGPRAPQLWLPPLDE

SEQ ID NO: 99548 - protein, 17 aa, Mycobacterium avium
LASALFWGTERVLYIAG

SEQ ID NO: 99549 - protein, 17 aa, Mycobacterium avium
LASDWLGVDVNIAARVM

SEQ ID NO: 99550 - protein, 18 aa, Mycobacterium avium
LASEVAFLAMDFEYHGRG

SEQ ID NO: 99551 - protein, 24 aa, Mycobacterium avium
LASFCRERLAPFEVPAEFRRAAEL

SEQ ID NO: 99552 - protein, 18 aa, Mycobacterium avium
LASGWIPPHLRLPAHVTL

SEQ ID NO: 99553 - protein, 19 aa, Mycobacterium avium
LASHGYRFVGILMNPADRR

SEQ ID NO: 99554 - protein, 20 aa, Mycobacterium avium
LASLPPRWRPHPGARADPDA

SEQ ID NO: 99555 - protein, 25 aa, Mycobacterium avium
LASLRKLYATSEWLHRETTRIGQTL

SEQ ID NO: 99556 - protein, 25 aa, Mycobacterium avium
LASMMPMRVIGMLLGIPESEPVSVR

SEQ ID NO: 99557 - protein, 17 aa, Mycobacterium avium
LASRIPIGTADRYTVLC

SEQ ID NO: 99558 - protein, 18 aa, Mycobacterium avium
LATAGAFGCFGMSRREAL

SEQ ID NO: 99559 - protein, 18 aa, Mycobacterium avium
LATAKAFLAAGAKVALGD

SEQ ID NO: 99560 - protein, 23 aa, Mycobacterium avium
LATCAVEGIPIKVALINNGNLGM

SEQ ID NO: 99561 - protein, 22 aa, Mycobacterium avium
LATCLRSILRPHYMTRAREVAK

SEQ ID NO: 99562 - protein, 21 aa, Mycobacterium avium
LATDVWPNNLIIPIGYSQGAI

SEQ ID NO: 99563 - protein, 18 aa, Mycobacterium avium
LATEIPLRARLFRIADDE

SEQ ID NO: 99564 - protein, 19 aa, Mycobacterium avium
LATLAGRFSSPKSAARQGD

SEQ ID NO: 99565 - protein, 25 aa, Mycobacterium avium
LATLPYPMLMAARLKSLGLPTNSKA

SEQ ID NO: 99566 - protein, 18 aa, Mycobacterium avium
LATLSWVHWHNTSRLHGY

SEQ ID NO: 99567 - protein, 18 aa, Mycobacterium avium
LATMEAQIGVTLAVRTTR

SEQ ID NO: 99568 - protein, 24 aa, Mycobacterium avium
LATTVPGCIGALMHSGQGCALTTR

SEQ ID NO: 99569 - protein, 26 aa, Mycobacterium avium
LATYPWPASTVRNWFRGDYANLTLIV

SEQ ID NO: 99570 - protein, 18 aa, Mycobacterium avium
LAVCRDVALDHAFAQPIR

SEQ ID NO: 99571 - protein, 17 aa, Mycobacterium avium
LAVDPDARLTVADGPQP

SEQ ID NO: 99572 - protein, 18 aa, Mycobacterium avium
LAVGDGLRIDDVSVDARS

SEQ ID NO: 99573 - protein, 17 aa, Mycobacterium avium
LAVGFWADPGELRANWR

SEQ ID NO: 99574 - protein, 20 aa, Mycobacterium avium
LAVGRRLRERYGIDEKPTAS

SEQ ID NO: 99575 - protein, 18 aa, Mycobacterium avium
LAVHRRGRRLRFMIKAEM

SEQ ID NO: 99576 - protein, 18 aa, Mycobacterium avium
LAVPASWTSVIPAAHSAV

SEQ ID NO: 99577 - protein, 18 aa, Mycobacterium avium
LAVQAGLDRDLLQVLPGP

SEQ ID NO: 99578 - protein, 19 aa, Mycobacterium avium
LAVQAGLDRDLLQVLPGPG

SEQ ID NO: 99579 - protein, 18 aa, Mycobacterium avium
LAVRELTWSAASPDIEAA

SEQ ID NO: 99580 - protein, 25 aa, Mycobacterium avium
LAWIVEKFWDWADCDGHPEKALSRD

SEQ ID NO: 99581 - protein, 25 aa, Mycobacterium avium
LAWQRTQWEGGWAGIAWPKEYGGQG

SEQ ID NO: 99582 - protein, 22 aa, Mycobacterium avium
LAYFERLGWRTVQVEALYSAAR

SEQ ID NO: 99583 - protein, 24 aa, Mycobacterium avium
LAYFSNGITSFWSSIAQQLVSGPG

SEQ ID NO: 99584 - protein, 19 aa, Mycobacterium avium
LCADAGFTAADRALQTHGG

SEQ ID NO: 99585 - protein, 17 aa, Mycobacterium avium
LCAELDLTVVQHAGAGS

SEQ ID NO: 99586 - protein, 24 aa, Mycobacterium avium
LCAPDDPICFGGGNIMAHVSYIDA

SEQ ID NO: 99587 - protein, 17 aa, Mycobacterium avium
LCASGALGERSGAGYRP

SEQ ID NO: 99588 - protein, 28 aa, Mycobacterium avium
LCDELLGVPGIRQARFDWLRGDPSPTRP

SEQ ID NO: 99589 - protein, 20 aa, Mycobacterium avium
LCGRLRLADFDHMELSNLNR

SEQ ID NO: 99590 - protein, 19 aa, Mycobacterium avium
LCGTEPLLIERIDAEYGRY

SEQ ID NO: 99591 - protein, 24 aa, Mycobacterium avium
LCNLWRLPQSLVMNTELLDQTEMG

SEQ ID NO: 99592 - protein, 23 aa, Mycobacterium avium
LCPDSPVIPGIVWYSATTQPQGW

SEQ ID NO: 99593 - protein, 20 aa, Mycobacterium avium
LCPVSPVTPGIVWYSATTQP

SEQ ID NO: 99594 - protein, 19 aa, Mycobacterium avium
LCQGGGFQIALCSDLSVVS

SEQ ID NO: 99595 - protein, 19 aa, Mycobacterium avium
LCRRRSLRWRDPVGVGDIR

SEQ ID NO: 99596 - protein, 18 aa, Mycobacterium avium
LCRTPLAGLDRTRKVARV

SEQ ID NO: 99597 - protein, 17 aa, Mycobacterium avium
LCVKFLHDWAGPEAMIK

SEQ ID NO: 99598 - protein, 18 aa, Mycobacterium avium
LDAAGDGMWNWFAAPNLP

SEQ ID NO: 99599 - protein, 21 aa, Mycobacterium avium
LDADDIWALISATRVHLDESL

SEQ ID NO: 99600 - protein, 18 aa, Mycobacterium avium
LDAGACSPPRLADAALEA

SEQ ID NO: 99601 - protein, 19 aa, Mycobacterium avium
LDAGRELAKALGLDPNAVT

SEQ ID NO: 99602 - protein, 27 aa, Mycobacterium avium
LDALGWKLHGRFREKDGRQLVIRDLFY

SEQ ID NO: 99603 - protein, 17 aa, Mycobacterium avium
LDAMSSWWTAIHGHGHP

SEQ ID NO: 99604 - protein, 20 aa, Mycobacterium avium
LDAQRWARQQAQRAVAQARP

SEQ ID NO: 99605 - protein, 18 aa, Mycobacterium avium
LDAQRWARQRAQRAVAQA

SEQ ID NO: 99606 - protein, 27 aa, Mycobacterium avium
LDARAYRLPWPAGTVVYEVDMPDVIEF

SEQ ID NO: 99607 - protein, 20 aa, Mycobacterium avium
LDARGPIRLVEFNSRRPFHP

SEQ ID NO: 99608 - protein, 21 aa, Mycobacterium avium
LDARGPIRLVEFNSRRPFHPG

SEQ ID NO: 99609 - protein, 17 aa, Mycobacterium avium
LDARLSVRVLFEAPTIA

SEQ ID NO: 99610 - protein, 26 aa, Mycobacterium avium
LDARPYRLSWPAGTTVYEIDQPEVIA

SEQ ID NO: 99611 - protein, 26 aa, Mycobacterium avium
LDASTFLGRLALIRIYNGKLRKGQQV

SEQ ID NO: 99612 - protein, 17 aa, Mycobacterium avium
LDATLSFLGMDGAKHSS

SEQ ID NO: 99613 - protein, 24 aa, Mycobacterium avium
LDATPAQIALAWTLSVAPSIALIP

SEQ ID NO: 99614 - protein, 25 aa, Mycobacterium avium
LDAVEKLPRWRLDLDDGSITFDNTE

SEQ ID NO: 99615 - protein, 20 aa, Mycobacterium avium
LDAYLDRYVETFGGAVEVNV

SEQ ID NO: 99616 - protein, 19 aa, Mycobacterium avium
LDCCQESDGGVAMVVTSVE

SEQ ID NO: 99617 - protein, 19 aa, Mycobacterium avium
LDCLKWAGMDAKVIASKWI

SEQ ID NO: 99618 - protein, 20 aa, Mycobacterium avium
LDCTSEVDGAVAILITGEDI

SEQ ID NO: 99619 - protein, 22 aa, Mycobacterium avium
LDDAEWGQAIVAVIVPESGTAP

SEQ ID NO: 99620 - protein, 24 aa, Mycobacterium avium
LDDELRPTWLFGNTVHEGCDRAGY

SEQ ID NO: 99621 - protein, 20 aa, Mycobacterium avium
LDDEVRWVLTKGKLPTSLWI

SEQ ID NO: 99622 - protein, 18 aa, Mycobacterium avium
LDDIGNRAALAGPPPAPP

SEQ ID NO: 99623 - protein, 26 aa, Mycobacterium avium
LDDLLPEALRWPGRRPGGCSTSARST

SEQ ID NO: 99624 - protein, 24 aa, Mycobacterium avium
LDDNACRFLLQRGAGEDVTALGWQ

SEQ ID NO: 99625 - protein, 20 aa, Mycobacterium avium
LDDPLPWLLADRRAVRVTAV

SEQ ID NO: 99626 - protein, 20 aa, Mycobacterium avium
LDDPLPWLLADRRSVRVTAV

SEQ ID NO: 99627 - protein, 24 aa, Mycobacterium avium
LDDPRLELVGVYAFSEEKAGSDAG

SEQ ID NO: 99628 - protein, 17 aa, Mycobacterium avium
LDDRLGLGRVWSQCHSL

SEQ ID NO: 99629 - protein, 20 aa, Mycobacterium avium
LDDSPIFLHVCQELEPPHLI

SEQ ID NO: 99630 - protein, 32 aa, Mycobacterium avium
LDEARPPVRFALKGRHPFAVYRWVFELDTLDG

SEQ ID NO: 99631 - protein, 27 aa, Mycobacterium avium
LDECTARGIAFVAYFPLGSGFSTDNPV

SEQ ID NO: 99632 - protein, 25 aa, Mycobacterium avium
LDEHRPEVVFHLAAQIDVRHSVADP

SEQ ID NO: 99633 - protein, 20 aa, Mycobacterium avium
LDELVGFFVNTLVLRVDLAG

SEQ ID NO: 99634 - protein, 21 aa, Mycobacterium avium
LDFAGNADFAIAIRTALMRGG

SEQ ID NO: 99635 - protein, 22 aa, Mycobacterium avium
LDFLCSLLGRPVSVCAEVRTSD

SEQ ID NO: 99636 - protein, 30 aa, Mycobacterium avium
LDFLRSCSIKHRMASVIFSLEMSKSEIVMR

SEQ ID NO: 99637 - protein, 28 aa, Mycobacterium avium
LDFPELVIVCGHVGYPWTEEMVAVARKH

SEQ ID NO: 99638 - protein, 23 aa, Mycobacterium avium
LDFRPKHKLAVLVVSVTPLAEPV

SEQ ID NO: 99639 - protein, 19 aa, Mycobacterium avium
LDFVPAFGSAFQWQYPAPP

SEQ ID NO: 99640 - protein, 22 aa, Mycobacterium avium
LDGGAPFYGCYETADGKYVAVG

SEQ ID NO: 99641 - protein, 25 aa, Mycobacterium avium
LDGGFKQSVRMIADHMGFRIDPNIR

SEQ ID NO: 99642 - protein, 26 aa, Mycobacterium avium
LDGGFKQSVRMIADHMGFRIDPNIRT

SEQ ID NO: 99643 - protein, 30 aa, Mycobacterium avium
LDGGFKQSVRMIADHMGFRIDPNIRTIQDV

SEQ ID NO: 99644 - protein, 19 aa, Mycobacterium avium
LDGGGRGAVAVGVLVVRRR

SEQ ID NO: 99645 - protein, 22 aa, Mycobacterium avium
LDGGRWQDEWLYARAYTIAGGS

SEQ ID NO: 99646 - protein, 23 aa, Mycobacterium avium
LDGGRWQDEWLYARAYTIAGGSS

SEQ ID NO: 99647 - protein, 17 aa, Mycobacterium avium
LDGHFTLVFANADEPGT

SEQ ID NO: 99648 - protein, 19 aa, Mycobacterium avium
LDGIRPAQSLALVPLAAGG

SEQ ID NO: 99649 - protein, 17 aa, Mycobacterium avium
LDGLPRRRGALGHRVLP

SEQ ID NO: 99650 - protein, 18 aa, Mycobacterium avium
LDGLRATGHLGLTAQRFE

SEQ ID NO: 99651 - protein, 19 aa, Mycobacterium avium
LDGRAAVYSRVQAVATGMF

SEQ ID NO: 99652 - protein, 18 aa, Mycobacterium avium
LDGRILGYAMLIHDLAGD

SEQ ID NO: 99653 - protein, 21 aa, Mycobacterium avium
LDGRPRYVPVGDIMDDTLLTR

SEQ ID NO: 99654 - protein, 22 aa, Mycobacterium avium
LDGVRWPDIVSRVFGRIDPIAL

SEQ ID NO: 99655 - protein, 20 aa, Mycobacterium avium
LDHARRLRDAFPHAALIEIP

SEQ ID NO: 99656 - protein, 24 aa, Mycobacterium avium
LDHGVWLRPFRNLIYAMPPYICPP

SEQ ID NO: 99657 - protein, 25 aa, Mycobacterium avium
LDHLAGRRGRKWFQIKASQQVVLPQ

SEQ ID NO: 99658 - protein, 18 aa, Mycobacterium avium
LDHLKFAVLALGDSSYEL

SEQ ID NO: 99659 - protein, 23 aa, Mycobacterium avium
LDHVAEHYLHFGGVSPINGINRA

SEQ ID NO: 99660 - protein, 19 aa, Mycobacterium avium
LDIGCGWGSTMRHAMEEYD

SEQ ID NO: 99661 - protein, 22 aa, Mycobacterium avium
LDIGRNALLTAGWPETVPGVTV

SEQ ID NO: 99662 - protein, 18 aa, Mycobacterium avium
LDILTRCRLTTITDDNPD

SEQ ID NO: 99663 - protein, 17 aa, Mycobacterium avium
LDITAPIAENIKAVAKV

SEQ ID NO: 99664 - protein, 17 aa, Mycobacterium avium
LDKDIVAFVGRIQPLKA

SEQ ID NO: 99665 - protein, 17 aa, Mycobacterium avium
LDLAMRFGTDSGGPVRV

SEQ ID NO: 99666 - protein, 21 aa, Mycobacterium avium
LDLATVIGCGEPQLVVRDGVA

SEQ ID NO: 99667 - protein, 25 aa, Mycobacterium avium
LDLIKAAVRRFGRDGTDGYDLVLRS

SEQ ID NO: 99668 - protein, 17 aa, Mycobacterium avium
LDLLQSILAEYQKRADD

SEQ ID NO: 99669 - protein, 20 aa, Mycobacterium avium
LDLLRIDLMRSLGVGINDIQ

SEQ ID NO: 99670 - protein, 21 aa, Mycobacterium avium
LDLLRIDPMRSLGVGINDIQR

SEQ ID NO: 99671 - protein, 19 aa, Mycobacterium avium
LDLLRLGTYQLLRTRVDAH

SEQ ID NO: 99672 - protein, 20 aa, Mycobacterium avium
LDLLRLGTYQLLRTRVDAHA

SEQ ID NO: 99673 - protein, 24 aa, Mycobacterium avium
LDLLRPELDRVLGPDQGRGVEAGE

SEQ ID NO: 99674 - protein, 30 aa, Mycobacterium avium; identical to SEQ ID NO: 16490

SEQ ID NO: 99675 - protein, 17 aa, Mycobacterium avium
LDLPAFRIGTIPVTNGE

SEQ ID NO: 99676 - protein, 17 aa, Mycobacterium avium
LDLPYMESVIWAFKQLW

SEQ ID NO: 99677 - protein, 19 aa, Mycobacterium avium
LDLQHRFRHQLARALAKRA

SEQ ID NO: 99678 - protein, 21 aa, Mycobacterium avium
LDLQLALAMCYELHYRGFTGV

SEQ ID NO: 99679 - protein, 20 aa, Mycobacterium avium
LDLSAFVVFSSMAGIVGAPG

SEQ ID NO: 99680 - protein, 26 aa, Mycobacterium avium
LDLSRLRFISVESFRALLLLNDELRK

SEQ ID NO: 99681 - protein, 23 aa, Mycobacterium avium
LDMHPSMRLRIEHYLQHRDSPYL

SEQ ID NO: 99682 - protein, 25 aa, Mycobacterium avium
LDNLGRPTSFIWYGPRWAQAATAPS

SEQ ID NO: 99683 - protein, 31 aa, Mycobacterium avium
LDNWLSPPYARWSFQHLEDFVPTAVIARGTG

SEQ ID NO: 99684 - protein, 18 aa, Mycobacterium avium
LDPAWDFGGRGERFEVEI

SEQ ID NO: 99685 - protein, 18 aa, Mycobacterium avium
LDPDASLGAGWACGVTVV

SEQ ID NO: 99686 - protein, 24 aa, Mycobacterium avium
LDPEVWRPIHKDIDLLASSEHGSP

SEQ ID NO: 99687 - protein, 22 aa, Mycobacterium avium
LDPFDPLVVWAFDSCDATEPSR

SEQ ID NO: 99688 - protein, 18 aa, Mycobacterium avium
LDPRVAPAVRARRLQRLS

SEQ ID NO: 99689 - protein, 19 aa, Mycobacterium avium
LDPRVAPAVRARRLQRLSE

SEQ ID NO: 99690 - protein, 23 aa, Mycobacterium avium
LDQLRLRTSMKWRAHPADVLPLW

SEQ ID NO: 99691 - protein, 18 aa, Mycobacterium avium
LDRARGVKMELKTKGGKT

SEQ ID NO: 99692 - protein, 21 aa, Mycobacterium avium
LDRCIQIHGALGISTELPLER

SEQ ID NO: 99693 - protein, 26 aa, Mycobacterium avium
LDRDCAELRAAGVVAAEALRLQRAQV

SEQ ID NO: 99694 - protein, 28 aa, Mycobacterium avium
LDRHPMLRLCLDDDGAGGWDLHVPPPGS

SEQ ID NO: 99695 - protein, 18 aa, Mycobacterium avium
LDRIGWLQAQTSRTFGRG

SEQ ID NO: 99696 - protein, 21 aa, Mycobacterium avium
LDRLYGYEVTPVLWKKVAPKL

SEQ ID NO: 99697 - protein, 22 aa, Mycobacterium avium
LDRNTTLWASWALAGPTHRAYF

SEQ ID NO: 99698 - protein, 18 aa, Mycobacterium avium
LDRPWRRPGALRYALNRI

SEQ ID NO: 99699 - protein, 22 aa, Mycobacterium avium
LDRQLPRLMVVAWDIPGACDIG

SEQ ID NO: 99700 - protein, 18 aa, Mycobacterium avium
LDRRCFRRAQPPRALPSN

SEQ ID NO: 99701 - protein, 30 aa, Mycobacterium avium
LDRREKTMLSWEFPFGFLDQGLSSPIRMPT

SEQ ID NO: 99702 - protein, 19 aa, Mycobacterium avium
LDRRFHTNLFTKLGEIPGS

SEQ ID NO: 99703 - protein, 23 aa, Mycobacterium avium
LDRSRPLWEMYFVEGLANNRIAV

SEQ ID NO: 99704 - protein, 24 aa, Mycobacterium avium
LDRVWRHLPFAAQWHSDNELARHR

SEQ ID NO: 99705 - protein, 17 aa, Mycobacterium avium
LDRWLRPAPPGVVGELY

SEQ ID NO: 99706 - protein, 25 aa, Mycobacterium avium
LDSGLRPVPCGATGELYLGGAQLAR

SEQ ID NO: 99707 - protein, 19 aa, Mycobacterium avium
LDSGPWRKLSANRDNRVYV

SEQ ID NO: 99708 - protein, 18 aa, Mycobacterium avium
LDSLQWVIGSILSNIDSV

SEQ ID NO: 99709 - protein, 35 aa, Mycobacterium avium
LDSRLRELVIMRIGWLTGCDYEWTQHWRVASRLGV

SEQ ID NO: 99710 - protein, 23 aa, Mycobacterium avium
LDTAGRWGATRVWLGVNQKNQRA

SEQ ID NO: 99711 - protein, 24 aa, Mycobacterium avium
LDTARAEWWYSRAATIMGGTAEVQ

SEQ ID NO: 99712 - protein, 24 aa, Mycobacterium avium
LDTARAEWWYSRAATVMGGTAEVQ

SEQ ID NO: 99713 - protein, 25 aa, Mycobacterium avium
LDTPNPLCWDSFRFIVIQRADHFTI

SEQ ID NO: 99714 - protein, 27 aa, Mycobacterium avium
LDTRAYRLDWPAGMTVFEIDQPAVVEF

SEQ ID NO: 99715 - protein, 23 aa, Mycobacterium avium
LDVAELYDPFSIVTLVLLEEYRL

SEQ ID NO: 99716 - protein, 19 aa, Mycobacterium avium
LDVALLLGDEAYRYPDNLP

SEQ ID NO: 99717 - protein, 19 aa, Mycobacterium avium
LDVANVIAFLASDAAAAVH

SEQ ID NO: 99718 - protein, 25 aa, Mycobacterium avium
LDVLKRVSPSMVFCSDEFALVAAGL

SEQ ID NO: 99719 - protein, 19 aa, Mycobacterium avium
LDVPILIGAFNKIMLRTVG

SEQ ID NO: 99720 - protein, 18 aa, Mycobacterium avium
LDVPYTRIHEFRHFHTER

SEQ ID NO: 99721 - protein, 21 aa, Mycobacterium avium
LDVRPPRLVGIDDSFFDLGGD

SEQ ID NO: 99722 - protein, 26 aa, Mycobacterium avium
LDVRVVGALIRLYAPPLVRIAELTTD

SEQ ID NO: 99723 - protein, 18 aa, Mycobacterium avium
LDVSDPASFVAFLDDVEA

SEQ ID NO: 99724 - protein, 17 aa, Mycobacterium avium
LDWMVCRTVATVLRTKV

SEQ ID NO: 99725 - protein, 21 aa, Mycobacterium avium
LDWNAPLTRIYTCAATPSPSP

SEQ ID NO: 99726 - protein, 25 aa, Mycobacterium avium
LDYARRLAPIAAEFADRLKIVMRVY

SEQ ID NO: 99727 - protein, 17 aa, Mycobacterium avium
LDYGSALLSKVTGPPPM

SEQ ID NO: 99728 - protein, 24 aa, Mycobacterium avium
LDYLKRLTADLRRTRRRVAELEGR

SEQ ID NO: 99729 - protein, 30 aa, Mycobacterium avium
LDYPRGNLAFRWFLADGVPARPEVELVKAA

SEQ ID NO: 99730 - protein, 17 aa, Mycobacterium avium
LDYWQMWHYGDSTMAGV

SEQ ID NO: 99731 - protein, 17 aa, Mycobacterium avium
LEAAGWAVIRVSAAMLS

SEQ ID NO: 99732 - protein, 17 aa, Mycobacterium avium
LEAARSWTNPKEYVAEL

SEQ ID NO: 99733 - protein, 27 aa, Mycobacterium avium
LEAAVQRSVVISAGWDVMDFVQQMQKL

SEQ ID NO: 99734 - protein, 17 aa, Mycobacterium avium
LEACPGCFKHYGLEERI

SEQ ID NO: 99735 - protein, 17 aa, Mycobacterium avium
LEAGCRLIDTAASYGNE

SEQ ID NO: 99736 - protein, 22 aa, Mycobacterium avium
LEAGMVLAITGYVWQRGIGAVF

SEQ ID NO: 99737 - protein, 26 aa, Mycobacterium avium
LEAGPSGRFRPLWAHNRAEERKALTD

SEQ ID NO: 99738 - protein, 18 aa, Mycobacterium avium
LEALKRLQNVVRRVADQW

SEQ ID NO: 99739 - protein, 20 aa, Mycobacterium avium
LEALPAQTPHTFNFGHELRR

SEQ ID NO: 99740 - protein, 18 aa, Mycobacterium avium
LEALWWDRPFTLNGVDIG

SEQ ID NO: 99741 - protein, 31 aa, Mycobacterium avium
LEAPSRADALLAFPAMQAMPTPYVEASDISN

SEQ ID NO: 99742 - protein, 18 aa, Mycobacterium avium
LEAQIRAGADIKSLSDGL

SEQ ID NO: 99743 - protein, 22 aa, Mycobacterium avium
LEARCNAVAAAVLMPAADVRAR

SEQ ID NO: 99744 - protein, 22 aa, Mycobacterium avium
LEASRSAVEWHRGTLEFWDHMV

SEQ ID NO: 99745 - protein, 24 aa, Mycobacterium avium
LEASWSVAALGIWRIKRRSTSSNW

SEQ ID NO: 99746 - protein, 20 aa, Mycobacterium avium
LEAVPEFRLKLADTPLNLDH

SEQ ID NO: 99747 - protein, 20 aa, Mycobacterium avium
LECETFRFRGHYFADRMPYI

SEQ ID NO: 99748 - protein, 20 aa, Mycobacterium avium
LEDAGFCAKGQGMQWIGDHD

SEQ ID NO: 99749 - protein, 18 aa, Mycobacterium avium
LEDFGFCKKGEGGPYVAD

SEQ ID NO: 99750 - protein, 17 aa, Mycobacterium avium
LEDGHRVFVELSPHPLL

SEQ ID NO: 99751 - protein, 21 aa, Mycobacterium avium
LEDGQMCRLRAAGPNYTINMV

SEQ ID NO: 99752 - protein, 20 aa, Mycobacterium avium
LEDGRVFTGTAFGAIGQTLG

SEQ ID NO: 99753 - protein, 21 aa, Mycobacterium avium
LEEASRLVAHAANPARARRRA

SEQ ID NO: 99754 - protein, 24 aa, Mycobacterium avium
LEEILKRFPEWEVDLSRATLSPTS

SEQ ID NO: 99755 - protein, 17 aa, Mycobacterium avium
LEFLEWFLETVPITPIW

SEQ ID NO: 99756 - protein, 22 aa, Mycobacterium avium
LEGAVRLGYRKELAAVTDPAER

SEQ ID NO: 99757 - protein, 17 aa, Mycobacterium avium
LEGFRPGVMERMGLGPE

SEQ ID NO: 99758 - protein, 21 aa, Mycobacterium avium
LEHAAAWPAAEQTWLHGWLLR

SEQ ID NO: 99759 - protein, 17 aa, Mycobacterium avium
LEIILPMIRGERATFEG

SEQ ID NO: 99760 - protein, 17 aa, Mycobacterium avium
LEILPAKQREILILRVV

SEQ ID NO: 99761 - protein, 19 aa, Mycobacterium avium
LEITTCLRRGEIEMVTRYE

SEQ ID NO: 99762 - protein, 23 aa, Mycobacterium avium
LEKEMFWPRVWQMACRLEEIPKP

SEQ ID NO: 99763 - protein, 33 aa, Mycobacterium avium; identical to SEQ ID NO: 13745

SEQ ID NO: 99764 - protein, 23 aa, Mycobacterium avium
LEKLPVYEGAVVRGTNLPADVLE

SEQ ID NO: 99765 - protein, 29 aa, Mycobacterium avium
LEKMRYKWRKWLYFDCNWKVALEAFNETY

SEQ ID NO: 99766 - protein, 36 aa, Mycobacterium avium
LEKRREMAYEGKIDWAFAELLALGSLVAGGKLVRLS

SEQ ID NO: 99767 - protein, 18 aa, Mycobacterium avium
LELACWDLNAKLRDEPAW

SEQ ID NO: 99768 - protein, 20 aa, Mycobacterium avium
LELAWTTGLIRWEDDPQPGW

SEQ ID NO: 99769 - protein, 25 aa, Mycobacterium avium
LELGTYCGYGALRIARAAPGARVFS

SEQ ID NO: 99770 - protein, 19 aa, Mycobacterium avium
LELLAALAVKATGTEITYH

SEQ ID NO: 99771 - protein, 18 aa, Mycobacterium avium
LELLEDFQQFGYYLVHNP

SEQ ID NO: 99772 - protein, 26 aa, Mycobacterium avium
LELRIPKLRTGSCFPALLERRRRVDQ

SEQ ID NO: 99773 - protein, 26 aa, Mycobacterium avium
LELRIPKLRTGSFFPALLERRRRVDQ

SEQ ID NO: 99774 - protein, 17 aa, Mycobacterium avium
LELRRSRPYWGPRRLVF

SEQ ID NO: 99775 - protein, 22 aa, Mycobacterium avium
LELTSAAAMRAAVLAGAGPAAM

SEQ ID NO: 99776 - protein, 17 aa, Mycobacterium avium
LEMRTAVNLLLDRLPNL

SEQ ID NO: 99777 - protein, 17 aa, Mycobacterium avium
LENRLQQLDGFIGQAVE

SEQ ID NO: 99778 - protein, 17 aa, Mycobacterium avium
LEPDLDYGKVIDGAAAL

SEQ ID NO: 99779 - protein, 18 aa, Mycobacterium avium
LEPEPICVAISHVRVRVA

SEQ ID NO: 99780 - protein, 23 aa, Mycobacterium avium
LEPERRSGDVVALIGETVRRVTY

SEQ ID NO: 99781 - protein, 24 aa, Mycobacterium avium
LEPERRSGDVVALIGETVRRVTYT

SEQ ID NO: 99782 - protein, 21 aa, Mycobacterium avium
LEPGDALIVRGGWSAASDHDA

SEQ ID NO: 99783 - protein, 25 aa, Mycobacterium avium
LEPTARRILAHFGLDHHFEVIAGAS

SEQ ID NO: 99784 - protein, 22 aa, Mycobacterium avium
LEPTFRRSVIYIVEHNDGGTLG

SEQ ID NO: 99785 - protein, 24 aa, Mycobacterium avium
LEQADLLLAHLVLRPFLDAYHIVA

SEQ ID NO: 99786 - protein, 20 aa, Mycobacterium avium
LEQLSAAPLRTLDAAMSAVT

SEQ ID NO: 99787 - protein, 19 aa, Mycobacterium avium
LEQLVRVIAEIGSDLDLDV

SEQ ID NO: 99788 - protein, 26 aa, Mycobacterium avium
LEQTFMFYLPRICEHCLNPSCVASCP

SEQ ID NO: 99789 - protein, 27 aa, Mycobacterium avium
LEQTFMFYLPRICEHCLNPSCVASCPS

SEQ ID NO: 99790 - protein, 22 aa, Mycobacterium avium
LERAARDGIDWRALAEREVSLF

SEQ ID NO: 99791 - protein, 17 aa, Mycobacterium avium
LERAARDGVDWRALAER

SEQ ID NO: 99792 - protein, 17 aa, Mycobacterium avium
LERAELVIAQDAYLGTE

SEQ ID NO: 99793 - protein, 18 aa, Mycobacterium avium
LERFMLRPRHIEVQILAD

SEQ ID NO: 99794 - protein, 17 aa, Mycobacterium avium
LERLLDFMPRYDVDWAG

SEQ ID NO: 99795 - protein, 20 aa, Mycobacterium avium
LERMRRAPTVFIDAAHNPAG

SEQ ID NO: 99796 - protein, 18 aa, Mycobacterium avium
LERRAALIDPARAKPVSA

SEQ ID NO: 99797 - protein, 19 aa, Mycobacterium avium
LERRLARWMRLYPDVQAES

SEQ ID NO: 99798 - protein, 20 aa, Mycobacterium avium
LERVAALTSDRGWVMLLSRY

SEQ ID NO: 99799 - protein, 19 aa, Mycobacterium avium
LERVRVCKRDGQLLEPPHA

SEQ ID NO: 99800 - protein, 21 aa, Mycobacterium avium
LESAYRLAVINTFGGGANELQ

SEQ ID NO: 99801 - protein, 19 aa, Mycobacterium avium
LESEGGFDPVRRRIFQLEI

SEQ ID NO: 99802 - protein, 21 aa, Mycobacterium avium
LESEIRMLRECTAEIQHAVLT

SEQ ID NO: 99803 - protein, 19 aa, Mycobacterium avium
LESGCYARIRPGAAPDVTR

SEQ ID NO: 99804 - protein, 21 aa, Mycobacterium avium
LESGLPLPTLLVAATAATVTR

SEQ ID NO: 99805 - protein, 31 aa, Mycobacterium avium
LESLRRLRGLGRRAVLPGHGPDLIDLESVAQ

SEQ ID NO: 99806 - protein, 31 aa, Mycobacterium avium
LESPETYFQAAFRIQSPWSIRNPNGDNPNEE

SEQ ID NO: 99807 - protein, 25 aa, Mycobacterium avium
LESPEVYQFVVLFPSPEQASAFLSA

SEQ ID NO: 99808 - protein, 19 aa, Mycobacterium avium
LESRIALERLLDFMPRYDV

SEQ ID NO: 99809 - protein, 20 aa, Mycobacterium avium
LESWLLPSLGLRATVFHFNP

SEQ ID NO: 99810 - protein, 22 aa, Mycobacterium avium
LETRLRIGPKVAELAAEQHGPE

SEQ ID NO: 99811 - protein, 17 aa, Mycobacterium avium
LETRPFAGISVDDLAKG

SEQ ID NO: 99812 - protein, 19 aa, Mycobacterium avium
LEVAIRCMIEEPFSGFHGE

SEQ ID NO: 99813 - protein, 17 aa, Mycobacterium avium
LEVAIRCMVEEPFSGFH

SEQ ID NO: 99814 - protein, 23 aa, Mycobacterium avium
LEVDRDCFARIAPGLPSNVIRIA

SEQ ID NO: 99815 - protein, 20 aa, Mycobacterium avium
LEVFAGLPQLAGRPAAEDQN

SEQ ID NO: 99816 - protein, 21 aa, Mycobacterium avium
LEVFDEADLDAAIARFDELTR

SEQ ID NO: 99817 - protein, 17 aa, Mycobacterium avium
LEVGCRLIDTAAAYGNE

SEQ ID NO: 99818 - protein, 21 aa, Mycobacterium avium
LEVLFPGCEFLPLNDERRRIV

SEQ ID NO: 99819 - protein, 24 aa, Mycobacterium avium
LEVRRGTTAGVRWTFTAFTGEVPF

SEQ ID NO: 99820 - protein, 17 aa, Mycobacterium avium
LEYRFSQDWPEYPFRHG

SEQ ID NO: 99821 - protein, 20 aa, Mycobacterium avium
LFAFGTRLDPRFGSDSSARH

SEQ ID NO: 99822 - protein, 22 aa, Mycobacterium avium
LFAFGTRLDPRFGSDSSARHRS

SEQ ID NO: 99823 - protein, 23 aa, Mycobacterium avium
LFAFGTRLDPRFGSDSSARHRSS

SEQ ID NO: 99824 - protein, 20 aa, Mycobacterium avium
LFAGQPGFAKAFAREGRAPR

SEQ ID NO: 99825 - protein, 19 aa, Mycobacterium avium
LFAKTLKWASTTPLDDGMV

SEQ ID NO: 99826 - protein, 19 aa, Mycobacterium avium
LFAQLPFYDVVDTDDSVVV

SEQ ID NO: 99827 - protein, 24 aa, Mycobacterium avium
LFDGSDTVTLVWLGQRRIPGIDSG

SEQ ID NO: 99828 - protein, 18 aa, Mycobacterium avium
LFDPNRLAALWGPTVHLV

SEQ ID NO: 99829 - protein, 18 aa, Mycobacterium avium
LFDRTGLFDDVRARRDLT

SEQ ID NO: 99830 - protein, 19 aa, Mycobacterium avium
LFEAARLAAGVIGYTGAGT

SEQ ID NO: 99831 - protein, 24 aa, Mycobacterium avium
LFGEPSSGFSTMLWGGQPLPTINP

SEQ ID NO: 99832 - protein, 19 aa, Mycobacterium avium
LFGLFSRSQVFPIRQFADG

SEQ ID NO: 99833 - protein, 24 aa, Mycobacterium avium
LFGTADSWVLWQLTGGPRGGVHAT

SEQ ID NO: 99834 - protein, 20 aa, Mycobacterium avium
LFGTAISRPVIPFFVNAIGV

SEQ ID NO: 99835 - protein, 21 aa, Mycobacterium avium
LFGTAISRPVIPVFVNAIGVP

SEQ ID NO: 99836 - protein, 18 aa, Mycobacterium avium
LFHIRAESLDVCFELADR

SEQ ID NO: 99837 - protein, 18 aa, Mycobacterium avium
LFHQWGRPKPTKLIAKVR

SEQ ID NO: 99838 - protein, 17 aa, Mycobacterium avium
LFHRSTLAFQELAGEAT

SEQ ID NO: 99839 - protein, 20 aa, Mycobacterium avium
LFKRYTCALDYARADRDELE

SEQ ID NO: 99840 - protein, 17 aa, Mycobacterium avium
LFLPAAGVSNWLVDTGI

SEQ ID NO: 99841 - protein, 17 aa, Mycobacterium avium
LFNDLTVYFALTVRGRL

SEQ ID NO: 99842 - protein, 19 aa, Mycobacterium avium
LFRELAFRVVNRFEEDAGL

SEQ ID NO: 99843 - protein, 23 aa, Mycobacterium avium
LFRESYRAFLDRHVAPYHDEWEK

SEQ ID NO: 99844 - protein, 17 aa, Mycobacterium avium
LFRPRGNLSQALDAALS

SEQ ID NO: 99845 - protein, 17 aa, Mycobacterium avium
LFRRYAANTSRDLSHIA

SEQ ID NO: 99846 - protein, 18 aa, Mycobacterium avium
LFRRYAANTSRDLSHIAW

SEQ ID NO: 99847 - protein, 20 aa, Mycobacterium avium
LFRYFSGKDEILFARDYDLS

SEQ ID NO: 99848 - protein, 24 aa, Mycobacterium avium
LFSGKLMQFPGLKLAFAEAQAGWI

SEQ ID NO: 99849 - protein, 18 aa, Mycobacterium avium
LFSSMGLAGMLGSAVGSG

SEQ ID NO: 99850 - protein, 19 aa, Mycobacterium avium
LFSSMGLAGMLGSAVGSGG

SEQ ID NO: 99851 - protein, 21 aa, Mycobacterium avium
LFTDFAPRLLVTHPAEVKVAH

SEQ ID NO: 99852 - protein, 25 aa, Mycobacterium avium
LFTKRPLMAEAMLRVFFEAYEIVAD

SEQ ID NO: 99853 - protein, 20 aa, Mycobacterium avium
LFTRDGWMRMGDICEIDADG

SEQ ID NO: 99854 - protein, 26 aa, Mycobacterium avium
LFVAFAARLAHRMGRVLADGKSVTVV

SEQ ID NO: 99855 - protein, 24 aa, Mycobacterium avium
LFWMVRKRPALQIHLLKSNLRLLP

SEQ ID NO: 99856 - protein, 23 aa, Mycobacterium avium
LFWVSDYGVRFGIANDESTLRAL

SEQ ID NO: 99857 - protein, 17 aa, Mycobacterium avium
LFYPEFSLWCGTTKTAD

SEQ ID NO: 99858 - protein, 19 aa, Mycobacterium avium
LGAAFAKVMRAEGAGQVVI

SEQ ID NO: 99859 - protein, 19 aa, Mycobacterium avium
LGADFFVFSGHKIYGPTGI

SEQ ID NO: 99860 - protein, 27 aa, Mycobacterium avium
LGAESLLALPRWLAESVRVPRGSVAVL

SEQ ID NO: 99861 - protein, 18 aa, Mycobacterium avium
LGAESLLAMPRWLAESVR

SEQ ID NO: 99862 - protein, 18 aa, Mycobacterium avium
LGAESLLAMPRWLAESVW

SEQ ID NO: 99863 - protein, 18 aa, Mycobacterium avium
LGAFAVWLRDFLDELGVS

SEQ ID NO: 99864 - protein, 26 aa, Mycobacterium avium
LGAGLARYACGLGMTVVLADIDGDAV

SEQ ID NO: 99865 - protein, 24 aa, Mycobacterium avium
LGAGWACGVTVVLTAPGTVGAVDC

SEQ ID NO: 99866 - protein, 30 aa, Mycobacterium avium
LGAIGGRLVELCAPFGMEVLVFDPYLDETT

SEQ ID NO: 99867 - protein, 21 aa, Mycobacterium avium
LGAKIAFFFTRRKLAQMTGLE

SEQ ID NO: 99868 - protein, 26 aa, Mycobacterium avium
LGALLRRLQPDWSMTFVERLDAVGAE

SEQ ID NO: 99869 - protein, 20 aa, Mycobacterium avium
LGANLARREIRVVFDELRHE

SEQ ID NO: 99870 - protein, 23 aa, Mycobacterium avium
LGAQGCLQRLWWLHSGPGDPRVL

SEQ ID NO: 99871 - protein, 25 aa, Mycobacterium avium
LGAQMPMKVISMLLGIPEDDQEYIR

SEQ ID NO: 99872 - protein, 24 aa, Mycobacterium avium
LGARGGGLGGPGHRAVRRGDGSPA

SEQ ID NO: 99873 - protein, 17 aa, Mycobacterium avium
LGARLLSRHELRSRYVA

SEQ ID NO: 99874 - protein, 19 aa, Mycobacterium avium
LGATGWRLDDGELDLQVRG

SEQ ID NO: 99875 - protein, 23 aa, Mycobacterium avium
LGATRPFGGIGISGMGKEGGRQG

SEQ ID NO: 99876 - protein, 22 aa, Mycobacterium avium
LGAVLQRLAGYQARSVDIDGCT

SEQ ID NO: 99877 - protein, 24 aa, Mycobacterium avium
LGAWPQLAGKPDALAVLAQKIADG

SEQ ID NO: 99878 - protein, 23 aa, Mycobacterium avium
LGCRCGRADCAAGTGPAAGPVVI

SEQ ID NO: 99879 - protein, 19 aa, Mycobacterium avium
LGDAAARYIDWLDGNAARG

SEQ ID NO: 99880 - protein, 23 aa, Mycobacterium avium
LGDAAARYIDWLGGNAARGEQAA

SEQ ID NO: 99881 - protein, 17 aa, Mycobacterium avium
LGDATTITWRQYRDRVR

SEQ ID NO: 99882 - protein, 20 aa, Mycobacterium avium
LGDDLPVEWKHRSERYTEKL

SEQ ID NO: 99883 - protein, 17 aa, Mycobacterium avium
LGDGRALLLGELVDNKG

SEQ ID NO: 99884 - protein, 17 aa, Mycobacterium avium
LGDKVARRVLESGQREE

SEQ ID NO: 99885 - protein, 19 aa, Mycobacterium avium
LGDLTGRRVIVTGATNGVG

SEQ ID NO: 99886 - protein, 18 aa, Mycobacterium avium
LGDMVAELIELSRLQGAE

SEQ ID NO: 99887 - protein, 22 aa, Mycobacterium avium
LGDQRFPYVFLDATYCKARVNH

SEQ ID NO: 99888 - protein, 17 aa, Mycobacterium avium
LGEAAAFIHHLPVDQSF

SEQ ID NO: 99889 - protein, 23 aa, Mycobacterium avium
LGEAVCASGRVLSVDTSRASTRA

SEQ ID NO: 99890 - protein, 22 aa, Mycobacterium avium
LGEDRPSLHGTLGHLEGIQQAL

SEQ ID NO: 99891 - protein, 24 aa, Mycobacterium avium
LGEGFHCIAPTWPLGAHSTPTGGA

SEQ ID NO: 99892 - protein, 17 aa, Mycobacterium avium
LGEGLLILPERDSASLA

SEQ ID NO: 99893 - protein, 22 aa, Mycobacterium avium
LGEMCGLAGVAMERATQALLQA

SEQ ID NO: 99894 - protein, 22 aa, Mycobacterium avium
LGEPEYLTGNFITAVKSLPYTL

SEQ ID NO: 99895 - protein, 22 aa, Mycobacterium avium
LGEPRDIAAITAFLLSDEAEWI

SEQ ID NO: 99896 - protein, 17 aa, Mycobacterium avium
LGESWRDGGELLALAAK

SEQ ID NO: 99897 - protein, 20 aa, Mycobacterium avium
LGFAGAHPMTRRLADAAAAQ

SEQ ID NO: 99898 - protein, 24 aa, Mycobacterium avium
LGFDRLVFHPCVPDTGQVDRLANA

SEQ ID NO: 99899 - protein, 17 aa, Mycobacterium avium
LGFGDRLGICYVHTHVS

SEQ ID NO: 99900 - protein, 20 aa, Mycobacterium avium
LGFVPAPCRVVYVVDEPDIR

SEQ ID NO: 99901 - protein, 24 aa, Mycobacterium avium
LGGAALRPAPVGAYPAGASACGAE

SEQ ID NO: 99902 - protein, 17 aa, Mycobacterium avium
LGGAGFDATALGVVAHE

SEQ ID NO: 99903 - protein, 26 aa, Mycobacterium avium
LGGCEAYPGVFAPFGGYPDGCVVSSG

SEQ ID NO: 99904 - protein, 24 aa, Mycobacterium avium
LGGDFGGVWYWNRYPGIQCDNESY

SEQ ID NO: 99905 - protein, 30 aa, Mycobacterium avium
LGGDKDFWLQVGIDPIRIITGSGTFYTLRC

SEQ ID NO: 99906 - protein, 24 aa, Mycobacterium avium
LGGERAGDILAHYAASGLSAYEAL

SEQ ID NO: 99907 - protein, 19 aa, Mycobacterium avium
LGGGAYFIHFAWDSSDPEQ

SEQ ID NO: 99908 - protein, 24 aa, Mycobacterium avium
LGGLKVTTANAWFAARPSGTEDVY

SEQ ID NO: 99909 - protein, 18 aa, Mycobacterium avium
LGGMSLWLAPTSAFTASP

SEQ ID NO: 99910 - protein, 19 aa, Mycobacterium avium
LGGNRPRWLGADIGQRQFY

SEQ ID NO: 99911 - protein, 25 aa, Mycobacterium avium
LGGPGSWLLALPAHHIAGVQVLVRS

SEQ ID NO: 99912 - protein, 18 aa, Mycobacterium avium
LGGPQRRTLFLLSSTDAY

SEQ ID NO: 99913 - protein, 17 aa, Mycobacterium avium
LGGPVGRAHPGRWFGGL

SEQ ID NO: 99914 - protein, 18 aa, Mycobacterium avium
LGGRRRARGRRRARGRRR

SEQ ID NO: 99915 - protein, 25 aa, Mycobacterium avium
LGGVAAHCYFEFELADFDRPRFDSA

SEQ ID NO: 99916 - protein, 17 aa, Mycobacterium avium
LGGVLGIISGAERVEPA

SEQ ID NO: 99917 - protein, 24 aa, Mycobacterium avium
LGGVLRCAVTVFGAELGGGQGAGV

SEQ ID NO: 99918 - protein, 18 aa, Mycobacterium avium
LGGVVPGFQKAIAGQKVG

SEQ ID NO: 99919 - protein, 27 aa, Mycobacterium avium
LGGYQAWQLGGTYQRGGKTRVIAQKTV

SEQ ID NO: 99920 - protein, 28 aa, Mycobacterium avium
LGGYQAWQLGGTYQRGGKTRVIAQKTVV

SEQ ID NO: 99921 - protein, 20 aa, Mycobacterium avium
LGHRRRSRWTAVGHTPAGPA

SEQ ID NO: 99922 - protein, 18 aa, Mycobacterium avium
LGICIDLFHCWAEGDFEA

SEQ ID NO: 99923 - protein, 19 aa, Mycobacterium avium
LGICIDLFHCWAEGDFEAQ

SEQ ID NO: 99924 - protein, 37 aa, Mycobacterium avium
LGIKLPTQLPMMLSFLDFRKIPLNGLWAETKFGTYGD

SEQ ID NO: 99925 - protein, 19 aa, Mycobacterium avium
LGILERFDMASLPVDSADS

SEQ ID NO: 99926 - protein, 17 aa, Mycobacterium avium
LGILIERAAKLQLAAMA

SEQ ID NO: 99927 - protein, 19 aa, Mycobacterium avium
LGIREWDAVSLIGSRTTAA

SEQ ID NO: 99928 - protein, 21 aa, Mycobacterium avium
LGITTDWKSRWYADKQYADYV

SEQ ID NO: 99929 - protein, 24 aa, Mycobacterium avium
LGKIPAGGGWRMLGRTVGNRNAQA

SEQ ID NO: 99930 - protein, 18 aa, Mycobacterium avium
LGKRLMQTAGVDRLSALY

SEQ ID NO: 99931 - protein, 17 aa, Mycobacterium avium
LGLAAWNLSPDVAVSQI

SEQ ID NO: 99932 - protein, 19 aa, Mycobacterium avium
LGLACDFGERVDLGGASSA

SEQ ID NO: 99933 - protein, 29 aa, Mycobacterium avium
LGLAQAPRVDSYGGFVFASLAPDGISLTE

SEQ ID NO: 99934 - protein, 18 aa, Mycobacterium avium
LGLEAAYCAETVAITYEE

SEQ ID NO: 99935 - protein, 17 aa, Mycobacterium avium
LGLFLAGEMACRDGDVG

SEQ ID NO: 99936 - protein, 19 aa, Mycobacterium avium
LGLFLSLPGVSQWRTLRRV

SEQ ID NO: 99937 - protein, 19 aa, Mycobacterium avium
LGLFPFRRNLSLFAVDLAL

SEQ ID NO: 99938 - protein, 28 aa, Mycobacterium avium
LGLGLYPGFVGESLAPILSRLTERTNRI

SEQ ID NO: 99939 - protein, 18 aa, Mycobacterium avium
LGLGRVWSQCHSLAFDFS

SEQ ID NO: 99940 - protein, 23 aa, Mycobacterium avium
LGLHIRSVEGFREVVTTPRALTV

SEQ ID NO: 99941 - protein, 19 aa, Mycobacterium avium
LGLLFGRPKSNLTFAQNDA

SEQ ID NO: 99942 - protein, 26 aa, Mycobacterium avium
LGLPADWEPLGAIAIGYAAEPAGPRG

SEQ ID NO: 99943 - protein, 17 aa, Mycobacterium avium
LGLQGIVVPERWGGAGA

SEQ ID NO: 99944 - protein, 25 aa, Mycobacterium avium
LGLQIRLDWDRGFELIAPTAAAPTD

SEQ ID NO: 99945 - protein, 19 aa, Mycobacterium avium
LGLRPRWIDSTAVGGASWE

SEQ ID NO: 99946 - protein, 18 aa, Mycobacterium avium
LGLTGRRWAFGRSTTSQQ

SEQ ID NO: 99947 - protein, 25 aa, Mycobacterium avium
LGMGAIKPRLVAVGTEVVVRPTMSL

SEQ ID NO: 99948 - protein, 29 aa, Mycobacterium avium
LGMVRCVRAALPLLRKAQWARIVTFSAHS

SEQ ID NO: 99949 - protein, 19 aa, Mycobacterium avium
LGNARRALVESLCYARQRR

SEQ ID NO: 99950 - protein, 22 aa, Mycobacterium avium
LGNPALRRAAVRLDATPAQIAL

SEQ ID NO: 99951 - protein, 18 aa, Mycobacterium avium
LGNPRMSDQLSRLARRGS

SEQ ID NO: 99952 - protein, 20 aa, Mycobacterium avium
LGNYLPRYLRGICDDADSLA

SEQ ID NO: 99953 - protein, 19 aa, Mycobacterium avium
LGPALAAGCTVVLKPAPDA

SEQ ID NO: 99954 - protein, 19 aa, Mycobacterium avium
LGPALLKFAPGLAAAYLPG

SEQ ID NO: 99955 - protein, 25 aa, Mycobacterium avium
LGPEPSDLVLSRWHGVGPMGGTDLD

SEQ ID NO: 99956 - protein, 17 aa, Mycobacterium avium
LGPRYAVANPLNIHLSG

SEQ ID NO: 99957 - protein, 23 aa, Mycobacterium avium
LGPSGKRPGAIAERVKKTWDLGE

SEQ ID NO: 99958 - protein, 23 aa, Mycobacterium avium
LGPSGKRPGAIAERVKKTWELGE

SEQ ID NO: 99959 - protein, 24 aa, Mycobacterium avium
LGPSGMVTLDAWFKSKQVADSANE

SEQ ID NO: 99960 - protein, 18 aa, Mycobacterium avium
LGQLPVTFAPGKSRKTLL

SEQ ID NO: 99961 - protein, 20 aa, Mycobacterium avium
LGQRLPAYMVPAAVVVLDAL

SEQ ID NO: 99962 - protein, 22 aa, Mycobacterium avium
LGRAEAELGAFLRTVDRDSVTI

SEQ ID NO: 99963 - protein, 23 aa, Mycobacterium avium
LGRAEAELGTFLRTVDRDSVTIA

SEQ ID NO: 99964 - protein, 26 aa, Mycobacterium avium
LGRAYLDFGEPLPLRKRLEELRAEES

SEQ ID NO: 99965 - protein, 21 aa, Mycobacterium avium
LGRDDVCYVSMPLFHSNAVLV

SEQ ID NO: 99966 - protein, 19 aa, Mycobacterium avium
LGRDDWAVHVALWEAGELV

SEQ ID NO: 99967 - protein, 24 aa, Mycobacterium avium
LGREPRGVLAIAYRCPNGEPGVVK

SEQ ID NO: 99968 - protein, 17 aa, Mycobacterium avium
LGRHFPFDPSQATIPEP

SEQ ID NO: 99969 - protein, 17 aa, Mycobacterium avium
LGRIPHMVHLYRYRDML

SEQ ID NO: 99970 - protein, 19 aa, Mycobacterium avium
LGRIYGRMPGVADVPVSGT

SEQ ID NO: 99971 - protein, 24 aa, Mycobacterium avium
LGRLEDGRHVWAIRGALQAPDDPE

SEQ ID NO: 99972 - protein, 18 aa, Mycobacterium avium
LGRRGMKIAVLDVNEHAA

SEQ ID NO: 99973 - protein, 19 aa, Mycobacterium avium
LGSALARLEGRVALEEILK

SEQ ID NO: 99974 - protein, 25 aa, Mycobacterium avium
LGSAQPRPRCPATRRAEEQLVAVAG

SEQ ID NO: 99975 - protein, 17 aa, Mycobacterium avium
LGSDVPFALHGGTALGT

SEQ ID NO: 99976 - protein, 17 aa, Mycobacterium avium
LGSIRALLEKAVEQGAV

SEQ ID NO: 99977 - protein, 18 aa, Mycobacterium avium
LGSMHIELAPPKGEPPVG

SEQ ID NO: 99978 - protein, 18 aa, Mycobacterium avium
LGSWRPGLSYRQLARELT

SEQ ID NO: 99979 - protein, 25 aa, Mycobacterium avium
LGTAAGYLKPEFKALGIDFDNRGAL

SEQ ID NO: 99980 - protein, 26 aa, Mycobacterium avium
LGTANFRAGPVLAFLSGNLCYQIEHH

SEQ ID NO: 99981 - protein, 25 aa, Mycobacterium avium
LGTPDEFADAAAFLLTNGYINGEVM

SEQ ID NO: 99982 - protein, 18 aa, Mycobacterium avium
LGTTRWLVAILENHQQPD

SEQ ID NO: 99983 - protein, 18 aa, Mycobacterium avium
LGTTRWLVAILENHQRPD

SEQ ID NO: 99984 - protein, 21 aa, Mycobacterium avium
LGTTVEWYDFFLYATAAGLVF

SEQ ID NO: 99985 - protein, 31 aa, Mycobacterium avium
LGVDHLRKVAAWARDRGCLVASDECYLGLGW

SEQ ID NO: 99986 - protein, 25 aa, Mycobacterium avium
LGVKDFRFNQIISEEMFMTGSVGIG

SEQ ID NO: 99987 - protein, 26 aa, Mycobacterium avium
LGVKDFRFNQIVSEEMFLTGSVGIGL

SEQ ID NO: 99988 - protein, 21 aa, Mycobacterium avium
LGVLSRYGVAMFHGGTGSLPK

SEQ ID NO: 99989 - protein, 24 aa, Mycobacterium avium
LGVPYTAIMTPVFDVHRSPDGDLL

SEQ ID NO: 99990 - protein, 17 aa, Mycobacterium avium
LGVQLHRQATGAGVGVH

SEQ ID NO: 99991 - protein, 24 aa, Mycobacterium avium
LGVQRVGIQRALRGHRGHHVQDLS

SEQ ID NO: 99992 - protein, 27 aa, Mycobacterium avium
LGVTPAQVGLAWILARTPHTLLIPGTR

SEQ ID NO: 99993 - protein, 30 aa, Mycobacterium avium
LGYPRGNLAFRWFLADGVPARPEVELVKAA

SEQ ID NO: 99994 - protein, 30 aa, Mycobacterium avium
LGYPRGNLAFRWFLADGVPARPEVELVKAS

SEQ ID NO: 99995 - protein, 24 aa, Mycobacterium avium
LHAAASRWHGFAAAMNGVQGTLNA

SEQ ID NO: 99996 - protein, 22 aa, Mycobacterium avium
LHAIIKALRTAAVNDTKDALGQ

SEQ ID NO: 99997 - protein, 20 aa, Mycobacterium avium
LHALGSQWVLVKGGHLRSSQ

SEQ ID NO: 99998 - protein, 20 aa, Mycobacterium avium
LHAPAAATFADFCRHVDQRS

SEQ ID NO: 99999 - protein, 19 aa, Mycobacterium avium
LHAYFKARDWDAITDLLTD

SEQ ID NO: 100000 - protein, 17 aa, Mycobacterium avium
LHEFAFARSSMKRWDTE

SEQ ID NO: 100001 - protein, 28 aa, Mycobacterium avium
LHEYHRQWEPKIPLGRMGRPDELAGIYL

SEQ ID NO: 100002 - protein, 18 aa, Mycobacterium avium
LHFDDIRKLLKVINGLVD

SEQ ID NO: 100003 - protein, 18 aa, Mycobacterium avium
LHFMPGWLEMLVEVGRGR

SEQ ID NO: 100004 - protein, 18 aa, Mycobacterium avium
LHGCGVADLAGLRAVELI

SEQ ID NO: 100005 - protein, 17 aa, Mycobacterium avium
LHGGYGYMREYPVARAY

SEQ ID NO: 100006 - protein, 18 aa, Mycobacterium avium
LHGGYGYMREYPVARAYL

SEQ ID NO: 100007 - protein, 24 aa, Mycobacterium avium
LHGLAEMPWRLSIFGDGPDRQRLE

SEQ ID NO: 100008 - protein, 18 aa, Mycobacterium avium
LHGMGFLHEACVQLWGEG

SEQ ID NO: 100009 - protein, 18 aa, Mycobacterium avium
LHGMGFLHEACVQMWGEG

SEQ ID NO: 100010 - protein, 17 aa, Mycobacterium avium
LHGPHHYNVNLLVGTLK

SEQ ID NO: 100011 - protein, 19 aa, Mycobacterium avium
LHHALALAGRHLRRHPNAL

SEQ ID NO: 100012 - protein, 17 aa, Mycobacterium avium
LHHREPGPALALLRDPR

SEQ ID NO: 100013 - protein, 18 aa, Mycobacterium avium
LHIPRTTWYDDVRFEEVS

SEQ ID NO: 100014 - protein, 19 aa, Mycobacterium avium
LHKEDVWAEMVHRLQNQAK

SEQ ID NO: 100015 - protein, 23 aa, Mycobacterium avium
LHLTLKHIHWNVVGPNFIGVHEM

SEQ ID NO: 100016 - protein, 20 aa, Mycobacterium avium
LHLYWRRAISLAASIGPANR

SEQ ID NO: 100017 - protein, 19 aa, Mycobacterium avium
LHNSKPWRWVAGSTGVDLF

SEQ ID NO: 100018 - protein, 21 aa, Mycobacterium avium
LHPGPGRFQFGDELGRARRVR

SEQ ID NO: 100019 - protein, 21 aa, Mycobacterium avium
LHRHRCSSAGWAKEVADELLP

SEQ ID NO: 100020 - protein, 22 aa, Mycobacterium avium
LHRLPLAIARLRRARRRTAPLF

SEQ ID NO: 100021 - protein, 19 aa, Mycobacterium avium
LHRLSRPEVTIALGDGVGG

SEQ ID NO: 100022 - protein, 20 aa, Mycobacterium avium
LHRRGVEVVEIIGDDAQDAR

SEQ ID NO: 100023 - protein, 32 aa, Mycobacterium avium
LHRRMGAADVLLRCPRCHSHFDVVHAGAGIDV

SEQ ID NO: 100024 - protein, 17 aa, Mycobacterium avium
LHRRWDALWDKLIAACH

SEQ ID NO: 100025 - protein, 18 aa, Mycobacterium avium
LHRSRSALDAALDPILAA

SEQ ID NO: 100026 - protein, 18 aa, Mycobacterium avium
LHSRLAMEAAEQGASRGV

SEQ ID NO: 100027 - protein, 19 aa, Mycobacterium avium
LHTGHIRLLRQARELGDAL

SEQ ID NO: 100028 - protein, 18 aa, Mycobacterium avium
LHTLRADIDYGLYEAKTT

SEQ ID NO: 100029 - protein, 23 aa, Mycobacterium avium
LHTLRADIGYGLYEAKTTFGRIG

SEQ ID NO: 100030 - protein, 17 aa, Mycobacterium avium
LHVLSHRLAGAAAEGET

SEQ ID NO: 100031 - protein, 17 aa, Mycobacterium avium
LHYERFSPAPVVDGVPF

SEQ ID NO: 100032 - protein, 17 aa, Mycobacterium avium
LIAALTPVFATKTKLEW

SEQ ID NO: 100033 - protein, 17 aa, Mycobacterium avium
LIAEARKGLPPNPDATS

SEQ ID NO: 100034 - protein, 24 aa, Mycobacterium avium
LIARCPCLLAVCSAGAGYDVIDVD

SEQ ID NO: 100035 - protein, 20 aa, Mycobacterium avium
LIARRVREARVFSEVIPHTA

SEQ ID NO: 100036 - protein, 23 aa, Mycobacterium avium
LIASGAPVAAHWTADRQVAPGLL

SEQ ID NO: 100037 - protein, 19 aa, Mycobacterium avium
LIDCANAYCTVGEMVSALK

SEQ ID NO: 100038 - protein, 18 aa, Mycobacterium avium
LIDRGPRVGTHVAQRKYD

SEQ ID NO: 100039 - protein, 19 aa, Mycobacterium avium
LIDRGPRVGTHVAQRKYDH

SEQ ID NO: 100040 - protein, 17 aa, Mycobacterium avium
LIEKIQGGFLDFDAAIA

SEQ ID NO: 100041 - protein, 23 aa, Mycobacterium avium
LIELPDAHWRLVLTAHHIVIDGW

SEQ ID NO: 100042 - protein, 17 aa, Mycobacterium avium
LIEVLRRRGRILQSAPD

SEQ ID NO: 100043 - protein, 26 aa, Mycobacterium avium
LIEVMGRTGFDFVWLDSEHCDINPRA

SEQ ID NO: 100044 - protein, 18 aa, Mycobacterium avium
LIHPISYAPWAFRRDFNE

SEQ ID NO: 100045 - protein, 28 aa, Mycobacterium avium
LIHPPAPVCRYCRSRDIGVRAVSGKATL

SEQ ID NO: 100046 - protein, 17 aa, Mycobacterium avium
LILRALQMQLGRGGTIV

SEQ ID NO: 100047 - protein, 25 aa, Mycobacterium avium
LINSGFTRRRVSVLEPKIRKIVRGI

SEQ ID NO: 100048 - protein, 19 aa, Mycobacterium avium
LIQRGTLRVGDSIVAGDAY

SEQ ID NO: 100049 - protein, 25 aa, Mycobacterium avium
LIRERPRITAALDKLRVFSNTATQL

SEQ ID NO: 100050 - protein, 17 aa, Mycobacterium avium
LIRRSDVFVDSWAPGVA

SEQ ID NO: 100051 - protein, 23 aa, Mycobacterium avium
LIRTGPDRHRLVLTIHHIVLDGW

SEQ ID NO: 100052 - protein, 18 aa, Mycobacterium avium
LKAAAGVVNACRKCGALI

SEQ ID NO: 100053 - protein, 17 aa, Mycobacterium avium
LKAAAIISGVAQAIVTS

SEQ ID NO: 100054 - protein, 17 aa, Mycobacterium avium
LKAGIADPVKVTRSALQ

SEQ ID NO: 100055 - protein, 19 aa, Mycobacterium avium
LKALQDWTARLFEAGYVGA

SEQ ID NO: 100056 - protein, 26 aa, Mycobacterium avium
LKARAEALSRAFLDQGITFSLSGQER

SEQ ID NO: 100057 - protein, 22 aa, Mycobacterium avium
LKDGDAIAGAFGYWRESGQFVL

SEQ ID NO: 100058 - protein, 17 aa, Mycobacterium avium
LKDRPMLGISVLGEEHD

SEQ ID NO: 100059 - protein, 17 aa, Mycobacterium avium
LKDVAGLSLTKLFVGSE

SEQ ID NO: 100060 - protein, 18 aa, Mycobacterium avium
LKEATDFYTRIAGDRSRG

SEQ ID NO: 100061 - protein, 24 aa, Mycobacterium avium
LKGGPYMFAEKFFPSGEGALSIDS

SEQ ID NO: 100062 - protein, 18 aa, Mycobacterium avium
LKGLCPFHDEKSPSFHVR

SEQ ID NO: 100063 - protein, 19 aa, Mycobacterium avium
LKGLVDVGTHNAYHANEVN

SEQ ID NO: 100064 - protein, 22 aa, Mycobacterium avium
LKHELTPIICIGEHLEVREAGN

SEQ ID NO: 100065 - protein, 20 aa, Mycobacterium avium
LKIALSEGGTGWIPYFLERA

SEQ ID NO: 100066 - protein, 24 aa, Mycobacterium avium
LKISSWHCDVWKPVIAAVNGVCAG

SEQ ID NO: 100067 - protein, 21 aa, Mycobacterium avium
LKLAEVCLRVGVSTGSFYHFF

SEQ ID NO: 100068 - protein, 19 aa, Mycobacterium avium
LKLFGELEIPAAPLNSPGA

SEQ ID NO: 100069 - protein, 17 aa, Mycobacterium avium
LKLPEAVRHSHDLSSLQ

SEQ ID NO: 100070 - protein, 19 aa, Mycobacterium avium
LKLRGEGMVQLEPHRGHVV

SEQ ID NO: 100071 - protein, 17 aa, Mycobacterium avium
LKLWKALLETGAVEMAV

SEQ ID NO: 100072 - protein, 17 aa, Mycobacterium avium
LKMGCPLSTEQVPLIMG

SEQ ID NO: 100073 - protein, 18 aa, Mycobacterium avium
LKNLPFPMLSDIKRELSL

SEQ ID NO: 100074 - protein, 21 aa, Mycobacterium avium
LKNRGGPILLRHSPSNRGTSN

SEQ ID NO: 100075 - protein, 20 aa, Mycobacterium avium
LKPAELAAVVSSVLYESRGG

SEQ ID NO: 100076 - protein, 21 aa, Mycobacterium avium
LKPAPATVVGVDWRTALADAA

SEQ ID NO: 100077 - protein, 24 aa, Mycobacterium avium
LKPAPDAPLEFGVLMEAIEEAGLP

SEQ ID NO: 100078 - protein, 20 aa, Mycobacterium avium
LKPAPDAPLEFGVLTEAIEQ

SEQ ID NO: 100079 - protein, 18 aa, Mycobacterium avium
LKPDRLALRELITQRDRD

SEQ ID NO: 100080 - protein, 22 aa, Mycobacterium avium
LKPFMEHSAHWFLDQQITTGQM

SEQ ID NO: 100081 - protein, 21 aa, Mycobacterium avium
LKPFMEQSAHWFLDQQITTGQ

SEQ ID NO: 100082 - protein, 21 aa, Mycobacterium avium
LKPPPLHPIPILIGSSGEKKT

SEQ ID NO: 100083 - protein, 19 aa, Mycobacterium avium
LKPSRGLAPYGPQTGELML

SEQ ID NO: 100084 - protein, 18 aa, Mycobacterium avium
LKQHGSLVAHGRLINPHP

SEQ ID NO: 100085 - protein, 17 aa, Mycobacterium avium
LKRAERLGAARVEVSEE

SEQ ID NO: 100086 - protein, 18 aa, Mycobacterium avium
LKRLDAYVSSADRTKADN

SEQ ID NO: 100087 - protein, 20 aa, Mycobacterium avium
LKRLFVLTFETEFFGKHGFT

SEQ ID NO: 100088 - protein, 22 aa, Mycobacterium avium
LKRLGLCPPDVTPHPVVADGAP

SEQ ID NO: 100089 - protein, 23 aa, Mycobacterium avium
LKRTGRLSLRHALDMLEQTGRAL

SEQ ID NO: 100090 - protein, 28 aa, Mycobacterium avium
LKSATTVRCEYCIDLGSQIARQWGITDE

SEQ ID NO: 100091 - protein, 19 aa, Mycobacterium avium
LKSVYLCCRAALRHMVSAR

SEQ ID NO: 100092 - protein, 19 aa, Mycobacterium avium
LKTPLVLDLSRLRFISVES

SEQ ID NO: 100093 - protein, 18 aa, Mycobacterium avium
LKTSAVRTPSGYRLDGVK

SEQ ID NO: 100094 - protein, 18 aa, Mycobacterium avium
LKVGTSRRFSATTPETLV

SEQ ID NO: 100095 - protein, 21 aa, Mycobacterium avium
LKVLISEGGATWVPFLGDRML

SEQ ID NO: 100096 - protein, 22 aa, Mycobacterium avium
LKVTHPAAIVWAAQMGTVTLHP

SEQ ID NO: 100097 - protein, 24 aa, Mycobacterium avium
LKYPARLIDEYAWETDLGDKVISL

SEQ ID NO: 100098 - protein, 17 aa, Mycobacterium avium
LLAAFGAGAQAAGRDVA

SEQ ID NO: 100099 - protein, 18 aa, Mycobacterium avium
LLAAGGEHIEWVDSERPA

SEQ ID NO: 100100 - protein, 18 aa, Mycobacterium avium
LLAEALGFDAFRQRVKIY

SEQ ID NO: 100101 - protein, 24 aa, Mycobacterium avium
LLAEPRGYCAGVDRAVETVERALE

SEQ ID NO: 100102 - protein, 17 aa, Mycobacterium avium
LLAGLEPDLKWERFITA

SEQ ID NO: 100103 - protein, 29 aa, Mycobacterium avium
LLAGLEPDLKWERFITAVRLLAERLGVRQ

SEQ ID NO: 100104 - protein, 17 aa, Mycobacterium avium
LLAGLSVHTARMAENLA

SEQ ID NO: 100105 - protein, 25 aa, Mycobacterium avium
LLAGPADRAARLWHRRFFSDAEEAG

SEQ ID NO: 100106 - protein, 25 aa, Mycobacterium avium
LLAGPADRAARLWHRRFFTDAEEAG

SEQ ID NO: 100107 - protein, 26 aa, Mycobacterium avium
LLAGPADRAARLWHRRFFTDAEEAGR

SEQ ID NO: 100108 - protein, 21 aa, Mycobacterium avium
LLAIPLHQLYALLWRVGIIEV

SEQ ID NO: 100109 - protein, 18 aa, Mycobacterium avium
LLALSALDFDLSVYDTFG

SEQ ID NO: 100110 - protein, 22 aa, Mycobacterium avium
LLAMLAYRGFVRQDPVSKAYLP

SEQ ID NO: 100111 - protein, 26 aa, Mycobacterium avium
LLANATPGPDGWIRAVGYHDSVAGAL

SEQ ID NO: 100112 - protein, 19 aa, Mycobacterium avium
LLAPLELLAYCAACTERLR

SEQ ID NO: 100113 - protein, 36 aa, Mycobacterium avium
LLAPLELLAYCAACTERLRLGVAVLVTSLHDPLQLA

SEQ ID NO: 100114 - protein, 18 aa, Mycobacterium avium
LLAQSGVLGDSWTAESLT

SEQ ID NO: 100115 - protein, 17 aa, Mycobacterium avium
LLARELPVYVISIGRTF

SEQ ID NO: 100116 - protein, 21 aa, Mycobacterium avium
LLARRLNAMESIRDEYADNRG

SEQ ID NO: 100117 - protein, 19 aa, Mycobacterium avium
LLARVQARSLAAFEHQDVP

SEQ ID NO: 100118 - protein, 20 aa, Mycobacterium avium
LLATLSLPRRLMLRKLLSFT

SEQ ID NO: 100119 - protein, 17 aa, Mycobacterium avium
LLATVVYYTAKLAADFD

SEQ ID NO: 100120 - protein, 34 aa, Mycobacterium avium
LLAVPPHGWINLHFSLLPAWRGAAPVQAAIAAGD

SEQ ID NO: 100121 - protein, 19 aa, Mycobacterium avium
LLAWLYARLARYKCLGRFH

SEQ ID NO: 100122 - protein, 24 aa, Mycobacterium avium
LLCAATQLGVRLGVDPSVLLSTLQ

SEQ ID NO: 100123 - protein, 23 aa, Mycobacterium avium
LLCRQCGRAVAFTPVDIEEHTRR

SEQ ID NO: 100124 - protein, 29 aa, Mycobacterium avium
LLCRREGHVHRTPRLVAAGIRARAGHPGG

SEQ ID NO: 100125 - protein, 17 aa, Mycobacterium avium
LLDALARADVVAAEDTR

SEQ ID NO: 100126 - protein, 22 aa, Mycobacterium avium
LLDCKARPLVEVEITTDTGHVG

SEQ ID NO: 100127 - protein, 23 aa, Mycobacterium avium
LLDCKARPLVEVEITTDTGHVGR

SEQ ID NO: 100128 - protein, 24 aa, Mycobacterium avium
LLDDRVRFVPGWFKDTLQDAPIER

SEQ ID NO: 100129 - protein, 24 aa, Mycobacterium avium
LLDEGQRLLIFLPLAHVLARSLTL

SEQ ID NO: 100130 - protein, 18 aa, Mycobacterium avium
LLDGVDWAARSNVWTGAC

SEQ ID NO: 100131 - protein, 34 aa, Mycobacterium avium
LLDHALWILVMFAWKRWPIKGARTRTGHARSSGL

SEQ ID NO: 100132 - protein, 21 aa, Mycobacterium avium
LLDIGCGWGGALKRALEKYDF

SEQ ID NO: 100133 - protein, 18 aa, Mycobacterium avium
LLDNRIVSCFSMTEPQGG

SEQ ID NO: 100134 - protein, 17 aa, Mycobacterium avium
LLDPGLRESVRHGVTTV

SEQ ID NO: 100135 - protein, 17 aa, Mycobacterium avium
LLDQAWWSPGLTHPDGR

SEQ ID NO: 100136 - protein, 17 aa, Mycobacterium avium
LLDRGRDALRLLHERLG

SEQ ID NO: 100137 - protein, 17 aa, Mycobacterium avium
LLDVPLPAWTHRHLLLG

SEQ ID NO: 100138 - protein, 19 aa, Mycobacterium avium
LLDYFPEDFLLVIDESHVT

SEQ ID NO: 100139 - protein, 18 aa, Mycobacterium avium
LLEARWRDVVATLDRRFP

SEQ ID NO: 100140 - protein, 17 aa, Mycobacterium avium
LLEGFDEILALAGDGAP

SEQ ID NO: 100141 - protein, 23 aa, Mycobacterium avium
LLERAARDGIDWRALAEREVSLF

SEQ ID NO: 100142 - protein, 22 aa, Mycobacterium avium
LLEYPVWMWHWAVPGDPAVPWE

SEQ ID NO: 100143 - protein, 18 aa, Mycobacterium avium
LLFSSARANTAFTPLNYR

SEQ ID NO: 100144 - protein, 21 aa, Mycobacterium avium
LLGEQRWAGQFALTRELALDA

SEQ ID NO: 100145 - protein, 28 aa, Mycobacterium avium
LLGKKCYSLRIASKMARDEGWLAEHMLI

SEQ ID NO: 100146 - protein, 17 aa, Mycobacterium avium
LLGPSGTGKSVFLKSLI

SEQ ID NO: 100147 - protein, 23 aa, Mycobacterium avium
LLGSLTLQRVWELAAAAAGPDSA

SEQ ID NO: 100148 - protein, 22 aa, Mycobacterium avium
LLGTRYLPPFPYFMDNPNAFRV

SEQ ID NO: 100149 - protein, 25 aa, Mycobacterium avium
LLGVDPAVIKARFRFVAPSRPVREE

SEQ ID NO: 100150 - protein, 17 aa, Mycobacterium avium
LLHRDMGLVSRFLGPWV

SEQ ID NO: 100151 - protein, 20 aa, Mycobacterium avium
LLHTGHIRLLRQARELGDAL

SEQ ID NO: 100152 - protein, 22 aa, Mycobacterium avium
LLIERIDAEYGRYFTPTGRPTG

SEQ ID NO: 100153 - protein, 20 aa, Mycobacterium avium
LLIVRPGFVIGRMTEGMTPA

SEQ ID NO: 100154 - protein, 17 aa, Mycobacterium avium
LLKGLTAHYLLKSVYPV

SEQ ID NO: 100155 - protein, 30 aa, Mycobacterium avium
LLLAGLEPDLKWERFITAVRLLAERLGVRQ

SEQ ID NO: 100156 - protein, 19 aa, Mycobacterium avium
LLLGRSFAYADAHRYRVGA

SEQ ID NO: 100157 - protein, 21 aa, Mycobacterium avium
LLLGRSFAYPDAHRARIGVNH

SEQ ID NO: 100158 - protein, 18 aa, Mycobacterium avium
LLLPAGLETTYRSSGNLL

SEQ ID NO: 100159 - protein, 25 aa, Mycobacterium avium
LLLPHWAGVVPLQLSAGPPVPAPDL

SEQ ID NO: 100160 - protein, 23 aa, Mycobacterium avium
LLMSVAAARRFRVPEERWVFLHG

SEQ ID NO: 100161 - protein, 18 aa, Mycobacterium avium
LLNADGWGAGFFDAEVPR

SEQ ID NO: 100162 - protein, 18 aa, Mycobacterium avium
LLNEPQFDEPSLNSGGQA

SEQ ID NO: 100163 - protein, 41 aa, Mycobacterium avium
LLNPSQFPALINYFIAWQTYRIINWTIRTLRFILQELPLLL

SEQ ID NO: 100164 - protein, 43 aa, Mycobacterium avium
LLNPSQFPALINYFIAWQTYRIINWTIRTLRFILQELPLLLQV

SEQ ID NO: 100165 - protein, 19 aa, Mycobacterium avium
LLPDRLAHMANRWKAIAFS

SEQ ID NO: 100166 - protein, 20 aa, Mycobacterium avium
LLPDRLAHMANRWKAIAFST

SEQ ID NO: 100167 - protein, 19 aa, Mycobacterium avium
LLPEIPLVASGGIRTGMDA

SEQ ID NO: 100168 - protein, 17 aa, Mycobacterium avium
LLPGDGDQALRQSAERG

SEQ ID NO: 100169 - protein, 21 aa, Mycobacterium avium
LLPHWRERRFGHVVNVSSAGV

SEQ ID NO: 100170 - protein, 24 aa, Mycobacterium avium
LLPPKTMRALIGRICEQEGVVVDD

SEQ ID NO: 100171 - protein, 18 aa, Mycobacterium avium
LLPVDCRFCHARVAVRRL

SEQ ID NO: 100172 - protein, 24 aa, Mycobacterium avium
LLQPGVLSPAWGSVVRQLAAGLGV

SEQ ID NO: 100173 - protein, 19 aa, Mycobacterium avium
LLQRDRLGAVGLVGEPTVE

SEQ ID NO: 100174 - protein, 20 aa, Mycobacterium avium
LLQRYRVLFFRGQQLSTAHQ

SEQ ID NO: 100175 - protein, 17 aa, Mycobacterium avium
LLQTIPLRRLGAPREIA

SEQ ID NO: 100176 - protein, 24 aa, Mycobacterium avium
LLRCGAEEHLLVAVVHHIAADGWS

SEQ ID NO: 100177 - protein, 22 aa, Mycobacterium avium
LLRDAYCRHIGVEYTHILDPEQ

SEQ ID NO: 100178 - protein, 23 aa, Mycobacterium avium
LLREYLFGWARWFSRRPTTPTCC

SEQ ID NO: 100179 - protein, 20 aa, Mycobacterium avium
LLRHWERPLRAVSVLFDDEA

SEQ ID NO: 100180 - protein, 18 aa, Mycobacterium avium
LLRKRWPDPGVAVKYGDT

SEQ ID NO: 100181 - protein, 18 aa, Mycobacterium avium
LLRPMFDYRHRQLAGDLA

SEQ ID NO: 100182 - protein, 21 aa, Mycobacterium avium
LLRRKLAERGLSRSAGTARHD

SEQ ID NO: 100183 - protein, 17 aa, Mycobacterium avium
LLRRKLAERGLSRSTGT

SEQ ID NO: 100184 - protein, 17 aa, Mycobacterium avium
LLRRRSRVRRDNTGYDL

SEQ ID NO: 100185 - protein, 22 aa, Mycobacterium avium
LLRSLGTAGLRFERQCQNARAV

SEQ ID NO: 100186 - protein, 22 aa, Mycobacterium avium
LLRSRFGERLDVRVSAIRTDPW

SEQ ID NO: 100187 - protein, 17 aa, Mycobacterium avium
LLRYLSIIQNGQRRVAL

SEQ ID NO: 100188 - protein, 18 aa, Mycobacterium avium
LLSERIIFLGSEVNDDVA

SEQ ID NO: 100189 - protein, 21 aa, Mycobacterium avium
LLSEYDRFALLHGNYRLDNLL

SEQ ID NO: 100190 - protein, 23 aa, Mycobacterium avium
LLSGFERRGRWNVPKKLTTFTLW

SEQ ID NO: 100191 - protein, 20 aa, Mycobacterium avium
LLSGKRCFIGLTLNQIRAAD

SEQ ID NO: 100192 - protein, 23 aa, Mycobacterium avium
LLTDHRFELGLGAGYVKEEFEAA

SEQ ID NO: 100193 - protein, 25 aa, Mycobacterium avium
LLTFDGELLSRCELFDEADLPDALA

SEQ ID NO: 100194 - protein, 22 aa, Mycobacterium avium
LLTRDGCTICERIHARLVELAA

SEQ ID NO: 100195 - protein, 24 aa, Mycobacterium avium
LLVEHRPGLTVSRDLPKLGYKGVE

SEQ ID NO: 100196 - protein, 23 aa, Mycobacterium avium
LLVGPNLWAGVGLVRGGAGTALV

SEQ ID NO: 100197 - protein, 20 aa, Mycobacterium avium
LLVHAWDYARAVGRDVRAPE

SEQ ID NO: 100198 - protein, 21 aa, Mycobacterium avium
LLVKVPAGWSHTAAATASVVF

SEQ ID NO: 100199 - protein, 17 aa, Mycobacterium avium
LLVPIHWGTFRLAPHPW

SEQ ID NO: 100200 - protein, 17 aa, Mycobacterium avium
LLVRGELLGGHRQPRRG

SEQ ID NO: 100201 - protein, 18 aa, Mycobacterium avium
LLWYRPDLVLQPPRTWDA

SEQ ID NO: 100202 - protein, 19 aa, Mycobacterium avium
LLYFPVMGANEIWRVDPDG

SEQ ID NO: 100203 - protein, 22 aa, Mycobacterium avium
LMAATLAHWGLLTFSAPPTRSA

SEQ ID NO: 100204 - protein, 18 aa, Mycobacterium avium
LMEWCAMVGCPIIGIQDS

SEQ ID NO: 100205 - protein, 19 aa, Mycobacterium avium
LMEWCAMVGCPIIGIQDSG

SEQ ID NO: 100206 - protein, 18 aa, Mycobacterium avium
LMKLWWAEGQVAAVVGHR

SEQ ID NO: 100207 - protein, 28 aa, Mycobacterium avium
LMLGRKANRHFSFGIGVHRCIGSNVART

SEQ ID NO: 100208 - protein, 20 aa, Mycobacterium avium
LMLLRSMGIPSHYVSGYLHP

SEQ ID NO: 100209 - protein, 23 aa, Mycobacterium avium
LMQMAWALVLSRLTDTDDVVFGV

SEQ ID NO: 100210 - protein, 20 aa, Mycobacterium avium
LMQMAWALVLSRLTDTRDVV

SEQ ID NO: 100211 - protein, 23 aa, Mycobacterium avium
LMQMAWALVLSRLTDTRDVVFGV

SEQ ID NO: 100212 - protein, 18 aa, Mycobacterium avium
LMQRVCPDMIGAGGGAII

SEQ ID NO: 100213 - protein, 25 aa, Mycobacterium avium
LMQVWANELAQYWIRVNTIHPTGVA

SEQ ID NO: 100214 - protein, 51 aa, Mycobacterium avium
LMQYAYAGAGIKLPRSSGAMYRVGQKILPQQARKGDLIFYGPEGTQSVAMY

SEQ ID NO: 100215 - protein, 27 aa, Mycobacterium avium
LMRIPHMVNLYRYRGMYGLPSRATVST

SEQ ID NO: 100216 - protein, 18 aa, Mycobacterium avium
LMRYPHRNTVCISSQAGC

SEQ ID NO: 100217 - protein, 18 aa, Mycobacterium avium
LMSGKWHLGATIETSPWA

SEQ ID NO: 100218 - protein, 21 aa, Mycobacterium avium
LMSHLPRERLGVTAKSLATTR

SEQ ID NO: 100219 - protein, 19 aa, Mycobacterium avium
LMSVAGWKNRSMIDRYVGA

SEQ ID NO: 100220 - protein, 24 aa, Mycobacterium avium
LMTCAQLGLRPGVSVLGQAYLLPF

SEQ ID NO: 100221 - protein, 20 aa, Mycobacterium avium
LMVNYDLPWNPNRIEQRFGR

SEQ ID NO: 100222 - protein, 18 aa, Mycobacterium avium
LMVPLPVPGCTAVGAIEN

SEQ ID NO: 100223 - protein, 17 aa, Mycobacterium avium
LMWPQDVLEDFMAGQRG

SEQ ID NO: 100224 - protein, 17 aa, Mycobacterium avium
LNALFEIVVPAVVDGGG

SEQ ID NO: 100225 - protein, 25 aa, Mycobacterium avium
LNAVAGKPPEEWGMDPVRYEDMIPG

SEQ ID NO: 100226 - protein, 18 aa, Mycobacterium avium
LNDFGALLGEAWTEKKRM

SEQ ID NO: 100227 - protein, 21 aa, Mycobacterium avium
LNDFSLTAATGWNPVRAVATR

SEQ ID NO: 100228 - protein, 21 aa, Mycobacterium avium
LNDFSLTGATGWNPVRAVATR

SEQ ID NO: 100229 - protein, 17 aa, Mycobacterium avium
LNEYWSAVREPDWSQFM

SEQ ID NO: 100230 - protein, 17 aa, Mycobacterium avium
LNEYWSAVREPDWSQFV

SEQ ID NO: 100231 - protein, 25 aa, Mycobacterium avium
LNGSTCAPTYFAVVLAAAPESAGID

SEQ ID NO: 100232 - protein, 18 aa, Mycobacterium avium
LNGTYNLTRLVAAAVAAA

SEQ ID NO: 100233 - protein, 19 aa, Mycobacterium avium
LNICVSYRLIGAVDAARLH

SEQ ID NO: 100234 - protein, 19 aa, Mycobacterium avium
LNICVSYRLTGGVDTGRLH

SEQ ID NO: 100235 - protein, 22 aa, Mycobacterium avium
LNIGNPAPFGFEAPDVIMRDMI

SEQ ID NO: 100236 - protein, 24 aa, Mycobacterium avium
LNKEIKRRTDVVGVFPNPAALLRL

SEQ ID NO: 100237 - protein, 26 aa, Mycobacterium avium
LNKVRFPAPVPVGSRVRAQSSLVSVD

SEQ ID NO: 100238 - protein, 25 aa, Mycobacterium avium
LNLPGVAFGHDWLTGAARYANLLEH

SEQ ID NO: 100239 - protein, 19 aa, Mycobacterium avium
LNLPTLHGVVVRRSYAAAH

SEQ ID NO: 100240 - protein, 27 aa, Mycobacterium avium
LNPAPWLPVYWVFGGFLRKRRNIRDMT

SEQ ID NO: 100241 - protein, 27 aa, Mycobacterium avium
LNPLAIRYGQITDIFIRDYFNADGSVF

SEQ ID NO: 100242 - protein, 19 aa, Mycobacterium avium
LNPRLGRREIESILQQADP

SEQ ID NO: 100243 - protein, 19 aa, Mycobacterium avium
LNPRLGRREVESILQQADP

SEQ ID NO: 100244 - protein, 38 aa, Mycobacterium avium
LNPSQFPALINYFIAWQTYRIINWTIRTLRFILQELPL

SEQ ID NO: 100245 - protein, 17 aa, Mycobacterium avium
LNPSTGVELLIPDFNGR

SEQ ID NO: 100246 - protein, 18 aa, Mycobacterium avium
LNPSTGVELLIPDFNGRP

SEQ ID NO: 100247 - protein, 25 aa, Mycobacterium avium
LNQGEVCTCPSRSLIQADIYDEFLE

SEQ ID NO: 100248 - protein, 24 aa, Mycobacterium avium
LNQMEIFTLLGYWNMPRAQISLVA

SEQ ID NO: 100249 - protein, 21 aa, Mycobacterium avium
LNQWMLEHWGFSHANRVYSTP

SEQ ID NO: 100250 - protein, 25 aa, Mycobacterium avium
LNQWMLEHWGFTYANRIYSTPVLNL

SEQ ID NO: 100251 - protein, 24 aa, Mycobacterium avium
LNRKAVELDARMRRRLAIVDQQAL

SEQ ID NO: 100252 - protein, 21 aa, Mycobacterium avium
LNTAWLHKPMFTLRGGTNEVL

SEQ ID NO: 100253 - protein, 28 aa, Mycobacterium avium
LNVPRRDLRMLAARLGSDVPFALHGGTA

SEQ ID NO: 100254 - protein, 24 aa, Mycobacterium avium
LNVSDGVLLSAVWASETSQLALVV

SEQ ID NO: 100255 - protein, 21 aa, Mycobacterium avium
LNYYAPLRLIRGIAPGMIERG

SEQ ID NO: 100256 - protein, 17 aa, Mycobacterium avium
LPAALPEIRSYRDYAVR

SEQ ID NO: 100257 - protein, 21 aa, Mycobacterium avium
LPAAPYLHVFLARGRADIEDV

SEQ ID NO: 100258 - protein, 21 aa, Mycobacterium avium
LPAAPYLHVFLARGRADVEGV

SEQ ID NO: 100259 - protein, 20 aa, Mycobacterium avium
LPADDVLACYADRLTDRSLG

SEQ ID NO: 100260 - protein, 18 aa, Mycobacterium avium
LPAEWGRIALSNLRLGAT

SEQ ID NO: 100261 - protein, 24 aa, Mycobacterium avium
LPAFPANLRKQLKGSPMPAPRAIM

SEQ ID NO: 100262 - protein, 18 aa, Mycobacterium avium
LPAGDPVASNWALRPFQR

SEQ ID NO: 100263 - protein, 17 aa, Mycobacterium avium
LPALLARDLHPTAVAGF

SEQ ID NO: 100264 - protein, 18 aa, Mycobacterium avium
LPANGKWWIDNWISETVD

SEQ ID NO: 100265 - protein, 22 aa, Mycobacterium avium
LPAPEILSFLYLEARLADEGRY

SEQ ID NO: 100266 - protein, 24 aa, Mycobacterium avium
LPAPRVSPFPAVFQDVSLVVAADV

SEQ ID NO: 100267 - protein, 20 aa, Mycobacterium avium
LPAQPLLRIAGFGYNEEATE

SEQ ID NO: 100268 - protein, 17 aa, Mycobacterium avium
LPARGAVDLGFRLAPPA

SEQ ID NO: 100269 - protein, 24 aa, Mycobacterium avium
LPATPRRELCDFVEWMTDREPGIA

SEQ ID NO: 100270 - protein, 18 aa, Mycobacterium avium
LPAVIERRGYVLIVSSLA

SEQ ID NO: 100271 - protein, 21 aa, Mycobacterium avium
LPAVLLGPGPFVGRGRELDGL

SEQ ID NO: 100272 - protein, 17 aa, Mycobacterium avium
LPAYMVPAAVVTLDAIP

SEQ ID NO: 100273 - protein, 18 aa, Mycobacterium avium
LPCACGQPDCPARTGNQN

SEQ ID NO: 100274 - protein, 19 aa, Mycobacterium avium
LPCACGQPDCPARTRDQNA

SEQ ID NO: 100275 - protein, 17 aa, Mycobacterium avium
LPDAGSFDDFCAREREY

SEQ ID NO: 100276 - protein, 17 aa, Mycobacterium avium
LPDDRLDDLLALAHEVR

SEQ ID NO: 100277 - protein, 22 aa, Mycobacterium avium
LPDERWALLPLVPLIPKRVFRR

SEQ ID NO: 100278 - protein, 24 aa, Mycobacterium avium
LPDLPVDVVERIRIATIDSQSEGT

SEQ ID NO: 100279 - protein, 22 aa, Mycobacterium avium
LPDPDPWAWPNLDCNAVQRDGL

SEQ ID NO: 100280 - protein, 18 aa, Mycobacterium avium
LPDPFSKQAEWTCYAGSQ

SEQ ID NO: 100281 - protein, 22 aa, Mycobacterium avium
LPDRDWISALCLDLKAADACGA

SEQ ID NO: 100282 - protein, 24 aa, Mycobacterium avium
LPDRDWISALCLDLKAADACGAAG

SEQ ID NO: 100283 - protein, 17 aa, Mycobacterium avium
LPDVTAWLEIGSVTAAV

SEQ ID NO: 100284 - protein, 22 aa, Mycobacterium avium
LPDYARTDWRLERQDVVKAFSM

SEQ ID NO: 100285 - protein, 17 aa, Mycobacterium avium
LPEAQLDRFAIRLELRY

SEQ ID NO: 100286 - protein, 18 aa, Mycobacterium avium
LPEARAYLRHELLGPRLR

SEQ ID NO: 100287 - protein, 18 aa, Mycobacterium avium
LPEFPWDTLAEAKALAGS

SEQ ID NO: 100288 - protein, 23 aa, Mycobacterium avium
LPEGPLPLGTPVTGRLYFDVRNG

SEQ ID NO: 100289 - protein, 23 aa, Mycobacterium avium
LPEHLVIVGSGFVAAEFAHIFSA

SEQ ID NO: 100290 - protein, 20 aa, Mycobacterium avium
LPERLPDPGLAWDATAAAWQ

SEQ ID NO: 100291 - protein, 25 aa, Mycobacterium avium
LPESIIRTGGTLAFSLAAYPDKHWG

SEQ ID NO: 100292 - protein, 24 aa, Mycobacterium avium
LPEWERDRVREVIDPAVVVDETSR

SEQ ID NO: 100293 - protein, 23 aa, Mycobacterium avium
LPEWPQMLLRALMFRLAVHALHP

SEQ ID NO: 100294 - protein, 27 aa, Mycobacterium avium
LPFACGPHHRLLQPGAWTTHRNAKGET

SEQ ID NO: 100295 - protein, 31 aa, Mycobacterium avium
LPFYHDLGLILGICAPILAGVRSVFTSPVAF

SEQ ID NO: 100296 - protein, 22 aa, Mycobacterium avium
LPGAQWRLVLTAHHIVIDGWSM

SEQ ID NO: 100297 - protein, 17 aa, Mycobacterium avium
LPGAVVMVGHGGKVVFH

SEQ ID NO: 100298 - protein, 20 aa, Mycobacterium avium
LPGDLKFTLVEPLRLLFKDE

SEQ ID NO: 100299 - protein, 19 aa, Mycobacterium avium
LPGFLLRQRIRPVARAQRL

SEQ ID NO: 100300 - protein, 20 aa, Mycobacterium avium
LPGGAPERRAWGLDAQTLAR

SEQ ID NO: 100301 - protein, 17 aa, Mycobacterium avium
LPGGVWAYEAHRVAARR

SEQ ID NO: 100302 - protein, 17 aa, Mycobacterium avium
LPGHGHSAWRADGDYSP

SEQ ID NO: 100303 - protein, 18 aa, Mycobacterium avium
LPGHRLGDQPAHRCAGGL

SEQ ID NO: 100304 - protein, 17 aa, Mycobacterium avium
LPGIGFSGGIIGGLEGA

SEQ ID NO: 100305 - protein, 27 aa, Mycobacterium avium
LPGPIQRLSEGFALMITTGFLPQRFRD

SEQ ID NO: 100306 - protein, 19 aa, Mycobacterium avium
LPGPNGSVVPSTWRAQRAF

SEQ ID NO: 100307 - protein, 19 aa, Mycobacterium avium
LPGPNGSVVPTTWRAQRAT

SEQ ID NO: 100308 - protein, 19 aa, Mycobacterium avium
LPGPPAVWRLAAGDAGTLE

SEQ ID NO: 100309 - protein, 18 aa, Mycobacterium avium
LPGPPILRHSLTVALIAG

SEQ ID NO: 100310 - protein, 18 aa, Mycobacterium avium
LPGPPILWHSLTVALIAG

SEQ ID NO: 100311 - protein, 21 aa, Mycobacterium avium
LPGRAWVQYDPLGVVLIIGPW

SEQ ID NO: 100312 - protein, 17 aa, Mycobacterium avium
LPGRDIYAALKKGSGTQ

SEQ ID NO: 100313 - protein, 18 aa, Mycobacterium avium
LPGTGVWSQCHSYGFDVS

SEQ ID NO: 100314 - protein, 17 aa, Mycobacterium avium
LPGVLSRRIDPRNGTVL

SEQ ID NO: 100315 - protein, 17 aa, Mycobacterium avium
LPGWAWSDVLDSFRAIE

SEQ ID NO: 100316 - protein, 26 aa, Mycobacterium avium
LPGYEEFAPWLLVEKRGNVHVVSINR

SEQ ID NO: 100317 - protein, 24 aa, Mycobacterium avium
LPHEACSMISALRHRNEFDIHRLI

SEQ ID NO: 100318 - protein, 20 aa, Mycobacterium avium
LPHRLESAGVHYWVIGADRA

SEQ ID NO: 100319 - protein, 18 aa, Mycobacterium avium
LPINPIRTRIQHCNIQVG

SEQ ID NO: 100320 - protein, 19 aa, Mycobacterium avium
LPIPPSRIVARLSKATGTP

SEQ ID NO: 100321 - protein, 17 aa, Mycobacterium avium
LPIVFVCQNNRYAEMTP

SEQ ID NO: 100322 - protein, 21 aa, Mycobacterium avium
LPKICLEAGRGIRGTIGHTQP

SEQ ID NO: 100323 - protein, 20 aa, Mycobacterium avium
LPKICLEAGRGISGTIGHTQ

SEQ ID NO: 100324 - protein, 18 aa, Mycobacterium avium
LPKPFVPPCMPLGSGPAM

SEQ ID NO: 100325 - protein, 21 aa, Mycobacterium avium
LPKPPFAQWLPDRLWAAQRKL

SEQ ID NO: 100326 - protein, 17 aa, Mycobacterium avium
LPKSARSELAIELATEA

SEQ ID NO: 100327 - protein, 20 aa, Mycobacterium avium
LPKVCLEAGRGIRGTIGHTQ

SEQ ID NO: 100328 - protein, 23 aa, Mycobacterium avium
LPKYKLPEELVFWDEPLPVNANG

SEQ ID NO: 100329 - protein, 21 aa, Mycobacterium avium
LPLAAPEELDRLAVAASSPAD

SEQ ID NO: 100330 - protein, 21 aa, Mycobacterium avium
LPLDCTYDFEVTAAKYLHALR

SEQ ID NO: 100331 - protein, 17 aa, Mycobacterium avium
LPLGRLVAGRLTRINAA

SEQ ID NO: 100332 - protein, 17 aa, Mycobacterium avium
LPLGRLVAGRLTRINAV

SEQ ID NO: 100333 - protein, 27 aa, Mycobacterium avium
LPMAADRGVGWKVLRDAGRVVSVDGIF

SEQ ID NO: 100334 - protein, 26 aa, Mycobacterium avium
LPMIRVAARRGIDWRAIYTGRSREYM

SEQ ID NO: 100335 - protein, 22 aa, Mycobacterium avium
LPMPKRLPPWILAKMGGAFTSS

SEQ ID NO: 100336 - protein, 27 aa, Mycobacterium avium
LPMPRAAHCPLAPPPEFVDWRQQPGLR

SEQ ID NO: 100337 - protein, 28 aa, Mycobacterium avium
LPMPRAAHCPLAPPPEFVDWRQQPGLRR

SEQ ID NO: 100338 - protein, 42 aa, Mycobacterium avium
LPMPRAAHCPLAPPPEFVDWRQRPGLRRALFQGNPVWVVSRY

SEQ ID NO: 100339 - protein, 19 aa, Mycobacterium avium
LPMRTIGMLLGIPDADQPS

SEQ ID NO: 100340 - protein, 17 aa, Mycobacterium avium
LPNTLAGHNLVFIYDDD

SEQ ID NO: 100341 - protein, 27 aa, Mycobacterium avium
LPPATYFSGAKLQWILDNVDGVREAAE

SEQ ID NO: 100342 - protein, 20 aa, Mycobacterium avium
LPPAWIGVGTLDLFYPECLE

SEQ ID NO: 100343 - protein, 21 aa, Mycobacterium avium
LPPAWIGVGTLDLFYPECLEY

SEQ ID NO: 100344 - protein, 21 aa, Mycobacterium avium
LPPEEAFESFAARVRPFTIPK

SEQ ID NO: 100345 - protein, 17 aa, Mycobacterium avium
LPPEIPLRDAAAVPTAS

SEQ ID NO: 100346 - protein, 17 aa, Mycobacterium avium
LPPEVHSTLLSSGPGPG

SEQ ID NO: 100347 - protein, 17 aa, Mycobacterium avium
LPPEVVYLYNGPGGTSF

SEQ ID NO: 100348 - protein, 17 aa, Mycobacterium avium
LPPGMPVLVDAYEAAYS

SEQ ID NO: 100349 - protein, 19 aa, Mycobacterium avium
LPPHLEWTAPFGALSAANW

SEQ ID NO: 100350 - protein, 28 aa, Mycobacterium avium
LPPPARREVLPPLARRVAPPRPERPALR

SEQ ID NO: 100351 - protein, 18 aa, Mycobacterium avium
LPPTQSCCRCGNVRRVHA

SEQ ID NO: 100352 - protein, 17 aa, Mycobacterium avium
LPQAVPASGVVVLNVDD

SEQ ID NO: 100353 - protein, 18 aa, Mycobacterium avium
LPQRWIDFLRRWEPAGWP

SEQ ID NO: 100354 - protein, 19 aa, Mycobacterium avium
LPREEWPSAIRRLVSGQLS

SEQ ID NO: 100355 - protein, 18 aa, Mycobacterium avium
LPRGYALHRGLKLQRAIM

SEQ ID NO: 100356 - protein, 20 aa, Mycobacterium avium
LPRKLDAVRRACEEVGRDPA

SEQ ID NO: 100357 - protein, 23 aa, Mycobacterium avium
LPRLRGWGESMSRQAGGRAGGSG

SEQ ID NO: 100358 - protein, 26 aa, Mycobacterium avium
LPRMASGEMRATMALTEPGGGSDLQA

SEQ ID NO: 100359 - protein, 21 aa, Mycobacterium avium
LPRRLMLRKLLSFTGAHVRAV

SEQ ID NO: 100360 - protein, 23 aa, Mycobacterium avium
LPSARRLLLFKVDGSVSVHADDR

SEQ ID NO: 100361 - protein, 17 aa, Mycobacterium avium
LPSCVPYDPASPDDLSE

SEQ ID NO: 100362 - protein, 19 aa, Mycobacterium avium
LPSGLRWVAVHQPDGYDPP

SEQ ID NO: 100363 - protein, 37 aa, Mycobacterium avium
LPSGPKPLPMGPFIGGDPRWGTAHFASGGPSGTDTIP

SEQ ID NO: 100364 - protein, 25 aa, Mycobacterium avium
LPSHRWPRRALRLTAIDVDSGELTV

SEQ ID NO: 100365 - protein, 29 aa, Mycobacterium avium
LPSKRRIHGVIFFPQWIRQHGERTVCFQN

SEQ ID NO: 100366 - protein, 24 aa, Mycobacterium avium
LPSLLDFYMCYRAYVRGKVRSLRL

SEQ ID NO: 100367 - protein, 17 aa, Mycobacterium avium
LPSLLVLTGVNSARDAV

SEQ ID NO: 100368 - protein, 17 aa, Mycobacterium avium
LPSNCFDQPPIVNPGLE

SEQ ID NO: 100369 - protein, 18 aa, Mycobacterium avium
LPSNCFDQPPIVNPGLEP

SEQ ID NO: 100370 - protein, 20 aa, Mycobacterium avium
LPSPFCYEIAQWAGEDAEPA

SEQ ID NO: 100371 - protein, 20 aa, Mycobacterium avium
LPSPFCYEIAQWAGEDVETA

SEQ ID NO: 100372 - protein, 18 aa, Mycobacterium avium
LPSRVWRAVRETRAVLHA

SEQ ID NO: 100373 - protein, 26 aa, Mycobacterium avium
LPSVESLKFPLGHSDLIQPHMFMNDQ

SEQ ID NO: 100374 - protein, 28 aa, Mycobacterium avium
LPTACCFENRWNPDWLAVADKVRSGFLG

SEQ ID NO: 100375 - protein, 26 aa, Mycobacterium avium
LPTGRRLLAAPGLRAVPGLPVCQLRR

SEQ ID NO: 100376 - protein, 19 aa, Mycobacterium avium
LPTPEEIWEMLFGPDGEQI

SEQ ID NO: 100377 - protein, 20 aa, Mycobacterium avium
LPTPEEIWEMLFGPDGEQIP

SEQ ID NO: 100378 - protein, 17 aa, Mycobacterium avium
LPTRFGRHYRKALRRTA

SEQ ID NO: 100379 - protein, 19 aa, Mycobacterium avium
LPTRFGRHYRKALRRTAGL

SEQ ID NO: 100380 - protein, 21 aa, Mycobacterium avium
LPTRFGRHYRKALRRTAGLTL

SEQ ID NO: 100381 - protein, 19 aa, Mycobacterium avium
LPTVPHIMKLSSRNMRHLV

SEQ ID NO: 100382 - protein, 23 aa, Mycobacterium avium
LPTYAFARERFWLGGASLAGAPA

SEQ ID NO: 100383 - protein, 26 aa, Mycobacterium avium
LPTYAFARRRFWLSGDAVGSANIASL

SEQ ID NO: 100384 - protein, 23 aa, Mycobacterium avium
LPVADLNIAAWLLDHVDSPAGDG

SEQ ID NO: 100385 - protein, 19 aa, Mycobacterium avium
LPVDEFLATVQRFNGFART

SEQ ID NO: 100386 - protein, 27 aa, Mycobacterium avium
LPVDSVAVATRFPGPITDLQLSRDSTR

SEQ ID NO: 100387 - protein, 17 aa, Mycobacterium avium
LPVGWVEPVDISNAVLF

SEQ ID NO: 100388 - protein, 21 aa, Mycobacterium avium
LPVKAKWGISLGALLRHLHVS

SEQ ID NO: 100389 - protein, 17 aa, Mycobacterium avium
LPVKPDRLLAGGDTVRI

SEQ ID NO: 100390 - protein, 18 aa, Mycobacterium avium
LPVKPDRLLAGGDTVRIG

SEQ ID NO: 100391 - protein, 21 aa, Mycobacterium avium
LPVLRPMLGFDKQEILAEARR

SEQ ID NO: 100392 - protein, 23 aa, Mycobacterium avium
LPVRRDGRFVVALGMGGMGNSFG

SEQ ID NO: 100393 - protein, 23 aa, Mycobacterium avium
LPVRVRDGVGLVGPLVIPGVTSC

SEQ ID NO: 100394 - protein, 21 aa, Mycobacterium avium
LPVSARPAPHAPAQAQPATAP

SEQ ID NO: 100395 - protein, 20 aa, Mycobacterium avium
LPVSYWKLTEREIFRHYRSI

SEQ ID NO: 100396 - protein, 24 aa, Mycobacterium avium
LPVVCSVRGWAVGFGCNLALAADF

SEQ ID NO: 100397 - protein, 19 aa, Mycobacterium avium
LPWEEVHAEACRWEHVMSE

SEQ ID NO: 100398 - protein, 24 aa, Mycobacterium avium
LPWLTRLGTVYSYDAPWHRGRDVD

SEQ ID NO: 100399 - protein, 21 aa, Mycobacterium avium
LPWMTDLVEQFGLRPPPAEQI

SEQ ID NO: 100400 - protein, 21 aa, Mycobacterium avium
LPWMTDLVEQFGLRPPPVEQI

SEQ ID NO: 100401 - protein, 18 aa, Mycobacterium avium
LPYFEQFLRREGMRHATA

SEQ ID NO: 100402 - protein, 17 aa, Mycobacterium avium
LPYRVAFSTFTSGPPQV

SEQ ID NO: 100403 - protein, 19 aa, Mycobacterium avium
LPYSPPEHAFKMVPSSLGI

SEQ ID NO: 100404 - protein, 17 aa, Mycobacterium avium
LQAAAGWINVREPGRAP

SEQ ID NO: 100405 - protein, 18 aa, Mycobacterium avium
LQAAFGTYVDPALAARLL

SEQ ID NO: 100406 - protein, 27 aa, Mycobacterium avium
LQAAGGPGCVARAAAALSTGALNGARG

SEQ ID NO: 100407 - protein, 17 aa, Mycobacterium avium
LQACLGSIVGQTYREVE

SEQ ID NO: 100408 - protein, 18 aa, Mycobacterium avium
LQAGSVQVNCQLVFDHDV

SEQ ID NO: 100409 - protein, 17 aa, Mycobacterium avium
LQAKAREAGLWSLQTPE

SEQ ID NO: 100410 - protein, 20 aa, Mycobacterium avium
LQALGAVVHPCARITKLSER

SEQ ID NO: 100411 - protein, 18 aa, Mycobacterium avium
LQALLAVRMHKRTRVMIL

SEQ ID NO: 100412 - protein, 33 aa, Mycobacterium avium
LQALLYSAVLHRFLRWRLAGYDPDRHLGGILYL

SEQ ID NO: 100413 - protein, 21 aa, Mycobacterium avium
LQARVPAALMWGNPLRSPGYA

SEQ ID NO: 100414 - protein, 17 aa, Mycobacterium avium
LQAWIRLAGLDTVQGSE

SEQ ID NO: 100415 - protein, 25 aa, Mycobacterium avium
LQCDAMPVLRWVRRMRSNSELPAQL

SEQ ID NO: 100416 - protein, 18 aa, Mycobacterium avium
LQCPTEFERFRAALDTPL

SEQ ID NO: 100417 - protein, 20 aa, Mycobacterium avium
LQDAGLMACHAYTWKQVVGT

SEQ ID NO: 100418 - protein, 19 aa, Mycobacterium avium
LQDLIARPWSWLAGGCEPN

SEQ ID NO: 100419 - protein, 19 aa, Mycobacterium avium
LQFGTNHLGHFALTGLLLA

SEQ ID NO: 100420 - protein, 19 aa, Mycobacterium avium
LQFGTNHLGHFALTGRLLA

SEQ ID NO: 100421 - protein, 17 aa, Mycobacterium avium
LQGIGFAVSRRTMMRRL

SEQ ID NO: 100422 - protein, 17 aa, Mycobacterium avium
LQGSGWAVLGYDTVGSR

SEQ ID NO: 100423 - protein, 20 aa, Mycobacterium avium
LQHPELWSSSVIVPTEPEPP

SEQ ID NO: 100424 - protein, 23 aa, Mycobacterium avium
LQHPKIRVVTTVLRVRRAHPDTF

SEQ ID NO: 100425 - protein, 17 aa, Mycobacterium avium
LQIARYVTRDVEYYGQT

SEQ ID NO: 100426 - protein, 18 aa, Mycobacterium avium
LQIYNAWFDPAANKARPI

SEQ ID NO: 100427 - protein, 17 aa, Mycobacterium avium
LQLAYELEEARPWARIQ

SEQ ID NO: 100428 - protein, 18 aa, Mycobacterium avium
LQLCYVCSMSEVASRELR

SEQ ID NO: 100429 - protein, 25 aa, Mycobacterium avium
LQLPAMQVLVAPDCYADSMSALEAS

SEQ ID NO: 100430 - protein, 29 aa, Mycobacterium avium
LQLPENAPILFIERLRSVGGLPLSLDTTS

SEQ ID NO: 100431 - protein, 17 aa, Mycobacterium avium
LQLWVMMETPRAFLRAE

SEQ ID NO: 100432 - protein, 22 aa, Mycobacterium avium
LQPAGVLRDEWQAVREPAMPPQ

SEQ ID NO: 100433 - protein, 18 aa, Mycobacterium avium
LQPARLTVDLPRPTELEP

SEQ ID NO: 100434 - protein, 27 aa, Mycobacterium avium
LQPDKYWAGFCRRIGLAELADDARFVP

SEQ ID NO: 100435 - protein, 17 aa, Mycobacterium avium
LQPDPRFAAAVQTAQRR

SEQ ID NO: 100436 - protein, 18 aa, Mycobacterium avium
LQPLALAPKGIWLGPKEL

SEQ ID NO: 100437 - protein, 28 aa, Mycobacterium avium
LQPPALRAICPWEGFTDAYRDLMFPGGV

SEQ ID NO: 100438 - protein, 17 aa, Mycobacterium avium
LQPYLNIARQFRGGNTA

SEQ ID NO: 100439 - protein, 18 aa, Mycobacterium avium
LQQLDGFIGQAVEMEKDP

SEQ ID NO: 100440 - protein, 22 aa, Mycobacterium avium
LQRAGLRTVCLEANTYAGGMAA

SEQ ID NO: 100441 - protein, 21 aa, Mycobacterium avium
LQRAQRAACDAVRPGMTAEQV

SEQ ID NO: 100442 - protein, 21 aa, Mycobacterium avium
LQRAQRAACDAVRPGVTAEQV

SEQ ID NO: 100443 - protein, 17 aa, Mycobacterium avium
LQRDRLGAVGLVGEPTV

SEQ ID NO: 100444 - protein, 26 aa, Mycobacterium avium
LQRIKDLVIPPAWKKVWISPHPNGHI

SEQ ID NO: 100445 - protein, 19 aa, Mycobacterium avium
LQRPARWMQLLAKESHTFS

SEQ ID NO: 100446 - protein, 21 aa, Mycobacterium avium
LQRQWLHARSLSFAHPADGRR

SEQ ID NO: 100447 - protein, 20 aa, Mycobacterium avium
LQRRHRRGADQDAVDRHQRE

SEQ ID NO: 100448 - protein, 18 aa, Mycobacterium avium
LQSPTEFQRFRAALDTPL

SEQ ID NO: 100449 - protein, 22 aa, Mycobacterium avium
LQTRPPVVTVMGHVDHGKTRLL

SEQ ID NO: 100450 - protein, 24 aa, Mycobacterium avium
LQVCRAGPGGDGWIDVPPRHGAFI

SEQ ID NO: 100451 - protein, 41 aa, Mycobacterium avium
LQVIFAYPGVHAIWGHRVNHWLWRRGARLAARISAEITRIL

SEQ ID NO: 100452 - protein, 21 aa, Mycobacterium avium
LQVNVRQALTLADQATAAGDT

SEQ ID NO: 100453 - protein, 17 aa, Mycobacterium avium
LQVPPYIYAHPDDLLEA

SEQ ID NO: 100454 - protein, 21 aa, Mycobacterium avium
LRAAAGVARSGACELVAARSR

SEQ ID NO: 100455 - protein, 20 aa, Mycobacterium avium
LRAAGPYAALGSRAPDAVDK

SEQ ID NO: 100456 - protein, 19 aa, Mycobacterium avium
LRAAHPDWANGKTPFLKTN

SEQ ID NO: 100457 - protein, 17 aa, Mycobacterium avium
LRAALRPGMTVVLGDGV

SEQ ID NO: 100458 - protein, 18 aa, Mycobacterium avium
LRAARLLMYQAAWNADLG

SEQ ID NO: 100459 - protein, 20 aa, Mycobacterium avium
LRAAVGKYWAIDDIRPSFIV

SEQ ID NO: 100460 - protein, 21 aa, Mycobacterium avium
LRADGWLRIGGADHRVCDDLA

SEQ ID NO: 100461 - protein, 20 aa, Mycobacterium avium
LRADGWLRIGGADHRVRDDL

SEQ ID NO: 100462 - protein, 20 aa, Mycobacterium avium
LRADGWLRIGGADYRVRDDL

SEQ ID NO: 100463 - protein, 27 aa, Mycobacterium avium
LRADRAEFGWMPAVDAWLGQWDEGFSA

SEQ ID NO: 100464 - protein, 22 aa, Mycobacterium avium
LRAETLVLCLALLHARTPDVPA

SEQ ID NO: 100465 - protein, 24 aa, Mycobacterium avium
LRAGAPAIDAVLCSTATRTRETLR

SEQ ID NO: 100466 - protein, 24 aa, Mycobacterium avium
LRAGIPSLILWTAGDQPLWGSHIK

SEQ ID NO: 100467 - protein, 25 aa, Mycobacterium avium
LRAGIPSLILWTAGDQPLWGSRIKQ

SEQ ID NO: 100468 - protein, 18 aa, Mycobacterium avium
LRAGPMRWTCVEPLKKWR

SEQ ID NO: 100469 - protein, 23 aa, Mycobacterium avium
LRAGRKRRHWMWFVFPQLRGLGG

SEQ ID NO: 100470 - protein, 21 aa, Mycobacterium avium
LRAHCRASLTPYEVPAQVFVV

SEQ ID NO: 100471 - protein, 18 aa, Mycobacterium avium
LRALAAPVRIAIVLQLRQ

SEQ ID NO: 100472 - protein, 18 aa, Mycobacterium avium
LRALASLPELVAAAPDGQ

SEQ ID NO: 100473 - protein, 18 aa, Mycobacterium avium
LRALPAPEYAAAGYRSPT

SEQ ID NO: 100474 - protein, 18 aa, Mycobacterium avium
LRALPREEWPSAIRRLVS

SEQ ID NO: 100475 - protein, 19 aa, Mycobacterium avium
LRAMLGTRLPRYMVPQRIV

SEQ ID NO: 100476 - protein, 20 aa, Mycobacterium avium
LRAPLLAALGAADLALATVN

SEQ ID NO: 100477 - protein, 18 aa, Mycobacterium avium
LRAPLRGVAPGQTLALYR

SEQ ID NO: 100478 - protein, 19 aa, Mycobacterium avium
LRAQAVLSVARRADELGWH

SEQ ID NO: 100479 - protein, 24 aa, Mycobacterium avium
LRAQRDPQLRECLIERRRAAADQA

SEQ ID NO: 100480 - protein, 22 aa, Mycobacterium avium
LRARLEAFGLPVVDVAATGAQP

SEQ ID NO: 100481 - protein, 22 aa, Mycobacterium avium
LRARVLKRWSVAPGTPPVTVVQ

SEQ ID NO: 100482 - protein, 21 aa, Mycobacterium avium
LRATINPKRVAAMTMQTVMFI

SEQ ID NO: 100483 - protein, 19 aa, Mycobacterium avium
LRAVPGLPVCQLRRSTGQH

SEQ ID NO: 100484 - protein, 17 aa, Mycobacterium avium
LRAWAYLSRVAEPPCPG

SEQ ID NO: 100485 - protein, 17 aa, Mycobacterium avium
LRCPGDLAVMGVDASPM

SEQ ID NO: 100486 - protein, 19 aa, Mycobacterium avium
LRDAFPHAALIEIPDCSAF

SEQ ID NO: 100487 - protein, 18 aa, Mycobacterium avium
LRDAGMRAYQRWLADFMS

SEQ ID NO: 100488 - protein, 17 aa, Mycobacterium avium
LRDALGYLHDQTVAGMN

SEQ ID NO: 100489 - protein, 18 aa, Mycobacterium avium
LRDALGYLHGQTVAGMNA

SEQ ID NO: 100490 - protein, 24 aa, Mycobacterium avium
LRDDPRFASAAARREHHDEFDEVL

SEQ ID NO: 100491 - protein, 17 aa, Mycobacterium avium
LRDGWCHTGDVGRFDHR

SEQ ID NO: 100492 - protein, 21 aa, Mycobacterium avium
LRDGWCRTGDMGRLDERGLLY

SEQ ID NO: 100493 - protein, 26 aa, Mycobacterium avium
LRDIWADGPLTFLGMMVPGLPNLFSI

SEQ ID NO: 100494 - protein, 25 aa, Mycobacterium avium
LRDLASRIFTDFTYRSGSTTISTGV

SEQ ID NO: 100495 - protein, 17 aa, Mycobacterium avium
LRDNLWYLIDAKAATAI

SEQ ID NO: 100496 - protein, 17 aa, Mycobacterium avium
LRDQRCRTPYCDAPIRH

SEQ ID NO: 100497 - protein, 23 aa, Mycobacterium avium
LRDRCARRPGWLGGSFPGDGAAL

SEQ ID NO: 100498 - protein, 19 aa, Mycobacterium avium
LRDRLALRGTQLFGKTLGV

SEQ ID NO: 100499 - protein, 19 aa, Mycobacterium avium
LRDRWYREGWYSRRTLVDA

SEQ ID NO: 100500 - protein, 18 aa, Mycobacterium avium
LRDTCARIGEHLPGGLPD

SEQ ID NO: 100501 - protein, 18 aa, Mycobacterium avium
LRDTCARLGEHLPGGLPD

SEQ ID NO: 100502 - protein, 18 aa, Mycobacterium avium
LRDVIAVVGVVADVRVAR

SEQ ID NO: 100503 - protein, 24 aa, Mycobacterium avium
LRDVLGWRAAEVAEAIGTTTAAVN

SEQ ID NO: 100504 - protein, 28 aa, Mycobacterium avium
LRDWRQWWHWVPGASWRHPSGPDSDIAD

SEQ ID NO: 100505 - protein, 31 aa, Mycobacterium avium
LREAQQCVFSFQDGPRGKVWDSNPPEALRLD

SEQ ID NO: 100506 - protein, 31 aa, Mycobacterium avium
LREFARSKLRGSRTPDRIVFRDELPTTPTGK

SEQ ID NO: 100507 - protein, 26 aa, Mycobacterium avium
LREGLACAVLRRPDHRETYDAMFDLW

SEQ ID NO: 100508 - protein, 18 aa, Mycobacterium avium
LREGRWASLRGISMGCSV

SEQ ID NO: 100509 - protein, 25 aa, Mycobacterium avium
LRERLGAGCSMSKIGARHLTTVDSV

SEQ ID NO: 100510 - protein, 18 aa, Mycobacterium avium
LRERRWGQLMLALYRAGR

SEQ ID NO: 100511 - protein, 17 aa, Mycobacterium avium
LRFAAAEVVPRLAGSSA

SEQ ID NO: 100512 - protein, 18 aa, Mycobacterium avium
LRFDRSTGQWVIIAALRQ

SEQ ID NO: 100513 - protein, 17 aa, Mycobacterium avium
LRFVLTEVRSDWLPVTL

SEQ ID NO: 100514 - protein, 18 aa, Mycobacterium avium
LRGAIEVARRVPATLERR

SEQ ID NO: 100515 - protein, 23 aa, Mycobacterium avium
LRGALVRDPRAWSGYLTEAIDTF

SEQ ID NO: 100516 - protein, 17 aa, Mycobacterium avium
LRGFLDDRARAVAAGKA

SEQ ID NO: 100517 - protein, 25 aa, Mycobacterium avium
LRGGKALRPALSIATCLGLGGHLEA

SEQ ID NO: 100518 - protein, 19 aa, Mycobacterium avium
LRGGPELSACSAQWQHVRA

SEQ ID NO: 100519 - protein, 31 aa, Mycobacterium avium
LRGGPFALGCFAGWLFTEFPPHVLTGHALSR

SEQ ID NO: 100520 - protein, 25 aa, Mycobacterium avium
LRGLAEIPWRLSIFGDGPDRQRLEA

SEQ ID NO: 100521 - protein, 19 aa, Mycobacterium avium
LRGLPGPRLLTGDLNMTPQ

SEQ ID NO: 100522 - protein, 19 aa, Mycobacterium avium
LRGMFELAAECLAPGGRLV

SEQ ID NO: 100523 - protein, 19 aa, Mycobacterium avium
LRGPGVTLFDVLRATEFVT

SEQ ID NO: 100524 - protein, 26 aa, Mycobacterium avium
LRGPRRLRRLRELAAEAVPRVRLRLY

SEQ ID NO: 100525 - protein, 18 aa, Mycobacterium avium
LRGRLDGLTIRDAARLGR

SEQ ID NO: 100526 - protein, 25 aa, Mycobacterium avium
LRGRPPRRVRRCPVRRARRPVRAPA

SEQ ID NO: 100527 - protein, 19 aa, Mycobacterium avium
LRGRRALVTGASSGIGKQV

SEQ ID NO: 100528 - protein, 18 aa, Mycobacterium avium
LRGSPPISNLRGDVATAA

SEQ ID NO: 100529 - protein, 25 aa, Mycobacterium avium
LRGTFFCMRAEIAHMIGHGGGAIVN

SEQ ID NO: 100530 - protein, 18 aa, Mycobacterium avium
LRGTVSFAPTAAGTRITE

SEQ ID NO: 100531 - protein, 19 aa, Mycobacterium avium
LRGVLVVSPHTSWLDVFAI

SEQ ID NO: 100532 - protein, 17 aa, Mycobacterium avium
LRGVVCAPDGAVDELDR

SEQ ID NO: 100533 - protein, 19 aa, Mycobacterium avium
LRGYAAWVSGLRRVEAPTR

SEQ ID NO: 100534 - protein, 17 aa, Mycobacterium avium
LRHESRKILGIPDLAVS

SEQ ID NO: 100535 - protein, 24 aa, Mycobacterium avium
LRHFDGDAALQCVSVEALFDPYAN

SEQ ID NO: 100536 - protein, 17 aa, Mycobacterium avium
LRHLLVLLAAGIDEALR

SEQ ID NO: 100537 - protein, 18 aa, Mycobacterium avium
LRHWERPLRAVSVLFDDE

SEQ ID NO: 100538 - protein, 21 aa, Mycobacterium avium
LRHYERRGLLTPARSDGGTRR

SEQ ID NO: 100539 - protein, 21 aa, Mycobacterium avium
LRILGRRTAVAASQCTELLAG

SEQ ID NO: 100540 - protein, 21 aa, Mycobacterium avium
LRIREELLRINAAVTGHRLLR

SEQ ID NO: 100541 - protein, 28 aa, Mycobacterium avium
LRIRPGNWAGAYACWGTENREAAVRFIV

SEQ ID NO: 100542 - protein, 22 aa, Mycobacterium avium
LRIYRGCLALADAEKVGIEAPN

SEQ ID NO: 100543 - protein, 18 aa, Mycobacterium avium
LRKEAYVLHARRYLAANG

SEQ ID NO: 100544 - protein, 18 aa, Mycobacterium avium
LRKEAYVLHARRYLADNG

SEQ ID NO: 100545 - protein, 18 aa, Mycobacterium avium
LRKIVSRGFSPRMVSELR

SEQ ID NO: 100546 - protein, 22 aa, Mycobacterium avium
LRKPVIRLGHNDPRFSGDPAVG

SEQ ID NO: 100547 - protein, 17 aa, Mycobacterium avium
LRKRYLEPLSVGGSSRE

SEQ ID NO: 100548 - protein, 17 aa, Mycobacterium avium
LRLARHRELVDGFEDPD

SEQ ID NO: 100549 - protein, 17 aa, Mycobacterium avium
LRLDRYLYTAMAYPTDY

SEQ ID NO: 100550 - protein, 17 aa, Mycobacterium avium
LRLDVLAQRDFRRPFDL

SEQ ID NO: 100551 - protein, 19 aa, Mycobacterium avium
LRLDVLAQRDFRRPFDLSK

SEQ ID NO: 100552 - protein, 17 aa, Mycobacterium avium
LRLEGLEVIGSVLPSAP

SEQ ID NO: 100553 - protein, 23 aa, Mycobacterium avium
LRLGHLLGQAILRSARRHEAADQ

SEQ ID NO: 100554 - protein, 17 aa, Mycobacterium avium
LRLKARLWFVHRGLEQL

SEQ ID NO: 100555 - protein, 19 aa, Mycobacterium avium
LRLLADCGRGEVIGSLARE

SEQ ID NO: 100556 - protein, 18 aa, Mycobacterium avium
LRLLAGAEHEAEHGALPP

SEQ ID NO: 100557 - protein, 19 aa, Mycobacterium avium
LRLLDRGYFRSGGEQYAEE

SEQ ID NO: 100558 - protein, 18 aa, Mycobacterium avium
LRLLEIFERETRRLRAPG

SEQ ID NO: 100559 - protein, 20 aa, Mycobacterium avium
LRLLLPGGLETTYRSSGNLL

SEQ ID NO: 100560 - protein, 18 aa, Mycobacterium avium
LRLLRNAFAHPAPPAPAP

SEQ ID NO: 100561 - protein, 17 aa, Mycobacterium avium
LRLPEAVRMSYDVSSLQ

SEQ ID NO: 100562 - protein, 17 aa, Mycobacterium avium
LRLPGRDIYAALKKGSG

SEQ ID NO: 100563 - protein, 33 aa, Mycobacterium avium
LRLSPEAVFKPRWLWKFGKTLWPPELRVPNQGR

SEQ ID NO: 100564 - protein, 19 aa, Mycobacterium avium
LRLSPLRPDERRTAVVDHE

SEQ ID NO: 100565 - protein, 19 aa, Mycobacterium avium
LRLVVVDYLQLMSSGKKVE

SEQ ID NO: 100566 - protein, 19 aa, Mycobacterium avium
LRLYPRLVSQGGRRSAADP

SEQ ID NO: 100567 - protein, 21 aa, Mycobacterium avium
LRMHQRWPIVMVDEFQDTDPV

SEQ ID NO: 100568 - protein, 22 aa, Mycobacterium avium
LRMLYEAWLQFGGRAGARQLSD

SEQ ID NO: 100569 - protein, 23 aa, Mycobacterium avium
LRNQGWRGSAGFMAGFRRVGAPH

SEQ ID NO: 100570 - protein, 23 aa, Mycobacterium avium
LRNVWAYVVICCGHLGEDTQKFA

SEQ ID NO: 100571 - protein, 21 aa, Mycobacterium avium
LRPAELHRFVELHGPRHTAPA

SEQ ID NO: 100572 - protein, 24 aa, Mycobacterium avium
LRPARAAVIAPSFTEPAAALSAAG

SEQ ID NO: 100573 - protein, 23 aa, Mycobacterium avium
LRPGELTERAHAVLPSYMVPQQV

SEQ ID NO: 100574 - protein, 20 aa, Mycobacterium avium
LRPGTTPEVYWRSRRFDLDD

SEQ ID NO: 100575 - protein, 43 aa, Mycobacterium avium
LRPLDGFPQRRARLMMEMHVLGPLHLCQLAIPAMRERGRGWIV

SEQ ID NO: 100576 - protein, 20 aa, Mycobacterium avium
LRPLPTTPPPVWVGGNSKPA

SEQ ID NO: 100577 - protein, 19 aa, Mycobacterium avium
LRPMEAFTLSVPRDIARTV

SEQ ID NO: 100578 - protein, 18 aa, Mycobacterium avium
LRPPQARVLLIAALAAGL

SEQ ID NO: 100579 - protein, 19 aa, Mycobacterium avium
LRPPQARVLLIAALAAGLP

SEQ ID NO: 100580 - protein, 20 aa, Mycobacterium avium
LRPRPHQTFRELLAQTRDGA

SEQ ID NO: 100581 - protein, 25 aa, Mycobacterium avium
LRPTVKFYEQVRVWMGKFDAQQRQA

SEQ ID NO: 100582 - protein, 21 aa, Mycobacterium avium
LRPVIDAVAARAPRPYDAGNH

SEQ ID NO: 100583 - protein, 20 aa, Mycobacterium avium
LRPVPPGVVGELYVAGAGVA

SEQ ID NO: 100584 - protein, 20 aa, Mycobacterium avium
LRPVPPGVVGELYVGGAGVA

SEQ ID NO: 100585 - protein, 17 aa, Mycobacterium avium
LRQAAILEVQRARTVID

SEQ ID NO: 100586 - protein, 19 aa, Mycobacterium avium
LRQAAPLLDTATMREGIDW

SEQ ID NO: 100587 - protein, 17 aa, Mycobacterium avium
LRQATILEVQRARTVID

SEQ ID NO: 100588 - protein, 17 aa, Mycobacterium avium
LRQAWPDGTEPFCGVAV

SEQ ID NO: 100589 - protein, 26 aa, Mycobacterium avium
LRQKRLMTLIHLWLVHRFKADAVIYV

SEQ ID NO: 100590 - protein, 17 aa, Mycobacterium avium
LRRALIFPVCDLALHSW

SEQ ID NO: 100591 - protein, 19 aa, Mycobacterium avium
LRRAQADPGLRQDLATLAG

SEQ ID NO: 100592 - protein, 19 aa, Mycobacterium avium
LRRAQEFERAAGRVRGERW

SEQ ID NO: 100593 - protein, 18 aa, Mycobacterium avium
LRRARAMAMVMLALPGAV

SEQ ID NO: 100594 - protein, 21 aa, Mycobacterium avium
LRRARANSVLVGRADALRDRA

SEQ ID NO: 100595 - protein, 21 aa, Mycobacterium avium
LRRAVRLLAQLTRQVAVVQYP

SEQ ID NO: 100596 - protein, 28 aa, Mycobacterium avium
LRRCREVTSLLGLFGRLVEIIGVDCRQL

SEQ ID NO: 100597 - protein, 18 aa, Mycobacterium avium
LRRDELLMYLTVIATAGS

SEQ ID NO: 100598 - protein, 18 aa, Mycobacterium avium
LRRGRGVVVDATFGNPGE

SEQ ID NO: 100599 - protein, 19 aa, Mycobacterium avium
LRRIAGRDERSWVQELAPD

SEQ ID NO: 100600 - protein, 20 aa, Mycobacterium avium
LRRIAGRDERSWVQELAPDP

SEQ ID NO: 100601 - protein, 18 aa, Mycobacterium avium
LRRKFRAIWIGGRTPPAG

SEQ ID NO: 100602 - protein, 19 aa, Mycobacterium avium
LRRLAGLWLAGQDRGWAAI

SEQ ID NO: 100603 - protein, 19 aa, Mycobacterium avium
LRRLAPRSRITCDITSIES

SEQ ID NO: 100604 - protein, 18 aa, Mycobacterium avium
LRRLGATMRFEFNSLPFT

SEQ ID NO: 100605 - protein, 26 aa, Mycobacterium avium
LRRLGIPGDFKGGFRVTTPEVLDVAR

SEQ ID NO: 100606 - protein, 20 aa, Mycobacterium avium
LRRLIPPWVTLGSRLAALPK

SEQ ID NO: 100607 - protein, 17 aa, Mycobacterium avium
LRRLISLFELLRARSQL

SEQ ID NO: 100608 - protein, 20 aa, Mycobacterium avium
LRRRGAQVASRVSGRVGEEM

SEQ ID NO: 100609 - protein, 19 aa, Mycobacterium avium
LRRYMNWIPADYVDAMAPM

SEQ ID NO: 100610 - protein, 20 aa, Mycobacterium avium
LRRYMNWIPADYVDAMAPTT

SEQ ID NO: 100611 - protein, 20 aa, Mycobacterium avium
LRRYVPFDVDAGILSASATA

SEQ ID NO: 100612 - protein, 25 aa, Mycobacterium avium
LRSGAEMARLFAWRPQAVTAAAELG

SEQ ID NO: 100613 - protein, 17 aa, Mycobacterium avium
LRSIAHLGVRTRDYAFA

SEQ ID NO: 100614 - protein, 18 aa, Mycobacterium avium
LRSIAHLGVRTRDYAFAV

SEQ ID NO: 100615 - protein, 17 aa, Mycobacterium avium
LRSIFAVGVDRSDREPA

SEQ ID NO: 100616 - protein, 20 aa, Mycobacterium avium
LRSLLRDYQDSFGLGDDGWV

SEQ ID NO: 100617 - protein, 18 aa, Mycobacterium avium
LRSRCRHVALVTPSTEAI

SEQ ID NO: 100618 - protein, 21 aa, Mycobacterium avium
LRSRVFFDWFDEAGVDDIPAV

SEQ ID NO: 100619 - protein, 18 aa, Mycobacterium avium
LRSWLSVHAKEFASSGDD

SEQ ID NO: 100620 - protein, 17 aa, Mycobacterium avium
LRTALTERLPAYLVPAA

SEQ ID NO: 100621 - protein, 20 aa, Mycobacterium avium
LRTDYSLGAFAVWLRDFLDE

SEQ ID NO: 100622 - protein, 18 aa, Mycobacterium avium
LRTFYRIRQSWAGKAVLL

SEQ ID NO: 100623 - protein, 21 aa, Mycobacterium avium
LRTGQYRACGAVNPDVQPRPT

SEQ ID NO: 100624 - protein, 27 aa, Mycobacterium avium
LRTIGIDLRQDWPAALQDAGFDPAQPT

SEQ ID NO: 100625 - protein, 18 aa, Mycobacterium avium
LRTVAVDLRDDWSTALAT

SEQ ID NO: 100626 - protein, 24 aa, Mycobacterium avium
LRTVAVDLRDDWSTALATAGLDSS

SEQ ID NO: 100627 - protein, 20 aa, Mycobacterium avium
LRTYRGVLDAGRVVEFMLLD

SEQ ID NO: 100628 - protein, 17 aa, Mycobacterium avium
LRVAERGLAAALAELAP

SEQ ID NO: 100629 - protein, 18 aa, Mycobacterium avium
LRVAYRPVFPNVYLPAQV

SEQ ID NO: 100630 - protein, 17 aa, Mycobacterium avium
LRVEDDGAGGWSLEVPE

SEQ ID NO: 100631 - protein, 20 aa, Mycobacterium avium
LRVESRCPRGEVVEVSAHVG

SEQ ID NO: 100632 - protein, 17 aa, Mycobacterium avium
LRVGLGYVAAAIVAGAT

SEQ ID NO: 100633 - protein, 18 aa, Mycobacterium avium
LRVGMRVQPVFCDYPEHD

SEQ ID NO: 100634 - protein, 18 aa, Mycobacterium avium
LRVGQPVVAIGSPLGLSG

SEQ ID NO: 100635 - protein, 21 aa, Mycobacterium avium
LRVGTRVRFSFRRLFTASDVH

SEQ ID NO: 100636 - protein, 20 aa, Mycobacterium avium
LRVLAEVVYDPWIEQRPLRI

SEQ ID NO: 100637 - protein, 26 aa, Mycobacterium avium
LRVLTRREFAGMISVAIESGDGAETT

SEQ ID NO: 100638 - protein, 25 aa, Mycobacterium avium
LRVPQPGRLELVLAHPSGITEIEVG

SEQ ID NO: 100639 - protein, 20 aa, Mycobacterium avium
LRVRAFELASEIAARRPNGV

SEQ ID NO: 100640 - protein, 22 aa, Mycobacterium avium
LRVSELPYLVPVLEQSFDHPDY

SEQ ID NO: 100641 - protein, 26 aa, Mycobacterium avium
LRVSPGELRRRFALAARIRPRRSLTG

SEQ ID NO: 100642 - protein, 24 aa, Mycobacterium avium
LRVVDARAALAARGYCSDETVTVA

SEQ ID NO: 100643 - protein, 18 aa, Mycobacterium avium
LRVVEVGSRTGLITERLT

SEQ ID NO: 100644 - protein, 20 aa, Mycobacterium avium
LRYEPLGVVAAMTPWNFPHT

SEQ ID NO: 100645 - protein, 20 aa, Mycobacterium avium
LRYIATLIQVFARVARPTGD

SEQ ID NO: 100646 - protein, 20 aa, Mycobacterium avium
LRYIATLIRVFIRVARPAAD

SEQ ID NO: 100647 - protein, 20 aa, Mycobacterium avium
LRYIATLIRVFTRVARPAAD

SEQ ID NO: 100648 - protein, 20 aa, Mycobacterium avium
LSAAACRRVAVAAHDGLARS

SEQ ID NO: 100649 - protein, 26 aa, Mycobacterium avium
LSAELPDLLAVLSVRLGRIDRVLYHL

SEQ ID NO: 100650 - protein, 20 aa, Mycobacterium avium
LSAFAERSRFAEAFRSTGKS

SEQ ID NO: 100651 - protein, 17 aa, Mycobacterium avium
LSAFSAYERQIFESGLV

SEQ ID NO: 100652 - protein, 19 aa, Mycobacterium avium
LSAHLRLEPDLDYGKVIDG

SEQ ID NO: 100653 - protein, 17 aa, Mycobacterium avium
LSALGYFDAGAMLRLQS

SEQ ID NO: 100654 - protein, 23 aa, Mycobacterium avium
LSAPGSRLAFDFVPDTAVFADPR

SEQ ID NO: 100655 - protein, 24 aa, Mycobacterium avium
LSAPGSRLAFDFVPDTAVFADPRW

SEQ ID NO: 100656 - protein, 23 aa, Mycobacterium avium
LSARSERALALQAQRLSAHLAER

SEQ ID NO: 100657 - protein, 22 aa, Mycobacterium avium
LSASSARWPACANRQDTVPADG

SEQ ID NO: 100658 - protein, 17 aa, Mycobacterium avium
LSAVPFDLAQLGEWATR

SEQ ID NO: 100659 - protein, 17 aa, Mycobacterium avium
LSAWPPAGATKVDIADG

SEQ ID NO: 100660 - protein, 17 aa, Mycobacterium avium
LSAWPPEHRPAVRRRGG

SEQ ID NO: 100661 - protein, 18 aa, Mycobacterium avium
LSDEAEWINGQVWYIGGA

SEQ ID NO: 100662 - protein, 19 aa, Mycobacterium avium
LSDEAEWINGQVWYIGGAS

SEQ ID NO: 100663 - protein, 18 aa, Mycobacterium avium
LSDICAFVTGQTIYADGG

SEQ ID NO: 100664 - protein, 21 aa, Mycobacterium avium
LSDPCGYLTRLRELVGPDAWI

SEQ ID NO: 100665 - protein, 17 aa, Mycobacterium avium
LSDVWTWAGTGSVHDSS

SEQ ID NO: 100666 - protein, 21 aa, Mycobacterium avium
LSERGLAGTMQYLFDTVQSKL

SEQ ID NO: 100667 - protein, 20 aa, Mycobacterium avium
LSFDECRVPAAAILGDEPGR

SEQ ID NO: 100668 - protein, 18 aa, Mycobacterium avium
LSFEWSENFPDSKIREIS

SEQ ID NO: 100669 - protein, 17 aa, Mycobacterium avium
LSFGGGPHRCLGSHLAR

SEQ ID NO: 100670 - protein, 18 aa, Mycobacterium avium
LSGLAVRLTIPGAAPADT

SEQ ID NO: 100671 - protein, 20 aa, Mycobacterium avium
LSGLHLGKVLSISEATGNAP

SEQ ID NO: 100672 - protein, 25 aa, Mycobacterium avium
LSGQGCAFPTRMLVERSVYDEVIER

SEQ ID NO: 100673 - protein, 19 aa, Mycobacterium avium
LSGRGWRVTSRTIAELHAA

SEQ ID NO: 100674 - protein, 20 aa, Mycobacterium avium
LSGRGWRVTSRTIAELHAAN

SEQ ID NO: 100675 - protein, 18 aa, Mycobacterium avium
LSIFGMPPLEFISLTAEL

SEQ ID NO: 100676 - protein, 17 aa, Mycobacterium avium
LSIPPSWATATPSIRTV

SEQ ID NO: 100677 - protein, 25 aa, Mycobacterium avium
LSKGLPGLAEWTVGFLEDLVLGPLE

SEQ ID NO: 100678 - protein, 17 aa, Mycobacterium avium
LSKLRGFIYEESRNIFD

SEQ ID NO: 100679 - protein, 27 aa, Mycobacterium avium
LSLGKLGLRPGMTLLDVGCGWGATMRR

SEQ ID NO: 100680 - protein, 30 aa, Mycobacterium avium
LSLPTEANFYRPLIEHPKVMRVVALSGGYS

SEQ ID NO: 100681 - protein, 17 aa, Mycobacterium avium
LSLRRWRRTLTANAAAN

SEQ ID NO: 100682 - protein, 30 aa, Mycobacterium avium
LSMGIVLIDACKPFAWKDSYPRANRFDDNY

SEQ ID NO: 100683 - protein, 17 aa, Mycobacterium avium
LSPAGVEPFGCLRSTPP

SEQ ID NO: 100684 - protein, 17 aa, Mycobacterium avium
LSPEGLEDLTLVVAGEA

SEQ ID NO: 100685 - protein, 17 aa, Mycobacterium avium
LSPEGLESTALVVAGEA

SEQ ID NO: 100686 - protein, 17 aa, Mycobacterium avium
LSPHPLLTYAIEQTAAS

SEQ ID NO: 100687 - protein, 29 aa, Mycobacterium avium
LSPILLVRGDFLAGVPLQIADGYHRVCAS

SEQ ID NO: 100688 - protein, 24 aa, Mycobacterium avium
LSPQNGCRMGICHTCTRRKTAGTV

SEQ ID NO: 100689 - protein, 19 aa, Mycobacterium avium
LSPRVARVAALPVPTDRER

SEQ ID NO: 100690 - protein, 17 aa, Mycobacterium avium
LSPRYFAFWNKWDPGAI

SEQ ID NO: 100691 - protein, 34 aa, Mycobacterium avium
LSPVSRTSVVFDRTKWPFKPDVVADGGNVAVSPD

SEQ ID NO: 100692 - protein, 20 aa, Mycobacterium avium
LSQEFPMLFIEDLLDGDDWA

SEQ ID NO: 100693 - protein, 25 aa, Mycobacterium avium
LSQTEWGCIGNERIMQIDGAGFMSL

SEQ ID NO: 100694 - protein, 18 aa, Mycobacterium avium
LSRKYGLRQTVIDPAHFQ

SEQ ID NO: 100695 - protein, 18 aa, Mycobacterium avium
LSRLGCRAVGESRDQEAT

SEQ ID NO: 100696 - protein, 19 aa, Mycobacterium avium
LSRLPAPPLPTARLRPRPI

SEQ ID NO: 100697 - protein, 24 aa, Mycobacterium avium
LSRLPAPPLPTARLRPRPIPERKG

SEQ ID NO: 100698 - protein, 25 aa, Mycobacterium avium
LSRLPAPPLPTARLRPRPMPERKGS

SEQ ID NO: 100699 - protein, 17 aa, Mycobacterium avium
LSRRGRDLAAGKVITAA

SEQ ID NO: 100700 - protein, 17 aa, Mycobacterium avium
LSRRYGNVFTLRLPMWG

SEQ ID NO: 100701 - protein, 17 aa, Mycobacterium avium
LSSAPVWCSDIRAGAGL

SEQ ID NO: 100702 - protein, 25 aa, Mycobacterium avium
LSSHPADLLPAVGLIKTITDTVPGL

SEQ ID NO: 100703 - protein, 20 aa, Mycobacterium avium
LSSPEIKDWIEFARDTDGDW

SEQ ID NO: 100704 - protein, 21 aa, Mycobacterium avium
LSSPEIKDWIEFARDTDGDWP

SEQ ID NO: 100705 - protein, 22 aa, Mycobacterium avium
LSSPEIKHWIEFARDTDGDWPS

SEQ ID NO: 100706 - protein, 17 aa, Mycobacterium avium
LSSSVWKLFYRVKSSVL

SEQ ID NO: 100707 - protein, 25 aa, Mycobacterium avium
LSTFPHPRYELIPQMIVHDGEAAVR

SEQ ID NO: 100708 - protein, 18 aa, Mycobacterium avium
LSTGMLLRPVQPPPSEGW

SEQ ID NO: 100709 - protein, 18 aa, Mycobacterium avium
LSTITPFVAHWTERGVVP

SEQ ID NO: 100710 - protein, 17 aa, Mycobacterium avium
LSVRVLFEAPTIAQLAA

SEQ ID NO: 100711 - protein, 26 aa, Mycobacterium avium
LSYAKLRGGSGIQWPCNTDHPDGIEG

SEQ ID NO: 100712 - protein, 26 aa, Mycobacterium avium
LSYAKLRGGSGIQWPCNTDHPDGIER

SEQ ID NO: 100713 - protein, 18 aa, Mycobacterium avium
LTAARLRSALPRGGADVE

SEQ ID NO: 100714 - protein, 25 aa, Mycobacterium avium
LTAELAALCRAELAGYKQPRRFVFW

SEQ ID NO: 100715 - protein, 22 aa, Mycobacterium avium
LTAFCPPSGPGVRVDTYGRPGL

SEQ ID NO: 100716 - protein, 17 aa, Mycobacterium avium
LTAFIGASPHERVTSRG

SEQ ID NO: 100717 - protein, 24 aa, Mycobacterium avium
LTAHPAQVREWYAGEDGLDLRALD

SEQ ID NO: 100718 - protein, 18 aa, Mycobacterium avium
LTALLRATLAVVRGAAAE

SEQ ID NO: 100719 - protein, 18 aa, Mycobacterium avium
LTALPMRRAIVMVICGKA

SEQ ID NO: 100720 - protein, 23 aa, Mycobacterium avium
LTANAYLGAWGIVDCLGDGADVV

SEQ ID NO: 100721 - protein, 25 aa, Mycobacterium avium
LTARCRRWPHASAICDDVLRAVDPA

SEQ ID NO: 100722 - protein, 25 aa, Mycobacterium avium
LTARCRRWPHASAICDDVLRAVDPT

SEQ ID NO: 100723 - protein, 17 aa, Mycobacterium avium
LTARFEAARPRLGALAY

SEQ ID NO: 100724 - protein, 23 aa, Mycobacterium avium
LTARRIVRRWSRSQAVYGDSDSR

SEQ ID NO: 100725 - protein, 31 aa, Mycobacterium avium
LTAWDRRPNCERPEYLPTVLSDVLKASRASP

SEQ ID NO: 100726 - protein, 23 aa, Mycobacterium avium
LTDAARRWPDRTAVLDASGGTGF

SEQ ID NO: 100727 - protein, 25 aa, Mycobacterium avium
LTDIGWLEMLWMQPVGINSHPAALP

SEQ ID NO: 100728 - protein, 18 aa, Mycobacterium avium
LTDLCRWHPAKAAQLIMT

SEQ ID NO: 100729 - protein, 34 aa, Mycobacterium avium
LTDMIRFGSLFLREGVSLTGRRVLPEAWIADTLR

SEQ ID NO: 100730 - protein, 22 aa, Mycobacterium avium
LTEAIRVQIVWGTKDVVVPVRH

SEQ ID NO: 100731 - protein, 19 aa, Mycobacterium avium
LTEALSVEWQRHGVRVADV

SEQ ID NO: 100732 - protein, 21 aa, Mycobacterium avium
LTELRAIFVHSLRSVVQGAAD

SEQ ID NO: 100733 - protein, 22 aa, Mycobacterium avium
LTERRRGVVVNPVLETSEIPET

SEQ ID NO: 100734 - protein, 23 aa, Mycobacterium avium
LTESNITSGFRKGWYPFNKTLGK

SEQ ID NO: 100735 - protein, 25 aa, Mycobacterium avium
LTFLDREGWDALTINALATQLGTKG

SEQ ID NO: 100736 - protein, 18 aa, Mycobacterium avium
LTFLRGPRTWVLKSPQHC

SEQ ID NO: 100737 - protein, 17 aa, Mycobacterium avium
LTGCAKLFREGYTDVNQ

SEQ ID NO: 100738 - protein, 31 aa, Mycobacterium avium
LTGDGRGTVYLATRGGYFVLDLGTGRVVRVG

SEQ ID NO: 100739 - protein, 24 aa, Mycobacterium avium
LTGEAAAYARTWSLLRASDAALDR

SEQ ID NO: 100740 - protein, 22 aa, Mycobacterium avium
LTGEPLPALLPATAAAQRYGAI

SEQ ID NO: 100741 - protein, 17 aa, Mycobacterium avium
LTGEPLPPVLAATAAAQ

SEQ ID NO: 100742 - protein, 22 aa, Mycobacterium avium
LTGIRKLAWPKLKQHYGERLEQ

SEQ ID NO: 100743 - protein, 19 aa, Mycobacterium avium
LTGKFKDSYTELVHDVVIP

SEQ ID NO: 100744 - protein, 22 aa, Mycobacterium avium
LTGMKLVLFDAFDPVETPVAIA

SEQ ID NO: 100745 - protein, 21 aa, Mycobacterium avium
LTGMWLVLFEAFDPAATPLAI

SEQ ID NO: 100746 - protein, 18 aa, Mycobacterium avium
LTGRENLVLFGRLRGLNR

SEQ ID NO: 100747 - protein, 18 aa, Mycobacterium avium
LTGRYAMAVLGAGLDAAE

SEQ ID NO: 100748 - protein, 17 aa, Mycobacterium avium
LTGTLQIRGTARNRVID

SEQ ID NO: 100749 - protein, 25 aa, Mycobacterium avium
LTGTVRSSLWLSMADGLPYGVLEPT

SEQ ID NO: 100750 - protein, 20 aa, Mycobacterium avium
LTHGQRAMVLVARVLPQPVL

SEQ ID NO: 100751 - protein, 19 aa, Mycobacterium avium
LTIVSWLPFYHDMGLVLGV

SEQ ID NO: 100752 - protein, 17 aa, Mycobacterium avium
LTKRLARTVFFGAAPTI

SEQ ID NO: 100753 - protein, 30 aa, Mycobacterium avium
LTLGTAVDWRFAATVGRRLARPGPPSTDYT

SEQ ID NO: 100754 - protein, 20 aa, Mycobacterium avium
LTLRAAPAIKAFDRPVTLTW

SEQ ID NO: 100755 - protein, 17 aa, Mycobacterium avium
LTLRGALVRDPRAWSGY

SEQ ID NO: 100756 - protein, 18 aa, Mycobacterium avium
LTLSAFANKVTVGFTSDI

SEQ ID NO: 100757 - protein, 29 aa, Mycobacterium avium
LTPEDLRPGWSMPSAEQFTFGYADEHIDA

SEQ ID NO: 100758 - protein, 24 aa, Mycobacterium avium
LTPGCTKQACDFRDSLAELNGAGL

SEQ ID NO: 100759 - protein, 18 aa, Mycobacterium avium
LTPLRGNELWQIALLELW

SEQ ID NO: 100760 - protein, 24 aa, Mycobacterium avium
LTPPRFADRFEHVYGRHDGFRRNH

SEQ ID NO: 100761 - protein, 27 aa, Mycobacterium avium
LTPRMRRIRFSGPRLQGLGWTPGQHIR

SEQ ID NO: 100762 - protein, 27 aa, Mycobacterium avium
LTPTAVEEVVRWASPVVYMRRTLTRDV

SEQ ID NO: 100763 - protein, 25 aa, Mycobacterium avium
LTPVFATKTKLEWEHELTAQNVGCV

SEQ ID NO: 100764 - protein, 17 aa, Mycobacterium avium
LTQLALGVGRQYVAQTR

SEQ ID NO: 100765 - protein, 24 aa, Mycobacterium avium
LTRARAVIEWGMRCTCPSIDACTC

SEQ ID NO: 100766 - protein, 22 aa, Mycobacterium avium
LTRERVLALGLRLLDRGYFRSG

SEQ ID NO: 100767 - protein, 17 aa, Mycobacterium avium
LTRLRRRGLLLAVVTNQ

SEQ ID NO: 100768 - protein, 18 aa, Mycobacterium avium
LTRLRRRGLLLAVVTNQS

SEQ ID NO: 100769 - protein, 21 aa, Mycobacterium avium
LTRMRCAHVLTDDAGYLYTRY

SEQ ID NO: 100770 - protein, 33 aa, Mycobacterium avium
LTRNAAAYWRSRAKEAGGRIFGRIVNTASEAGL

SEQ ID NO: 100771 - protein, 19 aa, Mycobacterium avium
LTRRGHEVLVQSGAGEGSS

SEQ ID NO: 100772 - protein, 22 aa, Mycobacterium avium
LTRRPDYAWPPSSWPNQGPAYV

SEQ ID NO: 100773 - protein, 18 aa, Mycobacterium avium
LTRWAIGELVASDVDVEG

SEQ ID NO: 100774 - protein, 24 aa, Mycobacterium avium
LTSAPYGALAVRDWHANLISFVHE

SEQ ID NO: 100775 - protein, 17 aa, Mycobacterium avium
LTSHVWRQDHNGASHQD

SEQ ID NO: 100776 - protein, 27 aa, Mycobacterium avium
LTSPGALPYYIQKGASFIGVQLDAGDY

SEQ ID NO: 100777 - protein, 19 aa, Mycobacterium avium
LTSQGHAPNAWAVLGAVAQ

SEQ ID NO: 100778 - protein, 24 aa, Mycobacterium avium
LTSQGHAPNAWAVLGAVAQATERV

SEQ ID NO: 100779 - protein, 17 aa, Mycobacterium avium
LTSRACQAVRAVLTGNR

SEQ ID NO: 100780 - protein, 18 aa, Mycobacterium avium
LTSRACQAVRAVLTGNRR

SEQ ID NO: 100781 - protein, 17 aa, Mycobacterium avium
LTSTELWPVALKEIDLG

SEQ ID NO: 100782 - protein, 35 aa, Mycobacterium avium
LTTCKHCSGRLRKRFNSVGVVFKGSGFYRTDSRES

SEQ ID NO: 100783 - protein, 23 aa, Mycobacterium avium
LTTEEFPIVLSVGERRAYTANDI

SEQ ID NO: 100784 - protein, 24 aa, Mycobacterium avium
LTTEEFPIVLSVGERRAYTANDIF

SEQ ID NO: 100785 - protein, 20 aa, Mycobacterium avium
LTTRKVWREPVGVVGAIVPW

SEQ ID NO: 100786 - protein, 18 aa, Mycobacterium avium
LTTTDGQLWCADVVVAAY

SEQ ID NO: 100787 - protein, 20 aa, Mycobacterium avium
LTVDLLRPVALQPLQMHSSV

SEQ ID NO: 100788 - protein, 20 aa, Mycobacterium avium
LTVDLPRPTALEPLRVHTQV

SEQ ID NO: 100789 - protein, 21 aa, Mycobacterium avium
LTVDLPRPTALEPLRVHTQVR

SEQ ID NO: 100790 - protein, 19 aa, Mycobacterium avium
LTWPTSRVSLPSHPRASHA

SEQ ID NO: 100791 - protein, 19 aa, Mycobacterium avium
LTWQNPRTLAAMVGNGQAP

SEQ ID NO: 100792 - protein, 20 aa, Mycobacterium avium
LTYRGMVIGTGIVRSFFIHA

SEQ ID NO: 100793 - protein, 17 aa, Mycobacterium avium
LTYRHMLEGEPAVLDTR

SEQ ID NO: 100794 - protein, 23 aa, Mycobacterium avium
LVAARGALMAALPPGGVMVAVTA

SEQ ID NO: 100795 - protein, 20 aa, Mycobacterium avium
LVACDRIPPGPGQIEVAVSA

SEQ ID NO: 100796 - protein, 23 aa, Mycobacterium avium
LVADPNVPLPGFVLKRAVKGTID

SEQ ID NO: 100797 - protein, 18 aa, Mycobacterium avium
LVADRWSTDSDFVSHGAT

SEQ ID NO: 100798 - protein, 28 aa, Mycobacterium avium
LVAECLRTGAWSGLKPAELAAVVSSVLY

SEQ ID NO: 100799 - protein, 25 aa, Mycobacterium avium
LVAEYGITWILPRLAGWGAAMDLLL

SEQ ID NO: 100800 - protein, 18 aa, Mycobacterium avium
LVAFLLGVGYPADRPLTP

SEQ ID NO: 100801 - protein, 24 aa, Mycobacterium avium
LVAHLRQAGAFVFAMVGAVAQARA

SEQ ID NO: 100802 - protein, 25 aa, Mycobacterium avium
LVAHLRQAGAFVFVMVGTVAQARAA

SEQ ID NO: 100803 - protein, 17 aa, Mycobacterium avium
LVALPLLAGYDIDARDP

SEQ ID NO: 100804 - protein, 26 aa, Mycobacterium avium
LVAMTTLDLTRSWARLDVDVSVLDWE

SEQ ID NO: 100805 - protein, 25 aa, Mycobacterium avium
LVARFPGHQILGIPMRDASRPCHQT

SEQ ID NO: 100806 - protein, 17 aa, Mycobacterium avium
LVATNFFGVNTIPIAQN

SEQ ID NO: 100807 - protein, 24 aa, Mycobacterium avium
LVDASARAAVRFAEPVFAASQTPQ

SEQ ID NO: 100808 - protein, 19 aa, Mycobacterium avium
LVDECIGAFGRLDALINCA

SEQ ID NO: 100809 - protein, 22 aa, Mycobacterium avium
LVDHPRVLAVLDRLLMPNYLLS

SEQ ID NO: 100810 - protein, 24 aa, Mycobacterium avium
LVDLAPRPALPHITEEDLATGAWA

SEQ ID NO: 100811 - protein, 19 aa, Mycobacterium avium
LVDRWAPGRTMINAYGPTE

SEQ ID NO: 100812 - protein, 17 aa, Mycobacterium avium
LVDVSLYALAQVVQPTA

SEQ ID NO: 100813 - protein, 19 aa, Mycobacterium avium
LVEGRRLTKVVGLAGAHRR

SEQ ID NO: 100814 - protein, 23 aa, Mycobacterium avium
LVEKTGQEMLFRKADVRDKAVLQ

SEQ ID NO: 100815 - protein, 19 aa, Mycobacterium avium
LVELCGPGGDTWSWGPPEA

SEQ ID NO: 100816 - protein, 17 aa, Mycobacterium avium
LVEPGWARALQPVAEQV

SEQ ID NO: 100817 - protein, 24 aa, Mycobacterium avium
LVETEKYVAAGLWHTADNLPELAA

SEQ ID NO: 100818 - protein, 24 aa, Mycobacterium avium
LVETEKYVAAGLWHTADSLPELAA

SEQ ID NO: 100819 - protein, 17 aa, Mycobacterium avium
LVFPRVLAGRIVKHRGR

SEQ ID NO: 100820 - protein, 24 aa, Mycobacterium avium
LVGDELRAGPGLVYGYTAELDTAA

SEQ ID NO: 100821 - protein, 26 aa, Mycobacterium avium
LVGFYEIVTRVSAVWANELFAEIPTP

SEQ ID NO: 100822 - protein, 20 aa, Mycobacterium avium
LVGGWQDLFIRQTLQQYAHL

SEQ ID NO: 100823 - protein, 19 aa, Mycobacterium avium
LVGHRRVGPVGGQRQPLGH

SEQ ID NO: 100824 - protein, 17 aa, Mycobacterium avium
LVGKLSIPPSWATATPS

SEQ ID NO: 100825 - protein, 18 aa, Mycobacterium avium
LVGLQWGAGLVVPIAPAA

SEQ ID NO: 100826 - protein, 23 aa, Mycobacterium avium
LVGNFDPREAITHGYVDSQKLPA

SEQ ID NO: 100827 - protein, 22 aa, Mycobacterium avium
LVGPNLWAGVGLVRGGAGTALV

SEQ ID NO: 100828 - protein, 18 aa, Mycobacterium avium
LVGSLGHRVGHHHQAAAV

SEQ ID NO: 100829 - protein, 20 aa, Mycobacterium avium
LVGTSRAMLTLARRHAVDRV

SEQ ID NO: 100830 - protein, 18 aa, Mycobacterium avium
LVHLRFASKRQWDCTAAC

SEQ ID NO: 100831 - protein, 22 aa, Mycobacterium avium
LVIGGSCQRTWEHAVPKTTAPV

SEQ ID NO: 100832 - protein, 24 aa, Mycobacterium avium
LVIPRPDGLRDIGYLTDLLAREGI

SEQ ID NO: 100833 - protein, 23 aa, Mycobacterium avium
LVLDGLRLAAAVVGAERGYVYVS

SEQ ID NO: 100834 - protein, 17 aa, Mycobacterium avium
LVLQWLERLELADGKLI

SEQ ID NO: 100835 - protein, 23 aa, Mycobacterium avium
LVNSDPYGAGWLLDVQVSDAAAL

SEQ ID NO: 100836 - protein, 26 aa, Mycobacterium avium
LVPALAKLWAHACEWEDNPPKSLRLL

SEQ ID NO: 100837 - protein, 23 aa, Mycobacterium avium
LVPEVVDAVAPVPVLAAGGIARG

SEQ ID NO: 100838 - protein, 18 aa, Mycobacterium avium
LVPHLARGLGPGPHVHAH

SEQ ID NO: 100839 - protein, 26 aa, Mycobacterium avium
LVPLIPKPVFRRLLSVVTGGAATVVS

SEQ ID NO: 100840 - protein, 19 aa, Mycobacterium avium
LVQRLDRWASGRDDDVTVV

SEQ ID NO: 100841 - protein, 29 aa, Mycobacterium avium
LVQYPNVNPALLLKCLLMATTEGIASGDP

SEQ ID NO: 100842 - protein, 25 aa, Mycobacterium avium
LVRDEWPPLYVFGTRTVPQIDLLVG

SEQ ID NO: 100843 - protein, 28 aa, Mycobacterium avium
LVRMRACGICGSDAFYISIGGVPPRQGH

SEQ ID NO: 100844 - protein, 19 aa, Mycobacterium avium
LVRRPKLVAMTTLDLTRSW

SEQ ID NO: 100845 - protein, 24 aa, Mycobacterium avium
LVRSRSCAKWLASEDFSETIGHLR

SEQ ID NO: 100846 - protein, 25 aa, Mycobacterium avium
LVRSTMTAIEWLFWRSTKKVDNAQR

SEQ ID NO: 100847 - protein, 18 aa, Mycobacterium avium
LVRYWRLLKFKLANPHII

SEQ ID NO: 100848 - protein, 25 aa, Mycobacterium avium
LVSGGRLAAAVTRAGGLGLIGGGYP

SEQ ID NO: 100849 - protein, 18 aa, Mycobacterium avium
LVSGRASFELAQKTVMAG

SEQ ID NO: 100850 - protein, 19 aa, Mycobacterium avium
LVSSAGPAWARLADPEQSW

SEQ ID NO: 100851 - protein, 20 aa, Mycobacterium avium
LVSSAGPAWARLADPEQSWL

SEQ ID NO: 100852 - protein, 26 aa, Mycobacterium avium
LVTRPAAACSGHFYTDEEILREEGRA

SEQ ID NO: 100853 - protein, 17 aa, Mycobacterium avium
LVTSRWPAAGVDLTGKR

SEQ ID NO: 100854 - protein, 17 aa, Mycobacterium avium
LVVPVRIRRSMLVVHCG

SEQ ID NO: 100855 - protein, 19 aa, Mycobacterium avium
LVVRRRITFLAKSEYFTGT

SEQ ID NO: 100856 - protein, 20 aa, Mycobacterium avium
LWADRLPGAVLAIGNAPTAL

SEQ ID NO: 100857 - protein, 21 aa, Mycobacterium avium
LWADRLPGAVLAIGNAPTALF

SEQ ID NO: 100858 - protein, 18 aa, Mycobacterium avium
LWAGQTWPRPEGLQLCYV

SEQ ID NO: 100859 - protein, 26 aa, Mycobacterium avium
LWARSGYLHPHWPKPYGRGADSVEQL

SEQ ID NO: 100860 - protein, 17 aa, Mycobacterium avium
LWFQAARRAGFDVAAVI

SEQ ID NO: 100861 - protein, 18 aa, Mycobacterium avium
LWFQAARRAGFDVAAVIA

SEQ ID NO: 100862 - protein, 20 aa, Mycobacterium avium
LWKVLCAQVGVAAIGMPEDL

SEQ ID NO: 100863 - protein, 18 aa, Mycobacterium avium
LWLFTLRAQSWADDYGTT

SEQ ID NO: 100864 - protein, 21 aa, Mycobacterium avium
LWLFTLRAQSWTADYGTTANY

SEQ ID NO: 100865 - protein, 21 aa, Mycobacterium avium
LWLVHRFKADAVIYVTPTEDN

SEQ ID NO: 100866 - protein, 19 aa, Mycobacterium avium
LWPAKPPRRPLYPVQVTES

SEQ ID NO: 100867 - protein, 19 aa, Mycobacterium avium
LWQECNQVGMPRAVLITKL

SEQ ID NO: 100868 - protein, 19 aa, Mycobacterium avium
LWQHCAAMVPGFTGSTEVS

SEQ ID NO: 100869 - protein, 20 aa, Mycobacterium avium
LWQNHIERILADWVGELGVP

SEQ ID NO: 100870 - protein, 17 aa, Mycobacterium avium
LWRLADHMNQLRDRLLI

SEQ ID NO: 100871 - protein, 18 aa, Mycobacterium avium
LWRVCSETQMPVSLHFGS

SEQ ID NO: 100872 - protein, 24 aa, Mycobacterium avium
LWSKASGLDLVRLGTTASTEEITD

SEQ ID NO: 100873 - protein, 18 aa, Mycobacterium avium
LWSSSVIVPTEPEPPYKW

SEQ ID NO: 100874 - protein, 27 aa, Mycobacterium avium
LWTLRGADESLCFAGANLIPLRGAPGD

SEQ ID NO: 100875 - protein, 26 aa, Mycobacterium avium
LWTLRGADESLCFAGANLITLRGAPG

SEQ ID NO: 100876 - protein, 26 aa, Mycobacterium avium
LWTLRGADESLCFAGANLVPLRGAPG

SEQ ID NO: 100877 - protein, 23 aa, Mycobacterium avium
LYAHPRAGALVAMESRARLFPQG

SEQ ID NO: 100878 - protein, 21 aa, Mycobacterium avium
LYALLWRVGVVEIRDDDRTRA

SEQ ID NO: 100879 - protein, 25 aa, Mycobacterium avium
LYDGFSFLTVMWLEALGFCEHGKVG

SEQ ID NO: 100880 - protein, 19 aa, Mycobacterium avium
LYDRAMAGWEVTVLLPHGC

SEQ ID NO: 100881 - protein, 18 aa, Mycobacterium avium
LYEAIARGEYPSWSLQVQ

SEQ ID NO: 100882 - protein, 33 aa, Mycobacterium avium
LYEAKTTFGRIGVKVWIYKGDVVGGKRELAAAA

SEQ ID NO: 100883 - protein, 17 aa, Mycobacterium avium
LYEQAAISAADIDVALL

SEQ ID NO: 100884 - protein, 18 aa, Mycobacterium avium
LYEQAGVGPADIDVALLY

SEQ ID NO: 100885 - protein, 17 aa, Mycobacterium avium
LYFELDGSFPHHEANPL

SEQ ID NO: 100886 - protein, 19 aa, Mycobacterium avium
LYHDGRIPSQVAIRVNRLE

SEQ ID NO: 100887 - protein, 18 aa, Mycobacterium avium
LYISYLRKKIDNGREPMI

SEQ ID NO: 100888 - protein, 17 aa, Mycobacterium avium
LYLDRLIGRYARSAKRA

SEQ ID NO: 100889 - protein, 23 aa, Mycobacterium avium
LYLNDLVRFGMRLPTDLGPFPGQ

SEQ ID NO: 100890 - protein, 17 aa, Mycobacterium avium
LYLTDVIAILRGDGLPI

SEQ ID NO: 100891 - protein, 18 aa, Mycobacterium avium
LYNTQPWRWVADGAGLDL

SEQ ID NO: 100892 - protein, 26 aa, Mycobacterium avium
LYPVRRMVFVGGLLPVPGHSFVEHLA

SEQ ID NO: 100893 - protein, 17 aa, Mycobacterium avium
LYRALRLLADCGRGEVI

SEQ ID NO: 100894 - protein, 20 aa, Mycobacterium avium
LYRFDLDKLIPVAAKIGPTV

SEQ ID NO: 100895 - protein, 39 aa, Mycobacterium avium
LYRMYRAADGYVFLAAPLPREWPALAKAMSPYVDLHADE

SEQ ID NO: 100896 - protein, 37 aa, Mycobacterium avium
LYRMYRAADGYVFLAAPLPREWPALTKAMSPYVDLHA

SEQ ID NO: 100897 - protein, 17 aa, Mycobacterium avium
LYRRFDTVMDFALPDDA

SEQ ID NO: 100898 - protein, 26 aa, Mycobacterium avium
LYRRTTIERLAGWLVRAVTAFADDLD

SEQ ID NO: 100899 - protein, 17 aa, Mycobacterium avium
LYSCFPSAVQVAAAELG

SEQ ID NO: 100900 - protein, 20 aa, Mycobacterium avium
LYSRRAYLPPSYRDMLRHRA

SEQ ID NO: 100901 - protein, 22 aa, Mycobacterium avium
LYTRALVGLCAMQVGVTERALK

SEQ ID NO: 100902 - protein, 18 aa, Mycobacterium avium
LYVYARETVGYALVIGGR

SEQ ID NO: 100903 - protein, 20 aa, Mycobacterium avium
MAAAAAPYVAWLSATAGLAE

SEQ ID NO: 100904 - protein, 19 aa, Mycobacterium avium
MAAARTKIRPDWDAEVLDA

SEQ ID NO: 100905 - protein, 19 aa, Mycobacterium avium
MAALARLGAVQNPIIPVLR

SEQ ID NO: 100906 - protein, 20 aa, Mycobacterium avium
MAALRLGDIENFPFLDPPDR

SEQ ID NO: 100907 - protein, 18 aa, Mycobacterium avium
MAARRHMIQFGTTVDQLA

SEQ ID NO: 100908 - protein, 17 aa, Mycobacterium avium
MAASLVHRAEAASFSGI

SEQ ID NO: 100909 - protein, 21 aa, Mycobacterium avium
MAASMGEFLLAAGTKGKRYAL

SEQ ID NO: 100910 - protein, 17 aa, Mycobacterium avium
MADLCWIENIGARGFAA

SEQ ID NO: 100911 - protein, 18 aa, Mycobacterium avium
MADLRDKVVILVDDGIAT

SEQ ID NO: 100912 - protein, 18 aa, Mycobacterium avium
MAGARKCVEEAAKYPETR

SEQ ID NO: 100913 - protein, 21 aa, Mycobacterium avium
MAGELKRRGFRFVGPTTAYAL

SEQ ID NO: 100914 - protein, 19 aa, Mycobacterium avium
MAGGESFTFHLPAYHRDRV

SEQ ID NO: 100915 - protein, 18 aa, Mycobacterium avium
MAGLDLRDVLIIQSGAER

SEQ ID NO: 100916 - protein, 18 aa, Mycobacterium avium
MAGLKPLVEGGRLTAAMA

SEQ ID NO: 100917 - protein, 18 aa, Mycobacterium avium
MAGYGRPAPAEVRDFVPG

SEQ ID NO: 100918 - protein, 18 aa, Mycobacterium avium
MAHDCPNTKMVLGGYSQG

SEQ ID NO: 100919 - protein, 22 aa, Mycobacterium avium
MAKLRYVLRQGRSYGVHVIIST

SEQ ID NO: 100920 - protein, 17 aa, Mycobacterium avium
MALAHSFFTPLGAELRD

SEQ ID NO: 100921 - protein, 20 aa, Mycobacterium avium
MALAKLKVGADYNLPLLQPD

SEQ ID NO: 100922 - protein, 24 aa, Mycobacterium avium
MALIHKRAHGVAVVAFEGRPLGLL

SEQ ID NO: 100923 - protein, 35 aa, Mycobacterium avium; identical to SEQ ID NO: 13954

SEQ ID NO: 100924 - protein, 20 aa, Mycobacterium avium
MANVVKWGLDTPITDESIAR

SEQ ID NO: 100925 - protein, 19 aa, Mycobacterium avium
MAPECDLVIVVGSRNSSNS

SEQ ID NO: 100926 - protein, 18 aa, Mycobacterium avium
MAPIPSLLAVAGVHHHLV

SEQ ID NO: 100927 - protein, 34 aa, Mycobacterium avium
MARSTKRVCRDCGFFLPLSGSLGRMFGVCGNELS

SEQ ID NO: 100928 - protein, 37 aa, Mycobacterium avium
MARSTKRVCRDCGFFLPLSGSLGRMFGVCGNELSADG

SEQ ID NO: 100929 - protein, 18 aa, Mycobacterium avium
MASVAAYTWLATRGGGNV

SEQ ID NO: 100930 - protein, 23 aa, Mycobacterium avium
MATGELRATMALTEPGGGSDLQN

SEQ ID NO: 100931 - protein, 22 aa, Mycobacterium avium
MATGEMLGCFGLTEPDVGSDPA

SEQ ID NO: 100932 - protein, 19 aa, Mycobacterium avium
MAVAACRDAIADAGLTPAD

SEQ ID NO: 100933 - protein, 31 aa, Mycobacterium avium
MAVAAPGCGVSWNLLAGIGRIESGHAGGGAV

SEQ ID NO: 100934 - protein, 25 aa, Mycobacterium avium
MAVDYQRLGKMPPLQTGGLHDGQTA

SEQ ID NO: 100935 - protein, 19 aa, Mycobacterium avium
MAYLARWNAGGALGEDTRD

SEQ ID NO: 100936 - protein, 18 aa, Mycobacterium avium
MCEYFVHRSLYHLKEGDP

SEQ ID NO: 100937 - protein, 20 aa, Mycobacterium avium
MCGNGVRVFAHYLRASGLET

SEQ ID NO: 100938 - protein, 30 aa, Mycobacterium avium
MCGPRPHLGGLRRSRLPAELITEIGPSGVL

SEQ ID NO: 100939 - protein, 18 aa, Mycobacterium avium
MDAEFLKDAGFVVVAPHT

SEQ ID NO: 100940 - protein, 22 aa, Mycobacterium avium
MDAGCYAVHMARTFGGRSPEVV

SEQ ID NO: 100941 - protein, 34 aa, Mycobacterium avium
MDAGGVLASMCFPSFPGFAGRLFATHPDKDLALA

SEQ ID NO: 100942 - protein, 24 aa, Mycobacterium avium
MDDARWDAVLAVNLLAPLRLTEGL

SEQ ID NO: 100943 - protein, 18 aa, Mycobacterium avium
MDHVFSMAADDGRPGALI

SEQ ID NO: 100944 - protein, 18 aa, Mycobacterium avium
MDLYWPGRLDGCAEPPVQ

SEQ ID NO: 100945 - protein, 26 aa, Mycobacterium avium
MDPQHRMLLELSWEALERAGIDPSGL

SEQ ID NO: 100946 - protein, 17 aa, Mycobacterium avium
MDRACVDECPVDCIYEG

SEQ ID NO: 100947 - protein, 24 aa, Mycobacterium avium
MDREQLRLIAWELIANRGGSRPPA

SEQ ID NO: 100948 - protein, 24 aa, Mycobacterium avium
MDRWSRGRVALVGDAGYCCSPLSG

SEQ ID NO: 100949 - protein, 29 aa, Mycobacterium avium
MDTRARFADMYRRIVLDGDASAAVPDDPF

SEQ ID NO: 100950 - protein, 20 aa, Mycobacterium avium
MEALGWKHSRLNRLEKSTTA

SEQ ID NO: 100951 - protein, 25 aa, Mycobacterium avium
MEASCAFGTAAQCARKLQEFKRAGA

SEQ ID NO: 100952 - protein, 17 aa, Mycobacterium avium
MEAVRSVFARQALPMSW

SEQ ID NO: 100953 - protein, 30 aa, Mycobacterium avium
MECAELLDWPAKLRLLEGFRQRENLSWSAP

SEQ ID NO: 100954 - protein, 25 aa, Mycobacterium avium
MELFKTALRLARHRELVDGFEDPDI

SEQ ID NO: 100955 - protein, 20 aa, Mycobacterium avium
MELHDGCAYGRGVHVYSGTL

SEQ ID NO: 100956 - protein, 17 aa, Mycobacterium avium
MELQAYDEFFFPGLAAE

SEQ ID NO: 100957 - protein, 18 aa, Mycobacterium avium
MELQAYDEFFFPGLAAEW

SEQ ID NO: 100958 - protein, 24 aa, Mycobacterium avium
MENKDLRLGYDVVPGRDGAIARND

SEQ ID NO: 100959 - protein, 22 aa, Mycobacterium avium
MEQLEAFCRGVLSRAESSEAVG

SEQ ID NO: 100960 - protein, 24 aa, Mycobacterium avium
MERFGVDDVRAFDLLRRLSQESQV

SEQ ID NO: 100961 - protein, 17 aa, Mycobacterium avium
MERHRATITLGWPQQGK

SEQ ID NO: 100962 - protein, 17 aa, Mycobacterium avium
MFAVLPTIVAADMRRRR

SEQ ID NO: 100963 - protein, 18 aa, Mycobacterium avium
MFDTLLVYENFPMDGLTA

SEQ ID NO: 100964 - protein, 19 aa, Mycobacterium avium
MFDTLLVYENFPMNGLSSS

SEQ ID NO: 100965 - protein, 23 aa, Mycobacterium avium
MFFPEPRCRVLTGVGTFDPGLGR

SEQ ID NO: 100966 - protein, 18 aa, Mycobacterium avium
MFFPHAYSTYGADIADDA

SEQ ID NO: 100967 - protein, 25 aa, Mycobacterium avium
MFKIKDERTADCVVAGYRVHKSGAD

SEQ ID NO: 100968 - protein, 19 aa, Mycobacterium avium
MFRRYWPADLHMIGKDIIR

SEQ ID NO: 100969 - protein, 20 aa, Mycobacterium avium
MFTRMLKLPEAVRHSHDLSS

SEQ ID NO: 100970 - protein, 24 aa, Mycobacterium avium
MGADLCQQLSWGASPQQLEGLALQ

SEQ ID NO: 100971 - protein, 18 aa, Mycobacterium avium
MGAGAWGTALAKVLVDAG

SEQ ID NO: 100972 - protein, 19 aa, Mycobacterium avium
MGAIKPRPVAIGTEVVVRP

SEQ ID NO: 100973 - protein, 19 aa, Mycobacterium avium
MGALHSWCLAAQHPELVSA

SEQ ID NO: 100974 - protein, 18 aa, Mycobacterium avium
MGAMLGGIIIGDLLSSGM

SEQ ID NO: 100975 - protein, 18 aa, Mycobacterium avium
MGAQFARIQQEAVELANR

SEQ ID NO: 100976 - protein, 21 aa, Mycobacterium avium
MGDPVWCPLPGTKIEGLYISF

SEQ ID NO: 100977 - protein, 27 aa, Mycobacterium avium
MGEHLQLLKGWHPVASVSNGEKRWDAQ

SEQ ID NO: 100978 - protein, 20 aa, Mycobacterium avium
MGFCTPQEYVLFLRQTPIFE

SEQ ID NO: 100979 - protein, 19 aa, Mycobacterium avium
MGIPSHYVSGYLHPKRDAV

SEQ ID NO: 100980 - protein, 20 aa, Mycobacterium avium
MGLMLGEYWDLSALAADCAA

SEQ ID NO: 100981 - protein, 25 aa, Mycobacterium avium
MGMGGSIPFIAEFAAAFPEAKILVT

SEQ ID NO: 100982 - protein, 24 aa, Mycobacterium avium
MGMLFRRKLVMFGPREVLLTSDEP

SEQ ID NO: 100983 - protein, 18 aa, Mycobacterium avium
MGNLEFLVRNGIHAVVGT

SEQ ID NO: 100984 - protein, 24 aa, Mycobacterium avium
MGPAVLKFAPKLAAQYLPGYLDGS

SEQ ID NO: 100985 - protein, 18 aa, Mycobacterium avium
MGRKPLRFTSFGDQSTPA

SEQ ID NO: 100986 - protein, 19 aa, Mycobacterium avium
MGVKAGLDPAVMIEVLNAG

SEQ ID NO: 100987 - protein, 25 aa, Mycobacterium avium
MGVPDYLGWDWKSKAGIPIVCVPGC

SEQ ID NO: 100988 - protein, 26 aa, Mycobacterium avium
MGWEEWKVGVEFDGAQHWTDPAQRTR

SEQ ID NO: 100989 - protein, 29 aa, Mycobacterium avium
MHDYFWRWDTDWFWCSRAFGVQNPRVRRW

SEQ ID NO: 100990 - protein, 30 aa, Mycobacterium avium
MHDYFWRWDTDWFWCSRAFGVQNPRVRRWW

SEQ ID NO: 100991 - protein, 18 aa, Mycobacterium avium
MHFHDLRHAAGVMAAQTG

SEQ ID NO: 100992 - protein, 26 aa, Mycobacterium avium
MHQNLPIYRYWFSPDGMLGFDRGTQT

SEQ ID NO: 100993 - protein, 24 aa, Mycobacterium avium
MHQRCPIAWTDTYGGHWVAAGGDA

SEQ ID NO: 100994 - protein, 24 aa, Mycobacterium avium
MHQRCPIAWTDTYGGHWVAASGDA

SEQ ID NO: 100995 - protein, 19 aa, Mycobacterium avium
MIAELAVAYAEIERSQDIW

SEQ ID NO: 100996 - protein, 17 aa, Mycobacterium avium
MIILRKGYGLGAMAMAG

SEQ ID NO: 100997 - protein, 20 aa, Mycobacterium avium
MIKDGFKSGAIKAGIGAAFG

SEQ ID NO: 100998 - protein, 17 aa, Mycobacterium avium
MINLGGLDYEIWDDGWT

SEQ ID NO: 100999 - protein, 27 aa, Mycobacterium avium
MIRDFCAQCLDPLVGTGHFDFVTDLGA

SEQ ID NO: 101000 - protein, 22 aa, Mycobacterium avium
MIYREVEGLPKGSVKAVIDAFG

SEQ ID NO: 101001 - protein, 35 aa, Mycobacterium avium
MKAEGTFEYQALLFIPSHAPFDLFNRDAHTGIQLY

SEQ ID NO: 101002 - protein, 21 aa, Mycobacterium avium
MKDHRRILSALKKRDDKLARA

SEQ ID NO: 101003 - protein, 20 aa, Mycobacterium avium
MKSVHRILRNFKMPGFTVPE

SEQ ID NO: 101004 - protein, 26 aa, Mycobacterium avium
MKTFLVRPAPVPSRFGGSRSMGLPEF

SEQ ID NO: 101005 - protein, 30 aa, Mycobacterium avium
MKVSHPIVFGHAVKIFYKDAFAKHQELFDE

SEQ ID NO: 101006 - protein, 18 aa, Mycobacterium avium
MLAARLGSDVPFALHGGT

SEQ ID NO: 101007 - protein, 23 aa, Mycobacterium avium
MLAHDTWNWLIHVLAQRYGSAFT

SEQ ID NO: 101008 - protein, 18 aa, Mycobacterium avium
MLARADSVGVFQVESRAQ

SEQ ID NO: 101009 - protein, 24 aa, Mycobacterium avium
MLARLEQRLGVALFDRHGRRLSLN

SEQ ID NO: 101010 - protein, 25 aa, Mycobacterium avium
MLARLEQRLGVALFDRHGRRLSLNT

SEQ ID NO: 101011 - protein, 23 aa, Mycobacterium avium
MLDRGWHSGPVFGTHAAAMASGK

SEQ ID NO: 101012 - protein, 22 aa, Mycobacterium avium
MLFTNWPRPVLTTAEGDEMQAA

SEQ ID NO: 101013 - protein, 19 aa, Mycobacterium avium
MLGEARVPAARMGKPHEIA

SEQ ID NO: 101014 - protein, 17 aa, Mycobacterium avium
MLGRPCYEVEFSDGTVI

SEQ ID NO: 101015 - protein, 28 aa, Mycobacterium avium
MLHARASLRPADIAFTFTDYERDWAGVR

SEQ ID NO: 101016 - protein, 23 aa, Mycobacterium avium
MLHSPPMYRAFRPDLPASTREDA

SEQ ID NO: 101017 - protein, 17 aa, Mycobacterium avium
MLKCAAAAAQARAAAAL

SEQ ID NO: 101018 - protein, 23 aa, Mycobacterium avium
MLKLECPQHHPVGRILKDAPHQA

SEQ ID NO: 101019 - protein, 21 aa, Mycobacterium avium
MLLMRAGREYALKRALAKLAD

SEQ ID NO: 101020 - protein, 26 aa, Mycobacterium avium
MLNFLTRRGVALIRCAGWSDYYPNHK

SEQ ID NO: 101021 - protein, 25 aa, Mycobacterium avium
MLPLPARATVTWSLTGALQLMLFPE

SEQ ID NO: 101022 - protein, 24 aa, Mycobacterium avium
MLQRREAWEIIDYVNRLTDPSALA

SEQ ID NO: 101023 - protein, 18 aa, Mycobacterium avium
MLREARVPAARMGKPSEI

SEQ ID NO: 101024 - protein, 20 aa, Mycobacterium avium
MLRRHAYPTLGDRQLTSILP

SEQ ID NO: 101025 - protein, 27 aa, Mycobacterium avium
MLRRLGIPGDFKGGFRVTTPEVLDVAR

SEQ ID NO: 101026 - protein, 17 aa, Mycobacterium avium
MLSPTGRCHAFDVAADG

SEQ ID NO: 101027 - protein, 17 aa, Mycobacterium avium
MLTADWVHWYNTDRLMH

SEQ ID NO: 101028 - protein, 18 aa, Mycobacterium avium
MLTGIRVEISGDTVVLAA

SEQ ID NO: 101029 - protein, 31 aa, Mycobacterium avium
MLVRHPNLRASFFSRGIPRPVQIVPSRVELP

SEQ ID NO: 101030 - protein, 27 aa, Mycobacterium avium
MLVRHPNLRASFFSRGVPRPVQIVPSR

SEQ ID NO: 101031 - protein, 21 aa, Mycobacterium avium
MMGAQRLHWLGAELNGTSVDA

SEQ ID NO: 101032 - protein, 22 aa, Mycobacterium avium
MMLIGSACRDEAQFGSDAGEFN

SEQ ID NO: 101033 - protein, 18 aa, Mycobacterium avium
MMQPLQSMMGMFANPGAM

SEQ ID NO: 101034 - protein, 23 aa, Mycobacterium avium
MNMVSMMAICFEKMLVSAVREAM

SEQ ID NO: 101035 - protein, 17 aa, Mycobacterium avium
MNSPFWRAGEGGPGDLN

SEQ ID NO: 101036 - protein, 18 aa, Mycobacterium avium
MNSPFWRAGEGGPGDLNP

SEQ ID NO: 101037 - protein, 17 aa, Mycobacterium avium
MNVCSAAADLLWSRVIK

SEQ ID NO: 101038 - protein, 17 aa, Mycobacterium avium
MPAALRLARSIAENNAY

SEQ ID NO: 101039 - protein, 25 aa, Mycobacterium avium
MPAEAVLRMALVGSHERLTAQRAYE

SEQ ID NO: 101040 - protein, 18 aa, Mycobacterium avium
MPARVRNTAFAFEKFTRA

SEQ ID NO: 101041 - protein, 20 aa, Mycobacterium avium
MPCSRWRRYDKLRRFPDGLL

SEQ ID NO: 101042 - protein, 30 aa, Mycobacterium avium
MPDGRPAGAWICPHMPPVFAEYRDPHIKRY

SEQ ID NO: 101043 - protein, 32 aa, Mycobacterium avium
MPECTGRVGIAGFCMGGRFALVMSPKGFSASA

SEQ ID NO: 101044 - protein, 28 aa, Mycobacterium avium
MPEGKYIPRLGGLAFRDPDWADEVYVFG

SEQ ID NO: 101045 - protein, 22 aa, Mycobacterium avium
MPGKVMKTRAKIAAAVPIAEML

SEQ ID NO: 101046 - protein, 18 aa, Mycobacterium avium
MPIVRDDPIRDWVKLAVD

SEQ ID NO: 101047 - protein, 19 aa, Mycobacterium avium
MPLFGGAPLMGLPGRGAAD

SEQ ID NO: 101048 - protein, 20 aa, Mycobacterium avium
MPLLRGDEWWALGMSEPEAG

SEQ ID NO: 101049 - protein, 19 aa, Mycobacterium avium
MPLMNAVGITSESVYLSPA

SEQ ID NO: 101050 - protein, 23 aa, Mycobacterium avium
MPNSVDWALAWFATTRIGAVAVP

SEQ ID NO: 101051 - protein, 19 aa, Mycobacterium avium
MPNVRAMNFLGEPPVVIGP

SEQ ID NO: 101052 - protein, 22 aa, Mycobacterium avium
MPPDRKFRAAVARSHRRTAAAL

SEQ ID NO: 101053 - protein, 17 aa, Mycobacterium avium
MPPPKLAGIHERGGVPI

SEQ ID NO: 101054 - protein, 18 aa, Mycobacterium avium
MPSFPALQQAGVRYRWDG

SEQ ID NO: 101055 - protein, 20 aa, Mycobacterium avium
MPSVHRDLLAAAATLERHGR

SEQ ID NO: 101056 - protein, 18 aa, Mycobacterium avium
MPTLPRMPGLEDFRDGLI

SEQ ID NO: 101057 - protein, 19 aa, Mycobacterium avium
MPVEEAWRSVQLLTDKALP

SEQ ID NO: 101058 - protein, 21 aa, Mycobacterium avium
MPVELREGYQRSIVRAAAPGA

SEQ ID NO: 101059 - protein, 18 aa, Mycobacterium avium
MPVNSFAGTHGWGYDGVL

SEQ ID NO: 101060 - protein, 19 aa, Mycobacterium avium
MPYVLALADRGWRAACRSN

SEQ ID NO: 101061 - protein, 21 aa, Mycobacterium avium
MQARFGMTVLLTTHYMEEADA

SEQ ID NO: 101062 - protein, 17 aa, Mycobacterium avium
MQPRARGCLTLVSADPA

SEQ ID NO: 101063 - protein, 21 aa, Mycobacterium avium
MQSLPWWRRSRGMDQYVICGV

SEQ ID NO: 101064 - protein, 22 aa, Mycobacterium avium
MQVCRRNSRPGSRRHVDTVPRR

SEQ ID NO: 101065 - protein, 19 aa, Mycobacterium avium
MQYERGMYGYAVLNKVLTE

SEQ ID NO: 101066 - protein, 17 aa, Mycobacterium avium
MRAAGIEGVRRGKRVRT

SEQ ID NO: 101067 - protein, 27 aa, Mycobacterium avium
MRAGWYWRPDIAGVMRVFEDTGEYPDH

SEQ ID NO: 101068 - protein, 17 aa, Mycobacterium avium
MRAIVGFAAETGDASGD

SEQ ID NO: 101069 - protein, 17 aa, Mycobacterium avium
MRAKAIAKLGFGYDDVA

SEQ ID NO: 101070 - protein, 19 aa, Mycobacterium avium
MRAKAIARLGFGYDDVAAI

SEQ ID NO: 101071 - protein, 17 aa, Mycobacterium avium
MRDSRGFDFTGYKRTSL

SEQ ID NO: 101072 - protein, 17 aa, Mycobacterium avium
MREAGIAGVRRGKRVRT

SEQ ID NO: 101073 - protein, 25 aa, Mycobacterium avium
MREQALRFGADLRMEDVESVSLAGP

SEQ ID NO: 101074 - protein, 17 aa, Mycobacterium avium
MRGMFLMVEAVRQLRGE

SEQ ID NO: 101075 - protein, 25 aa, Mycobacterium avium
MRGPSSIWYRIRINLQHIPEDQRPP

SEQ ID NO: 101076 - protein, 25 aa, Mycobacterium avium
MRGPSSIWYRIRINLQHVPEDQRPP

SEQ ID NO: 101077 - protein, 26 aa, Mycobacterium avium
MRGPSSIWYRIRINLQRVPEDQRPPQ

SEQ ID NO: 101078 - protein, 19 aa, Mycobacterium avium
MRGTICITGGCSNSCNGTA

SEQ ID NO: 101079 - protein, 20 aa, Mycobacterium avium
MRHAASYWRGLSKAGEAVDG

SEQ ID NO: 101080 - protein, 19 aa, Mycobacterium avium
MRHDMYWSGDLAYRDADGW

SEQ ID NO: 101081 - protein, 17 aa, Mycobacterium avium
MRILTGIEVDILEDGGL

SEQ ID NO: 101082 - protein, 21 aa, Mycobacterium avium
MRLLGVTCLEELSPRHVTQLR

SEQ ID NO: 101083 - protein, 23 aa, Mycobacterium avium
MRPHDPPWCRPLLGQRRAVTHAA

SEQ ID NO: 101084 - protein, 18 aa, Mycobacterium avium
MRQGRGGAIITTASMSGH

SEQ ID NO: 101085 - protein, 17 aa, Mycobacterium avium
MRRLLGVRWGAREQAEF

SEQ ID NO: 101086 - protein, 26 aa, Mycobacterium avium
MRRMVKEELLTFEGKKLFPERIAETV

SEQ ID NO: 101087 - protein, 17 aa, Mycobacterium avium
MRRRHRGDRLLVCRTAS

SEQ ID NO: 101088 - protein, 17 aa, Mycobacterium avium
MRRVYRGALPVLSSKQK

SEQ ID NO: 101089 - protein, 17 aa, Mycobacterium avium
MRTAVNLLLDRLPNLRL

SEQ ID NO: 101090 - protein, 25 aa, Mycobacterium avium
MRWPHGRLRYYVAMLAELSQLRLLP

SEQ ID NO: 101091 - protein, 19 aa, Mycobacterium avium
MSAFKWTALGHREIADMLT

SEQ ID NO: 101092 - protein, 25 aa, Mycobacterium avium
MSASWKASVPISVRPTWPVTATTGI

SEQ ID NO: 101093 - protein, 22 aa, Mycobacterium avium
MSATARLAAPRTVYAFPGQGIQ

SEQ ID NO: 101094 - protein, 19 aa, Mycobacterium avium
MSAVRAIPYVLARPPGVVT

SEQ ID NO: 101095 - protein, 24 aa, Mycobacterium avium
MSDAMPKLRGLADFAETFGAEYGR

SEQ ID NO: 101096 - protein, 21 aa, Mycobacterium avium
MSDVIRLARHAHHYLAVFDNG

SEQ ID NO: 101097 - protein, 21 aa, Mycobacterium avium
MSDVIRLSRHAHHYLAIFDHG

SEQ ID NO: 101098 - protein, 22 aa, Mycobacterium avium
MSDVIRLSRHAHHYLAIFDHGK

SEQ ID NO: 101099 - protein, 21 aa, Mycobacterium avium
MSDVIRLSRHAHHYLAIFDKG

SEQ ID NO: 101100 - protein, 23 aa, Mycobacterium avium
MSDVIRLSRHAHHYLAIFDKGKA

SEQ ID NO: 101101 - protein, 22 aa, Mycobacterium avium
MSECLPYYVGMFEQMKRQALAG

SEQ ID NO: 101102 - protein, 22 aa, Mycobacterium avium
MSEVIRLARHAHHYLAVFDNGK

SEQ ID NO: 101103 - protein, 17 aa, Mycobacterium avium
MSFRCRIAIHIHPLQRT

SEQ ID NO: 101104 - protein, 28 aa, Mycobacterium avium
MSFSRYELLRLLAFSRTGALPITKASDR

SEQ ID NO: 101105 - protein, 17 aa, Mycobacterium avium
MSGFGGMVSVRMRGGRQ

SEQ ID NO: 101106 - protein, 27 aa, Mycobacterium avium
MSLGKLWASPELRANLDAWLARFAAPG

SEQ ID NO: 101107 - protein, 24 aa, Mycobacterium avium
MSPPGKDLWWFWTGLTPSYPEEGW

SEQ ID NO: 101108 - protein, 19 aa, Mycobacterium avium
MSQIFLLRAVLPAMQAAGW

SEQ ID NO: 101109 - protein, 22 aa, Mycobacterium avium
MSRLAGAPAMSGFRAAADAVAP

SEQ ID NO: 101110 - protein, 25 aa, Mycobacterium avium
MSVNERLHHLFARMPDARVHLYGKA

SEQ ID NO: 101111 - protein, 21 aa, Mycobacterium avium
MSVSNLRWDGDYVLVDVDASP

SEQ ID NO: 101112 - protein, 18 aa, Mycobacterium avium
MTALVARHLDLAAVAAVA

SEQ ID NO: 101113 - protein, 20 aa, Mycobacterium avium
MTAPAAFSMLDPAYCARHGV

SEQ ID NO: 101114 - protein, 21 aa, Mycobacterium avium
MTARFDLFVVGSGFFGLTIAE

SEQ ID NO: 101115 - protein, 20 aa, Mycobacterium avium
MTCNTAIPIMWVGRQPPGTH

SEQ ID NO: 101116 - protein, 19 aa, Mycobacterium avium
MTDACARWRDAARDLPDPV

SEQ ID NO: 101117 - protein, 18 aa, Mycobacterium avium
MTEVAEILLPLLAENTRR

SEQ ID NO: 101118 - protein, 25 aa, Mycobacterium avium
MTGEAPRELGLLIGIVPGRPRGCGL

SEQ ID NO: 101119 - protein, 25 aa, Mycobacterium avium
MTIHFRPAGALAFLGCPLSDLEDAL

SEQ ID NO: 101120 - protein, 22 aa, Mycobacterium avium
MTLARERHGVFVFTGNTRHRVE

SEQ ID NO: 101121 - protein, 18 aa, Mycobacterium avium
MTQRDPWVNMLRCTLAAF

SEQ ID NO: 101122 - protein, 18 aa, Mycobacterium avium
MTRARLAARVDAVVAKAD

SEQ ID NO: 101123 - protein, 19 aa, Mycobacterium avium
MTRVQRAALPPMHAGRADV

SEQ ID NO: 101124 - protein, 23 aa, Mycobacterium avium
MTSHPRFPATMTVTQQDDRTFVL

SEQ ID NO: 101125 - protein, 19 aa, Mycobacterium avium
MTVADFDAVIAVHLRGTWL

SEQ ID NO: 101126 - protein, 28 aa, Mycobacterium avium
MTVPPPLIAANRARLLALVQSNIFGQNT

SEQ ID NO: 101127 - protein, 19 aa, Mycobacterium avium
MTVPPPLVAANRIRLLALI

SEQ ID NO: 101128 - protein, 25 aa, Mycobacterium avium
MTVRERKVCALWDIANPDKFTGSPL

SEQ ID NO: 101129 - protein, 21 aa, Mycobacterium avium
MVAALRLHGPVDIGALGAALH

SEQ ID NO: 101130 - protein, 24 aa, Mycobacterium avium
MVAEPLRLLDCARPVNGAVAVVLT

SEQ ID NO: 101131 - protein, 25 aa, Mycobacterium avium
MVARENRLRTALADLDKLDFDCVFI

SEQ ID NO: 101132 - protein, 23 aa, Mycobacterium avium
MVCSEAFLQVALDNMRIHGGIGF

SEQ ID NO: 101133 - protein, 21 aa, Mycobacterium avium
MVGVPEWLAEILPSAYPSRSI

SEQ ID NO: 101134 - protein, 18 aa, Mycobacterium avium
MVLLGWICVSIDYSKSPR

SEQ ID NO: 101135 - protein, 21 aa, Mycobacterium avium
MVSMMAICFEKMLVSAVREAM

SEQ ID NO: 101136 - protein, 20 aa, Mycobacterium avium
MVSSCKTFKGVLYGEMNPRE

SEQ ID NO: 101137 - protein, 24 aa, Mycobacterium avium
MVTARGGAAVARRILLDGETKGRW

SEQ ID NO: 101138 - protein, 17 aa, Mycobacterium avium
MVVENNVDGYHALFTHA

SEQ ID NO: 101139 - protein, 17 aa, Mycobacterium avium
MWAQDAAAMYGYAASSA

SEQ ID NO: 101140 - protein, 20 aa, Mycobacterium avium
MWAQDVAAMYGYAGAAQAAS

SEQ ID NO: 101141 - protein, 17 aa, Mycobacterium avium
MWVVPFCMGPLGVEDPK

SEQ ID NO: 101142 - protein, 18 aa, Mycobacterium avium
MYDCGFVNSVVPRDKLEA

SEQ ID NO: 101143 - protein, 18 aa, Mycobacterium avium
MYEEIRVGVLAYMAYHEQ

SEQ ID NO: 101144 - protein, 17 aa, Mycobacterium avium
MYELRDFGFSTSIGIGG

SEQ ID NO: 101145 - protein, 18 aa, Mycobacterium avium
MYLCRELTDLSLPKIGQA

SEQ ID NO: 101146 - protein, 33 aa, Mycobacterium avium
NAAERLSSVGFPFPDTRVRVVGADGGVLPVGQA

SEQ ID NO: 101147 - protein, 20 aa, Mycobacterium avium
NAANARRIWAHAGVADRVTC

SEQ ID NO: 101148 - protein, 17 aa, Mycobacterium avium
NAATARRHLPGLYERWW

SEQ ID NO: 101149 - protein, 26 aa, Mycobacterium avium
NAATHPARLALRWRPDDYRGERHGDV

SEQ ID NO: 101150 - protein, 25 aa, Mycobacterium avium
NAATRRWCGADGKARALPAALNAAS

SEQ ID NO: 101151 - protein, 24 aa, Mycobacterium avium
NAATRRWCGAHGKARALPAALNAA

SEQ ID NO: 101152 - protein, 17 aa, Mycobacterium avium
NACRVVDDTGADCPDWV

SEQ ID NO: 101153 - protein, 22 aa, Mycobacterium avium
NADIAMAFERYRIVTGDDDLEA

SEQ ID NO: 101154 - protein, 23 aa, Mycobacterium avium
NADNRLAAHIAFDPDDITGAIAE

SEQ ID NO: 101155 - protein, 23 aa, Mycobacterium avium
NADNRLGAHIAFDPDDITGAIAE

SEQ ID NO: 101156 - protein, 18 aa, Mycobacterium avium
NAEIRVAFWEKLLAAVRR

SEQ ID NO: 101157 - protein, 20 aa, Mycobacterium avium
NAGDKVVVWYPAANRDPAVF

SEQ ID NO: 101158 - protein, 24 aa, Mycobacterium avium
NAGKDLSFVPLRPERVVEVRYDHM

SEQ ID NO: 101159 - protein, 24 aa, Mycobacterium avium
NAGQCGSCFNGTAAMAAAGGALRD

SEQ ID NO: 101160 - protein, 19 aa, Mycobacterium avium
NAIREALELLRGEGLITRV

SEQ ID NO: 101161 - protein, 17 aa, Mycobacterium avium
NAITVPPKQFWREFDIP

SEQ ID NO: 101162 - protein, 26 aa, Mycobacterium avium
NAKQRLRECWLWSRAYTISGGSSEMM

SEQ ID NO: 101163 - protein, 21 aa, Mycobacterium avium
NALALAEVWDAATVRVISKAE

SEQ ID NO: 101164 - protein, 20 aa, Mycobacterium avium
NALDGARFVLENSAPFGRRL

SEQ ID NO: 101165 - protein, 29 aa, Mycobacterium avium
NALGRTRKSFVCGFHGWTYGLDGACTHIR

SEQ ID NO: 101166 - protein, 17 aa, Mycobacterium avium
NALRASGCPLRSPNVDL

SEQ ID NO: 101167 - protein, 21 aa, Mycobacterium avium
NALWPDLFIAGGGISRKADKW

SEQ ID NO: 101168 - protein, 22 aa, Mycobacterium avium
NALWPDLFIAGGGISRKADKWL

SEQ ID NO: 101169 - protein, 26 aa, Mycobacterium avium
NAQELYFPVCFELAVTKGAPPPHDNE

SEQ ID NO: 101170 - protein, 17 aa, Mycobacterium avium
NAREHLAFASGIHACLG

SEQ ID NO: 101171 - protein, 20 aa, Mycobacterium avium
NARGETQWLPPPHLDRNQPR

SEQ ID NO: 101172 - protein, 18 aa, Mycobacterium avium
NARIKAVSAYGGGGAGNR

SEQ ID NO: 101173 - protein, 20 aa, Mycobacterium avium
NARVRYTTIQNWSGNVYNLV

SEQ ID NO: 101174 - protein, 20 aa, Mycobacterium avium
NASALLFRYTVNGYRGCSHA

SEQ ID NO: 101175 - protein, 20 aa, Mycobacterium avium
NASGDFEFETFAPLATPVTG

SEQ ID NO: 101176 - protein, 23 aa, Mycobacterium avium
NASLHGLAGWVDVKPAVVATAIS

SEQ ID NO: 101177 - protein, 24 aa, Mycobacterium avium
NASLRLVAPGGVFLEMGKTDIRDP

SEQ ID NO: 101178 - protein, 25 aa, Mycobacterium avium
NASQPIFWVVRALELLEDFQQFGYY

SEQ ID NO: 101179 - protein, 24 aa, Mycobacterium avium
NAVVGRPVAEYGFEPVRFDEMRRG

SEQ ID NO: 101180 - protein, 19 aa, Mycobacterium avium
NAYREALAVIGEWAEADAA

SEQ ID NO: 101181 - protein, 17 aa, Mycobacterium avium
NAYRVVSPHVPFGGMGH

SEQ ID NO: 101182 - protein, 20 aa, Mycobacterium avium
NCAVELKPIIYSSSSVVVFG

SEQ ID NO: 101183 - protein, 17 aa, Mycobacterium avium
NCDCDLGAFSAIVPCGI

SEQ ID NO: 101184 - protein, 20 aa, Mycobacterium avium
NCPRRSGPRTPSWSTSARSR

SEQ ID NO: 101185 - protein, 19 aa, Mycobacterium avium
NCVCPGTIVTASFTEALKG

SEQ ID NO: 101186 - protein, 19 aa, Mycobacterium avium
NCVCPGTIVTASFTETLRE

SEQ ID NO: 101187 - protein, 22 aa, Mycobacterium avium
NCVSSCGRWCLVGCHSGRRSGN

SEQ ID NO: 101188 - protein, 17 aa, Mycobacterium avium
NDADLWGALADRMATLN

SEQ ID NO: 101189 - protein, 24 aa, Mycobacterium avium
NDGFAAELLEWLRNRLAHYKCPRS

SEQ ID NO: 101190 - protein, 18 aa, Mycobacterium avium
NDILREFRQAISYLSAEL

SEQ ID NO: 101191 - protein, 18 aa, Mycobacterium avium
NDLRVVDNVRYFAALYGF

SEQ ID NO: 101192 - protein, 26 aa, Mycobacterium avium
NDMHLYLKRAHVFRHLFGEPTDVLAE

SEQ ID NO: 101193 - protein, 17 aa, Mycobacterium avium
NDSKYGLAGNVMSGSLE

SEQ ID NO: 101194 - protein, 18 aa, Mycobacterium avium
NDVATIYGIVGIPITDLA

SEQ ID NO: 101195 - protein, 19 aa, Mycobacterium avium
NDVATIYGIVGIPITDLAR

SEQ ID NO: 101196 - protein, 21 aa, Mycobacterium avium
NEAFAAQAVACARELGLDEEI

SEQ ID NO: 101197 - protein, 22 aa, Mycobacterium avium
NEAFAAQAVACARELRLDEEIV

SEQ ID NO: 101198 - protein, 29 aa, Mycobacterium avium
NEAGEGLVRTCVFAVPKYLLSGGKGRSWE

SEQ ID NO: 101199 - protein, 22 aa, Mycobacterium avium
NEDEVDAFLDLVEAELTRLIEE

SEQ ID NO: 101200 - protein, 17 aa, Mycobacterium avium
NEEEVWVALSVPGRPID

SEQ ID NO: 101201 - protein, 24 aa, Mycobacterium avium
NEELCDLLPGYLIFRCIFSNRPPT

SEQ ID NO: 101202 - protein, 17 aa, Mycobacterium avium
NEGQWALGDREPLNDTE

SEQ ID NO: 101203 - protein, 25 aa, Mycobacterium avium
NEHPWLPGFEPPYVIAVVALDECAE

SEQ ID NO: 101204 - protein, 19 aa, Mycobacterium avium
NEILARFTAVPSQELILPY

SEQ ID NO: 101205 - protein, 17 aa, Mycobacterium avium
NEIRLPERFDVGEGYGR

SEQ ID NO: 101206 - protein, 24 aa, Mycobacterium avium
NEIRRFVECTGIPFLPMSMAKGLI

SEQ ID NO: 101207 - protein, 24 aa, Mycobacterium avium
NEIRRFVECTGIPFLPMSMAKGLL

SEQ ID NO: 101208 - protein, 23 aa, Mycobacterium avium
NELWEFAESGLMARREASINDVP

SEQ ID NO: 101209 - protein, 25 aa, Mycobacterium avium
NEMPSRAYVSAFGFKGPDQQKPAGV

SEQ ID NO: 101210 - protein, 20 aa, Mycobacterium avium
NEPRVALAQLYGAPGTAAVA

SEQ ID NO: 101211 - protein, 21 aa, Mycobacterium avium
NEPVLSRVFAYWRHVDADIGR

SEQ ID NO: 101212 - protein, 22 aa, Mycobacterium avium
NESRFRISFRLAGFHLAISPPA

SEQ ID NO: 101213 - protein, 19 aa, Mycobacterium avium
NEVLRFCGIQVPEGDEPLT

SEQ ID NO: 101214 - protein, 21 aa, Mycobacterium avium
NEVYRLPKHLDEKVARIHVEA

SEQ ID NO: 101215 - protein, 20 aa, Mycobacterium avium
NEYLMFDAMGFGRPLDFKPM

SEQ ID NO: 101216 - protein, 24 aa, Mycobacterium avium
NFDDTWGWRTMCWLNLTDKGEKLA

SEQ ID NO: 101217 - protein, 24 aa, Mycobacterium avium
NFDNGALAPHAWRRKPMSVDAILS

SEQ ID NO: 101218 - protein, 19 aa, Mycobacterium avium
NFTAYKLLIADVIGGELKA

SEQ ID NO: 101219 - protein, 21 aa, Mycobacterium avium
NGAKNPNAWRRKPMSEEAILA

SEQ ID NO: 101220 - protein, 17 aa, Mycobacterium avium
NGALALLSGRVHDRVFV

SEQ ID NO: 101221 - protein, 23 aa, Mycobacterium avium
NGDPHVGHAYEYIATDAIARFKR

SEQ ID NO: 101222 - protein, 19 aa, Mycobacterium avium
NGDSLAFGEYRCRADQAGL

SEQ ID NO: 101223 - protein, 25 aa, Mycobacterium avium
NGELKRWAPILSKFRTVSVRGPRSA

SEQ ID NO: 101224 - protein, 20 aa, Mycobacterium avium
NGGIEVVELGWMINEPGVSI

SEQ ID NO: 101225 - protein, 24 aa, Mycobacterium avium
NGGSWAQRLMDVFDRVYRKRPYDF

SEQ ID NO: 101226 - protein, 17 aa, Mycobacterium avium
NGHPVTRIDGGREPVWQ

SEQ ID NO: 101227 - protein, 19 aa, Mycobacterium avium
NGIKLCRAGARPVGADSGL

SEQ ID NO: 101228 - protein, 20 aa, Mycobacterium avium
NGIKLCRAGARPVGADSGLR

SEQ ID NO: 101229 - protein, 25 aa, Mycobacterium avium
NGILASMCFPTFTGFSARHLNMHRE

SEQ ID NO: 101230 - protein, 32 aa, Mycobacterium avium
NGKLRKGQQVAWMREVDGLPVITSAKITELLA

SEQ ID NO: 101231 - protein, 17 aa, Mycobacterium avium
NGLCQGGGFQIALCSDL

SEQ ID NO: 101232 - protein, 33 aa, Mycobacterium avium
NGLLRGMPVGALGRRGAAAGYVNKYGFRYSVLT

SEQ ID NO: 101233 - protein, 23 aa, Mycobacterium avium
NGMGSDAFAIVWDGEKVHGLNAS

SEQ ID NO: 101234 - protein, 26 aa, Mycobacterium avium
NGNAYAGWGMPGLRDGQVTGGISGPD

SEQ ID NO: 101235 - protein, 30 aa, Mycobacterium avium
NGNGVFCDFGWGGIEVYCVVDGVVTMLYRV

SEQ ID NO: 101236 - protein, 30 aa, Mycobacterium avium
NGQLCAALTRILLPRSRYGEYVAALTDAVG

SEQ ID NO: 101237 - protein, 23 aa, Mycobacterium avium
NGQRFMLAPARVWAVHTPGRCWT

SEQ ID NO: 101238 - protein, 23 aa, Mycobacterium avium
NGQRFMLAPARVWGVHHSRAVLD

SEQ ID NO: 101239 - protein, 26 aa, Mycobacterium avium
NGRAVACFDAALALWRGIPELPDGRR

SEQ ID NO: 101240 - protein, 21 aa, Mycobacterium avium
NGSFPEFPLPLGNPSEATASA

SEQ ID NO: 101241 - protein, 22 aa, Mycobacterium avium
NGSPRAAGRLLSLVEGERRDEV

SEQ ID NO: 101242 - protein, 18 aa, Mycobacterium avium
NGTAFRLLGLPVIITDNI

SEQ ID NO: 101243 - protein, 19 aa, Mycobacterium avium
NGTFTRRRNVALAGVDLEN

SEQ ID NO: 101244 - protein, 20 aa, Mycobacterium avium
NGTMRRLHNAVALGLIDIDE

SEQ ID NO: 101245 - protein, 23 aa, Mycobacterium avium
NHFEGWSALASWGEIINRAQIGL

SEQ ID NO: 101246 - protein, 25 aa, Mycobacterium avium
NHHCYAGAIIHWLGPEQRDRWLRLG

SEQ ID NO: 101247 - protein, 19 aa, Mycobacterium avium
NHKGISCLIVDMTLPGIEA

SEQ ID NO: 101248 - protein, 17 aa, Mycobacterium avium
NHPGMPFPDRDHYNRMH

SEQ ID NO: 101249 - protein, 23 aa, Mycobacterium avium
NHPIRSRQVVKLVGISDEQELAY

SEQ ID NO: 101250 - protein, 18 aa, Mycobacterium avium
NICVSYRLTGGVDTGRLH

SEQ ID NO: 101251 - protein, 19 aa, Mycobacterium avium
NIFESWSQMASQLFDTETF

SEQ ID NO: 101252 - protein, 19 aa, Mycobacterium avium
NIFPTPRWHDGDGGRYIGT

SEQ ID NO: 101253 - protein, 24 aa, Mycobacterium avium
NIGIGLAEARRAHPENDLMTSLVQ

SEQ ID NO: 101254 - protein, 20 aa, Mycobacterium avium
NIGNPAPFGFEAPDVIMRDM

SEQ ID NO: 101255 - protein, 21 aa, Mycobacterium avium
NIGNPAPFGFEAPDVIMRDMI

SEQ ID NO: 101256 - protein, 22 aa, Mycobacterium avium
NIRARTGVVLATGSFAYNDSMV

SEQ ID NO: 101257 - protein, 21 aa, Mycobacterium avium
NIYADEIFAWMARTPVEEIRE

SEQ ID NO: 101258 - protein, 26 aa, Mycobacterium avium
NKACDPGLPLMLWAYDPLAFAGKGRA

SEQ ID NO: 101259 - protein, 18 aa, Mycobacterium avium
NKLAADWLQQTRVQRKGL

SEQ ID NO: 101260 - protein, 19 aa, Mycobacterium avium
NKTRLEWEHELSAQDVGCV

SEQ ID NO: 101261 - protein, 21 aa, Mycobacterium avium
NKVNPTHWVMTSASFSALRKL

SEQ ID NO: 101262 - protein, 19 aa, Mycobacterium avium
NLAAALALQGLKTLVIDLD

SEQ ID NO: 101263 - protein, 24 aa, Mycobacterium avium
NLARREIAEALNVLANRLRNPRPA

SEQ ID NO: 101264 - protein, 18 aa, Mycobacterium avium
NLDLQAARQDGVTYQGKV

SEQ ID NO: 101265 - protein, 24 aa, Mycobacterium avium
NLGGVFLGCKYAVLRFKEQGAGGV

SEQ ID NO: 101266 - protein, 17 aa, Mycobacterium avium
NLGRPDAGLDLPIVLGG

SEQ ID NO: 101267 - protein, 19 aa, Mycobacterium avium
NLIPMAAVYVGRPVKKLSP

SEQ ID NO: 101268 - protein, 33 aa, Mycobacterium avium
NLKCLCRGHHLLKTFWGWRDRQLPDGTVIWTLP

SEQ ID NO: 101269 - protein, 34 aa, Mycobacterium avium
NLKCLCRGHHLLKTFWGWRDRQLPDGTVIWTLPD

SEQ ID NO: 101270 - protein, 24 aa, Mycobacterium avium
NLLLSEFEELLGPRTKLVAASHVS

SEQ ID NO: 101271 - protein, 26 aa, Mycobacterium avium
NLLPQARAKLRIHLEEIRRINPSIIY

SEQ ID NO: 101272 - protein, 18 aa, Mycobacterium avium
NLLTTKPFLYVFNADESV

SEQ ID NO: 101273 - protein, 19 aa, Mycobacterium avium
NLNSPRWQTIPEMVLSAAD

SEQ ID NO: 101274 - protein, 19 aa, Mycobacterium avium
NLPDMFTRLLFSVVASGVA

SEQ ID NO: 101275 - protein, 22 aa, Mycobacterium avium
NLPRVNAHGGPGGRPGCWQKIT

SEQ ID NO: 101276 - protein, 22 aa, Mycobacterium avium
NLPSDTGHWGVPYFNHALDPLR

SEQ ID NO: 101277 - protein, 19 aa, Mycobacterium avium
NLPSTPIAVIFRSDKSGTT

SEQ ID NO: 101278 - protein, 20 aa, Mycobacterium avium
NLPSTPIAVIFRSDKSGTTA

SEQ ID NO: 101279 - protein, 28 aa, Mycobacterium avium
NLRLRDGRWCWHWDPAFMTKPGDDPELR

SEQ ID NO: 101280 - protein, 26 aa, Mycobacterium avium
NLRLRDGRWYWHWDPAFMASPTDLPV

SEQ ID NO: 101281 - protein, 22 aa, Mycobacterium avium
NLRVARVLYDFVNDEALPGTDI

SEQ ID NO: 101282 - protein, 23 aa, Mycobacterium avium
NLSAECFARYLADPHRAILAAEL

SEQ ID NO: 101283 - protein, 22 aa, Mycobacterium avium
NLSAECFARYLADPHRAVLAAE

SEQ ID NO: 101284 - protein, 20 aa, Mycobacterium avium
NLSQAWTLRADEVIQNVTVY

SEQ ID NO: 101285 - protein, 22 aa, Mycobacterium avium
NLTQLELQWGRTIGMQPSPVTG

SEQ ID NO: 101286 - protein, 26 aa, Mycobacterium avium
NLVAPDLVRRLCWDWEPTPDPFAAVD

SEQ ID NO: 101287 - protein, 33 aa, Mycobacterium avium
NLVPDRSAITFSIKNMWGLLTVRGRFTDFTGDG

SEQ ID NO: 101288 - protein, 25 aa, Mycobacterium avium
NLVPLYRERYVLLAPADLLASGAAT

SEQ ID NO: 101289 - protein, 25 aa, Mycobacterium avium
NLYAGRAIVYLRRFDPHEWVRLVRD

SEQ ID NO: 101290 - protein, 21 aa, Mycobacterium avium
NLYLRDLVLALQWVRDNIAEF

SEQ ID NO: 101291 - protein, 18 aa, Mycobacterium avium
NMSPEFGSTAAIFPIDEE

SEQ ID NO: 101292 - protein, 25 aa, Mycobacterium avium
NMYARGGLVRCITRVMKELAAQRGR

SEQ ID NO: 101293 - protein, 20 aa, Mycobacterium avium
NNDVRISPQLQAAAQRHTQD

SEQ ID NO: 101294 - protein, 22 aa, Mycobacterium avium
NNFPGATVPFGMVQYSPDTAGN

SEQ ID NO: 101295 - protein, 28 aa, Mycobacterium avium
NNLGGRWADRFGGLVFDATGITTPEGLK

SEQ ID NO: 101296 - protein, 22 aa, Mycobacterium avium
NNLPIPINIFLQKSVDPSKILY

SEQ ID NO: 101297 - protein, 24 aa, Mycobacterium avium
NNMGTPFLPQWACEPEDVAAAVCW

SEQ ID NO: 101298 - protein, 21 aa, Mycobacterium avium
NPAHLAHALVLLLTVGGAPSV

SEQ ID NO: 101299 - protein, 26 aa, Mycobacterium avium
NPAPWLPVYWVFGGFLRKRRNIRDMT

SEQ ID NO: 101300 - protein, 21 aa, Mycobacterium avium
NPDNGYVSFNFQVRDSDSMEI

SEQ ID NO: 101301 - protein, 23 aa, Mycobacterium avium
NPELTCTLLGSKYDAEFFGDVAG

SEQ ID NO: 101302 - protein, 17 aa, Mycobacterium avium
NPFPLNALGCLIRSITL

SEQ ID NO: 101303 - protein, 28 aa, Mycobacterium avium
NPGDPICSGGYQWASHLSYVPGLTNQAA

SEQ ID NO: 101304 - protein, 22 aa, Mycobacterium avium
NPIQRMWAGWLPPFGIVEHVGR

SEQ ID NO: 101305 - protein, 32 aa, Mycobacterium avium
NPKSWWRAALRFGYHMQFAWYVSLARALRLDD

SEQ ID NO: 101306 - protein, 23 aa, Mycobacterium avium
NPMLAQRLSVWVPLDEVPDVWEA

SEQ ID NO: 101307 - protein, 26 aa, Mycobacterium avium
NPNAFRRKEIPVEEILNSAVLNYPLT

SEQ ID NO: 101308 - protein, 19 aa, Mycobacterium avium
NPNHAVALVYVNQTVTVGN

SEQ ID NO: 101309 - protein, 18 aa, Mycobacterium avium
NPNLMFPQTPLSIGAKQG

SEQ ID NO: 101310 - protein, 18 aa, Mycobacterium avium
NPPELLAYQFDNADNHVV

SEQ ID NO: 101311 - protein, 21 aa, Mycobacterium avium
NPRGMSYLVVRGRRGGSAMAA

SEQ ID NO: 101312 - protein, 20 aa, Mycobacterium avium
NPRIHVVGTIGGRIAPELLF

SEQ ID NO: 101313 - protein, 24 aa, Mycobacterium avium
NPRYRDRIPLMIGGSGEKKTIPLA

SEQ ID NO: 101314 - protein, 18 aa, Mycobacterium avium
NPVTMAWLGAVNAVVQAW

SEQ ID NO: 101315 - protein, 24 aa, Mycobacterium avium
NQIEAFKQVFGREPSSAADWETAA

SEQ ID NO: 101316 - protein, 21 aa, Mycobacterium avium
NQRDWQRWAAAVGDHNPLYFD

SEQ ID NO: 101317 - protein, 23 aa, Mycobacterium avium
NQTHSLGFITVWVAKRDRESSEP

SEQ ID NO: 101318 - protein, 17 aa, Mycobacterium avium
NRAPVPGGVEVGSPKTA

SEQ ID NO: 101319 - protein, 20 aa, Mycobacterium avium
NRARLAMLLASNVFGQNSAA

SEQ ID NO: 101320 - protein, 19 aa, Mycobacterium avium
NRCNPRTGDKVVVFGAGPV

SEQ ID NO: 101321 - protein, 17 aa, Mycobacterium avium
NRDAPGVIAAWLQAGGR

SEQ ID NO: 101322 - protein, 22 aa, Mycobacterium avium
NRDAPGVIAAWLQAGGRLASSE

SEQ ID NO: 101323 - protein, 20 aa, Mycobacterium avium
NRFDPGLSVLAARFTDTDRI

SEQ ID NO: 101324 - protein, 17 aa, Mycobacterium avium
NRGKRSVGLALDNSEAR

SEQ ID NO: 101325 - protein, 26 aa, Mycobacterium avium
NRGPEPAPPAIRAELISGGKNTNAGI

SEQ ID NO: 101326 - protein, 18 aa, Mycobacterium avium
NRGVDKFICAMGVGDGQL

SEQ ID NO: 101327 - protein, 31 aa, Mycobacterium avium
NRIADGLGRTAAPVVLRWHIQRGDIVFPKTV

SEQ ID NO: 101328 - protein, 30 aa, Mycobacterium avium
NRIADGLGRTAAQVVLRWHIQRGDIVFPKT

SEQ ID NO: 101329 - protein, 31 aa, Mycobacterium avium
NRIADGLGRTAAQVVLRWHIQRGDVVFPKTV

SEQ ID NO: 101330 - protein, 20 aa, Mycobacterium avium
NRIVSCFSMTEPQGGADPKV

SEQ ID NO: 101331 - protein, 23 aa, Mycobacterium avium
NRKQLAALGRWMSSSQAEAVEES

SEQ ID NO: 101332 - protein, 20 aa, Mycobacterium avium
NRLAALWGPTVHLVADGVGL

SEQ ID NO: 101333 - protein, 17 aa, Mycobacterium avium
NRLLTAAMPRAAARAPI

SEQ ID NO: 101334 - protein, 25 aa, Mycobacterium avium
NRLTPASAAKLIWSQMRDVLPPAGQ

SEQ ID NO: 101335 - protein, 17 aa, Mycobacterium avium
NRLVAAMAGATVVVEAG

SEQ ID NO: 101336 - protein, 22 aa, Mycobacterium avium
NRMICDPYPRLLVARDQVNQGA

SEQ ID NO: 101337 - protein, 20 aa, Mycobacterium avium
NRMIEPRPAPSASTVSTCPP

SEQ ID NO: 101338 - protein, 25 aa, Mycobacterium avium
NRPLFPSLRGCLAGGAPITAELSRR

SEQ ID NO: 101339 - protein, 27 aa, Mycobacterium avium
NRRAAKHPGRRGFLRVGQRANRSPVSF

SEQ ID NO: 101340 - protein, 22 aa, Mycobacterium avium
NRRPVSWCRELLSATNRSSDYA

SEQ ID NO: 101341 - protein, 22 aa, Mycobacterium avium
NRSPRARLLALFDTPAPGDALM

SEQ ID NO: 101342 - protein, 22 aa, Mycobacterium avium
NRSPRARLLALFDTPSPGDALM

SEQ ID NO: 101343 - protein, 17 aa, Mycobacterium avium
NRSRLASLVATNLLGQN

SEQ ID NO: 101344 - protein, 18 aa, Mycobacterium avium
NRSWNCGVEGPTDDPDIT

SEQ ID NO: 101345 - protein, 18 aa, Mycobacterium avium
NRTNQHWIVELSQDDVVK

SEQ ID NO: 101346 - protein, 19 aa, Mycobacterium avium
NRVAVPVDLRHDWPEALRQ

SEQ ID NO: 101347 - protein, 17 aa, Mycobacterium avium
NRVECAVAYQAVLLCGA

SEQ ID NO: 101348 - protein, 18 aa, Mycobacterium avium
NRYARAGADIVFVEAPHD

SEQ ID NO: 101349 - protein, 17 aa, Mycobacterium avium
NRYASVWTVSAQLVDER

SEQ ID NO: 101350 - protein, 20 aa, Mycobacterium avium
NRYLPRFIRQFPFNVLLHDL

SEQ ID NO: 101351 - protein, 21 aa, Mycobacterium avium
NRYPNIRFLLSHAGGFVPYAS

SEQ ID NO: 101352 - protein, 25 aa, Mycobacterium avium
NRYPNIRFLLSHAGGFVPYASHRMA

SEQ ID NO: 101353 - protein, 23 aa, Mycobacterium avium
NSAGATVPVRWSVVPHDGGVAGA

SEQ ID NO: 101354 - protein, 20 aa, Mycobacterium avium
NSAGFGAPRYGVKPIVMPKP

SEQ ID NO: 101355 - protein, 23 aa, Mycobacterium avium
NSDDPAALALRFHSHLFGLGGAI

SEQ ID NO: 101356 - protein, 18 aa, Mycobacterium avium
NSIALFADYIEWRADHPS

SEQ ID NO: 101357 - protein, 17 aa, Mycobacterium avium
NSLFFRNAVNSGLPAIT

SEQ ID NO: 101358 - protein, 17 aa, Mycobacterium avium
NSNALALAEVWDAATVR

SEQ ID NO: 101359 - protein, 34 aa, Mycobacterium avium
NSNDCKCGGPISSPSCRRARLSPMTRTPESQQES

SEQ ID NO: 101360 - protein, 23 aa, Mycobacterium avium
NSPQRFQVTASRFGRSVDVAAAV

SEQ ID NO: 101361 - protein, 17 aa, Mycobacterium avium
NSPWLSVSACTGSPGCA

SEQ ID NO: 101362 - protein, 17 aa, Mycobacterium avium
NSRAIWELYGGWFHHRS

SEQ ID NO: 101363 - protein, 20 aa, Mycobacterium avium
NSVAPGPIWTPLIPSTMPPD

SEQ ID NO: 101364 - protein, 21 aa, Mycobacterium avium
NSVAPGPIWTPLIPSTMPPDS

SEQ ID NO: 101365 - protein, 19 aa, Mycobacterium avium
NSVILRPSPLTPISSLIFG

SEQ ID NO: 101366 - protein, 20 aa, Mycobacterium avium
NTALAPWPDRGGPRRAGVSS

SEQ ID NO: 101367 - protein, 18 aa, Mycobacterium avium
NTEFRIWSTTGRDVSSVS

SEQ ID NO: 101368 - protein, 17 aa, Mycobacterium avium
NTFRSALAVDRVVAMIT

SEQ ID NO: 101369 - protein, 27 aa, Mycobacterium avium
NTLETWKRLCDPMAQQISTVWAASLPE

SEQ ID NO: 101370 - protein, 17 aa, Mycobacterium avium
NTLWPRTLVATAAVQNL

SEQ ID NO: 101371 - protein, 17 aa, Mycobacterium avium
NTQPWSFVVVRAEENRK

SEQ ID NO: 101372 - protein, 23 aa, Mycobacterium avium
NTRGETQWIPPPHLDRNQPRTNT

SEQ ID NO: 101373 - protein, 21 aa, Mycobacterium avium
NTRIGQDVAELLRRSETLVNS

SEQ ID NO: 101374 - protein, 19 aa, Mycobacterium avium
NTTIPTKRSETFTTADDNQ

SEQ ID NO: 101375 - protein, 20 aa, Mycobacterium avium
NVAVSLGRSRLVVVDCDTTA

SEQ ID NO: 101376 - protein, 19 aa, Mycobacterium avium
NVDVPMMIVVVGSGAHIGG

SEQ ID NO: 101377 - protein, 19 aa, Mycobacterium avium
NVGVARFGRIGSIELDDLF

SEQ ID NO: 101378 - protein, 21 aa, Mycobacterium avium
NVIDPLDWVDMFGADALRFTL

SEQ ID NO: 101379 - protein, 28 aa, Mycobacterium avium
NVKDCIQVLGGIGCTWEHDAHLYLRRAH

SEQ ID NO: 101380 - protein, 18 aa, Mycobacterium avium
NVLTFAGKLWSRIVAEVG

SEQ ID NO: 101381 - protein, 25 aa, Mycobacterium avium
NVPRLVPGWTKPIVIGRHAFGDQYR

SEQ ID NO: 101382 - protein, 23 aa, Mycobacterium avium
NVPRRDLRMLAARLGSDVPFALH

SEQ ID NO: 101383 - protein, 29 aa, Mycobacterium avium
NVSKDLPFAQARFCGAEGIENVKTASAFR

SEQ ID NO: 101384 - protein, 19 aa, Mycobacterium avium
NVSRVRWVGYGGAPIAPSL

SEQ ID NO: 101385 - protein, 17 aa, Mycobacterium avium
NVTKAFLPHLLKRPTAH

SEQ ID NO: 101386 - protein, 18 aa, Mycobacterium avium
NWADRASPSWTRCGRRRS

SEQ ID NO: 101387 - protein, 23 aa, Mycobacterium avium
NWLALNCRRHMQLYGTRKEQLGW

SEQ ID NO: 101388 - protein, 22 aa, Mycobacterium avium
NWPEGSGGIMLGSHKPGAEWCR

SEQ ID NO: 101389 - protein, 25 aa, Mycobacterium avium
NWREDKRWTPAWSDEQRTAGYAGWH

SEQ ID NO: 101390 - protein, 21 aa, Mycobacterium avium
NWRLLGSVALGRLVTNFAGEA

SEQ ID NO: 101391 - protein, 18 aa, Mycobacterium avium
NWRSRRYSPWLAYSQSKL

SEQ ID NO: 101392 - protein, 20 aa, Mycobacterium avium
NWWLRARTAGDIGGARLALD

SEQ ID NO: 101393 - protein, 17 aa, Mycobacterium avium
NYCRHRGAMPACGSGNT

SEQ ID NO: 101394 - protein, 29 aa, Mycobacterium avium
NYPAIKGQNLFGFGWDIDTGYSRPRGRVF

SEQ ID NO: 101395 - protein, 18 aa, Mycobacterium avium
NYQDRIFPVPAISLNDPA

SEQ ID NO: 101396 - protein, 22 aa, Mycobacterium avium
NYVKETPGWTVSAGVDETHTHT

SEQ ID NO: 101397 - protein, 17 aa, Mycobacterium avium
PAAAAVDLPAAPCLHVF

SEQ ID NO: 101398 - protein, 18 aa, Mycobacterium avium
PAADFDFERSWRAVGPDD

SEQ ID NO: 101399 - protein, 17 aa, Mycobacterium avium
PAADVLLVLARATGGDG

SEQ ID NO: 101400 - protein, 19 aa, Mycobacterium avium
PAAFPRLLTLLAAAGHADA

SEQ ID NO: 101401 - protein, 22 aa, Mycobacterium avium
PAAIRLGLLAGHFRGDRYWSDQ

SEQ ID NO: 101402 - protein, 17 aa, Mycobacterium avium
PAAKIWDLIADVRNMGR

SEQ ID NO: 101403 - protein, 18 aa, Mycobacterium avium
PAALLRCLVEGADEVHVD

SEQ ID NO: 101404 - protein, 22 aa, Mycobacterium avium
PAARAGEMLNLVAAYAADPLDP

SEQ ID NO: 101405 - protein, 27 aa, Mycobacterium avium
PAARFEFPGDLGSGLVPVPATRPLVAA

SEQ ID NO: 101406 - protein, 29 aa, Mycobacterium avium
PAARGLGVLLCFAGRVLQPLGLSKVATED

SEQ ID NO: 101407 - protein, 34 aa, Mycobacterium avium
PAARPALGFCGSCPSGTVGRGGVVPMSFVQATPE

SEQ ID NO: 101408 - protein, 20 aa, Mycobacterium avium
PAARREFAEELGLAVPAGER

SEQ ID NO: 101409 - protein, 17 aa, Mycobacterium avium
PAARRPMELQAYDEFFF

SEQ ID NO: 101410 - protein, 23 aa, Mycobacterium avium
PAAVLKPYLIEAGIEPVMTNTSE

SEQ ID NO: 101411 - protein, 18 aa, Mycobacterium avium
PAAWSALVEFGLPGLAVD

SEQ ID NO: 101412 - protein, 27 aa, Mycobacterium avium
PACGNCRWCASGYTYLCDVGADIYSKA

SEQ ID NO: 101413 - protein, 19 aa, Mycobacterium avium
PADADVRGGNIFRDGSIPY

SEQ ID NO: 101414 - protein, 20 aa, Mycobacterium avium
PADADVRGGNIFRDGSIPYQ

SEQ ID NO: 101415 - protein, 23 aa, Mycobacterium avium
PADCAGAALFLCTEAASYITGST

SEQ ID NO: 101416 - protein, 21 aa, Mycobacterium avium
PADCTALPFGVPLPNNVCRVV

SEQ ID NO: 101417 - protein, 26 aa, Mycobacterium avium
PADGGVRLTGRWSWATGAMDADWLIV

SEQ ID NO: 101418 - protein, 26 aa, Mycobacterium avium
PADGGVRLTGRWSWATGAMEADWLIV

SEQ ID NO: 101419 - protein, 25 aa, Mycobacterium avium
PADGGVRLTGRWSWATGARDADWLI

SEQ ID NO: 101420 - protein, 21 aa, Mycobacterium avium
PADGRPAVMLLGSGDISRELA

SEQ ID NO: 101421 - protein, 27 aa, Mycobacterium avium
PADIERFARRFGCVVQDGFGSTEGGVA

SEQ ID NO: 101422 - protein, 20 aa, Mycobacterium avium
PADRARIVAEPQLIPRAVEE

SEQ ID NO: 101423 - protein, 21 aa, Mycobacterium avium
PADTMVRLCVAAINRDDSDEI

SEQ ID NO: 101424 - protein, 18 aa, Mycobacterium avium
PADVALPWVLSARSERAL

SEQ ID NO: 101425 - protein, 20 aa, Mycobacterium avium
PADVIVCCKFRDRRLDRAIV

SEQ ID NO: 101426 - protein, 21 aa, Mycobacterium avium
PADVIVCCKFRDRRLDRAIVE

SEQ ID NO: 101427 - protein, 19 aa, Mycobacterium avium
PAEALPWYRIASQSNGSEP

SEQ ID NO: 101428 - protein, 23 aa, Mycobacterium avium
PAEAVVAVGDWVRGELEYLPGTT

SEQ ID NO: 101429 - protein, 21 aa, Mycobacterium avium
PAEEPREPVSVPAGGVHDPVA

SEQ ID NO: 101430 - protein, 20 aa, Mycobacterium avium
PAEHWIHLRTTNPIESTFAT

SEQ ID NO: 101431 - protein, 22 aa, Mycobacterium avium
PAELPLRLCAGQHLQADIAVSV

SEQ ID NO: 101432 - protein, 31 aa, Mycobacterium avium
PAEPGKQPPGHLWRWELSPVNAELTTVTHTY

SEQ ID NO: 101433 - protein, 17 aa, Mycobacterium avium
PAERADFGWQVVDASGW

SEQ ID NO: 101434 - protein, 17 aa, Mycobacterium avium
PAERADFGWQVVDATGW

SEQ ID NO: 101435 - protein, 25 aa, Mycobacterium avium
PAERADLGWRVVNARDWSASRLREA

SEQ ID NO: 101436 - protein, 26 aa, Mycobacterium avium
PAEVLDRAFADFRHALDLLSTDASAW

SEQ ID NO: 101437 - protein, 23 aa, Mycobacterium avium
PAFGDLLGGMAIAGGIAAALYRK

SEQ ID NO: 101438 - protein, 24 aa, Mycobacterium avium
PAGAMSVPSAWARALCEHLLAEEF

SEQ ID NO: 101439 - protein, 23 aa, Mycobacterium avium
PAGELGGFFVKPTVLTGVDRSMR

SEQ ID NO: 101440 - protein, 18 aa, Mycobacterium avium
PAGGAPCPPGGGGAPGAA

SEQ ID NO: 101441 - protein, 19 aa, Mycobacterium avium
PAGLSAPVLDEFADAPRAP

SEQ ID NO: 101442 - protein, 29 aa, Mycobacterium avium
PAGSAPLSWPPGWSGWPHRVYGDTRLELA

SEQ ID NO: 101443 - protein, 18 aa, Mycobacterium avium
PAHLLAAVRGAEPVGEPV

SEQ ID NO: 101444 - protein, 18 aa, Mycobacterium avium
PAHVRPLLMPALQPEIRL

SEQ ID NO: 101445 - protein, 19 aa, Mycobacterium avium
PAIAGELYVAPSTVKTHVQ

SEQ ID NO: 101446 - protein, 28 aa, Mycobacterium avium
PAIETPWSALRWGRIIAEKTDIPAGVVN

SEQ ID NO: 101447 - protein, 17 aa, Mycobacterium avium
PAIGLDGAWMREIAEAM

SEQ ID NO: 101448 - protein, 20 aa, Mycobacterium avium
PAIGLDGAWMREIAEAMLSS

SEQ ID NO: 101449 - protein, 18 aa, Mycobacterium avium
PAIRGCSRPPGPRDAAPA

SEQ ID NO: 101450 - protein, 17 aa, Mycobacterium avium
PAISPALGEYARAALSA

SEQ ID NO: 101451 - protein, 24 aa, Mycobacterium avium
PAITKKWWDWTAIFEEHHRRVRRA

SEQ ID NO: 101452 - protein, 22 aa, Mycobacterium avium
PAKLRVGMRVQPVFCDYPEHDV

SEQ ID NO: 101453 - protein, 23 aa, Mycobacterium avium
PAKRSGGRAGLSVHGQARLLSEE

SEQ ID NO: 101454 - protein, 17 aa, Mycobacterium avium
PAKVWRMLTEPELMKLW

SEQ ID NO: 101455 - protein, 17 aa, Mycobacterium avium
PALAAGCTVVLKGAPDT

SEQ ID NO: 101456 - protein, 24 aa, Mycobacterium avium
PALAEAAADAFLLPVGDDVVVVHA

SEQ ID NO: 101457 - protein, 22 aa, Mycobacterium avium
PALAEAAADLFLLPSGDDLVLV

SEQ ID NO: 101458 - protein, 26 aa, Mycobacterium avium
PALAKLWAQACEWEPVTPKTLRLLQV

SEQ ID NO: 101459 - protein, 31 aa, Mycobacterium avium
PALCQLWKDNYCVYGARKLWKTARREGHDVG

SEQ ID NO: 101460 - protein, 20 aa, Mycobacterium avium
PALIAEAGGDPWAVDRSLQA

SEQ ID NO: 101461 - protein, 24 aa, Mycobacterium avium
PALIAEAGGDPWAVDRSLQAGSPF

SEQ ID NO: 101462 - protein, 24 aa, Mycobacterium avium
PALIAFAGGDPWAINRSLQAGSPL

SEQ ID NO: 101463 - protein, 20 aa, Mycobacterium avium
PALLWIHGGGTVMGRAAQDD

SEQ ID NO: 101464 - protein, 25 aa, Mycobacterium avium
PALPGERIGFMLADAAPLVAISTAE

SEQ ID NO: 101465 - protein, 24 aa, Mycobacterium avium
PALPGERIGFMLADAAPMVAISTA

SEQ ID NO: 101466 - protein, 21 aa, Mycobacterium avium
PALWIPDVGGPVFDAVGHLLE

SEQ ID NO: 101467 - protein, 20 aa, Mycobacterium avium
PAMHTEMWLHPATVDNVATL

SEQ ID NO: 101468 - protein, 29 aa, Mycobacterium avium
PAMPGQTGMTGMPMMPPGAMGAGGEGGNK

SEQ ID NO: 101469 - protein, 18 aa, Mycobacterium avium
PANFCGPLVSAKQRDRVM

SEQ ID NO: 101470 - protein, 44 aa, Mycobacterium avium
PAPDGGRAALPFNGLRVLDLTTFWAGPCCTHFMAMLGAEVIHVE

SEQ ID NO: 101471 - protein, 27 aa, Mycobacterium avium
PAPELDPRWAPAFPDRFGGWDIGVRME

SEQ ID NO: 101472 - protein, 23 aa, Mycobacterium avium
PAPEPPKGPGLIERMITSKLRAQ

SEQ ID NO: 101473 - protein, 25 aa, Mycobacterium avium
PAPGDALMRGCPFHNAAVEAGQTMP

SEQ ID NO: 101474 - protein, 26 aa, Mycobacterium avium
PAPGGVKLAAGWLVERAGFGKGYPVP

SEQ ID NO: 101475 - protein, 26 aa, Mycobacterium avium
PAPGVWALCHSLAFDVSVWEIFGALV

SEQ ID NO: 101476 - protein, 20 aa, Mycobacterium avium
PAPIGRAWMSQMRQGWPHRC

SEQ ID NO: 101477 - protein, 20 aa, Mycobacterium avium
PAPPPELLAEPGRWAYYPWR

SEQ ID NO: 101478 - protein, 17 aa, Mycobacterium avium
PAPRIIAAVPVLLSDDV

SEQ ID NO: 101479 - protein, 29 aa, Mycobacterium avium
PAPVARFLAHWVRRAGPRIVEPSCGDGAI

SEQ ID NO: 101480 - protein, 29 aa, Mycobacterium avium
PAPVARFLARWVRRAGPRIVEPSCGDGAI

SEQ ID NO: 101481 - protein, 24 aa, Mycobacterium avium
PAPWVPVYWVFGGFLRKRRNIRDM

SEQ ID NO: 101482 - protein, 18 aa, Mycobacterium avium
PAQPLAWWPEVKAQANVV

SEQ ID NO: 101483 - protein, 17 aa, Mycobacterium avium
PAQSLALVPLAAGGLHA

SEQ ID NO: 101484 - protein, 25 aa, Mycobacterium avium
PARKRRMFDLLVRMGYKEIEVGFPS

SEQ ID NO: 101485 - protein, 22 aa, Mycobacterium avium
PARLRRLLTKAGRRRHLDRDIE

SEQ ID NO: 101486 - protein, 21 aa, Mycobacterium avium
PARMLRTAWTDEWDRPENPDP

SEQ ID NO: 101487 - protein, 22 aa, Mycobacterium avium
PARNACAILALELLVHAWDYAR

SEQ ID NO: 101488 - protein, 23 aa, Mycobacterium avium
PARQWPPDRFAAVAAALRDDGHE

SEQ ID NO: 101489 - protein, 28 aa, Mycobacterium avium
PARRSLLHWECIHPVPPATTATLKSDPR

SEQ ID NO: 101490 - protein, 25 aa, Mycobacterium avium
PARSRPPARWWPAPPARRRGAVVCR

SEQ ID NO: 101491 - protein, 22 aa, Mycobacterium avium
PARTVYRLAPRTAAPEAAAPRP

SEQ ID NO: 101492 - protein, 18 aa, Mycobacterium avium
PARVNGRLLPNVPSPLSR

SEQ ID NO: 101493 - protein, 18 aa, Mycobacterium avium
PASARLFVASALARLGPL

SEQ ID NO: 101494 - protein, 20 aa, Mycobacterium avium
PASARLFVASALARLGPLLV

SEQ ID NO: 101495 - protein, 17 aa, Mycobacterium avium
PASGGVVLTGRLSPSLQ

SEQ ID NO: 101496 - protein, 17 aa, Mycobacterium avium
PASGRCRDCGGALVARE

SEQ ID NO: 101497 - protein, 18 aa, Mycobacterium avium
PASGRCRDCGGALVAREV

SEQ ID NO: 101498 - protein, 25 aa, Mycobacterium avium
PASNITRLPVRYTFDNRYFSDTYEG

SEQ ID NO: 101499 - protein, 23 aa, Mycobacterium avium
PASPGDFFDLVGMAHWRALDEKY

SEQ ID NO: 101500 - protein, 18 aa, Mycobacterium avium
PASSFAIVGYAARFPDAA

SEQ ID NO: 101501 - protein, 17 aa, Mycobacterium avium
PATECYADGSADLIAAT

SEQ ID NO: 101502 - protein, 23 aa, Mycobacterium avium
PATGELLGTVGIAGPDDVGAAVA

SEQ ID NO: 101503 - protein, 18 aa, Mycobacterium avium
PATLGFPSFHDDYWDPMW

SEQ ID NO: 101504 - protein, 19 aa, Mycobacterium avium
PATPGISFPGVPAAGSPVS

SEQ ID NO: 101505 - protein, 19 aa, Mycobacterium avium
PATPGISFPGVPAAGSPVT

SEQ ID NO: 101506 - protein, 26 aa, Mycobacterium avium
PATRLLRPSIMWRAARARGADHPGTA

SEQ ID NO: 101507 - protein, 19 aa, Mycobacterium avium
PATRSYRYIDYWGTAVTAF

SEQ ID NO: 101508 - protein, 20 aa, Mycobacterium avium
PATRSYRYIDYWGTAVTAFD

SEQ ID NO: 101509 - protein, 20 aa, Mycobacterium avium
PAVCSGAAIVPAKFSARNFL

SEQ ID NO: 101510 - protein, 19 aa, Mycobacterium avium
PAVELAYYLGVACVLVEQS

SEQ ID NO: 101511 - protein, 19 aa, Mycobacterium avium
PAVIYCHAGGFALGNLDTD

SEQ ID NO: 101512 - protein, 27 aa, Mycobacterium avium
PAVLANRARLLVLIATNFFGQNTAAIA

SEQ ID NO: 101513 - protein, 25 aa, Mycobacterium avium
PAVLGLARDGGWWVFGVAAPALADC

SEQ ID NO: 101514 - protein, 26 aa, Mycobacterium avium
PAVLGLARDGGWWVFGVAAPALADCL

SEQ ID NO: 101515 - protein, 26 aa, Mycobacterium avium
PAVLGLARDGGWWVLGVAAPVLADCL

SEQ ID NO: 101516 - protein, 19 aa, Mycobacterium avium
PAVRDRSWMATLSTHDVSP

SEQ ID NO: 101517 - protein, 19 aa, Mycobacterium avium
PAVRRRGGVLVLFTSPALQ

SEQ ID NO: 101518 - protein, 23 aa, Mycobacterium avium
PAVSRLPLGGMVGRESEGPVHRV

SEQ ID NO: 101519 - protein, 26 aa, Mycobacterium avium
PAVWMRLVVLGVKFREAYGVDARVTD

SEQ ID NO: 101520 - protein, 27 aa, Mycobacterium avium
PAYARAFEPKIRWEAAVFDQSPGIDSA

SEQ ID NO: 101521 - protein, 26 aa, Mycobacterium avium
PAYARAFEPKIRWEAAVFEESPGIDA

SEQ ID NO: 101522 - protein, 18 aa, Mycobacterium avium
PAYDESWDDILLQRLRAA

SEQ ID NO: 101523 - protein, 19 aa, Mycobacterium avium
PAYDESWDDILLQRLRAAA

SEQ ID NO: 101524 - protein, 17 aa, Mycobacterium avium
PAYDVPALLAARSSSVD

SEQ ID NO: 101525 - protein, 17 aa, Mycobacterium avium
PCAQAALQETIVRSDDL

SEQ ID NO: 101526 - protein, 18 aa, Mycobacterium avium
PCDVGRAGLPEEVASVTA

SEQ ID NO: 101527 - protein, 22 aa, Mycobacterium avium
PCDVSHAVVYLAADESRYVTGQ

SEQ ID NO: 101528 - protein, 20 aa, Mycobacterium avium
PCLEKHEFEHLAVQRHRRAL

SEQ ID NO: 101529 - protein, 26 aa, Mycobacterium avium
PCPGPLGERADWWWYDPFQPQPPPSN

SEQ ID NO: 101530 - protein, 26 aa, Mycobacterium avium
PCPGPLGERADWWWYDPFQPQPPPTN

SEQ ID NO: 101531 - protein, 18 aa, Mycobacterium avium
PCYEVEFSDGTVIVADAA

SEQ ID NO: 101532 - protein, 30 aa, Mycobacterium avium
PDAEFAELLARAGVPLVAFGDSLRAMKTAA

SEQ ID NO: 101533 - protein, 21 aa, Mycobacterium avium
PDAEHGPGWHLAVLPLTDGGA

SEQ ID NO: 101534 - protein, 22 aa, Mycobacterium avium
PDAEPPRFVGMYERGATAIPVV

SEQ ID NO: 101535 - protein, 20 aa, Mycobacterium avium
PDAKFLWSHRDPAKVMASVC

SEQ ID NO: 101536 - protein, 17 aa, Mycobacterium avium
PDAPSYFVLAPRDGGAV

SEQ ID NO: 101537 - protein, 18 aa, Mycobacterium avium
PDAPTLCEGWTTRDLAAH

SEQ ID NO: 101538 - protein, 21 aa, Mycobacterium avium
PDARGIYYGRLSEMTSTDFQV

SEQ ID NO: 101539 - protein, 17 aa, Mycobacterium avium
PDARITLSPLGFVAEGR

SEQ ID NO: 101540 - protein, 18 aa, Mycobacterium avium
PDARITVSPLGFVAEGRS

SEQ ID NO: 101541 - protein, 17 aa, Mycobacterium avium
PDARPGLVEAARLTEAL

SEQ ID NO: 101542 - protein, 17 aa, Mycobacterium avium
PDAWEFVAAEVIPRLLA

SEQ ID NO: 101543 - protein, 25 aa, Mycobacterium avium
PDDARLGVLLAGWCGLRKGEVFALR

SEQ ID NO: 101544 - protein, 18 aa, Mycobacterium avium
PDDDGAWLARTCAEFEGL

SEQ ID NO: 101545 - protein, 17 aa, Mycobacterium avium
PDDEAPCVAGEPDEESA

SEQ ID NO: 101546 - protein, 18 aa, Mycobacterium avium
PDDEAPCVAGEPDEESAT

SEQ ID NO: 101547 - protein, 17 aa, Mycobacterium avium
PDDFAIWAHVDVLVDDD

SEQ ID NO: 101548 - protein, 24 aa, Mycobacterium avium
PDDGFVTVIYRWARTADLAAALAA

SEQ ID NO: 101549 - protein, 25 aa, Mycobacterium avium
PDDKWRGIEAPVMIVASGKDHGVYQ

SEQ ID NO: 101550 - protein, 24 aa, Mycobacterium avium
PDDLEIRAPWTLPKRSRKAGPSSR

SEQ ID NO: 101551 - protein, 20 aa, Mycobacterium avium
PDDRLAAALYRATAKTTFPV

SEQ ID NO: 101552 - protein, 21 aa, Mycobacterium avium
PDDRLAAALYRATAKTTFPVW

SEQ ID NO: 101553 - protein, 21 aa, Mycobacterium avium
PDDRLAAALYRATARTTFPVW

SEQ ID NO: 101554 - protein, 25 aa, Mycobacterium avium
PDEKEILFPAGSKFYVVSKTVDPQT

SEQ ID NO: 101555 - protein, 27 aa, Mycobacterium avium
PDERLGEVPWAFVVRGDESVSEAGLVS

SEQ ID NO: 101556 - protein, 18 aa, Mycobacterium avium
PDERVWPLPDHAFTHDGQ

SEQ ID NO: 101557 - protein, 20 aa, Mycobacterium avium
PDFNSGGVLNAREDFITAHP

SEQ ID NO: 101558 - protein, 22 aa, Mycobacterium avium
PDFRDYAVPVSRPGSVTHEATR

SEQ ID NO: 101559 - protein, 25 aa, Mycobacterium avium
PDGAGWRWRTWHLYPDLPAGRGGTV

SEQ ID NO: 101560 - protein, 26 aa, Mycobacterium avium
PDGAGWRWRTWHLYPDRPAGRGGTVV

SEQ ID NO: 101561 - protein, 18 aa, Mycobacterium avium
PDGFAVQVDRRVRVLGDG

SEQ ID NO: 101562 - protein, 21 aa, Mycobacterium avium
PDGHAGTWVRANFIASVDGGA

SEQ ID NO: 101563 - protein, 26 aa, Mycobacterium avium
PDGLPAIEDLHIWTAESVRADRLDFR

SEQ ID NO: 101564 - protein, 21 aa, Mycobacterium avium
PDGPELVWLGAAMIIGAGSTS

SEQ ID NO: 101565 - protein, 28 aa, Mycobacterium avium
PDGSRATVIAWIWARTVTCPNPACGIAM

SEQ ID NO: 101566 - protein, 17 aa, Mycobacterium avium
PDGTAVPGFVDMHVHGG

SEQ ID NO: 101567 - protein, 24 aa, Mycobacterium avium
PDGTEPFCGVAVRGFPNYFFACGP

SEQ ID NO: 101568 - protein, 19 aa, Mycobacterium avium
PDGTLVPGFVDMHVHGGGG

SEQ ID NO: 101569 - protein, 26 aa, Mycobacterium avium
PDIDLGWWLMFERFLCEALGFTRLPG

SEQ ID NO: 101570 - protein, 17 aa, Mycobacterium avium
PDIDMTPHRGFYRVAAI

SEQ ID NO: 101571 - protein, 18 aa, Mycobacterium avium
PDKRAVAMVVEITDPQTA

SEQ ID NO: 101572 - protein, 24 aa, Mycobacterium avium
PDLAEAWSHLLARLGEAAQMVESD

SEQ ID NO: 101573 - protein, 22 aa, Mycobacterium avium
PDLDGIRVLRTFDESLALREHA

SEQ ID NO: 101574 - protein, 18 aa, Mycobacterium avium
PDLELVGVRVYDAGKAGV

SEQ ID NO: 101575 - protein, 18 aa, Mycobacterium avium
PDLFLLRQIHAAPRLTVN

SEQ ID NO: 101576 - protein, 19 aa, Mycobacterium avium
PDLFLLRQIHAAPRLTVNA

SEQ ID NO: 101577 - protein, 18 aa, Mycobacterium avium
PDLPWPGRLPEPSPSVLL

SEQ ID NO: 101578 - protein, 18 aa, Mycobacterium avium
PDLRGCVGGGAPITAELG

SEQ ID NO: 101579 - protein, 20 aa, Mycobacterium avium
PDLSPGAAMTMSYLDAAPVK

SEQ ID NO: 101580 - protein, 17 aa, Mycobacterium avium
PDMKRIGAGGPLPISHN

SEQ ID NO: 101581 - protein, 22 aa, Mycobacterium avium
PDNELRRIAALCAAFDVDGMRA

SEQ ID NO: 101582 - protein, 20 aa, Mycobacterium avium
PDPFADPGWFLTDDLGAVDD

SEQ ID NO: 101583 - protein, 17 aa, Mycobacterium avium
PDPLPPHRYRLVNQTAG

SEQ ID NO: 101584 - protein, 24 aa, Mycobacterium avium
PDPLPWHPLGMAIDVMIPDPESAQ

SEQ ID NO: 101585 - protein, 17 aa, Mycobacterium avium
PDPPGICVVTSDRTLAE

SEQ ID NO: 101586 - protein, 17 aa, Mycobacterium avium
PDPRLVYPPYSQRALGV

SEQ ID NO: 101587 - protein, 18 aa, Mycobacterium avium
PDPRPRRVLFVSGGSGIT

SEQ ID NO: 101588 - protein, 19 aa, Mycobacterium avium
PDPRPRRVLFVSGGSGITP

SEQ ID NO: 101589 - protein, 18 aa, Mycobacterium avium
PDPWPKARHHKRRFLQPG

SEQ ID NO: 101590 - protein, 25 aa, Mycobacterium avium
PDRFPGVIAEPLIPPARASAYRCGE

SEQ ID NO: 101591 - protein, 24 aa, Mycobacterium avium
PDRYLRIAAAMRREGMGMTSGFAA

SEQ ID NO: 101592 - protein, 20 aa, Mycobacterium avium
PDSGAAWLLPRLIGLVRTRQ

SEQ ID NO: 101593 - protein, 24 aa, Mycobacterium avium
PDSGSTWLLARLVGLARARRMLLL

SEQ ID NO: 101594 - protein, 22 aa, Mycobacterium avium
PDSHARGGLAARLTTECGRQVE

SEQ ID NO: 101595 - protein, 23 aa, Mycobacterium avium
PDSPRPRGFWAIGAHRDVVDISR

SEQ ID NO: 101596 - protein, 23 aa, Mycobacterium avium
PDTCRKLAKRAAALGVSVVDAPV

SEQ ID NO: 101597 - protein, 22 aa, Mycobacterium avium
PDTCRKLTKRAAALGVSVVDAP

SEQ ID NO: 101598 - protein, 19 aa, Mycobacterium avium
PDTDVGLVLRVAAASASTG

SEQ ID NO: 101599 - protein, 26 aa, Mycobacterium avium
PDTEFGTRWFADKAFWVKDGQNYLPF

SEQ ID NO: 101600 - protein, 21 aa, Mycobacterium avium
PDTELRRIAALCAAFDVDGMR

SEQ ID NO: 101601 - protein, 24 aa, Mycobacterium avium
PDTLTADVGIEFTAPDVTTAMNQT

SEQ ID NO: 101602 - protein, 25 aa, Mycobacterium avium
PDTPRFAVAHAVRFDQLVSGADPNA

SEQ ID NO: 101603 - protein, 19 aa, Mycobacterium avium
PDTPRSVLRSLSLHASTDP

SEQ ID NO: 101604 - protein, 17 aa, Mycobacterium avium
PDTRLVLGGYSLGAAVT

SEQ ID NO: 101605 - protein, 18 aa, Mycobacterium avium
PDTRLVLGGYSLGAAVTD

SEQ ID NO: 101606 - protein, 24 aa, Mycobacterium avium
PDTSNPSHRLWCASQAPRDRRSSS

SEQ ID NO: 101607 - protein, 22 aa, Mycobacterium avium
PDTVNLVTAWRMLRATDPRSRL

SEQ ID NO: 101608 - protein, 17 aa, Mycobacterium avium
PDVALELGTYCGYGALR

SEQ ID NO: 101609 - protein, 19 aa, Mycobacterium avium
PDVAVGFPIAGRRDPALDD

SEQ ID NO: 101610 - protein, 23 aa, Mycobacterium avium
PDWPRHPSPLGGYRVIVDGLPTY

SEQ ID NO: 101611 - protein, 21 aa, Mycobacterium avium
PDYARTDWRLERQDVVKAFSM

SEQ ID NO: 101612 - protein, 17 aa, Mycobacterium avium
PEAAEGFRAFKQKDSPD

SEQ ID NO: 101613 - protein, 21 aa, Mycobacterium avium
PEAFDGWKQRNHKGAGASVAD

SEQ ID NO: 101614 - protein, 19 aa, Mycobacterium avium
PEAGNAFDALMLDELEAAW

SEQ ID NO: 101615 - protein, 23 aa, Mycobacterium avium
PEAGRLLYSLVRATRPATVVEFG

SEQ ID NO: 101616 - protein, 27 aa, Mycobacterium avium
PEAHPRGGVELELFASVFDYAMQLTAD

SEQ ID NO: 101617 - protein, 32 aa, Mycobacterium avium
PEALQMPSIHTRYWYPLFEAVCENKTVLCTHV

SEQ ID NO: 101618 - protein, 17 aa, Mycobacterium avium
PEANLAVFLSYRDCDEV

SEQ ID NO: 101619 - protein, 17 aa, Mycobacterium avium
PEAPGWYPNLKAKPEAE

SEQ ID NO: 101620 - protein, 21 aa, Mycobacterium avium
PEARIKFAGIHVHPQVIAENA

SEQ ID NO: 101621 - protein, 21 aa, Mycobacterium avium
PEARPEPRAEPTPEPKPAPEP

SEQ ID NO: 101622 - protein, 17 aa, Mycobacterium avium
PEATAITRAIAHAPAGL

SEQ ID NO: 101623 - protein, 23 aa, Mycobacterium avium
PEDIADAVAWLASDQSRFVTASG

SEQ ID NO: 101624 - protein, 18 aa, Mycobacterium avium
PEDIIVFCGVHFMAETAK

SEQ ID NO: 101625 - protein, 20 aa, Mycobacterium avium
PEDLCALLIDEHVDVLSQTP

SEQ ID NO: 101626 - protein, 20 aa, Mycobacterium avium
PEDLCALLIEERVDVLSQTP

SEQ ID NO: 101627 - protein, 19 aa, Mycobacterium avium
PEDRPWRLGISSAGTFENL

SEQ ID NO: 101628 - protein, 20 aa, Mycobacterium avium
PEDRPWRLGISSAGTFENLQ

SEQ ID NO: 101629 - protein, 18 aa, Mycobacterium avium
PEDYAQWFPESHPPTAEA

SEQ ID NO: 101630 - protein, 17 aa, Mycobacterium avium
PEDYVQWFPESHPPTAE

SEQ ID NO: 101631 - protein, 20 aa, Mycobacterium avium
PEEGVGVFVHTGRWPTDLDL

SEQ ID NO: 101632 - protein, 29 aa, Mycobacterium avium
PEELADAFAKAWYKLLHRDMGLVSRFLGP

SEQ ID NO: 101633 - protein, 21 aa, Mycobacterium avium
PEEPHWYLAVIGSDPVVRGKG

SEQ ID NO: 101634 - protein, 20 aa, Mycobacterium avium
PEERILFTGNLFGPLFGHVP

SEQ ID NO: 101635 - protein, 17 aa, Mycobacterium avium
PEFLTRMLARMVPHPDR

SEQ ID NO: 101636 - protein, 20 aa, Mycobacterium avium
PEFRLLIDTMHIARLGTRPA

SEQ ID NO: 101637 - protein, 26 aa, Mycobacterium avium
PEFVAAAATDLARIGSTISSANTAAL

SEQ ID NO: 101638 - protein, 20 aa, Mycobacterium avium
PEGDGLVIGGPLGDLLEGLT

SEQ ID NO: 101639 - protein, 20 aa, Mycobacterium avium
PEGGRRLFVFLGSTIGNLTP

SEQ ID NO: 101640 - protein, 27 aa, Mycobacterium avium
PEGKHAASAFALWFPIEGEVDYGRAKI

SEQ ID NO: 101641 - protein, 17 aa, Mycobacterium avium
PEGLQLCYVCSMSEVAS

SEQ ID NO: 101642 - protein, 17 aa, Mycobacterium avium
PEGRRLGETGAHGGALV

SEQ ID NO: 101643 - protein, 20 aa, Mycobacterium avium
PEGSGGIMLGSHKPGAEWCR

SEQ ID NO: 101644 - protein, 21 aa, Mycobacterium avium
PEHAAGVAIERCAELVVAWWA

SEQ ID NO: 101645 - protein, 24 aa, Mycobacterium avium
PEHPFPVWTERGGPATIVPMFLLY

SEQ ID NO: 101646 - protein, 19 aa, Mycobacterium avium
PEHVRTWFAGLGNEHETRN

SEQ ID NO: 101647 - protein, 22 aa, Mycobacterium avium
PEIEGTPPLIARAFNKYVDRVL

SEQ ID NO: 101648 - protein, 18 aa, Mycobacterium avium
PEIREVRRSDFCGHFIGE

SEQ ID NO: 101649 - protein, 26 aa, Mycobacterium avium
PELAGRETFSGISIHSAHWDPELDLT

SEQ ID NO: 101650 - protein, 23 aa, Mycobacterium avium
PELLWPNSVRTYTRMWREDSRLA

SEQ ID NO: 101651 - protein, 19 aa, Mycobacterium avium
PELLYRLVVDEHLGPLAAG

SEQ ID NO: 101652 - protein, 17 aa, Mycobacterium avium
PELRALANQVGVKGTSG

SEQ ID NO: 101653 - protein, 19 aa, Mycobacterium avium
PELRRAHERELLDNYRGRL

SEQ ID NO: 101654 - protein, 21 aa, Mycobacterium avium
PELRSSYARALHRATKPGARL

SEQ ID NO: 101655 - protein, 25 aa, Mycobacterium avium
PELVPRQVVIVGFPGVQALDVVGPH

SEQ ID NO: 101656 - protein, 19 aa, Mycobacterium avium
PELVSAAVLMGTRGRMDRA

SEQ ID NO: 101657 - protein, 31 aa, Mycobacterium avium
PELWRQPGRGPGRFWGVYGLKKAIAVAEVAQ

SEQ ID NO: 101658 - protein, 27 aa, Mycobacterium avium
PEPALRLVAVARLRLLCRAAGITEVSA

SEQ ID NO: 101659 - protein, 20 aa, Mycobacterium avium
PEPGAAVLRRMRLQPAGHGD

SEQ ID NO: 101660 - protein, 26 aa, Mycobacterium avium
PEPGARCPRCPCLAPQDVPRSPARPA

SEQ ID NO: 101661 - protein, 24 aa, Mycobacterium avium
PEPGHKAAPSWLDKAGFTPFSGIA

SEQ ID NO: 101662 - protein, 20 aa, Mycobacterium avium
PEPPYKWIPIMIDPPDHAKW

SEQ ID NO: 101663 - protein, 17 aa, Mycobacterium avium
PEPVLALIGKDLPPVSG

SEQ ID NO: 101664 - protein, 19 aa, Mycobacterium avium
PEQLAALAGTLADCLNPDG

SEQ ID NO: 101665 - protein, 19 aa, Mycobacterium avium
PERARCVVLGLVAATTAGV

SEQ ID NO: 101666 - protein, 20 aa, Mycobacterium avium
PERARCVVLGLVAATTAGVI

SEQ ID NO: 101667 - protein, 21 aa, Mycobacterium avium
PERARCVVLGLVAATTAGVIQ

SEQ ID NO: 101668 - protein, 24 aa, Mycobacterium avium
PERDARAAGVEWGRELIDECGRTG

SEQ ID NO: 101669 - protein, 26 aa, Mycobacterium avium
PERDRPRIFDLFDRILKALAPEAHPR

SEQ ID NO: 101670 - protein, 40 aa, Mycobacterium avium
PERHWPALCRAVGRPEWRDDPRFADARARAANSVALIAAL

SEQ ID NO: 101671 - protein, 18 aa, Mycobacterium avium
PERLPAAEALSWGLVTAV

SEQ ID NO: 101672 - protein, 26 aa, Mycobacterium avium
PERVSAELAAAGLRRTRWWTDGADDF

SEQ ID NO: 101673 - protein, 26 aa, Mycobacterium avium
PERVSAELAAAGLRRTRWWTDGAEDF

SEQ ID NO: 101674 - protein, 20 aa, Mycobacterium avium
PERWTFVDEIPRTSVGKYDK

SEQ ID NO: 101675 - protein, 18 aa, Mycobacterium avium
PESACRELGREADEVVCL

SEQ ID NO: 101676 - protein, 21 aa, Mycobacterium avium
PESDLRVCGGGFRALATAPEV

SEQ ID NO: 101677 - protein, 21 aa, Mycobacterium avium
PESFGQLLARAEDRGGRVTGI

SEQ ID NO: 101678 - protein, 20 aa, Mycobacterium avium
PESLPIKGFLSFDETRVELL

SEQ ID NO: 101679 - protein, 24 aa, Mycobacterium avium
PESLWRECAELGLLTLGLDEASGG

SEQ ID NO: 101680 - protein, 24 aa, Mycobacterium avium
PESRKLFIRQGFDRWDEAPAQLRI

SEQ ID NO: 101681 - protein, 24 aa, Mycobacterium avium
PESRKLFIRQGFDRWDETPAQLRI

SEQ ID NO: 101682 - protein, 23 aa, Mycobacterium avium
PESRKLFIRQGFDSWDEAPAQLR

SEQ ID NO: 101683 - protein, 17 aa, Mycobacterium avium
PETAQGIFVNFANVVTT

SEQ ID NO: 101684 - protein, 20 aa, Mycobacterium avium
PETIAYGLIPRAHRGIVAVN

SEQ ID NO: 101685 - protein, 19 aa, Mycobacterium avium
PETIDRLLAAYIATVSDGL

SEQ ID NO: 101686 - protein, 17 aa, Mycobacterium avium
PETNYRIGFVPQGIGAD

SEQ ID NO: 101687 - protein, 31 aa, Mycobacterium avium
PETSVALGCGFRCGFLGLLHMEITRERLERE

SEQ ID NO: 101688 - protein, 17 aa, Mycobacterium avium
PEVACALHRGLLQGLAG

SEQ ID NO: 101689 - protein, 20 aa, Mycobacterium avium
PEVDSLLTAAARLFTAGADV

SEQ ID NO: 101690 - protein, 18 aa, Mycobacterium avium
PEVGRFDDFFALGGDSIL

SEQ ID NO: 101691 - protein, 19 aa, Mycobacterium avium
PEVHSAALSSGPGPGSLLA

SEQ ID NO: 101692 - protein, 24 aa, Mycobacterium avium
PEVTGQFGTPAWIISQGPQVLLDA

SEQ ID NO: 101693 - protein, 18 aa, Mycobacterium avium
PEVWSALVEFGLPGLAVD

SEQ ID NO: 101694 - protein, 17 aa, Mycobacterium avium
PFAMWVLEDDFADGRPP

SEQ ID NO: 101695 - protein, 18 aa, Mycobacterium avium
PFDAATLERLYPGGRTEY

SEQ ID NO: 101696 - protein, 21 aa, Mycobacterium avium
PFDDVEEALRLAATPGAADKV

SEQ ID NO: 101697 - protein, 18 aa, Mycobacterium avium
PFDLLLQLIFVHRLDVTE

SEQ ID NO: 101698 - protein, 22 aa, Mycobacterium avium
PFDPHLRPGGVIDVNAEMAPAT

SEQ ID NO: 101699 - protein, 18 aa, Mycobacterium avium
PFDRDRTGFVFGEAGALM

SEQ ID NO: 101700 - protein, 18 aa, Mycobacterium avium
PFEALAGFRPASRTVELL

SEQ ID NO: 101701 - protein, 18 aa, Mycobacterium avium
PFEPWSVADFSKYLHTLG

SEQ ID NO: 101702 - protein, 18 aa, Mycobacterium avium
PFFAYLPFQAPHWPLQAP

SEQ ID NO: 101703 - protein, 22 aa, Mycobacterium avium
PFGGAYRLIDFVLSNLVNARYL

SEQ ID NO: 101704 - protein, 23 aa, Mycobacterium avium
PFGLYVHVPFCVTRCGYCDFNTY

SEQ ID NO: 101705 - protein, 27 aa, Mycobacterium avium
PFHRPKLPGIPGIKTFGGHSFHSSRWD

SEQ ID NO: 101706 - protein, 26 aa, Mycobacterium avium
PFLANRIEAAEAMVQRNCMVPMQLCH

SEQ ID NO: 101707 - protein, 18 aa, Mycobacterium avium
PFLPTVAVSAVISEVGTD

SEQ ID NO: 101708 - protein, 19 aa, Mycobacterium avium
PFMEQSAHWFLDQQITTGQ

SEQ ID NO: 101709 - protein, 18 aa, Mycobacterium avium
PFRECVSVAGGTNGVLNA

SEQ ID NO: 101710 - protein, 25 aa, Mycobacterium avium
PFRRRELPIVHVVRLYRADGSNADP

SEQ ID NO: 101711 - protein, 23 aa, Mycobacterium avium
PFSEQLVMWWNFVGRSHEDIVGY

SEQ ID NO: 101712 - protein, 19 aa, Mycobacterium avium
PFTDGRWLLSHNGVVDRSV

SEQ ID NO: 101713 - protein, 19 aa, Mycobacterium avium
PFVPPCMPLGSGPAMAELF

SEQ ID NO: 101714 - protein, 17 aa, Mycobacterium avium
PFYAAAVELEMPLGVHG

SEQ ID NO: 101715 - protein, 20 aa, Mycobacterium avium
PGACDSTLLIAERVQSYAEV

SEQ ID NO: 101716 - protein, 26 aa, Mycobacterium avium
PGAGSLIRAAAAWDGLARQLRAVATS

SEQ ID NO: 101717 - protein, 21 aa, Mycobacterium avium
PGAIIPPTFLTSAARWAPPGV

SEQ ID NO: 101718 - protein, 18 aa, Mycobacterium avium
PGALIAVAGDLGRSAAGF

SEQ ID NO: 101719 - protein, 21 aa, Mycobacterium avium
PGALPDFIGLALRVNAPQPAG

SEQ ID NO: 101720 - protein, 25 aa, Mycobacterium avium
PGAPARWNSTWTRYPSSRRCPPPAS

SEQ ID NO: 101721 - protein, 21 aa, Mycobacterium avium
PGAPDPGSFWRLLRDGREVTR

SEQ ID NO: 101722 - protein, 18 aa, Mycobacterium avium
PGAPRIPIWWAGTSPRAR

SEQ ID NO: 101723 - protein, 19 aa, Mycobacterium avium
PGARITFAEWIGRARSVAT

SEQ ID NO: 101724 - protein, 18 aa, Mycobacterium avium
PGASQWRTLRRVPIGGEA

SEQ ID NO: 101725 - protein, 18 aa, Mycobacterium avium
PGAVIRRGVYYRYRLLWR

SEQ ID NO: 101726 - protein, 21 aa, Mycobacterium avium
PGCDHEIRSGAAHLVVWPVEP

SEQ ID NO: 101727 - protein, 23 aa, Mycobacterium avium
PGCDHEIRSGAAHLVVWPVEPTL

SEQ ID NO: 101728 - protein, 22 aa, Mycobacterium avium
PGCGGCIFAAKDLTKAGVPFTE

SEQ ID NO: 101729 - protein, 17 aa, Mycobacterium avium
PGCRPRLLTGQPGREDL

SEQ ID NO: 101730 - protein, 27 aa, Mycobacterium avium
PGDARLPLRFISAAPIAARSYRDIEKR

SEQ ID NO: 101731 - protein, 17 aa, Mycobacterium avium
PGDDLLGVRDWRNYPGF

SEQ ID NO: 101732 - protein, 18 aa, Mycobacterium avium
PGDEQALIAIPGIGARKL

SEQ ID NO: 101733 - protein, 17 aa, Mycobacterium avium
PGDGLPLPDDPPVRVLR

SEQ ID NO: 101734 - protein, 17 aa, Mycobacterium avium
PGDIGLHGPHHYNVNLL

SEQ ID NO: 101735 - protein, 24 aa, Mycobacterium avium
PGDIRECLRIGLQAANGSNAQSWR

SEQ ID NO: 101736 - protein, 17 aa, Mycobacterium avium
PGDKRLVAYVTESATAT

SEQ ID NO: 101737 - protein, 21 aa, Mycobacterium avium
PGDLHWDRILFCAKEATYKAW

SEQ ID NO: 101738 - protein, 20 aa, Mycobacterium avium
PGDPARLGPTLSEAARAAEQ

SEQ ID NO: 101739 - protein, 19 aa, Mycobacterium avium
PGDPARLGPTLTEAARAAE

SEQ ID NO: 101740 - protein, 20 aa, Mycobacterium avium
PGDPARLGPTLTEAARAAEQ

SEQ ID NO: 101741 - protein, 18 aa, Mycobacterium avium
PGDVISLAATSWRITEIT

SEQ ID NO: 101742 - protein, 18 aa, Mycobacterium avium
PGDVISLGATSWRITEIT

SEQ ID NO: 101743 - protein, 19 aa, Mycobacterium avium
PGDVISLGATSWRITEITH

SEQ ID NO: 101744 - protein, 23 aa, Mycobacterium avium
PGDVLQCYLELVLDGLVARLASG

SEQ ID NO: 101745 - protein, 17 aa, Mycobacterium avium
PGDWYVIHSYAGYENKV

SEQ ID NO: 101746 - protein, 26 aa, Mycobacterium avium
PGELLGCASGALGLRKFFEDGGHELV

SEQ ID NO: 101747 - protein, 22 aa, Mycobacterium avium
PGELRPALERAFASGLPAVVNV

SEQ ID NO: 101748 - protein, 19 aa, Mycobacterium avium
PGESPRLFVLTRNAAVVVA

SEQ ID NO: 101749 - protein, 23 aa, Mycobacterium avium
PGETSFEDWQYGQLVQLAKALHV

SEQ ID NO: 101750 - protein, 25 aa, Mycobacterium avium
PGEVPARLEALGALGGLDRAALHSQ

SEQ ID NO: 101751 - protein, 26 aa, Mycobacterium avium
PGEVPARLEALGALGGLDRAALHSQL

SEQ ID NO: 101752 - protein, 19 aa, Mycobacterium avium
PGFAKAFAREGRAPRPGER

SEQ ID NO: 101753 - protein, 19 aa, Mycobacterium avium
PGFERTLIGRALDFWNEEV

SEQ ID NO: 101754 - protein, 21 aa, Mycobacterium avium
PGFGRTLIGRALDFWNEEVYE

SEQ ID NO: 101755 - protein, 19 aa, Mycobacterium avium
PGFTVPYYWWTFNMPTDHG

SEQ ID NO: 101756 - protein, 21 aa, Mycobacterium avium
PGFVTKGGAPVMSFGVMGGMM

SEQ ID NO: 101757 - protein, 18 aa, Mycobacterium avium
PGGATLRLGTHPYAQELA

SEQ ID NO: 101758 - protein, 19 aa, Mycobacterium avium
PGGATLRLGTHPYVQELAS

SEQ ID NO: 101759 - protein, 18 aa, Mycobacterium avium
PGGCVSFVSIVSRTRRKR

SEQ ID NO: 101760 - protein, 19 aa, Mycobacterium avium
PGGGGCNVIELTIAGKSDK

SEQ ID NO: 101761 - protein, 17 aa, Mycobacterium avium
PGGIHSYLGEFVGRLAA

SEQ ID NO: 101762 - protein, 17 aa, Mycobacterium avium
PGGKACFVMMDEETQAL

SEQ ID NO: 101763 - protein, 25 aa, Mycobacterium avium
PGGLIAYLRAGWDLAEDVKNHILAV

SEQ ID NO: 101764 - protein, 20 aa, Mycobacterium avium
PGGLPIDFPSYQFIEYAGGG

SEQ ID NO: 101765 - protein, 18 aa, Mycobacterium avium
PGGQLRYLEHIASACARG

SEQ ID NO: 101766 - protein, 17 aa, Mycobacterium avium
PGGRLVFNTFLARDGYV

SEQ ID NO: 101767 - protein, 23 aa, Mycobacterium avium
PGGRYRFNHAIVRQSLLAELSSV

SEQ ID NO: 101768 - protein, 17 aa, Mycobacterium avium
PGGSYRYLSTVTDFYAK

SEQ ID NO: 101769 - protein, 20 aa, Mycobacterium avium
PGHPTGGWWDEMVGPGAPID

SEQ ID NO: 101770 - protein, 26 aa, Mycobacterium avium
PGHRASPSWLGKDGFKPFASIADIDF

SEQ ID NO: 101771 - protein, 22 aa, Mycobacterium avium
PGHSHWYIERFRAMARAGDDLA

SEQ ID NO: 101772 - protein, 23 aa, Mycobacterium avium
PGHTRGSMCFRVSSDKQVVFTGD

SEQ ID NO: 101773 - protein, 20 aa, Mycobacterium avium
PGHYTLCAAVGWQQHKPGAE

SEQ ID NO: 101774 - protein, 21 aa, Mycobacterium avium
PGHYTLCAAVGWQQHKPGAEH

SEQ ID NO: 101775 - protein, 23 aa, Mycobacterium avium
PGIDAAPQFPPRLRVDNAGRLAT

SEQ ID NO: 101776 - protein, 17 aa, Mycobacterium avium
PGIEARPRVTLGGDADF

SEQ ID NO: 101777 - protein, 23 aa, Mycobacterium avium
PGILRHLEEVLTLLIGAGFTGED

SEQ ID NO: 101778 - protein, 17 aa, Mycobacterium avium
PGKADPGLLKWLEDPKV

SEQ ID NO: 101779 - protein, 27 aa, Mycobacterium avium
PGKAWPFGLPSIGAHGSYWDNMSNPAL

SEQ ID NO: 101780 - protein, 28 aa, Mycobacterium avium
PGKQPPGHLWRWELSPVNAELTTVTHTY

SEQ ID NO: 101781 - protein, 17 aa, Mycobacterium avium
PGLACERTERVVVQDLS

SEQ ID NO: 101782 - protein, 21 aa, Mycobacterium avium
PGLDLRAGIACQLRELGVTAI

SEQ ID NO: 101783 - protein, 22 aa, Mycobacterium avium
PGLDLRAGIACQLRELGVTAID

SEQ ID NO: 101784 - protein, 18 aa, Mycobacterium avium
PGLGRKAPIYVIEDAPWS

SEQ ID NO: 101785 - protein, 17 aa, Mycobacterium avium
PGLHLELSTGYGQMVET

SEQ ID NO: 101786 - protein, 24 aa, Mycobacterium avium
PGLHRPRTLLGKRLNDLVRDTYAE

SEQ ID NO: 101787 - protein, 18 aa, Mycobacterium avium
PGLISDVLPLFVSGYSGK

SEQ ID NO: 101788 - protein, 18 aa, Mycobacterium avium
PGLKIAFTAGHCRGGGGV

SEQ ID NO: 101789 - protein, 18 aa, Mycobacterium avium
PGLLRFTIGLAQTTTLLL

SEQ ID NO: 101790 - protein, 17 aa, Mycobacterium avium
PGLPEVFISVGAEALNR

SEQ ID NO: 101791 - protein, 20 aa, Mycobacterium avium
PGLPRMINMYGITETTVHAS

SEQ ID NO: 101792 - protein, 21 aa, Mycobacterium avium
PGLQYKAIVAVERLIPRTLMR

SEQ ID NO: 101793 - protein, 22 aa, Mycobacterium avium
PGLRWPDLALQGGRLNWAAVRD

SEQ ID NO: 101794 - protein, 23 aa, Mycobacterium avium
PGLRWPDLALQGGRLNWAAVRDA

SEQ ID NO: 101795 - protein, 25 aa, Mycobacterium avium
PGMMFPDRWIPNLADQVRAAALAGG

SEQ ID NO: 101796 - protein, 19 aa, Mycobacterium avium
PGMVLTIRYDDTGEIETFL

SEQ ID NO: 101797 - protein, 19 aa, Mycobacterium avium
PGMVLTIRYDDTGEVETFL

SEQ ID NO: 101798 - protein, 19 aa, Mycobacterium avium
PGPDDVRRAVREGREGNLV

SEQ ID NO: 101799 - protein, 20 aa, Mycobacterium avium
PGPFTSWAQLCERAPGPPSS

SEQ ID NO: 101800 - protein, 23 aa, Mycobacterium avium
PGPMPYPGAPPYGAPQYAPDGTP

SEQ ID NO: 101801 - protein, 18 aa, Mycobacterium avium
PGPNGSVVPSTWRAQRAF

SEQ ID NO: 101802 - protein, 22 aa, Mycobacterium avium
PGPQGAIAVRIYWPPIHSESRP

SEQ ID NO: 101803 - protein, 25 aa, Mycobacterium avium
PGPQGAIAVRIYWPPSHSESCPAPV

SEQ ID NO: 101804 - protein, 21 aa, Mycobacterium avium
PGPQGPIAVRIYWPPSHSENR

SEQ ID NO: 101805 - protein, 22 aa, Mycobacterium avium
PGPRGAATLLEYVVGVLIQRCD

SEQ ID NO: 101806 - protein, 22 aa, Mycobacterium avium
PGPRGSIVKLMYAELAKEIGRL

SEQ ID NO: 101807 - protein, 22 aa, Mycobacterium avium
PGPRGSIVKLMYAELTKEIGKL

SEQ ID NO: 101808 - protein, 18 aa, Mycobacterium avium
PGPSDLLVAVRACGVCRT

SEQ ID NO: 101809 - protein, 25 aa, Mycobacterium avium
PGQRIPRKWLESGVIIQADTLEELA

SEQ ID NO: 101810 - protein, 20 aa, Mycobacterium avium
PGQTVALLFSRSAEAVAAIL

SEQ ID NO: 101811 - protein, 17 aa, Mycobacterium avium
PGQWTVSSELSMDLSPD

SEQ ID NO: 101812 - protein, 22 aa, Mycobacterium avium
PGRIDPGYRHEYLDTDPGGGPA

SEQ ID NO: 101813 - protein, 26 aa, Mycobacterium avium
PGRSRARFGRLLRWRAGGVLSVADRG

SEQ ID NO: 101814 - protein, 25 aa, Mycobacterium avium
PGRWFGGLDGFGWAACHSGAPVRPG

SEQ ID NO: 101815 - protein, 19 aa, Mycobacterium avium
PGSAGGRHRADLGARARPA

SEQ ID NO: 101816 - protein, 27 aa, Mycobacterium avium
PGSAVQAPWPLLRTFAAGPALSREAAL

SEQ ID NO: 101817 - protein, 17 aa, Mycobacterium avium
PGSDHQLAFVNALCSSL

SEQ ID NO: 101818 - protein, 19 aa, Mycobacterium avium
PGSRLRGVRDFVVSRHGAP

SEQ ID NO: 101819 - protein, 21 aa, Mycobacterium avium
PGSRLRGVRDFVVSRHGAPAR

SEQ ID NO: 101820 - protein, 22 aa, Mycobacterium avium
PGTARVSVCYMGVNGRDGTVFD

SEQ ID NO: 101821 - protein, 17 aa, Mycobacterium avium
PGTDWARYALKAPVMLV

SEQ ID NO: 101822 - protein, 17 aa, Mycobacterium avium
PGTSVLIAPNFAIGAVL

SEQ ID NO: 101823 - protein, 21 aa, Mycobacterium avium
PGTTLPGGFAITARKTYGRNS

SEQ ID NO: 101824 - protein, 17 aa, Mycobacterium avium
PGVALITLNRPERMNSM

SEQ ID NO: 101825 - protein, 17 aa, Mycobacterium avium
PGVAVTLSSVFEHCQAR

SEQ ID NO: 101826 - protein, 19 aa, Mycobacterium avium
PGVGTAIGVISAYKNFEQG

SEQ ID NO: 101827 - protein, 21 aa, Mycobacterium avium
PGVILGEHFDLLALGSTASSY

SEQ ID NO: 101828 - protein, 20 aa, Mycobacterium avium
PGVLSARWSGRHGDDAANTA

SEQ ID NO: 101829 - protein, 28 aa, Mycobacterium avium
PGVPGRSVTRWGAFLDDVGGFDCDFFGM

SEQ ID NO: 101830 - protein, 22 aa, Mycobacterium avium
PGVPRLGVPPLLMSDAGLGVTN

SEQ ID NO: 101831 - protein, 23 aa, Mycobacterium avium
PGVPRSFAVTRFDGTEVVSFTEA

SEQ ID NO: 101832 - protein, 17 aa, Mycobacterium avium
PGWERKRQHVMTLIGGD

SEQ ID NO: 101833 - protein, 22 aa, Mycobacterium avium
PHAPIAEYFVWFGDEYRIDETD

SEQ ID NO: 101834 - protein, 23 aa, Mycobacterium avium
PHAPIAEYFVWFGDEYRIDETDR

SEQ ID NO: 101835 - protein, 18 aa, Mycobacterium avium
PHAWSAAPNFAFDLAARK

SEQ ID NO: 101836 - protein, 17 aa, Mycobacterium avium
PHERPGPDYPFALITGR

SEQ ID NO: 101837 - protein, 18 aa, Mycobacterium avium
PHFDGYPAVLVNLAAISV

SEQ ID NO: 101838 - protein, 19 aa, Mycobacterium avium
PHGAVRWNTLVHNWIAEET

SEQ ID NO: 101839 - protein, 20 aa, Mycobacterium avium
PHGDGLFALTRRVPVVTIVI

SEQ ID NO: 101840 - protein, 20 aa, Mycobacterium avium
PHGDGLFALTRRVPVVTIVV

SEQ ID NO: 101841 - protein, 23 aa, Mycobacterium avium
PHHTRLRKIISRGFTPRAVGRLR

SEQ ID NO: 101842 - protein, 23 aa, Mycobacterium avium
PHHTRPVRFVWLQTPAVRTQLLD

SEQ ID NO: 101843 - protein, 17 aa, Mycobacterium avium
PHIEIGTLPALNDPHLS

SEQ ID NO: 101844 - protein, 20 aa, Mycobacterium avium
PHIHCDLRFGTEGTAASAND

SEQ ID NO: 101845 - protein, 19 aa, Mycobacterium avium
PHIKRYVARYDALLRFTPT

SEQ ID NO: 101846 - protein, 17 aa, Mycobacterium avium
PHLNYAGTFLHSARTPR

SEQ ID NO: 101847 - protein, 22 aa, Mycobacterium avium
PHLRPRVQITLTDGTRVTPDYI

SEQ ID NO: 101848 - protein, 18 aa, Mycobacterium avium
PHMLRHSFATHLLEGGAD

SEQ ID NO: 101849 - protein, 19 aa, Mycobacterium avium
PHMLRHSFATHLLEGGADV

SEQ ID NO: 101850 - protein, 25 aa, Mycobacterium avium
PHQIHSGDLVFQWHRRDVHVAQAHI

SEQ ID NO: 101851 - protein, 25 aa, Mycobacterium avium
PHSAPPVARLGCRIAPQAAGGRDVV

SEQ ID NO: 101852 - protein, 20 aa, Mycobacterium avium
PHSIRHATVFGAFDAVPDGG

SEQ ID NO: 101853 - protein, 17 aa, Mycobacterium avium
PHSQWIIEDAFSDGRPP

SEQ ID NO: 101854 - protein, 20 aa, Mycobacterium avium
PHVGEAEFGPLLRRLGRFLP

SEQ ID NO: 101855 - protein, 31 aa, Mycobacterium avium
PHVLAALRLHYLRWLLFDVGSGLHFQYQGIF

SEQ ID NO: 101856 - protein, 17 aa, Mycobacterium avium
PHWDPDRGEVMAYEQVT

SEQ ID NO: 101857 - protein, 19 aa, Mycobacterium avium
PIAEYFVWFGDEYRIDETD

SEQ ID NO: 101858 - protein, 18 aa, Mycobacterium avium
PIAKRLYEQAAISAADID

SEQ ID NO: 101859 - protein, 23 aa, Mycobacterium avium
PIARHLQGMWVSWLHEFDDGQLG

SEQ ID NO: 101860 - protein, 17 aa, Mycobacterium avium
PICSGGGNIMAHVSYID

SEQ ID NO: 101861 - protein, 18 aa, Mycobacterium avium
PICSGGGNIMAHVSYIDA

SEQ ID NO: 101862 - protein, 17 aa, Mycobacterium avium
PIDGSWRAPGAGPTQIS

SEQ ID NO: 101863 - protein, 27 aa, Mycobacterium avium
PIEPRLSLQWWVRVESLAKAAGDAVRN

SEQ ID NO: 101864 - protein, 17 aa, Mycobacterium avium
PIEWARAGRPLPSEYTS

SEQ ID NO: 101865 - protein, 17 aa, Mycobacterium avium
PIGEVTGLYRWLGEQVS

SEQ ID NO: 101866 - protein, 18 aa, Mycobacterium avium
PIGFPVPGAGLFVLDESL

SEQ ID NO: 101867 - protein, 20 aa, Mycobacterium avium
PIGGWRNGLTRLGIQGYARC

SEQ ID NO: 101868 - protein, 25 aa, Mycobacterium avium
PIGLGGFAFPLGEFGARGFQPAARR

SEQ ID NO: 101869 - protein, 20 aa, Mycobacterium avium
PIGRNPWRGPPVPYDTPVTN

SEQ ID NO: 101870 - protein, 20 aa, Mycobacterium avium
PIIPLIVWGAHRIWTKDHPR

SEQ ID NO: 101871 - protein, 20 aa, Mycobacterium avium
PILKRIMRSGNQLAYLDSGA

SEQ ID NO: 101872 - protein, 18 aa, Mycobacterium avium
PILTPGLSYYARDFDDTA

SEQ ID NO: 101873 - protein, 19 aa, Mycobacterium avium
PILTPGLSYYARDFDDTAS

SEQ ID NO: 101874 - protein, 35 aa, Mycobacterium avium
PIPREVHEFVLGLGIPVCEGYGMTECTAGATVNRP

SEQ ID NO: 101875 - protein, 20 aa, Mycobacterium avium
PISTVRCFQDNALLKSVLSE

SEQ ID NO: 101876 - protein, 20 aa, Mycobacterium avium
PIVGSYANEEFGNFGDNPAT

SEQ ID NO: 101877 - protein, 23 aa, Mycobacterium avium
PIYYNERYDFWALSRHSDVERAL

SEQ ID NO: 101878 - protein, 23 aa, Mycobacterium avium
PKAPFLRTVAVWGPSDQAWTTTI

SEQ ID NO: 101879 - protein, 23 aa, Mycobacterium avium
PKFMPQPYGGYIMPGSTLDDMKI

SEQ ID NO: 101880 - protein, 21 aa, Mycobacterium avium
PKFVSGEYIGSIAMSEPAAGS

SEQ ID NO: 101881 - protein, 21 aa, Mycobacterium avium
PKGALVHRLIRSGRSLFTAHT

SEQ ID NO: 101882 - protein, 20 aa, Mycobacterium avium
PKGPGLLERLWHDRDVQSAV

SEQ ID NO: 101883 - protein, 17 aa, Mycobacterium avium
PKILRDVMFAEELMRSL

SEQ ID NO: 101884 - protein, 17 aa, Mycobacterium avium
PKIYRHFHDKSDLFQAI

SEQ ID NO: 101885 - protein, 22 aa, Mycobacterium avium
PKLAKKLGLQRQWLHARSLSFA

SEQ ID NO: 101886 - protein, 18 aa, Mycobacterium avium
PKLIEAFNEIRGYGVEFD

SEQ ID NO: 101887 - protein, 17 aa, Mycobacterium avium
PKLPGTVYTAAKELEEA

SEQ ID NO: 101888 - protein, 24 aa, Mycobacterium avium
PKLRELYLATCGLRRADLATAAQE

SEQ ID NO: 101889 - protein, 19 aa, Mycobacterium avium
PKMRAEGSGGSESDAAGDQ

SEQ ID NO: 101890 - protein, 23 aa, Mycobacterium avium
PKPADIVSALALPVPSLVISQLL

SEQ ID NO: 101891 - protein, 19 aa, Mycobacterium avium
PKPDAAIDWHRRTPGPDQE

SEQ ID NO: 101892 - protein, 19 aa, Mycobacterium avium
PKPDAAIDWHRRTQAQIKK

SEQ ID NO: 101893 - protein, 19 aa, Mycobacterium avium
PKPDAAIDWHRRTQSQIKK

SEQ ID NO: 101894 - protein, 19 aa, Mycobacterium avium
PKPLDGFRVLDFTQNIAGP

SEQ ID NO: 101895 - protein, 19 aa, Mycobacterium avium
PKPPFAQWIPNRLWAAQRK

SEQ ID NO: 101896 - protein, 20 aa, Mycobacterium avium
PKSNAPLTNRDWWPNQIDVS

SEQ ID NO: 101897 - protein, 18 aa, Mycobacterium avium
PKTFRHMHGFGLHTFSFL

SEQ ID NO: 101898 - protein, 21 aa, Mycobacterium avium
PKTFRHMHGFGLHTFSFLNAA

SEQ ID NO: 101899 - protein, 26 aa, Mycobacterium avium
PKTSGSRGFHIYAHIARRWEFRQVRL

SEQ ID NO: 101900 - protein, 19 aa, Mycobacterium avium
PKTSGSRGFPIYARIARRW

SEQ ID NO: 101901 - protein, 21 aa, Mycobacterium avium
PKTVGLRGIYRGVAKAAGLPP

SEQ ID NO: 101902 - protein, 18 aa, Mycobacterium avium
PKVARIVMDATVLKDTMV

SEQ ID NO: 101903 - protein, 25 aa, Mycobacterium avium
PLAADHFRYFAGALRAQEGSLSQID

SEQ ID NO: 101904 - protein, 24 aa, Mycobacterium avium
PLAELRGGAVWDAAAVRKFAQDWQ

SEQ ID NO: 101905 - protein, 18 aa, Mycobacterium avium
PLAFASLDRWPGTVAQYL

SEQ ID NO: 101906 - protein, 30 aa, Mycobacterium avium
PLANLAFFVLDGWLRPVPVGVVGELYVAGG

SEQ ID NO: 101907 - protein, 19 aa, Mycobacterium avium
PLANSLRGMHAVRGRVDAV

SEQ ID NO: 101908 - protein, 23 aa, Mycobacterium avium
PLCPAPVRIPILFGGRADATIRR

SEQ ID NO: 101909 - protein, 21 aa, Mycobacterium avium
PLDDPLPWLLADRRAVRVTAV

SEQ ID NO: 101910 - protein, 25 aa, Mycobacterium avium
PLDLVPRVISAAEWARLERGITQRV

SEQ ID NO: 101911 - protein, 26 aa, Mycobacterium avium
PLDRPADCTLPPPMRLLLDGEVPGVP

SEQ ID NO: 101912 - protein, 18 aa, Mycobacterium avium
PLDVGWSLVSARAVFEHR

SEQ ID NO: 101913 - protein, 18 aa, Mycobacterium avium
PLERWFRDLRVKRLGEGA

SEQ ID NO: 101914 - protein, 19 aa, Mycobacterium avium
PLFCIHAAGGLSWSYQVLG

SEQ ID NO: 101915 - protein, 27 aa, Mycobacterium avium
PLFGTRIQYNIGLGLLFGRPKSNLTFA

SEQ ID NO: 101916 - protein, 31 aa, Mycobacterium avium
PLFGTRIQYNIGLGLLFGRPKSNLTFAQNDA

SEQ ID NO: 101917 - protein, 24 aa, Mycobacterium avium
PLGAREFHKFLLAKQHEIASVITE

SEQ ID NO: 101918 - protein, 19 aa, Mycobacterium avium
PLGGVGCQTYFELVGARVD

SEQ ID NO: 101919 - protein, 22 aa, Mycobacterium avium
PLGSGLLEMIGFPRVDEYLDRD

SEQ ID NO: 101920 - protein, 23 aa, Mycobacterium avium
PLGSGLLEMIGFPRVDEYLDRDP

SEQ ID NO: 101921 - protein, 17 aa, Mycobacterium avium
PLGSWLAELSDERLIRL

SEQ ID NO: 101922 - protein, 17 aa, Mycobacterium avium
PLIESMIAAHRIIGSLV

SEQ ID NO: 101923 - protein, 22 aa, Mycobacterium avium
PLIPKRVFRRLLGVVTGGATTV

SEQ ID NO: 101924 - protein, 22 aa, Mycobacterium avium
PLLADLDCGRWRGRALQAVDQA

SEQ ID NO: 101925 - protein, 22 aa, Mycobacterium avium
PLLADLDCGRWRGRALQTVDEA

SEQ ID NO: 101926 - protein, 30 aa, Mycobacterium avium
PLLCEEEVDRACAPWGLLAEDKQAALVAGI

SEQ ID NO: 101927 - protein, 17 aa, Mycobacterium avium
PLLPVAIAAHAKTDEDK

SEQ ID NO: 101928 - protein, 17 aa, Mycobacterium avium
PLMVPFLEQFVLKARYA

SEQ ID NO: 101929 - protein, 27 aa, Mycobacterium avium
PLMVTDAWLPPELAPVLTERALRRAPL

SEQ ID NO: 101930 - protein, 28 aa, Mycobacterium avium
PLMVTDAWLPPELAPVLTERALRRAPLY

SEQ ID NO: 101931 - protein, 28 aa, Mycobacterium avium
PLMVTNAWLPPELAPVLTERALRRAPLY

SEQ ID NO: 101932 - protein, 24 aa, Mycobacterium avium
PLNRDPRLAGSINDVGIFVPTDEQ

SEQ ID NO: 101933 - protein, 17 aa, Mycobacterium avium
PLPAERWREYCLSSVTT

SEQ ID NO: 101934 - protein, 23 aa, Mycobacterium avium
PLPAPARWAMRFPGGKALQRLLS

SEQ ID NO: 101935 - protein, 23 aa, Mycobacterium avium
PLPCTPRGIVHLLRRYDAEIAGA

SEQ ID NO: 101936 - protein, 31 aa, Mycobacterium avium
PLPDAALHAGWRALGWWLVGTSRAMLTLARR

SEQ ID NO: 101937 - protein, 24 aa, Mycobacterium avium
PLPDPEILAFLYLEARLADEGRYS

SEQ ID NO: 101938 - protein, 21 aa, Mycobacterium avium
PLPLCWGEYRPGTLTTGRWGL

SEQ ID NO: 101939 - protein, 22 aa, Mycobacterium avium
PLPPEGASAIVFRDTDHAAELA

SEQ ID NO: 101940 - protein, 18 aa, Mycobacterium avium
PLPPVLAATAARQREGLL

SEQ ID NO: 101941 - protein, 20 aa, Mycobacterium avium
PLPTWSHRRLMLRRESVQRA

SEQ ID NO: 101942 - protein, 19 aa, Mycobacterium avium
PLQAATQWDALSHVYYDDL

SEQ ID NO: 101943 - protein, 18 aa, Mycobacterium avium
PLQTVGWTAAAPQAGVGT

SEQ ID NO: 101944 - protein, 29 aa, Mycobacterium avium
PLRARLPLPCLIGAPVLFGRGSVVFARLV

SEQ ID NO: 101945 - protein, 17 aa, Mycobacterium avium
PLRGVVRNLGPVAGTGA

SEQ ID NO: 101946 - protein, 23 aa, Mycobacterium avium
PLRLLFKDEVRAVGRELGLPEEI

SEQ ID NO: 101947 - protein, 17 aa, Mycobacterium avium
PLRPGKGPIALRVHLGT

SEQ ID NO: 101948 - protein, 21 aa, Mycobacterium avium
PLRPGTTPEVYWRSRRFNLDD

SEQ ID NO: 101949 - protein, 21 aa, Mycobacterium avium
PLRPGTTPEVYWRSRRFSLDD

SEQ ID NO: 101950 - protein, 19 aa, Mycobacterium avium
PLRPWKAEQLGGGYRISTW

SEQ ID NO: 101951 - protein, 25 aa, Mycobacterium avium
PLSASQLRSWFAYRLDGPSPVNNIP

SEQ ID NO: 101952 - protein, 24 aa, Mycobacterium avium
PLSGAAQPYGEWLPRGQGEDVVSG

SEQ ID NO: 101953 - protein, 26 aa, Mycobacterium avium
PLSGPLFRFALFATRRDQFYLFACCH

SEQ ID NO: 101954 - protein, 19 aa, Mycobacterium avium
PLSSAERRAIQGFLESGVD

SEQ ID NO: 101955 - protein, 18 aa, Mycobacterium avium
PLSTAVRCALTGPPSVDH

SEQ ID NO: 101956 - protein, 19 aa, Mycobacterium avium
PLSVPFWEGCRSRQLRYQR

SEQ ID NO: 101957 - protein, 23 aa, Mycobacterium avium
PLTELRPAPRLGEHNEALLAQDS

SEQ ID NO: 101958 - protein, 18 aa, Mycobacterium avium
PLTERLGTTGWVIDTPGI

SEQ ID NO: 101959 - protein, 21 aa, Mycobacterium avium
PLTHDELWRLADHMNQLRDRL

SEQ ID NO: 101960 - protein, 21 aa, Mycobacterium avium
PLTQITAALCDRWQPGARLLP

SEQ ID NO: 101961 - protein, 22 aa, Mycobacterium avium
PLTQITAALCDRWQPGARLLPV

SEQ ID NO: 101962 - protein, 24 aa, Mycobacterium avium
PLTQITAALCDRWQPGARLLPVSD

SEQ ID NO: 101963 - protein, 19 aa, Mycobacterium avium
PLTRYLKYELPLVNGVPAL

SEQ ID NO: 101964 - protein, 25 aa, Mycobacterium avium
PLVAANRIRLLALIQTNIFGQNTPA

SEQ ID NO: 101965 - protein, 19 aa, Mycobacterium avium
PLVEQLRGQLTVRLRSYEI

SEQ ID NO: 101966 - protein, 17 aa, Mycobacterium avium
PLVQVLLGWENFPGEVT

SEQ ID NO: 101967 - protein, 18 aa, Mycobacterium avium
PLVQVLLGWENFPGEVTA

SEQ ID NO: 101968 - protein, 23 aa, Mycobacterium avium
PLWDQQLPFGIAITSLLAVTASY

SEQ ID NO: 101969 - protein, 18 aa, Mycobacterium avium
PLWPDAVGEMCIRQIDGK

SEQ ID NO: 101970 - protein, 20 aa, Mycobacterium avium
PLYARVMRAGDGVVLQFAQL

SEQ ID NO: 101971 - protein, 20 aa, Mycobacterium avium
PMACRAELDQTVALVEEAGG

SEQ ID NO: 101972 - protein, 20 aa, Mycobacterium avium
PMAPGLICTPFVAVSSSSEA

SEQ ID NO: 101973 - protein, 25 aa, Mycobacterium avium
PMAPTDLAIWVNVLAIPVLKYGNPS

SEQ ID NO: 101974 - protein, 18 aa, Mycobacterium avium
PMATITFTGATALKLTGR

SEQ ID NO: 101975 - protein, 23 aa, Mycobacterium avium
PMEELIAAFLPLLFPGMEIVEHH

SEQ ID NO: 101976 - protein, 19 aa, Mycobacterium avium
PMEISRPLWTATLVDGLAD

SEQ ID NO: 101977 - protein, 19 aa, Mycobacterium avium
PMELQAYDEFFFPGLAAEW

SEQ ID NO: 101978 - protein, 27 aa, Mycobacterium avium
PMIADPFTKLHCCIRSDGGAAVVLVSA

SEQ ID NO: 101979 - protein, 26 aa, Mycobacterium avium
PMIAEPLRLLDCARPVNGAVAVVLTG

SEQ ID NO: 101980 - protein, 20 aa, Mycobacterium avium
PMLLQPGVLSIAWGTAIRQL

SEQ ID NO: 101981 - protein, 25 aa, Mycobacterium avium
PMLRAAAPALRLSGMTVTRPAAAMR

SEQ ID NO: 101982 - protein, 19 aa, Mycobacterium avium
PMMAAAAAFSNLADELSTT

SEQ ID NO: 101983 - protein, 17 aa, Mycobacterium avium
PMPLSGPLFRFALFATR

SEQ ID NO: 101984 - protein, 30 aa, Mycobacterium avium
PMSISVAFHEPVRWDGWLLYSHESTQVGAG

SEQ ID NO: 101985 - protein, 27 aa, Mycobacterium avium
PMTECPEWTWRTTLLPRIAPTARDEES

SEQ ID NO: 101986 - protein, 17 aa, Mycobacterium avium
PMVDAMFFGSSSNQYGS

SEQ ID NO: 101987 - protein, 18 aa, Mycobacterium avium
PNAMFDWEANGGDLANYY

SEQ ID NO: 101988 - protein, 23 aa, Mycobacterium avium
PNDPGTVCGPVISARQRDRVQSY

SEQ ID NO: 101989 - protein, 25 aa, Mycobacterium avium
PNFAIGAVLSMHFAKQAARFFDSAE

SEQ ID NO: 101990 - protein, 17 aa, Mycobacterium avium
PNGARRAVAAGLRTIEY

SEQ ID NO: 101991 - protein, 23 aa, Mycobacterium avium
PNIGKPPPYSGIDPLRITMETPA

SEQ ID NO: 101992 - protein, 19 aa, Mycobacterium avium
PNILMPLMNAVGITSESVY

SEQ ID NO: 101993 - protein, 19 aa, Mycobacterium avium
PNLHWPLEYVDSFAGLVPR

SEQ ID NO: 101994 - protein, 25 aa, Mycobacterium avium
PNPNLRPLFDGPFYAVRMVLSDLGT

SEQ ID NO: 101995 - protein, 18 aa, Mycobacterium avium
PNPPRPGNALAAAGAAPP

SEQ ID NO: 101996 - protein, 19 aa, Mycobacterium avium
PNPTRAGGFPTRGEMVEAY

SEQ ID NO: 101997 - protein, 23 aa, Mycobacterium avium
PNQRLQAQILRRAPQRARVVAGE

SEQ ID NO: 101998 - protein, 24 aa, Mycobacterium avium
PNQRRGVARPGPRHLGDGADGEQV

SEQ ID NO: 101999 - protein, 19 aa, Mycobacterium avium
PNSCQFAVALFGLLRAGAV

SEQ ID NO: 102000 - protein, 25 aa, Mycobacterium avium
PNSGPTRPGIRSTLLTVADLDATVI

SEQ ID NO: 102001 - protein, 30 aa, Mycobacterium avium
PNTGWFKYWSTWGNQFLAASGFPINLIGVL

SEQ ID NO: 102002 - protein, 25 aa, Mycobacterium avium
PNTPFFFRLLVGLTKDGTWLQFSQT

SEQ ID NO: 102003 - protein, 28 aa, Mycobacterium avium
PNVGGICIGCTMPGFPDKFMPFMDEPPG

SEQ ID NO: 102004 - protein, 21 aa, Mycobacterium avium
PNVPDAFAVIADRHGSSIYSS

SEQ ID NO: 102005 - protein, 18 aa, Mycobacterium avium
PNWRVEIDGSPSIACTID

SEQ ID NO: 102006 - protein, 17 aa, Mycobacterium avium
PNWSAPRLRIRAGSLVI

SEQ ID NO: 102007 - protein, 17 aa, Mycobacterium avium
PPADGRLRFVPATHDDP

SEQ ID NO: 102008 - protein, 22 aa, Mycobacterium avium
PPAELQAHWAALGVSRLSILDN

SEQ ID NO: 102009 - protein, 19 aa, Mycobacterium avium
PPAEQIEAFAALPSPSNPL

SEQ ID NO: 102010 - protein, 19 aa, Mycobacterium avium
PPAGGAPCPPGGGGAPGAA

SEQ ID NO: 102011 - protein, 26 aa, Mycobacterium avium
PPAKACGPHIIRGAAIAWAPNGEPMT

SEQ ID NO: 102012 - protein, 26 aa, Mycobacterium avium
PPAKACGPHIIRGAAIAWAPNGEPTT

SEQ ID NO: 102013 - protein, 19 aa, Mycobacterium avium
PPALGADNGRVHWPPRPEP

SEQ ID NO: 102014 - protein, 19 aa, Mycobacterium avium
PPALGADNGRVHWPPRPGP

SEQ ID NO: 102015 - protein, 32 aa, Mycobacterium avium
PPALLGIEVARRLLPGIAHVAVFDTGFFHDLP

SEQ ID NO: 102016 - protein, 19 aa, Mycobacterium avium
PPAPKLADMSLLFEIEEPR

SEQ ID NO: 102017 - protein, 18 aa, Mycobacterium avium
PPAPRFCGQCDTMIERKI

SEQ ID NO: 102018 - protein, 21 aa, Mycobacterium avium
PPARPARTGWPRNCCGACPSS

SEQ ID NO: 102019 - protein, 17 aa, Mycobacterium avium
PPASRARLWKFGMTGAR

SEQ ID NO: 102020 - protein, 33 aa, Mycobacterium avium
PPASRKVLWERIARWRPGWIGSCGTTRRAPTTF

SEQ ID NO: 102021 - protein, 21 aa, Mycobacterium avium
PPDAASRLLALIVGTGGDATR

SEQ ID NO: 102022 - protein, 24 aa, Mycobacterium avium
PPDCYLVPIDACYEFVGRLRRLWR

SEQ ID NO: 102023 - protein, 23 aa, Mycobacterium avium
PPDRARLAYLRMKGRVAENRLQE

SEQ ID NO: 102024 - protein, 18 aa, Mycobacterium avium
PPDVPSWHKRGWTVDLSS

SEQ ID NO: 102025 - protein, 17 aa, Mycobacterium avium
PPEALRLDGADIQKEIA

SEQ ID NO: 102026 - protein, 18 aa, Mycobacterium avium
PPEINSALIAGGAGSGPL

SEQ ID NO: 102027 - protein, 19 aa, Mycobacterium avium
PPELSWEVAGSLYVVGVTA

SEQ ID NO: 102028 - protein, 24 aa, Mycobacterium avium
PPELVDRWAPDRVMINVYGPTETT

SEQ ID NO: 102029 - protein, 22 aa, Mycobacterium avium
PPERAWGLWLSRQIIARIMGTF

SEQ ID NO: 102030 - protein, 21 aa, Mycobacterium avium
PPESLPIKGFLSFDDTRVELL

SEQ ID NO: 102031 - protein, 21 aa, Mycobacterium avium
PPESLPIKGFLSFDETRVELL

SEQ ID NO: 102032 - protein, 18 aa, Mycobacterium avium
PPFSCPVDDVYAACAPLV

SEQ ID NO: 102033 - protein, 20 aa, Mycobacterium avium
PPFTWDYRLFAGPHPAPVAP

SEQ ID NO: 102034 - protein, 23 aa, Mycobacterium avium
PPGATGVAQCYELFNQLRGEAEN

SEQ ID NO: 102035 - protein, 23 aa, Mycobacterium avium
PPGATGVAQCYELFNQLRGQAEN

SEQ ID NO: 102036 - protein, 21 aa, Mycobacterium avium
PPGDARGRIVRLCLDSPSVAE

SEQ ID NO: 102037 - protein, 17 aa, Mycobacterium avium
PPGDGTVTWVLDPIDGT

SEQ ID NO: 102038 - protein, 22 aa, Mycobacterium avium
PPGERRARRRQLHRLAGAVQRP

SEQ ID NO: 102039 - protein, 25 aa, Mycobacterium avium
PPGNVGAVWRGTWHGGLGFTDKCCA

SEQ ID NO: 102040 - protein, 26 aa, Mycobacterium avium
PPGQPTWYRGAARISDLVEQIRRSGV

SEQ ID NO: 102041 - protein, 22 aa, Mycobacterium avium
PPGSRLRGVRDFVVSRHGAPAR

SEQ ID NO: 102042 - protein, 18 aa, Mycobacterium avium
PPGVVGEIWVHGENVADG

SEQ ID NO: 102043 - protein, 19 aa, Mycobacterium avium
PPHPDRLVAGYLEALDDAA

SEQ ID NO: 102044 - protein, 24 aa, Mycobacterium avium
PPIRKAGIMMPVFVMMREHGELWR

SEQ ID NO: 102045 - protein, 20 aa, Mycobacterium avium
PPKPSMRIISDIFAYTSAKM

SEQ ID NO: 102046 - protein, 17 aa, Mycobacterium avium
PPLAGSLLIGGEGGVVE

SEQ ID NO: 102047 - protein, 19 aa, Mycobacterium avium
PPLAVCLGGVGLHGAGAPR

SEQ ID NO: 102048 - protein, 19 aa, Mycobacterium avium
PPLDDFISLVIGQGDPAVG

SEQ ID NO: 102049 - protein, 17 aa, Mycobacterium avium
PPLDEPIPLSAMLARAG

SEQ ID NO: 102050 - protein, 23 aa, Mycobacterium avium
PPLNMDPRWVGAHVGHTVGKYAE

SEQ ID NO: 102051 - protein, 17 aa, Mycobacterium avium
PPLPVAWVPISTAVAAA

SEQ ID NO: 102052 - protein, 19 aa, Mycobacterium avium
PPLRQGFCGGAVDDRPHLD

SEQ ID NO: 102053 - protein, 24 aa, Mycobacterium avium
PPLRRPKHRRVFTVANQKGGVGKT

SEQ ID NO: 102054 - protein, 30 aa, Mycobacterium avium
PPLRRPSGPMALRTLWRMDLARDRRLKRLR

SEQ ID NO: 102055 - protein, 18 aa, Mycobacterium avium
PPLTCSYSQPLSTASGRQ

SEQ ID NO: 102056 - protein, 21 aa, Mycobacterium avium
PPPGALFRALRRVRAVLDAAG

SEQ ID NO: 102057 - protein, 21 aa, Mycobacterium avium
PPPQVFRMKGVVAVRQRATVR

SEQ ID NO: 102058 - protein, 17 aa, Mycobacterium avium
PPPRRRGPRGSRCSRAG

SEQ ID NO: 102059 - protein, 25 aa, Mycobacterium avium
PPPSWTAPSIWCWPAPSRRCRSSPT

SEQ ID NO: 102060 - protein, 24 aa, Mycobacterium avium
PPPVPLDAAILFAPVGDLVLPALA

SEQ ID NO: 102061 - protein, 25 aa, Mycobacterium avium
PPQDFSGIVGHRFIYTYANGWRYEM

SEQ ID NO: 102062 - protein, 18 aa, Mycobacterium avium
PPRLRIWLRANGEVTDDP

SEQ ID NO: 102063 - protein, 20 aa, Mycobacterium avium
PPRPDRLVAGYLEALNDAAR

SEQ ID NO: 102064 - protein, 26 aa, Mycobacterium avium
PPRPWRRAAAGFGMRRRSAFCDFDFR

SEQ ID NO: 102065 - protein, 23 aa, Mycobacterium avium
PPRRVALLQAFLVRRMRRNAVWP

SEQ ID NO: 102066 - protein, 19 aa, Mycobacterium avium
PPSAIFIGGGLTRPGLLDA

SEQ ID NO: 102067 - protein, 17 aa, Mycobacterium avium
PPSGEALHDGFFRQAER

SEQ ID NO: 102068 - protein, 19 aa, Mycobacterium avium
PPSLGLLTINALVAAPEVM

SEQ ID NO: 102069 - protein, 24 aa, Mycobacterium avium
PPSPRAMPMAVPLEPGQQTVKFTV

SEQ ID NO: 102070 - protein, 27 aa, Mycobacterium avium
PPTEVCYSCGALDWAWRTHTGNGSVYS

SEQ ID NO: 102071 - protein, 17 aa, Mycobacterium avium
PPVAVPLAQAQGLVLAD

SEQ ID NO: 102072 - protein, 19 aa, Mycobacterium avium
PPVPELRSGRSARENLLAM

SEQ ID NO: 102073 - protein, 19 aa, Mycobacterium avium
PPVRFQLLWYPSTMWDASL

SEQ ID NO: 102074 - protein, 18 aa, Mycobacterium avium
PPVRTSLYSDPQFQTKYP

SEQ ID NO: 102075 - protein, 18 aa, Mycobacterium avium
PPWIDVFIARNFHYLTEL

SEQ ID NO: 102076 - protein, 21 aa, Mycobacterium avium
PPWTPAMDIVKAWKDLSKSID

SEQ ID NO: 102077 - protein, 17 aa, Mycobacterium avium
PQAALVEIARVLRPGGR

SEQ ID NO: 102078 - protein, 17 aa, Mycobacterium avium
PQAAPLTSDRLGALLLS

SEQ ID NO: 102079 - protein, 23 aa, Mycobacterium avium
PQAARIWLLQALTGRRASEILML

SEQ ID NO: 102080 - protein, 29 aa, Mycobacterium avium
PQAGGNFGLLDWVAALSWVAENIATFGGD

SEQ ID NO: 102081 - protein, 17 aa, Mycobacterium avium
PQCREWVQRTMTKLVTD

SEQ ID NO: 102082 - protein, 21 aa, Mycobacterium avium
PQELAKFFILLIGAGNETTRN

SEQ ID NO: 102083 - protein, 19 aa, Mycobacterium avium
PQFESWQAVMAQVYVDGRL

SEQ ID NO: 102084 - protein, 21 aa, Mycobacterium avium
PQFQRWSISLLSWILNPERGL

SEQ ID NO: 102085 - protein, 19 aa, Mycobacterium avium
PQFRSLRMWESQSPTPPPE

SEQ ID NO: 102086 - protein, 17 aa, Mycobacterium avium
PQGGGYGRQDYGSAEYT

SEQ ID NO: 102087 - protein, 18 aa, Mycobacterium avium
PQGILLHGGVLYVVGAGA

SEQ ID NO: 102088 - protein, 42 aa, Mycobacterium avium
PQGVLRLALRVWRRRPSMTMEAWNAPTLLKFLATPALAREYL

SEQ ID NO: 102089 - protein, 17 aa, Mycobacterium avium
PQHELDLGLPPYATPAE

SEQ ID NO: 102090 - protein, 17 aa, Mycobacterium avium
PQHRLLLETSWDAIEHA

SEQ ID NO: 102091 - protein, 17 aa, Mycobacterium avium
PQIPGIDQVSAWLERHR

SEQ ID NO: 102092 - protein, 17 aa, Mycobacterium avium
PQLHKEPIAAWRDAAFA

SEQ ID NO: 102093 - protein, 18 aa, Mycobacterium avium
PQLHKEPIAAWRDAAFAR

SEQ ID NO: 102094 - protein, 27 aa, Mycobacterium avium
PQPVLQRLAALAGRFSSPKSAARQGDQ

SEQ ID NO: 102095 - protein, 23 aa, Mycobacterium avium
PQQRVSLRVAWRALENSGINPDD

SEQ ID NO: 102096 - protein, 25 aa, Mycobacterium avium
PQTLRLYERRGLLTPSRTDGGTRRY

SEQ ID NO: 102097 - protein, 19 aa, Mycobacterium avium
PQTQIAVRNEWGWAEAYLD

SEQ ID NO: 102098 - protein, 33 aa, Mycobacterium avium
PQTQIPVRNEWGWAEAYLDMGWEEIKVAAEYDG

SEQ ID NO: 102099 - protein, 23 aa, Mycobacterium avium
PQTRLPQRLFIKTQLGTVHDLPE

SEQ ID NO: 102100 - protein, 47 aa, Mycobacterium avium
PQVGQPLCRECYDYFGHVLFTWHLPELWRRFTITLRRALRRHLKAAG

SEQ ID NO: 102101 - protein, 26 aa, Mycobacterium avium
PQWSPQCRWMKPLGPVRQGTRTINLN

SEQ ID NO: 102102 - protein, 20 aa, Mycobacterium avium
PRAEATAVYLDRRQLGAGHA

SEQ ID NO: 102103 - protein, 21 aa, Mycobacterium avium
PRALLPATVLARWFHTEQARA

SEQ ID NO: 102104 - protein, 25 aa, Mycobacterium avium
PRALPSNCRYLLPSLIRSSARAGTA

SEQ ID NO: 102105 - protein, 25 aa, Mycobacterium avium
PRAPAEGFAAMWADLRRPELREFER

SEQ ID NO: 102106 - protein, 21 aa, Mycobacterium avium
PRAPDDFVHLLLGVASVGAGI

SEQ ID NO: 102107 - protein, 20 aa, Mycobacterium avium
PRARAKISMRVAPGGDAAAH

SEQ ID NO: 102108 - protein, 21 aa, Mycobacterium avium
PRARAKISMRVAPGGDAAAHL

SEQ ID NO: 102109 - protein, 17 aa, Mycobacterium avium
PRARGCLTLVSADPAVP

SEQ ID NO: 102110 - protein, 19 aa, Mycobacterium avium
PRASLALAAARVALPDPAP

SEQ ID NO: 102111 - protein, 20 aa, Mycobacterium avium
PRCGWARTWASSSCPIPAPA

SEQ ID NO: 102112 - protein, 18 aa, Mycobacterium avium
PRDCGLGAVKVIGKVLQR

SEQ ID NO: 102113 - protein, 25 aa, Mycobacterium avium
PRDELDAAALRVARDIAAKDTRVIR

SEQ ID NO: 102114 - protein, 22 aa, Mycobacterium avium
PRDFDRLGLPGWAWSDVLDSFR

SEQ ID NO: 102115 - protein, 26 aa, Mycobacterium avium
PRDRRGGPLEGVRVVELTKVWAGPYA

SEQ ID NO: 102116 - protein, 18 aa, Mycobacterium avium
PREAGRRAAAAAGATVQR

SEQ ID NO: 102117 - protein, 18 aa, Mycobacterium avium
PRELKQKFYELLASRLAG

SEQ ID NO: 102118 - protein, 18 aa, Mycobacterium avium
PREYGVLEFLMRNKDVVV

SEQ ID NO: 102119 - protein, 19 aa, Mycobacterium avium
PRFDAAAVVKVLRRKHSEI

SEQ ID NO: 102120 - protein, 21 aa, Mycobacterium avium
PRGAAALAPLARQPRPDRAGE

SEQ ID NO: 102121 - protein, 20 aa, Mycobacterium avium
PRGAELAAWSLVHGFATLWL

SEQ ID NO: 102122 - protein, 21 aa, Mycobacterium avium
PRGAGNLGFAGTAPRETVAAA

SEQ ID NO: 102123 - protein, 21 aa, Mycobacterium avium
PRGEELLRLIADYQSRSGVTT

SEQ ID NO: 102124 - protein, 17 aa, Mycobacterium avium
PRGKRRGEGPHAHPETF

SEQ ID NO: 102125 - protein, 20 aa, Mycobacterium avium
PRGMSYLVVRGRRGGSAMAA

SEQ ID NO: 102126 - protein, 23 aa, Mycobacterium avium
PRGMWYKSITDPATFWRMQGPGH

SEQ ID NO: 102127 - protein, 18 aa, Mycobacterium avium
PRGPGMERSDLLEANGAI

SEQ ID NO: 102128 - protein, 24 aa, Mycobacterium avium
PRGRRFAGRWAEAVFSVSPNLDIM

SEQ ID NO: 102129 - protein, 18 aa, Mycobacterium avium
PRHADALLVTGVVTRNMV

SEQ ID NO: 102130 - protein, 22 aa, Mycobacterium avium
PRHRRCGGRGTCWGRRTTAGGR

SEQ ID NO: 102131 - protein, 20 aa, Mycobacterium avium
PRIDVGWFLINCDPDTYRRV

SEQ ID NO: 102132 - protein, 19 aa, Mycobacterium avium
PRIGAPRWDTVIIGLDCDT

SEQ ID NO: 102133 - protein, 24 aa, Mycobacterium avium
PRIGAPRWDTVIIGLDCDTTVLDE

SEQ ID NO: 102134 - protein, 25 aa, Mycobacterium avium
PRIGAPRWDTVIIGLDCDTTVLDER

SEQ ID NO: 102135 - protein, 17 aa, Mycobacterium avium
PRILTWPTGSMEILNEG

SEQ ID NO: 102136 - protein, 18 aa, Mycobacterium avium
PRIPIWWAGTSPRARPTS

SEQ ID NO: 102137 - protein, 21 aa, Mycobacterium avium
PRLGDDWLVAPAIAYGASGEH

SEQ ID NO: 102138 - protein, 18 aa, Mycobacterium avium
PRLLRGEEHWCQGFSEPG

SEQ ID NO: 102139 - protein, 23 aa, Mycobacterium avium
PRLMSRAQFVAHLSTIMMAVIIG

SEQ ID NO: 102140 - protein, 20 aa, Mycobacterium avium
PRLPFDPALQPARALMERAG

SEQ ID NO: 102141 - protein, 19 aa, Mycobacterium avium
PRLPHQLIYATATAAMGLN

SEQ ID NO: 102142 - protein, 19 aa, Mycobacterium avium
PRMSDQLSRLARRGSTKIA

SEQ ID NO: 102143 - protein, 18 aa, Mycobacterium avium
PRNLDGLRKNLRLRDGRW

SEQ ID NO: 102144 - protein, 21 aa, Mycobacterium avium
PRPAELHRFVELHGPRHTAPA

SEQ ID NO: 102145 - protein, 19 aa, Mycobacterium avium
PRPAQARDLAAMFDAVGAA

SEQ ID NO: 102146 - protein, 18 aa, Mycobacterium avium
PRPASSPGSGRTRPARPP

SEQ ID NO: 102147 - protein, 19 aa, Mycobacterium avium
PRPAVKAAQLRTPRDRRGG

SEQ ID NO: 102148 - protein, 18 aa, Mycobacterium avium
PRPGAPRPRGGAHRRPGH

SEQ ID NO: 102149 - protein, 24 aa, Mycobacterium avium
PRPGSRTGAKLGPFLVPATVSAPE

SEQ ID NO: 102150 - protein, 17 aa, Mycobacterium avium
PRPPFAQRIPNRLWAAQ

SEQ ID NO: 102151 - protein, 26 aa, Mycobacterium avium
PRPPWLMSACAPAPVGDTPAVGEADR

SEQ ID NO: 102152 - protein, 17 aa, Mycobacterium avium
PRPQLRVGRQQQVVEVL

SEQ ID NO: 102153 - protein, 17 aa, Mycobacterium avium
PRPRLPRSVPRPITTGQ

SEQ ID NO: 102154 - protein, 19 aa, Mycobacterium avium
PRQAPAVGYAPALALLPRR

SEQ ID NO: 102155 - protein, 18 aa, Mycobacterium avium
PRRGQPPGVVATGRSAIG

SEQ ID NO: 102156 - protein, 18 aa, Mycobacterium avium
PRRHGKWLVLPTDGPTLL

SEQ ID NO: 102157 - protein, 20 aa, Mycobacterium avium
PRRPTPWPMPGRSASPTTAR

SEQ ID NO: 102158 - protein, 24 aa, Mycobacterium avium
PRRPVVGVPHRIRMVGGARRRPQR

SEQ ID NO: 102159 - protein, 21 aa, Mycobacterium avium
PRRQWPSPMLPALQSLLDDHT

SEQ ID NO: 102160 - protein, 18 aa, Mycobacterium avium
PRRREWPEAPGSPRVAPA

SEQ ID NO: 102161 - protein, 28 aa, Mycobacterium avium
PRRRRWPGWSRPVASRRSWWSASTGCRR

SEQ ID NO: 102162 - protein, 21 aa, Mycobacterium avium
PRRVLLERLLDGFPPGRIHCD

SEQ ID NO: 102163 - protein, 19 aa, Mycobacterium avium
PRSAERARLRAELAALAGH

SEQ ID NO: 102164 - protein, 18 aa, Mycobacterium avium
PRSGELPADAGLVAAMDQ

SEQ ID NO: 102165 - protein, 29 aa, Mycobacterium avium
PRSGEVIELGDWVRPVLLDGLAVLLLEPP

SEQ ID NO: 102166 - protein, 27 aa, Mycobacterium avium
PRSLEIVSCPSCGRAQVDVYTLANEVS

SEQ ID NO: 102167 - protein, 22 aa, Mycobacterium avium
PRSRMGRIAWSWLRHPVKSREF

SEQ ID NO: 102168 - protein, 23 aa, Mycobacterium avium
PRTELLDRLGAHLTRHVGPGVEY

SEQ ID NO: 102169 - protein, 21 aa, Mycobacterium avium
PRTGLWLLLLAKGGGDDHVSA

SEQ ID NO: 102170 - protein, 17 aa, Mycobacterium avium
PRTGRQLGNFPQAFTHL

SEQ ID NO: 102171 - protein, 21 aa, Mycobacterium avium
PRTPACYGFSIIAKVKEGREE

SEQ ID NO: 102172 - protein, 29 aa, Mycobacterium avium
PRTRYGPPSAVLRRHVRVLLAAAHTTGDL

SEQ ID NO: 102173 - protein, 17 aa, Mycobacterium avium
PRTSLLVLGDGRTNYRN

SEQ ID NO: 102174 - protein, 20 aa, Mycobacterium avium
PRTTIGWKGLINDPAMDSSF

SEQ ID NO: 102175 - protein, 18 aa, Mycobacterium avium
PRVAVLEVVDANPHADTE

SEQ ID NO: 102176 - protein, 26 aa, Mycobacterium avium
PRVDEARAALSWLRRHAFLVRNLDIT

SEQ ID NO: 102177 - protein, 20 aa, Mycobacterium avium
PRVDMLQRLAQVCGKRLHIR

SEQ ID NO: 102178 - protein, 18 aa, Mycobacterium avium
PRVLDWLARTEVDVLAMQ

SEQ ID NO: 102179 - protein, 19 aa, Mycobacterium avium
PRVNPDLLRHIAHRREADR

SEQ ID NO: 102180 - protein, 23 aa, Mycobacterium avium
PRVVFGTPVSGFGRTVAADTRTY

SEQ ID NO: 102181 - protein, 24 aa, Mycobacterium avium
PRVWFGERWIDSVLDLFAENIRYF

SEQ ID NO: 102182 - protein, 27 aa, Mycobacterium avium
PRYAVGCKRPGFHNGYLATFNRDNVRL

SEQ ID NO: 102183 - protein, 23 aa, Mycobacterium avium
PRYLGWRHRRVDDDDYYAFIDKF

SEQ ID NO: 102184 - protein, 18 aa, Mycobacterium avium
PRYLRDLREACTRHDVLL

SEQ ID NO: 102185 - protein, 21 aa, Mycobacterium avium
PRYQGCLDRCRGASARFTAGS

SEQ ID NO: 102186 - protein, 19 aa, Mycobacterium avium
PRYRAQRSVEEYGKIVDYL

SEQ ID NO: 102187 - protein, 21 aa, Mycobacterium avium
PSAAVFAELIVDPIRARSVAA

SEQ ID NO: 102188 - protein, 27 aa, Mycobacterium avium
PSATIALPFDIAGALTGFHTDDIVSGW

SEQ ID NO: 102189 - protein, 17 aa, Mycobacterium avium
PSAWIAEGLLIYLPASA

SEQ ID NO: 102190 - protein, 20 aa, Mycobacterium avium
PSAWIAEGLLIYLPASAQEQ

SEQ ID NO: 102191 - protein, 17 aa, Mycobacterium avium
PSCRPRLLTGQPGREDL

SEQ ID NO: 102192 - protein, 23 aa, Mycobacterium avium
PSDFLHGKWLVLRRGKRTIAGVE

SEQ ID NO: 102193 - protein, 24 aa, Mycobacterium avium
PSDLFRKHFWGCFIDDEHGLTNRH

SEQ ID NO: 102194 - protein, 25 aa, Mycobacterium avium
PSDLFRKHFWGCFIDDMHGLKNRHE

SEQ ID NO: 102195 - protein, 24 aa, Mycobacterium avium
PSEPTFYAGAAYSLSCGFDGNNHP

SEQ ID NO: 102196 - protein, 25 aa, Mycobacterium avium
PSGCGKTTLIRCIVGTQILTKGRVT

SEQ ID NO: 102197 - protein, 26 aa, Mycobacterium avium
PSGLGRIDAVLARAARIGPMSVPAGW

SEQ ID NO: 102198 - protein, 20 aa, Mycobacterium avium
PSGRAFGLCRYWARDGRITL

SEQ ID NO: 102199 - protein, 24 aa, Mycobacterium avium
PSGVFDWRPPSSLIAALSDLLDAQ

SEQ ID NO: 102200 - protein, 23 aa, Mycobacterium avium
PSHGSDWRWGPVHVAPPAPPGPM

SEQ ID NO: 102201 - protein, 21 aa, Mycobacterium avium
PSKEDLALEVLHQGFTDSLDT

SEQ ID NO: 102202 - protein, 22 aa, Mycobacterium avium
PSLDLFLTPTFRGYLANYGTVL

SEQ ID NO: 102203 - protein, 17 aa, Mycobacterium avium
PSLNTVIGHSYGSTEVG

SEQ ID NO: 102204 - protein, 19 aa, Mycobacterium avium
PSLTGSRFVACPFGAPATR

SEQ ID NO: 102205 - protein, 29 aa, Mycobacterium avium
PSLYSALAEQCRRLDALGIGYEIVPGVPA

SEQ ID NO: 102206 - protein, 25 aa, Mycobacterium avium
PSMDSSWRKLLLVCEAVAEPGDVEA

SEQ ID NO: 102207 - protein, 23 aa, Mycobacterium avium
PSNVFVAGFIGSPAMNLFTLQVV

SEQ ID NO: 102208 - protein, 23 aa, Mycobacterium avium
PSPELMARWRSRRTHEHPLVWTH

SEQ ID NO: 102209 - protein, 24 aa, Mycobacterium avium
PSPNSGPVPGGWAAAPTASPGPAV

SEQ ID NO: 102210 - protein, 26 aa, Mycobacterium avium
PSRGFPRPRFDDGYGRYDGDDYDDPR

SEQ ID NO: 102211 - protein, 22 aa, Mycobacterium avium
PSSTPGHRWAWQTRSWSHGERE

SEQ ID NO: 102212 - protein, 17 aa, Mycobacterium avium
PSTGTRRRYPWGATPPS

SEQ ID NO: 102213 - protein, 17 aa, Mycobacterium avium
PSTPIAVIFRSDKSGTT

SEQ ID NO: 102214 - protein, 25 aa, Mycobacterium avium
PSVDKRNRPVLVFVLDAGMPGLTQG

SEQ ID NO: 102215 - protein, 19 aa, Mycobacterium avium
PSVPVHFVQMWVIPDEAGI

SEQ ID NO: 102216 - protein, 18 aa, Mycobacterium avium
PTARLVVFKLSGDFDPAQ

SEQ ID NO: 102217 - protein, 23 aa, Mycobacterium avium
PTAWIAEGLFGYLAPEAQDRLLD

SEQ ID NO: 102218 - protein, 24 aa, Mycobacterium avium
PTAWLAEGVLIGFLPPEAEVRLLD

SEQ ID NO: 102219 - protein, 17 aa, Mycobacterium avium
PTDKVLGGWTVGTDAGR

SEQ ID NO: 102220 - protein, 24 aa, Mycobacterium avium
PTECCIKGPHTFLGYTDAEDDEYA

SEQ ID NO: 102221 - protein, 19 aa, Mycobacterium avium
PTEFEAAFYDAYRTDQPLI

SEQ ID NO: 102222 - protein, 23 aa, Mycobacterium avium
PTERAVPFGAFSHLVRIAEIGKP

SEQ ID NO: 102223 - protein, 25 aa, Mycobacterium avium
PTFADTPSGWRVVFGEASRADCLEY

SEQ ID NO: 102224 - protein, 20 aa, Mycobacterium avium
PTFYFYFKSKEAVVLSLLEP

SEQ ID NO: 102225 - protein, 26 aa, Mycobacterium avium
PTGLGRIDAVLARAARIGPMSVPAGW

SEQ ID NO: 102226 - protein, 19 aa, Mycobacterium avium
PTGQHWRLLSTVKELDPAW

SEQ ID NO: 102227 - protein, 27 aa, Mycobacterium avium
PTGRPTGEWAAAIARLADAEVAVAECA

SEQ ID NO: 102228 - protein, 25 aa, Mycobacterium avium
PTGRRLLICGSAGFVAGALAGQRAE

SEQ ID NO: 102229 - protein, 19 aa, Mycobacterium avium
PTIATLVDWANRAGLGRAV

SEQ ID NO: 102230 - protein, 19 aa, Mycobacterium avium
PTKHKYLAAFIGWLEKQRL

SEQ ID NO: 102231 - protein, 25 aa, Mycobacterium avium
PTKVPRLAAQYAFCNGMSPQQREFA

SEQ ID NO: 102232 - protein, 17 aa, Mycobacterium avium
PTLIELYLQGRLPLEKF

SEQ ID NO: 102233 - protein, 20 aa, Mycobacterium avium
PTLLHPRPRSVLGQLAAAVY

SEQ ID NO: 102234 - protein, 18 aa, Mycobacterium avium
PTLLLLRHLLRFGEHARV

SEQ ID NO: 102235 - protein, 21 aa, Mycobacterium avium
PTLRLAAPLYELPFKHDALAY

SEQ ID NO: 102236 - protein, 17 aa, Mycobacterium avium
PTNCFNLTMLHLSTRST

SEQ ID NO: 102237 - protein, 26 aa, Mycobacterium avium
PTNRVRRYVCLKGPDHGGCGRLTVVA

SEQ ID NO: 102238 - protein, 21 aa, Mycobacterium avium
PTPMIRCIWCSPRAPPASRKV

SEQ ID NO: 102239 - protein, 25 aa, Mycobacterium avium
PTPPEVRSPLGPGMPAGFPDLSQLP

SEQ ID NO: 102240 - protein, 19 aa, Mycobacterium avium
PTPRPRRVLFVSGGSGITP

SEQ ID NO: 102241 - protein, 17 aa, Mycobacterium avium
PTRALRQLAEYGIGLSP

SEQ ID NO: 102242 - protein, 19 aa, Mycobacterium avium
PTRPARAGWSRVNPVTGHE

SEQ ID NO: 102243 - protein, 22 aa, Mycobacterium avium
PTRPARAGWSRVNPVTGHEEFP

SEQ ID NO: 102244 - protein, 23 aa, Mycobacterium avium
PTRQRLVDWLKSMVYNQALITEQ

SEQ ID NO: 102245 - protein, 23 aa, Mycobacterium avium
PTSWSAAIDALAFGRAIDDSDPK

SEQ ID NO: 102246 - protein, 27 aa, Mycobacterium avium
PTTEYHEWTWRTTLLPRIAPTARDEES

SEQ ID NO: 102247 - protein, 19 aa, Mycobacterium avium
PTTLCEAFQATAAKHPDAV

SEQ ID NO: 102248 - protein, 17 aa, Mycobacterium avium
PTVEIRDGLAITIEDPR

SEQ ID NO: 102249 - protein, 20 aa, Mycobacterium avium
PTVFATNFAGMWSAQLREGD

SEQ ID NO: 102250 - protein, 23 aa, Mycobacterium avium
PTVFATNFAGMWSAQLREGDVVA

SEQ ID NO: 102251 - protein, 17 aa, Mycobacterium avium
PTVFQRLAPGIMPLSVA

SEQ ID NO: 102252 - protein, 23 aa, Mycobacterium avium
PTVSKLPLGGMVGRESEGAVQRV

SEQ ID NO: 102253 - protein, 17 aa, Mycobacterium avium
PTVSWSAVAAVVYGLVL

SEQ ID NO: 102254 - protein, 22 aa, Mycobacterium avium
PTWESLHAVFAHLIADEANRLP

SEQ ID NO: 102255 - protein, 25 aa, Mycobacterium avium
PTYAVPRLLARNGLSLQDFDFYEIH

SEQ ID NO: 102256 - protein, 24 aa, Mycobacterium avium
PTYPEDRLSFILGDADAKLVLREP

SEQ ID NO: 102257 - protein, 24 aa, Mycobacterium avium
PVADLFVIGAAYRRYAIKHRHMYR

SEQ ID NO: 102258 - protein, 23 aa, Mycobacterium avium
PVADLFVIGAAYRRYAIRHRHMY

SEQ ID NO: 102259 - protein, 24 aa, Mycobacterium avium
PVADPALVPLFFVAREARKHVKVV

SEQ ID NO: 102260 - protein, 25 aa, Mycobacterium avium
PVADYRGASVMVEWPTELQQRVRTV

SEQ ID NO: 102261 - protein, 17 aa, Mycobacterium avium
PVAIKLFRGPRYVVAML

SEQ ID NO: 102262 - protein, 17 aa, Mycobacterium avium
PVALCARTPDRLERAAA

SEQ ID NO: 102263 - protein, 24 aa, Mycobacterium avium
PVAMAARTRFFDSFFQAATQAGIR

SEQ ID NO: 102264 - protein, 27 aa, Mycobacterium avium
PVARFLSRWVRRAGPRIVEPSCGDGAI

SEQ ID NO: 102265 - protein, 18 aa, Mycobacterium avium
PVATLISGHALCASGALG

SEQ ID NO: 102266 - protein, 20 aa, Mycobacterium avium
PVCRTSNAGTDWRAGVSSPG

SEQ ID NO: 102267 - protein, 17 aa, Mycobacterium avium
PVDADWLLLVELAADHD

SEQ ID NO: 102268 - protein, 30 aa, Mycobacterium avium
PVDGELLSYVRGVLYFRTGRWPDVLNQFPE

SEQ ID NO: 102269 - protein, 20 aa, Mycobacterium avium
PVDGPRGWATCKYVVACNMQ

SEQ ID NO: 102270 - protein, 35 aa, Mycobacterium avium
PVDLRAWRQWWTWMPGACWRQPFGPGSSIEDRLDH

SEQ ID NO: 102271 - protein, 20 aa, Mycobacterium avium
PVDPGFRIPLGQADIKRPGT

SEQ ID NO: 102272 - protein, 18 aa, Mycobacterium avium
PVDPSGWEGYGRGAQFLA

SEQ ID NO: 102273 - protein, 24 aa, Mycobacterium avium
PVDQLRLAPTLDWIEAALPQQNTS

SEQ ID NO: 102274 - protein, 19 aa, Mycobacterium avium
PVDRARVYVTGMSNGAMMA

SEQ ID NO: 102275 - protein, 19 aa, Mycobacterium avium
PVDYRARRAALQALQHPKI

SEQ ID NO: 102276 - protein, 19 aa, Mycobacterium avium
PVEDCYAALLWLARQPWVD

SEQ ID NO: 102277 - protein, 21 aa, Mycobacterium avium
PVEGWDFSWLNGRATEERPSW

SEQ ID NO: 102278 - protein, 17 aa, Mycobacterium avium
PVEREHRLRPVAGAPAL

SEQ ID NO: 102279 - protein, 17 aa, Mycobacterium avium
PVEYDALGADFGRRGAL

SEQ ID NO: 102280 - protein, 22 aa, Mycobacterium avium
PVGRLPQPVAFEGVHREALVRQ

SEQ ID NO: 102281 - protein, 18 aa, Mycobacterium avium
PVGRPRRGQPPGVVATGR

SEQ ID NO: 102282 - protein, 23 aa, Mycobacterium avium
PVHAECAGLLYLVSELDGHPMCG

SEQ ID NO: 102283 - protein, 23 aa, Mycobacterium avium
PVHAIALRCQIRIEPLRRGYSDD

SEQ ID NO: 102284 - protein, 23 aa, Mycobacterium avium
PVHAVRLAGLVAHQEILFGTEGE

SEQ ID NO: 102285 - protein, 18 aa, Mycobacterium avium
PVIECHVGDQLGAGGAVL

SEQ ID NO: 102286 - protein, 17 aa, Mycobacterium avium
PVIPPAILECGVTYHTS

SEQ ID NO: 102287 - protein, 17 aa, Mycobacterium avium
PVIPVFVNAIGVPLGPM

SEQ ID NO: 102288 - protein, 17 aa, Mycobacterium avium
PVKPDRLLAGGDTVRIG

SEQ ID NO: 102289 - protein, 19 aa, Mycobacterium avium
PVLAWLHPPGIDFRPALLA

SEQ ID NO: 102290 - protein, 29 aa, Mycobacterium avium
PVLAWLHPPGIDFRPALLAGVQIGLSSQR

SEQ ID NO: 102291 - protein, 19 aa, Mycobacterium avium
PVLGGGGFRAPVGVVEEVL

SEQ ID NO: 102292 - protein, 18 aa, Mycobacterium avium
PVLHRQRAGHIVQISSVG

SEQ ID NO: 102293 - protein, 22 aa, Mycobacterium avium
PVLKIPRLQDAYFKRFPGYPKG

SEQ ID NO: 102294 - protein, 24 aa, Mycobacterium avium
PVLRFFGDLLYFDRYWLEEEQVCT

SEQ ID NO: 102295 - protein, 17 aa, Mycobacterium avium
PVLYELVHGTPFTELLA

SEQ ID NO: 102296 - protein, 20 aa, Mycobacterium avium
PVNCATAPLPTGRRVAEFGA

SEQ ID NO: 102297 - protein, 26 aa, Mycobacterium avium
PVPFEVYADGISLVVFEEFGSGAAAL

SEQ ID NO: 102298 - protein, 35 aa, Mycobacterium avium
PVPPQGLCADAFARIVTLMPGWGMRELLSSHVVHS

SEQ ID NO: 102299 - protein, 19 aa, Mycobacterium avium
PVPVGNWYYATGIVASPAN

SEQ ID NO: 102300 - protein, 18 aa, Mycobacterium avium
PVQNVWHTTALVAPPLDE

SEQ ID NO: 102301 - protein, 18 aa, Mycobacterium avium
PVQNVWRTTALVAPPLDE

SEQ ID NO: 102302 - protein, 25 aa, Mycobacterium avium
PVRRAEGVGEAWLQEQLDVERRHCF

SEQ ID NO: 102303 - protein, 19 aa, Mycobacterium avium
PVRRRIFQLEIGRAHTPWF

SEQ ID NO: 102304 - protein, 18 aa, Mycobacterium avium
PVRRRRAGAESWFGGGGQ

SEQ ID NO: 102305 - protein, 22 aa, Mycobacterium avium
PVRSLVWVRGRLHEVDPAQILE

SEQ ID NO: 102306 - protein, 35 aa, Mycobacterium avium
PVRVRRLGPAAARLRLARPLPLRVADVGLLRDPGK

SEQ ID NO: 102307 - protein, 35 aa, Mycobacterium avium
PVRVRRLGPAAARLRLARPLPLRVADVGLLRDPGQ

SEQ ID NO: 102308 - protein, 32 aa, Mycobacterium avium
PVSALVVFEVMVRPLIRLSLGKRQPMRRIVQA

SEQ ID NO: 102309 - protein, 18 aa, Mycobacterium avium
PVSARPAPHAPAQAQPAT

SEQ ID NO: 102310 - protein, 18 aa, Mycobacterium avium
PVTFDEVDFTLAVLGGND

SEQ ID NO: 102311 - protein, 20 aa, Mycobacterium avium
PVTRSSLPTAQRARKLVYAP

SEQ ID NO: 102312 - protein, 20 aa, Mycobacterium avium
PVTTLRLAMHAVEAGLREIA

SEQ ID NO: 102313 - protein, 19 aa, Mycobacterium avium
PVVAFRLAKDRGYTEFDVS

SEQ ID NO: 102314 - protein, 17 aa, Mycobacterium avium
PVVDRAKHLLLDGIGCA

SEQ ID NO: 102315 - protein, 18 aa, Mycobacterium avium
PVVDSWRPTYADFSDNFA

SEQ ID NO: 102316 - protein, 17 aa, Mycobacterium avium
PVVNGQCIQHCVCGRSA

SEQ ID NO: 102317 - protein, 24 aa, Mycobacterium avium
PVVPRAATAPSWLPEAPSVADLGW

SEQ ID NO: 102318 - protein, 19 aa, Mycobacterium avium
PVVPSLRMLIGGGAACPPE

SEQ ID NO: 102319 - protein, 17 aa, Mycobacterium avium
PVVQFLSVGPLTFGAGV

SEQ ID NO: 102320 - protein, 19 aa, Mycobacterium avium
PVYLSGRARDLWTAGDETA

SEQ ID NO: 102321 - protein, 32 aa, Mycobacterium avium
PVYVGFGSMPMRACRDVARVAIEAVRAQRRRV

SEQ ID NO: 102322 - protein, 19 aa, Mycobacterium avium
PVYYMPQWDTFALSRFDDI

SEQ ID NO: 102323 - protein, 19 aa, Mycobacterium avium
PWAAELEDLSGARVLADLG

SEQ ID NO: 102324 - protein, 20 aa, Mycobacterium avium
PWIGNIALSFPYLDTEATRT

SEQ ID NO: 102325 - protein, 21 aa, Mycobacterium avium
PWIGNIALSFPYLDTEATRTI

SEQ ID NO: 102326 - protein, 22 aa, Mycobacterium avium
PWKSRRLLTLETRMQVCRRNSR

SEQ ID NO: 102327 - protein, 19 aa, Mycobacterium avium
PWLAGYLGPEVMDLNRRIK

SEQ ID NO: 102328 - protein, 17 aa, Mycobacterium avium
PWLCRRLAQAEADVAVA

SEQ ID NO: 102329 - protein, 19 aa, Mycobacterium avium
PWLDEVGEWLAAHRDGGVA

SEQ ID NO: 102330 - protein, 17 aa, Mycobacterium avium
PWLRPMEAFTLSVPRDI

SEQ ID NO: 102331 - protein, 20 aa, Mycobacterium avium
PWMTDLVEQFGLRPPPVEQI

SEQ ID NO: 102332 - protein, 19 aa, Mycobacterium avium
PWSAQGMFDILRAERITVA

SEQ ID NO: 102333 - protein, 21 aa, Mycobacterium avium
PWTMPEPLLPVAIAAHAKTDE

SEQ ID NO: 102334 - protein, 27 aa, Mycobacterium avium
PYAFTYRTGCTWLRTWDAKLWSLHSGG

SEQ ID NO: 102335 - protein, 17 aa, Mycobacterium avium
PYAGTWLLSSSVLADHV

SEQ ID NO: 102336 - protein, 17 aa, Mycobacterium avium
PYEPGYRVLDGIRAALG

SEQ ID NO: 102337 - protein, 30 aa, Mycobacterium avium
PYERSSCFWQRIAYLYSRFDDLIAEVSAAG

SEQ ID NO: 102338 - protein, 24 aa, Mycobacterium avium
PYGGPRPLISYAPGTQGQGNQCAP

SEQ ID NO: 102339 - protein, 24 aa, Mycobacterium avium
PYGGPRPLMSYAPGTQGQGNQCAP

SEQ ID NO: 102340 - protein, 21 aa, Mycobacterium avium
PYGRFREMRESGCPVAHSEHY

SEQ ID NO: 102341 - protein, 17 aa, Mycobacterium avium
PYGYPLANQMFRVVDDN

SEQ ID NO: 102342 - protein, 20 aa, Mycobacterium avium
PYLGEKICAAVVFEGPALSL

SEQ ID NO: 102343 - protein, 22 aa, Mycobacterium avium
PYLGEKICAAVVFNGPELSLAE

SEQ ID NO: 102344 - protein, 27 aa, Mycobacterium avium
PYNRRSRFPQRWWWVALTDEAYPRLAV

SEQ ID NO: 102345 - protein, 17 aa, Mycobacterium avium
PYPQRAPVLVGIDGSPA

SEQ ID NO: 102346 - protein, 17 aa, Mycobacterium avium
PYPTMYVNQPWTIRQYA

SEQ ID NO: 102347 - protein, 17 aa, Mycobacterium avium
PYQRAWDIERIALLEAA

SEQ ID NO: 102348 - protein, 19 aa, Mycobacterium avium
PYRASRSAFAFKDTLAGGI

SEQ ID NO: 102349 - protein, 17 aa, Mycobacterium avium
PYRKLGRNQLRVGMFPA

SEQ ID NO: 102350 - protein, 17 aa, Mycobacterium avium
PYVASKWGVRGLAKSAA

SEQ ID NO: 102351 - protein, 17 aa, Mycobacterium avium
PYVTTTNNVVWGISQSQ

SEQ ID NO: 102352 - protein, 20 aa, Mycobacterium avium
PYVYRFGQPVFDRLFYHRYR

SEQ ID NO: 102353 - protein, 21 aa, Mycobacterium avium
PYVYRFGQPVFDRLFYQRYRR

SEQ ID NO: 102354 - protein, 18 aa, Mycobacterium avium
PYWGPRRLVFELAKRRVG

SEQ ID NO: 102355 - protein, 19 aa, Mycobacterium avium
PYYHYRVVIDGDPGTELIL

SEQ ID NO: 102356 - protein, 18 aa, Mycobacterium avium
PYYVCVLAALGTLPELVH

SEQ ID NO: 102357 - protein, 26 aa, Mycobacterium avium
QAAAHGRFSLGLGLGAADLERRTFGT

SEQ ID NO: 102358 - protein, 30 aa, Mycobacterium avium
QAADAVLDYTFDFTNWLAGTGDSVAAATFT

SEQ ID NO: 102359 - protein, 27 aa, Mycobacterium avium
QAAGLIDWIGDLPIRALISSPLLRCRR

SEQ ID NO: 102360 - protein, 30 aa, Mycobacterium avium
QAAGRRGCLPRCRHDLGFRPTVAALGARLH

SEQ ID NO: 102361 - protein, 19 aa, Mycobacterium avium
QAAHLMVNYDLPWNPNRIE

SEQ ID NO: 102362 - protein, 18 aa, Mycobacterium avium
QAAIAHERAAEVEDRAVA

SEQ ID NO: 102363 - protein, 17 aa, Mycobacterium avium
QAARLALEAHQHRAEQP

SEQ ID NO: 102364 - protein, 17 aa, Mycobacterium avium
QAARLPVDFTGFVSDRT

SEQ ID NO: 102365 - protein, 27 aa, Mycobacterium avium
QACRLGDDVVLSWDYRAGCFPPGVVDD

SEQ ID NO: 102366 - protein, 26 aa, Mycobacterium avium
QADLDYWRPLMADLPEPLELPGPNGS

SEQ ID NO: 102367 - protein, 24 aa, Mycobacterium avium
QADRFWADFCTRLGRPDLIDDERF

SEQ ID NO: 102368 - protein, 24 aa, Mycobacterium avium
QADRFWADFCTRLGRTDLIEDERF

SEQ ID NO: 102369 - protein, 24 aa, Mycobacterium avium
QAEAAYRKGLSWSEAADTIDLGEY

SEQ ID NO: 102370 - protein, 18 aa, Mycobacterium avium
QAEGGWAGIAWPTEYGGK

SEQ ID NO: 102371 - protein, 24 aa, Mycobacterium avium
QAETFPELRLLALNEPLATQLGLD

SEQ ID NO: 102372 - protein, 22 aa, Mycobacterium avium
QAEVAAELIARIAAGERGIGGL

SEQ ID NO: 102373 - protein, 19 aa, Mycobacterium avium
QAGAWGGPSAESYVAAHAP

SEQ ID NO: 102374 - protein, 25 aa, Mycobacterium avium
QAGDALAGLRGWGLRDLGYTLTRRR

SEQ ID NO: 102375 - protein, 17 aa, Mycobacterium avium
QAGHLRRALRCPDDRLA

SEQ ID NO: 102376 - protein, 23 aa, Mycobacterium avium
QAGIDVAVCKPVQTGTDDGDDDL

SEQ ID NO: 102377 - protein, 25 aa, Mycobacterium avium
QAGKDYLIFPALSLRRWRRTLTANA

SEQ ID NO: 102378 - protein, 26 aa, Mycobacterium avium
QAGVSRPTLYRWFASKEELLSAFSAY

SEQ ID NO: 102379 - protein, 23 aa, Mycobacterium avium
QAHSQKFAWARLFRPMVHGHPLT

SEQ ID NO: 102380 - protein, 21 aa, Mycobacterium avium
QAHWNIVGINFRDLHLQLDEL

SEQ ID NO: 102381 - protein, 17 aa, Mycobacterium avium
QAIADIATLILKTGAEV

SEQ ID NO: 102382 - protein, 24 aa, Mycobacterium avium
QALHSSAMPGGWAAAPSPGPTVSK

SEQ ID NO: 102383 - protein, 18 aa, Mycobacterium avium
QALVPGRVPPYVVGLIEL

SEQ ID NO: 102384 - protein, 23 aa, Mycobacterium avium
QAMGADAYRLLPAYREAADRCAQ

SEQ ID NO: 102385 - protein, 18 aa, Mycobacterium avium
QAMLECTDVQPTFRKHPA

SEQ ID NO: 102386 - protein, 23 aa, Mycobacterium avium
QAPYGLAGSRALAWVSQTVSNIV

SEQ ID NO: 102387 - protein, 24 aa, Mycobacterium avium
QAPYGLAGSRALAWVSQTVSNIVI

SEQ ID NO: 102388 - protein, 18 aa, Mycobacterium avium
QARDLRYTLLDDVPVATL

SEQ ID NO: 102389 - protein, 18 aa, Mycobacterium avium
QARDRFDAAWNHQDGDHP

SEQ ID NO: 102390 - protein, 19 aa, Mycobacterium avium
QARVVLCGVISSYLTGDHP

SEQ ID NO: 102391 - protein, 22 aa, Mycobacterium avium
QASCGRRQITWSRRRSNPESGR

SEQ ID NO: 102392 - protein, 17 aa, Mycobacterium avium
QASRWSPERANRWYQAQ

SEQ ID NO: 102393 - protein, 23 aa, Mycobacterium avium
QATASAPAHDWLTLTGGAIGYGI

SEQ ID NO: 102394 - protein, 17 aa, Mycobacterium avium
QAVAAPAVRKTGVLESE

SEQ ID NO: 102395 - protein, 18 aa, Mycobacterium avium
QAVAELRALVGEVVGPDD

SEQ ID NO: 102396 - protein, 17 aa, Mycobacterium avium
QAVMAQFLERVMSGKLS

SEQ ID NO: 102397 - protein, 25 aa, Mycobacterium avium
QAYQFPMGLGLVSQFFGKYFSPEEA

SEQ ID NO: 102398 - protein, 21 aa, Mycobacterium avium
QCAPAAEWFGSRGWTAVPTPL

SEQ ID NO: 102399 - protein, 18 aa, Mycobacterium avium
QCHSLAFDFSVWEIFGAL

SEQ ID NO: 102400 - protein, 28 aa, Mycobacterium avium
QCHSLAFDFSVWEIWAALLHGGRLVVVS

SEQ ID NO: 102401 - protein, 25 aa, Mycobacterium avium
QDESTRAALQWAMSVAAQRAAALVA

SEQ ID NO: 102402 - protein, 18 aa, Mycobacterium avium
QDHKSVLGLLETLDGAPS

SEQ ID NO: 102403 - protein, 17 aa, Mycobacterium avium
QDISGLVRAIGFREPQK

SEQ ID NO: 102404 - protein, 17 aa, Mycobacterium avium
QDLIARPWSWLAGGCEP

SEQ ID NO: 102405 - protein, 18 aa, Mycobacterium avium
QDLIARPWSWLAGGCEPN

SEQ ID NO: 102406 - protein, 24 aa, Mycobacterium avium
QDLPGDSFVGPRFGYLGRTQPVGR

SEQ ID NO: 102407 - protein, 24 aa, Mycobacterium avium
QDLPGDTFVGPRFGYLGRTQPVGR

SEQ ID NO: 102408 - protein, 26 aa, Mycobacterium avium
QDNEGHSMFPWLTLALVGSSTSHVSF

SEQ ID NO: 102409 - protein, 22 aa, Mycobacterium avium
QDPLGRLAIRRITDATNGVDPL

SEQ ID NO: 102410 - protein, 18 aa, Mycobacterium avium
QDRFAKFNLRDTVIRPSY

SEQ ID NO: 102411 - protein, 20 aa, Mycobacterium avium
QDRRFSVPIERIRYSEELGY

SEQ ID NO: 102412 - protein, 23 aa, Mycobacterium avium
QDSPHGWPSRPTHSGWPDSPAIA

SEQ ID NO: 102413 - protein, 27 aa, Mycobacterium avium
QDSSLSRRGFLWWAVVEGLVNAGAPVL

SEQ ID NO: 102414 - protein, 20 aa, Mycobacterium avium
QDTVPEGYSWIDANDSANNV

SEQ ID NO: 102415 - protein, 21 aa, Mycobacterium avium
QEAATSWELYGKRHGYMACLP

SEQ ID NO: 102416 - protein, 20 aa, Mycobacterium avium
QEALAGLPERLALPTDRPYP

SEQ ID NO: 102417 - protein, 25 aa, Mycobacterium avium
QEATEGRFRLGLGTQVRTHVVRRYG

SEQ ID NO: 102418 - protein, 17 aa, Mycobacterium avium
QECPGAVASASRITGMT

SEQ ID NO: 102419 - protein, 17 aa, Mycobacterium avium
QEDVYNPLRFLRAAMKW

SEQ ID NO: 102420 - protein, 29 aa, Mycobacterium avium
QEELLAAKLMGRWRSGAPLVLAPDEDDPE

SEQ ID NO: 102421 - protein, 21 aa, Mycobacterium avium
QEFPPPLPYKGNRDPKVFQPY

SEQ ID NO: 102422 - protein, 27 aa, Mycobacterium avium
QEHPVPAMVWPFVQECLREHRAGARRA

SEQ ID NO: 102423 - protein, 21 aa, Mycobacterium avium
QEIMTELEIAPTRRLRGLGDR

SEQ ID NO: 102424 - protein, 23 aa, Mycobacterium avium
QEITRGRCAAIAVPQGGHGKAGR

SEQ ID NO: 102425 - protein, 25 aa, Mycobacterium avium
QELAQLRLGLMHGRLSAEEKDAVMA

SEQ ID NO: 102426 - protein, 19 aa, Mycobacterium avium
QELEPACAALAARRPDRAD

SEQ ID NO: 102427 - protein, 30 aa, Mycobacterium avium
QELRKISIIEAKGYCYGWHFYQAGDADLVI

SEQ ID NO: 102428 - protein, 19 aa, Mycobacterium avium
QEMLLRASRYFDIPIERVE

SEQ ID NO: 102429 - protein, 23 aa, Mycobacterium avium
QEMMRRATAKWREHGFNLEFGDL

SEQ ID NO: 102430 - protein, 19 aa, Mycobacterium avium
QEMQDEWERIIPMGRMGRP

SEQ ID NO: 102431 - protein, 19 aa, Mycobacterium avium
QERMAALAEAVWALPQPVI

SEQ ID NO: 102432 - protein, 25 aa, Mycobacterium avium
QESTLGLIFHWAKERDRRLVTTDDL

SEQ ID NO: 102433 - protein, 25 aa, Mycobacterium avium
QESTLGLIFHWAKERNWPLVTTDNL

SEQ ID NO: 102434 - protein, 25 aa, Mycobacterium avium
QEVEALLCREARDGVQKLHGNRLLA

SEQ ID NO: 102435 - protein, 20 aa, Mycobacterium avium
QEYYHVPALHSQQVPPEVRD

SEQ ID NO: 102436 - protein, 24 aa, Mycobacterium avium
QFCPSPCRPGGAGVASPHTLHSAA

SEQ ID NO: 102437 - protein, 23 aa, Mycobacterium avium
QFGLPEVKRGLIAAAGGVFRIVE

SEQ ID NO: 102438 - protein, 17 aa, Mycobacterium avium
QFGRLDIVLANAGIAPL

SEQ ID NO: 102439 - protein, 21 aa, Mycobacterium avium
QFHCWRDILDAVLAVTKAGVT

SEQ ID NO: 102440 - protein, 20 aa, Mycobacterium avium
QFRELEAFAAFASDLDATSK

SEQ ID NO: 102441 - protein, 20 aa, Mycobacterium avium
QFTAMAWSLMKLATLHLTIK

SEQ ID NO: 102442 - protein, 28 aa, Mycobacterium avium
QFTHAVALAEAWRCFGVLPEITIGHSLG

SEQ ID NO: 102443 - protein, 28 aa, Mycobacterium avium
QFTHAVALAEAWRCFGVLPEMAIGHSLG

SEQ ID NO: 102444 - protein, 31 aa, Mycobacterium avium
QFTHAVSLAEAWRCCGVLPDITIGHSLGEVA

SEQ ID NO: 102445 - protein, 18 aa, Mycobacterium avium
QFTVAWPTGEIDGMGLEG

SEQ ID NO: 102446 - protein, 18 aa, Mycobacterium avium
QFTVAWPTGEIGGMGLEG

SEQ ID NO: 102447 - protein, 18 aa, Mycobacterium avium
QFTVAWPTGEIGGMGLES

SEQ ID NO: 102448 - protein, 17 aa, Mycobacterium avium
QGARVYEPRAGVHRVAI

SEQ ID NO: 102449 - protein, 21 aa, Mycobacterium avium
QGFAGTLPKSGVRASGLNTLA

SEQ ID NO: 102450 - protein, 18 aa, Mycobacterium avium
QGFLGMAVPEDYGGGGNP

SEQ ID NO: 102451 - protein, 18 aa, Mycobacterium avium
QGFLLSRPLDSAAMESLL

SEQ ID NO: 102452 - protein, 19 aa, Mycobacterium avium
QGHVLERLFPGIGKLDESF

SEQ ID NO: 102453 - protein, 24 aa, Mycobacterium avium
QGIYWSFSIGNPWWETIHYGRHQS

SEQ ID NO: 102454 - protein, 18 aa, Mycobacterium avium
QGKALALYHTKRLASPAQ

SEQ ID NO: 102455 - protein, 24 aa, Mycobacterium avium
QGLVRGAVFGTHWHGLLDNDDFRR

SEQ ID NO: 102456 - protein, 19 aa, Mycobacterium avium
QGPAGWLRAKTGSLTAINA

SEQ ID NO: 102457 - protein, 23 aa, Mycobacterium avium
QGPRSADVLAELGLPSDMDYMAY

SEQ ID NO: 102458 - protein, 23 aa, Mycobacterium avium
QGPRSADVLAELGLPTDMDYMAY

SEQ ID NO: 102459 - protein, 22 aa, Mycobacterium avium
QGPRSANVLAELGLPSDMDYMA

SEQ ID NO: 102460 - protein, 25 aa, Mycobacterium avium
QGPWLRTGDSGFFFDGELFIIGRMK

SEQ ID NO: 102461 - protein, 17 aa, Mycobacterium avium
QGQPNWSPSEYLQNLGN

SEQ ID NO: 102462 - protein, 24 aa, Mycobacterium avium
QGRSSVGTWLFGIVKHTAARHRRR

SEQ ID NO: 102463 - protein, 25 aa, Mycobacterium avium
QGSARFWLFGVIPAWTHHLTIERLD

SEQ ID NO: 102464 - protein, 19 aa, Mycobacterium avium
QGSAWELPHTDYVTFATGD

SEQ ID NO: 102465 - protein, 23 aa, Mycobacterium avium
QGSKRPTFASVHGRDATVVRAAD

SEQ ID NO: 102466 - protein, 18 aa, Mycobacterium avium
QGSLPVLQLGGDRAVGVV

SEQ ID NO: 102467 - protein, 18 aa, Mycobacterium avium
QGTRLGRAYLDFGEPLPL

SEQ ID NO: 102468 - protein, 19 aa, Mycobacterium avium
QGVLEAWRGQPQCLQRPDL

SEQ ID NO: 102469 - protein, 28 aa, Mycobacterium avium
QGVLRSKGFCWIASRPDIAAIWSQAGPN

SEQ ID NO: 102470 - protein, 22 aa, Mycobacterium avium
QGVPISGILFGARRKTTVPLVT

SEQ ID NO: 102471 - protein, 17 aa, Mycobacterium avium
QGWILNALWLLDTGITA

SEQ ID NO: 102472 - protein, 21 aa, Mycobacterium avium
QGYRRYPNWRAMDMSAFTQDK

SEQ ID NO: 102473 - protein, 26 aa, Mycobacterium avium
QHAMPGHLMIAMSAVRAIPYVLARPP

SEQ ID NO: 102474 - protein, 17 aa, Mycobacterium avium
QHGEVFLTEAAVGGVPA

SEQ ID NO: 102475 - protein, 23 aa, Mycobacterium avium
QHGWEGALIGTGWGRPDTFTVAT

SEQ ID NO: 102476 - protein, 29 aa, Mycobacterium avium
QHIATVSGPGFLGWEHPPAAAASVTAPAK

SEQ ID NO: 102477 - protein, 25 aa, Mycobacterium avium
QHLCQGDRAILMWAAANRDPAMFEN

SEQ ID NO: 102478 - protein, 21 aa, Mycobacterium avium
QHLRSPDFFDVERFEKISVVV

SEQ ID NO: 102479 - protein, 27 aa, Mycobacterium avium
QHMLSLNIPVPPGFVLTTDVCREYHDR

SEQ ID NO: 102480 - protein, 18 aa, Mycobacterium avium
QHQADAWAIWDPYTAQAE

SEQ ID NO: 102481 - protein, 23 aa, Mycobacterium avium
QHQRGRYAAALAGELAEECGGLC

SEQ ID NO: 102482 - protein, 25 aa, Mycobacterium avium
QHRDAKQNLLRWARAQHVAGKQFTA

SEQ ID NO: 102483 - protein, 26 aa, Mycobacterium avium
QHRPHRLPALVVTAGALLGVPVAHAD

SEQ ID NO: 102484 - protein, 19 aa, Mycobacterium avium
QHWRVASRLGVPGDDLLGV

SEQ ID NO: 102485 - protein, 29 aa, Mycobacterium avium
QHYRLVGWRNGVCGYRRFFSITSLAGLRQ

SEQ ID NO: 102486 - protein, 20 aa, Mycobacterium avium
QIAGTFGRRPLVSVRPSEVQ

SEQ ID NO: 102487 - protein, 23 aa, Mycobacterium avium
QIDLSPTFVRRAFELGATTNMLE

SEQ ID NO: 102488 - protein, 17 aa, Mycobacterium avium
QIEWLFGTLLGPRPNWS

SEQ ID NO: 102489 - protein, 17 aa, Mycobacterium avium
QIFAGEPDFFWSPVNSL

SEQ ID NO: 102490 - protein, 27 aa, Mycobacterium avium
QIIASLLPPAVKWKAFFNAQAKNPKYL

SEQ ID NO: 102491 - protein, 19 aa, Mycobacterium avium
QIIYKQCRDHASTIRAVLV

SEQ ID NO: 102492 - protein, 20 aa, Mycobacterium avium
QILPRPKDFAALMPLVPPDT

SEQ ID NO: 102493 - protein, 21 aa, Mycobacterium avium
QILPRPKDFAALMPLVPPDTV

SEQ ID NO: 102494 - protein, 23 aa, Mycobacterium avium
QINGRICINFTYSSILPAMKTLG

SEQ ID NO: 102495 - protein, 23 aa, Mycobacterium avium
QIRRLCAGERAAVYDLAEAPAVR

SEQ ID NO: 102496 - protein, 23 aa, Mycobacterium avium
QIRTGAPLLLLHRLTHLRDGTPF

SEQ ID NO: 102497 - protein, 21 aa, Mycobacterium avium
QIRYDVRRLADLAGAYTKAAP

SEQ ID NO: 102498 - protein, 29 aa, Mycobacterium avium
QIVKLCRLSSRVGGGIVRLLATGPGQSFF

SEQ ID NO: 102499 - protein, 18 aa, Mycobacterium avium
QKLADLFAAAGQLQSAPR

SEQ ID NO: 102500 - protein, 31 aa, Mycobacterium avium
QKPQGFKALDITLPMPARWTQVPDPNVPDAF

SEQ ID NO: 102501 - protein, 22 aa, Mycobacterium avium
QKRAQLRAGLESGRLQRFPGAF

SEQ ID NO: 102502 - protein, 29 aa, Mycobacterium avium
QKSPLRCGWLANSWRLPSCGRRGASGRTH

SEQ ID NO: 102503 - protein, 18 aa, Mycobacterium avium
QKWAEFHPDALRAQVAAA

SEQ ID NO: 102504 - protein, 20 aa, Mycobacterium avium
QLAAGVFFREPRQVVELDRD

SEQ ID NO: 102505 - protein, 17 aa, Mycobacterium avium
QLADAALLFGNVLARLT

SEQ ID NO: 102506 - protein, 23 aa, Mycobacterium avium
QLAEALARAGERGAPVVQQGVMP

SEQ ID NO: 102507 - protein, 17 aa, Mycobacterium avium
QLAEMWLNSDALHTQLI

SEQ ID NO: 102508 - protein, 23 aa, Mycobacterium avium
QLARARALLLGRDYVIPEDVKAL

SEQ ID NO: 102509 - protein, 20 aa, Mycobacterium avium
QLAVLWALWAHRPDGASFHG

SEQ ID NO: 102510 - protein, 18 aa, Mycobacterium avium
QLEVFRCGDEVFADLVFD

SEQ ID NO: 102511 - protein, 19 aa, Mycobacterium avium
QLFPTAEGYLALFITHDGF

SEQ ID NO: 102512 - protein, 29 aa, Mycobacterium avium
QLFTGDCLFPGGVGKTWLPGDFDQLIDDV

SEQ ID NO: 102513 - protein, 34 aa, Mycobacterium avium
QLGELDIELALCQLVGPLVFARMTGLRVITHQDC

SEQ ID NO: 102514 - protein, 18 aa, Mycobacterium avium
QLGKRSRMDAELIAEHAD

SEQ ID NO: 102515 - protein, 23 aa, Mycobacterium avium
QLGRRAVVAAAKRGAHRIVTGHP

SEQ ID NO: 102516 - protein, 24 aa, Mycobacterium avium
QLGTEVIIVPGLWRDFDHTALAYQ

SEQ ID NO: 102517 - protein, 19 aa, Mycobacterium avium
QLKTLPLVERTYHIDRTIA

SEQ ID NO: 102518 - protein, 17 aa, Mycobacterium avium
QLLDIGAQNIIVPMIDG

SEQ ID NO: 102519 - protein, 18 aa, Mycobacterium avium
QLLRAHPLNREWVDCPDF

SEQ ID NO: 102520 - protein, 22 aa, Mycobacterium avium
QLMCVCRPCYLLFTNSDAHLRY

SEQ ID NO: 102521 - protein, 22 aa, Mycobacterium avium
QLMSVLARRHMHLYGTRREAFA

SEQ ID NO: 102522 - protein, 23 aa, Mycobacterium avium
QLMSVLARRHMHLYGTRREAFAE

SEQ ID NO: 102523 - protein, 17 aa, Mycobacterium avium
QLPAGVVQINRRNYLMV

SEQ ID NO: 102524 - protein, 25 aa, Mycobacterium avium
QLRDGSLRLPYWMIYDDKEGAVPPV

SEQ ID NO: 102525 - protein, 19 aa, Mycobacterium avium
QLRGVTVSMALDFMAPARP

SEQ ID NO: 102526 - protein, 25 aa, Mycobacterium avium
QLRKFLADKVVRWSLPERWTFVDEI

SEQ ID NO: 102527 - protein, 18 aa, Mycobacterium avium
QLRLIFTAFTEYLRSPAA

SEQ ID NO: 102528 - protein, 21 aa, Mycobacterium avium
QLRSRAIELAREIAARRPLGV

SEQ ID NO: 102529 - protein, 17 aa, Mycobacterium avium
QLSEFGFSAAAEHPRLG

SEQ ID NO: 102530 - protein, 24 aa, Mycobacterium avium
QLSEGRLHGFGFLYEAVLQLRHQA

SEQ ID NO: 102531 - protein, 19 aa, Mycobacterium avium
QLSFGLIAPFIPAAGAPGV

SEQ ID NO: 102532 - protein, 24 aa, Mycobacterium avium
QLTPAGLIVADWAARLLEVAHEID

SEQ ID NO: 102533 - protein, 19 aa, Mycobacterium avium
QLVGLGIMRYGIRSEPLHS

SEQ ID NO: 102534 - protein, 19 aa, Mycobacterium avium
QLVLALGLFLLRDLPAVQL

SEQ ID NO: 102535 - protein, 18 aa, Mycobacterium avium
QLVTRLQSLLSTPPQPSG

SEQ ID NO: 102536 - protein, 30 aa, Mycobacterium avium
QLWVGACLYKGGLDIYRMFIGELDGEDAER

SEQ ID NO: 102537 - protein, 26 aa, Mycobacterium avium
QLYDGFSFLTVMWLEAMGFCEHGKVG

SEQ ID NO: 102538 - protein, 19 aa, Mycobacterium avium
QMCEYFVHRSLYHLKEGDP

SEQ ID NO: 102539 - protein, 23 aa, Mycobacterium avium
QMPDDRTYFWIARTTSGGPSRYL

SEQ ID NO: 102540 - protein, 22 aa, Mycobacterium avium
QMRRFGGLVAVELADAAAVRAL

SEQ ID NO: 102541 - protein, 18 aa, Mycobacterium avium
QMTMRVFTGLTLLDTIQG

SEQ ID NO: 102542 - protein, 27 aa, Mycobacterium avium
QMWTAYRESPAWGFCMWAITPDQMYSV

SEQ ID NO: 102543 - protein, 17 aa, Mycobacterium avium
QNARAVATLLARHPAVR

SEQ ID NO: 102544 - protein, 18 aa, Mycobacterium avium
QNARAVATLLARHPAVRA

SEQ ID NO: 102545 - protein, 17 aa, Mycobacterium avium
QNARLAARLTGWRIDIR

SEQ ID NO: 102546 - protein, 18 aa, Mycobacterium avium
QNARLAARLTGWRIDIRG

SEQ ID NO: 102547 - protein, 17 aa, Mycobacterium avium
QNFDVVARAFIKIVNSM

SEQ ID NO: 102548 - protein, 25 aa, Mycobacterium avium
QNLTYYCRWHHRGPGGVHCASSADF

SEQ ID NO: 102549 - protein, 22 aa, Mycobacterium avium
QNNLRWRNLRKITIAQVHGDVF

SEQ ID NO: 102550 - protein, 23 aa, Mycobacterium avium
QNSAEWLRFCEIVLERRDLVDEP

SEQ ID NO: 102551 - protein, 17 aa, Mycobacterium avium
QPAELAPIYVLLASDEA

SEQ ID NO: 102552 - protein, 18 aa, Mycobacterium avium
QPALSPARQWAGRQGSAG

SEQ ID NO: 102553 - protein, 20 aa, Mycobacterium avium
QPARDAMAQFGINADEVSQK

SEQ ID NO: 102554 - protein, 21 aa, Mycobacterium avium
QPARLPFWRGDGVGRPAELGA

SEQ ID NO: 102555 - protein, 25 aa, Mycobacterium avium
QPDEIGALIAFLLSDICAFVTGQTI

SEQ ID NO: 102556 - protein, 20 aa, Mycobacterium avium
QPDLFLLRQIHAAPRLTVNA

SEQ ID NO: 102557 - protein, 23 aa, Mycobacterium avium
QPEARPEPRPEPTPEPKPARASE

SEQ ID NO: 102558 - protein, 20 aa, Mycobacterium avium
QPEAVQHWNVDKAGLDDLLD

SEQ ID NO: 102559 - protein, 22 aa, Mycobacterium avium
QPEMPHRAVVGVRRRRRGTGQV

SEQ ID NO: 102560 - protein, 17 aa, Mycobacterium avium
QPGDGRCGLHTDLDEPL

SEQ ID NO: 102561 - protein, 17 aa, Mycobacterium avium
QPGEVILSGSFTKPVFA

SEQ ID NO: 102562 - protein, 19 aa, Mycobacterium avium
QPGKYYAIFGDSFSGNKAY

SEQ ID NO: 102563 - protein, 26 aa, Mycobacterium avium
QPHAKGTGAFGRFEVTNDLSAYTKAA

SEQ ID NO: 102564 - protein, 18 aa, Mycobacterium avium
QPKHKGITYFLLDMHQPG

SEQ ID NO: 102565 - protein, 24 aa, Mycobacterium avium
QPLATIAYDFARLMADIWDKNHSP

SEQ ID NO: 102566 - protein, 30 aa, Mycobacterium avium
QPLPADTVGEVWLRGATVVRGYLGDPAITA

SEQ ID NO: 102567 - protein, 18 aa, Mycobacterium avium
QPLRVVVGMREILSEAKV

SEQ ID NO: 102568 - protein, 23 aa, Mycobacterium avium
QPMADVWWRFREAITSAPQLNIG

SEQ ID NO: 102569 - protein, 19 aa, Mycobacterium avium
QPPQRFCAHRSDAIVHCGG

SEQ ID NO: 102570 - protein, 26 aa, Mycobacterium avium
QPQTPCAVVAFASWPQETVLRGTLDD

SEQ ID NO: 102571 - protein, 18 aa, Mycobacterium avium
QPQWARLGTDGKPLPGSE

SEQ ID NO: 102572 - protein, 27 aa, Mycobacterium avium
QPRPPWLMSACAPAPVGDTPAVGEADR

SEQ ID NO: 102573 - protein, 22 aa, Mycobacterium avium
QPSLPAGWTPHWLRHTHATALL

SEQ ID NO: 102574 - protein, 24 aa, Mycobacterium avium
QPTAWIAEGLFGYLPPEAQDRLLD

SEQ ID NO: 102575 - protein, 28 aa, Mycobacterium avium
QPTEFNDIVAVLALYRPGPMGMNAHNDY

SEQ ID NO: 102576 - protein, 26 aa, Mycobacterium avium
QPTRYWAPVCRLFGLDAAAADERFAS

SEQ ID NO: 102577 - protein, 26 aa, Mycobacterium avium
QPTRYWPEFCRLMGLHDLAEDPRFTT

SEQ ID NO: 102578 - protein, 27 aa, Mycobacterium avium
QPVFYLPDKAGSIWGEALAAGAAKRDP

SEQ ID NO: 102579 - protein, 20 aa, Mycobacterium avium
QPVLQRLATLAGRFSSPKSA

SEQ ID NO: 102580 - protein, 20 aa, Mycobacterium avium
QPVQNVWRTTALVAPPLDEV

SEQ ID NO: 102581 - protein, 24 aa, Mycobacterium avium
QPWVPRSRSHVVTFPRDLTDRAEM

SEQ ID NO: 102582 - protein, 20 aa, Mycobacterium avium
QQAIRRRAFTKALRITGSPD

SEQ ID NO: 102583 - protein, 21 aa, Mycobacterium avium
QQARDRFNAAWNHQNGDHPIN

SEQ ID NO: 102584 - protein, 17 aa, Mycobacterium avium
QQAVLCASTGNTSASAA

SEQ ID NO: 102585 - protein, 21 aa, Mycobacterium avium
QQFAPLIDLKWWQKRPGERTE

SEQ ID NO: 102586 - protein, 23 aa, Mycobacterium avium
QQFAPLIDLRWWQERPAERSELY

SEQ ID NO: 102587 - protein, 17 aa, Mycobacterium avium
QQFSRVRVFAFIDTTDE

SEQ ID NO: 102588 - protein, 23 aa, Mycobacterium avium
QQKKRFLAPLLRADEFWCQGFSE

SEQ ID NO: 102589 - protein, 18 aa, Mycobacterium avium
QQPWKFVVLRSSALRDVV

SEQ ID NO: 102590 - protein, 18 aa, Mycobacterium avium
QQRLQDICDYHSSVEEAA

SEQ ID NO: 102591 - protein, 24 aa, Mycobacterium avium
QQRLWPTEEFELARSRVPVRLPED

SEQ ID NO: 102592 - protein, 17 aa, Mycobacterium avium
QQRVDGITLREEHLAGK

SEQ ID NO: 102593 - protein, 21 aa, Mycobacterium avium
QQVDPVRDFALLRSTTVASGS

SEQ ID NO: 102594 - protein, 22 aa, Mycobacterium avium
QQVSLPAGQSWSITAAGPTAVE

SEQ ID NO: 102595 - protein, 24 aa, Mycobacterium avium
QRAAAGGLLLPVGVRRLRNYHSTR

SEQ ID NO: 102596 - protein, 23 aa, Mycobacterium avium
QRAAANGGLDRRRSAGRRRHGGA

SEQ ID NO: 102597 - protein, 23 aa, Mycobacterium avium
QRAAGEMRSRLRALAAAAGTDAA

SEQ ID NO: 102598 - protein, 17 aa, Mycobacterium avium
QRAALPPMHAGRADVIA

SEQ ID NO: 102599 - protein, 29 aa, Mycobacterium avium
QRAASSVKERHGWSYEKWAKQVTRVLVSI

SEQ ID NO: 102600 - protein, 29 aa, Mycobacterium avium
QRAATEFTLQAWAGSPGFRGDPAGPPIAI

SEQ ID NO: 102601 - protein, 22 aa, Mycobacterium avium
QRADIPFGGTVAVIGLGAVGLC

SEQ ID NO: 102602 - protein, 20 aa, Mycobacterium avium
QRAGLSTVFIPARNEPDLDD

SEQ ID NO: 102603 - protein, 22 aa, Mycobacterium avium
QRAKIATGFAKPDGVFVLTDAN

SEQ ID NO: 102604 - protein, 24 aa, Mycobacterium avium
QRAVIPRDHIKSVLESADVVIWTT

SEQ ID NO: 102605 - protein, 21 aa, Mycobacterium avium
QRAWLNLVRPLTIVEGFALLS

SEQ ID NO: 102606 - protein, 22 aa, Mycobacterium avium
QRAWLNLVRPLTIVEGFALLSV

SEQ ID NO: 102607 - protein, 29 aa, Mycobacterium avium
QRCLDLTVQWCRDRETFGRPLISRQSVQN

SEQ ID NO: 102608 - protein, 18 aa, Mycobacterium avium
QRCRVHFLRNVLAQVPKV

SEQ ID NO: 102609 - protein, 20 aa, Mycobacterium avium
QRCSGCGKLRHPPRPMCPHC

SEQ ID NO: 102610 - protein, 21 aa, Mycobacterium avium
QRCSGCGKLRHPPRPMCPHCR

SEQ ID NO: 102611 - protein, 21 aa, Mycobacterium avium
QRCSGCGQLRHPPRPMCPHCR

SEQ ID NO: 102612 - protein, 20 aa, Mycobacterium avium
QRDRFLFKINVGYPSPEEER

SEQ ID NO: 102613 - protein, 24 aa, Mycobacterium avium
QRDRWLRLGLVEEIDDTPPAAAAA

SEQ ID NO: 102614 - protein, 17 aa, Mycobacterium avium
QREAFAWHIDLAKRCGK

SEQ ID NO: 102615 - protein, 18 aa, Mycobacterium avium
QRECPPGVVGEIWVHGEN

SEQ ID NO: 102616 - protein, 17 aa, Mycobacterium avium
QRELLRFHGNPTAALFP

SEQ ID NO: 102617 - protein, 18 aa, Mycobacterium avium
QREMLARIEVPYRVIDVA

SEQ ID NO: 102618 - protein, 39 aa, Mycobacterium avium
QREYGEPARYIWKLEFQRRGAPHIHLWMAPPISPGRSGR

SEQ ID NO: 102619 - protein, 33 aa, Mycobacterium avium
QRFAGMLVAGVFLREFIADGVGWAHIDVAGPAY

SEQ ID NO: 102620 - protein, 17 aa, Mycobacterium avium
QRFAGRTRDEWARVFAG

SEQ ID NO: 102621 - protein, 23 aa, Mycobacterium avium
QRFATAMAPFGFRAAAATPAYGM

SEQ ID NO: 102622 - protein, 19 aa, Mycobacterium avium
QRFDEVIGRLAEGLAATVQ

SEQ ID NO: 102623 - protein, 19 aa, Mycobacterium avium
QRFDEVIGRLAEGLATTVQ

SEQ ID NO: 102624 - protein, 26 aa, Mycobacterium avium
QRFLPPTFRGEMIWCQLFSEPGAGSD

SEQ ID NO: 102625 - protein, 23 aa, Mycobacterium avium
QRFSWVGHWSGRPLLAIHEEWVL

SEQ ID NO: 102626 - protein, 26 aa, Mycobacterium avium
QRGAEYRLAGQIAHRGAFGGAQLLDR

SEQ ID NO: 102627 - protein, 19 aa, Mycobacterium avium
QRGAGLGFDGRVVHVDDEE

SEQ ID NO: 102628 - protein, 17 aa, Mycobacterium avium
QRGFRFRGGQRVVDPAP

SEQ ID NO: 102629 - protein, 19 aa, Mycobacterium avium
QRGGPMMLLASPTLPGRGL

SEQ ID NO: 102630 - protein, 18 aa, Mycobacterium avium
QRGLQVVGGRGSGAVMVL

SEQ ID NO: 102631 - protein, 17 aa, Mycobacterium avium
QRGPWGPGRRAEAADAF

SEQ ID NO: 102632 - protein, 18 aa, Mycobacterium avium
QRGPWGPGRRAEAADAFE

SEQ ID NO: 102633 - protein, 18 aa, Mycobacterium avium
QRGRPRHRRCGGRGTCWG

SEQ ID NO: 102634 - protein, 26 aa, Mycobacterium avium
QRHELPRGDLDRVVRQQVVMASLAHR

SEQ ID NO: 102635 - protein, 26 aa, Mycobacterium avium
QRHQSVLQLLALRKARHVPPADPARG

SEQ ID NO: 102636 - protein, 24 aa, Mycobacterium avium
QRHQSVLQLLALRNARHVPPADPA

SEQ ID NO: 102637 - protein, 17 aa, Mycobacterium avium
QRIIEINLFSALAATQA

SEQ ID NO: 102638 - protein, 19 aa, Mycobacterium avium
QRILGDWAQQQRHLVKVMP

SEQ ID NO: 102639 - protein, 21 aa, Mycobacterium avium
QRIMLEICWEALERAGIDPSA

SEQ ID NO: 102640 - protein, 21 aa, Mycobacterium avium
QRLAPGTALARVFWPNGRIVV

SEQ ID NO: 102641 - protein, 24 aa, Mycobacterium avium
QRLARAGWRVVVLEAGPFWHPDED

SEQ ID NO: 102642 - protein, 24 aa, Mycobacterium avium
QRLERLLRRWLDALEEAGMVVMHR

SEQ ID NO: 102643 - protein, 19 aa, Mycobacterium avium
QRLGGLVAVLHENRAESAG

SEQ ID NO: 102644 - protein, 19 aa, Mycobacterium avium
QRLGGPPATPPRTLDEQAE

SEQ ID NO: 102645 - protein, 18 aa, Mycobacterium avium
QRLPELPDPPALPTTAGR

SEQ ID NO: 102646 - protein, 17 aa, Mycobacterium avium
QRLQRLVDAVARQEPRL

SEQ ID NO: 102647 - protein, 32 aa, Mycobacterium avium
QRLVDAVARQEPRLSWAAGLRDDGTTTLVTDL

SEQ ID NO: 102648 - protein, 27 aa, Mycobacterium avium
QRLWARSGYLQPHWPAPYGRAADSVEQ

SEQ ID NO: 102649 - protein, 22 aa, Mycobacterium avium
QRLYELASRIPIGTADRYTVLC

SEQ ID NO: 102650 - protein, 19 aa, Mycobacterium avium
QRMPTWRAFWADGDPALPE

SEQ ID NO: 102651 - protein, 22 aa, Mycobacterium avium
QRPIVGPSWRMTRRPARITRGA

SEQ ID NO: 102652 - protein, 24 aa, Mycobacterium avium
QRPPALDTEKGWFFGSNLQQAPGS

SEQ ID NO: 102653 - protein, 20 aa, Mycobacterium avium
QRPPAPPGYSGQGYDQGYRP

SEQ ID NO: 102654 - protein, 24 aa, Mycobacterium avium
QRPPRPGVHNSGWVQSPGAERLGD

SEQ ID NO: 102655 - protein, 20 aa, Mycobacterium avium
QRPPRSFAWEAGPGCLPRTH

SEQ ID NO: 102656 - protein, 22 aa, Mycobacterium avium
QRPSWPGGIAVGKTAVSSSMID

SEQ ID NO: 102657 - protein, 22 aa, Mycobacterium avium
QRRPGSRGQQQFPDGCVEGRGG

SEQ ID NO: 102658 - protein, 34 aa, Mycobacterium avium
QRRPILHLPTHWPWADHWITLWCNTIGHSPPTTA

SEQ ID NO: 102659 - protein, 17 aa, Mycobacterium avium
QRRRVVVSRGWAGLGPI

SEQ ID NO: 102660 - protein, 24 aa, Mycobacterium avium
QRSRARAAGLGLTIDYREANAQAL

SEQ ID NO: 102661 - protein, 19 aa, Mycobacterium avium
QRSRDEWSAVFANTDACVT

SEQ ID NO: 102662 - protein, 19 aa, Mycobacterium avium
QRVAFVLHDGFAVPFSEVA

SEQ ID NO: 102663 - protein, 17 aa, Mycobacterium avium
QRVARFATEHAWTEDPP

SEQ ID NO: 102664 - protein, 18 aa, Mycobacterium avium
QRVCLARTLMARPRVLLL

SEQ ID NO: 102665 - protein, 17 aa, Mycobacterium avium
QRVHWRLSAHALICESS

SEQ ID NO: 102666 - protein, 24 aa, Mycobacterium avium
QRVRDGLLEIGRKLNIPPLATNDC

SEQ ID NO: 102667 - protein, 18 aa, Mycobacterium avium
QRVSVRFDNIDDVWIPLF

SEQ ID NO: 102668 - protein, 18 aa, Mycobacterium avium
QRWLPGFAAGELIGALAM

SEQ ID NO: 102669 - protein, 17 aa, Mycobacterium avium
QRWPARHPAGRGRGRHQ

SEQ ID NO: 102670 - protein, 18 aa, Mycobacterium avium
QRYAPLLAALDCPVHLVT

SEQ ID NO: 102671 - protein, 17 aa, Mycobacterium avium
QRYRVADVLPLTPLQQG

SEQ ID NO: 102672 - protein, 23 aa, Mycobacterium avium
QRYRVADVLPLTPLQQGLLFHAG

SEQ ID NO: 102673 - protein, 19 aa, Mycobacterium avium
QSAEFSGRVELDIRDSEPD

SEQ ID NO: 102674 - protein, 23 aa, Mycobacterium avium
QSAPLRASARWVNGTTLTAVAAR

SEQ ID NO: 102675 - protein, 34 aa, Mycobacterium avium
QSCGGPCWRHRGSVWGYTCAACIDRHLDAAAARG

SEQ ID NO: 102676 - protein, 22 aa, Mycobacterium avium
QSDEIACLVLYGIHRAGLRCPG

SEQ ID NO: 102677 - protein, 31 aa, Mycobacterium avium
QSGEWKDGEALFLRCNIWREAAENVAESLTR

SEQ ID NO: 102678 - protein, 25 aa, Mycobacterium avium
QSGRFAFRAGPIFTNLLLADEINRT

SEQ ID NO: 102679 - protein, 23 aa, Mycobacterium avium
QSGYVDGAWWPRSDDLSAELPDL

SEQ ID NO: 102680 - protein, 31 aa, Mycobacterium avium
QSLPADTVGEVWLRGATVVRGYLGDPAITAA

SEQ ID NO: 102681 - protein, 26 aa, Mycobacterium avium
QSNSWERTRWTLAHEVGHLSLHASGG

SEQ ID NO: 102682 - protein, 17 aa, Mycobacterium avium
QSPFVWSVIGALSEATS

SEQ ID NO: 102683 - protein, 19 aa, Mycobacterium avium
QSRVTFDAAPARRLATASA

SEQ ID NO: 102684 - protein, 18 aa, Mycobacterium avium
QSSLWSVGQDNIFNEKQI

SEQ ID NO: 102685 - protein, 17 aa, Mycobacterium avium
QSTLAISVEVRAKNIAA

SEQ ID NO: 102686 - protein, 23 aa, Mycobacterium avium
QSVSYIGALGFDTPVSSNGALNQ

SEQ ID NO: 102687 - protein, 17 aa, Mycobacterium avium
QTDWVTICAAYDRLWQL

SEQ ID NO: 102688 - protein, 31 aa, Mycobacterium avium
QTEDFAAGGFRRGEGFLCMMPSGPHGVGYFS

SEQ ID NO: 102689 - protein, 24 aa, Mycobacterium avium
QTGIRLKPGEFFVFSLRQPSNGRP

SEQ ID NO: 102690 - protein, 17 aa, Mycobacterium avium
QTGMTGMPMMPPGAMGA

SEQ ID NO: 102691 - protein, 19 aa, Mycobacterium avium
QTISAWLAGDVRLEPDELV

SEQ ID NO: 102692 - protein, 17 aa, Mycobacterium avium
QTLQYAKDRKAFGQPIG

SEQ ID NO: 102693 - protein, 23 aa, Mycobacterium avium
QTLRAGRWSGYIKPDIDLPTLAD

SEQ ID NO: 102694 - protein, 24 aa, Mycobacterium avium
QTNVEFLRFLLADQRVRAGDLDTA

SEQ ID NO: 102695 - protein, 17 aa, Mycobacterium avium
QTPKAATFCLSQRAEHI

SEQ ID NO: 102696 - protein, 19 aa, Mycobacterium avium
QTPNVCPALHMPLQSGSDR

SEQ ID NO: 102697 - protein, 23 aa, Mycobacterium avium
QTVFDFTTQWALDRHTFGRPLAS

SEQ ID NO: 102698 - protein, 18 aa, Mycobacterium avium
QTVMLGLGPGWRATADEP

SEQ ID NO: 102699 - protein, 19 aa, Mycobacterium avium
QTWSPRAAVVPEPHSEVLA

SEQ ID NO: 102700 - protein, 17 aa, Mycobacterium avium
QVARLGLMNAVNRFDPA

SEQ ID NO: 102701 - protein, 19 aa, Mycobacterium avium
QVASVALELIELVRRQHEQ

SEQ ID NO: 102702 - protein, 18 aa, Mycobacterium avium
QVATAWGVDLDQLDYTVT

SEQ ID NO: 102703 - protein, 19 aa, Mycobacterium avium
QVCRWLLTSRLELIEDRNR

SEQ ID NO: 102704 - protein, 20 aa, Mycobacterium avium
QVCRWLLTSRLELIEDRNRY

SEQ ID NO: 102705 - protein, 19 aa, Mycobacterium avium
QVFGLPGIDWPAVRSEAER

SEQ ID NO: 102706 - protein, 24 aa, Mycobacterium avium
QVFLVDCGRGVLQRAAAGGVGAAG

SEQ ID NO: 102707 - protein, 17 aa, Mycobacterium avium
QVGACERVLEIACEYAR

SEQ ID NO: 102708 - protein, 18 aa, Mycobacterium avium
QVGLWTFRVDGWGDPIHS

SEQ ID NO: 102709 - protein, 18 aa, Mycobacterium avium
QVGMPRAVLITKLDHARA

SEQ ID NO: 102710 - protein, 20 aa, Mycobacterium avium
QVHTLLDFHFHPHISAPSGK

SEQ ID NO: 102711 - protein, 20 aa, Mycobacterium avium
QVISRLIDWVSFTPLHNVTG

SEQ ID NO: 102712 - protein, 25 aa, Mycobacterium avium
QVLNSVECLLPFFDRKTATAVAEEL

SEQ ID NO: 102713 - protein, 18 aa, Mycobacterium avium
QVNGRYVFHKDLRRAVIF

SEQ ID NO: 102714 - protein, 25 aa, Mycobacterium avium
QVNRPLRGSYRVTFLSLKGGVGKTT

SEQ ID NO: 102715 - protein, 23 aa, Mycobacterium avium
QVPARYPLRSVFHAAGVLDDAVI

SEQ ID NO: 102716 - protein, 20 aa, Mycobacterium avium
QVRSICARFDLPYTTGPLAR

SEQ ID NO: 102717 - protein, 25 aa, Mycobacterium avium
QVSKRLPMWTIYEMLGLPDDQRDEA

SEQ ID NO: 102718 - protein, 26 aa, Mycobacterium avium
QVSVALVARSAWHECHHHLRDIRGCS

SEQ ID NO: 102719 - protein, 24 aa, Mycobacterium avium
QVVARARAAGVICRPRDVFTEQTV

SEQ ID NO: 102720 - protein, 19 aa, Mycobacterium avium
QVVRERLEVALGVVPVEGA

SEQ ID NO: 102721 - protein, 25 aa, Mycobacterium avium
QVVSKFAATFSICFQTLENRIERLE

SEQ ID NO: 102722 - protein, 23 aa, Mycobacterium avium
QVVVCGKPSFYTGRGTFSLRLSE

SEQ ID NO: 102723 - protein, 23 aa, Mycobacterium avium
QVYRQRLALRQCVHHQRQRWGEP

SEQ ID NO: 102724 - protein, 24 aa, Mycobacterium avium
QWDIREVIPVAATVVTVFVENVLD

SEQ ID NO: 102725 - protein, 26 aa, Mycobacterium avium
QWEALQIPVGLAFFFRNSALDRTVAF

SEQ ID NO: 102726 - protein, 19 aa, Mycobacterium avium
QWEEALEVAIRCMIEEPFS

SEQ ID NO: 102727 - protein, 18 aa, Mycobacterium avium
QWKRELVARTSLTEDEIG

SEQ ID NO: 102728 - protein, 28 aa, Mycobacterium avium
QWLRGGAEAGAFNYAWLNLRKDRQVDLL

SEQ ID NO: 102729 - protein, 24 aa, Mycobacterium avium
QWYTARLRPGPLRPADRRTTVVDH

SEQ ID NO: 102730 - protein, 27 aa, Mycobacterium avium
QYPNVNPALLLKCLLMAATEGIASGDP

SEQ ID NO: 102731 - protein, 17 aa, Mycobacterium avium
QYWTAALASIPDLRFSV

SEQ ID NO: 102732 - protein, 19 aa, Mycobacterium avium
RAAAAPIRQAWQLSTNPDL

SEQ ID NO: 102733 - protein, 24 aa, Mycobacterium avium
RAAALWLLCTIEFAARRWLSGPRN

SEQ ID NO: 102734 - protein, 23 aa, Mycobacterium avium
RAAARAGIPFSLSTLGTCAIEDL

SEQ ID NO: 102735 - protein, 24 aa, Mycobacterium avium
RAAARRCPPDSGVTFLPSDPAAYD

SEQ ID NO: 102736 - protein, 20 aa, Mycobacterium avium
RAADAAAKFPANEANGSQEM

SEQ ID NO: 102737 - protein, 18 aa, Mycobacterium avium
RAADVVVLIDGYRQPAGP

SEQ ID NO: 102738 - protein, 19 aa, Mycobacterium avium
RAADVVVLIDGYRQPAGPA

SEQ ID NO: 102739 - protein, 19 aa, Mycobacterium avium
RAAELGWTGLLVPEELGGG

SEQ ID NO: 102740 - protein, 17 aa, Mycobacterium avium
RAAERECEQLLGDAKQG

SEQ ID NO: 102741 - protein, 18 aa, Mycobacterium avium
RAAFASRIQAEAARVTSA

SEQ ID NO: 102742 - protein, 24 aa, Mycobacterium avium
RAAFEAGWIQPTWPREHGGRSLGL

SEQ ID NO: 102743 - protein, 22 aa, Mycobacterium avium
RAAGEMRSRLRALAAAAGTDAA

SEQ ID NO: 102744 - protein, 18 aa, Mycobacterium avium
RAAGLVCKTRDIFVEQTV

SEQ ID NO: 102745 - protein, 19 aa, Mycobacterium avium
RAAGRAIRVYADLVVSLVG

SEQ ID NO: 102746 - protein, 20 aa, Mycobacterium avium
RAAGVLAGLPQPFTVSEARR

SEQ ID NO: 102747 - protein, 19 aa, Mycobacterium avium
RAAIKPADVKFVYLQPADA

SEQ ID NO: 102748 - protein, 23 aa, Mycobacterium avium
RAALPERLTMIAGISGVAEVGDL

SEQ ID NO: 102749 - protein, 26 aa, Mycobacterium avium
RAALPMLRAAEWARIVTLSAHSIQRQ

SEQ ID NO: 102750 - protein, 33 aa, Mycobacterium avium
RAALRRSGGLAARLALAHALGWQGRGREADALL

SEQ ID NO: 102751 - protein, 19 aa, Mycobacterium avium
RAALTRPATGWVSISQLFA

SEQ ID NO: 102752 - protein, 19 aa, Mycobacterium avium
RAAMPVTAPPSVARRLRLA

SEQ ID NO: 102753 - protein, 18 aa, Mycobacterium avium
RAAMVIGGQVILASVEQT

SEQ ID NO: 102754 - protein, 19 aa, Mycobacterium avium
RAAMWLEHIRRRGWQGAAV

SEQ ID NO: 102755 - protein, 18 aa, Mycobacterium avium
RAAPAVLAHGDFRMGNLI

SEQ ID NO: 102756 - protein, 17 aa, Mycobacterium avium
RAAPRVRAARHARHPVS

SEQ ID NO: 102757 - protein, 17 aa, Mycobacterium avium
RAARLGFGGKLCIHPCQ

SEQ ID NO: 102758 - protein, 17 aa, Mycobacterium avium
RAASDAGALHWVAGPTL

SEQ ID NO: 102759 - protein, 17 aa, Mycobacterium avium
RAASDAGALHWVVGPTL

SEQ ID NO: 102760 - protein, 19 aa, Mycobacterium avium
RAASLEYPQLWGGLADLAQ

SEQ ID NO: 102761 - protein, 21 aa, Mycobacterium avium
RAASLEYPQLWGGLADLAQGS

SEQ ID NO: 102762 - protein, 28 aa, Mycobacterium avium
RAATVGRLSVPPAWPAANPVAPLGETVM

SEQ ID NO: 102763 - protein, 23 aa, Mycobacterium avium
RAAVAHAAWRGAPTVEEQDIRVA

SEQ ID NO: 102764 - protein, 17 aa, Mycobacterium avium
RAAVCAGVDALGARAGA

SEQ ID NO: 102765 - protein, 20 aa, Mycobacterium avium
RAAVGLLERQGWLVRRQGLG

SEQ ID NO: 102766 - protein, 19 aa, Mycobacterium avium
RAAVKEAKLPHGTGFHALR

SEQ ID NO: 102767 - protein, 26 aa, Mycobacterium avium
RAAWPRYEGPDWDDAHFLQGIAGTLE

SEQ ID NO: 102768 - protein, 19 aa, Mycobacterium avium
RAAYELAGIGPEDVDVAQL

SEQ ID NO: 102769 - protein, 21 aa, Mycobacterium avium
RAAYIQGEWGAVASLSPELFL

SEQ ID NO: 102770 - protein, 17 aa, Mycobacterium avium
RAAYTLRRDDDDWGQAG

SEQ ID NO: 102771 - protein, 25 aa, Mycobacterium avium
RACAAEHTPLLGVCLGHQAIGVAFG

SEQ ID NO: 102772 - protein, 18 aa, Mycobacterium avium
RADALAWSVKLVGEHAEE

SEQ ID NO: 102773 - protein, 19 aa, Mycobacterium avium
RADFGWQVVDASGWPTDRL

SEQ ID NO: 102774 - protein, 20 aa, Mycobacterium avium
RADFGWQVVDATGWPTDRLQ

SEQ ID NO: 102775 - protein, 26 aa, Mycobacterium avium
RADGALRRSIKFPSFLDGIDAVRRVA

SEQ ID NO: 102776 - protein, 26 aa, Mycobacterium avium
RADGCGVQLLFDRAARIWYFERPATD

SEQ ID NO: 102777 - protein, 19 aa, Mycobacterium avium
RADGGWLLSGSKVWTSGAH

SEQ ID NO: 102778 - protein, 30 aa, Mycobacterium avium
RADGMSFGKLWASPELRANLDAWLARFAAP

SEQ ID NO: 102779 - protein, 22 aa, Mycobacterium avium
RADGSVVPGLYAAGACAPNLAQ

SEQ ID NO: 102780 - protein, 23 aa, Mycobacterium avium
RADGTTIFPFRRVFIVAEVGSGR

SEQ ID NO: 102781 - protein, 24 aa, Mycobacterium avium
RADGTTIFPFRRVFIVAEVGSGRP

SEQ ID NO: 102782 - protein, 18 aa, Mycobacterium avium
RADIGLLGAILGDTVREQ

SEQ ID NO: 102783 - protein, 21 aa, Mycobacterium avium
RADLGARARPAGARPDGMRRA

SEQ ID NO: 102784 - protein, 27 aa, Mycobacterium avium
RADLHEVQRWCALLEWAGIPCDSTDIL

SEQ ID NO: 102785 - protein, 24 aa, Mycobacterium avium
RADLLGRRLHRALGPLVHVNLIPL

SEQ ID NO: 102786 - protein, 19 aa, Mycobacterium avium
RADLRRVRELTAGAVGANI

SEQ ID NO: 102787 - protein, 28 aa, Mycobacterium avium
RADQDEYLRWAVGAFRLATSGVADSTQI

SEQ ID NO: 102788 - protein, 28 aa, Mycobacterium avium
RADQEEYLRWAVGAFRLATSGVADSTQI

SEQ ID NO: 102789 - protein, 18 aa, Mycobacterium avium
RADSRCTLIGEIDRDGTR

SEQ ID NO: 102790 - protein, 17 aa, Mycobacterium avium
RAEARLQGWEEFDEPVD

SEQ ID NO: 102791 - protein, 18 aa, Mycobacterium avium
RAEDFTWHRAAAGMLASL

SEQ ID NO: 102792 - protein, 19 aa, Mycobacterium avium
RAEGGWVLSGTKVWTSGAH

SEQ ID NO: 102793 - protein, 17 aa, Mycobacterium avium
RAEKLLRERGIEELPRY

SEQ ID NO: 102794 - protein, 17 aa, Mycobacterium avium
RAELKDRLKRGGTNLSQ

SEQ ID NO: 102795 - protein, 21 aa, Mycobacterium avium
RAELNVDFCAAIPVLTITGSF

SEQ ID NO: 102796 - protein, 21 aa, Mycobacterium avium
RAELRSAAVIYGSKRQLDLLD

SEQ ID NO: 102797 - protein, 18 aa, Mycobacterium avium
RAESSALFAMLSGQHVGN

SEQ ID NO: 102798 - protein, 17 aa, Mycobacterium avium
RAETLGDDIAWMRFGKD

SEQ ID NO: 102799 - protein, 21 aa, Mycobacterium avium
RAFCAALRAAGARTVGHAELS

SEQ ID NO: 102800 - protein, 20 aa, Mycobacterium avium
RAFERLVALQVIRVDGSRAT

SEQ ID NO: 102801 - protein, 21 aa, Mycobacterium avium
RAFERLVALQVIRVDGSRATL

SEQ ID NO: 102802 - protein, 20 aa, Mycobacterium avium
RAFERLVALQVIRVDGTRAT

SEQ ID NO: 102803 - protein, 17 aa, Mycobacterium avium
RAFGVDLGQHMIRVNSV

SEQ ID NO: 102804 - protein, 24 aa, Mycobacterium avium
RAFRVRCVGRRACPHHGARAVRRG

SEQ ID NO: 102805 - protein, 23 aa, Mycobacterium avium
RAFWPGALSLVVPQAPSLQWDLG

SEQ ID NO: 102806 - protein, 17 aa, Mycobacterium avium
RAGAAGMEMFGEIVKHM

SEQ ID NO: 102807 - protein, 24 aa, Mycobacterium avium
RAGAEPGSLIAVVGDLGRSAAGFD

SEQ ID NO: 102808 - protein, 17 aa, Mycobacterium avium
RAGCGGAPRWTVTAPTR

SEQ ID NO: 102809 - protein, 19 aa, Mycobacterium avium
RAGDCALLVYPPGLEMVAA

SEQ ID NO: 102810 - protein, 18 aa, Mycobacterium avium
RAGDTAWLTRPLIDSYHT

SEQ ID NO: 102811 - protein, 17 aa, Mycobacterium avium
RAGEATSMVLLTATSMG

SEQ ID NO: 102812 - protein, 21 aa, Mycobacterium avium
RAGFHTLRLQTFLTAGPKEAR

SEQ ID NO: 102813 - protein, 17 aa, Mycobacterium avium
RAGHPGMLLQGGGTVEW

SEQ ID NO: 102814 - protein, 18 aa, Mycobacterium avium
RAGIDCIEHGFLASDETI

SEQ ID NO: 102815 - protein, 23 aa, Mycobacterium avium
RAGIGCPQCVVVVHQPDEHTGPR

SEQ ID NO: 102816 - protein, 17 aa, Mycobacterium avium
RAGLARHPDAVVVANCD

SEQ ID NO: 102817 - protein, 30 aa, Mycobacterium avium
RAGLLLPLGWNPRLPIMGQQYISQGAISKG

SEQ ID NO: 102818 - protein, 20 aa, Mycobacterium avium
RAGLTASRFVACPFASMSGQ

SEQ ID NO: 102819 - protein, 19 aa, Mycobacterium avium
RAGPAYAELALLRGDPSDG

SEQ ID NO: 102820 - protein, 17 aa, Mycobacterium avium
RAGRPAEALPWYRIASQ

SEQ ID NO: 102821 - protein, 22 aa, Mycobacterium avium
RAGTHIMLEWGDVFGPWEAGPQ

SEQ ID NO: 102822 - protein, 21 aa, Mycobacterium avium
RAGVRAAPAWPARAPAALGGP

SEQ ID NO: 102823 - protein, 22 aa, Mycobacterium avium
RAGVRAAPAWPARAPAALGGSG

SEQ ID NO: 102824 - protein, 19 aa, Mycobacterium avium
RAGVSPADIDVCQLYDSFT

SEQ ID NO: 102825 - protein, 21 aa, Mycobacterium avium
RAHAVAVPPMFADLVNAPTRR

SEQ ID NO: 102826 - protein, 22 aa, Mycobacterium avium
RAHAVAVPPMFAELVNAPTRRR

SEQ ID NO: 102827 - protein, 20 aa, Mycobacterium avium
RAHCAPILGLPRHADPQSYW

SEQ ID NO: 102828 - protein, 19 aa, Mycobacterium avium
RAHCPDVAFLRLSGSAALL

SEQ ID NO: 102829 - protein, 19 aa, Mycobacterium avium
RAHCPLPRVHDHGVRPRPL

SEQ ID NO: 102830 - protein, 22 aa, Mycobacterium avium
RAHDALRAYVHAAVRASTQPAL

SEQ ID NO: 102831 - protein, 23 aa, Mycobacterium avium
RAHDVARCWLYLGLTRLGSGALE

SEQ ID NO: 102832 - protein, 18 aa, Mycobacterium avium
RAHELGVGQVWLAQQQSY

SEQ ID NO: 102833 - protein, 23 aa, Mycobacterium avium
RAHPGVRYRAFDLMEAGPDRIAA

SEQ ID NO: 102834 - protein, 29 aa, Mycobacterium avium
RAHRGRRPDAEWLGVAAFQQARAAAERPD

SEQ ID NO: 102835 - protein, 18 aa, Mycobacterium avium
RAHVPGAIRRKLRLADVL

SEQ ID NO: 102836 - protein, 19 aa, Mycobacterium avium
RAIDACGPPSSTTAGDVTT

SEQ ID NO: 102837 - protein, 22 aa, Mycobacterium avium
RAIGEVLLAHVLLAEGEFASAA

SEQ ID NO: 102838 - protein, 36 aa, Mycobacterium avium
RAIMRRIPPNWGRWVGCSRGWYPIIIALDQALAAID

SEQ ID NO: 102839 - protein, 17 aa, Mycobacterium avium
RAIPHIHALIRLDPYED

SEQ ID NO: 102840 - protein, 27 aa, Mycobacterium avium
RAIVEVRRLLPGIPLVASGGIRTGMDA

SEQ ID NO: 102841 - protein, 17 aa, Mycobacterium avium
RAIWELYGGWFHHRSTT

SEQ ID NO: 102842 - protein, 18 aa, Mycobacterium avium
RAKAAVVNQLLGVLDDLE

SEQ ID NO: 102843 - protein, 23 aa, Mycobacterium avium
RAKARPGVTPHLLVMTATPIPRT

SEQ ID NO: 102844 - protein, 23 aa, Mycobacterium avium
RAKDLRAKPVWVLGSGETTSHML

SEQ ID NO: 102845 - protein, 20 aa, Mycobacterium avium
RAKLGELCRELGITEFMLLQ

SEQ ID NO: 102846 - protein, 22 aa, Mycobacterium avium
RAKLRSSIKRLLVKYRYPPDKQ

SEQ ID NO: 102847 - protein, 27 aa, Mycobacterium avium
RAKNMFALGLLSWMYGRPIETSEKFIR

SEQ ID NO: 102848 - protein, 18 aa, Mycobacterium avium
RAKVSRLAAVIPVHTHFD

SEQ ID NO: 102849 - protein, 18 aa, Mycobacterium avium
RALAACFCDEGVLEFTGG

SEQ ID NO: 102850 - protein, 19 aa, Mycobacterium avium
RALAGAGVRTVGNGTTGAA

SEQ ID NO: 102851 - protein, 24 aa, Mycobacterium avium
RALDHGVEVIGYWGEPVSTATDAR

SEQ ID NO: 102852 - protein, 26 aa, Mycobacterium avium
RALDRQRPAAGLGHRVVQAAQVVEGQ

SEQ ID NO: 102853 - protein, 17 aa, Mycobacterium avium
RALEPALARTLRRALPL

SEQ ID NO: 102854 - protein, 18 aa, Mycobacterium avium
RALGDYWFEGVSRAARLR

SEQ ID NO: 102855 - protein, 17 aa, Mycobacterium avium
RALGGPVPIPADVNRNF

SEQ ID NO: 102856 - protein, 18 aa, Mycobacterium avium
RALGRRLGHEGMKVVLAD

SEQ ID NO: 102857 - protein, 18 aa, Mycobacterium avium
RALISICAAGGQGVAAIL

SEQ ID NO: 102858 - protein, 25 aa, Mycobacterium avium
RALPHWAGVVPLQLSAGPPVPAPDL

SEQ ID NO: 102859 - protein, 17 aa, Mycobacterium avium
RALPQVKPGTVARTVPV

SEQ ID NO: 102860 - protein, 27 aa, Mycobacterium avium
RALRILDSRFCEWSLPHPLDVGAPTSF

SEQ ID NO: 102861 - protein, 20 aa, Mycobacterium avium
RALRRAPLYELLSANGVAVD

SEQ ID NO: 102862 - protein, 17 aa, Mycobacterium avium
RALRVIRGRLTATAGEI

SEQ ID NO: 102863 - protein, 19 aa, Mycobacterium avium
RALSELKLVEPLVISSPRQ

SEQ ID NO: 102864 - protein, 22 aa, Mycobacterium avium
RAMAAGAAPYVGWLHTTAERAQ

SEQ ID NO: 102865 - protein, 21 aa, Mycobacterium avium
RAMAVARRIRTGSLMINSGMY

SEQ ID NO: 102866 - protein, 25 aa, Mycobacterium avium
RAMQFLRGGRRWLLKSPQHLEQVPV

SEQ ID NO: 102867 - protein, 24 aa, Mycobacterium avium
RANASGLVRLQWVSARTLTIAPKG

SEQ ID NO: 102868 - protein, 18 aa, Mycobacterium avium
RANGQGRRRGVASAGGPR

SEQ ID NO: 102869 - protein, 22 aa, Mycobacterium avium
RANRTPIDWDGYTPPVPATGAG

SEQ ID NO: 102870 - protein, 19 aa, Mycobacterium avium
RAPAAYDAVCERLHTASLR

SEQ ID NO: 102871 - protein, 24 aa, Mycobacterium avium
RAPKRMAGGESFTFHLPAYHRDRV

SEQ ID NO: 102872 - protein, 19 aa, Mycobacterium avium
RAPLLAALGAADLALATVN

SEQ ID NO: 102873 - protein, 17 aa, Mycobacterium avium
RAPRRYTLISVDDHIVE

SEQ ID NO: 102874 - protein, 18 aa, Mycobacterium avium
RAPSIWASRPADLYGRRD

SEQ ID NO: 102875 - protein, 18 aa, Mycobacterium avium
RAPVLPFKVTGTRRKALA

SEQ ID NO: 102876 - protein, 19 aa, Mycobacterium avium
RAPWRLKQNYFFDMRTIRR

SEQ ID NO: 102877 - protein, 20 aa, Mycobacterium avium
RAPWRLKQNYFFDMRTIRRG

SEQ ID NO: 102878 - protein, 20 aa, Mycobacterium avium
RAQALPPGRGLLLSADGDVE

SEQ ID NO: 102879 - protein, 19 aa, Mycobacterium avium
RAQPDWTPRALEPALARTL

SEQ ID NO: 102880 - protein, 19 aa, Mycobacterium avium
RAQRACRRFDPDGKVPDSD

SEQ ID NO: 102881 - protein, 25 aa, Mycobacterium avium
RAQRFYAKHGFTVSGTRTFQLGAGR

SEQ ID NO: 102882 - protein, 23 aa, Mycobacterium avium
RAQRPEWLAAAAAVTAGQPDRDD

SEQ ID NO: 102883 - protein, 18 aa, Mycobacterium avium
RARAALRDSRPIRIPANL

SEQ ID NO: 102884 - protein, 19 aa, Mycobacterium avium
RARAPRPVDQVNLAAHVLL

SEQ ID NO: 102885 - protein, 22 aa, Mycobacterium avium
RARAVLPSSFLGSGLTEAAYRG

SEQ ID NO: 102886 - protein, 19 aa, Mycobacterium avium
RARDEVVGVIAIARGTEQP

SEQ ID NO: 102887 - protein, 20 aa, Mycobacterium avium
RAREAVDRWLATGGVGTVRI

SEQ ID NO: 102888 - protein, 23 aa, Mycobacterium avium
RARESLDSAAGWLAPLGGSHLRS

SEQ ID NO: 102889 - protein, 17 aa, Mycobacterium avium
RARIGAAACNTARSVDY

SEQ ID NO: 102890 - protein, 18 aa, Mycobacterium avium
RARIGAAACNTARSVDYV

SEQ ID NO: 102891 - protein, 19 aa, Mycobacterium avium
RARNPKIIYARGHGYGTRG

SEQ ID NO: 102892 - protein, 30 aa, Mycobacterium avium
RARPQLAVTFRNGWQWATVEGRAELVGPDD

SEQ ID NO: 102893 - protein, 22 aa, Mycobacterium avium
RARQWPPDRFAAVAAALRDDGH

SEQ ID NO: 102894 - protein, 18 aa, Mycobacterium avium
RARRLPRVMTSTLPDARP

SEQ ID NO: 102895 - protein, 22 aa, Mycobacterium avium
RARRLQPHYIELAFKAAFTRLG

SEQ ID NO: 102896 - protein, 18 aa, Mycobacterium avium
RARYELTLQATRDPALAA

SEQ ID NO: 102897 - protein, 19 aa, Mycobacterium avium
RASARRLGLDRIPLYQVHQ

SEQ ID NO: 102898 - protein, 24 aa, Mycobacterium avium
RASARRLGLDRIPLYQVHQPNPVF

SEQ ID NO: 102899 - protein, 18 aa, Mycobacterium avium
RASGLETRDEFVVGSLAG

SEQ ID NO: 102900 - protein, 28 aa, Mycobacterium avium
RASVVKWAVDGGMMVRAPYTLRPDDDDW

SEQ ID NO: 102901 - protein, 19 aa, Mycobacterium avium
RATHGYVRYHDVHVPADHV

SEQ ID NO: 102902 - protein, 20 aa, Mycobacterium avium
RATINPKRVAAMTMQTVMFI

SEQ ID NO: 102903 - protein, 19 aa, Mycobacterium avium
RATLALPGGLRWVAVHQPD

SEQ ID NO: 102904 - protein, 19 aa, Mycobacterium avium
RATLALPGGLRWVAVHRPD

SEQ ID NO: 102905 - protein, 19 aa, Mycobacterium avium
RATLALPSGLRWVAVHQPD

SEQ ID NO: 102906 - protein, 25 aa, Mycobacterium avium
RAVADAVLYEGYLLYPYRATSSKNE

SEQ ID NO: 102907 - protein, 20 aa, Mycobacterium avium
RAVAECERLGLGGWLDSRIR

SEQ ID NO: 102908 - protein, 24 aa, Mycobacterium avium
RAVAELLAGLGAGVVVNGRDPQAV

SEQ ID NO: 102909 - protein, 18 aa, Mycobacterium avium
RAVAMVVEITDPQTARPV

SEQ ID NO: 102910 - protein, 17 aa, Mycobacterium avium
RAVDLLEEFARSGRCIP

SEQ ID NO: 102911 - protein, 19 aa, Mycobacterium avium
RAVEELLRVYPIVQTARKA

SEQ ID NO: 102912 - protein, 17 aa, Mycobacterium avium
RAVGARAVLVDRLGEGQ

SEQ ID NO: 102913 - protein, 17 aa, Mycobacterium avium
RAVGLPVLADPGAVPPP

SEQ ID NO: 102914 - protein, 17 aa, Mycobacterium avium
RAVHRCMRAGRITAGPA

SEQ ID NO: 102915 - protein, 17 aa, Mycobacterium avium
RAVHRCMRAGRITAGSA

SEQ ID NO: 102916 - protein, 25 aa, Mycobacterium avium
RAVLPAMQAAGWGRFVHIGSATAKE

SEQ ID NO: 102917 - protein, 17 aa, Mycobacterium avium
RAVMIGRAYLWGLAAAG

SEQ ID NO: 102918 - protein, 18 aa, Mycobacterium avium
RAVPRAVPVVAMVGGGQL

SEQ ID NO: 102919 - protein, 17 aa, Mycobacterium avium
RAVRARRGVLLAAGGFE

SEQ ID NO: 102920 - protein, 18 aa, Mycobacterium avium
RAVRDWLLAERRILTTFV

SEQ ID NO: 102921 - protein, 21 aa, Mycobacterium avium
RAVRKPCERTQLTGPSAARDV

SEQ ID NO: 102922 - protein, 29 aa, Mycobacterium avium
RAVRVRRLRAAKCRTRNLPLIGAPANPGI

SEQ ID NO: 102923 - protein, 20 aa, Mycobacterium avium
RAVSLEDRFTQLLPEVTLGV

SEQ ID NO: 102924 - protein, 25 aa, Mycobacterium avium
RAVTGTSRCGSRFIVDVRPIESVAV

SEQ ID NO: 102925 - protein, 20 aa, Mycobacterium avium
RAVTLAALAPRPGERLWDVG

SEQ ID NO: 102926 - protein, 24 aa, Mycobacterium avium
RAVTLAALAPRPGERLWDVGAGSG

SEQ ID NO: 102927 - protein, 22 aa, Mycobacterium avium
RAVTVGDGWTAGALRDYANQSV

SEQ ID NO: 102928 - protein, 20 aa, Mycobacterium avium
RAVVAFGGLQDCCVQFPDAP

SEQ ID NO: 102929 - protein, 17 aa, Mycobacterium avium
RAVVPALPLHDTVKAVD

SEQ ID NO: 102930 - protein, 24 aa, Mycobacterium avium
RAWAFLPYVAGFGIPTFDQSGNPL

SEQ ID NO: 102931 - protein, 25 aa, Mycobacterium avium
RAYADRLEKALARVRDGDVAWLTRP

SEQ ID NO: 102932 - protein, 34 aa, Mycobacterium avium
RAYNHPRRLHWYVPRSIRLIDVFKGLSPEFVRRS

SEQ ID NO: 102933 - protein, 19 aa, Mycobacterium avium
RAYQPRIVFVDADNKPVDL

SEQ ID NO: 102934 - protein, 17 aa, Mycobacterium avium
RAYQRWLADFMSGGDGR

SEQ ID NO: 102935 - protein, 19 aa, Mycobacterium avium
RAYRTDPEFFAMGHNMMLE

SEQ ID NO: 102936 - protein, 18 aa, Mycobacterium avium
RAYVTRQARWVDFDNDYK

SEQ ID NO: 102937 - protein, 19 aa, Mycobacterium avium
RCADMLVALEGARSQILEA

SEQ ID NO: 102938 - protein, 17 aa, Mycobacterium avium
RCGADVVIASRNLDNCV

SEQ ID NO: 102939 - protein, 31 aa, Mycobacterium avium
RCGMVSPTVFWPIPRVYSGLVRIDRYPTSPW

SEQ ID NO: 102940 - protein, 18 aa, Mycobacterium avium
RCIELLDRVEIDRPAQRL

SEQ ID NO: 102941 - protein, 17 aa, Mycobacterium avium
RCIQIHGALGISTELPL

SEQ ID NO: 102942 - protein, 24 aa, Mycobacterium avium
RCLPELPRRVRAERTVMVRNLLMH

SEQ ID NO: 102943 - protein, 17 aa, Mycobacterium avium
RCLQLHGGYGYMREYPV

SEQ ID NO: 102944 - protein, 19 aa, Mycobacterium avium
RCLQLHGGYGYMREYPVAR

SEQ ID NO: 102945 - protein, 22 aa, Mycobacterium avium
RCLQLHGGYGYMREYPVARAYL

SEQ ID NO: 102946 - protein, 23 aa, Mycobacterium avium
RCNLRCSYCMPAEGLDWLPGEQL

SEQ ID NO: 102947 - protein, 42 aa, Mycobacterium avium
RCPDIRLARQRLGWRPRVDYRTGLSTTLAWFAERAGRTGEST

SEQ ID NO: 102948 - protein, 21 aa, Mycobacterium avium
RCPTRRRCSFARLRSSPDRWS

SEQ ID NO: 102949 - protein, 18 aa, Mycobacterium avium
RCRALGAAVGTYLATLDK

SEQ ID NO: 102950 - protein, 18 aa, Mycobacterium avium
RCRDCGGALVAREVCGRG

SEQ ID NO: 102951 - protein, 26 aa, Mycobacterium avium
RCRQHRCFPVLAGALGEHDLLLVSPI

SEQ ID NO: 102952 - protein, 19 aa, Mycobacterium avium
RCTVERLMRANGWRGVTRR

SEQ ID NO: 102953 - protein, 19 aa, Mycobacterium avium
RCVGDLGFVGALIAGSYDG

SEQ ID NO: 102954 - protein, 26 aa, Mycobacterium avium
RDAGWDSLWVYDHFHTVPVPTGEATH

SEQ ID NO: 102955 - protein, 19 aa, Mycobacterium avium
RDALHWAIRQAVQEAEPAR

SEQ ID NO: 102956 - protein, 18 aa, Mycobacterium avium
RDALKRWYDRVLRRFYRS

SEQ ID NO: 102957 - protein, 22 aa, Mycobacterium avium
RDALQRVWRPLADKLDVHAYIE

SEQ ID NO: 102958 - protein, 17 aa, Mycobacterium avium
RDAMAVLDGVLPRGVDI

SEQ ID NO: 102959 - protein, 34 aa, Mycobacterium avium
RDAPDIPVALAFVKRASGPVLRRFIEAAVDAAAN

SEQ ID NO: 102960 - protein, 17 aa, Mycobacterium avium
RDARFATTFTNVGLAGD

SEQ ID NO: 102961 - protein, 17 aa, Mycobacterium avium
RDAWTRMTQFALQAQAS

SEQ ID NO: 102962 - protein, 26 aa, Mycobacterium avium
RDDGNVWAYPAAPWWDKLRQRITDFF

SEQ ID NO: 102963 - protein, 20 aa, Mycobacterium avium
RDDLAPDWPQPRIAIAPKDL

SEQ ID NO: 102964 - protein, 18 aa, Mycobacterium avium
RDDLAPDWPQPRIAITPK

SEQ ID NO: 102965 - protein, 18 aa, Mycobacterium avium
RDDNALLMGYRVPKTSFA

SEQ ID NO: 102966 - protein, 19 aa, Mycobacterium avium
RDDVLLGLMLRRVDHALAE

SEQ ID NO: 102967 - protein, 26 aa, Mycobacterium avium
RDEIAERGWPVFLVSTVAREGLQPLT

SEQ ID NO: 102968 - protein, 22 aa, Mycobacterium avium
RDEKHPVPAWIVVGAGTGGTSA

SEQ ID NO: 102969 - protein, 21 aa, Mycobacterium avium
RDETIAAIAARAAELEVPGAD

SEQ ID NO: 102970 - protein, 19 aa, Mycobacterium avium
RDETIAAIAARAAELQVPG

SEQ ID NO: 102971 - protein, 21 aa, Mycobacterium avium
RDETIAAIAARAAELQVPGAD

SEQ ID NO: 102972 - protein, 18 aa, Mycobacterium avium
RDEVEPLEVLFPGCEFLP

SEQ ID NO: 102973 - protein, 24 aa, Mycobacterium avium
RDFFRNPIRLVLKVWDPIIKYWAD

SEQ ID NO: 102974 - protein, 24 aa, Mycobacterium avium
RDFFRNPIRLVLKVWDPIIKYWAE

SEQ ID NO: 102975 - protein, 22 aa, Mycobacterium avium
RDGEQPLALMIAYLPPGLGKAV

SEQ ID NO: 102976 - protein, 17 aa, Mycobacterium avium
RDGKLGVGWPKEFGGLG

SEQ ID NO: 102977 - protein, 19 aa, Mycobacterium avium
RDGLIRALISYRQASLGAD

SEQ ID NO: 102978 - protein, 19 aa, Mycobacterium avium
RDGLPRIAQAVAAPAVRKT

SEQ ID NO: 102979 - protein, 21 aa, Mycobacterium avium
RDGRARLVLRRETVDDLLSLE

SEQ ID NO: 102980 - protein, 22 aa, Mycobacterium avium
RDGRARLVLRRETVDDLLSLEV

SEQ ID NO: 102981 - protein, 25 aa, Mycobacterium avium
RDGRDAGRRRPPVLTEAEFLARREA

SEQ ID NO: 102982 - protein, 24 aa, Mycobacterium avium
RDHLELGETLGLIDMARGAKVSGS

SEQ ID NO: 102983 - protein, 20 aa, Mycobacterium avium
RDHMSWPDFIAGLYGRSFRD

SEQ ID NO: 102984 - protein, 22 aa, Mycobacterium avium
RDHRASFVQIHFALDGLPEFAP

SEQ ID NO: 102985 - protein, 27 aa, Mycobacterium avium
RDHRGFTWRSFCARDFAAHGLNLDVAQ

SEQ ID NO: 102986 - protein, 25 aa, Mycobacterium avium
RDISAKKNEPEWMLQTRLKALRIFE

SEQ ID NO: 102987 - protein, 18 aa, Mycobacterium avium
RDKDAWLAVFADDAVVED

SEQ ID NO: 102988 - protein, 17 aa, Mycobacterium avium
RDKDGRPFPPWTDPESA

SEQ ID NO: 102989 - protein, 23 aa, Mycobacterium avium
RDKRMEIALTYIYGVGRTRSNEI

SEQ ID NO: 102990 - protein, 21 aa, Mycobacterium avium
RDKSRWPAMHALLSEKFAQRS

SEQ ID NO: 102991 - protein, 21 aa, Mycobacterium avium
RDKWYSAGWYSDRTCLDAFEA

SEQ ID NO: 102992 - protein, 18 aa, Mycobacterium avium
RDLAFRASPVAQIVVTGE

SEQ ID NO: 102993 - protein, 23 aa, Mycobacterium avium
RDLGAAYARRCAGHAPGWEPLPV

SEQ ID NO: 102994 - protein, 22 aa, Mycobacterium avium
RDLGAAYARRCDGRGPDWTPLP

SEQ ID NO: 102995 - protein, 17 aa, Mycobacterium avium
RDLGPMLVFLAGSGSGF

SEQ ID NO: 102996 - protein, 25 aa, Mycobacterium avium
RDLPKTRIADGVGIPISMPAYARAF

SEQ ID NO: 102997 - protein, 25 aa, Mycobacterium avium
RDLPRRPLHPELRVEDRIIPGPQGP

SEQ ID NO: 102998 - protein, 24 aa, Mycobacterium avium
RDLSVQLSGWMLMEAACNVSAESS

SEQ ID NO: 102999 - protein, 26 aa, Mycobacterium avium
RDLTAAIARCRRLLDLDADPEAVDEA

SEQ ID NO: 103000 - protein, 24 aa, Mycobacterium avium
RDPAHLLLQLGGPVDRHAVAALVG

SEQ ID NO: 103001 - protein, 33 aa, Mycobacterium avium
RDPAWEWNPALLALRAELERVFLAGVRRDVGPI

SEQ ID NO: 103002 - protein, 25 aa, Mycobacterium avium
RDPFLRKRARSLYRETLRHITELAD

SEQ ID NO: 103003 - protein, 17 aa, Mycobacterium avium
RDPGALGGYRTYTPALK

SEQ ID NO: 103004 - protein, 19 aa, Mycobacterium avium
RDPGQWAALGADPGRAPAI

SEQ ID NO: 103005 - protein, 20 aa, Mycobacterium avium
RDPGQWAALGADPGRAPAIV

SEQ ID NO: 103006 - protein, 21 aa, Mycobacterium avium
RDPMAMLPFIGYHVGDYFQHW

SEQ ID NO: 103007 - protein, 24 aa, Mycobacterium avium
RDPMKFPNLIRAGGRRADNDLHDH

SEQ ID NO: 103008 - protein, 26 aa, Mycobacterium avium
RDQARLRALQELGWIVVRVIAEDKPD

SEQ ID NO: 103009 - protein, 27 aa, Mycobacterium avium
RDQARLRTLQELGWIVVRVIAEDKPDD

SEQ ID NO: 103010 - protein, 26 aa, Mycobacterium avium
RDQIRLWLDLLLERRPGEIATTAEGF

SEQ ID NO: 103011 - protein, 25 aa, Mycobacterium avium
RDQLRVGRFTGVVLLTGPKDGDRDD

SEQ ID NO: 103012 - protein, 18 aa, Mycobacterium avium
RDRCARRPGWLGGSFPGD

SEQ ID NO: 103013 - protein, 23 aa, Mycobacterium avium
RDRIHQGWILNALWLLDTGITAA

SEQ ID NO: 103014 - protein, 30 aa, Mycobacterium avium
RDRLFLFMSAERWLFKRDGRWRAYQAQVDC

SEQ ID NO: 103015 - protein, 25 aa, Mycobacterium avium
RDRMAFRSASYWDIVAQLDASVSDP

SEQ ID NO: 103016 - protein, 32 aa, Mycobacterium avium
RDRPTLKAKILPIIAGTLFPNALGEIVGMTKA

SEQ ID NO: 103017 - protein, 21 aa, Mycobacterium avium
RDRRAIAMGRRGRPEEQAGAI

SEQ ID NO: 103018 - protein, 18 aa, Mycobacterium avium
RDRRQGLVDAERLRSPAF

SEQ ID NO: 103019 - protein, 22 aa, Mycobacterium avium
RDRRRVGLTVGQYGGDWSLARE

SEQ ID NO: 103020 - protein, 25 aa, Mycobacterium avium
RDRTGFVFGEAGALMVIETEEHAKA

SEQ ID NO: 103021 - protein, 20 aa, Mycobacterium avium
RDRVEGFLRRARQDGATVLV

SEQ ID NO: 103022 - protein, 23 aa, Mycobacterium avium
RDRWQPWNGTGWGKAGDLATATV

SEQ ID NO: 103023 - protein, 21 aa, Mycobacterium avium
RDSEAKGEELLAERLAGWQEQ

SEQ ID NO: 103024 - protein, 22 aa, Mycobacterium avium
RDSEAKGEELLAERLAGWQEQY

SEQ ID NO: 103025 - protein, 26 aa, Mycobacterium avium
RDSVQRMAVALGFELDDMEFFIEHAT

SEQ ID NO: 103026 - protein, 19 aa, Mycobacterium avium
RDTLGFSVLHVVRDNPTSI

SEQ ID NO: 103027 - protein, 21 aa, Mycobacterium avium
RDTNVRVSVVFPGAVKTDIAV

SEQ ID NO: 103028 - protein, 21 aa, Mycobacterium avium
RDVEIPPHLLPAIRDHLDRFV

SEQ ID NO: 103029 - protein, 21 aa, Mycobacterium avium
RDVPVAAFGAVELWPVVHAVE

SEQ ID NO: 103030 - protein, 17 aa, Mycobacterium avium
RDVRRWVTSEVLPSIRK

SEQ ID NO: 103031 - protein, 19 aa, Mycobacterium avium
RDYQDSFGLGDDAWVLDEL

SEQ ID NO: 103032 - protein, 19 aa, Mycobacterium avium
RDYQDSFGLGDDGWVLDEL

SEQ ID NO: 103033 - protein, 24 aa, Mycobacterium avium
RDYRLAELLTGFLARLKTDLQQRS

SEQ ID NO: 103034 - protein, 18 aa, Mycobacterium avium
REAARYGVDTHLDGVRWP

SEQ ID NO: 103035 - protein, 18 aa, Mycobacterium avium
REACTRHDVLLIFDEIAT

SEQ ID NO: 103036 - protein, 27 aa, Mycobacterium avium
READVRRREWLAGRRGRVADQREQIAD

SEQ ID NO: 103037 - protein, 22 aa, Mycobacterium avium
REAFDRWGLIPRMFVGAAERDL

SEQ ID NO: 103038 - protein, 23 aa, Mycobacterium avium
REAIFKRAWLNVARVEELPRVGS

SEQ ID NO: 103039 - protein, 31 aa, Mycobacterium avium
REAVGIAAYHCGDWAQALAELRAARRMGSKS

SEQ ID NO: 103040 - protein, 24 aa, Mycobacterium avium
RECVSARTALTMFLGQADQPDRVR

SEQ ID NO: 103041 - protein, 19 aa, Mycobacterium avium
REDQDEWALRSHQRAIKAI

SEQ ID NO: 103042 - protein, 24 aa, Mycobacterium avium
REDVEAWVAGYFDYLDRNGAFVIR

SEQ ID NO: 103043 - protein, 19 aa, Mycobacterium avium
REDWGCWVDWARPEPGHKA

SEQ ID NO: 103044 - protein, 21 aa, Mycobacterium avium
REEADRLAARLDKIDAIQRDR

SEQ ID NO: 103045 - protein, 18 aa, Mycobacterium avium
REEAGDAAPVWVVENKAG

SEQ ID NO: 103046 - protein, 18 aa, Mycobacterium avium
REFDRVKLGPSLWHRDFY

SEQ ID NO: 103047 - protein, 17 aa, Mycobacterium avium
REFGRLDIVLANAGIIR

SEQ ID NO: 103048 - protein, 25 aa, Mycobacterium avium
REGAKLFHAKGWWVGAVDRNDDGLA

SEQ ID NO: 103049 - protein, 18 aa, Mycobacterium avium
REGLIDRGPRVGTHVAQR

SEQ ID NO: 103050 - protein, 18 aa, Mycobacterium avium
REGSQFGPYRLWQLVGRG

SEQ ID NO: 103051 - protein, 17 aa, Mycobacterium avium
REGVCQDFARLAIACLR

SEQ ID NO: 103052 - protein, 20 aa, Mycobacterium avium
REGWAARVRLAHALGPTMIA

SEQ ID NO: 103053 - protein, 21 aa, Mycobacterium avium
REHLRVPVVHAYGMTEAPMIC

SEQ ID NO: 103054 - protein, 19 aa, Mycobacterium avium
REHTSYRRWAHALTARAHR

SEQ ID NO: 103055 - protein, 19 aa, Mycobacterium avium
REHTSYRRWAHALTARAPA

SEQ ID NO: 103056 - protein, 18 aa, Mycobacterium avium
REIAPTFGATHAAADIGA

SEQ ID NO: 103057 - protein, 19 aa, Mycobacterium avium
REIDEAAGIAWDDLLRAMV

SEQ ID NO: 103058 - protein, 20 aa, Mycobacterium avium
REITDLLGKLAELRATGALT

SEQ ID NO: 103059 - protein, 17 aa, Mycobacterium avium
REIVGAALFLASDASSF

SEQ ID NO: 103060 - protein, 19 aa, Mycobacterium avium
REIVRRTVLATGTVTDTAL

SEQ ID NO: 103061 - protein, 18 aa, Mycobacterium avium
REKHGALRGSMTVLAVNT

SEQ ID NO: 103062 - protein, 20 aa, Mycobacterium avium
REKLALLNRCERLRRRLPAI

SEQ ID NO: 103063 - protein, 21 aa, Mycobacterium avium
REKLALLTRCERLRRRLPAVE

SEQ ID NO: 103064 - protein, 26 aa, Mycobacterium avium
RELAREFGRLGLLGMHLHGYGCGGAS

SEQ ID NO: 103065 - protein, 19 aa, Mycobacterium avium
RELATYFVGQVVGSLDRIC

SEQ ID NO: 103066 - protein, 19 aa, Mycobacterium avium
RELCAEIDLAPVVLMPGPL

SEQ ID NO: 103067 - protein, 19 aa, Mycobacterium avium
RELCAEIDLAPVVLMPGPV

SEQ ID NO: 103068 - protein, 17 aa, Mycobacterium avium
RELDPWLRDTFAEARHQ

SEQ ID NO: 103069 - protein, 24 aa, Mycobacterium avium
RELFCARDPFGIKPLFVATGTGGT

SEQ ID NO: 103070 - protein, 20 aa, Mycobacterium avium
RELFGMIAVNARRNAALNPS

SEQ ID NO: 103071 - protein, 17 aa, Mycobacterium avium
RELKAYAEHCADKYGIR

SEQ ID NO: 103072 - protein, 18 aa, Mycobacterium avium
RELLERWTAMSAATPSPA

SEQ ID NO: 103073 - protein, 18 aa, Mycobacterium avium
RELPRLVRDTVKGVRRVR

SEQ ID NO: 103074 - protein, 21 aa, Mycobacterium avium
RELPVAWRIPVSADDNDAEIA

SEQ ID NO: 103075 - protein, 20 aa, Mycobacterium avium
RELSIPYLPIRWSTDNPDSI

SEQ ID NO: 103076 - protein, 26 aa, Mycobacterium avium
REMFMDLPGFDAWLARWRALSPDADA

SEQ ID NO: 103077 - protein, 22 aa, Mycobacterium avium
REMSLRLAERGVLVKDTHGATL

SEQ ID NO: 103078 - protein, 18 aa, Mycobacterium avium
RENGRWLLSKHITVKTGD

SEQ ID NO: 103079 - protein, 19 aa, Mycobacterium avium
RENIREVHRADLIGQHIGE

SEQ ID NO: 103080 - protein, 23 aa, Mycobacterium avium
RENPRPGIVNALLQMRIDGEPAP

SEQ ID NO: 103081 - protein, 17 aa, Mycobacterium avium
RENRLRTALADLDNLDF

SEQ ID NO: 103082 - protein, 17 aa, Mycobacterium avium
REPHSWDLCVNHAGRIT

SEQ ID NO: 103083 - protein, 25 aa, Mycobacterium avium
REPQKRLSAIASIGSDVWDRLFSGL

SEQ ID NO: 103084 - protein, 27 aa, Mycobacterium avium
REPRATLWRRTEFRAVDAVSFRLRRAR

SEQ ID NO: 103085 - protein, 23 aa, Mycobacterium avium
REPRPYPELILAHRDSIFDYTYD

SEQ ID NO: 103086 - protein, 22 aa, Mycobacterium avium
REPRPYPELVLAHRDSIFDYTY

SEQ ID NO: 103087 - protein, 23 aa, Mycobacterium avium
REPRPYPELVLAHRDSIFDYTYD

SEQ ID NO: 103088 - protein, 24 aa, Mycobacterium avium
REQLAELSGAWGVVQTPGELCDDP

SEQ ID NO: 103089 - protein, 19 aa, Mycobacterium avium
RERGRVGGALVTEIYSVGP

SEQ ID NO: 103090 - protein, 22 aa, Mycobacterium avium
RERKMGFNLAFGYGIHSCLGAA

SEQ ID NO: 103091 - protein, 23 aa, Mycobacterium avium
RERLRGWRFYDGFRVDAGAPARH

SEQ ID NO: 103092 - protein, 17 aa, Mycobacterium avium
RERRLALGSKWVESGLV

SEQ ID NO: 103093 - protein, 18 aa, Mycobacterium avium
RERSLELDDAKSFLDSLV

SEQ ID NO: 103094 - protein, 24 aa, Mycobacterium avium
RERSLIGAWCFIDHYGPAHTRMDV

SEQ ID NO: 103095 - protein, 22 aa, Mycobacterium avium
RERSLRWVAVHTAHELHHHLLD

SEQ ID NO: 103096 - protein, 18 aa, Mycobacterium avium
RERVEAIAADASSLLDGV

SEQ ID NO: 103097 - protein, 17 aa, Mycobacterium avium
RERVLALGLRLLDRGYF

SEQ ID NO: 103098 - protein, 21 aa, Mycobacterium avium
RERVRRWARTRLESPPRDAFL

SEQ ID NO: 103099 - protein, 20 aa, Mycobacterium avium
RERWLPRLVSGDVVAGIGTN

SEQ ID NO: 103100 - protein, 18 aa, Mycobacterium avium
RESLWFNAGLAVRKIDKR

SEQ ID NO: 103101 - protein, 26 aa, Mycobacterium avium
RESTDILKRWKRGVMSTVGDVAAQNV

SEQ ID NO: 103102 - protein, 20 aa, Mycobacterium avium
RESYLRLLLIDAGLPRPQTQ

SEQ ID NO: 103103 - protein, 17 aa, Mycobacterium avium
RETAGTAAGLWAGATVG

SEQ ID NO: 103104 - protein, 24 aa, Mycobacterium avium
RETAKRLAGWVKERAASVELSDLA

SEQ ID NO: 103105 - protein, 24 aa, Mycobacterium avium
RETGRWADPVIRNKVMRLWAQERV

SEQ ID NO: 103106 - protein, 20 aa, Mycobacterium avium
RETLARYAGLILEYEGVTLK

SEQ ID NO: 103107 - protein, 21 aa, Mycobacterium avium
RETLARYAGLILEYEGVTVKD

SEQ ID NO: 103108 - protein, 21 aa, Mycobacterium avium
RETLERLGWIVIQVVAGDRPA

SEQ ID NO: 103109 - protein, 24 aa, Mycobacterium avium
RETLRLLVDLARTAKLEERRNQMF

SEQ ID NO: 103110 - protein, 19 aa, Mycobacterium avium
RETRRLRAPGHQLINQLAE

SEQ ID NO: 103111 - protein, 18 aa, Mycobacterium avium
RETWLIHLCTDWMGDDAW

SEQ ID NO: 103112 - protein, 17 aa, Mycobacterium avium
REVADAVAFLVSAEASF

SEQ ID NO: 103113 - protein, 17 aa, Mycobacterium avium
REVEERWGVKTVAISAD

SEQ ID NO: 103114 - protein, 18 aa, Mycobacterium avium
REVEERWGVKTVAISADM

SEQ ID NO: 103115 - protein, 20 aa, Mycobacterium avium
REVGTIAFPIAHIGGMVYLA

SEQ ID NO: 103116 - protein, 17 aa, Mycobacterium avium
REVSLGVLQVWQALTEG

SEQ ID NO: 103117 - protein, 21 aa, Mycobacterium avium
REYLEQVSIFDVALRIWRPRW

SEQ ID NO: 103118 - protein, 18 aa, Mycobacterium avium
RFAAVAALLRHRVATTDR

SEQ ID NO: 103119 - protein, 19 aa, Mycobacterium avium
RFADLFTAVRVRLGEAVDR

SEQ ID NO: 103120 - protein, 17 aa, Mycobacterium avium
RFADLFTAVRVRLREAV

SEQ ID NO: 103121 - protein, 25 aa, Mycobacterium avium
RFAEGERLWLSWAMANRDPNLFDNP

SEQ ID NO: 103122 - protein, 25 aa, Mycobacterium avium
RFAEGERLWLSWAMANRDPSLFDNP

SEQ ID NO: 103123 - protein, 19 aa, Mycobacterium avium
RFAGLALQGDITFDGAAST

SEQ ID NO: 103124 - protein, 25 aa, Mycobacterium avium
RFARPLRFGTAGLRGPVRAGPDAMN

SEQ ID NO: 103125 - protein, 17 aa, Mycobacterium avium
RFARRIAAQIVRRRAKE

SEQ ID NO: 103126 - protein, 22 aa, Mycobacterium avium
RFDLDGEVPFNWNAGNPAFSTY

SEQ ID NO: 103127 - protein, 19 aa, Mycobacterium avium
RFDPGLSVLAARFTDTDRI

SEQ ID NO: 103128 - protein, 26 aa, Mycobacterium avium
RFDRLWKGAGVLLPLGSPLPDDTVSA

SEQ ID NO: 103129 - protein, 23 aa, Mycobacterium avium
RFEELAGPFLRKDISACREAAAE

SEQ ID NO: 103130 - protein, 19 aa, Mycobacterium avium
RFEVEFSVAAGEVLAVLGP

SEQ ID NO: 103131 - protein, 20 aa, Mycobacterium avium
RFGLRGGPVLIGRTPLACDY

SEQ ID NO: 103132 - protein, 19 aa, Mycobacterium avium
RFGLSLARGPFCRAGAAGV

SEQ ID NO: 103133 - protein, 25 aa, Mycobacterium avium
RFGPLPPPRAVAIITQIASALDAAH

SEQ ID NO: 103134 - protein, 26 aa, Mycobacterium avium
RFGVAPLHTFCLAGAFMVPDPLTGRA

SEQ ID NO: 103135 - protein, 26 aa, Mycobacterium avium
RFGVSRPTLREAFRVLESESLIQVQR

SEQ ID NO: 103136 - protein, 26 aa, Mycobacterium avium
RFGVSRPTLREAFRVLESESLIVVQR

SEQ ID NO: 103137 - protein, 25 aa, Mycobacterium avium
RFIDAAWRAGFGWIDDLNDAAAQPV

SEQ ID NO: 103138 - protein, 23 aa, Mycobacterium avium
RFKYEYQVLSALNSEWAKRNVRE

SEQ ID NO: 103139 - protein, 19 aa, Mycobacterium avium
RFLGMPYAAPPVGDLRWAP

SEQ ID NO: 103140 - protein, 19 aa, Mycobacterium avium
RFLLAAAIREAHTKTDGPP

SEQ ID NO: 103141 - protein, 18 aa, Mycobacterium avium
RFPRARLDGEPQYKTNVT

SEQ ID NO: 103142 - protein, 21 aa, Mycobacterium avium
RFPRARLDGEPQYKTNVTLRG

SEQ ID NO: 103143 - protein, 21 aa, Mycobacterium avium
RFQLDIMRVPGIIVARTDAEA

SEQ ID NO: 103144 - protein, 23 aa, Mycobacterium avium
RFQPRCRLYVAAVGRAQRTLAAS

SEQ ID NO: 103145 - protein, 28 aa, Mycobacterium avium
RFQRTRGVLRLMSTVIHALWTGEDASPL

SEQ ID NO: 103146 - protein, 20 aa, Mycobacterium avium
RFRDKFGVIVLNSYGQTELG

SEQ ID NO: 103147 - protein, 25 aa, Mycobacterium avium
RFRKHPRARAGLDRASGRIPLDAPL

SEQ ID NO: 103148 - protein, 18 aa, Mycobacterium avium
RFRSHPDLEILNHGLTLW

SEQ ID NO: 103149 - protein, 18 aa, Mycobacterium avium
RFRTAWESARAAIGQPDM

SEQ ID NO: 103150 - protein, 19 aa, Mycobacterium avium
RFSPFSGFGYFAGGLSGFA

SEQ ID NO: 103151 - protein, 20 aa, Mycobacterium avium
RFSQDWPEYPFRHGGVDAES

SEQ ID NO: 103152 - protein, 22 aa, Mycobacterium avium
RFTELAGPFLRKDIAACREAAA

SEQ ID NO: 103153 - protein, 19 aa, Mycobacterium avium
RFTLLRPLLFTIAYEMLGS

SEQ ID NO: 103154 - protein, 20 aa, Mycobacterium avium
RFTPLSLKHRIFRKAVGSHS

SEQ ID NO: 103155 - protein, 19 aa, Mycobacterium avium
RFTREIIPFAGVSVDEGPR

SEQ ID NO: 103156 - protein, 18 aa, Mycobacterium avium
RFTRPGAPFRLSKTPVPP

SEQ ID NO: 103157 - protein, 20 aa, Mycobacterium avium
RFVACPFGEPGTRMYRTGDL

SEQ ID NO: 103158 - protein, 24 aa, Mycobacterium avium
RFVACPFGGTGTRMYRTGDLARWG

SEQ ID NO: 103159 - protein, 24 aa, Mycobacterium avium
RFVACPFGGTGTRMYRTGDLVRWG

SEQ ID NO: 103160 - protein, 28 aa, Mycobacterium avium
RFVLENSAPFGRRLRGVSYVFVTKDRPG

SEQ ID NO: 103161 - protein, 20 aa, Mycobacterium avium
RFVPLPGEDTLYWVGDTGPT

SEQ ID NO: 103162 - protein, 19 aa, Mycobacterium avium
RGAAHAAFSVGELLGLDNL

SEQ ID NO: 103163 - protein, 18 aa, Mycobacterium avium
RGAHLALFRFAFVSQEHE

SEQ ID NO: 103164 - protein, 18 aa, Mycobacterium avium
RGAPIVFRSASPADLFML

SEQ ID NO: 103165 - protein, 17 aa, Mycobacterium avium
RGAPRLTAYVATTDTTG

SEQ ID NO: 103166 - protein, 27 aa, Mycobacterium avium
RGAPVDFPLGGVVPGFQKAIAGQKVGS

SEQ ID NO: 103167 - protein, 20 aa, Mycobacterium avium
RGAPVLAICAAVQVLGHWYE

SEQ ID NO: 103168 - protein, 17 aa, Mycobacterium avium
RGCEELWGLRADETTGT

SEQ ID NO: 103169 - protein, 20 aa, Mycobacterium avium
RGDDGTFLWPGFGDNSRVLK

SEQ ID NO: 103170 - protein, 19 aa, Mycobacterium avium
RGDGGFCTEPIDWEQLAPP

SEQ ID NO: 103171 - protein, 20 aa, Mycobacterium avium
RGDGLPIRARHVDDSALVAG

SEQ ID NO: 103172 - protein, 29 aa, Mycobacterium avium
RGDLDIRSATEWFARMLFSLFTTPSPYLD

SEQ ID NO: 103173 - protein, 17 aa, Mycobacterium avium
RGDNFAFTFNIADYNVV

SEQ ID NO: 103174 - protein, 20 aa, Mycobacterium avium
RGDRTRWPAAGGRRRWQALR

SEQ ID NO: 103175 - protein, 19 aa, Mycobacterium avium
RGDRWIINGAKTWSTSAFA

SEQ ID NO: 103176 - protein, 23 aa, Mycobacterium avium
RGEAGAYLNGWDPLLQQGLPQPT

SEQ ID NO: 103177 - protein, 23 aa, Mycobacterium avium
RGERLVLCRTCIRGEDQQPGGFH

SEQ ID NO: 103178 - protein, 24 aa, Mycobacterium avium
RGFLDERATVLGPRLQDLVELALP

SEQ ID NO: 103179 - protein, 19 aa, Mycobacterium avium
RGFVVRLALDQLPQRAEDG

SEQ ID NO: 103180 - protein, 21 aa, Mycobacterium avium
RGGAAVELVWIIAQRLGLAVQ

SEQ ID NO: 103181 - protein, 18 aa, Mycobacterium avium
RGGAELDTARAEWWYSRA

SEQ ID NO: 103182 - protein, 19 aa, Mycobacterium avium
RGGEAPSWAPLRVQYADYA

SEQ ID NO: 103183 - protein, 19 aa, Mycobacterium avium
RGGESYRLFGNRGTARYVG

SEQ ID NO: 103184 - protein, 19 aa, Mycobacterium avium
RGGEWKFAVTKDGRHSLTH

SEQ ID NO: 103185 - protein, 17 aa, Mycobacterium avium
RGGHRPHRRGRLVDDDV

SEQ ID NO: 103186 - protein, 25 aa, Mycobacterium avium
RGGKISFTHLLGYALVQAIKKFPNM

SEQ ID NO: 103187 - protein, 20 aa, Mycobacterium avium
RGGPERSCVIESAREHGGRL

SEQ ID NO: 103188 - protein, 17 aa, Mycobacterium avium
RGGPRGDGWIDVPPRQG

SEQ ID NO: 103189 - protein, 25 aa, Mycobacterium avium
RGGVGGEWRRPPVRDGGCTRRADRT

SEQ ID NO: 103190 - protein, 20 aa, Mycobacterium avium
RGGVITWLGGDDVGRSLFPD

SEQ ID NO: 103191 - protein, 20 aa, Mycobacterium avium
RGGVVPMSFVQATPEFVAAA

SEQ ID NO: 103192 - protein, 23 aa, Mycobacterium avium
RGHLRKFGLSRVRVRELAHAGQL

SEQ ID NO: 103193 - protein, 29 aa, Mycobacterium avium
RGHRLDWAGVFAGLPARRVELPTYAFARE

SEQ ID NO: 103194 - protein, 17 aa, Mycobacterium avium
RGIARPVQIVPSRVELP

SEQ ID NO: 103195 - protein, 26 aa, Mycobacterium avium
RGICPAYRAAGYSIRTFAEYAAWSDA

SEQ ID NO: 103196 - protein, 21 aa, Mycobacterium avium
RGIDMSRLLTAGWDIPGRCDI

SEQ ID NO: 103197 - protein, 18 aa, Mycobacterium avium
RGIPPGNVGAVWRGTWHG

SEQ ID NO: 103198 - protein, 18 aa, Mycobacterium avium
RGIPRPPGGSGYYQPTGI

SEQ ID NO: 103199 - protein, 25 aa, Mycobacterium avium
RGISAALADRGWRVYATSRTIADTP

SEQ ID NO: 103200 - protein, 24 aa, Mycobacterium avium
RGISAALADRGWRVYATSRTIGDT

SEQ ID NO: 103201 - protein, 25 aa, Mycobacterium avium
RGISAALADRGWRVYATSRTIGDTP

SEQ ID NO: 103202 - protein, 18 aa, Mycobacterium avium
RGIYCGTIGLASPVAGCE

SEQ ID NO: 103203 - protein, 19 aa, Mycobacterium avium
RGKVGPFRVEGTAHAGGSG

SEQ ID NO: 103204 - protein, 19 aa, Mycobacterium avium
RGKVGPFRVEGTAHPGASG

SEQ ID NO: 103205 - protein, 24 aa, Mycobacterium avium
RGLAREIACAYDLEFVDPADVKPL

SEQ ID NO: 103206 - protein, 20 aa, Mycobacterium avium
RGLARGGTFVTLGYASGTIP

SEQ ID NO: 103207 - protein, 31 aa, Mycobacterium avium
RGLDMRPNPGIGFPGYVDYLPVTRGTPQPPS

SEQ ID NO: 103208 - protein, 19 aa, Mycobacterium avium
RGLGIADEVIDRVCFVMER

SEQ ID NO: 103209 - protein, 17 aa, Mycobacterium avium
RGLQVVGGRGSGAVMVL

SEQ ID NO: 103210 - protein, 22 aa, Mycobacterium avium
RGLRETGFWRFVRDPDDPSESQ

SEQ ID NO: 103211 - protein, 24 aa, Mycobacterium avium
RGLRKLRAALPLVDPGAASPKETW

SEQ ID NO: 103212 - protein, 17 aa, Mycobacterium avium
RGLRLSGFEVSTAVDGA

SEQ ID NO: 103213 - protein, 21 aa, Mycobacterium avium
RGMALRARLILDCTNIRELAE

SEQ ID NO: 103214 - protein, 25 aa, Mycobacterium avium
RGMELFCAGAHPFAQWTTQKLTDAP

SEQ ID NO: 103215 - protein, 18 aa, Mycobacterium avium
RGMGLGQGVLEAWRGQPQ

SEQ ID NO: 103216 - protein, 17 aa, Mycobacterium avium
RGMKIAVLDVDEHAAQR

SEQ ID NO: 103217 - protein, 17 aa, Mycobacterium avium
RGMKIAVLDVNEHAAQR

SEQ ID NO: 103218 - protein, 17 aa, Mycobacterium avium
RGPGAIIPPTFLTSAAR

SEQ ID NO: 103219 - protein, 18 aa, Mycobacterium avium
RGPLYGRHVIVTGASSGI

SEQ ID NO: 103220 - protein, 24 aa, Mycobacterium avium
RGPRGADTLTDWGGHVIVGGVMPS

SEQ ID NO: 103221 - protein, 17 aa, Mycobacterium avium
RGPRYVVAMLAVLKAGG

SEQ ID NO: 103222 - protein, 24 aa, Mycobacterium avium
RGQRPADDVYLVFTANEEIGGVGG

SEQ ID NO: 103223 - protein, 20 aa, Mycobacterium avium
RGRAAAIERAVIRLDDLTDV

SEQ ID NO: 103224 - protein, 20 aa, Mycobacterium avium
RGRHALDAAVALLREAGAPD

SEQ ID NO: 103225 - protein, 20 aa, Mycobacterium avium
RGRNGVLYAGEVNWEAAGLG

SEQ ID NO: 103226 - protein, 21 aa, Mycobacterium avium
RGRPDLGWFPGLAARLRAADR

SEQ ID NO: 103227 - protein, 21 aa, Mycobacterium avium
RGRPDLGWFPGLAARLRAAER

SEQ ID NO: 103228 - protein, 24 aa, Mycobacterium avium
RGRPWPAHQPRYMVRSTIAATAAD

SEQ ID NO: 103229 - protein, 23 aa, Mycobacterium avium
RGRSGRPWLQASVNFAFGDDEAV

SEQ ID NO: 103230 - protein, 19 aa, Mycobacterium avium
RGRWGCVLGGDPDRRVTAM

SEQ ID NO: 103231 - protein, 24 aa, Mycobacterium avium
RGSGERAYKVVFKDATDGGYLVTL

SEQ ID NO: 103232 - protein, 19 aa, Mycobacterium avium
RGSISLPLVITDMPDPGGC

SEQ ID NO: 103233 - protein, 27 aa, Mycobacterium avium
RGSTAELRTATPLGDVFVALKPPPGDH

SEQ ID NO: 103234 - protein, 18 aa, Mycobacterium avium
RGSVPGLFNALHAEITFE

SEQ ID NO: 103235 - protein, 21 aa, Mycobacterium avium
RGSWRRYRRYVGFLDGVGPQR

SEQ ID NO: 103236 - protein, 25 aa, Mycobacterium avium
RGVACGYLGRPSLTGSRFVACPFGA

SEQ ID NO: 103237 - protein, 17 aa, Mycobacterium avium
RGVDKFICAMGVGDGQL

SEQ ID NO: 103238 - protein, 18 aa, Mycobacterium avium
RGVGVVALHAWSDVGVFP

SEQ ID NO: 103239 - protein, 19 aa, Mycobacterium avium
RGVGVVALHAWSDVGVFPI

SEQ ID NO: 103240 - protein, 19 aa, Mycobacterium avium
RGVHPVKLPGVTDTGLDDQ

SEQ ID NO: 103241 - protein, 17 aa, Mycobacterium avium
RGVLSVRAKIKVRLTQL

SEQ ID NO: 103242 - protein, 19 aa, Mycobacterium avium
RGVLYFRTGRWPDVLNQFP

SEQ ID NO: 103243 - protein, 17 aa, Mycobacterium avium
RGVRLGRGRGFYDRSLG

SEQ ID NO: 103244 - protein, 32 aa, Mycobacterium avium
RGWEALAGDEVWNWADELAQLPSLLAEKVKAP

SEQ ID NO: 103245 - protein, 24 aa, Mycobacterium avium
RGYWEPRAAIMLNEAILRRHDSNW

SEQ ID NO: 103246 - protein, 24 aa, Mycobacterium avium
RGYWKRPALTATRFVANPYGGDPG

SEQ ID NO: 103247 - protein, 25 aa, Mycobacterium avium
RGYWKRPGLTAARFVANPFGAEPGS

SEQ ID NO: 103248 - protein, 17 aa, Mycobacterium avium
RHAAIALALAAGRQHAL

SEQ ID NO: 103249 - protein, 26 aa, Mycobacterium avium
RHAMLRLCLDDDGAGGWDLHVPPPGS

SEQ ID NO: 103250 - protein, 26 aa, Mycobacterium avium
RHCFELDGELPIRVAVLRVANAAEHV

SEQ ID NO: 103251 - protein, 21 aa, Mycobacterium avium
RHDGQKFAWVRETKLLVDDEP

SEQ ID NO: 103252 - protein, 19 aa, Mycobacterium avium
RHEHLWLHFARHGPDITPP

SEQ ID NO: 103253 - protein, 21 aa, Mycobacterium avium
RHELIAEAFGGKGYHVSTAAE

SEQ ID NO: 103254 - protein, 20 aa, Mycobacterium avium
RHELPWLTPDWVNIDHRRGA

SEQ ID NO: 103255 - protein, 21 aa, Mycobacterium avium
RHIAAHPSPTGWRTDPAELAA

SEQ ID NO: 103256 - protein, 26 aa, Mycobacterium avium
RHIKNRRLAAVGPIWALGSLRASPGA

SEQ ID NO: 103257 - protein, 20 aa, Mycobacterium avium
RHLAGLPGPTLLAAALGSVE

SEQ ID NO: 103258 - protein, 17 aa, Mycobacterium avium
RHLDGKAGVAIALALAK

SEQ ID NO: 103259 - protein, 21 aa, Mycobacterium avium
RHLEIRWDGQVALLSDLNSTN

SEQ ID NO: 103260 - protein, 20 aa, Mycobacterium avium
RHLGGILYLFVRGMCGPDTP

SEQ ID NO: 103261 - protein, 24 aa, Mycobacterium avium
RHLPEIRAGRQLWCQLFSEPGAGS

SEQ ID NO: 103262 - protein, 17 aa, Mycobacterium avium
RHLTFGRGVHFCLGAPL

SEQ ID NO: 103263 - protein, 26 aa, Mycobacterium avium
RHLVLPMFVADGIDEPRPIASMPKVV

SEQ ID NO: 103264 - protein, 19 aa, Mycobacterium avium
RHMDDTLPNAGHRALATLE

SEQ ID NO: 103265 - protein, 26 aa, Mycobacterium avium
RHNIGSAAWLCRADALHPVTRDAVLM

SEQ ID NO: 103266 - protein, 17 aa, Mycobacterium avium
RHPAMGFLDGLLDVVRK

SEQ ID NO: 103267 - protein, 19 aa, Mycobacterium avium
RHPDAVVLHLGCGLDGRAF

SEQ ID NO: 103268 - protein, 23 aa, Mycobacterium avium
RHPGTRIGVIVNDFGDINIDAGL

SEQ ID NO: 103269 - protein, 20 aa, Mycobacterium avium
RHPMLRVRFLPDGTQCITPA

SEQ ID NO: 103270 - protein, 19 aa, Mycobacterium avium
RHPMLRVRFLPDGTQRIAP

SEQ ID NO: 103271 - protein, 30 aa, Mycobacterium avium
RHPTLKLLSGHWGELAAFYLERLDETLGLL

SEQ ID NO: 103272 - protein, 20 aa, Mycobacterium avium
RHQFTKDEVQAIVAALDAAG

SEQ ID NO: 103273 - protein, 20 aa, Mycobacterium avium
RHQFTKDEVQAIVAALDVAG

SEQ ID NO: 103274 - protein, 23 aa, Mycobacterium avium
RHQSVLQLLALRNARHVPPADPA

SEQ ID NO: 103275 - protein, 18 aa, Mycobacterium avium
RHRHRVGGALHVFGEGLG

SEQ ID NO: 103276 - protein, 22 aa, Mycobacterium avium
RHRLRHPGHLGGEQFGHRHPAP

SEQ ID NO: 103277 - protein, 26 aa, Mycobacterium avium
RHRVEFAQRLFLALAVLEHPRGFLDE

SEQ ID NO: 103278 - protein, 17 aa, Mycobacterium avium
RHTPYRCMLGGPPGGLP

SEQ ID NO: 103279 - protein, 19 aa, Mycobacterium avium
RHVHPSTLYPGGVGTVATI

SEQ ID NO: 103280 - protein, 34 aa, Mycobacterium avium
RHVKAAMLRARHRIMLVGWDFDSRVTFERGDKTL

SEQ ID NO: 103281 - protein, 18 aa, Mycobacterium avium
RIAALALRNRCTKTLGGR

SEQ ID NO: 103282 - protein, 19 aa, Mycobacterium avium
RIAARPAAVLLHLGPGLGN

SEQ ID NO: 103283 - protein, 26 aa, Mycobacterium avium
RIACEPRGDGGFGYDPVFVPDDAGGR

SEQ ID NO: 103284 - protein, 28 aa, Mycobacterium avium
RIADLVPLGRPILCTEYMARPLGSTVQT

SEQ ID NO: 103285 - protein, 17 aa, Mycobacterium avium
RIAEDFTALGKEVITAR

SEQ ID NO: 103286 - protein, 24 aa, Mycobacterium avium
RIAHDQCDAWTGLAAAGDTSLRVL

SEQ ID NO: 103287 - protein, 19 aa, Mycobacterium avium
RIALCGNLSGGQRTRVSLA

SEQ ID NO: 103288 - protein, 18 aa, Mycobacterium avium
RIALGALLDLLPEYEVDR

SEQ ID NO: 103289 - protein, 27 aa, Mycobacterium avium
RIAPALRHATTEWGRPPPRIVAGLPVA

SEQ ID NO: 103290 - protein, 35 aa, Mycobacterium avium
RIAPALRHATTEWGRPPPRIVAGLPVAVHDDPVEA

SEQ ID NO: 103291 - protein, 20 aa, Mycobacterium avium
RIAPPELFTTLASRYGAAIT

SEQ ID NO: 103292 - protein, 19 aa, Mycobacterium avium
RIAQDFDATLCWMADNTTL

SEQ ID NO: 103293 - protein, 25 aa, Mycobacterium avium
RIATCWRTGAHYVLRDTDGRPITFE

SEQ ID NO: 103294 - protein, 20 aa, Mycobacterium avium
RIAVSYHTPVIVLSDGAIAN

SEQ ID NO: 103295 - protein, 21 aa, Mycobacterium avium
RIDLGWEQWRVGVEYDGAQHW

SEQ ID NO: 103296 - protein, 22 aa, Mycobacterium avium
RIDLGWEQWRVGVEYDGAQHWT

SEQ ID NO: 103297 - protein, 17 aa, Mycobacterium avium
RIDLPVALMERAATTGW

SEQ ID NO: 103298 - protein, 20 aa, Mycobacterium avium
RIELEPVAPFVALRHIRFHA

SEQ ID NO: 103299 - protein, 20 aa, Mycobacterium avium
RIELEPVAPFVTLRHIRFHA

SEQ ID NO: 103300 - protein, 25 aa, Mycobacterium avium
RIELGEVRAALAWVDGVDQAVVVAR

SEQ ID NO: 103301 - protein, 21 aa, Mycobacterium avium
RIERGLWLTALLRATLAVVRG

SEQ ID NO: 103302 - protein, 19 aa, Mycobacterium avium
RIEVGEIRSALAALDGVDE

SEQ ID NO: 103303 - protein, 17 aa, Mycobacterium avium
RIEVPPEVARYVVEKGS

SEQ ID NO: 103304 - protein, 18 aa, Mycobacterium avium
RIGAPIPGVCARVLDGWL

SEQ ID NO: 103305 - protein, 17 aa, Mycobacterium avium
RIGGPLRLFPKAAQPGA

SEQ ID NO: 103306 - protein, 18 aa, Mycobacterium avium
RIGIFGLAVPEEYGGSPV

SEQ ID NO: 103307 - protein, 24 aa, Mycobacterium avium
RIHRLAAGVSLDWELLAQGAQAAK

SEQ ID NO: 103308 - protein, 25 aa, Mycobacterium avium
RIIADHSRTAAILIGDGVTPGNDGR

SEQ ID NO: 103309 - protein, 19 aa, Mycobacterium avium
RIITSPAFTGDRVLAAILF

SEQ ID NO: 103310 - protein, 19 aa, Mycobacterium avium
RILAEANHPLVIQAETMDS

SEQ ID NO: 103311 - protein, 17 aa, Mycobacterium avium
RILDRLYGYEVTPVLWK

SEQ ID NO: 103312 - protein, 25 aa, Mycobacterium avium
RILTWPNPFLPIFIQEPGEWFGIGP

SEQ ID NO: 103313 - protein, 18 aa, Mycobacterium avium
RINEGAAMIRSKGEAGTG

SEQ ID NO: 103314 - protein, 20 aa, Mycobacterium avium
RINPAIIYVVGSGFGLKGPD

SEQ ID NO: 103315 - protein, 27 aa, Mycobacterium avium
RIPEIRPAQVVSIRPGDLLVMRTDGII

SEQ ID NO: 103316 - protein, 32 aa, Mycobacterium avium
RIPEIRPAQVVSIRPGDLLVMRTDGIIDDYLD

SEQ ID NO: 103317 - protein, 29 aa, Mycobacterium avium
RIPQAVRYEAWSFPDFETGAAALRAVTQN

SEQ ID NO: 103318 - protein, 30 aa, Mycobacterium avium
RIPQAVRYEAWSFPDFETGAAALRAVTQNG

SEQ ID NO: 103319 - protein, 30 aa, Mycobacterium avium
RIPQAVRYEAWSFPDFETGAAALRVVTQNG

SEQ ID NO: 103320 - protein, 19 aa, Mycobacterium avium
RIRAGFMGVNGGAPYGADT

SEQ ID NO: 103321 - protein, 20 aa, Mycobacterium avium
RIRARGQSVLRLDRGDATPV

SEQ ID NO: 103322 - protein, 17 aa, Mycobacterium avium
RIRGYEVDEANAVRVHS

SEQ ID NO: 103323 - protein, 22 aa, Mycobacterium avium
RIRQRFWAGRVIHTIRRSADGL

SEQ ID NO: 103324 - protein, 18 aa, Mycobacterium avium
RIRVNGVAPTNCSTPMIT

SEQ ID NO: 103325 - protein, 26 aa, Mycobacterium avium
RISGFAEILGFYGLNYWYPFQVTALG

SEQ ID NO: 103326 - protein, 24 aa, Mycobacterium avium
RISLDRPAYVYPLFEQALRVSTGE

SEQ ID NO: 103327 - protein, 25 aa, Mycobacterium avium
RITFDGFCVKSSYEAMRTGLLTDGP

SEQ ID NO: 103328 - protein, 19 aa, Mycobacterium avium
RITVAGAVPTQWAKLLEVD

SEQ ID NO: 103329 - protein, 20 aa, Mycobacterium avium
RIVLDWPERANAQSSEMVSQ

SEQ ID NO: 103330 - protein, 26 aa, Mycobacterium avium
RIVLLEALAVLGWERWSAIGHRYNIG

SEQ ID NO: 103331 - protein, 23 aa, Mycobacterium avium
RIWSALRRIPLRELRRTGLLDKL

SEQ ID NO: 103332 - protein, 24 aa, Mycobacterium avium
RIWSALRRIPLRELRRTGLLDKLL

SEQ ID NO: 103333 - protein, 17 aa, Mycobacterium avium
RIWYRTGDLVRYWPDGT

SEQ ID NO: 103334 - protein, 17 aa, Mycobacterium avium
RIYRDVRLLRLYEGTSE

SEQ ID NO: 103335 - protein, 19 aa, Mycobacterium avium
RKAAEFGDEVIRQFTQDIE

SEQ ID NO: 103336 - protein, 25 aa, Mycobacterium avium
RKAARKHGVPVYAVAPFATRSLTKM

SEQ ID NO: 103337 - protein, 18 aa, Mycobacterium avium
RKAPEPDSAAAAAAASAR

SEQ ID NO: 103338 - protein, 27 aa, Mycobacterium avium
RKAWVPRLAAMDVIASYCLTEPGAGSD

SEQ ID NO: 103339 - protein, 18 aa, Mycobacterium avium
RKDGFVIVAECADGDEVP

SEQ ID NO: 103340 - protein, 19 aa, Mycobacterium avium
RKELIIRGGENIAPAEVEE

SEQ ID NO: 103341 - protein, 19 aa, Mycobacterium avium
RKGGHVLCGVDGRVYGVDH

SEQ ID NO: 103342 - protein, 20 aa, Mycobacterium avium
RKGGTCVLTGMPKITDLMVP

SEQ ID NO: 103343 - protein, 18 aa, Mycobacterium avium
RKGVLIGDTVMIRKAGDV

SEQ ID NO: 103344 - protein, 19 aa, Mycobacterium avium
RKHPAFFGGVTNLAWSIDK

SEQ ID NO: 103345 - protein, 17 aa, Mycobacterium avium
RKIKIGMWRQANVAKVG

SEQ ID NO: 103346 - protein, 18 aa, Mycobacterium avium
RKIPPAWLESGVVKAAMT

SEQ ID NO: 103347 - protein, 17 aa, Mycobacterium avium
RKLAATCDVFLTSYLPT

SEQ ID NO: 103348 - protein, 25 aa, Mycobacterium avium
RKLAPRPSSTIAYWDVALDGGLVGI

SEQ ID NO: 103349 - protein, 19 aa, Mycobacterium avium
RKLDLTLGRVPRVDSYGGF

SEQ ID NO: 103350 - protein, 21 aa, Mycobacterium avium
RKLIGGTCVNTGCIPTKTLVA

SEQ ID NO: 103351 - protein, 20 aa, Mycobacterium avium
RKLPHEQSCFGATLRDPSPG

SEQ ID NO: 103352 - protein, 32 aa, Mycobacterium avium
RKLPIFGGPFRWEDLEWLRSRTSLPLMAKGIC

SEQ ID NO: 103353 - protein, 17 aa, Mycobacterium avium
RKLPSSAMEAFFEESMK

SEQ ID NO: 103354 - protein, 18 aa, Mycobacterium avium
RKLQQPRRAAVSSYGVSG

SEQ ID NO: 103355 - protein, 22 aa, Mycobacterium avium
RKLTPHCFRHSFISHMTEDGVD

SEQ ID NO: 103356 - protein, 22 aa, Mycobacterium avium
RKMARGDWIVFYSPKTVYPDGE

SEQ ID NO: 103357 - protein, 20 aa, Mycobacterium avium
RKPRFGHGVVAELAPGVRLL

SEQ ID NO: 103358 - protein, 19 aa, Mycobacterium avium
RKRGRRISVVDVELTQGER

SEQ ID NO: 103359 - protein, 17 aa, Mycobacterium avium
RKRLRALKYSKQMIDDV

SEQ ID NO: 103360 - protein, 17 aa, Mycobacterium avium
RKRLRALKYSKQMVDDV

SEQ ID NO: 103361 - protein, 18 aa, Mycobacterium avium
RKRLRALRYSKQMVDDVS

SEQ ID NO: 103362 - protein, 18 aa, Mycobacterium avium
RKRMPAFFQPDEYGVPDV

SEQ ID NO: 103363 - protein, 17 aa, Mycobacterium avium
RKRPVRAVLVFTDEDGR

SEQ ID NO: 103364 - protein, 21 aa, Mycobacterium avium
RKSVALRAGRRVVAEVRATAI

SEQ ID NO: 103365 - protein, 18 aa, Mycobacterium avium
RKVKKWLVDGDFDVLHLH

SEQ ID NO: 103366 - protein, 25 aa, Mycobacterium avium
RKVLPRKPAHLVIRMYSALTEAVFF

SEQ ID NO: 103367 - protein, 24 aa, Mycobacterium avium
RKVLPRNPAHLVIRMYSALTEAVF

SEQ ID NO: 103368 - protein, 18 aa, Mycobacterium avium
RKVRFLPYGIAVSVLDDD

SEQ ID NO: 103369 - protein, 19 aa, Mycobacterium avium
RKVRRLRRLAGLWLAGQDR

SEQ ID NO: 103370 - protein, 20 aa, Mycobacterium avium
RKVRRLRRLAGLWLAGQDRG

SEQ ID NO: 103371 - protein, 25 aa, Mycobacterium avium
RKVRRLRRLAGLWLAGQDRRWAAIR

SEQ ID NO: 103372 - protein, 21 aa, Mycobacterium avium
RKVVDDEFPGRVLLAEANQWP

SEQ ID NO: 103373 - protein, 23 aa, Mycobacterium avium
RKWAKTHPAELAALLASQATVSQ

SEQ ID NO: 103374 - protein, 21 aa, Mycobacterium avium
RKWLSGVRRNGRPSERALYGA

SEQ ID NO: 103375 - protein, 19 aa, Mycobacterium avium
RLAAAGVTWLTIAPSGSDR

SEQ ID NO: 103376 - protein, 20 aa, Mycobacterium avium
RLAAGIPGVQRWLAGQLSGL

SEQ ID NO: 103377 - protein, 20 aa, Mycobacterium avium
RLAAHLARQVFRSWYILYFQ

SEQ ID NO: 103378 - protein, 20 aa, Mycobacterium avium
RLAAHLARQVFRSWYIMYFQ

SEQ ID NO: 103379 - protein, 21 aa, Mycobacterium avium
RLADFIRCRDLTCRAPGCDRP

SEQ ID NO: 103380 - protein, 19 aa, Mycobacterium avium
RLADLAGAYTKAAPDLLDF

SEQ ID NO: 103381 - protein, 31 aa, Mycobacterium avium
RLAGHALKASIAWRALRALLLSRRGDYDEAR

SEQ ID NO: 103382 - protein, 27 aa, Mycobacterium avium
RLAGHALKASIAWRTLRALLLSRRGDY

SEQ ID NO: 103383 - protein, 28 aa, Mycobacterium avium
RLAGHALKASIAWRTLRALLLSRRGDYD

SEQ ID NO: 103384 - protein, 19 aa, Mycobacterium avium
RLAGYRSGNRLVRVDLNEL

SEQ ID NO: 103385 - protein, 20 aa, Mycobacterium avium
RLALGSKWVESGLVVVGEDG

SEQ ID NO: 103386 - protein, 20 aa, Mycobacterium avium
RLALTDFPPNFNILHIDGNS

SEQ ID NO: 103387 - protein, 18 aa, Mycobacterium avium
RLAQILIERCRLRGVGIR

SEQ ID NO: 103388 - protein, 18 aa, Mycobacterium avium
RLAQLAAGVFFREPRQVV

SEQ ID NO: 103389 - protein, 26 aa, Mycobacterium avium
RLARAARWGAAPLKAPALEAILAATG

SEQ ID NO: 103390 - protein, 19 aa, Mycobacterium avium
RLARAARWGATPLKAPALE

SEQ ID NO: 103391 - protein, 20 aa, Mycobacterium avium
RLARAARWGATPVKAPALEA

SEQ ID NO: 103392 - protein, 28 aa, Mycobacterium avium
RLARRIECSPLPFGRHRWVSTGAQGALE

SEQ ID NO: 103393 - protein, 17 aa, Mycobacterium avium
RLARRPVSHIALTHKHF

SEQ ID NO: 103394 - protein, 20 aa, Mycobacterium avium
RLASGAFVYTAFAIDAYAGR

SEQ ID NO: 103395 - protein, 21 aa, Mycobacterium avium
RLAVEAMTALVARHLDLAAVA

SEQ ID NO: 103396 - protein, 25 aa, Mycobacterium avium
RLAVEAMTALVARHVDLAAVAAVAA

SEQ ID NO: 103397 - protein, 18 aa, Mycobacterium avium
RLAVKYQALTGLRYVDVS

SEQ ID NO: 103398 - protein, 19 aa, Mycobacterium avium
RLAYAGIRLTDFHSAPACS

SEQ ID NO: 103399 - protein, 24 aa, Mycobacterium avium
RLCDWCPHQQLCPLFDGTPPPYPG

SEQ ID NO: 103400 - protein, 19 aa, Mycobacterium avium
RLCELDFELPLAGGDRRSA

SEQ ID NO: 103401 - protein, 21 aa, Mycobacterium avium
RLCPHAVVVPPRMHAYSRASD

SEQ ID NO: 103402 - protein, 23 aa, Mycobacterium avium
RLCRAEFLHYLRIREWQDLVGQL

SEQ ID NO: 103403 - protein, 17 aa, Mycobacterium avium
RLDAGLFTGTFLEGELT

SEQ ID NO: 103404 - protein, 20 aa, Mycobacterium avium
RLDDEALLFVELGKRLAPGP

SEQ ID NO: 103405 - protein, 19 aa, Mycobacterium avium
RLDDLPVLYELAAEDGEGA

SEQ ID NO: 103406 - protein, 23 aa, Mycobacterium avium
RLDGLCARILRIGDHDDVATHIT

SEQ ID NO: 103407 - protein, 24 aa, Mycobacterium avium
RLDLSRPVGRDVILECIRLAMQAP

SEQ ID NO: 103408 - protein, 26 aa, Mycobacterium avium
RLDPERGTLLAAVWLRPPAGESVLLL

SEQ ID NO: 103409 - protein, 26 aa, Mycobacterium avium
RLDPERGVLLGAVWLRPADGDGVLLL

SEQ ID NO: 103410 - protein, 18 aa, Mycobacterium avium
RLDPPAPFVPRVSTQEVT

SEQ ID NO: 103411 - protein, 19 aa, Mycobacterium avium
RLDPRLRMLVPVNDYPLID

SEQ ID NO: 103412 - protein, 20 aa, Mycobacterium avium
RLDPRLRMLVPVNDYPLIDA

SEQ ID NO: 103413 - protein, 22 aa, Mycobacterium avium
RLDWKFLRWVWRYPIDSRPLLD

SEQ ID NO: 103414 - protein, 17 aa, Mycobacterium avium
RLDWQLRHYPPRTDDVR

SEQ ID NO: 103415 - protein, 19 aa, Mycobacterium avium
RLDWSTPHDIGRKAIAQNA

SEQ ID NO: 103416 - protein, 20 aa, Mycobacterium avium
RLEHCAAEWVRAPGVSGERA

SEQ ID NO: 103417 - protein, 18 aa, Mycobacterium avium
RLEKELVRDPAAVADVDE

SEQ ID NO: 103418 - protein, 21 aa, Mycobacterium avium
RLELKLIVGEWLRRIPEFSVK

SEQ ID NO: 103419 - protein, 23 aa, Mycobacterium avium
RLEPYRRMWVLRLLDMALDESGV

SEQ ID NO: 103420 - protein, 21 aa, Mycobacterium avium
RLEQRLGVALFDRHGRRLSLN

SEQ ID NO: 103421 - protein, 20 aa, Mycobacterium avium
RLESELLALVATRQPQNAIS

SEQ ID NO: 103422 - protein, 18 aa, Mycobacterium avium
RLESPVQLTARMALDDVE

SEQ ID NO: 103423 - protein, 18 aa, Mycobacterium avium
RLETGWVNTDFVDEKLPE

SEQ ID NO: 103424 - protein, 27 aa, Mycobacterium avium
RLEVAVLLQEWLRRVPDYAIRADAATR

SEQ ID NO: 103425 - protein, 18 aa, Mycobacterium avium
RLFLPAAGVSNWLVDTGI

SEQ ID NO: 103426 - protein, 19 aa, Mycobacterium avium
RLFSGLRPAELHRFVELHG

SEQ ID NO: 103427 - protein, 19 aa, Mycobacterium avium
RLGADLAKQGFAPKIEVSK

SEQ ID NO: 103428 - protein, 19 aa, Mycobacterium avium
RLGAELCALLPDEREAHAL

SEQ ID NO: 103429 - protein, 18 aa, Mycobacterium avium
RLGAEPFAGSLDDLDRLR

SEQ ID NO: 103430 - protein, 19 aa, Mycobacterium avium
RLGAGLAAMFPGLTSVEVG

SEQ ID NO: 103431 - protein, 20 aa, Mycobacterium avium
RLGALIANGATMTRVPARSG

SEQ ID NO: 103432 - protein, 19 aa, Mycobacterium avium
RLGAPREIAHAICALLDED

SEQ ID NO: 103433 - protein, 24 aa, Mycobacterium avium
RLGERLPAYMVPAAIVALDAIPLT

SEQ ID NO: 103434 - protein, 17 aa, Mycobacterium avium
RLGGPAGGTLFYPDCSN

SEQ ID NO: 103435 - protein, 17 aa, Mycobacterium avium
RLGGWLDGHPARPRLIN

SEQ ID NO: 103436 - protein, 18 aa, Mycobacterium avium
RLGHRVGVVGQVVKSQLD

SEQ ID NO: 103437 - protein, 18 aa, Mycobacterium avium
RLGIPTGPAMVLTVPGRK

SEQ ID NO: 103438 - protein, 24 aa, Mycobacterium avium
RLGITTDWKSRWYADKQYADYVKE

SEQ ID NO: 103439 - protein, 21 aa, Mycobacterium avium
RLGKRVLRPGGVELTRTLLSH

SEQ ID NO: 103440 - protein, 20 aa, Mycobacterium avium
RLGLEATVRPSFAFYNTFEE

SEQ ID NO: 103441 - protein, 20 aa, Mycobacterium avium
RLGPPPDEPNAFVVEGAPTS

SEQ ID NO: 103442 - protein, 19 aa, Mycobacterium avium
RLGQRLPSFMVPSAVVVLD

SEQ ID NO: 103443 - protein, 19 aa, Mycobacterium avium
RLGRLTTHLHMAWQANPHL

SEQ ID NO: 103444 - protein, 24 aa, Mycobacterium avium
RLGRMALAAGDPWDLVIGNLTRPK

SEQ ID NO: 103445 - protein, 27 aa, Mycobacterium avium
RLGSRDAKARWLPPLVSGSLRATTALW

SEQ ID NO: 103446 - protein, 18 aa, Mycobacterium avium
RLGTPPHPIPQSPAQRIR

SEQ ID NO: 103447 - protein, 27 aa, Mycobacterium avium
RLGVEEELLRLGARPGCAVTIGDMTFD

SEQ ID NO: 103448 - protein, 31 aa, Mycobacterium avium
RLGVTELQFRPEVSDGLFLQLAVTSVESLAC

SEQ ID NO: 103449 - protein, 20 aa, Mycobacterium avium
RLHAELAVTILVVAHDLNPL

SEQ ID NO: 103450 - protein, 26 aa, Mycobacterium avium
RLHNGTVYRWNRPVYDVAEGRPHLRL

SEQ ID NO: 103451 - protein, 17 aa, Mycobacterium avium
RLIFPLNTILELDDIPE

SEQ ID NO: 103452 - protein, 20 aa, Mycobacterium avium
RLIGMCYPYEVNLVADAKAA

SEQ ID NO: 103453 - protein, 20 aa, Mycobacterium avium
RLIPRTLMRAITKRVGGGRG

SEQ ID NO: 103454 - protein, 19 aa, Mycobacterium avium
RLIRRGVEAVVPVAKSVLA

SEQ ID NO: 103455 - protein, 20 aa, Mycobacterium avium
RLKAASLLAPVLRTGLASSS

SEQ ID NO: 103456 - protein, 17 aa, Mycobacterium avium
RLKRGGTNLSQVLKDAE

SEQ ID NO: 103457 - protein, 23 aa, Mycobacterium avium
RLKRLRTPTLVLWGRDDKVNRPA

SEQ ID NO: 103458 - protein, 21 aa, Mycobacterium avium
RLLDCCQETDGAVAIVVTSVE

SEQ ID NO: 103459 - protein, 23 aa, Mycobacterium avium
RLLDDPFLLCFNAHHESIEFTLP

SEQ ID NO: 103460 - protein, 20 aa, Mycobacterium avium
RLLDFMPRYDVDWAGCRRVT

SEQ ID NO: 103461 - protein, 21 aa, Mycobacterium avium
RLLEHVEIKGATTIAMIARAR

SEQ ID NO: 103462 - protein, 21 aa, Mycobacterium avium
RLLEHVEIKGATTIAMIQRAC

SEQ ID NO: 103463 - protein, 19 aa, Mycobacterium avium
RLLFEGCTMHAGQACILNS

SEQ ID NO: 103464 - protein, 19 aa, Mycobacterium avium
RLLGGELRQGALAGIMADA

SEQ ID NO: 103465 - protein, 24 aa, Mycobacterium avium
RLLGLKAACAFADEPDCVRELAAM

SEQ ID NO: 103466 - protein, 17 aa, Mycobacterium avium
RLLGPGGRFIEMGKTDL

SEQ ID NO: 103467 - protein, 20 aa, Mycobacterium avium
RLLGVAYAGLLARAARLTDS

SEQ ID NO: 103468 - protein, 33 aa, Mycobacterium avium
RLLIVVAGYCGLRWGELAALRWADVDLANKTLR

SEQ ID NO: 103469 - protein, 20 aa, Mycobacterium avium
RLLLETSWDAIEHAGLDPAS

SEQ ID NO: 103470 - protein, 20 aa, Mycobacterium avium
RLLRDGREVTRFAGEAAEFD

SEQ ID NO: 103471 - protein, 23 aa, Mycobacterium avium
RLLRSMCSPTPLSELQRRALEHG

SEQ ID NO: 103472 - protein, 26 aa, Mycobacterium avium
RLLSEEDRRFAVVFAHDQSDYARMEA

SEQ ID NO: 103473 - protein, 26 aa, Mycobacterium avium
RLLVQEVAVGALLVRFAAGDHVQQQP

SEQ ID NO: 103474 - protein, 17 aa, Mycobacterium avium
RLLVRLAGVTDRDAADA

SEQ ID NO: 103475 - protein, 20 aa, Mycobacterium avium
RLMEWCAMVGCPIIGIQDSG

SEQ ID NO: 103476 - protein, 18 aa, Mycobacterium avium
RLMHRLGRIPPVEYEAIY

SEQ ID NO: 103477 - protein, 25 aa, Mycobacterium avium
RLMWPSLEGDIRWCQLFSEPGAGSD

SEQ ID NO: 103478 - protein, 19 aa, Mycobacterium avium
RLMWRLCKINGKPSRYRSE

SEQ ID NO: 103479 - protein, 24 aa, Mycobacterium avium
RLNKEIKRRTDVVGVFPNPAALLR

SEQ ID NO: 103480 - protein, 25 aa, Mycobacterium avium
RLNKEIKRRTDVVGVFPNPAALLRP

SEQ ID NO: 103481 - protein, 19 aa, Mycobacterium avium
RLNPCLYPTGAFQPQNAED

SEQ ID NO: 103482 - protein, 19 aa, Mycobacterium avium
RLNPCLYPTGAFQPQNAGD

SEQ ID NO: 103483 - protein, 26 aa, Mycobacterium avium
RLPAPAPYRRFVTWLAERDLDAARAA

SEQ ID NO: 103484 - protein, 23 aa, Mycobacterium avium
RLPEVVTATLALPVEALIADGEA

SEQ ID NO: 103485 - protein, 24 aa, Mycobacterium avium
RLPEVVTATLALPVEALIADGEAI

SEQ ID NO: 103486 - protein, 28 aa, Mycobacterium avium
RLPFTGHVGISFLRRFRPQVLRPAGRAV

SEQ ID NO: 103487 - protein, 20 aa, Mycobacterium avium
RLPGFRPGKAPAKLLEARFG

SEQ ID NO: 103488 - protein, 19 aa, Mycobacterium avium
RLPMPDMIRMAAKAIHYLA

SEQ ID NO: 103489 - protein, 19 aa, Mycobacterium avium
RLPSPLVVVDAEYRDIGAG

SEQ ID NO: 103490 - protein, 22 aa, Mycobacterium avium
RLPTERVYADYGFELPDNDILR

SEQ ID NO: 103491 - protein, 19 aa, Mycobacterium avium
RLPTERVYTDYGFELPDNE

SEQ ID NO: 103492 - protein, 19 aa, Mycobacterium avium
RLQERWKQIEAKAIEIKEK

SEQ ID NO: 103493 - protein, 18 aa, Mycobacterium avium
RLQLSAQVGDSWHDVHLD

SEQ ID NO: 103494 - protein, 20 aa, Mycobacterium avium
RLQQLDGFIGQAVEMEKDPK

SEQ ID NO: 103495 - protein, 21 aa, Mycobacterium avium
RLQRAWPRYDAMRVELAVGQF

SEQ ID NO: 103496 - protein, 24 aa, Mycobacterium avium
RLQRWGNRPALSRPATGPSLPELF

SEQ ID NO: 103497 - protein, 22 aa, Mycobacterium avium
RLRALLIELERLYNHAADLGAL

SEQ ID NO: 103498 - protein, 21 aa, Mycobacterium avium
RLRARHGWLDHLIRAYQRFDD

SEQ ID NO: 103499 - protein, 25 aa, Mycobacterium avium
RLRARRDRLAAGLIDIGFEVHDSAG

SEQ ID NO: 103500 - protein, 25 aa, Mycobacterium avium
RLRDPALLPRIVWGNLRARFAAKRH

SEQ ID NO: 103501 - protein, 25 aa, Mycobacterium avium
RLRDPALLPRIVWGNLRARFVAKRH

SEQ ID NO: 103502 - protein, 26 aa, Mycobacterium avium
RLRDRVLLRFGLHRALRLGKPLQLHV

SEQ ID NO: 103503 - protein, 25 aa, Mycobacterium avium
RLRDYLLAVKACFAAFRSGTLEHHG

SEQ ID NO: 103504 - protein, 19 aa, Mycobacterium avium
RLREMDARHGGSIIDAQIA

SEQ ID NO: 103505 - protein, 17 aa, Mycobacterium avium
RLRGRAGALAWELSWTD

SEQ ID NO: 103506 - protein, 18 aa, Mycobacterium avium
RLRLDRYLYTAMAYPTDY

SEQ ID NO: 103507 - protein, 19 aa, Mycobacterium avium
RLRLDRYLYTAMAYPTDYG

SEQ ID NO: 103508 - protein, 20 aa, Mycobacterium avium
RLRLDVLAQRDFRRPFDLSK

SEQ ID NO: 103509 - protein, 22 aa, Mycobacterium avium
RLRMHQRWPIVMVDEFQDTDPV

SEQ ID NO: 103510 - protein, 20 aa, Mycobacterium avium
RLRPLPPMRPQHPVPKPRPA

SEQ ID NO: 103511 - protein, 17 aa, Mycobacterium avium
RLRPRPIPERKGSTNDN

SEQ ID NO: 103512 - protein, 24 aa, Mycobacterium avium
RLRPVPLRDPRFVVDVNLGRLAWL

SEQ ID NO: 103513 - protein, 18 aa, Mycobacterium avium
RLRRMLTGNFTFRRCESM

SEQ ID NO: 103514 - protein, 20 aa, Mycobacterium avium
RLRRQLACALGQLRDDTGRH

SEQ ID NO: 103515 - protein, 18 aa, Mycobacterium avium
RLRTALADLDNLDFDCVF

SEQ ID NO: 103516 - protein, 18 aa, Mycobacterium avium
RLRVDTAADTGEWSLQVP

SEQ ID NO: 103517 - protein, 18 aa, Mycobacterium avium
RLRVEDDGAGGWSLEVPE

SEQ ID NO: 103518 - protein, 27 aa, Mycobacterium avium
RLSDGFAHGGYRLAVQHSRQRLASTSD

SEQ ID NO: 103519 - protein, 21 aa, Mycobacterium avium
RLSELWFDALAGICTHVRAGG

SEQ ID NO: 103520 - protein, 23 aa, Mycobacterium avium
RLSELWFDALAGICTHVRAGGGG

SEQ ID NO: 103521 - protein, 18 aa, Mycobacterium avium
RLSETVCMWVNRMHDKTQ

SEQ ID NO: 103522 - protein, 20 aa, Mycobacterium avium
RLSGSAALLGPRLAARSGHF

SEQ ID NO: 103523 - protein, 25 aa, Mycobacterium avium
RLSMDEFLLRHGFHGPNEGNVIGHS

SEQ ID NO: 103524 - protein, 17 aa, Mycobacterium avium
RLSSLDLLDRGERELVL

SEQ ID NO: 103525 - protein, 21 aa, Mycobacterium avium
RLTGGAWLHVRLPEAPAPPQN

SEQ ID NO: 103526 - protein, 17 aa, Mycobacterium avium
RLTHLRDGTPFDLETVR

SEQ ID NO: 103527 - protein, 18 aa, Mycobacterium avium
RLTPETDYAALARACGGS

SEQ ID NO: 103528 - protein, 19 aa, Mycobacterium avium
RLTPYRVPVRIVFVEQLPR

SEQ ID NO: 103529 - protein, 26 aa, Mycobacterium avium
RLTSIALPRIRDFRGLSSKQFDGVGN

SEQ ID NO: 103530 - protein, 17 aa, Mycobacterium avium
RLTSPLRRRPDGSYEEI

SEQ ID NO: 103531 - protein, 19 aa, Mycobacterium avium
RLTTLMTMVTLRSITDVLE

SEQ ID NO: 103532 - protein, 31 aa, Mycobacterium avium
RLTTPLLRVRGALRPCDWDTAMERIVARSRE

SEQ ID NO: 103533 - protein, 25 aa, Mycobacterium avium
RLVAARGALMAALPAGGVMVAVTAG

SEQ ID NO: 103534 - protein, 24 aa, Mycobacterium avium
RLVAARGALMAALPPGGVMVAVTA

SEQ ID NO: 103535 - protein, 19 aa, Mycobacterium avium
RLVDFSGAVVRTLPARVTL

SEQ ID NO: 103536 - protein, 18 aa, Mycobacterium avium
RLVGFFVNTLVLRIDLTG

SEQ ID NO: 103537 - protein, 20 aa, Mycobacterium avium
RLVGLTGITFTNVFNACAAA

SEQ ID NO: 103538 - protein, 18 aa, Mycobacterium avium
RLVHPLIVAVQTLFRGQT

SEQ ID NO: 103539 - protein, 25 aa, Mycobacterium avium
RLVRSRSCAKWLASEDFSETIGHLR

SEQ ID NO: 103540 - protein, 20 aa, Mycobacterium avium
RLWVDGLLAGLFSRADASQQ

SEQ ID NO: 103541 - protein, 21 aa, Mycobacterium avium
RLYPTADGWVMLAVSDDSDRR

SEQ ID NO: 103542 - protein, 25 aa, Mycobacterium avium
RMAALFATLGSLAWSNVVRTKQFKE

SEQ ID NO: 103543 - protein, 20 aa, Mycobacterium avium
RMAARLAARHGVAVDVVAGS

SEQ ID NO: 103544 - protein, 24 aa, Mycobacterium avium
RMAGEGWVRPQLLEYMRTAPDFYF

SEQ ID NO: 103545 - protein, 24 aa, Mycobacterium avium
RMASGEIRATMALTEPGGGSDLQN

SEQ ID NO: 103546 - protein, 30 aa, Mycobacterium avium
RMEADWESAYLLSLRAAWQADNEIPNSKEA

SEQ ID NO: 103547 - protein, 18 aa, Mycobacterium avium
RMEARVALTELFKRIRGY

SEQ ID NO: 103548 - protein, 17 aa, Mycobacterium avium
RMFTPRRIAALEPMIRD

SEQ ID NO: 103549 - protein, 18 aa, Mycobacterium avium
RMGDGLMAVFGDPTVAVR

SEQ ID NO: 103550 - protein, 24 aa, Mycobacterium avium
RMGLLDWQLIRRGSWSHDVGYALI

SEQ ID NO: 103551 - protein, 19 aa, Mycobacterium avium
RMHWGEEGFEFSRDGAEYF

SEQ ID NO: 103552 - protein, 18 aa, Mycobacterium avium
RMLAEAIEQAGLPGADLD

SEQ ID NO: 103553 - protein, 17 aa, Mycobacterium avium
RMLAEAIEQAGLRGADL

SEQ ID NO: 103554 - protein, 17 aa, Mycobacterium avium
RMLHAEGMAPRKLMTAS

SEQ ID NO: 103555 - protein, 20 aa, Mycobacterium avium
RMLLPSIRRSEHVWCQLLSE

SEQ ID NO: 103556 - protein, 22 aa, Mycobacterium avium
RMLTEPELMKLWWAEGQVAAVV

SEQ ID NO: 103557 - protein, 26 aa, Mycobacterium avium
RMLTGNFTFRRCESMRPQIQDTVDHY

SEQ ID NO: 103558 - protein, 21 aa, Mycobacterium avium
RMMGAGLRRLVRLSIPSPAKA

SEQ ID NO: 103559 - protein, 18 aa, Mycobacterium avium
RMNSMAFDVMVPLKEALQ

SEQ ID NO: 103560 - protein, 19 aa, Mycobacterium avium
RMPGFGLQGPWRDYVGWAL

SEQ ID NO: 103561 - protein, 19 aa, Mycobacterium avium
RMRCAHVLTDDAGYLYTRY

SEQ ID NO: 103562 - protein, 22 aa, Mycobacterium avium
RMRQEILAGIGGVRAIRAYTAI

SEQ ID NO: 103563 - protein, 19 aa, Mycobacterium avium
RMSLRPGATPLELATEAST

SEQ ID NO: 103564 - protein, 17 aa, Mycobacterium avium
RMSVKWIEASREITTAL

SEQ ID NO: 103565 - protein, 20 aa, Mycobacterium avium
RMTREMFCLMEGRHVHPSTL

SEQ ID NO: 103566 - protein, 17 aa, Mycobacterium avium
RMTRPQGKFVIRDDAPY

SEQ ID NO: 103567 - protein, 19 aa, Mycobacterium avium
RMVPTFCLQALRGDPLTVS

SEQ ID NO: 103568 - protein, 20 aa, Mycobacterium avium
RMVPTFCLQALRGDPLTVSG

SEQ ID NO: 103569 - protein, 21 aa, Mycobacterium avium
RMVRVQEEILPGGVQPARGTK

SEQ ID NO: 103570 - protein, 19 aa, Mycobacterium avium
RMWENAAEIFGWLEEGRAR

SEQ ID NO: 103571 - protein, 28 aa, Mycobacterium avium
RMYRTGDLVRWRGDGQLDYLGRADEQVK

SEQ ID NO: 103572 - protein, 17 aa, Mycobacterium avium
RNAEFLWFYDLDGNKME

SEQ ID NO: 103573 - protein, 20 aa, Mycobacterium avium
RNAKARLLRDNVVVSENLTI

SEQ ID NO: 103574 - protein, 17 aa, Mycobacterium avium
RNALCGLYDGVQDKRSD

SEQ ID NO: 103575 - protein, 17 aa, Mycobacterium avium
RNALRARWPGADLLDEP

SEQ ID NO: 103576 - protein, 20 aa, Mycobacterium avium
RNAWVPLASWFRHHGARISM

SEQ ID NO: 103577 - protein, 21 aa, Mycobacterium avium
RNDELKFWALSRHQDVLQGFR

SEQ ID NO: 103578 - protein, 23 aa, Mycobacterium avium
RNDPSMKVCKLISVVTIPIAPPT

SEQ ID NO: 103579 - protein, 26 aa, Mycobacterium avium
RNEGKRIVPVCSMIGTVLKKHPEFDD

SEQ ID NO: 103580 - protein, 19 aa, Mycobacterium avium
RNESIYIWHDVARRAPMWE

SEQ ID NO: 103581 - protein, 19 aa, Mycobacterium avium
RNFKMPGFTVPEFRRKAVI

SEQ ID NO: 103582 - protein, 24 aa, Mycobacterium avium
RNGTMRRLHNAVALGLIDIDEFEQ

SEQ ID NO: 103583 - protein, 18 aa, Mycobacterium avium
RNGWWLVARTKIIDDAIA

SEQ ID NO: 103584 - protein, 18 aa, Mycobacterium avium
RNHKGSTWVLSLSAGRLV

SEQ ID NO: 103585 - protein, 19 aa, Mycobacterium avium
RNHMRDMLFLFKGGPSTSP

SEQ ID NO: 103586 - protein, 17 aa, Mycobacterium avium
RNIEGWVRRKRPGSAAA

SEQ ID NO: 103587 - protein, 19 aa, Mycobacterium avium
RNKRGRAWCAAPFFVGRAH

SEQ ID NO: 103588 - protein, 18 aa, Mycobacterium avium
RNLPTPSGNTFEWSPDST

SEQ ID NO: 103589 - protein, 18 aa, Mycobacterium avium
RNMARMGSFFSDRRMAAI

SEQ ID NO: 103590 - protein, 19 aa, Mycobacterium avium
RNPPEKGSRVRLHPAPGHL

SEQ ID NO: 103591 - protein, 23 aa, Mycobacterium avium
RNPRGHLGFGYGVHQCIGANLAR

SEQ ID NO: 103592 - protein, 27 aa, Mycobacterium avium
RNRLPSGWIKTLCAWHRTGPIVRYRPG

SEQ ID NO: 103593 - protein, 23 aa, Mycobacterium avium
RNTRGHLGFGYGVHQCIGANLAR

SEQ ID NO: 103594 - protein, 24 aa, Mycobacterium avium
RNTRGHLGFGYGVHQCIGANLARV

SEQ ID NO: 103595 - protein, 17 aa, Mycobacterium avium
RNVAFGYGRHQCVGQQL

SEQ ID NO: 103596 - protein, 40 aa, Mycobacterium avium
RNVALAAEICDGWLPIFYTPRLADMYNEWLDEGFARPGAR

SEQ ID NO: 103597 - protein, 24 aa, Mycobacterium avium
RNVFAARIHQRWSQGLAKAGCQMP

SEQ ID NO: 103598 - protein, 19 aa, Mycobacterium avium
RPAAPPASRARLWKFGMTG

SEQ ID NO: 103599 - protein, 17 aa, Mycobacterium avium
RPADIAFTLTDYERDWA

SEQ ID NO: 103600 - protein, 22 aa, Mycobacterium avium
RPADLEKLWKVIGLSEQDTVRV

SEQ ID NO: 103601 - protein, 21 aa, Mycobacterium avium
RPADREFPDGTLVPGFVDMHV

SEQ ID NO: 103602 - protein, 20 aa, Mycobacterium avium
RPAELHRFVELHGPRHTAPA

SEQ ID NO: 103603 - protein, 19 aa, Mycobacterium avium
RPAGPAPWKPMVSLSGPTS

SEQ ID NO: 103604 - protein, 18 aa, Mycobacterium avium
RPAHRPGRRRRHLDRRRP

SEQ ID NO: 103605 - protein, 17 aa, Mycobacterium avium
RPAPPGVVGELYVAGAG

SEQ ID NO: 103606 - protein, 17 aa, Mycobacterium avium
RPAPRPENVTSRLIELF

SEQ ID NO: 103607 - protein, 19 aa, Mycobacterium avium
RPARPYLQASVNFALGPAE

SEQ ID NO: 103608 - protein, 20 aa, Mycobacterium avium
RPATGPSLPELFAAQVANAP

SEQ ID NO: 103609 - protein, 17 aa, Mycobacterium avium
RPDAVRALSRLVCGGEP

SEQ ID NO: 103610 - protein, 17 aa, Mycobacterium avium
RPDAVRSLSRLVCGGEP

SEQ ID NO: 103611 - protein, 23 aa, Mycobacterium avium
RPDEIGALIAFLLSDVCGFVTGQ

SEQ ID NO: 103612 - protein, 25 aa, Mycobacterium avium
RPDPFCALESDLLWHLDTAHGDVVS

SEQ ID NO: 103613 - protein, 26 aa, Mycobacterium avium
RPDPLPWHPLGMAIDVMIPDPESAQG

SEQ ID NO: 103614 - protein, 22 aa, Mycobacterium avium
RPDPRFASLLMDQFGGANGALT

SEQ ID NO: 103615 - protein, 24 aa, Mycobacterium avium
RPDRYLRIAAAMRREGMGMTSGFA

SEQ ID NO: 103616 - protein, 18 aa, Mycobacterium avium
RPDSPRVRGFWAVGTHRD

SEQ ID NO: 103617 - protein, 28 aa, Mycobacterium avium
RPDVVPLSFAQNRLWFIDQFQGPSPLYN

SEQ ID NO: 103618 - protein, 21 aa, Mycobacterium avium
RPDYSSSWPAHCLAGSAGADF

SEQ ID NO: 103619 - protein, 17 aa, Mycobacterium avium
RPEAAAITRTIAHAPAG

SEQ ID NO: 103620 - protein, 17 aa, Mycobacterium avium
RPENEFVAPWGMFTTAE

SEQ ID NO: 103621 - protein, 20 aa, Mycobacterium avium
RPENVTSRLIERFLAHFAIR

SEQ ID NO: 103622 - protein, 20 aa, Mycobacterium avium
RPEPRLENGASRVVQQFLAK

SEQ ID NO: 103623 - protein, 21 aa, Mycobacterium avium
RPEQLQAILAKIRRQHAELFG

SEQ ID NO: 103624 - protein, 23 aa, Mycobacterium avium
RPERRRRAAGAGIGLAQRQVDHH

SEQ ID NO: 103625 - protein, 25 aa, Mycobacterium avium
RPERYRFSVTLPRTVPGRGAGIVER

SEQ ID NO: 103626 - protein, 29 aa, Mycobacterium avium
RPFDRDRTGFVFGEAGALMVIETEEHAKA

SEQ ID NO: 103627 - protein, 25 aa, Mycobacterium avium
RPFHPGRLHACLDLLLDGVIRTRGR

SEQ ID NO: 103628 - protein, 17 aa, Mycobacterium avium
RPFPGRPSRPTDLGRAV

SEQ ID NO: 103629 - protein, 17 aa, Mycobacterium avium
RPFPLDLVPRVISAAEW

SEQ ID NO: 103630 - protein, 19 aa, Mycobacterium avium
RPGDKRLVGYVTESVTGAA

SEQ ID NO: 103631 - protein, 18 aa, Mycobacterium avium
RPGGVWAYEAHRVAARRP

SEQ ID NO: 103632 - protein, 25 aa, Mycobacterium avium
RPGIPYPEWNMWTQRFMHDHVAVVE

SEQ ID NO: 103633 - protein, 26 aa, Mycobacterium avium
RPGIPYPEWNMWTQRFMRDHVAVVEH

SEQ ID NO: 103634 - protein, 21 aa, Mycobacterium avium
RPGLGHPLLPPWTVVDSGAHG

SEQ ID NO: 103635 - protein, 18 aa, Mycobacterium avium
RPGLPAVLLGPGPFVGRG

SEQ ID NO: 103636 - protein, 20 aa, Mycobacterium avium
RPGLSATRFVACPFGGPGAR

SEQ ID NO: 103637 - protein, 22 aa, Mycobacterium avium
RPGPDYPFALITGRTVYHFHTR

SEQ ID NO: 103638 - protein, 19 aa, Mycobacterium avium
RPGPEFRPSEVARLGYLAG

SEQ ID NO: 103639 - protein, 18 aa, Mycobacterium avium
RPGQFGLVAANGGIMSKY

SEQ ID NO: 103640 - protein, 18 aa, Mycobacterium avium
RPHLVLDGLRLAAAVVGA

SEQ ID NO: 103641 - protein, 25 aa, Mycobacterium avium
RPLCPVSPVIPGIVWYSATTQPQGW

SEQ ID NO: 103642 - protein, 23 aa, Mycobacterium avium
RPLDPARAAAFEVLRAVSERDAY

SEQ ID NO: 103643 - protein, 26 aa, Mycobacterium avium
RPLDVDLRWVAALLLRNGVIEESGVA

SEQ ID NO: 103644 - protein, 19 aa, Mycobacterium avium
RPLFTLERVRVCKRDGQLL

SEQ ID NO: 103645 - protein, 18 aa, Mycobacterium avium
RPLFTLERVRVCKRDGRL

SEQ ID NO: 103646 - protein, 19 aa, Mycobacterium avium
RPLFTLERVRVCKRDGRLL

SEQ ID NO: 103647 - protein, 28 aa, Mycobacterium avium
RPLHPGRPPWECWVIEGLRGNRWAMLMK

SEQ ID NO: 103648 - protein, 26 aa, Mycobacterium avium
RPLLEHGVDVFIRFNEGLSILKKVVA

SEQ ID NO: 103649 - protein, 20 aa, Mycobacterium avium
RPLRAVPEGGYPDWEAVYAD

SEQ ID NO: 103650 - protein, 23 aa, Mycobacterium avium
RPLRGLKQIVLHLGNGCSASAIA

SEQ ID NO: 103651 - protein, 17 aa, Mycobacterium avium
RPLRTMHGVDEFCEVYY

SEQ ID NO: 103652 - protein, 20 aa, Mycobacterium avium
RPLSCAIAAVSVGVVDGRIR

SEQ ID NO: 103653 - protein, 25 aa, Mycobacterium avium
RPLSEFCWPSWPHLAWGQERQSAQQ

SEQ ID NO: 103654 - protein, 23 aa, Mycobacterium avium
RPNRPGWFLSPAVVAATNDMEIA

SEQ ID NO: 103655 - protein, 23 aa, Mycobacterium avium
RPPERVSVNFIPSAFTLPFGGVT

SEQ ID NO: 103656 - protein, 21 aa, Mycobacterium avium
RPPPRRRGPRGSRCSRAGAAL

SEQ ID NO: 103657 - protein, 17 aa, Mycobacterium avium
RPPQARVLLIAALAAGL

SEQ ID NO: 103658 - protein, 18 aa, Mycobacterium avium
RPPRETWESNPLYRQLDT

SEQ ID NO: 103659 - protein, 17 aa, Mycobacterium avium
RPPRIPLVSNLTGQLAG

SEQ ID NO: 103660 - protein, 19 aa, Mycobacterium avium
RPPRMLVLLHLDGSADRPA

SEQ ID NO: 103661 - protein, 25 aa, Mycobacterium avium
RPPVKTGAASARWLDPARLGITDCE

SEQ ID NO: 103662 - protein, 18 aa, Mycobacterium avium
RPQHGIQLGGQRVGALGH

SEQ ID NO: 103663 - protein, 24 aa, Mycobacterium avium
RPQLRKEPIAAWRDAAFAREAHQL

SEQ ID NO: 103664 - protein, 28 aa, Mycobacterium avium
RPQRAAAHRGWLAPARRLGHRRRSRWTA

SEQ ID NO: 103665 - protein, 20 aa, Mycobacterium avium
RPQRAAGLLDAAGWKPGGDG

SEQ ID NO: 103666 - protein, 17 aa, Mycobacterium avium
RPQRPGGIGGHRRQHPL

SEQ ID NO: 103667 - protein, 22 aa, Mycobacterium avium
RPRAGLIGCAFAELAEVMAGVF

SEQ ID NO: 103668 - protein, 20 aa, Mycobacterium avium
RPREIAHAICFLLDEDAGYI

SEQ ID NO: 103669 - protein, 19 aa, Mycobacterium avium
RPRGKTVWFTGLSGSGKSS

SEQ ID NO: 103670 - protein, 19 aa, Mycobacterium avium
RPRLAAAGGAVTVWSNGET

SEQ ID NO: 103671 - protein, 17 aa, Mycobacterium avium
RPRLDSITYLVLDDAAR

SEQ ID NO: 103672 - protein, 21 aa, Mycobacterium avium
RPRNPCPQKRIAGQVSSSDHD

SEQ ID NO: 103673 - protein, 20 aa, Mycobacterium avium
RPRQKAVVEVGGRRLEVSLP

SEQ ID NO: 103674 - protein, 18 aa, Mycobacterium avium
RPRVAAALAGELWSMASW

SEQ ID NO: 103675 - protein, 19 aa, Mycobacterium avium
RPRVAAVLAGELWSMASWL

SEQ ID NO: 103676 - protein, 25 aa, Mycobacterium avium
RPRVWFGERWIDSVLDLFAENIRYF

SEQ ID NO: 103677 - protein, 17 aa, Mycobacterium avium
RPRWTRNTACCWRPHGR

SEQ ID NO: 103678 - protein, 19 aa, Mycobacterium avium
RPSDASAVLLCLAGGTYDK

SEQ ID NO: 103679 - protein, 18 aa, Mycobacterium avium
RPSDRLDAVAQRLGATTF

SEQ ID NO: 103680 - protein, 21 aa, Mycobacterium avium
RPSDRLDAVAQRLGATTFPLD

SEQ ID NO: 103681 - protein, 17 aa, Mycobacterium avium
RPSEWLRDDPVRYLNEL

SEQ ID NO: 103682 - protein, 18 aa, Mycobacterium avium
RPSEYWERHCFATPSSIH

SEQ ID NO: 103683 - protein, 19 aa, Mycobacterium avium
RPSQLAGVVLPPMPTPTLL

SEQ ID NO: 103684 - protein, 25 aa, Mycobacterium avium
RPTAQLPPKSLRRLLEVNVEGPFAI

SEQ ID NO: 103685 - protein, 20 aa, Mycobacterium avium
RPTFQKGLAHHRAAWRAARL

SEQ ID NO: 103686 - protein, 20 aa, Mycobacterium avium
RPTPELLDIVSRDNRRVYDM

SEQ ID NO: 103687 - protein, 18 aa, Mycobacterium avium
RPVALFLRALARDLNAST

SEQ ID NO: 103688 - protein, 20 aa, Mycobacterium avium
RPVDFHRGAALVGHQRIGPV

SEQ ID NO: 103689 - protein, 17 aa, Mycobacterium avium
RPVGLRPAGALGAEALR

SEQ ID NO: 103690 - protein, 24 aa, Mycobacterium avium
RPVGLRPAGALGAEALRPQTTTMS

SEQ ID NO: 103691 - protein, 19 aa, Mycobacterium avium
RPVGVPAIVAPPVDAADAL

SEQ ID NO: 103692 - protein, 18 aa, Mycobacterium avium
RPVPAGVIGEIYIAGTHV

SEQ ID NO: 103693 - protein, 21 aa, Mycobacterium avium
RPVPGLRWPWVARVGTVVMSW

SEQ ID NO: 103694 - protein, 17 aa, Mycobacterium avium
RPVRAVLVFTDEDGRAH

SEQ ID NO: 103695 - protein, 23 aa, Mycobacterium avium
RPVRSARGWSAAPVRHGVSVVRS

SEQ ID NO: 103696 - protein, 17 aa, Mycobacterium avium
RPWNIKTGDVMPATYIG

SEQ ID NO: 103697 - protein, 26 aa, Mycobacterium avium
RPWTSAPRCPGWGCAARCGSPADRWP

SEQ ID NO: 103698 - protein, 19 aa, Mycobacterium avium
RPYARSRPISITDVELAPP

SEQ ID NO: 103699 - protein, 19 aa, Mycobacterium avium
RPYARSRPITITDVELAPP

SEQ ID NO: 103700 - protein, 18 aa, Mycobacterium avium
RQAEGLGILRGELGTPEY

SEQ ID NO: 103701 - protein, 17 aa, Mycobacterium avium
RQAGVLLAGDVNGLAAT

SEQ ID NO: 103702 - protein, 21 aa, Mycobacterium avium
RQALEMHPQYVLENGVDFAHF

SEQ ID NO: 103703 - protein, 20 aa, Mycobacterium avium
RQALRMRPDRIVVGEVRGAE

SEQ ID NO: 103704 - protein, 21 aa, Mycobacterium avium
RQALRMRPDRIVVGEVRGAEV

SEQ ID NO: 103705 - protein, 25 aa, Mycobacterium avium
RQARKVSCPILFAICANDTVAPAKA

SEQ ID NO: 103706 - protein, 21 aa, Mycobacterium avium
RQCRVDRQVRRTGFQHRQNRH

SEQ ID NO: 103707 - protein, 18 aa, Mycobacterium avium
RQELAGWCARRDGQAGGA

SEQ ID NO: 103708 - protein, 17 aa, Mycobacterium avium
RQFTCKYHAWRYDLDGN

SEQ ID NO: 103709 - protein, 24 aa, Mycobacterium avium
RQGNWKALHLPAPYGPGSWQLYDL

SEQ ID NO: 103710 - protein, 22 aa, Mycobacterium avium
RQGSNQFCWRPVGKPWGGRKKA

SEQ ID NO: 103711 - protein, 17 aa, Mycobacterium avium
RQKHGLLNADGWGAGFF

SEQ ID NO: 103712 - protein, 25 aa, Mycobacterium avium
RQKYLWNALVDYWFRMEIDGWENIP

SEQ ID NO: 103713 - protein, 26 aa, Mycobacterium avium
RQKYLWNALVDYWFRMEIDGWENIPD

SEQ ID NO: 103714 - protein, 26 aa, Mycobacterium avium
RQKYLWNALVDYWFRMEIDGWENLPD

SEQ ID NO: 103715 - protein, 21 aa, Mycobacterium avium
RQLADLGARVIKVERPQGGDF

SEQ ID NO: 103716 - protein, 18 aa, Mycobacterium avium
RQLAEYGIGLSPEAPNPE

SEQ ID NO: 103717 - protein, 19 aa, Mycobacterium avium
RQLEQDIGRLIRELAEATR

SEQ ID NO: 103718 - protein, 20 aa, Mycobacterium avium
RQLLPGAVAKFVRGDVKIVQ

SEQ ID NO: 103719 - protein, 24 aa, Mycobacterium avium
RQMIADRELETWLVVDMSASLDFG

SEQ ID NO: 103720 - protein, 18 aa, Mycobacterium avium
RQMLGLAAAELYNFDLGA

SEQ ID NO: 103721 - protein, 22 aa, Mycobacterium avium
RQMSLRLAERGVLVKDTHGATL

SEQ ID NO: 103722 - protein, 19 aa, Mycobacterium avium
RQNPWWWDVLRNGRSSPYA

SEQ ID NO: 103723 - protein, 17 aa, Mycobacterium avium
RQPRAAVVGHRRVGPIG

SEQ ID NO: 103724 - protein, 25 aa, Mycobacterium avium
RQPVARARVSAVRGVNVDAVMRTLL

SEQ ID NO: 103725 - protein, 25 aa, Mycobacterium avium
RQPWIPGLDPPYIVAMVELADEPDV

SEQ ID NO: 103726 - protein, 17 aa, Mycobacterium avium
RQPWWAPIIDLADGPAV

SEQ ID NO: 103727 - protein, 26 aa, Mycobacterium avium
RQQASIRLGFSWLLPDPWAQDTVARF

SEQ ID NO: 103728 - protein, 21 aa, Mycobacterium avium
RQRCVEEFSWAHVAEQTLEIY

SEQ ID NO: 103729 - protein, 19 aa, Mycobacterium avium
RQREACAALAVAGVDTLIV

SEQ ID NO: 103730 - protein, 27 aa, Mycobacterium avium
RQRENLSWSAPRLHLVDLQYSDVRLDK

SEQ ID NO: 103731 - protein, 26 aa, Mycobacterium avium
RQRENLSWSAPRLHLVDLQYSDVRLG

SEQ ID NO: 103732 - protein, 19 aa, Mycobacterium avium
RQRHRVRCAGHLRREQVHH

SEQ ID NO: 103733 - protein, 17 aa, Mycobacterium avium
RQRLQAAFGTYVDPALA

SEQ ID NO: 103734 - protein, 18 aa, Mycobacterium avium
RQRLSAMMGTLVSPQYWM

SEQ ID NO: 103735 - protein, 19 aa, Mycobacterium avium
RQSGRGFEPVAHFDRGQRV

SEQ ID NO: 103736 - protein, 18 aa, Mycobacterium avium
RQSPRLVAYTATKSALSS

SEQ ID NO: 103737 - protein, 18 aa, Mycobacterium avium
RQTLGPARRIVRDRGMEL

SEQ ID NO: 103738 - protein, 20 aa, Mycobacterium avium
RQVDPTAAVFARFASESAWG

SEQ ID NO: 103739 - protein, 22 aa, Mycobacterium avium
RQVFRSWYIMYFQLPWLPERSA

SEQ ID NO: 103740 - protein, 24 aa, Mycobacterium avium
RQVLNAALPWSLTMVTTQPGAFSN

SEQ ID NO: 103741 - protein, 20 aa, Mycobacterium avium
RQVRNYSVGLCVGFQLEALA

SEQ ID NO: 103742 - protein, 25 aa, Mycobacterium avium
RQWLLVELRSDWTLGTRTYAAGSLL

SEQ ID NO: 103743 - protein, 26 aa, Mycobacterium avium
RQWLLVELRSDWTLGTRTYAAGSLLA

SEQ ID NO: 103744 - protein, 19 aa, Mycobacterium avium
RRAAAAGINTYRCYGSTEH

SEQ ID NO: 103745 - protein, 26 aa, Mycobacterium avium
RRAAALWLLCTIEFAARRWLSGPRNV

SEQ ID NO: 103746 - protein, 20 aa, Mycobacterium avium
RRAAEAWSGGYFAKSVVPVR

SEQ ID NO: 103747 - protein, 17 aa, Mycobacterium avium
RRAALLNALFAAATETE

SEQ ID NO: 103748 - protein, 20 aa, Mycobacterium avium
RRAAVWPAPDWTASTSRWTA

SEQ ID NO: 103749 - protein, 18 aa, Mycobacterium avium
RRADDGLEIPSVVLEVEF

SEQ ID NO: 103750 - protein, 22 aa, Mycobacterium avium
RRADGPVCRRCYNKDPQFLQVC

SEQ ID NO: 103751 - protein, 29 aa, Mycobacterium avium
RRADQEEYLRWAVGAFRLATSGVADSTQI

SEQ ID NO: 103752 - protein, 27 aa, Mycobacterium avium
RRADRAGWLRYGLPASLGGRDGSNVDM

SEQ ID NO: 103753 - protein, 18 aa, Mycobacterium avium
RRAEAPSMPELMSAAEIA

SEQ ID NO: 103754 - protein, 24 aa, Mycobacterium avium
RRAEKATALCWLREVDAETLADRK

SEQ ID NO: 103755 - protein, 25 aa, Mycobacterium avium
RRAGIPGGTAHRLRHWYGTTLVASG

SEQ ID NO: 103756 - protein, 18 aa, Mycobacterium avium
RRAGLTVGGGHRVLGGGG

SEQ ID NO: 103757 - protein, 18 aa, Mycobacterium avium
RRAHRLSNTGALWLGGGG

SEQ ID NO: 103758 - protein, 18 aa, Mycobacterium avium
RRALHRWLQHEVRAPDDV

SEQ ID NO: 103759 - protein, 19 aa, Mycobacterium avium
RRALRCSPKAFTQGSSQSH

SEQ ID NO: 103760 - protein, 23 aa, Mycobacterium avium
RRALSVLPRTGFLNLYGQTEAIV

SEQ ID NO: 103761 - protein, 20 aa, Mycobacterium avium
RRAPDAAAWRAIDDITERYR

SEQ ID NO: 103762 - protein, 25 aa, Mycobacterium avium
RRAPMWEVPDGLQVLGDHIRDREYV

SEQ ID NO: 103763 - protein, 18 aa, Mycobacterium avium
RRARFSVHLDGQIIEIIE

SEQ ID NO: 103764 - protein, 18 aa, Mycobacterium avium
RRARNCWPSGWPAGRTST

SEQ ID NO: 103765 - protein, 17 aa, Mycobacterium avium
RRASPLAEWVARGTVDN

SEQ ID NO: 103766 - protein, 34 aa, Mycobacterium avium
RRASSMGYESWWRRAESVGFCAHPIQLTGTEDYG

SEQ ID NO: 103767 - protein, 19 aa, Mycobacterium avium
RRAVVAVLGPRGYRAVRLD

SEQ ID NO: 103768 - protein, 18 aa, Mycobacterium avium
RRAYPRGGGGDMGAMLGG

SEQ ID NO: 103769 - protein, 18 aa, Mycobacterium avium
RRDAAVAWTRYVAEVAER

SEQ ID NO: 103770 - protein, 24 aa, Mycobacterium avium
RRDFSEPTALNWARHGTDVDFGAL

SEQ ID NO: 103771 - protein, 27 aa, Mycobacterium avium
RRDGLPRIAQAVAAPAVRKTGVLESEI

SEQ ID NO: 103772 - protein, 29 aa, Mycobacterium avium
RRDPFPNGMLVRALEIWPDKDAGELRKEF

SEQ ID NO: 103773 - protein, 18 aa, Mycobacterium avium
RRDPVVLYRVTPQAFTDR

SEQ ID NO: 103774 - protein, 18 aa, Mycobacterium avium
RRDVWALVSSLRVQGISV

SEQ ID NO: 103775 - protein, 18 aa, Mycobacterium avium
RREDVMAYLARWNAGGAL

SEQ ID NO: 103776 - protein, 28 aa, Mycobacterium avium
RREICSRFIRQPGYRFVELRDPKRSDRA

SEQ ID NO: 103777 - protein, 19 aa, Mycobacterium avium
RREVRNFWWPTRCTGCRSS

SEQ ID NO: 103778 - protein, 19 aa, Mycobacterium avium
RRFAAWKAGETGFPFVDAG

SEQ ID NO: 103779 - protein, 25 aa, Mycobacterium avium
RRFAGRARAGAVMLIDGTPGIVIAA

SEQ ID NO: 103780 - protein, 18 aa, Mycobacterium avium
RRFDGVLLSPGPGTPERA

SEQ ID NO: 103781 - protein, 20 aa, Mycobacterium avium
RRFEHPATRAADRAFAAVPA

SEQ ID NO: 103782 - protein, 17 aa, Mycobacterium avium
RRFGHPATRAADRAFAA

SEQ ID NO: 103783 - protein, 23 aa, Mycobacterium avium
RRGAVVCRRRRSAARSGRSSGRR

SEQ ID NO: 103784 - protein, 17 aa, Mycobacterium avium
RRGENIGLTTVYRTLQS

SEQ ID NO: 103785 - protein, 23 aa, Mycobacterium avium
RRGIDAAAMAAVYDDFRAINADF

SEQ ID NO: 103786 - protein, 21 aa, Mycobacterium avium
RRGKYLWLLLDGCDTALVVHL

SEQ ID NO: 103787 - protein, 17 aa, Mycobacterium avium
RRGLMPRLAVPDRMLTP

SEQ ID NO: 103788 - protein, 28 aa, Mycobacterium avium
RRGLPAPDGECWLLASIGMLLVERALNQ

SEQ ID NO: 103789 - protein, 20 aa, Mycobacterium avium
RRGPRVDPALPLHGPERQGV

SEQ ID NO: 103790 - protein, 17 aa, Mycobacterium avium
RRGRCADWQRPEDGITL

SEQ ID NO: 103791 - protein, 28 aa, Mycobacterium avium
RRGRRRPRCRFPGKCGGWPAARSGCCSP

SEQ ID NO: 103792 - protein, 17 aa, Mycobacterium avium
RRGVHPYSVSQPVDEAS

SEQ ID NO: 103793 - protein, 23 aa, Mycobacterium avium
RRGWLEALLGHFCDPTVGAGRAA

SEQ ID NO: 103794 - protein, 27 aa, Mycobacterium avium
RRHCFELDGELPIRVAVLRVANAAEHV

SEQ ID NO: 103795 - protein, 27 aa, Mycobacterium avium
RRHCFELDSELPIRVAVLRTENADEHV

SEQ ID NO: 103796 - protein, 18 aa, Mycobacterium avium
RRHEAFAIGTFEELGGSN

SEQ ID NO: 103797 - protein, 20 aa, Mycobacterium avium
RRHESSTAPGAWEAIAAARF

SEQ ID NO: 103798 - protein, 17 aa, Mycobacterium avium
RRHEVVYQRLARHCAGR

SEQ ID NO: 103799 - protein, 18 aa, Mycobacterium avium
RRHEVVYQRLARHCAGRD

SEQ ID NO: 103800 - protein, 19 aa, Mycobacterium avium
RRHPGRRSPLWQQRQRAAQ

SEQ ID NO: 103801 - protein, 17 aa, Mycobacterium avium
RRIAALEPMIRDFCAQC

SEQ ID NO: 103802 - protein, 20 aa, Mycobacterium avium
RRIAAYLKDAGVQLVSESRA

SEQ ID NO: 103803 - protein, 19 aa, Mycobacterium avium
RRIEELPRVLAHVHRELVA

SEQ ID NO: 103804 - protein, 21 aa, Mycobacterium avium
RRIEPSVLKWAGQALTAAAAD

SEQ ID NO: 103805 - protein, 25 aa, Mycobacterium avium
RRIIKVRVLRRWGPARIAYLLGLNV

SEQ ID NO: 103806 - protein, 22 aa, Mycobacterium avium
RRILEAAGRCIVRRGNTQFRMG

SEQ ID NO: 103807 - protein, 21 aa, Mycobacterium avium
RRILQPFFSPRMIKPLEPDLR

SEQ ID NO: 103808 - protein, 20 aa, Mycobacterium avium
RRIRAGFMGVNGGAPYGADT

SEQ ID NO: 103809 - protein, 17 aa, Mycobacterium avium
RRIWELEKRRAHVPWVT

SEQ ID NO: 103810 - protein, 17 aa, Mycobacterium avium
RRKGIRIVAEAAIAQIA

SEQ ID NO: 103811 - protein, 17 aa, Mycobacterium avium
RRKLAERGLSRSTGTAR

SEQ ID NO: 103812 - protein, 18 aa, Mycobacterium avium
RRLAGLWLAGQDRGWAAI

SEQ ID NO: 103813 - protein, 24 aa, Mycobacterium avium
RRLAKLRGATILAHNYQLPEIQDV

SEQ ID NO: 103814 - protein, 22 aa, Mycobacterium avium
RRLAQRLALAAGRRLDDAQPWA

SEQ ID NO: 103815 - protein, 17 aa, Mycobacterium avium
RRLARWMRLYPDVQAES

SEQ ID NO: 103816 - protein, 28 aa, Mycobacterium avium
RRLATGHWLRRWWPASRQDGIAGLDRAL

SEQ ID NO: 103817 - protein, 17 aa, Mycobacterium avium
RRLDGHFTLVFANADEP

SEQ ID NO: 103818 - protein, 19 aa, Mycobacterium avium
RRLDIEAGDLVHVSTPRGR

SEQ ID NO: 103819 - protein, 19 aa, Mycobacterium avium
RRLEVCFEHGYPAAQIFAP

SEQ ID NO: 103820 - protein, 20 aa, Mycobacterium avium
RRLFAGGGFGGRRFDTGGFG

SEQ ID NO: 103821 - protein, 20 aa, Mycobacterium avium
RRLGLDRIPLYQVHQPNPVF

SEQ ID NO: 103822 - protein, 18 aa, Mycobacterium avium
RRLGRTGLDLTLEAVLRA

SEQ ID NO: 103823 - protein, 17 aa, Mycobacterium avium
RRLHSVLAVEGGGSASD

SEQ ID NO: 103824 - protein, 21 aa, Mycobacterium avium
RRLILPCLRVGAATLACDHLP

SEQ ID NO: 103825 - protein, 19 aa, Mycobacterium avium
RRLLDVAGQTYAAQARIKL

SEQ ID NO: 103826 - protein, 18 aa, Mycobacterium avium
RRLMQLPLALTVQACEAA

SEQ ID NO: 103827 - protein, 19 aa, Mycobacterium avium
RRLPTGTALIALIETAAGV

SEQ ID NO: 103828 - protein, 26 aa, Mycobacterium avium
RRLRAGGVDTVFTLSGGHLFSIYDGC

SEQ ID NO: 103829 - protein, 17 aa, Mycobacterium avium
RRLRLDVLAQRDFRRPF

SEQ ID NO: 103830 - protein, 18 aa, Mycobacterium avium
RRLRMRLSALGVYTTNAH

SEQ ID NO: 103831 - protein, 21 aa, Mycobacterium avium
RRLRRQLACALGQLRDDTGRH

SEQ ID NO: 103832 - protein, 18 aa, Mycobacterium avium
RRLRSRFYDGMRALHGAP

SEQ ID NO: 103833 - protein, 24 aa, Mycobacterium avium
RRLRSTPALRRLVAQTSLEPRHLV

SEQ ID NO: 103834 - protein, 18 aa, Mycobacterium avium
RRLTEVRKNGVLPYLRPD

SEQ ID NO: 103835 - protein, 18 aa, Mycobacterium avium
RRLTKVVGLAGAHRRTQR

SEQ ID NO: 103836 - protein, 18 aa, Mycobacterium avium
RRLVKIRSSIVKRRTAVF

SEQ ID NO: 103837 - protein, 28 aa, Mycobacterium avium
RRLYAFMAAIGWVFKVKGRWRAYQSQVE

SEQ ID NO: 103838 - protein, 25 aa, Mycobacterium avium
RRLYLRLACGLAERIGAQAVVTGDS

SEQ ID NO: 103839 - protein, 18 aa, Mycobacterium avium
RRMKLRRIVSAVPKPHRA

SEQ ID NO: 103840 - protein, 18 aa, Mycobacterium avium
RRMPQWSPQCRWMKPLGP

SEQ ID NO: 103841 - protein, 24 aa, Mycobacterium avium
RRMRPGLDVRLAFLELNAPNFVDV

SEQ ID NO: 103842 - protein, 20 aa, Mycobacterium avium
RRNGLPVPPAFCITTEICAQ

SEQ ID NO: 103843 - protein, 17 aa, Mycobacterium avium
RRNVALAGVDLENVKAV

SEQ ID NO: 103844 - protein, 21 aa, Mycobacterium avium
RRPAEFCSGHGTQIFDQTAEM

SEQ ID NO: 103845 - protein, 20 aa, Mycobacterium avium
RRPAHEFRVVNAHLVHKLLP

SEQ ID NO: 103846 - protein, 20 aa, Mycobacterium avium
RRPDAGACYTQIKTIVDDIE

SEQ ID NO: 103847 - protein, 17 aa, Mycobacterium avium
RRPELAGLPVIVGGNGD

SEQ ID NO: 103848 - protein, 26 aa, Mycobacterium avium
RRPFHPGRLHACLDLLLDGVIRTRGR

SEQ ID NO: 103849 - protein, 28 aa, Mycobacterium avium
RRPGNWLLAARCVRGFLAMSSEKPDPAL

SEQ ID NO: 103850 - protein, 29 aa, Mycobacterium avium
RRPGNWLLAARCVRGFLAMSSEKPEPALT

SEQ ID NO: 103851 - protein, 28 aa, Mycobacterium avium
RRPGNWLLAARCVRGFLAMSSEKPNPAL

SEQ ID NO: 103852 - protein, 19 aa, Mycobacterium avium
RRPGPFPVASFGVAELQRP

SEQ ID NO: 103853 - protein, 28 aa, Mycobacterium avium
RRPPRCGWSAPCARSWAPSRAQCSGSLA

SEQ ID NO: 103854 - protein, 23 aa, Mycobacterium avium
RRPPSPSWKAAWRCWPGWRRARR

SEQ ID NO: 103855 - protein, 21 aa, Mycobacterium avium
RRPTTVPEMREWLRNWVGRAV

SEQ ID NO: 103856 - protein, 18 aa, Mycobacterium avium
RRQGPVKLDRIIAQLQEM

SEQ ID NO: 103857 - protein, 29 aa, Mycobacterium avium
RRQGVRKLAGFWGHAWQSAVFPSGKAFGY

SEQ ID NO: 103858 - protein, 22 aa, Mycobacterium avium
RRQVLAPVRLVLGIVRGGLVAR

SEQ ID NO: 103859 - protein, 20 aa, Mycobacterium avium
RRQWPSPMLPALQSLLDDHT

SEQ ID NO: 103860 - protein, 22 aa, Mycobacterium avium
RRRADLDAGVFEHRCPIGGEEL

SEQ ID NO: 103861 - protein, 28 aa, Mycobacterium avium
RRRARRPGRACGAHRAGDTARGRRRAGC

SEQ ID NO: 103862 - protein, 19 aa, Mycobacterium avium
RRRCRAGLAGQRRIVDVDD

SEQ ID NO: 103863 - protein, 26 aa, Mycobacterium avium
RRRDGGRGRPRLCQRADQESPVRARR

SEQ ID NO: 103864 - protein, 23 aa, Mycobacterium avium
RRRGDRWYWHWDPQFTSGTAAFP

SEQ ID NO: 103865 - protein, 18 aa, Mycobacterium avium
RRRGGGLQRRHRRGADQD

SEQ ID NO: 103866 - protein, 22 aa, Mycobacterium avium
RRRIRASGLVIVLCGKYTHLAT

SEQ ID NO: 103867 - protein, 26 aa, Mycobacterium avium
RRRLGMDRLRIGVTGAAPIPREVHEF

SEQ ID NO: 103868 - protein, 19 aa, Mycobacterium avium
RRRLRIVVAASLLGTTVEW

SEQ ID NO: 103869 - protein, 29 aa, Mycobacterium avium
RRRMPAPDSECRLLAAVGMLLVERALNQW

SEQ ID NO: 103870 - protein, 19 aa, Mycobacterium avium
RRRPRPGRIDPGYRHEYLD

SEQ ID NO: 103871 - protein, 19 aa, Mycobacterium avium
RRRPRQRGAGLGFDGRVVH

SEQ ID NO: 103872 - protein, 27 aa, Mycobacterium avium
RRRPRSVIDPGYRYEFIEGDDEVVAVA

SEQ ID NO: 103873 - protein, 17 aa, Mycobacterium avium
RRRQPVLIRVTPDIDIH

SEQ ID NO: 103874 - protein, 24 aa, Mycobacterium avium
RRRRAQRPPGRFPSSWPTGWDCRC

SEQ ID NO: 103875 - protein, 18 aa, Mycobacterium avium
RRRRGLAGQGGRRAEQVQ

SEQ ID NO: 103876 - protein, 20 aa, Mycobacterium avium
RRRRGRGQRAVRHCGAPLRA

SEQ ID NO: 103877 - protein, 23 aa, Mycobacterium avium
RRRRVGHMLLLLVETGVSERALA

SEQ ID NO: 103878 - protein, 25 aa, Mycobacterium avium
RRRTMLREYLEAMRALWTQEEAAYD

SEQ ID NO: 103879 - protein, 18 aa, Mycobacterium avium
RRRVIRAWLLAGGATGLT

SEQ ID NO: 103880 - protein, 18 aa, Mycobacterium avium
RRRWEAVMMHNYGTPPVA

SEQ ID NO: 103881 - protein, 19 aa, Mycobacterium avium
RRSAWWAGTVTLGVAKIIE

SEQ ID NO: 103882 - protein, 18 aa, Mycobacterium avium
RRSDNLAALLARSGAGPG

SEQ ID NO: 103883 - protein, 19 aa, Mycobacterium avium
RRSDNLAALLVDRGVGPGT

SEQ ID NO: 103884 - protein, 18 aa, Mycobacterium avium
RRSGDVVALIGETVRRVT

SEQ ID NO: 103885 - protein, 29 aa, Mycobacterium avium
RRSSGAVKFPAERPELFDGDSDIQQDIEP

SEQ ID NO: 103886 - protein, 28 aa, Mycobacterium avium
RRSTGVVKFPAERPELFDGSPDTQEDIE

SEQ ID NO: 103887 - protein, 19 aa, Mycobacterium avium
RRSWWSASTGCRRWRRAAT

SEQ ID NO: 103888 - protein, 24 aa, Mycobacterium avium
RRSYDAGLGRRGIPDQFDAELWRN

SEQ ID NO: 103889 - protein, 22 aa, Mycobacterium avium
RRTAELTLWTGLTCTEIVTEPA

SEQ ID NO: 103890 - protein, 20 aa, Mycobacterium avium
RRTFEATLQLTGRLAMAADS

SEQ ID NO: 103891 - protein, 21 aa, Mycobacterium avium
RRTRDAFVVGDGYAELMTADY

SEQ ID NO: 103892 - protein, 24 aa, Mycobacterium avium
RRTRLRAAALPARRHRRTARRPPV

SEQ ID NO: 103893 - protein, 23 aa, Mycobacterium avium
RRTTEGWRRRGLDMDIAALTYPG

SEQ ID NO: 103894 - protein, 17 aa, Mycobacterium avium
RRTVLLIGDGAAQLTVQ

SEQ ID NO: 103895 - protein, 20 aa, Mycobacterium avium
RRVAAFKVGPDFIDPGYHGL

SEQ ID NO: 103896 - protein, 22 aa, Mycobacterium avium
RRVAGFGAAVGRFLDSVDQRVL

SEQ ID NO: 103897 - protein, 28 aa, Mycobacterium avium
RRVAPSIVFCAAEFVPVIGDLIADMPSP

SEQ ID NO: 103898 - protein, 17 aa, Mycobacterium avium
RRVAVLEQLWLHALWAG

SEQ ID NO: 103899 - protein, 27 aa, Mycobacterium avium
RRVELPTYAFARERFWLGGASLAGAPA

SEQ ID NO: 103900 - protein, 17 aa, Mycobacterium avium
RRVKAVRAVRRSTELEG

SEQ ID NO: 103901 - protein, 17 aa, Mycobacterium avium
RRVKGEWVYGPRTPTSE

SEQ ID NO: 103902 - protein, 17 aa, Mycobacterium avium
RRVLAALGPKMLKLSAS

SEQ ID NO: 103903 - protein, 20 aa, Mycobacterium avium
RRVLPEAWIADTLRGGPDSR

SEQ ID NO: 103904 - protein, 25 aa, Mycobacterium avium
RRVRRACQIAQPLLRTGEAVQAGIL

SEQ ID NO: 103905 - protein, 19 aa, Mycobacterium avium
RRVVAALGPRVLKLSAERS

SEQ ID NO: 103906 - protein, 17 aa, Mycobacterium avium
RRYDVADILPLTPLQQG

SEQ ID NO: 103907 - protein, 27 aa, Mycobacterium avium
RRYGNVFTLRLPMWGPVVMVSDPQLAK

SEQ ID NO: 103908 - protein, 19 aa, Mycobacterium avium
RRYLDCLSAYSAVNFGHRH

SEQ ID NO: 103909 - protein, 17 aa, Mycobacterium avium
RRYLEGDAQAWAHGATF

SEQ ID NO: 103910 - protein, 17 aa, Mycobacterium avium
RRYMNWIPADYGDAMAP

SEQ ID NO: 103911 - protein, 25 aa, Mycobacterium avium
RRYNPWSAYGESKLANLLFVRELVA

SEQ ID NO: 103912 - protein, 18 aa, Mycobacterium avium
RRYPAWPASQDASLRVPW

SEQ ID NO: 103913 - protein, 18 aa, Mycobacterium avium
RRYPTIVCQVHLGIVEGM

SEQ ID NO: 103914 - protein, 23 aa, Mycobacterium avium
RSAFLAENWRPYVAGDIVIHEID

SEQ ID NO: 103915 - protein, 18 aa, Mycobacterium avium
RSAGCSRSAAGISRTSTR

SEQ ID NO: 103916 - protein, 26 aa, Mycobacterium avium
RSAIDAVLIGAAWQRCRVHFLRNVRA

SEQ ID NO: 103917 - protein, 24 aa, Mycobacterium avium
RSALPNDVPRTWILTTRDRALSQK

SEQ ID NO: 103918 - protein, 19 aa, Mycobacterium avium
RSALTPGLQQVFGMAEGLL

SEQ ID NO: 103919 - protein, 25 aa, Mycobacterium avium
RSAPNPAVIAAVEWVGTVDASGATF

SEQ ID NO: 103920 - protein, 24 aa, Mycobacterium avium
RSDFGHIAIGPGFSLVELPAKLPK

SEQ ID NO: 103921 - protein, 19 aa, Mycobacterium avium
RSDSALLQRLQVVLRGAQL

SEQ ID NO: 103922 - protein, 19 aa, Mycobacterium avium
RSDSRACAVRERQAELDEL

SEQ ID NO: 103923 - protein, 21 aa, Mycobacterium avium
RSDVFVDSWAPGVASRLGLAA

SEQ ID NO: 103924 - protein, 23 aa, Mycobacterium avium
RSEGCGILVLKRMSDAVRDGDRV

SEQ ID NO: 103925 - protein, 19 aa, Mycobacterium avium
RSEHLAWKIAEVAADPVAV

SEQ ID NO: 103926 - protein, 20 aa, Mycobacterium avium
RSEHLAWKIAEVAADPVAVP

SEQ ID NO: 103927 - protein, 22 aa, Mycobacterium avium
RSESTVEGFVLPGFAVGDNAGN

SEQ ID NO: 103928 - protein, 22 aa, Mycobacterium avium
RSESTVEGFVLPGFAVGDNAGS

SEQ ID NO: 103929 - protein, 25 aa, Mycobacterium avium
RSFDPCLPCGVHMYLGKGKTLDRLH

SEQ ID NO: 103930 - protein, 17 aa, Mycobacterium avium
RSFPVQYFYHLYRSDEL

SEQ ID NO: 103931 - protein, 18 aa, Mycobacterium avium
RSGALPVAKGVFSVLNSD

SEQ ID NO: 103932 - protein, 22 aa, Mycobacterium avium
RSGDLPDRLRVHSLARTLGTTS

SEQ ID NO: 103933 - protein, 19 aa, Mycobacterium avium
RSGGVLPGYGGSKAALEHL

SEQ ID NO: 103934 - protein, 21 aa, Mycobacterium avium
RSGLDAAEFDDFVLAESMQGG

SEQ ID NO: 103935 - protein, 18 aa, Mycobacterium avium
RSGLIALLCKTDPKARPQ

SEQ ID NO: 103936 - protein, 17 aa, Mycobacterium avium
RSGLIALLCKTDPQAQP

SEQ ID NO: 103937 - protein, 24 aa, Mycobacterium avium
RSGLPADVPRTWILTTRDRALSVA

SEQ ID NO: 103938 - protein, 32 aa, Mycobacterium avium
RSGLTASRFVACPFGAPGARMYRTGDLVCWRP

SEQ ID NO: 103939 - protein, 21 aa, Mycobacterium avium
RSGLTASRFVACPFGEPGTRM

SEQ ID NO: 103940 - protein, 17 aa, Mycobacterium avium
RSGPLAFARAGVSPADI

SEQ ID NO: 103941 - protein, 24 aa, Mycobacterium avium
RSGRTRIDIGWALDRLDEPDMTRH

SEQ ID NO: 103942 - protein, 25 aa, Mycobacterium avium
RSHAWIEAWTGAWWSYDPTNDAEIT

SEQ ID NO: 103943 - protein, 19 aa, Mycobacterium avium
RSHGARFSLVMTRNTAIDR

SEQ ID NO: 103944 - protein, 17 aa, Mycobacterium avium
RSHRLRNNLSWTNSYYD

SEQ ID NO: 103945 - protein, 23 aa, Mycobacterium avium
RSIADLLGALGLGPRRGAGSGGA

SEQ ID NO: 103946 - protein, 18 aa, Mycobacterium avium
RSIADLLGALGLGPRRRA

SEQ ID NO: 103947 - protein, 17 aa, Mycobacterium avium
RSIKTAKLRAAQRVQRF

SEQ ID NO: 103948 - protein, 22 aa, Mycobacterium avium
RSKLSEMPVLWAYARDLFQTPG

SEQ ID NO: 103949 - protein, 18 aa, Mycobacterium avium
RSKSHLLVTVLAREFERL

SEQ ID NO: 103950 - protein, 21 aa, Mycobacterium avium
RSLALTDCLDRIVLAELAAVL

SEQ ID NO: 103951 - protein, 18 aa, Mycobacterium avium
RSLASWKNYVAGWKGLHD

SEQ ID NO: 103952 - protein, 17 aa, Mycobacterium avium
RSLCFDVLAVGEPDESG

SEQ ID NO: 103953 - protein, 17 aa, Mycobacterium avium
RSLHIQGGYGFGMEGDI

SEQ ID NO: 103954 - protein, 20 aa, Mycobacterium avium
RSLLLPGIRIGNRFRGGPKR

SEQ ID NO: 103955 - protein, 17 aa, Mycobacterium avium
RSLPTLLHVIDRAERAG

SEQ ID NO: 103956 - protein, 30 aa, Mycobacterium avium
RSMTRLWARMWLLRFTWQRAIDSGDLTSPA

SEQ ID NO: 103957 - protein, 20 aa, Mycobacterium avium
RSNTPFPFSTLDIAVTGRTP

SEQ ID NO: 103958 - protein, 17 aa, Mycobacterium avium
RSPCAWRGSATPTWWPS

SEQ ID NO: 103959 - protein, 22 aa, Mycobacterium avium
RSPEDLHALLIGEGVTVLSQTP

SEQ ID NO: 103960 - protein, 17 aa, Mycobacterium avium
RSPEGFFGWEAAGLRWL

SEQ ID NO: 103961 - protein, 27 aa, Mycobacterium avium
RSPHEPRLPYASLKAAVATFTRGIART

SEQ ID NO: 103962 - protein, 18 aa, Mycobacterium avium
RSPMDFHALLVAENVTVL

SEQ ID NO: 103963 - protein, 18 aa, Mycobacterium avium
RSQGVTMYRVDPSEVTQR

SEQ ID NO: 103964 - protein, 18 aa, Mycobacterium avium
RSQRSVEVPDDFMDYRPG

SEQ ID NO: 103965 - protein, 23 aa, Mycobacterium avium
RSQWRLLVNRGLALTKDNGSYAI

SEQ ID NO: 103966 - protein, 23 aa, Mycobacterium avium
RSRAWRRLPDWPPATTERALYLR

SEQ ID NO: 103967 - protein, 18 aa, Mycobacterium avium
RSRCREIASAFGGGNNVH

SEQ ID NO: 103968 - protein, 17 aa, Mycobacterium avium
RSRDPSDLRAVLVDITP

SEQ ID NO: 103969 - protein, 18 aa, Mycobacterium avium
RSRDPSDLRAVLVDITPR

SEQ ID NO: 103970 - protein, 25 aa, Mycobacterium avium
RSREIPMAALAGMRRGQALPHGLRG

SEQ ID NO: 103971 - protein, 23 aa, Mycobacterium avium
RSRPDLWSPLEYACHLRDVLLVQ

SEQ ID NO: 103972 - protein, 33 aa, Mycobacterium avium
RSRRCFRTSAWWWPPTCRPRRWPTPSARAPGTC

SEQ ID NO: 103973 - protein, 19 aa, Mycobacterium avium
RSRTSLPLMAKGICHPDDV

SEQ ID NO: 103974 - protein, 17 aa, Mycobacterium avium
RSRWRAVREDLADAVAA

SEQ ID NO: 103975 - protein, 21 aa, Mycobacterium avium
RSSPYATFFDVDWDLDEDGRI

SEQ ID NO: 103976 - protein, 24 aa, Mycobacterium avium
RSTTELFPIPPWSVAPDVVAAAGA

SEQ ID NO: 103977 - protein, 19 aa, Mycobacterium avium
RSTTVAMHLLRHLLRRLLT

SEQ ID NO: 103978 - protein, 17 aa, Mycobacterium avium
RSVDDFNREFTIETSNG

SEQ ID NO: 103979 - protein, 20 aa, Mycobacterium avium
RSVERFNRFAAKGLDPDFGR

SEQ ID NO: 103980 - protein, 24 aa, Mycobacterium avium
RSVKGEVIASTFDRPPSDHTSVAE

SEQ ID NO: 103981 - protein, 17 aa, Mycobacterium avium
RSVPLLSRVGADRADQL

SEQ ID NO: 103982 - protein, 18 aa, Mycobacterium avium
RSVPLLSRVGADRADQLR

SEQ ID NO: 103983 - protein, 28 aa, Mycobacterium avium
RSVPQWPELEAAALKRIRGPRVGDPADV

SEQ ID NO: 103984 - protein, 27 aa, Mycobacterium avium
RSVVPRSWSGFFRPGPAVVVSPDNFGQ

SEQ ID NO: 103985 - protein, 23 aa, Mycobacterium avium
RSWSRPEIQGAQFTHAVSLAEAW

SEQ ID NO: 103986 - protein, 18 aa, Mycobacterium avium
RSYPRAVSLEDRFTQLLP

SEQ ID NO: 103987 - protein, 26 aa, Mycobacterium avium
RSYWDSAFAQHHWGGLLAPPALLMGW

SEQ ID NO: 103988 - protein, 27 aa, Mycobacterium avium
RSYWDSAFAQRHWGGLLAPPALLMGWL

SEQ ID NO: 103989 - protein, 39 aa, Mycobacterium avium
RSYWDSAFAQRHWGGLLAPPALLMGWLIAPPWQPDGRPS

SEQ ID NO: 103990 - protein, 18 aa, Mycobacterium avium
RTADICFPASSAAPRGPA

SEQ ID NO: 103991 - protein, 23 aa, Mycobacterium avium
RTAERFGRLGIDMINVGPLPGNP

SEQ ID NO: 103992 - protein, 24 aa, Mycobacterium avium
RTALKNPLFATARGLENDFTRMLD

SEQ ID NO: 103993 - protein, 23 aa, Mycobacterium avium
RTAPLDICFSAGNLLEDSRSADE

SEQ ID NO: 103994 - protein, 22 aa, Mycobacterium avium
RTAQFTARWGLTGTLITVDGEL

SEQ ID NO: 103995 - protein, 17 aa, Mycobacterium avium
RTASVRLALAAVPGNPA

SEQ ID NO: 103996 - protein, 18 aa, Mycobacterium avium
RTAVLRWSSSSVFTRSPG

SEQ ID NO: 103997 - protein, 22 aa, Mycobacterium avium
RTAYLHTDFRSITPVGEELTVR

SEQ ID NO: 103998 - protein, 25 aa, Mycobacterium avium
RTCVVELPTALLIDADALRDAAALQ

SEQ ID NO: 103999 - protein, 24 aa, Mycobacterium avium
RTCVVELPTALLIDAHALHDAAAL

SEQ ID NO: 104000 - protein, 25 aa, Mycobacterium avium
RTDPRVSPALAESLAGLAPALIAVA

SEQ ID NO: 104001 - protein, 25 aa, Mycobacterium avium
RTDRLPFLAPLDWESFEGLLRGRID

SEQ ID NO: 104002 - protein, 23 aa, Mycobacterium avium
RTDTWLPMPKEWAALTVQKQRDD

SEQ ID NO: 104003 - protein, 24 aa, Mycobacterium avium
RTDYTFPAECKYTTHAGLASEYAG

SEQ ID NO: 104004 - protein, 20 aa, Mycobacterium avium
RTEAVLRRLAPRSRITCDIT

SEQ ID NO: 104005 - protein, 21 aa, Mycobacterium avium
RTENIRLGFGIMHLPPAVNHP

SEQ ID NO: 104006 - protein, 18 aa, Mycobacterium avium
RTFEATLQLTGRLAMAAD

SEQ ID NO: 104007 - protein, 17 aa, Mycobacterium avium
RTFHPLIAIDVRSAEMA

SEQ ID NO: 104008 - protein, 22 aa, Mycobacterium avium
RTGAPRYVKIVDMTEADDAPLG

SEQ ID NO: 104009 - protein, 23 aa, Mycobacterium avium
RTGAPRYVKIVDMTEADDAPLGY

SEQ ID NO: 104010 - protein, 25 aa, Mycobacterium avium
RTGDMGCYWRDGTLQFLGRADSQVK

SEQ ID NO: 104011 - protein, 18 aa, Mycobacterium avium
RTGERVCAVVVPATADGV

SEQ ID NO: 104012 - protein, 20 aa, Mycobacterium avium
RTGFEDGLFASWRSDPSFVL

SEQ ID NO: 104013 - protein, 19 aa, Mycobacterium avium
RTGLTWPQAAERFAAMVAP

SEQ ID NO: 104014 - protein, 43 aa, Mycobacterium avium
RTGPGPAARPGRWWCWWTASWPGSWSGAAGRCSPSPTTRPPST

SEQ ID NO: 104015 - protein, 17 aa, Mycobacterium avium
RTGQQWEERFGAQHYTA

SEQ ID NO: 104016 - protein, 18 aa, Mycobacterium avium
RTGRVRFLDALELEAIVW

SEQ ID NO: 104017 - protein, 18 aa, Mycobacterium avium
RTGTFFAHQHDGITPDVV

SEQ ID NO: 104018 - protein, 21 aa, Mycobacterium avium
RTGTYAINWYAFDRCCPFGGY

SEQ ID NO: 104019 - protein, 24 aa, Mycobacterium avium
RTHRFDIETGDTWTVELTRLPHGC

SEQ ID NO: 104020 - protein, 19 aa, Mycobacterium avium
RTIHGYRRAYRIAGSGPAI

SEQ ID NO: 104021 - protein, 18 aa, Mycobacterium avium
RTIPELLEPSRAWDADRI

SEQ ID NO: 104022 - protein, 18 aa, Mycobacterium avium
RTLGRRTAVAASQCTELL

SEQ ID NO: 104023 - protein, 17 aa, Mycobacterium avium
RTLIEDINIAWAQHHSG

SEQ ID NO: 104024 - protein, 17 aa, Mycobacterium avium
RTLIEDINIAWAQHQGG

SEQ ID NO: 104025 - protein, 24 aa, Mycobacterium avium
RTLIPEHGLRLVVIEKSVFTLKSR

SEQ ID NO: 104026 - protein, 18 aa, Mycobacterium avium
RTLLRGTPTLGERMAVQV

SEQ ID NO: 104027 - protein, 19 aa, Mycobacterium avium
RTMAMLGVHACVAVTAVTA

SEQ ID NO: 104028 - protein, 20 aa, Mycobacterium avium
RTMEALTRLLADRTGGPLLD

SEQ ID NO: 104029 - protein, 17 aa, Mycobacterium avium
RTMEVYAGMVDRMDYNV

SEQ ID NO: 104030 - protein, 22 aa, Mycobacterium avium
RTMGRVYGWLLICEPPQQSLTQ

SEQ ID NO: 104031 - protein, 25 aa, Mycobacterium avium
RTNRLPFRAPKHWSALEPVLRDAGR

SEQ ID NO: 104032 - protein, 26 aa, Mycobacterium avium
RTNRLPFRAPKHWSALEPVLRDAGRD

SEQ ID NO: 104033 - protein, 25 aa, Mycobacterium avium
RTNRLPFRAPKHWSALEPVLRDVGR

SEQ ID NO: 104034 - protein, 23 aa, Mycobacterium avium
RTNSAHWKRPVNRSTTQYSTVRT

SEQ ID NO: 104035 - protein, 20 aa, Mycobacterium avium
RTPLARRIPGNQVLNSVECL

SEQ ID NO: 104036 - protein, 19 aa, Mycobacterium avium
RTPMGKIRKAELRKEHFEN

SEQ ID NO: 104037 - protein, 27 aa, Mycobacterium avium
RTQRRPVCGRSCALRGLADAGQRGQRR

SEQ ID NO: 104038 - protein, 25 aa, Mycobacterium avium
RTQWWGRQMLIWGVHVHVGISSPNK

SEQ ID NO: 104039 - protein, 17 aa, Mycobacterium avium
RTRESVVLAMLTDTLTA

SEQ ID NO: 104040 - protein, 18 aa, Mycobacterium avium
RTRESVVLAMLTDTLTAA

SEQ ID NO: 104041 - protein, 24 aa, Mycobacterium avium
RTSDLIPLCHQLALTGVDVDFAVG

SEQ ID NO: 104042 - protein, 19 aa, Mycobacterium avium
RTSLYFKRDITTPFVEKEC

SEQ ID NO: 104043 - protein, 25 aa, Mycobacterium avium
RTSTVLDMRVDLVINVFGAPMHAHW

SEQ ID NO: 104044 - protein, 17 aa, Mycobacterium avium
RTSVELLAPHAGTPGLD

SEQ ID NO: 104045 - protein, 23 aa, Mycobacterium avium
RTTGRPGTAIGLSEGAFVVDGEQ

SEQ ID NO: 104046 - protein, 20 aa, Mycobacterium avium
RTTINPKRVAAMTMQTVMFI

SEQ ID NO: 104047 - protein, 26 aa, Mycobacterium avium
RTTPVGPRLSALVDHTIWFHRAADFT

SEQ ID NO: 104048 - protein, 25 aa, Mycobacterium avium
RTVAGIHLEGPWLSRARCGAHDARR

SEQ ID NO: 104049 - protein, 20 aa, Mycobacterium avium
RTVANLRLGHLLGQAILRSA

SEQ ID NO: 104050 - protein, 17 aa, Mycobacterium avium
RTVAVDLRDDWSTALAT

SEQ ID NO: 104051 - protein, 22 aa, Mycobacterium avium
RTVERFGRLGIDMINVGPLPGN

SEQ ID NO: 104052 - protein, 24 aa, Mycobacterium avium
RTVERLGRLGIEMINVGPLPGNPD

SEQ ID NO: 104053 - protein, 18 aa, Mycobacterium avium
RTVNLGWTSWATRWLSRT

SEQ ID NO: 104054 - protein, 19 aa, Mycobacterium avium
RTVPDNMGMLFRRKLVMFG

SEQ ID NO: 104055 - protein, 24 aa, Mycobacterium avium
RTVRLNHEFHRAINIAADSPKLAQ

SEQ ID NO: 104056 - protein, 18 aa, Mycobacterium avium
RTVVLERLVKFNGEQHVA

SEQ ID NO: 104057 - protein, 25 aa, Mycobacterium avium
RTVYRQEMLRMFGLPESGLAETLRE

SEQ ID NO: 104058 - protein, 17 aa, Mycobacterium avium
RTYVEFYDRYSGCIEAW

SEQ ID NO: 104059 - protein, 22 aa, Mycobacterium avium
RVAAALPDYMTPAAYVVLDEIP

SEQ ID NO: 104060 - protein, 18 aa, Mycobacterium avium
RVAAELIFDQGLGDMFVV

SEQ ID NO: 104061 - protein, 20 aa, Mycobacterium avium
RVAAKRLGLPSGQRSLTAAS

SEQ ID NO: 104062 - protein, 17 aa, Mycobacterium avium
RVADHGWGLGYMLNQRC

SEQ ID NO: 104063 - protein, 23 aa, Mycobacterium avium
RVAELALRIAGPAILLGEEQEVV

SEQ ID NO: 104064 - protein, 17 aa, Mycobacterium avium
RVAGWGVSGRARLADVV

SEQ ID NO: 104065 - protein, 18 aa, Mycobacterium avium
RVAKQILDLAMRFGTDSG

SEQ ID NO: 104066 - protein, 21 aa, Mycobacterium avium
RVAPHASWMFEYYPMRDLREL

SEQ ID NO: 104067 - protein, 22 aa, Mycobacterium avium
RVAQPLFDRVHRALGAEATVEA

SEQ ID NO: 104068 - protein, 23 aa, Mycobacterium avium
RVARLRLAGTVARGADVVGPHGR

SEQ ID NO: 104069 - protein, 19 aa, Mycobacterium avium
RVASALDRMYSESKNQMSL

SEQ ID NO: 104070 - protein, 21 aa, Mycobacterium avium
RVATVLRRMFIRGEIPEGTML

SEQ ID NO: 104071 - protein, 21 aa, Mycobacterium avium
RVATVLRRMFIRGEITEGTML

SEQ ID NO: 104072 - protein, 18 aa, Mycobacterium avium
RVAVELENSVSSYASTLS

SEQ ID NO: 104073 - protein, 18 aa, Mycobacterium avium
RVAVGDRVMGLFPDGTGT

SEQ ID NO: 104074 - protein, 17 aa, Mycobacterium avium
RVAVMGCVVNGPGEARE

SEQ ID NO: 104075 - protein, 23 aa, Mycobacterium avium
RVDDPRLALAVAGGALMGLGQLL

SEQ ID NO: 104076 - protein, 20 aa, Mycobacterium avium
RVDGGRAVLFASRRRSSGAV

SEQ ID NO: 104077 - protein, 17 aa, Mycobacterium avium
RVDLGWWVIEKDTIAAM

SEQ ID NO: 104078 - protein, 18 aa, Mycobacterium avium
RVDMSVQLTPHFGNVQAH

SEQ ID NO: 104079 - protein, 26 aa, Mycobacterium avium
RVDQAVREVEAWLAAEPFRAPEADEL

SEQ ID NO: 104080 - protein, 30 aa, Mycobacterium avium
RVDTIPLRLAFSLTEPRLELVQAVPNTLWT

SEQ ID NO: 104081 - protein, 20 aa, Mycobacterium avium
RVDVVLRFTGAHWVAIDLSH

SEQ ID NO: 104082 - protein, 20 aa, Mycobacterium avium
RVEFELTGPLARVIRVSVDG

SEQ ID NO: 104083 - protein, 25 aa, Mycobacterium avium
RVELPTYAFARERFWLGGASLAGAP

SEQ ID NO: 104084 - protein, 17 aa, Mycobacterium avium
RVFAYWRHVDPDIGRKV

SEQ ID NO: 104085 - protein, 20 aa, Mycobacterium avium
RVFWPNGRIVVTREAIQLFG

SEQ ID NO: 104086 - protein, 17 aa, Mycobacterium avium
RVGAVAMGRALTLIIAP

SEQ ID NO: 104087 - protein, 18 aa, Mycobacterium avium
RVGELEPAFGEELAARYD

SEQ ID NO: 104088 - protein, 17 aa, Mycobacterium avium
RVGHALHGTQMLDRGWH

SEQ ID NO: 104089 - protein, 18 aa, Mycobacterium avium
RVGHSLDPKADYGPLVTE

SEQ ID NO: 104090 - protein, 20 aa, Mycobacterium avium
RVGIARARQMLLLPQPIGAE

SEQ ID NO: 104091 - protein, 18 aa, Mycobacterium avium
RVGLVNAVVRFDVDAGSD

SEQ ID NO: 104092 - protein, 18 aa, Mycobacterium avium
RVGPHGTRVYRARVYYRG

SEQ ID NO: 104093 - protein, 18 aa, Mycobacterium avium
RVGPVGGQRQPLGHAGQR

SEQ ID NO: 104094 - protein, 17 aa, Mycobacterium avium
RVGRFGLEQAYGLDELA

SEQ ID NO: 104095 - protein, 24 aa, Mycobacterium avium
RVGRHAGWRALRRAVECAQRKSEL

SEQ ID NO: 104096 - protein, 18 aa, Mycobacterium avium
RVGVFPRVGFKQQRWWDV

SEQ ID NO: 104097 - protein, 25 aa, Mycobacterium avium
RVHARTGLPCPVCGDTVREVSFADK

SEQ ID NO: 104098 - protein, 23 aa, Mycobacterium avium
RVHRWARGVDVLRFAPSARSEAL

SEQ ID NO: 104099 - protein, 17 aa, Mycobacterium avium
RVIKVERPQGGDFARGY

SEQ ID NO: 104100 - protein, 25 aa, Mycobacterium avium
RVILHGWLAFTFEICRQRIIDPTTD

SEQ ID NO: 104101 - protein, 18 aa, Mycobacterium avium
RVISELIAIVAGGQPLTP

SEQ ID NO: 104102 - protein, 24 aa, Mycobacterium avium
RVKALGFKMALSVGQHTNDRELSY

SEQ ID NO: 104103 - protein, 25 aa, Mycobacterium avium
RVKLAGFKIPQYWYSVTELPLNSAG

SEQ ID NO: 104104 - protein, 26 aa, Mycobacterium avium
RVKLGPSLWHRDFYDAVIVECPDKSL

SEQ ID NO: 104105 - protein, 25 aa, Mycobacterium avium
RVKRGPLPALERLHRALLAGKPAPC

SEQ ID NO: 104106 - protein, 24 aa, Mycobacterium avium
RVKRGPLPALERLHRALLSGKPAP

SEQ ID NO: 104107 - protein, 25 aa, Mycobacterium avium
RVKRGPLPALERLHRALLSGKPAPC

SEQ ID NO: 104108 - protein, 17 aa, Mycobacterium avium
RVKRRMVALQGSGTLSF

SEQ ID NO: 104109 - protein, 20 aa, Mycobacterium avium
RVLFTGNLFGPLFGHVPNLV

SEQ ID NO: 104110 - protein, 19 aa, Mycobacterium avium
RVLKRLQPRLYSISSSPKA

SEQ ID NO: 104111 - protein, 26 aa, Mycobacterium avium
RVLPNGVCLLPPLKTCDKGNACLSCG

SEQ ID NO: 104112 - protein, 24 aa, Mycobacterium avium
RVLRRARDGVALNIDEAAVAMTAR

SEQ ID NO: 104113 - protein, 32 aa, Mycobacterium avium
RVLSEASGWRTTYPADHSWMVATLSGARSSSS

SEQ ID NO: 104114 - protein, 26 aa, Mycobacterium avium
RVNAICPAAMPLTGFMAAGGLEVDAE

SEQ ID NO: 104115 - protein, 19 aa, Mycobacterium avium
RVPAARIVDRPEWIAAAAE

SEQ ID NO: 104116 - protein, 19 aa, Mycobacterium avium
RVPDRKGFGTLRLSDYPLI

SEQ ID NO: 104117 - protein, 18 aa, Mycobacterium avium
RVPEERWVFLHGHADMVD

SEQ ID NO: 104118 - protein, 17 aa, Mycobacterium avium
RVPEPGVAELLAGSRTV

SEQ ID NO: 104119 - protein, 17 aa, Mycobacterium avium
RVPERFDIGEGYGKTSW

SEQ ID NO: 104120 - protein, 25 aa, Mycobacterium avium
RVPGADAFRSWRVLVSKYGTPAPGP

SEQ ID NO: 104121 - protein, 24 aa, Mycobacterium avium
RVPNPYILATVFSFNGVTPNADAY

SEQ ID NO: 104122 - protein, 21 aa, Mycobacterium avium
RVPPGDPFGVYAGKTDGNPET

SEQ ID NO: 104123 - protein, 25 aa, Mycobacterium avium
RVPRVDSYGGFVFGSFAPDGPSLVE

SEQ ID NO: 104124 - protein, 17 aa, Mycobacterium avium
RVQPPLARNYGYVVLTN

SEQ ID NO: 104125 - protein, 17 aa, Mycobacterium avium
RVQPPLARNYGYVVVTN

SEQ ID NO: 104126 - protein, 23 aa, Mycobacterium avium
RVRARWERRLAEAGVGELHAELA

SEQ ID NO: 104127 - protein, 17 aa, Mycobacterium avium
RVRCAGHLRREQVHHRH

SEQ ID NO: 104128 - protein, 20 aa, Mycobacterium avium
RVRDGDVAWLTRPIIDSYHT

SEQ ID NO: 104129 - protein, 23 aa, Mycobacterium avium
RVRDGLLEIGRKLNIPPLATNDC

SEQ ID NO: 104130 - protein, 19 aa, Mycobacterium avium
RVREALAEVLGVYGPPLKF

SEQ ID NO: 104131 - protein, 18 aa, Mycobacterium avium
RVRELTAGAVGANIALLF

SEQ ID NO: 104132 - protein, 17 aa, Mycobacterium avium
RVREMILAAAFVPPQGQ

SEQ ID NO: 104133 - protein, 19 aa, Mycobacterium avium
RVRLPGGMLTPAQLTVLCD

SEQ ID NO: 104134 - protein, 19 aa, Mycobacterium avium
RVRNTAFAFEKFTRATLEH

SEQ ID NO: 104135 - protein, 19 aa, Mycobacterium avium
RVRPRRVLAAAARLEPAGP

SEQ ID NO: 104136 - protein, 22 aa, Mycobacterium avium
RVRRRDCWVFAFAFAGRPGVRL

SEQ ID NO: 104137 - protein, 20 aa, Mycobacterium avium
RVRSAMRGCVVFDGRNIYDP

SEQ ID NO: 104138 - protein, 19 aa, Mycobacterium avium
RVSSLVIINGAARTVYAPD

SEQ ID NO: 104139 - protein, 18 aa, Mycobacterium avium
RVTARFCVMATGPLSAAM

SEQ ID NO: 104140 - protein, 22 aa, Mycobacterium avium
RVTELLPLAAAYDMTAAELAAA

SEQ ID NO: 104141 - protein, 18 aa, Mycobacterium avium
RVTLELGGKSANIVFADC

SEQ ID NO: 104142 - protein, 17 aa, Mycobacterium avium
RVTQPYIDRLEKWCDTY

SEQ ID NO: 104143 - protein, 21 aa, Mycobacterium avium
RVTRRSRLRVGALSQADTLDP

SEQ ID NO: 104144 - protein, 18 aa, Mycobacterium avium
RVVAALGPRVLKLSAERS

SEQ ID NO: 104145 - protein, 19 aa, Mycobacterium avium
RVVAALGPRVLRLSAERSA

SEQ ID NO: 104146 - protein, 29 aa, Mycobacterium avium
RVVAVDLRDDWPAALRAAGFDPARPTAWS

SEQ ID NO: 104147 - protein, 20 aa, Mycobacterium avium
RVVDNVRYFAALYGFDGQAA

SEQ ID NO: 104148 - protein, 20 aa, Mycobacterium avium
RVVELAAWTFVPAAGAVLAD

SEQ ID NO: 104149 - protein, 18 aa, Mycobacterium avium
RVVFVRYALPGERVRVRV

SEQ ID NO: 104150 - protein, 19 aa, Mycobacterium avium
RVVFVRYALPGERVRVRVT

SEQ ID NO: 104151 - protein, 17 aa, Mycobacterium avium
RVVLADRARRDAAAAQS

SEQ ID NO: 104152 - protein, 18 aa, Mycobacterium avium
RVVRPLDVDLRWVAALLL

SEQ ID NO: 104153 - protein, 19 aa, Mycobacterium avium
RVVSPDAFFQFPTSKYGLA

SEQ ID NO: 104154 - protein, 20 aa, Mycobacterium avium
RVVSPHVPFGGMGHSGIGRE

SEQ ID NO: 104155 - protein, 18 aa, Mycobacterium avium
RVVVLCRPHNPTGTVESA

SEQ ID NO: 104156 - protein, 19 aa, Mycobacterium avium
RVVVSRGWAGLGPIDDGED

SEQ ID NO: 104157 - protein, 20 aa, Mycobacterium avium
RVVWIAGGLLKGASVDAEVA

SEQ ID NO: 104158 - protein, 20 aa, Mycobacterium avium
RVVWIAGGLLKGASVDAVVA

SEQ ID NO: 104159 - protein, 23 aa, Mycobacterium avium
RVWAPKPARLRLDVEGRPHAMSR

SEQ ID NO: 104160 - protein, 23 aa, Mycobacterium avium
RVWFGERWIDSVLDLFAENIRYF

SEQ ID NO: 104161 - protein, 17 aa, Mycobacterium avium
RVWTGRSKFSAELASQW

SEQ ID NO: 104162 - protein, 25 aa, Mycobacterium avium
RVYADLRAAGFGQLAFVDLFNHSTL

SEQ ID NO: 104163 - protein, 18 aa, Mycobacterium avium
RWAKPIVLHSSWAGQGDP

SEQ ID NO: 104164 - protein, 18 aa, Mycobacterium avium
RWAMAATLGDHVRMTRPQ

SEQ ID NO: 104165 - protein, 21 aa, Mycobacterium avium
RWAPPGVRVSVGFDRKRLLHG

SEQ ID NO: 104166 - protein, 18 aa, Mycobacterium avium
RWAYYPWRRAVVAVLGPR

SEQ ID NO: 104167 - protein, 20 aa, Mycobacterium avium
RWCCWPRRAAGWWTGRRCRD

SEQ ID NO: 104168 - protein, 25 aa, Mycobacterium avium
RWDADGWAGYYYYGFSQAIGGGTSE

SEQ ID NO: 104169 - protein, 21 aa, Mycobacterium avium
RWEPPALQIARYVTRDVEYYG

SEQ ID NO: 104170 - protein, 21 aa, Mycobacterium avium
RWGPARIAYLLGLNVSTVHRV

SEQ ID NO: 104171 - protein, 25 aa, Mycobacterium avium
RWHSLARLAICDDIYASLRSLCFDV

SEQ ID NO: 104172 - protein, 17 aa, Mycobacterium avium
RWIDFLRRWEPAGWPSP

SEQ ID NO: 104173 - protein, 22 aa, Mycobacterium avium
RWIEIAAEWGRRDYWAQWRAVR

SEQ ID NO: 104174 - protein, 17 aa, Mycobacterium avium
RWLDAMPQYGPGHAELV

SEQ ID NO: 104175 - protein, 19 aa, Mycobacterium avium
RWLRMRERLGLDVNVAALT

SEQ ID NO: 104176 - protein, 17 aa, Mycobacterium avium
RWPRWRPMFAPSRMPCG

SEQ ID NO: 104177 - protein, 21 aa, Mycobacterium avium
RWPSKSELILAAVIEGTRQSA

SEQ ID NO: 104178 - protein, 24 aa, Mycobacterium avium
RWQHLAGLLPEFALAAPDLVGHGR

SEQ ID NO: 104179 - protein, 26 aa, Mycobacterium avium
RWQHLAGLLPEFAWAAPDLVGHGRSS

SEQ ID NO: 104180 - protein, 18 aa, Mycobacterium avium
RWRHFAFGVLGFAEGKGP

SEQ ID NO: 104181 - protein, 17 aa, Mycobacterium avium
RWRPWRSYATQYLWTTL

SEQ ID NO: 104182 - protein, 17 aa, Mycobacterium avium
RWSRGNMLPGLRCHSDA

SEQ ID NO: 104183 - protein, 25 aa, Mycobacterium avium
RWVHRHVLRLGGWTIVRSARDEVVL

SEQ ID NO: 104184 - protein, 24 aa, Mycobacterium avium
RYANLLEHLASWGVVAAAPDTQRG

SEQ ID NO: 104185 - protein, 20 aa, Mycobacterium avium
RYDRRRAVVTGCASGIGEQV

SEQ ID NO: 104186 - protein, 21 aa, Mycobacterium avium
RYFTVRAGSLVAWDSTGADGP

SEQ ID NO: 104187 - protein, 21 aa, Mycobacterium avium
RYFTVRAGSLVAWNSTGADGP

SEQ ID NO: 104188 - protein, 18 aa, Mycobacterium avium
RYGLAGILIQLARQRGVS

SEQ ID NO: 104189 - protein, 19 aa, Mycobacterium avium
RYGTNVGFVPQWAGTAEQI

SEQ ID NO: 104190 - protein, 24 aa, Mycobacterium avium
RYGVDELRAFDLLRRLSQESQTKL

SEQ ID NO: 104191 - protein, 17 aa, Mycobacterium avium
RYHGWTWDLAGALKRVP

SEQ ID NO: 104192 - protein, 25 aa, Mycobacterium avium
RYIIPDPRHPAGRQVLFYAGDDAPA

SEQ ID NO: 104193 - protein, 25 aa, Mycobacterium avium
RYKEWLTIHRVWRSTLPDQNDKGTV

SEQ ID NO: 104194 - protein, 26 aa, Mycobacterium avium
RYLDCARCAGMLKPDIVYFGESVPKD

SEQ ID NO: 104195 - protein, 23 aa, Mycobacterium avium
RYLGELPLSLDLTYLAPAIGRQV

SEQ ID NO: 104196 - protein, 24 aa, Mycobacterium avium
RYLGELPLSLDLTYLAPAIGRQVL

SEQ ID NO: 104197 - protein, 23 aa, Mycobacterium avium
RYLGELPLSLDLTYLAPPIGRQV

SEQ ID NO: 104198 - protein, 23 aa, Mycobacterium avium
RYLPDRHRIACPTLGLDITGEPV

SEQ ID NO: 104199 - protein, 18 aa, Mycobacterium avium
RYLRARRAHRLSNTGALW

SEQ ID NO: 104200 - protein, 25 aa, Mycobacterium avium
RYLRDLKTADEWRAAAFTSAEDGLA

SEQ ID NO: 104201 - protein, 26 aa, Mycobacterium avium
RYLYPRVEVEVGFILNADLPGAGCTE

SEQ ID NO: 104202 - protein, 22 aa, Mycobacterium avium
RYNAVCSVYGHLHIPRTTWYDD

SEQ ID NO: 104203 - protein, 30 aa, Mycobacterium avium
RYNLMFPMRAVKHWNRWCEGAGIGDVARLV

SEQ ID NO: 104204 - protein, 21 aa, Mycobacterium avium
RYPGDVTPQWLSAALSGRGAP

SEQ ID NO: 104205 - protein, 25 aa, Mycobacterium avium
RYQEVIPMHECRSAKQLAAVIDQLL

SEQ ID NO: 104206 - protein, 20 aa, Mycobacterium avium
RYRMRWSLHGDGARSKRSPV

SEQ ID NO: 104207 - protein, 19 aa, Mycobacterium avium
RYSGSLLREGDDWYERGPL

SEQ ID NO: 104208 - protein, 21 aa, Mycobacterium avium
RYSKLASFSRTTGHRMDGGSF

SEQ ID NO: 104209 - protein, 24 aa, Mycobacterium avium
RYTDRPVWVRGVGLGMDRVMHQHK

SEQ ID NO: 104210 - protein, 19 aa, Mycobacterium avium
RYVAECLAVARAEGARLSD

SEQ ID NO: 104211 - protein, 17 aa, Mycobacterium avium
RYVTGLQMRVDAGSVIK

SEQ ID NO: 104212 - protein, 17 aa, Mycobacterium avium
SAAAAWAARAGHDVLVV

SEQ ID NO: 104213 - protein, 20 aa, Mycobacterium avium
SAAAMVWRAAAAIELGICDA

SEQ ID NO: 104214 - protein, 18 aa, Mycobacterium avium
SAADPFVIALAMVHNGTV

SEQ ID NO: 104215 - protein, 25 aa, Mycobacterium avium
SAADWEPLEAGLLQRSRVLDAVLAD

SEQ ID NO: 104216 - protein, 21 aa, Mycobacterium avium
SAAEPRWVYFTSGTTGRPKAV

SEQ ID NO: 104217 - protein, 34 aa, Mycobacterium avium
SAAGTRWLWDAGIRPGMTIAWQLPSHVSAALLML

SEQ ID NO: 104218 - protein, 17 aa, Mycobacterium avium
SAAMLAPYELMWPQDVL

SEQ ID NO: 104219 - protein, 19 aa, Mycobacterium avium
SAANRPAIYVATYFGDPGA

SEQ ID NO: 104220 - protein, 24 aa, Mycobacterium avium
SAAPEVVGPLLFPLSSTSAEQLRV

SEQ ID NO: 104221 - protein, 24 aa, Mycobacterium avium
SAAQAIRVAREFARSAEESGGRSM

SEQ ID NO: 104222 - protein, 17 aa, Mycobacterium avium
SAARKPTAAAWIVNRLA

SEQ ID NO: 104223 - protein, 25 aa, Mycobacterium avium
SAASNPDLFWALRGGGGGNFGVTTS

SEQ ID NO: 104224 - protein, 27 aa, Mycobacterium avium
SADARGRFPGRYRMAVLENLSRVSSRL

SEQ ID NO: 104225 - protein, 19 aa, Mycobacterium avium
SADGEGFIEVTFRGANSLG

SEQ ID NO: 104226 - protein, 22 aa, Mycobacterium avium
SADGLRLIRKVVHLVDAGGPVE

SEQ ID NO: 104227 - protein, 21 aa, Mycobacterium avium
SADGQQGWSEVPGLTVPGAAP

SEQ ID NO: 104228 - protein, 18 aa, Mycobacterium avium
SADLLAFEFGDLMDNDLT

SEQ ID NO: 104229 - protein, 23 aa, Mycobacterium avium
SADMLRYRPYDILSRTRNALRAS

SEQ ID NO: 104230 - protein, 33 aa, Mycobacterium avium
SAEAACIPSLYEGFSLPAVEAMASGTPIVASRV

SEQ ID NO: 104231 - protein, 24 aa, Mycobacterium avium
SAEADPRVLPGLVAASQQAAATAP

SEQ ID NO: 104232 - protein, 18 aa, Mycobacterium avium
SAEDFPRSEHLAWKIAEV

SEQ ID NO: 104233 - protein, 23 aa, Mycobacterium avium
SAEDRLREVLARYGPQDPVHRAV

SEQ ID NO: 104234 - protein, 26 aa, Mycobacterium avium
SAEGRVAALRRCVPMVAQIKDPTLRD

SEQ ID NO: 104235 - protein, 24 aa, Mycobacterium avium
SAELFAAEVMPHFQGQAQPTLDAA

SEQ ID NO: 104236 - protein, 20 aa, Mycobacterium avium
SAEQRARCLNQLGEALTKHA

SEQ ID NO: 104237 - protein, 22 aa, Mycobacterium avium
SAERAFDILVWRSQETNLKLRD

SEQ ID NO: 104238 - protein, 23 aa, Mycobacterium avium
SAERPRGVFSRQLFLGDNLDTDK

SEQ ID NO: 104239 - protein, 19 aa, Mycobacterium avium
SAFGDIGPWSTRMGYGPLV

SEQ ID NO: 104240 - protein, 28 aa, Mycobacterium avium
SAGPPPWHLYRFVLRAAVGVALTEPHGA

SEQ ID NO: 104241 - protein, 24 aa, Mycobacterium avium
SAGSSPRGRLRCPASRGTRLPTRP

SEQ ID NO: 104242 - protein, 18 aa, Mycobacterium avium
SAGVWPLVINDATVVERS

SEQ ID NO: 104243 - protein, 18 aa, Mycobacterium avium
SAHGPLSTAVRCALTGPP

SEQ ID NO: 104244 - protein, 26 aa, Mycobacterium avium
SAHRHPRLLPGRMPAPVRRRHRRGQL

SEQ ID NO: 104245 - protein, 20 aa, Mycobacterium avium
SAHVDLHFEAAVAGAIPVIR

SEQ ID NO: 104246 - protein, 27 aa, Mycobacterium avium
SAIRAWLEREGTCLLLAPHHDVGGTDD

SEQ ID NO: 104247 - protein, 18 aa, Mycobacterium avium
SAIRRSFDLVGFDPRGVG

SEQ ID NO: 104248 - protein, 27 aa, Mycobacterium avium
SAKELYEIRTLFGVMFQDGALFGSMNL

SEQ ID NO: 104249 - protein, 24 aa, Mycobacterium avium
SAKEVTALARWFRIDGDELSYSVQ

SEQ ID NO: 104250 - protein, 24 aa, Mycobacterium avium
SAKEVTALARWFRVDGDELSYSVQ

SEQ ID NO: 104251 - protein, 17 aa, Mycobacterium avium
SAKSKRCLIPMDGYYEW

SEQ ID NO: 104252 - protein, 24 aa, Mycobacterium avium
SAKTTPPRIAFVFPGQGNQWQAMG

SEQ ID NO: 104253 - protein, 17 aa, Mycobacterium avium
SALARASRWNRISDYLV

SEQ ID NO: 104254 - protein, 19 aa, Mycobacterium avium
SALARNAAELGLIPDTAHL

SEQ ID NO: 104255 - protein, 18 aa, Mycobacterium avium
SALDAALDPILAALVLGG

SEQ ID NO: 104256 - protein, 21 aa, Mycobacterium avium
SALDMTCQWAKDRDVFGGRLA

SEQ ID NO: 104257 - protein, 19 aa, Mycobacterium avium
SALEVELAKAFKAFPRSDV

SEQ ID NO: 104258 - protein, 18 aa, Mycobacterium avium
SALEVELAKAFKASPRSD

SEQ ID NO: 104259 - protein, 19 aa, Mycobacterium avium
SALGQPRVEPHDNFFQLGG

SEQ ID NO: 104260 - protein, 23 aa, Mycobacterium avium
SALHHPCCGDLVYGADPKLAKKL

SEQ ID NO: 104261 - protein, 23 aa, Mycobacterium avium
SALKRLMTRWQLKADNSPNDHGD

SEQ ID NO: 104262 - protein, 23 aa, Mycobacterium avium
SALLARWLPQYVDPEAVRVVEGD

SEQ ID NO: 104263 - protein, 21 aa, Mycobacterium avium
SALLEGYKVLPDCGYTDVGTS

SEQ ID NO: 104264 - protein, 17 aa, Mycobacterium avium
SALRFAEEGARVVAADI

SEQ ID NO: 104265 - protein, 20 aa, Mycobacterium avium
SALTAAQFAAHAQMYQAVSA

SEQ ID NO: 104266 - protein, 20 aa, Mycobacterium avium
SALTAAQFAAYAQMYQAVSA

SEQ ID NO: 104267 - protein, 27 aa, Mycobacterium avium
SALTRARAGWLWSRRRGVIAGLSAAAV

SEQ ID NO: 104268 - protein, 19 aa, Mycobacterium avium
SALWNIRGYPSAKISFIDN

SEQ ID NO: 104269 - protein, 25 aa, Mycobacterium avium
SANAVRGALMGGYFAGLLNRSVLQT

SEQ ID NO: 104270 - protein, 27 aa, Mycobacterium avium
SANGGNAQRWFVVWLGTSNDPVDKVAA

SEQ ID NO: 104271 - protein, 24 aa, Mycobacterium avium
SANGITFHRGRLFIGECRERGRLL

SEQ ID NO: 104272 - protein, 25 aa, Mycobacterium avium
SANWERPSNLAGWSVRDLVGHATGS

SEQ ID NO: 104273 - protein, 25 aa, Mycobacterium avium
SAPAIKLLIHRAGARSSDIAAELAK

SEQ ID NO: 104274 - protein, 25 aa, Mycobacterium avium
SAPAIKLLIRRAGARSSDIAAELAK

SEQ ID NO: 104275 - protein, 25 aa, Mycobacterium avium
SAPAIKLLIRRAGARSSDMAAELAK

SEQ ID NO: 104276 - protein, 22 aa, Mycobacterium avium
SAPERLGGPGVDDFRYNAIVVD

SEQ ID NO: 104277 - protein, 22 aa, Mycobacterium avium
SAPGSRLAFDFVPDTAVFADPR

SEQ ID NO: 104278 - protein, 19 aa, Mycobacterium avium
SAPKHSGITYFLLDMKSEG

SEQ ID NO: 104279 - protein, 20 aa, Mycobacterium avium
SAPLRPGALGGVPIGSPVPG

SEQ ID NO: 104280 - protein, 17 aa, Mycobacterium avium
SAPRGAAALAPLARQPR

SEQ ID NO: 104281 - protein, 20 aa, Mycobacterium avium
SAPYRYQLRLPPGAEQAPRR

SEQ ID NO: 104282 - protein, 19 aa, Mycobacterium avium
SAQALRVLFDAHLVDENER

SEQ ID NO: 104283 - protein, 17 aa, Mycobacterium avium
SAQRLGKLLAESGLATG

SEQ ID NO: 104284 - protein, 21 aa, Mycobacterium avium
SARMYRTGDLVRWRADGQLDY

SEQ ID NO: 104285 - protein, 22 aa, Mycobacterium avium
SARRVARACRLRGHRKAEAAVV

SEQ ID NO: 104286 - protein, 22 aa, Mycobacterium avium
SARSEWAPELALHEFGSAEELL

SEQ ID NO: 104287 - protein, 19 aa, Mycobacterium avium
SARVWTRQGGLLASSHQVV

SEQ ID NO: 104288 - protein, 35 aa, Mycobacterium avium
SASAGRAGLVGALSVPANWASAVPAVRTVAAELPE

SEQ ID NO: 104289 - protein, 36 aa, Mycobacterium avium
SASAGRAGLVGALSVPANWASAVPAVRTVAAELPET

SEQ ID NO: 104290 - protein, 24 aa, Mycobacterium avium
SASDRGAGALGFAGTARKDAAGAA

SEQ ID NO: 104291 - protein, 21 aa, Mycobacterium avium
SATARLAAPRTVYAFPGQGIQ

SEQ ID NO: 104292 - protein, 17 aa, Mycobacterium avium
SATEWWLGPEPDSPRLM

SEQ ID NO: 104293 - protein, 17 aa, Mycobacterium avium
SATPQLPDRGWRRALRL

SEQ ID NO: 104294 - protein, 24 aa, Mycobacterium avium
SAVEEILRIASPVQMTARTPSCDV

SEQ ID NO: 104295 - protein, 17 aa, Mycobacterium avium
SAVFYQVYPRSFADSDG

SEQ ID NO: 104296 - protein, 18 aa, Mycobacterium avium
SAVLLCLAGGTYDKHYWH

SEQ ID NO: 104297 - protein, 19 aa, Mycobacterium avium
SAYGESKLANMLFVQELTR

SEQ ID NO: 104298 - protein, 23 aa, Mycobacterium avium
SCDCRKPGPGMLLRAAAEHDVDL

SEQ ID NO: 104299 - protein, 20 aa, Mycobacterium avium
SCGAVKAALGAIEEGAIPGG

SEQ ID NO: 104300 - protein, 19 aa, Mycobacterium avium
SCLPEPARYVTGTGRVPEK

SEQ ID NO: 104301 - protein, 19 aa, Mycobacterium avium
SCPATRSGYGFAQLARDMG

SEQ ID NO: 104302 - protein, 24 aa, Mycobacterium avium
SCPATRSGYGFAQLVRDIGAVIDS

SEQ ID NO: 104303 - protein, 23 aa, Mycobacterium avium
SCPATRSGYGFAQLVRDMGAVID

SEQ ID NO: 104304 - protein, 33 aa, Mycobacterium avium
SCRTGRLRIEYCDGCARWVHPASGRCRDCGGAL

SEQ ID NO: 104305 - protein, 17 aa, Mycobacterium avium
SCSDLYARDTWQLVHAG

SEQ ID NO: 104306 - protein, 26 aa, Mycobacterium avium
SCVKVKGFRNVIHWTVTRYDEPKSIE

SEQ ID NO: 104307 - protein, 19 aa, Mycobacterium avium
SCVPPDFLFMHTGLALATG

SEQ ID NO: 104308 - protein, 26 aa, Mycobacterium avium
SDAAAWLARHGWRVHSVDNRDEMARL

SEQ ID NO: 104309 - protein, 17 aa, Mycobacterium avium
SDAAGYITGAWIEVDGG

SEQ ID NO: 104310 - protein, 26 aa, Mycobacterium avium
SDAELKAAVWELVWAGWITGDTFAPV

SEQ ID NO: 104311 - protein, 31 aa, Mycobacterium avium
SDANEIYAAICIAATLTVRGCDHASLLVREN

SEQ ID NO: 104312 - protein, 18 aa, Mycobacterium avium
SDAYLARTGSRPQVLLLP

SEQ ID NO: 104313 - protein, 18 aa, Mycobacterium avium
SDDARWVNGQALAADGGI

SEQ ID NO: 104314 - protein, 22 aa, Mycobacterium avium
SDDEWRARIALRQQQVAARMLG

SEQ ID NO: 104315 - protein, 17 aa, Mycobacterium avium
SDDFFALFLDPNMVYTC

SEQ ID NO: 104316 - protein, 18 aa, Mycobacterium avium
SDDLAALAHYTGPGYQEL

SEQ ID NO: 104317 - protein, 17 aa, Mycobacterium avium
SDEFFALFLDPTMAYTC

SEQ ID NO: 104318 - protein, 18 aa, Mycobacterium avium
SDESRYVTGLQFKVDAGA

SEQ ID NO: 104319 - protein, 23 aa, Mycobacterium avium
SDFLRAGWELDQHLDLYVETVHR

SEQ ID NO: 104320 - protein, 18 aa, Mycobacterium avium
SDFLSSGSPFSRPVNGTD

SEQ ID NO: 104321 - protein, 18 aa, Mycobacterium avium
SDFPVDRGWDVEGLYDPD

SEQ ID NO: 104322 - protein, 19 aa, Mycobacterium avium
SDFPVDRGWDVEGLYDPDP

SEQ ID NO: 104323 - protein, 18 aa, Mycobacterium avium
SDGSWSGWVEPLADAIRL

SEQ ID NO: 104324 - protein, 22 aa, Mycobacterium avium
SDGTHTWVRCGWRRSAAAMRTT

SEQ ID NO: 104325 - protein, 22 aa, Mycobacterium avium
SDGTLRFLLWAAALLSPQPPSL

SEQ ID NO: 104326 - protein, 23 aa, Mycobacterium avium
SDGTLRFLLWAAALLSPQPPSLM

SEQ ID NO: 104327 - protein, 23 aa, Mycobacterium avium
SDGTLRFLLWSAALLSPQPPSLM

SEQ ID NO: 104328 - protein, 19 aa, Mycobacterium avium
SDGVLKLSSVVGYAPQKLM

SEQ ID NO: 104329 - protein, 20 aa, Mycobacterium avium
SDISNAVLFLASDESRYVTG

SEQ ID NO: 104330 - protein, 26 aa, Mycobacterium avium
SDISRAQLAAGLAYHCPLTYRPLLAK

SEQ ID NO: 104331 - protein, 17 aa, Mycobacterium avium
SDLGWTAPLYMSDGQMW

SEQ ID NO: 104332 - protein, 25 aa, Mycobacterium avium
SDLHVAELYDPFSIVTLVLLDEYRL

SEQ ID NO: 104333 - protein, 17 aa, Mycobacterium avium
SDLLVAECLRTGAWSGL

SEQ ID NO: 104334 - protein, 17 aa, Mycobacterium avium
SDLPAFRGARGRLPGDD

SEQ ID NO: 104335 - protein, 17 aa, Mycobacterium avium
SDLPAQLSTLIDVTPTM

SEQ ID NO: 104336 - protein, 17 aa, Mycobacterium avium
SDLPGFVLHVEISEDMF

SEQ ID NO: 104337 - protein, 19 aa, Mycobacterium avium
SDLRFFHFLGKEIFPGGQM

SEQ ID NO: 104338 - protein, 19 aa, Mycobacterium avium
SDLRGKAIAVAKGSSSHAN

SEQ ID NO: 104339 - protein, 23 aa, Mycobacterium avium
SDLRGRFRWMGLYTQREQGYDGS

SEQ ID NO: 104340 - protein, 18 aa, Mycobacterium avium
SDPAPWVIGGAQIYLLAL

SEQ ID NO: 104341 - protein, 19 aa, Mycobacterium avium
SDPLGRFSAITREWFTSTF

SEQ ID NO: 104342 - protein, 32 aa, Mycobacterium avium
SDPLLATEVPHWAGESLLYFTPQVPQLTQLSF

SEQ ID NO: 104343 - protein, 18 aa, Mycobacterium avium
SDQHVWCFLGDGEMDEPE

SEQ ID NO: 104344 - protein, 17 aa, Mycobacterium avium
SDQPRALIDILRGVLDG

SEQ ID NO: 104345 - protein, 22 aa, Mycobacterium avium
SDRAEFGWQPGVDSWLAGWDEE

SEQ ID NO: 104346 - protein, 27 aa, Mycobacterium avium
SDRRFARARLRAEVLPLLEEVLGGGVV

SEQ ID NO: 104347 - protein, 27 aa, Mycobacterium avium
SDRRFTRARLRAEVLPLLEEVLGGGVA

SEQ ID NO: 104348 - protein, 18 aa, Mycobacterium avium
SDRVHRLLSACVRDRDLV

SEQ ID NO: 104349 - protein, 18 aa, Mycobacterium avium
SDSALLQRLQVVLRGAQL

SEQ ID NO: 104350 - protein, 19 aa, Mycobacterium avium
SDSFQGRSSVGTWLFGIVK

SEQ ID NO: 104351 - protein, 19 aa, Mycobacterium avium
SDSFYRTWYPTPLGPVPTP

SEQ ID NO: 104352 - protein, 20 aa, Mycobacterium avium
SDSHRCIAPTLPFGAQAAPV

SEQ ID NO: 104353 - protein, 17 aa, Mycobacterium avium
SDSIKRKDPSGVTHANI

SEQ ID NO: 104354 - protein, 25 aa, Mycobacterium avium
SDSPLWPVRSAVIICGGGEIQQNEH

SEQ ID NO: 104355 - protein, 18 aa, Mycobacterium avium
SDSRACAVRERQAELDEL

SEQ ID NO: 104356 - protein, 19 aa, Mycobacterium avium
SDVFLTNYLPSTRKKLSID

SEQ ID NO: 104357 - protein, 31 aa, Mycobacterium avium
SDVFPGVGLKGGVCYFLWDRDNPGSCRVTTH

SEQ ID NO: 104358 - protein, 17 aa, Mycobacterium avium
SDVGYARAVRVGPHVWV

SEQ ID NO: 104359 - protein, 18 aa, Mycobacterium avium
SDVIRLSRHAHHYLAIFD

SEQ ID NO: 104360 - protein, 20 aa, Mycobacterium avium
SDVIRLSRHAHHYLAIFDQG

SEQ ID NO: 104361 - protein, 17 aa, Mycobacterium avium
SDVLISYHAPFGTGVNF

SEQ ID NO: 104362 - protein, 23 aa, Mycobacterium avium
SDVRPGVPVLFLDTGYHFPETIG

SEQ ID NO: 104363 - protein, 18 aa, Mycobacterium avium
SDVVLAGRSAKFFSGAVR

SEQ ID NO: 104364 - protein, 25 aa, Mycobacterium avium
SDWLPQQRWYAGRNRRLTGAEPSVI

SEQ ID NO: 104365 - protein, 20 aa, Mycobacterium avium
SDWPFAPVAVGKLFAAGLET

SEQ ID NO: 104366 - protein, 20 aa, Mycobacterium avium
SDYFYVWLRRSLRSVHPRLL

SEQ ID NO: 104367 - protein, 17 aa, Mycobacterium avium
SDYRACAVRARQAELDE

SEQ ID NO: 104368 - protein, 26 aa, Mycobacterium avium
SDYVEWRKRPEWEIDMDNARRSRTST

SEQ ID NO: 104369 - protein, 20 aa, Mycobacterium avium
SEAGLYLWVTRGEPCRDTIT

SEQ ID NO: 104370 - protein, 39 aa, Mycobacterium avium
SEAISGMNAVGGWRGAPRPVLARELLPERALMGDASAIV

SEQ ID NO: 104371 - protein, 17 aa, Mycobacterium avium
SEARPLLDELIRRSDVF

SEQ ID NO: 104372 - protein, 22 aa, Mycobacterium avium
SEAYPRLVVATITGWGSTGPFR

SEQ ID NO: 104373 - protein, 18 aa, Mycobacterium avium
SEDLLKVMLREPDELGDL

SEQ ID NO: 104374 - protein, 23 aa, Mycobacterium avium
SEDLRWWPVDALPADTDHALAYL

SEQ ID NO: 104375 - protein, 24 aa, Mycobacterium avium
SEDLRWWPVDALPAGTDHALAYLV

SEQ ID NO: 104376 - protein, 24 aa, Mycobacterium avium
SEDLRWWPVDGLPAGTDHALAYLV

SEQ ID NO: 104377 - protein, 19 aa, Mycobacterium avium
SEFDHLLLTAHQRLKASDT

SEQ ID NO: 104378 - protein, 21 aa, Mycobacterium avium
SEFNALIWMPPHAERAGDIVL

SEQ ID NO: 104379 - protein, 23 aa, Mycobacterium avium
SEFPWCAQAADLLRSRFGERLDV

SEQ ID NO: 104380 - protein, 17 aa, Mycobacterium avium
SEGSGYDILIGRSNASM

SEQ ID NO: 104381 - protein, 21 aa, Mycobacterium avium
SEHGMPVGMMLSADIGQEALL

SEQ ID NO: 104382 - protein, 18 aa, Mycobacterium avium
SEHLAWKIAEVAADPVAV

SEQ ID NO: 104383 - protein, 23 aa, Mycobacterium avium
SEIDRAELARMFAGIDIHQAIPV

SEQ ID NO: 104384 - protein, 18 aa, Mycobacterium avium
SELFGVVGRFRRQLRRSA

SEQ ID NO: 104385 - protein, 26 aa, Mycobacterium avium
SELTAEVLRDGWLRTGDVGVLGDDGN

SEQ ID NO: 104386 - protein, 18 aa, Mycobacterium avium
SELVDAFANFEATVDAAA

SEQ ID NO: 104387 - protein, 22 aa, Mycobacterium avium
SENDTCFAEWGLTSPLGSGAPL

SEQ ID NO: 104388 - protein, 25 aa, Mycobacterium avium
SEPLARRYMAAGASFVLVGADVALL

SEQ ID NO: 104389 - protein, 25 aa, Mycobacterium avium
SEPLTEAIPLWKRPRTAPSSPAGTT

SEQ ID NO: 104390 - protein, 21 aa, Mycobacterium avium
SEPVAVVGMACRYAGGVDSPE

SEQ ID NO: 104391 - protein, 18 aa, Mycobacterium avium
SERWVRNWNAHDVDAVLD

SEQ ID NO: 104392 - protein, 20 aa, Mycobacterium avium
SESQERMCAVVTPENVDAFL

SEQ ID NO: 104393 - protein, 21 aa, Mycobacterium avium
SESTVEGFVLPGFAVGDNAGS

SEQ ID NO: 104394 - protein, 26 aa, Mycobacterium avium
SETGRLRLARCVVEDGWSLRRAAERF

SEQ ID NO: 104395 - protein, 26 aa, Mycobacterium avium
SETQWRAPSPLPGWDVKAVVSHMIGT

SEQ ID NO: 104396 - protein, 19 aa, Mycobacterium avium
SEVALDFPVSRRVRPESKT

SEQ ID NO: 104397 - protein, 20 aa, Mycobacterium avium
SEVALDFPVSRRVRPESKTL

SEQ ID NO: 104398 - protein, 21 aa, Mycobacterium avium
SEVFEMPSVRHWPHFEDPESF

SEQ ID NO: 104399 - protein, 17 aa, Mycobacterium avium
SEVQAWAAEISRKQSAA

SEQ ID NO: 104400 - protein, 17 aa, Mycobacterium avium
SEVWTFNGAIIPNIGLN

SEQ ID NO: 104401 - protein, 24 aa, Mycobacterium avium
SEYPVEACALLFRAQGRSLALTDA

SEQ ID NO: 104402 - protein, 33 aa, Mycobacterium avium
SEYRGRYGISVRQLEDWHRPRLEVLAGADADVL

SEQ ID NO: 104403 - protein, 30 aa, Mycobacterium avium
SEYRGRYGLSVRQLEDWHRPRLEVLADADA

SEQ ID NO: 104404 - protein, 19 aa, Mycobacterium avium
SFADWRKAWQVPDEGAPRD

SEQ ID NO: 104405 - protein, 17 aa, Mycobacterium avium
SFAELLALVQARSLAAF

SEQ ID NO: 104406 - protein, 26 aa, Mycobacterium avium
SFAGQGVGFGGWYAPVALRVDTASVD

SEQ ID NO: 104407 - protein, 25 aa, Mycobacterium avium
SFDIELRAAAPVWDMAGALGAPRPR

SEQ ID NO: 104408 - protein, 25 aa, Mycobacterium avium
SFIPACGSCRFCVNGQSYICDIGAS

SEQ ID NO: 104409 - protein, 21 aa, Mycobacterium avium
SFLQRPARWMQLLAKESHTFS

SEQ ID NO: 104410 - protein, 20 aa, Mycobacterium avium
SFPRCAAGLREGRLSLDQLG

SEQ ID NO: 104411 - protein, 21 aa, Mycobacterium avium
SFPRCAAGLREGRLSLDQLGV

SEQ ID NO: 104412 - protein, 24 aa, Mycobacterium avium
SFPRCAAGLREGRLSLDQLGVIAQ

SEQ ID NO: 104413 - protein, 23 aa, Mycobacterium avium
SFSDLGVVVGRLGKPAEIGYEPM

SEQ ID NO: 104414 - protein, 19 aa, Mycobacterium avium
SFSLALPVEREHRLRPVAG

SEQ ID NO: 104415 - protein, 23 aa, Mycobacterium avium
SFVDDFVLYWGFLALAQVRSGRH

SEQ ID NO: 104416 - protein, 17 aa, Mycobacterium avium
SFVRGARAVEYLRRRQQ

SEQ ID NO: 104417 - protein, 19 aa, Mycobacterium avium
SFVRNPRDGFLQPGHPYRM

SEQ ID NO: 104418 - protein, 19 aa, Mycobacterium avium
SGADPVLGALGFDQHPLDR

SEQ ID NO: 104419 - protein, 17 aa, Mycobacterium avium
SGADVFDGWAVVVDEAG

SEQ ID NO: 104420 - protein, 26 aa, Mycobacterium avium
SGAKWTTPGGHALVFDGGYRAGLAGT

SEQ ID NO: 104421 - protein, 26 aa, Mycobacterium avium
SGAMVLDELIPLLGNQGLDTSRVAFL

SEQ ID NO: 104422 - protein, 25 aa, Mycobacterium avium
SGAPLKAGEFILGYPDEVGPVANQP

SEQ ID NO: 104423 - protein, 21 aa, Mycobacterium avium
SGARPPAPPRPTLDAPGADLE

SEQ ID NO: 104424 - protein, 17 aa, Mycobacterium avium
SGARRGGAVSGIGGHNA

SEQ ID NO: 104425 - protein, 24 aa, Mycobacterium avium
SGARTRLREAIKLLEQAPSTVADA

SEQ ID NO: 104426 - protein, 19 aa, Mycobacterium avium
SGENVFFCATGVTNGDLLK

SEQ ID NO: 104427 - protein, 22 aa, Mycobacterium avium
SGEPRTVPVYGIPHPEGLALIA

SEQ ID NO: 104428 - protein, 25 aa, Mycobacterium avium
SGERLAAGIPKAFCEIDGASMLARA

SEQ ID NO: 104429 - protein, 18 aa, Mycobacterium avium
SGFAGRLVGTVAGDVALT

SEQ ID NO: 104430 - protein, 20 aa, Mycobacterium avium
SGFMLIGLIDHGAWITKAGI

SEQ ID NO: 104431 - protein, 19 aa, Mycobacterium avium
SGFSQRAGDVGARHDASHF

SEQ ID NO: 104432 - protein, 25 aa, Mycobacterium avium
SGGFLLTFLACFDVGDRVALASPGY

SEQ ID NO: 104433 - protein, 25 aa, Mycobacterium avium
SGGGSLLLPLGVRRIRAYASARTAH

SEQ ID NO: 104434 - protein, 25 aa, Mycobacterium avium
SGGMRQRVLIAIAFALNPGLLIADE

SEQ ID NO: 104435 - protein, 20 aa, Mycobacterium avium
SGGRGVGSAENFKVVEELAD

SEQ ID NO: 104436 - protein, 22 aa, Mycobacterium avium
SGGRLTVGLGVGNRSDEYAGTG

SEQ ID NO: 104437 - protein, 24 aa, Mycobacterium avium
SGGRMMVTFGVGWLAREFELLDVP

SEQ ID NO: 104438 - protein, 20 aa, Mycobacterium avium
SGGRPAALYRFTDAALRVTD

SEQ ID NO: 104439 - protein, 19 aa, Mycobacterium avium
SGIGRAVAIAYAREGADVL

SEQ ID NO: 104440 - protein, 20 aa, Mycobacterium avium
SGKLARRACRAQYLDGSLGT

SEQ ID NO: 104441 - protein, 23 aa, Mycobacterium avium
SGKYRRVLAMAWEKQSESNAMWA

SEQ ID NO: 104442 - protein, 19 aa, Mycobacterium avium
SGLDAADFDDLVLAESMQG

SEQ ID NO: 104443 - protein, 26 aa, Mycobacterium avium
SGLLRYGHIPGALALAERLATGVLDA

SEQ ID NO: 104444 - protein, 25 aa, Mycobacterium avium
SGLPPLSGGMVGFFAYDLVRRLERL

SEQ ID NO: 104445 - protein, 17 aa, Mycobacterium avium
SGLRIIADDVIAGVEDY

SEQ ID NO: 104446 - protein, 26 aa, Mycobacterium avium
SGLVGRSSLVYDMWGAAVNLAHQTRS

SEQ ID NO: 104447 - protein, 19 aa, Mycobacterium avium
SGMPRLYREAPLMGIWEGS

SEQ ID NO: 104448 - protein, 19 aa, Mycobacterium avium
SGMSCGHCEAAVHSEVARI

SEQ ID NO: 104449 - protein, 19 aa, Mycobacterium avium
SGNFLWWGTFWVGKHRRDP

SEQ ID NO: 104450 - protein, 21 aa, Mycobacterium avium
SGPELPEWDGTGLSGVVPIVA

SEQ ID NO: 104451 - protein, 18 aa, Mycobacterium avium
SGPFSGPANLAYLYQTFM

SEQ ID NO: 104452 - protein, 19 aa, Mycobacterium avium
SGPLGMMKAILALQHGVVP

SEQ ID NO: 104453 - protein, 22 aa, Mycobacterium avium
SGPSGQICAYGYGNPGASPGTV

SEQ ID NO: 104454 - protein, 32 aa, Mycobacterium avium
SGPVPRGRGQACARRARSHLGDLELPRHRGGG

SEQ ID NO: 104455 - protein, 24 aa, Mycobacterium avium
SGQGCALTTRMLVPRERYDEAVEL

SEQ ID NO: 104456 - protein, 23 aa, Mycobacterium avium
SGQPAPDWFPLLGGHEGAGVVAE

SEQ ID NO: 104457 - protein, 17 aa, Mycobacterium avium
SGRFLDRNTTLWASWAL

SEQ ID NO: 104458 - protein, 24 aa, Mycobacterium avium
SGRSWRVPVTAFWQAHRDAAATYR

SEQ ID NO: 104459 - protein, 18 aa, Mycobacterium avium
SGSAAALCAARQGRFDDV

SEQ ID NO: 104460 - protein, 24 aa, Mycobacterium avium
SGSAKWNLLAPYAVKSEGGAHGDA

SEQ ID NO: 104461 - protein, 25 aa, Mycobacterium avium
SGSAKWNLLAPYAVKSEGGAHGDAG

SEQ ID NO: 104462 - protein, 20 aa, Mycobacterium avium
SGSSDYLAGRAFSFISAIDS

SEQ ID NO: 104463 - protein, 24 aa, Mycobacterium avium
SGSVPQRLWAKPAITVIGIDATPV

SEQ ID NO: 104464 - protein, 25 aa, Mycobacterium avium
SGTFRCPYHGWTFRNTGELIGFPFF

SEQ ID NO: 104465 - protein, 20 aa, Mycobacterium avium
SGVDDFRFNAVIDEEIARYG

SEQ ID NO: 104466 - protein, 18 aa, Mycobacterium avium
SGVIRIQFVASQLVGVVM

SEQ ID NO: 104467 - protein, 17 aa, Mycobacterium avium
SGVRFRNRFVRTRHYLR

SEQ ID NO: 104468 - protein, 25 aa, Mycobacterium avium
SGVTLDRRRMLELAGKFAAEHPWLL

SEQ ID NO: 104469 - protein, 18 aa, Mycobacterium avium
SGVVLDFPVSRRVRPELK

SEQ ID NO: 104470 - protein, 23 aa, Mycobacterium avium
SGWKLEHMPVAMAARTRFFDSFF

SEQ ID NO: 104471 - protein, 22 aa, Mycobacterium avium
SHAKRGPGQLVEMAWDPITRIV

SEQ ID NO: 104472 - protein, 23 aa, Mycobacterium avium
SHAWIEAWTGAWWSYDPTNDAEI

SEQ ID NO: 104473 - protein, 24 aa, Mycobacterium avium
SHAWIEAWTGAWWSYDPTNDAEIT

SEQ ID NO: 104474 - protein, 17 aa, Mycobacterium avium
SHHYLAAYHWLDAGFGA

SEQ ID NO: 104475 - protein, 18 aa, Mycobacterium avium
SHIAWYTVLACFKLGIVI

SEQ ID NO: 104476 - protein, 24 aa, Mycobacterium avium
SHLQSRIRLAEFMLHSDMEPDLDV

SEQ ID NO: 104477 - protein, 23 aa, Mycobacterium avium
SHRGRGAFYPAMFQAAIDAGRPV

SEQ ID NO: 104478 - protein, 25 aa, Mycobacterium avium
SHSENRPAPVVLYFHGGGFVIGDLD

SEQ ID NO: 104479 - protein, 24 aa, Mycobacterium avium
SHVGPSGFMLIVLIDHGAWITKAG

SEQ ID NO: 104480 - protein, 22 aa, Mycobacterium avium
SIADLLGGLGLGPRRGAGSGGA

SEQ ID NO: 104481 - protein, 20 aa, Mycobacterium avium
SIAGARVRRANYVYGSAKAG

SEQ ID NO: 104482 - protein, 18 aa, Mycobacterium avium
SIAPAAWQHAGRGRPAKR

SEQ ID NO: 104483 - protein, 19 aa, Mycobacterium avium
SIAVNCVGPSTAVRTPGAA

SEQ ID NO: 104484 - protein, 18 aa, Mycobacterium avium
SIGRGIDGVAIYNSDTVT

SEQ ID NO: 104485 - protein, 24 aa, Mycobacterium avium
SIGSIYSGGFWLVPTLESLANATG

SEQ ID NO: 104486 - protein, 17 aa, Mycobacterium avium
SIKAATDDLDFLRLAVL

SEQ ID NO: 104487 - protein, 23 aa, Mycobacterium avium
SILADRALRVAVSKGIDRQTIAK

SEQ ID NO: 104488 - protein, 20 aa, Mycobacterium avium
SILIRGLMNYTFWVPNGSPE

SEQ ID NO: 104489 - protein, 23 aa, Mycobacterium avium
SILRRAGLVTARREGLSVRYALT

SEQ ID NO: 104490 - protein, 17 aa, Mycobacterium avium
SIRDARVVKIEAIADPA

SEQ ID NO: 104491 - protein, 18 aa, Mycobacterium avium
SIRHSVGVWPLVIDDATV

SEQ ID NO: 104492 - protein, 18 aa, Mycobacterium avium
SIRHSVGVWPLVINDATV

SEQ ID NO: 104493 - protein, 18 aa, Mycobacterium avium
SISLLSWILNPERGLAAS

SEQ ID NO: 104494 - protein, 32 aa, Mycobacterium avium
SITASGMLHWPDSGNGLAQFHCEIAVDGQVVV

SEQ ID NO: 104495 - protein, 20 aa, Mycobacterium avium
SITWKGAGGDGLRQRTGADL

SEQ ID NO: 104496 - protein, 23 aa, Mycobacterium avium
SIVLGALPFDVRRPAALLTPDTV

SEQ ID NO: 104497 - protein, 24 aa, Mycobacterium avium
SIVLGALPFDVRRPAALLTPDTVS

SEQ ID NO: 104498 - protein, 21 aa, Mycobacterium avium
SKERAIAVGRRIRTGSVCVNS

SEQ ID NO: 104499 - protein, 17 aa, Mycobacterium avium
SKFSAELASQWISAGAR

SEQ ID NO: 104500 - protein, 30 aa, Mycobacterium avium
SKGRYGGRHFLWSVPAEWAVPGMELTSPRA

SEQ ID NO: 104501 - protein, 17 aa, Mycobacterium avium
SKHEKWRGDGIDLRLAC

SEQ ID NO: 104502 - protein, 22 aa, Mycobacterium avium
SKIMPVAPFPRWSGNARGPAPG

SEQ ID NO: 104503 - protein, 19 aa, Mycobacterium avium
SKLANLLFVRELVARGKTA

SEQ ID NO: 104504 - protein, 19 aa, Mycobacterium avium
SKLANMLFVQELTRRGRTA

SEQ ID NO: 104505 - protein, 19 aa, Mycobacterium avium
SKLNVAVGLSKVSLQDFAG

SEQ ID NO: 104506 - protein, 23 aa, Mycobacterium avium
SKLPKVFFVNWFRRGDDGGFLWP

SEQ ID NO: 104507 - protein, 28 aa, Mycobacterium avium
SKQAEWTCYAGSQWNASGDFEFETFAPL

SEQ ID NO: 104508 - protein, 26 aa, Mycobacterium avium
SKRCLIPMDGYYEWRINSDAAAGKKP

SEQ ID NO: 104509 - protein, 26 aa, Mycobacterium avium
SKRCLIPMDGYYEWRVNSDPAAGKKP

SEQ ID NO: 104510 - protein, 21 aa, Mycobacterium avium
SKRGLVGLMQVWANELAQHSI

SEQ ID NO: 104511 - protein, 19 aa, Mycobacterium avium
SKRPPRWVVVAELIETTRL

SEQ ID NO: 104512 - protein, 19 aa, Mycobacterium avium
SKRPPRWVVVAELVETTRL

SEQ ID NO: 104513 - protein, 17 aa, Mycobacterium avium
SKSPRPDPRLVYPPYSQ

SEQ ID NO: 104514 - protein, 24 aa, Mycobacterium avium
SKTLPAMLAGVVPLVLSTAPESTV

SEQ ID NO: 104515 - protein, 25 aa, Mycobacterium avium
SKTLPAMLAGVVPLVLSTAPESTVA

SEQ ID NO: 104516 - protein, 22 aa, Mycobacterium avium
SKTYRWTFAQVQGAPPKITLMH

SEQ ID NO: 104517 - protein, 19 aa, Mycobacterium avium
SKVFTRGIITWGIRDARRI

SEQ ID NO: 104518 - protein, 17 aa, Mycobacterium avium
SLAEANCLGQLSPAVAD

SEQ ID NO: 104519 - protein, 23 aa, Mycobacterium avium
SLALPGHAFTVVALDGNPVPNRA

SEQ ID NO: 104520 - protein, 26 aa, Mycobacterium avium
SLALSLRLAAFELLRADESDPVLLLD

SEQ ID NO: 104521 - protein, 26 aa, Mycobacterium avium
SLAMASAFAPYMAWMAGAAGRAAETA

SEQ ID NO: 104522 - protein, 25 aa, Mycobacterium avium
SLARARAVIEWGMRCTCPSIDACTC

SEQ ID NO: 104523 - protein, 17 aa, Mycobacterium avium
SLASALRHNDRPEVRTK

SEQ ID NO: 104524 - protein, 24 aa, Mycobacterium avium
SLCCTRVARWCWIASHADGQLRHQ

SEQ ID NO: 104525 - protein, 18 aa, Mycobacterium avium
SLCFPTITRFCGQLFMEA

SEQ ID NO: 104526 - protein, 35 aa, Mycobacterium avium
SLCSGSGSGLRELKCGYHGWTWDLAGALKRVPDRK

SEQ ID NO: 104527 - protein, 28 aa, Mycobacterium avium
SLCSGSGSGLRELKCRYHGWTWDLAGAL

SEQ ID NO: 104528 - protein, 21 aa, Mycobacterium avium
SLDPRLPVFELLAEPLRANGF

SEQ ID NO: 104529 - protein, 20 aa, Mycobacterium avium
SLEAWFMHIPGLKVIVPATP

SEQ ID NO: 104530 - protein, 20 aa, Mycobacterium avium
SLEGAILLARAHRSTRPLRD

SEQ ID NO: 104531 - protein, 28 aa, Mycobacterium avium
SLEQTFMFYLPRICEHCLNPSCVASCPS

SEQ ID NO: 104532 - protein, 25 aa, Mycobacterium avium
SLFDALVEWMSQPLYYGRYGGKAPP

SEQ ID NO: 104533 - protein, 20 aa, Mycobacterium avium
SLFSSMGLAGMLGSAVGSGG

SEQ ID NO: 104534 - protein, 17 aa, Mycobacterium avium
SLGGWVAFELERRGRAP

SEQ ID NO: 104535 - protein, 26 aa, Mycobacterium avium
SLGKLWASPELRANLDAWLARFAAPG

SEQ ID NO: 104536 - protein, 25 aa, Mycobacterium avium
SLGRARAVIEWGMRCTCPSIDACTC

SEQ ID NO: 104537 - protein, 18 aa, Mycobacterium avium
SLHVRDAQRILALADLIS

SEQ ID NO: 104538 - protein, 22 aa, Mycobacterium avium
SLIRAAAAWDGLARQLRAAATS

SEQ ID NO: 104539 - protein, 20 aa, Mycobacterium avium
SLLAMPRWLAESVRVPRGSV

SEQ ID NO: 104540 - protein, 25 aa, Mycobacterium avium
SLLAMPRWLAESVWVPRGSVAVLSG

SEQ ID NO: 104541 - protein, 18 aa, Mycobacterium avium
SLLDRAYAKKFRFPTFLG

SEQ ID NO: 104542 - protein, 23 aa, Mycobacterium avium
SLLEFGCVAAPIGGPGEAAAAVS

SEQ ID NO: 104543 - protein, 19 aa, Mycobacterium avium
SLLPIVPMFHANAWGLPYA

SEQ ID NO: 104544 - protein, 17 aa, Mycobacterium avium
SLLQDWTQFAAPAVFGI

SEQ ID NO: 104545 - protein, 18 aa, Mycobacterium avium
SLLTLGWAAEFASIPVAV

SEQ ID NO: 104546 - protein, 30 aa, Mycobacterium avium
SLLVEIPGLLAWRIELRATVATRLMSALGA

SEQ ID NO: 104547 - protein, 24 aa, Mycobacterium avium
SLMRLGIEPAEFALSVLGDDRAEQ

SEQ ID NO: 104548 - protein, 23 aa, Mycobacterium avium
SLNDIRWLYELMHRVGSLNHARD

SEQ ID NO: 104549 - protein, 25 aa, Mycobacterium avium
SLNLVGGLRRSMAKAGYCDLKEFQK

SEQ ID NO: 104550 - protein, 18 aa, Mycobacterium avium
SLNYRLGAFGFLAHPQAG

SEQ ID NO: 104551 - protein, 29 aa, Mycobacterium avium
SLPADTVGEVWLRGATVVRGYLGDPAITA

SEQ ID NO: 104552 - protein, 35 aa, Mycobacterium avium
SLPITELAAGVSRPENFVGIHFFSPVEKMDPIEII

SEQ ID NO: 104553 - protein, 24 aa, Mycobacterium avium
SLPPEFRAAVVLCDIEGLSYEEIG

SEQ ID NO: 104554 - protein, 17 aa, Mycobacterium avium
SLPRRVGIARARQMLLL

SEQ ID NO: 104555 - protein, 35 aa, Mycobacterium avium
SLPTLRSVFLSGDWIPLDLPRRLRRAAPGVRLVAM

SEQ ID NO: 104556 - protein, 24 aa, Mycobacterium avium
SLPVHVADPLEWVRLARIGATIGK

SEQ ID NO: 104557 - protein, 23 aa, Mycobacterium avium
SLQPETRLAAPLLAKGLPACPGV

SEQ ID NO: 104558 - protein, 24 aa, Mycobacterium avium
SLQPRAAAVLSMYRYHADAHHVDT

SEQ ID NO: 104559 - protein, 26 aa, Mycobacterium avium
SLRDPEFAAGFARLYNRWVADYCAQS

SEQ ID NO: 104560 - protein, 19 aa, Mycobacterium avium
SLRNVMLSGDWIPVSQPPE

SEQ ID NO: 104561 - protein, 19 aa, Mycobacterium avium
SLRRFLLEETYELLDAVAG

SEQ ID NO: 104562 - protein, 19 aa, Mycobacterium avium
SLRSGECDLALAGGVTVMA

SEQ ID NO: 104563 - protein, 19 aa, Mycobacterium avium
SLRSGECDLALAGGVTVNA

SEQ ID NO: 104564 - protein, 17 aa, Mycobacterium avium
SLSHPYLDTVLFLLGVT

SEQ ID NO: 104565 - protein, 18 aa, Mycobacterium avium
SLSHPYLDTVLFLLGVTR

SEQ ID NO: 104566 - protein, 17 aa, Mycobacterium avium
SLTAVELRNRLKIATGL

SEQ ID NO: 104567 - protein, 19 aa, Mycobacterium avium
SLTGGWDVTHDAVARAGAH

SEQ ID NO: 104568 - protein, 17 aa, Mycobacterium avium
SLTHWGTAGLQFINADY

SEQ ID NO: 104569 - protein, 18 aa, Mycobacterium avium
SLTKTNCAYAMPHTYRLI

SEQ ID NO: 104570 - protein, 22 aa, Mycobacterium avium
SLTSPRGKRQFRRAVLDDDAGT

SEQ ID NO: 104571 - protein, 18 aa, Mycobacterium avium
SLVDKGYFAPAWPVEFGG

SEQ ID NO: 104572 - protein, 20 aa, Mycobacterium avium
SLVELHGWTDEVARIRSAFR

SEQ ID NO: 104573 - protein, 18 aa, Mycobacterium avium
SLVPMCYPPAADRETVEL

SEQ ID NO: 104574 - protein, 27 aa, Mycobacterium avium
SLVTPGGFLALWAPNVVEWPIIQYGAA

SEQ ID NO: 104575 - protein, 25 aa, Mycobacterium avium
SLVTQLLVLRRARVLGIAGPGNADW

SEQ ID NO: 104576 - protein, 23 aa, Mycobacterium avium
SLWPAFADIPAGWQMVYGEADRA

SEQ ID NO: 104577 - protein, 23 aa, Mycobacterium avium
SMADEITELFGPGLAQITVIRNG

SEQ ID NO: 104578 - protein, 27 aa, Mycobacterium avium
SMLHELERTGGRFGLQTMCEGGGQANV

SEQ ID NO: 104579 - protein, 22 aa, Mycobacterium avium
SMLRAGAPWDSDWILELGNADP

SEQ ID NO: 104580 - protein, 24 aa, Mycobacterium avium
SMLSELLRGGWLLRDPVRKTYHLG

SEQ ID NO: 104581 - protein, 22 aa, Mycobacterium avium
SMPEEPVMLAAVMIGDGRSRIA

SEQ ID NO: 104582 - protein, 18 aa, Mycobacterium avium
SMRAHFFALASFTRAASM

SEQ ID NO: 104583 - protein, 23 aa, Mycobacterium avium
SMVEAAICDGDWVVVRQQHVADN

SEQ ID NO: 104584 - protein, 23 aa, Mycobacterium avium
SNDLQSWATLTAHEKQMTIRVFT

SEQ ID NO: 104585 - protein, 23 aa, Mycobacterium avium
SNDLQSWATLTAHEKQMTMRVFT

SEQ ID NO: 104586 - protein, 24 aa, Mycobacterium avium
SNGLAVSYCGKMFADAGADVVKVE

SEQ ID NO: 104587 - protein, 24 aa, Mycobacterium avium
SNGMGSDAFAIVWDGEKVHGLNAS

SEQ ID NO: 104588 - protein, 24 aa, Mycobacterium avium
SNHIPAGLHFDRIGPNGGGFLSPE

SEQ ID NO: 104589 - protein, 17 aa, Mycobacterium avium
SNIDAFHRALATAAAEV

SEQ ID NO: 104590 - protein, 26 aa, Mycobacterium avium
SNIDPKWREAGIFPILSEGALRATLG

SEQ ID NO: 104591 - protein, 26 aa, Mycobacterium avium
SNLAFRCERPFTKWRITFDGFCVKSS

SEQ ID NO: 104592 - protein, 35 aa, Mycobacterium avium
SNLKCLCRGHHLLKTFWGWRDRQLPDGTVIWTLPD

SEQ ID NO: 104593 - protein, 18 aa, Mycobacterium avium
SNPFFDWGSDRAPLTPYH

SEQ ID NO: 104594 - protein, 19 aa, Mycobacterium avium
SNQDGWRMLHAEGMAPRKL

SEQ ID NO: 104595 - protein, 25 aa, Mycobacterium avium
SNSCNGTAHRCCGTSRLRCTCSPST

SEQ ID NO: 104596 - protein, 18 aa, Mycobacterium avium
SNTLWPRTLVATAAVQNL

SEQ ID NO: 104597 - protein, 37 aa, Mycobacterium avium
SNYQGSKELFLWPTLRYWEFPKPMIAQVHGYAIGGGT

SEQ ID NO: 104598 - protein, 18 aa, Mycobacterium avium
SPAARVVSTTGIPTRAIT

SEQ ID NO: 104599 - protein, 17 aa, Mycobacterium avium
SPAQRIRHSLSRGAMRI

SEQ ID NO: 104600 - protein, 24 aa, Mycobacterium avium
SPARKCGVCGEIAQIQARATDTHP

SEQ ID NO: 104601 - protein, 28 aa, Mycobacterium avium
SPDEGRALARICALNALAAVDALVGIDA

SEQ ID NO: 104602 - protein, 24 aa, Mycobacterium avium
SPDFIRLGLMLALERRPVEPRARA

SEQ ID NO: 104603 - protein, 23 aa, Mycobacterium avium
SPDGLRWSTTEQLGYNRRYTLTA

SEQ ID NO: 104604 - protein, 27 aa, Mycobacterium avium
SPDLDWQSVWDRGWTLAAAAEDKPVES

SEQ ID NO: 104605 - protein, 19 aa, Mycobacterium avium
SPDMKRIGAGGPLPISHNN

SEQ ID NO: 104606 - protein, 17 aa, Mycobacterium avium
SPDTSWQSINRLIPALV

SEQ ID NO: 104607 - protein, 17 aa, Mycobacterium avium
SPEEWRAAQTRLGELVY

SEQ ID NO: 104608 - protein, 18 aa, Mycobacterium avium
SPELAAWVDEHVCFPSSM

SEQ ID NO: 104609 - protein, 17 aa, Mycobacterium avium
SPERLWEALLRGDDFVT

SEQ ID NO: 104610 - protein, 25 aa, Mycobacterium avium
SPEVTDQFGTPAWIISQGPQVLLDA

SEQ ID NO: 104611 - protein, 24 aa, Mycobacterium avium
SPGDALMRGCPFHNAAVEAGQTMP

SEQ ID NO: 104612 - protein, 24 aa, Mycobacterium avium
SPGDVDAFLTALAGRHIDLLIYNT

SEQ ID NO: 104613 - protein, 19 aa, Mycobacterium avium
SPGGGDLLELLAGGQPEAH

SEQ ID NO: 104614 - protein, 25 aa, Mycobacterium avium
SPGLIREMMDWAACEHVPDDYLPLI

SEQ ID NO: 104615 - protein, 19 aa, Mycobacterium avium
SPGLRRLEAALGLVDPGAQ

SEQ ID NO: 104616 - protein, 18 aa, Mycobacterium avium
SPGPEWASAVIAAALRHC

SEQ ID NO: 104617 - protein, 26 aa, Mycobacterium avium
SPGPPAWTCGCAPRSSCRGIRADAPR

SEQ ID NO: 104618 - protein, 18 aa, Mycobacterium avium
SPGTSVLIAPNFAIGAVL

SEQ ID NO: 104619 - protein, 18 aa, Mycobacterium avium
SPGTSVLVAPNFAIGAVL

SEQ ID NO: 104620 - protein, 18 aa, Mycobacterium avium
SPGVRLRGTVSFAPTAAG

SEQ ID NO: 104621 - protein, 25 aa, Mycobacterium avium
SPHEPRLPYASLKAAVATFTRGIAR

SEQ ID NO: 104622 - protein, 20 aa, Mycobacterium avium
SPHMLRHSFATHLLEGGADV

SEQ ID NO: 104623 - protein, 18 aa, Mycobacterium avium
SPHTSWLDVFAIGAVLPG

SEQ ID NO: 104624 - protein, 20 aa, Mycobacterium avium
SPITDGWMLPVFRAAASPNA

SEQ ID NO: 104625 - protein, 28 aa, Mycobacterium avium
SPKARFLPTRLAAIPALLADVLRPDVLL

SEQ ID NO: 104626 - protein, 24 aa, Mycobacterium avium
SPKLSGRDAVMEWLSEHRKQSPYP

SEQ ID NO: 104627 - protein, 20 aa, Mycobacterium avium
SPKTWSGYTQHWELRIKPRF

SEQ ID NO: 104628 - protein, 17 aa, Mycobacterium avium
SPLAVEWTRGAVKTVPP

SEQ ID NO: 104629 - protein, 17 aa, Mycobacterium avium
SPLEVFVLRPCIVAGPG

SEQ ID NO: 104630 - protein, 18 aa, Mycobacterium avium
SPLISVTDLLEWYRVARR

SEQ ID NO: 104631 - protein, 25 aa, Mycobacterium avium
SPLRGAAFFVLDGWLCPVPVGVVGE

SEQ ID NO: 104632 - protein, 18 aa, Mycobacterium avium
SPLSRLAVSAFWCGYWCV

SEQ ID NO: 104633 - protein, 17 aa, Mycobacterium avium
SPLTPISSLIFGAAADA

SEQ ID NO: 104634 - protein, 39 aa, Mycobacterium avium
SPMARSTKRVCRDCGFFLPLSGSLGRMFGVCGNELSADG

SEQ ID NO: 104635 - protein, 18 aa, Mycobacterium avium
SPNFDIWPYNTFTSRVTP

SEQ ID NO: 104636 - protein, 18 aa, Mycobacterium avium
SPNRMLLDPVGYGKTMAG

SEQ ID NO: 104637 - protein, 29 aa, Mycobacterium avium
SPPPLPVQFWPDWVRPEGTPDPPAELAAL

SEQ ID NO: 104638 - protein, 26 aa, Mycobacterium avium
SPPPPWPSPKVCWARTPRRPTTPWCW

SEQ ID NO: 104639 - protein, 19 aa, Mycobacterium avium
SPPVYFGFGSLPVKSPADT

SEQ ID NO: 104640 - protein, 21 aa, Mycobacterium avium
SPQAALRCAVQLQREGVISTK

SEQ ID NO: 104641 - protein, 18 aa, Mycobacterium avium
SPQRAYPSIHVAGTNGKT

SEQ ID NO: 104642 - protein, 17 aa, Mycobacterium avium
SPQRLWEALLRGDDLVG

SEQ ID NO: 104643 - protein, 23 aa, Mycobacterium avium
SPRAPFRRIAEVVGAGEQTVARR

SEQ ID NO: 104644 - protein, 20 aa, Mycobacterium avium
SPRRLAAGAVVRSRNVTTEV

SEQ ID NO: 104645 - protein, 19 aa, Mycobacterium avium
SPSGWVYIVADSFTRRDPV

SEQ ID NO: 104646 - protein, 26 aa, Mycobacterium avium
SPSNARWAAIWPAAPPRRAHAPWASR

SEQ ID NO: 104647 - protein, 21 aa, Mycobacterium avium
SPSPFHVCATVAARLIAAGYT

SEQ ID NO: 104648 - protein, 28 aa, Mycobacterium avium
SPTSSGWSAAECRSRRSSSASPAGSRWA

SEQ ID NO: 104649 - protein, 20 aa, Mycobacterium avium
SPVADFPRLGGPAGGTLFYP

SEQ ID NO: 104650 - protein, 19 aa, Mycobacterium avium
SPVGLEIIDMLPAGAPTRC

SEQ ID NO: 104651 - protein, 25 aa, Mycobacterium avium
SPVGRGRFAGRHTIDLLASAVAMGW

SEQ ID NO: 104652 - protein, 25 aa, Mycobacterium avium
SPVRTAGMAPYMVRVLGTTAPTQQV

SEQ ID NO: 104653 - protein, 21 aa, Mycobacterium avium
SPVRYGGRVVAVLTRHQTAVA

SEQ ID NO: 104654 - protein, 25 aa, Mycobacterium avium
SQAAEDWLCLLEAFDQPHRPGVVRA

SEQ ID NO: 104655 - protein, 20 aa, Mycobacterium avium
SQCHSLAFDFSVWEIFGALL

SEQ ID NO: 104656 - protein, 17 aa, Mycobacterium avium
SQEAGFAGTQWQLGLLV

SEQ ID NO: 104657 - protein, 19 aa, Mycobacterium avium
SQEGMPLAGLVLNRTHPPL

SEQ ID NO: 104658 - protein, 24 aa, Mycobacterium avium
SQGFPLPWQLVVGALQAQAEGARG

SEQ ID NO: 104659 - protein, 24 aa, Mycobacterium avium
SQGGFDLAAYWARGGIGDAYSAGD

SEQ ID NO: 104660 - protein, 24 aa, Mycobacterium avium
SQGGFDLAAYWARGGIGEGYAAGD

SEQ ID NO: 104661 - protein, 20 aa, Mycobacterium avium
SQIRALEHAAAWPAAEQTWL

SEQ ID NO: 104662 - protein, 24 aa, Mycobacterium avium
SQKPRAVYRYEFPTIIECLAESDS

SEQ ID NO: 104663 - protein, 19 aa, Mycobacterium avium
SQLHAPFWGSRRLANGGDL

SEQ ID NO: 104664 - protein, 18 aa, Mycobacterium avium
SQLMAIVAEGNRTRIYLE

SEQ ID NO: 104665 - protein, 18 aa, Mycobacterium avium
SQLRCYRVVLADRARRDA

SEQ ID NO: 104666 - protein, 24 aa, Mycobacterium avium
SQPTWRFGPISGMIETAENLAADY

SEQ ID NO: 104667 - protein, 21 aa, Mycobacterium avium
SQRRYAYADGKRAVRPPDPAD

SEQ ID NO: 104668 - protein, 26 aa, Mycobacterium avium
SQSARKRGPWPWLQPNRNDAPPVAGL

SEQ ID NO: 104669 - protein, 21 aa, Mycobacterium avium
SQTEWGCIGNERIMQIDGAGF

SEQ ID NO: 104670 - protein, 24 aa, Mycobacterium avium
SQTEWGCIGNERIMQIDGAGFMSM

SEQ ID NO: 104671 - protein, 21 aa, Mycobacterium avium
SQTLRTQWTLFAAHNQGHTAD

SEQ ID NO: 104672 - protein, 25 aa, Mycobacterium avium
SQTPCAVVAFASWPQETVLRGTLDD

SEQ ID NO: 104673 - protein, 25 aa, Mycobacterium avium
SQTPCAVVAFASWPQQTVLRGTLDD

SEQ ID NO: 104674 - protein, 23 aa, Mycobacterium avium
SQTTERLWAAFLRACDLDPTDPE

SEQ ID NO: 104675 - protein, 26 aa, Mycobacterium avium
SRAACANLRFFLCRACLLCPVIPMLR

SEQ ID NO: 104676 - protein, 18 aa, Mycobacterium avium
SRAEALTALLGDVPKADD

SEQ ID NO: 104677 - protein, 17 aa, Mycobacterium avium
SRAKLVRLFPTVMTGTH

SEQ ID NO: 104678 - protein, 22 aa, Mycobacterium avium
SRAMALMLQDWLPAFDGAPSNV

SEQ ID NO: 104679 - protein, 22 aa, Mycobacterium avium
SRAMALMLQDWLPAFDGGPSGA

SEQ ID NO: 104680 - protein, 25 aa, Mycobacterium avium
SRAPPRPNYGAGMRVAMMTREYPPE

SEQ ID NO: 104681 - protein, 21 aa, Mycobacterium avium
SRAPTIMPAVVKLHRALSIET

SEQ ID NO: 104682 - protein, 23 aa, Mycobacterium avium
SRARARLASFAPAGPPRRDGHRI

SEQ ID NO: 104683 - protein, 23 aa, Mycobacterium avium
SRCDSCAATTFPVQQWCPRCSSG

SEQ ID NO: 104684 - protein, 25 aa, Mycobacterium avium
SRCTRCGRIYWPGSHHAKLLALVER

SEQ ID NO: 104685 - protein, 24 aa, Mycobacterium avium
SRDECRALIAAGVDDWGGVSPLTP

SEQ ID NO: 104686 - protein, 25 aa, Mycobacterium avium
SRDPKIFRPYIVGFIELAEGVLVES

SEQ ID NO: 104687 - protein, 18 aa, Mycobacterium avium
SREADWDAVIAVHLKGTF

SEQ ID NO: 104688 - protein, 19 aa, Mycobacterium avium
SREDALLCGDFYDVVQTPD

SEQ ID NO: 104689 - protein, 21 aa, Mycobacterium avium
SREQLLRFIGELDRPGRLTLV

SEQ ID NO: 104690 - protein, 19 aa, Mycobacterium avium
SRESLFWVSDYGVRFGIAN

SEQ ID NO: 104691 - protein, 17 aa, Mycobacterium avium
SRFALELVESVVGEDQV

SEQ ID NO: 104692 - protein, 21 aa, Mycobacterium avium
SRFVACPFASMSGQRMYRTGD

SEQ ID NO: 104693 - protein, 27 aa, Mycobacterium avium
SRFVACPFGAPGARMYRTGDLVRWRGD

SEQ ID NO: 104694 - protein, 25 aa, Mycobacterium avium
SRFVACPFGGVGVRMYRTGDLVRWG

SEQ ID NO: 104695 - protein, 25 aa, Mycobacterium avium
SRGDQRLWAVTGFEGRGENRSAKLV

SEQ ID NO: 104696 - protein, 23 aa, Mycobacterium avium
SRGKWDTLRAMGFDDAHIADSRT

SEQ ID NO: 104697 - protein, 21 aa, Mycobacterium avium
SRGVPPTRLRLIYLADGQVLD

SEQ ID NO: 104698 - protein, 17 aa, Mycobacterium avium
SRIAIGALGSRLDHDQL

SEQ ID NO: 104699 - protein, 17 aa, Mycobacterium avium
SRIAYEIVRRDERRATA

SEQ ID NO: 104700 - protein, 25 aa, Mycobacterium avium
SRIEGAELRKAFGAIGIQYGPAFSG

SEQ ID NO: 104701 - protein, 19 aa, Mycobacterium avium
SRKAPQFHFDRHAPEYRER

SEQ ID NO: 104702 - protein, 18 aa, Mycobacterium avium
SRKRPYLGMSREPADIAA

SEQ ID NO: 104703 - protein, 21 aa, Mycobacterium avium
SRLAGAPAMSGFRAAADKVAP

SEQ ID NO: 104704 - protein, 18 aa, Mycobacterium avium
SRLARRATAIGGVDIPAG

SEQ ID NO: 104705 - protein, 21 aa, Mycobacterium avium
SRLAVSAFWCGYWCVTNKAEE

SEQ ID NO: 104706 - protein, 18 aa, Mycobacterium avium
SRLDLPSIHSGYWDPFFA

SEQ ID NO: 104707 - protein, 19 aa, Mycobacterium avium
SRLGLAQFAAPRPGRRIGL

SEQ ID NO: 104708 - protein, 24 aa, Mycobacterium avium
SRLGYEACRGELIEVVRQLEQGGL

SEQ ID NO: 104709 - protein, 25 aa, Mycobacterium avium
SRLIERFLAHFAIRDWDAMAELLAD

SEQ ID NO: 104710 - protein, 17 aa, Mycobacterium avium
SRLLVDVMHGTGLIPGR

SEQ ID NO: 104711 - protein, 17 aa, Mycobacterium avium
SRLPAPLRRGQVRPLGL

SEQ ID NO: 104712 - protein, 20 aa, Mycobacterium avium
SRLPEGVYIGLASVTHYSHA

SEQ ID NO: 104713 - protein, 18 aa, Mycobacterium avium
SRLPERYRDIGPRIVRTR

SEQ ID NO: 104714 - protein, 22 aa, Mycobacterium avium
SRLRRHARLRKKIAGTPERPRL

SEQ ID NO: 104715 - protein, 17 aa, Mycobacterium avium
SRLTLPGGALVGHAAVT

SEQ ID NO: 104716 - protein, 19 aa, Mycobacterium avium
SRLWFDALAGICAHVRAGG

SEQ ID NO: 104717 - protein, 17 aa, Mycobacterium avium
SRLWFLDQLQGPSPMYN

SEQ ID NO: 104718 - protein, 24 aa, Mycobacterium avium
SRLYPETLHIMGWNIGSAGMQLVM

SEQ ID NO: 104719 - protein, 17 aa, Mycobacterium avium
SRMARWWVIWPSVMVKM

SEQ ID NO: 104720 - protein, 19 aa, Mycobacterium avium
SRMIIGWRVASHMRTTVVL

SEQ ID NO: 104721 - protein, 17 aa, Mycobacterium avium
SRMVICGDTGVAHLAAA

SEQ ID NO: 104722 - protein, 24 aa, Mycobacterium avium
SRNPKWWGTRPRLDSITYLVLDDA

SEQ ID NO: 104723 - protein, 19 aa, Mycobacterium avium
SRNSIEFGELNAAAQLGGI

SEQ ID NO: 104724 - protein, 20 aa, Mycobacterium avium
SRNSVEFGEVMAATHLSGVI

SEQ ID NO: 104725 - protein, 22 aa, Mycobacterium avium
SRPDLAFDMVRPGIAVYGLSPV

SEQ ID NO: 104726 - protein, 23 aa, Mycobacterium avium
SRPDLAFDMVRPGIAVYGLSPVP

SEQ ID NO: 104727 - protein, 17 aa, Mycobacterium avium
SRPGRRVGRLAGGAGQH

SEQ ID NO: 104728 - protein, 21 aa, Mycobacterium avium
SRPLLELPWDIEESPSGMAVA

SEQ ID NO: 104729 - protein, 19 aa, Mycobacterium avium
SRPRMKIVGLDALLTTARL

SEQ ID NO: 104730 - protein, 25 aa, Mycobacterium avium
SRPRPCQPSACARRQPRRQAAGAPQ

SEQ ID NO: 104731 - protein, 20 aa, Mycobacterium avium
SRPTPCAQFDVTRLTDHLLK

SEQ ID NO: 104732 - protein, 24 aa, Mycobacterium avium
SRQDPRPAIEVIRAAVAQRHELAV

SEQ ID NO: 104733 - protein, 17 aa, Mycobacterium avium
SRQLKLLAKELEVPVVA

SEQ ID NO: 104734 - protein, 21 aa, Mycobacterium avium
SRQYPEWELGVQLVAEDDEFS

SEQ ID NO: 104735 - protein, 23 aa, Mycobacterium avium
SRRAKHFRTAHVVANSGHSVQSD

SEQ ID NO: 104736 - protein, 19 aa, Mycobacterium avium
SRRCAKWLASEDFSETIGH

SEQ ID NO: 104737 - protein, 21 aa, Mycobacterium avium
SRRLMRAPIWIYRARGGAVFG

SEQ ID NO: 104738 - protein, 17 aa, Mycobacterium avium
SRRPMWRRGRRAEKATA

SEQ ID NO: 104739 - protein, 26 aa, Mycobacterium avium
SRRRARLLALRLRRLHYRHRRPAAGS

SEQ ID NO: 104740 - protein, 26 aa, Mycobacterium avium
SRRRARLLALRLRRLHYRRRRPAAGP

SEQ ID NO: 104741 - protein, 26 aa, Mycobacterium avium
SRRRARLLALRLRRLYYRHRRPAAGS

SEQ ID NO: 104742 - protein, 18 aa, Mycobacterium avium
SRRRASGQTRHHLTADQP

SEQ ID NO: 104743 - protein, 21 aa, Mycobacterium avium
SRRRLAMAMGAIRARESLDSA

SEQ ID NO: 104744 - protein, 29 aa, Mycobacterium avium
SRRRPRSVIDPGYRYEFIESDDEPVAVTP

SEQ ID NO: 104745 - protein, 27 aa, Mycobacterium avium
SRRSGFKEIHDHGGFLCGATTFDPEFF

SEQ ID NO: 104746 - protein, 19 aa, Mycobacterium avium
SRSAAGISRTSTRAVITPR

SEQ ID NO: 104747 - protein, 27 aa, Mycobacterium avium
SRSNFPRSAPIWKNIAAALAEAQKAGT

SEQ ID NO: 104748 - protein, 18 aa, Mycobacterium avium
SRTARGGSIVIISSTSGI

SEQ ID NO: 104749 - protein, 23 aa, Mycobacterium avium
SRTIRLPVHLVEQVNKLARIKRE

SEQ ID NO: 104750 - protein, 20 aa, Mycobacterium avium
SRTLLEFLDTVPLSEGADGE

SEQ ID NO: 104751 - protein, 21 aa, Mycobacterium avium
SRTQLPISAWQQHFADATTSI

SEQ ID NO: 104752 - protein, 23 aa, Mycobacterium avium
SRTRLATWVAVPGHTASPAGSIS

SEQ ID NO: 104753 - protein, 17 aa, Mycobacterium avium
SRTSLPLMAKGICHPDD

SEQ ID NO: 104754 - protein, 18 aa, Mycobacterium avium
SRVSLSFYGKRPGPGMKL

SEQ ID NO: 104755 - protein, 23 aa, Mycobacterium avium
SRVVRPFAEWRVIRDARKRAARR

SEQ ID NO: 104756 - protein, 17 aa, Mycobacterium avium
SRWDYDYTGGDSGGNLH

SEQ ID NO: 104757 - protein, 25 aa, Mycobacterium avium
SRYPPNEGPIHWYIHLMEQSRTPGA

SEQ ID NO: 104758 - protein, 27 aa, Mycobacterium avium
SSAQRLRIGEAWAKLPHDWIERYEANH

SEQ ID NO: 104759 - protein, 25 aa, Mycobacterium avium
SSDEERAAAVAARLQVGSVAVNSTA

SEQ ID NO: 104760 - protein, 28 aa, Mycobacterium avium
SSEAVMLGGLAMKWRWRAKTKDWKKRTP

SEQ ID NO: 104761 - protein, 24 aa, Mycobacterium avium
SSEFAGRAIHEWSAQVFRDDEGTI

SEQ ID NO: 104762 - protein, 24 aa, Mycobacterium avium
SSELRAVWSGFMQKWIDQTAAMIT

SEQ ID NO: 104763 - protein, 27 aa, Mycobacterium avium
SSEQRLRIGEAWGKLPHEWIEQYEANH

SEQ ID NO: 104764 - protein, 27 aa, Mycobacterium avium
SSGAFKALRPDFLFFSRRADGTIAANI

SEQ ID NO: 104765 - protein, 26 aa, Mycobacterium avium
SSGAKGSDLLLVFGVIPEGFPQQGAI

SEQ ID NO: 104766 - protein, 23 aa, Mycobacterium avium
SSGEYEDRCGPIITEWLAQQGFS

SEQ ID NO: 104767 - protein, 26 aa, Mycobacterium avium
SSGNVDALFTWLPWAAELEDLSGARV

SEQ ID NO: 104768 - protein, 22 aa, Mycobacterium avium
SSGPQGAFGFRHNPIHVMTVDG

SEQ ID NO: 104769 - protein, 17 aa, Mycobacterium avium
SSGRDGDKLASLRTKTG

SEQ ID NO: 104770 - protein, 17 aa, Mycobacterium avium
SSIQLLGKEGSYASLRM

SEQ ID NO: 104771 - protein, 31 aa, Mycobacterium avium
SSKVGIIAGCMITSGVVRRNAKARLLRDNVV

SEQ ID NO: 104772 - protein, 23 aa, Mycobacterium avium
SSLAGRAVAAAATRPVGGAAAAA

SEQ ID NO: 104773 - protein, 29 aa, Mycobacterium avium
SSLDQGGPCARTVLDTALLHQVIAGHDIR

SEQ ID NO: 104774 - protein, 30 aa, Mycobacterium avium
SSLDQGGPCARTVLDTALLHQVIAGHDIRD

SEQ ID NO: 104775 - protein, 17 aa, Mycobacterium avium
SSLGRALGRRWHQETVY

SEQ ID NO: 104776 - protein, 25 aa, Mycobacterium avium
SSLKRPDRRLAVVFGAGGERDPGKR

SEQ ID NO: 104777 - protein, 17 aa, Mycobacterium avium
SSLLDRHRPLWETHIVE

SEQ ID NO: 104778 - protein, 19 aa, Mycobacterium avium
SSLQTSRMAFHAIKAGEGD

SEQ ID NO: 104779 - protein, 20 aa, Mycobacterium avium
SSLVRELRGLWGDAVTAHRY

SEQ ID NO: 104780 - protein, 20 aa, Mycobacterium avium
SSPDRWSWWWPPESTSARSR

SEQ ID NO: 104781 - protein, 23 aa, Mycobacterium avium
SSPTRACRAIWCPPVARCTCSPG

SEQ ID NO: 104782 - protein, 21 aa, Mycobacterium avium
SSSWPGCPSGWRCPPTDPIRR

SEQ ID NO: 104783 - protein, 20 aa, Mycobacterium avium
SSTAGFGWPHRLDAIRDLLA

SEQ ID NO: 104784 - protein, 25 aa, Mycobacterium avium
SSTAGRGPRTWPRRWPPPTPEVPAP

SEQ ID NO: 104785 - protein, 28 aa, Mycobacterium avium
SSTAHRLLAMLAYRGFVRQDPVSKAYLP

SEQ ID NO: 104786 - protein, 17 aa, Mycobacterium avium
SSTCALVLAELERRAWV

SEQ ID NO: 104787 - protein, 23 aa, Mycobacterium avium
SSTPWPEHWPKPSRVEQGGMVFR

SEQ ID NO: 104788 - protein, 26 aa, Mycobacterium avium
SSVVLFGMPNVRAMNFLGEPPVVIGP

SEQ ID NO: 104789 - protein, 22 aa, Mycobacterium avium
STAFLTPRVKPLIITNQPDNFG

SEQ ID NO: 104790 - protein, 23 aa, Mycobacterium avium
STAFLTPRVKPLIITNQPDNFGP

SEQ ID NO: 104791 - protein, 17 aa, Mycobacterium avium
STALAYLLSRLGTKRLI

SEQ ID NO: 104792 - protein, 20 aa, Mycobacterium avium
STALRLILRALQMQLGRGGT

SEQ ID NO: 104793 - protein, 33 aa, Mycobacterium avium
STANSPGAVCLRLPVRTPFGFQGVFGHLAASVV

SEQ ID NO: 104794 - protein, 17 aa, Mycobacterium avium
STAPGAWEAIAAARFRR

SEQ ID NO: 104795 - protein, 20 aa, Mycobacterium avium
STDASAWHRPLLPAQPPETT

SEQ ID NO: 104796 - protein, 26 aa, Mycobacterium avium
STDPLRAGMRLGLIPTVVPYVLPTVL

SEQ ID NO: 104797 - protein, 17 aa, Mycobacterium avium
STEEGWRQFVQTYLSGN

SEQ ID NO: 104798 - protein, 24 aa, Mycobacterium avium
STFDLYSCFPVPVFNFCDGTGLAT

SEQ ID NO: 104799 - protein, 25 aa, Mycobacterium avium
STFDLYSCFPVPVFNFCDGTGLATD

SEQ ID NO: 104800 - protein, 24 aa, Mycobacterium avium
STFDLYSCFPVPVFNFCDGTSLAT

SEQ ID NO: 104801 - protein, 18 aa, Mycobacterium avium
STFWAGAYLTCYLGAFGA

SEQ ID NO: 104802 - protein, 20 aa, Mycobacterium avium
STGGSWDAGAAWPPILAAAA

SEQ ID NO: 104803 - protein, 21 aa, Mycobacterium avium
STGRCRPRRPTPWPMPGRSAS

SEQ ID NO: 104804 - protein, 26 aa, Mycobacterium avium
STIFGSGVSPGFAELLAIVSAMVCNR

SEQ ID NO: 104805 - protein, 18 aa, Mycobacterium avium
STIGKSFGKAYLEAAKSP

SEQ ID NO: 104806 - protein, 18 aa, Mycobacterium avium
STLDELRIFVSQWDTRAR

SEQ ID NO: 104807 - protein, 30 aa, Mycobacterium avium
STLDLSRSWARVDLDATIADWTRLPAGTLA

SEQ ID NO: 104808 - protein, 20 aa, Mycobacterium avium
STLRHWLATYVEFYDRYSGC

SEQ ID NO: 104809 - protein, 17 aa, Mycobacterium avium
STLSFFRRALELRRRRV

SEQ ID NO: 104810 - protein, 20 aa, Mycobacterium avium
STLSVPPSWAATVSSVTPLQ

SEQ ID NO: 104811 - protein, 22 aa, Mycobacterium avium
STMAAIEWLFWRSTKKVDNAQR

SEQ ID NO: 104812 - protein, 26 aa, Mycobacterium avium
STPFAHAGYMFKLWDQLVWGSTLVVP

SEQ ID NO: 104813 - protein, 21 aa, Mycobacterium avium
STPIRPGEFGDRGGFQPVVEH

SEQ ID NO: 104814 - protein, 27 aa, Mycobacterium avium
STRAESRWFASAGFSLVNMTGYPEAVL

SEQ ID NO: 104815 - protein, 17 aa, Mycobacterium avium
STRCWPNSPPPACATHS

SEQ ID NO: 104816 - protein, 25 aa, Mycobacterium avium
STRDGRPIFWSGLGESRLFVGKKPD

SEQ ID NO: 104817 - protein, 17 aa, Mycobacterium avium
STTHILPAAAHDIGGVT

SEQ ID NO: 104818 - protein, 17 aa, Mycobacterium avium
STTRPLRVIQWTTGNIG

SEQ ID NO: 104819 - protein, 17 aa, Mycobacterium avium
STVCAYVPVGAEPGSVE

SEQ ID NO: 104820 - protein, 22 aa, Mycobacterium avium
STVHLAKLVLRNMTRRNTGKVL

SEQ ID NO: 104821 - protein, 20 aa, Mycobacterium avium
STVIAGRWAIAGVLTEEAAP

SEQ ID NO: 104822 - protein, 24 aa, Mycobacterium avium
STVRGARNYPCQEFPGKRAPTVQL

SEQ ID NO: 104823 - protein, 33 aa, Mycobacterium avium
STVYTLSMGLAFAEMGFRINAVLPGPVQTPILP

SEQ ID NO: 104824 - protein, 28 aa, Mycobacterium avium
STYQRWLGTRLPYYANWIRIKSYWGTAD

SEQ ID NO: 104825 - protein, 28 aa, Mycobacterium avium
SVAGDLTSRCSWAGAQAARLAAEARDVY

SEQ ID NO: 104826 - protein, 17 aa, Mycobacterium avium
SVAKPSPPYAAAVREWE

SEQ ID NO: 104827 - protein, 19 aa, Mycobacterium avium
SVAPCDPPPGFGYTREGTY

SEQ ID NO: 104828 - protein, 19 aa, Mycobacterium avium
SVATATFDFTGGYVTVTVK

SEQ ID NO: 104829 - protein, 23 aa, Mycobacterium avium
SVCYLPLTYDHRLIDGADAGRFL

SEQ ID NO: 104830 - protein, 17 aa, Mycobacterium avium
SVDICLSSNVAEHVPRP

SEQ ID NO: 104831 - protein, 27 aa, Mycobacterium avium
SVDLLNRFVGLGLRFISAGTDVGMMTE

SEQ ID NO: 104832 - protein, 23 aa, Mycobacterium avium
SVDVRLDCMFRVFNNTRYTHIDP

SEQ ID NO: 104833 - protein, 27 aa, Mycobacterium avium
SVEGTCLRCPYHGWLWDADGRNAEIPY

SEQ ID NO: 104834 - protein, 23 aa, Mycobacterium avium
SVEKALSVLPTWIEPQGDPVWCP

SEQ ID NO: 104835 - protein, 19 aa, Mycobacterium avium
SVESLACAYAVVLAEAKHY

SEQ ID NO: 104836 - protein, 22 aa, Mycobacterium avium
SVESLAGQGARVTVTEIDPINA

SEQ ID NO: 104837 - protein, 23 aa, Mycobacterium avium
SVFTRLYLATGLISVGKTQLSEF

SEQ ID NO: 104838 - protein, 17 aa, Mycobacterium avium
SVGKAASIGGLSVPASW

SEQ ID NO: 104839 - protein, 18 aa, Mycobacterium avium
SVHPRLLSTMLVPKAEEL

SEQ ID NO: 104840 - protein, 23 aa, Mycobacterium avium
SVISGRIAYTLGLAGPALTLDSS

SEQ ID NO: 104841 - protein, 17 aa, Mycobacterium avium
SVKELSKALGVRRSSVL

SEQ ID NO: 104842 - protein, 29 aa, Mycobacterium avium
SVKPEPGARCPRCPCLAPQDVPAVAGPSG

SEQ ID NO: 104843 - protein, 23 aa, Mycobacterium avium
SVLGRSWPVICDELLGHYEAVLS

SEQ ID NO: 104844 - protein, 35 aa, Mycobacterium avium
SVLMTRNRVRHVPVLDGKKLIGIVSIGDVVKIRME

SEQ ID NO: 104845 - protein, 18 aa, Mycobacterium avium
SVMPWFTDHSDYYDVGSE

SEQ ID NO: 104846 - protein, 21 aa, Mycobacterium avium
SVPALMRGYLRLGAQVCGEPA

SEQ ID NO: 104847 - protein, 20 aa, Mycobacterium avium
SVPDWLVWMHGCPGGESVAQ

SEQ ID NO: 104848 - protein, 17 aa, Mycobacterium avium
SVPMARFVETFVRVLGD

SEQ ID NO: 104849 - protein, 27 aa, Mycobacterium avium
SVPQWPELEAAALKRIRGPRVGDPADV

SEQ ID NO: 104850 - protein, 20 aa, Mycobacterium avium
SVRHWPHFEDPESFNAAAVE

SEQ ID NO: 104851 - protein, 23 aa, Mycobacterium avium
SVRIKYDAGNPFAPSITADTNGP

SEQ ID NO: 104852 - protein, 17 aa, Mycobacterium avium
SVSGVVTFGRYFLGGGG

SEQ ID NO: 104853 - protein, 30 aa, Mycobacterium avium
SVSLHRRWLLVELRSDWTLGTRTYAAGSLL

SEQ ID NO: 104854 - protein, 17 aa, Mycobacterium avium
SVVAIPLPRNGSAVQSG

SEQ ID NO: 104855 - protein, 24 aa, Mycobacterium avium
SVVARFIPRAGMIGTSLRDGEVEL

SEQ ID NO: 104856 - protein, 24 aa, Mycobacterium avium
SVVARFVPRAGMIGTSLRDGEVEL

SEQ ID NO: 104857 - protein, 21 aa, Mycobacterium avium
SVVLFGMPNVRAMNFLGEPPV

SEQ ID NO: 104858 - protein, 25 aa, Mycobacterium avium
SVVLRRIATRTGIPDYGYAFWPGRT

SEQ ID NO: 104859 - protein, 17 aa, Mycobacterium avium
SVVPCGVDLDAFTPDGP

SEQ ID NO: 104860 - protein, 18 aa, Mycobacterium avium
SVVPTTFVFEAFVHIRYD

SEQ ID NO: 104861 - protein, 25 aa, Mycobacterium avium
SVVSLSWRTGDDIVVTRTDPSHPVS

SEQ ID NO: 104862 - protein, 21 aa, Mycobacterium avium
SVWGESVAPPALVGGDTLIGE

SEQ ID NO: 104863 - protein, 24 aa, Mycobacterium avium
SVWGEYPAAVSWQATSEEVREDLG

SEQ ID NO: 104864 - protein, 22 aa, Mycobacterium avium
SWASIVPHTWLWASPLGAGIRA

SEQ ID NO: 104865 - protein, 17 aa, Mycobacterium avium
SWATPFTRVLDWSRAPF

SEQ ID NO: 104866 - protein, 28 aa, Mycobacterium avium
SWAVYRAELALVEVARKIGIRLRLFHGR

SEQ ID NO: 104867 - protein, 29 aa, Mycobacterium avium
SWFDHWYRHLVALGVRFVRDAATRLDPVP

SEQ ID NO: 104868 - protein, 25 aa, Mycobacterium avium
SWLTAVAEQCGRAAAQATAAASAFE

SEQ ID NO: 104869 - protein, 18 aa, Mycobacterium avium
SWMFEYYPMRDLRELPDG

SEQ ID NO: 104870 - protein, 19 aa, Mycobacterium avium
SWPDTKNPLFSEAQERSAA

SEQ ID NO: 104871 - protein, 20 aa, Mycobacterium avium
SWPTGWDCRCCRCARWWRVR

SEQ ID NO: 104872 - protein, 17 aa, Mycobacterium avium
SWVAIAVATDDQWQRLC

SEQ ID NO: 104873 - protein, 17 aa, Mycobacterium avium
SWYGQGASDSFYRTWYP

SEQ ID NO: 104874 - protein, 18 aa, Mycobacterium avium
SYEATHMAPFLGVPATGR

SEQ ID NO: 104875 - protein, 17 aa, Mycobacterium avium
SYELMRDCDTLLTVGSS

SEQ ID NO: 104876 - protein, 24 aa, Mycobacterium avium
SYEQRPPAPPGYSGQGYDQGYRPP

SEQ ID NO: 104877 - protein, 18 aa, Mycobacterium avium
SYHGVVFAELGPPAYALK

SEQ ID NO: 104878 - protein, 32 aa, Mycobacterium avium
SYHREIAMNFGMDGPWGQWVNRWTAEEARHST

SEQ ID NO: 104879 - protein, 25 aa, Mycobacterium avium
SYKDMEKWGRKMFVTPGIVVDGKLV

SEQ ID NO: 104880 - protein, 24 aa, Mycobacterium avium
SYLEMAAALADMFPGRGEQRGRGP

SEQ ID NO: 104881 - protein, 19 aa, Mycobacterium avium
SYLLASIMGDNRYLYPGFQ

SEQ ID NO: 104882 - protein, 25 aa, Mycobacterium avium
SYPDRIIPCQLPWLLDPELGAKMIY

SEQ ID NO: 104883 - protein, 35 aa, Mycobacterium avium
SYPVLAVTLNEEFPRLIVYRGPRRKGVRYFGPYSH

SEQ ID NO: 104884 - protein, 17 aa, Mycobacterium avium
SYQAAVFEAEFGDGSKL

SEQ ID NO: 104885 - protein, 20 aa, Mycobacterium avium
SYRFTEFRSAKTAPKDKGLQ

SEQ ID NO: 104886 - protein, 18 aa, Mycobacterium avium
SYTELVHDVVIPGAKKDH

SEQ ID NO: 104887 - protein, 31 aa, Mycobacterium avium; identical to SEQ ID NO: 14498

SEQ ID NO: 104888 - protein, 28 aa, Mycobacterium avium
TAADDVRAGWDWLINTCGVLPEQMVIAG

SEQ ID NO: 104889 - protein, 26 aa, Mycobacterium avium
TAADDVRAGWDWLINTCGVPPEQMVI

SEQ ID NO: 104890 - protein, 31 aa, Mycobacterium avium
TAADDVRAGWDWLVDTCGLLPKHIVIAGDSA

SEQ ID NO: 104891 - protein, 17 aa, Mycobacterium avium
TAAEVADGLLVMPFNSA

SEQ ID NO: 104892 - protein, 23 aa, Mycobacterium avium
TAAPELRLTALQAPAAAAAPPGR

SEQ ID NO: 104893 - protein, 18 aa, Mycobacterium avium
TAAPPSGGTPDWTLTGTT

SEQ ID NO: 104894 - protein, 25 aa, Mycobacterium avium
TAAQFWASIHGFVMLELAGYCGDDG

SEQ ID NO: 104895 - protein, 26 aa, Mycobacterium avium
TAAQPALVPMDAWRDGEKLVVEFDLP

SEQ ID NO: 104896 - protein, 23 aa, Mycobacterium avium
TAARVVNAIDWVCRAPQGLIGVE

SEQ ID NO: 104897 - protein, 20 aa, Mycobacterium avium
TAAVFARFASESAWGENDVD

SEQ ID NO: 104898 - protein, 24 aa, Mycobacterium avium
TADARRAASAGARRREAAAPENVE

SEQ ID NO: 104899 - protein, 20 aa, Mycobacterium avium
TADIERWRHFAFGVLGFAEG

SEQ ID NO: 104900 - protein, 23 aa, Mycobacterium avium
TADIERWRHFAFGVLGFAEGKGP

SEQ ID NO: 104901 - protein, 24 aa, Mycobacterium avium
TADIYPRYTCDYGTPRRPSSSADY

SEQ ID NO: 104902 - protein, 22 aa, Mycobacterium avium
TADRGRAGLSIYAATKAAVRSL

SEQ ID NO: 104903 - protein, 23 aa, Mycobacterium avium
TAEARTGVDVVRLVAGDPLTVDA

SEQ ID NO: 104904 - protein, 23 aa, Mycobacterium avium
TAEDVARAVLWFSSPSAARQVTG

SEQ ID NO: 104905 - protein, 18 aa, Mycobacterium avium
TAEFLTHPAFTQYRTETA

SEQ ID NO: 104906 - protein, 24 aa, Mycobacterium avium
TAEKISAATAFEWGMISHITSADE

SEQ ID NO: 104907 - protein, 26 aa, Mycobacterium avium
TAEKLAELYLRLELAKEPGGEKAAAK

SEQ ID NO: 104908 - protein, 17 aa, Mycobacterium avium
TAELAARAVEAFGKLDI

SEQ ID NO: 104909 - protein, 17 aa, Mycobacterium avium
TAEQRLGDEKGVIGNSL

SEQ ID NO: 104910 - protein, 18 aa, Mycobacterium avium
TAEQRLGDEKGVIGNSLQ

SEQ ID NO: 104911 - protein, 23 aa, Mycobacterium avium
TAERSLRWVAVHTAHEAQHHLLD

SEQ ID NO: 104912 - protein, 25 aa, Mycobacterium avium
TAFADFPVAHWKKIWSTNPLERLNK

SEQ ID NO: 104913 - protein, 18 aa, Mycobacterium avium
TAFARKGFSGVTIKDITD

SEQ ID NO: 104914 - protein, 19 aa, Mycobacterium avium
TAFDPDVLTIGFARRVPTY

SEQ ID NO: 104915 - protein, 18 aa, Mycobacterium avium
TAFFDNFFLAATHAGVRQ

SEQ ID NO: 104916 - protein, 23 aa, Mycobacterium avium
TAFSRAIARYGDRDHFLLTLTTM

SEQ ID NO: 104917 - protein, 19 aa, Mycobacterium avium
TAFTARLADRVQAHSRRVA

SEQ ID NO: 104918 - protein, 27 aa, Mycobacterium avium
TAGEPLDWFCLFSSAAALVGSPGQGAY

SEQ ID NO: 104919 - protein, 31 aa, Mycobacterium avium
TAGERPAVVPLSFAQNRLWFLDQLQGPSPVY

SEQ ID NO: 104920 - protein, 32 aa, Mycobacterium avium
TAGERPAVVPLSFAQSRLWFLDQLQGPSPVYN

SEQ ID NO: 104921 - protein, 24 aa, Mycobacterium avium
TAGEWPEGLAAVLTGAADQARAAV

SEQ ID NO: 104922 - protein, 25 aa, Mycobacterium avium
TAGGSEIPLDFRILDTILGAQTTFR

SEQ ID NO: 104923 - protein, 30 aa, Mycobacterium avium
TAGQARLAVEVFEAAFAMTVPPPAVAANRV

SEQ ID NO: 104924 - protein, 26 aa, Mycobacterium avium
TAGSCGCPKGRFSLQSSATGMELHDG

SEQ ID NO: 104925 - protein, 17 aa, Mycobacterium avium
TAGSGAKVLLAHSDAAT

SEQ ID NO: 104926 - protein, 21 aa, Mycobacterium avium
TAGTAAGLWAGATVGGLAADA

SEQ ID NO: 104927 - protein, 26 aa, Mycobacterium avium
TAIPLAKACARIMLGATISQLRAEEM

SEQ ID NO: 104928 - protein, 20 aa, Mycobacterium avium
TAKAVGWTPADWVDNTLETW

SEQ ID NO: 104929 - protein, 20 aa, Mycobacterium avium
TAKEFGRRGANVALLARGAA

SEQ ID NO: 104930 - protein, 20 aa, Mycobacterium avium
TALASEEWLGSASASMASAV

SEQ ID NO: 104931 - protein, 26 aa, Mycobacterium avium
TALIYDLRLGPAWQGLGFGVGMITEA

SEQ ID NO: 104932 - protein, 25 aa, Mycobacterium avium
TALLDARLADFAPLPAPDDVLAAAG

SEQ ID NO: 104933 - protein, 25 aa, Mycobacterium avium
TALLDARLADFTPLPAPDDVLAAAG

SEQ ID NO: 104934 - protein, 18 aa, Mycobacterium avium
TALLKERLLLTVHLDPFT

SEQ ID NO: 104935 - protein, 19 aa, Mycobacterium avium
TALLRRAQVPLHIDTGLLT

SEQ ID NO: 104936 - protein, 17 aa, Mycobacterium avium
TALRIGIVTEVVPDDQL

SEQ ID NO: 104937 - protein, 25 aa, Mycobacterium avium
TALSGLKAAGILGIGAQLGGQWAQD

SEQ ID NO: 104938 - protein, 25 aa, Mycobacterium avium
TALTAGTRRARLFYANRSRDAVIFD

SEQ ID NO: 104939 - protein, 29 aa, Mycobacterium avium
TAMLRRLGIPGDFKGGFRVTTPEVLDVAR

SEQ ID NO: 104940 - protein, 29 aa, Mycobacterium avium
TAMPGKPCLRLLGFERVELGPGESRHVTI

SEQ ID NO: 104941 - protein, 24 aa, Mycobacterium avium
TAMREIRVPERFDIGEGYGKTSWN

SEQ ID NO: 104942 - protein, 19 aa, Mycobacterium avium
TAMSVDVKTVRRWLSNTNY

SEQ ID NO: 104943 - protein, 32 aa, Mycobacterium avium
TANSPGAVCLRLPVRTPFGFQGVFGHLAASVV

SEQ ID NO: 104944 - protein, 27 aa, Mycobacterium avium
TANVLLRLCKDAELRAKFTADPSLVKK

SEQ ID NO: 104945 - protein, 18 aa, Mycobacterium avium
TAPFWFAGSLGELEAVGA

SEQ ID NO: 104946 - protein, 23 aa, Mycobacterium avium
TAPGCTAPGCTVPGYYSEVHHCT

SEQ ID NO: 104947 - protein, 24 aa, Mycobacterium avium
TAPGCTAPGCTVPGYYSEVHHCTD

SEQ ID NO: 104948 - protein, 19 aa, Mycobacterium avium
TAPGQWKVWHEWEQASCGR

SEQ ID NO: 104949 - protein, 25 aa, Mycobacterium avium
TAPNPMFLAWVISEDLKRLWPSLGT

SEQ ID NO: 104950 - protein, 18 aa, Mycobacterium avium
TAQYGTPCYARVDAPADR

SEQ ID NO: 104951 - protein, 17 aa, Mycobacterium avium
TARAYRTDPEFFAMGHN

SEQ ID NO: 104952 - protein, 21 aa, Mycobacterium avium
TARDKEAWLAVFADDAVVEDP

SEQ ID NO: 104953 - protein, 23 aa, Mycobacterium avium
TARGRRRAGCDAVRPGAHRPGHP

SEQ ID NO: 104954 - protein, 22 aa, Mycobacterium avium
TARLRRWRTATALPAGPDATDV

SEQ ID NO: 104955 - protein, 19 aa, Mycobacterium avium
TARRSSCTRPSRGRATVAV

SEQ ID NO: 104956 - protein, 22 aa, Mycobacterium avium
TARSIPWAKAVDESGRFRSRAE

SEQ ID NO: 104957 - protein, 19 aa, Mycobacterium avium
TARVSVCYMGVNGRDGTVF

SEQ ID NO: 104958 - protein, 18 aa, Mycobacterium avium
TASAIAWIGYDPPQVPGF

SEQ ID NO: 104959 - protein, 21 aa, Mycobacterium avium
TASDALRWGLINEVVPDGTVV

SEQ ID NO: 104960 - protein, 21 aa, Mycobacterium avium
TASERVHLGWWVIEKDTIAAM

SEQ ID NO: 104961 - protein, 18 aa, Mycobacterium avium
TASPRGAGNLGFAGTAPR

SEQ ID NO: 104962 - protein, 19 aa, Mycobacterium avium
TATLFLLAPSWRYRPHADK

SEQ ID NO: 104963 - protein, 20 aa, Mycobacterium avium
TATLFLLAPSWRYRPHADKR

SEQ ID NO: 104964 - protein, 21 aa, Mycobacterium avium
TATLFLLAPSWRYRPHADKRR

SEQ ID NO: 104965 - protein, 19 aa, Mycobacterium avium
TATLRWLADHRIHEVAALP

SEQ ID NO: 104966 - protein, 17 aa, Mycobacterium avium
TAVAGVIAMLVSDDGAF

SEQ ID NO: 104967 - protein, 28 aa, Mycobacterium avium
TAVELRNRLKIATGLTLSPTVIFDHPTP

SEQ ID NO: 104968 - protein, 17 aa, Mycobacterium avium
TAVKELGQRMCHAAAEL

SEQ ID NO: 104969 - protein, 26 aa, Mycobacterium avium
TAVPVPELHYGMFRRKDKVSRRAARE

SEQ ID NO: 104970 - protein, 18 aa, Mycobacterium avium
TAVRWARAHPQQWAQSYA

SEQ ID NO: 104971 - protein, 25 aa, Mycobacterium avium
TAVSLELFGRLGYFDTSVDAIAKGA

SEQ ID NO: 104972 - protein, 25 aa, Mycobacterium avium
TAVYVCGPSAMLEAVWIARNEHAGA

SEQ ID NO: 104973 - protein, 17 aa, Mycobacterium avium
TAWLAEGLLPYLPSDAQ

SEQ ID NO: 104974 - protein, 20 aa, Mycobacterium avium
TAWRNDEWLTARLRLSPLRP

SEQ ID NO: 104975 - protein, 17 aa, Mycobacterium avium
TAWTDEWDRPENPDPLG

SEQ ID NO: 104976 - protein, 18 aa, Mycobacterium avium
TAYASALTRAYADGRRIV

SEQ ID NO: 104977 - protein, 25 aa, Mycobacterium avium
TAYLECAQACGLALLGGPPTPETAM

SEQ ID NO: 104978 - protein, 18 aa, Mycobacterium avium
TCAFLCPSAAAAVDVGTE

SEQ ID NO: 104979 - protein, 19 aa, Mycobacterium avium
TCLELPYVRRQGATAQEAM

SEQ ID NO: 104980 - protein, 27 aa, Mycobacterium avium
TCRSHESAWPAAVLVAATMLSVTACGH

SEQ ID NO: 104981 - protein, 22 aa, Mycobacterium avium
TCVEPLKKWRLDVGPNNSGIEW

SEQ ID NO: 104982 - protein, 17 aa, Mycobacterium avium
TCVFVDHGLLRAGERAQ

SEQ ID NO: 104983 - protein, 20 aa, Mycobacterium avium
TDAARQWPDRTAVRDAVGGT

SEQ ID NO: 104984 - protein, 22 aa, Mycobacterium avium
TDAARRWPDRTAVLDASGGTGF

SEQ ID NO: 104985 - protein, 17 aa, Mycobacterium avium
TDAAVLPARGNIVYRSD

SEQ ID NO: 104986 - protein, 22 aa, Mycobacterium avium
TDADLLNFSFLLLVAGNETTRN

SEQ ID NO: 104987 - protein, 20 aa, Mycobacterium avium
TDAETTWKLLLDSQSGIRKL

SEQ ID NO: 104988 - protein, 18 aa, Mycobacterium avium
TDALRAAGWDPPRYTTTA

SEQ ID NO: 104989 - protein, 26 aa, Mycobacterium avium
TDDAGRWLAFEVGVLVARQNGKNGGI

SEQ ID NO: 104990 - protein, 17 aa, Mycobacterium avium
TDDGLLVPIHWGTFRLA

SEQ ID NO: 104991 - protein, 29 aa, Mycobacterium avium
TDDIRWALDLLRQRFAKVIWVPGNHELWT

SEQ ID NO: 104992 - protein, 17 aa, Mycobacterium avium
TDDQWHRLCRALGSPSW

SEQ ID NO: 104993 - protein, 20 aa, Mycobacterium avium
TDDVVTWGMECPDCLYTRAV

SEQ ID NO: 104994 - protein, 18 aa, Mycobacterium avium
TDFNRLMWDNGIAPTRVI

SEQ ID NO: 104995 - protein, 21 aa, Mycobacterium avium
TDFVDEFGRTWQAVVPEQTDE

SEQ ID NO: 104996 - protein, 28 aa, Mycobacterium avium
TDGDWPSFPLPLGDTWSSTRGDLLTVEL

SEQ ID NO: 104997 - protein, 17 aa, Mycobacterium avium
TDGQRIAAASAFGIAGT

SEQ ID NO: 104998 - protein, 17 aa, Mycobacterium avium
TDIDAVLEFRVSQDELL

SEQ ID NO: 104999 - protein, 29 aa, Mycobacterium avium
TDKEFRKRLPMYFWVAGWETCRRMLAFLK

SEQ ID NO: 105000 - protein, 17 aa, Mycobacterium avium
TDLGPLVSRRQQQRVRD

SEQ ID NO: 105001 - protein, 17 aa, Mycobacterium avium
TDLLYKLLRSDWLEPRW

SEQ ID NO: 105002 - protein, 23 aa, Mycobacterium avium
TDLPFLIKLEERGDMVPGKNLTA

SEQ ID NO: 105003 - protein, 19 aa, Mycobacterium avium
TDLRAWLTTVVSRLGLDRL

SEQ ID NO: 105004 - protein, 21 aa, Mycobacterium avium
TDLRCAQLPPGMLDGIAETQW

SEQ ID NO: 105005 - protein, 20 aa, Mycobacterium avium
TDLSAWPPVGAVPVDLGDGY

SEQ ID NO: 105006 - protein, 18 aa, Mycobacterium avium
TDNPSLKATDTFIIKVAC

SEQ ID NO: 105007 - protein, 17 aa, Mycobacterium avium
TDPERWRALWKTVVDLG

SEQ ID NO: 105008 - protein, 19 aa, Mycobacterium avium
TDPGYRWSGRIDVAHDQSK

SEQ ID NO: 105009 - protein, 25 aa, Mycobacterium avium
TDPRRPVSVTARRVGCWRFVTLHRQ

SEQ ID NO: 105010 - protein, 19 aa, Mycobacterium avium
TDPRRVWRNGIKAFFTAFS

SEQ ID NO: 105011 - protein, 24 aa, Mycobacterium avium
TDRCVTEEIFGPVVTVLAFDDEQD

SEQ ID NO: 105012 - protein, 23 aa, Mycobacterium avium
TDRLRSAPIRGLDLADATAALMR

SEQ ID NO: 105013 - protein, 21 aa, Mycobacterium avium
TDTTIAWKGDEAIELTSSTGE

SEQ ID NO: 105014 - protein, 22 aa, Mycobacterium avium
TDTWLPMPKEWAALTVQKQRDD

SEQ ID NO: 105015 - protein, 18 aa, Mycobacterium avium
TDVELRIRCLDQLHRALL

SEQ ID NO: 105016 - protein, 18 aa, Mycobacterium avium
TDVICLTSPGALPYYIQK

SEQ ID NO: 105017 - protein, 27 aa, Mycobacterium avium
TDVLTRLRGMFAFALWDTVTRELFCAR

SEQ ID NO: 105018 - protein, 23 aa, Mycobacterium avium
TDVPKLGSFEVMNRTIDIAQAAL

SEQ ID NO: 105019 - protein, 18 aa, Mycobacterium avium
TDVQPTFRKHPAFFGGVT

SEQ ID NO: 105020 - protein, 20 aa, Mycobacterium avium
TDVRGGLLFVWHDHENNPPD

SEQ ID NO: 105021 - protein, 27 aa, Mycobacterium avium
TDVRTGESFCLKGWTSLGVTGRATHGG

SEQ ID NO: 105022 - protein, 17 aa, Mycobacterium avium
TDWWAHDTWDLRADPRI

SEQ ID NO: 105023 - protein, 22 aa, Mycobacterium avium
TDYPSLEAYQDFPGGSTRTLLI

SEQ ID NO: 105024 - protein, 18 aa, Mycobacterium avium
TEAAFGPIDVWVNVAFTS

SEQ ID NO: 105025 - protein, 23 aa, Mycobacterium avium
TEACGISRAGFYTYFKDKREIFN

SEQ ID NO: 105026 - protein, 23 aa, Mycobacterium avium
TEAELDQLIGFFVNILVLRNDMD

SEQ ID NO: 105027 - protein, 20 aa, Mycobacterium avium
TEAGLFTWGGHGGITAPFYA

SEQ ID NO: 105028 - protein, 24 aa, Mycobacterium avium
TEALLRWQHPTLGLLMPDSFIQVV

SEQ ID NO: 105029 - protein, 29 aa, Mycobacterium avium
TEAPRGTHALRFIRSCSAPLTAETAQALQ

SEQ ID NO: 105030 - protein, 22 aa, Mycobacterium avium
TEATFCYPEVAIGVPTIVGAIR

SEQ ID NO: 105031 - protein, 21 aa, Mycobacterium avium
TECARCAPPARIGRSTSAPAA

SEQ ID NO: 105032 - protein, 17 aa, Mycobacterium avium
TECARCATPGPHRAFHV

SEQ ID NO: 105033 - protein, 24 aa, Mycobacterium avium
TEDGPHLHANWTWAPSAVDRDQIS

SEQ ID NO: 105034 - protein, 25 aa, Mycobacterium avium
TEDGPHLHANWTWAPSAVDRDQISR

SEQ ID NO: 105035 - protein, 24 aa, Mycobacterium avium
TEDQRLRFLPPIVRNEEKWCQLFS

SEQ ID NO: 105036 - protein, 18 aa, Mycobacterium avium
TEEIFGPVVTVLAFDDEQ

SEQ ID NO: 105037 - protein, 22 aa, Mycobacterium avium
TEEILLELDVDWDDIAEAKALK

SEQ ID NO: 105038 - protein, 18 aa, Mycobacterium avium
TEEITDWQLASNAEHSST

SEQ ID NO: 105039 - protein, 18 aa, Mycobacterium avium
TEELARGWMSLAGAMGGH

SEQ ID NO: 105040 - protein, 24 aa, Mycobacterium avium
TEEQKAKFLPAILKGTVDFAIGYS

SEQ ID NO: 105041 - protein, 23 aa, Mycobacterium avium
TEEVLMEAGLDWDTIATYKETGA

SEQ ID NO: 105042 - protein, 23 aa, Mycobacterium avium
TEEYLRIISALLRGEEVDYSGQD

SEQ ID NO: 105043 - protein, 24 aa, Mycobacterium avium
TEEYLRIISALLRGEEVDYSGQDW

SEQ ID NO: 105044 - protein, 24 aa, Mycobacterium avium
TEFAANAAEGWAMATASVRDLFAE

SEQ ID NO: 105045 - protein, 24 aa, Mycobacterium avium
TEFAELRPRLVYDRDTGTLTARPG

SEQ ID NO: 105046 - protein, 17 aa, Mycobacterium avium
TEFVEGSVIAWCPAEPG

SEQ ID NO: 105047 - protein, 30 aa, Mycobacterium avium
TEGGAAMTECRRALGDAGLLGVAWPVEYGG

SEQ ID NO: 105048 - protein, 25 aa, Mycobacterium avium
TEGRCWRPTTTWWAPTRTSRGIPWC

SEQ ID NO: 105049 - protein, 21 aa, Mycobacterium avium
TEGTVTRWLKQEGDTVELDEP

SEQ ID NO: 105050 - protein, 20 aa, Mycobacterium avium
TEHTWLPESIIRTGGTLAFS

SEQ ID NO: 105051 - protein, 25 aa, Mycobacterium avium
TEIDNWRWAGVPIFLRAGKALPHKV

SEQ ID NO: 105052 - protein, 31 aa, Mycobacterium avium
TEIDNWRWAGVPIFLRAGKALPHKVTEVRMF

SEQ ID NO: 105053 - protein, 17 aa, Mycobacterium avium
TEIGIGTVRSAFIPADG

SEQ ID NO: 105054 - protein, 18 aa, Mycobacterium avium
TEIKFRSVLEEPTYEDGI

SEQ ID NO: 105055 - protein, 19 aa, Mycobacterium avium
TEIKFRSVLEEPTYEDGIG

SEQ ID NO: 105056 - protein, 18 aa, Mycobacterium avium
TEILEGLGETEVRMRVTL

SEQ ID NO: 105057 - protein, 17 aa, Mycobacterium avium
TEIPLRAWLFRRNHDEH

SEQ ID NO: 105058 - protein, 18 aa, Mycobacterium avium
TEIRGRIHRAMWLENCDV

SEQ ID NO: 105059 - protein, 20 aa, Mycobacterium avium
TEITWRWDIHPRSPLTAWAL

SEQ ID NO: 105060 - protein, 21 aa, Mycobacterium avium
TELFFDRLKPGGSVTIVSSTA

SEQ ID NO: 105061 - protein, 18 aa, Mycobacterium avium
TELGALPQRVIAVLHRQV

SEQ ID NO: 105062 - protein, 22 aa, Mycobacterium avium
TELHCPASMALAAKLLGVNESP

SEQ ID NO: 105063 - protein, 20 aa, Mycobacterium avium
TELLAGLSVHAARIAENLAA

SEQ ID NO: 105064 - protein, 17 aa, Mycobacterium avium
TELQRIAALCAAFDVDG

SEQ ID NO: 105065 - protein, 24 aa, Mycobacterium avium
TELRDWVGALVRPLTDHLSALDTP

SEQ ID NO: 105066 - protein, 25 aa, Mycobacterium avium
TELRDWVGALVRPLTDHLSALGTPS

SEQ ID NO: 105067 - protein, 27 aa, Mycobacterium avium
TELRELRSSGAVFGLLDVDDEFFVIVR

SEQ ID NO: 105068 - protein, 19 aa, Mycobacterium avium
TELRPCARCGEDGYIIARR

SEQ ID NO: 105069 - protein, 25 aa, Mycobacterium avium
TEPIPDDWTALPFGVPLPNNACRVV

SEQ ID NO: 105070 - protein, 22 aa, Mycobacterium avium
TEPPEAALPRYTGGTSPRALAM

SEQ ID NO: 105071 - protein, 19 aa, Mycobacterium avium
TEQLARGWMSLAGAMGGHT

SEQ ID NO: 105072 - protein, 22 aa, Mycobacterium avium
TERARELLAPYGNRVSIAAVNG

SEQ ID NO: 105073 - protein, 20 aa, Mycobacterium avium
TERHIRLIFQRAREKASEGT

SEQ ID NO: 105074 - protein, 20 aa, Mycobacterium avium
TERLPAYLVPAAVLVLDALP

SEQ ID NO: 105075 - protein, 18 aa, Mycobacterium avium
TERLWPTLLEPLRSRRHA

SEQ ID NO: 105076 - protein, 17 aa, Mycobacterium avium
TESPWARRAFDLRCGPL

SEQ ID NO: 105077 - protein, 25 aa, Mycobacterium avium
TETGWELFGRRAIRQGNWKALHLPA

SEQ ID NO: 105078 - protein, 17 aa, Mycobacterium avium
TETRAGYGAAVHAGVLA

SEQ ID NO: 105079 - protein, 20 aa, Mycobacterium avium
TEVGRRGAITPALATLGFAV

SEQ ID NO: 105080 - protein, 24 aa, Mycobacterium avium
TEVLIKAYHRWGDDFVSHLFGMFA

SEQ ID NO: 105081 - protein, 19 aa, Mycobacterium avium
TEVRMRVTLSYFVEPNPSS

SEQ ID NO: 105082 - protein, 17 aa, Mycobacterium avium
TEVSCKFRPERVSAELA

SEQ ID NO: 105083 - protein, 25 aa, Mycobacterium avium
TEVTLRFADGEVVTMQVISIVEETP

SEQ ID NO: 105084 - protein, 19 aa, Mycobacterium avium
TEYECRRALGLCGDREDAR

SEQ ID NO: 105085 - protein, 18 aa, Mycobacterium avium
TFAAIAVNAYCPDQASSI

SEQ ID NO: 105086 - protein, 25 aa, Mycobacterium avium
TFAAYYRWDVYCFTTAGDVLLPIGY

SEQ ID NO: 105087 - protein, 28 aa, Mycobacterium avium
TFADAYGADFFAPWGKLAALRTPTIAAV

SEQ ID NO: 105088 - protein, 27 aa, Mycobacterium avium
TFADAYGADFFAPWGKLAAVRTPTIAA

SEQ ID NO: 105089 - protein, 27 aa, Mycobacterium avium
TFADAYGADFFATWGKLAAVRTPTIAA

SEQ ID NO: 105090 - protein, 23 aa, Mycobacterium avium
TFAPRAYLADLFYAGEVPQDVVD

SEQ ID NO: 105091 - protein, 25 aa, Mycobacterium avium
TFGRKIIDHQGLAFLLADMAAAVDS

SEQ ID NO: 105092 - protein, 24 aa, Mycobacterium avium
TFLEGCSGPSALGFELPRDVGYGF

SEQ ID NO: 105093 - protein, 17 aa, Mycobacterium avium
TFLRPLDGFPQRRARLM

SEQ ID NO: 105094 - protein, 28 aa, Mycobacterium avium
TFNCVSWLEALGFCGFGEAQGWLDGGRR

SEQ ID NO: 105095 - protein, 17 aa, Mycobacterium avium
TFNRPGRLNAWGPDISS

SEQ ID NO: 105096 - protein, 19 aa, Mycobacterium avium
TFRRLRPDLDNPTADDAAE

SEQ ID NO: 105097 - protein, 17 aa, Mycobacterium avium
TFRSGGMDRTYMLHVPA

SEQ ID NO: 105098 - protein, 25 aa, Mycobacterium avium
TFSLGSWWSGVAWSTIKVPLAIAAL

SEQ ID NO: 105099 - protein, 24 aa, Mycobacterium avium
TFSPRMREVIILRVAHLQDSPYEL

SEQ ID NO: 105100 - protein, 22 aa, Mycobacterium avium
TFSRIPVMASFAPYELHFDNVR

SEQ ID NO: 105101 - protein, 30 aa, Mycobacterium avium
TFTCIATAKAAIWAGLASPVMIWSMAQAAC

SEQ ID NO: 105102 - protein, 23 aa, Mycobacterium avium
TFTPRHMGVMFGAPGGDYCHGLL

SEQ ID NO: 105103 - protein, 19 aa, Mycobacterium avium
TGADFTSKEDFAFDLSARN

SEQ ID NO: 105104 - protein, 20 aa, Mycobacterium avium
TGAEGFCYMVGSFGLGMDSK

SEQ ID NO: 105105 - protein, 27 aa, Mycobacterium avium
TGAGGGLGRAYARFVAANGGLVVVNDL

SEQ ID NO: 105106 - protein, 18 aa, Mycobacterium avium
TGAGVIREFVGLPSRTAG

SEQ ID NO: 105107 - protein, 22 aa, Mycobacterium avium
TGAIVKRPRVIVDEFGNESIGV

SEQ ID NO: 105108 - protein, 25 aa, Mycobacterium avium
TGAIVKRPRVIVDEFGNESIGVRSI

SEQ ID NO: 105109 - protein, 25 aa, Mycobacterium avium
TGAIVKRPRVIVDEFGNESIGVRSV

SEQ ID NO: 105110 - protein, 23 aa, Mycobacterium avium
TGAPGRAWLFFGARNRALDFLYA

SEQ ID NO: 105111 - protein, 24 aa, Mycobacterium avium
TGAPHLRGPAALRAGRPRCPAARQ

SEQ ID NO: 105112 - protein, 17 aa, Mycobacterium avium
TGAPLGLDRPWFVEDEE

SEQ ID NO: 105113 - protein, 23 aa, Mycobacterium avium
TGARRREVYWARYRDGVRTDGPA

SEQ ID NO: 105114 - protein, 18 aa, Mycobacterium avium
TGASCPPGVVGELVNTAG

SEQ ID NO: 105115 - protein, 25 aa, Mycobacterium avium
TGATWQEIADALGYRSRQAAQLAVK

SEQ ID NO: 105116 - protein, 18 aa, Mycobacterium avium
TGCDRGRATGRTMSPRVG

SEQ ID NO: 105117 - protein, 17 aa, Mycobacterium avium
TGCRVELARAKAIKDAY

SEQ ID NO: 105118 - protein, 18 aa, Mycobacterium avium
TGDKVVVFGAGPVGLGAI

SEQ ID NO: 105119 - protein, 24 aa, Mycobacterium avium
TGDLHWRLGQLRGIERFVDERETE

SEQ ID NO: 105120 - protein, 23 aa, Mycobacterium avium
TGDMPIRLPCIGGHEGAGVVKAV

SEQ ID NO: 105121 - protein, 25 aa, Mycobacterium avium
TGELIGFPFFRGYGGRKLDLTLGRV

SEQ ID NO: 105122 - protein, 22 aa, Mycobacterium avium
TGFVGRYLVLQWLERLELADGK

SEQ ID NO: 105123 - protein, 23 aa, Mycobacterium avium
TGGAPGNFLSAGGHYQAPGHTGK

SEQ ID NO: 105124 - protein, 19 aa, Mycobacterium avium
TGGEIIDLLARMRGGIDKR

SEQ ID NO: 105125 - protein, 27 aa, Mycobacterium avium
TGGELAVALHADFPPERITFHGNNKSV

SEQ ID NO: 105126 - protein, 22 aa, Mycobacterium avium
TGGFTEFVPLPFVHQSSPLYLA

SEQ ID NO: 105127 - protein, 20 aa, Mycobacterium avium
TGGLQPARAWTFFLTASLGF

SEQ ID NO: 105128 - protein, 25 aa, Mycobacterium avium
TGHSALDVAARWQAMVRAMRNNGRP

SEQ ID NO: 105129 - protein, 19 aa, Mycobacterium avium
TGIDVSWTGGRDLWWHDVV

SEQ ID NO: 105130 - protein, 21 aa, Mycobacterium avium
TGKELPEGWEVRYGEVGDAFG

SEQ ID NO: 105131 - protein, 19 aa, Mycobacterium avium
TGKELWQVADDMPLVPAST

SEQ ID NO: 105132 - protein, 22 aa, Mycobacterium avium
TGKKALLMHGALWQGTVVATMA

SEQ ID NO: 105133 - protein, 18 aa, Mycobacterium avium
TGKRAQCFGGAKNHMIVM

SEQ ID NO: 105134 - protein, 17 aa, Mycobacterium avium
TGKRLGATINDMVLAMS

SEQ ID NO: 105135 - protein, 18 aa, Mycobacterium avium
TGKRLGATINDMVLAMST

SEQ ID NO: 105136 - protein, 26 aa, Mycobacterium avium
TGLIPEIPDGLGWWDPEADNAVRPDV

SEQ ID NO: 105137 - protein, 24 aa, Mycobacterium avium
TGLLTLPHPEQWGGGGQPYEVYLQ

SEQ ID NO: 105138 - protein, 32 aa, Mycobacterium avium
TGLPGVLSRRIEPRNGTVLVWGAVNAGVAANA

SEQ ID NO: 105139 - protein, 24 aa, Mycobacterium avium
TGLPVFCIDYRLAPKHRFPTAADD

SEQ ID NO: 105140 - protein, 22 aa, Mycobacterium avium
TGLSVAIAHSGFRPPSADPSAR

SEQ ID NO: 105141 - protein, 23 aa, Mycobacterium avium
TGLTEAALMDWALLRAANQFWML

SEQ ID NO: 105142 - protein, 21 aa, Mycobacterium avium
TGLVCALLLTTRGAALTLRQL

SEQ ID NO: 105143 - protein, 20 aa, Mycobacterium avium
TGNREINEILASKKLPPEKL

SEQ ID NO: 105144 - protein, 19 aa, Mycobacterium avium
TGNVDEWVALSVRHDDDWR

SEQ ID NO: 105145 - protein, 18 aa, Mycobacterium avium
TGPHVARWMAADFECYGT

SEQ ID NO: 105146 - protein, 24 aa, Mycobacterium avium
TGPMPLLPNGRWLYEHGNPRRLAQ

SEQ ID NO: 105147 - protein, 27 aa, Mycobacterium avium
TGPSRFSAPLAARWISAGARIVGGCCQ

SEQ ID NO: 105148 - protein, 18 aa, Mycobacterium avium
TGQTCLAGSRLLVHESVA

SEQ ID NO: 105149 - protein, 18 aa, Mycobacterium avium
TGQYRACGAVNPDVQPRP

SEQ ID NO: 105150 - protein, 17 aa, Mycobacterium avium
TGRENLVLFGRLRGLNR

SEQ ID NO: 105151 - protein, 19 aa, Mycobacterium avium
TGRHPLKFTAYDGSTAGSE

SEQ ID NO: 105152 - protein, 21 aa, Mycobacterium avium
TGRNALALARRGHPVDAVEMT

SEQ ID NO: 105153 - protein, 24 aa, Mycobacterium avium
TGRQRFPGWPFRISPGPIHQHRAA

SEQ ID NO: 105154 - protein, 20 aa, Mycobacterium avium
TGRQSYWESICFKPDAPSYF

SEQ ID NO: 105155 - protein, 19 aa, Mycobacterium avium
TGRRFEALSALSAGVKDVR

SEQ ID NO: 105156 - protein, 24 aa, Mycobacterium avium
TGRRLLICGSAGFVAGALAGQRAE

SEQ ID NO: 105157 - protein, 26 aa, Mycobacterium avium
TGRRLLICGSAGFVPGALAGQRAGAA

SEQ ID NO: 105158 - protein, 25 aa, Mycobacterium avium
TGRRRRCGWFDAVVARYATRVNGIT

SEQ ID NO: 105159 - protein, 23 aa, Mycobacterium avium
TGRTVVLRLRFDDFTRTTRSHTL

SEQ ID NO: 105160 - protein, 23 aa, Mycobacterium avium
TGRVVATPIMRWLQNMDGPVEQF

SEQ ID NO: 105161 - protein, 17 aa, Mycobacterium avium
TGSALGRSVKLDGAYWR

SEQ ID NO: 105162 - protein, 21 aa, Mycobacterium avium
TGSLCNLLMMPQQVVMREADI

SEQ ID NO: 105163 - protein, 27 aa, Mycobacterium avium
TGTATGVPWARACAAALLAVTTPAGLR

SEQ ID NO: 105164 - protein, 18 aa, Mycobacterium avium
TGTIARSGEIGYLPQDPK

SEQ ID NO: 105165 - protein, 18 aa, Mycobacterium avium
TGTRARWRPVTPELARRY

SEQ ID NO: 105166 - protein, 19 aa, Mycobacterium avium
TGTRARWRPVTPVLARRYT

SEQ ID NO: 105167 - protein, 19 aa, Mycobacterium avium
TGVDPHWSDLHATYEASDL

SEQ ID NO: 105168 - protein, 35 aa, Mycobacterium avium
TGVEIAEMFRLPPALERGWHARGYYGSVSHNVKAI

SEQ ID NO: 105169 - protein, 17 aa, Mycobacterium avium
TGVPIDYFAEVNLAGFY

SEQ ID NO: 105170 - protein, 18 aa, Mycobacterium avium
TGWSITRLPTERVYADYG

SEQ ID NO: 105171 - protein, 18 aa, Mycobacterium avium
TGWSVTRLPTERVYADYG

SEQ ID NO: 105172 - protein, 18 aa, Mycobacterium avium
TGWSVTRLPTERVYTDYG

SEQ ID NO: 105173 - protein, 27 aa, Mycobacterium avium
TGYTFACDRWRVVPDVYLLGKALGGGV

SEQ ID NO: 105174 - protein, 24 aa, Mycobacterium avium
THAPDALPVLFGHIGEGNLHLNVL

SEQ ID NO: 105175 - protein, 25 aa, Mycobacterium avium
THAPDALPVLFGHIGEGNLHLNVLH

SEQ ID NO: 105176 - protein, 25 aa, Mycobacterium avium
THAPDALPVLFGHIGEGNLHLNVLR

SEQ ID NO: 105177 - protein, 21 aa, Mycobacterium avium
THEVWKAGQPVSLSPNEFTLL

SEQ ID NO: 105178 - protein, 25 aa, Mycobacterium avium
THHLVKTFWGWREQQLPDATLILTS

SEQ ID NO: 105179 - protein, 19 aa, Mycobacterium avium
THHMFLPMPPEDGGAPPPA

SEQ ID NO: 105180 - protein, 20 aa, Mycobacterium avium
THITQLLGRMVRTPLARRIP

SEQ ID NO: 105181 - protein, 21 aa, Mycobacterium avium
THLIDKWKIYTGRAAPGTGNR

SEQ ID NO: 105182 - protein, 18 aa, Mycobacterium avium
THLIEHLHLYLSVRTTDT

SEQ ID NO: 105183 - protein, 17 aa, Mycobacterium avium
THLPGYRVGGTIHIIVN

SEQ ID NO: 105184 - protein, 19 aa, Mycobacterium avium
THPAVADCAVFGLPDDRLG

SEQ ID NO: 105185 - protein, 23 aa, Mycobacterium avium
THPDGRSAFALWFTGGIFVNQSA

SEQ ID NO: 105186 - protein, 24 aa, Mycobacterium avium
THPGCDAPGYWCEVHHLDEWATGG

SEQ ID NO: 105187 - protein, 22 aa, Mycobacterium avium
THPGMLAGVVPLVLHAPAAATF

SEQ ID NO: 105188 - protein, 22 aa, Mycobacterium avium
THPGMLAGVVPLVLHAPATATF

SEQ ID NO: 105189 - protein, 25 aa, Mycobacterium avium
THQPWVVSFQLNWPRDHGPTATGWM

SEQ ID NO: 105190 - protein, 19 aa, Mycobacterium avium
THRAIPGSRLCVIADGPHG

SEQ ID NO: 105191 - protein, 23 aa, Mycobacterium avium
THRELMTQLGLGVRRGILLAGPP

SEQ ID NO: 105192 - protein, 17 aa, Mycobacterium avium
THRGGKWATFYAEEALA

SEQ ID NO: 105193 - protein, 17 aa, Mycobacterium avium
THRLPKPFIVLATDNPI

SEQ ID NO: 105194 - protein, 22 aa, Mycobacterium avium
THTRPPVKFRVKLDSPEGRVEL

SEQ ID NO: 105195 - protein, 26 aa, Mycobacterium avium
THVVAHAFNRWLLDDWTFNYQDRIFP

SEQ ID NO: 105196 - protein, 23 aa, Mycobacterium avium
TIAELHAANGFAYAADDVAAAFA

SEQ ID NO: 105197 - protein, 24 aa, Mycobacterium avium
TIAPRAEATAVYFDRRQLGAGHAV

SEQ ID NO: 105198 - protein, 24 aa, Mycobacterium avium
TIDRPHPRNAIALDTMDQLEKALD

SEQ ID NO: 105199 - protein, 20 aa, Mycobacterium avium
TIEIAAAIGKPVIVYPNSGE

SEQ ID NO: 105200 - protein, 24 aa, Mycobacterium avium
TIFEVTEPIPADWTALPFGVPLPN

SEQ ID NO: 105201 - protein, 25 aa, Mycobacterium avium
TIGAGSFPWVLAITCPYRDAAERNA

SEQ ID NO: 105202 - protein, 17 aa, Mycobacterium avium
TIGLGVSQWKNFFIYAP

SEQ ID NO: 105203 - protein, 24 aa, Mycobacterium avium
TIKLDVRLSYALRIKDEGGLVVFR

SEQ ID NO: 105204 - protein, 24 aa, Mycobacterium avium
TIKSAVAFGALLSRGIGDTIRVSL

SEQ ID NO: 105205 - protein, 17 aa, Mycobacterium avium
TILPLQHPIVLAKALAT

SEQ ID NO: 105206 - protein, 26 aa, Mycobacterium avium
TIRDVPKHIAMDWLRKRFATVVYEPM

SEQ ID NO: 105207 - protein, 17 aa, Mycobacterium avium
TIREFLQSKGVKFEAQK

SEQ ID NO: 105208 - protein, 24 aa, Mycobacterium avium
TISGLKFKIRFLRVNQRHHSVAIA

SEQ ID NO: 105209 - protein, 20 aa, Mycobacterium avium
TISRRVREALAMADSDPIHP

SEQ ID NO: 105210 - protein, 18 aa, Mycobacterium avium
TITFAGFLKAYVETVDEL

SEQ ID NO: 105211 - protein, 23 aa, Mycobacterium avium
TITGWATSGGFCDKPNAYTVYFA

SEQ ID NO: 105212 - protein, 17 aa, Mycobacterium avium
TITRFCGQLFMEASDRE

SEQ ID NO: 105213 - protein, 25 aa, Mycobacterium avium
TITRLREHLTILGSVFHSGAVDFHG

SEQ ID NO: 105214 - protein, 24 aa, Mycobacterium avium
TIVCVQRFGPLIAEIPDTVRVIRQ

SEQ ID NO: 105215 - protein, 32 aa, Mycobacterium avium
TIWVEIGRGHTRNCRLHWVQIIPTIASESTPQ

SEQ ID NO: 105216 - protein, 20 aa, Mycobacterium avium
TKAALPVLHRQRAGHIVQIS

SEQ ID NO: 105217 - protein, 20 aa, Mycobacterium avium
TKADHFLVVTGIDTDTQIVH

SEQ ID NO: 105218 - protein, 30 aa, Mycobacterium avium
TKAFLPHLLKRPTAHITIVSSMASYAPVPG

SEQ ID NO: 105219 - protein, 18 aa, Mycobacterium avium
TKALPGDRVAILGVGGLG

SEQ ID NO: 105220 - protein, 26 aa, Mycobacterium avium
TKDQIVGLLLRLQRQLGLTYLFVSHD

SEQ ID NO: 105221 - protein, 21 aa, Mycobacterium avium
TKDVHIGPSDHVSWLDDRKWA

SEQ ID NO: 105222 - protein, 19 aa, Mycobacterium avium
TKDVHRAHRVAARLNAGTV

SEQ ID NO: 105223 - protein, 18 aa, Mycobacterium avium
TKERQCQFMPTIGSTVVP

SEQ ID NO: 105224 - protein, 19 aa, Mycobacterium avium
TKERYPVVHNDSARVYWPE

SEQ ID NO: 105225 - protein, 26 aa, Mycobacterium avium
TKGFKFSTYATWWIRQAITRGMADQS

SEQ ID NO: 105226 - protein, 23 aa, Mycobacterium avium
TKPGQRQILGIPLLTSPYVTTTN

SEQ ID NO: 105227 - protein, 23 aa, Mycobacterium avium
TKRLRAVDFTLGYEVRSVNADPE

SEQ ID NO: 105228 - protein, 18 aa, Mycobacterium avium
TKRPPSRRRAGGPGASDA

SEQ ID NO: 105229 - protein, 17 aa, Mycobacterium avium
TKRPYAVVLGGSKVSDK

SEQ ID NO: 105230 - protein, 25 aa, Mycobacterium avium
TKSGYPRVVKRWRRGTPLDEAQTVF

SEQ ID NO: 105231 - protein, 19 aa, Mycobacterium avium
TKTWEKFEVPDEGIGCGFT

SEQ ID NO: 105232 - protein, 21 aa, Mycobacterium avium
TKYPVALTVGALDWAQVVAGA

SEQ ID NO: 105233 - protein, 21 aa, Mycobacterium avium
TKYPVALTVGALEWEQVTSGA

SEQ ID NO: 105234 - protein, 22 aa, Mycobacterium avium
TKYPVSLDVAGLRWPQVAAGDP

SEQ ID NO: 105235 - protein, 23 aa, Mycobacterium avium
TLAAGLGRPELDVTRNFYTTSSC

SEQ ID NO: 105236 - protein, 17 aa, Mycobacterium avium
TLAALPMGIPANFAAPA

SEQ ID NO: 105237 - protein, 22 aa, Mycobacterium avium
TLACARMGWNVHDTEVISLVTA

SEQ ID NO: 105238 - protein, 19 aa, Mycobacterium avium
TLADLCCKVLLEIGPQPVL

SEQ ID NO: 105239 - protein, 24 aa, Mycobacterium avium
TLAERERVFSFARDEENMWLVTDP

SEQ ID NO: 105240 - protein, 20 aa, Mycobacterium avium
TLALLSNRPILVVGDLEQVR

SEQ ID NO: 105241 - protein, 23 aa, Mycobacterium avium
TLALPFTGGSWVLWERRDSCDSA

SEQ ID NO: 105242 - protein, 26 aa, Mycobacterium avium
TLARELVGVFVLQAWHTSGSATYLSV

SEQ ID NO: 105243 - protein, 18 aa, Mycobacterium avium
TLASLKWVLRNRAYTPWY

SEQ ID NO: 105244 - protein, 18 aa, Mycobacterium avium
TLATACGDQGDVVTILAY

SEQ ID NO: 105245 - protein, 18 aa, Mycobacterium avium
TLCVFDVEPGRGLLLTEL

SEQ ID NO: 105246 - protein, 32 aa, Mycobacterium avium
TLDALSGGRLRLCVGVGWLQEELRACGADFDN

SEQ ID NO: 105247 - protein, 19 aa, Mycobacterium avium
TLDIMSLDVVWTAEFAEAG

SEQ ID NO: 105248 - protein, 18 aa, Mycobacterium avium
TLFGRDSLLTAWMALPLD

SEQ ID NO: 105249 - protein, 23 aa, Mycobacterium avium
TLGAGWDGVVLFGEATTVIGARM

SEQ ID NO: 105250 - protein, 21 aa, Mycobacterium avium
TLGIPEVRFTAALTSGGGGSA

SEQ ID NO: 105251 - protein, 18 aa, Mycobacterium avium
TLGSGVGVRLFRPAGAAE

SEQ ID NO: 105252 - protein, 17 aa, Mycobacterium avium
TLHGVVVRRSYAAAHPE

SEQ ID NO: 105253 - protein, 24 aa, Mycobacterium avium
TLIPRARAKISMRVAPGGDAAAHL

SEQ ID NO: 105254 - protein, 20 aa, Mycobacterium avium
TLKSDPRCLALLEEQQAMLK

SEQ ID NO: 105255 - protein, 24 aa, Mycobacterium avium
TLLRECSEFLAPYVSAARLTGEVR

SEQ ID NO: 105256 - protein, 23 aa, Mycobacterium avium
TLLRSMCSPTPLSELQHRALEHG

SEQ ID NO: 105257 - protein, 23 aa, Mycobacterium avium
TLLRSMCSPTPLSELQRRALEHG

SEQ ID NO: 105258 - protein, 28 aa, Mycobacterium avium
TLNRPGVRNAIDIPLRIELAEVLEAADA

SEQ ID NO: 105259 - protein, 25 aa, Mycobacterium avium
TLPAPRISPFPAVFQDVSLVVAADV

SEQ ID NO: 105260 - protein, 22 aa, Mycobacterium avium
TLPERLPDAGLAWDATAAAWQR

SEQ ID NO: 105261 - protein, 18 aa, Mycobacterium avium
TLPLRPFKTMAVNVDGEL

SEQ ID NO: 105262 - protein, 19 aa, Mycobacterium avium
TLPVLRPLLGFDKQEILAE

SEQ ID NO: 105263 - protein, 25 aa, Mycobacterium avium
TLQDWADRGLRVIGLDAGGDTMLDD

SEQ ID NO: 105264 - protein, 25 aa, Mycobacterium avium
TLQHVEAALCFPLPKFSDIRYDYAL

SEQ ID NO: 105265 - protein, 18 aa, Mycobacterium avium
TLQSGRPAQISNLAKAFH

SEQ ID NO: 105266 - protein, 18 aa, Mycobacterium avium
TLRAHCYGLLRTIMGTAL

SEQ ID NO: 105267 - protein, 20 aa, Mycobacterium avium
TLRGYSAWVTGLRRSEAATR

SEQ ID NO: 105268 - protein, 25 aa, Mycobacterium avium
TLRISSQLLANWLRHGVITEEDVRA

SEQ ID NO: 105269 - protein, 22 aa, Mycobacterium avium
TLRRPAIAAVRADYDKVLRQRT

SEQ ID NO: 105270 - protein, 19 aa, Mycobacterium avium
TLRRRLRYAYPYSGRLGAL

SEQ ID NO: 105271 - protein, 24 aa, Mycobacterium avium
TLRRWQRPLAGYEIHHGRVSRCAE

SEQ ID NO: 105272 - protein, 39 aa, Mycobacterium avium
TLTAARALGRYGVCANAICPRARTAMTADVFGDAPEVPA

SEQ ID NO: 105273 - protein, 22 aa, Mycobacterium avium
TLTRLLPRGVLEPKKQNAADHI

SEQ ID NO: 105274 - protein, 25 aa, Mycobacterium avium
TMADPGSVSYLFSRKSVVTCEKNGL

SEQ ID NO: 105275 - protein, 18 aa, Mycobacterium avium
TMADRADWMFALVRTGSG

SEQ ID NO: 105276 - protein, 22 aa, Mycobacterium avium
TMCAYCGVGCGMVLQITTDPQT

SEQ ID NO: 105277 - protein, 28 aa, Mycobacterium avium
TMGVDFRPANYFGVTALNLVPGDGGRPL

SEQ ID NO: 105278 - protein, 26 aa, Mycobacterium avium
TMGVLDWQLVRRGSWSHDVGYALIGA

SEQ ID NO: 105279 - protein, 17 aa, Mycobacterium avium
TMPSTWLEALVKTYVGD

SEQ ID NO: 105280 - protein, 17 aa, Mycobacterium avium
TMQGHFTRSHVGGNNAV

SEQ ID NO: 105281 - protein, 29 aa, Mycobacterium avium
TMTLPSIRWSRWPLQRMALSRYADRQAVD

SEQ ID NO: 105282 - protein, 18 aa, Mycobacterium avium
TMWACKSAPLTAGSGFPP

SEQ ID NO: 105283 - protein, 19 aa, Mycobacterium avium
TMWACKSAPLTAGSGFPPI

SEQ ID NO: 105284 - protein, 17 aa, Mycobacterium avium
TMYVIAFCMGPLDAAEP

SEQ ID NO: 105285 - protein, 18 aa, Mycobacterium avium
TNAAAWRSLGRTWESAFT

SEQ ID NO: 105286 - protein, 21 aa, Mycobacterium avium
TNARIAVNLGAPILLTVSGKG

SEQ ID NO: 105287 - protein, 18 aa, Mycobacterium avium
TNARPAGVRSLRTLVRHR

SEQ ID NO: 105288 - protein, 19 aa, Mycobacterium avium
TNARPAGVRSLRTLVRHRA

SEQ ID NO: 105289 - protein, 22 aa, Mycobacterium avium
TNEYLDWRRQWDAANRARDGYS

SEQ ID NO: 105290 - protein, 30 aa, Mycobacterium avium
TNFDELCEIFARYDVTFSLGDGLRPGSIAD

SEQ ID NO: 105291 - protein, 19 aa, Mycobacterium avium
TNGALGLSRRCWATARPAS

SEQ ID NO: 105292 - protein, 17 aa, Mycobacterium avium
TNHLGHFALTGLLLALL

SEQ ID NO: 105293 - protein, 17 aa, Mycobacterium avium
TNHLGHFALTGLLLDHL

SEQ ID NO: 105294 - protein, 17 aa, Mycobacterium avium
TNHLGHFALTGRLLALL

SEQ ID NO: 105295 - protein, 23 aa, Mycobacterium avium
TNHPLMISMEFKEGLHGFTDARA

SEQ ID NO: 105296 - protein, 20 aa, Mycobacterium avium
TNIAMPDWMRPAATNYTGAQ

SEQ ID NO: 105297 - protein, 17 aa, Mycobacterium avium
TNIQSKEGFFWRATLWA

SEQ ID NO: 105298 - protein, 19 aa, Mycobacterium avium
TNIRPQVDLWTFPDTGKSI

SEQ ID NO: 105299 - protein, 18 aa, Mycobacterium avium
TNRPNRRIVIMPSDDEPK

SEQ ID NO: 105300 - protein, 19 aa, Mycobacterium avium
TNRPNRRIVIMPSDDEPKE

SEQ ID NO: 105301 - protein, 23 aa, Mycobacterium avium
TNSYYDDMAWLALALERAARIAG

SEQ ID NO: 105302 - protein, 18 aa, Mycobacterium avium
TNTLCAIMGGDAIFDALK

SEQ ID NO: 105303 - protein, 18 aa, Mycobacterium avium
TNYRIGFVPQGIGADLIA

SEQ ID NO: 105304 - protein, 18 aa, Mycobacterium avium
TPAAAPWMKVSEAVDYLR

SEQ ID NO: 105305 - protein, 23 aa, Mycobacterium avium
TPAEFVTPGWFASFIPVTFPVAG

SEQ ID NO: 105306 - protein, 18 aa, Mycobacterium avium
TPAGSGWLHQRRFPHRFR

SEQ ID NO: 105307 - protein, 18 aa, Mycobacterium avium
TPALMLAVGPGFGSELVL

SEQ ID NO: 105308 - protein, 17 aa, Mycobacterium avium
TPALWKALSGAGVFGLA

SEQ ID NO: 105309 - protein, 20 aa, Mycobacterium avium
TPCGSARSWATSPIATARSL

SEQ ID NO: 105310 - protein, 22 aa, Mycobacterium avium
TPDELLATIVYYTAKLAADFDA

SEQ ID NO: 105311 - protein, 17 aa, Mycobacterium avium
TPDKHRLGGNAIYSTSI

SEQ ID NO: 105312 - protein, 20 aa, Mycobacterium avium
TPDTLEWGCFTYGIVQHADY

SEQ ID NO: 105313 - protein, 23 aa, Mycobacterium avium
TPEARELVRLAADVADKVLDPIV

SEQ ID NO: 105314 - protein, 19 aa, Mycobacterium avium
TPEVGRFDDFFALGGDSIL

SEQ ID NO: 105315 - protein, 22 aa, Mycobacterium avium
TPEVRGDLAAFYGAISTADAAV

SEQ ID NO: 105316 - protein, 33 aa, Mycobacterium avium
TPFPTMYELFSVGWGRPDLRSQWEHGSPQVRAR

SEQ ID NO: 105317 - protein, 25 aa, Mycobacterium avium
TPFSHAGYMFKLWDQLVWGSTLVVP

SEQ ID NO: 105318 - protein, 19 aa, Mycobacterium avium
TPGADRLRSFLGPEGSAFM

SEQ ID NO: 105319 - protein, 21 aa, Mycobacterium avium
TPGCFADVCDLLASGKNVVAT

SEQ ID NO: 105320 - protein, 22 aa, Mycobacterium avium
TPGKMYSRFGGYLDQIDEFEPE

SEQ ID NO: 105321 - protein, 17 aa, Mycobacterium avium
TPHPTVWMGGDADAVLR

SEQ ID NO: 105322 - protein, 18 aa, Mycobacterium avium
TPHRGFYRVAAITPGHAV

SEQ ID NO: 105323 - protein, 24 aa, Mycobacterium avium
TPISVLQPYGGYILPNSTINDLNI

SEQ ID NO: 105324 - protein, 26 aa, Mycobacterium avium
TPLDRSRPLWEFHFVEGMADNRFAII

SEQ ID NO: 105325 - protein, 17 aa, Mycobacterium avium
TPLFEFAIRSALAELDL

SEQ ID NO: 105326 - protein, 22 aa, Mycobacterium avium
TPLGGSHFARWLTVWNGTVDEM

SEQ ID NO: 105327 - protein, 19 aa, Mycobacterium avium
TPLNFRLAYIADLEATFTP

SEQ ID NO: 105328 - protein, 25 aa, Mycobacterium avium
TPLPARLILRLLKFDESRHMDWVHW

SEQ ID NO: 105329 - protein, 23 aa, Mycobacterium avium
TPLPARLILRLLNFDESRFMDWV

SEQ ID NO: 105330 - protein, 18 aa, Mycobacterium avium
TPLYGMSSILGIAQTAQG

SEQ ID NO: 105331 - protein, 18 aa, Mycobacterium avium
TPNVCPALHMPLQSGSDR

SEQ ID NO: 105332 - protein, 18 aa, Mycobacterium avium
TPPAEARALIARRRELRA

SEQ ID NO: 105333 - protein, 17 aa, Mycobacterium avium
TPPAVLTSLRLHRSGNP

SEQ ID NO: 105334 - protein, 17 aa, Mycobacterium avium
TPPTAGIPHSGEPSAPS

SEQ ID NO: 105335 - protein, 22 aa, Mycobacterium avium
TPQELAKFFILLIGAGNETTRN

SEQ ID NO: 105336 - protein, 17 aa, Mycobacterium avium
TPRERLLAVFATPPAFT

SEQ ID NO: 105337 - protein, 20 aa, Mycobacterium avium
TPRILRPGPVSAQRIAAVLG

SEQ ID NO: 105338 - protein, 19 aa, Mycobacterium avium
TPRVHWPRGTVGLDSLHLT

SEQ ID NO: 105339 - protein, 21 aa, Mycobacterium avium
TPRVLPWQECPGAVASASRIT

SEQ ID NO: 105340 - protein, 24 aa, Mycobacterium avium
TPRWGTPASCIRRWSNAPACPGAP

SEQ ID NO: 105341 - protein, 18 aa, Mycobacterium avium
TPSDLPPWHQAQLALAES

SEQ ID NO: 105342 - protein, 25 aa, Mycobacterium avium
TPSFITNWNEFWSVVTGVYSPQSWS

SEQ ID NO: 105343 - protein, 20 aa, Mycobacterium avium
TPSKGAWQFIEPTFAAYHQR

SEQ ID NO: 105344 - protein, 22 aa, Mycobacterium avium
TPSQRADAMWKRFRGIRRRYVL

SEQ ID NO: 105345 - protein, 18 aa, Mycobacterium avium
TPTTPCGSARSWATSPIA

SEQ ID NO: 105346 - protein, 18 aa, Mycobacterium avium
TPVAISLFRGPQYVVAIL

SEQ ID NO: 105347 - protein, 17 aa, Mycobacterium avium
TPYRKGNTLAIALGHGK

SEQ ID NO: 105348 - protein, 28 aa, Mycobacterium avium
TQGRGAWPVCGGPLSGPTPRDVPAPAGL

SEQ ID NO: 105349 - protein, 20 aa, Mycobacterium avium
TQHWRVASRLGVPGDDLLGV

SEQ ID NO: 105350 - protein, 22 aa, Mycobacterium avium
TQHWRVASRLGVPGDDLLGVRD

SEQ ID NO: 105351 - protein, 19 aa, Mycobacterium avium
TQMPVSLHFGSGSFVPGFS

SEQ ID NO: 105352 - protein, 23 aa, Mycobacterium avium
TQPSFDITTLFNGLQPVLATLSP

SEQ ID NO: 105353 - protein, 18 aa, Mycobacterium avium
TQRARPLIESMIAAHRII

SEQ ID NO: 105354 - protein, 18 aa, Mycobacterium avium
TQRFGLGRDDVCYVSMPL

SEQ ID NO: 105355 - protein, 18 aa, Mycobacterium avium
TQTFFPWDSWEHPDPAMP

SEQ ID NO: 105356 - protein, 17 aa, Mycobacterium avium
TQVESMILPPIAHDVRV

SEQ ID NO: 105357 - protein, 22 aa, Mycobacterium avium
TRADGAISLGLVVNGLDCSGVP

SEQ ID NO: 105358 - protein, 28 aa, Mycobacterium avium
TRAFDVAKGLPWPARFPSRVLANDFVER

SEQ ID NO: 105359 - protein, 19 aa, Mycobacterium avium
TRAGYGAAVHAGVLAATTP

SEQ ID NO: 105360 - protein, 18 aa, Mycobacterium avium
TRAPALLQNFGRILEERR

SEQ ID NO: 105361 - protein, 37 aa, Mycobacterium avium
TRAQLERWVHEWRIPRVKIKIGESWGSHERRDLDRIA

SEQ ID NO: 105362 - protein, 23 aa, Mycobacterium avium
TRARAGWLWSRRRGVIAGRRLPP

SEQ ID NO: 105363 - protein, 17 aa, Mycobacterium avium
TRARLAARVDAVVAKAD

SEQ ID NO: 105364 - protein, 19 aa, Mycobacterium avium
TRARSALAAGRPAASSAGA

SEQ ID NO: 105365 - protein, 17 aa, Mycobacterium avium
TRAVAAWLWSGRTATLA

SEQ ID NO: 105366 - protein, 19 aa, Mycobacterium avium
TRAVLRGGESYRLFGNRGT

SEQ ID NO: 105367 - protein, 17 aa, Mycobacterium avium
TRAWLRDPAPLFRTNVE

SEQ ID NO: 105368 - protein, 25 aa, Mycobacterium avium
TRAYRLTWPAGTVVYEIDQPQVIAF

SEQ ID NO: 105369 - protein, 19 aa, Mycobacterium avium
TRCTGCRSSTSTGCGWTRW

SEQ ID NO: 105370 - protein, 18 aa, Mycobacterium avium
TRDELSCLHRAARITEEA

SEQ ID NO: 105371 - protein, 22 aa, Mycobacterium avium
TRDEVRAALAAGDWSSDSESKL

SEQ ID NO: 105372 - protein, 23 aa, Mycobacterium avium
TRDEVRAALAAGDWSSDSESKLL

SEQ ID NO: 105373 - protein, 19 aa, Mycobacterium avium
TRDGQRRWQPFTDWPDPWV

SEQ ID NO: 105374 - protein, 21 aa, Mycobacterium avium
TRDGRFIAFVLLQADRFWADF

SEQ ID NO: 105375 - protein, 21 aa, Mycobacterium avium
TRDTLGFSVLRVVRDNPTSII

SEQ ID NO: 105376 - protein, 21 aa, Mycobacterium avium
TREQLGWIALNARRNAGLNPD

SEQ ID NO: 105377 - protein, 17 aa, Mycobacterium avium
TRFGRHYRKALRRTAEL

SEQ ID NO: 105378 - protein, 30 aa, Mycobacterium avium
TRFVACPFGGPGARMYRTGDLVRWGADGQL

SEQ ID NO: 105379 - protein, 21 aa, Mycobacterium avium
TRGIITWGIRDARRIADWNPR

SEQ ID NO: 105380 - protein, 25 aa, Mycobacterium avium
TRGIYCGTIGWASPVAGCELNVAIR

SEQ ID NO: 105381 - protein, 26 aa, Mycobacterium avium
TRHGDSWLLNGFKWFASNCAGEAFVV

SEQ ID NO: 105382 - protein, 21 aa, Mycobacterium avium
TRIAEVWVSVLGLPSTEALSP

SEQ ID NO: 105383 - protein, 26 aa, Mycobacterium avium
TRIATCWRAGAHYVLRDTDGRPITFE

SEQ ID NO: 105384 - protein, 17 aa, Mycobacterium avium
TRIDIGSAFDHLDEPHV

SEQ ID NO: 105385 - protein, 20 aa, Mycobacterium avium
TRIRRCYALPPAPVSRLPAT

SEQ ID NO: 105386 - protein, 18 aa, Mycobacterium avium
TRLAAALFDASPTVHGHV

SEQ ID NO: 105387 - protein, 17 aa, Mycobacterium avium
TRLDPRFGSDSSARHRS

SEQ ID NO: 105388 - protein, 19 aa, Mycobacterium avium
TRLERGAGIPAVERLAISP

SEQ ID NO: 105389 - protein, 21 aa, Mycobacterium avium
TRLGPLPPLRMHPGEAPILDH

SEQ ID NO: 105390 - protein, 24 aa, Mycobacterium avium
TRLKSELDILLGLGAAHGEQALID

SEQ ID NO: 105391 - protein, 17 aa, Mycobacterium avium
TRLLGPLTRTRELLRRP

SEQ ID NO: 105392 - protein, 22 aa, Mycobacterium avium
TRLPTERVYADYGFELPDNEIL

SEQ ID NO: 105393 - protein, 22 aa, Mycobacterium avium
TRLRREGLRPGDADWEALGICD

SEQ ID NO: 105394 - protein, 19 aa, Mycobacterium avium
TRLTDLFGIEQPILLAPMA

SEQ ID NO: 105395 - protein, 20 aa, Mycobacterium avium
TRMRCAHVLTDDAGYLYTRY

SEQ ID NO: 105396 - protein, 17 aa, Mycobacterium avium
TRMRVPRSLMASIGTEE

SEQ ID NO: 105397 - protein, 18 aa, Mycobacterium avium
TRNAQAYAVLNGVFNTAV

SEQ ID NO: 105398 - protein, 19 aa, Mycobacterium avium
TRNEGQWALGDREPLNDTE

SEQ ID NO: 105399 - protein, 21 aa, Mycobacterium avium
TRNTACCWRPHGRQWNTPVSP

SEQ ID NO: 105400 - protein, 17 aa, Mycobacterium avium
TRPAPRLQNAASQADQR

SEQ ID NO: 105401 - protein, 21 aa, Mycobacterium avium
TRPDAASGRRGKPEPSPVARE

SEQ ID NO: 105402 - protein, 21 aa, Mycobacterium avium
TRPEPRLENGASRVVQQFLAK

SEQ ID NO: 105403 - protein, 23 aa, Mycobacterium avium
TRPEPRLENGASRVVQQFLAKFA

SEQ ID NO: 105404 - protein, 34 aa, Mycobacterium avium
TRPGDTWLADRSWNRPGWTVAELEAAKGGRTISV

SEQ ID NO: 105405 - protein, 19 aa, Mycobacterium avium
TRPGGNWMRIDGEHPTLTV

SEQ ID NO: 105406 - protein, 21 aa, Mycobacterium avium
TRPGQYEAPLGITLRELLDYA

SEQ ID NO: 105407 - protein, 21 aa, Mycobacterium avium
TRPQGKFVIRDDAPYHVFVGE

SEQ ID NO: 105408 - protein, 17 aa, Mycobacterium avium
TRREAFAEIALSTRTNA

SEQ ID NO: 105409 - protein, 19 aa, Mycobacterium avium
TRRELPKRRPVPLRLRDWR

SEQ ID NO: 105410 - protein, 21 aa, Mycobacterium avium
TRRPDYAWPPSSWPNQGPAYV

SEQ ID NO: 105411 - protein, 29 aa, Mycobacterium avium
TRRRPRSVIDPGYRYEFIEGDDEVVAVAS

SEQ ID NO: 105412 - protein, 20 aa, Mycobacterium avium
TRRSPCLAINRAAWNALGAF

SEQ ID NO: 105413 - protein, 20 aa, Mycobacterium avium
TRSGALPVAKGVFSVLNSDQ

SEQ ID NO: 105414 - protein, 17 aa, Mycobacterium avium
TRSGYGFAQLARDMGAV

SEQ ID NO: 105415 - protein, 24 aa, Mycobacterium avium
TRSLDFYATFPFPKPTLSKWLRGD

SEQ ID NO: 105416 - protein, 21 aa, Mycobacterium avium
TRSPIALSVTLAAVRRAADLP

SEQ ID NO: 105417 - protein, 17 aa, Mycobacterium avium
TRSRPVEWCKSGRVSAC

SEQ ID NO: 105418 - protein, 23 aa, Mycobacterium avium
TRSTFGYRWRAAVKEAKLPHGTG

SEQ ID NO: 105419 - protein, 24 aa, Mycobacterium avium
TRTDTSTYCPFKGEASYYSVTTSA

SEQ ID NO: 105420 - protein, 21 aa, Mycobacterium avium
TRTGDLWLFRGGSGPDRAIQT

SEQ ID NO: 105421 - protein, 17 aa, Mycobacterium avium
TRVALALGSGGARGYAH

SEQ ID NO: 105422 - protein, 18 aa, Mycobacterium avium
TRVGRFGLEQAYGLDELA

SEQ ID NO: 105423 - protein, 19 aa, Mycobacterium avium
TRVGRFGLEQAYGLDELAE

SEQ ID NO: 105424 - protein, 25 aa, Mycobacterium avium
TRVRSEALRQLSLTPGHEHDTASAI

SEQ ID NO: 105425 - protein, 23 aa, Mycobacterium avium
TRYDIPTGPGVRLDSGVEAGSVI

SEQ ID NO: 105426 - protein, 19 aa, Mycobacterium avium
TRYFVPRFAAVPITRDTEQ

SEQ ID NO: 105427 - protein, 19 aa, Mycobacterium avium
TRYPRAWQRMRLVLEETLG

SEQ ID NO: 105428 - protein, 30 aa, Mycobacterium avium
TSACFPFSAWTGATARRRARNCWPSGWPAG

SEQ ID NO: 105429 - protein, 30 aa, Mycobacterium avium
TSALLVPVAVEWTRYYAGWADKISSEVTAS

SEQ ID NO: 105430 - protein, 17 aa, Mycobacterium avium
TSAPYGALAVRDRHANL

SEQ ID NO: 105431 - protein, 24 aa, Mycobacterium avium
TSARLHAVAMEWRRERETAERERQ

SEQ ID NO: 105432 - protein, 27 aa, Mycobacterium avium
TSASAALIWRRPRWAKRLQPEPIADLL

SEQ ID NO: 105433 - protein, 18 aa, Mycobacterium avium
TSDIAVIRVQGMSGLTPI

SEQ ID NO: 105434 - protein, 19 aa, Mycobacterium avium
TSEHYLGFGDRTVVLLYAS

SEQ ID NO: 105435 - protein, 26 aa, Mycobacterium avium
TSEWPWRPRHLVVTLGSHGARYVGAD

SEQ ID NO: 105436 - protein, 18 aa, Mycobacterium avium
TSFADLMAVHIAQDGPAT

SEQ ID NO: 105437 - protein, 22 aa, Mycobacterium avium
TSGAEFADYIWLAARTDPTVKK

SEQ ID NO: 105438 - protein, 25 aa, Mycobacterium avium
TSHKEVLLHLSAEGWVQWSNTVSDK

SEQ ID NO: 105439 - protein, 21 aa, Mycobacterium avium
TSILQRRVVFRADRAAVQEIA

SEQ ID NO: 105440 - protein, 18 aa, Mycobacterium avium
TSIPAMFAAQVARTPHAV

SEQ ID NO: 105441 - protein, 18 aa, Mycobacterium avium
TSIRRAGADIVLSYWAAD

SEQ ID NO: 105442 - protein, 19 aa, Mycobacterium avium
TSIRRAGADIVLSYWAADA

SEQ ID NO: 105443 - protein, 27 aa, Mycobacterium avium
TSLGFGRPRLKTSLLSAADIKAIPFVI

SEQ ID NO: 105444 - protein, 19 aa, Mycobacterium avium
TSLMRRVRHRMDQAGYTAF

SEQ ID NO: 105445 - protein, 17 aa, Mycobacterium avium
TSPEATGLLVALRALAD

SEQ ID NO: 105446 - protein, 17 aa, Mycobacterium avium
TSQGHAPNAWAVLGAVA

SEQ ID NO: 105447 - protein, 18 aa, Mycobacterium avium
TSRLRLTARASLDDAELE

SEQ ID NO: 105448 - protein, 17 aa, Mycobacterium avium
TSRRAPDAAAWRAIDDI

SEQ ID NO: 105449 - protein, 23 aa, Mycobacterium avium
TSSDTYAGFSLRPRPRPNSNDCK

SEQ ID NO: 105450 - protein, 25 aa, Mycobacterium avium
TSSKNESRWQFGVLGPPGAADAGIG

SEQ ID NO: 105451 - protein, 20 aa, Mycobacterium avium
TSTEADWDAVIAVHLKGTFA

SEQ ID NO: 105452 - protein, 25 aa, Mycobacterium avium
TSTECPPGTVGEIWVHGENVSAGYW

SEQ ID NO: 105453 - protein, 25 aa, Mycobacterium avium
TSTTLRCIRSWVLDVRHATNGPVPI

SEQ ID NO: 105454 - protein, 17 aa, Mycobacterium avium
TSVLVAPNFAIGAVLSM

SEQ ID NO: 105455 - protein, 27 aa, Mycobacterium avium
TSYRGSVREACLWSAGLAAAGVRRRAT

SEQ ID NO: 105456 - protein, 23 aa, Mycobacterium avium
TSYYYRTRAALLQGVGKRVAEID

SEQ ID NO: 105457 - protein, 23 aa, Mycobacterium avium
TTAGQRWNWSGGRDGEVLVEIET

SEQ ID NO: 105458 - protein, 23 aa, Mycobacterium avium
TTARVTHRLSRPANFVADSLVSR

SEQ ID NO: 105459 - protein, 20 aa, Mycobacterium avium
TTAWLHKPMFTLRGGTNEVL

SEQ ID NO: 105460 - protein, 21 aa, Mycobacterium avium
TTDAFTRDELLAGNKTALMLH

SEQ ID NO: 105461 - protein, 21 aa, Mycobacterium avium
TTDALVAWLPDSRVLFTGNLF

SEQ ID NO: 105462 - protein, 29 aa, Mycobacterium avium
TTEAEYAEMWARDAAAMYGYAGAAAAATR

SEQ ID NO: 105463 - protein, 25 aa, Mycobacterium avium
TTFAQARSRFDAAWNHQDGDHPIND

SEQ ID NO: 105464 - protein, 17 aa, Mycobacterium avium
TTFYGLNAFLFTNSAGA

SEQ ID NO: 105465 - protein, 25 aa, Mycobacterium avium
TTGETIEAVSLWTGFDGDASAVCMF

SEQ ID NO: 105466 - protein, 21 aa, Mycobacterium avium
TTGTGVCAICYGRSMATGKLV

SEQ ID NO: 105467 - protein, 25 aa, Mycobacterium avium
TTKDGDWTIVQGLEIDEFSRSRIDK

SEQ ID NO: 105468 - protein, 17 aa, Mycobacterium avium
TTLADWNRTLAVNLTGT

SEQ ID NO: 105469 - protein, 19 aa, Mycobacterium avium
TTLHEILELVAPQSGSIEV

SEQ ID NO: 105470 - protein, 19 aa, Mycobacterium avium
TTLPGGFAIAARKTYGRNS

SEQ ID NO: 105471 - protein, 19 aa, Mycobacterium avium
TTLPGGFAITARKTYGRNS

SEQ ID NO: 105472 - protein, 18 aa, Mycobacterium avium
TTMCGCPPTPCSASPGRA

SEQ ID NO: 105473 - protein, 26 aa, Mycobacterium avium
TTMNTRGRLAVSFARRPERFTDGLYK

SEQ ID NO: 105474 - protein, 17 aa, Mycobacterium avium
TTPARYVEMVRIDAARA

SEQ ID NO: 105475 - protein, 18 aa, Mycobacterium avium
TTPARYVEMVRIDAARAA

SEQ ID NO: 105476 - protein, 19 aa, Mycobacterium avium
TTPDEVVWCDGSDDEWRRL

SEQ ID NO: 105477 - protein, 19 aa, Mycobacterium avium
TTRGMAVAACRDAIADAGL

SEQ ID NO: 105478 - protein, 33 aa, Mycobacterium avium
TTRSPAGVVRLDYEVPLLLSALSPRMLRIAGHF

SEQ ID NO: 105479 - protein, 33 aa, Mycobacterium avium
TTRSPAGVVRLDYEVPLLLSALSPRMLRIAGRF

SEQ ID NO: 105480 - protein, 25 aa, Mycobacterium avium
TTRSVLPGGLNWPLDLAVGHDGRLY

SEQ ID NO: 105481 - protein, 18 aa, Mycobacterium avium
TTSFYFRTRSALLRAAAE

SEQ ID NO: 105482 - protein, 28 aa, Mycobacterium avium
TTTGGELWCADVVVAAYRPAQVPWLPDI

SEQ ID NO: 105483 - protein, 20 aa, Mycobacterium avium
TTTRLIGWAGKTLADYPDQR

SEQ ID NO: 105484 - protein, 20 aa, Mycobacterium avium
TTTRLIGWTGKVLAEHPDQR

SEQ ID NO: 105485 - protein, 17 aa, Mycobacterium avium
TTVGWKGLINDPAMDGS

SEQ ID NO: 105486 - protein, 26 aa, Mycobacterium avium
TTVSKLSVPPSWAGATPGGRFQQRAA

SEQ ID NO: 105487 - protein, 19 aa, Mycobacterium avium
TVAAVPLMLEHSGGGNIIN

SEQ ID NO: 105488 - protein, 18 aa, Mycobacterium avium
TVADLSWVRERGLADAIT

SEQ ID NO: 105489 - protein, 18 aa, Mycobacterium avium
TVAKRGAAIIDARGASSA

SEQ ID NO: 105490 - protein, 17 aa, Mycobacterium avium
TVAPMRILTGIEVDILE

SEQ ID NO: 105491 - protein, 17 aa, Mycobacterium avium
TVARFLALVTEFRGGRA

SEQ ID NO: 105492 - protein, 28 aa, Mycobacterium avium
TVASGPSMVRWARENGWSAPPGAGARDL

SEQ ID NO: 105493 - protein, 24 aa, Mycobacterium avium
TVCGGTLICRWHGLPLDGRAREFG

SEQ ID NO: 105494 - protein, 29 aa, Mycobacterium avium
TVDGVDALHRWLVAWADIYDAHAAVFAEF

SEQ ID NO: 105495 - protein, 17 aa, Mycobacterium avium
TVDLPRPTELEPLRVHT

SEQ ID NO: 105496 - protein, 23 aa, Mycobacterium avium
TVELRLPLRETFAGKAKGHGRHV

SEQ ID NO: 105497 - protein, 19 aa, Mycobacterium avium
TVENWNRYVVAGVDPDFGR

SEQ ID NO: 105498 - protein, 17 aa, Mycobacterium avium
TVFKSMLTAVLERMPDY

SEQ ID NO: 105499 - protein, 25 aa, Mycobacterium avium
TVGKSFKHRWLPALPHHRYKPVSGP

SEQ ID NO: 105500 - protein, 17 aa, Mycobacterium avium
TVGWFTAKYPVALRLGG

SEQ ID NO: 105501 - protein, 22 aa, Mycobacterium avium
TVHGESSYFVWLNRGKESLTVD

SEQ ID NO: 105502 - protein, 21 aa, Mycobacterium avium
TVHLAKLVLRNMTRRNTGKVL

SEQ ID NO: 105503 - protein, 19 aa, Mycobacterium avium
TVIDVLRGKLEFESGEEGR

SEQ ID NO: 105504 - protein, 20 aa, Mycobacterium avium
TVIGCSLVRGTPYRYIGETL

SEQ ID NO: 105505 - protein, 18 aa, Mycobacterium avium
TVIKANWQRAAKLLGDAR

SEQ ID NO: 105506 - protein, 22 aa, Mycobacterium avium
TVKAGLELLDFKVGDPRAPLLP

SEQ ID NO: 105507 - protein, 17 aa, Mycobacterium avium
TVKRLEAAVQRSVVISA

SEQ ID NO: 105508 - protein, 18 aa, Mycobacterium avium
TVLGKRAGSAELRHRVGY

SEQ ID NO: 105509 - protein, 17 aa, Mycobacterium avium
TVPIPAIVSEELATFRT

SEQ ID NO: 105510 - protein, 29 aa, Mycobacterium avium
TVPNFLPLLAERWARQRLTALARVEGKVT

SEQ ID NO: 105511 - protein, 21 aa, Mycobacterium avium
TVPPGAVPTPSGWEVTTHGGR

SEQ ID NO: 105512 - protein, 18 aa, Mycobacterium avium
TVPPLLGALPLAYTAPQG

SEQ ID NO: 105513 - protein, 19 aa, Mycobacterium avium
TVPVCVGYRIDGARINEMP

SEQ ID NO: 105514 - protein, 31 aa, Mycobacterium avium
TVPYRANLWALRKLGVRRVLAPCAVGSLVPE

SEQ ID NO: 105515 - protein, 25 aa, Mycobacterium avium
TVQRWKAIRGEAGWMTTYAYPPQAI

SEQ ID NO: 105516 - protein, 20 aa, Mycobacterium avium
TVREALRLGHNYVGTEHQLL

SEQ ID NO: 105517 - protein, 21 aa, Mycobacterium avium
TVREALRLGHNYVGTEHQLLA

SEQ ID NO: 105518 - protein, 24 aa, Mycobacterium avium
TVRPEVLHAWHLLQRSRGLMPVTA

SEQ ID NO: 105519 - protein, 20 aa, Mycobacterium avium
TVRPSFAFYNTFEEIDVFLR

SEQ ID NO: 105520 - protein, 17 aa, Mycobacterium avium
TVRRAAPFATLPRSIYE

SEQ ID NO: 105521 - protein, 26 aa, Mycobacterium avium
TVSARPSDSVAIALRVGVPIYVEEAV

SEQ ID NO: 105522 - protein, 17 aa, Mycobacterium avium
TVSPLGFVAEGRSLIGS

SEQ ID NO: 105523 - protein, 25 aa, Mycobacterium avium
TVSVFGDSIGWTWMHYLPPTPGFAF

SEQ ID NO: 105524 - protein, 24 aa, Mycobacterium avium
TVTFSDDYLPAWMYRTQESGHRDG

SEQ ID NO: 105525 - protein, 19 aa, Mycobacterium avium
TVTGIGLRGTFFCMRAEIA

SEQ ID NO: 105526 - protein, 17 aa, Mycobacterium avium
TVVDLGWTELAAANTGD

SEQ ID NO: 105527 - protein, 17 aa, Mycobacterium avium
TVVDRLTGRYAMAVLGA

SEQ ID NO: 105528 - protein, 17 aa, Mycobacterium avium
TVVDRLTGRYAMAVLGT

SEQ ID NO: 105529 - protein, 18 aa, Mycobacterium avium
TVVMSMPMSGLRNPFTGA

SEQ ID NO: 105530 - protein, 20 aa, Mycobacterium avium
TWDLGEGWAKHVTVEVALGT

SEQ ID NO: 105531 - protein, 18 aa, Mycobacterium avium
TWFERLAAAGVRARAVLP

SEQ ID NO: 105532 - protein, 25 aa, Mycobacterium avium
TWGMECPDCLYTRAVLRGGESYRLF

SEQ ID NO: 105533 - protein, 18 aa, Mycobacterium avium
TWGNQFISSGFPINLLDV

SEQ ID NO: 105534 - protein, 23 aa, Mycobacterium avium
TWRSATCRVLAAATGSRTANAGP

SEQ ID NO: 105535 - protein, 19 aa, Mycobacterium avium
TWRSCPWPEVHGMAESIAV

SEQ ID NO: 105536 - protein, 24 aa, Mycobacterium avium
TWSAKVGFGRRWSDGVDQPGETKN

SEQ ID NO: 105537 - protein, 18 aa, Mycobacterium avium
TYCKARVNHRVVSQAVVI

SEQ ID NO: 105538 - protein, 23 aa, Mycobacterium avium
TYDRSQIGIGIAHFGVEGFHRAH

SEQ ID NO: 105539 - protein, 25 aa, Mycobacterium avium
TYDVGARLAGAWVLRADSLTQVGPQ

SEQ ID NO: 105540 - protein, 18 aa, Mycobacterium avium
TYLLSGMLRCGRCGNRLF

SEQ ID NO: 105541 - protein, 19 aa, Mycobacterium avium
TYPASVVPTTFVFEAFVHI

SEQ ID NO: 105542 - protein, 25 aa, Mycobacterium avium
TYRIVSVFFCCGHARTSSDSEYVAE

SEQ ID NO: 105543 - protein, 25 aa, Mycobacterium avium
VAAARAAFDAGPWSRGAPSHRIAAI

SEQ ID NO: 105544 - protein, 24 aa, Mycobacterium avium
VAAARAAFDAGTWSRGGPSHRIAA

SEQ ID NO: 105545 - protein, 25 aa, Mycobacterium avium
VAAAVAALRRPAGRRARRRGRDGRR

SEQ ID NO: 105546 - protein, 20 aa, Mycobacterium avium
VAADGRPLVAPIWFVVDDGE

SEQ ID NO: 105547 - protein, 33 aa, Mycobacterium avium
VAAERPAVVPLSFAQSRLWFIGQLHGPSPVHNM

SEQ ID NO: 105548 - protein, 34 aa, Mycobacterium avium
VAAERPAVVPLSFAQSRLWFIGQLHGPSPVYNMV

SEQ ID NO: 105549 - protein, 19 aa, Mycobacterium avium
VAAFLEHRAPRFTARLSSE

SEQ ID NO: 105550 - protein, 25 aa, Mycobacterium avium
VAAIVPWNMPQFLIVTKLIPALLAG

SEQ ID NO: 105551 - protein, 17 aa, Mycobacterium avium
VAALAYEPVPEWITGMA

SEQ ID NO: 105552 - protein, 17 aa, Mycobacterium avium
VAALCDRRRGLGADGVL

SEQ ID NO: 105553 - protein, 17 aa, Mycobacterium avium
VAALGCTVLMEIGPQPV

SEQ ID NO: 105554 - protein, 26 aa, Mycobacterium avium
VAANRARLAAALGLKPERVVWMNQVH

SEQ ID NO: 105555 - protein, 25 aa, Mycobacterium avium
VAANRARLAMLLATNFFGINYPAIA

SEQ ID NO: 105556 - protein, 17 aa, Mycobacterium avium
VAAPERLEPPAGSRSSG

SEQ ID NO: 105557 - protein, 19 aa, Mycobacterium avium
VAARFVPNPAAAALEAQVY

SEQ ID NO: 105558 - protein, 22 aa, Mycobacterium avium
VAARFVPNPAAAALEAQVYPSP

SEQ ID NO: 105559 - protein, 26 aa, Mycobacterium avium
VAAVADRLAGSGARVHRLAVSHAFHS

SEQ ID NO: 105560 - protein, 24 aa, Mycobacterium avium
VAAVFPIQVFLTLFGLPLDMRDQF

SEQ ID NO: 105561 - protein, 18 aa, Mycobacterium avium
VAAVPLMLEHSGGGNIIK

SEQ ID NO: 105562 - protein, 18 aa, Mycobacterium avium
VAAVPLMLEHSGGGNIIN

SEQ ID NO: 105563 - protein, 20 aa, Mycobacterium avium
VAAWIDGRLDLAFDDRIGND

SEQ ID NO: 105564 - protein, 25 aa, Mycobacterium avium
VAAWRLLLAEGIEGRCRIIGPIDDY

SEQ ID NO: 105565 - protein, 17 aa, Mycobacterium avium
VACGIALGAGVAAVARR

SEQ ID NO: 105566 - protein, 28 aa, Mycobacterium avium
VACGYWRRGGLTASRFVACPFGAPGARM

SEQ ID NO: 105567 - protein, 37 aa, Mycobacterium avium
VACGYWRRGGLTASRFVACPFGRPGARMYRTGDLVRW

SEQ ID NO: 105568 - protein, 24 aa, Mycobacterium avium
VACTPYKGALRVSGALELRRHHQP

SEQ ID NO: 105569 - protein, 24 aa, Mycobacterium avium
VADFRGASVTIDWPAQLQQQISRL

SEQ ID NO: 105570 - protein, 22 aa, Mycobacterium avium
VADICGALDKLAARGGVDVPVH

SEQ ID NO: 105571 - protein, 23 aa, Mycobacterium avium
VADICGALDKLAARGGVDVPVHV

SEQ ID NO: 105572 - protein, 24 aa, Mycobacterium avium
VADLGRLTLYLSTRDCYATNSTFI

SEQ ID NO: 105573 - protein, 19 aa, Mycobacterium avium
VADRQRLATQLGYSETVFV

SEQ ID NO: 105574 - protein, 34 aa, Mycobacterium avium
VADSRTSYLAAFGRDDCGPVWVFSGQGSQWTQMG

SEQ ID NO: 105575 - protein, 23 aa, Mycobacterium avium
VADTRGGQLLVYGVDPLILRQAY

SEQ ID NO: 105576 - protein, 17 aa, Mycobacterium avium
VAEALEVLAGGGPADVV

SEQ ID NO: 105577 - protein, 26 aa, Mycobacterium avium
VAEELGQPLPLLIKWDDAEYGLRAGE

SEQ ID NO: 105578 - protein, 21 aa, Mycobacterium avium
VAELALRIADRAILVGEEPEV

SEQ ID NO: 105579 - protein, 23 aa, Mycobacterium avium
VAELGLPVVVRPSFTMGGLGSGM

SEQ ID NO: 105580 - protein, 20 aa, Mycobacterium avium
VAELYDAFTYMLLLTLEDLG

SEQ ID NO: 105581 - protein, 22 aa, Mycobacterium avium
VAEMPGIFAYVVAQGDGPFIGC

SEQ ID NO: 105582 - protein, 20 aa, Mycobacterium avium
VAEPGSPVPNGVTPPDGAPV

SEQ ID NO: 105583 - protein, 26 aa, Mycobacterium avium
VAEPPCPGLGALVRRVGPVEAADRVR

SEQ ID NO: 105584 - protein, 26 aa, Mycobacterium avium
VAEPPCPGLGALVRRVGPVEAAERVR

SEQ ID NO: 105585 - protein, 17 aa, Mycobacterium avium
VAERARWATPTRPLRVL

SEQ ID NO: 105586 - protein, 18 aa, Mycobacterium avium
VAERLGPLGAEIVNADAM

SEQ ID NO: 105587 - protein, 19 aa, Mycobacterium avium
VAERLGPLGAEIVNADAMQ

SEQ ID NO: 105588 - protein, 18 aa, Mycobacterium avium
VAEVTRLLATSARTNVAI

SEQ ID NO: 105589 - protein, 21 aa, Mycobacterium avium
VAFSERWVRNWNAHDVDAVLD

SEQ ID NO: 105590 - protein, 17 aa, Mycobacterium avium
VAGAGGDPWEVNRTLQA

SEQ ID NO: 105591 - protein, 17 aa, Mycobacterium avium
VAGAVFVAVLGRMSEPT

SEQ ID NO: 105592 - protein, 25 aa, Mycobacterium avium
VAGDPWPALRCWAAGRATAEIVERA

SEQ ID NO: 105593 - protein, 22 aa, Mycobacterium avium
VAGELRIPALVLTQPLDTEPRA

SEQ ID NO: 105594 - protein, 31 aa, Mycobacterium avium
VAGERPAVVPLSFAQSRLWFLDQLHGPSPVH

SEQ ID NO: 105595 - protein, 41 aa, Mycobacterium avium
VAGGLRADGLRRGDRVAVRYPAGIDWVLAFWGTVLAGGVAV

SEQ ID NO: 105596 - protein, 18 aa, Mycobacterium avium
VAGGRFLLRIRDGVGTCT

SEQ ID NO: 105597 - protein, 22 aa, Mycobacterium avium
VAGIRMSWDIATNVVAAESISV

SEQ ID NO: 105598 - protein, 30 aa, Mycobacterium avium
VAGLGRKLIEVPVGFKWFVDGLIGGTLGFG

SEQ ID NO: 105599 - protein, 17 aa, Mycobacterium avium
VAGLHLQFGKNAGTEVV

SEQ ID NO: 105600 - protein, 17 aa, Mycobacterium avium
VAGRLSAQVGAYHLMRT

SEQ ID NO: 105601 - protein, 19 aa, Mycobacterium avium
VAGRQRLATQLGYSETVFV

SEQ ID NO: 105602 - protein, 24 aa, Mycobacterium avium
VAGRQRLATQLGYSETVFVDLPAP

SEQ ID NO: 105603 - protein, 18 aa, Mycobacterium avium
VAGTVLFPGAGFVELALR

SEQ ID NO: 105604 - protein, 18 aa, Mycobacterium avium
VAGVALRGGVRLVAADAG

SEQ ID NO: 105605 - protein, 17 aa, Mycobacterium avium
VAGYRIDLDLTDGKGGP

SEQ ID NO: 105606 - protein, 25 aa, Mycobacterium avium
VAHELGRALAPVPFVGSTVLATGLL

SEQ ID NO: 105607 - protein, 20 aa, Mycobacterium avium
VAHPDRRTVLLIGDGAAQLT

SEQ ID NO: 105608 - protein, 26 aa, Mycobacterium avium
VAHPVLMPVFRLSGLTELTTVEAAPS

SEQ ID NO: 105609 - protein, 21 aa, Mycobacterium avium
VAIDLRDDWAAALREEGFDPQ

SEQ ID NO: 105610 - protein, 21 aa, Mycobacterium avium
VAIDLRDDWAAALREEGFDTQ

SEQ ID NO: 105611 - protein, 22 aa, Mycobacterium avium
VAIDSGEAWVVLRADQLEIEPV

SEQ ID NO: 105612 - protein, 17 aa, Mycobacterium avium
VAIEGDSAFGFSGMEIE

SEQ ID NO: 105613 - protein, 23 aa, Mycobacterium avium
VAIEGDSAFGFSGMEIETICRYR

SEQ ID NO: 105614 - protein, 19 aa, Mycobacterium avium
VAKAAPWLRDGDVVVVTSK

SEQ ID NO: 105615 - protein, 25 aa, Mycobacterium avium
VAKFKAPEQVVLWDALPKNDAGKVL

SEQ ID NO: 105616 - protein, 17 aa, Mycobacterium avium
VALARLGMPLIDVAEVD

SEQ ID NO: 105617 - protein, 17 aa, Mycobacterium avium
VALDFPELVIVCGHVGY

SEQ ID NO: 105618 - protein, 17 aa, Mycobacterium avium
VALHCGAKALVQRITGG

SEQ ID NO: 105619 - protein, 17 aa, Mycobacterium avium
VALLFSRSVDAVVAMLA

SEQ ID NO: 105620 - protein, 17 aa, Mycobacterium avium
VALMGGPILDPTAQSCT

SEQ ID NO: 105621 - protein, 22 aa, Mycobacterium avium
VALPRVSIFLSLLDAHVQRAPV

SEQ ID NO: 105622 - protein, 27 aa, Mycobacterium avium
VALQPYGGAWLNSWLDRDLGISGRLSV

SEQ ID NO: 105623 - protein, 18 aa, Mycobacterium avium
VAMEAEVSMLLQRRCVWM

SEQ ID NO: 105624 - protein, 17 aa, Mycobacterium avium
VAMLMRFQHATGRIAES

SEQ ID NO: 105625 - protein, 20 aa, Mycobacterium avium
VANALYWLQEFHIDGLRVDA

SEQ ID NO: 105626 - protein, 24 aa, Mycobacterium avium
VANALYWLQEFHIDGLRVDAVASM

SEQ ID NO: 105627 - protein, 27 aa, Mycobacterium avium
VANRRLPGFFPRRRSRVPGNDRTGSRI

SEQ ID NO: 105628 - protein, 23 aa, Mycobacterium avium
VANWQKYAVIISHTIPFDDVEEA

SEQ ID NO: 105629 - protein, 28 aa, Mycobacterium avium
VAPEQARSGLAYAVSKSFVKWYSQSQAE

SEQ ID NO: 105630 - protein, 17 aa, Mycobacterium avium
VAPHVPFGGIGYSGIGR

SEQ ID NO: 105631 - protein, 24 aa, Mycobacterium avium
VAPKRVLPVFGLRSAIPAEREVFV

SEQ ID NO: 105632 - protein, 17 aa, Mycobacterium avium
VAPRAVLVLAHGFGEHA

SEQ ID NO: 105633 - protein, 23 aa, Mycobacterium avium
VAPRHAEEWLREPLQRACEAGNT

SEQ ID NO: 105634 - protein, 19 aa, Mycobacterium avium
VAPRPYRDYIGWLASRDPE

SEQ ID NO: 105635 - protein, 29 aa, Mycobacterium avium
VAPSELVGPVWRRDEVFEFNGSLIDSEEF

SEQ ID NO: 105636 - protein, 21 aa, Mycobacterium avium
VAQASGIRYLGFRQEASAGNA

SEQ ID NO: 105637 - protein, 29 aa, Mycobacterium avium
VAQGWVCGMDVDWRGALGTGHLVDLPTYA

SEQ ID NO: 105638 - protein, 22 aa, Mycobacterium avium
VAQMLERIVALMPLGAAVVDAH

SEQ ID NO: 105639 - protein, 17 aa, Mycobacterium avium
VARAAVAHAAWRGAPTV

SEQ ID NO: 105640 - protein, 17 aa, Mycobacterium avium
VARALDVDVGRLFSDET

SEQ ID NO: 105641 - protein, 22 aa, Mycobacterium avium
VARARAAGVICRPRDVFVEQTV

SEQ ID NO: 105642 - protein, 21 aa, Mycobacterium avium
VARARAAGVMCTARDVFVEQT

SEQ ID NO: 105643 - protein, 25 aa, Mycobacterium avium
VARARPHARRNGGRVVVASYLLADG

SEQ ID NO: 105644 - protein, 21 aa, Mycobacterium avium
VARAYLDTRIQTIYGGTTEIM

SEQ ID NO: 105645 - protein, 23 aa, Mycobacterium avium
VARCARGGVTKLVALSAINADDD

SEQ ID NO: 105646 - protein, 24 aa, Mycobacterium avium
VARCARGGVTKLVALSAINADDDF

SEQ ID NO: 105647 - protein, 23 aa, Mycobacterium avium
VARENRLRTALADLDNLDFDCVF

SEQ ID NO: 105648 - protein, 17 aa, Mycobacterium avium
VAREVLEDYGLTPWPKT

SEQ ID NO: 105649 - protein, 17 aa, Mycobacterium avium
VARGEGYLDPAVTSRVL

SEQ ID NO: 105650 - protein, 20 aa, Mycobacterium avium
VARHGVNRCQPRPTDKVVVF

SEQ ID NO: 105651 - protein, 18 aa, Mycobacterium avium
VARIAVGVAEKIRDDDPR

SEQ ID NO: 105652 - protein, 26 aa, Mycobacterium avium
VARISRVFPSTVFLTIMGMPVEDLEK

SEQ ID NO: 105653 - protein, 22 aa, Mycobacterium avium
VARLKTRLGVEYADLARELGLA

SEQ ID NO: 105654 - protein, 23 aa, Mycobacterium avium
VARRIRAGFMGVNGGAPYGADTP

SEQ ID NO: 105655 - protein, 24 aa, Mycobacterium avium
VARVLPWQECPGAVESAARITGMT

SEQ ID NO: 105656 - protein, 17 aa, Mycobacterium avium
VARVRGVSVEALRDNAL

SEQ ID NO: 105657 - protein, 17 aa, Mycobacterium avium
VARVRGVSVEALRDNVL

SEQ ID NO: 105658 - protein, 17 aa, Mycobacterium avium
VASALARLGPLLVVTAT

SEQ ID NO: 105659 - protein, 22 aa, Mycobacterium avium
VASALARLGPLLVVTATGREAD

SEQ ID NO: 105660 - protein, 23 aa, Mycobacterium avium
VASHCVVDGLGLVTAVAEAVKGE

SEQ ID NO: 105661 - protein, 17 aa, Mycobacterium avium
VASHMRTSMVLDALEMA

SEQ ID NO: 105662 - protein, 19 aa, Mycobacterium avium
VASLLALLVSKGVAKFKAP

SEQ ID NO: 105663 - protein, 22 aa, Mycobacterium avium
VASPRLDALIFGVGDFSLSQGA

SEQ ID NO: 105664 - protein, 22 aa, Mycobacterium avium
VASVAWSGVPPGVFDAAEDTVG

SEQ ID NO: 105665 - protein, 26 aa, Mycobacterium avium
VATADQRLICYARDRGCTRPNCLEPG

SEQ ID NO: 105666 - protein, 19 aa, Mycobacterium avium
VATAWRMRPALTARWADAG

SEQ ID NO: 105667 - protein, 19 aa, Mycobacterium avium
VATDAEWGALCDVLDAPAL

SEQ ID NO: 105668 - protein, 25 aa, Mycobacterium avium
VATGCGTASRFSCPYHAWTYDNTGR

SEQ ID NO: 105669 - protein, 25 aa, Mycobacterium avium
VATKATRVADGWVVSGQKVWTSDAV

SEQ ID NO: 105670 - protein, 29 aa, Mycobacterium avium
VATMAGWRTDFLNQMGLVIADSIKPFGTD

SEQ ID NO: 105671 - protein, 19 aa, Mycobacterium avium
VATPIMRWLQNMDGPVEQF

SEQ ID NO: 105672 - protein, 25 aa, Mycobacterium avium
VAVAHRLAGEWTFRRARPEPPLAVL

SEQ ID NO: 105673 - protein, 23 aa, Mycobacterium avium
VAVARLMLGPGMRIQAPPNLVSR

SEQ ID NO: 105674 - protein, 23 aa, Mycobacterium avium
VAVARQLRILPFAPANRASGSAA

SEQ ID NO: 105675 - protein, 26 aa, Mycobacterium avium
VAVDGVKAWKGIRYAAPPIGDLRFRA

SEQ ID NO: 105676 - protein, 20 aa, Mycobacterium avium
VAVDLRDDWATALRDNGFDS

SEQ ID NO: 105677 - protein, 22 aa, Mycobacterium avium
VAVDLRDDWLKALVEAGFGKGQ

SEQ ID NO: 105678 - protein, 22 aa, Mycobacterium avium
VAVDLRDDWPTALRDNGFDSSA

SEQ ID NO: 105679 - protein, 22 aa, Mycobacterium avium
VAVDLRDDWPTALRDTGFDSSA

SEQ ID NO: 105680 - protein, 29 aa, Mycobacterium avium
VAVDRNGQLRWFGLDGVEHTGGPMVDFDG

SEQ ID NO: 105681 - protein, 31 aa, Mycobacterium avium
VAVERLAVVPLSFAQQRLWFIDQLQGPSPIY

SEQ ID NO: 105682 - protein, 17 aa, Mycobacterium avium
VAVHRLLCWGIVATPLI

SEQ ID NO: 105683 - protein, 20 aa, Mycobacterium avium
VAVHRLLCWGIVATPLTVVP

SEQ ID NO: 105684 - protein, 18 aa, Mycobacterium avium
VAVNSLWPATTVASTGMI

SEQ ID NO: 105685 - protein, 28 aa, Mycobacterium avium
VAVPRLMIASVLWWRHVDEVYAAIRATH

SEQ ID NO: 105686 - protein, 30 aa, Mycobacterium avium
VAVRGYRSLREVVLPLGRLSVITGANGTGK

SEQ ID NO: 105687 - protein, 21 aa, Mycobacterium avium
VAVRTDNRWLLAASQNTTHRR

SEQ ID NO: 105688 - protein, 17 aa, Mycobacterium avium
VAWDIPGACDIGAMTAT

SEQ ID NO: 105689 - protein, 26 aa, Mycobacterium avium
VAWLANRLAPHGVWLERGEVILSGSF

SEQ ID NO: 105690 - protein, 24 aa, Mycobacterium avium
VAYGDMIAALGMLDARHVAGDARL

SEQ ID NO: 105691 - protein, 17 aa, Mycobacterium avium
VCCAANPGLVYLRLTGW

SEQ ID NO: 105692 - protein, 19 aa, Mycobacterium avium
VCFSELPSRLDLPSIHSGY

SEQ ID NO: 105693 - protein, 21 aa, Mycobacterium avium
VCGAGDRFAVAAAVALAAGND

SEQ ID NO: 105694 - protein, 20 aa, Mycobacterium avium
VCGAGDRFAVAAAVVRAAVG

SEQ ID NO: 105695 - protein, 19 aa, Mycobacterium avium
VCGDRRLVTLDGPEVGALG

SEQ ID NO: 105696 - protein, 17 aa, Mycobacterium avium
VCHSRKPACGVCLLAKD

SEQ ID NO: 105697 - protein, 19 aa, Mycobacterium avium
VCITHAGTAFAVFVGPGGQ

SEQ ID NO: 105698 - protein, 18 aa, Mycobacterium avium
VCPVDCIRPVPGEDAVTA

SEQ ID NO: 105699 - protein, 22 aa, Mycobacterium avium
VCQDFARLAIACLRAHGLAASY

SEQ ID NO: 105700 - protein, 21 aa, Mycobacterium avium
VCSVRGWAVGFGCNLALAADF

SEQ ID NO: 105701 - protein, 23 aa, Mycobacterium avium
VDAAPRLAHYPSRLSNALTRVAA

SEQ ID NO: 105702 - protein, 18 aa, Mycobacterium avium
VDAATAWHGRLHGAVHCA

SEQ ID NO: 105703 - protein, 17 aa, Mycobacterium avium
VDADGVARVRLNRPQTS

SEQ ID NO: 105704 - protein, 24 aa, Mycobacterium avium
VDADGYLRLCGRRHDMVVRGGENV

SEQ ID NO: 105705 - protein, 17 aa, Mycobacterium avium
VDAGLARLLGLSRSAAA

SEQ ID NO: 105706 - protein, 23 aa, Mycobacterium avium
VDAKCGADWELPVLGRVSAPPAV

SEQ ID NO: 105707 - protein, 25 aa, Mycobacterium avium
VDAKPAQVALAWLISYPGVVAIPGA

SEQ ID NO: 105708 - protein, 18 aa, Mycobacterium avium
VDAMLGVVRLARGEFPAA

SEQ ID NO: 105709 - protein, 25 aa, Mycobacterium avium
VDANIWRRVVPKGWFYNVMVTGVKP

SEQ ID NO: 105710 - protein, 24 aa, Mycobacterium avium
VDARRYPAIMAMTSLNDTRVYYVE

SEQ ID NO: 105711 - protein, 26 aa, Mycobacterium avium
VDARSRLNLADGILVRAVWASETSQL

SEQ ID NO: 105712 - protein, 17 aa, Mycobacterium avium
VDASVGLPPGWNIEFSI

SEQ ID NO: 105713 - protein, 29 aa, Mycobacterium avium
VDAVARQEPRLSWAAGLRDDGITTLLVTD

SEQ ID NO: 105714 - protein, 17 aa, Mycobacterium avium
VDCGACEPVCPVEAIYY

SEQ ID NO: 105715 - protein, 24 aa, Mycobacterium avium
VDCGRLAEKVGRPFWHEGRGELVA

SEQ ID NO: 105716 - protein, 33 aa, Mycobacterium avium
VDDPLAMYLFDLCTLPLNLAGNCGMSVPSGLSP

SEQ ID NO: 105717 - protein, 25 aa, Mycobacterium avium
VDDRARRLAAFLIGRGLVPGDRVMV

SEQ ID NO: 105718 - protein, 24 aa, Mycobacterium avium
VDDTRSDIFAGYWISEETSEGPGD

SEQ ID NO: 105719 - protein, 27 aa, Mycobacterium avium
VDECMQLSGGIGFTWEYPLHYELRRVF

SEQ ID NO: 105720 - protein, 17 aa, Mycobacterium avium
VDEGVEAYGRLDVIVAN

SEQ ID NO: 105721 - protein, 18 aa, Mycobacterium avium
VDEICRLLRGGKSVVASG

SEQ ID NO: 105722 - protein, 22 aa, Mycobacterium avium
VDELLRSGTLVDLYPLVRRSIR

SEQ ID NO: 105723 - protein, 18 aa, Mycobacterium avium
VDELWQWGIGQSARIVAA

SEQ ID NO: 105724 - protein, 18 aa, Mycobacterium avium
VDGARWLSLEGRSKVNSD

SEQ ID NO: 105725 - protein, 17 aa, Mycobacterium avium
VDGAVAILITGEDIARD

SEQ ID NO: 105726 - protein, 19 aa, Mycobacterium avium
VDGGYRITDPVSVADMQAY

SEQ ID NO: 105727 - protein, 19 aa, Mycobacterium avium
VDGKLICLVRARSDEEAWG

SEQ ID NO: 105728 - protein, 17 aa, Mycobacterium avium
VDGLPVFGPFWDRDAQL

SEQ ID NO: 105729 - protein, 17 aa, Mycobacterium avium
VDGRLRAACALLADNLR

SEQ ID NO: 105730 - protein, 22 aa, Mycobacterium avium
VDGSLGHLFGYHLSTPAVIDLW

SEQ ID NO: 105731 - protein, 20 aa, Mycobacterium avium
VDGTFEWNQSLFGYNFGDPD

SEQ ID NO: 105732 - protein, 17 aa, Mycobacterium avium
VDGYTAWLQNMAAHENI

SEQ ID NO: 105733 - protein, 21 aa, Mycobacterium avium
VDHPRVLAVLDRLLMPNYLLS

SEQ ID NO: 105734 - protein, 24 aa, Mycobacterium avium
VDHYAEIGLLGFALITDALGGVDV

SEQ ID NO: 105735 - protein, 17 aa, Mycobacterium avium
VDKCLQIFGGYGYMTEY

SEQ ID NO: 105736 - protein, 23 aa, Mycobacterium avium
VDKGRWTFGYLMSRATTIGAGTA

SEQ ID NO: 105737 - protein, 22 aa, Mycobacterium avium
VDKSAVLAGLFAVWDDIDALLA

SEQ ID NO: 105738 - protein, 17 aa, Mycobacterium avium
VDLALLYDGFTFNCVSW

SEQ ID NO: 105739 - protein, 20 aa, Mycobacterium avium
VDLDLARDALIVFTGLSGSG

SEQ ID NO: 105740 - protein, 19 aa, Mycobacterium avium
VDLEALPVVVGPEVVQAGV

SEQ ID NO: 105741 - protein, 23 aa, Mycobacterium avium
VDLFPTWLRIATRMAGWSKRTAR

SEQ ID NO: 105742 - protein, 18 aa, Mycobacterium avium
VDLKKAGLPIPPPSKKEQ

SEQ ID NO: 105743 - protein, 33 aa, Mycobacterium avium
VDLRREVHDAARRARVASRVLALLPAVAKDQAL

SEQ ID NO: 105744 - protein, 23 aa, Mycobacterium avium
VDLSRTVGWFTAKYPVALRLGGL

SEQ ID NO: 105745 - protein, 19 aa, Mycobacterium avium
VDLSRTVGWFTTKYPVALR

SEQ ID NO: 105746 - protein, 20 aa, Mycobacterium avium
VDLSRTVGWFTTKYPVALRM

SEQ ID NO: 105747 - protein, 20 aa, Mycobacterium avium
VDLSRTVGWFTTKYPVALTI

SEQ ID NO: 105748 - protein, 20 aa, Mycobacterium avium
VDLSRTVGWFTTKYPVALTV

SEQ ID NO: 105749 - protein, 17 aa, Mycobacterium avium
VDLWLDKQRFVVSGDIA

SEQ ID NO: 105750 - protein, 22 aa, Mycobacterium avium
VDLYSAPSMRELNTWAVDRVHA

SEQ ID NO: 105751 - protein, 23 aa, Mycobacterium avium
VDNALKLLLLLGEQPEIRLSEAT

SEQ ID NO: 105752 - protein, 33 aa, Mycobacterium avium
VDPAWEWNPALLALRAELERVFLAGVRRDVGPI

SEQ ID NO: 105753 - protein, 23 aa, Mycobacterium avium
VDPDPFAEPGWFLTDDLGAVDDD

SEQ ID NO: 105754 - protein, 33 aa, Mycobacterium avium
VDPMIREWLTVLLRRDLGLLVMIAVPGREPSRA

SEQ ID NO: 105755 - protein, 20 aa, Mycobacterium avium
VDPQGRCEPVAGTNTGEALP

SEQ ID NO: 105756 - protein, 17 aa, Mycobacterium avium
VDPTLLFDGMFALVQHS

SEQ ID NO: 105757 - protein, 27 aa, Mycobacterium avium
VDRARNSGMPVVFWLDQERPHENELRK

SEQ ID NO: 105758 - protein, 17 aa, Mycobacterium avium
VDRLGLFFELLGATRTM

SEQ ID NO: 105759 - protein, 17 aa, Mycobacterium avium
VDRLPAPYLGRRTGKEL

SEQ ID NO: 105760 - protein, 22 aa, Mycobacterium avium
VDRLTFDPAGFGFPRAELDDLL

SEQ ID NO: 105761 - protein, 21 aa, Mycobacterium avium
VDRPILAPIYLPDIRVACTPY

SEQ ID NO: 105762 - protein, 17 aa, Mycobacterium avium
VDRSAWVAAGKYGLIGF

SEQ ID NO: 105763 - protein, 21 aa, Mycobacterium avium
VDSRIRAGAELLKVERNDKGG

SEQ ID NO: 105764 - protein, 23 aa, Mycobacterium avium
VDTAGRWGVSRVWLGVNQKNQRA

SEQ ID NO: 105765 - protein, 20 aa, Mycobacterium avium
VDTAVLCDRCHGKGTNGDSA

SEQ ID NO: 105766 - protein, 19 aa, Mycobacterium avium
VDTAVLCDRCQGKGTNGDS

SEQ ID NO: 105767 - protein, 17 aa, Mycobacterium avium
VDTDVWYPAGPVQTGSM

SEQ ID NO: 105768 - protein, 25 aa, Mycobacterium avium
VDTEIPSPAAGVLTKIIAQEDDTVE

SEQ ID NO: 105769 - protein, 24 aa, Mycobacterium avium
VDTHFARLVHRWRWTAEKDPVKIE

SEQ ID NO: 105770 - protein, 32 aa, Mycobacterium avium
VDTRIRFLPPESWGNHEWDTMTAMPAVSAAVD

SEQ ID NO: 105771 - protein, 24 aa, Mycobacterium avium
VDVKHRMMRWFGPIIHEYYGGTEG

SEQ ID NO: 105772 - protein, 20 aa, Mycobacterium avium
VDVKTVRRWLSNTNYNIRED

SEQ ID NO: 105773 - protein, 18 aa, Mycobacterium avium
VDVLEVYERLILDAMRGD

SEQ ID NO: 105774 - protein, 17 aa, Mycobacterium avium
VDVLPAVGAIPWNDGSE

SEQ ID NO: 105775 - protein, 20 aa, Mycobacterium avium
VDVPELLRVLDFAPTTEDQL

SEQ ID NO: 105776 - protein, 32 aa, Mycobacterium avium
VDVRLRAAQQLPWHPGRCAEVLVGDTPVGYAG

SEQ ID NO: 105777 - protein, 33 aa, Mycobacterium avium
VDVRLRAAQQLPWHPGRCAEVLVGDTPVGYAGQ

SEQ ID NO: 105778 - protein, 21 aa, Mycobacterium avium
VEAALALAERITCNAPLSVQA

SEQ ID NO: 105779 - protein, 18 aa, Mycobacterium avium
VEAALCTHPAVADCAVFG

SEQ ID NO: 105780 - protein, 24 aa, Mycobacterium avium
VEAARAAGFALVIGLAPDGRDGDG

SEQ ID NO: 105781 - protein, 19 aa, Mycobacterium avium
VEATLRWAANSMTTNGVSV

SEQ ID NO: 105782 - protein, 17 aa, Mycobacterium avium
VECAVAYQAVLLCGAVL

SEQ ID NO: 105783 - protein, 26 aa, Mycobacterium avium
VECGVWRGGASILMRAVLAAYGDEKR

SEQ ID NO: 105784 - protein, 18 aa, Mycobacterium avium
VEEAERFLAHQATLLRPD

SEQ ID NO: 105785 - protein, 25 aa, Mycobacterium avium
VEEGIQCPFHGWVWNGAGRNVHIPY

SEQ ID NO: 105786 - protein, 25 aa, Mycobacterium avium
VEEILRYASPVIHFRRTVTRDGVTL

SEQ ID NO: 105787 - protein, 24 aa, Mycobacterium avium
VEEILRYASPVIHMRRTVTRDGVT

SEQ ID NO: 105788 - protein, 25 aa, Mycobacterium avium
VEELFPAEAIIDLQAFFGAADEQDL

SEQ ID NO: 105789 - protein, 24 aa, Mycobacterium avium
VEEMLRFTSPVAHMARRATEDVEI

SEQ ID NO: 105790 - protein, 18 aa, Mycobacterium avium
VEEMVRWTSPSPSKRRTA

SEQ ID NO: 105791 - protein, 23 aa, Mycobacterium avium
VEEPGRLREALVGARREAATSFG

SEQ ID NO: 105792 - protein, 19 aa, Mycobacterium avium
VEFSTWTPHWFGVVEGPVE

SEQ ID NO: 105793 - protein, 24 aa, Mycobacterium avium
VEFWRSRLGAMASRGETDGPRVDE

SEQ ID NO: 105794 - protein, 31 aa, Mycobacterium avium
VEGGYPTTLWARRPATLEAFADTDAKVAGSP

SEQ ID NO: 105795 - protein, 31 aa, Mycobacterium avium
VEGGYPTTLWARRPATLEVFADTDAKVAGSP

SEQ ID NO: 105796 - protein, 21 aa, Mycobacterium avium
VEGHIYRACQRVGAQSRDELA

SEQ ID NO: 105797 - protein, 17 aa, Mycobacterium avium
VEGKVAFITGAARGQGR

SEQ ID NO: 105798 - protein, 18 aa, Mycobacterium avium
VEGNPSMSLELYLEPSKE

SEQ ID NO: 105799 - protein, 22 aa, Mycobacterium avium
VEGRDGYLRSIHRAAAAGASLF

SEQ ID NO: 105800 - protein, 17 aa, Mycobacterium avium
VEGRRLTKVVGLAGAHR

SEQ ID NO: 105801 - protein, 20 aa, Mycobacterium avium
VEGVARCLVGGLRQPGRRPP

SEQ ID NO: 105802 - protein, 28 aa, Mycobacterium avium
VEHAFTWILPLMWRMDAIYEARKSRVEI

SEQ ID NO: 105803 - protein, 29 aa, Mycobacterium avium
VEHAFTWILPLMWRMDAIYEARKSRVEIK

SEQ ID NO: 105804 - protein, 28 aa, Mycobacterium avium
VEHAFTWILPLMWRMDAIYEARKSRVQI

SEQ ID NO: 105805 - protein, 17 aa, Mycobacterium avium
VEHLPQRIITAAGVSSG

SEQ ID NO: 105806 - protein, 25 aa, Mycobacterium avium
VEHLTALCWDGGAALPFDADDIRTI

SEQ ID NO: 105807 - protein, 24 aa, Mycobacterium avium
VEIEGSPSMRCEFEMAEDHDHDLG

SEQ ID NO: 105808 - protein, 19 aa, Mycobacterium avium
VEIKGAVYSAELGAEMPTD

SEQ ID NO: 105809 - protein, 24 aa, Mycobacterium avium
VEILPTPFLPAGVFDVWGLPDDDP

SEQ ID NO: 105810 - protein, 19 aa, Mycobacterium avium
VEINEAFAAVALASTRELG

SEQ ID NO: 105811 - protein, 22 aa, Mycobacterium avium
VEINEAFAPVVLAWLAELGADP

SEQ ID NO: 105812 - protein, 17 aa, Mycobacterium avium
VEINIACSLGMLTAEQV

SEQ ID NO: 105813 - protein, 23 aa, Mycobacterium avium
VEIRMPVVVDPEWERPARSVTNG

SEQ ID NO: 105814 - protein, 27 aa, Mycobacterium avium
VEKILGRPALPFAHWVATHRDLFDRRN

SEQ ID NO: 105815 - protein, 19 aa, Mycobacterium avium
VEKLFYKTGVGFDDLALIE

SEQ ID NO: 105816 - protein, 20 aa, Mycobacterium avium
VEKWADYGASLGHDRDELLA

SEQ ID NO: 105817 - protein, 17 aa, Mycobacterium avium
VELARRLAPGATVVLAA

SEQ ID NO: 105818 - protein, 22 aa, Mycobacterium avium
VELARSGVIHALWVSDAPDGDE

SEQ ID NO: 105819 - protein, 28 aa, Mycobacterium avium
VELAYRSGRIASLHARRVYANDYFEIEY

SEQ ID NO: 105820 - protein, 18 aa, Mycobacterium avium
VELDGKHLWSYDGQVFPT

SEQ ID NO: 105821 - protein, 26 aa, Mycobacterium avium
VELDRRSRLGGWGLMSNAAHPGLAKT

SEQ ID NO: 105822 - protein, 18 aa, Mycobacterium avium
VELFKPLATKATRPEVRG

SEQ ID NO: 105823 - protein, 17 aa, Mycobacterium avium
VELGKAGFLTAIDGCRA

SEQ ID NO: 105824 - protein, 19 aa, Mycobacterium avium
VELKTSWYSFITPLQAGTV

SEQ ID NO: 105825 - protein, 18 aa, Mycobacterium avium
VELLRSRVFFDWFDEAGV

SEQ ID NO: 105826 - protein, 24 aa, Mycobacterium avium
VELLRSRVFFDWFDEAGVDDIPAV

SEQ ID NO: 105827 - protein, 26 aa, Mycobacterium avium
VELLRSRVFFDWFGEAGVDDIPAVFA

SEQ ID NO: 105828 - protein, 22 aa, Mycobacterium avium
VELRIPPFAAVQCIPGPAHTRG

SEQ ID NO: 105829 - protein, 26 aa, Mycobacterium avium
VELTRLPHGCIVHFAVDLIIADVTSI

SEQ ID NO: 105830 - protein, 17 aa, Mycobacterium avium
VEMAWDPITRIVGSLGI

SEQ ID NO: 105831 - protein, 18 aa, Mycobacterium avium
VEMLRAATTFFVRESDPR

SEQ ID NO: 105832 - protein, 19 aa, Mycobacterium avium
VENEGRRIVAHQADVRDAD

SEQ ID NO: 105833 - protein, 17 aa, Mycobacterium avium
VENPVGMAAKFKNLDLQ

SEQ ID NO: 105834 - protein, 17 aa, Mycobacterium avium
VENSFAWHEYAYSRGKI

SEQ ID NO: 105835 - protein, 18 aa, Mycobacterium avium
VENWGRRGCSGELGDDVT

SEQ ID NO: 105836 - protein, 17 aa, Mycobacterium avium
VEPCAAVARELQGRGHD

SEQ ID NO: 105837 - protein, 29 aa, Mycobacterium avium
VEPDPRQPGAFVVSGARPERWVRQTNFDN

SEQ ID NO: 105838 - protein, 23 aa, Mycobacterium avium
VEPDRIEVARAWHAELVDHQLAA

SEQ ID NO: 105839 - protein, 18 aa, Mycobacterium avium
VEPFGCLRSTPPPDGVGA

SEQ ID NO: 105840 - protein, 22 aa, Mycobacterium avium
VEPHAAIARELLRRGHEVCVAA

SEQ ID NO: 105841 - protein, 26 aa, Mycobacterium avium
VEPVLTRSGAEWMPNFIDLLQRKLSR

SEQ ID NO: 105842 - protein, 25 aa, Mycobacterium avium
VEQMFPEARIQMVSSVINPGGASRT

SEQ ID NO: 105843 - protein, 19 aa, Mycobacterium avium
VERALRIAAEYTTGREQFG

SEQ ID NO: 105844 - protein, 24 aa, Mycobacterium avium
VERLRRHPAARALRVDKLTLAALE

SEQ ID NO: 105845 - protein, 19 aa, Mycobacterium avium
VERMWPRVWQLACMVDHVA

SEQ ID NO: 105846 - protein, 17 aa, Mycobacterium avium
VERQRLWARSGYLQPHW

SEQ ID NO: 105847 - protein, 17 aa, Mycobacterium avium
VERSGLDAAEFDDFVLA

SEQ ID NO: 105848 - protein, 24 aa, Mycobacterium avium
VESDPRAAAVIARNIDTLGLPGAT

SEQ ID NO: 105849 - protein, 20 aa, Mycobacterium avium
VESLPLIASSVMSKKLAEGA

SEQ ID NO: 105850 - protein, 23 aa, Mycobacterium avium
VETEKYVAAGLWHTADSLPELAA

SEQ ID NO: 105851 - protein, 18 aa, Mycobacterium avium
VETERRFYLANSVEMTPR

SEQ ID NO: 105852 - protein, 18 aa, Mycobacterium avium
VETIPVLLARAAQSELTP

SEQ ID NO: 105853 - protein, 21 aa, Mycobacterium avium
VEVGVLRFVEDVDRRHRPGGI

SEQ ID NO: 105854 - protein, 21 aa, Mycobacterium avium
VEVHGPCVMRGYWRNPEVTAE

SEQ ID NO: 105855 - protein, 19 aa, Mycobacterium avium
VEVMSRVPLGAARATGMPY

SEQ ID NO: 105856 - protein, 17 aa, Mycobacterium avium
VEVPDLASHFVFVNLAH

SEQ ID NO: 105857 - protein, 22 aa, Mycobacterium avium
VEVPGVLTARVIAGATTLDVQA

SEQ ID NO: 105858 - protein, 22 aa, Mycobacterium avium
VEVPGVLTARVIPGATTLDVQA

SEQ ID NO: 105859 - protein, 18 aa, Mycobacterium avium
VEVRGWLEGLRAARRAVP

SEQ ID NO: 105860 - protein, 21 aa, Mycobacterium avium
VEVSEYLGLRPTWVDATNVGG

SEQ ID NO: 105861 - protein, 20 aa, Mycobacterium avium
VEVVGAVLGRFAEAYYDLGT

SEQ ID NO: 105862 - protein, 21 aa, Mycobacterium avium
VEWKHGVCRALRLPHADQADI

SEQ ID NO: 105863 - protein, 24 aa, Mycobacterium avium
VEYELDCIIYASGFEITTEISRRY

SEQ ID NO: 105864 - protein, 29 aa, Mycobacterium avium
VFAAAWRLALMGLRRGEILGLSWDSVDLD

SEQ ID NO: 105865 - protein, 21 aa, Mycobacterium avium
VFAAEGFAGATIDAIGQAAGF

SEQ ID NO: 105866 - protein, 20 aa, Mycobacterium avium
VFADPRWRAHHDRMSELGFE

SEQ ID NO: 105867 - protein, 21 aa, Mycobacterium avium
VFADPRWRAHHERMSELGFEV

SEQ ID NO: 105868 - protein, 17 aa, Mycobacterium avium
VFAVIDMTIPRLKRTLL

SEQ ID NO: 105869 - protein, 25 aa, Mycobacterium avium
VFDHRGRASLMVAVHPLCPLSARQI

SEQ ID NO: 105870 - protein, 19 aa, Mycobacterium avium
VFDREWPLRVGDIDRTGRL

SEQ ID NO: 105871 - protein, 19 aa, Mycobacterium avium
VFDRLAGRLSYLSGDVTDA

SEQ ID NO: 105872 - protein, 25 aa, Mycobacterium avium
VFFESPRRLPACLQDAVERLGGERR

SEQ ID NO: 105873 - protein, 24 aa, Mycobacterium avium
VFFFDILHCDGVDLLDAPTTDRLA

SEQ ID NO: 105874 - protein, 17 aa, Mycobacterium avium
VFGLPGMDWPAVRSEAE

SEQ ID NO: 105875 - protein, 17 aa, Mycobacterium avium
VFGLPGMDWPAVRSQAE

SEQ ID NO: 105876 - protein, 26 aa, Mycobacterium avium
VFGRRFLGSFAHRFLAAELVCRIQEP

SEQ ID NO: 105877 - protein, 18 aa, Mycobacterium avium
VFHAKAVVLATGGSGRMY

SEQ ID NO: 105878 - protein, 19 aa, Mycobacterium avium
VFHIMPFWYFNAISPAWGQ

SEQ ID NO: 105879 - protein, 21 aa, Mycobacterium avium
VFKGSGFYRTDSRESGKKPAG

SEQ ID NO: 105880 - protein, 19 aa, Mycobacterium avium
VFLQYPWQVIPDELIKPLE

SEQ ID NO: 105881 - protein, 17 aa, Mycobacterium avium
VFNDPDLASFNGAVTQT

SEQ ID NO: 105882 - protein, 18 aa, Mycobacterium avium
VFPDSIVVFTHRDPVPVA

SEQ ID NO: 105883 - protein, 18 aa, Mycobacterium avium
VFPNLPSDTGHWGVPYFN

SEQ ID NO: 105884 - protein, 21 aa, Mycobacterium avium
VFPTYRLDHQFEVIRKVGELT

SEQ ID NO: 105885 - protein, 21 aa, Mycobacterium avium
VFPTYRLDHQFEVISKVGELT

SEQ ID NO: 105886 - protein, 24 aa, Mycobacterium avium
VFQRTPIWCFPKLDVPLPAPARWA

SEQ ID NO: 105887 - protein, 22 aa, Mycobacterium avium
VFRCGDEVFADLVFDERHIGAP

SEQ ID NO: 105888 - protein, 20 aa, Mycobacterium avium
VFRRNIWVSPFWEGSVADVV

SEQ ID NO: 105889 - protein, 17 aa, Mycobacterium avium
VFSRAVAVGPPIELVLD

SEQ ID NO: 105890 - protein, 18 aa, Mycobacterium avium
VFTLPVLAKTSVEIKGAV

SEQ ID NO: 105891 - protein, 18 aa, Mycobacterium avium
VFVDGWDPPTAVELIHRH

SEQ ID NO: 105892 - protein, 20 aa, Mycobacterium avium
VGAAFNRLIALVRNTSGDDR

SEQ ID NO: 105893 - protein, 18 aa, Mycobacterium avium
VGACLRPGDRPQPASQPV

SEQ ID NO: 105894 - protein, 17 aa, Mycobacterium avium
VGADRRPGFHRYHSEEL

SEQ ID NO: 105895 - protein, 17 aa, Mycobacterium avium
VGADWPVEFGGRGDFTP

SEQ ID NO: 105896 - protein, 20 aa, Mycobacterium avium
VGAGERVALLFSRSAEAIVA

SEQ ID NO: 105897 - protein, 18 aa, Mycobacterium avium
VGAIRLPRRVGWGNAMEL

SEQ ID NO: 105898 - protein, 20 aa, Mycobacterium avium
VGAKLWVDMAHFAGPVAAGL

SEQ ID NO: 105899 - protein, 19 aa, Mycobacterium avium
VGALLRMPGTLVVEHRMEG

SEQ ID NO: 105900 - protein, 21 aa, Mycobacterium avium
VGAPDELKARISRVSPHATLE

SEQ ID NO: 105901 - protein, 21 aa, Mycobacterium avium
VGAPDELKARISRVSQHATLE

SEQ ID NO: 105902 - protein, 17 aa, Mycobacterium avium
VGAVAAWGGSKLVEVAW

SEQ ID NO: 105903 - protein, 17 aa, Mycobacterium avium
VGAVAGRDDLTREGQAQ

SEQ ID NO: 105904 - protein, 23 aa, Mycobacterium avium
VGAVPKKLCHPGLEEIPVEVALD

SEQ ID NO: 105905 - protein, 23 aa, Mycobacterium avium
VGCAEVIRQVWLLLDGECGPDTR

SEQ ID NO: 105906 - protein, 19 aa, Mycobacterium avium
VGDLPGIYQASGVYDAATN

SEQ ID NO: 105907 - protein, 23 aa, Mycobacterium avium
VGDVVGVGHRWRRRGLGGDGGVG

SEQ ID NO: 105908 - protein, 20 aa, Mycobacterium avium
VGEEGWGFLKGLYEVSPNRM

SEQ ID NO: 105909 - protein, 18 aa, Mycobacterium avium
VGEIRLAYLSSFGSTVVP

SEQ ID NO: 105910 - protein, 23 aa, Mycobacterium avium
VGEIRLAYLSSFGSTVVPRLIAR

SEQ ID NO: 105911 - protein, 20 aa, Mycobacterium avium
VGEPCYLGGAGRWRDSGMPG

SEQ ID NO: 105912 - protein, 18 aa, Mycobacterium avium
VGERRARLTKFQEDLPEQ

SEQ ID NO: 105913 - protein, 17 aa, Mycobacterium avium
VGFEFPDQAFGHLDLER

SEQ ID NO: 105914 - protein, 19 aa, Mycobacterium avium
VGFGCNLALAADFTVAAAD

SEQ ID NO: 105915 - protein, 21 aa, Mycobacterium avium
VGFGCSLALACDLVVAAPASY

SEQ ID NO: 105916 - protein, 17 aa, Mycobacterium avium
VGGAIGGIVGGITGALG

SEQ ID NO: 105917 - protein, 20 aa, Mycobacterium avium
VGGARRLRGEPGGHRHRGGR

SEQ ID NO: 105918 - protein, 28 aa, Mycobacterium avium
VGGPRSGVGIVEGWRGTIVHRVEIAADC

SEQ ID NO: 105919 - protein, 17 aa, Mycobacterium avium
VGGQPVRALDRISLQLA

SEQ ID NO: 105920 - protein, 17 aa, Mycobacterium avium
VGGRAAVQIGRRLARLA

SEQ ID NO: 105921 - protein, 29 aa, Mycobacterium avium
VGGTAAWQGLKTLFSREMLDGLTSENVMS

SEQ ID NO: 105922 - protein, 19 aa, Mycobacterium avium
VGGTWYWNRYPGARCDVES

SEQ ID NO: 105923 - protein, 19 aa, Mycobacterium avium
VGGWQDLFIRQTLQQYAHL

SEQ ID NO: 105924 - protein, 21 aa, Mycobacterium avium
VGHRAVTLVFTLAGGAEPCTL

SEQ ID NO: 105925 - protein, 17 aa, Mycobacterium avium
VGHSFGAGLAMHLAAVR

SEQ ID NO: 105926 - protein, 18 aa, Mycobacterium avium
VGHSFGAGLAMHLAAVRP

SEQ ID NO: 105927 - protein, 18 aa, Mycobacterium avium
VGHSMGACLTTMVQATAH

SEQ ID NO: 105928 - protein, 27 aa, Mycobacterium avium
VGHTPAGPAQLGWRRRISRTRDRQVSA

SEQ ID NO: 105929 - protein, 18 aa, Mycobacterium avium
VGIELPGKAEAAGKKAQK

SEQ ID NO: 105930 - protein, 19 aa, Mycobacterium avium
VGIELPGKAEAAGKKAQKA

SEQ ID NO: 105931 - protein, 19 aa, Mycobacterium avium
VGIELPGKAEAAGKKTQKA

SEQ ID NO: 105932 - protein, 25 aa, Mycobacterium avium
VGILAPLTRQGCIPLAIHPAMTFTG

SEQ ID NO: 105933 - protein, 20 aa, Mycobacterium avium
VGIPTPRLGMIFEDHTLEDF

SEQ ID NO: 105934 - protein, 21 aa, Mycobacterium avium
VGIRVVTRYDVGLLHPQAVTV

SEQ ID NO: 105935 - protein, 25 aa, Mycobacterium avium
VGKADGCGCPMWTAPGVHGNPKSAT

SEQ ID NO: 105936 - protein, 23 aa, Mycobacterium avium
VGKSFKHRWLPALPHHRYKPVSG

SEQ ID NO: 105937 - protein, 26 aa, Mycobacterium avium
VGLDPVLRADLWDQFAALARGGTTLL

SEQ ID NO: 105938 - protein, 27 aa, Mycobacterium avium
VGLDPVLRADLWDQFAALARGGTTLLV

SEQ ID NO: 105939 - protein, 20 aa, Mycobacterium avium
VGLGCSIALLSDFLVMGESS

SEQ ID NO: 105940 - protein, 20 aa, Mycobacterium avium
VGLGCSIALLSDLLVMGENS

SEQ ID NO: 105941 - protein, 18 aa, Mycobacterium avium
VGLLDEWTPVIAGAELGE

SEQ ID NO: 105942 - protein, 33 aa, Mycobacterium avium
VGLLVNFPLSQWLKFAPPIGYGALPKDALGAGL

SEQ ID NO: 105943 - protein, 17 aa, Mycobacterium avium
VGLPAIYVPLPIGNGEQ

SEQ ID NO: 105944 - protein, 17 aa, Mycobacterium avium
VGLPPGWNIEFSIAAPW

SEQ ID NO: 105945 - protein, 18 aa, Mycobacterium avium
VGLQQGVARTVEYFRNQH

SEQ ID NO: 105946 - protein, 17 aa, Mycobacterium avium
VGLRAGSNPEFVVALLA

SEQ ID NO: 105947 - protein, 25 aa, Mycobacterium avium
VGLRDVLAALKWVRDNITAFGGDPR

SEQ ID NO: 105948 - protein, 21 aa, Mycobacterium avium
VGLRGELEYAAGMDGTDAEAP

SEQ ID NO: 105949 - protein, 22 aa, Mycobacterium avium
VGLRPAGALGAEALRPQTTTMS

SEQ ID NO: 105950 - protein, 17 aa, Mycobacterium avium
VGLVNAVVRFDVDAGSD

SEQ ID NO: 105951 - protein, 28 aa, Mycobacterium avium
VGNAGFDVVSWNVFNTIVSNILYNHTLD

SEQ ID NO: 105952 - protein, 24 aa, Mycobacterium avium
VGNIVGGPMGWESVFTQPGQSDWV

SEQ ID NO: 105953 - protein, 32 aa, Mycobacterium avium
VGNNFPVFFIQDGIKFPDFVHAVKPEPHNEIP

SEQ ID NO: 105954 - protein, 26 aa, Mycobacterium avium
VGPEFGTAIAAGFVFPFTQNFVDRAV

SEQ ID NO: 105955 - protein, 27 aa, Mycobacterium avium
VGPEFGTAIAAGFVFPFTQNFVDRAVR

SEQ ID NO: 105956 - protein, 26 aa, Mycobacterium avium
VGPEFGTAIAAGFVFPLTQNFVDRAV

SEQ ID NO: 105957 - protein, 23 aa, Mycobacterium avium
VGPERAVGVAIERCAELVVAWWA

SEQ ID NO: 105958 - protein, 18 aa, Mycobacterium avium
VGPVTCAVIAGRIGDPHR

SEQ ID NO: 105959 - protein, 18 aa, Mycobacterium avium
VGQAEFADVLVLNRADPF

SEQ ID NO: 105960 - protein, 18 aa, Mycobacterium avium
VGQAGGDPWEINRSLQAG

SEQ ID NO: 105961 - protein, 18 aa, Mycobacterium avium
VGQCGAMIFRCSKRRLNA

SEQ ID NO: 105962 - protein, 17 aa, Mycobacterium avium
VGQRILGDWAQQQRHLV

SEQ ID NO: 105963 - protein, 22 aa, Mycobacterium avium
VGRARAVGALTVLDACQSVPHQ

SEQ ID NO: 105964 - protein, 28 aa, Mycobacterium avium
VGRATRWRLSGLGLRVIAHDPYHPEARH

SEQ ID NO: 105965 - protein, 23 aa, Mycobacterium avium
VGRDIPLRLVYVIDPHGAPGGHE

SEQ ID NO: 105966 - protein, 25 aa, Mycobacterium avium
VGRIKDIVIRNGLKIPAAEVEEAVS

SEQ ID NO: 105967 - protein, 19 aa, Mycobacterium avium
VGRQGEWNLDPGARHRDAE

SEQ ID NO: 105968 - protein, 19 aa, Mycobacterium avium
VGSAENFKVVEELADALGA

SEQ ID NO: 105969 - protein, 23 aa, Mycobacterium avium
VGSALARASRWNRISDYLATADA

SEQ ID NO: 105970 - protein, 18 aa, Mycobacterium avium
VGSCGYPDEIFEVTKDLV

SEQ ID NO: 105971 - protein, 22 aa, Mycobacterium avium
VGSEKLWMGETHALPGSASDNH

SEQ ID NO: 105972 - protein, 18 aa, Mycobacterium avium
VGSFRLDPGQALVLDIAP

SEQ ID NO: 105973 - protein, 22 aa, Mycobacterium avium
VGSLLRPLISGARSVFVDGWDP

SEQ ID NO: 105974 - protein, 22 aa, Mycobacterium avium
VGSMLRPLLSGARTVFMDGWDP

SEQ ID NO: 105975 - protein, 23 aa, Mycobacterium avium
VGSPVCVNAAYTGIRCGAVLSTD

SEQ ID NO: 105976 - protein, 37 aa, Mycobacterium avium
VGTSLCYKLRLTVPGGVTLKAAWLAMIAVAATHLGRG

SEQ ID NO: 105977 - protein, 19 aa, Mycobacterium avium
VGVCTNTLCAIMGGDAIFD

SEQ ID NO: 105978 - protein, 17 aa, Mycobacterium avium
VGVGTLFRHFPTREALV

SEQ ID NO: 105979 - protein, 20 aa, Mycobacterium avium
VGVIFLEIHLTYAALVSGGR

SEQ ID NO: 105980 - protein, 19 aa, Mycobacterium avium
VGVPGALSGPGGRHVEIRQ

SEQ ID NO: 105981 - protein, 25 aa, Mycobacterium avium
VGVPTIAKALRWQFDGVDRVGPDLL

SEQ ID NO: 105982 - protein, 26 aa, Mycobacterium avium
VGVPTIAKALRWQFDGVDRVGPDLLL

SEQ ID NO: 105983 - protein, 23 aa, Mycobacterium avium
VGVRPEHFELGGLGVEMEVDVVE

SEQ ID NO: 105984 - protein, 18 aa, Mycobacterium avium
VGVSGRFGLRGGPVLIGR

SEQ ID NO: 105985 - protein, 19 aa, Mycobacterium avium
VGVSGRFGLRGGPVLIGRT

SEQ ID NO: 105986 - protein, 33 aa, Mycobacterium avium
VGWFTTKYPVALRMGRRLDWARVVAGEAALGAV

SEQ ID NO: 105987 - protein, 31 aa, Mycobacterium avium
VGYARIDPVLARELFIRHALVEGDWHTRHHF

SEQ ID NO: 105988 - protein, 40 aa, Mycobacterium avium
VGYGYLRRAGLTASRFVACPFGAPGARMYRTGDLVRWRAD

SEQ ID NO: 105989 - protein, 26 aa, Mycobacterium avium
VGYVRRAGLTASRFVACPFGESGTRM

SEQ ID NO: 105990 - protein, 19 aa, Mycobacterium avium
VHAEACRWEHVMSEDVERR

SEQ ID NO: 105991 - protein, 21 aa, Mycobacterium avium
VHASPAWLPVFVAAQLITRSG

SEQ ID NO: 105992 - protein, 24 aa, Mycobacterium avium
VHAWTRSAAKAWGSEGITVNAIAP

SEQ ID NO: 105993 - protein, 24 aa, Mycobacterium avium
VHDAGGRYGLVGILIQLARQRGVS

SEQ ID NO: 105994 - protein, 19 aa, Mycobacterium avium
VHELYEFRQNTGLVDADGN

SEQ ID NO: 105995 - protein, 17 aa, Mycobacterium avium
VHIGGLWALLQALVAAR

SEQ ID NO: 105996 - protein, 18 aa, Mycobacterium avium
VHIPAGTVIMLCLGAANR

SEQ ID NO: 105997 - protein, 25 aa, Mycobacterium avium
VHKVAELPAGHGLNAEKLGYGDLIA

SEQ ID NO: 105998 - protein, 18 aa, Mycobacterium avium
VHLRIGRRLITLGDDRLF

SEQ ID NO: 105999 - protein, 26 aa, Mycobacterium avium
VHLVGYCMGGLLATEIAKCLEESGIV

SEQ ID NO: 106000 - protein, 19 aa, Mycobacterium avium
VHNLIHGFILAAQHLTPGG

SEQ ID NO: 106001 - protein, 24 aa, Mycobacterium avium
VHNTWRFGIDRILAGVAMSDDSNA

SEQ ID NO: 106002 - protein, 25 aa, Mycobacterium avium
VHPECGCATSALYLAGEGAFPADRV

SEQ ID NO: 106003 - protein, 24 aa, Mycobacterium avium
VHPECGCATSALYLAGEGAFPAER

SEQ ID NO: 106004 - protein, 24 aa, Mycobacterium avium
VHPECGCATSALYLAGEGDFPADR

SEQ ID NO: 106005 - protein, 25 aa, Mycobacterium avium
VHPPRPEELGSFARVKLAGFKIPQY

SEQ ID NO: 106006 - protein, 22 aa, Mycobacterium avium
VHPRVIVCLGATAAQSLLGTSF

SEQ ID NO: 106007 - protein, 18 aa, Mycobacterium avium
VHRLLCWGIVATPLIVVP

SEQ ID NO: 106008 - protein, 23 aa, Mycobacterium avium
VHRLTGELGRWYGIDAGTLRVGD

SEQ ID NO: 106009 - protein, 24 aa, Mycobacterium avium
VHRPRRASSPFGQFAAVADAVNPA

SEQ ID NO: 106010 - protein, 18 aa, Mycobacterium avium
VHRYFLAAKQAEFALGGA

SEQ ID NO: 106011 - protein, 19 aa, Mycobacterium avium
VHRYFLAAKQAEFALGGAT

SEQ ID NO: 106012 - protein, 25 aa, Mycobacterium avium
VHSIRYCAGCGEDGANSYNVLDVTL

SEQ ID NO: 106013 - protein, 18 aa, Mycobacterium avium
VHTEFRKLVSRGFTPRQV

SEQ ID NO: 106014 - protein, 17 aa, Mycobacterium avium
VHTEFRKLVSRSFTPRQ

SEQ ID NO: 106015 - protein, 24 aa, Mycobacterium avium
VHTMVRPGLLTWRDIAKVMSENPA

SEQ ID NO: 106016 - protein, 21 aa, Mycobacterium avium
VHTRDMSRWVSVRMPEISVVN

SEQ ID NO: 106017 - protein, 25 aa, Mycobacterium avium
VHVAEVFPGAAGVAVRILRLLAAAE

SEQ ID NO: 106018 - protein, 19 aa, Mycobacterium avium
VHVDPGIAAAGRRSVQRMI

SEQ ID NO: 106019 - protein, 19 aa, Mycobacterium avium
VHVGQRVSVRFDNIDDVWI

SEQ ID NO: 106020 - protein, 20 aa, Mycobacterium avium
VHVTETFVAQGIFDALGKLA

SEQ ID NO: 106021 - protein, 23 aa, Mycobacterium avium
VIADGPIPLARLIPAGVDIRGNA

SEQ ID NO: 106022 - protein, 19 aa, Mycobacterium avium
VIAPWLLSEYDRFALLHGD

SEQ ID NO: 106023 - protein, 19 aa, Mycobacterium avium
VIAPWLLSEYDRFALLHGN

SEQ ID NO: 106024 - protein, 17 aa, Mycobacterium avium
VIARCRTSVELLAPHAG

SEQ ID NO: 106025 - protein, 17 aa, Mycobacterium avium
VICAQLRDTVGVADRAT

SEQ ID NO: 106026 - protein, 28 aa, Mycobacterium avium
VICDKGFPSYFLIVADLINYARSVDIRV

SEQ ID NO: 106027 - protein, 19 aa, Mycobacterium avium
VIDASGWSPARLDDVIRDT

SEQ ID NO: 106028 - protein, 18 aa, Mycobacterium avium
VIDASGWSPARVDDVIRD

SEQ ID NO: 106029 - protein, 22 aa, Mycobacterium avium
VIDGRAPFFALTVFARGLLNRL

SEQ ID NO: 106030 - protein, 19 aa, Mycobacterium avium
VIEGEPHIHCDLRFGTEGT

SEQ ID NO: 106031 - protein, 24 aa, Mycobacterium avium
VIEQMPLDAGHQWRRDAALSADAV

SEQ ID NO: 106032 - protein, 25 aa, Mycobacterium avium
VIEQMPLDAGHQWRRDAALSADAVL

SEQ ID NO: 106033 - protein, 20 aa, Mycobacterium avium
VIESRGGKAVSDFSDVGDEE

SEQ ID NO: 106034 - protein, 18 aa, Mycobacterium avium
VIGAQGFYIDVSTPHEQV

SEQ ID NO: 106035 - protein, 18 aa, Mycobacterium avium
VIGAQGFYIDVSTPHQQV

SEQ ID NO: 106036 - protein, 17 aa, Mycobacterium avium
VIGEIYIAGTHVAHGYH

SEQ ID NO: 106037 - protein, 18 aa, Mycobacterium avium
VIGSRFALELVESVVGED

SEQ ID NO: 106038 - protein, 20 aa, Mycobacterium avium
VIGSRFALELVESVVGEDQV

SEQ ID NO: 106039 - protein, 22 aa, Mycobacterium avium
VIGYTGAGTVEFLADDDGEFYF

SEQ ID NO: 106040 - protein, 27 aa, Mycobacterium avium
VIHDLCSATHPFGVGSPFWKEIDLPSY

SEQ ID NO: 106041 - protein, 25 aa, Mycobacterium avium
VIHLRGHTPGSIALALDGEATGGVT

SEQ ID NO: 106042 - protein, 18 aa, Mycobacterium avium
VIHPVEFEPPADYVTPER

SEQ ID NO: 106043 - protein, 18 aa, Mycobacterium avium
VIIAPAYQPAALDILTGK

SEQ ID NO: 106044 - protein, 18 aa, Mycobacterium avium
VIIAPAYQPAALDILTRK

SEQ ID NO: 106045 - protein, 18 aa, Mycobacterium avium
VIIAPAYQPAALEILTRK

SEQ ID NO: 106046 - protein, 17 aa, Mycobacterium avium
VIIRDGLWFDGTGGAAL

SEQ ID NO: 106047 - protein, 29 aa, Mycobacterium avium
VIKDGRPVDFGSFLIPRSEYRIDDVWHVV

SEQ ID NO: 106048 - protein, 18 aa, Mycobacterium avium
VILAMVLAAFEWGTERDT

SEQ ID NO: 106049 - protein, 22 aa, Mycobacterium avium
VIPDVLRHRLVLTYDALADEIS

SEQ ID NO: 106050 - protein, 20 aa, Mycobacterium avium
VIRIGGTVIYPPRHFPQYPG

SEQ ID NO: 106051 - protein, 17 aa, Mycobacterium avium
VIRKFCHQLPGWIDQAT

SEQ ID NO: 106052 - protein, 20 aa, Mycobacterium avium
VIRLSRHARHYLAIFDHGKA

SEQ ID NO: 106053 - protein, 26 aa, Mycobacterium avium
VIRTRGRLWLASRPSHAMWLESAGAG

SEQ ID NO: 106054 - protein, 26 aa, Mycobacterium avium
VISEDLKRLWPSLGTALTSLADGADL

SEQ ID NO: 106055 - protein, 17 aa, Mycobacterium avium
VITNPAGGFGTLASAGL

SEQ ID NO: 106056 - protein, 17 aa, Mycobacterium avium
VIVGLRDDLDLVLVDAD

SEQ ID NO: 106057 - protein, 22 aa, Mycobacterium avium
VIVRGGFKIAPETVVRALRSHG

SEQ ID NO: 106058 - protein, 17 aa, Mycobacterium avium
VKAELLGAARAARGDAG

SEQ ID NO: 106059 - protein, 17 aa, Mycobacterium avium
VKAGLDPAVMIEVLNAG

SEQ ID NO: 106060 - protein, 20 aa, Mycobacterium avium
VKAHGISGEIVVEIRTDDPA

SEQ ID NO: 106061 - protein, 27 aa, Mycobacterium avium
VKDGYGRNFLLPRGLAIVASRGAQKQA

SEQ ID NO: 106062 - protein, 23 aa, Mycobacterium avium
VKDLVSFLPVLAYDGSHMTQVDA

SEQ ID NO: 106063 - protein, 22 aa, Mycobacterium avium
VKDRAREALHHSVEPELLERLF

SEQ ID NO: 106064 - protein, 25 aa, Mycobacterium avium
VKEPRITALPGLWFEAARRVGFDVA

SEQ ID NO: 106065 - protein, 19 aa, Mycobacterium avium
VKETSGWTVSAGVDETHTH

SEQ ID NO: 106066 - protein, 17 aa, Mycobacterium avium
VKEVRLSNRLTDSPACL

SEQ ID NO: 106067 - protein, 19 aa, Mycobacterium avium
VKFLHDWAGPEAMIKKLSI

SEQ ID NO: 106068 - protein, 18 aa, Mycobacterium avium
VKGADLFPDVAAHQSDIL

SEQ ID NO: 106069 - protein, 37 aa, Mycobacterium avium
VKGIQRRRARIYCPRWVALFRWAKPVLSSRLGEMPLH

SEQ ID NO: 106070 - protein, 25 aa, Mycobacterium avium
VKGMLTGPVTILAWSFVRDDQPLAD

SEQ ID NO: 106071 - protein, 21 aa, Mycobacterium avium
VKHRCADMLVQVEGARSAQSH

SEQ ID NO: 106072 - protein, 20 aa, Mycobacterium avium
VKKLSPPRRRPVSEVTYREK

SEQ ID NO: 106073 - protein, 24 aa, Mycobacterium avium
VKLDYRTYSAQGWTIVANADGTRF

SEQ ID NO: 106074 - protein, 17 aa, Mycobacterium avium
VKLGLLPLLDAALDAVS

SEQ ID NO: 106075 - protein, 26 aa, Mycobacterium avium
VKLIRSKGVGVFFCTQLPTDIPNDVL

SEQ ID NO: 106076 - protein, 18 aa, Mycobacterium avium
VKNGQPFDPADCLAKRGS

SEQ ID NO: 106077 - protein, 28 aa, Mycobacterium avium
VKRAHDQFRWFAGGWKVNADLPTPAGFA

SEQ ID NO: 106078 - protein, 26 aa, Mycobacterium avium
VKRRYRAAHNIGHFRFVECSRLVDGR

SEQ ID NO: 106079 - protein, 17 aa, Mycobacterium avium
VKVPLGLTTQFNDVGLL

SEQ ID NO: 106080 - protein, 17 aa, Mycobacterium avium
VKVPLGLTTQFNGVGLL

SEQ ID NO: 106081 - protein, 17 aa, Mycobacterium avium
VKYHFKTDQGIQWLPQE

SEQ ID NO: 106082 - protein, 17 aa, Mycobacterium avium
VLAAPIGAFGFDSPLPP

SEQ ID NO: 106083 - protein, 25 aa, Mycobacterium avium
VLAAYPGHIARMLRLVFGDSADDHA

SEQ ID NO: 106084 - protein, 25 aa, Mycobacterium avium
VLAAYPGHIARMLRLVFGGSADDHA

SEQ ID NO: 106085 - protein, 17 aa, Mycobacterium avium
VLADALRRLPLPDHPGV

SEQ ID NO: 106086 - protein, 18 aa, Mycobacterium avium
VLADCKTEALAIKTMVDY

SEQ ID NO: 106087 - protein, 17 aa, Mycobacterium avium
VLADLVNEFAAVRLSLD

SEQ ID NO: 106088 - protein, 20 aa, Mycobacterium avium
VLAGELWSMASWLGLGGLSV

SEQ ID NO: 106089 - protein, 18 aa, Mycobacterium avium
VLAGWGGADVGRERLPIL

SEQ ID NO: 106090 - protein, 17 aa, Mycobacterium avium
VLAGWGGADVVRERLPI

SEQ ID NO: 106091 - protein, 18 aa, Mycobacterium avium
VLAGWTDLVCVIRAPLGD

SEQ ID NO: 106092 - protein, 17 aa, Mycobacterium avium
VLAHPILDLVGLHCHLG

SEQ ID NO: 106093 - protein, 17 aa, Mycobacterium avium
VLAIWCMDWPAVAAAAA

SEQ ID NO: 106094 - protein, 18 aa, Mycobacterium avium
VLALTRWAGEPDARDALG

SEQ ID NO: 106095 - protein, 24 aa, Mycobacterium avium
VLANAGIAPLAFRQVEHRGGTGPV

SEQ ID NO: 106096 - protein, 28 aa, Mycobacterium avium
VLARPATPVSVPARFAAQAARTPDAVAL

SEQ ID NO: 106097 - protein, 19 aa, Mycobacterium avium
VLAYPRVVWIAGGLLKGAS

SEQ ID NO: 106098 - protein, 20 aa, Mycobacterium avium
VLAYPRVVWIAGGLLKGASV

SEQ ID NO: 106099 - protein, 25 aa, Mycobacterium avium
VLAYPRVVWIAGGLLKGASVDAVVA

SEQ ID NO: 106100 - protein, 24 aa, Mycobacterium avium
VLDEWLRPVPPGVVGELYVAGAGV

SEQ ID NO: 106101 - protein, 18 aa, Mycobacterium avium
VLDGAGWSDDGMQSVVRV

SEQ ID NO: 106102 - protein, 25 aa, Mycobacterium avium
VLDKPRSVVLWTNCHHPFYDHNPYP

SEQ ID NO: 106103 - protein, 24 aa, Mycobacterium avium
VLDWSRAPFAEWFADGTLNVAYNC

SEQ ID NO: 106104 - protein, 25 aa, Mycobacterium avium
VLDYLVSRIPKWIDHEIVVVPYAMS

SEQ ID NO: 106105 - protein, 17 aa, Mycobacterium avium
VLEALTVTPTTDVADIV

SEQ ID NO: 106106 - protein, 19 aa, Mycobacterium avium
VLEAMGIPHTEVDLIVVNG

SEQ ID NO: 106107 - protein, 27 aa, Mycobacterium avium
VLEEAKQWPGVRVRVIPAMTAAQAVAS

SEQ ID NO: 106108 - protein, 17 aa, Mycobacterium avium
VLEPLGLTAEEPVGTRA

SEQ ID NO: 106109 - protein, 24 aa, Mycobacterium avium
VLEQYRPGEVITEAAFTSTSTDHT

SEQ ID NO: 106110 - protein, 22 aa, Mycobacterium avium
VLEVSGPCVMRGYWRNSELTAE

SEQ ID NO: 106111 - protein, 22 aa, Mycobacterium avium
VLEVTARLAAPLLPSVTELVWR

SEQ ID NO: 106112 - protein, 17 aa, Mycobacterium avium
VLFAFSVAENYDAKLKG

SEQ ID NO: 106113 - protein, 17 aa, Mycobacterium avium
VLFEEIGPFFADRNGGY

SEQ ID NO: 106114 - protein, 19 aa, Mycobacterium avium
VLFGEATTVIGARMDANGN

SEQ ID NO: 106115 - protein, 24 aa, Mycobacterium avium
VLGDGVGALGCLDDGGSVGAALSA

SEQ ID NO: 106116 - protein, 18 aa, Mycobacterium avium
VLGEAVALLRDMLNPDEL

SEQ ID NO: 106117 - protein, 17 aa, Mycobacterium avium
VLGGWTVGTDAGRHVEA

SEQ ID NO: 106118 - protein, 19 aa, Mycobacterium avium
VLGHGLFTDRWWTEVVEPE

SEQ ID NO: 106119 - protein, 19 aa, Mycobacterium avium
VLGPRGYRAVRLDRNRNNI

SEQ ID NO: 106120 - protein, 22 aa, Mycobacterium avium
VLGRAAGPLLRAGRVRLCGTVP

SEQ ID NO: 106121 - protein, 24 aa, Mycobacterium avium
VLGWPSINVPAGFTSDGLPIGVQL

SEQ ID NO: 106122 - protein, 29 aa, Mycobacterium avium
VLHRPKLGFPVPIRHWLRAGELQDWAYSM

SEQ ID NO: 106123 - protein, 24 aa, Mycobacterium avium
VLHYLPEFDMRTGAVLGTEALLRW

SEQ ID NO: 106124 - protein, 24 aa, Mycobacterium avium
VLKRTGRLSLRHALDMLEQTGRAL

SEQ ID NO: 106125 - protein, 24 aa, Mycobacterium avium
VLLAFSRRRLFAVIVLSIRDARVV

SEQ ID NO: 106126 - protein, 25 aa, Mycobacterium avium
VLLDHIPEALPIVYTPTVGEACQRF

SEQ ID NO: 106127 - protein, 19 aa, Mycobacterium avium
VLLGSRRRSTGVVKFPAER

SEQ ID NO: 106128 - protein, 23 aa, Mycobacterium avium
VLLPDVYYRSGEWAPFDMATVFA

SEQ ID NO: 106129 - protein, 23 aa, Mycobacterium avium
VLNHPGNGVAWLANRLAPHGVWL

SEQ ID NO: 106130 - protein, 24 aa, Mycobacterium avium
VLNHPGNGVAWLANRLSPHGVSLQ

SEQ ID NO: 106131 - protein, 17 aa, Mycobacterium avium
VLPAERADLGWRVVNAR

SEQ ID NO: 106132 - protein, 17 aa, Mycobacterium avium
VLPARRLPGYLRRFTRF

SEQ ID NO: 106133 - protein, 19 aa, Mycobacterium avium
VLPHLRAGSSIIGSSSVNS

SEQ ID NO: 106134 - protein, 29 aa, Mycobacterium avium
VLPQPVLQRLAALAGRFSSPKSAARQGDQ

SEQ ID NO: 106135 - protein, 25 aa, Mycobacterium avium
VLQIEGCKTWRVSDGPAVPPQQIQS

SEQ ID NO: 106136 - protein, 20 aa, Mycobacterium avium
VLQTGNPVTMAWLGAVNAVV

SEQ ID NO: 106137 - protein, 17 aa, Mycobacterium avium
VLRFIVDYQHSYSGVRM

SEQ ID NO: 106138 - protein, 18 aa, Mycobacterium avium
VLRHFSKKPADTHTVLVV

SEQ ID NO: 106139 - protein, 21 aa, Mycobacterium avium
VLRILRRRSLAALRAQVEPVS

SEQ ID NO: 106140 - protein, 20 aa, Mycobacterium avium
VLRRPELPALLSEVNLTGRQ

SEQ ID NO: 106141 - protein, 18 aa, Mycobacterium avium
VLRSFKRLLNDAGPQTRV

SEQ ID NO: 106142 - protein, 19 aa, Mycobacterium avium
VLRSGFVGAAIRCRRGATG

SEQ ID NO: 106143 - protein, 17 aa, Mycobacterium avium
VLRTWRIRLADGTEVES

SEQ ID NO: 106144 - protein, 18 aa, Mycobacterium avium
VLRVPRHPVRLAQFGPRA

SEQ ID NO: 106145 - protein, 17 aa, Mycobacterium avium
VLSLVVHHIASDHWSAG

SEQ ID NO: 106146 - protein, 24 aa, Mycobacterium avium
VLSRAQLLELVWGYDFAADTNVVD

SEQ ID NO: 106147 - protein, 19 aa, Mycobacterium avium
VLSRNGTYAAYRRLREHVA

SEQ ID NO: 106148 - protein, 18 aa, Mycobacterium avium
VLSSPGYRAAAQRAAAGI

SEQ ID NO: 106149 - protein, 18 aa, Mycobacterium avium
VLSVARLSSGTAPAAPCS

SEQ ID NO: 106150 - protein, 18 aa, Mycobacterium avium
VLTDPVWSERCSPSDIVG

SEQ ID NO: 106151 - protein, 23 aa, Mycobacterium avium
VLTRDLPQWGMAPLAPGEKAPLI

SEQ ID NO: 106152 - protein, 29 aa, Mycobacterium avium
VLVAPNFAIGAVLSMHFAKQAARFFDSAE

SEQ ID NO: 106153 - protein, 17 aa, Mycobacterium avium
VLVEHGQGLTVSRDLPK

SEQ ID NO: 106154 - protein, 24 aa, Mycobacterium avium
VLVIRGELRAVPAAAQASLLVLPV

SEQ ID NO: 106155 - protein, 19 aa, Mycobacterium avium
VLVRPNLLPLLVRKQLELT

SEQ ID NO: 106156 - protein, 22 aa, Mycobacterium avium
VLWGEGGTFCAGADLKAFGTPE

SEQ ID NO: 106157 - protein, 18 aa, Mycobacterium avium
VLWRKRFQREYGEPARYI

SEQ ID NO: 106158 - protein, 23 aa, Mycobacterium avium
VMADAAAALAEFDVPTEVRVVSA

SEQ ID NO: 106159 - protein, 23 aa, Mycobacterium avium
VMARGAAMHRLEVDDVHGWNHGA

SEQ ID NO: 106160 - protein, 18 aa, Mycobacterium avium
VMASRSAAEFVVETFEEG

SEQ ID NO: 106161 - protein, 21 aa, Mycobacterium avium
VMFTAMPFFWVGGLITGLHAV

SEQ ID NO: 106162 - protein, 27 aa, Mycobacterium avium
VMGSLPRLAAASGKTLGPRYGVIPTVM

SEQ ID NO: 106163 - protein, 17 aa, Mycobacterium avium
VMLALPGAVFIYNGEEL

SEQ ID NO: 106164 - protein, 19 aa, Mycobacterium avium
VMLKLSLPTEANFYRPLIE

SEQ ID NO: 106165 - protein, 19 aa, Mycobacterium avium
VMLSALWVGSTGRLVLIIH

SEQ ID NO: 106166 - protein, 24 aa, Mycobacterium avium
VMMAGCTYLPVGVDQPAERLSRIC

SEQ ID NO: 106167 - protein, 17 aa, Mycobacterium avium
VMMETPRAFLRAEEVAS

SEQ ID NO: 106168 - protein, 25 aa, Mycobacterium avium
VMPTTCPECGTPLAPAKEGDADIRC

SEQ ID NO: 106169 - protein, 21 aa, Mycobacterium avium
VMRSPHPFAATAIGLAVFLDK

SEQ ID NO: 106170 - protein, 22 aa, Mycobacterium avium
VMSRADIAAFLVAQLDDETFIR

SEQ ID NO: 106171 - protein, 23 aa, Mycobacterium avium
VMTSRTGHWVQWERADLFNKLVT

SEQ ID NO: 106172 - protein, 17 aa, Mycobacterium avium
VMVKAQVKTGGRGKAGG

SEQ ID NO: 106173 - protein, 17 aa, Mycobacterium avium
VNAALGITEQGFNSGDA

SEQ ID NO: 106174 - protein, 17 aa, Mycobacterium avium
VNADLPTPAGFAGATQF

SEQ ID NO: 106175 - protein, 27 aa, Mycobacterium avium
VNAEVELAWHILDPVLDNWASGGRPEP

SEQ ID NO: 106176 - protein, 18 aa, Mycobacterium avium
VNAPLPFVTLNTVGPTLI

SEQ ID NO: 106177 - protein, 17 aa, Mycobacterium avium
VNCCAPDDVLPAIGPAR

SEQ ID NO: 106178 - protein, 17 aa, Mycobacterium avium
VNECVRRVARWRPGPDG

SEQ ID NO: 106179 - protein, 23 aa, Mycobacterium avium
VNFRDVLVALGMYPGAAQLGAEG

SEQ ID NO: 106180 - protein, 23 aa, Mycobacterium avium
VNGRAVAMLTALGPQRRRWLSKA

SEQ ID NO: 106181 - protein, 30 aa, Mycobacterium avium
VNGSWNWSSGCDHATWAFLGGPVIKDGRPV

SEQ ID NO: 106182 - protein, 17 aa, Mycobacterium avium
VNHGWTYITGALDLERG

SEQ ID NO: 106183 - protein, 22 aa, Mycobacterium avium
VNHPARVAERIAILDLLSNGRV

SEQ ID NO: 106184 - protein, 23 aa, Mycobacterium avium
VNHRLALRNGVLVQRKVPADPTT

SEQ ID NO: 106185 - protein, 19 aa, Mycobacterium avium
VNIGLAYGIHVVITTPSWL

SEQ ID NO: 106186 - protein, 21 aa, Mycobacterium avium
VNIRGTFLLTKACLPYLRRAA

SEQ ID NO: 106187 - protein, 24 aa, Mycobacterium avium
VNIRIPGAPAFSIGYTQGADGEVT

SEQ ID NO: 106188 - protein, 20 aa, Mycobacterium avium
VNLAAALALQGLKTLVIDLD

SEQ ID NO: 106189 - protein, 17 aa, Mycobacterium avium
VNLDFAFSRDQRDKVYA

SEQ ID NO: 106190 - protein, 29 aa, Mycobacterium avium
VNLGRLAWLLRLFGFDVWWSNDADDQTLA

SEQ ID NO: 106191 - protein, 18 aa, Mycobacterium avium
VNLGRPDPGLDLPIVLGG

SEQ ID NO: 106192 - protein, 28 aa, Mycobacterium avium
VNLNGPFFLCRAALPELLERGGNIVNVS

SEQ ID NO: 106193 - protein, 18 aa, Mycobacterium avium
VNNAGWTAPGFIATDTDR

SEQ ID NO: 106194 - protein, 21 aa, Mycobacterium avium
VNNIHLVRGMLGRPGCGVLQM

SEQ ID NO: 106195 - protein, 25 aa, Mycobacterium avium
VNPGGRLPITFPVGLHQTPRPQLPG

SEQ ID NO: 106196 - protein, 17 aa, Mycobacterium avium
VNPIHWAYARISNEATT

SEQ ID NO: 106197 - protein, 20 aa, Mycobacterium avium
VNRARRIERFLSQNMMAAEQ

SEQ ID NO: 106198 - protein, 17 aa, Mycobacterium avium
VNRRVRAALAPYPDDLV

SEQ ID NO: 106199 - protein, 29 aa, Mycobacterium avium
VNRVKTWLQFPQWFYFNIPVNTMVAPRLT

SEQ ID NO: 106200 - protein, 23 aa, Mycobacterium avium
VNSEPRTGLSMGEHQATTAKQMG

SEQ ID NO: 106201 - protein, 19 aa, Mycobacterium avium
VNVARKFKTVRRVLGELPL

SEQ ID NO: 106202 - protein, 17 aa, Mycobacterium avium
VNVFGPVELTLALLPAL

SEQ ID NO: 106203 - protein, 19 aa, Mycobacterium avium
VNVKPKFAVDAMVATIGQQ

SEQ ID NO: 106204 - protein, 23 aa, Mycobacterium avium
VPAAIRLLAAIGYDVVLLETVGV

SEQ ID NO: 106205 - protein, 17 aa, Mycobacterium avium
VPACHYAPFEGAPSREQ

SEQ ID NO: 106206 - protein, 22 aa, Mycobacterium avium
VPADELAEWLAVARQRAGEPVG

SEQ ID NO: 106207 - protein, 18 aa, Mycobacterium avium
VPAEDLKPGALVFTPTAG

SEQ ID NO: 106208 - protein, 17 aa, Mycobacterium avium
VPAEVLEALTVTPTTDV

SEQ ID NO: 106209 - protein, 22 aa, Mycobacterium avium
VPAFGVRVLDAFEESPQSRAHD

SEQ ID NO: 106210 - protein, 23 aa, Mycobacterium avium
VPAHFPKDAWALGRFDGTPLYEH

SEQ ID NO: 106211 - protein, 26 aa, Mycobacterium avium
VPALAKLWAQACEWEDNPPKSLRLLQ

SEQ ID NO: 106212 - protein, 19 aa, Mycobacterium avium
VPAPRCWPGTSCAGAARCS

SEQ ID NO: 106213 - protein, 17 aa, Mycobacterium avium
VPARGQRVGDWVVDPQW

SEQ ID NO: 106214 - protein, 21 aa, Mycobacterium avium
VPARLHPGSFYALPQSPQLFK

SEQ ID NO: 106215 - protein, 22 aa, Mycobacterium avium
VPDERVGFVLADAAPIAAITGT

SEQ ID NO: 106216 - protein, 20 aa, Mycobacterium avium
VPDGLRCDDIYYGPTVPTHD

SEQ ID NO: 106217 - protein, 20 aa, Mycobacterium avium
VPDRCRSRCPAAGSRSRPRR

SEQ ID NO: 106218 - protein, 18 aa, Mycobacterium avium
VPDTYGFNGIDPAQTTGD

SEQ ID NO: 106219 - protein, 17 aa, Mycobacterium avium
VPEERWVFLHGHADMVD

SEQ ID NO: 106220 - protein, 25 aa, Mycobacterium avium
VPEEVWERFDMLPAQTIPKRAAKPI

SEQ ID NO: 106221 - protein, 17 aa, Mycobacterium avium
VPEGAIVVFSAHGVAPT

SEQ ID NO: 106222 - protein, 20 aa, Mycobacterium avium
VPELQRRGLFRTEYRSATLR

SEQ ID NO: 106223 - protein, 27 aa, Mycobacterium avium
VPEPFAVAAHHRRLMVASAVHETLVDR

SEQ ID NO: 106224 - protein, 23 aa, Mycobacterium avium
VPEPPARPVLVVDFGAQYAQLIA

SEQ ID NO: 106225 - protein, 18 aa, Mycobacterium avium
VPEPVLALIGKDLPPVSG

SEQ ID NO: 106226 - protein, 17 aa, Mycobacterium avium
VPERERSVVVQRVRERA

SEQ ID NO: 106227 - protein, 24 aa, Mycobacterium avium
VPETRLGETLAAFIVPTDLVHPPR

SEQ ID NO: 106228 - protein, 27 aa, Mycobacterium avium
VPEVPVPRPGWLPWRAAVAARTHCQLV

SEQ ID NO: 106229 - protein, 27 aa, Mycobacterium avium
VPEVPVPRPGWLPWRAAVAARTHRQLV

SEQ ID NO: 106230 - protein, 21 aa, Mycobacterium avium
VPFTKRGRMADEYLEAMFELW

SEQ ID NO: 106231 - protein, 18 aa, Mycobacterium avium
VPGAGVLNVDAHTAVVLR

SEQ ID NO: 106232 - protein, 17 aa, Mycobacterium avium
VPGCTAVGAIENITAVE

SEQ ID NO: 106233 - protein, 20 aa, Mycobacterium avium
VPGDALASFPEEFRQGMAAR

SEQ ID NO: 106234 - protein, 18 aa, Mycobacterium avium
VPGDDLLGVRDWRNYPGF

SEQ ID NO: 106235 - protein, 20 aa, Mycobacterium avium
VPGGDIKPEHLILIGQIAQD

SEQ ID NO: 106236 - protein, 17 aa, Mycobacterium avium
VPGMITGFVPLVLKASP

SEQ ID NO: 106237 - protein, 23 aa, Mycobacterium avium
VPGPTALLAPEWVPWEQRVRPGD

SEQ ID NO: 106238 - protein, 21 aa, Mycobacterium avium
VPGRPRGCGLLHCEHDTWLLT

SEQ ID NO: 106239 - protein, 22 aa, Mycobacterium avium
VPGTALLVLDGWLRPVPAGVVG

SEQ ID NO: 106240 - protein, 19 aa, Mycobacterium avium
VPGVLTARVTPGATTLDVQ

SEQ ID NO: 106241 - protein, 21 aa, Mycobacterium avium
VPIFLRAGKALPHKVTEVRMF

SEQ ID NO: 106242 - protein, 17 aa, Mycobacterium avium
VPISAIFFGGRRAGAIP

SEQ ID NO: 106243 - protein, 18 aa, Mycobacterium avium
VPLFRKLLRNTRLEVDVT

SEQ ID NO: 106244 - protein, 24 aa, Mycobacterium avium
VPLIPKRVFRRLLGVVTGGATTVV

SEQ ID NO: 106245 - protein, 18 aa, Mycobacterium avium
VPLPAWTHRHLLLGLDSR

SEQ ID NO: 106246 - protein, 24 aa, Mycobacterium avium
VPLRAIAEMIGRRLGVPVESAPAD

SEQ ID NO: 106247 - protein, 20 aa, Mycobacterium avium
VPLRHKLAGAGRRRAARSQP

SEQ ID NO: 106248 - protein, 19 aa, Mycobacterium avium
VPMVFPVWFENLQVKYLNS

SEQ ID NO: 106249 - protein, 19 aa, Mycobacterium avium
VPNALGVTDHLAFRVQTYG

SEQ ID NO: 106250 - protein, 21 aa, Mycobacterium avium
VPNFLGLDYWQMWHYGDSTMA

SEQ ID NO: 106251 - protein, 17 aa, Mycobacterium avium
VPNPAAAALEAQVYPSP

SEQ ID NO: 106252 - protein, 19 aa, Mycobacterium avium
VPNSLGVTDHLAFRVQTYG

SEQ ID NO: 106253 - protein, 23 aa, Mycobacterium avium
VPPDRSRTAFTLLHGVADDVVPV

SEQ ID NO: 106254 - protein, 18 aa, Mycobacterium avium
VPPGGRWQTEVMVQPTWS

SEQ ID NO: 106255 - protein, 18 aa, Mycobacterium avium
VPPKQFWREFDIPREVKK

SEQ ID NO: 106256 - protein, 24 aa, Mycobacterium avium
VPPTHKWARRSRVVTARELAQTPL

SEQ ID NO: 106257 - protein, 19 aa, Mycobacterium avium
VPPTPWSAQGMFDILRAER

SEQ ID NO: 106258 - protein, 17 aa, Mycobacterium avium
VPPTPWSAQGMFDVLRN

SEQ ID NO: 106259 - protein, 24 aa, Mycobacterium avium
VPRIWEKLKAGIEFTVANEQDEST

SEQ ID NO: 106260 - protein, 21 aa, Mycobacterium avium
VPRNELIAFFVAADVMLVTPL

SEQ ID NO: 106261 - protein, 23 aa, Mycobacterium avium
VPRPEGQPALGLGEVDGPYHQAL

SEQ ID NO: 106262 - protein, 25 aa, Mycobacterium avium
VPRPRAPLAAATIWAIDEFTADNGA

SEQ ID NO: 106263 - protein, 17 aa, Mycobacterium avium
VPSARRYLPGSLIMETT

SEQ ID NO: 106264 - protein, 24 aa, Mycobacterium avium
VPSGWRNLPSGFQLKDYRDDEGHE

SEQ ID NO: 106265 - protein, 17 aa, Mycobacterium avium
VPSLLGLFLSLPGASQW

SEQ ID NO: 106266 - protein, 27 aa, Mycobacterium avium
VPTACCFENRWNPDWLAVADRVRSGFL

SEQ ID NO: 106267 - protein, 20 aa, Mycobacterium avium
VPTPSGWEVTTHGGRRGTGI

SEQ ID NO: 106268 - protein, 24 aa, Mycobacterium avium
VPTWAGVAYVCFIIDAYSRMIVGW

SEQ ID NO: 106269 - protein, 25 aa, Mycobacterium avium
VPTWAGVAYVCFLTDAFSRMIIGWR

SEQ ID NO: 106270 - protein, 19 aa, Mycobacterium avium
VPVCVGYRIDGARVNEMPM

SEQ ID NO: 106271 - protein, 17 aa, Mycobacterium avium
VPVCVGYRIDGSRINEM

SEQ ID NO: 106272 - protein, 26 aa, Mycobacterium avium
VPVDELIRRRLLREITPPNDKLAIGY

SEQ ID NO: 106273 - protein, 26 aa, Mycobacterium avium
VPVDGVKAWKGIRYAAPPIGDLRFRA

SEQ ID NO: 106274 - protein, 29 aa, Mycobacterium avium
VPVEGFLPTLLDWCRRNDVLFIADEVQTG

SEQ ID NO: 106275 - protein, 18 aa, Mycobacterium avium
VPVEGLNLLSPVTAPCRV

SEQ ID NO: 106276 - protein, 22 aa, Mycobacterium avium
VPVEPGFRIPLGQADIKRPGTD

SEQ ID NO: 106277 - protein, 17 aa, Mycobacterium avium
VPVGAPGEIWVRGYSLM

SEQ ID NO: 106278 - protein, 17 aa, Mycobacterium avium
VPVGVGFAKRSGLVRDG

SEQ ID NO: 106279 - protein, 19 aa, Mycobacterium avium
VPVPLGRHLFGASYARTGT

SEQ ID NO: 106280 - protein, 24 aa, Mycobacterium avium
VPVRNRWGLHPARVAATGQMAPLT

SEQ ID NO: 106281 - protein, 26 aa, Mycobacterium avium
VPVRRVGKHLVCTVFDLMLAQYGVER

SEQ ID NO: 106282 - protein, 17 aa, Mycobacterium avium
VPVRVGRHAGWRALRRA

SEQ ID NO: 106283 - protein, 25 aa, Mycobacterium avium
VPVVPRAATAPSWLPEAPSVADLGW

SEQ ID NO: 106284 - protein, 20 aa, Mycobacterium avium
VQAGELLFRAQGRSLALTDC

SEQ ID NO: 106285 - protein, 23 aa, Mycobacterium avium
VQAGLPVGCLPGPSAVMTALAVS

SEQ ID NO: 106286 - protein, 24 aa, Mycobacterium avium
VQAIAPGRCAAVAVPAEGTEKVVV

SEQ ID NO: 106287 - protein, 17 aa, Mycobacterium avium
VQFAAAMGFETIAINRG

SEQ ID NO: 106288 - protein, 17 aa, Mycobacterium avium
VQHGIRDARIDLGDRTV

SEQ ID NO: 106289 - protein, 17 aa, Mycobacterium avium
VQHHVFGPLGMHDTRYL

SEQ ID NO: 106290 - protein, 22 aa, Mycobacterium avium
VQLHGFGVGVVRQQGGDGLGRV

SEQ ID NO: 106291 - protein, 17 aa, Mycobacterium avium
VQLMAATLAHWGLLTFS

SEQ ID NO: 106292 - protein, 25 aa, Mycobacterium avium
VQLTNRLECAVAYEAVLMCGATLVP

SEQ ID NO: 106293 - protein, 25 aa, Mycobacterium avium
VQLTRKRLGTGLVEAFSTSCPNCGG

SEQ ID NO: 106294 - protein, 17 aa, Mycobacterium avium
VQNAYNLVDRAAQPVLD

SEQ ID NO: 106295 - protein, 24 aa, Mycobacterium avium
VQPGEIPKYLGIIDDKGHAAVSLN

SEQ ID NO: 106296 - protein, 19 aa, Mycobacterium avium
VQQNWRLIAVLDMGWEDYL

SEQ ID NO: 106297 - protein, 17 aa, Mycobacterium avium
VQRFCLRGLGIADEVID

SEQ ID NO: 106298 - protein, 24 aa, Mycobacterium avium
VQRGLWFEEFEIGTTYLHRPGRTI

SEQ ID NO: 106299 - protein, 27 aa, Mycobacterium avium
VQRIYCRLVLRCFGVRITVSGNPIRNL

SEQ ID NO: 106300 - protein, 33 aa, Mycobacterium avium
VQRLIRFMPKVVICLVNGWAAGGGHSLHVVCDL

SEQ ID NO: 106301 - protein, 18 aa, Mycobacterium avium
VQRVFYGWAQVWRTKSRE

SEQ ID NO: 106302 - protein, 19 aa, Mycobacterium avium
VQRVFYGWAQVWRTKSREA

SEQ ID NO: 106303 - protein, 18 aa, Mycobacterium avium
VQRWLDVVGLREFAGHYP

SEQ ID NO: 106304 - protein, 17 aa, Mycobacterium avium
VQSLIRWDPVGHAESEL

SEQ ID NO: 106305 - protein, 18 aa, Mycobacterium avium
VQSLIRWDPVGHAESELT

SEQ ID NO: 106306 - protein, 33 aa, Mycobacterium avium
VQSLSMTPLVNWRIPGPELKFEERWMPPTHVEA

SEQ ID NO: 106307 - protein, 22 aa, Mycobacterium avium
VQTGMGCTGTFFAHQHDGITPD

SEQ ID NO: 106308 - protein, 18 aa, Mycobacterium avium
VQVARLGLMNAVNRFDPA

SEQ ID NO: 106309 - protein, 19 aa, Mycobacterium avium
VQVARLGLMNAVNRFDPAK

SEQ ID NO: 106310 - protein, 18 aa, Mycobacterium avium
VQVIPADPTMAWRYLELH

SEQ ID NO: 106311 - protein, 17 aa, Mycobacterium avium
VQVMGAAALHFGNVAEM

SEQ ID NO: 106312 - protein, 23 aa, Mycobacterium avium
VQWNTEAWQRCAYFTEVRQAGGD

SEQ ID NO: 106313 - protein, 23 aa, Mycobacterium avium
VQWNTEAWQRCAYFTEVRRAGGD

SEQ ID NO: 106314 - protein, 31 aa, Mycobacterium avium
VQYPNVNPALLLKCLLMAATEGIASGDPVSA

SEQ ID NO: 106315 - protein, 32 aa, Mycobacterium avium
VRAAAEELRRLWRARRVLAVTFPSHTSATETA

SEQ ID NO: 106316 - protein, 20 aa, Mycobacterium avium
VRAANLVWMLGRPADAALIL

SEQ ID NO: 106317 - protein, 20 aa, Mycobacterium avium
VRAANLVWMLGRPADAALVL

SEQ ID NO: 106318 - protein, 18 aa, Mycobacterium avium
VRAAPSLVIAEKLVEFGA

SEQ ID NO: 106319 - protein, 18 aa, Mycobacterium avium
VRALDAMSSWWTAIHGHG

SEQ ID NO: 106320 - protein, 28 aa, Mycobacterium avium
VRAPGYLSWLMGCDMRGTICITGGCSNS

SEQ ID NO: 106321 - protein, 18 aa, Mycobacterium avium
VRAQEIFDYSAYPNEYLM

SEQ ID NO: 106322 - protein, 17 aa, Mycobacterium avium
VRARLMVRSALRESGRR

SEQ ID NO: 106323 - protein, 21 aa, Mycobacterium avium
VRARNPKIIYARGHGYGTKGD

SEQ ID NO: 106324 - protein, 23 aa, Mycobacterium avium
VRARWERRLAEVGVGELHAELAR

SEQ ID NO: 106325 - protein, 23 aa, Mycobacterium avium
VRARWERRLGEVGVGELHAELAR

SEQ ID NO: 106326 - protein, 24 aa, Mycobacterium avium
VRASDGWIGINCLTGQHWLDVCAM

SEQ ID NO: 106327 - protein, 29 aa, Mycobacterium avium
VRATRPATVVEFGMSFGISAVHLAAAVRD

SEQ ID NO: 106328 - protein, 23 aa, Mycobacterium avium
VRAYAAGIADWFTVLSHTGHVWD

SEQ ID NO: 106329 - protein, 19 aa, Mycobacterium avium
VRCSMWSTRLLQISARVVG

SEQ ID NO: 106330 - protein, 21 aa, Mycobacterium avium
VRDGRACLIESHLQRLTQSAA

SEQ ID NO: 106331 - protein, 23 aa, Mycobacterium avium
VRDGRARLVLRRETVDDLLSLEV

SEQ ID NO: 106332 - protein, 18 aa, Mycobacterium avium
VREAGGVVYLWHAADGSA

SEQ ID NO: 106333 - protein, 17 aa, Mycobacterium avium
VREALAMADSDPIHPGQ

SEQ ID NO: 106334 - protein, 19 aa, Mycobacterium avium
VREALRLGHNYVGTEHQLL

SEQ ID NO: 106335 - protein, 26 aa, Mycobacterium avium
VREAVLALRARKGMVLDAADHDTWSV

SEQ ID NO: 106336 - protein, 26 aa, Mycobacterium avium
VRERLPILCGLDLTRKVAMTPDHLTR

SEQ ID NO: 106337 - protein, 18 aa, Mycobacterium avium
VRFRNRFVRTRHYLRSTA

SEQ ID NO: 106338 - protein, 30 aa, Mycobacterium avium
VRGAMGFRLPVDKRKGAALNLFSDTPNMFD

SEQ ID NO: 106339 - protein, 18 aa, Mycobacterium avium
VRGGLGGFAGLFALRGEY

SEQ ID NO: 106340 - protein, 22 aa, Mycobacterium avium
VRGGLLEIGRKLNIPPLATNDC

SEQ ID NO: 106341 - protein, 18 aa, Mycobacterium avium
VRGGVYWDAYRDPVSNVV

SEQ ID NO: 106342 - protein, 18 aa, Mycobacterium avium
VRGLALMAEVWPLRPDCR

SEQ ID NO: 106343 - protein, 24 aa, Mycobacterium avium
VRGRIKELINRGGEKISPERVEGV

SEQ ID NO: 106344 - protein, 20 aa, Mycobacterium avium
VRGRLRGIPNVTLRDEHCVT

SEQ ID NO: 106345 - protein, 23 aa, Mycobacterium avium
VRGSRMAVRKGLTMPIYEAELLA

SEQ ID NO: 106346 - protein, 20 aa, Mycobacterium avium
VRGVLYFRTGRWPDVLNQFP

SEQ ID NO: 106347 - protein, 18 aa, Mycobacterium avium
VRGWLTVVASRLCLDQLR

SEQ ID NO: 106348 - protein, 23 aa, Mycobacterium avium
VRHRRLSYAGAMTALTAGAISFV

SEQ ID NO: 106349 - protein, 19 aa, Mycobacterium avium
VRHSFDLATEIPLRARLFR

SEQ ID NO: 106350 - protein, 24 aa, Mycobacterium avium
VRHSFDLATEIPLRARLFRIADDE

SEQ ID NO: 106351 - protein, 24 aa, Mycobacterium avium
VRHTVFPVARWQYDIVGTDGGCDV

SEQ ID NO: 106352 - protein, 19 aa, Mycobacterium avium
VRHVLGGSVADDLVVVAID

SEQ ID NO: 106353 - protein, 18 aa, Mycobacterium avium
VRINDIPEVLGARGYAAD

SEQ ID NO: 106354 - protein, 20 aa, Mycobacterium avium
VRKAAVLALTRWAGEPDARD

SEQ ID NO: 106355 - protein, 19 aa, Mycobacterium avium
VRKAIDFVIDMQVGYGEIA

SEQ ID NO: 106356 - protein, 19 aa, Mycobacterium avium
VRKAIDFVIDMQVGYGEIT

SEQ ID NO: 106357 - protein, 18 aa, Mycobacterium avium
VRLAREGANIIGIDICAD

SEQ ID NO: 106358 - protein, 17 aa, Mycobacterium avium
VRLARPGAVIVADNVIR

SEQ ID NO: 106359 - protein, 20 aa, Mycobacterium avium
VRLDGYRLQPINTIEVLGLE

SEQ ID NO: 106360 - protein, 31 aa, Mycobacterium avium
VRLGGPGSWLLALPAHHIAGVQVLVRSLLAG

SEQ ID NO: 106361 - protein, 17 aa, Mycobacterium avium
VRLGLGAVRHIGDDLAE

SEQ ID NO: 106362 - protein, 21 aa, Mycobacterium avium
VRLKGAEAMRQAWDNDGVDVL

SEQ ID NO: 106363 - protein, 18 aa, Mycobacterium avium
VRLLINFSLNNEAFGADG

SEQ ID NO: 106364 - protein, 18 aa, Mycobacterium avium
VRLLPPARAAGVRIVHCL

SEQ ID NO: 106365 - protein, 17 aa, Mycobacterium avium
VRLPRAVHDAGGRYGLV

SEQ ID NO: 106366 - protein, 17 aa, Mycobacterium avium
VRLRPRPHQTFRELLAQ

SEQ ID NO: 106367 - protein, 20 aa, Mycobacterium avium
VRLRWPCPVPGAMPVSEVGD

SEQ ID NO: 106368 - protein, 21 aa, Mycobacterium avium
VRLRWPCPVPGAMPVSEVGDA

SEQ ID NO: 106369 - protein, 23 aa, Mycobacterium avium
VRMSARRFWVRYAAEAAGALTLD

SEQ ID NO: 106370 - protein, 21 aa, Mycobacterium avium
VRNGLEPCVARAKAYAPYSDL

SEQ ID NO: 106371 - protein, 18 aa, Mycobacterium avium
VRNGVIARKGRAHGLPTP

SEQ ID NO: 106372 - protein, 24 aa, Mycobacterium avium
VRPELKTLPGMVAGVVPLVLSLAP

SEQ ID NO: 106373 - protein, 20 aa, Mycobacterium avium
VRPGGVWAYEAHRVASRRPR

SEQ ID NO: 106374 - protein, 27 aa, Mycobacterium avium
VRPGQLGDVLLQFGRPVYLHARAEMVG

SEQ ID NO: 106375 - protein, 19 aa, Mycobacterium avium
VRPLLMPALQPEIRLAAPL

SEQ ID NO: 106376 - protein, 18 aa, Mycobacterium avium
VRPTVWAAVPRIWEKLKA

SEQ ID NO: 106377 - protein, 21 aa, Mycobacterium avium
VRQEPRLNWAIGDRADGTTIL

SEQ ID NO: 106378 - protein, 23 aa, Mycobacterium avium
VRQPDYLTAFAALWESLDLDEWK

SEQ ID NO: 106379 - protein, 24 aa, Mycobacterium avium
VRQPDYLTAFAALWESLDLDEWKW

SEQ ID NO: 106380 - protein, 21 aa, Mycobacterium avium
VRQWIEAEVPAAWRSAAAKDP

SEQ ID NO: 106381 - protein, 21 aa, Mycobacterium avium
VRRGEALVVPQVFFTKSGEVV

SEQ ID NO: 106382 - protein, 17 aa, Mycobacterium avium
VRRIREHPGLTVGLEPL

SEQ ID NO: 106383 - protein, 17 aa, Mycobacterium avium
VRRLLQRLIDRFPGGEM

SEQ ID NO: 106384 - protein, 17 aa, Mycobacterium avium
VRRMSLVGPRGYVAERM

SEQ ID NO: 106385 - protein, 21 aa, Mycobacterium avium
VRRRDCWVFAFAFAGRPGVRL

SEQ ID NO: 106386 - protein, 33 aa, Mycobacterium avium
VRRRHRRGQLGFGDFRPGRRFAGPHSDAGAAAR

SEQ ID NO: 106387 - protein, 23 aa, Mycobacterium avium
VRSALRAAGFADLVTLDRPDHEV

SEQ ID NO: 106388 - protein, 20 aa, Mycobacterium avium
VRSALRAAGFTDLVTLDRPY

SEQ ID NO: 106389 - protein, 17 aa, Mycobacterium avium
VRSGAALSMPGMMDTVL

SEQ ID NO: 106390 - protein, 17 aa, Mycobacterium avium
VRSGRHLFGPTFDRDKL

SEQ ID NO: 106391 - protein, 19 aa, Mycobacterium avium
VRSGWKVAEAFPATPVPGV

SEQ ID NO: 106392 - protein, 25 aa, Mycobacterium avium
VRSICYLPLTYDHRLIDGADAGRFL

SEQ ID NO: 106393 - protein, 22 aa, Mycobacterium avium
VRSLGVPAWLSYTIDGAHTRAG

SEQ ID NO: 106394 - protein, 21 aa, Mycobacterium avium
VRSLVWVRGRLHEVDPAQILE

SEQ ID NO: 106395 - protein, 26 aa, Mycobacterium avium
VRSLVWVRGRLREVDPAQILETLDVI

SEQ ID NO: 106396 - protein, 24 aa, Mycobacterium avium
VRSQLRGATFLDLPRLPHQLIYAT

SEQ ID NO: 106397 - protein, 21 aa, Mycobacterium avium
VRSSARLAGGIVGYRIPEIRP

SEQ ID NO: 106398 - protein, 18 aa, Mycobacterium avium
VRSVLTCTTGTGVCAICY

SEQ ID NO: 106399 - protein, 20 aa, Mycobacterium avium
VRTAMGGAQARRLCPHAVVV

SEQ ID NO: 106400 - protein, 21 aa, Mycobacterium avium
VRTCGRSCGGRARFMSDPVPS

SEQ ID NO: 106401 - protein, 17 aa, Mycobacterium avium
VRTGAWQAGNRAPLPEL

SEQ ID NO: 106402 - protein, 18 aa, Mycobacterium avium
VRTLLARARELFGPNPVE

SEQ ID NO: 106403 - protein, 18 aa, Mycobacterium avium
VRVAQRLTALTGESDDRV

SEQ ID NO: 106404 - protein, 19 aa, Mycobacterium avium
VRVARPVIECHVGDQLGAG

SEQ ID NO: 106405 - protein, 22 aa, Mycobacterium avium
VRVKGTPDAAGWASPLRSAGAW

SEQ ID NO: 106406 - protein, 18 aa, Mycobacterium avium
VRVPERFDIGEGYGKTSW

SEQ ID NO: 106407 - protein, 20 aa, Mycobacterium avium
VRVSDRIDFWLWLDAGFGDH

SEQ ID NO: 106408 - protein, 20 aa, Mycobacterium avium
VRWRADGQLDYLGRADEQVK

SEQ ID NO: 106409 - protein, 17 aa, Mycobacterium avium
VRYEAGPDGVRRSQANH

SEQ ID NO: 106410 - protein, 17 aa, Mycobacterium avium
VRYGELLSHERTLDLRA

SEQ ID NO: 106411 - protein, 34 aa, Mycobacterium avium
VRYPEWDVARGSYRPAWCTVREVEPAITARATLA

SEQ ID NO: 106412 - protein, 17 aa, Mycobacterium avium
VRYQRYSKLASFSRTTG

SEQ ID NO: 106413 - protein, 17 aa, Mycobacterium avium
VSAAIAYLVSDEARYVT

SEQ ID NO: 106414 - protein, 19 aa, Mycobacterium avium
VSAAIAYLVSDEARYVTGV

SEQ ID NO: 106415 - protein, 19 aa, Mycobacterium avium
VSAASWAQCEHEFKRDTTV

SEQ ID NO: 106416 - protein, 19 aa, Mycobacterium avium
VSAASWAQCEHEFNGDTTV

SEQ ID NO: 106417 - protein, 19 aa, Mycobacterium avium
VSAASWAQCEHEFNRDTTV

SEQ ID NO: 106418 - protein, 23 aa, Mycobacterium avium
VSACTGSPGCARSAADVRADAAL

SEQ ID NO: 106419 - protein, 23 aa, Mycobacterium avium
VSACTGSPGCARSTADVRADAAL

SEQ ID NO: 106420 - protein, 19 aa, Mycobacterium avium
VSAGFPSPLPYLVSPDEQS

SEQ ID NO: 106421 - protein, 19 aa, Mycobacterium avium
VSALNRPVSTTGESGNQNT

SEQ ID NO: 106422 - protein, 22 aa, Mycobacterium avium
VSALTAAQFAAHAQMYQAVSAQ

SEQ ID NO: 106423 - protein, 20 aa, Mycobacterium avium
VSAQLPLPVTILELDDGSIR

SEQ ID NO: 106424 - protein, 26 aa, Mycobacterium avium
VSARTGVGMPDWLAWLRRFMEGTPTA

SEQ ID NO: 106425 - protein, 17 aa, Mycobacterium avium
VSASFLWAPDPGPMRLV

SEQ ID NO: 106426 - protein, 17 aa, Mycobacterium avium
VSDEAKFITGVAWPLDA

SEQ ID NO: 106427 - protein, 19 aa, Mycobacterium avium
VSDEARFITGTAWPLDAGF

SEQ ID NO: 106428 - protein, 20 aa, Mycobacterium avium
VSDFPVDRGWDVEGLYDPDP

SEQ ID NO: 106429 - protein, 20 aa, Mycobacterium avium
VSEDEPFNWADRGGGYIRSR

SEQ ID NO: 106430 - protein, 18 aa, Mycobacterium avium
VSEIVTGYGMTECGGCMS

SEQ ID NO: 106431 - protein, 18 aa, Mycobacterium avium
VSETVLFLVSDSGRYYTG

SEQ ID NO: 106432 - protein, 19 aa, Mycobacterium avium
VSFRLRRARTLAIAGESGS

SEQ ID NO: 106433 - protein, 20 aa, Mycobacterium avium
VSFWRAVQTRVWRGRPDPAR

SEQ ID NO: 106434 - protein, 24 aa, Mycobacterium avium
VSFWRAVQTRVWRGRPDPARDARA

SEQ ID NO: 106435 - protein, 25 aa, Mycobacterium avium
VSFWRAVQTRVWRGRPDPARDARAT

SEQ ID NO: 106436 - protein, 20 aa, Mycobacterium avium
VSGEYAMICAAAANNWIDER

SEQ ID NO: 106437 - protein, 25 aa, Mycobacterium avium
VSGIRRWLHTLGFRGHITSKSRRYS

SEQ ID NO: 106438 - protein, 18 aa, Mycobacterium avium
VSGRPGGVFLDIPGDVLG

SEQ ID NO: 106439 - protein, 19 aa, Mycobacterium avium
VSGTVVFPGAGFVELAIRA

SEQ ID NO: 106440 - protein, 23 aa, Mycobacterium avium
VSKFVAAPGARTGWSSLFEDLSR

SEQ ID NO: 106441 - protein, 24 aa, Mycobacterium avium
VSLEYQPKCRDFALAIDDEPALIR

SEQ ID NO: 106442 - protein, 17 aa, Mycobacterium avium
VSLPLDCTYDFEVTAAK

SEQ ID NO: 106443 - protein, 17 aa, Mycobacterium avium
VSMDFYTRVVGLEPVRF

SEQ ID NO: 106444 - protein, 27 aa, Mycobacterium avium
VSMSAFRSAVFVPGYASSKMGLVALTM

SEQ ID NO: 106445 - protein, 18 aa, Mycobacterium avium
VSNAILFLISDAGRSFTG

SEQ ID NO: 106446 - protein, 30 aa, Mycobacterium avium
VSPRGYRALAGIPRLQFAHADLLVRSFGTL

SEQ ID NO: 106447 - protein, 22 aa, Mycobacterium avium
VSPRKARRVIDLVRGRSVTDAL

SEQ ID NO: 106448 - protein, 21 aa, Mycobacterium avium
VSQAFDWQHGVFLASTLSSET

SEQ ID NO: 106449 - protein, 18 aa, Mycobacterium avium
VSRDLAVVRLRLDQPMPY

SEQ ID NO: 106450 - protein, 21 aa, Mycobacterium avium
VSRFLGPWVPEPQLWQDPVPP

SEQ ID NO: 106451 - protein, 18 aa, Mycobacterium avium
VSRGEFVAVLGPNGSGKT

SEQ ID NO: 106452 - protein, 18 aa, Mycobacterium avium
VSRLQKLGANPIFNAAGI

SEQ ID NO: 106453 - protein, 18 aa, Mycobacterium avium
VSRVRWVGYGGAPIAPSL

SEQ ID NO: 106454 - protein, 18 aa, Mycobacterium avium
VSSASPAWARLADPELSW

SEQ ID NO: 106455 - protein, 24 aa, Mycobacterium avium
VSSLRCVIHAAAPCPVDVKHRMMR

SEQ ID NO: 106456 - protein, 26 aa, Mycobacterium avium
VSSVPPVPGKFYWMTPTQLRWRPLSF

SEQ ID NO: 106457 - protein, 18 aa, Mycobacterium avium
VSTCNLLLIAGHETTVNL

SEQ ID NO: 106458 - protein, 25 aa, Mycobacterium avium
VSVDYRLAPENAWPAAAEDVYAVTC

SEQ ID NO: 106459 - protein, 27 aa, Mycobacterium avium
VSVGYPREWRRRKPYGWLRQVLPDPQY

SEQ ID NO: 106460 - protein, 22 aa, Mycobacterium avium
VSVPDCQGALYTTQDPVYAGSG

SEQ ID NO: 106461 - protein, 20 aa, Mycobacterium avium
VSVQEIWGALAGGGGLVVVP

SEQ ID NO: 106462 - protein, 20 aa, Mycobacterium avium
VSVQEIWGALAGGGRLVVVP

SEQ ID NO: 106463 - protein, 24 aa, Mycobacterium avium
VSVQEIWGALAGGGRLVVVPESVT

SEQ ID NO: 106464 - protein, 18 aa, Mycobacterium avium
VSVSLFDALVEWMSQPLY

SEQ ID NO: 106465 - protein, 25 aa, Mycobacterium avium
VSVTMPGKFAALRFADERTEQARRV

SEQ ID NO: 106466 - protein, 26 aa, Mycobacterium avium
VSVTPAPGWTLGNRGPNWVALNNSDT

SEQ ID NO: 106467 - protein, 23 aa, Mycobacterium avium
VSVTSLVAIPWAQGDRSGVAFRA

SEQ ID NO: 106468 - protein, 22 aa, Mycobacterium avium
VSWLPCFHDMGMVGFLTIPMYF

SEQ ID NO: 106469 - protein, 32 aa, Mycobacterium avium
VSYERLRRQPLQWPCVPQSTADRNPIRYLNDG

SEQ ID NO: 106470 - protein, 17 aa, Mycobacterium avium
VTAAAATQVEWLTATAE

SEQ ID NO: 106471 - protein, 17 aa, Mycobacterium avium
VTAAFVTRGLRHDKLSW

SEQ ID NO: 106472 - protein, 25 aa, Mycobacterium avium
VTAALDIRPALLVHTSLATVQFVLD

SEQ ID NO: 106473 - protein, 25 aa, Mycobacterium avium
VTACFRCAVCVEQLRATDDVLLVAG

SEQ ID NO: 106474 - protein, 22 aa, Mycobacterium avium
VTAMRDAMQWVHDRVIDAMVSG

SEQ ID NO: 106475 - protein, 25 aa, Mycobacterium avium
VTAPLRGPGLDKLRVLAEVVYDPWI

SEQ ID NO: 106476 - protein, 40 aa, Mycobacterium avium
VTASLRADGEFSYTLAQPWGVIGAIITWNGPLISLAMKVP

SEQ ID NO: 106477 - protein, 18 aa, Mycobacterium avium
VTATIAGYFARRPDRSAD

SEQ ID NO: 106478 - protein, 26 aa, Mycobacterium avium
VTCQKYARRGLITFLGEDVGNPVATA

SEQ ID NO: 106479 - protein, 17 aa, Mycobacterium avium
VTCTFHGHRRLSPDEVA

SEQ ID NO: 106480 - protein, 24 aa, Mycobacterium avium
VTDARRREVYWARYRDGVRTDGPA

SEQ ID NO: 106481 - protein, 25 aa, Mycobacterium avium
VTDARRREVYWARYRDGVRTDGPAV

SEQ ID NO: 106482 - protein, 18 aa, Mycobacterium avium
VTDISRWREVGAVHAEVF

SEQ ID NO: 106483 - protein, 30 aa, Mycobacterium avium
VTDMVCWHVGMGMGMYGVRPLRLAWRNRQR

SEQ ID NO: 106484 - protein, 18 aa, Mycobacterium avium
VTDPMAWTGADFTSKEDF

SEQ ID NO: 106485 - protein, 19 aa, Mycobacterium avium
VTDPYRAVGLPVLADPGAV

SEQ ID NO: 106486 - protein, 21 aa, Mycobacterium avium
VTDSDLAWTIARITSPNNSRP

SEQ ID NO: 106487 - protein, 25 aa, Mycobacterium avium
VTDSLDCFFVYLARHPEHRRQLVER

SEQ ID NO: 106488 - protein, 20 aa, Mycobacterium avium
VTEEIFGPVVTVLAFDDEQD

SEQ ID NO: 106489 - protein, 22 aa, Mycobacterium avium
VTEGTVTRWLKKVGDSVQVDDA

SEQ ID NO: 106490 - protein, 23 aa, Mycobacterium avium
VTEGTVTRWLKKVGDSVQVDDAL

SEQ ID NO: 106491 - protein, 22 aa, Mycobacterium avium
VTELIPGASWTWVQRSPGARVA

SEQ ID NO: 106492 - protein, 18 aa, Mycobacterium avium
VTEYCWGAVWGREELPRK

SEQ ID NO: 106493 - protein, 17 aa, Mycobacterium avium
VTFDEVDFTLAVLGGND

SEQ ID NO: 106494 - protein, 18 aa, Mycobacterium avium
VTFEEMLEMAACGAKVLM

SEQ ID NO: 106495 - protein, 18 aa, Mycobacterium avium
VTFGGLKPVHALGDCGRV

SEQ ID NO: 106496 - protein, 24 aa, Mycobacterium avium
VTFSDGRTAPFTVVGADPTSDIAV

SEQ ID NO: 106497 - protein, 23 aa, Mycobacterium avium
VTFSRIPVMASFSPYELHFDNVR

SEQ ID NO: 106498 - protein, 27 aa, Mycobacterium avium
VTGAVLWLAGPRSRYVTGVAIPVDAGH

SEQ ID NO: 106499 - protein, 23 aa, Mycobacterium avium
VTGEPRSGTTLMHALMSVDPHAR

SEQ ID NO: 106500 - protein, 17 aa, Mycobacterium avium
VTGGLTFAGGPWSNYVM

SEQ ID NO: 106501 - protein, 18 aa, Mycobacterium avium
VTGGRPSLNTVIGHSYGS

SEQ ID NO: 106502 - protein, 17 aa, Mycobacterium avium
VTGMLRQLLEGALWRPG

SEQ ID NO: 106503 - protein, 43 aa, Mycobacterium avium
VTGRAARMGHRLTIAMTRWRAGVSWAGSRPVRAELAVEVDSFE

SEQ ID NO: 106504 - protein, 42 aa, Mycobacterium avium
VTGRAARMGHRLTIAMTRWRGGVGWAGSRPVRAELAVEVDSV

SEQ ID NO: 106505 - protein, 43 aa, Mycobacterium avium
VTGRAARMGHRLTIAMTRWRGGVSWAGSRPVRAELAVEVDSVE

SEQ ID NO: 106506 - protein, 35 aa, Mycobacterium avium
VTIDGRPSLVFPRELPRSGAEFLGILGQLATVGLT

SEQ ID NO: 106507 - protein, 18 aa, Mycobacterium avium
VTLAALAPRPGERLWDVG

SEQ ID NO: 106508 - protein, 17 aa, Mycobacterium avium
VTLADRLARNIGEYSGV

SEQ ID NO: 106509 - protein, 18 aa, Mycobacterium avium
VTLADRLARNIGEYSGVE

SEQ ID NO: 106510 - protein, 23 aa, Mycobacterium avium
VTLKRFSPGSAERFRDAAIEMTN

SEQ ID NO: 106511 - protein, 20 aa, Mycobacterium avium
VTLKRFSPGSAERFRESAIE

SEQ ID NO: 106512 - protein, 18 aa, Mycobacterium avium
VTLNGRVLPIGGVKQKLL

SEQ ID NO: 106513 - protein, 19 aa, Mycobacterium avium
VTLPGAAIWHMAWSDKDDA

SEQ ID NO: 106514 - protein, 24 aa, Mycobacterium avium
VTLRAARAGDDWNIDGTVRHVLGG

SEQ ID NO: 106515 - protein, 19 aa, Mycobacterium avium
VTLREVWRDGAYAYLGMAV

SEQ ID NO: 106516 - protein, 27 aa, Mycobacterium avium
VTNGLGTDRCGPWIIERAIRDVRRGID

SEQ ID NO: 106517 - protein, 18 aa, Mycobacterium avium
VTNPSPYMYLLHVPNDAG

SEQ ID NO: 106518 - protein, 20 aa, Mycobacterium avium
VTNRPNRRIVIMPSDDEPKE

SEQ ID NO: 106519 - protein, 21 aa, Mycobacterium avium
VTPGYLTMGGFIPAQDENGWY

SEQ ID NO: 106520 - protein, 17 aa, Mycobacterium avium
VTPLCDAMARLGGVTMS

SEQ ID NO: 106521 - protein, 25 aa, Mycobacterium avium
VTPLFSIYVSPRIRAAIGTIAGRLM

SEQ ID NO: 106522 - protein, 20 aa, Mycobacterium avium
VTPLRARIAERLDQSGPTVS

SEQ ID NO: 106523 - protein, 26 aa, Mycobacterium avium
VTPRPRVAPTQAWRKMFGENFFYILY

SEQ ID NO: 106524 - protein, 24 aa, Mycobacterium avium
VTQRHLRRLWGLPATQLGVVAWPP

SEQ ID NO: 106525 - protein, 25 aa, Mycobacterium avium
VTQRHLRRLWGLPATQLGVVAWPPT

SEQ ID NO: 106526 - protein, 19 aa, Mycobacterium avium
VTRAPALLQNFGRILEERR

SEQ ID NO: 106527 - protein, 23 aa, Mycobacterium avium
VTRASWKLGQAIAGGGGVHSPDV

SEQ ID NO: 106528 - protein, 23 aa, Mycobacterium avium
VTRASWKLGQAIAGNGTHSPDAI

SEQ ID NO: 106529 - protein, 28 aa, Mycobacterium avium
VTRGGPPCPPRAAAPICHTVALRFRAKP

SEQ ID NO: 106530 - protein, 17 aa, Mycobacterium avium
VTRIDGGREPVWQITPE

SEQ ID NO: 106531 - protein, 19 aa, Mycobacterium avium
VTSFGRVGPTWTQAADAVL

SEQ ID NO: 106532 - protein, 25 aa, Mycobacterium avium
VTSGLRPASYFALAEAHGRLGHPAQ

SEQ ID NO: 106533 - protein, 22 aa, Mycobacterium avium
VTSGRVSYVLGLEGPAVSVDTA

SEQ ID NO: 106534 - protein, 22 aa, Mycobacterium avium
VTSRPPALAAMAFQTLDHLAGG

SEQ ID NO: 106535 - protein, 19 aa, Mycobacterium avium
VTTDRYGEFSFREIDGKPV

SEQ ID NO: 106536 - protein, 24 aa, Mycobacterium avium
VTTELGAPLIVVGQAKFQRPGDFA

SEQ ID NO: 106537 - protein, 24 aa, Mycobacterium avium
VTTGDGWAAGAVRLYDEQADVAAR

SEQ ID NO: 106538 - protein, 29 aa, Mycobacterium avium
VTTTLRLSMYVLNSAFYKPALLSRDMQAL

SEQ ID NO: 106539 - protein, 24 aa, Mycobacterium avium
VTVLPTHRWIPAGMTVEYKAQART

SEQ ID NO: 106540 - protein, 33 aa, Mycobacterium avium
VTYARAMGPMQFLPGTWARYASDGKGDGVADPQ

SEQ ID NO: 106541 - protein, 17 aa, Mycobacterium avium
VTYELSVDLAMPMIGLL

SEQ ID NO: 106542 - protein, 19 aa, Mycobacterium avium
VTYELSVDLAMPMIGLLKR

SEQ ID NO: 106543 - protein, 19 aa, Mycobacterium avium
VTYHCWRNQFGGLKAEDAK

SEQ ID NO: 106544 - protein, 21 aa, Mycobacterium avium
VTYYLDMGWEDLMVAAEYDGE

SEQ ID NO: 106545 - protein, 19 aa, Mycobacterium avium
VVAAALRLSTEEQRSLRSA

SEQ ID NO: 106546 - protein, 19 aa, Mycobacterium avium
VVAAAPGVIEWPLAGPEIV

SEQ ID NO: 106547 - protein, 25 aa, Mycobacterium avium
VVADYLTGKGWRVTPHPARQLYARN

SEQ ID NO: 106548 - protein, 17 aa, Mycobacterium avium
VVAGAERHPGWHALRKL

SEQ ID NO: 106549 - protein, 19 aa, Mycobacterium avium
VVAKATWDRGVDKFICAMG

SEQ ID NO: 106550 - protein, 17 aa, Mycobacterium avium
VVALFDWETAGTGPPDI

SEQ ID NO: 106551 - protein, 23 aa, Mycobacterium avium
VVALRSAQLITFTAMDIDDPRAL

SEQ ID NO: 106552 - protein, 17 aa, Mycobacterium avium
VVAMPLQAPYIVSKHAV

SEQ ID NO: 106553 - protein, 21 aa, Mycobacterium avium
VVAPGSFSWHVLTSLADDVQT

SEQ ID NO: 106554 - protein, 20 aa, Mycobacterium avium
VVARLVKQFGAPELADAILP

SEQ ID NO: 106555 - protein, 19 aa, Mycobacterium avium
VVCFPQRWLDLRYVGPAKD

SEQ ID NO: 106556 - protein, 18 aa, Mycobacterium avium
VVDATGWPTDRLQQAIEA

SEQ ID NO: 106557 - protein, 19 aa, Mycobacterium avium
VVDEACLDPSPTNAATARL

SEQ ID NO: 106558 - protein, 26 aa, Mycobacterium avium
VVDELPRGAALKVDRRRLIALLEDLG

SEQ ID NO: 106559 - protein, 25 aa, Mycobacterium avium
VVDELPRGAALKVDRRRLVATLEKL

SEQ ID NO: 106560 - protein, 22 aa, Mycobacterium avium
VVDGRFVSAMKFLGADGALRSD

SEQ ID NO: 106561 - protein, 19 aa, Mycobacterium avium
VVDGYPFEREVDGYQSYVT

SEQ ID NO: 106562 - protein, 17 aa, Mycobacterium avium
VVDRWAPGRVMVNAYGP

SEQ ID NO: 106563 - protein, 19 aa, Mycobacterium avium
VVDSICGHDGFLVESEAVG

SEQ ID NO: 106564 - protein, 18 aa, Mycobacterium avium
VVDVNLGRLAWLLRLFGF

SEQ ID NO: 106565 - protein, 24 aa, Mycobacterium avium
VVEAVKFLLRPDIDHLVGETIVAD

SEQ ID NO: 106566 - protein, 17 aa, Mycobacterium avium
VVEDFDAEMAFLTDVVG

SEQ ID NO: 106567 - protein, 17 aa, Mycobacterium avium
VVFTGYWRNEQATADAF

SEQ ID NO: 106568 - protein, 17 aa, Mycobacterium avium
VVFVRYALPGERVRVRV

SEQ ID NO: 106569 - protein, 19 aa, Mycobacterium avium
VVGCGGSVRRLRSRRYLMD

SEQ ID NO: 106570 - protein, 18 aa, Mycobacterium avium
VVGDKLWRDSGLKPQDIS

SEQ ID NO: 106571 - protein, 18 aa, Mycobacterium avium
VVGDTGWQLLDSKFAVVA

SEQ ID NO: 106572 - protein, 22 aa, Mycobacterium avium
VVGDVGGGWAVAMHLMQYERGM

SEQ ID NO: 106573 - protein, 27 aa, Mycobacterium avium
VVGEWQLLADLSFADYLMWVCRDDGML

SEQ ID NO: 106574 - protein, 18 aa, Mycobacterium avium
VVGQAKFQRPGDFADIDD

SEQ ID NO: 106575 - protein, 18 aa, Mycobacterium avium
VVGQRFSWVGHWSGRPLL

SEQ ID NO: 106576 - protein, 36 aa, Mycobacterium avium
VVGTAAGVVRFIGVDGYRWMIRCVVNGTHETMEALE

SEQ ID NO: 106577 - protein, 22 aa, Mycobacterium avium
VVGVLIQRCDPIFVMAAPGQPL

SEQ ID NO: 106578 - protein, 23 aa, Mycobacterium avium
VVHDYLFSRCLTIAGGTSEIVRN

SEQ ID NO: 106579 - protein, 25 aa, Mycobacterium avium
VVIACGDCALNRGVFTDAYGVVGAV

SEQ ID NO: 106580 - protein, 20 aa, Mycobacterium avium
VVIHDRLLRVLAYSRLQQHA

SEQ ID NO: 106581 - protein, 25 aa, Mycobacterium avium
VVILAMVLAAFEWRTERDTWRVGER

SEQ ID NO: 106582 - protein, 18 aa, Mycobacterium avium
VVIPAERADFGWQVVDAS

SEQ ID NO: 106583 - protein, 18 aa, Mycobacterium avium
VVIPAERADFGWQVVDAT

SEQ ID NO: 106584 - protein, 17 aa, Mycobacterium avium
VVIPSQGAVYVLQLNAD

SEQ ID NO: 106585 - protein, 18 aa, Mycobacterium avium
VVIPSQGAVYVLQLNADG

SEQ ID NO: 106586 - protein, 21 aa, Mycobacterium avium
VVLAELIALAAHHLRDVPPRR

SEQ ID NO: 106587 - protein, 18 aa, Mycobacterium avium
VVLFEALASFTIIADDVD

SEQ ID NO: 106588 - protein, 25 aa, Mycobacterium avium
VVMAEFLKRVMAGTLTLGEWLDLTT

SEQ ID NO: 106589 - protein, 18 aa, Mycobacterium avium
VVNARDWSASRLREAIDA

SEQ ID NO: 106590 - protein, 21 aa, Mycobacterium avium
VVPELPKTRSGKIMRRLLRDI

SEQ ID NO: 106591 - protein, 22 aa, Mycobacterium avium
VVPELPKTRSGKIMRRLLRDIA

SEQ ID NO: 106592 - protein, 21 aa, Mycobacterium avium
VVPTGGDWVRPEVVRRLRAEA

SEQ ID NO: 106593 - protein, 21 aa, Mycobacterium avium
VVRAAAATMFFGETAETLAAG

SEQ ID NO: 106594 - protein, 17 aa, Mycobacterium avium
VVRAFAGVSTAALDPFV

SEQ ID NO: 106595 - protein, 20 aa, Mycobacterium avium
VVRKAIDFVIDMQVGYGEIA

SEQ ID NO: 106596 - protein, 18 aa, Mycobacterium avium
VVRLPRAVHDAGGRYGLA

SEQ ID NO: 106597 - protein, 18 aa, Mycobacterium avium
VVRRRITFLAKSEYFTGT

SEQ ID NO: 106598 - protein, 24 aa, Mycobacterium avium
VVRRVFRPSMTMCSIRHGLCTPRI

SEQ ID NO: 106599 - protein, 18 aa, Mycobacterium avium
VVSTRGAMTLPREDVTDL

SEQ ID NO: 106600 - protein, 20 aa, Mycobacterium avium
VVSVGFNWTMGDHVVPPKPL

SEQ ID NO: 106601 - protein, 28 aa, Mycobacterium avium
VVTFAKPYAEWRGMFAGNGMLLPKSMTA

SEQ ID NO: 106602 - protein, 18 aa, Mycobacterium avium
VVTFGRYFLGGGGAVHGG

SEQ ID NO: 106603 - protein, 19 aa, Mycobacterium avium
VVTLLKVVPYAGGDSKPRS

SEQ ID NO: 106604 - protein, 24 aa, Mycobacterium avium
VVTMLYRVVDLFSAPLPGETWQFI

SEQ ID NO: 106605 - protein, 19 aa, Mycobacterium avium
VVTYLKMGCPLSTEQVPLI

SEQ ID NO: 106606 - protein, 17 aa, Mycobacterium avium
VVVDCGETTLAVEHLTR

SEQ ID NO: 106607 - protein, 18 aa, Mycobacterium avium
VVVPGEVLPGQHYLHQRV

SEQ ID NO: 106608 - protein, 18 aa, Mycobacterium avium
VVVYAHGGGFVFCDLDSH

SEQ ID NO: 106609 - protein, 23 aa, Mycobacterium avium
VVYLRVPALNAVFPNYRGSTLEA

SEQ ID NO: 106610 - protein, 20 aa, Mycobacterium avium
VVYNACKAGVIGFTRNLAHE

SEQ ID NO: 106611 - protein, 21 aa, Mycobacterium avium
VVYNACKAGVIGFTRNLAHEV

SEQ ID NO: 106612 - protein, 24 aa, Mycobacterium avium
VVYSFAVVHGFPGMPDLLLVPAVL

SEQ ID NO: 106613 - protein, 19 aa, Mycobacterium avium
VWDDIRAHGAIGFAGAGAM

SEQ ID NO: 106614 - protein, 22 aa, Mycobacterium avium
VWDTDWCGVPALDGDRKEGERG

SEQ ID NO: 106615 - protein, 17 aa, Mycobacterium avium
VWFHDLIRPEGRPFQDI

SEQ ID NO: 106616 - protein, 17 aa, Mycobacterium avium
VWGDVELAWRLDAAGHY

SEQ ID NO: 106617 - protein, 25 aa, Mycobacterium avium
VWGDVELAWRLDVAGHYGPPRRWLV

SEQ ID NO: 106618 - protein, 22 aa, Mycobacterium avium
VWGISQSQAFMVVRETAEVESD

SEQ ID NO: 106619 - protein, 18 aa, Mycobacterium avium
VWLANLIAVIGGRIDADL

SEQ ID NO: 106620 - protein, 20 aa, Mycobacterium avium
VWLDGGAPGYRVRVCGCEPV

SEQ ID NO: 106621 - protein, 20 aa, Mycobacterium avium
VWLEAGKQGFLGMAVPEDYG

SEQ ID NO: 106622 - protein, 21 aa, Mycobacterium avium
VWLEAGKQGFLGMAVPEEYGG

SEQ ID NO: 106623 - protein, 17 aa, Mycobacterium avium
VWNLRGQQWDFLKNRDD

SEQ ID NO: 106624 - protein, 18 aa, Mycobacterium avium
VWPQVETVLGREELEKIG

SEQ ID NO: 106625 - protein, 19 aa, Mycobacterium avium
VWRALRASMRSVLEETTLA

SEQ ID NO: 106626 - protein, 29 aa, Mycobacterium avium
VWREPVGVVGAIVPWNFPFEVTLNKLGQA

SEQ ID NO: 106627 - protein, 18 aa, Mycobacterium avium
VWSQCHSYGFDVSVQEIW

SEQ ID NO: 106628 - protein, 23 aa, Mycobacterium avium
VWTAEFAEAGWALPLSDDPAGRA

SEQ ID NO: 106629 - protein, 29 aa, Mycobacterium avium
VWTSAAHKARWGVCLARTDPDAPKHKGIT

SEQ ID NO: 106630 - protein, 25 aa, Mycobacterium avium
VYDAARAAFRLAWGTEPIDMGMGGS

SEQ ID NO: 106631 - protein, 26 aa, Mycobacterium avium
VYDVAEGRPHLRLENRVLPAGPTVID

SEQ ID NO: 106632 - protein, 18 aa, Mycobacterium avium
VYGGALLVEQAAWERATR

SEQ ID NO: 106633 - protein, 27 aa, Mycobacterium avium
VYGVDPLILRQAYPVPQAPYGLAGSRA

SEQ ID NO: 106634 - protein, 18 aa, Mycobacterium avium
VYIPRGKKEYFLKRLDAY

SEQ ID NO: 106635 - protein, 18 aa, Mycobacterium avium
VYKEARALGPTVIVLEDI

SEQ ID NO: 106636 - protein, 26 aa, Mycobacterium avium
VYLARWLHPGQRAFQLATQIALLTQP

SEQ ID NO: 106637 - protein, 23 aa, Mycobacterium avium
VYLATRGGYFVLDLATGRVVRVG

SEQ ID NO: 106638 - protein, 24 aa, Mycobacterium avium
VYNKHMIFPKPGVDLSNPDNFASI

SEQ ID NO: 106639 - protein, 25 aa, Mycobacterium avium
VYPDVYRLGEWVIPRGYSIIVGIAQ

SEQ ID NO: 106640 - protein, 26 aa, Mycobacterium avium
VYPDVYRLGEWVIPRGYSIIVGIAQI

SEQ ID NO: 106641 - protein, 20 aa, Mycobacterium avium
VYRCDYPGLVALLPTALAET

SEQ ID NO: 106642 - protein, 20 aa, Mycobacterium avium
VYRGCPTWSTAPGVPHDGYL

SEQ ID NO: 106643 - protein, 25 aa, Mycobacterium avium
VYSHGWSIGDTVIWDNRGVLHRAAP

SEQ ID NO: 106644 - protein, 18 aa, Mycobacterium avium
VYSPQSWSTIPGGPFLSF

SEQ ID NO: 106645 - protein, 23 aa, Mycobacterium avium
VYVELFAKFMRWPVDKFVLRSVS

SEQ ID NO: 106646 - protein, 19 aa, Mycobacterium avium
VYYRHELMYATGRVDGVEV

SEQ ID NO: 106647 - protein, 26 aa, Mycobacterium avium
WAAARRGTAELGRMYVHDGVVVVEQK

SEQ ID NO: 106648 - protein, 18 aa, Mycobacterium avium
WAAEQGFKAVFLPTTPHP

SEQ ID NO: 106649 - protein, 23 aa, Mycobacterium avium
WAASEGFKAVFLPTTPHPSAPDW

SEQ ID NO: 106650 - protein, 18 aa, Mycobacterium avium
WADCDGHPEKALSRDELL

SEQ ID NO: 106651 - protein, 18 aa, Mycobacterium avium
WADEVYVFGYPRVPMTAE

SEQ ID NO: 106652 - protein, 19 aa, Mycobacterium avium
WADGKSILRGIDYTHDISR

SEQ ID NO: 106653 - protein, 23 aa, Mycobacterium avium
WADLPVQYCDYTLWQRAQFGDLD

SEQ ID NO: 106654 - protein, 23 aa, Mycobacterium avium
WADLPVQYCDYTLWQRAQFGDLN

SEQ ID NO: 106655 - protein, 18 aa, Mycobacterium avium
WADRGGGYIRSRVEAENL

SEQ ID NO: 106656 - protein, 19 aa, Mycobacterium avium
WADRLPGAVLAIGNAPTAL

SEQ ID NO: 106657 - protein, 19 aa, Mycobacterium avium
WAEGAAMFVLQRKSAALQA

SEQ ID NO: 106658 - protein, 19 aa, Mycobacterium avium
WAEGAAMFVLQRKSTAVRA

SEQ ID NO: 106659 - protein, 20 aa, Mycobacterium avium
WAEGAAMFVLQRKSVALRAG

SEQ ID NO: 106660 - protein, 24 aa, Mycobacterium avium
WAEGRRYLGLDILTRCRLTTITDD

SEQ ID NO: 106661 - protein, 18 aa, Mycobacterium avium
WAEPVERLLAAAEPAKVK

SEQ ID NO: 106662 - protein, 21 aa, Mycobacterium avium
WAEVPRWPLVINTASGTTGPW

SEQ ID NO: 106663 - protein, 26 aa, Mycobacterium avium
WAGARRGTAELGRMYVHDGVVVVEQK

SEQ ID NO: 106664 - protein, 18 aa, Mycobacterium avium
WAGATPGGRFQQRAAANG

SEQ ID NO: 106665 - protein, 17 aa, Mycobacterium avium
WAGATPVVGSSSAPLQT

SEQ ID NO: 106666 - protein, 19 aa, Mycobacterium avium
WAGIAWPKEYGGQGLTLMQ

SEQ ID NO: 106667 - protein, 19 aa, Mycobacterium avium
WAGLCLPVVRAAGLLHRET

SEQ ID NO: 106668 - protein, 24 aa, Mycobacterium avium
WAGRRLPSEAQWEYAARAGTSSAY

SEQ ID NO: 106669 - protein, 24 aa, Mycobacterium avium
WAGSCRPGDGLGIAGGEVLIVAAD

SEQ ID NO: 106670 - protein, 19 aa, Mycobacterium avium
WAGSISPAAARFIEEIARQ

SEQ ID NO: 106671 - protein, 23 aa, Mycobacterium avium
WAGSISPAAARFIEEIARQTARR

SEQ ID NO: 106672 - protein, 24 aa, Mycobacterium avium
WAGSISPAAARFIEEIARQTARRG

SEQ ID NO: 106673 - protein, 17 aa, Mycobacterium avium
WAHARAAAHTLIDRAVS

SEQ ID NO: 106674 - protein, 20 aa, Mycobacterium avium
WAHDTWDLRADPRIPQREHE

SEQ ID NO: 106675 - protein, 18 aa, Mycobacterium avium
WAIDDIRPSFIVSNVPQI

SEQ ID NO: 106676 - protein, 23 aa, Mycobacterium avium
WALADLAAVFGLDVRPVDVRVQR

SEQ ID NO: 106677 - protein, 22 aa, Mycobacterium avium
WALKHWHFGPIYTLDEYFALQT

SEQ ID NO: 106678 - protein, 21 aa, Mycobacterium avium
WAMLGDGRWSDGRGDNIFDGS

SEQ ID NO: 106679 - protein, 24 aa, Mycobacterium avium
WANLLDLLAALGFSAEPVRVDDAG

SEQ ID NO: 106680 - protein, 24 aa, Mycobacterium avium
WANLLDLLAALGFSAEPVRVDDDG

SEQ ID NO: 106681 - protein, 25 aa, Mycobacterium avium
WANLLDLLAALGFSAEPVRVDDDGP

SEQ ID NO: 106682 - protein, 18 aa, Mycobacterium avium
WAPAGVRVDVGFDRKRLL

SEQ ID NO: 106683 - protein, 20 aa, Mycobacterium avium
WAPECAYAPGLEHDYAAAGV

SEQ ID NO: 106684 - protein, 18 aa, Mycobacterium avium
WAPYGGVTPTCWQFTDQA

SEQ ID NO: 106685 - protein, 18 aa, Mycobacterium avium
WAQGDRSGVAFRADAITG

SEQ ID NO: 106686 - protein, 19 aa, Mycobacterium avium
WAQSGRRALYISGEESAGQ

SEQ ID NO: 106687 - protein, 23 aa, Mycobacterium avium
WARDHGWPQFADRLLELARAAEP

SEQ ID NO: 106688 - protein, 17 aa, Mycobacterium avium
WARLHGRDVWQEPCDDV

SEQ ID NO: 106689 - protein, 18 aa, Mycobacterium avium
WARPRGVAPDALFALMCG

SEQ ID NO: 106690 - protein, 18 aa, Mycobacterium avium
WARQRAQRAVAQARPATA

SEQ ID NO: 106691 - protein, 18 aa, Mycobacterium avium
WARRLGELTCTRQRDMAV

SEQ ID NO: 106692 - protein, 17 aa, Mycobacterium avium
WASAIATAWQHLRTAFG

SEQ ID NO: 106693 - protein, 19 aa, Mycobacterium avium
WASAVIAAALRHCRPEQVL

SEQ ID NO: 106694 - protein, 17 aa, Mycobacterium avium
WATKDVVGAHRFLQRVW

SEQ ID NO: 106695 - protein, 21 aa, Mycobacterium avium
WAVHTRAPWHVRSFAGDHFYI

SEQ ID NO: 106696 - protein, 17 aa, Mycobacterium avium
WAVRLARPGAVIVADNV

SEQ ID NO: 106697 - protein, 17 aa, Mycobacterium avium
WCEGAGIGDVARLVEEA

SEQ ID NO: 106698 - protein, 18 aa, Mycobacterium avium
WCGADGKARALPAALNAA

SEQ ID NO: 106699 - protein, 17 aa, Mycobacterium avium
WCRQVLDLLDQVRNAAP

SEQ ID NO: 106700 - protein, 33 aa, Mycobacterium avium
WCTIGDPIADLAWLLMDWRSPRELASCLPNPTR

SEQ ID NO: 106701 - protein, 29 aa, Mycobacterium avium
WCVSRQLWWGHRIPIWYGPNGEQRCVGPD

SEQ ID NO: 106702 - protein, 18 aa, Mycobacterium avium
WDAVIAVHLKGTFAVTKH

SEQ ID NO: 106703 - protein, 23 aa, Mycobacterium avium
WDCTAPCFAAILGDPAVGRVNGA

SEQ ID NO: 106704 - protein, 19 aa, Mycobacterium avium
WDERLCLAPDGDFFRTIRH

SEQ ID NO: 106705 - protein, 20 aa, Mycobacterium avium
WDERLCLAPDGDFFRTIRHG

SEQ ID NO: 106706 - protein, 30 aa, Mycobacterium avium
WDFEREAPAWRKLFYEDFLPVDKNPAINIT

SEQ ID NO: 106707 - protein, 30 aa, Mycobacterium avium
WDGLWRVCSDAKMPVSLHFGSGSFVPGFSF

SEQ ID NO: 106708 - protein, 18 aa, Mycobacterium avium
WDGTGLSGVVPIVAGAPH

SEQ ID NO: 106709 - protein, 26 aa, Mycobacterium avium
WDGVAAVLRRRFNVVAYDVRGAGQSS

SEQ ID NO: 106710 - protein, 26 aa, Mycobacterium avium
WDGVAGVLRRRFNVVAYDVRGAGQSS

SEQ ID NO: 106711 - protein, 19 aa, Mycobacterium avium
WDIHRCLGRQVELPPDLLA

SEQ ID NO: 106712 - protein, 22 aa, Mycobacterium avium
WDIPGACDIGAMTATINAHLHR

SEQ ID NO: 106713 - protein, 22 aa, Mycobacterium avium
WDIPGACDIGAMTATINAHLRR

SEQ ID NO: 106714 - protein, 19 aa, Mycobacterium avium
WDLEIGCLTELLAEKEGPA

SEQ ID NO: 106715 - protein, 25 aa, Mycobacterium avium
WDLGDARGTVMLRMPLHPVAIELLR

SEQ ID NO: 106716 - protein, 18 aa, Mycobacterium avium
WDPAELGPVVADLLAKAR

SEQ ID NO: 106717 - protein, 25 aa, Mycobacterium avium
WDPARAVEVVHRFGVTCTAGTPFHL

SEQ ID NO: 106718 - protein, 22 aa, Mycobacterium avium
WDRRRITAGLDRLRYAEGSSGA

SEQ ID NO: 106719 - protein, 20 aa, Mycobacterium avium
WDSRAIAVFGHRPYGRGVGQ

SEQ ID NO: 106720 - protein, 17 aa, Mycobacterium avium
WDTELVGPLVDRTIAKF

SEQ ID NO: 106721 - protein, 17 aa, Mycobacterium avium
WDTLRILGRRTAVAASQ

SEQ ID NO: 106722 - protein, 17 aa, Mycobacterium avium
WDTRARVAAPYRVIQFA

SEQ ID NO: 106723 - protein, 17 aa, Mycobacterium avium
WDVPGFEIPGGSPSTPA

SEQ ID NO: 106724 - protein, 17 aa, Mycobacterium avium
WDVRNGVIARKGRAHGL

SEQ ID NO: 106725 - protein, 22 aa, Mycobacterium avium
WDYRAGCFPPGVVDDMFEAYVT

SEQ ID NO: 106726 - protein, 17 aa, Mycobacterium avium
WEAAVFDQSPGIDSAPQ

SEQ ID NO: 106727 - protein, 18 aa, Mycobacterium avium
WEAFDLGGNKIGQWDSPD

SEQ ID NO: 106728 - protein, 17 aa, Mycobacterium avium
WEALPPGTLQHVRDALA

SEQ ID NO: 106729 - protein, 21 aa, Mycobacterium avium
WEAVDNRLGRRVAVKVLKQEF

SEQ ID NO: 106730 - protein, 18 aa, Mycobacterium avium
WECARPSGCSTARRPGRR

SEQ ID NO: 106731 - protein, 18 aa, Mycobacterium avium
WEDAESFDIFRERKPHIG

SEQ ID NO: 106732 - protein, 21 aa, Mycobacterium avium
WEFDEKYGGLGVKDFRFNQIV

SEQ ID NO: 106733 - protein, 20 aa, Mycobacterium avium
WEGALKLGIEMRVGPVGIVN

SEQ ID NO: 106734 - protein, 25 aa, Mycobacterium avium
WEHDLHLFLRRIKVDEAFNGSVAEH

SEQ ID NO: 106735 - protein, 17 aa, Mycobacterium avium
WEHDMHLYFKRAHGSAH

SEQ ID NO: 106736 - protein, 19 aa, Mycobacterium avium
WEHPAHLLLRRAKANAVLV

SEQ ID NO: 106737 - protein, 17 aa, Mycobacterium avium
WEIGDFVGAMAEGEQVL

SEQ ID NO: 106738 - protein, 18 aa, Mycobacterium avium
WEKACVWDPSTGTRRRYP

SEQ ID NO: 106739 - protein, 28 aa, Mycobacterium avium
WELFWPDFPIGGLYKFKVHGADGVVTER

SEQ ID NO: 106740 - protein, 19 aa, Mycobacterium avium
WELGEGWAKHVTVEVALGT

SEQ ID NO: 106741 - protein, 17 aa, Mycobacterium avium
WELYGGWFHHRSTTELF

SEQ ID NO: 106742 - protein, 25 aa, Mycobacterium avium
WEPRQPRCEIGAWLERRARVAVDPE

SEQ ID NO: 106743 - protein, 18 aa, Mycobacterium avium
WEPTIVRPICNALIDEFI

SEQ ID NO: 106744 - protein, 18 aa, Mycobacterium avium
WEPTVPALVNLVAAAGAP

SEQ ID NO: 106745 - protein, 18 aa, Mycobacterium avium
WEPWLHALPVEFDSAEQV

SEQ ID NO: 106746 - protein, 18 aa, Mycobacterium avium
WERAHAVPAPAWAVSRKR

SEQ ID NO: 106747 - protein, 26 aa, Mycobacterium avium
WERHPLMLRSYFQARSGPGGKRLIRR

SEQ ID NO: 106748 - protein, 19 aa, Mycobacterium avium
WERTIREFTELLKSEDAKE

SEQ ID NO: 106749 - protein, 20 aa, Mycobacterium avium
WEVESAIYVYAPDLIPKIKA

SEQ ID NO: 106750 - protein, 20 aa, Mycobacterium avium
WFASNCAGEAFVVLAKPEGA

SEQ ID NO: 106751 - protein, 35 aa, Mycobacterium avium
WFATLPAEFTGAVQQHWGPPPGQLFVDRSNDPDGE

SEQ ID NO: 106752 - protein, 23 aa, Mycobacterium avium
WFDDPELMTWLSGARLDLSGHLI

SEQ ID NO: 106753 - protein, 20 aa, Mycobacterium avium
WFDVRDGLRAGSPEAPVVYT

SEQ ID NO: 106754 - protein, 18 aa, Mycobacterium avium
WFPQPPPPHHPWRTMPNH

SEQ ID NO: 106755 - protein, 17 aa, Mycobacterium avium
WFRRHEVVYQRLARHCA

SEQ ID NO: 106756 - protein, 20 aa, Mycobacterium avium
WFRRHEVVYQRLARHCAGRD

SEQ ID NO: 106757 - protein, 17 aa, Mycobacterium avium
WFRTGDRGYLRPDGRIV

SEQ ID NO: 106758 - protein, 17 aa, Mycobacterium avium
WFVDGLIGGTLGFGGEE

SEQ ID NO: 106759 - protein, 17 aa, Mycobacterium avium
WGADEAVIRSLLPAADA

SEQ ID NO: 106760 - protein, 23 aa, Mycobacterium avium
WGADSGMLAALYVLAALGEQDRP

SEQ ID NO: 106761 - protein, 19 aa, Mycobacterium avium
WGADVVKIEHPVTGDAQRG

SEQ ID NO: 106762 - protein, 18 aa, Mycobacterium avium
WGAGFFDAEVPRRWRSPA

SEQ ID NO: 106763 - protein, 17 aa, Mycobacterium avium
WGALAGGGGLVVVPESV

SEQ ID NO: 106764 - protein, 25 aa, Mycobacterium avium
WGALRRTYLRLGHRVDVIEPVAGLP

SEQ ID NO: 106765 - protein, 26 aa, Mycobacterium avium
WGAQGVRCNGVMPGLVMGETQKQQND

SEQ ID NO: 106766 - protein, 27 aa, Mycobacterium avium
WGAQGVRCNGVMPGLVMGETQKQQNDI

SEQ ID NO: 106767 - protein, 23 aa, Mycobacterium avium
WGAQPGILSAVFVQDGDQAAEPL

SEQ ID NO: 106768 - protein, 18 aa, Mycobacterium avium
WGATPLKAPALEAILAAT

SEQ ID NO: 106769 - protein, 18 aa, Mycobacterium avium
WGATPVKAPALEAILAAT

SEQ ID NO: 106770 - protein, 18 aa, Mycobacterium avium
WGAVWGREELPRKTRSML

SEQ ID NO: 106771 - protein, 17 aa, Mycobacterium avium
WGDGWPLGVSRATTRTQ

SEQ ID NO: 106772 - protein, 17 aa, Mycobacterium avium
WGETKLGSVGRPLPGID

SEQ ID NO: 106773 - protein, 19 aa, Mycobacterium avium
WGGALKRALEKYDFNVIGI

SEQ ID NO: 106774 - protein, 29 aa, Mycobacterium avium
WGGATYDVALRFLKEDPWERLTALREAMP

SEQ ID NO: 106775 - protein, 27 aa, Mycobacterium avium
WGGLLAPPALLMGWLIAPPWQPDGRPS

SEQ ID NO: 106776 - protein, 17 aa, Mycobacterium avium
WGGPFMLKGVMRVDDAK

SEQ ID NO: 106777 - protein, 23 aa, Mycobacterium avium
WGKGEPPPLLWAVIQALVSEVWP

SEQ ID NO: 106778 - protein, 20 aa, Mycobacterium avium
WGLDSWRISPAVGPDVVVST

SEQ ID NO: 106779 - protein, 23 aa, Mycobacterium avium
WGMTEFPCATSPSLTAAPEVLDH

SEQ ID NO: 106780 - protein, 18 aa, Mycobacterium avium
WGPHLIRLLHHAEHWATT

SEQ ID NO: 106781 - protein, 17 aa, Mycobacterium avium
WGPVHVAPPAPPGPMKS

SEQ ID NO: 106782 - protein, 18 aa, Mycobacterium avium
WGREVVGTAAGVVRFIGV

SEQ ID NO: 106783 - protein, 23 aa, Mycobacterium avium
WGRPPPRIVAGLPVAVHDDPVEA

SEQ ID NO: 106784 - protein, 18 aa, Mycobacterium avium
WGSIQAWAAVTDKAVTGE

SEQ ID NO: 106785 - protein, 17 aa, Mycobacterium avium
WGSIQAWAAVTDQAIMG

SEQ ID NO: 106786 - protein, 17 aa, Mycobacterium avium
WGSIQAWAAVTDQAVTG

SEQ ID NO: 106787 - protein, 17 aa, Mycobacterium avium
WGSRPYAYLGITVPEFP

SEQ ID NO: 106788 - protein, 24 aa, Mycobacterium avium
WGSVEWTNLVTLYLRACESRSRQP

SEQ ID NO: 106789 - protein, 19 aa, Mycobacterium avium
WHAVVKQYRPAVAGLPPAA

SEQ ID NO: 106790 - protein, 18 aa, Mycobacterium avium
WHGDCAAIHVLFVAIERR

SEQ ID NO: 106791 - protein, 19 aa, Mycobacterium avium
WHLERQLKTLPLVERTYHI

SEQ ID NO: 106792 - protein, 17 aa, Mycobacterium avium
WHRAIVDKWRGAGVRMA

SEQ ID NO: 106793 - protein, 23 aa, Mycobacterium avium
WHRKEWEPFWAAAEDAGMVIAFH

SEQ ID NO: 106794 - protein, 23 aa, Mycobacterium avium
WHRKEWEPFWAAAEEAGMVIAFH

SEQ ID NO: 106795 - protein, 17 aa, Mycobacterium avium
WHRPRLEVLADADADVL

SEQ ID NO: 106796 - protein, 23 aa, Mycobacterium avium
WHRRRYNPWSAYGESKLANMLFV

SEQ ID NO: 106797 - protein, 18 aa, Mycobacterium avium
WIDHEIVVVPYAMSSAER

SEQ ID NO: 106798 - protein, 19 aa, Mycobacterium avium
WIDHGQIRMSGGIEDVVRA

SEQ ID NO: 106799 - protein, 19 aa, Mycobacterium avium
WIDRLGQMLAALVRDRDVI

SEQ ID NO: 106800 - protein, 23 aa, Mycobacterium avium
WIEINGRMDSIWKLVNQQVQDNG

SEQ ID NO: 106801 - protein, 19 aa, Mycobacterium avium
WIGNIALSFPYLDTEATRT

SEQ ID NO: 106802 - protein, 18 aa, Mycobacterium avium
WIGYDPPQVPGFDDIGKS

SEQ ID NO: 106803 - protein, 17 aa, Mycobacterium avium
WIKPLFDDLEMTYKKMP

SEQ ID NO: 106804 - protein, 24 aa, Mycobacterium avium
WIPPHLRLPAHVTLLEPAARRHDA

SEQ ID NO: 106805 - protein, 19 aa, Mycobacterium avium
WIPYYLQRVDEVWEDRRAW

SEQ ID NO: 106806 - protein, 17 aa, Mycobacterium avium
WIYYSSGTTAAPKGARH

SEQ ID NO: 106807 - protein, 30 aa, Mycobacterium avium
WKDGHVSLGALWRLYSQYPYMPRLRDRRVL

SEQ ID NO: 106808 - protein, 24 aa, Mycobacterium avium
WKDNYCVYGARKLWKTARRDGHDV

SEQ ID NO: 106809 - protein, 21 aa, Mycobacterium avium
WKDYWDFNSLVAFAPPNHFEG

SEQ ID NO: 106810 - protein, 17 aa, Mycobacterium avium
WKFVVLRSSALRDVVTA

SEQ ID NO: 106811 - protein, 17 aa, Mycobacterium avium
WKGDEAIELTSSTGERV

SEQ ID NO: 106812 - protein, 26 aa, Mycobacterium avium
WKLFYRVKSSVLLYVGALGVPQTEQS

SEQ ID NO: 106813 - protein, 20 aa, Mycobacterium avium
WKQNWPQHLAGAYIDAGMAD

SEQ ID NO: 106814 - protein, 19 aa, Mycobacterium avium
WKVAVEYDGIQHWDDPSQR

SEQ ID NO: 106815 - protein, 18 aa, Mycobacterium avium
WLAANMPRLDPARAALLQ

SEQ ID NO: 106816 - protein, 19 aa, Mycobacterium avium
WLAANMPRLDPARAALLQR

SEQ ID NO: 106817 - protein, 20 aa, Mycobacterium avium
WLADHRIHEVAALPAAAYCE

SEQ ID NO: 106818 - protein, 17 aa, Mycobacterium avium
WLADLYQSMIRRETNRH

SEQ ID NO: 106819 - protein, 17 aa, Mycobacterium avium
WLAEGLLMYLPAEAQDR

SEQ ID NO: 106820 - protein, 24 aa, Mycobacterium avium
WLAEMIEQLELPPGVVSVLPGGTD

SEQ ID NO: 106821 - protein, 25 aa, Mycobacterium avium
WLAEMIEQLELPPGVVSVLPGGTDV

SEQ ID NO: 106822 - protein, 17 aa, Mycobacterium avium
WLAEMIEQLELPQGVVS

SEQ ID NO: 106823 - protein, 19 aa, Mycobacterium avium
WLAEQVPIYAVNLLLSTAT

SEQ ID NO: 106824 - protein, 20 aa, Mycobacterium avium
WLAEQVPIYAVNLLLSTATE

SEQ ID NO: 106825 - protein, 18 aa, Mycobacterium avium
WLAVDPDARLTVADGPQP

SEQ ID NO: 106826 - protein, 22 aa, Mycobacterium avium
WLDDGWVALLRKWIDDAERAGA

SEQ ID NO: 106827 - protein, 24 aa, Mycobacterium avium
WLDNLRHTVRFGAAVQAALEDGHR

SEQ ID NO: 106828 - protein, 17 aa, Mycobacterium avium
WLDPALTTPYAWYQYFF

SEQ ID NO: 106829 - protein, 19 aa, Mycobacterium avium
WLEAGKQGFLGMAVPEEYG

SEQ ID NO: 106830 - protein, 21 aa, Mycobacterium avium
WLELLGELEIPAAPLNSPGAL

SEQ ID NO: 106831 - protein, 25 aa, Mycobacterium avium
WLERGEVILSGSFTKPVFAEPGDTF

SEQ ID NO: 106832 - protein, 18 aa, Mycobacterium avium
WLGHKKAAAVVLRPDGFI

SEQ ID NO: 106833 - protein, 19 aa, Mycobacterium avium
WLGLDWDEGPEVGGPYGPY

SEQ ID NO: 106834 - protein, 25 aa, Mycobacterium avium
WLHPPGIDFRPALLAGVQIGLSSQR

SEQ ID NO: 106835 - protein, 22 aa, Mycobacterium avium
WLLKQAFYYSLTTINEAMREHG

SEQ ID NO: 106836 - protein, 19 aa, Mycobacterium avium
WLPPFGIVEHVGRRSGKPY

SEQ ID NO: 106837 - protein, 18 aa, Mycobacterium avium
WLPSGIDYATCYAAAAMI

SEQ ID NO: 106838 - protein, 17 aa, Mycobacterium avium
WLQAGRVHAPFWEVHAT

SEQ ID NO: 106839 - protein, 17 aa, Mycobacterium avium
WLQGPNQWPAALPELPG

SEQ ID NO: 106840 - protein, 26 aa, Mycobacterium avium
WLRAGAPAIDAVLCSTATRTRETLRN

SEQ ID NO: 106841 - protein, 25 aa, Mycobacterium avium
WLRAGAPAIDGVLCSTATRTRETLR

SEQ ID NO: 106842 - protein, 19 aa, Mycobacterium avium
WLRELWGGPFMLKGVMRVD

SEQ ID NO: 106843 - protein, 17 aa, Mycobacterium avium
WLRRSLRSVHPRLLSTM

SEQ ID NO: 106844 - protein, 17 aa, Mycobacterium avium
WLSRARCGAHDARRMRD

SEQ ID NO: 106845 - protein, 24 aa, Mycobacterium avium
WLTATRARNALVLVRGKPTDQLPG

SEQ ID NO: 106846 - protein, 17 aa, Mycobacterium avium
WLTDRFEGRPVTEHLIR

SEQ ID NO: 106847 - protein, 27 aa, Mycobacterium avium
WLTPEARASWEAVLAKLAALGMCNPDD

SEQ ID NO: 106848 - protein, 17 aa, Mycobacterium avium
WLTQLIVTRRVIAAEAA

SEQ ID NO: 106849 - protein, 17 aa, Mycobacterium avium
WMAETTLGRVLFNELLP

SEQ ID NO: 106850 - protein, 20 aa, Mycobacterium avium
WMAVRAMPEFAARNAFDAAA

SEQ ID NO: 106851 - protein, 29 aa, Mycobacterium avium
WMTPTQLRWRPLSFWPAHTAVTVDAGGTV

SEQ ID NO: 106852 - protein, 18 aa, Mycobacterium avium
WMVCRTVATVLRTKVSAQ

SEQ ID NO: 106853 - protein, 17 aa, Mycobacterium avium
WMVGTVWTTQCSNYFRA

SEQ ID NO: 106854 - protein, 22 aa, Mycobacterium avium
WNIKTGDVMPATYIGIWQTLSD

SEQ ID NO: 106855 - protein, 19 aa, Mycobacterium avium
WNKLPSADAITHFAFGCGD

SEQ ID NO: 106856 - protein, 22 aa, Mycobacterium avium
WNPNRIEQRFGRIHRIGQEEVC

SEQ ID NO: 106857 - protein, 18 aa, Mycobacterium avium
WNPYGALPEMRLLTYQMP

SEQ ID NO: 106858 - protein, 19 aa, Mycobacterium avium
WNSPRAVAYRKHHGRDDLG

SEQ ID NO: 106859 - protein, 22 aa, Mycobacterium avium
WPAAAARPRWSALAEDARQTAR

SEQ ID NO: 106860 - protein, 32 aa, Mycobacterium avium
WPAAEQTWLHGWLLRAGPPPGRPAGPSTDSAV

SEQ ID NO: 106861 - protein, 17 aa, Mycobacterium avium
WPAAGGRRRWQALREDA

SEQ ID NO: 106862 - protein, 17 aa, Mycobacterium avium
WPAANPVAPLGETVMRQ

SEQ ID NO: 106863 - protein, 17 aa, Mycobacterium avium
WPADALTMIGMKRLTSL

SEQ ID NO: 106864 - protein, 18 aa, Mycobacterium avium
WPADALTMIGMKRLTSLQ

SEQ ID NO: 106865 - protein, 23 aa, Mycobacterium avium
WPAERRILACLPGEYGPNLAVMA

SEQ ID NO: 106866 - protein, 19 aa, Mycobacterium avium
WPAHCLAGSAGADFRPELD

SEQ ID NO: 106867 - protein, 17 aa, Mycobacterium avium
WPAHDPVGLIARINGHL

SEQ ID NO: 106868 - protein, 19 aa, Mycobacterium avium
WPAPTLGKYVESFEGMIEA

SEQ ID NO: 106869 - protein, 20 aa, Mycobacterium avium
WPDFIAGLYGRSFRDVVRDA

SEQ ID NO: 106870 - protein, 31 aa, Mycobacterium avium
WPDGTEPFCGVAVRGFPNYFFATGPDPGPQA

SEQ ID NO: 106871 - protein, 24 aa, Mycobacterium avium
WPDREYRPDLDILIAGCGTFQAAV

SEQ ID NO: 106872 - protein, 17 aa, Mycobacterium avium
WPDVFALVAQYLIDARR

SEQ ID NO: 106873 - protein, 19 aa, Mycobacterium avium
WPEALRANGFDVTQPTSWS

SEQ ID NO: 106874 - protein, 21 aa, Mycobacterium avium
WPEGSGGIMLGSHKPGAEWCR

SEQ ID NO: 106875 - protein, 19 aa, Mycobacterium avium
WPEPLRTKALQGRGPGQAG

SEQ ID NO: 106876 - protein, 19 aa, Mycobacterium avium
WPFEQWGRFLPEHTTAASI

SEQ ID NO: 106877 - protein, 21 aa, Mycobacterium avium
WPHRVPGAAACCDFSTASSWE

SEQ ID NO: 106878 - protein, 27 aa, Mycobacterium avium
WPMKKTPKKVCHRITLGAGRNKVTATF

SEQ ID NO: 106879 - protein, 18 aa, Mycobacterium avium
WPMTCFLTPDGRPFFCGT

SEQ ID NO: 106880 - protein, 17 aa, Mycobacterium avium
WPREYGGRGATVLEQLV

SEQ ID NO: 106881 - protein, 24 aa, Mycobacterium avium
WPRHQLRLPAGHGLLLLTDGLYEG

SEQ ID NO: 106882 - protein, 25 aa, Mycobacterium avium
WPRHQLRLPAGHGLLLLTDGLYEGY

SEQ ID NO: 106883 - protein, 17 aa, Mycobacterium avium
WPRMSHAERMAKIEQLA

SEQ ID NO: 106884 - protein, 17 aa, Mycobacterium avium
WPRMSHAERMAKVEQLA

SEQ ID NO: 106885 - protein, 17 aa, Mycobacterium avium
WPSPMLPALQSLLDDHT

SEQ ID NO: 106886 - protein, 19 aa, Mycobacterium avium
WPTALEVVREIAKVDGSLG

SEQ ID NO: 106887 - protein, 19 aa, Mycobacterium avium
WPTEIGYAVTFEGKPNMTF

SEQ ID NO: 106888 - protein, 19 aa, Mycobacterium avium
WPTPSARAPGTCWKTCSCS

SEQ ID NO: 106889 - protein, 19 aa, Mycobacterium avium
WPTRLRRLVSEQVSLILRR

SEQ ID NO: 106890 - protein, 21 aa, Mycobacterium avium
WQAARCVANWHGARVEKGLRR

SEQ ID NO: 106891 - protein, 17 aa, Mycobacterium avium
WQADIGRGYEFGALATA

SEQ ID NO: 106892 - protein, 19 aa, Mycobacterium avium
WQALSRRDWDAVKTFLSDD

SEQ ID NO: 106893 - protein, 18 aa, Mycobacterium avium
WQAVMAQVYVDGRLPGAQ

SEQ ID NO: 106894 - protein, 20 aa, Mycobacterium avium
WQGWAAGPQGGWGKPPTPLW

SEQ ID NO: 106895 - protein, 17 aa, Mycobacterium avium
WQHGVFLASTLSSETTA

SEQ ID NO: 106896 - protein, 25 aa, Mycobacterium avium
WQIIARIACEIGFSEAFSYSCAEEV

SEQ ID NO: 106897 - protein, 17 aa, Mycobacterium avium
WQKRPGERTELYRRLRD

SEQ ID NO: 106898 - protein, 23 aa, Mycobacterium avium
WQLEKALPVPVFVQSMAQVTIAR

SEQ ID NO: 106899 - protein, 19 aa, Mycobacterium avium
WQLPSHVNAAVAMLALARM

SEQ ID NO: 106900 - protein, 19 aa, Mycobacterium avium
WQLPSHVSAALLMLALARC

SEQ ID NO: 106901 - protein, 17 aa, Mycobacterium avium
WQLRIHRIHDLLVNAVV

SEQ ID NO: 106902 - protein, 17 aa, Mycobacterium avium
WQTIPEMVLSAADRFGD

SEQ ID NO: 106903 - protein, 18 aa, Mycobacterium avium
WQTLREIQEGNSIALINE

SEQ ID NO: 106904 - protein, 17 aa, Mycobacterium avium
WQTYGEVVVRFEQSSSL

SEQ ID NO: 106905 - protein, 26 aa, Mycobacterium avium
WQVVDAARWPASWLAEATHEAARYTF

SEQ ID NO: 106906 - protein, 21 aa, Mycobacterium avium
WRAACRSDHALAKGLSTHDGA

SEQ ID NO: 106907 - protein, 21 aa, Mycobacterium avium
WRAACRSDHALAKGLSTHDGT

SEQ ID NO: 106908 - protein, 21 aa, Mycobacterium avium
WRAACRSNHALAKGLSTHDGA

SEQ ID NO: 106909 - protein, 19 aa, Mycobacterium avium
WRAEHPEIAVIRVSVGPTC

SEQ ID NO: 106910 - protein, 20 aa, Mycobacterium avium
WRAFNERSGFRFGGSGRNMA

SEQ ID NO: 106911 - protein, 25 aa, Mycobacterium avium
WRAGDLTLPLTYRFQPGAADDGVTV

SEQ ID NO: 106912 - protein, 18 aa, Mycobacterium avium
WRALQTIPYGETRSYGEI

SEQ ID NO: 106913 - protein, 22 aa, Mycobacterium avium
WRAPSPLPGWDVKAVVSHMIGT

SEQ ID NO: 106914 - protein, 20 aa, Mycobacterium avium
WRASRSRWVCFLDDDVLPDR

SEQ ID NO: 106915 - protein, 18 aa, Mycobacterium avium
WRDPTSRTGQQWEERFGA

SEQ ID NO: 106916 - protein, 18 aa, Mycobacterium avium
WRDTGWRPPVKTGAASAR

SEQ ID NO: 106917 - protein, 20 aa, Mycobacterium avium
WREISGMGSLYSYTVAHRPV

SEQ ID NO: 106918 - protein, 38 aa, Mycobacterium avium
WRELGNPLHLHRILLQRSWIAIFWSRFADAVELIAQAR

SEQ ID NO: 106919 - protein, 21 aa, Mycobacterium avium
WRETDGLVIPAPFDQTALMKS

SEQ ID NO: 106920 - protein, 17 aa, Mycobacterium avium
WRGAPTVEEQDIRVAAE

SEQ ID NO: 106921 - protein, 21 aa, Mycobacterium avium
WRGLVPGPLRFVRAVANYYRP

SEQ ID NO: 106922 - protein, 17 aa, Mycobacterium avium
WRGPQLPHHVQEFGGAR

SEQ ID NO: 106923 - protein, 18 aa, Mycobacterium avium
WRGQRLRALASLPELVAA

SEQ ID NO: 106924 - protein, 17 aa, Mycobacterium avium
WRGSICAAIEDPEGAVE

SEQ ID NO: 106925 - protein, 21 aa, Mycobacterium avium
WRHVDPDIGRKVEEGVRANLN

SEQ ID NO: 106926 - protein, 20 aa, Mycobacterium avium
WRILLQDLNIAWAQHHGGQP

SEQ ID NO: 106927 - protein, 19 aa, Mycobacterium avium
WRIRARRVTTPIIIEPKAI

SEQ ID NO: 106928 - protein, 19 aa, Mycobacterium avium
WRKMIAINLMGPIHVIETF

SEQ ID NO: 106929 - protein, 21 aa, Mycobacterium avium
WRLDGQKTWITDGHWADMGLA

SEQ ID NO: 106930 - protein, 19 aa, Mycobacterium avium
WRLKCPSHVLWLDRLAAVF

SEQ ID NO: 106931 - protein, 34 aa, Mycobacterium avium
WRLKCPSHVLWLDRLAAVFPDAKFVMTHRDPTDV

SEQ ID NO: 106932 - protein, 17 aa, Mycobacterium avium
WRLSDYRMLTHDRGSSV

SEQ ID NO: 106933 - protein, 17 aa, Mycobacterium avium
WRLVLTAHHIVIDGWSL

SEQ ID NO: 106934 - protein, 20 aa, Mycobacterium avium
WRMASKSLRPLPVAHKEMSE

SEQ ID NO: 106935 - protein, 25 aa, Mycobacterium avium
WRNHHNAWRPAYIHFSVFGTAFTQR

SEQ ID NO: 106936 - protein, 19 aa, Mycobacterium avium
WRNQFGGLKAEDAKRLKDS

SEQ ID NO: 106937 - protein, 20 aa, Mycobacterium avium
WRPGRFRDRFVAFEGSYGYG

SEQ ID NO: 106938 - protein, 20 aa, Mycobacterium avium
WRQTDGLVIPAPFDQTALMK

SEQ ID NO: 106939 - protein, 17 aa, Mycobacterium avium
WRRGGLGLPRQGRQIQL

SEQ ID NO: 106940 - protein, 19 aa, Mycobacterium avium
WRRHRWPEVHGLAEGIAAW

SEQ ID NO: 106941 - protein, 17 aa, Mycobacterium avium
WRRVRRFRPDVVLAELV

SEQ ID NO: 106942 - protein, 19 aa, Mycobacterium avium
WRSIARSLARRPAAEIKRV

SEQ ID NO: 106943 - protein, 21 aa, Mycobacterium avium
WRSPSCWCCVAGRRGSGRIGP

SEQ ID NO: 106944 - protein, 18 aa, Mycobacterium avium
WRTMLDVNLTGVWHTCRA

SEQ ID NO: 106945 - protein, 21 aa, Mycobacterium avium
WRVGKKLLAWERPLRPSEREA

SEQ ID NO: 106946 - protein, 22 aa, Mycobacterium avium
WRVIDANGWPASRLNDAIDAIA

SEQ ID NO: 106947 - protein, 18 aa, Mycobacterium avium
WRVLEFSNGLAVSYCGKM

SEQ ID NO: 106948 - protein, 20 aa, Mycobacterium avium
WRVLLEDLNIAWGQHHNGQP

SEQ ID NO: 106949 - protein, 18 aa, Mycobacterium avium
WRVVEFSNGLAVSYCGKM

SEQ ID NO: 106950 - protein, 17 aa, Mycobacterium avium
WSAAPNFAFDLAARKTT

SEQ ID NO: 106951 - protein, 24 aa, Mycobacterium avium
WSAGGPPGALFGYLAAGKRSMVGR

SEQ ID NO: 106952 - protein, 24 aa, Mycobacterium avium
WSAGGPPGALFGYLAAGKRSVVGR

SEQ ID NO: 106953 - protein, 17 aa, Mycobacterium avium
WSAGLAAAGVRRRATVL

SEQ ID NO: 106954 - protein, 18 aa, Mycobacterium avium
WSAGVLFADVMTAYRARR

SEQ ID NO: 106955 - protein, 24 aa, Mycobacterium avium
WSAKVGFGRRWSDGLDRTGDTMNT

SEQ ID NO: 106956 - protein, 17 aa, Mycobacterium avium
WSALVEFGLPGLAVDET

SEQ ID NO: 106957 - protein, 21 aa, Mycobacterium avium
WSAMLRPFMEARGYSDLAQRL

SEQ ID NO: 106958 - protein, 17 aa, Mycobacterium avium
WSASTGCRRWRRAATVP

SEQ ID NO: 106959 - protein, 17 aa, Mycobacterium avium
WSDQFGNQGWDYWDVNN

SEQ ID NO: 106960 - protein, 17 aa, Mycobacterium avium
WSFDELLPYFKRSESTC

SEQ ID NO: 106961 - protein, 17 aa, Mycobacterium avium
WSGGYFAKSVVPVRDIN

SEQ ID NO: 106962 - protein, 21 aa, Mycobacterium avium
WSGRPLLAIHEEWVLTRDLPQ

SEQ ID NO: 106963 - protein, 19 aa, Mycobacterium avium
WSGVFERFPGLRWGVTECG

SEQ ID NO: 106964 - protein, 17 aa, Mycobacterium avium
WSLPVFVNELMTLYRAG

SEQ ID NO: 106965 - protein, 20 aa, Mycobacterium avium
WSMRADGRWSDDRGANIFDG

SEQ ID NO: 106966 - protein, 17 aa, Mycobacterium avium
WSPGRVMVNAYGPTETT

SEQ ID NO: 106967 - protein, 20 aa, Mycobacterium avium
WSQFGVRLEAIGARIQQVAS

SEQ ID NO: 106968 - protein, 26 aa, Mycobacterium avium
WSQSARSRGPWPWLQPDRNGAPPVAG

SEQ ID NO: 106969 - protein, 29 aa, Mycobacterium avium
WSTIPGGPFLSFGQAYAWGQNGQGAAAYL

SEQ ID NO: 106970 - protein, 25 aa, Mycobacterium avium
WTAAAPAIRPAALALPATTVTAAAE

SEQ ID NO: 106971 - protein, 18 aa, Mycobacterium avium
WTAPLYMSDGQMWKVKHE

SEQ ID NO: 106972 - protein, 20 aa, Mycobacterium avium
WTATLKPHYVRITPTEVTGR

SEQ ID NO: 106973 - protein, 17 aa, Mycobacterium avium
WTCMIPRQVAEELGQPL

SEQ ID NO: 106974 - protein, 18 aa, Mycobacterium avium
WTDLVCVIRAPLGDTRED

SEQ ID NO: 106975 - protein, 18 aa, Mycobacterium avium
WTDPNAFDIRRPRQAHIA

SEQ ID NO: 106976 - protein, 18 aa, Mycobacterium avium
WTDRDTLLYALGVGAGVD

SEQ ID NO: 106977 - protein, 26 aa, Mycobacterium avium
WTFLGPRPANWWIRRRLHETAVHLAD

SEQ ID NO: 106978 - protein, 20 aa, Mycobacterium avium
WTGDLVKLLAADRAHAGPRV

SEQ ID NO: 106979 - protein, 19 aa, Mycobacterium avium
WTGRYIYPSHGLRFATRRP

SEQ ID NO: 106980 - protein, 23 aa, Mycobacterium avium
WTKRSLNHWYRTMGPTFETSVGL

SEQ ID NO: 106981 - protein, 18 aa, Mycobacterium avium
WTLPNGWEMTWQGRPDPA

SEQ ID NO: 106982 - protein, 18 aa, Mycobacterium avium
WTRMRVPRSLMASIGTEE

SEQ ID NO: 106983 - protein, 18 aa, Mycobacterium avium
WTRSRPGDRFIVAPQSDG

SEQ ID NO: 106984 - protein, 19 aa, Mycobacterium avium
WTSLGHRADWCQLYVRTDP

SEQ ID NO: 106985 - protein, 26 aa, Mycobacterium avium
WTVISDLRIKLGPVRLGAASDLPAPP

SEQ ID NO: 106986 - protein, 26 aa, Mycobacterium avium
WVDCPDFDLAWHLRRVAIAGTGDEAE

SEQ ID NO: 106987 - protein, 18 aa, Mycobacterium avium
WVDMFGADALRFTLARGA

SEQ ID NO: 106988 - protein, 17 aa, Mycobacterium avium
WVESLRVEWWQSCRLPV

SEQ ID NO: 106989 - protein, 18 aa, Mycobacterium avium
WVGPALMRYGTEEQKTKH

SEQ ID NO: 106990 - protein, 17 aa, Mycobacterium avium
WVLLKGLETMAIRVEHS

SEQ ID NO: 106991 - protein, 19 aa, Mycobacterium avium
WVLRNRAYTPWYLVRYWRL

SEQ ID NO: 106992 - protein, 17 aa, Mycobacterium avium
WVMLLSRYQRPKAIRNS

SEQ ID NO: 106993 - protein, 17 aa, Mycobacterium avium
WVNGQALAADGGISGAV

SEQ ID NO: 106994 - protein, 26 aa, Mycobacterium avium
WVPSPGMGLSGIWLGAVVADASGQNY

SEQ ID NO: 106995 - protein, 24 aa, Mycobacterium avium
WVQHVIWWQVYPLGFVGAYPLPQS

SEQ ID NO: 106996 - protein, 20 aa, Mycobacterium avium
WVREHQLKPAIWVRPNGRRV

SEQ ID NO: 106997 - protein, 20 aa, Mycobacterium avium
WVRRRGRWRGSRASPNRWAG

SEQ ID NO: 106998 - protein, 17 aa, Mycobacterium avium
WVSLRPTVFATNFAGMW

SEQ ID NO: 106999 - protein, 18 aa, Mycobacterium avium
WVSLRPTVFATNFAGMWS

SEQ ID NO: 107000 - protein, 17 aa, Mycobacterium avium
WVSVLGLPSTEALSPNS

SEQ ID NO: 107001 - protein, 27 aa, Mycobacterium avium
WVTCARLTAGHPVRIGAPIPGVCARVL

SEQ ID NO: 107002 - protein, 17 aa, Mycobacterium avium
WVTCARLTAGQPVRIGA

SEQ ID NO: 107003 - protein, 21 aa, Mycobacterium avium
WVVDPQWWAARRDEAAAQVRR

SEQ ID NO: 107004 - protein, 17 aa, Mycobacterium avium
WVVPTLLQHGSKEQVDR

SEQ ID NO: 107005 - protein, 18 aa, Mycobacterium avium
WWAPLRANHRVFRRNALV

SEQ ID NO: 107006 - protein, 22 aa, Mycobacterium avium
WWFDLPWSAGFVRPQHPIETIR

SEQ ID NO: 107007 - protein, 27 aa, Mycobacterium avium
WWSNRVENERAWRVPIADIEANDMYNL

SEQ ID NO: 107008 - protein, 20 aa, Mycobacterium avium
WWVRADGLATIHRDGAALET

SEQ ID NO: 107009 - protein, 25 aa, Mycobacterium avium
WYAFDRCCPFGGYKNSGIGRENGPE

SEQ ID NO: 107010 - protein, 21 aa, Mycobacterium avium
WYEGPRWLARVLRALPEAGVR

SEQ ID NO: 107011 - protein, 22 aa, Mycobacterium avium
WYETDYGLWLLGHDVGTKIDPE

SEQ ID NO: 107012 - protein, 18 aa, Mycobacterium avium
WYLRQMLGTANFRAGPVL

SEQ ID NO: 107013 - protein, 21 aa, Mycobacterium avium
YAAAVELEMPLGVHGAPGIHL

SEQ ID NO: 107014 - protein, 25 aa, Mycobacterium avium
YAAKVFLCSEVARWIDEEGLSLDVC

SEQ ID NO: 107015 - protein, 17 aa, Mycobacterium avium
YAALLWLARQPWVDPER

SEQ ID NO: 107016 - protein, 18 aa, Mycobacterium avium
YAALLWLARQPWVDPERV

SEQ ID NO: 107017 - protein, 17 aa, Mycobacterium avium
YAANCFLATKISFINEM

SEQ ID NO: 107018 - protein, 17 aa, Mycobacterium avium
YAAPPVGDLRWAPPAPP

SEQ ID NO: 107019 - protein, 20 aa, Mycobacterium avium
YAARGFPGIDACFVGNSHAG

SEQ ID NO: 107020 - protein, 21 aa, Mycobacterium avium
YAARGFPGIDACFVGNSHAGP

SEQ ID NO: 107021 - protein, 18 aa, Mycobacterium avium
YADAATFLLSNGYVNGEV

SEQ ID NO: 107022 - protein, 18 aa, Mycobacterium avium
YADRSGGVLPGYGGSKAA

SEQ ID NO: 107023 - protein, 26 aa, Mycobacterium avium
YADVEFAGAVALRLNEAGGRDAVDSL

SEQ ID NO: 107024 - protein, 24 aa, Mycobacterium avium
YAESKAAADAHLRVSDLDWTILGP

SEQ ID NO: 107025 - protein, 18 aa, Mycobacterium avium
YAESTPWGGSGGDFTEDL

SEQ ID NO: 107026 - protein, 23 aa, Mycobacterium avium
YAFDFSVWEIWGALLHGGRLVVV

SEQ ID NO: 107027 - protein, 20 aa, Mycobacterium avium
YAGHQFGGFVPRLGDGRALL

SEQ ID NO: 107028 - protein, 28 aa, Mycobacterium avium
YAGLINRIRLAGAIPRHIAAHPSPTGWR

SEQ ID NO: 107029 - protein, 23 aa, Mycobacterium avium
YAGPAMLRRATYMYGTLLPRGLF

SEQ ID NO: 107030 - protein, 24 aa, Mycobacterium avium
YAGSWPASVHMMFSGPAFGWHAEA

SEQ ID NO: 107031 - protein, 20 aa, Mycobacterium avium
YAGTIARSGEIGYLPQDPKE

SEQ ID NO: 107032 - protein, 21 aa, Mycobacterium avium
YAGTIARSGEIGYLPRDPKEG

SEQ ID NO: 107033 - protein, 25 aa, Mycobacterium avium
YAIALPILRTPWRIDPNGAEDEIVD

SEQ ID NO: 107034 - protein, 24 aa, Mycobacterium avium
YAIGKAAPVGLFIETFGTATVDPV

SEQ ID NO: 107035 - protein, 20 aa, Mycobacterium avium
YAKMMFDVMLTQVLKRLPDF

SEQ ID NO: 107036 - protein, 20 aa, Mycobacterium avium
YALLWRVGVVEIRDDDRTRA

SEQ ID NO: 107037 - protein, 27 aa, Mycobacterium avium
YALTYPRRLGFGLGNSVVSLSWRTGDD

SEQ ID NO: 107038 - protein, 23 aa, Mycobacterium avium
YAPPRLTERLFRRIATSGSGNKL

SEQ ID NO: 107039 - protein, 17 aa, Mycobacterium avium
YAPRSAERARLRAELAA

SEQ ID NO: 107040 - protein, 23 aa, Mycobacterium avium
YAPVWGSGILFELDYVLAGLHDK

SEQ ID NO: 107041 - protein, 23 aa, Mycobacterium avium
YAQLRKAKGVTIEQAREIMRDAT

SEQ ID NO: 107042 - protein, 17 aa, Mycobacterium avium
YAQNFLHMCFGDVPEQV

SEQ ID NO: 107043 - protein, 18 aa, Mycobacterium avium
YAQNVLGWAAAYATGVVP

SEQ ID NO: 107044 - protein, 24 aa, Mycobacterium avium
YAQRLATRHLLRYPGLQRAAERGA

SEQ ID NO: 107045 - protein, 18 aa, Mycobacterium avium
YARCLGSAVNPVLREGNS

SEQ ID NO: 107046 - protein, 19 aa, Mycobacterium avium
YARKHLKKWMRRRRQSLPL

SEQ ID NO: 107047 - protein, 17 aa, Mycobacterium avium
YARPVIDGIMSKAYTAI

SEQ ID NO: 107048 - protein, 23 aa, Mycobacterium avium
YASLNFPSFLPGFAGQRLQQLTD

SEQ ID NO: 107049 - protein, 18 aa, Mycobacterium avium
YATPRLADIPGVRLIGTA

SEQ ID NO: 107050 - protein, 17 aa, Mycobacterium avium
YATTVFAEMSALAARAG

SEQ ID NO: 107051 - protein, 17 aa, Mycobacterium avium
YAVPVTRPGSVTHEATR

SEQ ID NO: 107052 - protein, 26 aa, Mycobacterium avium
YAYARASAGVWKLTPFDSPPPAADPA

SEQ ID NO: 107053 - protein, 18 aa, Mycobacterium avium
YAYLVRWRDPGIVVEFGS

SEQ ID NO: 107054 - protein, 40 aa, Mycobacterium avium
YCAGSLAHFEWLVGCGVPFKAEFFGEPGWEPMGDQGLMYS

SEQ ID NO: 107055 - protein, 41 aa, Mycobacterium avium
YCAGSLAHFEWLVGCGVPFKAEFFGEPGWEPMGDQGLMYSG

SEQ ID NO: 107056 - protein, 26 aa, Mycobacterium avium
YDAAHFRPELTAVLAKHEFSAAAMAD

SEQ ID NO: 107057 - protein, 18 aa, Mycobacterium avium
YDAARAAFRQAWGAEPID

SEQ ID NO: 107058 - protein, 21 aa, Mycobacterium avium
YDALMRMLKTCQVHLEDDVRE

SEQ ID NO: 107059 - protein, 22 aa, Mycobacterium avium
YDAVFTAEAWGSDAYTPLAWWG

SEQ ID NO: 107060 - protein, 26 aa, Mycobacterium avium
YDDIPADVMPLDWYLHVRHAAEGAIA

SEQ ID NO: 107061 - protein, 22 aa, Mycobacterium avium
YDEFFFPGLAAEWAHCEVRRPF

SEQ ID NO: 107062 - protein, 21 aa, Mycobacterium avium
YDEFFFPGLAAEWAQCEVRRP

SEQ ID NO: 107063 - protein, 22 aa, Mycobacterium avium
YDEFFFPGLAAEWAQCGVRRPF

SEQ ID NO: 107064 - protein, 25 aa, Mycobacterium avium
YDFFLYATAAGLVFNKVFFPNESSL

SEQ ID NO: 107065 - protein, 19 aa, Mycobacterium avium
YDGAVAWLVGEEGRGVPTI

SEQ ID NO: 107066 - protein, 17 aa, Mycobacterium avium
YDGHAFWDTEGYVLPVL

SEQ ID NO: 107067 - protein, 17 aa, Mycobacterium avium
YDILRIELQRVGAGSAP

SEQ ID NO: 107068 - protein, 24 aa, Mycobacterium avium
YDLPFLQQWVYRPPHNEVIAQLRS

SEQ ID NO: 107069 - protein, 25 aa, Mycobacterium avium
YDRQARIGITATWVRFYDFGAGRLP

SEQ ID NO: 107070 - protein, 17 aa, Mycobacterium avium
YDTGLYLQFRATTPDDF

SEQ ID NO: 107071 - protein, 21 aa, Mycobacterium avium
YDVADILPLTPLQQGLLFHAT

SEQ ID NO: 107072 - protein, 24 aa, Mycobacterium avium
YDVDWAGCRRVTMQNVAGWKNVPV

SEQ ID NO: 107073 - protein, 19 aa, Mycobacterium avium
YDVPAPLPATEFGPVTRAP

SEQ ID NO: 107074 - protein, 26 aa, Mycobacterium avium
YDVVRRLDWPAGYTVRALNNAFLGTW

SEQ ID NO: 107075 - protein, 17 aa, Mycobacterium avium
YEAIARGEYPSWSLQVQ

SEQ ID NO: 107076 - protein, 25 aa, Mycobacterium avium
YEAIARGKYPSWSLQVQLMPFADAK

SEQ ID NO: 107077 - protein, 31 aa, Mycobacterium avium
YEAKTTFGRIGVKVWIYKGDVVGGKRELAAA

SEQ ID NO: 107078 - protein, 32 aa, Mycobacterium avium
YEAKTTFGRIGVKVWIYKGDVVGGKRELAAAA

SEQ ID NO: 107079 - protein, 18 aa, Mycobacterium avium
YEDGRFPAAPDYCEAYGK

SEQ ID NO: 107080 - protein, 23 aa, Mycobacterium avium
YEDIRALTYMNGFRLEVLGLPDY

SEQ ID NO: 107081 - protein, 25 aa, Mycobacterium avium
YEDPFWPVVLQACRDANLPVLGYHY

SEQ ID NO: 107082 - protein, 18 aa, Mycobacterium avium
YEGLPVDGYTAWLQNMAA

SEQ ID NO: 107083 - protein, 19 aa, Mycobacterium avium
YEGVERFALVAPDGSAIAV

SEQ ID NO: 107084 - protein, 25 aa, Mycobacterium avium
YEKGLRDVMKYHVSMTSSFNFPAVD

SEQ ID NO: 107085 - protein, 20 aa, Mycobacterium avium
YELAIEFANVLNLPERAKVV

SEQ ID NO: 107086 - protein, 23 aa, Mycobacterium avium
YEPLWALCAELDLTVVQHAGAGS

SEQ ID NO: 107087 - protein, 23 aa, Mycobacterium avium
YEQVTLYGLPLVSRRRVGYARID

SEQ ID NO: 107088 - protein, 22 aa, Mycobacterium avium
YERFRSCFAARDWDAMARLLTA

SEQ ID NO: 107089 - protein, 18 aa, Mycobacterium avium
YEVASGWIEPGTMGGMRF

SEQ ID NO: 107090 - protein, 21 aa, Mycobacterium avium
YEVLQRIPSVQVVFVGQRRGE

SEQ ID NO: 107091 - protein, 20 aa, Mycobacterium avium
YEVPARIFVVDELPRGAALK

SEQ ID NO: 107092 - protein, 21 aa, Mycobacterium avium
YEVTPVLWKKVAPKLSAGRVQ

SEQ ID NO: 107093 - protein, 23 aa, Mycobacterium avium
YEYVGADRQVHWADSGNSTQGVL

SEQ ID NO: 107094 - protein, 24 aa, Mycobacterium avium
YFALAGELSRDFDIHLIDFPGYGL

SEQ ID NO: 107095 - protein, 23 aa, Mycobacterium avium
YFAPGEMLPAFGGPVQAQVPRNA

SEQ ID NO: 107096 - protein, 23 aa, Mycobacterium avium
YFASWFERYARSFSGTIAGGTLE

SEQ ID NO: 107097 - protein, 29 aa, Mycobacterium avium
YFDEYKARLQPHLEAMAALKEQVKPFTQQ

SEQ ID NO: 107098 - protein, 17 aa, Mycobacterium avium
YFECAWAGNAAKAVQYC

SEQ ID NO: 107099 - protein, 18 aa, Mycobacterium avium
YFEKPRTTIGWKGLINDP

SEQ ID NO: 107100 - protein, 17 aa, Mycobacterium avium
YFFPAGHILIYRERTKA

SEQ ID NO: 107101 - protein, 20 aa, Mycobacterium avium
YFGCPQRFSFSKSALQDIRP

SEQ ID NO: 107102 - protein, 35 aa, Mycobacterium avium
YFLNLMLRAPFRLAREVLPHLPPGSAIINVTSTFA

SEQ ID NO: 107103 - protein, 35 aa, Mycobacterium avium
YFLNLMLRAPFRLAREVLPHLPPGSAIINVTSTFT

SEQ ID NO: 107104 - protein, 23 aa, Mycobacterium avium
YFQMPLVPGLGFAGGETMIEPWV

SEQ ID NO: 107105 - protein, 23 aa, Mycobacterium avium
YFTHWGGAFKYAASLLGLPIGAY

SEQ ID NO: 107106 - protein, 20 aa, Mycobacterium avium
YGAGPGDCVALLLERSAEAV

SEQ ID NO: 107107 - protein, 17 aa, Mycobacterium avium
YGDAMAPTTGWAGDEDE

SEQ ID NO: 107108 - protein, 25 aa, Mycobacterium avium
YGDTKLGLFPFRRNLAFYGVDLGLM

SEQ ID NO: 107109 - protein, 27 aa, Mycobacterium avium
YGDVAPRLGGPIAPCYHAAVDTSTGVF

SEQ ID NO: 107110 - protein, 32 aa, Mycobacterium avium
YGELRYPDLADWGVPTARAIVEVRRLLPGIPL

SEQ ID NO: 107111 - protein, 17 aa, Mycobacterium avium
YGESFIMPIEFEAARDL

SEQ ID NO: 107112 - protein, 20 aa, Mycobacterium avium
YGEVMRWALLGSEERMSAQT

SEQ ID NO: 107113 - protein, 20 aa, Mycobacterium avium
YGEVMRWALLGSEERMTAQT

SEQ ID NO: 107114 - protein, 17 aa, Mycobacterium avium
YGGLGVKDFRFNQIVSE

SEQ ID NO: 107115 - protein, 18 aa, Mycobacterium avium
YGGLKLAEVCLRVGVSTG

SEQ ID NO: 107116 - protein, 21 aa, Mycobacterium avium
YGGLRAARWLGVPTVAVYQTD

SEQ ID NO: 107117 - protein, 17 aa, Mycobacterium avium
YGGRKLDLTLGRVPRVD

SEQ ID NO: 107118 - protein, 17 aa, Mycobacterium avium
YGGSGVDDFRFNAVIDE

SEQ ID NO: 107119 - protein, 26 aa, Mycobacterium avium
YGISDSAAFELLKWLSQEGNVKLRPL

SEQ ID NO: 107120 - protein, 17 aa, Mycobacterium avium
YGLIPRAHRGIVAVNEL

SEQ ID NO: 107121 - protein, 17 aa, Mycobacterium avium
YGLKVGGTAAWQGLKTL

SEQ ID NO: 107122 - protein, 20 aa, Mycobacterium avium
YGLNKVRFLAPVTAGSRVRV

SEQ ID NO: 107123 - protein, 19 aa, Mycobacterium avium
YGLTYPGVAFVVWRSKEYL

SEQ ID NO: 107124 - protein, 24 aa, Mycobacterium avium
YGMAEATCAVTMPGCGEGLQIDER

SEQ ID NO: 107125 - protein, 23 aa, Mycobacterium avium
YGMAEATCAVTMPSCGEGLQIDE

SEQ ID NO: 107126 - protein, 23 aa, Mycobacterium avium
YGPEVKDPLYVLAGRDEGYVPFY

SEQ ID NO: 107127 - protein, 17 aa, Mycobacterium avium
YGPIPAAVARRMVANAA

SEQ ID NO: 107128 - protein, 25 aa, Mycobacterium avium
YGPQTGELMLGMATQGVVTRTVRDS

SEQ ID NO: 107129 - protein, 29 aa, Mycobacterium avium
YGQRLPAPPSYRSYLMWLSAQDRAAAQDA

SEQ ID NO: 107130 - protein, 23 aa, Mycobacterium avium
YGRPATAVLIDFADLAVTPVAFD

SEQ ID NO: 107131 - protein, 20 aa, Mycobacterium avium
YGSIFPPVWNFQLALHTRGY

SEQ ID NO: 107132 - protein, 18 aa, Mycobacterium avium
YGVARAFVDARIQTIYGG

SEQ ID NO: 107133 - protein, 26 aa, Mycobacterium avium
YGVDPLILRQAYPVPQAPYGLAGSRA

SEQ ID NO: 107134 - protein, 21 aa, Mycobacterium avium
YGVKVTGCTVHLVDAGTDTGP

SEQ ID NO: 107135 - protein, 22 aa, Mycobacterium avium
YGVKVTGCTVHLVDAGTDTGPI

SEQ ID NO: 107136 - protein, 19 aa, Mycobacterium avium
YGVRPLRLAWRNRQRIPRF

SEQ ID NO: 107137 - protein, 19 aa, Mycobacterium avium
YHAYPAHAAFGGYKQSGIG

SEQ ID NO: 107138 - protein, 27 aa, Mycobacterium avium
YHLTTLFPPVRPRQWLEIRYLDSVPDT

SEQ ID NO: 107139 - protein, 19 aa, Mycobacterium avium
YHTIIPGFVTKGGAPVMSF

SEQ ID NO: 107140 - protein, 24 aa, Mycobacterium avium
YHTVWFELHEELILATGLTRDAEA

SEQ ID NO: 107141 - protein, 35 aa, Mycobacterium avium
YIAQLDWPLADAVRWPAQYISEFAWERQLDVDAKM

SEQ ID NO: 107142 - protein, 18 aa, Mycobacterium avium
YIPLMLIPMWDPKLAAKE

SEQ ID NO: 107143 - protein, 24 aa, Mycobacterium avium
YIVEKRFNLSWSIEGTRSRTGKML

SEQ ID NO: 107144 - protein, 17 aa, Mycobacterium avium
YIVLESKTLNDCVVLEL

SEQ ID NO: 107145 - protein, 24 aa, Mycobacterium avium
YKAELIYGPARPGPWKTVEDVELA

SEQ ID NO: 107146 - protein, 20 aa, Mycobacterium avium
YKFNDEFPMSEGFEENAAFF

SEQ ID NO: 107147 - protein, 25 aa, Mycobacterium avium
YKTARSIPKDAWLDRIGEVSDAKGD

SEQ ID NO: 107148 - protein, 23 aa, Mycobacterium avium
YKVPRSITVLDELPRSSTGKIAR

SEQ ID NO: 107149 - protein, 17 aa, Mycobacterium avium
YLAANGFAADRDHAIYA

SEQ ID NO: 107150 - protein, 27 aa, Mycobacterium avium
YLAGLCGALRRYHEVFGVPISTLPMAV

SEQ ID NO: 107151 - protein, 27 aa, Mycobacterium avium
YLALLDALRWLGLDWDEGPEVGGPYGP

SEQ ID NO: 107152 - protein, 28 aa, Mycobacterium avium
YLALLDALRWLGLDWDEGPEVGGPYGPY

SEQ ID NO: 107153 - protein, 20 aa, Mycobacterium avium
YLAQLKKIGVAWQPGGDTTL

SEQ ID NO: 107154 - protein, 20 aa, Mycobacterium avium
YLCADAGFTAADRALQTHGG

SEQ ID NO: 107155 - protein, 18 aa, Mycobacterium avium
YLDFTFAGLPAYKQGLGR

SEQ ID NO: 107156 - protein, 26 aa, Mycobacterium avium
YLDTEPWRAGPLLDYLRKMVFWSDVT

SEQ ID NO: 107157 - protein, 21 aa, Mycobacterium avium
YLESWLLPSLGLRATVFHFNP

SEQ ID NO: 107158 - protein, 18 aa, Mycobacterium avium
YLGGAGRWRDSGMPGTPR

SEQ ID NO: 107159 - protein, 27 aa, Mycobacterium avium
YLGPVHVCSAFLPGMIETHGGGRVVNV

SEQ ID NO: 107160 - protein, 18 aa, Mycobacterium avium
YLHDMSAWTALSVTEQEN

SEQ ID NO: 107161 - protein, 18 aa, Mycobacterium avium
YLHTDYRSITPIGEELAV

SEQ ID NO: 107162 - protein, 18 aa, Mycobacterium avium
YLIFRCIFSNRPPTHLTI

SEQ ID NO: 107163 - protein, 17 aa, Mycobacterium avium
YLLLGALLEKITGEDED

SEQ ID NO: 107164 - protein, 18 aa, Mycobacterium avium
YLLSGGKGRSWETVTEAE

SEQ ID NO: 107165 - protein, 29 aa, Mycobacterium avium
YLNDRVVALPELLRDAGYLTLMSGKWHLG

SEQ ID NO: 107166 - protein, 19 aa, Mycobacterium avium
YLRIREWQDLVGQLRGIAG

SEQ ID NO: 107167 - protein, 20 aa, Mycobacterium avium
YLRIREWQDLVGQLRGIAGE

SEQ ID NO: 107168 - protein, 20 aa, Mycobacterium avium
YLRIREWQDLVGQLRGIARE

SEQ ID NO: 107169 - protein, 17 aa, Mycobacterium avium
YLSCATPAAADRAATVL

SEQ ID NO: 107170 - protein, 17 aa, Mycobacterium avium
YLTEGLTDLVGRAVRRL

SEQ ID NO: 107171 - protein, 20 aa, Mycobacterium avium
YLTPHSKWSFHSTYQDNLYM

SEQ ID NO: 107172 - protein, 17 aa, Mycobacterium avium
YLVARRVLPDGSAHVFH

SEQ ID NO: 107173 - protein, 20 aa, Mycobacterium avium
YLVNGRIAAFPKTFNAKPGQ

SEQ ID NO: 107174 - protein, 17 aa, Mycobacterium avium
YLWPDVTLVGGPAGAPV

SEQ ID NO: 107175 - protein, 19 aa, Mycobacterium avium
YLYRDGSDFVFMDSQDYEQ

SEQ ID NO: 107176 - protein, 18 aa, Mycobacterium avium
YMAARTAFFDNFFLAATH

SEQ ID NO: 107177 - protein, 17 aa, Mycobacterium avium
YMHDFGLTREQLGWIAL

SEQ ID NO: 107178 - protein, 23 aa, Mycobacterium avium
YMPRLRDRRVLDEGIIDMPMIWQ

SEQ ID NO: 107179 - protein, 24 aa, Mycobacterium avium
YNGFFYKVMPPFCIGTSASGVGDY

SEQ ID NO: 107180 - protein, 24 aa, Mycobacterium avium
YNLRYRVWADWDFNIRCFSNPALI

SEQ ID NO: 107181 - protein, 17 aa, Mycobacterium avium
YNVKRVEDVIGEADIVI

SEQ ID NO: 107182 - protein, 21 aa, Mycobacterium avium
YPAYLDWAVRLARPGAVIVAD

SEQ ID NO: 107183 - protein, 22 aa, Mycobacterium avium
YPDGHAGTWVRANFIASVDGGA

SEQ ID NO: 107184 - protein, 27 aa, Mycobacterium avium
YPDGPYHLVGWSFGGVVAHELAIELQR

SEQ ID NO: 107185 - protein, 25 aa, Mycobacterium avium
YPDIDLGAFSYRQCHIQDPESVDAL

SEQ ID NO: 107186 - protein, 19 aa, Mycobacterium avium
YPDLADWGVPTARAIVEVR

SEQ ID NO: 107187 - protein, 17 aa, Mycobacterium avium
YPDVELACYQRMGSQDP

SEQ ID NO: 107188 - protein, 21 aa, Mycobacterium avium
YPEPFLYTYCRDDDPQVLVRG

SEQ ID NO: 107189 - protein, 21 aa, Mycobacterium avium
YPFELAETLAYAFGRDTFEQW

SEQ ID NO: 107190 - protein, 21 aa, Mycobacterium avium
YPGDGRPALLQVRSGSSLAGN

SEQ ID NO: 107191 - protein, 24 aa, Mycobacterium avium
YPHLRGLHKPLLPEGIAQPEDIAD

SEQ ID NO: 107192 - protein, 17 aa, Mycobacterium avium
YPIAANRIRGVWLPGPV

SEQ ID NO: 107193 - protein, 17 aa, Mycobacterium avium
YPLGLVAPANFALHVIR

SEQ ID NO: 107194 - protein, 24 aa, Mycobacterium avium
YPLLRELRRKAAVHPGWPEMGVPE

SEQ ID NO: 107195 - protein, 20 aa, Mycobacterium avium
YPPEVLLTGIIVNKEGKRFV

SEQ ID NO: 107196 - protein, 27 aa, Mycobacterium avium
YPPLADYRGASVLVDWPAELQQRVRTV

SEQ ID NO: 107197 - protein, 25 aa, Mycobacterium avium
YPPMGPELVAPVVGWLAHESCSVSG

SEQ ID NO: 107198 - protein, 17 aa, Mycobacterium avium
YPPVAISMLIAQAARSL

SEQ ID NO: 107199 - protein, 25 aa, Mycobacterium avium
YPPWLAEPWDSVGLVCGDPDEPVES

SEQ ID NO: 107200 - protein, 18 aa, Mycobacterium avium
YPQLRFVLTEVRSDWLPV

SEQ ID NO: 107201 - protein, 23 aa, Mycobacterium avium
YPQPDPRGWLVFESLPADLQRAE

SEQ ID NO: 107202 - protein, 20 aa, Mycobacterium avium
YPRFGPWGQLDRWRRHYDGV

SEQ ID NO: 107203 - protein, 20 aa, Mycobacterium avium
YPRFGPWGQLDRWRRQYDGV

SEQ ID NO: 107204 - protein, 23 aa, Mycobacterium avium
YPRNQECLLRLAALAERQEPNQV

SEQ ID NO: 107205 - protein, 20 aa, Mycobacterium avium
YPRQAPAVGYAPTLALLPRR

SEQ ID NO: 107206 - protein, 17 aa, Mycobacterium avium
YPSNGVLIRAALRDHAE

SEQ ID NO: 107207 - protein, 17 aa, Mycobacterium avium
YPSQVFLTLFGLPLEDR

SEQ ID NO: 107208 - protein, 19 aa, Mycobacterium avium
YPSRLSNALTRVAAGDHSW

SEQ ID NO: 107209 - protein, 19 aa, Mycobacterium avium
YPSRSIEGLYDYTAPDGSE

SEQ ID NO: 107210 - protein, 24 aa, Mycobacterium avium
YPTCASTSGCRRSRPTRGPGRDSA

SEQ ID NO: 107211 - protein, 19 aa, Mycobacterium avium
YPTPGHAVGLSFSVAPGVS

SEQ ID NO: 107212 - protein, 19 aa, Mycobacterium avium
YPVAFPVGLLPTNPNDSGG

SEQ ID NO: 107213 - protein, 18 aa, Mycobacterium avium
YPVALTISQRLDWARVVA

SEQ ID NO: 107214 - protein, 17 aa, Mycobacterium avium
YPVGEGRVSFDLGPSQI

SEQ ID NO: 107215 - protein, 19 aa, Mycobacterium avium
YPVWHRLREKGPVLPGVLH

SEQ ID NO: 107216 - protein, 20 aa, Mycobacterium avium
YPVWQRMRDALPLYHHEKYG

SEQ ID NO: 107217 - protein, 18 aa, Mycobacterium avium
YPVYRELRNTTPVVWNDV

SEQ ID NO: 107218 - protein, 18 aa, Mycobacterium avium
YQFGDAKPVYALEGSIAV

SEQ ID NO: 107219 - protein, 27 aa, Mycobacterium avium
YQINYLRCIGCGFCIEACPTRALTMIN

SEQ ID NO: 107220 - protein, 21 aa, Mycobacterium avium
YQLGNLVLRGGPFALGCFAGW

SEQ ID NO: 107221 - protein, 23 aa, Mycobacterium avium
YQPSARLAVSVRRWTACGAVCGG

SEQ ID NO: 107222 - protein, 17 aa, Mycobacterium avium
YQQATDVVIARGLSQRG

SEQ ID NO: 107223 - protein, 23 aa, Mycobacterium avium
YQRARGKGGLVRITWAEATELIA

SEQ ID NO: 107224 - protein, 22 aa, Mycobacterium avium
YQSKRSGARPCRCRTSRHHAAS

SEQ ID NO: 107225 - protein, 17 aa, Mycobacterium avium
YQVLVCWDAAPVSEYST

SEQ ID NO: 107226 - protein, 17 aa, Mycobacterium avium
YQVPLWPERLLTRDGGA

SEQ ID NO: 107227 - protein, 20 aa, Mycobacterium avium
YRAAGRVFSADLARTYVGHL

SEQ ID NO: 107228 - protein, 22 aa, Mycobacterium avium
YRAATGVYARLGSCVNATHYLV

SEQ ID NO: 107229 - protein, 19 aa, Mycobacterium avium
YRAFQTLVFRTDLITDAQV

SEQ ID NO: 107230 - protein, 27 aa, Mycobacterium avium
YRALGFPTRMFTVLFALGACPAGSRTG

SEQ ID NO: 107231 - protein, 19 aa, Mycobacterium avium
YRCADLASEVAFLAMDFEY

SEQ ID NO: 107232 - protein, 19 aa, Mycobacterium avium
YRCADLASEVSFLAMDFEY

SEQ ID NO: 107233 - protein, 18 aa, Mycobacterium avium
YRCGPYGVLIVRDDDGAL

SEQ ID NO: 107234 - protein, 19 aa, Mycobacterium avium
YRDIGAGFGQRVMTSDEFI

SEQ ID NO: 107235 - protein, 24 aa, Mycobacterium avium
YRDPRIPHTLYRPTFVKSLVMVPI

SEQ ID NO: 107236 - protein, 23 aa, Mycobacterium avium
YRDRGCPEPEPLSPELIREMMDW

SEQ ID NO: 107237 - protein, 24 aa, Mycobacterium avium
YRDRGCPEPEPLSPELIREMMDWA

SEQ ID NO: 107238 - protein, 23 aa, Mycobacterium avium
YRDRSCPEPEPLSPGLIREMMDW

SEQ ID NO: 107239 - protein, 18 aa, Mycobacterium avium
YRDVLVPLNGRWLFAHRR

SEQ ID NO: 107240 - protein, 17 aa, Mycobacterium avium
YRDYIGWLASRDPEASQ

SEQ ID NO: 107241 - protein, 17 aa, Mycobacterium avium
YREALRLARDVVNNPSA

SEQ ID NO: 107242 - protein, 23 aa, Mycobacterium avium
YREKLCADWYFGGQVEGVAGDVL

SEQ ID NO: 107243 - protein, 20 aa, Mycobacterium avium
YRELDDWSTRLARKLIQHGV

SEQ ID NO: 107244 - protein, 22 aa, Mycobacterium avium
YREMCPRIMAMTVRERKVCALW

SEQ ID NO: 107245 - protein, 22 aa, Mycobacterium avium
YRGDHGRWPQSVGLSVWGTSAM

SEQ ID NO: 107246 - protein, 22 aa, Mycobacterium avium
YRKFEEIFLPKFPPPFRAGDLS

SEQ ID NO: 107247 - protein, 27 aa, Mycobacterium avium
YRLDLACLLGCGFITGWGSAVYAAEVR

SEQ ID NO: 107248 - protein, 27 aa, Mycobacterium avium
YRLDLACLLGCGFITGWGSSVYAANVR

SEQ ID NO: 107249 - protein, 20 aa, Mycobacterium avium
YRLQPINTIEVLGLEGDRLT

SEQ ID NO: 107250 - protein, 22 aa, Mycobacterium avium
YRLRELREAAGYTQTTLAAAIG

SEQ ID NO: 107251 - protein, 23 aa, Mycobacterium avium
YRLTGDIPAGAFVRDGHTGPGGT

SEQ ID NO: 107252 - protein, 24 aa, Mycobacterium avium
YRLTGDVPAGAFVRDGHTGPGGTL

SEQ ID NO: 107253 - protein, 17 aa, Mycobacterium avium
YRLTGTLQIRGAARNHV

SEQ ID NO: 107254 - protein, 17 aa, Mycobacterium avium
YRLTGTLQIRGTARNRV

SEQ ID NO: 107255 - protein, 20 aa, Mycobacterium avium
YRMKAEFFKTLGHPARIRVL

SEQ ID NO: 107256 - protein, 20 aa, Mycobacterium avium
YRNDGARGWTGTSPVGTFAP

SEQ ID NO: 107257 - protein, 20 aa, Mycobacterium avium
YRPAAEFEELTGATILQFYG

SEQ ID NO: 107258 - protein, 18 aa, Mycobacterium avium
YRPADRLADMDIAGIEAS

SEQ ID NO: 107259 - protein, 17 aa, Mycobacterium avium
YRPDIDLTIAYGMAENQ

SEQ ID NO: 107260 - protein, 17 aa, Mycobacterium avium
YRPDLVLQPPRTWDAVV

SEQ ID NO: 107261 - protein, 18 aa, Mycobacterium avium
YRPGCWLDSGPFGCLGSG

SEQ ID NO: 107262 - protein, 17 aa, Mycobacterium avium
YRPGTLTTGRWGLLEPA

SEQ ID NO: 107263 - protein, 19 aa, Mycobacterium avium
YRPTISALRAAGIPKAGRQ

SEQ ID NO: 107264 - protein, 17 aa, Mycobacterium avium
YRRFIAYRERLGFEVLP

SEQ ID NO: 107265 - protein, 26 aa, Mycobacterium avium
YRRGRRVVVALPFGVGQPVDRPALRR

SEQ ID NO: 107266 - protein, 19 aa, Mycobacterium avium
YRRHPRGMWYKSITDPATF

SEQ ID NO: 107267 - protein, 17 aa, Mycobacterium avium
YRRLRDAGGPVFVRTNR

SEQ ID NO: 107268 - protein, 17 aa, Mycobacterium avium
YRRYAIRHRHMYRLMFG

SEQ ID NO: 107269 - protein, 23 aa, Mycobacterium avium
YRSDELQIFLYARPDSGVVYSRV

SEQ ID NO: 107270 - protein, 17 aa, Mycobacterium avium
YRSGNRLVRVDLNELDA

SEQ ID NO: 107271 - protein, 27 aa, Mycobacterium avium
YRSIWMYLKELEFRQGFIDIPVNGVLV

SEQ ID NO: 107272 - protein, 17 aa, Mycobacterium avium
YRSKPRSPEGLKKNLRL

SEQ ID NO: 107273 - protein, 27 aa, Mycobacterium avium
YRSLWMYLKELEFRQGFVDIAVNGTVV

SEQ ID NO: 107274 - protein, 17 aa, Mycobacterium avium
YRTGDLVRWRADGQLDY

SEQ ID NO: 107275 - protein, 25 aa, Mycobacterium avium
YRTVRVGRHDVRMLLAKNPAGWQEA

SEQ ID NO: 107276 - protein, 21 aa, Mycobacterium avium
YRVADVLPLTPLQQGLLFHAG

SEQ ID NO: 107277 - protein, 25 aa, Mycobacterium avium
YRVNGAKAWITHGGIADFYSLFART

SEQ ID NO: 107278 - protein, 22 aa, Mycobacterium avium
YRYDSTFLLRGLTELHIEFTQA

SEQ ID NO: 107279 - protein, 21 aa, Mycobacterium avium
YRYESTFLLRGLTELHIEFTQ

SEQ ID NO: 107280 - protein, 21 aa, Mycobacterium avium
YRYESTFLLRGLTELHIEFTR

SEQ ID NO: 107281 - protein, 19 aa, Mycobacterium avium
YRYWSREAIIADIDRRRHP

SEQ ID NO: 107282 - protein, 21 aa, Mycobacterium avium
YSAAAALHFAEKALVEIRAGR

SEQ ID NO: 107283 - protein, 25 aa, Mycobacterium avium
YSALDPELWTWVAVSGLNLLYQAYL

SEQ ID NO: 107284 - protein, 17 aa, Mycobacterium avium
YSAVTVCERDELPAAPA

SEQ ID NO: 107285 - protein, 21 aa, Mycobacterium avium
YSDTFHVMLLGSGYTPDDTHR

SEQ ID NO: 107286 - protein, 28 aa, Mycobacterium avium
YSGGMIRRLEVAQALVNRPSLLVLDEPT

SEQ ID NO: 107287 - protein, 24 aa, Mycobacterium avium
YSGPTAALTDVWRALRASMRSVLE

SEQ ID NO: 107288 - protein, 20 aa, Mycobacterium avium
YSLSCGFDGNNHPLLQIIVN

SEQ ID NO: 107289 - protein, 21 aa, Mycobacterium avium
YSPARWCWPARRGRCGAPSCR

SEQ ID NO: 107290 - protein, 29 aa, Mycobacterium avium
YSQGAICGSWWWRDFILANGLQARVPAAL

SEQ ID NO: 107291 - protein, 17 aa, Mycobacterium avium
YSQNLACEVVLAELATE

SEQ ID NO: 107292 - protein, 24 aa, Mycobacterium avium
YSRRLRPVMYMSALTAIRCDPQSR

SEQ ID NO: 107293 - protein, 25 aa, Mycobacterium avium
YSTLQAGPEFVRWLDERGPARMPEI

SEQ ID NO: 107294 - protein, 17 aa, Mycobacterium avium
YSVWEIWGALLHGGRLV

SEQ ID NO: 107295 - protein, 23 aa, Mycobacterium avium
YTALTRLRIRDGVQLPRGSTAEL

SEQ ID NO: 107296 - protein, 24 aa, Mycobacterium avium
YTALTRLRIRDGVQLPRGSTAELR

SEQ ID NO: 107297 - protein, 17 aa, Mycobacterium avium
YTARAQLAPVVFEGTSF

SEQ ID NO: 107298 - protein, 17 aa, Mycobacterium avium
YTARAVACFAYRRPVPV

SEQ ID NO: 107299 - protein, 19 aa, Mycobacterium avium
YTDALIWTPAHLVADDVAE

SEQ ID NO: 107300 - protein, 23 aa, Mycobacterium avium
YTDRPVWVRGVGLGMDRVMHQHK

SEQ ID NO: 107301 - protein, 23 aa, Mycobacterium avium
YTEARLTPLAMEMLRQIDEETVD

SEQ ID NO: 107302 - protein, 29 aa, Mycobacterium avium
YTEEMPIAVPWSLPAVRPVHSGDPDDPAP

SEQ ID NO: 107303 - protein, 18 aa, Mycobacterium avium
YTFRLNVGAYFYLTKAVL

SEQ ID NO: 107304 - protein, 23 aa, Mycobacterium avium
YTGAQRYWWSPGVTQVVPNWNDQ

SEQ ID NO: 107305 - protein, 20 aa, Mycobacterium avium
YTGIARWRALGDYWFEGVSR

SEQ ID NO: 107306 - protein, 18 aa, Mycobacterium avium
YTICRPESLPAQVHSADA

SEQ ID NO: 107307 - protein, 24 aa, Mycobacterium avium
YTLDRVGADWPIRYEDLRRHYEQV

SEQ ID NO: 107308 - protein, 27 aa, Mycobacterium avium
YTLKEPYSVVGLIFPWNGPIFNANAKL

SEQ ID NO: 107309 - protein, 23 aa, Mycobacterium avium
YTLKSVAAKDVWVRPTERARAEA

SEQ ID NO: 107310 - protein, 25 aa, Mycobacterium avium
YTLRFKDLRTGELYPDEIADIAAGA

SEQ ID NO: 107311 - protein, 21 aa, Mycobacterium avium
YTLRLPLDVLVVASANPEDYT

SEQ ID NO: 107312 - protein, 18 aa, Mycobacterium avium
YTLTRRRAHRPVRTVVSA

SEQ ID NO: 107313 - protein, 19 aa, Mycobacterium avium
YTPAPELIAGFAIRTARPK

SEQ ID NO: 107314 - protein, 19 aa, Mycobacterium avium
YTQWERWAFAHLPLAKKLY

SEQ ID NO: 107315 - protein, 17 aa, Mycobacterium avium
YTRPCADSAALVLIDVQ

SEQ ID NO: 107316 - protein, 21 aa, Mycobacterium avium
YTVKDLRTWHGTVLAAAAFAE

SEQ ID NO: 107317 - protein, 18 aa, Mycobacterium avium
YTVRAGCLARLGRIGDCE

SEQ ID NO: 107318 - protein, 27 aa, Mycobacterium avium
YTVRYDWPVRTGIIIGRLDDDGSRFLA

SEQ ID NO: 107319 - protein, 27 aa, Mycobacterium avium
YTVRYDWPVRTGIIIGRLDDGSRFLAL

SEQ ID NO: 107320 - protein, 27 aa, Mycobacterium avium
YTVRYDWPVRTGIMIGRLDDDGSRFLA

SEQ ID NO: 107321 - protein, 24 aa, Mycobacterium avium
YVAAHMPYLAWLQLAGALSAEAAA

SEQ ID NO: 107322 - protein, 19 aa, Mycobacterium avium
YVAGRGVGYGYLRRAGLTA

SEQ ID NO: 107323 - protein, 17 aa, Mycobacterium avium
YVAKGLSAKQIAEKLSL

SEQ ID NO: 107324 - protein, 17 aa, Mycobacterium avium
YVDAAVIEHRFVGLFTV

SEQ ID NO: 107325 - protein, 19 aa, Mycobacterium avium
YVFDFGRREVRNFWWPTRC

SEQ ID NO: 107326 - protein, 18 aa, Mycobacterium avium
YVGADWPVEFGGRDDRSA

SEQ ID NO: 107327 - protein, 23 aa, Mycobacterium avium
YVGDADALYAEWAALDNLGGRLL

SEQ ID NO: 107328 - protein, 20 aa, Mycobacterium avium
YVGVSGRFGLRGGPVLIGRT

SEQ ID NO: 107329 - protein, 20 aa, Mycobacterium avium
YVHNLIHGFILAAQHLTPGG

SEQ ID NO: 107330 - protein, 20 aa, Mycobacterium avium
YVHRWEEIPNISLWQEDGPV

SEQ ID NO: 107331 - protein, 17 aa, Mycobacterium avium
YVKEEFEAAGLAFPSAR

SEQ ID NO: 107332 - protein, 27 aa, Mycobacterium avium
YVLAHPCPMCLGALYYCSPREVVFLTT

SEQ ID NO: 107333 - protein, 23 aa, Mycobacterium avium
YVPGEPFATHVLNVLHLQLPAGE

SEQ ID NO: 107334 - protein, 19 aa, Mycobacterium avium
YVPLFRKLLRNTRLEVDVT

SEQ ID NO: 107335 - protein, 22 aa, Mycobacterium avium
YVPSLACARCRTIARCRHCTGP

SEQ ID NO: 107336 - protein, 23 aa, Mycobacterium avium
YVPSLACARCRTIARCRHCTGPL

SEQ ID NO: 107337 - protein, 20 aa, Mycobacterium avium
YVSHTNKWVCRRLSPDRQSP

SEQ ID NO: 107338 - protein, 21 aa, Mycobacterium avium
YVTYLAWRGLVTMEPPRRPEP

SEQ ID NO: 107339 - protein, 17 aa, Mycobacterium avium
YVVQLLISGAGALHIPS

SEQ ID NO: 107340 - protein, 23 aa, Mycobacterium avium
YVVSGWRADTFVAGTPEPRHDEV

SEQ ID NO: 107341 - protein, 23 aa, Mycobacterium avium
YWDEMLDRFVPHKTVLYGTGYLR

SEQ ID NO: 107342 - protein, 19 aa, Mycobacterium avium
YWLQEFHIDGLRVDAVASM

SEQ ID NO: 107343 - protein, 18 aa, Mycobacterium avium
YWNMPRAQISLVATGLER

SEQ ID NO: 107344 - protein, 19 aa, Mycobacterium avium
YWPDGTLEFVGRADHRVKI

SEQ ID NO: 107345 - protein, 22 aa, Mycobacterium avium
YWQEALAGLPERLALPTDRPYP

SEQ ID NO: 107346 - protein, 23 aa, Mycobacterium avium
YWRDGYKTLHGMTSRGFPNQFYT

SEQ ID NO: 107347 - protein, 22 aa, Mycobacterium avium
YWRHVDPDIGRKVEEGVRANLN

SEQ ID NO: 107348 - protein, 17 aa, Mycobacterium avium
YWVCKRSTPHAAEALEC

SEQ ID NO: 107349 - protein, 20 aa, Mycobacterium avium
YWYRNIRQTVQFDQTVRSAA

SEQ ID NO: 107350 - protein, 17 aa, Mycobacterium avium
YYASKSLILYDIYQQAA

SEQ ID NO: 107351 - protein, 18 aa, Mycobacterium avium
YYASLLIRHGESVKTVQA

SEQ ID NO: 107352 - protein, 18 aa, Mycobacterium avium
YYFRDFWGADSGMLAALY

SEQ ID NO: 107353 - protein, 17 aa, Mycobacterium avium
YYGSMWPNNSAVGASYG

SEQ ID NO: 107354 - protein, 23 aa, Mycobacterium avium
YYSQGRRAVSMVPVKRFHDQLNA

SEQ ID NO: 107355 - protein, 17 aa, Mycobacterium avium
KEIKRRTDVVGVFPNPA

SEQ ID NO: 107356 - protein, 17 aa, Mycobacterium avium
QRFPYVFLDATYCKARV

SEQ ID NO: 107357 - protein, 23 aa, Mycobacterium avium
LRIPKLRTGSFFPALLERRRRVD

SEQ ID NO: 107358 - protein, 24 aa, Mycobacterium avium
SAIDAVLIGAAWQRCRVHFLRNVL

SEQ ID NO: 107359 - protein, 23 aa, Mycobacterium avium
ALARRRLNVLWAMLRDHAVYHPA

SEQ ID NO: 107360 - protein, 23 aa, Mycobacterium avium
LRIPKLRSGSFFPALLERRRRVD

SEQ ID NO: 107361 - protein, 19 aa, Mycobacterium avium
ANEILKRAASFFGAELDRQ

SEQ ID NO: 107362 - protein, 21 aa, Mycobacterium avium
FADFPVLHWKKIWSTNPLERL

SEQ ID NO: 107363 - protein, 22 aa, Mycobacterium avium
LARRHVDVLWALLRDNRTWQPQ

SEQ ID NO: 107364 - protein, 18 aa, Mycobacterium avium
NEILKRAASFFGAELDRQ

SEQ ID NO: 107365 - protein, 18 aa, Mycobacterium avium
DGALGFWKAMREVFPATR

SEQ ID NO: 107366 - protein, 18 aa, Mycobacterium avium
FSSAILPAWARKSPQMTE

SEQ ID NO: 107367 - protein, 18 aa, Mycobacterium avium
TEVLPLLYLHGLSTSDFG

SEQ ID NO: 107368 - protein, 18 aa, Mycobacterium avium
GVAYVCFLTDAFSRMIIG

SEQ ID NO: 107369 - protein, 22 aa, Mycobacterium avium
QWRSHLRKILSLMPVGVPVHDR

SEQ ID NO: 107370 - protein, 20 aa, Mycobacterium avium
AALRRLKLATVRRNAAEVLQ

SEQ ID NO: 107371 - protein, 19 aa, Mycobacterium avium
IAMNFGMDGPWGQWVNRWT

SEQ ID NO: 107372 - protein, 18 aa, Mycobacterium avium
KDNYCVYGARKLWKTARR

SEQ ID NO: 107373 - protein, 19 aa, Mycobacterium avium
YERRSLAIASHWPFEQWGR

SEQ ID NO: 107374 - protein, 17 aa, Mycobacterium avium
ACPFGAPGARMYRTGDL

SEQ ID NO: 107375 - protein, 17 aa, Mycobacterium avium
AERPAVVPLSFAQSRLW

SEQ ID NO: 107376 - protein, 22 aa, Mycobacterium avium
AGPALACGNAFVLKPSERDPSV

SEQ ID NO: 107377 - protein, 24 aa, Mycobacterium avium
AVLAYSRWRFVRFAADEKASTTLA

SEQ ID NO: 107378 - protein, 18 aa, Mycobacterium avium
DGLSCIRYGSARYSVPQR

SEQ ID NO: 107379 - protein, 22 aa, Mycobacterium avium
GCSHPGCDVSGYYCEVHHVTGY

SEQ ID NO: 107380 - protein, 17 aa, Mycobacterium avium
LIGASWQRCRVHFLRNV

SEQ ID NO: 107381 - protein, 21 aa, Mycobacterium avium
RPAVVPLSFAQSRLWFIGQLH

SEQ ID NO: 107382 - protein, 24 aa, Mycobacterium avium
RSWAEFVPFLAFPVEIRKIIYTTN

SEQ ID NO: 107383 - protein, 19 aa, Mycobacterium avium
SAIDAVLIGAAWQRCRVHF

SEQ ID NO: 107384 - protein, 19 aa, Mycobacterium avium
VACPFGGPGARMYRTGDLV

SEQ ID NO: 107385 - protein, 18 aa, Mycobacterium avium
VRLAELFVEAGLPPGVFQ

SEQ ID NO: 107386 - protein, 18 aa, Mycobacterium avium
YHTFGGWKRSGFGDLNQH

SEQ ID NO: 107387 - protein, 25 aa, Mycobacterium avium
AAAGRPWWEWAATYERAFSAAYDAL

SEQ ID NO: 107388 - protein, 17 aa, Mycobacterium avium
AAAPWSRAIVGSAVSAA

SEQ ID NO: 107389 - protein, 20 aa, Mycobacterium avium
AACTERLRLGVAVLVTSLHD

SEQ ID NO: 107390 - protein, 19 aa, Mycobacterium avium
AAEARLGFGDPALFAEALL

SEQ ID NO: 107391 - protein, 21 aa, Mycobacterium avium
AAGRWPAVRFAVRNTAVQGPN

SEQ ID NO: 107392 - protein, 18 aa, Mycobacterium avium
AAGVPVRVALPVGTSFSD

SEQ ID NO: 107393 - protein, 18 aa, Mycobacterium avium
AAILASIAFHTRVTADDV

SEQ ID NO: 107394 - protein, 17 aa, Mycobacterium avium
AAIRLLAAIGYDVVLLE

SEQ ID NO: 107395 - protein, 20 aa, Mycobacterium avium
AAKWREIFGADNFFLELMDH

SEQ ID NO: 107396 - protein, 21 aa, Mycobacterium avium
AALADRWAPGRVMINAYGPTE

SEQ ID NO: 107397 - protein, 24 aa, Mycobacterium avium
AALELAGALGFRLHHRRRYLTVPA

SEQ ID NO: 107398 - protein, 17 aa, Mycobacterium avium
AALGVGISLGNLTMPPA

SEQ ID NO: 107399 - protein, 18 aa, Mycobacterium avium
AALRAVPAERLWVNPDCG

SEQ ID NO: 107400 - protein, 24 aa, Mycobacterium avium
AALTARLAFDWAQLKPGDRVLIHA

SEQ ID NO: 107401 - protein, 19 aa, Mycobacterium avium
AALVGSMSVPQGWTEAAPA

SEQ ID NO: 107402 - protein, 26 aa, Mycobacterium avium
AAMARLSALAGYRWITPVSYTLPFRT

SEQ ID NO: 107403 - protein, 24 aa, Mycobacterium avium
AAMARRCVDAGWLLSLSGTVSFRN

SEQ ID NO: 107404 - protein, 22 aa, Mycobacterium avium
AAPRPAPQFEVMYRLDDCAPAA

SEQ ID NO: 107405 - protein, 19 aa, Mycobacterium avium
AAPRPGRRIGLVFRSSSGR

SEQ ID NO: 107406 - protein, 19 aa, Mycobacterium avium
AAQIAKVYCARAARTVCET

SEQ ID NO: 107407 - protein, 20 aa, Mycobacterium avium
AARAARLKWWTTDLQVRTAD

SEQ ID NO: 107408 - protein, 21 aa, Mycobacterium avium
AARMLVWRAGWMARNNQAFDA

SEQ ID NO: 107409 - protein, 18 aa, Mycobacterium avium
AASFELLHAFALLQDDVM

SEQ ID NO: 107410 - protein, 19 aa, Mycobacterium avium
AATRLGHSVAFFIGTAYGS

SEQ ID NO: 107411 - protein, 18 aa, Mycobacterium avium
ACIKAAADRVVFINTGFL

SEQ ID NO: 107412 - protein, 24 aa, Mycobacterium avium
ADAFPLLITHGWPGSIVEFHKVIE

SEQ ID NO: 107413 - protein, 25 aa, Mycobacterium avium
ADALALAICHCWRAPMIARMARAEA

SEQ ID NO: 107414 - protein, 19 aa, Mycobacterium avium
ADEIVRWATPVTSFQRTAL

SEQ ID NO: 107415 - protein, 19 aa, Mycobacterium avium
ADFTRCFDLVFAEAAEQGV

SEQ ID NO: 107416 - protein, 26 aa, Mycobacterium avium
ADFWFDPLCPWAWITSRWILEVEKVR

SEQ ID NO: 107417 - protein, 21 aa, Mycobacterium avium
ADGRAAIGFGAYREYEFTDFL

SEQ ID NO: 107418 - protein, 17 aa, Mycobacterium avium
ADGYLVISAYVPKHWDK

SEQ ID NO: 107419 - protein, 21 aa, Mycobacterium avium
ADLPPAVGVLVEYQGSGKDSD

SEQ ID NO: 107420 - protein, 17 aa, Mycobacterium avium
ADRAARIAKFWAAEAGA

SEQ ID NO: 107421 - protein, 23 aa, Mycobacterium avium
ADTHARVGLLPTWGLSVRLPQKV

SEQ ID NO: 107422 - protein, 18 aa, Mycobacterium avium
ADVAARWPVPGPHDDKYT

SEQ ID NO: 107423 - protein, 19 aa, Mycobacterium avium
ADVGYRWFAAKGHVPMFAF

SEQ ID NO: 107424 - protein, 22 aa, Mycobacterium avium
ADVPRWLSAPARLVVQSLLGRV

SEQ ID NO: 107425 - protein, 21 aa, Mycobacterium avium
AEAIRRFGPIFAQYYGQSEAP

SEQ ID NO: 107426 - protein, 22 aa, Mycobacterium avium
AEAYRAISLLLRRPPGREAYPG

SEQ ID NO: 107427 - protein, 23 aa, Mycobacterium avium
AEDPRVAGLIARVQLAPSPSAAV

SEQ ID NO: 107428 - protein, 18 aa, Mycobacterium avium
AEEMLYLAMEDFRVDVVV

SEQ ID NO: 107429 - protein, 18 aa, Mycobacterium avium
AEGAFLLCGFMMALAEHQ

SEQ ID NO: 107430 - protein, 17 aa, Mycobacterium avium
AEGFSWTPVHTMAGPDT

SEQ ID NO: 107431 - protein, 17 aa, Mycobacterium avium
AEGRLKGILKYYDAPIV

SEQ ID NO: 107432 - protein, 17 aa, Mycobacterium avium
AEIPLLVVITEGIPVQD

SEQ ID NO: 107433 - protein, 17 aa, Mycobacterium avium
AELLARFAGLRTCTNRL

SEQ ID NO: 107434 - protein, 18 aa, Mycobacterium avium
AELRRFWNIEFDDAGAIG

SEQ ID NO: 107435 - protein, 17 aa, Mycobacterium avium
AELSFRAGIGVKVIAAL

SEQ ID NO: 107436 - protein, 21 aa, Mycobacterium avium
AELVRRLSVVHGRVTLSSGKE

SEQ ID NO: 107437 - protein, 20 aa, Mycobacterium avium
AELWAPCFGRDDVDPLDADL

SEQ ID NO: 107438 - protein, 19 aa, Mycobacterium avium
AEPKWVLAMGVCASSGGMF

SEQ ID NO: 107439 - protein, 23 aa, Mycobacterium avium
AEQQWRPGLPMPRDEFHIALAEQ

SEQ ID NO: 107440 - protein, 20 aa, Mycobacterium avium
AERGWPVFLVSTVAREGLQP

SEQ ID NO: 107441 - protein, 17 aa, Mycobacterium avium
AERHLVFACGRYEGIDQ

SEQ ID NO: 107442 - protein, 20 aa, Mycobacterium avium
AESRGATMIFTRTKRTAQKV

SEQ ID NO: 107443 - protein, 18 aa, Mycobacterium avium
AETGIIYIDEVDKIARKS

SEQ ID NO: 107444 - protein, 18 aa, Mycobacterium avium
AEVAAWLGTLGTLGRAAF

SEQ ID NO: 107445 - protein, 25 aa, Mycobacterium avium
AEVWRRGSVIGSWLLDLTAIALHES

SEQ ID NO: 107446 - protein, 17 aa, Mycobacterium avium
AEWAHLVAGTSSIREGS

SEQ ID NO: 107447 - protein, 20 aa, Mycobacterium avium
AEYAEMWARDAAAMYGYAGA

SEQ ID NO: 107448 - protein, 20 aa, Mycobacterium avium
AEYFTVPLSNIWGTTLDIVD

SEQ ID NO: 107449 - protein, 17 aa, Mycobacterium avium
AEYSLRGANLWDEVKDR

SEQ ID NO: 107450 - protein, 18 aa, Mycobacterium avium
AFGTSRWSSKLVHGGLRY

SEQ ID NO: 107451 - protein, 19 aa, Mycobacterium avium
AFLREVVDFELPPEGSYAT

SEQ ID NO: 107452 - protein, 24 aa, Mycobacterium avium
AFLRPLPVRRLWGVGAVTAEKLRA

SEQ ID NO: 107453 - protein, 18 aa, Mycobacterium avium
AFSPRPVPTVSVGHLHEV

SEQ ID NO: 107454 - protein, 19 aa, Mycobacterium avium
AFTRLAARFLGPAVSGVRP

SEQ ID NO: 107455 - protein, 17 aa, Mycobacterium avium
AGADFELGMMWREVHRL

SEQ ID NO: 107456 - protein, 22 aa, Mycobacterium avium
AGDPWPALRCWAAGRATAEIVE

SEQ ID NO: 107457 - protein, 20 aa, Mycobacterium avium
AGDSRLAAVLAELDDADTRA

SEQ ID NO: 107458 - protein, 23 aa, Mycobacterium avium
AGGESYYRLGLPAGIASDGTEVI

SEQ ID NO: 107459 - protein, 18 aa, Mycobacterium avium
AGGFGVLGAVGFTPEQLE

SEQ ID NO: 107460 - protein, 17 aa, Mycobacterium avium
AGIELADLVVLLDHFGI

SEQ ID NO: 107461 - protein, 18 aa, Mycobacterium avium
AGLLAGAVTMVWQRGELL

SEQ ID NO: 107462 - protein, 24 aa, Mycobacterium avium
AGLRAGVPMLILWLWLDQPVWAEA

SEQ ID NO: 107463 - protein, 22 aa, Mycobacterium avium
AGLSLRPGYVLSDGFRVPGLAV

SEQ ID NO: 107464 - protein, 18 aa, Mycobacterium avium
AGLTASRFVACPFGESGT

SEQ ID NO: 107465 - protein, 18 aa, Mycobacterium avium
AGPPPQWWAQRFGIEPDL

SEQ ID NO: 107466 - protein, 19 aa, Mycobacterium avium
AGRRFARLAPIVGTYRKLM

SEQ ID NO: 107467 - protein, 24 aa, Mycobacterium avium
AGVARPDLVIGWWAAPTILEHGTP

SEQ ID NO: 107468 - protein, 20 aa, Mycobacterium avium
AHEFGLPIVEVIAGGDISEG

SEQ ID NO: 107469 - protein, 23 aa, Mycobacterium avium
AHKKIAGPGIEWYIMPGSDKPMR

SEQ ID NO: 107470 - protein, 21 aa, Mycobacterium avium
AHLYLKRLLGYSAFLGGPDRY

SEQ ID NO: 107471 - protein, 19 aa, Mycobacterium avium
AHMWFGDLVTMAWWDDLWL

SEQ ID NO: 107472 - protein, 19 aa, Mycobacterium avium
AIHRFPGSMAKRIQALAQL

SEQ ID NO: 107473 - protein, 18 aa, Mycobacterium avium
AILDEWKTITGLDRRVDD

SEQ ID NO: 107474 - protein, 23 aa, Mycobacterium avium
AINTAAWWVCATIPNAVSLGKTL

SEQ ID NO: 107475 - protein, 20 aa, Mycobacterium avium
AIQWPDGRMQFMLNERMMPA

SEQ ID NO: 107476 - protein, 21 aa, Mycobacterium avium
AIRAFRAAYELEMATVAVYPY

SEQ ID NO: 107477 - protein, 19 aa, Mycobacterium avium
AISGMNAVGGWRGAPRPVL

SEQ ID NO: 107478 - protein, 18 aa, Mycobacterium avium
AITDSWRALADVLLSSAV

SEQ ID NO: 107479 - protein, 17 aa, Mycobacterium avium
AITTRLLVPRDRYDEAV

SEQ ID NO: 107480 - protein, 19 aa, Mycobacterium avium
AIVHLGFGFGIVFINPALQ

SEQ ID NO: 107481 - protein, 19 aa, Mycobacterium avium
AIVPWNMPQFLIVTKLIPA

SEQ ID NO: 107482 - protein, 17 aa, Mycobacterium avium
AKIPIGLGPDIVCVVPE

SEQ ID NO: 107483 - protein, 20 aa, Mycobacterium avium
AKIVKFSGCYHGHVDALLAD

SEQ ID NO: 107484 - protein, 17 aa, Mycobacterium avium
AKKRLGYTKVVLAGWSG

SEQ ID NO: 107485 - protein, 17 aa, Mycobacterium avium
AKLGCTFVVVGHSERRT

SEQ ID NO: 107486 - protein, 17 aa, Mycobacterium avium
AKLLDDRVRAFIAQHAD

SEQ ID NO: 107487 - protein, 19 aa, Mycobacterium avium
AKPGSYRWLKGGQRVPADE

SEQ ID NO: 107488 - protein, 17 aa, Mycobacterium avium
ALAGFGLTEPGAGSDAG

SEQ ID NO: 107489 - protein, 19 aa, Mycobacterium avium
ALASILSWQGWETLFELAH

SEQ ID NO: 107490 - protein, 22 aa, Mycobacterium avium
ALASRARKAPGFALLGEPGETR

SEQ ID NO: 107491 - protein, 20 aa, Mycobacterium avium
ALELIDWPVAVVIAAGHLLA

SEQ ID NO: 107492 - protein, 23 aa, Mycobacterium avium
ALGCTIKLLSICERITGDDGQER

SEQ ID NO: 107493 - protein, 18 aa, Mycobacterium avium
ALGRDFLTIWFAQLHQQV

SEQ ID NO: 107494 - protein, 18 aa, Mycobacterium avium
ALLALAQRYGEWLHAHPD

SEQ ID NO: 107495 - protein, 18 aa, Mycobacterium avium
ALLARRRMDLYGATLEDF

SEQ ID NO: 107496 - protein, 18 aa, Mycobacterium avium
ALMPMVWVACEREDFVVE

SEQ ID NO: 107497 - protein, 17 aa, Mycobacterium avium
ALPRPLRRLPLLGDRIA

SEQ ID NO: 107498 - protein, 18 aa, Mycobacterium avium
ALQMPSIHTRYWYPLFEA

SEQ ID NO: 107499 - protein, 19 aa, Mycobacterium avium
ALRRWAHRFYPGPQPAPTD

SEQ ID NO: 107500 - protein, 17 aa, Mycobacterium avium
ALSRLGAIAVVMRPDAD

SEQ ID NO: 107501 - protein, 24 aa, Mycobacterium avium
ALTEVRPTLFLGVPRVWIKAKAGL

SEQ ID NO: 107502 - protein, 17 aa, Mycobacterium avium
ALTRLAARCPVAVLSGR

SEQ ID NO: 107503 - protein, 21 aa, Mycobacterium avium
AMQFLRGGRRWLLKSPQHLEQ

SEQ ID NO: 107504 - protein, 24 aa, Mycobacterium avium
AMSKFEVLTAMAFAAFADAPVDVA

SEQ ID NO: 107505 - protein, 19 aa, Mycobacterium avium
AMTEFKMFYKLPVEGLDIP

SEQ ID NO: 107506 - protein, 20 aa, Mycobacterium avium
ANFYRPLIEHPKVMRVVALS

SEQ ID NO: 107507 - protein, 19 aa, Mycobacterium avium
ANLFYRGLVFHRFPVIGDS

SEQ ID NO: 107508 - protein, 20 aa, Mycobacterium avium
ANLLDLLAALGFSAEPVRVD

SEQ ID NO: 107509 - protein, 19 aa, Mycobacterium avium
ANLRLVVSLAKRYTGRGMA

SEQ ID NO: 107510 - protein, 19 aa, Mycobacterium avium
ANLRSAPMLGVVRAADGWV

SEQ ID NO: 107511 - protein, 17 aa, Mycobacterium avium
ANMADCHPILFLRMMDR

SEQ ID NO: 107512 - protein, 22 aa, Mycobacterium avium
APARAYNPLFIWGESGLGKTHL

SEQ ID NO: 107513 - protein, 20 aa, Mycobacterium avium
APDALPVLFGHIGEGNLHLN

SEQ ID NO: 107514 - protein, 24 aa, Mycobacterium avium
APERLRSGWLNGIKHWQVDYTGKC

SEQ ID NO: 107515 - protein, 17 aa, Mycobacterium avium
APGCPFAPPPKVLQLNA

SEQ ID NO: 107516 - protein, 18 aa, Mycobacterium avium
APILTLRTDRDWIADIVR

SEQ ID NO: 107517 - protein, 17 aa, Mycobacterium avium
APLRIALVAALDSGTAP

SEQ ID NO: 107518 - protein, 18 aa, Mycobacterium avium
APMTLRWLTDRFEGRPVT

SEQ ID NO: 107519 - protein, 21 aa, Mycobacterium avium
APNLPWPWGLIDLTARVLLPV

SEQ ID NO: 107520 - protein, 19 aa, Mycobacterium avium
APSPPGRWRTLGLFAAADD

SEQ ID NO: 107521 - protein, 19 aa, Mycobacterium avium
AQGRLRVGAAIGINGDVGA

SEQ ID NO: 107522 - protein, 19 aa, Mycobacterium avium
AQLELKWRAIREDLERRGV

SEQ ID NO: 107523 - protein, 18 aa, Mycobacterium avium
AQSWPLERINAVKAATGA

SEQ ID NO: 107524 - protein, 18 aa, Mycobacterium avium
ARALTGWVIGAGGATSVL

SEQ ID NO: 107525 - protein, 19 aa, Mycobacterium avium
ARCALAWSVETAQLAREHN

SEQ ID NO: 107526 - protein, 20 aa, Mycobacterium avium
AREFGRLGLLGMHLHGYGCG

SEQ ID NO: 107527 - protein, 17 aa, Mycobacterium avium
ARFGSWYEMFPRSTGGW

SEQ ID NO: 107528 - protein, 19 aa, Mycobacterium avium
ARGGLRWSDRRDDFRTEIL

SEQ ID NO: 107529 - protein, 18 aa, Mycobacterium avium
ARIAKFWAAEAGARVAAT

SEQ ID NO: 107530 - protein, 19 aa, Mycobacterium avium
ARKRLPVVLFAEGGGGRPG

SEQ ID NO: 107531 - protein, 19 aa, Mycobacterium avium
ARLAMLLATNFFGINYPAI

SEQ ID NO: 107532 - protein, 18 aa, Mycobacterium avium
ARLEKWWLPGPDRLLDCV

SEQ ID NO: 107533 - protein, 17 aa, Mycobacterium avium
ARLSVVVDHTWRAEALA

SEQ ID NO: 107534 - protein, 21 aa, Mycobacterium avium
ARLTVPLGMIILRKGYGLGAM

SEQ ID NO: 107535 - protein, 19 aa, Mycobacterium avium
ARPAITLSWIRELPSLGAA

SEQ ID NO: 107536 - protein, 22 aa, Mycobacterium avium
ARPRAGILRVREFVMKDSYSFD

SEQ ID NO: 107537 - protein, 21 aa, Mycobacterium avium
ARQALTEAVLWPLQHPDTFAR

SEQ ID NO: 107538 - protein, 19 aa, Mycobacterium avium
ARQLLDLMVHSVYSNKDSF

SEQ ID NO: 107539 - protein, 18 aa, Mycobacterium avium
ARRCARSVLDLHVVDGRL

SEQ ID NO: 107540 - protein, 24 aa, Mycobacterium avium
ARRLKVPPERWVYPLAGTDAHDTA

SEQ ID NO: 107541 - protein, 18 aa, Mycobacterium avium
ARRLRWDPTLLFRRLKEL

SEQ ID NO: 107542 - protein, 19 aa, Mycobacterium avium
ARRSDVFLTSFLPAHRKKF

SEQ ID NO: 107543 - protein, 17 aa, Mycobacterium avium
ARTFLMYRTQRWPDVLL

SEQ ID NO: 107544 - protein, 19 aa, Mycobacterium avium
ARTLLGWGQFGTGLNLANI

SEQ ID NO: 107545 - protein, 20 aa, Mycobacterium avium
ARVDTWAGLVFVNLDPDAMP

SEQ ID NO: 107546 - protein, 17 aa, Mycobacterium avium
ARWGCLRAANLAWGCGD

SEQ ID NO: 107547 - protein, 21 aa, Mycobacterium avium
ARWLHPGQRAFQLATQIALLT

SEQ ID NO: 107548 - protein, 19 aa, Mycobacterium avium
ARYAQHWNFVGGPPDVFAH

SEQ ID NO: 107549 - protein, 23 aa, Mycobacterium avium
ARYLFRRVVSWGRSSNVFLRNGA

SEQ ID NO: 107550 - protein, 18 aa, Mycobacterium avium
ARYLRICVLTQYKSHSLD

SEQ ID NO: 107551 - protein, 19 aa, Mycobacterium avium
ASAALIWRRPRWAKRLQPE

SEQ ID NO: 107552 - protein, 17 aa, Mycobacterium avium
ASAELFAARGADVAILD

SEQ ID NO: 107553 - protein, 19 aa, Mycobacterium avium
ASEALSFVRQRHGLDNGDL

SEQ ID NO: 107554 - protein, 24 aa, Mycobacterium avium
ASGVRLGIVASTWHSRICDALLAG

SEQ ID NO: 107555 - protein, 22 aa, Mycobacterium avium
ASHHWPTWGRDGIVEFLSLQRD

SEQ ID NO: 107556 - protein, 17 aa, Mycobacterium avium
ASLRLVAPGGIFLEMGK

SEQ ID NO: 107557 - protein, 20 aa, Mycobacterium avium
ASPPVKWPCFYGIDFPSPAE

SEQ ID NO: 107558 - protein, 23 aa, Mycobacterium avium
ATAFPWRRQSALVQWYVETSGDP

SEQ ID NO: 107559 - protein, 24 aa, Mycobacterium avium
ATALREFAQRAGVPMAQTVAVGDG

SEQ ID NO: 107560 - protein, 17 aa, Mycobacterium avium
ATHPFGVGSPFWKEIDL

SEQ ID NO: 107561 - protein, 18 aa, Mycobacterium avium
ATIAEVFARDGARVVAID

SEQ ID NO: 107562 - protein, 19 aa, Mycobacterium avium
ATIALPFDIAGALTGFHTD

SEQ ID NO: 107563 - protein, 22 aa, Mycobacterium avium
ATLLTARCPVLFAPAMHTEMWL

SEQ ID NO: 107564 - protein, 23 aa, Mycobacterium avium
ATPDFPLLVAHGMACVLHCHGAR

SEQ ID NO: 107565 - protein, 22 aa, Mycobacterium avium
ATSHWLTIPALKAFGVTAVPDE

SEQ ID NO: 107566 - protein, 23 aa, Mycobacterium avium
ATTCGRPFADFELRIDDSGEVLL

SEQ ID NO: 107567 - protein, 17 aa, Mycobacterium avium
ATYFSGAKLQWILDNVD

SEQ ID NO: 107568 - protein, 17 aa, Mycobacterium avium
AVARAGSEFAVLGRQVA

SEQ ID NO: 107569 - protein, 22 aa, Mycobacterium avium
AVDLRQDWPAALRAAGFDPTQR

SEQ ID NO: 107570 - protein, 20 aa, Mycobacterium avium
AVGIAAYHCGDWAQALAELR

SEQ ID NO: 107571 - protein, 20 aa, Mycobacterium avium
AVICCPAFGAAGLVGKFNWA

SEQ ID NO: 107572 - protein, 17 aa, Mycobacterium avium
AVLAEWGAEVVKVEHAV

SEQ ID NO: 107573 - protein, 20 aa, Mycobacterium avium
AVLIGAAWQRCRVHFLRNVL

SEQ ID NO: 107574 - protein, 24 aa, Mycobacterium avium
AVLLRECVEFFAPYLAAARLTGEV

SEQ ID NO: 107575 - protein, 20 aa, Mycobacterium avium
AVPAERLWVNPDCGLKTRNP

SEQ ID NO: 107576 - protein, 18 aa, Mycobacterium avium
AVVTRYELVDGFPRFDVD

SEQ ID NO: 107577 - protein, 23 aa, Mycobacterium avium
AWERGRFGAPYLRDSLLAAGALC

SEQ ID NO: 107578 - protein, 17 aa, Mycobacterium avium
AWSGLKPAELAAVVSSV

SEQ ID NO: 107579 - protein, 17 aa, Mycobacterium avium
AYEGYRVLPYCWRDETP

SEQ ID NO: 107580 - protein, 19 aa, Mycobacterium avium
AYHCGDWAQALAELRAARR

SEQ ID NO: 107581 - protein, 22 aa, Mycobacterium avium
AYPGRFLLGIGVGHPEAHTEYR

SEQ ID NO: 107582 - protein, 18 aa, Mycobacterium avium
AYRREVLEAIDLDGVDSK

SEQ ID NO: 107583 - protein, 20 aa, Mycobacterium avium
AYRRRGCRVAVLAVDPSSPF

SEQ ID NO: 107584 - protein, 20 aa, Mycobacterium avium
CAAQSWPLERIKNVKNAAGV

SEQ ID NO: 107585 - protein, 17 aa, Mycobacterium avium
CAARERLTSDFDWHTVA

SEQ ID NO: 107586 - protein, 17 aa, Mycobacterium avium
CAGMLKPDIVYFGESVP

SEQ ID NO: 107587 - protein, 19 aa, Mycobacterium avium
CAIQNLWLAARAEGLGMGW

SEQ ID NO: 107588 - protein, 18 aa, Mycobacterium avium
CARLRFILTAQRDHYLPL

SEQ ID NO: 107589 - protein, 19 aa, Mycobacterium avium
CAVGIPDASGWRMLSGDET

SEQ ID NO: 107590 - protein, 22 aa, Mycobacterium avium
CDNARPGMRIHVLAPSGNFVPK

SEQ ID NO: 107591 - protein, 17 aa, Mycobacterium avium
CDPEVVEALKFHLRDLA

SEQ ID NO: 107592 - protein, 19 aa, Mycobacterium avium
CGDCPRVILGSPLAGESLE

SEQ ID NO: 107593 - protein, 25 aa, Mycobacterium avium
CGKYKRVRFKGIICERCGVEVTRAK

SEQ ID NO: 107594 - protein, 23 aa, Mycobacterium avium
CHNGCPLGNLIPEWNDLVRTGRW

SEQ ID NO: 107595 - protein, 18 aa, Mycobacterium avium
CIACGAIRTDGLLADAAK

SEQ ID NO: 107596 - protein, 20 aa, Mycobacterium avium
CPGLKRSALIGGIRYYDTIV

SEQ ID NO: 107597 - protein, 19 aa, Mycobacterium avium
CPIPDPLDLLAFLAGHTTR

SEQ ID NO: 107598 - protein, 19 aa, Mycobacterium avium
CPVCLGLPGSLPVLNQAAV

SEQ ID NO: 107599 - protein, 26 aa, Mycobacterium avium
CQQVWCPVCALAALATGDQHPLLTAI

SEQ ID NO: 107600 - protein, 20 aa, Mycobacterium avium
CRDPARLAGWWAEQFGGTTH

SEQ ID NO: 107601 - protein, 18 aa, Mycobacterium avium
CRPSCPVRPPFARNVRFY

SEQ ID NO: 107602 - protein, 22 aa, Mycobacterium avium
CRSTQELRNWLMLRAYESGVLP

SEQ ID NO: 107603 - protein, 18 aa, Mycobacterium avium
CSTWDLTDWRGEAIRIGF

SEQ ID NO: 107604 - protein, 18 aa, Mycobacterium avium
CWTMLGAWAEQTSRIQIG

SEQ ID NO: 107605 - protein, 27 aa, Mycobacterium avium
DADEALRMGLVWRVCAPDELLPQARHH

SEQ ID NO: 107606 - protein, 20 aa, Mycobacterium avium
DAELPWSRVLEAMRALPSPE

SEQ ID NO: 107607 - protein, 19 aa, Mycobacterium avium
DARGIPFSGQWDGLNAGIY

SEQ ID NO: 107608 - protein, 22 aa, Mycobacterium avium
DARSWRLPWPDGTVVYELDQPK

SEQ ID NO: 107609 - protein, 18 aa, Mycobacterium avium
DAVALGFAGTVCIHPSQV

SEQ ID NO: 107610 - protein, 17 aa, Mycobacterium avium
DAVELPGWYRPNPGLAR

SEQ ID NO: 107611 - protein, 22 aa, Mycobacterium avium
DCIQVLGGIGCTWEHDAHLYLR

SEQ ID NO: 107612 - protein, 18 aa, Mycobacterium avium
DDPRLRRMAVFDVLVNNA

SEQ ID NO: 107613 - protein, 17 aa, Mycobacterium avium
DEMARLGAQITIFRLGS

SEQ ID NO: 107614 - protein, 22 aa, Mycobacterium avium
DEQKQRWAVPILRAEITASLGM

SEQ ID NO: 107615 - protein, 18 aa, Mycobacterium avium
DEVHLLPAPVFRMTADLQ

SEQ ID NO: 107616 - protein, 18 aa, Mycobacterium avium
DEWPAADVLAAFRAHAVD

SEQ ID NO: 107617 - protein, 22 aa, Mycobacterium avium
DEWRATFAVNVFGPVELTLALL

SEQ ID NO: 107618 - protein, 17 aa, Mycobacterium avium
DFERIRHEFGFPGDDLV

SEQ ID NO: 107619 - protein, 19 aa, Mycobacterium avium
DFIEACAWIKENLPGVHLS

SEQ ID NO: 107620 - protein, 18 aa, Mycobacterium avium
DFNFAWPTARIAVIGAEG

SEQ ID NO: 107621 - protein, 19 aa, Mycobacterium avium
DGAPAWLRFFGCNPRHHSL

SEQ ID NO: 107622 - protein, 27 aa, Mycobacterium avium
DGASNWYLEFARLAPLMEKDVHYEVDL

SEQ ID NO: 107623 - protein, 17 aa, Mycobacterium avium
DGGRFGLIWTSRDRDVD

SEQ ID NO: 107624 - protein, 25 aa, Mycobacterium avium
DGISRLRFRLRWRDFRVTVDVNHAD

SEQ ID NO: 107625 - protein, 18 aa, Mycobacterium avium
DGLRWSTTEQLGYNRRYT

SEQ ID NO: 107626 - protein, 18 aa, Mycobacterium avium
DGPARAWERGRFGAPYLR

SEQ ID NO: 107627 - protein, 20 aa, Mycobacterium avium
DGSLRLPYWMIYDDKEGAVP

SEQ ID NO: 107628 - protein, 18 aa, Mycobacterium avium
DGWRLKTRAMTFIRRSGV

SEQ ID NO: 107629 - protein, 24 aa, Mycobacterium avium
DHCLDLPGLFVWRRYHPTRPLGKA

SEQ ID NO: 107630 - protein, 23 aa, Mycobacterium avium
DHERIAPLIADWADDLGRPIDVA

SEQ ID NO: 107631 - protein, 25 aa, Mycobacterium avium
DHLTRIGRLWARFNAVAVDNPHAWI

SEQ ID NO: 107632 - protein, 17 aa, Mycobacterium avium
DHPRLGWRQAPVGQVLA

SEQ ID NO: 107633 - protein, 20 aa, Mycobacterium avium
DIDFAFAVGQLFATVPYAQL

SEQ ID NO: 107634 - protein, 17 aa, Mycobacterium avium
DIGCGWGGALKRALEKY

SEQ ID NO: 107635 - protein, 22 aa, Mycobacterium avium
DKALEGFTMFALNQGEVCTCPS

SEQ ID NO: 107636 - protein, 22 aa, Mycobacterium avium
DKGRLTLPAKFRDALAGGLMVT

SEQ ID NO: 107637 - protein, 19 aa, Mycobacterium avium
DKPFLMPVEDVFTITGRGT

SEQ ID NO: 107638 - protein, 24 aa, Mycobacterium avium
DLEHWRWMWETNVIGTLRVTRALL

SEQ ID NO: 107639 - protein, 19 aa, Mycobacterium avium
DLLKCSFCGKSQKQVKKLI

SEQ ID NO: 107640 - protein, 18 aa, Mycobacterium avium
DLLRRNQILFTFLHLAAS

SEQ ID NO: 107641 - protein, 18 aa, Mycobacterium avium
DLLVKRAEALGVQIRYET

SEQ ID NO: 107642 - protein, 19 aa, Mycobacterium avium
DLRVRFRLDRNVSLADSID

SEQ ID NO: 107643 - protein, 25 aa, Mycobacterium avium
DLSIPRLKRGLMLGTHWGQLDQPLV

SEQ ID NO: 107644 - protein, 25 aa, Mycobacterium avium
DLVIAKCFLLWAGVLGAISLEVFGQ

SEQ ID NO: 107645 - protein, 18 aa, Mycobacterium avium
DLVIAVHLRGHFLLTRNA

SEQ ID NO: 107646 - protein, 23 aa, Mycobacterium avium
DLVRLGLQIGDFVALITSPELTA

SEQ ID NO: 107647 - protein, 17 aa, Mycobacterium avium
DPCSDVSVVFARGTHQE

SEQ ID NO: 107648 - protein, 24 aa, Mycobacterium avium
DPGESRFYLSLGDELMRRFNGAAL

SEQ ID NO: 107649 - protein, 17 aa, Mycobacterium avium
DPLRRWGPFASGVVDPD

SEQ ID NO: 107650 - protein, 17 aa, Mycobacterium avium
DPSKFVGSLGFRESVVR

SEQ ID NO: 107651 - protein, 21 aa, Mycobacterium avium
DPTRLPPGWHIEQSEVAPWFH

SEQ ID NO: 107652 - protein, 19 aa, Mycobacterium avium
DPVLARELFIRHALVEGDW

SEQ ID NO: 107653 - protein, 17 aa, Mycobacterium avium
DPYRLAAQLGMPPWRVQ

SEQ ID NO: 107654 - protein, 21 aa, Mycobacterium avium
DQGLRFYFGFNNREAYRAFKK

SEQ ID NO: 107655 - protein, 24 aa, Mycobacterium avium
DRERCILCARCTRFSEQIAGDPFI

SEQ ID NO: 107656 - protein, 21 aa, Mycobacterium avium
DRFPIDMVRLYFDDHADDAAG

SEQ ID NO: 107657 - protein, 19 aa, Mycobacterium avium
DRGLSWLPFFHDMGLITAM

SEQ ID NO: 107658 - protein, 21 aa, Mycobacterium avium
DRLGFDEAWFGEHHSGGYELI

SEQ ID NO: 107659 - protein, 18 aa, Mycobacterium avium
DRLLRPGGVVDMLTSEGG

SEQ ID NO: 107660 - protein, 18 aa, Mycobacterium avium
DRPAPGLLRGVCEDAPKT

SEQ ID NO: 107661 - protein, 21 aa, Mycobacterium avium
DRPGRLLGFHWTKVHLDQPGL

SEQ ID NO: 107662 - protein, 20 aa, Mycobacterium avium
DRPIADVCPVEWARMENRSV

SEQ ID NO: 107663 - protein, 18 aa, Mycobacterium avium
DRPLPWAVMHKLTAPTLL

SEQ ID NO: 107664 - protein, 24 aa, Mycobacterium avium
DRVFAGKVWGAWHLSEAAADLRLD

SEQ ID NO: 107665 - protein, 18 aa, Mycobacterium avium
DRVGIAWLRHTCGVCKYC

SEQ ID NO: 107666 - protein, 25 aa, Mycobacterium avium
DRVVIPFQICCGSCYMCGQQLYTQC

SEQ ID NO: 107667 - protein, 19 aa, Mycobacterium avium
DSADGVWSRMKFEGGVHRV

SEQ ID NO: 107668 - protein, 19 aa, Mycobacterium avium
DSAGFKWLAPYTGSAIAQH

SEQ ID NO: 107669 - protein, 24 aa, Mycobacterium avium
DSLIWQCPVVLLGEVRSVGVQGDN

SEQ ID NO: 107670 - protein, 20 aa, Mycobacterium avium
DSRGGSSFAEFAANAKALTG

SEQ ID NO: 107671 - protein, 21 aa, Mycobacterium avium
DSVRIAREFLIRVVNDAIEHG

SEQ ID NO: 107672 - protein, 22 aa, Mycobacterium avium
DTALYRYLWRSVLAFDGATRFR

SEQ ID NO: 107673 - protein, 19 aa, Mycobacterium avium
DTDLRWRIVTALAAAGEID

SEQ ID NO: 107674 - protein, 19 aa, Mycobacterium avium
DTELLDFTALAKVFGYPTT

SEQ ID NO: 107675 - protein, 24 aa, Mycobacterium avium
DTGYRAPAAFGYRPFEGGLALKRL

SEQ ID NO: 107676 - protein, 25 aa, Mycobacterium avium
DTPPQRYAMFMSFSLASGAGRTELQ

SEQ ID NO: 107677 - protein, 19 aa, Mycobacterium avium
DTVGEVWLRGATVVRGYLG

SEQ ID NO: 107678 - protein, 17 aa, Mycobacterium avium
DTVRRWINQGALEVGHD

SEQ ID NO: 107679 - protein, 26 aa, Mycobacterium avium
DVALIVGVPMDFRLGFGAVFGPHTRL

SEQ ID NO: 107680 - protein, 17 aa, Mycobacterium avium
DVCPVEWARMENRSVLQ

SEQ ID NO: 107681 - protein, 18 aa, Mycobacterium avium
DVFLTSFLPAHRKKFGID

SEQ ID NO: 107682 - protein, 22 aa, Mycobacterium avium
DVGCGWGGAVVRALEKYDVNVI

SEQ ID NO: 107683 - protein, 20 aa, Mycobacterium avium
DVIRYLRWFTFLSADELGEL

SEQ ID NO: 107684 - protein, 24 aa, Mycobacterium avium
DWAEMLMRMYIRWAEQHKYPVEVF

SEQ ID NO: 107685 - protein, 22 aa, Mycobacterium avium
DWMLGNGGLDWAVKRTADSAGR

SEQ ID NO: 107686 - protein, 24 aa, Mycobacterium avium
DYALTELCALSWTVYSLPGAPVLD

SEQ ID NO: 107687 - protein, 20 aa, Mycobacterium avium
DYFKREAIELAWTLLTGSVE

SEQ ID NO: 107688 - protein, 22 aa, Mycobacterium avium
DYLQWLGIDCIWLPPFYDSPLR

SEQ ID NO: 107689 - protein, 18 aa, Mycobacterium avium
DYRWAEADRHLWIADERG

SEQ ID NO: 107690 - protein, 20 aa, Mycobacterium avium
EAAELMWRYYLGPTVGSAAA

SEQ ID NO: 107691 - protein, 24 aa, Mycobacterium avium
EAAPYLAGHGWRLNSVTIRDLFAA

SEQ ID NO: 107692 - protein, 22 aa, Mycobacterium avium
EADEKFWLGVGLTRSEAYVMIA

SEQ ID NO: 107693 - protein, 21 aa, Mycobacterium avium
EAEPAWAYSVLALRWAAKYYA

SEQ ID NO: 107694 - protein, 17 aa, Mycobacterium avium
EAGLPPGLVNVLPAGPE

SEQ ID NO: 107695 - protein, 18 aa, Mycobacterium avium
EAGVALSAVTARFPRARL

SEQ ID NO: 107696 - protein, 18 aa, Mycobacterium avium
EARFPQINWEITAGNSSP

SEQ ID NO: 107697 - protein, 21 aa, Mycobacterium avium
EAVLPFHRFRTVEGAGIDSLL

SEQ ID NO: 107698 - protein, 20 aa, Mycobacterium avium
EAVMLGGLAMKWRWRAKTKD

SEQ ID NO: 107699 - protein, 20 aa, Mycobacterium avium
EAWRFLKELRLERGPLDPDE

SEQ ID NO: 107700 - protein, 17 aa, Mycobacterium avium
EAYKHLKPIGAYGAGVD

SEQ ID NO: 107701 - protein, 19 aa, Mycobacterium avium
EAYLRAVIAWHFGADTGSP

SEQ ID NO: 107702 - protein, 17 aa, Mycobacterium avium
EAYPVLCGSAFKNKGVQ

SEQ ID NO: 107703 - protein, 19 aa, Mycobacterium avium
EDAARQCVQLTLERFGSVD

SEQ ID NO: 107704 - protein, 20 aa, Mycobacterium avium
EDKPFWWAHFDRLNFPIDEW

SEQ ID NO: 107705 - protein, 19 aa, Mycobacterium avium
EEPPEHLIFIFATTEPEKV

SEQ ID NO: 107706 - protein, 27 aa, Mycobacterium avium
EERAALPPQCWRLVWRNPVNGRKALYL

SEQ ID NO: 107707 - protein, 22 aa, Mycobacterium avium
EEVRASGLLPTWAETQAFIEGL

SEQ ID NO: 107708 - protein, 23 aa, Mycobacterium avium
EFARRFGCRVVDSFGSSEFAVIV

SEQ ID NO: 107709 - protein, 18 aa, Mycobacterium avium
EFMGCCAFAVLTDEAKRC

SEQ ID NO: 107710 - protein, 22 aa, Mycobacterium avium
EGERLWISWAMANRDPAVFHDP

SEQ ID NO: 107711 - protein, 24 aa, Mycobacterium avium
EGISVNVTLIFSVERYRAVMDAYL

SEQ ID NO: 107712 - protein, 19 aa, Mycobacterium avium
EGRRAIKYLGDFVKDVTAA

SEQ ID NO: 107713 - protein, 18 aa, Mycobacterium avium
EGRVSWLFVPRLRADGWL

SEQ ID NO: 107714 - protein, 17 aa, Mycobacterium avium
EGTFEYQALLFIPSHAP

SEQ ID NO: 107715 - protein, 31 aa, Mycobacterium avium
EGTFVKFHWKPRLGVHSLIWDECQKIAGKDP

SEQ ID NO: 107716 - protein, 26 aa, Mycobacterium avium
EGVPRWRKGSGLGWLTAEYAMLPSAT

SEQ ID NO: 107717 - protein, 18 aa, Mycobacterium avium
EHLDALGFDEVWLGEHHS

SEQ ID NO: 107718 - protein, 25 aa, Mycobacterium avium
EHPYPHCWRCRNPLIYRAVSSWFVA

SEQ ID NO: 107719 - protein, 18 aa, Mycobacterium avium
EIAEGWQPIFYLPEKARD

SEQ ID NO: 107720 - protein, 18 aa, Mycobacterium avium
EIAILHRHAHGFDPRDLS

SEQ ID NO: 107721 - protein, 18 aa, Mycobacterium avium
EIGIKWLSLYAFSTENWK

SEQ ID NO: 107722 - protein, 20 aa, Mycobacterium avium
EIGPRIVPIIPDEARTFGMD

SEQ ID NO: 107723 - protein, 22 aa, Mycobacterium avium
EILADLRLVPGFSERLGEMVAS

SEQ ID NO: 107724 - protein, 21 aa, Mycobacterium avium
EIPSPAAGVLTKIIAQEDDTV

SEQ ID NO: 107725 - protein, 23 aa, Mycobacterium avium
EIRRLAIECLRRLADVAPAVFAD

SEQ ID NO: 107726 - protein, 20 aa, Mycobacterium avium
EIVEFSRFILAEIFPGGWLP

SEQ ID NO: 107727 - protein, 19 aa, Mycobacterium avium
EIWRRIRAANLPVALSDRL

SEQ ID NO: 107728 - protein, 17 aa, Mycobacterium avium
EIYRAPLSYPYRDGLLD

SEQ ID NO: 107729 - protein, 24 aa, Mycobacterium avium
EKEAWLSMVMLEWGCCGQVATAIP

SEQ ID NO: 107730 - protein, 23 aa, Mycobacterium avium
EKMPRRFYCRGKWRPSALDSETQ

SEQ ID NO: 107731 - protein, 17 aa, Mycobacterium avium
EKRRAHVPWVTWGTTAM

SEQ ID NO: 107732 - protein, 24 aa, Mycobacterium avium
EKTRWGLPVDRLRFAMSNYQRLTM

SEQ ID NO: 107733 - protein, 23 aa, Mycobacterium avium
ELDGLRLITWRGAARAEQGLPFA

SEQ ID NO: 107734 - protein, 19 aa, Mycobacterium avium
ELELGWGRLIFGQTFANSQ

SEQ ID NO: 107735 - protein, 19 aa, Mycobacterium avium
ELHEIYKLGVVPIPTNKPM

SEQ ID NO: 107736 - protein, 22 aa, Mycobacterium avium
ELLNRWPEWDIDYDTAQLASTS

SEQ ID NO: 107737 - protein, 18 aa, Mycobacterium avium
ELLRRLKGLPGFGEQKAR

SEQ ID NO: 107738 - protein, 19 aa, Mycobacterium avium
ELRARIAPLQQLWTSEAAT

SEQ ID NO: 107739 - protein, 18 aa, Mycobacterium avium
ELRHAWLDLHESWLAAKA

SEQ ID NO: 107740 - protein, 18 aa, Mycobacterium avium
ELRIGLATAEDIRQWSYG

SEQ ID NO: 107741 - protein, 20 aa, Mycobacterium avium
ELYDGFSFNCLSWIEALGFC

SEQ ID NO: 107742 - protein, 18 aa, Mycobacterium avium
ELYEIRTLFGVMFQDGAL

SEQ ID NO: 107743 - protein, 23 aa, Mycobacterium avium
ELYRRWTGLLSYRYIGRKHSSMN

SEQ ID NO: 107744 - protein, 21 aa, Mycobacterium avium
EMPEIRSAVVAQLARVDDQLA

SEQ ID NO: 107745 - protein, 23 aa, Mycobacterium avium
ENIVCPWHGWQWRGDGSNALIPY

SEQ ID NO: 107746 - protein, 24 aa, Mycobacterium avium
ENLSGWFEFVWKPGYADYYPELPG

SEQ ID NO: 107747 - protein, 17 aa, Mycobacterium avium
ENPDRWAPPYAEAGAHN

SEQ ID NO: 107748 - protein, 17 aa, Mycobacterium avium
ENTRFWAPLSLTAEQKH

SEQ ID NO: 107749 - protein, 19 aa, Mycobacterium avium
EPFTTVGLCCYRDGSDSVA

SEQ ID NO: 107750 - protein, 19 aa, Mycobacterium avium
EPGRWSGWVRIDGQRVSVD

SEQ ID NO: 107751 - protein, 23 aa, Mycobacterium avium
EPLPRSLVWSAAWEMTREAELRA

SEQ ID NO: 107752 - protein, 18 aa, Mycobacterium avium
EPNMRWRTFCAELVAIAD

SEQ ID NO: 107753 - protein, 20 aa, Mycobacterium avium
EPRLFPWRDVRTNVGYGLTR

SEQ ID NO: 107754 - protein, 21 aa, Mycobacterium avium
EPRLSLQWWVRVESLAKAAGD

SEQ ID NO: 107755 - protein, 17 aa, Mycobacterium avium
EPVEFARRLALAVAAEV

SEQ ID NO: 107756 - protein, 20 aa, Mycobacterium avium
EPWVPLPEFWVRRARKKILH

SEQ ID NO: 107757 - protein, 20 aa, Mycobacterium avium
EQQARFAMRMIRRPVHDPAR

SEQ ID NO: 107758 - protein, 22 aa, Mycobacterium avium
ERAELVRWLLAQGITAEEIRTT

SEQ ID NO: 107759 - protein, 23 aa, Mycobacterium avium
ERFLAEGVERVFITGRRQRELED

SEQ ID NO: 107760 - protein, 17 aa, Mycobacterium avium
ERIGFAAQHIWDGSAER

SEQ ID NO: 107761 - protein, 17 aa, Mycobacterium avium
ERLRGVIAEHIGVPAEL

SEQ ID NO: 107762 - protein, 17 aa, Mycobacterium avium
ERLVPDFLWISTEHTAR

SEQ ID NO: 107763 - protein, 20 aa, Mycobacterium avium
ERPRLTAALDKLRVFSNTAT

SEQ ID NO: 107764 - protein, 23 aa, Mycobacterium avium
ERREVRGRLALVTGAGAGIGRAT

SEQ ID NO: 107765 - protein, 24 aa, Mycobacterium avium
ERVGWQWRLVWYKAVAELLTGDYD

SEQ ID NO: 107766 - protein, 17 aa, Mycobacterium avium
ERWPAFWDWAYKSLPND

SEQ ID NO: 107767 - protein, 18 aa, Mycobacterium avium
ERYLRAAVRPEWPLLVQA

SEQ ID NO: 107768 - protein, 27 aa, Mycobacterium avium
ESRLTFLAVRRWYGWSAGRIINLDIGG

SEQ ID NO: 107769 - protein, 23 aa, Mycobacterium avium
ETLRRAGERFGFAVEAMSLLSEH

SEQ ID NO: 107770 - protein, 24 aa, Mycobacterium avium
ETNVEFWAAVILDFARVPANMMPA

SEQ ID NO: 107771 - protein, 18 aa, Mycobacterium avium
ETRGRFGTFVARYDPTDA

SEQ ID NO: 107772 - protein, 24 aa, Mycobacterium avium
EVALFRLLESWGVRPDFVMGHSIG

SEQ ID NO: 107773 - protein, 24 aa, Mycobacterium avium
EVAPWLDLVRKLGLLAATLSDGPP

SEQ ID NO: 107774 - protein, 17 aa, Mycobacterium avium
EVIELGDWVRPVLLDGL

SEQ ID NO: 107775 - protein, 18 aa, Mycobacterium avium
EVIRRSGVDPAAIDDIIF

SEQ ID NO: 107776 - protein, 18 aa, Mycobacterium avium
EVKKAAAEHGLWYPPDPS

SEQ ID NO: 107777 - protein, 18 aa, Mycobacterium avium
EVLGRAGLGVSLAGVNYV

SEQ ID NO: 107778 - protein, 22 aa, Mycobacterium avium
EVLRFRTADGLVHYVSLGCSRH

SEQ ID NO: 107779 - protein, 23 aa, Mycobacterium avium
EVQIGKFRLVFLTGPKQGEDGGS

SEQ ID NO: 107780 - protein, 19 aa, Mycobacterium avium
EVYRPRLAGPVPQAEDVVA

SEQ ID NO: 107781 - protein, 17 aa, Mycobacterium avium
EWFCLFSSAAALVGSPG

SEQ ID NO: 107782 - protein, 21 aa, Mycobacterium avium
EWTDWRWNRILIEGSNCRDII

SEQ ID NO: 107783 - protein, 18 aa, Mycobacterium avium
EYVDSFAGLVPRLGSAGT

SEQ ID NO: 107784 - protein, 19 aa, Mycobacterium avium
FAAEAAFVFAMIGVDLSRL

SEQ ID NO: 107785 - protein, 17 aa, Mycobacterium avium
FAAPGWVVSPGVVKALP

SEQ ID NO: 107786 - protein, 17 aa, Mycobacterium avium
FAFDAAWQPLVALLDGH

SEQ ID NO: 107787 - protein, 25 aa, Mycobacterium avium
FAGAFKPPLRWGMRMTGKKFLREYP

SEQ ID NO: 107788 - protein, 24 aa, Mycobacterium avium
FAGIGIPIAEVWGMSELSCVAAVS

SEQ ID NO: 107789 - protein, 20 aa, Mycobacterium avium
FAPRCPLAIDECRSQEPELL

SEQ ID NO: 107790 - protein, 19 aa, Mycobacterium avium
FAQSRLWFIGQLHGPSPVY

SEQ ID NO: 107791 - protein, 18 aa, Mycobacterium avium
FDGLRLAGRPVRRPDLTL

SEQ ID NO: 107792 - protein, 19 aa, Mycobacterium avium
FDGLTRWLTGMFERDGWQP

SEQ ID NO: 107793 - protein, 18 aa, Mycobacterium avium
FDGRIITVPFSFKEIDDD

SEQ ID NO: 107794 - protein, 17 aa, Mycobacterium avium
FDISWQADEAWSYIVGD

SEQ ID NO: 107795 - protein, 18 aa, Mycobacterium avium
FDLNAHWSRLWSGQPEIL

SEQ ID NO: 107796 - protein, 19 aa, Mycobacterium avium
FDPNAGWFNYFSTWGNQFI

SEQ ID NO: 107797 - protein, 17 aa, Mycobacterium avium
FDPRTPYVVFWVVDPDT

SEQ ID NO: 107798 - protein, 17 aa, Mycobacterium avium
FDRTAGFGIYGTAKAAL

SEQ ID NO: 107799 - protein, 23 aa, Mycobacterium avium
FDSRAVGPGGLFLALPGARTDGH

SEQ ID NO: 107800 - protein, 17 aa, Mycobacterium avium
FELDAGVLYPDRQDVAD

SEQ ID NO: 107801 - protein, 20 aa, Mycobacterium avium
FEVNEAFAPVVLAWAQDTGA

SEQ ID NO: 107802 - protein, 19 aa, Mycobacterium avium
FFAAARTLLGWGQFGTGLN

SEQ ID NO: 107803 - protein, 17 aa, Mycobacterium avium
FGELRWAVSGAAPIPKE

SEQ ID NO: 107804 - protein, 17 aa, Mycobacterium avium
FGLELVECSEFFKDTTF

SEQ ID NO: 107805 - protein, 21 aa, Mycobacterium avium
FGLLKRFAKGWVVRANQVGVD

SEQ ID NO: 107806 - protein, 17 aa, Mycobacterium avium
FGPSWAWPKPVQPHIPV

SEQ ID NO: 107807 - protein, 17 aa, Mycobacterium avium
FGRRAGIAAANYARGHD

SEQ ID NO: 107808 - protein, 23 aa, Mycobacterium avium
FGSMPMRACRDVARVAIEAVRAQ

SEQ ID NO: 107809 - protein, 17 aa, Mycobacterium avium
FGTCLDAVYLHPCGSDE

SEQ ID NO: 107810 - protein, 19 aa, Mycobacterium avium
FGVFCRRWGVPLIDGGTVR

SEQ ID NO: 107811 - protein, 17 aa, Mycobacterium avium
FGVGRARARAVSDGRPV

SEQ ID NO: 107812 - protein, 18 aa, Mycobacterium avium
FGVPMGFGGPHAGYLAVH

SEQ ID NO: 107813 - protein, 18 aa, Mycobacterium avium
FGYNVVRDFTGHGIGTTF

SEQ ID NO: 107814 - protein, 17 aa, Mycobacterium avium
FHFKSKHALAVAIIESQ

SEQ ID NO: 107815 - protein, 17 aa, Mycobacterium avium
FHWWLVLATLRWGVICR

SEQ ID NO: 107816 - protein, 17 aa, Mycobacterium avium
FKAPFVFTGGTIARVTL

SEQ ID NO: 107817 - protein, 19 aa, Mycobacterium avium
FKDAELLGVPWIVVVGRGW

SEQ ID NO: 107818 - protein, 21 aa, Mycobacterium avium
FKSERIVAAPVTFVDIAGLVK

SEQ ID NO: 107819 - protein, 19 aa, Mycobacterium avium
FLDREGWDALTINALATQL

SEQ ID NO: 107820 - protein, 18 aa, Mycobacterium avium
FLGPRPANWWIRRRLHET

SEQ ID NO: 107821 - protein, 18 aa, Mycobacterium avium
FLHKELYREYALRPPKGV

SEQ ID NO: 107822 - protein, 26 aa, Mycobacterium avium
FLHPELKWDFRLPRVVSINVSGHKYG

SEQ ID NO: 107823 - protein, 26 aa, Mycobacterium avium
FMERRVPPRWWPPVMKKFVWPWVAGR

SEQ ID NO: 107824 - protein, 26 aa, Mycobacterium avium
FNELVMRAGLRWQQVVLLRAYAKYLR

SEQ ID NO: 107825 - protein, 18 aa, Mycobacterium avium
FPALKFVWADGAADFLTP

SEQ ID NO: 107826 - protein, 18 aa, Mycobacterium avium
FPEELGKMGFVFNFITYG

SEQ ID NO: 107827 - protein, 17 aa, Mycobacterium avium
FPLMPIPSWMDNPIDPI

SEQ ID NO: 107828 - protein, 23 aa, Mycobacterium avium
FPLSQWLKFAPPIGYGALPKDAL

SEQ ID NO: 107829 - protein, 21 aa, Mycobacterium avium
FQRPNPFPAMSIRDNVVAGLK

SEQ ID NO: 107830 - protein, 19 aa, Mycobacterium avium
FRASVCVLGPLVGRCKRAR

SEQ ID NO: 107831 - protein, 18 aa, Mycobacterium avium
FREHASWALASDTLDFVD

SEQ ID NO: 107832 - protein, 24 aa, Mycobacterium avium
FRFFPAYYLHIWDLFQRIPVYELR

SEQ ID NO: 107833 - protein, 20 aa, Mycobacterium avium
FRHTFDWCVTSAFIMSQLVA

SEQ ID NO: 107834 - protein, 21 aa, Mycobacterium avium
FRLLVLRTAWLIDKHHDYQKV

SEQ ID NO: 107835 - protein, 23 aa, Mycobacterium avium
FRLPANELEFFFFVLAFAGSDTT

SEQ ID NO: 107836 - protein, 19 aa, Mycobacterium avium
FRYVMMVLRHIPRPIFRKL

SEQ ID NO: 107837 - protein, 17 aa, Mycobacterium avium
FSALAFKVATHPFFGKL

SEQ ID NO: 107838 - protein, 19 aa, Mycobacterium avium
FSLLPAWRGAAPVQAAIAA

SEQ ID NO: 107839 - protein, 18 aa, Mycobacterium avium
FSPLRLPPDLDFTALFHG

SEQ ID NO: 107840 - protein, 17 aa, Mycobacterium avium
FSSLCWGERIAFDNPDS

SEQ ID NO: 107841 - protein, 23 aa, Mycobacterium avium
FSSWADDVFKAFSFTVDLREVEP

SEQ ID NO: 107842 - protein, 19 aa, Mycobacterium avium
FSTYATWWIRQAITRAMAD

SEQ ID NO: 107843 - protein, 17 aa, Mycobacterium avium
FTEGVGFDKGFLSAYFV

SEQ ID NO: 107844 - protein, 20 aa, Mycobacterium avium
FTEHGLRLGVEAALRNLARV

SEQ ID NO: 107845 - protein, 17 aa, Mycobacterium avium
FTLAVGVGYLKREFAAL

SEQ ID NO: 107846 - protein, 18 aa, Mycobacterium avium
FVSGLSLNLAVMVRQTED

SEQ ID NO: 107847 - protein, 18 aa, Mycobacterium avium
FVVLDGLAKPGRLAGPDP

SEQ ID NO: 107848 - protein, 24 aa, Mycobacterium avium
FWASWCGPCRQFGPTFQASSEKHP

SEQ ID NO: 107849 - protein, 18 aa, Mycobacterium avium
GAALRPAPVGAYPAGASA

SEQ ID NO: 107850 - protein, 17 aa, Mycobacterium avium
GADIIAIDVCKQLDGVK

SEQ ID NO: 107851 - protein, 23 aa, Mycobacterium avium
GAELFPRMRIPQAWYDAGIAVRA

SEQ ID NO: 107852 - protein, 18 aa, Mycobacterium avium
GAEVRWASCNIFSTQDHA

SEQ ID NO: 107853 - protein, 25 aa, Mycobacterium avium
GAFHVLRPAFPVMCRAGYGRIVLTS

SEQ ID NO: 107854 - protein, 17 aa, Mycobacterium avium
GAGLDWKTSLQELTAAR

SEQ ID NO: 107855 - protein, 18 aa, Mycobacterium avium
GAHFECWTMLGAWAEQTS

SEQ ID NO: 107856 - protein, 23 aa, Mycobacterium avium
GAKMVTAVACARVPKLTVVIGGS

SEQ ID NO: 107857 - protein, 24 aa, Mycobacterium avium
GASPRFLLDFSRRFPDATVVRLER

SEQ ID NO: 107858 - protein, 18 aa, Mycobacterium avium
GAVGMPGVPLAGLPGAHE

SEQ ID NO: 107859 - protein, 19 aa, Mycobacterium avium
GAVSFRFGDRTQINGVPRD

SEQ ID NO: 107860 - protein, 18 aa, Mycobacterium avium
GAVTMVWQRGELLQVNEI

SEQ ID NO: 107861 - protein, 19 aa, Mycobacterium avium
GCFGMKIPSEFGGLNMSQV

SEQ ID NO: 107862 - protein, 21 aa, Mycobacterium avium
GDARGGAALSVREVTGVPILF

SEQ ID NO: 107863 - protein, 22 aa, Mycobacterium avium
GDCVQCPFHGWRWGPDGTNRYI

SEQ ID NO: 107864 - protein, 22 aa, Mycobacterium avium
GDDGRWRLGPAVTELAAHVNDP

SEQ ID NO: 107865 - protein, 21 aa, Mycobacterium avium
GDILLIRTGWWTRYLETGNKT

SEQ ID NO: 107866 - protein, 17 aa, Mycobacterium avium
GDLLTWRGGSELFEFAD

SEQ ID NO: 107867 - protein, 19 aa, Mycobacterium avium
GDPRFSDVSSRVFGTPHDV

SEQ ID NO: 107868 - protein, 19 aa, Mycobacterium avium
GEGARPPWSIGEPQPEIAA

SEQ ID NO: 107869 - protein, 18 aa, Mycobacterium avium
GEGPRWFEGLLWFSDMLG

SEQ ID NO: 107870 - protein, 20 aa, Mycobacterium avium
GELIGAPVLDADLLRRAKHH

SEQ ID NO: 107871 - protein, 17 aa, Mycobacterium avium
GEPFPYPVTVGYMYIMK

SEQ ID NO: 107872 - protein, 17 aa, Mycobacterium avium
GFGVWRLGDDDAMLGIV

SEQ ID NO: 107873 - protein, 18 aa, Mycobacterium avium
GFPSPWLVVVGAFQAQAE

SEQ ID NO: 107874 - protein, 18 aa, Mycobacterium avium
GFRVRRLAGRVVWMQPPD

SEQ ID NO: 107875 - protein, 17 aa, Mycobacterium avium
GGACSMSAFTAAMHAGQ

SEQ ID NO: 107876 - protein, 19 aa, Mycobacterium avium
GGFPEGCFQTLLVPSSAVE

SEQ ID NO: 107877 - protein, 24 aa, Mycobacterium avium
GGLPGRITVCYRFTRPGHDITLFS

SEQ ID NO: 107878 - protein, 25 aa, Mycobacterium avium
GGPATWRLGGAFNCGKAQPGQIAPV

SEQ ID NO: 107879 - protein, 18 aa, Mycobacterium avium
GGPVARWAEETDRNPPRL

SEQ ID NO: 107880 - protein, 19 aa, Mycobacterium avium
GHARVAPVYLYRFDYSTPL

SEQ ID NO: 107881 - protein, 20 aa, Mycobacterium avium
GHDAGWRVGDDVAHPDLGHG

SEQ ID NO: 107882 - protein, 20 aa, Mycobacterium avium
GHFYGAGLINWWDPQGTRKT

SEQ ID NO: 107883 - protein, 25 aa, Mycobacterium avium
GHIELAAPVTHIWYFKGVPSRLGYL

SEQ ID NO: 107884 - protein, 18 aa, Mycobacterium avium
GHLRQRWARNTGGLLLVT

SEQ ID NO: 107885 - protein, 20 aa, Mycobacterium avium
GIAHRLGMRPSWVLDLNNGG

SEQ ID NO: 107886 - protein, 19 aa, Mycobacterium avium
GIEEAERLLGYEVTRTGEQ

SEQ ID NO: 107887 - protein, 21 aa, Mycobacterium avium
GIHVFLRIATDWDFVEVRRAG

SEQ ID NO: 107888 - protein, 20 aa, Mycobacterium avium
GKFLNNWRMAELHAKEAPDR

SEQ ID NO: 107889 - protein, 23 aa, Mycobacterium avium
GKHHRIGFPFTWITNAATDPAAS

SEQ ID NO: 107890 - protein, 19 aa, Mycobacterium avium
GKIRLCLGYTEPEGGSDVA

SEQ ID NO: 107891 - protein, 18 aa, Mycobacterium avium
GKPSLGWRGRRAAERLSE

SEQ ID NO: 107892 - protein, 19 aa, Mycobacterium avium
GLAAWRLGAGRSRPGERVQ

SEQ ID NO: 107893 - protein, 18 aa, Mycobacterium avium
GLCRLLARRGVRVAPFKA

SEQ ID NO: 107894 - protein, 19 aa, Mycobacterium avium
GLDGSHGWERTHIDSLEAA

SEQ ID NO: 107895 - protein, 19 aa, Mycobacterium avium
GLEFPVVFVTGWEDGMFPH

SEQ ID NO: 107896 - protein, 19 aa, Mycobacterium avium
GLIEWKMDLELGAHYYVKF

SEQ ID NO: 107897 - protein, 20 aa, Mycobacterium avium
GLPYRWPHPWLVDPKTASEQ

SEQ ID NO: 107898 - protein, 23 aa, Mycobacterium avium
GLRGGILIPARWVGYPPYHDRRY

SEQ ID NO: 107899 - protein, 18 aa, Mycobacterium avium
GLTLPEFVCLRILSMFPG

SEQ ID NO: 107900 - protein, 19 aa, Mycobacterium avium
GMFTDRHALALGPGKALLD

SEQ ID NO: 107901 - protein, 21 aa, Mycobacterium avium
GMSHLKWLVVRDFNLIESATW

SEQ ID NO: 107902 - protein, 21 aa, Mycobacterium avium
GNALCAAAVALECGATVEQVV

SEQ ID NO: 107903 - protein, 22 aa, Mycobacterium avium
GPAMSAFNAWVLLKGLETMAIR

SEQ ID NO: 107904 - protein, 18 aa, Mycobacterium avium
GPEPLSWHTATIAPESAC

SEQ ID NO: 107905 - protein, 17 aa, Mycobacterium avium
GPFAQRAATEFTLQAWA

SEQ ID NO: 107906 - protein, 17 aa, Mycobacterium avium
GPGGLHFAGRVGTGFTE

SEQ ID NO: 107907 - protein, 19 aa, Mycobacterium avium
GPLTWPLHISLLLAKEYAL

SEQ ID NO: 107908 - protein, 25 aa, Mycobacterium avium
GPQVARAALLFGMRFDAEAAVRHGL

SEQ ID NO: 107909 - protein, 19 aa, Mycobacterium avium
GPVLRPSTTLVRRSRGFAE

SEQ ID NO: 107910 - protein, 19 aa, Mycobacterium avium
GQCGSCFNGTAAMAAAGGA

SEQ ID NO: 107911 - protein, 17 aa, Mycobacterium avium
GQLRWFGLDGVEHTGGP

SEQ ID NO: 107912 - protein, 23 aa, Mycobacterium avium
GQRFRAGVALSVFTDDAGSAIGF

SEQ ID NO: 107913 - protein, 22 aa, Mycobacterium avium
GRADPGEIVWTWVVYEDDPSRG

SEQ ID NO: 107914 - protein, 19 aa, Mycobacterium avium
GRANPGMFSRIVIDYYGAA

SEQ ID NO: 107915 - protein, 20 aa, Mycobacterium avium
GRFIPCGILPLFDVAEAAKE

SEQ ID NO: 107916 - protein, 18 aa, Mycobacterium avium
GRGSIRMRGVVEVEEDSR

SEQ ID NO: 107917 - protein, 18 aa, Mycobacterium avium
GRHIPKLRQVIGTVFQDF

SEQ ID NO: 107918 - protein, 23 aa, Mycobacterium avium
GRIAARVPQEWLLPYVHQRYDDV

SEQ ID NO: 107919 - protein, 23 aa, Mycobacterium avium
GRIVSFDAAGGWNLEEEGYQSVG

SEQ ID NO: 107920 - protein, 20 aa, Mycobacterium avium
GRLRYLGVVLYDMDRVLEAA

SEQ ID NO: 107921 - protein, 19 aa, Mycobacterium avium
GRPRLKTSLLSAADIKAIP

SEQ ID NO: 107922 - protein, 19 aa, Mycobacterium avium
GRVSLHWGPRRDAHLLIPE

SEQ ID NO: 107923 - protein, 23 aa, Mycobacterium avium
GRWADRFGGLVFDATGITTPEGL

SEQ ID NO: 107924 - protein, 21 aa, Mycobacterium avium
GRWSCVRWGTLTPPFYPEAAE

SEQ ID NO: 107925 - protein, 18 aa, Mycobacterium avium
GSAHFVWVRETLRLGDKF

SEQ ID NO: 107926 - protein, 25 aa, Mycobacterium avium
GSAKWALKIAREWSGERVQWGKPLA

SEQ ID NO: 107927 - protein, 24 aa, Mycobacterium avium
GSFNFGVPTAALWSAHRYGAPFVT

SEQ ID NO: 107928 - protein, 23 aa, Mycobacterium avium
GSLPVARSMLWARLRVSPGELRR

SEQ ID NO: 107929 - protein, 18 aa, Mycobacterium avium
GSMSLSFSDPRFDEVKAP

SEQ ID NO: 107930 - protein, 22 aa, Mycobacterium avium
GSRIDPVLARSWLLVNGTHPDR

SEQ ID NO: 107931 - protein, 25 aa, Mycobacterium avium
GSVLELRPDYGVGIVTALVRVEGVP

SEQ ID NO: 107932 - protein, 18 aa, Mycobacterium avium
GTGGFEWDPVLVQAFLRG

SEQ ID NO: 107933 - protein, 19 aa, Mycobacterium avium
GTPLGPLRCDAWIDRREGV

SEQ ID NO: 107934 - protein, 18 aa, Mycobacterium avium
GTTQRFGVPMGFGGPHAG

SEQ ID NO: 107935 - protein, 18 aa, Mycobacterium avium
GVAARGGHRLDLTATELR

SEQ ID NO: 107936 - protein, 22 aa, Mycobacterium avium
GVACYPARFQLVLAANLCPCAP

SEQ ID NO: 107937 - protein, 19 aa, Mycobacterium avium
GVAIRAFELAVRYAQQRET

SEQ ID NO: 107938 - protein, 17 aa, Mycobacterium avium
GVDEVWAVGGAQAVALL

SEQ ID NO: 107939 - protein, 20 aa, Mycobacterium avium
GVDIAFNWDHFFPLYGDPDG

SEQ ID NO: 107940 - protein, 21 aa, Mycobacterium avium
GVDQLRYFLLREVPFGQDGSY

SEQ ID NO: 107941 - protein, 18 aa, Mycobacterium avium
GVFLPERLGFMFVGAAEM

SEQ ID NO: 107942 - protein, 24 aa, Mycobacterium avium
GVGAWLVLCCRAMRAGAQEALSIA

SEQ ID NO: 107943 - protein, 19 aa, Mycobacterium avium
GVLSGKIRLCLGYTEPEGG

SEQ ID NO: 107944 - protein, 18 aa, Mycobacterium avium
GVMRRLWHGELIFNHDGP

SEQ ID NO: 107945 - protein, 25 aa, Mycobacterium avium
GVSQWKNFFIYAPWSAAMAKSSLGA

SEQ ID NO: 107946 - protein, 26 aa, Mycobacterium avium
GVVIGRGCLGRPWLFAELSAAFTGSP

SEQ ID NO: 107947 - protein, 19 aa, Mycobacterium avium
GVYQCRACGAELFRSTEKF

SEQ ID NO: 107948 - protein, 22 aa, Mycobacterium avium
GWCPHCGSAYSFLPQLNPGDIV

SEQ ID NO: 107949 - protein, 18 aa, Mycobacterium avium
GWEGALIGTGWGRPDTFT

SEQ ID NO: 107950 - protein, 19 aa, Mycobacterium avium
GWFINQHIIWRVGDEDVAE

SEQ ID NO: 107951 - protein, 19 aa, Mycobacterium avium
GWLAFTFEICRQRIIDPTT

SEQ ID NO: 107952 - protein, 18 aa, Mycobacterium avium
GWYEHEWRAYGYGFPSAG

SEQ ID NO: 107953 - protein, 24 aa, Mycobacterium avium
HAGKWRVVFFWPKDFTFVCPTEIA

SEQ ID NO: 107954 - protein, 23 aa, Mycobacterium avium
HALWACLELRLLEALDMTGQRIS

SEQ ID NO: 107955 - protein, 18 aa, Mycobacterium avium
HDDWRWVIDIDLWGSIHA

SEQ ID NO: 107956 - protein, 20 aa, Mycobacterium avium
HDLYRRWPFFRSVLSNLAQV

SEQ ID NO: 107957 - protein, 18 aa, Mycobacterium avium
HDRFRFYLNVEVGKHLSH

SEQ ID NO: 107958 - protein, 19 aa, Mycobacterium avium
HEVPEVWAAVTSVFRDYGY

SEQ ID NO: 107959 - protein, 19 aa, Mycobacterium avium
HFFVCSTHDWILFFTTQGR

SEQ ID NO: 107960 - protein, 17 aa, Mycobacterium avium
HFIRTGQEFSWRAEELF

SEQ ID NO: 107961 - protein, 21 aa, Mycobacterium avium
HGFGSFWWSWRHQLRGLTGAR

SEQ ID NO: 107962 - protein, 19 aa, Mycobacterium avium
HGLQLHGAMGFTWENDLQF

SEQ ID NO: 107963 - protein, 17 aa, Mycobacterium avium
HHIKRSLILDGLLGSAR

SEQ ID NO: 107964 - protein, 17 aa, Mycobacterium avium
HHLPVPPAFCLTTAVGL

SEQ ID NO: 107965 - protein, 18 aa, Mycobacterium avium
HIVAAFAFELGKVEMPEI

SEQ ID NO: 107966 - protein, 17 aa, Mycobacterium avium
HKKGSALVPSWVAFAVT

SEQ ID NO: 107967 - protein, 18 aa, Mycobacterium avium
HQFRERFAPYGLRPEALT

SEQ ID NO: 107968 - protein, 23 aa, Mycobacterium avium
HQGLCYFAYLAGYREVHEAAQDP

SEQ ID NO: 107969 - protein, 24 aa, Mycobacterium avium
HQIPRAGNMLSVFFTDTPVTDFAS

SEQ ID NO: 107970 - protein, 19 aa, Mycobacterium avium
HRLALRNGVLVQRKVPADP

SEQ ID NO: 107971 - protein, 18 aa, Mycobacterium avium
HRRGKPLILDEAWGAHLP

SEQ ID NO: 107972 - protein, 20 aa, Mycobacterium avium
HSFGGITIMAWAQRFAAHAV

SEQ ID NO: 107973 - protein, 20 aa, Mycobacterium avium
HSVWLPDHMVSFWPDSIWAP

SEQ ID NO: 107974 - protein, 19 aa, Mycobacterium avium
HTVRPAFEIIKTVPDVSTV

SEQ ID NO: 107975 - protein, 30 aa, Mycobacterium avium
HVKAAMLRARHRIMLVGWDFDSRVTFERGD

SEQ ID NO: 107976 - protein, 17 aa, Mycobacterium avium
HVVPRWGGDANFITIIG

SEQ ID NO: 107977 - protein, 20 aa, Mycobacterium avium
HWYVPRSIRLIDVFKGLSPE

SEQ ID NO: 107978 - protein, 19 aa, Mycobacterium avium
HYLRVPFVLTKCAVPHMRK

SEQ ID NO: 107979 - protein, 19 aa, Mycobacterium avium
IAEGCVRAGCALLGGETAE

SEQ ID NO: 107980 - protein, 23 aa, Mycobacterium avium
IAMPALRLDAAFVHLNLGDAQGN

SEQ ID NO: 107981 - protein, 20 aa, Mycobacterium avium
IAPDGSFEWRVRPTSNGQLV

SEQ ID NO: 107982 - protein, 26 aa, Mycobacterium avium
IAQARLGPGRIHHCMRALGGAERALA

SEQ ID NO: 107983 - protein, 23 aa, Mycobacterium avium
IARFKRLDGFDVRFLTGTDEHGL

SEQ ID NO: 107984 - protein, 18 aa, Mycobacterium avium
IARLMLSALIGRVAIPDP

SEQ ID NO: 107985 - protein, 19 aa, Mycobacterium avium
ICAFGRIGSMFACADFGYV

SEQ ID NO: 107986 - protein, 17 aa, Mycobacterium avium
IDAEIPLLVVITEGIPV

SEQ ID NO: 107987 - protein, 18 aa, Mycobacterium avium
IDAKLGFPQRDPHGDPIP

SEQ ID NO: 107988 - protein, 24 aa, Mycobacterium avium
IDERARAGIFLAMQYPVEVPGVSV

SEQ ID NO: 107989 - protein, 23 aa, Mycobacterium avium
IDGHVRAGGFGLVGACDIAVAGP

SEQ ID NO: 107990 - protein, 27 aa, Mycobacterium avium
IDKFAPRLSFFWGIGMNFFMEVAKLRA

SEQ ID NO: 107991 - protein, 17 aa, Mycobacterium avium
IDKRGKISLVLVEEDNS

SEQ ID NO: 107992 - protein, 17 aa, Mycobacterium avium
IDNWRWAGVPIFLRAGK

SEQ ID NO: 107993 - protein, 20 aa, Mycobacterium avium
IDPWGGSYYVEWLTHHLARK

SEQ ID NO: 107994 - protein, 18 aa, Mycobacterium avium
IDTELGWAQFYGHNTARV

SEQ ID NO: 107995 - protein, 17 aa, Mycobacterium avium
IDYARGRFDAIVPEHVL

SEQ ID NO: 107996 - protein, 18 aa, Mycobacterium avium
IEAFRLLTLQTAWKIDQF

SEQ ID NO: 107997 - protein, 17 aa, Mycobacterium avium
IEAGYEFVNTPHITKAQ

SEQ ID NO: 107998 - protein, 20 aa, Mycobacterium avium
IEALLRVLEPFGIREIVQSG

SEQ ID NO: 107999 - protein, 17 aa, Mycobacterium avium
IEARPAITLSWIRELPS

SEQ ID NO: 108000 - protein, 18 aa, Mycobacterium avium
IEIREFLEGYVIGQDTAK

SEQ ID NO: 108001 - protein, 20 aa, Mycobacterium avium
IEKMRVAGRIAAGALVEAGK

SEQ ID NO: 108002 - protein, 19 aa, Mycobacterium avium
IELGDWVRPVLLDGLAVLL

SEQ ID NO: 108003 - protein, 18 aa, Mycobacterium avium
IGCALRWMRDFHADGLRL

SEQ ID NO: 108004 - protein, 20 aa, Mycobacterium avium
IGGARRCAAQSWPLERIKNV

SEQ ID NO: 108005 - protein, 25 aa, Mycobacterium avium
IGGGMCFTFLAAQGFSVGKSLLETE

SEQ ID NO: 108006 - protein, 17 aa, Mycobacterium avium
IGGRYGLQTMCEGGGTA

SEQ ID NO: 108007 - protein, 23 aa, Mycobacterium avium
IGRELDRYLPFLATTKVLIAAVR

SEQ ID NO: 108008 - protein, 21 aa, Mycobacterium avium
IGSKELIAWLPTLLGLGPADL

SEQ ID NO: 108009 - protein, 18 aa, Mycobacterium avium
IGSMFACADFGYVPDMIT

SEQ ID NO: 108010 - protein, 19 aa, Mycobacterium avium
IGVNCLWPQTYIATAAVAN

SEQ ID NO: 108011 - protein, 18 aa, Mycobacterium avium
IHAGEAFGLPSIHEAIAF

SEQ ID NO: 108012 - protein, 18 aa, Mycobacterium avium
IHTRYWYPLFEAVCENKT

SEQ ID NO: 108013 - protein, 20 aa, Mycobacterium avium
IIPWNFPILMGAWKLAPALA

SEQ ID NO: 108014 - protein, 22 aa, Mycobacterium avium
IIVPGCLDLLFRGEIPDGVDPA

SEQ ID NO: 108015 - protein, 25 aa, Mycobacterium avium
IKELCRRWYPRIYFGQPVKGLTHRA

SEQ ID NO: 108016 - protein, 20 aa, Mycobacterium avium
IKKLPTLRGRTVVTMFYENS

SEQ ID NO: 108017 - protein, 17 aa, Mycobacterium avium
ILAEIFPGGWLPTPQTV

SEQ ID NO: 108018 - protein, 24 aa, Mycobacterium avium
ILASICFPSFPGFAGRLFATEDND

SEQ ID NO: 108019 - protein, 24 aa, Mycobacterium avium
ILATEILDPLGFRWTNFGVAKQDV

SEQ ID NO: 108020 - protein, 19 aa, Mycobacterium avium
ILEYHWGPDWVVYDAKGTS

SEQ ID NO: 108021 - protein, 18 aa, Mycobacterium avium
ILGNLGLVIGGGFDTTTA

SEQ ID NO: 108022 - protein, 24 aa, Mycobacterium avium
ILLQRSWIAIFWSRFADAVELIAQ

SEQ ID NO: 108023 - protein, 17 aa, Mycobacterium avium
ILVRPAPVPGFRGPRSF

SEQ ID NO: 108024 - protein, 17 aa, Mycobacterium avium
IMRRLYPLIGRLFARQT

SEQ ID NO: 108025 - protein, 23 aa, Mycobacterium avium
INEPRFPSFKGIMAAKKKEVTVL

SEQ ID NO: 108026 - protein, 19 aa, Mycobacterium avium
INMNPRWLGAHPAYTLSKY

SEQ ID NO: 108027 - protein, 20 aa, Mycobacterium avium
IPGPLKWDLTLGVATDTRES

SEQ ID NO: 108028 - protein, 17 aa, Mycobacterium avium
IPLLVVITEGIPVQDSA

SEQ ID NO: 108029 - protein, 21 aa, Mycobacterium avium
IPNAYCTTVFLAILDTETGVL

SEQ ID NO: 108030 - protein, 23 aa, Mycobacterium avium
IPTEMAIEFDISWQADEAWSYIV

SEQ ID NO: 108031 - protein, 19 aa, Mycobacterium avium
IPVGPRLGNVVVEVEHLDK

SEQ ID NO: 108032 - protein, 17 aa, Mycobacterium avium
IQIPRFCDHPLLEPVGA

SEQ ID NO: 108033 - protein, 19 aa, Mycobacterium avium
IQSRLGFLLDVGLEYLSLS

SEQ ID NO: 108034 - protein, 18 aa, Mycobacterium avium
IRAPWTLPKRSRKAGPSS

SEQ ID NO: 108035 - protein, 20 aa, Mycobacterium avium
IRFCDAFNIPLVFVVDTPGF

SEQ ID NO: 108036 - protein, 19 aa, Mycobacterium avium
IRGLSKVAALEWGRDNIRV

SEQ ID NO: 108037 - protein, 18 aa, Mycobacterium avium
IRVKEMWESIKIVEQCLD

SEQ ID NO: 108038 - protein, 21 aa, Mycobacterium avium
ISCGPYRFVYRKRFHKKCETE

SEQ ID NO: 108039 - protein, 18 aa, Mycobacterium avium
ISDGLAMRHGKEMTWSQV

SEQ ID NO: 108040 - protein, 24 aa, Mycobacterium avium
ISPLQARCGWAIGWKKEAFFGRDA

SEQ ID NO: 108041 - protein, 22 aa, Mycobacterium avium
ISSARTAAQFGIEPRVAMLSYS

SEQ ID NO: 108042 - protein, 17 aa, Mycobacterium avium
ITALGHWVHVYVDRDTR

SEQ ID NO: 108043 - protein, 18 aa, Mycobacterium avium
ITAVMPFYPYARQDKKHR

SEQ ID NO: 108044 - protein, 24 aa, Mycobacterium avium
ITKTSDVSTVWTWPDKPGVAGCAA

SEQ ID NO: 108045 - protein, 20 aa, Mycobacterium avium
ITWLAGHLRQRWARNTGGLL

SEQ ID NO: 108046 - protein, 19 aa, Mycobacterium avium
IVARGWRSPLQLLFIDGGH

SEQ ID NO: 108047 - protein, 18 aa, Mycobacterium avium
IVDDVIWGCVMQAGEQAL

SEQ ID NO: 108048 - protein, 17 aa, Mycobacterium avium
IVERLVPDFLWISTEHT

SEQ ID NO: 108049 - protein, 19 aa, Mycobacterium avium
IVLCAGAIETAHLLMLSGI

SEQ ID NO: 108050 - protein, 18 aa, Mycobacterium avium
IVLVTGACRFLGGYLTAR

SEQ ID NO: 108051 - protein, 23 aa, Mycobacterium avium
IVSRGGSIMAAWCLAHHRESFLY

SEQ ID NO: 108052 - protein, 17 aa, Mycobacterium avium
IYFSGGYSFEYLNDEAK

SEQ ID NO: 108053 - protein, 21 aa, Mycobacterium avium
KAFAFAGGRLGYLIATPAVIE

SEQ ID NO: 108054 - protein, 17 aa, Mycobacterium avium
KAGELTPALAAQEILAA

SEQ ID NO: 108055 - protein, 17 aa, Mycobacterium avium
KALAAFGGIGLRLKSSD

SEQ ID NO: 108056 - protein, 21 aa, Mycobacterium avium
KAVPSRLAWEAGVALADSLLT

SEQ ID NO: 108057 - protein, 23 aa, Mycobacterium avium
KDPKRPSGSFIFAGPSGVGKTEL

SEQ ID NO: 108058 - protein, 20 aa, Mycobacterium avium
KDRLLELSIAMHSTGPDVMG

SEQ ID NO: 108059 - protein, 20 aa, Mycobacterium avium
KEERGARIFIDFNQNARDRT

SEQ ID NO: 108060 - protein, 22 aa, Mycobacterium avium
KEGDDVFVALSWTKHPPPQTYQ

SEQ ID NO: 108061 - protein, 18 aa, Mycobacterium avium
KEIGLVWKLVEPDRLQAE

SEQ ID NO: 108062 - protein, 18 aa, Mycobacterium avium
KEVLPEFIERDAKAVADK

SEQ ID NO: 108063 - protein, 25 aa, Mycobacterium avium
KGIFTSNFGYRWGVLHAGIDLANSI

SEQ ID NO: 108064 - protein, 23 aa, Mycobacterium avium
KGPRFALAGSYALWAYGAPEPSH

SEQ ID NO: 108065 - protein, 21 aa, Mycobacterium avium
KGSALVPSWVAFAVTGLLEQH

SEQ ID NO: 108066 - protein, 24 aa, Mycobacterium avium
KGTFRLAFGIGDFRRDTGFGEDPA

SEQ ID NO: 108067 - protein, 20 aa, Mycobacterium avium
KHLRAGASIIVIGSNAAFMS

SEQ ID NO: 108068 - protein, 20 aa, Mycobacterium avium
KIDKGEFVFLIGPSGSGKST

SEQ ID NO: 108069 - protein, 17 aa, Mycobacterium avium
KISELYDRVGFAAAGKF

SEQ ID NO: 108070 - protein, 17 aa, Mycobacterium avium
KIWSGEATFLFTRTTVG

SEQ ID NO: 108071 - protein, 25 aa, Mycobacterium avium
KKFRFPTFLGAFKYYTSYTLKTFDG

SEQ ID NO: 108072 - protein, 20 aa, Mycobacterium avium
KKLSIRLGVPCFPDDPLRFT

SEQ ID NO: 108073 - protein, 21 aa, Mycobacterium avium
KLAKLRPVFGVKAGDATMTAG

SEQ ID NO: 108074 - protein, 23 aa, Mycobacterium avium
KLQKRLSEELAWVRSGAKARQAK

SEQ ID NO: 108075 - protein, 20 aa, Mycobacterium avium
KLRELLKFEFLFSARAQFEK

SEQ ID NO: 108076 - protein, 17 aa, Mycobacterium avium
KLSGRDAVMEWLSEHRK

SEQ ID NO: 108077 - protein, 19 aa, Mycobacterium avium
KLVPFGAFVRVEEGIEGLV

SEQ ID NO: 108078 - protein, 19 aa, Mycobacterium avium
KMVFGHRGINIPVIDHATG

SEQ ID NO: 108079 - protein, 19 aa, Mycobacterium avium
KNMLPRLSGLRGIIEAIDD

SEQ ID NO: 108080 - protein, 18 aa, Mycobacterium avium
KPGMTLLDIGCGWGTTMK

SEQ ID NO: 108081 - protein, 17 aa, Mycobacterium avium
KPLSAPERLRSGWLNGI

SEQ ID NO: 108082 - protein, 18 aa, Mycobacterium avium
KPLYGSSLVTGWARLHGY

SEQ ID NO: 108083 - protein, 21 aa, Mycobacterium avium
KPPDFWAWLIAAVKGIDPDVL

SEQ ID NO: 108084 - protein, 19 aa, Mycobacterium avium
KPRMGNAIVRMRLTMARWS

SEQ ID NO: 108085 - protein, 17 aa, Mycobacterium avium
KRECGLCSITTLVYDGD

SEQ ID NO: 108086 - protein, 19 aa, Mycobacterium avium
KRGDGWIKLVGDWIDRSVG

SEQ ID NO: 108087 - protein, 17 aa, Mycobacterium avium
KRPPAFPEDIWVPERDP

SEQ ID NO: 108088 - protein, 24 aa, Mycobacterium avium
KRRIHGVIFFPQWIRQHGERTVCF

SEQ ID NO: 108089 - protein, 17 aa, Mycobacterium avium
KRTRLGVGHFVETLETY

SEQ ID NO: 108090 - protein, 20 aa, Mycobacterium avium
KRTRLWPGLQETFNSGSTSI

SEQ ID NO: 108091 - protein, 21 aa, Mycobacterium avium
KRWHAIAEIIARGWDDVLGAI

SEQ ID NO: 108092 - protein, 17 aa, Mycobacterium avium
KRYAAGFSRELDDEWQL

SEQ ID NO: 108093 - protein, 21 aa, Mycobacterium avium
KSARFVKRFADIGGELRRAAT

SEQ ID NO: 108094 - protein, 20 aa, Mycobacterium avium
KSKLRTGGLLLNHCITRHDN

SEQ ID NO: 108095 - protein, 18 aa, Mycobacterium avium
KTALGTGFFLTWLTTYTD

SEQ ID NO: 108096 - protein, 20 aa, Mycobacterium avium
KTPKKVCHRITLGAGRNKVT

SEQ ID NO: 108097 - protein, 18 aa, Mycobacterium avium
KVFLEWPVLRQVRSTDKL

SEQ ID NO: 108098 - protein, 19 aa, Mycobacterium avium
KVLPGYGWIFPLGNGEVNI

SEQ ID NO: 108099 - protein, 19 aa, Mycobacterium avium
KVPGARCALAWSVETAQLA

SEQ ID NO: 108100 - protein, 19 aa, Mycobacterium avium
KVVVFRPLYAVGGQELGYL

SEQ ID NO: 108101 - protein, 19 aa, Mycobacterium avium
LAAHAAVFWLGRGRTASRE

SEQ ID NO: 108102 - protein, 18 aa, Mycobacterium avium
LAAVEAFFGAGAQRQLDV

SEQ ID NO: 108103 - protein, 18 aa, Mycobacterium avium
LADWRWGIDVNVLGVIHG

SEQ ID NO: 108104 - protein, 17 aa, Mycobacterium avium
LAEALWKDHEDPLSSSI

SEQ ID NO: 108105 - protein, 24 aa, Mycobacterium avium
LAILRRPRAGLSYETLLHTIEQRL

SEQ ID NO: 108106 - protein, 18 aa, Mycobacterium avium
LAKLRGATILAHNYQLPE

SEQ ID NO: 108107 - protein, 19 aa, Mycobacterium avium
LALAWLLKRSPVMLPIPGT

SEQ ID NO: 108108 - protein, 20 aa, Mycobacterium avium
LALNHLVCTRFRSDALQIIA

SEQ ID NO: 108109 - protein, 17 aa, Mycobacterium avium
LALVVGGASPPALLDTY

SEQ ID NO: 108110 - protein, 17 aa, Mycobacterium avium
LARRPAAEIKRVIRGVS

SEQ ID NO: 108111 - protein, 18 aa, Mycobacterium avium
LASGRIAYALGVHGPALT

SEQ ID NO: 108112 - protein, 22 aa, Mycobacterium avium
LAWCRDRMAGFKVPRTVEFLDA

SEQ ID NO: 108113 - protein, 17 aa, Mycobacterium avium
LAWTACRTFLAINAHWI

SEQ ID NO: 108114 - protein, 23 aa, Mycobacterium avium
LAYFAHLCGFEFVHEAARDPLFA

SEQ ID NO: 108115 - protein, 17 aa, Mycobacterium avium
LCLTAGAGRAHFEHRAA

SEQ ID NO: 108116 - protein, 21 aa, Mycobacterium avium
LDAPSVLGWAEFRDVAQRYSL

SEQ ID NO: 108117 - protein, 19 aa, Mycobacterium avium
LDCAINWKLAIDTFAENYH

SEQ ID NO: 108118 - protein, 18 aa, Mycobacterium avium
LDEWRVLTAAALVGLVEE

SEQ ID NO: 108119 - protein, 18 aa, Mycobacterium avium
LDGALWCTRAVYKKMTKR

SEQ ID NO: 108120 - protein, 18 aa, Mycobacterium avium
LDGGPSWHEGPAAGMWNG

SEQ ID NO: 108121 - protein, 17 aa, Mycobacterium avium
LDGLRWLQDRGFDGDRV

SEQ ID NO: 108122 - protein, 18 aa, Mycobacterium avium
LDGTEVFDITGIEELNKG

SEQ ID NO: 108123 - protein, 19 aa, Mycobacterium avium
LDIADWWAYLDDVQSTYPL

SEQ ID NO: 108124 - protein, 19 aa, Mycobacterium avium
LDIGCGWGTTIVRALERYD

SEQ ID NO: 108125 - protein, 19 aa, Mycobacterium avium
LDIGLPWRQYRSVQRGIAG

SEQ ID NO: 108126 - protein, 19 aa, Mycobacterium avium
LDILERFYGLVLTDCGPGL

SEQ ID NO: 108127 - protein, 22 aa, Mycobacterium avium
LDLCPRIRVNAIAPGSILTSAL

SEQ ID NO: 108128 - protein, 19 aa, Mycobacterium avium
LDLFLRIIVELFRRHWSST

SEQ ID NO: 108129 - protein, 21 aa, Mycobacterium avium
LDNGKWTWRYDAIRKFPDFDG

SEQ ID NO: 108130 - protein, 20 aa, Mycobacterium avium
LDVGCGWGGMVRYAARRGVR

SEQ ID NO: 108131 - protein, 17 aa, Mycobacterium avium
LEDWAKWGQARHDYFLR

SEQ ID NO: 108132 - protein, 18 aa, Mycobacterium avium
LEGDAKWVESVEQLMEAV

SEQ ID NO: 108133 - protein, 17 aa, Mycobacterium avium
LEHMPVAMAARTRFFDS

SEQ ID NO: 108134 - protein, 20 aa, Mycobacterium avium
LEPDLKWERFITAVRLLAER

SEQ ID NO: 108135 - protein, 18 aa, Mycobacterium avium
LEPPRFCAACGRRMVVQV

SEQ ID NO: 108136 - protein, 20 aa, Mycobacterium avium
LESGFTFPVLSDFWPHGAVS

SEQ ID NO: 108137 - protein, 20 aa, Mycobacterium avium
LEVIDLRSLVPLDFDTIATS

SEQ ID NO: 108138 - protein, 17 aa, Mycobacterium avium
LFDPRFQQLGLHPGGGA

SEQ ID NO: 108139 - protein, 23 aa, Mycobacterium avium
LFFKEKRYDLARVGRYKVNKKLG

SEQ ID NO: 108140 - protein, 23 aa, Mycobacterium avium
LFFRDARVLSRWELRVDGQVAEA

SEQ ID NO: 108141 - protein, 20 aa, Mycobacterium avium
LFLPAPLRWLVGATRFAPVR

SEQ ID NO: 108142 - protein, 18 aa, Mycobacterium avium
LGAYRWLRPSGRRSAKEI

SEQ ID NO: 108143 - protein, 22 aa, Mycobacterium avium
LGELRPLYRPGLFHMYHALTWG

SEQ ID NO: 108144 - protein, 23 aa, Mycobacterium avium
LGGFRIAVRRAKILAGLDEDADV

SEQ ID NO: 108145 - protein, 24 aa, Mycobacterium avium
LGHRLRAAIHFDDLHWERRYDRVA

SEQ ID NO: 108146 - protein, 18 aa, Mycobacterium avium
LGKGGGFFSFGIMHYYMT

SEQ ID NO: 108147 - protein, 19 aa, Mycobacterium avium
LGLRPDVRRVPLFGLGCAA

SEQ ID NO: 108148 - protein, 17 aa, Mycobacterium avium
LGMRPSWVLDLNNGGCA

SEQ ID NO: 108149 - protein, 19 aa, Mycobacterium avium
LGPRGRHVVLAKAFGGPAV

SEQ ID NO: 108150 - protein, 17 aa, Mycobacterium avium
LGREIHDPYPLYEALAQ

SEQ ID NO: 108151 - protein, 26 aa, Mycobacterium avium
LGRKLIEVPVGFKWFVDGLIGGTLGF

SEQ ID NO: 108152 - protein, 26 aa, Mycobacterium avium
LGRPLRIAHAWSFAFDAAWQPLVALL

SEQ ID NO: 108153 - protein, 17 aa, Mycobacterium avium
LGRSGGVLPVMSALENR

SEQ ID NO: 108154 - protein, 22 aa, Mycobacterium avium
LGSLRIGNRFVHTGKPTPAGYA

SEQ ID NO: 108155 - protein, 23 aa, Mycobacterium avium
LGVGWPKEFGGLGFGPIEQSIFV

SEQ ID NO: 108156 - protein, 17 aa, Mycobacterium avium
LGVLPGMGGSQRLTRAI

SEQ ID NO: 108157 - protein, 18 aa, Mycobacterium avium
LGYYEWREGLLRGLAAHH

SEQ ID NO: 108158 - protein, 18 aa, Mycobacterium avium
LHPLSAPMTLRWLTDRFE

SEQ ID NO: 108159 - protein, 17 aa, Mycobacterium avium
LHSPCLHTAGIFRGRTC

SEQ ID NO: 108160 - protein, 22 aa, Mycobacterium avium
LHSVKVIPSRGAWLEFDVDKRD

SEQ ID NO: 108161 - protein, 19 aa, Mycobacterium avium
LHTPLPLLAFTAWPEVRSQ

SEQ ID NO: 108162 - protein, 17 aa, Mycobacterium avium
LIEAMGLTVGWITAESS

SEQ ID NO: 108163 - protein, 24 aa, Mycobacterium avium
LIKSIGLRLGVPWYAYDTVTFSGE

SEQ ID NO: 108164 - protein, 17 aa, Mycobacterium avium
LKACIKAAADRVVFINT

SEQ ID NO: 108165 - protein, 17 aa, Mycobacterium avium
LKFYASVRMDVRRIETL

SEQ ID NO: 108166 - protein, 18 aa, Mycobacterium avium
LKPRKAFGPIRVGATGTT

SEQ ID NO: 108167 - protein, 18 aa, Mycobacterium avium
LLADLSFADYLMWVCRDD

SEQ ID NO: 108168 - protein, 18 aa, Mycobacterium avium
LLADLSFDAVVLLINGVP

SEQ ID NO: 108169 - protein, 18 aa, Mycobacterium avium
LLAYCAACTERLRLGVAV

SEQ ID NO: 108170 - protein, 17 aa, Mycobacterium avium
LLDGHRVTTHWAFADRL

SEQ ID NO: 108171 - protein, 19 aa, Mycobacterium avium
LLDRVSSKYALVIYAAKRA

SEQ ID NO: 108172 - protein, 18 aa, Mycobacterium avium
LLDWCRRNDVLFIADEVQ

SEQ ID NO: 108173 - protein, 19 aa, Mycobacterium avium
LLEPVGACRQCLVEVEGQR

SEQ ID NO: 108174 - protein, 19 aa, Mycobacterium avium
LLEYHWGPDWMVWDADRTA

SEQ ID NO: 108175 - protein, 19 aa, Mycobacterium avium
LLFDSGWLLPGNPPEFGGR

SEQ ID NO: 108176 - protein, 18 aa, Mycobacterium avium
LLGLECVIYMGAVDTERQ

SEQ ID NO: 108177 - protein, 17 aa, Mycobacterium avium
LLNGFKWFASNCAGEAF

SEQ ID NO: 108178 - protein, 20 aa, Mycobacterium avium
LLNLALEMGCVFSIDTDAHA

SEQ ID NO: 108179 - protein, 18 aa, Mycobacterium avium
LLSRARCLLFPIQWEEPF

SEQ ID NO: 108180 - protein, 18 aa, Mycobacterium avium
LLTTEQWTGGGSAAAAAA

SEQ ID NO: 108181 - protein, 18 aa, Mycobacterium avium
LMAAARLDLASVFLYAGS

SEQ ID NO: 108182 - protein, 17 aa, Mycobacterium avium
LMGAWKLAPALAAGNAV

SEQ ID NO: 108183 - protein, 17 aa, Mycobacterium avium
LMIDPGLGFAKTGQHNW

SEQ ID NO: 108184 - protein, 23 aa, Mycobacterium avium
LMLRAPFRLAREVLPHLPPGSAI

SEQ ID NO: 108185 - protein, 25 aa, Mycobacterium avium
LMPPQMLHMILPRKDYEIVEDSWNV

SEQ ID NO: 108186 - protein, 23 aa, Mycobacterium avium
LMRNRIDLLIGHGRFVDPHTIEV

SEQ ID NO: 108187 - protein, 21 aa, Mycobacterium avium
LMSVGDLIIGWLLQRQAAVAV

SEQ ID NO: 108188 - protein, 19 aa, Mycobacterium avium
LNELERIGGRYGLQTMCEG

SEQ ID NO: 108189 - protein, 24 aa, Mycobacterium avium
LNFREVLNVLGLYPGDPGPLGGDF

SEQ ID NO: 108190 - protein, 25 aa, Mycobacterium avium
LNLELPFPCVWVTGWSREGGRAAAL

SEQ ID NO: 108191 - protein, 26 aa, Mycobacterium avium
LNQLWMCGLPGYFPGDLIDFEFSGDT

SEQ ID NO: 108192 - protein, 19 aa, Mycobacterium avium
LNSKTRRPSVCNAAETLLV

SEQ ID NO: 108193 - protein, 21 aa, Mycobacterium avium
LPADWEPLGAIAIGYAAEPAG

SEQ ID NO: 108194 - protein, 17 aa, Mycobacterium avium
LPARYGQAVAESEVHPL

SEQ ID NO: 108195 - protein, 21 aa, Mycobacterium avium
LPDERICLCGNTFGPLFGHIP

SEQ ID NO: 108196 - protein, 17 aa, Mycobacterium avium
LPDWLSADVAILGEPTG

SEQ ID NO: 108197 - protein, 20 aa, Mycobacterium avium
LPEGSGFEFVDKVVGGAVPR

SEQ ID NO: 108198 - protein, 18 aa, Mycobacterium avium
LPGLGSWRRPQAELDESS

SEQ ID NO: 108199 - protein, 17 aa, Mycobacterium avium
LPIVEVIAGGDISEGAY

SEQ ID NO: 108200 - protein, 19 aa, Mycobacterium avium
LPPDIAWPYLKRVGEVVLP

SEQ ID NO: 108201 - protein, 17 aa, Mycobacterium avium
LPQVFRWARAVDASQPL

SEQ ID NO: 108202 - protein, 19 aa, Mycobacterium avium
LPTLYGGDFVSTWRVLEEF

SEQ ID NO: 108203 - protein, 17 aa, Mycobacterium avium
LPTPALMHYLSEVDYVD

SEQ ID NO: 108204 - protein, 22 aa, Mycobacterium avium
LPTWQWEGLIGKSTRLVAVASA

SEQ ID NO: 108205 - protein, 17 aa, Mycobacterium avium
LQAGSVWVNRHSDIEPQ

SEQ ID NO: 108206 - protein, 20 aa, Mycobacterium avium
LQARLRLAIGRRRGGLDGTL

SEQ ID NO: 108207 - protein, 19 aa, Mycobacterium avium
LQREVQGFLRLAQPPAATS

SEQ ID NO: 108208 - protein, 19 aa, Mycobacterium avium
LQTGVRWKDLGLVVVDEEQ

SEQ ID NO: 108209 - protein, 18 aa, Mycobacterium avium
LQVAEAFSRYGAHLPKIN

SEQ ID NO: 108210 - protein, 18 aa, Mycobacterium avium
LRAAAAWFEALKLERRRQ

SEQ ID NO: 108211 - protein, 23 aa, Mycobacterium avium
LRALKRLKVVAAFQQSGNSPMGM

SEQ ID NO: 108212 - protein, 19 aa, Mycobacterium avium
LRAPLTWEVDEPCPVPRPE

SEQ ID NO: 108213 - protein, 17 aa, Mycobacterium avium
LREPAFAILDSHRIDYE

SEQ ID NO: 108214 - protein, 20 aa, Mycobacterium avium
LRFGELCLEAGLPPGLVNVL

SEQ ID NO: 108215 - protein, 18 aa, Mycobacterium avium
LRGANLWDEVKDRLDRPG

SEQ ID NO: 108216 - protein, 25 aa, Mycobacterium avium
LRGMPVGALGRRGAAAGYVNKYGFR

SEQ ID NO: 108217 - protein, 24 aa, Mycobacterium avium
LRIAPELFLKRCVVGGFDKVFELN

SEQ ID NO: 108218 - protein, 23 aa, Mycobacterium avium
LRIGWFEGGISWVPWALQDAEHL

SEQ ID NO: 108219 - protein, 23 aa, Mycobacterium avium
LRLGEYDVLVGINLLREGLDLPE

SEQ ID NO: 108220 - protein, 20 aa, Mycobacterium avium
LRLLVIALRRNEIMNSTWVD

SEQ ID NO: 108221 - protein, 25 aa, Mycobacterium avium
LRLPQRIPSAIAMELALTGDNLSAE

SEQ ID NO: 108222 - protein, 17 aa, Mycobacterium avium
LRLQFWVCGVFEVQNGR

SEQ ID NO: 108223 - protein, 20 aa, Mycobacterium avium
LRLVAPGGIFLEMGKTDIRD

SEQ ID NO: 108224 - protein, 18 aa, Mycobacterium avium
LRMADLQARVDLLQHGLN

SEQ ID NO: 108225 - protein, 18 aa, Mycobacterium avium
LRPGAIIRDLDLLRPIYA

SEQ ID NO: 108226 - protein, 20 aa, Mycobacterium avium
LRPGDLIGVAATGAYCYSLS

SEQ ID NO: 108227 - protein, 22 aa, Mycobacterium avium
LRPGGRLGLVWNTRDERLGWVR

SEQ ID NO: 108228 - protein, 20 aa, Mycobacterium avium
LRQRIGMVFQHFNLFPHRTV

SEQ ID NO: 108229 - protein, 18 aa, Mycobacterium avium
LRRACAAGALATLVPGAG

SEQ ID NO: 108230 - protein, 18 aa, Mycobacterium avium
LRRRGPVHVVDWRNVQGL

SEQ ID NO: 108231 - protein, 17 aa, Mycobacterium avium
LRRSGRTLTEFPIIAQA

SEQ ID NO: 108232 - protein, 21 aa, Mycobacterium avium
LRTAPPFAVHRFWLDRPVSPR

SEQ ID NO: 108233 - protein, 20 aa, Mycobacterium avium
LRTLCLDAKLYAGGMASTVE

SEQ ID NO: 108234 - protein, 19 aa, Mycobacterium avium
LRVGAAIGINGDVGAKARS

SEQ ID NO: 108235 - protein, 20 aa, Mycobacterium avium
LRYLRDFRFGGDIDGYAEGE

SEQ ID NO: 108236 - protein, 17 aa, Mycobacterium avium
LRYRPGDVLMFGPEPTG

SEQ ID NO: 108237 - protein, 20 aa, Mycobacterium avium
LRYTMPLGEIIFDFFDSLKS

SEQ ID NO: 108238 - protein, 17 aa, Mycobacterium avium
LSACADLLMTTSPNVLI

SEQ ID NO: 108239 - protein, 17 aa, Mycobacterium avium
LSADFRPADALQRDRYA

SEQ ID NO: 108240 - protein, 24 aa, Mycobacterium avium
LSAEAGAILGRWCTALTRAFVNDG

SEQ ID NO: 108241 - protein, 22 aa, Mycobacterium avium
LSDLELYLFFSLLFSAGAETTR

SEQ ID NO: 108242 - protein, 18 aa, Mycobacterium avium
LSELLAWPTDHLTEAADH

SEQ ID NO: 108243 - protein, 19 aa, Mycobacterium avium
LSFRAGIGVKVIAALERIG

SEQ ID NO: 108244 - protein, 21 aa, Mycobacterium avium
LSGQVGWLARDRWAVPLVHTA

SEQ ID NO: 108245 - protein, 23 aa, Mycobacterium avium
LSKLARPTSTWTYMVNDNPLSDD

SEQ ID NO: 108246 - protein, 19 aa, Mycobacterium avium
LSKPFTFKRVEALRPAVQK

SEQ ID NO: 108247 - protein, 17 aa, Mycobacterium avium
LSKRGGGVALLLTNIRE

SEQ ID NO: 108248 - protein, 24 aa, Mycobacterium avium
LTCAIRPSGIWGRGDQTMFRKLFE

SEQ ID NO: 108249 - protein, 19 aa, Mycobacterium avium
LTGNFTFRRCESMRPQIQD

SEQ ID NO: 108250 - protein, 24 aa, Mycobacterium avium
LTGRPAISVPLHWTDDGLPLGVQF

SEQ ID NO: 108251 - protein, 17 aa, Mycobacterium avium
LTLRLLVIALRRNEIMN

SEQ ID NO: 108252 - protein, 24 aa, Mycobacterium avium
LTTFWAGPCCTHFMAMLGAEVIHV

SEQ ID NO: 108253 - protein, 20 aa, Mycobacterium avium
LVAPDLVRRLCWDWEPTPDP

SEQ ID NO: 108254 - protein, 23 aa, Mycobacterium avium
LVDDLRINWVWNPPWGPDKITDE

SEQ ID NO: 108255 - protein, 18 aa, Mycobacterium avium
LVDLRVARLLAYRAVSLQ

SEQ ID NO: 108256 - protein, 17 aa, Mycobacterium avium
LVRPSLGIAEWILPSVI

SEQ ID NO: 108257 - protein, 19 aa, Mycobacterium avium
LVVSLAKRYTGRGMAFLDL

SEQ ID NO: 108258 - protein, 20 aa, Mycobacterium avium
LWAVWRFGTDPAFTQISMEF

SEQ ID NO: 108259 - protein, 20 aa, Mycobacterium avium
LWLRFRQAALYAYAAPLITA

SEQ ID NO: 108260 - protein, 23 aa, Mycobacterium avium
LWLRRRVGMCFQRPTPFPGTVAD

SEQ ID NO: 108261 - protein, 18 aa, Mycobacterium avium
LYALPPRGRFVLTDTDRQ

SEQ ID NO: 108262 - protein, 18 aa, Mycobacterium avium
LYARFWHKVLYDLGHVSS

SEQ ID NO: 108263 - protein, 18 aa, Mycobacterium avium
LYDRVGFAAAGKFNEFDN

SEQ ID NO: 108264 - protein, 18 aa, Mycobacterium avium
LYIALGISGAIQHRAGMQ

SEQ ID NO: 108265 - protein, 21 aa, Mycobacterium avium
LYPRVEVEVGFILNADLPGAG

SEQ ID NO: 108266 - protein, 24 aa, Mycobacterium avium
MAANCPRTKMVLGGYSQGAAVMGF

SEQ ID NO: 108267 - protein, 20 aa, Mycobacterium avium
MADCHPILFLRMMDRVKAGA

SEQ ID NO: 108268 - protein, 21 aa, Mycobacterium avium
MAEELWLRLGHTTSLAHGPFP

SEQ ID NO: 108269 - protein, 18 aa, Mycobacterium avium
MALPPCHAFFQFYVADGR

SEQ ID NO: 108270 - protein, 17 aa, Mycobacterium avium
MAQLGFRTLNEAVGQVK

SEQ ID NO: 108271 - protein, 18 aa, Mycobacterium avium
MASGEIRATMALTEPGGG

SEQ ID NO: 108272 - protein, 18 aa, Mycobacterium avium
MAVICLIGAMLVEDGHSD

SEQ ID NO: 108273 - protein, 17 aa, Mycobacterium avium
MDAWRDGDQFVVEFDLP

SEQ ID NO: 108274 - protein, 17 aa, Mycobacterium avium
MELGMDWDRIEELKNAG

SEQ ID NO: 108275 - protein, 19 aa, Mycobacterium avium
MFLELSWEALERAGIDPVK

SEQ ID NO: 108276 - protein, 17 aa, Mycobacterium avium
MGGITIAAWSNRYRHKV

SEQ ID NO: 108277 - protein, 23 aa, Mycobacterium avium
MGLARLWQSWGFEPDVVLGHSVG

SEQ ID NO: 108278 - protein, 17 aa, Mycobacterium avium
MGVAGLEEFLERKTFAV

SEQ ID NO: 108279 - protein, 23 aa, Mycobacterium avium
MIDCLRAGGKVILFGNGGSAQDA

SEQ ID NO: 108280 - protein, 25 aa, Mycobacterium avium
MIDVIRFWLGLGIDGFRLDAVPYLF

SEQ ID NO: 108281 - protein, 20 aa, Mycobacterium avium
MKPDVCWQLPIRRSQEWVTR

SEQ ID NO: 108282 - protein, 18 aa, Mycobacterium avium
MLLPRSRYDEGVAILKGI

SEQ ID NO: 108283 - protein, 25 aa, Mycobacterium avium
MLRELRPDLTIGFFLHIPFPPVELF

SEQ ID NO: 108284 - protein, 19 aa, Mycobacterium avium
MLTAAGRRSLLCGNIGSPV

SEQ ID NO: 108285 - protein, 18 aa, Mycobacterium avium
MNLSRRWAGDGIRVNAIA

SEQ ID NO: 108286 - protein, 19 aa, Mycobacterium avium
MPEMPLIRFLDGYETIAEM

SEQ ID NO: 108287 - protein, 17 aa, Mycobacterium avium
MPGGFDPNAGWFNYFST

SEQ ID NO: 108288 - protein, 20 aa, Mycobacterium avium
MPPDPAAMVVRWVADILSEH

SEQ ID NO: 108289 - protein, 19 aa, Mycobacterium avium
MPYKGGFGPFAPEIYRAPL

SEQ ID NO: 108290 - protein, 21 aa, Mycobacterium avium
MRACGICGSDAFYISIGGVPP

SEQ ID NO: 108291 - protein, 18 aa, Mycobacterium avium
MRGGKFLNNWRMAELHAK

SEQ ID NO: 108292 - protein, 24 aa, Mycobacterium avium
MRKFYEAFKPYGLRETAIKPSYGL

SEQ ID NO: 108293 - protein, 17 aa, Mycobacterium avium
MRSGVAFSENYDDPAAQ

SEQ ID NO: 108294 - protein, 18 aa, Mycobacterium avium
MRSLLRMQHRVLAGTRRL

SEQ ID NO: 108295 - protein, 26 aa, Mycobacterium avium
MSISVAFHEPVRWDGWLLYSHESTQV

SEQ ID NO: 108296 - protein, 21 aa, Mycobacterium avium
MSMARLLYWGCDVWLNNPLRP

SEQ ID NO: 108297 - protein, 19 aa, Mycobacterium avium
MSYHLPRIVGTGVAADWML

SEQ ID NO: 108298 - protein, 23 aa, Mycobacterium avium
MTGWQRLHFRFGIPAPLLEPLAV

SEQ ID NO: 108299 - protein, 24 aa, Mycobacterium avium
MVARGCPFSGLLYAGLAITSNGPA

SEQ ID NO: 108300 - protein, 18 aa, Mycobacterium avium
MVRKRPALQIHLLKSNLR

SEQ ID NO: 108301 - protein, 18 aa, Mycobacterium avium
MWERRLDTPIARASYEIH

SEQ ID NO: 108302 - protein, 18 aa, Mycobacterium avium
NARGVPFIFVRTDSAGNI

SEQ ID NO: 108303 - protein, 20 aa, Mycobacterium avium
NAVGGWRGAPRPVLARELLP

SEQ ID NO: 108304 - protein, 17 aa, Mycobacterium avium
NAVIFCGHFPDGAEKFT

SEQ ID NO: 108305 - protein, 17 aa, Mycobacterium avium
NCHYCTFVTVPGKLRAR

SEQ ID NO: 108306 - protein, 17 aa, Mycobacterium avium
NDARFLFHPAMKELTLD

SEQ ID NO: 108307 - protein, 17 aa, Mycobacterium avium
NDGALGWVGTSPVGVFA

SEQ ID NO: 108308 - protein, 24 aa, Mycobacterium avium
NDVLKDAWAYRGWVMSDWGATPGW

SEQ ID NO: 108309 - protein, 24 aa, Mycobacterium avium
NEDNRWTVQLAWKVGRSDNVAHFC

SEQ ID NO: 108310 - protein, 18 aa, Mycobacterium avium
NELGHPWTVLRATADTDY

SEQ ID NO: 108311 - protein, 22 aa, Mycobacterium avium
NFPDLRLTAAPQRRSLINLHGY

SEQ ID NO: 108312 - protein, 20 aa, Mycobacterium avium
NFTGRSWPLADVRLLAPILA

SEQ ID NO: 108313 - protein, 26 aa, Mycobacterium avium
NFVFGEMWLRPGLGMKERRLITVACV

SEQ ID NO: 108314 - protein, 17 aa, Mycobacterium avium
NGARALTGWVIGAGGAT

SEQ ID NO: 108315 - protein, 27 aa, Mycobacterium avium
NGGKRLRPAFAYWGWRAVATEAPDDQA

SEQ ID NO: 108316 - protein, 18 aa, Mycobacterium avium
NHAAGWVRMDFIVPSRGL

SEQ ID NO: 108317 - protein, 20 aa, Mycobacterium avium
NIAPWLRAAHRYGAKVKWAE

SEQ ID NO: 108318 - protein, 17 aa, Mycobacterium avium
NITAYWKGYTEYHHEGL

SEQ ID NO: 108319 - protein, 17 aa, Mycobacterium avium
NKRVCVRIVARRARSWD

SEQ ID NO: 108320 - protein, 23 aa, Mycobacterium avium
NLAREFMELFALGHGNGYTESDV

SEQ ID NO: 108321 - protein, 18 aa, Mycobacterium avium
NLGWKLALVVGGASPPAL

SEQ ID NO: 108322 - protein, 20 aa, Mycobacterium avium
NLNMAIPWTAAERGFIDAVI

SEQ ID NO: 108323 - protein, 18 aa, Mycobacterium avium
NLVEYGFRLPSACDNRPL

SEQ ID NO: 108324 - protein, 21 aa, Mycobacterium avium
NPCFPEYRFTGLDAEKATGRV

SEQ ID NO: 108325 - protein, 23 aa, Mycobacterium avium
NPRTRSGIMALELLDTTPDWQQF

SEQ ID NO: 108326 - protein, 25 aa, Mycobacterium avium
NREVRWRPEHFWKSGTVIDVAVNTY

SEQ ID NO: 108327 - protein, 23 aa, Mycobacterium avium
NRKVLPGYILVRMDLTDDSWAAV

SEQ ID NO: 108328 - protein, 21 aa, Mycobacterium avium
NTWECAAHVYLRRALTSTELW

SEQ ID NO: 108329 - protein, 17 aa, Mycobacterium avium
NVDEWRATFAVNVFGPV

SEQ ID NO: 108330 - protein, 19 aa, Mycobacterium avium
NWPWRRWALSWTANTYARL

SEQ ID NO: 108331 - protein, 17 aa, Mycobacterium avium
PAAEIKRVIRGVSPEEA

SEQ ID NO: 108332 - protein, 17 aa, Mycobacterium avium
PAGFRFYHTHVVPRADL

SEQ ID NO: 108333 - protein, 17 aa, Mycobacterium avium
PAHGVVMVSGYDEALAV

SEQ ID NO: 108334 - protein, 19 aa, Mycobacterium avium
PALCRAVGRPEWRDDPRFA

SEQ ID NO: 108335 - protein, 23 aa, Mycobacterium avium
PALPATRIEFMLGDAAPVVAVST

SEQ ID NO: 108336 - protein, 18 aa, Mycobacterium avium
PALRRARGQVVFINSGAG

SEQ ID NO: 108337 - protein, 19 aa, Mycobacterium avium
PALVGMPRWYAENGQYLTT

SEQ ID NO: 108338 - protein, 18 aa, Mycobacterium avium
PAPAPYRGFVTWLAARDV

SEQ ID NO: 108339 - protein, 26 aa, Mycobacterium avium
PAPVPGFRGPRSFALPEFDPFWERVV

SEQ ID NO: 108340 - protein, 26 aa, Mycobacterium avium
PAPVPGYRGSRSFGFEEFDPFWQACV

SEQ ID NO: 108341 - protein, 21 aa, Mycobacterium avium
PASARGSLRLSLGHTSIDADV

SEQ ID NO: 108342 - protein, 20 aa, Mycobacterium avium
PASYWRRWSICESVVLKVEL

SEQ ID NO: 108343 - protein, 18 aa, Mycobacterium avium
PDEIVRWATPVTAFQRTA

SEQ ID NO: 108344 - protein, 18 aa, Mycobacterium avium
PDERGMRTVMCILNGQLR

SEQ ID NO: 108345 - protein, 18 aa, Mycobacterium avium
PDGKLAHAAVRINGFMVM

SEQ ID NO: 108346 - protein, 17 aa, Mycobacterium avium
PDHPWAREHRNWFTELP

SEQ ID NO: 108347 - protein, 22 aa, Mycobacterium avium
PDNEFRVVLARRGQHWVSAVRV

SEQ ID NO: 108348 - protein, 19 aa, Mycobacterium avium
PDVARWVRRFAGHAVSPEK

SEQ ID NO: 108349 - protein, 18 aa, Mycobacterium avium
PEAFKWIQRAAMDRRTTM

SEQ ID NO: 108350 - protein, 23 aa, Mycobacterium avium
PEEPRGVPVFAWKGETLEEYWWA

SEQ ID NO: 108351 - protein, 20 aa, Mycobacterium avium
PEFIGRLPVVASVTNLDRES

SEQ ID NO: 108352 - protein, 25 aa, Mycobacterium avium
PEIWDEFTQRFGIARVCEFYASSEG

SEQ ID NO: 108353 - protein, 18 aa, Mycobacterium avium
PELLSRAAALNWDTTAPA

SEQ ID NO: 108354 - protein, 18 aa, Mycobacterium avium
PELRPMVQLDGGRFATSD

SEQ ID NO: 108355 - protein, 20 aa, Mycobacterium avium
PENKRALADWTWGRQSIDLL

SEQ ID NO: 108356 - protein, 18 aa, Mycobacterium avium
PENPRFLMCTPLSHAGAA

SEQ ID NO: 108357 - protein, 22 aa, Mycobacterium avium
PEQKQRWAVPILRAEMTASLGM

SEQ ID NO: 108358 - protein, 20 aa, Mycobacterium avium
PEQLKRLVAQISEQPESVQH

SEQ ID NO: 108359 - protein, 23 aa, Mycobacterium avium
PERLRSGWLNGIKHWQVDYHTNG

SEQ ID NO: 108360 - protein, 18 aa, Mycobacterium avium
PETLHAIMWLMSDRALPR

SEQ ID NO: 108361 - protein, 20 aa, Mycobacterium avium
PEVFDLRPGAIIRDLDLLRP

SEQ ID NO: 108362 - protein, 20 aa, Mycobacterium avium
PEVVEALKFHLRDLAVTFRF

SEQ ID NO: 108363 - protein, 18 aa, Mycobacterium avium
PEYHPGYFGAFVRDPDGN

SEQ ID NO: 108364 - protein, 18 aa, Mycobacterium avium
PFAAFGISGEFGMGDLGQ

SEQ ID NO: 108365 - protein, 19 aa, Mycobacterium avium
PFTHMAFRFNECSTRSVAA

SEQ ID NO: 108366 - protein, 18 aa, Mycobacterium avium
PFWLRTARTLSFDPLTDV

SEQ ID NO: 108367 - protein, 23 aa, Mycobacterium avium
PGAMARLGVWPGVGPQLDLHQPT

SEQ ID NO: 108368 - protein, 19 aa, Mycobacterium avium
PGCFVALLFSRSAEAIVAM

SEQ ID NO: 108369 - protein, 18 aa, Mycobacterium avium
PGDLLAVACTGAYHHSMA

SEQ ID NO: 108370 - protein, 18 aa, Mycobacterium avium
PGDLRPGDLIGVAATGAY

SEQ ID NO: 108371 - protein, 19 aa, Mycobacterium avium
PGGIYAPMIHPWSSGRDLY

SEQ ID NO: 108372 - protein, 22 aa, Mycobacterium avium
PGGPFLSFGQAYAWGQNGQGAA

SEQ ID NO: 108373 - protein, 20 aa, Mycobacterium avium
PGHRLSETWHPLGVVGVITA

SEQ ID NO: 108374 - protein, 19 aa, Mycobacterium avium
PGKPCLRLLGFERVELGPG

SEQ ID NO: 108375 - protein, 17 aa, Mycobacterium avium
PGLPNLFSISGPGSPSV

SEQ ID NO: 108376 - protein, 19 aa, Mycobacterium avium
PGREPITGVSFAFVSNSSP

SEQ ID NO: 108377 - protein, 20 aa, Mycobacterium avium
PGRLSSRFWRLLGASTEKNR

SEQ ID NO: 108378 - protein, 18 aa, Mycobacterium avium
PGTLEKWNLGYDVLCERN

SEQ ID NO: 108379 - protein, 25 aa, Mycobacterium avium
PGVLARVAALFSRRGFNIESLAVGA

SEQ ID NO: 108380 - protein, 19 aa, Mycobacterium avium
PHRCLPMLIANQSGWEVRN

SEQ ID NO: 108381 - protein, 19 aa, Mycobacterium avium
PHVGGGWIGYLSYPDGGAD

SEQ ID NO: 108382 - protein, 25 aa, Mycobacterium avium
PIAKELPMEYALELNRLIELQMEGA

SEQ ID NO: 108383 - protein, 18 aa, Mycobacterium avium
PKDLPAFCSTILAQFAGA

SEQ ID NO: 108384 - protein, 18 aa, Mycobacterium avium
PKVKCYLEIRCAPSDDLA

SEQ ID NO: 108385 - protein, 18 aa, Mycobacterium avium
PLLDLGWLLATWRQPDGS

SEQ ID NO: 108386 - protein, 22 aa, Mycobacterium avium
PLLPEVAWSWLVEALESRMEHV

SEQ ID NO: 108387 - protein, 18 aa, Mycobacterium avium
PLPDRPATTFADGRLSGT

SEQ ID NO: 108388 - protein, 21 aa, Mycobacterium avium
PLPQTRFVLRKALAAHLPVIL

SEQ ID NO: 108389 - protein, 17 aa, Mycobacterium avium
PLVMPERDWDRWLDPDA

SEQ ID NO: 108390 - protein, 23 aa, Mycobacterium avium
PMDVLWFRLKWRPGDPRELFGVF

SEQ ID NO: 108391 - protein, 23 aa, Mycobacterium avium
PNRAWRLYRRLGFTDIIRRYHFA

SEQ ID NO: 108392 - protein, 21 aa, Mycobacterium avium
PPDVIRRLGALGLLVMVTVTS

SEQ ID NO: 108393 - protein, 22 aa, Mycobacterium avium
PPEEKLDWARRVLAAARSERGV

SEQ ID NO: 108394 - protein, 18 aa, Mycobacterium avium
PPEVPYYSATLFDPREQP

SEQ ID NO: 108395 - protein, 19 aa, Mycobacterium avium
PPLRLLLGRDVLKAMRDKI

SEQ ID NO: 108396 - protein, 19 aa, Mycobacterium avium
PPPSEGWRLLLYKLSGGLI

SEQ ID NO: 108397 - protein, 23 aa, Mycobacterium avium
PPPWHLYRFVLRAAVGVALTEPH

SEQ ID NO: 108398 - protein, 25 aa, Mycobacterium avium
PPQVFGALFSHEWFVDPALPTGTVR

SEQ ID NO: 108399 - protein, 19 aa, Mycobacterium avium
PPVRFALKGRHPFAVYRWV

SEQ ID NO: 108400 - protein, 23 aa, Mycobacterium avium
PQRGRISTWPLPEAFNGITVNGV

SEQ ID NO: 108401 - protein, 23 aa, Mycobacterium avium
PRAEVLRPGLLVLPVRGAARYFG

SEQ ID NO: 108402 - protein, 20 aa, Mycobacterium avium
PRAGKTVLFLGRYDEPRKGM

SEQ ID NO: 108403 - protein, 18 aa, Mycobacterium avium
PRELAGWLAAALAETDGI

SEQ ID NO: 108404 - protein, 22 aa, Mycobacterium avium
PRETWLRLLLLRAGFPRPRTQL

SEQ ID NO: 108405 - protein, 19 aa, Mycobacterium avium
PRFLMCTPLSHAGAAFFVP

SEQ ID NO: 108406 - protein, 18 aa, Mycobacterium avium
PRGIPVIVLAGQVDLDTA

SEQ ID NO: 108407 - protein, 24 aa, Mycobacterium avium
PRKYWVLKGFHGFRLKELFDTYPD

SEQ ID NO: 108408 - protein, 18 aa, Mycobacterium avium
PRLREFALREGLADAALR

SEQ ID NO: 108409 - protein, 22 aa, Mycobacterium avium
PRPGFWPNLVELGWLGLHIDEE

SEQ ID NO: 108410 - protein, 19 aa, Mycobacterium avium
PRPGGMPPWDSTPVTGIPR

SEQ ID NO: 108411 - protein, 20 aa, Mycobacterium avium
PRPVTFSALTGWEAPDPAWW

SEQ ID NO: 108412 - protein, 17 aa, Mycobacterium avium
PRRAGVSSFGFTGTNAH

SEQ ID NO: 108413 - protein, 21 aa, Mycobacterium avium
PRWLPGPRELRAWTLAAGNPE

SEQ ID NO: 108414 - protein, 24 aa, Mycobacterium avium
PSERPRIRLAYRLTPDRILGEQRV

SEQ ID NO: 108415 - protein, 19 aa, Mycobacterium avium
PSGGLACFGEAIPAQAIAQ

SEQ ID NO: 108416 - protein, 20 aa, Mycobacterium avium
PSIRWSRWPLQRMALSRYAD

SEQ ID NO: 108417 - protein, 17 aa, Mycobacterium avium
PSKAELVLAAFIEGVRQ

SEQ ID NO: 108418 - protein, 18 aa, Mycobacterium avium
PSSGVAFVLGERLGRVDV

SEQ ID NO: 108419 - protein, 18 aa, Mycobacterium avium
PSVREYSSLYGLSDRRQA

SEQ ID NO: 108420 - protein, 20 aa, Mycobacterium avium
PSYTRPPSWRGLDVPEVLLS

SEQ ID NO: 108421 - protein, 18 aa, Mycobacterium avium
PTAPRPGGMPPWDSTPVT

SEQ ID NO: 108422 - protein, 21 aa, Mycobacterium avium
PTARLHQIWSLLLPGIVSQAS

SEQ ID NO: 108423 - protein, 20 aa, Mycobacterium avium
PTGARLAGKHGIGLLSIGAT

SEQ ID NO: 108424 - protein, 20 aa, Mycobacterium avium
PTLYCISEPIPPGSYVGVSG

SEQ ID NO: 108425 - protein, 19 aa, Mycobacterium avium
PTTCPECGTPLAPAKEGDA

SEQ ID NO: 108426 - protein, 20 aa, Mycobacterium avium
PVEGAFYWLNNREVRWRPEH

SEQ ID NO: 108427 - protein, 22 aa, Mycobacterium avium
PVFRPPLDMARLFGQPRLGACE

SEQ ID NO: 108428 - protein, 18 aa, Mycobacterium avium
PVHVVDWRNVQGLTPSAL

SEQ ID NO: 108429 - protein, 19 aa, Mycobacterium avium
PVIFSTFLMWLLADLYTQL

SEQ ID NO: 108430 - protein, 23 aa, Mycobacterium avium
PVLTRSGAEWMPNFIDLLQRKLS

SEQ ID NO: 108431 - protein, 19 aa, Mycobacterium avium
PVTCSLGLPTRHLDLQFVA

SEQ ID NO: 108432 - protein, 23 aa, Mycobacterium avium
PWDRFQTLCGIQYYFDTEFQLLR

SEQ ID NO: 108433 - protein, 19 aa, Mycobacterium avium
PYFLWRAEHVYNRHSGWTL

SEQ ID NO: 108434 - protein, 19 aa, Mycobacterium avium
QADKYDVPRICFVNKMDKI

SEQ ID NO: 108435 - protein, 23 aa, Mycobacterium avium
QARTIRIPVHMVEVINKLGRIQR

SEQ ID NO: 108436 - protein, 26 aa, Mycobacterium avium
QCGLPKLMALELFKPFVMKRLVDLNH

SEQ ID NO: 108437 - protein, 18 aa, Mycobacterium avium
QEDFIGIHFFSPVDKMPL

SEQ ID NO: 108438 - protein, 24 aa, Mycobacterium avium
QEVRWCPGCGDYVILNTIRNFLPD

SEQ ID NO: 108439 - protein, 19 aa, Mycobacterium avium
QGFPLPWQLVVGALQAQAE

SEQ ID NO: 108440 - protein, 21 aa, Mycobacterium avium
QGGPCARTVLDTALLHQVIAG

SEQ ID NO: 108441 - protein, 22 aa, Mycobacterium avium
QGRVALDWLDRVDVIGQTQASS

SEQ ID NO: 108442 - protein, 24 aa, Mycobacterium avium
QIDFWRFNVAFARQILAQQPISGP

SEQ ID NO: 108443 - protein, 19 aa, Mycobacterium avium
QIRALVLGCAMDWLEDNKA

SEQ ID NO: 108444 - protein, 17 aa, Mycobacterium avium
QIRSIPTLMAFKKGKLL

SEQ ID NO: 108445 - protein, 22 aa, Mycobacterium avium
QIYEMYRLLAIAKYEERYVIPT

SEQ ID NO: 108446 - protein, 17 aa, Mycobacterium avium
QLCILRLTSPAEHPYGS

SEQ ID NO: 108447 - protein, 23 aa, Mycobacterium avium
QMGKDGWLTLNWPKEYGGQDRSP

SEQ ID NO: 108448 - protein, 19 aa, Mycobacterium avium
QNWWEWRALIGPLAADGYR

SEQ ID NO: 108449 - protein, 18 aa, Mycobacterium avium
QPHKRTGIDIAIALLTPL

SEQ ID NO: 108450 - protein, 19 aa, Mycobacterium avium
QPIEWRYTNDPAWVMRTKG

SEQ ID NO: 108451 - protein, 29 aa, Mycobacterium avium
QQRPSRLVVCLDLDWRPQFRVDLVPSYKA

SEQ ID NO: 108452 - protein, 23 aa, Mycobacterium avium
QRGEPVSCFLLRIEDNMESIGRS

SEQ ID NO: 108453 - protein, 25 aa, Mycobacterium avium
QRGWLAVRYNLPFRRRRPTGPPSGS

SEQ ID NO: 108454 - protein, 18 aa, Mycobacterium avium
QRLGRPVFGPTFEVDIDS

SEQ ID NO: 108455 - protein, 19 aa, Mycobacterium avium
QRLICYARDRGCTRPNCLE

SEQ ID NO: 108456 - protein, 18 aa, Mycobacterium avium
QRRRFWPKASGIAGIDGQ

SEQ ID NO: 108457 - protein, 17 aa, Mycobacterium avium
QRYWGEPFPIVYDSDGR

SEQ ID NO: 108458 - protein, 21 aa, Mycobacterium avium
QSIDGIGAMWARHVREGLSQL

SEQ ID NO: 108459 - protein, 17 aa, Mycobacterium avium
QTLLARWSAAAAILQQG

SEQ ID NO: 108460 - protein, 17 aa, Mycobacterium avium
QTMFRKLFESVIAGHVK

SEQ ID NO: 108461 - protein, 18 aa, Mycobacterium avium
QTTECWRQWINIGNFPDH

SEQ ID NO: 108462 - protein, 19 aa, Mycobacterium avium
QTVARWLVLYLRRPGGQTQ

SEQ ID NO: 108463 - protein, 17 aa, Mycobacterium avium
QTVLWARMLDRLAGSDP

SEQ ID NO: 108464 - protein, 17 aa, Mycobacterium avium
QVLKEIQSRLGFLLDVG

SEQ ID NO: 108465 - protein, 18 aa, Mycobacterium avium
RAAESIGGLGIVTDVRDS

SEQ ID NO: 108466 - protein, 22 aa, Mycobacterium avium
RAAGLKAANTWHATRAIQESRE

SEQ ID NO: 108467 - protein, 23 aa, Mycobacterium avium
RAARYGDRVFLRFGDQQLTYRDA

SEQ ID NO: 108468 - protein, 21 aa, Mycobacterium avium
RACGICGSDLHFAAHGAQVLQ

SEQ ID NO: 108469 - protein, 20 aa, Mycobacterium avium
RADEALPFSAIKVGANLVRT

SEQ ID NO: 108470 - protein, 21 aa, Mycobacterium avium
RAEALWKRWREGGVLFAKTFP

SEQ ID NO: 108471 - protein, 19 aa, Mycobacterium avium
RAEGVACYQLFISGLLDVT

SEQ ID NO: 108472 - protein, 17 aa, Mycobacterium avium
RAFEVLDKLTLIDISNN

SEQ ID NO: 108473 - protein, 18 aa, Mycobacterium avium
RAGKIPAVLYGHGTDPQH

SEQ ID NO: 108474 - protein, 19 aa, Mycobacterium avium
RAGQKLRIVKYLAYGWSSM

SEQ ID NO: 108475 - protein, 19 aa, Mycobacterium avium
RAGSEFAVLGRQVAIGGQL

SEQ ID NO: 108476 - protein, 22 aa, Mycobacterium avium
RAGTNLKAWLYRILTNTYINSY

SEQ ID NO: 108477 - protein, 19 aa, Mycobacterium avium
RAGVLRFVVLDGLAKPGRL

SEQ ID NO: 108478 - protein, 22 aa, Mycobacterium avium
RAHDQFRWFAGGWKVNADLPTP

SEQ ID NO: 108479 - protein, 17 aa, Mycobacterium avium
RAKEIGLVWKLVEPDRL

SEQ ID NO: 108480 - protein, 20 aa, Mycobacterium avium
RAKQVIGIIIGHNGLIEQGK

SEQ ID NO: 108481 - protein, 20 aa, Mycobacterium avium
RALIAVRGLHRFLAAEGLAE

SEQ ID NO: 108482 - protein, 19 aa, Mycobacterium avium
RAMGFCLFNNISIGARHAQ

SEQ ID NO: 108483 - protein, 20 aa, Mycobacterium avium
RAQLLELVWGYDFAADTNVV

SEQ ID NO: 108484 - protein, 18 aa, Mycobacterium avium
RATLWRRTEFRAVDAVSF

SEQ ID NO: 108485 - protein, 23 aa, Mycobacterium avium
RATRWRLSGLGLRVIAHDPYHPE

SEQ ID NO: 108486 - protein, 17 aa, Mycobacterium avium
RAYRLAWPAGTVVYEVD

SEQ ID NO: 108487 - protein, 19 aa, Mycobacterium avium
RAYRLDWPAGTTVYEIDQP

SEQ ID NO: 108488 - protein, 19 aa, Mycobacterium avium
RAYRLEWPPATTVFEVDLA

SEQ ID NO: 108489 - protein, 20 aa, Mycobacterium avium
RAYRLPWPAGTTVFEIDQPR

SEQ ID NO: 108490 - protein, 19 aa, Mycobacterium avium
RCIGCGLCVEACPTRALTM

SEQ ID NO: 108491 - protein, 20 aa, Mycobacterium avium
RCWDQSGGFGCMLQMGHEWA

SEQ ID NO: 108492 - protein, 25 aa, Mycobacterium avium
RDDPRLRFEMCLGVSGVHYPHETGR

SEQ ID NO: 108493 - protein, 19 aa, Mycobacterium avium
RDLEKCWSLLLTGILQPDR

SEQ ID NO: 108494 - protein, 22 aa, Mycobacterium avium
RDPDSVRVWSCFATVGDHLPEQ

SEQ ID NO: 108495 - protein, 24 aa, Mycobacterium avium
REGHCGACACTLRKGQVSMEVNDV

SEQ ID NO: 108496 - protein, 25 aa, Mycobacterium avium
RELELRWAGLRAHNRWLADFCSLSP

SEQ ID NO: 108497 - protein, 25 aa, Mycobacterium avium
RELLGGLPVRRLWGIGPVAEEKLHR

SEQ ID NO: 108498 - protein, 20 aa, Mycobacterium avium
RELRSSGAVFGLLDVDDEFF

SEQ ID NO: 108499 - protein, 21 aa, Mycobacterium avium
RETFRAIGVDLMFTHIKESLH

SEQ ID NO: 108500 - protein, 20 aa, Mycobacterium avium
RFIRDTTWVSVRWYQPGGPL

SEQ ID NO: 108501 - protein, 18 aa, Mycobacterium avium
RFRILPTLWEPGGDEITL

SEQ ID NO: 108502 - protein, 18 aa, Mycobacterium avium
RFTLGIGPSHHWIVNGQL

SEQ ID NO: 108503 - protein, 20 aa, Mycobacterium avium
RGDIKVALFGNHAPKTVANF

SEQ ID NO: 108504 - protein, 23 aa, Mycobacterium avium
RGERLCWWGGPWPVDERWWDDRG

SEQ ID NO: 108505 - protein, 20 aa, Mycobacterium avium
RGGCIIRAKFLNRIKDAFDE

SEQ ID NO: 108506 - protein, 25 aa, Mycobacterium avium
RGGPFALGCFAGWLFTEFPPHVLTG

SEQ ID NO: 108507 - protein, 17 aa, Mycobacterium avium
RGGSELFEFADVEVVDP

SEQ ID NO: 108508 - protein, 17 aa, Mycobacterium avium
RGMGSLGAMAGRGSGAG

SEQ ID NO: 108509 - protein, 24 aa, Mycobacterium avium
RGNLAFRWFLADGVPARPEVELVK

SEQ ID NO: 108510 - protein, 18 aa, Mycobacterium avium
RGPMLHRALQQFLADVYW

SEQ ID NO: 108511 - protein, 19 aa, Mycobacterium avium
RHDIGYRIAHHADLNAPPA

SEQ ID NO: 108512 - protein, 24 aa, Mycobacterium avium
RHLFSVLMDREWKHGVAAAVDVTL

SEQ ID NO: 108513 - protein, 22 aa, Mycobacterium avium
RHLPFYGRWYRFLVLWPGSDKG

SEQ ID NO: 108514 - protein, 23 aa, Mycobacterium avium
RHMLADSGVRAWLGPLPDEPDGL

SEQ ID NO: 108515 - protein, 20 aa, Mycobacterium avium
RHPHCAWTVIIDESYPEAQP

SEQ ID NO: 108516 - protein, 20 aa, Mycobacterium avium
RIAGRLGLRPDVRRVPLFGL

SEQ ID NO: 108517 - protein, 23 aa, Mycobacterium avium
RIFKRIRPAFTYRRSLDVLTAAR

SEQ ID NO: 108518 - protein, 19 aa, Mycobacterium avium
RIGVKVWIYKGDVVGGKRE

SEQ ID NO: 108519 - protein, 19 aa, Mycobacterium avium
RISFVPGPAGFRFYHTHVV

SEQ ID NO: 108520 - protein, 22 aa, Mycobacterium avium
RITELRSGALLDLDAAFTTQRA

SEQ ID NO: 108521 - protein, 19 aa, Mycobacterium avium
RIVSIEAFEHFGHENYDDF

SEQ ID NO: 108522 - protein, 18 aa, Mycobacterium avium
RIWEKLKAGIEFTVANEQ

SEQ ID NO: 108523 - protein, 17 aa, Mycobacterium avium
RKIAERRVFPAVDVNPS

SEQ ID NO: 108524 - protein, 20 aa, Mycobacterium avium
RKIGAKGWFGLNWPREYGGL

SEQ ID NO: 108525 - protein, 22 aa, Mycobacterium avium
RKPLVRRWYGFLAMQQEVARHI

SEQ ID NO: 108526 - protein, 17 aa, Mycobacterium avium
RKRFNSVGVVFKGSGFY

SEQ ID NO: 108527 - protein, 18 aa, Mycobacterium avium
RKSFVCGFHGWTYGLDGA

SEQ ID NO: 108528 - protein, 19 aa, Mycobacterium avium
RLAAMDVIASYCLTEPGAG

SEQ ID NO: 108529 - protein, 18 aa, Mycobacterium avium
RLALWARRLLGEAITQAQ

SEQ ID NO: 108530 - protein, 23 aa, Mycobacterium avium
RLARSLFLYALCNGWIGEGTTVV

SEQ ID NO: 108531 - protein, 19 aa, Mycobacterium avium
RLATRHLLRYPGLQRAAER

SEQ ID NO: 108532 - protein, 21 aa, Mycobacterium avium
RLEGSAVFRWAAFEMGKVGQQ

SEQ ID NO: 108533 - protein, 18 aa, Mycobacterium avium
RLETLLALIEGWVQVVVA

SEQ ID NO: 108534 - protein, 18 aa, Mycobacterium avium
RLGRFVGLVVIDRGHPRA

SEQ ID NO: 108535 - protein, 17 aa, Mycobacterium avium
RLLDVGCGWGGMVRYAA

SEQ ID NO: 108536 - protein, 17 aa, Mycobacterium avium
RLLGSVPDPSKFVGSLG

SEQ ID NO: 108537 - protein, 17 aa, Mycobacterium avium
RLLKLTLHPGVMTGYGH

SEQ ID NO: 108538 - protein, 20 aa, Mycobacterium avium
RLRLVPLRWALACLLIDIGS

SEQ ID NO: 108539 - protein, 26 aa, Mycobacterium avium
RLTRLTWRLLPFMWLDIDEAVKPTLY

SEQ ID NO: 108540 - protein, 19 aa, Mycobacterium avium
RLVAEHRWRVGVVAQSHAT

SEQ ID NO: 108541 - protein, 20 aa, Mycobacterium avium
RLYGWHRAMRIFDGPDEVHM

SEQ ID NO: 108542 - protein, 22 aa, Mycobacterium avium
RMAFRSASYWDIVAQLDASVSD

SEQ ID NO: 108543 - protein, 18 aa, Mycobacterium avium
RMGMRVEAVWKPREQWGF

SEQ ID NO: 108544 - protein, 24 aa, Mycobacterium avium
RMLTLPATFGLYVERAWPRHRRLS

SEQ ID NO: 108545 - protein, 17 aa, Mycobacterium avium
RNLLARCAERGVDPQAL

SEQ ID NO: 108546 - protein, 18 aa, Mycobacterium avium
RNLPGAEVRFVWHETGPI

SEQ ID NO: 108547 - protein, 18 aa, Mycobacterium avium
RNQECLLRLAALAERQEP

SEQ ID NO: 108548 - protein, 19 aa, Mycobacterium avium
RPDLDWDKGKTLHWVIEHL

SEQ ID NO: 108549 - protein, 20 aa, Mycobacterium avium
RPDRPGVRLLLRHGATDPVL

SEQ ID NO: 108550 - protein, 18 aa, Mycobacterium avium
RPFLRLEGSAVFRWAAFE

SEQ ID NO: 108551 - protein, 17 aa, Mycobacterium avium
RPGPGWGGSCLPKDTAA

SEQ ID NO: 108552 - protein, 19 aa, Mycobacterium avium
RPITELGMVKSIDTEPDGA

SEQ ID NO: 108553 - protein, 20 aa, Mycobacterium avium
RPKHYWSIYQKMIVKGRDFD

SEQ ID NO: 108554 - protein, 17 aa, Mycobacterium avium
RPKRYAAGFSRELDDEW

SEQ ID NO: 108555 - protein, 17 aa, Mycobacterium avium
RPLRPSFVDGLRNEIQV

SEQ ID NO: 108556 - protein, 19 aa, Mycobacterium avium
RPPSCRFWNMVVWNQFMAT

SEQ ID NO: 108557 - protein, 23 aa, Mycobacterium avium
RPQTVFMYLDYIHHWRHPIRDGL

SEQ ID NO: 108558 - protein, 19 aa, Mycobacterium avium
RPSEVARLGYLAGIVATML

SEQ ID NO: 108559 - protein, 26 aa, Mycobacterium avium
RPSYSLKEIRHWLQVFVQRFYSFSQF

SEQ ID NO: 108560 - protein, 19 aa, Mycobacterium avium
RPWRPDVVHAHDWLVAHPA

SEQ ID NO: 108561 - protein, 17 aa, Mycobacterium avium
RQAPELLPAALGGAQSG

SEQ ID NO: 108562 - protein, 22 aa, Mycobacterium avium
RQPIPPFKWWRGLRARQLLEDY

SEQ ID NO: 108563 - protein, 19 aa, Mycobacterium avium
RRAKLYYLRELRGKKAKIK

SEQ ID NO: 108564 - protein, 17 aa, Mycobacterium avium
RRAKRLIVFDVDSTLVQ

SEQ ID NO: 108565 - protein, 25 aa, Mycobacterium avium
RRFLERRLREAFGFEGTPIRINVRV

SEQ ID NO: 108566 - protein, 20 aa, Mycobacterium avium
RRGRPAAHLQFGRWHQDRGL

SEQ ID NO: 108567 - protein, 21 aa, Mycobacterium avium
RRIGAEFLRPGPGWGGSCLPK

SEQ ID NO: 108568 - protein, 19 aa, Mycobacterium avium
RRLGVPLAQELSAYLRGLE

SEQ ID NO: 108569 - protein, 21 aa, Mycobacterium avium
RRPDLPSGKGLVIAEGVLVVQ

SEQ ID NO: 108570 - protein, 17 aa, Mycobacterium avium
RRRGMAVIISDFLGPIN

SEQ ID NO: 108571 - protein, 18 aa, Mycobacterium avium
RRSLLCGNIGSPVLDVLD

SEQ ID NO: 108572 - protein, 23 aa, Mycobacterium avium
RRTPPAFYAWRAFARYSPVLPAG

SEQ ID NO: 108573 - protein, 19 aa, Mycobacterium avium
RRVFAHGFLLNRGEKMSKS

SEQ ID NO: 108574 - protein, 24 aa, Mycobacterium avium
RRVQLEIFTKFSIPINIARVIHRD

SEQ ID NO: 108575 - protein, 24 aa, Mycobacterium avium
RRWQRLLFDNGWLLPSQPPEYGGR

SEQ ID NO: 108576 - protein, 17 aa, Mycobacterium avium
RRYLDMFTFFASSALGM

SEQ ID NO: 108577 - protein, 17 aa, Mycobacterium avium
RSAAKAWAADHVTVNAL

SEQ ID NO: 108578 - protein, 19 aa, Mycobacterium avium
RSAAYAMRWVAKNIVAAGL

SEQ ID NO: 108579 - protein, 23 aa, Mycobacterium avium
RSADLRPARSFAVDYAGWVGLSQ

SEQ ID NO: 108580 - protein, 18 aa, Mycobacterium avium
RSEAKGVTFVEPVLVGEV

SEQ ID NO: 108581 - protein, 20 aa, Mycobacterium avium
RSGLPFGTCLDAVYLHPCGS

SEQ ID NO: 108582 - protein, 19 aa, Mycobacterium avium
RSREVWLMVSGAGKADAVA

SEQ ID NO: 108583 - protein, 24 aa, Mycobacterium avium
RSTTLALRWLVSFSRQRREKTMVE

SEQ ID NO: 108584 - protein, 20 aa, Mycobacterium avium
RSVVEIGDYVGAYFLDDRAA

SEQ ID NO: 108585 - protein, 22 aa, Mycobacterium avium
RSYNCLKREGVHTVGELVSRTE

SEQ ID NO: 108586 - protein, 17 aa, Mycobacterium avium
RTDRDWIADIVRFVESR

SEQ ID NO: 108587 - protein, 18 aa, Mycobacterium avium
RTLAVAVYNHYKRIQAGE

SEQ ID NO: 108588 - protein, 17 aa, Mycobacterium avium
RTLGLRRIRHSVIREDN

SEQ ID NO: 108589 - protein, 20 aa, Mycobacterium avium
RTPESWLLIDFEGEPGQPLE

SEQ ID NO: 108590 - protein, 18 aa, Mycobacterium avium
RTRIRPHFFPFTEPSAEV

SEQ ID NO: 108591 - protein, 18 aa, Mycobacterium avium
RTRISPISTMSFDEDAKI

SEQ ID NO: 108592 - protein, 22 aa, Mycobacterium avium
RTRKAGAVGLVMAEPLTYFFSD

SEQ ID NO: 108593 - protein, 19 aa, Mycobacterium avium
RVAALRRCVPMVAQIKDPT

SEQ ID NO: 108594 - protein, 18 aa, Mycobacterium avium
RVADGWIKAQAYRLQTFG

SEQ ID NO: 108595 - protein, 17 aa, Mycobacterium avium
RVARLLAYRAVSLQDDP

SEQ ID NO: 108596 - protein, 27 aa, Mycobacterium avium
RVEAVWKPREQWGFGIDNIEYFRPTGE

SEQ ID NO: 108597 - protein, 23 aa, Mycobacterium avium
RVEVAADLRADWSRPLEAAGFDV

SEQ ID NO: 108598 - protein, 23 aa, Mycobacterium avium
RVHGRLRLGPGWVSHVLQQLAVE

SEQ ID NO: 108599 - protein, 21 aa, Mycobacterium avium
RVRPGNCFAPFHWNDAFGEYL

SEQ ID NO: 108600 - protein, 20 aa, Mycobacterium avium
RVRTRLVELFDLFDPADPEV

SEQ ID NO: 108601 - protein, 17 aa, Mycobacterium avium
RVVKAHVPLSEMFGYVG

SEQ ID NO: 108602 - protein, 18 aa, Mycobacterium avium
RVVRHWIDHGVKFFRVDN

SEQ ID NO: 108603 - protein, 23 aa, Mycobacterium avium
RWAVEHPACWALLYGSPVPGYHA

SEQ ID NO: 108604 - protein, 21 aa, Mycobacterium avium
RWVTECLRASYPLGHGHGPVS

SEQ ID NO: 108605 - protein, 18 aa, Mycobacterium avium
RYDLAVQEIFVFTPKGDV

SEQ ID NO: 108606 - protein, 20 aa, Mycobacterium avium
RYFEAIPGVWARRSSEVAQT

SEQ ID NO: 108607 - protein, 18 aa, Mycobacterium avium
RYFWPRVVGDTGWQLLDS

SEQ ID NO: 108608 - protein, 17 aa, Mycobacterium avium
RYLDALMPMVWVACERE

SEQ ID NO: 108609 - protein, 25 aa, Mycobacterium avium
RYLEGPCLHAAWTRKVVVVDDLRTD

SEQ ID NO: 108610 - protein, 19 aa, Mycobacterium avium
RYRGLRAPHKIKMGVSGCA

SEQ ID NO: 108611 - protein, 25 aa, Mycobacterium avium
SAAHKARWGVCLARTDPDAPKHKGI

SEQ ID NO: 108612 - protein, 20 aa, Mycobacterium avium
SAALCKRLLWDSAINRYPPR

SEQ ID NO: 108613 - protein, 21 aa, Mycobacterium avium
SAEHGRSWSRWSFIGAGSPSA

SEQ ID NO: 108614 - protein, 17 aa, Mycobacterium avium
SAGVPVLRNGRRAFRMP

SEQ ID NO: 108615 - protein, 17 aa, Mycobacterium avium
SAPMLGVVRAADGWVGI

SEQ ID NO: 108616 - protein, 19 aa, Mycobacterium avium
SCADLHRRDRDAAWPVICA

SEQ ID NO: 108617 - protein, 17 aa, Mycobacterium avium
SCAGCATRDPVLCHSGF

SEQ ID NO: 108618 - protein, 20 aa, Mycobacterium avium
SCYMCGQQLYTQCETTQVRD

SEQ ID NO: 108619 - protein, 19 aa, Mycobacterium avium
SDEVLACFVLDPRLQRSSG

SEQ ID NO: 108620 - protein, 17 aa, Mycobacterium avium
SDEWTDWRWNRILIEGS

SEQ ID NO: 108621 - protein, 22 aa, Mycobacterium avium
SDIKNLLPMFAVFKPTVVVSVP

SEQ ID NO: 108622 - protein, 17 aa, Mycobacterium avium
SDRIPKWLLPVINDNLA

SEQ ID NO: 108623 - protein, 18 aa, Mycobacterium avium
SDWWIRRMVVVRQPFHEK

SEQ ID NO: 108624 - protein, 24 aa, Mycobacterium avium
SEGFPADMPFLIWGYGATRAGSPG

SEQ ID NO: 108625 - protein, 21 aa, Mycobacterium avium
SEPWARLGVNVDADFEPLYII

SEQ ID NO: 108626 - protein, 22 aa, Mycobacterium avium
SEWPWRPRHLVVTLGSHGARYV

SEQ ID NO: 108627 - protein, 22 aa, Mycobacterium avium
SEYVFRFAPLVGIYGGTLEVFR

SEQ ID NO: 108628 - protein, 24 aa, Mycobacterium avium
SFEEVFIRAGIPYKVVGGVRFYER

SEQ ID NO: 108629 - protein, 20 aa, Mycobacterium avium
SFGFKYGLPMDADMVMDVRF

SEQ ID NO: 108630 - protein, 18 aa, Mycobacterium avium
SFQLFPNFVILFWGQGWY

SEQ ID NO: 108631 - protein, 25 aa, Mycobacterium avium
SFSRYELLRLLAFSRTGALPITKAS

SEQ ID NO: 108632 - protein, 17 aa, Mycobacterium avium
SGEPVVFIAGHGGAGRT

SEQ ID NO: 108633 - protein, 23 aa, Mycobacterium avium
SGEQRLSGFLLWQSAYSEMWFTE

SEQ ID NO: 108634 - protein, 19 aa, Mycobacterium avium
SGGLLAWLGLAPNTNGPGQ

SEQ ID NO: 108635 - protein, 23 aa, Mycobacterium avium
SGGRVSLGVGFGWNTDELADHGV

SEQ ID NO: 108636 - protein, 21 aa, Mycobacterium avium
SGLRSLPWEGLNLSHGEPAIP

SEQ ID NO: 108637 - protein, 17 aa, Mycobacterium avium
SGSRFLVFMQRYTPAAL

SEQ ID NO: 108638 - protein, 22 aa, Mycobacterium avium
SGTCPEWVYFWLGAARIGAVSA

SEQ ID NO: 108639 - protein, 23 aa, Mycobacterium avium
SGVLGRLWLARGGTYVLANIRGG

SEQ ID NO: 108640 - protein, 26 aa, Mycobacterium avium
SGWMRAPLRWALRASLAVRARLMVRS

SEQ ID NO: 108641 - protein, 17 aa, Mycobacterium avium
SHALSFASLVFYSSWFK

SEQ ID NO: 108642 - protein, 23 aa, Mycobacterium avium
SHRLGHACVLAFLDVDGLKQVND

SEQ ID NO: 108643 - protein, 20 aa, Mycobacterium avium
SIFLMCLPDRVLAYGDCAII

SEQ ID NO: 108644 - protein, 21 aa, Mycobacterium avium
SIHPPRFLVGLSRRNHTFRTA

SEQ ID NO: 108645 - protein, 17 aa, Mycobacterium avium
SILPISWAYIRMMGADG

SEQ ID NO: 108646 - protein, 22 aa, Mycobacterium avium
SIPVKRLRQAGVLELLLALANE

SEQ ID NO: 108647 - protein, 18 aa, Mycobacterium avium
SIQKEWEWRVSRGESLKN

SEQ ID NO: 108648 - protein, 21 aa, Mycobacterium avium
SKCPQCGTYVFPPRENNCPNP

SEQ ID NO: 108649 - protein, 18 aa, Mycobacterium avium
SKDLPFAQARFCGAEGIE

SEQ ID NO: 108650 - protein, 18 aa, Mycobacterium avium
SKHIRLLAAFDHRHIFLD

SEQ ID NO: 108651 - protein, 17 aa, Mycobacterium avium
SKLPVPIHVGGGYGGDS

SEQ ID NO: 108652 - protein, 22 aa, Mycobacterium avium
SKMNRFFLRGALVARLLSESAW

SEQ ID NO: 108653 - protein, 26 aa, Mycobacterium avium
SKPLVRLRVPFTLSRYEIDNVERGAN

SEQ ID NO: 108654 - protein, 18 aa, Mycobacterium avium
SKTYRLTKGVLRRSAGEV

SEQ ID NO: 108655 - protein, 18 aa, Mycobacterium avium
SLAPRAALGVGISLGNLT

SEQ ID NO: 108656 - protein, 22 aa, Mycobacterium avium
SLDDVVKFLLPRGATKKVAKGA

SEQ ID NO: 108657 - protein, 23 aa, Mycobacterium avium
SLKRPDRRLAVVFGAGGERDPGK

SEQ ID NO: 108658 - protein, 23 aa, Mycobacterium avium
SLLSRPSVNNVLRVAPRQFKMPR

SEQ ID NO: 108659 - protein, 18 aa, Mycobacterium avium
SLRARFGTLTGVERPVAE

SEQ ID NO: 108660 - protein, 24 aa, Mycobacterium avium
SLYHFAWDEFCDWYVELAKTQLAE

SEQ ID NO: 108661 - protein, 22 aa, Mycobacterium avium
SMPKSVVINPYFDWGNDRPPDH

SEQ ID NO: 108662 - protein, 25 aa, Mycobacterium avium
SMSGWETPGGLPLSGLQAGDASDPA

SEQ ID NO: 108663 - protein, 21 aa, Mycobacterium avium
SNEFFKLWLDPSMTYSCGYWE

SEQ ID NO: 108664 - protein, 19 aa, Mycobacterium avium
SNVQVVWEKFCRYFDVEPR

SEQ ID NO: 108665 - protein, 17 aa, Mycobacterium avium
SNWARRDFPALAPAVRV

SEQ ID NO: 108666 - protein, 18 aa, Mycobacterium avium
SPGFSWQPLHTMPGISTF

SEQ ID NO: 108667 - protein, 22 aa, Mycobacterium avium
SQAVCFKAPYFSTVHPVIVELR

SEQ ID NO: 108668 - protein, 17 aa, Mycobacterium avium
SRAGLGYEVIVSRLDDE

SEQ ID NO: 108669 - protein, 22 aa, Mycobacterium avium
SRARFGDVLPFLVKVLAADEPL

SEQ ID NO: 108670 - protein, 23 aa, Mycobacterium avium
SRASICRFATWWVVLERHDQLVR

SEQ ID NO: 108671 - protein, 24 aa, Mycobacterium avium
SRAYRLPWPAGTVVYEIDQPRVIE

SEQ ID NO: 108672 - protein, 21 aa, Mycobacterium avium
SRGFPRPRFDDGYGRYDGDDY

SEQ ID NO: 108673 - protein, 18 aa, Mycobacterium avium
SRHRDMLAALVDYVHGRA

SEQ ID NO: 108674 - protein, 18 aa, Mycobacterium avium
SRLWRLLLAPGRGIGRLV

SEQ ID NO: 108675 - protein, 19 aa, Mycobacterium avium
SRMAIAMARAGGMGVLHRN

SEQ ID NO: 108676 - protein, 20 aa, Mycobacterium avium
SRRKHIEAGYEFVNTPHITK

SEQ ID NO: 108677 - protein, 26 aa, Mycobacterium avium
SRSTPRAGDGFIRLDVNGVVAYASPN

SEQ ID NO: 108678 - protein, 18 aa, Mycobacterium avium
SRWPELRAALTEKFASRD

SEQ ID NO: 108679 - protein, 24 aa, Mycobacterium avium
SRYTRSRFAPAFGPRARLEYLPSG

SEQ ID NO: 108680 - protein, 21 aa, Mycobacterium avium
SSFRYAGPAGRDWKIADLAGK

SEQ ID NO: 108681 - protein, 19 aa, Mycobacterium avium
SSLVTGWARLHGYPIGILA

SEQ ID NO: 108682 - protein, 18 aa, Mycobacterium avium
SSRFKAPFVFTGGTIARV

SEQ ID NO: 108683 - protein, 18 aa, Mycobacterium avium
STGAIAYRALAREFIDRF

SEQ ID NO: 108684 - protein, 23 aa, Mycobacterium avium
STLLLTLLFRFMRPLIEHGHVFL

SEQ ID NO: 108685 - protein, 23 aa, Mycobacterium avium
SVKYRLGRGMARIEAAMSTPGMY

SEQ ID NO: 108686 - protein, 23 aa, Mycobacterium avium
SVPRWLPERVCWLLSDEYHSNEG

SEQ ID NO: 108687 - protein, 22 aa, Mycobacterium avium
SVQRMAVALGFELDDMEFFIEH

SEQ ID NO: 108688 - protein, 21 aa, Mycobacterium avium
SWTEPKGGYFISLDVLPGTAK

SEQ ID NO: 108689 - protein, 21 aa, Mycobacterium avium
SYAKLRGGSGIQWPCNTDHPD

SEQ ID NO: 108690 - protein, 21 aa, Mycobacterium avium
SYGSRCVRPPILYGDVVRTHP

SEQ ID NO: 108691 - protein, 17 aa, Mycobacterium avium
TAELLEWEILRDICDAD

SEQ ID NO: 108692 - protein, 18 aa, Mycobacterium avium
TAFFDEFFLAAADAGVRQ

SEQ ID NO: 108693 - protein, 21 aa, Mycobacterium avium
TAFSRPATWWARAGGPVLRVG

SEQ ID NO: 108694 - protein, 18 aa, Mycobacterium avium
TAGGLYRWEGRYLRGDDQ

SEQ ID NO: 108695 - protein, 24 aa, Mycobacterium avium
TAHFCSMCGPKFCSMRITQDVRDY

SEQ ID NO: 108696 - protein, 19 aa, Mycobacterium avium
TAHPLVICDLGMPRDVDPA

SEQ ID NO: 108697 - protein, 17 aa, Mycobacterium avium
TALLSNAETIFWNGPMG

SEQ ID NO: 108698 - protein, 23 aa, Mycobacterium avium
TAQEKASVLSFVLAGHEPLEVGK

SEQ ID NO: 108699 - protein, 19 aa, Mycobacterium avium
TARLKCPFTSLGVAPEAAS

SEQ ID NO: 108700 - protein, 25 aa, Mycobacterium avium
TATPCGVCDSCLALAPNAPGSIDVV

SEQ ID NO: 108701 - protein, 22 aa, Mycobacterium avium
TCSEFFRYYAGWCSKINGTAYD

SEQ ID NO: 108702 - protein, 18 aa, Mycobacterium avium
TDELRFLVHWSAEVFSDY

SEQ ID NO: 108703 - protein, 17 aa, Mycobacterium avium
TDGRWDPGKDFAMVSAR

SEQ ID NO: 108704 - protein, 24 aa, Mycobacterium avium
TDHRPEILLSFGFVPKMESRVGLI

SEQ ID NO: 108705 - protein, 21 aa, Mycobacterium avium
TDIRPGLLVQLAFAAADFGFQ

SEQ ID NO: 108706 - protein, 19 aa, Mycobacterium avium
TDLAWARITYWRALLAAAV

SEQ ID NO: 108707 - protein, 19 aa, Mycobacterium avium
TDLLERFRDLILLQAVPDA

SEQ ID NO: 108708 - protein, 17 aa, Mycobacterium avium
TDMAHFFYIHFGLPTYF

SEQ ID NO: 108709 - protein, 19 aa, Mycobacterium avium
TEAIKLVALVADRGAQVRM

SEQ ID NO: 108710 - protein, 18 aa, Mycobacterium avium
TEALAIKTMVDYAVGQYL

SEQ ID NO: 108711 - protein, 23 aa, Mycobacterium avium
TEALRAGGFFHHAKVEMVWVASD

SEQ ID NO: 108712 - protein, 21 aa, Mycobacterium avium
TECDDRFDIVQAFTDDALTTC

SEQ ID NO: 108713 - protein, 19 aa, Mycobacterium avium
TEEMIRWVTPVKEFMRTAA

SEQ ID NO: 108714 - protein, 20 aa, Mycobacterium avium
TEGCVREMLVLAAALSIPDP

SEQ ID NO: 108715 - protein, 22 aa, Mycobacterium avium
TFDGELLSRCELFDEADLPDAL

SEQ ID NO: 108716 - protein, 20 aa, Mycobacterium avium
TGAPMPRWLAGALAAPAGPP

SEQ ID NO: 108717 - protein, 26 aa, Mycobacterium avium
TGEVLSVPVGDAFLGRVVNPLGQPID

SEQ ID NO: 108718 - protein, 20 aa, Mycobacterium avium
TGFLGRYLALEWLERMDMVD

SEQ ID NO: 108719 - protein, 17 aa, Mycobacterium avium
TGIDIAIALLTPLVGQE

SEQ ID NO: 108720 - protein, 19 aa, Mycobacterium avium
TGIQLYVKRVFIMGDCDQL

SEQ ID NO: 108721 - protein, 24 aa, Mycobacterium avium
TGQHWLDVCAMLGLPEFGEHQLAI

SEQ ID NO: 108722 - protein, 23 aa, Mycobacterium avium
TGQPAAVVPWDFDADGLPMSVQL

SEQ ID NO: 108723 - protein, 17 aa, Mycobacterium avium
TGSFSINGGNYFGADSP

SEQ ID NO: 108724 - protein, 24 aa, Mycobacterium avium
TGSMAAAWGRKGIRVNCIACGAIR

SEQ ID NO: 108725 - protein, 17 aa, Mycobacterium avium
THPFGWLPLLSRVLASA

SEQ ID NO: 108726 - protein, 25 aa, Mycobacterium avium
TIANGARLNLPWRRDFNALVYVLSG

SEQ ID NO: 108727 - protein, 21 aa, Mycobacterium avium
TIYRWWPTRPALVADVMLEDA

SEQ ID NO: 108728 - protein, 24 aa, Mycobacterium avium
TLADEFDFRFLVGVLSVLADKDVD

SEQ ID NO: 108729 - protein, 18 aa, Mycobacterium avium
TLALLPALRRARGQVVFI

SEQ ID NO: 108730 - protein, 17 aa, Mycobacterium avium
TLGSLALMGVRVEELIV

SEQ ID NO: 108731 - protein, 17 aa, Mycobacterium avium
TLHAALELSRRGSGYAV

SEQ ID NO: 108732 - protein, 17 aa, Mycobacterium avium
TLKAVAVKAPFFGDRRK

SEQ ID NO: 108733 - protein, 21 aa, Mycobacterium avium
TLLRLCNRLELPTSGRVSFYG

SEQ ID NO: 108734 - protein, 18 aa, Mycobacterium avium
TLPFISIRLWQPISENET

SEQ ID NO: 108735 - protein, 23 aa, Mycobacterium avium
TLQRFVDRFAHFNFRDEMVRPSY

SEQ ID NO: 108736 - protein, 19 aa, Mycobacterium avium
TLYRDRLLVLAALDLAATV

SEQ ID NO: 108737 - protein, 21 aa, Mycobacterium avium
TNTFPSWPLAHPFRRIAHNGE

SEQ ID NO: 108738 - protein, 17 aa, Mycobacterium avium
TNWNEFWSVVTGVYSPQ

SEQ ID NO: 108739 - protein, 19 aa, Mycobacterium avium
TPWGRRTTTVWAQGSAWEL

SEQ ID NO: 108740 - protein, 17 aa, Mycobacterium avium
TQLCAFAAGVLRAEASH

SEQ ID NO: 108741 - protein, 18 aa, Mycobacterium avium
TRALAAAVGISWTSELLT

SEQ ID NO: 108742 - protein, 18 aa, Mycobacterium avium
TRARAGAVAATIRTDGAA

SEQ ID NO: 108743 - protein, 19 aa, Mycobacterium avium
TRILAPRSRYDEIVDAVST

SEQ ID NO: 108744 - protein, 17 aa, Mycobacterium avium
TRLQWYVELGIDPQNLR

SEQ ID NO: 108745 - protein, 17 aa, Mycobacterium avium
TRMTEWPGGVTVYDIRI

SEQ ID NO: 108746 - protein, 19 aa, Mycobacterium avium
TRPAVMPMDAWREGEHFVV

SEQ ID NO: 108747 - protein, 19 aa, Mycobacterium avium
TRRGVALIRCAGWSDYYPN

SEQ ID NO: 108748 - protein, 18 aa, Mycobacterium avium
TRRPSVCNAAETLLVDAA

SEQ ID NO: 108749 - protein, 17 aa, Mycobacterium avium
TSFDWGVKVPDHPDHVM

SEQ ID NO: 108750 - protein, 21 aa, Mycobacterium avium
TSPLRPWPGFAPMLYERYSQP

SEQ ID NO: 108751 - protein, 23 aa, Mycobacterium avium
TTEYHGLHAFRWIAADGSARFVR

SEQ ID NO: 108752 - protein, 18 aa, Mycobacterium avium
TTIAHGFMTLALLPRLQH

SEQ ID NO: 108753 - protein, 17 aa, Mycobacterium avium
TTITMAFGSTMVLSQAV

SEQ ID NO: 108754 - protein, 17 aa, Mycobacterium avium
TTLFPPVRPRQWLEIRY

SEQ ID NO: 108755 - protein, 19 aa, Mycobacterium avium
TTNHWDWFDPFWAHRLLWP

SEQ ID NO: 108756 - protein, 20 aa, Mycobacterium avium
TVDLRRSYPFYGQPHQGGID

SEQ ID NO: 108757 - protein, 20 aa, Mycobacterium avium
TVLACFKLGIVIEGTLARAC

SEQ ID NO: 108758 - protein, 17 aa, Mycobacterium avium
TVTCPRDLVLNAPVKLA

SEQ ID NO: 108759 - protein, 23 aa, Mycobacterium avium
TYAVPRLLARNGLSLQDFDFYEI

SEQ ID NO: 108760 - protein, 24 aa, Mycobacterium avium
VAACLKWEGGYVWACKNYDGDVQS

SEQ ID NO: 108761 - protein, 17 aa, Mycobacterium avium
VAAICHGPWTLVEAGVA

SEQ ID NO: 108762 - protein, 26 aa, Mycobacterium avium
VACFPGPAPAGWRIIGRVLDGPARVL

SEQ ID NO: 108763 - protein, 17 aa, Mycobacterium avium
VAIGITPQGSWVLTDGD

SEQ ID NO: 108764 - protein, 18 aa, Mycobacterium avium
VAKGLPWPARFPSRVLAN

SEQ ID NO: 108765 - protein, 17 aa, Mycobacterium avium
VALLKILALQFIMSDPR

SEQ ID NO: 108766 - protein, 25 aa, Mycobacterium avium
VALRIWRPRWAKWTAHVVRSGGLIR

SEQ ID NO: 108767 - protein, 17 aa, Mycobacterium avium
VAPLTFLAIAGRRVQLE

SEQ ID NO: 108768 - protein, 18 aa, Mycobacterium avium
VAQMWDWIYPLGDNPDYE

SEQ ID NO: 108769 - protein, 19 aa, Mycobacterium avium
VARCPRNILTFSHGAHHCL

SEQ ID NO: 108770 - protein, 20 aa, Mycobacterium avium
VARIDWTRFLPLYQQAGQRS

SEQ ID NO: 108771 - protein, 18 aa, Mycobacterium avium
VATAAQWQALSSQFIGAP

SEQ ID NO: 108772 - protein, 19 aa, Mycobacterium avium
VAVCSTGLIGDRLPMDKLL

SEQ ID NO: 108773 - protein, 18 aa, Mycobacterium avium
VAVKAPFFGDRRKAFLED

SEQ ID NO: 108774 - protein, 24 aa, Mycobacterium avium
VCNEILPRWGVQTVFVDGDDLAQW

SEQ ID NO: 108775 - protein, 23 aa, Mycobacterium avium
VCPEPRPLLDVVLKLVEAVDTDN

SEQ ID NO: 108776 - protein, 18 aa, Mycobacterium avium
VDAFEWTGPLGVTYPGVV

SEQ ID NO: 108777 - protein, 23 aa, Mycobacterium avium
VDARIAARLGLRDDVRRVPLFGL

SEQ ID NO: 108778 - protein, 20 aa, Mycobacterium avium
VDGLNRFSASLARDKDNLGR

SEQ ID NO: 108779 - protein, 23 aa, Mycobacterium avium
VDGRFGIGLVDWVMRNEAGLLED

SEQ ID NO: 108780 - protein, 23 aa, Mycobacterium avium
VDLVCSWGPMILGHAHPAVVEAV

SEQ ID NO: 108781 - protein, 17 aa, Mycobacterium avium
VDLVQLFPAAAYGKNGA

SEQ ID NO: 108782 - protein, 17 aa, Mycobacterium avium
VDPRPSVDLGLLADELD

SEQ ID NO: 108783 - protein, 23 aa, Mycobacterium avium
VEEVLRWASPVAYWTRTAKVDVE

SEQ ID NO: 108784 - protein, 17 aa, Mycobacterium avium
VEGWMPFGRVFETLSWG

SEQ ID NO: 108785 - protein, 18 aa, Mycobacterium avium
VELGRAGAKLAISDVDTA

SEQ ID NO: 108786 - protein, 26 aa, Mycobacterium avium
VELPGWYRPNPGLARDLAFIAFSAAG

SEQ ID NO: 108787 - protein, 17 aa, Mycobacterium avium
VELRGPQRWRIRANWKI

SEQ ID NO: 108788 - protein, 23 aa, Mycobacterium avium
VEMRARHAALRFGDRAQAARVDE

SEQ ID NO: 108789 - protein, 23 aa, Mycobacterium avium
VERMHRACLILTFGGGTNEVQRD

SEQ ID NO: 108790 - protein, 19 aa, Mycobacterium avium
VESWARLAVAARPELTLGR

SEQ ID NO: 108791 - protein, 18 aa, Mycobacterium avium
VETARLWLSLGHHDRHGV

SEQ ID NO: 108792 - protein, 20 aa, Mycobacterium avium
VEVELDQCWDLLRQRRALRE

SEQ ID NO: 108793 - protein, 19 aa, Mycobacterium avium
VFIRPALRAAMGLPDPERP

SEQ ID NO: 108794 - protein, 22 aa, Mycobacterium avium
VFPDQSCLWGFGRAASLEYPQL

SEQ ID NO: 108795 - protein, 19 aa, Mycobacterium avium
VFWPIPRVYSGLVRIDRYP

SEQ ID NO: 108796 - protein, 17 aa, Mycobacterium avium
VGARLNWLLGHGESPQW

SEQ ID NO: 108797 - protein, 21 aa, Mycobacterium avium
VGDIVLAGWGFRTDRRAHPEI

SEQ ID NO: 108798 - protein, 18 aa, Mycobacterium avium
VGHIPGAVKIDWHTDLND

SEQ ID NO: 108799 - protein, 17 aa, Mycobacterium avium
VGKRLRDLMSWVDRPIT

SEQ ID NO: 108800 - protein, 23 aa, Mycobacterium avium
VGLARFCTLRGWLSQWSYDDARG

SEQ ID NO: 108801 - protein, 20 aa, Mycobacterium avium
VGTFSWPGAYGTWWQADPTA

SEQ ID NO: 108802 - protein, 21 aa, Mycobacterium avium
VGYAACHWCHVMAHESFEDPD

SEQ ID NO: 108803 - protein, 17 aa, Mycobacterium avium
VIDRGRWKDHREGETGR

SEQ ID NO: 108804 - protein, 17 aa, Mycobacterium avium
VIDSCLYTTPSKYGGEG

SEQ ID NO: 108805 - protein, 18 aa, Mycobacterium avium
VIGFREHASWALASDTLD

SEQ ID NO: 108806 - protein, 18 aa, Mycobacterium avium
VIRVHQFDKVEGFVYCTP

SEQ ID NO: 108807 - protein, 22 aa, Mycobacterium avium
VKDKPAWLGRAWRRIGEEVAAG

SEQ ID NO: 108808 - protein, 20 aa, Mycobacterium avium
VKKWLAEVLPNFPVYAHMLG

SEQ ID NO: 108809 - protein, 19 aa, Mycobacterium avium
VKVPRRLKELHLRLGTATA

SEQ ID NO: 108810 - protein, 18 aa, Mycobacterium avium
VLALGGAVGEEWDSRAIA

SEQ ID NO: 108811 - protein, 18 aa, Mycobacterium avium
VLAPRLWVPDEFGLCRYL

SEQ ID NO: 108812 - protein, 19 aa, Mycobacterium avium
VLARAIVRLALSYVSMPPE

SEQ ID NO: 108813 - protein, 17 aa, Mycobacterium avium
VLARLGLTAADIERLAD

SEQ ID NO: 108814 - protein, 20 aa, Mycobacterium avium
VLCALPARYITPSSKKKPRP

SEQ ID NO: 108815 - protein, 24 aa, Mycobacterium avium
VLGLGIPVCEGYGMTECTAGATVN

SEQ ID NO: 108816 - protein, 19 aa, Mycobacterium avium
VLGNWTGIPVFKLTEAETT

SEQ ID NO: 108817 - protein, 18 aa, Mycobacterium avium
VLPRSRWTTELSEGARLE

SEQ ID NO: 108818 - protein, 18 aa, Mycobacterium avium
VLQCPFHGWQWSAEGRNV

SEQ ID NO: 108819 - protein, 24 aa, Mycobacterium avium
VLRLPRIPMRFPMYLPGPNRVMIV

SEQ ID NO: 108820 - protein, 17 aa, Mycobacterium avium
VLRNGRRAFRMPRPAYG

SEQ ID NO: 108821 - protein, 19 aa, Mycobacterium avium
VLVGHSFGGITIMAWAQRF

SEQ ID NO: 108822 - protein, 18 aa, Mycobacterium avium
VMAARWNRVLGAWPITTS

SEQ ID NO: 108823 - protein, 18 aa, Mycobacterium avium
VMPPRGVGVIELRGESVT

SEQ ID NO: 108824 - protein, 17 aa, Mycobacterium avium
VMVRPLIRLSLGKRQPM

SEQ ID NO: 108825 - protein, 22 aa, Mycobacterium avium
VNIRLAIDWLDRWADDMPLSLL

SEQ ID NO: 108826 - protein, 17 aa, Mycobacterium avium
VNLLLPFTRRRHVAVCV

SEQ ID NO: 108827 - protein, 20 aa, Mycobacterium avium
VNQRWLGGMLTNFSTVHKRL

SEQ ID NO: 108828 - protein, 17 aa, Mycobacterium avium
VPAHTQLAWVLGCFTGF

SEQ ID NO: 108829 - protein, 18 aa, Mycobacterium avium
VPAQRLTATVLRFNGFAA

SEQ ID NO: 108830 - protein, 21 aa, Mycobacterium avium
VPGRSVTRWGAFLDDVGGFDC

SEQ ID NO: 108831 - protein, 18 aa, Mycobacterium avium
VPLSNIWGTTLDIVDRTG

SEQ ID NO: 108832 - protein, 24 aa, Mycobacterium avium
VPPHGWINLHFSLLPAWRGAAPVQ

SEQ ID NO: 108833 - protein, 25 aa, Mycobacterium avium
VPYYRVLELAPWLKWPQPNFPVSNF

SEQ ID NO: 108834 - protein, 17 aa, Mycobacterium avium
VQEWVRFGWFFLVTRRD

SEQ ID NO: 108835 - protein, 22 aa, Mycobacterium avium
VQSVLLPRLLNWMSYAPDPDGG

SEQ ID NO: 108836 - protein, 19 aa, Mycobacterium avium
VRCEVWEGFIFINFDDNAA

SEQ ID NO: 108837 - protein, 18 aa, Mycobacterium avium
VRDPGCLAVAALIDTYRV

SEQ ID NO: 108838 - protein, 19 aa, Mycobacterium avium
VREALTLPPHIPVITVDAR

SEQ ID NO: 108839 - protein, 18 aa, Mycobacterium avium
VRETLRLGDKFPLKAGMV

SEQ ID NO: 108840 - protein, 19 aa, Mycobacterium avium
VRFPAPVPVGSRVRAQSSL

SEQ ID NO: 108841 - protein, 17 aa, Mycobacterium avium
VRGDFLAGVPLQIADGY

SEQ ID NO: 108842 - protein, 19 aa, Mycobacterium avium
VRLNHEFHRAINIAADSPK

SEQ ID NO: 108843 - protein, 19 aa, Mycobacterium avium
VRPHPEWFRTGDLGRLDRD

SEQ ID NO: 108844 - protein, 21 aa, Mycobacterium avium
VRRMRLQPGRMFLVDTAQGRI

SEQ ID NO: 108845 - protein, 29 aa, Mycobacterium avium
VRSGVAFDILRRWLIALGYDVAFIRNVTD

SEQ ID NO: 108846 - protein, 18 aa, Mycobacterium avium
VRSKRLIIDYADRTCKGV

SEQ ID NO: 108847 - protein, 18 aa, Mycobacterium avium
VSAAEWWCRAGTMPRAEL

SEQ ID NO: 108848 - protein, 23 aa, Mycobacterium avium
VSARGIEVAHIFQLGRKYTDAFT

SEQ ID NO: 108849 - protein, 23 aa, Mycobacterium avium
VSCVKPAGALYAFPRLDPEVYDI

SEQ ID NO: 108850 - protein, 17 aa, Mycobacterium avium
VSLALLHAGRTVVAVTH

SEQ ID NO: 108851 - protein, 22 aa, Mycobacterium avium
VSPGELRRRFALAARIRPRRSL

SEQ ID NO: 108852 - protein, 17 aa, Mycobacterium avium
VSQRRFEVEFSVAAGEV

SEQ ID NO: 108853 - protein, 23 aa, Mycobacterium avium
VSYEAGDALGVWPRNSDELVDEW

SEQ ID NO: 108854 - protein, 18 aa, Mycobacterium avium
VTAFPYRLVDFWRDHRAP

SEQ ID NO: 108855 - protein, 17 aa, Mycobacterium avium
VTEILPLDGFDFDDLDF

SEQ ID NO: 108856 - protein, 18 aa, Mycobacterium avium
VTPVKEFMRTAAKDTVVR

SEQ ID NO: 108857 - protein, 22 aa, Mycobacterium avium
VTRLRPDLRPDLPQPAAGDGSY

SEQ ID NO: 108858 - protein, 17 aa, Mycobacterium avium
VVAEPFTAWVLEDKFAD

SEQ ID NO: 108859 - protein, 18 aa, Mycobacterium avium
VVDPRWVLPVSDSILELA

SEQ ID NO: 108860 - protein, 24 aa, Mycobacterium avium
VVFQEPRLLPWRSLAANVAFGLPR

SEQ ID NO: 108861 - protein, 19 aa, Mycobacterium avium
VVLGDAWDLLKFLNDDEYA

SEQ ID NO: 108862 - protein, 18 aa, Mycobacterium avium
VVRLRFGLTDGQPRTLDE

SEQ ID NO: 108863 - protein, 17 aa, Mycobacterium avium
VVRPRLKIVESILQSAV

SEQ ID NO: 108864 - protein, 18 aa, Mycobacterium avium
VVRTRLAEALWKDHEDPL

SEQ ID NO: 108865 - protein, 17 aa, Mycobacterium avium
VVSMPCVEWFESQPDDY

SEQ ID NO: 108866 - protein, 24 aa, Mycobacterium avium
VVVEARASGRLMFYGQGAGGAPTA

SEQ ID NO: 108867 - protein, 17 aa, Mycobacterium avium
VWAMRYTLERAMRGQDT

SEQ ID NO: 108868 - protein, 17 aa, Mycobacterium avium
VYICGPGAFMDSAREAL

SEQ ID NO: 108869 - protein, 17 aa, Mycobacterium avium
WAPLLWTSLAVKSWMGE

SEQ ID NO: 108870 - protein, 23 aa, Mycobacterium avium
WAREGPFPYGRDVSGLQVGILGL

SEQ ID NO: 108871 - protein, 19 aa, Mycobacterium avium
WCALTIRLLGRTEIRRLAK

SEQ ID NO: 108872 - protein, 17 aa, Mycobacterium avium
WDAVLAVNLLAPLRLTE

SEQ ID NO: 108873 - protein, 19 aa, Mycobacterium avium
WDLLPGYLIFRSIVPTRPP

SEQ ID NO: 108874 - protein, 17 aa, Mycobacterium avium
WDLTLGVATDTRESLIN

SEQ ID NO: 108875 - protein, 18 aa, Mycobacterium avium
WDPTLLFRRLKELHLEFT

SEQ ID NO: 108876 - protein, 18 aa, Mycobacterium avium
WEDFDWLMGINVGGVVNG

SEQ ID NO: 108877 - protein, 17 aa, Mycobacterium avium
WEPFTHMAFRFNECSTR

SEQ ID NO: 108878 - protein, 21 aa, Mycobacterium avium
WESIISLLTTEQWTGGGSAAA

SEQ ID NO: 108879 - protein, 18 aa, Mycobacterium avium
WFAAKGHVPMFAFGHGLS

SEQ ID NO: 108880 - protein, 27 aa, Mycobacterium avium
WFGGCCYRCDPCRAGLFIHCVNGKVPS

SEQ ID NO: 108881 - protein, 25 aa, Mycobacterium avium
WFVGKKGGAGWVEWGGCGMVHPNVL

SEQ ID NO: 108882 - protein, 19 aa, Mycobacterium avium
WGEAVTAVIVLRPDHPSDE

SEQ ID NO: 108883 - protein, 17 aa, Mycobacterium avium
WGGLGLNLMQDVELAME

SEQ ID NO: 108884 - protein, 18 aa, Mycobacterium avium
WGGMVRYAARRGVRAIGA

SEQ ID NO: 108885 - protein, 17 aa, Mycobacterium avium
WIDGPRVVPAGHAITPT

SEQ ID NO: 108886 - protein, 20 aa, Mycobacterium avium
WKAIEATGRFCVNVLTEKQK

SEQ ID NO: 108887 - protein, 22 aa, Mycobacterium avium
WKIALRRCTVEWTLQGDGSALK

SEQ ID NO: 108888 - protein, 23 aa, Mycobacterium avium
WKIGAVPVPMHWDLPEWERDRVR

SEQ ID NO: 108889 - protein, 20 aa, Mycobacterium avium
WKMDLELGAHYYVKFANPDV

SEQ ID NO: 108890 - protein, 21 aa, Mycobacterium avium
WKPVGGFPITFGWLHAVRRGQ

SEQ ID NO: 108891 - protein, 20 aa, Mycobacterium avium
WLDAFARWRHARGAPATAIA

SEQ ID NO: 108892 - protein, 22 aa, Mycobacterium avium
WLDAFTRWRRARGLKATAIAWG

SEQ ID NO: 108893 - protein, 19 aa, Mycobacterium avium
WLDEPCTFYDWRSSETGKP

SEQ ID NO: 108894 - protein, 19 aa, Mycobacterium avium
WLIGAPRWREAAIARGDAE

SEQ ID NO: 108895 - protein, 19 aa, Mycobacterium avium
WLMSACAPAPVGDTPAVGE

SEQ ID NO: 108896 - protein, 24 aa, Mycobacterium avium
WLPKFCTGELITAIAMTEPGTGSD

SEQ ID NO: 108897 - protein, 19 aa, Mycobacterium avium
WLVLATLRWGVICRYQAER

SEQ ID NO: 108898 - protein, 17 aa, Mycobacterium avium
WMARTGFQMLDPLKTAK

SEQ ID NO: 108899 - protein, 23 aa, Mycobacterium avium
WNEWKDPRLIIAVLHNNDLNQVT

SEQ ID NO: 108900 - protein, 18 aa, Mycobacterium avium
WNMFKQNIGIMIAVAQLA

SEQ ID NO: 108901 - protein, 18 aa, Mycobacterium avium
WNPKMKRFIFTDRNGIYI

SEQ ID NO: 108902 - protein, 17 aa, Mycobacterium avium
WNTLLALLFEWGVGLQH

SEQ ID NO: 108903 - protein, 17 aa, Mycobacterium avium
WPEVRSQLAMTWGTETF

SEQ ID NO: 108904 - protein, 17 aa, Mycobacterium avium
WPLHISLLLAKEYALTG

SEQ ID NO: 108905 - protein, 18 aa, Mycobacterium avium
WPPVRRIDGAYGDRNLVC

SEQ ID NO: 108906 - protein, 18 aa, Mycobacterium avium
WPTVAAWVKWLSTGGDKP

SEQ ID NO: 108907 - protein, 17 aa, Mycobacterium avium
WRPQFRVDLVPSYKAHR

SEQ ID NO: 108908 - protein, 18 aa, Mycobacterium avium
WRQPELKAAGAAMATTAL

SEQ ID NO: 108909 - protein, 19 aa, Mycobacterium avium
WRSPLQLLFIDGGHSETAA

SEQ ID NO: 108910 - protein, 18 aa, Mycobacterium avium
WSFAVGKQLSMASIITSA

SEQ ID NO: 108911 - protein, 20 aa, Mycobacterium avium
WSTSLKSLWMGDGEAVGDVT

SEQ ID NO: 108912 - protein, 27 aa, Mycobacterium avium
WTQDSFVPWVWRRLRGLSSYDGREPKR

SEQ ID NO: 108913 - protein, 18 aa, Mycobacterium avium
WTQWIFLQIYNAWFDPAA

SEQ ID NO: 108914 - protein, 17 aa, Mycobacterium avium
WVGHDWGAAVVWNAPLL

SEQ ID NO: 108915 - protein, 18 aa, Mycobacterium avium
WVIDIDLWGSIHAVEAFL

SEQ ID NO: 108916 - protein, 18 aa, Mycobacterium avium
YAAGFSRELDDEWQLPDA

SEQ ID NO: 108917 - protein, 17 aa, Mycobacterium avium
YAAVYGYDERAMAKIVV

SEQ ID NO: 108918 - protein, 19 aa, Mycobacterium avium
YANRFGYNVVRDFTGHGIG

SEQ ID NO: 108919 - protein, 21 aa, Mycobacterium avium
YDAAAAWARRFLDGPRHALAA

SEQ ID NO: 108920 - protein, 18 aa, Mycobacterium avium
YDDLRAGLRMNIIGNPGV

SEQ ID NO: 108921 - protein, 21 aa, Mycobacterium avium
YDILFFWVARMMMFGTFVGDD

SEQ ID NO: 108922 - protein, 17 aa, Mycobacterium avium
YDPPRKWWQAGPGEGSI

SEQ ID NO: 108923 - protein, 18 aa, Mycobacterium avium
YEGFSLPAVEAMASGTPI

SEQ ID NO: 108924 - protein, 21 aa, Mycobacterium avium
YEKLEGVPLTFAGKVNRLAIM

SEQ ID NO: 108925 - protein, 18 aa, Mycobacterium avium
YELARPGKDISIADVLRC

SEQ ID NO: 108926 - protein, 18 aa, Mycobacterium avium
YERKEIRDIIAYLRVLDN

SEQ ID NO: 108927 - protein, 18 aa, Mycobacterium avium
YFVAPGLWRGFDHGGLAR

SEQ ID NO: 108928 - protein, 18 aa, Mycobacterium avium
YGSIPLPGSFTAKLSSAV

SEQ ID NO: 108929 - protein, 18 aa, Mycobacterium avium
YHGKALGAFTGWHPQFPV

SEQ ID NO: 108930 - protein, 19 aa, Mycobacterium avium
YILELEPFASLPPEQIAAT

SEQ ID NO: 108931 - protein, 22 aa, Mycobacterium avium
YKACFLAMVRRFYELGVKDLNG

SEQ ID NO: 108932 - protein, 20 aa, Mycobacterium avium
YKHGWWLPERPLTPIGAQMN

SEQ ID NO: 108933 - protein, 25 aa, Mycobacterium avium
YKLLRSDWLEPRWMVGIDPQSEGLA

SEQ ID NO: 108934 - protein, 17 aa, Mycobacterium avium
YKSEPWARLGVNVDADF

SEQ ID NO: 108935 - protein, 17 aa, Mycobacterium avium
YKVAALDVMNKVRALNQ

SEQ ID NO: 108936 - protein, 23 aa, Mycobacterium avium
YLLSRAPGGLGLHAALTGAPFSG

SEQ ID NO: 108937 - protein, 21 aa, Mycobacterium avium
YLRRWLAPAIRQWVQQAAAGT

SEQ ID NO: 108938 - protein, 17 aa, Mycobacterium avium
YPCPPFALLTGQDKWLL

SEQ ID NO: 108939 - protein, 17 aa, Mycobacterium avium
YPLPSAWAGDADVALYL

SEQ ID NO: 108940 - protein, 18 aa, Mycobacterium avium
YPVEEVREALTLPPHIPV

SEQ ID NO: 108941 - protein, 20 aa, Mycobacterium avium
YPVLCGSAFKNKGVQPMLDA

SEQ ID NO: 108942 - protein, 20 aa, Mycobacterium avium
YRDADGWIYLAGRTADWMRV

SEQ ID NO: 108943 - protein, 19 aa, Mycobacterium avium
YRDRIGLAIAREYSGGTVF

SEQ ID NO: 108944 - protein, 18 aa, Mycobacterium avium
YREYALRPPKGVLLYGPP

SEQ ID NO: 108945 - protein, 17 aa, Mycobacterium avium
YRFPGLLPGDRWCVTAL

SEQ ID NO: 108946 - protein, 17 aa, Mycobacterium avium
YRIAELALRDKIPLVML

SEQ ID NO: 108947 - protein, 20 aa, Mycobacterium avium
YRLAAQLGMPPWRVQKAQKQ

SEQ ID NO: 108948 - protein, 19 aa, Mycobacterium avium
YRTEVDWATQMSYSGVFVH

SEQ ID NO: 108949 - protein, 20 aa, Mycobacterium avium
YRVLPYCWRDETPLSNHELR

SEQ ID NO: 108950 - protein, 18 aa, Mycobacterium avium
YSDFIAWPIRMEVERRTP

SEQ ID NO: 108951 - protein, 18 aa, Mycobacterium avium
YTARLCPAPLLPEERHTA

SEQ ID NO: 108952 - protein, 19 aa, Mycobacterium avium
YTEFPRFHALMAEQSGVVF

SEQ ID NO: 108953 - protein, 19 aa, Mycobacterium avium
YTPAHWKYLTSGLLGLARG

SEQ ID NO: 108954 - protein, 20 aa, Mycobacterium avium
YTVSLLKAWWGEAATADNDW

SEQ ID NO: 108955 - protein, 17 aa, Mycobacterium avium
YVMECLQLMALRRATTV

SEQ ID NO: 108956 - protein, 18 aa, Mycobacterium avium
YVPKHWDKLCEVIGRPDL

SEQ ID NO: 108957 - protein, 17 aa, Mycobacterium avium
YWGRPVPSWGSARPRLL

SEQ ID NO: 108958 - protein, 22 aa, Mycobacterium avium
YYADFEGVLAFLQRKMAQTESE

SEQ ID NO: 108959 - protein, 18 aa, Mycobacterium avium
AAAARCGRWALPRRDHVT

SEQ ID NO: 108960 - protein, 25 aa, Mycobacterium avium
AAADRLRVRPGRCVVVAGDPAAVEA

SEQ ID NO: 108961 - protein, 18 aa, Mycobacterium avium
AAARGRFEASWNHRNGAL

SEQ ID NO: 108962 - protein, 18 aa, Mycobacterium avium
AADGYVFLAAPLPREWPA

SEQ ID NO: 108963 - protein, 17 aa, Mycobacterium avium
AAELMGIQIPRFCDHPL

SEQ ID NO: 108964 - protein, 20 aa, Mycobacterium avium
AAETCRGCSLFADATQTVFG

SEQ ID NO: 108965 - protein, 17 aa, Mycobacterium avium
AAFARSALFPALVAGLD

SEQ ID NO: 108966 - protein, 24 aa, Mycobacterium avium
AAFPRYHPRWAWWLTSVPVLREFL

SEQ ID NO: 108967 - protein, 17 aa, Mycobacterium avium
AAFQLGVLERGLQMTAE

SEQ ID NO: 108968 - protein, 17 aa, Mycobacterium avium
AAGELHFSIGYSEPGAG

SEQ ID NO: 108969 - protein, 26 aa, Mycobacterium avium
AAKATFLRWAWYAARREELHLDGADD

SEQ ID NO: 108970 - protein, 25 aa, Mycobacterium avium
AALHAGWRALGWWLVGTSRAMLTLG

SEQ ID NO: 108971 - protein, 19 aa, Mycobacterium avium
AAPGECVALLFSRSDEAIV

SEQ ID NO: 108972 - protein, 17 aa, Mycobacterium avium
AAPSWRKGPRHIAGRGP

SEQ ID NO: 108973 - protein, 18 aa, Mycobacterium avium
AAQIPWRLGDLAALTDGH

SEQ ID NO: 108974 - protein, 22 aa, Mycobacterium avium
AARARLLAPIPRPPSIRDSLCF

SEQ ID NO: 108975 - protein, 23 aa, Mycobacterium avium
AARGDFRAPLVIGDRLDTDIEGA

SEQ ID NO: 108976 - protein, 17 aa, Mycobacterium avium
AAVELALVDPGRVTGRT

SEQ ID NO: 108977 - protein, 18 aa, Mycobacterium avium
AAVRPEWPLLVQAIAEAQ

SEQ ID NO: 108978 - protein, 19 aa, Mycobacterium avium
ACGPHIIRGAAIAWAPNGE

SEQ ID NO: 108979 - protein, 20 aa, Mycobacterium avium
ADEGLRRWGVDAEVRDRFLG

SEQ ID NO: 108980 - protein, 22 aa, Mycobacterium avium
ADFRGASVAVEWPAQLQQQISR

SEQ ID NO: 108981 - protein, 18 aa, Mycobacterium avium
ADHFRYFAGALRAQEGSL

SEQ ID NO: 108982 - protein, 21 aa, Mycobacterium avium
ADLFLWPTLYLWEFPKPTISQ

SEQ ID NO: 108983 - protein, 25 aa, Mycobacterium avium
ADLRAIPWVLAWSQSRVMLPGWYGT

SEQ ID NO: 108984 - protein, 24 aa, Mycobacterium avium
ADPLRAGMRLGLIPTVAPYVLPTV

SEQ ID NO: 108985 - protein, 24 aa, Mycobacterium avium
ADQEEYLRWAVGAFRLATSGVADS

SEQ ID NO: 108986 - protein, 17 aa, Mycobacterium avium
AEAFPGLARTAALVRLV

SEQ ID NO: 108987 - protein, 17 aa, Mycobacterium avium
AEEAWPNIVITDVDSTG

SEQ ID NO: 108988 - protein, 21 aa, Mycobacterium avium
AEIYVPFSWFEPMWLENLGFA

SEQ ID NO: 108989 - protein, 17 aa, Mycobacterium avium
AELFKPLPSMVVAHYLG

SEQ ID NO: 108990 - protein, 18 aa, Mycobacterium avium
AELHTRLTLSFIVTPHTS

SEQ ID NO: 108991 - protein, 20 aa, Mycobacterium avium
AELLARAGVPLVAFGDSLRA

SEQ ID NO: 108992 - protein, 20 aa, Mycobacterium avium
AELPLRLCAGQHLQADIAVS

SEQ ID NO: 108993 - protein, 19 aa, Mycobacterium avium
AELVAPVVGWLAHESCSVS

SEQ ID NO: 108994 - protein, 18 aa, Mycobacterium avium
AEPYLRPGQIEEHLVYPV

SEQ ID NO: 108995 - protein, 18 aa, Mycobacterium avium
AEQCRRLDALGIDYEIVP

SEQ ID NO: 108996 - protein, 23 aa, Mycobacterium avium
AEQMKMFLTRLGFGSKIVVTGDI

SEQ ID NO: 108997 - protein, 20 aa, Mycobacterium avium
AFAAIAIKIQQYFGIPDQKY

SEQ ID NO: 108998 - protein, 19 aa, Mycobacterium avium
AFAQRHWGGLLAPPALLMG

SEQ ID NO: 108999 - protein, 17 aa, Mycobacterium avium
AFEAGWIQPTWPREHGG

SEQ ID NO: 109000 - protein, 18 aa, Mycobacterium avium
AFGWDRINALLSRVDSIR

SEQ ID NO: 109001 - protein, 17 aa, Mycobacterium avium
AFPRLAVVRAPRHDRAV

SEQ ID NO: 109002 - protein, 22 aa, Mycobacterium avium
AFRRKEIPVDEILNSAVLNYPL

SEQ ID NO: 109003 - protein, 18 aa, Mycobacterium avium
AFVLIPWLAVDPDARLTV

SEQ ID NO: 109004 - protein, 17 aa, Mycobacterium avium
AGAALAWAALHDAAHAK

SEQ ID NO: 109005 - protein, 21 aa, Mycobacterium avium
AGCGMACPFCATGQGGLSRNL

SEQ ID NO: 109006 - protein, 23 aa, Mycobacterium avium
AGCKICDRPACPQRAFPYLGRPV

SEQ ID NO: 109007 - protein, 18 aa, Mycobacterium avium
AGGVLRFSADFAELADRD

SEQ ID NO: 109008 - protein, 17 aa, Mycobacterium avium
AGIPSLILWTAGDQPLW

SEQ ID NO: 109009 - protein, 17 aa, Mycobacterium avium
AGITLFSPLRHWKAGPG

SEQ ID NO: 109010 - protein, 23 aa, Mycobacterium avium
AGLRARSAWLWSRRRGVVAGRSA

SEQ ID NO: 109011 - protein, 21 aa, Mycobacterium avium
AGPGECVALLFSRSAEAIVSI

SEQ ID NO: 109012 - protein, 21 aa, Mycobacterium avium
AGRGGYGMGPRYGVKPKVMPT

SEQ ID NO: 109013 - protein, 17 aa, Mycobacterium avium
AGRRAALEMVRRHRLLE

SEQ ID NO: 109014 - protein, 25 aa, Mycobacterium avium
AGVSRPENFIGIHFFSPVEKMDPIE

SEQ ID NO: 109015 - protein, 19 aa, Mycobacterium avium
AGWLRYGLPASLGGRDGSN

SEQ ID NO: 109016 - protein, 17 aa, Mycobacterium avium
AHLPGYQGWQWAVVVAA

SEQ ID NO: 109017 - protein, 17 aa, Mycobacterium avium
AHREILRAGYAYVAVSA

SEQ ID NO: 109018 - protein, 20 aa, Mycobacterium avium
AHSTLQRFGGIGVDTVLSHG

SEQ ID NO: 109019 - protein, 23 aa, Mycobacterium avium
AHTQLAWVLGCFTGFGQASRMTQ

SEQ ID NO: 109020 - protein, 19 aa, Mycobacterium avium
AICHGPWTLVEAGVAAGRT

SEQ ID NO: 109021 - protein, 19 aa, Mycobacterium avium
AIGGGLCLALAADIRVAST

SEQ ID NO: 109022 - protein, 23 aa, Mycobacterium avium
AIILPGGWWLLSLQALGLAQNAP

SEQ ID NO: 109023 - protein, 24 aa, Mycobacterium avium
AIVKGLRTGTDFEYELQMAQMNKH

SEQ ID NO: 109024 - protein, 18 aa, Mycobacterium avium
AIVPWNFPFEVTLNKLGQ

SEQ ID NO: 109025 - protein, 18 aa, Mycobacterium avium
AKGTGAFGRFEVTNDLSA

SEQ ID NO: 109026 - protein, 24 aa, Mycobacterium avium
AKLKEAICRGTLWAIRREAAKPGS

SEQ ID NO: 109027 - protein, 20 aa, Mycobacterium avium
AKLWTIADLGGWSAADPQLF

SEQ ID NO: 109028 - protein, 17 aa, Mycobacterium avium
AKMPLPHWEDADGPTED

SEQ ID NO: 109029 - protein, 19 aa, Mycobacterium avium
AKPGWPGFVSTPLHAYRRH

SEQ ID NO: 109030 - protein, 19 aa, Mycobacterium avium
AKTTFGRIGVKVWIYKGDV

SEQ ID NO: 109031 - protein, 22 aa, Mycobacterium avium
ALCARFRISGLPVVDDSGALVG

SEQ ID NO: 109032 - protein, 24 aa, Mycobacterium avium
ALCDIFYPRVFLRRGGFVPSGTIS

SEQ ID NO: 109033 - protein, 17 aa, Mycobacterium avium
ALELTWEALEHARIPAS

SEQ ID NO: 109034 - protein, 19 aa, Mycobacterium avium
ALHSPFWWLKCAVGVHNTD

SEQ ID NO: 109035 - protein, 21 aa, Mycobacterium avium
ALRRTYLRLGHRVDVIEPVAG

SEQ ID NO: 109036 - protein, 21 aa, Mycobacterium avium
ALTELWVRPALSLPAVAEDLR

SEQ ID NO: 109037 - protein, 17 aa, Mycobacterium avium
ALVLGDWPADPPAPQPA

SEQ ID NO: 109038 - protein, 17 aa, Mycobacterium avium
AMAARTRFFDSFFQGAT

SEQ ID NO: 109039 - protein, 22 aa, Mycobacterium avium
AMDRKVWLPSGGTLVIDRTEAM

SEQ ID NO: 109040 - protein, 21 aa, Mycobacterium avium
AMELGCDAVLLATAVTRAGDP

SEQ ID NO: 109041 - protein, 19 aa, Mycobacterium avium
AMFDGRFLGFADFLVRDGE

SEQ ID NO: 109042 - protein, 20 aa, Mycobacterium avium
ANEILKRAASFFGAELDRQH

SEQ ID NO: 109043 - protein, 17 aa, Mycobacterium avium
ANLLLAECNWLVPVNEP

SEQ ID NO: 109044 - protein, 20 aa, Mycobacterium avium
ANLRKQLKGSRMPAPRAIMA

SEQ ID NO: 109045 - protein, 19 aa, Mycobacterium avium
ANTVGRLSVPPTWASATPA

SEQ ID NO: 109046 - protein, 18 aa, Mycobacterium avium
APAIRPAALALPATTVTA

SEQ ID NO: 109047 - protein, 25 aa, Mycobacterium avium
APEQARSGLAYAVSKSFVKWYSQSQ

SEQ ID NO: 109048 - protein, 19 aa, Mycobacterium avium
APNPMFLAWVISEDLKRLW

SEQ ID NO: 109049 - protein, 18 aa, Mycobacterium avium
APTGPGFWFPPTVLTPSR

SEQ ID NO: 109050 - protein, 22 aa, Mycobacterium avium
APVCRYCRSRDIGVRAVSGRAT

SEQ ID NO: 109051 - protein, 18 aa, Mycobacterium avium
APVPVLWLGAGERVSALV

SEQ ID NO: 109052 - protein, 21 aa, Mycobacterium avium
AQAFSEWRRTPAPVRGALVAR

SEQ ID NO: 109053 - protein, 18 aa, Mycobacterium avium
AQFAQWGALLARTDPNAP

SEQ ID NO: 109054 - protein, 18 aa, Mycobacterium avium
AQFTARWGLTGTLITVDG

SEQ ID NO: 109055 - protein, 20 aa, Mycobacterium avium
AQIKRLKVGTARRFSATTSE

SEQ ID NO: 109056 - protein, 18 aa, Mycobacterium avium
AQILAGFCDVALVIGADT

SEQ ID NO: 109057 - protein, 17 aa, Mycobacterium avium
AQLRLGLMHGRLSAEEK

SEQ ID NO: 109058 - protein, 18 aa, Mycobacterium avium
AQLVGSLSVPQGWANAAT

SEQ ID NO: 109059 - protein, 18 aa, Mycobacterium avium
AQRPEWLAAAAAVTAGQP

SEQ ID NO: 109060 - protein, 17 aa, Mycobacterium avium
AQTLTPWPAIDGQRTAA

SEQ ID NO: 109061 - protein, 18 aa, Mycobacterium avium
AQVALAWLISYPGVVAIP

SEQ ID NO: 109062 - protein, 17 aa, Mycobacterium avium
ARAWSSYAPTLVRLPDG

SEQ ID NO: 109063 - protein, 20 aa, Mycobacterium avium
ARAYRLAWPAGTTVFEIDQP

SEQ ID NO: 109064 - protein, 19 aa, Mycobacterium avium
AREFHKFLLAKQHEIASVV

SEQ ID NO: 109065 - protein, 19 aa, Mycobacterium avium
AREIACAYDLEFVDPADVK

SEQ ID NO: 109066 - protein, 19 aa, Mycobacterium avium
ARFWLFGVIPAWTHHLTIK

SEQ ID NO: 109067 - protein, 17 aa, Mycobacterium avium
ARGEFRPRPSFLSPGKK

SEQ ID NO: 109068 - protein, 20 aa, Mycobacterium avium
ARGGWKPFLHHISKGAPRSR

SEQ ID NO: 109069 - protein, 18 aa, Mycobacterium avium
ARLKVGIISAGRVGTALG

SEQ ID NO: 109070 - protein, 24 aa, Mycobacterium avium
ARLPADLLGQWGIRVVPLHILLDG

SEQ ID NO: 109071 - protein, 27 aa, Mycobacterium avium
ARPQLAVTFRNGWQWATVEGRAELVGP

SEQ ID NO: 109072 - protein, 19 aa, Mycobacterium avium
ARPSPFYIMDEVEAALDDT

SEQ ID NO: 109073 - protein, 17 aa, Mycobacterium avium
ARTHLALSWALARSPGG

SEQ ID NO: 109074 - protein, 18 aa, Mycobacterium avium
ARVAALIRRVCAQTSSLP

SEQ ID NO: 109075 - protein, 21 aa, Mycobacterium avium
ARVKCALLGWMACKDALAQAY

SEQ ID NO: 109076 - protein, 25 aa, Mycobacterium avium
ASAGRAGLVGALSVPANWASAVPAV

SEQ ID NO: 109077 - protein, 17 aa, Mycobacterium avium
ASFKYGLNAKWPVYLST

SEQ ID NO: 109078 - protein, 23 aa, Mycobacterium avium
ATACLRKTDWLFPQYRELGAFLV

SEQ ID NO: 109079 - protein, 18 aa, Mycobacterium avium
ATIRAEADLARFPADVAR

SEQ ID NO: 109080 - protein, 23 aa, Mycobacterium avium
ATLRRFTEKFARFNLPGKAVRPA

SEQ ID NO: 109081 - protein, 23 aa, Mycobacterium avium
ATSRELPWRRPIASLNYLLTSHV

SEQ ID NO: 109082 - protein, 24 aa, Mycobacterium avium
ATVGRLSVPPAWPAANPVAPLGET

SEQ ID NO: 109083 - protein, 18 aa, Mycobacterium avium
AVAKARFVRVSPRKARRV

SEQ ID NO: 109084 - protein, 17 aa, Mycobacterium avium
AVAKRFGDKSVRSAHAV

SEQ ID NO: 109085 - protein, 20 aa, Mycobacterium avium
AVCLRLPVRTPFGFQGVFGH

SEQ ID NO: 109086 - protein, 18 aa, Mycobacterium avium
AVERPAVVPLSFAQQRLW

SEQ ID NO: 109087 - protein, 17 aa, Mycobacterium avium
AVLQRLAGYQARSVEID

SEQ ID NO: 109088 - protein, 17 aa, Mycobacterium avium
AVLWRYALRLTGDASQS

SEQ ID NO: 109089 - protein, 19 aa, Mycobacterium avium
AVRGGHPWWTLSQLSDESA

SEQ ID NO: 109090 - protein, 20 aa, Mycobacterium avium
AVRPGVVVLLNLSRDQLDRV

SEQ ID NO: 109091 - protein, 17 aa, Mycobacterium avium
AVYLRFLRDLPVHTDVN

SEQ ID NO: 109092 - protein, 20 aa, Mycobacterium avium
AWHALCWGIIIPAGWWRSGD

SEQ ID NO: 109093 - protein, 18 aa, Mycobacterium avium
AWLLRLFGFDVWWSNDAD

SEQ ID NO: 109094 - protein, 18 aa, Mycobacterium avium
AWPRPRVLCTVRLARRVL

SEQ ID NO: 109095 - protein, 25 aa, Mycobacterium avium
CDKGFPSYFLIVADLINYARSVDIR

SEQ ID NO: 109096 - protein, 24 aa, Mycobacterium avium
CGADFRLTDAAAWERFYGAPHAGS

SEQ ID NO: 109097 - protein, 17 aa, Mycobacterium avium
CIAHGGLGWVYLAVDHN

SEQ ID NO: 109098 - protein, 20 aa, Mycobacterium avium
CMDCGIPFCHNGCPLGNLIP

SEQ ID NO: 109099 - protein, 17 aa, Mycobacterium avium
CPLWVVHHAFSRPGQFL

SEQ ID NO: 109100 - protein, 18 aa, Mycobacterium avium
CQPQAAKLVEWLKLALDE

SEQ ID NO: 109101 - protein, 19 aa, Mycobacterium avium
CSIEPWIFMNWRRAAYYLY

SEQ ID NO: 109102 - protein, 18 aa, Mycobacterium avium
CSWHPGPHRLPILDDAAA

SEQ ID NO: 109103 - protein, 17 aa, Mycobacterium avium
CTAIRWGLWQDAGVVAG

SEQ ID NO: 109104 - protein, 17 aa, Mycobacterium avium
CVGVFDFYRGVADIDAG

SEQ ID NO: 109105 - protein, 21 aa, Mycobacterium avium
CYSLRIASAMAHDEGWLAEHM

SEQ ID NO: 109106 - protein, 21 aa, Mycobacterium avium
DAAARVLLLWGRRPADPSRIR

SEQ ID NO: 109107 - protein, 17 aa, Mycobacterium avium
DAFRSWRVLVSKYGTPA

SEQ ID NO: 109108 - protein, 19 aa, Mycobacterium avium
DAGMAAALWALSEQLTKTE

SEQ ID NO: 109109 - protein, 24 aa, Mycobacterium avium
DAHPRGGVELELFASVFDYAMQLT

SEQ ID NO: 109110 - protein, 24 aa, Mycobacterium avium
DALVGLCWPAVFAAIGAAATDTGV

SEQ ID NO: 109111 - protein, 25 aa, Mycobacterium avium
DDDWLIARWGCLRAANLFWGCGDVE

SEQ ID NO: 109112 - protein, 17 aa, Mycobacterium avium
DDPRWPPIPAQDFSNLP

SEQ ID NO: 109113 - protein, 20 aa, Mycobacterium avium
DEALRLGERVAVFKGGMLQQ

SEQ ID NO: 109114 - protein, 17 aa, Mycobacterium avium
DEISVLVPDDFVGAVMG

SEQ ID NO: 109115 - protein, 18 aa, Mycobacterium avium
DESLWRLLCEQVGAAALV

SEQ ID NO: 109116 - protein, 18 aa, Mycobacterium avium
DFLRSCSIKHRMASVIFS

SEQ ID NO: 109117 - protein, 23 aa, Mycobacterium avium
DFVKLAEALGCVGLRCEREEDVV

SEQ ID NO: 109118 - protein, 18 aa, Mycobacterium avium
DFWTSCPETAHLVTLVMG

SEQ ID NO: 109119 - protein, 17 aa, Mycobacterium avium
DGAVFHRVIRGFMIQGG

SEQ ID NO: 109120 - protein, 18 aa, Mycobacterium avium
DGGRAALVLGDWPADPPA

SEQ ID NO: 109121 - protein, 17 aa, Mycobacterium avium
DGIGLDEYVDWLIEAGY

SEQ ID NO: 109122 - protein, 22 aa, Mycobacterium avium
DGIGLDEYVDWLIEAGYPIERV

SEQ ID NO: 109123 - protein, 22 aa, Mycobacterium avium
DGIGLDEYVDWLVDAGYSIERI

SEQ ID NO: 109124 - protein, 24 aa, Mycobacterium avium
DGPLAGTVRFEWDPLRWFEEDEPI

SEQ ID NO: 109125 - protein, 19 aa, Mycobacterium avium
DGRCSAGFAALLDAIVEAL

SEQ ID NO: 109126 - protein, 17 aa, Mycobacterium avium
DGSCPDCTRGAFRADRP

SEQ ID NO: 109127 - protein, 23 aa, Mycobacterium avium
DGSPASNFAVCWAARDAAMRNVP

SEQ ID NO: 109128 - protein, 17 aa, Mycobacterium avium
DGTFEWNQSLFGYNFGD

SEQ ID NO: 109129 - protein, 23 aa, Mycobacterium avium
DGTRAGLWDGLRTAFNTTRALSV

SEQ ID NO: 109130 - protein, 19 aa, Mycobacterium avium
DHAAICWPLLVGMAKAKYY

SEQ ID NO: 109131 - protein, 22 aa, Mycobacterium avium
DIAEVLALLGVRPVWDDASRRV

SEQ ID NO: 109132 - protein, 23 aa, Mycobacterium avium
DISAKKNEPGWMLQTRLKALRIF

SEQ ID NO: 109133 - protein, 24 aa, Mycobacterium avium
DLARRGRHRPVWIKGFGEHIAFKT

SEQ ID NO: 109134 - protein, 23 aa, Mycobacterium avium
DLRAEGFAGIATRNQRMVDRGAD

SEQ ID NO: 109135 - protein, 20 aa, Mycobacterium avium
DLSRFYVRFGRYEMKNSGAF

SEQ ID NO: 109136 - protein, 20 aa, Mycobacterium avium
DLYFNLSLWSAYDVMLMHTV

SEQ ID NO: 109137 - protein, 24 aa, Mycobacterium avium
DMIRFGSLFLREGVSLTGRRVLPE

SEQ ID NO: 109138 - protein, 18 aa, Mycobacterium avium
DMLKYYAGWVGKIHGESA

SEQ ID NO: 109139 - protein, 23 aa, Mycobacterium avium
DPALPAARMEFMLGDATPIAAVT

SEQ ID NO: 109140 - protein, 17 aa, Mycobacterium avium
DPAVAPWIHRGLTSQDV

SEQ ID NO: 109141 - protein, 18 aa, Mycobacterium avium
DPELRRPITELGMVKSID

SEQ ID NO: 109142 - protein, 21 aa, Mycobacterium avium
DPGSVSYLFSRKGVVTCEKNG

SEQ ID NO: 109143 - protein, 19 aa, Mycobacterium avium
DPKKAVLFDDRWASAREDL

SEQ ID NO: 109144 - protein, 21 aa, Mycobacterium avium
DPLSEIWFLLTGQTTLPTSLG

SEQ ID NO: 109145 - protein, 21 aa, Mycobacterium avium
DPRLELVGVYAFSEEKAGSDA

SEQ ID NO: 109146 - protein, 17 aa, Mycobacterium avium
DPRRPVSVTARRVGCWR

SEQ ID NO: 109147 - protein, 21 aa, Mycobacterium avium
DPVKLRLGIGYVIQHAGLMPH

SEQ ID NO: 109148 - protein, 22 aa, Mycobacterium avium
DQAALDWHNFVAFRGRELAPEG

SEQ ID NO: 109149 - protein, 17 aa, Mycobacterium avium
DQPRWADGLPYFVRDGN

SEQ ID NO: 109150 - protein, 18 aa, Mycobacterium avium
DQRRPGCALGEFHEVDLA

SEQ ID NO: 109151 - protein, 19 aa, Mycobacterium avium
DRAIAAWLWSGRRAVVAGN

SEQ ID NO: 109152 - protein, 20 aa, Mycobacterium avium
DRCRGWRMCVSGCPYKKVYF

SEQ ID NO: 109153 - protein, 21 aa, Mycobacterium avium
DRPRIFDLFDRILKALAPDAH

SEQ ID NO: 109154 - protein, 17 aa, Mycobacterium avium
DRVKCLHVLIAHSLAKG

SEQ ID NO: 109155 - protein, 19 aa, Mycobacterium avium
DRVRFVPGWFKDTLQDAPI

SEQ ID NO: 109156 - protein, 18 aa, Mycobacterium avium
DRWYWHWDPQFISGTAAF

SEQ ID NO: 109157 - protein, 27 aa, Mycobacterium avium
DSHCAMASQFTLYALGAGGGGTSGPGA

SEQ ID NO: 109158 - protein, 20 aa, Mycobacterium avium
DSLDCFFVYLARHPQHRRQL

SEQ ID NO: 109159 - protein, 23 aa, Mycobacterium avium
DTPRFAVAHAVRFDRLVSGADPD

SEQ ID NO: 109160 - protein, 18 aa, Mycobacterium avium
DVDRIVVHLAPWLEPEPI

SEQ ID NO: 109161 - protein, 17 aa, Mycobacterium avium
DVLQGQCTFSWPPRIHL

SEQ ID NO: 109162 - protein, 19 aa, Mycobacterium avium
DVPSLGWRAYRLVAGEAAS

SEQ ID NO: 109163 - protein, 22 aa, Mycobacterium avium
DVTKRLSAPVGIRADCLGVQDP

SEQ ID NO: 109164 - protein, 25 aa, Mycobacterium avium
DVVRRARFAAAFTFQYSKRPGTPAA

SEQ ID NO: 109165 - protein, 19 aa, Mycobacterium avium
EADLARFPADVARVVVRLI

SEQ ID NO: 109166 - protein, 18 aa, Mycobacterium avium
EAECAQWVAEQLAAVGYA

SEQ ID NO: 109167 - protein, 19 aa, Mycobacterium avium
EAFDRWGLIPRMFVGAAER

SEQ ID NO: 109168 - protein, 17 aa, Mycobacterium avium
EAFKRWGLYPRMGIAPE

SEQ ID NO: 109169 - protein, 24 aa, Mycobacterium avium
EAGPSGRFRPLWAHNRSEERKALT

SEQ ID NO: 109170 - protein, 21 aa, Mycobacterium avium
EARRYPAIMAMTSLNDTRVYY

SEQ ID NO: 109171 - protein, 17 aa, Mycobacterium avium
EATRAALQWAMSVAAQR

SEQ ID NO: 109172 - protein, 18 aa, Mycobacterium avium
ECPPCLVYLQQMLDLKIL

SEQ ID NO: 109173 - protein, 19 aa, Mycobacterium avium
EDASPAFLGFNLFQHAIAR

SEQ ID NO: 109174 - protein, 20 aa, Mycobacterium avium
EDRLRTRFEWGLITDVQPPE

SEQ ID NO: 109175 - protein, 19 aa, Mycobacterium avium
EEGNLWFEWSRSLDDPAEY

SEQ ID NO: 109176 - protein, 19 aa, Mycobacterium avium
EELARYGVQPDWFGLGDRD

SEQ ID NO: 109177 - protein, 18 aa, Mycobacterium avium
EFRCARCAKPYTGELPAM

SEQ ID NO: 109178 - protein, 20 aa, Mycobacterium avium
EFWAFDLLYLDGRSLLRARY

SEQ ID NO: 109179 - protein, 19 aa, Mycobacterium avium
EGFLPTLLDWCRRNDVLFI

SEQ ID NO: 109180 - protein, 17 aa, Mycobacterium avium
EGFPEMRVAVIPREQIS

SEQ ID NO: 109181 - protein, 19 aa, Mycobacterium avium
EGLLNYLALLGWAIADDRD

SEQ ID NO: 109182 - protein, 22 aa, Mycobacterium avium
EGRALARICALNALAAVDALVG

SEQ ID NO: 109183 - protein, 20 aa, Mycobacterium avium
EGRARLDFRGEFYTHTIMAP

SEQ ID NO: 109184 - protein, 17 aa, Mycobacterium avium
EGRFALYSVADAHDDAS

SEQ ID NO: 109185 - protein, 23 aa, Mycobacterium avium
EGRGCARVEYKLRDWLFARQRYW

SEQ ID NO: 109186 - protein, 20 aa, Mycobacterium avium
EGVNLTFLPFIARAVIDALK

SEQ ID NO: 109187 - protein, 19 aa, Mycobacterium avium
EHPAGSVLIEFGHTKVMCT

SEQ ID NO: 109188 - protein, 19 aa, Mycobacterium avium
EIARLVPFIEWLRDAYPDQ

SEQ ID NO: 109189 - protein, 19 aa, Mycobacterium avium
EICDGWLPIFYTPRLADMY

SEQ ID NO: 109190 - protein, 19 aa, Mycobacterium avium
EICSRFIRQPGYRFVELPD

SEQ ID NO: 109191 - protein, 18 aa, Mycobacterium avium
EIPDHYRLYVSQKLARLE

SEQ ID NO: 109192 - protein, 20 aa, Mycobacterium avium
EIWRFTPLRRLRGLHDGSAP

SEQ ID NO: 109193 - protein, 19 aa, Mycobacterium avium
EIYRLSFATIRAEADLARF

SEQ ID NO: 109194 - protein, 18 aa, Mycobacterium avium
EKFWDWADCDGHPENALS

SEQ ID NO: 109195 - protein, 20 aa, Mycobacterium avium
EKLGFCRELGADITINYRDE

SEQ ID NO: 109196 - protein, 21 aa, Mycobacterium avium
EKRLGPAVFRDMLGLHFCSTR

SEQ ID NO: 109197 - protein, 23 aa, Mycobacterium avium
EKTLRFWLERGVDGFRIDVAHGM

SEQ ID NO: 109198 - protein, 19 aa, Mycobacterium avium
ELAECPRLSYSLDEACLLI

SEQ ID NO: 109199 - protein, 23 aa, Mycobacterium avium
ELARANGWAGLIVNGAVRDSAAL

SEQ ID NO: 109200 - protein, 19 aa, Mycobacterium avium
ELELPLCVNTGIPGPPIPG

SEQ ID NO: 109201 - protein, 20 aa, Mycobacterium avium
ELGQPLPLFIKWDDAEYGLR

SEQ ID NO: 109202 - protein, 18 aa, Mycobacterium avium
ELLDRLGAHLTRHVGPGV

SEQ ID NO: 109203 - protein, 22 aa, Mycobacterium avium
ELLEPRLSPGVLVVADNTSAAD

SEQ ID NO: 109204 - protein, 19 aa, Mycobacterium avium
ELLGCVSGALGLRKFFEDG

SEQ ID NO: 109205 - protein, 25 aa, Mycobacterium avium
ELPAGSMLVPFSWQRVSLHAAGAAA

SEQ ID NO: 109206 - protein, 26 aa, Mycobacterium avium
ELQRRGCPVRHLILLDALLVIPSSDA

SEQ ID NO: 109207 - protein, 22 aa, Mycobacterium avium
ELRLKGPQCFLGYADPTLDADA

SEQ ID NO: 109208 - protein, 21 aa, Mycobacterium avium
ELRRTAGRLADWVHAHGDLAL

SEQ ID NO: 109209 - protein, 20 aa, Mycobacterium avium
ELRSVWSGFMQKWIDQTAAM

SEQ ID NO: 109210 - protein, 18 aa, Mycobacterium avium
ELTLAWQRLVPWPDVLPG

SEQ ID NO: 109211 - protein, 19 aa, Mycobacterium avium
ELTSADWFGPSSMSMLAAV

SEQ ID NO: 109212 - protein, 19 aa, Mycobacterium avium
ELVDGFPRFDVDDVYLGNG

SEQ ID NO: 109213 - protein, 19 aa, Mycobacterium avium
EMNEAFAAIAIKIQQYFGI

SEQ ID NO: 109214 - protein, 19 aa, Mycobacterium avium
EPACDGWSPPAIQMPADLP

SEQ ID NO: 109215 - protein, 23 aa, Mycobacterium avium
EPFDAVVCSLVLCSVRDPQNVLR

SEQ ID NO: 109216 - protein, 22 aa, Mycobacterium avium
EPGIYFPGRWGARIEDIVVVTD

SEQ ID NO: 109217 - protein, 18 aa, Mycobacterium avium
EPHTAWATGMPAVASAGR

SEQ ID NO: 109218 - protein, 19 aa, Mycobacterium avium
EPLLFEWTDRDTLLYALGV

SEQ ID NO: 109219 - protein, 21 aa, Mycobacterium avium
EPRHARFERFLSFGDVCEQIR

SEQ ID NO: 109220 - protein, 21 aa, Mycobacterium avium
EPRLAATVARGLKAEGFVVVT

SEQ ID NO: 109221 - protein, 17 aa, Mycobacterium avium
ERALICFGGTDVRGVPR

SEQ ID NO: 109222 - protein, 21 aa, Mycobacterium avium
ERAMREWARLDPVAAENIRAA

SEQ ID NO: 109223 - protein, 18 aa, Mycobacterium avium
ERDGWQPGGIVVVGAHSD

SEQ ID NO: 109224 - protein, 20 aa, Mycobacterium avium
EREGLQIPLLIGGATTSRAH

SEQ ID NO: 109225 - protein, 19 aa, Mycobacterium avium
ERRRGVVVNPVLETSEIPE

SEQ ID NO: 109226 - protein, 24 aa, Mycobacterium avium
ERTRACGYRRLYLITGNRQPEAEA

SEQ ID NO: 109227 - protein, 18 aa, Mycobacterium avium
ESGLKVARKWGAEVKGVP

SEQ ID NO: 109228 - protein, 23 aa, Mycobacterium avium
ESGWIRTWLDTVLELPWNVRTDD

SEQ ID NO: 109229 - protein, 19 aa, Mycobacterium avium
ESKRFCWNCGKPVGRSTKK

SEQ ID NO: 109230 - protein, 17 aa, Mycobacterium avium
ETFPELRLLVLNEPLAT

SEQ ID NO: 109231 - protein, 23 aa, Mycobacterium avium
EVGLPMRCVFALTAMGFLPQSPD

SEQ ID NO: 109232 - protein, 18 aa, Mycobacterium avium
EVMEVLLAQCVQADAAVA

SEQ ID NO: 109233 - protein, 23 aa, Mycobacterium avium
EVPMKRFDLMNGIQVRGTYAVSQ

SEQ ID NO: 109234 - protein, 19 aa, Mycobacterium avium
EVPPVVVVPYFWSDQYDVK

SEQ ID NO: 109235 - protein, 28 aa, Mycobacterium avium
EVYERIKPAFKHWAAVVIHAGEPGAGTR

SEQ ID NO: 109236 - protein, 20 aa, Mycobacterium avium
FADFPVLHWKKIWSTNPLER

SEQ ID NO: 109237 - protein, 18 aa, Mycobacterium avium
FAELFLPAPLRWLVGATR

SEQ ID NO: 109238 - protein, 17 aa, Mycobacterium avium
FAIGAVLSMHFAKQAAR

SEQ ID NO: 109239 - protein, 25 aa, Mycobacterium avium
FAVELDWRSRLGGWGLMSNAAHPGL

SEQ ID NO: 109240 - protein, 19 aa, Mycobacterium avium
FAVGPFASMLDRARDLIGR

SEQ ID NO: 109241 - protein, 17 aa, Mycobacterium avium
FCVGGGIGLVGNSDVIV

SEQ ID NO: 109242 - protein, 18 aa, Mycobacterium avium
FDDLRIGIELSPRQVWTQ

SEQ ID NO: 109243 - protein, 18 aa, Mycobacterium avium
FDLARLGEWATRITSFPA

SEQ ID NO: 109244 - protein, 19 aa, Mycobacterium avium
FDPLIFFRPRVERLFEFHY

SEQ ID NO: 109245 - protein, 17 aa, Mycobacterium avium
FGMFAFAIVERDSGRVL

SEQ ID NO: 109246 - protein, 24 aa, Mycobacterium avium
FGSRGGLLGHVWLRAGKRYLSFQR

SEQ ID NO: 109247 - protein, 19 aa, Mycobacterium avium
FGTAIAAGFVFPFTQNFVD

SEQ ID NO: 109248 - protein, 21 aa, Mycobacterium avium
FHPGRLHACLDLLLDGVIRTR

SEQ ID NO: 109249 - protein, 17 aa, Mycobacterium avium
FHRVIRGFMIQGGDPTG

SEQ ID NO: 109250 - protein, 17 aa, Mycobacterium avium
FIAQSVWRRMGDEFLAE

SEQ ID NO: 109251 - protein, 17 aa, Mycobacterium avium
FISVEGFRALLLLNDEL

SEQ ID NO: 109252 - protein, 17 aa, Mycobacterium avium
FLPDSWKAAASRVNSTP

SEQ ID NO: 109253 - protein, 19 aa, Mycobacterium avium
FLPPDSWGNHEWDTMTAMP

SEQ ID NO: 109254 - protein, 20 aa, Mycobacterium avium
FLTCDARLAVTLPPGLADDQ

SEQ ID NO: 109255 - protein, 21 aa, Mycobacterium avium
FLTTRLDRRWGGAFGTMPDGL

SEQ ID NO: 109256 - protein, 17 aa, Mycobacterium avium
FLVAEAGGDPWSIDSGL

SEQ ID NO: 109257 - protein, 20 aa, Mycobacterium avium
FMDLPGFDAWLARWRALGPD

SEQ ID NO: 109258 - protein, 17 aa, Mycobacterium avium
FNLSWSIEGTRSRTGKM

SEQ ID NO: 109259 - protein, 20 aa, Mycobacterium avium
FPGLEVCVYAAPSQTVIGGP

SEQ ID NO: 109260 - protein, 19 aa, Mycobacterium avium
FPHAVRWKGITYLEDGLHR

SEQ ID NO: 109261 - protein, 20 aa, Mycobacterium avium
FPINLLGVWAQLATAQGVAS

SEQ ID NO: 109262 - protein, 22 aa, Mycobacterium avium
FPMTSCISGWAMLNRDAAVIPD

SEQ ID NO: 109263 - protein, 19 aa, Mycobacterium avium
FPNLFATHRVRAVDDYAAH

SEQ ID NO: 109264 - protein, 21 aa, Mycobacterium avium
FPPVELFMQLPWRTEIVKGLL

SEQ ID NO: 109265 - protein, 17 aa, Mycobacterium avium
FPRLMVYRGPRRKGVRY

SEQ ID NO: 109266 - protein, 21 aa, Mycobacterium avium
FPTTMRLTGRWLRGRLPTAYD

SEQ ID NO: 109267 - protein, 18 aa, Mycobacterium avium
FPYAWPRKPVLADNVVCT

SEQ ID NO: 109268 - protein, 19 aa, Mycobacterium avium
FRECAARALLLPRRHPGRR

SEQ ID NO: 109269 - protein, 18 aa, Mycobacterium avium
FRFVEEMIRLGADARTDG

SEQ ID NO: 109270 - protein, 23 aa, Mycobacterium avium
FRPDLDVDLVYRFIRDTTWVSVR

SEQ ID NO: 109271 - protein, 17 aa, Mycobacterium avium
FRPPTAVGHTGELVSMR

SEQ ID NO: 109272 - protein, 21 aa, Mycobacterium avium
FSAAPLRWAEWLSDSQATFTA

SEQ ID NO: 109273 - protein, 19 aa, Mycobacterium avium
FSEPMYGFRPRIIGRPPAA

SEQ ID NO: 109274 - protein, 20 aa, Mycobacterium avium
FSLRVLHSFLTDPGRPPRTG

SEQ ID NO: 109275 - protein, 20 aa, Mycobacterium avium
FSNDHVTAWATPSAPEGPDD

SEQ ID NO: 109276 - protein, 22 aa, Mycobacterium avium
FSPRMREVIILRVAHLQDSPYE

SEQ ID NO: 109277 - protein, 23 aa, Mycobacterium avium
FTVPEFRRKAVIIAVGGVYDPRI

SEQ ID NO: 109278 - protein, 17 aa, Mycobacterium avium
FVEAGLPPGVFQVVHGD

SEQ ID NO: 109279 - protein, 19 aa, Mycobacterium avium
FVEVHWSRWGEAYVTPVEP

SEQ ID NO: 109280 - protein, 22 aa, Mycobacterium avium
FVRRGRKAPGFFVRSADNRYLL

SEQ ID NO: 109281 - protein, 18 aa, Mycobacterium avium
GACRQCLVEVEGQRKPMA

SEQ ID NO: 109282 - protein, 23 aa, Mycobacterium avium
GADWPRLVAPVFDPKKAVLFDDR

SEQ ID NO: 109283 - protein, 18 aa, Mycobacterium avium
GAFNYAWLNLRKDRQVDL

SEQ ID NO: 109284 - protein, 21 aa, Mycobacterium avium
GAGLARYACGLGMTVVLADID

SEQ ID NO: 109285 - protein, 19 aa, Mycobacterium avium
GAIVKRPRVIVDEFGNESI

SEQ ID NO: 109286 - protein, 18 aa, Mycobacterium avium
GALERIWSKDRPDVVHAY

SEQ ID NO: 109287 - protein, 17 aa, Mycobacterium avium
GALIGFLGPRVYQQLYG

SEQ ID NO: 109288 - protein, 23 aa, Mycobacterium avium
GALKNVFAIAVGMGYSLGIGENT

SEQ ID NO: 109289 - protein, 23 aa, Mycobacterium avium
GALSEWRATLIVRESACLDAEDR

SEQ ID NO: 109290 - protein, 22 aa, Mycobacterium avium
GANLRAAWLTMIAVASTHQGKG

SEQ ID NO: 109291 - protein, 19 aa, Mycobacterium avium
GASGWCTAAPCLRPQPCID

SEQ ID NO: 109292 - protein, 18 aa, Mycobacterium avium
GATLRFAPPLVVTAQEID

SEQ ID NO: 109293 - protein, 25 aa, Mycobacterium avium
GATLRRAALVVPRYGVRITVMARPP

SEQ ID NO: 109294 - protein, 17 aa, Mycobacterium avium
GATPGWECALGGLDQEC

SEQ ID NO: 109295 - protein, 19 aa, Mycobacterium avium
GAVGYACSVVEKFGDSLVV

SEQ ID NO: 109296 - protein, 21 aa, Mycobacterium avium
GCAGLRYNLFFDDRSLDGDLT

SEQ ID NO: 109297 - protein, 18 aa, Mycobacterium avium
GCKRPGFHNGYLATFNRD

SEQ ID NO: 109298 - protein, 18 aa, Mycobacterium avium
GCQPWQLTPDAVPPPSAP

SEQ ID NO: 109299 - protein, 17 aa, Mycobacterium avium
GCSHPGCDVSGYSCEVH

SEQ ID NO: 109300 - protein, 18 aa, Mycobacterium avium
GCTAPGCTVPGYYSEVHH

SEQ ID NO: 109301 - protein, 17 aa, Mycobacterium avium
GDGGFGYDPVFVPDDAG

SEQ ID NO: 109302 - protein, 19 aa, Mycobacterium avium
GDGWRLAMDLLPYERSSCF

SEQ ID NO: 109303 - protein, 18 aa, Mycobacterium avium
GDLAWAFVDSYVRASGDD

SEQ ID NO: 109304 - protein, 21 aa, Mycobacterium avium
GDLRTGMMGVWIGAIQNMYPE

SEQ ID NO: 109305 - protein, 19 aa, Mycobacterium avium
GEAAVSLYLAERGFTTVGL

SEQ ID NO: 109306 - protein, 22 aa, Mycobacterium avium
GEGGGGLVCRWCGRVDPTRRCA

SEQ ID NO: 109307 - protein, 20 aa, Mycobacterium avium
GELPNLRAIVGFAAETGDAN

SEQ ID NO: 109308 - protein, 17 aa, Mycobacterium avium
GFARYWLHNGWVTMGGE

SEQ ID NO: 109309 - protein, 21 aa, Mycobacterium avium
GFLLTFLACFDVGDRVAVASP

SEQ ID NO: 109310 - protein, 19 aa, Mycobacterium avium
GFQRRACAALERGHGVLVC

SEQ ID NO: 109311 - protein, 19 aa, Mycobacterium avium
GFRMPSVWLAEGHARVAPV

SEQ ID NO: 109312 - protein, 17 aa, Mycobacterium avium
GGAFGIKLARPHAPVVA

SEQ ID NO: 109313 - protein, 18 aa, Mycobacterium avium
GGALAYACAIGLKRAGAD

SEQ ID NO: 109314 - protein, 17 aa, Mycobacterium avium
GGASILMRAVLSAYGDE

SEQ ID NO: 109315 - protein, 18 aa, Mycobacterium avium
GGFELAYRLLSYPKPVVM

SEQ ID NO: 109316 - protein, 18 aa, Mycobacterium avium
GGKALRPALSIATCLGLG

SEQ ID NO: 109317 - protein, 17 aa, Mycobacterium avium
GGKRLDPGFFYAPTLLT

SEQ ID NO: 109318 - protein, 17 aa, Mycobacterium avium
GGLPWDAVFAAEMAGVF

SEQ ID NO: 109319 - protein, 17 aa, Mycobacterium avium
GGPHFLPFGAATVGSDT

SEQ ID NO: 109320 - protein, 24 aa, Mycobacterium avium
GGRLRLCVGVGWLQEELRACGADF

SEQ ID NO: 109321 - protein, 17 aa, Mycobacterium avium
GGVGKTWQPGDFDQLID

SEQ ID NO: 109322 - protein, 19 aa, Mycobacterium avium
GGVRAGHRLKFWTPGGSST

SEQ ID NO: 109323 - protein, 20 aa, Mycobacterium avium
GHIARACARAGARLLHVSTD

SEQ ID NO: 109324 - protein, 24 aa, Mycobacterium avium
GHPARPRLINMYGITETTVHASFR

SEQ ID NO: 109325 - protein, 23 aa, Mycobacterium avium
GHRKGFLQFRWQRVSRQLTEADG

SEQ ID NO: 109326 - protein, 23 aa, Mycobacterium avium
GHRWEWSDAVARMHGYRPGQVQP

SEQ ID NO: 109327 - protein, 23 aa, Mycobacterium avium
GHYGGLFIRMSWHAAGTYRIHDG

SEQ ID NO: 109328 - protein, 20 aa, Mycobacterium avium
GIDNWRWAGVPVYLRTGKRM

SEQ ID NO: 109329 - protein, 21 aa, Mycobacterium avium
GKAEKCTLCYPRMEVGLPTIC

SEQ ID NO: 109330 - protein, 18 aa, Mycobacterium avium
GKAGCSTYKWETFLTSEL

SEQ ID NO: 109331 - protein, 23 aa, Mycobacterium avium
GKHAASAFALWFPIEGEVDYGQA

SEQ ID NO: 109332 - protein, 17 aa, Mycobacterium avium
GKIRVAEGWAHGPQIDK

SEQ ID NO: 109333 - protein, 21 aa, Mycobacterium avium
GKRYALPHARILMHQPLGGVT

SEQ ID NO: 109334 - protein, 20 aa, Mycobacterium avium
GLAALPARIAVRWRHIHEFE

SEQ ID NO: 109335 - protein, 23 aa, Mycobacterium avium
GLAGLRVGYAIGHPELITALDKV

SEQ ID NO: 109336 - protein, 21 aa, Mycobacterium avium
GLCAMGLRFSEDWTSPRERFT

SEQ ID NO: 109337 - protein, 19 aa, Mycobacterium avium
GLDGGRWGAAPLRPRERAR

SEQ ID NO: 109338 - protein, 21 aa, Mycobacterium avium
GLGVLLCFAGRVLQPLGLSKV

SEQ ID NO: 109339 - protein, 20 aa, Mycobacterium avium
GLIAPHWPKPWGLDAGPLRQ

SEQ ID NO: 109340 - protein, 20 aa, Mycobacterium avium
GLSCAGLVIGAWPEHPGPVE

SEQ ID NO: 109341 - protein, 17 aa, Mycobacterium avium
GMSRWLPYLSELQPEMF

SEQ ID NO: 109342 - protein, 17 aa, Mycobacterium avium
GMWLYRLSLAKAKWHAL

SEQ ID NO: 109343 - protein, 17 aa, Mycobacterium avium
GNCPLWVVHHAFSRPGQ

SEQ ID NO: 109344 - protein, 18 aa, Mycobacterium avium
GNLRARFNIALGIGSSGF

SEQ ID NO: 109345 - protein, 17 aa, Mycobacterium avium
GNRRWARDAGYDDVSYG

SEQ ID NO: 109346 - protein, 28 aa, Mycobacterium avium
GPASWTDVCLRPGDVLYLPRGQVHSART

SEQ ID NO: 109347 - protein, 21 aa, Mycobacterium avium
GPEPYCPVGISPLFETIEDLH

SEQ ID NO: 109348 - protein, 21 aa, Mycobacterium avium
GPSMVRWARENGWSAAPGAGA

SEQ ID NO: 109349 - protein, 18 aa, Mycobacterium avium
GPTRDWECYCGKYKRVRF

SEQ ID NO: 109350 - protein, 18 aa, Mycobacterium avium
GQRPADDVYLVFTTNEEI

SEQ ID NO: 109351 - protein, 22 aa, Mycobacterium avium
GRAPRPGERFRLPAHADTLEAI

SEQ ID NO: 109352 - protein, 17 aa, Mycobacterium avium
GRARLCCLMLARAPAPG

SEQ ID NO: 109353 - protein, 17 aa, Mycobacterium avium
GRFTLAVGVGYLKREFA

SEQ ID NO: 109354 - protein, 24 aa, Mycobacterium avium
GRGFPFALVFGGLYAARGYHVVLQ

SEQ ID NO: 109355 - protein, 19 aa, Mycobacterium avium
GRIKDLLIVYGRNHSPDDI

SEQ ID NO: 109356 - protein, 19 aa, Mycobacterium avium
GRIKLAWFLLNAARYMPVL

SEQ ID NO: 109357 - protein, 24 aa, Mycobacterium avium
GRLALGVGPSHHWIIRDMLGLPYQ

SEQ ID NO: 109358 - protein, 18 aa, Mycobacterium avium
GRLAPRARVVLCGVISSY

SEQ ID NO: 109359 - protein, 18 aa, Mycobacterium avium
GRLRWRWLAGCDARPVDS

SEQ ID NO: 109360 - protein, 20 aa, Mycobacterium avium
GRMHGYWALHEGCLQLRGDA

SEQ ID NO: 109361 - protein, 18 aa, Mycobacterium avium
GRMLWSLPKGHIELGETA

SEQ ID NO: 109362 - protein, 17 aa, Mycobacterium avium
GRPFLAFLYGIAAHKVA

SEQ ID NO: 109363 - protein, 17 aa, Mycobacterium avium
GRPVLVGGLGGRGVVAG

SEQ ID NO: 109364 - protein, 19 aa, Mycobacterium avium
GRSGYRFGHIEGPMQVQHH

SEQ ID NO: 109365 - protein, 18 aa, Mycobacterium avium
GRSVSRWGAFIDDVAGFD

SEQ ID NO: 109366 - protein, 17 aa, Mycobacterium avium
GRTPAQVLVRWNLQLDN

SEQ ID NO: 109367 - protein, 18 aa, Mycobacterium avium
GRWLRPGGLIGIEHDDTT

SEQ ID NO: 109368 - protein, 21 aa, Mycobacterium avium
GSDRRLRVIGVTWNDEASVPA

SEQ ID NO: 109369 - protein, 17 aa, Mycobacterium avium
GSEELRAGIGINTGAVA

SEQ ID NO: 109370 - protein, 22 aa, Mycobacterium avium
GSRDAKARWLPPLVSGSMRATT

SEQ ID NO: 109371 - protein, 23 aa, Mycobacterium avium
GTLQRLAALQGRRVDALTEEEPG

SEQ ID NO: 109372 - protein, 18 aa, Mycobacterium avium
GVLPLLERMGLWRHPNRR

SEQ ID NO: 109373 - protein, 18 aa, Mycobacterium avium
GVLPRLARQGYLPGELAD

SEQ ID NO: 109374 - protein, 19 aa, Mycobacterium avium
GVPGIWYAGSHGFELTAPD

SEQ ID NO: 109375 - protein, 18 aa, Mycobacterium avium
GVRDVVLCPGSRNAPLAF

SEQ ID NO: 109376 - protein, 17 aa, Mycobacterium avium
GVTWGVIQYHFGDRNGL

SEQ ID NO: 109377 - protein, 19 aa, Mycobacterium avium
GVVLLMWAGILAYLDRYGY

SEQ ID NO: 109378 - protein, 19 aa, Mycobacterium avium
GVVRLDYEVPLLLSALSPR

SEQ ID NO: 109379 - protein, 17 aa, Mycobacterium avium
GVWRGGASILMRAVLSA

SEQ ID NO: 109380 - protein, 18 aa, Mycobacterium avium
GWHPKWTLEDGLRALLEW

SEQ ID NO: 109381 - protein, 19 aa, Mycobacterium avium
GYAPRLWRYWAEHLDPDRA

SEQ ID NO: 109382 - protein, 18 aa, Mycobacterium avium
GYHGWTWDLAGALKRVPD

SEQ ID NO: 109383 - protein, 24 aa, Mycobacterium avium
GYWRRPGLTAARFLACPFGEPGTR

SEQ ID NO: 109384 - protein, 20 aa, Mycobacterium avium
HAAKGLEWDAVFLVGLADGT

SEQ ID NO: 109385 - protein, 20 aa, Mycobacterium avium
HAGYMFKLWDQLVWGSTLVV

SEQ ID NO: 109386 - protein, 20 aa, Mycobacterium avium
HAKGAGAYGRFEVTADVSEY

SEQ ID NO: 109387 - protein, 21 aa, Mycobacterium avium
HAVAVTCGRRSWTYRELDSSA

SEQ ID NO: 109388 - protein, 17 aa, Mycobacterium avium
HDILAFERQWWKFAGVK

SEQ ID NO: 109389 - protein, 22 aa, Mycobacterium avium
HDRLRLALLLCAVRPEIGGALI

SEQ ID NO: 109390 - protein, 20 aa, Mycobacterium avium
HDTFCPVGPWIVTDLNPLDP

SEQ ID NO: 109391 - protein, 19 aa, Mycobacterium avium
HEGSLRFGDKVVLGRDNVI

SEQ ID NO: 109392 - protein, 18 aa, Mycobacterium avium
HGWCWSLDGRNTFVLRPE

SEQ ID NO: 109393 - protein, 22 aa, Mycobacterium avium
HGWQWCAGCGTDAAPYFRVFNP

SEQ ID NO: 109394 - protein, 22 aa, Mycobacterium avium
HLAAELMGRFAFDRPGLAAISL

SEQ ID NO: 109395 - protein, 18 aa, Mycobacterium avium
HLRRHKWTRLGAYAQSKL

SEQ ID NO: 109396 - protein, 19 aa, Mycobacterium avium
HLTALCWDGGAALPFNADD

SEQ ID NO: 109397 - protein, 17 aa, Mycobacterium avium
HPGCDVSGYSCEVHHVT

SEQ ID NO: 109398 - protein, 19 aa, Mycobacterium avium
HPRYELIPQLIVHDGEAAV

SEQ ID NO: 109399 - protein, 18 aa, Mycobacterium avium
HRAMLEAFAQWRANTRGA

SEQ ID NO: 109400 - protein, 18 aa, Mycobacterium avium
HRMMRWFGPIIHEYYGGT

SEQ ID NO: 109401 - protein, 19 aa, Mycobacterium avium
HSLARLAIRDDIYASLRSL

SEQ ID NO: 109402 - protein, 17 aa, Mycobacterium avium
HTPWFHWGTTAVVARLV

SEQ ID NO: 109403 - protein, 23 aa, Mycobacterium avium
HVMYKPRWGAFYGTKLEQHLRES

SEQ ID NO: 109404 - protein, 23 aa, Mycobacterium avium
IAASWRLPVVFVVQNVRGGPDAR

SEQ ID NO: 109405 - protein, 21 aa, Mycobacterium avium
IACSACYWAQALVLGVDLNMP

SEQ ID NO: 109406 - protein, 19 aa, Mycobacterium avium
IAEQLPRKVAMRLLLTGEP

SEQ ID NO: 109407 - protein, 19 aa, Mycobacterium avium
IAKALRWQFDGVDRVGPDL

SEQ ID NO: 109408 - protein, 20 aa, Mycobacterium avium
IATAKAAIWAGLASPVMIWS

SEQ ID NO: 109409 - protein, 19 aa, Mycobacterium avium
IAWQTYRIINWTIRTLRFI

SEQ ID NO: 109410 - protein, 18 aa, Mycobacterium avium
IDATHAWAAVWTPHEPGQ

SEQ ID NO: 109411 - protein, 17 aa, Mycobacterium avium
IDAVLARAARIGPMSVP

SEQ ID NO: 109412 - protein, 17 aa, Mycobacterium avium
IDLRDDWPAALRRVGFD

SEQ ID NO: 109413 - protein, 20 aa, Mycobacterium avium
IEEKRMFGGLAFLLNGNMSV

SEQ ID NO: 109414 - protein, 19 aa, Mycobacterium avium
IERFLQLWAEGSMTIAMPS

SEQ ID NO: 109415 - protein, 17 aa, Mycobacterium avium
IERWKALIVETGAVRLI

SEQ ID NO: 109416 - protein, 17 aa, Mycobacterium avium
IGPALEDWAKWGQARHD

SEQ ID NO: 109417 - protein, 18 aa, Mycobacterium avium
IGPFRVRIPLLLSADDGH

SEQ ID NO: 109418 - protein, 19 aa, Mycobacterium avium
IGVDGYRWMIRCVVNGTHE

SEQ ID NO: 109419 - protein, 18 aa, Mycobacterium avium
IHLEGPWLSRARCGAHDA

SEQ ID NO: 109420 - protein, 18 aa, Mycobacterium avium
IICPPLFLQYAILGVSRL

SEQ ID NO: 109421 - protein, 19 aa, Mycobacterium avium
IINGAKTWSTWAFAADYGL

SEQ ID NO: 109422 - protein, 21 aa, Mycobacterium avium
ILAFERQWWKFAGVKEDAIKE

SEQ ID NO: 109423 - protein, 18 aa, Mycobacterium avium
ILANRLFPALTFGGSNLN

SEQ ID NO: 109424 - protein, 19 aa, Mycobacterium avium
ILQELPLLLQVGLSLSITS

SEQ ID NO: 109425 - protein, 17 aa, Mycobacterium avium
ILRVAVWELLYADDVPE

SEQ ID NO: 109426 - protein, 19 aa, Mycobacterium avium
ILSEAGWYSALFGMQHETS

SEQ ID NO: 109427 - protein, 17 aa, Mycobacterium avium
INELLNWQVAAAGEDIN

SEQ ID NO: 109428 - protein, 21 aa, Mycobacterium avium
INSGFTRRRVSVLEPKIREIV

SEQ ID NO: 109429 - protein, 18 aa, Mycobacterium avium
INYLRCIGCGLCVEACPT

SEQ ID NO: 109430 - protein, 21 aa, Mycobacterium avium
IPLYYDWLFGMVVSGANCPPT

SEQ ID NO: 109431 - protein, 17 aa, Mycobacterium avium
IPNDFVVGYGLDYDERY

SEQ ID NO: 109432 - protein, 17 aa, Mycobacterium avium
IRHAVAWAGPGDVVLVA

SEQ ID NO: 109433 - protein, 17 aa, Mycobacterium avium
IRPALLVHTSLATVQFV

SEQ ID NO: 109434 - protein, 17 aa, Mycobacterium avium
IRRPRGAPRQLLLDTAR

SEQ ID NO: 109435 - protein, 27 aa, Mycobacterium avium
IRTGQEFSWRAEELFAAIAAGDITVEV

SEQ ID NO: 109436 - protein, 17 aa, Mycobacterium avium
IRYLGEDGGRAFVQSLE

SEQ ID NO: 109437 - protein, 19 aa, Mycobacterium avium
ISAERAFDILVWRSQETNL

SEQ ID NO: 109438 - protein, 20 aa, Mycobacterium avium
ISARLDLPLGVARVLVGDLV

SEQ ID NO: 109439 - protein, 25 aa, Mycobacterium avium
ISRQLWWGHRIPIWYGPNGEQRCVG

SEQ ID NO: 109440 - protein, 17 aa, Mycobacterium avium
ITATPAWDALRKHHDRI

SEQ ID NO: 109441 - protein, 22 aa, Mycobacterium avium
ITWTLPNVRAWWEMTWQGRPDP

SEQ ID NO: 109442 - protein, 18 aa, Mycobacterium avium
ITYNEWSFAVGKQLSMAS

SEQ ID NO: 109443 - protein, 17 aa, Mycobacterium avium
IVLGGNMIQYNWTINGE

SEQ ID NO: 109444 - protein, 19 aa, Mycobacterium avium
IVVHLAPWLEPEPICLAIN

SEQ ID NO: 109445 - protein, 21 aa, Mycobacterium avium
IYAMWRINELLNWQVAAAGED

SEQ ID NO: 109446 - protein, 19 aa, Mycobacterium avium
KACPAPGVMQGCLESTSGL

SEQ ID NO: 109447 - protein, 17 aa, Mycobacterium avium
KAKEAVGAVAGRDDLTR

SEQ ID NO: 109448 - protein, 24 aa, Mycobacterium avium
KANLKRAWELMGMRVHWQSSNDLV

SEQ ID NO: 109449 - protein, 17 aa, Mycobacterium avium
KAPEQVVLWDALPKNDA

SEQ ID NO: 109450 - protein, 19 aa, Mycobacterium avium
KDLQDIIAILGIDELSEED

SEQ ID NO: 109451 - protein, 23 aa, Mycobacterium avium
KDRPDVVHAYGWLGGLAAQLAAR

SEQ ID NO: 109452 - protein, 23 aa, Mycobacterium avium
KEDWYQWPWRVHVGLWAAASASL

SEQ ID NO: 109453 - protein, 18 aa, Mycobacterium avium
KELHLRLGTATADLSQRL

SEQ ID NO: 109454 - protein, 21 aa, Mycobacterium avium
KEPYSVVGLIFPWNGPIFNAS

SEQ ID NO: 109455 - protein, 17 aa, Mycobacterium avium
KFIPGMRERGFGQIINV

SEQ ID NO: 109456 - protein, 18 aa, Mycobacterium avium
KGEVKDVLLLDVTPLSLG

SEQ ID NO: 109457 - protein, 17 aa, Mycobacterium avium
KGPDFPTSGLIVGTQGI

SEQ ID NO: 109458 - protein, 20 aa, Mycobacterium avium
KLFSSRGATVFGIGRDTARL

SEQ ID NO: 109459 - protein, 17 aa, Mycobacterium avium
KMPANRFDLAWSAEKAG

SEQ ID NO: 109460 - protein, 18 aa, Mycobacterium avium
KQRSRLALWARRLLGEAI

SEQ ID NO: 109461 - protein, 18 aa, Mycobacterium avium
KSGCYWARLRSFDTNDII

SEQ ID NO: 109462 - protein, 22 aa, Mycobacterium avium
KSLRAGKIFVDWSQNNGSKTTI

SEQ ID NO: 109463 - protein, 26 aa, Mycobacterium avium
KSSRYPGGLALRFARVLRYRDDKGPA

SEQ ID NO: 109464 - protein, 17 aa, Mycobacterium avium
KTFWGWREQQLPDATLI

SEQ ID NO: 109465 - protein, 21 aa, Mycobacterium avium
KVAELPAGHGLNAEKLSYGDL

SEQ ID NO: 109466 - protein, 22 aa, Mycobacterium avium
KVLPRKPAHLVIRMYSALTEAV

SEQ ID NO: 109467 - protein, 19 aa, Mycobacterium avium
KVSALRWGSTDARIVFVHG

SEQ ID NO: 109468 - protein, 21 aa, Mycobacterium avium
KWKFTVPFVCGATNLGEALRR

SEQ ID NO: 109469 - protein, 19 aa, Mycobacterium avium
KYWGGVCLNVGCIPSKALL

SEQ ID NO: 109470 - protein, 23 aa, Mycobacterium avium
LAAELRLPLVLVIDTAGPALSAE

SEQ ID NO: 109471 - protein, 17 aa, Mycobacterium avium
LAAPEELDRLAVPASSP

SEQ ID NO: 109472 - protein, 19 aa, Mycobacterium avium
LACALVCRPDLLVLDEPTV

SEQ ID NO: 109473 - protein, 21 aa, Mycobacterium avium
LACARLGVMHSVVFAGFTAKA

SEQ ID NO: 109474 - protein, 19 aa, Mycobacterium avium
LADGLGLPVLSVRAMVARS

SEQ ID NO: 109475 - protein, 20 aa, Mycobacterium avium
LADVMLRYNFPGAGLTDDAL

SEQ ID NO: 109476 - protein, 18 aa, Mycobacterium avium
LAEFSNDHVTAWATPSAP

SEQ ID NO: 109477 - protein, 18 aa, Mycobacterium avium
LAESWRWGADEAVIRSLL

SEQ ID NO: 109478 - protein, 19 aa, Mycobacterium avium
LAGFWGHAWQSAVFPSGKA

SEQ ID NO: 109479 - protein, 25 aa, Mycobacterium avium
LAHFEWLVGCGVPFKAEFFGEPGWE

SEQ ID NO: 109480 - protein, 18 aa, Mycobacterium avium
LAHLGFFVLDGWLRPVPA

SEQ ID NO: 109481 - protein, 18 aa, Mycobacterium avium
LAHLRAFVLIPWLAVDPD

SEQ ID NO: 109482 - protein, 20 aa, Mycobacterium avium
LAKACARIMLGATISQLRAE

SEQ ID NO: 109483 - protein, 21 aa, Mycobacterium avium
LAKRARHRPVWVKGFGEHVPF

SEQ ID NO: 109484 - protein, 23 aa, Mycobacterium avium
LALNRRTPIFGGWVTGPTLLGPE

SEQ ID NO: 109485 - protein, 21 aa, Mycobacterium avium
LALQFGWRLFAPILRAATGIE

SEQ ID NO: 109486 - protein, 18 aa, Mycobacterium avium
LAPENAWPAAAEDVYAAT

SEQ ID NO: 109487 - protein, 21 aa, Mycobacterium avium
LAPRLGGPIAPCYHAAVDTST

SEQ ID NO: 109488 - protein, 17 aa, Mycobacterium avium
LASACLFLLEHFDGPNH

SEQ ID NO: 109489 - protein, 20 aa, Mycobacterium avium
LAWQRLVPWPDVLPGLTRLK

SEQ ID NO: 109490 - protein, 20 aa, Mycobacterium avium
LAYERRVLKLLAWGEPTRPW

SEQ ID NO: 109491 - protein, 20 aa, Mycobacterium avium
LCGALRRYHEAFGVPISTLP

SEQ ID NO: 109492 - protein, 17 aa, Mycobacterium avium
LCPGSRNAPLAFALADA

SEQ ID NO: 109493 - protein, 20 aa, Mycobacterium avium
LCSRFSRRLGITVASVDYRL

SEQ ID NO: 109494 - protein, 20 aa, Mycobacterium avium
LDALGYRGFWMGYFAARSAP

SEQ ID NO: 109495 - protein, 20 aa, Mycobacterium avium
LDEGRIVLVAGFQGVSQDTR

SEQ ID NO: 109496 - protein, 25 aa, Mycobacterium avium
LDEWKWWARWRVIRARAGWLTDELV

SEQ ID NO: 109497 - protein, 23 aa, Mycobacterium avium
LDGLSLPLLRSWLSAAAAGGVAR

SEQ ID NO: 109498 - protein, 17 aa, Mycobacterium avium
LDLPRDALIVFTGLSGS

SEQ ID NO: 109499 - protein, 18 aa, Mycobacterium avium
LDLRPARSRAHCLQLIAD

SEQ ID NO: 109500 - protein, 17 aa, Mycobacterium avium
LDPELWTWVAVSGLNLL

SEQ ID NO: 109501 - protein, 19 aa, Mycobacterium avium
LEGGRCLLDLRTVSPEDDE

SEQ ID NO: 109502 - protein, 21 aa, Mycobacterium avium
LEIGRAHTPWFHWGTTAVVAR

SEQ ID NO: 109503 - protein, 17 aa, Mycobacterium avium
LEMGCVFSIDTDAHAPG

SEQ ID NO: 109504 - protein, 21 aa, Mycobacterium avium
LEPARAAFEWSRRTQRPDGSW

SEQ ID NO: 109505 - protein, 30 aa, Mycobacterium avium
LESFFRGAGWNVIKVVWGREWDALLHADRD

SEQ ID NO: 109506 - protein, 20 aa, Mycobacterium avium
LEVEEVYLPLARLIHLQVAA

SEQ ID NO: 109507 - protein, 17 aa, Mycobacterium avium
LEWDAVFLVGLADGTLP

SEQ ID NO: 109508 - protein, 23 aa, Mycobacterium avium
LFALGRLPGWIAHWREMHDEGDS

SEQ ID NO: 109509 - protein, 17 aa, Mycobacterium avium
LFMAGLWSVWKPAKDAP

SEQ ID NO: 109510 - protein, 18 aa, Mycobacterium avium
LFPRSVFYSLRLAEHNLD

SEQ ID NO: 109511 - protein, 18 aa, Mycobacterium avium
LFVEAGLPPGVFQVVHGD

SEQ ID NO: 109512 - protein, 20 aa, Mycobacterium avium
LFYSGFYLPMYWSSRAKLTN

SEQ ID NO: 109513 - protein, 21 aa, Mycobacterium avium
LGDRPPFGAALIRTADTEHRF

SEQ ID NO: 109514 - protein, 18 aa, Mycobacterium avium
LGEAILLPGLMDMEVNLL

SEQ ID NO: 109515 - protein, 20 aa, Mycobacterium avium
LGEQCAFGLALIAPRLPPFD

SEQ ID NO: 109516 - protein, 17 aa, Mycobacterium avium
LGIAEWILPSVIRAAPK

SEQ ID NO: 109517 - protein, 18 aa, Mycobacterium avium
LGMDRLRIGVTGAAPIPR

SEQ ID NO: 109518 - protein, 19 aa, Mycobacterium avium
LGPAAARLRLARPLPLRVA

SEQ ID NO: 109519 - protein, 20 aa, Mycobacterium avium
LGPFCAALAYLCDKDMVLPM

SEQ ID NO: 109520 - protein, 17 aa, Mycobacterium avium
LGPTDALPRCRRTVHRG

SEQ ID NO: 109521 - protein, 24 aa, Mycobacterium avium
LGRYGVCANAICPRARTAMTADVF

SEQ ID NO: 109522 - protein, 17 aa, Mycobacterium avium
LGVKGRVLPMCPIALQI

SEQ ID NO: 109523 - protein, 17 aa, Mycobacterium avium
LGWRAYRLVAGEAASGW

SEQ ID NO: 109524 - protein, 22 aa, Mycobacterium avium
LIDLNVRWRKGQTLDPDWKIEQ

SEQ ID NO: 109525 - protein, 17 aa, Mycobacterium avium
LKGWFQRWFFTAVGQVP

SEQ ID NO: 109526 - protein, 18 aa, Mycobacterium avium
LKLSALRGLFSAVVEGPV

SEQ ID NO: 109527 - protein, 18 aa, Mycobacterium avium
LKRPIPFLPNMIGLITGR

SEQ ID NO: 109528 - protein, 17 aa, Mycobacterium avium
LKSSVAMELVRKQRGLA

SEQ ID NO: 109529 - protein, 20 aa, Mycobacterium avium
LKTHCKTCLVVRREGSAIRR

SEQ ID NO: 109530 - protein, 18 aa, Mycobacterium avium
LKTSYAWAAARYGGDDPV

SEQ ID NO: 109531 - protein, 17 aa, Mycobacterium avium
LKVAFDWKNRHNERRGV

SEQ ID NO: 109532 - protein, 18 aa, Mycobacterium avium
LLAHDWGSIQAWAAVTDQ

SEQ ID NO: 109533 - protein, 19 aa, Mycobacterium avium
LLARLGKRVLRPGGVELTR

SEQ ID NO: 109534 - protein, 22 aa, Mycobacterium avium
LLDALRWLGLDWDEGPEVGGPY

SEQ ID NO: 109535 - protein, 23 aa, Mycobacterium avium
LLDEAWWFPAIQWPDGRMQFMLN

SEQ ID NO: 109536 - protein, 18 aa, Mycobacterium avium
LLDICFLFLIAGLDTVTD

SEQ ID NO: 109537 - protein, 18 aa, Mycobacterium avium
LLESFLFYSGFYLPMYWS

SEQ ID NO: 109538 - protein, 19 aa, Mycobacterium avium
LLFGIPYDRIEVVVHPQSI

SEQ ID NO: 109539 - protein, 23 aa, Mycobacterium avium
LLRARPGTRLVVAGVCMQPDTVH

SEQ ID NO: 109540 - protein, 21 aa, Mycobacterium avium
LLRDIWLLIVDEIGHAIEAFQ

SEQ ID NO: 109541 - protein, 24 aa, Mycobacterium avium
LLRSCTGWPSGIWIDDPRRSAPDG

SEQ ID NO: 109542 - protein, 17 aa, Mycobacterium avium
LLSGLLRAGRQVKDLVV

SEQ ID NO: 109543 - protein, 19 aa, Mycobacterium avium
LLSRFGAVRVVRPVEWARS

SEQ ID NO: 109544 - protein, 24 aa, Mycobacterium avium
LLTPRLAQLIAIGGFRNWDRMVKR

SEQ ID NO: 109545 - protein, 21 aa, Mycobacterium avium
LLVELRSDWTLGTRTYAAGSL

SEQ ID NO: 109546 - protein, 20 aa, Mycobacterium avium
LLVRGGVVFSGYWRNEQATA

SEQ ID NO: 109547 - protein, 21 aa, Mycobacterium avium
LLVVMCGVGLYAGYVETYQEM

SEQ ID NO: 109548 - protein, 24 aa, Mycobacterium avium
LMVKAGVQWGLFGGAVENLGTERH

SEQ ID NO: 109549 - protein, 18 aa, Mycobacterium avium
LNEFSLRVLHSFLTDPGR

SEQ ID NO: 109550 - protein, 29 aa, Mycobacterium avium
LNFFPMGAWAKRTGAIFIRRQTKDLPVYR

SEQ ID NO: 109551 - protein, 18 aa, Mycobacterium avium
LNGPRYWLMNGIEKQPQG

SEQ ID NO: 109552 - protein, 24 aa, Mycobacterium avium
LNLPGVAFGHDWLTGAARYANLLE

SEQ ID NO: 109553 - protein, 17 aa, Mycobacterium avium
LNMMAHLLSTIPYHAVE

SEQ ID NO: 109554 - protein, 18 aa, Mycobacterium avium
LPDRGWRRALRLATFGLI

SEQ ID NO: 109555 - protein, 18 aa, Mycobacterium avium
LPGGLNWPLDLAVGHDGR

SEQ ID NO: 109556 - protein, 21 aa, Mycobacterium avium
LPGHCPSGLGFRPDGSLLIAS

SEQ ID NO: 109557 - protein, 20 aa, Mycobacterium avium
LPGSIGFAVAFCYARFVRRG

SEQ ID NO: 109558 - protein, 20 aa, Mycobacterium avium
LPGYQGWQWAVVVAAYPGAD

SEQ ID NO: 109559 - protein, 18 aa, Mycobacterium avium
LPHWAGVVPLQLSAGPPV

SEQ ID NO: 109560 - protein, 22 aa, Mycobacterium avium
LPIWPDWVRRWPTPSATAAASA

SEQ ID NO: 109561 - protein, 19 aa, Mycobacterium avium
LPLLLQVGLSLSITSLGGL

SEQ ID NO: 109562 - protein, 21 aa, Mycobacterium avium
LPLPCLIGAPVLFGRGSVVFA

SEQ ID NO: 109563 - protein, 23 aa, Mycobacterium avium
LPLRIRAAWLWSGRTAVIAGAAA

SEQ ID NO: 109564 - protein, 17 aa, Mycobacterium avium
LPPDLDFTALFHGVDER

SEQ ID NO: 109565 - protein, 18 aa, Mycobacterium avium
LPTHLVIVGGSYIALEFA

SEQ ID NO: 109566 - protein, 23 aa, Mycobacterium avium
LPVKLCYAGPFFRYERPQAGRYR

SEQ ID NO: 109567 - protein, 17 aa, Mycobacterium avium
LQAELGLAYLFISHDLA

SEQ ID NO: 109568 - protein, 18 aa, Mycobacterium avium
LQDWRSAVAYARTLDGID

SEQ ID NO: 109569 - protein, 21 aa, Mycobacterium avium
LQGQCTFSWPPRIHLPGYKPT

SEQ ID NO: 109570 - protein, 19 aa, Mycobacterium avium
LQHPDTFARLGVQPPRGVL

SEQ ID NO: 109571 - protein, 17 aa, Mycobacterium avium
LQPEIRLAAPLLAKGLP

SEQ ID NO: 109572 - protein, 20 aa, Mycobacterium avium
LQRREAWEIIDYVNRLTDPS

SEQ ID NO: 109573 - protein, 20 aa, Mycobacterium avium
LQRRGCAIARLVLLDAQPGL

SEQ ID NO: 109574 - protein, 17 aa, Mycobacterium avium
LQRRLRALVGHGVDEVR

SEQ ID NO: 109575 - protein, 20 aa, Mycobacterium avium
LRAAEGIPDCALADVPALAR

SEQ ID NO: 109576 - protein, 17 aa, Mycobacterium avium
LRAAHRYGAKVKWAEID

SEQ ID NO: 109577 - protein, 20 aa, Mycobacterium avium
LRAAQQLPWHPGRCAEVLVG

SEQ ID NO: 109578 - protein, 19 aa, Mycobacterium avium
LRAGLPPTLAVAGGYLDGI

SEQ ID NO: 109579 - protein, 17 aa, Mycobacterium avium
LRAIVGFAAETGDANGD

SEQ ID NO: 109580 - protein, 18 aa, Mycobacterium avium
LRAVHSFLANPSDPPRDA

SEQ ID NO: 109581 - protein, 28 aa, Mycobacterium avium
LRDLAKRWVRWRLSTGLGLEAGGGRPVV

SEQ ID NO: 109582 - protein, 19 aa, Mycobacterium avium
LRDLLKFDFYFADSATFRD

SEQ ID NO: 109583 - protein, 18 aa, Mycobacterium avium
LRDPALLPRIVWGNLRAR

SEQ ID NO: 109584 - protein, 20 aa, Mycobacterium avium
LRELKCGYHGWTWDLAGALK

SEQ ID NO: 109585 - protein, 17 aa, Mycobacterium avium
LRGRLQLMIDFMATRTA

SEQ ID NO: 109586 - protein, 19 aa, Mycobacterium avium
LRIAQAQLVGWLEGLFHGI

SEQ ID NO: 109587 - protein, 26 aa, Mycobacterium avium
LRKFLADKVVRWWLPERWTFVDEIPR

SEQ ID NO: 109588 - protein, 21 aa, Mycobacterium avium
LRKVVAWARDRGCLVASDECY

SEQ ID NO: 109589 - protein, 20 aa, Mycobacterium avium
LRLLPFRLVLDGAREIDADI

SEQ ID NO: 109590 - protein, 23 aa, Mycobacterium avium
LRLRDIGGIVVIDFIDMVLESNR

SEQ ID NO: 109591 - protein, 18 aa, Mycobacterium avium
LRPDCRILACSSVFGVWG

SEQ ID NO: 109592 - protein, 21 aa, Mycobacterium avium
LRPDELHLGFNFRLTKIDFDA

SEQ ID NO: 109593 - protein, 20 aa, Mycobacterium avium
LRPDWSMPSAEQFTFGYADD

SEQ ID NO: 109594 - protein, 17 aa, Mycobacterium avium
LRPGGLIGIEHDDTTSH

SEQ ID NO: 109595 - protein, 20 aa, Mycobacterium avium
LRPSMLEFMDSVAINAVEDT

SEQ ID NO: 109596 - protein, 19 aa, Mycobacterium avium
LRRAPRLGFEIDIDDAKIS

SEQ ID NO: 109597 - protein, 22 aa, Mycobacterium avium
LRRWHRRRPLWIGVAIGGTVDS

SEQ ID NO: 109598 - protein, 17 aa, Mycobacterium avium
LRTELRRAPRLGFEIDI

SEQ ID NO: 109599 - protein, 20 aa, Mycobacterium avium
LRTPKHFRRARGRKVDVVLS

SEQ ID NO: 109600 - protein, 17 aa, Mycobacterium avium
LRVAWSVADLAGRTSPG

SEQ ID NO: 109601 - protein, 17 aa, Mycobacterium avium
LRVGLRVRVQFHTVAAD

SEQ ID NO: 109602 - protein, 18 aa, Mycobacterium avium
LSAIASIGSDVWDRLFSG

SEQ ID NO: 109603 - protein, 21 aa, Mycobacterium avium
LSASQLRSWFAYRMDGPSPVN

SEQ ID NO: 109604 - protein, 22 aa, Mycobacterium avium
LSDLQPGDVLTFYSDASHAGIY

SEQ ID NO: 109605 - protein, 19 aa, Mycobacterium avium
LSKPFTFKRVEGLRPTIQQ

SEQ ID NO: 109606 - protein, 19 aa, Mycobacterium avium
LSVPANWASAVPAVRTVAA

SEQ ID NO: 109607 - protein, 17 aa, Mycobacterium avium
LSYSLDEACLLIFGRRD

SEQ ID NO: 109608 - protein, 18 aa, Mycobacterium avium
LTCPMFLTTAEFLPQHHQ

SEQ ID NO: 109609 - protein, 18 aa, Mycobacterium avium
LTDLLWRMGIRTIGQFAA

SEQ ID NO: 109610 - protein, 21 aa, Mycobacterium avium
LTDRLRRSFGRMPWTTTQKRR

SEQ ID NO: 109611 - protein, 19 aa, Mycobacterium avium
LTEAILVRRVDWVQEITRV

SEQ ID NO: 109612 - protein, 18 aa, Mycobacterium avium
LTHPRLLGALPLLREANR

SEQ ID NO: 109613 - protein, 18 aa, Mycobacterium avium
LTLHPGVMTGYGHGELAD

SEQ ID NO: 109614 - protein, 19 aa, Mycobacterium avium
LTTPELLIFLAVIAGAGVE

SEQ ID NO: 109615 - protein, 20 aa, Mycobacterium avium
LVFGRRAGLGAADYVRALSS

SEQ ID NO: 109616 - protein, 17 aa, Mycobacterium avium
LVGELRAGLPPTLAVAG

SEQ ID NO: 109617 - protein, 18 aa, Mycobacterium avium
LVNFPLSQWLKFAPPIGY

SEQ ID NO: 109618 - protein, 18 aa, Mycobacterium avium
LVSFEVFIRPALRAAMGL

SEQ ID NO: 109619 - protein, 18 aa, Mycobacterium avium
LWRMGIRTIGQFAALARG

SEQ ID NO: 109620 - protein, 18 aa, Mycobacterium avium
LYDPFSFEIIRQLEAFGF

SEQ ID NO: 109621 - protein, 17 aa, Mycobacterium avium
LYREGFFGLSWPREYGG

SEQ ID NO: 109622 - protein, 17 aa, Mycobacterium avium
MACAIGIAPCMHAGQGC

SEQ ID NO: 109623 - protein, 18 aa, Mycobacterium avium
MADLIVSGALEFDIAATY

SEQ ID NO: 109624 - protein, 17 aa, Mycobacterium avium
MAHFFYIHFGLPTYFKN

SEQ ID NO: 109625 - protein, 18 aa, Mycobacterium avium
MALHYEGWVVDIAHNGRE

SEQ ID NO: 109626 - protein, 17 aa, Mycobacterium avium
MASAVAPYVGWMSTTAA

SEQ ID NO: 109627 - protein, 17 aa, Mycobacterium avium
MCFPTFTGFSARHLNMH

SEQ ID NO: 109628 - protein, 18 aa, Mycobacterium avium
MFFHRLGPVLARRLLLTG

SEQ ID NO: 109629 - protein, 20 aa, Mycobacterium avium
MFRLPPALERAWHARGYYGS

SEQ ID NO: 109630 - protein, 18 aa, Mycobacterium avium
MGEALQALTAILTRRGVS

SEQ ID NO: 109631 - protein, 19 aa, Mycobacterium avium
MIEGLRIGRKIGMSQALDP

SEQ ID NO: 109632 - protein, 22 aa, Mycobacterium avium
MIRYCAPAQWFARTVRKPFDIH

SEQ ID NO: 109633 - protein, 21 aa, Mycobacterium avium
MNTRGRLAVSFARPPERFTDG

SEQ ID NO: 109634 - protein, 17 aa, Mycobacterium avium
MQLHLACFAAFDDIGCV

SEQ ID NO: 109635 - protein, 24 aa, Mycobacterium avium
MRPGNWAGAYACWGTENREAAVRF

SEQ ID NO: 109636 - protein, 23 aa, Mycobacterium avium
MRRRSAFCDFDFRATRPEYTNGG

SEQ ID NO: 109637 - protein, 17 aa, Mycobacterium avium
MRTVMCILNGQLRPVVV

SEQ ID NO: 109638 - protein, 17 aa, Mycobacterium avium
MSLRPRRVLEIGAGSGL

SEQ ID NO: 109639 - protein, 25 aa, Mycobacterium avium
MTSRPCPTCRGVGVVIPDPCHQCMG

SEQ ID NO: 109640 - protein, 24 aa, Mycobacterium avium
MVRCVRAALPLLRKAQWARIVNFS

SEQ ID NO: 109641 - protein, 19 aa, Mycobacterium avium
MVRDFQRIIGLEARAQIQA

SEQ ID NO: 109642 - protein, 19 aa, Mycobacterium avium
NAETIFWNGPMGVFEFPAF

SEQ ID NO: 109643 - protein, 18 aa, Mycobacterium avium
NALRSWSVLRFEVTEDPS

SEQ ID NO: 109644 - protein, 17 aa, Mycobacterium avium
NEEFPRLMVYRGPRRKG

SEQ ID NO: 109645 - protein, 18 aa, Mycobacterium avium
NEGPIHWYIHLMEQSRTP

SEQ ID NO: 109646 - protein, 20 aa, Mycobacterium avium
NEVMRSLGLPTMFPTIGGHE

SEQ ID NO: 109647 - protein, 24 aa, Mycobacterium avium
NFRPAIEAPYRWRDWAADPNGRTG

SEQ ID NO: 109648 - protein, 18 aa, Mycobacterium avium
NGCRMGICHTCTRRKTAG

SEQ ID NO: 109649 - protein, 18 aa, Mycobacterium avium
NGFRDIICPPLFLQYAIL

SEQ ID NO: 109650 - protein, 22 aa, Mycobacterium avium
NGGLRFAPRADLATREEQITVA

SEQ ID NO: 109651 - protein, 18 aa, Mycobacterium avium
NGIPLWAGAAFKHASAGP

SEQ ID NO: 109652 - protein, 17 aa, Mycobacterium avium
NGITAFWSQLAQQLVSG

SEQ ID NO: 109653 - protein, 18 aa, Mycobacterium avium
NGVALILVGHVTKDGAIA

SEQ ID NO: 109654 - protein, 17 aa, Mycobacterium avium
NHGLTLWDLDRVFKVNG

SEQ ID NO: 109655 - protein, 17 aa, Mycobacterium avium
NLADGILVRAVWASETS

SEQ ID NO: 109656 - protein, 22 aa, Mycobacterium avium
NMFALGLLSWMYGRPIETSEKF

SEQ ID NO: 109657 - protein, 25 aa, Mycobacterium avium
NPLRFLRAAMKWCRKAQALGTLDDA

SEQ ID NO: 109658 - protein, 25 aa, Mycobacterium avium
NPQRVWGWYLWRHYLVADVAPNAGH

SEQ ID NO: 109659 - protein, 17 aa, Mycobacterium avium
NRFLEIFQTIGRDLEEF

SEQ ID NO: 109660 - protein, 17 aa, Mycobacterium avium
NRLFPALTFGGSNLNFF

SEQ ID NO: 109661 - protein, 19 aa, Mycobacterium avium
NRSTIRWTLHQLVASGVVN

SEQ ID NO: 109662 - protein, 25 aa, Mycobacterium avium
NWGRFRWGDDFGWTWGTILPAGPDD

SEQ ID NO: 109663 - protein, 19 aa, Mycobacterium avium
PAAAARYWAAQSLEDNCGL

SEQ ID NO: 109664 - protein, 17 aa, Mycobacterium avium
PAAGSYRAFLTWLAERD

SEQ ID NO: 109665 - protein, 19 aa, Mycobacterium avium
PAARAAWRAVLDGFDTPTL

SEQ ID NO: 109666 - protein, 19 aa, Mycobacterium avium
PADDVYLVFTTNEEIGGVG

SEQ ID NO: 109667 - protein, 19 aa, Mycobacterium avium
PADVLPLWVAEMDVKLAPT

SEQ ID NO: 109668 - protein, 24 aa, Mycobacterium avium
PAGKRALAKWAFGVGRARARAVSD

SEQ ID NO: 109669 - protein, 19 aa, Mycobacterium avium
PAQVGLAWILARAPHTLLI

SEQ ID NO: 109670 - protein, 27 aa, Mycobacterium avium
PATLADLVFAWRVCRAVKSNAIVIAAG

SEQ ID NO: 109671 - protein, 18 aa, Mycobacterium avium
PATRWCPACAAELVVKPD

SEQ ID NO: 109672 - protein, 18 aa, Mycobacterium avium
PAVPFAHWVATHRDLFDR

SEQ ID NO: 109673 - protein, 21 aa, Mycobacterium avium
PAWDLPTVFGPIAVTYHLTGV

SEQ ID NO: 109674 - protein, 19 aa, Mycobacterium avium
PDCTRGAFRADRPYQAEVA

SEQ ID NO: 109675 - protein, 23 aa, Mycobacterium avium
PDKYWAGFCRRIGLAELADDARF

SEQ ID NO: 109676 - protein, 18 aa, Mycobacterium avium
PDLARPGQVWSQWHSYSF

SEQ ID NO: 109677 - protein, 24 aa, Mycobacterium avium
PDMRLPISLALGWPHRVPGAAACC

SEQ ID NO: 109678 - protein, 26 aa, Mycobacterium avium
PDYRGLIGPRCRAVWLLTVRAEHVDG

SEQ ID NO: 109679 - protein, 19 aa, Mycobacterium avium
PEARAGWEAVLAKLAAPGM

SEQ ID NO: 109680 - protein, 19 aa, Mycobacterium avium
PEDFRFLIRLARQQGTRLG

SEQ ID NO: 109681 - protein, 20 aa, Mycobacterium avium
PEEIGELGVQVLRAVKDTLD

SEQ ID NO: 109682 - protein, 20 aa, Mycobacterium avium
PEFRAAVVLCDIEGLSYEEI

SEQ ID NO: 109683 - protein, 21 aa, Mycobacterium avium
PEIDVRFGLGWGAVTVLDAAA

SEQ ID NO: 109684 - protein, 21 aa, Mycobacterium avium
PERYRFSVTLPRTVPGPGAGI

SEQ ID NO: 109685 - protein, 17 aa, Mycobacterium avium
PETKGPMLINARADKVT

SEQ ID NO: 109686 - protein, 22 aa, Mycobacterium avium
PETSVALGFGFRCGFLGLLHME

SEQ ID NO: 109687 - protein, 20 aa, Mycobacterium avium
PEWLRWNYATVVWGIATAHE

SEQ ID NO: 109688 - protein, 23 aa, Mycobacterium avium
PFGARPGFGFGFGPGRVDRRALH

SEQ ID NO: 109689 - protein, 18 aa, Mycobacterium avium
PGKDISIADVLRCIDGPL

SEQ ID NO: 109690 - protein, 22 aa, Mycobacterium avium
PGLVRWTGRYDMRYVEGAMPGR

SEQ ID NO: 109691 - protein, 20 aa, Mycobacterium avium
PGPLGQRADWWWYDPFQPQP

SEQ ID NO: 109692 - protein, 23 aa, Mycobacterium avium
PGRPPWECWVIEGLRGNRWAMLM

SEQ ID NO: 109693 - protein, 19 aa, Mycobacterium avium
PGRREGWDYPGMARESGTN

SEQ ID NO: 109694 - protein, 19 aa, Mycobacterium avium
PHLEAFKAKGYEVLLLTDP

SEQ ID NO: 109695 - protein, 26 aa, Mycobacterium avium
PHNERLFCIPATIDLAGAEIELVSMV

SEQ ID NO: 109696 - protein, 18 aa, Mycobacterium avium
PHRVPVWFMRQAGRSLPE

SEQ ID NO: 109697 - protein, 20 aa, Mycobacterium avium
PIAVPWSLPAARPVHSGDPD

SEQ ID NO: 109698 - protein, 21 aa, Mycobacterium avium
PKARDAWQFFQRMLADVTAIV

SEQ ID NO: 109699 - protein, 26 aa, Mycobacterium avium
PKASVMTHLRWLKALAAFGGIGLRLK

SEQ ID NO: 109700 - protein, 17 aa, Mycobacterium avium
PLEFGLRVTTLVRDTSE

SEQ ID NO: 109701 - protein, 18 aa, Mycobacterium avium
PLGIYCRASLAQYMDAER

SEQ ID NO: 109702 - protein, 17 aa, Mycobacterium avium
PLRVKAAAVGLAADEYH

SEQ ID NO: 109703 - protein, 19 aa, Mycobacterium avium
PNAWRLPFEREWRDPRPYP

SEQ ID NO: 109704 - protein, 18 aa, Mycobacterium avium
PNHMKIFWNNKGVVAKAT

SEQ ID NO: 109705 - protein, 17 aa, Mycobacterium avium
PNVWALGDVASWRDATG

SEQ ID NO: 109706 - protein, 18 aa, Mycobacterium avium
PNYYRWLLYEADHAGAYR

SEQ ID NO: 109707 - protein, 20 aa, Mycobacterium avium
PPDWPARKLPSMRVAAALPP

SEQ ID NO: 109708 - protein, 19 aa, Mycobacterium avium
PPEIWRSYIRTVGRTPNGV

SEQ ID NO: 109709 - protein, 21 aa, Mycobacterium avium
PPGGLGPRFTFVPADVTDESA

SEQ ID NO: 109710 - protein, 20 aa, Mycobacterium avium
PPGHLWRWELSPVNAELTTV

SEQ ID NO: 109711 - protein, 18 aa, Mycobacterium avium
PPKTMRALIGRICEQEGV

SEQ ID NO: 109712 - protein, 22 aa, Mycobacterium avium
PQHRLLLETAWRAVEHSGTAPT

SEQ ID NO: 109713 - protein, 22 aa, Mycobacterium avium
PRIVAGIPVCLCAPSQVDEAKE

SEQ ID NO: 109714 - protein, 20 aa, Mycobacterium avium
PRLQRIFTFQSLYAGVAPRD

SEQ ID NO: 109715 - protein, 17 aa, Mycobacterium avium
PRMQGMVDYMAARTAFF

SEQ ID NO: 109716 - protein, 19 aa, Mycobacterium avium
PRPAGAVTRAHLNRLISKI

SEQ ID NO: 109717 - protein, 19 aa, Mycobacterium avium
PRPDFKTRILQAFNDGMKH

SEQ ID NO: 109718 - protein, 17 aa, Mycobacterium avium
PRPEGQPALGLGEVDGP

SEQ ID NO: 109719 - protein, 24 aa, Mycobacterium avium
PRPRRRAAAGFGMRRRSAFCDFDF

SEQ ID NO: 109720 - protein, 20 aa, Mycobacterium avium
PRPTLCVIHGFLGSSYLANG

SEQ ID NO: 109721 - protein, 24 aa, Mycobacterium avium
PRQLRPVLRLVWPVLTSLAARPVV

SEQ ID NO: 109722 - protein, 17 aa, Mycobacterium avium
PRRVLEIGAGSGLLLSQ

SEQ ID NO: 109723 - protein, 21 aa, Mycobacterium avium
PRWIALAGWAPRIQVVHDDRP

SEQ ID NO: 109724 - protein, 18 aa, Mycobacterium avium
PSDSVAIALRVGVPIYVE

SEQ ID NO: 109725 - protein, 21 aa, Mycobacterium avium
PSEQARAWWGNFLVQKANEAN

SEQ ID NO: 109726 - protein, 17 aa, Mycobacterium avium
PSLPSARIEFMLTDAAP

SEQ ID NO: 109727 - protein, 18 aa, Mycobacterium avium
PSLPSARIEFMLTDAAPA

SEQ ID NO: 109728 - protein, 22 aa, Mycobacterium avium
PSVSGLPQWYGDQGMFLTTHYF

SEQ ID NO: 109729 - protein, 19 aa, Mycobacterium avium
PTARIEFMVADAAPIAAIT

SEQ ID NO: 109730 - protein, 18 aa, Mycobacterium avium
PTARRILAHFGLDHHFEV

SEQ ID NO: 109731 - protein, 22 aa, Mycobacterium avium
PTQLPMMLSFLDFRKIPLNGLW

SEQ ID NO: 109732 - protein, 18 aa, Mycobacterium avium
PVAACATAAVSVEEGVDK

SEQ ID NO: 109733 - protein, 24 aa, Mycobacterium avium
PVGNGTCYWKRMGNPDGAVIDNAM

SEQ ID NO: 109734 - protein, 18 aa, Mycobacterium avium
PVVPALGLALLGARAAGK

SEQ ID NO: 109735 - protein, 23 aa, Mycobacterium avium
PWAVPKFYWSVFATRPFEAAVQA

SEQ ID NO: 109736 - protein, 17 aa, Mycobacterium avium
PWLPGYMSQALALLTRD

SEQ ID NO: 109737 - protein, 19 aa, Mycobacterium avium
PYARWSFQHVEDFVPTAVI

SEQ ID NO: 109738 - protein, 19 aa, Mycobacterium avium
PYPGDNVLLCLGMCGQMIY

SEQ ID NO: 109739 - protein, 20 aa, Mycobacterium avium
QAAHARFVEVAARVNTLLDI

SEQ ID NO: 109740 - protein, 17 aa, Mycobacterium avium
QAARRVRRVWANIRTEV

SEQ ID NO: 109741 - protein, 18 aa, Mycobacterium avium
QARSRFDAAWNHQDGDHP

SEQ ID NO: 109742 - protein, 23 aa, Mycobacterium avium
QAVRYEAWSFPDFETGAAALRAV

SEQ ID NO: 109743 - protein, 22 aa, Mycobacterium avium
QAVWPERMFSLLAGFVEAGESF

SEQ ID NO: 109744 - protein, 17 aa, Mycobacterium avium
QDIRFGLGAVRNVGANV

SEQ ID NO: 109745 - protein, 24 aa, Mycobacterium avium
QFRPEVSDGLFLRLAVTSVESLAC

SEQ ID NO: 109746 - protein, 18 aa, Mycobacterium avium
QFSDDFIEWSISFSQKPF

SEQ ID NO: 109747 - protein, 17 aa, Mycobacterium avium
QFTCKYHAWRYSLDGDL

SEQ ID NO: 109748 - protein, 20 aa, Mycobacterium avium
QGLRLAQTLTPWPAIDGQRT

SEQ ID NO: 109749 - protein, 24 aa, Mycobacterium avium
QGVLCGSIVSGLRMRPGNWAGAYA

SEQ ID NO: 109750 - protein, 20 aa, Mycobacterium avium
QGVRKLAGFWGHAWQSAVFP

SEQ ID NO: 109751 - protein, 18 aa, Mycobacterium avium
QKKRWLPGIADGTLTMAF

SEQ ID NO: 109752 - protein, 17 aa, Mycobacterium avium
QLKRLKVGATRRFSATD

SEQ ID NO: 109753 - protein, 19 aa, Mycobacterium avium
QQFLRRRAALAINTSATDD

SEQ ID NO: 109754 - protein, 19 aa, Mycobacterium avium
QRIPRKWLESGVIIQAETL

SEQ ID NO: 109755 - protein, 17 aa, Mycobacterium avium
QSLRLYERHGLVTPARS

SEQ ID NO: 109756 - protein, 22 aa, Mycobacterium avium
QSVVFRPAFEFIEQQWRELGVV

SEQ ID NO: 109757 - protein, 23 aa, Mycobacterium avium
QTPCAVVAFASWPQETVLRGTLD

SEQ ID NO: 109758 - protein, 17 aa, Mycobacterium avium
RAAAVRGGHPWWTLSQL

SEQ ID NO: 109759 - protein, 19 aa, Mycobacterium avium
RAACFTWTVPDDVELTGPM

SEQ ID NO: 109760 - protein, 24 aa, Mycobacterium avium
RAAPPGCRCCRCSASACWAAGSPS

SEQ ID NO: 109761 - protein, 17 aa, Mycobacterium avium
RAARIAKFWAAEAGARV

SEQ ID NO: 109762 - protein, 22 aa, Mycobacterium avium
RAEGRYALMPGIIGALAESGTP

SEQ ID NO: 109763 - protein, 17 aa, Mycobacterium avium
RAELAAWFGRWRDTQIT

SEQ ID NO: 109764 - protein, 18 aa, Mycobacterium avium
RAHRGIVAVNELPDLAER

SEQ ID NO: 109765 - protein, 23 aa, Mycobacterium avium
RARRKGIKVAHAHLRYLNPFPAN

SEQ ID NO: 109766 - protein, 17 aa, Mycobacterium avium
RARWGDAVPDGFARISL

SEQ ID NO: 109767 - protein, 17 aa, Mycobacterium avium
RAVDLVQLFPAAAYGKN

SEQ ID NO: 109768 - protein, 23 aa, Mycobacterium avium
RAYFRGECLRRFGADIAAASWDS

SEQ ID NO: 109769 - protein, 19 aa, Mycobacterium avium
RAYRLDWPAATTIFELDQP

SEQ ID NO: 109770 - protein, 20 aa, Mycobacterium avium
RAYRLPWPAGTVVYEVDMPD

SEQ ID NO: 109771 - protein, 20 aa, Mycobacterium avium
RAYRLSWPAGTVVFEVDQPE

SEQ ID NO: 109772 - protein, 19 aa, Mycobacterium avium
RAYSPRFLWMWPNARISVM

SEQ ID NO: 109773 - protein, 19 aa, Mycobacterium avium
RCGWFDAVIARYATRVNGI

SEQ ID NO: 109774 - protein, 23 aa, Mycobacterium avium
RCTRCGRIYWPGSHHAKLLALVE

SEQ ID NO: 109775 - protein, 18 aa, Mycobacterium avium
RDAALCLATLRVGADPQG

SEQ ID NO: 109776 - protein, 21 aa, Mycobacterium avium
RDGRWYWHWDPAFMTKPGDDP

SEQ ID NO: 109777 - protein, 21 aa, Mycobacterium avium
RDIAAEIGRPVMVKAQVKTGG

SEQ ID NO: 109778 - protein, 22 aa, Mycobacterium avium
RDPEFAAGFARLYNRWIADYCA

SEQ ID NO: 109779 - protein, 20 aa, Mycobacterium avium
RDPRAVKVFTMVTPVVAETH

SEQ ID NO: 109780 - protein, 19 aa, Mycobacterium avium
RDRICRAREQLAATDNPLH

SEQ ID NO: 109781 - protein, 17 aa, Mycobacterium avium
RDWAAKVYGAWNLHCAL

SEQ ID NO: 109782 - protein, 20 aa, Mycobacterium avium
REFSDVFGVLFPGGEGRLRL

SEQ ID NO: 109783 - protein, 17 aa, Mycobacterium avium
REHLTILGSVFHSGAVD

SEQ ID NO: 109784 - protein, 21 aa, Mycobacterium avium
RELGVQFARQGIRVNALCPGP

SEQ ID NO: 109785 - protein, 17 aa, Mycobacterium avium
RELPIVHVVRLYRADGS

SEQ ID NO: 109786 - protein, 18 aa, Mycobacterium avium
RELPRSGAEFLGILGQLA

SEQ ID NO: 109787 - protein, 17 aa, Mycobacterium avium
RELVARTGVDPAQIDDV

SEQ ID NO: 109788 - protein, 20 aa, Mycobacterium avium
REMLPHNAVEYFVSYYDYYQ

SEQ ID NO: 109789 - protein, 19 aa, Mycobacterium avium
RERTVLVLRFFESMTQTQI

SEQ ID NO: 109790 - protein, 19 aa, Mycobacterium avium
REYGVRVLVIRPGQVRTRM

SEQ ID NO: 109791 - protein, 17 aa, Mycobacterium avium
RFDRISYSWIPRERNSH

SEQ ID NO: 109792 - protein, 19 aa, Mycobacterium avium
RFLWMWPNARISVMGGEQA

SEQ ID NO: 109793 - protein, 19 aa, Mycobacterium avium
RFVEVAARVNTLLDIAQAN

SEQ ID NO: 109794 - protein, 17 aa, Mycobacterium avium
RFVKGITQEAVFQKRAP

SEQ ID NO: 109795 - protein, 20 aa, Mycobacterium avium
RGCAIPGCGATRGLHAHHLR

SEQ ID NO: 109796 - protein, 24 aa, Mycobacterium avium
RGEHPSLCLFASWAAPDSPAGRRL

SEQ ID NO: 109797 - protein, 17 aa, Mycobacterium avium
RGFLRCVAALARAADTI

SEQ ID NO: 109798 - protein, 18 aa, Mycobacterium avium
RGGFPGMLLGSVSSHVAQ

SEQ ID NO: 109799 - protein, 19 aa, Mycobacterium avium
RGLLCGVVLTAPRAKDAEA

SEQ ID NO: 109800 - protein, 19 aa, Mycobacterium avium
RGPQRWRIRANWKIGAENF

SEQ ID NO: 109801 - protein, 18 aa, Mycobacterium avium
RGRFRWMGLYTQREQGYD

SEQ ID NO: 109802 - protein, 19 aa, Mycobacterium avium
RGSFFPVIPVCSSTGVGTC

SEQ ID NO: 109803 - protein, 20 aa, Mycobacterium avium
RGTHALRFIRSCSAPLTAET

SEQ ID NO: 109804 - protein, 17 aa, Mycobacterium avium
RGVILGTGGFEWDPVLV

SEQ ID NO: 109805 - protein, 19 aa, Mycobacterium avium
RGVLFPKHRTDLIGCAVTV

SEQ ID NO: 109806 - protein, 18 aa, Mycobacterium avium
RHGPEFAQRFGLGFSAQD

SEQ ID NO: 109807 - protein, 17 aa, Mycobacterium avium
RHVLRLGGWTIVRSARD

SEQ ID NO: 109808 - protein, 17 aa, Mycobacterium avium
RIDVPVLLGYGVVDVSP

SEQ ID NO: 109809 - protein, 19 aa, Mycobacterium avium
RIGTDWLRAYLALPNYANN

SEQ ID NO: 109810 - protein, 22 aa, Mycobacterium avium
RIPKLRTGSFFPALLERRRRVD

SEQ ID NO: 109811 - protein, 18 aa, Mycobacterium avium
RITARYAQHWNFVGGPPD

SEQ ID NO: 109812 - protein, 19 aa, Mycobacterium avium
RKLQVANRVELARYAIEHG

SEQ ID NO: 109813 - protein, 25 aa, Mycobacterium avium
RKSRTEMAWCFPAVPLVVRAPAAKP

SEQ ID NO: 109814 - protein, 20 aa, Mycobacterium avium
RLAEKLWKLRILADERSASD

SEQ ID NO: 109815 - protein, 17 aa, Mycobacterium avium
RLAGPTVNVAWDAPQTG

SEQ ID NO: 109816 - protein, 22 aa, Mycobacterium avium
RLARISERWQRLGLNLNAADLF

SEQ ID NO: 109817 - protein, 18 aa, Mycobacterium avium
RLGDKFPLKAGMVTSLGF

SEQ ID NO: 109818 - protein, 17 aa, Mycobacterium avium
RLGEVGRAFVVPRPGAQ

SEQ ID NO: 109819 - protein, 21 aa, Mycobacterium avium
RLKSELLLLMAGVERLAHAPV

SEQ ID NO: 109820 - protein, 17 aa, Mycobacterium avium
RLLFKDEVRAVGRELGL

SEQ ID NO: 109821 - protein, 23 aa, Mycobacterium avium
RLLPNLVTVLGWRSCDHTGPVHE

SEQ ID NO: 109822 - protein, 23 aa, Mycobacterium avium
RLPRIAGPCGMVIFGVTGDLARK

SEQ ID NO: 109823 - protein, 17 aa, Mycobacterium avium
RLRGRAVGMVFQDPMSA

SEQ ID NO: 109824 - protein, 18 aa, Mycobacterium avium
RLRYAVVAHGGFGVAQRI

SEQ ID NO: 109825 - protein, 17 aa, Mycobacterium avium
RLSEILAAYALLRDPAR

SEQ ID NO: 109826 - protein, 19 aa, Mycobacterium avium
RLTATVLRFNGFAAAGVDE

SEQ ID NO: 109827 - protein, 18 aa, Mycobacterium avium
RLVKAGKVAKDWNTDATK

SEQ ID NO: 109828 - protein, 19 aa, Mycobacterium avium
RLWRARRVLAVTFPSHTSA

SEQ ID NO: 109829 - protein, 17 aa, Mycobacterium avium
RMFDLLVRMGYKEIEVG

SEQ ID NO: 109830 - protein, 18 aa, Mycobacterium avium
RMKFEGGVHRVQRVPVTE

SEQ ID NO: 109831 - protein, 18 aa, Mycobacterium avium
RMRGVLALFEGVATGAAD

SEQ ID NO: 109832 - protein, 17 aa, Mycobacterium avium
RNPSRFMAMQGAFVDEH

SEQ ID NO: 109833 - protein, 18 aa, Mycobacterium avium
RPAAVLLHLGPGLGNGLA

SEQ ID NO: 109834 - protein, 21 aa, Mycobacterium avium
RPAVIPLSFAQTRLWFIDQFQ

SEQ ID NO: 109835 - protein, 21 aa, Mycobacterium avium
RPAVVPLSFAQQRLWFIDQLL

SEQ ID NO: 109836 - protein, 19 aa, Mycobacterium avium
RPCPTWIRRSPCAWRGSAT

SEQ ID NO: 109837 - protein, 17 aa, Mycobacterium avium
RPFRSLIRAVLRHAGGV

SEQ ID NO: 109838 - protein, 20 aa, Mycobacterium avium
RPGQYVRLHWARPRALAGAH

SEQ ID NO: 109839 - protein, 24 aa, Mycobacterium avium
RPIPRPVPRPGAPRPGAPRPGASP

SEQ ID NO: 109840 - protein, 19 aa, Mycobacterium avium
RPKRAAVIAPSFTEPAAAL

SEQ ID NO: 109841 - protein, 17 aa, Mycobacterium avium
RPLPVTRFDVRRAPAAL

SEQ ID NO: 109842 - protein, 19 aa, Mycobacterium avium
RPLWEMWVIEGLDGNAGGR

SEQ ID NO: 109843 - protein, 24 aa, Mycobacterium avium
RPPARLIGWTARFLGMVRPGDEVA

SEQ ID NO: 109844 - protein, 20 aa, Mycobacterium avium
RPSKIAFLAWHAWSDPEQGN

SEQ ID NO: 109845 - protein, 20 aa, Mycobacterium avium
RPTGEWAAAIARLADAEAAV

SEQ ID NO: 109846 - protein, 17 aa, Mycobacterium avium
RPWRVSPPGGRRELDEA

SEQ ID NO: 109847 - protein, 17 aa, Mycobacterium avium
RQARIGITPTWVRFYDF

SEQ ID NO: 109848 - protein, 17 aa, Mycobacterium avium
RRALRLATFGLIDLGPS

SEQ ID NO: 109849 - protein, 18 aa, Mycobacterium avium
RRATSTTCGLGWATVTPT

SEQ ID NO: 109850 - protein, 24 aa, Mycobacterium avium
RREMAYEGKIDWAFAELLALGSLV

SEQ ID NO: 109851 - protein, 19 aa, Mycobacterium avium
RRFGCGFAPSGWDTLTKHL

SEQ ID NO: 109852 - protein, 17 aa, Mycobacterium avium
RRLHWYVPRSIRLIDVF

SEQ ID NO: 109853 - protein, 20 aa, Mycobacterium avium
RRLLPGIAHVAVFDTGFFHD

SEQ ID NO: 109854 - protein, 17 aa, Mycobacterium avium
RRLPELPDPPALPITAG

SEQ ID NO: 109855 - protein, 17 aa, Mycobacterium avium
RRLRALVGHGVDEVRGL

SEQ ID NO: 109856 - protein, 17 aa, Mycobacterium avium
RRLRAWLTRLYRTEFDG

SEQ ID NO: 109857 - protein, 19 aa, Mycobacterium avium
RRLSGEIDRPVSFALIQVD

SEQ ID NO: 109858 - protein, 19 aa, Mycobacterium avium
RRPATLEVFADTDAKVAGS

SEQ ID NO: 109859 - protein, 22 aa, Mycobacterium avium
RRRRGRRGRGRGRGEQGGSDGP

SEQ ID NO: 109860 - protein, 22 aa, Mycobacterium avium
RRSRFPQRWWWVALTDEAFPRL

SEQ ID NO: 109861 - protein, 17 aa, Mycobacterium avium
RRTLEEISRMQAEAQAE

SEQ ID NO: 109862 - protein, 24 aa, Mycobacterium avium
RRTSAVKAFTAWAVRRGLLTADPA

SEQ ID NO: 109863 - protein, 18 aa, Mycobacterium avium
RRYEIGKVIALTNPASGH

SEQ ID NO: 109864 - protein, 20 aa, Mycobacterium avium
RRYGVRWHYRVPAWSEFVEV

SEQ ID NO: 109865 - protein, 19 aa, Mycobacterium avium
RSAAGWAQRVVFVNGHGGN

SEQ ID NO: 109866 - protein, 25 aa, Mycobacterium avium
RSAITFRIKNMWGLLTVRGRFTDFT

SEQ ID NO: 109867 - protein, 24 aa, Mycobacterium avium
RSAMTAFDWFCWRLNKKVEDAQRR

SEQ ID NO: 109868 - protein, 19 aa, Mycobacterium avium
RSGMTIGIGGWGSRRKPMA

SEQ ID NO: 109869 - protein, 19 aa, Mycobacterium avium
RSLLLPGIRIGNRFRGGPK

SEQ ID NO: 109870 - protein, 17 aa, Mycobacterium avium
RSPAGVVRLDYEVPLLL

SEQ ID NO: 109871 - protein, 20 aa, Mycobacterium avium
RSSVGTWLFGIVKHTAARHR

SEQ ID NO: 109872 - protein, 20 aa, Mycobacterium avium
RTDEQWRWLAHTLTVERLTE

SEQ ID NO: 109873 - protein, 17 aa, Mycobacterium avium
RVGAVGLIRSWRARNSG

SEQ ID NO: 109874 - protein, 17 aa, Mycobacterium avium
RVLAMAWEKQSESNAMW

SEQ ID NO: 109875 - protein, 23 aa, Mycobacterium avium
RVRLRGGPVLAELTARFGAAARA

SEQ ID NO: 109876 - protein, 19 aa, Mycobacterium avium
RVSYFYDFRGPSVAVDTAC

SEQ ID NO: 109877 - protein, 17 aa, Mycobacterium avium
RVVKRWRRGTPLDEAQT

SEQ ID NO: 109878 - protein, 17 aa, Mycobacterium avium
RWACATTAFATRPEASV

SEQ ID NO: 109879 - protein, 19 aa, Mycobacterium avium
RWGSTDARIVFVHGGGQNA

SEQ ID NO: 109880 - protein, 18 aa, Mycobacterium avium
RWQPPLWRALVARVAADP

SEQ ID NO: 109881 - protein, 17 aa, Mycobacterium avium
RWTTWQAAWLVAHGRPA

SEQ ID NO: 109882 - protein, 18 aa, Mycobacterium avium
RYGGYALAGVSSFGFGGA

SEQ ID NO: 109883 - protein, 17 aa, Mycobacterium avium
RYLPIWIGQSEAAAIAL

SEQ ID NO: 109884 - protein, 18 aa, Mycobacterium avium
RYRLRHGVGLAGLRGPGS

SEQ ID NO: 109885 - protein, 24 aa, Mycobacterium avium
RYTWPRFVCALPREFFAAVRAELA

SEQ ID NO: 109886 - protein, 17 aa, Mycobacterium avium
SAAFQAAHARFVEVAAR

SEQ ID NO: 109887 - protein, 20 aa, Mycobacterium avium
SALDVPARWQAMVRAMRNNG

SEQ ID NO: 109888 - protein, 17 aa, Mycobacterium avium
SAQLLPRFETITYGEVA

SEQ ID NO: 109889 - protein, 20 aa, Mycobacterium avium
SARLASALTHTWVSTTDEDA

SEQ ID NO: 109890 - protein, 18 aa, Mycobacterium avium
SARVAVLVADESGMSTVE

SEQ ID NO: 109891 - protein, 20 aa, Mycobacterium avium
SAYLLSLRAAWQADNKIPNS

SEQ ID NO: 109892 - protein, 20 aa, Mycobacterium avium
SDELPPLWRAFGASRRGDGH

SEQ ID NO: 109893 - protein, 17 aa, Mycobacterium avium
SDFKGRKVIVYFYPAAS

SEQ ID NO: 109894 - protein, 20 aa, Mycobacterium avium
SDIRAGAGLVLAGLVADGDT

SEQ ID NO: 109895 - protein, 20 aa, Mycobacterium avium
SDLLVIFGITGDLARKMTFR

SEQ ID NO: 109896 - protein, 17 aa, Mycobacterium avium
SDPRAAAVIARNIDTLG

SEQ ID NO: 109897 - protein, 24 aa, Mycobacterium avium
SDRYPRLLLPRVPSWVEELTHEPA

SEQ ID NO: 109898 - protein, 17 aa, Mycobacterium avium
SDSAAFELLKWLSQEGN

SEQ ID NO: 109899 - protein, 19 aa, Mycobacterium avium
SEILAAYALLRDPARRADY

SEQ ID NO: 109900 - protein, 21 aa, Mycobacterium avium
SERARRCHEFLGQLQGTPAAG

SEQ ID NO: 109901 - protein, 17 aa, Mycobacterium avium
SEYDRFALLHGDYRLDN

SEQ ID NO: 109902 - protein, 20 aa, Mycobacterium avium
SFAQTRLWFIDQFQGPSPMY

SEQ ID NO: 109903 - protein, 18 aa, Mycobacterium avium
SFKTSGCQPWQLTPDAVP

SEQ ID NO: 109904 - protein, 19 aa, Mycobacterium avium
SFNCLSWIEALGFCGIGEA

SEQ ID NO: 109905 - protein, 18 aa, Mycobacterium avium
SFPAIALCRRFADAGDTP

SEQ ID NO: 109906 - protein, 25 aa, Mycobacterium avium
SGATVHRLRIRGSRCTGVEYTTAEG

SEQ ID NO: 109907 - protein, 17 aa, Mycobacterium avium
SGEVIELGDWVRPVLLD

SEQ ID NO: 109908 - protein, 20 aa, Mycobacterium avium
SGGMCQRALIAIGLAGRPRL

SEQ ID NO: 109909 - protein, 20 aa, Mycobacterium avium
SGNGCWGSFVLADARHAVTL

SEQ ID NO: 109910 - protein, 21 aa, Mycobacterium avium
SGPMLAAAMAWDELAATLHST

SEQ ID NO: 109911 - protein, 22 aa, Mycobacterium avium
SGVMWACVFMRTGARRVHFGET

SEQ ID NO: 109912 - protein, 24 aa, Mycobacterium avium
SHFLPGIAGPAGWRVYLGTRRDEQ

SEQ ID NO: 109913 - protein, 21 aa, Mycobacterium avium
SIGGKLSVPVAWSGAPATPAL

SEQ ID NO: 109914 - protein, 23 aa, Mycobacterium avium
SIGWLRDFLRAHTGGLVIISHNV

SEQ ID NO: 109915 - protein, 24 aa, Mycobacterium avium
SISGICMSTGFSLWAHRMTVEYLL

SEQ ID NO: 109916 - protein, 17 aa, Mycobacterium avium
SKTRFAIYLGDLGTDTA

SEQ ID NO: 109917 - protein, 17 aa, Mycobacterium avium
SLNHWYRMMGPTFETSV

SEQ ID NO: 109918 - protein, 17 aa, Mycobacterium avium
SLRKLYATSEWLHRETT

SEQ ID NO: 109919 - protein, 18 aa, Mycobacterium avium
SLSNLRWDGDYVLVDVDA

SEQ ID NO: 109920 - protein, 22 aa, Mycobacterium avium
SMMPMRVIGMLLGIPESEQVSV

SEQ ID NO: 109921 - protein, 25 aa, Mycobacterium avium
SPEAVFKPRWLWKFGKTLRPPELRV

SEQ ID NO: 109922 - protein, 17 aa, Mycobacterium avium
SPGSPWLADTWRDRFEQ

SEQ ID NO: 109923 - protein, 20 aa, Mycobacterium avium
SPGYPCYRNILSALGCEVVE

SEQ ID NO: 109924 - protein, 19 aa, Mycobacterium avium
SPRGALALFGGWTGVDLAE

SEQ ID NO: 109925 - protein, 20 aa, Mycobacterium avium
SPVPRAALFVLDRWLRPAPP

SEQ ID NO: 109926 - protein, 20 aa, Mycobacterium avium
SQLRTALRMQILAGYPIAEA

SEQ ID NO: 109927 - protein, 17 aa, Mycobacterium avium
SRCSWAGAQAARLAAEA

SEQ ID NO: 109928 - protein, 19 aa, Mycobacterium avium
SRICASLGLPERVLTQQLR

SEQ ID NO: 109929 - protein, 21 aa, Mycobacterium avium
SRPDALLPLARRETGECLAED

SEQ ID NO: 109930 - protein, 19 aa, Mycobacterium avium
SRQRLEQVVIRFAGDSGDG

SEQ ID NO: 109931 - protein, 18 aa, Mycobacterium avium
SSFYRPTQQGAYPIVLAT

SEQ ID NO: 109932 - protein, 18 aa, Mycobacterium avium
SSGFPINLLGVWAQLATA

SEQ ID NO: 109933 - protein, 18 aa, Mycobacterium avium
SSYVASWYAAPLLVAGGR

SEQ ID NO: 109934 - protein, 22 aa, Mycobacterium avium
STKRVCRDCGFFLPLSGSLGRM

SEQ ID NO: 109935 - protein, 17 aa, Mycobacterium avium
STLLHRLTGMWPDRLAE

SEQ ID NO: 109936 - protein, 18 aa, Mycobacterium avium
STLVGSLSVPPGWTTAAP

SEQ ID NO: 109937 - protein, 17 aa, Mycobacterium avium
SVPRMRGVLALFEGVAT

SEQ ID NO: 109938 - protein, 25 aa, Mycobacterium avium
TAARPGWREARWVSVVINYRAERWS

SEQ ID NO: 109939 - protein, 21 aa, Mycobacterium avium
TACIKAMIEKVVERMYAEIDD

SEQ ID NO: 109940 - protein, 17 aa, Mycobacterium avium
TAELGRMYVHDGVVVVE

SEQ ID NO: 109941 - protein, 17 aa, Mycobacterium avium
TAIEVLKNFAFTEQRGA

SEQ ID NO: 109942 - protein, 22 aa, Mycobacterium avium
TARCRRWPHASAICDDVLRAVD

SEQ ID NO: 109943 - protein, 23 aa, Mycobacterium avium
TASNPDLFWALRGGGGGNFGVTT

SEQ ID NO: 109944 - protein, 25 aa, Mycobacterium avium
TAVDWRFAATVGRRLARPGPPSTDY

SEQ ID NO: 109945 - protein, 18 aa, Mycobacterium avium
TDAVRGWLAKTFSRNQNA

SEQ ID NO: 109946 - protein, 19 aa, Mycobacterium avium
TDCPLRWLAERHGGTDPRD

SEQ ID NO: 109947 - protein, 21 aa, Mycobacterium avium
TDEIKGRILAMAQPDAQGNRP

SEQ ID NO: 109948 - protein, 23 aa, Mycobacterium avium
TDEILMELGLDWDRIIELKTAGA

SEQ ID NO: 109949 - protein, 22 aa, Mycobacterium avium
TDPRARRGLAFQLVEGAAKLGR

SEQ ID NO: 109950 - protein, 21 aa, Mycobacterium avium
TDWKIELCDTIADNASSAGFV

SEQ ID NO: 109951 - protein, 18 aa, Mycobacterium avium
TEALRCLKRRLARVVFHH

SEQ ID NO: 109952 - protein, 20 aa, Mycobacterium avium
TEIPSPVAGVLISITAEEDS

SEQ ID NO: 109953 - protein, 17 aa, Mycobacterium avium
TELPYVWGTLGAPKDPT

SEQ ID NO: 109954 - protein, 20 aa, Mycobacterium avium
TEPWRAGPLLDYLRKMVFWS

SEQ ID NO: 109955 - protein, 18 aa, Mycobacterium avium
TFSGISIHSAHWDLELDL

SEQ ID NO: 109956 - protein, 18 aa, Mycobacterium avium
TFSLGSWWSGVAWSTIKV

SEQ ID NO: 109957 - protein, 22 aa, Mycobacterium avium
TGAGVSGLWLLSGMSDDGVLTT

SEQ ID NO: 109958 - protein, 22 aa, Mycobacterium avium
TGDCLFPGGVGKTWQPGDFDQL

SEQ ID NO: 109959 - protein, 23 aa, Mycobacterium avium
TGEVWPGKAYPLGASYDGAGTNF

SEQ ID NO: 109960 - protein, 19 aa, Mycobacterium avium
TGFLGRYLVLEWLEQLEQV

SEQ ID NO: 109961 - protein, 17 aa, Mycobacterium avium
TGHGWRVHSVDNRDEMA

SEQ ID NO: 109962 - protein, 23 aa, Mycobacterium avium
TGMAVYDWMCWRMNKKAEDRQRR

SEQ ID NO: 109963 - protein, 17 aa, Mycobacterium avium
TGMFERDGWQPGGIVVV

SEQ ID NO: 109964 - protein, 18 aa, Mycobacterium avium
TGSFRWASARALRLAARL

SEQ ID NO: 109965 - protein, 24 aa, Mycobacterium avium
TGYARRAGLTASRFVACPFGGPGA

SEQ ID NO: 109966 - protein, 24 aa, Mycobacterium avium
TGYARRSGLTASRFVACPFGGPGA

SEQ ID NO: 109967 - protein, 19 aa, Mycobacterium avium
TIRLPVHLVEQVNKLARIK

SEQ ID NO: 109968 - protein, 25 aa, Mycobacterium avium
TITPRWLLHLLNWVPVEAGIYRVNR

SEQ ID NO: 109969 - protein, 17 aa, Mycobacterium avium
TKGPMLINARADKVTSS

SEQ ID NO: 109970 - protein, 20 aa, Mycobacterium avium
TKGRFRLGLGTQVRTHVVRR

SEQ ID NO: 109971 - protein, 24 aa, Mycobacterium avium
TKNMGQWLAALGFQPGIGGPGSIS

SEQ ID NO: 109972 - protein, 22 aa, Mycobacterium avium
TLAMGHAMIRAGLPPKLHDKKP

SEQ ID NO: 109973 - protein, 17 aa, Mycobacterium avium
TLFRRFGSRAGLMMVLL

SEQ ID NO: 109974 - protein, 18 aa, Mycobacterium avium
TLLRCTRGAIVAAAVDVR

SEQ ID NO: 109975 - protein, 21 aa, Mycobacterium avium
TLLRRLVIMGGSYDHRGNTTA

SEQ ID NO: 109976 - protein, 18 aa, Mycobacterium avium
TPAPGWTLGNRGPNWVAL

SEQ ID NO: 109977 - protein, 21 aa, Mycobacterium avium
TPAQVLVRWNLQLDNVVVSRS

SEQ ID NO: 109978 - protein, 18 aa, Mycobacterium avium
TPHRGAWCGNDIWREVLP

SEQ ID NO: 109979 - protein, 18 aa, Mycobacterium avium
TPPGWRVVFGAAGRADCL

SEQ ID NO: 109980 - protein, 20 aa, Mycobacterium avium
TPQARLGLISAIRAAGLDCH

SEQ ID NO: 109981 - protein, 23 aa, Mycobacterium avium
TPRPRLAPTQAWRKMFGENFFYI

SEQ ID NO: 109982 - protein, 22 aa, Mycobacterium avium
TPWLTSRHSFSFGDHYDPDNTH

SEQ ID NO: 109983 - protein, 22 aa, Mycobacterium avium
TPWSALRWGRIIAEKTDIPAGV

SEQ ID NO: 109984 - protein, 19 aa, Mycobacterium avium
TRAALQWAMSVAAQRAAAL

SEQ ID NO: 109985 - protein, 24 aa, Mycobacterium avium
TRAYRLDWPAGMTVFEIDQPAVIE

SEQ ID NO: 109986 - protein, 20 aa, Mycobacterium avium
TRIYCAGGWYTGDTLDITTA

SEQ ID NO: 109987 - protein, 17 aa, Mycobacterium avium
TRLPYYANWIRLKSYWG

SEQ ID NO: 109988 - protein, 20 aa, Mycobacterium avium
TRVPVSIVHRADIEFPAPAL

SEQ ID NO: 109989 - protein, 17 aa, Mycobacterium avium
TSALWGGRCVKFDRIDF

SEQ ID NO: 109990 - protein, 19 aa, Mycobacterium avium
TSFARWSSILAEYAKSPAV

SEQ ID NO: 109991 - protein, 18 aa, Mycobacterium avium
TSFARWSSLLAEHALTPA

SEQ ID NO: 109992 - protein, 17 aa, Mycobacterium avium
TSLCYKLRLTVPGGATL

SEQ ID NO: 109993 - protein, 23 aa, Mycobacterium avium
TSPDIRALYAFKRLAWWPYSVAM

SEQ ID NO: 109994 - protein, 17 aa, Mycobacterium avium
TTIFPFRRVFIVAEVGS

SEQ ID NO: 109995 - protein, 20 aa, Mycobacterium avium
TTLWARRPATLEVFADTDAK

SEQ ID NO: 109996 - protein, 17 aa, Mycobacterium avium
TVLSRFGFPGGGYLAPE

SEQ ID NO: 109997 - protein, 19 aa, Mycobacterium avium
TVPEFPNFFIIYGPGTHLA

SEQ ID NO: 109998 - protein, 23 aa, Mycobacterium avium
TVYRQEMLRMFGLPESGLAETLR

SEQ ID NO: 109999 - protein, 18 aa, Mycobacterium avium
TYRFSVPNPGTYWAHPHT

SEQ ID NO: 110000 - protein, 18 aa, Mycobacterium avium
VAALARWSGDLTVAEDAV

SEQ ID NO: 110001 - protein, 23 aa, Mycobacterium avium
VAARFALDIIRHFPGRQARKVSC

SEQ ID NO: 110002 - protein, 17 aa, Mycobacterium avium
VAAWRGFSRWLMRAYDV

SEQ ID NO: 110003 - protein, 18 aa, Mycobacterium avium
VACGYYIFEAENLDEALA

SEQ ID NO: 110004 - protein, 19 aa, Mycobacterium avium
VAEFSRWYAGDVDLSDPPA

SEQ ID NO: 110005 - protein, 17 aa, Mycobacterium avium
VAERLRVLIDWTSSHLA

SEQ ID NO: 110006 - protein, 19 aa, Mycobacterium avium
VAFGKRWVTECLRASYPLG

SEQ ID NO: 110007 - protein, 18 aa, Mycobacterium avium
VAPQPGWRVDVGDTAITV

SEQ ID NO: 110008 - protein, 17 aa, Mycobacterium avium
VATGLGVPDSVKFDARG

SEQ ID NO: 110009 - protein, 23 aa, Mycobacterium avium
VDAKWAASISGYWRRGRTEETFR

SEQ ID NO: 110010 - protein, 18 aa, Mycobacterium avium
VDAVSWWILLEDLNIAWA

SEQ ID NO: 110011 - protein, 19 aa, Mycobacterium avium
VDELIEWQAPWVDFEAPEL

SEQ ID NO: 110012 - protein, 19 aa, Mycobacterium avium
VDGAWCFESRTMFVDQVGD

SEQ ID NO: 110013 - protein, 21 aa, Mycobacterium avium
VDGKVGWKGFHAIERDLWQAG

SEQ ID NO: 110014 - protein, 20 aa, Mycobacterium avium
VDRACAPWGLLAEDKQATLV

SEQ ID NO: 110015 - protein, 20 aa, Mycobacterium avium
VEDWPLLRWRMRQYRHGRWG

SEQ ID NO: 110016 - protein, 19 aa, Mycobacterium avium
VEIAEMFRLPPALERAWHA

SEQ ID NO: 110017 - protein, 21 aa, Mycobacterium avium
VEIGGPFSLELCGGTHVHNSA

SEQ ID NO: 110018 - protein, 19 aa, Mycobacterium avium
VELYPGWRKYEVRAGDRHI

SEQ ID NO: 110019 - protein, 21 aa, Mycobacterium avium
VEMRNRLKAATGLALSPTLIF

SEQ ID NO: 110020 - protein, 22 aa, Mycobacterium avium
VEVINRFLARFGVAAPFTAEQL

SEQ ID NO: 110021 - protein, 20 aa, Mycobacterium avium
VEWHKMGAGWSWTRKAGSDD

SEQ ID NO: 110022 - protein, 19 aa, Mycobacterium avium
VFSGYRFVRHAAARGIPIA

SEQ ID NO: 110023 - protein, 17 aa, Mycobacterium avium
VGAFPLALARRSLSGSN

SEQ ID NO: 110024 - protein, 21 aa, Mycobacterium avium
VGAYFPLGWQLACHVQGDAGV

SEQ ID NO: 110025 - protein, 20 aa, Mycobacterium avium
VGDWAGALERIWSKDRPDVV

SEQ ID NO: 110026 - protein, 23 aa, Mycobacterium avium
VGKTRLAGEWSRRVYEQGAVVLY

SEQ ID NO: 110027 - protein, 19 aa, Mycobacterium avium
VGLLLRLQRQLGLTYLFVS

SEQ ID NO: 110028 - protein, 17 aa, Mycobacterium avium
VGLPAFMIRAFCDLAER

SEQ ID NO: 110029 - protein, 17 aa, Mycobacterium avium
VGQVFDWAPSVTLSSGL

SEQ ID NO: 110030 - protein, 19 aa, Mycobacterium avium
VGVALRFLPDSWKAAASRV

SEQ ID NO: 110031 - protein, 19 aa, Mycobacterium avium
VHYPFPIKDLVAIDDALKF

SEQ ID NO: 110032 - protein, 19 aa, Mycobacterium avium
VICRRSRLMARIAGRGAMA

SEQ ID NO: 110033 - protein, 21 aa, Mycobacterium avium
VIGDLRIKLGPVRLGAASDLP

SEQ ID NO: 110034 - protein, 25 aa, Mycobacterium avium
VILSRCLQVPFALDFPSTYRLARRH

SEQ ID NO: 110035 - protein, 18 aa, Mycobacterium avium
VILWNRGCEELWGLRADE

SEQ ID NO: 110036 - protein, 19 aa, Mycobacterium avium
VKAALARRTNPAGLTGSLA

SEQ ID NO: 110037 - protein, 17 aa, Mycobacterium avium
VKAEFPDQMLAYNCSPS

SEQ ID NO: 110038 - protein, 21 aa, Mycobacterium avium
VKALGGRGVFGVELMVNDDEV

SEQ ID NO: 110039 - protein, 17 aa, Mycobacterium avium
VKRDAALCLATLRVGAD

SEQ ID NO: 110040 - protein, 20 aa, Mycobacterium avium
VKRVPLARARRAAQRHDYLG

SEQ ID NO: 110041 - protein, 25 aa, Mycobacterium avium
VLAHPCPMCLGALYYCSPREVIFLT

SEQ ID NO: 110042 - protein, 17 aa, Mycobacterium avium
VLYCKTGVRSAQALAVV

SEQ ID NO: 110043 - protein, 18 aa, Mycobacterium avium
VNGFCVGGGIGLVGNSDV

SEQ ID NO: 110044 - protein, 21 aa, Mycobacterium avium
VNMPAMPAGLPVSVPAQVTLP

SEQ ID NO: 110045 - protein, 23 aa, Mycobacterium avium
VNRLRPSEIQWALNHDAVHGIAY

SEQ ID NO: 110046 - protein, 22 aa, Mycobacterium avium
VNSWSAAFARYGRTVGQVLLSA

SEQ ID NO: 110047 - protein, 21 aa, Mycobacterium avium
VPCSRPLPWPARPVSSRVPEE

SEQ ID NO: 110048 - protein, 19 aa, Mycobacterium avium
VPFKAEFFGEPGWEPMGDQ

SEQ ID NO: 110049 - protein, 18 aa, Mycobacterium avium
VPGDIIWAPAIDGAFVLT

SEQ ID NO: 110050 - protein, 20 aa, Mycobacterium avium
VPPGRLGWGWAKFAFNGWKT

SEQ ID NO: 110051 - protein, 17 aa, Mycobacterium avium
VPQRLWAKPAITVIGID

SEQ ID NO: 110052 - protein, 20 aa, Mycobacterium avium
VQLILKFIPGMRERGFGQII

SEQ ID NO: 110053 - protein, 25 aa, Mycobacterium avium
VQLTRKRLGTGLVEAFSTSCPNCGG

SEQ ID NO: 110054 - protein, 17 aa, Mycobacterium avium
VQRPVWPMIVLRTPKGW

SEQ ID NO: 110055 - protein, 17 aa, Mycobacterium avium
VRALDMLLILHADHEQN

SEQ ID NO: 110056 - protein, 21 aa, Mycobacterium avium
VRARVKAVLVQKGFLGQDYAA

SEQ ID NO: 110057 - protein, 19 aa, Mycobacterium avium
VRAVARWLVVYLKRAGGQS

SEQ ID NO: 110058 - protein, 18 aa, Mycobacterium avium
VRDPRWIALAGWAPRIQV

SEQ ID NO: 110059 - protein, 19 aa, Mycobacterium avium
VREACLWSAGLTQSGVRRR

SEQ ID NO: 110060 - protein, 18 aa, Mycobacterium avium
VRGLHRFLAAEGLAELDV

SEQ ID NO: 110061 - protein, 22 aa, Mycobacterium avium
VRPEPFGALLYHFGTRKLSFLK

SEQ ID NO: 110062 - protein, 22 aa, Mycobacterium avium
VRPEVLHAWHLLQRSRGLMPVT

SEQ ID NO: 110063 - protein, 22 aa, Mycobacterium avium
VRRARRAVAEFRIRGVSTNIPF

SEQ ID NO: 110064 - protein, 19 aa, Mycobacterium avium
VRRGRCPPVGSVRDTVGVD

SEQ ID NO: 110065 - protein, 17 aa, Mycobacterium avium
VRRKRPGSAAARAAEAA

SEQ ID NO: 110066 - protein, 22 aa, Mycobacterium avium
VRSRLMLDIASWRRRRREELAA

SEQ ID NO: 110067 - protein, 17 aa, Mycobacterium avium
VRVDTWGGWLWINMDPD

SEQ ID NO: 110068 - protein, 20 aa, Mycobacterium avium
VSARTALTMFLGRADQPDRV

SEQ ID NO: 110069 - protein, 17 aa, Mycobacterium avium
VSLELADGLGLPVLSVR

SEQ ID NO: 110070 - protein, 24 aa, Mycobacterium avium
VSRALPGVEGFPADTFPVLVALMR

SEQ ID NO: 110071 - protein, 21 aa, Mycobacterium avium
VTAELLAGCARRLLDAPAVLG

SEQ ID NO: 110072 - protein, 20 aa, Mycobacterium avium
VTEAVLWLAGPRSRYVTGVA

SEQ ID NO: 110073 - protein, 19 aa, Mycobacterium avium
VVAERRLWLAVLRAQQQLG

SEQ ID NO: 110074 - protein, 17 aa, Mycobacterium avium
VVVSEPFLVAIPVLQEK

SEQ ID NO: 110075 - protein, 24 aa, Mycobacterium avium
VWGGAAPGGFDCSGLVMWAFQQAG

SEQ ID NO: 110076 - protein, 20 aa, Mycobacterium avium
VWVHPEWRGLGLGTAGTATV

SEQ ID NO: 110077 - protein, 24 aa, Mycobacterium avium
VYFELRLSDAWVWDMYRPARFVKQ

SEQ ID NO: 110078 - protein, 17 aa, Mycobacterium avium
VYRAELALVEVARKTGI

SEQ ID NO: 110079 - protein, 20 aa, Mycobacterium avium
WAAKVYGAWNLHCALQESGA

SEQ ID NO: 110080 - protein, 19 aa, Mycobacterium avium
WAGSLKRHGEWTVPTRLAL

SEQ ID NO: 110081 - protein, 18 aa, Mycobacterium avium
WAPPYAEAGAHNVTFHAE

SEQ ID NO: 110082 - protein, 20 aa, Mycobacterium avium
WASDVAAMFGYHADASAAVA

SEQ ID NO: 110083 - protein, 17 aa, Mycobacterium avium
WCSDIRAGAGLVLAGLV

SEQ ID NO: 110084 - protein, 17 aa, Mycobacterium avium
WDPGKDFAMVSARETGP

SEQ ID NO: 110085 - protein, 24 aa, Mycobacterium avium
WDVARGSYRPAWCTVREVEPAVTA

SEQ ID NO: 110086 - protein, 17 aa, Mycobacterium avium
WEFPFGFLDQGLSSPIR

SEQ ID NO: 110087 - protein, 17 aa, Mycobacterium avium
WEVHGGTSLAGYVVPQR

SEQ ID NO: 110088 - protein, 17 aa, Mycobacterium avium
WFACAGVRVADEQLRGR

SEQ ID NO: 110089 - protein, 21 aa, Mycobacterium avium
WFVACPFGAPGARMYRTGDLV

SEQ ID NO: 110090 - protein, 20 aa, Mycobacterium avium
WGDAVPDGFARISLGIEDTD

SEQ ID NO: 110091 - protein, 20 aa, Mycobacterium avium
WGEVIFPSLGMWASTFRTPE

SEQ ID NO: 110092 - protein, 24 aa, Mycobacterium avium
WGKPEEMAELLAFCASDKAGYLTG

SEQ ID NO: 110093 - protein, 19 aa, Mycobacterium avium
WGPAVAALARWSGDLTVAE

SEQ ID NO: 110094 - protein, 23 aa, Mycobacterium avium
WHERETYDFFGIIFDGHPSLTRI

SEQ ID NO: 110095 - protein, 18 aa, Mycobacterium avium
WHRFPLRDKVAAAVPATP

SEQ ID NO: 110096 - protein, 19 aa, Mycobacterium avium
WILLEDLNIAWALHRAGQP

SEQ ID NO: 110097 - protein, 18 aa, Mycobacterium avium
WILPLMWRMDAIYEARKS

SEQ ID NO: 110098 - protein, 23 aa, Mycobacterium avium
WKDGEALFLRCNIWREAAENVAE

SEQ ID NO: 110099 - protein, 17 aa, Mycobacterium avium
WLGTRLPYYANWIRLKS

SEQ ID NO: 110100 - protein, 17 aa, Mycobacterium avium
WLQFPQWFYFNIPVNTM

SEQ ID NO: 110101 - protein, 19 aa, Mycobacterium avium
WMGRVHRFLGLDVGVILAQ

SEQ ID NO: 110102 - protein, 18 aa, Mycobacterium avium
WNPALLALRAELERVFLA

SEQ ID NO: 110103 - protein, 17 aa, Mycobacterium avium
WNRPGWTVAELEAAKAG

SEQ ID NO: 110104 - protein, 24 aa, Mycobacterium avium
WPAKRAGTAAALWELSEELTGTKF

SEQ ID NO: 110105 - protein, 20 aa, Mycobacterium avium
WPASTVRNWFRGDYANLTLI

SEQ ID NO: 110106 - protein, 20 aa, Mycobacterium avium
WPDFPIGGLYKFKVHGADGV

SEQ ID NO: 110107 - protein, 21 aa, Mycobacterium avium
WPDRDYRPGLDILIAGCGTFQ

SEQ ID NO: 110108 - protein, 20 aa, Mycobacterium avium
WPHGRLRYYVAMLAELSQLR

SEQ ID NO: 110109 - protein, 17 aa, Mycobacterium avium
WPPTGWFEGWAGGLDVF

SEQ ID NO: 110110 - protein, 18 aa, Mycobacterium avium
WQLPLEWLQIPRGGVALD

SEQ ID NO: 110111 - protein, 18 aa, Mycobacterium avium
WQPLHTMPGISTFYTFYD

SEQ ID NO: 110112 - protein, 18 aa, Mycobacterium avium
WRALRASMRLVLEETTLA

SEQ ID NO: 110113 - protein, 19 aa, Mycobacterium avium
WRGFSRWLMRAYDVLIDED

SEQ ID NO: 110114 - protein, 19 aa, Mycobacterium avium
WRLLCEQVGAAALVIPEEL

SEQ ID NO: 110115 - protein, 17 aa, Mycobacterium avium
WRNRWITRDGIVECREA

SEQ ID NO: 110116 - protein, 18 aa, Mycobacterium avium
WRPDGQLDYRGRADEQVK

SEQ ID NO: 110117 - protein, 18 aa, Mycobacterium avium
WRPLPAEIYPLAEAKTAF

SEQ ID NO: 110118 - protein, 24 aa, Mycobacterium avium
WRQWWHWVPGASWRHPFGPDSDVA

SEQ ID NO: 110119 - protein, 21 aa, Mycobacterium avium
WRRGGLTASWFVACPFGAPGA

SEQ ID NO: 110120 - protein, 18 aa, Mycobacterium avium
WRRTEFRAVDAVSFRLHR

SEQ ID NO: 110121 - protein, 19 aa, Mycobacterium avium
WRRTPAPVRGALVARLGEL

SEQ ID NO: 110122 - protein, 17 aa, Mycobacterium avium
WRSAVAYARTLDGIDPD

SEQ ID NO: 110123 - protein, 20 aa, Mycobacterium avium
WRVNCFGAFLGMRAALERLR

SEQ ID NO: 110124 - protein, 17 aa, Mycobacterium avium
WRWGGQWTAPVDYQHFE

SEQ ID NO: 110125 - protein, 18 aa, Mycobacterium avium
WSAEGWVGVAGRVVNDGV

SEQ ID NO: 110126 - protein, 17 aa, Mycobacterium avium
WSSGCDHATWAFLGGPV

SEQ ID NO: 110127 - protein, 18 aa, Mycobacterium avium
WTLRGADESLCFAGANLI

SEQ ID NO: 110128 - protein, 22 aa, Mycobacterium avium
WVNTIFLSTRFKAWRVGGYNEY

SEQ ID NO: 110129 - protein, 18 aa, Mycobacterium avium
WWLQRRLLLSGIRATSPA

SEQ ID NO: 110130 - protein, 19 aa, Mycobacterium avium
WYCPVCLEVTNSALCGHEA

SEQ ID NO: 110131 - protein, 17 aa, Mycobacterium avium
YADMPLFLFHLLEYMDV

SEQ ID NO: 110132 - protein, 22 aa, Mycobacterium avium
YAFDPCCPFGGYKNSGIGRENG

SEQ ID NO: 110133 - protein, 26 aa, Mycobacterium avium
YAGVPITFGRPVWRVDLFGSTESPPG

SEQ ID NO: 110134 - protein, 23 aa, Mycobacterium avium
YAIEHWTRLPVEVELASEFRYRD

SEQ ID NO: 110135 - protein, 22 aa, Mycobacterium avium
YANKAVPCWMIFDDGYVRRYVT

SEQ ID NO: 110136 - protein, 17 aa, Mycobacterium avium
YDIRFPELYTELARRGA

SEQ ID NO: 110137 - protein, 25 aa, Mycobacterium avium
YEDLAWFCIRAWRFGAPAGLGAGGL

SEQ ID NO: 110138 - protein, 25 aa, Mycobacterium avium
YERSSCFWQRIAYLYSRFDDLIAEV

SEQ ID NO: 110139 - protein, 17 aa, Mycobacterium avium
YEVPLLLSALSPRMLRI

SEQ ID NO: 110140 - protein, 19 aa, Mycobacterium avium
YFTGTGLKGWFQRWFFTAV

SEQ ID NO: 110141 - protein, 18 aa, Mycobacterium avium
YGKDGSVMACVFNFAGAE

SEQ ID NO: 110142 - protein, 18 aa, Mycobacterium avium
YGKTASQVLLRWNLQLGN

SEQ ID NO: 110143 - protein, 17 aa, Mycobacterium avium
YGRDRIGLLTGDMSVNA

SEQ ID NO: 110144 - protein, 17 aa, Mycobacterium avium
YHALTWGPLVREIVYAA

SEQ ID NO: 110145 - protein, 18 aa, Mycobacterium avium
YILWAAWHRSGLQRRWLS

SEQ ID NO: 110146 - protein, 22 aa, Mycobacterium avium
YKWRKWLYFDCNWKVALEAFNE

SEQ ID NO: 110147 - protein, 17 aa, Mycobacterium avium
YLKRLTADLRRTRRRVA

SEQ ID NO: 110148 - protein, 17 aa, Mycobacterium avium
YLRFERYGPIALCTIDR

SEQ ID NO: 110149 - protein, 18 aa, Mycobacterium avium
YPALAALCDIFYPRVFLR

SEQ ID NO: 110150 - protein, 24 aa, Mycobacterium avium
YPEWSDGVTGCWVLARYDDGRPSQ

SEQ ID NO: 110151 - protein, 17 aa, Mycobacterium avium
YPGWPFRIAPGPRRHHR

SEQ ID NO: 110152 - protein, 22 aa, Mycobacterium avium
YQLSWWVNRFLEIFQTIGRDLE

SEQ ID NO: 110153 - protein, 19 aa, Mycobacterium avium
YQNAMRWYSFDPFTHISRE

SEQ ID NO: 110154 - protein, 25 aa, Mycobacterium avium
YQNLGAAHPMVWYKSFNYNLASQQP

SEQ ID NO: 110155 - protein, 22 aa, Mycobacterium avium
YQYRPELPFVLGAEIAGVVRSA

SEQ ID NO: 110156 - protein, 21 aa, Mycobacterium avium
YRDADGWIYLAGRTADWMRVD

SEQ ID NO: 110157 - protein, 18 aa, Mycobacterium avium
YRFTRPGHDITLFSRTMT

SEQ ID NO: 110158 - protein, 21 aa, Mycobacterium avium
YRGCSHACRYCFARPSHEYLE

SEQ ID NO: 110159 - protein, 23 aa, Mycobacterium avium
YRHGWSIGDTVIWDNRGVLHRAA

SEQ ID NO: 110160 - protein, 20 aa, Mycobacterium avium
YRHLVALGVRFVRAAATRLD

SEQ ID NO: 110161 - protein, 18 aa, Mycobacterium avium
YRPFYLRNLLDAVQGRTL

SEQ ID NO: 110162 - protein, 18 aa, Mycobacterium avium
YRQMRNFWATLMVSQGTP

SEQ ID NO: 110163 - protein, 17 aa, Mycobacterium avium
YRRALMLAASFGRSSDY

SEQ ID NO: 110164 - protein, 19 aa, Mycobacterium avium
YRWITPVSYTLPFRTVSGT

SEQ ID NO: 110165 - protein, 23 aa, Mycobacterium avium
YSDGRYSYQLTIYVFRYGEGTAM

SEQ ID NO: 110166 - protein, 19 aa, Mycobacterium avium
YTAPEFFDYLVALAAADPD

SEQ ID NO: 110167 - protein, 17 aa, Mycobacterium avium
YTPRLADMYNEWLDEGF

SEQ ID NO: 110168 - protein, 21 aa, Mycobacterium avium
YTQRPSWPGGIAVGKTAVSSS

SEQ ID NO: 110169 - protein, 19 aa, Mycobacterium avium
YVMPHWPKPWGRAADAVEQ

SEQ ID NO: 110170 - protein, 18 aa, Mycobacterium avium
YVQRLGVERIAAYEHALL

SEQ ID NO: 110171 - protein, 18 aa, Mycobacterium avium
YWDSAFAQRHWGGLLAPP

SEQ ID NO: 110172 - protein, 19 aa, Mycobacterium avium
YYAMTGWRLGWLLVPVELR

SEQ ID NO: 110173 - protein, 21 aa, Mycobacterium avium
AAAHGRFSLGLGLGAADLERR

SEQ ID NO: 110174 - protein, 18 aa, Mycobacterium avium
AAAKAQRGPLCVGIDPHP

SEQ ID NO: 110175 - protein, 22 aa, Mycobacterium avium
AAAKAQRGPLCVGIDPHPELLR

SEQ ID NO: 110176 - protein, 18 aa, Mycobacterium avium
AAALWLLCTIEFAARRWL

SEQ ID NO: 110177 - protein, 18 aa, Mycobacterium avium
AAAPGAWCAAPWRGAGHP

SEQ ID NO: 110178 - protein, 18 aa, Mycobacterium avium
AAAQRLGPLLAHHPGQRV

SEQ ID NO: 110179 - protein, 17 aa, Mycobacterium avium
AAASRWHGFAAAMNGVQ

SEQ ID NO: 110180 - protein, 18 aa, Mycobacterium avium
AAAVLSMYRYHADAHHVD

SEQ ID NO: 110181 - protein, 18 aa, Mycobacterium avium
AAEDWLCLLEAFDQPHRP

SEQ ID NO: 110182 - protein, 18 aa, Mycobacterium avium
AAELMGIQIPRFCDHPLL

SEQ ID NO: 110183 - protein, 18 aa, Mycobacterium avium
AAEQTWLHGWLLRAGPPP

SEQ ID NO: 110184 - protein, 23 aa, Mycobacterium avium
AAERLSSVGFPFPDTRVRVVGAD

SEQ ID NO: 110185 - protein, 18 aa, Mycobacterium avium
AAFEAGWIQPTWPREHGG

SEQ ID NO: 110186 - protein, 23 aa, Mycobacterium avium
AAFPRYHPRWAWSLTSVPVLREF

SEQ ID NO: 110187 - protein, 18 aa, Mycobacterium avium
AAFQLGVLERGLQMTAEY

SEQ ID NO: 110188 - protein, 18 aa, Mycobacterium avium
AAFTRLGGRIAKREQGRY

SEQ ID NO: 110189 - protein, 25 aa, Mycobacterium avium
AAGGRANDVSFIWAKMNRVIANKRA

SEQ ID NO: 110190 - protein, 18 aa, Mycobacterium avium
AAGRLPRWWDRLVTNGFH

SEQ ID NO: 110191 - protein, 32 aa, Mycobacterium avium
AAGTRWLWDAGIRPGMTIAWQLPSHVSAALLM

SEQ ID NO: 110192 - protein, 18 aa, Mycobacterium avium
AAHLWSRTDLRPEDVDLA

SEQ ID NO: 110193 - protein, 25 aa, Mycobacterium avium
AALHAGWRALGWWLVGTSRAMLTLA

SEQ ID NO: 110194 - protein, 18 aa, Mycobacterium avium
AALTRILLPRSRYGEYVA

SEQ ID NO: 110195 - protein, 20 aa, Mycobacterium avium
AAMTECRRALGDAGLLGVAW

SEQ ID NO: 110196 - protein, 23 aa, Mycobacterium avium
AAPETRIGFMLADAKPVAALSTA

SEQ ID NO: 110197 - protein, 18 aa, Mycobacterium avium
AAPSWRKGPRHIAGRGPR

SEQ ID NO: 110198 - protein, 18 aa, Mycobacterium avium
AARAAWRAVLDGFDTPTL

SEQ ID NO: 110199 - protein, 24 aa, Mycobacterium avium
AARGDFRAPLVIGDRLDTDIEGAN

SEQ ID NO: 110200 - protein, 18 aa, Mycobacterium avium
AARIEFMLADAAPIAAVG

SEQ ID NO: 110201 - protein, 24 aa, Mycobacterium avium
AARIKSLGYGAAWIGGSPDAELSW

SEQ ID NO: 110202 - protein, 20 aa, Mycobacterium avium
AARMWARLRIHLAEAGRRMR

SEQ ID NO: 110203 - protein, 18 aa, Mycobacterium avium
AARRCPPDSGVTFLPSDP

SEQ ID NO: 110204 - protein, 20 aa, Mycobacterium avium
AASARFGLLLARTGPDKHRD

SEQ ID NO: 110205 - protein, 17 aa, Mycobacterium avium
AASEEWAGLGVGLLGNA

SEQ ID NO: 110206 - protein, 24 aa, Mycobacterium avium
AASFSWEFENGFSLSRIARLDTMV

SEQ ID NO: 110207 - protein, 17 aa, Mycobacterium avium
AATAFEWGLISYVVDDD

SEQ ID NO: 110208 - protein, 17 aa, Mycobacterium avium
AATAFEWGMISHITSAD

SEQ ID NO: 110209 - protein, 23 aa, Mycobacterium avium
AATHPARLALRWRPDDYRGERHG

SEQ ID NO: 110210 - protein, 25 aa, Mycobacterium avium
AATVGRLSVPPAWPAANPVAPLGET

SEQ ID NO: 110211 - protein, 19 aa, Mycobacterium avium
AAVGDWMLLAAIQALIDGH

SEQ ID NO: 110212 - protein, 19 aa, Mycobacterium avium
AAVLWRYALRLTGDASQSE

SEQ ID NO: 110213 - protein, 17 aa, Mycobacterium avium
AAVQRSVVISAGWDVMD

SEQ ID NO: 110214 - protein, 18 aa, Mycobacterium avium
AAVRPEWPLLVQAIAEVQ

SEQ ID NO: 110215 - protein, 18 aa, Mycobacterium avium
AAWGHDWSATELQVGAAV

SEQ ID NO: 110216 - protein, 21 aa, Mycobacterium avium
ACARLGERALICFGGTDVRGV

SEQ ID NO: 110217 - protein, 20 aa, Mycobacterium avium
ACDRWRVVPDVYLLGKALGG

SEQ ID NO: 110218 - protein, 17 aa, Mycobacterium avium
ACGDCALNRGVFTDAYG

SEQ ID NO: 110219 - protein, 19 aa, Mycobacterium avium
ACGPHHRLLQPGAWTTHRN

SEQ ID NO: 110220 - protein, 18 aa, Mycobacterium avium
ACIPSLYEGFSLPAVEAM

SEQ ID NO: 110221 - protein, 19 aa, Mycobacterium avium
ACLDRYARLFAHLRTWDSH

SEQ ID NO: 110222 - protein, 18 aa, Mycobacterium avium
ACPFGGPGARMYRTGDLV

SEQ ID NO: 110223 - protein, 20 aa, Mycobacterium avium
ACSACYWAQALVLGVDLNMP

SEQ ID NO: 110224 - protein, 21 aa, Mycobacterium avium
ACSFRLTGRFFRRRPEESKVL

SEQ ID NO: 110225 - protein, 17 aa, Mycobacterium avium
ACWAAPGGQGWLHGEAV

SEQ ID NO: 110226 - protein, 18 aa, Mycobacterium avium
ADAFRSWRVLVSKYGTPA

SEQ ID NO: 110227 - protein, 24 aa, Mycobacterium avium
ADAYGADFFAPWGKLAALRTPTIA

SEQ ID NO: 110228 - protein, 24 aa, Mycobacterium avium
ADAYGADFFAPWGKLAAVRTPTIA

SEQ ID NO: 110229 - protein, 24 aa, Mycobacterium avium
ADAYGADFFATWGKLAAVRTPTIA

SEQ ID NO: 110230 - protein, 23 aa, Mycobacterium avium
ADDVRAGWDWLINTCGVPPEQMV

SEQ ID NO: 110231 - protein, 21 aa, Mycobacterium avium
ADEIKGRILAMAQPDAQGNRP

SEQ ID NO: 110232 - protein, 18 aa, Mycobacterium avium
ADESLCFAGANLIPLRGA

SEQ ID NO: 110233 - protein, 18 aa, Mycobacterium avium
ADESLCFAGANLITLRGA

SEQ ID NO: 110234 - protein, 17 aa, Mycobacterium avium
ADESLCFAGANLVPLRG

SEQ ID NO: 110235 - protein, 18 aa, Mycobacterium avium
ADFRLFWDNAYAVHTLTH

SEQ ID NO: 110236 - protein, 23 aa, Mycobacterium avium
ADGALRRSIKFPSFLDGIDAVRR

SEQ ID NO: 110237 - protein, 21 aa, Mycobacterium avium
ADGEFSYTLAQPWGVIGAIIT

SEQ ID NO: 110238 - protein, 23 aa, Mycobacterium avium
ADGGVRLTGRWSWATGAMDADWL

SEQ ID NO: 110239 - protein, 23 aa, Mycobacterium avium
ADGGVRLTGRWSWATGAMEADWL

SEQ ID NO: 110240 - protein, 23 aa, Mycobacterium avium
ADGGVRLTGRWSWATGARDADWL

SEQ ID NO: 110241 - protein, 19 aa, Mycobacterium avium
ADGWAGYYYYGFSQAIGGG

SEQ ID NO: 110242 - protein, 20 aa, Mycobacterium avium
ADGWECQRALSVANNVIVDI

SEQ ID NO: 110243 - protein, 18 aa, Mycobacterium avium
ADGWRISQDMSLLGAAAA

SEQ ID NO: 110244 - protein, 19 aa, Mycobacterium avium
ADHFRYFAGALRAQEGSLS

SEQ ID NO: 110245 - protein, 17 aa, Mycobacterium avium
ADIILFDICHDIETNEY

SEQ ID NO: 110246 - protein, 17 aa, Mycobacterium avium
ADIILFDICHDIETNKY

SEQ ID NO: 110247 - protein, 22 aa, Mycobacterium avium
ADKRIGYDFLFPGIGYGASCLP

SEQ ID NO: 110248 - protein, 17 aa, Mycobacterium avium
ADKRLETVLPFSWQGVS

SEQ ID NO: 110249 - protein, 17 aa, Mycobacterium avium
ADKWLPLLENRIPVVAA

SEQ ID NO: 110250 - protein, 17 aa, Mycobacterium avium
ADLEKLWKVIGLSEQDT

SEQ ID NO: 110251 - protein, 17 aa, Mycobacterium avium
ADLLLAHLVLRPFLDAY

SEQ ID NO: 110252 - protein, 19 aa, Mycobacterium avium
ADLLPAVGLIKTITDTVPG

SEQ ID NO: 110253 - protein, 20 aa, Mycobacterium avium
ADLRAAGFGQLAFVDLFNHS

SEQ ID NO: 110254 - protein, 18 aa, Mycobacterium avium
ADLYAEPTLRSWQRLFDA

SEQ ID NO: 110255 - protein, 17 aa, Mycobacterium avium
ADMMKRNLLELGGKSVY

SEQ ID NO: 110256 - protein, 24 aa, Mycobacterium avium
ADPTMAWRYLELHANGSESDAQIR

SEQ ID NO: 110257 - protein, 24 aa, Mycobacterium avium
ADVEFAGAVALRLNEAGGRDAVDS

SEQ ID NO: 110258 - protein, 19 aa, Mycobacterium avium
ADVMLRYNFPGAGLTDDAL

SEQ ID NO: 110259 - protein, 17 aa, Mycobacterium avium
ADVPRTWILTTRDRALS

SEQ ID NO: 110260 - protein, 17 aa, Mycobacterium avium
ADYRGASVMVEWPTELQ

SEQ ID NO: 110261 - protein, 21 aa, Mycobacterium avium
AEAAYRKGLSWSEAADTIDLG

SEQ ID NO: 110262 - protein, 17 aa, Mycobacterium avium
AEFTGAVQQHWGPPPGQ

SEQ ID NO: 110263 - protein, 18 aa, Mycobacterium avium
AEGERLWLSWAMANRDPS

SEQ ID NO: 110264 - protein, 25 aa, Mycobacterium avium
AEGRGCARVEFKLRDWLFARQRYWG

SEQ ID NO: 110265 - protein, 20 aa, Mycobacterium avium
AEGRLGWRTLDFEVEVLPIG

SEQ ID NO: 110266 - protein, 17 aa, Mycobacterium avium
AEKATALCWLREVDAET

SEQ ID NO: 110267 - protein, 19 aa, Mycobacterium avium
AEKCTLCYPRMEVGLPTIC

SEQ ID NO: 110268 - protein, 19 aa, Mycobacterium avium
AELAALCRAELAGYKQPRR

SEQ ID NO: 110269 - protein, 24 aa, Mycobacterium avium
AELARANGWAGLIVNGAVRDSAAL

SEQ ID NO: 110270 - protein, 17 aa, Mycobacterium avium
AELFLPAPLRWLVGATR

SEQ ID NO: 110271 - protein, 17 aa, Mycobacterium avium
AELGEQCAFGLALIAPR

SEQ ID NO: 110272 - protein, 22 aa, Mycobacterium avium
AELGEQCAFGLALIAPRLPPFD

SEQ ID NO: 110273 - protein, 19 aa, Mycobacterium avium
AELHTRLTLSFIVTPHTSI

SEQ ID NO: 110274 - protein, 19 aa, Mycobacterium avium
AELPAGRSGEVWVRSNQNM

SEQ ID NO: 110275 - protein, 19 aa, Mycobacterium avium
AELPGFRPPTAVGHTGELV

SEQ ID NO: 110276 - protein, 20 aa, Mycobacterium avium
AELPGFRPPTAVGHTGELVS

SEQ ID NO: 110277 - protein, 24 aa, Mycobacterium avium
AELPRDVVVGLEMPQREAALAGTG

SEQ ID NO: 110278 - protein, 20 aa, Mycobacterium avium
AELRATGALTDTEFAEQKQR

SEQ ID NO: 110279 - protein, 18 aa, Mycobacterium avium
AEMAEFLARYGYRCAGEI

SEQ ID NO: 110280 - protein, 18 aa, Mycobacterium avium
AEQCRRLDALGIGYEIVP

SEQ ID NO: 110281 - protein, 22 aa, Mycobacterium avium
AEQMKMFLTRLGFGSKIVVTGD

SEQ ID NO: 110282 - protein, 17 aa, Mycobacterium avium
AEQTWLHGWLLRAGPPP

SEQ ID NO: 110283 - protein, 17 aa, Mycobacterium avium
AEQTWLHGWLLRAGPPS

SEQ ID NO: 110284 - protein, 20 aa, Mycobacterium avium
AEYLSALGFQFEAFELEHLG

SEQ ID NO: 110285 - protein, 19 aa, Mycobacterium avium
AFAARLAHRMGRVLADGKS

SEQ ID NO: 110286 - protein, 18 aa, Mycobacterium avium
AFCFLRGAGLVQLGEHCW

SEQ ID NO: 110287 - protein, 18 aa, Mycobacterium avium
AFGKRWVTECLRASYPLG

SEQ ID NO: 110288 - protein, 18 aa, Mycobacterium avium
AFGRLDALINCAGIAEPA

SEQ ID NO: 110289 - protein, 20 aa, Mycobacterium avium
AFIYPRITAYLAQRLQVEDW

SEQ ID NO: 110290 - protein, 21 aa, Mycobacterium avium
AFTEQRGATLIAREPIGVCGL

SEQ ID NO: 110291 - protein, 18 aa, Mycobacterium avium
AFVLIPWLAVDPDAQLTV

SEQ ID NO: 110292 - protein, 27 aa, Mycobacterium avium
AGASPRFYASWCRLLPAGVDLYGVTYP

SEQ ID NO: 110293 - protein, 24 aa, Mycobacterium avium
AGCKICDRAACPQRAFPYLGRPVS

SEQ ID NO: 110294 - protein, 22 aa, Mycobacterium avium
AGDIGYNCHLIFRTDLYRRTTI

SEQ ID NO: 110295 - protein, 19 aa, Mycobacterium avium
AGERLRLEIAAAREDVARL

SEQ ID NO: 110296 - protein, 24 aa, Mycobacterium avium
AGERPAVVPLSFAQNRLWFLDQLQ

SEQ ID NO: 110297 - protein, 24 aa, Mycobacterium avium
AGERPAVVPLSFAQSRLWFLDQLQ

SEQ ID NO: 110298 - protein, 18 aa, Mycobacterium avium
AGFGAPRYGVKPIVMPKP

SEQ ID NO: 110299 - protein, 19 aa, Mycobacterium avium
AGGVLRFSADFAELADRDV

SEQ ID NO: 110300 - protein, 24 aa, Mycobacterium avium
AGHALKASIAWRTLRALLLSRRGD

SEQ ID NO: 110301 - protein, 18 aa, Mycobacterium avium
AGIDVAVCKPVQTGTDDG

SEQ ID NO: 110302 - protein, 27 aa, Mycobacterium avium
AGIKLPRSSGAMYRVGQKILPQQARKG

SEQ ID NO: 110303 - protein, 17 aa, Mycobacterium avium
AGKRALAKWAFGVGRAR

SEQ ID NO: 110304 - protein, 25 aa, Mycobacterium avium
AGLINRIRLAGAIPRHIAAHPSPTG

SEQ ID NO: 110305 - protein, 17 aa, Mycobacterium avium
AGMVLAITGYVWQRGIG

SEQ ID NO: 110306 - protein, 26 aa, Mycobacterium avium
AGRRGCLPRCRHDLGFRPTVAALGAR

SEQ ID NO: 110307 - protein, 21 aa, Mycobacterium avium
AGRWLRPGGLIGIEHDDTTSH

SEQ ID NO: 110308 - protein, 18 aa, Mycobacterium avium
AGVARSGFYFYFDSKYAV

SEQ ID NO: 110309 - protein, 19 aa, Mycobacterium avium
AGVDCFVAGLAVYGADDPA

SEQ ID NO: 110310 - protein, 18 aa, Mycobacterium avium
AGVTWGVIQYHFGDRNGL

SEQ ID NO: 110311 - protein, 19 aa, Mycobacterium avium
AHFRPELTAVLAKHEFSAA

SEQ ID NO: 110312 - protein, 22 aa, Mycobacterium avium
AHLPGYQGWQWAVVVAAYPGAD

SEQ ID NO: 110313 - protein, 17 aa, Mycobacterium avium
AHLRQAGAFVFVMVGTV

SEQ ID NO: 110314 - protein, 24 aa, Mycobacterium avium
AHSSCFSMALALKLGENHTPPQRL

SEQ ID NO: 110315 - protein, 22 aa, Mycobacterium avium
AHTQLAWVLGCFTGFGQASRMT

SEQ ID NO: 110316 - protein, 17 aa, Mycobacterium avium
AIAELRTLWHGPSSTAM

SEQ ID NO: 110317 - protein, 19 aa, Mycobacterium avium
AIAPGRCAAVAVPAEGTEK

SEQ ID NO: 110318 - protein, 19 aa, Mycobacterium avium
AICHGPWTLVEAGVATGRT

SEQ ID NO: 110319 - protein, 18 aa, Mycobacterium avium
AIGGGLCLALAADIRVAS

SEQ ID NO: 110320 - protein, 18 aa, Mycobacterium avium
AIGWVFKVKGRWRAYQSQ

SEQ ID NO: 110321 - protein, 17 aa, Mycobacterium avium
AIIKALRTAAVNDTKDA

SEQ ID NO: 110322 - protein, 20 aa, Mycobacterium avium
AILLPAHWQTAAVLFGVWWI

SEQ ID NO: 110323 - protein, 25 aa, Mycobacterium avium
AILLPAHWQTAAVLFGVWWIGAEAV

SEQ ID NO: 110324 - protein, 28 aa, Mycobacterium avium
AIMRRIPPNWGRWVGCSRGWYPIIIALD

SEQ ID NO: 110325 - protein, 27 aa, Mycobacterium avium
AISTGWDCPRAEVLVSFRPAVDPTHIT

SEQ ID NO: 110326 - protein, 17 aa, Mycobacterium avium
AKALRWQFDGVDRVGPD

SEQ ID NO: 110327 - protein, 20 aa, Mycobacterium avium
AKILPIIAGTLFPNALGEIV

SEQ ID NO: 110328 - protein, 17 aa, Mycobacterium avium
AKLNWWESRALYGWTVL

SEQ ID NO: 110329 - protein, 19 aa, Mycobacterium avium
AKQWPGVRVRVIPAMTAAQ

SEQ ID NO: 110330 - protein, 18 aa, Mycobacterium avium
AKTWSTWAFAADYGLCLA

SEQ ID NO: 110331 - protein, 19 aa, Mycobacterium avium
AKTWSTWAFAADYGLCLAR

SEQ ID NO: 110332 - protein, 18 aa, Mycobacterium avium
AKVFLCSEVARWIDEEGL

SEQ ID NO: 110333 - protein, 18 aa, Mycobacterium avium
ALAKLWAHACEWEDNPPK

SEQ ID NO: 110334 - protein, 21 aa, Mycobacterium avium
ALCARFRISGLPVVDDSGALV

SEQ ID NO: 110335 - protein, 17 aa, Mycobacterium avium
ALDARPALTAALNTVET

SEQ ID NO: 110336 - protein, 18 aa, Mycobacterium avium
ALDITLPMPARWTQVPDP

SEQ ID NO: 110337 - protein, 19 aa, Mycobacterium avium
ALDVAARWQAMVRAMRNNG

SEQ ID NO: 110338 - protein, 20 aa, Mycobacterium avium
ALHSPFWWLKCAVGVHNTDH

SEQ ID NO: 110339 - protein, 18 aa, Mycobacterium avium
ALIMPARFRSISYVDRIA

SEQ ID NO: 110340 - protein, 20 aa, Mycobacterium avium
ALINYFIAWQTYRIINWTIR

SEQ ID NO: 110341 - protein, 21 aa, Mycobacterium avium
ALIRLRWAFAAAVYHGEAPAI

SEQ ID NO: 110342 - protein, 23 aa, Mycobacterium avium
ALKEWKGNPGLPLLRYMIANRIP

SEQ ID NO: 110343 - protein, 17 aa, Mycobacterium avium
ALLWRVGVVEIRDDDRT

SEQ ID NO: 110344 - protein, 18 aa, Mycobacterium avium
ALMRGCPFHNAAVEAGQT

SEQ ID NO: 110345 - protein, 18 aa, Mycobacterium avium
ALPAARIEFMLADAAPIA

SEQ ID NO: 110346 - protein, 17 aa, Mycobacterium avium
ALPFGLWVPVLPGTRQV

SEQ ID NO: 110347 - protein, 18 aa, Mycobacterium avium
ALPSNWGRWGTTDELGTL

SEQ ID NO: 110348 - protein, 23 aa, Mycobacterium avium
ALRCPACAYVRWAAVVSAHEDGG

SEQ ID NO: 110349 - protein, 17 aa, Mycobacterium avium
ALRGVDRLVRFPGPNGL

SEQ ID NO: 110350 - protein, 19 aa, Mycobacterium avium
ALRRHFNWVRSWYDFAVPD

SEQ ID NO: 110351 - protein, 20 aa, Mycobacterium avium
ALRRHFNWVRSWYDFAVPDI

SEQ ID NO: 110352 - protein, 20 aa, Mycobacterium avium
ALRRTYLRLGHRVDVIEPVA

SEQ ID NO: 110353 - protein, 20 aa, Mycobacterium avium
ALTELWVRPALSLPAVAEDL

SEQ ID NO: 110354 - protein, 18 aa, Mycobacterium avium
ALTESAAWGHDWSATELQ

SEQ ID NO: 110355 - protein, 18 aa, Mycobacterium avium
ALTESAAWGHDWSATEVH

SEQ ID NO: 110356 - protein, 17 aa, Mycobacterium avium
ALTRARAGWLWSRRRGV

SEQ ID NO: 110357 - protein, 23 aa, Mycobacterium avium
ALTYPRRLGFGLGNSVVSLSWRT

SEQ ID NO: 110358 - protein, 17 aa, Mycobacterium avium
AMAARTRFFDSFFQAAT

SEQ ID NO: 110359 - protein, 22 aa, Mycobacterium avium
AMELGCDAVLLATAVTRAGDPA

SEQ ID NO: 110360 - protein, 20 aa, Mycobacterium avium
AMIKKLSIRLGVPAYPNDPM

SEQ ID NO: 110361 - protein, 18 aa, Mycobacterium avium
AMQAAGWGRFVHIGSATA

SEQ ID NO: 110362 - protein, 24 aa, Mycobacterium avium
AMYANKAVPCWMIFDDGYVRRYVT

SEQ ID NO: 110363 - protein, 26 aa, Mycobacterium avium
ANDKDIEEFGRWFGVQVEDGFGSTEN

SEQ ID NO: 110364 - protein, 20 aa, Mycobacterium avium
ANDSRYGLVGAVWSADAERA

SEQ ID NO: 110365 - protein, 21 aa, Mycobacterium avium
ANDSRYGLVGAVWSSDEERAA

SEQ ID NO: 110366 - protein, 18 aa, Mycobacterium avium
ANEKCDWMPAVASNGGGR

SEQ ID NO: 110367 - protein, 25 aa, Mycobacterium avium
ANGGNAQRWFVVWLGTSNDPVDKVA

SEQ ID NO: 110368 - protein, 23 aa, Mycobacterium avium
ANLKRAWELMGMRVHWQSSNDLV

SEQ ID NO: 110369 - protein, 18 aa, Mycobacterium avium
ANLLEHLASWGIVAAAPD

SEQ ID NO: 110370 - protein, 19 aa, Mycobacterium avium
APAIRPAALALPATTVTAA

SEQ ID NO: 110371 - protein, 18 aa, Mycobacterium avium
APARWNSTWTRYPSSRRC

SEQ ID NO: 110372 - protein, 18 aa, Mycobacterium avium
APDGECWLLASIGMLLVE

SEQ ID NO: 110373 - protein, 22 aa, Mycobacterium avium
APETRIGFMLADAKPVAALSTA

SEQ ID NO: 110374 - protein, 18 aa, Mycobacterium avium
APFLRTVAVWGPSDQAWT

SEQ ID NO: 110375 - protein, 22 aa, Mycobacterium avium
APKARDAWQFFQRMLADVTAIV

SEQ ID NO: 110376 - protein, 18 aa, Mycobacterium avium
APLAARWISAGARIVGGC

SEQ ID NO: 110377 - protein, 18 aa, Mycobacterium avium
APLKAGEFILGYPDEVGP

SEQ ID NO: 110378 - protein, 17 aa, Mycobacterium avium
APRELGLLIGIVPGRPR

SEQ ID NO: 110379 - protein, 19 aa, Mycobacterium avium
APVQIRFGIDFVAASLADA

SEQ ID NO: 110380 - protein, 18 aa, Mycobacterium avium
APVRVGFRLGEPAAGELG

SEQ ID NO: 110381 - protein, 20 aa, Mycobacterium avium
APWLPVYWVFGGFLRKRRNI

SEQ ID NO: 110382 - protein, 22 aa, Mycobacterium avium
APWLPVYWVFGGFLRKRRNIRD

SEQ ID NO: 110383 - protein, 19 aa, Mycobacterium avium
APYNDIVGWKWTEVPNALG

SEQ ID NO: 110384 - protein, 18 aa, Mycobacterium avium
AQAIRVAREFARSAEESG

SEQ ID NO: 110385 - protein, 20 aa, Mycobacterium avium
AQARRIAVDIGYPVLVRPSY

SEQ ID NO: 110386 - protein, 24 aa, Mycobacterium avium
AQEFYFPVCFELAVTKGAPAPHDN

SEQ ID NO: 110387 - protein, 24 aa, Mycobacterium avium
AQELYFPVCFELAVTKGAPAPHDN

SEQ ID NO: 110388 - protein, 24 aa, Mycobacterium avium
AQELYFPVCFELAVTKGAPPPHDN

SEQ ID NO: 110389 - protein, 17 aa, Mycobacterium avium
AQFELVKLPALDAPPAE

SEQ ID NO: 110390 - protein, 19 aa, Mycobacterium avium
AQFTARWGLTGTLITVDGE

SEQ ID NO: 110391 - protein, 17 aa, Mycobacterium avium
AQILAGFCDVALVIGAD

SEQ ID NO: 110392 - protein, 17 aa, Mycobacterium avium
AQLDWPLADAVRWPAQY

SEQ ID NO: 110393 - protein, 21 aa, Mycobacterium avium
AQMPMKVISMLLGIPEDDQEY

SEQ ID NO: 110394 - protein, 19 aa, Mycobacterium avium
AQQRRFRGATLRRQTDRHA

SEQ ID NO: 110395 - protein, 17 aa, Mycobacterium avium
AQRLPEYMVPAAVVVLE

SEQ ID NO: 110396 - protein, 24 aa, Mycobacterium avium
AQRPLKWRLILTLGEPGDPTHDAT

SEQ ID NO: 110397 - protein, 24 aa, Mycobacterium avium
AQSALDMACRWARDRDVFGGRLAD

SEQ ID NO: 110398 - protein, 19 aa, Mycobacterium avium
ARAAFRLAWGTEPIDMGMG

SEQ ID NO: 110399 - protein, 20 aa, Mycobacterium avium
ARAEWWYSRAATIMGGTAEV

SEQ ID NO: 110400 - protein, 19 aa, Mycobacterium avium
ARAEWWYSRAATVMGGTAE

SEQ ID NO: 110401 - protein, 27 aa, Mycobacterium avium
ARARLAAFKVPARWFVADAFPVTPTGK

SEQ ID NO: 110402 - protein, 17 aa, Mycobacterium avium
ARARLLAPIPRPPSIRD

SEQ ID NO: 110403 - protein, 17 aa, Mycobacterium avium
ARARLNPGAGLMLSAVW

SEQ ID NO: 110404 - protein, 19 aa, Mycobacterium avium
ARASFKYGLNAKWPVYLST

SEQ ID NO: 110405 - protein, 19 aa, Mycobacterium avium
AREFHKFLLAKQHEIASVI

SEQ ID NO: 110406 - protein, 22 aa, Mycobacterium avium
ARFADMYRRIVLDGDASAAVPD

SEQ ID NO: 110407 - protein, 19 aa, Mycobacterium avium
ARFPGHQILGIPMRDASRP

SEQ ID NO: 110408 - protein, 23 aa, Mycobacterium avium
ARFRDALFPVWRYHPFFTNTDLP

SEQ ID NO: 110409 - protein, 19 aa, Mycobacterium avium
ARFRLPLSLADHLPDIADY

SEQ ID NO: 110410 - protein, 19 aa, Mycobacterium avium
ARFRLPLSLADHLPEIADY

SEQ ID NO: 110411 - protein, 19 aa, Mycobacterium avium
ARFWLFGVIPAWTHHLTIE

SEQ ID NO: 110412 - protein, 20 aa, Mycobacterium avium
ARGLSQRGVPFSWAGGGING

SEQ ID NO: 110413 - protein, 21 aa, Mycobacterium avium
ARIAPMLWLRAGARGPIITEI

SEQ ID NO: 110414 - protein, 18 aa, Mycobacterium avium
ARKCGVCGEIAQIQARAT

SEQ ID NO: 110415 - protein, 20 aa, Mycobacterium avium
ARLAAALGLKPDRVVWMNQV

SEQ ID NO: 110416 - protein, 17 aa, Mycobacterium avium
ARLCRELGLPLVVDAAQ

SEQ ID NO: 110417 - protein, 22 aa, Mycobacterium avium
ARLGEALALLGWNMSLSNLRWD

SEQ ID NO: 110418 - protein, 17 aa, Mycobacterium avium
ARLLAGIAPRSAAAAGR

SEQ ID NO: 110419 - protein, 19 aa, Mycobacterium avium
ARLLAPIPRPPSIRDSLCF

SEQ ID NO: 110420 - protein, 18 aa, Mycobacterium avium
ARLTAPVGLHLAHALVCD

SEQ ID NO: 110421 - protein, 18 aa, Mycobacterium avium
ARPAVMPMDAWRDGDQFV

SEQ ID NO: 110422 - protein, 19 aa, Mycobacterium avium
ARPAVMPMDAWRDGDQFVV

SEQ ID NO: 110423 - protein, 17 aa, Mycobacterium avium
ARRGTAELGRMYVHDGV

SEQ ID NO: 110424 - protein, 24 aa, Mycobacterium avium
ARRIECSPLPFGRHRWVSTGAQGA

SEQ ID NO: 110425 - protein, 22 aa, Mycobacterium avium
ARRKGIKVAHAHLRYLNPFPAN

SEQ ID NO: 110426 - protein, 20 aa, Mycobacterium avium
ARRPGRACGAHRAGDTARGR

SEQ ID NO: 110427 - protein, 18 aa, Mycobacterium avium
ARRYPAIMAMTSLNDTRV

SEQ ID NO: 110428 - protein, 23 aa, Mycobacterium avium
ARSRPRFVAAMLRHADKVILLSE

SEQ ID NO: 110429 - protein, 18 aa, Mycobacterium avium
ARVQAVLVQKGFLGQDYA

SEQ ID NO: 110430 - protein, 19 aa, Mycobacterium avium
ARWGYKFRFGVFKIDDHDL

SEQ ID NO: 110431 - protein, 18 aa, Mycobacterium avium
ASAGVWKLTPFDSPPPAA

SEQ ID NO: 110432 - protein, 18 aa, Mycobacterium avium
ASGWCTAAPCLRPQPCID

SEQ ID NO: 110433 - protein, 21 aa, Mycobacterium avium
ASHMRFWFGAVYGRACRLTGR

SEQ ID NO: 110434 - protein, 18 aa, Mycobacterium avium
ASKTRFAIYLGDLGTDTA

SEQ ID NO: 110435 - protein, 17 aa, Mycobacterium avium
ASLKWDRVSKLVFTNCD

SEQ ID NO: 110436 - protein, 20 aa, Mycobacterium avium
ASLRPADIAFTFTDYERDWA

SEQ ID NO: 110437 - protein, 19 aa, Mycobacterium avium
ASNITRLPVRYTFDNRYFS

SEQ ID NO: 110438 - protein, 23 aa, Mycobacterium avium
ASPKETWLRLLLIDAGIPVPATQ

SEQ ID NO: 110439 - protein, 25 aa, Mycobacterium avium
ASQVLLRWNLQLGNAVIFRSANAEH

SEQ ID NO: 110440 - protein, 26 aa, Mycobacterium avium
ASQVLLRWNLQLGNAVIFRSANAEHI

SEQ ID NO: 110441 - protein, 21 aa, Mycobacterium avium
ASQVLLRWNLQLSNAVIFRSA

SEQ ID NO: 110442 - protein, 21 aa, Mycobacterium avium
ASRALAMAVQWARERHQFGRP

SEQ ID NO: 110443 - protein, 17 aa, Mycobacterium avium
ASTVRNWFRGDYANLTL

SEQ ID NO: 110444 - protein, 22 aa, Mycobacterium avium
ATACLRKTDWLFPQYRELGAFL

SEQ ID NO: 110445 - protein, 18 aa, Mycobacterium avium
ATCWRAGAHYVLRDTDGR

SEQ ID NO: 110446 - protein, 21 aa, Mycobacterium avium
ATEGRFRLGLGTQVRTHVVRR

SEQ ID NO: 110447 - protein, 24 aa, Mycobacterium avium
ATGTWDWPKVEGFADGIYKTARSI

SEQ ID NO: 110448 - protein, 17 aa, Mycobacterium avium
ATGVPWARACAAALLAV

SEQ ID NO: 110449 - protein, 18 aa, Mycobacterium avium
ATIAHGFLTLSLIPGVSK

SEQ ID NO: 110450 - protein, 19 aa, Mycobacterium avium
ATKATRVADGWVVSGQKVW

SEQ ID NO: 110451 - protein, 24 aa, Mycobacterium avium
ATLRRFTEKFARFNLPGKAVRPAY

SEQ ID NO: 110452 - protein, 17 aa, Mycobacterium avium
ATLSFAILARRDSVHSA

SEQ ID NO: 110453 - protein, 17 aa, Mycobacterium avium
ATPIIEWLRGVNGPVDE

SEQ ID NO: 110454 - protein, 18 aa, Mycobacterium avium
ATSRELPWRRPIASLNYL

SEQ ID NO: 110455 - protein, 18 aa, Mycobacterium avium
ATWQEIADALGYRSRQAA

SEQ ID NO: 110456 - protein, 19 aa, Mycobacterium avium
AVAACPRQAISVLTEQPPY

SEQ ID NO: 110457 - protein, 19 aa, Mycobacterium avium
AVAHAAWRGAPTVEEQDIR

SEQ ID NO: 110458 - protein, 17 aa, Mycobacterium avium
AVAKRFADKSVRSAHAV

SEQ ID NO: 110459 - protein, 20 aa, Mycobacterium avium
AVCLRLPVRTPFGFHGVFGH

SEQ ID NO: 110460 - protein, 17 aa, Mycobacterium avium
AVGDWMLLAAIQALIDG

SEQ ID NO: 110461 - protein, 17 aa, Mycobacterium avium
AVGLCFLFVLAGLDTVM

SEQ ID NO: 110462 - protein, 17 aa, Mycobacterium avium
AVHRLDAATLFRLALEK

SEQ ID NO: 110463 - protein, 20 aa, Mycobacterium avium
AVKLWQHWDHCALHWFPGSH

SEQ ID NO: 110464 - protein, 17 aa, Mycobacterium avium
AVLADWGADVVKIEHPV

SEQ ID NO: 110465 - protein, 17 aa, Mycobacterium avium
AVLAEWGAEVIKVEPRE

SEQ ID NO: 110466 - protein, 24 aa, Mycobacterium avium
AVLHRFLRWRLAGYDPDRHLGGIL

SEQ ID NO: 110467 - protein, 17 aa, Mycobacterium avium
AVLQRLAGYQARSVDID

SEQ ID NO: 110468 - protein, 20 aa, Mycobacterium avium
AVQAPWPLLRTFAAGPALSR

SEQ ID NO: 110469 - protein, 17 aa, Mycobacterium avium
AVQQHWGPPPGQLFVDR

SEQ ID NO: 110470 - protein, 22 aa, Mycobacterium avium
AVSLELFGRLGYFDTSVDAIAK

SEQ ID NO: 110471 - protein, 17 aa, Mycobacterium avium
AVVGRPVAEYGFEPVRF

SEQ ID NO: 110472 - protein, 18 aa, Mycobacterium avium
AVVPLSFAQQRLWFIDQL

SEQ ID NO: 110473 - protein, 19 aa, Mycobacterium avium
AWAFLPYVAGFGIPTFDQS

SEQ ID NO: 110474 - protein, 18 aa, Mycobacterium avium
AWAVCVYCASGPQHPELL

SEQ ID NO: 110475 - protein, 22 aa, Mycobacterium avium
AWDRRPNCERPEYLPTVLSDVL

SEQ ID NO: 110476 - protein, 17 aa, Mycobacterium avium
AWFPLTRRWLGFEDAHI

SEQ ID NO: 110477 - protein, 18 aa, Mycobacterium avium
AWFPLTRRWLGFEDAHIT

SEQ ID NO: 110478 - protein, 17 aa, Mycobacterium avium
AWGHDWSATEVHVGAAV

SEQ ID NO: 110479 - protein, 19 aa, Mycobacterium avium
AWHALCWGIIIPAGWWRSG

SEQ ID NO: 110480 - protein, 19 aa, Mycobacterium avium
AWPRFGLELPELLPDKLTG

SEQ ID NO: 110481 - protein, 20 aa, Mycobacterium avium
AWPRFGLELPELLPDKLTGL

SEQ ID NO: 110482 - protein, 18 aa, Mycobacterium avium
AWRHLPFAAQWHSDNELA

SEQ ID NO: 110483 - protein, 19 aa, Mycobacterium avium
AYAGWGMPGLRDGQVTGGI

SEQ ID NO: 110484 - protein, 17 aa, Mycobacterium avium
AYHGFGSATPMVMEEAG

SEQ ID NO: 110485 - protein, 19 aa, Mycobacterium avium
AYLARAGLRVRLLERLGQV

SEQ ID NO: 110486 - protein, 20 aa, Mycobacterium avium
AYLARAGLRVRLLERLGQVG

SEQ ID NO: 110487 - protein, 17 aa, Mycobacterium avium
CAALGRFAFLLSAAPPR

SEQ ID NO: 110488 - protein, 18 aa, Mycobacterium avium
CAFPTRMLVERSVYDEVI

SEQ ID NO: 110489 - protein, 18 aa, Mycobacterium avium
CALHWFPGSHVLHISQLD

SEQ ID NO: 110490 - protein, 18 aa, Mycobacterium avium
CALTTRMLVPRERYDEAV

SEQ ID NO: 110491 - protein, 19 aa, Mycobacterium avium
CARTFPRWWQLKTNTTAIY

SEQ ID NO: 110492 - protein, 17 aa, Mycobacterium avium
CAVGFLPPPLMRTPADE

SEQ ID NO: 110493 - protein, 19 aa, Mycobacterium avium
CCFENRWNPDWLAVADKVR

SEQ ID NO: 110494 - protein, 19 aa, Mycobacterium avium
CCFENRWNPDWLAVADRVR

SEQ ID NO: 110495 - protein, 20 aa, Mycobacterium avium
CCTECSRARLNAVSTATMAR

SEQ ID NO: 110496 - protein, 24 aa, Mycobacterium avium
CDKGFPSYFLIVADLINYARSVDI

SEQ ID NO: 110497 - protein, 24 aa, Mycobacterium avium
CGADFRLTDAAAWERFYGSPHAGS

SEQ ID NO: 110498 - protein, 17 aa, Mycobacterium avium
CGAPSCRPARCCPARSA

SEQ ID NO: 110499 - protein, 22 aa, Mycobacterium avium
CGCRKPRPGLILAAAEALGVPA

SEQ ID NO: 110500 - protein, 26 aa, Mycobacterium avium
CGGPCWRHRGSVWGYTCAACIDRHLD

SEQ ID NO: 110501 - protein, 18 aa, Mycobacterium avium
CGGPSAGMRLCLKCHSTV

SEQ ID NO: 110502 - protein, 20 aa, Mycobacterium avium
CGWLANSWRLPSCGRRGASG

SEQ ID NO: 110503 - protein, 20 aa, Mycobacterium avium
CILDERWPFSYLQVYADAAL

SEQ ID NO: 110504 - protein, 17 aa, Mycobacterium avium
CKARPLVEVEITTDTGH

SEQ ID NO: 110505 - protein, 19 aa, Mycobacterium avium
CKCGGPISSPSCRRARLSP

SEQ ID NO: 110506 - protein, 17 aa, Mycobacterium avium
CPCLLAVCSAGAGYDVI

SEQ ID NO: 110507 - protein, 20 aa, Mycobacterium avium
CPDCTRGAFRADRPYQAEVA

SEQ ID NO: 110508 - protein, 20 aa, Mycobacterium avium
CPDWVPGELWVSGRGIARGY

SEQ ID NO: 110509 - protein, 19 aa, Mycobacterium avium
CPPAGTGTHHYRFTLYQLP

SEQ ID NO: 110510 - protein, 18 aa, Mycobacterium avium
CPRCPCLAPQDVPRSPAR

SEQ ID NO: 110511 - protein, 18 aa, Mycobacterium avium
CPSPCRPGGAGVASPHTL

SEQ ID NO: 110512 - protein, 18 aa, Mycobacterium avium
CREALAVNVKPKFAVDAM

SEQ ID NO: 110513 - protein, 19 aa, Mycobacterium avium
CRGHHLLKTFWGWRDRQLP

SEQ ID NO: 110514 - protein, 20 aa, Mycobacterium avium
CRGHHLLKTFWGWRDRQLPD

SEQ ID NO: 110515 - protein, 22 aa, Mycobacterium avium
CRHVLCFRTVWESTYAALRLHG

SEQ ID NO: 110516 - protein, 19 aa, Mycobacterium avium
CRTPTIASVYGWCIGGGVD

SEQ ID NO: 110517 - protein, 18 aa, Mycobacterium avium
CRWCASGYTYLCDVGADI

SEQ ID NO: 110518 - protein, 18 aa, Mycobacterium avium
CSANERLIHVDGPAFMVG

SEQ ID NO: 110519 - protein, 21 aa, Mycobacterium avium
CTAAPCLRPQPCIDLYDAVRA

SEQ ID NO: 110520 - protein, 21 aa, Mycobacterium avium
CTAAPCLRPQPCIDLYGAVRA

SEQ ID NO: 110521 - protein, 17 aa, Mycobacterium avium
CTAPCFAAILGDPAVGR

SEQ ID NO: 110522 - protein, 22 aa, Mycobacterium avium
CVTQVRRYCHLRGIRRDLDSWM

SEQ ID NO: 110523 - protein, 17 aa, Mycobacterium avium
CVVELPTALLIDADALR

SEQ ID NO: 110524 - protein, 17 aa, Mycobacterium avium
CVVELPTALLIDAHALH

SEQ ID NO: 110525 - protein, 17 aa, Mycobacterium avium
CWIASRPDIAAIWSQAG

SEQ ID NO: 110526 - protein, 18 aa, Mycobacterium avium
CYDIRFPELYTELARRGA

SEQ ID NO: 110527 - protein, 19 aa, Mycobacterium avium
CYDYFGHVLFTWHLPELWR

SEQ ID NO: 110528 - protein, 22 aa, Mycobacterium avium
CYSLRIASAMAHDEGWLAEHML

SEQ ID NO: 110529 - protein, 22 aa, Mycobacterium avium
DAAARVLLLWGRRPADPSRIRS

SEQ ID NO: 110530 - protein, 17 aa, Mycobacterium avium
DAAFGPADIRAWVGHYF

SEQ ID NO: 110531 - protein, 17 aa, Mycobacterium avium
DAARAAFRLAWGTEPID

SEQ ID NO: 110532 - protein, 18 aa, Mycobacterium avium
DACAMGCLGYVARASGIR

SEQ ID NO: 110533 - protein, 18 aa, Mycobacterium avium
DACRAAGVGFSFGYPVDV

SEQ ID NO: 110534 - protein, 24 aa, Mycobacterium avium
DAELKAAVWELVWAGWITGDTFAP

SEQ ID NO: 110535 - protein, 18 aa, Mycobacterium avium
DAGLGRRGIPDQFDAELW

SEQ ID NO: 110536 - protein, 17 aa, Mycobacterium avium
DAKPAQVALAWLISYPG

SEQ ID NO: 110537 - protein, 20 aa, Mycobacterium avium
DAKQNLLRWARAQHVAGKQF

SEQ ID NO: 110538 - protein, 20 aa, Mycobacterium avium
DALAGLRGWGLRDLGYTLTR

SEQ ID NO: 110539 - protein, 18 aa, Mycobacterium avium
DALCALGLQSRVVGAALP

SEQ ID NO: 110540 - protein, 18 aa, Mycobacterium avium
DALMRGCPFHNAAVEAGQ

SEQ ID NO: 110541 - protein, 20 aa, Mycobacterium avium
DAMPVLRWVRRMRSNSELPA

SEQ ID NO: 110542 - protein, 23 aa, Mycobacterium avium
DAPDIPVALAFVKRASGPVLRRF

SEQ ID NO: 110543 - protein, 22 aa, Mycobacterium avium
DARSWRLPWPAGTTVYELDQPR

SEQ ID NO: 110544 - protein, 18 aa, Mycobacterium avium
DASPAFLGFNLFQHAIAR

SEQ ID NO: 110545 - protein, 17 aa, Mycobacterium avium
DAVGVLAGFPVEIAPTA

SEQ ID NO: 110546 - protein, 21 aa, Mycobacterium avium
DAVRMWARLRIHLAEAGRRMR

SEQ ID NO: 110547 - protein, 21 aa, Mycobacterium avium
DCGLTGLVVRYGPEMTPEPVP

SEQ ID NO: 110548 - protein, 18 aa, Mycobacterium avium
DCKARPLVEVEITTDTGH

SEQ ID NO: 110549 - protein, 21 aa, Mycobacterium avium
DCPDFDLAWHLRRVAIAGTGD

SEQ ID NO: 110550 - protein, 17 aa, Mycobacterium avium
DCTRQFGGRFAIQQISL

SEQ ID NO: 110551 - protein, 17 aa, Mycobacterium avium
DCTYDFEVTAAKYLHAL

SEQ ID NO: 110552 - protein, 18 aa, Mycobacterium avium
DDARLGVLLAGWCGLRKG

SEQ ID NO: 110553 - protein, 25 aa, Mycobacterium avium
DDDWLIARWGCLRAANLFWGCGDAE

SEQ ID NO: 110554 - protein, 23 aa, Mycobacterium avium
DDGVGLDEYVDWLVDAGYSIERI

SEQ ID NO: 110555 - protein, 24 aa, Mycobacterium avium
DDIPADVMPLDWYLHVRHAAEGAI

SEQ ID NO: 110556 - protein, 17 aa, Mycobacterium avium
DDLRPLWLAAPVTEVLP

SEQ ID NO: 110557 - protein, 22 aa, Mycobacterium avium
DDPRLELVGVYAFSEEKAGSDA

SEQ ID NO: 110558 - protein, 17 aa, Mycobacterium avium
DDTWGWRTMCWLNLTDK

SEQ ID NO: 110559 - protein, 22 aa, Mycobacterium avium
DDVRAGWDWLINTCGVLPEQMV

SEQ ID NO: 110560 - protein, 17 aa, Mycobacterium avium
DDYLPAWMYRTQESGHR

SEQ ID NO: 110561 - protein, 17 aa, Mycobacterium avium
DEALALWRGIPELPDGR

SEQ ID NO: 110562 - protein, 17 aa, Mycobacterium avium
DEALGLWRGIPELPDGR

SEQ ID NO: 110563 - protein, 23 aa, Mycobacterium avium
DECMQLSGGIGFTWEYPLHYELR

SEQ ID NO: 110564 - protein, 23 aa, Mycobacterium avium
DEFRRPDLRLALMDRQGVYGAVM

SEQ ID NO: 110565 - protein, 23 aa, Mycobacterium avium
DEGRALARICALNALAAVDALVG

SEQ ID NO: 110566 - protein, 22 aa, Mycobacterium avium
DEILMELGLDWDRIIELKTAGA

SEQ ID NO: 110567 - protein, 21 aa, Mycobacterium avium
DEIWRFTPLRRLRGLHDGSAP

SEQ ID NO: 110568 - protein, 18 aa, Mycobacterium avium
DELIPLLGNQGLDTSRVA

SEQ ID NO: 110569 - protein, 20 aa, Mycobacterium avium
DELIRRRLLREITPPNDKLA

SEQ ID NO: 110570 - protein, 17 aa, Mycobacterium avium
DELRELAGILGVARDAE

SEQ ID NO: 110571 - protein, 24 aa, Mycobacterium avium
DELSRRGGWCRCIQIVGALDAAAA

SEQ ID NO: 110572 - protein, 22 aa, Mycobacterium avium
DEPRWPRYAPAAVEHGVLSSLS

SEQ ID NO: 110573 - protein, 24 aa, Mycobacterium avium
DERLGEVPWAFVVRGDESVSEAGL

SEQ ID NO: 110574 - protein, 18 aa, Mycobacterium avium
DERTADCVVAGYRVHKSG

SEQ ID NO: 110575 - protein, 17 aa, Mycobacterium avium
DFARASFKYGLNAKWPV

SEQ ID NO: 110576 - protein, 26 aa, Mycobacterium avium
DFARYWAEICAIPISFIAESVRRAQA

SEQ ID NO: 110577 - protein, 19 aa, Mycobacterium avium
DFFRNPIRLVLKVWDPIIK

SEQ ID NO: 110578 - protein, 17 aa, Mycobacterium avium
DFFTRWAAGELDAADVD

SEQ ID NO: 110579 - protein, 27 aa, Mycobacterium avium
DFLRSCSIKHRMASVIFSLEMSKSEIV

SEQ ID NO: 110580 - protein, 18 aa, Mycobacterium avium
DFPDRPDNMFALANTLMG

SEQ ID NO: 110581 - protein, 19 aa, Mycobacterium avium
DFWTSCPETAHLVTLVMGD

SEQ ID NO: 110582 - protein, 22 aa, Mycobacterium avium
DGALRRSIKFPSFLDGIDAVRR

SEQ ID NO: 110583 - protein, 19 aa, Mycobacterium avium
DGDCGRWLDLCAGPGGKTA

SEQ ID NO: 110584 - protein, 17 aa, Mycobacterium avium
DGGWTINGHKIWTSAAH

SEQ ID NO: 110585 - protein, 18 aa, Mycobacterium avium
DGGWTINGHKIWTSAAHR

SEQ ID NO: 110586 - protein, 17 aa, Mycobacterium avium
DGIGLDEYVDWLIDAGY

SEQ ID NO: 110587 - protein, 23 aa, Mycobacterium avium
DGKEIAGRLAAWIGSGLLVDVVE

SEQ ID NO: 110588 - protein, 19 aa, Mycobacterium avium
DGKVGWKGFHAIERDLWQA

SEQ ID NO: 110589 - protein, 18 aa, Mycobacterium avium
DGNRRWARDAGYDDVSYG

SEQ ID NO: 110590 - protein, 23 aa, Mycobacterium avium
DGPLAGTVRFEWDPLRWFEEDEP

SEQ ID NO: 110591 - protein, 20 aa, Mycobacterium avium
DGRWYWHWDPAFMASPTDLP

SEQ ID NO: 110592 - protein, 18 aa, Mycobacterium avium
DGSCPDCTRGAFRADRPY

SEQ ID NO: 110593 - protein, 25 aa, Mycobacterium avium
DGSRATVIAWIWARTVTCPNPACGI

SEQ ID NO: 110594 - protein, 23 aa, Mycobacterium avium
DGTRVPVSIVHRVDIEFPSPALI

SEQ ID NO: 110595 - protein, 18 aa, Mycobacterium avium
DGVKAWKGIRYAAPPIGD

SEQ ID NO: 110596 - protein, 19 aa, Mycobacterium avium
DGVPSWAFRLLHVADTYNP

SEQ ID NO: 110597 - protein, 20 aa, Mycobacterium avium
DHAAICWPLLVGMAKAKYYL

SEQ ID NO: 110598 - protein, 17 aa, Mycobacterium avium
DHIVAHPRLRWVGNANE

SEQ ID NO: 110599 - protein, 17 aa, Mycobacterium avium
DHPRWSVKVQIMPFEDA

SEQ ID NO: 110600 - protein, 21 aa, Mycobacterium avium
DIAEVLALLGVRPVWDDASRR

SEQ ID NO: 110601 - protein, 17 aa, Mycobacterium avium
DIELALCQLVGPLVFAR

SEQ ID NO: 110602 - protein, 24 aa, Mycobacterium avium
DIFLREVQDVWTWVQPYFDDRATG

SEQ ID NO: 110603 - protein, 17 aa, Mycobacterium avium
DIISMHMGWGWGGYGVG

SEQ ID NO: 110604 - protein, 23 aa, Mycobacterium avium
DIISMHMGWGWGGYGVGPLKFAH

SEQ ID NO: 110605 - protein, 18 aa, Mycobacterium avium
DIPNDFVVGYGLDYDERY

SEQ ID NO: 110606 - protein, 17 aa, Mycobacterium avium
DIRECLRIGLQAANGSN

SEQ ID NO: 110607 - protein, 18 aa, Mycobacterium avium
DIRLARQRLGWRPRVDYR

SEQ ID NO: 110608 - protein, 18 aa, Mycobacterium avium
DIVGWKWTEVPNALGVTE

SEQ ID NO: 110609 - protein, 22 aa, Mycobacterium avium
DKAVREVEAWLAAEPFRAPEAD

SEQ ID NO: 110610 - protein, 22 aa, Mycobacterium avium
DKDFWLQVGIDPIRIITSSGTF

SEQ ID NO: 110611 - protein, 17 aa, Mycobacterium avium
DKPRSVVLWTNCHHPFY

SEQ ID NO: 110612 - protein, 22 aa, Mycobacterium avium
DKWKFTVPFVCGATNLGEALRR

SEQ ID NO: 110613 - protein, 17 aa, Mycobacterium avium
DKWRGIEAPVMIVASGK

SEQ ID NO: 110614 - protein, 22 aa, Mycobacterium avium
DKYWAGFCRRIGLAELADDARF

SEQ ID NO: 110615 - protein, 19 aa, Mycobacterium avium
DLAEAWSHLLARLGEAAQM

SEQ ID NO: 110616 - protein, 23 aa, Mycobacterium avium
DLARRGRHRPVWIKGFGEHIAFK

SEQ ID NO: 110617 - protein, 20 aa, Mycobacterium avium
DLDYWRPLMADLPEPLELPG

SEQ ID NO: 110618 - protein, 20 aa, Mycobacterium avium
DLFLWPTLYLWEFPKPTISQ

SEQ ID NO: 110619 - protein, 22 aa, Mycobacterium avium
DLGALAGWYVWAALGLYPATPG

SEQ ID NO: 110620 - protein, 23 aa, Mycobacterium avium
DLKGKLLGLPVCRLLGMAHDSVP

SEQ ID NO: 110621 - protein, 24 aa, Mycobacterium avium
DLKRSCLDIGLAARVLGWQPKVGL

SEQ ID NO: 110622 - protein, 18 aa, Mycobacterium avium
DLLNRFVGLGLRFISAGT

SEQ ID NO: 110623 - protein, 22 aa, Mycobacterium avium
DLPAAPCLHVFLARGRADIEDV

SEQ ID NO: 110624 - protein, 18 aa, Mycobacterium avium
DLQDIIAILGIDELSEED

SEQ ID NO: 110625 - protein, 18 aa, Mycobacterium avium
DLRDDWPAALRAAGFDPT

SEQ ID NO: 110626 - protein, 21 aa, Mycobacterium avium
DLRGSLRLLIRALRGHRRPVA

SEQ ID NO: 110627 - protein, 22 aa, Mycobacterium avium
DLRPGWSMPSAEQFTFGYADEH

SEQ ID NO: 110628 - protein, 18 aa, Mycobacterium avium
DLRQDWPAALQDAGFDPA

SEQ ID NO: 110629 - protein, 18 aa, Mycobacterium avium
DLSRSWARVDLDATIADW

SEQ ID NO: 110630 - protein, 21 aa, Mycobacterium avium
DLYFNLSLWSAYDVMLMHTVL

SEQ ID NO: 110631 - protein, 20 aa, Mycobacterium avium
DNLRHTVRFGAAVQAALEDG

SEQ ID NO: 110632 - protein, 18 aa, Mycobacterium avium
DNLRLETLAAYWGVTQQR

SEQ ID NO: 110633 - protein, 17 aa, Mycobacterium avium
DNYCVYGARKLWKTARR

SEQ ID NO: 110634 - protein, 19 aa, Mycobacterium avium
DPALPAARVEFMLTDAAPI

SEQ ID NO: 110635 - protein, 20 aa, Mycobacterium avium
DPALPAARVEFMLTDAAPIV

SEQ ID NO: 110636 - protein, 20 aa, Mycobacterium avium
DPARAVEVVHRFGVTCTAGT

SEQ ID NO: 110637 - protein, 18 aa, Mycobacterium avium
DPAVAPWIHRGLTSQDVL

SEQ ID NO: 110638 - protein, 23 aa, Mycobacterium avium
DPDSRIGTQLAYWEDALAGMPER

SEQ ID NO: 110639 - protein, 23 aa, Mycobacterium avium
DPDSRIGTQLAYWQDALAGMPER

SEQ ID NO: 110640 - protein, 25 aa, Mycobacterium avium
DPEHALECIQRYGITHGQFVPAMFV

SEQ ID NO: 110641 - protein, 23 aa, Mycobacterium avium
DPERGVLLGAVWLRPADGDGVLL

SEQ ID NO: 110642 - protein, 22 aa, Mycobacterium avium
DPITRIVGSLGIYTKIDFDNRE

SEQ ID NO: 110643 - protein, 18 aa, Mycobacterium avium
DPQHRMLLELSWEALERA

SEQ ID NO: 110644 - protein, 18 aa, Mycobacterium avium
DPRCAVVFQEPRLLPWRS

SEQ ID NO: 110645 - protein, 19 aa, Mycobacterium avium
DPRCAVVFQEPRLLPWRSL

SEQ ID NO: 110646 - protein, 17 aa, Mycobacterium avium
DPRRPVSVTARRIGCWR

SEQ ID NO: 110647 - protein, 19 aa, Mycobacterium avium
DPSMKVCKLISVVTIPIAP

SEQ ID NO: 110648 - protein, 21 aa, Mycobacterium avium
DQAALDWHNFVAFRGRELAPE

SEQ ID NO: 110649 - protein, 20 aa, Mycobacterium avium
DQFVACVFDWVVAELAATTQ

SEQ ID NO: 110650 - protein, 21 aa, Mycobacterium avium
DQFVACVFDWVVAELAATTQA

SEQ ID NO: 110651 - protein, 18 aa, Mycobacterium avium
DQRFPYVFLDATYCKARV

SEQ ID NO: 110652 - protein, 17 aa, Mycobacterium avium
DQRRPGCALGEFHEVDL

SEQ ID NO: 110653 - protein, 22 aa, Mycobacterium avium
DRACSWLPLYHDMGLAFLLTSA

SEQ ID NO: 110654 - protein, 22 aa, Mycobacterium avium
DRACSWLPLYHDMGLAFLLTSV

SEQ ID NO: 110655 - protein, 17 aa, Mycobacterium avium
DRARVAATIDEIVTNHQ

SEQ ID NO: 110656 - protein, 18 aa, Mycobacterium avium
DRLAAVFPDAKFVMTHRD

SEQ ID NO: 110657 - protein, 19 aa, Mycobacterium avium
DRLAAVFPDAKFVMTHRDP

SEQ ID NO: 110658 - protein, 17 aa, Mycobacterium avium
DRLAGSGARVHRLAVSH

SEQ ID NO: 110659 - protein, 22 aa, Mycobacterium avium
DRLRLALDADLCAAVTGLPAPL

SEQ ID NO: 110660 - protein, 22 aa, Mycobacterium avium
DRLWKGAGVLLPLGSPLPDDTV

SEQ ID NO: 110661 - protein, 18 aa, Mycobacterium avium
DRRFARARLRAEVLPLLE

SEQ ID NO: 110662 - protein, 17 aa, Mycobacterium avium
DRTPPRLAVIAMGKCGA

SEQ ID NO: 110663 - protein, 17 aa, Mycobacterium avium
DRWLLRNRPHLVLDGLR

SEQ ID NO: 110664 - protein, 18 aa, Mycobacterium avium
DSCQWFKSQFDPLMGQIN

SEQ ID NO: 110665 - protein, 19 aa, Mycobacterium avium
DSGNGLAQFHCEIAVDGQV

SEQ ID NO: 110666 - protein, 24 aa, Mycobacterium avium
DSIGWLRDFLRAHTGGLVIISHNV

SEQ ID NO: 110667 - protein, 17 aa, Mycobacterium avium
DSIGWTWMHYLPPTPGF

SEQ ID NO: 110668 - protein, 20 aa, Mycobacterium avium
DSLDCFFVYLARHPEHRRQL

SEQ ID NO: 110669 - protein, 17 aa, Mycobacterium avium
DSLWVYDHFHTVPVPTG

SEQ ID NO: 110670 - protein, 19 aa, Mycobacterium avium
DTAGRWGVSRVWLGVNQKN

SEQ ID NO: 110671 - protein, 21 aa, Mycobacterium avium
DTEPWRAGPLLDYLRKMVFWS

SEQ ID NO: 110672 - protein, 21 aa, Mycobacterium avium
DTIPLRLAFSLTEPRLELVQA

SEQ ID NO: 110673 - protein, 24 aa, Mycobacterium avium
DTLIKEKWLTANAVIGFFPANAIG

SEQ ID NO: 110674 - protein, 22 aa, Mycobacterium avium
DTPNPLCWDSFRFIVIQRADHF

SEQ ID NO: 110675 - protein, 19 aa, Mycobacterium avium
DTPRFAVAHAVRFDQLVSG

SEQ ID NO: 110676 - protein, 19 aa, Mycobacterium avium
DTSRLLARFPALGGTDTSG

SEQ ID NO: 110677 - protein, 20 aa, Mycobacterium avium
DTSRLLARFPALGGTDTSGR

SEQ ID NO: 110678 - protein, 22 aa, Mycobacterium avium
DVAPRLGGPIAPCYHAAVDTST

SEQ ID NO: 110679 - protein, 18 aa, Mycobacterium avium
DVDLRWVILAARIGILRQ

SEQ ID NO: 110680 - protein, 19 aa, Mycobacterium avium
DVELAWRLDVAGHYGPPRR

SEQ ID NO: 110681 - protein, 24 aa, Mycobacterium avium
DVLRWCEDRWKLARRSIFVDESVL

SEQ ID NO: 110682 - protein, 25 aa, Mycobacterium avium
DVLTRLRGMFAFALWDTVTRELFCA

SEQ ID NO: 110683 - protein, 21 aa, Mycobacterium avium
DVRAGWDWLVDTCGLLPKHIV

SEQ ID NO: 110684 - protein, 17 aa, Mycobacterium avium
DWPARKLPSVRVAAALP

SEQ ID NO: 110685 - protein, 24 aa, Mycobacterium avium
DWPSFPLPLGDTWASSKGDLLTVE

SEQ ID NO: 110686 - protein, 19 aa, Mycobacterium avium
DYLGWDWKSKAGIPIVCVP

SEQ ID NO: 110687 - protein, 25 aa, Mycobacterium avium
DYPALIGPRCRAVWLLTVGAEQVDR

SEQ ID NO: 110688 - protein, 21 aa, Mycobacterium avium
DYRPELPGGRPSGGRSLSAVP

SEQ ID NO: 110689 - protein, 18 aa, Mycobacterium avium
EAADRVAAILARPDAAGR

SEQ ID NO: 110690 - protein, 18 aa, Mycobacterium avium
EAALCFPLPKFSDIRYDY

SEQ ID NO: 110691 - protein, 18 aa, Mycobacterium avium
EAAVSLYLAERGFTTVGL

SEQ ID NO: 110692 - protein, 17 aa, Mycobacterium avium
EAECAQWVAEQLAAVGY

SEQ ID NO: 110693 - protein, 17 aa, Mycobacterium avium
EAFDVEAFSRWMLDYVR

SEQ ID NO: 110694 - protein, 17 aa, Mycobacterium avium
EAGLRSRILLQVHDELL

SEQ ID NO: 110695 - protein, 24 aa, Mycobacterium avium
EAGPSGRFRPLWAHNRAEERKALT

SEQ ID NO: 110696 - protein, 24 aa, Mycobacterium avium
EAHPRGGVELELFASVFDYAMQLT

SEQ ID NO: 110697 - protein, 17 aa, Mycobacterium avium
EAIRWTTWQAAWLVAHG

SEQ ID NO: 110698 - protein, 17 aa, Mycobacterium avium
EALRLGERVAVFKGGVL

SEQ ID NO: 110699 - protein, 17 aa, Mycobacterium avium
EALRWPGRRPGGCSTSA

SEQ ID NO: 110700 - protein, 26 aa, Mycobacterium avium
EAPSRADALLAFPAMQAMPTPYVEAS

SEQ ID NO: 110701 - protein, 19 aa, Mycobacterium avium
EAVLRMALVGSHERLTAQR

SEQ ID NO: 110702 - protein, 17 aa, Mycobacterium avium
EAYRLAASIQRTVMPLD

SEQ ID NO: 110703 - protein, 17 aa, Mycobacterium avium
ECPPCLVYLQQMLDLKI

SEQ ID NO: 110704 - protein, 18 aa, Mycobacterium avium
EDIFARGGPYLARGAADL

SEQ ID NO: 110705 - protein, 17 aa, Mycobacterium avium
EDKRWTPAWSDEQRTAG

SEQ ID NO: 110706 - protein, 19 aa, Mycobacterium avium
EDQRLRFLPPIVRNEEKWC

SEQ ID NO: 110707 - protein, 19 aa, Mycobacterium avium
EDRLRTRFEWGLITDVQPP

SEQ ID NO: 110708 - protein, 17 aa, Mycobacterium avium
EEFRMAVYYADVEGFPY

SEQ ID NO: 110709 - protein, 23 aa, Mycobacterium avium
EEILKRFPAWEVDWANAVPSETA

SEQ ID NO: 110710 - protein, 18 aa, Mycobacterium avium
EELLAAKLMGRWRSGAPL

SEQ ID NO: 110711 - protein, 18 aa, Mycobacterium avium
EELRKIWYRTWVFVGHES

SEQ ID NO: 110712 - protein, 21 aa, Mycobacterium avium
EEVWERFDMLPAQTIPKRAAK

SEQ ID NO: 110713 - protein, 17 aa, Mycobacterium avium
EFAEAGWALPLSDDPAG

SEQ ID NO: 110714 - protein, 18 aa, Mycobacterium avium
EFGCVAAPIGGPGEAAAA

SEQ ID NO: 110715 - protein, 20 aa, Mycobacterium avium
EFGTRWFADKAFWVKDGQNY

SEQ ID NO: 110716 - protein, 18 aa, Mycobacterium avium
EGFHCIAPTWPLGAHSTP

SEQ ID NO: 110717 - protein, 21 aa, Mycobacterium avium
EGHSMFPWLTLALVGSSTSHV

SEQ ID NO: 110718 - protein, 18 aa, Mycobacterium avium
EGIQCPFHGWVWNGAGRN

SEQ ID NO: 110719 - protein, 24 aa, Mycobacterium avium
EGKYIPRLGGLAFRDPDWADEVYV

SEQ ID NO: 110720 - protein, 20 aa, Mycobacterium avium
EGLLNYLALLGWAIADDRDV

SEQ ID NO: 110721 - protein, 21 aa, Mycobacterium avium
EGRARLDFRGEFYTHTIMAPT

SEQ ID NO: 110722 - protein, 17 aa, Mycobacterium avium
EGSLRFGDKVVLGRDNV

SEQ ID NO: 110723 - protein, 23 aa, Mycobacterium avium
EGTCLRCPYHGWLWDADGRNAEI

SEQ ID NO: 110724 - protein, 17 aa, Mycobacterium avium
EGTPPLIARAFNKYVDR

SEQ ID NO: 110725 - protein, 18 aa, Mycobacterium avium
EIAERAGARFVLASTSEV

SEQ ID NO: 110726 - protein, 20 aa, Mycobacterium avium
EIARLVPFIEWLRGAYPDQL

SEQ ID NO: 110727 - protein, 18 aa, Mycobacterium avium
EICDGWLPIFYTPRLADM

SEQ ID NO: 110728 - protein, 17 aa, Mycobacterium avium
EICSIPISFIAESVRRA

SEQ ID NO: 110729 - protein, 18 aa, Mycobacterium avium
EICSRFIRQPGYRFVELR

SEQ ID NO: 110730 - protein, 18 aa, Mycobacterium avium
EIERARAAAELAVAAASE

SEQ ID NO: 110731 - protein, 19 aa, Mycobacterium avium
EIFTLLGYWNMPRAQISLV

SEQ ID NO: 110732 - protein, 20 aa, Mycobacterium avium
EIGQPLATEFVWGRQYGENT

SEQ ID NO: 110733 - protein, 18 aa, Mycobacterium avium
EIPLDFRILDTILGAQTT

SEQ ID NO: 110734 - protein, 19 aa, Mycobacterium avium
EIRAELGLAQAPRVDSYGG

SEQ ID NO: 110735 - protein, 19 aa, Mycobacterium avium
EIRARLASFTVIAQRGNDF

SEQ ID NO: 110736 - protein, 20 aa, Mycobacterium avium
EIRARLASFTVIAQRGNDFG

SEQ ID NO: 110737 - protein, 21 aa, Mycobacterium avium
EISARLDLPLGVARVLVGDLV

SEQ ID NO: 110738 - protein, 19 aa, Mycobacterium avium
EIVTRVSAVWANELFAEIP

SEQ ID NO: 110739 - protein, 20 aa, Mycobacterium avium
EIYVPFSWFEPMWLENLGFA

SEQ ID NO: 110740 - protein, 17 aa, Mycobacterium avium
EKEMFWPRVWQMACRLE

SEQ ID NO: 110741 - protein, 18 aa, Mycobacterium avium
EKFWDWADCDGHPEKALS

SEQ ID NO: 110742 - protein, 23 aa, Mycobacterium avium
EKLAELYLRLELAKEPGGEKAAA

SEQ ID NO: 110743 - protein, 18 aa, Mycobacterium avium
EKRCPRPPLENGATRAYE

SEQ ID NO: 110744 - protein, 23 aa, Mycobacterium avium
EKTMLSWEFPFGFLDQGLSSPIR

SEQ ID NO: 110745 - protein, 20 aa, Mycobacterium avium
ELAECPRLSYGLDEACLLIF

SEQ ID NO: 110746 - protein, 19 aa, Mycobacterium avium
ELALLWADRSIRVNAVHPT

SEQ ID NO: 110747 - protein, 18 aa, Mycobacterium avium
ELALVEVARKIGIRLRLF

SEQ ID NO: 110748 - protein, 18 aa, Mycobacterium avium
ELELPLCVNTGIPGPPIP

SEQ ID NO: 110749 - protein, 17 aa, Mycobacterium avium
ELGEVRAALAWVDGVDQ

SEQ ID NO: 110750 - protein, 21 aa, Mycobacterium avium
ELGQPLPLLIKWDDAEYGLRA

SEQ ID NO: 110751 - protein, 24 aa, Mycobacterium avium
ELIARFLKQLGINWDPAQGTVNGL

SEQ ID NO: 110752 - protein, 19 aa, Mycobacterium avium
ELLARAGVPLVAFGDSLRA

SEQ ID NO: 110753 - protein, 17 aa, Mycobacterium avium
ELLARLQADLGLAYLFI

SEQ ID NO: 110754 - protein, 21 aa, Mycobacterium avium
ELLEPRLSPGVLVVADNTSAA

SEQ ID NO: 110755 - protein, 18 aa, Mycobacterium avium
ELPAGRSGEVWVRSNQNM

SEQ ID NO: 110756 - protein, 18 aa, Mycobacterium avium
ELPLTPRRARAVQRDRDD

SEQ ID NO: 110757 - protein, 19 aa, Mycobacterium avium
ELPRGAALKVDRRRLVATL

SEQ ID NO: 110758 - protein, 20 aa, Mycobacterium avium
ELQFGLNWFPWILRGVYPPP

SEQ ID NO: 110759 - protein, 20 aa, Mycobacterium avium
ELRAVWSGFMQKWIDQTAAM

SEQ ID NO: 110760 - protein, 20 aa, Mycobacterium avium
ELRIAQAQLVGWLEGLFHGI

SEQ ID NO: 110761 - protein, 23 aa, Mycobacterium avium
ELRLKGPQCFLGYADPTLDADAF

SEQ ID NO: 110762 - protein, 23 aa, Mycobacterium avium
ELRMIGWRVGWIVGPRAIMADIA

SEQ ID NO: 110763 - protein, 21 aa, Mycobacterium avium
ELRRTAGRLADWVHAHDDLAL

SEQ ID NO: 110764 - protein, 19 aa, Mycobacterium avium
ELYEIRTLFGVMFQDGALF

SEQ ID NO: 110765 - protein, 20 aa, Mycobacterium avium
EMRNRLKAATGLALSPTLIF

SEQ ID NO: 110766 - protein, 19 aa, Mycobacterium avium
EMVTRVSAVWANELFAEIP

SEQ ID NO: 110767 - protein, 18 aa, Mycobacterium avium
EPACDGWSPPAIQMPADL

SEQ ID NO: 110768 - protein, 19 aa, Mycobacterium avium
EPARYIWKLEFQRRGAPHI

SEQ ID NO: 110769 - protein, 23 aa, Mycobacterium avium
EPFDAVVCSLVLCSVRDPQGVLR

SEQ ID NO: 110770 - protein, 20 aa, Mycobacterium avium
EPKLRPGNVYFLNAQKLSKG

SEQ ID NO: 110771 - protein, 17 aa, Mycobacterium avium
EPMPVAASFSWEFENGF

SEQ ID NO: 110772 - protein, 19 aa, Mycobacterium avium
EPPARPVLVVDFGAQYAQL

SEQ ID NO: 110773 - protein, 18 aa, Mycobacterium avium
EPRQPRCEIGAWLERRAR

SEQ ID NO: 110774 - protein, 18 aa, Mycobacterium avium
EPVARWGAAVPWAAILEP

SEQ ID NO: 110775 - protein, 17 aa, Mycobacterium avium
EPYLRPGQIEEHLVYPV

SEQ ID NO: 110776 - protein, 17 aa, Mycobacterium avium
EQLPRKVAMRLLLTGEP

SEQ ID NO: 110777 - protein, 17 aa, Mycobacterium avium
EQLVMWWNFVGRSHEDI

SEQ ID NO: 110778 - protein, 18 aa, Mycobacterium avium
ERARRCHEFLGQLQGTPA

SEQ ID NO: 110779 - protein, 20 aa, Mycobacterium avium
ERERTVLVLRFFESMTQTQI

SEQ ID NO: 110780 - protein, 20 aa, Mycobacterium avium
ERGTLLAAVWLRPPAGESVL

SEQ ID NO: 110781 - protein, 25 aa, Mycobacterium avium
ERIYWAFCTHLGYLVSNNSFGHRMV

SEQ ID NO: 110782 - protein, 22 aa, Mycobacterium avium
ERLKSELLLLMAGVERLAHAPV

SEQ ID NO: 110783 - protein, 23 aa, Mycobacterium avium
ERLPILCGLDLTRKVAMTPDHLT

SEQ ID NO: 110784 - protein, 23 aa, Mycobacterium avium
ERLPILCGLDLTRKVAMTPGHLT

SEQ ID NO: 110785 - protein, 18 aa, Mycobacterium avium
ERLSEILAAYALLRDPAR

SEQ ID NO: 110786 - protein, 19 aa, Mycobacterium avium
ERPRITAALDKLRVFSNTA

SEQ ID NO: 110787 - protein, 18 aa, Mycobacterium avium
ERRRGVVVNPVLETSEIP

SEQ ID NO: 110788 - protein, 24 aa, Mycobacterium avium
ERSSCFWQRIAYLYSRFDDLIAEV

SEQ ID NO: 110789 - protein, 19 aa, Mycobacterium avium
ERYGIPILITYGATEFAGA

SEQ ID NO: 110790 - protein, 19 aa, Mycobacterium avium
ERYGIPILVVYGATEFSGA

SEQ ID NO: 110791 - protein, 19 aa, Mycobacterium avium
ERYPRLVVATITGWGSTGP

SEQ ID NO: 110792 - protein, 17 aa, Mycobacterium avium
ESAWPAAVLVAATMLSV

SEQ ID NO: 110793 - protein, 29 aa, Mycobacterium avium
ESFFRGAGWNVIKVVWGREWDALLHADRD

SEQ ID NO: 110794 - protein, 18 aa, Mycobacterium avium
ESKRFCWNCGKPVGRSTK

SEQ ID NO: 110795 - protein, 22 aa, Mycobacterium avium
ESTDILKRWKRGVMSTVGDVAA

SEQ ID NO: 110796 - protein, 21 aa, Mycobacterium avium
ESTRAALQWAMSVAAQRAAAL

SEQ ID NO: 110797 - protein, 19 aa, Mycobacterium avium
ESVALLFNRRAEAVVAVLA

SEQ ID NO: 110798 - protein, 20 aa, Mycobacterium avium
ESVALLFNRRAEAVVAVLAV

SEQ ID NO: 110799 - protein, 20 aa, Mycobacterium avium
ETRKSFGIAGARVVESIKLS

SEQ ID NO: 110800 - protein, 18 aa, Mycobacterium avium
EVARRLLPGIAHVAVFDT

SEQ ID NO: 110801 - protein, 22 aa, Mycobacterium avium
EVGLPMRCVFALTAMGFLPQSP

SEQ ID NO: 110802 - protein, 17 aa, Mycobacterium avium
EVHRLRQPVLLIWGRED

SEQ ID NO: 110803 - protein, 21 aa, Mycobacterium avium
EVLKRWPDWEVDYANAERART

SEQ ID NO: 110804 - protein, 20 aa, Mycobacterium avium
EVLLHLSAEGWVRWSNTVSD

SEQ ID NO: 110805 - protein, 21 aa, Mycobacterium avium
EVLLHLSAEGWVRWSNTVSDK

SEQ ID NO: 110806 - protein, 23 aa, Mycobacterium avium
EVMGRTGFDFVWLDSEHCDINPR

SEQ ID NO: 110807 - protein, 18 aa, Mycobacterium avium
EVPARLEALGALGGLDRA

SEQ ID NO: 110808 - protein, 22 aa, Mycobacterium avium
EVPMKRFDLMNGIQVRGTYAVS

SEQ ID NO: 110809 - protein, 20 aa, Mycobacterium avium
EVPPVVVVPYFWSDQYDVKI

SEQ ID NO: 110810 - protein, 18 aa, Mycobacterium avium
EVPTMAALLIKESVNQSV

SEQ ID NO: 110811 - protein, 19 aa, Mycobacterium avium
EVRVPWSLAPRQRGPRRRP

SEQ ID NO: 110812 - protein, 20 aa, Mycobacterium avium
EVRVPWSLAPRQRGPRRRPS

SEQ ID NO: 110813 - protein, 19 aa, Mycobacterium avium
EVRVPWSLAPRQRGSRRRP

SEQ ID NO: 110814 - protein, 19 aa, Mycobacterium avium
EVSDGLFLQLAVTSVESLA

SEQ ID NO: 110815 - protein, 19 aa, Mycobacterium avium
EVTATWPIRSELGNRMIGA

SEQ ID NO: 110816 - protein, 18 aa, Mycobacterium avium
EVTFPFMQAMPIPYIDPC

SEQ ID NO: 110817 - protein, 29 aa, Mycobacterium avium
EVYERIKPAFKHWAAVVIHAGEPGAGTRM

SEQ ID NO: 110818 - protein, 26 aa, Mycobacterium avium
EWCVISIRSDDEWRRAAAVFDHAEWA

SEQ ID NO: 110819 - protein, 25 aa, Mycobacterium avium
EWCVISIRSDDEWRRAASVFDHAEW

SEQ ID NO: 110820 - protein, 26 aa, Mycobacterium avium
EWCVISIRSDDEWRRAASVFDHAEWA

SEQ ID NO: 110821 - protein, 17 aa, Mycobacterium avium
EWHKMGAGWSWTRKAGS

SEQ ID NO: 110822 - protein, 20 aa, Mycobacterium avium
EWIWPRAMVLSAAYLTGIAT

SEQ ID NO: 110823 - protein, 20 aa, Mycobacterium avium
EWLKPTAYMMAKFGMTLCAL

SEQ ID NO: 110824 - protein, 17 aa, Mycobacterium avium
EWMAIRYDNVVGVPHAD

SEQ ID NO: 110825 - protein, 20 aa, Mycobacterium avium
EWMGRVHRFLGLDVGVILAQ

SEQ ID NO: 110826 - protein, 18 aa, Mycobacterium avium
EWRQAGCSMCLGMNPDQL

SEQ ID NO: 110827 - protein, 19 aa, Mycobacterium avium
EWRRHLSGWIGLDSYDERN

SEQ ID NO: 110828 - protein, 17 aa, Mycobacterium avium
EYCDGCARWVHPASGRC

SEQ ID NO: 110829 - protein, 18 aa, Mycobacterium avium
EYQPKCRDFALAIDDEPA

SEQ ID NO: 110830 - protein, 25 aa, Mycobacterium avium
FAAAWRLALMGLRRGEILGLSWDSV

SEQ ID NO: 110831 - protein, 17 aa, Mycobacterium avium
FAAGGFRRGEGFLCMMP

SEQ ID NO: 110832 - protein, 17 aa, Mycobacterium avium
FAASFFAVVPYEWDRYV

SEQ ID NO: 110833 - protein, 18 aa, Mycobacterium avium
FADFPVLHWKKIWSTNPL

SEQ ID NO: 110834 - protein, 19 aa, Mycobacterium avium
FADFPVLHWKKIWSTNPLE

SEQ ID NO: 110835 - protein, 18 aa, Mycobacterium avium
FAEAFGPILIFRSVVPAD

SEQ ID NO: 110836 - protein, 19 aa, Mycobacterium avium
FAEGERLWLSWAMANRDPN

SEQ ID NO: 110837 - protein, 19 aa, Mycobacterium avium
FAIGAVLSMHFAKQAARFF

SEQ ID NO: 110838 - protein, 19 aa, Mycobacterium avium
FAIRLELRYLSERDETSML

SEQ ID NO: 110839 - protein, 22 aa, Mycobacterium avium
FAKPYAEWRGMFAGNGMLLPKS

SEQ ID NO: 110840 - protein, 17 aa, Mycobacterium avium
FALLQTRVDEFYLFVCC

SEQ ID NO: 110841 - protein, 18 aa, Mycobacterium avium
FALLQTRVDEFYLFVCCH

SEQ ID NO: 110842 - protein, 17 aa, Mycobacterium avium
FAMAMAPFGFRASAATP

SEQ ID NO: 110843 - protein, 20 aa, Mycobacterium avium
FAMKFSRPFISYGSWDGSTV

SEQ ID NO: 110844 - protein, 17 aa, Mycobacterium avium
FAPPIGYGALPKDALGA

SEQ ID NO: 110845 - protein, 22 aa, Mycobacterium avium
FAQARSRFDAAWNHQDGDHPIN

SEQ ID NO: 110846 - protein, 17 aa, Mycobacterium avium
FAQHHWGGLLAPPALLM

SEQ ID NO: 110847 - protein, 18 aa, Mycobacterium avium
FAQNRLWFIDQFQGPSPL

SEQ ID NO: 110848 - protein, 17 aa, Mycobacterium avium
FAQQRLWFIDQLQGPSP

SEQ ID NO: 110849 - protein, 18 aa, Mycobacterium avium
FAQSRLWFIDQLHGPSPV

SEQ ID NO: 110850 - protein, 19 aa, Mycobacterium avium
FAQSRLWFIGQLHGPSPVH

SEQ ID NO: 110851 - protein, 17 aa, Mycobacterium avium
FAQSRLWFLDQLHGPSP

SEQ ID NO: 110852 - protein, 18 aa, Mycobacterium avium
FAQSRLWFLDQLQGPSPV

SEQ ID NO: 110853 - protein, 21 aa, Mycobacterium avium
FAQYWAEICSIPISFIAESVR

SEQ ID NO: 110854 - protein, 17 aa, Mycobacterium avium
FARARLRAEVLPLLEEV

SEQ ID NO: 110855 - protein, 19 aa, Mycobacterium avium
FARRFGCVVQDGFGSTEGG

SEQ ID NO: 110856 - protein, 25 aa, Mycobacterium avium
FARYWAEICAIPISFIAESVRRAQA

SEQ ID NO: 110857 - protein, 20 aa, Mycobacterium avium
FAVGPFASMLDRARDLIGRA

SEQ ID NO: 110858 - protein, 17 aa, Mycobacterium avium
FCAAEFVPVIGDLIADM

SEQ ID NO: 110859 - protein, 17 aa, Mycobacterium avium
FCPVGPWIVTDLNPLDP

SEQ ID NO: 110860 - protein, 20 aa, Mycobacterium avium
FCRKRHIVPGLDFVRGDAQN

SEQ ID NO: 110861 - protein, 17 aa, Mycobacterium avium
FDEADLDAAIARFDELT

SEQ ID NO: 110862 - protein, 17 aa, Mycobacterium avium
FDKRLAGASAWWRYTPG

SEQ ID NO: 110863 - protein, 17 aa, Mycobacterium avium
FDLAAYWARGGIGDAYS

SEQ ID NO: 110864 - protein, 17 aa, Mycobacterium avium
FDLAAYWARGGIGEGYA

SEQ ID NO: 110865 - protein, 18 aa, Mycobacterium avium
FDRCCPFGGYKNSGIGRE

SEQ ID NO: 110866 - protein, 17 aa, Mycobacterium avium
FDRGCAFPHGGHLINLH

SEQ ID NO: 110867 - protein, 21 aa, Mycobacterium avium
FDRTKWPFKPDVVADGGNVAV

SEQ ID NO: 110868 - protein, 27 aa, Mycobacterium avium
FDVEAFSRWMLDYVRFHRVYRGVIRAW

SEQ ID NO: 110869 - protein, 23 aa, Mycobacterium avium
FEACQAVGLPVVWQDDAEVPFAY

SEQ ID NO: 110870 - protein, 25 aa, Mycobacterium avium
FEMNEAFAAIAIKIQQYFGIPDQKY

SEQ ID NO: 110871 - protein, 18 aa, Mycobacterium avium
FEPKIRWEAAVFDQSPGI

SEQ ID NO: 110872 - protein, 18 aa, Mycobacterium avium
FEPKIRWEAAVFEESPGI

SEQ ID NO: 110873 - protein, 17 aa, Mycobacterium avium
FFHRLGPVLARRLLLTG

SEQ ID NO: 110874 - protein, 18 aa, Mycobacterium avium
FFRNPIRLVLKVWDPIIK

SEQ ID NO: 110875 - protein, 21 aa, Mycobacterium avium
FGDGWAPWLTRPEELPAKMDY

SEQ ID NO: 110876 - protein, 21 aa, Mycobacterium avium
FGDRPGYRFVQRDVCDPGLID

SEQ ID NO: 110877 - protein, 21 aa, Mycobacterium avium
FGIRTPRHWAVLPAGNGDWAV

SEQ ID NO: 110878 - protein, 17 aa, Mycobacterium avium
FGLLLARTGPDKHRDLS

SEQ ID NO: 110879 - protein, 17 aa, Mycobacterium avium
FGMSMRFYKSREALLDK

SEQ ID NO: 110880 - protein, 20 aa, Mycobacterium avium
FGTAIAAGFVFPLTQNFVDR

SEQ ID NO: 110881 - protein, 17 aa, Mycobacterium avium
FGVDDVRAFDLLRRLSQ

SEQ ID NO: 110882 - protein, 17 aa, Mycobacterium avium
FHTRYEPLWALCAELDF

SEQ ID NO: 110883 - protein, 19 aa, Mycobacterium avium
FIRQPGYRFVELRDPKRSD

SEQ ID NO: 110884 - protein, 18 aa, Mycobacterium avium
FLAHFAIRDWDAMAELLA

SEQ ID NO: 110885 - protein, 19 aa, Mycobacterium avium
FLAHWVRRAGPRIVEPSCG

SEQ ID NO: 110886 - protein, 17 aa, Mycobacterium avium
FLPTRLAAIPALLADVL

SEQ ID NO: 110887 - protein, 17 aa, Mycobacterium avium
FLSTRFKAWRVGGYNEY

SEQ ID NO: 110888 - protein, 21 aa, Mycobacterium avium
FLTCDARLAVTVPPGLADDQA

SEQ ID NO: 110889 - protein, 17 aa, Mycobacterium avium
FLTDVSRAWNLEAAQEN

SEQ ID NO: 110890 - protein, 20 aa, Mycobacterium avium
FMDLPGFDAWLARWRALSPD

SEQ ID NO: 110891 - protein, 18 aa, Mycobacterium avium
FNCLSWIEALGFCGIGEA

SEQ ID NO: 110892 - protein, 18 aa, Mycobacterium avium
FNGSVWFPAAFNNASGAG

SEQ ID NO: 110893 - protein, 21 aa, Mycobacterium avium
FNGWKTLSWVDANIWRRVVPK

SEQ ID NO: 110894 - protein, 22 aa, Mycobacterium avium
FNGWKTLSWVDANIWRRVVPKG

SEQ ID NO: 110895 - protein, 17 aa, Mycobacterium avium
FPAIALCRRFADAGDTP

SEQ ID NO: 110896 - protein, 17 aa, Mycobacterium avium
FPALTFGGSNLNFFPMG

SEQ ID NO: 110897 - protein, 17 aa, Mycobacterium avium
FPAMQAMPTPYVEASDI

SEQ ID NO: 110898 - protein, 17 aa, Mycobacterium avium
FPDIWAATVARRGLVHA

SEQ ID NO: 110899 - protein, 22 aa, Mycobacterium avium
FPFTEQRGATLIAREPIGVCGL

SEQ ID NO: 110900 - protein, 20 aa, Mycobacterium avium
FPINLLDVWAQLATAQGVAS

SEQ ID NO: 110901 - protein, 20 aa, Mycobacterium avium
FPPVELFMQLPWRTEIVKGL

SEQ ID NO: 110902 - protein, 22 aa, Mycobacterium avium
FPQRRARLMMEMHVLGPLHLCQ

SEQ ID NO: 110903 - protein, 21 aa, Mycobacterium avium
FPTKESVLFFGEYDFIDAVSG

SEQ ID NO: 110904 - protein, 20 aa, Mycobacterium avium
FPTKESVLFFGEYDFIHAFS

SEQ ID NO: 110905 - protein, 17 aa, Mycobacterium avium
FPTKESVLFQDYETQLE

SEQ ID NO: 110906 - protein, 17 aa, Mycobacterium avium
FPYAWPRKPVLADNVVC

SEQ ID NO: 110907 - protein, 18 aa, Mycobacterium avium
FQRRACAALERGHGVLVC

SEQ ID NO: 110908 - protein, 17 aa, Mycobacterium avium
FRAAVVLCDIEGLSYEE

SEQ ID NO: 110909 - protein, 18 aa, Mycobacterium avium
FRECAARALLLPRRHPGR

SEQ ID NO: 110910 - protein, 17 aa, Mycobacterium avium
FRENAARGIDMSRLLTA

SEQ ID NO: 110911 - protein, 19 aa, Mycobacterium avium
FRKHFWGCFIDDMHGLKNR

SEQ ID NO: 110912 - protein, 20 aa, Mycobacterium avium
FRLPVDKRKGAALNLFSDTP

SEQ ID NO: 110913 - protein, 21 aa, Mycobacterium avium
FRPSKIAFLAWHAWSDPEQGN

SEQ ID NO: 110914 - protein, 18 aa, Mycobacterium avium
FRSRGAFRVPLPAEFGPI

SEQ ID NO: 110915 - protein, 25 aa, Mycobacterium avium
FRVIGRAGGIYGDFYNFYLCDISIK

SEQ ID NO: 110916 - protein, 17 aa, Mycobacterium avium
FSEPTALNWARHGTDVD

SEQ ID NO: 110917 - protein, 19 aa, Mycobacterium avium
FSFQDGPRGKVWDSNPPEA

SEQ ID NO: 110918 - protein, 19 aa, Mycobacterium avium
FSIKNMWGLLTVRGRFTDF

SEQ ID NO: 110919 - protein, 17 aa, Mycobacterium avium
FSLGLGLGAADLERRTF

SEQ ID NO: 110920 - protein, 21 aa, Mycobacterium avium
FSVGWGRPDLRSQWEHGSPQV

SEQ ID NO: 110921 - protein, 18 aa, Mycobacterium avium
FTEQRGATLIAREPIGVC

SEQ ID NO: 110922 - protein, 24 aa, Mycobacterium avium
FTHAVALAEAWRCFGVLPEITIGH

SEQ ID NO: 110923 - protein, 24 aa, Mycobacterium avium
FTHAVALAEAWRCFGVLPEMAIGH

SEQ ID NO: 110924 - protein, 20 aa, Mycobacterium avium
FTIGDLRTGMTVVEYVDRPE

SEQ ID NO: 110925 - protein, 21 aa, Mycobacterium avium
FTVQSGKLWLLQSRAAKRSPQ

SEQ ID NO: 110926 - protein, 22 aa, Mycobacterium avium
FVACPFGAPATRMYRTGDLVRW

SEQ ID NO: 110927 - protein, 19 aa, Mycobacterium avium
FVACPFGGVGVRMYRTGDL

SEQ ID NO: 110928 - protein, 24 aa, Mycobacterium avium
FVDWRQRPGLRRALFQGNPVWVVS

SEQ ID NO: 110929 - protein, 18 aa, Mycobacterium avium
FVEVHWSRWGEAYVTPVE

SEQ ID NO: 110930 - protein, 17 aa, Mycobacterium avium
FVGESLAPILSRLTERT

SEQ ID NO: 110931 - protein, 17 aa, Mycobacterium avium
FVKRASGPVLRRFIEAA

SEQ ID NO: 110932 - protein, 19 aa, Mycobacterium avium
FWRSRLGAMASRGETDGPR

SEQ ID NO: 110933 - protein, 19 aa, Mycobacterium avium
FWTCSGIGYALTPEELGGA

SEQ ID NO: 110934 - protein, 17 aa, Mycobacterium avium
FYCYSFEPNNDWTHFFA

SEQ ID NO: 110935 - protein, 18 aa, Mycobacterium avium
FYTPRLADMYNEWLDEGF

SEQ ID NO: 110936 - protein, 17 aa, Mycobacterium avium
FYWSVFATRPFEAAVQA

SEQ ID NO: 110937 - protein, 18 aa, Mycobacterium avium
GADAYRLLPAYREAADRC

SEQ ID NO: 110938 - protein, 17 aa, Mycobacterium avium
GAECCRRLFRLPPVPVR

SEQ ID NO: 110939 - protein, 17 aa, Mycobacterium avium
GAEGVWCGSVWLTTEEA

SEQ ID NO: 110940 - protein, 17 aa, Mycobacterium avium
GAFNYAWLNLRKDRQVD

SEQ ID NO: 110941 - protein, 18 aa, Mycobacterium avium
GAGALGFAGTARKDAAGA

SEQ ID NO: 110942 - protein, 22 aa, Mycobacterium avium
GAGLARYACGLGMTVVLADIDR

SEQ ID NO: 110943 - protein, 18 aa, Mycobacterium avium
GAGNLGFAGTAPRETVAA

SEQ ID NO: 110944 - protein, 21 aa, Mycobacterium avium
GAGVSGLWLLSGMSDDGVLTT

SEQ ID NO: 110945 - protein, 19 aa, Mycobacterium avium
GAIAVYPVAGWWKNQRKYD

SEQ ID NO: 110946 - protein, 25 aa, Mycobacterium avium
GAICGSWWWRDFILANGLQARVPAA

SEQ ID NO: 110947 - protein, 21 aa, Mycobacterium avium
GALRRSIKFPSFLDGIDAVRR

SEQ ID NO: 110948 - protein, 20 aa, Mycobacterium avium
GALSEWRATLIVRESACLDA

SEQ ID NO: 110949 - protein, 20 aa, Mycobacterium avium
GANRSTRRWHWLDPQTRDAL

SEQ ID NO: 110950 - protein, 18 aa, Mycobacterium avium
GAPAHDWLTLTGGAIGYG

SEQ ID NO: 110951 - protein, 21 aa, Mycobacterium avium
GAPPHPCPLSFIVAPTLIQHG

SEQ ID NO: 110952 - protein, 18 aa, Mycobacterium avium
GARRGTAELGRMYVHDGV

SEQ ID NO: 110953 - protein, 20 aa, Mycobacterium avium
GATIAHGFLTLSLIPGVSKD

SEQ ID NO: 110954 - protein, 24 aa, Mycobacterium avium
GAVKFPAERPELFDGDSDIQQDIE

SEQ ID NO: 110955 - protein, 19 aa, Mycobacterium avium
GCAGLRYNLFFDDRSLDGD

SEQ ID NO: 110956 - protein, 21 aa, Mycobacterium avium
GCALATRMLVPRSHYDQAVEV

SEQ ID NO: 110957 - protein, 24 aa, Mycobacterium avium
GCGCRKPRPGLILAAAEALGVPAR

SEQ ID NO: 110958 - protein, 20 aa, Mycobacterium avium
GCGMACPFCATGQGGLSRNL

SEQ ID NO: 110959 - protein, 19 aa, Mycobacterium avium
GCQPQAAKLVEWLKLALDE

SEQ ID NO: 110960 - protein, 20 aa, Mycobacterium avium
GCRKPRPGLILAAAEALGVP

SEQ ID NO: 110961 - protein, 17 aa, Mycobacterium avium
GCRMGICHTCTRRKTAG

SEQ ID NO: 110962 - protein, 18 aa, Mycobacterium avium
GDAVPDGFARISLGIEDT

SEQ ID NO: 110963 - protein, 20 aa, Mycobacterium avium
GDCAFCLGREAAHRGESEDQ

SEQ ID NO: 110964 - protein, 18 aa, Mycobacterium avium
GDCGRWLDLCAGPGGKTA

SEQ ID NO: 110965 - protein, 18 aa, Mycobacterium avium
GDEVWNWADELAQLPSLL

SEQ ID NO: 110966 - protein, 17 aa, Mycobacterium avium
GDGGFGYDPVFVPDDAA

SEQ ID NO: 110967 - protein, 23 aa, Mycobacterium avium
GDGRGTVYLATRGGYFVLDLGTG

SEQ ID NO: 110968 - protein, 18 aa, Mycobacterium avium
GDGWRLAMDLLPYERSSC

SEQ ID NO: 110969 - protein, 22 aa, Mycobacterium avium
GDLTSRCSWAGAQAARLAAEAR

SEQ ID NO: 110970 - protein, 23 aa, Mycobacterium avium
GDRLRLALDADLCAAVTGLPAPL

SEQ ID NO: 110971 - protein, 24 aa, Mycobacterium avium
GDRLRLALDADLCAAVTGLPAPLA

SEQ ID NO: 110972 - protein, 20 aa, Mycobacterium avium
GDRPGYRFVQRDVCEPGLID

SEQ ID NO: 110973 - protein, 20 aa, Mycobacterium avium
GDRPPFGAALIRTADTEHRF

SEQ ID NO: 110974 - protein, 17 aa, Mycobacterium avium
GDTFVGPRFGYLGRTQP

SEQ ID NO: 110975 - protein, 25 aa, Mycobacterium avium
GDWPSFPLPLGDTWASSKGDLLTVE

SEQ ID NO: 110976 - protein, 25 aa, Mycobacterium avium
GDWPSFPLPLGDTWSSTRGDLLTVE

SEQ ID NO: 110977 - protein, 18 aa, Mycobacterium avium
GEAMLFGEYIRFMALVEY

SEQ ID NO: 110978 - protein, 19 aa, Mycobacterium avium
GEAMLFGEYIRFMALVEYS

SEQ ID NO: 110979 - protein, 20 aa, Mycobacterium avium
GEARIEKVIERFRRVLEAMT

SEQ ID NO: 110980 - protein, 21 aa, Mycobacterium avium
GEFPDSAALFWEAISAESADR

SEQ ID NO: 110981 - protein, 19 aa, Mycobacterium avium
GEGCVMLLLKRLDDARRDG

SEQ ID NO: 110982 - protein, 17 aa, Mycobacterium avium
GELIGALAMTEPGAGSD

SEQ ID NO: 110983 - protein, 24 aa, Mycobacterium avium
GELRLKGPQCFLGYVDATLDAHAF

SEQ ID NO: 110984 - protein, 17 aa, Mycobacterium avium
GELVGLVPHLARGLGPG

SEQ ID NO: 110985 - protein, 17 aa, Mycobacterium avium
GEVKDVLLLDVTPLSLG

SEQ ID NO: 110986 - protein, 22 aa, Mycobacterium avium
GFLLTFLACFDVGDRVALASPG

SEQ ID NO: 110987 - protein, 17 aa, Mycobacterium avium
GFLPTLLDWCRRNDVLF

SEQ ID NO: 110988 - protein, 21 aa, Mycobacterium avium
GFPPPGGRVLLVWDAPNLDMG

SEQ ID NO: 110989 - protein, 19 aa, Mycobacterium avium
GFRSRGAFRVPLPAEFGPI

SEQ ID NO: 110990 - protein, 19 aa, Mycobacterium avium
GFRWWTRCRALELGLTGYA

SEQ ID NO: 110991 - protein, 21 aa, Mycobacterium avium
GFTWRSFCARDFAAHGLNLDV

SEQ ID NO: 110992 - protein, 17 aa, Mycobacterium avium
GFWKMGEMRGMWREMWD

SEQ ID NO: 110993 - protein, 17 aa, Mycobacterium avium
GGASILMRAVLAAYGDE

SEQ ID NO: 110994 - protein, 23 aa, Mycobacterium avium
GGICIGCTMPGFPDKFMPFMDEP

SEQ ID NO: 110995 - protein, 17 aa, Mycobacterium avium
GGKALRPALSIATCLGL

SEQ ID NO: 110996 - protein, 18 aa, Mycobacterium avium
GGPHFLPFGAATVGSDTI

SEQ ID NO: 110997 - protein, 20 aa, Mycobacterium avium
GGPPCPPRAAAPICHTVALR

SEQ ID NO: 110998 - protein, 25 aa, Mycobacterium avium
GGPRSGVGIVEGWRGTIVHRVEIAA

SEQ ID NO: 110999 - protein, 19 aa, Mycobacterium avium
GGRLPITFPVGLHQTPRPQ

SEQ ID NO: 111000 - protein, 22 aa, Mycobacterium avium
GGRLRLCVGVGWLQEELRACGA

SEQ ID NO: 111001 - protein, 23 aa, Mycobacterium avium
GGRRISIYWTWSYPWESQRDIQT

SEQ ID NO: 111002 - protein, 19 aa, Mycobacterium avium
GGTLICRWHGLPLDGRARE

SEQ ID NO: 111003 - protein, 22 aa, Mycobacterium avium
GGVAAHCYFEFELADFDRPRFD

SEQ ID NO: 111004 - protein, 19 aa, Mycobacterium avium
GGVLPRLARQGYLPGELAD

SEQ ID NO: 111005 - protein, 19 aa, Mycobacterium avium
GGVRDVVLCPGSRNAPLAF

SEQ ID NO: 111006 - protein, 21 aa, Mycobacterium avium
GHIARACARAGARLLHVSTDY

SEQ ID NO: 111007 - protein, 22 aa, Mycobacterium avium
GHPAKLLLQFGRPVHRQPRAAV

SEQ ID NO: 111008 - protein, 24 aa, Mycobacterium avium
GHRKGFLQFRWQRVSRQLTEADGP

SEQ ID NO: 111009 - protein, 20 aa, Mycobacterium avium
GIAASTAWEAFDLGGNKIGQ

SEQ ID NO: 111010 - protein, 21 aa, Mycobacterium avium
GIAGFCMGGRFALVMSPKGFG

SEQ ID NO: 111011 - protein, 17 aa, Mycobacterium avium
GIDVAVCKPVQTGTDDG

SEQ ID NO: 111012 - protein, 18 aa, Mycobacterium avium
GIRMSWDIATNVVAAESI

SEQ ID NO: 111013 - protein, 18 aa, Mycobacterium avium
GIYWSFSIGNPWWETIHY

SEQ ID NO: 111014 - protein, 17 aa, Mycobacterium avium
GKAEKCTLCYPRMEVGL

SEQ ID NO: 111015 - protein, 18 aa, Mycobacterium avium
GKCPPPAGFFGTVASVDG

SEQ ID NO: 111016 - protein, 17 aa, Mycobacterium avium
GKFPTARLVVFKLSGDF

SEQ ID NO: 111017 - protein, 23 aa, Mycobacterium avium
GKHAASAFALWFPIEGEVDYGRA

SEQ ID NO: 111018 - protein, 18 aa, Mycobacterium avium
GKLLHRLGEIIAREADQL

SEQ ID NO: 111019 - protein, 17 aa, Mycobacterium avium
GLAAALWATTARRALVL

SEQ ID NO: 111020 - protein, 20 aa, Mycobacterium avium
GLAEMPWRLSIFGDGPDRQR

SEQ ID NO: 111021 - protein, 24 aa, Mycobacterium avium
GLAGLRVGYAIGHPELITALDKVV

SEQ ID NO: 111022 - protein, 17 aa, Mycobacterium avium
GLARAIADIAARARSGN

SEQ ID NO: 111023 - protein, 24 aa, Mycobacterium avium
GLARHVLCFRTLWEATHAELMKQG

SEQ ID NO: 111024 - protein, 24 aa, Mycobacterium avium
GLARHVLCFRTLWEATHTELMKQG

SEQ ID NO: 111025 - protein, 24 aa, Mycobacterium avium
GLGTARFVGAMAVPPTWQGSMPAY

SEQ ID NO: 111026 - protein, 22 aa, Mycobacterium avium
GLGVLLCFAGRVLQPLGLSKVA

SEQ ID NO: 111027 - protein, 17 aa, Mycobacterium avium
GLIFHWAKERDRRLVTT

SEQ ID NO: 111028 - protein, 24 aa, Mycobacterium avium
GLIPEIPDGLGWWDPEADNAVRPD

SEQ ID NO: 111029 - protein, 17 aa, Mycobacterium avium
GLLKSASRVSLKTAGRL

SEQ ID NO: 111030 - protein, 26 aa, Mycobacterium avium
GLMTCGSVWACPRCSAVIANTRAAEI

SEQ ID NO: 111031 - protein, 23 aa, Mycobacterium avium
GLPSARIDFMLADAVPVVTVTTA

SEQ ID NO: 111032 - protein, 21 aa, Mycobacterium avium
GLQIRLDWDRGFELIAPTAAA

SEQ ID NO: 111033 - protein, 17 aa, Mycobacterium avium
GLSKGLPGLAEWTVGFL

SEQ ID NO: 111034 - protein, 20 aa, Mycobacterium avium
GLSSRAEWLPAWEDGLARAS

SEQ ID NO: 111035 - protein, 17 aa, Mycobacterium avium
GLTAARFVACPFGDAGA

SEQ ID NO: 111036 - protein, 19 aa, Mycobacterium avium
GLVRTCVFAVPKYLLSGGK

SEQ ID NO: 111037 - protein, 17 aa, Mycobacterium avium
GMDVDWRGALGTGHLVD

SEQ ID NO: 111038 - protein, 17 aa, Mycobacterium avium
GMIRRLEVAQALVNRPS

SEQ ID NO: 111039 - protein, 18 aa, Mycobacterium avium
GMIRRLEVAQALVNRPSL

SEQ ID NO: 111040 - protein, 18 aa, Mycobacterium avium
GMLVRALEIWPDKDAGEL

SEQ ID NO: 111041 - protein, 18 aa, Mycobacterium avium
GMRCDGTVFPVDVSLSPL

SEQ ID NO: 111042 - protein, 17 aa, Mycobacterium avium
GNACLSCGHFATDITHA

SEQ ID NO: 111043 - protein, 26 aa, Mycobacterium avium
GNSLFRPAYKHWLLKDELIRIEATAA

SEQ ID NO: 111044 - protein, 23 aa, Mycobacterium avium
GNWLLAARCVRGFLAMSSEKPDP

SEQ ID NO: 111045 - protein, 23 aa, Mycobacterium avium
GNWLLAARCVRGFLAMSSEKPEP

SEQ ID NO: 111046 - protein, 23 aa, Mycobacterium avium
GNWLLAARCVRGFLAMSSEKPNP

SEQ ID NO: 111047 - protein, 18 aa, Mycobacterium avium
GPCKMVAPVLEEIASERG

SEQ ID NO: 111048 - protein, 17 aa, Mycobacterium avium
GPFCAALAYLCDKDMVL

SEQ ID NO: 111049 - protein, 17 aa, Mycobacterium avium
GPFRVRIPLLLSADDGH

SEQ ID NO: 111050 - protein, 18 aa, Mycobacterium avium
GPGQRVAVVIPRSAEAVV

SEQ ID NO: 111051 - protein, 23 aa, Mycobacterium avium
GPKPLPMGPFIGGDPRWGTAHFA

SEQ ID NO: 111052 - protein, 17 aa, Mycobacterium avium
GPLFKFALLQTRVDEFY

SEQ ID NO: 111053 - protein, 18 aa, Mycobacterium avium
GPLPLGTPVTGRLYFDVR

SEQ ID NO: 111054 - protein, 25 aa, Mycobacterium avium
GPQRLSGPEALSFVRQRHELPRGDL

SEQ ID NO: 111055 - protein, 18 aa, Mycobacterium avium
GPQRWRIRANWKIGAENF

SEQ ID NO: 111056 - protein, 22 aa, Mycobacterium avium
GPRPQEWLLFLGADDALDQPDT

SEQ ID NO: 111057 - protein, 20 aa, Mycobacterium avium
GPSMVRWARENGWSAPPGAG

SEQ ID NO: 111058 - protein, 20 aa, Mycobacterium avium
GPTQLSWWVTRVQEVARAIS

SEQ ID NO: 111059 - protein, 17 aa, Mycobacterium avium
GPTRDWECYCGKYKRVR

SEQ ID NO: 111060 - protein, 22 aa, Mycobacterium avium
GPVKRDAALCLATLRVGADPQG

SEQ ID NO: 111061 - protein, 18 aa, Mycobacterium avium
GQAVSSLFSWTGDATQGP

SEQ ID NO: 111062 - protein, 19 aa, Mycobacterium avium
GQDIRFGLGAVRNVGANVV

SEQ ID NO: 111063 - protein, 18 aa, Mycobacterium avium
GQPSWLLRVAGDSIGNDT

SEQ ID NO: 111064 - protein, 22 aa, Mycobacterium avium
GQRPADDVYLVFTANEEIGGVG

SEQ ID NO: 111065 - protein, 23 aa, Mycobacterium avium
GQTRLRIVVLIGIPTVKRNLGDE

SEQ ID NO: 111066 - protein, 18 aa, Mycobacterium avium
GRAIHEWSAQVFRDDEGT

SEQ ID NO: 111067 - protein, 20 aa, Mycobacterium avium
GRAPRPGERFRLPAHADTLE

SEQ ID NO: 111068 - protein, 18 aa, Mycobacterium avium
GRCSAGFAALLDAIVEAL

SEQ ID NO: 111069 - protein, 18 aa, Mycobacterium avium
GRGARPGERVAVLVPRSA

SEQ ID NO: 111070 - protein, 18 aa, Mycobacterium avium
GRGAWPVCGGPLSGPTPR

SEQ ID NO: 111071 - protein, 25 aa, Mycobacterium avium
GRGEHPSLCLFASWAAPDSPAGRRL

SEQ ID NO: 111072 - protein, 17 aa, Mycobacterium avium
GRLAEKVGRPFWHEGRG

SEQ ID NO: 111073 - protein, 18 aa, Mycobacterium avium
GRLLMGVTGVRPAGQQNT

SEQ ID NO: 111074 - protein, 18 aa, Mycobacterium avium
GRLLMGVTGVRTAGQQNT

SEQ ID NO: 111075 - protein, 19 aa, Mycobacterium avium
GRLRWRWLAGCDARPVDSA

SEQ ID NO: 111076 - protein, 20 aa, Mycobacterium avium
GRPSLVFPRELPRSGAEFLG

SEQ ID NO: 111077 - protein, 19 aa, Mycobacterium avium
GRPTSFIWYGPRWAQAATA

SEQ ID NO: 111078 - protein, 22 aa, Mycobacterium avium
GRRFLGSFAHRFLAAELVCRIQ

SEQ ID NO: 111079 - protein, 18 aa, Mycobacterium avium
GRRYLGLDILTRCRLTTI

SEQ ID NO: 111080 - protein, 20 aa, Mycobacterium avium
GRSAAGWAQRVVFVNGHGGN

SEQ ID NO: 111081 - protein, 18 aa, Mycobacterium avium
GRTALPFNGLRVLDLTTF

SEQ ID NO: 111082 - protein, 17 aa, Mycobacterium avium
GRTLTEFPIIAQAMVAV

SEQ ID NO: 111083 - protein, 23 aa, Mycobacterium avium
GRTPAQVLVRWNLQLDNVVVSRS

SEQ ID NO: 111084 - protein, 19 aa, Mycobacterium avium
GRVPRKFADRAPCVVDTDT

SEQ ID NO: 111085 - protein, 20 aa, Mycobacterium avium
GSAPLSWPAGWSGWPHRVYG

SEQ ID NO: 111086 - protein, 20 aa, Mycobacterium avium
GSAPLSWPPGWSGWPHRVYG

SEQ ID NO: 111087 - protein, 22 aa, Mycobacterium avium
GSCGCPKGRFSLQSSATGMELH

SEQ ID NO: 111088 - protein, 20 aa, Mycobacterium avium
GSELCAAPSFPVRVPGGTPI

SEQ ID NO: 111089 - protein, 18 aa, Mycobacterium avium
GSFFPVIPVCSSTGVGTL

SEQ ID NO: 111090 - protein, 21 aa, Mycobacterium avium
GSRALAMSVEWAGERQQFGRP

SEQ ID NO: 111091 - protein, 21 aa, Mycobacterium avium
GSRDAKARWLPPLVSGSLRAT

SEQ ID NO: 111092 - protein, 19 aa, Mycobacterium avium
GTAAPCWARRIRWPGSSTW

SEQ ID NO: 111093 - protein, 19 aa, Mycobacterium avium
GTAHRCCGTSRLRCTCSPS

SEQ ID NO: 111094 - protein, 24 aa, Mycobacterium avium
GTANFRAGPVLAFLSGNLCYQIEH

SEQ ID NO: 111095 - protein, 26 aa, Mycobacterium avium
GTAVDWRFAATVGRRLARPGPPSTDY

SEQ ID NO: 111096 - protein, 18 aa, Mycobacterium avium
GTLMCRWHGLPLDGRARE

SEQ ID NO: 111097 - protein, 22 aa, Mycobacterium avium
GTLQRLAALQGRRVDALTEEEP

SEQ ID NO: 111098 - protein, 22 aa, Mycobacterium avium
GTNLRAAWLTMIAVASTHQGKG

SEQ ID NO: 111099 - protein, 20 aa, Mycobacterium avium
GTPFLPQWACEPEDVAAAVC

SEQ ID NO: 111100 - protein, 17 aa, Mycobacterium avium
GTPVAMTMNLDWHTDGT

SEQ ID NO: 111101 - protein, 20 aa, Mycobacterium avium
GTSFARWSSILAEYAKSPAV

SEQ ID NO: 111102 - protein, 18 aa, Mycobacterium avium
GTVKFRIGPDGKLQTIGK

SEQ ID NO: 111103 - protein, 18 aa, Mycobacterium avium
GTVLSRFGFPGGGYLAPE

SEQ ID NO: 111104 - protein, 17 aa, Mycobacterium avium
GVAYVCFLTDAFSRMII

SEQ ID NO: 111105 - protein, 18 aa, Mycobacterium avium
GVCAALFHRGRTGEPTIV

SEQ ID NO: 111106 - protein, 18 aa, Mycobacterium avium
GVDGYRWMIRCVVNGTHE

SEQ ID NO: 111107 - protein, 25 aa, Mycobacterium avium
GVFCDFGWGGIEVYCVVDGVVTMLY

SEQ ID NO: 111108 - protein, 17 aa, Mycobacterium avium
GVGCTRLAIHAATGSGE

SEQ ID NO: 111109 - protein, 23 aa, Mycobacterium avium
GVGWLKDEFDIIGVPFNKRGRIT

SEQ ID NO: 111110 - protein, 22 aa, Mycobacterium avium
GVKRVPLARARRAAQRHDYLGN

SEQ ID NO: 111111 - protein, 18 aa, Mycobacterium avium
GVPGIRQARFDWLRGDPS

SEQ ID NO: 111112 - protein, 17 aa, Mycobacterium avium
GVPNWRSAPPVVLAVKD

SEQ ID NO: 111113 - protein, 24 aa, Mycobacterium avium
GVQSALCFPSFPGFGGGTFQRAED

SEQ ID NO: 111114 - protein, 25 aa, Mycobacterium avium
GVSRPENFVGIHFFSPVEKMDPIEI

SEQ ID NO: 111115 - protein, 17 aa, Mycobacterium avium
GVSYGFLSSAIMEYLDW

SEQ ID NO: 111116 - protein, 23 aa, Mycobacterium avium
GVVKFPAERPELFDGSPDTQEDI

SEQ ID NO: 111117 - protein, 18 aa, Mycobacterium avium
GVVLLMWAGILAYLDRYG

SEQ ID NO: 111118 - protein, 17 aa, Mycobacterium avium
GVVPLQLSAGPPVPAPD

SEQ ID NO: 111119 - protein, 17 aa, Mycobacterium avium
GVWRGGASILMRAVLAA

SEQ ID NO: 111120 - protein, 21 aa, Mycobacterium avium
GVWVHPEWRGLGLGTAGTATV

SEQ ID NO: 111121 - protein, 17 aa, Mycobacterium avium
GWCWSLDGRNTFVLRPE

SEQ ID NO: 111122 - protein, 18 aa, Mycobacterium avium
GWHSGPVFGTHAAAMASG

SEQ ID NO: 111123 - protein, 18 aa, Mycobacterium avium
GWLRYGLPASLGGRDGSN

SEQ ID NO: 111124 - protein, 21 aa, Mycobacterium avium
GWPDILFYGPGTWGFGNGPNS

SEQ ID NO: 111125 - protein, 17 aa, Mycobacterium avium
GWVPRLAAMDVIASYCL

SEQ ID NO: 111126 - protein, 19 aa, Mycobacterium avium
GYGPAFRGLRAVWRRGAET

SEQ ID NO: 111127 - protein, 19 aa, Mycobacterium avium
GYLQPHWPAPYGRAADSVE

SEQ ID NO: 111128 - protein, 23 aa, Mycobacterium avium
GYLRRAGLTASRFVACPFGAPGA

SEQ ID NO: 111129 - protein, 18 aa, Mycobacterium avium
GYTCAACIDRHLDAAAAR

SEQ ID NO: 111130 - protein, 24 aa, Mycobacterium avium
GYTFACDRWRVVPDVYLLGKALGG

SEQ ID NO: 111131 - protein, 25 aa, Mycobacterium avium
GYTFACDRWRVVPDVYLLGKALGGG

SEQ ID NO: 111132 - protein, 19 aa, Mycobacterium avium
GYTPRLWRYWAEHLDPDRA

SEQ ID NO: 111133 - protein, 18 aa, Mycobacterium avium
GYWKRPALTATRFVANPY

SEQ ID NO: 111134 - protein, 19 aa, Mycobacterium avium
HAAASCYRSVIAGLTTGRW

SEQ ID NO: 111135 - protein, 22 aa, Mycobacterium avium
HAAKGLEWDAVFLVGLADGTLP

SEQ ID NO: 111136 - protein, 17 aa, Mycobacterium avium
HAIERDLWQAGAITPGT

SEQ ID NO: 111137 - protein, 19 aa, Mycobacterium avium
HAIERDLWQAGAITPGTKA

SEQ ID NO: 111138 - protein, 18 aa, Mycobacterium avium
HAIIKALRTAAVNDTKDA

SEQ ID NO: 111139 - protein, 19 aa, Mycobacterium avium
HAKGAGAYGRFEVTADVSE

SEQ ID NO: 111140 - protein, 20 aa, Mycobacterium avium
HARGEFRPRPSFLSPGKKIL

SEQ ID NO: 111141 - protein, 22 aa, Mycobacterium avium
HARQPVCRRVEFAVGPGPLAAA

SEQ ID NO: 111142 - protein, 18 aa, Mycobacterium avium
HAWIEAWTGAWWSYDPTN

SEQ ID NO: 111143 - protein, 22 aa, Mycobacterium avium
HDQSARMDLVFSLAERWNPDGE

SEQ ID NO: 111144 - protein, 21 aa, Mycobacterium avium
HDRLRLALLLCAVRPEIGGAL

SEQ ID NO: 111145 - protein, 18 aa, Mycobacterium avium
HDTFCPVGPWIVTDLNPL

SEQ ID NO: 111146 - protein, 18 aa, Mycobacterium avium
HELERTGGRFGLQTMCEG

SEQ ID NO: 111147 - protein, 19 aa, Mycobacterium avium
HELRIGLEVEVHFDSASAD

SEQ ID NO: 111148 - protein, 17 aa, Mycobacterium avium
HEPRLPYASLKAAVATF

SEQ ID NO: 111149 - protein, 17 aa, Mycobacterium avium
HGPEFAQRFGLGFSAQD

SEQ ID NO: 111150 - protein, 19 aa, Mycobacterium avium
HGPVRFPGVPTWFSQTPGR

SEQ ID NO: 111151 - protein, 20 aa, Mycobacterium avium
HGPVRFPGVPTWFSQTPGRV

SEQ ID NO: 111152 - protein, 23 aa, Mycobacterium avium
HGQAVSSLFSWTGDATKEPKQAS

SEQ ID NO: 111153 - protein, 22 aa, Mycobacterium avium
HGQAVSSLFSWTGDATQGPEAS

SEQ ID NO: 111154 - protein, 18 aa, Mycobacterium avium
HGSDWRWGPVHVAPPAPP

SEQ ID NO: 111155 - protein, 23 aa, Mycobacterium avium
HGTTPPMPIVWGISATTQNFEDA

SEQ ID NO: 111156 - protein, 23 aa, Mycobacterium avium
HGWQWCAGCGTDAAPYFRVFNPA

SEQ ID NO: 111157 - protein, 17 aa, Mycobacterium avium
HIKRLKVGTSRRFSATT

SEQ ID NO: 111158 - protein, 21 aa, Mycobacterium avium
HKCADMLVDLEWARSASQAAL

SEQ ID NO: 111159 - protein, 22 aa, Mycobacterium avium
HLAAELMGRFAFDRPGLAAMSL

SEQ ID NO: 111160 - protein, 22 aa, Mycobacterium avium
HLISPWGTWDWMGPAAVGAVLP

SEQ ID NO: 111161 - protein, 19 aa, Mycobacterium avium
HLTALCWDGGAALPFDADD

SEQ ID NO: 111162 - protein, 18 aa, Mycobacterium avium
HLVGWSFGGVVAHELAIE

SEQ ID NO: 111163 - protein, 24 aa, Mycobacterium avium
HNERLFCIPATIDLAGAEIELVSM

SEQ ID NO: 111164 - protein, 18 aa, Mycobacterium avium
HPAGSVLIEFGHTKVMCT

SEQ ID NO: 111165 - protein, 19 aa, Mycobacterium avium
HPPGIDFRPALLAGVQIGL

SEQ ID NO: 111166 - protein, 20 aa, Mycobacterium avium
HPRRLHWYVPRSIRLIDVFK

SEQ ID NO: 111167 - protein, 20 aa, Mycobacterium avium
HPWLPGFEPPYVIAVVALDE

SEQ ID NO: 111168 - protein, 17 aa, Mycobacterium avium
HRVPVWFMRQAGRSLPE

SEQ ID NO: 111169 - protein, 17 aa, Mycobacterium avium
HRWPRRALRLTAIDVDS

SEQ ID NO: 111170 - protein, 20 aa, Mycobacterium avium
HSLARLAICDDIYASLRSLC

SEQ ID NO: 111171 - protein, 21 aa, Mycobacterium avium
HSMGAVVAFEFARVAETHGAA

SEQ ID NO: 111172 - protein, 17 aa, Mycobacterium avium
HSYRIPIVTTDPSASWT

SEQ ID NO: 111173 - protein, 23 aa, Mycobacterium avium
HTPAGPAQLGWRRRISRTRDRQV

SEQ ID NO: 111174 - protein, 19 aa, Mycobacterium avium
HVGMGMGMYGVRPLRLAWR

SEQ ID NO: 111175 - protein, 18 aa, Mycobacterium avium
HVIGCCLENLMAGKPHEE

SEQ ID NO: 111176 - protein, 30 aa, Mycobacterium avium
HVLRELPYDWALELGCGTGFFLLNLIQSGV

SEQ ID NO: 111177 - protein, 23 aa, Mycobacterium avium
HVMYKPRWGAFYGTKLVQHLRES

SEQ ID NO: 111178 - protein, 17 aa, Mycobacterium avium
HVRLCLGYTEPEGGSDV

SEQ ID NO: 111179 - protein, 23 aa, Mycobacterium avium
HVSLGALWRLYSQYPYMPRLRDR

SEQ ID NO: 111180 - protein, 19 aa, Mycobacterium avium
HWQTAAVLFGVWWIGAEAV

SEQ ID NO: 111181 - protein, 17 aa, Mycobacterium avium
HYRSVAVPVTFDAEGHP

SEQ ID NO: 111182 - protein, 18 aa, Mycobacterium avium
IAAEIGLPVMVKAQVKTG

SEQ ID NO: 111183 - protein, 18 aa, Mycobacterium avium
IAAGELHFSIGYSEPGAG

SEQ ID NO: 111184 - protein, 17 aa, Mycobacterium avium
IACEPRGDGGFGYDPVF

SEQ ID NO: 111185 - protein, 21 aa, Mycobacterium avium
IADEGLRRWGVDAEVRDRFLG

SEQ ID NO: 111186 - protein, 26 aa, Mycobacterium avium
IADLRAIPWVLAWSQSRVMLPGWYGT

SEQ ID NO: 111187 - protein, 19 aa, Mycobacterium avium
IAFGWDRINALLSRVDSIR

SEQ ID NO: 111188 - protein, 20 aa, Mycobacterium avium
IAGFCMGGRFALVMSPKGFG

SEQ ID NO: 111189 - protein, 20 aa, Mycobacterium avium
IAGFCMGGRFALVMSPKGFS

SEQ ID NO: 111190 - protein, 19 aa, Mycobacterium avium
IALKDGIDATVSWYRTNAD

SEQ ID NO: 111191 - protein, 19 aa, Mycobacterium avium
IALKEGIDATVSWYRTNAD

SEQ ID NO: 111192 - protein, 23 aa, Mycobacterium avium
IALVVRAGRDWAIREIPLGDVVK

SEQ ID NO: 111193 - protein, 20 aa, Mycobacterium avium
IASLELEYYGSMWPNNRPSA

SEQ ID NO: 111194 - protein, 23 aa, Mycobacterium avium
IASLLPPAVKWKAFFNAQAKNPK

SEQ ID NO: 111195 - protein, 20 aa, Mycobacterium avium
ICMSTGFSLWAHRMTVEYLL

SEQ ID NO: 111196 - protein, 17 aa, Mycobacterium avium
ICVSGPLLSGGYWNLPE

SEQ ID NO: 111197 - protein, 18 aa, Mycobacterium avium
IDAAWRAGFGWIDDLNDA

SEQ ID NO: 111198 - protein, 17 aa, Mycobacterium avium
IDANGWPASRLNDAIDA

SEQ ID NO: 111199 - protein, 17 aa, Mycobacterium avium
IDARLARWFGRQDLDST

SEQ ID NO: 111200 - protein, 17 aa, Mycobacterium avium
IDGRPSLVFPRELPRSG

SEQ ID NO: 111201 - protein, 19 aa, Mycobacterium avium
IDLGWWLMFERFLCEALGF

SEQ ID NO: 111202 - protein, 21 aa, Mycobacterium avium
IDLNVRWRKGQTLDPDWKIEQ

SEQ ID NO: 111203 - protein, 18 aa, Mycobacterium avium
IDLRLDWPKALAQAGFDA

SEQ ID NO: 111204 - protein, 18 aa, Mycobacterium avium
IDLVGPVLIKFGTDEQKA

SEQ ID NO: 111205 - protein, 17 aa, Mycobacterium avium
IEAAEAMVQRNCMVPMQ

SEQ ID NO: 111206 - protein, 18 aa, Mycobacterium avium
IEDLHIWTAESVRADRLD

SEQ ID NO: 111207 - protein, 18 aa, Mycobacterium avium
IEEKRMFGGLAFLLNGNM

SEQ ID NO: 111208 - protein, 21 aa, Mycobacterium avium
IEHWTRLPVEVELASEFRYRD

SEQ ID NO: 111209 - protein, 19 aa, Mycobacterium avium
IELADLVVLLDHFGIKSEM

SEQ ID NO: 111210 - protein, 20 aa, Mycobacterium avium
IERFLQLWAEGSMTIAMPST

SEQ ID NO: 111211 - protein, 19 aa, Mycobacterium avium
IEVARRLLPGIAHVAVFDT

SEQ ID NO: 111212 - protein, 23 aa, Mycobacterium avium
IFLREVQDVWTWVQPYFDDRATG

SEQ ID NO: 111213 - protein, 17 aa, Mycobacterium avium
IGAVLSMHFAKQAARFF

SEQ ID NO: 111214 - protein, 17 aa, Mycobacterium avium
IGDTVIWDNRGVLHRAA

SEQ ID NO: 111215 - protein, 25 aa, Mycobacterium avium
IGGRLVELCAPFGMEVLVFDPYLDE

SEQ ID NO: 111216 - protein, 17 aa, Mycobacterium avium
IGLDEYVDWLIDAGYPI

SEQ ID NO: 111217 - protein, 17 aa, Mycobacterium avium
IGLDEYVDWLIEAGYLI

SEQ ID NO: 111218 - protein, 17 aa, Mycobacterium avium
IGLDEYVDWLIEAGYPI

SEQ ID NO: 111219 - protein, 18 aa, Mycobacterium avium
IGQCAGFAPDGLMVSSHQ

SEQ ID NO: 111220 - protein, 21 aa, Mycobacterium avium
IGRIKDLLIVYGRNHSPDDIE

SEQ ID NO: 111221 - protein, 18 aa, Mycobacterium avium
IGTDWLRAYLALPNYANN

SEQ ID NO: 111222 - protein, 17 aa, Mycobacterium avium
IGYNCHLIFRTDLYRRT

SEQ ID NO: 111223 - protein, 17 aa, Mycobacterium avium
IHFQEWWVRYRAQVPTH

SEQ ID NO: 111224 - protein, 17 aa, Mycobacterium avium
IHRLAAGVSLDWELLAQ

SEQ ID NO: 111225 - protein, 17 aa, Mycobacterium avium
IICPPLFLQYAILGVSR

SEQ ID NO: 111226 - protein, 18 aa, Mycobacterium avium
IIEAKGYCYGWHFYQAGD

SEQ ID NO: 111227 - protein, 21 aa, Mycobacterium avium
IKDLVIPPAWKKVWISPHPNG

SEQ ID NO: 111228 - protein, 22 aa, Mycobacterium avium
IKDLVIPPAWKKVWISPHPNGH

SEQ ID NO: 111229 - protein, 21 aa, Mycobacterium avium
IKLDVRLSYALRIKDEAGLVV

SEQ ID NO: 111230 - protein, 21 aa, Mycobacterium avium
IKLDVRLSYALRIKDEGGLVV

SEQ ID NO: 111231 - protein, 17 aa, Mycobacterium avium
IKNAIDWLSRPFGDGAL

SEQ ID NO: 111232 - protein, 17 aa, Mycobacterium avium
ILAAYALLRDPARRADY

SEQ ID NO: 111233 - protein, 17 aa, Mycobacterium avium
ILKPVCFVFDFAPTRAL

SEQ ID NO: 111234 - protein, 19 aa, Mycobacterium avium
ILNHGLTLWDLDRVFKVNG

SEQ ID NO: 111235 - protein, 17 aa, Mycobacterium avium
ILRRAGLVTARREGLSV

SEQ ID NO: 111236 - protein, 20 aa, Mycobacterium avium
ILRYASPVIHFRRTVTRDGV

SEQ ID NO: 111237 - protein, 18 aa, Mycobacterium avium
ILSEAGWYSALFGMQHET

SEQ ID NO: 111238 - protein, 26 aa, Mycobacterium avium
INMVSAIPGPIGWVGIAASTAWEAFD

SEQ ID NO: 111239 - protein, 21 aa, Mycobacterium avium
INSGFTRRRVSVLEPKIRKIV

SEQ ID NO: 111240 - protein, 23 aa, Mycobacterium avium
INYLRCIGCGFCIEACPTRALTM

SEQ ID NO: 111241 - protein, 18 aa, Mycobacterium avium
IPEALAFRESLAGWAHDD

SEQ ID NO: 111242 - protein, 19 aa, Mycobacterium avium
IPEALPIVYTPTVGEACQR

SEQ ID NO: 111243 - protein, 23 aa, Mycobacterium avium
IPEKHLPLVMPLRYIGIDENTLN

SEQ ID NO: 111244 - protein, 18 aa, Mycobacterium avium
IPGLLAWRIDLRATVATR

SEQ ID NO: 111245 - protein, 17 aa, Mycobacterium avium
IPKAGGVEAILRLDEGP

SEQ ID NO: 111246 - protein, 20 aa, Mycobacterium avium
IPKLRTGSFFPALLERRRRV

SEQ ID NO: 111247 - protein, 20 aa, Mycobacterium avium
IPKPVFRRLLSVVTGGAATV

SEQ ID NO: 111248 - protein, 18 aa, Mycobacterium avium
IPKRVFRRLLGVVTGGAT

SEQ ID NO: 111249 - protein, 17 aa, Mycobacterium avium
IPLDFRILDTILGAQTT

SEQ ID NO: 111250 - protein, 18 aa, Mycobacterium avium
IPLRVKAAAVGLAADEYH

SEQ ID NO: 111251 - protein, 22 aa, Mycobacterium avium
IPLYYDWLFGMVVSGANCPPTR

SEQ ID NO: 111252 - protein, 23 aa, Mycobacterium avium
IQLYYRRVRGWAMVFGEPAVALD

SEQ ID NO: 111253 - protein, 18 aa, Mycobacterium avium
IQRRRARIYCPRWVALFR

SEQ ID NO: 111254 - protein, 17 aa, Mycobacterium avium
IRAGRQLWCQLFSEPGA

SEQ ID NO: 111255 - protein, 18 aa, Mycobacterium avium
IRHAVAWAGPGDVVLVAG

SEQ ID NO: 111256 - protein, 18 aa, Mycobacterium avium
IRLGFSWLLPDPWAQDTV

SEQ ID NO: 111257 - protein, 17 aa, Mycobacterium avium
IRLLAAFDHRHIFLDPN

SEQ ID NO: 111258 - protein, 24 aa, Mycobacterium avium
IRPGNWAGAYACWGTENREAAVRF

SEQ ID NO: 111259 - protein, 20 aa, Mycobacterium avium
IRPRVEVELAFVLGDELRGP

SEQ ID NO: 111260 - protein, 18 aa, Mycobacterium avium
IRRGPRSRFAGVAFQAAD

SEQ ID NO: 111261 - protein, 24 aa, Mycobacterium avium
IRRKLRLADVLAYREELHARRNRF

SEQ ID NO: 111262 - protein, 21 aa, Mycobacterium avium
IRSATEWFARMLFSLFTTPSP

SEQ ID NO: 111263 - protein, 27 aa, Mycobacterium avium
IRTGQEFSWRAEELFVAIAAGDITVEV

SEQ ID NO: 111264 - protein, 18 aa, Mycobacterium avium
IRTLFGVMFQDGALFGSM

SEQ ID NO: 111265 - protein, 21 aa, Mycobacterium avium
IRVPGFITWPGFARQGQIGTA

SEQ ID NO: 111266 - protein, 18 aa, Mycobacterium avium
IRWTTWQAAWLVAHGRPA

SEQ ID NO: 111267 - protein, 20 aa, Mycobacterium avium
ISDLRIKLGPVRLGAASDLP

SEQ ID NO: 111268 - protein, 18 aa, Mycobacterium avium
ISGGLGVRFARPGETVVT

SEQ ID NO: 111269 - protein, 17 aa, Mycobacterium avium
ITARYAQHWNFVGGPPD

SEQ ID NO: 111270 - protein, 21 aa, Mycobacterium avium
ITKRLSAPVGIRADCLGVQDP

SEQ ID NO: 111271 - protein, 19 aa, Mycobacterium avium
ITLPMPARWTQVPDPNVPD

SEQ ID NO: 111272 - protein, 17 aa, Mycobacterium avium
ITYNEWSFAVGKQLSMA

SEQ ID NO: 111273 - protein, 19 aa, Mycobacterium avium
IVAGIPVCLCAPSQVDEAK

SEQ ID NO: 111274 - protein, 23 aa, Mycobacterium avium
IVDEPFLLPAHIDLAALRVKFDG

SEQ ID NO: 111275 - protein, 20 aa, Mycobacterium avium
IVGLLLRLQRQLGLTYLFVS

SEQ ID NO: 111276 - protein, 24 aa, Mycobacterium avium
IVKAEYKAGTALGEKLAGKIAGEG

SEQ ID NO: 111277 - protein, 17 aa, Mycobacterium avium
IWLLGAIGPRMVYSTNL

SEQ ID NO: 111278 - protein, 23 aa, Mycobacterium avium
IWMYLKELEFRQGFIDIPVNGVL

SEQ ID NO: 111279 - protein, 18 aa, Mycobacterium avium
IWRNRWITRDGIVECREA

SEQ ID NO: 111280 - protein, 23 aa, Mycobacterium avium
IYAMWRINELLNWQVAAAGEDIN

SEQ ID NO: 111281 - protein, 19 aa, Mycobacterium avium
KAADMIPVYAANVGQNLSL

SEQ ID NO: 111282 - protein, 19 aa, Mycobacterium avium
KAAGCGADLVFLDLEDAVP

SEQ ID NO: 111283 - protein, 18 aa, Mycobacterium avium
KAALWELVWAGWITGDTF

SEQ ID NO: 111284 - protein, 18 aa, Mycobacterium avium
KAAVRLGSDMGEFFMPYP

SEQ ID NO: 111285 - protein, 20 aa, Mycobacterium avium
KAGVIGLTIAAARDLSSAGI

SEQ ID NO: 111286 - protein, 20 aa, Mycobacterium avium
KAGVIGLTIAAARDLSSVGI

SEQ ID NO: 111287 - protein, 20 aa, Mycobacterium avium
KALRPDFLFFSRRADGTIAA

SEQ ID NO: 111288 - protein, 17 aa, Mycobacterium avium
KAPLVPSMLEWLHTART

SEQ ID NO: 111289 - protein, 19 aa, Mycobacterium avium
KAQRGPLCVGIDPHPELLR

SEQ ID NO: 111290 - protein, 25 aa, Mycobacterium avium
KASVMTHLRWLKALAAFGGIGLRLK

SEQ ID NO: 111291 - protein, 21 aa, Mycobacterium avium
KAVREVEAWLAAEPFRAPEAD

SEQ ID NO: 111292 - protein, 18 aa, Mycobacterium avium
KAWVPRLAAMDVIASYCL

SEQ ID NO: 111293 - protein, 19 aa, Mycobacterium avium
KCADMLVDLEWARSASQAA

SEQ ID NO: 111294 - protein, 18 aa, Mycobacterium avium
KCYGVRPGAVIGHSLGEC

SEQ ID NO: 111295 - protein, 23 aa, Mycobacterium avium
KCYSLRIASKMARDEGWLAEHML

SEQ ID NO: 111296 - protein, 20 aa, Mycobacterium avium
KDAGMAAALWALSEQLTKTE

SEQ ID NO: 111297 - protein, 21 aa, Mycobacterium avium
KDAMIDWWGPILVEYYGATEQ

SEQ ID NO: 111298 - protein, 22 aa, Mycobacterium avium
KDFWLQVGIDPIRIITGSGTFY

SEQ ID NO: 111299 - protein, 21 aa, Mycobacterium avium
KDFWLQVGIDPIRIITSSGTF

SEQ ID NO: 111300 - protein, 17 aa, Mycobacterium avium
KDLRTWHGTVLAAAAFA

SEQ ID NO: 111301 - protein, 20 aa, Mycobacterium avium
KDLVIPPAWKKVWISPHPNG

SEQ ID NO: 111302 - protein, 24 aa, Mycobacterium avium
KDRPDVVHAYGWLGGLAAQLAARR

SEQ ID NO: 111303 - protein, 20 aa, Mycobacterium avium
KEIAGRLAARIGSGLLVDVV

SEQ ID NO: 111304 - protein, 23 aa, Mycobacterium avium
KEPRITALPGLWFEAARRVGFDV

SEQ ID NO: 111305 - protein, 21 aa, Mycobacterium avium
KEPYSVVGLIFPWNGPIFNAN

SEQ ID NO: 111306 - protein, 22 aa, Mycobacterium avium
KEWLKPTAYMMAKFGMTLCALG

SEQ ID NO: 111307 - protein, 17 aa, Mycobacterium avium
KGGKFPTARLVVFKLSG

SEQ ID NO: 111308 - protein, 19 aa, Mycobacterium avium
KGGKFPTARLVVFKLSGDF

SEQ ID NO: 111309 - protein, 22 aa, Mycobacterium avium
KGKRYALPHARILMHQPLGGVT

SEQ ID NO: 111310 - protein, 17 aa, Mycobacterium avium
KGTGAFGRFEVTNDLSA

SEQ ID NO: 111311 - protein, 18 aa, Mycobacterium avium
KGWVPRLAAMDVIASYCL

SEQ ID NO: 111312 - protein, 25 aa, Mycobacterium avium
KIAASWRLPVVFVVQNVRGGPDARR

SEQ ID NO: 111313 - protein, 24 aa, Mycobacterium avium
KILGRPALPFAHWVATHRDLFDRR

SEQ ID NO: 111314 - protein, 18 aa, Mycobacterium avium
KILGRPAVPFAHWVATHR

SEQ ID NO: 111315 - protein, 20 aa, Mycobacterium avium
KILGRPAVPFAHWVATHRDL

SEQ ID NO: 111316 - protein, 28 aa, Mycobacterium avium
KILRCPLRFPHDLPRPEGHAGQLARVRA

SEQ ID NO: 111317 - protein, 18 aa, Mycobacterium avium
KKHMAFGVGMHRCLGSHY

SEQ ID NO: 111318 - protein, 17 aa, Mycobacterium avium
KLAELLALWDRYVEETG

SEQ ID NO: 111319 - protein, 17 aa, Mycobacterium avium
KLAGFKIPQYWYSVTEL

SEQ ID NO: 111320 - protein, 24 aa, Mycobacterium avium
KLAPRPSSTIAYWDVALDGGLVGI

SEQ ID NO: 111321 - protein, 19 aa, Mycobacterium avium
KLGFPVPIRHWLRAGELQD

SEQ ID NO: 111322 - protein, 17 aa, Mycobacterium avium
KLIELLLGEPGRRDVGR

SEQ ID NO: 111323 - protein, 23 aa, Mycobacterium avium
KLKEAICRGTLWAIRREAAKPGS

SEQ ID NO: 111324 - protein, 18 aa, Mycobacterium avium
KLMGRWRSGAPLVLAPDE

SEQ ID NO: 111325 - protein, 18 aa, Mycobacterium avium
KLRTGSCFPALLERRRRV

SEQ ID NO: 111326 - protein, 25 aa, Mycobacterium avium
KMRYKWRKWLYFDCNWKVALEAFNE

SEQ ID NO: 111327 - protein, 17 aa, Mycobacterium avium
KNPNAWRRKPMSEEAIL

SEQ ID NO: 111328 - protein, 19 aa, Mycobacterium avium
KNRRLAAVGPIWALGSLRA

SEQ ID NO: 111329 - protein, 17 aa, Mycobacterium avium
KPAQVALAWLISYPGVV

SEQ ID NO: 111330 - protein, 20 aa, Mycobacterium avium
KPAQVALAWLISYPGVVAIP

SEQ ID NO: 111331 - protein, 17 aa, Mycobacterium avium
KPSYGIAEATLFVATIA

SEQ ID NO: 111332 - protein, 20 aa, Mycobacterium avium
KPVCFVFDFAPTRALRQLAE

SEQ ID NO: 111333 - protein, 20 aa, Mycobacterium avium
KQEMNAAGFVAWWRNPSRTA

SEQ ID NO: 111334 - protein, 19 aa, Mycobacterium avium
KQMWKGCREVLAATSARLD

SEQ ID NO: 111335 - protein, 17 aa, Mycobacterium avium
KQRSRLALWARRLLGEA

SEQ ID NO: 111336 - protein, 21 aa, Mycobacterium avium
KRALAKWAFGVGRARARAVSD

SEQ ID NO: 111337 - protein, 17 aa, Mycobacterium avium
KRGKISLVLVEEDNSAP

SEQ ID NO: 111338 - protein, 18 aa, Mycobacterium avium
KRGPWPWLQPNRNDAPPV

SEQ ID NO: 111339 - protein, 20 aa, Mycobacterium avium
KRIVPVCSMIGTVLKKHPEF

SEQ ID NO: 111340 - protein, 18 aa, Mycobacterium avium
KRLDPGFFYAPTLLTNVD

SEQ ID NO: 111341 - protein, 19 aa, Mycobacterium avium
KRLDPGFFYAPTLLTNVDP

SEQ ID NO: 111342 - protein, 20 aa, Mycobacterium avium
KRLETVLPFSWQGVSLHAAG

SEQ ID NO: 111343 - protein, 20 aa, Mycobacterium avium
KRLVDFAAGLAFALRGSFDK

SEQ ID NO: 111344 - protein, 17 aa, Mycobacterium avium
KRMFGGLAFLLNGNMSV

SEQ ID NO: 111345 - protein, 27 aa, Mycobacterium avium
KSGASYAYFGVGIFKNGLLYDTDVICL

SEQ ID NO: 111346 - protein, 17 aa, Mycobacterium avium
KTFPLPNPFLVMATQNP

SEQ ID NO: 111347 - protein, 22 aa, Mycobacterium avium
KTGKLRPALFVLPTDAPGFSAT

SEQ ID NO: 111348 - protein, 18 aa, Mycobacterium avium
KTHCKTCLVVRREGSAIR

SEQ ID NO: 111349 - protein, 31 aa, Mycobacterium avium
KTLRPADRWWRLIADHGWRPTHMIQDGPGLT

SEQ ID NO: 111350 - protein, 18 aa, Mycobacterium avium
KTTFGRIGVKVWIYKGDV

SEQ ID NO: 111351 - protein, 22 aa, Mycobacterium avium
KVAELPAGHGLNAEKLGYGDLI

SEQ ID NO: 111352 - protein, 18 aa, Mycobacterium avium
KVGVEFDGAQHWTDPAQR

SEQ ID NO: 111353 - protein, 19 aa, Mycobacterium avium
KVHACLFDLDGVLTDTASV

SEQ ID NO: 111354 - protein, 18 aa, Mycobacterium avium
KVVICLVNGWAAGGGHSL

SEQ ID NO: 111355 - protein, 25 aa, Mycobacterium avium
KYPVALRMGRRLDWARVVAGEAALG

SEQ ID NO: 111356 - protein, 21 aa, Mycobacterium avium
KYPVALRMSRRLDWARVVAGE

SEQ ID NO: 111357 - protein, 18 aa, Mycobacterium avium
KYTLWRLQERVVGRGPNA

SEQ ID NO: 111358 - protein, 18 aa, Mycobacterium avium
KYTLWRLQERVVGRGPNS

SEQ ID NO: 111359 - protein, 17 aa, Mycobacterium avium
LAAASGKTLGPRYGVIP

SEQ ID NO: 111360 - protein, 18 aa, Mycobacterium avium
LAAELARKGVAPETPVAI

SEQ ID NO: 111361 - protein, 17 aa, Mycobacterium avium
LAAHIAFDPDDITGAIA

SEQ ID NO: 111362 - protein, 26 aa, Mycobacterium avium
LAALCDIFYPRVFLRRGGFVPSGTIS

SEQ ID NO: 111363 - protein, 19 aa, Mycobacterium avium
LAALPARIAVRWRHIHEFE

SEQ ID NO: 111364 - protein, 17 aa, Mycobacterium avium
LAAPEELDRLAVAASSP

SEQ ID NO: 111365 - protein, 19 aa, Mycobacterium avium
LAARLALAHALGWQGRGRE

SEQ ID NO: 111366 - protein, 20 aa, Mycobacterium avium
LACARLGVMHSVVFAGFTAK

SEQ ID NO: 111367 - protein, 17 aa, Mycobacterium avium
LADCRKLGITVLPPDVN

SEQ ID NO: 111368 - protein, 18 aa, Mycobacterium avium
LADCRKLGITVLPPDVNE

SEQ ID NO: 111369 - protein, 19 aa, Mycobacterium avium
LAEKLWKLRILADERSASD

SEQ ID NO: 111370 - protein, 18 aa, Mycobacterium avium
LAELGGRFWFSLDDGRAD

SEQ ID NO: 111371 - protein, 18 aa, Mycobacterium avium
LAEWGCSANERLIHVDGP

SEQ ID NO: 111372 - protein, 20 aa, Mycobacterium avium
LAFERQWWKFAGVKEDAIKE

SEQ ID NO: 111373 - protein, 17 aa, Mycobacterium avium
LAGASAWWRYTPGATSA

SEQ ID NO: 111374 - protein, 26 aa, Mycobacterium avium
LAGHALKASIAWRALRALLLSRRGDY

SEQ ID NO: 111375 - protein, 25 aa, Mycobacterium avium
LAGHALKASIAWRTLRALLLSRRGD

SEQ ID NO: 111376 - protein, 26 aa, Mycobacterium avium
LAGLRRGEICGLEWADVQLDDDRDAG

SEQ ID NO: 111377 - protein, 17 aa, Mycobacterium avium
LAGRLDLPAGWSYQPRV

SEQ ID NO: 111378 - protein, 17 aa, Mycobacterium avium
LAHALGWQGRGREADAL

SEQ ID NO: 111379 - protein, 19 aa, Mycobacterium avium
LAHLRAFVLIPWLAVDPDA

SEQ ID NO: 111380 - protein, 19 aa, Mycobacterium avium
LAKACARIMLGATISQLRA

SEQ ID NO: 111381 - protein, 18 aa, Mycobacterium avium
LAKKLGLQRQWLHARSLS

SEQ ID NO: 111382 - protein, 19 aa, Mycobacterium avium
LAKRLPEYMVPAAVVVLET

SEQ ID NO: 111383 - protein, 21 aa, Mycobacterium avium
LALACVRAWNDWHFEVWAGSY

SEQ ID NO: 111384 - protein, 23 aa, Mycobacterium avium
LALNRRSPIFGGWVTGPTLLGPE

SEQ ID NO: 111385 - protein, 17 aa, Mycobacterium avium
LALRYRLRHGVGMAGLR

SEQ ID NO: 111386 - protein, 24 aa, Mycobacterium avium
LAMASAFAPYMAWMAGAAGRAAET

SEQ ID NO: 111387 - protein, 21 aa, Mycobacterium avium
LAMGHAMIRAGLPPKLHDKKP

SEQ ID NO: 111388 - protein, 17 aa, Mycobacterium avium
LAMPRLDMVTGLYYLTT

SEQ ID NO: 111389 - protein, 18 aa, Mycobacterium avium
LAMPRLDMVTGLYYLTTE

SEQ ID NO: 111390 - protein, 20 aa, Mycobacterium avium
LANRARLLVLIATNFFGQNT

SEQ ID NO: 111391 - protein, 18 aa, Mycobacterium avium
LAPENAWPAAAEDVYAVT

SEQ ID NO: 111392 - protein, 17 aa, Mycobacterium avium
LAPNFKDIVIRHITFAP

SEQ ID NO: 111393 - protein, 18 aa, Mycobacterium avium
LAQLRLGLMHGRLSAEEK

SEQ ID NO: 111394 - protein, 17 aa, Mycobacterium avium
LARDRWAVPLVHTAHTL

SEQ ID NO: 111395 - protein, 23 aa, Mycobacterium avium
LARHVLCFRTLWEATHTELMKQG

SEQ ID NO: 111396 - protein, 17 aa, Mycobacterium avium
LARWVRRAGPRIVEPSC

SEQ ID NO: 111397 - protein, 23 aa, Mycobacterium avium
LASMCFPSFPGFAGRLFATHPDK

SEQ ID NO: 111398 - protein, 23 aa, Mycobacterium avium
LASRAGLPVDEFLATVQRFNGFA

SEQ ID NO: 111399 - protein, 17 aa, Mycobacterium avium
LASRIFTDFTYRSGSTT

SEQ ID NO: 111400 - protein, 18 aa, Mycobacterium avium
LAVEVFEAAFAMTVPPPA

SEQ ID NO: 111401 - protein, 19 aa, Mycobacterium avium
LAWLLRLFGFDVWWSNDAD

SEQ ID NO: 111402 - protein, 20 aa, Mycobacterium avium
LCGALRRYHEVFGVPISTLP

SEQ ID NO: 111403 - protein, 21 aa, Mycobacterium avium
LCILDERWPFSYLQVYADAAL

SEQ ID NO: 111404 - protein, 21 aa, Mycobacterium avium
LCSRFSRRLGITVASVDYRLA

SEQ ID NO: 111405 - protein, 17 aa, Mycobacterium avium
LCVIPFDDEEDAIRIAN

SEQ ID NO: 111406 - protein, 19 aa, Mycobacterium avium
LDAFTHWRRAQGLPATAIA

SEQ ID NO: 111407 - protein, 19 aa, Mycobacterium avium
LDALGYRGFWMGYFAARSA

SEQ ID NO: 111408 - protein, 23 aa, Mycobacterium avium
LDCLFPGLWPSFWGVNEDPLPDG

SEQ ID NO: 111409 - protein, 22 aa, Mycobacterium avium
LDEAWWFPAIQWPDGRMQFMLN

SEQ ID NO: 111410 - protein, 18 aa, Mycobacterium avium
LDEEFVWYGRIPRAKLAD

SEQ ID NO: 111411 - protein, 18 aa, Mycobacterium avium
LDEEFVWYGRIPRAKLAK

SEQ ID NO: 111412 - protein, 18 aa, Mycobacterium avium
LDEGRIVLVAGFQGVSQD

SEQ ID NO: 111413 - protein, 17 aa, Mycobacterium avium
LDEYVDWLIDAGYPIER

SEQ ID NO: 111414 - protein, 18 aa, Mycobacterium avium
LDEYVDWLIEAGYLIERV

SEQ ID NO: 111415 - protein, 18 aa, Mycobacterium avium
LDEYVDWLIEAGYPIERV

SEQ ID NO: 111416 - protein, 18 aa, Mycobacterium avium
LDFCRELGADITINYRDE

SEQ ID NO: 111417 - protein, 17 aa, Mycobacterium avium
LDGGRWGAAPLRPRERA

SEQ ID NO: 111418 - protein, 17 aa, Mycobacterium avium
LDLGIDWKTYRDAIDGL

SEQ ID NO: 111419 - protein, 18 aa, Mycobacterium avium
LDLTRSWARLDVDVSVLD

SEQ ID NO: 111420 - protein, 23 aa, Mycobacterium avium
LDMRPNPGIGFPGYVDYLPVTRG

SEQ ID NO: 111421 - protein, 20 aa, Mycobacterium avium
LDRRSRLGGWGLMSNAAHPG

SEQ ID NO: 111422 - protein, 24 aa, Mycobacterium avium
LDSRAWRLAWPAGCVVYEIDQPKV

SEQ ID NO: 111423 - protein, 18 aa, Mycobacterium avium
LDVDLRWVAALLLRNGVI

SEQ ID NO: 111424 - protein, 19 aa, Mycobacterium avium
LDWFCLFSSAAALVGSPGQ

SEQ ID NO: 111425 - protein, 19 aa, Mycobacterium avium
LDWKFLRWVWRYPIDSRPL

SEQ ID NO: 111426 - protein, 22 aa, Mycobacterium avium
LDWQSVWDRGWTLAAAAEDKPV

SEQ ID NO: 111427 - protein, 19 aa, Mycobacterium avium
LEIGRAHTPWFHWGTTAVV

SEQ ID NO: 111428 - protein, 17 aa, Mycobacterium avium
LEKPSLGLGNWVVPTLL

SEQ ID NO: 111429 - protein, 20 aa, Mycobacterium avium
LELYDPFSFEIIRQLEAFGF

SEQ ID NO: 111430 - protein, 18 aa, Mycobacterium avium
LEPARAAFDWSRRTQRPD

SEQ ID NO: 111431 - protein, 19 aa, Mycobacterium avium
LETLAAYWGVTQQRPHDAF

SEQ ID NO: 111432 - protein, 21 aa, Mycobacterium avium
LEVEEVYLPLARLIHLQVAAR

SEQ ID NO: 111433 - protein, 17 aa, Mycobacterium avium
LEWITGTALVPVRDRLD

SEQ ID NO: 111434 - protein, 17 aa, Mycobacterium avium
LFDWPTHILEILTTAPQ

SEQ ID NO: 111435 - protein, 18 aa, Mycobacterium avium
LFGMFAFAIVERDSGRVL

SEQ ID NO: 111436 - protein, 18 aa, Mycobacterium avium
LFKQLLMVAGMERYYQIA

SEQ ID NO: 111437 - protein, 27 aa, Mycobacterium avium
LFTWHLPELWRRFTITLRRALRRHLKA

SEQ ID NO: 111438 - protein, 22 aa, Mycobacterium avium
LFYRVKSSVLLYVGALGVPQTE

SEQ ID NO: 111439 - protein, 17 aa, Mycobacterium avium
LGCFRRPPFRLIRPVRV

SEQ ID NO: 111440 - protein, 17 aa, Mycobacterium avium
LGDKFPLKAGMVTSLGF

SEQ ID NO: 111441 - protein, 19 aa, Mycobacterium avium
LGEAILLPGLMDMEVNLLM

SEQ ID NO: 111442 - protein, 17 aa, Mycobacterium avium
LGESLGLIDMARGAKVS

SEQ ID NO: 111443 - protein, 19 aa, Mycobacterium avium
LGGPGSWLLALPAHHIAGV

SEQ ID NO: 111444 - protein, 18 aa, Mycobacterium avium
LGGTYQRGGKTRVIAQKT

SEQ ID NO: 111445 - protein, 17 aa, Mycobacterium avium
LGILCDLYALSVIEDDK

SEQ ID NO: 111446 - protein, 18 aa, Mycobacterium avium
LGILCDLYALSVIEDDKA

SEQ ID NO: 111447 - protein, 17 aa, Mycobacterium avium
LGPAFTAEAAWRHEVAR

SEQ ID NO: 111448 - protein, 17 aa, Mycobacterium avium
LGPLLAHHPGQRVDDVG

SEQ ID NO: 111449 - protein, 19 aa, Mycobacterium avium
LGRLLIKLAATFIPLREEG

SEQ ID NO: 111450 - protein, 25 aa, Mycobacterium avium
LGRYGVCANAICPRARTAMTADVFG

SEQ ID NO: 111451 - protein, 17 aa, Mycobacterium avium
LGWRPRIALKDGIDATV

SEQ ID NO: 111452 - protein, 18 aa, Mycobacterium avium
LHANWRWARSVLTDEQLN

SEQ ID NO: 111453 - protein, 19 aa, Mycobacterium avium
LHHPCCGDLVYGADPKLAK

SEQ ID NO: 111454 - protein, 17 aa, Mycobacterium avium
LHLCQLAIPAMRERGRG

SEQ ID NO: 111455 - protein, 18 aa, Mycobacterium avium
LHLCQLAIPAMRERGRGW

SEQ ID NO: 111456 - protein, 18 aa, Mycobacterium avium
LHLHRILLQRSWIAIFWS

SEQ ID NO: 111457 - protein, 22 aa, Mycobacterium avium
LHLYRCREVCAAVDVARADILL

SEQ ID NO: 111458 - protein, 17 aa, Mycobacterium avium
LHPVAGCTAHWAFVRSA

SEQ ID NO: 111459 - protein, 18 aa, Mycobacterium avium
LIAPHWPKPWGLDAGPLR

SEQ ID NO: 111460 - protein, 20 aa, Mycobacterium avium
LIGFPFFRGYGGRKLDLTLG

SEQ ID NO: 111461 - protein, 17 aa, Mycobacterium avium
LILADAIVRACEDNPDY

SEQ ID NO: 111462 - protein, 18 aa, Mycobacterium avium
LILADAIVRACEDNPDYL

SEQ ID NO: 111463 - protein, 17 aa, Mycobacterium avium
LINYFIAWQTYRIINWT

SEQ ID NO: 111464 - protein, 20 aa, Mycobacterium avium
LIPFIPRWLVRRGESLAMAS

SEQ ID NO: 111465 - protein, 21 aa, Mycobacterium avium
LISPWGTWDWMGPAAVGAVLP

SEQ ID NO: 111466 - protein, 20 aa, Mycobacterium avium
LKAALWELVWAGWITGDTFA

SEQ ID NO: 111467 - protein, 17 aa, Mycobacterium avium
LKAKILPIIAGTLFPNA

SEQ ID NO: 111468 - protein, 21 aa, Mycobacterium avium
LKGKLLGLPVCRLLGMAHDSV

SEQ ID NO: 111469 - protein, 22 aa, Mycobacterium avium
LKGKLLGLPVCRLLGMAHDSVP

SEQ ID NO: 111470 - protein, 20 aa, Mycobacterium avium
LKICLSEGGIGWVAGLLDRL

SEQ ID NO: 111471 - protein, 19 aa, Mycobacterium avium
LKLSALRVLFSAVVEGPVT

SEQ ID NO: 111472 - protein, 17 aa, Mycobacterium avium
LKPFTPRYFEAIPGVWA

SEQ ID NO: 111473 - protein, 19 aa, Mycobacterium avium
LKRPIPFLPNMIGLITGRA

SEQ ID NO: 111474 - protein, 18 aa, Mycobacterium avium
LKTADEWRAAAFTSAEDG

SEQ ID NO: 111475 - protein, 18 aa, Mycobacterium avium
LKTFWGWRDRQLPDGTVI

SEQ ID NO: 111476 - protein, 18 aa, Mycobacterium avium
LKTLPAHRPWAATLTTDE

SEQ ID NO: 111477 - protein, 17 aa, Mycobacterium avium
LKTSYAWAAARYGGDDP

SEQ ID NO: 111478 - protein, 17 aa, Mycobacterium avium
LKVAFDWKSRHNERRGV

SEQ ID NO: 111479 - protein, 19 aa, Mycobacterium avium
LKVAVLLGAFAGLRVAEVS

SEQ ID NO: 111480 - protein, 17 aa, Mycobacterium avium
LKVGTARRFSATTSETL

SEQ ID NO: 111481 - protein, 18 aa, Mycobacterium avium
LKVGTARRFSATTSETLA

SEQ ID NO: 111482 - protein, 18 aa, Mycobacterium avium
LKWWTSEVQWEIIDRCLQ

SEQ ID NO: 111483 - protein, 18 aa, Mycobacterium avium
LLAALGFSAEPVRVDDAG

SEQ ID NO: 111484 - protein, 17 aa, Mycobacterium avium
LLAALGFSAEPVRVDDD

SEQ ID NO: 111485 - protein, 18 aa, Mycobacterium avium
LLAALGFSAEPVRVDDDG

SEQ ID NO: 111486 - protein, 22 aa, Mycobacterium avium
LLAAWCALRFGELTELRRRDII

SEQ ID NO: 111487 - protein, 17 aa, Mycobacterium avium
LLAEGIEGRCRIIGPID

SEQ ID NO: 111488 - protein, 17 aa, Mycobacterium avium
LLAGFPFPHLLQVAVRL

SEQ ID NO: 111489 - protein, 18 aa, Mycobacterium avium
LLAHDWGSIQAWAAVTDK

SEQ ID NO: 111490 - protein, 18 aa, Mycobacterium avium
LLAMLAYRGFVRQDPVSK

SEQ ID NO: 111491 - protein, 17 aa, Mycobacterium avium
LLCREARDGVQKLHGNR

SEQ ID NO: 111492 - protein, 17 aa, Mycobacterium avium
LLDHIPEALPIVYTPTV

SEQ ID NO: 111493 - protein, 17 aa, Mycobacterium avium
LLEDAFIVAETLRGEAV

SEQ ID NO: 111494 - protein, 19 aa, Mycobacterium avium
LLERCWAPKVVGAWNLHRV

SEQ ID NO: 111495 - protein, 17 aa, Mycobacterium avium
LLGCASGALGLRKFFED

SEQ ID NO: 111496 - protein, 17 aa, Mycobacterium avium
LLGCGFITGWGSAVYAA

SEQ ID NO: 111497 - protein, 17 aa, Mycobacterium avium
LLGCGFITGWGSSVYAA

SEQ ID NO: 111498 - protein, 23 aa, Mycobacterium avium
LLGFSIKRAVTWSEEAGNTRPRY

SEQ ID NO: 111499 - protein, 17 aa, Mycobacterium avium
LLIALSLFDMVGIGIQV

SEQ ID NO: 111500 - protein, 29 aa, Mycobacterium avium
LLIVVAGYCGLRWGELAALRWADVDLANK

SEQ ID NO: 111501 - protein, 19 aa, Mycobacterium avium
LLKTFWGWRDRQLPDGTVI

SEQ ID NO: 111502 - protein, 18 aa, Mycobacterium avium
LLLAEGIEGRCRIIGPID

SEQ ID NO: 111503 - protein, 19 aa, Mycobacterium avium
LLLAEGIEGRCRIIGPIDD

SEQ ID NO: 111504 - protein, 21 aa, Mycobacterium avium
LLLEVVCARLLLPSASDTEAA

SEQ ID NO: 111505 - protein, 22 aa, Mycobacterium avium
LLLEVVCARLLLPSASDTESAL

SEQ ID NO: 111506 - protein, 22 aa, Mycobacterium avium
LLLEVVCARLLLPSASDTETAL

SEQ ID NO: 111507 - protein, 17 aa, Mycobacterium avium
LLLPLGVRRIRAYASAR

SEQ ID NO: 111508 - protein, 22 aa, Mycobacterium avium
LLPNLVTVLGWRSCDHTGPVHE

SEQ ID NO: 111509 - protein, 18 aa, Mycobacterium avium
LLRARPGTRLVVAGVCMQ

SEQ ID NO: 111510 - protein, 17 aa, Mycobacterium avium
LLRCPRCHSHFDVVHAG

SEQ ID NO: 111511 - protein, 20 aa, Mycobacterium avium
LLRRSGVIFIRRNIGNDQLY

SEQ ID NO: 111512 - protein, 19 aa, Mycobacterium avium
LLSRFGAVRVVRPVEWTRS

SEQ ID NO: 111513 - protein, 19 aa, Mycobacterium avium
LLTGWRDAWELGRTARDDA

SEQ ID NO: 111514 - protein, 21 aa, Mycobacterium avium
LLTGWRDAWELGRTVRDDALA

SEQ ID NO: 111515 - protein, 21 aa, Mycobacterium avium
LLVFGRRAGLGAADYVRALSS

SEQ ID NO: 111516 - protein, 18 aa, Mycobacterium avium
LLVLRRARVLGIAGPGNA

SEQ ID NO: 111517 - protein, 19 aa, Mycobacterium avium
LLVNFPLSQWLKFAPPIGY

SEQ ID NO: 111518 - protein, 20 aa, Mycobacterium avium
LLVRGGVVFTGYWRNEQATA

SEQ ID NO: 111519 - protein, 19 aa, Mycobacterium avium
LLWPNSVRTYTRMWREDSR

SEQ ID NO: 111520 - protein, 18 aa, Mycobacterium avium
LMLIWACDLIVAADNAKF

SEQ ID NO: 111521 - protein, 18 aa, Mycobacterium avium
LMLIWACDLIVGSEEVRF

SEQ ID NO: 111522 - protein, 18 aa, Mycobacterium avium
LMSEVMVRAVLVRIPDYQ

SEQ ID NO: 111523 - protein, 23 aa, Mycobacterium avium
LMVKAGVQWGLFGGAVENLGTER

SEQ ID NO: 111524 - protein, 25 aa, Mycobacterium avium
LNEEFPRLIVYRGPRRKGVRYFGPY

SEQ ID NO: 111525 - protein, 23 aa, Mycobacterium avium
LNEFSLRVLHSFLTDPGRPPRTG

SEQ ID NO: 111526 - protein, 17 aa, Mycobacterium avium
LNGRSGYRFGHIEGPMQ

SEQ ID NO: 111527 - protein, 18 aa, Mycobacterium avium
LNLDPRWVGAHVGHTVGK

SEQ ID NO: 111528 - protein, 23 aa, Mycobacterium avium
LNLPGVAFGHDWLTGTARYANLL

SEQ ID NO: 111529 - protein, 18 aa, Mycobacterium avium
LNMMAHLLSTIPYHAVEA

SEQ ID NO: 111530 - protein, 18 aa, Mycobacterium avium
LNPAAGVMLSALWVGSTG

SEQ ID NO: 111531 - protein, 18 aa, Mycobacterium avium
LNPQVWPRYCERFHDILG

SEQ ID NO: 111532 - protein, 25 aa, Mycobacterium avium
LNWWESRALYGWTVLVPRTKDQAGE

SEQ ID NO: 111533 - protein, 26 aa, Mycobacterium avium
LNWWESRALYGWTVLVPRTKDQAGEM

SEQ ID NO: 111534 - protein, 24 aa, Mycobacterium avium
LPAGSMLVPFSWQRVSLHAAGAAA

SEQ ID NO: 111535 - protein, 24 aa, Mycobacterium avium
LPAKAADSLTEWMLGYVRFHRTYR

SEQ ID NO: 111536 - protein, 19 aa, Mycobacterium avium
LPARLILRLLKFDESRHMD

SEQ ID NO: 111537 - protein, 20 aa, Mycobacterium avium
LPAVRVGRSFRVHAKAVHDM

SEQ ID NO: 111538 - protein, 19 aa, Mycobacterium avium
LPCLIGAPVLFGRGSVVFA

SEQ ID NO: 111539 - protein, 21 aa, Mycobacterium avium
LPDLLAVLSVRLGRIDRVLYH

SEQ ID NO: 111540 - protein, 22 aa, Mycobacterium avium
LPDSRLWWLLNLVITRGTPPRL

SEQ ID NO: 111541 - protein, 21 aa, Mycobacterium avium
LPDVRRYGATYANYVGKPLSY

SEQ ID NO: 111542 - protein, 22 aa, Mycobacterium avium
LPELPLRVGDTWEEAGPDGDRI

SEQ ID NO: 111543 - protein, 22 aa, Mycobacterium avium
LPELPLRVGDTWEETGPDGDRI

SEQ ID NO: 111544 - protein, 18 aa, Mycobacterium avium
LPESIIIAGAGAIGMEFG

SEQ ID NO: 111545 - protein, 17 aa, Mycobacterium avium
LPFMARVQLRWMGVFVA

SEQ ID NO: 111546 - protein, 20 aa, Mycobacterium avium
LPFRAPKHWSALEPVLRDAG

SEQ ID NO: 111547 - protein, 17 aa, Mycobacterium avium
LPGGLNWPLDLAVGHDG

SEQ ID NO: 111548 - protein, 19 aa, Mycobacterium avium
LPGTWARYASDGKGDGVAD

SEQ ID NO: 111549 - protein, 17 aa, Mycobacterium avium
LPGWRDYEGVLGVAGDA

SEQ ID NO: 111550 - protein, 22 aa, Mycobacterium avium
LPGYEEFAPWLLVEKRGNVHVV

SEQ ID NO: 111551 - protein, 18 aa, Mycobacterium avium
LPLCVLLGGWLRGQVQPR

SEQ ID NO: 111552 - protein, 22 aa, Mycobacterium avium
LPLCVLLGGWLRRQVQPRAAAR

SEQ ID NO: 111553 - protein, 17 aa, Mycobacterium avium
LPLPVAMRLILMGKHEK

SEQ ID NO: 111554 - protein, 17 aa, Mycobacterium avium
LPMPAELTVAMKQARKQ

SEQ ID NO: 111555 - protein, 18 aa, Mycobacterium avium
LPPESWGNHEWDTMTAMP

SEQ ID NO: 111556 - protein, 19 aa, Mycobacterium avium
LPPWNEVLQNLGFSNASTA

SEQ ID NO: 111557 - protein, 23 aa, Mycobacterium avium
LPQARAKLRIHLEEIRRINPSII

SEQ ID NO: 111558 - protein, 23 aa, Mycobacterium avium
LPQQARKGDLIFYGPEGTQSVAM

SEQ ID NO: 111559 - protein, 25 aa, Mycobacterium avium
LPRQLRPVLRLVWPVLTSLAARPVV

SEQ ID NO: 111560 - protein, 17 aa, Mycobacterium avium
LPRRLQIEFSQVIQKIS

SEQ ID NO: 111561 - protein, 19 aa, Mycobacterium avium
LPSNCRYLLPSLIRSSARA

SEQ ID NO: 111562 - protein, 23 aa, Mycobacterium avium
LPTLRSVFLSGDWIPLDLPRRLR

SEQ ID NO: 111563 - protein, 24 aa, Mycobacterium avium
LPVKLCYAGPFFRYERPQAGRYRQ

SEQ ID NO: 111564 - protein, 17 aa, Mycobacterium avium
LPVLRPGKQVLLTDQLA

SEQ ID NO: 111565 - protein, 18 aa, Mycobacterium avium
LPVLRPGKQVLLTDQLAE

SEQ ID NO: 111566 - protein, 19 aa, Mycobacterium avium
LPVPEWFPMLGGHEGSGVV

SEQ ID NO: 111567 - protein, 17 aa, Mycobacterium avium
LQAQILRRAPQRARVVA

SEQ ID NO: 111568 - protein, 20 aa, Mycobacterium avium
LQHPDTFARLGVRPPRGVLL

SEQ ID NO: 111569 - protein, 17 aa, Mycobacterium avium
LQPRAAAVLSMYRYHAD

SEQ ID NO: 111570 - protein, 21 aa, Mycobacterium avium
LQRRGCAIARVVLLDAQPGLD

SEQ ID NO: 111571 - protein, 25 aa, Mycobacterium avium
LQRRGCPVRHLILLDALLVIPSSDV

SEQ ID NO: 111572 - protein, 17 aa, Mycobacterium avium
LQRRLRALVGRRGGRGA

SEQ ID NO: 111573 - protein, 18 aa, Mycobacterium avium
LQVPFAVDFPSTYRLARR

SEQ ID NO: 111574 - protein, 17 aa, Mycobacterium avium
LRAADWGRIVTFAAHSI

SEQ ID NO: 111575 - protein, 18 aa, Mycobacterium avium
LRAAEGIPDCALADVPAL

SEQ ID NO: 111576 - protein, 22 aa, Mycobacterium avium
LRAEPWRSGAVLRHAGVLAEVC

SEQ ID NO: 111577 - protein, 18 aa, Mycobacterium avium
LRAGPGLVYGYTAELDTA

SEQ ID NO: 111578 - protein, 17 aa, Mycobacterium avium
LRAKPVWVLGSGETTSH

SEQ ID NO: 111579 - protein, 17 aa, Mycobacterium avium
LRAVHSFLANPSDPPRD

SEQ ID NO: 111580 - protein, 17 aa, Mycobacterium avium
LRAWKAYDRFEGKSSVR

SEQ ID NO: 111581 - protein, 18 aa, Mycobacterium avium
LRDLLKFDFYFADSATFR

SEQ ID NO: 111582 - protein, 18 aa, Mycobacterium avium
LRELAGWPALLRGKLSVT

SEQ ID NO: 111583 - protein, 17 aa, Mycobacterium avium
LRFLPPIVRNEEKWCQL

SEQ ID NO: 111584 - protein, 17 aa, Mycobacterium avium
LRFTSPVAHMARRATED

SEQ ID NO: 111585 - protein, 26 aa, Mycobacterium avium
LRGMPVGALGRRGAAAGYVNKYGFRY

SEQ ID NO: 111586 - protein, 17 aa, Mycobacterium avium
LRGWRFYDGFRVDAGAP

SEQ ID NO: 111587 - protein, 20 aa, Mycobacterium avium
LRHGLRIARCHALRAVAADS

SEQ ID NO: 111588 - protein, 19 aa, Mycobacterium avium
LRIPKLRTGSCFPALLERR

SEQ ID NO: 111589 - protein, 19 aa, Mycobacterium avium
LRISYAEACRRLREAKQLS

SEQ ID NO: 111590 - protein, 20 aa, Mycobacterium avium
LRKVAAWARDRGCLVASDEC

SEQ ID NO: 111591 - protein, 19 aa, Mycobacterium avium
LRLAPTLDWIEAALPQQNT

SEQ ID NO: 111592 - protein, 20 aa, Mycobacterium avium
LRLLLREVFTAAGGSHDDWD

SEQ ID NO: 111593 - protein, 19 aa, Mycobacterium avium
LRLLPFRLVLDGAQEIDAE

SEQ ID NO: 111594 - protein, 20 aa, Mycobacterium avium
LRLSDAWVWDMYRPARFVKQ

SEQ ID NO: 111595 - protein, 20 aa, Mycobacterium avium
LRLYERRGLLTPSRTDGGTR

SEQ ID NO: 111596 - protein, 17 aa, Mycobacterium avium
LRPAGRRALLELPGPPA

SEQ ID NO: 111597 - protein, 20 aa, Mycobacterium avium
LRPRAVIYHRGLGPKFADVL

SEQ ID NO: 111598 - protein, 19 aa, Mycobacterium avium
LRPSMLEFMDSVAINAVED

SEQ ID NO: 111599 - protein, 17 aa, Mycobacterium avium
LRQGFPVDLLNSAERER

SEQ ID NO: 111600 - protein, 19 aa, Mycobacterium avium
LRRLVIMGGSYDHRGNTTA

SEQ ID NO: 111601 - protein, 17 aa, Mycobacterium avium
LRSGGLGVREVKRLSKT

SEQ ID NO: 111602 - protein, 18 aa, Mycobacterium avium
LRSGGLGVREVKRLSKTT

SEQ ID NO: 111603 - protein, 20 aa, Mycobacterium avium
LRSGMTIGIGGWGSRRKPMA

SEQ ID NO: 111604 - protein, 18 aa, Mycobacterium avium
LRTALRMQILAGYPIAEA

SEQ ID NO: 111605 - protein, 19 aa, Mycobacterium avium
LRTATPLDDVFVALKPPPG

SEQ ID NO: 111606 - protein, 17 aa, Mycobacterium avium
LRTGMTVVEYVDRPEFR

SEQ ID NO: 111607 - protein, 17 aa, Mycobacterium avium
LRYLGSLTHGFANLFQL

SEQ ID NO: 111608 - protein, 21 aa, Mycobacterium avium
LRYRLRHGVGMAGLRGPGSDR

SEQ ID NO: 111609 - protein, 21 aa, Mycobacterium avium
LSASQLRSWFAYRLDGPSPVN

SEQ ID NO: 111610 - protein, 18 aa, Mycobacterium avium
LSEARYGIIWGARGAARS

SEQ ID NO: 111611 - protein, 22 aa, Mycobacterium avium
LSEEDRRFAVVFAHDQSDYARM

SEQ ID NO: 111612 - protein, 17 aa, Mycobacterium avium
LSFLDFRKIPLNGLWAE

SEQ ID NO: 111613 - protein, 19 aa, Mycobacterium avium
LSFLDFRKIPLNGLWAETK

SEQ ID NO: 111614 - protein, 17 aa, Mycobacterium avium
LSGADHAWSFVFLASDR

SEQ ID NO: 111615 - protein, 21 aa, Mycobacterium avium
LSGGMCQRALIAIGLAGRPRL

SEQ ID NO: 111616 - protein, 24 aa, Mycobacterium avium
LSGLSTDVKFHWNGNAVELIGNTP

SEQ ID NO: 111617 - protein, 17 aa, Mycobacterium avium
LSTTLAWFAERAGRTGE

SEQ ID NO: 111618 - protein, 22 aa, Mycobacterium avium
LSTYRFPTGWFIVAFGSDLAPG

SEQ ID NO: 111619 - protein, 17 aa, Mycobacterium avium
LSVGRSGVWLTVSDGEI

SEQ ID NO: 111620 - protein, 19 aa, Mycobacterium avium
LSVPPSWAGATPGGRFQQR

SEQ ID NO: 111621 - protein, 19 aa, Mycobacterium avium
LSVPPSWAGATPVVGSSSA

SEQ ID NO: 111622 - protein, 17 aa, Mycobacterium avium
LSYAGAMTALTAGAISF

SEQ ID NO: 111623 - protein, 17 aa, Mycobacterium avium
LTARPGIDFGVQTRGDG

SEQ ID NO: 111624 - protein, 18 aa, Mycobacterium avium
LTDESWSGPASMSMVAAV

SEQ ID NO: 111625 - protein, 22 aa, Mycobacterium avium
LTDRLRRSFGRMPWTTTQKRRP

SEQ ID NO: 111626 - protein, 17 aa, Mycobacterium avium
LTFKAIDIVGTILRPIA

SEQ ID NO: 111627 - protein, 17 aa, Mycobacterium avium
LTGKGWRVTPHPARQLY

SEQ ID NO: 111628 - protein, 18 aa, Mycobacterium avium
LTGKGWRVTPHPARQLYA

SEQ ID NO: 111629 - protein, 17 aa, Mycobacterium avium
LTLAWQRLVPWPDVLPG

SEQ ID NO: 111630 - protein, 17 aa, Mycobacterium avium
LTLHPGVMTGYGHGELA

SEQ ID NO: 111631 - protein, 21 aa, Mycobacterium avium
LTNRSTIRWTLHQLVASGVVS

SEQ ID NO: 111632 - protein, 24 aa, Mycobacterium avium
LTPRIASLELEYYGSMWPNNSAVG

SEQ ID NO: 111633 - protein, 17 aa, Mycobacterium avium
LTSMWRRGDEIFAEVNL

SEQ ID NO: 111634 - protein, 20 aa, Mycobacterium avium
LTTRLDRRWGGAFGTMPDGL

SEQ ID NO: 111635 - protein, 17 aa, Mycobacterium avium
LTWPNPFLPIFIQEPGE

SEQ ID NO: 111636 - protein, 24 aa, Mycobacterium avium
LVAHLRLAGAFVFVMVGTVAQARA

SEQ ID NO: 111637 - protein, 17 aa, Mycobacterium avium
LVDCGRGVLQRAAAGGV

SEQ ID NO: 111638 - protein, 17 aa, Mycobacterium avium
LVDCGRGVLQRAAAVGV

SEQ ID NO: 111639 - protein, 18 aa, Mycobacterium avium
LVDCGRGVLQRAAAVGVG

SEQ ID NO: 111640 - protein, 17 aa, Mycobacterium avium
LVGPVWRRDEVFEFNGS

SEQ ID NO: 111641 - protein, 18 aa, Mycobacterium avium
LVGRSSLVYDMWGAAVNL

SEQ ID NO: 111642 - protein, 23 aa, Mycobacterium avium
LVGYCMGGLLATEIAKCLEESGI

SEQ ID NO: 111643 - protein, 17 aa, Mycobacterium avium
LVLPMFVADGIDEPRPI

SEQ ID NO: 111644 - protein, 23 aa, Mycobacterium avium
LVNSWSAAFARYGRTVGQVLLSA

SEQ ID NO: 111645 - protein, 17 aa, Mycobacterium avium
LVRESFADAVSWVAKSL

SEQ ID NO: 111646 - protein, 17 aa, Mycobacterium avium
LVRRALDLLPQVGFVNA

SEQ ID NO: 111647 - protein, 17 aa, Mycobacterium avium
LVRRARCPVAVIHDEDP

SEQ ID NO: 111648 - protein, 18 aa, Mycobacterium avium
LVTPVVVYLCHRSCDRTA

SEQ ID NO: 111649 - protein, 20 aa, Mycobacterium avium
LVVMCGVGLYAGYVETYQEM

SEQ ID NO: 111650 - protein, 18 aa, Mycobacterium avium
LWARSGYLQPHWPAPYGR

SEQ ID NO: 111651 - protein, 18 aa, Mycobacterium avium
LWCADVVVAAYRPAQVPW

SEQ ID NO: 111652 - protein, 17 aa, Mycobacterium avium
LWDAAEWSVQVQLNHLR

SEQ ID NO: 111653 - protein, 18 aa, Mycobacterium avium
LWRARRVLAVTFPSHTSA

SEQ ID NO: 111654 - protein, 17 aa, Mycobacterium avium
LYAGSIMRDDLLALCPP

SEQ ID NO: 111655 - protein, 19 aa, Mycobacterium avium
LYKGLDWFDMIVALYQQAG

SEQ ID NO: 111656 - protein, 21 aa, Mycobacterium avium
LYLKRAHVFRHLFGEPTDVLA

SEQ ID NO: 111657 - protein, 17 aa, Mycobacterium avium
LYLRLACGLAERIGAQA

SEQ ID NO: 111658 - protein, 23 aa, Mycobacterium avium
LYQYRPELPFVLGAEIAGVVRSA

SEQ ID NO: 111659 - protein, 17 aa, Mycobacterium avium
LYSCFPVPVFNFCDGTG

SEQ ID NO: 111660 - protein, 17 aa, Mycobacterium avium
LYSCFPVPVFNFCDGTS

SEQ ID NO: 111661 - protein, 23 aa, Mycobacterium avium
LYYLEMPPSLFAPIVENLAKADL

SEQ ID NO: 111662 - protein, 24 aa, Mycobacterium avium
LYYLEMPPSLFAPIVENLAKADLL

SEQ ID NO: 111663 - protein, 19 aa, Mycobacterium avium
MAGAVMPYVSWLTAVAEQC

SEQ ID NO: 111664 - protein, 17 aa, Mycobacterium avium
MAGTGFLGAHAEEVYRI

SEQ ID NO: 111665 - protein, 19 aa, Mycobacterium avium
MALCALAHFLNLDRGGSYA

SEQ ID NO: 111666 - protein, 17 aa, Mycobacterium avium
MAQAAGIPVVFLTAYYG

SEQ ID NO: 111667 - protein, 19 aa, Mycobacterium avium
MDCGIPFCHNGCPLGNLIP

SEQ ID NO: 111668 - protein, 17 aa, Mycobacterium avium
MDLTFSLAERWTEDDEP

SEQ ID NO: 111669 - protein, 27 aa, Mycobacterium avium
MDPRQRLALELAWELLEDAFIVAETLR

SEQ ID NO: 111670 - protein, 20 aa, Mycobacterium avium
MDRKVWLPSGGTLVIDRTEA

SEQ ID NO: 111671 - protein, 19 aa, Mycobacterium avium
MECPDCLYTRAVLRGGESY

SEQ ID NO: 111672 - protein, 21 aa, Mycobacterium avium
MFAWKRWPIKGARTRTGHARS

SEQ ID NO: 111673 - protein, 18 aa, Mycobacterium avium
MFDGRFLGFADFLVRDGE

SEQ ID NO: 111674 - protein, 20 aa, Mycobacterium avium
MFRLPPALERGWHARGYYGS

SEQ ID NO: 111675 - protein, 20 aa, Mycobacterium avium
MGAIKPRLVAVGTEVVVRPT

SEQ ID NO: 111676 - protein, 20 aa, Mycobacterium avium
MGDDAWLWKLDCEFRLFNYV

SEQ ID NO: 111677 - protein, 19 aa, Mycobacterium avium
MGEALQALAAILTRRGVSS

SEQ ID NO: 111678 - protein, 22 aa, Mycobacterium avium
MGITHLTSLIARRSVYCSKWAN

SEQ ID NO: 111679 - protein, 19 aa, Mycobacterium avium
MGPMQFLPGTWARYASDGK

SEQ ID NO: 111680 - protein, 18 aa, Mycobacterium avium
MGSADWSAVLARVGADPD

SEQ ID NO: 111681 - protein, 23 aa, Mycobacterium avium
MHLYLKRAHVFRHLFGEPTDVLA

SEQ ID NO: 111682 - protein, 18 aa, Mycobacterium avium
MIFYRDLVRLMTHLSDKH

SEQ ID NO: 111683 - protein, 18 aa, Mycobacterium avium
MILLAAFAGLRAHEIAKV

SEQ ID NO: 111684 - protein, 23 aa, Mycobacterium avium
MIRFGSLFLREGVSLTGRRVLPE

SEQ ID NO: 111685 - protein, 22 aa, Mycobacterium avium
MIRYCTPAQWFARTVRKPFDIH

SEQ ID NO: 111686 - protein, 22 aa, Mycobacterium avium
MKDFKGALSAARIEIGQDFLPA

SEQ ID NO: 111687 - protein, 17 aa, Mycobacterium avium
MKFEGGVHRVQRVPVTE

SEQ ID NO: 111688 - protein, 21 aa, Mycobacterium avium
MKLTPREIGVWDMTHICRIDD

SEQ ID NO: 111689 - protein, 19 aa, Mycobacterium avium
MLHWPDSGNGLAQFHCEIA

SEQ ID NO: 111690 - protein, 19 aa, Mycobacterium avium
MLLELSWEALERAGIDPSG

SEQ ID NO: 111691 - protein, 20 aa, Mycobacterium avium
MLLEPGKFYDLQEYKVVSAD

SEQ ID NO: 111692 - protein, 21 aa, Mycobacterium avium
MLLQRRCVWMVEQGDIPVAEG

SEQ ID NO: 111693 - protein, 18 aa, Mycobacterium avium
MLPHNAVEYFVSYYDYYQ

SEQ ID NO: 111694 - protein, 19 aa, Mycobacterium avium
MLRAAEWARIVTLSAHSIQ

SEQ ID NO: 111695 - protein, 24 aa, Mycobacterium avium
MLSLNIPVPPGFVLTTDVCREYHD

SEQ ID NO: 111696 - protein, 21 aa, Mycobacterium avium
MMFPDRWIPNLADQVRAAALA

SEQ ID NO: 111697 - protein, 20 aa, Mycobacterium avium
MPAMIRLGGKMYGADGRTKD

SEQ ID NO: 111698 - protein, 21 aa, Mycobacterium avium
MPIAVPWSLPAVRPVHSGDPD

SEQ ID NO: 111699 - protein, 19 aa, Mycobacterium avium
MPMRVIGMLLGLPEDRQRQ

SEQ ID NO: 111700 - protein, 17 aa, Mycobacterium avium
MPRPVWYALDRGLIMES

SEQ ID NO: 111701 - protein, 20 aa, Mycobacterium avium
MPSRAYVSAFGFKGPDQQKP

SEQ ID NO: 111702 - protein, 18 aa, Mycobacterium avium
MQLHLACFAAFDDIGCVI

SEQ ID NO: 111703 - protein, 17 aa, Mycobacterium avium
MRLALFEAFDPAATPLA

SEQ ID NO: 111704 - protein, 18 aa, Mycobacterium avium
MRLWAQERVRGWTNERVR

SEQ ID NO: 111705 - protein, 17 aa, Mycobacterium avium
MRQGYKLGDQVLRHALV

SEQ ID NO: 111706 - protein, 23 aa, Mycobacterium avium
MRRRSAFCDFDFRATRPQYTNGG

SEQ ID NO: 111707 - protein, 18 aa, Mycobacterium avium
MRSPHPFAATAIGLAVFL

SEQ ID NO: 111708 - protein, 28 aa, Mycobacterium avium
MSFVAVCGQCRWCASGMEYLCDVGIGTM

SEQ ID NO: 111709 - protein, 29 aa, Mycobacterium avium
MSFVAVCGQCRWCASGMEYLCDVGIGTMI

SEQ ID NO: 111710 - protein, 23 aa, Mycobacterium avium
MSHWAGKEWDHFLHGTPVGRALN

SEQ ID NO: 111711 - protein, 17 aa, Mycobacterium avium
MSRRLDWARVVAGEAAL

SEQ ID NO: 111712 - protein, 27 aa, Mycobacterium avium
MTKLWARMWLLRFTWQRAIDSGDTSSA

SEQ ID NO: 111713 - protein, 19 aa, Mycobacterium avium
MTLAGRWRRQGIAVDFATL

SEQ ID NO: 111714 - protein, 20 aa, Mycobacterium avium
MTQWVPKSGASYAYFGVGIF

SEQ ID NO: 111715 - protein, 17 aa, Mycobacterium avium
MVFVGGLLPVPGHSFVE

SEQ ID NO: 111716 - protein, 24 aa, Mycobacterium avium
MVRCVRAALPLLRKAQWARIVTFS

SEQ ID NO: 111717 - protein, 19 aa, Mycobacterium avium
MVRIRLACLVAAYHGTLTV

SEQ ID NO: 111718 - protein, 25 aa, Mycobacterium avium
MWTAYRQSPAWGFCMWAIAPDQMYS

SEQ ID NO: 111719 - protein, 20 aa, Mycobacterium avium
NACRKCGALIQQGASNYSAA

SEQ ID NO: 111720 - protein, 18 aa, Mycobacterium avium
NADNRLAVHIAFDPDDIT

SEQ ID NO: 111721 - protein, 18 aa, Mycobacterium avium
NAETIFWNGPMGVFEFPA

SEQ ID NO: 111722 - protein, 17 aa, Mycobacterium avium
NALKVAFDWKSRHNERR

SEQ ID NO: 111723 - protein, 18 aa, Mycobacterium avium
NAMGRPGFTLGLGPSHEP

SEQ ID NO: 111724 - protein, 17 aa, Mycobacterium avium
NAPILFIERLRSVGGLP

SEQ ID NO: 111725 - protein, 21 aa, Mycobacterium avium
NAVGGFSYVLPAGWVESDASH

SEQ ID NO: 111726 - protein, 17 aa, Mycobacterium avium
NAWRLPFEREWRDPQTL

SEQ ID NO: 111727 - protein, 19 aa, Mycobacterium avium
NCETCIRFAAITGGGTDAA

SEQ ID NO: 111728 - protein, 23 aa, Mycobacterium avium
NEGLCAMGLRFGEDWTSPRERFT

SEQ ID NO: 111729 - protein, 17 aa, Mycobacterium avium
NEGPIHWYIHLMEQSRT

SEQ ID NO: 111730 - protein, 18 aa, Mycobacterium avium
NELAQYWIRVNTIHPTGV

SEQ ID NO: 111731 - protein, 17 aa, Mycobacterium avium
NELRAKWASRVSRREVL

SEQ ID NO: 111732 - protein, 19 aa, Mycobacterium avium
NFGLLDWVAALSWVAENIA

SEQ ID NO: 111733 - protein, 17 aa, Mycobacterium avium
NFLTRWAIGELVASDVD

SEQ ID NO: 111734 - protein, 17 aa, Mycobacterium avium
NGCWGTFVLADARHAVT

SEQ ID NO: 111735 - protein, 19 aa, Mycobacterium avium
NGIPLWAGAAFKHASAGPA

SEQ ID NO: 111736 - protein, 18 aa, Mycobacterium avium
NGITSFWSSIAQQLVSGP

SEQ ID NO: 111737 - protein, 17 aa, Mycobacterium avium
NGVALILVGHVTKDGAI

SEQ ID NO: 111738 - protein, 20 aa, Mycobacterium avium
NGWKTLSWVDANIWRRVVPK

SEQ ID NO: 111739 - protein, 18 aa, Mycobacterium avium
NKEIKRRTDVVGVFPNPA

SEQ ID NO: 111740 - protein, 23 aa, Mycobacterium avium
NMFALGLLSWMYGRPIETSEKFI

SEQ ID NO: 111741 - protein, 20 aa, Mycobacterium avium
NPELRWKVGPVTNANGMLST

SEQ ID NO: 111742 - protein, 17 aa, Mycobacterium avium
NPFGAPGSRMYRTGDLV

SEQ ID NO: 111743 - protein, 17 aa, Mycobacterium avium
NRARLAAALGLKPDRVV

SEQ ID NO: 111744 - protein, 22 aa, Mycobacterium avium
NRARLAAALGLKPERVVWMNQV

SEQ ID NO: 111745 - protein, 17 aa, Mycobacterium avium
NRIRLLALIQTNIFGQN

SEQ ID NO: 111746 - protein, 20 aa, Mycobacterium avium
NRLAVHIAFDPDDITGAIAE

SEQ ID NO: 111747 - protein, 22 aa, Mycobacterium avium
NSFRCPYHGWTFGNTGALQGVP

SEQ ID NO: 111748 - protein, 20 aa, Mycobacterium avium
NSVECLLPFFDRKTATAVAE

SEQ ID NO: 111749 - protein, 18 aa, Mycobacterium avium
NSVGRLSVPPTWASATPA

SEQ ID NO: 111750 - protein, 23 aa, Mycobacterium avium
NTFRHLYGLDCSHIAPANVYGPR

SEQ ID NO: 111751 - protein, 22 aa, Mycobacterium avium
NVSELPCGPGRDVQEMLAAAAA

SEQ ID NO: 111752 - protein, 22 aa, Mycobacterium avium
NVSELPCGPGRDVQEMLAAAAD

SEQ ID NO: 111753 - protein, 25 aa, Mycobacterium avium
NWGRFRWGDDFGWTWGTILPAEPDD

SEQ ID NO: 111754 - protein, 17 aa, Mycobacterium avium
NYLRCIGCGLCVEACPT

SEQ ID NO: 111755 - protein, 22 aa, Mycobacterium avium
NYWGVRGCDDFLTGMTHVVSPV

SEQ ID NO: 111756 - protein, 17 aa, Mycobacterium avium
NYYRWLLYEADHAGAYR

SEQ ID NO: 111757 - protein, 19 aa, Mycobacterium avium
PAAVCPHVEWALSSTLGAK

SEQ ID NO: 111758 - protein, 20 aa, Mycobacterium avium
PAAVCPHVEWALSSTLGAKA

SEQ ID NO: 111759 - protein, 19 aa, Mycobacterium avium
PADVLPLWVAEMDVRLAPT

SEQ ID NO: 111760 - protein, 20 aa, Mycobacterium avium
PAEGFAAMWADLRRPELREF

SEQ ID NO: 111761 - protein, 22 aa, Mycobacterium avium
PAESWPPTGWFEGWAGGLDVFD

SEQ ID NO: 111762 - protein, 17 aa, Mycobacterium avium
PAGALAFLGCPLSDLED

SEQ ID NO: 111763 - protein, 17 aa, Mycobacterium avium
PALAALCDIFYPRVFLR

SEQ ID NO: 111764 - protein, 20 aa, Mycobacterium avium
PALIAFAGGDPWAINRSLQA

SEQ ID NO: 111765 - protein, 18 aa, Mycobacterium avium
PALLLKCLLMAATEGIAS

SEQ ID NO: 111766 - protein, 17 aa, Mycobacterium avium
PALPAARIEFMLDDTAP

SEQ ID NO: 111767 - protein, 18 aa, Mycobacterium avium
PANYFGVTALNLVPGDGG

SEQ ID NO: 111768 - protein, 21 aa, Mycobacterium avium
PAPAARWAFCNGMTAAQRRLT

SEQ ID NO: 111769 - protein, 18 aa, Mycobacterium avium
PAPAPYRGFVDWLAERDL

SEQ ID NO: 111770 - protein, 17 aa, Mycobacterium avium
PAPKLGKYVESFEGMIE

SEQ ID NO: 111771 - protein, 19 aa, Mycobacterium avium
PAQVGLAWILARTPHTLLI

SEQ ID NO: 111772 - protein, 18 aa, Mycobacterium avium
PASYFALAEAHGRLGHPA

SEQ ID NO: 111773 - protein, 17 aa, Mycobacterium avium
PATPVSVPTRFAAQAAR

SEQ ID NO: 111774 - protein, 20 aa, Mycobacterium avium
PATVVEFGMSFGISAVHLAA

SEQ ID NO: 111775 - protein, 21 aa, Mycobacterium avium
PATVVEFGMSFGISAVHLAAA

SEQ ID NO: 111776 - protein, 20 aa, Mycobacterium avium
PAVLPLSFAQSRLWFIDQLH

SEQ ID NO: 111777 - protein, 19 aa, Mycobacterium avium
PAVVPLSFAQSRLWFLDQL

SEQ ID NO: 111778 - protein, 19 aa, Mycobacterium avium
PAWDLPTVFGPIAVTYHLT

SEQ ID NO: 111779 - protein, 18 aa, Mycobacterium avium
PCLPCGVHMYLGKGKTLD

SEQ ID NO: 111780 - protein, 17 aa, Mycobacterium avium
PCSARLPTVPHIMKLSS

SEQ ID NO: 111781 - protein, 18 aa, Mycobacterium avium
PDDPRWPPIPAQDFSNLP

SEQ ID NO: 111782 - protein, 20 aa, Mycobacterium avium
PDFIRLGLMLALERRPVEPR

SEQ ID NO: 111783 - protein, 17 aa, Mycobacterium avium
PDHMVSFWPDSIWAPEF

SEQ ID NO: 111784 - protein, 17 aa, Mycobacterium avium
PDIAGVMRVFEDTGEYP

SEQ ID NO: 111785 - protein, 17 aa, Mycobacterium avium
PDKLAELLALWDRYVEE

SEQ ID NO: 111786 - protein, 20 aa, Mycobacterium avium
PDPRAADIVQTWAHVLDQLE

SEQ ID NO: 111787 - protein, 17 aa, Mycobacterium avium
PDRVCATLSRVARALPQ

SEQ ID NO: 111788 - protein, 18 aa, Mycobacterium avium
PDRVCATLSRVARALPQV

SEQ ID NO: 111789 - protein, 19 aa, Mycobacterium avium
PDRVKCLHVLIAHSLAKGP

SEQ ID NO: 111790 - protein, 18 aa, Mycobacterium avium
PDVSKNFPLRYLVTNTGW

SEQ ID NO: 111791 - protein, 17 aa, Mycobacterium avium
PDWFACAGVRVADEQLR

SEQ ID NO: 111792 - protein, 18 aa, Mycobacterium avium
PDWVPGEYWVSGRGIARG

SEQ ID NO: 111793 - protein, 20 aa, Mycobacterium avium
PEDFRFLIRLARQQGTRLGR

SEQ ID NO: 111794 - protein, 18 aa, Mycobacterium avium
PEEFRMAVYYADVEGFPY

SEQ ID NO: 111795 - protein, 24 aa, Mycobacterium avium
PEHARRDAFHWLSLTTEFGITVWN

SEQ ID NO: 111796 - protein, 20 aa, Mycobacterium avium
PEIDVRFGLGWGAVTVLDAA

SEQ ID NO: 111797 - protein, 17 aa, Mycobacterium avium
PEIKHWIEFARDTDGDW

SEQ ID NO: 111798 - protein, 17 aa, Mycobacterium avium
PEIKLGVLPGMGGSQRL

SEQ ID NO: 111799 - protein, 17 aa, Mycobacterium avium
PEIRAPWTLPKRSRKAG

SEQ ID NO: 111800 - protein, 22 aa, Mycobacterium avium
PELDPRWAPAFPDRFGGWDIGV

SEQ ID NO: 111801 - protein, 18 aa, Mycobacterium avium
PELPGGRPRGGRSLSAVP

SEQ ID NO: 111802 - protein, 17 aa, Mycobacterium avium
PELRRPITELGMVKSID

SEQ ID NO: 111803 - protein, 17 aa, Mycobacterium avium
PEMAWRYLELDGGDIDE

SEQ ID NO: 111804 - protein, 17 aa, Mycobacterium avium
PEMAWRYLELDGGDIDG

SEQ ID NO: 111805 - protein, 25 aa, Mycobacterium avium
PEPGARCPRCPCLAPQDVPAVAGPS

SEQ ID NO: 111806 - protein, 19 aa, Mycobacterium avium
PEPYCPVGISPLLETIEDL

SEQ ID NO: 111807 - protein, 27 aa, Mycobacterium avium
PERAVKLWQHWDRCALHWFPGSHVLHI

SEQ ID NO: 111808 - protein, 22 aa, Mycobacterium avium
PERYRAMVLLAAWCALRFGELT

SEQ ID NO: 111809 - protein, 20 aa, Mycobacterium avium
PERYRFSVTLPRTVPGRGAG

SEQ ID NO: 111810 - protein, 19 aa, Mycobacterium avium
PESIIRTGGTLAFSLAAYP

SEQ ID NO: 111811 - protein, 18 aa, Mycobacterium avium
PEWVPGELWVSGRGIARG

SEQ ID NO: 111812 - protein, 17 aa, Mycobacterium avium
PFEREWRDPQTLPRSGQ

SEQ ID NO: 111813 - protein, 18 aa, Mycobacterium avium
PFGGVGVRMYRTGDLVRW

SEQ ID NO: 111814 - protein, 25 aa, Mycobacterium avium
PFIGGDPRWGTAHFASGGPSGTDTI

SEQ ID NO: 111815 - protein, 18 aa, Mycobacterium avium
PFLTDVSRAWNLEAAQEN

SEQ ID NO: 111816 - protein, 18 aa, Mycobacterium avium
PFLTDVSRAWNLEAVQEN

SEQ ID NO: 111817 - protein, 18 aa, Mycobacterium avium
PFRAPKHWSALEPVLRDA

SEQ ID NO: 111818 - protein, 18 aa, Mycobacterium avium
PFRAPKHWSALEPVLRDV

SEQ ID NO: 111819 - protein, 18 aa, Mycobacterium avium
PFSRLSRRLSPRVPESGV

SEQ ID NO: 111820 - protein, 23 aa, Mycobacterium avium
PFWKACVDLDLTLAVHAGWGFPQ

SEQ ID NO: 111821 - protein, 18 aa, Mycobacterium avium
PGALCSSTLWAADVLATA

SEQ ID NO: 111822 - protein, 18 aa, Mycobacterium avium
PGALIGFLGPRVYQQLYG

SEQ ID NO: 111823 - protein, 19 aa, Mycobacterium avium
PGARCPRCPCLAPQDVPRS

SEQ ID NO: 111824 - protein, 21 aa, Mycobacterium avium
PGCGVSWNLLAGIGRIESGHA

SEQ ID NO: 111825 - protein, 20 aa, Mycobacterium avium
PGHCPSGLGFRPDGSLLIAS

SEQ ID NO: 111826 - protein, 17 aa, Mycobacterium avium
PGIPGIKTFGGHSFHSS

SEQ ID NO: 111827 - protein, 19 aa, Mycobacterium avium
PGKDISIADVLRCIDGPLA

SEQ ID NO: 111828 - protein, 18 aa, Mycobacterium avium
PGLAPGWGSPHAVRPATA

SEQ ID NO: 111829 - protein, 17 aa, Mycobacterium avium
PGLLAWRIDLRATVATR

SEQ ID NO: 111830 - protein, 18 aa, Mycobacterium avium
PGLLKWLEDPKVGGVELR

SEQ ID NO: 111831 - protein, 17 aa, Mycobacterium avium
PGLTASRFVPNPFGAPG

SEQ ID NO: 111832 - protein, 23 aa, Mycobacterium avium
PGLVRWTGRYDMRYVEGAMPGRG

SEQ ID NO: 111833 - protein, 18 aa, Mycobacterium avium
PGMTVAWQLPSHVNAAVA

SEQ ID NO: 111834 - protein, 18 aa, Mycobacterium avium
PGPFGEMPLFGGAPLMGL

SEQ ID NO: 111835 - protein, 23 aa, Mycobacterium avium
PGPLGERADWWWYDPFQPQPPPS

SEQ ID NO: 111836 - protein, 23 aa, Mycobacterium avium
PGPLGERADWWWYDPFQPQPPPT

SEQ ID NO: 111837 - protein, 21 aa, Mycobacterium avium
PGPLGQRADWWWYDPFQPQPP

SEQ ID NO: 111838 - protein, 23 aa, Mycobacterium avium
PGQLGDVLLQFGRPVYLHARAEM

SEQ ID NO: 111839 - protein, 17 aa, Mycobacterium avium
PGQSVALLFSRSAHAIV

SEQ ID NO: 111840 - protein, 22 aa, Mycobacterium avium
PGRPPWECWVIEGLRGNRWAML

SEQ ID NO: 111841 - protein, 19 aa, Mycobacterium avium
PGRREGWDYPDMARESGTN

SEQ ID NO: 111842 - protein, 19 aa, Mycobacterium avium
PGSVSYLFSRKSVVTCEKN

SEQ ID NO: 111843 - protein, 17 aa, Mycobacterium avium
PGTRIGVIVNDFGDINI

SEQ ID NO: 111844 - protein, 17 aa, Mycobacterium avium
PGTRLVVAGVCMQPDTV

SEQ ID NO: 111845 - protein, 26 aa, Mycobacterium avium
PGVGLKGGVCYFLWDRDNPGSCRVTT

SEQ ID NO: 111846 - protein, 19 aa, Mycobacterium avium
PGVIAEPLIPPARASAYRC

SEQ ID NO: 111847 - protein, 17 aa, Mycobacterium avium
PGWSGWPHRVYGDTRLE

SEQ ID NO: 111848 - protein, 19 aa, Mycobacterium avium
PGYLSWLMGCDMRGTICIT

SEQ ID NO: 111849 - protein, 19 aa, Mycobacterium avium
PGYPCYRNILSALGCEVVE

SEQ ID NO: 111850 - protein, 19 aa, Mycobacterium avium
PHGRLRYYVAMLAELSQLR

SEQ ID NO: 111851 - protein, 17 aa, Mycobacterium avium
PHLEAFKAKGYEVLLLT

SEQ ID NO: 111852 - protein, 17 aa, Mycobacterium avium
PHRGAWCGNDIWREVLP

SEQ ID NO: 111853 - protein, 18 aa, Mycobacterium avium
PIAIVGMSCRFPGGVDSP

SEQ ID NO: 111854 - protein, 19 aa, Mycobacterium avium
PIAIVGMSCRFPGGVDSPE

SEQ ID NO: 111855 - protein, 20 aa, Mycobacterium avium
PKACPAPGVMQGCLESTSGL

SEQ ID NO: 111856 - protein, 17 aa, Mycobacterium avium
PKLANQFLRAWVPEDGG

SEQ ID NO: 111857 - protein, 18 aa, Mycobacterium avium
PKLPGIPGIKTFGGHSFH

SEQ ID NO: 111858 - protein, 20 aa, Mycobacterium avium
PKLPGIPGIKTFGGHSFHSS

SEQ ID NO: 111859 - protein, 29 aa, Mycobacterium avium
PKSWWRAALRFGYHMQFAWYVSLARALRL

SEQ ID NO: 111860 - protein, 19 aa, Mycobacterium avium
PKVVICLVNGWAAGGGHSL

SEQ ID NO: 111861 - protein, 24 aa, Mycobacterium avium
PLADYRGASVLVDWPAELQQRVRT

SEQ ID NO: 111862 - protein, 19 aa, Mycobacterium avium
PLAMPRLDMVTGLYYLTTE

SEQ ID NO: 111863 - protein, 19 aa, Mycobacterium avium
PLDGFPQRRARLMMEMHVL

SEQ ID NO: 111864 - protein, 28 aa, Mycobacterium avium
PLDGFPQRRARLMMEMHVLGPLHLCQLA

SEQ ID NO: 111865 - protein, 18 aa, Mycobacterium avium
PLDICFSAGNLLEDSRSA

SEQ ID NO: 111866 - protein, 20 aa, Mycobacterium avium
PLDVDLRWVAALLLRNGTIE

SEQ ID NO: 111867 - protein, 18 aa, Mycobacterium avium
PLEFGLRVTTLVRDTSEQ

SEQ ID NO: 111868 - protein, 19 aa, Mycobacterium avium
PLHLCQLAIPAMRERGRGW

SEQ ID NO: 111869 - protein, 19 aa, Mycobacterium avium
PLHLHRILLQRSWIAIFWS

SEQ ID NO: 111870 - protein, 21 aa, Mycobacterium avium
PLLRRSGVIFIRRNIGNDQLY

SEQ ID NO: 111871 - protein, 17 aa, Mycobacterium avium
PLLSIPEALAFRESLAG

SEQ ID NO: 111872 - protein, 22 aa, Mycobacterium avium
PLPARATVTWSLTGALQLMLFP

SEQ ID NO: 111873 - protein, 17 aa, Mycobacterium avium
PLPREWPALTKAMSPYV

SEQ ID NO: 111874 - protein, 22 aa, Mycobacterium avium
PLPVQFWPDWVRPEGTPDPPAE

SEQ ID NO: 111875 - protein, 19 aa, Mycobacterium avium
PLRPDCRILACSSVFGTWG

SEQ ID NO: 111876 - protein, 19 aa, Mycobacterium avium
PLRRPKHRRVFTVANQKGG

SEQ ID NO: 111877 - protein, 17 aa, Mycobacterium avium
PLVPSMLEWLHTARTSM

SEQ ID NO: 111878 - protein, 25 aa, Mycobacterium avium
PLYYLEMPPSLFAPIVENLAKADLL

SEQ ID NO: 111879 - protein, 18 aa, Mycobacterium avium
PMFHAWGFSQLLLAASFA

SEQ ID NO: 111880 - protein, 18 aa, Mycobacterium avium
PMGLGLVSQFFGKYFSPE

SEQ ID NO: 111881 - protein, 20 aa, Mycobacterium avium
PMTSCISGWAMLNRDAAVIP

SEQ ID NO: 111882 - protein, 18 aa, Mycobacterium avium
PNLFATHRVRAVDDYAAH

SEQ ID NO: 111883 - protein, 17 aa, Mycobacterium avium
PNLRPLFDGPFYAVRMV

SEQ ID NO: 111884 - protein, 19 aa, Mycobacterium avium
PNPFLPIFIQEPGEWFGIG

SEQ ID NO: 111885 - protein, 21 aa, Mycobacterium avium
PPCPGLGALVRRVGPVEAADR

SEQ ID NO: 111886 - protein, 21 aa, Mycobacterium avium
PPCPGLGALVRRVGPVEAAER

SEQ ID NO: 111887 - protein, 20 aa, Mycobacterium avium
PPEIWRSYIRTVGRTPNGVW

SEQ ID NO: 111888 - protein, 18 aa, Mycobacterium avium
PPGIDFRPALLAGVQIGL

SEQ ID NO: 111889 - protein, 20 aa, Mycobacterium avium
PPHPCPLSFILAPTLIAHGT

SEQ ID NO: 111890 - protein, 20 aa, Mycobacterium avium
PPLRRPKHRRVFTVANQKGG

SEQ ID NO: 111891 - protein, 17 aa, Mycobacterium avium
PPMKWNAWGDPAAAKPL

SEQ ID NO: 111892 - protein, 17 aa, Mycobacterium avium
PPNEGPIHWYIHLMEQS

SEQ ID NO: 111893 - protein, 17 aa, Mycobacterium avium
PPPRAVAIITQIASALD

SEQ ID NO: 111894 - protein, 26 aa, Mycobacterium avium
PPRCGWSAPCARSWAPSRAQCSGSLA

SEQ ID NO: 111895 - protein, 25 aa, Mycobacterium avium
PPRPWRRAAAGFGMRRRSAFCDFDF

SEQ ID NO: 111896 - protein, 18 aa, Mycobacterium avium
PPWNEVLQNLGFSNASTA

SEQ ID NO: 111897 - protein, 18 aa, Mycobacterium avium
PQGAIAVRIYWPPIHSES

SEQ ID NO: 111898 - protein, 18 aa, Mycobacterium avium
PQGAIAVRIYWPPSHSES

SEQ ID NO: 111899 - protein, 22 aa, Mycobacterium avium
PQHRLLLETAWRAVEHCGTAPT

SEQ ID NO: 111900 - protein, 20 aa, Mycobacterium avium
PQPGRLELVLAHPSGITEIE

SEQ ID NO: 111901 - protein, 19 aa, Mycobacterium avium
PQVSWRVCVCYTGSVGSQV

SEQ ID NO: 111902 - protein, 17 aa, Mycobacterium avium
PQWRFVAEWTRSRAEEL

SEQ ID NO: 111903 - protein, 17 aa, Mycobacterium avium
PRAVYRYEFPTIIECLA

SEQ ID NO: 111904 - protein, 17 aa, Mycobacterium avium
PRCAVVFQEPRLLPWRS

SEQ ID NO: 111905 - protein, 18 aa, Mycobacterium avium
PRCEIGAWLERRARVAVD

SEQ ID NO: 111906 - protein, 18 aa, Mycobacterium avium
PRCGWARTWASSSCPIPA

SEQ ID NO: 111907 - protein, 17 aa, Mycobacterium avium
PRCRVLTGVGAFDPGLG

SEQ ID NO: 111908 - protein, 20 aa, Mycobacterium avium
PRGRRFAGRWAEAVFSVSPN

SEQ ID NO: 111909 - protein, 17 aa, Mycobacterium avium
PRIGMWVASGSGYVTEI

SEQ ID NO: 111910 - protein, 24 aa, Mycobacterium avium
PRLLTMIIPARWFAGGKGLDEFRE

SEQ ID NO: 111911 - protein, 19 aa, Mycobacterium avium
PRLPDGFRFVLRLFGADVQ

SEQ ID NO: 111912 - protein, 19 aa, Mycobacterium avium
PRLSWAAGLRDDGITTLLV

SEQ ID NO: 111913 - protein, 19 aa, Mycobacterium avium
PRLSYGLDEACLLIFGRRD

SEQ ID NO: 111914 - protein, 20 aa, Mycobacterium avium
PRMSVGQHRMWFVQSVDPDS

SEQ ID NO: 111915 - protein, 17 aa, Mycobacterium avium
PRPAVLADHDWLINQRG

SEQ ID NO: 111916 - protein, 17 aa, Mycobacterium avium
PRPGPALNGRSVDQVLQ

SEQ ID NO: 111917 - protein, 22 aa, Mycobacterium avium
PRPRLFSLLHEFVHLVLHTEGL

SEQ ID NO: 111918 - protein, 19 aa, Mycobacterium avium
PRPTLCVIHGFLGSSYLAN

SEQ ID NO: 111919 - protein, 17 aa, Mycobacterium avium
PRQKAVVEVGGRRLEVS

SEQ ID NO: 111920 - protein, 18 aa, Mycobacterium avium
PRSAELLADIGLDVEVSG

SEQ ID NO: 111921 - protein, 21 aa, Mycobacterium avium
PRSVIDPGYRYEFIEGDDEVV

SEQ ID NO: 111922 - protein, 18 aa, Mycobacterium avium
PRTGLSMGEHQAITAKQM

SEQ ID NO: 111923 - protein, 22 aa, Mycobacterium avium
PRVDSYGGFVFGSFAPDGPSLV

SEQ ID NO: 111924 - protein, 20 aa, Mycobacterium avium
PRWKRPLGRLLIKLAATFIP

SEQ ID NO: 111925 - protein, 20 aa, Mycobacterium avium
PSEQARAWWGNFLVQKANEA

SEQ ID NO: 111926 - protein, 23 aa, Mycobacterium avium
PSPGMGLSGIWLGAVVADASGQN

SEQ ID NO: 111927 - protein, 18 aa, Mycobacterium avium
PSSIWYRIRINLQHVPED

SEQ ID NO: 111928 - protein, 20 aa, Mycobacterium avium
PSSIWYRIRINLQRVPEDQR

SEQ ID NO: 111929 - protein, 17 aa, Mycobacterium avium
PTARRILAHFGLDHHFE

SEQ ID NO: 111930 - protein, 18 aa, Mycobacterium avium
PTCRPRRWPTPSARAPGT

SEQ ID NO: 111931 - protein, 23 aa, Mycobacterium avium
PTEVRWWEVWLLNRDRREQARFS

SEQ ID NO: 111932 - protein, 17 aa, Mycobacterium avium
PTFRGEMIWCQLFSEPG

SEQ ID NO: 111933 - protein, 24 aa, Mycobacterium avium
PTKVPRLAAQYAFCNGMSPQQREF

SEQ ID NO: 111934 - protein, 17 aa, Mycobacterium avium
PTLYRWFASKEELLSAF

SEQ ID NO: 111935 - protein, 21 aa, Mycobacterium avium
PTQLPMMLSFLDFRKIPLNGL

SEQ ID NO: 111936 - protein, 18 aa, Mycobacterium avium
PTQLRWRPLSFWPAHTAV

SEQ ID NO: 111937 - protein, 24 aa, Mycobacterium avium
PTRYWPEFCRLMGLHDLAEDPRFT

SEQ ID NO: 111938 - protein, 18 aa, Mycobacterium avium
PTTLPLVGVGHSMGACLT

SEQ ID NO: 111939 - protein, 19 aa, Mycobacterium avium
PVAEAWLQFHVPMSYHGTF

SEQ ID NO: 111940 - protein, 20 aa, Mycobacterium avium
PVAGCTAHWAFVRSASKAYG

SEQ ID NO: 111941 - protein, 21 aa, Mycobacterium avium
PVCRYCRSRDIGVRAVSGKAT

SEQ ID NO: 111942 - protein, 23 aa, Mycobacterium avium
PVFIKRLLDVGAQNLIVPMIDDA

SEQ ID NO: 111943 - protein, 17 aa, Mycobacterium avium
PVFVEWASGALIPCSCV

SEQ ID NO: 111944 - protein, 23 aa, Mycobacterium avium
PVLQRLAALAGRFSSPKSAARQG

SEQ ID NO: 111945 - protein, 24 aa, Mycobacterium avium
PVLQRLAALAGRFSSPKSAARQGD

SEQ ID NO: 111946 - protein, 20 aa, Mycobacterium avium
PVPLADRFGLSKGLPGLAEW

SEQ ID NO: 111947 - protein, 22 aa, Mycobacterium avium
PVPRGRGQACARRARSHLGDLE

SEQ ID NO: 111948 - protein, 17 aa, Mycobacterium avium
PVPVLWLGAGERVSALV

SEQ ID NO: 111949 - protein, 17 aa, Mycobacterium avium
PVQEWQLADGDVIRLGH

SEQ ID NO: 111950 - protein, 18 aa, Mycobacterium avium
PVQEWQLADGDVIRLGHS

SEQ ID NO: 111951 - protein, 20 aa, Mycobacterium avium
PVRNRWGLHPARVAATGQMA

SEQ ID NO: 111952 - protein, 18 aa, Mycobacterium avium
PVRVDTWGGWLWINMDPD

SEQ ID NO: 111953 - protein, 17 aa, Mycobacterium avium
PVRVGFRLGEPAAGELG

SEQ ID NO: 111954 - protein, 21 aa, Mycobacterium avium
PWAVPKFYWSVFATRPFEAAV

SEQ ID NO: 111955 - protein, 19 aa, Mycobacterium avium
PWLAEPWDSVGLVCGDPDE

SEQ ID NO: 111956 - protein, 17 aa, Mycobacterium avium
PWLPHFYLGHGIGPYPA

SEQ ID NO: 111957 - protein, 17 aa, Mycobacterium avium
PWLPHFYLGHGIGTYPA

SEQ ID NO: 111958 - protein, 18 aa, Mycobacterium avium
PWLPHFYLGHGIGTYPAE

SEQ ID NO: 111959 - protein, 17 aa, Mycobacterium avium
PYHLKRLLGRGGMGEVY

SEQ ID NO: 111960 - protein, 20 aa, Mycobacterium avium
PYPGDNVLLCLGMCGQMIYV

SEQ ID NO: 111961 - protein, 19 aa, Mycobacterium avium
QAAGIPVVFLTAYYGLSVL

SEQ ID NO: 111962 - protein, 18 aa, Mycobacterium avium
QAARRVRRVWANIRTEVL

SEQ ID NO: 111963 - protein, 17 aa, Mycobacterium avium
QAAVAFKNFQYTAAAQK

SEQ ID NO: 111964 - protein, 17 aa, Mycobacterium avium
QAGAFVFVMVGTVAQAR

SEQ ID NO: 111965 - protein, 17 aa, Mycobacterium avium
QAGGFIWADPDIERALV

SEQ ID NO: 111966 - protein, 23 aa, Mycobacterium avium
QALSQFVAWPGLLVFQGKAKLLY

SEQ ID NO: 111967 - protein, 23 aa, Mycobacterium avium
QAPRRCVVCGKSFIPQTSQVRTC

SEQ ID NO: 111968 - protein, 22 aa, Mycobacterium avium
QARKVSCPILFAICANDTVAPA

SEQ ID NO: 111969 - protein, 21 aa, Mycobacterium avium
QARKVSCPILFAICENDTVAP

SEQ ID NO: 111970 - protein, 17 aa, Mycobacterium avium
QARSRFDAAWNHQDGDH

SEQ ID NO: 111971 - protein, 17 aa, Mycobacterium avium
QATAFPVEFLSLGTNGI

SEQ ID NO: 111972 - protein, 17 aa, Mycobacterium avium
QATAGAPAHDWLTLTGG

SEQ ID NO: 111973 - protein, 23 aa, Mycobacterium avium
QAVRYEAWSFPDFETGAAALRVV

SEQ ID NO: 111974 - protein, 18 aa, Mycobacterium avium
QCAAEVFLQNGFHATSID

SEQ ID NO: 111975 - protein, 23 aa, Mycobacterium avium
QDEYLRWAVGAFRLATSGVADST

SEQ ID NO: 111976 - protein, 21 aa, Mycobacterium avium
QDRCRGWRMCVSGCPYKKVYF

SEQ ID NO: 111977 - protein, 18 aa, Mycobacterium avium
QEAYRLAASIQRTVMPLD

SEQ ID NO: 111978 - protein, 17 aa, Mycobacterium avium
QEHFFDFIVTPRRGDDG

SEQ ID NO: 111979 - protein, 18 aa, Mycobacterium avium
QEIADALGYRSRQAAQLA

SEQ ID NO: 111980 - protein, 22 aa, Mycobacterium avium
QEIKRPLVTLGMPRTGTTVISY

SEQ ID NO: 111981 - protein, 17 aa, Mycobacterium avium
QEVIPMHECRSAKQLAA

SEQ ID NO: 111982 - protein, 21 aa, Mycobacterium avium
QEVRNALGLRCRWYVSAMETA

SEQ ID NO: 111983 - protein, 17 aa, Mycobacterium avium
QFSDDFIEWSISFSQKP

SEQ ID NO: 111984 - protein, 17 aa, Mycobacterium avium
QGLRLAQTLTPWPATDG

SEQ ID NO: 111985 - protein, 21 aa, Mycobacterium avium
QGLSCAGLVIGAWPEHPGPVE

SEQ ID NO: 111986 - protein, 30 aa, Mycobacterium avium
QGSKELFLWPTLRYWEFPKPMIAQVHGYAI

SEQ ID NO: 111987 - protein, 23 aa, Mycobacterium avium
QGVLCGSIVSGLRIRPGNWAGAY

SEQ ID NO: 111988 - protein, 18 aa, Mycobacterium avium
QHLRRFRENAARGIDMSR

SEQ ID NO: 111989 - protein, 25 aa, Mycobacterium avium
QIKVAIDEFVRWTTPVMTFRRTATQ

SEQ ID NO: 111990 - protein, 17 aa, Mycobacterium avium
QKFAWARLFRPMVHGHP

SEQ ID NO: 111991 - protein, 19 aa, Mycobacterium avium
QKKRWLPGIADGTLTMAFA

SEQ ID NO: 111992 - protein, 19 aa, Mycobacterium avium
QLDRFAIRLELRYLSERDE

SEQ ID NO: 111993 - protein, 19 aa, Mycobacterium avium
QLFKQLLMVAGMERYYQIA

SEQ ID NO: 111994 - protein, 20 aa, Mycobacterium avium
QLFKQLLMVAGMERYYQIAR

SEQ ID NO: 111995 - protein, 21 aa, Mycobacterium avium
QLLRYCLEYGYQLRVIEQMPL

SEQ ID NO: 111996 - protein, 23 aa, Mycobacterium avium
QLQSAPRFANWVDRRFNAALRPG

SEQ ID NO: 111997 - protein, 17 aa, Mycobacterium avium
QLTLPFGAPRTMLNVKI

SEQ ID NO: 111998 - protein, 24 aa, Mycobacterium avium
QLTRKRLGTGLVEAFSTSCPNCGG

SEQ ID NO: 111999 - protein, 17 aa, Mycobacterium avium
QLVGSLSVPQGWANAAT

SEQ ID NO: 112000 - protein, 22 aa, Mycobacterium avium
QMAADLATVWARVRDDDDIHVA

SEQ ID NO: 112001 - protein, 22 aa, Mycobacterium avium
QMAAELAAVWARVRDDEDIRAA

SEQ ID NO: 112002 - protein, 22 aa, Mycobacterium avium
QNLPIYRYWFSPDGMLGFDRGT

SEQ ID NO: 112003 - protein, 18 aa, Mycobacterium avium
QPEIKLGVLPGMGGSQRL

SEQ ID NO: 112004 - protein, 17 aa, Mycobacterium avium
QPLHTMPGISTFYTFYD

SEQ ID NO: 112005 - protein, 17 aa, Mycobacterium avium
QPSACARRQPRRQAAGA

SEQ ID NO: 112006 - protein, 18 aa, Mycobacterium avium
QPWVVSFQLNWPRDHGPT

SEQ ID NO: 112007 - protein, 19 aa, Mycobacterium avium
QQFLRRRAALAINTSSTDD

SEQ ID NO: 112008 - protein, 17 aa, Mycobacterium avium
QRDPQLRECLIERRRAA

SEQ ID NO: 112009 - protein, 17 aa, Mycobacterium avium
QRGATLIAREPIGVCGL

SEQ ID NO: 112010 - protein, 25 aa, Mycobacterium avium
QRGEPARRLGFCHAVPIDLFDKNGA

SEQ ID NO: 112011 - protein, 19 aa, Mycobacterium avium
QRIEPLLARSANWVTGESS

SEQ ID NO: 112012 - protein, 20 aa, Mycobacterium avium
QRIEPLLARSANWVTGESSA

SEQ ID NO: 112013 - protein, 19 aa, Mycobacterium avium
QRIPRKWLESGVIIQADTL

SEQ ID NO: 112014 - protein, 24 aa, Mycobacterium avium
QRLCKGDRAILMWAAANRDPAMFE

SEQ ID NO: 112015 - protein, 20 aa, Mycobacterium avium
QRLTATVLRFNGFAAAGVDE

SEQ ID NO: 112016 - protein, 18 aa, Mycobacterium avium
QRPAAGLGHRVVQAAQVV

SEQ ID NO: 112017 - protein, 17 aa, Mycobacterium avium
QRPSWPGGIAVGKTAVS

SEQ ID NO: 112018 - protein, 19 aa, Mycobacterium avium
QRRAQRLGVQWAVQPQRGR

SEQ ID NO: 112019 - protein, 24 aa, Mycobacterium avium
QRRGLTIDLGFVWTELAGRRLAFV

SEQ ID NO: 112020 - protein, 17 aa, Mycobacterium avium
QRWCALLEWAGIPCDST

SEQ ID NO: 112021 - protein, 18 aa, Mycobacterium avium
QRWKAIRGEAGWMTTYAY

SEQ ID NO: 112022 - protein, 20 aa, Mycobacterium avium
QSARMDLVFSLAERWNPDGE

SEQ ID NO: 112023 - protein, 24 aa, Mycobacterium avium
QSPKETWLRLLLIRAGLPRPQTQI

SEQ ID NO: 112024 - protein, 17 aa, Mycobacterium avium
QSVALLFSRSAEAVASI

SEQ ID NO: 112025 - protein, 17 aa, Mycobacterium avium
QSVALLFSRSAHAIVAI

SEQ ID NO: 112026 - protein, 18 aa, Mycobacterium avium
QTPCAVVAFASWPQQTVL

SEQ ID NO: 112027 - protein, 17 aa, Mycobacterium avium
QVPPRVAALPGPATALT

SEQ ID NO: 112028 - protein, 22 aa, Mycobacterium avium
QWKSVLTSDGWFRTGDRGYLRP

SEQ ID NO: 112029 - protein, 19 aa, Mycobacterium avium
RAAAPGAWCAAPWRGDGHP

SEQ ID NO: 112030 - protein, 20 aa, Mycobacterium avium
RAAGVGFSFGYPVDVRVQDA

SEQ ID NO: 112031 - protein, 17 aa, Mycobacterium avium
RAAHCPLAPPPEFVDWR

SEQ ID NO: 112032 - protein, 24 aa, Mycobacterium avium
RADCALWHGLSWEPAVVARLLEAG

SEQ ID NO: 112033 - protein, 23 aa, Mycobacterium avium
RAEGRYALMPGIIGALAESGTPL

SEQ ID NO: 112034 - protein, 18 aa, Mycobacterium avium
RAELAAWFGRWRDTQITA

SEQ ID NO: 112035 - protein, 17 aa, Mycobacterium avium
RAGLPPTLAVAGGYLDG

SEQ ID NO: 112036 - protein, 17 aa, Mycobacterium avium
RAGWLWSRRRGVIAGRR

SEQ ID NO: 112037 - protein, 22 aa, Mycobacterium avium
RAGWYWRPDIAGVMRVFEDTGE

SEQ ID NO: 112038 - protein, 17 aa, Mycobacterium avium
RAHTPWFHWGTTAVVAR

SEQ ID NO: 112039 - protein, 18 aa, Mycobacterium avium
RAKEAGGRIFGRIVNTAS

SEQ ID NO: 112040 - protein, 18 aa, Mycobacterium avium
RAKLNWWESRALYGWTVL

SEQ ID NO: 112041 - protein, 17 aa, Mycobacterium avium
RALELGCGTGFFLLNLI

SEQ ID NO: 112042 - protein, 19 aa, Mycobacterium avium
RALVCSPFFATVALATQAI

SEQ ID NO: 112043 - protein, 20 aa, Mycobacterium avium
RAMREWARLDPVAAENIRAA

SEQ ID NO: 112044 - protein, 19 aa, Mycobacterium avium
RAPTVQLCRDPKGYVPIGR

SEQ ID NO: 112045 - protein, 20 aa, Mycobacterium avium
RAQAQVVAWWSPAYHEPNGG

SEQ ID NO: 112046 - protein, 21 aa, Mycobacterium avium
RARAGWLWSRRRGVIAGLSAA

SEQ ID NO: 112047 - protein, 42 aa, Mycobacterium avium
RARLWKFGMTGARCRACGFMHLPPVRVCRSCNAIDEMDPQSA

SEQ ID NO: 112048 - protein, 19 aa, Mycobacterium avium
RARRGLAFQLVEGAAKLGR

SEQ ID NO: 112049 - protein, 20 aa, Mycobacterium avium
RARSRLNPGAGLMLSAVWAS

SEQ ID NO: 112050 - protein, 19 aa, Mycobacterium avium
RARWLPRLVSGDMVVGIGA

SEQ ID NO: 112051 - protein, 18 aa, Mycobacterium avium
RASIAISVGNRWTEIMER

SEQ ID NO: 112052 - protein, 17 aa, Mycobacterium avium
RAVACFDAALALWRGIP

SEQ ID NO: 112053 - protein, 19 aa, Mycobacterium avium
RAVAFRRFRAADVRSILAA

SEQ ID NO: 112054 - protein, 22 aa, Mycobacterium avium
RAVIPRDHIKSVLESADVVIWT

SEQ ID NO: 112055 - protein, 18 aa, Mycobacterium avium
RAWRQWWTWMPGACWRQP

SEQ ID NO: 112056 - protein, 19 aa, Mycobacterium avium
RAYRLAWPAGTTVFEIDQP

SEQ ID NO: 112057 - protein, 21 aa, Mycobacterium avium
RAYRLPWPAGTVVYEVDMPDV

SEQ ID NO: 112058 - protein, 19 aa, Mycobacterium avium
RAYRLTWPAGTVVFEVDQP

SEQ ID NO: 112059 - protein, 29 aa, Mycobacterium avium
RAYSPRFLWLWPNARISVMGGEQAASVLA

SEQ ID NO: 112060 - protein, 17 aa, Mycobacterium avium
RDEFPLGPAGKILKREI

SEQ ID NO: 112061 - protein, 18 aa, Mycobacterium avium
RDEWPPLYVFGTRTVPQI

SEQ ID NO: 112062 - protein, 17 aa, Mycobacterium avium
RDGWQPGGIVVVGAHSD

SEQ ID NO: 112063 - protein, 23 aa, Mycobacterium avium
RDHAKPGYIGYAWTAMEPVNAIP

SEQ ID NO: 112064 - protein, 17 aa, Mycobacterium avium
RDIAAEIGLPVMVKAQV

SEQ ID NO: 112065 - protein, 17 aa, Mycobacterium avium
RDLALACVRAWNDWHFE

SEQ ID NO: 112066 - protein, 22 aa, Mycobacterium avium
RDPEFAAGFARLYNRWVADYCA

SEQ ID NO: 112067 - protein, 17 aa, Mycobacterium avium
RDRGCPEPEPLSPELIR

SEQ ID NO: 112068 - protein, 17 aa, Mycobacterium avium
RDRVRWHGWSAGPGPAL

SEQ ID NO: 112069 - protein, 22 aa, Mycobacterium avium
RDWAAKVYGAWNLHLALQESGA

SEQ ID NO: 112070 - protein, 25 aa, Mycobacterium avium
REAPAWRKLFYEDFLPVDKNPAINI

SEQ ID NO: 112071 - protein, 23 aa, Mycobacterium avium
REFRRKVALCLDVFATMLARSCF

SEQ ID NO: 112072 - protein, 21 aa, Mycobacterium avium
REFSDVFGVLFPGGEGRLRLT

SEQ ID NO: 112073 - protein, 19 aa, Mycobacterium avium
REGLQIPLLIGGATTSRAH

SEQ ID NO: 112074 - protein, 18 aa, Mycobacterium avium
REIACAYDLEFVDPADVK

SEQ ID NO: 112075 - protein, 21 aa, Mycobacterium avium
REIWRGTLVFYIRRGTLYIDY

SEQ ID NO: 112076 - protein, 19 aa, Mycobacterium avium
RELASWPALLRGKRSVTLD

SEQ ID NO: 112077 - protein, 18 aa, Mycobacterium avium
RELLGILCDLYALSVIED

SEQ ID NO: 112078 - protein, 21 aa, Mycobacterium avium
RELLGILCDLYALSVIEDDKA

SEQ ID NO: 112079 - protein, 17 aa, Mycobacterium avium
RELPESIIIAGAGAIGM

SEQ ID NO: 112080 - protein, 17 aa, Mycobacterium avium
RELPRSGAEFLGILGQL

SEQ ID NO: 112081 - protein, 20 aa, Mycobacterium avium
RELPWRRPIASLNYLLTSHV

SEQ ID NO: 112082 - protein, 20 aa, Mycobacterium avium
RELQVQFGLGSIRALLEKAV

SEQ ID NO: 112083 - protein, 21 aa, Mycobacterium avium
RELVGVFVLQAWHTSGSATYL

SEQ ID NO: 112084 - protein, 18 aa, Mycobacterium avium
RENLSWSAPRLHLVDLQY

SEQ ID NO: 112085 - protein, 22 aa, Mycobacterium avium
RENLSWSAPRLHLVDLQYSDVR

SEQ ID NO: 112086 - protein, 21 aa, Mycobacterium avium
REPRGVLAIAYRCPNGEPGVV

SEQ ID NO: 112087 - protein, 20 aa, Mycobacterium avium
REPRWPRYAPAAVQLGVLSS

SEQ ID NO: 112088 - protein, 24 aa, Mycobacterium avium
RERLPILCGLDLTRKVAMTPDHLT

SEQ ID NO: 112089 - protein, 18 aa, Mycobacterium avium
REVHRLRQPVLLIWGRED

SEQ ID NO: 112090 - protein, 19 aa, Mycobacterium avium
REVHRLRQPVLLIWGREDR

SEQ ID NO: 112091 - protein, 18 aa, Mycobacterium avium
REVLPPLARRVAPPRPER

SEQ ID NO: 112092 - protein, 17 aa, Mycobacterium avium
REYGVRVLVIRPGQVRT

SEQ ID NO: 112093 - protein, 17 aa, Mycobacterium avium
RFDRISYTWIPRERNSH

SEQ ID NO: 112094 - protein, 19 aa, Mycobacterium avium
RFRFVEEMIRLGADARTDG

SEQ ID NO: 112095 - protein, 18 aa, Mycobacterium avium
RFVKGITQEAVFQKRAPA

SEQ ID NO: 112096 - protein, 24 aa, Mycobacterium avium
RGAEYRLAGQIAHRGAFGGAQLLD

SEQ ID NO: 112097 - protein, 21 aa, Mycobacterium avium
RGANRSTRRWHWLDPQTRDAL

SEQ ID NO: 112098 - protein, 19 aa, Mycobacterium avium
RGAPHIHLWMAPPISPGRS

SEQ ID NO: 112099 - protein, 19 aa, Mycobacterium avium
RGCAIPGCGATRGLHAHHL

SEQ ID NO: 112100 - protein, 20 aa, Mycobacterium avium
RGCAIPGCGATRGLQAHHLR

SEQ ID NO: 112101 - protein, 20 aa, Mycobacterium avium
RGCSHACRYCFARPSHEYLE

SEQ ID NO: 112102 - protein, 20 aa, Mycobacterium avium
RGDQRLWAVTGFEGRGENRS

SEQ ID NO: 112103 - protein, 18 aa, Mycobacterium avium
RGFCWSRGDGLCNVFVPH

SEQ ID NO: 112104 - protein, 20 aa, Mycobacterium avium
RGFCWSRGDGLCNVFVPHAT

SEQ ID NO: 112105 - protein, 23 aa, Mycobacterium avium
RGFCWSRGDGLCNVFVPHATAGV

SEQ ID NO: 112106 - protein, 18 aa, Mycobacterium avium
RGFSRWLMRAYDVLIDED

SEQ ID NO: 112107 - protein, 22 aa, Mycobacterium avium
RGFTWRSFCARDFAAHGLNLDV

SEQ ID NO: 112108 - protein, 17 aa, Mycobacterium avium
RGGGVALLLTNIREHGA

SEQ ID NO: 112109 - protein, 22 aa, Mycobacterium avium
RGGLRLGRRSALAVAARQVLGV

SEQ ID NO: 112110 - protein, 18 aa, Mycobacterium avium
RGHHLLKTFWGWRDRQLP

SEQ ID NO: 112111 - protein, 18 aa, Mycobacterium avium
RGHTRNCRLHWVQIIPTI

SEQ ID NO: 112112 - protein, 20 aa, Mycobacterium avium
RGLAEIPWRLSIFGDGPDRQ

SEQ ID NO: 112113 - protein, 17 aa, Mycobacterium avium
RGLTSMWRRGDEIFAEV

SEQ ID NO: 112114 - protein, 23 aa, Mycobacterium avium
RGMPWEFECLVAYPDGTTDIYHT

SEQ ID NO: 112115 - protein, 18 aa, Mycobacterium avium
RGPGRFWGVYGLKKAIAV

SEQ ID NO: 112116 - protein, 17 aa, Mycobacterium avium
RGPLQWEAPYGHTLISK

SEQ ID NO: 112117 - protein, 20 aa, Mycobacterium avium
RGQLGFGDFRPGRRFAGPHS

SEQ ID NO: 112118 - protein, 17 aa, Mycobacterium avium
RGRFRWMGLYTQREQGY

SEQ ID NO: 112119 - protein, 17 aa, Mycobacterium avium
RGRLREVDPAQILETLD

SEQ ID NO: 112120 - protein, 18 aa, Mycobacterium avium
RGRLRYPHWVPAAVAPEQ

SEQ ID NO: 112121 - protein, 19 aa, Mycobacterium avium
RGRLRYPHWVPAAVAPEQV

SEQ ID NO: 112122 - protein, 21 aa, Mycobacterium avium
RGTHALRFIRSCSAPLTAETA

SEQ ID NO: 112123 - protein, 17 aa, Mycobacterium avium
RGVGWKVLRDAGRVVSV

SEQ ID NO: 112124 - protein, 18 aa, Mycobacterium avium
RGVILGTGGFEWDPVLVQ

SEQ ID NO: 112125 - protein, 20 aa, Mycobacterium avium
RGVLFPKHRTDLIGCAVTAQ

SEQ ID NO: 112126 - protein, 17 aa, Mycobacterium avium
RGYRCVLTMPETMSVER

SEQ ID NO: 112127 - protein, 24 aa, Mycobacterium avium
RGYWKRPGLTAARFVANPFGAEPG

SEQ ID NO: 112128 - protein, 19 aa, Mycobacterium avium
RHFGCGFAPSGWDTLTKHL

SEQ ID NO: 112129 - protein, 18 aa, Mycobacterium avium
RHFLWSVPAEWAVPGMEL

SEQ ID NO: 112130 - protein, 17 aa, Mycobacterium avium
RHFPTKESVLFQDYETQ

SEQ ID NO: 112131 - protein, 18 aa, Mycobacterium avium
RHGRRWRADFAWPAHDPV

SEQ ID NO: 112132 - protein, 18 aa, Mycobacterium avium
RHGRRWRADFAWPASMVL

SEQ ID NO: 112133 - protein, 20 aa, Mycobacterium avium
RHPRLLPGRMPAPVRRRHRR

SEQ ID NO: 112134 - protein, 17 aa, Mycobacterium avium
RHRRLSYAGAMTALTAG

SEQ ID NO: 112135 - protein, 21 aa, Mycobacterium avium
RIAAMLAEVMELFAAGALTPL

SEQ ID NO: 112136 - protein, 18 aa, Mycobacterium avium
RIEPLLARSANWVTGESS

SEQ ID NO: 112137 - protein, 17 aa, Mycobacterium avium
RINGFAIIRAFLEIPYK

SEQ ID NO: 112138 - protein, 19 aa, Mycobacterium avium
RISGGLGVRFARPGETVVT

SEQ ID NO: 112139 - protein, 18 aa, Mycobacterium avium
RISYAEACRRLREAKQLS

SEQ ID NO: 112140 - protein, 17 aa, Mycobacterium avium
RITALMCTADILALSAM

SEQ ID NO: 112141 - protein, 17 aa, Mycobacterium avium
RKADAALGRPVISNQVH

SEQ ID NO: 112142 - protein, 18 aa, Mycobacterium avium
RKGDRLWRGPQLPHHVQE

SEQ ID NO: 112143 - protein, 17 aa, Mycobacterium avium
RKHFPGAVQTHFWSAQD

SEQ ID NO: 112144 - protein, 17 aa, Mycobacterium avium
RKRARSLYRETLRHITE

SEQ ID NO: 112145 - protein, 17 aa, Mycobacterium avium
RKRLPMYFWVAGWETCR

SEQ ID NO: 112146 - protein, 24 aa, Mycobacterium avium
RKSRTEMAWCFPAVPLVVRAPAAK

SEQ ID NO: 112147 - protein, 20 aa, Mycobacterium avium
RLAKRLPEYMVPAAVVVLDA

SEQ ID NO: 112148 - protein, 23 aa, Mycobacterium avium
RLALGVGPSHHWIIRDMLGLPYQ

SEQ ID NO: 112149 - protein, 23 aa, Mycobacterium avium
RLARISERWQRLGLNLNAADLFY

SEQ ID NO: 112150 - protein, 22 aa, Mycobacterium avium
RLCGLGLGIGRPVALHSKKANK

SEQ ID NO: 112151 - protein, 20 aa, Mycobacterium avium
RLEGGRCLLDLRTVSPEDDE

SEQ ID NO: 112152 - protein, 18 aa, Mycobacterium avium
RLGAHIAFDPDDITGAIA

SEQ ID NO: 112153 - protein, 21 aa, Mycobacterium avium
RLGEALALLGWNMSLSNLRWD

SEQ ID NO: 112154 - protein, 21 aa, Mycobacterium avium
RLGESLALLGWNMSVSNLRWD

SEQ ID NO: 112155 - protein, 23 aa, Mycobacterium avium
RLGSDMGEFFMPYPGTRINQDST

SEQ ID NO: 112156 - protein, 18 aa, Mycobacterium avium
RLHYLRWLLFDVGSGLHF

SEQ ID NO: 112157 - protein, 27 aa, Mycobacterium avium
RLIARELPEIFPLLILCIDELGAWAGQ

SEQ ID NO: 112158 - protein, 19 aa, Mycobacterium avium
RLILADAIVRACEDNPDYL

SEQ ID NO: 112159 - protein, 18 aa, Mycobacterium avium
RLIPHWVWILGYRIYLWD

SEQ ID NO: 112160 - protein, 17 aa, Mycobacterium avium
RLIPPWVTLGSRLAALP

SEQ ID NO: 112161 - protein, 17 aa, Mycobacterium avium
RLKRTLLAGTRWGDPDA

SEQ ID NO: 112162 - protein, 18 aa, Mycobacterium avium
RLLCEQVGAAALVIPEEL

SEQ ID NO: 112163 - protein, 17 aa, Mycobacterium avium
RLLGYSAFLGGPDRYLT

SEQ ID NO: 112164 - protein, 17 aa, Mycobacterium avium
RLLSVLMDPAWTPGVAA

SEQ ID NO: 112165 - protein, 19 aa, Mycobacterium avium
RLMIASVLWWRHVDEVYAA

SEQ ID NO: 112166 - protein, 21 aa, Mycobacterium avium
RLPAPPSYRSYLMWLSAQDRA

SEQ ID NO: 112167 - protein, 23 aa, Mycobacterium avium
RLPDSRLWWLLNLVITRGTPPRL

SEQ ID NO: 112168 - protein, 25 aa, Mycobacterium avium
RLPDSRLWWLLNLVITRGTPPRLEG

SEQ ID NO: 112169 - protein, 18 aa, Mycobacterium avium
RLQAQILRRAPQRARVVA

SEQ ID NO: 112170 - protein, 25 aa, Mycobacterium avium
RLRDGRWCWHWDPAFMTKPGDDPEL

SEQ ID NO: 112171 - protein, 22 aa, Mycobacterium avium
RLRDIGGIVVIDFIDMVLESNR

SEQ ID NO: 112172 - protein, 22 aa, Mycobacterium avium
RLRIEYCDGCARWVHPASGRCR

SEQ ID NO: 112173 - protein, 20 aa, Mycobacterium avium
RLRLARCVVEDGWSLRRAAE

SEQ ID NO: 112174 - protein, 21 aa, Mycobacterium avium
RLRPSEIQWALNHDAVHGIAY

SEQ ID NO: 112175 - protein, 21 aa, Mycobacterium avium
RLRRADVRGAYRIAGPLNVPG

SEQ ID NO: 112176 - protein, 23 aa, Mycobacterium avium
RLRRADVRGAYRIAGPLNVPGSR

SEQ ID NO: 112177 - protein, 20 aa, Mycobacterium avium
RLRSTPALRRLVAQTSLEPR

SEQ ID NO: 112178 - protein, 19 aa, Mycobacterium avium
RLSAIASIGSDVWDRLFSG

SEQ ID NO: 112179 - protein, 17 aa, Mycobacterium avium
RLSWDFLARSTAGLRDW

SEQ ID NO: 112180 - protein, 27 aa, Mycobacterium avium
RLTIAMTRWRAGVSWAGSRPVRAELAV

SEQ ID NO: 112181 - protein, 27 aa, Mycobacterium avium
RLTIAMTRWRGGVGWAGSRPVRAELAV

SEQ ID NO: 112182 - protein, 27 aa, Mycobacterium avium
RLTIAMTRWRGGVSWAGSRPVRAELAV

SEQ ID NO: 112183 - protein, 19 aa, Mycobacterium avium
RLTPASAAKLIWSQMRDVL

SEQ ID NO: 112184 - protein, 18 aa, Mycobacterium avium
RLVDFAAGLAFALRGSFD

SEQ ID NO: 112185 - protein, 19 aa, Mycobacterium avium
RLVDFAAGLAFALRGSFDK

SEQ ID NO: 112186 - protein, 24 aa, Mycobacterium avium
RLVEVLRFPAKFFTTAPTSRVHPS

SEQ ID NO: 112187 - protein, 25 aa, Mycobacterium avium
RLVGLRARAKAAFAEREGVNLTFLP

SEQ ID NO: 112188 - protein, 26 aa, Mycobacterium avium
RLVGLRARAKAAFAEREGVNLTFLPF

SEQ ID NO: 112189 - protein, 20 aa, Mycobacterium avium
RMASGEMRATMALTEPGGGS

SEQ ID NO: 112190 - protein, 19 aa, Mycobacterium avium
RMDLTFSVGERWCESGEPG

SEQ ID NO: 112191 - protein, 18 aa, Mycobacterium avium
RMDLTFSVGERWSESGEP

SEQ ID NO: 112192 - protein, 19 aa, Mycobacterium avium
RMHGYWALHEGCLQLRGDA

SEQ ID NO: 112193 - protein, 17 aa, Mycobacterium avium
RNCIEWPEISFGLAKAG

SEQ ID NO: 112194 - protein, 17 aa, Mycobacterium avium
RNLPSGFQLKDYRDDEG

SEQ ID NO: 112195 - protein, 19 aa, Mycobacterium avium
RPAAHPGLRRAPPLRLGHR

SEQ ID NO: 112196 - protein, 18 aa, Mycobacterium avium
RPARAAVIAPSFTEPAAA

SEQ ID NO: 112197 - protein, 19 aa, Mycobacterium avium
RPATPVSVPARFAAQAART

SEQ ID NO: 112198 - protein, 22 aa, Mycobacterium avium
RPATVVEFGMSFGISAVHLAAA

SEQ ID NO: 112199 - protein, 17 aa, Mycobacterium avium
RPAVMPMDAWRDGDQFV

SEQ ID NO: 112200 - protein, 18 aa, Mycobacterium avium
RPDFKTRILQAFNDGMKH

SEQ ID NO: 112201 - protein, 22 aa, Mycobacterium avium
RPDLDVDLVYRFIRDTTWVSVR

SEQ ID NO: 112202 - protein, 23 aa, Mycobacterium avium
RPELPLRVGDTWEEAGPDGDRIF

SEQ ID NO: 112203 - protein, 19 aa, Mycobacterium avium
RPGQYVRLHWARPRALAGA

SEQ ID NO: 112204 - protein, 19 aa, Mycobacterium avium
RPGRQWCALAGPHGGFGGA

SEQ ID NO: 112205 - protein, 20 aa, Mycobacterium avium
RPGRWWCWWTASWPGSWSGA

SEQ ID NO: 112206 - protein, 18 aa, Mycobacterium avium
RPGVPVLFLDTGYHFAET

SEQ ID NO: 112207 - protein, 18 aa, Mycobacterium avium
RPGVPVLFLDTGYHFPET

SEQ ID NO: 112208 - protein, 19 aa, Mycobacterium avium
RPHAAICCTECSRARLNAV

SEQ ID NO: 112209 - protein, 21 aa, Mycobacterium avium
RPKLPGIPGIKTFGGHSFHSS

SEQ ID NO: 112210 - protein, 28 aa, Mycobacterium avium
RPLDGFPQRRARLMMEMHVLGPLHLCQL

SEQ ID NO: 112211 - protein, 19 aa, Mycobacterium avium
RPLFDGPFYAVRMVLSDLG

SEQ ID NO: 112212 - protein, 18 aa, Mycobacterium avium
RPLMAEAMLRVFFEAYEI

SEQ ID NO: 112213 - protein, 18 aa, Mycobacterium avium
RPLPVTRFDVRRAPAALR

SEQ ID NO: 112214 - protein, 22 aa, Mycobacterium avium
RPPALDTEKGWFFGSNLQQAPG

SEQ ID NO: 112215 - protein, 26 aa, Mycobacterium avium
RPQLAVTFRNGWQWATVEGRAELVGP

SEQ ID NO: 112216 - protein, 19 aa, Mycobacterium avium
RPRAVIYHRGLGPKFADVL

SEQ ID NO: 112217 - protein, 19 aa, Mycobacterium avium
RPRCRFPGKCGGWPAARSG

SEQ ID NO: 112218 - protein, 18 aa, Mycobacterium avium
RPRGRVFPIGSFGNTGFT

SEQ ID NO: 112219 - protein, 19 aa, Mycobacterium avium
RPRGRVFPIGSFGNTGFTG

SEQ ID NO: 112220 - protein, 19 aa, Mycobacterium avium
RPRIFDLFDRILKALAPEA

SEQ ID NO: 112221 - protein, 17 aa, Mycobacterium avium
RPRSSRMARWWVIWPSV

SEQ ID NO: 112222 - protein, 19 aa, Mycobacterium avium
RPSDSVAIALRVGVPIYVE

SEQ ID NO: 112223 - protein, 18 aa, Mycobacterium avium
RPSPFYIMDEVEAALDDT

SEQ ID NO: 112224 - protein, 20 aa, Mycobacterium avium
RPTGEWAAAIARLADAEVAV

SEQ ID NO: 112225 - protein, 18 aa, Mycobacterium avium
RPTLKAKILPIIAGTLFP

SEQ ID NO: 112226 - protein, 20 aa, Mycobacterium avium
RPYRLSWPAGTTVYEIDQPE

SEQ ID NO: 112227 - protein, 17 aa, Mycobacterium avium
RQARIGITATWVRFYDF

SEQ ID NO: 112228 - protein, 18 aa, Mycobacterium avium
RQFTCKYHAWRYSLDGDL

SEQ ID NO: 112229 - protein, 19 aa, Mycobacterium avium
RQHRCFPVLAGALGEHDLL

SEQ ID NO: 112230 - protein, 19 aa, Mycobacterium avium
RRAPPLRLGHRAVTGERVQ

SEQ ID NO: 112231 - protein, 20 aa, Mycobacterium avium
RRARLLALRLRRLHYRHRRP

SEQ ID NO: 112232 - protein, 20 aa, Mycobacterium avium
RRARLLALRLRRLHYRRRRP

SEQ ID NO: 112233 - protein, 21 aa, Mycobacterium avium
RRARLLALRLRRLYYRHRRPA

SEQ ID NO: 112234 - protein, 21 aa, Mycobacterium avium
RRARRAVAEFRIRGVSTNIPF

SEQ ID NO: 112235 - protein, 24 aa, Mycobacterium avium
RRCREVTSLLGLFGRLVEIIGVDC

SEQ ID NO: 112236 - protein, 17 aa, Mycobacterium avium
RRDGRFVVALGMGGMGN

SEQ ID NO: 112237 - protein, 18 aa, Mycobacterium avium
RRELPIVHVVRLYRADGS

SEQ ID NO: 112238 - protein, 25 aa, Mycobacterium avium
RREMAYEGKIDWAFAELLALGSLVA

SEQ ID NO: 112239 - protein, 23 aa, Mycobacterium avium
RRGLTIDLGFVWTELAGRRLAFV

SEQ ID NO: 112240 - protein, 18 aa, Mycobacterium avium
RRLIPPWVTLGSRLAALP

SEQ ID NO: 112241 - protein, 19 aa, Mycobacterium avium
RRLSGEINRPVSFALIQVD

SEQ ID NO: 112242 - protein, 17 aa, Mycobacterium avium
RRLSYAGAMTALTAGAI

SEQ ID NO: 112243 - protein, 18 aa, Mycobacterium avium
RRMFDLLVRMGYKEIEVG

SEQ ID NO: 112244 - protein, 19 aa, Mycobacterium avium
RRPDAEWLGVAAFQQARAA

SEQ ID NO: 112245 - protein, 24 aa, Mycobacterium avium
RRPRSVIDPGYRYEFIEGDDEVVA

SEQ ID NO: 112246 - protein, 25 aa, Mycobacterium avium
RRPRSVIDPGYRYEFIESDDEPVAV

SEQ ID NO: 112247 - protein, 18 aa, Mycobacterium avium
RRRIRWGARAMLWQASSL

SEQ ID NO: 112248 - protein, 23 aa, Mycobacterium avium
RRRWPGWSRPVASRRSWWSASTG

SEQ ID NO: 112249 - protein, 17 aa, Mycobacterium avium
RRRYECRSLRFAAASGS

SEQ ID NO: 112250 - protein, 24 aa, Mycobacterium avium
RRSGFKEIHDHGGFLCGATTFDPE

SEQ ID NO: 112251 - protein, 23 aa, Mycobacterium avium
RRSRFPQRWWWVALTDEAYPRLA

SEQ ID NO: 112252 - protein, 21 aa, Mycobacterium avium
RRTVWIPWALGPAAAVLRMLP

SEQ ID NO: 112253 - protein, 17 aa, Mycobacterium avium
RRVVPEIPRWPTRARRR

SEQ ID NO: 112254 - protein, 18 aa, Mycobacterium avium
RRVVPEIPRWPTRARRRL

SEQ ID NO: 112255 - protein, 23 aa, Mycobacterium avium
RRWLLVELRSDWTLGTRTYAAGS

SEQ ID NO: 112256 - protein, 20 aa, Mycobacterium avium
RRWRADFAWPASMVLAEYDS

SEQ ID NO: 112257 - protein, 18 aa, Mycobacterium avium
RRYEIGKVIALTNPVSGH

SEQ ID NO: 112258 - protein, 19 aa, Mycobacterium avium
RRYGVRWHYRVPAWSEFVE

SEQ ID NO: 112259 - protein, 18 aa, Mycobacterium avium
RSAAKAWGSEGITVNAIA

SEQ ID NO: 112260 - protein, 23 aa, Mycobacterium avium
RSCSIKHRMASVIFSLEMSKSEI

SEQ ID NO: 112261 - protein, 24 aa, Mycobacterium avium
RSCSIKHRMASVIFSLEMSKSEIV

SEQ ID NO: 112262 - protein, 17 aa, Mycobacterium avium
RSGRIASLHARRVYAND

SEQ ID NO: 112263 - protein, 18 aa, Mycobacterium avium
RSIPKDAWLDRIGEVSDA

SEQ ID NO: 112264 - protein, 17 aa, Mycobacterium avium
RSLRWVAVHTAHEAQHH

SEQ ID NO: 112265 - protein, 17 aa, Mycobacterium avium
RSPASWLRCDVTSVNSV

SEQ ID NO: 112266 - protein, 19 aa, Mycobacterium avium
RSRGPWPWLQPDRNGAPPV

SEQ ID NO: 112267 - protein, 26 aa, Mycobacterium avium
RSRLALRLLGPLLRPLLRTILIVQRR

SEQ ID NO: 112268 - protein, 27 aa, Mycobacterium avium
RSRLALRLLGPLLRPLLRTILIVQRRL

SEQ ID NO: 112269 - protein, 20 aa, Mycobacterium avium
RSRLMLDIASWRRRRREELA

SEQ ID NO: 112270 - protein, 17 aa, Mycobacterium avium
RSRSHVVTFPRDLTDRA

SEQ ID NO: 112271 - protein, 19 aa, Mycobacterium avium
RSSVGTWLFGIVKHTAARH

SEQ ID NO: 112272 - protein, 17 aa, Mycobacterium avium
RSWLSLHAKEFASSGDD

SEQ ID NO: 112273 - protein, 17 aa, Mycobacterium avium
RSWRVPVTAFWQAHRDA

SEQ ID NO: 112274 - protein, 17 aa, Mycobacterium avium
RTAGMAPYMVRVLGTTA

SEQ ID NO: 112275 - protein, 24 aa, Mycobacterium avium
RTDVCLRPGDVLYLPRGQVHSART

SEQ ID NO: 112276 - protein, 19 aa, Mycobacterium avium
RTFSLGSWWSGVAWSTIKV

SEQ ID NO: 112277 - protein, 22 aa, Mycobacterium avium
RTGESFCLKGWTSLGVTGRATH

SEQ ID NO: 112278 - protein, 25 aa, Mycobacterium avium
RTGIYGHARACGWAIRDGVVGPSST

SEQ ID NO: 112279 - protein, 17 aa, Mycobacterium avium
RTGVFWIREMLPIGELR

SEQ ID NO: 112280 - protein, 20 aa, Mycobacterium avium
RTIRLPVHLVEQVNKLARIK

SEQ ID NO: 112281 - protein, 24 aa, Mycobacterium avium
RTKALELNPAFALQQCMDAMQRAG

SEQ ID NO: 112282 - protein, 17 aa, Mycobacterium avium
RTPIDWDGYTPPVPATG

SEQ ID NO: 112283 - protein, 24 aa, Mycobacterium avium
RTPSVDVFNGWRITSHQGGYFAQS

SEQ ID NO: 112284 - protein, 18 aa, Mycobacterium avium
RTPTIASVHGWCIGGGVD

SEQ ID NO: 112285 - protein, 19 aa, Mycobacterium avium
RTPTIASVHGWCIGGGVDL

SEQ ID NO: 112286 - protein, 23 aa, Mycobacterium avium
RTRACGYRRLYLITGNRQPEAEA

SEQ ID NO: 112287 - protein, 20 aa, Mycobacterium avium
RTRLRAAALPARRHRRTARR

SEQ ID NO: 112288 - protein, 20 aa, Mycobacterium avium
RTSAWWWPPTCRPRRWPTPS

SEQ ID NO: 112289 - protein, 19 aa, Mycobacterium avium
RTSTCWAKSAGLCPTSPRW

SEQ ID NO: 112290 - protein, 24 aa, Mycobacterium avium
RVEPEMLRRALLYAIERKRAELIA

SEQ ID NO: 112291 - protein, 20 aa, Mycobacterium avium
RVGLRLGRRSALAVAARQVL

SEQ ID NO: 112292 - protein, 20 aa, Mycobacterium avium
RVIRTLRRLGIRSVAVYSDP

SEQ ID NO: 112293 - protein, 20 aa, Mycobacterium avium
RVKCALLGWMACKDALAQAY

SEQ ID NO: 112294 - protein, 19 aa, Mycobacterium avium
RVRAALLAARRGRIQPGRD

SEQ ID NO: 112295 - protein, 18 aa, Mycobacterium avium
RWITPVSYTLPFRTVSGT

SEQ ID NO: 112296 - protein, 17 aa, Mycobacterium avium
RWTCVFGTPACRGTVAG

SEQ ID NO: 112297 - protein, 17 aa, Mycobacterium avium
RYDVRRLADLAGAYTKA

SEQ ID NO: 112298 - protein, 23 aa, Mycobacterium avium
RYDWPVRTGIIIGRLDDDGSRFL

SEQ ID NO: 112299 - protein, 23 aa, Mycobacterium avium
RYDWPVRTGIIIGRLDDGSRFLA

SEQ ID NO: 112300 - protein, 18 aa, Mycobacterium avium
RYPGWPFRIAPGPRRHHR

SEQ ID NO: 112301 - protein, 18 aa, Mycobacterium avium
RYRLALVTVDPRGPQYDE

SEQ ID NO: 112302 - protein, 18 aa, Mycobacterium avium
RYRMVVCEEVSRVTALSF

SEQ ID NO: 112303 - protein, 18 aa, Mycobacterium avium
RYTCKGEGIAPPLAWSAP

SEQ ID NO: 112304 - protein, 20 aa, Mycobacterium avium
RYTCKGEGIAPPLAWSAPTG

SEQ ID NO: 112305 - protein, 24 aa, Mycobacterium avium
SAGLRARSAWLWSRRRGVVAGRSA

SEQ ID NO: 112306 - protein, 19 aa, Mycobacterium avium
SAITFSIKNMWGLLTVRGR

SEQ ID NO: 112307 - protein, 24 aa, Mycobacterium avium
SALLVPVAVEWTRYYAGWADKISS

SEQ ID NO: 112308 - protein, 17 aa, Mycobacterium avium
SAMPGGWAAAPSPGPTV

SEQ ID NO: 112309 - protein, 19 aa, Mycobacterium avium
SAPNPAVIAAVEWVGTVDA

SEQ ID NO: 112310 - protein, 17 aa, Mycobacterium avium
SAQLLPRFETITYSEVA

SEQ ID NO: 112311 - protein, 20 aa, Mycobacterium avium
SAQPRPRCPATRRAEEQLVA

SEQ ID NO: 112312 - protein, 24 aa, Mycobacterium avium
SAQRLRIGEAWAKLPHDWIERYEA

SEQ ID NO: 112313 - protein, 21 aa, Mycobacterium avium
SARLASALTHTWVSTTDEDAG

SEQ ID NO: 112314 - protein, 18 aa, Mycobacterium avium
SARLGERALICFGGTDVR

SEQ ID NO: 112315 - protein, 24 aa, Mycobacterium avium
SASGPRLHANWTWAPSALDDQQIA

SEQ ID NO: 112316 - protein, 18 aa, Mycobacterium avium
SASIAALFDAHSQVYQAL

SEQ ID NO: 112317 - protein, 17 aa, Mycobacterium avium
SAVAFGALLSRGIGDTI

SEQ ID NO: 112318 - protein, 17 aa, Mycobacterium avium
SAWTCFSRGGFHATSMD

SEQ ID NO: 112319 - protein, 20 aa, Mycobacterium avium
SAYFPLGWQLACHVQGDAGV

SEQ ID NO: 112320 - protein, 20 aa, Mycobacterium avium
SAYLLSLRAAWQADNEIPNS

SEQ ID NO: 112321 - protein, 18 aa, Mycobacterium avium
SCKSCPSSAVTLELTVED

SEQ ID NO: 112322 - protein, 19 aa, Mycobacterium avium
SCPVCLYAGSIMRDDLLAL

SEQ ID NO: 112323 - protein, 18 aa, Mycobacterium avium
SDALRWGLINEVVPDGTV

SEQ ID NO: 112324 - protein, 18 aa, Mycobacterium avium
SDEERAAAVAARLQVGSV

SEQ ID NO: 112325 - protein, 20 aa, Mycobacterium avium
SDELPPLWRAFGASRRADGH

SEQ ID NO: 112326 - protein, 17 aa, Mycobacterium avium
SDFKGRKVIVYFYPAAL

SEQ ID NO: 112327 - protein, 17 aa, Mycobacterium avium
SDIGYNCHLIFRTDLYR

SEQ ID NO: 112328 - protein, 19 aa, Mycobacterium avium
SDLLVIFGITGDLARKMTF

SEQ ID NO: 112329 - protein, 19 aa, Mycobacterium avium
SDQRLRVIGVTWNDEASVP

SEQ ID NO: 112330 - protein, 19 aa, Mycobacterium avium
SDYQLRFRWSAGAVVLWDN

SEQ ID NO: 112331 - protein, 23 aa, Mycobacterium avium
SEDLKRLWPSLGTALMSLADGAD

SEQ ID NO: 112332 - protein, 20 aa, Mycobacterium avium
SEDLKRLWPSLGTALTSLAD

SEQ ID NO: 112333 - protein, 21 aa, Mycobacterium avium
SEDLKRLWPSLGTALTSLADG

SEQ ID NO: 112334 - protein, 17 aa, Mycobacterium avium
SEILAAYALLRDPARRA

SEQ ID NO: 112335 - protein, 23 aa, Mycobacterium avium
SEQRLRIGEAWGKLPHEWIEQYE

SEQ ID NO: 112336 - protein, 24 aa, Mycobacterium avium
SGAKGSDLLLVFGVIPEGFPQQGA

SEQ ID NO: 112337 - protein, 17 aa, Mycobacterium avium
SGEWKDGEALFLRCNIW

SEQ ID NO: 112338 - protein, 18 aa, Mycobacterium avium
SGIRRWLHTLGFRGHITS

SEQ ID NO: 112339 - protein, 17 aa, Mycobacterium avium
SGNFLWWGTFWVGKHRR

SEQ ID NO: 112340 - protein, 20 aa, Mycobacterium avium
SGPLFRFALFATRRDQFYLF

SEQ ID NO: 112341 - protein, 20 aa, Mycobacterium avium
SGPTRPGIRSTLLTVADLDA

SEQ ID NO: 112342 - protein, 20 aa, Mycobacterium avium
SGRIKLAWFLLNAARYMPVL

SEQ ID NO: 112343 - protein, 20 aa, Mycobacterium avium
SGSIGLGFAIPVDQAKRIAD

SEQ ID NO: 112344 - protein, 20 aa, Mycobacterium avium
SGSPLLDLGIDWKTYRDAIA

SEQ ID NO: 112345 - protein, 20 aa, Mycobacterium avium
SGSPLLDLGIDWKTYRDAID

SEQ ID NO: 112346 - protein, 20 aa, Mycobacterium avium
SGSPLLDLGIDWRTYRDAID

SEQ ID NO: 112347 - protein, 17 aa, Mycobacterium avium
SGSRIAAQLAYWQDALA

SEQ ID NO: 112348 - protein, 17 aa, Mycobacterium avium
SGSRIAAQLAYWQQALA

SEQ ID NO: 112349 - protein, 20 aa, Mycobacterium avium
SGYLHPHWPKPYGRGADSVE

SEQ ID NO: 112350 - protein, 24 aa, Mycobacterium avium
SHFLPGIAGPAGWRVYLGTRRDER

SEQ ID NO: 112351 - protein, 18 aa, Mycobacterium avium
SHPIVFGHAVKIFYKDAF

SEQ ID NO: 112352 - protein, 19 aa, Mycobacterium avium
SISGICMSTGFSLWAHRMT

SEQ ID NO: 112353 - protein, 20 aa, Mycobacterium avium
SKEGFFWRATLWATQETPVD

SEQ ID NO: 112354 - protein, 19 aa, Mycobacterium avium
SKNESRWQFGVLGPPGAAD

SEQ ID NO: 112355 - protein, 20 aa, Mycobacterium avium
SKNFPLRYLVTNTGWGRGLD

SEQ ID NO: 112356 - protein, 21 aa, Mycobacterium avium
SKRLPMWTIYEMLGLPDDQRD

SEQ ID NO: 112357 - protein, 17 aa, Mycobacterium avium
SLCYKLRLTVPGGVTLK

SEQ ID NO: 112358 - protein, 18 aa, Mycobacterium avium
SLEGDIRWCQLFSEPGAG

SEQ ID NO: 112359 - protein, 19 aa, Mycobacterium avium
SLEGELRWCQLFSEPGAGS

SEQ ID NO: 112360 - protein, 19 aa, Mycobacterium avium
SLLHWECIHPVPPATTATL

SEQ ID NO: 112361 - protein, 17 aa, Mycobacterium avium
SLVAIPWAQGDRSGVAF

SEQ ID NO: 112362 - protein, 24 aa, Mycobacterium avium
SLWMYLKELEFRQGFVDIAVNGTV

SEQ ID NO: 112363 - protein, 18 aa, Mycobacterium avium
SMCFPTFTGFSARHLNMH

SEQ ID NO: 112364 - protein, 18 aa, Mycobacterium avium
SMDEFLLRHGFHGPNEGN

SEQ ID NO: 112365 - protein, 22 aa, Mycobacterium avium
SMDSSWRKLLLVCEAVAEPGDV

SEQ ID NO: 112366 - protein, 18 aa, Mycobacterium avium
SMGLAFAEMGFRINAVLP

SEQ ID NO: 112367 - protein, 19 aa, Mycobacterium avium
SMHMGWGWGGYGVGPLKFA

SEQ ID NO: 112368 - protein, 17 aa, Mycobacterium avium
SMMAICFEKMLVSAVRE

SEQ ID NO: 112369 - protein, 22 aa, Mycobacterium avium
SMMPMRVIGMLLGIPESEPVSV

SEQ ID NO: 112370 - protein, 20 aa, Mycobacterium avium
SMRVPGWWVLDPMRALPVAV

SEQ ID NO: 112371 - protein, 23 aa, Mycobacterium avium
SNFPRSAPIWKNIAAALAEAQKA

SEQ ID NO: 112372 - protein, 21 aa, Mycobacterium avium
SNPDLFWALRGGGGGNFGVTT

SEQ ID NO: 112373 - protein, 21 aa, Mycobacterium avium
SNPIDILAWLLGFNGQSSGGL

SEQ ID NO: 112374 - protein, 22 aa, Mycobacterium avium
SNPIDILAWLLGFNGQSSGGLG

SEQ ID NO: 112375 - protein, 18 aa, Mycobacterium avium
SPAAGFDFERSWRAVGPD

SEQ ID NO: 112376 - protein, 26 aa, Mycobacterium avium
SPEAVFKPRWLWKFGKTLWPPELRVP

SEQ ID NO: 112377 - protein, 24 aa, Mycobacterium avium
SPGFSWKPLHTMPGVSTYYTFYDD

SEQ ID NO: 112378 - protein, 21 aa, Mycobacterium avium
SPKESWLRVLLIDAGFPRPQT

SEQ ID NO: 112379 - protein, 22 aa, Mycobacterium avium
SPKESWLRVLLIDAGFPRPQTQ

SEQ ID NO: 112380 - protein, 22 aa, Mycobacterium avium
SPLEFLYGLFFDYVRDRRRQPR

SEQ ID NO: 112381 - protein, 18 aa, Mycobacterium avium
SPLRCGWLANSWRLPSCG

SEQ ID NO: 112382 - protein, 21 aa, Mycobacterium avium
SPRMREVIILRVAHLQDSPYE

SEQ ID NO: 112383 - protein, 30 aa, Mycobacterium avium
SQFPALINYFIAWQTYRIINWTIRTLRFIL

SEQ ID NO: 112384 - protein, 17 aa, Mycobacterium avium
SQLRTALRMQILAGYPI

SEQ ID NO: 112385 - protein, 18 aa, Mycobacterium avium
SREIPMAALAGMRRGQAL

SEQ ID NO: 112386 - protein, 19 aa, Mycobacterium avium
SREIPMAALAGMRRGQALP

SEQ ID NO: 112387 - protein, 19 aa, Mycobacterium avium
SREIPMAALASMRRGQALP

SEQ ID NO: 112388 - protein, 18 aa, Mycobacterium avium
SRGDGLCNVFVPHATAGV

SEQ ID NO: 112389 - protein, 18 aa, Mycobacterium avium
SRGMGRNGPWIGGKLTER

SEQ ID NO: 112390 - protein, 20 aa, Mycobacterium avium
SRICASLGLPERVLTQQLRT

SEQ ID NO: 112391 - protein, 19 aa, Mycobacterium avium
SRIFTDFTYRSGSTTISTG

SEQ ID NO: 112392 - protein, 17 aa, Mycobacterium avium
SRIGRRTGIPGLELTME

SEQ ID NO: 112393 - protein, 20 aa, Mycobacterium avium
SRPDALLPLARRETGECLAE

SEQ ID NO: 112394 - protein, 20 aa, Mycobacterium avium
SRPLWEMWVIEGLDGNAGGR

SEQ ID NO: 112395 - protein, 24 aa, Mycobacterium avium
SRQLWWGHRIPIWYGPNGEQRCVG

SEQ ID NO: 112396 - protein, 22 aa, Mycobacterium avium
SRRLWTVLIFMLWHAIFVEHSV

SEQ ID NO: 112397 - protein, 21 aa, Mycobacterium avium
SRTRLATWVAVPGHTASPAGS

SEQ ID NO: 112398 - protein, 20 aa, Mycobacterium avium
SRTSYLAAFGRDDCGPVWVF

SEQ ID NO: 112399 - protein, 18 aa, Mycobacterium avium
SRVFFDWFGEAGVDDIPA

SEQ ID NO: 112400 - protein, 17 aa, Mycobacterium avium
SSAFARYLADYIHEQGW

SEQ ID NO: 112401 - protein, 18 aa, Mycobacterium avium
SSGFPINLLDVWAQLATA

SEQ ID NO: 112402 - protein, 17 aa, Mycobacterium avium
SSIWYRIRINLQHIPED

SEQ ID NO: 112403 - protein, 17 aa, Mycobacterium avium
SSLGGMSVPQGWSTAAP

SEQ ID NO: 112404 - protein, 19 aa, Mycobacterium avium
SSLRLPTLLVRGGESDVLS

SEQ ID NO: 112405 - protein, 23 aa, Mycobacterium avium
SSLSRRGFLWWAVVEGLVNAGAP

SEQ ID NO: 112406 - protein, 26 aa, Mycobacterium avium
SSNPWLYPFGSLYLFGVIDPPVGAQT

SEQ ID NO: 112407 - protein, 17 aa, Mycobacterium avium
SSPMCYPVGDFLVGDRD

SEQ ID NO: 112408 - protein, 23 aa, Mycobacterium avium
STAELRTATPLGDVFVALKPPPG

SEQ ID NO: 112409 - protein, 17 aa, Mycobacterium avium
STAEWLKLFGELEIPAA

SEQ ID NO: 112410 - protein, 17 aa, Mycobacterium avium
STVLDMRVDLVINVFGA

SEQ ID NO: 112411 - protein, 21 aa, Mycobacterium avium
STYRFPTGWFIVAFGSDLAPG

SEQ ID NO: 112412 - protein, 19 aa, Mycobacterium avium
SVAEVGIGFCFAPLFHPSY

SEQ ID NO: 112413 - protein, 20 aa, Mycobacterium avium
SVAVATRFPGPITDLQLSRD

SEQ ID NO: 112414 - protein, 17 aa, Mycobacterium avium
SVFFCCGHARTSSDSEY

SEQ ID NO: 112415 - protein, 19 aa, Mycobacterium avium
SVFFTSHRVAVRAIVRLGF

SEQ ID NO: 112416 - protein, 20 aa, Mycobacterium avium
SVHYPFPIKDLVAIDDALKF

SEQ ID NO: 112417 - protein, 21 aa, Mycobacterium avium
SVPPGRLGWGWAKFAFNGWKT

SEQ ID NO: 112418 - protein, 17 aa, Mycobacterium avium
SVPPVPGKFYWMTPTQL

SEQ ID NO: 112419 - protein, 18 aa, Mycobacterium avium
SVPQRLWAKPAITVIGID

SEQ ID NO: 112420 - protein, 19 aa, Mycobacterium avium
SWCGYCHRLMTVLKSNGIP

SEQ ID NO: 112421 - protein, 21 aa, Mycobacterium avium
SWERTRWTLAHEVGHLSLHAS

SEQ ID NO: 112422 - protein, 17 aa, Mycobacterium avium
SWHPGPHRLPILDDAAA

SEQ ID NO: 112423 - protein, 17 aa, Mycobacterium avium
SYRPAWCTVREVEPAIT

SEQ ID NO: 112424 - protein, 19 aa, Mycobacterium avium
SYYDDMAWLALALERAARI

SEQ ID NO: 112425 - protein, 20 aa, Mycobacterium avium
SYYDDMAWLALALERAARIA

SEQ ID NO: 112426 - protein, 20 aa, Mycobacterium avium
TAAKLRLIFDALIDTRGVYL

SEQ ID NO: 112427 - protein, 20 aa, Mycobacterium avium
TAALQCFTQAFVLRQKNPKM

SEQ ID NO: 112428 - protein, 20 aa, Mycobacterium avium
TAAPCLRPQPCIDLYDAVRA

SEQ ID NO: 112429 - protein, 17 aa, Mycobacterium avium
TAAQVVLRWHIQRGDIV

SEQ ID NO: 112430 - protein, 17 aa, Mycobacterium avium
TAAQVVLRWHIQRGDVV

SEQ ID NO: 112431 - protein, 20 aa, Mycobacterium avium
TACIKAMIEKVVERMYAEID

SEQ ID NO: 112432 - protein, 19 aa, Mycobacterium avium
TAELLAGCARRLLDAPAVL

SEQ ID NO: 112433 - protein, 21 aa, Mycobacterium avium
TAGAPAHDWLTLTGGAIGYGI

SEQ ID NO: 112434 - protein, 17 aa, Mycobacterium avium
TAGRWGVSRVWLGVNQK

SEQ ID NO: 112435 - protein, 22 aa, Mycobacterium avium
TAHRLLAMLAYRGFVRQDPVSK

SEQ ID NO: 112436 - protein, 24 aa, Mycobacterium avium
TALCGAPVRIPLLFGGRSAATVRR

SEQ ID NO: 112437 - protein, 17 aa, Mycobacterium avium
TALKNPLFATARGLEND

SEQ ID NO: 112438 - protein, 18 aa, Mycobacterium avium
TALSRPPLFLMASSAAVY

SEQ ID NO: 112439 - protein, 23 aa, Mycobacterium avium
TAPYNDIVGWKWTEVPNALGVTD

SEQ ID NO: 112440 - protein, 23 aa, Mycobacterium avium
TAPYNDIVGWKWTEVPNSLGVTD

SEQ ID NO: 112441 - protein, 20 aa, Mycobacterium avium
TAPYWSEFEVALLRCVDELI

SEQ ID NO: 112442 - protein, 20 aa, Mycobacterium avium
TDGHWARYGYLLARTDPDAP

SEQ ID NO: 112443 - protein, 17 aa, Mycobacterium avium
TDLLWRMGIRTIGQFAA

SEQ ID NO: 112444 - protein, 24 aa, Mycobacterium avium
TDPLRAGMRLGLIPTVVPYVLPTV

SEQ ID NO: 112445 - protein, 19 aa, Mycobacterium avium
TDRCGPWIIERAIRDVRRG

SEQ ID NO: 112446 - protein, 17 aa, Mycobacterium avium
TDWKIELCDTIADNASS

SEQ ID NO: 112447 - protein, 17 aa, Mycobacterium avium
TEAWQRCAYFTEVRRAG

SEQ ID NO: 112448 - protein, 22 aa, Mycobacterium avium
TECPEWTWRTTLLPRIAPTARD

SEQ ID NO: 112449 - protein, 21 aa, Mycobacterium avium
TEKDARGWLSLRQAEIIRKAW

SEQ ID NO: 112450 - protein, 18 aa, Mycobacterium avium
TELPYVWGTLGAPKDPTL

SEQ ID NO: 112451 - protein, 19 aa, Mycobacterium avium
TELRDGWHLRIARSRLDRT

SEQ ID NO: 112452 - protein, 17 aa, Mycobacterium avium
TETGWRINGQKVWSSAA

SEQ ID NO: 112453 - protein, 24 aa, Mycobacterium avium
TEVCYSCGALDWAWRTHTGNGSVY

SEQ ID NO: 112454 - protein, 22 aa, Mycobacterium avium
TEYHEWTWRTTLLPRIAPTARD

SEQ ID NO: 112455 - protein, 18 aa, Mycobacterium avium
TFLVRPAPVPSRFGGSRS

SEQ ID NO: 112456 - protein, 22 aa, Mycobacterium avium
TFRCPYHGWTFRNTGELIGFPF

SEQ ID NO: 112457 - protein, 18 aa, Mycobacterium avium
TFSGISIHSAHWDPELDL

SEQ ID NO: 112458 - protein, 22 aa, Mycobacterium avium
TGDCLFPGGVGKTWLPGDFDQL

SEQ ID NO: 112459 - protein, 23 aa, Mycobacterium avium
TGETIEAVSLWTGFDGDASAVCM

SEQ ID NO: 112460 - protein, 22 aa, Mycobacterium avium
TGGKRLDPGFFYAPTLLTNVDP

SEQ ID NO: 112461 - protein, 20 aa, Mycobacterium avium
TGIDTCLWLLGRGVEPDRLT

SEQ ID NO: 112462 - protein, 17 aa, Mycobacterium avium
TGLSTTLAWFAERAGRT

SEQ ID NO: 112463 - protein, 17 aa, Mycobacterium avium
TGMRLALFEAFDPAATP

SEQ ID NO: 112464 - protein, 25 aa, Mycobacterium avium
THAVSLAEAWRCCGVLPDITIGHSL

SEQ ID NO: 112465 - protein, 17 aa, Mycobacterium avium
THPRLLGALPLLREANR

SEQ ID NO: 112466 - protein, 17 aa, Mycobacterium avium
THVWASDHIQPWQDNEG

SEQ ID NO: 112467 - protein, 19 aa, Mycobacterium avium
THWPWADHWITLWCNTIGH

SEQ ID NO: 112468 - protein, 18 aa, Mycobacterium avium
TKGPMLINARADKVTSSP

SEQ ID NO: 112469 - protein, 21 aa, Mycobacterium avium
TKRVCRDCGFFLPLSGSLGRM

SEQ ID NO: 112470 - protein, 23 aa, Mycobacterium avium
TKSLRAGKIFVDWSQNNGSKTTI

SEQ ID NO: 112471 - protein, 26 aa, Mycobacterium avium
TLADLAFAWRVCRAVKSNAIVIAAGG

SEQ ID NO: 112472 - protein, 17 aa, Mycobacterium avium
TLEEYWWAAEQALTWPP

SEQ ID NO: 112473 - protein, 23 aa, Mycobacterium avium
TLIKEKWLTANAVIGFFPANAIG

SEQ ID NO: 112474 - protein, 24 aa, Mycobacterium avium
TLPLRIRAAWLWSGRTAVIAGAAA

SEQ ID NO: 112475 - protein, 17 aa, Mycobacterium avium
TLQELGWIVVRVIAEDK

SEQ ID NO: 112476 - protein, 17 aa, Mycobacterium avium
TLREAFRVLESESLIQV

SEQ ID NO: 112477 - protein, 19 aa, Mycobacterium avium
TLRNWLGMWSLRVAQTRAE

SEQ ID NO: 112478 - protein, 19 aa, Mycobacterium avium
TLRNWLSMWSLRVAQTRAE

SEQ ID NO: 112479 - protein, 24 aa, Mycobacterium avium
TMNTRGRLAVSFARRPERFTDGLY

SEQ ID NO: 112480 - protein, 19 aa, Mycobacterium avium
TMYELFSVGWGRPDLRSQW

SEQ ID NO: 112481 - protein, 21 aa, Mycobacterium avium
TNCRKRLTGAAGLSARRDHAG

SEQ ID NO: 112482 - protein, 19 aa, Mycobacterium avium
TNCRKRLTGAAGPSARRDH

SEQ ID NO: 112483 - protein, 23 aa, Mycobacterium avium
TNRVRRYVCLKGPDHGGCGRLTV

SEQ ID NO: 112484 - protein, 24 aa, Mycobacterium avium
TNWFGDQPFAVWPWAADKLGGAQP

SEQ ID NO: 112485 - protein, 17 aa, Mycobacterium avium
TPEDLRPGWSMPSAEQF

SEQ ID NO: 112486 - protein, 18 aa, Mycobacterium avium
TPFQGGWQLSRHTAETLL

SEQ ID NO: 112487 - protein, 17 aa, Mycobacterium avium
TPKLPPKNFHRLLGVNV

SEQ ID NO: 112488 - protein, 19 aa, Mycobacterium avium
TPQARLGLISAIRAAGLDC

SEQ ID NO: 112489 - protein, 24 aa, Mycobacterium avium
TPRPRVAPTQAWRKMFGENFFYIL

SEQ ID NO: 112490 - protein, 21 aa, Mycobacterium avium
TPWLTSRHSFSFGDHYDPDNT

SEQ ID NO: 112491 - protein, 25 aa, Mycobacterium avium
TQAFSEWRRTPAPVRGALVARLGEL

SEQ ID NO: 112492 - protein, 23 aa, Mycobacterium avium
TQHWELRIKPRFGHVPVDEISRG

SEQ ID NO: 112493 - protein, 17 aa, Mycobacterium avium
TQLWACVDFDYLKKSDR

SEQ ID NO: 112494 - protein, 18 aa, Mycobacterium avium
TQWEGGWAGIAWPKEYGG

SEQ ID NO: 112495 - protein, 20 aa, Mycobacterium avium
TRAESRWFASAGFSLVNMTG

SEQ ID NO: 112496 - protein, 24 aa, Mycobacterium avium
TRAYRLDWPAGMTVFEIDQPAVVE

SEQ ID NO: 112497 - protein, 18 aa, Mycobacterium avium
TRGSMCFRVSSDKQVVFT

SEQ ID NO: 112498 - protein, 26 aa, Mycobacterium avium
TRINTIWGELAWQLGGAEAFALVAKA

SEQ ID NO: 112499 - protein, 19 aa, Mycobacterium avium
TRLASLLRRYGMGVPDAAR

SEQ ID NO: 112500 - protein, 22 aa, Mycobacterium avium
TRLLRPSIMWRAARARGADHPG

SEQ ID NO: 112501 - protein, 19 aa, Mycobacterium avium
TRLPHGCIVHFAVDLIIAD

SEQ ID NO: 112502 - protein, 26 aa, Mycobacterium avium
TRLWARMWLLRFTWQRAIDSGDLTSP

SEQ ID NO: 112503 - protein, 19 aa, Mycobacterium avium
TRVARWCWIASHADGQLRH

SEQ ID NO: 112504 - protein, 17 aa, Mycobacterium avium
TRYELVDGFPRFDVDDV

SEQ ID NO: 112505 - protein, 23 aa, Mycobacterium avium
TRYWAPVCRLFGLDAAAADERFA

SEQ ID NO: 112506 - protein, 17 aa, Mycobacterium avium
TSAAAMRAAVLAGAGPA

SEQ ID NO: 112507 - protein, 17 aa, Mycobacterium avium
TSFARWASLLAEHASSP

SEQ ID NO: 112508 - protein, 17 aa, Mycobacterium avium
TSFEDWQYGQLVQLAKA

SEQ ID NO: 112509 - protein, 18 aa, Mycobacterium avium
TSGLRPASYFALAEAHGR

SEQ ID NO: 112510 - protein, 23 aa, Mycobacterium avium
TSPDIRALYAFKRLAWWPYSVVM

SEQ ID NO: 112511 - protein, 24 aa, Mycobacterium avium
TSRPCPTCRGVGVVIPDPCHQCMG

SEQ ID NO: 112512 - protein, 27 aa, Mycobacterium avium
TSTGCGWTRWPRCCTWTTPAPRAAGPP

SEQ ID NO: 112513 - protein, 24 aa, Mycobacterium avium
TSVALGCGFRCGFLGLLHMEITRE

SEQ ID NO: 112514 - protein, 20 aa, Mycobacterium avium
TSWCGYCHRLMTVLKSNGIP

SEQ ID NO: 112515 - protein, 18 aa, Mycobacterium avium
TTLRCIRSWVLDVRHATN

SEQ ID NO: 112516 - protein, 24 aa, Mycobacterium avium
TTLWARRPATLEAFADTDAKVAGS

SEQ ID NO: 112517 - protein, 18 aa, Mycobacterium avium
TTMRLTGRWLRGRLPTAY

SEQ ID NO: 112518 - protein, 17 aa, Mycobacterium avium
TVLPRKLIELLLGEPGR

SEQ ID NO: 112519 - protein, 18 aa, Mycobacterium avium
TVPEFPNFFIIYGPGTHL

SEQ ID NO: 112520 - protein, 29 aa, Mycobacterium avium
TVTCPNPACGIAMPLVRSWWLGKKKGKEA

SEQ ID NO: 112521 - protein, 17 aa, Mycobacterium avium
TVVLPCLNEEESLPGVL

SEQ ID NO: 112522 - protein, 21 aa, Mycobacterium avium
TVYRQEMLRIFGLPESGLAET

SEQ ID NO: 112523 - protein, 19 aa, Mycobacterium avium
TWLQFPQWFYFNIPVNTMV

SEQ ID NO: 112524 - protein, 22 aa, Mycobacterium avium
TWMPGACWRQPFGPGSSIEDRL

SEQ ID NO: 112525 - protein, 17 aa, Mycobacterium avium
TWTAALIGPWWPAPSTA

SEQ ID NO: 112526 - protein, 25 aa, Mycobacterium avium
TYFQAAFRIQSPWSIRNPNGDNPNE

SEQ ID NO: 112527 - protein, 17 aa, Mycobacterium avium
TYLALSWALARSPGGRQ

SEQ ID NO: 112528 - protein, 20 aa, Mycobacterium avium
TYQNAMRWYSFDPFTHISRE

SEQ ID NO: 112529 - protein, 17 aa, Mycobacterium avium
VAACATAAVSVEEGVDK

SEQ ID NO: 112530 - protein, 23 aa, Mycobacterium avium
VAAKLRAGTVWVNAYRVVAPHVP

SEQ ID NO: 112531 - protein, 19 aa, Mycobacterium avium
VAALARWSGDLTVAEDAVQ

SEQ ID NO: 112532 - protein, 18 aa, Mycobacterium avium
VAANRIRLLALIQTNIFG

SEQ ID NO: 112533 - protein, 18 aa, Mycobacterium avium
VAAVLRRRFNVVAYDVRG

SEQ ID NO: 112534 - protein, 17 aa, Mycobacterium avium
VAAWKLLLAEGIEGRCR

SEQ ID NO: 112535 - protein, 18 aa, Mycobacterium avium
VAAWKLLLAEGIEGRCRI

SEQ ID NO: 112536 - protein, 17 aa, Mycobacterium avium
VACGYYIFEAENLDEAL

SEQ ID NO: 112537 - protein, 23 aa, Mycobacterium avium
VADFRGASVAVEWPAQLQQQISR

SEQ ID NO: 112538 - protein, 20 aa, Mycobacterium avium
VAEAWLPFHVPMSYHGTFTT

SEQ ID NO: 112539 - protein, 21 aa, Mycobacterium avium
VAEAWLPFHVPMSYHGTFTTR

SEQ ID NO: 112540 - protein, 18 aa, Mycobacterium avium
VAEFSRWYAGDVDLSDPP

SEQ ID NO: 112541 - protein, 23 aa, Mycobacterium avium
VALVVRAGRDWAIREIPLGDVVK

SEQ ID NO: 112542 - protein, 17 aa, Mycobacterium avium
VALWRVLVALSIRHVGP

SEQ ID NO: 112543 - protein, 19 aa, Mycobacterium avium
VAPSIVFCAAEFVPVIGDL

SEQ ID NO: 112544 - protein, 25 aa, Mycobacterium avium
VARQEPRLSWAAGLRDDGTTTLVTD

SEQ ID NO: 112545 - protein, 23 aa, Mycobacterium avium
VATGEFLAAIGFSQVQAPTQVEV

SEQ ID NO: 112546 - protein, 18 aa, Mycobacterium avium
VDAEWRYHHLLMVDGESI

SEQ ID NO: 112547 - protein, 24 aa, Mycobacterium avium
VDAKWAASISGYWRRGRTEETFRQ

SEQ ID NO: 112548 - protein, 20 aa, Mycobacterium avium
VDALFTWLPWAAELEDLSGA

SEQ ID NO: 112549 - protein, 23 aa, Mycobacterium avium
VDALHRWLVAWADIYDAHAAVFA

SEQ ID NO: 112550 - protein, 19 aa, Mycobacterium avium
VDALKRWDRPVLMAWGTSD

SEQ ID NO: 112551 - protein, 23 aa, Mycobacterium avium
VDEARAALSWLRRHAFLVRNLDI

SEQ ID NO: 112552 - protein, 21 aa, Mycobacterium avium
VDEPFLLPAHIDLAALRAKFD

SEQ ID NO: 112553 - protein, 22 aa, Mycobacterium avium
VDEPFLLPAHIDLAALRVKFDG

SEQ ID NO: 112554 - protein, 19 aa, Mycobacterium avium
VDGGWTINGHKIWTSAAHR

SEQ ID NO: 112555 - protein, 19 aa, Mycobacterium avium
VDGVKAWKGIRYAAPPIGD

SEQ ID NO: 112556 - protein, 20 aa, Mycobacterium avium
VDGVKAWKGIRYAAPPIGDL

SEQ ID NO: 112557 - protein, 19 aa, Mycobacterium avium
VDLRDDWPAALRAAGFDPA

SEQ ID NO: 112558 - protein, 19 aa, Mycobacterium avium
VDLRDDWPAALRAAGFDPT

SEQ ID NO: 112559 - protein, 18 aa, Mycobacterium avium
VDQLRLAPTLDWIEAALP

SEQ ID NO: 112560 - protein, 20 aa, Mycobacterium avium
VDRACAPWGLLAEDKQAALV

SEQ ID NO: 112561 - protein, 17 aa, Mycobacterium avium
VDRLVRFPGPNGLAHEI

SEQ ID NO: 112562 - protein, 17 aa, Mycobacterium avium
VDSYGGFIFASLAAEGV

SEQ ID NO: 112563 - protein, 19 aa, Mycobacterium avium
VDSYGGFVFASLAPDGISL

SEQ ID NO: 112564 - protein, 19 aa, Mycobacterium avium
VDVDLWAPVAQQISTTVEI

SEQ ID NO: 112565 - protein, 18 aa, Mycobacterium avium
VDYQRLGKMPPLQTGGLH

SEQ ID NO: 112566 - protein, 22 aa, Mycobacterium avium
VEAIRWTTWHAAWLIAEGRPAA

SEQ ID NO: 112567 - protein, 21 aa, Mycobacterium avium
VEDGIQCPFHGWVWNGEGRNV

SEQ ID NO: 112568 - protein, 21 aa, Mycobacterium avium
VEFAQRLFLALAVLEHPRGFL

SEQ ID NO: 112569 - protein, 19 aa, Mycobacterium avium
VEFLRFLLADQRVRAGDLD

SEQ ID NO: 112570 - protein, 21 aa, Mycobacterium avium
VEFWAFDLLYLDGRSLLRARY

SEQ ID NO: 112571 - protein, 19 aa, Mycobacterium avium
VEIAEMFRLPPALERGWHA

SEQ ID NO: 112572 - protein, 20 aa, Mycobacterium avium
VEIGGPFSLELCGGTHVHNS

SEQ ID NO: 112573 - protein, 19 aa, Mycobacterium avium
VEIPDHYRLYVSQKLARLE

SEQ ID NO: 112574 - protein, 18 aa, Mycobacterium avium
VELDARMRRRLAIVDQQA

SEQ ID NO: 112575 - protein, 19 aa, Mycobacterium avium
VELRLPLRETFAGKAKGHG

SEQ ID NO: 112576 - protein, 19 aa, Mycobacterium avium
VELRNRLKIATGLTLSPTV

SEQ ID NO: 112577 - protein, 19 aa, Mycobacterium avium
VEMWLRDVAAMLGYHAGAQ

SEQ ID NO: 112578 - protein, 17 aa, Mycobacterium avium
VENALKVAFDWKSRHNE

SEQ ID NO: 112579 - protein, 17 aa, Mycobacterium avium
VERLAVVPLSFAQQRLW

SEQ ID NO: 112580 - protein, 23 aa, Mycobacterium avium
VEVINRFLARFGVAAPFTAEQLR

SEQ ID NO: 112581 - protein, 17 aa, Mycobacterium avium
VEVVHRFGVTCTAGTPF

SEQ ID NO: 112582 - protein, 17 aa, Mycobacterium avium
VEWCKSGRVSACGSVVA

SEQ ID NO: 112583 - protein, 18 aa, Mycobacterium avium
VEWCKSGRVSACGSVVAT

SEQ ID NO: 112584 - protein, 18 aa, Mycobacterium avium
VFHRVIRGFMIQGGDPTG

SEQ ID NO: 112585 - protein, 20 aa, Mycobacterium avium
VFSGYRFVRHAAARGIPIAI

SEQ ID NO: 112586 - protein, 19 aa, Mycobacterium avium
VGACRQCLVEVEGQRKPMA

SEQ ID NO: 112587 - protein, 18 aa, Mycobacterium avium
VGADWPIRYEDLRRHYEQ

SEQ ID NO: 112588 - protein, 20 aa, Mycobacterium avium
VGARLAGAWVLRADSLTQVG

SEQ ID NO: 112589 - protein, 23 aa, Mycobacterium avium
VGDWAGALERIWSKDRPDVVHAY

SEQ ID NO: 112590 - protein, 17 aa, Mycobacterium avium
VGEMFGRKVARLMEWCA

SEQ ID NO: 112591 - protein, 18 aa, Mycobacterium avium
VGFGGWYAPVALRVDTAS

SEQ ID NO: 112592 - protein, 20 aa, Mycobacterium avium
VGFRMPSVWLAEGHARVAPV

SEQ ID NO: 112593 - protein, 23 aa, Mycobacterium avium
VGKTRLAGEWSRRAYEQGAVVLY

SEQ ID NO: 112594 - protein, 22 aa, Mycobacterium avium
VGNGTCYWKRMGNPDGAVIDNA

SEQ ID NO: 112595 - protein, 21 aa, Mycobacterium avium
VGPRLSALVDHTIWFHRAADF

SEQ ID NO: 112596 - protein, 17 aa, Mycobacterium avium
VGSGLAWVSLRPTVFAT

SEQ ID NO: 112597 - protein, 17 aa, Mycobacterium avium
VGVLAGFPVEIAPTAQG

SEQ ID NO: 112598 - protein, 17 aa, Mycobacterium avium
VHLRGHFLLTRNAAAYW

SEQ ID NO: 112599 - protein, 17 aa, Mycobacterium avium
VIFAYPGVHAIWGHRVN

SEQ ID NO: 112600 - protein, 17 aa, Mycobacterium avium
VIIVPGLWRDFDHTALA

SEQ ID NO: 112601 - protein, 21 aa, Mycobacterium avium
VILSRCLQVPFAVDFPSTYRL

SEQ ID NO: 112602 - protein, 18 aa, Mycobacterium avium
VIVAPMFHAWGFSQLLLA

SEQ ID NO: 112603 - protein, 20 aa, Mycobacterium avium
VKDFRFNQIISEEMFMTGSV

SEQ ID NO: 112604 - protein, 20 aa, Mycobacterium avium
VKDFRFNQIVSEEMFLTGSV

SEQ ID NO: 112605 - protein, 18 aa, Mycobacterium avium
VKHWNRWCEGAGIGDVAR

SEQ ID NO: 112606 - protein, 21 aa, Mycobacterium avium
VKLAEALGCVGLRCEREEDVV

SEQ ID NO: 112607 - protein, 19 aa, Mycobacterium avium
VKLWQHWDHCALHWFPGSH

SEQ ID NO: 112608 - protein, 18 aa, Mycobacterium avium
VKTFWGWREQQLPDATLI

SEQ ID NO: 112609 - protein, 22 aa, Mycobacterium avium
VKVICRRSRLMARIAGRGAMAS

SEQ ID NO: 112610 - protein, 22 aa, Mycobacterium avium
VKVRGGVVLGEFATLVDPQRSI

SEQ ID NO: 112611 - protein, 25 aa, Mycobacterium avium
VLAHPCPMCLGALYYCSPREVVFLT

SEQ ID NO: 112612 - protein, 23 aa, Mycobacterium avium
VLDGKRATTHWVAAELFSATYPN

SEQ ID NO: 112613 - protein, 17 aa, Mycobacterium avium
VLDPRFRTAATWLPTLR

SEQ ID NO: 112614 - protein, 17 aa, Mycobacterium avium
VLDRAFADFRHALDLLS

SEQ ID NO: 112615 - protein, 22 aa, Mycobacterium avium
VLDYTFDFTNWLAGTGDSVAAA

SEQ ID NO: 112616 - protein, 17 aa, Mycobacterium avium
VLGRRVWENAGSPEVDS

SEQ ID NO: 112617 - protein, 18 aa, Mycobacterium avium
VLIGAAWQRCRVHFLRNV

SEQ ID NO: 112618 - protein, 19 aa, Mycobacterium avium
VLIGAAWQRCRVHFLRNVL

SEQ ID NO: 112619 - protein, 18 aa, Mycobacterium avium
VLLHLSAEGWVQWSNTVS

SEQ ID NO: 112620 - protein, 17 aa, Mycobacterium avium
VLSESWRYGGLLSAQTA

SEQ ID NO: 112621 - protein, 18 aa, Mycobacterium avium
VMAGTGFLGAHAEEVYRI

SEQ ID NO: 112622 - protein, 17 aa, Mycobacterium avium
VMEVLLAQCVQADAAVA

SEQ ID NO: 112623 - protein, 18 aa, Mycobacterium avium
VNGAKAWITHGGIADFYS

SEQ ID NO: 112624 - protein, 18 aa, Mycobacterium avium
VNGAWCFESRTMFVDQVG

SEQ ID NO: 112625 - protein, 18 aa, Mycobacterium avium
VNGFCVGSGIGLVGNSDV

SEQ ID NO: 112626 - protein, 20 aa, Mycobacterium avium
VNPALLLKCLLMATTEGIAS

SEQ ID NO: 112627 - protein, 20 aa, Mycobacterium avium
VPCSRPLPWPARTVSSRVPE

SEQ ID NO: 112628 - protein, 17 aa, Mycobacterium avium
VPFCAACAQVLDLDQEV

SEQ ID NO: 112629 - protein, 19 aa, Mycobacterium avium
VPGDIIWAPAIDGAFVLTT

SEQ ID NO: 112630 - protein, 20 aa, Mycobacterium avium
VPGQGVVRVSQWIEQRDVTS

SEQ ID NO: 112631 - protein, 17 aa, Mycobacterium avium
VPKHIAMDWLRKRFATV

SEQ ID NO: 112632 - protein, 19 aa, Mycobacterium avium
VPLYRERYVLLAPADLLAS

SEQ ID NO: 112633 - protein, 21 aa, Mycobacterium avium
VPQWPELEAAALKRIRGPRVG

SEQ ID NO: 112634 - protein, 23 aa, Mycobacterium avium
VPQWPELEAAALKRIRGPRVGDP

SEQ ID NO: 112635 - protein, 19 aa, Mycobacterium avium
VPVDPGFRIPLGQADIKRP

SEQ ID NO: 112636 - protein, 22 aa, Mycobacterium avium
VQAALCFPSFPGFGGGTFVRAE

SEQ ID NO: 112637 - protein, 22 aa, Mycobacterium avium
VQLLRYCLEYGYQLRVIEQMPL

SEQ ID NO: 112638 - protein, 23 aa, Mycobacterium avium
VQLLRYCLEYGYQLRVIEQMPLD

SEQ ID NO: 112639 - protein, 18 aa, Mycobacterium avium
VQRGLWFEEFEIGTTYLH

SEQ ID NO: 112640 - protein, 18 aa, Mycobacterium avium
VQRPVWPMIVLRTPKGWT

SEQ ID NO: 112641 - protein, 18 aa, Mycobacterium avium
VQRWCALLEWAGIPCDST

SEQ ID NO: 112642 - protein, 18 aa, Mycobacterium avium
VRAADCLRAVDSLSDAAL

SEQ ID NO: 112643 - protein, 17 aa, Mycobacterium avium
VRAGHRLKFWTPGGSST

SEQ ID NO: 112644 - protein, 18 aa, Mycobacterium avium
VREACLWSAGLAAAGVRR

SEQ ID NO: 112645 - protein, 19 aa, Mycobacterium avium
VRERKVCALWDIANPDKFT

SEQ ID NO: 112646 - protein, 19 aa, Mycobacterium avium
VREVEAWLAAEPFRAPEAD

SEQ ID NO: 112647 - protein, 17 aa, Mycobacterium avium
VRFGDRPGYRFVQRDVC

SEQ ID NO: 112648 - protein, 17 aa, Mycobacterium avium
VRGAYRIAGPLNVPGSR

SEQ ID NO: 112649 - protein, 17 aa, Mycobacterium avium
VRGLHRFLAAEGLAELD

SEQ ID NO: 112650 - protein, 20 aa, Mycobacterium avium
VRLMRWGLVPPWAKAGPDGA

SEQ ID NO: 112651 - protein, 20 aa, Mycobacterium avium
VRLMRWGLVPPWAKAGPGGA

SEQ ID NO: 112652 - protein, 20 aa, Mycobacterium avium
VRLMRWGLVPPWAKAGRDGA

SEQ ID NO: 112653 - protein, 18 aa, Mycobacterium avium
VRNALGLRTRWYVSAMET

SEQ ID NO: 112654 - protein, 22 aa, Mycobacterium avium
VRPEVLHAWHLLQRSRGLIPVT

SEQ ID NO: 112655 - protein, 17 aa, Mycobacterium avium
VRQLEDWHRPRLEVLAD

SEQ ID NO: 112656 - protein, 18 aa, Mycobacterium avium
VRQLEDWHRPRLEVLADA

SEQ ID NO: 112657 - protein, 18 aa, Mycobacterium avium
VRQLEDWHRPRLEVLAGA

SEQ ID NO: 112658 - protein, 20 aa, Mycobacterium avium
VRRREWLAGRRGRVADQREQ

SEQ ID NO: 112659 - protein, 21 aa, Mycobacterium avium
VRTDEQWRWLAHTLTVERLTE

SEQ ID NO: 112660 - protein, 18 aa, Mycobacterium avium
VRVLRRWGPARIAYLLGL

SEQ ID NO: 112661 - protein, 18 aa, Mycobacterium avium
VRVPWQWRATGSAAEVIP

SEQ ID NO: 112662 - protein, 17 aa, Mycobacterium avium
VRWGVGGGLEFVGRVDE

SEQ ID NO: 112663 - protein, 24 aa, Mycobacterium avium
VRYDWPVRTGIMIGRLDDDGSRFL

SEQ ID NO: 112664 - protein, 17 aa, Mycobacterium avium
VSDGVLLSAVWASETSQ

SEQ ID NO: 112665 - protein, 17 aa, Mycobacterium avium
VSELTRFTPEAVVEKYG

SEQ ID NO: 112666 - protein, 17 aa, Mycobacterium avium
VSFEVFIRPALRAAMGL

SEQ ID NO: 112667 - protein, 17 aa, Mycobacterium avium
VSGELIVAVAMTEPGAG

SEQ ID NO: 112668 - protein, 22 aa, Mycobacterium avium
VSKFAATFSICFQTLENRIERL

SEQ ID NO: 112669 - protein, 19 aa, Mycobacterium avium
VSLSWRTGDDIVVTRTDPS

SEQ ID NO: 112670 - protein, 23 aa, Mycobacterium avium
VSNLRAAYRISISDLDWMTPQTR

SEQ ID NO: 112671 - protein, 24 aa, Mycobacterium avium
VSNLRAAYRISISDLDWMTPQTRQ

SEQ ID NO: 112672 - protein, 17 aa, Mycobacterium avium
VSNLRWDGDYVLVDVDA

SEQ ID NO: 112673 - protein, 23 aa, Mycobacterium avium
VSRALPGVEGFPADTFPVLVALM

SEQ ID NO: 112674 - protein, 17 aa, Mycobacterium avium
VSSLFSWTGDATQGPEA

SEQ ID NO: 112675 - protein, 17 aa, Mycobacterium avium
VSVTARRIGCWRFVTLH

SEQ ID NO: 112676 - protein, 18 aa, Mycobacterium avium
VTVGDGWTAGALRDYANQ

SEQ ID NO: 112677 - protein, 17 aa, Mycobacterium avium
VVAFASWPQQTVLRGTL

SEQ ID NO: 112678 - protein, 19 aa, Mycobacterium avium
VVDAARWPASWLAEATHEA

SEQ ID NO: 112679 - protein, 17 aa, Mycobacterium avium
VVGRPAAHPGLRRAPPL

SEQ ID NO: 112680 - protein, 22 aa, Mycobacterium avium
VVGWSAADAREWGETKLGSVGR

SEQ ID NO: 112681 - protein, 18 aa, Mycobacterium avium
VVHLAPWLEPEPICVAIS

SEQ ID NO: 112682 - protein, 17 aa, Mycobacterium avium
VVLRRIATRTGIPDYGY

SEQ ID NO: 112683 - protein, 17 aa, Mycobacterium avium
VVPALGLALLGARAAGK

SEQ ID NO: 112684 - protein, 23 aa, Mycobacterium avium
VVRRLDWPAGYTVRALNNAFLGT

SEQ ID NO: 112685 - protein, 19 aa, Mycobacterium avium
VVVALPFGVGQPVDRPALR

SEQ ID NO: 112686 - protein, 17 aa, Mycobacterium avium
VVVDHTWRAEALADMIS

SEQ ID NO: 112687 - protein, 19 aa, Mycobacterium avium
VWLWQRIAKDFGVSEIVTG

SEQ ID NO: 112688 - protein, 21 aa, Mycobacterium avium
VWPRYCERFHDILGVHPTARV

SEQ ID NO: 112689 - protein, 19 aa, Mycobacterium avium
VYFELRLSDAWVWDMYRPA

SEQ ID NO: 112690 - protein, 17 aa, Mycobacterium avium
VYLATRGGYFVLDLATG

SEQ ID NO: 112691 - protein, 20 aa, Mycobacterium avium
VYLFRACVDLAKLSWGKNHD

SEQ ID NO: 112692 - protein, 17 aa, Mycobacterium avium
VYRAELALVEVARKIGI

SEQ ID NO: 112693 - protein, 17 aa, Mycobacterium avium
VYWVFGGFLRKRRNIRD

SEQ ID NO: 112694 - protein, 18 aa, Mycobacterium avium
WAAAIARLADAEVAVAEC

SEQ ID NO: 112695 - protein, 17 aa, Mycobacterium avium
WAAPGGQGWLHGEAVVD

SEQ ID NO: 112696 - protein, 17 aa, Mycobacterium avium
WAFAELLALGSLVAGGK

SEQ ID NO: 112697 - protein, 17 aa, Mycobacterium avium
WAGESLLYFTPQVPQLT

SEQ ID NO: 112698 - protein, 17 aa, Mycobacterium avium
WAPPYAEAGAHNVTFHA

SEQ ID NO: 112699 - protein, 18 aa, Mycobacterium avium
WATWCGPCKMVAPVLEEI

SEQ ID NO: 112700 - protein, 22 aa, Mycobacterium avium
WCSDIRAGAGLVLAGLVADGDT

SEQ ID NO: 112701 - protein, 17 aa, Mycobacterium avium
WDMYRPARFVKQVRVVT

SEQ ID NO: 112702 - protein, 17 aa, Mycobacterium avium
WDRPVLMAWGTSDKMFP

SEQ ID NO: 112703 - protein, 19 aa, Mycobacterium avium
WDVARGSYRPAWCTVREVE

SEQ ID NO: 112704 - protein, 24 aa, Mycobacterium avium
WEALQIPVGLAFFFRNSALDRTVA

SEQ ID NO: 112705 - protein, 17 aa, Mycobacterium avium
WFACAGVRVADERLRGR

SEQ ID NO: 112706 - protein, 18 aa, Mycobacterium avium
WFASAGFSLVNMTGYPEA

SEQ ID NO: 112707 - protein, 18 aa, Mycobacterium avium
WGPAVAALARWSGDLTVA

SEQ ID NO: 112708 - protein, 17 aa, Mycobacterium avium
WGRDGIVEFLSLQRDLY

SEQ ID NO: 112709 - protein, 19 aa, Mycobacterium avium
WGVGGGLEFVGRVDEQVKV

SEQ ID NO: 112710 - protein, 23 aa, Mycobacterium avium
WHERETYDFFGIVFDGHPSLTRI

SEQ ID NO: 112711 - protein, 18 aa, Mycobacterium avium
WHRFPLRDKVAAVVPATP

SEQ ID NO: 112712 - protein, 19 aa, Mycobacterium avium
WILPLMWRMDAIYEARKSR

SEQ ID NO: 112713 - protein, 22 aa, Mycobacterium avium
WKDGEALFLRCNIWREAAENVA

SEQ ID NO: 112714 - protein, 19 aa, Mycobacterium avium
WKIELCDTIADNASSAGFV

SEQ ID NO: 112715 - protein, 17 aa, Mycobacterium avium
WKLALVVGGASPPALLD

SEQ ID NO: 112716 - protein, 18 aa, Mycobacterium avium
WLARDRWAVPLVHTAHTL

SEQ ID NO: 112717 - protein, 19 aa, Mycobacterium avium
WLARDRWAVPLVHTAHTLA

SEQ ID NO: 112718 - protein, 19 aa, Mycobacterium avium
WLEPTAYMMAKFGMTLCAL

SEQ ID NO: 112719 - protein, 17 aa, Mycobacterium avium
WLEREGTCLLLAPHHDV

SEQ ID NO: 112720 - protein, 18 aa, Mycobacterium avium
WLGTRLPYYANWIRIKSY

SEQ ID NO: 112721 - protein, 17 aa, Mycobacterium avium
WLLKQAFYYSLTTINEA

SEQ ID NO: 112722 - protein, 19 aa, Mycobacterium avium
WLMGCDMRGTICITGGCSN

SEQ ID NO: 112723 - protein, 32 aa, Mycobacterium avium
WLREGVRFWLRTALDAELLRWSSAVERARDMA

SEQ ID NO: 112724 - protein, 19 aa, Mycobacterium avium
WMLEHWGFTYANRIYSTPV

SEQ ID NO: 112725 - protein, 19 aa, Mycobacterium avium
WMPTDPMFSRWVMADTELA

SEQ ID NO: 112726 - protein, 18 aa, Mycobacterium avium
WNLQLSNAVIFRSANAEH

SEQ ID NO: 112727 - protein, 17 aa, Mycobacterium avium
WNRPGWTVAELEAAKGG

SEQ ID NO: 112728 - protein, 23 aa, Mycobacterium avium
WNVSELPCGPGRDVQEMLAAAAD

SEQ ID NO: 112729 - protein, 20 aa, Mycobacterium avium
WPAGWSGWPHRVYGDTRLEL

SEQ ID NO: 112730 - protein, 17 aa, Mycobacterium avium
WPGSWSGAAGRCSPSPT

SEQ ID NO: 112731 - protein, 17 aa, Mycobacterium avium
WPQMLLRALMFRLAVHA

SEQ ID NO: 112732 - protein, 17 aa, Mycobacterium avium
WPRPRVLCTVRLARRVL

SEQ ID NO: 112733 - protein, 20 aa, Mycobacterium avium
WPTDLDLWWAQTIALLPDGR

SEQ ID NO: 112734 - protein, 19 aa, Mycobacterium avium
WPTHILEILTTAPQLLAPA

SEQ ID NO: 112735 - protein, 19 aa, Mycobacterium avium
WPVCGGPLSGPTPRDVPAP

SEQ ID NO: 112736 - protein, 24 aa, Mycobacterium avium
WQDELFFKFGLRFDLLTNQLIDAN

SEQ ID NO: 112737 - protein, 18 aa, Mycobacterium avium
WQEARFRDALAFMSAEVI

SEQ ID NO: 112738 - protein, 18 aa, Mycobacterium avium
WQKYAVIISHTIPFDDVE

SEQ ID NO: 112739 - protein, 19 aa, Mycobacterium avium
WQRWRELQVQFGLGSIRAL

SEQ ID NO: 112740 - protein, 18 aa, Mycobacterium avium
WRADFAWPAHDPVGLIAR

SEQ ID NO: 112741 - protein, 18 aa, Mycobacterium avium
WRATLIVRESACLDAEDR

SEQ ID NO: 112742 - protein, 17 aa, Mycobacterium avium
WRDYRLGVLQAPLISAL

SEQ ID NO: 112743 - protein, 19 aa, Mycobacterium avium
WREARWVSVVINYRAERWS

SEQ ID NO: 112744 - protein, 17 aa, Mycobacterium avium
WRGAPRPVLARELLPER

SEQ ID NO: 112745 - protein, 19 aa, Mycobacterium avium
WRKADAALGRPVISNQVHF

SEQ ID NO: 112746 - protein, 17 aa, Mycobacterium avium
WRMGIRTIGQFAALARG

SEQ ID NO: 112747 - protein, 19 aa, Mycobacterium avium
WRPLPAEIYPLAEAKTAFR

SEQ ID NO: 112748 - protein, 17 aa, Mycobacterium avium
WRPTHMIQDGPGLTLIA

SEQ ID NO: 112749 - protein, 17 aa, Mycobacterium avium
WRQAGCSMCLGMNPDQL

SEQ ID NO: 112750 - protein, 17 aa, Mycobacterium avium
WRQPGRGPGRFWGVYGL

SEQ ID NO: 112751 - protein, 23 aa, Mycobacterium avium
WRQWWHWVPGASWRHPSGPDSDI

SEQ ID NO: 112752 - protein, 19 aa, Mycobacterium avium
WRRAAAVFDHAEWADDPRF

SEQ ID NO: 112753 - protein, 18 aa, Mycobacterium avium
WRRAASVFDHAEWADDPR

SEQ ID NO: 112754 - protein, 19 aa, Mycobacterium avium
WRRAASVFDHAEWADDPRF

SEQ ID NO: 112755 - protein, 20 aa, Mycobacterium avium
WRRGGLTASRFVACPFGAPG

SEQ ID NO: 112756 - protein, 20 aa, Mycobacterium avium
WRRGGLTASRFVACPFGRPG

SEQ ID NO: 112757 - protein, 18 aa, Mycobacterium avium
WRRTEFRAVDAVSFRLRR

SEQ ID NO: 112758 - protein, 17 aa, Mycobacterium avium
WRTDFLNQMGLVIADSI

SEQ ID NO: 112759 - protein, 22 aa, Mycobacterium avium
WRTTYPADHSWMVATLSGARSS

SEQ ID NO: 112760 - protein, 20 aa, Mycobacterium avium
WRVNCFGAFLGIRAALERLR

SEQ ID NO: 112761 - protein, 21 aa, Mycobacterium avium
WRWDTDWFWCSRAFGVQNPRV

SEQ ID NO: 112762 - protein, 22 aa, Mycobacterium avium
WRWDTDWFWCSRAFGVQNPRVR

SEQ ID NO: 112763 - protein, 18 aa, Mycobacterium avium
WSAAECRSRRSSSASPAG

SEQ ID NO: 112764 - protein, 19 aa, Mycobacterium avium
WSAEGWVGVAGRVVNDGVR

SEQ ID NO: 112765 - protein, 17 aa, Mycobacterium avium
WSAPRLHLVDLQYSDVR

SEQ ID NO: 112766 - protein, 18 aa, Mycobacterium avium
WSGPASMSMVAAVMPYIA

SEQ ID NO: 112767 - protein, 18 aa, Mycobacterium avium
WSSGCDHATWAFLGGPVI

SEQ ID NO: 112768 - protein, 17 aa, Mycobacterium avium
WSTEAWQRCAYFTEVRR

SEQ ID NO: 112769 - protein, 18 aa, Mycobacterium avium
WTLRGADESLCFAGANLV

SEQ ID NO: 112770 - protein, 18 aa, Mycobacterium avium
WVALSVRHDDDWRAVLDA

SEQ ID NO: 112771 - protein, 20 aa, Mycobacterium avium
WVNTIFLSTRFKAWRVGGYN

SEQ ID NO: 112772 - protein, 17 aa, Mycobacterium avium
WWQRAVEAWPDYAEYQT

SEQ ID NO: 112773 - protein, 19 aa, Mycobacterium avium
WWQRAVEAWPDYAEYQTKT

SEQ ID NO: 112774 - protein, 17 aa, Mycobacterium avium
YAFMAAIGWVFKVKGRW

SEQ ID NO: 112775 - protein, 25 aa, Mycobacterium avium
YAFTYRTGCTWLRTWDAKLWSLHSG

SEQ ID NO: 112776 - protein, 17 aa, Mycobacterium avium
YAHWARRTCDPLAARVT

SEQ ID NO: 112777 - protein, 17 aa, Mycobacterium avium
YDDMAWLALALERAARI

SEQ ID NO: 112778 - protein, 19 aa, Mycobacterium avium
YDESLWRLLCEQVGAAALV

SEQ ID NO: 112779 - protein, 18 aa, Mycobacterium avium
YDGAVFHRVIRGFMIQGG

SEQ ID NO: 112780 - protein, 26 aa, Mycobacterium avium
YEDLAWFCIRAWRFGAPAGFGAGGLG

SEQ ID NO: 112781 - protein, 20 aa, Mycobacterium avium
YELVDGFPRFDVDDVYLGNG

SEQ ID NO: 112782 - protein, 20 aa, Mycobacterium avium
YEMVTRVSAVWANELFAEIP

SEQ ID NO: 112783 - protein, 18 aa, Mycobacterium avium
YENACRWYSFDPFEHRTR

SEQ ID NO: 112784 - protein, 19 aa, Mycobacterium avium
YEPLWALCAELDFTVVQHA

SEQ ID NO: 112785 - protein, 18 aa, Mycobacterium avium
YEPLWALCAELDLTVVQH

SEQ ID NO: 112786 - protein, 19 aa, Mycobacterium avium
YGAGPGRCVAVLLERSAEA

SEQ ID NO: 112787 - protein, 17 aa, Mycobacterium avium
YGGPRPLISYAPGTQGQ

SEQ ID NO: 112788 - protein, 21 aa, Mycobacterium avium
YGGSCALRLALDNPRRVGKLV

SEQ ID NO: 112789 - protein, 24 aa, Mycobacterium avium
YGHYGGLFIRMSWHAAGTYRIHDG

SEQ ID NO: 112790 - protein, 20 aa, Mycobacterium avium
YGKDGSVMACVFNFAGAEHS

SEQ ID NO: 112791 - protein, 18 aa, Mycobacterium avium
YGKTASQVLLRWNLQLSN

SEQ ID NO: 112792 - protein, 19 aa, Mycobacterium avium
YGRDRIGLLTGDMSVNADA

SEQ ID NO: 112793 - protein, 25 aa, Mycobacterium avium
YGRGFPFALVFGGLYAARGYHVVLQ

SEQ ID NO: 112794 - protein, 17 aa, Mycobacterium avium
YGVRVLVIRPGQVRTRM

SEQ ID NO: 112795 - protein, 19 aa, Mycobacterium avium
YHLVGWSFGGVVAHELAIE

SEQ ID NO: 112796 - protein, 21 aa, Mycobacterium avium
YHRQWEPKIPLGRMGRPDELA

SEQ ID NO: 112797 - protein, 17 aa, Mycobacterium avium
YHRYWLAEHHFVAVASS

SEQ ID NO: 112798 - protein, 17 aa, Mycobacterium avium
YHWFLGDGMVHGIRIRD

SEQ ID NO: 112799 - protein, 18 aa, Mycobacterium avium
YIRPRVEVELAFVMGEQL

SEQ ID NO: 112800 - protein, 22 aa, Mycobacterium avium
YKARLQPHLEAMAALKEQVKPF

SEQ ID NO: 112801 - protein, 17 aa, Mycobacterium avium
YLGAFGMDAVQAHEERL

SEQ ID NO: 112802 - protein, 17 aa, Mycobacterium avium
YLIFPALSLRRWRRTLT

SEQ ID NO: 112803 - protein, 18 aa, Mycobacterium avium
YLRLGLLVEQMFPEARIQ

SEQ ID NO: 112804 - protein, 23 aa, Mycobacterium avium
YLRRWHRRRPLWIGVAIGGTVDS

SEQ ID NO: 112805 - protein, 25 aa, Mycobacterium avium
YLSSELRRGWLYSFEINPSWADIAE

SEQ ID NO: 112806 - protein, 17 aa, Mycobacterium avium
YNCHLIFRTDLYRRTTI

SEQ ID NO: 112807 - protein, 19 aa, Mycobacterium avium
YNLETCWRDYRLGVLQAPL

SEQ ID NO: 112808 - protein, 26 aa, Mycobacterium avium
YNPLRFLRAAMKWCRKAQTLGTLDDA

SEQ ID NO: 112809 - protein, 20 aa, Mycobacterium avium
YNVRVMTQWVPKSGASYAYF

SEQ ID NO: 112810 - protein, 17 aa, Mycobacterium avium
YPAIMAMTSLNDTRVYY

SEQ ID NO: 112811 - protein, 23 aa, Mycobacterium avium
YPEWSDGVTGCWVLARYDDGRPS

SEQ ID NO: 112812 - protein, 23 aa, Mycobacterium avium
YPGYAGSLDHIWALAEHPPAGTG

SEQ ID NO: 112813 - protein, 17 aa, Mycobacterium avium
YPRLVVATITGWGSTGP

SEQ ID NO: 112814 - protein, 18 aa, Mycobacterium avium
YQAWQLGGTYQRGGKTRV

SEQ ID NO: 112815 - protein, 18 aa, Mycobacterium avium
YQVFAWRPGLIVDLLEAA

SEQ ID NO: 112816 - protein, 17 aa, Mycobacterium avium
YRCGESWSTLVRHRPTG

SEQ ID NO: 112817 - protein, 23 aa, Mycobacterium avium
YRDADGWIYLAGRTADWMRVDGE

SEQ ID NO: 112818 - protein, 20 aa, Mycobacterium avium
YRDRICRAREQLAATDNPLH

SEQ ID NO: 112819 - protein, 20 aa, Mycobacterium avium
YRESPAWGFCMWAITPDQMY

SEQ ID NO: 112820 - protein, 17 aa, Mycobacterium avium
YRFTRPGHDITLFSRTM

SEQ ID NO: 112821 - protein, 20 aa, Mycobacterium avium
YRHLVALGVRFVRDAATRLD

SEQ ID NO: 112822 - protein, 18 aa, Mycobacterium avium
YRPFRALIRAVLRHAGGV

SEQ ID NO: 112823 - protein, 17 aa, Mycobacterium avium
YRQMRNFWATLMVSQGT

SEQ ID NO: 112824 - protein, 19 aa, Mycobacterium avium
YRVGQKILPQQARKGDLIF

SEQ ID NO: 112825 - protein, 23 aa, Mycobacterium avium
YSDGRYSYQLTIYVFRYGDGTAM

SEQ ID NO: 112826 - protein, 21 aa, Mycobacterium avium
YSHGWSIGDTVIWDNRGVLHR

SEQ ID NO: 112827 - protein, 21 aa, Mycobacterium avium
YSMGGVVAFEFARVAEANGTP

SEQ ID NO: 112828 - protein, 20 aa, Mycobacterium avium
YTAPEFFDYLVALAAADPDL

SEQ ID NO: 112829 - protein, 17 aa, Mycobacterium avium
YTFACDRWRVVPDVYLL

SEQ ID NO: 112830 - protein, 21 aa, Mycobacterium avium
YTGLRWSELVGLRVKDIDLVA

SEQ ID NO: 112831 - protein, 18 aa, Mycobacterium avium
YVMPHWPKPWGRAADAVE

SEQ ID NO: 112832 - protein, 17 aa, Mycobacterium avium
YVRRPGLTASRFVPNPF

SEQ ID NO: 112833 - protein, 19 aa, Mycobacterium avium
YVRRPGLTASRFVPNPFGA

SEQ ID NO: 112834 - protein, 17 aa, Mycobacterium avium
YWDSAFAQHHWGGLLAP

SEQ ID NO: 112835 - protein, 18 aa, Mycobacterium avium
YWGGVCLNVGCIPSKALL

SEQ ID NO: 112836 - protein, 17 aa, Mycobacterium avium
YWRPLMADLPEPLELPG

SEQ ID NO: 112837 - protein, 20 aa, Mycobacterium avium
YYAMTGWRLGWLLVPVELRR

SEQ ID NO: 112838 - protein, 27 aa, Mycobacterium avium
RPLGDQRFPYVFLDATYCKARVNHRVV

SEQ ID NO: 112839 - protein, 28 aa, Mycobacterium avium
SEDGAFWTAFLRSLKSRGLAGVQLVISD

SEQ ID NO: 112840 - protein, 17 aa, Mycobacterium avium
LERRRRVDQCLFAVVME

SEQ ID NO: 112841 - protein, 23 aa, Mycobacterium avium
AVLIGAAWQRCRVHFLRNVLAQV

SEQ ID NO: 112842 - protein, 18 aa, Mycobacterium avium
QRCRVHFLRNVLAQVPKG

SEQ ID NO: 112843 - protein, 21 aa, Mycobacterium avium
DLELRIPKLRTGSFFPALLER

SEQ ID NO: 112844 - protein, 21 aa, Mycobacterium avium
PVAHWKKIWSTNPLERLNKEI

SEQ ID NO: 112845 - protein, 17 aa, Mycobacterium avium
IDLNAGGAALLIALLIA

SEQ ID NO: 112846 - protein, 17 aa, Mycobacterium avium
LARRRLNVLWAMLRDHA

SEQ ID NO: 112847 - protein, 34 aa, Mycobacterium avium
NAGGAALLIALLIAAGQRLLYIPGRTVHHAAGSY

SEQ ID NO: 112848 - protein, 25 aa, Mycobacterium avium
NRMRAQLLEYFPALERAFDYNKSRA

SEQ ID NO: 112849 - protein, 18 aa, Mycobacterium avium
RRLNVLWAMLRDHAVYHP

SEQ ID NO: 112850 - protein, 23 aa, Mycobacterium avium
RRYDRRLLRACYLSALVSIRTDP

SEQ ID NO: 112851 - protein, 27 aa, Mycobacterium avium
RPLSEQHFPYVFLDATYCKARVNHRVV

SEQ ID NO: 112852 - protein, 29 aa, Mycobacterium avium
DITAFADFPVLHWKKIWSTNPLERLNKEI

SEQ ID NO: 112853 - protein, 26 aa, Mycobacterium avium
EDGAFWTAFLRSLKTRGLSGVQLVIS

SEQ ID NO: 112854 - protein, 17 aa, Mycobacterium avium
RCRVHFLRNVLAQVPKG

SEQ ID NO: 112855 - protein, 23 aa, Mycobacterium avium
EAILIGASWQRCRVHFLRNVLAQ

SEQ ID NO: 112856 - protein, 27 aa, Mycobacterium avium
ANHVVWAIDLTSPPAALLIAVLLSAKA

SEQ ID NO: 112857 - protein, 22 aa, Mycobacterium avium
AVMRPVITQLWEDNYRVYGARK

SEQ ID NO: 112858 - protein, 25 aa, Mycobacterium avium
EIRELKRANEILKRAASFFGAELDR

SEQ ID NO: 112859 - protein, 19 aa, Mycobacterium avium
MLTAIFPALEAAFDYSTRA

SEQ ID NO: 112860 - protein, 24 aa, Mycobacterium avium
NRELKRANEILKRAASFFGAELDR

SEQ ID NO: 112861 - protein, 17 aa, Mycobacterium avium
PAALLIAVLLSAKAEVV

SEQ ID NO: 112862 - protein, 20 aa, Mycobacterium avium
PALEAAFDYSTRAPLILVSA

SEQ ID NO: 112863 - protein, 18 aa, Mycobacterium avium
RLRSMLTAIFPALEAAFD

SEQ ID NO: 112864 - protein, 28 aa, Mycobacterium avium
RPKRYNRRLRRVFYLAALSSLKIEGPSR

SEQ ID NO: 112865 - protein, 24 aa, Mycobacterium avium
RRHVDVLWALLRDNRTWQPQQPTV

SEQ ID NO: 112866 - protein, 24 aa, Mycobacterium avium
TFACGPHHRLLQPGAWTTHKNAKG

SEQ ID NO: 112867 - protein, 21 aa, Mycobacterium avium
VESVRTWVRQVDIDEGLAPGV

SEQ ID NO: 112868 - protein, 45 aa, Mycobacterium avium
AERRRFSSAILPAWARKSPQMTEVLPLLYLHGLSTSDFGPALEQF

SEQ ID NO: 112869 - protein, 28 aa, Mycobacterium avium
APNQLWVTDLTFVPTWAGVAYVCFLTDA

SEQ ID NO: 112870 - protein, 23 aa, Mycobacterium avium
DADVLLEFYRYPAEHWIHLRTTN

SEQ ID NO: 112871 - protein, 17 aa, Mycobacterium avium
DLSGTDYVYLWVDGIHL

SEQ ID NO: 112872 - protein, 19 aa, Mycobacterium avium
IAMAYKLIDAAQARWRAVN

SEQ ID NO: 112873 - protein, 19 aa, Mycobacterium avium
KLIDAAQARWRAVNAPHLV

SEQ ID NO: 112874 - protein, 19 aa, Mycobacterium avium
LGFWKAMREVFPATREQRC

SEQ ID NO: 112875 - protein, 24 aa, Mycobacterium avium
LTDAFSRMIIGWRVASHMRTTVVL

SEQ ID NO: 112876 - protein, 21 aa, Mycobacterium avium
SGTDYVYLWVDGIHLKVRLEQ

SEQ ID NO: 112877 - protein, 18 aa, Mycobacterium avium
WEDNYRVYGARKLWKAAR

SEQ ID NO: 112878 - protein, 27 aa, Mycobacterium avium
AEHQAIIRDVLAAGDFWGGAGSVACQE

SEQ ID NO: 112879 - protein, 24 aa, Mycobacterium avium
DEARKMWASSMNIAGAGWSGQAQA

SEQ ID NO: 112880 - protein, 20 aa, Mycobacterium avium
GYLPDQELAPRAAEAVALLA

SEQ ID NO: 112881 - protein, 18 aa, Mycobacterium avium
HRHHLGHRLTRPHTKALP

SEQ ID NO: 112882 - protein, 17 aa, Mycobacterium avium
HRLTRPHTKALPQPPTA

SEQ ID NO: 112883 - protein, 18 aa, Mycobacterium avium
KLAKLRWLDRATGQVVRR

SEQ ID NO: 112884 - protein, 22 aa, Mycobacterium avium
PLALYHTKRLASPGQRIVLYAK

SEQ ID NO: 112885 - protein, 25 aa, Mycobacterium avium
PSQWRSHLRKILSLMPVGVPVHDRH

SEQ ID NO: 112886 - protein, 24 aa, Mycobacterium avium
QTHPSYPRAIIARCSRRGPRPRLA

SEQ ID NO: 112887 - protein, 25 aa, Mycobacterium avium
RDADGWIYLAGRTADWMRVDGENLA

SEQ ID NO: 112888 - protein, 19 aa, Mycobacterium avium
RNANMLSAFRRCPATDSAS

SEQ ID NO: 112889 - protein, 19 aa, Mycobacterium avium
IDALRRAVAFRRFRAADVR

SEQ ID NO: 112890 - protein, 25 aa, Mycobacterium avium
LAIASHWPFEQWGRFLPEHTTAASI

SEQ ID NO: 112891 - protein, 27 aa, Mycobacterium avium
RKETAAAFWLRAQAWFTTCGFTVRKVL

SEQ ID NO: 112892 - protein, 21 aa, Mycobacterium avium
AAAMKLLYLAIRNINQKRGSA

SEQ ID NO: 112893 - protein, 25 aa, Mycobacterium avium
AADGWSLTPLVRDLARAYASRSAGR

SEQ ID NO: 112894 - protein, 33 aa, Mycobacterium avium
AAPGLMVFCAVLAYSRWRFVRFAADEKASTTLA

SEQ ID NO: 112895 - protein, 19 aa, Mycobacterium avium
ADEWAYARLYRSDTERCEE

SEQ ID NO: 112896 - protein, 22 aa, Mycobacterium avium
ALALYHTKRLASPAQRIVLYAK

SEQ ID NO: 112897 - protein, 20 aa, Mycobacterium avium
AVIQTCVVHLLRASMRYASY

SEQ ID NO: 112898 - protein, 19 aa, Mycobacterium avium
DEWVHYYNTARPHQSLNMT

SEQ ID NO: 112899 - protein, 20 aa, Mycobacterium avium
FTTWLHTYNHHRGHTALGGQ

SEQ ID NO: 112900 - protein, 18 aa, Mycobacterium avium
GEQALIDALRRAVAFRRF

SEQ ID NO: 112901 - protein, 26 aa, Mycobacterium avium
GVIKMVLAMRHELLPATLHVDEPSPH

SEQ ID NO: 112902 - protein, 28 aa, Mycobacterium avium
IKETAAEFWTRANAWFAECGISVRKVLT

SEQ ID NO: 112903 - protein, 19 aa, Mycobacterium avium
MVVQAALAVLLAKVSASSD

SEQ ID NO: 112904 - protein, 19 aa, Mycobacterium avium
NYCVYGARKLWKTARRDGH

SEQ ID NO: 112905 - protein, 17 aa, Mycobacterium avium
PALACGNAFVLKPSERD

SEQ ID NO: 112906 - protein, 19 aa, Mycobacterium avium
PPVEVLFDAICRQNGIDHL

SEQ ID NO: 112907 - protein, 17 aa, Mycobacterium avium
PVAYHTFGGWKRSGFGD

SEQ ID NO: 112908 - protein, 18 aa, Mycobacterium avium
QALDEWVHYYNTARPHQS

SEQ ID NO: 112909 - protein, 29 aa, Mycobacterium avium
QSRPVDPVYPILYIDAIRLKIRDGGVVSN

SEQ ID NO: 112910 - protein, 25 aa, Mycobacterium avium
RATFEHRAVVVGGDRDRLLAGLDEL

SEQ ID NO: 112911 - protein, 23 aa, Mycobacterium avium
RRKVDGLSCIRYGSARYSVPQRL

SEQ ID NO: 112912 - protein, 23 aa, Mycobacterium avium
SARNFRRLVAEQKVLWRNANRHQ

SEQ ID NO: 112913 - protein, 27 aa, Mycobacterium avium
VHVDGELLRFWIGDQLVKTAARTNHAE

SEQ ID NO: 112914 - protein, 18 aa, Mycobacterium avium
VSLLTEAQPWPGERPRRA

SEQ ID NO: 112915 - protein, 17 aa, Mycobacterium avium
VVHLLRASMRYASYTDR

SEQ ID NO: 112916 - protein, 29 aa, Mycobacterium avium
VWDRSWAEFVPFLAFPVEIRKIIYTTNAI

SEQ ID NO: 112917 - protein, 17 aa, Mycobacterium avium
WFAECGISVRKVLTDNG

SEQ ID NO: 112918 - protein, 23 aa, Mycobacterium avium
WSPGDYLVMDWAEAAPGLMVFCA

SEQ ID NO: 112919 - protein, 17 aa, Mycobacterium avium
YARLYRSDTERCEEFTT

SEQ ID NO: 112920 - protein, 24 aa, Mycobacterium avium
YEIRTLFGVMFQDGALFGSMNLFD

SEQ ID NO: 112921 - protein, 20 aa, Mycobacterium avium
AAAAVLPYRQFHDVAENFRY

SEQ ID NO: 112922 - protein, 22 aa, Mycobacterium avium
AAADLSTIRRKAAKRLAKEVTA

SEQ ID NO: 112923 - protein, 25 aa, Mycobacterium avium
AAAELRQPIWLVTRGAQRVTDADTV

SEQ ID NO: 112924 - protein, 21 aa, Mycobacterium avium
AAAGRISYRLGLQGPAVAVDT

SEQ ID NO: 112925 - protein, 26 aa, Mycobacterium avium
AAAGRPIVVRLLVTAMRHAAVSREIA

SEQ ID NO: 112926 - protein, 18 aa, Mycobacterium avium
AAAIFPPGTVIADAAIGL

SEQ ID NO: 112927 - protein, 17 aa, Mycobacterium avium
AAAIRRLSSLLVSLEHP

SEQ ID NO: 112928 - protein, 29 aa, Mycobacterium avium
AAALHAPLDVFLVRKLGVPNWSELAMGAL

SEQ ID NO: 112929 - protein, 17 aa, Mycobacterium avium
AAALRRELLRDGQAFYV

SEQ ID NO: 112930 - protein, 26 aa, Mycobacterium avium
AAANSWLDAFTRWRRARGLKATAIAW

SEQ ID NO: 112931 - protein, 24 aa, Mycobacterium avium
AAAPAITAVVPPAADPVSLQTALG

SEQ ID NO: 112932 - protein, 35 aa, Mycobacterium avium
AAARPPTFVLFTTGFLEAGYRRFLERRLREAFGFE

SEQ ID NO: 112933 - protein, 20 aa, Mycobacterium avium
AAARVPYTRGLHQVGDRVWA

SEQ ID NO: 112934 - protein, 24 aa, Mycobacterium avium
AAAVDVTLLGRFYERFADHAVEVA

SEQ ID NO: 112935 - protein, 17 aa, Mycobacterium avium
AAAVRLHKQAHLPYLVY

SEQ ID NO: 112936 - protein, 18 aa, Mycobacterium avium
AAAWPRWATVITKVTWTS

SEQ ID NO: 112937 - protein, 23 aa, Mycobacterium avium
AADAVAAYLPYRSKPRSPEGLKK

SEQ ID NO: 112938 - protein, 17 aa, Mycobacterium avium
AADGWDPFPEFINGLRS

SEQ ID NO: 112939 - protein, 30 aa, Mycobacterium avium
AADIDEDLLVRLKAWRLDVAKEQKVPAYVV

SEQ ID NO: 112940 - protein, 27 aa, Mycobacterium avium
AADIKAIPFVIHVMDRLARVVNALGGD

SEQ ID NO: 112941 - protein, 36 aa, Mycobacterium avium
AADKAAHFIMVADSFHLPIVFLADNPGMLPGSRSER

SEQ ID NO: 112942 - protein, 33 aa, Mycobacterium avium
AADKAGDFLALCESFGLPVISLCDTPGFMVGPD

SEQ ID NO: 112943 - protein, 24 aa, Mycobacterium avium
AADPPPVPLDAAILFAPVGDLVLP

SEQ ID NO: 112944 - protein, 17 aa, Mycobacterium avium
AADRYVRAGRWAREGPF

SEQ ID NO: 112945 - protein, 28 aa, Mycobacterium avium
AADSAELPLFRYLGGPNAHILPVPMMNI

SEQ ID NO: 112946 - protein, 19 aa, Mycobacterium avium
AAEAAFVFAMIGVDLSRLA

SEQ ID NO: 112947 - protein, 30 aa, Mycobacterium avium
AAEALSARHLLPVPWVEPVDVSNAVVFLAS

SEQ ID NO: 112948 - protein, 26 aa, Mycobacterium avium
AAEELRRLWRARRVLAVTFPSHTSAT

SEQ ID NO: 112949 - protein, 27 aa, Mycobacterium avium
AAEICDGWLPIFYTPRLADMYNEWLDE

SEQ ID NO: 112950 - protein, 25 aa, Mycobacterium avium
AAELATMFHIYFLGSAEGLIFDVPS

SEQ ID NO: 112951 - protein, 32 aa, Mycobacterium avium
AAELLGIPWIELSPHPLYLPSKGLPPIGSGLA

SEQ ID NO: 112952 - protein, 22 aa, Mycobacterium avium
AAELSMVLLDTAAMADLHMRWM

SEQ ID NO: 112953 - protein, 28 aa, Mycobacterium avium
AAENPPMIRYPIPPMIHGATQSATWMSI

SEQ ID NO: 112954 - protein, 18 aa, Mycobacterium avium
AAEPLLPALQRELRRRSG

SEQ ID NO: 112955 - protein, 19 aa, Mycobacterium avium
AAFELTHWTVVHPSLVAAN

SEQ ID NO: 112956 - protein, 19 aa, Mycobacterium avium
AAFELVVVNLYPFTETVDS

SEQ ID NO: 112957 - protein, 19 aa, Mycobacterium avium
AAFERPGPRLRDYLLAVKA

SEQ ID NO: 112958 - protein, 20 aa, Mycobacterium avium
AAFYERLRELFAQKKSITTF

SEQ ID NO: 112959 - protein, 30 aa, Mycobacterium avium
AAGDEVMMGWRSFECYLPIVQVAGAIAVKV

SEQ ID NO: 112960 - protein, 33 aa, Mycobacterium avium
AAGDHAAICWPLLVGMAKAKYYLLTCETLLGEE

SEQ ID NO: 112961 - protein, 26 aa, Mycobacterium avium
AAGLDARSWRLPWPDGTVVYELDQPK

SEQ ID NO: 112962 - protein, 28 aa, Mycobacterium avium
AAGLDVPTFRMLAGLRGRVPLVSVVSGR

SEQ ID NO: 112963 - protein, 20 aa, Mycobacterium avium
AAGLPPLRGSLPGAVAAPVL

SEQ ID NO: 112964 - protein, 32 aa, Mycobacterium avium
AAGLRAGVPMLILWLWLDQPVWAEAVSALEVG

SEQ ID NO: 112965 - protein, 22 aa, Mycobacterium avium
AAGLTLRIPRPGLCTDNGAMIA

SEQ ID NO: 112966 - protein, 25 aa, Mycobacterium avium
AAGRYVLDRAIFDALRRIDRGAGGE

SEQ ID NO: 112967 - protein, 32 aa, Mycobacterium avium
AAGVAFPDALLTRGLYQYRPELPFVLGAEIAG

SEQ ID NO: 112968 - protein, 26 aa, Mycobacterium avium
AAGYPDMVAPLTFLAIAGRRVQLEIF

SEQ ID NO: 112969 - protein, 24 aa, Mycobacterium avium
AAHKGDFLLHALRLCRPAVIFTDP

SEQ ID NO: 112970 - protein, 24 aa, Mycobacterium avium
AAHLQWHLERQLKTLPLVERTYHI

SEQ ID NO: 112971 - protein, 19 aa, Mycobacterium avium
AAIFSFPYDVDAVTKIAAL

SEQ ID NO: 112972 - protein, 28 aa, Mycobacterium avium
AAIGLVKFDLLGLGMLSALHYAIDLVAE

SEQ ID NO: 112973 - protein, 18 aa, Mycobacterium avium
AAIRARLAERLPAYMVPA

SEQ ID NO: 112974 - protein, 20 aa, Mycobacterium avium
AAIRIAGARALQLAGLGIDD

SEQ ID NO: 112975 - protein, 24 aa, Mycobacterium avium
AAKALPILDALLNATGIKPADVVA

SEQ ID NO: 112976 - protein, 25 aa, Mycobacterium avium
AAKELAYLGVRVNAIAPGLIRSAMT

SEQ ID NO: 112977 - protein, 23 aa, Mycobacterium avium
AAKGKELVWAPAAFRYVMMVLRH

SEQ ID NO: 112978 - protein, 26 aa, Mycobacterium avium
AAKRPEDFRFLIRLARQQGTRLGRAY

SEQ ID NO: 112979 - protein, 19 aa, Mycobacterium avium
AALAPLRRSLVVTAITGDD

SEQ ID NO: 112980 - protein, 25 aa, Mycobacterium avium
AALGDLPLIYPFLVNDPGEGTQAKR

SEQ ID NO: 112981 - protein, 25 aa, Mycobacterium avium
AALGRDFLTIWFAQLHQQVADIRRR

SEQ ID NO: 112982 - protein, 21 aa, Mycobacterium avium
AALISPLRLRGLSAMLARIKR

SEQ ID NO: 112983 - protein, 26 aa, Mycobacterium avium
AALPPQCWRLVWRNPVNGRKALYLAS

SEQ ID NO: 112984 - protein, 17 aa, Mycobacterium avium
AALPQQCLRSDRLSALH

SEQ ID NO: 112985 - protein, 31 aa, Mycobacterium avium
AALRDLVARRTPLFEFAIRSALAELDLDSAE

SEQ ID NO: 112986 - protein, 19 aa, Mycobacterium avium
AAMAAWESFHAKAGPAIKA

SEQ ID NO: 112987 - protein, 21 aa, Mycobacterium avium
AAMMAYFADFTGKLSHGVYKM

SEQ ID NO: 112988 - protein, 29 aa, Mycobacterium avium
AAMTGWQRLHFRFGIPAPLLEPLAVERLY

SEQ ID NO: 112989 - protein, 25 aa, Mycobacterium avium
AANFRDVMIALGLYPDPDAVMGIEA

SEQ ID NO: 112990 - protein, 29 aa, Mycobacterium avium
AANMAALWDLPIVFVCQNNRYAEMTPTTD

SEQ ID NO: 112991 - protein, 24 aa, Mycobacterium avium
AAPFLSYGPFTGNAPRDLCALWPV

SEQ ID NO: 112992 - protein, 24 aa, Mycobacterium avium
AAPSLDIGLPWRQYRSVQRGIAGF

SEQ ID NO: 112993 - protein, 29 aa, Mycobacterium avium
AAPTAWLAEGLLIYLPPEAQDRLFDNITA

SEQ ID NO: 112994 - protein, 25 aa, Mycobacterium avium
AAPTTLQVIFAYPGVHAIWGHRVNH

SEQ ID NO: 112995 - protein, 20 aa, Mycobacterium avium
AAQEDWLFEFGWHALDAVAD

SEQ ID NO: 112996 - protein, 30 aa, Mycobacterium avium
AAQETLIALARLRELIDRYPLRGIKGPMGT

SEQ ID NO: 112997 - protein, 24 aa, Mycobacterium avium
AAQHSWPTVAAWVKWLSTGGDKPT

SEQ ID NO: 112998 - protein, 19 aa, Mycobacterium avium
AAQLLMKRFPDPTTPEAQQ

SEQ ID NO: 112999 - protein, 37 aa, Mycobacterium avium
AAQLREFLLSRFRDITLLTFERLVFDGVLQEVVLFCG

SEQ ID NO: 113000 - protein, 20 aa, Mycobacterium avium
AAQRAVIIGAGFIGCEVAAS

SEQ ID NO: 113001 - protein, 26 aa, Mycobacterium avium
AARAMNLLQVPWVDPVDVANAALFLA

SEQ ID NO: 113002 - protein, 18 aa, Mycobacterium avium
AARDLQFELAARFRDEIA

SEQ ID NO: 113003 - protein, 32 aa, Mycobacterium avium
AARERLLDTLDLFGTALAIAAIRRGAGPAQLR

SEQ ID NO: 113004 - protein, 18 aa, Mycobacterium avium
AARFRRPGATPSPTPSSA

SEQ ID NO: 113005 - protein, 28 aa, Mycobacterium avium
AARITTPLLPDDYLHLANPLWSARELRG

SEQ ID NO: 113006 - protein, 26 aa, Mycobacterium avium
AARLAAHAAVFWLGRGRTASRETAVA

SEQ ID NO: 113007 - protein, 22 aa, Mycobacterium avium
AARLLSIPLRHVYAALWRVGVL

SEQ ID NO: 113008 - protein, 29 aa, Mycobacterium avium
AARLRAVATWLRTMFAIVPLAVGNRVDDQ

SEQ ID NO: 113009 - protein, 26 aa, Mycobacterium avium
AARVPQEWLLPYVHQRYDDVALLAAP

SEQ ID NO: 113010 - protein, 19 aa, Mycobacterium avium
AARVVNAIDWVCRAPQGLI

SEQ ID NO: 113011 - protein, 23 aa, Mycobacterium avium
AASDAFFPFPDGLETLTGAGVKA

SEQ ID NO: 113012 - protein, 26 aa, Mycobacterium avium
AASGCVLLPGLPYLGLEHRAAWVEAE

SEQ ID NO: 113013 - protein, 24 aa, Mycobacterium avium
AASSWRELDPWLRDTFAEARHQLP

SEQ ID NO: 113014 - protein, 27 aa, Mycobacterium avium
AATAFPWRRQSALVQWYVETSGDPAAA

SEQ ID NO: 113015 - protein, 30 aa, Mycobacterium avium
AATDLLDEAWWFPAIQWPDGRMQFMLNERM

SEQ ID NO: 113016 - protein, 32 aa, Mycobacterium avium
AATHLSRLVPQHLMRRLFFTAATVDAATLHHF

SEQ ID NO: 113017 - protein, 24 aa, Mycobacterium avium
AATIKRVFLELGGKSAFVVLDDAD

SEQ ID NO: 113018 - protein, 27 aa, Mycobacterium avium
AATPYAAVTFPWYQLGRQVHLRGPVSK

SEQ ID NO: 113019 - protein, 26 aa, Mycobacterium avium
AATVPPPVIAANRSLLATLVATNFLG

SEQ ID NO: 113020 - protein, 41 aa, Mycobacterium avium
AAVDFSVLYPTGRLVDAPLPTWTHRRLWLTDGGLESPTHGG

SEQ ID NO: 113021 - protein, 27 aa, Mycobacterium avium
AAVGASGFYAKWLPQLVFGEGQRPRAY

SEQ ID NO: 113022 - protein, 19 aa, Mycobacterium avium
AAVNPWMLRMAGEVADGVH

SEQ ID NO: 113023 - protein, 26 aa, Mycobacterium avium
AAVPMRVEALLRYPVKSMLGETLDRL

SEQ ID NO: 113024 - protein, 23 aa, Mycobacterium avium
AAVRHGGFTLAERKRLAALAFQH

SEQ ID NO: 113025 - protein, 18 aa, Mycobacterium avium
AAWRTIFTDDFLSDTSEA

SEQ ID NO: 113026 - protein, 24 aa, Mycobacterium avium
AAYGARFAGVAFPGETLKVGIWKE

SEQ ID NO: 113027 - protein, 21 aa, Mycobacterium avium
AAYLAGFAWGLSRDYSVLVEM

SEQ ID NO: 113028 - protein, 22 aa, Mycobacterium avium
AAYLAGPKAISGALAPLASGGN

SEQ ID NO: 113029 - protein, 17 aa, Mycobacterium avium
AAYTGIDPYFDDLFLMA

SEQ ID NO: 113030 - protein, 35 aa, Mycobacterium avium
ACAAFTRSISLFAKGFPSPWLVVVGAFQAQAEGAR

SEQ ID NO: 113031 - protein, 31 aa, Mycobacterium avium
ACGFDTPYPPARLEKWWLPGPDRLLDCVERT

SEQ ID NO: 113032 - protein, 19 aa, Mycobacterium avium
ACHGFDSLLPDWPGSQRLF

SEQ ID NO: 113033 - protein, 28 aa, Mycobacterium avium
ACQIAGITYRQLDYWARTSLVVPSIRSA

SEQ ID NO: 113034 - protein, 24 aa, Mycobacterium avium
ADAFPLLITHGWPGSIVEFHKVIE

SEQ ID NO: 113035 - protein, 17 aa, Mycobacterium avium
ADALLPMLREHAAGADL

SEQ ID NO: 113036 - protein, 29 aa, Mycobacterium avium
ADASLSHPYLDTVLFLLGVTRGEIEAADA

SEQ ID NO: 113037 - protein, 23 aa, Mycobacterium avium
ADAYSLAHLGAVDAALAAGDAML

SEQ ID NO: 113038 - protein, 26 aa, Mycobacterium avium
ADDPASILMLFAPGAPREAYFEGFAA

SEQ ID NO: 113039 - protein, 27 aa, Mycobacterium avium
ADDRAYKPLNWMSPPCWLREEAGDAAP

SEQ ID NO: 113040 - protein, 20 aa, Mycobacterium avium
ADDYLRFVRMLLGDGTIDGV

SEQ ID NO: 113041 - protein, 24 aa, Mycobacterium avium
ADEHDQLWRLASLRDARVPVALST

SEQ ID NO: 113042 - protein, 23 aa, Mycobacterium avium
ADENLHMIFYRDVSEAGFAIAPN

SEQ ID NO: 113043 - protein, 24 aa, Mycobacterium avium
ADEYQGFMAIRQWAKQFYPEFAAQ

SEQ ID NO: 113044 - protein, 24 aa, Mycobacterium avium
ADGTSIYWTGLNKGKRSATIDLRS

SEQ ID NO: 113045 - protein, 29 aa, Mycobacterium avium
ADHCLDLPGLFVWRRYHPTRPLGKAMLYG

SEQ ID NO: 113046 - protein, 25 aa, Mycobacterium avium
ADIGYNVVIYPVTTLRLAMHAVEAG

SEQ ID NO: 113047 - protein, 18 aa, Mycobacterium avium
ADIRICSAAATFANAAIL

SEQ ID NO: 113048 - protein, 22 aa, Mycobacterium avium
ADIRRLIDERVLFGPADPAGPA

SEQ ID NO: 113049 - protein, 23 aa, Mycobacterium avium
ADKDRLLVITQEKSWKVKRIRHT

SEQ ID NO: 113050 - protein, 25 aa, Mycobacterium avium
ADLLWSRPIKEFPDLKIALSEGGTG

SEQ ID NO: 113051 - protein, 24 aa, Mycobacterium avium
ADNDWAYDYLPRLTGPHGTYQTVM

SEQ ID NO: 113052 - protein, 33 aa, Mycobacterium avium
ADPARLVVHGRGERLCWWGGPWPVDERWWDDRG

SEQ ID NO: 113053 - protein, 17 aa, Mycobacterium avium
ADPDLLIELRDVSLRRG

SEQ ID NO: 113054 - protein, 21 aa, Mycobacterium avium
ADPVIMLTAPIPATQKVLKKS

SEQ ID NO: 113055 - protein, 28 aa, Mycobacterium avium
ADPVKPSMPLWSYPVEIALTADTRVALL

SEQ ID NO: 113056 - protein, 23 aa, Mycobacterium avium
ADRGGVPLVIDRKPPAADVPYVG

SEQ ID NO: 113057 - protein, 23 aa, Mycobacterium avium
ADRMPVLYCKTGVRSAQALAVVR

SEQ ID NO: 113058 - protein, 26 aa, Mycobacterium avium
ADRYSLPVLAPPIPRTVRFAEASASG

SEQ ID NO: 113059 - protein, 27 aa, Mycobacterium avium
ADSWMEIEAFRLLTLQTAWKIDQFNDY

SEQ ID NO: 113060 - protein, 25 aa, Mycobacterium avium
ADTVQLYLQETLTFLCYTAEAAVPL

SEQ ID NO: 113061 - protein, 21 aa, Mycobacterium avium
ADVFVHYTEIQGTGFRTLEEN

SEQ ID NO: 113062 - protein, 32 aa, Mycobacterium avium
ADVRIAGPAALFDPRFQQLGLHPGGGATWMLQ

SEQ ID NO: 113063 - protein, 18 aa, Mycobacterium avium
ADVVIHLAFIIMGSRDES

SEQ ID NO: 113064 - protein, 21 aa, Mycobacterium avium
ADVVLIATGASPRILPSAQPD

SEQ ID NO: 113065 - protein, 18 aa, Mycobacterium avium
ADWNRTLAVNLTGTFLMT

SEQ ID NO: 113066 - protein, 24 aa, Mycobacterium avium
AEAHRWPDVFALVAQYLIDARRRR

SEQ ID NO: 113067 - protein, 29 aa, Mycobacterium avium
AEALAYGDMGLALPLLAPGGVASALTHWG

SEQ ID NO: 113068 - protein, 27 aa, Mycobacterium avium
AEALGEGWFWPAAAAHPSLPRGALLQV

SEQ ID NO: 113069 - protein, 20 aa, Mycobacterium avium
AEAMLLMRAGREYALKRALA

SEQ ID NO: 113070 - protein, 30 aa, Mycobacterium avium
AEASIVERLVPDFLWISTEHTARVSLDALG

SEQ ID NO: 113071 - protein, 24 aa, Mycobacterium avium
AEEFNSLFFRNAVNSGLPAITVPD

SEQ ID NO: 113072 - protein, 26 aa, Mycobacterium avium
AEEGRLFTRFLAMLPTNESMVEELLA

SEQ ID NO: 113073 - protein, 28 aa, Mycobacterium avium
AEELGAALYPGPWLSTAVAAPRALIRLC

SEQ ID NO: 113074 - protein, 25 aa, Mycobacterium avium
AEERELLGGLPVRRLWGIGPVAEEK

SEQ ID NO: 113075 - protein, 24 aa, Mycobacterium avium
AEETALRLLNLRRAARSVEGTGPG

SEQ ID NO: 113076 - protein, 20 aa, Mycobacterium avium
AEFGGIDYLVNNAAIFGGMK

SEQ ID NO: 113077 - protein, 33 aa, Mycobacterium avium
AEFVSMIFSVQYRLPNYYRWLLYEADHAGAYRF

SEQ ID NO: 113078 - protein, 20 aa, Mycobacterium avium
AEFYAGLLGAYPLVSIEDPL

SEQ ID NO: 113079 - protein, 22 aa, Mycobacterium avium
AEGFRHRIADTRLLLNTALEAG

SEQ ID NO: 113080 - protein, 34 aa, Mycobacterium avium
AEGISVNVTLIFSVERYRAVMDAYLAGMEKAREA

SEQ ID NO: 113081 - protein, 18 aa, Mycobacterium avium
AEGLPRRPGVYLFRGPSG

SEQ ID NO: 113082 - protein, 24 aa, Mycobacterium avium
AEGQPAHWRAVEVAPLGTGGQQFT

SEQ ID NO: 113083 - protein, 23 aa, Mycobacterium avium
AEGRLKGILKYYDAPIVSSDIVT

SEQ ID NO: 113084 - protein, 28 aa, Mycobacterium avium
AEGTFEYQALLFIPSHAPFDLFNRDAHT

SEQ ID NO: 113085 - protein, 23 aa, Mycobacterium avium
AEGWQPVFYLPDKAGSIWGEALA

SEQ ID NO: 113086 - protein, 22 aa, Mycobacterium avium
AEHPTPLLFVHGGWHAAWCWEN

SEQ ID NO: 113087 - protein, 24 aa, Mycobacterium avium
AEHTPALGQPRRTKHHGLVAPYIL

SEQ ID NO: 113088 - protein, 20 aa, Mycobacterium avium
AEIPLLVVITEGIPVQDSAY

SEQ ID NO: 113089 - protein, 23 aa, Mycobacterium avium
AEIPLRAVLLRCGDEEHLLVAVV

SEQ ID NO: 113090 - protein, 27 aa, Mycobacterium avium
AEISCGPYRFVYRKRFHKKCETELTVI

SEQ ID NO: 113091 - protein, 27 aa, Mycobacterium avium
AEKTYLQEWHYFFQNTCRWRDLRKITI

SEQ ID NO: 113092 - protein, 29 aa, Mycobacterium avium
AELALRDKIPLVMLLEGAGFRPTGGHYGR

SEQ ID NO: 113093 - protein, 23 aa, Mycobacterium avium
AELAPHPLLVRALEQTARSREIP

SEQ ID NO: 113094 - protein, 49 aa, Mycobacterium avium
AELEPDFQRAYKELAKQVRLPGFRPGKAPAKLLEARFGREAMLDQVVTE

SEQ ID NO: 113095 - protein, 22 aa, Mycobacterium avium
AELFPRMRIPQAWYDAGIAVRA

SEQ ID NO: 113096 - protein, 26 aa, Mycobacterium avium
AELHFLGAVLWRRGIHRVLREFVEAG

SEQ ID NO: 113097 - protein, 17 aa, Mycobacterium avium
AELIYGPARSRPWKTVE

SEQ ID NO: 113098 - protein, 23 aa, Mycobacterium avium
AELLARFAGLRTCTNRLGRAALH

SEQ ID NO: 113099 - protein, 18 aa, Mycobacterium avium
AELLGYLDAGAHAAAEGA

SEQ ID NO: 113100 - protein, 18 aa, Mycobacterium avium
AEMRRVAPIWWNEQPIGA

SEQ ID NO: 113101 - protein, 24 aa, Mycobacterium avium
AEQIGKVVIAYEPVWAIGTGRVAS

SEQ ID NO: 113102 - protein, 24 aa, Mycobacterium avium
AEQSLDWFCSFSSAAALVGSPGQG

SEQ ID NO: 113103 - protein, 19 aa, Mycobacterium avium
AERFLAHQATLLRPDQLEK

SEQ ID NO: 113104 - protein, 19 aa, Mycobacterium avium
AERGLLDFLTIDDSLDAQP

SEQ ID NO: 113105 - protein, 24 aa, Mycobacterium avium
AERGLQPYGWATIISPRAAIEARV

SEQ ID NO: 113106 - protein, 25 aa, Mycobacterium avium
AERHPGWHALRKLAARITTPLLPDD

SEQ ID NO: 113107 - protein, 23 aa, Mycobacterium avium
AERIRSLLQLRGPFVELAQAGHH

SEQ ID NO: 113108 - protein, 17 aa, Mycobacterium avium
AERPPFVVLTSNATREL

SEQ ID NO: 113109 - protein, 18 aa, Mycobacterium avium
AETLALGDYRMMPRATFC

SEQ ID NO: 113110 - protein, 30 aa, Mycobacterium avium
AEVMPEDLIKFGLIPEFIGRLPVVASVTNL

SEQ ID NO: 113111 - protein, 20 aa, Mycobacterium avium
AEWLNYAALDVELLIELRAA

SEQ ID NO: 113112 - protein, 24 aa, Mycobacterium avium
AEWMGPLIEAMGLTVGWITAESSS

SEQ ID NO: 113113 - protein, 25 aa, Mycobacterium avium
AEWMPNFIDLLQRKLSRIGDAVLQK

SEQ ID NO: 113114 - protein, 18 aa, Mycobacterium avium
AEYDRDLPVYIPVEQIRD

SEQ ID NO: 113115 - protein, 24 aa, Mycobacterium avium
AEYGSIIAPTLVLWTSDDPTADVS

SEQ ID NO: 113116 - protein, 28 aa, Mycobacterium avium
AEYVAVPAGQLLPIPAGVDLVDAAGLPE

SEQ ID NO: 113117 - protein, 23 aa, Mycobacterium avium
AFAAQFILRRAPRSGLADSTLLI

SEQ ID NO: 113118 - protein, 30 aa, Mycobacterium avium
AFAAQPGIFTFGWGPVLHQLAAGLGVEIDH

SEQ ID NO: 113119 - protein, 17 aa, Mycobacterium avium
AFAHLEPGQRKPTAEVG

SEQ ID NO: 113120 - protein, 18 aa, Mycobacterium avium
AFCAALPEKVGVAAIPLS

SEQ ID NO: 113121 - protein, 30 aa, Mycobacterium avium
AFDFRVMTPTAWWRVPMQSLVAGLPTDPAA

SEQ ID NO: 113122 - protein, 19 aa, Mycobacterium avium
AFEALLRHDRACTGYAPIT

SEQ ID NO: 113123 - protein, 24 aa, Mycobacterium avium
AFGELARRWDGELNALVITVGPGA

SEQ ID NO: 113124 - protein, 20 aa, Mycobacterium avium
AFGGIGLRLKSSDTLYCCLP

SEQ ID NO: 113125 - protein, 24 aa, Mycobacterium avium
AFGQPIVLIHGFGCRIEYWNPQIN

SEQ ID NO: 113126 - protein, 18 aa, Mycobacterium avium
AFHTKYMASALDGYAAAA

SEQ ID NO: 113127 - protein, 18 aa, Mycobacterium avium
AFIMMLRHPEKVTGFFGV

SEQ ID NO: 113128 - protein, 18 aa, Mycobacterium avium
AFKEMTLLELSDFVKKFE

SEQ ID NO: 113129 - protein, 23 aa, Mycobacterium avium
AFKPPLRWGMRMTGKKFLREYPY

SEQ ID NO: 113130 - protein, 18 aa, Mycobacterium avium
AFKWIQRAAMDRRTTMKR

SEQ ID NO: 113131 - protein, 19 aa, Mycobacterium avium
AFLHVDYRKITPIDVPLLV

SEQ ID NO: 113132 - protein, 24 aa, Mycobacterium avium
AFNQVALEIMPAWGGAERLAALVG

SEQ ID NO: 113133 - protein, 26 aa, Mycobacterium avium
AFVNALPVFIASDPVWAKKFTDAGVP

SEQ ID NO: 113134 - protein, 28 aa, Mycobacterium avium
AGALRLCPGLKRSALIGGIRYYDTIVDD

SEQ ID NO: 113135 - protein, 27 aa, Mycobacterium avium
AGARDFQRFLIGKLRDIRAVVLNASLD

SEQ ID NO: 113136 - protein, 25 aa, Mycobacterium avium
AGAVEGWMPFGRVFETLSWGRRHVV

SEQ ID NO: 113137 - protein, 24 aa, Mycobacterium avium
AGDRALIMAIINRTPDSFYDRGAT

SEQ ID NO: 113138 - protein, 22 aa, Mycobacterium avium
AGEAWIHVQLLPSVDSKGLTEA

SEQ ID NO: 113139 - protein, 23 aa, Mycobacterium avium
AGEEYLLYERGGEWVLATGVRAM

SEQ ID NO: 113140 - protein, 20 aa, Mycobacterium avium
AGELGVVGVLAVELFETTDG

SEQ ID NO: 113141 - protein, 27 aa, Mycobacterium avium
AGEWFARILFSLFSTPSPTLNLDDPDV

SEQ ID NO: 113142 - protein, 17 aa, Mycobacterium avium
AGFPRPRTQLPVRQYGA

SEQ ID NO: 113143 - protein, 31 aa, Mycobacterium avium
AGFQAARPTAWLAEGLLPYLPSDAQDRLFEM

SEQ ID NO: 113144 - protein, 18 aa, Mycobacterium avium
AGFRAAGIAAGIKASGKR

SEQ ID NO: 113145 - protein, 27 aa, Mycobacterium avium
AGGGGYILLFCDFAKKHRLIEALEGAG

SEQ ID NO: 113146 - protein, 18 aa, Mycobacterium avium
AGGLELAIWCDLRVVEQD

SEQ ID NO: 113147 - protein, 24 aa, Mycobacterium avium
AGGLLLAHHPLLLRGVDTVAASTP

SEQ ID NO: 113148 - protein, 19 aa, Mycobacterium avium
AGGMLINHLAFQVSTAKLP

SEQ ID NO: 113149 - protein, 23 aa, Mycobacterium avium
AGGMSRWLPYLSELQPEMFCEVS

SEQ ID NO: 113150 - protein, 24 aa, Mycobacterium avium
AGGPDTLLLLQHPAVYTAGRRTEP

SEQ ID NO: 113151 - protein, 25 aa, Mycobacterium avium
AGGQVWLMPHNPAFDPIPGNDATVL

SEQ ID NO: 113152 - protein, 24 aa, Mycobacterium avium
AGHPAVSAVLYPGLPGHPGHDVAA

SEQ ID NO: 113153 - protein, 26 aa, Mycobacterium avium
AGIERRALRVILGNPLIAITMLRHDV

SEQ ID NO: 113154 - protein, 24 aa, Mycobacterium avium
AGIERVRATLPRLGELAIGGTAVG

SEQ ID NO: 113155 - protein, 24 aa, Mycobacterium avium
AGIKGTPLHLPYTASKHGIVGMTL

SEQ ID NO: 113156 - protein, 34 aa, Mycobacterium avium
AGIKRPDYGITGWVILTLIQHGTPWQIERFVEKA

SEQ ID NO: 113157 - protein, 36 aa, Mycobacterium avium
AGILLALLHHGDPVAGLTWLPFLDQRYTAVTGGPLR

SEQ ID NO: 113158 - protein, 18 aa, Mycobacterium avium
AGIPAGLLGQMALGSVTG

SEQ ID NO: 113159 - protein, 19 aa, Mycobacterium avium
AGIPGFYTRTGYGTTLAEG

SEQ ID NO: 113160 - protein, 25 aa, Mycobacterium avium
AGITCAVLIPQGKIAMGKLAQAVMH

SEQ ID NO: 113161 - protein, 20 aa, Mycobacterium avium
AGIVPPRDLVFAFIADEEHG

SEQ ID NO: 113162 - protein, 22 aa, Mycobacterium avium
AGKPAVILYPSGTVVTFDDLEA

SEQ ID NO: 113163 - protein, 20 aa, Mycobacterium avium
AGLRIGYGVASPRLARPLWD

SEQ ID NO: 113164 - protein, 26 aa, Mycobacterium avium
AGLRWQQVVLLRAYAKYLRQANFPYS

SEQ ID NO: 113165 - protein, 26 aa, Mycobacterium avium
AGLSRPTFYFYFKSKEAVVLSLLEPV

SEQ ID NO: 113166 - protein, 19 aa, Mycobacterium avium
AGMLKPDIVYFGESVPKDV

SEQ ID NO: 113167 - protein, 20 aa, Mycobacterium avium
AGMLPAFRHTVEELFTAGLV

SEQ ID NO: 113168 - protein, 20 aa, Mycobacterium avium
AGNTVVLKPAPDTPWCAAVL

SEQ ID NO: 113169 - protein, 21 aa, Mycobacterium avium
AGPDVGGTWYFNRYPGARCDV

SEQ ID NO: 113170 - protein, 19 aa, Mycobacterium avium
AGPGIPPALRTADRSAGVP

SEQ ID NO: 113171 - protein, 29 aa, Mycobacterium avium
AGPGKLDQWTLLARARALDSMSYIAAAGQ

SEQ ID NO: 113172 - protein, 31 aa, Mycobacterium avium
AGPLSTALIYDLRLGPAWQGLGFGVGMITEA

SEQ ID NO: 113173 - protein, 25 aa, Mycobacterium avium
AGPRHQLYFLGCRLDGMYPLGPIIA

SEQ ID NO: 113174 - protein, 27 aa, Mycobacterium avium
AGQIGYSLLFRLASGSLLGPDRPIELR

SEQ ID NO: 113175 - protein, 26 aa, Mycobacterium avium
AGQKLRIVKYLAYGWSSMRSRPALRD

SEQ ID NO: 113176 - protein, 24 aa, Mycobacterium avium
AGQRRDLAVLPKSTALVVWQPRKG

SEQ ID NO: 113177 - protein, 24 aa, Mycobacterium avium
AGQVGVTLLIPGGMHTPFFDGRPE

SEQ ID NO: 113178 - protein, 17 aa, Mycobacterium avium
AGRLNAHRLALTAELVP

SEQ ID NO: 113179 - protein, 33 aa, Mycobacterium avium
AGRVLADTWYRVPAFYFACPATVLGPYDDAPTA

SEQ ID NO: 113180 - protein, 35 aa, Mycobacterium avium
AGSILCDPWVNPAYFASWFPFPDNSTLDWDQLGDC

SEQ ID NO: 113181 - protein, 27 aa, Mycobacterium avium
AGSLNRPGYLRFDFNWQGPLTEEQRTQ

SEQ ID NO: 113182 - protein, 24 aa, Mycobacterium avium
AGSLRLDLSQFRELEAFAAFASDL

SEQ ID NO: 113183 - protein, 18 aa, Mycobacterium avium
AGSRFFELIGAPMTSFYD

SEQ ID NO: 113184 - protein, 29 aa, Mycobacterium avium
AGSYPDRFIPIAILPTWNPEAMCAEIRRV

SEQ ID NO: 113185 - protein, 24 aa, Mycobacterium avium
AGTAWQIFPNFQIGQGLTSALCYG

SEQ ID NO: 113186 - protein, 25 aa, Mycobacterium avium
AGTGWLHGWRLTFGGEDIGWEGALA

SEQ ID NO: 113187 - protein, 25 aa, Mycobacterium avium
AGTRACTATFWLLDAPDSLAEQSRR

SEQ ID NO: 113188 - protein, 22 aa, Mycobacterium avium
AGTSPFDHFIYVIASDGDIEEG

SEQ ID NO: 113189 - protein, 41 aa, Mycobacterium avium
AGTTLLRHVPLGVVAVLTPWNFPHCLNVMKLNHALAAGNTV

SEQ ID NO: 113190 - protein, 23 aa, Mycobacterium avium
AGTYFLCADPRPLGYDDSVAFCA

SEQ ID NO: 113191 - protein, 30 aa, Mycobacterium avium
AGVARPDLVIGWWAAPTILEHGTPEQIERF

SEQ ID NO: 113192 - protein, 28 aa, Mycobacterium avium
AGVGKQTIYRWWPTRPALVADVMLEDAD

SEQ ID NO: 113193 - protein, 24 aa, Mycobacterium avium
AGVGTLVMTHYVPALVAGQEEQWR

SEQ ID NO: 113194 - protein, 25 aa, Mycobacterium avium
AGVPKTLIQHLIRWVISSEEFAPEV

SEQ ID NO: 113195 - protein, 28 aa, Mycobacterium avium
AGVPPPRRSISVPTLYALGALGDLRARL

SEQ ID NO: 113196 - protein, 22 aa, Mycobacterium avium
AGVRRIVYLGGFVPAGEVLSEH

SEQ ID NO: 113197 - protein, 26 aa, Mycobacterium avium
AGVVRFIGVDGYRWMIRCVVNGTHET

SEQ ID NO: 113198 - protein, 20 aa, Mycobacterium avium
AGWAAVSWPREYGGRGATVL

SEQ ID NO: 113199 - protein, 27 aa, Mycobacterium avium
AGYLFETPQRRLFSEYWDLVQSGKLIE

SEQ ID NO: 113200 - protein, 24 aa, Mycobacterium avium
AGYTAPEFFDYLVALAAADPDLAH

SEQ ID NO: 113201 - protein, 24 aa, Mycobacterium avium
AGYVRKNSLWPATFGLACCAIEMM

SEQ ID NO: 113202 - protein, 23 aa, Mycobacterium avium
AHAHLRYLNPFPANLGEVLRRYP

SEQ ID NO: 113203 - protein, 18 aa, Mycobacterium avium
AHAIRRYGPAAVPNYVIS

SEQ ID NO: 113204 - protein, 19 aa, Mycobacterium avium
AHAVLVDHLIPPMARAETY

SEQ ID NO: 113205 - protein, 25 aa, Mycobacterium avium
AHERGLVDELGGFRIAVRRAKILAG

SEQ ID NO: 113206 - protein, 24 aa, Mycobacterium avium
AHFDSMLIKLTCRGRDFPTAVRRA

SEQ ID NO: 113207 - protein, 18 aa, Mycobacterium avium
AHGIGVVGLLNVQYALKD

SEQ ID NO: 113208 - protein, 25 aa, Mycobacterium avium
AHHDDGFYPVPRPRAPLAAATIWAI

SEQ ID NO: 113209 - protein, 39 aa, Mycobacterium avium
AHHRSTYMFLADRYSGWMRAPLRWALRASLAVRARLMVR

SEQ ID NO: 113210 - protein, 25 aa, Mycobacterium avium
AHQGLHMWLAEFPQPRPPRETWESN

SEQ ID NO: 113211 - protein, 19 aa, Mycobacterium avium
AHQRYLVQLTITSLADQAA

SEQ ID NO: 113212 - protein, 22 aa, Mycobacterium avium
AHRKGLAAFGKAGGRIVESVSP

SEQ ID NO: 113213 - protein, 31 aa, Mycobacterium avium
AHRQLRYFWPRVVGDTGWQLLDSKFAVVARA

SEQ ID NO: 113214 - protein, 19 aa, Mycobacterium avium
AHRVGFFYLTGHGVPADLV

SEQ ID NO: 113215 - protein, 17 aa, Mycobacterium avium
AHTDQWRYDGYGADKLA

SEQ ID NO: 113216 - protein, 25 aa, Mycobacterium avium
AHVPDYLMQIIARFARYLRESNSVD

SEQ ID NO: 113217 - protein, 25 aa, Mycobacterium avium
AHYVNDFALALAPFSIRMNAVHPTN

SEQ ID NO: 113218 - protein, 18 aa, Mycobacterium avium
AIALAQFYDVPMVSTIHA

SEQ ID NO: 113219 - protein, 18 aa, Mycobacterium avium
AIALGHPLGATGAKLFAT

SEQ ID NO: 113220 - protein, 25 aa, Mycobacterium avium
AIARPDLEVVLLEPLLRRSEFLTEV

SEQ ID NO: 113221 - protein, 26 aa, Mycobacterium avium
AIEVIDVVTNWRIATHRLAHSLSDLA

SEQ ID NO: 113222 - protein, 27 aa, Mycobacterium avium
AIFGVGEIWRRIRAANLPVALSDRLTL

SEQ ID NO: 113223 - protein, 18 aa, Mycobacterium avium
AIGLYRSVGFEQIGLRRR

SEQ ID NO: 113224 - protein, 20 aa, Mycobacterium avium
AIGMPVLPPTMVLVQQLRSL

SEQ ID NO: 113225 - protein, 28 aa, Mycobacterium avium
AIIAYNYPNQLALAKLAPALAAGCTVVL

SEQ ID NO: 113226 - protein, 20 aa, Mycobacterium avium
AILAVPGVRGALRAAGAPIV

SEQ ID NO: 113227 - protein, 28 aa, Mycobacterium avium
AILGGFEAWLLLRSLGTAGLRFERQCQN

SEQ ID NO: 113228 - protein, 24 aa, Mycobacterium avium
AIQESLDSLGPIFSELRDAGRELL

SEQ ID NO: 113229 - protein, 20 aa, Mycobacterium avium
AIRPVANPALYLYAAISPEG

SEQ ID NO: 113230 - protein, 25 aa, Mycobacterium avium
AISAGLMLIWACDLIVAADNAKFSD

SEQ ID NO: 113231 - protein, 22 aa, Mycobacterium avium
AITMIEMLAMSDLSLMVKAGVQ

SEQ ID NO: 113232 - protein, 20 aa, Mycobacterium avium
AIVKAQVDSALHGALHSLNH

SEQ ID NO: 113233 - protein, 24 aa, Mycobacterium avium
AIYDTMVLAPCDIATYAMGMAASM

SEQ ID NO: 113234 - protein, 29 aa, Mycobacterium avium
AIYQRYMGWFDGNPARLWPHPPEALGPRY

SEQ ID NO: 113235 - protein, 22 aa, Mycobacterium avium
AKALGLRPRARIISQALVGAEP

SEQ ID NO: 113236 - protein, 25 aa, Mycobacterium avium
AKAQQLGLSWLAEIGAHGVVAGPDS

SEQ ID NO: 113237 - protein, 29 aa, Mycobacterium avium
AKAYSAAWGVPFYAVNHLGGHLAADVYQH

SEQ ID NO: 113238 - protein, 28 aa, Mycobacterium avium
AKDQLRFSAPPRLDLSLLSAALPEDYKA

SEQ ID NO: 113239 - protein, 23 aa, Mycobacterium avium
AKEELLLAPVRYGGAAIVHLLEG

SEQ ID NO: 113240 - protein, 21 aa, Mycobacterium avium
AKFASTPLAPATPIVSRLVAR

SEQ ID NO: 113241 - protein, 24 aa, Mycobacterium avium
AKFNRKIIELNLIGALSVSQHANA

SEQ ID NO: 113242 - protein, 23 aa, Mycobacterium avium
AKGKNFYHALATKYGYGPQADRI

SEQ ID NO: 113243 - protein, 17 aa, Mycobacterium avium
AKGLEWDAVFLVGLADG

SEQ ID NO: 113244 - protein, 27 aa, Mycobacterium avium
AKKRPEFGKLTPLYPNQRLRLETTPDR

SEQ ID NO: 113245 - protein, 19 aa, Mycobacterium avium
AKLEAVFGNSPLIRQIYVY

SEQ ID NO: 113246 - protein, 20 aa, Mycobacterium avium
AKNDFGLVAIDTLLARMEND

SEQ ID NO: 113247 - protein, 26 aa, Mycobacterium avium
AKPAQVALAWLISYPGVVAIPGASSV

SEQ ID NO: 113248 - protein, 25 aa, Mycobacterium avium
AKRGDGWIKLVGDWIDRSVGDLAPL

SEQ ID NO: 113249 - protein, 18 aa, Mycobacterium avium
AKRGFDPVLGARPLRRTI

SEQ ID NO: 113250 - protein, 26 aa, Mycobacterium avium
AKSLTQRTILRLLDPSISAAGVMRAG

SEQ ID NO: 113251 - protein, 19 aa, Mycobacterium avium
AKVAFFEDHLYLTGSGGTF

SEQ ID NO: 113252 - protein, 25 aa, Mycobacterium avium
AKVGRIARVLGPRGLMPNPKTGTVT

SEQ ID NO: 113253 - protein, 23 aa, Mycobacterium avium
AKWAASISGYWRRGRTEETFRQW

SEQ ID NO: 113254 - protein, 29 aa, Mycobacterium avium
ALAALCDIFYPRVFLRRGGFVPSGTISLT

SEQ ID NO: 113255 - protein, 21 aa, Mycobacterium avium
ALADAMPWNQLPGPLRAIVKA

SEQ ID NO: 113256 - protein, 27 aa, Mycobacterium avium
ALAEFKAMFQMKFYAVALLRSRGVPPT

SEQ ID NO: 113257 - protein, 28 aa, Mycobacterium avium
ALAFKVATHPFFGKLTYVRVYSGKVDSG

SEQ ID NO: 113258 - protein, 30 aa, Mycobacterium avium
ALAGLDAPVRRRVIRAWLLAGGATGLTDKQ

SEQ ID NO: 113259 - protein, 18 aa, Mycobacterium avium
ALAHDLPAYDSAAIHLSR

SEQ ID NO: 113260 - protein, 18 aa, Mycobacterium avium
ALALGAQGAWTGSQWLMV

SEQ ID NO: 113261 - protein, 17 aa, Mycobacterium avium
ALALQHAILGPADLPNG

SEQ ID NO: 113262 - protein, 17 aa, Mycobacterium avium
ALALVTTTADLVGVARG

SEQ ID NO: 113263 - protein, 25 aa, Mycobacterium avium
ALAQRLPVYMVPAAVVALDAIPLTP

SEQ ID NO: 113264 - protein, 21 aa, Mycobacterium avium
ALASWFAVTRPPIAGELAEHS

SEQ ID NO: 113265 - protein, 22 aa, Mycobacterium avium
ALDAALGWQRDGAEWIHLVDLD

SEQ ID NO: 113266 - protein, 24 aa, Mycobacterium avium
ALDELRARIAPLQQLWTSEAATAY

SEQ ID NO: 113267 - protein, 33 aa, Mycobacterium avium
ALDHGVWLRPFRNLIYAMPPYICPPDEIARIAS

SEQ ID NO: 113268 - protein, 26 aa, Mycobacterium avium
ALDIHPIRRTIQHADLLVVRRGEKVV

SEQ ID NO: 113269 - protein, 22 aa, Mycobacterium avium
ALDLEPILDLRMRLGEGTGAAL

SEQ ID NO: 113270 - protein, 26 aa, Mycobacterium avium
ALDRPSQLALTLRLVSGLTVAEIARA

SEQ ID NO: 113271 - protein, 24 aa, Mycobacterium avium
ALDRVRVPVLLVGGWQDLFIRQTL

SEQ ID NO: 113272 - protein, 19 aa, Mycobacterium avium
ALEFAQMYRRFGAAVTVVE

SEQ ID NO: 113273 - protein, 17 aa, Mycobacterium avium
ALEFIPAKRVGTAAEVA

SEQ ID NO: 113274 - protein, 19 aa, Mycobacterium avium
ALEHDERFGIWGGLSERER

SEQ ID NO: 113275 - protein, 27 aa, Mycobacterium avium
ALELGCGTGFFLLNLIQSGVARRGSVT

SEQ ID NO: 113276 - protein, 18 aa, Mycobacterium avium
ALEMSFFGALVQAGSGEF

SEQ ID NO: 113277 - protein, 24 aa, Mycobacterium avium
ALEPLFDKTLDWALSTELDGGRVI

SEQ ID NO: 113278 - protein, 20 aa, Mycobacterium avium
ALEVPRPDWPDEAVLVGPLH

SEQ ID NO: 113279 - protein, 29 aa, Mycobacterium avium
ALFAVEMGLARLWQSWGFEPDVVLGHSVG

SEQ ID NO: 113280 - protein, 20 aa, Mycobacterium avium
ALFGRPMVTSPAATIAIEIE

SEQ ID NO: 113281 - protein, 22 aa, Mycobacterium avium
ALFLGRYAPYKGAHLALRAAHE

SEQ ID NO: 113282 - protein, 17 aa, Mycobacterium avium
ALGFRLHHRRRYLTVPA

SEQ ID NO: 113283 - protein, 28 aa, Mycobacterium avium
ALGGVAMPKALLWALHEHILGANPAVWM

SEQ ID NO: 113284 - protein, 23 aa, Mycobacterium avium
ALGHRGPNWLFFGEQHAATDFYY

SEQ ID NO: 113285 - protein, 20 aa, Mycobacterium avium
ALGLATFYNALAQEKLLSRE

SEQ ID NO: 113286 - protein, 19 aa, Mycobacterium avium
ALGLPSRPSSWRKNTMACT

SEQ ID NO: 113287 - protein, 26 aa, Mycobacterium avium
ALGRPRVVPPDRLQRVLSLVPGNPRL

SEQ ID NO: 113288 - protein, 34 aa, Mycobacterium avium
ALGSDYVDLFLIHWPLPTLYGGDFVSTWRVLEEF

SEQ ID NO: 113289 - protein, 20 aa, Mycobacterium avium
ALHGLLKDGITVAAGGFGLC

SEQ ID NO: 113290 - protein, 24 aa, Mycobacterium avium
ALIDLGSPLWASPSARVPFTAVLL

SEQ ID NO: 113291 - protein, 30 aa, Mycobacterium avium
ALKALHRRCADVRYLGSWPTGTPAGALPPS

SEQ ID NO: 113292 - protein, 18 aa, Mycobacterium avium
ALLAGCTVVLKPAAETPL

SEQ ID NO: 113293 - protein, 28 aa, Mycobacterium avium
ALLARSGARWYAAPAAPAGPLASGQRAV

SEQ ID NO: 113294 - protein, 20 aa, Mycobacterium avium
ALLDEAGVTVTRFVRFEVGQ

SEQ ID NO: 113295 - protein, 19 aa, Mycobacterium avium
ALLMLHPPSETMPSLPECT

SEQ ID NO: 113296 - protein, 18 aa, Mycobacterium avium
ALLQARKALDELRGSLSG

SEQ ID NO: 113297 - protein, 21 aa, Mycobacterium avium
ALLREGVRVFGFHLCGLDMRQ

SEQ ID NO: 113298 - protein, 19 aa, Mycobacterium avium
ALMAEQVDWMLGNGGLDWA

SEQ ID NO: 113299 - protein, 29 aa, Mycobacterium avium
ALNCEIVPWCRFARKNYFYPDMPKNYQIS

SEQ ID NO: 113300 - protein, 21 aa, Mycobacterium avium
ALNDDTRPRKLRPGDSLLVDT

SEQ ID NO: 113301 - protein, 32 aa, Mycobacterium avium
ALNPDTFYWAHATFFMLIIKVAEYFCGGLTEA

SEQ ID NO: 113302 - protein, 25 aa, Mycobacterium avium
ALPDDARLLLTIRPGDLLDGEPDAA

SEQ ID NO: 113303 - protein, 18 aa, Mycobacterium avium
ALPRRGVSALVRRPKRRP

SEQ ID NO: 113304 - protein, 17 aa, Mycobacterium avium
ALQHAILGPADLPNGFA

SEQ ID NO: 113305 - protein, 27 aa, Mycobacterium avium
ALQSDQPLWAVWRFGTDPAFTQISMEF

SEQ ID NO: 113306 - protein, 18 aa, Mycobacterium avium
ALQWAMSVAAQRAAALVA

SEQ ID NO: 113307 - protein, 22 aa, Mycobacterium avium
ALRAGGFFHHAKVEMVWVASDD

SEQ ID NO: 113308 - protein, 17 aa, Mycobacterium avium
ALRQISFRFAADDDQFM

SEQ ID NO: 113309 - protein, 32 aa, Mycobacterium avium
ALRRAARFGSGWWPFLTPPEQIAEKLDYIKSQ

SEQ ID NO: 113310 - protein, 24 aa, Mycobacterium avium
ALRRDVLDGLRRTPKSLPPKWFYD

SEQ ID NO: 113311 - protein, 28 aa, Mycobacterium avium
ALSAALLKLPVPNWPMLGGMGNASWVQL

SEQ ID NO: 113312 - protein, 28 aa, Mycobacterium avium
ALSGSGPAYFFLLVEALVDAGVAAGLSR

SEQ ID NO: 113313 - protein, 26 aa, Mycobacterium avium
ALSLDDVVKFLLPRGATKKVAKGAAS

SEQ ID NO: 113314 - protein, 21 aa, Mycobacterium avium
ALSLKLIEPPPSLTKARREGP

SEQ ID NO: 113315 - protein, 18 aa, Mycobacterium avium
ALSLPEPQLRETFRAIGV

SEQ ID NO: 113316 - protein, 20 aa, Mycobacterium avium
ALSPVPPLDEALARGLLDGC

SEQ ID NO: 113317 - protein, 25 aa, Mycobacterium avium
ALSQARFEFRWNDQFALSLDPDTAR

SEQ ID NO: 113318 - protein, 25 aa, Mycobacterium avium
ALSVRDMTVCILDRPRHAKLIDEVR

SEQ ID NO: 113319 - protein, 17 aa, Mycobacterium avium
ALTALDLEPILDLRMRL

SEQ ID NO: 113320 - protein, 29 aa, Mycobacterium avium
ALTEVRPTLFLGVPRVWIKAKAGLEAAVD

SEQ ID NO: 113321 - protein, 19 aa, Mycobacterium avium
ALTQALLPSMRAAGRGRIV

SEQ ID NO: 113322 - protein, 19 aa, Mycobacterium avium
ALTRLRMQDLLDAVQQRAG

SEQ ID NO: 113323 - protein, 23 aa, Mycobacterium avium
ALTTPEAPALQALLAAMAEQRVD

SEQ ID NO: 113324 - protein, 24 aa, Mycobacterium avium
ALVAEPRLLLLDEPFGALDALTRL

SEQ ID NO: 113325 - protein, 19 aa, Mycobacterium avium
ALVITHRPPSCRFWNMVVW

SEQ ID NO: 113326 - protein, 18 aa, Mycobacterium avium
ALVKTYVGDALAADLYLE

SEQ ID NO: 113327 - protein, 17 aa, Mycobacterium avium
ALVRRRLAVAHPGYDNE

SEQ ID NO: 113328 - protein, 22 aa, Mycobacterium avium
ALVSPAPIYLALREVREWAQNT

SEQ ID NO: 113329 - protein, 30 aa, Mycobacterium avium
ALVTQIAPLLGPMIQQMLFMQLRHMMETEA

SEQ ID NO: 113330 - protein, 21 aa, Mycobacterium avium
ALWAATFLRRRGAAADAILLN

SEQ ID NO: 113331 - protein, 29 aa, Mycobacterium avium
AMAPENVSPLVVWLGSAEARDVTGKVFEV

SEQ ID NO: 113332 - protein, 26 aa, Mycobacterium avium
AMARRCVDAGWLLSLSGTVSFRNARA

SEQ ID NO: 113333 - protein, 25 aa, Mycobacterium avium
AMDEFKAIIRWIQTRGHYSALNVFK

SEQ ID NO: 113334 - protein, 18 aa, Mycobacterium avium
AMEALVAQLTQPVRWDLC

SEQ ID NO: 113335 - protein, 21 aa, Mycobacterium avium
AMFADVRRALAIAEVIRAATV

SEQ ID NO: 113336 - protein, 20 aa, Mycobacterium avium
AMFDPSAVFYMNKIAVGPEA

SEQ ID NO: 113337 - protein, 20 aa, Mycobacterium avium
AMGAIALFGESYPEQVRVVE

SEQ ID NO: 113338 - protein, 22 aa, Mycobacterium avium
AMLGIPLKKWKMYSEPVHAAVY

SEQ ID NO: 113339 - protein, 27 aa, Mycobacterium avium
AMLGQPVSMLIPRVVGFKLTGEIQPGV

SEQ ID NO: 113340 - protein, 23 aa, Mycobacterium avium
AMQRLLIDTWRTHPTTIVFVTHD

SEQ ID NO: 113341 - protein, 24 aa, Mycobacterium avium
AMSAFNAWVLLKGLETMAIRVEHS

SEQ ID NO: 113342 - protein, 23 aa, Mycobacterium avium
AMSKFEVLTAMAFAAFADAPVDV

SEQ ID NO: 113343 - protein, 24 aa, Mycobacterium avium
AMTDPAYYNIIVKGALSSPSLVQV

SEQ ID NO: 113344 - protein, 19 aa, Mycobacterium avium
AMTLPATVTATLLRGKVTA

SEQ ID NO: 113345 - protein, 17 aa, Mycobacterium avium
AMTPPFPGLDTFAGQVY

SEQ ID NO: 113346 - protein, 24 aa, Mycobacterium avium
AMVFQDNALLPWRTVRSNIELALR

SEQ ID NO: 113347 - protein, 21 aa, Mycobacterium avium
AMYHQFADKAALFRAVVEAVE

SEQ ID NO: 113348 - protein, 24 aa, Mycobacterium avium
ANAAVLHALMTPGERLLGLDLANG

SEQ ID NO: 113349 - protein, 26 aa, Mycobacterium avium
ANDADVLIGLIRDYAPKLSLIVTSHQ

SEQ ID NO: 113350 - protein, 23 aa, Mycobacterium avium
ANDQPVQRFWRDAHAGRVHAAND

SEQ ID NO: 113351 - protein, 31 aa, Mycobacterium avium
ANGVGILAPLTRQGCIPLAIHPAMTFTGSDE

SEQ ID NO: 113352 - protein, 25 aa, Mycobacterium avium
ANIAPWLRAAHRYGAKVKWAEIDIE

SEQ ID NO: 113353 - protein, 21 aa, Mycobacterium avium
ANLAELRRSLSGAATYSVAKN

SEQ ID NO: 113354 - protein, 18 aa, Mycobacterium avium
ANLEGGFFIGPTLFDHVT

SEQ ID NO: 113355 - protein, 24 aa, Mycobacterium avium
ANNLDLVGLMAIPPLNSDPDEAFD

SEQ ID NO: 113356 - protein, 18 aa, Mycobacterium avium
ANTFHQFRERFAPYGLRP

SEQ ID NO: 113357 - protein, 21 aa, Mycobacterium avium
ANYVNLLSKTALMQGFNALDQ

SEQ ID NO: 113358 - protein, 20 aa, Mycobacterium avium
APADGVGAVLRYAPTLHQSV

SEQ ID NO: 113359 - protein, 30 aa, Mycobacterium avium
APALSDLELYLFFSLLFSAGAETTRNAVAG

SEQ ID NO: 113360 - protein, 21 aa, Mycobacterium avium
APAPSFSAPVSGAGRFGTPRA

SEQ ID NO: 113361 - protein, 24 aa, Mycobacterium avium
APARTVYRLAPRTAAPEAAAPRPA

SEQ ID NO: 113362 - protein, 24 aa, Mycobacterium avium
APAYTGRLFTAPVPALRMPDESMD

SEQ ID NO: 113363 - protein, 20 aa, Mycobacterium avium
APDGTLLWTQKRSIFARGEG

SEQ ID NO: 113364 - protein, 23 aa, Mycobacterium avium
APDLEVIALLSRGKLAYGVIDDQ

SEQ ID NO: 113365 - protein, 28 aa, Mycobacterium avium
APEDVANAVAWLVSDQARYITGVTLPVD

SEQ ID NO: 113366 - protein, 21 aa, Mycobacterium avium
APEGDLRSALTWLCNAQSRIA

SEQ ID NO: 113367 - protein, 27 aa, Mycobacterium avium
APEHVHTYRITPLALWNARAAGHDAEQ

SEQ ID NO: 113368 - protein, 17 aa, Mycobacterium avium
APEKPWFSYVCPGAGHA

SEQ ID NO: 113369 - protein, 24 aa, Mycobacterium avium
APEPVLHAALGPGALIAELGSAAQ

SEQ ID NO: 113370 - protein, 18 aa, Mycobacterium avium
APERAPVVVLWASQTGNA

SEQ ID NO: 113371 - protein, 24 aa, Mycobacterium avium
APETRIWWGAYLGTADELLVAGTV

SEQ ID NO: 113372 - protein, 21 aa, Mycobacterium avium
APFGPDLLFAASDLPGFVLHV

SEQ ID NO: 113373 - protein, 24 aa, Mycobacterium avium
APGIKTYLDLPLFAGRPAPGLATS

SEQ ID NO: 113374 - protein, 23 aa, Mycobacterium avium
APGLFKTPLLGSLPEEAQASLGK

SEQ ID NO: 113375 - protein, 26 aa, Mycobacterium avium
APHHTRLRKIISRGFTPRAVGRLRDE

SEQ ID NO: 113376 - protein, 25 aa, Mycobacterium avium
APHSKLAIRWALHDRPEDACRKILG

SEQ ID NO: 113377 - protein, 22 aa, Mycobacterium avium
APILAAARRLVAGAAPMIARRG

SEQ ID NO: 113378 - protein, 35 aa, Mycobacterium avium
APKRLGSFMDSRLWRLLLAPGRGIGRLVTGAMGLA

SEQ ID NO: 113379 - protein, 22 aa, Mycobacterium avium
APLLCAGIIGYRALLRAQLPPG

SEQ ID NO: 113380 - protein, 19 aa, Mycobacterium avium
APLRFGELCLEAGLPPGLV

SEQ ID NO: 113381 - protein, 18 aa, Mycobacterium avium
APLYYNEKYNFYALSRYE

SEQ ID NO: 113382 - protein, 19 aa, Mycobacterium avium
APMVHPYVASKWGVRGLAK

SEQ ID NO: 113383 - protein, 24 aa, Mycobacterium avium
APNNPLVGLYTTSDGRYISFVMMQ

SEQ ID NO: 113384 - protein, 25 aa, Mycobacterium avium
APPPLDVMAALREPGIGVIAEVKRA

SEQ ID NO: 113385 - protein, 20 aa, Mycobacterium avium
APQGIDYVAGFYAAVKAGTI

SEQ ID NO: 113386 - protein, 31 aa, Mycobacterium avium
APQMLAFLENLSGWFEFVWKPGYADYYPELP

SEQ ID NO: 113387 - protein, 29 aa, Mycobacterium avium
APRDLAYLVAAGLYRFSLLDIIDIGDIND

SEQ ID NO: 113388 - protein, 27 aa, Mycobacterium avium
APRDLCALWPVPATSAPHAAPPMPAGK

SEQ ID NO: 113389 - protein, 27 aa, Mycobacterium avium
APSERPRIRLAYRLTPDRILGEQRVTG

SEQ ID NO: 113390 - protein, 18 aa, Mycobacterium avium
APSVLGWAEFRDVAQRYS

SEQ ID NO: 113391 - protein, 24 aa, Mycobacterium avium
APTASGFWHWAVANLPADVTELPA

SEQ ID NO: 113392 - protein, 25 aa, Mycobacterium avium
APTPVAWTRMRVPRSLMASIGTEEI

SEQ ID NO: 113393 - protein, 33 aa, Mycobacterium avium
APTQAWRKMFGENFFYILYFQEPGVADAELNAD

SEQ ID NO: 113394 - protein, 24 aa, Mycobacterium avium
APVARYWPEFAQAGKQDITLAMVM

SEQ ID NO: 113395 - protein, 26 aa, Mycobacterium avium
APVEDCYAALLWLARQPWVDPERVAV

SEQ ID NO: 113396 - protein, 21 aa, Mycobacterium avium
APVGYYDLRRAASPIPVVCTA

SEQ ID NO: 113397 - protein, 26 aa, Mycobacterium avium
APVQRTWPELIPLLQSGRLDVDGIFT

SEQ ID NO: 113398 - protein, 20 aa, Mycobacterium avium
APVRERLALGFGSSSFRYAG

SEQ ID NO: 113399 - protein, 21 aa, Mycobacterium avium
APYSDLIWMETGTPDLELAAK

SEQ ID NO: 113400 - protein, 30 aa, Mycobacterium avium
AQAHSPMDVLWFRLKWRPGDPRELFGVFRK

SEQ ID NO: 113401 - protein, 26 aa, Mycobacterium avium
AQDKLRTATLRMLLAAIQTEEVSGKQ

SEQ ID NO: 113402 - protein, 26 aa, Mycobacterium avium
AQDQVSPLLALAAKVLGVIVPGLPAQ

SEQ ID NO: 113403 - protein, 29 aa, Mycobacterium avium
AQDRPHTLLMLALAGWARYLRGYDLNGRK

SEQ ID NO: 113404 - protein, 18 aa, Mycobacterium avium
AQEISARVLMKLKRDAEA

SEQ ID NO: 113405 - protein, 22 aa, Mycobacterium avium
AQIDALLWQAESFGAPLRDAYA

SEQ ID NO: 113406 - protein, 25 aa, Mycobacterium avium
AQKERWLPELMTLEKIAAWAITEPD

SEQ ID NO: 113407 - protein, 31 aa, Mycobacterium avium
AQKRQQFLTDLSLLGGLLIASADTAGKPSLG

SEQ ID NO: 113408 - protein, 22 aa, Mycobacterium avium
AQLDRFLLKLNVTLPPREAEIA

SEQ ID NO: 113409 - protein, 25 aa, Mycobacterium avium
AQLHARIWVAQVGRVPLLLLDSDVP

SEQ ID NO: 113410 - protein, 20 aa, Mycobacterium avium
AQLHDLDWVPADRGWLGDLA

SEQ ID NO: 113411 - protein, 25 aa, Mycobacterium avium
AQMARGQYWIHPALPEVVENALLGL

SEQ ID NO: 113412 - protein, 25 aa, Mycobacterium avium
AQMGKDGWLTLNWPKEYGGQDRSPM

SEQ ID NO: 113413 - protein, 30 aa, Mycobacterium avium
AQNFQVVSIPTLILFKDGQPVKRIVGAKGK

SEQ ID NO: 113414 - protein, 22 aa, Mycobacterium avium
AQNTVALMWGAEDLVATLGGSS

SEQ ID NO: 113415 - protein, 30 aa, Mycobacterium avium
AQPGQHELLKPFTPRYFEAIPGVWARRSSE

SEQ ID NO: 113416 - protein, 24 aa, Mycobacterium avium
AQQLSFYETIPSYRNVIAREGLSN

SEQ ID NO: 113417 - protein, 19 aa, Mycobacterium avium
AQRTVLCKDPFRAVDERVK

SEQ ID NO: 113418 - protein, 28 aa, Mycobacterium avium
AQSAGPPPWHLYRFVLRAAVGVALTEPH

SEQ ID NO: 113419 - protein, 25 aa, Mycobacterium avium
AQSARRFFATAYDPGWRIAGVTNHC

SEQ ID NO: 113420 - protein, 22 aa, Mycobacterium avium
AQVTAMVTRILALQAKPTPADA

SEQ ID NO: 113421 - protein, 19 aa, Mycobacterium avium
AQYILLTTFTKDGKPKPTP

SEQ ID NO: 113422 - protein, 28 aa, Mycobacterium avium
ARAHGADMLLLIVAALEQSALVSMLDRT

SEQ ID NO: 113423 - protein, 19 aa, Mycobacterium avium
ARAHWKAHRLDLGPVLHEP

SEQ ID NO: 113424 - protein, 19 aa, Mycobacterium avium
ARARRFAGNPWAAPTGWRA

SEQ ID NO: 113425 - protein, 24 aa, Mycobacterium avium
ARDFLVPARLHPGSFYALPQSPQL

SEQ ID NO: 113426 - protein, 26 aa, Mycobacterium avium
ARDGRRYLDMFTFFASSALGMNHPAL

SEQ ID NO: 113427 - protein, 23 aa, Mycobacterium avium
ARDKVLPGYGWIFPLGNGEVNIG

SEQ ID NO: 113428 - protein, 20 aa, Mycobacterium avium
AREEIFGPVLTVLRYRDEDD

SEQ ID NO: 113429 - protein, 25 aa, Mycobacterium avium
AREHGGRLLVRLAGVTDRDAADALR

SEQ ID NO: 113430 - protein, 17 aa, Mycobacterium avium
AREIIRRGLVEDLRYGP

SEQ ID NO: 113431 - protein, 25 aa, Mycobacterium avium
AREVILRLFGALLDAAPTLGAGLDW

SEQ ID NO: 113432 - protein, 19 aa, Mycobacterium avium
ARFDDAFAEVMFSAAIWSS

SEQ ID NO: 113433 - protein, 20 aa, Mycobacterium avium
ARFDGWFVTAVLTTGIYCRP

SEQ ID NO: 113434 - protein, 30 aa, Mycobacterium avium
ARHDFYVLDEFTYPLKWGWVDVDEVVSVLA

SEQ ID NO: 113435 - protein, 23 aa, Mycobacterium avium
ARHFQIPLTIIRICSTYGPQGGA

SEQ ID NO: 113436 - protein, 18 aa, Mycobacterium avium
ARIDGLLREIRLVRALSG

SEQ ID NO: 113437 - protein, 22 aa, Mycobacterium avium
ARLEQLDLFPANRNAAGQIVAA

SEQ ID NO: 113438 - protein, 27 aa, Mycobacterium avium
ARLSALAGYRWITPVSYTLPFRTVSGT

SEQ ID NO: 113439 - protein, 27 aa, Mycobacterium avium
ARLTVPLGMIILRKGYGLGAMAMAGGS

SEQ ID NO: 113440 - protein, 19 aa, Mycobacterium avium
ARNLRFRGNMRGSLSGTLA

SEQ ID NO: 113441 - protein, 19 aa, Mycobacterium avium
ARNSGMTAVFWLDTERPHE

SEQ ID NO: 113442 - protein, 31 aa, Mycobacterium avium
ARNVIPKPLQKPHPPVWVACTRPASVQMAAQ

SEQ ID NO: 113443 - protein, 30 aa, Mycobacterium avium
ARQAGTLAFFPLWGYATPPAIELAERLAGY

SEQ ID NO: 113444 - protein, 24 aa, Mycobacterium avium
ARQALTEAVLWPLQHPDTFARLGV

SEQ ID NO: 113445 - protein, 28 aa, Mycobacterium avium
ARQRGYAVGLHLLPDLRLQELALLVRSA

SEQ ID NO: 113446 - protein, 24 aa, Mycobacterium avium
ARRDLADAILRRRTNRLPFRAPKH

SEQ ID NO: 113447 - protein, 22 aa, Mycobacterium avium
ARRGKMFARLIKNIEVAARVGG

SEQ ID NO: 113448 - protein, 27 aa, Mycobacterium avium
ARRGRHRPVWIKGFGEHIAFKTPTYAE

SEQ ID NO: 113449 - protein, 19 aa, Mycobacterium avium
ARRMSEISEAPLYIDDSPN

SEQ ID NO: 113450 - protein, 28 aa, Mycobacterium avium
ARRREEYVGPWLPEPLLLDEQDPSTDVV

SEQ ID NO: 113451 - protein, 37 aa, Mycobacterium avium
ARSEIAHRLGLIDPQAWAFVWVVDPPLFEPADDATAA

SEQ ID NO: 113452 - protein, 23 aa, Mycobacterium avium
ARSGVKRFVMVSYFGAGPDHGVP

SEQ ID NO: 113453 - protein, 23 aa, Mycobacterium avium
ARSLTLSAFANKVTVGFTSDIKN

SEQ ID NO: 113454 - protein, 26 aa, Mycobacterium avium
ARTERAELVRWLLAQGITAEEIRTTN

SEQ ID NO: 113455 - protein, 26 aa, Mycobacterium avium
ARTFGMDSWFPSLKIYNRNGQLYTAV

SEQ ID NO: 113456 - protein, 26 aa, Mycobacterium avium
ARTLADEFDFRFLVGVLSVLADKDVD

SEQ ID NO: 113457 - protein, 29 aa, Mycobacterium avium
ARVELERRLARWMRLYPDVQAESAVLTGG

SEQ ID NO: 113458 - protein, 24 aa, Mycobacterium avium
ARVQLLRDLGSAAAPFNAFLVAQG

SEQ ID NO: 113459 - protein, 17 aa, Mycobacterium avium
ARYILPSFIEHSSFGIK

SEQ ID NO: 113460 - protein, 26 aa, Mycobacterium avium
ASAHEWLRVLKRLQPRLYSISSSPKA

SEQ ID NO: 113461 - protein, 29 aa, Mycobacterium avium
ASAQRIKILEQLMSVYRELEDVPAALQAA

SEQ ID NO: 113462 - protein, 26 aa, Mycobacterium avium
ASATDRRYLLYSPLTKAKITGEGERV

SEQ ID NO: 113463 - protein, 25 aa, Mycobacterium avium
ASDSAGFKWLAPYTGSAIAQHWMYD

SEQ ID NO: 113464 - protein, 18 aa, Mycobacterium avium
ASELILPIAVAVQNRITV

SEQ ID NO: 113465 - protein, 29 aa, Mycobacterium avium
ASFLVKDLHLPWQWGAHWFLQQLVDGDLA

SEQ ID NO: 113466 - protein, 17 aa, Mycobacterium avium
ASFMRYIDANRASWIVM

SEQ ID NO: 113467 - protein, 23 aa, Mycobacterium avium
ASGFPINLIGVLAQLQTASGFQS

SEQ ID NO: 113468 - protein, 25 aa, Mycobacterium avium
ASGLDARAYRLAWPAGTVVYEVDQP

SEQ ID NO: 113469 - protein, 26 aa, Mycobacterium avium
ASGLDTRAYRLDWPAGMTVFEIDQPA

SEQ ID NO: 113470 - protein, 28 aa, Mycobacterium avium
ASGLDTRPYRLWWPRGTTVYEIDRPRVL

SEQ ID NO: 113471 - protein, 23 aa, Mycobacterium avium
ASGLSWLTGYPDRTPYDPYSIGD

SEQ ID NO: 113472 - protein, 18 aa, Mycobacterium avium
ASKRFRRTGTGKIVRQKT

SEQ ID NO: 113473 - protein, 24 aa, Mycobacterium avium
ASLAKALLPIMNPGGSIVGMDFDP

SEQ ID NO: 113474 - protein, 18 aa, Mycobacterium avium
ASLALRNLDSYLATGQLV

SEQ ID NO: 113475 - protein, 21 aa, Mycobacterium avium
ASLPKLPTFTLTSQSLTDGGT

SEQ ID NO: 113476 - protein, 20 aa, Mycobacterium avium
ASLREHTWKRSSFSGTEIFG

SEQ ID NO: 113477 - protein, 22 aa, Mycobacterium avium
ASNTHRWFGPYGVTKSAIDHMM

SEQ ID NO: 113478 - protein, 17 aa, Mycobacterium avium
ASPPAEPLPPPPPREQP

SEQ ID NO: 113479 - protein, 33 aa, Mycobacterium avium
ASPRLARPLWDQQLPFGIAITSLLAVTASYRAE

SEQ ID NO: 113480 - protein, 28 aa, Mycobacterium avium
ASRDKFPRAILPRSFDYGFATGLMVKDV

SEQ ID NO: 113481 - protein, 26 aa, Mycobacterium avium
ASSKMGLVALTMNLSRRWAGDGIRVN

SEQ ID NO: 113482 - protein, 23 aa, Mycobacterium avium
ASTRQLWLDGALPTFSSWVNPAA

SEQ ID NO: 113483 - protein, 23 aa, Mycobacterium avium
ASTTLPYSGPFSGPANLAYLYQT

SEQ ID NO: 113484 - protein, 32 aa, Mycobacterium avium
ASVVTPFLLPDIPVVVWWPDVAPAVPAQDPLG

SEQ ID NO: 113485 - protein, 19 aa, Mycobacterium avium
ASVYIWHDLQRREPYFDPP

SEQ ID NO: 113486 - protein, 28 aa, Mycobacterium avium
ASYEFLRLLEHRLQLQRLKRTHLLPEAD

SEQ ID NO: 113487 - protein, 17 aa, Mycobacterium avium
ASYLHSWRAGDVVMWDN

SEQ ID NO: 113488 - protein, 24 aa, Mycobacterium avium
ATAAPAIRLASTALPATSLAAAAA

SEQ ID NO: 113489 - protein, 17 aa, Mycobacterium avium
ATATLAFINGIMLTFVA

SEQ ID NO: 113490 - protein, 22 aa, Mycobacterium avium
ATATYLVRMLRDIPGLTVTRIA

SEQ ID NO: 113491 - protein, 24 aa, Mycobacterium avium
ATAYDNYFIPQGVAADLLATIEGY

SEQ ID NO: 113492 - protein, 20 aa, Mycobacterium avium
ATCCRALGIVVYQRQRPADL

SEQ ID NO: 113493 - protein, 25 aa, Mycobacterium avium
ATDPALGIDWPLVAGAAPTLSERDA

SEQ ID NO: 113494 - protein, 31 aa, Mycobacterium avium
ATEAAVRHLIPALQVLHDALASKAREWHTVV

SEQ ID NO: 113495 - protein, 23 aa, Mycobacterium avium
ATEFAGFLWVSLDPGATLDVATH

SEQ ID NO: 113496 - protein, 17 aa, Mycobacterium avium
ATELPYVWGTLGAPKDP

SEQ ID NO: 113497 - protein, 24 aa, Mycobacterium avium
ATEVAIFIDPQQLVRGILVNGRGQ

SEQ ID NO: 113498 - protein, 26 aa, Mycobacterium avium
ATGLELTVPPLLGALPLAYTAPQGLT

SEQ ID NO: 113499 - protein, 25 aa, Mycobacterium avium
ATGLRPFDVQLLGALRMLAGDVIEM

SEQ ID NO: 113500 - protein, 21 aa, Mycobacterium avium
ATGLVCALLLTTRGAALTLRQ

SEQ ID NO: 113501 - protein, 26 aa, Mycobacterium avium
ATMASVHAFNLWLDEDWGFDRPDHRI

SEQ ID NO: 113502 - protein, 24 aa, Mycobacterium avium
ATMKRLFLELGGKSATIVLEDADF

SEQ ID NO: 113503 - protein, 18 aa, Mycobacterium avium
ATMLRMLLRPEEELDDAW

SEQ ID NO: 113504 - protein, 20 aa, Mycobacterium avium
ATNIGFLRRLLAEQRLETGW

SEQ ID NO: 113505 - protein, 24 aa, Mycobacterium avium
ATPAGWSHFDADRWELFHIEADRS

SEQ ID NO: 113506 - protein, 20 aa, Mycobacterium avium
ATPHRFGSAIGALAAAIRAG

SEQ ID NO: 113507 - protein, 21 aa, Mycobacterium avium
ATPMLLNEPTYRMFRPDLENP

SEQ ID NO: 113508 - protein, 20 aa, Mycobacterium avium
ATRKALLESLLRNVPTDGLD

SEQ ID NO: 113509 - protein, 24 aa, Mycobacterium avium
ATRLGIPIPGFSSALSYYDALRTE

SEQ ID NO: 113510 - protein, 18 aa, Mycobacterium avium
ATRSPIGKRNGWLSGLHA

SEQ ID NO: 113511 - protein, 28 aa, Mycobacterium avium
ATSASTPLFFAQAVGRFVRSRRPGETAS

SEQ ID NO: 113512 - protein, 20 aa, Mycobacterium avium
ATSRAPRWAVAYKYPPQEAQ

SEQ ID NO: 113513 - protein, 20 aa, Mycobacterium avium
ATTAWLIERLQRPTLVMAPN

SEQ ID NO: 113514 - protein, 21 aa, Mycobacterium avium
ATTMLLPFADRYRHIRRPLIT

SEQ ID NO: 113515 - protein, 31 aa, Mycobacterium avium
ATVPPAVVAANRSLLATLLQTNILGQNDAAI

SEQ ID NO: 113516 - protein, 24 aa, Mycobacterium avium
ATVQEVHLLLIHGLCMALDDHLLR

SEQ ID NO: 113517 - protein, 22 aa, Mycobacterium avium
ATWEDAYAYSKFARIVLGSNDI

SEQ ID NO: 113518 - protein, 30 aa, Mycobacterium avium
AVAAYHKLLVWDLMRRPKITQLAESLLNPL

SEQ ID NO: 113519 - protein, 26 aa, Mycobacterium avium
AVADRASWRRWWPDLRLQVVEDRGDK

SEQ ID NO: 113520 - protein, 25 aa, Mycobacterium avium
AVADSVFTRLYLATGLISVGKTQLS

SEQ ID NO: 113521 - protein, 21 aa, Mycobacterium avium
AVADWIAMFSTWPVKSTPGMR

SEQ ID NO: 113522 - protein, 32 aa, Mycobacterium avium
AVAEAPLRERRWGQLMLALYRAGRQGEALGAY

SEQ ID NO: 113523 - protein, 37 aa, Mycobacterium avium
AVAGEHGFRFFPAYYLHIWDLFQRIPVYELRNPGGWA

SEQ ID NO: 113524 - protein, 24 aa, Mycobacterium avium
AVAKLFCEAGIIALTAFISPYVRD

SEQ ID NO: 113525 - protein, 18 aa, Mycobacterium avium
AVALAAALGADVCEIYTD

SEQ ID NO: 113526 - protein, 20 aa, Mycobacterium avium
AVAQLELVLPAMAGLVGSLT

SEQ ID NO: 113527 - protein, 25 aa, Mycobacterium avium
AVARRLMHVLGTSAYVPDLLMRAPR

SEQ ID NO: 113528 - protein, 21 aa, Mycobacterium avium
AVCSALRQGAVETLIIGDIGD

SEQ ID NO: 113529 - protein, 17 aa, Mycobacterium avium
AVDAGPIAFLRDGDRIR

SEQ ID NO: 113530 - protein, 23 aa, Mycobacterium avium
AVDAHIEMLTAKQQLLIDDVESL

SEQ ID NO: 113531 - protein, 24 aa, Mycobacterium avium
AVDSIRVVNILSAQYRDPGLLLGQ

SEQ ID NO: 113532 - protein, 20 aa, Mycobacterium avium
AVEFPPAGTLTGIAKRELRG

SEQ ID NO: 113533 - protein, 20 aa, Mycobacterium avium
AVEHLFAVASGLDSAVIGEQ

SEQ ID NO: 113534 - protein, 26 aa, Mycobacterium avium
AVEHPACWALLYGSPVPGYHAPPERT

SEQ ID NO: 113535 - protein, 22 aa, Mycobacterium avium
AVFANFKPGTLAALGFSYEQLR

SEQ ID NO: 113536 - protein, 21 aa, Mycobacterium avium
AVFRFLRRVPRDTVVLLDEAY

SEQ ID NO: 113537 - protein, 27 aa, Mycobacterium avium
AVGAAIGLLDLLLASGGDLVTVLLGAG

SEQ ID NO: 113538 - protein, 18 aa, Mycobacterium avium
AVGSWLHRIVVNACLDRL

SEQ ID NO: 113539 - protein, 24 aa, Mycobacterium avium
AVGVVHSLWQPMAGRFKDYIAQPR

SEQ ID NO: 113540 - protein, 18 aa, Mycobacterium avium
AVLFFASDEARYITGVTL

SEQ ID NO: 113541 - protein, 27 aa, Mycobacterium avium
AVLGPIESITLAPLYFELDGSFPHHEA

SEQ ID NO: 113542 - protein, 18 aa, Mycobacterium avium
AVLHLLAIAHEADVALSL

SEQ ID NO: 113543 - protein, 21 aa, Mycobacterium avium
AVLRVLELHPLLNPAGYVVSE

SEQ ID NO: 113544 - protein, 26 aa, Mycobacterium avium
AVLSRAQLLELVWGYDFAADTNVVDV

SEQ ID NO: 113545 - protein, 17 aa, Mycobacterium avium
AVMFVCPEPRPLLDVVL

SEQ ID NO: 113546 - protein, 22 aa, Mycobacterium avium
AVMVRMPGFGLTGPWRDNPAFA

SEQ ID NO: 113547 - protein, 27 aa, Mycobacterium avium
AVNAAYRALSPPVDPIGLLAREVYPEL

SEQ ID NO: 113548 - protein, 24 aa, Mycobacterium avium
AVNAGARYIFAIDPVEWKRDQALK

SEQ ID NO: 113549 - protein, 28 aa, Mycobacterium avium
AVNVATLPFPGFPTDLQPMAIALASIAD

SEQ ID NO: 113550 - protein, 26 aa, Mycobacterium avium
AVNYPLYVIMSLLGLPEADFPRMLKL

SEQ ID NO: 113551 - protein, 24 aa, Mycobacterium avium
AVPDEPYLQLLLEEPSHALLRSIT

SEQ ID NO: 113552 - protein, 23 aa, Mycobacterium avium
AVPFATWELPVAAIRWCLDHAGV

SEQ ID NO: 113553 - protein, 25 aa, Mycobacterium avium
AVPPSPFPVITNPAGGFGTLASAGL

SEQ ID NO: 113554 - protein, 18 aa, Mycobacterium avium
AVPRTEESRFRSMCEARG

SEQ ID NO: 113555 - protein, 18 aa, Mycobacterium avium
AVQPDVLLMDEPCSALDP

SEQ ID NO: 113556 - protein, 21 aa, Mycobacterium avium
AVRGLDLRVLPGQTVAVVGES

SEQ ID NO: 113557 - protein, 28 aa, Mycobacterium avium
AVRQGKLLASRLLPWARSGHLAVPRGTD

SEQ ID NO: 113558 - protein, 22 aa, Mycobacterium avium
AVRRFGRMFVLGARLTVPLGMI

SEQ ID NO: 113559 - protein, 23 aa, Mycobacterium avium
AVRRSLMTLTTLDPPVAAVVSMW

SEQ ID NO: 113560 - protein, 19 aa, Mycobacterium avium
AVRRYVTDAGPLLPRLHKL

SEQ ID NO: 113561 - protein, 25 aa, Mycobacterium avium
AVRTKFFDEFFLNATKAGIAQVVIL

SEQ ID NO: 113562 - protein, 23 aa, Mycobacterium avium
AVTINKLWELFVAEDATLVEVNP

SEQ ID NO: 113563 - protein, 29 aa, Mycobacterium avium
AVTKGTDPYFFLLQSLATAGLSPADIEIV

SEQ ID NO: 113564 - protein, 31 aa, Mycobacterium avium
AVTSKLRFNFFVLKLPIRPPALVAKQIGSLA

SEQ ID NO: 113565 - protein, 34 aa, Mycobacterium avium
AVVANLPYNVAVPALLHLLAEFPSIRTVTVMVQA

SEQ ID NO: 113566 - protein, 19 aa, Mycobacterium avium
AVVRYFVAGTPPPASYRCQ

SEQ ID NO: 113567 - protein, 32 aa, Mycobacterium avium
AVVVLTEWPQFRSLDWRAVAQDAPLAVVLDAR

SEQ ID NO: 113568 - protein, 17 aa, Mycobacterium avium
AVWTGDDISFEGRHFSA

SEQ ID NO: 113569 - protein, 20 aa, Mycobacterium avium
AVYQLRRWYQQFYVDVADIE

SEQ ID NO: 113570 - protein, 21 aa, Mycobacterium avium
AVYVDAGHLRWHSPEDMAARL

SEQ ID NO: 113571 - protein, 24 aa, Mycobacterium avium
AWCWENFLDFFADAGYRAVALSLR

SEQ ID NO: 113572 - protein, 26 aa, Mycobacterium avium
AWFGDRFGVPLPRGLRERAEAMSWDA

SEQ ID NO: 113573 - protein, 21 aa, Mycobacterium avium
AWLFCPADRPERFAKAAAAAD

SEQ ID NO: 113574 - protein, 21 aa, Mycobacterium avium
AWLSMVMLEWGCCGQVATAIP

SEQ ID NO: 113575 - protein, 28 aa, Mycobacterium avium
AWQPDDLLIVLFGIALAWANSPHPDAAT

SEQ ID NO: 113576 - protein, 26 aa, Mycobacterium avium
AWRDPRVWWQLRNPFRPSWGEPYTEI

SEQ ID NO: 113577 - protein, 19 aa, Mycobacterium avium
AWRGAFLAHGSLTEPGRSS

SEQ ID NO: 113578 - protein, 25 aa, Mycobacterium avium
AWSAEGLLPFLPAAAQQLLFERVQT

SEQ ID NO: 113579 - protein, 25 aa, Mycobacterium avium
AWSPYLGEYVGTCLELPYVRRQGAT

SEQ ID NO: 113580 - protein, 20 aa, Mycobacterium avium
AWWGNFLVQKANEANIGLDE

SEQ ID NO: 113581 - protein, 26 aa, Mycobacterium avium
AYAEGLRALYLFTSTYQDAAVAEALY

SEQ ID NO: 113582 - protein, 19 aa, Mycobacterium avium
AYAPYSRFRVGAAGLVDDG

SEQ ID NO: 113583 - protein, 26 aa, Mycobacterium avium
AYAQSKLAVMLWGLELDRRLRAAGSP

SEQ ID NO: 113584 - protein, 32 aa, Mycobacterium avium
AYEQWRWTQDSFVPWVWRRLRGLSSYDGREPK

SEQ ID NO: 113585 - protein, 25 aa, Mycobacterium avium
AYGHGWATWFPPDGPPRTGRFGPVP

SEQ ID NO: 113586 - protein, 22 aa, Mycobacterium avium
AYRDLMFPGGVRELGFIRMWSR

SEQ ID NO: 113587 - protein, 25 aa, Mycobacterium avium
AYVEALLAKQKLLIDEVQNLRAQRN

SEQ ID NO: 113588 - protein, 25 aa, Mycobacterium avium
AYWELPAMMVQFLRSGPGAARPAVD

SEQ ID NO: 113589 - protein, 27 aa, Mycobacterium avium
CAAHVYLRRALTSTELWPVALKEIDLG

SEQ ID NO: 113590 - protein, 22 aa, Mycobacterium avium
CAFGLALIAPRLPPFDVPDGHT

SEQ ID NO: 113591 - protein, 18 aa, Mycobacterium avium
CDAWLARILAGEQSLDVL

SEQ ID NO: 113592 - protein, 19 aa, Mycobacterium avium
CDLPGIMQHFTIPVSFFDE

SEQ ID NO: 113593 - protein, 23 aa, Mycobacterium avium
CEAGLLPGALTRNVGLHFICRDV

SEQ ID NO: 113594 - protein, 24 aa, Mycobacterium avium
CEDAPKTAWLFTGQGSQYAGMARE

SEQ ID NO: 113595 - protein, 19 aa, Mycobacterium avium
CEFLAYHQSAYFAVSHGLT

SEQ ID NO: 113596 - protein, 22 aa, Mycobacterium avium
CFLESDLFNQGVRPAINVGVSV

SEQ ID NO: 113597 - protein, 18 aa, Mycobacterium avium
CFLVQHRSRLASEKNGVM

SEQ ID NO: 113598 - protein, 21 aa, Mycobacterium avium
CFVVCNEILPRWGVQTVFVDG

SEQ ID NO: 113599 - protein, 30 aa, Mycobacterium avium
CGDVGWFQLVDKHVILLSGAQANEFFFRSA

SEQ ID NO: 113600 - protein, 26 aa, Mycobacterium avium
CGKTYLAQTLAKMLNVPFAIADATAL

SEQ ID NO: 113601 - protein, 29 aa, Mycobacterium avium
CGMICDASYPTFLLTHWARDRSRGDKLAL

SEQ ID NO: 113602 - protein, 17 aa, Mycobacterium avium
CGPKFCSMRITQDVRDY

SEQ ID NO: 113603 - protein, 18 aa, Mycobacterium avium
CHAFFQFYVADGRLSCQL

SEQ ID NO: 113604 - protein, 17 aa, Mycobacterium avium
CIHPSQVPVVRQAYRPP

SEQ ID NO: 113605 - protein, 20 aa, Mycobacterium avium
CLDLLFRGEIPDGVDPASLM

SEQ ID NO: 113606 - protein, 18 aa, Mycobacterium avium
CLPFAPPRDNPYSGAGIL

SEQ ID NO: 113607 - protein, 27 aa, Mycobacterium avium
CNPRHHSLAFLPLPTPSGIVHLMLEVE

SEQ ID NO: 113608 - protein, 25 aa, Mycobacterium avium
CPQYAERGFFVDTGSFRRPGPPFRF

SEQ ID NO: 113609 - protein, 22 aa, Mycobacterium avium
CQGQCPPRQFERARVVVFAGDH

SEQ ID NO: 113610 - protein, 23 aa, Mycobacterium avium
CQSELQFFYELGKRIRQRLAGST

SEQ ID NO: 113611 - protein, 24 aa, Mycobacterium avium
CQSILGYVVRWVAQGVGCSKVPDI

SEQ ID NO: 113612 - protein, 25 aa, Mycobacterium avium
CTAGHPPPLLVTADATARYVEPSGA

SEQ ID NO: 113613 - protein, 23 aa, Mycobacterium avium
CTANRYPEFLPERLRGVIAEHIG

SEQ ID NO: 113614 - protein, 20 aa, Mycobacterium avium
CVALLLERSAEAVAAILGVL

SEQ ID NO: 113615 - protein, 18 aa, Mycobacterium avium
CVGRLRYLGVVLYDMDRV

SEQ ID NO: 113616 - protein, 25 aa, Mycobacterium avium
CYDELFIGGQWRKPANPQQLDVISP

SEQ ID NO: 113617 - protein, 17 aa, Mycobacterium avium
DAAAKMLAGKPFKKEAA

SEQ ID NO: 113618 - protein, 26 aa, Mycobacterium avium
DAAGDGMWNWFAAPNLPAQIAEAEPD

SEQ ID NO: 113619 - protein, 23 aa, Mycobacterium avium
DAAGRRPFWTYAHVPAGSTLDAT

SEQ ID NO: 113620 - protein, 25 aa, Mycobacterium avium
DAANGFILDGFPRSLQQAKALHEML

SEQ ID NO: 113621 - protein, 19 aa, Mycobacterium avium
DAAPARRLATASADDVAAV

SEQ ID NO: 113622 - protein, 26 aa, Mycobacterium avium
DAAQGTRLVPIPGAPPSLAGLDPGCP

SEQ ID NO: 113623 - protein, 24 aa, Mycobacterium avium
DAARFLLEGMPVQVAFHNGSPLYI

SEQ ID NO: 113624 - protein, 24 aa, Mycobacterium avium
DAARLTVVWLADWADDAVHVSMHH

SEQ ID NO: 113625 - protein, 31 aa, Mycobacterium avium
DAATRQGIAFIPWFPLAAGPLAAPDGPLQRI

SEQ ID NO: 113626 - protein, 22 aa, Mycobacterium avium
DADIVMLDLTPAAALRLYGELM

SEQ ID NO: 113627 - protein, 22 aa, Mycobacterium avium
DADPLLHATINRFAQHTGVPVV

SEQ ID NO: 113628 - protein, 28 aa, Mycobacterium avium
DADQLRGYLRRWLAPAIRQWVQQAAAGT

SEQ ID NO: 113629 - protein, 20 aa, Mycobacterium avium
DAEIKRAYRKLARELHPDVN

SEQ ID NO: 113630 - protein, 18 aa, Mycobacterium avium
DAERLRSPAFDVQRERIT

SEQ ID NO: 113631 - protein, 28 aa, Mycobacterium avium
DAEVMANPLPYYRILRDHHPVYYMPQWD

SEQ ID NO: 113632 - protein, 27 aa, Mycobacterium avium
DAEVRKLFDVNYFGAVDMIKAVLPGMR

SEQ ID NO: 113633 - protein, 21 aa, Mycobacterium avium
DAFEHFPPPVLRPVILAAKSK

SEQ ID NO: 113634 - protein, 18 aa, Mycobacterium avium
DAGFAPDLLLSSWDLRPF

SEQ ID NO: 113635 - protein, 40 aa, Mycobacterium avium
DAGLSVITWPKKYGGRDAPLLHWVVFEEEYFRAGAPGRAS

SEQ ID NO: 113636 - protein, 26 aa, Mycobacterium avium
DAGPGILYRLHLDLASLSIAEFYSDG

SEQ ID NO: 113637 - protein, 43 aa, Mycobacterium avium
DAGVLFGGDLLFIGCTPIVWAGPIANWVAACDAMIALDAPTVV

SEQ ID NO: 113638 - protein, 25 aa, Mycobacterium avium
DAHAPGQLEFLGYGAQRALDAGVPV

SEQ ID NO: 113639 - protein, 20 aa, Mycobacterium avium
DAIAVRRPLARLGMGLHRRH

SEQ ID NO: 113640 - protein, 29 aa, Mycobacterium avium
DAIRTFNKAFAPYGLPRTAFKPSYGIAEA

SEQ ID NO: 113641 - protein, 29 aa, Mycobacterium avium
DALARAGFHTLRLQTFLTAGPKEARAWVI

SEQ ID NO: 113642 - protein, 18 aa, Mycobacterium avium
DALDPFVALGFAAATTST

SEQ ID NO: 113643 - protein, 20 aa, Mycobacterium avium
DALDVPLSSVLTDAGERMAS

SEQ ID NO: 113644 - protein, 25 aa, Mycobacterium avium
DALFRARRVLPDPVALLRCAGGADL

SEQ ID NO: 113645 - protein, 28 aa, Mycobacterium avium
DALITGHPLLRHRGPQLLPAIFSYSQRD

SEQ ID NO: 113646 - protein, 23 aa, Mycobacterium avium
DALTELWVRPALSLPAVAEDLRR

SEQ ID NO: 113647 - protein, 23 aa, Mycobacterium avium
DALTPTFAALLPEAFPNAELVDA

SEQ ID NO: 113648 - protein, 33 aa, Mycobacterium avium
DALTRLSMHTLLLDLWRRHGFGVLLVTHDVDEA

SEQ ID NO: 113649 - protein, 26 aa, Mycobacterium avium
DALVSLVLDWRRPVKLFIETKHPVRY

SEQ ID NO: 113650 - protein, 23 aa, Mycobacterium avium
DAMAVGLAAWRLGAGRSRPGERV

SEQ ID NO: 113651 - protein, 22 aa, Mycobacterium avium
DAMPTFRQVFMAGASGMTLERR

SEQ ID NO: 113652 - protein, 29 aa, Mycobacterium avium
DAPKHKRLTLFLIPMDRPGFTVRPIPSML

SEQ ID NO: 113653 - protein, 26 aa, Mycobacterium avium
DAPSATIALPFDIAGALTGFHTDDIV

SEQ ID NO: 113654 - protein, 26 aa, Mycobacterium avium
DAPTNAFVMSFLGAVSTLNGTLVRPH

SEQ ID NO: 113655 - protein, 19 aa, Mycobacterium avium
DARFGWPKRNGFVQPLVDA

SEQ ID NO: 113656 - protein, 18 aa, Mycobacterium avium
DARIAGRLGLRPDVRRVP

SEQ ID NO: 113657 - protein, 23 aa, Mycobacterium avium
DARINLLIIPYATYSALARMVLR

SEQ ID NO: 113658 - protein, 22 aa, Mycobacterium avium
DASANLAVLRTPPGAADYLASA

SEQ ID NO: 113659 - protein, 36 aa, Mycobacterium avium
DASEGPLPQTRFVLRKALAAHLPVILVVNKTDRPDA

SEQ ID NO: 113660 - protein, 25 aa, Mycobacterium avium
DASLLLVVLTRFLPPDDPRVRNTVL

SEQ ID NO: 113661 - protein, 25 aa, Mycobacterium avium
DASPAFLGFNLFQHAIARAVIHGTY

SEQ ID NO: 113662 - protein, 31 aa, Mycobacterium avium
DASTPFDAFIRLISPTRLFTTSFKDIQGIAQ

SEQ ID NO: 113663 - protein, 18 aa, Mycobacterium avium
DATLFTKADSWYLGANVP

SEQ ID NO: 113664 - protein, 28 aa, Mycobacterium avium
DATPSQLALAWLLKRSPVMLPIPGTSKV

SEQ ID NO: 113665 - protein, 28 aa, Mycobacterium avium
DATTLFESLLPRYLTTRVYAALLESAAS

SEQ ID NO: 113666 - protein, 27 aa, Mycobacterium avium
DAVATNLLRYLWPDVTLVGGPAGAPVL

SEQ ID NO: 113667 - protein, 26 aa, Mycobacterium avium
DAVGRPETWKQAFYARDLAGTVVLVG

SEQ ID NO: 113668 - protein, 20 aa, Mycobacterium avium
DAVRWLAEQVPIYAVNLLLS

SEQ ID NO: 113669 - protein, 21 aa, Mycobacterium avium
DAVSFTLLQDQLQSVLETLSE

SEQ ID NO: 113670 - protein, 20 aa, Mycobacterium avium
DAVYPLVIRAGGGSPRDTLS

SEQ ID NO: 113671 - protein, 24 aa, Mycobacterium avium
DAVYRAAKLLGYRPNLAARNLARG

SEQ ID NO: 113672 - protein, 24 aa, Mycobacterium avium
DAWTTGFLGLHAKPIVLLDPIGHY

SEQ ID NO: 113673 - protein, 21 aa, Mycobacterium avium
DAYGGTFRLIDKVFTRWNVEY

SEQ ID NO: 113674 - protein, 19 aa, Mycobacterium avium
DAYHRLLSLVVDGYRREGK

SEQ ID NO: 113675 - protein, 19 aa, Mycobacterium avium
DAYLAMLAETLDKPALVTH

SEQ ID NO: 113676 - protein, 18 aa, Mycobacterium avium
DAYVYLAESIRAWPDQAA

SEQ ID NO: 113677 - protein, 18 aa, Mycobacterium avium
DCAIYLAQHGWNVTAVDF

SEQ ID NO: 113678 - protein, 36 aa, Mycobacterium avium
DCLNKACDPGLPLMLWAYDPLAFAGKGRAGIAIGNP

SEQ ID NO: 113679 - protein, 22 aa, Mycobacterium avium
DCPPSLGVLTLNGLTAADEVIV

SEQ ID NO: 113680 - protein, 23 aa, Mycobacterium avium
DCPVRPVGRWIVDPDGAVVRAGL

SEQ ID NO: 113681 - protein, 24 aa, Mycobacterium avium
DDDQFMTIAKFRAARTVWARVAEV

SEQ ID NO: 113682 - protein, 25 aa, Mycobacterium avium
DDDYPFLLNTGRLPHQWHTMTKTGK

SEQ ID NO: 113683 - protein, 23 aa, Mycobacterium avium
DDEARGVIWPTIPPDILGQAGTA

SEQ ID NO: 113684 - protein, 18 aa, Mycobacterium avium
DDEFGFFVVMLAVAGNET

SEQ ID NO: 113685 - protein, 24 aa, Mycobacterium avium
DDETLPFISIRLWQPISENETEVC

SEQ ID NO: 113686 - protein, 28 aa, Mycobacterium avium
DDGLDRRTPFWPYQLNADLVSLADPEAI

SEQ ID NO: 113687 - protein, 18 aa, Mycobacterium avium
DDGSIIEGLYAAGNVSAP

SEQ ID NO: 113688 - protein, 24 aa, Mycobacterium avium
DDKRLTRRLVSEAGITVPRARLAT

SEQ ID NO: 113689 - protein, 18 aa, Mycobacterium avium
DDLDFFIVSSSVSSLLGS

SEQ ID NO: 113690 - protein, 24 aa, Mycobacterium avium
DDLNPYARIIADEALRRGIWVEVL

SEQ ID NO: 113691 - protein, 33 aa, Mycobacterium avium
DDMAPICQMFHTLPIPWVEPIDISNAVLFFASD

SEQ ID NO: 113692 - protein, 29 aa, Mycobacterium avium
DDPEHRIYRTVLNPYLSPAAVKRWEPFID

SEQ ID NO: 113693 - protein, 24 aa, Mycobacterium avium
DDPHSLIAGQLRYWESALAGMPER

SEQ ID NO: 113694 - protein, 19 aa, Mycobacterium avium
DDPRFCDVLPLIQNADAAA

SEQ ID NO: 113695 - protein, 23 aa, Mycobacterium avium
DDPRIWPNIVAAQLDWDVELIGR

SEQ ID NO: 113696 - protein, 18 aa, Mycobacterium avium
DDPRLRFEMCLGVSGVHY

SEQ ID NO: 113697 - protein, 17 aa, Mycobacterium avium
DDRDDLPRIIRAGKHLA

SEQ ID NO: 113698 - protein, 23 aa, Mycobacterium avium
DDRYMRTLDPWVSLGAACAVTSR

SEQ ID NO: 113699 - protein, 37 aa, Mycobacterium avium
DDTVILYGGNNNWFAAYAYWYFKLYGHEKVKLLDGGR

SEQ ID NO: 113700 - protein, 25 aa, Mycobacterium avium
DDTVLARLYGWHRAMRIFDGPDEVH

SEQ ID NO: 113701 - protein, 25 aa, Mycobacterium avium
DDVLGPWFAVLCWNNNPRKILGETA

SEQ ID NO: 113702 - protein, 33 aa, Mycobacterium avium
DDVLVHGLPLFHVHGLVLGLLGSLRIGNRFVHT

SEQ ID NO: 113703 - protein, 17 aa, Mycobacterium avium
DDYLPKPFALEELLARM

SEQ ID NO: 113704 - protein, 36 aa, Mycobacterium avium
DDYLTKPFSFRVLVARLRALVRRGAPERPVVLTAGS

SEQ ID NO: 113705 - protein, 22 aa, Mycobacterium avium
DEALLDIYRKLRPGEPPTKESA

SEQ ID NO: 113706 - protein, 18 aa, Mycobacterium avium
DEALRMGLVWRVCAPDEL

SEQ ID NO: 113707 - protein, 23 aa, Mycobacterium avium
DEDSLALLIYTSGSTGAPKGAMY

SEQ ID NO: 113708 - protein, 24 aa, Mycobacterium avium
DEFDITKLRYHKIVLMADADVDGQ

SEQ ID NO: 113709 - protein, 27 aa, Mycobacterium avium
DEFRQTELFRLLLPARFGGLEASFPEL

SEQ ID NO: 113710 - protein, 25 aa, Mycobacterium avium
DEGHTIALGIRRDWPRPEARVTIPA

SEQ ID NO: 113711 - protein, 17 aa, Mycobacterium avium
DEGLRFAIREGGRTVGA

SEQ ID NO: 113712 - protein, 20 aa, Mycobacterium avium
DEGRIARIWLNRPDAHNAQS

SEQ ID NO: 113713 - protein, 18 aa, Mycobacterium avium
DEGYRRRFRKDYDSRFGP

SEQ ID NO: 113714 - protein, 25 aa, Mycobacterium avium
DEHIARIAALGRIALVLISHRHGDH

SEQ ID NO: 113715 - protein, 28 aa, Mycobacterium avium
DEHSDFMSYLNLWRYLREQRKELSGNQF

SEQ ID NO: 113716 - protein, 24 aa, Mycobacterium avium
DEIGFTQLLYDDHIGKVSLIGAGM

SEQ ID NO: 113717 - protein, 30 aa, Mycobacterium avium
DELERLYPRTAAELFSWGKSWLETCQQAFA

SEQ ID NO: 113718 - protein, 18 aa, Mycobacterium avium
DELPLPRPKYEIFVYSPR

SEQ ID NO: 113719 - protein, 27 aa, Mycobacterium avium
DELVTLVEWGLPPVAVLRAATVTAAEL

SEQ ID NO: 113720 - protein, 18 aa, Mycobacterium avium
DEMTRVIWKMIKENLILP

SEQ ID NO: 113721 - protein, 31 aa, Mycobacterium avium
DENPDLPTLIVAPYFRSAIEAAIDGWRRVVV

SEQ ID NO: 113722 - protein, 17 aa, Mycobacterium avium
DEPIVAPGSWIGGDRDG

SEQ ID NO: 113723 - protein, 18 aa, Mycobacterium avium
DEPPGTRMRVALSALTMA

SEQ ID NO: 113724 - protein, 25 aa, Mycobacterium avium
DEPRKGMAVLLDALPRLVERFADVQ

SEQ ID NO: 113725 - protein, 22 aa, Mycobacterium avium
DEQGNYIFPEGFDPETNEWLEG

SEQ ID NO: 113726 - protein, 26 aa, Mycobacterium avium
DERARAGIFLAMQYPVEVPGVSVSNF

SEQ ID NO: 113727 - protein, 21 aa, Mycobacterium avium
DERGRRFLVHTSKIAYVEIGI

SEQ ID NO: 113728 - protein, 17 aa, Mycobacterium avium
DERICLCGNTFGPLFGH

SEQ ID NO: 113729 - protein, 25 aa, Mycobacterium avium
DERRDVVLRLRPSPPALLEPYDLAR

SEQ ID NO: 113730 - protein, 23 aa, Mycobacterium avium
DESVAAILRYCSQHRIAVVPFGG

SEQ ID NO: 113731 - protein, 25 aa, Mycobacterium avium
DETAHPLVICDLGMPRDVDPAVAGL

SEQ ID NO: 113732 - protein, 24 aa, Mycobacterium avium
DETGMVNVLCTPGVWARHRKLANT

SEQ ID NO: 113733 - protein, 24 aa, Mycobacterium avium
DETGWLLGDYLLSQPQRADRPVVA

SEQ ID NO: 113734 - protein, 29 aa, Mycobacterium avium
DEVLQRVADALWYPLWDANVRLDHSVRTV

SEQ ID NO: 113735 - protein, 24 aa, Mycobacterium avium
DEVVDVVLLWWRDGDGDLVDTLMD

SEQ ID NO: 113736 - protein, 17 aa, Mycobacterium avium
DEWRVLTAAALVGLVEE

SEQ ID NO: 113737 - protein, 23 aa, Mycobacterium avium
DFEAQLPRALPRTALIQLSDYVL

SEQ ID NO: 113738 - protein, 19 aa, Mycobacterium avium
DFEILGPLPRKNIDTGMGV

SEQ ID NO: 113739 - protein, 19 aa, Mycobacterium avium
DFFALFLDPNMVYTCAYFE

SEQ ID NO: 113740 - protein, 17 aa, Mycobacterium avium
DFFIVSSSVSSLLGSPG

SEQ ID NO: 113741 - protein, 18 aa, Mycobacterium avium
DFFTWENMKYLEKPNLAP

SEQ ID NO: 113742 - protein, 17 aa, Mycobacterium avium
DFGVPFTLTRRGALTAE

SEQ ID NO: 113743 - protein, 18 aa, Mycobacterium avium
DFLTRATAQRPDAVAVAD

SEQ ID NO: 113744 - protein, 18 aa, Mycobacterium avium
DFMAKHGEFFPESPRNVE

SEQ ID NO: 113745 - protein, 17 aa, Mycobacterium avium
DFMPVVWAMFEWGRRHL

SEQ ID NO: 113746 - protein, 19 aa, Mycobacterium avium
DFNLIESATWWKDGPEIAS

SEQ ID NO: 113747 - protein, 30 aa, Mycobacterium avium
DFPNQINNVLAFPGVFRGALEAGARRITEK

SEQ ID NO: 113748 - protein, 34 aa, Mycobacterium avium
DFPVPALLEVRGEVFFLLADFEALNASLVEDGKA

SEQ ID NO: 113749 - protein, 19 aa, Mycobacterium avium
DFRGTGVATVSIWMGILLT

SEQ ID NO: 113750 - protein, 17 aa, Mycobacterium avium
DFRLARKTTTLGGVHIP

SEQ ID NO: 113751 - protein, 19 aa, Mycobacterium avium
DFTGRLCPAPCEPACVLGI

SEQ ID NO: 113752 - protein, 20 aa, Mycobacterium avium
DFTYQQAWIDGRSTYRITGT

SEQ ID NO: 113753 - protein, 25 aa, Mycobacterium avium
DFVVRIPDSLPLDKAAPLLCAGITL

SEQ ID NO: 113754 - protein, 19 aa, Mycobacterium avium
DFYALDRLWSDCPVVPVNL

SEQ ID NO: 113755 - protein, 24 aa, Mycobacterium avium
DFYDLDFITPQWSPGPIDAPDPKV

SEQ ID NO: 113756 - protein, 26 aa, Mycobacterium avium
DGADTVAWLREQPWFTGRFATIGMSY

SEQ ID NO: 113757 - protein, 24 aa, Mycobacterium avium
DGAPAWLRFFGCNPRHHSLAFLPL

SEQ ID NO: 113758 - protein, 24 aa, Mycobacterium avium
DGAQPWVRPVFPLINEMVVVDLPA

SEQ ID NO: 113759 - protein, 25 aa, Mycobacterium avium
DGASEYVFRFAPLVGIYGGTLEVFR

SEQ ID NO: 113760 - protein, 30 aa, Mycobacterium avium
DGDANLVAMPLFHVGGIGYALFGIRAGAPT

SEQ ID NO: 113761 - protein, 17 aa, Mycobacterium avium
DGDFFGVIAQLPGASGA

SEQ ID NO: 113762 - protein, 18 aa, Mycobacterium avium
DGDLLCFVHGGAGLLHTE

SEQ ID NO: 113763 - protein, 24 aa, Mycobacterium avium
DGDPLDAMVLLPQSVFPGVIVEAR

SEQ ID NO: 113764 - protein, 29 aa, Mycobacterium avium
DGEFVKFGPSWAWPKPVQPHIPVLVGAAG

SEQ ID NO: 113765 - protein, 21 aa, Mycobacterium avium
DGFRIPELLESTGARLREVGT

SEQ ID NO: 113766 - protein, 24 aa, Mycobacterium avium
DGGATVIFGWTYSQAKPRDVIWNQ

SEQ ID NO: 113767 - protein, 31 aa, Mycobacterium avium
DGGFVGLRVVPWLWNAPPTDRRYYPLFAACV

SEQ ID NO: 113768 - protein, 27 aa, Mycobacterium avium
DGGPLTWPLHISLLLAKEYALTGTRIS

SEQ ID NO: 113769 - protein, 29 aa, Mycobacterium avium
DGGTVRNWPWRRWALSWTANTYARLALGI

SEQ ID NO: 113770 - protein, 19 aa, Mycobacterium avium
DGGVLLLPADGRWLVVDTA

SEQ ID NO: 113771 - protein, 24 aa, Mycobacterium avium
DGGYRDTEIVRWLFTRDPSLTVTR

SEQ ID NO: 113772 - protein, 25 aa, Mycobacterium avium
DGKDLPVVGFLWEVLGRIGIGRKDA

SEQ ID NO: 113773 - protein, 24 aa, Mycobacterium avium
DGKHELLLALFEDALSRSADQIRA

SEQ ID NO: 113774 - protein, 22 aa, Mycobacterium avium
DGLASGEWRPLPAEIYPLAEAK

SEQ ID NO: 113775 - protein, 17 aa, Mycobacterium avium
DGLVRFVDACHARGLGV

SEQ ID NO: 113776 - protein, 23 aa, Mycobacterium avium
DGMESLLGAIYLQHGIDTAREVI

SEQ ID NO: 113777 - protein, 22 aa, Mycobacterium avium
DGMLVCVAQCRPNTAPTVLQTD

SEQ ID NO: 113778 - protein, 21 aa, Mycobacterium avium
DGMYPLGPIIAGAALNITVMS

SEQ ID NO: 113779 - protein, 24 aa, Mycobacterium avium
DGPGAPIRFLVRARGWPDGGPRVL

SEQ ID NO: 113780 - protein, 18 aa, Mycobacterium avium
DGPLDRLLRPGGVVDMLT

SEQ ID NO: 113781 - protein, 17 aa, Mycobacterium avium
DGQPLELRLYRGHTESA

SEQ ID NO: 113782 - protein, 35 aa, Mycobacterium avium
DGQRVMLKLSLPTEANFYRPLIEHPKVMRVVALSG

SEQ ID NO: 113783 - protein, 21 aa, Mycobacterium avium
DGRGPLGWLYTPSGDVTSLLT

SEQ ID NO: 113784 - protein, 24 aa, Mycobacterium avium
DGRPFFCGTYYPKDAFLQLLSAVS

SEQ ID NO: 113785 - protein, 24 aa, Mycobacterium avium
DGRRATSHWLTIPALKAFGVTAVP

SEQ ID NO: 113786 - protein, 30 aa, Mycobacterium avium
DGRRSRDLLLDAYLLRAMGIAGWAPALTEC

SEQ ID NO: 113787 - protein, 34 aa, Mycobacterium avium
DGRSGEPFPYPVTVGYMYIMKLHHLVDDKIHARS

SEQ ID NO: 113788 - protein, 19 aa, Mycobacterium avium
DGSAAILFMSAEKAKELGL

SEQ ID NO: 113789 - protein, 26 aa, Mycobacterium avium
DGSTPPLLEVVRPATFLFAAGQETVT

SEQ ID NO: 113790 - protein, 24 aa, Mycobacterium avium
DGSTPWLVHGYQAIRALFADARTS

SEQ ID NO: 113791 - protein, 24 aa, Mycobacterium avium
DGTPETAWPLGMVTEFAANAAEGW

SEQ ID NO: 113792 - protein, 23 aa, Mycobacterium avium
DGVPVWISGPQYAAHYRDKHTQL

SEQ ID NO: 113793 - protein, 17 aa, Mycobacterium avium
DGVTGCWVLARYDDGRP

SEQ ID NO: 113794 - protein, 25 aa, Mycobacterium avium
DGVTRELVWPAMRISHCRPPGSDRD

SEQ ID NO: 113795 - protein, 20 aa, Mycobacterium avium
DGWGLAPQLLSALSQARIVA

SEQ ID NO: 113796 - protein, 23 aa, Mycobacterium avium
DHDRFTAVLWGVRAVFEGFASVS

SEQ ID NO: 113797 - protein, 25 aa, Mycobacterium avium
DHHPVYYMPQWDTFALSRFDDIWRV

SEQ ID NO: 113798 - protein, 27 aa, Mycobacterium avium
DHHSRRGLLLLVGRRRRLLKYVAQIDV

SEQ ID NO: 113799 - protein, 38 aa, Mycobacterium avium
DHLHAVVGEWQLLADLSFADYLMWVCRDDGMLVCVAQC

SEQ ID NO: 113800 - protein, 30 aa, Mycobacterium avium
DHLQRLWTPYRMTYLAEAPMKRGPNSSGKS

SEQ ID NO: 113801 - protein, 17 aa, Mycobacterium avium
DHPFNPVSLALGAEATF

SEQ ID NO: 113802 - protein, 24 aa, Mycobacterium avium
DHSGPLVTELLTEAGFVVDGVVAV

SEQ ID NO: 113803 - protein, 25 aa, Mycobacterium avium
DHVPEQAFFLIGGLDDLAKKAESLG

SEQ ID NO: 113804 - protein, 22 aa, Mycobacterium avium
DHYFASWFERYARSFSGTIAGG

SEQ ID NO: 113805 - protein, 27 aa, Mycobacterium avium
DIAEEYYISFLLDRANRTYLAMCSVEG

SEQ ID NO: 113806 - protein, 19 aa, Mycobacterium avium
DIAEPLPRSLVWSAAWEMT

SEQ ID NO: 113807 - protein, 23 aa, Mycobacterium avium
DIAGTLSVLAFTFTMVTGGNDTT

SEQ ID NO: 113808 - protein, 20 aa, Mycobacterium avium
DIAHRYSAKPVYLRAVEVRT

SEQ ID NO: 113809 - protein, 27 aa, Mycobacterium avium
DIDDPPVLLIMGLGAQLLLWRTAFCEK

SEQ ID NO: 113810 - protein, 29 aa, Mycobacterium avium
DIDEIQAQAILDMQLRRLAALERQRIIDD

SEQ ID NO: 113811 - protein, 22 aa, Mycobacterium avium
DIDVVLTRLRRAHGQLGGVIAM

SEQ ID NO: 113812 - protein, 26 aa, Mycobacterium avium
DIGAFTPIFVMSRITGWTAHIIEQTA

SEQ ID NO: 113813 - protein, 17 aa, Mycobacterium avium
DIIAWECDYPHSDCFWP

SEQ ID NO: 113814 - protein, 20 aa, Mycobacterium avium
DIIRRYHFAGDPRPFAILGR

SEQ ID NO: 113815 - protein, 25 aa, Mycobacterium avium
DIKPEHLILIGQIAQDFGLYTKITG

SEQ ID NO: 113816 - protein, 17 aa, Mycobacterium avium
DILVRLTAFMIEHGLAV

SEQ ID NO: 113817 - protein, 20 aa, Mycobacterium avium
DIPLAADHFRYFAGALRAQE

SEQ ID NO: 113818 - protein, 24 aa, Mycobacterium avium
DIRESIHLRALGRQNPLDEFHRLA

SEQ ID NO: 113819 - protein, 23 aa, Mycobacterium avium
DIRPGLLVQLAFAAADFGFQQWV

SEQ ID NO: 113820 - protein, 24 aa, Mycobacterium avium
DISEQLARRRLGYGRGARMSFERD

SEQ ID NO: 113821 - protein, 24 aa, Mycobacterium avium
DISGIDVLAGLRGWLTAPVIVLSA

SEQ ID NO: 113822 - protein, 26 aa, Mycobacterium avium
DITAQLLPRPIGLIIGLQLSANPFVL

SEQ ID NO: 113823 - protein, 29 aa, Mycobacterium avium
DITVNVDGFWMLQALLDIRHVAPELRCRP

SEQ ID NO: 113824 - protein, 17 aa, Mycobacterium avium
DIVLRAAAKLPGVRIVV

SEQ ID NO: 113825 - protein, 25 aa, Mycobacterium avium
DIVSSVGYTALLVAGWRALHAVSPR

SEQ ID NO: 113826 - protein, 21 aa, Mycobacterium avium
DIVWADAVIFGSPTRFGSPAA

SEQ ID NO: 113827 - protein, 20 aa, Mycobacterium avium
DKAFTVTWTDGRSATFDSVE

SEQ ID NO: 113828 - protein, 24 aa, Mycobacterium avium
DKAGSPLNLLRWTSARTIKETFVP

SEQ ID NO: 113829 - protein, 26 aa, Mycobacterium avium
DKAQHGVMELLLINHPLDCPMCDKGG

SEQ ID NO: 113830 - protein, 22 aa, Mycobacterium avium
DKARRLAEKLWKLRILADERSA

SEQ ID NO: 113831 - protein, 20 aa, Mycobacterium avium
DKAWYIEHRYLSTERAKAVT

SEQ ID NO: 113832 - protein, 24 aa, Mycobacterium avium
DKEGRLILSKKRAQYERAWGTIEA

SEQ ID NO: 113833 - protein, 27 aa, Mycobacterium avium
DKEQLVANLLPQVFRWARAVDASQPLT

SEQ ID NO: 113834 - protein, 20 aa, Mycobacterium avium
DKLALLLEFANELPPLPPEL

SEQ ID NO: 113835 - protein, 17 aa, Mycobacterium avium
DKLLDAALAACDKLFAA

SEQ ID NO: 113836 - protein, 29 aa, Mycobacterium avium
DKLPYDEPPLWPYPVRQTLASILIRRAIA

SEQ ID NO: 113837 - protein, 20 aa, Mycobacterium avium
DKMLFLLATAKLNQAERFGV

SEQ ID NO: 113838 - protein, 28 aa, Mycobacterium avium
DKSDLRGRFRWWGLYTQREQGYDGSWTG

SEQ ID NO: 113839 - protein, 24 aa, Mycobacterium avium
DKTRPLWEMYLVEGLSKNRLALYT

SEQ ID NO: 113840 - protein, 21 aa, Mycobacterium avium
DKVILDDVTLSFYPGAKIGVV

SEQ ID NO: 113841 - protein, 22 aa, Mycobacterium avium
DKYWRAANYLSVGQIYLLDNPL

SEQ ID NO: 113842 - protein, 19 aa, Mycobacterium avium
DLAKGIPEMLRFTTTWIDE

SEQ ID NO: 113843 - protein, 27 aa, Mycobacterium avium
DLARELIRVVTIAPGLFKTPLLGSLPE

SEQ ID NO: 113844 - protein, 26 aa, Mycobacterium avium
DLDEGFALLSDDFSYWTLYTRAACDK

SEQ ID NO: 113845 - protein, 27 aa, Mycobacterium avium
DLDNPALALMFFLTSSRIFGRGRGVRM

SEQ ID NO: 113846 - protein, 17 aa, Mycobacterium avium
DLDVTLRRVLKAAMELT

SEQ ID NO: 113847 - protein, 18 aa, Mycobacterium avium
DLDVVQTGAWLLADDRRL

SEQ ID NO: 113848 - protein, 19 aa, Mycobacterium avium
DLELVDEAIRRFHLADARE

SEQ ID NO: 113849 - protein, 25 aa, Mycobacterium avium
DLEPDNFLYQPFLHTRGLGEKDLSL

SEQ ID NO: 113850 - protein, 17 aa, Mycobacterium avium
DLFHCWAEGDFEAQLPR

SEQ ID NO: 113851 - protein, 24 aa, Mycobacterium avium
DLGSVGVRVLAIAPSLFATGLTQG

SEQ ID NO: 113852 - protein, 26 aa, Mycobacterium avium
DLHDHNMVWDFWTSCPETAHLVTLVM

SEQ ID NO: 113853 - protein, 23 aa, Mycobacterium avium
DLHLGQVLRTPESWLLIDFEGEP

SEQ ID NO: 113854 - protein, 25 aa, Mycobacterium avium
DLHLYEILGAFMKPGDILGHEPMGV

SEQ ID NO: 113855 - protein, 20 aa, Mycobacterium avium
DLIEHPTVRAAYRSVAQTWL

SEQ ID NO: 113856 - protein, 21 aa, Mycobacterium avium
DLLGVDGLLAHRSENAPLAGK

SEQ ID NO: 113857 - protein, 21 aa, Mycobacterium avium
DLLKGVQYYPGGCTTQSIVMR

SEQ ID NO: 113858 - protein, 28 aa, Mycobacterium avium
DLLRGRRPRPFLPDDFEAAQLRTAIELR

SEQ ID NO: 113859 - protein, 19 aa, Mycobacterium avium
DLLRPVIDAVAARAPRPYD

SEQ ID NO: 113860 - protein, 25 aa, Mycobacterium avium
DLLWGPAMRNYPDLKFAFSEGGIGW

SEQ ID NO: 113861 - protein, 18 aa, Mycobacterium avium
DLMGTRLLELTFDAPRRL

SEQ ID NO: 113862 - protein, 18 aa, Mycobacterium avium
DLPRIIRAGKHLARPKRY

SEQ ID NO: 113863 - protein, 31 aa, Mycobacterium avium
DLPVDPTLLFDGMFALVQHSLHRLYALGDPP

SEQ ID NO: 113864 - protein, 19 aa, Mycobacterium avium
DLQDVGFFTLLQPEQWGGL

SEQ ID NO: 113865 - protein, 17 aa, Mycobacterium avium
DLQIVRSYKLRGAYNLL

SEQ ID NO: 113866 - protein, 21 aa, Mycobacterium avium
DLRAGLRMNIIGNPGVEKANF

SEQ ID NO: 113867 - protein, 23 aa, Mycobacterium avium
DLRAPLLAALGAADLALATVNDL

SEQ ID NO: 113868 - protein, 18 aa, Mycobacterium avium
DLRAVLRDYSRDMILPAL

SEQ ID NO: 113869 - protein, 24 aa, Mycobacterium avium
DLSGLPLDEPIPARLLGSVPDPSK

SEQ ID NO: 113870 - protein, 23 aa, Mycobacterium avium
DLTARLLGARITGTDRRGKYLWL

SEQ ID NO: 113871 - protein, 19 aa, Mycobacterium avium
DLTLLPVDSIPVPGPVGVL

SEQ ID NO: 113872 - protein, 18 aa, Mycobacterium avium
DLVALMKVGLRRGKIIVV

SEQ ID NO: 113873 - protein, 21 aa, Mycobacterium avium
DLVARVLATIKPVAALAQRFA

SEQ ID NO: 113874 - protein, 20 aa, Mycobacterium avium
DLVDGAPKPLLEKVAKEAAD

SEQ ID NO: 113875 - protein, 21 aa, Mycobacterium avium
DLVEWQLRVAAGEKLVFAQDD

SEQ ID NO: 113876 - protein, 26 aa, Mycobacterium avium
DLVGNNFPVFFIQDGIKFPDFVHAVK

SEQ ID NO: 113877 - protein, 17 aa, Mycobacterium avium
DLVLIDPAGSVLQAAQG

SEQ ID NO: 113878 - protein, 18 aa, Mycobacterium avium
DLVLVYLAAANRDPAVFG

SEQ ID NO: 113879 - protein, 18 aa, Mycobacterium avium
DLVRLGLDGGRWGAAPLR

SEQ ID NO: 113880 - protein, 25 aa, Mycobacterium avium
DLVRQFTFEFPTRVIARLLGLPDED

SEQ ID NO: 113881 - protein, 17 aa, Mycobacterium avium
DLWQAGAITPGTKALST

SEQ ID NO: 113882 - protein, 30 aa, Mycobacterium avium
DMSVELFGTRFPSPIFMAPIGVIGVCDPDG

SEQ ID NO: 113883 - protein, 26 aa, Mycobacterium avium
DMTLEMPLVDFFSHGGSLKSSWYGDC

SEQ ID NO: 113884 - protein, 23 aa, Mycobacterium avium
DNAAWVYRTLFARVGNRADAEDL

SEQ ID NO: 113885 - protein, 26 aa, Mycobacterium avium
DNAGVPTFDSVRDKIEARYATAQGAA

SEQ ID NO: 113886 - protein, 17 aa, Mycobacterium avium
DNCHYCTFVTVPGKLRA

SEQ ID NO: 113887 - protein, 24 aa, Mycobacterium avium
DNELTWIDWANADVDLLAFTRVVS

SEQ ID NO: 113888 - protein, 18 aa, Mycobacterium avium
DNERLIPYRASRSAFAFK

SEQ ID NO: 113889 - protein, 27 aa, Mycobacterium avium
DNFLAHRQLFDPALLARARSIAAAGGC

SEQ ID NO: 113890 - protein, 32 aa, Mycobacterium avium
DNGGVYFVPAFSGLFAPYWRSDARGAIVGLSR

SEQ ID NO: 113891 - protein, 24 aa, Mycobacterium avium
DNGPWAVFDLSLGRAMYSGFTIGG

SEQ ID NO: 113892 - protein, 23 aa, Mycobacterium avium
DNPVNWPRVLTVWRANLIGSSGK

SEQ ID NO: 113893 - protein, 18 aa, Mycobacterium avium
DNQLAWQWYLNGADPDEA

SEQ ID NO: 113894 - protein, 39 aa, Mycobacterium avium
DNRSQFVIEPLEPGFGYTLGNSLRRTLLSSIPGAAVTSI

SEQ ID NO: 113895 - protein, 24 aa, Mycobacterium avium
DNRTYGHPIVLRPVTSEDAMTADW

SEQ ID NO: 113896 - protein, 25 aa, Mycobacterium avium
DNVSKLLWANWHRALGELAMDVIGK

SEQ ID NO: 113897 - protein, 19 aa, Mycobacterium avium
DNYWSMGIPGPCGPSSEIY

SEQ ID NO: 113898 - protein, 18 aa, Mycobacterium avium
DPARYRRGPAAPAVLAVT

SEQ ID NO: 113899 - protein, 18 aa, Mycobacterium avium
DPDAAGVALLLIDSRERH

SEQ ID NO: 113900 - protein, 23 aa, Mycobacterium avium
DPDAALLALVRLAETPDAGWDEL

SEQ ID NO: 113901 - protein, 25 aa, Mycobacterium avium
DPDAVELPGWYRPNPGLARDLAFIA

SEQ ID NO: 113902 - protein, 24 aa, Mycobacterium avium
DPDGGLLAYRRLSEALAGESWYLS

SEQ ID NO: 113903 - protein, 26 aa, Mycobacterium avium
DPDHDFFAAPIAWQQRLWPTEEFELA

SEQ ID NO: 113904 - protein, 24 aa, Mycobacterium avium
DPDPPLYPYLGSAHWHVPWAQEYF

SEQ ID NO: 113905 - protein, 20 aa, Mycobacterium avium
DPEILLLDEGLGAVDADFMK

SEQ ID NO: 113906 - protein, 26 aa, Mycobacterium avium
DPEYPAAAILGNYLPRYLRGICDDAD

SEQ ID NO: 113907 - protein, 19 aa, Mycobacterium avium
DPFPEFINGLRSAGAQVMP

SEQ ID NO: 113908 - protein, 24 aa, Mycobacterium avium
DPLFAEYLWAYFESEAIPTLPPVP

SEQ ID NO: 113909 - protein, 20 aa, Mycobacterium avium
DPPRKWWQAGPGEGSIGFTD

SEQ ID NO: 113910 - protein, 23 aa, Mycobacterium avium
DPQGNVIAWASSGHVGFKGSRKS

SEQ ID NO: 113911 - protein, 17 aa, Mycobacterium avium
DPRLVGPDLRPVLEAVG

SEQ ID NO: 113912 - protein, 23 aa, Mycobacterium avium
DPRPQATRLLPPGSTLMLFTDGL

SEQ ID NO: 113913 - protein, 30 aa, Mycobacterium avium
DPRRFATDLLERFRDLILLQAVPDAASRGV

SEQ ID NO: 113914 - protein, 23 aa, Mycobacterium avium
DPTGLDIALFSAGKTMSLVQAPR

SEQ ID NO: 113915 - protein, 21 aa, Mycobacterium avium
DPTLWPQREALKSALQYPALA

SEQ ID NO: 113916 - protein, 17 aa, Mycobacterium avium
DPTMTYSCAYWDRNRDI

SEQ ID NO: 113917 - protein, 26 aa, Mycobacterium avium
DPTTAAFLSIHNMCAWMIDSYGTPEQ

SEQ ID NO: 113918 - protein, 23 aa, Mycobacterium avium
DPTVFPGHWYSAEPSASLSEVKR

SEQ ID NO: 113919 - protein, 31 aa, Mycobacterium avium
DPVLKIPRLQDAYFKRFPGYPKGITVPAIVD

SEQ ID NO: 113920 - protein, 21 aa, Mycobacterium avium
DPVRRRIFQLEIGRAHTPWFH

SEQ ID NO: 113921 - protein, 17 aa, Mycobacterium avium
DQFDWLATRLEIARKLR

SEQ ID NO: 113922 - protein, 20 aa, Mycobacterium avium
DQGLSLTLFFKDTATTRDVN

SEQ ID NO: 113923 - protein, 25 aa, Mycobacterium avium
DQLMKAALPFGLWVPVLPGTRQVTV

SEQ ID NO: 113924 - protein, 22 aa, Mycobacterium avium
DQMLAYNCSPSFNWKKHLDDAT

SEQ ID NO: 113925 - protein, 25 aa, Mycobacterium avium
DQREALLRRIGLAASKYWVCKRSTP

SEQ ID NO: 113926 - protein, 20 aa, Mycobacterium avium
DQRPITVPVLLTLTERFDLP

SEQ ID NO: 113927 - protein, 22 aa, Mycobacterium avium
DQRRDGLLRPDELQRMTIPTFA

SEQ ID NO: 113928 - protein, 25 aa, Mycobacterium avium
DQVATLFRMWLRDAVRRVAAGALDV

SEQ ID NO: 113929 - protein, 24 aa, Mycobacterium avium
DQVLIDLNVRWRKGQTLDPDWKIE

SEQ ID NO: 113930 - protein, 19 aa, Mycobacterium avium
DQYGSIPLPGSFTAKLSSA

SEQ ID NO: 113931 - protein, 24 aa, Mycobacterium avium
DRAARIAKFWAAEAGARVAATAQH

SEQ ID NO: 113932 - protein, 25 aa, Mycobacterium avium
DRAEKYRALLAERSPLYRRAATIRV

SEQ ID NO: 113933 - protein, 24 aa, Mycobacterium avium
DRATLRISSQLLANWLRHGVITEE

SEQ ID NO: 113934 - protein, 17 aa, Mycobacterium avium
DRATVTHLIQARGLVDV

SEQ ID NO: 113935 - protein, 22 aa, Mycobacterium avium
DRDAAWPVICAQLRDTVGVADR

SEQ ID NO: 113936 - protein, 27 aa, Mycobacterium avium
DRDDVAALLRWLGNGNFLLLGYQRCRV

SEQ ID NO: 113937 - protein, 24 aa, Mycobacterium avium
DRDELIGRLWRGGVIVLPTGDDGV

SEQ ID NO: 113938 - protein, 34 aa, Mycobacterium avium
DRDGQWWYESLTGAPMPRWLAGALAAPAGPPRPC

SEQ ID NO: 113939 - protein, 28 aa, Mycobacterium avium
DRDGSDAMRWFLMASPILRGGNLIVTEQ

SEQ ID NO: 113940 - protein, 22 aa, Mycobacterium avium
DRDNLYTPLQAAKLAKETSSTK

SEQ ID NO: 113941 - protein, 34 aa, Mycobacterium avium
DRDWEHLRTLYAERAPGFLKTALPGLNPAVVHHV

SEQ ID NO: 113942 - protein, 19 aa, Mycobacterium avium
DREILGIAEAIRGSGLSAG

SEQ ID NO: 113943 - protein, 25 aa, Mycobacterium avium
DRENLQLHWIRIEDVPEIWRRLESV

SEQ ID NO: 113944 - protein, 25 aa, Mycobacterium avium
DRFGLAARRPAVFTDLPPLNGDNLD

SEQ ID NO: 113945 - protein, 18 aa, Mycobacterium avium
DRFHLVIDVLDRVEGLAS

SEQ ID NO: 113946 - protein, 18 aa, Mycobacterium avium
DRFLAYFAARDWDAMANM

SEQ ID NO: 113947 - protein, 26 aa, Mycobacterium avium
DRGKIEALLRVLEPFGIREIVQSGVV

SEQ ID NO: 113948 - protein, 21 aa, Mycobacterium avium
DRGPVWVFSGQGSQWAAMGAD

SEQ ID NO: 113949 - protein, 19 aa, Mycobacterium avium
DRIGRRPGARWAADLVSAA

SEQ ID NO: 113950 - protein, 23 aa, Mycobacterium avium
DRIVNWLVDKFKGTSGIDLTKDK

SEQ ID NO: 113951 - protein, 25 aa, Mycobacterium avium
DRKGPGRPPLMFRAVRQMDRGGTRH

SEQ ID NO: 113952 - protein, 28 aa, Mycobacterium avium
DRKRRQPVTVLLKALGWTNEQITERFGF

SEQ ID NO: 113953 - protein, 24 aa, Mycobacterium avium
DRLEDIWNTFTKLAPKQLIVDENL

SEQ ID NO: 113954 - protein, 24 aa, Mycobacterium avium
DRLRDIWADGPLTFLGMMVPGLPN

SEQ ID NO: 113955 - protein, 17 aa, Mycobacterium avium
DRLYFEPLTFEDVLEVF

SEQ ID NO: 113956 - protein, 18 aa, Mycobacterium avium
DRNLIGHVPVIGGGLSLL

SEQ ID NO: 113957 - protein, 33 aa, Mycobacterium avium
DRNTHGVSWLPLYHDMGLSMIGFPAVYGGHSTL

SEQ ID NO: 113958 - protein, 26 aa, Mycobacterium avium
DRRKMFSLLFASLRRQRKLLTRFDEM

SEQ ID NO: 113959 - protein, 19 aa, Mycobacterium avium
DRRLLRYDTLILDEAHERS

SEQ ID NO: 113960 - protein, 24 aa, Mycobacterium avium
DRRSVSWTLVSSSLLRALEGSYRL

SEQ ID NO: 113961 - protein, 23 aa, Mycobacterium avium
DRSRPLWEMYFVEGLANNRIAVV

SEQ ID NO: 113962 - protein, 28 aa, Mycobacterium avium
DRSVVPVRVFWLPPPDRGRIAKLAGLVP

SEQ ID NO: 113963 - protein, 22 aa, Mycobacterium avium
DRTLMFPTLASLIEERLRDDPV

SEQ ID NO: 113964 - protein, 18 aa, Mycobacterium avium
DRTVMAKLYLREVNQRVG

SEQ ID NO: 113965 - protein, 19 aa, Mycobacterium avium
DRTWPDKVIDRAPLWCAVD

SEQ ID NO: 113966 - protein, 22 aa, Mycobacterium avium
DRVHGRLRLGPGWVSHVLQQLA

SEQ ID NO: 113967 - protein, 19 aa, Mycobacterium avium
DRVLYDAGLSVITWPKKYG

SEQ ID NO: 113968 - protein, 19 aa, Mycobacterium avium
DRVVLATKFGLISHTGRDG

SEQ ID NO: 113969 - protein, 26 aa, Mycobacterium avium
DSDRPGRLLGFHWTKVHLDQPGLGEV

SEQ ID NO: 113970 - protein, 21 aa, Mycobacterium avium
DSFLRGAQLLDVPAGAAAVFE

SEQ ID NO: 113971 - protein, 24 aa, Mycobacterium avium
DSFMAGLLDALWEAGLLGGDRRGA

SEQ ID NO: 113972 - protein, 26 aa, Mycobacterium avium
DSIVMLHLALRAFRPGRLPFPVMHVD

SEQ ID NO: 113973 - protein, 26 aa, Mycobacterium avium
DSKGYCFQIDLTWRTICNGFTIAEVP

SEQ ID NO: 113974 - protein, 33 aa, Mycobacterium avium
DSLLPIVPMFHANAWGLPYAALMAGADLVLPDC

SEQ ID NO: 113975 - protein, 26 aa, Mycobacterium avium
DSLRRRRDLSVLLLLDVSGSAAEPGT

SEQ ID NO: 113976 - protein, 20 aa, Mycobacterium avium
DSLRTLVPLPVRSAVLSHLP

SEQ ID NO: 113977 - protein, 27 aa, Mycobacterium avium
DSLVKTAVFGSDPNWGRVVAAVGIAPI

SEQ ID NO: 113978 - protein, 17 aa, Mycobacterium avium
DSRFGPRVWHRDFFDAE

SEQ ID NO: 113979 - protein, 22 aa, Mycobacterium avium
DSRLRVLTRREFAGMISVAIES

SEQ ID NO: 113980 - protein, 26 aa, Mycobacterium avium
DSSDHIPKWLLPVVHDNLRSGGPVQL

SEQ ID NO: 113981 - protein, 25 aa, Mycobacterium avium
DTDGFWAAVLHRTAERRAATFSSLS

SEQ ID NO: 113982 - protein, 28 aa, Mycobacterium avium
DTDLAWARITYWRALLAAAVDLAPHEPI

SEQ ID NO: 113983 - protein, 23 aa, Mycobacterium avium
DTDQIIPAVYLKRVTRTGFEDGL

SEQ ID NO: 113984 - protein, 25 aa, Mycobacterium avium
DTDSERVFALITAAIRARDGDITAG

SEQ ID NO: 113985 - protein, 32 aa, Mycobacterium avium
DTEPWRAGPLLDYLRKMVFWSDVTPAAADLAV

SEQ ID NO: 113986 - protein, 32 aa, Mycobacterium avium
DTETLVRYIDRFVMYYIRTADRLQRTAPWVES

SEQ ID NO: 113987 - protein, 19 aa, Mycobacterium avium
DTFAPVRALLGGGGTRRRS

SEQ ID NO: 113988 - protein, 25 aa, Mycobacterium avium
DTGAPALGWALGGAFGIKLARPHAP

SEQ ID NO: 113989 - protein, 25 aa, Mycobacterium avium
DTGSPFWLRTARTLSFDPLTDVHTF

SEQ ID NO: 113990 - protein, 33 aa, Mycobacterium avium
DTHARVGLLPTWGLSVRLPQKVGIGLARRMSLT

SEQ ID NO: 113991 - protein, 23 aa, Mycobacterium avium
DTIKRILLELGGKSASIVLDDAN

SEQ ID NO: 113992 - protein, 25 aa, Mycobacterium avium
DTLADFEILFDGIPLDKLSTSMTIN

SEQ ID NO: 113993 - protein, 23 aa, Mycobacterium avium
DTLDLLRGIFPRTTITMAFGSTM

SEQ ID NO: 113994 - protein, 25 aa, Mycobacterium avium
DTLGTQLMLSIWRGRAGDVPAAVAE

SEQ ID NO: 113995 - protein, 25 aa, Mycobacterium avium
DTLVLGCTHYPLLSGLIQLAMGDNV

SEQ ID NO: 113996 - protein, 29 aa, Mycobacterium avium
DTLVRMAQPWSLRYPLVDGQGNFGSPGND

SEQ ID NO: 113997 - protein, 22 aa, Mycobacterium avium
DTNYHYIVPEIAPTTKFALNPD

SEQ ID NO: 113998 - protein, 31 aa, Mycobacterium avium
DTQNDLPAFDRLLASLPWPLNKTTTVDKCAA

SEQ ID NO: 113999 - protein, 25 aa, Mycobacterium avium
DTRAPSTPWPTYPLMYRVSSAHEEG

SEQ ID NO: 114000 - protein, 18 aa, Mycobacterium avium
DTRPLRMHYLDEGPIDGP

SEQ ID NO: 114001 - protein, 23 aa, Mycobacterium avium
DTTYGGRWVVNPSGGLISKGHPL

SEQ ID NO: 114002 - protein, 23 aa, Mycobacterium avium
DTVLRLPDVRALLTRHLSGRPTR

SEQ ID NO: 114003 - protein, 23 aa, Mycobacterium avium
DTVPRGYRLVARPGAVTRRAISL

SEQ ID NO: 114004 - protein, 28 aa, Mycobacterium avium
DTVRYPIEQGVKKVYYWSARATGGEFVP

SEQ ID NO: 114005 - protein, 22 aa, Mycobacterium avium
DVALAKLRHALPGAVFVSAATG

SEQ ID NO: 114006 - protein, 17 aa, Mycobacterium avium
DVALGIGGLPRGRVVEI

SEQ ID NO: 114007 - protein, 21 aa, Mycobacterium avium
DVAQRLLTRNGWRNTTLAQIA

SEQ ID NO: 114008 - protein, 23 aa, Mycobacterium avium
DVARWVRRFAGHAVSPEKAADKI

SEQ ID NO: 114009 - protein, 25 aa, Mycobacterium avium
DVAVGTLYRYFPSKVHLLVSALGRE

SEQ ID NO: 114010 - protein, 26 aa, Mycobacterium avium
DVDDEFFVIVRPAPSGTRLLLSDATA

SEQ ID NO: 114011 - protein, 25 aa, Mycobacterium avium
DVDFDWSALPFYYVPGEPFTTHFCN

SEQ ID NO: 114012 - protein, 22 aa, Mycobacterium avium
DVDFHLRRIGVPAPGGRRELEE

SEQ ID NO: 114013 - protein, 26 aa, Mycobacterium avium
DVDLPSALPMLVFSGIMNSGQACVAQ

SEQ ID NO: 114014 - protein, 32 aa, Mycobacterium avium
DVDMTVLIDLQFATMWISPTRIHDPDRLAVIM

SEQ ID NO: 114015 - protein, 21 aa, Mycobacterium avium
DVDWLDDGWVALLRKWIDDAE

SEQ ID NO: 114016 - protein, 26 aa, Mycobacterium avium
DVELIGRIGWTCRDVWWAATQDPRAW

SEQ ID NO: 114017 - protein, 30 aa, Mycobacterium avium
DVERHLRVILHGWLAFTFEICRQRIIDPTT

SEQ ID NO: 114018 - protein, 19 aa, Mycobacterium avium
DVERLASAPALLHEHEKWT

SEQ ID NO: 114019 - protein, 26 aa, Mycobacterium avium
DVERRYRAWIRWNAAIMVHRAQRPGV

SEQ ID NO: 114020 - protein, 23 aa, Mycobacterium avium
DVEVGLPMRCVFALTAMGFLPQS

SEQ ID NO: 114021 - protein, 29 aa, Mycobacterium avium
DVFASRLPLYFPTPLRHRFTPEIRAHQLR

SEQ ID NO: 114022 - protein, 24 aa, Mycobacterium avium
DVFCSVVRRVALPDSFFAIDGQIE

SEQ ID NO: 114023 - protein, 17 aa, Mycobacterium avium
DVFRPGDRRAARAALGL

SEQ ID NO: 114024 - protein, 26 aa, Mycobacterium avium
DVGDITLGERLILSSGFVAVTVVVQR

SEQ ID NO: 114025 - protein, 18 aa, Mycobacterium avium
DVGYGQLAWSLRSDARVV

SEQ ID NO: 114026 - protein, 28 aa, Mycobacterium avium
DVHAYIEEKIFYPQLLKRGSADAEGETL

SEQ ID NO: 114027 - protein, 22 aa, Mycobacterium avium
DVKKQLLLDALADKLQVQVGQE

SEQ ID NO: 114028 - protein, 34 aa, Mycobacterium avium
DVKLPRELVLIGKQFLYVERYMKLLAPKWQMMSD

SEQ ID NO: 114029 - protein, 18 aa, Mycobacterium avium
DVLGRLRAGYRVDGREVT

SEQ ID NO: 114030 - protein, 22 aa, Mycobacterium avium
DVLLRMCLDYIDRVFGAGSELA

SEQ ID NO: 114031 - protein, 18 aa, Mycobacterium avium
DVLQCYLELVLDGLVARL

SEQ ID NO: 114032 - protein, 20 aa, Mycobacterium avium
DVLTIERFAHLIGGARMGTR

SEQ ID NO: 114033 - protein, 20 aa, Mycobacterium avium
DVLVFGLARGGLPVAWEIAA

SEQ ID NO: 114034 - protein, 27 aa, Mycobacterium avium
DVNVSGVFYGVRAFLPKMMAAGQQAWV

SEQ ID NO: 114035 - protein, 25 aa, Mycobacterium avium
DVPAAGWGWLPLATGVAVVDTVAPL

SEQ ID NO: 114036 - protein, 27 aa, Mycobacterium avium
DVPILPQQALLYRLCGDRNPLHSDPEF

SEQ ID NO: 114037 - protein, 21 aa, Mycobacterium avium
DVPQLYLTAMPGKPCLRLLGF

SEQ ID NO: 114038 - protein, 26 aa, Mycobacterium avium
DVQAGLAMLAPIWGYKPLLDTDDATA

SEQ ID NO: 114039 - protein, 18 aa, Mycobacterium avium
DVRGEGFFYGVELVKDRA

SEQ ID NO: 114040 - protein, 27 aa, Mycobacterium avium
DVRRYRVTYLNYVGKPLALILSTPERP

SEQ ID NO: 114041 - protein, 19 aa, Mycobacterium avium
DVSLRPRSLREFIGQPRVR

SEQ ID NO: 114042 - protein, 18 aa, Mycobacterium avium
DVSPLEAWKLLSDNPNAV

SEQ ID NO: 114043 - protein, 24 aa, Mycobacterium avium
DVTNFWALLKYEDIRFVSSNPALF

SEQ ID NO: 114044 - protein, 22 aa, Mycobacterium avium
DVTRRLGLPPPAALTGDWFDAL

SEQ ID NO: 114045 - protein, 18 aa, Mycobacterium avium
DVWNGFVFINFDPQPRQS

SEQ ID NO: 114046 - protein, 20 aa, Mycobacterium avium
DVWWRFREAITSAPQLNIGA

SEQ ID NO: 114047 - protein, 21 aa, Mycobacterium avium
DVYAACAPLVDPTMRLLERVL

SEQ ID NO: 114048 - protein, 20 aa, Mycobacterium avium
DVYQLGNLVLRGGPFALGCF

SEQ ID NO: 114049 - protein, 18 aa, Mycobacterium avium
DWDAFFCVVDLHAITIAQ

SEQ ID NO: 114050 - protein, 29 aa, Mycobacterium avium
DWDRNYVHSLQWLWLTEPLSEGPGESWIS

SEQ ID NO: 114051 - protein, 21 aa, Mycobacterium avium
DWSLVADVLTAMGLLRAISGQ

SEQ ID NO: 114052 - protein, 20 aa, Mycobacterium avium
DWTRLARRMSEISEAPLYID

SEQ ID NO: 114053 - protein, 20 aa, Mycobacterium avium
DWVIKRKLFQRYQDRYNMEL

SEQ ID NO: 114054 - protein, 29 aa, Mycobacterium avium
DWVQHVIWWQVYPLGFVGAYPLPQSSEPP

SEQ ID NO: 114055 - protein, 17 aa, Mycobacterium avium
DYAKRKGWTLAEAERWL

SEQ ID NO: 114056 - protein, 23 aa, Mycobacterium avium
DYGDGWCPFPAPPQLARTAGTAV

SEQ ID NO: 114057 - protein, 27 aa, Mycobacterium avium
DYGTYYKGHLYIAGRIKDLVIIDGRNH

SEQ ID NO: 114058 - protein, 18 aa, Mycobacterium avium
DYHHELDWWTSPSRKFDG

SEQ ID NO: 114059 - protein, 18 aa, Mycobacterium avium
DYKTLFREFGFTAEAVAA

SEQ ID NO: 114060 - protein, 18 aa, Mycobacterium avium
DYTALRFPKRQGMRIDFI

SEQ ID NO: 114061 - protein, 27 aa, Mycobacterium avium
DYTYSSAWFDLISPPPKLGRAAVSRGS

SEQ ID NO: 114062 - protein, 18 aa, Mycobacterium avium
DYVAGFYAAVKAGTIAVP

SEQ ID NO: 114063 - protein, 26 aa, Mycobacterium avium
DYVILNTIRNFLPDLGLRRENIVFIS

SEQ ID NO: 114064 - protein, 19 aa, Mycobacterium avium
DYYRNGGILQYVLRNMLKS

SEQ ID NO: 114065 - protein, 25 aa, Mycobacterium avium
EAAIDGWRRVVVTATRLGIPIPGFS

SEQ ID NO: 114066 - protein, 18 aa, Mycobacterium avium
EAARLRELYADDGLFRST

SEQ ID NO: 114067 - protein, 25 aa, Mycobacterium avium
EAAVPHPIDPILLGRTVLNLLRTPV

SEQ ID NO: 114068 - protein, 17 aa, Mycobacterium avium
EAAWRGAFLAHGSLTEP

SEQ ID NO: 114069 - protein, 35 aa, Mycobacterium avium
EACARKLFVHPNTVRYRLKRITDFTGRDPMQPRDA

SEQ ID NO: 114070 - protein, 29 aa, Mycobacterium avium
EACQSLRQFLDPDTLRYLRDFRFGGDIDG

SEQ ID NO: 114071 - protein, 31 aa, Mycobacterium avium
EADGYPLHTFPGEPPFVRGPYPTMYVNQPWT

SEQ ID NO: 114072 - protein, 27 aa, Mycobacterium avium
EADLEHWRWMWETNVIGTLRVTRALLP

SEQ ID NO: 114073 - protein, 19 aa, Mycobacterium avium
EADPRMFRVIRGQVAIATT

SEQ ID NO: 114074 - protein, 25 aa, Mycobacterium avium
EADRTWMVDTLLALLQTPSPSGRTD

SEQ ID NO: 114075 - protein, 29 aa, Mycobacterium avium
EAEGRGFYQLMKNLPQERLSLAVGAVAAA

SEQ ID NO: 114076 - protein, 18 aa, Mycobacterium avium
EAFDLLRRHSQALNIKLA

SEQ ID NO: 114077 - protein, 22 aa, Mycobacterium avium
EAFEKRWELGGVLFSKTFADQM

SEQ ID NO: 114078 - protein, 30 aa, Mycobacterium avium
EAFGAQWAAFARSALFPALVAGLDDGIRDP

SEQ ID NO: 114079 - protein, 24 aa, Mycobacterium avium
EAFQYVREYLSFLPSNCFDQPPIV

SEQ ID NO: 114080 - protein, 17 aa, Mycobacterium avium
EAFRLIEQNGYAATTVE

SEQ ID NO: 114081 - protein, 23 aa, Mycobacterium avium
EAGFVIVAIPPAHRAAIEFAPPL

SEQ ID NO: 114082 - protein, 33 aa, Mycobacterium avium
EAGMTEPLYLMPWSTMFPLGISAATIGIAEGAL

SEQ ID NO: 114083 - protein, 23 aa, Mycobacterium avium
EAGRINHAYLFSGPRGCGKTSSA

SEQ ID NO: 114084 - protein, 24 aa, Mycobacterium avium
EAIASFARLWVADPHWQAAERVMA

SEQ ID NO: 114085 - protein, 27 aa, Mycobacterium avium
EAIVHLGFGFGIVFINPALQAVDWDPP

SEQ ID NO: 114086 - protein, 22 aa, Mycobacterium avium
EALARLDRALSHTAILGVQTNV

SEQ ID NO: 114087 - protein, 30 aa, Mycobacterium avium
EALDRTGLWGRLLPEWDAIRDLPPRDVAHK

SEQ ID NO: 114088 - protein, 22 aa, Mycobacterium avium
EALIGVFDKIGVKTGIDFFDIA

SEQ ID NO: 114089 - protein, 32 aa, Mycobacterium avium
EALKSVAAFRLALPRTMLRFAGGREITLGDLG

SEQ ID NO: 114090 - protein, 19 aa, Mycobacterium avium
EALPPTEPRVLQIRALVLG

SEQ ID NO: 114091 - protein, 18 aa, Mycobacterium avium
EALREYGVRVLVIRPGQV

SEQ ID NO: 114092 - protein, 21 aa, Mycobacterium avium
EALRRRWSPQGKPIVGFVGRL

SEQ ID NO: 114093 - protein, 19 aa, Mycobacterium avium
EALVESALWEASLFEEHGF

SEQ ID NO: 114094 - protein, 20 aa, Mycobacterium avium
EALWKRWREGGVLFAKTFPD

SEQ ID NO: 114095 - protein, 21 aa, Mycobacterium avium
EAPIYYNERYDFWALSRHSDV

SEQ ID NO: 114096 - protein, 26 aa, Mycobacterium avium
EAQENKYRLIFDKLRLAPGDRLLDVG

SEQ ID NO: 114097 - protein, 18 aa, Mycobacterium avium
EAQKARWLEPMAAGDVVA

SEQ ID NO: 114098 - protein, 20 aa, Mycobacterium avium
EARLVVIKPYEASQVGAIET

SEQ ID NO: 114099 - protein, 19 aa, Mycobacterium avium
EARQRFPRELIEHLGARGV

SEQ ID NO: 114100 - protein, 18 aa, Mycobacterium avium
EARYFMMRVRCDGGAISA

SEQ ID NO: 114101 - protein, 32 aa, Mycobacterium avium
EAVLMVTGLDEPPLRLLLGRDVLKAMRDKIAA

SEQ ID NO: 114102 - protein, 17 aa, Mycobacterium avium
EAVLTWSRHEGPFLAAV

SEQ ID NO: 114103 - protein, 40 aa, Mycobacterium avium
EAVTQLFRDYGYRRLRAKARLKFLVKDWGIEKFREILEQE

SEQ ID NO: 114104 - protein, 26 aa, Mycobacterium avium
EAYADMPLFLFHLLEYMDVDYELDIE

SEQ ID NO: 114105 - protein, 20 aa, Mycobacterium avium
ECAQACGLALLGGPPTPETA

SEQ ID NO: 114106 - protein, 35 aa, Mycobacterium avium
ECCRLRKVAPLGKTLRGYSAWVTGLRRSEAATRAN

SEQ ID NO: 114107 - protein, 24 aa, Mycobacterium avium
ECDKTVYRAGWLRDGIVCPAQLGT

SEQ ID NO: 114108 - protein, 26 aa, Mycobacterium avium
ECGAFWANDLLWLMDTRYLREHSAKK

SEQ ID NO: 114109 - protein, 24 aa, Mycobacterium avium
ECTGYIVQLPLPKQLDENAALERV

SEQ ID NO: 114110 - protein, 19 aa, Mycobacterium avium
ECWAMQAYGAAYTLQELLT

SEQ ID NO: 114111 - protein, 17 aa, Mycobacterium avium
EDAGARPMPIYCASLRT

SEQ ID NO: 114112 - protein, 18 aa, Mycobacterium avium
EDEDGFWFIVDRVKDMIV

SEQ ID NO: 114113 - protein, 25 aa, Mycobacterium avium
EDESPIVFLRLRKAARKHGVPVYAV

SEQ ID NO: 114114 - protein, 23 aa, Mycobacterium avium
EDGRIFEELSLRGCVAALDGSDV

SEQ ID NO: 114115 - protein, 17 aa, Mycobacterium avium
EDGVIWVLTPKTGKPGH

SEQ ID NO: 114116 - protein, 30 aa, Mycobacterium avium
EDHAGKWRVVFFWPKDFTFVCPTEIATFGK

SEQ ID NO: 114117 - protein, 23 aa, Mycobacterium avium
EDHALVACFPGPAPAGWRIIGRV

SEQ ID NO: 114118 - protein, 25 aa, Mycobacterium avium
EDIRLALVAFGPNTLALGGRVFDDV

SEQ ID NO: 114119 - protein, 24 aa, Mycobacterium avium
EDLGRLTVYLCTRDCYATNAIFHV

SEQ ID NO: 114120 - protein, 25 aa, Mycobacterium avium
EDLNQLWMCGLPGYFPGDLIDFEFS

SEQ ID NO: 114121 - protein, 24 aa, Mycobacterium avium
EDLTGALSVIRPLSRSAAEEVSVG

SEQ ID NO: 114122 - protein, 23 aa, Mycobacterium avium
EDMAALRILAPRDYVGATEAIAD

SEQ ID NO: 114123 - protein, 25 aa, Mycobacterium avium
EDRCGPIITEWLAQQGFSSAQPEVV

SEQ ID NO: 114124 - protein, 17 aa, Mycobacterium avium
EDRGSFGDVLTAAGLPA

SEQ ID NO: 114125 - protein, 17 aa, Mycobacterium avium
EDRIRMLRSFDPRTGAH

SEQ ID NO: 114126 - protein, 22 aa, Mycobacterium avium
EDRLLVTVLIGHLSLALQHVRQ

SEQ ID NO: 114127 - protein, 25 aa, Mycobacterium avium
EDVKGKAKEAVGAVAGRDDLTREGQ

SEQ ID NO: 114128 - protein, 23 aa, Mycobacterium avium
EDVPEIWRRLESVGLQTTEACGD

SEQ ID NO: 114129 - protein, 24 aa, Mycobacterium avium
EDVPNLFWCVGYTNASWTLRADIT

SEQ ID NO: 114130 - protein, 25 aa, Mycobacterium avium
EDVTSLYKVGLGSVRFLMSVGDLII

SEQ ID NO: 114131 - protein, 25 aa, Mycobacterium avium
EDWAGVMRRLWHGELIFNHDGPMGK

SEQ ID NO: 114132 - protein, 17 aa, Mycobacterium avium
EDWTEMIDINLAGVWKT

SEQ ID NO: 114133 - protein, 24 aa, Mycobacterium avium
EEACSLGILIERAAKLQLAAMAAG

SEQ ID NO: 114134 - protein, 24 aa, Mycobacterium avium
EEANLVRLTELPSGAPVAVVVRQL

SEQ ID NO: 114135 - protein, 27 aa, Mycobacterium avium
EEARKGFFRVPLIRGTITHPVQGEAAA

SEQ ID NO: 114136 - protein, 26 aa, Mycobacterium avium
EEEYLNLNAKLLKLSSELLDCGIPTS

SEQ ID NO: 114137 - protein, 19 aa, Mycobacterium avium
EEFITGTILPLKSSGHAFG

SEQ ID NO: 114138 - protein, 23 aa, Mycobacterium avium
EEIRTTIFALRSPAAVAGDFRHR

SEQ ID NO: 114139 - protein, 27 aa, Mycobacterium avium
EEKPYTRRPYAPFMTSTLQQEAGRKLR

SEQ ID NO: 114140 - protein, 27 aa, Mycobacterium avium
EELGIDVFLVMPFTTDFMKLTPDRYVH

SEQ ID NO: 114141 - protein, 23 aa, Mycobacterium avium
EELIGQFGIGFYSSFMVADKVEL

SEQ ID NO: 114142 - protein, 22 aa, Mycobacterium avium
EELLRYLSIIQNGQRRVALEDI

SEQ ID NO: 114143 - protein, 25 aa, Mycobacterium avium
EELTDLLWRMGIRTIGQFAALARGD

SEQ ID NO: 114144 - protein, 27 aa, Mycobacterium avium
EEQAGAILFLLSELSSYVTGQTLLVDG

SEQ ID NO: 114145 - protein, 27 aa, Mycobacterium avium
EEQKRKWLPDLTAGRALAGFGLTEPGA

SEQ ID NO: 114146 - protein, 18 aa, Mycobacterium avium
EERRLAYVGITRARQRLY

SEQ ID NO: 114147 - protein, 20 aa, Mycobacterium avium
EERRRMFELPRSSWDDYDKS

SEQ ID NO: 114148 - protein, 17 aa, Mycobacterium avium
EERYVIPTAFAPQARDL

SEQ ID NO: 114149 - protein, 18 aa, Mycobacterium avium
EETLRFEPPSPVQARYVA

SEQ ID NO: 114150 - protein, 26 aa, Mycobacterium avium
EETPLGRWWRDMKLARVGGGTDEVLW

SEQ ID NO: 114151 - protein, 25 aa, Mycobacterium avium
EEVAKLTYYGLYALQHRGQEAAGIA

SEQ ID NO: 114152 - protein, 25 aa, Mycobacterium avium
EEVASYLFHAFGTNLQFAPGEFNFV

SEQ ID NO: 114153 - protein, 23 aa, Mycobacterium avium
EEVDKMVWATRWGADTIMDLSTG

SEQ ID NO: 114154 - protein, 19 aa, Mycobacterium avium
EEVFGPVASMYRAADIDEA

SEQ ID NO: 114155 - protein, 20 aa, Mycobacterium avium
EEVLFTIRPDRWLSADFTGD

SEQ ID NO: 114156 - protein, 26 aa, Mycobacterium avium
EEWCEEAPFYTLGPLATDIAPAYDHI

SEQ ID NO: 114157 - protein, 25 aa, Mycobacterium avium
EEWSTRLRRLISDQVSLILRRNVDP

SEQ ID NO: 114158 - protein, 29 aa, Mycobacterium avium
EFADAPRPDLILLDLNLPKYDGRQLLEKI

SEQ ID NO: 114159 - protein, 17 aa, Mycobacterium avium
EFFMRYLTWGLRGVTDG

SEQ ID NO: 114160 - protein, 25 aa, Mycobacterium avium
EFGHIDVHLLQYSGAIWYPMVYDMP

SEQ ID NO: 114161 - protein, 31 aa, Mycobacterium avium
EFLETHPAVRWVRYPYLPSHPQYDLAKRQMS

SEQ ID NO: 114162 - protein, 21 aa, Mycobacterium avium
EFLHYLRIREWQDLVGQLRGI

SEQ ID NO: 114163 - protein, 25 aa, Mycobacterium avium
EFQRRVWRALQTIPYGETRSYGEIA

SEQ ID NO: 114164 - protein, 19 aa, Mycobacterium avium
EFVENFFMFIAEEVREYMA

SEQ ID NO: 114165 - protein, 19 aa, Mycobacterium avium
EFYALEKEMFWPRVWQMAC

SEQ ID NO: 114166 - protein, 18 aa, Mycobacterium avium
EGARPPWSIGEPQPEIAA

SEQ ID NO: 114167 - protein, 17 aa, Mycobacterium avium
EGAVALGWIASRWPGLL

SEQ ID NO: 114168 - protein, 31 aa, Mycobacterium avium
EGGEGPVVGIWRRAPLQALARLHMLAAADQV

SEQ ID NO: 114169 - protein, 26 aa, Mycobacterium avium
EGGKRPVMLLTSDSAFLFHIAELETA

SEQ ID NO: 114170 - protein, 25 aa, Mycobacterium avium
EGGMHSLWTDILARQVFAPQVPRDY

SEQ ID NO: 114171 - protein, 27 aa, Mycobacterium avium
EGGQMPIHMRLPKLKGFRNRFRTEYEI

SEQ ID NO: 114172 - protein, 24 aa, Mycobacterium avium
EGHKWAMLTAYDYSTARIFDEAGI

SEQ ID NO: 114173 - protein, 26 aa, Mycobacterium avium
EGLATVIPFHRAVVRDPAFIGDDNGF

SEQ ID NO: 114174 - protein, 25 aa, Mycobacterium avium
EGLIEKLPRMLGTQAAGAAPLVHGE

SEQ ID NO: 114175 - protein, 20 aa, Mycobacterium avium
EGLLPYLPPEAQDRLFDNIT

SEQ ID NO: 114176 - protein, 25 aa, Mycobacterium avium
EGLRKLFRQFSFPGGIPSHVAAQTP

SEQ ID NO: 114177 - protein, 26 aa, Mycobacterium avium
EGNDIVLVDFWASWCGPCRQFGPTFQ

SEQ ID NO: 114178 - protein, 23 aa, Mycobacterium avium
EGNLGLIRAVEKFDYTKGYKFST

SEQ ID NO: 114179 - protein, 18 aa, Mycobacterium avium
EGQRRYVESLSAYARQFL

SEQ ID NO: 114180 - protein, 24 aa, Mycobacterium avium
EGQRVLVDRIWPRGVRKDDPRVGI

SEQ ID NO: 114181 - protein, 20 aa, Mycobacterium avium
EGRGIVMRVPLEGGGRLVVE

SEQ ID NO: 114182 - protein, 32 aa, Mycobacterium avium
EGRINPDVKMNYLASPPLVVAYALAGTMDFDF

SEQ ID NO: 114183 - protein, 27 aa, Mycobacterium avium
EGTFVKFHWKPRLGVHSLIWDECQKIA

SEQ ID NO: 114184 - protein, 23 aa, Mycobacterium avium
EGTPPFRTMAKPVLTAVNGICCG

SEQ ID NO: 114185 - protein, 28 aa, Mycobacterium avium
EGTWPHTRDWLRRSFWDIPVEETRQMLG

SEQ ID NO: 114186 - protein, 17 aa, Mycobacterium avium
EGVDWLLAQPEKPDLVF

SEQ ID NO: 114187 - protein, 18 aa, Mycobacterium avium
EGVKGKVKEVAGAVAGRD

SEQ ID NO: 114188 - protein, 27 aa, Mycobacterium avium
EGVPGPDRVPLLALLRSTPLTEEQIAE

SEQ ID NO: 114189 - protein, 21 aa, Mycobacterium avium
EGVRCNVIVPAALTRMADGID

SEQ ID NO: 114190 - protein, 20 aa, Mycobacterium avium
EGWRRYVALVVDAISVDERR

SEQ ID NO: 114191 - protein, 21 aa, Mycobacterium avium
EGYDMFMAMLDGMKEESVGFL

SEQ ID NO: 114192 - protein, 17 aa, Mycobacterium avium
EHAAALEQLGIAAFELV

SEQ ID NO: 114193 - protein, 28 aa, Mycobacterium avium
EHEGKPFFASLLEFITSGPVVAAIVEGP

SEQ ID NO: 114194 - protein, 30 aa, Mycobacterium avium
EHELKVIAQLQFPGYFLVVHDIARFCRENN

SEQ ID NO: 114195 - protein, 24 aa, Mycobacterium avium
EHGRSWSRWSFIGAGSPSALTVRD

SEQ ID NO: 114196 - protein, 27 aa, Mycobacterium avium
EHGVGRLKRPWLAGYLGPEVMDLNRRI

SEQ ID NO: 114197 - protein, 36 aa, Mycobacterium avium
EHHAWSADPWTTLPARYGLPLPGRPAPLHPNAAGMR

SEQ ID NO: 114198 - protein, 27 aa, Mycobacterium avium
EHIDRLVPGDIIWAPAIDGAFVLTTRG

SEQ ID NO: 114199 - protein, 19 aa, Mycobacterium avium
EHLQGWFHLADVPADIVAA

SEQ ID NO: 114200 - protein, 24 aa, Mycobacterium avium
EHPDLRCLMLTSFTSDEAMLEAIL

SEQ ID NO: 114201 - protein, 26 aa, Mycobacterium avium
EIAEGWQPIFYLPEKARDVWGESLAA

SEQ ID NO: 114202 - protein, 21 aa, Mycobacterium avium
EICRQVWRREPVQHRGKHYTI

SEQ ID NO: 114203 - protein, 24 aa, Mycobacterium avium
EIDEFAMPVAPWMFGAAGREHMRQ

SEQ ID NO: 114204 - protein, 17 aa, Mycobacterium avium
EIDVRFGLGWGAVTVLD

SEQ ID NO: 114205 - protein, 23 aa, Mycobacterium avium
EIEALYYLHPLTGDVIRQVDSLR

SEQ ID NO: 114206 - protein, 17 aa, Mycobacterium avium
EIEFFMRYLTWGLRGVT

SEQ ID NO: 114207 - protein, 23 aa, Mycobacterium avium
EIFARYDVTFSLGDGLRPGSIAD

SEQ ID NO: 114208 - protein, 17 aa, Mycobacterium avium
EIFTKFSIPINIARVIH

SEQ ID NO: 114209 - protein, 25 aa, Mycobacterium avium
EIGRSLAPVPWIDQVCTARLLARLG

SEQ ID NO: 114210 - protein, 17 aa, Mycobacterium avium
EILALRAAAAALGDGWR

SEQ ID NO: 114211 - protein, 21 aa, Mycobacterium avium
EINEAFAPVVLAWLKEIKADP

SEQ ID NO: 114212 - protein, 24 aa, Mycobacterium avium
EINTRGDIILFIDELHTLVGAGAA

SEQ ID NO: 114213 - protein, 18 aa, Mycobacterium avium
EIPRPPLTSIDLADALVG

SEQ ID NO: 114214 - protein, 22 aa, Mycobacterium avium
EIVTWMSVAPALRDGWEDSILQ

SEQ ID NO: 114215 - protein, 24 aa, Mycobacterium avium
EKEQTILVFDLGGGTFDVSLLEIG

SEQ ID NO: 114216 - protein, 36 aa, Mycobacterium avium
EKFDYTKGYKFSTYATWWIRQAITRAMADQARTIRI

SEQ ID NO: 114217 - protein, 25 aa, Mycobacterium avium
EKGWGNTVLPLPDGTWKDALTGSVV

SEQ ID NO: 114218 - protein, 20 aa, Mycobacterium avium
EKIMLLFESGNFDESVFDDP

SEQ ID NO: 114219 - protein, 24 aa, Mycobacterium avium
EKLDDVVFPLFPQGGGFPRNNDDK

SEQ ID NO: 114220 - protein, 30 aa, Mycobacterium avium
EKLSDEAIYSFLRLLLPAGLETTYRSSGNL

SEQ ID NO: 114221 - protein, 24 aa, Mycobacterium avium
EKRFPQLTVLSIAPLLASTIRAVF

SEQ ID NO: 114222 - protein, 24 aa, Mycobacterium avium
EKVRRKPFSVVLFDEIEKAHQEIY

SEQ ID NO: 114223 - protein, 25 aa, Mycobacterium avium
ELADAIGRPLLWTTSALLGQHPIPA

SEQ ID NO: 114224 - protein, 17 aa, Mycobacterium avium
ELAFPNAVLALFHYPDK

SEQ ID NO: 114225 - protein, 21 aa, Mycobacterium avium
ELAGFLEELPVDASALEAKLA

SEQ ID NO: 114226 - protein, 17 aa, Mycobacterium avium
ELALRLRGQPRAGRRAA

SEQ ID NO: 114227 - protein, 18 aa, Mycobacterium avium
ELALRPLIDHYTDLRRDE

SEQ ID NO: 114228 - protein, 32 aa, Mycobacterium avium
ELARQGQLLRLWRAPSPPGRWRTLGLFAAADD

SEQ ID NO: 114229 - protein, 25 aa, Mycobacterium avium
ELASGVLPLYIRTPSLLAMTAAGLD

SEQ ID NO: 114230 - protein, 25 aa, Mycobacterium avium
ELATALNDLILFKGRRVLSAVLAQA

SEQ ID NO: 114231 - protein, 19 aa, Mycobacterium avium
ELAWTLLTGSVEQGGYGLD

SEQ ID NO: 114232 - protein, 25 aa, Mycobacterium avium
ELDELGFPALWIPDVGGPVFDAVGH

SEQ ID NO: 114233 - protein, 35 aa, Mycobacterium avium
ELDGETHTVSWPRNAKLLDVLLAKGLDAPFSCREG

SEQ ID NO: 114234 - protein, 17 aa, Mycobacterium avium
ELDLFSFPDEIGSGLAV

SEQ ID NO: 114235 - protein, 24 aa, Mycobacterium avium
ELDVSLLSTAWWAAGASVTQGMET

SEQ ID NO: 114236 - protein, 24 aa, Mycobacterium avium
ELELKRLFVLTFETEFFGKHGFTE

SEQ ID NO: 114237 - protein, 21 aa, Mycobacterium avium
ELFNLRFQMATGQLTNNRRLR

SEQ ID NO: 114238 - protein, 23 aa, Mycobacterium avium
ELFSAVDLVPTLLGLLGISVPPD

SEQ ID NO: 114239 - protein, 18 aa, Mycobacterium avium
ELFTALLLSLPGSPVLYY

SEQ ID NO: 114240 - protein, 22 aa, Mycobacterium avium
ELGHPWTVLRATADTDYLVLEM

SEQ ID NO: 114241 - protein, 29 aa, Mycobacterium avium
ELGRALVPSPLLGTTLAELALLGAAEPDT

SEQ ID NO: 114242 - protein, 24 aa, Mycobacterium avium
ELGRRIVSWQAARGADWALAADYR

SEQ ID NO: 114243 - protein, 21 aa, Mycobacterium avium
ELGSLNQRLARLCDRVVLVVA

SEQ ID NO: 114244 - protein, 24 aa, Mycobacterium avium
ELGWERNIAALAARYRVLAPDQLG

SEQ ID NO: 114245 - protein, 21 aa, Mycobacterium avium
ELHPDPVLPSLSLLAHTVRTA

SEQ ID NO: 114246 - protein, 26 aa, Mycobacterium avium
ELIRVRILPTWLRLDARFGSVYRRRG

SEQ ID NO: 114247 - protein, 21 aa, Mycobacterium avium
ELKKHFRPEFLNRIDDIIVFH

SEQ ID NO: 114248 - protein, 24 aa, Mycobacterium avium
ELKRRGFRFVGPTTAYALMQATGM

SEQ ID NO: 114249 - protein, 27 aa, Mycobacterium avium
ELLAVELSSFQLHWAPSLRPEGGAVLN

SEQ ID NO: 114250 - protein, 22 aa, Mycobacterium avium
ELLEWEILRDICDADAMASLER

SEQ ID NO: 114251 - protein, 19 aa, Mycobacterium avium
ELMKLRMLNAGHQCLAYFA

SEQ ID NO: 114252 - protein, 18 aa, Mycobacterium avium
ELMPHAFVIDCDAVGCAC

SEQ ID NO: 114253 - protein, 24 aa, Mycobacterium avium
ELMRRLRTSPPETLAGFGVALTDI

SEQ ID NO: 114254 - protein, 24 aa, Mycobacterium avium
ELNRFVFAMPEQLGRVYLGLTDEA

SEQ ID NO: 114255 - protein, 19 aa, Mycobacterium avium
ELPALRRVLHIDGSGPKAL

SEQ ID NO: 114256 - protein, 24 aa, Mycobacterium avium
ELPKRRPVPLRLRDWREVYEEFDH

SEQ ID NO: 114257 - protein, 23 aa, Mycobacterium avium
ELPMQMICILLGVPESERHWLFQ

SEQ ID NO: 114258 - protein, 25 aa, Mycobacterium avium
ELPTRYLGLVTAVEYGRRARLAVEA

SEQ ID NO: 114259 - protein, 17 aa, Mycobacterium avium
ELPTWQWEGLIGKSTRL

SEQ ID NO: 114260 - protein, 26 aa, Mycobacterium avium
ELRSKPGDWYVIHSYAGYENKVKANL

SEQ ID NO: 114261 - protein, 25 aa, Mycobacterium avium
ELRYRGLRAPHKIKMGVSGCARECA

SEQ ID NO: 114262 - protein, 19 aa, Mycobacterium avium
ELRYRQMRNFWATLMVSQG

SEQ ID NO: 114263 - protein, 32 aa, Mycobacterium avium
ELSGAIRLIHPRETLWRPPVLTMSAAQGTGLP

SEQ ID NO: 114264 - protein, 33 aa, Mycobacterium avium
ELSNVANLPITLWPGMKIGQLCILRLTSPAEHP

SEQ ID NO: 114265 - protein, 21 aa, Mycobacterium avium
ELSVRVIPKQADEFTCSSCFL

SEQ ID NO: 114266 - protein, 24 aa, Mycobacterium avium
ELTKGAMYFHFKSKHALAVAIIES

SEQ ID NO: 114267 - protein, 17 aa, Mycobacterium avium
ELVEHLTALCWDGGAAL

SEQ ID NO: 114268 - protein, 29 aa, Mycobacterium avium
ELVERLRLTIPELPWLSRKRIQQEWGVSD

SEQ ID NO: 114269 - protein, 24 aa, Mycobacterium avium
ELVKALLFSLFEGGLRHGLFHGDL

SEQ ID NO: 114270 - protein, 29 aa, Mycobacterium avium
ELVKVTPMDFLRDTLLWAKLIDKYKGTMT

SEQ ID NO: 114271 - protein, 20 aa, Mycobacterium avium
ELVLVKEIPLYSTCEHHLVS

SEQ ID NO: 114272 - protein, 38 aa, Mycobacterium avium
ELVSFTFGVPPPDVIRRLGALGLLVMVTVTSAYEAGVA

SEQ ID NO: 114273 - protein, 18 aa, Mycobacterium avium
ELVVLTKFDPAEVLRVIE

SEQ ID NO: 114274 - protein, 25 aa, Mycobacterium avium
ELYGKPQFWPLWEAAADANLPVAVH

SEQ ID NO: 114275 - protein, 18 aa, Mycobacterium avium
EMGIRVRYLHSEVDTLRR

SEQ ID NO: 114276 - protein, 17 aa, Mycobacterium avium
EMIDINLAGVWKTVKAG

SEQ ID NO: 114277 - protein, 21 aa, Mycobacterium avium
EMLMPCFAQLYQDLGITKADI

SEQ ID NO: 114278 - protein, 19 aa, Mycobacterium avium
EMNEAFAAIAIKIQQYFGI

SEQ ID NO: 114279 - protein, 25 aa, Mycobacterium avium
EMNLGQLALLLRGKYLVDVQSVSKV

SEQ ID NO: 114280 - protein, 21 aa, Mycobacterium avium
EMYKYLVAVSREPELDKIRAY

SEQ ID NO: 114281 - protein, 26 aa, Mycobacterium avium
ENHEGVYRFLLKRNRRLYGVAYTLDN

SEQ ID NO: 114282 - protein, 37 aa, Mycobacterium avium
ENLRQLHAFLSDTVLMTGFGFAPPVMTPTWGEPARPN

SEQ ID NO: 114283 - protein, 33 aa, Mycobacterium avium
ENPSFSVVAPLLSRSLILQLRPLSADDIRTVVR

SEQ ID NO: 114284 - protein, 17 aa, Mycobacterium avium
ENQGWQLITTQLNFERA

SEQ ID NO: 114285 - protein, 25 aa, Mycobacterium avium
ENQPGFLGFQLLRPVQGEDRYFVVT

SEQ ID NO: 114286 - protein, 23 aa, Mycobacterium avium
ENVPEIWRRLDAVGLRTTEACGD

SEQ ID NO: 114287 - protein, 28 aa, Mycobacterium avium
ENVPGLRALVRLAIYWGQEALAFGMTKR

SEQ ID NO: 114288 - protein, 36 aa, Mycobacterium avium
EPASIKDRWLLRNRPHLVLDGLRLAAAVVGAERGYV

SEQ ID NO: 114289 - protein, 26 aa, Mycobacterium avium
EPAWAYSVLALRWAAKYYAAEREFAL

SEQ ID NO: 114290 - protein, 33 aa, Mycobacterium avium
EPDLKWERFITAVRLLAERLGVRQTIGLGTVPM

SEQ ID NO: 114291 - protein, 32 aa, Mycobacterium avium
EPDPELLNLELPFPCVWVTGWSREGGRAAALA

SEQ ID NO: 114292 - protein, 31 aa, Mycobacterium avium
EPEAPGFVHVPWDAVDTWWEEGRKLVHYPPN

SEQ ID NO: 114293 - protein, 21 aa, Mycobacterium avium
EPFGIVMIEAMVCGTPVVALR

SEQ ID NO: 114294 - protein, 20 aa, Mycobacterium avium
EPFPAEQPLFLLYTSGTTGK

SEQ ID NO: 114295 - protein, 26 aa, Mycobacterium avium
EPGAYICVYPFVRSYEWYLLPDEERR

SEQ ID NO: 114296 - protein, 19 aa, Mycobacterium avium
EPGLDDKMLFLLATAKLNQ

SEQ ID NO: 114297 - protein, 26 aa, Mycobacterium avium
EPGNSLFINVNCWGRLVTGVGAALGK

SEQ ID NO: 114298 - protein, 18 aa, Mycobacterium avium
EPGRLRIALSTKVPTPLP

SEQ ID NO: 114299 - protein, 20 aa, Mycobacterium avium
EPIDISNAVLFFASDEARYI

SEQ ID NO: 114300 - protein, 29 aa, Mycobacterium avium
EPIGIVRFYADLLRSYPFTEDLGEKESRG

SEQ ID NO: 114301 - protein, 25 aa, Mycobacterium avium
EPINPEAWRWYRSVIGADRLPIVDT

SEQ ID NO: 114302 - protein, 18 aa, Mycobacterium avium
EPLYILGAGMHPWGKWGN

SEQ ID NO: 114303 - protein, 19 aa, Mycobacterium avium
EPVDISNAVLFLASDESRY

SEQ ID NO: 114304 - protein, 26 aa, Mycobacterium avium
EQAGPDALVVVLLPDGGRGYMAKIFN

SEQ ID NO: 114305 - protein, 26 aa, Mycobacterium avium
EQARRLKVPPERWVYPLAGTDAHDTA

SEQ ID NO: 114306 - protein, 25 aa, Mycobacterium avium
EQARRLVIRGFFAEIISKIAVPEIR

SEQ ID NO: 114307 - protein, 25 aa, Mycobacterium avium
EQDLRGLLGAFMFSGPQLDQPAGTL

SEQ ID NO: 114308 - protein, 27 aa, Mycobacterium avium
EQGFNDLLLPLRYGQVSLREKMPRRFY

SEQ ID NO: 114309 - protein, 24 aa, Mycobacterium avium
EQIMPGFLAFHPMGALVGQECVRI

SEQ ID NO: 114310 - protein, 23 aa, Mycobacterium avium
EQKKYFLPKIAAGELHFSIGYSE

SEQ ID NO: 114311 - protein, 22 aa, Mycobacterium avium
EQKQRFLPRMAVGETRGAFSMS

SEQ ID NO: 114312 - protein, 23 aa, Mycobacterium avium
EQKRPGYILLSTDVARFPTEPPE

SEQ ID NO: 114313 - protein, 17 aa, Mycobacterium avium
EQKSIIFMDPPEHRHMR

SEQ ID NO: 114314 - protein, 30 aa, Mycobacterium avium
EQLHGELASLLRFVLELLGDYGLTDFYLEL

SEQ ID NO: 114315 - protein, 35 aa, Mycobacterium avium
EQNRPTLMLLDGNSLAFRAFYALPAENFKTRGGLT

SEQ ID NO: 114316 - protein, 20 aa, Mycobacterium avium
EQPLFLLYTSGTTGKPKGIV

SEQ ID NO: 114317 - protein, 28 aa, Mycobacterium avium
EQQKEFADLLAWLKDTLSDHVKEVRLSN

SEQ ID NO: 114318 - protein, 23 aa, Mycobacterium avium
EQRDRILIITINRPKAKNAVNAA

SEQ ID NO: 114319 - protein, 32 aa, Mycobacterium avium
EQSKNPVLQLFIKVLMRLTTRYALQSRTDSET

SEQ ID NO: 114320 - protein, 28 aa, Mycobacterium avium
ERARQLERLITEPLLRLQARDDRIGDVR

SEQ ID NO: 114321 - protein, 17 aa, Mycobacterium avium
ERDKLWRKVWQQVGRVE

SEQ ID NO: 114322 - protein, 23 aa, Mycobacterium avium
EREPYGVVAVIAPWNGPLVVAGA

SEQ ID NO: 114323 - protein, 25 aa, Mycobacterium avium
EREYRTRLKTYLESQLEELGQRGSA

SEQ ID NO: 114324 - protein, 18 aa, Mycobacterium avium
ERFDVNVIGLTLSKNQHA

SEQ ID NO: 114325 - protein, 25 aa, Mycobacterium avium
ERGDILLIRTGWWTRYLETGNKTEP

SEQ ID NO: 114326 - protein, 21 aa, Mycobacterium avium
ERGITIKAQNVRLPWQVSGGE

SEQ ID NO: 114327 - protein, 24 aa, Mycobacterium avium
ERHWPALCRAVGRPEWRDDPRFAD

SEQ ID NO: 114328 - protein, 26 aa, Mycobacterium avium
ERIARAWETLMLRLGYQRYGAQGGDW

SEQ ID NO: 114329 - protein, 17 aa, Mycobacterium avium
ERIARLDSQLRCYRVVL

SEQ ID NO: 114330 - protein, 28 aa, Mycobacterium avium
ERLETICRHIMLYHLDRGWADHLAYLAD

SEQ ID NO: 114331 - protein, 31 aa, Mycobacterium avium
ERLGIPTIATVPWTTDRLLNALLRETQTAKW

SEQ ID NO: 114332 - protein, 31 aa, Mycobacterium avium
ERLGLDYVDLYLIHWPAPALGTYVNSFGGMI

SEQ ID NO: 114333 - protein, 20 aa, Mycobacterium avium
ERLLAVLREGALDAALIALP

SEQ ID NO: 114334 - protein, 24 aa, Mycobacterium avium
ERMRHGMYWSGDLAYRDADGWIYL

SEQ ID NO: 114335 - protein, 19 aa, Mycobacterium avium
ERPFFAEPLRRHDIAPITD

SEQ ID NO: 114336 - protein, 29 aa, Mycobacterium avium
ERQEAVLEDPFILLVSSKVSTVKDLLPLL

SEQ ID NO: 114337 - protein, 25 aa, Mycobacterium avium
ERQVDRWLAFLDAYRVRELPGLDEA

SEQ ID NO: 114338 - protein, 19 aa, Mycobacterium avium
ERTLAWRSLFRQRLGVAVP

SEQ ID NO: 114339 - protein, 29 aa, Mycobacterium avium
ERVSARVYPALVPLSHPLATVNGAFNAVV

SEQ ID NO: 114340 - protein, 17 aa, Mycobacterium avium
ERWVPVERVGLYVPGGN

SEQ ID NO: 114341 - protein, 17 aa, Mycobacterium avium
ERYRWRHGAAVSVGLVF

SEQ ID NO: 114342 - protein, 30 aa, Mycobacterium avium
ESAAAGLRPLRPWRPALVAALTNAGSPAAA

SEQ ID NO: 114343 - protein, 23 aa, Mycobacterium avium
ESAAPLLVYAHGGAFVTGNLATD

SEQ ID NO: 114344 - protein, 25 aa, Mycobacterium avium
ESAEFLAELFDLPGPKPFGHFMVVE

SEQ ID NO: 114345 - protein, 28 aa, Mycobacterium avium
ESAQRLHYALADLPLPAPITVVGGGLTG

SEQ ID NO: 114346 - protein, 26 aa, Mycobacterium avium
ESAQTLLENLFFKEKRYDLARVGRYK

SEQ ID NO: 114347 - protein, 27 aa, Mycobacterium avium
ESCDTLIVIPNDRLLQMGDAAVSLMDA

SEQ ID NO: 114348 - protein, 19 aa, Mycobacterium avium
ESFKVLLKELQSLCLNVEV

SEQ ID NO: 114349 - protein, 40 aa, Mycobacterium avium
ESIADLRAIPWVLAWSQSRVMLPGWYGTGSAFEQWIAAGP

SEQ ID NO: 114350 - protein, 18 aa, Mycobacterium avium
ESIAVAPVLLAGDEHAER

SEQ ID NO: 114351 - protein, 25 aa, Mycobacterium avium
ESIRELQFYRRTAFVAPPGPSTSEI

SEQ ID NO: 114352 - protein, 24 aa, Mycobacterium avium
ESKDELFLALLDREFELRGQQIAI

SEQ ID NO: 114353 - protein, 18 aa, Mycobacterium avium
ESLPKLNSFVLPGGSPLS

SEQ ID NO: 114354 - protein, 17 aa, Mycobacterium avium
ESLRQLIAVDNAWVPAA

SEQ ID NO: 114355 - protein, 22 aa, Mycobacterium avium
ESMAMWPGAAVSGWYFSHPQSQ

SEQ ID NO: 114356 - protein, 17 aa, Mycobacterium avium
ESMTFPDPVIEVAIEPK

SEQ ID NO: 114357 - protein, 26 aa, Mycobacterium avium
ESNAPVLLGLIGLWYSNFMGAQSRAV

SEQ ID NO: 114358 - protein, 23 aa, Mycobacterium avium
ESPWALMHFMVRLPTDDPAAKPV

SEQ ID NO: 114359 - protein, 26 aa, Mycobacterium avium
ESQQAVRFGLFHLLQASARAERRAIA

SEQ ID NO: 114360 - protein, 17 aa, Mycobacterium avium
ESRVPLGDALRTALLAF

SEQ ID NO: 114361 - protein, 25 aa, Mycobacterium avium
ESTWSTFMATYWQLGNTPHVPLVLV

SEQ ID NO: 114362 - protein, 20 aa, Mycobacterium avium
ESYLDLVRDFATHAAIALVL

SEQ ID NO: 114363 - protein, 17 aa, Mycobacterium avium
ETALNRDFRRFQAGTHP

SEQ ID NO: 114364 - protein, 27 aa, Mycobacterium avium
ETAWRDGAWYTARLCPAPLLPEERHTA

SEQ ID NO: 114365 - protein, 21 aa, Mycobacterium avium
ETAYAWRTILARGNGSGPVGL

SEQ ID NO: 114366 - protein, 23 aa, Mycobacterium avium
ETDKPFLMPVEDVFTITGRGTVV

SEQ ID NO: 114367 - protein, 25 aa, Mycobacterium avium
ETDTALWQRMFATSVLGPVALTQAL

SEQ ID NO: 114368 - protein, 19 aa, Mycobacterium avium
ETERAMGFCLFNNISIGAR

SEQ ID NO: 114369 - protein, 21 aa, Mycobacterium avium
ETFGVKRVVARIYDAKRAEVY

SEQ ID NO: 114370 - protein, 23 aa, Mycobacterium avium
ETGDIWRMPIVRDEPIRDWVKLA

SEQ ID NO: 114371 - protein, 21 aa, Mycobacterium avium
ETGEWLASRSGLRYRFHSYRR

SEQ ID NO: 114372 - protein, 18 aa, Mycobacterium avium
ETGPAPFRHIPPARQAPA

SEQ ID NO: 114373 - protein, 26 aa, Mycobacterium avium
ETGRLRLDRYLYTAMAYPTDYGFIED

SEQ ID NO: 114374 - protein, 27 aa, Mycobacterium avium
ETHPLWIVRRTMLDLIRPIEFNDMLRL

SEQ ID NO: 114375 - protein, 24 aa, Mycobacterium avium
ETKLLALLHRFGIAAPASADRSRA

SEQ ID NO: 114376 - protein, 27 aa, Mycobacterium avium
ETLFEQRGRRWPVIISGTITDASGRTL

SEQ ID NO: 114377 - protein, 20 aa, Mycobacterium avium
ETLVRLRPTFGAVNLEDISA

SEQ ID NO: 114378 - protein, 26 aa, Mycobacterium avium
ETNPQLSHVLTPFLPDWVAEPEDIAD

SEQ ID NO: 114379 - protein, 22 aa, Mycobacterium avium
ETQAPLLVFYHGGGWSIGDLDT

SEQ ID NO: 114380 - protein, 31 aa, Mycobacterium avium
ETQAVLALLESPLGQLLYAAGSGTLADFGEL

SEQ ID NO: 114381 - protein, 24 aa, Mycobacterium avium
ETRDALLASLRRGLSSRQAAAEPV

SEQ ID NO: 114382 - protein, 17 aa, Mycobacterium avium
ETRIVVTGNYRAWRHFI

SEQ ID NO: 114383 - protein, 17 aa, Mycobacterium avium
ETRRLFAGGGFGGRRFD

SEQ ID NO: 114384 - protein, 28 aa, Mycobacterium avium
ETTKRYMHHYNFPPFSTGETGRVGSPKR

SEQ ID NO: 114385 - protein, 25 aa, Mycobacterium avium
ETTPFSLENGLLTGIRKLAWPKLKQ

SEQ ID NO: 114386 - protein, 20 aa, Mycobacterium avium
ETVLPKVRPIVQAVAERGAD

SEQ ID NO: 114387 - protein, 32 aa, Mycobacterium avium
ETVPPPVIAANRALLLQLLATNFLGQNTPAIA

SEQ ID NO: 114388 - protein, 37 aa, Mycobacterium avium
ETWHPLGVVGVITAFNFPVAVWAWNAALALVCGDTVV

SEQ ID NO: 114389 - protein, 23 aa, Mycobacterium avium
ETYGIDMALLQRVQRAIGLVRVD

SEQ ID NO: 114390 - protein, 24 aa, Mycobacterium avium
EVADLPLHPGFAASWHRLRTEPAR

SEQ ID NO: 114391 - protein, 25 aa, Mycobacterium avium
EVAPFSSYIFAEILAAAGVPAGVFN

SEQ ID NO: 114392 - protein, 18 aa, Mycobacterium avium
EVDGGLQPLPAPRFSRTA

SEQ ID NO: 114393 - protein, 25 aa, Mycobacterium avium
EVDRVGWFPVAAARTKLLKSQHGFL

SEQ ID NO: 114394 - protein, 23 aa, Mycobacterium avium
EVEALQLEYNWIKEFDPRFNVRY

SEQ ID NO: 114395 - protein, 18 aa, Mycobacterium avium
EVEALWWQERRRQWQIHS

SEQ ID NO: 114396 - protein, 17 aa, Mycobacterium avium
EVELAKRIEAGLYATQL

SEQ ID NO: 114397 - protein, 27 aa, Mycobacterium avium
EVGPRATFLLMQAVHPLLVKEGGGAIV

SEQ ID NO: 114398 - protein, 24 aa, Mycobacterium avium
EVGPTLHRLIRGAEGRVIVACFAS

SEQ ID NO: 114399 - protein, 25 aa, Mycobacterium avium
EVLHPPRLWPEYHPGYFGAFVRDPD

SEQ ID NO: 114400 - protein, 26 aa, Mycobacterium avium
EVLPEKPELVLLDNFPVWQTQMAVQR

SEQ ID NO: 114401 - protein, 24 aa, Mycobacterium avium
EVLRVVRHWIDHGVKFFRVDNPHT

SEQ ID NO: 114402 - protein, 26 aa, Mycobacterium avium
EVQRPVWPMIVLRTPKGWTGPKVVDG

SEQ ID NO: 114403 - protein, 23 aa, Mycobacterium avium
EVRPDRSTTLALRWLVSFSRQRR

SEQ ID NO: 114404 - protein, 25 aa, Mycobacterium avium
EVRSEFLNQLQKGAIRKGVVSSIVN

SEQ ID NO: 114405 - protein, 24 aa, Mycobacterium avium
EVSGPLLRRKFRLGSAAMDPLQKA

SEQ ID NO: 114406 - protein, 21 aa, Mycobacterium avium
EVTAFSRPATWWARAGGPVLR

SEQ ID NO: 114407 - protein, 26 aa, Mycobacterium avium
EVTLNGRVLPIGGVKQKLLAAQRAGL

SEQ ID NO: 114408 - protein, 30 aa, Mycobacterium avium
EVVASATGDFRFFAAPGSWTLRALSAAGNG

SEQ ID NO: 114409 - protein, 26 aa, Mycobacterium avium
EVVKGGLILDIGLRGFLPASLVEMRR

SEQ ID NO: 114410 - protein, 18 aa, Mycobacterium avium
EVVTDMWGRPRVRLSGDI

SEQ ID NO: 114411 - protein, 20 aa, Mycobacterium avium
EWIIAAFGLLTAGGVLVPVN

SEQ ID NO: 114412 - protein, 27 aa, Mycobacterium avium
EWKDGEALFLRCNIWREAAENVAESLT

SEQ ID NO: 114413 - protein, 24 aa, Mycobacterium avium
EWPENPRFLMCTPLSHAGAAFFVP

SEQ ID NO: 114414 - protein, 19 aa, Mycobacterium avium
EYATGYRWDIVLAGGGRTP

SEQ ID NO: 114415 - protein, 35 aa, Mycobacterium avium
EYEPYGTVLIIGAWNYPFYLTLGPAVGAIAAGNAV

SEQ ID NO: 114416 - protein, 17 aa, Mycobacterium avium
EYFSLRGLALLTDTVDK

SEQ ID NO: 114417 - protein, 19 aa, Mycobacterium avium
EYHHEGLIEKLPRMLGTQA

SEQ ID NO: 114418 - protein, 20 aa, Mycobacterium avium
EYLDYLRRVLTELPGHRLEV

SEQ ID NO: 114419 - protein, 19 aa, Mycobacterium avium
EYPVARAYLDARVQTIYGG

SEQ ID NO: 114420 - protein, 26 aa, Mycobacterium avium
FAAARTLLGWGQFGTGLNLANIQAAK

SEQ ID NO: 114421 - protein, 18 aa, Mycobacterium avium
FAALSLDPPLVLFCPTKV

SEQ ID NO: 114422 - protein, 20 aa, Mycobacterium avium
FAAPVWMPRARRDSIREVQE

SEQ ID NO: 114423 - protein, 21 aa, Mycobacterium avium
FAASLRALLAAENPLHLVRAL

SEQ ID NO: 114424 - protein, 26 aa, Mycobacterium avium
FAASVLAVLRRLDGHFTLVFANADEP

SEQ ID NO: 114425 - protein, 19 aa, Mycobacterium avium
FAAVGRLLQRHAGPIFPLI

SEQ ID NO: 114426 - protein, 18 aa, Mycobacterium avium
FAAVRQFRASVCVLGPLV

SEQ ID NO: 114427 - protein, 17 aa, Mycobacterium avium
FACQSFAALSLDPPLVL

SEQ ID NO: 114428 - protein, 23 aa, Mycobacterium avium
FAEFGGWLMPVSYAGTVSEHNAT

SEQ ID NO: 114429 - protein, 24 aa, Mycobacterium avium
FAEVNLAGFYDLAQTLGGVEVCLN

SEQ ID NO: 114430 - protein, 21 aa, Mycobacterium avium
FAGNPWAAPTGWRAGGSPAPV

SEQ ID NO: 114431 - protein, 28 aa, Mycobacterium avium
FAGVAKYPARVKCALLGWMACKDALAQA

SEQ ID NO: 114432 - protein, 20 aa, Mycobacterium avium
FALTGLLLDHLLGVRDSRVV

SEQ ID NO: 114433 - protein, 28 aa, Mycobacterium avium
FAPTAEAYLGLLRFLLGLDLVDRVQFWM

SEQ ID NO: 114434 - protein, 22 aa, Mycobacterium avium
FAQALRLALIDAAPDVAQDPVV

SEQ ID NO: 114435 - protein, 25 aa, Mycobacterium avium
FAQAVIDAGLIWIGPSPQSIRDLGD

SEQ ID NO: 114436 - protein, 25 aa, Mycobacterium avium
FAQSPTVLFLGRHVGYPVALEGALK

SEQ ID NO: 114437 - protein, 27 aa, Mycobacterium avium
FATIGMSYLGFTQWALLQDPPPDMATA

SEQ ID NO: 114438 - protein, 23 aa, Mycobacterium avium
FATRYLINDAAVLAGKPYVWGSI

SEQ ID NO: 114439 - protein, 23 aa, Mycobacterium avium
FATTPRMSTYLVALIAGPYAEWK

SEQ ID NO: 114440 - protein, 20 aa, Mycobacterium avium
FAVVEFVVSPLFGSPPEAGL

SEQ ID NO: 114441 - protein, 35 aa, Mycobacterium avium
FAVWVYETHWWAHRALWHLIFSGALDRHPDLTVVF

SEQ ID NO: 114442 - protein, 30 aa, Mycobacterium avium
FDAFKKERWPAFWDWAYKSLPNDSRMLMHS

SEQ ID NO: 114443 - protein, 20 aa, Mycobacterium avium
FDFHVGLAQLAGNAPLDLFL

SEQ ID NO: 114444 - protein, 29 aa, Mycobacterium avium
FDGTVEAYLHRRAADLPPAVGVLVEYQGS

SEQ ID NO: 114445 - protein, 19 aa, Mycobacterium avium
FDGWAKWVTPGGALAIHDV

SEQ ID NO: 114446 - protein, 18 aa, Mycobacterium avium
FDITLEEALKIYAEPKRR

SEQ ID NO: 114447 - protein, 23 aa, Mycobacterium avium
FDLAKWQKVIDVNLTGTFLGMRV

SEQ ID NO: 114448 - protein, 25 aa, Mycobacterium avium
FDQEGPTILMQILHQPMLDSDATPS

SEQ ID NO: 114449 - protein, 19 aa, Mycobacterium avium
FDQITRLPEYYPTRAEAEI

SEQ ID NO: 114450 - protein, 36 aa, Mycobacterium avium
FDRFPTLRIVFVEHAFTWILPLMWRMDAIYEARKSR

SEQ ID NO: 114451 - protein, 17 aa, Mycobacterium avium
FDSMRTLAPPMGRGWEA

SEQ ID NO: 114452 - protein, 17 aa, Mycobacterium avium
FDVGFLRAAAQQCDIAW

SEQ ID NO: 114453 - protein, 29 aa, Mycobacterium avium
FDVHLGGPALFGPIGMIVAAALRGDIDQS

SEQ ID NO: 114454 - protein, 19 aa, Mycobacterium avium
FDVQRMAALAPAGYTLATD

SEQ ID NO: 114455 - protein, 24 aa, Mycobacterium avium
FDVRHTVFPVARWQYDIVGTDGGC

SEQ ID NO: 114456 - protein, 25 aa, Mycobacterium avium
FEGQHDVFFPLLIAAEATGCELMTN

SEQ ID NO: 114457 - protein, 25 aa, Mycobacterium avium
FEIADYGVVGDLFKVAPQLTEAIKA

SEQ ID NO: 114458 - protein, 25 aa, Mycobacterium avium
FEIICEPTDLVAVRTALQDAGIDYD

SEQ ID NO: 114459 - protein, 21 aa, Mycobacterium avium
FEKLVALLNYPMFVVTTQSDG

SEQ ID NO: 114460 - protein, 18 aa, Mycobacterium avium
FELELSLLLCYTGITRDS

SEQ ID NO: 114461 - protein, 35 aa, Mycobacterium avium
FELNVYIPMMARNILESFKLLTNVSRLFAERCISG

SEQ ID NO: 114462 - protein, 33 aa, Mycobacterium avium
FEMTLGTNLLGPFALTNLLLPKVRSQIINVGSD

SEQ ID NO: 114463 - protein, 24 aa, Mycobacterium avium
FESYAAHLDFAVPTLPLVCNRTGT

SEQ ID NO: 114464 - protein, 21 aa, Mycobacterium avium
FEVAWRILQATPVTATGLVCA

SEQ ID NO: 114465 - protein, 19 aa, Mycobacterium avium
FEWDPLRWFEEDEPIYGHP

SEQ ID NO: 114466 - protein, 24 aa, Mycobacterium avium
FEWDPVLVQAFLRGPMHGAVSPPN

SEQ ID NO: 114467 - protein, 27 aa, Mycobacterium avium
FFDIGAVVYFLRKVIWTVPDFSVARYR

SEQ ID NO: 114468 - protein, 19 aa, Mycobacterium avium
FFELIGAPMTSFYDWYADL

SEQ ID NO: 114469 - protein, 18 aa, Mycobacterium avium
FGAFVPRGITLRVYGDAN

SEQ ID NO: 114470 - protein, 21 aa, Mycobacterium avium
FGAVELWPVVHAVEPSRRITG

SEQ ID NO: 114471 - protein, 25 aa, Mycobacterium avium
FGEQKARIFLALLGKQYGVTPPGWR

SEQ ID NO: 114472 - protein, 22 aa, Mycobacterium avium
FGGITIMAWAQRFAAHAVSAVL

SEQ ID NO: 114473 - protein, 28 aa, Mycobacterium avium
FGGMKLDFLLTIDPEYYKKFMSVNLDGA

SEQ ID NO: 114474 - protein, 24 aa, Mycobacterium avium
FGGNPVCAAAALAVLRVLASENLV

SEQ ID NO: 114475 - protein, 17 aa, Mycobacterium avium
FGGRRFDTGGFGGFNVG

SEQ ID NO: 114476 - protein, 28 aa, Mycobacterium avium
FGGSNYPQMLLRIGWPPINADPLPATPR

SEQ ID NO: 114477 - protein, 19 aa, Mycobacterium avium
FGLSWPLRHRVVPNAATRR

SEQ ID NO: 114478 - protein, 17 aa, Mycobacterium avium
FGMALRAWNAGLSVAVF

SEQ ID NO: 114479 - protein, 27 aa, Mycobacterium avium
FGNRDGILTAAWLRALERFQARALAAD

SEQ ID NO: 114480 - protein, 25 aa, Mycobacterium avium
FGTADSWVLWQLTGGPRGGVHATDV

SEQ ID NO: 114481 - protein, 23 aa, Mycobacterium avium
FGVDQLRYFLLREVPFGQDGSYT

SEQ ID NO: 114482 - protein, 22 aa, Mycobacterium avium
FGVSILLSALGPTMLQLAGERA

SEQ ID NO: 114483 - protein, 26 aa, Mycobacterium avium
FHEGYDFFLTPTLATPPLVVGATSTS

SEQ ID NO: 114484 - protein, 19 aa, Mycobacterium avium
FHGGSLYGIPMPPGLISHA

SEQ ID NO: 114485 - protein, 26 aa, Mycobacterium avium
FHHSRRVFLFGALQGRRRGLQPDLEL

SEQ ID NO: 114486 - protein, 24 aa, Mycobacterium avium
FHIDRGYPLFVENLAILGAEIERV

SEQ ID NO: 114487 - protein, 19 aa, Mycobacterium avium
FHMNEGHAGFLGAERIREL

SEQ ID NO: 114488 - protein, 23 aa, Mycobacterium avium
FHMYHALTWGPLVREIVYAATGK

SEQ ID NO: 114489 - protein, 31 aa, Mycobacterium avium
FHPLAPLHSCSLLIPALLSTAATRSATTTGR

SEQ ID NO: 114490 - protein, 22 aa, Mycobacterium avium
FHRIEAAYPGRFLLGIGVGHPE

SEQ ID NO: 114491 - protein, 26 aa, Mycobacterium avium
FHRPILAHDRLYFDTYLDSVIESHGT

SEQ ID NO: 114492 - protein, 17 aa, Mycobacterium avium
FHTLTGRMHFYLAHDWV

SEQ ID NO: 114493 - protein, 20 aa, Mycobacterium avium
FHYTRKWLQKMSAIEIDRSV

SEQ ID NO: 114494 - protein, 18 aa, Mycobacterium avium
FIAPFHRAGTNPTLALQR

SEQ ID NO: 114495 - protein, 18 aa, Mycobacterium avium
FICPVDPKRRYRISGNKG

SEQ ID NO: 114496 - protein, 25 aa, Mycobacterium avium
FIDVEAIRWTTWQAAWLVAHGRPAD

SEQ ID NO: 114497 - protein, 21 aa, Mycobacterium avium
FIEETLRFEAPFRGHYRHVWR

SEQ ID NO: 114498 - protein, 26 aa, Mycobacterium avium
FIMQADGKGWLFAPKGVVDGPLPTHY

SEQ ID NO: 114499 - protein, 19 aa, Mycobacterium avium
FINGIMLTFVAGQPAVDDA

SEQ ID NO: 114500 - protein, 18 aa, Mycobacterium avium
FIPVTHLCRDNCHYCTFV

SEQ ID NO: 114501 - protein, 23 aa, Mycobacterium avium
FKDAELLGVPWIVVVGRGWADGV

SEQ ID NO: 114502 - protein, 25 aa, Mycobacterium avium
FKEGERLWISWAMANRDPAVFHDPD

SEQ ID NO: 114503 - protein, 22 aa, Mycobacterium avium
FKRHKQIDRPCLLGYIDKCSAP

SEQ ID NO: 114504 - protein, 17 aa, Mycobacterium avium
FLMPLNPGKDDDGNMID

SEQ ID NO: 114505 - protein, 17 aa, Mycobacterium avium
FLPASLVEMRRVRDLQP

SEQ ID NO: 114506 - protein, 25 aa, Mycobacterium avium
FLRDLEKCWSLLLTGILQPDRTEYF

SEQ ID NO: 114507 - protein, 26 aa, Mycobacterium avium
FLSDRELFIIGRIKDLLIVYGRNHSP

SEQ ID NO: 114508 - protein, 24 aa, Mycobacterium avium
FLYEGELFVCGRSKDLIIVRGVNC

SEQ ID NO: 114509 - protein, 23 aa, Mycobacterium avium
FMADHVFSRLAIPSWMARTGFQM

SEQ ID NO: 114510 - protein, 26 aa, Mycobacterium avium
FNAMPPLHHREPGPALALLRDPRVTV

SEQ ID NO: 114511 - protein, 25 aa, Mycobacterium avium
FNAVRVFLHDLLWEQDHRGFQGRLA

SEQ ID NO: 114512 - protein, 31 aa, Mycobacterium avium
FNDYGRMVIGVWISKLFPQRMFKKVNQLRAF

SEQ ID NO: 114513 - protein, 17 aa, Mycobacterium avium
FNGTFTRRRNVALAGVD

SEQ ID NO: 114514 - protein, 17 aa, Mycobacterium avium
FNLVQYLGQLGVDADVW

SEQ ID NO: 114515 - protein, 33 aa, Mycobacterium avium
FNQASGRIKLAWFLLNAARYMPVLVYAADPQWG

SEQ ID NO: 114516 - protein, 29 aa, Mycobacterium avium
FNTADADVIRYLRWFTFLSADELGELERA

SEQ ID NO: 114517 - protein, 17 aa, Mycobacterium avium
FNTLIKLSQSMNTPLRD

SEQ ID NO: 114518 - protein, 17 aa, Mycobacterium avium
FPAYLDPLRQSLPGKAI

SEQ ID NO: 114519 - protein, 32 aa, Mycobacterium avium
FPEGFTPSLDLFLTPTFRGYLANYGTVLYPEL

SEQ ID NO: 114520 - protein, 25 aa, Mycobacterium avium
FPGKAAILAVYYRRAADQLSADLSS

SEQ ID NO: 114521 - protein, 25 aa, Mycobacterium avium
FPKGVMWRHEDIYRVLFGGTDFATG

SEQ ID NO: 114522 - protein, 23 aa, Mycobacterium avium
FPKRQGMRIDFILGSPALARRVT

SEQ ID NO: 114523 - protein, 24 aa, Mycobacterium avium
FPPSALLEALLRSYERTGSAAVLQ

SEQ ID NO: 114524 - protein, 29 aa, Mycobacterium avium
FPTAEGYLALFITHDGFWKSFAAEAGIGG

SEQ ID NO: 114525 - protein, 17 aa, Mycobacterium avium
FPTPAACGRTPLTATGL

SEQ ID NO: 114526 - protein, 20 aa, Mycobacterium avium
FPVELFDRPDGQPQWPTFGI

SEQ ID NO: 114527 - protein, 25 aa, Mycobacterium avium
FQGRMLRYLVTSPLRRARELQNMSA

SEQ ID NO: 114528 - protein, 24 aa, Mycobacterium avium
FQNAWVNPIMWNAFMGWVGVDQYD

SEQ ID NO: 114529 - protein, 25 aa, Mycobacterium avium
FQYAKTWRTLAKLSLPNKYLRDDAD

SEQ ID NO: 114530 - protein, 30 aa, Mycobacterium avium
FRAGTNLKAWLYRILTNTYINSYRKKQRQP

SEQ ID NO: 114531 - protein, 31 aa, Mycobacterium avium
FRDELIYERGGWYFTSRALQWDSVPSRHPLV

SEQ ID NO: 114532 - protein, 18 aa, Mycobacterium avium
FRELTIGQVKAAMAEAGI

SEQ ID NO: 114533 - protein, 20 aa, Mycobacterium avium
FRLLGGVDVVFSNAGIVVAG

SEQ ID NO: 114534 - protein, 29 aa, Mycobacterium avium
FRLPANELEFFFFVLAFAGSDTTKNALAI

SEQ ID NO: 114535 - protein, 21 aa, Mycobacterium avium
FRNIVNMLHGVRDGLIRDANN

SEQ ID NO: 114536 - protein, 19 aa, Mycobacterium avium
FRPGTLEKWNLGYDVLCER

SEQ ID NO: 114537 - protein, 26 aa, Mycobacterium avium
FRRAQLPPLTAPLAVILLGGLRELTA

SEQ ID NO: 114538 - protein, 18 aa, Mycobacterium avium
FRRDGMLLAVDRNMQPNP

SEQ ID NO: 114539 - protein, 19 aa, Mycobacterium avium
FRRMLSKPFTFKRVEALRP

SEQ ID NO: 114540 - protein, 22 aa, Mycobacterium avium
FRTVLYVTCEVVRIAALLVQPV

SEQ ID NO: 114541 - protein, 34 aa, Mycobacterium avium
FSADDYVRILDILERFYGLVLTDCGPGLLHSVMK

SEQ ID NO: 114542 - protein, 20 aa, Mycobacterium avium
FSALRRHYVYRLSTAPWGVL

SEQ ID NO: 114543 - protein, 17 aa, Mycobacterium avium
FSAQYRILRQPRPVTFS

SEQ ID NO: 114544 - protein, 28 aa, Mycobacterium avium
FSDEFRIQLAWMRLSPPTANPGWSYATR

SEQ ID NO: 114545 - protein, 25 aa, Mycobacterium avium
FSFGDYFKREAIELAWTLLTGSVEQ

SEQ ID NO: 114546 - protein, 18 aa, Mycobacterium avium
FSGRYWAALARTAERGLL

SEQ ID NO: 114547 - protein, 29 aa, Mycobacterium avium
FSGTCPEWVYFWLGAARIGAVSAAINAAH

SEQ ID NO: 114548 - protein, 20 aa, Mycobacterium avium
FSLTVPRRDGGERRLYLIET

SEQ ID NO: 114549 - protein, 29 aa, Mycobacterium avium
FSRLHQPGLGDYFAPGLPAAFDGTHPAGA

SEQ ID NO: 114550 - protein, 17 aa, Mycobacterium avium
FSRPLARVVLDSAPATV

SEQ ID NO: 114551 - protein, 20 aa, Mycobacterium avium
FTASWYGRVLHFGVREHAMG

SEQ ID NO: 114552 - protein, 21 aa, Mycobacterium avium
FTGPGLWANLACRKRFIADKL

SEQ ID NO: 114553 - protein, 19 aa, Mycobacterium avium
FTHQHLIIAEAIRIPGPTK

SEQ ID NO: 114554 - protein, 18 aa, Mycobacterium avium
FTNICYTGCRFCAFAQRK

SEQ ID NO: 114555 - protein, 38 aa, Mycobacterium avium
FTQLEPVGVVGLIIPWNGPFFVAMLKVAPALAAGCSAV

SEQ ID NO: 114556 - protein, 33 aa, Mycobacterium avium
FTRDRPVIFAYHGYPWLIHRLTYRRANHAQLHV

SEQ ID NO: 114557 - protein, 28 aa, Mycobacterium avium
FTSDIKNLLPMFAVFKPTVVVSVPRVFE

SEQ ID NO: 114558 - protein, 25 aa, Mycobacterium avium
FTVEDGALWLLQTRAAERSAQAAVR

SEQ ID NO: 114559 - protein, 17 aa, Mycobacterium avium
FVAVYLDVLRRFDRMYD

SEQ ID NO: 114560 - protein, 18 aa, Mycobacterium avium
FVFINFDPQPRQSLREFL

SEQ ID NO: 114561 - protein, 18 aa, Mycobacterium avium
FVLFGEFTDAPASWQRYL

SEQ ID NO: 114562 - protein, 23 aa, Mycobacterium avium
FVRDIAAPLPMAVIGDMLGVLPT

SEQ ID NO: 114563 - protein, 20 aa, Mycobacterium avium
FVRYYAGYPDKLTGASTPVS

SEQ ID NO: 114564 - protein, 25 aa, Mycobacterium avium
FVTRMDYLSPFFNETAYCLGVEKLL

SEQ ID NO: 114565 - protein, 20 aa, Mycobacterium avium
FVVFARTRPADDQGPGIAVF

SEQ ID NO: 114566 - protein, 26 aa, Mycobacterium avium
FVVPEPLSLRPHYIKTLHIWGDTLES

SEQ ID NO: 114567 - protein, 18 aa, Mycobacterium avium
FVWDAWTVGLQWWRRFGP

SEQ ID NO: 114568 - protein, 17 aa, Mycobacterium avium
FWVPRRLGGGAPTQEDS

SEQ ID NO: 114569 - protein, 17 aa, Mycobacterium avium
FYRRPLNVGDAGGGAGA

SEQ ID NO: 114570 - protein, 23 aa, Mycobacterium avium
GAAAKLWEGALKLGIEMRVGPVG

SEQ ID NO: 114571 - protein, 33 aa, Mycobacterium avium
GAACWDARRWLGRPGLEHGASADLLCFAEDPRS

SEQ ID NO: 114572 - protein, 25 aa, Mycobacterium avium
GAAEALRWAMMRGEPLVVLADALAE

SEQ ID NO: 114573 - protein, 30 aa, Mycobacterium avium
GAAIDAALTVRLLLAPEIDVRFGLGWGAVT

SEQ ID NO: 114574 - protein, 30 aa, Mycobacterium avium
GAAIDLMDQAWWFPAVAPLPGKAPAVMLAE

SEQ ID NO: 114575 - protein, 24 aa, Mycobacterium avium
GAAKAGIISLTLTAARALGRYGVC

SEQ ID NO: 114576 - protein, 18 aa, Mycobacterium avium
GAALGAAFLARMAAGLET

SEQ ID NO: 114577 - protein, 43 aa, Mycobacterium avium
GAARAYIRYQPLGVVLAVMPWNFPLWQAVRFAAPALMAGNVGI

SEQ ID NO: 114578 - protein, 19 aa, Mycobacterium avium
GACFGYHMGLLGAGEVCIT

SEQ ID NO: 114579 - protein, 35 aa, Mycobacterium avium
GADGRAMAALPRLLGVAYAGLLARAARLTDSRAAH

SEQ ID NO: 114580 - protein, 24 aa, Mycobacterium avium
GADYRWMNLVARLPRKGIPVYAKR

SEQ ID NO: 114581 - protein, 26 aa, Mycobacterium avium
GAELRATLLALLGSPHLCSRAFITEQ

SEQ ID NO: 114582 - protein, 29 aa, Mycobacterium avium
GAESPRETWLRLLLLRAGFPRPRTQLPVR

SEQ ID NO: 114583 - protein, 23 aa, Mycobacterium avium
GAEVPLLGQIPLDPALVEAGDSG

SEQ ID NO: 114584 - protein, 26 aa, Mycobacterium avium
GAGDLALWLELRTPRWVSGEDRLLVT

SEQ ID NO: 114585 - protein, 27 aa, Mycobacterium avium
GAGFSGLYMLHRLRQLGIPARVLEMAE

SEQ ID NO: 114586 - protein, 27 aa, Mycobacterium avium
GAGKSTFIALTLAPLLPGSVVVNADEI

SEQ ID NO: 114587 - protein, 24 aa, Mycobacterium avium
GAGLELWGMRCDGTVFPVDVSLSP

SEQ ID NO: 114588 - protein, 18 aa, Mycobacterium avium
GAGLFLMGHSGGCELVLR

SEQ ID NO: 114589 - protein, 21 aa, Mycobacterium avium
GAGLNLALAADVRIAGPAALF

SEQ ID NO: 114590 - protein, 19 aa, Mycobacterium avium
GAGMHPWGKWGNDFTEYGV

SEQ ID NO: 114591 - protein, 25 aa, Mycobacterium avium
GAGRRIRGLRLRATDIDWTHGDGPQ

SEQ ID NO: 114592 - protein, 25 aa, Mycobacterium avium
GAHLRNMAFYNSGLRLLRHAHDAQK

SEQ ID NO: 114593 - protein, 25 aa, Mycobacterium avium
GAHYGMICDASYSTYFLTHWARDRK

SEQ ID NO: 114594 - protein, 20 aa, Mycobacterium avium
GAIEFIFRHAVPAGIYGGTM

SEQ ID NO: 114595 - protein, 24 aa, Mycobacterium avium
GAIEPQFFAALLDGLGLSPEEVPG

SEQ ID NO: 114596 - protein, 27 aa, Mycobacterium avium
GAINTAAWWVCATIPNAVSLGKTLGTV

SEQ ID NO: 114597 - protein, 31 aa, Mycobacterium avium
GAITPALATLGFAVLPLLELASEEQQDRFLA

SEQ ID NO: 114598 - protein, 25 aa, Mycobacterium avium
GAKEQLGILARLAGAALVAKEDAVP

SEQ ID NO: 114599 - protein, 24 aa, Mycobacterium avium
GAKIPGRLFAGPMLAMPSGSSAAE

SEQ ID NO: 114600 - protein, 30 aa, Mycobacterium avium
GAKTDLMDEAWWLPSVFIANGGAVAASLGS

SEQ ID NO: 114601 - protein, 22 aa, Mycobacterium avium
GALAALYRRSVTGRGQVVDVAL

SEQ ID NO: 114602 - protein, 17 aa, Mycobacterium avium
GALATPMPALPAPQPPG

SEQ ID NO: 114603 - protein, 18 aa, Mycobacterium avium
GALGWRGLLDRVDVDPAA

SEQ ID NO: 114604 - protein, 24 aa, Mycobacterium avium
GALHDVLPADLLAHSLRELVARTG

SEQ ID NO: 114605 - protein, 19 aa, Mycobacterium avium
GALPPHRYPQRELTDFFVS

SEQ ID NO: 114606 - protein, 25 aa, Mycobacterium avium
GALRRSIKFPSFLDGIDAVRRVAEH

SEQ ID NO: 114607 - protein, 24 aa, Mycobacterium avium
GALRTLLLRYDGQAQPLLASVPVS

SEQ ID NO: 114608 - protein, 25 aa, Mycobacterium avium
GALRYYLLEQNALPDTPLIAMVPVS

SEQ ID NO: 114609 - protein, 18 aa, Mycobacterium avium
GALSVPPTWGATGAAITP

SEQ ID NO: 114610 - protein, 29 aa, Mycobacterium avium
GALVLARIARLVFGAWEPKTGAVGSLWDV

SEQ ID NO: 114611 - protein, 25 aa, Mycobacterium avium
GANLALLVGARPRGPGMERSDLLEA

SEQ ID NO: 114612 - protein, 24 aa, Mycobacterium avium
GAPEHPAWYFNLKAHPEVTLQDGD

SEQ ID NO: 114613 - protein, 30 aa, Mycobacterium avium
GAPELVKLRPYFDHPLFVEMFAGAIADAAA

SEQ ID NO: 114614 - protein, 22 aa, Mycobacterium avium
GAPPRPSVGYLIYGIGRHASDE

SEQ ID NO: 114615 - protein, 26 aa, Mycobacterium avium
GAPTMIHVDLYRLLDHTGNQGADLLG

SEQ ID NO: 114616 - protein, 19 aa, Mycobacterium avium
GAPVLDADLLRRAKHHGLS

SEQ ID NO: 114617 - protein, 23 aa, Mycobacterium avium
GAQSGLPIGWYSHPAQGIKQIIN

SEQ ID NO: 114618 - protein, 25 aa, Mycobacterium avium
GAQVMPIHVYRWKPTPAGGEFDQLV

SEQ ID NO: 114619 - protein, 24 aa, Mycobacterium avium
GAQWSRIRLADRAHLEPWEPSAEG

SEQ ID NO: 114620 - protein, 25 aa, Mycobacterium avium
GAREHALLLALRKDPQVTGLAIAPG

SEQ ID NO: 114621 - protein, 23 aa, Mycobacterium avium
GAREVQLGLAMLARLVGQAGEAY

SEQ ID NO: 114622 - protein, 21 aa, Mycobacterium avium
GARGWAMNTLFDGIEALLADL

SEQ ID NO: 114623 - protein, 24 aa, Mycobacterium avium
GARNAGLLAVRILGASDPGLRARI

SEQ ID NO: 114624 - protein, 21 aa, Mycobacterium avium
GARPMPIYCASLRTAEPELLQ

SEQ ID NO: 114625 - protein, 25 aa, Mycobacterium avium
GARPPLVKRMVLQTAARLSRRGRRL

SEQ ID NO: 114626 - protein, 17 aa, Mycobacterium avium
GARVVVVAPYEGPLRDS

SEQ ID NO: 114627 - protein, 19 aa, Mycobacterium avium
GASYWYAHTDQWRYDGYGA

SEQ ID NO: 114628 - protein, 24 aa, Mycobacterium avium
GATADGAAFHRLCFGLAAGGVGNR

SEQ ID NO: 114629 - protein, 18 aa, Mycobacterium avium
GATSRVLRLAGHDGDWVP

SEQ ID NO: 114630 - protein, 25 aa, Mycobacterium avium
GCAGLRYNLFFDDRSLDGDLTAEFG

SEQ ID NO: 114631 - protein, 19 aa, Mycobacterium avium
GCATPARVFKGTRMAGRMG

SEQ ID NO: 114632 - protein, 25 aa, Mycobacterium avium
GCDKSLPGMLMAAARLDLASVFLYA

SEQ ID NO: 114633 - protein, 25 aa, Mycobacterium avium
GCEAYPGVFAPFGGYPDGCVVSSGM

SEQ ID NO: 114634 - protein, 27 aa, Mycobacterium avium
GCMALGITGPILRATGLPHDLRKSEPY

SEQ ID NO: 114635 - protein, 20 aa, Mycobacterium avium
GCVYSVFTEGYWSTAGPSAI

SEQ ID NO: 114636 - protein, 25 aa, Mycobacterium avium
GDARGHFFEWLTDKGFRSFAGHRLD

SEQ ID NO: 114637 - protein, 27 aa, Mycobacterium avium
GDDDNEAKWFWFEGNFGAYEENKIERL

SEQ ID NO: 114638 - protein, 21 aa, Mycobacterium avium
GDDFVSHLFGMFAFAIVERDS

SEQ ID NO: 114639 - protein, 27 aa, Mycobacterium avium
GDDLVIAKCFLLWAGVLGAISLEVFGQ

SEQ ID NO: 114640 - protein, 27 aa, Mycobacterium avium
GDECHMAFHFPLMPRIFMAVRRESRFP

SEQ ID NO: 114641 - protein, 21 aa, Mycobacterium avium
GDEHLAMLRRLMMDDSFFRGE

SEQ ID NO: 114642 - protein, 24 aa, Mycobacterium avium
GDEVLLRLFGKIVELAFLAVPDEI

SEQ ID NO: 114643 - protein, 19 aa, Mycobacterium avium
GDFDLSTLRFALSGAEPVE

SEQ ID NO: 114644 - protein, 27 aa, Mycobacterium avium
GDFGGGSMFLLLGILSALWERQSSGKG

SEQ ID NO: 114645 - protein, 34 aa, Mycobacterium avium
GDGSKPVIGTVMRQGYKLGDQVLRHALVGVVDTV

SEQ ID NO: 114646 - protein, 24 aa, Mycobacterium avium
GDGSYWTGLVFADGKRWPEERTTW

SEQ ID NO: 114647 - protein, 27 aa, Mycobacterium avium
GDIDKPKLVFFFDEAHLLFADASKAFL

SEQ ID NO: 114648 - protein, 23 aa, Mycobacterium avium
GDITPYDPVLFPFDPALRDRDDL

SEQ ID NO: 114649 - protein, 19 aa, Mycobacterium avium
GDKGYWAITKHKDVKEISV

SEQ ID NO: 114650 - protein, 17 aa, Mycobacterium avium
GDKLALEYVIRKQSRDT

SEQ ID NO: 114651 - protein, 18 aa, Mycobacterium avium
GDLATAIDALRRPERRRG

SEQ ID NO: 114652 - protein, 25 aa, Mycobacterium avium
GDLELRIPKLRTGSFFPALLERRRR

SEQ ID NO: 114653 - protein, 18 aa, Mycobacterium avium
GDLGLLSDIGLPEAVLGV

SEQ ID NO: 114654 - protein, 21 aa, Mycobacterium avium
GDLLLHPASFTASLDGRELNL

SEQ ID NO: 114655 - protein, 22 aa, Mycobacterium avium
GDPAFRQRYWARNHVGWRHMDD

SEQ ID NO: 114656 - protein, 24 aa, Mycobacterium avium
GDPFEPGTLVGPLIHETAYRDMVG

SEQ ID NO: 114657 - protein, 37 aa, Mycobacterium avium
GDPGDYLIRPGFWHGAIGVAACWLGGARRVADPLYRC

SEQ ID NO: 114658 - protein, 21 aa, Mycobacterium avium
GDQHYDVISAFIKSVRGSDVD

SEQ ID NO: 114659 - protein, 31 aa, Mycobacterium avium
GDREGEAIAWHLLETLKPNIPVKRMVFHEIT

SEQ ID NO: 114660 - protein, 21 aa, Mycobacterium avium
GDRIFSWQLAAAVRPSLFVFT

SEQ ID NO: 114661 - protein, 27 aa, Mycobacterium avium
GDRVAIYLPLIPEAVIAMLACARLGVM

SEQ ID NO: 114662 - protein, 18 aa, Mycobacterium avium
GDRYAFGELFVRHQRHLH

SEQ ID NO: 114663 - protein, 24 aa, Mycobacterium avium
GDTPAFFQLYTPPDRKMAASLVHR

SEQ ID NO: 114664 - protein, 35 aa, Mycobacterium avium
GDTVKRLARLHTPLPLLAFTAWPEVRSQLAMTWGT

SEQ ID NO: 114665 - protein, 19 aa, Mycobacterium avium
GDVWALLVDGKFGHGLPPA

SEQ ID NO: 114666 - protein, 25 aa, Mycobacterium avium
GEAAELMWRYYLGPTVGSAAAVPAR

SEQ ID NO: 114667 - protein, 18 aa, Mycobacterium avium
GEATFLFTRTTVGEIGIL

SEQ ID NO: 114668 - protein, 18 aa, Mycobacterium avium
GEDFWPQAYDRTVPDEII

SEQ ID NO: 114669 - protein, 30 aa, Mycobacterium avium
GEDMRTLISVPLFHVTGCNSQLLAAARLGG

SEQ ID NO: 114670 - protein, 19 aa, Mycobacterium avium
GEEALYLRPFVIATEPGLG

SEQ ID NO: 114671 - protein, 22 aa, Mycobacterium avium
GEEQFMAWRRSYDTPPPPIERG

SEQ ID NO: 114672 - protein, 30 aa, Mycobacterium avium
GEESALFAADLARMYIRYAERHGWTVTVLD

SEQ ID NO: 114673 - protein, 26 aa, Mycobacterium avium
GEFDEWQRLFLFTRADTIYGGSNEIQ

SEQ ID NO: 114674 - protein, 32 aa, Mycobacterium avium
GEFSRISDVLLPFLVTRQLICGAGKVLQTPKA

SEQ ID NO: 114675 - protein, 23 aa, Mycobacterium avium
GEGKRLYPLTADRAKPAVPFGGA

SEQ ID NO: 114676 - protein, 22 aa, Mycobacterium avium
GEGVLRFFEYVAARTDIALGMF

SEQ ID NO: 114677 - protein, 24 aa, Mycobacterium avium
GEHGYELLPPWESAGVVFDALAAA

SEQ ID NO: 114678 - protein, 25 aa, Mycobacterium avium
GEITPYIPERWRKFFFEHRVGELIY

SEQ ID NO: 114679 - protein, 27 aa, Mycobacterium avium
GEKKRHEILQLELLKPKIAILDETDSG

SEQ ID NO: 114680 - protein, 19 aa, Mycobacterium avium
GELARLCHAALESLRAGIT

SEQ ID NO: 114681 - protein, 29 aa, Mycobacterium avium
GELDGAHLLIWTTTPWTLPSNLAVAVHPE

SEQ ID NO: 114682 - protein, 18 aa, Mycobacterium avium
GELFGFDAAAPYPRRLAQ

SEQ ID NO: 114683 - protein, 17 aa, Mycobacterium avium
GELPVIATGFDAGAPQQ

SEQ ID NO: 114684 - protein, 23 aa, Mycobacterium avium
GELRPLYRPGLFHMYHALTWGPL

SEQ ID NO: 114685 - protein, 32 aa, Mycobacterium avium
GELSSPLSFLERPARWVQALASSPHAWSAAPN

SEQ ID NO: 114686 - protein, 17 aa, Mycobacterium avium
GELYVTGRIADLVRIDG

SEQ ID NO: 114687 - protein, 22 aa, Mycobacterium avium
GEMIRKTLLLAGSQSAGPGGAG

SEQ ID NO: 114688 - protein, 26 aa, Mycobacterium avium
GENLDPLFDVLLEHIPAPSGDPEAPL

SEQ ID NO: 114689 - protein, 25 aa, Mycobacterium avium
GEPAPDMEIIGMLTLLIGGGFDTTT

SEQ ID NO: 114690 - protein, 39 aa, Mycobacterium avium
GEPSSGFSTMLWGGQPLPTINPLYGGKTISLCAPDDPIC

SEQ ID NO: 114691 - protein, 20 aa, Mycobacterium avium
GEPVSCFLLRIEDNMESIGR

SEQ ID NO: 114692 - protein, 26 aa, Mycobacterium avium
GEQRAQQPCRWIFRGRNQRAEQRRTG

SEQ ID NO: 114693 - protein, 30 aa, Mycobacterium avium
GERRRVALCKLLLSKPDLLLLDEPTNHLDA

SEQ ID NO: 114694 - protein, 24 aa, Mycobacterium avium
GERTLYRRFPAKADLVRAALDQSI

SEQ ID NO: 114695 - protein, 24 aa, Mycobacterium avium
GESWVRVNSIRPGLIRTDLVDASV

SEQ ID NO: 114696 - protein, 34 aa, Mycobacterium avium
GEVARFRRKIGAKGWFGLNWPREYGGLGLGAVHL

SEQ ID NO: 114697 - protein, 24 aa, Mycobacterium avium
GEVDVYNMSWQKYLDARATDEQRR

SEQ ID NO: 114698 - protein, 22 aa, Mycobacterium avium
GEVLLRTDVLGHRLIDVATVEL

SEQ ID NO: 114699 - protein, 25 aa, Mycobacterium avium
GEVNVRIWIHPDFRKRGYGTAALRK

SEQ ID NO: 114700 - protein, 20 aa, Mycobacterium avium
GEWASIEMYPSLSAALGEEI

SEQ ID NO: 114701 - protein, 18 aa, Mycobacterium avium
GEYGAGRVVIWDSGTYDA

SEQ ID NO: 114702 - protein, 23 aa, Mycobacterium avium
GFDAPFFGMSAREARLLDPQHRL

SEQ ID NO: 114703 - protein, 18 aa, Mycobacterium avium
GFDPGAVRFLLLDLAEQV

SEQ ID NO: 114704 - protein, 17 aa, Mycobacterium avium
GFDPVRRRIFQLEIGRA

SEQ ID NO: 114705 - protein, 19 aa, Mycobacterium avium
GFERLLPVAPPPQETRPRW

SEQ ID NO: 114706 - protein, 18 aa, Mycobacterium avium
GFGGITRGLHRITKPVIG

SEQ ID NO: 114707 - protein, 35 aa, Mycobacterium avium
GFGTDRAMIAACPLTFPWNVLGWPSINVPAGFTSD

SEQ ID NO: 114708 - protein, 25 aa, Mycobacterium avium
GFLSEPWWCRMVVLSAERIARRHGV

SEQ ID NO: 114709 - protein, 21 aa, Mycobacterium avium
GFMGLGMIYTAMPVTNAVPAV

SEQ ID NO: 114710 - protein, 20 aa, Mycobacterium avium
GFPADMPFLIWGYGATRAGS

SEQ ID NO: 114711 - protein, 26 aa, Mycobacterium avium
GFPIAKIAAKLAIGYTLDEIVNDITK

SEQ ID NO: 114712 - protein, 27 aa, Mycobacterium avium
GFPKASVMTHLRWLKALAAFGGIGLRL

SEQ ID NO: 114713 - protein, 18 aa, Mycobacterium avium
GFRNSMTFVLTGLDIEAK

SEQ ID NO: 114714 - protein, 27 aa, Mycobacterium avium
GFTEFVPLPFVHQSSPLYLAGAARPGP

SEQ ID NO: 114715 - protein, 31 aa, Mycobacterium avium
GGAEHAVLHLLYARFWHKVLYDLGHVSSREP

SEQ ID NO: 114716 - protein, 21 aa, Mycobacterium avium
GGAEQLHRLVVGSLPVSSVLT

SEQ ID NO: 114717 - protein, 24 aa, Mycobacterium avium
GGARALEWIVGHPSRVRAGLLLAV

SEQ ID NO: 114718 - protein, 23 aa, Mycobacterium avium
GGEDFSWYLEEIPGAMARLGVWP

SEQ ID NO: 114719 - protein, 17 aa, Mycobacterium avium
GGEIRRLMSLSEDELYV

SEQ ID NO: 114720 - protein, 26 aa, Mycobacterium avium
GGEVLLHCCGPDMPWNLLQDSAFSAV

SEQ ID NO: 114721 - protein, 26 aa, Mycobacterium avium
GGGILGPHFSFSWYRGSPIGRERKTE

SEQ ID NO: 114722 - protein, 20 aa, Mycobacterium avium
GGGSALPYKRRLFGQIVAAA

SEQ ID NO: 114723 - protein, 34 aa, Mycobacterium avium
GGGSLWLDPALTTPYAWYQYFFNTADADVIRYLR

SEQ ID NO: 114724 - protein, 24 aa, Mycobacterium avium
GGHLDPTMFAAFAPHALELTVEEG

SEQ ID NO: 114725 - protein, 17 aa, Mycobacterium avium
GGITERFPLMVSSLSSA

SEQ ID NO: 114726 - protein, 23 aa, Mycobacterium avium
GGKALKFYASVRMDVRRIETLKD

SEQ ID NO: 114727 - protein, 19 aa, Mycobacterium avium
GGKALLLKAGVFDDISAAV

SEQ ID NO: 114728 - protein, 18 aa, Mycobacterium avium
GGKLMRLSGILDDLIRES

SEQ ID NO: 114729 - protein, 25 aa, Mycobacterium avium
GGKPLDGPGWFYPPTVVTDITKDMA

SEQ ID NO: 114730 - protein, 32 aa, Mycobacterium avium
GGKVTAWRYIRAAVPAVWGYTRREPMLTLELP

SEQ ID NO: 114731 - protein, 21 aa, Mycobacterium avium
GGLADIEWTVQLLQLLHAHEV

SEQ ID NO: 114732 - protein, 26 aa, Mycobacterium avium
GGLGGFAGLFALRGEYREPLLAASTD

SEQ ID NO: 114733 - protein, 19 aa, Mycobacterium avium
GGLLLVTHDRWFLDEVATT

SEQ ID NO: 114734 - protein, 24 aa, Mycobacterium avium
GGLNFREVLNVLGLYPGDPGPLGG

SEQ ID NO: 114735 - protein, 21 aa, Mycobacterium avium
GGLQFKPATWARYGGVGNPAA

SEQ ID NO: 114736 - protein, 20 aa, Mycobacterium avium
GGLYRWEGRYLRGDDQRKLA

SEQ ID NO: 114737 - protein, 24 aa, Mycobacterium avium
GGMELGAMTPMFVGFRGREIVLTL

SEQ ID NO: 114738 - protein, 30 aa, Mycobacterium avium
GGNTIPPAPPPAMAPALPSFGGGSLPGLGA

SEQ ID NO: 114739 - protein, 25 aa, Mycobacterium avium
GGNVLVGPLDWAVELDERWVIVGPN

SEQ ID NO: 114740 - protein, 28 aa, Mycobacterium avium
GGPATIVPMFLLYDYSFLPDGAASKAEG

SEQ ID NO: 114741 - protein, 21 aa, Mycobacterium avium
GGPFPPLPFTPEGDDISELIE

SEQ ID NO: 114742 - protein, 27 aa, Mycobacterium avium
GGPGRPVLLMHPWPLSGQSWSAQVPVL

SEQ ID NO: 114743 - protein, 22 aa, Mycobacterium avium
GGPLREWLHKQRTGLPHLTWKY

SEQ ID NO: 114744 - protein, 29 aa, Mycobacterium avium
GGQETTLLSLYITLMHFGGIIVAPGYTDP

SEQ ID NO: 114745 - protein, 25 aa, Mycobacterium avium
GGQRRRVELARILFAAAEGGATGSG

SEQ ID NO: 114746 - protein, 28 aa, Mycobacterium avium
GGRAVVMTYWNPVLRYGVDAFARDLAAA

SEQ ID NO: 114747 - protein, 31 aa, Mycobacterium avium
GGRHTPFFNNYRPQFYFRTTDVTGVVTLPEG

SEQ ID NO: 114748 - protein, 21 aa, Mycobacterium avium
GGRRLEVSLPGDLALSNGGSA

SEQ ID NO: 114749 - protein, 17 aa, Mycobacterium avium
GGRVKDLPGVRYKIIRG

SEQ ID NO: 114750 - protein, 38 aa, Mycobacterium avium
GGRVRAKYGWTDVARFAALGIPALNFGPGDPNLAHRRD

SEQ ID NO: 114751 - protein, 27 aa, Mycobacterium avium
GGSAVRLVRQIPYTVACDLLLTGRHIT

SEQ ID NO: 114752 - protein, 26 aa, Mycobacterium avium
GGSGITPVFSLLRTALTAGTRRARLF

SEQ ID NO: 114753 - protein, 23 aa, Mycobacterium avium
GGSMLVLLGITAALYERERSGRG

SEQ ID NO: 114754 - protein, 24 aa, Mycobacterium avium
GGSMLYIQSLLDDWSFPATDPRVR

SEQ ID NO: 114755 - protein, 20 aa, Mycobacterium avium
GGTFGAQWLVDNRPELFAGV

SEQ ID NO: 114756 - protein, 24 aa, Mycobacterium avium
GGTLAVSVPRWLPERVCWLLSDEY

SEQ ID NO: 114757 - protein, 20 aa, Mycobacterium avium
GGVDLLIVETIFDTLNAKAA

SEQ ID NO: 114758 - protein, 21 aa, Mycobacterium avium
GGVFASLFTCGIAVPHMIASG

SEQ ID NO: 114759 - protein, 25 aa, Mycobacterium avium
GGVKGFFEKTFAPLGLKKIQGEVLA

SEQ ID NO: 114760 - protein, 21 aa, Mycobacterium avium
GHCLLRLRDGDITHREVESAC

SEQ ID NO: 114761 - protein, 24 aa, Mycobacterium avium
GHERVMLWMGYVDLLHELSADFRP

SEQ ID NO: 114762 - protein, 26 aa, Mycobacterium avium
GHEVGWSMLPVARSVLRRIGEQTDVV

SEQ ID NO: 114763 - protein, 23 aa, Mycobacterium avium
GHGGWPMTCFLTPDGRPFFCGTY

SEQ ID NO: 114764 - protein, 25 aa, Mycobacterium avium
GHHPVPGIYPITLDKSKNASAAYLK

SEQ ID NO: 114765 - protein, 42 aa, Mycobacterium avium
GHLGIYVTEVRWWGARPLWFALWSGVFERFPGLRWGVTECGA

SEQ ID NO: 114766 - protein, 26 aa, Mycobacterium avium
GHLVISYRRAALPRLQLWRIDADGTY

SEQ ID NO: 114767 - protein, 25 aa, Mycobacterium avium
GHNYIGTEHILLGLIREGEGVAAQV

SEQ ID NO: 114768 - protein, 27 aa, Mycobacterium avium
GHSSLTLYLQLYLGGFGLELSDIESLR

SEQ ID NO: 114769 - protein, 28 aa, Mycobacterium avium
GHTQPAGWFRFYFADQRWEWSEQVQRMH

SEQ ID NO: 114770 - protein, 31 aa, Mycobacterium avium
GHYGMCGRAYDPRFLFAWPTSKSAVMGGAQL

SEQ ID NO: 114771 - protein, 17 aa, Mycobacterium avium
GIAFLPQSSKDAATACA

SEQ ID NO: 114772 - protein, 32 aa, Mycobacterium avium
GICHWFHSDAIYRAVLALLMLTGSMGRNGGGW

SEQ ID NO: 114773 - protein, 22 aa, Mycobacterium avium
GIDAFIDLFGPQYVQLAVDLGV

SEQ ID NO: 114774 - protein, 27 aa, Mycobacterium avium
GIDFIEACAWIKENLPGVHLSGGISNV

SEQ ID NO: 114775 - protein, 27 aa, Mycobacterium avium
GIDFTNIYFYTVLYHALRASNRIAIER

SEQ ID NO: 114776 - protein, 18 aa, Mycobacterium avium
GIDMSKSPSFLWLQVDDV

SEQ ID NO: 114777 - protein, 24 aa, Mycobacterium avium
GIEKNLEYRYWTQGVTFVTRMDYL

SEQ ID NO: 114778 - protein, 26 aa, Mycobacterium avium
GIEPVNRPWYRAFNAYKMAVICLIGA

SEQ ID NO: 114779 - protein, 27 aa, Mycobacterium avium
GIGCSSRFPYYLETYGFHSIHGRAPAI

SEQ ID NO: 114780 - protein, 25 aa, Mycobacterium avium
GIGFVFQHYAAFKHLTVRDNVAYGL

SEQ ID NO: 114781 - protein, 22 aa, Mycobacterium avium
GIGLLKSLAGRPIDWSAVHLFW

SEQ ID NO: 114782 - protein, 17 aa, Mycobacterium avium
GIGRLMLDRLLEFADGG

SEQ ID NO: 114783 - protein, 19 aa, Mycobacterium avium
GINCLTGQHWLDVCAMLGL

SEQ ID NO: 114784 - protein, 24 aa, Mycobacterium avium
GIPVASIYQYFPGKAAILAVYYRR

SEQ ID NO: 114785 - protein, 20 aa, Mycobacterium avium
GIRRFGDAFIPMDETLAHAA

SEQ ID NO: 114786 - protein, 25 aa, Mycobacterium avium
GITGIITMPWMFYAGPQASLDDKID

SEQ ID NO: 114787 - protein, 20 aa, Mycobacterium avium
GIVQNSIDIGTYAVDRTKEV

SEQ ID NO: 114788 - protein, 19 aa, Mycobacterium avium
GKAGWLSVYVPSAEVLHHK

SEQ ID NO: 114789 - protein, 32 aa, Mycobacterium avium
GKEGDRGLSWLPFFHDMGLITAMLSPVLGHNF

SEQ ID NO: 114790 - protein, 26 aa, Mycobacterium avium
GKEVPPVVVVPYFWSDQYDVKIQCLG

SEQ ID NO: 114791 - protein, 22 aa, Mycobacterium avium
GKIVLQMPKPLQPRGDRSYLIT

SEQ ID NO: 114792 - protein, 24 aa, Mycobacterium avium
GKIYVRFPEAVSMRQYLGAPHGPL

SEQ ID NO: 114793 - protein, 33 aa, Mycobacterium avium
GKPLILDEAWGAHLPFHEDLPTWAMDAGADVCV

SEQ ID NO: 114794 - protein, 24 aa, Mycobacterium avium
GKQDLLLATIVRILDVFRDQLAPV

SEQ ID NO: 114795 - protein, 23 aa, Mycobacterium avium
GKSLLSTAVARWAREERLGVDVC

SEQ ID NO: 114796 - protein, 24 aa, Mycobacterium avium
GKSTIAAALALTLAAGGRKVLLVE

SEQ ID NO: 114797 - protein, 28 aa, Mycobacterium avium
GKSTVAVPLIWRKRLLRKAIDFTDPLRY

SEQ ID NO: 114798 - protein, 26 aa, Mycobacterium avium
GKTDALDALLWRAARPGEPSWPSPFG

SEQ ID NO: 114799 - protein, 20 aa, Mycobacterium avium
GKTMVVTGLHLLGGARADAT

SEQ ID NO: 114800 - protein, 24 aa, Mycobacterium avium
GKWTWRYDAIRKFPDFDGLWADVD

SEQ ID NO: 114801 - protein, 23 aa, Mycobacterium avium
GKYDLFREVFLALGQQLVDATAF

SEQ ID NO: 114802 - protein, 20 aa, Mycobacterium avium
GKYRDTVRDFWRGEPATLDE

SEQ ID NO: 114803 - protein, 27 aa, Mycobacterium avium
GLAAAHQAILGDRLRLALDADLCAAVT

SEQ ID NO: 114804 - protein, 18 aa, Mycobacterium avium
GLAEIALPDLQPGSSIMP

SEQ ID NO: 114805 - protein, 17 aa, Mycobacterium avium
GLALVAQQRGYKCVFVC

SEQ ID NO: 114806 - protein, 32 aa, Mycobacterium avium
GLARLIANRFRRALPPVLAATARHASRRTGPH

SEQ ID NO: 114807 - protein, 22 aa, Mycobacterium avium
GLDSRAYRLNWPAGTTVYEIDQ

SEQ ID NO: 114808 - protein, 24 aa, Mycobacterium avium
GLEIDTDLRWRIVTALAAAGEIDA

SEQ ID NO: 114809 - protein, 26 aa, Mycobacterium avium
GLEQRLRALDYPKLVIGISGGLDSTH

SEQ ID NO: 114810 - protein, 22 aa, Mycobacterium avium
GLETSRMMLWRAAGALDADDPD

SEQ ID NO: 114811 - protein, 21 aa, Mycobacterium avium
GLFDTLPTFRRTLDAAGLDDH

SEQ ID NO: 114812 - protein, 20 aa, Mycobacterium avium
GLFGLMIPQEYGGLGESLLT

SEQ ID NO: 114813 - protein, 20 aa, Mycobacterium avium
GLFTRPLLPELVEEEPFTGT

SEQ ID NO: 114814 - protein, 18 aa, Mycobacterium avium
GLGAAWYEREHTALGIPY

SEQ ID NO: 114815 - protein, 26 aa, Mycobacterium avium
GLGLDFLRHIERCAVLVHVIDCATAD

SEQ ID NO: 114816 - protein, 24 aa, Mycobacterium avium
GLHALVTIGARRSLRMRSMARGEH

SEQ ID NO: 114817 - protein, 24 aa, Mycobacterium avium
GLHFICRDVWLRVASTSTAWTSRF

SEQ ID NO: 114818 - protein, 24 aa, Mycobacterium avium
GLHPYRVRHLLDRYGSLIGDVLAL

SEQ ID NO: 114819 - protein, 23 aa, Mycobacterium avium
GLKQILTIGPVPEALSGSAVDLV

SEQ ID NO: 114820 - protein, 25 aa, Mycobacterium avium
GLLEQSRRHAFLASLLGIQHIVLAV

SEQ ID NO: 114821 - protein, 26 aa, Mycobacterium avium
GLLGKFMPNYLFAPSGELPVIGRRDD

SEQ ID NO: 114822 - protein, 17 aa, Mycobacterium avium
GLLGPLEMTVDGDLVPL

SEQ ID NO: 114823 - protein, 17 aa, Mycobacterium avium
GLLLQLLDPANRADPYR

SEQ ID NO: 114824 - protein, 20 aa, Mycobacterium avium
GLNLPSTPIAVIFRSDKSGT

SEQ ID NO: 114825 - protein, 25 aa, Mycobacterium avium
GLPAGSALLVVKRGPNAGSRFLLDQ

SEQ ID NO: 114826 - protein, 20 aa, Mycobacterium avium
GLPGIPLAIARPDLEVVLLE

SEQ ID NO: 114827 - protein, 30 aa, Mycobacterium avium
GLPSYPHPRLMPDFWEFPTVSMGLGPLNAI

SEQ ID NO: 114828 - protein, 20 aa, Mycobacterium avium
GLPVILGPDHPVTGGYPVVG

SEQ ID NO: 114829 - protein, 25 aa, Mycobacterium avium
GLPVPVTSRHTLLLGPPGTGKTSVA

SEQ ID NO: 114830 - protein, 24 aa, Mycobacterium avium
GLQARLMSQALRKMTGALNNSGTT

SEQ ID NO: 114831 - protein, 21 aa, Mycobacterium avium
GLQIMAPALADDRLYRVGAAY

SEQ ID NO: 114832 - protein, 21 aa, Mycobacterium avium
GLQRFLPAMARHLLSETLLLP

SEQ ID NO: 114833 - protein, 17 aa, Mycobacterium avium
GLQVGILGLGRIGSAIA

SEQ ID NO: 114834 - protein, 17 aa, Mycobacterium avium
GLRLAVPPEQLKFKDAN

SEQ ID NO: 114835 - protein, 18 aa, Mycobacterium avium
GLRVPKILDYGAMAGLSH

SEQ ID NO: 114836 - protein, 34 aa, Mycobacterium avium
GLSDRRQAMLPGHAVVLHPGPMLRGMEIASSVAD

SEQ ID NO: 114837 - protein, 31 aa, Mycobacterium avium
GLSKARFTGTITVKYLRGTPLGPLRCDAWID

SEQ ID NO: 114838 - protein, 26 aa, Mycobacterium avium
GLTDQLPLVNVLLGGIALGLADGPTE

SEQ ID NO: 114839 - protein, 24 aa, Mycobacterium avium
GLTDRLRRSFGRMPWTTTQKRRPR

SEQ ID NO: 114840 - protein, 20 aa, Mycobacterium avium
GLTKSYLSKIERGQSTPSIA

SEQ ID NO: 114841 - protein, 29 aa, Mycobacterium avium
GLTLPEFVCLRILSMFPGMSSAELSRRAG

SEQ ID NO: 114842 - protein, 20 aa, Mycobacterium avium
GLTNIAIWADPARGLAAGVI

SEQ ID NO: 114843 - protein, 19 aa, Mycobacterium avium
GLVAIDTLLARMENDRDRL

SEQ ID NO: 114844 - protein, 22 aa, Mycobacterium avium
GLVEASKFAEPLFTPATKAALG

SEQ ID NO: 114845 - protein, 25 aa, Mycobacterium avium
GMADPLPMLTLFDKQVTLRMGQANV

SEQ ID NO: 114846 - protein, 25 aa, Mycobacterium avium
GMAKGAGMIAPSLATMLCVLTTDAA

SEQ ID NO: 114847 - protein, 19 aa, Mycobacterium avium
GMALAHSFFTPLGAELRDA

SEQ ID NO: 114848 - protein, 32 aa, Mycobacterium avium
GMAVIISDFLGPINWQRPLRAIAARHEVLAIE

SEQ ID NO: 114849 - protein, 24 aa, Mycobacterium avium
GMETTWLLDPSIPLPEVFKQYAET

SEQ ID NO: 114850 - protein, 21 aa, Mycobacterium avium
GMFIGPVFGPLLRILGADKVA

SEQ ID NO: 114851 - protein, 17 aa, Mycobacterium avium
GMIVGEIALLRDIPRTA

SEQ ID NO: 114852 - protein, 18 aa, Mycobacterium avium
GMKAKFASTPLAPATPIV

SEQ ID NO: 114853 - protein, 27 aa, Mycobacterium avium
GMLTTPQLKAFYLDLQDDRLTSALGIV

SEQ ID NO: 114854 - protein, 26 aa, Mycobacterium avium
GMMSALVGFWMTPESIYLSPAPLYHT

SEQ ID NO: 114855 - protein, 19 aa, Mycobacterium avium
GMPATRFLGPALGSLHMFF

SEQ ID NO: 114856 - protein, 21 aa, Mycobacterium avium
GMPGVEYYAHPWEFGPRKAKE

SEQ ID NO: 114857 - protein, 25 aa, Mycobacterium avium
GMTETSPLATMAWPPPGTPEDQHWA

SEQ ID NO: 114858 - protein, 28 aa, Mycobacterium avium
GMTLSGKTLGLLGLGRVGSRMAGFAAAF

SEQ ID NO: 114859 - protein, 17 aa, Mycobacterium avium
GMTQLLYSDAIVGFLRE
